United States Patent
Wu et al.

(10) Patent No.: US 7,491,813 B2
(45) Date of Patent: Feb. 17, 2009

(54) PROMOTER POLYNUCLEOTIDES IDENTIFIED FROM ZEA MAYS FOR USE IN PLANTS

(75) Inventors: Wei Wu, St. Louis, MO (US); Qi Wang, St. Louis, MO (US); James Morrell, St. Louis, MO (US); Linda Lutfiyya, St. Louis, MO (US); Maolong Lu, St. Louis, MO (US); Zhaolong Li, St. Louis, MO (US); Ping Li, St. Peters, MO (US); Michelle Lacy, St. Louis, MO (US); David Kovalic, Clayton, MO (US); Yongwei Cao, Chesterfield, MO (US); Andrey Boukharov, Wildwood, MO (US); Stanislaw Flasinski, Chesterfield, MO (US); Peter T. Hajdukiewicz, Chesterfield, MO (US)

(73) Assignee: Monsanto Technology LLC, St. Louis, MO (US)

( * ) Notice: Subject to any disclaimer, the term of this patent is extended or adjusted under 35 U.S.C. 154(b) by 0 days.

(21) Appl. No.: 11/635,706

(22) Filed: Dec. 7, 2006

(65) Prior Publication Data
US 2007/0130645 A1  Jun. 7, 2007

Related U.S. Application Data

(60) Provisional application No. 60/748,114, filed on Dec. 7, 2005.

(51) Int. Cl.
*C07H 21/04* (2006.01)
*A01H 5/00* (2006.01)
*C12N 15/82* (2006.01)

(52) U.S. Cl. .............. 536/24.1; 536/23.2; 800/298; 800/295; 800/279; 800/289; 800/278; 435/468; 435/419

(58) Field of Classification Search .................. None
See application file for complete search history.

(56) References Cited

U.S. PATENT DOCUMENTS 5,294,593 A * 3/1994 Khan .................. 504/100
6,207,879 B1 * 3/2001 McElroy et al. ........... 800/278

OTHER PUBLICATIONS

Donald et al. Mutation of either G box or I box sequences profoundly affects expression from the Arabidopsis rbcS-1A promoter. (1990) EMBO J. vol. 9, pp. 1717-1726.*
Benfey et al. The Cauliflower mosaic virus 35S promoter: combinatorial regulation of transcription in plants. (1990) Science, vol. 250, pp. 959-966.*
Kim et al. A 20 nucleotide upstream element is essential for the nopaline synthase (nos) promoter activity. (1994) Plant Mol. Biol. vol. 24, pp. 105-117.*
GenBank Accession No. BZ411658, Dec. 4, 2002.
Huang et al., "Gene expression induced by physical impedance in maize roots," *Plant Mol. Biol.*, 37:921-930, 1998.
TIGR Accession No. AZM5_84460, Mar. 5, 2008.
TIGR Accession No. AZM5_84462, Mar. 5, 2008.

* cited by examiner

*Primary Examiner*—Cathy Kingdon Worley
(74) *Attorney, Agent, or Firm*—Sonnenschein Nath & Rosenthal LLP

(57) ABSTRACT

The present invention provides non-coding regulatory element polynucleotide molecules isolated from *Zea mays* and useful for expressing transgenes in plants. The invention further discloses compositions, polynucleotide constructs, transformed host cells, transgenic plants and seeds containing the *Zea mays* regulatory polynucleotide sequences, and methods for preparing and using the same.

25 Claims, No Drawings

PROMOTER POLYNUCLEOTIDES IDENTIFIED FROM *ZEA MAYS* FOR USE IN PLANTS

This application claims benefit under 35USC §119(e) of U.S. provisional application Ser. No. 60/748,114 filed Dec. 7, 2005, herein incorporated by reference in its entirety.

INCORPORATION OF SEQUENCE LISTING

Two copies of the sequence listing (Seq. Listing Copy 1 and Seq. Listing Copy 2) and a computer-readable form of the sequence listing, all on CD-ROMs, each containing the file named pa_01269.rpt which is 14,550,658 bytes (measured in Microsoft Windows®) and was created on Dec. 6, 2006, all of which are incorporated herein by reference.

FIELD OF THE INVENTION

The present invention relates to the field of plant molecular biology and plant genetic engineering and polynucleotide molecules useful for gene expression in plants. Specifically, the present invention discloses nucleic acid sequences from *Zea mays* (corn) containing regulatory elements, such as promoters. The invention further discloses methods of producing and using said regulatory elements.

BACKGROUND

One of the goals of plant genetic engineering is to produce plants with agronomically desirable characteristics or traits. The proper expression of a desirable transgene in a transgenic plant is one way to achieve this goal. Elements having gene regulatory activity, i.e. regulatory elements such as promoters, leaders, introns and transcription termination regions, are non-coding polynucleotide molecules which play an integral part in the overall expression of genes in living cells. Isolated regulatory elements that function in plants are therefore useful for modifying plant phenotypes through the methods of genetic engineering.

Many regulatory elements are available and are useful for providing good overall gene expression. For example, constitutive promoters such as P-FMV, the promoter from the 35S transcript of the Figwort mosaic virus (U.S. Pat. No. 6,051,753); P-CaMV 35S, the promoter from the 35S RNA transcript of the Cauliflower mosaic virus (U.S. Pat. No. 5,530,196); P-Corn Actin 1, the promoter from the actin 1 gene of *Oryza sativa* (U.S. Pat. No. 5,641,876); and P-NOS, the promoter from the nopaline synthase gene of *Agrobacterium tumefaciens* are known to provide some level of gene expression in most or all of the tissues of a plant during most or all of the plant's lifespan. While previous work has provided a number of regulatory elements useful to affect gene expression in transgenic plants, there is still a great need for novel regulatory elements with beneficial expression characteristics. Many previously identified regulatory elements fail to provide the patterns or levels of expression required to fully realize the benefits of expression of selected genes in transgenic crop plants. One example of this is the need for regulatory elements capable of driving gene expression in different types of tissues.

Promoters

The genetic enhancement of plants and seeds provides significant benefits to society. For example, plants and seeds may be enhanced to have desirable agricultural, biosynthetic, commercial, chemical, insecticidal, industrial, nutritional, or pharmaceutical properties. Despite the availability of many molecular tools, however, the genetic modification of plants and seeds is often constrained by an insufficient or poorly localized expression of the engineered transgene.

Many intracellular processes may impact overall transgene expression, including transcription, translation, protein assembly and folding, methylation, phosphorylation, transport, and proteolysis. Intervention in one or more of these processes can increase the amount of transgene expression in genetically engineered plants and seeds. For example, raising the steady-state level of mRNA in the cytosol often yields an increased accumulation of transgene expression. Many factors may contribute to increasing the steady-state level of an mRNA in the cytosol, including the rate of transcription, promoter strength and other regulatory features of the promoter, efficiency of mRNA processing, and the overall stability of the mRNA.

Among these factors, the promoter plays a central role. Along the promoter, the transcription machinery is assembled and transcription is initiated. This early step is often rate-limiting relative to subsequent stages of protein production. Transcription initiation at the promoter may be regulated in several ways. For example, a promoter may be induced by the presence of a particular compound or external stimuli, express a gene only in a specific tissue, express a gene during a specific stage of development, or constitutively express a gene. Thus, transcription of a transgene may be regulated by operably linking the coding sequence to promoters with different regulatory characteristics. Accordingly, regulatory elements such as promoters, play a pivotal role in enhancing the agronomic, pharmaceutical or nutritional value of crops.

At least two types of information are useful in predicting promoter regions within a genomic DNA sequence. First, promoters may be identified on the basis of their sequence "content," such as transcription factor binding sites and various known promoter motifs. (Stormo, Genome Research 10: 394-397 (2000)). Such signals may be identified by computer programs that identify sites associated with promoters, such as TATA boxes and transcription factor (TF) binding sites.

Second, promoters may be identified on the basis of their "location," i.e. their proximity to a known or suspected coding sequence. (Stormo, Genome Research 10: 394-397 (2000)). Promoters are typically contained within a region of DNA extending approximately 150-1500 basepairs in the 5' direction from the start codon of a coding sequence. Thus, promoter regions may be identified by locating the start codon of a coding sequence, and moving beyond the start codon in the 5' direction to locate the promoter region.

Corn Maize (*Zea mays* L.), or corn, is one of the three most important cereal crops in the world. Maize is high yielding, easy to process, readily digested, and costs less than other cereals. It is also a versatile crop, allowing it to grow across a range of agroecological zones. Every part of the maize plant has economic value: the grain, leaves, stalk, tassel, and cob can all be used to produce a large variety of food and non-food products. *Zea mays* Linnaeus, known as maize throughout most of the world, and as corn in the United States, is a large, annual, monoecious grass, that is grown for animal feed, silage, human grain, vegetable oil, sugar syrups, and other miscellaneous uses. It is the premier cash crop in the United States, and its cultivation, genetics, processing, financing, and distribution on a national and international scale is pervasive and complex.

Maize is used primarily as a staple food for human consumption, animal feed and as raw material for industrial use. It is also used as seed. In industrialized countries, a larger proportion of maize is used for livestock feeding and as industrial raw material for food and non-food uses. On the other hand, the bulk of maize produced in developing countries is used as human food although its use as animal feed is increasing. An understanding of trends in maize processing/utilization is of timely interest and importance.

According to FAO data, 589 million metric tons of maize were produced worldwide in 2000, on 138 million hectares. The United States was the largest maize producer (43% of world production) followed by Asia (25%) and Latin America and the Caribbean (13%). Africa produced 7% of the world's maize. The world average yield in 2000 was 4255 kg per hectare. Average yield in the USA was 8600 kg per hectare, while in sub-Saharan Africa it was 1316 kg per hectare. Corn has the highest value of production of any United States crop: its 1987 value was 12.1 billion dollars, compared to soybeans at 10.4, hay at 9.1, wheat at 5.4, and cotton at 5.0.

Corn has been cultivated since the earliest historic times from Peru to central North America. The region of origin is now presumed to be Mexico (Gould, 1968). Dispersal to the Old World is generally deemed to have occurred in the sixteenth and seventeenth centuries (Cobley and Steele, 1976); however, recent evidence indicates that dispersal to India may have occurred prior to the twelfth and thirteenth centuries by unknown means (Johannessen and Parker, 1989).

In industrialized countries maize is largely used as livestock feed and as a raw material for industrial products, while in low-income countries it is mainly used for human consumption. In sub-Saharan Africa, maize is a staple food for an estimated 50% of the population. It is an important source of carbohydrate, protein, iron, vitamin B, and minerals.

Throughout the tropics and subtropics most maize is grown by small-scale farmers, generally for subsistence as part of agricultural systems that feature several crops and sometimes livestock production. The systems often lack inputs such as fertilizer, improved seed, irrigation, and labor. Most maize-producing countries in the industrialized world employ intensive input and highly mechanized monocropping production systems. Hybrid maize varieties are commonly used.

Threats to the maize plant include pests, weeds and drought. Major insect pests include stem and ear borers, armyworms, cutworms, rootworm, grain moths, beetles (weevils, grain borers, rootworms, and whitegrubs), and virus vectors (aphids and leafhoppers). A range of pathogens, primarily fungi, also damage the maize plant. Weeds often cause severe maize yield losses because they compete for nutrients, light, and moisture. In the Nigerian savanna, for example, weed-related yield losses ranging from 65% to 92% have been recorded. Last but not least, periodic drought caused by irregular rainfall distribution reduces maize yields by an average of 15% each year, which is equivalent to at least US $200 million in foregone grain. The effects of prolonged droughts, such as those that have struck Eastern and Southern Africa in recent years, have been disastrous.

For these reasons and others, it is of immense social, ecological and economic interests to develop corn plants that have enhanced nutrition, improved resistance to pests, and tolerance to harsh conditions such as drought. Thus, the identification of new genes, promoters and other regulatory elements that function in corn is useful not only in developing enhanced varieties of maize, but also in developing enhanced varieties of other crops. In particular, developments in corn are applicable to other cereal crops, such as sorghum, corn, barley and wheat. Clearly, there exists a need in the art for new regulatory elements, such as promoters, that are capable of expressing heterologous nucleic acid sequences in important crop species.

SUMMARY

The present invention describes the composition and utility for non-coding regulatory element molecules identified from *Zea mays*.

The present invention includes and provides an isolated nucleic acid molecule, or a DNA construct useful for modulating gene expression in plant cells, or a transgenic plant cell, or a transgenic plant, or a fertile transgenic plant, or a seed of a fertile transgenic plant, comprising a nucleic acid sequence wherein the nucleic acid sequence: i) hybridizes under stringent conditions with a sequence elected from the group consisting of SEQ ID NO: 1 through SEQ ID NO: 14,151 or any complements thereof, or any fragments thereof, or any cis elements thereof; or ii) exhibits an 85% or greater identity to a sequence elected from the group consisting of SEQ ID NO: 1 through SEQ ID NO: 14,151, or any complements thereof, or any fragments thereof, or any cis elements thereof.

The present invention further includes and provides for tissue-specific, tissue-enhanced and stress-tolerant promoters identified from transcriptional profiling analysis of SEQ ID NO: 1 through SEQ ID NO: 14,151.

The present invention includes and provides a method of transforming a host cell comprising: a) providing a nucleic acid molecule that comprises in the 5' to 3' direction: a nucleic acid sequence that: i) hybridizing under stringent conditions with a sequence selected from the group consisting of SEQ ID NO: 1 through SEQ ID NO: 14,151, or any complements thereof, or any fragments thereof, or any cis elements thereof; or ii) exhibiting an 85% or greater identity to a sequences elected from the group consisting SEQ ID NO: 1 through SEQ ID NO: 14,151, or any complements thereof, or any fragments thereof, or any cis elements thereof; operably linked to a transcribable polynucleotide molecule sequence ; and b) transforming said plant with the nucleic acid molecule.

In one embodiment, the invention provides regulatory elements isolated from rice and useful for modulating gene expression in transgenic plants In another embodiment, the invention provides DNA constructs containing polynucleotide molecules useful for modulating gene expression in plants. In another embodiment, the invention provides transgenic plants and seeds containing the DNA constructs, comprising a promoter and regulatory elements operably linked to a heterologous DNA molecule, useful for modulating gene expression in plants. The transgenic plant expresses an agronomically desirable phenotype, in particular herbicide tolerance, more specifically tolerance to glyphosate herbicide.

DETAILED DESCRIPTION OF THE INVENTION

The invention disclosed herein provides polynucleotide molecules having gene The invention disclosed herein provides polynucleotide molecules having gene regulatory activity from *Zea mays*. The design, construction, and use of these polynucleotide molecules are one object of this invention. The polynucleotide sequences of these polynucleotide molecules are provided as SEQ ID NO: 1 through SEQ ID NO: 14,151. These polynucleotide molecules are capable of affecting the expression of an operably linked transcribable polynucleotide molecule in plant tissues and therefore can selectively regulate gene expression in transgenic plants. The present invention also provides methods of modifying, producing, and using the same. The invention also includes compositions, transformed host cells, transgenic plants, and seeds containing the promoters, and methods for preparing and using the same.

Polynucleotide Molecules

Many types of regulatory sequences control gene expression. Not all genes are turned on at all times during the life cycle of a plant. Different genes are required for the completion of different steps in the developmental and sexual maturation of the plant. Two general types of control can be described: temporal regulation, in which a gene is only expressed at a specific time in development (for example, during flowering), and spatial regulation, in which a gene is only expressed in a specific location in the plant (for example, seed storage proteins). Many genes, however, may fall into both classes. For example, seed storage proteins are only expressed in the seed, but they also are only expressed during a short period of time during the development of the seed. Furthermore, because the binding of RNA Polymerase II to the promoter is the key step in gene expression, it follows that sequences may exist in the promoter that control temporal and spatial gene expression.

The following definitions and methods are provided to better define the present invention and to guide those of ordinary skill in the art in the practice of the present invention. Unless otherwise noted, terms are to be understood according to conventional usage by those of ordinary skill in the relevant art.

The phrases "coding sequence," "structural sequence," and "transcribable polynucleotide sequence" refer to a physical structure comprising an orderly arrangement of nucleic acids. The nucleic acids are arranged in a series of nucleic acid triplets that each form a codon. Each codon encodes for a specific amino acid. Thus the coding sequence, structural sequence, and transcribable polynucleotide sequence encode a series of amino acids forming a protein, polypeptide, or peptide sequence. The coding sequence, structural sequence, and transcribable polynucleotide sequence may be contained, without limitation, within a larger nucleic acid molecule, vector, etc. In addition, the orderly arrangement of nucleic acids in these sequences may be depicted, without limitation, in the form of a sequence listing, figure, table, electronic medium, etc.

As used herein, the term "polynucleotide molecule" refers to the single- or double-stranded DNA or RNA molecule of genomic or synthetic origin, i.e., a polymer of deoxyribonucleotide or ribonucleotide bases, respectively, read from the 5' (upstream) end to the 3' (downstream) end.

As used herein, the term "polynucleotide sequence" refers to the sequence of a polynucleotide molecule. The nomenclature for nucleotide bases as set forth at 37 CFR §1.822 is used herein.

By the term "isolated", it is meant that the molecule referenced is not in its native environment, that is, not normally found in the genome of a particular host cell, or a DNA not normally found in the host genome in an identical context, or any two sequences adjacent to each other that are not normally or naturally adjacent to each other.

As used herein, the term "regulatory element" refers to a polynucleotide molecule having gene regulatory activity, i.e. one that has the ability to affect the transcription or translation of an operably linked transcribable polynucleotide molecule. Regulatory elements such as promoters, leaders, introns, and transcription termination regions are polynucleotide molecules having gene regulatory activity which play an integral part in the overall expression of genes in living cells. Isolated regulatory elements that function in plants are therefore useful for modifying plant phenotypes through the methods of genetic engineering. By "regulatory element" it is intended a series of nucleotides that determines if, when, and at what level a particular gene is expressed. The regulatory DNA sequences specifically interact with regulatory proteins or other proteins.

As used herein, the term "operably linked" refers to a first polynucleotide molecule, such as a promoter, connected with a second transcribable polynucleotide molecule, such as a gene of interest, where the polynucleotide molecules are so arranged that the first polynucleotide molecule affects the function of the second polynucleotide molecule. The two polynucleotide molecules may be part of a single contiguous polynucleotide molecule and may be adjacent. For example, a promoter is operably linked to a gene of interest if the promoter modulates transcription of the gene of interest in a cell.

As used herein, the term "gene regulatory activity" refers to a polynucleotide molecule capable of affecting transcription or translation of an operably linked polynucleotide molecule. An isolated polynucleotide molecule having gene regulatory activity may provide temporal or spatial expression or modulate levels and rates of expression of the operably linked polynucleotide molecule. An isolated polynucleotide molecule having gene regulatory activity may comprise a promoter, intron, leader, or 3' transcriptional termination region.

As used herein, the term "gene expression" or "expression" refers to the transcription of a DNA molecule into a transcribed RNA molecule. Gene expression may be described as related to temporal, spatial, developmental, or morphological qualities as well as quantitative or qualitative indications. The transcribed RNA molecule may be translated to produce a protein molecule or may provide an antisense or other regulatory RNA molecule.

As used herein, an "expression pattern" is any pattern of differential gene expression. In a preferred embodiment, an expression pattern is selected from the group consisting of tissue, temporal, spatial, developmental, stress, environmental, physiological, pathological, cell cycle, and chemically responsive expression patterns.

As used herein, an "enhanced expression pattern" is any expression pattern for which an operably linked nucleic acid sequence is expressed at a level greater than 0.01%; preferably in a range of about 0.5% to about 20% (w/w) of the total cellular RNA or protein.

As used herein, the term "operably linked" refers to a first polynucleotide molecule, such as a promoter, connected with a second transcribable polynucleotide molecule, such as a gene of interest, where the polynucleotide molecules are so arranged that the first polynucleotide molecule affects the function of the second polynucleotide molecule. The two polynucleotide molecules may or may not be part of a single contiguous polynucleotide molecule and may or may not be adjacent. For example, a promoter is operably linked to a gene of interest if the promoter regulates or mediates transcription of the gene of interest in a cell.

As used herein, the term "transcribable polynucleotide molecule" refers to any polynucleotide molecule capable of being transcribed into a RNA molecule, including but not limited to protein coding sequences (e.g. transgenes) and sequences (e.g. a molecule useful for gene suppression). The present invention includes a polynucleotide molecule having a nucleic acid sequence that hybridizes to SEQ ID NO: 1 through SEQ ID NO: 14,151, or any complements thereof, or any cis elements thereof, or any fragments thereof. The present invention also provides a nucleic acid molecule comprising a nucleic acid sequence selected from the group consisting of SEQ ID NO: 1 through SEQ ID NO: 14,151, any complements thereof, or any cis elements thereof, or any fragments thereof. The polynucleotide molecules of the present invention (SEQ ID NO: 1 through SEQ ID NO: 14,151) were all isolated or identified from *Zea mays*.

Determination of Sequence Similarity Using Hybridization Techniques

Nucleic acid hybridization is a technique well known to those of skill in the art of DNA manipulation. The hybridization properties of a given pair of nucleic acids are an indication of their similarity or identity.

The term "hybridization" refers generally to the ability of nucleic acid molecules to join via complementary base strand pairing. Such hybridization may occur when nucleic acid molecules are contacted under appropriate conditions. "Specifically hybridizes" refers to the ability of two nucleic acid molecules to form an anti-parallel, double-stranded nucleic acid structure. A nucleic acid molecule is said to be the "complement" of another nucleic acid molecule if they exhibit "complete complementarity," i.e., each nucleotide in one sequence is complementary to its base pairing partner nucleotide in another sequence. Two molecules are said to be "minimally complementary" if they can hybridize to one another with sufficient stability to permit them to remain annealed to one another under at least conventional "low-stringency" conditions. Similarly, the molecules are said to be "complementary" if they can hybridize to one another with sufficient stability to permit them to remain annealed to one another under conventional "high-stringency" conditions. Nucleic acid molecules that hybridize to other nucleic acid molecules, e.g., at least under low stringency conditions are said to be "hybridizable cognates" of the other nucleic acid molecules. Conventional low stringency and high stringency conditions are described herein and by Sambrook et al., Molecular Cloning, A Laboratory Manual, 2nd Ed., Cold Spring Harbor Press, Cold Spring Harbor, N.Y. (1989) and by Haymes et al., Nucleic Acid Hybridization, A Practical Approach, IRL Press, Washington, D.C. (1985). Departures from complete complementarity are permissible, as long as such departures do not completely preclude the capacity of the molecules to form a double-stranded structure.

Low stringency conditions may be used to select nucleic acid sequences with lower sequence identities to a target nucleic acid sequence. One may wish to employ conditions such as about 0.15 M to about 0.9 M sodium chloride, at temperatures ranging from about 20° C. to about 55° C. High stringency conditions may be used to select for nucleic acid sequences with higher degrees of identity to the disclosed nucleic acid sequences (Sambrook et al., 1989). High stringency conditions typically involve nucleic acid hybridization in about 2× to about 10× SSC (diluted from a 20× SSC stock solution containing 3 M sodium chloride and 0.3 M sodium citrate, pH 7.0 in distilled water), about 2.5× to about 5× Denhardt's solution (diluted from a 50× stock solution containing 1% (w/v) bovine serum albumin, 1% (w/v) ficoll, and 1% (w/v) polyvinylpyrrolidone in distilled water), about 10 mg/mL to about 100 mg/mL fish sperm DNA, and about 0.02% (w/v) to about 0.1% (w/v) SDS, with an incubation at about 50° C. to about 70° C. for several hours to overnight. High stringency conditions are preferably provided by 6× SSC, 5× Denhardt's solution, 100 mg/mL fish sperm DNA, and 0.1% (w/v) SDS, with an incubation at 55° C. for several hours. Hybridization is generally followed by several wash steps. The wash compositions generally comprise 0.5× to about 10× SSC, and 0.01% (w/v) to about 0.5% (w/v) SDS with a 15 minute incubation at about 20° C. to about 70° C. Preferably, the nucleic acid segments remain hybridized after washing at least one time in 0.1× SSC at 65° C.

A nucleic acid molecule preferably comprises a nucleic acid sequence that hybridizes, under low or high stringency conditions, with SEQ ID NO: 1 through SEQ ID NO: 14,151, any complements thereof, or any fragments thereof, or any cis elements thereof. A nucleic acid molecule most preferably comprises a nucleic acid sequence that hybridizes under high stringency conditions with SEQ ID NO: 1 through SEQ ID NO: 14,151, any complements thereof, or any fragments thereof, or any cis elements thereof.

Analysis of Sequence Similarity Using Identity Scoring

As used herein "sequence identity" refers to the extent to which two optimally aligned polynucleotide or peptide sequences are invariant throughout a window of alignment of components, e.g., nucleotides or amino acids. An "identity fraction" for aligned segments of a test sequence and a reference sequence is the number of identical components which are shared by the two aligned sequences divided by the total number of components in reference sequence segment, i.e., the entire reference sequence or a smaller defined part of the reference sequence.

As used herein, the term "percent sequence identity" or "percent identity" refers to the percentage of identical nucleotides in a linear polynucleotide sequence of a reference ("query") polynucleotide molecule (or its complementary strand) as compared to a test ("subject") polynucleotide molecule (or its complementary strand) when the two sequences are optimally aligned (with appropriate nucleotide insertions, deletions, or gaps totaling less than 20 percent of the reference sequence over the window of comparison). Optimal alignment of sequences for aligning a comparison window are well known to those skilled in the art and may be conducted by tools such as the local homology algorithm of Smith and Waterman, the homology alignment algorithm of Needleman and Wunsch, the search for similarity method of Pearson and Lipman, and preferably by computerized implementations of these algorithms such as GAP, BESTFIT, FASTA, and TFASTA available as part of the GCG® Wisconsin Package® (Accelrys Inc., Burlington, Mass.). An "identity fraction" for aligned segments of a test sequence and a reference sequence is the number of identical components which are shared by the two aligned sequences divided by the total number of components in the reference sequence segment, i.e., the entire reference sequence or a smaller defined part of the reference sequence. Percent sequence identity is represented as the identity fraction multiplied by 100. The comparison of one or more polynucleotide sequences may be to a full-length polynucleotide sequence or a portion thereof, or to a longer polynucleotide sequence. For purposes of this invention "percent identity" may also be determined using BLASTX version 2.0 for translated nucleotide sequences and BLASTN version 2.0 for polynucleotide sequences.

The percent of sequence identity is preferably determined using the "Best Fit" or "Gap" program of the Sequence Analysis Software Package™ (Version 10; Genetics Computer Group, Inc., Madison, Wis.). "Gap" utilizes the algorithm of Needleman and Wunsch (Needleman and Wunsch, *Journal of Molecular Biology* 48:443-453, 1970) to find the alignment of two sequences that maximizes the number of matches and minimizes the number of gaps. "BestFit" performs an optimal alignment of the best segment of similarity between two sequences and inserts gaps to maximize the number of matches using the local homology algorithm of Smith and Waterman (Smith and Waterman, *Advances in Applied Mathematics*, 2:482-489, 1981, Smith et al., *Nucleic Acids Research* 11:2205-2220, 1983). The percent identity is most preferably determined using the "Best Fit" program.

Useful methods for determining sequence identity are also disclosed in Guide to Huge Computers, Martin J. Bishop, ed., Academic Press, San Diego, 1994, and Carillo, H., and Lipton, D., *Applied Math* (1988) 48:1073. More particularly, preferred computer programs for determining sequence identity include the Basic Local Alignment Search Tool (BLAST) programs which are publicly available from National Center Biotechnology Information (NCBI) at the National Library of Medicine, National Institute of Health, Bethesda, Md. 20894; see BLAST Manual, Altschul et al., NCBI, NLM, NIH; Altschul et al., *J. Mol. Biol.* 215:403-410 (1990); version 2.0 or higher of BLAST programs allows the introduction of gaps (deletions and insertions) into alignments; for peptide sequence BLASTX can be used to determine sequence identity; and, for polynucleotide sequence BLASTN can be used to determine sequence identity.

As used herein, the term "substantial percent sequence identity" refers to a percent sequence identity of at least about 70% sequence identity, at least about 80% sequence identity, at least about 85% identity, at least about 90% sequence identity, or even greater sequence identity, such as about 98% or about 99% sequence identity. Thus, one embodiment of the invention is a polynucleotide molecule that has at least about 70% sequence identity, at least about 80% sequence identity, at least about 85% identity, at least about 90% sequence identity, or even greater sequence identity, such as about 98% or about 99% sequence identity with a polynucleotide sequence described herein. Polynucleotide molecules that are capable of regulating transcription of operably linked transcribable polynucleotide molecules and have a substantial percent sequence identity to the polynucleotide sequences of the polynucleotide molecules provided herein are encompassed within the scope of this invention.

"Homology" refers to the level of similarity between two or more nucleic acid or amino acid sequences in terms of percent of positional identity (i.e., sequence similarity or identity). Homology also refers to the concept of similar functional properties among different nucleic acids or proteins.

In an alternative embodiment, the nucleic acid molecule comprises a nucleic acid sequence that exhibits 70% or greater identity, and more preferably at least 80 or greater, 85 or greater, 87 or greater, 88 or greater, 89 or greater, 90 or greater, 91 or greater, 92 or greater, 93 or greater, 94 or greater, 95 or greater, 96 or greater, 97 or greater, 98 or greater, or 99% or greater identity to a nucleic acid molecule selected from the group consisting of SEQ ID NO: 1 through SEQ ID NO: 14,151, any complements thereof, any fragments thereof, or any cis elements thereof. The nucleic acid molecule preferably comprises a nucleic acid sequence that exhibits a 75% or greater sequence identity with a polynucleotide selected from the group consisting of SEQ ID NO: 1 through SEQ ID NO: 14,151, any complements thereof, any fragments thereof, or any cis elements thereof. The nucleic acid molecule more preferably comprises a nucleic acid sequence that exhibits an 80% or greater sequence identity with a polynucleotide selected from the group consisting of SEQ ID NO: 1 through SEQ ID NO: 14,151, any complements thereof, any fragments thereof, or any cis elements thereof. The nucleic acid molecule most preferably comprises a nucleic acid sequence that exhibits an 85% or greater sequence identity with a polynucleotide selected from the group consisting of SEQ ID NO: 1 through SEQ ID NO: 14,151, any complements thereof, any fragments thereof, or any cis elements thereof.

For purposes of this invention "percent identity" may also be determined using BLASTX version 2.0 for translated nucleotide sequences and BLASTN version 2.0 for polynucleotide sequences. In a preferred embodiment of the present invention, the presently disclosed corn genomic promoter sequences comprise nucleic acid molecules or fragments having a BLAST score of more than 200, preferably a BLAST score of more than 300, and even more preferably a BLAST score of more than 400 with their respective homologues.

Polynucleotide Molecules, Motifs, Fragments, Chimeric Molecules

Nucleic acid molecules of the present invention include nucleic acid sequences that are between about 0.01 Kb and about 50 Kb, more preferably between about 0.1 Kb and about 25 Kb, even more preferably between about 1 Kb and about 10 Kb, and most preferably between about 3 Kb and about 10 Kb, about 3 Kb and about 7 Kb, about 4 Kb and about 6 Kb, about 2 Kb and about 4 Kb, about 2 Kb and about 5 Kb, about 1 Kb and about 5 Kb, about 1 Kb and about 3 Kb, or about 1 Kb and about 2 Kb.

As used herein, the term "fragment" or "fragment thereof" refers to a finite polynucleotide sequence length that comprises at least 25, at least 50, at least 75, at least 85, or at least 95 contiguous nucleotide bases wherein its complete sequence in entirety is identical to a contiguous component of the referenced polynucleotide molecule.

As used herein, the term "chimeric" refers to the product of the fusion of portions of two or more different polynucleotide molecules. As used herein, the term "chimeric" refers to a gene expression element produced through the manipulation of known elements or other polynucleotide molecules. Novel chimeric regulatory elements can be designed or engineered by a number of methods. In one embodiment of the present invention, a chimeric promoter may be produced by fusing an enhancer domain from a first promoter to a second promoter. The resultant chimeric promoter may have novel expression properties relative to the first or second promoters. Novel chimeric promoters can be constructed such that the enhancer domain from a first promoter is fused at the 5' end, at the 3' end, or at any position internal to the second promoter. The location of the enhancer domain fusion relative to the second promoter may cause the resultant chimeric promoter to have novel expression properties relative to a fusion made at a different location.

In another embodiment of the present invention, chimeric molecules may combine enhancer domains that can confer or modulate gene expression from one or more promoters, by fusing a heterologous enhancer domain from a first promoter to a second promoter with its own partial or complete regulatory elements. Examples of suitable enhancer domains to be used in the practice of the present invention include, but are not limited to the enhancer domains from promoters such as P-FMV, the promoter from the 35S transcript of the Figwort mosaic virus (described in U.S. Pat. No. 6,051,753, which is incorporated herein by reference) and P-CaMV 35S, the promoter from the 35S RNA transcript of the Cauliflower mosaic virus (described in U.S. Pat. Nos. 5,530,196, 5,424,200, and 5,164,316, all of which are incorporated herein by reference). Construction of chimeric promoters using enhancer domains is described in, for example, U.S. Pat. No. 6,660,911, which is incorporated herein by reference. Thus, the design, construction, and use of chimeric expression elements according to the methods disclosed herein for modulating the expression of operably linked transcribable polynucleotide molecules are encompassed by the present invention.

The invention disclosed herein provides polynucleotide molecules comprising regulatory element fragments that may be used in constructing novel chimeric regulatory elements. Novel combinations comprising fragments of these polynucleotide molecules and at least one other regulatory element or fragment can be constructed and tested in plants and are considered to be within the scope of this invention. Thus, the design, construction, and use of chimeric regulatory elements is one object of this invention.

Regulatory Elements

Gene expression is finely regulated at both the transcriptional and post-transcriptional levels. A spectrum of control regions regulate transcription by RNA polymerase II. Enhancers that can stimulate transcription from a promoter tens of thousands of base pairs away (e.g., the SV40 enhancer) are an example of long-range effectors, whereas more proximal elements include promoters and introns. Transcription initiates at the cap site encoding the first nucleotide of the first exon of an mRNA. For many genes, especially those encoding abundantly expressed proteins, a TATA box located 25-30 base pairs upstream form the cap site directs RNA polymerase II to the start site. Promoter-proximal elements roughly within the first 200 base pairs upsteam of the cap site stimulate transcription.

Features of the untranslated regions of mRNAs that control translation, degradation and localization include stem-loop structures, upstream initiation codons and open reading frames, internal ribosome entry sites and various cis-acting elements that are bound by RNA-binding proteins.

The present invention provides the composition and utility of molecules comprising regulatory element sequences identified from *Zea mays*. These regulatory element sequences may comprise promoters, cis-elements, enhancers, terminators, or introns. regulatory elements may be isolated or identified from UnTranslated Regions (UTRs) from a particular polynucleotide sequence. Any of the regulatory elements described herein may be present in a recombinant construct of the present invention.

One skilled in the art would know various promoters, introns, enhancers, transit peptides, targeting signal sequences, 5' and 3' untranslated regions (UTRs), as well as other molecules involved in the regulation of gene expression that are useful in the design of effective plant expression vectors, such as those disclosed, for example, in U.S. Patent Application Publication 2003/01403641 (herein incorporated by reference).

UTRs

UTRs are known to play crucial roles in the post-transcriptional regulation of gene expression, including modulation of the transport of mRNAs out of the nucleus and of translation efficiency, subcellular localization and stability. Regulation by UTRs is mediated in several ways. Nucleotide patterns or motifs located in 5' UTRs and 3' UTRs can interact with specific RNA-binding proteins. Unlike DNA-mediated regulatory signals, however, whose activity is essentially mediated by their primary structure, the biological activity of regulatory motifs at the RNA level relies on a combination of primary and secondary structure. Interactions between sequence elements located in the UTRs and specific complementary RNAs have also been shown to play key regulatory roles. Finally, there are examples of repetitive elements that are important for regulation at the RNA level, affecting translation efficiency.

For example, non-translated 5' leader polynucleotide molecules derived from heat shock protein genes have been demonstrated to enhance gene expression in plants (see for example, U.S. Pat. No. 5,659,122 and U.S. Pat. No. 5,362,865, all of which are incorporated herein by reference).

Cis-Acting Elements

Many regulatory elements act in cis ("cis elements") and are believed to affect DNA topology, producing local conformations that selectively allow or restrict access of RNA polymerase to the DNA template or that facilitate selective opening of the double helix at the site of transcriptional initiation. Cis elements occur within the 5' UTR associated with a particular coding sequence, and are often found within promoters and promoter modulating sequences (inducible elements). Cis elements can be identified using known cis elements as a target sequence or target motif in the BLAST programs of the present invention. Examples of cis-acting elements in the 5' UTR associated with a polynucleotide coding sequence include, but are not limited to, promoters and enhancers.

Promoters

Among the gene expression regulatory elements, the promoter plays a central role. Along the promoter, the transcription machinery is assembled and transcription is initiated. This early step is often rate-limiting relative to subsequent stages of protein production. Transcription initiation at the promoter may be regulated in several ways. For example, a promoter may be induced by the presence of a particular compound or external stimuli, express a gene only in a specific tissue, express a gene during a specific stage of development, or constitutively express a gene. Thus, transcription of a transgene may be regulated by operably linking the coding sequence to promoters with different regulatory characteristics. Accordingly, regulatory elements such as promoters, play a pivotal role in enhancing the agronomic, pharmaceutical or nutritional value of crops.

As used herein, the term "promoter" refers to a polynucleotide molecule that is involved in recognition and binding of RNA polymerase II and other proteins such as transcription factors (trans-acting protein factors that regulate transcription) to initiate transcription of an operably linked gene. A promoter may be isolated from the 5' untranslated region (5' UTR) of a genomic copy of a gene. Alternately, promoters may be synthetically produced or manipulated DNA elements. Promoters may be defined by their temporal, spatial, or developmental expression pattern. A promoter can be used as a regulatory element for modulating expression of an operably linked transcribable polynucleotide molecule. Promoters may themselves contain sub-elements such as cis-elements or enhancer domains that effect the transcription of operably linked genes. A "plant promoter" is a native or non-native promoter that is functional in plant cells. A plant promoter can be used as a 5' regulatory element for modulating expression of an operably linked gene or genes. Plant promoters may be defined by their temporal, spatial, or developmental expression pattern.

Any of the nucleic acid molecules described herein may comprise nucleic acid sequences comprising promoters. Promoters of the present invention can include between about 300 bp upstream and about 10 kb upstream of the trinucleotide ATG sequence at the start site of a protein coding region. Promoters of the present invention can preferably include between about 300 bp upstream and about 5 kb upstream of the trinucleotide ATG sequence at the start site of a protein coding region. Promoters of the present invention can more preferably include between about 300 bp upstream and about 2 kb upstream of the trinucleotide ATG sequence at the start site of a protein coding region. Promoters of the present invention can include between about 300 bp upstream and about 1 kb upstream of the trinucleotide ATG sequence at the start site of a protein coding region. While in many circumstances a 300 bp promoter may be sufficient for expression, additional sequences may act to further regulate expression, for example, in response to biochemical, developmental or environmental signals.

The promoter of the present invention preferably transcribes a heterologous transcribable polynucleotide sequence at a high level in a plant. More preferably, the promoter hybridizes to a nucleic acid sequence selected from the group consisting of SEQ ID NO: 1 through SEQ ID NO: 14,151, or any complements thereof; or any fragments thereof. Suitable hybridization conditions include those described above. A nucleic acid sequence of the promoter preferably hybridizes, under low or high stringency conditions, with SEQ ID NO: 1 through SEQ ID NO: 14,151, or any complements thereof. The promoter most preferably hybridizes under high stringency conditions to a nucleic acid sequence selected from the group consisting of SEQ ID NO: 1 through SEQ ID NO: 14,151, or any complements thereof.

In an alternative embodiment, the promoter comprises a nucleic acid sequence that exhibits 85% or greater identity, and more preferably at least 86 or greater, 87 or greater, 88 or greater, 89 or greater, 90 or greater, 91 or greater, 92 or greater, 93 or greater, 94 or greater, 95 or greater, 96 or greater, 97 or greater, 98 or greater, or 99% or greater identity to a nucleic acid sequence selected from the group consisting of SEQ ID NO: 1 through SEQ ID NO: 14,151, or complements thereof. The promoter most preferably comprises a nucleic acid sequence selected from the group consisting of SEQ ID NO: 1 through SEQ ID NO: 14,151, any complements thereof, or any fragments thereof.

A promoter comprises promoter fragments that have promoter activity. Promoter fragments may comprise other regulatory elements such as enhancer domains, and may further be useful for constructing chimeric molecules. Fragments of SEQ ID NO: 1 through SEQ ID NO: 14,151 comprise at least about 50, 95, 150, 250, 350, 400, 450 or 500 contiguous nucleotides of the corresponding polynucleotide sequence, up to the full length of the corresponding polynucleotide sequence.

At least two types of information are useful in predicting promoter regions within a genomic DNA sequence. First, promoters may be identified on the basis of their sequence "content," such as transcription factor binding sites and various known promoter motifs. (Stormo, Genome Research 10: 394-397 (2000)). Such signals may be identified by computer programs that identify sites associated with promoters, such as TATA boxes and transcription factor (TF) binding sites. Second, promoters may be identified on the basis of their "location," i.e. their proximity to a known or suspected coding sequence. (Stormo, Genome Research 10: 394-397 (2000)). Promoters are typically found within a region of DNA extending approximately 150-1500 basepairs in the 5' direction from the start codon of a coding sequence. Thus, promoter regions may be identified by locating the start codon of a coding sequence, and moving beyond the start codon in the 5' direction to locate the promoter region.

Promoter sequence may be analyzed for the presence of common promoter sequence characteristics, such as a TATA-box and other known transcription factor binding site motifs. These motifs are not always found in every known promoter, nor are they necessary for promoter function, but when present, do indicate that a segment of DNA is a promoter sequence.

For identification of the TATA-box, the putative promoter sequences immediately upstream of the coding start site of the predicted genes within a given sequence size range, as described above, are used. The transcription start site and TATA-box (if present) may be predicted with program TSSP. TSSP is designed for predicting PolII promoter regions in plants, and is based on the discriminate analysis combing characteristics of functional elements of regulatory sequence with the regulatory motifs from Softberry Inc.'s plant RegSite database (Solovyev V. V. (2001) *Statistical approaches in Eukaryotic gene prediction*. In: Handbook of Statistical genetics (eds. Balding D. et al.), John Wiley & Sons, Ltd., p. 83-127). In the cases that multiple TATA-boxes are predicted, only the rightmost (closest to the 5' end) TATA-box is kept. The transcription start sites (TSS) are refined and extended upstream, based on the matches to the database sequences. Promoter sequences with unique TATA-box, as well the TATA-box locations, may be identified within the promoter sequences.

For identification of other known transcription factor binding motifs (such as a GC-box, CAAT-box, etc.), the promoter sequences immediately upstream of the coding start site of the predicted genes within a given sequence size range, as described above, are used. The known transcription factor binding motifs (except TATA-box) on the promoter sequences are predicted with a proprietary program PromoterScan. The identification of such motifs provide important information about the candidate promoter. For example, some motifs are associated with informative annotations such as (but not limited to) "light inducible binding site" or "stress inducible binding motif" and can be used to select with confidence a promoter that is able to confer light inducibility or stress inducibility to an operably-linked transgene, respectively.

Putative promoter sequences are also searched with matcorns for the GC box (factor name: V_GC_01) and CCAAT box (factor name: F_HAP234_01). The matcorns for the GC box and the CCAAT box are from Transfac. The algorithm that is used to annotate promoters searches for matches to both sequence motifs and matrix motifs. First, individual matches are found. For sequence motifs, a maximum number of mismatches are allowed. If the code M,R,W,S,Y, or K are listed in the sequence motif (each of which is a degenerate code for 2 nucleotides) 1/2 mismatch is allowed. If the code B, D, H, or V is listed in the sequence motif (each of which is a degenerate code for 3 nucleotides) 1/3 mismatch is allowed. Appropriate p values may be determined by simulation by generation of a 5 Mb length of random DNA with the same dinucleotide frequency as the test set, and from this test set the probability of a given matrix score was determined (number of hits/5 e7). Once the individual hits are found, the putative promoter sequence is searched for clusters of hits in a 250 bp window. The score for a cluster is found by summing the negative natural log of the p value for each individual hit. Using simulations with 100 Mb lengths, the probability of a window having a cluster score greater than or equal to the given value is determined. Clusters with a p value more significant than p<1 e-6 are reported. Effects of repetitive elements are screened. For matrix motifs, a p value cutoff is used on a matrix score. The matrix score is determined by adding the path of a given DNA sequence through a matrix. Appropriate p values are determined by simulation: 5 Mb lengths of random DNA with the same dinucleotide frequency as a test set are generated to test individual matrix hits, and 100 Mb lengths are used to test clusters. The probability of a given matrix score and the probability scores for clusters are determined, as are the sequence motifs. The usual cutoff for matcorns is 2.5 e-4. No clustering was done for the GC box or CAAT box.

Examples of promoters include: those described in U.S. Pat. No. 6,437,217 (maize RS81 promoter), U.S. Pat. No. 5,641,876 (rice actin promoter), U.S. Pat. No. 6,426,446

(maize RS324 promoter), U.S. Pat. No. 6,429,362 (maize PR-1 promoter), U.S. Pat. No. 6,232,526 (maize A3 promoter), U.S. Pat. No. 6,177,611 (constitutive maize promoters), U.S. Pat. Nos. 5,322,938, 5,352,605, 5,359,142 and 5,530,196 (35S promoter), U.S. Pat. No. 6,433,252 (maize L3 oleosin promoter, P-Zm.L3), U.S. Pat. No. 6,429,357 (rice actin 2 promoter as well as a rice actin 2 intron), U.S. Pat. No. 5,837,848 (root specific promoter), U.S. Pat. No. 6,294,714 (light inducible promoters), U.S. Pat. No. 6,140,078 (salt inducible promoters), U.S. Pat. No. 6,252,138 (pathogen inducible promoters), U.S. Pat. No. 6,175,060 (phosphorus deficiency inducible promoters), U.S. Pat. No. 6,635,806 (gama-coixin promoter, P-Cl.Gcx), and U.S. patent application Ser. No. 09/757,089 (maize chloroplast aldolase promoter), all of which are incorporated herein by reference in their entirety.

Promoters of the present invention include homologues of cis elements known to effect gene regulation that show homology with the promoter sequences of the present invention. These cis elements include, but are not limited to, oxygen responsive cis elements (Cowen et al., J. Biol. Chem. 268(36):26904-26910 (1993)), light regulatory elements (Bruce and Quaill, Plant Cell 2 (11):1081-1089 (1990); Bruce et al., EMBO J. 10:3015-3024 (1991); Rocholl et al., Plant Sci. 97:189-198 (1994); Block et al., Proc. Natl. Acad. Sci. USA 87:5387-5391 (1990); Giuliano et al., Proc. Natl. Acad. Sci. USA 85:7089-7093 (1988); Staiger et al., Proc. Natl. Acad. Sci. USA 86:6930-6934 (1989); Izawa et al., Plant Cell 6:1277-1287 (1994); Menkens et al., Trends in Biochemistry 20:506-510 (1995); Foster et al., FASEB J. 8:192-200 (1994); Plesse et al., Mol Gen Gene 254:258-266 (1997); Green et al., EMBO J. 6:2543-2549 (1987); Kuhlemeier et al., Ann. Rev Plant Physiol. 38:221-257 (1987); Villain et al., J. Biol. Chem. 271:32593-32598 (1996); Lam et al., Plant Cell 2:857-866 (1990); Gilmartin et al., Plant Cell 2:369-378 (1990); Datta et al., Plant Cell 1:1069-1077 (1989); Gilmartin et al., Plant Cell 2:369-378 (1990); Castresana et al., EMBO J. 7:1929-1936 (1988); Ueda et al., Plant Cell 1:217-227 (1989); Terzaghi et al., Annu. Rev. Plant Physiol. Plant Mol. Biol. 46:445-474 (1995); Green et al., EMBO J. 6:2543-2549 (1987); Villain et al., J. Biol. Chem. 271:32593-32598 (1996); Tjaden et al., Plant Cell 6:107-118 (1994); Tjaden et al., Plant Physiol. 108:1109-1117 (1995); Ngai et al., Plant J. 12:1021-1234 (1997); Bruce et al., EMBO J. 10:3015-3024 (1991); Ngai et al., Plant J. 12:1021-1034 (1997)), elements responsive to gibberellin, (Muller et al., J. Plant Physiol. 145:606-613 (1995); Croissant et al., Plant Science 116:27-35 (1996); Lohmer et al., EMBO J. 10:617-624 (1991); Rogers et al., Plant Cell 4:1443-1451 (1992); Lanahan et al., Plant Cell 4:203-211 (1992); Skriver et al., Proc. Natl. Acad. Sci. USA 88:7266-7270 (1991); Gilmartin et al., Plant Cell 2:369-378 (1990); Huang et al., Plant Mol. Biol. 14:655-668 (1990), Gubler et al., Plant Cell 7:1879-1891 (1995)), elements responsive to abscisic acid, (Busk et al., Plant Cell 9:2261-2270 (1997); Guiltinan et al., Science 250:267-270 (1990); Shen et al., Plant Cell 7:295-307 (1995); Shen et al., Plant Cell 8:1107-1119 (1996); Seo et al., Plant Mol. Biol. 27:1119-1131 (1995); Marcotte et al., Plant Cell 1:969-976 (1989); Shen et al., Plant Cell 7:295-307 (1995); Iwasaki et al., Mol Gen Genet 247:391-398 (1995); Hattori et al., Genes Dev. 6:609-618 (1992); Thomas et al., Plant Cell 5:1401-1410 (1993)), elements similar to abscisic acid responsive elements, (Ellerstrom et al., Plant Mol. Biol. 32:1019-1027 (1996)), auxin responsive elements (Liu et al., Plant Cell 6:645-657 (1994); Liu et al., Plant Physiol. 115:397-407 (1997); Kosugi et al., Plant J. 7:877-886 (1995); Kosugi et al., Plant Cell 9:1607-1619 (1997); Ballas et al., J. Mol. Biol. 233:580-596 (1993)), a cis element responsive to methyl jasmonate treatment (Beaudoin and Rothstein, Plant Mol. Biol. 33:835-846 (1997)), a cis element responsive to abscisic acid and stress response (Straub et al., Plant Mol. Biol. 26:617-630 (1994)), ethylene responsive cis elements (Itzhaki et al., Proc. Natl. Acad. Sci. USA 91:8925-8929 (1994); Montgomery et al., Proc. Natl. Acad. Sci. USA 90:5939-5943 (1993); Sessa et al., Plant Mol. Biol. 28:145-153 (1995); Shinshi et al., Plant Mol. Biol. 27:923-932 (1995)), salicylic acid cis responsive elements, (Strange et al., Plant J. 11:1315-1324 (1997); Qin et al., Plant Cell 6:863-874 (1994)), a cis element that responds to water stress and abscisic acid (Lam et al., J. Biol. Chem. 266:17131-17135 (1991); Thomas et al., Plant Cell 5:1401-1410 (1993); Pla et al., Plant Mol Biol 21:259-266 (1993)), a cis element essential for M phase-specific expression (Ito et al., Plant Cell 10:331-341 (1998)), sucrose responsive elements (Huang et al., Plant Mol. Biol. 14:655-668 (1990); Hwang et al., Plant Mol Biol 36:331-341 (1998); Grierson et al., Plant J. 5:815-826 (1994)), heat shock response elements (Pelham et al., Trends Genet. 1:31-35 (1985)), elements responsive to auxin and/or salicylic acid and also reported for light regulation (Lam et al., Proc. Natl. Acad. Sci. USA 86:7890-7897 (1989); Benfey et al., Science 250:959-966 (1990)), elements responsive to ethylene and salicylic acid (Ohme-Takagi et al., Plant Mol. Biol. 15:941-946 (1990)), elements responsive to wounding and abiotic stress (Loake et al., Proc. Natl. Acad. Sci. USA 89:9230-9234 (1992); Mhiri et al., Plant Mol. Biol. 33:257-266 (1997)), antoxidant response elements (Rushmore et al., J. Biol. Chem. 266:11632-11639; Dalton et al., Nucleic Acids Res. 22:5016-5023 (1994)), Sph elements (Suzuki et al., Plant Cell 9:799-807 1997)), elicitor responsive elements, (Fukuda et al., Plant Mol. Biol. 34:81-87 (1997); Rushton et al., EMBO J. 15:5690-5700 (1996)), metal responsive elements (Stuart et al., Nature 317:828-831 (1985); Westin et al., EMBO J. 7:3763-3770 (1988); Thiele et al., Nucleic Acids Res. 20:1183-1191 (1992); Faisst et al., Nucleic Acids Res. 20:3-26 (1992)), low temperature responsive elements, (Baker et al., Plant Mol. Biol. 24:701-713 (1994); Jiang et al., Plant Mol. Biol. 30:679-684 (1996); Nordin et al., Plant Mol. Biol. 21:641-653 (1993); Zhou et al., J. Biol. Chem. 267:23515-23519 (1992)), drought responsive elements, (Yamaguchi et al., Plant Cell 6:251-264 (1994); Wang et al., Plant Mol. Biol. 28:605-617 (1995); Bray EA, Trends in Plant Science 2:48-54 (1997)) enhancer elements for glutenin, (Colot et al., EMBO J. 6:3559-3564 (1987); Thomas et al., Plant Cell 2:1171-1180 (1990); Kreis et al., Philos. Trans. R. Soc. Lond., B314:355-365 (1986)), light-independent regulatory elements, (Lagrange et al., Plant Cell 9:1469-1479 (1997); Villain et al., J. Biol. Chem. 271:32593-32598 (1996)), OCS enhancer elements, (Bouchez et al., EMBO J. 8:4197-4204 (1989); Foley et al., Plant J. 3:669-679 (1993)), ACGT elements, (Foster et al., FASEB J. 8:192-200 (1994); Izawa et al., Plant Cell 6:1277-1287 (1994); Izawa et al., J. Mol. Biol. 230:1131-1144 (1993)), negative cis elements in plastid related genes, (Zhou et al., J. Biol. Chem. 267:23515-23519 (1992); Lagrange et al., Mol. Cell Biol. 13:2614-2622 (1993); Lagrange et al., Plant Cell 9:1469-1479 (1997); Zhou et al., J. Biol. Chem. 267:23515-23519 (1992)), prolamin box elements, (Forde et al., Nucleic Acids Res. 13:7327-7339 (1985); Colot et al., EMBO J. 6:3559-3564 (1987); Thomas et al., Plant Cell 2:1171-1180 (1990); Thompson et al., Plant Mol. Biol. 15:755-764 (1990); Vicente et al., Proc. Natl. Acad. Sci. USA 94:7685-7690 (1997)), elements in enhancers from the IgM heavy chain gene (Gillies et al., Cell 33:717-728 (1983); Whittier et al., Nucleic Acids Res. 15:2515-2535 (1987)).

The activity or strength of a promoter may be measured in terms of the amount of mRNA or protein accumulation it specifically produces, relative to the total amount of mRNA or protein. The promoter preferably expresses an operably linked nucleic acid sequence at a level greater than 0.01%; preferably in a range of about 0.5% to about 20% (w/w) of the total cellular RNA or protein.

Alternatively, the activity or strength of a promoter may be expressed relative to a well-characterized promoter (for which transcriptional activity was previously assessed). For example, a less-characterized promoter may be operably linked to a reporter sequence (e.g., GUS) and introduced into a specific cell type. A well-characterized promoter (e.g. the 35S promoter) is similarly prepared and introduced into the same cellular context. Transcriptional activity of the unknown promoter is determined by comparing the amount of reporter expression, relative to the well characterized promoter. In one embodiment, the activity of the present promoter is as strong as the 35S promoter when compared in the same cellular context. The cellular context is preferably maize, sorghum, corn, barley, wheat, canola, soybean, or maize; and more preferably is maize, sorghum, corn, barley, or wheat; and most preferably is maize.

Enhancers

Enhancers, which strongly activate transcription, frequently in a specific differentiated cell type, are usually 100-200 base pairs long. Although enhancers often lie within a few kilobases of the cap site, in some cases they lie much further upstream or downstream from the cap site or within an intron. Some genes are controlled by more than one enhancer region, as in the case of the *Drosophila* even-skipped gene.

As used herein, the term "enhancer domain" refers to a cis-acting transcriptional regulatory element (cis-element), which confers an aspect of the overall modulation of gene expression. An enhancer domain may function to bind transcription factors, trans-acting protein factors that regulate transcription. Some enhancer domains bind more than one transcription factor, and transcription factors may interact with different affinities with more than one enhancer domain. Enhancer domains can be identified by a number of techniques, including deletion analysis, i.e., deleting one or more nucleotides from the 5' end or internal to a promoter; DNA binding protein analysis using DNase I footprinting, methylation interference, electrophoresis mobility-shift assays, in vivo genomic footprinting by ligation-mediated PCR, and other conventional assays; or by DNA sequence similarity analysis with known cis-element motifs by conventional DNA sequence comparison methods. The fine structure of an enhancer domain can be further studied by mutagenesis (or substitution) of one or more nucleotides or by other conventional methods. Enhancer domains can be obtained by chemical synthesis or by isolation from regulatory elements that include such elements, and they can be synthesized with additional flanking nucleotides that contain useful restriction enzyme sites to facilitate subsequence manipulation.

Any of the nucleic acid molecules described herein may comprise nucleic acid sequences comprising enhancers. An enhancer of the present invention preferably assists in the regulation of transcription of a heterologous transcribable polynucleotide sequence at a high level in a plant. More preferably, the enhancer hybridizes to a nucleic acid sequence selected from the group consisting of SEQ ID NO: 1 through SEQ ID NO: 14,151, or any complements thereof; or any fragments thereof. Suitable hybridization conditions include those described above. A nucleic acid sequence of the enhancer preferably hybridizes, under low or high stringency conditions, with SEQ ID NO: 1 through SEQ ID NO: 14,151, or any complements thereof. The enhancer most preferably hybridizes under high stringency conditions to a nucleic acid sequence selected from the group consisting of SEQ ID NO: 1 through SEQ ID NO: 14,15.1, or any complements thereof.

In an alternative embodiment, the enhancer comprises a nucleic acid sequence that exhibits 85% or greater identity, and more preferably at least 86 or greater, 87 or greater, 88 or greater, 89 or greater, 90 or greater, 91 or greater, 92 or greater, 93 or greater, 94 or greater, 95 or greater, 96 or greater, 97 or greater, 98 or greater, or 99% or greater identity to a nucleic acid sequence selected from the group consisting of SEQ ID NO: 1 through SEQ ID NO: 14,151, or complements thereof. The enhancer most preferably comprises a nucleic acid sequence selected from the group consisting of SEQ ID NO: 1 through SEQ ID NO: 14,151, any complements thereof, or any fragments thereof.

Translational enhancers may also be incorporated as part of a recombinant vector. Thus the recombinant vector may preferably contain one or more 5' non-translated leader sequences which serve to enhance expression of the nucleic acid sequence. Such enhancer sequences may be desirable to increase or alter the translational efficiency of the resultant mRNA. Examples of other regulatory element 5' nucleic acid leader sequences include dSSU 5', PetHSP70 5', and GmHSP17.9 5'. A translational enhancer sequence derived from the untranslated leader sequence from the mRNA of the coat protein gene of alfalfa mosaic virus coat protein gene, placed between the promoter and the gene, to increase translational efficiency, is described in U.S. Pat. No. 6,037,527, herein incorporated by reference. Thus, the design, construction, and use of enhancer domains according to the methods disclosed herein for modulating the expression of operably linked transcribable polynucleotide molecules are encompassed by the present invention.

Leaders

As used herein, the term "leader" refers to a polynucleotide molecule isolated from the untranslated 5' region (5' UTR) of a genomic copy of a gene and defined generally as a segment between the transcription start site (TSS) and the coding sequence start site. Alternately, leaders may be synthetically produced or manipulated DNA elements. A "plant leader" is a native or non-native leader that is functional in plant cells. A plant leader can be used as a 5' regulatory element for modulating expression of an operably linked transcribable polynucleotide molecule.

For example, non-translated 5' leader polynucleotide molecules derived from heat shock protein genes have been demonstrated to enhance gene expression in plants (see for example, U.S. Pat. No. 5,659,122 and U.S. Pat. No. 5,362,865, all of which are incorporated herein by reference).

Any of the nucleic acid molecules described herein may comprise nucleic acid sequences comprising leaders. A leader of the present invention preferably assists in the regulation of transcription of a heterologous transcribable polynucleotide sequence at a high level in a plant. More preferably, the leader hybridizes to a nucleic acid sequence selected from the group consisting of SEQ ID NO: 1 through SEQ ID NO: 14,151, or any complements thereof, or any fragments thereof. Suitable hybridization conditions include those described above. A nucleic acid sequence of the leader preferably hybridizes, under low or high stringency conditions, with SEQ ID NO: 1 through SEQ ID NO: 14,151, or any complements thereof. The leader most preferably hybridizes under high stringency conditions to a nucleic acid sequence selected from the group consisting of SEQ ID NO: 1 through SEQ ID NO: 14,151, or any complements thereof.

In an alternative embodiment, the leader comprises a nucleic acid sequence that exhibits 85% or greater identity, and more preferably at least 86 or greater, 87 or greater, 88 or greater, 89 or greater, 90 or greater, 91 or greater, 92 or greater, 93 or greater, 94 or greater, 95 or greater, 96 or greater, 97 or greater, 98 or greater, or 99% or greater identity to a nucleic acid sequence selected from the group consisting of SEQ ID NO: 1 through SEQ ID NO: 14,151, or complements thereof. The leader most preferably comprises a nucleic acid sequence selected from the group consisting of SEQ ID NO: 1 through SEQ ID NO: 14,151, any complements thereof, or any fragments thereof.

Introns

As used herein, the term "intron" refers to a polynucleotide molecule that may be isolated or identified from the intervening sequence of a genomic copy of a gene and may be defined generally as a region spliced out during mRNA processing prior to translation. Alternately, introns may be synthetically produced or manipulated DNA elements. Introns may themselves contain sub-elements such as cis-elements or enhancer domains that effect the transcription of operably linked genes. A "plant intron" is a native or non-native intron that is functional in plant cells. A plant intron may be used as a regulatory element for modulating expression of an operably linked gene or genes. A polynucleotide molecule sequence in a recombinant construct may comprise introns. The introns may be heterologous with respect to the transcribable polynucleotide molecule sequence. Any of the nucleic acid molecules described herein may comprise nucleic acid sequences comprising introns.

The transcribable polynucleotide molecule sequence in the recombinant vector may comprise introns. The introns may be heterologous with respect to the transcribable polynucleotide molecule sequence. Examples of regulatory element introns include the corn actin intron and the corn HSP70 intron (U.S. Pat. No. 5,859,347, herein incorporated by reference in its entirety).

Terminators

The 3' untranslated regions (3' UTRs) of mRNAs are generated by specific cleavage and polyadenylation. A 3' polyadenylation region means a DNA molecule linked to and located downstream of a structural polynucleotide molecule and includes polynucleotides that provide a polyadenylation signal and other regulatory signals capable of affecting transcription, mRNA processing or gene expression. PolyA tails are thought to function in mRNA stability and in initiation of translation.

As used herein, the term "terminator" refers to a polynucleotide sequence that may be isolated or identified from the 3' untranslated region (3' UTR) of a transcribable gene, which functions to signal to RNA polymerase the termination of transcription. The polynucleotide sequences of the present invention may comprise terminator sequences.

Polyadenylation is the non-templated addition of a 50 to 200 nt chain of polyadenylic acid (polyA). Cleavage must precede polyadenylation. The polyadenylation signal functions in plants to cause the addition of polyadenylate nucleotides to the 3' end of the mRNA precursor. The polyadenylation sequence can be derived from the natural gene, from a variety of plant genes, or from *Agrobacterium* T-DNA genes. Transcription termination often occurs at sites considerably downstream of the sites that, after polyadenylation, are the 3' ends of most eukaryotic mRNAs.

Examples of 3' UTR regions are the nopaline synthase 3' region (nos 3'; Fraley, et al., *Proc. Natl. Acad. Sci.* USA 80: 4803-4807, 1983), wheat hsp17 (T-Ta.Hsp17), and T-Ps.R-bcS2:E9 (pea rubisco small subunit), those disclosed in WO0011200A2 (herein incorporated by reference) and other 3' UTRs known in the art can be tested and used in combination with a DHDPS or AK coding region, herein referred to as T-3' UTR. Another example of terminator regions is given in U.S. Pat. No. 6,635,806, herein incorporated by reference.

Regulatory Element Isolation and Modification

Any number of methods well known to those skilled in the art can be used to isolate a polynucleotide molecule, or fragment thereof, disclosed in the present invention. For example, PCR (polymerase chain reaction) technology can be used to amplify flanking regions from a genomic library of a plant using publicly available sequence information. A number of methods are known to those of skill in the art to amplify unknown polynucleotide molecules adjacent to a core region of known polynucleotide sequence. Methods include but are not limited to inverse PCR (IPCR), vectorette PCR, Y-shaped PCR, and genome walking approaches. Polynucleotide fragments can also be obtained by other techniques such as by directly synthesizing the fragment by chemical means, as is commonly practiced by using an automated oligonucleotide synthesizer. For the present invention, the polynucleotide molecules were isolated from genomic DNA by designing oligonucleotide primers based on available sequence information and using PCR techniques.

As used herein, the term "isolated polynucleotide molecule" refers to a polynucleotide molecule at least partially separated from other molecules normally associated with it in its native state. In one embodiment, the term "isolated" is also used herein in reference to a polynucleotide molecule that is at least partially separated from nucleic acids which normally flank the polynucleotide in its native state. Thus, polynucleotides fused to regulatory or coding sequences with which they are not normally associated, for example as the result of recombinant techniques, are considered isolated herein. Such molecules are considered isolated even when present, for example in the chromosome of a host cell, or in a nucleic acid solution. The term "isolated" as used herein is intended to encompass molecules not present in their native state.

Those of skill in the art are familiar with the standard resource materials that describe specific conditions and procedures for the construction, manipulation, and isolation of macromolecules (e.g., polynucleotide molecules, plasmids, etc.), as well as the generation of recombinant organisms and the screening and isolation of polynucleotide molecules.

Short nucleic acid sequences having the ability to specifically hybridize to complementary nucleic acid sequences may be produced and utilized in the present invention. These short nucleic acid molecules may be used as probes to identify the presence of a complementary nucleic acid sequence in a given sample. Thus, by constructing a nucleic acid probe which is complementary to a small portion of a particular nucleic acid sequence, the presence of that nucleic acid sequence may be detected and assessed. Use of these probes may greatly facilitate the identification of transgenic plants which contain the presently disclosed nucleic acid molecules. The probes may also be used to screen cDNA or genomic libraries for additional nucleic acid sequences related or sharing homology to the presently disclosed promoters and transcribable polynucleotide sequences. The short nucleic acid sequences may be used as probes and specifically as PCR probes. A PCR probe is a nucleic acid molecule capable of initiating a polymerase activity while in a double-stranded structure with another nucleic acid. Various methods for determining the structure of PCR probes and PCR techniques exist in the art. Computer generated searches using programs such as Primer3 STSPipeline, or GeneUp (Pesole, et at., *BioTechniques* 25:112-123, 1998), for example, can be used to identify potential PCR primers.

Alternatively, the short nucleic acid sequences may be used as oligonucleotide primers to amplify or mutate a complementary nucleic acid sequence using PCR technology. These primers may also facilitate the amplification of related complementary nucleic acid sequences (e.g. related nucleic acid sequences from other species).

The primer or probe is generally complementary to a portion of a nucleic acid sequence that is to be identified, amplified, or mutated. The primer or probe should be of sufficient length to form a stable and sequence-specific duplex molecule with its complement. The primer or probe preferably is about 10 to about 200 nucleotides long, more preferably is about 10 to about 100 nucleotides long, even more preferably is about 10 to about 50 nucleotides long, and most preferably is about 14 to about 30 nucleotides long. The primer or probe may be prepared by direct chemical synthesis, by PCR (See, for example, U.S. Pat. Nos. 4,683,195, and 4,683,202, each of which is herein incorporated by reference), or by excising the nucleic acid specific fragment from a larger nucleic acid molecule.

Transcribable Polynucleotide Molecules

A regulatory element of the present invention may be operably linked to a transcribable polynucleotide sequence that is heterologous with respect to the regulatory element. The term "heterologous" refers to the relationship between two or more nucleic acid or protein sequences that are derived from different sources. For example, a promoter is heterologous with respect to a transcribable polynucleotide sequence if such a combination is not normally found in nature. In addition, a particular sequence may be "heterologous" with respect to a cell or organism into which it is inserted (i.e. does not naturally occur in that particular cell or organism).

The transcribable polynucleotide molecule may generally be any nucleic acid sequence for which an increased level of transcription is desired. Alternatively, the regulatory element and transcribable polynucleotide sequence may be designed to down-regulate a specific nucleic acid sequence. This is typically accomplished by linking the promoter to a transcribable polynucleotide sequence that is oriented in the antisense direction. One of ordinary skill in the art is familiar with such antisense technology. Briefly, as the antisense nucleic acid sequence is transcribed, it hybridizes to and sequesters a complimentary nucleic acid sequence inside the cell. This duplex RNA molecule cannot be translated into a protein by the cell's translational machinery. Any nucleic acid sequence may be negatively regulated in this manner.

A regulatory element of the present invention may also be operably linked to a modified transcribable polynucleotide molecule that is heterologous with respect to the promoter. The transcribable polynucleotide molecule may be modified to provide various desirable features. For example, a transcribable polynucleotide molecule may be modified to increase the content of essential amino acids, enhance translation of the amino acid sequence, alter post-translational modifications (e.g., phosphorylation sites), transport a translated product to a compartment inside or outside of the cell, improve protein stability, insert or delete cell signaling motifs, etc.

Due to the degeneracy of the genetic code, different nucleotide codons may be used to code for a particular amino acid. A host cell often displays a preferred pattern of codon usage. Transcribable polynucleotide molecules are preferably constructed to utilize the codon usage pattern of the particular host cell. This generally enhances the expression of the transcribable polynucleotide sequence in a transformed host cell. Any of the above described nucleic acid and amino acid sequences may be modified to reflect the preferred codon usage of a host cell or organism in which they are contained. Modification of a transcribable polynucleotide sequence for optimal codon usage in plants is described in U.S. Pat. No. 5,689,052, herein incorporated by reference.

Additional variations in the transcribable polynucleotide molecules may encode proteins having equivalent or superior characteristics when compared to the proteins from which they are engineered. Mutations may include, but are not limited to, deletions, insertions, truncations, substitutions, fusions, shuffling of motif sequences, and the like. Mutations to a transcribable polynucleotide molecule may be introduced in either a specific or random manner, both of which are well known to those of skill in the art of molecular biology.

Thus, one embodiment of the invention is a regulatory element such as provided in SEQ ID NO: 1 through SEQ ID NO: 14,151, operably linked to a transcribable polynucleotide molecule so as to modulate transcription of said transcribable polynucleotide molecule at a desired level or in a desired tissue or developmental pattern upon introduction of said construct into a plant cell. In one embodiment, the transcribable polynucleotide molecule comprises a protein-coding region of a gene, and the regulatory element affects the transcription of a functional mRNA molecule that is translated and expressed as a protein product. In another embodiment, the transcribable polynucleotide molecule comprises an antisense region of a gene, and the regulatory element affects the transcription of an antisense RNA molecule or other similar inhibitory RNA in order to inhibit expression of a specific RNA molecule of interest in a target host cell.

Genes of Agronomic Interest

The transcribable polynucleotide molecule preferably encodes a polypeptide that is suitable for incorporation into the diet of a human or an animal. Specifically, such transcribable polynucleotide molecules comprise genes of agronomic interest. As used herein, the term "gene of agronomic interest" refers to a transcribable polynucleotide molecule that includes but is not limited to a gene that provides a desirable characteristic associated with plant morphology, physiology, growth and development, yield, nutritional enhancement, disease or pest resistance, or environmental or chemical tolerance. Suitable transcribable polynucleotide molecules include but are not limited to those encoding a yield protein, a stress resistance protein, a developmental control protein, a tissue differentiation protein, a meristem protein, an environmentally responsive protein, a senescence protein, a hormone responsive protein, an abscission protein, a source protein, a sink protein, a flower control protein, a seed protein, an herbicide resistance protein, a disease resistance protein, a fatty acid biosynthetic enzyme, a tocopherol biosynthetic enzyme, an amino acid biosynthetic enzyme, or an insecticidal protein.

In one embodiment of the invention, a polynucleotide molecule as shown in SEQ ID NO: 1 through SEQ ID NO: 14,151, or complements thereof, or fragments thereof, or cis elements thereof comprising regulatory elements is incorporated into a construct such that a polynucleotide molecule of the present invention is operably linked to a transcribable polynucleotide molecule that is a gene of agronomic interest.

The expression of a gene of agronomic interest is desirable in order to confer an agronomically important trait. A gene of agronomic interest that provides a beneficial agronomic trait to crop plants may be, for example, including, but not limited to genetic elements comprising herbicide resistance (U.S. Pat. Nos. 6,803,501; 6,448,476; 6,248,876; 6,225,114; 6,107, 549; 5,866,775; 5,804,425; 5,633,435; 5,463,175), increased yield (U.S. Pat. RE38,446; U.S. Pat. Nos. 6,716,474; 6,663, 906; 6,476,295; 6,441,277; 6,423,828; 6,399,330; 6,372,211; 6,235,971; 6,222,098; 5,716,837), insect control (U.S. Pat. Nos. 6,809,078; 6,713,063; 6,686,452; 6,657,046; 6,645,497; 6,642,030; 6,639,054; 6,620,988; 6,593,293; 6,555,655; 6,538,109; 6,537,756; 6,521,442; 6,501,009; 6,468,523; 6,326,351; 6,313,378; 6,284,949; 6,281,016; 6,248,536; 6,242,241; 6,221,649; 6,177,615; 6,156,573; 6,153,814; 6,110,464; 6,093,695; 6,063,756; 6,063,597; 6,023,013; 5,959,091; 5,942,664; 5,942,658; 5,880,275; 5,763,245; 5,763,241), fungal disease resistance (U.S. Pat. Nos. 6,653, 280; 6,573,361; 6,506,962; 6,316,407; 6,215,048; 5,516,671; 5,773,696; 6,121,436; 6,316,407; 6,506,962), virus resistance (U.S. Pat. Nos. 6,617,496; 6,608,241; 6,015,940; 6,013, 864; 5,850,023; 5,304,730), nematode resistance (U.S. Pat. No. 6,228,992), bacterial disease resistance (U.S. Pat. No. 5,516,671), plant growth and development (U.S. Pat. Nos. 6,723,897; 6,518,488), starch production (U.S. Pat. Nos. 6,538,181; 6,538,179; 6,538,178; 5,750,876; 6,476,295), modified oils production (U.S. Pat. Nos. 6,444,876; 6,426, 447; 6,380,462), high oil production (U.S. Pat. Nos. 6,495, 739; 5,608,149; 6,483,008; 6,476,295), modified fatty acid content (U.S. Pat. Nos. 6,828,475; 6,822,141; 6,770,465; 6,706,950; 6,660,849; 6,596,538; 6,589,767; 6,537,750; 6,489,461; 6,459,018), high protein production (U.S. Pat. No. 6,380,466), fruit ripening (U.S. Pat. No. 5,512,466), enhanced animal and human nutrition (U.S. Pat. Nos. 6,723, 837; 6,653,530; 6,5412,59; 5,985,605; 6,171,640), biopolymers (U.S. Pat. RE37,543; U.S. Pat Nos. 6,228,623; 5,958, 745 and U.S. Patent Publication No. US20030028917), environmental stress resistance (U.S. Pat. No. 6,072,103), pharmaceutical peptides and secretable peptides (U.S. Pat. Nos.6,812,379; 6,774,283; 6,140,075; 6,080,560), improved processing traits (U.S. Pat. No. 6,476,295), improved digestibility (U.S. Pat No. 6,531,648) low raffinose (U.S. Pat. No. 6,166,292), industrial enzyme production (U.S. Pat No. 5,543,576), improved flavor (U.S. Pat. No. 6,011,199), nitrogen fixation (U.S. Pat. No. 5,229,114), hybrid seed production (U.S. Pat. No. 5,689,041), fiber production (U.S. Pat. Nos. 6,576,818; 6,271,443; 5,981,834; 5,869,720) and biofuel production (U.S. Pat. No. 5,998,700). The genetic elements, methods, and transgenes described in the patents listed above are incorporated herein by reference.

Alternatively, a transcribable polynucleotide molecule can effect the above mentioned plant characteristic or phenotype by encoding a RNA molecule that causes the targeted inhibition of expression of an endogenous gene, for example via antisense, inhibitory RNA (RNAi), or cosuppression-mediated mechanisms. The RNA could also be a catalytic RNA molecule (i.e., a ribozyme) engineered to cleave a desired endogenous mRNA product. Thus, any transcribable polynucleotide molecule that encodes a transcribed RNA molecule that affects a phenotype or morphology change of interest may be useful for the practice of the present invention.

Selectable Markers

As used herein the term "marker" refers to any transcribable polynucleotide molecule whose expression, or lack thereof, can be screened for or scored in some way. Marker genes for use in the practice of the present invention include, but are not limited to transcribable polynucleotide molecules encoding β-glucuronidase (GUS described in U.S. Pat. No. 5,599,670, which is incorporated herein by reference), green fluorescent protein (GFP described in U.S. Pat. No. 5,491,084 and U.S. Pat. No. 6,146,826, all of which are incorporated herein by reference), proteins that confer antibiotic resistance, or proteins that confer herbicide tolerance. Marker genes in genetically modified plants are generally of two types: genes conferring antibiotic resistance or genes conferring herbicide tolerance.

Useful antibiotic resistance markers, including those encoding proteins conferring resistance to kanamycin (nptII), hygromycin B (aph IV), streptomycin or spectinomycin (aad, spec/strep) and gentamycin (aac3 and aacC4) are known in the art.

Herbicides for which transgenic plant tolerance has been demonstrated and the method of the present invention can be applied, include but are not limited to: glyphosate, glufosinate, sulfonylureas, imidazolinones, bromoxynil, delapon, dicamba, cyclohezanedione, protoporphyrionogen oxidase inhibitors, and isoxasflutole herbicides. Polynucleotide molecules encoding proteins involved in herbicide tolerance are known in the art, and include, but are not limited to a polynucleotide molecule encoding 5-enolpyruvylshikimate-3-phosphate synthase (EPSPS described in U.S. Pat. No. 5,627, 061, U.S. Pat. No. 5,633,435, U.S. Pat. No. 6,040,497 and in U.S. Pat. No. 5,094,945 for glyphosate tolerance, all of which are incorporated herein by reference); polynucleotides encoding a glyphosate oxidoreductase and a glyphosate-N-acetyl transferase (GOX described in U.S. Pat. No. 5,463,175 and GAT described in U.S. Patent publication 20030083480, dicamba monooxygenase U.S. Patent publication 20030135879, all of which are incorporated herein by reference); a polynucleotide molecule encoding bromoxynil nitrilase (Bxn described in U.S. Pat. No. 4,810,648 for Bromoxynil tolerance, which is incorporated herein by reference); a polynucleotide molecule encoding phytoene desaturase (crtI) described in Misawa et al, (1993) *Plant J.* 4:833-840 and Misawa et al, (1994) *Plant J.* 6:481-489 for norflurazon tolerance; a polynucleotide molecule encoding acetohydroxyacid synthase (AHAS, aka ALS) described in Sathasiivan et al. (1990) *Nucl. Acids Res.* 18:2188-2193 for tolerance to sulfonylurea herbicides; and the bar gene described in DeBlock, et al. (1987) *EMBO J.* 6:2513-2519 for glufosinate and bialaphos tolerance. The regulatory elements of the present invention can express transcribable polynucleotide molecules that encode for phosphinothricin acetyltransferase, glyphosate resistant EPSPS, aminoglycoside phosphotransferase, hydroxyphenyl pyruvate dehydrogenase, hygromycin phosphotransferase, neomycin phosphotransferase, dalapon dehalogenase, bromoxynil resistant nitrilase, anthranilate synthase, glyphosate oxidoreductase and glyphosate-N-acetyl transferase.

Included within the term "selectable markers" are also genes which encode a secretable marker whose secretion can be detected as a means of identifying or selecting for transformed cells. Examples include markers that encode a secretable antigen that can be identified by antibody interaction, or even secretable enzymes which can be detected catalytically. Selectable secreted marker proteins fall into a number of classes, including small, diffusible proteins which are detectable, (e.g., by ELISA), small active enzymes which are detectable in extracellular solution (e.g., α-amylase, β-lactamase, phosphinothricin transferase), or proteins which are inserted or trapped in the cell wall (such as proteins which include a leader sequence such as that found in the expression unit of extension or tobacco PR-S). Other possible selectable marker genes will be apparent to those of skill in the art.

The selectable marker is preferably GUS, green fluorescent protein (GFP), neomycin phosphotransferase II (nptII), luciferase (LUX), an antibiotic resistance coding sequence, or an herbicide (e.g., glyphosate) resistance coding sequence. The selectable marker is most preferably a kanamycin, hygromycin, or herbicide resistance marker.

Probes and Primers

Short nucleic acid sequences having the ability to specifically hybridize to complementary nucleic acid sequences may be produced and utilized in the present invention. These short polynucleotide molecules may be used as probes to identify the presence of a complementary nucleic acid sequence in a given sample. Thus, by constructing a nucleic acid probe which is complementary to a small portion of a particular nucleic acid sequence, the presence of that nucleic acid sequence may be detected and assessed.

Use of these probes may greatly facilitate the identification of transgenic plants which contain the presently disclosed polynucleotide molecules. The probes may also be used to screen cDNA or genomic libraries for additional nucleic acid sequences related or sharing homology to the presently disclosed promoters and transcribable polynucleotide sequences.

Alternatively, the short nucleic acid sequences may be used as oligonucleotide primers to amplify or mutate a complementary nucleic acid sequence using PCR technology. These primers may also facilitate the amplification of related complementary nucleic acid sequences (e.g. related nucleic acid sequences from other species).

The short nucleic acid sequences may be used as probes and specifically as PCR probes. A PCR probe is a polynucleotide molecule capable of initiating a polymerase activity while in a double-stranded structure with another nucleic acid. Various methods for determining the structure of PCR probes and PCR techniques exist in the art. Computer generated searches using programs such as Primer3, STSPipeline, or GeneUp (Pesole, et at., Bio Techniques 25:112-123, 1998), for example, can be used to identify potential PCR primers.

The primer or probe is generally complementary to a portion of a nucleic acid sequence that is to be identified, amplified, or mutated. The primer or probe should be of sufficient length to form a stable and sequence-specific duplex molecule with its complement. The primer or probe preferably is about 10 to about 200 nucleotides long, more preferably is about 10 to about 100 nucleotides long, even more preferably is about 10 to about 50 nucleotides long, and most preferably is about 14 to about 30 nucleotides long.

The primer or probe may be prepared by direct chemical synthesis, by PCR (See, for example, U.S. Pat. Nos.4,683, 195, and 4,683,202), or by excising the nucleic acid specific fragment from a larger polynucleotide molecule.

Constructs and Vectors

The constructs of the present invention are generally double Ti plasmid border DNA constructs that have the right border (RB or AGRtu.RB) and left border (LB or AGRtu.LB) regions of the Ti plasmid isolated from Agrobacterium tumefaciens comprising a T-DNA, that along with transfer molecules provided by the Agrobacterium cells, permit the integration of the T-DNA into the genome of a plant cell (see for example U.S. Pat. No. 6,603,061, herein incorporated by reference in its entirety). The constructs may also contain the plasmid backbone DNA segments that provide replication function and antibiotic selection in bacterial cells, for example, an Escherichia coli origin of replication such as ori322, a broad host range origin of replication such as oriV or oriRi, and a coding region for a selectable marker such as Spec/Strp that encodes for Tn7 aminoglycoside adenyltransferase (aadA) conferring resistance to spectinomycin or streptomycin, or a gentamicin (Gm, Gent) selectable marker gene. For plant transformation, the host bacterial strain is often Agrobacterium tumefaciens ABI, C58, or LBA4404, however, other strains known to those skilled in the art of plant transformation can function in the present invention.

As used herein, the term "construct" means any recombinant polynucleotide molecule such as a plasmid, cosmid, virus, autonomously replicating polynucleotide molecule, phage, or linear or circular single-stranded or double-stranded DNA or RNA polynucleotide molecule, derived from any source, capable of genomic integration or autonomous replication, comprising a polynucleotide molecule where one or more polynucleotide molecule has been linked in a functionally operative manner, i.e. operably linked. As used herein, the term "vector" means any recombinant polynucleotide construct that may be used for the purpose of transformation, i.e. the introduction of heterologous DNA into a host cell.

Methods are known in the art for assembling and introducing constructs into a cell in such a manner that the transcribable polynucleotide molecule is transcribed into a functional mRNA molecule that is translated and expressed as a protein product. For the practice of the present invention, conventional compositions and methods for preparing and using constructs and host cells are well known to one skilled in the art, see for example, Molecular Cloning: A Laboratory Manual, 3rd edition Volumes 1, 2, and 3 (2000) J. F. Sambrook, D. W. Russell, and N. Irwin, Cold Spring Harbor Laboratory Press. Methods for making recombinant vectors particularly suited to plant transformation include, without limitation, those described in U.S. Pat. Nos. 4,971,908, 4,940, 835, 4,769,061 and 4,757,011, all of which are herein incorporated by reference in their entirety. These type of vectors have also been reviewed (Rodriguez, et al. Vectors: A Survey of Molecular Cloning Vectors and Their Uses, Butterworths, Boston, 1988; Glick et al., Methods in Plant Molecular Biology and Biotechnology, CRC Press, Boca Raton, Fla., 1993). Typical vectors useful for expression of nucleic acids in higher plants are well known in the art and include vectors derived from the tumor-inducing (Ti) plasmid of Agrobacterium tumefaciens (Rogers, et al., Meth. In Enzymol, 153: 253-277, 1987). Other recombinant vectors useful for plant transformation, including the pCaMVCN transfer control vector, have also been described (Fromm et al., Proc. Natl. Acad. Sci. USA, 82(17): 5824-5828, 1985).

Regulatory Elements in the Construct

Various untranslated regulatory sequences may be included in the recombinant vector. Any such regulatory sequences may be provided in a recombinant vector with other regulatory sequences. Such combinations can be designed or modified to produce desirable regulatory features. Constructs of the present invention would typically comprise one or more gene expression regulatory elements operably linked to a transcribable polynucleotide molecule operably linked to a 3' transcription termination polynucleotide molecule.

Constructs of the present invention may also include additional 5' untranslated regions (5' UTR) of an mRNA polynucleotide molecule or gene which can play an important role in translation initiation. For example, non-translated 5' leader polynucleotide molecules derived from heat shock protein genes have been demonstrated to enhance gene expression in plants (see for example, U.S. Pat. No. 5,659,122 and U.S. Pat. No. 5,362,865, all of which are incorporated herein by reference). These additional upstream regulatory polynucleotide molecules may be derived from a source that is native or heterologous with respect to the other elements present on the construct.

One or more additional promoters may also be provided in the recombinant vector. These promoters may be operably linked to any of the transcribable polynucleotide sequences described above. Alternatively, the promoters may be operably linked to other nucleic acid sequences, such as those encoding transit peptides, selectable marker proteins, or antisense sequences. These additional promoters may be selected on the basis of the cell type into which the vector will be inserted. Promoters which function in bacteria, yeast, and plants are all well taught in the art. The additional promoters may also be selected on the basis of their regulatory features. Examples of such features include enhancement of transcriptional activity, inducibility, tissue-specificity, and developmental stage-specificity. In plants, promoters that are inducible, of viral or synthetic origin, constitutively active, temporally regulated, and spatially regulated have been described (Poszkowski, et al., *EMBO J.*, 3: 2719, 1989; Odell, et al., *Nature,* 313:810, 1985; Chau et al., *Science,* 244:174-181. 1989).

Often-used constitutive promoters include the CaMV 35S promoter (Odell, et al., *Nature,* 313: 810, 1985), the enhanced CaMV 35S promoter, the Figwort Mosaic Virus (FMV) promoter (Richins, et al., *Nucleic Acids Res.* 20: 8451, 1987), the mannopine synthase (mas) promoter, the nopaline synthase (nos) promoter, and the octopine synthase (ocs) promoter.

Useful inducible promoters include promoters induced by salicylic acid or polyacrylic acids (PR-1; Williams, et al., *Biotechnology* 10:540-543, 1992), induced by application of safeners (substituted benzenesulfonamide herbicides; Hershey and Stoner, *Plant Mol. Biol.* 17: 679-690, 1991), heat-shock promoters (Ou-Lee et al., *Proc. Natl. Acad. Sci U.S.A.* 83: 6815, 1986; Ainley et al., *Plant Mol. Biol.* 14: 949, 1990), a nitrate-inducible promoter derived from the spinach nitrite reductase transcribable polynucleotide sequence (Back et al., *Plant Mol. Biol.* 17: 9, 1991), hormone-inducible promoters (Yamaguchi-Shinozaki et al., *Plant Mol. Biol.* 15: 905, 1990), and light-inducible promoters associated with the small subunit of RuBP carboxylase and LHCP families (Kuhlemeier et al., *Plant Cell* 1: 471, 1989; Feinbaum et al., *Mol. Gen. Genet.* 226:449-456, 1991; Weisshaar, et al, *EMBO J.* 10: 1777-1786, 1991; Lam and Chua, *J. Biol. Chem.* 266: 17131-17135, 1990; Castresana et al., *EMBO J.* 7: 1929-1936, 1988; Schulze-Lefert, et al., *EMBO J.* 8: 651, 1989).

Examples of useful tissue-specific, developmentally-regulated promoters include the β-conglycinin 7Sα promoter (Doyle et al., *J. Biol. Chem.* 261: 9228-9238, 1986; Slighton and Beachy, *Planta* 172: 356, 1987), and seed-specific promoters (Knutzon, et al., *Proc. Natl. Acad. Sci U.S.A.* 89: 2624-2628, 1992; Bustos, et al., *EMBO J.* 10: 1469-1479, 1991; Lam and Chua, *Science* 248: 471, 1991). Plant functional promoters useful for preferential expression in seed plastid include those from plant storage proteins and from proteins involved in fatty acid biosynthesis in oilseeds. Examples of such promoters include the 5' regulatory regions from such transcribable polynucleotide sequences as napin (Kridl et al., *Seed Sci. Res.* 1: 209, 1991), phaseolin, zein, soybean trypsin inhibitor, ACP, stearoyl-ACP desaturase, and oleosin. Seed-specific regulation is discussed in EP 0 255 378.

Another exemplary tissue-specific promoter is the lectin promoter, which is specific for seed tissue. The Lectin protein in soybean seeds is encoded by a single transcribable polynucleotide sequence (Le1) that is only expressed during seed maturation and accounts for about 2 to about 5% of total seed mRNA. The lectin transcribable polynucleotide sequence and seed-specific promoter have been fully characterized and used to direct seed specific expression in transgenic tobacco plants (Vodkin, et al., *Cell,* 34: 1023, 1983; Lindstrom, et al., *Developmental Genetics,* 11: 160, 1990).

Particularly preferred additional promoters in the recombinant vector include the nopaline synthase (nos), mannopine synthase (mas), and octopine synthase (ocs) promoters, which are carried on tumor-inducing plasmids of *Agrobacterium tumefaciens*; the cauliflower mosaic virus (CaMV) 19S and 35S promoters; the enhanced CaMV 35S promoter; the Figwort Mosaic Virus (FMV) 35S promoter; the light-inducible promoter from the small subunit of ribulose-1,5-bisphosphate carboxylase (ssRUBISCO); the EIF-4A promoter from tobacco (Mandel, et al., *Plant Mol. Biol,* 29: 995-1004, 1995); corn sucrose synthetase 1 (Yang, et al., *Proc. Natl. Acad. Sci. USA,* 87: 4144-48, 1990); corn alcohol dehydrogenase 1 (Vogel, et al., *J. Cell Biochem.,* (Suppl) 13D: 312, 1989); corn light harvesting complex (Simpson, *Science,* 233: 34, 1986); corn heat shock protein (Odell, et al., *Nature,* 313: 810, 1985); the chitinase promoter from *Arabidopsis* (Samac, et al., *Plant Cell,* 3:1063-1072, 1991); the LTP (Lipid Transfer Protein) promoters from broccoli (Pyee, et al., *Plant J.,* 7: 49-59, 1995); petunia chalcone isomerase (Van Tunen, et al., *EMBO J.* 7: 1257, 1988); bean glycine rich protein 1 (Keller, et al., *EMBO L.,* 8: 1309-1314, 1989); Potato patatin (Wenzler, et al., *Plant Mol. Biol.,* 12: 41-50, 1989); the ubiquitin promoter from maize (Christensen et al., *Plant Mol. Biol.,* 18: 675,689, 1992); and the actin promoter from corn (McElroy, et al., *Plant Cell,* 2:163-171, 1990).

The additional promoter is preferably seed selective, tissue specific, constitutive, or inducible. The promoter is most preferably the nopaline synthase (NO:S), octopine synthase (OCS), mannopine synthase (MAS), cauliflower mosaic virus 19S and 35S (CaMV19S, CaMV35S), enhanced CaMV (eCaMV), ribulose 1,5-bisphosphate carboxylase (ss-RUBISCO), figwort mosaic virus (FMV), CaMV derived AS4, tobacco RB7, wheat POX1, tobacco EIF-4, lectin protein (Le1), or corn RC2 promoter.

Translational enhancers may also be incorporated as part of the recombinant vector. Thus the recombinant vector may preferably contain one or more 5' non-translated leader sequences which serve to enhance expression of the nucleic acid sequence. Such enhancer sequences may be desirable to increase or alter the translational efficiency of the resultant mRNA. Preferred 5' nucleic acid sequences include dSSU 5', PetHSP70 5', and GmHSP17.9 5'.

The recombinant vector may further comprise a nucleic acid sequence encoding a transit peptide. This peptide may be useful for directing a protein to the extracellular space, a chloroplast, or to some other compartment inside or outside of the cell (see, e.g., European Patent Application Publication Number 0218571, herein incorporated by reference).

The transcribable polynucleotide sequence in the recombinant vector may comprise introns. The introns may be heterologous with respect to the transcribable polynucleotide sequence. Preferred introns include the corn actin intron and the corn HSP70 intron.

In addition, constructs may include additional regulatory polynucleotide molecules from the 3'-untranslated region (3' UTR) of plant genes (e.g., a 3' UTR to increase mRNA stability of the mRNA, such as the PI-II termination region of potato or the octopine or nopaline synthase 3' termination regions). A 3' non-translated region typically provides a transcriptional termination signal, and a polyadenylation signal which functions in plants to cause the addition of adenylate nucleotides to the 3' end of the mRNA. These may be obtained from the 3' regions to the nopaline synthase (nos) coding sequence, the soybean 7Sα storage protein coding sequence, the albumin coding sequence, and the pea ssRUBISCO E9 coding sequence. Particularly preferred 3' nucleic acid sequences include nos 3', E9 3', ADR12 3', 7Sα 3', 11S 3', and albumin 3'. Typically, nucleic acid sequences located a few hundred base pairs downstream of the polyadenylation site serve to terminate transcription. These regions are required for efficient polyadenylation of transcribed mRNA. These additional downstream regulatory polynucleotide molecules may be derived from a source that is native or heterologous with respect to the other elements present on the construct.

Transcribable Polynucleotides in the Construct

The promoter in the recombinant vector is preferably operably linked to a transcribable polynucleotide sequence. Exemplary transcribable polynucleotide sequences, and modified forms thereof, are described in detail above. The promoter of the present invention may be operably linked to a transcribable polynucleotide sequence that is heterologous with respect to the promoter. In one aspect, the transcribable polynucleotide sequence may generally be any nucleic acid sequence for which an increased level of transcription is desired. The transcribable polynucleotide sequence preferably encodes a polypeptide that is suitable for incorporation into the diet of a human or an animal. Suitable transcribable polynucleotide sequences include those encoding a yield protein, a stress resistance protein, a developmental control protein, a tissue differentiation protein, a meristem protein, an environmentally responsive protein, a senescence protein, a hormone responsive protein, an abscission protein, a source protein, a sink protein, a flower control protein, a seed protein, an herbicide resistance protein, a disease resistance protein, a fatty acid biosynthetic enzyme, a tocopherol biosynthetic enzyme, an amino acid biosynthetic enzyme, and an insecticidal protein.

Alternatively, the promoter and transcribable polynucleotide sequence may be designed to down-regulate a specific nucleic acid sequence. This is typically accomplished by linking the promoter to a transcribable polynucleotide sequence that is oriented in the antisense direction. One of ordinary skill in the art is familiar with such antisense technology. Using such an approach, a cellular nucleic acid sequence is effectively down regulated as the subsequent steps of translation are disrupted. Nucleic acid sequences may be negatively regulated in this manner.

Methods are known in the art for constructing and introducing constructs into a cell in such a manner that the transcribable polynucleotide molecule is transcribed into a molecule that is capable of causing gene suppression. For example, posttranscriptional gene suppression using a construct with an anti-sense oriented transcribable polynucleotide molecule to regulate gene expression in plant cells is disclosed in U.S. Pat. No. 5,107,065 and U.S. Pat. No. 5,759,829; posttranscriptional gene suppression using a construct with a sense-oriented transcribable polynucleotide molecule to regulate gene expression in plants is disclosed in U.S. Pat. No. 5,283,184 and U.S. Pat. No. 5,231,020, all of which are hereby incorporated by reference.

Thus, one embodiment of the invention is a construct comprising a regulatory element such as provided in SEQ ID NO: 1 through SEQ ID NO: 14,151, operably linked to a transcribable polynucleotide molecule so as to modulate transcription of said transcribable polynucleotide molecule at a desired level or in a desired tissue or developmental pattern upon introduction of said construct into a plant cell. In one embodiment, the transcribable polynucleotide molecule comprises a protein-coding region of a gene, and the regulatory element affects the transcription of a functional mRNA molecule that is translated and expressed as a protein product. In another embodiment, the transcribable polynucleotide molecule comprises an antisense region of a gene, and the regulatory element affects the transcription of an antisense RNA molecule or other similar inhibitory RNA in order to inhibit expression of a specific RNA molecule of interest in a target host cell.

Exemplary transcribable polynucleotide molecules for incorporation into constructs of the present invention include, for example, polynucleotide molecules or genes from a species other than the target species or genes that originate with or are present in the same species, but are incorporated into recipient cells by genetic engineering methods rather than classical reproduction or breeding techniques. The type of polynucleotide molecule can include but is not limited to a polynucleotide molecule that is already present in the plant cell, a polynucleotide molecule from another plant, a polynucleotide molecule from a different organism, or a polynucleotide molecule generated externally, such as a polynucleotide molecule containing an antisense message of a gene, or a polynucleotide molecule encoding an artificial, synthetic, or otherwise modified version of a transgene.

The constructs of this invention comprising a regulatory element identified or isolated from *Zea mays* may further comprise one or more transcribable polynucleotide molecules. In one embodiment of the invention, a polynucleotide molecule as shown in SEQ ID NO: 1 through SEQ ID NO: 14,151, or any complements thereof, or any fragments thereof, comprising regulatory elements such as promoters, leaders and chimeric regulatory elements, is incorporated into a construct such that a polynucleotide molecule of the present invention is operably linked to a transcribable polynucleotide molecule that is a selectable marker or a gene of agronomic interest.

The gene regulatory elements of the present invention can be incorporated into a construct using selectable markers and tested in transient or stable plant analyses to provide an indication of the regulatory element's gene expression pattern in stable transgenic plants. Current methods of generating transgenic plants employ a selectable marker gene which is transferred along with any other genes of interest usually on the same DNA molecule. The presence of a suitable marker is necessary to facilitate the detection of genetically modified plant tissue during development.

Thus, in one embodiment of the invention, a polynucleotide molecule of the present invention as shown in SEQ ID NO: 1 through SEQ ID NO: 14,151, or fragments thereof, or complements thereof, or cis elements thereof is incorporated into a polynucleotide construct such that a polynucleotide molecule of the present invention is operably linked to a transcribable polynucleotide molecule that provides for a selectable, screenable, or scorable marker. The constructs containing the regulatory elements operably linked to a marker gene may be delivered to the tissues and the tissues analyzed by the appropriate mechanism, depending on the marker. The quantitative or qualitative analyses are used as a tool to evaluate the potential expression profile of a regulatory element when operatively linked to a gene of agronomic interest in stable plants. Any marker gene, described above, may be used in a transient assay.

Methods of testing for marker gene expression in transient assays are known to those of skill in the art. Transient expression of marker genes has been reported using a variety of plants, tissues, and DNA delivery systems. For example, types of transient analyses can include but are not limited to direct gene delivery via electroporation or particle bombardment of tissues in any transient plant assay using any plant species of interest. Such transient systems would include but are not limited to electroporation of protoplasts from a variety of tissue sources or particle bombardment of specific tissues of interest. The present invention encompasses the use of any transient expression system to evaluate regulatory elements operably linked to any transcribable polynucleotide molecule, including but not limited to marker genes or genes of agronomic interest. Examples of plant tissues envisioned to test in transients via an appropriate delivery system would include but are not limited to leaf base tissues, callus, cotyledons, roots, endosperm, embryos, floral tissue, pollen, and epidermal tissue.

Transformation

The invention is also directed to a method of producing transformed cells and plants which comprise, in a 5' to 3' orientation, a gene expression regulatory element operably linked to a heterologous transcribable polynucleotide sequence. Other sequences may also be introduced into the cell, including 3' transcriptional terminators, 3' polyadenylation signals, other translated or untranslated sequences, transit or targeting sequences, selectable markers, enhancers, and operators.

The term "transformation" refers to the introduction of nucleic acid into a recipient host. The term "host" refers to bacteria cells, fungi, animals and animal cells, plants and plant cells, or any plant parts or tissues including protoplasts, calli, roots, tubers, seeds, stems, leaves, seedlings, embryos, and pollen. As used herein, the term "transformed" refers to a cell, tissue, organ, or organism into which has been introduced a foreign polynucleotide molecule, such as a construct. The introduced polynucleotide molecule may be integrated into the genomic DNA of the recipient cell, tissue, organ, or organism such that the introduced polynucleotide molecule is inherited by subsequent progeny. A "transgenic" or "transformed" cell or organism also includes progeny of the cell or organism and progeny produced from a breeding program employing such a transgenic plant as a parent in a cross and exhibiting an altered phenotype resulting from the presence of a foreign polynucleotide molecule. The term "transgenic" refers to an animal, plant, or other organism containing one or more heterologous nucleic acid sequences.

There are many methods for introducing nucleic acids into plant cells. The method generally comprises the steps of selecting a suitable host cell, transforming the host cell with a recombinant vector, and obtaining the transformed host cell. Suitable methods include bacterial infection (e.g. *Agrobacterium*), binary bacterial artificial chromosome vectors, direct delivery of DNA (e.g. via PEG-mediated transformation, desiccation/inhibition-mediated DNA uptake, electroporation, agitation with silicon carbide fibers, and acceleration of DNA coated particles, etc. (reviewed in Potrykus, et al., *Ann. Rev. Plant Physiol. Plant Mol. Biol.*, 42: 205, 1991).

Technology for introduction of DNA into cells is well known to those of skill in the art. Methods and materials for transforming plant cells by introducing a plant polynucleotide construct into a plant genome in the practice of this invention can include any of the well-known and demonstrated methods including:

(1) chemical methods (Graham and Van der Eb, *Virology*, 54(2): 536-539, 1973; Zatloukal, et al., *Ann. N.Y. Acad. Sci.*, 660: 136-153, 1992);

(2) physical methods such as microinjection (Capecchi, *Cell*, 22(2): 479-488, 1980), electroporation (Wong and Neumann, *Biochim. Biophys. Res. Commun.*, 107(2): 584-587, 1982; Fromm et al., *Proc. Natl. Acad. Sci. USA*, 82(17): 5824-5828, 1985; U.S. Pat No. 5,384,253, herein incorporated by reference) particle acceleration (Johnston and Tang, *Methods Cell Biol.*, 43(A): 353-365, 1994; Fynan et al., *Proc. Natl. Acad. Sci. USA*, 90(24): 11478-11482, 1993) and microprojectile bombardment (as illustrated in U.S. Pat. No. 5,015,580; U.S. Pat. No. 5,550,318; U.S. Pat. No. 5,538,880; U.S. Pat. No. 6,160,208; U.S. Pat. No. 6,399,861; and U.S. Pat. No. 6,403,865, all of which are herein incorporated by reference);

(3) viral vectors (Clapp, *Clin. Perinatol.*, 20(1): 155-168, 1993; Lu, et al., *J. Exp. Med.*, 178(6): 2089-2096, 1993; Eglitis and Anderson, *Biotechniques*, 6(7): 608-614, 1988);

(4) receptor-mediated mechanisms (Curiel et al., *Hum. Gen. Ther.*, 3(2):147-154, 1992; Wagner, et al., *Proc. Natl. Acad. Sci. USA*, 89(13): 6099-6103, 1992), and (5) bacterial mediated mechanisms such as *Agrobacterium*-mediated transformation (as illustrated in U.S. Pat. No. 5,824,877; U.S. Pat. No. 5,591,616; U.S. Pat. No. 5,981,840; and U.S. Pat. No. 6,384,301, all of which are herein incorporated by reference);

(6) Nucleic acids can be directly introduced into pollen by directly injecting a plant's reproductive organs (Zhou, et al., *Methods in Enzymology*, 101: 433, 1983; Hess, *Intern Rev. Cytol.*, 107: 367, 1987; Luo, et al., *Plant Mol Biol. Reporter*, 6: 165, 1988; Pena, et al., *Nature*, 325: 274, 1987).

(7) Protoplast transformation, as illustrated in U.S. Pat. No. 5,508,184 (herein incorporated by reference).

(8) The nucleic acids may also be injected into immature embryos (Neuhaus, et al., *Theor. Appl. Genet.*, 75: 30, 1987).

Any of the above described methods may be utilized to transform a host cell with one or more gene regulatory elements of the present invention and one or more transcribable polynucleotide molecules. Host cells may be any cell or organism such as a plant cell, algae cell, algae, fungal cell, fungi, bacterial cell, or insect cell. Preferred hosts and transformants include cells from: plants, *Aspergillus*, yeasts, insects, bacteria and algae.

The prokaryotic transformed cell or organism is preferably a bacterial cell, even more preferably an *Agrobacterium*, *Bacillus*, *Escherichia*, *Pseudomonas* cell, and most preferably is an *Escherichia coli* cell. Alternatively, the transformed organism is preferably a yeast or fungal cell. The yeast cell is preferably a *Saccharomyces cerevisiae*, *Schizosaccharomyces pombe*, or *Pichia pastoris*. Methods to transform such cells or organisms are known in the art (EP 0238023; Yelton et al., *Proc. Natl. Acad. Sci. (U.S.A.)*, 81:1470-1474 (1984); Malardier et al., *Gene*, 78:147-156 (1989); Becker and Guarente, In: Abelson and Simon (eds.,), *Guide to Yeast Genetics and Molecular Biology, Methods Enzymol.*, Vol. 194, pp. 182-187, Academic Press, Inc., New York; Ito et al., *J. Bacteriology*, 153:163 (1983); Hinnen et al., *Proc. Natl. Acad. Sci. (U.S.A.)*, 75:1920 (1978); Bennett and LaSure (eds.), *More Gene Manipulations in Fungi*, Academic Press, CA (1991)). Methods to produce proteins of the present invention from such organisms are also known (Kudla et al., *EMBO*, 9:1355-1364 (1990); Jarai and Buxton, *Current Genetics*, 26:2238-2244 (1994); Verdier, *Yeast*, 6:271-297 (1990); MacKenzie et al., *Journal of Gen. Microbiol.*, 139: 2295-2307 (1993); Hartl et al., *TIBS*, 19:20-25 (1994); Bergeron et al., *TIBS*, 19:124-128 (1994); Demolder et al., *J. Biotechnology*, 32:179-189 (1994); Craig, *Science*, 260:

1902-1903 (1993); Gething and Sambrook, *Nature*, 355:33-45 (1992); Puig and Gilbert, *J. Biol. Chem.*, 269:7764-7771 (1994); Wang and Tsou, *FASEB Journal*, 7:1515-1517 (9193); Robinson et al., *Bio/Technology*, 1:381-384 (1994); Enderlin and Ogrydziak, *Yeast*, 10:67-79 (1994); Fuller et al., *Proc. Natl. Acad. Sci.* (*U.S.A.*), 86:1434-1438 (1989); Julius et al., *Cell*, 37:1075-1089 (1984); Julius et al, *Cell*, 32:839-852 (1983)).

Another preferred embodiment of the present invention is the transformation of a plant cell. A plant transformation construct comprising a regulatory element of the present invention may be introduced into plants by any plant transformation method.

Methods for transforming dicotyledons, primarily by use of *Agrobacterium tumefaciens* and obtaining transgenic plants have been published for cotton (U.S. Pat. No. 5,004,863; U.S. Pat. No. 5,159,135; U.S. Pat. No. 5,518,908, all of which are herein incorporated by reference); soybean (U.S. Pat. No. 5,569,834; U.S. Pat. No. 5,416,011, all of which are herein incorporated by reference; McCabe, et al., *Biotechnolgy*, 6: 923, 1988; Christou et al., *Plant Physiol.* 87:671-674 (1988)); *Brassica* (U.S. Pat. No. 5,463,174, herein incorporated by reference); peanut (Cheng et al., *Plant Cell Rep.* 15:653-657 (1996), McKently et al., *Plant Cell Rep.* 14:699-703 (1995)); papaya; and pea (Grant et al, *Plant Cell Rep.* 15:254-258 (1995)).

Transformation of monocotyledons using electroporation, particle bombardment and *Agrobacterium* have also been reported. Transformation and plant regeneration have been achieved in asparagus (Bytebier et al., *Proc. Natl. Acad. Sci.* (USA) 84:5354 (1987)); barley (Wan and Lemaux, *Plant Physiol* 104:37 (1994)); maize (Rhodes et al., *Science* 240: 204 (1988); Gordon-Kamm et al, *Plant Cell* 2:603-618 (1990); Fromm et al., *Bio/Technology* 8:833 (1990); Koziel et al., *Bio/Technology* 11:194 (1993); Armstrong et al., *Crop Science* 35:550-557 (1995)); oat (Somers et al., *Bio/Technology* 10:1589 (1992)); orchard grass (Horn et al., *Plant Cell Rep.* 7:469 (1988)); corn (Toriyama et al., *Theor Appl. Genet.* 205:34 (1986); Part et al., *Plant Mol. Biol.* 32:1135-1148 (1996); Abedinia et al., *Aust. J. Plant Physiol.* 24:133-141 (1997); Zhang and Wu, *Theor. Appl. Genet.* 76:835 (1988); Zhang et al., *Plant Cell Rep.* 7:379 (1988); Battraw and Hall, *Plant Sci.* 86:191-202 (1992); Christou et al., *Bio/Technology* 9:957 (1991)); rye (De la Pena et al., *Nature* 325:274 (1987)); sugarcane (Bower and Birch, *Plant J.* 2:409 (1992)); tall fescue (Wang et al., *Bio/Technology* 10:691 (1992)) and wheat (Vasil et al., *Bio/Technology* 10:667 (1992); U.S. Pat. No. 5,631,152, herein incorporated by reference).

The regeneration, development, and cultivation of plants from transformed plant protoplast or explants is well taught in the art (Weissbach and Weissbach, *Methods for Plant Molecular Biology*, (Eds.), Academic Press, Inc., San Diego, Calif., 1988; Horsch et al., *Science*, 227: 1229-1231, 1985). In this method, transformants are generally cultured in the presence of a selective media which selects for the successfully transformed cells and induces the regeneration of plant shoots (Fraley et al., *Proc. Natl. Acad. Sci. U.S.A.*, 80: 4803, 1983). These shoots are typically obtained within two to four months.

The shoots are then transferred to an appropriate root-inducing medium containing the selective agent and an antibiotic to prevent bacterial growth. Many of the shoots will develop roots. These are then transplanted to soil or other media to allow the continued development of roots. The method, as outlined, will generally vary depending on the particular plant strain employed.

The regenerated transgenic plants are self-pollinated to provide homozygous transgenic plants. Alternatively, pollen obtained from the regenerated transgenic plants may be crossed with non-transgenic plants, preferably inbred lines of agronomically important species. Conversely, pollen from non-transgenic plants may be used to pollinate the regenerated transgenic plants.

The transformed plants are analyzed for the presence of the genes of interest and the expression level and/or profile conferred by the regulatory elements of the present invention. Those of skill in the art are aware of the numerous methods available for the analysis of transformed plants. For example, methods for plant analysis include, but are not limited to Southern blots or northern blots, PCR-based approaches, biochemical analyses, phenotypic screening methods, field evaluations, and immunodiagnostic assays.

The seeds of the plants of this invention can be harvested from fertile transgenic plants and be used to grow progeny generations of transformed plants of this invention including hybrid plant lines comprising the construct of this invention and expressing a gene of agronomic interest. The present invention also provides for parts of the plants of the present invention. Plant parts, without limitation, include seed, endosperm, ovule and pollen. In a particularly preferred embodiment of the present invention, the plant part is a seed. The invention also includes and provides transformed plant cells which comprise a nucleic acid molecule of the present invention.

The transgenic plant may pass along the transformed nucleic acid sequence to its progeny. The transgenic plant is preferably homozygous for the transformed nucleic acid sequence and transmits that sequence to all of its offspring upon as a result of sexual reproduction. Progeny may be grown from seeds produced by the transgenic plant. These additional plants may then be self-pollinated to generate a true breeding line of plants. The progeny from these plants are evaluated, among other things, for gene expression. The gene expression may be detected by several common methods such as western blotting, northern blotting, immunoprecipitation, and ELISA.

Computer Related Uses of the Invention

A polynucleotide molecule comprising SEQ ID NO: 1 through SEQ ID NO: 14,151, complements thereof and fragments of either, or a polynucleotide molecule that hybridizes under stringent conditions with SEQ ID NO: 1 through SEQ ID NO: 14,151, or any complement thereof; or exhibits 85% or greater identity, and more preferably at least 86 or greater, 87 or greater, 88 or greater, 89 or greater, 90 or greater, 91 or greater, 92 or greater, 93 or greater, 94 or greater, 95 or greater, 96 or greater, 97 or greater, 98 or greater, or 99% or greater identity to SEQ ID NO: 1 through SEQ ID NO: 14,151; can be "provided" in a variety of mediums to facilitate its. Such a medium can also provide a subset thereof in a form that allows a skilled artisan to examine the sequences.

In a preferred embodiment, at least 20, 50, 100, 500, 1,000, 2,000, 3,000, or 4,000 of the nucleic acid sequences of the present invention are provided in a variety of mediums. In one application of this embodiment, a nucleotide sequence of the present invention can be recorded on computer readable media. As used herein, "computer readable media" refers to any medium that can be read and accessed directly by a computer. Such media include, but are not limited to: magnetic storage media, such as floppy discs, hard disc, storage medium, and magnetic tape: optical storage media such as CD-ROM; electrical storage media such as RAM and ROM; and hybrids of these categories such as magnetic/optical storage media. A skilled artisan can readily appreciate how any of the presently known computer readable mediums can be used to create a manufacture comprising computer readable medium having recorded thereon a nucleotide sequence of the present invention.

As used herein, "recorded" refers to a process for storing information on computer readable medium. A skilled artisan can readily adopt any of the presently known methods for recording information on computer readable medium to generate media comprising the nucleotide sequence information of the present invention. A variety of data storage structures are available to a skilled artisan for creating a computer readable medium having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable medium. The sequence information can be represented in a word processing text file, formatted in commercially-available software such as WordPerfect and Microsoft Word, or represented in the form of an ASCII file, stored in a database application, such as DB2, Sybase, Oracle, or the like. A skilled artisan can readily adapt any number of data processor structuring formats (e.g., text file or database) in order to obtain computer readable medium having recorded thereon the nucleotide sequence information of the present invention.

By providing one or more of nucleotide sequences of the present invention, a skilled artisan can routinely access the sequence information for a variety of purposes. Computer software is publicly available which allows a skilled artisan to access sequence information provided in a computer readable medium. The examples which follow demonstrate how software which implements the BLAST (Altschul et al., *J. Mol. Biol.* 215:403-410 (1990)) and BLAZE (Brutlag et al., *Comp. Chem.* 17:203-207 (1993)) search algorithms on a Sybase system can be used to identify open reading frames (ORFs) within the genome that contain homology to ORFs or proteins from other organisms. Such ORFs are protein-encoding fragments within the sequences of the present invention and are useful in producing commercially important proteins such as enzymes used in amino acid biosynthesis, metabolism, transcription, translation, RNA processing, nucleic acid and a protein degradation, protein modification, and DNA replication, restriction, modification, recombination, and repair.

The present invention further provides systems, particularly computer-based systems, which contain the sequence information described herein. Such systems are designed to identify commercially important fragments of the polynucleotide molecule of the present invention. As used herein, "a computer-based system" refers to the hardware means, software means, and data storage means used to analyze the nucleotide sequence information of the present invention. The minimum hardware means of the computer-based systems of the present invention comprises a central processing unit (CPU), input means, output means, and data storage means. A skilled artisan can readily appreciate that any one of the currently available computer-based system are suitable for use in the present invention.

As indicated above, the computer-based systems of the present invention comprise a data storage means having stored therein a nucleotide sequence of the present invention and the necessary hardware means and software means for supporting and implementing a search means. As used herein, "data storage means" refers to memory that can store nucleotide sequence information of the present invention, or a memory access means which can access manufactures having recorded thereon the nucleotide sequence information of the present invention. As used herein, "search means" refers to one or more programs which are implemented on the computer-based system to compare a target sequence or target structural motif with the sequence information stored within the data storage means. Search means are used to identify fragments or regions of the sequence of the present invention that match a particular target sequence or target motif. A variety of known algorithms are disclosed publicly and a variety of commercially available software for conducting search means are available and can be used in the computer-based systems of the present invention. Examples of such software include, but are not limited to, MacPattern (EMBL), BLASTN and BLASTX (NCBI). One of the available algorithms or implementing software packages for conducting homology searches can be adapted for use in the present computer-based systems.

As used herein, "a target structural motif," or "target motif," refers to any rationally selected sequence or combination of sequences in which the sequence(s) are chosen based on primary sequence composition or a three dimensional configuration which is formed upon folding of the target motif. There are a variety of target motifs known in the art. Target motifs include, but are not limited to, transcription factor binding sites, repressor binding sites, inducible expression elements, transcriptional activation sites, transcription initiation sites, untranslated leaders, intron splicing sites, methylation sites, histone binding sites, RNA processing sites, non-histone structural protein binding sites, replication sites, sites which influence the stability of transcribed mRNA message and hairpin sites.

Thus, the present invention further provides an input means for receiving a target sequence, a data storage means for storing the target sequences of the present invention sequence identified using a search means as described above, and an output means for outputting the identified homologous sequences. A variety of structural formats for the input and output means can be used to input and output information in the computer-based systems of the present invention. A preferred format for an output means ranks fragments of the sequence of the present invention by varying degrees of homology to the target sequence or target motif. Such presentation provides a skilled artisan with a ranking of sequences which contain various amounts of the target sequence or target motif and identifies the degree of homology contained in the identified fragment.

A variety of comparing means can be used to compare a target sequence or target motif with the data storage means to identify sequence fragments sequence of the present invention. For example, implementing software which implement the BLAST and BLAZE algorithms (Altschul et al., *J. Mol. Biol.* 215:403-410 (1990)) can be used to identify open frames within the polynucleotide molecules of the present invention. A skilled artisan can readily recognize that any one of the publicly available homology search programs can be used as the search means for the computer-based systems of the present invention.

Sequence Analysis

In the present invention, sequence similarity or identity is preferably determined using the "Best Fit" or "Gap" programs of the Sequence Analysis Software Package™ (Version 10; Genetics Computer Group, Inc., Center, Madison, Wis.). "Gap" utilizes the algorithm of Needleman and Wunsch (Needleman and Wunsch, *Journal of Molecular Biology* 48:443-453, 1970) to find the alignment of two sequences that maximizes the number of matches and minimizes the number of gaps. "BestFit" performs an optimal alignment of the best segment of similarity between two sequences. Optimal alignments are found by inserting gaps to maximize the number of matches using the local homology algorithm of Smith and Waterman (Smith, et al, In: *Genetic Engineering:Principles and Methods*, Setlow et al., Eds., Plenum Press, N.Y., 1-32, 1981; Smith and Waterman *Advances in Applied Mathematics*, 2:482-489, 1981).

The Sequence Analysis Software Package described above contains a number of other useful sequence analysis tools for identifying homologues of the presently disclosed nucleotide and amino acid sequences. For example, the "BLAST" program (Altschul, et al., *Journal of Molecular Biology* 215: 403-410, 1990) searches for sequences similar to a query sequence (either peptide or nucleic acid) in a specified database (e.g., sequence databases maintained at the National Center for Biotechnology Information (NCBI) in Bethesda, Md., USA); "FastA" (Lipman and Pearson, *Science*, 227: 1435-1441, 1985; see also Pearson and Lipman, *Proceedings of the National Academy of Sciences USA* 85, 2444-2448, 1988; Pearson, *Methods in Enzymology*, (R. Doolittle, ed.), 183, 63-98, Academic Press, San Diego, Calif., USA, 1990) performs a Pearson and Lipman search for similarity between a query sequence and a group of sequences of the same type (nucleic acid or protein); "TfastA" performs a Pearson and Lipman search for similarity between a protein query sequence and any group of nucleotide sequences (it translates the nucleotide sequences in all six reading frames before performing the comparison); "FastX" performs a Pearson and Lipman search for similarity between a nucleotide query sequence and a group of protein sequences, taking frameshifts into account. "TfastX" performs a Pearson and Lipman search for similarity between a protein query sequence and any group of nucleotide sequences, taking frameshifts into account (it translates both strands of the nucleic acid sequence before performing the comparison).

Having now generally described the invention, the same will be more readily understood through reference to the following examples which are provided by way of illustration, and are not intended to be limiting of the present invention, unless specified.

Each periodical, patent, and other document or reference cited herein is herein incorporated by reference in its entirety.

The following examples are included to demonstrate preferred embodiments of the invention. It should be appreciated by those of skill in the art that the techniques disclosed in the examples that follow represent techniques discovered by the inventors to function well in the practice of the invention. However, those of skill in the art should, in light of the present disclosure, appreciate that many changes can be made in the specific embodiments that are disclosed and still obtain a like or similar result without departing from the spirit and scope of the invention, therefore all matter set forth or shown in the accompanying drawings is to be interpreted as illustrative and not in a limiting sense.

EXAMPLES

EXAMPLES

Example 1

Assembly of the Sequence Data Set, Identification of Genes and Corresponding Promoters In order to identify putative promoter sequences, genomic DNA sequences for *Zea mays* were collected from both public domain datasets (AZM4) and in-house (ZMRR) sources. The coding regions (genes) were identified, and each corresponding promoter was located. Each of these promoter sequences were then analyzed for the presence of typical promoter motifs.

The parameters of the datasets were:

| AZM4 (Public Domain Dataset) | |
|---|---:|
| Format: | FASTA |
| Type (of 1st seq): | DNA |
| Number of sequences: | 243807 |
| Total # residues: | 297964415 |
| Smallest: | 101 |
| Largest: | 16340 |
| Average length: | 1222.1 |
| ZMRR (In-House Dataset) | |
| Format: | FASTA |
| Type (of 1st seq): | DNA |
| Number of sequences: | 119904 |
| Total # residues: | 85532730 |
| Smallest: | 60 |
| Largest: | 6587 |
| Average length: | 713.3 |

The in-house data set, ZMRR, contains sequences from *Zea mays* sequencing projects, which have been screened to reduce the repetition of recurrent identical sequences. These two datasets were combined to form an master input dataset for clustering and cross-assembly. Overlapping sequences were assembled together into "contigs" (longer, less redundant sequences), while the "singletons" (those sequences that did not sufficiently overlap with other sequences") were retained. The parameters of the final master input dataset were:

| Format: | FASTA |
|---|---:|
| Type (of 1st seq): | DNA |
| Number of sequences: | 363711 |
| Total # residues: | 383497145 |
| Smallest: | 60 |
| Largest: | 16340 |
| Average length: | 1054.4 |

The sequences from the master input dataset were used as input for clustering and assembly, as performed by the 64-bit version of the software program phrap, with the manyreads compilation ELF 64-bit MSB executable SPARCv9 Version 1. The standard parameter set was modified with the following supplied options:

minmatch 25
miniscore 50
retain_duplicates
old_ace which resulted in the following run parameters:

Pairwise comparison algorithm: banded Smith-Waterman
Score matrix (set by value of penalty: −2)

|   | A  | C  | G  | T  | N | X  |
|---|----|----|----|----|---|----|
| A | 1  | −2 | −2 | −2 | 0 | −3 |
| C | −2 | 1  | −2 | −2 | 0 | −3 |
| G | −2 | −2 | 1  | −2 | 0 | −3 |
| T | −2 | −2 | −2 | 1  | 0 | −3 |
| N | 0  | 0  | 0  | 0  | 0 | 0  |
| X | −3 | −3 | −3 | −3 | 0 | −3 |

Gap penalties:
    gap_init: −4
    gap_ext: −3
    ins_gap_ext: −3
    del_gap_ext: −3,
Using complexity-adjusted scores.
Assumed background frequencies:
A: 0.250 C: 0.250 G: 0.250 T: 0.250 N: 0.000 X: 0.000
minmatch: 25
maxmatch: 30
max_group_size: 20
minscore: 50
bandwidth: 14
indexwordsize: 10
vector_bound: 80
word_raw: 0
trim_penalty: −2
trim_score: 20
trim_qual: 13
maxgap: 30
repeat_stringency: 0.950000
qual_show: 20
confirm_length: 8
confirm_trim: 1
confirm_penalty: −5
confirm_score: 30
node_seg: 8
node_space: 4
forcelevel: 0
bypasslevel: 1
max_subclone_size: 5000

The resultant output statistics for the final sequence data set, henceforth referred to as the corn genomic sequences, were:

| Format:             | FASTA     |
|---------------------|-----------|
| Type (of 1st seg) : | DNA       |
| Number of sequences:| 131023    |
| Total # residues:   | 234110883 |
| Smallest:           | 60        |
| Largest:            | 43771     |
| Average length:     | 1786.8    |

These corn genomic sequences contained both actual coding regions (genes) and intergenic regions. In order to identify the protein-coding genes (both transcripts and coding regions), both homology-based approaches and model-based approaches were utilized.

Homology-based searches searched and aligned large genomic sequences containing introns with both public and proprietary protein and cDNA sequence databases. Existence of a *Zea mays* gene was inferred if significant sequence similarity extended over the majority of the target gene. For these homology-based approaches, the genomic sequence Analysis and Annotation Tool (AAT) from the National Center for Biological Information (NCBI) was utilized. The AAT package includes two sets of programs, one set DPS/NAP (referred to as "NAP") for comparing the query sequence with a protein database, and the other set DDS/GAP2 (referred to as "GAP2") for comparing the query sequence with a cDNA database. GAP2 and NAP are part of the Analysis and Annotation Tool (AAT) for Finding Genes in Genomic Sequences which was developed by Xiaoqiu Huang at Michigan Tech University and is available at the web site genome.cs.mtu-.edu/. Each set contained a FASTA database search program and a rigorous alignment program. The database search program identified regions of the query sequence that were similar to a database sequence. Then the alignment program constructed an optimal alignment for each region and the database sequence. The alignment program also reported the coordinates of exons in the query sequence. See Huang, et al., *Genomics* 46: 37-45 (1997). These tools allowed large intron gaps in the subject sequence. AAT alignment utilized the GT-AG dinucleotides signal to identify splicing sites and coding strand. Output of the tool included: exon coordinates in the query sequence, predicted peptide sequence (AAT/NAP) and spliced DNA sequence (AAT/GAP).

The first homology-based module, AAT/NAP, matched and aligned the *Zea mays* genomic sequences with a protein database, namely the NCBI non-redundant amino acid database nr.aa (maintained by the National Center for Biotechnology Information as part of GenBank, to identify potential coding regions on a genomic sequence, and to associate the annotation information of nr.aa sequences with the genomic sequence coding region. The NAP program computed a global alignment of a DNA sequence and a protein sequence without penalizing terminal gaps. NAP handled frameshifts and long introns in the DNA sequence. The program delivered the alignment in linear space, so long sequences could be aligned. It made use of splice site consensuses in alignment computation. Both strands of the DNA sequence were compared with the protein sequence and one of the two alignments with the larger score is reported. See Huang, and Zhang, *Computer Applications in the Biosciences* 12(6), 497-506 (1996). The fundamental algorithm behind NAP is that it takes a nucleotide sequence, translates it in three forward reading frames and three reverse complement reading frames, and then compares the six translations against a protein sequence database.

Utilization of the AAT/NAP algorithm included the following steps. (1) A subset of nr.aa (subdb) was constructed by NCBI BLASTX [BLASTX parameters: -v 100000 -b 1 -f 13 -a 4] search of query sequence vs. nr.aa, to narrow down the database size and speed up all following steps. For a description of BLASTX see Coulson, *Trends in Biotechnology* 12:76-80 (1994) and Birren et al., *Genome Analysis,* 1:543-559 (1997). (2) For each query sequence, high-scoring chains of segment pairs were created with the DPS program [DPS parameters: default parameters, BLOSUM62 matrix], between query DNA sequence and protein database (subdb) from the first step. (3) Results from this were summarized with the program EXT [EXT parameters: default]. (4) Summaries were further filtered with program parse_ext.pl, to filter out any chain that was longer than 15,000 bases, filter out any chain with score <=100, and also perform a non-redundancy filter (if two or more chains overlapped, kept only the one with the best score). (5) A global alignment of the query DNA sequence and matching protein sequence in nr.aa was done with program NAP [NAP parameters: default], for each high-scoring chain from step 4. Introns were allowed in the alignment, and the splice site consensus information (GT and AG) was used to identify RNA splice sites.

The second homology-based module, AAT/GAP2, matched and aligned the *Zea mays* genomic sequences with the Unigene *Zea mays* EST/cDNA database sequences. Annotation information of the Unigene was associated with the matching region of the genomic sequence. The *Zea mays* clusters were mapped onto an assembly of *Zea mays* contigs using the GAP2 program. The GAP2 program computed an optimal global alignment of a genomic sequence and a cDNA sequence without penalizing terminal gaps. A long gap in the cDNA sequence was given a constant penalty. The DNA-DNA alignment by GAP2 adjusted penalties to accommodate introns. The GAP2 program made use of splice site consensuses in alignment computation. GAP2 delivered the alignment in linear space, so long sequences could be aligned. See Huang, *Computer Applications in the Biosciences* 10 227-235 (1994). The GAP2 program aligned the *Zea mays* contigs with a library (Unigene database) of 42,260 *Zea mays* cDNAs.

Utilization of the AAT/GAP2 program included the following steps. (1) For each query sequence, high-scoring chains of segment pairs were created with the DDS program [DDS parameters: default except percent identity is 95% or greater (-p 95)], between query DNA sequence and a Unigene database of the same organism (*Zea mays*). (2) Results were summarized with program EXT [EXT parameters: default]. (3) Summaries are further filtered with program parse_ext.pl to filter out any chain that is longer than 15,000 bases, filter out any chain with score <=100, and also perform a non-redundancy filter (if two or more chains overlapped, kept only the one with the best score). (4) A global alignment of the query DNA sequence and matching Unigene sequence was done with the program GAP2 [GAP2 parameters: default except that the mismatch penalty was set to 6 (instead of 2 as default), while the match penalty remained at the default of 2. This reduced the mis-extension of the matching segment, for each high-scoring chain from step 3]. Introns were allowed in the alignment, and the splice site consensus information (GT and AG) was used to identify RNA splice sites, as well as the coding strand.

When a particular *Zea mays* cDNA aligned to more than one *Zea mays* contig, the alignment with the highest identity was selected and alignments with lower levels of identity are filtered out as surreptitious alignments. *Zea mays* cDNA sequences aligning to *Zea mays* contigs with exceptionally low complexity were filtered out when the basis for alignment included a high number of cDNAs with poly A tails aligning to genomic regions with extended repeats of A or T.

Since homology-based methods may overlook genes unique to *Zea mays*, for which homologous polynucleotide molecules have not yet been identified in databases, gene prediction programs were also used. For model-based approaches, the ab initio gene structure prediction programs FgeneSH and GmHMM were used.

FgeneSH is the Hidden Markov Model based gene-finding program with the algorithm similar to Genie (Kulp et al, 1996) and Genscan (Burge and Karlin, 1997). The difference of FgeneSH from the analogous programs is that in the model of gene structure a signal terms (such as splice site or start site score) have some advantage over content terms (such as coding potentials), reflecting a biological significance of the signals. It means in loglikelihood terms that in the model, splice sites and start site have an additional score, depending from the environments of the sites, but not from conserved nucleotides. At the same time in computing the coding scores of potential exons, a priori probabilities of exons were taken into account according to Bayes theorem. As a result, the coding scores of potential exons are generally lower than in Genscan. Output of FgeneSH includes: one or more of these gene structure features with loglikelihood scores, strand, coordinates on the genomic sequence: transcription start (TATA box), initial, internal and terminal exons, and polyA site; Open Reading Frame (ORF) within each exon, and predicted peptide sequence. The monocots gene model was used for FgeneSH.

GeneMark.hmm searches a file containing DNA sequence data for genes. For Genemark.hmm, a model trained on *Zea mays* genes was used. The GeneMark family of programs relies on inhomogenous Markov chain models of coding and noncoding regions, based on analysis of known genes and on the Bayes decision making function. The GeneMark.hmm algorithm generates a maximum-likelihood parse of the DNA sequence into coding and non-coding regions, and is designed to precisely locate the exact gene boundaries. Output of GeneMark.hmm includes: one or more of these gene structure features with strand, coordinates on the genomic sequence: initial, internal and terminal exons; Predicted peptide sequence. The *Zea mays* gene model was used for the gene identification and gene structure prediction of the maize genomic sequences. For more information, see Lukashin A. and Borodovsky M., *GeneMark.hmm: new solutions for gene finding, NAR,* 1998, Vol. 26, No. 4, pp. 1107-1115.

The results of both the homology-based and model-based gene finding efforts were consolidated into a relational database in such a way that each predicted, putative gene (henceforth referred to simply as a "gene") was represented by a set of coordinates that defined the position of all segments of the gene on the gDNA contig. The genes had the following types of segments: peptide-encoding segments (initial exon, internal exon, terminal exon, single exon—in the case of single-exon gene) and non-coding segments (transcription start site, polyA signal site). Often the same position on a gDNA contig was predicted to contain a gene by more than one gene finding program. These programs often disagreed on the position of the putative translation start site of the gene. To address this problem, a custom bioinformatics process was developed and used to validate each predicted translation start and consolidate them so that each gDNA locus corresponding to a gene contained a single validated translation start site. An Auto Gene Validation program was developed to accept only the start and stop codons with the most supporting evidence and the least contrary evidence.

The Auto Gene Validation program reads in detailed raw alignments from four sources, comprising both genomic sequences and gene model sequences:

1. BLAST alignment with cross species EST
2. GAP alignment with same species EST
3. BLAST alignment with cross species NRAA
4. BLAST alignment with cross species genomic DNA The output alignments were processed with two separate algorithms, the Boundary Effect Remover and the Boundary Sharper functions, Boundary Effect Remover is an algorithm that was developed in-house to remove the low-confident HSP ends with too many inserts, deletions and mis-matches in processing BLAST alignment. This algorithm allows only 3 consecutive inserts, deletions or mis-matches at the beginning or end of a BLAST alignment. The alignment segment will be removed if it does not meet this requirement. Boundary Sharper function is another algorithm developed in-house that further sharpens BLAST HSP ends with confident splice sites when there is a same species EST match available. The same species EST match is obtained from GAP alignment. This algorithm uses the predicted splice sites by GAP as the start and end of BLAST alignment, any BLAST alignment passes this boundary is removed to ensure the quality of BLAST alignment.

When applied to the *Zea mays* reduced rep sequence set, the Gene Auto Validator program found 35,339 gene starts (which does contain redundant data sets, as one real gene may have several gene models that were predicted).

Upon identification of the actual genes and determination of each gene's translation start site, the corresponding promoter sites were then ascertained. The putative promoters were described as regions of genomic DNA immediately upstream of the putative genes. These sequences were prepared as putative promoter regions of the genes which started with a validated translation start. The procedure for promoter identification proceeded as follows. (1) the first nucleotide (A) of each validated translation start (ATG) was used as the reference point for promoter sequence extraction. The sequence of the gDNA contig which started 1500 nucleotides upstream and ended 2 nucleotides downstream of this reference point was attempted to be extracted. (2) The resulting sequence of the upstream region was shorter if the translation start was located closer than 1500 nucleotides to the upstream end of the contig. If there was another gene located upstream and predicted by one of these methods (FgeneSH or AAT/NAP), the upstream region was shortened (truncated) so that it did not overlap with the closest peptide-encoding segment of that gene. If the resulting sequence was shorter than 50 nucloetides, it was not included in the library. (3) If the extracted sequence overlapped with the 5' portion of an AAT/GAP-predicted gene, the region of the overlap was reported as 5' UTR.

There were total of 13,303 maize gDNA contigs with at least one validated gene locus. The total number of validated gene loci was 14,781. The total number of putative promoter sequences that were extracted according to the procedure above was 14,151. The average length of the sequences was 765 nucleotides.

Using the example described herein, the present invention thus provides a method for assembling a data set of DNA sequences, locating genes therein, and identifying the promoter sequence that correspond to each gene. For the *Zea mays* data set, 14,151 promoter sequences were identified.

Example 2

Analysis of Known Promoter Motifs

Each putative promoter sequence was analyzed for the presence of common promoter sequence characteristics, such as a TATA-box and other known transcription factor binding site motifs. These motifs are not always found in every known promoter, nor are they necessary for promoter function, but when present, do indicate that a segment of DNA is a promoter sequence.

For identification of the TATA-box, the putative corn promoter sequences immediately upstream of the coding start site of the predicted genes within a given sequence size range, as described above, were used. The transcription start site and TATA-box (if present) were predicted with program TSSP. TSSP is designed for predicting PolII promoter regions in plants, and is based on the discriminate analysis combing characteristics of functional elements of regulatory sequence with the regulatory motifs from Softberry Inc.'s plant RegSite database (Solovyev V. V. (2001) *Statistical approaches in Eukaryotic gene prediction*. In: Handbook of Statistical genetics (eds. Balding D. et al.), John Wiley & Sons, Ltd., p. 83-127). Of the 14,151 putative promoter sequences, 6898 TATA-box locations were predicted in 5670 sequences. In the cases that multiple TATA-boxes were predicted, only the rightmost (closest to the 5' end) TATA-box was kept. The transcription start sites (TSS) were refined and extended upstream, based on the matches to the corn unigene sequences. Predicted TATA-boxes were filtered out, if it was downstream of the unigene-matched TSS. After the filtering, 4,894 promoter sequences were predicted with unique TATA-box, and the TATA-box locations were identified within the promoter sequences.

For identification of other known transcription factor binding motifs (such as a GC-box, CAAT-box, etc.), the putative corn promoter sequences immediately upstream of the coding start site of the predicted genes within a given sequence size range, as described above, were used. The known transcription factor binding motifs (except TATA-box) on the promoter sequences were predicted with a proprietary program PromoterScan. The identification of such motifs provided important information about the candidate promoter. For example, some motifs are associated with informative annotations such as (but not limited to) "light inducible binding site" or "stress inducible binding motif" and can be used to select with confidence a promoter that is able to confer light inducibility or stress inducibility to an operably-linked transgene, respectively.

Putative promoter sequences were also searched with matcoms for the GC box (factor name: V_GC_01) and CCAAT box (factor name: F_HAP234_01). The matcoms for the GC box and the CCAAT box are from Transfac. The algorithm that was used to annotate promoters searched for matches to both sequence motifs and matrix motifs. First, individual matches were found. For sequence motifs, a maximum number of mismatches were allowed. If the code M,R,W,S,Y, or K are listed in the sequence motif (each of which is a degenerate code for 2 nucleotides) 1/2 mismatch was allowed. If the code B, D, H, or V are listed in the sequence motif (each of which is a degenerate code for 3 nucleotides) 1/3 mismatch was allowed. Appropriate p values were determined by simulation by generation of a 5 Mb length of random DNA with the same dinucleotide frequency as the test set, and from this test set the probability of a given matrix score was determined (number of hits/5e7). Once the individual hits were found, the putative promoter sequence was searched for clusters of hits in a 250 bp window. The score for a cluster was found by summing the negative natural log of the p value for each individual hit. Using simulations with 100 Mb lengths, the probability of a window having a cluster score greater than or equal to the given value was determined. Clusters with a p value more significant than p<1 e-6 were reported. Only the top 287 hits were taken and ranked by p value. Effects of repetitive elements were screened. If the 287th ranked hit had the same p value as the first ranked hit, no results were reported for that factor. For matrix motifs, a p value cutoff was used on a matrix score. The matrix score was determined by adding the path of a given DNA sequence through a matrix. Appropriate p values were determined by simulation: 5 Mb lengths of random DNA with the same dinucleotide frequency as a test set were generated to test individual matrix hits, and 100 Mb lengths were used to test clusters. The probability of a given matrix score and the probability scores for clusters were determined, as were the sequence motifs. The usual cutoff for matcoms was 2.5e-4. No clustering was done for the GC box or CAAT box. After screening, 6789 motif clusters were found, with 3705 individual promoter sequences containing at least one transcription factor binding site motif.

Using the example described herein, the present invention thus provides a method for screening putative promoter sequences for any one of a number of known promoter functional motifs.

Example 3

PCR Amplification of Promoter Sequences and Cloning Into Vectors

The promoters in SEQ ID NO: 1 through SEQ ID NO: 14,151 may be amplified by PCR from corn genomic DNA and cloned into an expression vector containing a reporter transgene (e.g., GUS or GFP). Primers for PCR amplification can be designed at or near the start and stop codons of the coding sequence, in order to eliminate most of the 5' and 3' untranslated regions. For GATEWAY cloning methods, PCR products are tailed with attB1 and attB2 sequences, purified then recombined into a destination vector to produce an expression vector for use in transformation.

The individual promoter or a collection of promoters ("promoter library") may then be screened in an expression assay for the ability to express the reporter transgene. In a common expression assay for leaf promoters, the promoters are transfected into corn or maize leaf protoplasts. Reporter gene expression in the protoplasts indicates a promoter capable of conferring gene-expression in the leaf. The promoters are also transfected into protoplasts from other tissues or plant species to identify other regulatory features of the promoter.

Alternatively, promoters may be screened using a particle gun technique to bombard the cells, tissues or plants. The bombarded samples are visually inspected for reporter gene expression. Reporter gene expression observed in any bombarded samples indicates the presence of a promoter able to confer expression of a transgene in that cell, tissue or plant.

The promoters may also be screened in plants where transformation protocols have been greatly enhanced to facilitate the screening of large numbers of promoters. In this approach, the individual corn promoters or "promoter library" is transformed into Arabidopsis plants. The resulting transformed tissues or progeny are scored for reporter expression. Again, reporter gene expression in a given tissue indicates that a promoter is able to confer transgene expression in that tissue.

For some promoters, such as those providing constitutive expression, a reporter transgene can be replaced with a selectable marker transgene, such as a gene conferring glyphosate tolerance. Transformed cells, tissues or plants expressing the selectable marker are selected, rather than visually scored. For example, the promoter is linked to a selectable marker, such as glyphosate resistance, and then screening for male sterile plants. The selected plants, in this case male sterile plants, may contain a promoter for male reproductive tissues.

The promoters described herein can also be used to ablate or kill cells expressing a gene from the promoter. In such cases, the promoter is operably linked to a negative selectable marker gene, including but not limited to the diphtheria toxin gene, or to a conditional lethal gene, including but not limited to the phosphonate ester hydrolase gene (pehA). The negative selectable marker gene is transformed into cells, tissues or plants. The cells, tissues or plants which express the negative selectable gene from the promoter are selectively killed. In the case of the conditional lethal gene, the transformed cells, tissues or plants which express the conditional lethal gene are only killed in the presence of the negative selective agent or negative selective condition. In the example of the phosphonate ester hydrolase gene, the transformed cells, tissues or plants which express the conditional lethal gene are only killed in the presence of glyceryl glyphosate.

Example 4

Plant Transformation and GUS Analysis

Corn plants may be transformed with plant expression constructs comprising a promoter of the present invention operably linked to a reporter gene such as GUS, for histochemical analysis in plants. Plants are transformed using methods known to those skilled in the art. Particle bombardment of corn H99 immature zygotic embryos may be used to produce transgenic maize plants. Ears of maize H99 plants are collected 10-13 days after pollination from greenhouse grown plants and sterilized. Immature zygotic embryos of 1.2-1.5 mm are excised from the ear and incubated at 28° C. in the dark for 3-5 days before use as target tissue for bombardment. DNA comprising an isolated expression cassette containing the selectable marker for kanamycin resistance (NPTII gene) and the screenable marker for β-D-Glucuronidase (GUS gene) is gel purified and used to coat 0.6 micron gold particles (Catalog #165-2262 BIO-RAD, Hercules, Calif.) for bombardment. Macro-carriers are loaded with the DNA-coated gold particles (Catalog #165-2335 BIO-RAD, Hercules Calif.). The embryos are transferred onto osmotic medium scutellum side up. A PDS 1000/He biolistic gun is used for transformation (Catalog #165-2257 BIO-RAD, Hercules Calif.). Bombarded immature embryos are cultured and transgenic calli are selected and transferred to shoot formation medium. Transgenic corn plants are regenerated from the transgenic calli and transferred to the greenhouse.

GUS activity is qualitatively and quantitatively measured using methods known to those skilled in the art. Plant tissue samples are collected from the same tissue for both the qualitative and quantitative assays. For qualitative analysis, whole tissue sections are incubated with the GUS staining solution X-Gluc (5-bromo-4-chloro-3-indolyl-β-glucuronide) (1 milligram/milliliter) for an appropriate length of time, rinsed, and visually inspected for blue coloration. For quantitative analysis, total protein is first extracted from each tissue sample. One microgram of total protein is used with the fluorogenic substrate 4-methyleumbelliferyl-β-D- glucuronide (MUG) in a total reaction volume of 50 μl (microliters). The reaction product 4- methlyumbelliferone (4-MU) is maximally fluorescent at high pH, where the hydroxyl group is ionized. Addition of a basic solution of sodium carbonate simultaneously stops the assay and adjusts the pH for quantifying the fluorescent product. Fluorescence is measured with excitation at 365 nm, emission at 445 nm using a FLUO-ROMAX-3 with MICROMAX Reader, with slit width set at excitation 2 nm and emission 3 nm. The GUS activity is expressed as pmole of 4-MU/micrograms of protein/hour (pMole of 4-MU/μg protein/hour).

Example 5

Identification of Promoter Expression Patterns Using Transcriptional Profiling (TxP)

Corn reduced rep genomic data was assembled and putative proteins were predicted using the FGenesh program. Virtual coding sequences corresponding to predicted proteins were extracted and sequence upstream of the start site for each predicted gene was defined as promoter. To map the promoter sequences to microarray elements (ROSETTA and AFFYMETRIX), the corresponding virtual coding sequences were compared by BLAST (>97% identity over >99 nt) to Monsanto proprietary sequences to identify more full length coding sequences and the microarray elements previously mapped to these full length sequences were considered as associated with the promoter sequence of interest.

Tissue-Specific and Constitutive Promoter Expression Patterns

Eight tissue-specific categories were identified (embryo, endosperm, internode, kernel, leaf, pollen, root and silk) as well as two constitutive expression pattern categories (high constitutive expression, low constitutive expression). Specificity was determined when a particular promoter scored >1200 in the ROSETTA analysis in at least one of the representative tissues and <700 in either one of two criteria: one representative of all other tissue categories or two representatives of all other tissue categories. Tissues selected as the negative control ("background" expression) were not the same as either of these two criteria categories, and were arbitrarily selected. The constitutive and tissue-specific promoters that were identified include the following.

Embryo-specific promoters include SEQ IDs: 31, 90, 100, 126, 144, 148, 156, 157, 159, 175, 191, 203, 294, 320, 323, 337, 358, 441, 458, 466, 479, 482, 501, 502, 504, 505, 514, 555, 556, 605, 611, 647, 661, 664, 665, 670, 733, 742, 812, 824, 825, 826, 841, 846, 891, 907, 908, 920, 947, 1003, 1017, 1033, 1038, 1097, 1111, 1148, 1180, 1205, 1227, 1257, 1272, 1312, 1325, 1402, 1405, 1410, 1412, 1437, 1440, 1443, 1444, 1472, 1485, 1486, 1489, 1503, 1530, 1585, 1586, 1648, 1650, 1688, 1723, 1774, 1793, 1814, 1867, 1873, 1880, 1893, 1904, 1913, 1944, 1979, 1981, 2026, 2040, 2099, 2107, 2133, 2141, 2158, 2214, 2216, 2221, 2296, 2306, 2313, 2342, 2348, 2431, 2432, 2436, 2510, 2514, 2537, 2545, 2568, 2576, 2605, 2656, 2661, 2662, 2666, 2692, 2721, 2726, 2745, 2758, 2783, 2901, 2911, 2914, 2951, 2962, 3005, 3080, 3139, 3187, 3246, 3283, 3346, 3359, 3360, 3415, 3419, 3426, 3457, 3465, 3612, 3690, 3693, 3719, 3771, 3796, 3817, 3845, 3847, 3860, 3884, 3890, 3897, 3903, 3907, 3931, 3951, 3994, 3998, 4014, 4021, 4058, 4095, 4150, 4151, 4194, 4216, 4240, 4241, 4266, 4278, 4281, 4282, 4303, 4335, 4336, 4338, 4392, 4477, 4555, 4591, 4697, 4764, 4780, 4789, 4796, 4803, 4830, 4831, 4888, 4897, 4926, 4930, 4944, 4983, 4996, 5021, 5068, 5069, 5075, 5087, 5106, 5131, 5143, 5149, 5153, 5171, 5172, 5251, 5252, 5255, 5267, 5289, 5302, 5331, 5349, 5450, 5512, 5531, 5602, 5615, 5620, 5680, 5681, 5720, 5771, 5807, 5814, 5815, 5817, 5828, 5833, 5839, 5875, 5876, 5892, 5919, 5980, 6053, 6131, 6138, 6176, 6228, 6248, 6310, 6314, 6359, 6412, 6435, 6468, 6493, 6544, 6545, 6574, 6581, 6588, 6637, 6677, 6714, 6760, 6786, 6793, 6829, 6837, 6865, 6897, 7003, 7051, 7052, 7072, 7073, 7075, 7135, 7192, 7243, 7340, 7360, 7379, 7382, 7410, 7498, 7504, 7524, 7534, 7572, 7587, 7591, 7598, 7607, 7618, 7664, 7674, 7740, 7767, 7777, 7778, 7782, 7783, 7792, 7818, 7849, 7850, 7909, 7917, 7921, 7929, 7949, 7983, 7989, 7990, 7991, 8008, 8029, 8039, 8075, 8079, 8095, 8099, 8121, 8134, 8148, 8176, 8195, 8210, 8257, 8258, 8363, 8407, 8413, 8423, 8435, 8470, 8535, 8537, 8538, 8604, 8613, 8635, 8641, 8660, 8743, 8761, 8803, 8822, 8829, 8839, 8854, 8935, 8956, 9015, 9114, 9167, 9168, 9183, 9187, 9214, 9255, 9263, 9276, 9285, 9293, 9299, 9373, 9393, 9443, 9466, 9475, 9522, 9555, 9577, 9589, 9614, 9624, 9674, 9677, 9699, 9706, 9793, 9808, 9810, 9814, 9829, 9845, 9850, 9851, 10077, 10127, 10136, 10231, 10389, 10426, 10440, 10478, 10482, 10497, 10515, 10524, 10640, 10641, 10665, 10687, 10698, 10727, 10776, 10798, 10832, 10872, 10905, 10978, 10979, 10981, 11052, 11053, 11102, 11103, 11145, 11159, 11305, 11364, 11379, 11389, 11392, 11418, 11501, 11516, 11520, 11651, 11682, 11683, 11707, 11753, 11756, 11786, 11828, 11876, 11879, 11903, 11955, 12054, 12060, 12066, 12162, 12220, 12233, 12254, 12296, 12299, 12350, 12369, 12393, 12420, 12441, 12445, 12446, 12454, 12461, 12479, 12480, 12497, 12548, 12578, 12616, 12650, 12685, 12710, 12760, 12782, 12793, 12807, 12849, 12873, 12928, 12956, 12958, 13001, 13031, 13035, 13212, 13250, 13264, 13265, 13304, 13337, 13380, 13395, 13407, 13418, 13441, 13464, 13489, 13491, 13505, 13601, 13639, 13696, 13755, 13766, 13768, 13788, 13859, 13918, 13932, 14001, 14027, 14036, 14049, 14076, 14080, 14087.

Endosperm-specific promoters include SEQ IDs: 31, 156, 157, 159, 175, 203, 236, 294, 320, 358, 466, 482, 488, 493, 501, 514, 537, 556, 585, 611, 629, 661, 664, 665, 701, 742, 841, 846, 855, 891, 920, 947, 948, 974, 1017, 1033, 1046, 1096, 1097, 1122, 1167, 1180, 1205, 1257, 1272, 1312, 1405, 1410, 1412, 1440, 1443, 1444, 1506, 1525, 1526, 1530, 1539, 1585, 1586, 1688, 1771, 1774, 1808, 1851, 1873, 1895, 1939, 1952, 1964, 1981, 2026, 2071, 2087, 2119, 2133, 2201, 2216, 2242, 2265, 2306, 2313, 2361, 2362, 2431, 2432, 2436, 2456, 2483, 2519, 2568, 2656, 2721, 2726, 2745, 2758, 2869, 2901, 3006, 3047, 3097, 3118, 3139, 3169, 3171, 3173, 3228, 3246, 3253, 3283, 3310, 3325, 3347, 3359, 3360, 3405, 3415, 3497, 3498, 3585, 3588, 3719, 3751, 3756, 3771, 3796, 3847, 3852, 3860, 3896, 3931, 3987, 3988, 3998, 4014, 4021, 4057, 4150, 4194, 4218, 4255, 4266, 4278, 4281, 4282, 4303, 4335, 4355, 4357, 4477, 4515, 4591, 4697, 4723, 4764, 4814, 4827, 4897, 4944, 4956, 4983, 5007, 5021, 5027, 5068, 5069, 5106, 5143, 5163, 5244, 5245, 5251, 5255, 5334, 5349, 5398, 5418, 5512, 5531, 5602, 5611, 5680, 5720, 5807, 5817, 5828, 5833, 5839, 5892, 5919, 5936, 6025, 6026, 6186, 6310, 6359, 6412, 6435, 6468, 6574, 6581, 6594, 6603, 6748, 6760, 6767, 6783, 6803, 6829, 6837, 6865, 7033, 7069, 7072, 7073, 7074, 7075, 7137, 7243, 7340, 7345, 7379, 7415, 7427, 7443, 7444, 7487, 7504, 7534, 7664, 7713, 7727, 7777, 7778, 7782, 7783, 7853, 7870, 7909, 7921, 7929, 7960, 7983, 7989, 7990, 7991, 8008, 8029, 8075, 8095, 8121, 8148, 8176, 8184, 8187, 8188, 8340, 8363, 8435, 8447, 8499, 8509, 8535, 8537, 8538, 8543, 8613, 8803, 8821, 8830, 8839, 8956, 9015, 9023, 9044, 9080, 9111, 9128, 9167, 9168, 9231, 9255, 9263, 9285, 9292, 9293, 9373, 9393, 9466, 9470, 9534, 9555, 9577, 9677, 9706, 9793, 9808, 9810, 9814, 9851, 9887, 10077, 10110, 10119, 10127, 10136, 10178, 10324, 10330, 10388, 10389, 10400, 10408, 10414, 10478, 10497, 10524, 10561, 10641, 10687, 10698, 10723, 10727, 10798, 10832, 10845, 10905, 10941, 10981, 11016, 11018, 11044, 11061, 11072, 11102, 11103, 11126, 11145, 11175, 11294, 11308, 11381, 11389, 11392, 11418, 11516, 11520, 11576, 11682, 11683, 11684, 11725, 11828, 11868, 11876, 11879, 11903, 11908, 11955, 11998, 12047, 12054, 12060, 12066, 12136, 12162, 12200, 12201, 12233, 12254, 12296, 12358, 12369, 12393, 12424, 12426, 12445, 12446, 12473, 12490, 12494, 12495, 12578, 12616, 12695, 12708, 12710, 12760, 12790, 12793, 12860, 12956, 12957, 12958, 13001, 13013, 13031, 13035, 13102, 13227, 13304, 13380, 13395, 13441, 13444, 13489, 13524, 13677, 13696, 13755, 13763, 13788, 13930, 13974, 14001, 14036, 14104.

Internode-specific promoters include SEQ IDs: 8, 237, 614, 1162, 1356, 1411, 2622, 2737, 3141, 3369, 3432, 3541, 3599, 4179, 4464, 4728, 4802, 4815, 5292, 5565, 5584, 5754, 5764, 6239, 6339, 6902, 6925, 7224, 7943, 7953, 8000, 8069, 8407, 8964, 8965, 9026, 9027, 9520, 10741, 10858, 11596, 11838, 11899, 12128, 12164, 12292, 12726, 13144, 13450.

Kernel-specific promoters include SEQ IDs: 72, 237, 339, 340, 614, 760, 761, 762, 1191, 1536, 2119, 2446, 2534, 2622, 2679, 3373, 3376, 3893, 4095, 4111, 4215, 4269, 4464, 4766, 4963, 5290, 5482, 5557, 5764, 6184, 6902, 7096, 7375, 7385, 7494, 8407, 8432, 8546, 8893, 9560, 9602, 9808, 9932, 10016, 10150, 10524, 10913, 10949, 11186, 11300, 11899, 11911, 12130, 12186, 12189, 12764, 13279, 13402, 13930, 14005, 14006.

Leaf-specific promoters include SEQ IDs: 8, 11, 24, 53, 93, 97, 115, 133, 144, 160, 168, 211, 214, 230, 269, 270, 271, 280, 319, 342, 348, 376, 434, 484, 520, 741, 763, 794, 808, 855, 889, 925, 977, 1039, 1091, 1106, 1218, 1234, 1235, 1239, 1243, 1356, 1386, 1458, 1527, 1534, 1540, 1547, 1582, 1622, 1639, 1772, 1837, 1850, 1868, 1910, 1927, 1991, 2014, 2015, 2023, 2027, 2049, 2096, 2113, 2115, 2172, 2201, 2213, 2237, 2259, 2321, 2325, 2346, 2352, 2354, 2482, 2491, 2497, 2507, 2560, 2587, 2651, 2659, 2680, 2737, 2786, 2814, 2826, 2843, 2845, 2854, 2855, 2859, 2879, 2892, 2893, 2897, 2938, 2948, 2969, 3113, 3141, 3157, 3158, 3199, 3286, 3288, 3307, 3327, 3411, 3412, 3429, 3432, 3440, 3458, 3503, 3504, 3556, 3557, 3571, 3591, 3643, 3669, 3671, 3673, 3698, 3790, 3858, 3899, 3923, 3926, 3937, 3959, 3969, 3974, 3991, 4044, 4099, 4111, 4198, 4200, 4247, 4333, 4457, 4467, 4487, 4513, 4549, 4684, 4688, 4690, 4713, 4722, 4725, 4729, 4748, 4820, 4836, 4837, 4854, 4867, 4931, 4955, 4968, 5049, 5136, 5137, 5144, 5157, 5175, 5177, 5178, 5182, 5219, 5230, 5341, 5446, 5475, 5481, 5497, 5558, 5647, 5657, 5670, 5671, 5677, 5700, 5711, 5712, 5713, 5728, 5764, 5852, 5858, 5869, 5956, 5984, 5992, 6031, 6038, 6044, 6082, 6096, 6135, 6149, 6155, 6171, 6173, 6182, 6188, 6221, 6247, 6272, 6273, 6339, 6365, 6387, 6404, 6448, 6452, 6458, 6486, 6497, 6523, 6570, 6605, 6614, 6730, 6740, 6741, 6787, 6791, 6817, 6845, 6847, 6850, 6930, 6959, 7019, 7020, 7025, 7032, 7033, 7050, 7140, 7215, 7269, 7275, 7281, 7401, 7453, 7465, 7479, 7502, 7545, 7549, 7589, 7632, 7634, 7672, 7747, 7750, 7786, 7840, 7873, 7901, 7911, 7943, 7950, 7953, 7965, 7966, 7967, 7971, 7979, 8049, 8078, 8169, 8196, 8244, 8275, 8288, 8297, 8334, 8335, 8354, 8382, 8429, 8433, 8435, 8478, 8557, 8588, 8593, 8714, 8715, 8719, 8721, 8769, 8782, 8841, 8842, 8862, 8901, 8928, 9014, 9016, 9017, 9025, 9138, 9217, 9276, 9282, 9283, 9291, 9310, 9349, 9389, 9521, 9560, 9568, 9586, 9590, 9628, 9630, 9638, 9668, 9695, 9708, 9727, 9738, 9772, 9809, 9813, 9888, 9894, 9898, 9974, 10007, 10086, 10087, 10135, 10169, 10207, 10300, 10307, 10329, 10336, 10345, 10365, 10382, 10410, 10411, 10427, 10451, 10501, 10571, 10584, 10593, 10597, 10605, 10664, 10669, 10702, 10740, 10754, 10774, 10780, 10856, 10857, 10863, 10869, 11015, 11072, 11108, 11119, 11123, 11133, 11150, 11152, 11230, 11237, 11254, 11255, 11307, 11328, 11374, 11411, 11412, 11413, 11414, 11448, 11473, 11487, 11522, 11538, 11550, 11624, 11655, 11710, 11738, 11822, 11847, 11860, 11876, 11895, 12073, 12114, 12127, 12148, 12192, 12198, 12228, 12245, 12292, 12305, 12340, 12343, 12344, 12383, 12394, 12399, 12418, 12428, 12429, 12454, 12475, 12476, 12482, 12515, 12628, 12645, 12830, 12931, 13063, 13069, 13070, 13077, 13144, 13156, 13167, 13212, 13213, 13239, 13273, 13295, 13298, 13319, 13344, 13349, 13414, 13420, 13424, 13444, 13446, 13460, 13510, 13556, 13565, 13566, 13629, 13689, 13712, 13720, 13738, 13786, 13787, 13795, 13802, 13907, 13915, 13923, 13957, 13960, 13994, 14003, 14016, 14081, 14095, 14102, 14110.

Pollen-specific promoters include SEQ IDs:5, 92, 134, 139, 211, 249, 343, 344, 363, 386, 418, 468, 485, 562, 611, 634, 666, 739, 784, 866, 869, 923, 962, 966, 1089, 1166, 1182, 1187, 1197, 1218, 1275, 1385, 1445, 1641, 1701, 1702, 1707, 1749, 1846, 1892, 1967, 1998, 2012, 2072, 2194, 2229, 2230, 2231, 2416, 2502, 2568, 2584, 2585, 2594, 2615, 2665, 2675, 2676, 2696, 2709, 2755, 2780, 2816, 2862, 2895, 2971, 2982, 3012, 3026, 3067, 3082, 3142, 3145, 3148, 3251, 3275, 3320, 3334, 3401, 3409, 3527, 3623, 3636, 3637, 3742, 3976, 3977, 4066, 4087, 4115, 4144, 4183, 4213, 4256, 4275, 4290, 4319, 4324, 4375, 4387, 4391, 4422, 4438, 4455, 4563, 4605, 4619, 4638, 4669, 4781, 4794, 4902, 4927, 4928, 4937, 5054, 5110, 5154, 5199, 5236, 5311, 5347, 5369, 5392, 5397, 5444, 5466, 5488, 5516, 5539, 5561, 5580, 5634, 5654, 5735, 5760, 5798, 5799, 5808, 5883, 5937, 5975, 5983, 6005, 6007, 6083, 6091, 6132, 6139, 6237, 6250, 6258, 6259, 6271, 6293, 6307, 6408, 6414, 6430, 6481, 6485, 6528, 6587, 6661, 6723, 6752, 6777, 6781, 6789, 6878, 7054, 7068, 7190, 7222, 7387, 7396, 7454, 7473, 7511, 7544, 7567, 7662, 7691, 7702, 7719, 7846, 7935, 8032, 8042, 8238, 8259, 8322, 8406, 8445, 8585, 8622, 8639, 8642, 8647, 8740, 8765, 8770, 8771, 8833, 8851, 8918, 8948, 8984, 9050, 9068, 9106, 9180, 9222, 9225, 9298, 9313, 9355, 9414, 9459, 9461, 9524, 9538, 9633, 9744, 9745, 9908, 9916, 9942, 9945, 10001, 10046, 10148, 10173, 10192, 10202, 10214, 10221, 10423, 10481, 10566, 10663, 10671, 10728, 10750, 10757, 10781, 10840, 10886, 10928, 10960, 10973, 10994, 10997, 11012, 11104, 11136, 11173, 11339, 11340, 11378, 11539, 11634, 11643, 11783, 11831, 11832, 11839, 11915, 11924, 11937, 11970, 12038, 12058, 12074, 12108, 12117, 12183, 12187, 12224, 12302, 12364, 12379, 12414, 12425, 12468, 12472, 12568, 12580, 12590, 12696, 12765, 12896, 12962, 13175, 13189, 13195, 13199, 13207, 13283, 13284, 13501, 13504, 13509, 13606, 13640, 13649, 13667, 13708, 13764, 13856, 13976, 14030, 14031, 14063, 14126.

Root-specific promoters include SEQ IDs: 8, 12, 38, 73, 97, 160, 182, 217, 251, 271, 348, 376, 454, 492, 534, 614, 667, 668, 683, 685, 763, 771, 785, 1120, 1175, 1213, 1283, 1291, 1337, 1343, 1356, 1363, 1411, 1416, 1492, 1518, 1921, 1992, 2126, 2162, 2225, 2290, 2426, 2466, 2479, 2504, 2556, 2648, 2727, 2785, 2834, 2837, 2881, 2892, 2944, 2948, 3018, 3027, 3040, 3043, 3078, 3126, 3129, 3141, 3215, 3235, 3332, 3373, 3389, 3390, 3432, 3441, 3458, 3491, 3577, 3657, 3662, 3671, 3804, 3820, 3831, 3858, 3937, 3964, 3972, 4047, 4099, 4157, 4170, 4217, 4263, 4377, 4395, 4437, 4513, 4518, 4532, 4578, 4579, 4596, 4641, 4688, 4722, 4815, 4955, 4984, 5032, 5079, 5113, 5214, 5228, 5243, 5285, 5292, 5383, 5463, 5464, 5502, 5503, 5541, 5583, 5619, 5683, 5690, 5705, 5717, 5823, 5850, 5950, 6043, 6084, 6100, 6184, 6220, 6239, 6272, 6273, 6312, 6316, 6323, 6343, 6344, 6393, 6404, 6464, 6494, 6497, 6499, 6502, 6553, 6574, 6672, 6693, 6742, 6832, 6887, 6891, 6894, 6925, 7040, 7049, 7096, 7128, 7129, 7183, 7207, 7227, 7264, 7270, 7282, 7395, 7406, 7407, 7568, 7678, 7679, 7680, 7854, 7866, 7867, 7909, 7965, 7966, 7967, 7992, 8030, 8043, 8114, 8125, 8248, 8372, 8382, 8417, 8418, 8465, 8469, 8516, 8527, 8587, 8598, 8652, 8690, 8752, 8795, 8869, 9021, 9026, 9027, 9058, 9116, 9164, 9194, 9196, 9244, 9248, 9291, 9295, 9325, 9332, 9357, 9453, 9459, 9561, 9573, 9586, 9614, 9617, 9627, 9651, 9653, 9675, 9787, 9804, 9809, 9975, 9976, 10015, 10170, 10195, 10200, 10201, 10254, 10292, 10307, 10490, 10516, 10563, 10612, 10619, 10741, 10945, 10968, 11067, 11081, 11210, 11230, 11237, 11240, 11296, 11436, 11461, 11489, 11523, 11531, 11532, 11538, 11669, 11740, 11804, 11811, 11838, 11876, 11889, 11899, 11912, 11945, 11987, 12004, 12050, 12076, 12087, 12089, 12141, 12164, 12176, 12218, 12275, 12292, 12417, 12439, 12469, 12475, 12505, 12560, 12606, 12673, 12676, 12721, 12852, 13067, 13243, 13291, 13292, 13413, 13434, 13444, 13479, 13510, 13530, 13604, 13821, 13875, 13877, 13904, 13915, 13924, 13930, 13949, 13986, 13987, 14005, 14006, 14010, 14125.

Silk-specific promoters include SEQ IDs: 32, 45, 97, 232, 307, 383, 680, 699, 746, 785, 883, 917, 974, 1198, 1220, 1398, 1469, 1566, 1894, 2066, 2101, 2455, 2479, 2492, 2528, 2546, 2607, 2720, 2878, 2944, 3202, 3232, 3346, 3354, 3376, 3427, 3458, 3809, 3868, 4099, 4292, 4356, 4364, 4366, 4434, 4518, 4599, 4614, 4641, 4711, 4714, 5022, 5169, 5308, 5327, 5360, 5472, 5749, 5805, 5816, 5887, 5947, 5952, 5968, 5989, 6120, 6144, 6463, 6592, 6993, 7032, 7106, 7207, 7210, 7303, 7391, 7431, 7452, 7483, 7531, 7532, 7560, 7599, 7747, 7802, 7858, 7936, 7965, 7966, 7967, 8177, 8291, 8295, 8325, 8337, 8378, 8386, 8449, 8496, 8666, 8712, 8728, 8848, 8886, 8922, 8952, 9086, 9100, 9234, 9275, 9350, 9559, 9579, 9676, 9710, 9711, 9825, 9827, 9944, 9991, 10012, 10021, 10156, 10157, 10217, 10235, 10292, 10361, 10504, 10579, 10648, 10651, 10866, 10961, 11181, 11198, 11235, 11265, 11283, 11608, 11672, 11889, 11916, 11917, 12026, 12035, 12150, 12288, 12326, 12509, 12602, 12630, 12693, 12783, 12803, 12875, 12986, 13081, 13082, 13166, 13373, 13457, 13530, 13761, 13812, 13813, 13831, 13840, 13876, 13920, 13999, 14035, 14072, 14081, 14093.

High-constitutive promoters include SEQ IDs: 88, 131, 187, 293, 319, 724, 765, 855, 876, 908, 953, 958, 974, 979, 999, 1092, 1119, 1292, 1331, 1404, 1527, 1543, 1555, 1717, 1786, 1798, 1869, 1905, 1950, 2142, 2240, 2308, 2382, 2418, 2581, 2729, 2966, 3128, 3280, 3286, 3288, 3386, 3541, 3624, 3792, 3887, 4056, 4185, 4205, 4206, 4492, 4507, 4673, 4700, 4721, 4822, 4857, 4861, 5039, 5040, 5054, 5164, 5180, 5283, 5334, 5388, 5568, 5569, 5734, 5932, 5957, 6038, 6182, 6338, 7155, 7515, 7586, 7745, 7944, 7974, 8042, 8204, 8270, 8402, 8403, 8597, 8665, 8773, 8881, 8929, 8960, 9071, 9092, 9118, 9129, 9140, 9267, 9391, 9460, 9784, 9909, 9984, 10110, 10410, 10655, 10705, 10788, 10858, 10937, 10941, 10996, 11459, 11487, 11577, 11707, 11753, 12059, 12080, 12104, 12420, 12440, 12668, 12731, 12732, 12824, 12898, 12932, 12947, 13022, 13236, 13237, 13348, 13473, 13546, 13552, 13604, 14132.

Low-constitutive promoters include SEQ IDs: 65, 94, 96, 104, 152, 183, 191, 212, 232, 237, 246, 251, 319, 332, 335, 338, 381, 388, 411, 441, 450, 470, 471, 485, 514, 546, 547, 554, 561, 578, 580, 613, 620, 638, 681, 693, 694, 705, 706, 718, 734, 753, 764, 804, 809, 830, 855, 856, 858, 870, 877, 908, 924, 928, 932, 943, 955, 1008, 1011, 1012, 1043, 1046, 1055, 1057, 1077, 1095, 1100, 1104, 1117, 1132, 1167, 1183, 1196, 1223, 1254, 1258, 1290, 1296, 1307, 1311, 1334, 1366, 1371, 1388, 1458, 1484, 1493, 1530, 1556, 1586, 1590, 1598, 1600, 1601, 1615, 1634, 1637, 1669, 1671, 1678, 1684, 1687, 1698, 1705, 1716, 1732, 1811, 1837, 1839, 1852, 1879, 1923, 1945, 1952, 1968, 1972, 2037, 2043, 2062, 2088, 2091, 2093, 2094, 2133, 2143, 2156, 2170, 2175, 2189, 2200, 2215, 2263, 2310, 2381, 2401, 2423, 2439, 2454, 2457, 2495, 2568, 2570, 2578, 2601, 2611, 2635, 2644, 2692, 2700, 2704, 2728, 2746, 2752, 2765, 2805, 2808, 2819, 2823, 2860, 2871, 2878, 2893, 2943, 2959, 2966, 2994, 3003, 3005, 3013, 3020, 3044, 3068, 3085, 3115, 3118, 3167, 3172, 3177, 3242, 3263, 3299, 3310, 3337, 3338, 3342, 3343, 3345, 3379, 3383, 3426, 3449, 3452, 3458, 3466, 3468, 3493, 3500, 3502, 3516, 3541, 3549, 3554, 3594, 3634, 3643, 3648, 3659, 3674, 3690, 3709, 3715, 3718, 3730, 3749, 3764, 3766, 3792, 3817, 3833, 3837, 3838, 3843, 3846, 3873, 3884, 3887, 3908, 3912, 3954, 3967, 3970, 3971, 4014, 4039, 4042, 4043, 4050, 4054, 4092, 4106, 4113, 4160, 4227, 4228, 4233, 4246, 4251, 4257, 4266, 4275, 4296, 4329, 4330, 4347, 4369, 4390, 4393, 4397, 4405, 4439, 4440, 4446, 4461, 4462, 4508, 4514, 4521, 4522, 4535, 4575, 4601, 4606, 4639, 4656, 4677, 4697, 4713, 4721, 4734, 4739, 4745, 4753, 4780, 4787, 4790, 4805, 4806, 4807, 4818, 4822, 4889, 4891, 4904, 4910, 4914, 4941, 4969, 5026, 5045, 5057, 5060, 5072, 5078, 5101, 5160, 5165, 5189, 5202, 5213, 5218, 5225, 5256, 5260, 5275, 5276, 5308, 5317, 5339, 5348, 5352, 5405, 5414, 5418, 5427, 5446, 5453, 5461, 5493, 5505, 5513, 5518, 5519, 5545, 5554, 5566, 5575, 5582, 5584, 5585, 5589, 5614, 5616, 5638, 5643, 5651, 5663, 5680, 5690, 5694, 5702, 5706, 5719, 5722, 5734, 5770, 5808, 5820, 5867, 5871, 5892, 5893, 5919, 5921, 5931, 5932, 5944, 5959, 5971, 5980, 5985, 6007, 6012, 6047, 6051, 6058, 6075, 6080, 6095, 6098, 6122, 6129, 6133, 6165, 6168, 6200, 6223, 6224, 6246, 6249, 6264, 6272, 6273, 6279, 6302, 6310, 6351, 6362, 6363, 6396, 6399, 6403, 6415, 6437, 6464, 6467, 6469, 6480, 6505, 6524, 6543, 6548, 6549, 6554, 6560, 6561, 6574, 6576, 6579, 6611, 6624, 6626, 6638, 6643, 6711, 6714, 6716, 6747, 6759, 6786, 6813, 6821, 6827, 6869, 6878, 6879, 6903, 6919, 6936, 6948, 6979, 6994, 7006, 7013, 7057, 7077, 7085, 7086, 7140, 7142, 7176, 7177, 7203, 7228, 7259, 7274, 7288, 7328, 7355, 7371, 7373, 7383, 7459, 7470, 7493, 7504, 7505, 7506, 7533, 7538, 7578, 7585, 7621, 7623, 7652, 7677, 7689, 7703, 7729, 7744, 7745, 7768, 7769, 7815, 7825, 7856, 7862, 7945, 7947, 7948, 7955, 7956, 7978, 7986, 8012, 8026, 8042, 8047, 8068, 8080, 8082, 8084, 8091, 8095, 8100, 8103, 8118, 8136, 8151, 8199, 8202, 8207, 8211, 8227, 8239, 8245, 8252, 8272, 8293, 8294, 8304, 8350, 8392, 8414, 8438, 8458, 8459, 8515, 8528, 8533, 8549, 8550, 8568, 8594, 8596, 8601, 8603, 8638, 8640, 8644, 8654, 8659, 8672, 8685, 8693, 8732, 8741, 8789, 8805, 8832, 8838, 8843, 8853, 8861, 8886, 8888, 8892, 8909, 8910, 8914, 8929, 8957, 8967, 8969, 8972, 8974, 8976, 8986, 9002, 9029, 9030, 9058, 9073, 9076, 9110, 9174, 9187, 9233, 9243, 9299, 9320, 9326, 9336, 9337, 9341, 9345, 9354, 9375, 9392, 9406, 9432, 9433, 9444, 9478, 9501, 9503, 9519, 9533, 9536, 9563, 9577, 9589, 9590, 9613, 9620, 9623, 9629, 9641, 9642, 9644, 9645, 9646, 9660, 9692, 9723, 9730, 9733, 9763, 9768, 9770, 9781, 9845, 9861, 9873, 9901, 9908, 9909, 9940, 9950, 9971, 9997, 10009, 10010, 10019, 10038, 10048, 10052, 10054, 10062, 10092, 10101, 10107, 10109, 10114, 10149, 10163, 10178, 10195, 10209, 10218, 10233, 10291, 10306, 10328, 10353, 10357, 10362, 10380, 10399, 10414, 10430, 10463, 10464, 10468, 10469, 10504, 10508, 10525, 10527, 10528, 10533, 10541, 10543, 10544, 10547, 10561, 10565, 10569, 10582, 10602, 10611, 10616, 10621, 10623, 10626, 10668, 10697, 10699, 10703, 10707, 10711, 10715, 10725, 10766, 10778, 10779, 10787, 10795, 10805, 10809, 10820, 10821, 10824, 10838, 10853, 10858, 10862, 10880, 10935, 10938, 10954, 10960, 10962, 10967, 10997, 10999, 11004, 11005, 11006, 11008, 11039, 11086, 11110, 11127, 11158, 11161, 11175, 11177, 11187, 11188, 11232, 11237, 11239, 11257, 11262, 11263, 11266, 11274, 11278, 11289, 11290, 11295, 11316, 11339, 11340, 11346, 11352, 11356, 11365, 11382, 11391, 11394, 11406, 11409, 11416, 11423, 11449, 11459, 11463, 11481, 11490, 11512, 11528, 11530, 11538, 11541, 11544, 11548, 11560, 11561, 11567, 11576, 11580, 11594, 11597, 11650, 11657, 11658, 11669, 11693, 11733, 11744, 11753, 11765, 11783, 11799, 11828, 11863, 11870, 11890, 11957, 11977, 12020, 12023, 12024, 12061, 12081, 12091, 12093, 12120, 12131, 12166, 12171, 12181, 12215, 12217, 12252, 12255, 12278, 12285, 12295, 12310, 12339, 12347, 12350, 12366, 12415, 12419, 12420, 12426, 12437, 12444, 12450, 12488, 12492, 12513, 12518, 12555, 12556, 12565, 12572, 12588, 12610, 12623, 12648, 12664, 12683, 12696, 12764, 12807, 12810, 12817, 12823, 12900, 12903, 12908, 12928, 12947, 12960, 12969, 12986, 13010, 13017, 13035, 13054, 13056, 13061, 13110, 13112, 13123, 13125, 13136, 13151, 13154, 13169, 13186, 13199, 13221, 13235, 13239, 13264, 13271, 13274, 13304, 13329, 13340, 13352, 13363, 13368, 13370, 13381, 13391, 13477, 13478, 13480, 13519, 13522, 13539, 13546, 13561, 13599, 13605, 13634, 13641, 13662, 13665, 13677, 13697, 13700, 13720, 13739, 13745, 13772, 13783, 13834, 13873, 13877, 13892, 13897, 13909, 13950, 13963, 14001, 14005, 14006, 14027, 14059, 14071, 14081, 14085, 14094, 14122, 14124, 14138, 14139, 14146, 14147.

Tissue-Enhanced Promoter Expression Patterns

Tissue-enhanced promoter expression patterns were identified using AFFYMETRIX and ROSETTA. Multiple tissue survey microarray experimental data from the past several years were normalized using standard procedures. Previous analysis has shown that intensity levels greater than 512 (or 2^9) for the AFFYMETRIX data, and greater than 0.6 for the ROSETTA data, correspond to the top 25-30% most highly expressed genes. In order to identify the promoters meeting the expression criteria, the promoters were linked to the corresponding gene probe sets and were then filtered for intensity based on the above criteria. For the AFFYMETRIX data, 12497 of the 16872 unique probesets were classified into at least one of the 42 sample categories. 1877 of the 12497 Probesets were found in all 42 categories. 5147 were found in at least 30, 6644 were found in at least 20, and 8575 were found in at least 10. 945 were found in only 1 of the 42. For the ROSETTA data, 11538 of the 14493 unique probesets were classified into at least one of the 32 sample categories. 809 of the 11538 probesets were found in all 32. 4436 were found in at least 20, and 7216 were found in at least 10. 834 were found in only 1 of the 32.

The tissue-enhanced promoters that were identified by AFFYMETRIX analysis include the following. In the following descriptions, a reference to a "Vn" stage means plant development stage at which the nth leaf has emerged.

Promoters expressing in the inflorescent meristem at V12 to V15 stage include SEQ IDs: 1, 3, 7, 9, 12, 14, 15, 16, 17, 19, 29, 31, 33, 34, 36, 37, 48, 54, 56, 57, 63, 64, 65, 79, 80, 88, 93, 94, 96, 97, 98, 99, 101, 103, 104, 110, 112, 121, 123, 128, 130, 131, 132, 137, 141, 142, 143, 147, 148, 152, 154, 155, 156, 157, 159, 162, 165, 174, 175, 176, 181, 183, 187, 191, 193, 194, 196, 197, 199, 202, 203, 205, 207, 211, 212, 214, 223, 232, 233, 235, 236, 237, 239, 240, 242, 246, 248, 249, 250, 251, 257, 259, 262, 264, 267, 269, 270, 286, 288, 289, 293, 294, 301, 302, 305, 306, 309, 316, 319, 320, 322, 323, 328, 329, 332, 334, 335, 338, 341, 346, 349, 352, 353, 354, 355, 356, 357, 358, 359, 360, 364, 365, 373, 374, 378, 379, 381, 386, 388, 389, 395, 396, 401, 411, 412, 414, 423, 428, 431, 432, 433, 434, 436, 441, 448, 450, 452, 456, 461, 462, 463, 466, 470, 471, 474, 478, 479, 483, 485, 488, 489, 496, 498, 504, 507, 509, 510, 511, 514, 515, 516, 517, 523, 525, 528, 532, 535, 537, 541, 542, 543, 544, 546, 547, 548, 553, 554, 557, 560, 561, 563, 565, 573, 577, 578, 579, 580, 585, 588, 591, 592, 594, 595, 596, 598, 599, 601, 602, 605, 606, 607, 608, 609, 613, 614, 619, 620, 623, 630, 631, 633, 635, 636, 637, 638, 643, 645, 647, 650, 655, 659, 661, 662, 663, 664, 670, 671, 681, 683, 687, 692, 693, 694, 701, 702, 705, 706, 709, 717, 718, 719, 721, 722, 723, 724, 727, 731, 732, 734, 736, 739, 740, 742, 744, 749, 750, 753, 757, 759, 760, 761, 762, 763, 764, 765, 779, 782, 783, 784, 792, 793, 800, 804, 806, 809, 811, 812, 820, 822, 824, 825, 826, 829, 830, 833, 836, 840, 845, 846, 849, 855, 856, 857, 858, 860, 862, 863, 864, 865, 870, 871, 872, 875, 876, 877, 882, 887, 890, 891, 892, 893, 895, 897, 898, 899, 903, 907, 908, 911, 912, 915, 916, 917, 919, 920, 924, 928, 929, 931, 932, 933, 936, 939, 943, 944, 947, 949, 951, 953, 955, 957, 958, 960, 961, 971, 974, 975, 976, 977, 978, 979, 980, 982, 984, 985, 987, 988, 993, 994, 995, 997, 999, 1002, 1007, 1008, 1009, 1010, 1011, 1012, 1013, 1014, 1016, 1017, 1019, 1022, 1025, 1026, 1032, 1033, 1035, 1038, 1039, 1041, 1042, 1043, 1046, 1047, 1049, 1051, 1052, 1054, 1055, 1056, 1057, 1059, 1064, 1065, 1069, 1070, 1073, 1074, 1076, 1077, 1080, 1085, 1086, 1087, 1089, 1091, 1092, 1095, 1100, 1101, 1103, 1104, 1110, 1112, 1114, 1115, 1116, 1117, 1119, 1121, 1125, 1130, 1132, 1136, 1137, 1140, 1146, 1148, 1153, 1154, 1155, 1160, 1161, 1164, 1165, 1167, 1168, 1170, 1171, 1176, 1178, 1183, 1189, 1191, 1193, 1196, 1200, 1201, 1204, 1205, 1213, 1214, 1218, 1220, 1222, 1223, 1225, 1228, 1230, 1231, 1232, 1236, 1239, 1240, 1244, 1248, 1249, 1251, 1254, 1257, 1258, 1261, 1262, 1263, 1272, 1275, 1277, 1281, 1282, 1285, 1286, 1290, 1292, 1293, 1296, 1303, 1306, 1307, 1309, 1310, 1311, 1312, 1314, 1316, 1320, 1321, 1322, 1323, 1327, 1330, 1331, 1334, 1339, 1345, 1347, 1349, 1356, 1360, 1363, 1364, 1366, 1367, 1368, 1371, 1375, 1376, 1377, 1380, 1383, 1387, 1389, 1391, 1393, 1394, 1396, 1398, 1399, 1404, 1405, 1406, 1407, 1412, 1415, 1420, 1421, 1423, 1426, 1431, 1432, 1433, 1438, 1439, 1440, 1441, 1442, 1447, 1448, 1451, 1453, 1458, 1459, 1461, 1462, 1466, 1472, 1475, 1484, 1487, 1488, 1490, 1491, 1492, 1493, 1498, 1499, 1503, 1504, 1506, 1508, 1510, 1511, 1512, 1514, 1518, 1519, 1525, 1526, 1527, 1528, 1530, 1539, 1543, 1545, 1546, 1549, 1550, 1551, 1554, 1555, 1556, 1560, 1561, 1564, 1567, 1568, 1570, 1571, 1575, 1578, 1584, 1585, 1586, 1588, 1590, 1591, 1596, 1597, 1598, 1599, 1600, 1601, 1602, 1604, 1605, 1608, 1609, 1610, 1612, 1614, 1615, 1616, 1617, 1622, 1623, 1625, 1627, 1634, 1635, 1636, 1637, 1638, 1639, 1641, 1643, 1651, 1654, 1658, 1659, 1662, 1663, 1669, 1671, 1673, 1675, 1676, 1678, 1681, 1682, 1684, 1687, 1688, 1689, 1690, 1691, 1696, 1697, 1698, 1699, 1703, 1705, 1706, 1707, 1708, 1710, 1716, 1717, 1718, 1720, 1725, 1729, 1732, 1735, 1749, 1750, 1755, 1758, 1761, 1764, 1769, 1770, 1773, 1774, 1776, 1777, 1778, 1785, 1786, 1791, 1792, 1793, 1796, 1798, 1802, 1807, 1808, 1809, 1811, 1812, 1813, 1822, 1825, 1826, 1828, 1830, 1832, 1837, 1839, 1840, 1843, 1848, 1849, 1852, 1859, 1861, 1863, 1866, 1867, 1869, 1872, 1873, 1876, 1879, 1880, 1882, 1886, 1888, 1891, 1894, 1897, 1898, 1899, 1900, 1901, 1902, 1905, 1906, 1910, 1911, 1915, 1916, 1918, 1920, 1922, 1923, 1924, 1928, 1933, 1934, 1936, 1939, 1940, 1942, 1945, 1948, 1949, 1950, 1951, 1952, 1953, 1956, 1958, 1968, 1969, 1970, 1971, 1972, 1973, 1974, 1979, 1986, 1990, 1993, 1994, 1995, 1996, 1999, 2000, 2007, 2008, 2009, 2010, 2012, 2014, 2015, 2016, 2017, 2019, 2021, 2026, 2032, 2037, 2040, 2041, 2043, 2048, 2057, 2058, 2060, 2062, 2064, 2066, 2069, 2072, 2074, 2077, 2078, 2085, 2087, 2088, 2089, 2091, 2092, 2093, 2094, 2097, 2099, 2101, 2103, 2104, 2106, 2112, 2122, 2123, 2125, 2128, 2132, 2133, 2137, 2139, 2140, 2142, 2143, 2146, 2147, 2150, 2151, 2156, 2157, 2161, 2164, 2167, 2168, 2170, 2172, 2173, 2175, 2177, 2178, 2179, 2185, 2188, 2189, 2193, 2195, 2196, 2202, 2203, 2205, 2206, 2210, 2215, 2216, 2218, 2221, 2222, 2223, 2226, 2235, 2240, 2241, 2242, 2243, 2253, 2257, 2259, 2260, 2263, 2266, 2267, 2274, 2276, 2278, 2280, 2282, 2283, 2284, 2288, 2291, 2296, 2297, 2298, 2300, 2303, 2305, 2306, 2308, 2309, 2310, 2313, 2314, 2322, 2323, 2328, 2329, 2331, 2333, 2339, 2342, 2343, 2345, 2348, 2353, 2363, 2366, 2369, 2371, 2372, 2376, 2379, 2380, 2381, 2382, 2384, 2398, 2401, 2402, 2405, 2410, 2411, 2412, 2413, 2414, 2416, 2418, 2419, 2420, 2422, 2423, 2428, 2430, 2431, 2432, 2433, 2434, 2435, 2437, 2439, 2440, 2441, 2442, 2443, 2445, 2449, 2452, 2453, 2454, 2457, 2458, 2469, 2470, 2472, 2474, 2476, 2479, 2480, 2481, 2485, 2487, 2490, 2492, 2494, 2495, 2496, 2498, 2500, 2505, 2506, 2507, 2509, 2513, 2514, 2515, 2516, 2517, 2519, 2521, 2525, 2526, 2528, 2529, 2531, 2533, 2534, 2536, 2537, 2538, 2539, 2541, 2544, 2545, 2549, 2550, 2551, 2552, 2554, 2555, 2556, 2559, 2560, 2567, 2568, 2570, 2573, 2576, 2578, 2579, 2581, 2583, 2589, 2590, 2591, 2594, 2596, 2599, 2601, 2605, 2609, 2611, 2613, 2616, 2617, 2619, 2622, 2625, 2626, 2627, 2632, 2634, 2635, 2636, 2639, 2641, 2644, 2645, 2648, 2649, 2651, 2652, 2655, 2656, 2658, 2661, 2662, 2663, 2671, 2672, 2674, 2676, 2684, 2685, 2687, 2688, 2689, 2690, 2691, 2692, 2694, 2700, 2702, 2704, 2709, 2711, 2712, 2719, 2720, 2721, 2722, 2723, 2725, 2726, 2728, 2729, 2730, 2735, 2736, 2745, 2746, 2747, 2749, 2752, 2755, 2756, 2758, 2759, 2760, 2762, 2764, 2765, 2769, 2770, 2775, 2776, 2779, 2782, 2784, 2787, 2788, 2789, 2791, 2796, 2798, 2800, 2801, 2802, 2805, 2808, 2812, 2814, 2819, 2821, 2822, 2823, 2824, 2826, 2827, 2828, 2832, 2838, 2840, 2844, 2845, 2850, 2860, 2861, 2865, 2869, 2871, 2876, 2878, 2885, 2888, 2889, 2892, 2893, 2894, 2895, 2896, 2897, 2898, 2901, 2902, 2903, 2906, 2908, 2909, 2915, 2916, 2917, 2918, 2919, 2923, 2926, 2929, 2930, 2931, 2935, 2941, 2942, 2943, 2944, 2946, 2947, 2955, 2959, 2962, 2963, 2965, 2966, 2968, 2976, 2978, 2982, 2985, 2987, 2992, 2994, 2998, 3000, 3003, 3005, 3007, 3008, 3009, 3013, 3015, 3017, 3018, 3019, 3020, 3023, 3029, 3031, 3033, 3039, 3042, 3044, 3045, 3047, 3048, 3049, 3051, 3052, 3053, 3055, 3058, 3059, 3061, 3062, 3064, 3065, 3067, 3068, 3070, 3072, 3075, 3080, 3083, 3085, 3087, 3090, 3095, 3097, 3100, 3101, 3106, 3107, 3115, 3118, 3119, 3121, 3122, 3123, 3126, 3128, 3137, 3139, 3143, 3149, 3153, 3167, 3169, 3170, 3172, 3177, 3179, 3181, 3189, 3191, 3192, 3194, 3196, 3202, 3205, 3206, 3208, 3210, 3217, 3218, 3220, 3221, 3224, 3225, 3228, 3230, 3237, 3240, 3242, 3246, 3249, 3250, 3252, 3254, 3261, 3263, 3266, 3267, 3269, 3271, 3272, 3273, 3278, 3280, 3283, 3286, 3288, 3290, 3291, 3294, 3295, 3297, 3299, 3301, 3308, 3310, 3312, 3313, 3314, 3324, 3331, 3332, 3333, 3337, 3338, 3340, 3342, 3343, 3345, 3347, 3351, 3353, 3355, 3356, 3357, 3358, 3359, 3360, 3361, 3363, 3368, 3369, 3370, 3373, 3376, 3377, 3378, 3379, 3382, 3383, 3386, 3394, 3396, 3397, 3399, 3403, 3404, 3405, 3413, 3415, 3416, 3418, 3419, 3424, 3426, 3427, 3428, 3432, 3435, 3438, 3442, 3446, 3447, 3449, 3450, 3452, 3453, 3458, 3461, 3465, 3466, 3468, 3469, 3470, 3471, 3474, 3477, 3483, 3484, 3486, 3488, 3490, 3493, 3494, 3499, 3500, 3502, 3503, 3504, 3506, 3507, 3510, 3516, 3517, 3518, 3523, 3524, 3529, 3533, 3535, 3536, 3537, 3538, 3540, 3541, 3542, 3544, 3545, 3546, 3548, 3549, 3554, 3558, 3560, 3562, 3569, 3571, 3574, 3576, 3580, 3587, 3588, 3589, 3592, 3594, 3595, 3599, 3600, 3603, 3604, 3606, 3607, 3610, 3611, 3613, 3615, 3616, 3620, 3622, 3624, 3629, 3633, 3634, 3636, 3640, 3642, 3643, 3644, 3645, 3646, 3648, 3655, 3659, 3660, 3661, 3667, 3671, 3672, 3674, 3677, 3681, 3682, 3684, 3685, 3690, 3693, 3694, 3704, 3706, 3707, 3709, 3713, 3715, 3718, 3719, 3721, 3722, 3723, 3725, 3726, 3730, 3731, 3732, 3733, 3738, 3739, 3744, 3749, 3752, 3756, 3757, 3760, 3763, 3764, 3765, 3766, 3777, 3778, 3785, 3787, 3791, 3792, 3793, 3794, 3798, 3801, 3806, 3808, 3817, 3818, 3819, 3823, 3825, 3828, 3830, 3831, 3832, 3833, 3834, 3837, 3838, 3839, 3843, 3844, 3845, 3846, 3847, 3849, 3852, 3858, 3859, 3860, 3866, 3867, 3868, 3870, 3871, 3872, 3873, 3881, 3883, 3884, 3885, 3887, 3889, 3890, 3892, 3894, 3895, 3897, 3902, 3903, 3904, 3907, 3908, 3909, 3912, 3913, 3917, 3918, 3924, 3926, 3928, 3929, 3938, 3941, 3947, 3950, 3951, 3952, 3954, 3958, 3962, 3967, 3968, 3970, 3971, 3972, 3974, 3975, 3976, 3977, 3978, 3983, 3988, 3994, 3995, 3996, 4000, 4001, 4002, 4003, 4007, 4008, 4012, 4013, 4014, 4019, 4020, 4028, 4030, 4033, 4037, 4039, 4040, 4041, 4042, 4043, 4046, 4047, 4048, 4049, 4050, 4051, 4052, 4053, 4054, 4055, 4056, 4057, 4062, 4066, 4067, 4068, 4070, 4075, 4080, 4084, 4088, 4092, 4094, 4096, 4102, 4105, 4106, 4109, 4110, 4111, 4113, 4116, 4117, 4122, 4124, 4126, 4128, 4132, 4133, 4134, 4140, 4143, 4144, 4146, 4147, 4149, 4150, 4155, 4160, 4163, 4164, 4165, 4166, 4167, 4168, 4171, 4175, 4176, 4178, 4181, 4183, 4185, 4187, 4188, 4189, 4191, 4193, 4195, 4197, 4201, 4202, 4204, 4205, 4206, 4207, 4208, 4210, 4211, 4212, 4213, 4219, 4221, 4227, 4228, 4229, 4232, 4233, 4234, 4235, 4237, 4241, 4244, 4245, 4246, 4251, 4252, 4257, 4260, 4261, 4266, 4270, 4272, 4275, 4276, 4280, 4281, 4283, 4284, 4288, 4290, 4295, 4296, 4298, 4300, 4301, 4302, 4304, 4305, 4306, 4309, 4312, 4314, 4317, 4320, 4321, 4324, 4329, 4330, 4332, 4335, 4338, 4341, 4347, 4349, 4358, 4359, 4360, 4369, 4370, 4374, 4375, 4378, 4380, 4383, 4388, 4390, 4391, 4396, 4397, 4401, 4402, 4403, 4404, 4405, 4406, 4409, 4410, 4417, 4422, 4423, 4432, 4436, 4439, 4440, 4442, 4443, 4446, 4448, 4449, 4450, 4453, 4461, 4462, 4463, 4466, 4467, 4468, 4474, 4475, 4479, 4485, 4486, 4490, 4492, 4494, 4497, 4498, 4500, 4502, 4507, 4508, 4509, 4512, 4513, 4514, 4515, 4519, 4521, 4522, 4525, 4529, 4531, 4535, 4541, 4543, 4545, 4548, 4549, 4551, 4554, 4555, 4556, 4557, 4558, 4560, 4562, 4563, 4565, 4566, 4567, 4568, 4575, 4576, 4578, 4579, 4580, 4582, 4583, 4590, 4591, 4594, 4597, 4598, 4601, 4606, 4614, 4616, 4618, 4623, 4625, 4628, 4630, 4632, 4633, 4634, 4635, 4639, 4641, 4643, 4644, 4646, 4647, 4650, 4651, 4653, 4654, 4655, 4656, 4658, 4659, 4662, 4664, 4667, 4669, 4671, 4672, 4673, 4674, 4676, 4677, 4680, 4682, 4685, 4691, 4692, 4694, 4697, 4699, 4700, 4701, 4703, 4706, 4708, 4710, 4711, 4713, 4715, 4719, 4720, 4721, 4724, 4730, 4736, 4737, 4738, 4739, 4740, 4741, 4745, 4746, 4747, 4749, 4750, 4751, 4753, 4754, 4755, 4756, 4761, 4762, 4763, 4766, 4767, 4769, 4770, 4771, 4773, 4775, 4779, 4780, 4784, 4787, 4788, 4789, 4790, 4791, 4794, 4795, 4796, 4801, 4803, 4804, 4805, 4806, 4807, 4813, 4814, 4815, 4818, 4822, 4823, 4828, 4830, 4831, 4834, 4836, 4838, 4840, 4841, 4842, 4854, 4855, 4856, 4857, 4859, 4861, 4862, 4863, 4864, 4869, 4874, 4875, 4876, 4878, 4881, 4887, 4889, 4891, 4895, 4896, 4897, 4900, 4902, 4904, 4905, 4907, 4909, 4910, 4914, 4921, 4922, 4935, 4936, 4937, 4941, 4942, 4950, 4954, 4955, 4958, 4959, 4963, 4967, 4969, 4971, 4972, 4974, 4975, 4980, 4987, 4989, 4990, 4993, 4994, 4996, 5000, 5010, 5014, 5015, 5016, 5024, 5026, 5029, 5030, 5036, 5037, 5039, 5040, 5041, 5042, 5044, 5045, 5046, 5049, 5052, 5054, 5057, 5060, 5067, 5068, 5072, 5074, 5075, 5078, 5082, 5089, 5090, 5091, 5094, 5100, 5101, 5102, 5106, 5107, 5109, 5110, 5113, 5114, 5115, 5116, 5123, 5125, 5131, 5132, 5140, 5143, 5145, 5147, 5149, 5151, 5159, 5160, 5163, 5164, 5165, 5168, 5170, 5174, 5180, 5181, 5185, 5187, 5188, 5189, 5190, 5191, 5192, 5193, 5196, 5198, 5200, 5202, 5206, 5209, 5212, 5213, 5217, 5219, 5221, 5224, 5225, 5234, 5237, 5238, 5239, 5240, 5243, 5244, 5245, 5249, 5251, 5253, 5254, 5255, 5258, 5260, 5261, 5263, 5264, 5267, 5268, 5269, 5273, 5274, 5275, 5276, 5280, 5281, 5282, 5283, 5287, 5292, 5293, 5297, 5298, 5299, 5300, 5301, 5308, 5311, 5315, 5317, 5319, 5321, 5324, 5328, 5329, 5330, 5333, 5334, 5338, 5339, 5342, 5345, 5346, 5348, 5349, 5351, 5352, 5366, 5367, 5369, 5371, 5375, 5376, 5386, 5388, 5389, 5391, 5393, 5395, 5396, 5397, 5404, 5405, 5409, 5411, 5413, 5414, 5417, 5418, 5422, 5427, 5428, 5431, 5433, 5434, 5437, 5438, 5446, 5448, 5449, 5452, 5453, 5456, 5458, 5459, 5461, 5475, 5483, 5485, 5487, 5488, 5491, 5493, 5495, 5496, 5498, 5505, 5508, 5510, 5512, 5513, 5515, 5517, 5518, 5519, 5524, 5526, 5529, 5530, 5531, 5532, 5534, 5535, 5537, 5543, 5545, 5549, 5554, 5561, 5562, 5563, 5566, 5568, 5569, 5572, 5575, 5579, 5581, 5582, 5584, 5585, 5589, 5591, 5593, 5594, 5597, 5602, 5608, 5610, 5613, 5614, 5615, 5616, 5620, 5623, 5627, 5630, 5632, 5633, 5635, 5638, 5640, 5643, 5647, 5648, 5649, 5650, 5651, 5652, 5653, 5656, 5659, 5660, 5662, 5663, 5669, 5680, 5681, 5683, 5689, 5690, 5691, 5694, 5695, 5696, 5697, 5698, 5702, 5706, 5711, 5712, 5713, 5714, 5717, 5718, 5719, 5721, 5722, 5729, 5730, 5731, 5732, 5734, 5735, 5736, 5737, 5740, 5742, 5744, 5748, 5751, 5768, 5770, 5773, 5775, 5778, 5780, 5784, 5785, 5787, 5791, 5792, 5794, 5803, 5805, 5807, 5808, 5809, 5811, 5814, 5815, 5817, 5820, 5825, 5826, 5828, 5832, 5833, 5834, 5835, 5836, 5837, 5839, 5842, 5844, 5846, 5854, 5859, 5864, 5866, 5867, 5869, 5871, 5872, 5873, 5875, 5876, 5877, 5878, 5879, 5881, 5882, 5883, 5888, 5889, 5892, 5893, 5906, 5910, 5912, 5918, 5919, 5921, 5922, 5923, 5925, 5926, 5927, 5928, 5930, 5931, 5932, 5933, 5938, 5939, 5940, 5941, 5942, 5944, 5945, 5948, 5951, 5954, 5957, 5959, 5961, 5967, 5968, 5969, 5971, 5973, 5978, 5979, 5980, 5985, 5986, 5990, 5991, 5994, 5996, 5997, 5999, 6000, 6003, 6004, 6005, 6006, 6007, 6010, 6012, 6013, 6016, 6017, 6019, 6023, 6025, 6026, 6031, 6034, 6038, 6040, 6041, 6044, 6046, 6047, 6048, 6051, 6053, 6054, 6058, 6059, 6061, 6062, 6063, 6065, 6068, 6069, 6070, 6072, 6073, 6074, 6075, 6080, 6081, 6085, 6089, 6091, 6092, 6093, 6094, 6095, 6096, 6098, 6107, 6108, 6109, 6110, 6112, 6113, 6116, 6118, 6119, 6122, 6129, 6130, 6132, 6133, 6135, 6136, 6137, 6140, 6143, 6144, 6145, 6146, 6147, 6149, 6151, 6153, 6156, 6160, 6163, 6164, 6165, 6168, 6173, 6176, 6182, 6183, 6186, 6188, 6189, 6190, 6191, 6193, 6197, 6198, 6200, 6205, 6207, 6209, 6212, 6213, 6215, 6220, 6221, 6223, 6224, 6226, 6227, 6228, 6230, 6231, 6233, 6234, 6238, 6239, 6240, 6241, 6243, 6244, 6245, 6246, 6248, 6249, 6251, 6255, 6257, 6258, 6259, 6260, 6264, 6265, 6269, 6270, 6271, 6272, 6273, 6275, 6278, 6279, 6280, 6281, 6282, 6286, 6291, 6292, 6294, 6295, 6299, 6302, 6308, 6309, 6310, 6311, 6312, 6315, 6317, 6319, 6321, 6322, 6325, 6326, 6328, 6332, 6333, 6338, 6346, 6350, 6351, 6352, 6353, 6354, 6358, 6359, 6362, 6363, 6364, 6367, 6370, 6372, 6375, 6378, 6379, 6381, 6383, 6394, 6395, 6396, 6397, 6398, 6399, 6403, 6405, 6407, 6412, 6413, 6414, 6415, 6419, 6420, 6422, 6425, 6428, 6429, 6430, 6431, 6434, 6436, 6437, 6442, 6449, 6454, 6456, 6459, 6463, 6464, 6466, 6467, 6468, 6469, 6470, 6471, 6474, 6476, 6480, 6481, 6484, 6486, 6488, 6493, 6495, 6499, 6500, 6501, 6502, 6504, 6505, 6510, 6513, 6514, 6516, 6517, 6519, 6524, 6525, 6526, 6530, 6532, 6534, 6535, 6537, 6543, 6544, 6547, 6548, 6549, 6552, 6554, 6555, 6558, 6560, 6561, 6563, 6564, 6567, 6572, 6574, 6576, 6577, 6579, 6581, 6582, 6584, 6587, 6588, 6589, 6595, 6598, 6599, 6600, 6603, 6607, 6609, 6611, 6614, 6620, 6621, 6624, 6626, 6627, 6630, 6634, 6635, 6637, 6638, 6639, 6640, 6643, 6644, 6646, 6647, 6648, 6649, 6652, 6655, 6656, 6658, 6662, 6666, 6671, 6672, 6677, 6678, 6681, 6686, 6691, 6692, 6696, 6703, 6705, 6706, 6711, 6714, 6716, 6718, 6720, 6724, 6725, 6729, 6731, 6734, 6736, 6737, 6739, 6746, 6747, 6752, 6756, 6757, 6759, 6761, 6764, 6766, 6778, 6779, 6780, 6783, 6786, 6788, 6792, 6793, 6794, 6797, 6799, 6803, 6804, 6805, 6807, 6810, 6811, 6812, 6813, 6816, 6819, 6820, 6821, 6824, 6827, 6828, 6830, 6831, 6834, 6836, 6839, 6840, 6841, 6842, 6843, 6845, 6851, 6854, 6859, 6863, 6864, 6869, 6870, 6872, 6874, 6875, 6876, 6878, 6879, 6880, 6884, 6886, 6888, 6890, 6892, 6897, 6903, 6904, 6913, 6914, 6915, 6917, 6919, 6920, 6921, 6925, 6930, 6933, 6936, 6941, 6943, 6944, 6946, 6948, 6950, 6951, 6952, 6959, 6960, 6963, 6969, 6979, 6980, 6984, 6985, 6987, 6988, 6990, 6991, 6993, 6994, 6995, 6999, 7002, 7003, 7006, 7009, 7012, 7013, 7015, 7017, 7022, 7032, 7039, 7042, 7043, 7045, 7046, 7051, 7052, 7053, 7056, 7057, 7064, 7067, 7072, 7075, 7077, 7079, 7083, 7085, 7086, 7093, 7094, 7097, 7105, 7106, 7107, 7108, 7109, 7112, 7116, 7117, 7118, 7124, 7130, 7132, 7135, 7137, 7140, 7142, 7144, 7146, 7149, 7151, 7155, 7163, 7164, 7165, 7166, 7169, 7176, 7177, 7182, 7183, 7184, 7187, 7188, 7192, 7194, 7196, 7197, 7201, 7202, 7203, 7206, 7207, 7208, 7216, 7217, 7218, 7219, 7227, 7228, 7230, 7231, 7232, 7233, 7234, 7235, 7239, 7240, 7241, 7243, 7244, 7245, 7248, 7255, 7257, 7258, 7259, 7262, 7267, 7268, 7269, 7270, 7274, 7277, 7281, 7282, 7284, 7287, 7288, 7291, 7292, 7293, 7298, 7299, 7300, 7301, 7303, 7304, 7305, 7306, 7307, 7310, 7311, 7312, 7315, 7317, 7328, 7330, 7334, 7339, 7340, 7344, 7348, 7354, 7355, 7356, 7357, 7358, 7361, 7363, 7365, 7371, 7373, 7379, 7380, 7381, 7382, 7383, 7388, 7389, 7392, 7395, 7398, 7400, 7401, 7410, 7411, 7417, 7425, 7428, 7430, 7434, 7435, 7436, 7438, 7443, 7444, 7445, 7446, 7447, 7448, 7452, 7454, 7458, 7459, 7466, 7470, 7483, 7486, 7487, 7490, 7492, 7493, 7498, 7504, 7505, 7512, 7515, 7517, 7518, 7523, 7524, 7525, 7528, 7529, 7533, 7537, 7538, 7542, 7546, 7547, 7548, 7560, 7561, 7570, 7574, 7577, 7578, 7579, 7580, 7585, 7586, 7587, 7588, 7590, 7591, 7593, 7594, 7601, 7605, 7611, 7617, 7619, 7620, 7621, 7623, 7624, 7632, 7633, 7634, 7638, 7639, 7640, 7642, 7643, 7647, 7652, 7658, 7661, 7663, 7664, 7665, 7666, 7667, 7674, 7677, 7678, 7679, 7680, 7682, 7687, 7689, 7695, 7699, 7700, 7703, 7704, 7708, 7712, 7713, 7716, 7717, 7718, 7719, 7724, 7725, 7729, 7730, 7733, 7736, 7737, 7738, 7740, 7744, 7745, 7747, 7751, 7753, 7755, 7761, 7762, 7763, 7764, 7767, 7768, 7769, 7770, 7772, 7774, 7775, 7777, 7778, 7779, 7780, 7782, 7785, 7786, 7788, 7791, 7793, 7796, 7798, 7800, 7803, 7804, 7806, 7807, 7812, 7815, 7818, 7819, 7820, 7823, 7824, 7825, 7832, 7833, 7834, 7838, 7841, 7844, 7847, 7848, 7849, 7856, 7858, 7859, 7860, 7862, 7863, 7865, 7873, 7876, 7878, 7888, 7890, 7895, 7896, 7900, 7908, 7909, 7910, 7911, 7917, 7918, 7920, 7921, 7922, 7923, 7925, 7927, 7929, 7933, 7934, 7935, 7936, 7938, 7942, 7943, 7944, 7945, 7947, 7948, 7949, 7952, 7953, 7955, 7956, 7964, 7965, 7966, 7967, 7972, 7974, 7976, 7977, 7978, 7980, 7982, 7983, 7984, 7986, 7989, 7990, 7991, 7992, 7993, 8002, 8004, 8006, 8012, 8021, 8026, 8029, 8035, 8039, 8042, 8044, 8045, 8047, 8048, 8052, 8053, 8056, 8058, 8059, 8061, 8063, 8064, 8066, 8067, 8068, 8071, 8072, 8073, 8075, 8076, 8077, 8078, 8079, 8080, 8082, 8084, 8088, 8091, 8093, 8095, 8100, 8102, 8103, 8105, 8112, 8116, 8118, 8120, 8121, 8126, 8130, 8136, 8137, 8145, 8146, 8150, 8154, 8159, 8163, 8164, 8165, 8170, 8174, 8176, 8178, 8179, 8186, 8189, 8193, 8195, 8199, 8202, 8204, 8207, 8208, 8210, 8211, 8213, 8215, 8216, 8219, 8220, 8222, 8223, 8225, 8227, 8231, 8234, 8235, 8237, 8239, 8245, 8250, 8252, 8253, 8257, 8258, 8266, 8268, 8269, 8270, 8272, 8274, 8289, 8291, 8292, 8293, 8294, 8300, 8301, 8302, 8304, 8310, 8311, 8312, 8315, 8318, 8319, 8320, 8321, 8324, 8329, 8339, 8340, 8349, 8350, 8351, 8352, 8353, 8355, 8363, 8367, 8368, 8369, 8373, 8376, 8379, 8385, 8386, 8387, 8389, 8392, 8393, 8395, 8400, 8401, 8402, 8403, 8404, 8407, 8410, 8411, 8413, 8414, 8416, 8417, 8418, 8423, 8428, 8430, 8433, 8436, 8438, 8439, 8441, 8444, 8446, 8447, 8448, 8449, 8450, 8451, 8452, 8457, 8465, 8466, 8469, 8472, 8473, 8474, 8476, 8477, 8481, 8482, 8485, 8486, 8490, 8493, 8498, 8501, 8502, 8503, 8505, 8509, 8511, 8513, 8515, 8517, 8520, 8523, 8524, 8525, 8527, 8528, 8531, 8532, 8533, 8537, 8538, 8539, 8541, 8544, 8549, 8550, 8552, 8554, 8561, 8562, 8565, 8566, 8568, 8575, 8576, 8579, 8581, 8582, 8584, 8589, 8590, 8593, 8594, 8596, 8597, 8599, 8600, 8601, 8603, 8605, 8609, 8611, 8612, 8614, 8617, 8618, 8621, 8624, 8631, 8634, 8637, 8638, 8640, 8641, 8642, 8644, 8650, 8654, 8657, 8658, 8659, 8660, 8665, 8669, 8672, 8676, 8677, 8685, 8693, 8699, 8700, 8703, 8706, 8708, 8709, 8713, 8716, 8717, 8719, 8720, 8726, 8729, 8730, 8731, 8732, 8734, 8735, 8736, 8740, 8741, 8745, 8746, 8748, 8752, 8753, 8755, 8757, 8759, 8764, 8767, 8772, 8773, 8775, 8777, 8779, 8782, 8783, 8784, 8789, 8792, 8796, 8797, 8803, 8804, 8805, 8810, 8817, 8818, 8822, 8824, 8829, 8831, 8832, 8834, 8835, 8836, 8838, 8841, 8843, 8846, 8853, 8854, 8861, 8865, 8867, 8876, 8877, 8878, 8880, 8881, 8883, 8884, 8886, 8888, 8891, 8892, 8896, 8897, 8899, 8900, 8905, 8907, 8908, 8909, 8910, 8911, 8912, 8914, 8916, 8917, 8926, 8929, 8930, 8935, 8938, 8941, 8942, 8945, 8946, 8949, 8951, 8954, 8957, 8959, 8960, 8961, 8962, 8967, 8968, 8969, 8972, 8974, 8976, 8977, 8978, 8979, 8980, 8981, 8985, 8986, 8992, 8996, 8998, 8999, 9002, 9003, 9006, 9009, 9012, 9015, 9017, 9018, 9020, 9021, 9023, 9026, 9027, 9029, 9030, 9033, 9037, 9044, 9047, 9052, 9057, 9058, 9059, 9060, 9062, 9066, 9069, 9071, 9072, 9073, 9074, 9076, 9084, 9088, 9091, 9092, 9095, 9096, 9097, 9103, 9105, 9108, 9110, 9111, 9112, 9114, 9118, 9120, 9123, 9125, 9129, 9133, 9134, 9139, 9140, 9141, 9142, 9146, 9149, 9151, 9154, 9155, 9157, 9173, 9174, 9177, 9179, 9183, 9185, 9187, 9188, 9190, 9191, 9195, 9204, 9206, 9207, 9210, 9211, 9213, 9215, 9216, 9218, 9226, 9229, 9233, 9234, 9235, 9237, 9241, 9243, 9247, 9252, 9253, 9255, 9263, 9265, 9267, 9269, 9270, 9273, 9276, 9278, 9284, 9285, 9287, 9288, 9290, 9292, 9293, 9298, 9299, 9300, 9304, 9308, 9311, 9320, 9323, 9325, 9326, 9327, 9328, 9329, 9330, 9333, 9336, 9337, 9338, 9339, 9340, 9341, 9345, 9346, 9347, 9348, 9354, 9355, 9357, 9359, 9362, 9366, 9367, 9373, 9375, 9376, 9378, 9382, 9383, 9388, 9389, 9391, 9392, 9393, 9394, 9396, 9398, 9400, 9402, 9403, 9404, 9406, 9407, 9413, 9414, 9415, 9417, 9423, 9432, 9433, 9434, 9440, 9443, 9444, 9449, 9451, 9452, 9456, 9459, 9460, 9468, 9471, 9472, 9473, 9475, 9478, 9481, 9483, 9486, 9488, 9490, 9494, 9495, 9497, 9500, 9501, 9502, 9503, 9504, 9509, 9514, 9515, 9517, 9518, 9519, 9525, 9531, 9533, 9534, 9536, 9540, 9545, 9548, 9553, 9555, 9557, 9559, 9560, 9563, 9564, 9565, 9567, 9568, 9571, 9577, 9582, 9583, 9586, 9587, 9589, 9590, 9591, 9602, 9606, 9609, 9610, 9613, 9614, 9617, 9618, 9620, 9623, 9626, 9627, 9628, 9629, 9630, 9633, 9634, 9635, 9640, 9641, 9642, 9644, 9645, 9646, 9648, 9649, 9650, 9652, 9653, 9655, 9656, 9657, 9658, 9659, 9660, 9663, 9666, 9668, 9670, 9681, 9682, 9686, 9692, 9693, 9694, 9698, 9706, 9710, 9711, 9715, 9717, 9718, 9722, 9723, 9725, 9726, 9729, 9730, 9731, 9732, 9733, 9734, 9737, 9746, 9750, 9751, 9753, 9754, 9755, 9756, 9763, 9764, 9767, 9768, 9770, 9774, 9776, 9780, 9781, 9782, 9784, 9791, 9794, 9796, 9799, 9804, 9806, 9809, 9812, 9813, 9816, 9819, 9820, 9824, 9825, 9827, 9830, 9833, 9845, 9846, 9847, 9849, 9850, 9851, 9853, 9854, 9861, 9864, 9866, 9869, 9871, 9873, 9882, 9885, 9886, 9887, 9892, 9897, 9900, 9901, 9902, 9906, 9907, 9908, 9909, 9910, 9911, 9912, 9917, 9923, 9924, 9928, 9935, 9938, 9940, 9946, 9947, 9949, 9950, 9953, 9955, 9958, 9960, 9962, 9963, 9964, 9967, 9968, 9971, 9972, 9979, 9980, 9982, 9984, 9985, 9987, 9988, 9990, 9991, 9996, 9997, 9998, 10000, 10008, 10009, 10010, 10013, 10017, 10018, 10019, 10021, 10022, 10026, 10031, 10032, 10033, 10034, 10037, 10038, 10041, 10042, 10043, 10045, 10047, 10048, 10050, 10051, 10052, 10054, 10056, 10058, 10060, 10062, 10064, 10066, 10068, 10073, 10077, 10078, 10082, 10083, 10086, 10089, 10090, 10091, 10092, 10093, 10095, 10101, 10102, 10103, 10105, 10106, 10107, 10108, 10109, 10110, 10114, 10115, 10116, 10118, 10122, 10127, 10128, 10131, 10132, 10136, 10141, 10143, 10146, 10149, 10151, 10152, 10154, 10158, 10162, 10163, 10165, 10166, 10168, 10170, 10174, 10176, 10177, 10178, 10181, 10182, 10187, 10191, 10192, 10193, 10194, 10195, 10197, 10199, 10203, 10206, 10209, 10212, 10214, 10218, 10219, 10220, 10222, 10223, 10225, 10228, 10231, 10232, 10233, 10236, 10237, 10239, 10246, 10247, 10252, 10253, 10255, 10257, 10263, 10268, 10270, 10275, 10284, 10291, 10292, 10293, 10295, 10296, 10297, 10300, 10302, 10306, 10307, 10311, 10321, 10322, 10323, 10325, 10326, 10327, 10328, 10331, 10333, 10334, 10335, 10336, 10342, 10343, 10344, 10346, 10351, 10353, 10356, 10357, 10359, 10360, 10362, 10364, 10368, 10371, 10373, 10375, 10378, 10380, 10384, 10385, 10388, 10389, 10397, 10398, 10399, 10401, 10409, 10410, 10413, 10414, 10416, 10421, 10422, 10423, 10430, 10435, 10437, 10438, 10440, 10446, 10447, 10448, 10449, 10450, 10453, 10456, 10460, 10463, 10464, 10465, 10468, 10469, 10470, 10474, 10478, 10480, 10482, 10487, 10488, 10492, 10494, 10496, 10499, 10504, 10506, 10508, 10513, 10514, 10516, 10518, 10525, 10527, 10528, 10531, 10533, 10535, 10536, 10537, 10541, 10542, 10543, 10544, 10545, 10547, 10548, 10549, 10550, 10551, 10555, 10556, 10558, 10560, 10561, 10562, 10563, 10565, 10567, 10569, 10571, 10573, 10577, 10580, 10581, 10582, 10583, 10585, 10587, 10591, 10593, 10595, 10596, 10597, 10599, 10601, 10602, 10606, 10610, 10611, 10613, 10615, 10616, 10617, 10621, 10622, 10623, 10626, 10628, 10634, 10637, 10638, 10639, 10640, 10641, 10642, 10643, 10645, 10646, 10650, 10655, 10657, 10659, 10663, 10665, 10666, 10668, 10670, 10673, 10674, 10678, 10681, 10682, 10683, 10684, 10685, 10686, 10687, 10689, 10693, 10697, 10698, 10699, 10700, 10702, 10703, 10705, 10706, 10707, 10711, 10712, 10715, 10716, 10721, 10722, 10723, 10725, 10726, 10732, 10734, 10735, 10737, 10738, 10740, 10741, 10744, 10745, 10748, 10749, 10752, 10761, 10762, 10763, 10766, 10775, 10778, 10779, 10782, 10784, 10785, 10787, 10788, 10790, 10791, 10792, 10795, 10796, 10798, 10800, 10801, 10803, 10804, 10805, 10809, 10810, 10812, 10815, 10818, 10819, 10820, 10821, 10822, 10823, 10824, 10825, 10826, 10831, 10833, 10836, 10838, 10839, 10841, 10843, 10846, 10847, 10850, 10852, 10853, 10854, 10857, 10858, 10860, 10862, 10866, 10867, 10871, 10874, 10876, 10877, 10880, 10881, 10887, 10891, 10892, 10893, 10896, 10897, 10898, 10899, 10902, 10905, 10910, 10912, 10913, 10916, 10917, 10920, 10926, 10927, 10928, 10930, 10933, 10934, 10935, 10936, 10937, 10938, 10940, 10941, 10944, 10947, 10948, 10950, 10954, 10957, 10960, 10962, 10965, 10967, 10972, 10976, 10977, 10979, 10980, 10988, 10993, 10995, 10996, 10997, 10999, 11004, 11005, 11006, 11008, 11009, 11010, 11018, 11024, 11026, 11027, 11032, 11036, 11037, 11039, 11045, 11046, 11047, 11052, 11053, 11056, 11060, 11068, 11070, 11071, 11072, 11078, 11080, 11082, 11083, 11086, 11090, 11095, 11098, 11099, 11100, 11101, 11102, 11107, 11108, 11110, 11114, 11116, 11117, 11118, 11123, 11124, 11125, 11127, 11128, 11129, 11132, 11133, 11134, 11135, 11137, 11138, 11145, 11146, 11152, 11153, 11154, 11158, 11159, 11160, 11161, 11162, 11163, 11165, 11166, 11168, 11169, 11175, 11177, 11178, 11181, 11184, 11185, 11187, 11188, 11190, 11191, 11192, 11198, 11199, 11201, 11202, 11203, 11207, 11214, 11217, 11218, 11222, 11224, 11226, 11227, 11228, 11229, 11230, 11232, 11233, 11234, 11235, 11236, 11237, 11238, 11239, 11246, 11247, 11248, 11251, 11256, 11257, 11258, 11259, 11260, 11261, 11262, 11263, 11264, 11266, 11274, 11275, 11278, 11286, 11288, 11289, 11290, 11291, 11292, 11293, 11294, 11295, 11298, 11305, 11306, 11307, 11313, 11315, 11316, 11317, 11319, 11320, 11322, 11324, 11326, 11329, 11332, 11339, 11340, 11345, 11346, 11348, 11349, 11352, 11356, 11358, 11363, 11364, 11365, 11366, 11370, 11371, 11373, 11374, 11377, 11381, 11382, 11387, 11388, 11389, 11391, 11392, 11394, 11395, 11397, 11403, 11405, 11406, 11409, 11416, 11418, 11423, 11426, 11428, 11430, 11431, 11434, 11437, 11438, 11445, 11446, 11449, 11459, 11463, 11465, 11467, 11471, 11472, 11475, 11476, 11477, 11478, 11481, 11482, 11485, 11487, 11496, 11497, 11498, 11500, 11501, 11505, 11506, 11507, 11508, 11509, 11512, 11516, 11520, 11523, 11524, 11527, 11528, 11530, 11531, 11532, 11533, 11534, 11535, 11538, 11540, 11541, 11544, 11546, 11547, 11548, 11551, 11553, 11558, 11560, 11561, 11564, 11567, 11568, 11571, 11574, 11576, 11577, 11578, 11580, 11583, 11586, 11593, 11594, 11595, 11597, 11599, 11604, 11610, 11612, 11618, 11621, 11623, 11625, 11628, 11629, 11632, 11633, 11636, 11639, 11642, 11650, 11652, 11654, 11655, 11656, 11657, 11658, 11659, 11663, 11664, 11667, 11668, 11669, 11673, 11677, 11678, 11681, 11682, 11683, 11688, 11691, 11692, 11694, 11695, 11696, 11701, 11703, 11705, 11707, 11711, 11712, 11720, 11721, 11725, 11726, 11731, 11732, 11733, 11736, 11740, 11743, 11744, 11753, 11755, 11759, 11760, 11761, 11762, 11763, 11764, 11765, 11766, 11767, 11770, 11771, 11773, 11776, 11780, 11781, 11782, 11783, 11785, 11786, 11789, 11790, 11792, 11795, 11799, 11800, 11809, 11811, 11812, 11814, 11816, 11818, 11819, 11826, 11828, 11829, 11830, 11831, 11832, 11833, 11837, 11838, 11841, 11846, 11849, 11850, 11851, 11853, 11854, 11856, 11858, 11863, 11868, 11870, 11872, 11876, 11877, 11878, 11881, 11890, 11891, 11893, 11897, 11898, 11899, 11903, 11904, 11909, 11913, 11915, 11916, 11917, 11919, 11920, 11921, 11922, 11923, 11927, 11928, 11929, 11930, 11934, 11935, 11939, 11940, 11941, 11943, 11946, 11947, 11948, 11949, 11953, 11955, 11957, 11958, 11959, 11960, 11961, 11962, 11963, 11965, 11968, 11977, 11980, 11983, 11988, 11993, 11997, 11998, 11999, 12002, 12004, 12008, 12017, 12019, 12020, 12021, 12023, 12024, 12025, 12026, 12032, 12035, 12042, 12043, 12044, 12047, 12050, 12051, 12054, 12059, 12060, 12061, 12064, 12068, 12078, 12079, 12080, 12081, 12083, 12085, 12086, 12091, 12092, 12093, 12097, 12098, 12104, 12106, 12112, 12114, 12115, 12118, 12120, 12122, 12126, 12127, 12128, 12129, 12130, 12131, 12134, 12135, 12138, 12139, 12140, 12143, 12144, 12145, 12146, 12147, 12149, 12150, 12151, 12153, 12161, 12162, 12165, 12166, 12167, 12170, 12171, 12173, 12174, 12175, 12179, 12181, 12186, 12197, 12198, 12202, 12204, 12208, 12212, 12215, 12217, 12223, 12229, 12233, 12237, 12240, 12241, 12243, 12245, 12246, 12249, 12250, 12252, 12254, 12255, 12256, 12259, 12265, 12268, 12269, 12271, 12278, 12280, 12283, 12284, 12285, 12286, 12287, 12288, 12295, 12296, 12310, 12311, 12312, 12313, 12314, 12315, 12317, 12319, 12321, 12323, 12325, 12328, 12331, 12334, 12335, 12337, 12339, 12342, 12343, 12345, 12347, 12350, 12354, 12356, 12359, 12364, 12366, 12370, 12375, 12376, 12379, 12381, 12383, 12385, 12390, 12393, 12394, 12397, 12400, 12401, 12403, 12404, 12406, 12411, 12414, 12415, 12419, 12420, 12423, 12424, 12425, 12426, 12427, 12437, 12440, 12444, 12445, 12450, 12451, 12455, 12456, 12457, 12459, 12461, 12462, 12465, 12467, 12468, 12470, 12472, 12473, 12478, 12481, 12483, 12487, 12488, 12489, 12492, 12494, 12495, 12497, 12503, 12508, 12510, 12511, 12512, 12513, 12514, 12515, 12518, 12519, 12527, 12530, 12535, 12536, 12537, 12539, 12546, 12547, 12548, 12549, 12551, 12552, 12554, 12555, 12556, 12557, 12561, 12563, 12565, 12567, 12568, 12570, 12572, 12577, 12578, 12580, 12583, 12585, 12586, 12588, 12589, 12591, 12600, 12603, 12605, 12608, 12609, 12610, 12611, 12616, 12620, 12622, 12623, 12626, 12628, 12629, 12631, 12634, 12638, 12639, 12640, 12641, 12644, 12648, 12649, 12650, 12651, 12652, 12653, 12654, 12663, 12664, 12668, 12670, 12671, 12674, 12679, 12680, 12681, 12683, 12684, 12685, 12688, 12689, 12691, 12692, 12693, 12695, 12696, 12699, 12701, 12702, 12705, 12706, 12708, 12713, 12714, 12716, 12723, 12731, 12732, 12733, 12735, 12738, 12739, 12740, 12741, 12742, 12752, 12753, 12754, 12755, 12757, 12758, 12760, 12761, 12764, 12765, 12766, 12771, 12775, 12777, 12782, 12783, 12790, 12794, 12797, 12800, 12802, 12803, 12807, 12810, 12812, 12813, 12817, 12820, 12822, 12823, 12824, 12826, 12827, 12828, 12835, 12836, 12837, 12838, 12839, 12843, 12844, 12848, 12849, 12853, 12860, 12861, 12866, 12870, 12873, 12878, 12882, 12883, 12884, 12887, 12888, 12891, 12898, 12899, 12900, 12901, 12903, 12904, 12905, 12906, 12908, 12910, 12912, 12913, 12916, 12917, 12920, 12921, 12928, 12929, 12932, 12933, 12934, 12935, 12938, 12945, 12946, 12947, 12950, 12952, 12953, 12956, 12958, 12959, 12960, 12961, 12963, 12967, 12968, 12969, 12978, 12983, 12984, 12986, 12987, 12988, 12990, 12991, 12999, 13001, 13003, 13004, 13005, 13007, 13010, 13012, 13014, 13015, 13017, 13018, 13022, 13027, 13030, 13031, 13033, 13034, 13035, 13036, 13038, 13040, 13041, 13044, 13045, 13049, 13050, 13053, 13054, 13055, 13056, 13059, 13061, 13062, 13064, 13066, 13067, 13071, 13075, 13079, 13083, 13085, 13086, 13087, 13097, 13099, 13101, 13102, 13105, 13106, 13110, 13112, 13114, 13115, 13116, 13117, 13118, 13120, 13122, 13123, 13124, 13125, 13127, 13128, 13131, 13134, 13135, 13144, 13147, 13148, 13149, 13151, 13154, 13159, 13160, 13164, 13169, 13170, 13175, 13180, 13181, 13182, 13186, 13188, 13189, 13190, 13197, 13198, 13199, 13203, 13205, 13206, 13209, 13210, 13212, 13213, 13215, 13217, 13221, 13224, 13226, 13227, 13228, 13232, 13234, 13235, 13236, 13237, 13239, 13241, 13243, 13248, 13250, 13251, 13255, 13256, 13259, 13260, 13261, 13262, 13263, 13264, 13267, 13268, 13269, 13271, 13274, 13281, 13283, 13284, 13287, 13296, 13298, 13301, 13303, 13304, 13313, 13315, 13317, 13319, 13325, 13329, 13332, 13335, 13337, 13340, 13343, 13344, 13345, 13346, 13347, 13348, 13350, 13352, 13361, 13363, 13367, 13368, 13369, 13370, 13377, 13380, 13381, 13384, 13385, 13386, 13391, 13393, 13394, 13395, 13396, 13397, 13398, 13401, 13402, 13403, 13404, 13407, 13408, 13410, 13413, 13416, 13417, 13419, 13423, 13424, 13429, 13430, 13433, 13439, 13441, 13444, 13446, 13448, 13456, 13457, 13460, 13467, 13469, 13473, 13475, 13477, 13478, 13480, 13484, 13489, 13492, 13497, 13499, 13503, 13504, 13505, 13513, 13514, 13515, 13516, 13519, 13521, 13522, 13526, 13529, 13530, 13533, 13535, 13536, 13539, 13540, 13543, 13544, 13545, 13546, 13547, 13549, 13552, 13553, 13555, 13558, 13559, 13561, 13568, 13569, 13574, 13577, 13578, 13580, 13584, 13587, 13597, 13598, 13599, 13600, 13601, 13602, 13604, 13605, 13606, 13611, 13612, 13613, 13614, 13621, 13623, 13630, 13631, 13632, 13634, 13636, 13637, 13641, 13643, 13650, 13651, 13653, 13654, 13660, 13662, 13663, 13665, 13668, 13670, 13675, 13677, 13678, 13679, 13683, 13687, 13688, 13697, 13698, 13699, 13700, 13702, 13706, 13710, 13713, 13714, 13716, 13719, 13720, 13727, 13729, 13739, 13742, 13745, 13747, 13750, 13756, 13764, 13767, 13772, 13773, 13775, 13777, 13779, 13780, 13782, 13783, 13786, 13787, 13789, 13791, 13793, 13794, 13796, 13797, 13799, 13809, 13816, 13817, 13818, 13819, 13822, 13823, 13828, 13830, 13831, 13834, 13835, 13843, 13848, 13849, 13852, 13858, 13866, 13869, 13872, 13873, 13875, 13877, 13879, 13887, 13888, 13891, 13892, 13895, 13897, 13898, 13899, 13901, 13902, 13903, 13906, 13908, 13909, 13910, 13911, 13915, 13917, 13918, 13919, 13921, 13924, 13925, 13934, 13947, 13948, 13950, 13952, 13953, 13954, 13958, 13960, 13961, 13963, 13969, 13970, 13971, 13975, 13984, 13986, 13987, 13991, 13999, 14000, 14001, 14005, 14006, 14008, 14009, 14013, 14014, 14017, 14022, 14027, 14030, 14031, 14035, 14036, 14038, 14040, 14049, 14051, 14052, 14054, 14059, 14062, 14063, 14066, 14067, 14069, 14070, 14071, 14072, 14073, 14074, 14075, 14078, 14081, 14084, 14085, 14086, 14088, 14092, 14094, 14096, 14097, 14106, 14112, 14114, 14116, 14117, 14118, 14119, 14121, 14122, 14124, 14129, 14130, 14132, 14133, 14135, 14137, 14138, 14139, 14140, 14141, 14142, 14145, 14146, 14147.

Promoters expressing in the germinating seedling at 2 days after planting include SEQ IDs: 3, 7, 12, 14, 15, 17, 19, 26, 29, 31, 34, 36, 37, 48, 54, 56, 57, 64, 65, 79, 80, 86, 88, 90, 93, 94, 95, 96, 98, 99, 100, 102, 103, 104, 108, 110, 117, 123, 126, 128, 130, 131, 134, 136, 137, 138, 143, 146, 152, 154, 156, 157, 159, 162, 165, 168, 169, 172, 174, 175, 176, 181, 183, 187, 191, 193, 194, 197, 199, 202, 203, 204, 205, 207, 210, 211, 212, 214, 232, 233, 235, 236, 237, 240, 242, 246, 249, 250, 251, 257, 259, 262, 264, 267, 269, 270, 271, 286, 288, 293, 294, 299, 301, 302, 305, 306, 308, 309, 316, 319, 320, 322, 323, 328, 329, 332, 334, 335, 338, 340, 346, 349, 352, 354, 355, 356, 358, 359, 360, 362, 364, 365, 367, 371, 372, 373, 374, 381, 386, 388, 389, 396, 401, 411, 412, 414, 416, 423, 431, 432, 433, 441, 448, 450, 452, 456, 459, 461, 462, 463, 466, 468, 470, 471, 474, 478, 483, 485, 488, 489, 493, 496, 498, 501, 504, 507, 509, 510, 511, 514, 516, 517, 523, 525, 528, 532, 537, 541, 543, 544, 546, 547, 548, 554, 556, 557, 560, 561, 573, 578, 579, 580, 582, 585, 589, 591, 594, 595, 596, 601, 602, 604, 606, 607, 608, 609, 613, 619, 620, 623, 629, 630, 631, 633, 635, 636, 637, 638, 643, 645, 647, 656, 661, 662, 663, 664, 670, 671, 681, 683, 684, 692, 693, 694, 701, 702, 705, 706, 707, 708, 709, 717, 718, 719, 721, 722, 724, 727, 731, 732, 733, 734, 739, 740, 742, 744, 749, 753, 757, 759, 760, 761, 762, 764, 765, 771, 779, 783, 786, 793, 795, 798, 800, 804, 806, 808, 809, 811, 812, 820, 821, 822, 829, 830, 831, 832, 833, 834, 835, 841, 845, 846, 855, 856, 857, 858, 860, 862, 863, 865, 869, 870, 871, 875, 876, 877, 890, 891, 892, 893, 895, 897, 898, 903, 907, 908, 910, 911, 912, 913, 915, 916, 919, 920, 924, 928, 929, 931, 932, 933, 936, 938, 939, 943, 947, 949, 951, 953, 955, 957, 958, 960, 961, 964, 971, 974, 975, 977, 978, 979, 980, 982, 984, 985, 987, 991, 996, 999, 1007, 1008, 1009, 1010, 1011, 1012, 1013, 1014, 1016, 1017, 1019, 1021, 1022, 1025, 1026, 1032, 1033, 1035, 1038, 1039, 1041, 1042, 1043, 1046, 1047, 1049, 1051, 1052, 1055, 1057, 1064, 1065, 1069, 1070, 1073, 1080,
1086, 1087, 1089, 1092, 1095, 1096, 1097, 1100, 1101, 1103,
1104, 1111, 1112, 1114, 1115, 1116, 1117, 1119, 1121, 1125,
1127, 1130, 1132, 1136, 1137, 1140, 1144, 1146, 1154, 1155,
1160, 1161, 1165, 1167, 1168, 1170, 1171, 1174, 1176, 1178,
1180, 1183, 1187, 1191, 1196, 1199, 1200, 1204, 1205, 1214,
1215, 1218, 1220, 1222, 1223, 1225, 1228, 1230, 1232, 1233,
1236, 1240, 1244, 1246, 1248, 1249, 1250, 1251, 1252, 1253,
1254, 1257, 1258, 1261, 1262, 1263, 1269, 1272, 1275, 1277,
1281, 1285, 1286, 1290, 1291, 1292, 1293, 1296, 1306, 1307,
1309, 1310, 1311, 1312, 1314, 1316, 1320, 1321, 1322, 1323,
1325, 1327, 1330, 1331, 1334, 1339, 1344, 1345, 1349, 1360,
1361, 1364, 1365, 1366, 1367, 1368, 1371, 1375, 1376, 1377,
1380, 1382, 1387, 1388, 1389, 1391, 1393, 1396, 1399, 1402,
1404, 1405, 1406, 1410, 1412, 1415, 1420, 1421, 1423, 1426,
1431, 1432, 1433, 1438, 1440, 1441, 1442, 1443, 1444, 1447,
1451, 1453, 1458, 1459, 1466, 1471, 1472, 1474, 1475, 1484,
1486, 1488, 1489, 1490, 1491, 1493, 1497, 1498, 1499, 1501,
1503, 1506, 1512, 1518, 1525, 1526, 1527, 1528, 1530, 1539,
1543, 1545, 1547, 1549, 1550, 1551, 1553, 1555, 1556, 1560,
1561, 1563, 1567, 1570, 1575, 1576, 1578, 1579, 1584, 1585,
1586, 1590, 1591, 1596, 1598, 1599, 1600, 1601, 1602, 1604,
1605, 1608, 1609, 1610, 1612, 1614, 1615, 1616, 1617, 1623,
1625, 1634, 1635, 1636, 1637, 1638, 1641, 1642, 1643, 1648,
1650, 1651, 1653, 1654, 1658, 1659, 1662, 1663, 1669, 1671,
1673, 1675, 1678, 1681, 1682, 1684, 1687, 1688, 1689, 1690,
1691, 1696, 1698, 1705, 1706, 1707, 1708, 1710, 1716, 1717,
1725, 1732, 1735, 1750, 1755, 1759, 1761, 1764, 1769, 1770,
1771, 1773, 1774, 1776, 1777, 1785, 1786, 1789, 1791, 1798,
1802, 1807, 1808, 1809, 1811, 1820, 1822, 1825, 1826, 1828,
1830, 1832, 1834, 1837, 1839, 1840, 1843, 1846, 1848, 1851,
1852, 1854, 1855, 1859, 1861, 1863, 1866, 1867, 1869, 1872,
1873, 1876, 1879, 1882, 1886, 1888, 1891, 1893, 1895, 1897,
1900, 1902, 1904, 1905, 1906, 1910, 1911, 1914, 1915, 1918,
1920, 1922, 1923, 1924, 1930, 1931, 1939, 1940, 1944, 1945,
1949, 1950, 1952, 1953, 1958, 1964, 1968, 1970, 1971, 1972,
1973, 1977, 1979, 1981, 1990, 1993, 1999, 2000, 2002, 2007,
2008, 2009, 2010, 2012, 2014, 2015, 2017, 2019, 2021, 2026,
2031, 2032, 2033, 2037, 2038, 2040, 2041, 2043, 2048, 2051,
2060, 2062, 2064, 2071, 2072, 2074, 2077, 2078, 2085, 2087,
2088, 2089, 2091, 2092, 2093, 2094, 2097, 2103, 2106, 2107,
2112, 2116, 2117, 2122, 2123, 2125, 2126, 2128, 2132, 2133,
2139, 2142, 2143, 2144, 2146, 2147, 2150, 2151, 2152, 2156,
2157, 2158, 2161, 2162, 2164, 2167, 2168, 2170, 2175, 2177,
2179, 2185, 2188, 2189, 2190, 2193, 2195, 2196, 2200, 2202,
2203, 2206, 2207, 2210, 2215, 2216, 2218, 2221, 2240, 2241,
2242, 2243, 2245, 2253, 2257, 2260, 2263, 2265, 2266, 2274,
2276, 2280, 2282, 2283, 2284, 2288, 2291, 2293, 2296, 2298,
2300, 2303, 2304, 2306, 2308, 2309, 2310, 2313, 2314, 2322,
2323, 2328, 2329, 2331, 2333, 2335, 2339, 2342, 2353, 2359,
2361, 2362, 2363, 2369, 2371, 2372, 2376, 2379, 2380, 2381,
2382, 2384, 2401, 2402, 2405, 2406, 2410, 2412, 2413, 2414,
2416, 2417, 2418, 2419, 2420, 2423, 2430, 2431, 2432, 2433,
2434, 2435, 2436, 2437, 2439, 2440, 2441, 2442, 2443, 2445,
2449, 2451, 2452, 2453, 2454, 2456, 2457, 2458, 2465, 2469,
2470, 2474, 2476, 2477, 2479, 2480, 2481, 2482, 2487, 2490,
2495, 2496, 2498, 2500, 2505, 2506, 2507, 2509, 2510, 2513,
2514, 2515, 2516, 2517, 2519, 2521, 2522, 2525, 2528, 2529,
2531, 2532, 2533, 2534, 2536, 2537, 2538, 2539, 2541, 2543,
2549, 2550, 2551, 2552, 2554, 2555, 2559, 2560, 2561, 2567,
2568, 2570, 2573, 2578, 2579, 2581, 2583, 2589, 2590, 2591,
2594, 2596, 2599, 2600, 2601, 2609, 2611, 2613, 2614, 2616,
2619, 2620, 2625, 2627, 2632, 2634, 2635, 2636, 2637, 2639,
2644, 2645, 2649, 2652, 2655, 2656, 2658, 2663, 2666, 2671,
2672, 2674, 2684, 2685, 2687, 2688, 2689, 2690, 2691, 2692,
2694, 2700, 2704, 2708, 2709, 2715, 2719, 2720, 2721, 2722,
2725, 2726, 2728, 2729, 2735, 2738, 2739, 2745, 2746, 2747,
2749, 2752, 2756, 2758, 2762, 2764, 2765, 2770, 2776, 2780,
2784, 2785, 2787, 2791, 2794, 2798, 2800, 2801, 2802, 2805,
2808, 2812, 2814, 2819, 2821, 2822, 2823, 2824, 2826, 2827,
2828, 2831, 2833, 2838, 2840, 2844, 2850, 2860, 2865, 2869,
2871, 2876, 2878, 2888, 2889, 2890, 2893, 2894, 2895, 2896,
2897, 2901, 2902, 2903, 2906, 2908, 2909, 2911, 2915, 2916,
2917, 2922, 2923, 2926, 2929, 2930, 2931, 2935, 2941, 2942,
2943, 2944, 2946, 2948, 2955, 2959, 2963, 2966, 2968, 2976,
2979, 2981, 2982, 2987, 2992, 2994, 3003, 3005, 3006, 3007,
3009, 3013, 3015, 3017, 3018, 3020, 3024, 3029, 3039, 3041,
3042, 3044, 3045, 3047, 3048, 3049, 3051, 3052, 3053, 3055,
3058, 3059, 3064, 3068, 3070, 3072, 3075, 3080, 3083, 3084,
3085, 3087, 3090, 3095, 3097, 3100, 3106, 3115, 3118, 3119,
3120, 3121, 3123, 3127, 3128, 3129, 3137, 3138, 3139, 3143,
3145, 3153, 3164, 3167, 3169, 3170, 3171, 3172, 3173, 3177,
3179, 3181, 3189, 3191, 3192, 3194, 3196, 3205, 3206, 3208,
3210, 3217, 3219, 3221, 3225, 3228, 3230, 3231, 3240, 3242,
3246, 3247, 3249, 3250, 3254, 3261, 3263, 3266, 3269, 3272,
3278, 3280, 3283, 3286, 3288, 3290, 3291, 3294, 3295, 3297,
3299, 3301, 3308, 3310, 3312, 3313, 3324, 3325, 3327, 3331,
3332, 3337, 3338, 3340, 3342, 3343, 3345, 3347, 3351, 3353,
3355, 3357, 3358, 3359, 3360, 3361, 3363, 3368, 3370, 3374,
3377, 3379, 3382, 3383, 3386, 3394, 3396, 3399, 3403, 3405,
3413, 3415, 3416, 3418, 3419, 3422, 3424, 3425, 3426, 3428,
3429, 3435, 3438, 3441, 3446, 3447, 3449, 3452, 3457, 3458,
3461, 3466, 3468, 3469, 3471, 3473, 3474, 3477, 3484, 3486,
3487, 3488, 3493, 3497, 3498, 3500, 3502, 3503, 3504, 3506,
3507, 3510, 3516, 3517, 3518, 3523, 3524, 3533, 3535, 3537,
3538, 3540, 3541, 3542, 3544, 3545, 3549, 3554, 3558, 3560,
3561, 3562, 3569, 3571, 3574, 3576, 3580, 3587, 3588, 3589,
3591, 3592, 3594, 3595, 3597, 3603, 3604, 3606, 3607, 3610,
3611, 3613, 3616, 3620, 3621, 3624, 3633, 3634, 3636, 3640,
3642, 3643, 3644, 3645, 3646, 3647, 3648, 3659, 3661, 3664,
3665, 3667, 3672, 3674, 3676, 3677, 3682, 3684, 3685, 3690,
3707, 3709, 3710, 3713, 3715, 3718, 3719, 3720, 3721, 3722,
3723, 3726, 3729, 3730, 3731, 3732, 3733, 3738, 3739, 3744,
3749, 3752, 3756, 3761, 3764, 3765, 3766, 3771, 3772, 3773,
3775, 3778, 3791, 3792, 3793, 3794, 3796, 3800, 3801, 3804,
3806, 3808, 3817, 3818, 3819, 3823, 3825, 3829, 3830, 3832,
3833, 3834, 3837, 3838, 3839, 3843, 3844, 3845, 3846, 3847,
3849, 3852, 3858, 3859, 3860, 3867, 3868, 3870, 3871, 3872,
3873, 3876, 3878, 3881, 3882, 3884, 3887, 3889, 3890, 3892,
3894, 3895, 3896, 3902, 3903, 3904, 3907, 3908, 3912, 3913,
3917, 3918, 3923, 3926, 3928, 3929, 3931, 3933, 3938, 3941,
3943, 3947, 3950, 3951, 3954, 3958, 3962, 3967, 3968, 3970,
3971, 3974, 3975, 3978, 3983, 3985, 3987, 3988, 3990, 3994,
3995, 3996, 3998, 4001, 4003, 4007, 4008, 4013, 4014, 4021,
4030, 4033, 4037, 4039, 4042, 4043, 4044, 4046, 4047, 4048,
4050, 4051, 4052, 4053, 4054, 4056, 4057, 4062, 4066, 4068,
4070, 4075, 4084, 4088, 4092, 4094, 4096, 4098, 4099, 4102,
4105, 4106, 4109, 4110, 4113, 4116, 4126, 4128, 4132, 4133,
4134, 4139, 4140, 4143, 4144, 4146, 4148, 4149, 4150, 4151,
4155, 4160, 4163, 4164, 4165, 4166, 4167, 4168, 4171, 4178,
4181, 4183, 4185, 4187, 4188, 4189, 4191, 4193, 4194, 4195,
4201, 4202, 4204, 4205, 4206, 4207, 4210, 4211, 4212, 4213,
4217, 4218, 4219, 4221, 4227, 4228, 4229, 4233, 4234, 4235,
4237, 4245, 4246, 4250, 4251, 4252, 4255, 4257, 4258, 4261,
4266, 4270, 4272, 4275, 4280, 4281, 4282, 4284, 4290, 4292,
4296, 4298, 4301, 4302, 4303, 4305, 4309, 4312, 4314, 4317,
4320, 4321, 4324, 4329, 4330, 4335, 4336, 4337, 4339, 4341,
4344, 4347, 4355, 4356, 4357, 4358, 4360, 4369, 4370, 4378,
4380, 4383, 4390, 4391, 4392, 4393, 4396, 4397, 4401, 4402,
4403, 4404, 4405, 4409, 4410, 4422, 4423, 4425, 4430, 4432,
4439, 4440, 4443, 4446, 4448, 4450, 4453, 4456, 4458, 4461,
4462, 4463, 4466, 4468, 4471, 4474, 4475, 4477, 4479, 4486,
4492, 4494, 4498, 4500, 4502, 4507, 4508, 4512, 4514, 4515,
4519, 4521, 4522, 4524, 4525, 4529, 4531, 4535, 4541, 4543, 4548, 4549, 4551, 4554, 4556, 4557, 4558, 4560, 4561, 4562, 4565, 4566, 4568, 4575, 4576, 4580, 4582, 4583, 4590, 4591, 4593, 4594, 4597, 4598, 4601, 4606, 4612, 4613, 4616, 4618, 4623, 4625, 4628, 4630, 4632, 4634, 4635, 4639, 4641, 4643, 4644, 4645, 4646, 4647, 4650, 4651, 4653, 4654, 4655, 4656, 4658, 4659, 4662, 4664, 4667, 4669, 4671, 4673, 4674, 4676, 4677, 4680, 4682, 4685, 4691, 4692, 4693, 4697, 4699, 4700, 4703, 4706, 4710, 4711, 4713, 4716, 4719, 4721, 4722, 4723, 4724, 4729, 4730, 4734, 4737, 4738, 4739, 4740, 4741, 4745, 4749, 4753, 4755, 4756, 4760, 4761, 4762, 4763, 4764, 4766, 4767, 4769, 4770, 4771, 4773, 4775, 4779, 4780, 4784, 4787, 4788, 4789, 4790, 4795, 4796, 4801, 4803, 4804, 4805, 4806, 4807, 4813, 4814, 4818, 4822, 4827, 4828, 4830, 4831, 4834, 4836, 4840, 4841, 4842, 4855, 4856, 4857, 4861, 4862, 4863, 4864, 4869, 4874, 4875, 4878, 4881, 4887, 4889, 4891, 4893, 4896, 4897, 4900, 4904, 4907, 4909, 4910, 4913, 4914, 4920, 4921, 4922, 4928, 4930, 4935, 4936, 4937, 4941, 4942, 4944, 4945, 4954, 4956, 4958, 4959, 4960, 4967, 4969, 4971, 4972, 4974, 4975, 4980, 4983, 4985, 4987, 4993, 4996, 5007, 5013, 5015, 5016, 5021, 5023, 5024, 5026, 5029, 5030, 5034, 5036, 5037, 5038, 5039, 5040, 5042, 5044, 5045, 5046, 5051, 5052, 5054, 5057, 5060, 5065, 5067, 5068, 5069, 5072, 5075, 5078, 5082, 5087, 5088, 5089, 5094, 5100, 5101, 5102, 5106, 5110, 5113, 5114, 5119, 5120, 5122, 5123, 5125, 5131, 5132, 5140, 5143, 5145, 5147, 5149, 5153, 5159, 5160, 5163, 5164, 5165, 5166, 5168, 5170, 5172, 5174, 5180, 5181, 5182, 5184, 5185, 5187, 5188, 5189, 5190, 5191, 5192, 5193, 5195, 5196, 5198, 5199, 5200, 5202, 5206, 5212, 5213, 5216, 5218, 5219, 5224, 5225, 5229, 5234, 5240, 5241, 5244, 5245, 5248, 5251, 5253, 5254, 5255, 5256, 5257, 5258, 5260, 5261, 5262, 5263, 5266, 5268, 5269, 5273, 5275, 5276, 5280, 5281, 5282, 5283, 5286, 5293, 5297, 5298, 5299, 5300, 5301, 5308, 5311, 5314, 5315, 5317, 5319, 5321, 5324, 5329, 5330, 5333, 5334, 5338, 5339, 5343, 5344, 5345, 5346, 5348, 5349, 5352, 5361, 5366, 5367, 5369, 5386, 5388, 5389, 5393, 5395, 5396, 5397, 5398, 5400, 5405, 5413, 5414, 5418, 5422, 5427, 5428, 5431, 5434, 5438, 5445, 5446, 5450, 5452, 5453, 5456, 5458, 5459, 5461, 5472, 5475, 5480, 5483, 5487, 5491, 5493, 5495, 5496, 5498, 5505, 5508, 5510, 5512, 5513, 5515, 5517, 5518, 5519, 5524, 5530, 5531, 5532, 5535, 5543, 5545, 5547, 5549, 5554, 5558, 5563, 5564, 5566, 5568, 5569, 5572, 5575, 5579, 5581, 5582, 5584, 5585, 5586, 5587, 5589, 5592, 5593, 5594, 5597, 5599, 5602, 5608, 5610, 5613, 5614, 5615, 5616, 5620, 5623, 5627, 5632, 5633, 5635, 5638, 5640, 5643, 5647, 5648, 5649, 5650, 5651, 5652, 5653, 5656, 5659, 5660, 5663, 5664, 5667, 5669, 5675, 5676, 5680, 5681, 5689, 5690, 5694, 5695, 5696, 5697, 5698, 5702, 5706, 5711, 5712, 5713, 5714, 5717, 5718, 5719, 5721, 5722, 5729, 5730, 5731, 5732, 5734, 5735, 5736, 5737, 5738, 5742, 5744, 5746, 5748, 5751, 5764, 5768, 5770, 5771, 5775, 5778, 5780, 5782, 5783, 5785, 5787, 5791, 5792, 5794, 5803, 5806, 5807, 5808, 5810, 5811, 5817, 5820, 5823, 5826, 5828, 5832, 5833, 5834, 5835, 5836, 5839, 5842, 5844, 5853, 5854, 5859, 5864, 5866, 5867, 5869, 5871, 5872, 5873, 5876, 5877, 5878, 5879, 5881, 5882, 5883, 5884, 5888, 5889, 5892, 5893, 5900, 5901, 5902, 5906, 5907, 5910, 5912, 5913, 5914, 5918, 5919, 5921, 5925, 5926, 5927, 5928, 5931, 5932, 5933, 5936, 5938, 5939, 5940, 5941, 5943, 5944, 5945, 5948, 5951, 5952, 5954, 5956, 5957, 5959, 5961, 5968, 5971, 5978, 5979, 5980, 5985, 5986, 5988, 5990, 5991, 5992, 5994, 5996, 5997, 6000, 6002, 6003, 6004, 6005, 6006, 6007, 6012, 6013, 6016, 6017, 6019, 6025, 6026, 6038, 6040, 6041, 6044, 6045, 6047, 6048, 6051, 6053, 6054, 6058, 6059, 6060, 6061, 6062, 6063, 6068, 6069, 6070, 6072, 6073, 6074, 6075, 6080, 6083, 6085, 6092, 6093, 6094, 6095, 6097, 6098, 6107, 6108, 6109, 6110, 6112, 6113, 6116, 6118, 6119, 6122, 6125, 6129, 6130, 6131, 6132, 6133, 6136, 6137, 6138, 6145, 6146, 6147, 6151, 6152, 6153, 6156, 6163, 6164, 6165, 6168, 6170, 6173, 6182, 6183, 6186, 6188, 6189, 6190, 6191, 6193, 6196, 6197, 6198, 6200, 6203, 6205, 6207, 6209, 6212, 6213, 6215, 6220, 6221, 6223, 6224, 6227, 6228, 6230, 6231, 6234, 6238, 6241, 6243, 6246, 6249, 6251, 6255, 6257, 6258, 6259, 6264, 6265, 6269, 6270, 6271, 6272, 6273, 6278, 6279, 6280, 6282, 6283, 6284, 6285, 6286, 6287, 6289, 6292, 6294, 6296, 6299, 6300, 6302, 6304, 6309, 6310, 6311, 6315, 6317, 6319, 6321, 6322, 6325, 6326, 6328, 6333, 6338, 6345, 6351, 6352, 6353, 6354, 6359, 6360, 6362, 6363, 6364, 6367, 6370, 6372, 6378, 6381, 6383, 6394, 6395, 6396, 6397, 6398, 6399, 6403, 6405, 6407, 6412, 6414, 6415, 6419, 6420, 6422, 6429, 6430, 6431, 6434, 6435, 6436, 6437, 6440, 6441, 6442, 6452, 6454, 6456, 6458, 6459, 6463, 6464, 6466, 6467, 6468, 6469, 6470, 6471, 6474, 6476, 6480, 6482, 6486, 6488, 6495, 6500, 6501, 6502, 6503, 6504, 6505, 6510, 6513, 6514, 6516, 6517, 6519, 6524, 6530, 6533, 6534, 6535, 6537, 6539, 6543, 6544, 6547, 6548, 6549, 6554, 6555, 6558, 6560, 6561, 6563, 6567, 6569, 6572, 6574, 6576, 6577, 6579, 6581, 6582, 6584, 6587, 6588, 6595, 6597, 6598, 6600, 6603, 6607, 6609, 6611, 6621, 6622, 6624, 6626, 6627, 6628, 6630, 6634, 6635, 6637, 6638, 6639, 6643, 6649, 6650, 6655, 6656, 6658, 6662, 6666, 6667, 6671, 6672, 6678, 6679, 6681, 6691, 6692, 6695, 6699, 6703, 6705, 6706, 6711, 6714, 6716, 6718, 6720, 6724, 6729, 6731, 6733, 6734, 6737, 6739, 6746, 6747, 6748, 6749, 6758, 6759, 6760, 6761, 6766, 6776, 6778, 6779, 6780, 6783, 6786, 6788, 6793, 6794, 6795, 6799, 6803, 6804, 6805, 6807, 6810, 6811, 6812, 6813, 6816, 6819, 6820, 6821, 6824, 6827, 6828, 6829, 6830, 6834, 6836, 6837, 6839, 6840, 6841, 6843, 6845, 6848, 6852, 6859, 6864, 6865, 6869, 6872, 6874, 6875, 6878, 6879, 6880, 6882, 6883, 6886, 6897, 6903, 6906, 6909, 6914, 6915, 6919, 6920, 6921, 6930, 6933, 6936, 6941, 6944, 6946, 6948, 6950, 6952, 6959, 6960, 6963, 6967, 6969, 6979, 6980, 6984, 6985, 6987, 6988, 6990, 6993, 6994, 6999, 7006, 7010, 7011, 7012, 7013, 7015, 7022, 7031, 7032, 7035, 7042, 7043, 7045, 7048, 7051, 7052, 7053, 7056, 7057, 7060, 7062, 7064, 7069, 7072, 7073, 7074, 7075, 7077, 7083, 7085, 7086, 7097, 7105, 7107, 7108, 7109, 7112, 7116, 7117, 7118, 7124, 7126, 7130, 7132, 7134, 7135, 7137, 7140, 7142, 7144, 7146, 7149, 7154, 7155, 7163, 7164, 7165, 7166, 7167, 7169, 7172, 7173, 7174, 7176, 7177, 7182, 7184, 7187, 7188, 7189, 7192, 7193, 7194, 7196, 7201, 7202, 7203, 7206, 7207, 7209, 7212, 7216, 7217, 7218, 7219, 7227, 7228, 7232, 7233, 7234, 7235, 7236, 7239, 7240, 7243, 7244, 7245, 7248, 7254, 7255, 7257, 7258, 7259, 7262, 7267, 7268, 7274, 7276, 7277, 7278, 7282, 7284, 7286, 7287, 7288, 7290, 7291, 7292, 7293, 7298, 7299, 7300, 7301, 7303, 7304, 7305, 7306, 7307, 7310, 7313, 7315, 7317, 7321, 7328, 7330, 7340, 7344, 7345, 7354, 7355, 7356, 7357, 7358, 7365, 7371, 7373, 7379, 7382, 7383, 7388, 7389, 7392, 7395, 7398, 7399, 7400, 7409, 7411, 7415, 7425, 7428, 7430, 7434, 7435, 7436, 7438, 7441, 7443, 7444, 7445, 7446, 7447, 7448, 7454, 7458, 7459, 7466, 7470, 7474, 7475, 7483, 7486, 7487, 7490, 7493, 7498, 7504, 7505, 7506, 7512, 7515, 7517, 7518, 7523, 7525, 7528, 7533, 7534, 7537, 7538, 7542, 7546, 7547, 7548, 7554, 7557, 7561, 7565, 7570, 7577, 7578, 7579, 7580, 7585, 7586, 7589, 7591, 7594, 7595, 7605, 7611, 7619, 7620, 7621, 7623, 7624, 7633, 7639, 7640, 7642, 7643, 7652, 7653, 7661, 7663, 7664, 7665, 7666, 7667, 7674, 7677, 7678, 7679, 7680, 7682, 7685, 7687, 7689, 7695, 7699, 7700, 7703, 7704, 7708, 7712, 7713, 7717, 7718, 7719, 7724, 7725, 7727, 7729, 7733, 7736, 7737, 7738, 7740, 7743, 7744, 7745, 7747, 7751, 7753, 7761, 7762, 7763, 7764, 7767, 7768, 7769, 7770, 7774, 7775, 7777, 7778, 7779, 7782, 7783, 7785, 7786, 7788, 7791, 7793, 7796, 7798, 7800, 7803, 7804, 7806, 7807, 7812, 7815, 7818, 7819, 7820, 7824, 7825, 7832, 7833, 7834, 7838, 7841, 7844, 7845, 7848, 7849, 7853, 7856, 7859, 7860, 7862, 7863, 7865, 7870, 7873, 7876, 7878, 7881, 7888, 7890, 7896, 7900, 7908, 7909, 7910, 7911, 7913, 7918, 7921, 7922, 7923, 7925, 7927, 7929, 7934, 7935, 7936, 7938, 7942, 7944, 7945, 7946, 7947, 7948, 7952, 7955, 7956, 7960, 7964, 7972, 7974, 7976, 7977, 7978, 7980, 7981, 7983, 7984, 7986, 7989, 7990, 7991, 7993, 7998, 7999, 8001, 8005, 8006, 8007, 8008, 8009, 8012, 8020, 8023, 8026, 8029, 8036, 8039, 8042, 8044, 8047, 8052, 8053, 8056, 8058, 8059, 8061, 8063, 8067, 8068, 8073, 8075, 8076, 8078, 8080, 8082, 8084, 8088, 8091, 8093, 8095, 8100, 8103, 8105, 8106, 8112, 8116, 8118, 8121, 8126, 8130, 8134, 8136, 8137, 8143, 8147, 8148, 8150, 8151, 8158, 8159, 8162, 8163, 8165, 8168, 8170, 8176, 8178, 8179, 8182, 8184, 8185, 8187, 8188, 8189, 8192, 8193, 8195, 8199, 8202, 8204, 8207, 8208, 8211, 8213, 8216, 8217, 8219, 8220, 8222, 8223, 8225, 8227, 8231, 8234, 8235, 8236, 8237, 8239, 8240, 8242, 8245, 8246, 8250, 8252, 8253, 8266, 8268, 8269, 8270, 8272, 8274, 8282, 8288, 8289, 8292, 8293, 8294, 8300, 8301, 8304, 8310, 8311, 8312, 8313, 8317, 8318, 8319, 8320, 8323, 8329, 8331, 8336, 8339, 8340, 8349, 8350, 8352, 8353, 8355, 8361, 8363, 8367, 8368, 8373, 8376, 8379, 8385, 8387, 8389, 8390, 8392, 8395, 8401, 8402, 8403, 8404, 8405, 8409, 8410, 8413, 8414, 8416, 8423, 8433, 8435, 8436, 8438, 8439, 8441, 8442, 8444, 8445, 8446, 8447, 8448, 8450, 8451, 8452, 8457, 8458, 8459, 8472, 8473, 8474, 8476, 8480, 8481, 8482, 8486, 8490, 8493, 8498, 8501, 8502, 8503, 8505, 8509, 8511, 8513, 8515, 8517, 8520, 8523, 8524, 8528, 8531, 8533, 8535, 8537, 8538, 8539, 8542, 8544, 8549, 8550, 8551, 8552, 8553, 8554, 8561, 8562, 8565, 8566, 8568, 8575, 8576, 8579, 8581, 8582, 8589, 8590, 8592, 8593, 8594, 8596, 8597, 8599, 8600, 8601, 8603, 8605, 8609, 8611, 8612, 8613, 8614, 8617, 8618, 8624, 8630, 8631, 8634, 8635, 8637, 8638, 8640, 8642, 8644, 8648, 8650, 8654, 8657, 8658, 8659, 8663, 8665, 8669, 8672, 8676, 8677, 8685, 8693, 8694, 8700, 8703, 8704, 8706, 8708, 8709, 8713, 8716, 8717, 8720, 8726, 8728, 8729, 8732, 8734, 8736, 8740, 8741, 8742, 8744, 8745, 8746, 8748, 8761, 8764, 8766, 8767, 8770, 8772, 8773, 8776, 8777, 8779, 8782, 8783, 8784, 8789, 8792, 8797, 8803, 8805, 8810, 8818, 8821, 8822, 8824, 8829, 8830, 8831, 8832, 8834, 8835, 8838, 8839, 8843, 8846, 8853, 8859, 8861, 8865, 8866, 8867, 8875, 8878, 8881, 8883, 8884, 8886, 8888, 8890, 8891, 8892, 8896, 8897, 8899, 8900, 8902, 8907, 8908, 8909, 8910, 8911, 8913, 8914, 8917, 8919, 8924, 8926, 8929, 8930, 8935, 8941, 8942, 8945, 8946, 8949, 8951, 8954, 8956, 8957, 8959, 8960, 8961, 8962, 8963, 8967, 8968, 8969, 8972, 8974, 8976, 8977, 8979, 8980, 8981, 8985, 8986, 8992, 8996, 8998, 8999, 9000, 9001, 9002, 9003, 9006, 9009, 9012, 9015, 9018, 9020, 9023, 9029, 9030, 9033, 9037, 9044, 9052, 9056, 9057, 9058, 9059, 9060, 9061, 9066, 9069, 9071, 9072, 9073, 9074, 9076, 9080, 9084, 9091, 9092, 9095, 9096, 9105, 9108, 9109, 9110, 9111, 9112, 9114, 9115, 9116, 9118, 9120, 9123, 9124, 9125, 9128, 9129, 9133, 9134, 9138, 9139, 9140, 9141, 9142, 9149, 9151, 9152, 9155, 9167, 9168, 9172, 9173, 9174, 9175, 9177, 9179, 9183, 9185, 9187, 9188, 9190, 9195, 9199, 9206, 9207, 9210, 9211, 9213, 9214, 9215, 9216, 9223, 9226, 9229, 9233, 9241, 9243, 9247, 9248, 9249, 9252, 9253, 9255, 9263, 9265, 9267, 9270, 9273, 9276, 9278, 9284, 9285, 9288, 9290, 9292, 9293, 9298, 9299, 9300, 9304, 9308, 9311, 9314, 9320, 9323, 9325, 9326, 9327, 9328, 9329, 9330, 9333, 9336, 9337, 9339, 9340, 9341, 9345, 9346, 9347, 9348, 9354, 9355, 9359, 9367, 9373, 9375, 9376, 9382, 9383, 9388, 9391, 9392, 9393, 9394, 9396, 9398, 9400, 9402, 9403, 9404, 9406, 9407, 9412, 9413, 9414, 9415, 9423, 9432, 9433, 9434, 9440, 9442, 9444, 9449, 9451, 9452, 9456, 9459, 9460, 9468, 9471, 9472, 9473, 9478, 9483, 9488, 9490, 9494, 9495, 9497, 9500, 9501, 9502, 9503, 9504, 9505, 9509, 9514, 9515, 9517, 9518, 9519, 9520, 9525, 9531, 9532, 9533, 9534, 9536, 9540, 9545, 9546, 9548, 9549, 9553, 9554, 9555, 9559, 9561, 9563, 9564, 9565, 9568, 9571, 9573, 9577, 9582, 9583, 9587, 9589, 9590, 9591, 9596, 9602, 9606, 9609, 9613, 9617, 9618, 9620, 9623, 9624, 9626, 9627, 9628, 9629, 9633, 9635, 9640, 9641, 9642, 9644, 9645, 9646, 9648, 9649, 9650, 9653, 9655, 9656, 9658, 9659, 9660, 9663, 9666, 9668, 9670, 9677, 9681, 9682, 9686, 9692, 9694, 9698, 9700, 9706, 9707, 9715, 9718, 9722, 9723, 9724, 9725, 9726, 9729, 9730, 9731, 9733, 9734, 9737, 9744, 9745, 9746, 9750, 9753, 9754, 9756, 9763, 9764, 9767, 9768, 9770, 9776, 9780, 9781, 9782, 9784, 9786, 9792, 9793, 9794, 9796, 9799, 9810, 9812, 9813, 9814, 9816, 9819, 9824, 9825, 9827, 9829, 9830, 9833, 9836, 9845, 9847, 9849, 9850, 9851, 9853, 9861, 9864, 9866, 9869, 9871, 9873, 9882, 9886, 9887, 9892, 9897, 9901, 9906, 9907, 9908, 9909, 9910, 9917, 9923, 9924, 9928, 9930, 9935, 9938, 9940, 9946, 9947, 9949, 9950, 9953, 9955, 9957, 9960, 9962, 9963, 9964, 9967, 9968, 9971, 9972, 9979, 9980, 9982, 9984, 9985, 9987, 9988, 9990, 9997, 9998, 10000, 10008, 10009, 10010, 10017, 10018, 10019, 10021, 10022, 10026, 10031, 10033, 10037, 10038, 10040, 10041, 10042, 10043, 10044, 10045, 10048, 10051, 10052, 10054, 10056, 10059, 10060, 10062, 10063, 10064, 10068, 10075, 10077, 10078, 10083, 10089, 10091, 10092, 10093, 10095, 10097, 10101, 10102, 10103, 10105, 10106, 10107, 10108, 10109, 10110, 10114, 10115, 10116, 10117, 10118, 10119, 10122, 10127, 10128, 10131, 10132, 10136, 10138, 10141, 10143, 10146, 10149, 10151, 10152, 10158, 10163, 10165, 10166, 10168, 10170, 10174, 10176, 10178, 10181, 10182, 10191, 10192, 10193, 10194, 10195, 10197, 10199, 10203, 10209, 10213, 10214, 10218, 10219, 10220, 10222, 10223, 10225, 10228, 10231, 10233, 10234, 10236, 10237, 10238, 10239, 10242, 10247, 10252, 10255, 10258, 10275, 10278, 10284, 10286, 10291, 10292, 10293, 10295, 10300, 10302, 10306, 10307, 10311, 10321, 10323, 10324, 10325, 10326, 10328, 10330, 10331, 10333, 10334, 10335, 10336, 10338, 10352, 10353, 10357, 10359, 10360, 10362, 10364, 10368, 10373, 10375, 10376, 10378, 10380, 10384, 10385, 10388, 10389, 10397, 10398, 10399, 10400, 10401, 10405, 10408, 10410, 10413, 10414, 10416, 10421, 10422, 10423, 10427, 10428, 10429, 10430, 10435, 10437, 10438, 10440, 10442, 10443, 10446, 10448, 10449, 10450, 10451, 10453, 10455, 10463, 10464, 10465, 10468, 10469, 10470, 10474, 10478, 10480, 10482, 10492, 10494, 10495, 10496, 10497, 10504, 10506, 10508, 10514, 10515, 10518, 10521, 10525, 10527, 10528, 10530, 10531, 10533, 10535, 10536, 10541, 10542, 10543, 10544, 10547, 10548, 10555, 10556, 10558, 10560, 10561, 10562, 10563, 10565, 10567, 10569, 10571, 10577, 10580, 10581, 10582, 10583, 10585, 10589, 10591, 10593, 10595, 10596, 10597, 10600, 10601, 10602, 10609, 10610, 10611, 10614, 10615, 10616, 10617, 10621, 10622, 10623, 10626, 10628, 10629, 10630, 10631, 10633, 10637, 10638, 10639, 10640, 10641, 10642, 10645, 10646, 10649, 10650, 10655, 10657, 10663, 10665, 10668, 10671, 10673, 10674, 10677, 10678, 10681, 10682, 10683, 10684, 10685, 10687, 10689, 10693, 10697, 10698, 10699, 10700, 10702, 10703, 10705, 10707, 10708, 10711, 10712, 10715, 10716, 10723, 10725, 10726, 10727, 10730, 10732, 10734, 10735, 10736, 10737, 10740, 10744, 10747, 10748, 10749, 10752, 10753, 10756, 10761, 10762, 10763, 10766, 10775, 10778, 10779, 10782, 10784, 10785, 10787, 10788, 10790, 10791, 10795, 10796, 10798, 10800, 10801, 10802, 10803, 10805, 10809, 10810, 10811, 10813, 10818, 10819, 10820, 10821, 10824, 10825, 10826, 10831, 10832, 10833, 10836, 10838, 10839, 10840, 10841, 10843, 10845, 10846, 10850, 10852, 10853, 10858, 10860, 10861, 10862, 10864, 10867, 10870, 10874, 10876, 10877, 10880, 10881, 10892, 10896, 10897, 10898, 10899, 10902, 10903, 10905, 10912, 10917, 10920, 10926, 10927, 10930, 10933, 10934, 10935, 10936, 10937, 10938, 10941, 10944, 10947, 10948, 10950, 10954, 10957, 10960, 10962, 10963, 10964, 10967, 10972, 10977, 10978, 10980, 10981, 10985, 10988, 10993, 10995, 10996, 10997, 10998, 10999, 11002, 11004, 11005, 11006, 11008, 11009, 11010, 11015, 11016, 11018, 11022, 11024, 11030, 11032, 11036, 11037, 11039, 11044, 11045, 11046, 11047, 11049, 11053, 11056, 11058, 11060, 11061, 11066, 11068, 11070, 11071, 11072, 11078, 11079, 11080, 11082, 11083, 11086, 11090, 11095, 11098, 11102, 11107, 11110, 11114, 11116, 11118, 11119, 11123, 11124, 11125, 11126, 11127, 11134, 11135, 11137, 11138, 11145, 11146, 11153, 11154, 11158, 11159, 11160, 11161, 11162, 11163, 11166, 11168, 11169, 11174, 11175, 11177, 11178, 11184, 11187, 11188, 11190, 11191, 11192, 11198, 11199, 11200, 11201, 11202, 11203, 11206, 11207, 11210, 11214, 11217, 11218, 11222, 11226, 11227, 11232, 11233, 11234, 11235, 11236, 11237, 11238, 11239, 11246, 11247, 11248, 11254, 11255, 11256, 11257, 11258, 11259, 11260, 11262, 11263, 11264, 11265, 11266, 11274, 11275, 11278, 11286, 11288, 11289, 11290, 11291, 11292, 11293, 11294, 11295, 11306, 11307, 11308, 11313, 11315, 11316, 11318, 11320, 11322, 11324, 11326, 11329, 11332, 11337, 11339, 11340, 11345, 11346, 11348, 11352, 11356, 11363, 11365, 11370, 11371, 11373, 11374, 11376, 11377, 11378, 11380, 11381, 11382, 11388, 11389, 11391, 11392, 11394, 11395, 11397, 11402, 11403, 11405, 11406, 11409, 11416, 11418, 11420, 11423, 11424, 11428, 11431, 11433, 11434, 11437, 11438, 11443, 11446, 11449, 11451, 11458, 11459, 11463, 11465, 11468, 11471, 11472, 11473, 11475, 11476, 11478, 11481, 11482, 11485, 11487, 11490, 11494, 11496, 11497, 11498, 11500, 11505, 11506, 11507, 11508, 11509, 11512, 11516, 11518, 11520, 11523, 11526, 11528, 11530, 11533, 11534, 11538, 11540, 11541, 11544, 11545, 11546, 11547, 11548, 11551, 11553, 11558, 11560, 11561, 11567, 11568, 11570, 11571, 11576, 11577, 11578, 11579, 11580, 11583, 11593, 11594, 11595, 11596, 11597, 11598, 11599, 11604, 11610, 11615, 11618, 11620, 11621, 11623, 11625, 11628, 11629, 11632, 11633, 11638, 11639, 11642, 11649, 11650, 11651, 11652, 11654, 11655, 11656, 11657, 11658, 11663, 11669, 11673, 11677, 11678, 11681, 11682, 11683, 11685, 11688, 11691, 11692, 11693, 11695, 11701, 11703, 11705, 11707, 11711, 11712, 11721, 11722, 11725, 11726, 11731, 11732, 11733, 11736, 11741, 11743, 11744, 11746, 11753, 11755, 11756, 11759, 11760, 11761, 11762, 11763, 11764, 11765, 11766, 11767, 11770, 11771, 11776, 11781, 11782, 11783, 11785, 11786, 11790, 11792, 11799, 11800, 11809, 11812, 11813, 11814, 11816, 11818, 11819, 11820, 11821, 11823, 11825, 11826, 11828, 11830, 11831, 11832, 11837, 11839, 11841, 11846, 11849, 11851, 11856, 11858, 11861, 11863, 11868, 11869, 11870, 11872, 11876, 11877, 11878, 11879, 11881, 11886, 11890, 11891, 11894, 11895, 11898, 11903, 11908, 11909, 11913, 11920, 11921, 11923, 11926, 11928, 11929, 11930, 11934, 11935, 11940, 11943, 11946, 11947, 11948, 11949, 11952, 11953, 11955, 11957, 11958, 11959, 11960, 11961, 11962, 11963, 11965, 11976, 11977, 11978, 11979, 11980, 11983, 11988, 11989, 11991, 11993, 11994, 11995, 11996, 11997, 11998, 11999, 12002, 12004, 12008, 12016, 12018, 12019, 12020, 12021, 12023, 12024, 12025, 12030, 12032, 12042, 12043, 12044, 12047, 12050, 12051, 12054, 12059, 12060, 12061, 12064, 12066, 12068, 12078, 12079, 12080, 12081, 12082, 12083, 12086, 12091, 12093, 12094, 12097, 12098, 12104, 12106, 12109, 12110, 12112, 12115, 12118, 12120, 12122, 12128, 12129, 12131, 12134, 12135, 12136, 12137, 12138, 12139, 12143, 12144, 12145, 12146, 12147, 12151, 12155, 12161, 12162, 12163, 12165, 12166, 12167, 12170, 12171, 12174, 12176, 12179, 12181, 12186, 12187, 12197, 12200, 12201, 12202, 12204, 12208, 12212, 12214, 12215, 12217, 12220, 12223, 12233, 12234, 12237, 12238, 12240, 12241, 12243, 12245, 12250, 12252, 12254, 12255, 12256, 12259, 12265, 12271, 12278, 12280, 12285, 12286, 12287, 12293, 12295, 12296, 12299, 12310, 12311, 12312, 12313, 12314, 12315, 12317, 12319, 12321, 12323, 12325, 12328, 12331, 12334, 12339, 12342, 12343, 12345, 12347, 12350, 12354, 12356, 12358, 12359, 12364, 12366, 12369, 12375, 12376, 12379, 12380, 12381, 12385, 12390, 12393, 12397, 12400, 12401, 12403, 12404, 12406, 12409, 12411, 12414, 12415, 12416, 12419, 12420, 12423, 12424, 12425, 12426, 12427, 12437, 12440, 12441, 12444, 12445, 12446, 12450, 12451, 12455, 12456, 12457, 12459, 12461, 12462, 12465, 12467, 12468, 12470, 12472, 12473, 12475, 12478, 12479, 12480, 12481, 12485, 12487, 12488, 12489, 12492, 12494, 12495, 12497, 12501, 12502, 12503, 12510, 12511, 12512, 12513, 12514, 12515, 12518, 12519, 12527, 12530, 12531, 12535, 12536, 12537, 12538, 12539, 12540, 12546, 12547, 12551, 12552, 12554, 12555, 12556, 12561, 12563, 12565, 12567, 12568, 12570, 12572, 12578, 12583, 12585, 12586, 12588, 12591, 12600, 12608, 12609, 12610, 12611, 12616, 12620, 12623, 12626, 12628, 12629, 12634, 12638, 12639, 12640, 12641, 12648, 12649, 12651, 12655, 12658, 12663, 12664, 12668, 12670, 12674, 12679, 12681, 12683, 12684, 12688, 12689, 12691, 12693, 12695, 12696, 12697, 12699, 12701, 12702, 12705, 12706, 12708, 12710, 12714, 12716, 12723, 12731, 12732, 12733, 12739, 12740, 12741, 12742, 12751, 12752, 12753, 12754, 12755, 12758, 12760, 12764, 12766, 12771, 12775, 12777, 12779, 12782, 12785, 12790, 12793, 12797, 12799, 12801, 12802, 12804, 12807, 12810, 12812, 12813, 12817, 12818, 12819, 12820, 12822, 12823, 12824, 12826, 12827, 12835, 12837, 12838, 12839, 12843, 12848, 12849, 12853, 12858, 12860, 12861, 12866, 12870, 12873, 12878, 12882, 12883, 12884, 12887, 12888, 12891, 12898, 12899, 12900, 12901, 12902, 12903, 12904, 12905, 12906, 12908, 12910, 12912, 12916, 12921, 12923, 12928, 12929, 12932, 12933, 12934, 12945, 12946, 12947, 12952, 12956, 12958, 12959, 12960, 12963, 12967, 12968, 12969, 12978, 12984, 12986, 12987, 12988, 12990, 12991, 12999, 13001, 13003, 13004, 13005, 13007, 13010, 13012, 13013, 13014, 13015, 13017, 13018, 13022, 13027, 13030, 13031, 13033, 13034, 13035, 13040, 13041, 13047, 13050, 13053, 13054, 13055, 13056, 13060, 13061, 13062, 13064, 13066, 13071, 13075, 13083, 13085, 13086, 13087, 13098, 13099, 13101, 13102, 13105, 13110, 13111, 13112, 13114, 13115, 13116, 13117, 13118, 13120, 13121, 13122, 13123, 13124, 13125, 13128, 13131, 13134, 13136, 13148, 13149, 13151, 13153, 13154, 13159, 13160, 13169, 13170, 13175, 13181, 13182, 13186, 13187, 13189, 13190, 13193, 13197, 13198, 13199, 13206, 13209, 13217, 13220, 13221, 13224, 13226, 13227, 13228, 13232, 13233, 13234, 13235, 13236, 13237, 13239, 13241, 13250, 13251, 13255, 13259, 13261, 13262, 13263, 13264, 13265, 13268, 13271, 13274, 13275, 13281, 13297, 13298, 13301, 13303, 13304, 13312, 13315, 13317, 13326, 13329, 13332, 13340, 13343, 13345, 13346, 13347, 13348, 13352, 13361, 13363, 13367, 13368, 13369, 13370, 13377, 13380, 13381, 13385, 13386, 13388, 13391, 13393, 13394, 13395, 13396, 13397, 13402, 13403, 13407, 13408, 13410, 13413, 13416, 13417, 13419, 13423, 13424, 13429, 13430, 13433, 13439, 13441, 13444, 13448, 13456, 13460, 13463, 13467, 13469, 13473, 13475, 13477, 13478, 13480, 13489, 13490, 13491, 13492, 13499, 13503, 13504, 13506, 13513, 13514, 13515, 13519, 13521, 13522, 13525, 13526, 13530, 13539, 13540, 13543, 13544, 13546, 13547, 13549, 13551, 13552, 13553, 13555, 13556, 13558, 13559, 13561, 13568, 13569, 13574, 13579, 13580, 13584, 13587, 13597, 13599, 13600, 13601, 13602, 13604, 13605, 13612, 13613, 13614, 13620, 13621, 13623, 13628, 13630, 13631, 13632, 13634, 13636, 13637, 13638, 13639, 13641, 13643, 13647, 13650, 13653, 13662, 13663, 13665, 13668, 13669, 13677, 13678, 13679, 13683, 13687, 13688, 13690, 13693, 13696, 13697, 13698, 13699, 13700, 13706, 13712, 13713, 13714, 13715, 13716, 13719, 13720, 13722, 13727, 13729, 13734, 13737, 13739, 13742, 13745, 13747, 13749, 13750, 13753, 13755, 13756, 13764, 13766, 13767, 13772, 13773, 13775, 13777, 13779, 13780, 13782, 13783, 13785, 13786, 13787, 13788, 13791, 13793, 13794, 13796, 13799, 13809, 13816, 13817, 13818, 13819, 13822, 13823, 13828, 13830, 13831, 13834, 13835, 13843, 13849, 13852, 13858, 13866, 13869, 13872, 13873, 13875, 13877, 13887, 13891, 13892, 13895, 13897, 13898, 13899, 13901, 13906, 13908, 13909, 13910, 13911, 13913, 13915, 13917, 13918, 13919, 13924, 13929, 13932, 13934, 13947, 13948, 13950, 13952, 13953, 13954, 13958, 13960, 13961, 13963, 13969, 13970, 13974, 13975, 13984, 13991, 14000, 14001, 14005, 14006, 14008, 14013, 14014, 14017, 14018, 14021, 14022, 14027, 14030, 14031, 14036, 14038, 14040, 14043, 14052, 14054, 14059, 14062, 14063, 14066, 14067, 14069, 14070, 14071, 14073, 14075, 14076, 14078, 14081, 14085, 14086, 14087, 14088, 14092, 14094, 14097, 14106, 14112, 14115, 14116, 14117, 14118, 14119, 14121, 14122, 14124, 14125, 14129, 14132, 14133, 14138, 14139, 14140, 14141, 14145, 14146, 14147.

Promoters expressing in the shoot apical meristem at the V5 stage include SEQ IDs: 3, 7, 9, 12, 14, 15, 16, 17, 19, 20, 26, 29, 31, 33, 34, 36, 37, 48, 54, 57, 63, 64, 65, 79, 80, 88, 93, 94, 96, 97, 98, 99, 101, 103, 104, 110, 111, 112, 117, 121, 123, 128, 130, 131, 132, 141, 142, 143, 144, 147, 148, 154, 156, 157, 159, 160, 162, 165, 172, 174, 175, 176, 181, 183, 187, 191, 193, 194, 196, 197, 199, 202, 203, 205, 207, 211, 212, 214, 223, 232, 233, 235, 236, 237, 239, 240, 242, 246, 249, 250, 251, 257, 259, 262, 264, 267, 269, 270, 271, 280, 286, 288, 289, 293, 294, 301, 302, 305, 306, 309, 316, 319, 320, 322, 323, 328, 329, 332, 334, 335, 338, 340, 346, 349, 352, 353, 354, 355, 356, 357, 358, 359, 360, 364, 365, 371, 373, 374, 378, 379, 381, 386, 388, 389, 395, 396, 401, 411, 412, 414, 423, 428, 431, 432, 433, 434, 436, 441, 448, 450, 452, 455, 456, 461, 462, 463, 466, 470, 471, 474, 478, 479, 483, 485, 488, 489, 496, 498, 504, 507, 509, 510, 511, 514, 515, 516, 517, 523, 525, 528, 532, 535, 537, 541, 542, 543, 544, 546, 547, 548, 553, 554, 557, 560, 561, 563, 565, 573, 577, 578, 580, 585, 588, 591, 592, 594, 595, 596, 598, 599, 602, 605, 606, 607, 608, 609, 613, 614, 619, 620, 623, 630, 631, 633, 634, 635, 636, 637, 638, 643, 645, 647, 650, 655, 659, 661, 662, 663, 664, 669, 670, 671, 681, 683, 687, 692, 693, 694, 701, 702, 705, 706, 709, 716, 717, 718, 719, 721, 722, 723, 724, 727, 731, 732, 734, 736, 739, 740, 742, 744, 749, 750, 753, 757, 759, 760, 761, 762, 763, 764, 765, 779, 782, 783, 784, 792, 793, 800, 804, 806, 808, 809, 811, 812, 820, 822, 824, 825, 826, 829, 830, 833, 836, 840, 845, 846, 849, 855, 856, 857, 858, 860, 862, 863, 864, 865, 870, 871, 872, 875, 876, 877, 882, 887, 890, 891, 892, 893, 895, 897, 898, 899, 903, 907, 908, 911, 912, 915, 916, 917, 919, 920, 924, 928, 929, 931, 932, 936, 939, 943, 944, 947, 949, 951, 953, 955, 957, 958, 960, 971, 974, 975, 976, 977, 978, 979, 980, 982, 984, 985, 987, 989, 993, 994, 995, 997, 999, 1002, 1003, 1007, 1008, 1009, 1010, 1011, 1012, 1013, 1014, 1016, 1017, 1019, 1022, 1025, 1026, 1032, 1033, 1035, 1038, 1039, 1040, 1041, 1042, 1043, 1046, 1047, 1049, 1051, 1052, 1054, 1055, 1056, 1057, 1059, 1064, 1065, 1067, 1069, 1070, 1073, 1074, 1076, 1077, 1080, 1085, 1086, 1087, 1089, 1092, 1095, 1096, 1100, 1101, 1103, 1104, 1110, 1112, 1114, 1115, 1116, 1117, 1119, 1121, 1125, 1130, 1132, 1136, 1137, 1140, 1146, 1148, 1154, 1155, 1160, 1161, 1165, 1167, 1168, 1170, 1171, 1176, 1178, 1183, 1189, 1191, 1193, 1196, 1200, 1201, 1204, 1205, 1213, 1214, 1218, 1220, 1222, 1223, 1225, 1228, 1230, 1231, 1236, 1239, 1240, 1244, 1248, 1249, 1251, 1253, 1254, 1257, 1258, 1261, 1262, 1263, 1272, 1277, 1281, 1282, 1285, 1286, 1290, 1292, 1293, 1296, 1303, 1306, 1307, 1309, 1311, 1312, 1314, 1316, 1320, 1321, 1322, 1323, 1327, 1330, 1331, 1334, 1339, 1345, 1347, 1349, 1356, 1360, 1363, 1364, 1366, 1367, 1368, 1371, 1375, 1376, 1377, 1380, 1383, 1387, 1389, 1393, 1394, 1396, 1398, 1399, 1404, 1405, 1406, 1407, 1412, 1415, 1420, 1421, 1423, 1426, 1431, 1432, 1433, 1435, 1438, 1440, 1441, 1442, 1447, 1448, 1451, 1453, 1458, 1459, 1461, 1462, 1466, 1472, 1475, 1484, 1487, 1488, 1490, 1491, 1492, 1493, 1498, 1499, 1503, 1504, 1506, 1508, 1510, 1511, 1512, 1514, 1518, 1519, 1525, 1526, 1527, 1528, 1530, 1539, 1543, 1545, 1546, 1549, 1550, 1551, 1554, 1555, 1556, 1559, 1560, 1561, 1564, 1566, 1567, 1570, 1571, 1575, 1578, 1584, 1585, 1586, 1588, 1590, 1591, 1594, 1596, 1597, 1598, 1599, 1600, 1601, 1602, 1604, 1605, 1609, 1610, 1612, 1614, 1615, 1616, 1617, 1622, 1623, 1625, 1634, 1635, 1636, 1637, 1638, 1639, 1641, 1643, 1650, 1651, 1653, 1654, 1658, 1659, 1662, 1663, 1669, 1671, 1673, 1675, 1676, 1678, 1681, 1682, 1684, 1687, 1688, 1689, 1690, 1691, 1696, 1697, 1698, 1699, 1703, 1705, 1706, 1707, 1708, 1710, 1716, 1717, 1718, 1720, 1725, 1729, 1732, 1735, 1750, 1755, 1758, 1759, 1760, 1761, 1764, 1769, 1770, 1773, 1774, 1776, 1777, 1778, 1785, 1786, 1791, 1792, 1793, 1798, 1807, 1808, 1809, 1811, 1812, 1813, 1822, 1825, 1826, 1828, 1830, 1832, 1834, 1837, 1839, 1840, 1848, 1849, 1852, 1859, 1861, 1863, 1866, 1867, 1869, 1872, 1873, 1876, 1879, 1880, 1882, 1884, 1886, 1888, 1891, 1894, 1897, 1898, 1899, 1900, 1901, 1902, 1905, 1906, 1910, 1911, 1915, 1916, 1918, 1920, 1922, 1923, 1924, 1928, 1930, 1931, 1933, 1934, 1936, 1939, 1940, 1942, 1945, 1948, 1949, 1950, 1951, 1952, 1953, 1956, 1958, 1968, 1969, 1970, 1971, 1972, 1973, 1974, 1979, 1986, 1990, 1991, 1993, 1994, 1995, 1996, 1999, 2000, 2007, 2008, 2009, 2010, 2012, 2014, 2015, 2016, 2017, 2019, 2021, 2026, 2032, 2033, 2037, 2040, 2041, 2042, 2043, 2048, 2057, 2058, 2060, 2062, 2064, 2066, 2072, 2074, 2077, 2078, 2085, 2087, 2088, 2089, 2091, 2092, 2093, 2094, 2097, 2099, 2101, 2103, 2104, 2106, 2107, 2112, 2122, 2123, 2125, 2128, 2132, 2133, 2137, 2139, 2140, 2142, 2143, 2146, 2147, 2150, 2151, 2156, 2157, 2161, 2164, 2167, 2168, 2170, 2172, 2173, 2175, 2177, 2178, 2179, 2185, 2188, 2189, 2193, 2195, 2196, 2202, 2203, 2205, 2206, 2210, 2215, 2216, 2218, 2221, 2222, 2223, 2226, 2235, 2240, 2241, 2242, 2243, 2244, 2253, 2257, 2259, 2260, 2263, 2266, 2267, 2274, 2276, 2278, 2280, 2282, 2283, 2284, 2288, 2291, 2296, 2297, 2298, 2300, 2303, 2304, 2305, 2306, 2308, 2309, 2310, 2313, 2314, 2322, 2323, 2328, 2329, 2331, 2333, 2339, 2342, 2348, 2353, 2358, 2363, 2366, 2367, 2369, 2371, 2372, 2376, 2379, 2380, 2381, 2382, 2384, 2395, 2401, 2402, 2405, 2410, 2412, 2413, 2414, 2416, 2418, 2419, 2420, 2422, 2423, 2428, 2430, 2431, 2432, 2433, 2434, 2435, 2437, 2439, 2440, 2441, 2442, 2443, 2445, 2449, 2452, 2453, 2454, 2457, 2458, 2469, 2470, 2472, 2474, 2476, 2477, 2479, 2480, 2481, 2485, 2487, 2489, 2490, 2492, 2494, 2495, 2496, 2498, 2500, 2505, 2506, 2507, 2509, 2513, 2514, 2515, 2516, 2517, 2519, 2521, 2525, 2526, 2528, 2529, 2531, 2533, 2534, 2536, 2537, 2538, 2539, 2541, 2544, 2545, 2549, 2550, 2551, 2552, 2554, 2555, 2556, 2559, 2560, 2567, 2568, 2570, 2573, 2576, 2578, 2579, 2581, 2583, 2589, 2590, 2591, 2594, 2596, 2599, 2601, 2605, 2607, 2609, 2611, 2613, 2616, 2617, 2619, 2620, 2622, 2625, 2626, 2627, 2632, 2634, 2635, 2636, 2639, 2641, 2644, 2645, 2648, 2649, 2651, 2652, 2655, 2656, 2658, 2661, 2662, 2663, 2671, 2672, 2674, 2676, 2679, 2684, 2685, 2687, 2688, 2689, 2690, 2691, 2692, 2694, 2700, 2702, 2704, 2706, 2709, 2711, 2719, 2720, 2721, 2722, 2723, 2725, 2726, 2728, 2729, 2730, 2735, 2736, 2745, 2746, 2747, 2749, 2752, 2755, 2756, 2758, 2759, 2760, 2762, 2764, 2765, 2770, 2775, 2776, 2779, 2782, 2784, 2787, 2788, 2789, 2791, 2794, 2796, 2798, 2800, 2802, 2805, 2808, 2812, 2814, 2819, 2821, 2822, 2823, 2824, 2826, 2827, 2828, 2832, 2838, 2840, 2844, 2845, 2850, 2854, 2855, 2860, 2861, 2865, 2869, 2871, 2876, 2878, 2888, 2889, 2892, 2893, 2894, 2895, 2896, 2897, 2898, 2901, 2902, 2903, 2906, 2908, 2909, 2915, 2916, 2917, 2918, 2919, 2922, 2923, 2926, 2929, 2930, 2931, 2935, 2941, 2942, 2943, 2946, 2947, 2948, 2955, 2959, 2962, 2963, 2965, 2966, 2968, 2976, 2978, 2979, 2982, 2985, 2987, 2992, 2994, 2998, 3000, 3003, 3005, 3007, 3008, 3009, 3013, 3015, 3017, 3018, 3019, 3020, 3023, 3029, 3031, 3033, 3039, 3041, 3042, 3044, 3045, 3047, 3048, 3049, 3051, 3052, 3053, 3055, 3062, 3064, 3065, 3067, 3068, 3070, 3072, 3075, 3080, 3083, 3085, 3087, 3090, 3095, 3096, 3097, 3100, 3101, 3106, 3115, 3118, 3119, 3120, 3121, 3122, 3123, 3126, 3127, 3128, 3137, 3139, 3143, 3149, 3153, 3167, 3169, 3170, 3172, 3177, 3179, 3181, 3189, 3191, 3192, 3194, 3196, 3202, 3205, 3206, 3208, 3210, 3217, 3218, 3220, 3221, 3224, 3225, 3228, 3230, 3237, 3240, 3242, 3246, 3249, 3250, 3252, 3254, 3261, 3263, 3266, 3267, 3269, 3271, 3272, 3273, 3278, 3280, 3283, 3286, 3288, 3289, 3290, 3291, 3294, 3295, 3297, 3299, 3301, 3308, 3310, 3312, 3313, 3314, 3324, 3331, 3332, 3333, 3337, 3338, 3340, 3342, 3343, 3345, 3347, 3351, 3353, 3355, 3356, 3357, 3358, 3359, 3360, 3361, 3363, 3369, 3370, 3373, 3374, 3376, 3377, 3378, 3379, 3382, 3383, 3386, 3394, 3396, 3399, 3403, 3404, 3405, 3413, 3415, 3416, 3418, 3419, 3424, 3426, 3427, 3428, 3432, 3438, 3442, 3445, 3446, 3447, 3449, 3450, 3452, 3453, 3458, 3461, 3465, 3466, 3468, 3469, 3470, 3471, 3474, 3477, 3483, 3484, 3486, 3488, 3490, 3493, 3494, 3499, 3500, 3502, 3503, 3504, 3506, 3507, 3510, 3516, 3517, 3518, 3521, 3522, 3523, 3524, 3529, 3533, 3535, 3536, 3537, 3538, 3540, 3541, 3544, 3545, 3546, 3548, 3549, 3554, 3558, 3560, 3562, 3569, 3571, 3574, 3576, 3580, 3587, 3588, 3589, 3592, 3594, 3595, 3599, 3600, 3603, 3604, 3606, 3607, 3610, 3611, 3613, 3615, 3616, 3620, 3622, 3624, 3629, 3633, 3634, 3636, 3637, 3640, 3642, 3643, 3644, 3645, 3646, 3648, 3655, 3659, 3660, 3661, 3667, 3672, 3674, 3677, 3681, 3682, 3684, 3685, 3690, 3693, 3704, 3706, 3707, 3709, 3713, 3715, 3718, 3719, 3721, 3722, 3723, 3725, 3726, 3729, 3730, 3731, 3732, 3733, 3738, 3739, 3744, 3749, 3752, 3756, 3757, 3760, 3763, 3764, 3765, 3766, 3775, 3777, 3778, 3783, 3785, 3787, 3791, 3792, 3793, 3794, 3798, 3801, 3806, 3808, 3817, 3818, 3819, 3823, 3825, 3830, 3831, 3832, 3833, 3834, 3835, 3837, 3838, 3843, 3844, 3845, 3846, 3847, 3849, 3852, 3858, 3859, 3860, 3866, 3867, 3870, 3871, 3872, 3873, 3876, 3881, 3882, 3883, 3884, 3887, 3889, 3890, 3892, 3894, 3895, 3897, 3902, 3903, 3904, 3907, 3908, 3909, 3912, 3913, 3917, 3918, 3924, 3926, 3928, 3929, 3934, 3935, 3938, 3941, 3947, 3950, 3951, 3952, 3954, 3958, 3962, 3964, 3967, 3968, 3970, 3971, 3972, 3974, 3975, 3976, 3977, 3978, 3983, 3985, 3988, 3994, 3995, 3996, 3997, 4000, 4001, 4002, 4003, 4007, 4008, 4013, 4014, 4019, 4020, 4028, 4030, 4033, 4037, 4039, 4040, 4041, 4042, 4043, 4046, 4047, 4048, 4050, 4051, 4052, 4053, 4054, 4055, 4056, 4057, 4062, 4066, 4067, 4068, 4070, 4071, 4075, 4080, 4084, 4088, 4092, 4094, 4096, 4102, 4105, 4106, 4109, 4110, 4111, 4113, 4116, 4117, 4122, 4124, 4126, 4128, 4132, 4133, 4134, 4135, 4140, 4143, 4144, 4146, 4147, 4148, 4149, 4150, 4151, 4155, 4160, 4163, 4164, 4165, 4166, 4167, 4168, 4171, 4175, 4176, 4178, 4181, 4183, 4185, 4187, 4188, 4189, 4190, 4191, 4192, 4193, 4195, 4197, 4201, 4202, 4204, 4205, 4206, 4207, 4208, 4210, 4211, 4212, 4213, 4218, 4219, 4221, 4227, 4228, 4229, 4232, 4233, 4234, 4235, 4237, 4244, 4245, 4246, 4251, 4252, 4257, 4260, 4261, 4266, 4270, 4272, 4275, 4276, 4280, 4281, 4283, 4284, 4288, 4290, 4295, 4296, 4298, 4300, 4301, 4302, 4304, 4305, 4306, 4309, 4312, 4314, 4317, 4320, 4321, 4324, 4329, 4330, 4332, 4335, 4338, 4339, 4341, 4347, 4358, 4359, 4360, 4369, 4370, 4374, 4375, 4378, 4380, 4383, 4388, 4390, 4391, 4396, 4397, 4401, 4402, 4403, 4404, 4405, 4406, 4409, 4410, 4417, 4422, 4423, 4432, 4436, 4439, 4440, 4442, 4443, 4446, 4448, 4449, 4450, 4453, 4456, 4461, 4462, 4463, 4466, 4467, 4468, 4474, 4475, 4479, 4485, 4486, 4490, 4492, 4494, 4497, 4498, 4500, 4502, 4507, 4508, 4509, 4512, 4513, 4514, 4515, 4519, 4521, 4525, 4529, 4531, 4535, 4541, 4543, 4545, 4548, 4549, 4551, 4554, 4555, 4556, 4557, 4558, 4560, 4562, 4563, 4565, 4566, 4567, 4568, 4575, 4576, 4578, 4579, 4580, 4582, 4583, 4590, 4591, 4594, 4597, 4598, 4601, 4606, 4614, 4616, 4623, 4625, 4628, 4630, 4632, 4633, 4634, 4635, 4639, 4641, 4643, 4644, 4646, 4647, 4650, 4651, 4653, 4654, 4655, 4656, 4658, 4659, 4662, 4664, 4667, 4669, 4671, 4672, 4673, 4674, 4676, 4677, 4682, 4685, 4688, 4691, 4692, 4694, 4697, 4699, 4700, 4701, 4703, 4706, 4708, 4710, 4711, 4713, 4719, 4720, 4721, 4724, 4729, 4730, 4736, 4737, 4738, 4739, 4740, 4741, 4745, 4746, 4749, 4750, 4751, 4753, 4754, 4755, 4756, 4761, 4762, 4763, 4766, 4767, 4769, 4770, 4771, 4773, 4775, 4779, 4780, 4784, 4787, 4788, 4789, 4790, 4791, 4794, 4795, 4796, 4801, 4803, 4804, 4805, 4806, 4807, 4812, 4813, 4814, 4815, 4818, 4822, 4823, 4828, 4830, 4831, 4834, 4838, 4840, 4841, 4842, 4854, 4855, 4856, 4857, 4858, 4859, 4861, 4862, 4863, 4864, 4869, 4874, 4875, 4876, 4878, 4880, 4881, 4887, 4889, 4891, 4895, 4896, 4897, 4900, 4902, 4904, 4905, 4907, 4909, 4910, 4913, 4914, 4921, 4922, 4924, 4935, 4936, 4937, 4941, 4942, 4944, 4950, 4954, 4955, 4958, 4959, 4963, 4967, 4969, 4971, 4972, 4974, 4975, 4980, 4985, 4987, 4989, 4990, 4993, 4994, 4996, 5000, 5010, 5014, 5015, 5016, 5024, 5026, 5029, 5030, 5036, 5037, 5039, 5040, 5041, 5042, 5044, 5045, 5046, 5049, 5052, 5054, 5057, 5060, 5067, 5068, 5072, 5074, 5075, 5078, 5082, 5089, 5090, 5091, 5094, 5100, 5101, 5102, 5106, 5107, 5109, 5110, 5113, 5114, 5115, 5116, 5123, 5125, 5131, 5132, 5140, 5143, 5147, 5149, 5151, 5159, 5160, 5163, 5164, 5165, 5168, 5170, 5174, 5180, 5181, 5184, 5185, 5187, 5188, 5189, 5190, 5191, 5192, 5193, 5196, 5198, 5200, 5202, 5206, 5209, 5212, 5213, 5217, 5218, 5219, 5221, 5225, 5234, 5239, 5240, 5244, 5245, 5249, 5251, 5253, 5254, 5255, 5258, 5260, 5261, 5263, 5264, 5267, 5268, 5269, 5273, 5274, 5275, 5276, 5279, 5280, 5281, 5282, 5283, 5285, 5292, 5293, 5297, 5298, 5299, 5300, 5301, 5308, 5311, 5315, 5317, 5319, 5321, 5324, 5328, 5329, 5330, 5333, 5334, 5338, 5339, 5342, 5345, 5346, 5348, 5349, 5351, 5352, 5366, 5367, 5369, 5371, 5386, 5388, 5389, 5391, 5393, 5395, 5396, 5397, 5404, 5405, 5409, 5411, 5413, 5414, 5417, 5418, 5422, 5427, 5428, 5431, 5434, 5437, 5438, 5446, 5448, 5449, 5452, 5453, 5456, 5458, 5459, 5461, 5462, 5475, 5483, 5485, 5487, 5488, 5491, 5493, 5495, 5496, 5505, 5508, 5509, 5510, 5512, 5513, 5515, 5517, 5518, 5519, 5524, 5526, 5529, 5530, 5531, 5532, 5534, 5535, 5537, 5543, 5545, 5549, 5554, 5561, 5562, 5563, 5566, 5568, 5569, 5572, 5575, 5579, 5581, 5582, 5584, 5585, 5589, 5591, 5593, 5594, 5597, 5602, 5608, 5610, 5613, 5614, 5615, 5616, 5618, 5620, 5623, 5627, 5630, 5632, 5633, 5635, 5638, 5640, 5643, 5647, 5648, 5649, 5650, 5651, 5652, 5653, 5656, 5659, 5660, 5662, 5663, 5669, 5673, 5680, 5681, 5683, 5689, 5690, 5691, 5694, 5695, 5696, 5697, 5698, 5702, 5706, 5711, 5712, 5713, 5714, 5717, 5718, 5719, 5721, 5722, 5729, 5730, 5731, 5732, 5734, 5735, 5736, 5737, 5740, 5742, 5744, 5748, 5751, 5768, 5770, 5773, 5775, 5778, 5780, 5783, 5784, 5785, 5787, 5791, 5792, 5794, 5803, 5805, 5807, 5808, 5809, 5811, 5814, 5815, 5817, 5820, 5825, 5826, 5828, 5832, 5833, 5834, 5835, 5836, 5839, 5842, 5844, 5846, 5854, 5859, 5864, 5866, 5867, 5869, 5871, 5872, 5873, 5875, 5876, 5877, 5878, 5879, 5881, 5882, 5883, 5888, 5889, 5892, 5893, 5906, 5910, 5912, 5918, 5919, 5921, 5922, 5923, 5925, 5926, 5927, 5928, 5930, 5931, 5932, 5933, 5938, 5939, 5940, 5941, 5942, 5944, 5945, 5947, 5948, 5951, 5954, 5957, 5959, 5961, 5967, 5968, 5969, 5971, 5973, 5978, 5979, 5980, 5985, 5986, 5990, 5991, 5994, 5996, 5997, 5999, 6000, 6003, 6004, 6005, 6006, 6007, 6010, 6012, 6013, 6016, 6017, 6023, 6025, 6026, 6031, 6034, 6038, 6040, 6041, 6044, 6046, 6047, 6048, 6051, 6053, 6058, 6059, 6061, 6062, 6063, 6065, 6068, 6069, 6070, 6072, 6073, 6074, 6075, 6077, 6080, 6081, 6088, 6089, 6091, 6092, 6093, 6094, 6095, 6096, 6098, 6107, 6108, 6109, 6110, 6112, 6113, 6116, 6118, 6119, 6122, 6129, 6130, 6132, 6133, 6135, 6136, 6137, 6140, 6143, 6145, 6146, 6147, 6149, 6151, 6153, 6156, 6160, 6163, 6164, 6165, 6168, 6173, 6176, 6182, 6183, 6186, 6188, 6189, 6190, 6191, 6193, 6197, 6198, 6200, 6205, 6207, 6209, 6212, 6213, 6215, 6220, 6221, 6223, 6224, 6226, 6227, 6228, 6230, 6231, 6233, 6234, 6237, 6238, 6239, 6240, 6241, 6243, 6244, 6245, 6246, 6247, 6248, 6249, 6251, 6255, 6257, 6258, 6259, 6260, 6264, 6265, 6269, 6270, 6271, 6272, 6273, 6275, 6278, 6279, 6280, 6281, 6282, 6283, 6284, 6285, 6286, 6292, 6294, 6299, 6302, 6308, 6309, 6310, 6311, 6312, 6315, 6317, 6319, 6321, 6322, 6325, 6326, 6328, 6332, 6333, 6338, 6346, 6350, 6351, 6352, 6353, 6354, 6359, 6362, 6363, 6364, 6367, 6370, 6372, 6375, 6378, 6379, 6381, 6383, 6394, 6395, 6396, 6397, 6398, 6399, 6403, 6405, 6407, 6408, 6410, 6412, 6413, 6414, 6415, 6419, 6420, 6422, 6425, 6428, 6429, 6430, 6431, 6434, 6436, 6437, 6442, 6449, 6454, 6458, 6459, 6463, 6464, 6466, 6467, 6468, 6469, 6470, 6471, 6474, 6476, 6480, 6481, 6484, 6486, 6488, 6493, 6495, 6497, 6499, 6500, 6501, 6502, 6503, 6504, 6505, 6510, 6513, 6514, 6515, 6516, 6517, 6519, 6524, 6525, 6526, 6530, 6532, 6533, 6534, 6535, 6537, 6543, 6544, 6547, 6548, 6549, 6552, 6554, 6555, 6558, 6560, 6561, 6563, 6564, 6567, 6572, 6574, 6576, 6577, 6579, 6581, 6582, 6584, 6587, 6588, 6589, 6595, 6598, 6599, 6600, 6603, 6607, 6609, 6611, 6614, 6621, 6622, 6624, 6625, 6626, 6627, 6630, 6634, 6635, 6637, 6638, 6639, 6640, 6643, 6644, 6646, 6647, 6648, 6649, 6652, 6655, 6656, 6658, 6662, 6666, 6671, 6677, 6678, 6681, 6686, 6691, 6692, 6696, 6703, 6705, 6706, 6711, 6714, 6716, 6718, 6720, 6724, 6725, 6729, 6731, 6734, 6736, 6737, 6739, 6746, 6747, 6752, 6756, 6757, 6759, 6761, 6764, 6766, 6778, 6779, 6780, 6783, 6786, 6788, 6792, 6793, 6794, 6797, 6799, 6803, 6804, 6805, 6807, 6810, 6811, 6812, 6813, 6816, 6819, 6820, 6821, 6824, 6827, 6828, 6830, 6831, 6834, 6836, 6839, 6840, 6841, 6842, 6843, 6845, 6848, 6854, 6859, 6864, 6869, 6870, 6872, 6874, 6875, 6876, 6878, 6879, 6880, 6884, 6888, 6890, 6892, 6897, 6903, 6904, 6906, 6913, 6914, 6915, 6917, 6919, 6920, 6921, 6925, 6930, 6933, 6936, 6941, 6943, 6944, 6946, 6948, 6950, 6951, 6952, 6959, 6963, 6969, 6979, 6980, 6984, 6985, 6987, 6988, 6990, 6991, 6993, 6994, 6995, 6999, 7002, 7003, 7005, 7006, 7009, 7011, 7012, 7013, 7015, 7017, 7022, 7032, 7039, 7042, 7043, 7045, 7046, 7051, 7052, 7053, 7056, 7057, 7064, 7067, 7068, 7072, 7074, 7075, 7077, 7079, 7083, 7084, 7085, 7086, 7093, 7094, 7097, 7105, 7106, 7107, 7108, 7112, 7116, 7117, 7118, 7124, 7130, 7132, 7135, 7137, 7140, 7142, 7144, 7146, 7149, 7151, 7155, 7163, 7164, 7165, 7166, 7169, 7176, 7177, 7182, 7183, 7184, 7187, 7188, 7192, 7194, 7196, 7197, 7201, 7203, 7206, 7207, 7208, 7216, 7217, 7218, 7219, 7227, 7228, 7230, 7231, 7232, 7233, 7234, 7235, 7236, 7239, 7240, 7241, 7243, 7244, 7245, 7248, 7255, 7257, 7258, 7259, 7262, 7267, 7268, 7269, 7270, 7274, 7276, 7277, 7281, 7282, 7284, 7287, 7288, 7291, 7292, 7293, 7298, 7299, 7300, 7301, 7303, 7304, 7305, 7306, 7307, 7310, 7311, 7312, 7315, 7317, 7328, 7330, 7334, 7338, 7339, 7340, 7344, 7348, 7354, 7355, 7356, 7357, 7358, 7361, 7363, 7365, 7371, 7373, 7379, 7380, 7381, 7382, 7383, 7388, 7389, 7392, 7395, 7398, 7400, 7401, 7410, 7411, 7417, 7425, 7428, 7430, 7434, 7435, 7436, 7438, 7443, 7444, 7445, 7446, 7447, 7448, 7452, 7454, 7458, 7459, 7464, 7466, 7470, 7472, 7483, 7486, 7487, 7490, 7492, 7493, 7498, 7504, 7505, 7512, 7515, 7517, 7518, 7523, 7524, 7525, 7528, 7529, 7533, 7537, 7538, 7542, 7546, 7547, 7548, 7560, 7561, 7570, 7574, 7577, 7578, 7579, 7580, 7583, 7585, 7586, 7587, 7588, 7590, 7591, 7593, 7594, 7601, 7605, 7611, 7617, 7619, 7620, 7621, 7623, 7624, 7632, 7633, 7634, 7635, 7638, 7639, 7640, 7642, 7643, 7647, 7652, 7658, 7661, 7663, 7664, 7665, 7666, 7667, 7674, 7677, 7678, 7679, 7680, 7682, 7685, 7687, 7689, 7695, 7699, 7700, 7703, 7704, 7708, 7712, 7713, 7716, 7717, 7718, 7719, 7724, 7725, 7729, 7730, 7733, 7736, 7737, 7738, 7740, 7743, 7744, 7745, 7747, 7749, 7751, 7753, 7755, 7761, 7762, 7763, 7764, 7767, 7768, 7769, 7770, 7772, 7774, 7775, 7777, 7778, 7779, 7780, 7782, 7785, 7786, 7788, 7791, 7792, 7793, 7796, 7798, 7800, 7803, 7804, 7806, 7807, 7812, 7815, 7818, 7819, 7820, 7823, 7824, 7825, 7832, 7833, 7834, 7838, 7841, 7844, 7847, 7848, 7849, 7856, 7858, 7859, 7860, 7862, 7863, 7865, 7873, 7876, 7878, 7888, 7890, 7895, 7896, 7900, 7908, 7909, 7910, 7911, 7917, 7918, 7920, 7922, 7923, 7925, 7927, 7929, 7933, 7934, 7935, 7936, 7937, 7938, 7942, 7943, 7944, 7945, 7946, 7947, 7948, 7949, 7950, 7952, 7953, 7955, 7956, 7964, 7965, 7966, 7967, 7972, 7974, 7976, 7977, 7978, 7980, 7982, 7983, 7984, 7986, 7988, 7989, 7990, 7991, 7992, 7993, 8004, 8006, 8012, 8021, 8026, 8029, 8035, 8039, 8042, 8044, 8045, 8047, 8048, 8049, 8052, 8053, 8056, 8058, 8059, 8061, 8063, 8064, 8066, 8067, 8068, 8071, 8075, 8076, 8077, 8078, 8079, 8080, 8082, 8084, 8088, 8091, 8093, 8095, 8099, 8100, 8102, 8103, 8105, 8112, 8116, 8118, 8120, 8121, 8126, 8130, 8136, 8137, 8145, 8146, 8147, 8150, 8155, 8159, 8162, 8163, 8164, 8165, 8170, 8174, 8176, 8178, 8179, 8186, 8189, 8193, 8195, 8199, 8202, 8204, 8207, 8208, 8210, 8211, 8213, 8215, 8216, 8219, 8220, 8222, 8223, 8225, 8227, 8231, 8234, 8235, 8237, 8239, 8245, 8250, 8252, 8253, 8257, 8258, 8262, 8265, 8266, 8268, 8269, 8270, 8272, 8274, 8289, 8291, 8292, 8293, 8294, 8300, 8301, 8302, 8304, 8306, 8310, 8311, 8312, 8315, 8318, 8319, 8320, 8321, 8324, 8329, 8331, 8339, 8340, 8349, 8350, 8351, 8352, 8353, 8355, 8363, 8367, 8368, 8369, 8373, 8379, 8385, 8386, 8387, 8389, 8392, 8393, 8395, 8400, 8401, 8402, 8403, 8404, 8407, 8410, 8413, 8414, 8416, 8417, 8418, 8423, 8427, 8430, 8433, 8436, 8438, 8439, 8441, 8444, 8446, 8447, 8448, 8449, 8450, 8451, 8452, 8457, 8460, 8465, 8466, 8469, 8472, 8473, 8474, 8476, 8477, 8480, 8481, 8482, 8485, 8486, 8490, 8493, 8498, 8501, 8502, 8505, 8509, 8511, 8513, 8515, 8517, 8520, 8523, 8524, 8525, 8527, 8528, 8531, 8532, 8533, 8537, 8538, 8539, 8541, 8544, 8549, 8550, 8552, 8554, 8557, 8561, 8562, 8565, 8566, 8568, 8575, 8576, 8579, 8581, 8582, 8584, 8589, 8590, 8593, 8594, 8596, 8597, 8599, 8600, 8601, 8603, 8605, 8609, 8610, 8611, 8612, 8614, 8617, 8618, 8621, 8624, 8631, 8634, 8637, 8638, 8640, 8641, 8642, 8644, 8650, 8654, 8657, 8658, 8659, 8660, 8663, 8665, 8669, 8670, 8672, 8676, 8677, 8685, 8693, 8699, 8700, 8703, 8706, 8708, 8709, 8713, 8716, 8717, 8719, 8720, 8726, 8729, 8730, 8731, 8732, 8734, 8735, 8736, 8740, 8741, 8745, 8746, 8748, 8752, 8753, 8755, 8757, 8759, 8764, 8766, 8767, 8770, 8772, 8773, 8775, 8777, 8779, 8782, 8783, 8784, 8789, 8792, 8796, 8797, 8803, 8804, 8805, 8810, 8817, 8818, 8822, 8824, 8829, 8831, 8832, 8834, 8835, 8836, 8838, 8841, 8843, 8846, 8853, 8854, 8861, 8865, 8867, 8876, 8877, 8878, 8880, 8881, 8883, 8884, 8886, 8888, 8889, 8891, 8892, 8896, 8897, 8899, 8900, 8905, 8907, 8908, 8909, 8910, 8911, 8912, 8913, 8914, 8916, 8917, 8926, 8929, 8930, 8935, 8938, 8941, 8942, 8945, 8946, 8949, 8951, 8954, 8957, 8959, 8960, 8961, 8962, 8963, 8967, 8968, 8969, 8972, 8974, 8976, 8977, 8979, 8980, 8981, 8985, 8986, 8992, 8996, 8998, 8999, 9001, 9002, 9003, 9006, 9009, 9012, 9015, 9017, 9018, 9020, 9023, 9026, 9027, 9029, 9030, 9033, 9037, 9044, 9047, 9052, 9057, 9058, 9059, 9060, 9062, 9066, 9069, 9071, 9072, 9073, 9074, 9076, 9084, 9088, 9091, 9092, 9095, 9096, 9097, 9100, 9103, 9105, 9108, 9110, 9111, 9112, 9114, 9118, 9120, 9123, 9125, 9129, 9133, 9134, 9136, 9138, 9139, 9140, 9141, 9142, 9146, 9149, 9151, 9154, 9155, 9157, 9173, 9174, 9177, 9179, 9183, 9185, 9187, 9188, 9190, 9191, 9195, 9200, 9204, 9206, 9207, 9210, 9211, 9213, 9215, 9216, 9218, 9226, 9229, 9233, 9234, 9235, 9237, 9241, 9243, 9247, 9252, 9253, 9254, 9255, 9263, 9265, 9267, 9269, 9270, 9273, 9276, 9278, 9284, 9285, 9287, 9288, 9290, 9292, 9293, 9298, 9299, 9300, 9302, 9304, 9308, 9311, 9320, 9323, 9325, 9326, 9327, 9328, 9329, 9330, 9336, 9337, 9338, 9339, 9340, 9341, 9345, 9346, 9347, 9348, 9354, 9355, 9357, 9359, 9366, 9367, 9373, 9375, 9376, 9378, 9382, 9383, 9388, 9389, 9391, 9392, 9393, 9394, 9396, 9398, 9400, 9402, 9403, 9404, 9406, 9407, 9413, 9414, 9415, 9417, 9423, 9432, 9433, 9434, 9440, 9443, 9444, 9451, 9452, 9456, 9460, 9468, 9471, 9472, 9473, 9478, 9481, 9483, 9486, 9488, 9490, 9494, 9495, 9497, 9500, 9501, 9502, 9503, 9504, 9509, 9514, 9515, 9517, 9518, 9519, 9525, 9532, 9533, 9534, 9536, 9540, 9545, 9548, 9553, 9555, 9557, 9559, 9560, 9563, 9564, 9565, 9567, 9568, 9571, 9577, 9582, 9583, 9586, 9587, 9589, 9590, 9591, 9602, 9606, 9608, 9609, 9610, 9613, 9614, 9618, 9620, 9623, 9626, 9627, 9628, 9629, 9630, 9633, 9634, 9635, 9640, 9641, 9642, 9644, 9645, 9646, 9648, 9649, 9650, 9652, 9655, 9656, 9657, 9658, 9659, 9660, 9663, 9666, 9668, 9670, 9681, 9682, 9686, 9687, 9692, 9693, 9694, 9698, 9700, 9706, 9710, 9711, 9717, 9718, 9722, 9723, 9725, 9726, 9729, 9730, 9731, 9732, 9733, 9734, 9737, 9746, 9749, 9750, 9751, 9753, 9754, 9755, 9756, 9763, 9764, 9767, 9768, 9770, 9774, 9776, 9780, 9781, 9782, 9784, 9786, 9791, 9792, 9794, 9796, 9799, 9801, 9804, 9806, 9809, 9812, 9813, 9816, 9819, 9820, 9824, 9825, 9827, 9830, 9833, 9836, 9845, 9846, 9847, 9849, 9850, 9851, 9853, 9854, 9861, 9864, 9866, 9869, 9871, 9873, 9882, 9885, 9886, 9887, 9892, 9897, 9900, 9901, 9902, 9906, 9907, 9908, 9909, 9910, 9911, 9912, 9917, 9923, 9924, 9928, 9935, 9938, 9940, 9946, 9947, 9949, 9950, 9953, 9955, 9957, 9958, 9960, 9962, 9963, 9964, 9967, 9968, 9969, 9971, 9972, 9974, 9979, 9980, 9982, 9984, 9985, 9987, 9988, 9990, 9991, 9996, 9997, 9998, 10000, 10008, 10009, 10010, 10013, 10017, 10018, 10019, 10021, 10022, 10026, 10031, 10032, 10033, 10034, 10037, 10038, 10041, 10042, 10043, 10045, 10047, 10048, 10050, 10051, 10052, 10054, 10056, 10058, 10060, 10062, 10064, 10066, 10068, 10073, 10075, 10077, 10078, 10082, 10083, 10086, 10089, 10090, 10091, 10092, 10093, 10095, 10097, 10101, 10102, 10103, 10105, 10106, 10107, 10108, 10109, 10110, 10114, 10115, 10116, 10118, 10119, 10122, 10127, 10128, 10131, 10132, 10136, 10138, 10141, 10143, 10146, 10149, 10151, 10152, 10154, 10158, 10161, 10162, 10163, 10165, 10166, 10168, 10170, 10174, 10176, 10177, 10178, 10181, 10182, 10187, 10191, 10192, 10193, 10194, 10195, 10197, 10199, 10203, 10206, 10209, 10212, 10214, 10218, 10219, 10220, 10222, 10223, 10225, 10228, 10231, 10232, 10233, 10236, 10237, 10239, 10246, 10247, 10252, 10253, 10255, 10257, 10263, 10268, 10270, 10275, 10284, 10286, 10291, 10292, 10295, 10296, 10297, 10300, 10302, 10306, 10307, 10311, 10321, 10322, 10323, 10325, 10326, 10327, 10328, 10331, 10333, 10334, 10335, 10336, 10338, 10342, 10343, 10346, 10351, 10353, 10356, 10357, 10359, 10360, 10362, 10364, 10368, 10369, 10371, 10373, 10375, 10378, 10380, 10383, 10384, 10385, 10388, 10389, 10397, 10398, 10399, 10401, 10409, 10410, 10413, 10414, 10416, 10421, 10422, 10423, 10430, 10435, 10437, 10438, 10440, 10442, 10443, 10446, 10447, 10448, 10449, 10450, 10453, 10456, 10460, 10463, 10464, 10465, 10468, 10469, 10470, 10474, 10478, 10480, 10482, 10487, 10488, 10492, 10494, 10496, 10499, 10504, 10506, 10508, 10513, 10514, 10516, 10518, 10525, 10527, 10528, 10531, 10532, 10533, 10535, 10536, 10537, 10541, 10542, 10543, 10544, 10545, 10547, 10548, 10549, 10550, 10551, 10555, 10556, 10558, 10560, 10561, 10562, 10565, 10567, 10569, 10571, 10573, 10577, 10580, 10581, 10582, 10583, 10585, 10587, 10591, 10593, 10595, 10596, 10597, 10599, 10601, 10602, 10606, 10610, 10611, 10613, 10615, 10616, 10617, 10621, 10622, 10623, 10626, 10628, 10634, 10637, 10638, 10639, 10640, 10641, 10642, 10643, 10645, 10646, 10650, 10655, 10657, 10659, 10660, 10663, 10665, 10666, 10668, 10670, 10671, 10673, 10674, 10677, 10678, 10681, 10682, 10683, 10684, 10685, 10687, 10689, 10693, 10697, 10698, 10699, 10700, 10701, 10702, 10703, 10705, 10706, 10707, 10711, 10715, 10716, 10721, 10722, 10723, 10725, 10726, 10732, 10734, 10735, 10736, 10737, 10740, 10741, 10744, 10745, 10748, 10749, 10752, 10761, 10762, 10763, 10766, 10775, 10778, 10779, 10782, 10784, 10785, 10787, 10788, 10790, 10791, 10792, 10795, 10796, 10798, 10800, 10801, 10802, 10803, 10804, 10805, 10809, 10810, 10811, 10812, 10813, 10815, 10818, 10819, 10820, 10821, 10822, 10823, 10824, 10825, 10826, 10831, 10833, 10836, 10838, 10839, 10841, 10843, 10846, 10847, 10850, 10852, 10853, 10854, 10857, 10858, 10860, 10861, 10862, 10866, 10867, 10871, 10874, 10876, 10877, 10878, 10880, 10881, 10887, 10891, 10892, 10893, 10896, 10897, 10898, 10899, 10902, 10905, 10910, 10912, 10913, 10916, 10917, 10920, 10926, 10927, 10928, 10930, 10933, 10934, 10935, 10936, 10937, 10938, 10940, 10941, 10944, 10947, 10948, 10950, 10954, 10957, 10960, 10962, 10965, 10967, 10972, 10976, 10977, 10979, 10980, 10988, 10993, 10995, 10996, 10997, 10999, 11004, 11005, 11006, 11008, 11009, 11010, 11018, 11024, 11027, 11032, 11039, 11045, 11046, 11047, 11052, 11053, 11056, 11060, 11068, 11070, 11071, 11078, 11080, 11082, 11083, 11086, 11090, 11095, 11098, 11099, 11100, 11101, 11102, 11107, 11108, 11110, 11114, 11116, 11117, 11118, 11119, 11123, 11124, 11125, 11127, 11128, 11129, 11132, 11133, 11135, 11137, 11138, 11145, 11146, 11148, 11152, 11154, 11158, 11159, 11160, 11161, 11162, 11163, 11165, 11166, 11168, 11169, 11175, 11177, 11178, 11181, 11184, 11185, 11187, 11188, 11190, 11191, 11192, 11194, 11198, 11199, 11201, 11202, 11203, 11207, 11210, 11214, 11217, 11218, 11222, 11226, 11227, 11228, 11229, 11232, 11233, 11234, 11235, 11236, 11237, 11238, 11239, 11246, 11247, 11248, 11251, 11256, 11257, 11258, 11259, 11260, 11261, 11262, 11263, 11264, 11266, 11274, 11275, 11278, 11288, 11289, 11290, 11291, 11292, 11293, 11294, 11295, 11298, 11305, 11306, 11307, 11313, 11315, 11316, 11317, 11319, 11320, 11322, 11324, 11326, 11329, 11332, 11337, 11339, 11340, 11345, 11346, 11348, 11349, 11352, 11356, 11358, 11363, 11364, 11365, 11366, 11370, 11371, 11373, 11374, 11377, 11381, 11382, 11387, 11388, 11389, 11391, 11392, 11394, 11395, 11397, 11398, 11403, 11405, 11406, 11409, 11416, 11418, 11423, 11426, 11428, 11430, 11431, 11434, 11437, 11438, 11445, 11446, 11449, 11451, 11459, 11463, 11465, 11467, 11471, 11472, 11475, 11476, 11477, 11478, 11481, 11482, 11485, 11487, 11496, 11497, 11498, 11500, 11501, 11506, 11507, 11508, 11509, 11512, 11516, 11520, 11523, 11524, 11527, 11528, 11530, 11531, 11532, 11533, 11534, 11535, 11538, 11541, 11544, 11546, 11547, 11548, 11551, 11553, 11558, 11560, 11561, 11564, 11567, 11568, 11571, 11574, 11576, 11577, 11578, 11579, 11580, 11583, 11586, 11593, 11594, 11595, 11596, 11597, 11599, 11604, 11610, 11612, 11618, 11621, 11623, 11625, 11628, 11629, 11632, 11633, 11636, 11639, 11642, 11650, 11652, 11654, 11655, 11656, 11657, 11658, 11659, 11663, 11664, 11667, 11668, 11669, 11672, 11673, 11677, 11678, 11680, 11681, 11682, 11683, 11688, 11691, 11692, 11693, 11694, 11695, 11696, 11701, 11703, 11705, 11707, 11711, 11712, 11720, 11721, 11725, 11726, 11731, 11733, 11736, 11740, 11743, 11744, 11748, 11753, 11755, 11759, 11760, 11761, 11762, 11763, 11764, 11765, 11766, 11767, 11770, 11771, 11773, 11776, 11780, 11781, 11782, 11783, 11785, 11786, 11790, 11792, 11795, 11799, 11800, 11809, 11812, 11813, 11814, 11816, 11818, 11819, 11826, 11828, 11829, 11830, 11831, 11832, 11833, 11837, 11838, 11839, 11841, 11846, 11849, 11850, 11851, 11853, 11854, 11856, 11858, 11863, 11868, 11870, 11872, 11876, 11877, 11878, 11881, 11890, 11891, 11893, 11897, 11898, 11903, 11904, 11909, 11913, 11915, 11916, 11917, 11919, 11920, 11921, 11923, 11926, 11927, 11928, 11929, 11930, 11934, 11935, 11939, 11940, 11941, 11943, 11946, 11947, 11948, 11949, 11953, 11955, 11957, 11958, 11959, 11960, 11961, 11962, 11963, 11965, 11968, 11977, 11980, 11983, 11988, 11993, 11997, 11998, 11999, 12002, 12004, 12008, 12017, 12019, 12020, 12021, 12023, 12024, 12025, 12030, 12032, 12035, 12042, 12043, 12044, 12047, 12050, 12051, 12054, 12059, 12060, 12061, 12064, 12068, 12078, 12079, 12080, 12081, 12083, 12085, 12086, 12091, 12092, 12093, 12097, 12098, 12104, 12106, 12112, 12114, 12115, 12118, 12120, 12122, 12127, 12128, 12129, 12130, 12131, 12134, 12135, 12138, 12139, 12143, 12144, 12145, 12146, 12147, 12149, 12150, 12151, 12153, 12161, 12162, 12165, 12166, 12170, 12171, 12173, 12174, 12175, 12179, 12181, 12186, 12195, 12197, 12198, 12202, 12204, 12208, 12212, 12215, 12217, 12223, 12229, 12233, 12237, 12240, 12241, 12243, 12245, 12249, 12250, 12252, 12254, 12255, 12256, 12259, 12265, 12268, 12269, 12271, 12278, 12280, 12283, 12284, 12285, 12286, 12287, 12288, 12295, 12296, 12302, 12310, 12311, 12312, 12313, 12314, 12315, 12317, 12319, 12321, 12323, 12325, 12328, 12331, 12334, 12335, 12337, 12339, 12342, 12343, 12345, 12347, 12350, 12354, 12356, 12359, 12364, 12366, 12370, 12375, 12376, 12379, 12381, 12383, 12385, 12390, 12393, 12394, 12397, 12400, 12401, 12403, 12404, 12406, 12410, 12411, 12414, 12415, 12417, 12419, 12420, 12423, 12424, 12425, 12426, 12427, 12437, 12440, 12444, 12445, 12450, 12451, 12455, 12456, 12457, 12459, 12461, 12462, 12465, 12467, 12468, 12470, 12472, 12473, 12475, 12478, 12481, 12483, 12487, 12488, 12489, 12492, 12494, 12495, 12497, 12503, 12510, 12511, 12512, 12513, 12514, 12515, 12518, 12519, 12527, 12530, 12531, 12535, 12536, 12537, 12539, 12540, 12546, 12547, 12548, 12549, 12551, 12552, 12554, 12555, 12556, 12557, 12561, 12563, 12565, 12567, 12568, 12570, 12572, 12574, 12578, 12580, 12583, 12585, 12586, 12588, 12589, 12591, 12600, 12603, 12605, 12606, 12608, 12609, 12610, 12611, 12616, 12622, 12623, 12626, 12628, 12629, 12631, 12634, 12639, 12640, 12641, 12644, 12648, 12649, 12650, 12651, 12652, 12653, 12654, 12655, 12663, 12664, 12668, 12670, 12671, 12674, 12679, 12680, 12681, 12683, 12684, 12685, 12688, 12689, 12691, 12692, 12693, 12695, 12696, 12699, 12701, 12702, 12705, 12706, 12714, 12716, 12723, 12731, 12732, 12733, 12735, 12738, 12739, 12740, 12741, 12742, 12750, 12752, 12753, 12754, 12755, 12757, 12758, 12760, 12761, 12764, 12765, 12766, 12771, 12775, 12777, 12782, 12783, 12790, 12794, 12797, 12800, 12802, 12803, 12807, 12808, 12810, 12812, 12813, 12817, 12820, 12822, 12823, 12824, 12826, 12827, 12828, 12835, 12836, 12837, 12838, 12839, 12843, 12844, 12848, 12849, 12850, 12853, 12860, 12861, 12866, 12870, 12873, 12878, 12882, 12883, 12884, 12887, 12888, 12891, 12895, 12898, 12899, 12900, 12901, 12903, 12904, 12905, 12906, 12908, 12910, 12912, 12913, 12916, 12917, 12920, 12921, 12928, 12929, 12932, 12933, 12934, 12935, 12938, 12939, 12945, 12946, 12947, 12950, 12952, 12953, 12956, 12958, 12959, 12960, 12961, 12963, 12967, 12968, 12969, 12978, 12983, 12984, 12986, 12987, 12988, 12990, 12991, 12999, 13001, 13003, 13004, 13005, 13007, 13010, 13012, 13014, 13015, 13017, 13018, 13022, 13027, 13030, 13031, 13033, 13034, 13035, 13036, 13037, 13038, 13040, 13041, 13045, 13049, 13050, 13053, 13054, 13055, 13056, 13059, 13061, 13062, 13064, 13066, 13067, 13071, 13075, 13079, 13083, 13085, 13086, 13087, 13097, 13099, 13101, 13102, 13105, 13106, 13110, 13111, 13112, 13114, 13115, 13116, 13117, 13118, 13120, 13121, 13122, 13123, 13124, 13125, 13128, 13131, 13134, 13135, 13142, 13144, 13147, 13148, 13149, 13151, 13154, 13159, 13160, 13169, 13175, 13181, 13182, 13186, 13188, 13189, 13190, 13197, 13198, 13199, 13203, 13205, 13206, 13209, 13210, 13212, 13213, 13215, 13217, 13221, 13224, 13227, 13228, 13232, 13234, 13235, 13236, 13237, 13239, 13241, 13243, 13248, 13250, 13251, 13255, 13256, 13259, 13260, 13261, 13262, 13263, 13264, 13267, 13268, 13269, 13271, 13274, 13281, 13283, 13284, 13287, 13296, 13297, 13298, 13300, 13301, 13303, 13304, 13313, 13315, 13317, 13319, 13325, 13329, 13332, 13335, 13337, 13340, 13343, 13344, 13345, 13346, 13347, 13348, 13350, 13352, 13361, 13363, 13367, 13368, 13369, 13370, 13377, 13380, 13381, 13384, 13385, 13386, 13391, 13393, 13394, 13395, 13396, 13397, 13398, 13401, 13402, 13403, 13404, 13407, 13408, 13410, 13413, 13416, 13417, 13419, 13423, 13424, 13429, 13430, 13433, 13439, 13441, 13444, 13448, 13451, 13456, 13457, 13460, 13463, 13467, 13469, 13473, 13474, 13475, 13477, 13478, 13480, 13484, 13489, 13492, 13496, 13497, 13499, 13503, 13504, 13505, 13507, 13513, 13514, 13515, 13516, 13519, 13521, 13522, 13526, 13529, 13533, 13535, 13536, 13539, 13540, 13543, 13544, 13545, 13546, 13547, 13549, 13552, 13553, 13555, 13558, 13559, 13561, 13568, 13569, 13574, 13577, 13578, 13580, 13584, 13587, 13597, 13598, 13599, 13600, 13601, 13602, 13604, 13605, 13606, 13611, 13612, 13613, 13614, 13621, 13623, 13630, 13631, 13632, 13634, 13636, 13637, 13641, 13643, 13650, 13651, 13653, 13654, 13660, 13662, 13663, 13665, 13668, 13670, 13675, 13677, 13678, 13679, 13683, 13687, 13688, 13697, 13698, 13699, 13700, 13702, 13706, 13710, 13713, 13714, 13716, 13719, 13720, 13724, 13727, 13729, 13739, 13742, 13745, 13747, 13750, 13753, 13756, 13764, 13767, 13772, 13773, 13775, 13777, 13779, 13780, 13782, 13783, 13786, 13787, 13789, 13791, 13793, 13794, 13796, 13797, 13799, 13809, 13816, 13817, 13818, 13819, 13822, 13823, 13828, 13830, 13831, 13834, 13835, 13843, 13848, 13849, 13852, 13858, 13869, 13872, 13873, 13875, 13877, 13879, 13887, 13888, 13891, 13892, 13895, 13897, 13898, 13899, 13901, 13902, 13903, 13906, 13908, 13909, 13910, 13911, 13915, 13917, 13918, 13919, 13921, 13924, 13925, 13934, 13947, 13948, 13950, 13952, 13953, 13954, 13958, 13960, 13961, 13963, 13969, 13970, 13971, 13975, 13984, 13986, 13987, 13991, 13999, 14000, 14001, 14005, 14006, 14008, 14009, 14013, 14014, 14017, 14022, 14027, 14030, 14031, 14035, 14036, 14038, 14040, 14049, 14051, 14052, 14059, 14062, 14063, 14066, 14067, 14069, 14070, 14071, 14072, 14073, 14074, 14075, 14078, 14081, 14084, 14085, 14086, 14088, 14092, 14094, 14096, 14097, 14106, 14112, 14116, 14117, 14118, 14119, 14121, 14122, 14124, 14126, 14129, 14130, 14132, 14133, 14135, 14137, 14138, 14139, 14140, 14141, 14142, 14143, 14145, 14146, 14147.

Promoters expressing in the spikelet/floral meristem at the V12 to V14 stage include SEQ IDs: 3, 7, 9, 12, 14, 15, 16, 17, 29, 31, 32, 33, 34, 36, 37, 44, 48, 54, 57, 63, 64, 65, 79, 80, 88, 93, 94, 96, 97, 98, 99, 100, 103, 104, 110, 112, 117, 121, 123, 128, 130, 131, 132, 135, 141, 142, 143, 147, 148, 152, 154, 156, 157, 159, 160, 162, 164, 165, 172, 174, 175, 176, 181, 183, 187, 191, 193, 194, 196, 197, 199, 202, 203, 205, 207, 211, 212, 214, 223, 232, 233, 235, 236, 237, 239, 240, 242, 246, 249, 250, 251, 257, 259, 262, 264, 267, 269, 270, 273, 280, 286, 288, 289, 293, 294, 301, 302, 305, 306, 309, 316, 319, 320, 322, 323, 328, 329, 332, 334, 335, 338, 346, 349, 352, 353, 354, 355, 356, 358, 359, 360, 364, 365, 373, 374, 378, 379, 381, 386, 388, 389, 395, 396, 401, 411, 412, 414, 423, 428, 431, 432, 433, 434, 436, 441, 448, 450, 452, 456, 460, 461, 462, 463, 466, 470, 471, 474, 478, 479, 483, 485, 488, 489, 496, 498, 501, 504, 507, 509, 510, 511, 514, 515, 516, 517, 522, 523, 525, 528, 532, 535, 537, 541, 542, 543, 544, 546, 547, 548, 553, 554, 557, 560, 561, 563, 565, 573, 577, 578, 580, 585, 588, 591, 592, 594, 595, 596, 598, 599, 601, 602, 605, 606, 607, 609, 613, 614, 619, 620, 623, 631, 633, 634, 635, 636, 637, 638, 643, 645, 647, 650, 659, 661, 662, 663, 664, 670, 671, 681, 683, 687, 692, 693, 694, 701, 702, 705, 706, 709, 716, 717, 718, 719, 721, 722, 723, 724, 727, 731, 732, 734, 736, 739, 740, 742, 744, 749, 750, 753, 757, 759, 760, 761, 762, 763, 764, 765, 779, 782, 783, 784, 792, 793, 800, 804, 806, 808, 809, 811, 812, 820, 822, 824, 825, 826, 829, 830, 833, 836, 840, 845, 846, 849, 855, 856, 857, 858, 860, 862, 863, 864, 865, 870, 871, 872, 875, 876, 877, 882, 887, 890, 891, 892, 893, 895, 897, 898, 899, 903, 907, 908, 911, 912, 913, 915, 916, 917, 919, 920, 924, 928, 932, 936, 939, 943, 944, 947, 949, 951, 953, 955, 957, 958, 960, 971, 972, 974, 975, 976, 977, 978, 979, 980, 982, 984, 985, 987, 989, 991, 993, 994, 995, 997, 999, 1002, 1003, 1007, 1008, 1009, 1010, 1011, 1012, 1013, 1014, 1016, 1017, 1019, 1022, 1025, 1026, 1032, 1033, 1035, 1038, 1039, 1040, 1041, 1042, 1043, 1044, 1046, 1047, 1049, 1051, 1052, 1054, 1055, 1056, 1057, 1059, 1064, 1065, 1067, 1069, 1070, 1073, 1074, 1076, 1077, 1080, 1085, 1086, 1087, 1089, 1092, 1095, 1100, 1101, 1103, 1104, 1110, 1111, 1112, 1114, 1115, 1116, 1117, 1119, 1121, 1122, 1125, 1130, 1132, 1136, 1137, 1140, 1146, 1148, 1154, 1155, 1160, 1161, 1165, 1167, 1168, 1170, 1171, 1175, 1176, 1178, 1183, 1189, 1191, 1193, 1196, 1200, 1201, 1204, 1205, 1213, 1214, 1218, 1220, 1222, 1223, 1225, 1228, 1230, 1231, 1232, 1236, 1237, 1239, 1240, 1244, 1248, 1249, 1251, 1254, 1257, 1258, 1261, 1262, 1263, 1272, 1277, 1281, 1282, 1285, 1286, 1290, 1292, 1293, 1296, 1303, 1306, 1307, 1309, 1310, 1311, 1312, 1314, 1316, 1320, 1321, 1322, 1323, 1325, 1327, 1330, 1331, 1334, 1339, 1345, 1347, 1349, 1356, 1360, 1363, 1364, 1366, 1367, 1368, 1371, 1375, 1376, 1377, 1380, 1383, 1387, 1388, 1389, 1391, 1393, 1394, 1396, 1398, 1399, 1404, 1405, 1406, 1407, 1410, 1412, 1415, 1420, 1421, 1423, 1426, 1431, 1432, 1433, 1435, 1438, 1439, 1440, 1441, 1442, 1447, 1448, 1451, 1453, 1458, 1459, 1462, 1466, 1475, 1484, 1486, 1487, 1488, 1489, 1490, 1491, 1492, 1493, 1498, 1499, 1503, 1504, 1506, 1508, 1510, 1511, 1512, 1514, 1518, 1519, 1525, 1526, 1527, 1528, 1530, 1539, 1543, 1545, 1546, 1549, 1550, 1551, 1554, 1555, 1556, 1559, 1560, 1561, 1563, 1564, 1567, 1568, 1570, 1571, 1575, 1578, 1584, 1585, 1586, 1588, 1590, 1591, 1594, 1597, 1598, 1599, 1600, 1601, 1602, 1604, 1605, 1609, 1610, 1612, 1614, 1615, 1616, 1617, 1622, 1623, 1625, 1634, 1635, 1636, 1637, 1638, 1641, 1643, 1648, 1650, 1651, 1653, 1654, 1658, 1659, 1662, 1663, 1669, 1671, 1673, 1675, 1676, 1678, 1681, 1682, 1684, 1687, 1688, 1689, 1690, 1691, 1696, 1697, 1698, 1699, 1703, 1705, 1706, 1707, 1708, 1710, 1716, 1717, 1718, 1720, 1725, 1729, 1732, 1735, 1739, 1745, 1749, 1750, 1755, 1758, 1759, 1760, 1761, 1764, 1769, 1770, 1773, 1774, 1776, 1777, 1779, 1785, 1786, 1791, 1792, 1793, 1796, 1798, 1807, 1809, 1811, 1812, 1813, 1822, 1825, 1826, 1828, 1830, 1832, 1834, 1837, 1839, 1840, 1848, 1849, 1852, 1859, 1861, 1863, 1866, 1867, 1869, 1872, 1873, 1876, 1879, 1880, 1882, 1884, 1886, 1888, 1891, 1894, 1897, 1898, 1899, 1900, 1901, 1902, 1904, 1905, 1906, 1910, 1911, 1915, 1916, 1918, 1920, 1922, 1923, 1924, 1928, 1930, 1931, 1933, 1934, 1936, 1939, 1940, 1942, 1944, 1945, 1948, 1949, 1950, 1951, 1952, 1953, 1954, 1956, 1958, 1968, 1969, 1970, 1971, 1972, 1973, 1974, 1979, 1981, 1986, 1990, 1993, 1994, 1995, 1996, 1999, 2000, 2007, 2008, 2009, 2010, 2012, 2014, 2015, 2016, 2017, 2019, 2021, 2026, 2032, 2033, 2037, 2040, 2043, 2048, 2057, 2058, 2060, 2062, 2064, 2066, 2069, 2072, 2074, 2077, 2078, 2085, 2087, 2088, 2089, 2091, 2092, 2093, 2094, 2096, 2097, 2099, 2101, 2103, 2104, 2106, 2107, 2112, 2116, 2117, 2122, 2123, 2125, 2128, 2132, 2133, 2137, 2139, 2140, 2142, 2143, 2146, 2147, 2150, 2151, 2156, 2157, 2161, 2164, 2167, 2168, 2170, 2172, 2173, 2175, 2177, 2178, 2179, 2185, 2188, 2189, 2193, 2195, 2196, 2202, 2203, 2205, 2206, 2210, 2215, 2216, 2218, 2221, 2222, 2223, 2226, 2227, 2235, 2240, 2241, 2242, 2243, 2253, 2257, 2259, 2260, 2263, 2266, 2267, 2274, 2276, 2278, 2280, 2282, 2283, 2284, 2288, 2291, 2296, 2297, 2298, 2300, 2303, 2305, 2306, 2308, 2309, 2310, 2313, 2314, 2322, 2323, 2328, 2329, 2331, 2333, 2339, 2342, 2345, 2348, 2353, 2361, 2362, 2363, 2366, 2371, 2372, 2376, 2379, 2380, 2381, 2382, 2384, 2401, 2402, 2405, 2410, 2412, 2413, 2414, 2416, 2418, 2419, 2420, 2423, 2428, 2430, 2431, 2432, 2433, 2434, 2435, 2437, 2439, 2440, 2441, 2442, 2443, 2445, 2449, 2451, 2452, 2453, 2454, 2457, 2458, 2469, 2470, 2472, 2474, 2476, 2477, 2479, 2480, 2481, 2482, 2483, 2485, 2487, 2490, 2492, 2494, 2495, 2496, 2498, 2500, 2505, 2506, 2507, 2509, 2510, 2513, 2514, 2515, 2516, 2517, 2519, 2521, 2525, 2526, 2528, 2529, 2531, 2533, 2534, 2536, 2537, 2538, 2539, 2541, 2544, 2545, 2549, 2550, 2551, 2552, 2554, 2555, 2556, 2559, 2560, 2567, 2568, 2570, 2573, 2576, 2578, 2579, 2581, 2583, 2589, 2590, 2591, 2594, 2596, 2599, 2601, 2605, 2607, 2609, 2611, 2612, 2613, 2616, 2617, 2620, 2622, 2625, 2626, 2627, 2632, 2634, 2635, 2636, 2639, 2641, 2644, 2645, 2648, 2649, 2651, 2652, 2655, 2656, 2658, 2661, 2662, 2663, 2665, 2666, 2671, 2672, 2674, 2676, 2684, 2685, 2687, 2688, 2689, 2690, 2691, 2692, 2694, 2696, 2700, 2702, 2704, 2709, 2711, 2712, 2719, 2720, 2721, 2722, 2723, 2725, 2726, 2728, 2729, 2730, 2735, 2736, 2745, 2746, 2747, 2749, 2752, 2755, 2756, 2758, 2759, 2760, 2762, 2764, 2765, 2770, 2775, 2776, 2779, 2782, 2784, 2787, 2788, 2789, 2791, 2794, 2796, 2798, 2800, 2801, 2802, 2805, 2808, 2812, 2814, 2819, 2821, 2822, 2823, 2824, 2826, 2827, 2828, 2832, 2838, 2840, 2844, 2845, 2850, 2860, 2861, 2865, 2869, 2871, 2876, 2878, 2888, 2889, 2892, 2893, 2894, 2895, 2896, 2897, 2898, 2901, 2902, 2903, 2906, 2908, 2909, 2911, 2915, 2916, 2917, 2918, 2919, 2922, 2923, 2926, 2929, 2930, 2931, 2935, 2941, 2942, 2943, 2944, 2946, 2947, 2948, 2954, 2955, 2959, 2962, 2963, 2965, 2966, 2968, 2976, 2978, 2979, 2982, 2985, 2987, 2992, 2994, 2998, 3000, 3003, 3005, 3007, 3008, 3013, 3015, 3017, 3018, 3019, 3020, 3023, 3029, 3031, 3039, 3042, 3044, 3045, 3047, 3048, 3049, 3051, 3052, 3053, 3055, 3062, 3064, 3065, 3067, 3068, 3070, 3072, 3075, 3080, 3083, 3084, 3085, 3087, 3090, 3094, 3095, 3096, 3097, 3100, 3101, 3106, 3115, 3118, 3119, 3120, 3121, 3122, 3123, 3126, 3127, 3128, 3137, 3139, 3143, 3149, 3153, 3167, 3169, 3170, 3172, 3177, 3181, 3189, 3191, 3192, 3194, 3196, 3202, 3205, 3206, 3208, 3210, 3217, 3218, 3220, 3221, 3224, 3225, 3228, 3230, 3237, 3240, 3242, 3246, 3249, 3250, 3252, 3254, 3261, 3263, 3266, 3267, 3269, 3271, 3272, 3273, 3278, 3280, 3283, 3286, 3288, 3289, 3290, 3291, 3294, 3295, 3297, 3299, 3301, 3308, 3310, 3312, 3313, 3314, 3324, 3331, 3332, 3333, 3337, 3338, 3340, 3342, 3343, 3345, 3347, 3351, 3353, 3355, 3356, 3357, 3358, 3359, 3360, 3361, 3363, 3368, 3369, 3370, 3373, 3374, 3376, 3377, 3378, 3379, 3382, 3383, 3386, 3394, 3396, 3399, 3403, 3405, 3413, 3415, 3416, 3418, 3419, 3424, 3426, 3427, 3428, 3432, 3435, 3438, 3442, 3446, 3447, 3449, 3450, 3452, 3453, 3457, 3458, 3461, 3465, 3466, 3468, 3469, 3470, 3471, 3474, 3477, 3483, 3484, 3486, 3488, 3490, 3493, 3494, 3499, 3500, 3502, 3503, 3504, 3506, 3507, 3510, 3516, 3517, 3518, 3521, 3522, 3523, 3524, 3529, 3533, 3535, 3536, 3537, 3538, 3540, 3541, 3542, 3544, 3545, 3548, 3549, 3554, 3558, 3560, 3562, 3569, 3571, 3574, 3576, 3580, 3586, 3587, 3588, 3592, 3594, 3595, 3599, 3600, 3603, 3604, 3606, 3607, 3610, 3611, 3613, 3615, 3616, 3620, 3624, 3629, 3633, 3634, 3636, 3637, 3640, 3642, 3643, 3644, 3645, 3646, 3648, 3655, 3659, 3660, 3661, 3667, 3672, 3674, 3677, 3681, 3682, 3684, 3685, 3689, 3690, 3693, 3694, 3704, 3706, 3707, 3709, 3713, 3715, 3718, 3719, 3721, 3723, 3725, 3726, 3730, 3731, 3732, 3733, 3738, 3739, 3744, 3749, 3752, 3756, 3757, 3760, 3761, 3763, 3764, 3765, 3766, 3775, 3777, 3778, 3785, 3787, 3791, 3792, 3793, 3794, 3798, 3801, 3806, 3808, 3817, 3818, 3819, 3823, 3825, 3828, 3830, 3831, 3832, 3833, 3837, 3838, 3843, 3844, 3845, 3846, 3847, 3849, 3852, 3858, 3859, 3860, 3866, 3867, 3870, 3871, 3872, 3873, 3880, 3881, 3883, 3884, 3887, 3889, 3890, 3892, 3894, 3895, 3897, 3902, 3903, 3904, 3907, 3908, 3909, 3912, 3913, 3917, 3918, 3924, 3926, 3928, 3929, 3931, 3933, 3934, 3935, 3938, 3941, 3947, 3950, 3951, 3952, 3954, 3958, 3962, 3964, 3967, 3968, 3970, 3971, 3972, 3974, 3975, 3976, 3977, 3978, 3983, 3985, 3988, 3994, 3995, 3996, 3997, 3998, 4000, 4001, 4002, 4003, 4007, 4008, 4012, 4013, 4014, 4019, 4020, 4028, 4030, 4033, 4037, 4039, 4040, 4041, 4042, 4043, 4046, 4047, 4048, 4049, 4050, 4051, 4052, 4053, 4054, 4055, 4056, 4057, 4062, 4066, 4067, 4068, 4070, 4071, 4072, 4080, 4084, 4088, 4090, 4092, 4094, 4096, 4099, 4102, 4105, 4106, 4109, 4110, 4111, 4113, 4116, 4117, 4122, 4124, 4126, 4128, 4132, 4133, 4134, 4139, 4140, 4143, 4144, 4146, 4147, 4148, 4149, 4150, 4151, 4155, 4160, 4163, 4164, 4165, 4166, 4167, 4168, 4170, 4171, 4175, 4176, 4178, 4181, 4183, 4185, 4187, 4188, 4189, 4191, 4192, 4193, 4195, 4197, 4201, 4202, 4204, 4205, 4206, 4207, 4208, 4210, 4211, 4212, 4213, 4219, 4221, 4227, 4228, 4229, 4232, 4233, 4234, 4235, 4237, 4241, 4244, 4245, 4246, 4251, 4252, 4257, 4260, 4261, 4266, 4270, 4272, 4275, 4276, 4280, 4281, 4283, 4284, 4288, 4290, 4296, 4298, 4300, 4301, 4302, 4303, 4304, 4305, 4306, 4309, 4312, 4314, 4317, 4320, 4321, 4324, 4329, 4330, 4332, 4335, 4336, 4338, 4339, 4341, 4347, 4358, 4359, 4360, 4369, 4370, 4371, 4373, 4374, 4375, 4378, 4380, 4383, 4388, 4390, 4391, 4396, 4397, 4401, 4402, 4403, 4404, 4405, 4406, 4409, 4410, 4417, 4422, 4423, 4430, 4432, 4436, 4439, 4440, 4442, 4443, 4446, 4448, 4449, 4450, 4453, 4456, 4461, 4462, 4463, 4466, 4467, 4468, 4474, 4475, 4479, 4485, 4486, 4490, 4492, 4494, 4497, 4498, 4500, 4502, 4507, 4508, 4509, 4512, 4514, 4515, 4519, 4521, 4522, 4525, 4529, 4531, 4535, 4541, 4543, 4545, 4548, 4549, 4551, 4554, 4555, 4556, 4557, 4558, 4560, 4562, 4563, 4565, 4566, 4567, 4568, 4575, 4576, 4578, 4579, 4580, 4582, 4583, 4590, 4591, 4594, 4597, 4598, 4601, 4606, 4614, 4616, 4623, 4625, 4628, 4630, 4632, 4633, 4634, 4635, 4639, 4641, 4643, 4644, 4646, 4647, 4650, 4651, 4653, 4654, 4655, 4656, 4658, 4659, 4662, 4664, 4667, 4669, 4671, 4672, 4673, 4674, 4676, 4677, 4680, 4682, 4685, 4691, 4692, 4694, 4697, 4699, 4700, 4701, 4703, 4706, 4708, 4710, 4711, 4713, 4719, 4720, 4721, 4722, 4724, 4729, 4730, 4734, 4736, 4737, 4738, 4739, 4740, 4741, 4745, 4746, 4749, 4750, 4751, 4753, 4754, 4755, 4756, 4761, 4762, 4763, 4766, 4767, 4769, 4770, 4771, 4773, 4775, 4779, 4780, 4784, 4787, 4788, 4789, 4790, 4791, 4794, 4795, 4796, 4801, 4803, 4804, 4805, 4806, 4807, 4812, 4813, 4814, 4815, 4818, 4822, 4823, 4828, 4830, 4831, 4834, 4836, 4838, 4840, 4841, 4842, 4854, 4855, 4856, 4857, 4858, 4859, 4861, 4862, 4863, 4864, 4869, 4871, 4874, 4875, 4876, 4878, 4881, 4887, 4889, 4891, 4895, 4896, 4897, 4900, 4902, 4904, 4905, 4907, 4909, 4910, 4914, 4921, 4922, 4924, 4930, 4935, 4936, 4937, 4938, 4941, 4942, 4950, 4954, 4955, 4958, 4959, 4963, 4967, 4969, 4971, 4972, 4974, 4975, 4980, 4987, 4989, 4990, 4993, 4994, 4996, 5000, 5010, 5014, 5015, 5016, 5024, 5026, 5029, 5030, 5034, 5036, 5037, 5039, 5040, 5041, 5042, 5044, 5045, 5046, 5049, 5052, 5054, 5057, 5060, 5067, 5068, 5069, 5072, 5074, 5075, 5078, 5082, 5089, 5090, 5091, 5094, 5099, 5100, 5101, 5102, 5106, 5110, 5113, 5114, 5115, 5116, 5123, 5125, 5131, 5132, 5140, 5143, 5147, 5148, 5149, 5151, 5153, 5159, 5160, 5163, 5164, 5165, 5168, 5170, 5172, 5174, 5180, 5181, 5184, 5185, 5187, 5188, 5189, 5190, 5191, 5192, 5193, 5196, 5198, 5200, 5202, 5206, 5209, 5212, 5213, 5217, 5218, 5219, 5221, 5224, 5225, 5234, 5237, 5238, 5240, 5244, 5245, 5249, 5251, 5253, 5254, 5255, 5258, 5260, 5261, 5263, 5264, 5267, 5268, 5269, 5273, 5274, 5275, 5276, 5279, 5280, 5281, 5282, 5283, 5284, 5285, 5287, 5292, 5293, 5297, 5298, 5299, 5300, 5301, 5308, 5311, 5315, 5317, 5319, 5321, 5324, 5328, 5329, 5330, 5333, 5334, 5338, 5339, 5342, 5345, 5346, 5348, 5349, 5351, 5352, 5366, 5367, 5369, 5371, 5386, 5388, 5389, 5391, 5393, 5395, 5396, 5397, 5404, 5405, 5409, 5411, 5413, 5414, 5417, 5418, 5422, 5427, 5428, 5431, 5433, 5434, 5437, 5438, 5446, 5448, 5449, 5450, 5452, 5453, 5456, 5458, 5459, 5461, 5475, 5482, 5483, 5485, 5487, 5488, 5491, 5493, 5495, 5496, 5498, 5505, 5506, 5508, 5509, 5510, 5512, 5513, 5515, 5517, 5518, 5519, 5524, 5526, 5529, 5530, 5531, 5532, 5534, 5535, 5537, 5543, 5545, 5549, 5554, 5561, 5562, 5563, 5565, 5566, 5568, 5569, 5572, 5575, 5579, 5581, 5582, 5584, 5585, 5589, 5591, 5593, 5594, 5597, 5602, 5608, 5613, 5614, 5615, 5616, 5620, 5623, 5627, 5630, 5632, 5633, 5635, 5638, 5640, 5643, 5647, 5648, 5649, 5650, 5651, 5652, 5653, 5656, 5657, 5659, 5660, 5662, 5663, 5669, 5680, 5681, 5683, 5689, 5690, 5694, 5695, 5696, 5697, 5698, 5702, 5706, 5711, 5712, 5713, 5714, 5717, 5718, 5719, 5721, 5722, 5729, 5730, 5731, 5732, 5734, 5735, 5736, 5737, 5742, 5744, 5748, 5751, 5768, 5770, 5773, 5775, 5778, 5780, 5783, 5784, 5785, 5787, 5791, 5792, 5794, 5803, 5805, 5807, 5808, 5809, 5811, 5814, 5815, 5817, 5820, 5825, 5826, 5828, 5832, 5833, 5834, 5835, 5836, 5839, 5842, 5844, 5846, 5854, 5859, 5864, 5866, 5867, 5869, 5871, 5872, 5873, 5875, 5876, 5877, 5878, 5879, 5881, 5882, 5883, 5888, 5889, 5892, 5893, 5906, 5907, 5910, 5912, 5918, 5919, 5921, 5922, 5923, 5925, 5926, 5927, 5928, 5930, 5931, 5932, 5933, 5938, 5939, 5940, 5941, 5942, 5944, 5945, 5947, 5948, 5951, 5954, 5957, 5959, 5961, 5967, 5968, 5969, 5971, 5973, 5978, 5979, 5980, 5985, 5986, 5990, 5991, 5994, 5996, 5997, 5999, 6000, 6003, 6004, 6005, 6006, 6007, 6010, 6012, 6013, 6016, 6017, 6023, 6025, 6026, 6031, 6034, 6038, 6040, 6041, 6044, 6046, 6047, 6048, 6051, 6053, 6054, 6058, 6059, 6061, 6062, 6063, 6065, 6068, 6069, 6070, 6072, 6073, 6074, 6075, 6080, 6081, 6085, 6088, 6089, 6091, 6092, 6093, 6094, 6095, 6096, 6098, 6099, 6107, 6108, 6109, 6110, 6112, 6113, 6116, 6118, 6119, 6122, 6129, 6130, 6132, 6133, 6135, 6136, 6137, 6138, 6140, 6143, 6145, 6146, 6147, 6149, 6151, 6152, 6153, 6156, 6158, 6160, 6163, 6164, 6165, 6168, 6173, 6176, 6182, 6183, 6186, 6188, 6189, 6190, 6191, 6193, 6197, 6198, 6200, 6205, 6207, 6209, 6212, 6213, 6215, 6220, 6221, 6223, 6224, 6226, 6227, 6228, 6230, 6231, 6233, 6234, 6238, 6239, 6240, 6243, 6244, 6245, 6246, 6247, 6248, 6249, 6251, 6255, 6257, 6258, 6259, 6260, 6264, 6265, 6269, 6270, 6271, 6272, 6273, 6275, 6278, 6279, 6280, 6281, 6282, 6286, 6288, 6289, 6291, 6292, 6294, 6299, 6302, 6308, 6309, 6310, 6312, 6315, 6317, 6319, 6321, 6322, 6325, 6328, 6332, 6333, 6338, 6346, 6350, 6351, 6352, 6353, 6354, 6359, 6362, 6363, 6364, 6367, 6370, 6375, 6378, 6379, 6381, 6383, 6394, 6395, 6396, 6397, 6398, 6399, 6403, 6405, 6407, 6408, 6412, 6413, 6414, 6415, 6419, 6420, 6422, 6425, 6428, 6429, 6430, 6431, 6434, 6436, 6437, 6440, 6442, 6449, 6452, 6454, 6458, 6459, 6463, 6464, 6466, 6467, 6468, 6469, 6470, 6471, 6474, 6476, 6484, 6486, 6488, 6495, 6499, 6500, 6501, 6502, 6504, 6505, 6510, 6513, 6514, 6515, 6516, 6517, 6519, 6524, 6525, 6526, 6530, 6532, 6533, 6534, 6535, 6537, 6543, 6544, 6547, 6548, 6549, 6552, 6554, 6555, 6558, 6560, 6561, 6563, 6564, 6567, 6572, 6574, 6576, 6577, 6579, 6581, 6582, 6584, 6587, 6588, 6589, 6594, 6595, 6598, 6599, 6600, 6603, 6607, 6609, 6611, 6614, 6621, 6624, 6626, 6627, 6630, 6634, 6635, 6637, 6638, 6639, 6640, 6643, 6644, 6646, 6647, 6649, 6652, 6655, 6656, 6658, 6662, 6666, 6671, 6672, 6677, 6678, 6681, 6691, 6692, 6695, 6696, 6699, 6703, 6705, 6706, 6711, 6713, 6714, 6716, 6718, 6720, 6724, 6725, 6729, 6731, 6734, 6736, 6737, 6739, 6746, 6747, 6752, 6756, 6757, 6759, 6761, 6764, 6766, 6776, 6778, 6779, 6780, 6783, 6786, 6788, 6792, 6793, 6794, 6797, 6799, 6803, 6804, 6805, 6807, 6810, 6811, 6812, 6813, 6816, 6819, 6820, 6821, 6824, 6827, 6828, 6830, 6831, 6834, 6836, 6837, 6839, 6840, 6841, 6842, 6843, 6845, 6851, 6854, 6859, 6864, 6869, 6870, 6872, 6874, 6875, 6876, 6878, 6879, 6880, 6882, 6883, 6884, 6888, 6890, 6892, 6897, 6903, 6904, 6906, 6913, 6914, 6915, 6917, 6919, 6920, 6921, 6925, 6930, 6933, 6936, 6941, 6943, 6946, 6948, 6950, 6951, 6952, 6959, 6960, 6963, 6969, 6974, 6979, 6980, 6984, 6985, 6987, 6988, 6990, 6991, 6993, 6994, 6995, 7002, 7003, 7006, 7009, 7012, 7013, 7015, 7017, 7022, 7032, 7039, 7042, 7043, 7045, 7046, 7051, 7052, 7053, 7056, 7057, 7060, 7062, 7064, 7067, 7068, 7072, 7073, 7074, 7075, 7077, 7079, 7083, 7084, 7085, 7086, 7093, 7094, 7097, 7105, 7106, 7107, 7108, 7112, 7116, 7117, 7118, 7124, 7130, 7132, 7135, 7137, 7140, 7142, 7144, 7146, 7149, 7151, 7155, 7163, 7164, 7165, 7166, 7169, 7176, 7177, 7182, 7183, 7184, 7187, 7188, 7192, 7194, 7196, 7197, 7201, 7203, 7206, 7207, 7208, 7209, 7216, 7217, 7218, 7219, 7220, 7227, 7228, 7230, 7231, 7232, 7233, 7234, 7235, 7236, 7239, 7240, 7241, 7243, 7244, 7245, 7248, 7255, 7257, 7258, 7259, 7262, 7267, 7268, 7269, 7270, 7274, 7276, 7277, 7281, 7282, 7284, 7287, 7288, 7291, 7292, 7293, 7298, 7299, 7300, 7301, 7303, 7304, 7305, 7306, 7307, 7308, 7310, 7311, 7312, 7315, 7317, 7328, 7330, 7334, 7338, 7339, 7340, 7344, 7348, 7354, 7355, 7356, 7357, 7358, 7361, 7363, 7365, 7371, 7373, 7375, 7379, 7380, 7381, 7382, 7383, 7388, 7389, 7392, 7395, 7398, 7400, 7401, 7410, 7411, 7417, 7425, 7428, 7430, 7434, 7435, 7436, 7443, 7444, 7445, 7446, 7447, 7448, 7452, 7454, 7458, 7459, 7466, 7470, 7476, 7483, 7486, 7487, 7490, 7492, 7493, 7498, 7502, 7504, 7505, 7512, 7515, 7517, 7518, 7523, 7524, 7525, 7528, 7529, 7533, 7534, 7537, 7538, 7546, 7547, 7548, 7560, 7561, 7570, 7574, 7577, 7578, 7579, 7580, 7585, 7586, 7587, 7588, 7590, 7591, 7593, 7594, 7598, 7601, 7605, 7611, 7617, 7619, 7620, 7621, 7623, 7624, 7632, 7633, 7634, 7639, 7640, 7642, 7643, 7647, 7652, 7658, 7661, 7663, 7664, 7665, 7666, 7667, 7674, 7677, 7678, 7679, 7680, 7682, 7685, 7687, 7689, 7695, 7699, 7700, 7703, 7704, 7708, 7712, 7713, 7716, 7717, 7718, 7719, 7724, 7725, 7729, 7733, 7736, 7737, 7738, 7740, 7744, 7745, 7747, 7749, 7751, 7753, 7755, 7761, 7762, 7763, 7764, 7767, 7768, 7769, 7770, 7772, 7774, 7775, 7777, 7778, 7779, 7780, 7782, 7785, 7786, 7788, 7791, 7793, 7798, 7800, 7803, 7804, 7806, 7807, 7812, 7815, 7818, 7819, 7820, 7823, 7824, 7825, 7832, 7833, 7834, 7838, 7841, 7844, 7847, 7848, 7849, 7856, 7858, 7859, 7860, 7862, 7863, 7865, 7876, 7878, 7888, 7890, 7895, 7896, 7900, 7908, 7909, 7910, 7911, 7917, 7918, 7920, 7921, 7922, 7923, 7925, 7929, 7933, 7934, 7935, 7936, 7938, 7942, 7943, 7944, 7945, 7946, 7947, 7948, 7949, 7950, 7952, 7953, 7955, 7956, 7964, 7965, 7966, 7967, 7972, 7974, 7976, 7977, 7978, 7980, 7982, 7983, 7984, 7986, 7988, 7989, 7990, 7991, 7992, 7993, 8002, 8004, 8006, 8008, 8012, 8021, 8026, 8029, 8035, 8039, 8042, 8044, 8045, 8047, 8048, 8052, 8053, 8056, 8058, 8059, 8061, 8063, 8064, 8066, 8067, 8068, 8071, 8072, 8075, 8076, 8077, 8078, 8079, 8080, 8082, 8084, 8088, 8091, 8093, 8095, 8099, 8100, 8102, 8103, 8105, 8106, 8112, 8116, 8118, 8120, 8121, 8126, 8130, 8134, 8136, 8137, 8145, 8146, 8148, 8150, 8155, 8159, 8162, 8163, 8164, 8165, 8170, 8174, 8176, 8178, 8179, 8186, 8189, 8193, 8195, 8199, 8202, 8204, 8207, 8208, 8210, 8211, 8213, 8215, 8216, 8219, 8220, 8222, 8223, 8225, 8227, 8231, 8234, 8235, 8237, 8239, 8245, 8250, 8252, 8253, 8257, 8258, 8266, 8268, 8269, 8270, 8272, 8274, 8289, 8291, 8292, 8293, 8294, 8300, 8301, 8302, 8304, 8310, 8311, 8312, 8318, 8319, 8320, 8321, 8324, 8329, 8336, 8339, 8340, 8349, 8350, 8351, 8352, 8353, 8355, 8363, 8367, 8368, 8369, 8373, 8379, 8385, 8386, 8387, 8389, 8392, 8393, 8395, 8400, 8401, 8402, 8403, 8404, 8407, 8410, 8411, 8413, 8414, 8416, 8417, 8418, 8423, 8427, 8428, 8430, 8433, 8436, 8438, 8439, 8441, 8444, 8446, 8447, 8448, 8449, 8450, 8451, 8452, 8456, 8457, 8465, 8466, 8469, 8472, 8473, 8474, 8476, 8477, 8480, 8481, 8482, 8485, 8486, 8490, 8493, 8498, 8501, 8502, 8503, 8505, 8509, 8511, 8513, 8515, 8517, 8520, 8523, 8524, 8525, 8527, 8528, 8531, 8532, 8533, 8537, 8538, 8539, 8541, 8543, 8544, 8549, 8550, 8552, 8554, 8557, 8561, 8562, 8565, 8566, 8568, 8575, 8576, 8579, 8581, 8582, 8589, 8590, 8593, 8594, 8596, 8597, 8599, 8600, 8601, 8603, 8605, 8609, 8610, 8611, 8612, 8613, 8614, 8617, 8618, 8621, 8624, 8631, 8634, 8635, 8637, 8638, 8640, 8641, 8642, 8644, 8650, 8654, 8657, 8658, 8659, 8660, 8663, 8665, 8669, 8670, 8672, 8676, 8677, 8685, 8693, 8699, 8700, 8703, 8706, 8708, 8709, 8713, 8716, 8717, 8719, 8720, 8722, 8726, 8727, 8729, 8730, 8731, 8732, 8734, 8735, 8736, 8740, 8741, 8744, 8745, 8746, 8748, 8751, 8752, 8753, 8755, 8757, 8759, 8764, 8767, 8772, 8773, 8775, 8777, 8779, 8782, 8783, 8784, 8789, 8792, 8796, 8797, 8803, 8804, 8805, 8810, 8817, 8818, 8822, 8824, 8829, 8831, 8832, 8834, 8835, 8838, 8839, 8841, 8843, 8846, 8853, 8854, 8861, 8865, 8866, 8867, 8876, 8877, 8878, 8880, 8881, 8883, 8884, 8886, 8888, 8889, 8891, 8892, 8896, 8897, 8899, 8900, 8905, 8907, 8908, 8909, 8910, 8911, 8912, 8914, 8916, 8917, 8926, 8929, 8930, 8935, 8938, 8941, 8942, 8945, 8946, 8949, 8951, 8954, 8957, 8959, 8960, 8961, 8962, 8967, 8968, 8969, 8972, 8974, 8976, 8977, 8979, 8980, 8981, 8985, 8986, 8992, 8996, 8998, 8999, 9001, 9002, 9003, 9006, 9009, 9012, 9015, 9017, 9018, 9020, 9021, 9023, 9026, 9027, 9029, 9030, 9033, 9037, 9044, 9047, 9052, 9056, 9057, 9058, 9059, 9060, 9062, 9066, 9069, 9071, 9072, 9073, 9074, 9076, 9084, 9088, 9091, 9092, 9095, 9096, 9097, 9100, 9103, 9105, 9108, 9110, 9111, 9112, 9114, 9115, 9118, 9120, 9123, 9125, 9129, 9133, 9134, 9139, 9140, 9141, 9142, 9149, 9151, 9154, 9155, 9157, 9167, 9168, 9173, 9174, 9177, 9179, 9183, 9185, 9187, 9188, 9190, 9191, 9195, 9206, 9207, 9210, 9211, 9213, 9215, 9216, 9218, 9226, 9229, 9231, 9233, 9234, 9235, 9237, 9241, 9243, 9247, 9252, 9253, 9254, 9255, 9263, 9265, 9267, 9269, 9270, 9273, 9276, 9278, 9284, 9285, 9287, 9288, 9290, 9292, 9293, 9298, 9299, 9300, 9304, 9308, 9311, 9320, 9323, 9325, 9326, 9327, 9328, 9329, 9330, 9336, 9337, 9338, 9339, 9340, 9341, 9345, 9346, 9347, 9348, 9354, 9355, 9357, 9359, 9362, 9366, 9367, 9373, 9375, 9376, 9378, 9382, 9383, 9388, 9389, 9391, 9392, 9393, 9394, 9396, 9398, 9400, 9402, 9403, 9404, 9406, 9407, 9413, 9415, 9417, 9423, 9432, 9433, 9434, 9440, 9443, 9444, 9451, 9452, 9456, 9460, 9466, 9468, 9471, 9472, 9473, 9478, 9481, 9483, 9486, 9488, 9490, 9494, 9495, 9497, 9500, 9501, 9502, 9503, 9504, 9509, 9514, 9515, 9517, 9518, 9519, 9525, 9533, 9534, 9536, 9540, 9545, 9548, 9553, 9555, 9557, 9559, 9560, 9563, 9564, 9565, 9567, 9568, 9571, 9577, 9582, 9586, 9587, 9589, 9590, 9591, 9602, 9606, 9609, 9610, 9613, 9614, 9617, 9618, 9620, 9623, 9626, 9627, 9628, 9629, 9630, 9633, 9635, 9640, 9641, 9642, 9644, 9645, 9646, 9648, 9649, 9650, 9652, 9653, 9655, 9656, 9657, 9658, 9659, 9660, 9663, 9666, 9668, 9670, 9681, 9682, 9686, 9692, 9693, 9694, 9698, 9700, 9706, 9710, 9711, 9717, 9718, 9722, 9723, 9725, 9726, 9729, 9730, 9731, 9733, 9734, 9737, 9746, 9749, 9750, 9751, 9753, 9754, 9755, 9756, 9763, 9764, 9767, 9768, 9770, 9774, 9776, 9780, 9781, 9782, 9784, 9786, 9791, 9792, 9793, 9794, 9796, 9799, 9801, 9804, 9806, 9809, 9810, 9812, 9813, 9816, 9819, 9820, 9824, 9825, 9827, 9829, 9830, 9833, 9836, 9845, 9846, 9847, 9849, 9850, 9851, 9853, 9854, 9858, 9860, 9861, 9864, 9866, 9869, 9871, 9873, 9882, 9885, 9886, 9887, 9892, 9897, 9900, 9901, 9902, 9906, 9907, 9908, 9909, 9910, 9911, 9912, 9917, 9921, 9923, 9924, 9928, 9935, 9938, 9940, 9946, 9947, 9949, 9950, 9953, 9955, 9957, 9958, 9960, 9962, 9963, 9964, 9967, 9968, 9971, 9972, 9979, 9980, 9982, 9984, 9985, 9987, 9988, 9990, 9991, 9996, 9997, 9998, 10000, 10008, 10009, 10010, 10013, 10017, 10018, 10019, 10021, 10022, 10026, 10031, 10032, 10033, 10034, 10037, 10038, 10041, 10042, 10043, 10045, 10047, 10048, 10050, 10051, 10052, 10054, 10056, 10058, 10059, 10060, 10062, 10063, 10064, 10066, 10068, 10073, 10077, 10078, 10082, 10083, 10086, 10087, 10089, 10090, 10091, 10092, 10093, 10095, 10097, 10101, 10102, 10103, 10105, 10106, 10107, 10108, 10109, 10110, 10114, 10115, 10116, 10118, 10122, 10127, 10128, 10131, 10132, 10136, 10141, 10143, 10146, 10149, 10151, 10152, 10158, 10162, 10163, 10165, 10166, 10168, 10170, 10174, 10176, 10177, 10178, 10181, 10182, 10187, 10191, 10192, 10193, 10194, 10195, 10197, 10199, 10203, 10206, 10209, 10212, 10214, 10218, 10219, 10220, 10222, 10223, 10225, 10228, 10232, 10233, 10236, 10237, 10239, 10246, 10247, 10252, 10253, 10255, 10257, 10263, 10268, 10270, 10275, 10284, 10291, 10292, 10295, 10296, 10297, 10300, 10302, 10306, 10307, 10311, 10321, 10322, 10323, 10325, 10326, 10327, 10328, 10331, 10333, 10334, 10335, 10336, 10343, 10346, 10351, 10353, 10356, 10357, 10359, 10360, 10362, 10364, 10368, 10371, 10373, 10375, 10378, 10380, 10381, 10383, 10384, 10385, 10388, 10389, 10397, 10398, 10399, 10401, 10409, 10410, 10413, 10414, 10416, 10421, 10422, 10423, 10430, 10435, 10437, 10438, 10440, 10442, 10443, 10446, 10447, 10448, 10449, 10450, 10453, 10456, 10460, 10463, 10464, 10465, 10468, 10469, 10470, 10474, 10478, 10480, 10482, 10487, 10488, 10492, 10494, 10496, 10497, 10499, 10504, 10506, 10508, 10513, 10514, 10516, 10518, 10521, 10525, 10527, 10528, 10531, 10533, 10535, 10536, 10537, 10541, 10542, 10543, 10544, 10545, 10547, 10548, 10555, 10556, 10558, 10560, 10561, 10562, 10563, 10565, 10567, 10569, 10571, 10573, 10580, 10581, 10582, 10583, 10585, 10587, 10591, 10593, 10595, 10596, 10597, 10599, 10601, 10602, 10606, 10610, 10611, 10613, 10615, 10616, 10617, 10621, 10622, 10623, 10626, 10628, 10634, 10637, 10638, 10639, 10640, 10641, 10642, 10643, 10645, 10646, 10650, 10655, 10657, 10659, 10660, 10663, 10665, 10666, 10668, 10670, 10673, 10674, 10678, 10681, 10682, 10683, 10684, 10685, 10687, 10689, 10693, 10697, 10698, 10699, 10700, 10701, 10702, 10703, 10705, 10706, 10707, 10711, 10715, 10716, 10721, 10722, 10723, 10725, 10726, 10732, 10734, 10735, 10737, 10740, 10741, 10744, 10745, 10748, 10749, 10752, 10761, 10762, 10763, 10766, 10775, 10778, 10779, 10782, 10784, 10785, 10787, 10788, 10790, 10791, 10792, 10795, 10796, 10798, 10800, 10801, 10802, 10803, 10804, 10805, 10809, 10810, 10811, 10812, 10815, 10818, 10819, 10820, 10821, 10822, 10823, 10824, 10825, 10826, 10831, 10833, 10836, 10838, 10839, 10841, 10843, 10846, 10847, 10850, 10852, 10853, 10854, 10857, 10858, 10860, 10861, 10862, 10866, 10867, 10871, 10874, 10877, 10878, 10880, 10881, 10891, 10892, 10893, 10896, 10897, 10898, 10899, 10902, 10905, 10910, 10912, 10913, 10916, 10917, 10920, 10926, 10927, 10928, 10930, 10933, 10934, 10935, 10936, 10937, 10938, 10940, 10941, 10944, 10947, 10948, 10950, 10954, 10957, 10960, 10962, 10965, 10967, 10972, 10976, 10977, 10979, 10980, 10981, 10988, 10993, 10995, 10996, 10997, 10999, 11004, 11005, 11006, 11008, 11009, 11010, 11018, 11024, 11027, 11032, 11039, 11045, 11046, 11047, 11052, 11053, 11056, 11060, 11068, 11070, 11071, 11072, 11078, 11079, 11080, 11082, 11083, 11086, 11090, 11095, 11098, 11099, 11100, 11101, 11102, 11103, 11107, 11108, 11110, 11114, 11116, 11117, 11118, 11123, 11124, 11125, 11127, 11128, 11129, 11132, 11133, 11135, 11137, 11138, 11141, 11145, 11146, 11152, 11153, 11154, 11158, 11159, 11160, 11161, 11162, 11163, 11165, 11166, 11168, 11169, 11175, 11177, 11178, 11181, 11184, 11185, 11187, 11188, 11190, 11191, 11192, 11198, 11199, 11201, 11202, 11203, 11207, 11214, 11217, 11218, 11222, 11224, 11226, 11227, 11228, 11229, 11232, 11233, 11234, 11235, 11236, 11237, 11238, 11239, 11246, 11247, 11248, 11251, 11256, 11257, 11258, 11259, 11260, 11261, 11262, 11263, 11264, 11266, 11274, 11275, 11278, 11286, 11288, 11289, 11290, 11291, 11292, 11293, 11294, 11295, 11298, 11305, 11306, 11307, 11313, 11315, 11316, 11317, 11319, 11320, 11322, 11324, 11326, 11329, 11332, 11337, 11339, 11340, 11345, 11346, 11348, 11349, 11352, 11356, 11358, 11363, 11364, 11365, 11366, 11370, 11371, 11373, 11374, 11377, 11381, 11382, 11387, 11388, 11389, 11391, 11392, 11394, 11395, 11397, 11401, 11403, 11405, 11406, 11409, 11416, 11418, 11423, 11424, 11426, 11428, 11430, 11431, 11434, 11437, 11438, 11445, 11446, 11449, 11451, 11459, 11463, 11465, 11467, 11471, 11472, 11473, 11475, 11476, 11477, 11478, 11481, 11482, 11485, 11487, 11496, 11497, 11498, 11500, 11501, 11506, 11507, 11508, 11509, 11512, 11513, 11516, 11520, 11523, 11524, 11526, 11527, 11528, 11530, 11531, 11532, 11533, 11534, 11535, 11538, 11541, 11544, 11546, 11547, 11548, 11551, 11553, 11558, 11560, 11561, 11564, 11567, 11568, 11571, 11574, 11576, 11577, 11578, 11580, 11583, 11586, 11588, 11593, 11594, 11595, 11597, 11598, 11599, 11604, 11612, 11618, 11620, 11621, 11623, 11625, 11628, 11629, 11632, 11633, 11636, 11637, 11639, 11642, 11650, 11651, 11652, 11654, 11655, 11656, 11657, 11658, 11659, 11663, 11664, 11667, 11668, 11669, 11672, 11673, 11677, 11678, 11680, 11681, 11682, 11683, 11688, 11691, 11692, 11694, 11695, 11701, 11703, 11705, 11707, 11711, 11712, 11720, 11721, 11725, 11726, 11731, 11733, 11736, 11740, 11743, 11744, 11748, 11753, 11755, 11759, 11760, 11761, 11762, 11763, 11764, 11765, 11766, 11767, 11770, 11771, 11773, 11776, 11780, 11781, 11782, 11783, 11785, 11786, 11790, 11792, 11795, 11799, 11800, 11809, 11811, 11812, 11813, 11814, 11816, 11818, 11819, 11825, 11826, 11828, 11829, 11830, 11831, 11832, 11833, 11837, 11838, 11841, 11846, 11849, 11850, 11851, 11853, 11854, 11856, 11858, 11863, 11868, 11870, 11872, 11876, 11877, 11878, 11879, 11881, 11886, 11890, 11891, 11893, 11894, 11898, 11903, 11904, 11909, 11913, 11915, 11916, 11917, 11919, 11920, 11921, 11923, 11926, 11927, 11928, 11929, 11930, 11934, 11935, 11939, 11940, 11941, 11943, 11946, 11947, 11948, 11949, 11953, 11955, 11957, 11958, 11959, 11960, 11961, 11962, 11963, 11965, 11968, 11976, 11977, 11978, 11980, 11983, 11988, 11993, 11997, 11998, 11999, 12002, 12004, 12006, 12008, 12017, 12019, 12020, 12021, 12023, 12024, 12025, 12032, 12035, 12042, 12043, 12044, 12047, 12050, 12054, 12059, 12060, 12061, 12064, 12077, 12078, 12079, 12080, 12081, 12083, 12085, 12086, 12091, 12092, 12093, 12097, 12098, 12104, 12106, 12109, 12112, 12114, 12115, 12118, 12120, 12122, 12127, 12128, 12129, 12130, 12131, 12134, 12135, 12138, 12139, 12143, 12144, 12145, 12146, 12147, 12149, 12150, 12151, 12161, 12162, 12165, 12166, 12170, 12171, 12173, 12174, 12175, 12179, 12181, 12186, 12187, 12197, 12198, 12200, 12201, 12202, 12204, 12208, 12212, 12215, 12217, 12220, 12223, 12229, 12233, 12237, 12240, 12241, 12243, 12245, 12249, 12250, 12252, 12254, 12255, 12256, 12259, 12265, 12268, 12269, 12271, 12278, 12280, 12283, 12284, 12285, 12286, 12287, 12288, 12295, 12296, 12302, 12310, 12311, 12312, 12313, 12314, 12315, 12317, 12319, 12321, 12323, 12325, 12328, 12331, 12334, 12335, 12339, 12342, 12343, 12345, 12347, 12350, 12354, 12356, 12359, 12364, 12366, 12369, 12370, 12375, 12376, 12379, 12381, 12383, 12385, 12390, 12393, 12394, 12397, 12399, 12400, 12401, 12403, 12404, 12406, 12411, 12414, 12415, 12419, 12420, 12423, 12424, 12425, 12426, 12427, 12430, 12432, 12437, 12440, 12441, 12444, 12445, 12447, 12450, 12451, 12456, 12457, 12459, 12461, 12462, 12465, 12467, 12468, 12470, 12472, 12473, 12475, 12478, 12479, 12480, 12481, 12483, 12487, 12488, 12489, 12492, 12494, 12495, 12497, 12503, 12508, 12510, 12511, 12512, 12513, 12514, 12515, 12518, 12519, 12527, 12530, 12531, 12535, 12536, 12537, 12538, 12539, 12540, 12546, 12547, 12548, 12549, 12551, 12552, 12554, 12555, 12556, 12557, 12561, 12563, 12565, 12567, 12568, 12570, 12572, 12574, 12577, 12578, 12580, 12583, 12585, 12586, 12588, 12589, 12591, 12600, 12603, 12605, 12608, 12609, 12610, 12611, 12616, 12622, 12623, 12626, 12628, 12629, 12631, 12634, 12639, 12640, 12641, 12644, 12648, 12649, 12650, 12651, 12652, 12653, 12654, 12663, 12664, 12668, 12670, 12671, 12674, 12679, 12680, 12681, 12683, 12684, 12685, 12688, 12689, 12691, 12692, 12693, 12695, 12696, 12699, 12701, 12702, 12705, 12706, 12713, 12714, 12716, 12723, 12731, 12732, 12733, 12735, 12738, 12739, 12740, 12741, 12742, 12752, 12753, 12754, 12755, 12757, 12758, 12760, 12761, 12764, 12765, 12766, 12771, 12775, 12777, 12782, 12783, 12790, 12794, 12797, 12800, 12802, 12803, 12807, 12808, 12810, 12812, 12813, 12817, 12820, 12822, 12823, 12824, 12826, 12827, 12828, 12835, 12836, 12837, 12838, 12839, 12843, 12844, 12848, 12849, 12850, 12853, 12860, 12861, 12866, 12870, 12873, 12875, 12878, 12882, 12883, 12884, 12887, 12888, 12891, 12898, 12899, 12900, 12901, 12903, 12904, 12905, 12906, 12908, 12910, 12912, 12913, 12916, 12917, 12920, 12921, 12928, 12929, 12932, 12933, 12934, 12935, 12938, 12945, 12946, 12947, 12950, 12952, 12953, 12956, 12958, 12959, 12960, 12961, 12963, 12967, 12968, 12969, 12978, 12983, 12984, 12986, 12987, 12988, 12990, 12991, 12999, 13001, 13003, 13004, 13007, 13010, 13014, 13015, 13017, 13018, 13022, 13027, 13030, 13031, 13033, 13034, 13035, 13036, 13037, 13038, 13040, 13041, 13044, 13045, 13049, 13050, 13053, 13054, 13055, 13056, 13061, 13062, 13064, 13066, 13067, 13071, 13075, 13079, 13083, 13085, 13086, 13087, 13097, 13099, 13101, 13102, 13105, 13106, 13110, 13111, 13112, 13114, 13115, 13116, 13117, 13118, 13120, 13122, 13123, 13124, 13125, 13128, 13131, 13134, 13135, 13144, 13147, 13148, 13149, 13151, 13154, 13159, 13160, 13169, 13175, 13181, 13182, 13186, 13188, 13189, 13190, 13197, 13198, 13199, 13203, 13205, 13206, 13209, 13210, 13212, 13213, 13215, 13217, 13221, 13224, 13226, 13227, 13228, 13232, 13234, 13235, 13236, 13237, 13239, 13241, 13243, 13248, 13250, 13251, 13255, 13256, 13259, 13260, 13261, 13262, 13263, 13264, 13267, 13268, 13269, 13271, 13274, 13281, 13283, 13284, 13287, 13296, 13297, 13298, 13300, 13301, 13303, 13304, 13313, 13315, 13317, 13319, 13325, 13329, 13332, 13335, 13337, 13340, 13343, 13344, 13345, 13346, 13347, 13348, 13350, 13352, 13361, 13363, 13367, 13368, 13369, 13370, 13377, 13379, 13380, 13381, 13384, 13385, 13386, 13391, 13393, 13394, 13395, 13396, 13397, 13398, 13401, 13402, 13403, 13404, 13407, 13408, 13410, 13412, 13413, 13416, 13417, 13419, 13423, 13424, 13429, 13430, 13433, 13439, 13441, 13444, 13448, 13456, 13457, 13460, 13463, 13467, 13469, 13473, 13475, 13477, 13478, 13480, 13484, 13489, 13491, 13492, 13496, 13497, 13499, 13503, 13504, 13505, 13507, 13513, 13514, 13515, 13516, 13519, 13521, 13522, 13524, 13526, 13529, 13533, 13535, 13536, 13539, 13540, 13543, 13544, 13545, 13546, 13547, 13549, 13552, 13553, 13555, 13558, 13559, 13561, 13568, 13569, 13574, 13580, 13584, 13587, 13597, 13599, 13600, 13601, 13602, 13604, 13605, 13611, 13612, 13613, 13614, 13621, 13623, 13630, 13631, 13632, 13634, 13636, 13637, 13641, 13643, 13647, 13650, 13651, 13653, 13654, 13660, 13662, 13663, 13665, 13668, 13670, 13675, 13676, 13677, 13678, 13679, 13683, 13687, 13688, 13697, 13698, 13699, 13700, 13702, 13706, 13710, 13713, 13714, 13716, 13719, 13720, 13724, 13727, 13729, 13737, 13739, 13742, 13745, 13747, 13750, 13755, 13756, 13758, 13764, 13766, 13767, 13772, 13773, 13775, 13777, 13779, 13780, 13781, 13782, 13783, 13786, 13787, 13789, 13791, 13793, 13794, 13796, 13797, 13799, 13809, 13816, 13817, 13818, 13819, 13822, 13823, 13828, 13830, 13831, 13834, 13835, 13843, 13848, 13849, 13852, 13858, 13866, 13869, 13872, 13873, 13875, 13877, 13879, 13887, 13888, 13891, 13892, 13895, 13897, 13898, 13899, 13901, 13902, 13903, 13906, 13908, 13909, 13910, 13911, 13917, 13918, 13919, 13921, 13924, 13925, 13932, 13934, 13947, 13950, 13952, 13953, 13954, 13958, 13960, 13961, 13963, 13969, 13970, 13971, 13975, 13984, 13986, 13987, 13991, 13999, 14000, 14001, 14005, 14006, 14008, 14009, 14013, 14014, 14017, 14022, 14027, 14030, 14031, 14035, 14036, 14038, 14040, 14049, 14051, 14052, 14059, 14062, 14063, 14066, 14067, 14069, 14070, 14071, 14072, 14073, 14074, 14075, 14078, 14081, 14084, 14085, 14086, 14088, 14092, 14094, 14096, 14097, 14106, 14112, 14114, 14116, 14117, 14118, 14119, 14121, 14122, 14124, 14129, 14130, 14132, 14133, 14135, 14137, 14138, 14139, 14140, 14142, 14145, 14146, 14147.

Promoters expressing in the spikelet pair meristem at the V12 to V14 stage include SEQ IDs: 3, 7, 9, 12, 14, 15, 16, 17, 19, 20, 29, 31, 32, 33, 34, 36, 37, 44, 48, 54, 57, 63, 64, 65, 79, 80, 88, 93, 94, 96, 97, 98, 99, 101, 103, 104, 110, 112, 117, 121, 123, 128, 130, 131, 132, 135, 141, 142, 143, 147, 148, 154, 156, 157, 159, 160, 162, 164, 165, 172, 174, 175, 176, 181, 183, 187, 191, 193, 194, 196, 197, 199, 202, 203, 205, 207, 211, 212, 214, 223, 232, 233, 235, 236, 237, 239, 240, 242, 246, 249, 250, 251, 257, 259, 262, 264, 267, 269, 270, 280, 286, 288, 289, 293, 294, 301, 302, 305, 306, 309, 316, 319, 320, 322, 323, 328, 329, 332, 334, 335, 338, 346, 349, 352, 353, 354, 355, 356, 358, 359, 360, 364, 365, 373, 374, 378, 379, 381, 386, 388, 389, 395, 396, 401, 411, 412, 414, 423, 428, 431, 432, 433, 434, 436, 441, 448, 450, 452, 455, 456, 460, 461, 462, 463, 466, 470, 471, 474, 478, 479, 483, 485, 488, 489, 496, 498, 504, 507, 509, 510, 511, 514, 515, 516, 517, 523, 525, 528, 532, 535, 537, 541, 542, 543, 544, 546, 547, 548, 549, 553, 554, 557, 560, 561, 563, 565, 573, 577, 578, 580, 585, 588, 591, 592, 594, 595, 596, 598, 599, 601, 602, 605, 606, 607, 608, 609, 613, 614, 619, 620, 623, 631, 633, 634, 635, 636, 637, 638, 643, 645, 647, 650, 655, 659, 661, 662, 663, 664, 670, 671, 681, 683, 687, 692, 693, 694, 701, 702, 705, 706, 709, 716, 717, 718, 719, 722, 723, 724, 727, 731, 732, 734, 736, 739, 740, 742, 744, 749, 750, 753, 757, 759, 760, 761, 762, 763, 764, 765, 779, 782, 783, 784, 785, 792, 793, 800, 804, 806, 808, 809, 811, 820, 822, 824, 825, 826, 829, 830, 833, 836, 840, 845, 846, 849, 852, 855, 856, 857, 858, 860, 862, 863, 864, 865, 870, 871, 872, 875, 876, 877, 882, 887, 890, 891, 892, 893, 895, 897, 898, 899, 903, 907, 908, 911, 912, 915, 916, 917, 919, 920, 924, 928, 929, 931, 932, 936, 939, 943, 944, 947, 949, 951, 953, 955, 957, 958, 960, 971, 973, 974, 976, 977, 978, 979, 980, 982, 984, 985, 987, 989, 993, 994, 995, 997, 999, 1002, 1007, 1008, 1009, 1010, 1011, 1012, 1013, 1014, 1016, 1017, 1019, 1022, 1025, 1026, 1032, 1033, 1035, 1038, 1039, 1040, 1041, 1042, 1043, 1046, 1047, 1049, 1051, 1052, 1054, 1055, 1056, 1057, 1059, 1064, 1065, 1067, 1069, 1070, 1073, 1074, 1076, 1077, 1080, 1085, 1086, 1087, 1089, 1091, 1092, 1095, 1100, 1101, 1103, 1104, 1110, 1112, 1114, 1115, 1116, 1117, 1119, 1121, 1125, 1130, 1132, 1136, 1137, 1140, 1146, 1148, 1154, 1155, 1160, 1161, 1165, 1167, 1168, 1170, 1171, 1176, 1178, 1183, 1189, 1191, 1193, 1196, 1200, 1201, 1204, 1205, 1213, 1214, 1218, 1220, 1222, 1223, 1225, 1228, 1230, 1231, 1232, 1236, 1237, 1239, 1240, 1244, 1248, 1249, 1251, 1254, 1257, 1258, 1261, 1262, 1263, 1272, 1277, 1281, 1282, 1285, 1286, 1290, 1292, 1293, 1296, 1303, 1306, 1307, 1309, 1310, 1311, 1312, 1314, 1316, 1320, 1321, 1322, 1323, 1327, 1330, 1331, 1334, 1339, 1345, 1347, 1349, 1356, 1360, 1363, 1364, 1366, 1367, 1368, 1371, 1375, 1376, 1377, 1380, 1383, 1387, 1388, 1389, 1393, 1394, 1396, 1398, 1399, 1404, 1405, 1406, 1407, 1412, 1415, 1420, 1421, 1423, 1426, 1431, 1432, 1433, 1435, 1438, 1439, 1440, 1441, 1442, 1447, 1448, 1451, 1453, 1458, 1459, 1461, 1462, 1466, 1472, 1475, 1484, 1487, 1488, 1490, 1491, 1492, 1493, 1498, 1499, 1503, 1504, 1506, 1508, 1510, 1511, 1512, 1514, 1518, 1519, 1525, 1526, 1527, 1528, 1530, 1539, 1543, 1545, 1546, 1549, 1550, 1551, 1554, 1555, 1556, 1559, 1560, 1561, 1564, 1567, 1568, 1570, 1571, 1575, 1578, 1584, 1585, 1586, 1588, 1590, 1591, 1594, 1597, 1598, 1599, 1600, 1601, 1602, 1604, 1605, 1609, 1610, 1612, 1614, 1615, 1616, 1617, 1622, 1623, 1625, 1634, 1635, 1636, 1637, 1638, 1641, 1643, 1650, 1651, 1654, 1658, 1659, 1662, 1663, 1669, 1671, 1673, 1675, 1676, 1678, 1681, 1682, 1684, 1687, 1688, 1689, 1690, 1691, 1696, 1697, 1698, 1699, 1703, 1705, 1706, 1707, 1708, 1710, 1716, 1717, 1718, 1720, 1725, 1729, 1732, 1735, 1739, 1745, 1750, 1755, 1758, 1759, 1760, 1761, 1764, 1769, 1770, 1773, 1774, 1776, 1777, 1778, 1785, 1786, 1791, 1792, 1793, 1796, 1798, 1807, 1808, 1809, 1811, 1812, 1813, 1822, 1825, 1826, 1828, 1830, 1832, 1834, 1837, 1839, 1840, 1848, 1849, 1852, 1859, 1861, 1863, 1866, 1867, 1869, 1872, 1873, 1876, 1879, 1880, 1882, 1886, 1888, 1891, 1894, 1897, 1898, 1899, 1900, 1901, 1902, 1905, 1906, 1910, 1911, 1915, 1916, 1918, 1920, 1922, 1923, 1924, 1928, 1930, 1931, 1933, 1934, 1936, 1939, 1940, 1942, 1945, 1948, 1949, 1950, 1951, 1952, 1953, 1954, 1956, 1958, 1968, 1969, 1970, 1971, 1972, 1973, 1974, 1979, 1986, 1990, 1991, 1993, 1994, 1995, 1996, 1999, 2000, 2007, 2008, 2009, 2010, 2012, 2014, 2015, 2016, 2017, 2019, 2021, 2026, 2032, 2033, 2037, 2040, 2041, 2042, 2043, 2048, 2057, 2058, 2060, 2062, 2064, 2066, 2072, 2074, 2077, 2078, 2085, 2087, 2088, 2089, 2091, 2092, 2093, 2094, 2097, 2099, 2101, 2103, 2104, 2106, 2107, 2112, 2122, 2123, 2125, 2128, 2132, 2133, 2137, 2139, 2140, 2142, 2143, 2146, 2147, 2150, 2151, 2156, 2157, 2161, 2164, 2167, 2168, 2170, 2172, 2173, 2175, 2177, 2178, 2179, 2185, 2188, 2189, 2193, 2195, 2196, 2202, 2203, 2206, 2210, 2215, 2216, 2218, 2221, 2222, 2223, 2226, 2232, 2235, 2240, 2241, 2242, 2243, 2244, 2253, 2257, 2259, 2260, 2263, 2266, 2267, 2274, 2276, 2278, 2280, 2282, 2283, 2284, 2288, 2291, 2296, 2297, 2298, 2300, 2303, 2304, 2305, 2306, 2308, 2309, 2310, 2313, 2314, 2322, 2323, 2328, 2329, 2331, 2333, 2339, 2342, 2348, 2353, 2363, 2366, 2369, 2371, 2372, 2376, 2379, 2380, 2381, 2382, 2384, 2401, 2402, 2405, 2410, 2412, 2413, 2414, 2418, 2419, 2420, 2423, 2428, 2430, 2431, 2432, 2433, 2434, 2435, 2437, 2439, 2440, 2441, 2442, 2443, 2445, 2449, 2451, 2452, 2453, 2454, 2457, 2458, 2469, 2470, 2472, 2474, 2476, 2477, 2479, 2480, 2481, 2485, 2487, 2490, 2492, 2494, 2495, 2496, 2498, 2500, 2505, 2506, 2507, 2509, 2513, 2514, 2515, 2516, 2517, 2519, 2521, 2525, 2526, 2528, 2529, 2531, 2533, 2534, 2536, 2537, 2538, 2539, 2541, 2544, 2545, 2549, 2550, 2551, 2552, 2554, 2555, 2556, 2559, 2560, 2567, 2568, 2570, 2573, 2576, 2578, 2579, 2581, 2583, 2589, 2590, 2591, 2594, 2596, 2599, 2601, 2605, 2607, 2609, 2611, 2612, 2613, 2616, 2617, 2619, 2620, 2622, 2625, 2626, 2627, 2632, 2634, 2635, 2636, 2639, 2641, 2644, 2645, 2648, 2649, 2651, 2652, 2655, 2656, 2658, 2661, 2662, 2663, 2665, 2666, 2671, 2672, 2674, 2676, 2679, 2684, 2685, 2687, 2688, 2689, 2690, 2691, 2692, 2694, 2696, 2700, 2702, 2704, 2709, 2711, 2712, 2719, 2720, 2721, 2722, 2723, 2725, 2726, 2728, 2729, 2730, 2735, 2736, 2745, 2746, 2747, 2749, 2752, 2755, 2756, 2758, 2759, 2760, 2762, 2764, 2765, 2770, 2775, 2776, 2779, 2782, 2784, 2787, 2788, 2789, 2791, 2794, 2796, 2798, 2800, 2801, 2802, 2805, 2808, 2812, 2814, 2819, 2821, 2822, 2823, 2824, 2826, 2827, 2828, 2832, 2838, 2840, 2844, 2845, 2850, 2854, 2855, 2860, 2861, 2865, 2869, 2871, 2876, 2878, 2888, 2889, 2892, 2893, 2894, 2895, 2896, 2897, 2898, 2901, 2902, 2903, 2906, 2908, 2909, 2915, 2916, 2917, 2918, 2919, 2922, 2923, 2926, 2929, 2930, 2931, 2935, 2937, 2941, 2942, 2943, 2944, 2946, 2947, 2948, 2955, 2959, 2962, 2963, 2966, 2968, 2976, 2978, 2979, 2982, 2985, 2987, 2992, 2994, 2998, 3000, 3003, 3005, 3007, 3008, 3009, 3013, 3015, 3017, 3018, 3019, 3020, 3023, 3029, 3031, 3033, 3039, 3042, 3044, 3045, 3047, 3048, 3049, 3051, 3052, 3053, 3055, 3062, 3064, 3065, 3067, 3068, 3070, 3072, 3075, 3080, 3083, 3085, 3087, 3090, 3094, 3095, 3096, 3097, 3100, 3101, 3106, 3115, 3118, 3119, 3120, 3121, 3122, 3123, 3126, 3127, 3128, 3137, 3139, 3143, 3149, 3153, 3167, 3169, 3170, 3172, 3173, 3177, 3181, 3189, 3191, 3192, 3194, 3196, 3202, 3205, 3206, 3208, 3210, 3217, 3218, 3220, 3221, 3224, 3225, 3228, 3230, 3237, 3240, 3242, 3246, 3249, 3250, 3252, 3254, 3261, 3263, 3266, 3267, 3269, 3271, 3272, 3273, 3278, 3280, 3283, 3286, 3288, 3289, 3290, 3291, 3294, 3295, 3297, 3299, 3301, 3308, 3310, 3312, 3313, 3314, 3324, 3331, 3332, 3333, 3337, 3338, 3340, 3342, 3343, 3345, 3347, 3351, 3353, 3355, 3356, 3357, 3358, 3359, 3360, 3361, 3363, 3368, 3369, 3370, 3373, 3374, 3376, 3377, 3378, 3379, 3382, 3383, 3386, 3394, 3396, 3399, 3403, 3404, 3405, 3413, 3415, 3416, 3418, 3419, 3424, 3426, 3427, 3428, 3432, 3435, 3438, 3442, 3446, 3447, 3449, 3450, 3452, 3453, 3458, 3461, 3465, 3466, 3468, 3469, 3470, 3471, 3474, 3477, 3483, 3484, 3486, 3488, 3490, 3493, 3494, 3499, 3500, 3502, 3503, 3504, 3506, 3507, 3510, 3516, 3517, 3518, 3521, 3522, 3523, 3524, 3529, 3533, 3535, 3536, 3537, 3538, 3540, 3541, 3542, 3544, 3545, 3548, 3549, 3554, 3558, 3560, 3562, 3569, 3571, 3574, 3576, 3580, 3587, 3588, 3589, 3592, 3594, 3595, 3599, 3600, 3603, 3604, 3606, 3607, 3610, 3611, 3613, 3615, 3616, 3619, 3620, 3624, 3629, 3633, 3634, 3636, 3637, 3640, 3642, 3643, 3644, 3645, 3646, 3648, 3655, 3659, 3660, 3661, 3667, 3672, 3674, 3677, 3681, 3682, 3684, 3685, 3690, 3693, 3704, 3706, 3707, 3709, 3713, 3715, 3718, 3719, 3721, 3722, 3723, 3725, 3726, 3730, 3731, 3732, 3733, 3738, 3739, 3744, 3749, 3752, 3756, 3757, 3760, 3763, 3764, 3765, 3766, 3775, 3777, 3778, 3783, 3785, 3787, 3791, 3792, 3793, 3794, 3798, 3801, 3806, 3808, 3809, 3817, 3818, 3819, 3823, 3825, 3828, 3830, 3831, 3832, 3833, 3837, 3838, 3843, 3844, 3845, 3846, 3847, 3849, 3852, 3858, 3859, 3860, 3866, 3867, 3868, 3870, 3871, 3872, 3873, 3881, 3883, 3884, 3887, 3889, 3890, 3892, 3894, 3895, 3897, 3902, 3903, 3904, 3907, 3908, 3909, 3912, 3913, 3917, 3918, 3924, 3926, 3928, 3929, 3931, 3933, 3934, 3938, 3941, 3947, 3950, 3951, 3952, 3954, 3958, 3962, 3964, 3967, 3968, 3970, 3971, 3972, 3974, 3975, 3976, 3977, 3978, 3983, 3985, 3988, 3994, 3995, 3996, 3997, 4000, 4001, 4002, 4003, 4007, 4008, 4012, 4013, 4014, 4019, 4020, 4028, 4030, 4033, 4037, 4039, 4040, 4041, 4042, 4043, 4046, 4047, 4048, 4049, 4050, 4051, 4052, 4053, 4054, 4055, 4056, 4057, 4062, 4066, 4067, 4068, 4070, 4071, 4080, 4084, 4088, 4090, 4092, 4094, 4096, 4102, 4105, 4106, 4109, 4110, 4111, 4113, 4116, 4117, 4122, 4124, 4126, 4128, 4132, 4133, 4134, 4135, 4139, 4140, 4143, 4144, 4146, 4147, 4149, 4150, 4151, 4155, 4160, 4163, 4164, 4165, 4166, 4167, 4168, 4170, 4171, 4175, 4176, 4178, 4181, 4183, 4185, 4187, 4188, 4189, 4191, 4192, 4193, 4195, 4197, 4201, 4202, 4204, 4205, 4206, 4207, 4208, 4210, 4211, 4212, 4213, 4218, 4219, 4221, 4227, 4228, 4229, 4232, 4233, 4234, 4235, 4237, 4244, 4245, 4246, 4251, 4252, 4257, 4260, 4261, 4266, 4270, 4272, 4275, 4276, 4280, 4281, 4283, 4284, 4288, 4290, 4294, 4295, 4296, 4298, 4300, 4301, 4302, 4304, 4305, 4306, 4309, 4312, 4314, 4317, 4320, 4321, 4324, 4329, 4330, 4332, 4335, 4338, 4339, 4341, 4347, 4358, 4359, 4360, 4369, 4370, 4371, 4373, 4374, 4375, 4378, 4383, 4388, 4390, 4391, 4396, 4397, 4401, 4402, 4403, 4404, 4405, 4406, 4409, 4410, 4417, 4422, 4423, 4430, 4432, 4436, 4439, 4440, 4442, 4443, 4446, 4448, 4449, 4450, 4453, 4456, 4461, 4462, 4463, 4466, 4467, 4468, 4474, 4475, 4479, 4485, 4490, 4492, 4494, 4497, 4498, 4500, 4502, 4507, 4508, 4509, 4512, 4513, 4514, 4515, 4519, 4521, 4525, 4529, 4531, 4535, 4541, 4543, 4545, 4548, 4549, 4551, 4554, 4555, 4556, 4557, 4558, 4560, 4562, 4563, 4565, 4566, 4567, 4568, 4575, 4576, 4578, 4579, 4580, 4582, 4583, 4590, 4591, 4594, 4597, 4598, 4601, 4606, 4614, 4616, 4623, 4625, 4628, 4630, 4632, 4633, 4634, 4635, 4639, 4641, 4643, 4644, 4646, 4647, 4650, 4651, 4653, 4654, 4655, 4656, 4658, 4659, 4662, 4664, 4667, 4669, 4671, 4672, 4673, 4674, 4676, 4677, 4682, 4685, 4691, 4692, 4694, 4697, 4699, 4700, 4703, 4706, 4708, 4710, 4711, 4713, 4719, 4720, 4721, 4724, 4729, 4730, 4734, 4736, 4737, 4738, 4739, 4740, 4741, 4745, 4746, 4749, 4750, 4751, 4753, 4755, 4756, 4761, 4762, 4763, 4766, 4767, 4769, 4770, 4771, 4773, 4775, 4779, 4780, 4784, 4787, 4788, 4789, 4790, 4791, 4794, 4795, 4796, 4801, 4803, 4804, 4805, 4806, 4807, 4812, 4813, 4814, 4815, 4818, 4822, 4823, 4828, 4830, 4831, 4834, 4836, 4838, 4840, 4841, 4842, 4854, 4855, 4856, 4857, 4858, 4859, 4861, 4862, 4863, 4864, 4869, 4874, 4875, 4876, 4878, 4881, 4887, 4889, 4891, 4895, 4896, 4897, 4900, 4902, 4904, 4905, 4907, 4909, 4910, 4914, 4921, 4922, 4924, 4935, 4936, 4937, 4941, 4942, 4950, 4954, 4955, 4958, 4959, 4963, 4967, 4969, 4971, 4972, 4974, 4975, 4980, 4987, 4989, 4990, 4993, 4994, 4996, 5000, 5010, 5014, 5015, 5016, 5024, 5026, 5029, 5030, 5036, 5037, 5039, 5040, 5041, 5042, 5044, 5045, 5046, 5049, 5052, 5054, 5057, 5060, 5067, 5068, 5069, 5072, 5074, 5075, 5078, 5082, 5089, 5090, 5091, 5094, 5100, 5101, 5102, 5106, 5107, 5109, 5110, 5113, 5114, 5115, 5116, 5123, 5125, 5131, 5132, 5140, 5143, 5147, 5149, 5151, 5159, 5160, 5163, 5164, 5165, 5168, 5170, 5172, 5174, 5180, 5181, 5184, 5185, 5187, 5188, 5189, 5190, 5191, 5192, 5193, 5196, 5198, 5200, 5202, 5206, 5209, 5212, 5213, 5217, 5218, 5219, 5221, 5225, 5234, 5237, 5238, 5240, 5244, 5245, 5249, 5251, 5253, 5254, 5255, 5258, 5260, 5261, 5263, 5264, 5267, 5268, 5269, 5273, 5274, 5275, 5276, 5279, 5280, 5281, 5282, 5283, 5284, 5285, 5286, 5287, 5292, 5293, 5297, 5298, 5299, 5300, 5301, 5308, 5311, 5315, 5317, 5319, 5321, 5324, 5328, 5329, 5330, 5333, 5334, 5338, 5339, 5342, 5345, 5346, 5348, 5349, 5351, 5352, 5366, 5367, 5369, 5371, 5375, 5376, 5386, 5388, 5389, 5391, 5393, 5395, 5396, 5397, 5404, 5405, 5409, 5411, 5413, 5414, 5417, 5418, 5422, 5427, 5428, 5431, 5434, 5437, 5438, 5446, 5448, 5449, 5452, 5453, 5456, 5458, 5459, 5461, 5462, 5475, 5482, 5483, 5485, 5487, 5488, 5491, 5493, 5495, 5496, 5505, 5508, 5510, 5512, 5513, 5515, 5517, 5518, 5519, 5524, 5526, 5529, 5530, 5531, 5532, 5534, 5535, 5537, 5543, 5545, 5549, 5554, 5561, 5562, 5563, 5566, 5568, 5569, 5572, 5575, 5579, 5581, 5582, 5584, 5585, 5589, 5591, 5593, 5594, 5597, 5602, 5608, 5613, 5614, 5615, 5616, 5618, 5620, 5623, 5627, 5630, 5632, 5633, 5635, 5638, 5640, 5643, 5647, 5648, 5649, 5650, 5651, 5652, 5653, 5656, 5657, 5659, 5660, 5662, 5663, 5669, 5680, 5681, 5683, 5689, 5690, 5694, 5695, 5696, 5697, 5698, 5702, 5706, 5711, 5712, 5713, 5714, 5717, 5718, 5719, 5721, 5722, 5729, 5730, 5731, 5732, 5734, 5735, 5736, 5737, 5740, 5742, 5744, 5748, 5751, 5768, 5770, 5773, 5775, 5778, 5780, 5784, 5785, 5787, 5791, 5792, 5794, 5803, 5805, 5807, 5808, 5809, 5811, 5814, 5815, 5817, 5820, 5825, 5826, 5828, 5832, 5833, 5834, 5835, 5836, 5837, 5839, 5842, 5844, 5846, 5854, 5859, 5864, 5866, 5867, 5869, 5871, 5872, 5873, 5875, 5876, 5877, 5878, 5879, 5881, 5882, 5883, 5888, 5889, 5892, 5893, 5906, 5910, 5912, 5918, 5919, 5921, 5922, 5923, 5925, 5926, 5927, 5928, 5930, 5931, 5932, 5933, 5938, 5939, 5940, 5941, 5942, 5944, 5945, 5947, 5948, 5951, 5954, 5957, 5959, 5961, 5967, 5968, 5969, 5971, 5973, 5978, 5979, 5980, 5985, 5986, 5990, 5991, 5994, 5996, 5997, 5999, 6000, 6003, 6004, 6005, 6006, 6007, 6010, 6012, 6013, 6016, 6017, 6023, 6025, 6026, 6031, 6034, 6038, 6040, 6041, 6044, 6046, 6047, 6048, 6051, 6053, 6058, 6059, 6061, 6062, 6063, 6065, 6068, 6069, 6070, 6072, 6073, 6074, 6075, 6080, 6081, 6089, 6091, 6093, 6094, 6095, 6096, 6098, 6099, 6107, 6108, 6109, 6110, 6112, 6113, 6116, 6118, 6119, 6122, 6129, 6130, 6132, 6133, 6135, 6136, 6137, 6140, 6143, 6145, 6146, 6147, 6149, 6151, 6153, 6156, 6160, 6163, 6164, 6165, 6168, 6173, 6176, 6182, 6183, 6186, 6188, 6189, 6190, 6191, 6193, 6197, 6198, 6200, 6205, 6207, 6209, 6212, 6213, 6215, 6220, 6221, 6223, 6224, 6226, 6227, 6228, 6230, 6231, 6233, 6234, 6237, 6238, 6239, 6240, 6243, 6245, 6246, 6247, 6248, 6249, 6251, 6255, 6257, 6258, 6259, 6260, 6264, 6265, 6269, 6270, 6271, 6272, 6273, 6275, 6278, 6279, 6280, 6281, 6282, 6286, 6288, 6292, 6294, 6299, 6302, 6308, 6309, 6310, 6312, 6315, 6317, 6319, 6321, 6322, 6325, 6328, 6332, 6333, 6338, 6346, 6351, 6352, 6353, 6354, 6358, 6359, 6362, 6363, 6364, 6367, 6370, 6372, 6375, 6378, 6379, 6381, 6383, 6394, 6395, 6396, 6397, 6398, 6399, 6403, 6405, 6407, 6408, 6412, 6413, 6414, 6415, 6419, 6420, 6422, 6428, 6429, 6430, 6431, 6434, 6436, 6437, 6442, 6449, 6452, 6454, 6458, 6459, 6463, 6464, 6466, 6467, 6468, 6469, 6470, 6471, 6474, 6476, 6480, 6481, 6482, 6484, 6486, 6488, 6495, 6499, 6500, 6501, 6502, 6503, 6504, 6505, 6510, 6513, 6514, 6515, 6516, 6517, 6519, 6524, 6525, 6526, 6530, 6532, 6533, 6534, 6535, 6537, 6543, 6544, 6547, 6548, 6549, 6552, 6554, 6555, 6558, 6560, 6561, 6563, 6564, 6567, 6572, 6574, 6576, 6577, 6579, 6581, 6582, 6584, 6587, 6588, 6589, 6595, 6598, 6599, 6600, 6603, 6607, 6609, 6611, 6614, 6621, 6624, 6625, 6626, 6627, 6630, 6634, 6635, 6637, 6638, 6639, 6640, 6643, 6644, 6646, 6647, 6648, 6649, 6652, 6655, 6656, 6658, 6662, 6666, 6671, 6672, 6677, 6678, 6681, 6686, 6691, 6692, 6696, 6703, 6705, 6706, 6711, 6714, 6716, 6718, 6720, 6724, 6725, 6729, 6731, 6734, 6736, 6737, 6739, 6746, 6747, 6752, 6756, 6757, 6759, 6761, 6764, 6766, 6778, 6779, 6780, 6783, 6786, 6788, 6792, 6793, 6794, 6797, 6799, 6803, 6804, 6805, 6807, 6810, 6811, 6812, 6813, 6816, 6819, 6820, 6821, 6824, 6827, 6828, 6830, 6831, 6834, 6837, 6839, 6840, 6841, 6842, 6843, 6845, 6851, 6854, 6859, 6864, 6869, 6870, 6872, 6874, 6875, 6876, 6878, 6879, 6880, 6884, 6888, 6890, 6892, 6897, 6903, 6904, 6913, 6914, 6915, 6917, 6919, 6920, 6921, 6925, 6930, 6933, 6936, 6941, 6943, 6946, 6948, 6950, 6951, 6952, 6959, 6960, 6963, 6969, 6979, 6980, 6984, 6985, 6987, 6988, 6990, 6991, 6993, 6994, 6995, 6999, 7002, 7003, 7005, 7006, 7009, 7011, 7012, 7013, 7015, 7017, 7022, 7032, 7039, 7042, 7043, 7045, 7046, 7051, 7052, 7053, 7056, 7057, 7064, 7067, 7068, 7072, 7074, 7075, 7077, 7079, 7083, 7084, 7085, 7086, 7093, 7094, 7097, 7105, 7106, 7107, 7108, 7112, 7116, 7117, 7118, 7124, 7130, 7132, 7135, 7137, 7140, 7142, 7144, 7146, 7149, 7151, 7155, 7163, 7164, 7165, 7166, 7169, 7176, 7177, 7182, 7183, 7184, 7187, 7188, 7192, 7196, 7197, 7201, 7203, 7206, 7207, 7208, 7209, 7216, 7217, 7218, 7219, 7227, 7228, 7230, 7231, 7232, 7233, 7234, 7235, 7236, 7239, 7240, 7241, 7243, 7244, 7245, 7248, 7255, 7257, 7258, 7259, 7262, 7267, 7268, 7269, 7270, 7274, 7276, 7277, 7281, 7282, 7284, 7287, 7288, 7291, 7292, 7293, 7298, 7299, 7300, 7301, 7303, 7304, 7305, 7306, 7307, 7310, 7311, 7312, 7315, 7317, 7321, 7328, 7330, 7334, 7338, 7339, 7340, 7344, 7348, 7354, 7355, 7356, 7357, 7358, 7361, 7363, 7365, 7371, 7373, 7375, 7379, 7380, 7381, 7382, 7383, 7388, 7389, 7392, 7395, 7398, 7400, 7401, 7410, 7411, 7417, 7424, 7425, 7428, 7430, 7434, 7435, 7436, 7443, 7444, 7445, 7446, 7447, 7448, 7452, 7454, 7458, 7459, 7466, 7470, 7483, 7486, 7487, 7490, 7492, 7493, 7498, 7502, 7504, 7505, 7512, 7515, 7517, 7518, 7523, 7524, 7525, 7528, 7529, 7533, 7537, 7538, 7542, 7546, 7547, 7548, 7560, 7561, 7570, 7574, 7577, 7578, 7579, 7580, 7583, 7585, 7586, 7587, 7588, 7590, 7591, 7593, 7594, 7598, 7601, 7605, 7611, 7617, 7619, 7620, 7621, 7623, 7624, 7632, 7633, 7634, 7638, 7639, 7640, 7642, 7643, 7647, 7652, 7658, 7661, 7663, 7664, 7665, 7666, 7667, 7674, 7677, 7678, 7679, 7680, 7682, 7687, 7689, 7695, 7699, 7700, 7703, 7704, 7708, 7712, 7713, 7716, 7717, 7718, 7719, 7724, 7725, 7729, 7730, 7733, 7736, 7737, 7738, 7740, 7743, 7744, 7745, 7747, 7749, 7751, 7753, 7755, 7761, 7762, 7763, 7764, 7767, 7768, 7769, 7770, 7774, 7775, 7777, 7778, 7779, 7780, 7782, 7785, 7786, 7788, 7791, 7793, 7796, 7798, 7800, 7803, 7804, 7806, 7807, 7812, 7815, 7818, 7819, 7820, 7823, 7824, 7825, 7832, 7833, 7834, 7838, 7841, 7844, 7847, 7848, 7849, 7856, 7858, 7859, 7860, 7862, 7863, 7865, 7873, 7876, 7878, 7888, 7890, 7895, 7896, 7900, 7908, 7909, 7910, 7911, 7917, 7918, 7920, 7921, 7922, 7923, 7925, 7929, 7933, 7934, 7935, 7936, 7938, 7942, 7943, 7944, 7945, 7946, 7947, 7948, 7949, 7950, 7952, 7953, 7955, 7956, 7964, 7965, 7966, 7967, 7972, 7974, 7976, 7977, 7978, 7980, 7982, 7983, 7984, 7986, 7988, 7989, 7990, 7991, 7992, 7993, 8002, 8004, 8006, 8012, 8021, 8026, 8029, 8035, 8039, 8042, 8044, 8045, 8047, 8048, 8052, 8053, 8056, 8058, 8059, 8061, 8063, 8064, 8066, 8067, 8068, 8071, 8072, 8073, 8075, 8076, 8077, 8078, 8079, 8080, 8082, 8084, 8088, 8091, 8093, 8095, 8099, 8100, 8102, 8103, 8105, 8106, 8112, 8116, 8118, 8120, 8121, 8126, 8130, 8136, 8137, 8145, 8146, 8147, 8150, 8155, 8159, 8162, 8163, 8164, 8165, 8170, 8174, 8176, 8178, 8179, 8186, 8189, 8193, 8195, 8199, 8202, 8204, 8207, 8208, 8210, 8211, 8213, 8215, 8216, 8219, 8220, 8222, 8223, 8225, 8227, 8231, 8234, 8235, 8237, 8239, 8245, 8250, 8252, 8253, 8257, 8258, 8266, 8268, 8269, 8270, 8272, 8274, 8289, 8291, 8292, 8293, 8294, 8300, 8301, 8302, 8304, 8306, 8310, 8311, 8312, 8315, 8318, 8319, 8320, 8321, 8324, 8329, 8331, 8339, 8340, 8349, 8350, 8351, 8352, 8353, 8355, 8363, 8367, 8368, 8369, 8373, 8376, 8379, 8386, 8389, 8392, 8393, 8395, 8400, 8401, 8402, 8403, 8404, 8407, 8410, 8411, 8413, 8414, 8416, 8417, 8418, 8423, 8427, 8428, 8430, 8433, 8436, 8438, 8439, 8441, 8444, 8446, 8447, 8448, 8449, 8450, 8451, 8452, 8456, 8457, 8465, 8466, 8469, 8472, 8473, 8474, 8476, 8477, 8480, 8481, 8482, 8485, 8486, 8490, 8493, 8498, 8501, 8502, 8505, 8509, 8511, 8513, 8515, 8517, 8520, 8523, 8524, 8525, 8527, 8528, 8531, 8532, 8533, 8537, 8538, 8539, 8541, 8544, 8549, 8550, 8552, 8554, 8557, 8561, 8562, 8565, 8566, 8568, 8575, 8576, 8579, 8581, 8582, 8589, 8590, 8593, 8594, 8596, 8597, 8599, 8600, 8601, 8603, 8605, 8609, 8611, 8612, 8614, 8617, 8618, 8624, 8631, 8634, 8637, 8638, 8640, 8641, 8642, 8644, 8650, 8654, 8657, 8658, 8659, 8660, 8663, 8665, 8669, 8670, 8672, 8676, 8677, 8685, 8693, 8699, 8700, 8703, 8706, 8708, 8709, 8713, 8716, 8717, 8719, 8720, 8726, 8729, 8730, 8731, 8732, 8734, 8735, 8736, 8740, 8741, 8744, 8745, 8746, 8748, 8751, 8752, 8753, 8755, 8757, 8759, 8764, 8766, 8767, 8772, 8773, 8775, 8777, 8779, 8782, 8783, 8784, 8789, 8792, 8796, 8797, 8803, 8804, 8805, 8810, 8817, 8818, 8822, 8824, 8829, 8831, 8832, 8834, 8835, 8836, 8838, 8841, 8843, 8846, 8853, 8854, 8861, 8865, 8866, 8867, 8876, 8877, 8878, 8880, 8881, 8883, 8886, 8888, 8889, 8891, 8892, 8896, 8897, 8899, 8900, 8905, 8907, 8908, 8909, 8910, 8911, 8912, 8914, 8916, 8917, 8926, 8929, 8930, 8935, 8938, 8941, 8942, 8945, 8946, 8949, 8951, 8954, 8957, 8959, 8960, 8961, 8962, 8963, 8967, 8968, 8969, 8972, 8974, 8976, 8977, 8979, 8980, 8981, 8985, 8986, 8992, 8996, 8998, 8999, 9001, 9002, 9003, 9006, 9009, 9012, 9015, 9017, 9018, 9020, 9023, 9026, 9027, 9029, 9030, 9033, 9037, 9044, 9047, 9052, 9057, 9058, 9059, 9060, 9062, 9066, 9069, 9071, 9072, 9073, 9074, 9076, 9084, 9088, 9091, 9092, 9095, 9096, 9097, 9100, 9103, 9105, 9108, 9110, 9111, 9112, 9114, 9118, 9120, 9123, 9125, 9129, 9133, 9134, 9139, 9140, 9141, 9142, 9146, 9149, 9151, 9154, 9155, 9157, 9173, 9174, 9177, 9179, 9183, 9185, 9187, 9188, 9190, 9191, 9195, 9206, 9207, 9210, 9211, 9213, 9215, 9216, 9218, 9226, 9229, 9233, 9234, 9235, 9237, 9241, 9243, 9247, 9252, 9253, 9254, 9255, 9263, 9265, 9267, 9269, 9270, 9273, 9276, 9278, 9284, 9285, 9287, 9288, 9290, 9292, 9293, 9298, 9299, 9300, 9304, 9308, 9311, 9320, 9323, 9325, 9326, 9327, 9328, 9329, 9330, 9336, 9337, 9338, 9339, 9340, 9341, 9345, 9346, 9347, 9348, 9354, 9355, 9357, 9359, 9362, 9366, 9367, 9373, 9375, 9376, 9378, 9382, 9383, 9388, 9389, 9391, 9392, 9393, 9394, 9396, 9398, 9400, 9402, 9403, 9404, 9406, 9407, 9413, 9415, 9417, 9423, 9432, 9433, 9434, 9440, 9443, 9444, 9451, 9452, 9456, 9460, 9466, 9468, 9471, 9472, 9473, 9478, 9481, 9483, 9486, 9488, 9490, 9494, 9495, 9497, 9500, 9501, 9502, 9503, 9504, 9509, 9514, 9515, 9517, 9518, 9519, 9525, 9533, 9534, 9536, 9540, 9545, 9548, 9553, 9555, 9557, 9559, 9560, 9563, 9564, 9565, 9567, 9568, 9571, 9577, 9582, 9583, 9586, 9587, 9589, 9590, 9591, 9602, 9606, 9609, 9610, 9613, 9614, 9618, 9620, 9623, 9626, 9628, 9629, 9630, 9633, 9634, 9635, 9640, 9641, 9642, 9644, 9645, 9646, 9648, 9649, 9650, 9652, 9653, 9655, 9656, 9657, 9658, 9659, 9660, 9663, 9666, 9668, 9670, 9681, 9682, 9686, 9687, 9692, 9693, 9694, 9698, 9700, 9706, 9710, 9711, 9717, 9718, 9722, 9723, 9725, 9726, 9729, 9730, 9731, 9733, 9734, 9737, 9746, 9749, 9750, 9751, 9753, 9754, 9755, 9756, 9763, 9764, 9765, 9770, 9774, 9776, 9780, 9781, 9782, 9784, 9786, 9791, 9792, 9794, 9796, 9799, 9801, 9804, 9806, 9809, 9812, 9813, 9816, 9819, 9820, 9824, 9825, 9827, 9830, 9833, 9836, 9845, 9846, 9847, 9849, 9850, 9851, 9853, 9854, 9861, 9864, 9866, 9869, 9871, 9873, 9882, 9885, 9886, 9887, 9892, 9897, 9900, 9901, 9902, 9906, 9907, 9908, 9909, 9910, 9911, 9912, 9917, 9923, 9924, 9928, 9935, 9938, 9940, 9946, 9947, 9949, 9950, 9953, 9955, 9957, 9958, 9960, 9962, 9963, 9964, 9967, 9968, 9969, 9971, 9972, 9979, 9980, 9982, 9984, 9985, 9987, 9988, 9990, 9991, 9996, 9997, 9998, 10000, 10008, 10009, 10010, 10013, 10017, 10018, 10019, 10021, 10022, 10026, 10031, 10032, 10033, 10034, 10037, 10038, 10041, 10042, 10043, 10045, 10047, 10048, 10050, 10051, 10052, 10054, 10056, 10058, 10059, 10060, 10062, 10064, 10066, 10068, 10073, 10077, 10078, 10082, 10083, 10086, 10087, 10089, 10090, 10091, 10092, 10095, 10097, 10101, 10102, 10103, 10105, 10106, 10107, 10108, 10109, 10110, 10114, 10115, 10116, 10118, 10119, 10122, 10127, 10128, 10131, 10132, 10136, 10141, 10143, 10146, 10149, 10151, 10152, 10154, 10158, 10162, 10163, 10165, 10166, 10168, 10170, 10174, 10176, 10177, 10178, 10181, 10182, 10187, 10191, 10192, 10193, 10194, 10195, 10197, 10199, 10202, 10203, 10206, 10209, 10212, 10214, 10218, 10219, 10220, 10222, 10223, 10225, 10228, 10231, 10232, 10233, 10236, 10237, 10239, 10247, 10252, 10253, 10255, 10257, 10263, 10268, 10270, 10275, 10284, 10291, 10292, 10295, 10296, 10297, 10300, 10302, 10306, 10307, 10311, 10321, 10322, 10323, 10325, 10326, 10327, 10328, 10331, 10333, 10334, 10335, 10336, 10338, 10342, 10343, 10346, 10351, 10353, 10356, 10357, 10359, 10360, 10362, 10364, 10368, 10369, 10371, 10373, 10375, 10378, 10380, 10383, 10384, 10385, 10388, 10389, 10397, 10398, 10399, 10401, 10409, 10410, 10413, 10414, 10416, 10421, 10422, 10423, 10430, 10435, 10437, 10438, 10440, 10442, 10443, 10446, 10447, 10448, 10449, 10450, 10453, 10456, 10460, 10463, 10464, 10465, 10468, 10469, 10470, 10474, 10478, 10480, 10482, 10487, 10488, 10492, 10494, 10496, 10499, 10504, 10506, 10508, 10513, 10514, 10516, 10518, 10525, 10527, 10528, 10531, 10532, 10533, 10535, 10536, 10537, 10541, 10542, 10543, 10544, 10545, 10547, 10548, 10555, 10556, 10558, 10560, 10561, 10562, 10565, 10567, 10569, 10571, 10573, 10577, 10580, 10581, 10582, 10583, 10585, 10587, 10590, 10591, 10593, 10595, 10596, 10597, 10599, 10601, 10602, 10606, 10610, 10611, 10613, 10615, 10616, 10617, 10621, 10622, 10623, 10626, 10628, 10634, 10637, 10638, 10639, 10640, 10641, 10642, 10643, 10645, 10646, 10650, 10655, 10657, 10659, 10660, 10663, 10665, 10666, 10668, 10670, 10673, 10674, 10678, 10681, 10682, 10683, 10684, 10685, 10687, 10689, 10693, 10697, 10698, 10699, 10700, 10701, 10702, 10703, 10705, 10706, 10707, 10711, 10715, 10716, 10721, 10722, 10723, 10725, 10726, 10732, 10734, 10735, 10737, 10740, 10741, 10744, 10745, 10748, 10749, 10752, 10761, 10762, 10763, 10766, 10775, 10778, 10779, 10782, 10784, 10785, 10787, 10788, 10790, 10791, 10792, 10795, 10796, 10798, 10800, 10801, 10802, 10803, 10804, 10805, 10809, 10810, 10811, 10812, 10813, 10815, 10818, 10819, 10820, 10821, 10822, 10823, 10824, 10825, 10826, 10831, 10833, 10836, 10838, 10839, 10841, 10843, 10846, 10847, 10850, 10852, 10853, 10854, 10857, 10858, 10860, 10861, 10862, 10866, 10867, 10871, 10874, 10877, 10878, 10880, 10881, 10887, 10891, 10892, 10893, 10896, 10897, 10898, 10902, 10905, 10910, 10912, 10913, 10916, 10917, 10920, 10926, 10927, 10928, 10930, 10933, 10934, 10935, 10936, 10937, 10938, 10940, 10941, 10944, 10947, 10948, 10950, 10954, 10957, 10960, 10962, 10965, 10967, 10972, 10976, 10977, 10979, 10980, 10988, 10993, 10995, 10996, 10997, 10999, 11004, 11005, 11006, 11008, 11009, 11010, 11018, 11024, 11026, 11027, 11032, 11039, 11045, 11046, 11047, 11052, 11053, 11056, 11060, 11068, 11070, 11071, 11072, 11078, 11079, 11080, 11082, 11083, 11086, 11090, 11095, 11098, 11099, 11100, 11101, 11102, 11107, 11108, 11110, 11114, 11116, 11117, 11118, 11123, 11124, 11125, 11127, 11128, 11129, 11132, 11133, 11135, 11137, 11138, 11145, 11146, 11152, 11153, 11154, 11158, 11159, 11160, 11161, 11162, 11163, 11165, 11166, 11168, 11169, 11175, 11177, 11178, 11181, 11184, 11185, 11187, 11188, 11190, 11191, 11192, 11194, 11198, 11199, 11201, 11202, 11203, 11207, 11214, 11217, 11218, 11222, 11226, 11227, 11228, 11229, 11232, 11233, 11234, 11235, 11236, 11237, 11238, 11239, 11246, 11247, 11248, 11251, 11256, 11257, 11258, 11259, 11260, 11261, 11262, 11263, 11264, 11266, 11274, 11275, 11278, 11286, 11288, 11289, 11290, 11291, 11292, 11293, 11294, 11295, 11305, 11306, 11307, 11313, 11315, 11316, 11317, 11319, 11320, 11322, 11324, 11326, 11329, 11332, 11337, 11339, 11340, 11345, 11346, 11348, 11349, 11352, 11356, 11358, 11363, 11364, 11365, 11366, 11370, 11371, 11373, 11374, 11377, 11381, 11382, 11387, 11388, 11389, 11391, 11392, 11394, 11395, 11397, 11403, 11405, 11406, 11409, 11416, 11418, 11423, 11424, 11426, 11428, 11430, 11431, 11434, 11437, 11438, 11445, 11446, 11449, 11451, 11459, 11463, 11465, 11467, 11471, 11472, 11475, 11476, 11477, 11478, 11481, 11482, 11485, 11487, 11496, 11497, 11498, 11500, 11501, 11506, 11507, 11508, 11509, 11512, 11513, 11516, 11520, 11523, 11524, 11527, 11528, 11530, 11531, 11532, 11533, 11534, 11535, 11538, 11540, 11541, 11544, 11546, 11547, 11548, 11551, 11553, 11558, 11560, 11561, 11564, 11567, 11568, 11571, 11574, 11576, 11577, 11578, 11580, 11583, 11586, 11593, 11594, 11595, 11597, 11599, 11604, 11610, 11612, 11618, 11620, 11621, 11623, 11625, 11628, 11629, 11632, 11633, 11636, 11637, 11639, 11642, 11650, 11652, 11654, 11655, 11656, 11657, 11658, 11659, 11663, 11664, 11667, 11668, 11669, 11672, 11673, 11677, 11678, 11680, 11681, 11682, 11683, 11688, 11691, 11692, 11694, 11695, 11701, 11703, 11705, 11707, 11711, 11712, 11720, 11721, 11725, 11726, 11731, 11733, 11736, 11740, 11743, 11744, 11748, 11753, 11755, 11759, 11760, 11761, 11762, 11763, 11764, 11765, 11766, 11767, 11770, 11771, 11773, 11776, 11780, 11781, 11782, 11783, 11785, 11786, 11789, 11790, 11792, 11795, 11799, 11800, 11809, 11812, 11814, 11816, 11818, 11819, 11826, 11828, 11829, 11830, 11831, 11832, 11833, 11837, 11838, 11841, 11846, 11849, 11850, 11851, 11853, 11854, 11856, 11858, 11863, 11868, 11870, 11872, 11876, 11877, 11878, 11881, 11890, 11891, 11893, 11894, 11898, 11903, 11904, 11909, 11913, 11915, 11916, 11917, 11919, 11920, 11921, 11923, 11926, 11927, 11928, 11929, 11930, 11934, 11935, 11939, 11940, 11941, 11943, 11946, 11947, 11948, 11949, 11953, 11955, 11957, 11958, 11959, 11960, 11961, 11962, 11963, 11965, 11968, 11977, 11980, 11983, 11988, 11993, 11997, 11998, 11999, 12002, 12004, 12006, 12008, 12017, 12019, 12020, 12021, 12023, 12024, 12025, 12032, 12035, 12042, 12043, 12044, 12047, 12050, 12054, 12059, 12060, 12061, 12064, 12078, 12079, 12080, 12081, 12083, 12085, 12086, 12091, 12092, 12093, 12097, 12098, 12104, 12106, 12112, 12114, 12115, 12118, 12120, 12122, 12126, 12127, 12128, 12129, 12130, 12131, 12134, 12135, 12138, 12139, 12143, 12144, 12145, 12146, 12147, 12149, 12150, 12151, 12155, 12161, 12162, 12165, 12166, 12170, 12171, 12173, 12174, 12175, 12179, 12181, 12186, 12195, 12197, 12198, 12202, 12204, 12208, 12212, 12215, 12217, 12223, 12229, 12233, 12237, 12240, 12241, 12243, 12245, 12249, 12250, 12252, 12254, 12255, 12256, 12259, 12265, 12268, 12269, 12271, 12278, 12280, 12283, 12284, 12285, 12286, 12287, 12288, 12295, 12296, 12302, 12310, 12311, 12312, 12313, 12314, 12315, 12317, 12319, 12321, 12323, 12325, 12328, 12331, 12334, 12335, 12339, 12342, 12343, 12345, 12347, 12350, 12354, 12356, 12359, 12364, 12366, 12370, 12375, 12376, 12379, 12381, 12383, 12385, 12390, 12393, 12394, 12397, 12399, 12400, 12401, 12403, 12404, 12406, 12411, 12414, 12415, 12417, 12419, 12420, 12423, 12424, 12425, 12426, 12427, 12437, 12440, 12444, 12445, 12450, 12451, 12456, 12457, 12459, 12461, 12462, 12465, 12467, 12468, 12470, 12472, 12473, 12475, 12478, 12480, 12481, 12483, 12487, 12488, 12489, 12492, 12494, 12495, 12497, 12503, 12508, 12510, 12511, 12512, 12513, 12514, 12515, 12518, 12519, 12527, 12530, 12531, 12535, 12536, 12537, 12539, 12540, 12546, 12547, 12548, 12549, 12551, 12552, 12554, 12555, 12556, 12557, 12561, 12563, 12565, 12567, 12568, 12570, 12572, 12574, 12577, 12578, 12580, 12583, 12585, 12586, 12588, 12589, 12591, 12600, 12603, 12605, 12608, 12609, 12610, 12611, 12616, 12622, 12623, 12626, 12628, 12629, 12631, 12634, 12639, 12640, 12641, 12644, 12648, 12649, 12650, 12651, 12652, 12653, 12654, 12663, 12664, 12668, 12670, 12671, 12674, 12679, 12680, 12681, 12683, 12684, 12685, 12688, 12689, 12691, 12692, 12693, 12695, 12696, 12699, 12701, 12702, 12705, 12706, 12707, 12713, 12714, 12716, 12723, 12731, 12732, 12733, 12735, 12738, 12739, 12740, 12741, 12742, 12750, 12752, 12753, 12754, 12755, 12757, 12758, 12760, 12761, 12764, 12765, 12766, 12771, 12775, 12777, 12782, 12783, 12790, 12794, 12797, 12800, 12802, 12803, 12807, 12808, 12810, 12812, 12813, 12817, 12820, 12822, 12823, 12824, 12826, 12827, 12828, 12835, 12836, 12837, 12838, 12839, 12843, 12844, 12848, 12849, 12850, 12853, 12860, 12861, 12866, 12870, 12873, 12878, 12882, 12883, 12884, 12887, 12888, 12891, 12895, 12898, 12899, 12900, 12901, 12903, 12904, 12905, 12906, 12908, 12910, 12912, 12913, 12914, 12916, 12917, 12920, 12921, 12928, 12929, 12932, 12933, 12934, 12935, 12938, 12940, 12945, 12946, 12947, 12950, 12952, 12953, 12956, 12958, 12959, 12960, 12961, 12963, 12967, 12968, 12969, 12973, 12978, 12983, 12984, 12986, 12987, 12988, 12990, 12991, 12999, 13001, 13003, 13004, 13007, 13010, 13014, 13015, 13017, 13018, 13022, 13027, 13030, 13031, 13032, 13033, 13034, 13035, 13036, 13037, 13038, 13040, 13041, 13044, 13045, 13049, 13050, 13053, 13054, 13055, 13056, 13059, 13061, 13062, 13064, 13066, 13067, 13071, 13075, 13079, 13083, 13085, 13086, 13087, 13097, 13099, 13101, 13102, 13105, 13106, 13110, 13111, 13112, 13114, 13115, 13116, 13117, 13118, 13120, 13121, 13122, 13123, 13124, 13125, 13128, 13131, 13134, 13135, 13142, 13144, 13147, 13148, 13149, 13151, 13154, 13159, 13160, 13163, 13169, 13175, 13181, 13182, 13186, 13188, 13189, 13190, 13197, 13198, 13199, 13203, 13205, 13206, 13209, 13210, 13212, 13213, 13215, 13217, 13221, 13224, 13227, 13228, 13232, 13234, 13235, 13236, 13237, 13239, 13241, 13243, 13248, 13250, 13251, 13255, 13256, 13259, 13260, 13261, 13262, 13263, 13264, 13267, 13268, 13269, 13271, 13274, 13281, 13283, 13284, 13287, 13296, 13297, 13298, 13300, 13301, 13303, 13304, 13313, 13315, 13317, 13319, 13325, 13329, 13332, 13335, 13337, 13340, 13343, 13344, 13345, 13346, 13347, 13348, 13350, 13352, 13361, 13363, 13367, 13368, 13369, 13370, 13377, 13380, 13381, 13384, 13385, 13386, 13391, 13393, 13394, 13395, 13396, 13397, 13398, 13401, 13402, 13403, 13404, 13407, 13408, 13410, 13413, 13416, 13417, 13419, 13423, 13424, 13429, 13430, 13433, 13439, 13441, 13444, 13448, 13456, 13457, 13460, 13463, 13467, 13469, 13473, 13474, 13475, 13477, 13478, 13480, 13484, 13489, 13492, 13496, 13497, 13499, 13503, 13504, 13505, 13507, 13513, 13514, 13515, 13519, 13521, 13522, 13526, 13529, 13533, 13535, 13536, 13539, 13540, 13543, 13544, 13545, 13546, 13547, 13549, 13552, 13553, 13555, 13558, 13559, 13561, 13568, 13569, 13574, 13577, 13578, 13580, 13584, 13587, 13597, 13599, 13600, 13601, 13602, 13604, 13605, 13606, 13611, 13612, 13613, 13614, 13621, 13623, 13630, 13631, 13632, 13634, 13636, 13637, 13641, 13643, 13651, 13653, 13654, 13660, 13662, 13663, 13665, 13668, 13670, 13675, 13676, 13677, 13678, 13679, 13683, 13687, 13688, 13697, 13698, 13699, 13700, 13702, 13706, 13710, 13713, 13714, 13716, 13719, 13720, 13724, 13727, 13729, 13739, 13742, 13745, 13747, 13750, 13755, 13756, 13764, 13767, 13772, 13773, 13775, 13777, 13779, 13780, 13781, 13782, 13783, 13786, 13787, 13789, 13791, 13793, 13794, 13796, 13797, 13799, 13809, 13816, 13817, 13818, 13819, 13822, 13823, 13828, 13830, 13831, 13834, 13835, 13843, 13848, 13849, 13852, 13858, 13869, 13872, 13873, 13875, 13877, 13879, 13887, 13888, 13891, 13892, 13895, 13897, 13898, 13899, 13901, 13902, 13903, 13906, 13908, 13909, 13910, 13911, 13917, 13918, 13919, 13921, 13924, 13925, 13934, 13947, 13950, 13952, 13953, 13954, 13958, 13960, 13961, 13963, 13969, 13970, 13971, 13975, 13984, 13986, 13987, 13991, 13999, 14000, 14001, 14005, 14006, 14008, 14009, 14013, 14014, 14017, 14022, 14027, 14030, 14031, 14035, 14036, 14038, 14040, 14049, 14051, 14052, 14059, 14062, 14063, 14066, 14067, 14069, 14070, 14071, 14072, 14073, 14074, 14075, 14078, 14081, 14084, 14085, 14086, 14088, 14092, 14094, 14096, 14097, 14106, 14112, 14114, 14116, 14117, 14118, 14119, 14121, 14122, 14124, 14126, 14129, 14130, 14132, 14133, 14135, 14137, 14138, 14139, 14140, 14142, 14143, 14145, 14146, 14147.

Promoters expressing in the inflorescent tassel at the V7 to V8 stage include SEQ IDs: 3, 7, 9, 12, 14, 15, 16, 17, 26, 29, 31, 32, 33, 34, 36, 37, 48, 54, 57, 63, 64, 65, 79, 80, 88, 90, 93, 94, 96, 97, 98, 99, 100, 101, 102, 103, 104, 110, 112, 117, 121, 123, 128, 130, 131, 132, 141, 142, 143, 147, 148, 152, 154, 156, 157, 159, 160, 162, 168, 174, 175, 176, 181, 183, 187, 191, 193, 194, 196, 197, 199, 202, 203, 205, 207, 211, 212, 214, 223, 224, 232, 233, 235, 236, 237, 239, 240, 242, 246, 249, 250, 251, 257, 259, 262, 264, 267, 269, 270, 286, 288, 289, 293, 294, 301, 302, 305, 306, 309, 316, 319, 320, 322, 323, 328, 329, 332, 334, 335, 338, 346, 349, 352, 353, 354, 356, 357, 358, 359, 360, 364, 365, 373, 378, 379, 381, 386, 388, 396, 401, 411, 412, 414, 423, 428, 431, 432, 433, 434, 436, 441, 448, 450, 452, 456, 460, 461, 462, 463, 466, 468, 470, 471, 474, 478, 479, 481, 483, 485, 488, 489, 496, 498, 501, 504, 507, 509, 510, 511, 514, 515, 516, 517, 523, 525, 528, 532, 535, 537, 541, 542, 543, 544, 546, 547, 548, 553, 554, 556, 557, 560, 561, 563, 578, 580, 585, 591, 592, 594, 595, 596, 598, 599, 601, 602, 605, 606, 607, 609, 613, 614, 619, 620, 623, 631, 633, 634, 635, 636, 637, 638, 643, 645, 647, 650, 659, 661, 662, 663, 664, 670, 671, 681, 683, 687, 692, 693, 694, 701, 702, 705, 706, 709, 716, 717, 718, 721, 722, 723, 724, 727, 731, 732, 734, 736, 739, 740, 742, 744, 749, 750, 753, 757, 759, 760, 761, 762, 763, 764, 765, 774, 779, 782, 783, 784, 792, 793, 800, 804, 806, 808, 809, 811, 812, 820, 822, 824, 825, 826, 829, 830, 833, 840, 845, 846, 849, 852, 855, 856, 857, 858, 859, 860, 862, 863, 864, 865, 869, 870, 871, 872, 875, 876, 877, 882, 887, 890, 891, 892, 893, 895, 897, 898, 899, 903, 907, 908, 911, 912, 913, 915, 916, 917, 919, 920, 924, 928, 929, 931, 932, 936, 939, 943, 944, 947, 948, 949, 951, 953, 955, 957, 958, 960, 971, 972, 974, 975, 976, 977, 979, 980, 982, 984, 985, 987, 988, 993, 994, 995, 997, 999, 1002, 1003, 1007, 1008, 1009, 1010, 1011, 1012, 1013, 1014, 1016, 1017, 1019, 1022, 1025, 1026, 1032, 1033, 1035, 1038, 1039, 1040, 1041, 1042, 1043, 1046, 1047, 1049, 1051, 1052, 1054, 1055, 1056, 1057, 1059, 1064, 1065, 1067, 1069, 1070, 1073, 1074, 1076, 1077, 1079, 1080, 1085, 1086, 1087, 1089, 1092, 1095, 1097, 1100, 1101, 1103, 1104, 1110, 1111, 1112, 1114, 1115, 1116, 1117, 1119, 1121, 1122, 1125, 1126, 1130, 1132, 1136, 1137, 1140, 1146, 1148, 1154, 1155, 1160, 1161, 1165, 1167, 1168, 1170, 1171, 1176, 1178, 1180, 1183, 1189, 1191, 1193, 1196, 1201, 1205, 1213, 1214, 1218, 1220, 1221, 1222, 1223, 1225, 1228, 1230, 1231, 1232, 1236, 1237, 1239, 1240, 1244, 1249, 1251, 1254, 1257, 1258, 1261, 1262, 1263, 1272, 1277, 1281, 1282, 1285, 1286, 1290, 1292, 1293, 1296, 1299, 1303, 1306, 1307, 1309, 1310, 1311, 1312, 1314, 1316, 1320, 1321, 1322, 1323, 1325, 1327, 1331, 1334, 1339, 1345, 1347, 1349, 1356, 1360, 1363, 1364, 1366, 1367, 1368, 1371, 1375, 1376, 1377, 1380, 1387, 1388, 1389, 1391, 1393, 1394, 1396, 1398, 1399, 1404, 1405, 1406, 1407, 1410, 1412, 1415, 1420, 1421, 1423, 1426, 1431, 1432, 1438, 1440, 1441, 1442, 1443, 1444, 1447, 1448, 1450, 1451, 1453, 1458, 1459, 1462, 1466, 1472, 1475, 1484, 1486, 1487, 1488, 1489, 1490, 1491, 1492, 1493, 1498, 1499, 1503, 1504, 1506, 1508, 1510, 1511, 1512, 1514, 1518, 1519, 1525, 1526, 1527, 1528, 1530, 1539, 1543, 1545, 1546, 1549, 1550, 1551, 1553, 1554, 1555, 1556, 1560, 1561, 1564, 1566, 1567, 1568, 1570, 1571, 1575, 1576, 1578, 1584, 1585, 1586, 1588, 1590, 1591, 1594, 1597, 1598, 1599, 1600, 1601, 1602, 1604, 1605, 1608, 1609, 1610, 1612, 1614, 1615, 1616, 1617, 1622, 1623, 1625, 1634, 1635, 1637, 1638, 1641, 1642, 1643, 1648, 1651, 1653, 1654, 1658, 1659, 1662, 1663, 1669, 1671, 1673, 1675, 1676, 1678, 1681, 1682, 1684, 1687, 1688, 1689, 1690, 1691, 1696, 1697, 1698, 1699, 1700, 1703, 1705, 1706, 1707, 1708, 1710, 1716, 1717, 1725, 1729, 1732, 1735, 1739, 1750, 1755, 1758, 1759, 1760, 1761, 1764, 1769, 1770, 1773, 1774, 1776, 1777, 1779, 1785, 1786, 1791, 1792, 1793, 1796, 1798, 1807, 1809, 1811, 1812, 1813, 1825, 1826, 1828, 1830, 1832, 1834, 1837, 1839, 1840, 1843, 1848, 1852, 1859, 1861, 1863, 1866, 1867, 1869, 1872, 1873, 1876, 1879, 1882, 1884, 1886, 1888, 1891, 1894, 1897, 1898, 1899, 1900, 1901, 1902, 1904, 1905, 1906, 1910, 1911, 1915, 1916, 1918, 1920, 1922, 1923, 1924, 1928, 1933, 1934, 1936, 1939, 1940, 1942, 1944, 1945, 1948, 1949, 1950, 1951, 1952, 1953, 1954, 1956, 1958, 1968, 1969, 1970, 1971, 1972, 1973, 1974, 1979, 1981, 1986, 1990, 1993, 1994, 1995, 1996, 1999, 2000, 2007, 2008, 2009, 2010, 2012, 2014, 2015, 2016, 2017, 2019, 2021, 2026, 2032, 2033, 2037, 2040, 2042, 2043, 2048, 2057, 2058, 2060, 2062, 2064, 2066, 2072, 2074, 2077, 2078, 2085, 2087, 2088, 2089, 2091, 2092, 2093, 2094, 2096, 2097, 2099, 2101, 2103, 2104, 2106, 2107, 2112, 2116, 2117, 2122, 2123, 2125, 2128, 2132, 2133, 2137, 2139, 2140, 2142, 2143, 2146, 2147, 2150, 2151, 2156, 2157, 2161, 2164, 2167, 2168, 2170, 2173, 2175, 2177, 2178, 2179, 2185, 2188, 2189, 2193, 2195, 2196, 2202, 2203, 2205, 2210, 2215, 2216, 2218, 2221, 2222, 2223, 2226, 2235, 2240, 2241, 2242, 2243, 2253, 2257, 2259, 2260, 2263, 2266, 2267, 2274, 2276, 2278, 2280, 2282, 2283, 2284, 2288, 2291, 2293, 2294, 2296, 2297, 2298, 2300, 2303, 2304, 2305, 2306, 2308, 2309, 2310, 2313, 2314, 2322, 2323, 2328, 2329, 2331, 2333, 2339, 2342, 2345, 2348, 2353, 2361, 2362, 2363, 2366, 2371, 2372, 2376, 2379, 2380, 2381, 2382, 2384, 2397, 2401, 2402, 2405, 2410, 2412, 2413, 2414, 2418, 2419, 2420, 2423, 2428, 2431, 2432, 2433, 2434, 2435, 2436, 2437, 2439, 2440, 2441, 2442, 2443, 2445, 2449, 2451, 2452, 2453, 2454, 2457, 2458, 2469, 2472, 2474, 2476, 2477, 2479, 2480, 2481, 2482, 2483, 2485, 2487, 2490, 2492, 2494, 2495, 2496, 2498, 2500, 2505, 2506, 2507, 2509, 2510, 2513, 2514, 2515, 2516, 2517, 2519, 2521, 2525, 2526, 2528, 2529, 2531, 2533, 2534, 2536, 2537, 2538, 2539, 2541, 2544, 2545, 2549, 2550, 2551, 2552, 2554, 2555, 2556, 2559, 2560, 2567, 2568, 2570, 2573, 2576, 2578, 2579, 2581, 2583, 2589, 2590, 2594, 2596, 2599, 2601, 2605, 2607, 2611, 2612, 2613, 2616, 2617, 2620, 2622, 2625, 2626, 2627, 2632, 2634, 2635, 2636, 2639, 2641, 2644, 2645, 2648, 2649, 2652, 2655, 2656, 2658, 2661, 2662, 2663, 2665, 2666, 2671, 2672, 2674, 2676, 2684, 2685, 2687, 2689, 2690, 2691, 2692, 2694, 2696, 2700, 2702, 2704, 2709, 2711, 2712, 2719, 2720, 2721, 2722, 2723, 2725, 2726, 2728, 2729, 2730, 2735, 2745, 2746, 2747, 2749, 2752, 2755, 2756, 2758, 2759, 2760, 2762, 2764, 2765, 2769, 2770, 2775, 2776, 2779, 2782, 2784, 2785, 2787, 2788, 2789, 2791, 2793, 2794, 2796, 2798, 2800, 2802, 2805, 2808, 2812, 2814, 2819, 2821, 2822, 2823, 2824, 2826, 2827, 2828, 2832, 2838, 2840, 2844, 2845, 2850, 2860, 2861, 2865, 2869, 2871, 2876, 2878, 2888, 2889, 2892, 2893, 2894, 2895, 2896, 2897, 2898, 2901, 2902, 2903, 2906, 2908, 2909, 2911, 2915, 2916, 2917, 2918, 2919, 2922, 2923, 2926, 2929, 2930, 2931, 2935, 2937, 2941, 2942, 2943, 2944, 2946, 2947, 2948, 2954, 2955, 2959, 2962, 2963, 2966, 2968, 2976, 2978, 2979, 2982, 2985, 2987, 2992, 2994, 2998, 3000, 3003, 3005, 3007, 3008, 3009, 3013, 3015, 3017, 3018, 3019, 3020, 3023, 3029, 3031, 3037, 3039, 3041, 3042, 3044, 3045, 3047, 3048, 3049, 3050, 3051, 3052, 3053, 3055, 3062, 3064, 3067, 3068, 3070, 3072, 3075, 3083, 3084, 3085, 3087, 3090, 3094, 3095, 3096, 3097, 3100, 3101, 3106, 3109, 3115, 3119, 3121, 3122, 3123, 3126, 3127, 3128, 3136, 3137, 3139, 3143, 3149, 3153, 3167, 3169, 3170, 3172, 3177, 3181, 3191, 3192, 3194, 3196, 3202, 3205, 3206, 3208, 3210, 3217, 3218, 3220, 3221, 3224, 3225, 3228, 3230, 3237, 3240, 3242, 3246, 3249, 3250, 3252, 3254, 3261, 3263, 3266, 3267, 3269, 3271, 3272, 3273, 3278, 3280, 3283, 3286, 3288, 3289, 3290, 3291, 3294, 3295, 3297, 3299, 3301, 3308, 3310, 3312, 3313, 3324, 3331, 3332, 3333, 3337, 3338, 3340, 3342, 3343, 3345, 3347, 3351, 3353, 3355, 3356, 3357, 3358, 3359, 3360, 3361, 3363, 3368, 3370, 3373, 3376, 3377, 3378, 3379, 3380, 3382, 3383, 3386, 3394, 3396, 3399, 3403, 3405, 3413, 3415, 3416, 3418, 3419, 3424, 3426, 3427, 3428, 3432, 3438, 3442, 3446, 3447, 3449, 3450, 3452, 3453, 3457, 3458, 3459, 3461, 3465, 3466, 3468, 3469, 3470, 3471, 3474, 3477, 3483, 3484, 3486, 3488, 3490, 3493, 3494, 3499, 3500, 3502, 3503, 3504, 3506, 3507, 3510, 3516, 3517, 3518, 3523, 3524, 3529, 3533, 3535, 3536, 3537, 3538, 3540, 3541, 3542, 3544, 3545, 3548, 3549, 3552, 3554, 3558, 3560, 3562, 3569, 3571, 3574, 3576, 3580, 3585, 3586, 3587, 3588, 3589, 3592, 3594, 3595, 3600, 3603, 3604, 3606, 3607, 3610, 3611, 3613, 3615, 3616, 3620, 3624, 3629, 3633, 3634, 3637, 3640, 3642, 3643, 3644, 3645, 3646, 3648, 3655, 3659, 3660, 3661, 3667, 3672, 3674, 3677, 3681, 3682, 3684, 3685, 3689, 3690, 3693, 3694, 3704, 3706, 3707, 3709, 3713, 3715, 3718, 3719, 3720, 3721, 3723, 3725, 3726, 3730, 3731, 3732, 3733, 3738, 3739, 3744, 3749, 3752, 3756, 3757, 3760, 3761, 3763, 3764, 3766, 3771, 3775, 3777, 3778, 3783, 3785, 3787, 3791, 3792, 3793, 3794, 3796, 3798, 3801, 3806, 3808, 3809, 3817, 3818, 3819, 3823, 3825, 3828, 3830, 3831, 3832, 3833, 3837, 3838, 3843, 3844, 3845, 3846, 3847, 3849, 3852, 3858, 3859, 3860, 3867, 3868, 3870, 3871, 3872, 3873, 3880, 3882, 3883, 3884, 3885, 3887, 3889, 3890, 3892, 3894, 3895, 3896, 3897, 3902, 3903, 3904, 3907, 3908, 3909, 3912, 3913, 3917, 3918, 3924, 3926, 3928, 3929, 3931, 3934, 3938, 3941, 3947, 3950, 3951, 3952, 3954, 3958, 3962, 3964, 3967, 3968, 3970, 3971, 3972, 3974, 3975, 3976, 3977, 3978, 3983, 3985, 3988, 3994, 3995, 3996, 3997, 3998, 4000, 4001, 4002, 4003, 4007, 4008, 4012, 4013, 4014, 4019, 4020, 4028, 4030, 4033, 4037, 4039, 4040, 4041, 4042, 4043, 4046, 4047, 4048, 4050, 4051, 4052, 4053, 4054, 4055, 4056, 4057, 4062, 4066, 4067, 4068, 4070, 4071, 4072, 4080, 4081, 4084, 4088, 4090, 4092, 4094, 4096, 4099, 4102, 4105, 4106, 4109, 4110, 4111, 4113, 4116, 4117, 4122, 4124, 4126, 4128, 4133, 4134, 4139, 4143, 4144, 4146, 4147, 4148, 4149, 4150, 4151, 4155, 4160, 4163, 4164, 4165, 4166, 4167, 4168, 4170, 4171, 4175, 4176, 4178, 4181, 4183, 4185, 4187, 4188, 4189, 4191, 4192, 4193, 4194, 4195, 4197, 4201, 4202, 4204, 4205, 4206, 4207, 4208, 4210, 4211, 4212, 4213, 4219, 4221, 4227, 4228, 4229, 4232, 4233, 4234, 4235, 4237, 4241, 4244, 4245, 4246, 4250, 4251, 4252, 4257, 4260, 4261, 4266, 4270, 4272, 4275, 4276, 4278, 4280, 4281, 4282, 4283, 4284, 4288, 4290, 4296, 4298, 4300, 4301, 4302, 4303, 4304, 4305, 4306, 4309, 4312, 4314, 4316, 4317, 4320, 4321, 4324, 4329, 4330, 4332, 4335, 4336, 4338, 4341, 4347, 4356, 4358, 4359, 4360, 4369, 4370, 4374, 4375, 4378, 4380, 4383, 4388, 4390, 4391, 4396, 4397, 4401, 4402, 4403, 4404, 4405, 4406, 4409, 4410, 4417, 4422, 4423, 4430, 4432, 4436, 4439, 4440, 4442, 4443, 4446, 4448, 4449, 4450, 4453, 4461, 4462, 4463, 4466, 4467, 4468, 4474, 4475, 4477, 4479, 4485, 4486, 4490, 4492, 4494, 4497, 4498, 4500, 4502, 4507, 4508, 4509, 4512, 4513, 4514, 4515, 4519, 4521, 4524, 4525, 4529, 4531, 4535, 4541, 4543, 4545, 4548, 4549, 4551, 4554, 4555, 4557, 4558, 4560, 4562, 4563, 4565, 4567, 4568, 4570, 4575, 4576, 4578, 4579, 4580, 4582, 4583, 4590, 4591, 4594, 4595, 4597, 4598, 4601, 4606, 4614, 4616, 4623, 4625, 4628, 4630, 4632, 4633, 4634, 4635, 4639, 4641, 4643, 4644, 4646, 4647, 4650, 4651, 4653, 4654, 4655, 4656, 4658, 4659, 4662, 4664, 4667, 4669, 4671, 4672, 4673, 4674, 4676, 4677, 4680, 4682, 4685, 4691, 4692, 4694, 4697, 4699, 4700, 4702, 4703, 4706, 4708, 4710, 4711, 4713, 4719, 4720, 4721, 4722, 4724, 4729, 4730, 4734, 4736, 4737, 4738, 4739, 4740, 4741, 4745, 4746, 4749, 4750, 4753, 4755, 4760, 4761, 4762, 4764, 4765, 4766, 4767, 4769, 4770, 4771, 4773, 4775, 4779, 4780, 4784, 4787, 4788, 4789, 4790, 4791, 4794, 4795, 4796, 4801, 4803, 4804, 4805, 4806, 4807, 4812, 4813, 4814, 4815, 4818, 4822, 4823, 4828, 4830, 4831, 4834, 4838, 4840, 4841, 4842, 4854, 4855, 4856, 4857, 4858, 4859, 4861, 4862, 4863, 4864, 4869, 4874, 4875, 4876, 4878, 4880, 4881, 4887, 4889, 4891, 4895, 4896, 4897, 4900, 4902, 4904, 4905, 4907, 4909, 4910, 4914, 4921, 4922, 4924, 4930, 4935, 4936, 4937, 4941, 4942, 4950, 4954, 4955, 4958, 4959, 4963, 4967, 4969, 4971, 4972, 4974, 4975, 4980, 4983, 4987, 4989, 4990, 4993, 4994, 4996, 5000, 5010, 5014, 5015, 5016, 5024, 5026, 5027, 5029, 5030, 5034, 5036, 5037, 5039, 5040, 5041, 5042, 5044, 5045, 5046, 5049, 5051, 5052, 5054, 5057, 5060, 5063, 5067, 5068, 5069, 5072, 5074, 5075, 5078, 5082, 5089, 5090, 5091, 5094, 5097, 5098, 5100, 5101, 5102, 5106, 5109, 5110, 5113, 5114, 5115, 5116, 5123, 5125, 5131, 5132, 5140, 5143, 5147, 5148, 5149, 5153, 5159, 5160, 5164, 5165, 5166, 5168, 5170, 5172, 5174, 5180, 5181, 5184, 5185, 5187, 5188, 5189, 5190, 5191, 5192, 5193, 5196, 5198, 5200, 5202, 5206, 5209, 5212, 5213, 5217, 5218, 5219, 5221, 5224, 5225, 5234, 5237, 5238, 5240, 5244, 5245, 5248, 5249, 5251, 5253, 5254, 5255, 5258, 5260, 5261, 5263, 5264, 5267, 5268, 5269, 5273, 5274, 5275, 5276, 5280, 5281, 5283, 5286, 5287, 5292, 5293, 5297, 5298, 5299, 5300, 5301, 5308, 5311, 5313, 5315, 5317, 5319, 5321, 5324, 5329, 5330, 5333, 5334, 5338, 5339, 5342, 5343, 5345, 5346, 5348, 5349, 5351, 5352, 5366, 5367, 5369, 5371, 5386, 5388, 5389, 5391, 5393, 5394, 5395, 5396, 5397, 5404, 5405, 5409, 5411, 5413, 5414, 5417, 5418, 5422, 5427, 5428, 5430, 5431, 5434, 5437, 5438, 5446, 5448, 5449, 5450, 5452, 5453, 5455, 5456, 5458, 5459, 5461, 5475, 5482, 5483, 5485, 5487, 5488, 5491, 5493, 5495, 5496, 5505, 5508, 5510, 5512, 5513, 5515, 5517, 5518, 5519, 5524, 5526, 5529, 5530, 5531, 5532, 5534, 5535, 5537, 5543, 5545, 5549, 5554, 5562, 5563, 5566, 5568, 5569, 5572, 5575, 5579, 5581, 5582, 5584, 5585, 5589, 5591, 5593, 5594, 5597, 5602, 5608, 5611, 5613, 5614, 5615, 5616, 5618, 5620, 5623, 5627, 5630, 5632, 5633, 5635, 5638, 5640, 5643, 5647, 5648, 5649, 5650, 5651, 5652, 5653, 5656, 5659, 5660, 5662, 5663, 5669, 5680, 5681, 5683, 5689, 5690, 5694, 5695, 5696, 5697, 5698, 5702, 5706, 5711, 5712, 5713, 5714, 5717, 5718, 5719, 5721, 5722, 5724, 5729, 5730, 5731, 5732, 5734, 5735, 5736, 5737, 5742, 5744, 5748, 5751, 5768, 5770, 5775, 5778, 5780, 5784, 5785, 5787, 5791, 5792, 5794, 5803, 5805, 5807, 5808, 5811, 5814, 5815, 5817, 5820, 5826, 5828, 5832, 5833, 5834, 5835, 5836, 5837, 5839, 5842, 5844, 5854, 5859, 5864, 5866, 5867, 5869, 5871, 5872, 5873, 5875, 5876, 5877, 5878, 5879, 5881, 5882, 5883, 5884, 5888, 5889, 5892, 5893, 5906, 5907, 5910, 5912, 5913, 5914, 5918, 5919, 5921, 5922, 5923, 5925, 5926, 5927, 5928, 5931, 5932, 5933, 5938, 5939, 5940, 5941, 5942, 5944, 5945, 5947, 5948, 5951, 5954, 5957, 5959, 5961, 5967, 5968, 5969, 5970, 5971, 5973, 5978, 5979, 5980, 5985, 5986, 5990, 5991, 5994, 5996, 5997, 6000, 6003, 6004, 6005, 6006, 6007, 6010, 6012, 6013, 6016, 6023, 6025, 6026, 6034, 6038, 6040, 6041, 6044, 6046, 6047, 6048, 6051, 6053, 6058, 6059, 6061, 6062, 6063, 6065, 6068, 6069, 6070, 6072, 6073, 6074, 6075, 6080, 6081, 6085, 6088, 6089, 6091, 6092, 6093, 6094, 6095, 6096, 6098, 6099, 6107, 6108, 6109, 6110, 6112, 6113, 6116, 6118, 6119, 6122, 6129, 6130, 6132, 6133, 6135, 6136, 6137, 6138, 6140, 6143, 6145, 6146, 6147, 6149, 6151, 6152, 6153, 6156, 6158, 6160, 6163, 6164, 6165, 6168, 6173, 6176, 6182, 6183, 6186, 6188, 6189, 6190, 6191, 6193, 6197, 6198, 6200, 6204, 6205, 6207, 6209, 6212, 6213, 6215, 6220, 6221, 6223, 6224, 6226, 6227, 6228, 6230, 6231, 6233, 6234, 6237, 6238, 6239, 6240, 6241, 6243, 6245, 6246, 6247, 6248, 6249, 6251, 6255, 6257, 6258, 6259, 6260, 6264, 6265, 6269, 6270, 6271, 6272, 6273, 6275, 6278, 6279, 6280, 6281, 6282, 6286, 6288, 6289, 6292, 6294, 6299, 6302, 6308, 6309, 6310, 6312, 6315, 6317, 6319, 6321, 6322, 6325, 6328, 6332, 6333, 6337, 6338, 6346, 6351, 6352, 6353, 6354, 6359, 6362, 6363, 6364, 6367, 6370, 6375, 6378, 6379, 6381, 6383, 6394, 6395, 6396, 6397, 6398, 6399, 6403, 6405, 6407, 6408, 6410, 6412, 6413, 6414, 6415, 6419, 6420, 6421, 6422, 6425, 6428, 6430, 6431, 6434, 6435, 6436, 6437, 6440, 6442, 6449, 6452, 6454, 6458, 6459, 6463, 6464, 6466, 6467, 6468, 6469, 6470, 6471, 6474, 6476, 6480, 6481, 6484, 6486, 6488, 6495, 6499, 6500, 6501, 6502, 6503, 6504, 6505, 6510, 6513, 6514, 6515, 6516, 6517, 6519, 6524, 6525, 6526, 6530, 6532, 6533, 6534, 6535, 6537, 6543, 6544, 6547, 6548, 6549, 6552, 6554, 6555, 6558, 6560, 6561, 6563, 6564, 6567, 6572, 6574, 6576, 6577, 6579, 6581, 6582, 6584, 6587, 6588, 6589, 6594, 6595, 6598, 6599, 6600, 6603, 6607, 6611, 6614, 6621, 6622, 6624, 6626, 6627, 6630, 6634, 6635, 6637, 6638, 6639, 6640, 6643, 6644, 6646, 6647, 6648, 6649, 6652, 6655, 6656, 6658, 6662, 6666, 6667, 6671, 6672, 6677, 6678, 6681, 6686, 6691, 6692, 6695, 6696, 6703, 6705, 6706, 6711, 6713, 6714, 6716, 6718, 6720, 6724, 6725, 6729, 6731, 6734, 6736, 6737, 6739, 6746, 6747, 6752, 6756, 6757, 6759, 6760, 6761, 6764, 6766, 6767, 6778, 6779, 6780, 6783, 6786, 6788, 6792, 6793, 6794, 6797, 6799, 6803, 6804, 6805, 6807, 6810, 6811, 6812, 6813, 6816, 6819, 6820, 6821, 6824, 6827, 6828, 6829, 6830, 6831, 6834, 6837, 6839, 6840, 6841, 6842, 6843, 6845, 6859, 6862, 6863, 6864, 6865, 6869, 6870, 6872, 6874, 6875, 6876, 6878, 6879, 6880, 6882, 6883, 6884, 6888, 6890, 6892, 6897, 6903, 6904, 6906, 6913, 6914, 6915, 6917, 6919, 6920, 6921, 6925, 6930, 6933, 6936, 6941, 6943, 6944, 6946, 6948, 6950, 6951, 6952, 6959, 6960, 6963, 6969, 6974, 6979, 6980, 6984, 6985, 6987, 6988, 6990, 6991, 6993, 6994, 6995, 6999, 7002, 7003, 7006, 7009, 7012, 7013, 7015, 7017, 7022, 7032, 7039, 7042, 7043, 7045, 7046, 7051, 7052, 7053, 7056, 7057, 7060, 7062, 7064, 7067, 7068, 7072, 7073, 7075, 7077, 7079, 7083, 7084, 7085, 7086, 7093, 7094, 7097, 7105, 7106, 7107, 7108, 7112, 7116, 7117, 7118, 7124, 7130, 7132, 7135, 7140, 7142, 7144, 7146, 7149, 7151, 7155, 7163, 7164, 7165, 7166, 7169, 7176, 7177, 7182, 7183, 7184, 7187, 7188, 7192, 7196, 7201, 7203, 7206, 7207, 7208, 7209, 7212, 7216, 7217, 7218, 7219, 7220, 7227, 7228, 7230, 7231, 7234, 7235, 7236, 7239, 7240, 7241, 7243, 7244, 7245, 7248, 7255, 7257, 7258, 7259, 7262, 7267, 7268, 7269, 7270, 7274, 7276, 7277, 7281, 7282, 7284, 7287, 7288, 7291, 7292, 7293, 7298, 7299, 7300, 7301, 7303, 7304, 7305, 7306, 7307, 7310, 7311, 7312, 7313, 7315, 7317, 7328, 7330, 7334, 7339, 7340, 7344, 7345, 7348, 7354, 7355, 7356, 7357, 7358, 7363, 7365, 7371, 7373, 7375, 7379, 7380, 7381, 7382, 7383, 7388, 7389, 7392, 7395, 7398, 7400, 7401, 7410, 7411, 7417, 7424, 7425, 7428, 7430, 7434, 7435, 7436, 7441, 7443, 7444, 7445, 7446, 7447, 7448, 7452, 7454, 7458, 7459, 7464, 7466, 7470, 7476, 7483, 7486, 7487, 7490, 7492, 7493, 7498, 7504, 7505, 7512, 7515, 7517, 7518, 7523, 7524, 7525, 7528, 7529, 7533, 7534, 7537, 7538, 7546, 7547, 7548, 7560, 7561, 7574, 7577, 7578, 7579, 7580, 7585, 7586, 7587, 7588, 7590, 7591, 7593, 7594, 7598, 7601, 7605, 7611, 7617, 7619, 7621, 7623, 7624, 7632, 7633, 7634, 7638, 7639, 7640, 7642, 7643, 7652, 7658, 7661, 7663, 7664, 7665, 7666, 7667, 7674, 7676, 7677, 7678, 7679, 7680, 7682, 7685, 7687, 7689, 7695, 7699, 7700, 7703, 7704, 7708, 7712, 7713, 7716, 7717, 7718, 7719, 7724, 7725, 7726, 7729, 7733, 7736, 7737, 7738, 7740, 7744, 7745, 7747, 7749, 7751, 7753, 7754, 7761, 7762, 7763, 7764, 7767, 7768, 7769, 7770, 7774, 7775, 7777, 7778, 7779, 7780, 7782, 7783, 7785, 7786, 7788, 7791, 7792, 7793, 7798, 7800, 7803, 7804, 7806, 7807, 7812, 7815, 7818, 7819, 7820, 7823, 7824, 7825, 7832, 7833, 7834, 7836, 7838, 7841, 7844, 7847, 7848, 7849, 7856, 7858, 7859, 7860, 7862, 7863, 7865, 7876, 7878, 7888, 7890, 7896, 7900, 7908, 7909, 7910, 7911, 7917, 7918, 7920, 7921, 7922, 7923, 7925, 7929, 7933, 7934, 7935, 7936, 7937, 7938, 7942, 7944, 7945, 7947, 7948, 7949, 7950, 7955, 7956, 7964, 7965, 7966, 7967, 7972, 7974, 7976, 7977, 7978, 7980, 7983, 7984, 7986, 7988, 7989, 7990, 7991, 7992, 7993, 8002, 8004, 8006, 8008, 8012, 8021, 8026, 8029, 8035, 8039, 8042, 8044, 8045, 8047, 8048, 8052, 8053, 8056, 8058, 8059, 8061, 8063, 8064, 8067, 8068, 8071, 8072, 8073, 8075, 8076, 8077, 8078, 8079, 8080, 8082, 8084, 8088, 8091, 8093, 8095, 8099, 8100, 8102, 8103, 8105, 8106, 8112, 8116, 8118, 8120, 8121, 8126, 8130, 8134, 8136, 8137, 8145, 8146, 8148, 8150, 8155, 8159, 8163, 8164, 8165, 8170, 8176, 8178, 8179, 8186, 8189, 8193, 8195, 8199, 8202, 8204, 8206, 8207, 8208, 8210, 8211, 8212, 8213, 8215, 8216, 8219, 8220, 8222, 8223, 8225, 8227, 8231, 8234, 8235, 8237, 8239, 8242, 8245, 8250, 8252, 8253, 8257, 8258, 8262, 8265, 8266, 8268, 8269, 8270, 8272, 8274, 8289, 8291, 8292, 8293, 8294, 8295, 8300, 8301, 8302, 8304, 8310, 8312, 8318, 8319, 8320, 8321, 8323, 8324, 8329, 8331, 8334, 8335, 8336, 8339, 8340, 8349, 8350, 8351, 8352, 8353, 8355, 8363, 8367, 8368, 8369, 8373, 8379, 8382, 8386, 8389, 8392, 8393, 8400, 8401, 8402, 8403, 8404, 8405, 8407, 8410, 8411, 8413, 8414, 8416, 8417, 8418, 8423, 8428, 8430, 8433, 8435, 8436, 8438, 8439, 8441, 8444, 8446, 8447, 8448, 8449, 8450, 8451, 8452, 8457, 8465, 8466, 8469, 8472, 8473, 8474, 8476, 8480, 8481, 8482, 8485, 8486, 8490, 8493, 8498, 8499, 8501, 8502, 8505, 8509, 8511, 8513, 8515, 8517, 8520, 8523, 8524, 8525, 8527, 8528, 8531, 8532, 8533, 8537, 8538, 8539, 8541, 8543, 8544, 8545, 8549, 8550, 8552, 8554, 8557, 8561, 8562, 8565, 8566, 8568, 8575, 8576, 8579, 8581, 8582, 8589, 8590, 8592, 8593, 8594, 8596, 8597, 8598, 8599, 8600, 8601, 8603, 8605, 8609, 8610, 8611, 8612, 8613, 8614, 8617, 8624, 8630, 8631, 8634, 8635, 8637, 8638, 8640, 8641, 8642, 8644, 8650, 8654, 8657, 8658, 8659, 8660, 8663, 8665, 8666, 8669, 8670, 8671, 8672, 8676, 8677, 8685, 8693, 8699, 8700, 8703, 8704, 8706, 8707, 8708, 8709, 8713, 8714, 8715, 8716, 8717, 8719, 8720, 8722, 8726, 8727, 8728, 8729, 8730, 8731, 8732, 8734, 8735, 8736, 8740, 8741, 8744, 8745, 8746, 8748, 8751, 8752, 8753, 8755, 8757, 8759, 8764, 8767, 8770, 8772, 8773, 8775, 8777, 8779, 8782, 8783, 8784, 8789, 8792, 8796, 8797, 8803, 8804, 8805, 8810, 8817, 8818, 8822, 8824, 8829, 8831, 8832, 8834, 8835, 8838, 8839, 8841, 8843, 8846, 8853, 8854, 8861, 8865, 8866, 8867, 8876, 8877, 8878, 8880, 8881, 8883, 8886, 8888, 8891, 8892, 8896, 8897, 8899, 8900, 8905, 8907, 8908, 8909, 8910, 8911, 8912, 8914, 8916, 8917, 8922, 8925, 8926, 8929, 8930, 8935, 8938, 8941, 8942, 8945, 8946, 8949, 8951, 8954, 8957, 8959, 8960, 8961, 8962, 8963, 8967, 8968, 8969, 8972, 8974, 8976, 8977, 8979, 8980, 8981, 8985, 8986, 8992, 8996, 8998, 8999, 9001, 9002, 9003, 9006, 9009, 9012, 9015, 9017, 9020, 9023, 9026, 9027, 9029, 9030, 9033, 9037, 9044, 9047, 9052, 9057, 9058, 9059, 9060, 9062, 9066, 9069, 9071, 9072, 9073, 9074, 9076, 9084, 9088, 9091, 9092, 9095, 9096, 9097, 9100, 9103, 9105, 9108, 9110, 9111, 9112, 9114, 9118, 9120, 9125, 9129, 9133, 9134, 9139, 9140, 9141, 9142, 9149, 9151, 9154, 9155, 9157, 9167, 9168, 9173, 9174, 9177, 9179, 9183, 9185, 9187, 9188, 9190, 9191, 9195, 9206, 9207, 9210, 9211, 9213, 9215, 9216, 9218, 9226, 9229, 9231, 9233, 9234, 9235, 9237, 9241, 9243, 9247, 9252, 9253, 9254, 9255, 9263, 9265, 9267, 9269, 9270, 9273, 9276, 9278, 9284, 9285, 9287, 9288, 9290, 9292, 9293, 9298, 9299, 9300, 9304, 9308, 9311, 9320, 9323, 9325, 9326, 9327, 9328, 9329, 9330, 9336, 9337, 9338, 9339, 9340, 9341, 9345, 9346, 9347, 9348, 9350, 9354, 9355, 9357, 9359, 9366, 9367, 9373, 9375, 9376, 9377, 9378, 9382, 9383, 9388, 9391, 9392, 9393, 9394, 9396, 9398, 9400, 9402, 9403, 9404, 9406, 9407, 9413, 9417, 9423, 9432, 9433, 9434, 9440, 9443, 9444, 9452, 9456, 9460, 9468, 9470, 9471, 9472, 9473, 9478, 9479, 9481, 9483, 9486, 9488, 9490, 9494, 9495, 9497, 9500, 9501, 9502, 9503, 9504, 9509, 9514, 9515, 9517, 9518, 9519, 9525, 9532, 9533, 9534, 9536, 9540, 9545, 9548, 9553, 9555, 9557, 9559, 9560, 9563, 9564, 9565, 9567, 9568, 9571, 9577, 9582, 9586, 9587, 9589, 9590, 9591, 9602, 9606, 9609, 9610, 9613, 9614, 9615, 9620, 9623, 9626, 9628, 9629, 9630, 9633, 9635, 9640, 9641, 9642, 9644, 9645, 9646, 9648, 9649, 9650, 9652, 9653, 9655, 9656, 9657, 9658, 9659, 9660, 9663, 9666, 9668, 9670, 9681, 9682, 9686, 9692, 9693, 9694, 9698, 9700, 9706, 9710, 9711, 9717, 9718, 9722, 9723, 9725, 9726, 9729, 9730, 9731, 9733, 9734, 9737, 9746, 9750, 9751, 9753, 9754, 9755, 9756, 9762, 9763, 9764, 9767, 9768, 9770, 9774, 9776, 9780, 9781, 9782, 9784, 9786, 9791, 9792, 9793, 9794, 9796, 9799, 9801, 9804, 9806, 9809, 9810, 9812, 9813, 9814, 9816, 9819, 9820, 9824, 9825, 9827, 9829, 9830, 9833, 9836, 9845, 9846, 9847, 9849, 9850, 9851, 9853, 9854, 9858, 9860, 9861, 9864, 9866, 9869, 9871, 9873, 9882, 9885, 9886, 9887, 9892, 9897, 9900, 9901, 9902, 9906, 9907, 9908, 9909, 9910, 9911, 9912, 9917, 9921, 9923, 9924, 9928, 9935, 9938, 9940, 9946, 9947, 9949, 9950, 9953, 9955, 9957, 9958, 9960, 9962, 9963, 9964, 9967, 9968, 9971, 9972, 9979, 9980, 9982, 9984, 9985, 9987, 9988, 9990, 9991, 9996, 9997, 9998, 10000, 10008, 10009, 10010, 10013, 10017, 10018, 10019, 10021, 10022, 10026, 10031, 10032, 10033, 10034, 10037, 10038, 10041, 10042, 10043, 10045, 10047, 10048, 10050, 10051, 10052, 10054, 10056, 10058, 10060, 10062, 10063, 10064, 10066, 10068, 10073, 10077, 10078, 10082, 10083, 10086, 10087, 10089, 10090, 10091, 10092, 10095, 10097, 10101, 10102, 10103, 10105, 10106, 10107, 10108, 10109, 10110, 10114, 10115, 10116, 10118, 10122, 10127, 10128, 10131, 10132, 10136, 10141, 10142, 10143, 10146, 10149, 10151, 10152, 10158, 10162, 10163, 10165, 10166, 10168, 10170, 10174, 10176, 10177, 10178, 10181, 10182, 10187, 10191, 10192, 10193, 10194, 10195, 10197, 10199, 10203, 10206, 10209, 10212, 10213, 10214, 10218, 10219, 10220, 10222, 10223, 10225, 10228, 10232, 10233, 10236, 10237, 10247, 10252, 10253, 10255, 10257, 10263, 10268, 10270, 10275, 10278, 10284, 10291, 10292, 10293, 10295, 10296, 10297, 10300, 10302, 10306, 10307, 10311, 10321, 10322, 10323, 10325, 10326, 10327, 10328, 10331, 10333, 10334, 10335, 10336, 10338, 10343, 10346, 10351, 10352, 10353, 10356, 10357, 10359, 10360, 10362, 10364, 10368, 10371, 10373, 10375, 10378, 10380, 10381, 10384, 10385, 10388, 10389, 10395, 10397, 10398, 10399, 10401, 10409, 10410, 10412, 10413, 10414, 10416, 10421, 10422, 10423, 10430, 10435, 10437, 10438, 10440, 10442, 10443, 10446, 10447, 10448, 10449, 10450, 10453, 10456, 10460, 10463, 10464, 10465, 10468, 10469, 10470, 10474, 10478, 10480, 10482, 10487, 10488, 10494, 10496, 10497, 10504, 10506, 10508, 10513, 10514, 10518, 10525, 10527, 10528, 10531, 10533, 10535, 10536, 10537, 10541, 10542, 10543, 10544, 10545, 10547, 10548, 10549, 10550, 10551, 10555, 10556, 10558, 10560, 10561, 10562, 10565, 10567, 10569, 10573, 10580, 10581, 10582, 10583, 10585, 10587, 10593, 10595, 10596, 10597, 10599, 10601, 10602, 10606, 10610, 10611, 10613, 10615, 10616, 10617, 10621, 10622, 10623, 10626, 10628, 10634, 10637, 10638, 10639, 10640, 10641, 10642, 10643, 10645, 10646, 10650, 10655, 10657, 10659, 10660, 10663, 10665, 10666, 10668, 10670, 10673, 10674, 10678, 10681, 10682, 10683, 10684, 10685, 10687, 10689, 10697, 10698, 10699, 10700, 10701, 10702, 10703, 10705, 10706, 10707, 10711, 10715, 10716, 10721, 10722, 10725, 10726, 10727, 10732, 10735, 10737, 10740, 10741, 10744, 10745, 10747, 10748, 10749, 10761, 10762, 10763, 10766, 10775, 10778, 10779, 10782, 10784, 10785, 10787, 10788, 10790, 10791, 10792, 10795, 10796, 10798, 10800, 10801, 10802, 10803, 10804, 10805, 10809, 10810, 10811, 10812, 10815, 10818, 10819, 10820, 10821, 10823, 10824, 10825, 10826, 10831, 10832, 10833, 10836, 10838, 10839, 10841, 10843, 10846, 10847, 10850, 10852, 10853, 10854, 10857, 10858, 10860, 10861, 10862, 10866, 10867, 10871, 10877, 10878, 10880, 10881, 10887, 10891, 10892, 10893, 10896, 10897, 10898, 10899, 10902, 10905, 10910, 10912, 10913, 10915, 10916, 10917, 10920, 10926, 10927, 10928, 10930, 10933, 10934, 10935, 10936, 10937, 10938, 10940, 10941, 10944, 10947, 10948, 10950, 10954, 10957, 10960, 10962, 10965, 10967, 10972, 10976, 10977, 10978, 10979, 10980, 10981, 10985, 10988, 10993, 10995, 10996, 10997, 10999, 11004, 11005, 11006, 11008, 11009, 11010, 11018, 11024, 11027, 11032, 11033, 11039, 11046, 11047, 11052, 11053, 11056, 11060, 11066, 11068, 11070, 11071, 11072, 11078, 11079, 11080, 11082, 11083, 11086, 11090, 11095, 11098, 11099, 11100, 11101, 11102, 11103, 11107, 11110, 11114, 11116, 11118, 11123, 11124, 11125, 11127, 11129, 11132, 11133, 11135, 11137, 11138, 11141, 11145, 11146, 11148, 11152, 11153, 11154, 11158, 11159, 11160, 11161, 11162, 11163, 11165, 11166, 11168, 11169, 11172, 11175, 11177, 11178, 11181, 11184, 11185, 11187, 11188, 11190, 11191, 11192, 11194, 11198, 11199, 11201, 11202, 11203, 11207, 11214, 11217, 11218, 11222, 11226, 11227, 11228, 11229, 11232, 11233, 11234, 11235, 11236, 11237, 11238, 11239, 11242, 11246, 11247, 11248, 11251, 11256, 11257, 11258, 11259, 11260, 11261, 11262, 11263, 11264, 11266, 11274, 11275, 11278, 11288, 11289, 11290, 11291, 11292, 11293, 11294, 11295, 11305, 11306, 11307, 11313, 11315, 11316, 11317, 11319, 11320, 11322, 11324, 11326, 11329, 11332, 11337, 11339, 11340, 11345, 11346, 11348, 11349, 11352, 11356, 11358, 11363, 11364, 11365, 11366, 11370, 11371, 11373, 11374, 11377, 11381, 11382, 11387, 11388, 11389, 11391, 11392, 11394, 11395, 11397, 11403, 11405, 11406, 11409, 11416, 11418, 11423, 11424, 11426, 11428, 11430, 11431, 11434, 11437, 11438, 11442, 11445, 11446, 11449, 11451, 11459, 11463, 11465, 11467, 11470, 11471, 11472, 11473, 11475, 11476, 11477, 11478, 11481, 11482, 11485, 11487, 11496, 11497, 11498, 11500, 11501, 11503, 11506, 11507, 11508, 11509, 11512, 11516, 11520, 11523, 11524, 11526, 11527, 11528, 11530, 11531, 11532, 11533, 11534, 11535, 11538, 11540, 11541, 11544, 11546, 11548, 11551, 11553, 11558, 11560, 11561, 11564, 11567, 11568, 11571, 11574, 11576, 11577, 11578, 11580, 11583, 11588, 11589, 11593, 11594, 11595, 11597, 11598, 11599, 11604, 11612, 11618, 11620, 11621, 11623, 11625, 11628, 11629, 11632, 11633, 11637, 11639, 11642, 11650, 11651, 11652, 11654, 11655, 11656, 11657, 11658, 11659, 11663, 11664, 11667, 11668, 11669, 11672, 11673, 11677, 11678, 11680, 11681, 11682, 11683, 11684, 11688, 11691, 11692, 11694, 11695, 11701, 11703, 11705, 11707, 11711, 11712, 11720, 11721, 11725, 11726, 11731, 11733, 11736, 11740, 11743, 11744, 11748, 11753, 11755, 11759, 11760, 11761, 11762, 11763, 11764, 11765, 11766, 11767, 11770, 11771, 11773, 11776, 11780, 11781, 11782, 11783, 11785, 11786, 11790, 11792, 11795, 11799, 11800, 11809, 11812, 11813, 11814, 11816, 11818, 11819, 11825, 11826, 11828, 11829, 11830, 11831, 11832, 11833, 11837, 11838, 11841, 11846, 11849, 11850, 11851, 11853, 11854, 11856, 11857, 11858, 11863, 11868, 11872, 11876, 11877, 11878, 11879, 11881, 11886, 11890, 11891, 11893, 11898, 11903, 11904, 11909, 11913, 11915, 11916, 11917, 11919, 11920, 11921, 11923, 11926, 11927, 11928, 11929, 11930, 11934, 11935, 11939, 11940, 11941, 11943, 11946, 11947, 11948, 11949, 11953, 11955, 11957, 11958, 11959, 11960, 11961, 11962, 11963, 11965, 11968, 11977, 11979, 11980, 11983, 11988, 11993, 11997, 11998, 11999, 12002, 12004, 12008, 12019, 12020, 12021, 12023, 12024, 12025, 12026, 12032, 12042, 12043, 12044, 12047, 12050, 12054, 12059, 12060, 12061, 12064, 12066, 12077, 12078, 12079, 12080, 12081, 12083, 12085, 12086, 12091, 12092, 12093, 12097, 12098, 12104, 12106, 12108, 12109, 12112, 12114, 12115, 12118, 12120, 12122, 12127, 12128, 12129, 12130, 12131, 12134, 12138, 12139, 12143, 12144, 12145, 12146, 12147, 12149, 12150, 12151, 12161, 12162, 12165, 12166, 12167, 12170, 12171, 12173, 12174, 12175, 12179, 12181, 12186, 12187, 12197, 12198, 12200, 12201, 12202, 12204, 12208, 12212, 12217, 12220, 12223, 12229, 12233, 12237, 12240, 12241, 12243, 12245, 12249, 12250, 12252, 12254, 12255, 12256, 12259, 12265, 12268, 12269, 12271, 12278, 12280, 12283, 12284, 12285, 12286, 12287, 12288, 12295, 12296, 12302, 12310, 12311, 12312, 12313, 12314, 12315, 12317, 12319, 12321, 12323, 12325, 12328, 12331, 12334, 12335, 12339, 12342, 12343, 12345, 12347, 12350, 12354, 12356, 12359, 12364, 12366, 12369, 12370, 12375, 12376, 12379, 12381, 12383, 12385, 12390, 12393, 12394, 12397, 12399, 12400, 12401, 12403, 12404, 12406, 12411, 12414, 12415, 12417, 12419, 12420, 12423, 12424, 12425, 12426, 12427, 12428, 12430, 12432, 12437, 12440, 12441, 12444, 12445, 12446, 12450, 12451, 12456, 12457, 12459, 12461, 12462, 12465, 12467, 12468, 12470, 12472, 12473, 12475, 12478, 12479, 12480, 12481, 12483, 12487, 12488, 12489, 12492, 12494, 12497, 12503, 12508, 12512, 12513, 12514, 12515, 12518, 12519, 12525, 12527, 12530, 12535, 12536, 12537, 12538, 12539, 12540, 12546, 12547, 12548, 12549, 12551, 12552, 12554, 12555, 12556, 12557, 12561, 12563, 12565, 12567, 12568, 12570, 12572, 12574, 12577, 12578, 12580, 12583, 12585, 12586, 12588, 12589, 12591, 12600, 12603, 12605, 12606, 12608, 12609, 12610, 12611, 12616, 12622, 12623, 12626, 12628, 12629, 12631, 12634, 12639, 12640, 12641, 12644, 12648, 12649, 12650, 12651, 12652, 12653, 12654, 12658, 12663, 12664, 12668, 12670, 12671, 12674, 12675, 12679, 12680, 12681, 12683, 12684, 12685, 12688, 12689, 12691, 12693, 12694, 12695, 12696, 12699, 12701, 12702, 12705, 12706, 12710, 12713, 12714, 12716, 12723, 12731, 12732, 12733, 12735, 12738, 12739, 12740, 12741, 12742, 12750, 12752, 12753, 12754, 12755, 12757, 12758, 12760, 12761, 12764, 12765, 12766, 12771, 12775, 12777, 12782, 12783, 12790, 12793, 12794, 12797, 12800, 12802, 12803, 12807, 12808, 12810, 12812, 12813, 12817, 12820, 12822, 12823, 12824, 12826, 12827, 12828, 12835, 12836, 12837, 12838, 12839, 12843, 12844, 12848, 12849, 12850, 12853, 12860, 12861, 12866, 12870, 12873, 12875, 12878, 12882, 12883, 12884, 12887, 12888, 12891, 12893, 12898, 12899, 12900, 12901, 12903, 12904, 12905, 12906, 12908, 12910, 12912, 12913, 12914, 12916, 12917, 12920, 12921, 12928, 12929, 12932, 12933, 12934, 12935, 12938, 12940, 12945, 12946, 12947, 12950, 12952, 12956, 12957, 12958, 12959, 12960, 12961, 12963, 12967, 12968, 12969, 12978, 12983, 12984, 12986, 12987, 12988, 12990, 12991, 12999, 13001, 13003, 13004, 13007, 13010, 13014, 13015, 13017, 13018, 13022, 13030, 13031, 13032, 13033, 13034, 13035, 13037, 13038, 13041, 13044, 13045, 13047, 13049, 13050, 13053, 13054, 13055, 13056, 13061, 13062, 13064, 13066, 13067, 13071, 13075, 13079, 13083, 13085, 13086, 13087, 13097, 13099, 13101, 13102, 13105, 13106, 13110, 13111, 13112, 13114, 13115, 13116, 13117, 13118, 13120, 13121, 13122, 13123, 13124, 13125, 13128, 13131, 13134, 13135, 13142, 13143, 13144, 13147, 13148, 13149, 13151, 13154, 13159, 13160, 13169, 13175, 13181, 13182, 13186, 13188, 13189, 13193, 13197, 13198, 13199, 13203, 13205, 13206, 13209, 13210, 13212, 13213, 13215, 13217, 13221, 13224, 13226, 13227, 13228, 13232, 13233, 13234, 13235, 13236, 13237, 13239, 13241, 13243, 13244, 13248, 13250, 13251, 13255, 13256, 13259, 13260, 13261, 13262, 13263, 13264, 13265, 13267, 13268, 13269, 13271, 13274, 13281, 13283, 13284, 13287, 13296, 13297, 13298, 13300, 13301, 13303, 13304, 13308, 13313, 13315, 13317, 13319, 13325, 13329, 13332, 13335, 13337, 13340, 13343, 13344, 13345, 13346, 13347, 13348, 13350, 13352, 13361, 13363, 13367, 13368, 13369, 13370, 13377, 13380, 13381, 13384, 13385, 13386, 13391, 13393, 13394, 13395, 13397, 13398, 13401, 13402, 13403, 13404, 13407, 13408, 13410, 13412, 13416, 13417, 13419, 13423, 13424, 13430, 13433, 13439, 13441, 13444, 13448, 13454, 13456, 13457, 13460, 13463, 13467, 13469, 13473, 13475, 13477, 13478, 13480, 13484, 13489, 13491, 13492, 13496, 13497, 13499, 13500, 13503, 13504, 13505, 13507, 13513, 13514, 13515, 13519, 13521, 13522, 13524, 13526, 13529, 13533, 13535, 13536, 13539, 13540, 13543, 13544, 13545, 13546, 13547, 13549, 13552, 13553, 13555, 13558, 13559, 13561, 13568, 13569, 13574, 13580, 13584, 13587, 13597, 13599, 13600, 13601, 13602, 13604, 13605, 13611, 13612, 13613, 13614, 13621, 13623, 13630, 13631, 13632, 13634, 13636, 13637, 13641, 13643, 13647, 13650, 13651, 13653, 13654, 13660, 13662, 13663, 13665, 13668, 13670, 13675, 13676, 13677, 13678, 13679, 13683, 13687, 13688, 13689, 13696, 13697, 13698, 13699, 13700, 13702, 13706, 13710, 13713, 13714, 13715, 13716, 13719, 13720, 13724, 13727, 13729, 13737, 13739, 13742, 13745, 13747, 13750, 13755, 13756, 13763, 13764, 13766, 13767, 13772, 13773, 13775, 13777, 13779, 13780, 13781, 13782, 13783, 13786, 13787, 13788, 13789, 13791, 13793, 13794, 13796, 13797, 13799, 13801, 13809, 13816, 13817, 13818, 13819, 13822, 13823, 13828, 13830, 13831, 13834, 13835, 13840, 13843, 13849, 13852, 13858, 13866, 13869, 13872, 13873, 13875, 13877, 13879, 13885, 13887, 13888, 13891, 13892, 13895, 13897, 13898, 13899, 13901, 13902, 13903, 13906, 13908, 13909, 13910, 13911, 13917, 13918, 13919, 13921, 13924, 13925, 13932, 13934, 13947, 13950, 13952, 13953, 13954, 13958, 13960, 13961, 13963, 13969, 13970, 13971, 13975, 13984, 13986, 13987, 13991, 13999, 14000, 14001, 14005, 14006, 14008, 14009, 14013, 14014, 14017, 14022, 14027, 14030, 14031, 14035, 14036, 14038, 14040, 14049, 14051, 14052, 14059, 14062, 14063, 14066, 14067, 14069, 14070, 14071, 14072, 14073, 14074, 14075, 14078, 14081, 14084, 14085, 14086, 14088, 14092, 14094, 14096, 14097, 14104, 14106, 14112, 14114, 14116, 14117, 14118, 14119, 14121, 14122, 14124, 14129, 14130, 14132, 14133, 14135, 14136, 14137, 14138, 14139, 14140, 14142, 14145, 14146, 14147.

Promoters expressing in the Stage 1 proliferating embryogenic callus grown in the dark include SEQ IDs: 3, 4, 7, 9, 12, 13, 14, 15, 16, 17, 19, 27, 29, 31, 33, 34, 36, 37, 44, 48, 54, 57, 63, 64, 65, 69, 70, 71, 79, 80, 86, 88, 90, 93, 94, 96, 98, 99, 100, 102, 103, 104, 105, 110, 111, 112, 117, 121, 123, 126, 128, 130, 131, 136, 137, 141, 143, 147, 148, 152, 154, 156, 157, 159, 162, 165, 172, 174, 175, 176, 179, 180, 181, 183, 187, 191, 193, 194, 196, 197, 199, 202, 203, 204, 205, 207, 211, 212, 214, 223, 232, 233, 235, 236, 237, 239, 240, 242, 244, 246, 249, 250, 251, 256, 257, 259, 262, 264, 267, 269, 270, 271, 273, 280, 281, 286, 288, 289, 293, 294, 299, 301, 302, 305, 306, 308, 309, 316, 319, 320, 322, 323, 328, 329, 332, 334, 335, 338, 340, 346, 348, 349, 352, 353, 354, 355, 356, 357, 358, 360, 365, 371, 373, 374, 378, 379, 381, 388, 396, 401, 411, 412, 414, 416, 423, 424, 428, 431, 432, 433, 434, 436, 441, 448, 450, 452, 456, 458, 461, 463, 466, 468, 470, 471, 474, 478, 479, 483, 485, 488, 489, 492, 496, 498, 501, 504, 505, 507, 509, 510, 511, 514, 515, 516, 517, 523, 525, 532, 534, 535, 536, 537, 538, 541, 543, 544, 546, 547, 548, 553, 554, 557, 561, 563, 569, 578, 580, 585, 591, 594, 595, 596, 599, 602, 605, 606, 607, 613, 619, 620, 623, 631, 633, 634, 635, 636, 637, 638, 643, 647, 650, 655, 661, 663, 664, 667, 668, 670, 671, 681, 683, 687, 693, 694, 695, 701, 702, 705, 706, 709, 716, 717, 718, 719, 722, 723, 724, 727, 731, 732, 733, 734, 736, 739, 740, 742, 744, 749, 752, 753, 757, 759, 760, 761, 762, 763, 764, 765, 771, 779, 782, 783, 784, 785, 786, 792, 793, 800, 804, 806, 808, 809, 811, 812, 819, 820, 821, 822, 824, 825, 826, 827, 829, 830, 833, 840, 841, 846, 849, 855, 856, 857, 858, 860, 862, 863, 865, 870, 871, 872, 875, 876, 877, 887, 890, 891, 892, 893, 895, 897, 898, 899, 900, 903, 907, 908, 911, 912, 913, 915, 916, 917, 919, 920, 924, 928, 932, 934, 936, 938, 943, 944, 947, 949, 951, 953, 955, 957, 958, 960, 964, 971, 974, 976, 977, 978, 979, 980, 981, 982, 984, 987, 988, 993, 994, 995, 996, 997, 999, 1003, 1005, 1006, 1007, 1008, 1009, 1010, 1011, 1012, 1013, 1014, 1016, 1017, 1022, 1025, 1026, 1032, 1033, 1035, 1038, 1039, 1041, 1042, 1043, 1046, 1047, 1049, 1051, 1052, 1054, 1055, 1056, 1057, 1059, 1064, 1065, 1067, 1069, 1070, 1073, 1074, 1076, 1077, 1080, 1085, 1086, 1087, 1089, 1092, 1095, 1096, 1100, 1101, 1103, 1104, 1106, 1110, 1112, 1114, 1115, 1116, 1117, 1119, 1120, 1121, 1125, 1130, 1132, 1136, 1137, 1140, 1144, 1146, 1148, 1153, 1154, 1155, 1160, 1161, 1162, 1164, 1165, 1167, 1168, 1170, 1171, 1175, 1176, 1178, 1183, 1187, 1189, 1190, 1191, 1196, 1201, 1204, 1205, 1213, 1214, 1215, 1217, 1218, 1220, 1222, 1223, 1225, 1227, 1228, 1230, 1231, 1233, 1236, 1237, 1240, 1248, 1249, 1251, 1254, 1257, 1258, 1261, 1263, 1269, 1272, 1277, 1281, 1285, 1286, 1290, 1292, 1293, 1296, 1298, 1301, 1306, 1307, 1309, 1310, 1311, 1312, 1314, 1316, 1320, 1322, 1323, 1327, 1330, 1331, 1334, 1337, 1339, 1345, 1347, 1349, 1354, 1355, 1360, 1363, 1364, 1366, 1367, 1368, 1371, 1375, 1376, 1377, 1380, 1381, 1387, 1388, 1389, 1391, 1392, 1393, 1394, 1396, 1398, 1399, 1402, 1404, 1405, 1406, 1407, 1412, 1415, 1416, 1420, 1421, 1423, 1426, 1431, 1432, 1433, 1438, 1440, 1441, 1442, 1447, 1448, 1451, 1453, 1458, 1459, 1461, 1462, 1466, 1468, 1471, 1472, 1474, 1475, 1484, 1485, 1488, 1490, 1491, 1492, 1493, 1497, 1498, 1499, 1501, 1503, 1504, 1506, 1508, 1510, 1511, 1514, 1518, 1519, 1527, 1528, 1530, 1539, 1543, 1545, 1546, 1547, 1549, 1550, 1551, 1554, 1555, 1556, 1561, 1563, 1564, 1567, 1568, 1570, 1571, 1575, 1578, 1579, 1584, 1585, 1586, 1590, 1591, 1594, 1596, 1597, 1598, 1599, 1600, 1601, 1602, 1604, 1605, 1608, 1609, 1610, 1612, 1615, 1616, 1617, 1622, 1623, 1625, 1628, 1629, 1634, 1635, 1637, 1638, 1639, 1642, 1643, 1650, 1651, 1653, 1654, 1658, 1659, 1662, 1663, 1668, 1669, 1671, 1673, 1675, 1676, 1678, 1681, 1682, 1684, 1685, 1687, 1688, 1689, 1690, 1691, 1697, 1698, 1699, 1703, 1705, 1706, 1707, 1708, 1709, 1710, 1716, 1717, 1718, 1720, 1725, 1729, 1732, 1735, 1745, 1750, 1755, 1759, 1761, 1764, 1768, 1769, 1773, 1774, 1776, 1777, 1778, 1785, 1786, 1791, 1792, 1793, 1796, 1798, 1807, 1809, 1811, 1812, 1813, 1814, 1826, 1828, 1830, 1832, 1834, 1835, 1837, 1838, 1839, 1840, 1843, 1848, 1852, 1854, 1855, 1859, 1861, 1863, 1866, 1867, 1868, 1869, 1872, 1873, 1876, 1879, 1880, 1882, 1886, 1888, 1891, 1894, 1897, 1898, 1899, 1900, 1902, 1905, 1906, 1910, 1911, 1913, 1914, 1915, 1916, 1918, 1920, 1922, 1923, 1924, 1928, 1933, 1934, 1936, 1939, 1940, 1945, 1946, 1947, 1949, 1950, 1951, 1952, 1953, 1954, 1958, 1968, 1969, 1970, 1971, 1972, 1973, 1977, 1979, 1990, 1991, 1993, 1994, 1995, 1996, 1999, 2000, 2001, 2007, 2009, 2010, 2012, 2014, 2015, 2016, 2017, 2019, 2021, 2026, 2027, 2031, 2032, 2033, 2037, 2040, 2041, 2043, 2048, 2060, 2062, 2064, 2066, 2072, 2074, 2077, 2078, 2087, 2088, 2089, 2091, 2092, 2093, 2094, 2097, 2099, 2101, 2103, 2104, 2106, 2107, 2111, 2112, 2119, 2121, 2122, 2123, 2125, 2126, 2132, 2133, 2137, 2139, 2140, 2141, 2142, 2143, 2146, 2147, 2150, 2151, 2156, 2157, 2159, 2161, 2162, 2164, 2166, 2167, 2168, 2170, 2172, 2173, 2175, 2177, 2179, 2183, 2185, 2188, 2190, 2193, 2196, 2200, 2202, 2203, 2205, 2206, 2210, 2214, 2215, 2216, 2221, 2222, 2223, 2226, 2235, 2240, 2241, 2242, 2243, 2253, 2257, 2260, 2263, 2267, 2271, 2274, 2276, 2278, 2280, 2282, 2283, 2284, 2288, 2289, 2291, 2296, 2297, 2298, 2303, 2304, 2305, 2306, 2308, 2309, 2310, 2313, 2314, 2322, 2323, 2328, 2329, 2331, 2333, 2337, 2338, 2339, 2342, 2345, 2348, 2353, 2358, 2359, 2361, 2362, 2363, 2366, 2369, 2371, 2372, 2379, 2380, 2381, 2382, 2384, 2395, 2401, 2402, 2405, 2410, 2412, 2413, 2414, 2418, 2419, 2420, 2423, 2426, 2431, 2432, 2433, 2434, 2435, 2437, 2439, 2440, 2441, 2442, 2443, 2445, 2449, 2451, 2452, 2453, 2454, 2457, 2458, 2469, 2470, 2472, 2474, 2476, 2477, 2479, 2480, 2481, 2485, 2487, 2489, 2490, 2494, 2495, 2496, 2497, 2498, 2500, 2504, 2505, 2506, 2507, 2509, 2513, 2514, 2515, 2516, 2517, 2519, 2521, 2522, 2525, 2528, 2529, 2531, 2532, 2533, 2534, 2536, 2537, 2538, 2539, 2541, 2544, 2545, 2546, 2549, 2550, 2551, 2552, 2554, 2555, 2556, 2557, 2559, 2567, 2568, 2570, 2571, 2573, 2576, 2578, 2579, 2581, 2583, 2589, 2590, 2594, 2596, 2599, 2600, 2601, 2605, 2609, 2611, 2612, 2613, 2616, 2617, 2619, 2620, 2625, 2626, 2627, 2632, 2634, 2635, 2636, 2639, 2644, 2645, 2648, 2649, 2652, 2655, 2656, 2658, 2661, 2662, 2663, 2666, 2670, 2671, 2672, 2674, 2676, 2679, 2684, 2685, 2687, 2688, 2689, 2690, 2691, 2692, 2694, 2700, 2702, 2704, 2708, 2711, 2719, 2720, 2721, 2722, 2723, 2725, 2726, 2727, 2728, 2729, 2730, 2735, 2737, 2744, 2745, 2746, 2747, 2749, 2752, 2755, 2756, 2757, 2758, 2762, 2764, 2765, 2770, 2775, 2776, 2779, 2783, 2784, 2785, 2786, 2787, 2789, 2794, 2796, 2798, 2800, 2801, 2802, 2805, 2808, 2812, 2814, 2819, 2821, 2822, 2823, 2824, 2826, 2827, 2828, 2831, 2832, 2837, 2838, 2840, 2844, 2845, 2857, 2860, 2861, 2862, 2865, 2869, 2871, 2876, 2878, 2888, 2889, 2890, 2892, 2893, 2894, 2896, 2897, 2898, 2901, 2902, 2903, 2906, 2908, 2909, 2914, 2915, 2916, 2917, 2918, 2919, 2922, 2923, 2926, 2929, 2930, 2931, 2935, 2942, 2943, 2946, 2947, 2948, 2951, 2955, 2959, 2962, 2963, 2966, 2968, 2969, 2976, 2978, 2979, 2982, 2987, 2992, 2994, 2998, 3003, 3005, 3007, 3008, 3013, 3015, 3017, 3020, 3023, 3027, 3029, 3031, 3039, 3041, 3042, 3043, 3044, 3045, 3047, 3048, 3049, 3051, 3052, 3053, 3055, 3064, 3067, 3068, 3070, 3072, 3075, 3078, 3080, 3083, 3084, 3085, 3087, 3090, 3095, 3100, 3101, 3106, 3112, 3115, 3118, 3119, 3120, 3121, 3122, 3123, 3126, 3127, 3128, 3129, 3137, 3138, 3139, 3141, 3143, 3145, 3153, 3161, 3167, 3169, 3170, 3171, 3172, 3177, 3181, 3187, 3189, 3191, 3192, 3194, 3196, 3200, 3202, 3204, 3205, 3206, 3208, 3210, 3213, 3217, 3219, 3220, 3221, 3224, 3225, 3228, 3230, 3231, 3236, 3237, 3240, 3242, 3246, 3247, 3249, 3252, 3254, 3261, 3263, 3266, 3267, 3269, 3271, 3272, 3278, 3280, 3283, 3286, 3288, 3289, 3290, 3291, 3294, 3295, 3296, 3297, 3299, 3301, 3308, 3310, 3312, 3313, 3324, 3327, 3331, 3332, 3333, 3337, 3338, 3340, 3342, 3343, 3345, 3346, 3347, 3351, 3353, 3354, 3355, 3356, 3357, 3358, 3359, 3360, 3361, 3363, 3370, 3374, 3376, 3377, 3378, 3379, 3382, 3383, 3384, 3386, 3394, 3396, 3399, 3402, 3403, 3404, 3405, 3413, 3415, 3416, 3418, 3419, 3424, 3426, 3428, 3438, 3441, 3446, 3447, 3449, 3450, 3452, 3453, 3458, 3461, 3462, 3465, 3466, 3468, 3469, 3470, 3471, 3474, 3477, 3483, 3484, 3486, 3488, 3490, 3493, 3494, 3500, 3502, 3503, 3504, 3507, 3515, 3516, 3521, 3522, 3523, 3524, 3529, 3533, 3535, 3536, 3537, 3538, 3540, 3541, 3542, 3544, 3545, 3546, 3548, 3549, 3554, 3558, 3562, 3569, 3571, 3574, 3576, 3577, 3580, 3587, 3588, 3589, 3592, 3594, 3595, 3597, 3600, 3601, 3603, 3604, 3607, 3610, 3611, 3612, 3613, 3615, 3616, 3618, 3619, 3620, 3621, 3624, 3627, 3628, 3629, 3630, 3631, 3633, 3634, 3638, 3640, 3642, 3643, 3644, 3645, 3646, 3647, 3648, 3657, 3659, 3660, 3661, 3662, 3667, 3669, 3671, 3672, 3674, 3676, 3677, 3681, 3682, 3684, 3685, 3690, 3693, 3694, 3702, 3704, 3706, 3707, 3709, 3713, 3715, 3717, 3718, 3719, 3720, 3721, 3725, 3730, 3731, 3738, 3739, 3744, 3749, 3752, 3756, 3757, 3758, 3760, 3764, 3765, 3766, 3772, 3773, 3775, 3777, 3778, 3783, 3785, 3791, 3792, 3793, 3794, 3796, 3798, 3801, 3804, 3806, 3808, 3809, 3817, 3818, 3819, 3820, 3823, 3825, 3828, 3829, 3830, 3831, 3832, 3833, 3837, 3838, 3843, 3844, 3845, 3846, 3847, 3849, 3852, 3858, 3859, 3860, 3867, 3868, 3870, 3871, 3872, 3873, 3876, 3882, 3883, 3884, 3885, 3887, 3889, 3890, 3891, 3892, 3894, 3895, 3897, 3898, 3899, 3902, 3903, 3904, 3907, 3908, 3912, 3917, 3918, 3923, 3924, 3928, 3929, 3933, 3934, 3938, 3940, 3941, 3947, 3950, 3951, 3952, 3954, 3958, 3962, 3964, 3967, 3968, 3969, 3970, 3971, 3972, 3974, 3975, 3978, 3983, 3985, 3988, 3994, 3996, 3997, 3998, 4000, 4007, 4008, 4013, 4014, 4019, 4020, 4021, 4028, 4030, 4033, 4037, 4039, 4040, 4041, 4042, 4043, 4046, 4047, 4048, 4050, 4051, 4052, 4053, 4054, 4056, 4057, 4062, 4066, 4068, 4070, 4072, 4080, 4084, 4088, 4092, 4094, 4096, 4099, 4102, 4105, 4106, 4109, 4110, 4113, 4116, 4122, 4124, 4126, 4128, 4132, 4133, 4135, 4139, 4143, 4144, 4146, 4147, 4148, 4149, 4150, 4151, 4155, 4160, 4161, 4162, 4163, 4164, 4165, 4166, 4167, 4168, 4171, 4175, 4178, 4181, 4185, 4187, 4188, 4189, 4191, 4193, 4195, 4197, 4201, 4202, 4204, 4205, 4206, 4207, 4208, 4210, 4211, 4212, 4215, 4217, 4218, 4219, 4221, 4227, 4228, 4229, 4232, 4233, 4234, 4235, 4237, 4241, 4242, 4244, 4245, 4246, 4250, 4251, 4253, 4257, 4261, 4263, 4266, 4270, 4272, 4275, 4276, 4280, 4281, 4284, 4288, 4290, 4292, 4294, 4296, 4298, 4300, 4301, 4302, 4304, 4305, 4306, 4309, 4312, 4317, 4320, 4321, 4324, 4329, 4330, 4332, 4335, 4337, 4338, 4339, 4341, 4344, 4347, 4356, 4358, 4359, 4360, 4369, 4370, 4375, 4378, 4380, 4383, 4388, 4390, 4391, 4393, 4395, 4396, 4397, 4401, 4402, 4403, 4404, 4405, 4406, 4409, 4410, 4417, 4422, 4423, 4425, 4430, 4432, 4436, 4439, 4440, 4442, 4443, 4446, 4448, 4449, 4450, 4453, 4456, 4458, 4461, 4462, 4463, 4466, 4467, 4468, 4470, 4474, 4475, 4479, 4485, 4490, 4492, 4494, 4497, 4498, 4500, 4502, 4507, 4508, 4509, 4512, 4514, 4515, 4519, 4521, 4522, 4525, 4529, 4531, 4535, 4545, 4548, 4549, 4551, 4554, 4555, 4556, 4557, 4558, 4560, 4562, 4563, 4565, 4566, 4567, 4568, 4575, 4576, 4580, 4582, 4583, 4590, 4591, 4594, 4596, 4597, 4598, 4601, 4606, 4616, 4618, 4623, 4625, 4628, 4630, 4632, 4633, 4635, 4636, 4639, 4641, 4643, 4644, 4645, 4646, 4647, 4650, 4651, 4653, 4654, 4655, 4656, 4657, 4658, 4659, 4664, 4667, 4669, 4671, 4672, 4673, 4674, 4676, 4677, 4680, 4682, 4685, 4691, 4692, 4694, 4696, 4697, 4699, 4700, 4703, 4704, 4705, 4706, 4708, 4710, 4711, 4713, 4719, 4721, 4722, 4723, 4724, 4729, 4730, 4734, 4736, 4737, 4738, 4739, 4740, 4741, 4745, 4746, 4747, 4748, 4749, 4750, 4751, 4753, 4755, 4756, 4761, 4762, 4763, 4766, 4767, 4769, 4770, 4771, 4773, 4775, 4779, 4780, 4784, 4787, 4788, 4789, 4790, 4794, 4795, 4796, 4801, 4803, 4804, 4805, 4806, 4807, 4813, 4814, 4815, 4817, 4818, 4822, 4828, 4829, 4830, 4831, 4834, 4838, 4840, 4841, 4842, 4845, 4851, 4855, 4856, 4857, 4859, 4861, 4862, 4863, 4869, 4874, 4875, 4876, 4880, 4881, 4887, 4889, 4891, 4896, 4897, 4900, 4902, 4904, 4905, 4907, 4909, 4910, 4913, 4914, 4918, 4921, 4922, 4923, 4924, 4926, 4935, 4936, 4938, 4941, 4942, 4943, 4944, 4950, 4954, 4955, 4958, 4959, 4963, 4967, 4969, 4971, 4972, 4974, 4975, 4980, 4985, 4987, 4988, 4993, 4994, 4996, 5000, 5005, 5007, 5010, 5011, 5014, 5015, 5016, 5021, 5026, 5029, 5030, 5034, 5036, 5037, 5038, 5039, 5040, 5042, 5044, 5045, 5046, 5051, 5052, 5054, 5057, 5060, 5067, 5068, 5069, 5072, 5074, 5075, 5076, 5078, 5079, 5082, 5087, 5088, 5089, 5090, 5094, 5100, 5101, 5102, 5106, 5107, 5109, 5111, 5113, 5114, 5116, 5120, 5122, 5123, 5125, 5129, 5131, 5132, 5140, 5143, 5145, 5146, 5147, 5149, 5150, 5151, 5159, 5160, 5164, 5165, 5168, 5170, 5172, 5174, 5180, 5181, 5184, 5185, 5187, 5188, 5189, 5190, 5191, 5192, 5196, 5198, 5200, 5202, 5203, 5206, 5209, 5212, 5213, 5216, 5217, 5219, 5225, 5228, 5229, 5234, 5240, 5241, 5249, 5251, 5253, 5254, 5255, 5256, 5257, 5258, 5260, 5261, 5263, 5267, 5268, 5269, 5273, 5274, 5275, 5276, 5280, 5281, 5282, 5283, 5285, 5286, 5289, 5292, 5293, 5297, 5298, 5299, 5300, 5301, 5308, 5311, 5314, 5317, 5319, 5321, 5324, 5329, 5330, 5333, 5334, 5338, 5339, 5342, 5345, 5346, 5348, 5349, 5350, 5351, 5352, 5363, 5364, 5366, 5367, 5369, 5371, 5386, 5388, 5389, 5391, 5393, 5395, 5396, 5397, 5402, 5405, 5409, 5411, 5413, 5414, 5417, 5418, 5422, 5426, 5427, 5428, 5430, 5431, 5433, 5434, 5437, 5438, 5445, 5446, 5448, 5449, 5452, 5453, 5456, 5458, 5459, 5461, 5463, 5464, 5466, 5471, 5472, 5475, 5483, 5485, 5487, 5488, 5491, 5493, 5495, 5496, 5505, 5506, 5508, 5510, 5512, 5513, 5515, 5517, 5518, 5519, 5524, 5526, 5529, 5530, 5531, 5532, 5534, 5535, 5541, 5543, 5545, 5549, 5554, 5557, 5562, 5563, 5565, 5566, 5568, 5569, 5572, 5575, 5579, 5581, 5582, 5584, 5585, 5586, 5589, 5591, 5593, 5594, 5597, 5602, 5608, 5612, 5613, 5614, 5615, 5616, 5618, 5619, 5620, 5623, 5627, 5632, 5633, 5635, 5638, 5640, 5643, 5647, 5648, 5649, 5650, 5651, 5652, 5653, 5656, 5659, 5660, 5662, 5663, 5664, 5669, 5673, 5675, 5676, 5680, 5681, 5683, 5689, 5690, 5694, 5695, 5697, 5698, 5702, 5706, 5709, 5711, 5714, 5717, 5718, 5719, 5721, 5722, 5723, 5729, 5730, 5731, 5732, 5734, 5735, 5736, 5742, 5744, 5751, 5757, 5768, 5770, 5771, 5773, 5775, 5778, 5780, 5784, 5785, 5788, 5791, 5792, 5794, 5803, 5805, 5807, 5808, 5810, 5811, 5814, 5815, 5816, 5817, 5820, 5826, 5828, 5832, 5833, 5834, 5835, 5836, 5837, 5839, 5842, 5844, 5854, 5856, 5859, 5864, 5866, 5867, 5868, 5869, 5871, 5872, 5876, 5878, 5879, 5881, 5882, 5883, 5884, 5888, 5889, 5892, 5893, 5900, 5901, 5902, 5906, 5907, 5910, 5912, 5918, 5919, 5921, 5922, 5923, 5925, 5926, 5927, 5928, 5930, 5931, 5932, 5933, 5938, 5939, 5940, 5941, 5942, 5944, 5946, 5947, 5948, 5951, 5954, 5956, 5957, 5959, 5961, 5967, 5968, 5971, 5978, 5979, 5980, 5985, 5986, 5988, 5989, 5991, 5994, 5996, 5997, 6000, 6002, 6003, 6004, 6006, 6007, 6010, 6012, 6013, 6016, 6017, 6021, 6023, 6025, 6026, 6033, 6038, 6040, 6041, 6042, 6044, 6047, 6048, 6051, 6053, 6054, 6058, 6059, 6060, 6061, 6062, 6063, 6065, 6068, 6069, 6070, 6072, 6073, 6074, 6075, 6077, 6080, 6083, 6085, 6087, 6088, 6089, 6091, 6092, 6093, 6094, 6095, 6097, 6098, 6107, 6108, 6109, 6112, 6113, 6116, 6118, 6119, 6120, 6122, 6129, 6130, 6131, 6132, 6133, 6135, 6136, 6137, 6143, 6145, 6146, 6147, 6149, 6151, 6152, 6153, 6156, 6158, 6160, 6163, 6164, 6165, 6168, 6173, 6176, 6181, 6182, 6183, 6186, 6188, 6189, 6190, 6191, 6193, 6197, 6198, 6200, 6205, 6207, 6209, 6212, 6213, 6215, 6220, 6221, 6223, 6224, 6226, 6227, 6228, 6230, 6231, 6233, 6234, 6237, 6238, 6239, 6240, 6243, 6245, 6246, 6247, 6249, 6250, 6251, 6255, 6257, 6258, 6259, 6260, 6264, 6265, 6269, 6270, 6271, 6272, 6273, 6275, 6278, 6279, 6280, 6282, 6283, 6284, 6285, 6286, 6288, 6292, 6294, 6295, 6296, 6299, 6302, 6303, 6308, 6309, 6310, 6311, 6312, 6314, 6315, 6317, 6319, 6321, 6322, 6323, 6325, 6328, 6333, 6338, 6346, 6351, 6352, 6353, 6354, 6356, 6359, 6360, 6362, 6363, 6367, 6370, 6372, 6373, 6375, 6376, 6378, 6379, 6381, 6383, 6386, 6394, 6395, 6396, 6397, 6398, 6399, 6403, 6405, 6407, 6408, 6410, 6412, 6413, 6414, 6415, 6419, 6420, 6422, 6425, 6426, 6427, 6428, 6429, 6430, 6431, 6434, 6436, 6440, 6442, 6452, 6454, 6458, 6459, 6463, 6464, 6466, 6467, 6468, 6469, 6470, 6471, 6474, 6476, 6480, 6482, 6484, 6488, 6492, 6495, 6497, 6500, 6501, 6502, 6503, 6504, 6505, 6510, 6513, 6514, 6515, 6516, 6517, 6519, 6524, 6525, 6526, 6530, 6532, 6533, 6534, 6535, 6537, 6539, 6543, 6544, 6545, 6547, 6548, 6549, 6553, 6554, 6555, 6558, 6560, 6561, 6563, 6564, 6567, 6569, 6572, 6574, 6576, 6577, 6579, 6581, 6582, 6584, 6587, 6588, 6589, 6595, 6597, 6599, 6600, 6607, 6609, 6611, 6614, 6620, 6621, 6622, 6624, 6626, 6628, 6629, 6630, 6634, 6635, 6637, 6639, 6643, 6644, 6646, 6647, 6649, 6650, 6652, 6654, 6655, 6658, 6662, 6666, 6671, 6672, 6673, 6677, 6686, 6689, 6691, 6692, 6693, 6695, 6696, 6702, 6703, 6705, 6706, 6711, 6714, 6716, 6718, 6720, 6724, 6725, 6729, 6731, 6734, 6736, 6737, 6739, 6746, 6747, 6748, 6752, 6756, 6757, 6758, 6759, 6761, 6764, 6766, 6778, 6779, 6780, 6786, 6788, 6793, 6795, 6797, 6799, 6803, 6804, 6805, 6807, 6810, 6811, 6812, 6813, 6816, 6819, 6820, 6821, 6824, 6827, 6828, 6830, 6831, 6834, 6836, 6837, 6839, 6840, 6841, 6842, 6843, 6845, 6851, 6859, 6863, 6864, 6869, 6872, 6874, 6875, 6876, 6878, 6879, 6880, 6884, 6888, 6890, 6895, 6903, 6904, 6906, 6907, 6914, 6915, 6917, 6919, 6920, 6921, 6923, 6924, 6930, 6932, 6933, 6936, 6941, 6944, 6946, 6948, 6950, 6951, 6952, 6959, 6960, 6961, 6963, 6966, 6967, 6969, 6970, 6979, 6980, 6984, 6985, 6987, 6988, 6990, 6991, 6993, 6994, 6995, 6999, 7002, 7003, 7005, 7006, 7009, 7011, 7012, 7013, 7015, 7022, 7032, 7038, 7039, 7042, 7043, 7045, 7046, 7048, 7049, 7051, 7052, 7053, 7056, 7057, 7064, 7067, 7068, 7072, 7074, 7075, 7077, 7079, 7083, 7084, 7085, 7086, 7094, 7097, 7105, 7106, 7107, 7108, 7112, 7113, 7116, 7117, 7118, 7119, 7124, 7126, 7129, 7130, 7132, 7135, 7138, 7139, 7140, 7142, 7144, 7146, 7149, 7151, 7155, 7163, 7164, 7165, 7166, 7169, 7173, 7176, 7177, 7182, 7184, 7187, 7188, 7192, 7194, 7196, 7197, 7201, 7202, 7203, 7206, 7207, 7208, 7209, 7212, 7216, 7217, 7219, 7227, 7228, 7230, 7231, 7232, 7233, 7234, 7235, 7236, 7239, 7241, 7243, 7244, 7245, 7248, 7255, 7257, 7258, 7259, 7267, 7268, 7270, 7274, 7276, 7277, 7278, 7281, 7282, 7284, 7287, 7288, 7290, 7291, 7292, 7293, 7298, 7299, 7300, 7301, 7303, 7304, 7305, 7306, 7307, 7308, 7310, 7313, 7315, 7328, 7330, 7334, 7336, 7339, 7340, 7343, 7344, 7348, 7350, 7351, 7354, 7355, 7357, 7358, 7360, 7363, 7365, 7371, 7373, 7379, 7380, 7381, 7382, 7383, 7386, 7388, 7389, 7392, 7398, 7400, 7406, 7409, 7410, 7411, 7415, 7417, 7418, 7425, 7428, 7430, 7431, 7433, 7434, 7435, 7436, 7441, 7443, 7444, 7446, 7447, 7448, 7452, 7454, 7458, 7459, 7464, 7466, 7470, 7479, 7483, 7486, 7490, 7492, 7498, 7502, 7504, 7505, 7506, 7512, 7514, 7515, 7517, 7523, 7524, 7525, 7528, 7529, 7533, 7534, 7538, 7542, 7546, 7547, 7548, 7554, 7556, 7560, 7561, 7570, 7574, 7577, 7578, 7579, 7580, 7585, 7586, 7587, 7589, 7590, 7591, 7593, 7594, 7598, 7605, 7607, 7611, 7613, 7618, 7619, 7620, 7621, 7623, 7624, 7633, 7634, 7638, 7639, 7640, 7642, 7643, 7647, 7652, 7656, 7658, 7661, 7663, 7664, 7665, 7666, 7667, 7669, 7674, 7676, 7677, 7678, 7679, 7680, 7682, 7685, 7687, 7689, 7695, 7699, 7700, 7703, 7704, 7712, 7716, 7717, 7718, 7719, 7724, 7725, 7729, 7730, 7733, 7736, 7737, 7738, 7740, 7742, 7743, 7744, 7745, 7747, 7748, 7749, 7751, 7753, 7755, 7761, 7762, 7763, 7764, 7767, 7768, 7769, 7770, 7772, 7774, 7775, 7777, 7778, 7779, 7780, 7781, 7782, 7785, 7786, 7788, 7791, 7792, 7793, 7794, 7798, 7800, 7803, 7804, 7806, 7807, 7812, 7815, 7818, 7819, 7820, 7823, 7824, 7825, 7832, 7833, 7834, 7838, 7841, 7844, 7847, 7848, 7849, 7850, 7852, 7856, 7859, 7860, 7862, 7863, 7865, 7873, 7876, 7878, 7880, 7888, 7890, 7896, 7900, 7908, 7909, 7910, 7911, 7913, 7917, 7918, 7920, 7921, 7923, 7925, 7929, 7933, 7934, 7935, 7936, 7937, 7938, 7942, 7944, 7945, 7946, 7947, 7948, 7949, 7950, 7952, 7955, 7956, 7962, 7964, 7972, 7974, 7976, 7977, 7978, 7980, 7981, 7983, 7984, 7986, 7988, 7989, 7990, 7991, 7993, 7998, 8002, 8004, 8005, 8006, 8007, 8008, 8012, 8021, 8026, 8029, 8030, 8035, 8039, 8041, 8042, 8043, 8044, 8047, 8048, 8052, 8053, 8056, 8058, 8059, 8062, 8063, 8064, 8065, 8067, 8068, 8071, 8072, 8075, 8076, 8077, 8078, 8079, 8080, 8082, 8084, 8088, 8091, 8093, 8095, 8096, 8100, 8102, 8103, 8105, 8106, 8112, 8116, 8118, 8120, 8121, 8123, 8124, 8126, 8130, 8136, 8137, 8145, 8146, 8147, 8148, 8150, 8151, 8155, 8159, 8163, 8164, 8165, 8166, 8168, 8170, 8176, 8178, 8179, 8181, 8182, 8185, 8189, 8192, 8193, 8195, 8199, 8202, 8204, 8207, 8208, 8210, 8211, 8213, 8216, 8219, 8220, 8222, 8223, 8225, 8227, 8234, 8235, 8236, 8237, 8239, 8240, 8241, 8242, 8245, 8250, 8252, 8253, 8257, 8258, 8265, 8266, 8268, 8269, 8270, 8272, 8274, 8282, 8288, 8289, 8291, 8292, 8293, 8294, 8300, 8301, 8304, 8310, 8311, 8312, 8318, 8319, 8320, 8321, 8324, 8329, 8331, 8339, 8340, 8349, 8350, 8352, 8353, 8355, 8361, 8363, 8367, 8368, 8369, 8373, 8378, 8379, 8385, 8386, 8387, 8389, 8392, 8393, 8395, 8398, 8401, 8402, 8403, 8404, 8405, 8407, 8410, 8413, 8414, 8416, 8417, 8418, 8423, 8427, 8430, 8433, 8436, 8438, 8439, 8441, 8442, 8444, 8446, 8447, 8448, 8449, 8450, 8451, 8452, 8457, 8458, 8459, 8465, 8466, 8469, 8470, 8472, 8473, 8474, 8476, 8477, 8480, 8481, 8482, 8485, 8486, 8490, 8493, 8494, 8498, 8501, 8502, 8505, 8509, 8511, 8513, 8515, 8516, 8517, 8520, 8523, 8524, 8525, 8527, 8528, 8531, 8532, 8533, 8535, 8537, 8538, 8539, 8542, 8549, 8550, 8552, 8553, 8554, 8557, 8558, 8561, 8562, 8565, 8566, 8568, 8575, 8576, 8579, 8581, 8582, 8584, 8589, 8590, 8592, 8593, 8594, 8596, 8597, 8598, 8599, 8600, 8601, 8602, 8603, 8605, 8609, 8611, 8612, 8613, 8614, 8617, 8624, 8628, 8630, 8631, 8634, 8637, 8638, 8639, 8640, 8641, 8642, 8644, 8647, 8648, 8650, 8654, 8657, 8658, 8659, 8660, 8663, 8665, 8669, 8670, 8672, 8673, 8674, 8676, 8677, 8685, 8693, 8694, 8699, 8700, 8703, 8704, 8706, 8708, 8709, 8713, 8716, 8717, 8719, 8720, 8726, 8728, 8729, 8731, 8732, 8734, 8735, 8736, 8740, 8741, 8742, 8744, 8745, 8746, 8748, 8751, 8752, 8753, 8757, 8758, 8761, 8764, 8767, 8770, 8772, 8773, 8774, 8775, 8777, 8779, 8782, 8783, 8784, 8785, 8789, 8792, 8796, 8797, 8803, 8805, 8810, 8818, 8821, 8822, 8824, 8829, 8831, 8832, 8834, 8835, 8838, 8841, 8843, 8846, 8853, 8861, 8865, 8866, 8867, 8876, 8878, 8881, 8883, 8886, 8888, 8889, 8891, 8892, 8896, 8899, 8900, 8902, 8905, 8907, 8908, 8909, 8910, 8911, 8913, 8914, 8916, 8917, 8922, 8926, 8929, 8930, 8935, 8938, 8941, 8942, 8945, 8946, 8949, 8951, 8956, 8957, 8959, 8960, 8961, 8963, 8967, 8968, 8969, 8972, 8974, 8976, 8977, 8979, 8980, 8981, 8985, 8986, 8991, 8992, 8996, 8998, 8999, 9000, 9001, 9002, 9003, 9006, 9009, 9012, 9015, 9020, 9023, 9029, 9030, 9033, 9037, 9044, 9047, 9052, 9056, 9057, 9058, 9059, 9060, 9061, 9062, 9069, 9071, 9072, 9073, 9074, 9076, 9080, 9084, 9088, 9091, 9092, 9095, 9096, 9097, 9103, 9105, 9108, 9110, 9111, 9112, 9114, 9116, 9118, 9119, 9123, 9124, 9125, 9129, 9131, 9133, 9134, 9138, 9139, 9140, 9141, 9142, 9146, 9149, 9151, 9152, 9154, 9155, 9173, 9174, 9175, 9177, 9183, 9185, 9187, 9188, 9190, 9191, 9195, 9205, 9206, 9207, 9210, 9211, 9213, 9214, 9215, 9216, 9218, 9226, 9229, 9232, 9233, 9237, 9241, 9243, 9244, 9247, 9248, 9249, 9252, 9253, 9254, 9255, 9257, 9262, 9263, 9265, 9267, 9269, 9270, 9273, 9275, 9276, 9278, 9284, 9285, 9287, 9288, 9290, 9292, 9293, 9298, 9299, 9300, 9302, 9304, 9308, 9311, 9313, 9320, 9321, 9323, 9325, 9326, 9327, 9328, 9329, 9330, 9332, 9336, 9337, 9338, 9339, 9340, 9341, 9345, 9346, 9347, 9348, 9354, 9355, 9357, 9359, 9366, 9367, 9372, 9373, 9375, 9376, 9378, 9382, 9383, 9388, 9391, 9392, 9393, 9394, 9396, 9398, 9400, 9402, 9403, 9404, 9406, 9407, 9413, 9414, 9415, 9423, 9425, 9432, 9433, 9434, 9440, 9442, 9443, 9444, 9451, 9452, 9453, 9456, 9460, 9466, 9468, 9471, 9472, 9473, 9478, 9483, 9486, 9488, 9490, 9497, 9500, 9501, 9502, 9503, 9504, 9505, 9509, 9514, 9515, 9517, 9518, 9519, 9520, 9522, 9525, 9531, 9533, 9534, 9536, 9540, 9543, 9545, 9546, 9548, 9553, 9555, 9557, 9563, 9564, 9565, 9568, 9571, 9575, 9577, 9582, 9583, 9586, 9587, 9589, 9590, 9591, 9606, 9607, 9609, 9610, 9613, 9614, 9615, 9620, 9623, 9626, 9627, 9628, 9629, 9632, 9633, 9635, 9640, 9641, 9642, 9644, 9645, 9646, 9648, 9649, 9650, 9652, 9653, 9655, 9656, 9657, 9658, 9659, 9660, 9663, 9666, 9668, 9670, 9675, 9681, 9682, 9686, 9687, 9692, 9693, 9695, 9698, 9706, 9718, 9722, 9723, 9726, 9729, 9730, 9731, 9733, 9734, 9737, 9744, 9745, 9746, 9750, 9751, 9753, 9754, 9755, 9756, 9763, 9764, 9767, 9768, 9770, 9774, 9776, 9780, 9781, 9782, 9784, 9786, 9791, 9792, 9793, 9794, 9796, 9799, 9801, 9804, 9806, 9808, 9809, 9812, 9813, 9816, 9819, 9820, 9824, 9825, 9827, 9830, 9833, 9835, 9836, 9845, 9846, 9847, 9849, 9850, 9851, 9853, 9854, 9861, 9864, 9866, 9869, 9873, 9882, 9886, 9887, 9892, 9897, 9900, 9901, 9906, 9907, 9908, 9909, 9910, 9911, 9912, 9917, 9918, 9921, 9923, 9924, 9928, 9935, 9938, 9940, 9946, 9949, 9950, 9953, 9955, 9957, 9958, 9960, 9962, 9963, 9964, 9967, 9968, 9971, 9972, 9974, 9975, 9979, 9980, 9982, 9984, 9985, 9987, 9988, 9990, 9991, 9996, 9997, 9998, 10000, 10008, 10009, 10010, 10012, 10013, 10017, 10018, 10019, 10021, 10022, 10026, 10027, 10031, 10032, 10033, 10034, 10035, 10037, 10038, 10040, 10041, 10043, 10045, 10048, 10051, 10052, 10054, 10056, 10058, 10059, 10060, 10062, 10063, 10064, 10066, 10068, 10072, 10073, 10075, 10076, 10077, 10078, 10082, 10083, 10089, 10091, 10092, 10095, 10097, 10101, 10102, 10103, 10105, 10106, 10107, 10108, 10109, 10110, 10114, 10115, 10116, 10117, 10118, 10119, 10122, 10127, 10128, 10131, 10132, 10136, 10138, 10141, 10143, 10146, 10149, 10151, 10152, 10158, 10162, 10163, 10165, 10166, 10168, 10170, 10174, 10176, 10178, 10181, 10182, 10191, 10192, 10193, 10194, 10195, 10196, 10197, 10199, 10203, 10206, 10209, 10212, 10214, 10218, 10219, 10220, 10222, 10223, 10224, 10225, 10228, 10231, 10232, 10233, 10236, 10237, 10239, 10247, 10252, 10253, 10254, 10255, 10258, 10259, 10262, 10270, 10275, 10284, 10291, 10292, 10293, 10295, 10300, 10302, 10306, 10307, 10311, 10319, 10321, 10322, 10323, 10325, 10326, 10328, 10330, 10331, 10333, 10334, 10335, 10336, 10338, 10343, 10351, 10352, 10353, 10356, 10357, 10359, 10360, 10362, 10364, 10365, 10368, 10369, 10371, 10373, 10375, 10378, 10380, 10381, 10383, 10384, 10385, 10388, 10389, 10395, 10397, 10398, 10399, 10400, 10401, 10405, 10410, 10413, 10414, 10416, 10421, 10423, 10426, 10429, 10430, 10435, 10437, 10438, 10440, 10442, 10443, 10446, 10447, 10448, 10449, 10450, 10451, 10453, 10455, 10456, 10463, 10464, 10465, 10468, 10469, 10470, 10472, 10473, 10474, 10478, 10480, 10482, 10487, 10488, 10490, 10492, 10494, 10496, 10504, 10506, 10508, 10512, 10513, 10514, 10516, 10518, 10525, 10527, 10528, 10530, 10531, 10533, 10535, 10536, 10537, 10541, 10542, 10543, 10544, 10547, 10548, 10555, 10556, 10558, 10560, 10561, 10562, 10564, 10565, 10567, 10569, 10573, 10577, 10580, 10581, 10582, 10583, 10584, 10585, 10590, 10593, 10596, 10597, 10599, 10601, 10602, 10606, 10610, 10611, 10614, 10615, 10616, 10617, 10621, 10622, 10623, 10625, 10626, 10628, 10629, 10630, 10631, 10633, 10634, 10636, 10637, 10638, 10639, 10640, 10641, 10642, 10645, 10646, 10649, 10650, 10655, 10657, 10659, 10663, 10665, 10666, 10668, 10670, 10674, 10676, 10677, 10678, 10681, 10682, 10683, 10684, 10685, 10687, 10689, 10693, 10697, 10698, 10699, 10700, 10702, 10703, 10705, 10707, 10708, 10711, 10715, 10716, 10721, 10722, 10723, 10725, 10726, 10732, 10734, 10735, 10737, 10738, 10740, 10741, 10744, 10745, 10748, 10749, 10752, 10753, 10756, 10761, 10762, 10763, 10766, 10770, 10774, 10775, 10776, 10777, 10778, 10779, 10782, 10784, 10785, 10787, 10788, 10790, 10791, 10792, 10795, 10796, 10798, 10800, 10801, 10802, 10803, 10804, 10805, 10809, 10810, 10811, 10812, 10815, 10818, 10819, 10820, 10821, 10823, 10824, 10825, 10826, 10831, 10833, 10836, 10838, 10839, 10840, 10841, 10843, 10845, 10846, 10847, 10850, 10852, 10853, 10854, 10857, 10858, 10860, 10861, 10862, 10866, 10867, 10872, 10874, 10877, 10880, 10881, 10887, 10892, 10896, 10897, 10898, 10899, 10902, 10905, 10912, 10915, 10917, 10920, 10926, 10927, 10928, 10930, 10933, 10934, 10935, 10936, 10937, 10938, 10940, 10941, 10944, 10947, 10948, 10950, 10954, 10957, 10960, 10962, 10963, 10965, 10966, 10967, 10970, 10972, 10973, 10975, 10976, 10977, 10979, 10980, 10981, 10988, 10993, 10995, 10996, 10997, 10999, 11002, 11004, 11005, 11006, 11008, 11010, 11015, 11018, 11024, 11026, 11027, 11032, 11033, 11039, 11046, 11047, 11052, 11053, 11056, 11058, 11060, 11066, 11068, 11070, 11071, 11078, 11079, 11082, 11083, 11086, 11090, 11095, 11098, 11101, 11102, 11107, 11110, 11114, 11116, 11118, 11123, 11124, 11125, 11127, 11129, 11132, 11133, 11135, 11137, 11138, 11145, 11146, 11148, 11152, 11153, 11154, 11158, 11159, 11160, 11161, 11162, 11163, 11165, 11166, 11168, 11169, 11173, 11175, 11177, 11178, 11179, 11180, 11181, 11184, 11185, 11187, 11188, 11190, 11191, 11192, 11194, 11198, 11199, 11201, 11202, 11203, 11204, 11207, 11210, 11214, 11216, 11217, 11218, 11222, 11226, 11227, 11228, 11229, 11230, 11232, 11233, 11234, 11235, 11236, 11237, 11238, 11239, 11244, 11246, 11247, 11248, 11251, 11253, 11254, 11255, 11256, 11257, 11258, 11259, 11260, 11262, 11263, 11264, 11266, 11274, 11275, 11278, 11286, 11288, 11289, 11290, 11291, 11292, 11293, 11294, 11295, 11298, 11302, 11305, 11306, 11307, 11313, 11315, 11316, 11319, 11320, 11322, 11324, 11326, 11329, 11330, 11331, 11332, 11337, 11338, 11339, 11340, 11345, 11346, 11348, 11349, 11352, 11356, 11358, 11363, 11364, 11365, 11366, 11370, 11371, 11373, 11374, 11377, 11380, 11381, 11382, 11387, 11388, 11389, 11391, 11392, 11394, 11395, 11401, 11403, 11405, 11406, 11409, 11411, 11412, 11413, 11414, 11416, 11418, 11420, 11423, 11424, 11426, 11428, 11430, 11431, 11434, 11437, 11438, 11439, 11440, 11445, 11446, 11448, 11449, 11451, 11459, 11461, 11463, 11465, 11466, 11467, 11471, 11472, 11475, 11476, 11477, 11478, 11481, 11482, 11485, 11487, 11489, 11490, 11494, 11496, 11497, 11498, 11499, 11500, 11501, 11506, 11507, 11508, 11509, 11512, 11513, 11516, 11518, 11520, 11523, 11524, 11526, 11527, 11528, 11530, 11531, 11532, 11533, 11534, 11538, 11541, 11544, 11546, 11547, 11548, 11551, 11553, 11558, 11560, 11561, 11567, 11568, 11570, 11571, 11576, 11577, 11578, 11579, 11580, 11583, 11585, 11586, 11593, 11594, 11595, 11596, 11597, 11599, 11604, 11612, 11615, 11618, 11619, 11621, 11623, 11625, 11628, 11629, 11632, 11633, 11636, 11639, 11642, 11649, 11650, 11652, 11656, 11657, 11658, 11663, 11664, 11668, 11669, 11673, 11677, 11678, 11680, 11681, 11682, 11683, 11688, 11689, 11691, 11692, 11694, 11695, 11699, 11701, 11703, 11705, 11707, 11711, 11712, 11718, 11720, 11721, 11722, 11725, 11731, 11733, 11736, 11740, 11741, 11743, 11744, 11753, 11755, 11756, 11759, 11760, 11761, 11762, 11763, 11764, 11765, 11766, 11767, 11770, 11771, 11774, 11776, 11780, 11781, 11782, 11783, 11784, 11785, 11786, 11790, 11792, 11795, 11799, 11800, 11809, 11811, 11812, 11813, 11814, 11816, 11818, 11819, 11820, 11821, 11826, 11828, 11830, 11837, 11838, 11841, 11846, 11848, 11849, 11850, 11851, 11853, 11856, 11858, 11861, 11863, 11868, 11870, 11872, 11876, 11877, 11878, 11881, 11889, 11890, 11891, 11894, 11898, 11903, 11909, 11911, 11913, 11916, 11917, 11918, 11919, 11920, 11921, 11923, 11926, 11927, 11928, 11929, 11930, 11934, 11935, 11940, 11941, 11943, 11945, 11946, 11947, 11948, 11949, 11953, 11955, 11957, 11958, 11959, 11960, 11961, 11962, 11963, 11965, 11966, 11968, 11974, 11977, 11978, 11979, 11980, 11983, 11988, 11993, 11994, 11995, 11996, 11997, 11998, 11999, 12002, 12004, 12006, 12008, 12017, 12019, 12020, 12021, 12023, 12024, 12025, 12029, 12032, 12042, 12043, 12044, 12047, 12050, 12054, 12059, 12060, 12061, 12063, 12064, 12068, 12076, 12078, 12079, 12080, 12081, 12082, 12083, 12085, 12086, 12087, 12091, 12092, 12093, 12097, 12098, 12102, 12104, 12106, 12109, 12112, 12114, 12115, 12118, 12120, 12122, 12126, 12128, 12129, 12130, 12131, 12134, 12135, 12136, 12137, 12138, 12139, 12143, 12144, 12145, 12146, 12147, 12148, 12149, 12151, 12153, 12161, 12162, 12165, 12166, 12167, 12170, 12171, 12174, 12175, 12176, 12179, 12181, 12186, 12197, 12202, 12204, 12208, 12212, 12214, 12215, 12217, 12223, 12233, 12234, 12237, 12240, 12241, 12243, 12245, 12249, 12250, 12252, 12254, 12255, 12256, 12259, 12268, 12269, 12271, 12278, 12280, 12281, 12283, 12285, 12286, 12287, 12288, 12295, 12296, 12302, 12304, 12310, 12311, 12312, 12313, 12314, 12315, 12317, 12319, 12321, 12323, 12325, 12328, 12331, 12333, 12334, 12337, 12339, 12342, 12345, 12347, 12350, 12354, 12356, 12358, 12359, 12364, 12366, 12370, 12375, 12376, 12379, 12380, 12381, 12383, 12385, 12390, 12393, 12394, 12397, 12400, 12401, 12403, 12404, 12406, 12410, 12411, 12414, 12415, 12416, 12417, 12419, 12420, 12423, 12424, 12426, 12427, 12437, 12440, 12444, 12445, 12450, 12451, 12455, 12456, 12457, 12459, 12461, 12462, 12465, 12467, 12468, 12470, 12472, 12473, 12475, 12478, 12480, 12481, 12483, 12485, 12486, 12487, 12488, 12492, 12495, 12497, 12499, 12501, 12502, 12503, 12505, 12508, 12512, 12513, 12514, 12515, 12518, 12519, 12530, 12531, 12535, 12536, 12537, 12538, 12539, 12540, 12546, 12547, 12548, 12549, 12551, 12552, 12554, 12555, 12556, 12557, 12561, 12562, 12563, 12565, 12567, 12568, 12570, 12572, 12574, 12577, 12578, 12580, 12583, 12584, 12585, 12586, 12588, 12591, 12600, 12603, 12605, 12606, 12608, 12609, 12610, 12611, 12616, 12622, 12623, 12626, 12628, 12629, 12631, 12633, 12634, 12638, 12639, 12640, 12641, 12644, 12648, 12649, 12650, 12651, 12652, 12653, 12654, 12655, 12663, 12664, 12668, 12670, 12671, 12674, 12679, 12680, 12681, 12683, 12684, 12685, 12688, 12689, 12691, 12693, 12695, 12696, 12697, 12699, 12701, 12702, 12707, 12708, 12713, 12714, 12723, 12726, 12731, 12732, 12733, 12735, 12738, 12739, 12740, 12741, 12742, 12743, 12751, 12752, 12753, 12754, 12755, 12757, 12758, 12760, 12761, 12762, 12764, 12765, 12766, 12771, 12772, 12773, 12775, 12777, 12782, 12785, 12790, 12794, 12797, 12800, 12802, 12803, 12807, 12808, 12810, 12812, 12813, 12817, 12818, 12820, 12822, 12823, 12824, 12826, 12827, 12828, 12834, 12835, 12836, 12837, 12838, 12839, 12843, 12844, 12848, 12849, 12850, 12853, 12861, 12866, 12870, 12873, 12875, 12878, 12882, 12883, 12884, 12887, 12888, 12891, 12898, 12899, 12900, 12901, 12902, 12903, 12904, 12905, 12906, 12908, 12910, 12912, 12913, 12916, 12920, 12921, 12923, 12928, 12929, 12932, 12933, 12934, 12935, 12940, 12942, 12945, 12946, 12947, 12953, 12956, 12958, 12959, 12960, 12963, 12967, 12968, 12969, 12972, 12973, 12978, 12983, 12984, 12986, 12987, 12988, 12990, 12991, 12999, 13001, 13003, 13004, 13007, 13010, 13014, 13015, 13017, 13018, 13022, 13027, 13030, 13031, 13032, 13033, 13034, 13035, 13037, 13038, 13040, 13041, 13047, 13049, 13050, 13053, 13054, 13055, 13056, 13061, 13062, 13064, 13066, 13071, 13075, 13077, 13079, 13083, 13085, 13086, 13087, 13099, 13101, 13102, 13105, 13106, 13110, 13111, 13112, 13114, 13115, 13116, 13117, 13118, 13120, 13121, 13122, 13123, 13124, 13125, 13128, 13131, 13134, 13135, 13136, 13142, 13144, 13147, 13148, 13149, 13151, 13154, 13159, 13160, 13166, 13175, 13181, 13182, 13186, 13188, 13190, 13197, 13199, 13203, 13205, 13206, 13209, 13212, 13213, 13215, 13217, 13220, 13221, 13224, 13226, 13227, 13228, 13232, 13234, 13235, 13236, 13237, 13239, 13241, 13243, 13248, 13250, 13251, 13255, 13256, 13259, 13260, 13261, 13262, 13263, 13264, 13265, 13267, 13268, 13269, 13271, 13274, 13280, 13281, 13283, 13284, 13295, 13296, 13297, 13298, 13300, 13301, 13303, 13304, 13313, 13315, 13317, 13323, 13325, 13328, 13329, 13330, 13332, 13335, 13337, 13340, 13343, 13344, 13345, 13346, 13347, 13348, 13350, 13352, 13353, 13358, 13361, 13363, 13365, 13367, 13368, 13369, 13374, 13377, 13380, 13381, 13384, 13385, 13386, 13388, 13393, 13394, 13395, 13396, 13397, 13398, 13402, 13403, 13404, 13407, 13408, 13410, 13413, 13416, 13417, 13419, 13423, 13424, 13429, 13430, 13433, 13434, 13439, 13441, 13448, 13450, 13451, 13456, 13457, 13461, 13463, 13467, 13469, 13473, 13475, 13477, 13478, 13479, 13480, 13484, 13489, 13492, 13494, 13496, 13499, 13503, 13512, 13513, 13514, 13515, 13519, 13521, 13522, 13526, 13529, 13532, 13533, 13539, 13540, 13543, 13544, 13546, 13547, 13549, 13552, 13553, 13555, 13556, 13558, 13559, 13560, 13561, 13568, 13569, 13574, 13577, 13578, 13579, 13580, 13584, 13586, 13587, 13589, 13597, 13599, 13600, 13601, 13602, 13604, 13605, 13606, 13611, 13612, 13613, 13614, 13621, 13623, 13627, 13628, 13630, 13631, 13632, 13634, 13636, 13637, 13638, 13641, 13643, 13647, 13650, 13651, 13652, 13653, 13654, 13662, 13663, 13665, 13668, 13675, 13677, 13678, 13679, 13683, 13684, 13687, 13688, 13693, 13697, 13698, 13699, 13700, 13702, 13706, 13710, 13713, 13714, 13715, 13716, 13719, 13720, 13722, 13727, 13729, 13730, 13734, 13736, 13739, 13742, 13745, 13747, 13750, 13753, 13755, 13756, 13764, 13767, 13768, 13772, 13773, 13774, 13775, 13777, 13779, 13780, 13782, 13783, 13786, 13787, 13791, 13793, 13794, 13796, 13798, 13799, 13809, 13816, 13817, 13818, 13819, 13822, 13823, 13828, 13830, 13831, 13834, 13835, 13843, 13848, 13849, 13852, 13858, 13859, 13860, 13862, 13867, 13869, 13870, 13872, 13873, 13875, 13877, 13879, 13880, 13885, 13887, 13888, 13891, 13892, 13895, 13897, 13898, 13899, 13901, 13906, 13908, 13909, 13910, 13911, 13917, 13918, 13919, 13920, 13924, 13925, 13927, 13929, 13934, 13944, 13947, 13948, 13949, 13950, 13953, 13954, 13958, 13960, 13961, 13963, 13969, 13970, 13975, 13983, 13984, 13985, 13986, 13987, 13990, 13991, 13999, 14000, 14001, 14005, 14006, 14009, 14010, 14013, 14014, 14018, 14022, 14027, 14030, 14031, 14036, 14038, 14040, 14043, 14049, 14051, 14052, 14059, 14062, 14063, 14066, 14067, 14069, 14070, 14071, 14072, 14073, 14074, 14075, 14076, 14078, 14080, 14081, 14085, 14086, 14087, 14088, 14092, 14094, 14096, 14105, 14106, 14111, 14112, 14115, 14116, 14118, 14119, 14121, 14122, 14124, 14129, 14130, 14132, 14133, 14135, 14138, 14139, 14141, 14142, 14145, 14146, 14147.

Promoters expressing in the Stage 2 regenerating, greening callus grown in the light include SEQ IDs: 1, 3, 4, 7, 9, 12, 13, 14, 15, 16, 17, 19, 24, 27, 29, 31, 32, 33, 36, 37, 44, 48, 54, 57, 63, 64, 65, 73, 79, 80, 88, 90, 93, 94, 96, 98, 99, 102, 103, 104, 110, 111, 112, 115, 117, 121, 123, 128, 130, 131, 132, 135, 137, 141, 143, 148, 152, 154, 156, 157, 159, 162, 165, 168, 172, 174, 175, 176, 179, 180, 183, 187, 191, 193, 194, 196, 197, 199, 202, 203, 204, 205, 207, 211, 212, 214, 223, 230, 232, 233, 235, 236, 237, 239, 240, 242, 244, 246, 249, 250, 251, 256, 257, 259, 262, 264, 267, 269, 270, 271, 273, 280, 281, 286, 288, 289, 293, 294, 299, 301, 302, 305, 306, 308, 309, 316, 319, 320, 322, 323, 328, 329, 332, 334, 335, 338, 340, 346, 348, 349, 352, 353, 354, 355, 356, 357, 358, 360, 365, 372, 373, 374, 378, 379, 381, 388, 396, 401, 411, 412, 414, 423, 424, 428, 431, 432, 433, 434, 436, 441, 448, 450, 452, 456, 461, 462, 463, 466, 468, 470, 471, 474, 478, 479, 483, 485, 488, 489, 492, 496, 498, 501, 504, 507, 509, 510, 511, 514, 516, 517, 522, 523, 525, 532, 534, 537, 538, 541, 543, 544, 546, 547, 548, 553, 554, 557, 561, 569, 578, 580, 582, 585, 591, 594, 595, 596, 599, 601, 602, 605, 606, 607, 613, 619, 620, 631, 633, 634, 635, 636, 637, 638, 642, 643, 647, 650, 655, 656, 661, 663, 664, 669, 670, 671, 681, 683, 687, 692, 693, 694, 695, 701, 702, 705, 706, 709, 716, 717, 718, 719, 722, 723, 724, 727, 731, 732, 733, 734, 735, 736, 739, 740, 742, 744, 749, 752, 753, 757, 758, 759, 760, 761, 762, 763, 764, 765, 771, 779, 782, 783, 784, 785, 786, 792, 800, 804, 806, 808, 809, 811, 812, 819, 820, 821, 822, 824, 825, 826, 827, 829, 830, 833, 840, 841, 845, 846, 849, 855, 856, 857, 858, 860, 862, 863, 865, 870, 871, 872, 875, 876, 877, 887, 890, 891, 892, 893, 895, 897, 898, 899, 900, 903, 907, 908, 910, 911, 912, 913, 915, 916, 917, 919, 920, 924, 928, 932, 934, 936, 938, 939, 943, 944, 947, 951, 953, 955, 957, 958, 960, 964, 971, 974, 975, 976, 977, 978, 979, 980, 981, 982, 984, 985, 987, 988, 991, 993, 994, 995, 996, 997, 999, 1003, 1005, 1006, 1007, 1008, 1009, 1010, 1011, 1012, 1013, 1014, 1016, 1017, 1022, 1025, 1026, 1032, 1033, 1035, 1038, 1039, 1040, 1041, 1042, 1043, 1046, 1047, 1049, 1051, 1052, 1054, 1055, 1056, 1057, 1064, 1065, 1067, 1068, 1069, 1070, 1073, 1074, 1076, 1077, 1080, 1085, 1086, 1087, 1088, 1089, 1092, 1095, 1096, 1100, 1101, 1103, 1104, 1106, 1110, 1112, 1114, 1115, 1116, 1117, 1119, 1120, 1121, 1125, 1130, 1132, 1136, 1137, 1140, 1144, 1146, 1148, 1153, 1154, 1155, 1160, 1161, 1162, 1164, 1165, 1167, 1168, 1170, 1171, 1176, 1178, 1183, 1187, 1189, 1190, 1191, 1196, 1201, 1203, 1204, 1205, 1213, 1214, 1215, 1218, 1220, 1222, 1223, 1225, 1228, 1230, 1231, 1232, 1233, 1236, 1240, 1243, 1244, 1248, 1249, 1250, 1251, 1252, 1253, 1254, 1257, 1258, 1261, 1263, 1269, 1272, 1277, 1281, 1285, 1286, 1290, 1292, 1293, 1296, 1301, 1303, 1306, 1307, 1309, 1310, 1311, 1312, 1314, 1316, 1320, 1322, 1323, 1327, 1330, 1331, 1334, 1337, 1339, 1345, 1347, 1349, 1354, 1355, 1360, 1363, 1364, 1366, 1367, 1368, 1371, 1375, 1376, 1377, 1380, 1381, 1387, 1388, 1389, 1391, 1393, 1394, 1396, 1398, 1399, 1402, 1404, 1405, 1406, 1412, 1416, 1420, 1421, 1423, 1426, 1431, 1432, 1433, 1438, 1439, 1440, 1441, 1442, 1447, 1448, 1451, 1453, 1458, 1459, 1461, 1466, 1468, 1471, 1472, 1474, 1475, 1484, 1485, 1488, 1490, 1491, 1492, 1493, 1498, 1499, 1501, 1503, 1504, 1506, 1512, 1514, 1518, 1519, 1527, 1528, 1530, 1539, 1543, 1545, 1546, 1547, 1549, 1550, 1551, 1553, 1554, 1555, 1556, 1559, 1560, 1561, 1564, 1567, 1568, 1570, 1571, 1575, 1578, 1579, 1584, 1585, 1586, 1588, 1590, 1591, 1596, 1597, 1598, 1599, 1600, 1601, 1602, 1604, 1605, 1608, 1609, 1610, 1612, 1615, 1616, 1617, 1622, 1623, 1625, 1634, 1635, 1637, 1638, 1639, 1642, 1643, 1650, 1651, 1653, 1654, 1658, 1659, 1662, 1663, 1668, 1669, 1671, 1673, 1675, 1676, 1678, 1681, 1682, 1684, 1685, 1687, 1688, 1689, 1690, 1691, 1696, 1697, 1698, 1699, 1703, 1705, 1706, 1707, 1708, 1710, 1716, 1717, 1718, 1720, 1725, 1729, 1732, 1735, 1736, 1739, 1745, 1750, 1755, 1759, 1761, 1764, 1768, 1769, 1770, 1773, 1774, 1776, 1777, 1778, 1785, 1786, 1791, 1792, 1793, 1796, 1798, 1807, 1808, 1809, 1811, 1812, 1813, 1814, 1823, 1826, 1828, 1830, 1832, 1834, 1835, 1837, 1838, 1839, 1840, 1843, 1848, 1852, 1854, 1855, 1859, 1861, 1863, 1866, 1867, 1868, 1869, 1872, 1873, 1876, 1879, 1880, 1882, 1886, 1888, 1891, 1894, 1897, 1898, 1899, 1900, 1902, 1905, 1906, 1910, 1911, 1913, 1916, 1918, 1920, 1922, 1923, 1924, 1928, 1933, 1934, 1936, 1939, 1940, 1945, 1949, 1950, 1952, 1953, 1954, 1958, 1968, 1970, 1971, 1972, 1973, 1974, 1977, 1990, 1991, 1993, 1994, 1995, 1996, 1999, 2000, 2001, 2007, 2008, 2009, 2010, 2012, 2014, 2015, 2016, 2017, 2019, 2021, 2026, 2027, 2031, 2032, 2037, 2040, 2041, 2042, 2043, 2048, 2060, 2062, 2064, 2066, 2072, 2074, 2077, 2078, 2088, 2089, 2091, 2092, 2093, 2094, 2097, 2099, 2101, 2103, 2104, 2106, 2107, 2111, 2112, 2113, 2121, 2122, 2123, 2125, 2126, 2128, 2132, 2133, 2137, 2139, 2140, 2141, 2142, 2143, 2146, 2147, 2150, 2151, 2156, 2157, 2161, 2162, 2164, 2166, 2167, 2168, 2170, 2172, 2173, 2175, 2177, 2178, 2179, 2183, 2185, 2188, 2189, 2190, 2193, 2195, 2196, 2200, 2202, 2203, 2205, 2206, 2210, 2215, 2216, 2221, 2222, 2223, 2226, 2235, 2240, 2241, 2242, 2243, 2253, 2257, 2260, 2261, 2263, 2267, 2271, 2274, 2276, 2278, 2280, 2282, 2283, 2284, 2288, 2289, 2291, 2296, 2297, 2298, 2303, 2304, 2305, 2306, 2308, 2309, 2310, 2313, 2314, 2322, 2323, 2328, 2329, 2331, 2333, 2337, 2338, 2339, 2342, 2345, 2346, 2348, 2353, 2358, 2363, 2366, 2367, 2369, 2371, 2372, 2379, 2380, 2381, 2382, 2384, 2396, 2401, 2402, 2405, 2410, 2412, 2413, 2414, 2418, 2419, 2420, 2423, 2426, 2428, 2431, 2432, 2433, 2434, 2435, 2437, 2439, 2440, 2441, 2442, 2443, 2445, 2449, 2451, 2452, 2453, 2454, 2457, 2458, 2465, 2469, 2470, 2471, 2472, 2474, 2476, 2477, 2479, 2480, 2481, 2482, 2485, 2487, 2489, 2490, 2494, 2495, 2496, 2497, 2498, 2500, 2504, 2505, 2506, 2507, 2509, 2513, 2514, 2515, 2516, 2517, 2519, 2521, 2522, 2525, 2528, 2529, 2531, 2532, 2533, 2534, 2536, 2537, 2538, 2539, 2541, 2544, 2546, 2549, 2550, 2551, 2552, 2554, 2555, 2556, 2557, 2559, 2567, 2568, 2570, 2571, 2573, 2578, 2579, 2581, 2583, 2589, 2590, 2594, 2596, 2599, 2601, 2605, 2609, 2611, 2612, 2613, 2616, 2617, 2619, 2620, 2625, 2626, 2627, 2632, 2634, 2635, 2636, 2639, 2644, 2645, 2648, 2649, 2651, 2652, 2655, 2656, 2658, 2661, 2662, 2663, 2666, 2671, 2672, 2674, 2676, 2678, 2679, 2684, 2685, 2687, 2688, 2689, 2690, 2691, 2692, 2694, 2700, 2702, 2704, 2708, 2711, 2719, 2720, 2721, 2722, 2723, 2725, 2726, 2728, 2729, 2730, 2735, 2744, 2745, 2746, 2747, 2749, 2752, 2755, 2756, 2758, 2762, 2763, 2764, 2765, 2770, 2775, 2776, 2779, 2784, 2785, 2786, 2787, 2789, 2791, 2794, 2796, 2798, 2800, 2802, 2805, 2808, 2812, 2814, 2819, 2821, 2822, 2823, 2824, 2826, 2827, 2828, 2831, 2832, 2837, 2840, 2844, 2845, 2850, 2857, 2860, 2861, 2865, 2869, 2871, 2876, 2878, 2879, 2888, 2889, 2892, 2893, 2894, 2895, 2896, 2897, 2898, 2901, 2902, 2903, 2906, 2908, 2909, 2914, 2915, 2916, 2917, 2918, 2919, 2922, 2923, 2926, 2929, 2930, 2931, 2935, 2941, 2942, 2943, 2944, 2946, 2947, 2948, 2951, 2955, 2959, 2962, 2963, 2966, 2968, 2969, 2976, 2979, 2982, 2987, 2992, 2994, 3003, 3005, 3007, 3008, 3009, 3013, 3015, 3017, 3018, 3020, 3023, 3027, 3029, 3031, 3039, 3042, 3043, 3044, 3045, 3047, 3048, 3049, 3051, 3052, 3053, 3055, 3064, 3067, 3068, 3070, 3072, 3075, 3083, 3084, 3085, 3087, 3090, 3095, 3100, 3101, 3106, 3112, 3115, 3118, 3119, 3120, 3121, 3122, 3123, 3126, 3127, 3128, 3129, 3137, 3138, 3139, 3141, 3143, 3145, 3153, 3167, 3169, 3170, 3171, 3172, 3177, 3181, 3189, 3191, 3192, 3194, 3196, 3202, 3204, 3205, 3206, 3208, 3210, 3217, 3218, 3219, 3220, 3221, 3224, 3225, 3228, 3230, 3231, 3236, 3237, 3240, 3242, 3246, 3247, 3249, 3250, 3252, 3254, 3261, 3263, 3266, 3267, 3269, 3271, 3272, 3278, 3280, 3283, 3286, 3288, 3289, 3290, 3291, 3294, 3295, 3297, 3299, 3301, 3308, 3310, 3312, 3313, 3324, 3327, 3331, 3332, 3333, 3337, 3338, 3340, 3342, 3343, 3345, 3346, 3351, 3353, 3354, 3355, 3356, 3357, 3358, 3359, 3360, 3361, 3363, 3370, 3374, 3376, 3377, 3378, 3379, 3382, 3383, 3384, 3386, 3394, 3396, 3399, 3402, 3403, 3404, 3405, 3413, 3415, 3416, 3418, 3419, 3424, 3426, 3428, 3435, 3438, 3440, 3441, 3445, 3446, 3447, 3449, 3450, 3452, 3453, 3458, 3461, 3465, 3466, 3468, 3469, 3470, 3471, 3474, 3477, 3484, 3486, 3488, 3490, 3493, 3494, 3500, 3501, 3502, 3503, 3504, 3507, 3515, 3516, 3523, 3524, 3529, 3533, 3535, 3536, 3537, 3538, 3540, 3541, 3542, 3544, 3545, 3546, 3548, 3549, 3551, 3554, 3556, 3558, 3560, 3562, 3569, 3574, 3576, 3577, 3580, 3587, 3588, 3589, 3591, 3592, 3594, 3595, 3597, 3600, 3601, 3603, 3604, 3607, 3610, 3611, 3612, 3613, 3615, 3616, 3618, 3619, 3620, 3621, 3624, 3629, 3633, 3634, 3638, 3640, 3642, 3643, 3644, 3645, 3646, 3647, 3648, 3655, 3657, 3659, 3660, 3661, 3667, 3671, 3672, 3674, 3676, 3677, 3681, 3682, 3684, 3685, 3690, 3693, 3694, 3702, 3704, 3706, 3707, 3709, 3710, 3713, 3715, 3717, 3718, 3719, 3720, 3721, 3723, 3725, 3730, 3731, 3738, 3739, 3744, 3749, 3752, 3760, 3761, 3763, 3764, 3765, 3766, 3772, 3773, 3775, 3777, 3778, 3783, 3785, 3791, 3792, 3793, 3798, 3801, 3804, 3806, 3808, 3809, 3817, 3818, 3819, 3820, 3823, 3825, 3828, 3829, 3830, 3831, 3832, 3833, 3837, 3838, 3843, 3844, 3845, 3846, 3847, 3849, 3852, 3858, 3859, 3860, 3867, 3868, 3870, 3871, 3872, 3873, 3877, 3882, 3883, 3884, 3887, 3889, 3890, 3892, 3894, 3895, 3897, 3898, 3899, 3902, 3903, 3904, 3907, 3908, 3910, 3912, 3917, 3918, 3923, 3924, 3926, 3928, 3929, 3934, 3938, 3940, 3941, 3947, 3950, 3952, 3954, 3958, 3959, 3962, 3964, 3967, 3968, 3970, 3971, 3972, 3974, 3975, 3978, 3983, 3985, 3988, 3991, 3994, 3996, 3997, 4000, 4007, 4008, 4013, 4014, 4019, 4020, 4021, 4028, 4030, 4033, 4037, 4039, 4040, 4041, 4042, 4043, 4044, 4046, 4047, 4048, 4049, 4050, 4051, 4052, 4053, 4054, 4056, 4057, 4062, 4066, 4068, 4070, 4072, 4080, 4084, 4088, 4092, 4094, 4096, 4099, 4102, 4105, 4106, 4109, 4110, 4113, 4116, 4124, 4126, 4128, 4132, 4133, 4134, 4135, 4139, 4143, 4144, 4146, 4147, 4148, 4149, 4150, 4155, 4157, 4160, 4161, 4162, 4163, 4164, 4165, 4166, 4167, 4168, 4171, 4173, 4175, 4178, 4181, 4183, 4185, 4187, 4188, 4189, 4191, 4193, 4195, 4201, 4202, 4204, 4205, 4206, 4207, 4208, 4210, 4211, 4212, 4213, 4217, 4218, 4219, 4221, 4227, 4228, 4229, 4232, 4233, 4234, 4235, 4237, 4244, 4245, 4246, 4250, 4251, 4252, 4257, 4261, 4263, 4266, 4270, 4272, 4275, 4276, 4280, 4281, 4284, 4290, 4292, 4294, 4296, 4298, 4300, 4301, 4302, 4304, 4305, 4306, 4309, 4312, 4317, 4320, 4321, 4324, 4329, 4330, 4332, 4335, 4339, 4341, 4344, 4347, 4352, 4354, 4356, 4358, 4359, 4360, 4366, 4369, 4370, 4375, 4378, 4380, 4383, 4388, 4390, 4391, 4396, 4397, 4401, 4402, 4403, 4404, 4405, 4406, 4409, 4410, 4417, 4422, 4423, 4425, 4430, 4432, 4436, 4439, 4440, 4442, 4443, 4446, 4448, 4449, 4450, 4453, 4458, 4461, 4462, 4463, 4466, 4467, 4468, 4470, 4474, 4475, 4479, 4486, 4490, 4492, 4494, 4497, 4498, 4500, 4502, 4507, 4508, 4512, 4514, 4515, 4519, 4521, 4522, 4525, 4531, 4535, 4545, 4548, 4549, 4551, 4554, 4555, 4556, 4557, 4558, 4560, 4562, 4563, 4565, 4566, 4567, 4568, 4575, 4576, 4580, 4582, 4583, 4590, 4591, 4594, 4596, 4597, 4598, 4601, 4606, 4616, 4623, 4625, 4628, 4630, 4632, 4633, 4635, 4636, 4639, 4641, 4643, 4644, 4645, 4646, 4647, 4650, 4651, 4653, 4654, 4655, 4656, 4658, 4659, 4664, 4667, 4669, 4671, 4672, 4673, 4674, 4676, 4677, 4680, 4682, 4685, 4691, 4692, 4694, 4696, 4697, 4699, 4700, 4701, 4703, 4705, 4706, 4708, 4710, 4711, 4713, 4715, 4719, 4721, 4724, 4727, 4729, 4730, 4734, 4736, 4737, 4738, 4739, 4740, 4741, 4745, 4746, 4747, 4748, 4749, 4750, 4751, 4753, 4755, 4756, 4761, 4762, 4763, 4766, 4767, 4769, 4770, 4771, 4773, 4775, 4779, 4780, 4784, 4787, 4788, 4789, 4790, 4791, 4794, 4795, 4796, 4801, 4803, 4804, 4805, 4806, 4807, 4813, 4814, 4815, 4817, 4818, 4822, 4828, 4829, 4830, 4831, 4834, 4838, 4841, 4842, 4845, 4854, 4855, 4856, 4857, 4859, 4861, 4862, 4863, 4869, 4874, 4875, 4876, 4878, 4880, 4881, 4887, 4889, 4891, 4896, 4897, 4900, 4902, 4904, 4905, 4907, 4909, 4910, 4913, 4914, 4921, 4922, 4924, 4931, 4935, 4936, 4938, 4941, 4942, 4943, 4950, 4954, 4955, 4958, 4959, 4963, 4967, 4969, 4971, 4972, 4974, 4975, 4977, 4980, 4981, 4984, 4987, 4988, 4989, 4990, 4993, 4994, 4996, 5000, 5005, 5007, 5011, 5014, 5015, 5016, 5021, 5024, 5026, 5029, 5030, 5034, 5036, 5037, 5038, 5039, 5040, 5042, 5044, 5045, 5046, 5051, 5052, 5054, 5057, 5060, 5061, 5067, 5068, 5072, 5074, 5075, 5078, 5079, 5082, 5087, 5088, 5089, 5090, 5091, 5094, 5100, 5101, 5102, 5106, 5109, 5113, 5114, 5116, 5120, 5122, 5123, 5125, 5129, 5131, 5132, 5140, 5143, 5145, 5146, 5147, 5149, 5150, 5151, 5159, 5160, 5164, 5165, 5168, 5170, 5174, 5180, 5181, 5184, 5185, 5187, 5188, 5189, 5190, 5191, 5192, 5196, 5198, 5200, 5202, 5203, 5206, 5209, 5212, 5213, 5216, 5217, 5218, 5219, 5224, 5225, 5228, 5229, 5234, 5240, 5241, 5243, 5244, 5245, 5249, 5251, 5253, 5254, 5255, 5256, 5257, 5258, 5260, 5261, 5263, 5267, 5268, 5269, 5273, 5274, 5275, 5276, 5280, 5281, 5283, 5286, 5289, 5292, 5293, 5297, 5298, 5299, 5300, 5301, 5308, 5311, 5314, 5317, 5319, 5321, 5324, 5329, 5330, 5332, 5333, 5334, 5338, 5339, 5342, 5345, 5346, 5348, 5349, 5351, 5352, 5363, 5364, 5366, 5367, 5369, 5371, 5386, 5388, 5389, 5391, 5393, 5395, 5396, 5397, 5402, 5405, 5409, 5411, 5413, 5414, 5417, 5418, 5422, 5426, 5427, 5428, 5430, 5431, 5433, 5434, 5437, 5438, 5445, 5446, 5448, 5449, 5452, 5453, 5456, 5458, 5459, 5461, 5463, 5464, 5471, 5472, 5475, 5483, 5484, 5485, 5487, 5488, 5491, 5493, 5495, 5496, 5505, 5506, 5508, 5510, 5512, 5513, 5515, 5517, 5518, 5519, 5524, 5526, 5529, 5530, 5531, 5532, 5534, 5535, 5536, 5541, 5543, 5545, 5549, 5554, 5562, 5563, 5564, 5565, 5566, 5568, 5569, 5572, 5575, 5579, 5581, 5582, 5584, 5585, 5586, 5589, 5593, 5594, 5596, 5597, 5602, 5608, 5612, 5613, 5614, 5615, 5616, 5618, 5619, 5620, 5621, 5623, 5627, 5632, 5633, 5635, 5638, 5640, 5643, 5647, 5648, 5649, 5650, 5651, 5652, 5653, 5656, 5657, 5659, 5660, 5662, 5663, 5664, 5667, 5669, 5675, 5676, 5680, 5681, 5683, 5689, 5690, 5694, 5695, 5697, 5698, 5702, 5706, 5709, 5711, 5714, 5717, 5718, 5719, 5721, 5722, 5723, 5729, 5730, 5731, 5732, 5734, 5735, 5736, 5742, 5744, 5748, 5751, 5757, 5768, 5770, 5771, 5773, 5775, 5780, 5784, 5785, 5787, 5788, 5791, 5792, 5794, 5805, 5807, 5808, 5810, 5811, 5814, 5815, 5816, 5817, 5820, 5823, 5826, 5828, 5832, 5833, 5834, 5835, 5836, 5837, 5839, 5842, 5844, 5846, 5850, 5853, 5854, 5856, 5859, 5861, 5864, 5866, 5867, 5869, 5871, 5872, 5873, 5875, 5876, 5878, 5879, 5881, 5882, 5883, 5888, 5889, 5892, 5893, 5900, 5901, 5902, 5906, 5907, 5910, 5912, 5918, 5919, 5921, 5922, 5923, 5925, 5926, 5927, 5928, 5930, 5931, 5932, 5933, 5938, 5939, 5940, 5941, 5942, 5944, 5946, 5947, 5948, 5951, 5954, 5956, 5957, 5959, 5961, 5967, 5968, 5971, 5978, 5979, 5980, 5984, 5985, 5986, 5988, 5989, 5990, 5991, 5992, 5994, 5996, 5997, 6000, 6002, 6003, 6004, 6006, 6007, 6010, 6012, 6013, 6016, 6017, 6021, 6023, 6025, 6026, 6028, 6031, 6033, 6038, 6040, 6041, 6042, 6044, 6047, 6048, 6051, 6053, 6054, 6058, 6059, 6060, 6061, 6062, 6063, 6065, 6068, 6069, 6070, 6072, 6073, 6074, 6075, 6077, 6080, 6085, 6088, 6089, 6091, 6092, 6093, 6094, 6095, 6098, 6107, 6108, 6109, 6112, 6113, 6116, 6118, 6119, 6122, 6129, 6130, 6131, 6132, 6133, 6135, 6136, 6137, 6143, 6145, 6146, 6147, 6149, 6151, 6153, 6156, 6158, 6160, 6163, 6164, 6165, 6168, 6173, 6176, 6180, 6181, 6182, 6183, 6186, 6188, 6189, 6190, 6191, 6193, 6197, 6198, 6200, 6205, 6207, 6209, 6212, 6213, 6215, 6220, 6221, 6223, 6224, 6227, 6228, 6230, 6231, 6234, 6237, 6238, 6239, 6240, 6243, 6245, 6246, 6247, 6248, 6249, 6250, 6251, 6255, 6257, 6258, 6259, 6260, 6264, 6265, 6269, 6270, 6271, 6272, 6273, 6275, 6278, 6279, 6280, 6282, 6286, 6288, 6291, 6292, 6294, 6295, 6299, 6300, 6302, 6303, 6308, 6309, 6310, 6311, 6312, 6315, 6317, 6319, 6321, 6322, 6323, 6325, 6326, 6328, 6333, 6338, 6346, 6351, 6352, 6353, 6354, 6356, 6359, 6360, 6362, 6363, 6364, 6367, 6370, 6372, 6373, 6375, 6378, 6379, 6381, 6383, 6394, 6395, 6396, 6397, 6398, 6399, 6403, 6405, 6407, 6408, 6410, 6412, 6413, 6414, 6415, 6419, 6420, 6422, 6426, 6428, 6429, 6430, 6431, 6434, 6436, 6437, 6440, 6442, 6448, 6454, 6458, 6459, 6463, 6464, 6466, 6467, 6468, 6469, 6470, 6471, 6474, 6476, 6477, 6478, 6480, 6484, 6486, 6488, 6492, 6493, 6495, 6497, 6499, 6500, 6501, 6502, 6504, 6505, 6510, 6513, 6514, 6516, 6517, 6519, 6524, 6525, 6526, 6530, 6532, 6533, 6534, 6535, 6537, 6539, 6543, 6544, 6547, 6548, 6549, 6552, 6553, 6554, 6555, 6558, 6560, 6561, 6563, 6564, 6567, 6569, 6572, 6574, 6576, 6577, 6579, 6581, 6582, 6584, 6587, 6588, 6589, 6595, 6599, 6600, 6607, 6609, 6610, 6611, 6614, 6620, 6621, 6624, 6626, 6627, 6628, 6629, 6630, 6634, 6635, 6637, 6638, 6639, 6643, 6644, 6646, 6647, 6649, 6650, 6652, 6655, 6656, 6658, 6662, 6666, 6671, 6672, 6673, 6677, 6686, 6691, 6692, 6695, 6696, 6703, 6705, 6706, 6711, 6714, 6716, 6718, 6720, 6724, 6725, 6729, 6731, 6734, 6737, 6739, 6746, 6747, 6748, 6752, 6756, 6757, 6758, 6759, 6761, 6764, 6766, 6778, 6779, 6780, 6783, 6786, 6788, 6793, 6794, 6795, 6797, 6799, 6803, 6804, 6805, 6807, 6810, 6811, 6812, 6813, 6816, 6817, 6819, 6820, 6821, 6824, 6827, 6828, 6830, 6831, 6834, 6836, 6839, 6840, 6841, 6842, 6843, 6845, 6851, 6854, 6859, 6864, 6869, 6872, 6874, 6875, 6877, 6878, 6879, 6880, 6884, 6888, 6890, 6897, 6903, 6906, 6907, 6909, 6914, 6915, 6917, 6919, 6920, 6921, 6923, 6924, 6930, 6933, 6936, 6941, 6944, 6946, 6948, 6950, 6951, 6952, 6959, 6960, 6963, 6966, 6967, 6979, 6980, 6984, 6985, 6987, 6988, 6990, 6991, 6993, 6994, 6995, 6999, 7002, 7003, 7006, 7009, 7011, 7012, 7013, 7015, 7022, 7025, 7032, 7033, 7039, 7042, 7043, 7045, 7046, 7049, 7051, 7052, 7053, 7056, 7057, 7064, 7067, 7068, 7072, 7075, 7077, 7079, 7083, 7085, 7086, 7094, 7097, 7105, 7106, 7107, 7108, 7112, 7113, 7116, 7117, 7118, 7119, 7124, 7126, 7129, 7130, 7132, 7135, 7138, 7139, 7140, 7142, 7144, 7146, 7149, 7151, 7155, 7163, 7164, 7165, 7166, 7169, 7173, 7176, 7177, 7182, 7184, 7187, 7188, 7192, 7194, 7197, 7201, 7202, 7203, 7206, 7207, 7208, 7209, 7211, 7212, 7216, 7217, 7219, 7227, 7228, 7230, 7231, 7232, 7233, 7234, 7235, 7236, 7239, 7241, 7243, 7244, 7245, 7248, 7255, 7257, 7258, 7259, 7267, 7268, 7270, 7274, 7277, 7278, 7281, 7282, 7284, 7287, 7288, 7290, 7291, 7292, 7293, 7298, 7299, 7300, 7301, 7303, 7304, 7305, 7306, 7307, 7308, 7310, 7313, 7315, 7328, 7330, 7331, 7334, 7336, 7338, 7339, 7340, 7344, 7350, 7351, 7354, 7355, 7357, 7358, 7363, 7365, 7371, 7373, 7379, 7380, 7381, 7382, 7383, 7386, 7388, 7389, 7392, 7398, 7400, 7406, 7409, 7410, 7411, 7415, 7417, 7418, 7425, 7428, 7430, 7431, 7433, 7434, 7435, 7436, 7441, 7443, 7444, 7446, 7447, 7448, 7452, 7453, 7454, 7458, 7459, 7464, 7466, 7470, 7479, 7486, 7490, 7492, 7493, 7498, 7504, 7505, 7506, 7512, 7515, 7517, 7523, 7524, 7525, 7528, 7529, 7533, 7537, 7538, 7542, 7546, 7547, 7548, 7554, 7556, 7560, 7561, 7570, 7574, 7577, 7578, 7579, 7580, 7585, 7586, 7587, 7589, 7590, 7591, 7593, 7594, 7605, 7611, 7619, 7620, 7621, 7623, 7624, 7633, 7634, 7638, 7639, 7640, 7642, 7643, 7652, 7658, 7661, 7663, 7664, 7665, 7666, 7667, 7674, 7676, 7677, 7678, 7679, 7680, 7682, 7685, 7687, 7689, 7695, 7699, 7700, 7703, 7704, 7712, 7716, 7718, 7719, 7724, 7725, 7729, 7730, 7733, 7736, 7737, 7738, 7740, 7743, 7744, 7745, 7747, 7750, 7751, 7753, 7761, 7762, 7763, 7764, 7767, 7768, 7769, 7770, 7774, 7775, 7777, 7778, 7779, 7780, 7781, 7782, 7785, 7786, 7788, 7791, 7792, 7793, 7794, 7798, 7800, 7803, 7804, 7806, 7807, 7812, 7815, 7818, 7819, 7820, 7823, 7824, 7825, 7832, 7833, 7834, 7838, 7841, 7844, 7845, 7847, 7848, 7849, 7852, 7856, 7858, 7859, 7860, 7862, 7863, 7865, 7873, 7875, 7876, 7878, 7888, 7890, 7896, 7900, 7908, 7909, 7910, 7911, 7918, 7921, 7923, 7925, 7929, 7933, 7934, 7935, 7936, 7937, 7938, 7942, 7944, 7945, 7946, 7947, 7948, 7949, 7950, 7955, 7956, 7962, 7964, 7972, 7974, 7976, 7977, 7978, 7980, 7981, 7982, 7983, 7984, 7986, 7988, 7989, 7990, 7991, 7993, 7998, 8002, 8004, 8005, 8006, 8007, 8012, 8021, 8026, 8029, 8030, 8035, 8039, 8042, 8043, 8044, 8047, 8048, 8052, 8053, 8056, 8058, 8059, 8062, 8063, 8064, 8065, 8067, 8068, 8071, 8072, 8073, 8075, 8076, 8077, 8078, 8079, 8080, 8082, 8084, 8088, 8091, 8093, 8095, 8100, 8102, 8103, 8105, 8112, 8114, 8116, 8118, 8121, 8123, 8124, 8125, 8126, 8130, 8136, 8137, 8150, 8151, 8159, 8163, 8164, 8165, 8168, 8170, 8176, 8178, 8179, 8182, 8185, 8189, 8192, 8193, 8195, 8199, 8202, 8204, 8207, 8208, 8210, 8211, 8213, 8216, 8219, 8220, 8222, 8223, 8225, 8227, 8234, 8235, 8237, 8239, 8240, 8241, 8242, 8245, 8250, 8252, 8253, 8262, 8265, 8266, 8268, 8269, 8270, 8272, 8282, 8288, 8289, 8291, 8292, 8293, 8294, 8295, 8297, 8300, 8301, 8304, 8305, 8310, 8311, 8312, 8318, 8319, 8320, 8321, 8324, 8329, 8339, 8340, 8349, 8350, 8352, 8353, 8354, 8355, 8361, 8363, 8367, 8368, 8369, 8372, 8373, 8378, 8379, 8385, 8386, 8387, 8389, 8390, 8392, 8393, 8395, 8398, 8401, 8402, 8403, 8404, 8405, 8407, 8410, 8413, 8414, 8416, 8417, 8418, 8423, 8428, 8430, 8433, 8436, 8438, 8439, 8441, 8442, 8444, 8446, 8447, 8448, 8449, 8450, 8451, 8452, 8456, 8457, 8458, 8459, 8465, 8466, 8469, 8470, 8472, 8473, 8474, 8476, 8477, 8480, 8481, 8482, 8485, 8486, 8490, 8493, 8498, 8501, 8502, 8505, 8507, 8509, 8511, 8513, 8515, 8516, 8517, 8520, 8523, 8524, 8525, 8527, 8528, 8531, 8532, 8533, 8535, 8537, 8538, 8539, 8542, 8549, 8550, 8552, 8553, 8554, 8557, 8558, 8561, 8562, 8565, 8566, 8568, 8575, 8576, 8579, 8581, 8582, 8583, 8589, 8590, 8592, 8593, 8594, 8596, 8597, 8598, 8599, 8600, 8601, 8602, 8603, 8604, 8605, 8609, 8611, 8612, 8614, 8617, 8618, 8624, 8628, 8630, 8631, 8634, 8637, 8638, 8640, 8641, 8642, 8644, 8648, 8650, 8654, 8657, 8658, 8659, 8660, 8663, 8665, 8669, 8670, 8672, 8676, 8677, 8685, 8693, 8694, 8700, 8704, 8706, 8708, 8709, 8713, 8716, 8717, 8719, 8720, 8726, 8728, 8729, 8731, 8732, 8734, 8735, 8736, 8740, 8741, 8742, 8744, 8745, 8746, 8748, 8751, 8752, 8753, 8757, 8764, 8767, 8770, 8772, 8773, 8774, 8775, 8776, 8777, 8779, 8782, 8783, 8784, 8785, 8789, 8792, 8797, 8803, 8804, 8805, 8810, 8818, 8822, 8824, 8829, 8831, 8832, 8834, 8835, 8838, 8841, 8842, 8843, 8846, 8853, 8854, 8861, 8865, 8866, 8867, 8876, 8878, 8881, 8883, 8886, 8888, 8889, 8891, 8892, 8896, 8899, 8900, 8902, 8905, 8907, 8908, 8909, 8910, 8911, 8913, 8914, 8916, 8917, 8926, 8928, 8929, 8930, 8935, 8938, 8941, 8942, 8945, 8946, 8949, 8951, 8954, 8956, 8957, 8959, 8960, 8962, 8967, 8968, 8969, 8972, 8974, 8976, 8977, 8979, 8980, 8981, 8985, 8986, 8992, 8996, 8998, 8999, 9001, 9002, 9003, 9006, 9009, 9012, 9015, 9020, 9023, 9029, 9030, 9033, 9037, 9042, 9044, 9047, 9052, 9057, 9058, 9059, 9060, 9061, 9066, 9069, 9071, 9072, 9073, 9074, 9076, 9080, 9084, 9088, 9091, 9092, 9095, 9096, 9105, 9108, 9110, 9111, 9112, 9114, 9115, 9116, 9118, 9119, 9123, 9124, 9125, 9129, 9131, 9133, 9134, 9139, 9140, 9141, 9142, 9149, 9151, 9152, 9155, 9173, 9174, 9175, 9177, 9183, 9185, 9187, 9188, 9190, 9191, 9195, 9200, 9206, 9207, 9210, 9211, 9213, 9214, 9215, 9216, 9218, 9226, 9229, 9233, 9237, 9241, 9242, 9243, 9244, 9247, 9248, 9249, 9252, 9253, 9254, 9255, 9257, 9263, 9265, 9267, 9269, 9270, 9273, 9275, 9276, 9278, 9282, 9284, 9285, 9287, 9288, 9290, 9292, 9293, 9299, 9300, 9302, 9304, 9308, 9311, 9313, 9320, 9321, 9323, 9325, 9326, 9327, 9328, 9329, 9330, 9336, 9337, 9338, 9339, 9340, 9341, 9345, 9346, 9347, 9348, 9349, 9354, 9355, 9357, 9359, 9366, 9373, 9375, 9376, 9378, 9382, 9383, 9388, 9391, 9392, 9393, 9394, 9396, 9398, 9400, 9402, 9403, 9404, 9406, 9407, 9413, 9414, 9415, 9422, 9423, 9432, 9433, 9434, 9440, 9442, 9443, 9444, 9451, 9452, 9453, 9456, 9460, 9468, 9471, 9472, 9473, 9478, 9483, 9488, 9490, 9497, 9500, 9501, 9502, 9503, 9504, 9505, 9509, 9514, 9515, 9517, 9518, 9519, 9520, 9525, 9531, 9533, 9534, 9536, 9540, 9543, 9545, 9546, 9548, 9549, 9553, 9555, 9563, 9564, 9565, 9568, 9571, 9575, 9577, 9579, 9582, 9583, 9586, 9587, 9589, 9590, 9591, 9592, 9596, 9602, 9606, 9607, 9608, 9609, 9610, 9613, 9614, 9615, 9617, 9620, 9623, 9626, 9627, 9628, 9629, 9632, 9633, 9635, 9640, 9641, 9642, 9644, 9645, 9646, 9648, 9649, 9650, 9653, 9655, 9656, 9657, 9658, 9659, 9660, 9663, 9666, 9668, 9670, 9675, 9681, 9682, 9686, 9692, 9693, 9698, 9706, 9710, 9711, 9717, 9718, 9722, 9723, 9726, 9729, 9730, 9731, 9733, 9734, 9737, 9738, 9746, 9750, 9751, 9753, 9754, 9756, 9763, 9764, 9767, 9768, 9770, 9774, 9776, 9777, 9780, 9781, 9782, 9784, 9786, 9791, 9792, 9794, 9796, 9799, 9801, 9804, 9806, 9808, 9812, 9813, 9816, 9819, 9820, 9824, 9825, 9827, 9833, 9835, 9836, 9845, 9846, 9847, 9849, 9850, 9851, 9853, 9854, 9861, 9864, 9866, 9869, 9873, 9882, 9886, 9887, 9892, 9893, 9897, 9900, 9901, 9906, 9907, 9908, 9909, 9910, 9911, 9912, 9917, 9923, 9924, 9928, 9934, 9935, 9938, 9940, 9944, 9946, 9949, 9950, 9953, 9955, 9957, 9958, 9960, 9962, 9963, 9964, 9967, 9968, 9971, 9972, 9974, 9975, 9976, 9979, 9980, 9982, 9984, 9985, 9987, 9988, 9990, 9991, 9997, 9998, 10000, 10008, 10009, 10010, 10012, 10013, 10017, 10018, 10019, 10021, 10022, 10026, 10027, 10031, 10032, 10033, 10034, 10035, 10037, 10038, 10041, 10043, 10045, 10047, 10048, 10050, 10051, 10052, 10054, 10056, 10058, 10059, 10060, 10062, 10063, 10064, 10066, 10068, 10072, 10073, 10075, 10077, 10078, 10082, 10083, 10089, 10090, 10091, 10092, 10095, 10097, 10101, 10102, 10103, 10105, 10106, 10107, 10108, 10109, 10110, 10114, 10115, 10116, 10118, 10119, 10122, 10127, 10128, 10131, 10132, 10134, 10136, 10138, 10143, 10146, 10149, 10151, 10152, 10158, 10162, 10163, 10165, 10166, 10168, 10170, 10174, 10176, 10178, 10179, 10181, 10182, 10191, 10192, 10193, 10194, 10195, 10197, 10199, 10201, 10203, 10206, 10209, 10214, 10218, 10219, 10220, 10222, 10223, 10224, 10225, 10228, 10230, 10231, 10233, 10235, 10236, 10237, 10239, 10240, 10247, 10252, 10253, 10255, 10258, 10260, 10262, 10270, 10275, 10284, 10291, 10292, 10293, 10295, 10300, 10302, 10306, 10307, 10311, 10318, 10321, 10322, 10323, 10325, 10326, 10328, 10329, 10330, 10331, 10333, 10334, 10335, 10336, 10338, 10342, 10343, 10352, 10353, 10356, 10357, 10359, 10360, 10362, 10364, 10365, 10368, 10371, 10373, 10375, 10378, 10380, 10381, 10384, 10385, 10388, 10389, 10395, 10397, 10398, 10399, 10400, 10401, 10405, 10410, 10413, 10414, 10416, 10421, 10423, 10424, 10427, 10429, 10430, 10435, 10437, 10438, 10440, 10442, 10443, 10446, 10447, 10448, 10449, 10450, 10451, 10453, 10456, 10463, 10464, 10465, 10466, 10468, 10469, 10470, 10472, 10473, 10474, 10478, 10480, 10482, 10487, 10490, 10492, 10494, 10496, 10504, 10506, 10508, 10513, 10514, 10515, 10516, 10518, 10525, 10527, 10528, 10530, 10531, 10533, 10535, 10536, 10537, 10541, 10542, 10543, 10544, 10547, 10548, 10549, 10550, 10551, 10555, 10556, 10558, 10560, 10561, 10562, 10563, 10565, 10567, 10569, 10571, 10573, 10577, 10580, 10581, 10582, 10583, 10585, 10590, 10593, 10596, 10597, 10599, 10601, 10602, 10610, 10611, 10614, 10615, 10616, 10617, 10621, 10622, 10623, 10625, 10626, 10629, 10630, 10631, 10633, 10634, 10636, 10637, 10638, 10639, 10640, 10641, 10642, 10643, 10645, 10646, 10649, 10650, 10655, 10657, 10659, 10663, 10665, 10668, 10669, 10670, 10674, 10676, 10677, 10678, 10681, 10682, 10683, 10684, 10685, 10687, 10689, 10693, 10697, 10698, 10699, 10700, 10702, 10703, 10705, 10707, 10708, 10711, 10715, 10716, 10721, 10722, 10723, 10725, 10726, 10732, 10734, 10735, 10737, 10738, 10740, 10741, 10744, 10745, 10747, 10748, 10749, 10752, 10753, 10756, 10761, 10762, 10763, 10766, 10770, 10774, 10775, 10777, 10778, 10779, 10782, 10784, 10785, 10787, 10788, 10790, 10791, 10792, 10795, 10796, 10798, 10800, 10801, 10802, 10803, 10804, 10805, 10809, 10810, 10811, 10812, 10815, 10818, 10819, 10820, 10821, 10823, 10824, 10825, 10826, 10831, 10833, 10836, 10838, 10839, 10840, 10841, 10843, 10846, 10850, 10852, 10853, 10854, 10857, 10858, 10860, 10861, 10862, 10866, 10867, 10869, 10872, 10874, 10877, 10878, 10880, 10881, 10887, 10891, 10892, 10896, 10897, 10898, 10899, 10902, 10903, 10905, 10911, 10912, 10917, 10920, 10926, 10927, 10928, 10930, 10933, 10934, 10935, 10936, 10937, 10938, 10940, 10941, 10944, 10945, 10947, 10948, 10950, 10954, 10956, 10957, 10960, 10962, 10963, 10965, 10966, 10967, 10972, 10973, 10975, 10976, 10977, 10979, 10980, 10988, 10993, 10995, 10996, 10997, 10999, 11002, 11004, 11005, 11006, 11008, 11010, 11015, 11018, 11024, 11026, 11027, 11032, 11033, 11039, 11046, 11047, 11052, 11053, 11056, 11058, 11060, 11066, 11068, 11070, 11071, 11078, 11079, 11080, 11082, 11083, 11086, 11090, 11092, 11095, 11098, 11101, 11102, 11107, 11109, 11110, 11114, 11116, 11118, 11119, 11123, 11124, 11125, 11127, 11129, 11132, 11133, 11135, 11137, 11138, 11145, 11146, 11148, 11150, 11151, 11152, 11153, 11154, 11158, 11159, 11160, 11161, 11162, 11163, 11166, 11168, 11169, 11175, 11177, 11178, 11179, 11180, 11181, 11184, 11185, 11187, 11188, 11190, 11191, 11192, 11194, 11198, 11199, 11201, 11202, 11203, 11207, 11210, 11214, 11217, 11218, 11222, 11226, 11227, 11228, 11229, 11230, 11232, 11233, 11234, 11235, 11236, 11237, 11239, 11244, 11246, 11247, 11248, 11251, 11254, 11255, 11256, 11257, 11258, 11259, 11260, 11262, 11263, 11264, 11266, 11274, 11275, 11278, 11282, 11286, 11288, 11289, 11290, 11291, 11292, 11293, 11294, 11295, 11298, 11302, 11305, 11306, 11307, 11313, 11315, 11316, 11318, 11320, 11322, 11324, 11326, 11329, 11330, 11331, 11332, 11337, 11338, 11339, 11340, 11345, 11346, 11348, 11349, 11352, 11356, 11358, 11363, 11364, 11365, 11366, 11369, 11370, 11371, 11373, 11374, 11377, 11380, 11381, 11382, 11387, 11388, 11389, 11391, 11392, 11394, 11395, 11397, 11401, 11403, 11405, 11406, 11408, 11409, 11411, 11412, 11413, 11414, 11416, 11418, 11423, 11424, 11426, 11428, 11430, 11431, 11434, 11437, 11438, 11445, 11446, 11448, 11449, 11451, 11459, 11461, 11463, 11465, 11471, 11472, 11473, 11475, 11476, 11477, 11478, 11481, 11482, 11485, 11487, 11490, 11491, 11494, 11496, 11497, 11498, 11499, 11500, 11501, 11503, 11506, 11507, 11508, 11509, 11512, 11516, 11518, 11520, 11523, 11524, 11526, 11528, 11530, 11531, 11532, 11533, 11534, 11538, 11541, 11544, 11546, 11547, 11548, 11551, 11553, 11558, 11560, 11561, 11567, 11568, 11570, 11571, 11576, 11577, 11578, 11579, 11580, 11583, 11586, 11593, 11594, 11595, 11596, 11597, 11599, 11604, 11612, 11615, 11618, 11620, 11621, 11623, 11625, 11628, 11629, 11632, 11633, 11636, 11639, 11642, 11644, 11650, 11652, 11654, 11655, 11656, 11657, 11658, 11663, 11667, 11668, 11669, 11673, 11678, 11681, 11682, 11683, 11688, 11691, 11692, 11693, 11694, 11695, 11698, 11699, 11701, 11703, 11705, 11707, 11711, 11712, 11718, 11720, 11721, 11722, 11725, 11731, 11733, 11736, 11740, 11741, 11743, 11744, 11753, 11755, 11756, 11759, 11760, 11761, 11762, 11763, 11764, 11765, 11766, 11767, 11770, 11771, 11774, 11776, 11781, 11782, 11783, 11784, 11785, 11786, 11790, 11792, 11795, 11799, 11800, 11809, 11811, 11812, 11814, 11816, 11818, 11819, 11820, 11821, 11822, 11826, 11828, 11830, 11837, 11838, 11841, 11846, 11848, 11849, 11850, 11851, 11853, 11856, 11858, 11863, 11868, 11870, 11872, 11876, 11877, 11878, 11881, 11890, 11891, 11894, 11898, 11903, 11909, 11913, 11916, 11917, 11918, 11919, 11920, 11921, 11923, 11926, 11927, 11928, 11929, 11930, 11934, 11935, 11940, 11941, 11943, 11945, 11946, 11947, 11948, 11949, 11953, 11955, 11957, 11958, 11959, 11960, 11961, 11962, 11963, 11965, 11966, 11968, 11977, 11978, 11979, 11980, 11983, 11988, 11993, 11994, 11995, 11996, 11997, 11998, 11999, 12002, 12004, 12006, 12008, 12017, 12019, 12020, 12021, 12023, 12024, 12025, 12029, 12032, 12042, 12043, 12044, 12047, 12050, 12051, 12054, 12059, 12060, 12061, 12064, 12068, 12076, 12078, 12079, 12080, 12081, 12082, 12083, 12085, 12086, 12087, 12091, 12092, 12093, 12097, 12098, 12104, 12106, 12109, 12112, 12114, 12115, 12118, 12120, 12122, 12126, 12128, 12129, 12130, 12131, 12134, 12135, 12136, 12137, 12138, 12139, 12143, 12144, 12145, 12146, 12147, 12148, 12149, 12151, 12153, 12161, 12162, 12165, 12166, 12167, 12170, 12171, 12174, 12175, 12176, 12179, 12181, 12186, 12197, 12202, 12204, 12208, 12214, 12215, 12217, 12223, 12228, 12229, 12233, 12234, 12237, 12240, 12241, 12243, 12245, 12249, 12250, 12252, 12254, 12255, 12256, 12259, 12268, 12269, 12271, 12278, 12280, 12283, 12285, 12286, 12287, 12288, 12291, 12295, 12296, 12302, 12304, 12310, 12311, 12312, 12313, 12314, 12315, 12317, 12319, 12321, 12323, 12325, 12328, 12331, 12333, 12334, 12337, 12339, 12340, 12342, 12345, 12347, 12350, 12354, 12356, 12358, 12359, 12364, 12366, 12370, 12374, 12375, 12376, 12379, 12380, 12381, 12383, 12385, 12390, 12393, 12394, 12397, 12400, 12401, 12403, 12404, 12406, 12411, 12414, 12415, 12416, 12417, 12419, 12420, 12423, 12424, 12426, 12427, 12428, 12437, 12440, 12444, 12445, 12450, 12451, 12456, 12457, 12459, 12461, 12462, 12465, 12467, 12468, 12470, 12472, 12473, 12478, 12481, 12483, 12487, 12488, 12492, 12495, 12497, 12499, 12501, 12502, 12503, 12505, 12508, 12512, 12513, 12514, 12515, 12518, 12519, 12530, 12531, 12535, 12536, 12537, 12538, 12539, 12540, 12546, 12547, 12548, 12549, 12551, 12552, 12554, 12555, 12556, 12557, 12561, 12563, 12565, 12567, 12568, 12570, 12572, 12577, 12578, 12580, 12583, 12584, 12585, 12586, 12588, 12591, 12600, 12603, 12605, 12606, 12608, 12609, 12610, 12611, 12616, 12622, 12623, 12626, 12628, 12629, 12631, 12633, 12634, 12638, 12639, 12640, 12641, 12648, 12649, 12651, 12652, 12653, 12654, 12663, 12664, 12668, 12670, 12671, 12674, 12677, 12679, 12681, 12683, 12684, 12685, 12688, 12689, 12691, 12693, 12695, 12696, 12697, 12699, 12701, 12702, 12705, 12706, 12707, 12708, 12713, 12714, 12723, 12726, 12731, 12732, 12733, 12735, 12738, 12739, 12740, 12741, 12742, 12743, 12752, 12753, 12754, 12755, 12756, 12757, 12758, 12760, 12761, 12762, 12764, 12765, 12766, 12767, 12771, 12772, 12773, 12775, 12777, 12782, 12783, 12785, 12790, 12794, 12797, 12800, 12802, 12803, 12807, 12808, 12810, 12812, 12813, 12817, 12820, 12822, 12823, 12824, 12826, 12827, 12828, 12834, 12835, 12836, 12837, 12838, 12839, 12843, 12844, 12848, 12849, 12850, 12853, 12861, 12866, 12870, 12873, 12875, 12878, 12882, 12883, 12884, 12887, 12888, 12891, 12898, 12899, 12900, 12901, 12902, 12903, 12904, 12905, 12906, 12908, 12910, 12912, 12913, 12916, 12920, 12921, 12928, 12929, 12931, 12932, 12933, 12934, 12935, 12939, 12940, 12945, 12946, 12947, 12950, 12953, 12956, 12958, 12960, 12961, 12963, 12967, 12968, 12969, 12978, 12983, 12984, 12986, 12987, 12988, 12990, 12991, 12999, 13001, 13003, 13004, 13007, 13010, 13014, 13015, 13017, 13018, 13022, 13027, 13030, 13031, 13032, 13033, 13034, 13035, 13036, 13040, 13041, 13047, 13049, 13050, 13053, 13054, 13055, 13056, 13061, 13062, 13064, 13066, 13071, 13075, 13077, 13079, 13083, 13085, 13086, 13087, 13099, 13101, 13102, 13105, 13106, 13110, 13111, 13112, 13114, 13115, 13116, 13117, 13118, 13120, 13121, 13122, 13123, 13124, 13125, 13128, 13130, 13131, 13134, 13136, 13142, 13147, 13148, 13149, 13151, 13154, 13156, 13159, 13160, 13166, 13169, 13175, 13181, 13182, 13186, 13190, 13197, 13198, 13199, 13203, 13206, 13209, 13212, 13213, 13217, 13220, 13221, 13224, 13226, 13227, 13228, 13232, 13234, 13235, 13236, 13237, 13239, 13241, 13243, 13248, 13250, 13251, 13255, 13256, 13259, 13260, 13261, 13262, 13263, 13264, 13265, 13267, 13268, 13269, 13271, 13274, 13280, 13281, 13283, 13284, 13296, 13297, 13298, 13300, 13301, 13303, 13304, 13313, 13315, 13317, 13325, 13328, 13329, 13330, 13332, 13337, 13340, 13343, 13344, 13345, 13346, 13347, 13348, 13350, 13352, 13353, 13358, 13361, 13363, 13367, 13368, 13369, 13370, 13377, 13380, 13381, 13384, 13385, 13386, 13388, 13391, 13393, 13394, 13395, 13396, 13397, 13398, 13402, 13403, 13404, 13407, 13408, 13410, 13416, 13417, 13419, 13423, 13424, 13429, 13430, 13433, 13434, 13439, 13441, 13448, 13450, 13451, 13456, 13457, 13463, 13467, 13469, 13473, 13475, 13477, 13478, 13479, 13480, 13489, 13492, 13494, 13496, 13499, 13503, 13510, 13513, 13514, 13515, 13519, 13521, 13522, 13526, 13532, 13533, 13539, 13540, 13543, 13544, 13546, 13547, 13549, 13552, 13553, 13555, 13556, 13558, 13559, 13560, 13561, 13568, 13569, 13574, 13577, 13578, 13579, 13580, 13584, 13587, 13589, 13597, 13599, 13600, 13601, 13602, 13604, 13605, 13606, 13612, 13613, 13621, 13623, 13627, 13628, 13630, 13631, 13632, 13634, 13636, 13637, 13641, 13643, 13647, 13651, 13653, 13654, 13660, 13662, 13663, 13665, 13668, 13675, 13677, 13678, 13679, 13683, 13684, 13687, 13688, 13693, 13697, 13698, 13699, 13700, 13702, 13706, 13710, 13713, 13714, 13715, 13716, 13719, 13720, 13722, 13727, 13729, 13730, 13734, 13736, 13738, 13739, 13742, 13745, 13747, 13750, 13753, 13756, 13764, 13767, 13772, 13773, 13774, 13775, 13779, 13780, 13782, 13783, 13785, 13786, 13787, 13791, 13793, 13795, 13796, 13798, 13799, 13809, 13816, 13817, 13818, 13819, 13822, 13823, 13828, 13830, 13831, 13834, 13835, 13843, 13848, 13849, 13852, 13858, 13860, 13862, 13866, 13867, 13869, 13870, 13872, 13873, 13874, 13875, 13877, 13885, 13887, 13891, 13892, 13895, 13897, 13898, 13899, 13901, 13904, 13906, 13907, 13908, 13909, 13910, 13911, 13917, 13918, 13919, 13920, 13921, 13924, 13925, 13927, 13929, 13934, 13944, 13947, 13948, 13949, 13950, 13953, 13954, 13958, 13960, 13963, 13969, 13970, 13975, 13984, 13986, 13987, 13991, 13999, 14000, 14001, 14005, 14006, 14009, 14010, 14013, 14014, 14018, 14022, 14027, 14030, 14031, 14035, 14036, 14038, 14040, 14043, 14049, 14051, 14052, 14059, 14062, 14063, 14066, 14067, 14069, 14070, 14071, 14072, 14073, 14075, 14076, 14078, 14081, 14085, 14086, 14087, 14088, 14092, 14094, 14096, 14102, 14105, 14111, 14112, 14116, 14118, 14119, 14121, 14122, 14124, 14129, 14130, 14132, 14133, 14135, 14138, 14139, 14142, 14145, 14146, 14147.

Promoters expressing in the embry at 12 days after pollination include SEQ IDs: 3, 7, 9, 12, 14, 15, 16, 17, 26, 27, 29, 31, 33, 34, 36, 37, 44, 48, 54, 56, 57, 63, 64, 65, 79, 80, 86, 88, 93, 94, 96, 98, 99, 100, 102, 103, 104, 110, 115, 121, 123, 130, 131, 132, 135, 137, 143, 146, 147, 148, 152, 154, 156, 157, 159, 162, 165, 168, 175, 176, 181, 183, 187, 191, 193, 194, 197, 199, 202, 203, 204, 205, 207, 211, 212, 214, 223, 224, 232, 235, 236, 237, 239, 240, 246, 249, 250, 251, 256, 257, 259, 264, 267, 271, 273, 286, 288, 289, 293, 294, 299, 301, 302, 308, 309, 314, 316, 319, 320, 322, 323, 328, 329, 332, 334, 335, 338, 340, 346, 349, 352, 353, 354, 355, 356, 358, 360, 364, 365, 371, 373, 374, 379, 381, 386, 388, 396, 401, 404, 411, 412, 414, 423, 428, 431, 432, 433, 436, 441, 448, 450, 452, 456, 459, 460, 461, 462, 463, 466, 468, 470, 471, 474, 478, 479, 483, 485, 488, 489, 496, 498, 502, 504, 505, 507, 509, 510, 511, 514, 515, 516, 517, 522, 523, 525, 532, 535, 536, 537, 541, 543, 544, 546, 547, 548, 549, 553, 554, 555, 556, 557, 560, 561, 563, 578, 580, 582, 585, 591, 598, 599, 601, 602, 605, 606, 607, 608, 613, 619, 620, 623, 631, 633, 635, 636, 637, 638, 643, 645, 647, 650, 661, 663, 664, 670, 671, 681, 683, 687, 693, 694, 701, 702, 705, 706, 707, 708, 709, 716, 717, 718, 721, 722, 723, 724, 727, 731, 732, 734, 736, 740, 742, 744, 749, 750, 753, 757, 759, 760, 762, 764, 765, 779, 781, 782, 783, 784, 792, 793, 795, 800, 804, 806, 808, 809, 811, 812, 820, 822, 824, 825, 826, 829, 830, 833, 845, 846, 849, 852, 855, 856, 857, 858, 862, 863, 865, 870, 871, 872, 875, 876, 877, 878, 882, 887, 890, 891, 892, 893, 895, 898, 899, 900, 903, 907, 908, 911, 912, 913, 915, 916, 917, 919, 920, 924, 928, 929, 931, 932, 934, 936, 938, 939, 942, 943, 944, 947, 948, 949, 951, 953, 955, 958, 960, 964, 971, 974, 976, 978, 979, 980, 981, 982, 984, 985, 991, 993, 994, 995, 997, 999, 1002, 1003, 1005, 1006, 1007, 1008, 1009, 1011, 1012, 1013, 1014, 1016, 1017, 1019, 1022, 1025, 1026, 1032, 1033, 1035, 1038, 1041, 1043, 1046, 1047, 1049, 1051, 1052, 1054, 1055, 1056, 1057, 1059, 1064, 1065, 1067, 1069, 1070, 1073, 1074, 1076, 1077, 1080, 1085, 1086, 1087, 1089, 1092, 1095, 1097, 1100, 1101, 1103, 1104, 1106, 1110, 1111, 1112, 1114, 1115, 1116, 1117, 1119, 1121, 1122, 1125, 1130, 1132, 1136, 1137, 1140, 1144, 1146, 1153, 1154, 1155, 1160, 1161, 1164, 1165, 1167, 1168, 1170, 1171, 1176, 1178, 1180, 1183, 1187, 1189, 1190, 1191, 1196, 1200, 1201, 1205, 1214, 1215, 1218, 1222, 1223, 1225, 1227, 1228, 1230, 1233, 1236, 1237, 1239, 1240, 1244, 1249, 1251, 1254, 1257, 1258, 1261, 1263, 1269, 1272, 1281, 1282, 1285, 1286, 1290, 1292, 1293, 1296, 1303, 1306, 1307, 1309, 1310, 1311, 1312, 1314, 1316, 1320, 1322, 1323, 1325, 1327, 1330, 1331, 1334, 1339, 1345, 1347, 1349, 1360, 1364, 1366, 1367, 1368, 1371, 1375, 1376, 1377, 1380, 1381, 1387, 1388, 1389, 1391, 1393, 1394, 1396, 1402, 1404, 1405, 1406, 1407, 1410, 1412, 1415, 1420, 1421, 1423, 1426, 1431, 1432, 1435, 1438, 1440, 1441, 1442, 1443, 1444, 1447, 1448, 1451, 1453, 1458, 1459, 1461, 1464, 1466, 1471, 1472, 1475, 1484, 1486, 1488, 1489, 1490, 1491, 1492, 1493, 1498, 1499, 1501, 1503, 1504, 1506, 1508, 1510, 1511, 1512, 1514, 1518, 1519, 1525, 1526, 1527, 1528, 1530, 1536, 1539, 1543, 1545, 1546, 1549, 1550, 1551, 1554, 1555, 1556, 1560, 1561, 1564, 1566, 1567, 1570, 1575, 1579, 1584, 1585, 1586, 1590, 1591, 1597, 1598, 1599, 1600, 1601, 1602, 1604, 1605, 1608, 1609, 1610, 1612, 1614, 1615, 1616, 1623, 1625, 1628, 1629, 1634, 1635, 1636, 1637, 1638, 1641, 1642, 1643, 1648, 1650, 1651, 1653, 1654, 1658, 1659, 1662, 1663, 1669, 1671, 1673, 1675, 1676, 1678, 1681, 1682, 1684, 1685, 1687, 1688, 1689, 1690, 1691, 1696, 1697, 1698, 1703, 1705, 1706, 1707, 1708, 1709, 1710, 1712, 1716, 1717, 1718, 1723, 1725, 1729, 1732, 1735, 1736, 1750, 1755, 1758, 1761, 1764, 1769, 1770, 1773, 1774, 1776, 1777, 1779, 1785, 1786, 1791, 1792, 1793, 1796, 1798, 1807, 1809, 1811, 1812, 1813, 1814, 1820, 1826, 1828, 1830, 1832, 1835, 1837, 1839, 1840, 1843, 1848, 1852, 1854, 1855, 1859, 1861, 1863, 1866, 1867, 1869, 1872, 1873, 1876, 1879, 1882, 1884, 1886, 1888, 1891, 1897, 1898, 1899, 1900, 1901, 1902, 1904, 1905, 1906, 1910, 1911, 1913, 1916, 1918, 1920, 1922, 1923, 1924, 1928, 1933, 1934, 1936, 1939, 1940, 1942, 1944, 1945, 1949, 1950, 1951, 1952, 1953, 1958, 1968, 1970, 1971, 1972, 1973, 1979, 1981, 1986, 1990, 1993, 1994, 1995, 1996, 1999, 2000, 2007, 2008, 2009, 2010, 2012, 2014, 2015, 2017, 2019, 2021, 2026, 2031, 2032, 2033, 2036, 2037, 2040, 2041, 2042, 2043, 2048, 2057, 2058, 2060, 2062, 2064, 2069, 2072, 2074, 2077, 2078, 2087, 2088, 2089, 2091, 2092, 2093, 2094, 2096, 2097, 2099, 2101, 2103, 2104, 2106, 2107, 2112, 2122, 2123, 2125, 2128, 2130, 2132, 2133, 2137, 2139, 2140, 2141, 2142, 2143, 2144, 2146, 2147, 2150, 2151, 2156, 2157, 2158, 2161, 2164, 2167, 2170, 2175, 2177, 2178, 2179, 2183, 2185, 2189, 2193, 2195, 2196, 2200, 2202, 2203, 2206, 2207, 2210, 2214, 2215, 2216, 2221, 2223, 2226, 2235, 2240, 2241, 2242, 2243, 2253, 2257, 2260, 2263, 2267, 2274, 2278, 2280, 2282, 2283, 2284, 2289, 2291, 2293, 2296, 2297, 2298, 2300, 2303, 2304, 2306, 2308, 2309, 2310, 2313, 2314, 2322, 2323, 2328, 2329, 2331, 2333, 2337, 2339, 2342, 2343, 2345, 2348, 2353, 2359, 2361, 2362, 2363, 2366, 2371, 2372, 2379, 2380, 2381, 2382, 2384, 2401, 2402, 2405, 2410, 2412, 2413, 2414, 2417, 2418, 2419, 2420, 2423, 2428, 2431, 2432, 2433, 2434, 2435, 2436, 2437, 2439, 2440, 2441, 2442, 2443, 2445, 2451, 2452, 2453, 2454, 2456, 2457, 2469, 2472, 2474, 2476, 2477, 2480, 2481, 2482, 2483, 2485, 2487, 2490, 2492, 2494, 2495, 2496, 2497, 2498, 2500, 2505, 2506, 2507, 2509, 2510, 2513, 2514, 2515, 2516, 2517, 2519, 2521, 2525, 2528, 2529, 2531, 2532, 2533, 2534, 2536, 2537, 2538, 2539, 2540, 2541, 2544, 2545, 2546, 2549, 2550, 2551, 2552, 2554, 2555, 2559, 2560, 2561, 2567, 2568, 2570, 2573, 2576, 2578, 2579, 2581, 2583, 2589, 2590, 2594, 2596, 2599, 2600, 2601, 2605, 2609, 2611, 2613, 2616, 2625, 2626, 2627, 2632, 2634, 2635, 2636, 2639, 2644, 2648, 2649, 2652, 2654, 2655, 2656, 2658, 2661, 2662, 2663, 2666, 2671, 2672, 2674, 2676, 2678, 2684, 2685, 2688, 2689, 2690, 2691, 2692, 2694, 2700, 2702, 2704, 2708, 2709, 2711, 2715, 2719, 2720, 2721, 2722, 2723, 2725, 2726, 2728, 2729, 2730, 2735, 2738, 2739, 2745, 2746, 2747, 2749, 2752, 2755, 2756, 2757, 2758, 2762, 2764, 2765, 2770, 2775, 2776, 2782, 2784, 2786, 2787, 2794, 2798, 2800, 2802, 2805, 2808, 2812, 2814, 2819, 2821, 2822, 2823, 2824, 2826, 2827, 2828, 2831, 2832, 2837, 2838, 2840, 2844, 2860, 2861, 2865, 2869, 2871, 2876, 2878, 2888, 2889, 2893, 2894, 2895, 2896, 2897, 2898, 2901, 2902, 2903, 2906, 2909, 2911, 2915, 2916, 2917, 2918, 2919, 2922, 2923, 2926, 2929, 2930, 2931, 2935, 2937, 2941, 2942, 2943, 2946, 2947, 2948, 2955, 2959, 2962, 2963, 2966, 2968, 2976, 2979, 2980, 2982, 2987, 2992, 2994, 3003, 3005, 3007, 3013, 3015, 3017, 3018, 3020, 3023, 3024, 3029, 3031, 3039, 3042, 3044, 3045, 3047, 3048, 3049, 3051, 3052, 3053, 3055, 3058, 3059, 3061, 3064, 3068, 3070, 3072, 3080, 3083, 3084, 3085, 3087, 3090, 3097, 3100, 3101, 3106, 3115, 3118, 3119, 3120, 3121, 3122, 3123, 3127, 3128, 3137, 3139, 3143, 3145, 3149, 3153, 3167, 3169, 3170, 3172, 3177, 3181, 3187, 3191, 3192, 3194, 3196, 3200, 3202, 3205, 3206, 3208, 3210, 3217, 3219, 3220, 3221, 3224, 3225, 3228, 3230, 3237, 3240, 3242, 3246, 3249, 3250, 3252, 3254, 3255, 3261, 3263, 3266, 3267, 3269, 3271, 3272, 3278, 3280, 3283, 3286, 3288, 3290, 3291, 3294, 3295, 3297, 3299, 3301, 3308, 3310, 3312, 3313, 3324, 3327, 3331, 3332, 3333, 3337, 3338, 3340, 3342, 3343, 3345, 3347, 3351, 3353, 3354, 3355, 3356, 3357, 3358, 3359, 3360, 3361, 3363, 3368, 3370, 3376, 3377, 3378, 3379, 3383, 3386, 3394, 3396, 3399, 3403, 3404, 3405, 3413, 3415, 3416, 3418, 3419, 3424, 3426, 3428, 3435, 3445, 3446, 3447, 3449, 3450, 3452, 3453, 3457, 3458, 3465, 3466, 3468, 3469, 3470, 3471, 3474, 3477, 3483, 3484, 3486, 3488, 3490, 3493, 3494, 3497, 3498, 3499, 3500, 3502, 3503, 3504, 3507, 3510, 3516, 3517, 3518, 3521, 3522, 3523, 3524, 3527, 3533, 3535, 3536, 3537, 3538, 3540, 3541, 3542, 3544, 3545, 3549, 3554, 3558, 3560, 3562, 3569, 3574, 3576, 3577, 3580, 3585, 3587, 3588, 3589, 3591, 3592, 3594, 3595, 3600, 3603, 3604, 3607, 3611, 3612, 3613, 3615, 3616, 3620, 3624, 3629, 3633, 3634, 3642, 3643, 3644, 3645, 3646, 3647, 3648, 3659, 3660, 3661, 3667, 3672, 3674, 3677, 3681, 3682, 3684, 3685, 3690, 3693, 3694, 3706, 3707, 3709, 3713, 3715, 3718, 3719, 3721, 3722, 3723, 3725, 3726, 3730, 3731, 3744, 3749, 3751, 3752, 3756, 3757, 3758, 3760, 3761, 3764, 3765, 3766, 3771, 3775, 3777, 3778, 3785, 3791, 3792, 3793, 3794, 3796, 3798, 3801, 3806, 3808, 3817, 3818, 3819, 3823, 3825, 3828, 3829, 3830, 3832, 3833, 3837, 3838, 3843, 3844, 3845, 3846, 3847, 3849, 3852, 3858, 3859, 3860, 3867, 3868, 3870, 3871, 3872, 3873, 3878, 3881, 3882, 3883, 3884, 3885, 3887, 3889, 3890, 3892, 3894, 3896, 3897, 3899, 3902, 3903, 3904, 3907, 3908, 3912, 3913, 3917, 3918, 3928, 3929, 3931, 3933, 3935, 3938, 3947, 3950, 3951, 3952, 3954, 3958, 3962, 3967, 3968, 3970, 3971, 3974, 3975, 3978, 3983, 3985, 3987, 3988, 3994, 3996, 3997, 3998, 4000, 4007, 4008, 4013, 4014, 4019, 4020, 4021, 4030, 4033, 4037, 4039, 4040, 4041, 4042, 4043, 4046, 4047, 4048, 4049, 4050, 4051, 4052, 4053, 4054, 4056, 4057, 4058, 4062, 4066, 4067, 4068, 4070, 4072, 4075, 4079, 4080, 4084, 4088, 4090, 4092, 4094, 4095, 4098, 4099, 4102, 4105, 4106, 4109, 4110, 4113, 4116, 4124, 4126, 4128, 4133, 4134, 4139, 4140, 4143, 4144, 4146, 4147, 4149, 4150, 4151, 4160, 4163, 4164, 4165, 4166, 4167, 4168, 4170, 4171, 4173, 4178, 4181, 4183, 4185, 4187, 4188, 4189, 4190, 4191, 4192, 4193, 4194, 4195, 4201, 4202, 4204, 4205, 4206, 4207, 4208, 4210, 4211, 4212, 4213, 4214, 4219, 4221, 4227, 4228, 4229, 4233, 4234, 4235, 4237, 4241, 4244, 4245, 4246, 4250, 4251, 4252, 4257, 4261, 4266, 4270, 4272, 4275, 4276, 4278, 4280, 4281, 4282, 4283, 4284, 4288, 4294, 4296, 4298, 4300, 4301, 4302, 4303, 4305, 4306, 4309, 4312, 4320, 4321, 4324, 4329, 4330, 4335, 4336, 4337, 4338, 4341, 4344, 4347, 4358, 4359, 4360, 4369, 4370, 4375, 4378, 4380, 4383, 4388, 4390, 4391, 4396, 4397, 4401, 4402, 4403, 4404, 4405, 4409, 4410, 4419, 4422, 4423, 4425, 4432, 4439, 4440, 4442, 4443, 4446, 4448, 4449, 4450, 4453, 4458, 4461, 4462, 4463, 4466, 4468, 4470, 4474, 4475, 4477, 4479, 4485, 4486, 4492, 4494, 4498, 4500, 4502, 4507, 4508, 4512, 4514, 4515, 4519, 4521, 4522, 4525, 4529, 4531, 4535, 4545, 4548, 4549, 4551, 4554, 4555, 4556, 4557, 4558, 4560, 4562, 4563, 4565, 4567, 4568, 4575, 4576, 4580, 4582, 4583, 4585, 4590, 4591, 4594, 4597, 4598, 4601, 4606, 4616, 4618, 4623, 4625, 4628, 4630, 4632, 4633, 4634, 4635, 4636, 4639, 4641, 4643, 4644, 4645, 4647, 4650, 4651, 4653, 4654, 4655, 4656, 4657, 4658, 4659, 4662, 4664, 4667, 4669, 4671, 4673, 4674, 4676, 4677, 4680, 4682, 4685, 4691, 4692, 4694, 4697, 4700, 4704, 4706, 4708, 4710, 4711, 4713, 4719, 4721, 4723, 4724, 4730, 4734, 4736, 4737, 4738, 4739, 4740, 4741, 4745, 4749, 4750, 4753, 4755, 4756, 4761, 4762, 4764, 4765, 4766, 4769, 4770, 4771, 4773, 4775, 4779, 4780, 4784, 4787, 4788, 4789, 4790, 4794, 4795, 4796, 4801, 4803, 4804, 4805, 4806, 4807, 4813, 4818, 4822, 4827, 4828, 4830, 4831, 4834, 4836, 4838, 4840, 4841, 4842, 4855, 4856, 4857, 4859, 4861, 4862, 4863, 4869, 4871, 4874, 4875, 4876, 4878, 4880, 4881, 4887, 4889, 4891, 4895, 4896, 4897, 4900, 4902, 4904, 4905, 4907, 4909, 4910, 4913, 4914, 4921, 4922, 4924, 4926, 4930, 4935, 4936, 4941, 4942, 4950, 4954, 4956, 4958, 4959, 4967, 4969, 4971, 4972, 4974, 4975, 4983, 4987, 4989, 4990, 4993, 4994, 4996, 5000, 5015, 5016, 5024, 5026, 5027, 5029, 5030, 5034, 5036, 5037, 5038, 5039, 5040, 5041, 5042, 5044, 5045, 5046, 5051, 5052, 5054, 5057, 5060, 5068, 5069, 5072, 5074, 5075, 5078, 5079, 5082, 5087, 5088, 5089, 5090, 5094, 5095, 5100, 5101, 5102, 5106, 5111, 5113, 5114, 5116, 5119, 5120, 5129, 5131, 5132, 5140, 5143, 5145, 5148, 5149, 5151, 5153, 5157, 5159, 5160, 5164, 5165, 5168, 5170, 5172, 5174, 5180, 5181, 5182, 5184, 5185, 5187, 5188, 5189, 5190, 5191, 5192, 5195, 5196, 5198, 5200, 5202, 5203, 5206, 5212, 5213, 5218, 5219, 5224, 5225, 5229, 5234, 5237, 5238, 5241, 5243, 5244, 5245, 5249, 5251, 5252, 5253, 5254, 5255, 5256, 5257, 5258, 5260, 5261, 5263, 5267, 5268, 5269, 5273, 5274, 5275, 5276, 5280, 5281, 5282, 5283, 5286, 5289, 5293, 5297, 5298, 5299, 5300, 5301, 5308, 5311, 5317, 5319, 5321, 5324, 5329, 5330, 5333, 5334, 5338, 5339, 5342, 5345, 5346, 5348, 5349, 5351, 5352, 5366, 5367, 5369, 5371, 5386, 5388, 5389, 5391, 5393, 5395, 5396, 5397, 5398, 5402, 5405, 5409, 5411, 5413, 5414, 5417, 5418, 5422, 5427, 5428, 5431, 5433, 5434, 5437, 5438, 5445, 5446, 5448, 5449, 5450, 5452, 5453, 5456, 5458, 5459, 5461, 5472, 5475, 5483, 5485, 5487, 5488, 5491, 5493, 5495, 5496, 5505, 5506, 5508, 5510, 5512, 5513, 5518, 5519, 5524, 5526, 5529, 5530, 5531, 5534, 5535, 5543, 5545, 5549, 5554, 5557, 5562, 5563, 5565, 5566, 5568, 5569, 5572, 5575, 5579, 5581, 5582, 5584, 5585, 5589, 5591, 5593, 5594, 5597, 5602, 5608, 5610, 5611, 5612, 5613, 5614, 5615, 5616, 5620, 5621, 5623, 5624, 5627, 5633, 5635, 5638, 5640, 5643, 5647, 5648, 5651, 5652, 5653, 5656, 5659, 5660, 5662, 5663, 5667, 5669, 5673, 5675, 5676, 5680, 5681, 5689, 5690, 5694, 5695, 5697, 5698, 5702, 5706, 5709, 5711, 5712, 5713, 5718, 5719, 5721, 5722, 5729, 5730, 5731, 5732, 5734, 5735, 5736, 5737, 5742, 5744, 5751, 5768, 5770, 5771, 5775, 5778, 5780, 5782, 5785, 5787, 5791, 5794, 5807, 5808, 5811, 5813, 5814, 5815, 5817, 5820, 5826, 5828, 5832, 5833, 5834, 5835, 5836, 5837, 5839, 5842, 5844, 5854, 5859, 5864, 5866, 5867, 5869, 5871, 5872, 5873, 5875, 5876, 5877, 5878, 5879, 5881, 5882, 5883, 5884, 5888, 5889, 5892, 5893, 5900, 5902, 5906, 5910, 5912, 5913, 5914, 5918, 5919, 5921, 5922, 5923, 5925, 5926, 5927, 5928, 5930, 5931, 5932, 5933, 5936, 5938, 5939, 5941, 5942, 5944, 5945, 5946, 5948, 5951, 5952, 5954, 5956, 5957, 5959, 5961, 5968, 5971, 5978, 5980, 5985, 5986, 5988, 5991, 5992, 5996, 5997, 6000, 6002, 6003, 6004, 6006, 6007, 6010, 6012, 6013, 6016, 6017, 6023, 6025, 6026, 6034, 6038, 6040, 6041, 6042, 6044, 6047, 6048, 6051, 6053, 6054, 6058, 6059, 6062, 6063, 6068, 6069, 6070, 6072, 6073, 6074, 6075, 6080, 6081, 6085, 6088, 6089, 6092, 6093, 6094, 6095, 6097, 6098, 6107, 6108, 6109, 6110, 6112, 6113, 6116, 6119, 6122, 6129, 6130, 6131, 6132, 6133, 6135, 6136, 6137, 6138, 6140, 6143, 6145, 6146, 6147, 6149, 6151, 6152, 6153, 6156, 6160, 6163, 6164, 6165, 6168, 6176, 6181, 6182, 6183, 6186, 6188, 6189, 6190, 6191, 6193, 6197, 6198, 6200, 6205, 6207, 6209, 6212, 6215, 6223, 6224, 6226, 6227, 6228, 6230, 6231, 6234, 6238, 6240, 6241, 6243, 6244, 6245, 6246, 6247, 6248, 6249, 6251, 6255, 6257, 6258, 6259, 6260, 6264, 6265, 6269, 6270, 6271, 6272, 6273, 6275, 6278, 6279, 6280, 6282, 6283, 6284, 6285, 6286, 6289, 6292, 6294, 6295, 6299, 6302, 6309, 6310, 6311, 6312, 6315, 6317, 6319, 6321, 6322, 6325, 6328, 6333, 6334, 6338, 6342, 6345, 6346, 6351, 6352, 6353, 6354, 6359, 6362, 6363, 6367, 6370, 6372, 6373, 6375, 6378, 6379, 6381, 6383, 6394, 6395, 6396, 6398, 6399, 6403, 6405, 6407, 6410, 6412, 6413, 6414, 6415, 6419, 6420, 6425, 6427, 6428, 6429, 6430, 6431, 6434, 6435, 6436, 6437, 6440, 6441, 6442, 6454, 6458, 6459, 6464, 6466, 6467, 6468, 6469, 6470, 6471, 6474, 6476, 6480, 6481, 6484, 6486, 6488, 6492, 6493, 6495, 6500, 6501, 6502, 6503, 6504, 6505, 6510, 6513, 6516, 6517, 6519, 6524, 6525, 6526, 6530, 6533, 6534, 6535, 6537, 6539, 6543, 6544, 6547, 6548, 6549, 6554, 6555, 6558, 6560, 6561, 6563, 6567, 6574, 6576, 6577, 6579, 6581, 6582, 6584, 6587, 6588, 6589, 6594, 6595, 6599, 6600, 6603, 6607, 6611, 6614, 6620, 6621, 6622, 6624, 6626, 6627, 6630, 6634, 6635, 6637, 6638, 6639, 6640, 6643, 6644, 6649, 6650, 6655, 6656, 6658, 6662, 6666, 6671, 6672, 6677, 6681, 6686, 6691, 6692, 6695, 6696, 6703, 6705, 6706, 6711, 6714, 6716, 6718, 6720, 6724, 6725, 6729, 6734, 6736, 6737, 6739, 6746, 6747, 6748, 6752, 6757, 6758, 6759, 6760, 6761, 6764, 6766, 6767, 6778, 6779, 6780, 6786, 6789, 6792, 6793, 6794, 6797, 6799, 6803, 6804, 6805, 6807, 6810, 6811, 6812, 6813, 6816, 6819, 6820, 6821, 6824, 6827, 6828, 6829, 6830, 6831, 6836, 6837, 6839, 6840, 6841, 6842, 6843, 6845, 6851, 6852, 6859, 6863, 6864, 6865, 6869, 6870, 6872, 6874, 6875, 6876, 6877, 6878, 6879, 6880, 6882, 6883, 6886, 6888, 6890, 6897, 6903, 6904, 6907, 6914, 6915, 6917, 6919, 6920, 6921, 6923, 6924, 6930, 6933, 6936, 6941, 6943, 6946, 6948, 6959, 6960, 6963, 6969, 6979, 6980, 6984, 6985, 6987, 6988, 6990, 6991, 6993, 6994, 6995, 6997, 6999, 7002, 7003, 7006, 7009, 7011, 7012, 7013, 7015, 7017, 7022, 7031, 7032, 7039, 7042, 7043, 7045, 7046, 7051, 7052, 7053, 7056, 7057, 7060, 7062, 7064, 7067, 7072, 7073, 7075, 7077, 7083, 7085, 7086, 7093, 7094, 7105, 7106, 7107, 7108, 7112, 7116, 7117, 7118, 7124, 7130, 7132, 7134, 7135, 7140, 7142, 7144, 7146, 7149, 7155, 7163, 7164, 7165, 7166, 7169, 7176, 7177, 7182, 7183, 7184, 7187, 7188, 7192, 7194, 7196, 7201, 7203, 7206, 7207, 7208, 7209, 7211, 7212, 7216, 7217, 7227, 7228, 7230, 7231, 7232, 7233, 7234, 7235, 7236, 7239, 7241, 7243, 7244, 7245, 7255, 7257, 7258, 7259, 7262, 7267, 7268, 7274, 7276, 7277, 7281, 7282, 7284, 7287, 7288, 7290, 7291, 7292, 7293, 7299, 7300, 7301, 7303, 7304, 7305, 7306, 7307, 7308, 7310, 7312, 7313, 7315, 7317, 7321, 7328, 7330, 7334, 7336, 7339, 7340, 7344, 7348, 7354, 7355, 7356, 7357, 7358, 7361, 7363, 7365, 7371, 7373, 7379, 7380, 7381, 7382, 7383, 7386, 7388, 7389, 7392, 7395, 7398, 7400, 7409, 7410, 7411, 7417, 7418, 7424, 7425, 7427, 7428, 7430, 7431, 7434, 7435, 7436, 7438, 7443, 7444, 7445, 7446, 7447, 7448, 7452, 7454, 7458, 7459, 7464, 7466, 7470, 7472, 7474, 7476, 7483, 7486, 7487, 7490, 7492, 7493, 7498, 7504, 7505, 7506, 7512, 7515, 7517, 7518, 7523, 7524, 7525, 7528, 7529, 7533, 7534, 7538, 7546, 7547, 7554, 7557, 7561, 7572, 7574, 7577, 7578, 7579, 7580, 7583, 7585, 7586, 7587, 7590, 7591, 7593, 7594, 7598, 7601, 7605, 7607, 7611, 7618, 7619, 7620, 7621, 7623, 7624, 7633, 7638, 7639, 7640, 7642, 7643, 7647, 7652, 7653, 7658, 7661, 7663, 7664, 7665, 7666, 7667, 7674, 7677, 7682, 7685, 7687, 7689, 7695, 7699, 7700, 7703, 7704, 7708, 7712, 7713, 7716, 7718, 7719, 7724, 7725, 7726, 7729, 7733, 7736, 7737, 7738, 7740, 7743, 7744, 7745, 7747, 7748, 7751, 7753, 7761, 7762, 7763, 7767, 7768, 7769, 7770, 7772, 7774, 7775, 7777, 7778, 7779, 7780, 7782, 7783, 7785, 7786, 7788, 7791, 7792, 7793, 7796, 7798, 7799, 7800, 7803, 7804, 7806, 7807, 7812, 7815, 7818, 7819, 7820, 7824, 7825, 7832, 7833, 7834, 7838, 7841, 7844, 7847, 7848, 7849, 7850, 7852, 7856, 7858, 7859, 7860, 7862, 7863, 7865, 7875, 7876, 7878, 7880, 7888, 7890, 7896, 7900, 7908, 7911, 7917, 7918, 7920, 7921, 7923, 7925, 7927, 7928, 7929, 7933, 7934, 7935, 7936, 7937, 7938, 7942, 7944, 7945, 7947, 7948, 7949, 7952, 7955, 7956, 7964, 7972, 7974, 7976, 7978, 7980, 7981, 7983, 7984, 7986, 7989, 7990, 7991, 7993, 7998, 8002, 8004, 8006, 8007, 8008, 8009, 8012, 8021, 8026, 8029, 8036, 8038, 8039, 8042, 8044, 8047, 8048, 8053, 8056, 8058, 8059, 8061, 8063, 8067, 8068, 8071, 8072, 8075, 8076, 8077, 8078, 8079, 8080, 8082, 8084, 8088, 8091, 8093, 8095, 8100, 8102, 8103, 8105, 8106, 8112, 8115, 8118, 8121, 8126, 8134, 8136, 8137, 8145, 8146, 8148, 8150, 8151, 8159, 8162, 8163, 8165, 8168, 8170, 8176, 8178, 8179, 8182, 8186, 8187, 8188, 8189, 8193, 8195, 8199, 8202, 8204, 8207, 8208, 8210, 8211, 8213, 8216, 8219, 8220, 8223, 8225, 8227, 8231, 8234, 8235, 8237, 8239, 8242, 8245, 8250, 8252, 8253, 8257, 8258, 8265, 8266, 8268, 8269, 8270, 8272, 8289, 8291, 8293, 8294, 8300, 8301, 8304, 8306, 8310, 8311, 8312, 8318, 8319, 8320, 8321, 8323, 8329, 8331, 8336, 8339, 8340, 8349, 8350, 8352, 8353, 8355, 8363, 8367, 8368, 8369, 8373, 8379, 8382, 8386, 8389, 8390, 8392, 8393, 8395, 8398, 8401, 8402, 8403, 8404, 8405, 8410, 8413, 8414, 8416, 8423, 8430, 8433, 8435, 8436, 8438, 8439, 8441, 8442, 8444, 8446, 8447, 8448, 8450, 8451, 8452, 8456, 8465, 8466, 8469, 8470, 8472, 8473, 8474, 8476, 8480, 8481, 8482, 8485, 8486, 8490, 8493, 8494, 8498, 8499, 8501, 8505, 8507, 8509, 8511, 8513, 8515, 8517, 8520, 8523, 8524, 8525, 8528, 8531, 8533, 8537, 8538, 8539, 8542, 8543, 8545, 8549, 8550, 8552, 8553, 8554, 8558, 8561, 8562, 8565, 8566, 8568, 8575, 8576, 8579, 8580, 8581, 8582, 8589, 8590, 8592, 8593, 8594, 8596, 8597, 8600, 8601, 8602, 8603, 8604, 8605, 8611, 8612, 8613, 8614, 8617, 8618, 8628, 8630, 8631, 8634, 8635, 8637, 8638, 8640, 8641, 8642, 8644, 8648, 8650, 8654, 8657, 8658, 8659, 8660, 8665, 8669, 8670, 8672, 8676, 8677, 8685, 8693, 8694, 8699, 8700, 8703, 8704, 8706, 8708, 8709, 8713, 8716, 8717, 8720, 8726, 8727, 8729, 8731, 8732, 8734, 8735, 8736, 8740, 8741, 8742, 8744, 8745, 8746, 8748, 8751, 8752, 8753, 8757, 8764, 8767, 8772, 8773, 8775, 8777, 8779, 8783, 8784, 8789, 8792, 8796, 8797, 8803, 8805, 8808, 8810, 8818, 8821, 8822, 8824, 8829, 8831, 8832, 8835, 8838, 8839, 8841, 8843, 8846, 8853, 8854, 8859, 8861, 8865, 8867, 8876, 8878, 8881, 8883, 8886, 8888, 8891, 8892, 8896, 8899, 8900, 8902, 8905, 8907, 8908, 8909, 8910, 8911, 8913, 8914, 8916, 8917, 8919, 8924, 8926, 8929, 8930, 8935, 8938, 8941, 8942, 8945, 8946, 8949, 8951, 8952, 8954, 8956, 8957, 8959, 8960, 8961, 8962, 8963, 8967, 8968, 8969, 8972, 8974, 8976, 8977, 8979, 8980, 8981, 8982, 8985, 8986, 8992, 8996, 8998, 8999, 9001, 9002, 9003, 9006, 9009, 9012, 9015, 9018, 9020, 9021, 9023, 9029, 9030, 9037, 9044, 9052, 9057, 9058, 9059, 9060, 9061, 9066, 9069, 9071, 9072, 9073, 9076, 9084, 9088, 9091, 9092, 9095, 9096, 9097, 9103, 9108, 9110, 9111, 9112, 9114, 9115, 9118, 9123, 9125, 9129, 9133, 9134, 9138, 9139, 9140, 9141, 9142, 9146, 9149, 9151, 9152, 9154, 9155, 9167, 9168, 9173, 9174, 9175, 9177, 9181, 9183, 9185, 9187, 9188, 9190, 9191, 9195, 9204, 9205, 9206, 9207, 9210, 9211, 9213, 9215, 9216, 9218, 9226, 9229, 9231, 9233, 9237, 9241, 9243, 9247, 9249, 9252, 9253, 9254, 9255, 9263, 9267, 9269, 9270, 9273, 9276, 9278, 9284, 9285, 9288, 9290, 9292, 9293, 9299, 9300, 9308, 9311, 9314, 9316, 9320, 9321, 9323, 9325, 9326, 9327, 9328, 9329, 9330, 9336, 9337, 9338, 9339, 9340, 9341, 9345, 9346, 9347, 9348, 9353, 9354, 9355, 9357, 9359, 9366, 9367, 9373, 9375, 9376, 9378, 9382, 9383, 9388, 9391, 9392, 9393, 9394, 9396, 9400, 9402, 9403, 9404, 9406, 9407, 9413, 9417, 9423, 9432, 9433, 9434, 9440, 9442, 9443, 9444, 9449, 9451, 9452, 9456, 9459, 9460, 9468, 9470, 9471, 9472, 9473, 9478, 9482, 9483, 9488, 9490, 9494, 9495, 9497, 9500, 9501, 9502, 9503, 9504, 9509, 9513, 9514, 9515, 9517, 9518, 9519, 9528, 9531, 9532, 9533, 9534, 9536, 9540, 9545, 9546, 9548, 9553, 9555, 9563, 9564, 9565, 9568, 9571, 9573, 9577, 9582, 9583, 9587, 9589, 9590, 9591, 9597, 9602, 9606, 9609, 9610, 9613, 9618, 9620, 9623, 9624, 9626, 9627, 9628, 9629, 9632, 9633, 9635, 9640, 9641, 9642, 9644, 9645, 9646, 9648, 9649, 9650, 9652, 9653, 9655, 9657, 9658, 9660, 9666, 9670, 9677, 9679, 9681, 9682, 9686, 9687, 9692, 9693, 9694, 9698, 9706, 9707, 9717, 9718, 9723, 9725, 9726, 9729, 9730, 9731, 9733, 9734, 9737, 9746, 9750, 9751, 9753, 9754, 9756, 9761, 9763, 9764, 9767, 9768, 9770, 9776, 9780, 9781, 9782, 9784, 9791, 9792, 9793, 9794, 9796, 9799, 9801, 9802, 9806, 9810, 9812, 9813, 9814, 9816, 9819, 9820, 9824, 9825, 9826, 9829, 9830, 9833, 9835, 9836, 9845, 9846, 9847, 9849, 9850, 9851, 9853, 9854, 9861, 9864, 9866, 9869, 9871, 9873, 9882, 9885, 9886, 9887, 9892, 9897, 9898, 9900, 9901, 9906, 9907, 9908, 9909, 9910, 9912, 9923, 9924, 9928, 9935, 9938, 9940, 9944, 9946, 9947, 9949, 9950, 9953, 9955, 9958, 9960, 9962, 9963, 9964, 9967, 9968, 9971, 9972, 9979, 9980, 9982, 9984, 9985, 9987, 9990, 9996, 9997, 9998, 10000, 10009, 10010, 10012, 10013, 10017, 10019, 10021, 10022, 10026, 10031, 10032, 10033, 10034, 10035, 10038, 10041, 10042, 10043, 10045, 10048, 10051, 10052, 10054, 10056, 10058, 10059, 10060, 10062, 10063, 10064, 10066, 10068, 10073, 10075, 10077, 10078, 10083, 10089, 10091, 10092, 10093, 10095, 10101, 10102, 10103, 10105, 10106, 10107, 10108, 10109, 10110, 10114, 10115, 10116, 10118, 10122, 10127, 10128, 10131, 10132, 10136, 10143, 10146, 10147, 10149, 10151, 10152, 10158, 10160, 10162, 10163, 10165, 10166, 10168, 10170, 10174, 10176, 10178, 10181, 10182, 10191, 10192, 10193, 10194, 10195, 10197, 10199, 10203, 10209, 10212, 10214, 10218, 10219, 10220, 10222, 10223, 10225, 10228, 10232, 10233, 10236, 10237, 10239, 10247, 10252, 10253, 10255, 10257, 10270, 10275, 10284, 10291, 10292, 10293, 10295, 10296, 10297, 10300, 10302, 10306, 10307, 10311, 10321, 10323, 10325, 10326, 10328, 10331, 10333, 10334, 10335, 10336, 10343, 10346, 10351, 10353, 10356, 10357, 10359, 10360, 10362, 10364, 10368, 10371, 10373, 10375, 10376, 10378, 10380, 10381, 10384, 10385, 10388, 10389, 10395, 10397, 10398, 10399, 10400, 10401, 10408, 10410, 10413, 10414, 10416, 10421, 10422, 10423, 10425, 10427, 10428, 10430, 10435, 10437, 10438, 10440, 10442, 10443, 10446, 10447, 10448, 10449, 10450, 10451, 10453, 10456, 10460, 10463, 10464, 10465, 10468, 10469, 10470, 10472, 10473, 10474, 10478, 10480, 10482, 10487, 10488, 10492, 10494, 10496, 10497, 10504, 10506, 10508, 10513, 10514, 10515, 10518, 10525, 10527, 10528, 10530, 10531, 10533, 10535, 10536, 10537, 10541, 10542, 10543, 10544, 10547, 10548, 10549, 10550, 10551, 10555, 10556, 10558, 10560, 10561, 10562, 10565, 10567, 10569, 10573, 10580, 10581, 10582, 10583, 10585, 10590, 10591, 10593, 10595, 10596, 10597, 10599, 10601, 10602, 10610, 10611, 10613, 10614, 10615, 10616, 10617, 10621, 10622, 10623, 10626, 10629, 10630, 10631, 10633, 10634, 10636, 10637, 10638, 10639, 10640, 10641, 10642, 10643, 10645, 10646, 10649, 10650, 10655, 10657, 10659, 10663, 10665, 10666, 10668, 10670, 10674, 10678, 10681, 10682, 10683, 10684, 10685, 10686, 10687, 10689, 10693, 10697, 10698, 10699, 10700, 10702, 10703, 10705, 10707, 10710, 10711, 10715, 10716, 10721, 10722, 10725, 10726, 10727, 10732, 10734, 10735, 10736, 10737, 10738, 10740, 10741, 10744, 10745, 10748, 10749, 10752, 10761, 10762, 10763, 10766, 10775, 10776, 10777, 10778, 10779, 10782, 10784, 10785, 10787, 10788, 10790, 10791, 10792, 10795, 10796, 10798, 10801, 10803, 10805, 10809, 10810, 10812, 10815, 10818, 10819, 10820, 10821, 10824, 10825, 10826, 10830, 10831, 10832, 10833, 10836, 10838, 10839, 10840, 10841, 10843, 10846, 10847, 10850, 10852, 10853, 10854, 10857, 10858, 10860, 10861, 10862, 10867, 10871, 10874, 10877, 10880, 10881, 10887, 10892, 10896, 10897, 10898, 10899, 10902, 10905, 10910, 10912, 10917, 10920, 10926, 10927, 10930, 10933, 10934, 10935, 10936, 10937, 10938, 10940, 10941, 10944, 10947, 10948, 10950, 10954, 10957, 10960, 10962, 10963, 10965, 10967, 10972, 10976, 10977, 10978, 10979, 10981, 10985, 10988, 10993, 10995, 10996, 10997, 10998, 10999, 11002, 11004, 11005, 11006, 11008, 11009, 11010, 11018, 11024, 11027, 11032, 11039, 11046, 11047, 11052, 11053, 11056, 11058, 11060, 11061, 11066, 11068, 11070, 11078, 11080, 11082, 11083, 11086, 11090, 11095, 11098, 11100, 11102, 11103, 11105, 11107, 11108, 11110, 11114, 11116, 11118, 11119, 11123, 11124, 11125, 11127, 11129, 11135, 11136, 11137, 11138, 11141, 11145, 11146, 11148, 11153, 11154, 11158, 11159, 11160, 11161, 11162, 11163, 11165, 11166, 11168, 11169, 11175, 11177, 11184, 11187, 11188, 11190, 11191, 11192, 11194, 11198, 11199, 11201, 11202, 11207, 11214, 11217, 11218, 11222, 11226, 11227, 11228, 11229, 11232, 11233, 11234, 11235, 11236, 11237, 11238, 11239, 11244, 11246, 11247, 11248, 11254, 11255, 11256, 11257, 11258, 11259, 11260, 11262, 11263, 11264, 11266, 11274, 11275, 11278, 11286, 11288, 11289, 11290, 11291, 11292, 11293, 11294, 11295, 11298, 11305, 11306, 11307, 11313, 11315, 11316, 11319, 11320, 11322, 11324, 11326, 11329, 11330, 11331, 11332, 11338, 11339, 11340, 11345, 11346, 11348, 11352, 11356, 11358, 11363, 11364, 11365, 11370, 11371, 11373, 11377, 11381, 11382, 11385, 11387, 11388, 11389, 11391, 11392, 11394, 11397, 11403, 11405, 11406, 11409, 11411, 11412, 11413, 11414, 11416, 11418, 11423, 11426, 11430, 11431, 11434, 11437, 11438, 11443, 11445, 11446, 11449, 11459, 11463, 11465, 11466, 11467, 11471, 11472, 11473, 11475, 11476, 11477, 11478, 11481, 11482, 11485, 11487, 11490, 11494, 11496, 11497, 11498, 11500, 11501, 11503, 11506, 11507, 11508, 11509, 11512, 11516, 11518, 11520, 11526, 11528, 11530, 11531, 11532, 11533, 11534, 11535, 11538, 11540, 11541, 11544, 11546, 11548, 11551, 11553, 11558, 11560, 11561, 11567, 11571, 11576, 11577, 11578, 11580, 11583, 11585, 11586, 11588, 11589, 11593, 11594, 11595, 11597, 11598, 11599, 11604, 11610, 11615, 11618, 11620, 11621, 11623, 11625, 11627, 11628, 11629, 11632, 11633, 11636, 11637, 11639, 11642, 11650, 11651, 11652, 11654, 11655, 11656, 11657, 11658, 11663, 11664, 11667, 11669, 11673, 11677, 11678, 11681, 11682, 11683, 11684, 11688, 11691, 11692, 11693, 11694, 11695, 11699, 11701, 11703, 11705, 11707, 11708, 11711, 11712, 11718, 11720, 11721, 11725, 11726, 11731, 11733, 11736, 11740, 11743, 11744, 11753, 11755, 11756, 11759, 11760, 11761, 11762, 11763, 11764, 11765, 11766, 11767, 11770, 11771, 11776, 11780, 11782, 11783, 11784, 11785, 11786, 11790, 11792, 11795, 11799, 11800, 11809, 11812, 11813, 11814, 11816, 11818, 11819, 11823, 11826, 11828, 11830, 11837, 11841, 11848, 11849, 11850, 11851, 11853, 11854, 11856, 11857, 11858, 11861, 11863, 11864, 11865, 11868, 11870, 11872, 11876, 11877, 11878, 11879, 11886, 11890, 11891, 11894, 11898, 11899, 11903, 11909, 11911, 11913, 11919, 11920, 11921, 11922, 11923, 11926, 11928, 11929, 11930, 11934, 11935, 11939, 11940, 11941, 11943, 11946, 11947, 11948, 11949, 11953, 11955, 11957, 11958, 11959, 11960, 11961, 11962, 11963, 11965, 11966, 11968, 11976, 11977, 11978, 11979, 11980, 11983, 11988, 11993, 11994, 11995, 11996, 11997, 11998, 11999, 12002, 12004, 12008, 12019, 12020, 12021, 12023, 12024, 12025, 12029, 12032, 12042, 12043, 12044, 12047, 12050, 12051, 12054, 12059, 12060, 12061, 12064, 12066, 12068, 12077, 12078, 12079, 12080, 12081, 12083, 12085, 12086, 12091, 12092, 12093, 12097, 12098, 12102, 12104, 12106, 12109, 12110, 12112, 12115, 12118, 12120, 12122, 12126, 12128, 12129, 12131, 12134, 12135, 12137, 12138, 12139, 12143, 12144, 12145, 12146, 12147, 12148, 12149, 12151, 12153, 12155, 12161, 12162, 12165, 12166, 12167, 12170, 12171, 12174, 12175, 12179, 12181, 12187, 12197, 12200, 12201, 12202, 12204, 12208, 12212, 12214, 12215, 12217, 12220, 12223, 12227, 12230, 12233, 12234, 12237, 12241, 12243, 12245, 12246, 12249, 12250, 12252, 12253, 12254, 12255, 12256, 12259, 12269, 12271, 12278, 12280, 12281, 12283, 12285, 12286, 12287, 12288, 12295, 12296, 12310, 12311, 12312, 12313, 12314, 12315, 12317, 12319, 12321, 12323, 12325, 12331, 12334, 12335, 12337, 12339, 12342, 12343, 12345, 12347, 12350, 12354, 12356, 12359, 12364, 12366, 12369, 12370, 12375, 12376, 12379, 12381, 12385, 12390, 12393, 12394, 12397, 12400, 12401, 12403, 12406, 12410, 12411, 12414, 12415, 12416, 12419, 12420, 12423, 12424, 12426, 12427, 12428, 12437, 12440, 12441, 12444, 12445, 12446, 12450, 12451, 12455, 12456, 12457, 12459, 12461, 12462, 12465, 12467, 12468, 12470, 12472, 12473, 12477, 12478, 12479, 12480, 12481, 12488, 12489, 12492, 12494, 12495, 12497, 12503, 12508, 12510, 12511, 12512, 12513, 12514, 12515, 12518, 12519, 12527, 12529, 12530, 12532, 12535, 12536, 12537, 12538, 12539, 12540, 12546, 12547, 12548, 12549, 12551, 12552, 12554, 12555, 12556, 12561, 12563, 12565, 12567, 12568, 12570, 12572, 12578, 12580, 12583, 12585, 12586, 12588, 12589, 12591, 12597, 12600, 12603, 12605, 12608, 12609, 12610, 12611, 12616, 12620, 12622, 12623, 12626, 12628, 12629, 12630, 12631, 12634, 12638, 12639, 12640, 12641, 12644, 12648, 12649, 12650, 12651, 12654, 12655, 12663, 12664, 12668, 12670, 12671, 12674, 12679, 12680, 12681, 12683, 12684, 12685, 12688, 12689, 12691, 12693, 12695, 12696, 12699, 12701, 12702, 12705, 12706, 12710, 12713, 12714, 12716, 12723, 12731, 12732, 12733, 12735, 12737, 12738, 12739, 12740, 12741, 12742, 12752, 12753, 12754, 12755, 12757, 12758, 12760, 12764, 12765, 12766, 12771, 12772, 12773, 12775, 12777, 12782, 12790, 12793, 12794, 12797, 12800, 12802, 12803, 12807, 12810, 12812, 12813, 12817, 12820, 12822, 12823, 12824, 12826, 12827, 12828, 12834, 12835, 12836, 12837, 12838, 12839, 12843, 12844, 12848, 12849, 12850, 12853, 12860, 12861, 12866, 12870, 12873, 12878, 12882, 12883, 12884, 12887, 12898, 12899, 12900, 12901, 12903, 12904, 12905, 12906, 12908, 12910, 12912, 12916, 12917, 12921, 12922, 12923, 12928, 12929, 12932, 12933, 12934, 12935, 12938, 12939, 12945, 12946, 12947, 12950, 12952, 12953, 12956, 12957, 12958, 12959, 12960, 12961, 12963, 12967, 12968, 12969, 12978, 12983, 12984, 12986, 12987, 12988, 12990, 12991, 12999, 13001, 13003, 13004, 13007, 13010, 13013, 13014, 13015, 13017, 13018, 13022, 13027, 13030, 13031, 13032, 13033, 13034, 13035, 13038, 13040, 13041, 13047, 13053, 13054, 13055, 13056, 13061, 13062, 13064, 13066, 13071, 13075, 13079, 13085, 13086, 13087, 13098, 13099, 13101, 13102, 13105, 13106, 13110, 13111, 13112, 13114, 13115, 13117, 13118, 13120, 13122, 13123, 13124, 13125, 13128, 13131, 13134, 13135, 13136, 13144, 13147, 13148, 13149, 13151, 13154, 13159, 13160, 13167, 13169, 13175, 13181, 13182, 13186, 13188, 13189, 13190, 13197, 13198, 13199, 13206, 13209, 13212, 13213, 13215, 13217, 13220, 13221, 13224, 13226, 13227, 13228, 13232, 13234, 13235, 13236, 13237, 13239, 13241, 13248, 13250, 13251, 13255, 13256, 13259, 13260, 13261, 13262, 13263, 13264, 13267, 13268, 13269, 13271, 13274, 13281, 13297, 13298, 13300, 13301, 13303, 13304, 13313, 13315, 13317, 13325, 13329, 13332, 13337, 13340, 13343, 13345, 13346, 13347, 13348, 13350, 13352, 13361, 13363, 13367, 13368, 13369, 13370, 13377, 13380, 13381, 13385, 13386, 13391, 13393, 13394, 13395, 13396, 13397, 13402, 13403, 13404, 13407, 13408, 13410, 13416, 13417, 13419, 13423, 13424, 13429, 13430, 13433, 13439, 13441, 13448, 13449, 13451, 13454, 13456, 13457, 13463, 13464, 13467, 13469, 13473, 13474, 13475, 13477, 13478, 13480, 13484, 13489, 13491, 13492, 13496, 13497, 13499, 13503, 13505, 13513, 13514, 13515, 13519, 13521, 13522, 13524, 13525, 13526, 13529, 13532, 13539, 13540, 13543, 13544, 13545, 13546, 13547, 13549, 13551, 13552, 13553, 13555, 13558, 13559, 13561, 13568, 13569, 13574, 13580, 13584, 13587, 13597, 13599, 13600, 13601, 13602, 13604, 13605, 13606, 13611, 13612, 13613, 13614, 13620, 13621, 13623, 13628, 13630, 13631, 13632, 13634, 13636, 13637, 13641, 13643, 13647, 13650, 13651, 13652, 13653, 13654, 13660, 13662, 13663, 13665, 13668, 13675, 13677, 13678, 13679, 13683, 13687, 13688, 13689, 13696, 13697, 13698, 13699, 13700, 13702, 13706, 13710, 13713, 13714, 13715, 13716, 13719, 13720, 13722, 13727, 13729, 13730, 13736, 13737, 13739, 13742, 13745, 13747, 13750, 13753, 13755, 13756, 13763, 13764, 13766, 13767, 13772, 13773, 13775, 13777, 13779, 13780, 13782, 13783, 13786, 13787, 13788, 13791, 13793, 13794, 13796, 13809, 13816, 13817, 13818, 13819, 13822, 13823, 13828, 13830, 13831, 13834, 13835, 13843, 13849, 13852, 13853, 13858, 13860, 13862, 13866, 13869, 13870, 13872, 13873, 13877, 13879, 13885, 13887, 13888, 13891, 13892, 13895, 13897, 13898, 13899, 13901, 13906, 13908, 13909, 13910, 13911, 13917, 13918, 13919, 13920, 13921, 13924, 13925, 13930, 13932, 13934, 13944, 13950, 13953, 13954, 13958, 13960, 13963, 13969, 13970, 13971, 13975, 13984, 13986, 13987, 13990, 13991, 13999, 14000, 14001, 14005, 14006, 14008, 14009, 14014, 14018, 14022, 14027, 14030, 14031, 14036, 14038, 14040, 14049, 14051, 14052, 14054, 14059, 14062, 14063, 14066, 14067, 14069, 14070, 14071, 14073, 14074, 14075, 14076, 14078, 14080, 14081, 14085, 14086, 14087, 14088, 14092, 14094, 14096, 14097, 14099, 14104, 14105, 14106, 14107, 14111, 14112, 14116, 14117, 14118, 14119, 14121, 14122, 14124, 14129, 14130, 14132, 14133, 14135, 14137, 14138, 14139, 14140, 14141, 14142, 14145, 14146, 14147.

Promoters expressing in the embryo at 15 days after pollination include SEQ IDs: 3, 7, 9, 12, 14, 15, 16, 17, 26, 27, 29, 31, 33, 34, 36, 37, 44, 48, 54, 56, 57, 63, 64, 65, 79, 80, 86, 88, 90, 93, 94, 96, 98, 99, 100, 102, 103, 104, 110, 121, 123, 130, 131, 132, 135, 137, 143, 146, 147, 148, 152, 154, 156, 157, 159, 162, 165, 168, 174, 175, 176, 179, 181, 183, 187, 191, 193, 194, 196, 197, 199, 202, 203, 204, 205, 207, 211, 212, 214, 223, 224, 232, 234, 235, 236, 237, 239, 240, 246, 249, 250, 251, 256, 257, 259, 264, 267, 271, 273, 286, 288, 289, 293, 294, 299, 301, 302, 305, 306, 308, 309, 314, 316, 319, 320, 322, 323, 328, 329, 332, 334, 335, 337, 338, 340, 346, 349, 352, 353, 354, 355, 356, 358, 360, 364, 365, 371, 373, 374, 379, 381, 388, 396, 401, 404, 411, 412, 414, 416, 423, 428, 431, 432, 433, 441, 448, 450, 452, 456, 458, 459, 460, 461, 463, 466, 468, 470, 471, 474, 478, 479, 483, 485, 488, 489, 493, 496, 498, 502, 504, 505, 507, 509, 510, 511, 514, 515, 516, 517, 522, 523, 525, 532, 535, 536, 537, 541, 543, 544, 546, 547, 548, 549, 553, 554, 555, 557, 560, 561, 563, 578, 580, 585, 591, 594, 595, 596, 599, 602, 605, 606, 607, 608, 613, 619, 620, 623, 631, 633, 635, 636, 637, 638, 643, 645, 647, 650, 661, 663, 664, 670, 671, 681, 683, 687, 693, 694, 701, 702, 705, 706, 709, 716, 717, 718, 722, 723, 724, 727, 731, 732, 734, 736, 740, 742, 744, 749, 750, 753, 757, 759, 760, 762, 764, 765, 779, 781, 782, 783, 784, 792, 793, 800, 804, 806, 808, 809, 811, 812, 820, 821, 822, 824, 825, 826, 829, 830, 833, 840, 845, 846, 849, 852, 855, 856, 857, 858, 860, 862, 863, 865, 870, 871, 872, 875, 876, 877, 878, 887, 890, 891, 892, 893, 895, 897, 898, 899, 900, 903, 907, 908, 911, 912, 913, 915, 916, 917, 919, 920, 924, 928, 929, 931, 932, 934, 936, 938, 939, 943, 944, 947, 949, 951, 953, 955, 958, 960, 964, 971, 974, 976, 977, 978, 979, 980, 981, 982, 984, 985, 987, 991, 993, 994, 995, 997, 999, 1002, 1003, 1005, 1006, 1007, 1008, 1009, 1011, 1012, 1013, 1014, 1016, 1017, 1019, 1022, 1025, 1026, 1032, 1033, 1035, 1038, 1041, 1043, 1046, 1047, 1049, 1051, 1052, 1054, 1055, 1056, 1057, 1059, 1065, 1067, 1069, 1070, 1073, 1074, 1076, 1077, 1080, 1085, 1086, 1087, 1089, 1092, 1095, 1100, 1101, 1103, 1104, 1110, 1111, 1112, 1114, 1115, 1116, 1117, 1119, 1121, 1122, 1125, 1130, 1132, 1136, 1137, 1140, 1144, 1146, 1148, 1153, 1154, 1155, 1160, 1161, 1162, 1164, 1165, 1167, 1168, 1170, 1171, 1176, 1178, 1183, 1185, 1186, 1187, 1189, 1190, 1191, 1196, 1201, 1205, 1214, 1215, 1217, 1218, 1222, 1223, 1225, 1227, 1228, 1230, 1233, 1236, 1237, 1239, 1240, 1249, 1251, 1254, 1257, 1258, 1261, 1262, 1263, 1269, 1272, 1281, 1282, 1285, 1286, 1290, 1292, 1293, 1296, 1303, 1306, 1307, 1309, 1310, 1311, 1312, 1314, 1316, 1320, 1322, 1323, 1325, 1327, 1330, 1331, 1334, 1339, 1344, 1345, 1347, 1349, 1354, 1355, 1360, 1364, 1366, 1367, 1368, 1371, 1375, 1376, 1377, 1380, 1381, 1387, 1388, 1389, 1391, 1393, 1396, 1402, 1404, 1405, 1406, 1410, 1412, 1415, 1420, 1421, 1423, 1426, 1431, 1432, 1435, 1437, 1438, 1440, 1441, 1442, 1447, 1448, 1451, 1453, 1458, 1459, 1461, 1464, 1466, 1471, 1472, 1475, 1484, 1485, 1488, 1489, 1490, 1491, 1493, 1498, 1499, 1501, 1503, 1504, 1506, 1508, 1510, 1511, 1512, 1514, 1518, 1519, 1527, 1528, 1530, 1536, 1539, 1543, 1545, 1546, 1549, 1550, 1551, 1554, 1555, 1556, 1561, 1563, 1564, 1566, 1567, 1570, 1575, 1579, 1582, 1584, 1585, 1586, 1590, 1591, 1597, 1598, 1599, 1600, 1601, 1602, 1604, 1605, 1608, 1609, 1610, 1612, 1614, 1615, 1616, 1617, 1623, 1625, 1628, 1629, 1634, 1635, 1636, 1637, 1638, 1639, 1641, 1642, 1643, 1648, 1650, 1651, 1653, 1654, 1658, 1659, 1662, 1663, 1668, 1669, 1671, 1673, 1675, 1676, 1678, 1681, 1682, 1684, 1685, 1687, 1688, 1689, 1690, 1691, 1696, 1698, 1699, 1703, 1705, 1706, 1707, 1708, 1709, 1710, 1716, 1717, 1718, 1720, 1723, 1725, 1732, 1735, 1736, 1750, 1755, 1761, 1764, 1769, 1773, 1774, 1776, 1777, 1779, 1785, 1786, 1791, 1792, 1793, 1796, 1798, 1807, 1809, 1811, 1812, 1813, 1814, 1820, 1822, 1826, 1828, 1830, 1832, 1834, 1837, 1839, 1840, 1848, 1852, 1854, 1855, 1859, 1861, 1863, 1866, 1867, 1869, 1872, 1873, 1876, 1879, 1880, 1882, 1884, 1886, 1888, 1891, 1893, 1897, 1898, 1899, 1900, 1902, 1904, 1905, 1906, 1910, 1911, 1913, 1916, 1918, 1920, 1922, 1923, 1924, 1928, 1933, 1934, 1936, 1939, 1940, 1942, 1944, 1945, 1949, 1950, 1952, 1953, 1954, 1958, 1968, 1970, 1971, 1972, 1973, 1977, 1979, 1981, 1986, 1990, 1993, 1994, 1995, 1996, 1999, 2000, 2007, 2008, 2009, 2010, 2012, 2014, 2015, 2017, 2019, 2021, 2026, 2031, 2032, 2033, 2036, 2037, 2040, 2041, 2042, 2043, 2045, 2048, 2057, 2060, 2062, 2064, 2066, 2072, 2074, 2077, 2078, 2087, 2088, 2089, 2091, 2092, 2093, 2094, 2096, 2097, 2099, 2101, 2103, 2104, 2106, 2107, 2112, 2116, 2117, 2122, 2123, 2125, 2128, 2130, 2132, 2133, 2137, 2139, 2140, 2141, 2142, 2143, 2144, 2146, 2147, 2150, 2151, 2156, 2157, 2158, 2159, 2161, 2164, 2167, 2170, 2175, 2177, 2179, 2183, 2185, 2188, 2189, 2193, 2195, 2196, 2200, 2206, 2207, 2210, 2214, 2215, 2216, 2221, 2223, 2235, 2240, 2241, 2242, 2243, 2253, 2257, 2260, 2263, 2266, 2267, 2274, 2276, 2278, 2280, 2282, 2283, 2284, 2291, 2296, 2297, 2298, 2300, 2303, 2304, 2306, 2308, 2309, 2310, 2313, 2314, 2322, 2323, 2328, 2329, 2331, 2337, 2339, 2342, 2343, 2345, 2348, 2353, 2359, 2361, 2362, 2363, 2366, 2371, 2372, 2379, 2380, 2381, 2382, 2384, 2395, 2401, 2402, 2405, 2410, 2412, 2413, 2414, 2418, 2419, 2420, 2423, 2428, 2430, 2431, 2432, 2433, 2434, 2435, 2437, 2439, 2440, 2441, 2442, 2443, 2445, 2451, 2452, 2453, 2454, 2456, 2457, 2458, 2469, 2470, 2472, 2474, 2476, 2477, 2480, 2481, 2482, 2483, 2485, 2487, 2490, 2492, 2494, 2495, 2496, 2497, 2498, 2500, 2505, 2506, 2507, 2509, 2510, 2513, 2514, 2515, 2516, 2517, 2519, 2521, 2522, 2525, 2528, 2529, 2531, 2532, 2533, 2534, 2536, 2537, 2538, 2539, 2540, 2541, 2544, 2545, 2546, 2549, 2550, 2551, 2552, 2554, 2555, 2559, 2561, 2567, 2568, 2570, 2573, 2576, 2578, 2579, 2581, 2583, 2589, 2590, 2594, 2596, 2599, 2600, 2601, 2605, 2609, 2611, 2613, 2616, 2625, 2627, 2632, 2634, 2635, 2636, 2639, 2644, 2648, 2649, 2652, 2655, 2656, 2658, 2661, 2662, 2663, 2666, 2670, 2671, 2672, 2674, 2676, 2678, 2684, 2685, 2687, 2688, 2689, 2690, 2691, 2692, 2694, 2700, 2702, 2704, 2708, 2709, 2711, 2715, 2719, 2720, 2721, 2722, 2723, 2725, 2726, 2728, 2729, 2735, 2738, 2739, 2740, 2745, 2746, 2747, 2749, 2752, 2755, 2756, 2758, 2762, 2764, 2765, 2770, 2775, 2776, 2782, 2783, 2784, 2787, 2794, 2798, 2800, 2802, 2805, 2808, 2812, 2814, 2819, 2821, 2822, 2823, 2824, 2826, 2827, 2828, 2831, 2832, 2838, 2840, 2844, 2860, 2861, 2865, 2869, 2871, 2876, 2878, 2888, 2889, 2893, 2894, 2895, 2896, 2897, 2898, 2901, 2902, 2903, 2906, 2908, 2909, 2911, 2914, 2915, 2916, 2917, 2918, 2919, 2922, 2923, 2926, 2929, 2930, 2931, 2935, 2937, 2941, 2942, 2943, 2946, 2947, 2948, 2951, 2955, 2959, 2962, 2963, 2966, 2968, 2976, 2979, 2980, 2982, 2992, 2994, 2998, 3003, 3005, 3007, 3013, 3015, 3017, 3018, 3020, 3023, 3024, 3029, 3031, 3039, 3041, 3042, 3044, 3045, 3047, 3048, 3049, 3051, 3052, 3053, 3055, 3058, 3059, 3061, 3064, 3068, 3070, 3072, 3075, 3080, 3083, 3084, 3085, 3087, 3090, 3097, 3100, 3101, 3106, 3115, 3118, 3119, 3120, 3121, 3122, 3123, 3127, 3128, 3129, 3137, 3139, 3143, 3145, 3149, 3153, 3167, 3169, 3170, 3172, 3177, 3181, 3187, 3191, 3192, 3194, 3196, 3200, 3205, 3206, 3208, 3210, 3217, 3219, 3220, 3221, 3224, 3225, 3228, 3230, 3237, 3240, 3242, 3245, 3246, 3249, 3250, 3252, 3254, 3255, 3261, 3263, 3266, 3267, 3268, 3269, 3271, 3272, 3278, 3280, 3283, 3286, 3288, 3290, 3291, 3294, 3295, 3296, 3297, 3299, 3301, 3308, 3310, 3312, 3313, 3324, 3331, 3332, 3333, 3337, 3338, 3340, 3342, 3343, 3345, 3347, 3351, 3353, 3354, 3355, 3356, 3357, 3358, 3359, 3360, 3361, 3363, 3368, 3370, 3376, 3377, 3378, 3379, 3383, 3386, 3394, 3396, 3399, 3403, 3404, 3405, 3413, 3415, 3416, 3418, 3419, 3424, 3426, 3428, 3435, 3442, 3445, 3446, 3447, 3449, 3450, 3452, 3453, 3457, 3458, 3461, 3465, 3466, 3468, 3469, 3470, 3471, 3474, 3477, 3483, 3484, 3486, 3488, 3490, 3493, 3494, 3499, 3500, 3502, 3503, 3504, 3507, 3510, 3516, 3517, 3518, 3521, 3522, 3523, 3524, 3527, 3533, 3535, 3536, 3537, 3538, 3540, 3541, 3542, 3544, 3545, 3549, 3552, 3554, 3558, 3560, 3562, 3569, 3574, 3576, 3577, 3580, 3587, 3588, 3589, 3591, 3592, 3594, 3600, 3603, 3604, 3607, 3611, 3612, 3613, 3616, 3618, 3620, 3621, 3624, 3629, 3633, 3634, 3642, 3643, 3644, 3645, 3646, 3647, 3648, 3659, 3660, 3661, 3667, 3671, 3672, 3674, 3677, 3681, 3682, 3684, 3685, 3690, 3693, 3694, 3706, 3707, 3709, 3710, 3713, 3715, 3718, 3719, 3721, 3723, 3725, 3730, 3731, 3744, 3749, 3752, 3757, 3758, 3760, 3761, 3764, 3765, 3766, 3775, 3777, 3778, 3785, 3791, 3792, 3793, 3794, 3796, 3798, 3801, 3806, 3808, 3817, 3818, 3819, 3823, 3825, 3828, 3829, 3830, 3831, 3832, 3833, 3837, 3838, 3839, 3843, 3844, 3845, 3846, 3847, 3849, 3852, 3858, 3859, 3860, 3867, 3868, 3870, 3871, 3872, 3873, 3881, 3882, 3883, 3884, 3885, 3887, 3889, 3890, 3892, 3894, 3895, 3896, 3897, 3899, 3902, 3903, 3904, 3907, 3908, 3912, 3913, 3917, 3918, 3928, 3929, 3931, 3933, 3935, 3938, 3947, 3950, 3951, 3952, 3954, 3958, 3962, 3967, 3968, 3970, 3971, 3974, 3975, 3978, 3983, 3985, 3987, 3988, 3994, 3996, 3997, 3998, 4000, 4007, 4008, 4013, 4014, 4019, 4020, 4021, 4028, 4030, 4033, 4037, 4039, 4040, 4041, 4042, 4043, 4046, 4047, 4048, 4050, 4051, 4052, 4053, 4054, 4055, 4056, 4057, 4058, 4062, 4066, 4067, 4068, 4070, 4072, 4075, 4079, 4080, 4084, 4088, 4092, 4094, 4096, 4098, 4099, 4102, 4105, 4106, 4109, 4110, 4113, 4116, 4122, 4124, 4126, 4128, 4133, 4134, 4139, 4140, 4143, 4144, 4146, 4147, 4148, 4149, 4150, 4151, 4160, 4163, 4164, 4165, 4166, 4167, 4168, 4171, 4173, 4175, 4178, 4181, 4183, 4185, 4187, 4188, 4189, 4190, 4191, 4193, 4195, 4201, 4202, 4204, 4205, 4206, 4207, 4208, 4210, 4211, 4212, 4213, 4216, 4219, 4221, 4227, 4228, 4229, 4233, 4234, 4235, 4237, 4244, 4245, 4246, 4250, 4251, 4252, 4255, 4257, 4261, 4266, 4270, 4272, 4275, 4276, 4279, 4280, 4281, 4283, 4284, 4294, 4296, 4298, 4300, 4301, 4302, 4303, 4305, 4306, 4309, 4312, 4320, 4321, 4324, 4329, 4330, 4335, 4336, 4337, 4338, 4341, 4344, 4347, 4358, 4359, 4360, 4369, 4370, 4375, 4378, 4380, 4383, 4388, 4390, 4391, 4392, 4393, 4396, 4397, 4401, 4402, 4403, 4404, 4405, 4409, 4410, 4422, 4423, 4425, 4428, 4432, 4436, 4439, 4440, 4442, 4443, 4446, 4448, 4449, 4450, 4453, 4458, 4461, 4462, 4463, 4466, 4468, 4470, 4474, 4475, 4479, 4485, 4490, 4492, 4494, 4497, 4498, 4500, 4502, 4507, 4508, 4512, 4514, 4515, 4519, 4521, 4522, 4525, 4529, 4531, 4535, 4545, 4548, 4549, 4551, 4554, 4555, 4556, 4557, 4558, 4560, 4562, 4563, 4565, 4567, 4568, 4575, 4576, 4580, 4582, 4583, 4585, 4590, 4591, 4594, 4597, 4598, 4601, 4606, 4616, 4618, 4623, 4625, 4628, 4630, 4632, 4634, 4635, 4636, 4639, 4641, 4643, 4644, 4645, 4646, 4647, 4650, 4651, 4653, 4654, 4655, 4656, 4657, 4658, 4659, 4662, 4664, 4667, 4669, 4671, 4673, 4674, 4676, 4677, 4680, 4682, 4685, 4691, 4692, 4694, 4697, 4700, 4704, 4706, 4708, 4711, 4713, 4718, 4719, 4721, 4723, 4724, 4725, 4730, 4734, 4736, 4737, 4738, 4739, 4740, 4741, 4745, 4746, 4749, 4750, 4753, 4755, 4756, 4761, 4762, 4763, 4769, 4770, 4773, 4775, 4779, 4780, 4784, 4787, 4788, 4789, 4790, 4791, 4794, 4795, 4796, 4801, 4803, 4804, 4805, 4806, 4807, 4813, 4814, 4818, 4822, 4827, 4828, 4830, 4831, 4834, 4836, 4838, 4840, 4841, 4842, 4855, 4856, 4857, 4859, 4861, 4862, 4863, 4869, 4874, 4875, 4876, 4878, 4880, 4881, 4887, 4889, 4891, 4895, 4896, 4897, 4900, 4902, 4904, 4905, 4907, 4909, 4910, 4913, 4914, 4921, 4922, 4923, 4924, 4926, 4930, 4935, 4936, 4941, 4942, 4944, 4950, 4954, 4956, 4958, 4959, 4967, 4969, 4971, 4972, 4974, 4975, 4985, 4987, 4989, 4990, 4993, 4994, 4996, 5000, 5007, 5015, 5016, 5024, 5026, 5029, 5030, 5034, 5036, 5037, 5038, 5039, 5040, 5041, 5042, 5044, 5045, 5046, 5051, 5052, 5054, 5057, 5060, 5067, 5068, 5069, 5072, 5074, 5075, 5078, 5082, 5087, 5088, 5089, 5090, 5094, 5095, 5100, 5101, 5102, 5106, 5111, 5114, 5116, 5119, 5120, 5129, 5131, 5132, 5140, 5143, 5145, 5147, 5148, 5149, 5150, 5151, 5153, 5157, 5159, 5160, 5164, 5165, 5168, 5170, 5172, 5174, 5180, 5181, 5182, 5184, 5185, 5187, 5188, 5189, 5190, 5191, 5192, 5195, 5196, 5198, 5200, 5202, 5203, 5206, 5212, 5213, 5217, 5218, 5219, 5224, 5225, 5229, 5234, 5241, 5249, 5251, 5252, 5253, 5254, 5255, 5256, 5257, 5258, 5260, 5261, 5263, 5267, 5268, 5269, 5273, 5274, 5275, 5276, 5280, 5281, 5282, 5283, 5286, 5289, 5293, 5297, 5298, 5299, 5300, 5301, 5308, 5311, 5317, 5319, 5321, 5324, 5329, 5330, 5333, 5334, 5338, 5339, 5342, 5345, 5346, 5348, 5349, 5351, 5352, 5366, 5367, 5369, 5371, 5386, 5388, 5389, 5391, 5393, 5395, 5396, 5397, 5402, 5405, 5409, 5411, 5413, 5414, 5417, 5418, 5422, 5427, 5428, 5431, 5433, 5434, 5437, 5438, 5446, 5448, 5449, 5450, 5452, 5453, 5456, 5458, 5459, 5461, 5466, 5472, 5475, 5483, 5485, 5487, 5488, 5491, 5493, 5495, 5496, 5505, 5506, 5508, 5510, 5512, 5513, 5518, 5519, 5524, 5526, 5529, 5530, 5531, 5534, 5535, 5543, 5545, 5549, 5554, 5557, 5562, 5563, 5565, 5566, 5568, 5569, 5572, 5575, 5579, 5581, 5582, 5584, 5585, 5589, 5591, 5593, 5594, 5597, 5602, 5608, 5610, 5612, 5613, 5614, 5615, 5616, 5620, 5621, 5623, 5627, 5633, 5635, 5638, 5640, 5643, 5646, 5647, 5648, 5651, 5652, 5653, 5656, 5659, 5660, 5662, 5663, 5667, 5669, 5673, 5675, 5676, 5680, 5681, 5689, 5690, 5694, 5695, 5697, 5698, 5702, 5706, 5711, 5718, 5719, 5721, 5722, 5729, 5730, 5731, 5732, 5734, 5735, 5736, 5737, 5742, 5744, 5751, 5768, 5770, 5771, 5773, 5775, 5778, 5780, 5782, 5785, 5787, 5791, 5792, 5794, 5805, 5807, 5808, 5810, 5811, 5813, 5814, 5815, 5817, 5820, 5826, 5828, 5832, 5833, 5834, 5835, 5836, 5837, 5839, 5842, 5844, 5854, 5859, 5864, 5866, 5867, 5868, 5869, 5871, 5872, 5875, 5876, 5877, 5878, 5879, 5881, 5882, 5883, 5888, 5889, 5892, 5893, 5900, 5902, 5906, 5910, 5912, 5918, 5919, 5921, 5922, 5923, 5925, 5926, 5927, 5928, 5930, 5931, 5932, 5933, 5936, 5938, 5939, 5941, 5942, 5944, 5945, 5946, 5948, 5951, 5954, 5956, 5957, 5959, 5961, 5968, 5971, 5978, 5980, 5985, 5986, 5988, 5991, 5992, 5996, 5997, 6000, 6003, 6004, 6006, 6007, 6008, 6010, 6012, 6013, 6016, 6017, 6023, 6025, 6026, 6034, 6038, 6040, 6041, 6042, 6044, 6047, 6048, 6051, 6053, 6054, 6058, 6059, 6062, 6063, 6068, 6069, 6070, 6072, 6073, 6074, 6075, 6080, 6085, 6088, 6089, 6092, 6093, 6094, 6095, 6097, 6098, 6107, 6108, 6109, 6110, 6112, 6113, 6116, 6118, 6119, 6122, 6129, 6130, 6131, 6132, 6133, 6135, 6136, 6137, 6138, 6140, 6143, 6145, 6146, 6147, 6149, 6151, 6152, 6153, 6156, 6160, 6163, 6164, 6165, 6168, 6176, 6181, 6182, 6183, 6186, 6188, 6189, 6190, 6191, 6193, 6197, 6198, 6200, 6205, 6207, 6209, 6212, 6215, 6223, 6224, 6227, 6228, 6230, 6231, 6233, 6234, 6238, 6240, 6241, 6243, 6244, 6245, 6246, 6247, 6248, 6249, 6251, 6255, 6257, 6258, 6259, 6264, 6265, 6269, 6270, 6271, 6272, 6273, 6275, 6278, 6279, 6280, 6281, 6282, 6283, 6284, 6285, 6286, 6288, 6289, 6292, 6295, 6299, 6302, 6309, 6310, 6311, 6314, 6315, 6317, 6319, 6321, 6322, 6325, 6328, 6330, 6333, 6334, 6338, 6342, 6345, 6346, 6351, 6352, 6353, 6354, 6359, 6362, 6363, 6367, 6370, 6373, 6375, 6378, 6379, 6381, 6383, 6387, 6394, 6395, 6396, 6398, 6399, 6403, 6405, 6407, 6410, 6412, 6413, 6414, 6415, 6419, 6420, 6425, 6426, 6427, 6429, 6430, 6431, 6434, 6436, 6437, 6440, 6441, 6442, 6454, 6458, 6464, 6466, 6467, 6468, 6469, 6470, 6471, 6474, 6476, 6480, 6484, 6486, 6488, 6492, 6493, 6495, 6500, 6501, 6502, 6503, 6504, 6505, 6510, 6513, 6516, 6517, 6519, 6524, 6525, 6526, 6530, 6533, 6534, 6535, 6537, 6539, 6543, 6544, 6545, 6547, 6548, 6549, 6554, 6555, 6558, 6560, 6561, 6563, 6567, 6574, 6576, 6577, 6579, 6581, 6582, 6584, 6587, 6588, 6589, 6594, 6595, 6599, 6600, 6607, 6611, 6614, 6620, 6621, 6622, 6624, 6626, 6627, 6630, 6634, 6635, 6637, 6638, 6639, 6640, 6643, 6644, 6649, 6650, 6655, 6656, 6658, 6662, 6666, 6671, 6677, 6681, 6686, 6691, 6692, 6695, 6696, 6702, 6703, 6705, 6706, 6711, 6714, 6716, 6718, 6720, 6724, 6725, 6729, 6734, 6736, 6737, 6739, 6746, 6747, 6752, 6757, 6758, 6759, 6761, 6764, 6766, 6778, 6779, 6780, 6786, 6788, 6789, 6792, 6793, 6794, 6797, 6799, 6801, 6803, 6804, 6805, 6807, 6810, 6811, 6812, 6813, 6816, 6819, 6820, 6821, 6824, 6827, 6828, 6830, 6831, 6834, 6836, 6837, 6839, 6840, 6841, 6842, 6843, 6845, 6851, 6852, 6859, 6863, 6864, 6869, 6870, 6872, 6874, 6875, 6876, 6877, 6878, 6879, 6880, 6882, 6883, 6886, 6888, 6890, 6897, 6903, 6904, 6907, 6914, 6915, 6917, 6919, 6920, 6921, 6923, 6924, 6930, 6933, 6936, 6941, 6943, 6946, 6948, 6959, 6960, 6963, 6967, 6969, 6970, 6979, 6980, 6984, 6985, 6987, 6988, 6990, 6991, 6993, 6994, 6995, 6997, 6999, 7002, 7003, 7006, 7009, 7011, 7012, 7013, 7015, 7022, 7031, 7038, 7039, 7042, 7043, 7045, 7046, 7048, 7051, 7052, 7053, 7056, 7057, 7060, 7062, 7064, 7067, 7072, 7075, 7077, 7083, 7085, 7086, 7093, 7105, 7106, 7107, 7108, 7109, 7112, 7116, 7117, 7118, 7124, 7130, 7132, 7134, 7135, 7140, 7142, 7144, 7149, 7155, 7163, 7164, 7165, 7166, 7169, 7176, 7177, 7183, 7184, 7187, 7188, 7192, 7194, 7196, 7201, 7203, 7206, 7207, 7208, 7209, 7211, 7212, 7216, 7217, 7220, 7227, 7228, 7230, 7231, 7234, 7235, 7236, 7239, 7241, 7243, 7244, 7245, 7255, 7257, 7258, 7259, 7262, 7267, 7268, 7274, 7276, 7277, 7281, 7282, 7284, 7287, 7288, 7290, 7291, 7292, 7293, 7298, 7299, 7300, 7301, 7303, 7304, 7305, 7306, 7307, 7308, 7310, 7312, 7313, 7315, 7317, 7321, 7328, 7330, 7334, 7336, 7339, 7340, 7344, 7348, 7354, 7355, 7356, 7357, 7358, 7360, 7361, 7363, 7365, 7371, 7373, 7379, 7380, 7381, 7382, 7383, 7386, 7388, 7389, 7392, 7395, 7398, 7409, 7410, 7411, 7417, 7418, 7424, 7425, 7428, 7430, 7431, 7434, 7435, 7436, 7438, 7441, 7443, 7444, 7446, 7447, 7448, 7452, 7454, 7458, 7459, 7464, 7466, 7470, 7472, 7483, 7486, 7487, 7490, 7492, 7493, 7498, 7502, 7504, 7505, 7506, 7512, 7515, 7517, 7518, 7523, 7524, 7525, 7528, 7529, 7533, 7534, 7538, 7546, 7547, 7554, 7557, 7561, 7572, 7574, 7577, 7578, 7579, 7580, 7583, 7585, 7586, 7587, 7590, 7591, 7593, 7594, 7598, 7605, 7607, 7611, 7613, 7618, 7619, 7620, 7621, 7623, 7624, 7629, 7633, 7638, 7639, 7640, 7642, 7643, 7652, 7653, 7658, 7661, 7663, 7664, 7665, 7666, 7667, 7674, 7676, 7677, 7682, 7685, 7687, 7689, 7695, 7699, 7700, 7703, 7704, 7708, 7712, 7713, 7716, 7718, 7719, 7724, 7725, 7726, 7729, 7733, 7736, 7737, 7738, 7740, 7743, 7744, 7745, 7748, 7751, 7753, 7755, 7761, 7762, 7763, 7767, 7768, 7769, 7770, 7772, 7774, 7775, 7777, 7778, 7779, 7780, 7782, 7785, 7786, 7788, 7791, 7792, 7793, 7798, 7799, 7800, 7803, 7804, 7806, 7807, 7812, 7815, 7818, 7819, 7820, 7823, 7824, 7825, 7832, 7833, 7834, 7838, 7841, 7844, 7847, 7848, 7849, 7850, 7852, 7856, 7858, 7859, 7860, 7862, 7863, 7865, 7875, 7876, 7878, 7880, 7888, 7890, 7896, 7900, 7908, 7911, 7917, 7918, 7920, 7921, 7923, 7925, 7927, 7928, 7929, 7933, 7934, 7935, 7936, 7937, 7938, 7942, 7944, 7945, 7946, 7947, 7948, 7949, 7951, 7952, 7955, 7956, 7964, 7971, 7972, 7974, 7976, 7978, 7980, 7981, 7983, 7984, 7986, 7989, 7990, 7991, 7993, 7998, 8002, 8004, 8006, 8007, 8008, 8009, 8012, 8021, 8026, 8029, 8036, 8038, 8039, 8042, 8044, 8047, 8048, 8052, 8053, 8056, 8058, 8059, 8061, 8063, 8067, 8068, 8071, 8072, 8075, 8076, 8077, 8078, 8079, 8080, 8082, 8084, 8088, 8091, 8093, 8095, 8100, 8102, 8103, 8105, 8112, 8115, 8116, 8118, 8121, 8123, 8126, 8134, 8136, 8137, 8145, 8146, 8147, 8148, 8150, 8151, 8159, 8162, 8163, 8165, 8166, 8168, 8170, 8176, 8178, 8179, 8182, 8187, 8188, 8189, 8193, 8195, 8199, 8202, 8204, 8207, 8208, 8210, 8211, 8213, 8216, 8219, 8220, 8223, 8225, 8227, 8231, 8234, 8235, 8236, 8237, 8239, 8242, 8245, 8250, 8252, 8253, 8257, 8258, 8265, 8266, 8268, 8269, 8270, 8272, 8274, 8289, 8291, 8293, 8294, 8300, 8301, 8304, 8306, 8310, 8311, 8312, 8318, 8319, 8320, 8321, 8323, 8329, 8331, 8336, 8339, 8340, 8350, 8352, 8353, 8355, 8363, 8367, 8368, 8369, 8373, 8379, 8385, 8386, 8387, 8389, 8390, 8392, 8393, 8395, 8398, 8401, 8402, 8403, 8404, 8405, 8410, 8413, 8414, 8415, 8416, 8423, 8430, 8433, 8436, 8438, 8439, 8441, 8442, 8444, 8446, 8447, 8448, 8450, 8451, 8452, 8453, 8456, 8458, 8459, 8463, 8465, 8466, 8469, 8470, 8472, 8473, 8474, 8476, 8477, 8480, 8481, 8482, 8485, 8486, 8490, 8493, 8494, 8498, 8501, 8505, 8509, 8511, 8513, 8515, 8517, 8520, 8523, 8524, 8525, 8528, 8531, 8532, 8533, 8537, 8538, 8539, 8542, 8543, 8545, 8549, 8550, 8552, 8553, 8554, 8557, 8561, 8562, 8565, 8566, 8568, 8575, 8576, 8579, 8581, 8582, 8584, 8589, 8590, 8592, 8593, 8594, 8596, 8597, 8600, 8601, 8602, 8603, 8604, 8605, 8610, 8611, 8612, 8613, 8614, 8617, 8618, 8628, 8630, 8631, 8634, 8635, 8637, 8638, 8640, 8641, 8642, 8644, 8648, 8650, 8654, 8657, 8658, 8659, 8660, 8665, 8669, 8670, 8672, 8676, 8677, 8685, 8693, 8699, 8700, 8703, 8704, 8706, 8708, 8709, 8713, 8716, 8717, 8720, 8726, 8727, 8729, 8731, 8732, 8734, 8735, 8736, 8741, 8742, 8744, 8745, 8746, 8748, 8751, 8752, 8753, 8757, 8761, 8764, 8767, 8770, 8772, 8773, 8775, 8777, 8779, 8783, 8784, 8789, 8792, 8796, 8797, 8803, 8805, 8808, 8810, 8818, 8821, 8822, 8824, 8829, 8831, 8832, 8835, 8838, 8839, 8841, 8843, 8846, 8853, 8854, 8859, 8861, 8865, 8867, 8876, 8877, 8878, 8881, 8883, 8886, 8888, 8891, 8892, 8896, 8899, 8900, 8902, 8905, 8907, 8908, 8909, 8910, 8911, 8913, 8914, 8916, 8917, 8924, 8926, 8929, 8930, 8935, 8938, 8941, 8942, 8945, 8946, 8949, 8951, 8954, 8956, 8957, 8959, 8960, 8963, 8967, 8968, 8969, 8972, 8974, 8976, 8977, 8979, 8980, 8981, 8982, 8985, 8986, 8992, 8996, 8998, 8999, 9001, 9002, 9003, 9006, 9009, 9012, 9015, 9018, 9020, 9029, 9030, 9037, 9044, 9047, 9052, 9056, 9057, 9058, 9059, 9060, 9061, 9066, 9069, 9071, 9072, 9073, 9074, 9076, 9084, 9088, 9091, 9092, 9095, 9096, 9103, 9105, 9108, 9110, 9111, 9112, 9114, 9115, 9118, 9119, 9123, 9125, 9129, 9133, 9134, 9138, 9139, 9140, 9141, 9142, 9149, 9151, 9152, 9154, 9155, 9167, 9168, 9173, 9174, 9175, 9177, 9183, 9185, 9187, 9188, 9190, 9191, 9195, 9204, 9205, 9206, 9207, 9210, 9211, 9213, 9215, 9216, 9218, 9226, 9229, 9231, 9233, 9237, 9241, 9243, 9247, 9249, 9252, 9253, 9254, 9255, 9257, 9263, 9267, 9269, 9270, 9273, 9276, 9278, 9282, 9284, 9285, 9287, 9288, 9290, 9292, 9293, 9299, 9300, 9304, 9308, 9311, 9314, 9320, 9321, 9323, 9325, 9326, 9327, 9328, 9329, 9330, 9336, 9337, 9338, 9339, 9340, 9341, 9345, 9346, 9347, 9348, 9353, 9354, 9355, 9359, 9366, 9367, 9373, 9375, 9376, 9378, 9382, 9383, 9386, 9388, 9391, 9392, 9393, 9394, 9396, 9400, 9402, 9403, 9404, 9406, 9407, 9413, 9415, 9417, 9423, 9432, 9433, 9434, 9439, 9440, 9442, 9443, 9444, 9449, 9451, 9452, 9456, 9459, 9460, 9468, 9471, 9472, 9473, 9475, 9478, 9483, 9488, 9490, 9497, 9500, 9501, 9502, 9503, 9504, 9509, 9513, 9514, 9515, 9517, 9518, 9519, 9522, 9531, 9532, 9533, 9534, 9536, 9540, 9545, 9548, 9553, 9555, 9563, 9564, 9565, 9568, 9571, 9573, 9577, 9582, 9583, 9587, 9589, 9590, 9591, 9596, 9597, 9602, 9606, 9609, 9610, 9613, 9620, 9623, 9624, 9626, 9627, 9628, 9629, 9632, 9633, 9635, 9640, 9641, 9642, 9644, 9645, 9646, 9648, 9649, 9652, 9653, 9655, 9657, 9658, 9659, 9660, 9663, 9666, 9668, 9670, 9677, 9679, 9681, 9682, 9686, 9687, 9692, 9693, 9694, 9698, 9706, 9717, 9718, 9723, 9726, 9729, 9730, 9731, 9733, 9734, 9737, 9746, 9750, 9751, 9753, 9754, 9756, 9763, 9764, 9767, 9768, 9770, 9776, 9780, 9781, 9782, 9784, 9791, 9792, 9793, 9794, 9796, 9799, 9801, 9802, 9806, 9812, 9813, 9816, 9819, 9820, 9824, 9825, 9826, 9829, 9830, 9833, 9835, 9836, 9845, 9846, 9847, 9849, 9850, 9851, 9853, 9854, 9861, 9864, 9866, 9869, 9871, 9873, 9882, 9885, 9886, 9887, 9892, 9897, 9900, 9901, 9906, 9907, 9908, 9909, 9910, 9912, 9923, 9924, 9928, 9930, 9934, 9935, 9938, 9940, 9944, 9946, 9947, 9949, 9950, 9953, 9955, 9958, 9960, 9962, 9963, 9964, 9967, 9968, 9971, 9979, 9980, 9982, 9984, 9985, 9987, 9990, 9991, 9996, 9997, 9998, 10000, 10009, 10010, 10012, 10013, 10015, 10017, 10019, 10021, 10022, 10026, 10031, 10032, 10033, 10034, 10035, 10038, 10041, 10042, 10043, 10045, 10048, 10051, 10052, 10054, 10056, 10058, 10059, 10060, 10062, 10063, 10064, 10066, 10068, 10073, 10075, 10077, 10078, 10080, 10081, 10083, 10086, 10087, 10089, 10091, 10092, 10095, 10097, 10101, 10102, 10103, 10105, 10106, 10107, 10108, 10109, 10110, 10114, 10115, 10116, 10118, 10122, 10127, 10128, 10131, 10132, 10136, 10141, 10143, 10146, 10147, 10149, 10151, 10152, 10158, 10162, 10163, 10165, 10166, 10168, 10174, 10176, 10178, 10181, 10182, 10191, 10192, 10193, 10194, 10195, 10197, 10199, 10203, 10206, 10209, 10212, 10218, 10219, 10220, 10222, 10223, 10225, 10228, 10231, 10232, 10233, 10236, 10237, 10239, 10247, 10252, 10253, 10255, 10257, 10270, 10275, 10284, 10291, 10292, 10293, 10295, 10296, 10297, 10300, 10302, 10306, 10307, 10311, 10318, 10321, 10323, 10325, 10326, 10328, 10331, 10333, 10334, 10335, 10336, 10343, 10346, 10351, 10353, 10356, 10357, 10359, 10360, 10362, 10364, 10368, 10371, 10373, 10375, 10376, 10378, 10380, 10381, 10384, 10385, 10388, 10389, 10395, 10397, 10398, 10399, 10400, 10401, 10408, 10410, 10413, 10414, 10416, 10421, 10422, 10423, 10425, 10427, 10428, 10430, 10435, 10437, 10438, 10440, 10442, 10443, 10446, 10447, 10448, 10449, 10450, 10453, 10456, 10463, 10464, 10465, 10468, 10469, 10470, 10474, 10478, 10480, 10482, 10487, 10488, 10492, 10494, 10496, 10497, 10504, 10506, 10508, 10513, 10514, 10515, 10518, 10525, 10527, 10528, 10530, 10531, 10533, 10535, 10536, 10537, 10541, 10542, 10543, 10544, 10547, 10548, 10549, 10550, 10551, 10555, 10556, 10558, 10560, 10561, 10565, 10567, 10569, 10571, 10573, 10580, 10581, 10582, 10583, 10585, 10590, 10591, 10593, 10596, 10597, 10599, 10601, 10602, 10609, 10610, 10611, 10613, 10614, 10615, 10616, 10617, 10621, 10622, 10623, 10626, 10629, 10630, 10631, 10633, 10634, 10636, 10637, 10638, 10639, 10640, 10641, 10642, 10643, 10645, 10646, 10648, 10649, 10650, 10655, 10657, 10659, 10663, 10665, 10666, 10668, 10670, 10674, 10678, 10681, 10682, 10683, 10684, 10685, 10687, 10693, 10697, 10698, 10699, 10700, 10702, 10703, 10705, 10707, 10708, 10710, 10711, 10712, 10715, 10716, 10721, 10722, 10725, 10726, 10732, 10734, 10735, 10737, 10738, 10740, 10741, 10744, 10745, 10748, 10749, 10752, 10761, 10762, 10763, 10766, 10775, 10776, 10777, 10778, 10779, 10782, 10784, 10785, 10787, 10788, 10790, 10791, 10792, 10795, 10796, 10798, 10801, 10803, 10805, 10809, 10810, 10811, 10812, 10818, 10819, 10820, 10821, 10824, 10825, 10826, 10829, 10830, 10831, 10833, 10836, 10838, 10839, 10840, 10841, 10843, 10846, 10847, 10850, 10852, 10853, 10854, 10857, 10858, 10860, 10861, 10862, 10867, 10871, 10874, 10877, 10880, 10881, 10887, 10892, 10896, 10897, 10898, 10899, 10902, 10905, 10910, 10912, 10917, 10920, 10926, 10927, 10928, 10930, 10933, 10934, 10935, 10936, 10937, 10938, 10940, 10941, 10944, 10947, 10948, 10950, 10954, 10957, 10960, 10962, 10963, 10965, 10967, 10972, 10976, 10977, 10978, 10979, 10981, 10988, 10993, 10995, 10996, 10997, 10998, 10999, 11002, 11004, 11005, 11006, 11008, 11010, 11018, 11024, 11026, 11027, 11032, 11033, 11039, 11046, 11047, 11052, 11053, 11056, 11058, 11060, 11066, 11068, 11070, 11072, 11078, 11080, 11082, 11083, 11086, 11090, 11095, 11098, 11101, 11102, 11107, 11108, 11110, 11114, 11116, 11118, 11119, 11123, 11124, 11125, 11126, 11127, 11129, 11135, 11137, 11138, 11145, 11146, 11148, 11153, 11154, 11158, 11159, 11160, 11161, 11162, 11163, 11165, 11166, 11168, 11169, 11175, 11177, 11178, 11184, 11187, 11188, 11190, 11192, 11194, 11198, 11199, 11201, 11202, 11204, 11207, 11214, 11217, 11218, 11222, 11224, 11226, 11227, 11228, 11229, 11230, 11232, 11233, 11234, 11235, 11236, 11237, 11238, 11239, 11244, 11246, 11247, 11248, 11254, 11255, 11256, 11257, 11258, 11259, 11260, 11262, 11263, 11264, 11266, 11274, 11275, 11278, 11286, 11288, 11289, 11290, 11291, 11292, 11293, 11294, 11295, 11298, 11305, 11306, 11307, 11313, 11315, 11316, 11318, 11319, 11320, 11322, 11324, 11326, 11329, 11330, 11331, 11332, 11337, 11338, 11339, 11340, 11345, 11346, 11348, 11352, 11356, 11358, 11363, 11364, 11365, 11370, 11371, 11373, 11377, 11381, 11382, 11385, 11387, 11388, 11389, 11391, 11392, 11394, 11395, 11397, 11403, 11404, 11405, 11406, 11409, 11411, 11412, 11413, 11414, 11416, 11418, 11420, 11423, 11426, 11428, 11430, 11431, 11434, 11437, 11438, 11443, 11445, 11446, 11449, 11459, 11463, 11465, 11466, 11467, 11471, 11472, 11473, 11475, 11476, 11477, 11478, 11481, 11482, 11485, 11487, 11490, 11494, 11496, 11497, 11498, 11500, 11501, 11503, 11506, 11507, 11508, 11509, 11512, 11516, 11518, 11520, 11526, 11528, 11530, 11531, 11532, 11533, 11534, 11535, 11538, 11541, 11544, 11546, 11548, 11551, 11553, 11558, 11560, 11561, 11567, 11571, 11576, 11577, 11578, 11580, 11583, 11585, 11586, 11588, 11589, 11593, 11594, 11595, 11597, 11598, 11599, 11604, 11610, 11615, 11618, 11620, 11621, 11623, 11625, 11627, 11628, 11629, 11632, 11633, 11636, 11637, 11639, 11642, 11650, 11651, 11652, 11654, 11655, 11656, 11657, 11658, 11663, 11664, 11667, 11669, 11673, 11678, 11681, 11682, 11683, 11688, 11691, 11692, 11693, 11694, 11695, 11699, 11701, 11703, 11705, 11707, 11711, 11712, 11718, 11720, 11721, 11722, 11725, 11726, 11731, 11733, 11736, 11740, 11741, 11743, 11744, 11753, 11755, 11756, 11759, 11760, 11761, 11762, 11763, 11764, 11765, 11766, 11767, 11770, 11771, 11776, 11780, 11782, 11783, 11784, 11785, 11786, 11790, 11792, 11795, 11799, 11800, 11809, 11812, 11813, 11814, 11816, 11818, 11819, 11826, 11828, 11829, 11830, 11837, 11841, 11846, 11848, 11849, 11850, 11851, 11853, 11854, 11856, 11858, 11860, 11863, 11864, 11865, 11868, 11870, 11872, 11876, 11877, 11878, 11881, 11890, 11891, 11894, 11898, 11899, 11903, 11909, 11911, 11913, 11919, 11920, 11921, 11923, 11926, 11928, 11929, 11930, 11934, 11935, 11940, 11941, 11943, 11946, 11947, 11948, 11949, 11953, 11955, 11957, 11958, 11959, 11960, 11961, 11962, 11963, 11965, 11966, 11968, 11974, 11976, 11977, 11978, 11979, 11980, 11983, 11988, 11993, 11994, 11995, 11996, 11997, 11998, 11999, 12002, 12004, 12008, 12019, 12020, 12021, 12023, 12024, 12025, 12029, 12032, 12042, 12043, 12044, 12047, 12050, 12051, 12054, 12059, 12060, 12061, 12064, 12068, 12078, 12079, 12080, 12081, 12083, 12085, 12086, 12091, 12092, 12093, 12097, 12098, 12102, 12104, 12106, 12109, 12110, 12112, 12115, 12118, 12120, 12122, 12126, 12128, 12129, 12131, 12134, 12135, 12137, 12138, 12139, 12142, 12143, 12144, 12145, 12146, 12147, 12148, 12149, 12151, 12153, 12155, 12161, 12162, 12165, 12166, 12167, 12170, 12171, 12174, 12175, 12179, 12181, 12187, 12197, 12202, 12204, 12208, 12212, 12214, 12215, 12217, 12220, 12223, 12227, 12229, 12230, 12233, 12234, 12237, 12240, 12241, 12243, 12245, 12246, 12249, 12250, 12252, 12253, 12254, 12255, 12256, 12259, 12269, 12271, 12278, 12280, 12281, 12283, 12285, 12286, 12287, 12295, 12296, 12310, 12311, 12312, 12313, 12314, 12315, 12317, 12319, 12321, 12323, 12325, 12331, 12334, 12337, 12339, 12342, 12343, 12345, 12347, 12350, 12354, 12356, 12359, 12364, 12366, 12369, 12370, 12375, 12376, 12379, 12381, 12385, 12390, 12393, 12394, 12397, 12399, 12400, 12401, 12403, 12406, 12411, 12414, 12415, 12416, 12419, 12420, 12423, 12424, 12426, 12427, 12428, 12437, 12440, 12441, 12444, 12445, 12450, 12451, 12455, 12456, 12457, 12459, 12461, 12462, 12465, 12467, 12468, 12470, 12472, 12473, 12477, 12478, 12479, 12480, 12481, 12488, 12492, 12495, 12497, 12503, 12508, 12510, 12511, 12512, 12513, 12514, 12515, 12518, 12519, 12527, 12529, 12530, 12532, 12535, 12536, 12537, 12538, 12539, 12540, 12546, 12547, 12548, 12549, 12551, 12552, 12554, 12555, 12556, 12561, 12563, 12565, 12567, 12568, 12570, 12572, 12577, 12578, 12580, 12583, 12584, 12585, 12586, 12588, 12589, 12591, 12600, 12603, 12605, 12608, 12609, 12610, 12611, 12616, 12620, 12622, 12623, 12626, 12628, 12629, 12630, 12631, 12634, 12638, 12639, 12640, 12641, 12645, 12648, 12649, 12650, 12651, 12654, 12655, 12663, 12664, 12668, 12670, 12671, 12674, 12679, 12681, 12683, 12684, 12685, 12688, 12689, 12691, 12693, 12695, 12696, 12697, 12699, 12701, 12702, 12705, 12706, 12707, 12714, 12723, 12726, 12729, 12731, 12732, 12733, 12735, 12737, 12738, 12739, 12740, 12741, 12742, 12752, 12753, 12754, 12755, 12757, 12758, 12760, 12764, 12765, 12766, 12771, 12772, 12773, 12775, 12777, 12782, 12790, 12794, 12797, 12800, 12802, 12803, 12807, 12810, 12812, 12813, 12817, 12820, 12822, 12823, 12824, 12827, 12828, 12834, 12835, 12836, 12837, 12838, 12839, 12843, 12844, 12848, 12849, 12850, 12853, 12860, 12861, 12866, 12870, 12873, 12875, 12878, 12882, 12883, 12884, 12887, 12898, 12899, 12900, 12901, 12903, 12904, 12905, 12906, 12908, 12910, 12912, 12916, 12917, 12920, 12921, 12922, 12923, 12928, 12929, 12932, 12933, 12934, 12935, 12938, 12939, 12945, 12946, 12947, 12953, 12956, 12958, 12959, 12960, 12963, 12967, 12968, 12969, 12978, 12983, 12984, 12986, 12987, 12988, 12989, 12990, 12991, 12999, 13001, 13003, 13004, 13007, 13010, 13014, 13015, 13017, 13018, 13022, 13027, 13030, 13031, 13032, 13033, 13034, 13035, 13038, 13040, 13041, 13047, 13050, 13053, 13054, 13055, 13056, 13061, 13062, 13064, 13066, 13071, 13075, 13079, 13085, 13086, 13087, 13098, 13099, 13101, 13102, 13105, 13106, 13110, 13111, 13112, 13114, 13115, 13117, 13118, 13120, 13121, 13122, 13123, 13124, 13125, 13128, 13131, 13134, 13136, 13144, 13147, 13148, 13149, 13151, 13154, 13159, 13160, 13169, 13170, 13175, 13181, 13182, 13186, 13188, 13189, 13190, 13197, 13198, 13199, 13205, 13206, 13209, 13212, 13213, 13215, 13217, 13220, 13221, 13224, 13226, 13227, 13228, 13232, 13234, 13235, 13236, 13237, 13239, 13241, 13248, 13250, 13251, 13255, 13256, 13259, 13260, 13261, 13262, 13263, 13264, 13265, 13267, 13268, 13269, 13271, 13274, 13281, 13297, 13298, 13300, 13301, 13303, 13304, 13313, 13315, 13317, 13329, 13332, 13337, 13340, 13343, 13345, 13346, 13347, 13348, 13350, 13352, 13361, 13363, 13367, 13368, 13369, 13370, 13377, 13380, 13381, 13385, 13386, 13391, 13393, 13394, 13395, 13396, 13397, 13403, 13404, 13407, 13408, 13410, 13416, 13417, 13418, 13419, 13423, 13424, 13430, 13433, 13439, 13441, 13448, 13451, 13456, 13457, 13460, 13463, 13464, 13467, 13469, 13473, 13474, 13475, 13477, 13478, 13480, 13489, 13491, 13492, 13494, 13496, 13497, 13499, 13503, 13505, 13512, 13513, 13514, 13515, 13518, 13519, 13521, 13522, 13524, 13525, 13526, 13529, 13532, 13539, 13540, 13543, 13544, 13545, 13546, 13547, 13549, 13551, 13552, 13553, 13555, 13558, 13559, 13561, 13568, 13569, 13574, 13580, 13584, 13587, 13597, 13599, 13600, 13601, 13602, 13604, 13605, 13606, 13611, 13612, 13613, 13614, 13620, 13621, 13623, 13628, 13630, 13631, 13632, 13634, 13636, 13637, 13638, 13639, 13641, 13647, 13650, 13651, 13652, 13653, 13654, 13660, 13662, 13663, 13665, 13668, 13675, 13677, 13678, 13679, 13683, 13687, 13688, 13689, 13697, 13698, 13699, 13700, 13702, 13706, 13710, 13713, 13714, 13715, 13716, 13719, 13720, 13722, 13727, 13729, 13730, 13734, 13736, 13737, 13739, 13742, 13745, 13747, 13750, 13753, 13755, 13756, 13764, 13766, 13767, 13768, 13772, 13773, 13774, 13775, 13777, 13779, 13780, 13782, 13783, 13786, 13787, 13791, 13793, 13794, 13796, 13809, 13816, 13817, 13818, 13819, 13822, 13823, 13828, 13830, 13834, 13835, 13843, 13849, 13852, 13853, 13858, 13866, 13867, 13869, 13870, 13872, 13873, 13877, 13879, 13885, 13887, 13888, 13891, 13892, 13895, 13897, 13898, 13899, 13901, 13906, 13908, 13909, 13910, 13911, 13917, 13918, 13919, 13920, 13921, 13924, 13925, 13932, 13934, 13944, 13950, 13953, 13954, 13958, 13960, 13963, 13969, 13970, 13971, 13975, 13984, 13986, 13987, 13990, 13991, 13999, 14000, 14001, 14005, 14006, 14008, 14009, 14014, 14017, 14018, 14022, 14027, 14030, 14031, 14036, 14038, 14040, 14049, 14051, 14052, 14059, 14062, 14063, 14066, 14067, 14069, 14070, 14071, 14073, 14074, 14075, 14076, 14078, 14080, 14081, 14085, 14086, 14087, 14088, 14092, 14094, 14096, 14105, 14111, 14112, 14116, 14117, 14118, 14119, 14121, 14122, 14124, 14129, 14130, 14132, 14133, 14135, 14137, 14138, 14139, 14140, 14141, 14142, 14145, 14146, 14147.

Promoters expressing in the embryo at 18 days after pollination include SEQ IDs: 3, 7, 9, 12, 14, 15, 16, 17, 26, 27, 29, 31, 33, 34, 36, 37, 44, 48, 54, 56, 57, 63, 64, 65, 79, 80, 86, 88, 90, 93, 94, 96, 98, 99, 100, 102, 103, 104, 110, 117, 121, 123, 126, 130, 131, 135, 137, 143, 144, 146, 147, 148, 152, 154, 156, 157, 159, 162, 165, 168, 174, 175, 176, 179, 181, 183, 187, 191, 193, 194, 196, 197, 199, 202, 203, 204, 205, 207, 210, 211, 214, 223, 232, 234, 235, 236, 237, 240, 246, 249, 250, 251, 256, 257, 259, 264, 267, 271, 273, 286, 288, 289, 293, 294, 298, 301, 302, 305, 306, 308, 309, 314, 316, 319, 320, 322, 323, 328, 329, 332, 334, 335, 337, 338, 340, 346, 349, 352, 353, 354, 355, 356, 358, 360, 364, 365, 371, 373, 374, 379, 380, 381, 386, 388, 396, 401, 404, 411, 412, 414, 416, 423, 428, 429, 431, 432, 433, 434, 441, 448, 450, 452, 456, 458, 459, 461, 462, 463, 466, 468, 470, 471, 474, 478, 479, 483, 485, 488, 489, 493, 496, 498, 502, 504, 505, 507, 509, 510, 511, 514, 515, 516, 517, 522, 523, 525, 532, 535, 536, 537, 541, 543, 544, 546, 547, 548, 549, 553, 554, 555, 556, 557, 560, 561, 563, 578, 580, 585, 591, 594, 595, 596, 599, 605, 606, 607, 609, 613, 619, 620, 623, 631, 633, 635, 636, 637, 638, 643, 647, 650, 661, 663, 664, 670, 671, 681, 683, 687, 693, 694, 701, 702, 705, 706, 709, 716, 717, 718, 722, 723, 724, 727, 731, 732, 734, 736, 740, 742, 744, 749, 750, 753, 757, 759, 760, 762, 764, 765, 779, 781, 782, 783, 784, 792, 793, 800, 804, 806, 808, 809, 811, 812, 820, 821, 822, 824, 825, 826, 829, 830, 833, 840, 841, 846, 849, 852, 855, 856, 857, 858, 860, 862, 863, 865, 870, 871, 872, 875, 876, 877, 878, 887, 890, 891, 892, 893, 895, 897, 898, 899, 900, 903, 907, 908, 911, 912, 913, 915, 916, 917, 919, 920, 924, 928, 932, 934, 936, 939, 943, 944, 947, 949, 951, 953, 955, 957, 958, 960, 964, 971, 974, 976, 977, 978, 979, 980, 981, 982, 984, 985, 993, 994, 995, 997, 999, 1002, 1003, 1005, 1006, 1007, 1008, 1009, 1011, 1012, 1014, 1016, 1017, 1019, 1022, 1025, 1026, 1032, 1033, 1035, 1038, 1039, 1041, 1043, 1046, 1047, 1049, 1051, 1052, 1054, 1055, 1056, 1057, 1059, 1065, 1067, 1069, 1070, 1074, 1076, 1077, 1080, 1085, 1086, 1087, 1089, 1092, 1095, 1097, 1100, 1101, 1103, 1104, 1110, 1111, 1112, 1114, 1115, 1116, 1117, 1119, 1121, 1125, 1130, 1132, 1136, 1137, 1140, 1144, 1146, 1148, 1153, 1154, 1155, 1160, 1161, 1162, 1164, 1165, 1167, 1168, 1170, 1171, 1176, 1178, 1180, 1183, 1185, 1186, 1187, 1189, 1190, 1191, 1196, 1201, 1205, 1214, 1215, 1217, 1218, 1220, 1222, 1223, 1225, 1227, 1228, 1230, 1233, 1236, 1237, 1239, 1240, 1249, 1251, 1254, 1257, 1258, 1261, 1263, 1269, 1272, 1281, 1285, 1286, 1290, 1292, 1293, 1296, 1303, 1306, 1307, 1309, 1310, 1311, 1312, 1314, 1316, 1320, 1322, 1323, 1325, 1327, 1330, 1331, 1334, 1337, 1339, 1344, 1345, 1347, 1349, 1354, 1355, 1360, 1364, 1366, 1367, 1368, 1371, 1375, 1376, 1377, 1380, 1381, 1387, 1388, 1389, 1391, 1393, 1396, 1402, 1404, 1405, 1406, 1412, 1415, 1420, 1421, 1423, 1426, 1431, 1432, 1433, 1435, 1437, 1438, 1440, 1441, 1442, 1443, 1444, 1447, 1448, 1451, 1453, 1458, 1459, 1461, 1464, 1466, 1471, 1472, 1475, 1484, 1485, 1486, 1488, 1489, 1490, 1491, 1493, 1498, 1499, 1501, 1503, 1504, 1506, 1512, 1514, 1518, 1519, 1527, 1528, 1530, 1536, 1539, 1543, 1545, 1546, 1549, 1550, 1551, 1554, 1555, 1556, 1561, 1563, 1564, 1566, 1567, 1570, 1575, 1578, 1579, 1582, 1584, 1585, 1586, 1590, 1591, 1597, 1598, 1599, 1600, 1601, 1602, 1604, 1605, 1608, 1609, 1610, 1612, 1614, 1615, 1616, 1617, 1623, 1625, 1627, 1628, 1629, 1634, 1635, 1636, 1637, 1638, 1641, 1642, 1643, 1648, 1650, 1651, 1653, 1654, 1658, 1659, 1662, 1663, 1668, 1669, 1671, 1673, 1675, 1676, 1678, 1681, 1682, 1684, 1685, 1687, 1688, 1689, 1690, 1691, 1696, 1697, 1698, 1699, 1703, 1705, 1706, 1707, 1708, 1709, 1710, 1716, 1717, 1718, 1720, 1723, 1725, 1732, 1733, 1735, 1736, 1749, 1750, 1755, 1761, 1764, 1769, 1773, 1774, 1776, 1777, 1779, 1785, 1786, 1791, 1792, 1793, 1796, 1798, 1807, 1809, 1811, 1812, 1813, 1814, 1820, 1822, 1826, 1828, 1830, 1832, 1834, 1837, 1839, 1840, 1848, 1852, 1854, 1855, 1859, 1861, 1863, 1866, 1867, 1869, 1872, 1873, 1876, 1879, 1880, 1882, 1886, 1888, 1891, 1893, 1897, 1898, 1899, 1900, 1902, 1904, 1905, 1906, 1910, 1911, 1913, 1916, 1918, 1920, 1922, 1923, 1924, 1928, 1930, 1931, 1933, 1934, 1936, 1939, 1940, 1944, 1945, 1949, 1950, 1952, 1953, 1954, 1958, 1968, 1970, 1971, 1972, 1973, 1977, 1979, 1981, 1990, 1993, 1994, 1995, 1996, 1999, 2000, 2001, 2007, 2008, 2009, 2010, 2012, 2014, 2015, 2017, 2019, 2021, 2026, 2031, 2032, 2036, 2037, 2040, 2041, 2042, 2043, 2045, 2048, 2057, 2060, 2062, 2064, 2066, 2072, 2074, 2077, 2078, 2085, 2087, 2088, 2089, 2091, 2092, 2093, 2094, 2096, 2097, 2099, 2103, 2104, 2106, 2107, 2112, 2116, 2117, 2119, 2122, 2123, 2125, 2128, 2130, 2132, 2133, 2137, 2139, 2140, 2141, 2142, 2143, 2144, 2146, 2147, 2150, 2151, 2156, 2157, 2158, 2159, 2161, 2164, 2167, 2170, 2175, 2177, 2179, 2183, 2185, 2188, 2189, 2193, 2196, 2200, 2206, 2207, 2210, 2214, 2215, 2216, 2221, 2223, 2235, 2240, 2241, 2242, 2243, 2253, 2257, 2260, 2263, 2266, 2267, 2274, 2276, 2278, 2280, 2282, 2283, 2284, 2291, 2296, 2297, 2298, 2300, 2303, 2304, 2306, 2308, 2309, 2310, 2313, 2314, 2322, 2323, 2325, 2328, 2329, 2331, 2337, 2339, 2342, 2343, 2345, 2348, 2353, 2359, 2361, 2362, 2363, 2366, 2371, 2372, 2379, 2380, 2381, 2382, 2384, 2395, 2401, 2402, 2405, 2410, 2412, 2413, 2414, 2416, 2418, 2419, 2420, 2423, 2428, 2430, 2431, 2432, 2433, 2434, 2435, 2436, 2437, 2439, 2440, 2441, 2442, 2443, 2445, 2451, 2452, 2453, 2454, 2456, 2457, 2458, 2465, 2469, 2470, 2472, 2474, 2476, 2477, 2479, 2480, 2481, 2482, 2485, 2487, 2490, 2494, 2495, 2496, 2497, 2498, 2500, 2505, 2506, 2507, 2509, 2510, 2513, 2514, 2515, 2516, 2517, 2519, 2521, 2522, 2525, 2528, 2529, 2531, 2532, 2533, 2534, 2536, 2537, 2538, 2539, 2540, 2541, 2544, 2545, 2546, 2549, 2550, 2551, 2552, 2554, 2555, 2559, 2567, 2568, 2570, 2573, 2576, 2578, 2579, 2581, 2583, 2589, 2590, 2594, 2596, 2599, 2600, 2601, 2605, 2609, 2611, 2613, 2616, 2618, 2625, 2627, 2632, 2634, 2635, 2636, 2639, 2644, 2645, 2647, 2648, 2649, 2652, 2655, 2656, 2658, 2661, 2662, 2663, 2666, 2670, 2671, 2672, 2674, 2676, 2678, 2684, 2685, 2687, 2688, 2689, 2690, 2691, 2692, 2694, 2700, 2702, 2704, 2708, 2709, 2711, 2715, 2719, 2720, 2721, 2722, 2725, 2726, 2728, 2729, 2735, 2738, 2739, 2745, 2746, 2747, 2749, 2752, 2755, 2756, 2758, 2762, 2764, 2765, 2770, 2775, 2776, 2783, 2784, 2787, 2794, 2798, 2800, 2801, 2802, 2805, 2808, 2812, 2814, 2819, 2821, 2822, 2823, 2824, 2826, 2827, 2828, 2831, 2832, 2837, 2838, 2840, 2844, 2850, 2860, 2861, 2865, 2869, 2871, 2876, 2878, 2888, 2889, 2893, 2894, 2895, 2896, 2897, 2898, 2901, 2902, 2903, 2906, 2908, 2909, 2911, 2914, 2915, 2916, 2917, 2918, 2919, 2922, 2923, 2926, 2929, 2930, 2931, 2935, 2937, 2941, 2942, 2943, 2944, 2946, 2947, 2948, 2951, 2955, 2959, 2962, 2963, 2966, 2968, 2969, 2976, 2979, 2982, 2992, 2994, 2998, 3003, 3005, 3007, 3013, 3015, 3017, 3018, 3020, 3023, 3024, 3029, 3031, 3039, 3041, 3042, 3044, 3045, 3047, 3048, 3049, 3051, 3052, 3053, 3055, 3064, 3068, 3070, 3072, 3080, 3083, 3084, 3085, 3087, 3090, 3097, 3100, 3101, 3106, 3115, 3118, 3119, 3120, 3121, 3122, 3123, 3127, 3128, 3137, 3139, 3142, 3143, 3145, 3149, 3153, 3167, 3169, 3170, 3172, 3177, 3181, 3187, 3191, 3192, 3194, 3196, 3200, 3202, 3205, 3206, 3208, 3210, 3217, 3219, 3220, 3221, 3224, 3225, 3228, 3230, 3240, 3242, 3246, 3249, 3250, 3252, 3254, 3261, 3263, 3266, 3267, 3268, 3269, 3271, 3272, 3278, 3280, 3283, 3286, 3288, 3290, 3291, 3294, 3295, 3297, 3299, 3301, 3308, 3310, 3312, 3313, 3324, 3331, 3332, 3333, 3337, 3338, 3340, 3342, 3343, 3345, 3347, 3351, 3353, 3354, 3355, 3356, 3357, 3358, 3359, 3360, 3361, 3363, 3368, 3370, 3374, 3376, 3377, 3378, 3379, 3383, 3386, 3394, 3396, 3399, 3403, 3404, 3405, 3413, 3415, 3416, 3418, 3419, 3424, 3426, 3427, 3428, 3445, 3446, 3447, 3449, 3452, 3453, 3457, 3458, 3461, 3462, 3465, 3466, 3468, 3469, 3470, 3471, 3474, 3477, 3483, 3484, 3486, 3488, 3490, 3493, 3494, 3499, 3500, 3502, 3503, 3504, 3507, 3510, 3516, 3521, 3522, 3523, 3524, 3527, 3533, 3535, 3536, 3537, 3538, 3541, 3542, 3544, 3545, 3549, 3552, 3554, 3558, 3560, 3562, 3569, 3574, 3576, 3580, 3582, 3587, 3588, 3589, 3591, 3592, 3594, 3595, 3600, 3601, 3603, 3604, 3607, 3611, 3612, 3613, 3616, 3618, 3620, 3621, 3624, 3633, 3634, 3642, 3643, 3644, 3645, 3646, 3647, 3648, 3659, 3660, 3661, 3667, 3672, 3674, 3677, 3681, 3682, 3684, 3685, 3690, 3693, 3694, 3706, 3707, 3709, 3713, 3715, 3718, 3719, 3721, 3725, 3730, 3731, 3744, 3749, 3752, 3756, 3757, 3758, 3760, 3761, 3764, 3765, 3766, 3771, 3772, 3773, 3775, 3777, 3778, 3785, 3791, 3792, 3793, 3794, 3798, 3801, 3806, 3808, 3817, 3818, 3819, 3823, 3825, 3828, 3829, 3830, 3831, 3832, 3833, 3834, 3837, 3838, 3843, 3844, 3845, 3846, 3847, 3849, 3852, 3858, 3859, 3860, 3867, 3868, 3870, 3871, 3872, 3873, 3881, 3882, 3883, 3884, 3885, 3887, 3889, 3890, 3892, 3893, 3894, 3895, 3896, 3897, 3899, 3902, 3903, 3904, 3907, 3908, 3912, 3913, 3917, 3918, 3928, 3929, 3931, 3933, 3935, 3938, 3947, 3950, 3951, 3952, 3954, 3958, 3962, 3967, 3968, 3970, 3971, 3974, 3975, 3978, 3979, 3983, 3987, 3988, 3994, 3996, 3997, 3998, 4000, 4007, 4008, 4013, 4014, 4019, 4020, 4021, 4028, 4030, 4033, 4037, 4039, 4040, 4041, 4042, 4043, 4046, 4048, 4049, 4050, 4051, 4052, 4053, 4054, 4056, 4057, 4058, 4062, 4066, 4067, 4068, 4070, 4072, 4075, 4079, 4080, 4084, 4088, 4090, 4092, 4094, 4096, 4098, 4099, 4102, 4105, 4106, 4109, 4110, 4113, 4116, 4122, 4124, 4126, 4128, 4133, 4134, 4139, 4140, 4143, 4144, 4146, 4147, 4148, 4149, 4150, 4151, 4160, 4163, 4164, 4165, 4166, 4167, 4168, 4171, 4175, 4178, 4181, 4183, 4185, 4187, 4188, 4189, 4191, 4192, 4193, 4194, 4195, 4201, 4202, 4204, 4205, 4206, 4207, 4208, 4210, 4211, 4212, 4216, 4219, 4221, 4227, 4228, 4229, 4232, 4233, 4234, 4235, 4237, 4240, 4244, 4245, 4246, 4250, 4251, 4252, 4255, 4257, 4261, 4266, 4270, 4272, 4275, 4276, 4280, 4281, 4282, 4283, 4284, 4288, 4292, 4294, 4296, 4298, 4300, 4301, 4302, 4303, 4305, 4306, 4309, 4312, 4320, 4321, 4324, 4329, 4330, 4333, 4335, 4336, 4337, 4338, 4341, 4344, 4347, 4358, 4359, 4360, 4369, 4370, 4375, 4378, 4380, 4383, 4390, 4391, 4392, 4393, 4396, 4397, 4401, 4402, 4403, 4404, 4405, 4409, 4410, 4419, 4422, 4423, 4425, 4432, 4436, 4439, 4440, 4442, 4443, 4446, 4448, 4449, 4450, 4453, 4456, 4458, 4461, 4462, 4463, 4466, 4468, 4470, 4474, 4475, 4477, 4479, 4485, 4490, 4492, 4494, 4497, 4498, 4500, 4502, 4507, 4508, 4512, 4514, 4515, 4519, 4521, 4522, 4525, 4529, 4531, 4535, 4545, 4548, 4549, 4551, 4554, 4555, 4556, 4557, 4558, 4560, 4562, 4563, 4565, 4567, 4568, 4575, 4576, 4580, 4582, 4583, 4590, 4591, 4594, 4597, 4598, 4601, 4604, 4606, 4608, 4616, 4618, 4623, 4625, 4628, 4630, 4632, 4633, 4634, 4635, 4636, 4639, 4641, 4643, 4644, 4645, 4647, 4650, 4651, 4653, 4654, 4655, 4656, 4657, 4658, 4659, 4662, 4664, 4667, 4669, 4671, 4673, 4674, 4676, 4677, 4680, 4682, 4685, 4691, 4692, 4694, 4697, 4700, 4704, 4706, 4708, 4711, 4713, 4719, 4721, 4723, 4724, 4725, 4728, 4730, 4734, 4736, 4737, 4738, 4739, 4740, 4741, 4745, 4746, 4749, 4750, 4753, 4755, 4756, 4761, 4762, 4764, 4769, 4770, 4773, 4775, 4779, 4780, 4784, 4787, 4788, 4789, 4790, 4791, 4794, 4795, 4796, 4801, 4803, 4804, 4805, 4806, 4807, 4813, 4814, 4818, 4822, 4828, 4830, 4831, 4834, 4838, 4840, 4841, 4842, 4848, 4855, 4856, 4857, 4859, 4861, 4862, 4863, 4869, 4874, 4875, 4876, 4878, 4880, 4881, 4887, 4889, 4890, 4891, 4895, 4896, 4897, 4902, 4904, 4905, 4907, 4909, 4910, 4913, 4914, 4918, 4921, 4922, 4923, 4924, 4925, 4926, 4930, 4935, 4936, 4941, 4942, 4944, 4950, 4954, 4956, 4958, 4959, 4967, 4969, 4971, 4972, 4974, 4975, 4983, 4985, 4987, 4988, 4989, 4990, 4993, 4994, 4996, 5000, 5007, 5015, 5016, 5026, 5029, 5030, 5034, 5036, 5037, 5038, 5039, 5040, 5042, 5044, 5045, 5046, 5051, 5052, 5054, 5057, 5060, 5067, 5068, 5069, 5072, 5075, 5078, 5082, 5084, 5087, 5088, 5089, 5090, 5091, 5094, 5095, 5100, 5101, 5102, 5106, 5111, 5114, 5116, 5119, 5120, 5129, 5131, 5132, 5140, 5143, 5145, 5146, 5147, 5148, 5149, 5151, 5153, 5159, 5160, 5164, 5165, 5168, 5170, 5171, 5172, 5174, 5180, 5181, 5184, 5185, 5187, 5188, 5189, 5190, 5191, 5192, 5195, 5196, 5198, 5200, 5202, 5203, 5206, 5212, 5213, 5217, 5218, 5219, 5224, 5225, 5229, 5234, 5239, 5241, 5249, 5251, 5252, 5253, 5254, 5255, 5256, 5257, 5258, 5260, 5261, 5263, 5267, 5268, 5269, 5273, 5274, 5275, 5276, 5280, 5281, 5282, 5283, 5286, 5289, 5293, 5297, 5298, 5299, 5300, 5301, 5302, 5308, 5311, 5315, 5317, 5318, 5319, 5321, 5324, 5329, 5330, 5333, 5334, 5338, 5339, 5342, 5345, 5346, 5348, 5349, 5351, 5352, 5366, 5367, 5369, 5371, 5386, 5388, 5389, 5391, 5393, 5395, 5396, 5397, 5402, 5405, 5409, 5411, 5413, 5414, 5417, 5418, 5422, 5427, 5428, 5431, 5433, 5434, 5437, 5438, 5446, 5448, 5449, 5450, 5452, 5453, 5456, 5458, 5459, 5461, 5463, 5464, 5466, 5472, 5474, 5475, 5483, 5485, 5487, 5488, 5491, 5493, 5495, 5496, 5498, 5505, 5506, 5508, 5510, 5512, 5513, 5517, 5518, 5519, 5524, 5526, 5529, 5530, 5531, 5534, 5535, 5543, 5545, 5549, 5554, 5557, 5562, 5563, 5565, 5566, 5568, 5569, 5572, 5575, 5579, 5581, 5582, 5584, 5585, 5589, 5591, 5593, 5594, 5597, 5602, 5608, 5612, 5613, 5614, 5615, 5616, 5619, 5620, 5621, 5623, 5627, 5633, 5635, 5638, 5640, 5643, 5646, 5647, 5648, 5651, 5652, 5653, 5656, 5659, 5660, 5662, 5663, 5667, 5669, 5680, 5681, 5689, 5690, 5694, 5695, 5697, 5698, 5702, 5706, 5711, 5718, 5719, 5721, 5722, 5729, 5730, 5731, 5732, 5734, 5735, 5736, 5737, 5742, 5744, 5751, 5768, 5770, 5771, 5773, 5775, 5778, 5780, 5782, 5785, 5787, 5791, 5792, 5794, 5805, 5807, 5808, 5810, 5811, 5814, 5815, 5816, 5817, 5820, 5826, 5828, 5832, 5833, 5834, 5835, 5836, 5837, 5839, 5842, 5844, 5854, 5859, 5864, 5866, 5867, 5868, 5869, 5871, 5872, 5875, 5876, 5877, 5878, 5879, 5881, 5882, 5883, 5888, 5889, 5892, 5893, 5900, 5902, 5906, 5910, 5912, 5919, 5921, 5922, 5923, 5925, 5926, 5927, 5928, 5930, 5931, 5932, 5933, 5936, 5938, 5939, 5941, 5942, 5944, 5945, 5946, 5948, 5951, 5952, 5954, 5956, 5957, 5959, 5961, 5968, 5969, 5971, 5978, 5980, 5985, 5986, 5988, 5991, 5996, 5997, 6000, 6003, 6004, 6006, 6007, 6010, 6012, 6013, 6016, 6017, 6023, 6025, 6026, 6034, 6038, 6040, 6041, 6042, 6044, 6047, 6048, 6051, 6053, 6054, 6058, 6059, 6062, 6063, 6068, 6069, 6070, 6072, 6073, 6074, 6075, 6080, 6083, 6085, 6088, 6089, 6092, 6093, 6094, 6095, 6097, 6098, 6107, 6108, 6109, 6112, 6113, 6116, 6118, 6119, 6122, 6129, 6130, 6131, 6132, 6133, 6135, 6136, 6137, 6138, 6140, 6143, 6145, 6146, 6147, 6149, 6151, 6152, 6153, 6156, 6163, 6164, 6165, 6168, 6176, 6181, 6182, 6183, 6186, 6188, 6189, 6190, 6191, 6193, 6197, 6198, 6200, 6205, 6207, 6209, 6212, 6215, 6219, 6220, 6223, 6224, 6227, 6228, 6230, 6231, 6233, 6234, 6237, 6238, 6240, 6243, 6244, 6245, 6246, 6247, 6248, 6249, 6250, 6251, 6255, 6257, 6258, 6259, 6264, 6265, 6269, 6270, 6271, 6272, 6273, 6275, 6278, 6279, 6280, 6281, 6282, 6283, 6284, 6285, 6286, 6288, 6289, 6292, 6295, 6299, 6302, 6309, 6310, 6311, 6312, 6314, 6315, 6317, 6319, 6321, 6322, 6325, 6328, 6330, 6333, 6334, 6338, 6346, 6351, 6352, 6353, 6354, 6359, 6362, 6363, 6367, 6370, 6372, 6373, 6375, 6378, 6379, 6381, 6383, 6387, 6394, 6395, 6396, 6398, 6399, 6403, 6405, 6407, 6410, 6412, 6413, 6414, 6415, 6419, 6420, 6425, 6426, 6429, 6430, 6431, 6434, 6435, 6436, 6437, 6440, 6442, 6454, 6458, 6459, 6464, 6465, 6466, 6467, 6468, 6469, 6470, 6471, 6474, 6476, 6480, 6484, 6486, 6488, 6493, 6495, 6500, 6501, 6502, 6503, 6504, 6505, 6510, 6513, 6516, 6517, 6519, 6524, 6525, 6526, 6530, 6533, 6534, 6535, 6537, 6539, 6543, 6544, 6545, 6547, 6548, 6549, 6554, 6555, 6558, 6560, 6561, 6563, 6567, 6569, 6574, 6576, 6577, 6579, 6581, 6582, 6584, 6587, 6588, 6589, 6595, 6598, 6599, 6600, 6607, 6611, 6614, 6620, 6621, 6622, 6624, 6625, 6626, 6627, 6630, 6634, 6635, 6637, 6638, 6639, 6643, 6644, 6649, 6650, 6652, 6655, 6658, 6662, 6666, 6671, 6677, 6681, 6686, 6691, 6692, 6695, 6696, 6699, 6702, 6703, 6704, 6705, 6706, 6711, 6714, 6716, 6718, 6720, 6724, 6725, 6729, 6734, 6736, 6737, 6739, 6746, 6747, 6748, 6752, 6756, 6757, 6758, 6759, 6760, 6761, 6764, 6766, 6778, 6779, 6780, 6786, 6788, 6789, 6792, 6793, 6794, 6797, 6799, 6801, 6803, 6804, 6805, 6807, 6810, 6811, 6812, 6813, 6815, 6816, 6819, 6820, 6821, 6824, 6827, 6828, 6829, 6830, 6831, 6834, 6836, 6837, 6839, 6840, 6841, 6842, 6843, 6845, 6851, 6852, 6859, 6863, 6864, 6865, 6869, 6872, 6874, 6875, 6878, 6879, 6880, 6884, 6885, 6888, 6890, 6895, 6897, 6903, 6904, 6907, 6909, 6914, 6915, 6917, 6919, 6920, 6921, 6923, 6924, 6930, 6933, 6936, 6941, 6943, 6946, 6948, 6959, 6960, 6963, 6967, 6969, 6970, 6979, 6980, 6984, 6985, 6987, 6988, 6990, 6991, 6993, 6994, 6995, 6997, 7002, 7003, 7006, 7009, 7011, 7012, 7013, 7015, 7022, 7038, 7039, 7042, 7043, 7045, 7046, 7048, 7051, 7052, 7053, 7056, 7057, 7064, 7067, 7072, 7073, 7075, 7077, 7083, 7084, 7085, 7086, 7093, 7105, 7106, 7107, 7108, 7112, 7113, 7116, 7117, 7118, 7124, 7130, 7132, 7135, 7140, 7142, 7144, 7149, 7155, 7163, 7164, 7165, 7166, 7169, 7176, 7177, 7184, 7187, 7188, 7192, 7194, 7196, 7201, 7203, 7206, 7207, 7208, 7209, 7212, 7216, 7217, 7220, 7227, 7228, 7230, 7231, 7234, 7235, 7236, 7239, 7240, 7241, 7243, 7244, 7245, 7255, 7257, 7258, 7259, 7262, 7267, 7268, 7274, 7276, 7277, 7278, 7281, 7282, 7284, 7287, 7288, 7290, 7291, 7292, 7293, 7298, 7299, 7300, 7301, 7303, 7304, 7305, 7306, 7307, 7308, 7310, 7312, 7313, 7315, 7317, 7321, 7328, 7330, 7334, 7336, 7339, 7340, 7344, 7354, 7355, 7356, 7357, 7358, 7360, 7363, 7365, 7371, 7373, 7379, 7380, 7381, 7382, 7383, 7386, 7388, 7389, 7392, 7395, 7398, 7409, 7410, 7411, 7417, 7418, 7424, 7425, 7428, 7430, 7431, 7434, 7435, 7436, 7438, 7441, 7443, 7444, 7445, 7446, 7447, 7448, 7452, 7454, 7458, 7459, 7464, 7466, 7470, 7472, 7483, 7486, 7487, 7490, 7492, 7493, 7498, 7502, 7504, 7505, 7506, 7512, 7514, 7515, 7517, 7518, 7523, 7524, 7525, 7528, 7529, 7533, 7534, 7538, 7546, 7547, 7548, 7554, 7557, 7561, 7570, 7572, 7574, 7577, 7578, 7579, 7580, 7583, 7585, 7586, 7587, 7590, 7591, 7593, 7594, 7598, 7605, 7611, 7613, 7619, 7620, 7621, 7623, 7624, 7629, 7633, 7638, 7639, 7640, 7642, 7647, 7652, 7653, 7655, 7658, 7661, 7663, 7664, 7665, 7666, 7667, 7669, 7674, 7676, 7677, 7678, 7679, 7680, 7682, 7685, 7686, 7687, 7689, 7693, 7695, 7699, 7700, 7703, 7704, 7708, 7712, 7716, 7717, 7718, 7719, 7724, 7725, 7726, 7729,
7733, 7736, 7737, 7738, 7740, 7743, 7744, 7745, 7748, 7751,
7753, 7755, 7761, 7762, 7763, 7767, 7768, 7769, 7770, 7772,
7774, 7775, 7777, 7778, 7779, 7780, 7782, 7783, 7785, 7786,
7788, 7791, 7792, 7793, 7798, 7799, 7800, 7803, 7804, 7806,
7807, 7812, 7815, 7818, 7819, 7820, 7823, 7824, 7825, 7832,
7833, 7834, 7838, 7841, 7844, 7847, 7848, 7849, 7850, 7852,
7856, 7858, 7859, 7860, 7862, 7863, 7865, 7875, 7876, 7878,
7880, 7888, 7890, 7896, 7900, 7908, 7910, 7911, 7917, 7918,
7920, 7921, 7923, 7925, 7927, 7928, 7929, 7933, 7934, 7935,
7936, 7937, 7938, 7942, 7944, 7945, 7946, 7947, 7948, 7949,
7950, 7951, 7952, 7955, 7956, 7964, 7965, 7966, 7967, 7971,
7972, 7974, 7976, 7977, 7978, 7980, 7981, 7983, 7984, 7986,
7988, 7989, 7990, 7991, 7993, 7998, 8002, 8004, 8006, 8007,
8008, 8009, 8012, 8021, 8026, 8029, 8039, 8042, 8044, 8047,
8048, 8052, 8053, 8056, 8058, 8059, 8061, 8063, 8067, 8068,
8071, 8072, 8075, 8076, 8077, 8078, 8079, 8080, 8082, 8084,
8088, 8091, 8093, 8095, 8100, 8102, 8103, 8105, 8112, 8115,
8116, 8118, 8121, 8123, 8126, 8134, 8136, 8137, 8145, 8146,
8148, 8150, 8151, 8159, 8162, 8163, 8165, 8166, 8168, 8170,
8176, 8178, 8179, 8182, 8187, 8188, 8189, 8193, 8195, 8199,
8202, 8204, 8207, 8208, 8210, 8211, 8213, 8216, 8217, 8219,
8220, 8223, 8225, 8227, 8231, 8234, 8235, 8236, 8237, 8239,
8242, 8245, 8250, 8252, 8253, 8257, 8258, 8265, 8266, 8268,
8269, 8270, 8272, 8289, 8291, 8293, 8294, 8300, 8301, 8304,
8306, 8310, 8311, 8312, 8318, 8319, 8320, 8321, 8329, 8331,
8334, 8335, 8336, 8339, 8340, 8350, 8352, 8353, 8355, 8361,
8363, 8367, 8368, 8369, 8373, 8379, 8385, 8386, 8387, 8389,
8390, 8392, 8393, 8395, 8401, 8402, 8403, 8404, 8410, 8413,
8414, 8416, 8423, 8430, 8433, 8435, 8436, 8438, 8439, 8441,
8442, 8444, 8446, 8447, 8448, 8449, 8450, 8451, 8452, 8456,
8458, 8459, 8463, 8465, 8466, 8469, 8470, 8472, 8473, 8474,
8476, 8477, 8480, 8481, 8482, 8485, 8486, 8490, 8493, 8494,
8498, 8501, 8505, 8509, 8511, 8513, 8515, 8517, 8520, 8523,
8524, 8525, 8528, 8531, 8532, 8533, 8535, 8537, 8538, 8539,
8542, 8549, 8550, 8552, 8553, 8554, 8557, 8561, 8562, 8565,
8568, 8575, 8576, 8579, 8581, 8582, 8589, 8590, 8592, 8593,
8594, 8596, 8597, 8599, 8600, 8601, 8602, 8603, 8604, 8605,
8610, 8611, 8612, 8613, 8614, 8617, 8618, 8628, 8631, 8634,
8635, 8637, 8638, 8640, 8641, 8642, 8644, 8647, 8648, 8650,
8654, 8657, 8658, 8659, 8660, 8665, 8669, 8670, 8672, 8676,
8677, 8685, 8693, 8699, 8700, 8703, 8704, 8706, 8708, 8709,
8712, 8713, 8716, 8717, 8720, 8726, 8727, 8729, 8731, 8732,
8734, 8735, 8736, 8741, 8742, 8743, 8744, 8746, 8748, 8751,
8752, 8753, 8757, 8758, 8761, 8764, 8766, 8767, 8770, 8772,
8773, 8775, 8777, 8779, 8782, 8783, 8784, 8789, 8792, 8796,
8797, 8803, 8805, 8808, 8810, 8818, 8821, 8822, 8824, 8829,
8831, 8832, 8834, 8835, 8838, 8841, 8843, 8846, 8853, 8854,
8859, 8861, 8865, 8867, 8876, 8877, 8878, 8881, 8883, 8884,
8886, 8888, 8891, 8892, 8896, 8899, 8900, 8902, 8905, 8907,
8908, 8909, 8910, 8911, 8913, 8914, 8916, 8917, 8924, 8926,
8929, 8930, 8935, 8938, 8941, 8942, 8945, 8946, 8949, 8951,
8954, 8956, 8957, 8959, 8960, 8963, 8967, 8968, 8969, 8972,
8974, 8976, 8977, 8979, 8980, 8981, 8985, 8986, 8991, 8992,
8996, 8998, 8999, 9001, 9002, 9003, 9006, 9009, 9012, 9015,
9018, 9020, 9023, 9029, 9030, 9033, 9037, 9044, 9047, 9052,
9056, 9057, 9058, 9059, 9060, 9061, 9066, 9069, 9071, 9072,
9073, 9074, 9076, 9080, 9084, 9088, 9091, 9092, 9095, 9096,
9098, 9103, 9105, 9108, 9110, 9111, 9112, 9114, 9115, 9118,
9119, 9123, 9125, 9129, 9133, 9134, 9138, 9139, 9140, 9141,
9142, 9149, 9151, 9152, 9154, 9155, 9167, 9168, 9173, 9174,
9175, 9177, 9183, 9185, 9187, 9188, 9190, 9191, 9195, 9204,
9205, 9206, 9207, 9210, 9211, 9213, 9215, 9216, 9218, 9223,
9226, 9229, 9233, 9237, 9241, 9243, 9247, 9249, 9252, 9253,
9254, 9255, 9263, 9267, 9269, 9270, 9273, 9276, 9284, 9285,
9287, 9288, 9290, 9292, 9293, 9299, 9300, 9304, 9308, 9311,
9314, 9320, 9321, 9323, 9325, 9326, 9327, 9328, 9329, 9330,
9336, 9337, 9338, 9339, 9340, 9341, 9345, 9346, 9347, 9348,
9353, 9354, 9355, 9359, 9366, 9367, 9373, 9375, 9376, 9378,
9382, 9383, 9386, 9388, 9391, 9392, 9393, 9394, 9396, 9400,
9402, 9403, 9404, 9406, 9407, 9413, 9415, 9423, 9432, 9433,
9434, 9440, 9442, 9443, 9444, 9449, 9451, 9452, 9456, 9460,
9468, 9471, 9472, 9473, 9475, 9478, 9483, 9488, 9490, 9497,
9500, 9501, 9502, 9503, 9504, 9505, 9509, 9513, 9514, 9515,
9517, 9518, 9519, 9522, 9531, 9532, 9533, 9534, 9536, 9540,
9545, 9548, 9553, 9555, 9563, 9564, 9565, 9568, 9571, 9577,
9582, 9583, 9587, 9589, 9590, 9591, 9596, 9597, 9602, 9606,
9609, 9610, 9613, 9620, 9623, 9624, 9626, 9627, 9628, 9629,
9632, 9633, 9635, 9640, 9641, 9642, 9644, 9645, 9646, 9648,
9649, 9652, 9653, 9655, 9657, 9658, 9659, 9660, 9663, 9666,
9668, 9670, 9675, 9679, 9681, 9682, 9686, 9687, 9692, 9693,
9694, 9698, 9706, 9718, 9723, 9726, 9729, 9730, 9731, 9733,
9734, 9737, 9746, 9750, 9751, 9753, 9754, 9755, 9756, 9763,
9764, 9767, 9768, 9770, 9776, 9780, 9781, 9782, 9784, 9791,
9792, 9793, 9794, 9796, 9799, 9801, 9802, 9806, 9808, 9809,
9812, 9813, 9814, 9816, 9819, 9820, 9824, 9825, 9826, 9827,
9829, 9830, 9833, 9835, 9836, 9845, 9846, 9847, 9849, 9850,
9851, 9853, 9854, 9861, 9864, 9866, 9869, 9871, 9873, 9882,
9886, 9887, 9892, 9897, 9900, 9901, 9906, 9907, 9908, 9909,
9910, 9912, 9923, 9924, 9928, 9930, 9934, 9935, 9938, 9940,
9944, 9946, 9947, 9949, 9950, 9953, 9955, 9957, 9958, 9960,
9962, 9963, 9964, 9967, 9968, 9971, 9974, 9979, 9980, 9982,
9984, 9985, 9987, 9990, 9991, 9996, 9997, 9998, 10000,
10009, 10010, 10012, 10013, 10017, 10019, 10021, 10022,
10026, 10031, 10032, 10033, 10034, 10035, 10038, 10043,
10045, 10048, 10051, 10052, 10054, 10056, 10058, 10059,
10060, 10062, 10063, 10064, 10066, 10068, 10073, 10075,
10077, 10078, 10080, 10081, 10083, 10087, 10089, 10091,
10092, 10095, 10097, 10101, 10102, 10103, 10105, 10106,
10107, 10108, 10109, 10110, 10112, 10114, 10115, 10116,
10118, 10122, 10127, 10128, 10131, 10132, 10136, 10141,
10143, 10146, 10147, 10149, 10151, 10152, 10158, 10162,
10163, 10165, 10166, 10168, 10174, 10176, 10178, 10180,
10181, 10182, 10191, 10192, 10193, 10194, 10195, 10197,
10199, 10203, 10206, 10209, 10212, 10218, 10219, 10220,
10222, 10223, 10225, 10228, 10231, 10232, 10233, 10236,
10237, 10239, 10247, 10252, 10253, 10255, 10257, 10259,
10268, 10270, 10275, 10284, 10291, 10292, 10293, 10295,
10296, 10297, 10300, 10302, 10306, 10307, 10311, 10318,
10321, 10323, 10325, 10326, 10328, 10331, 10333, 10334,
10335, 10336, 10343, 10346, 10352, 10353, 10356, 10357,
10359, 10360, 10362, 10364, 10368, 10371, 10373, 10375,
10376, 10378, 10380, 10381, 10384, 10385, 10388, 10389,
10395, 10397, 10398, 10399, 10400, 10401, 10408, 10410,
10413, 10414, 10416, 10421, 10422, 10423, 10426, 10427,
10428, 10430, 10435, 10437, 10438, 10440, 10442, 10443,
10446, 10447, 10448, 10449, 10450, 10453, 10456, 10463,
10464, 10465, 10468, 10469, 10470, 10474, 10478, 10480,
10482, 10487, 10488, 10490, 10492, 10494, 10496, 10497,
10504, 10506, 10508, 10513, 10514, 10515, 10518, 10521,
10525, 10527, 10528, 10530, 10531, 10533, 10535, 10536,
10537, 10541, 10542, 10543, 10544, 10547, 10548, 10549,
10550, 10551, 10555, 10556, 10558, 10560, 10561, 10564,
10565, 10567, 10569, 10571, 10573, 10580, 10581, 10582,
10583, 10585, 10590, 10593, 10596, 10597, 10599, 10601,
10602, 10609, 10610, 10611, 10614, 10615, 10616, 10617,
10619, 10621, 10622, 10623, 10626, 10628, 10629, 10630,
10631, 10633, 10634, 10636, 10637, 10638, 10639, 10640,
10641, 10642, 10643, 10645, 10646, 10648, 10649, 10650,
10655, 10657, 10659, 10663, 10665, 10666, 10668, 10670,
10674, 10678, 10681, 10682, 10683, 10684, 10685, 10687,
10697, 10698, 10699, 10700, 10702, 10703, 10705, 10707,
10708, 10710, 10711, 10715, 10716, 10721, 10722, 10725,
10726, 10727, 10732, 10734, 10735, 10737, 10738, 10740, 10741, 10744, 10745, 10748, 10749, 10752, 10761, 10762, 10763, 10766, 10774, 10775, 10776, 10777, 10778, 10779, 10782, 10784, 10785, 10787, 10788, 10790, 10791, 10792, 10795, 10796, 10798, 10800, 10801, 10803, 10805, 10809, 10810, 10811, 10812, 10818, 10819, 10820, 10821, 10824, 10825, 10826, 10829, 10830, 10831, 10832, 10833, 10836, 10838, 10839, 10840, 10841, 10843, 10846, 10850, 10852, 10853, 10854, 10857, 10858, 10860, 10861, 10862, 10866, 10867, 10871, 10872, 10874, 10877, 10880, 10881, 10887, 10892, 10896, 10897, 10898, 10899, 10902, 10905, 10912, 10917, 10920, 10926, 10927, 10928, 10930, 10933, 10934, 10935, 10936, 10937, 10938, 10940, 10941, 10944, 10947, 10948, 10950, 10954, 10957, 10960, 10962, 10963, 10965, 10967, 10972, 10975, 10976, 10977, 10979, 10980, 10981, 10983, 10984, 10988, 10993, 10995, 10996, 10997, 10998, 10999, 11002, 11004, 11005, 11006, 11008, 11010, 11018, 11024, 11026, 11027, 11032, 11033, 11039, 11046, 11047, 11052, 11053, 11056, 11058, 11060, 11066, 11068, 11070, 11072, 11078, 11080, 11082, 11083, 11086, 11090, 11095, 11098, 11101, 11102, 11103, 11107, 11108, 11110, 11114, 11116, 11118, 11119, 11123, 11124, 11125, 11126, 11127, 11129, 11132, 11135, 11137, 11138, 11145, 11146, 11148, 11153, 11154, 11158, 11159, 11160, 11161, 11162, 11163, 11165, 11166, 11168, 11169, 11175, 11177, 11178, 11184, 11187, 11188, 11190, 11192, 11194, 11198, 11199, 11201, 11204, 11207, 11214, 11217, 11218, 11222, 11224, 11226, 11227, 11228, 11229, 11232, 11233, 11234, 11235, 11236, 11237, 11238, 11239, 11244, 11246, 11247, 11248, 11251, 11254, 11255, 11256, 11257, 11258, 11259, 11260, 11262, 11263, 11264, 11266, 11274, 11275, 11278, 11288, 11289, 11290, 11291, 11292, 11293, 11294, 11295, 11298, 11305, 11306, 11307, 11313, 11315, 11316, 11319, 11320, 11322, 11324, 11326, 11329, 11330, 11331, 11332, 11337, 11338, 11339, 11340, 11345, 11346, 11348, 11352, 11356, 11358, 11363, 11364, 11365, 11370, 11371, 11373, 11377, 11379, 11380, 11381, 11382, 11385, 11387, 11388, 11389, 11391, 11392, 11394, 11395, 11397, 11403, 11404, 11405, 11406, 11409, 11411, 11412, 11413, 11414, 11416, 11418, 11420, 11423, 11426, 11428, 11430, 11431, 11434, 11437, 11438, 11443, 11445, 11446, 11449, 11459, 11463, 11465, 11466, 11467, 11471, 11472, 11473, 11475, 11476, 11477, 11478, 11481, 11482, 11487, 11490, 11494, 11496, 11497, 11498, 11500, 11501, 11506, 11507, 11508, 11509, 11512, 11516, 11518, 11520, 11524, 11526, 11528, 11530, 11531, 11532, 11533, 11534, 11535, 11538, 11541, 11544, 11546, 11548, 11551, 11553, 11558, 11560, 11561, 11567, 11571, 11576, 11577, 11578, 11580, 11583, 11585, 11586, 11588, 11589, 11593, 11594, 11595, 11596, 11597, 11599, 11604, 11615, 11618, 11620, 11621, 11623, 11625, 11628, 11629, 11632, 11633, 11636, 11639, 11642, 11649, 11650, 11651, 11652, 11654, 11655, 11656, 11657, 11658, 11663, 11664, 11667, 11669, 11673, 11678, 11681, 11682, 11683, 11688, 11691, 11692, 11693, 11694, 11695, 11699, 11701, 11703, 11705, 11707, 11711, 11712, 11718, 11720, 11721, 11722, 11725, 11726, 11731, 11733, 11736, 11740, 11741, 11743, 11744, 11753, 11755, 11756, 11759, 11760, 11761, 11762, 11763, 11764, 11765, 11766, 11767, 11770, 11771, 11776, 11780, 11781, 11782, 11783, 11784, 11785, 11786, 11790, 11792, 11795, 11799, 11800, 11809, 11812, 11813, 11814, 11816, 11818, 11819, 11826, 11828, 11829, 11830, 11837, 11841, 11846, 11848, 11849, 11850, 11851, 11853, 11854, 11856, 11858, 11860, 11863, 11868, 11870, 11872, 11876, 11877, 11878, 11879, 11881, 11890, 11891, 11894, 11898, 11899, 11903, 11909, 11911, 11913, 11915, 11916, 11917, 11919, 11920, 11921, 11923, 11926, 11928, 11929, 11930, 11934, 11935, 11940, 11941, 11943, 11946, 11947, 11948, 11949, 11953, 11955, 11957, 11958, 11959, 11960, 11961, 11962, 11963, 11965, 11966, 11968, 11974, 11977, 11978, 11979, 11980, 11983, 11988, 11993, 11994, 11995, 11996, 11997, 11998, 11999, 12002, 12004, 12006, 12008, 12014, 12017, 12019, 12020, 12021, 12023, 12024, 12025, 12029, 12032, 12042, 12043, 12044, 12047, 12050, 12051, 12054, 12059, 12060, 12061, 12063, 12064, 12066, 12068, 12076, 12078, 12079, 12080, 12081, 12083, 12085, 12086, 12087, 12091, 12092, 12093, 12097, 12098, 12102, 12104, 12106, 12109, 12110, 12112, 12115, 12118, 12120, 12122, 12126, 12128, 12129, 12130, 12131, 12134, 12135, 12137, 12138, 12139, 12142, 12143, 12144, 12145, 12146, 12147, 12148, 12151, 12153, 12155, 12161, 12162, 12165, 12166, 12167, 12170, 12171, 12174, 12175, 12179, 12181, 12187, 12197, 12202, 12204, 12208, 12212, 12214, 12215, 12217, 12220, 12223, 12227, 12229, 12230, 12233, 12234, 12237, 12241, 12243, 12245, 12249, 12250, 12252, 12253, 12254, 12255, 12256, 12259, 12269, 12271, 12278, 12280, 12281, 12283, 12284, 12285, 12286, 12287, 12295, 12296, 12299, 12310, 12311, 12312, 12313, 12314, 12315, 12317, 12319, 12321, 12323, 12325, 12331, 12334, 12337, 12339, 12342, 12345, 12347, 12350, 12354, 12356, 12359, 12364, 12366, 12369, 12370, 12375, 12376, 12379, 12381, 12385, 12388, 12390, 12393, 12394, 12397, 12399, 12400, 12401, 12403, 12404, 12406, 12411, 12414, 12415, 12416, 12419, 12420, 12423, 12424, 12425, 12426, 12427, 12428, 12437, 12440, 12441, 12444, 12445, 12446, 12450, 12451, 12455, 12456, 12457, 12459, 12461, 12462, 12465, 12467, 12468, 12470, 12472, 12473, 12478, 12479, 12480, 12481, 12488, 12492, 12494, 12497, 12501, 12502, 12503, 12508, 12512, 12513, 12514, 12515, 12518, 12519, 12527, 12529, 12530, 12535, 12536, 12537, 12538, 12539, 12540, 12546, 12547, 12548, 12549, 12551, 12552, 12554, 12555, 12556, 12557, 12561, 12563, 12565, 12567, 12568, 12570, 12572, 12578, 12580, 12583, 12584, 12585, 12586, 12588, 12589, 12591, 12597, 12600, 12603, 12604, 12605, 12608, 12609, 12610, 12611, 12616, 12620, 12622, 12623, 12626, 12628, 12629, 12631, 12634, 12638, 12639, 12640, 12641, 12648, 12649, 12650, 12651, 12654, 12655, 12663, 12664, 12668, 12670, 12671, 12674, 12679, 12681, 12683, 12684, 12685, 12688, 12689, 12691, 12693, 12695, 12696, 12697, 12699, 12701, 12702, 12705, 12706, 12707, 12710, 12713, 12714, 12723, 12726, 12729, 12731, 12732, 12733, 12735, 12737, 12738, 12739, 12740, 12741, 12742, 12752, 12753, 12754, 12755, 12757, 12758, 12760, 12762, 12764, 12765, 12766, 12771, 12772, 12773, 12775, 12777, 12782, 12790, 12791, 12793, 12794, 12797, 12800, 12802, 12803, 12807, 12810, 12812, 12813, 12817, 12820, 12822, 12823, 12824, 12827, 12828, 12834, 12835, 12836, 12837, 12838, 12839, 12843, 12844, 12848, 12849, 12850, 12853, 12860, 12861, 12866, 12870, 12873, 12875, 12878, 12882, 12883, 12884, 12887, 12891, 12895, 12898, 12899, 12900, 12901, 12903, 12904, 12905, 12906, 12908, 12910, 12912, 12916, 12920, 12921, 12923, 12928, 12929, 12932, 12933, 12934, 12935, 12938, 12945, 12946, 12947, 12952, 12953, 12956, 12958, 12959, 12960, 12963, 12967, 12968, 12969, 12978, 12983, 12984, 12986, 12987, 12988, 12989, 12990, 12991, 12999, 13001, 13003, 13004, 13007, 13010, 13014, 13015, 13017, 13018, 13022, 13027, 13030, 13031, 13033, 13034, 13035, 13038, 13040, 13041, 13047, 13050, 13053, 13054, 13055, 13056, 13061, 13062, 13064, 13066, 13071, 13075, 13077, 13079, 13085, 13086, 13087, 13097, 13099, 13101, 13102, 13105, 13106, 13110, 13111, 13112, 13114, 13115, 13117, 13118, 13120, 13121, 13122, 13123, 13124, 13125, 13128, 13131, 13134, 13136, 13144, 13147, 13148, 13149, 13151, 13154, 13159, 13160, 13169, 13175, 13181, 13182, 13186, 13189, 13190, 13197, 13198, 13199, 13205, 13206, 13209, 13210, 13212, 13213, 13215, 13217, 13220, 13221, 13224, 13226, 13227, 13228, 13232, 13234, 13235, 13236, 13237, 13239, 13241, 13248, 13250, 13251, 13255, 13256, 13259, 13260, 13261, 13262, 13263, 13264, 13265, 13267, 13268, 13269, 13271, 13274, 13281, 13297, 13298, 13300, 13301, 13303, 13304, 13313, 13315, 13317, 13329, 13332, 13337, 13340, 13343, 13345, 13346, 13347, 13348, 13350, 13352, 13361, 13363, 13367, 13368, 13369, 13370, 13377, 13380, 13381, 13384, 13385, 13386, 13391, 13393, 13394, 13395, 13397, 13403, 13404, 13407, 13408, 13410, 13416, 13417, 13418, 13419, 13423, 13424, 13429, 13430, 13433, 13439, 13441, 13448, 13451, 13456, 13463, 13464, 13467, 13469, 13473, 13474, 13475, 13477, 13478, 13479, 13480, 13489, 13491, 13492, 13494, 13496, 13499, 13503, 13504, 13505, 13512, 13513, 13514, 13515, 13518, 13519, 13521, 13522, 13525, 13526, 13529, 13530, 13532, 13533, 13539, 13540, 13543, 13544, 13545, 13546, 13547, 13549, 13551, 13552, 13553, 13555, 13558, 13559, 13561, 13568, 13569, 13572, 13574, 13580, 13584, 13587, 13597, 13599, 13600, 13601, 13602, 13604, 13605, 13606, 13612, 13613, 13614, 13620, 13621, 13623, 13628, 13630, 13631, 13632, 13634, 13636, 13637, 13638, 13639, 13641, 13643, 13647, 13650, 13651, 13652, 13653, 13654, 13662, 13663, 13665, 13668, 13675, 13677, 13678, 13679, 13683, 13687, 13688, 13689, 13696, 13697, 13698, 13699, 13700, 13702, 13706, 13710, 13713, 13714, 13715, 13716, 13719, 13720, 13722, 13727, 13729, 13730, 13734, 13736, 13737, 13739, 13742, 13745, 13747, 13750, 13753, 13755, 13756, 13764, 13766, 13767, 13768, 13772, 13773, 13774, 13775, 13777, 13779, 13780, 13782, 13783, 13786, 13787, 13788, 13791, 13793, 13796, 13809, 13816, 13817, 13818, 13819, 13822, 13823, 13828, 13830, 13834, 13835, 13843, 13849, 13852, 13853, 13858, 13859, 13866, 13869, 13870, 13872, 13873, 13877, 13879, 13885, 13887, 13888, 13891, 13892, 13895, 13897, 13898, 13899, 13901, 13906, 13908, 13909, 13910, 13911, 13917, 13918, 13919, 13920, 13921, 13925, 13929, 13932, 13934, 13944, 13947, 13950, 13953, 13954, 13958, 13960, 13963, 13969, 13970, 13971, 13975, 13984, 13986, 13987, 13990, 13991, 13999, 14000, 14001, 14005, 14006, 14009, 14014, 14017, 14018, 14022, 14027, 14030, 14031, 14036, 14038, 14040, 14049, 14052, 14059, 14062, 14063, 14066, 14067, 14069, 14070, 14071, 14073, 14074, 14075, 14076, 14078, 14080, 14081, 14085, 14086, 14087, 14088, 14092, 14094, 14096, 14105, 14107, 14111, 14112, 14116, 14118, 14119, 14121, 14122, 14124, 14129, 14130, 14132, 14133, 14135, 14137, 14138, 14139, 14140, 14141, 14142, 14145, 14146, 14147.

Promoters expressing in the embryo at 22 days after pollination include SEQ IDs: 3, 7, 12, 14, 15, 16, 17, 26, 27, 29, 31, 33, 34, 36, 37, 44, 48, 54, 56, 57, 63, 64, 65, 79, 80, 86, 88, 90, 93, 94, 96, 98, 99, 100, 102, 103, 104, 110, 111, 117, 121, 123, 126, 130, 131, 134, 137, 143, 144, 146, 147, 148, 152, 154, 156, 157, 159, 162, 165, 168, 174, 175, 176, 179, 181, 183, 187, 191, 193, 194, 196, 197, 199, 202, 203, 204, 205, 207, 210, 211, 214, 223, 232, 234, 235, 236, 237, 240, 246, 249, 250, 251, 256, 257, 259, 264, 267, 271, 273, 286, 288, 289, 293, 294, 298, 301, 302, 305, 306, 308, 309, 314, 316, 319, 320, 322, 323, 328, 329, 332, 334, 335, 337, 338, 340, 346, 349, 352, 353, 354, 355, 356, 358, 360, 364, 365, 371, 373, 379, 381, 388, 396, 401, 404, 411, 412, 414, 416, 423, 428, 429, 431, 432, 433, 434, 441, 448, 450, 452, 456, 458, 459, 461, 463, 466, 468, 470, 471, 474, 478, 479, 481, 483, 485, 488, 489, 496, 498, 501, 502, 504, 505, 507, 509, 510, 511, 514, 515, 516, 517, 522, 523, 525, 532, 535, 536, 537, 541, 543, 544, 546, 547, 548, 553, 554, 555, 556, 557, 561, 563, 578, 580, 585, 591, 594, 595, 596, 599, 605, 606, 607, 608, 613, 614, 619, 620, 623, 626, 630, 631, 633, 635, 636, 637, 638, 643, 647, 650, 661, 663, 664, 669, 670, 671, 681, 683, 687, 693, 694, 695, 701, 702, 705, 706, 709, 716, 717, 718, 719, 721, 722, 723, 724, 727, 731, 732, 733, 734, 736, 740, 742, 744, 749, 753, 757, 759, 764, 765, 779, 781, 782, 783, 784, 792, 793, 800, 804, 806, 808, 809, 811, 812, 820, 821, 822, 824, 825, 826, 829, 830, 833, 840, 841, 844, 846, 849, 855, 856, 857, 858, 859, 860, 862, 863, 865, 870, 871, 875, 876, 877, 878, 883, 887, 890, 891, 892, 893, 895, 897, 898, 899, 900, 903, 907, 908, 911, 912, 913, 915, 916, 917, 919, 920, 924, 928, 932, 934, 936, 943, 944, 947, 948, 949, 951, 953, 955, 957, 958, 960, 964, 971, 974, 976, 977, 978, 979, 980, 981, 982, 984, 985, 991, 993, 994, 995, 997, 999, 1003, 1005, 1007, 1008, 1009, 1011, 1012, 1013, 1014, 1016, 1017, 1019, 1022, 1025, 1026, 1032, 1033, 1035, 1038, 1039, 1041, 1043, 1046, 1047, 1049, 1051, 1052, 1054, 1055, 1056, 1057, 1065, 1069, 1070, 1074, 1076, 1077, 1080, 1085, 1086, 1087, 1089, 1092, 1095, 1096, 1097, 1100, 1101, 1103, 1104, 1110, 1111, 1112, 1114, 1115, 1116, 1117, 1119, 1121, 1122, 1125, 1127, 1130, 1132, 1136, 1137, 1140, 1144, 1146, 1148, 1154, 1155, 1160, 1161, 1162, 1165, 1167, 1168, 1170, 1171, 1176, 1178, 1180, 1183, 1185, 1186, 1187, 1189, 1190, 1191, 1196, 1200, 1201, 1205, 1213, 1214, 1215, 1217, 1218, 1220, 1222, 1223, 1225, 1227, 1228, 1230, 1233, 1236, 1237, 1240, 1249, 1250, 1251, 1252, 1254, 1257, 1258, 1261, 1263, 1269, 1272, 1281, 1285, 1286, 1290, 1292, 1293, 1296, 1299, 1303, 1306, 1307, 1309, 1310, 1311, 1312, 1314, 1316, 1320, 1321, 1322, 1323, 1325, 1327, 1330, 1331, 1334, 1337, 1339, 1344, 1345, 1347, 1349, 1354, 1355, 1358, 1360, 1364, 1366, 1367, 1368, 1371, 1375, 1376, 1377, 1380, 1381, 1387, 1388, 1389, 1391, 1393, 1396, 1402, 1404, 1405, 1406, 1410, 1412, 1415, 1420, 1421, 1423, 1426, 1431, 1432, 1433, 1435, 1437, 1438, 1440, 1441, 1442, 1443, 1444, 1447, 1448, 1451, 1453, 1458, 1459, 1461, 1464, 1466, 1471, 1472, 1475, 1484, 1485, 1486, 1488, 1489, 1490, 1491, 1493, 1498, 1499, 1501, 1503, 1504, 1506, 1512, 1514, 1518, 1519, 1527, 1528, 1530, 1536, 1539, 1543, 1545, 1549, 1550, 1551, 1554, 1555, 1556, 1561, 1563, 1564, 1566, 1567, 1570, 1575, 1578, 1579, 1582, 1584, 1585, 1586, 1590, 1591, 1594, 1597, 1598, 1599, 1600, 1601, 1602, 1604, 1605, 1608, 1609, 1610, 1612, 1614, 1615, 1616, 1617, 1623, 1625, 1634, 1635, 1637, 1638, 1639, 1642, 1643, 1648, 1650, 1651, 1653, 1654, 1658, 1659, 1662, 1663, 1668, 1669, 1671, 1673, 1675, 1676, 1678, 1681, 1682, 1684, 1685, 1687, 1688, 1689, 1690, 1691, 1696, 1697, 1698, 1699, 1700, 1703, 1705, 1706, 1707, 1708, 1709, 1710, 1716, 1717, 1718, 1720, 1725, 1732, 1735, 1750, 1755, 1761, 1764, 1769, 1773, 1774, 1776, 1777, 1785, 1786, 1791, 1792, 1796, 1798, 1807, 1809, 1811, 1813, 1814, 1826, 1828, 1830, 1832, 1834, 1835, 1837, 1839, 1840, 1848, 1851, 1852, 1854, 1855, 1859, 1861, 1863, 1866, 1867, 1869, 1872, 1873, 1876, 1879, 1880, 1882, 1886, 1888, 1891, 1893, 1897, 1898, 1899, 1900, 1902, 1904, 1905, 1906, 1910, 1911, 1913, 1916, 1918, 1920, 1922, 1923, 1924, 1928, 1930, 1931, 1933, 1934, 1936, 1939, 1940, 1944, 1945, 1949, 1950, 1952, 1953, 1954, 1958, 1968, 1970, 1971, 1972, 1973, 1977, 1979, 1981, 1990, 1993, 1994, 1995, 1996, 1999, 2000, 2001, 2007, 2009, 2010, 2012, 2014, 2015, 2017, 2019, 2021, 2026, 2031, 2032, 2033, 2036, 2037, 2040, 2041, 2042, 2043, 2045, 2048, 2060, 2062, 2064, 2066, 2072, 2074, 2077, 2078, 2087, 2088, 2089, 2091, 2092, 2093, 2094, 2096, 2097, 2099, 2103, 2104, 2106, 2107, 2112, 2116, 2117, 2119, 2122, 2123, 2125, 2128, 2130, 2132, 2133, 2137, 2139, 2140, 2141, 2142, 2143, 2144, 2146, 2147, 2150, 2151, 2154, 2155, 2156, 2157, 2158, 2159, 2161, 2164, 2167, 2170, 2177, 2179, 2185, 2188, 2189, 2193, 2196, 2200, 2206, 2207, 2210, 2214, 2215, 2216, 2221, 2223, 2235, 2240, 2241, 2242, 2243, 2253, 2257, 2259, 2260, 2263, 2266, 2267, 2274, 2276, 2278, 2280, 2282, 2283, 2284, 2291, 2293, 2294, 2296, 2297, 2298, 2300, 2303, 2304, 2306, 2308, 2309, 2310, 2313, 2314, 2322, 2323, 2325, 2328, 2329, 2331, 2337, 2339, 2342, 2348, 2353, 2358, 2359, 2361, 2362, 2363, 2366, 2371, 2372, 2379, 2380, 2381, 2382, 2383, 2384, 2395, 2401, 2402, 2405, 2410, 2412, 2413, 2414, 2417, 2418, 2419, 2420, 2423, 2428, 2430, 2431, 2432, 2433, 2434, 2435, 2436, 2437, 2439, 2440, 2441, 2442, 2443, 2445, 2451, 2452, 2453, 2454, 2456, 2457, 2458, 2465, 2469, 2470, 2472, 2474, 2476, 2477, 2479, 2480, 2481, 2482, 2483, 2485, 2487, 2490, 2494, 2495, 2496, 2497, 2498, 2500, 2505, 2506, 2507, 2509, 2510, 2513, 2514, 2515, 2516, 2517, 2519, 2521, 2522, 2525, 2528, 2529, 2531, 2532, 2533, 2534, 2536, 2537, 2538, 2539, 2540, 2541, 2544, 2545, 2546, 2549, 2550, 2551, 2552, 2554, 2555, 2559, 2567, 2568, 2570, 2571, 2573, 2576, 2578, 2579, 2581, 2583, 2589, 2590, 2596, 2599, 2600, 2601, 2605, 2609, 2611, 2613, 2616, 2620, 2625, 2627, 2632, 2634, 2635, 2636, 2639, 2644, 2645, 2647, 2648, 2649, 2652, 2655, 2656, 2658, 2661, 2662, 2663, 2666, 2670, 2671, 2672, 2674, 2676, 2678, 2684, 2685, 2687, 2688, 2689, 2690, 2691, 2692, 2694, 2700, 2702, 2704, 2708, 2709, 2711, 2715, 2719, 2720, 2721, 2722, 2725, 2726, 2728, 2729, 2731, 2735, 2738, 2739, 2745, 2746, 2747, 2749, 2752, 2755, 2756, 2758, 2762, 2764, 2765, 2766, 2770, 2775, 2776, 2783, 2784, 2787, 2793, 2794, 2798, 2800, 2801, 2802, 2805, 2808, 2812, 2814, 2819, 2821, 2822, 2823, 2824, 2826, 2827, 2828, 2831, 2832, 2838, 2840, 2844, 2845, 2850, 2860, 2861, 2865, 2869, 2871, 2876, 2878, 2888, 2889, 2893, 2894, 2895, 2896, 2898, 2901, 2902, 2903, 2906, 2908, 2909, 2911, 2914, 2915, 2916, 2917, 2918, 2919, 2922, 2923, 2926, 2929, 2930, 2931, 2935, 2938, 2941, 2942, 2943, 2946, 2947, 2948, 2951, 2955, 2959, 2962, 2963, 2966, 2968, 2969, 2976, 2979, 2982, 2992, 2994, 2998, 3003, 3005, 3006, 3007, 3013, 3015, 3017, 3018, 3020, 3023, 3024, 3029, 3031, 3039, 3041, 3042, 3044, 3045, 3047, 3048, 3049, 3051, 3052, 3053, 3055, 3058, 3059, 3064, 3067, 3068, 3070, 3072, 3075, 3080, 3083, 3084, 3085, 3087, 3090, 3095, 3100, 3101, 3106, 3115, 3118, 3119, 3120, 3121, 3123, 3127, 3128, 3137, 3139, 3142, 3143, 3145, 3153, 3157, 3158, 3167, 3169, 3170, 3172, 3177, 3181, 3185, 3187, 3191, 3192, 3194, 3196, 3200, 3202, 3205, 3206, 3208, 3210, 3213, 3217, 3219, 3220, 3221, 3224, 3225, 3228, 3230, 3240, 3242, 3246, 3247, 3249, 3252, 3254, 3261, 3263, 3266, 3267, 3268, 3269, 3271, 3272, 3278, 3280, 3283, 3286, 3288, 3290, 3291, 3294, 3295, 3297, 3299, 3300, 3301, 3308, 3310, 3312, 3313, 3324, 3331, 3332, 3333, 3337, 3338, 3340, 3342, 3343, 3345, 3346, 3351, 3353, 3355, 3356, 3357, 3358, 3359, 3360, 3361, 3363, 3368, 3370, 3374, 3376, 3377, 3378, 3379, 3380, 3382, 3383, 3386, 3394, 3396, 3399, 3403, 3404, 3405, 3413, 3415, 3416, 3418, 3419, 3424, 3426, 3427, 3428, 3442, 3445, 3446, 3447, 3449, 3450, 3452, 3453, 3457, 3458, 3459, 3461, 3462, 3465, 3466, 3468, 3469, 3470, 3471, 3474, 3477, 3483, 3484, 3486, 3488, 3490, 3493, 3494, 3500, 3502, 3503, 3504, 3507, 3510, 3516, 3523, 3524, 3527, 3533, 3535, 3536, 3537, 3538, 3541, 3542, 3544, 3545, 3549, 3552, 3554, 3558, 3560, 3562, 3569, 3571, 3574, 3576, 3580, 3582, 3585, 3587, 3588, 3589, 3591, 3592, 3594, 3600, 3601, 3603, 3604, 3607, 3610, 3611, 3612, 3613, 3616, 3618, 3620, 3621, 3624, 3627, 3628, 3630, 3631, 3633, 3634, 3640, 3642, 3643, 3644, 3645, 3646, 3647, 3648, 3650, 3659, 3660, 3661, 3667, 3672, 3674, 3677, 3681, 3682, 3684, 3685, 3690, 3693, 3706, 3707, 3709, 3713, 3715, 3717, 3718, 3719, 3720, 3721, 3723, 3725, 3730, 3731, 3744, 3748, 3749, 3752, 3756, 3757, 3760, 3761, 3764, 3765, 3766, 3771, 3772, 3773, 3775, 3777, 3778, 3783, 3785, 3791, 3792, 3793, 3794, 3796, 3798, 3801, 3806, 3808, 3817, 3818, 3819, 3820, 3823, 3828, 3829, 3830, 3831, 3832, 3833, 3837, 3838, 3843, 3844, 3845, 3846, 3847, 3849, 3852, 3858, 3859, 3860, 3867, 3868, 3870, 3871, 3872, 3873, 3881, 3882, 3883, 3884, 3885, 3887, 3889, 3890, 3892, 3893, 3894, 3895, 3896, 3897, 3899, 3902, 3903, 3904, 3907, 3908, 3912, 3913, 3917, 3918, 3928, 3929, 3931, 3933, 3938, 3947, 3950, 3951, 3952, 3954, 3958, 3962, 3964, 3967, 3968, 3970, 3971, 3974, 3975, 3978, 3979, 3983, 3987, 3988, 3994, 3996, 3997, 3998, 4007, 4008, 4013, 4014, 4019, 4020, 4021, 4028, 4030, 4033, 4037, 4039, 4040, 4041, 4042, 4043, 4046, 4048, 4049, 4050, 4051, 4052, 4053, 4054, 4056, 4057, 4058, 4062, 4066, 4067, 4068, 4070, 4072, 4079, 4080, 4081, 4084, 4088, 4092, 4094, 4096, 4098, 4099, 4102, 4105, 4106, 4109, 4110, 4113, 4116, 4122, 4124, 4126, 4128, 4133, 4139, 4143, 4144, 4146, 4147, 4148, 4149, 4150, 4151, 4158, 4160, 4163, 4164, 4165, 4166, 4167, 4168, 4171, 4175, 4178, 4181, 4183, 4185, 4187, 4188, 4189, 4191, 4192, 4193, 4194, 4195, 4197, 4201, 4202, 4204, 4205, 4206, 4207, 4208, 4210, 4211, 4212, 4213, 4216, 4219, 4221, 4227, 4228, 4229, 4232, 4233, 4234, 4235, 4237, 4240, 4244, 4245, 4246, 4250, 4251, 4252, 4255, 4257, 4261, 4266, 4270, 4272, 4275, 4276, 4278, 4280, 4281, 4282, 4283, 4284, 4288, 4290, 4292, 4294, 4296, 4298, 4300, 4301, 4302, 4303, 4305, 4306, 4309, 4312, 4320, 4321, 4324, 4329, 4330, 4333, 4335, 4336, 4337, 4341, 4344, 4347, 4352, 4354, 4358, 4359, 4360, 4369, 4375, 4378, 4380, 4383, 4390, 4391, 4392, 4393, 4396, 4397, 4401, 4402, 4403, 4404, 4405, 4409, 4410, 4422, 4423, 4425, 4430, 4432, 4436, 4439, 4440, 4442, 4443, 4446, 4448, 4449, 4450, 4453, 4458, 4461, 4462, 4463, 4466, 4468, 4470, 4474, 4475, 4477, 4479, 4485, 4490, 4492, 4494, 4497, 4498, 4500, 4502, 4507, 4508, 4509, 4512, 4514, 4515, 4519, 4521, 4522, 4529, 4531, 4535, 4545, 4548, 4549, 4551, 4554, 4555, 4556, 4557, 4558, 4560, 4562, 4563, 4565, 4567, 4568, 4575, 4576, 4580, 4582, 4583, 4590, 4591, 4594, 4597, 4598, 4601, 4604, 4606, 4616, 4623, 4625, 4628, 4630, 4632, 4634, 4635, 4636, 4639, 4641, 4643, 4644, 4645, 4646, 4647, 4650, 4651, 4653, 4654, 4655, 4656, 4657, 4658, 4659, 4662, 4664, 4667, 4669, 4671, 4673, 4674, 4676, 4677, 4680, 4682, 4685, 4691, 4692, 4694, 4697, 4699, 4700, 4704, 4706, 4708, 4711, 4713, 4719, 4721, 4724, 4725, 4729, 4730, 4734, 4737, 4738, 4739, 4740, 4741, 4745, 4746, 4749, 4750, 4752, 4753, 4755, 4756, 4761, 4762, 4763, 4764, 4765, 4769, 4770, 4773, 4775, 4779, 4780, 4784, 4787, 4788, 4789, 4790, 4791, 4794, 4795, 4796, 4801, 4803, 4804, 4805, 4806, 4807, 4813, 4814, 4818, 4822, 4828, 4830, 4831, 4834, 4838, 4841, 4842, 4848, 4855, 4856, 4857, 4859, 4861, 4862, 4863, 4869, 4874, 4875, 4876, 4878, 4880, 4881, 4887, 4888, 4889, 4890, 4891, 4895, 4896, 4897, 4902, 4904, 4905, 4907, 4909, 4910, 4913, 4914, 4918, 4921, 4922, 4923, 4924, 4925, 4926, 4930, 4935, 4936, 4941, 4942, 4944, 4950, 4954, 4956, 4958, 4959, 4967, 4969, 4971, 4972, 4974, 4975, 4983, 4985, 4987, 4988, 4989, 4990, 4993, 4994, 4996, 5000, 5007, 5011, 5014, 5015, 5016, 5021, 5026, 5027, 5029, 5030, 5034, 5036, 5037, 5038, 5039, 5040, 5042, 5044, 5045, 5046, 5049, 5051, 5052, 5054, 5057, 5060, 5067, 5068, 5069, 5072, 5075, 5078, 5082, 5084, 5087, 5088, 5089, 5094, 5095, 5100, 5101, 5102, 5106, 5111, 5114, 5116, 5119, 5120, 5122, 5129, 5131, 5132, 5140, 5143, 5145, 5146, 5147, 5149, 5151, 5153, 5159, 5160, 5164, 5165, 5168, 5170, 5171, 5172, 5174, 5180, 5181, 5184, 5185, 5187, 5188, 5189, 5190, 5191, 5192, 5195, 5196, 5198, 5200, 5202, 5203, 5206, 5212, 5213, 5217, 5218, 5219, 5224, 5225, 5229, 5234, 5241, 5249, 5251, 5252, 5253, 5254, 5255, 5256, 5257, 5258, 5260, 5261, 5263, 5267, 5268, 5269, 5273, 5274, 5275, 5276, 5280, 5281, 5282, 5283, 5286, 5289, 5293, 5297, 5298, 5299, 5300, 5301, 5302, 5308, 5311, 5313, 5317, 5319, 5321, 5324, 5329, 5330, 5333, 5334, 5338, 5339, 5342, 5345, 5346, 5348, 5349, 5351, 5352, 5366, 5367, 5371, 5386, 5388, 5389, 5391, 5393, 5395, 5396, 5397, 5402, 5405, 5409, 5411, 5413, 5414, 5417, 5418, 5422, 5427, 5428, 5430, 5431, 5432, 5434, 5437, 5438, 5446, 5448, 5449, 5450, 5452, 5453, 5456, 5458, 5459, 5461, 5463, 5464, 5466, 5472, 5474, 5475, 5476, 5483, 5487, 5488, 5491, 5493, 5495, 5496, 5505, 5506, 5508, 5510, 5512, 5513, 5517, 5518, 5519, 5524, 5526, 5529, 5530, 5531, 5534, 5535, 5543, 5545, 5554, 5557, 5562, 5563, 5565, 5566, 5568, 5569, 5572, 5575, 5579, 5581, 5582, 5584, 5585, 5586, 5589, 5591, 5593, 5594, 5596, 5597, 5602, 5608, 5610, 5611, 5612, 5613, 5614, 5615, 5616, 5619, 5620, 5621, 5623, 5627, 5632, 5633, 5635, 5638, 5640, 5643, 5646, 5647, 5648, 5651, 5652, 5653, 5656, 5659, 5660, 5662, 5663, 5669, 5680, 5681, 5689, 5690, 5694, 5695, 5697, 5698, 5702, 5706, 5709, 5711, 5718, 5719, 5720, 5721, 5722, 5723, 5724, 5729, 5730, 5731, 5732, 5734, 5735, 5736, 5742, 5744, 5746, 5751, 5768, 5770, 5771, 5773, 5775, 5778, 5780, 5785, 5791, 5792, 5794, 5807, 5808, 5810, 5811, 5816, 5817, 5820, 5826, 5828, 5832, 5833, 5834, 5835, 5836, 5837, 5839, 5842, 5844, 5853, 5854, 5859, 5864, 5866, 5867, 5868, 5869, 5871, 5872, 5876, 5877, 5878, 5879, 5881, 5882, 5883, 5884, 5888, 5892, 5893, 5900, 5902, 5906, 5907, 5910, 5912, 5913, 5914, 5919, 5921, 5922, 5923, 5925, 5926, 5927, 5928, 5930, 5931, 5932, 5933, 5936, 5938, 5939, 5941, 5942, 5944, 5945, 5946, 5948, 5950, 5951, 5952, 5954, 5956, 5957, 5959, 5961, 5968, 5969, 5971, 5978, 5980, 5985, 5986, 5988, 5991, 5996, 5997, 6000, 6003, 6004, 6006, 6007, 6010, 6012, 6013, 6016, 6017, 6021, 6023, 6025, 6026, 6038, 6040, 6041, 6044, 6047, 6048, 6051, 6053, 6054, 6058, 6059, 6062, 6063, 6068, 6069, 6070, 6072, 6073, 6074, 6075, 6080, 6085, 6088, 6089, 6092, 6093, 6094, 6095, 6097, 6098, 6107, 6108, 6109, 6110, 6112, 6113, 6116, 6118, 6119, 6122, 6129, 6130, 6131, 6132, 6133, 6135, 6136, 6137, 6138, 6143, 6145, 6146, 6147, 6149, 6151, 6152, 6153, 6156, 6160, 6163, 6164, 6165, 6168, 6176, 6181, 6182, 6183, 6186, 6188, 6189, 6190, 6191, 6193, 6196, 6197, 6198, 6200, 6204, 6205, 6207, 6209, 6212, 6215, 6219, 6220, 6223, 6224, 6227, 6228, 6230, 6231, 6233, 6234, 6237, 6238, 6240, 6243, 6245, 6246, 6247, 6249, 6250, 6251, 6255, 6257, 6258, 6259, 6264, 6265, 6269, 6270, 6271, 6272, 6273, 6275, 6278, 6279, 6280, 6281, 6282, 6283, 6284, 6285, 6286, 6288, 6289, 6292, 6295, 6299, 6302, 6309, 6310, 6311, 6312, 6314, 6315, 6317, 6319, 6321, 6322, 6325, 6328, 6330, 6333, 6334, 6338, 6345, 6346, 6351, 6352, 6353, 6354, 6359, 6360, 6362, 6363, 6367, 6370, 6372, 6375, 6376, 6378, 6379, 6381, 6383, 6387, 6394, 6395, 6396, 6398, 6399, 6403, 6405, 6407, 6408, 6410, 6412, 6413, 6414, 6415, 6419, 6420, 6421, 6428, 6429, 6430, 6431, 6434, 6435, 6436, 6437, 6440, 6442, 6452, 6454, 6458, 6459, 6464, 6465, 6466, 6467, 6468, 6469, 6470, 6471, 6474, 6476, 6480, 6482, 6484, 6486, 6488, 6493, 6495, 6500, 6501, 6502, 6504, 6505, 6510, 6513, 6514, 6516, 6517, 6519, 6524, 6525, 6526, 6530, 6533, 6534, 6537, 6539, 6543, 6544, 6545, 6547, 6548, 6549, 6554, 6555, 6558, 6560, 6561, 6563, 6567, 6574, 6576, 6577, 6579, 6581, 6582, 6584, 6587, 6588, 6589, 6594, 6595, 6598, 6599, 6600, 6607, 6611, 6614, 6620, 6621, 6622, 6624, 6625, 6626, 6627, 6628, 6630, 6634, 6635, 6637, 6638, 6639, 6643, 6644, 6649, 6650, 6652, 6655, 6656, 6658, 6662, 6666, 6671, 6677, 6681, 6686, 6691, 6692, 6695, 6696, 6699, 6702, 6703, 6704, 6705, 6706, 6711, 6714, 6716, 6718, 6720, 6724, 6725, 6729, 6734, 6736, 6737, 6739, 6746, 6747, 6752, 6756, 6757, 6758, 6759, 6760, 6761, 6764, 6766, 6767, 6778, 6779, 6780, 6786, 6788, 6789, 6792, 6793, 6794, 6797, 6799, 6803, 6804, 6805, 6807, 6808, 6810, 6811, 6812, 6813, 6816, 6819, 6820, 6821, 6824, 6827, 6828, 6829, 6830, 6831, 6834, 6836, 6837, 6839, 6840, 6841, 6842, 6843, 6845, 6851, 6852, 6859, 6860, 6863, 6864, 6865, 6869, 6872, 6874, 6875, 6878, 6879, 6880, 6882, 6883, 6884, 6885, 6886, 6888, 6890, 6895, 6897, 6903, 6904, 6909, 6914, 6915, 6917, 6919, 6920, 6921, 6923, 6924, 6930, 6933, 6936, 6941, 6943, 6946, 6948, 6959, 6960, 6963, 6967, 6969, 6970, 6979, 6980, 6984, 6985, 6987, 6988, 6990, 6991, 6993, 6994, 6995, 6997, 7002, 7003, 7006, 7009, 7011, 7012, 7013, 7015, 7022, 7032, 7038, 7039, 7042, 7043, 7045, 7046, 7048, 7051, 7052, 7053, 7056, 7057, 7060, 7062, 7064, 7067, 7072, 7073, 7074, 7075, 7077, 7083, 7084, 7085, 7086, 7105, 7106, 7107, 7108, 7112, 7113, 7117, 7118, 7124, 7130, 7132, 7135, 7140, 7142, 7144, 7149, 7155, 7163, 7164, 7165, 7166, 7169, 7173, 7176, 7177, 7184, 7187, 7188, 7192, 7194, 7196, 7201, 7202, 7203, 7206, 7207, 7208, 7209, 7212, 7216, 7217, 7220, 7227, 7228, 7230, 7231, 7234, 7235, 7236, 7239, 7240, 7241, 7243, 7244, 7245, 7248, 7255, 7257, 7258, 7259, 7262, 7267, 7268, 7274, 7276, 7277, 7278, 7281, 7282, 7284, 7287, 7288, 7290, 7291, 7292, 7293, 7298, 7299, 7300, 7301, 7303, 7304, 7305, 7306, 7307, 7308, 7310, 7313, 7315, 7317, 7321, 7328, 7330, 7334, 7336, 7339, 7340, 7344, 7354, 7355, 7356, 7357, 7358, 7360, 7363, 7365, 7371, 7373, 7379, 7380, 7381, 7382, 7383, 7386, 7388, 7389, 7392, 7396, 7398, 7409, 7410, 7411, 7417, 7418, 7425, 7428, 7430, 7434, 7435, 7436, 7441, 7443, 7444, 7445, 7446, 7447, 7448, 7452, 7454, 7458, 7459, 7464, 7466, 7470, 7472, 7476, 7483, 7484, 7486, 7487, 7490, 7491, 7492, 7493, 7498, 7502, 7504, 7505, 7506, 7512, 7514, 7515, 7517, 7523, 7524, 7525, 7528, 7529, 7533, 7534, 7538, 7546, 7547, 7548, 7554, 7557, 7561, 7572, 7574, 7577, 7578, 7579, 7580, 7585, 7586, 7587, 7590, 7591, 7593, 7594, 7598, 7605, 7611, 7613, 7619, 7620, 7621, 7623, 7624, 7629, 7633, 7638, 7639, 7640, 7642, 7647, 7652, 7655, 7658, 7661, 7663, 7664, 7665, 7666, 7667, 7669, 7674, 7676, 7677, 7678, 7679, 7680, 7682, 7685, 7687, 7689, 7693, 7695, 7699, 7700, 7703, 7704, 7708, 7712, 7716, 7717, 7718, 7719, 7724, 7725, 7726, 7729, 7733, 7736, 7737, 7738, 7740, 7743, 7744, 7745, 7747, 7748, 7751, 7753, 7761, 7762, 7763, 7767, 7768, 7769, 7770, 7774, 7775, 7777, 7778, 7779, 7780, 7782, 7783, 7785, 7786, 7788, 7791, 7792, 7793, 7798, 7799, 7800, 7803, 7804, 7806, 7807, 7812, 7815, 7818, 7819, 7820, 7823, 7824, 7825, 7832, 7833, 7834, 7838, 7841, 7844, 7845, 7847, 7848, 7849, 7850, 7856, 7858, 7859, 7860, 7862, 7863, 7865, 7873, 7875, 7876, 7878, 7880, 7888, 7890, 7896, 7900, 7908, 7909, 7910, 7911, 7917, 7918, 7920, 7921, 7923, 7925, 7928, 7929, 7933, 7934, 7935, 7936, 7937, 7938, 7942, 7944, 7945, 7946, 7947, 7948, 7949, 7950, 7951, 7952, 7955, 7956, 7964, 7971, 7972, 7974, 7976, 7977, 7978, 7980, 7981, 7983, 7984, 7986, 7988, 7989, 7990, 7991, 7993, 7998, 8002, 8004, 8006, 8007, 8008, 8009, 8012, 8021, 8026, 8029, 8039, 8042, 8044, 8047, 8048, 8052, 8053, 8056, 8058, 8059, 8063, 8067, 8068, 8071, 8072, 8075, 8076, 8077, 8078, 8080, 8082, 8084, 8088, 8091, 8093, 8095, 8099, 8100, 8102, 8103, 8105, 8112, 8115, 8116, 8118, 8121, 8123, 8126, 8134, 8136, 8137, 8145, 8146, 8148, 8150, 8151, 8155, 8159, 8162, 8163, 8165, 8166, 8168, 8170, 8176, 8178, 8179, 8182, 8189, 8192, 8193, 8195, 8199, 8202, 8204, 8206, 8207, 8208, 8211, 8213, 8216, 8217, 8219, 8220, 8223, 8225, 8227, 8231, 8235, 8236, 8237, 8239, 8242, 8245, 8250, 8252, 8253, 8257, 8258, 8265, 8266, 8268, 8269, 8270, 8272, 8282, 8289, 8291, 8292, 8293, 8294, 8300, 8301, 8304, 8306, 8310, 8311, 8312, 8318, 8319, 8320, 8321, 8329, 8334, 8335, 8336, 8339, 8340, 8350, 8352, 8353, 8355, 8361, 8363, 8367, 8368, 8369, 8373, 8379, 8382, 8385, 8386, 8387, 8389, 8390, 8392, 8393, 8395, 8398, 8401, 8402, 8403, 8404, 8405, 8407, 8410, 8413, 8414, 8416, 8423, 8427, 8430, 8433, 8435, 8436, 8438, 8439, 8441, 8442, 8444, 8446, 8447, 8448, 8449, 8450, 8451, 8452, 8456, 8458, 8459, 8463, 8465, 8466, 8470, 8472, 8473, 8474, 8476, 8477, 8480, 8481, 8482, 8483, 8485, 8486, 8490, 8493, 8494, 8498, 8499, 8501, 8505, 8509, 8511, 8513, 8515, 8517, 8520, 8523, 8524, 8525, 8528, 8531, 8532, 8533, 8535, 8537, 8538, 8539, 8542, 8543, 8549, 8550, 8552, 8553, 8554, 8557, 8561, 8562, 8565, 8568, 8575, 8576, 8579, 8581, 8582, 8589, 8590, 8592, 8593, 8594, 8596, 8597, 8598, 8599, 8600, 8601, 8602, 8603, 8604, 8605, 8610, 8611, 8612, 8613, 8614, 8617, 8624, 8628, 8631, 8634, 8635, 8637, 8638, 8640, 8642, 8644, 8648, 8650, 8654, 8657, 8658, 8659, 8660, 8665, 8669, 8670, 8672, 8675, 8676, 8677, 8685, 8693, 8699, 8700, 8703, 8704, 8706, 8708, 8709, 8712, 8713, 8716, 8717, 8720, 8726, 8727, 8729, 8731, 8732, 8734, 8735, 8736, 8741, 8742, 8743, 8746, 8748, 8751, 8752, 8753, 8757, 8761, 8764, 8766, 8767, 8770, 8772, 8773, 8775, 8777, 8779, 8782, 8783, 8784, 8789, 8792, 8797, 8803, 8805, 8810, 8818, 8821, 8822, 8824, 8829, 8831, 8832, 8834, 8835, 8838, 8839, 8841, 8843, 8846, 8853, 8854, 8859, 8861, 8865, 8867, 8876, 8877, 8878, 8881, 8883, 8886, 8888, 8889, 8891, 8892, 8896, 8899, 8900, 8902, 8905, 8907, 8908, 8909, 8910, 8911, 8913, 8914, 8916, 8917, 8922, 8924, 8926, 8929, 8930, 8935, 8938, 8941, 8942, 8945, 8946, 8949, 8951, 8954, 8956, 8957, 8960, 8967, 8968, 8969, 8972, 8974, 8976, 8977, 8979, 8980, 8981, 8985, 8986, 8991, 8992, 8996, 8998, 8999, 9001, 9002, 9003, 9006, 9009, 9012, 9013, 9015, 9018, 9020, 9023, 9029, 9030, 9033, 9037, 9042, 9044, 9047, 9052, 9056, 9057, 9058, 9059, 9060, 9061, 9062, 9066, 9069, 9071, 9072, 9073, 9074, 9076, 9080, 9084, 9088, 9091, 9092, 9095, 9096, 9098, 9105, 9108, 9110, 9111, 9112, 9114, 9115, 9118, 9119, 9123, 9124, 9125, 9129, 9133, 9134, 9138, 9139, 9140, 9141, 9142, 9149, 9151, 9152, 9154, 9155, 9167, 9168, 9173, 9174, 9175, 9177, 9183, 9185, 9187, 9188, 9190, 9191, 9195, 9204, 9205, 9206, 9207, 9210, 9211, 9213, 9214, 9215, 9216, 9218, 9223, 9226, 9229, 9231, 9233, 9237, 9241, 9242, 9243, 9247, 9249, 9252, 9253, 9254, 9255, 9257, 9263, 9267, 9269, 9270, 9273, 9276, 9282, 9284, 9285, 9287, 9288, 9290, 9292, 9293, 9299, 9300, 9302, 9304, 9308, 9311, 9314, 9316, 9320, 9321, 9323, 9325, 9326, 9327, 9328, 9329, 9330, 9333, 9336, 9337, 9338, 9339, 9340, 9341, 9345, 9346, 9347, 9348, 9353, 9354, 9355, 9359, 9366, 9367, 9373, 9375, 9376, 9378, 9382, 9383, 9388, 9391, 9392, 9393, 9394, 9396, 9400, 9402, 9403, 9404, 9406, 9407, 9413, 9415, 9423, 9432, 9433, 9434, 9439, 9440, 9442, 9443, 9444, 9449, 9451, 9452, 9455, 9456, 9460, 9468, 9470, 9471, 9472, 9473, 9475, 9483, 9488, 9490, 9497, 9500, 9501, 9502, 9503, 9504, 9509, 9513, 9514, 9515, 9517, 9518, 9519, 9522, 9531, 9532, 9533, 9534, 9536, 9540, 9545, 9548, 9553, 9555, 9563, 9564, 9565, 9568, 9571, 9573, 9575, 9577, 9582, 9583, 9587, 9589, 9590, 9591, 9596, 9597, 9602, 9606, 9609, 9610, 9613, 9618, 9620, 9623, 9626, 9627, 9628, 9629, 9632, 9633, 9635, 9641, 9642, 9644, 9645, 9646, 9648, 9649, 9652, 9653, 9655, 9657, 9658, 9659, 9660, 9663, 9666, 9668, 9670, 9675, 9681, 9682, 9686, 9687, 9692, 9693, 9698, 9699, 9706, 9718, 9723, 9726, 9729, 9730, 9731, 9733, 9734, 9737, 9746, 9750, 9751, 9753, 9754, 9755, 9756, 9763, 9764, 9767, 9768, 9770, 9776, 9780, 9781, 9782, 9784, 9791, 9792, 9793, 9794, 9796, 9799, 9801, 9802, 9808, 9809, 9810, 9812, 9813, 9814, 9816, 9819, 9820, 9824, 9825, 9826, 9827, 9829, 9830, 9833, 9835, 9836, 9845, 9846, 9847, 9849, 9850, 9851, 9853, 9854, 9861, 9864, 9866, 9869, 9871, 9873, 9882, 9886, 9887, 9892, 9897, 9900, 9901, 9906, 9907, 9908, 9909, 9910, 9912, 9923, 9924, 9928, 9930, 9935, 9938, 9940, 9944, 9946, 9947, 9949, 9950, 9953, 9955, 9957, 9958, 9960, 9962, 9963, 9964, 9967, 9968, 9971, 9974, 9979, 9980, 9982, 9984, 9985, 9987, 9988, 9990, 9991, 9996, 9997, 9998, 10000, 10008, 10009, 10010, 10012, 10013, 10017, 10019, 10021, 10022, 10026, 10031, 10032, 10033, 10034, 10035, 10038, 10040, 10043, 10045, 10048, 10051, 10052, 10054, 10056, 10058, 10059, 10060, 10062, 10063, 10064, 10068, 10073, 10075, 10077, 10078, 10080, 10081, 10083, 10089, 10091, 10092, 10095, 10097, 10101, 10102, 10103, 10105, 10106, 10107, 10108, 10109, 10110, 10112, 10114, 10115, 10116, 10118, 10122, 10127, 10128, 10131, 10132, 10136, 10141, 10143, 10146, 10149, 10151, 10152, 10158, 10162, 10163, 10165, 10166, 10168, 10174, 10176, 10178, 10180, 10181, 10182, 10191, 10192, 10193, 10194, 10195, 10197, 10199, 10203, 10206, 10209, 10212, 10218, 10219, 10220, 10222, 10223, 10225, 10228, 10231, 10232, 10233, 10236, 10237, 10239, 10247, 10252, 10255, 10258, 10259, 10260, 10270, 10275, 10284, 10291, 10292, 10293, 10295, 10300, 10302, 10306, 10307, 10311, 10318, 10321, 10323, 10325, 10326, 10328, 10330, 10331, 10333, 10334, 10335, 10336, 10343, 10346, 10352, 10353, 10356, 10357, 10359, 10360, 10362, 10364, 10368, 10371, 10373, 10375, 10376, 10378, 10380, 10381, 10384, 10385, 10388, 10389, 10395, 10397, 10398, 10399, 10400, 10401, 10405, 10408, 10410, 10412, 10413, 10414, 10416, 10421, 10423, 10426, 10427, 10430, 10435, 10437, 10438, 10440, 10442, 10443, 10446, 10447, 10449, 10450, 10453, 10456, 10463, 10464, 10465, 10468, 10469, 10470, 10474, 10478, 10482, 10487, 10488, 10490, 10492, 10494, 10496, 10497, 10504, 10506, 10508, 10513, 10514, 10515, 10518, 10521, 10525, 10527, 10528, 10530, 10531, 10533, 10535, 10536, 10537, 10541, 10542, 10543, 10544, 10547, 10548, 10549, 10550, 10551, 10555, 10556, 10558, 10560, 10561, 10562, 10564, 10565, 10567, 10569, 10571, 10573, 10580, 10581, 10582, 10583, 10585, 10590, 10593, 10596, 10597, 10599, 10601, 10602, 10609, 10610, 10611, 10614, 10615, 10616, 10617, 10619, 10621, 10622, 10623, 10626, 10628, 10634, 10636, 10637, 10638, 10639, 10640, 10641, 10642, 10643, 10645, 10646, 10648, 10649, 10650, 10655, 10657, 10659, 10663, 10665, 10666, 10668, 10670, 10674, 10678, 10681, 10682, 10683, 10684, 10685, 10687, 10697, 10698, 10699, 10700, 10702, 10703, 10705, 10707, 10708, 10711, 10712, 10715, 10716, 10721, 10722, 10723, 10725, 10726, 10727, 10732, 10734, 10735, 10738, 10740, 10741, 10744, 10745, 10748, 10749, 10752, 10753, 10761, 10762, 10763, 10766, 10774, 10775, 10776, 10778, 10779, 10782, 10784, 10785, 10787, 10788, 10790, 10791, 10792, 10795, 10796, 10798, 10800, 10801, 10803, 10805, 10809, 10810, 10811, 10818, 10819, 10820, 10821, 10824, 10825, 10826, 10830, 10831, 10832, 10833, 10836, 10838, 10839, 10840, 10841, 10843, 10846, 10850, 10852, 10853, 10854, 10857, 10858, 10860, 10861, 10862, 10866, 10867, 10871, 10872, 10874, 10877, 10880, 10881, 10892, 10896, 10897, 10898, 10899, 10902, 10905, 10912, 10917, 10920, 10926, 10927, 10930, 10933, 10934, 10935, 10936, 10937, 10938, 10940, 10941, 10944, 10947, 10948, 10950, 10954, 10957, 10960, 10962, 10963, 10965, 10967, 10970, 10972, 10975, 10976, 10977, 10978, 10979, 10981, 10985, 10988, 10993, 10995, 10996, 10997, 10999, 11002, 11004, 11005, 11006, 11008, 11010, 11015, 11018, 11024, 11026, 11027, 11032, 11033, 11039, 11046, 11047, 11049, 11052, 11053, 11056, 11058, 11060, 11066, 11068, 11070, 11072, 11078, 11080, 11082, 11083, 11086, 11090, 11095, 11098, 11101, 11102, 11103, 11105, 11107, 11108, 11110, 11114, 11116, 11118, 11119, 11123, 11124, 11125, 11126, 11127, 11129, 11132, 11135, 11137, 11138, 11141, 11145, 11146, 11148, 11153, 11154, 11158, 11159, 11160, 11161, 11162, 11163, 11165, 11166, 11168, 11169, 11171, 11175, 11177, 11178, 11184, 11187, 11188, 11190, 11192, 11194, 11198, 11199, 11201, 11204, 11207, 11214, 11217, 11218, 11222, 11226, 11227, 11228, 11229, 11232, 11233, 11234, 11235, 11236, 11237, 11238, 11239, 11242, 11244, 11246, 11247, 11248, 11251, 11254, 11255, 11256, 11257, 11258, 11259, 11260, 11262, 11263, 11264, 11266, 11274, 11275, 11278, 11288, 11289, 11290, 11291, 11292, 11293, 11294, 11295, 11298, 11305, 11306, 11307, 11313, 11315, 11316, 11319, 11320, 11322, 11324, 11326, 11329, 11330, 11331, 11332, 11337, 11338, 11339, 11340, 11345, 11346, 11348, 11352, 11356, 11358, 11363, 11364, 11365, 11370, 11371, 11373, 11377, 11379, 11380, 11381, 11382, 11385, 11387, 11388, 11389, 11392, 11394, 11395, 11397, 11403, 11404, 11405, 11406, 11409, 11411, 11412, 11413, 11414, 11416, 11418, 11420, 11423, 11428, 11430, 11431, 11434, 11437, 11438, 11442, 11443, 11445, 11446, 11449, 11456, 11459, 11463, 11465, 11466, 11467, 11470, 11471, 11472, 11473, 11475, 11476, 11478, 11481, 11482, 11487, 11490, 11492, 11496, 11497, 11498, 11500, 11501, 11506, 11507, 11508, 11509, 11512, 11513, 11516, 11518, 11520, 11523, 11524, 11526, 11527, 11528, 11530, 11531, 11532, 11533, 11534, 11538, 11541, 11544, 11546, 11548, 11551, 11553, 11558, 11560, 11561, 11567, 11571, 11576, 11577, 11578, 11580, 11583, 11585, 11586, 11588, 11589, 11593, 11594, 11595, 11596, 11597, 11598, 11599, 11603, 11604, 11610, 11615, 11618, 11620, 11621, 11623, 11625, 11628, 11629, 11632, 11633, 11636, 11639, 11642, 11649, 11650, 11651, 11652, 11655, 11656, 11657, 11658, 11663, 11669, 11673, 11678, 11681, 11682, 11683, 11684, 11688, 11691, 11692, 11694, 11695, 11701, 11703, 11705, 11707, 11711, 11712, 11718, 11720, 11721, 11722, 11725, 11726, 11731, 11733, 11736, 11740, 11743, 11744, 11753, 11755, 11756, 11759, 11760, 11761, 11762, 11763, 11765, 11770, 11771, 11776, 11780, 11781, 11782, 11783, 11784, 11785, 11786, 11790, 11792, 11795, 11799, 11800, 11809, 11811, 11812, 11813, 11814, 11816, 11818, 11819, 11826, 11828, 11829, 11830, 11837, 11841, 11846, 11848, 11849, 11850, 11851, 11853, 11856, 11857, 11858, 11863, 11868, 11870, 11872, 11876, 11877, 11878, 11879, 11881, 11889, 11890, 11891, 11894, 11898, 11899, 11903, 11909, 11911, 11913, 11916, 11917, 11919, 11920, 11921, 11923, 11926, 11928, 11929, 11930, 11934, 11935, 11940, 11941, 11943, 11946, 11947, 11948, 11949, 11953, 11955, 11957, 11958, 11959, 11960, 11961, 11962, 11963, 11965, 11966, 11968, 11974, 11976, 11977, 11978, 11979, 11980, 11983, 11988, 11993, 11994, 11995, 11996, 11997, 11998, 11999, 12002, 12004, 12006, 12014, 12017, 12019, 12020, 12021, 12023, 12024, 12025, 12029, 12032, 12042, 12043, 12044, 12047, 12050, 12051, 12054, 12058, 12059, 12060, 12061, 12063, 12066, 12068, 12077, 12078, 12079, 12080, 12081, 12083, 12085, 12086, 12091, 12092, 12093, 12097, 12098, 12102, 12104, 12106, 12109, 12110, 12112, 12115, 12118, 12120, 12122, 12126, 12128, 12129, 12131, 12134, 12135, 12137, 12138, 12139, 12142, 12143, 12144, 12145, 12146, 12147, 12148, 12151, 12153, 12155, 12161, 12162, 12165, 12166, 12170, 12171, 12174, 12175, 12179, 12181, 12186, 12187, 12197, 12200, 12201, 12202, 12204, 12208, 12212, 12214, 12215, 12217, 12220, 12223, 12227, 12228, 12229, 12230, 12233, 12234, 12237, 12241, 12243, 12245, 12250, 12252, 12253, 12254, 12255, 12256, 12259, 12269, 12271, 12278, 12280, 12281, 12283, 12285, 12286, 12287, 12295, 12296, 12299, 12310, 12311, 12312, 12313, 12314, 12315, 12317, 12319, 12321, 12323, 12325, 12326, 12331, 12334, 12335, 12337, 12339, 12342, 12345, 12347, 12350, 12354, 12356, 12358, 12359, 12364, 12366, 12369, 12370, 12374, 12375, 12376, 12379, 12381, 12385, 12388, 12390, 12393, 12394, 12397, 12400, 12403, 12404, 12406, 12411, 12414, 12415, 12416, 12419, 12420, 12423, 12424, 12425, 12426, 12427, 12428, 12437, 12440, 12441, 12444, 12445, 12446, 12450, 12451, 12455, 12456, 12457, 12459, 12461, 12462, 12465, 12467, 12468, 12470, 12472, 12473, 12478, 12479, 12480, 12481, 12485, 12488, 12492, 12494, 12497, 12499, 12501, 12502, 12503, 12508, 12512, 12513, 12514, 12515, 12518, 12519, 12527, 12529, 12530, 12535, 12536, 12537, 12538, 12539, 12540, 12546, 12547, 12549, 12551, 12552, 12554, 12555, 12556, 12561, 12563, 12565, 12567, 12568, 12570, 12572, 12577, 12578, 12580, 12583, 12584, 12585, 12586, 12588, 12589, 12591, 12600, 12603, 12604, 12605, 12608, 12609, 12610, 12611, 12616, 12620, 12622, 12623, 12626, 12628, 12629, 12631, 12634, 12638, 12639, 12640, 12641, 12649, 12651, 12655, 12663, 12664, 12668, 12670, 12671, 12674, 12675, 12679, 12681, 12683, 12684, 12685, 12688, 12689, 12691, 12693, 12694, 12695, 12696, 12697, 12699, 12701, 12702, 12705, 12706, 12707, 12708, 12710, 12713, 12714, 12723, 12726, 12729, 12731, 12732, 12733, 12735, 12737, 12738, 12739, 12740, 12741, 12742, 12744, 12752, 12753, 12754, 12755, 12757, 12758, 12760, 12761, 12762, 12764, 12765, 12766, 12771, 12772, 12773, 12775, 12777, 12782, 12783, 12790, 12791, 12793, 12794, 12797, 12800, 12802, 12803, 12807, 12810, 12812, 12813, 12817, 12819, 12820, 12822, 12823, 12824, 12827, 12828, 12834, 12835, 12836, 12837, 12838, 12839, 12843, 12844, 12848, 12849, 12850, 12853, 12860, 12861, 12866, 12870, 12873, 12875, 12878, 12882, 12883, 12887, 12891, 12893, 12895, 12898, 12899, 12900, 12901, 12903, 12904, 12905, 12906, 12908, 12910, 12912, 12916, 12920, 12921, 12923, 12928, 12929, 12932, 12933, 12934, 12935, 12938, 12945, 12946, 12947, 12950, 12952, 12953, 12956, 12957, 12958, 12960, 12961, 12963, 12967, 12968, 12969, 12973, 12978, 12983, 12984, 12986, 12987, 12988, 12989, 12990, 12991, 12999, 13001, 13003, 13004, 13006, 13007, 13010, 13014, 13015, 13017, 13018, 13022, 13027, 13030, 13031, 13033, 13034, 13035, 13038, 13040, 13041, 13047, 13050, 13053, 13054, 13055, 13056, 13061, 13062, 13064, 13066, 13071, 13075, 13077, 13079, 13083, 13085, 13086, 13087, 13097, 13099, 13101, 13102, 13105, 13106, 13110, 13111, 13112, 13114, 13115, 13117, 13118, 13120, 13121, 13122, 13123, 13124, 13125, 13128, 13131, 13134, 13136, 13143, 13144, 13147, 13148, 13149, 13151, 13154, 13159, 13160, 13169, 13175, 13181, 13182, 13186, 13190, 13197, 13198, 13199, 13206, 13209, 13210, 13212, 13213, 13215, 13217, 13220, 13221, 13224, 13227, 13228, 13232, 13234, 13235, 13236, 13237, 13239, 13241, 13248, 13250, 13251, 13255, 13256, 13259, 13260, 13261, 13262, 13263, 13264, 13265, 13267, 13268, 13269, 13271, 13274, 13281, 13297, 13298, 13300, 13301, 13303, 13304, 13313, 13315, 13317, 13329, 13332, 13337, 13340, 13343, 13345, 13346, 13347, 13348, 13350, 13352, 13361, 13363, 13367, 13368, 13369, 13370, 13377, 13380, 13381, 13384, 13385, 13386, 13391, 13393, 13394, 13395, 13397, 13403, 13404, 13407, 13408, 13410, 13416, 13417, 13418, 13419, 13423, 13424, 13430, 13433, 13439, 13441, 13444, 13448, 13451, 13454, 13456, 13460, 13463, 13464, 13467, 13469, 13473, 13475, 13477, 13478, 13479, 13480, 13489, 13491, 13492, 13494, 13496, 13499, 13503, 13504, 13513, 13514, 13515, 13518, 13519, 13521, 13522, 13524, 13525, 13526, 13529, 13532, 13533, 13539, 13540, 13543, 13544, 13546, 13547, 13549, 13551, 13552, 13553, 13555, 13558, 13559, 13560, 13561, 13568, 13569, 13572, 13574, 13577, 13578, 13580, 13584, 13587, 13597, 13598, 13599, 13600, 13601, 13602, 13604, 13605, 13612, 13613, 13614, 13620, 13621, 13623, 13628, 13630, 13631, 13632, 13634, 13636, 13637, 13638, 13639, 13641, 13643, 13647, 13651, 13652, 13653, 13654, 13662, 13663, 13665, 13668, 13675, 13677, 13678, 13679, 13683, 13687, 13688, 13689, 13696, 13697, 13698, 13700, 13702, 13706, 13710, 13713, 13714, 13715, 13716, 13719, 13720, 13722, 13727, 13729, 13730, 13736, 13737, 13739, 13742, 13745, 13747, 13750, 13753, 13755, 13756, 13763, 13764, 13766, 13767, 13768, 13772, 13773, 13774, 13775, 13777, 13779, 13780, 13782, 13783, 13786, 13787, 13788, 13791, 13793, 13796, 13801, 13809, 13816, 13817, 13818, 13819, 13820, 13822, 13823, 13828, 13830, 13834, 13835, 13843, 13849, 13852, 13853, 13858, 13859, 13866, 13869, 13870, 13872, 13873, 13877, 13885, 13887, 13888, 13891, 13892, 13895, 13897, 13898, 13899, 13901, 13906, 13908, 13909, 13910, 13911, 13917, 13918, 13919, 13920, 13927, 13929, 13932, 13934, 13947, 13949, 13950, 13953, 13954, 13958, 13960, 13961, 13963, 13969, 13970, 13971, 13975, 13984, 13986, 13987, 13990, 13991, 13999, 14000, 14001, 14005, 14006, 14009, 14014, 14017, 14018, 14022, 14027, 14030, 14031, 14036, 14038, 14040, 14049, 14051, 14052, 14059, 14062, 14063, 14066, 14067, 14069, 14070, 14071, 14073, 14075, 14076, 14078, 14080, 14081, 14085, 14086, 14087, 14088, 14092, 14094, 14096, 14104, 14105, 14111, 14112, 14116, 14118, 14119, 14121, 14122, 14124, 14129, 14130, 14132, 14133, 14135, 14137, 14138, 14139, 14140, 14141, 14142, 14145, 14146, 14147.

Promoters expressing in the embryo at 28 days after pollination include SEQ IDs: 3, 7, 12, 14, 15, 16, 17, 20, 26, 27, 29, 31, 33, 34, 36, 37, 44, 48, 54, 56, 57, 63, 64, 65, 79, 80, 86, 88, 90, 93, 94, 96, 98, 99, 100, 102, 103, 104, 110, 111, 112, 117, 121, 123, 126, 128, 130, 131, 137, 143, 144, 146, 147, 148, 152, 154, 155, 156, 157, 159, 162, 165, 168, 174, 175, 176, 177, 179, 181, 183, 187, 191, 193, 194, 196, 197, 199, 202, 203, 204, 205, 207, 210, 211, 212, 214, 223, 230, 232, 234, 235, 236, 237, 240, 242, 246, 249, 250, 251, 256, 257, 259, 264, 267, 269, 270, 271, 273, 286, 288, 289, 293, 294, 298, 301, 302, 305, 306, 308, 309, 314, 316, 319, 320, 322, 323, 328, 329, 332, 334, 335, 337, 338, 340, 346, 349, 352, 353, 354, 355, 356, 358, 360, 364, 365, 371, 373, 379, 381, 388, 396, 401, 404, 411, 412, 414, 416, 423, 428, 429, 431, 432, 433, 434, 436, 441, 448, 450, 452, 454, 456, 458, 459, 461, 462, 463, 466, 468, 470, 471, 474, 478, 479, 482, 483, 485, 488, 489, 496, 498, 501, 502, 504, 505, 507, 509, 510, 511, 514, 515, 516, 517, 522, 523, 525, 532, 536, 537, 541, 542, 543, 544, 546, 547, 548, 553, 554, 555, 557, 561, 563, 573, 578, 580, 585, 591, 594, 595, 596, 599, 605, 606, 607, 608, 611, 613, 614, 619, 620, 623, 626, 630, 631, 633, 635, 636, 637, 638, 643, 647, 650, 661, 663, 664, 665, 669, 670, 671, 681, 683, 684, 687, 693, 694, 695, 701, 702, 705, 706, 709, 716, 717, 718, 719, 722, 723, 724, 727, 731, 732, 733, 734, 736, 740, 742, 744, 749, 753, 757, 759, 764, 765, 779, 781, 782, 783, 784, 792, 793, 800, 804, 806, 808, 809, 811, 812, 820, 821, 824, 825, 826, 829, 830, 833, 840, 841, 844, 846, 849, 855, 856, 857, 858, 862, 863, 865, 870, 871, 875, 876, 877, 878, 883, 887, 890, 891, 892, 893, 895, 897, 898, 899, 900, 903, 907, 908, 910, 911, 912, 913, 915, 916, 919, 920, 924, 928, 932, 934, 936, 938, 939, 943, 944, 947, 949, 951, 953, 955, 957, 958, 960, 964, 971, 974, 976, 977, 978, 979, 980, 981, 982, 984, 985, 987, 991, 993, 994, 995, 997, 999, 1003, 1005, 1007, 1008, 1009, 1011, 1012, 1013, 1014, 1016, 1017, 1019, 1022, 1025, 1026, 1032, 1033, 1035, 1038, 1039, 1041, 1043, 1046, 1047, 1049, 1051, 1052, 1054, 1055, 1056, 1057, 1065, 1069, 1070, 1074, 1076, 1077, 1080, 1085, 1086, 1087, 1089, 1092, 1095, 1096, 1100, 1101, 1103, 1104, 1110, 1111, 1112, 1114, 1115, 1116, 1117, 1119, 1121, 1125, 1127, 1130, 1132, 1136, 1137, 1140, 1144, 1146, 1148, 1153, 1154, 1160, 1161, 1162, 1164, 1165, 1167, 1168, 1170, 1171, 1176, 1178, 1183, 1185, 1186, 1187, 1189, 1190, 1191, 1196, 1200, 1201, 1204, 1205, 1213, 1214, 1215, 1217, 1218, 1220, 1222, 1223, 1225, 1227, 1228, 1230, 1231, 1233, 1236, 1240, 1248, 1249, 1250, 1251, 1252, 1254, 1257, 1258, 1261, 1262, 1263, 1269, 1272, 1281, 1285, 1286, 1290, 1292, 1293, 1296, 1303, 1306, 1307, 1309, 1310, 1311, 1312, 1314, 1316, 1320, 1321, 1322, 1323, 1325, 1327, 1330, 1331, 1334, 1337, 1339, 1344, 1345, 1347, 1349, 1354, 1355, 1358, 1360, 1363, 1364, 1366, 1367, 1368, 1371, 1375, 1376, 1377, 1380, 1381, 1387, 1388, 1389, 1391, 1393, 1394, 1396, 1399, 1402, 1404, 1405, 1406, 1412, 1415, 1420, 1421, 1423, 1426, 1431, 1432, 1433, 1437, 1438, 1440, 1441, 1442, 1447, 1448, 1451, 1453, 1458, 1459, 1461, 1464, 1466, 1471, 1472, 1475, 1484, 1485, 1488, 1489, 1490, 1491, 1493, 1498, 1499, 1501, 1503, 1506, 1508, 1510, 1511, 1512, 1514, 1518, 1519, 1527, 1528, 1530, 1536, 1539, 1543, 1545, 1549, 1550, 1551, 1553, 1554, 1555, 1556, 1561, 1563, 1564, 1567, 1570, 1571, 1575, 1578, 1582, 1584, 1585, 1586, 1590, 1591, 1596, 1597, 1598, 1599, 1600, 1601, 1602, 1604, 1605, 1608, 1609, 1610, 1612, 1614, 1615, 1616, 1617, 1623, 1625, 1634, 1635, 1637, 1638, 1641, 1642, 1643, 1648, 1650, 1651, 1653, 1654, 1658, 1659, 1662, 1663, 1668, 1669, 1671, 1673, 1675, 1676, 1678, 1681, 1682, 1684, 1687, 1688, 1689, 1690, 1691, 1696, 1697, 1698, 1699, 1703, 1705, 1706, 1707, 1708, 1709, 1710, 1712, 1716, 1717, 1718, 1720, 1725, 1732, 1735, 1749, 1750, 1755, 1759, 1761, 1764, 1769, 1773, 1774, 1776, 1777, 1785, 1786, 1791, 1792, 1798, 1807, 1809, 1811, 1813, 1814, 1822, 1826, 1828, 1830, 1832, 1834, 1837, 1839, 1840, 1848, 1851, 1852, 1859, 1861, 1863, 1866, 1867, 1869, 1872, 1873, 1876, 1879, 1880, 1882, 1886, 1888, 1891, 1893, 1897, 1898, 1899, 1900, 1902, 1904, 1905, 1906, 1910, 1911, 1913, 1916, 1918, 1920, 1922, 1923, 1924, 1928, 1930, 1931, 1933, 1934, 1936, 1939, 1940, 1944, 1945, 1949, 1950, 1952, 1953, 1954, 1958, 1964, 1968, 1970, 1971, 1972, 1973, 1977, 1979, 1981, 1990, 1993, 1994, 1995, 1996, 1999, 2000, 2001, 2007, 2008, 2009, 2010, 2012, 2014, 2015, 2017, 2019, 2021, 2026, 2031, 2032, 2036, 2037, 2040, 2041, 2042, 2043, 2048, 2060, 2062, 2064, 2066, 2071, 2072, 2074, 2077, 2078, 2087, 2088, 2089, 2091, 2092, 2093, 2094, 2097, 2099, 2103, 2104, 2106, 2107, 2112, 2119, 2122, 2123, 2125, 2132, 2133, 2137, 2139, 2140, 2141, 2142, 2143, 2144, 2146, 2147, 2150, 2151, 2156, 2157, 2158, 2159, 2161, 2164, 2167, 2170, 2172, 2175, 2177, 2178, 2179, 2185, 2188, 2189, 2193, 2196, 2200, 2205, 2206, 2207, 2210, 2213, 2214, 2215, 2216, 2218, 2221, 2223, 2226, 2235, 2240, 2241, 2242, 2243, 2253, 2257, 2259, 2260, 2263, 2266, 2267, 2274, 2276, 2278, 2280, 2282, 2283, 2284, 2288, 2291, 2293, 2296, 2297, 2298, 2300, 2303, 2304, 2305, 2306, 2308, 2309, 2310, 2313, 2314, 2322, 2323, 2325, 2328, 2329, 2331, 2333, 2337, 2339, 2342, 2343, 2353, 2358, 2359, 2363, 2366, 2367, 2371, 2372, 2379, 2380, 2381, 2382, 2383, 2384, 2395, 2401, 2402, 2405, 2410, 2412, 2413, 2414, 2416, 2417, 2418, 2419, 2420, 2423, 2428, 2430, 2431, 2432, 2433, 2434, 2435, 2437, 2439, 2440, 2441, 2442, 2443, 2445, 2451, 2452, 2453, 2454, 2456, 2457, 2458, 2465, 2469, 2470, 2472, 2474, 2476, 2477, 2479, 2480, 2481, 2482, 2485, 2487, 2489, 2490, 2493, 2494, 2495, 2496, 2498, 2500, 2505, 2506, 2507, 2509, 2510, 2513, 2514, 2515, 2516, 2517, 2521, 2522, 2525, 2528, 2529, 2531, 2532, 2533, 2536, 2537, 2538, 2539, 2540, 2541, 2544, 2545, 2549, 2551, 2552, 2554, 2555, 2556, 2559, 2567, 2568, 2570, 2571, 2573, 2576, 2578, 2579, 2581, 2583, 2589, 2590, 2596, 2599, 2600, 2601, 2605, 2609, 2611, 2613, 2616, 2618, 2620, 2625, 2627, 2632, 2634, 2635, 2636, 2639, 2644, 2645, 2647, 2648, 2649, 2652, 2655, 2656, 2658, 2661, 2662, 2663, 2666, 2670, 2671, 2674, 2676, 2678, 2679, 2684, 2685, 2687, 2688, 2689, 2690, 2691, 2692, 2694, 2700, 2702, 2704, 2708, 2709, 2711, 2719, 2720, 2721, 2722, 2725, 2726, 2728, 2729, 2731, 2735, 2737, 2745, 2746, 2747, 2749, 2752, 2755, 2756, 2758, 2762, 2764, 2765, 2770, 2775, 2776, 2783, 2784, 2787, 2794, 2798, 2800, 2801, 2802, 2805, 2808, 2812, 2814, 2819, 2821, 2822, 2823, 2824, 2826, 2827, 2828, 2831, 2832, 2837, 2838, 2840, 2844, 2845, 2850, 2860, 2861, 2865, 2869, 2871, 2876, 2878, 2888, 2889, 2890, 2893, 2894, 2895, 2896, 2898, 2901, 2902, 2903, 2906, 2908, 2909, 2911, 2914, 2915, 2916, 2917, 2918, 2919, 2922, 2923, 2926, 2930, 2931, 2935, 2938, 2941, 2942, 2943, 2946, 2947, 2948, 2951, 2955, 2959, 2962, 2963, 2966, 2968, 2969, 2976, 2979, 2980, 2982, 2992, 2994, 2998, 3003, 3005, 3006, 3007, 3013, 3015, 3017, 3020, 3023, 3024, 3029, 3031, 3039, 3041, 3042, 3044, 3045, 3047, 3048, 3049, 3051, 3052, 3053, 3055, 3061, 3064, 3067, 3068, 3070, 3072, 3080, 3083, 3084, 3085, 3087, 3090, 3095, 3100, 3101, 3106, 3115, 3118, 3119, 3120, 3121, 3122, 3123, 3127, 3128, 3137, 3138, 3139, 3141, 3142, 3143, 3145, 3153, 3157, 3158, 3167, 3169, 3170, 3171, 3172, 3177, 3181, 3187, 3189, 3191, 3192, 3194, 3196, 3200, 3202, 3204, 3205, 3206, 3208, 3210, 3213, 3217, 3219, 3220, 3221, 3224, 3225, 3228, 3230, 3240, 3242, 3246, 3247, 3249, 3250, 3252, 3254, 3255, 3261, 3263, 3266, 3267, 3268, 3269, 3272, 3280, 3283, 3286, 3288, 3290, 3291, 3294, 3295, 3297, 3299, 3300, 3301, 3308, 3310, 3312, 3313, 3324, 3327, 3331, 3332, 3333, 3337, 3338, 3340, 3342, 3343, 3345, 3351, 3353, 3354, 3355, 3356, 3357, 3359, 3360, 3361, 3363, 3368, 3370, 3374, 3376, 3377, 3378, 3379, 3382, 3383, 3386, 3394, 3396, 3399, 3403, 3404, 3405, 3413, 3415, 3416, 3418, 3419, 3424, 3426, 3427, 3428, 3442, 3445, 3446, 3447, 3449, 3450, 3452, 3453, 3457, 3458, 3461, 3462, 3466, 3468, 3469, 3470, 3471, 3474, 3477, 3483, 3484, 3486, 3488, 3490, 3493, 3494, 3500, 3502, 3503, 3504, 3507, 3510, 3516, 3517, 3518, 3523, 3524, 3533, 3535, 3536, 3537, 3538, 3540, 3541, 3542, 3544, 3545, 3549, 3552, 3554,
3558, 3560, 3562, 3569, 3571, 3574, 3576, 3580, 3587, 3588,
3589, 3591, 3592, 3594, 3601, 3603, 3604, 3607, 3610, 3611,
3612, 3613, 3616, 3618, 3620, 3621, 3622, 3624, 3627, 3628,
3630, 3631, 3633, 3634, 3642, 3643, 3644, 3645, 3646, 3647,
3648, 3659, 3660, 3661, 3664, 3665, 3667, 3672, 3674, 3677,
3681, 3682, 3684, 3685, 3690, 3704, 3706, 3707, 3709, 3710,
3713, 3715, 3717, 3718, 3719, 3721, 3725, 3730, 3731, 3733,
3744, 3748, 3749, 3752, 3756, 3757, 3760, 3761, 3764, 3765,
3766, 3772, 3773, 3775, 3777, 3778, 3783, 3785, 3791, 3792,
3793, 3794, 3798, 3801, 3806, 3808, 3817, 3818, 3819, 3820,
3823, 3828, 3829, 3830, 3831, 3832, 3833, 3837, 3838, 3839,
3843, 3844, 3845, 3846, 3847, 3849, 3852, 3858, 3859, 3860,
3867, 3868, 3870, 3871, 3872, 3873, 3881, 3882, 3883, 3884,
3885, 3887, 3889, 3890, 3892, 3893, 3894, 3895, 3896, 3897,
3899, 3902, 3903, 3904, 3907, 3908, 3912, 3913, 3917, 3918,
3924, 3928, 3929, 3931, 3933, 3938, 3947, 3950, 3951, 3952,
3954, 3958, 3962, 3964, 3967, 3968, 3970, 3971, 3974, 3975,
3978, 3983, 3987, 3988, 3994, 3995, 3996, 3997, 3998, 4007,
4008, 4013, 4014, 4019, 4020, 4021, 4028, 4030, 4033, 4037,
4039, 4040, 4041, 4042, 4043, 4046, 4048, 4049, 4050, 4051,
4052, 4053, 4054, 4056, 4057, 4058, 4062, 4066, 4067, 4068,
4070, 4072, 4079, 4080, 4084, 4088, 4092, 4094, 4096, 4098,
4099, 4102, 4105, 4106, 4109, 4110, 4113, 4116, 4122, 4124,
4126, 4128, 4133, 4134, 4139, 4140, 4143, 4144, 4146, 4147,
4148, 4149, 4150, 4151, 4158, 4160, 4163, 4164, 4165, 4166,
4167, 4168, 4171, 4175, 4178, 4181, 4183, 4185, 4187, 4188,
4189, 4191, 4192, 4193, 4195, 4197, 4201, 4202, 4204, 4205,
4206, 4207, 4208, 4210, 4211, 4212, 4213, 4216, 4219, 4221,
4227, 4228, 4229, 4232, 4233, 4234, 4235, 4237, 4240, 4244,
4245, 4246, 4250, 4251, 4252, 4255, 4257, 4261, 4263, 4266,
4270, 4272, 4275, 4276, 4280, 4281, 4283, 4284, 4290, 4292,
4294, 4296, 4298, 4300, 4301, 4302, 4303, 4305, 4306, 4309,
4312, 4314, 4320, 4321, 4324, 4329, 4330, 4333, 4335, 4336,
4337, 4341, 4344, 4347, 4352, 4354, 4358, 4359, 4360, 4369,
4370, 4375, 4378, 4380, 4383, 4390, 4391, 4392, 4393, 4396,
4397, 4401, 4402, 4403, 4404, 4405, 4409, 4410, 4422, 4423,
4425, 4430, 4432, 4436, 4439, 4440, 4442, 4443, 4446, 4448,
4449, 4450, 4453, 4456, 4458, 4461, 4462, 4463, 4466, 4468,
4470, 4471, 4474, 4475, 4479, 4485, 4486, 4490, 4492, 4494,
4497, 4498, 4500, 4502, 4507, 4508, 4512, 4514, 4515, 4519,
4521, 4522, 4529, 4531, 4535, 4545, 4548, 4549, 4551, 4554,
4555, 4556, 4557, 4558, 4560, 4562, 4563, 4565, 4567, 4568,
4575, 4576, 4580, 4582, 4583, 4590, 4591, 4594, 4597, 4598,
4601, 4604, 4606, 4616, 4623, 4625, 4628, 4630, 4632, 4635,
4636, 4639, 4641, 4643, 4644, 4645, 4646, 4647, 4650, 4651,
4653, 4654, 4655, 4656, 4657, 4658, 4659, 4662, 4664, 4667,
4669, 4671, 4673, 4674, 4676, 4677, 4680, 4682, 4685, 4691,
4692, 4694, 4697, 4699, 4700, 4703, 4704, 4706, 4708, 4711,
4713, 4719, 4721, 4724, 4725, 4729, 4730, 4734, 4737, 4738,
4739, 4740, 4741, 4745, 4746, 4749, 4750, 4752, 4753, 4755,
4756, 4758, 4761, 4762, 4769, 4770, 4773, 4775, 4779, 4780,
4784, 4787, 4788, 4789, 4790, 4791, 4794, 4795, 4796, 4801,
4803, 4804, 4805, 4806, 4807, 4813, 4814, 4817, 4818, 4822,
4828, 4830, 4831, 4834, 4838, 4840, 4841, 4842, 4848, 4854,
4855, 4856, 4857, 4859, 4861, 4862, 4863, 4869, 4874, 4875,
4876, 4878, 4880, 4881, 4887, 4888, 4889, 4890, 4891, 4896,
4897, 4904, 4905, 4907, 4909, 4910, 4913, 4914, 4918, 4921,
4922, 4923, 4924, 4925, 4926, 4930, 4935, 4936, 4941, 4942,
4944, 4950, 4954, 4956, 4958, 4959, 4967, 4969, 4971, 4972,
4974, 4975, 4985, 4987, 4988, 4989, 4990, 4993, 4994, 4996,
5000, 5005, 5007, 5011, 5015, 5016, 5021, 5023, 5026, 5029,
5030, 5034, 5036, 5037, 5038, 5039, 5040, 5042, 5044, 5045,
5046, 5049, 5051, 5052, 5054, 5057, 5060, 5067, 5068, 5069,
5072, 5074, 5075, 5078, 5079, 5082, 5084, 5087, 5088, 5089,
5091, 5094, 5095, 5100, 5101, 5102, 5106, 5110, 5111, 5114,
5116, 5119, 5120, 5122, 5129, 5131, 5132, 5140, 5143, 5145,
5146, 5147, 5149, 5151, 5153, 5159, 5160, 5164, 5165, 5168,
5170, 5171, 5174, 5180, 5181, 5184, 5185, 5187, 5188, 5189,
5190, 5191, 5192, 5193, 5195, 5196, 5198, 5200, 5202, 5203,
5206, 5209, 5212, 5213, 5217, 5218, 5219, 5224, 5225, 5229,
5234, 5241, 5249, 5251, 5253, 5254, 5255, 5256, 5257, 5258,
5260, 5261, 5263, 5267, 5268, 5269, 5273, 5274, 5275, 5276,
5280, 5281, 5282, 5283, 5286, 5289, 5293, 5294, 5297, 5298,
5299, 5300, 5301, 5302, 5308, 5311, 5315, 5317, 5319, 5321,
5324, 5329, 5330, 5331, 5333, 5334, 5338, 5339, 5342, 5345,
5346, 5348, 5349, 5351, 5352, 5361, 5366, 5367, 5371, 5386,
5388, 5389, 5391, 5393, 5395, 5396, 5397, 5398, 5402, 5404,
5405, 5409, 5411, 5413, 5414, 5417, 5418, 5422, 5427, 5428,
5430, 5431, 5432, 5434, 5437, 5438, 5446, 5448, 5449, 5450,
5452, 5453, 5456, 5458, 5459, 5461, 5462, 5463, 5464, 5466,
5472, 5475, 5476, 5483, 5487, 5488, 5491, 5493, 5495, 5496,
5498, 5505, 5506, 5508, 5510, 5512, 5513, 5515, 5517, 5518,
5519, 5524, 5526, 5529, 5530, 5531, 5534, 5535, 5543, 5545,
5549, 5554, 5557, 5562, 5563, 5565, 5566, 5568, 5569, 5572,
5575, 5579, 5580, 5581, 5582, 5584, 5585, 5589, 5591, 5593,
5594, 5596, 5597, 5602, 5608, 5610, 5612, 5613, 5614, 5615,
5616, 5619, 5620, 5621, 5623, 5627, 5633, 5635, 5638, 5640,
5643, 5646, 5647, 5648, 5651, 5652, 5653, 5656, 5659, 5660,
5662, 5663, 5664, 5667, 5669, 5680, 5681, 5689, 5690, 5694,
5695, 5697, 5698, 5702, 5706, 5711, 5718, 5719, 5720, 5721,
5722, 5723, 5729, 5730, 5731, 5732, 5734, 5735, 5736, 5737,
5742, 5744, 5746, 5751, 5757, 5768, 5770, 5771, 5773, 5775,
5778, 5780, 5784, 5785, 5788, 5791, 5792, 5794, 5807, 5808,
5810, 5811, 5816, 5817, 5820, 5823, 5826, 5828, 5832, 5833,
5834, 5835, 5836, 5837, 5839, 5842, 5844, 5853, 5854, 5859,
5866, 5867, 5868, 5869, 5871, 5872, 5876, 5877, 5878, 5879,
5881, 5882, 5883, 5884, 5888, 5892, 5893, 5900, 5902, 5906,
5907, 5910, 5912, 5919, 5921, 5922, 5925, 5926, 5927, 5928,
5931, 5932, 5933, 5936, 5938, 5939, 5941, 5942, 5944, 5945,
5946, 5948, 5950, 5951, 5952, 5954, 5956, 5957, 5959, 5961,
5968, 5969, 5971, 5974, 5978, 5980, 5985, 5986, 5988, 5991,
5996, 5997, 6000, 6003, 6004, 6006, 6007, 6012, 6013, 6016,
6017, 6021, 6023, 6025, 6026, 6038, 6040, 6041, 6044, 6047,
6048, 6051, 6053, 6054, 6058, 6059, 6060, 6062, 6063, 6068,
6069, 6070, 6072, 6073, 6074, 6075, 6080, 6088, 6089, 6092,
6093, 6094, 6095, 6097, 6098, 6107, 6108, 6109, 6110, 6112,
6113, 6116, 6118, 6119, 6120, 6122, 6129, 6130, 6132, 6133,
6135, 6136, 6137, 6138, 6143, 6145, 6146, 6147, 6151, 6152,
6153, 6156, 6160, 6163, 6164, 6165, 6168, 6176, 6181, 6182,
6183, 6186, 6188, 6189, 6190, 6191, 6193, 6196, 6197, 6198,
6200, 6205, 6207, 6209, 6212, 6215, 6220, 6221, 6223, 6224,
6227, 6228, 6230, 6231, 6233, 6234, 6237, 6238, 6240, 6243,
6245, 6246, 6247, 6249, 6250, 6251, 6255, 6257, 6258, 6259,
6260, 6264, 6265, 6269, 6270, 6271, 6272, 6273, 6275, 6278,
6279, 6280, 6281, 6282, 6283, 6284, 6285, 6286, 6288, 6292,
6295, 6296, 6299, 6302, 6309, 6310, 6311, 6312, 6314, 6315,
6317, 6319, 6321, 6322, 6325, 6328, 6330, 6333, 6334, 6338,
6345, 6346, 6351, 6352, 6353, 6354, 6359, 6360, 6362, 6363,
6364, 6367, 6370, 6372, 6375, 6378, 6379, 6381, 6383, 6387,
6394, 6395, 6396, 6398, 6399, 6403, 6405, 6407, 6410, 6412,
6414, 6415, 6419, 6420, 6422, 6428, 6429, 6430, 6431, 6434,
6436, 6437, 6440, 6442, 6450, 6452, 6454, 6458, 6459, 6463,
6464, 6465, 6466, 6467, 6468, 6469, 6470, 6471, 6474, 6476,
6477, 6478, 6480, 6482, 6484, 6486, 6488, 6493, 6495, 6500,
6501, 6502, 6504, 6505, 6510, 6513, 6514, 6516, 6517, 6519,
6524, 6525, 6526, 6530, 6533, 6534, 6537, 6539, 6543, 6544,
6545, 6547, 6548, 6549, 6554, 6555, 6558, 6560, 6561, 6563,
6567, 6569, 6572, 6574, 6576, 6577, 6579, 6581, 6582, 6584,
6587, 6588, 6589, 6595, 6597, 6598, 6599, 6600, 6607, 6611,
6614, 6620, 6621, 6624, 6625, 6626, 6627, 6628, 6630, 6634,
6635, 6637, 6638, 6639, 6643, 6644, 6649, 6652, 6655, 6656,
6658, 6662, 6666, 6671, 6677, 6681, 6686, 6691, 6692, 6695,
6696, 6699, 6702, 6703, 6704, 6705, 6706, 6711, 6714, 6716, 6718, 6720, 6724, 6725, 6729, 6734, 6736, 6737, 6739, 6746, 6747, 6752, 6756, 6757, 6758, 6759, 6761, 6764, 6766, 6778, 6779, 6780, 6786, 6788, 6789, 6792, 6793, 6794, 6797, 6799, 6803, 6804, 6805, 6807, 6808, 6810, 6811, 6812, 6813, 6816, 6819, 6820, 6821, 6824, 6827, 6828, 6830, 6831, 6834, 6836, 6837, 6839, 6840, 6841, 6842, 6843, 6845, 6851, 6852, 6859, 6860, 6863, 6864, 6869, 6872, 6874, 6875, 6876, 6878, 6879, 6880, 6884, 6885, 6886, 6888, 6890, 6897, 6903, 6904, 6909, 6913, 6914, 6915, 6917, 6919, 6921, 6923, 6924, 6930, 6933, 6936, 6941, 6943, 6946, 6948, 6950, 6952, 6959, 6960, 6963, 6967, 6969, 6970, 6979, 6980, 6984, 6985, 6987, 6988, 6990, 6991, 6993, 6994, 6995, 6997, 7003, 7005, 7006, 7009, 7011, 7012, 7013, 7015, 7022, 7038, 7039, 7042, 7043, 7045, 7046, 7048, 7051, 7052, 7053, 7056, 7057, 7064, 7067, 7072, 7074, 7075, 7077, 7083, 7084, 7085, 7086, 7097, 7105, 7106, 7107, 7108, 7109, 7112, 7113, 7116, 7117, 7118, 7124, 7130, 7132, 7135, 7140, 7142, 7144, 7149, 7155, 7163, 7164, 7165, 7166, 7169, 7173, 7176, 7177, 7183, 7184, 7187, 7188, 7192, 7194, 7196, 7201, 7202, 7203, 7206, 7207, 7208, 7211, 7212, 7216, 7217, 7219, 7220, 7227, 7228, 7230, 7231, 7232, 7233, 7234, 7235, 7236, 7239, 7240, 7241, 7243, 7244, 7245, 7248, 7255, 7257, 7258, 7259, 7267, 7268, 7274, 7276, 7277, 7278, 7281, 7282, 7284, 7287, 7288, 7290, 7291, 7292, 7293, 7298, 7299, 7300, 7301, 7303, 7304, 7305, 7306, 7307, 7308, 7310, 7313, 7315, 7317, 7321, 7328, 7330, 7334, 7336, 7340, 7344, 7354, 7355, 7356, 7357, 7358, 7360, 7363, 7365, 7371, 7373, 7379, 7380, 7381, 7382, 7383, 7386, 7388, 7389, 7392, 7396, 7398, 7399, 7409, 7411, 7417, 7418, 7425, 7428, 7430, 7434, 7435, 7436, 7441, 7443, 7444, 7446, 7447, 7448, 7452, 7454, 7458, 7459, 7464, 7466, 7470, 7472, 7486, 7487, 7490, 7492, 7493, 7498, 7502, 7504, 7505, 7506, 7508, 7512, 7514, 7515, 7517, 7523, 7524, 7525, 7528, 7533, 7534, 7538, 7546, 7547, 7548, 7554, 7556, 7557, 7561, 7570, 7572, 7574, 7577, 7578, 7579, 7580, 7585, 7586, 7590, 7591, 7593, 7594, 7595, 7598, 7605, 7611, 7613, 7619, 7620, 7621, 7623, 7624, 7629, 7633, 7634, 7638, 7639, 7640, 7642, 7652, 7658, 7661, 7663, 7664, 7665, 7666, 7667, 7674, 7676, 7677, 7678, 7679, 7680, 7682, 7685, 7687, 7689, 7693, 7695, 7699, 7703, 7704, 7708, 7712, 7716, 7717, 7718, 7719, 7724, 7725, 7726, 7729, 7733, 7736, 7737, 7738, 7740, 7743, 7744, 7745, 7751, 7753, 7761, 7762, 7763, 7764, 7767, 7768, 7769, 7770, 7774, 7775, 7777, 7778, 7779, 7780, 7782, 7785, 7786, 7788, 7791, 7792, 7793, 7798, 7800, 7803, 7804, 7806, 7807, 7811, 7812, 7815, 7818, 7819, 7820, 7823, 7824, 7825, 7832, 7833, 7834, 7838, 7841, 7844, 7845, 7847, 7848, 7849, 7850, 7856, 7858, 7859, 7860, 7862, 7863, 7865, 7873, 7876, 7878, 7880, 7884, 7888, 7890, 7896, 7900, 7908, 7909, 7910, 7911, 7917, 7918, 7921, 7922, 7923, 7925, 7929, 7933, 7934, 7935, 7936, 7937, 7938, 7942, 7944, 7945, 7946, 7947, 7948, 7949, 7950, 7951, 7952, 7955, 7956, 7964, 7971, 7972, 7974, 7976, 7977, 7978, 7980, 7981, 7983, 7984, 7986, 7988, 7989, 7990, 7991, 7993, 7998, 8002, 8004, 8006, 8007, 8008, 8009, 8012, 8021, 8026, 8029, 8038, 8039, 8042, 8044, 8047, 8048, 8052, 8053, 8056, 8058, 8059, 8063, 8067, 8068, 8071, 8072, 8075, 8076, 8077, 8078, 8080, 8082, 8084, 8088, 8091, 8093, 8095, 8096, 8099, 8100, 8102, 8103, 8105, 8112, 8115, 8116, 8118, 8120, 8121, 8123, 8124, 8126, 8134, 8136, 8137, 8145, 8146, 8147, 8150, 8151, 8159, 8162, 8163, 8165, 8166, 8168, 8170, 8176, 8178, 8179, 8182, 8189, 8192, 8193, 8195, 8199, 8202, 8204, 8207, 8208, 8211, 8213, 8216, 8217, 8219, 8220, 8223, 8225, 8227, 8231, 8234, 8235, 8236, 8237, 8239, 8242, 8245, 8249, 8250, 8252, 8253, 8257, 8258, 8265, 8266, 8268, 8269, 8270, 8272, 8282, 8289, 8291, 8293, 8294, 8297, 8300, 8301, 8304, 8306, 8310, 8311, 8312, 8315, 8318, 8319, 8320, 8321, 8329, 8339, 8340, 8349, 8350, 8352, 8353, 8355, 8361, 8363, 8367, 8368, 8369, 8373, 8379, 8385, 8386, 8387, 8389, 8390, 8392, 8393, 8395, 8398, 8401, 8402, 8403, 8404, 8407, 8409, 8410, 8413, 8414, 8416, 8423, 8427, 8430, 8433, 8436, 8438, 8439, 8441, 8442, 8444, 8446, 8447, 8448, 8449, 8450, 8451, 8452, 8456, 8458, 8459, 8460, 8463, 8466, 8470, 8472, 8473, 8474, 8476, 8477, 8480, 8481, 8482, 8483, 8485, 8486, 8490, 8493, 8494, 8498, 8501, 8505, 8509, 8511, 8513, 8515, 8517, 8520, 8523, 8524, 8525, 8528, 8531, 8532, 8533, 8535, 8537, 8538, 8539, 8542, 8549, 8550, 8552, 8553, 8554, 8557, 8558, 8561, 8562, 8565, 8566, 8568, 8575, 8576, 8579, 8581, 8582, 8589, 8590, 8592, 8593, 8594, 8596, 8597, 8599, 8600, 8601, 8603, 8604, 8605, 8607, 8610, 8611, 8612, 8613, 8614, 8617, 8618, 8624, 8631, 8634, 8635, 8637, 8638, 8640, 8642, 8644, 8648, 8650, 8654, 8657, 8658, 8659, 8660, 8665, 8669, 8670, 8672, 8675, 8676, 8677, 8685, 8693, 8699, 8700, 8703, 8704, 8706, 8708, 8709, 8712, 8713, 8716, 8717, 8720, 8726, 8727, 8729, 8731, 8732, 8734, 8735, 8736, 8741, 8742, 8743, 8744, 8746, 8748, 8751, 8752, 8753, 8757, 8761, 8764, 8766, 8767, 8770, 8772, 8773, 8775, 8776, 8777, 8779, 8782, 8783, 8784, 8789, 8792, 8797, 8803, 8805, 8810, 8818, 8821, 8822, 8824, 8829, 8831, 8832, 8834, 8835, 8838, 8841, 8843, 8846, 8853, 8854, 8859, 8861, 8865, 8867, 8876, 8877, 8878, 8881, 8883, 8886, 8888, 8891, 8892, 8896, 8899, 8900, 8902, 8905, 8907, 8908, 8909, 8910, 8911, 8913, 8914, 8916, 8917, 8924, 8926, 8929, 8930, 8935, 8938, 8941, 8942, 8945, 8946, 8949, 8951, 8956, 8957, 8960, 8967, 8968, 8969, 8972, 8974, 8976, 8977, 8979, 8980, 8981, 8985, 8986, 8991, 8992, 8996, 8998, 8999, 9001, 9002, 9003, 9006, 9009, 9012, 9015, 9018, 9020, 9021, 9029, 9030, 9033, 9037, 9042, 9044, 9047, 9052, 9056, 9057, 9058, 9059, 9060, 9061, 9062, 9066, 9069, 9071, 9072, 9073, 9074, 9076, 9080, 9084, 9088, 9091, 9092, 9095, 9096, 9098, 9108, 9110, 9111, 9112, 9114, 9115, 9118, 9119, 9123, 9124, 9125, 9128, 9129, 9133, 9134, 9136, 9138, 9139, 9140, 9141, 9142, 9149, 9151, 9154, 9155, 9156, 9167, 9168, 9173, 9174, 9175, 9177, 9183, 9185, 9187, 9188, 9190, 9191, 9195, 9200, 9205, 9206, 9207, 9210, 9211, 9213, 9214, 9215, 9216, 9218, 9223, 9226, 9229, 9233, 9237, 9241, 9242, 9243, 9247, 9249, 9252, 9253, 9254, 9255, 9257, 9263, 9265, 9267, 9270, 9273, 9276, 9282, 9284, 9285, 9287, 9288, 9290, 9292, 9293, 9299, 9300, 9304, 9308, 9311, 9314, 9316, 9320, 9323, 9325, 9326, 9327, 9328, 9329, 9330, 9333, 9336, 9337, 9338, 9339, 9340, 9341, 9345, 9346, 9347, 9348, 9353, 9354, 9355, 9359, 9366, 9367, 9373, 9375, 9376, 9378, 9382, 9383, 9388, 9391, 9392, 9393, 9394, 9396, 9400, 9402, 9403, 9404, 9406, 9407, 9413, 9415, 9423, 9432, 9433, 9434, 9440, 9442, 9443, 9444, 9449, 9451, 9452, 9456, 9460, 9468, 9471, 9472, 9473, 9475, 9478, 9483, 9488, 9490, 9497, 9500, 9501, 9502, 9503, 9504, 9505, 9509, 9513, 9514, 9515, 9517, 9518, 9519, 9522, 9531, 9532, 9533, 9534, 9536, 9540, 9543, 9545, 9546, 9548, 9549, 9553, 9555, 9563, 9565, 9568, 9571, 9575, 9577, 9582, 9583, 9587, 9589, 9590, 9591, 9596, 9597, 9602, 9606, 9609, 9610, 9613, 9615, 9618, 9620, 9623, 9626, 9627, 9628, 9629, 9632, 9633, 9635, 9641, 9642, 9644, 9645, 9646, 9648, 9649, 9652, 9653, 9655, 9657, 9658, 9659, 9660, 9663, 9666, 9668, 9670, 9675, 9679, 9681, 9682, 9686, 9687, 9692, 9693, 9698, 9699, 9706, 9707, 9718, 9723, 9726, 9729, 9730, 9731, 9733, 9734, 9737, 9746, 9750, 9751, 9753, 9754, 9755, 9756, 9763, 9764, 9767, 9768, 9770, 9776, 9780, 9781, 9782, 9784, 9786, 9791, 9792, 9793, 9794, 9796, 9799, 9801, 9802, 9808, 9809, 9812, 9813, 9816, 9819, 9820, 9824, 9825, 9826, 9827, 9829, 9830, 9833, 9835, 9836, 9845, 9846, 9847, 9849, 9850, 9851, 9853, 9854, 9861, 9864, 9866, 9869, 9871, 9873, 9882, 9886, 9887, 9892, 9897, 9900, 9901, 9906, 9907, 9908, 9909, 9910, 9912, 9923, 9924, 9928, 9930, 9935, 9938, 9940, 9944, 9946, 9947, 9949, 9950, 9953, 9955, 9957, 9958, 9960, 9962, 9963, 9964, 9967, 9968, 9971, 9972, 9974, 9979, 9980, 9982, 9984, 9985, 9987, 9988, 9990, 9991, 9996, 9997, 9998, 10000, 10008, 10009, 10010, 10012, 10013, 10015, 10017, 10019, 10021, 10022, 10026, 10031, 10032, 10033, 10034, 10035, 10038, 10041, 10043, 10045, 10048, 10051, 10052, 10054, 10056, 10058, 10059, 10060, 10062, 10063, 10064, 10068, 10073, 10075, 10077, 10078, 10080, 10081, 10083, 10089, 10091, 10092, 10095, 10097, 10101, 10102, 10103, 10105, 10106, 10107, 10108, 10109, 10110, 10112, 10114, 10115, 10116, 10118, 10122, 10127, 10128, 10131, 10132, 10136, 10141, 10143, 10146, 10149, 10151, 10152, 10158, 10162, 10163, 10165, 10166, 10168, 10170, 10174, 10176, 10178, 10181, 10182, 10191, 10192, 10193, 10194, 10195, 10197, 10199, 10203, 10206, 10209, 10212, 10218, 10219, 10220, 10222, 10223, 10225, 10228, 10231, 10232, 10233, 10236, 10237, 10239, 10247, 10252, 10255, 10258, 10259, 10260, 10270, 10275, 10284, 10286, 10291, 10292, 10293, 10295, 10300, 10302, 10306, 10307, 10311, 10318, 10321, 10323, 10325, 10326, 10328, 10330, 10331, 10333, 10334, 10335, 10336, 10343, 10344, 10346, 10352, 10353, 10356, 10357, 10359, 10360, 10362, 10364, 10368, 10371, 10373, 10375, 10376, 10378, 10380, 10381, 10384, 10385, 10388, 10389, 10395, 10397, 10398, 10399, 10400, 10401, 10405, 10408, 10410, 10413, 10414, 10416, 10421, 10422, 10423, 10426, 10427, 10428, 10430, 10435, 10437, 10438, 10440, 10442, 10443, 10446, 10447, 10449, 10450, 10451, 10453, 10456, 10463, 10464, 10465, 10468, 10469, 10470, 10474, 10478, 10482, 10487, 10488, 10490, 10492, 10494, 10496, 10504, 10506, 10508, 10513, 10514, 10515, 10518, 10521, 10525, 10527, 10528, 10530, 10531, 10533, 10535, 10536, 10537, 10541, 10542, 10543, 10544, 10547, 10548, 10549, 10550, 10551, 10555, 10556, 10558, 10560, 10561, 10564, 10565, 10567, 10569, 10571, 10573, 10580, 10581, 10582, 10583, 10585, 10590, 10593, 10596, 10597, 10599, 10601, 10602, 10610, 10611, 10613, 10614, 10615, 10616, 10617, 10619, 10621, 10622, 10623, 10626, 10628, 10634, 10636, 10637, 10638, 10639, 10640, 10641, 10642, 10643, 10645, 10646, 10648, 10649, 10650, 10655, 10657, 10659, 10660, 10663, 10665, 10666, 10668, 10670, 10673, 10674, 10676, 10678, 10681, 10682, 10683, 10684, 10685, 10687, 10697, 10698, 10699, 10700, 10702, 10703, 10705, 10707, 10708, 10711, 10712, 10715, 10716, 10721, 10722, 10723, 10725, 10726, 10732, 10734, 10735, 10738, 10740, 10741, 10744, 10745, 10748, 10749, 10752, 10753, 10761, 10762, 10763, 10766, 10774, 10775, 10776, 10778, 10779, 10782, 10784, 10785, 10787, 10788, 10790, 10791, 10792, 10795, 10796, 10798, 10800, 10801, 10803, 10804, 10805, 10809, 10810, 10811, 10813, 10818, 10819, 10820, 10821, 10824, 10825, 10826, 10831, 10833, 10836, 10838, 10839, 10840, 10841, 10843, 10846, 10850, 10853, 10854, 10857, 10858, 10860, 10861, 10862, 10866, 10867, 10871, 10872, 10874, 10877, 10880, 10881, 10892, 10896, 10897, 10898, 10899, 10902, 10905, 10912, 10917, 10920, 10926, 10927, 10930, 10933, 10934, 10935, 10936, 10937, 10938, 10940, 10941, 10944, 10947, 10948, 10950, 10954, 10957, 10960, 10962, 10965, 10967, 10970, 10972, 10975, 10976, 10977, 10979, 10980, 10981, 10985, 10988, 10993, 10995, 10996, 10997, 10999, 11002, 11004, 11005, 11006, 11008, 11010, 11015, 11016, 11018, 11024, 11026, 11027, 11032, 11033, 11039, 11046, 11047, 11053, 11056, 11058, 11060, 11061, 11066, 11068, 11070, 11071, 11072, 11078, 11080, 11082, 11083, 11086, 11090, 11092, 11095, 11098, 11101, 11102, 11105, 11107, 11108, 11110, 11114, 11116, 11118, 11119, 11123, 11124, 11125, 11126, 11127, 11129, 11132, 11135, 11137, 11138, 11145, 11146, 11148, 11153, 11154, 11158, 11159, 11160, 11161, 11162, 11163, 11165, 11166, 11168, 11169, 11171, 11175, 11177, 11178, 11179, 11180, 11184, 11185, 11187, 11188, 11190, 11192, 11194, 11198, 11199, 11201, 11204, 11207, 11210, 11214, 11217, 11218, 11222, 11224, 11226, 11227, 11228, 11229, 11232, 11233, 11234, 11235, 11236, 11237, 11238, 11239, 11244, 11246, 11247, 11248, 11251, 11254, 11255, 11256, 11257, 11258, 11259, 11260, 11262, 11263, 11264, 11266, 11274, 11275, 11278, 11288, 11289, 11290, 11291, 11292, 11293, 11294, 11295, 11298, 11305, 11306, 11307, 11313, 11315, 11316, 11318, 11319, 11320, 11322, 11324, 11326, 11329, 11330, 11331, 11332, 11337, 11338, 11339, 11340, 11345, 11346, 11348, 11349, 11352, 11356, 11358, 11363, 11364, 11365, 11370, 11371, 11373, 11377, 11379, 11380, 11381, 11382, 11385, 11387, 11388, 11389, 11391, 11392, 11394, 11395, 11397, 11401, 11403, 11404, 11405, 11406, 11409, 11410, 11411, 11412, 11413, 11414, 11416, 11418, 11423, 11428, 11430, 11431, 11434, 11437, 11438, 11449, 11451, 11456, 11459, 11463, 11465, 11466, 11467, 11471, 11472, 11473, 11475, 11476, 11478, 11481, 11482, 11487, 11490, 11492, 11496, 11497, 11498, 11500, 11501, 11506, 11507, 11508, 11509, 11512, 11513, 11516, 11518, 11520, 11523, 11524, 11526, 11527, 11528, 11530, 11531, 11532, 11533, 11534, 11538, 11541, 11544, 11546, 11548, 11551, 11553, 11558, 11560, 11561, 11567, 11571, 11574, 11576, 11577, 11578, 11579, 11580, 11583, 11585, 11586, 11589, 11593, 11594, 11595, 11596, 11597, 11599, 11604, 11610, 11615, 11618, 11620, 11621, 11623, 11625, 11628, 11629, 11632, 11633, 11636, 11639, 11642, 11649, 11650, 11655, 11656, 11657, 11658, 11669, 11673, 11678, 11681, 11682, 11683, 11688, 11691, 11692, 11693, 11694, 11695, 11701, 11703, 11705, 11707, 11711, 11712, 11718, 11720, 11721, 11722, 11725, 11726, 11730, 11731, 11733, 11735, 11736, 11740, 11743, 11744, 11753, 11755, 11756, 11759, 11760, 11761, 11762, 11763, 11765, 11770, 11771, 11776, 11780, 11781, 11782, 11783, 11784, 11785, 11786, 11790, 11792, 11795, 11799, 11800, 11809, 11811, 11812, 11813, 11814, 11816, 11818, 11819, 11825, 11826, 11828, 11829, 11830, 11837, 11841, 11846, 11848, 11849, 11850, 11851, 11853, 11856, 11858, 11863, 11868, 11870, 11872, 11876, 11877, 11881, 11890, 11891, 11894, 11898, 11899, 11903, 11904, 11909, 11911, 11913, 11916, 11917, 11919, 11920, 11921, 11923, 11926, 11928, 11929, 11930, 11934, 11935, 11940, 11941, 11943, 11946, 11947, 11948, 11949, 11953, 11955, 11957, 11958, 11959, 11960, 11961, 11962, 11963, 11965, 11966, 11968, 11974, 11977, 11978, 11979, 11980, 11983, 11988, 11993, 11994, 11995, 11996, 11997, 11998, 11999, 12002, 12004, 12006, 12014, 12017, 12019, 12020, 12021, 12023, 12024, 12025, 12029, 12032, 12042, 12043, 12044, 12047, 12050, 12051, 12054, 12059, 12060, 12061, 12063, 12064, 12068, 12076, 12078, 12079, 12080, 12081, 12083, 12086, 12087, 12091, 12092, 12093, 12097, 12098, 12102, 12104, 12106, 12109, 12110, 12112, 12115, 12118, 12120, 12122, 12126, 12128, 12129, 12131, 12134, 12135, 12137, 12138, 12139, 12141, 12142, 12143, 12144, 12145, 12146, 12147, 12148, 12151, 12153, 12155, 12161, 12162, 12165, 12166, 12167, 12170, 12171, 12174, 12175, 12179, 12181, 12186, 12197, 12202, 12204, 12208, 12212, 12214, 12215, 12217, 12220, 12223, 12228, 12229, 12230, 12233, 12234, 12237, 12240, 12241, 12243, 12245, 12246, 12250, 12252, 12253, 12254, 12255, 12256, 12259, 12268, 12269, 12271, 12278, 12280, 12283, 12284, 12285, 12286, 12287, 12288, 12295, 12296, 12299, 12304, 12310, 12311, 12312, 12313, 12314, 12315, 12317, 12319, 12321, 12323, 12325, 12331, 12334, 12335, 12337, 12339, 12342, 12343, 12345, 12347, 12350, 12354, 12356, 12358, 12359, 12364, 12366, 12369, 12370, 12374, 12375, 12376, 12379, 12381, 12385, 12390, 12393, 12394, 12397, 12400, 12401, 12403, 12404, 12406, 12411, 12414, 12415, 12416, 12419, 12420, 12423, 12424, 12426, 12427, 12437, 12440, 12441, 12444, 12445, 12450, 12451, 12455, 12456, 12457, 12459, 12461, 12462, 12465, 12467, 12468, 12470, 12472, 12473, 12478, 12479, 12481, 12485, 12488, 12492, 12494, 12497, 12499, 12501, 12502, 12503, 12508, 12512, 12513, 12514, 12515, 12518, 12529, 12530, 12531, 12535, 12536, 12537, 12538, 12539, 12540, 12546, 12547, 12549, 12551, 12552, 12554, 12555, 12556, 12557, 12561, 12563, 12565, 12567, 12568, 12570, 12572, 12577, 12578, 12580, 12583, 12584, 12585, 12586, 12588, 12591, 12600, 12603, 12604, 12605, 12608, 12609, 12610, 12611, 12616, 12620, 12622, 12623, 12626, 12628, 12629, 12634, 12638, 12639, 12640, 12641, 12644, 12648, 12649, 12651, 12652, 12653, 12655, 12663, 12664, 12668, 12670, 12671, 12674, 12677, 12679, 12681, 12683, 12684, 12685, 12688, 12689, 12691, 12693, 12695, 12696, 12697, 12699, 12701, 12702, 12705, 12706, 12707, 12708, 12713, 12714, 12723, 12726, 12729, 12731, 12732, 12733, 12735, 12737, 12738, 12739, 12740, 12741, 12742, 12744, 12752, 12753, 12754, 12755, 12757, 12758, 12760, 12761, 12762, 12764, 12765, 12766, 12771, 12772, 12773, 12775, 12777, 12782, 12783, 12790, 12791, 12797, 12800, 12802, 12803, 12804, 12807, 12810, 12812, 12813, 12817, 12818, 12820, 12822, 12823, 12824, 12827, 12828, 12834, 12835, 12836, 12837, 12838, 12839, 12843, 12844, 12848, 12849, 12850, 12853, 12860, 12861, 12866, 12870, 12873, 12875, 12878, 12882, 12883, 12887, 12891, 12895, 12898, 12899, 12900, 12901, 12903, 12904, 12905, 12906, 12908, 12910, 12912, 12916, 12921, 12923, 12928, 12929, 12932, 12933, 12934, 12935, 12938, 12945, 12946, 12947, 12950, 12952, 12953, 12956, 12958, 12960, 12961, 12963, 12967, 12968, 12969, 12973, 12978, 12983, 12984, 12986, 12987, 12988, 12989, 12990, 12991, 12999, 13001, 13003, 13004, 13006, 13007, 13010, 13014, 13015, 13017, 13018, 13022, 13027, 13030, 13031, 13033, 13034, 13035, 13038, 13040, 13041, 13047, 13049, 13050, 13053, 13054, 13055, 13056, 13061, 13062, 13064, 13066, 13067, 13071, 13075, 13077, 13079, 13083, 13085, 13086, 13087, 13097, 13099, 13101, 13102, 13105, 13106, 13110, 13111, 13112, 13114, 13115, 13117, 13118, 13120, 13121, 13122, 13123, 13124, 13125, 13127, 13128, 13131, 13134, 13136, 13144, 13147, 13148, 13149, 13151, 13154, 13159, 13160, 13169, 13170, 13175, 13180, 13181, 13182, 13186, 13190, 13197, 13198, 13199, 13206, 13209, 13210, 13212, 13213, 13215, 13217, 13220, 13221, 13224, 13227, 13228, 13232, 13234, 13235, 13236, 13237, 13239, 13241, 13248, 13250, 13251, 13255, 13256, 13259, 13260, 13261, 13262, 13263, 13264, 13265, 13267, 13268, 13269, 13271, 13274, 13281, 13296, 13297, 13298, 13300, 13301, 13303, 13304, 13313, 13315, 13316, 13317, 13329, 13332, 13340, 13343, 13345, 13346, 13347, 13348, 13350, 13351, 13352, 13358, 13361, 13363, 13365, 13367, 13368, 13369, 13370, 13374, 13377, 13380, 13381, 13384, 13385, 13386, 13388, 13391, 13393, 13394, 13395, 13396, 13397, 13403, 13407, 13408, 13410, 13416, 13417, 13418, 13419, 13420, 13423, 13424, 13429, 13430, 13433, 13439, 13441, 13444, 13448, 13451, 13456, 13463, 13464, 13467, 13469, 13473, 13475, 13477, 13478, 13479, 13480, 13489, 13491, 13492, 13494, 13496, 13499, 13503, 13504, 13513, 13514, 13515, 13516, 13518, 13519, 13521, 13522, 13526, 13532, 13533, 13539, 13540, 13543, 13544, 13546, 13547, 13549, 13551, 13552, 13553, 13555, 13558, 13559, 13560, 13561, 13568, 13569, 13572, 13574, 13577, 13578, 13580, 13584, 13587, 13597, 13598, 13599, 13600, 13601, 13602, 13604, 13605, 13612, 13613, 13616, 13620, 13621, 13623, 13628, 13630, 13631, 13632, 13634, 13636, 13637, 13638, 13639, 13641, 13643, 13647, 13651, 13652, 13653, 13654, 13662, 13663, 13665, 13668, 13675, 13677, 13678, 13679, 13683, 13687, 13688, 13689, 13697, 13698, 13699, 13700, 13702, 13706, 13710, 13713, 13714, 13715, 13716, 13719, 13720, 13722, 13727, 13729, 13730, 13736, 13739, 13742, 13745, 13747, 13750, 13753, 13756, 13764, 13766, 13767, 13768, 13772, 13773, 13775, 13777, 13779, 13780, 13782, 13783, 13785, 13786, 13787, 13791, 13793, 13796, 13798, 13809, 13816, 13817, 13818, 13819, 13820, 13822, 13823, 13828, 13830, 13834, 13835, 13843, 13849, 13852, 13853, 13858, 13859, 13866, 13869, 13870, 13872, 13873, 13874, 13875, 13877, 13885, 13887, 13888, 13891, 13892, 13895, 13897, 13898, 13899, 13901, 13906, 13908, 13909, 13910, 13911, 13917, 13918, 13919, 13920, 13924, 13927, 13929, 13932, 13934, 13947, 13949, 13950, 13953, 13954, 13958, 13960, 13961, 13963, 13969, 13970, 13971, 13974, 13975, 13984, 13986, 13987, 13990, 13991, 13999, 14000, 14001, 14005, 14006, 14009, 14014, 14017, 14018, 14022, 14027, 14030, 14031, 14036, 14038, 14040, 14049, 14051, 14052, 14059, 14062, 14063, 14066, 14067, 14069, 14070, 14071, 14073, 14075, 14076, 14078, 14080, 14081, 14085, 14086, 14087, 14088, 14092, 14094, 14096, 14111, 14112, 14116, 14118, 14119, 14121, 14122, 14124, 14129, 14130, 14132, 14133, 14135, 14137, 14138, 14139, 14140, 14141, 14142, 14145, 14146, 14147.

Promoters expressing in the embryo at 40 days after pollination include SEQ IDs: 3, 7, 12, 14, 15, 16, 27, 29, 31, 33, 34, 36, 37, 44, 48, 54, 56, 57, 63, 64, 65, 79, 80, 86, 88, 90, 93, 94, 96, 98, 99, 100, 102, 103, 104, 105, 110, 111, 112, 117, 121, 123, 126, 128, 129, 130, 131, 137, 143, 144, 146, 148, 152, 154, 156, 157, 159, 162, 168, 172, 174, 175, 176, 179, 181, 183, 187, 188, 191, 193, 194, 196, 199, 202, 203, 205, 207, 210, 211, 212, 214, 223, 230, 232, 235, 236, 237, 240, 242, 244, 246, 249, 250, 251, 257, 259, 264, 267, 269, 270, 271, 273, 286, 288, 293, 294, 298, 301, 302, 303, 305, 306, 308, 309, 314, 316, 319, 320, 322, 323, 328, 329, 332, 335, 337, 338, 340, 346, 349, 352, 353, 354, 356, 358, 360, 364, 365, 367, 371, 372, 373, 376, 379, 381, 388, 396, 401, 404, 411, 412, 414, 416, 423, 428, 429, 431, 432, 433, 434, 436, 441, 448, 450, 452, 454, 456, 458, 459, 461, 463, 466, 468, 470, 471, 474, 478, 482, 483, 485, 488, 489, 496, 501, 502, 504, 505, 507, 509, 510, 511, 514, 515, 516, 517, 522, 523, 525, 532, 536, 537, 538, 541, 542, 543, 544, 546, 547, 548, 553, 554, 555, 557, 561, 563, 578, 580, 585, 591, 594, 595, 596, 599, 605, 606, 607, 608, 609, 611, 613, 614, 619, 620, 626, 630, 631, 633, 635, 636, 637, 638, 643, 647, 661, 663, 664, 665, 669, 670, 671, 681, 683, 684, 687, 693, 694, 695, 701, 702, 705, 706, 709, 716, 717, 718, 719, 721, 722, 723, 724, 727, 731, 732, 733, 734, 736, 739, 740, 742, 744, 749, 753, 757, 759, 764, 765, 779, 781, 783, 784, 792, 793, 800, 804, 806, 808, 809, 811, 812, 819, 820, 821, 822, 824, 825, 826, 829, 830, 833, 840, 841, 844, 846, 849, 855, 856, 857, 858, 859, 862, 863, 865, 870, 871, 873, 875, 876, 877, 878, 887, 890, 891, 892, 893, 895, 897, 898, 899, 900, 903, 907, 908, 910, 911, 912, 915, 916, 919, 920, 924, 928, 929, 931, 932, 934, 936, 938, 939, 943, 947, 949, 951, 953, 955, 958, 960, 964, 971, 974, 975, 976, 977, 978, 979, 980, 982, 984, 985, 987, 991, 994, 995, 996, 997, 999, 1005, 1007, 1008, 1009, 1010, 1011, 1012, 1013, 1014, 1016, 1017, 1019, 1021, 1022, 1025, 1026, 1032, 1033, 1035, 1038, 1039, 1041, 1042, 1043, 1046, 1047, 1049, 1051, 1052, 1055, 1056, 1057, 1064, 1065, 1069, 1070, 1076, 1077, 1085, 1086, 1087, 1089, 1092, 1095, 1100, 1101, 1103, 1104, 1110, 1112, 1114, 1115, 1116, 1117, 1119, 1121, 1125, 1127, 1130, 1132, 1136, 1137, 1140, 1143, 1144, 1146, 1148, 1153, 1155, 1160, 1161, 1164, 1165, 1167, 1168, 1170, 1171, 1174, 1176, 1178, 1183, 1187, 1191, 1196, 1200, 1201, 1204, 1205, 1213, 1214, 1215, 1217, 1218, 1220, 1222, 1223, 1225, 1227, 1228, 1229, 1230, 1232, 1236, 1240, 1244, 1248, 1249, 1250, 1251, 1252, 1254, 1257, 1258, 1261, 1262, 1263, 1269, 1272, 1281, 1285, 1286, 1290, 1292, 1293, 1296, 1306, 1307, 1309, 1310, 1311, 1312, 1314, 1316, 1320, 1321, 1322, 1323, 1327, 1330, 1331, 1334, 1337, 1339, 1344, 1345, 1347, 1349, 1354, 1355, 1358, 1360, 1361, 1363, 1364, 1366, 1368, 1371, 1375, 1376, 1377, 1380, 1381, 1387, 1388, 1389, 1391, 1393, 1394, 1396, 1399, 1402, 1404, 1405, 1412, 1415, 1420, 1421, 1423, 1426, 1431, 1432, 1433, 1437, 1440, 1441, 1442, 1447, 1448, 1451, 1453, 1458, 1459, 1461, 1466, 1471, 1472, 1475, 1484, 1488, 1490, 1491, 1493, 1497, 1499, 1501, 1503, 1506, 1508, 1510, 1511, 1512, 1514, 1518, 1519, 1527, 1528, 1530, 1539, 1543, 1545, 1548, 1549, 1550, 1551, 1554, 1555, 1556, 1561, 1564, 1567, 1570, 1575, 1578, 1584, 1585, 1586, 1590, 1591, 1596, 1597, 1598, 1599, 1600, 1601, 1602, 1604, 1605, 1608, 1609, 1610, 1612, 1614, 1615, 1616, 1623, 1625, 1634, 1635, 1636, 1637, 1638, 1641, 1642, 1643, 1650, 1651, 1653, 1654, 1658, 1659, 1662, 1663, 1669, 1671, 1673, 1675, 1676, 1678, 1681, 1682, 1684, 1685, 1687, 1688, 1689, 1690, 1691, 1696, 1697, 1698, 1699, 1705, 1706, 1707, 1708, 1709, 1710, 1712, 1716, 1717, 1718, 1720, 1725, 1732, 1735, 1749, 1750, 1755, 1759, 1761, 1764, 1769, 1770, 1773, 1774, 1776, 1777, 1785, 1786, 1791, 1792, 1798, 1807, 1808, 1809, 1811, 1813, 1814, 1826, 1828, 1830, 1832, 1834, 1835, 1837, 1839, 1840, 1845, 1848, 1851, 1852, 1859, 1861, 1863, 1866, 1868, 1869, 1872, 1873, 1876, 1879, 1880, 1882, 1886, 1888, 1891, 1893, 1897, 1898, 1899, 1900, 1901, 1902, 1903, 1905, 1906, 1910, 1911, 1913, 1914, 1915, 1916, 1918, 1920, 1922, 1923, 1924, 1928, 1930, 1931, 1933, 1934, 1936, 1939, 1940, 1945, 1950, 1951, 1952, 1953, 1954, 1958, 1964, 1968, 1969, 1970, 1971, 1972, 1973, 1977, 1979, 1990, 1991, 1993, 1999, 2000, 2001, 2007, 2009, 2010, 2012, 2014, 2015, 2019, 2021, 2026, 2031, 2032, 2037, 2040, 2041, 2043, 2048, 2060, 2062, 2064, 2066, 2071, 2074, 2077, 2078, 2088, 2089, 2091, 2092, 2093, 2094, 2097, 2099, 2103, 104, 2106, 2107, 2111, 2112, 2114, 2122, 2123, 2125, 2126, 2133, 2134, 2137, 2139, 2140, 2141, 2142, 2143, 2146, 2147, 2150, 2151, 2156, 2157, 2158, 2159, 2161, 2162, 2164, 2166, 2167, 2168, 2170, 2172, 2175, 2177, 2178, 2179, 2183, 2185, 2189, 2193, 2196, 2200, 2202, 2203, 2206, 2207, 2210, 2214, 2215, 2218, 2221, 2223, 2227, 2240, 2241, 2242, 2243, 2244, 2253, 2257, 2259, 2260, 2263, 2266, 2267, 2274, 2276, 2278, 2280, 2282, 2283, 2284, 2288, 2291, 2293, 2296, 2297, 2298, 2300, 2303, 2304, 2305, 2306, 2308, 2309, 2310, 2313, 2314, 2322, 2323, 2325, 2328, 2329, 2331, 2337, 2339, 2342, 2343, 2352, 2353, 2358, 2359, 2363, 2366, 2371, 2372, 2379, 2380, 2381, 2382, 2383, 2384, 2397, 2401, 2405, 2410, 2413, 2414, 2416, 2417, 2418, 2419, 2420, 2423, 2430, 2431, 2432, 2433, 2434, 2435, 2437, 2439, 2440, 2441, 2442, 2443, 2445, 2451, 2452, 2453, 2454, 2456, 2457, 2458, 2465, 2469, 2470, 2472, 2474, 2476, 2477, 2480, 2481, 2482, 2485, 2487, 2489, 2490, 2493, 2494, 2495, 2496, 2498, 2500, 2505, 2506, 2507, 2509, 2513, 2514, 2515, 2516, 2517, 2521, 2522, 2525, 2528, 2529, 2531, 2532, 2533, 2536, 2538, 2539, 2540, 2541, 2544, 2545, 2549, 2551, 2552, 2554, 2555, 2559, 2567, 2568, 2570, 2571, 2573, 2576, 2578, 2579, 2581, 2589, 2590, 2596, 2599, 2600, 2601, 2605, 2609, 2611, 2613, 2614, 2616, 2617, 2618, 2620, 2625, 2626, 2627, 2632, 2634, 2635, 2636, 2639, 2644, 2645, 2648, 2649, 2655, 2656, 2658, 2661, 2662, 2663, 2666, 2670, 2671, 2672, 2674, 2676, 2679, 2684, 2685, 2687, 2688, 2689, 2690, 2691, 2692, 2694, 2700, 2702, 2704, 2708, 2709, 2711, 2720, 2721, 2722, 2725, 2726, 2728, 2729, 2735, 2745, 2746, 2747, 2749, 2752, 2756, 2758, 2762, 2764, 2765, 2766, 2770, 2775, 2776, 2783, 2784, 2787, 2794, 2798, 2800, 2801, 2802, 2805, 2808, 2812, 2814, 2816, 2818, 2819, 2821, 2823, 2824, 2827, 2828, 2831, 2832, 2838, 2840, 2843, 2844, 2850, 2857, 2860, 2861, 2865, 2869, 2871, 2876, 2878, 2888, 2889, 2890, 2892, 2893, 2894, 2895, 2896, 2901, 2902, 2903, 2906, 2908, 2909, 2914, 2915, 2916, 2917, 2918, 2922, 2923, 2926, 2930, 2931, 2935, 2938, 2941, 2942, 2943, 2946, 2947, 2948, 2951, 2955, 2959, 2962, 2963, 2966, 2968, 2976, 2979, 2982, 2987, 2992, 2994, 2998, 3003, 3005, 3006, 3007, 3013, 3014, 3015, 3017, 3018, 3020, 3023, 3024, 3031, 3038, 3039, 3041, 3042, 3044, 3045, 3047, 3048, 3049, 3051, 3052, 3053, 3055, 3058, 3059, 3061, 3064, 3067, 3068, 3070, 3072, 3075, 3080, 3083, 3084, 3085, 3087, 3090, 3095, 3100, 3101, 3106, 3115, 3118, 3119, 3120, 3121, 3123, 3126, 3127, 3128, 3137, 3138, 3139, 3141, 3142, 3143, 3145, 3153, 3157, 3158, 3161, 3164, 3167, 3169, 3170, 3171, 3172, 3177, 3181, 3187, 3189, 3191, 3192, 3194, 3196, 3204, 3205, 3206, 3208, 3210, 3213, 3217, 3219, 3220, 3221, 3224, 3225, 3228, 3230, 3240, 3242, 3246, 3247, 3249, 3253, 3254, 3261, 3263, 3266, 3267, 3268, 3269, 3271, 3272, 3280, 3283, 3286, 3288, 3289, 3290, 3291, 3294, 3295, 3297, 3299, 3300, 3301, 3308, 3310, 3312, 3313, 3324, 3327, 3331, 3332, 3333, 3337, 3338, 3340, 3342, 3343, 3345, 3346, 3351, 3353, 3355, 3356, 3357, 3359, 3360, 3363, 3368, 3370, 3374, 3376, 3377, 3378, 3379, 3382, 3383, 3386, 3394, 3396, 3399, 3402, 3403, 3404, 3405, 3413, 3415, 3416, 3418, 3419, 3424, 3427, 3428, 3442, 3446, 3447, 3449, 3450, 3452, 3453, 3458, 3461, 3462, 3466, 3468, 3469, 3470, 3471, 3474, 3477, 3478, 3479, 3483, 3484, 3486, 3488, 3493, 3500, 3501, 3502, 3503, 3504, 3507, 3510, 3516, 3517, 3518, 3523, 3524, 3533, 3536, 3537, 3538, 3540, 3541, 3542, 3544, 3545, 3549, 3552, 3554, 3558, 3560, 3562, 3563, 3569, 3571, 3574, 3576, 3580, 3587, 3588, 3591, 3592, 3594, 3600, 3601, 3603, 3604, 3606, 3607, 3610, 3611, 3612, 3613, 3616, 3618, 3620, 3622, 3624, 3627, 3628, 3630, 3631, 3633, 3634, 3640, 3642, 3643, 3644, 3645, 3646, 3647, 3648, 3650, 3659, 3660, 3661, 3664, 3665, 3667, 3672, 3674, 3677, 3681, 3682, 3684, 3685, 3690, 3702, 3706, 3707, 3709, 3710, 3713, 3715, 3717, 3718, 3719, 3721, 3725, 3730, 3731, 3733, 3744, 3749, 3752, 3756, 3757, 3760, 3761, 3764, 3765, 3766, 3772, 3773, 3775, 3777, 3778, 3783, 3791, 3792, 3793, 3794, 3798, 3801, 3804, 3806, 3808, 3817, 3818, 3819, 3820, 3823, 3829, 3830, 3831, 3832, 3833, 3837, 3838, 3839, 3843, 3844, 3845, 3846, 3847, 3849, 3852, 3858, 3859, 3860, 3866, 3867, 3868, 3870, 3871, 3872, 3873, 3881, 3882, 3883, 3884, 3885, 3887, 3889, 3890, 3892, 3894, 3895, 3896, 3897, 3899, 3902, 3903, 3904, 3907, 3908, 3912, 3913, 3914, 3917, 3918, 3923, 3924, 3927, 3928, 3929, 3933, 3938, 3943, 3947, 3950, 3951, 3954, 3955, 3958, 3962, 3964, 3967, 3968, 3969, 3970, 3971, 3974, 3975, 3978, 3979, 3983, 3987, 3988, 3994, 3995, 3996, 3997, 4007, 4008, 4013, 4014, 4021, 4028, 4030, 4033, 4037, 4039, 4040, 4041, 4042, 4043, 4044, 4046, 4048, 4049, 4050, 4053, 4054, 4056, 4057, 4062, 4066, 4067, 4068, 4070, 4080, 4084, 4088, 4092, 4094, 4096, 4099, 4102, 4105, 4106, 4109, 4110, 4111, 4113, 4122, 4124, 4126, 4128, 4132, 4133, 4134, 4135, 4139, 4140, 4143, 4144, 4146, 4147, 4148, 4149, 4150, 4151, 4154, 4158, 4160, 4161, 4162, 4163, 4164, 4165, 4166, 4167, 4168, 4171, 4175, 4178, 4181, 4183, 4185, 4187, 4188, 4189, 4190, 4191, 4192, 4193, 4195, 4197, 4201, 4202, 4204, 4205, 4206, 4207, 4208, 4210, 4211, 4212, 4213, 4216, 4217, 4219, 4221, 4227, 4228, 4229, 4232, 4233, 4235, 4237, 4240, 4244, 4245, 4246, 4251, 4252, 4255, 4257, 4261, 4263, 4266, 4270, 4272, 4275, 4276, 4280, 4281, 4283, 4284, 4288, 4290, 4292, 4296, 4298, 4300, 4301, 4302, 4305, 4306, 4309, 4312, 4314, 4320, 4321, 4324, 4329, 4330, 4335, 4337, 4341, 4343, 4347, 4352, 4354, 4356, 4358, 4359, 4360, 4369, 4370, 4375, 4378, 4380, 4383, 4390, 4391, 4392, 4393, 4396, 4397, 4401, 4402, 4403, 4404, 4405, 4409, 4410, 4422, 4423, 4430, 4432, 4436, 4439, 4440, 4442, 4443, 4446, 4448, 4449, 4450, 4453, 4456, 4458, 4461, 4462, 4463, 4466, 4468, 4470, 4471, 4474, 4475, 4479, 4486, 4492, 4494, 4497, 4498, 4500, 4502, 4507, 4508, 4509, 4512, 4514, 4515, 4519, 4521, 4522, 4524, 4529, 4531, 4535, 4548, 4549, 4551, 4554, 4555, 4556, 4557, 4558, 4560, 4562, 4563, 4565, 4567, 4568, 4575, 4576, 4578, 4579, 4580, 4582, 4583, 4590, 4591, 4594, 4597, 4598, 4601, 4606, 4608, 4612, 4613, 4616, 4618, 4623, 4625, 4628, 4632, 4635, 4636, 4638, 4639, 4641, 4643, 4644, 4645, 4646, 4647, 4650, 4651, 4653, 4654, 4655, 4656, 4658, 4659, 4662, 4664, 4667, 4669, 4671, 4673, 4674, 4676, 4677, 4680, 4682, 4685, 4691, 4692, 4694, 4697, 4699, 4700, 4703, 4704, 4706, 4710, 4711, 4713, 4715, 4719, 4721, 4724, 4725, 4728, 4729, 4734, 4737, 4738, 4739, 4740, 4745, 4746, 4749, 4750, 4752, 4753, 4755, 4756, 4758, 4761, 4762, 4763, 4769, 4770, 4771, 4773, 4775, 4779, 4780, 4784, 4787, 4788, 4789, 4790, 4791, 4794, 4795, 4796, 4801, 4803, 4804, 4805, 4806, 4807, 4813, 4818, 4822, 4828, 4830, 4831, 4834, 4840, 4841, 4842, 4847, 4854, 4855, 4856, 4857, 4861, 4862, 4863, 4869, 4874, 4875, 4876, 4877, 4878, 4881, 4887, 4888, 4889, 4891, 4893, 4896, 4897, 4904, 4905, 4907, 4909, 4910, 4914, 4918, 4921, 4922, 4923, 4924, 4926, 4935, 4936, 4937, 4941, 4942, 4944, 4949, 4950, 4953, 4954, 4956, 4967, 4969, 4971, 4972, 4975, 4985, 4987, 4988, 4993, 4996, 5005, 5007, 5011, 5015, 5016, 5021, 5023, 5024, 5026, 5029, 5030, 5034, 5036, 5038, 5039, 5040, 5042, 5044, 5045, 5046, 5049, 5051, 5052, 5054, 5057, 5060, 5067, 5068, 5069, 5072, 5074, 5075, 5078, 5079, 5082, 5084, 5087, 5088, 5089, 5091, 5094, 5095, 5100, 5101, 5102, 5106, 5110, 5114, 5116, 5119, 5120, 5122, 5129, 5131, 5132, 5140, 5143, 5145, 5146, 5147, 5149, 5151, 5154, 5159, 5160, 5164, 5165, 5168, 5170, 5171, 5174, 5180, 5181, 5184, 5185, 5187, 5188, 5189, 5190, 5191, 5192, 5195, 5196, 5198, 5200, 5202, 5203, 5206, 5209, 5212, 5213, 5217, 5218, 5219, 5225, 5229, 5234, 5241, 5248, 5251, 5253, 5254, 5255, 5256, 5257, 5258, 5261, 5263, 5266, 5267, 5268, 5269, 5275, 5276, 5280, 5281, 5282, 5283, 5286, 5289, 5293, 5294, 5297, 5298, 5299, 5300, 5301, 5302, 5308, 5311, 5317, 5319, 5321, 5324, 5329, 5330, 5331, 5333, 5334, 5338, 5339, 5342, 5345, 5346, 5348, 5349, 5351, 5352, 5361, 5366, 5367, 5369, 5386, 5388, 5389, 5391, 5393, 5396, 5398, 5404, 5405, 5411, 5413, 5414, 5417, 5418, 5422, 5427, 5428, 5430, 5431, 5434, 5437, 5438, 5446, 5448, 5449, 5452, 5453, 5456, 5458, 5459, 5461, 5462, 5463, 5464, 5475, 5476, 5483, 5487, 5491, 5493, 5495, 5496, 5497, 5498, 5505, 5506, 5508, 5510, 5512, 5513, 5515, 5517, 5518, 5519, 5524, 5526, 5529, 5530, 5531, 5532, 5534, 5535, 5545, 5549, 5554, 5557, 5562, 5563, 5566, 5568, 5569, 5572, 5575, 5579, 5581, 5582, 5584, 5585, 5586, 5589, 5591, 5596, 5597, 5602, 5608, 5610, 5612, 5613, 5614, 5615, 5616, 5620, 5621, 5623, 5624, 5627, 5633, 5635, 5638, 5640, 5643, 5646, 5648, 5651, 5653, 5654, 5656, 5659, 5660, 5662, 5664, 5667, 5669, 5675, 5676, 5680, 5681, 5689, 5690, 5694, 5695, 5697, 5698, 5702, 5706, 5711, 5717, 5718, 5719, 5720, 5721, 5722, 5723, 5729, 5730, 5731, 5732, 5734, 5735, 5736, 5737, 5742, 5744, 5746, 5751, 5757, 5764, 5768, 5770, 5771, 5773, 5775, 5778, 5780, 5784, 5785, 5787, 5791, 5792, 5794, 5807, 5808, 5810, 5811, 5817, 5820, 5826, 5828, 5833, 5834, 5835, 5836, 5837, 5839, 5842, 5844, 5846, 5854, 5858, 5859, 5866, 5867, 5868, 5869, 5871, 5872, 5876, 5877, 5878, 5879, 5881, 5882, 5883, 5884, 5888, 5889, 5892, 5893, 5900, 5901, 5902, 5906, 5907, 5910, 5912, 5919, 5921, 5925, 5926, 5927, 5928, 5931, 5932, 5936, 5938, 5941, 5942, 5944, 5945, 5946, 5948, 5950, 5951, 5952, 5954, 5956, 5957, 5959, 5961, 5967, 5968, 5969, 5971, 5978, 5980, 5985, 5986, 5988, 5990, 5991, 5992, 5996, 5997, 6000, 6002, 6003, 6004, 6005, 6006, 6007, 6012, 6013, 6016, 6017, 6021, 6023, 6025, 6026, 6038, 6040, 6041, 6044, 6047, 6048, 6051, 6053, 6054, 6058, 6059, 6062, 6063, 6068, 6069, 6070, 6072, 6073, 6074, 6075, 6077, 6080, 6083, 6087, 6088, 6089, 6092, 6093, 6094, 6095, 6096, 6098, 6107, 6108, 6109, 6110, 6113, 6116, 6118, 6119, 6120, 6122, 6129, 6130, 6132, 6133, 6135, 6136, 6137, 6143, 6145, 6146, 6147, 6151, 6152, 6153, 6156, 6160, 6163, 6164, 6165, 6168, 6173, 6176, 6181, 6182, 6186, 6188, 6189, 6190, 6191, 6193, 6196, 6197, 6198, 6200, 6203, 6205, 6207, 6209, 6212, 6214, 6215, 6219, 6220, 6221, 6223, 6224, 6227, 6228, 6230, 6231, 6233, 6234, 6237, 6238, 6240, 6241, 6243, 6245, 6246, 6247, 6248, 6249, 6250, 6251, 6255, 6257, 6258, 6259, 6260, 6264, 6265, 6269, 6270, 6271, 6272, 6273, 6275, 6278, 6279, 6280, 6281, 6282, 6286, 6287, 6288, 6292, 6294, 6296, 6299, 6302, 6303, 6304, 6309, 6310, 6312, 6314, 6315, 6317, 6319, 6321, 6322, 6325, 6328, 6330, 6333, 6334, 6338, 6345, 6351, 6352, 6353, 6354, 6359, 6360, 6362, 6363, 6367, 6370, 6372, 6375, 6376, 6378, 6379, 6381, 6383, 6387, 6395, 6396, 6398, 6399, 6403, 6405, 6407, 6408, 6412, 6414, 6415, 6419, 6420, 6422, 6428, 6429, 6430, 6431, 6434, 6436, 6437, 6440, 6442, 6450, 6452, 6454, 6458, 6459, 6463, 6464, 6465, 6466, 6467, 6468, 6469, 6470, 6471, 6474, 6477, 6478, 6480, 6482, 6484, 6486, 6488, 6493, 6495, 6500, 6501, 6502, 6504, 6505, 6513, 6514, 6516, 6517, 6519, 6524, 6530, 6532, 6533, 6537, 6539, 6543, 6544, 6545, 6547, 6548, 6549, 6554, 6555, 6558, 6560, 6561, 6563, 6567, 6572, 6574, 6576, 6577, 6579, 6581, 6582, 6584, 6587, 6589, 6595, 6597, 6598, 6599, 6600, 6607, 6609, 6610, 6611, 6614, 6615, 6616, 6620, 6621, 6622, 6624, 6625, 6626, 6628, 6629, 6630, 6634, 6635, 6637, 6638, 6639, 6643, 6644, 6646, 6647, 6649, 6655, 6656, 6658, 6662, 6666, 6671, 6672, 6677, 6681, 6691, 6692, 6695, 6696, 6699, 6702, 6703, 6705, 6706, 6711, 6714, 6716, 6718, 6720, 6724, 6725, 6729, 6731, 6733, 6734, 6736, 6737, 6739, 6740, 6741, 6746, 6747, 6752, 6756, 6757, 6758, 6759, 6761, 6766, 6778, 6779, 6780, 6782, 6786, 6788, 6789, 6792, 6793, 6794, 6797, 6799, 6803, 6804, 6805, 6807, 6808, 6810, 6811, 6812, 6813, 6816, 6819, 6820, 6821, 6824, 6827, 6828, 6830, 6831, 6834, 6836, 6840, 6841, 6842, 6843, 6845, 6851, 6852, 6859, 6863, 6864, 6869, 6872, 6874, 6875, 6876, 6878, 6879, 6880, 6884, 6886, 6888, 6890, 6903, 6904, 6909, 6914, 6915, 6917, 6919, 6921, 6923, 6924, 6930, 6933, 6936, 6941, 6944, 6946, 6948, 6950, 6951, 6952, 6959, 6960, 6967, 6969, 6971, 6979, 6980, 6981, 6984, 6985, 6987, 6990, 6991, 6994, 6997, 6999, 7003, 7005, 7006, 7009, 7012, 7013, 7015, 7022, 7033, 7035, 7038, 7039, 7042, 7043, 7046, 7048, 7051, 7052, 7053, 7056, 7057, 7064, 7067, 7072, 7074, 7075, 7077, 7083, 7085, 7086, 7097, 7105, 7106, 7107, 7108, 7109, 7112, 7113, 7116, 7117, 7118, 7124, 7126, 7129, 7130, 7132, 7140, 7142, 7144, 7155, 7163, 7164, 7165, 7166, 7169, 7173, 7176, 7177, 7182, 7183, 7184, 7187, 7188, 7192, 7194, 7196, 7201, 7203, 7206, 7207, 7211, 7212, 7216, 7217, 7219, 7227, 7228, 7230, 7231, 7232, 7233, 7234, 7235, 7236, 7239, 7240, 7243, 7244, 7245, 7248, 7249, 7250, 7254, 7255, 7257, 7258, 7259, 7267, 7268, 7274, 7277, 7278, 7282, 7284, 7287, 7288, 7290, 7291, 7292, 7293, 7298, 7299, 7300, 7301, 7303, 7304, 7305, 7306, 7307, 7308, 7310, 7313, 7315, 7317, 7321, 7328, 7330, 7331, 7334, 7336, 7339, 7340, 7344, 7354, 7355, 7356, 7357, 7358, 7360, 7361, 7363, 7365, 7371, 7373, 7379, 7380, 7381, 7382, 7383, 7388, 7389, 7392, 7395, 7396, 7398, 7399, 7400, 7409, 7411, 7415, 7417, 7418, 7425, 7428, 7429, 7430, 7434, 7435, 7436, 7441, 7443, 7444, 7445, 7446, 7447, 7448, 7452, 7454, 7458, 7459, 7464, 7466, 7470, 7472, 7486, 7487, 7490, 7492, 7493, 7502, 7504, 7505, 7506, 7508, 7512, 7514, 7515, 7517, 7523, 7524, 7525, 7528, 7533, 7537, 7538, 7546, 7547, 7554, 7556, 7557, 7561, 7570, 7572, 7574, 7577, 7578, 7579, 7580, 7585, 7586, 7591, 7594, 7595, 7598, 7605, 7613, 7619, 7620, 7621, 7623, 7624, 7633, 7634, 7638, 7639, 7640, 7642, 7647, 7652, 7653, 7658, 7661, 7663, 7665, 7666, 7667, 7674, 7676, 7677, 7678, 7679, 7680, 7682, 7685, 7686, 7689, 7695, 7699, 7703, 7704, 7708, 7712, 7713, 7718, 7719, 7724, 7725, 7729, 7736, 7737, 7738, 7740, 7743, 7744, 7745, 7748, 7751, 7753, 7761, 7762, 7763, 7764, 7767, 7768, 7769, 7770, 7772, 7774, 7775, 7777, 7778, 7779, 7781, 7782, 7785, 7786, 7788, 7791, 7798, 7799, 7803, 7804, 7806, 7807, 7812, 7815, 7818, 7820, 7824, 7825, 7832, 7833, 7834, 7840, 7841, 7844, 7845, 7847, 7848, 7849, 7850, 7856, 7859, 7860, 7862, 7863, 7865, 7873, 7876, 7878, 7880, 7884, 7888, 7890, 7893, 7896, 7900, 7908, 7909, 7910, 7911, 7913, 7917, 7918, 7921, 7922, 7923, 7925, 7927, 7929, 7933, 7934, 7935, 7936, 7937, 7938, 7942, 7944, 7945, 7946, 7947, 7948, 7949, 7950, 7951, 7952, 7955, 7956, 7960, 7964, 7965, 7966, 7967, 7971, 7972, 7974, 7976, 7977, 7978, 7979, 7980, 7981, 7983, 7984, 7986, 7988, 7989, 7990, 7991, 7993, 7998, 8001, 8002, 8004, 8006, 8008, 8009, 8012, 8018, 8019, 8021, 8026, 8029, 8030, 8038, 8042, 8044, 8047, 8048, 8052, 8053, 8056, 8058, 8059, 8063, 8065, 8066, 8067, 8068, 8071, 8073, 8075, 8076, 8077, 8078, 8080, 8084, 8088, 8091, 8093, 8095, 8096, 8099, 8100, 8103, 8105, 8108, 8112, 8116, 8118, 8121, 8124, 8126, 8129, 8136, 8137, 8145, 8146, 8147, 8150, 8151, 8159, 8162, 8163, 8164, 8165, 8166, 8168, 8170, 8176, 8178, 8179, 8182, 8189, 8192, 8193, 8195, 8199, 8202, 8204, 8208, 8211, 8213, 8217, 8219, 8220, 8223, 8224, 8225, 8231, 8235, 8236, 8237, 8239, 8240, 8241, 8245, 8249, 8250, 8252, 8253, 8266, 8269, 8270, 8272, 8282, 8289, 8291, 8293, 8294, 8297, 8300, 8301, 8304, 8306, 8310, 8311, 8312, 8313, 8315, 8318, 8319, 8320, 8321, 8329, 8339, 8340, 8349, 8350, 8352, 8353, 8355, 8361, 8363, 8367, 8368, 8373, 8379, 8385, 8386, 8387, 8389, 8390, 8392, 8393, 8395, 8398, 8401, 8402, 8403, 8404, 8405, 8407, 8409, 8410, 8413, 8414, 8416, 8417, 8418, 8423, 8427, 8430, 8433, 8436, 8438, 8439, 8441, 8442, 8444, 8446, 8447, 8448, 8450, 8451, 8452, 8458, 8459, 8460, 8463, 8470, 8472, 8473, 8474, 8476, 8477, 8480, 8481, 8482, 8483, 8485, 8486, 8490, 8493, 8498, 8501, 8505, 8511, 8513, 8515, 8517, 8523, 8524, 8525, 8528, 8531, 8532, 8533, 8535, 8537, 8538, 8539, 8542, 8549, 8550, 8552, 8553, 8554, 8557, 8561, 8562, 8565, 8566, 8568, 8574, 8575, 8576, 8579, 8581, 8582, 8589, 8590, 8593, 8594, 8596, 8597, 8598, 8600, 8601, 8603, 8604, 8605, 8607, 8610, 8611, 8612, 8614, 8617, 8618, 8624, 8625, 8631, 8634, 8638, 8640, 8642, 8644, 8648, 8654, 8657, 8659, 8665, 8669, 8672, 8675, 8676, 8677, 8685, 8693, 8699, 8700, 8704, 8706, 8708, 8709, 8712, 8713, 8714, 8715, 8716, 8717, 8720, 8721, 8726, 8728, 8729, 8731, 8732, 8734, 8735, 8736, 8741, 8742, 8743, 8746, 8748, 8751, 8752, 8757, 8761, 8764, 8766, 8767, 8770, 8772, 8773, 8775, 8776, 8777, 8779, 8782, 8783, 8784, 8789, 8790, 8792, 8797, 8802, 8803, 8805, 8810, 8817, 8818, 8821, 8822, 8824, 8831, 8832, 8833, 8834, 8835, 8838, 8841, 8843, 8846, 8853, 8859, 8861, 8865, 8867, 8876, 8878, 8881, 8883, 8886, 8888, 8891, 8892, 8896, 8899, 8900, 8902, 8905, 8907, 8908, 8909, 8910, 8911, 8913, 8914, 8916, 8917, 8924, 8926, 8928, 8929, 8935, 8938, 8941, 8942, 8945, 8946, 8949, 8951, 8954, 8956, 8957, 8960, 8962, 8967, 8968, 8969, 8972, 8974, 8976, 8977, 8979, 8980, 8981, 8985, 8986, 8991, 8992, 8998, 8999, 9001, 9003, 9006, 9009, 9012, 9013, 9015, 9017, 9018, 9020, 9021, 9029, 9030, 9033, 9037, 9042, 9044, 9047, 9052, 9057, 9058, 9059, 9060, 9061, 9062, 9066, 9069, 9071, 9072, 9073, 9074, 9076, 9080, 9084, 9088, 9091, 9092, 9095, 9096, 9108, 9110, 9111, 9112, 9114, 9115, 9118, 9119, 9123, 9124, 9125, 9129, 9133, 9134, 9136, 9138, 9139, 9140, 9141, 9142, 9149, 9151, 9152, 9154, 9159, 9173, 9174, 9175, 9177, 9183, 9185, 9187, 9188, 9190, 9191, 9195, 9200, 9204, 9205, 9206, 9207, 9210, 9211, 9213, 9214, 9215, 9216, 9218, 9221, 9223, 9226, 9229, 9233, 9237, 9241, 9243, 9247, 9249, 9252, 9253, 9254, 9255, 9257, 9263, 9265, 9267, 9270, 9273, 9276, 9282, 9284, 9285, 9287, 9288, 9290, 9292, 9293, 9299, 9300, 9302, 9304, 9308, 9311, 9314, 9316, 9320, 9321, 9323, 9325, 9326, 9327, 9328, 9329, 9330, 9333, 9336, 9337, 9338, 9339, 9340, 9341, 9345, 9346, 9347, 9348, 9350, 9354, 9355, 9366, 9367, 9373, 9375, 9376, 9382, 9383, 9388, 9391, 9392, 9393, 9394, 9396, 9398, 9400, 9402, 9403, 9404, 9406, 9407, 9413, 9415, 9417, 9419, 9423, 9432, 9433, 9434, 9440, 9442, 9444, 9449, 9451, 9452, 9456, 9460, 9466, 9468, 9471, 9472, 9473, 9475, 9483, 9484, 9488, 9490, 9494, 9495, 9497, 9500, 9501, 9502, 9503, 9504, 9509, 9513, 9514, 9515, 9517, 9518, 9519, 9522, 9528, 9531, 9533, 9534, 9536, 9540, 9543, 9545, 9548, 9549, 9553, 9555, 9560, 9561, 9563, 9565, 9568, 9571, 9575, 9577, 9579, 9582, 9583, 9587, 9589, 9590, 9591, 9597, 9602, 9606, 9609, 9610, 9613, 9614, 9618, 9620, 9623, 9624, 9626, 9627, 9628, 9629, 9632, 9633, 9635, 9641, 9642, 9644, 9645, 9646, 9648, 9649, 9653, 9655, 9656, 9657, 9658, 9659, 9660, 9663, 9666, 9668, 9670, 9674, 9675, 9679, 9681, 9682, 9686, 9692, 9698, 9699, 9700, 9706, 9710, 9711, 9718, 9722, 9723, 9725, 9726, 9729, 9730, 9731, 9733, 9734, 9737, 9744, 9745, 9746, 9750, 9751, 9753, 9754, 9755, 9756, 9763, 9764, 9767, 9768, 9770, 9776, 9780, 9781, 9782, 9784, 9786, 9791, 9792, 9794, 9796, 9798, 9799, 9801, 9808, 9809, 9812, 9813, 9816, 9819, 9820, 9824, 9825, 9826, 9833, 9836, 9845, 9846, 9847, 9849, 9850, 9851, 9853, 9854, 9861, 9864, 9866, 9869, 9871, 9873, 9878, 9882, 9886, 9887, 9892, 9897, 9900, 9901, 9906, 9907, 9908, 9909, 9910, 9912, 9923, 9924, 9928, 9930, 9935, 9938, 9940, 9944, 9946, 9947, 9949, 9950, 9955, 9957, 9960, 9962, 9963, 9964, 9967, 9971, 9974, 9979, 9980, 9982, 9984, 9985, 9987, 9988, 9990, 9996, 9997, 9998, 10000, 10008, 10009, 10010, 10013, 10017, 10018, 10019, 10021, 10022, 10026, 10031, 10035, 10038, 10041, 10043, 10045, 10047, 10048, 10051, 10052, 10054, 10056, 10058, 10059, 10060, 10062, 10063, 10064, 10068, 10072, 10075, 10077, 10078, 10083, 10086, 10089, 10091, 10092, 10095, 10097, 10101, 10102, 10103, 10105, 10106, 10107, 10108, 10109, 10110, 10112, 10114, 10115, 10116, 10117, 10118, 10122, 10127, 10128, 10131, 10132, 10136, 10141, 10143, 10146, 10149, 10151, 10152, 10158, 10160, 10163, 10165, 10166, 10168, 10170, 10174, 10176, 10178, 10181, 10182, 10192, 10193, 10194, 10195, 10197, 10199, 10203, 10206, 10209, 10212, 10214, 10218, 10219, 10220, 10222, 10223, 10224, 10225, 10228, 10231, 10232, 10233, 10236, 10237, 10239, 10247, 10252, 10255, 10258, 10259, 10260, 10275, 10278, 10284, 10286, 10291, 10293, 10295, 10300, 10302, 10306, 10307, 10312, 10318, 10321, 10323, 10325, 10326, 10328, 10330, 10331, 10333, 10334, 10335, 10336, 10343, 10346, 10352, 10353, 10356, 10357, 10359, 10360, 10362, 10364, 10365, 10368, 10373, 10375, 10378, 10380, 10381, 10384, 10385, 10388, 10389, 10397, 10398, 10399, 10400, 10401, 10405, 10408, 10410, 10413, 10414, 10416, 10421, 10422, 10423, 10425, 10426, 10427, 10428, 10430, 10435, 10437, 10438, 10446, 10447, 10449, 10450, 10451, 10452, 10453, 10455, 10456, 10463, 10464, 10465, 10468, 10469, 10470, 10474, 10478, 10487, 10488, 10490, 10492, 10494, 10496, 10504, 10506, 10508, 10513, 10514, 10515, 10518, 10521, 10524, 10525, 10527, 10528, 10530, 10531, 10533, 10535, 10536, 10537, 10541, 10542, 10543, 10544, 10547, 10548, 10549, 10550, 10551, 10555, 10556, 10558, 10561, 10562, 10565, 10567, 10569, 10571, 10573, 10580, 10581, 10582, 10583, 10585, 10589, 10590, 10593, 10596, 10597, 10599, 10601, 10602, 10610, 10611, 10614, 10615, 10616, 10617, 10619, 10621, 10622, 10623, 10626, 10628, 10634, 10637, 10638, 10639, 10640, 10641, 10642, 10645, 10646, 10648, 10649, 10650, 10655, 10657, 10660, 10663, 10665, 10666, 10668, 10670, 10673, 10674, 10676, 10678, 10681, 10682, 10683, 10684, 10685, 10686, 10687, 10697, 10698, 10699, 10700, 10702, 10703, 10705, 10707, 10712, 10715, 10716, 10721, 10722, 10723, 10725, 10726, 10730, 10732, 10734, 10735, 10738, 10740, 10741, 10744, 10745, 10748, 10749, 10752, 10753, 10761, 10762, 10763, 10766, 10774, 10775, 10778, 10779, 10782, 10784, 10785, 10787, 10788, 10790, 10791, 10792, 10795, 10796, 10798, 10800, 10801, 10802, 10803, 10804, 10805, 10809, 10810, 10811, 10813, 10815, 10818, 10819, 10820, 10821, 10823, 10824, 10825, 10826, 10830, 10831, 10833, 10836, 10838, 10839, 10840, 10841, 10843, 10850, 10853, 10854, 10857, 10858, 10860, 10861, 10862, 10867, 10871, 10872, 10874, 10877, 10880, 10881, 10892, 10896, 10897, 10898, 10899, 10902, 10905, 10912, 10917, 10920, 10926, 10927, 10930, 10933, 10934, 10935, 10936, 10937, 10938, 10940, 10941, 10947, 10948, 10950, 10954, 10956, 10957, 10960, 10962, 10964, 10965, 10967, 10970, 10972, 10975, 10976, 10977, 10980, 10985, 10988, 10993, 10995, 10996, 10997, 10999, 11002, 11004, 11005, 11006, 11008, 11015, 11018, 11026, 11027, 11032, 11033, 11039, 11046, 11047, 11053, 11056, 11060, 11066, 11070, 11072, 11078, 11080, 11082, 11083, 11086, 11090, 11095, 11098, 11102, 11107, 11108, 11110, 11114, 11116, 11118, 11123, 11124, 11125, 11126, 11127, 11129, 11132, 11135, 11137, 11138, 11145, 11146, 11148, 11149, 11153, 11154, 11158, 11159, 11160, 11161, 11162, 11163, 11165, 11166, 11168, 11169, 11171, 11175, 11177, 11178, 11179, 11180, 11184, 11185, 11187, 11188, 11190, 11191, 11192, 11193, 11194, 11198, 11201, 11204, 11206, 11207, 11214, 11217, 11218, 11222, 11226, 11227, 11228, 11229, 11232, 11233, 11234, 11235, 11236, 11237, 11238, 11239, 11244, 11246, 11247, 11248, 11254, 11255, 11256, 11257, 11258, 11259, 11260, 11262, 11263, 11264, 11266, 11274, 11275, 11278, 11288, 11289, 11290, 11292, 11293, 11294, 11295, 11298, 11304, 11305, 11306, 11307, 11313, 11315, 11316, 11318, 11319, 11320, 11322, 11324, 11326, 11330, 11331, 11337, 11339, 11340, 11345, 11346, 11348, 11349, 11352, 11356, 11358, 11363, 11365, 11369, 11370, 11371, 11373, 11374, 11377, 11379, 11380, 11381, 11382, 11385, 11387, 11388, 11389, 11391, 11392, 11394, 11395, 11397, 11401, 11403, 11405, 11406, 11408, 11409, 11411, 11412, 11413, 11414, 11416, 11418, 11423, 11428, 11430, 11431, 11434, 11437, 11438, 11449, 11451, 11459, 11463, 11465, 11466, 11467, 11471, 11472, 11473, 11475, 11476, 11478, 11481, 11482, 11487, 11490, 11496, 11497, 11498, 11500, 11501, 11506, 11507, 11508, 11509, 11512, 11516, 11518, 11520, 11521, 11523, 11524, 11526, 11527, 11528, 11530, 11531, 11532, 11533, 11538, 11540, 11541, 11544, 11546, 11548, 11551, 11553, 11558, 11560, 11561, 11567, 11568, 11571, 11574, 11576, 11577, 11578, 11579, 11580, 11585, 11586, 11593, 11594, 11595, 11596, 11597, 11599, 11604, 11610, 11615, 11618, 11619, 11620, 11621, 11623, 11628, 11629, 11632, 11633, 11636, 11638, 11639, 11642, 11649, 11650, 11654, 11655, 11656, 11657, 11658, 11663, 11669, 11673, 11678, 11681, 11682, 11683, 11688, 11691, 11692, 11693, 11694, 11695, 11699, 11701, 11703, 11705, 11707, 11711, 11712, 11718, 11720, 11721, 11725, 11726, 11731, 11733, 11736, 11740, 11741, 11743, 11744, 11753, 11755, 11756, 11759, 11760, 11761, 11762, 11763, 11764, 11765, 11766, 11767, 11770, 11771, 11776, 11780, 11781, 11782, 11783, 11784, 11785, 11786, 11790, 11792, 11799, 11800, 11809, 11811, 11812, 11813, 11814, 11816, 11818, 11819, 11823, 11825, 11826, 11828, 11829, 11830, 11837, 11841, 11846, 11848, 11849, 11851, 11853, 11856, 11858, 11863, 11868, 11870, 11872, 11876, 11877, 11881, 11890, 11891, 11894, 11895, 11898, 11899, 11903, 11904, 11905, 11909, 11911, 11913, 11919, 11920, 11921, 11922, 11923, 11926, 11928, 11929, 11930, 11934, 11935, 11940, 11941, 11943, 11946, 11947, 11948, 11949, 11953, 11955, 11957, 11958, 11959, 11960, 11961, 11962, 11963, 11965, 11968, 11977, 11978, 11980, 11983, 11988, 11989, 11993, 11997, 11998, 11999, 12002, 12004, 12005, 12006, 12008, 12014, 12017, 12019, 12020, 12021, 12023, 12024, 12025, 12029, 12032, 12042, 12043, 12044, 12047, 12050, 12051, 12054, 12059, 12060, 12061, 12063, 12064, 12068, 12076, 12078, 12079, 12080, 12081, 12083, 12086, 12087, 12091, 12092, 12093, 12097, 12098, 12102, 12104, 12106, 12109, 12112, 12115, 12118, 12120, 12122, 12128, 12129, 12131, 12134, 12135, 12138, 12139, 12142, 12143, 12144, 12145, 12146, 12147, 12148, 12151, 12155, 12162, 12163, 12165, 12166, 12167, 12170, 12171, 12174, 12175, 12179, 12181, 12186, 12197, 12202, 12204, 12208, 12212, 12214, 12215, 12217, 12223, 12228, 12229, 12230, 12233, 12234, 12237, 12238, 12240, 12241, 12243, 12245, 12246, 12250, 12252, 12254, 12255, 12256, 12259, 12271, 12278, 12280, 12283, 12285, 12286, 12287, 12288, 12295, 12296, 12299, 12304, 12306, 12310, 12311, 12312, 12313, 12314, 12315, 12317, 12319, 12321, 12323, 12325, 12328, 12331, 12334, 12335, 12337, 12339, 12342, 12345, 12347, 12350, 12354, 12356, 12358, 12359, 12364, 12366, 12370, 12374, 12375, 12376, 12379, 12380, 12381, 12385, 12390, 12393, 12394, 12397, 12400, 12401, 12403, 12404, 12405, 12406, 12409, 12411, 12414, 12415, 12416, 12419, 12420, 12423, 12424, 12425, 12426, 12427, 12437, 12440, 12444, 12445, 12447, 12450, 12451, 12454, 12455, 12456, 12457, 12459, 12461, 12462, 12465, 12467, 12468, 12470, 12472, 12473, 12478, 12481, 12483, 12485, 12487, 12488, 12491, 12492, 12497, 12499, 12501, 12502, 12503, 12512, 12513, 12514, 12515, 12518, 12530, 12535, 12536, 12537, 12538, 12539, 12540, 12546, 12547, 12549, 12551, 12552, 12554, 12555, 12556, 12557, 12559, 12561, 12563, 12565, 12567, 12568, 12570, 12572, 12577, 12578, 12580, 12583, 12584, 12585, 12586, 12588, 12589, 12591, 12594, 12600, 12603, 12604, 12605, 12608, 12609, 12610, 12611, 12616, 12620, 12622, 12623, 12626, 12628, 12629, 12634, 12638, 12639, 12640, 12641, 12644, 12648, 12649, 12651, 12663, 12664, 12668, 12670, 12671, 12674, 12677, 12679, 12683, 12684, 12685, 12688, 12689, 12691, 12693, 12695, 12696, 12699, 12701, 12702, 12705, 12706, 12708, 12713, 12714, 12723, 12726, 12729, 12731, 12732, 12733, 12735, 12738, 12739, 12740, 12741, 12742, 12744, 12751, 12752, 12753, 12754, 12755, 12757, 12758, 12760, 12761, 12762, 12763, 12764, 12765, 12766, 12771, 12772, 12773, 12775, 12777, 12782, 12790, 12791, 12797, 12800, 12802, 12803, 12804, 12807, 12810, 12812, 12813, 12817, 12818, 12819, 12820, 12822, 12823, 12824, 12827, 12828, 12835, 12836, 12837, 12838, 12839, 12843, 12844, 12848, 12849, 12850, 12853, 12860, 12861, 12866, 12870, 12873, 12878, 12882, 12883, 12887, 12891, 12895, 12898, 12899, 12900, 12901, 12903, 12904, 12905, 12906, 12908, 12910, 12912, 12913, 12916, 12921, 12923, 12928, 12929, 12932, 12933, 12934, 12935, 12938, 12939, 12945, 12946, 12947, 12950, 12952, 12953, 12956, 12958, 12960, 12961, 12963, 12967, 12968, 12969, 12973, 12978, 12983, 12984, 12986, 12987, 12988, 12990, 12991, 12994, 12999, 13001, 13003, 13004, 13006, 13007, 13010, 13014, 13015, 13017, 13018, 13022, 13027, 13030, 13031, 13033, 13034, 13035, 13040, 13041, 13047, 13050, 13053, 13054, 13055, 13056, 13060, 13061, 13062, 13064, 13066, 13071, 13075, 13077, 13083, 13085, 13086, 13087, 13097, 13099, 13101, 13102, 13105, 13106, 13110, 13111, 13112, 13114, 13115, 13117, 13118, 13120, 13122, 13123, 13124, 13125, 13127, 13128, 13131, 13134, 13136, 13147, 13148, 13149, 13151, 13153, 13154, 13155, 13159, 13169, 13170, 13175, 13180, 13181, 13182, 13186, 13190, 13197, 13198, 13199, 13203, 13206, 13209, 13210, 13212, 13213, 13217, 13220, 13221, 13226, 13227, 13228, 13232, 13234, 13235, 13236, 13237, 13239, 13241, 13243, 13248, 13250, 13251, 13255, 13256, 13259, 13260, 13261, 13262, 13263, 13264, 13265, 13267, 13268, 13269, 13271, 13274, 13281, 13296, 13297, 13298, 13300, 13301, 13303, 13304, 13315, 13316, 13317, 13323, 13326, 13328, 13329, 13330, 13332, 13340, 13343, 13345, 13346, 13347, 13348, 13350, 13351, 13352, 13358, 13361, 13363, 13367, 13368, 13369, 13370, 13374, 13377, 13380, 13381, 13385, 13386, 13387, 13388, 13391, 13393, 13394, 13395, 13396, 13397, 13403, 13407, 13408, 13410, 13416, 13417, 13418, 13419, 13420, 13423, 13429, 13430, 13433, 13439, 13441, 13444, 13448, 13456, 13463, 13464, 13467, 13469, 13473, 13475, 13477, 13478, 13479, 13480, 13489, 13492, 13494, 13496, 13499, 13503, 13507, 13513, 13514, 13515, 13516, 13518, 13519, 13521, 13522, 13526, 13532, 13533, 13539, 13540, 13543, 13544, 13546, 13547, 13549, 13551, 13552, 13553, 13555, 13556, 13558, 13559, 13561, 13568, 13569, 13572, 13574, 13577, 13578, 13579, 13580, 13584, 13587, 13597, 13598, 13599, 13600, 13601, 13602, 13604, 13605, 13612, 13613, 13614, 13620, 13621, 13623, 13628, 13630, 13631, 13632, 13634, 13636, 13637, 13638, 13639, 13641, 13647, 13650, 13653, 13654, 13660, 13662, 13663, 13665, 13668, 13669, 13675, 13677, 13678, 13679, 13683, 13687, 13688, 13693, 13697, 13698, 13699, 13700, 13702, 13710, 13713, 13714, 13715, 13716, 13719, 13720, 13727, 13729, 13730, 13736, 13739, 13742, 13745, 13747, 13750, 13753, 13756, 13764, 13767, 13768, 13772, 13773, 13775, 13777, 13779, 13780, 13782, 13783, 13785, 13786, 13787, 13791, 13793, 13796, 13798, 13809, 13816, 13817, 13818, 13819, 13820, 13822, 13823, 13828, 13830, 13834, 13835, 13843, 13849, 13852, 13853, 13858, 13859, 13860, 13862, 13866, 13869, 13870, 13872, 13873, 13875, 13877, 13885, 13887, 13891, 13892, 13895, 13897, 13898, 13899, 13901, 13906, 13908, 13909, 13910, 13911, 13914, 13917, 13918, 13919, 13920, 13924, 13927, 13929, 13934, 13947, 13948, 13949, 13950, 13953, 13954, 13958, 13960, 13963, 13969, 13970, 13971, 13974, 13975, 13983, 13984, 13985, 13991, 13999, 14000, 14001, 14005, 14006, 14008, 14009, 14013, 14014, 14017, 14018, 14022, 14027, 14030, 14031, 14036, 14038, 14040, 14051, 14052, 14054, 14059, 14062, 14063, 14066, 14067, 14069, 14070, 14071, 14073, 14075, 14076, 14078, 14080, 14081, 14085, 14086, 14087, 14088, 14092, 14094, 14095, 14096, 14112, 14116, 14118, 14119, 14121, 14122, 14124, 14129, 14130, 14132, 14133, 14137, 14138, 14139, 14140, 14142, 14143, 14145, 14146, 14147.

Promoters expressing in the endosperm at 12 days after pollination include SEQ IDs: 3, 7, 12, 14, 15, 16, 17, 29, 31, 34, 37, 48, 54, 55, 57, 64, 65, 79, 80, 86, 88, 90, 92, 93, 94, 95, 96, 98, 99, 102, 103, 104, 110, 117, 123, 126, 128, 130, 131, 132, 134, 136, 137, 142, 143, 146, 147, 148, 152, 154, 156, 157, 159, 162, 165, 168, 169, 172, 174, 175, 176, 183, 187, 191, 193, 194, 197, 199, 202, 203, 204, 205, 207, 210, 211, 212, 214, 232, 233, 235, 236, 237, 239, 240, 242, 246, 249, 250, 251, 257, 259, 264, 267, 269, 270, 271, 273, 280, 286, 288, 293, 294, 298, 299, 301, 302, 308, 309, 314, 316, 319, 320, 322, 323, 328, 329, 332, 334, 335, 338, 340, 346, 349, 352, 354, 355, 356, 358, 360, 364, 365, 367, 371, 372, 373, 374, 381, 388, 389, 396, 401, 411, 412, 414, 423, 424, 428, 431, 432, 433, 434, 436, 441, 448, 450, 452, 456, 459, 461, 462, 463, 466, 468, 470, 471, 474, 478, 483, 485, 488, 489, 493, 496, 498, 504, 505, 507, 509, 510, 511, 514, 516, 517, 522, 523, 525, 528, 532, 536, 537, 541, 543, 544, 546, 547, 548, 553, 554, 557, 560, 561, 573, 578, 580, 582, 585, 589, 591, 592, 594, 595, 596, 599, 601, 602, 606, 607, 608, 613, 619, 620, 623, 630, 631, 633, 635, 636, 637, 638, 643, 645, 647, 661, 662, 663, 664, 670, 671, 681, 683, 692, 693, 694, 701, 702, 705, 706, 707, 708, 709, 717, 718, 719, 721, 722, 724, 727, 731, 732, 734, 736, 740, 742, 744, 749, 753, 757, 759, 760, 761, 762, 764, 765, 779, 781, 782, 783, 784, 800, 804, 806, 808, 809, 811, 812, 820, 821, 822, 829, 830, 831, 832, 833, 834, 835, 841, 846, 849, 855, 856, 857, 858, 860, 862, 863, 865, 870, 871, 872, 875, 876, 877, 882, 890, 891, 892, 893, 895, 897, 898, 899, 903, 907, 908, 910, 911, 912, 913, 915, 916, 917, 919, 920, 924, 928, 929, 931, 932, 936, 938, 939, 942, 943, 947, 949, 951, 953, 955, 958, 960, 961, 964, 971, 974, 975, 976, 978, 979, 980, 982, 984, 985, 987, 991, 996, 999, 1002, 1006, 1007, 1008, 1009, 1010, 1011, 1012, 1013, 1014, 1016, 1017, 1019, 1022, 1025, 1026, 1032, 1033, 1035, 1038, 1039, 1041, 1042, 1043, 1046, 1047, 1049, 1051, 1052, 1055, 1056, 1057, 1064, 1065, 1069, 1070, 1073, 1077, 1080, 1085, 1086, 1087, 1089, 1092, 1095, 1096, 1100, 1101, 1103, 1104, 1112, 1114, 1115, 1116, 1117, 1119, 1121, 1125, 1127, 1130, 1132, 1136, 1137, 1140, 1144, 1146, 1154, 1155, 1160, 1161, 1165, 1167, 1168, 1170, 1171, 1176, 1178, 1183, 1187, 1191, 1196, 1200, 1201, 1204, 1205, 1214, 1215, 1218, 1222, 1223, 1225, 1228, 1230, 1232, 1233, 1236, 1240, 1241, 1248, 1249, 1250, 1251, 1252, 1253, 1254, 1257, 1258, 1261, 1262, 1263, 1269, 1272, 1277, 1281, 1285, 1286, 1290, 1291, 1292, 1293, 1296, 1303, 1307, 1309, 1310, 1311, 1312, 1314, 1316, 1320, 1321, 1322, 1323, 1327, 1330, 1331, 1334, 1339, 1344, 1345, 1349, 1360, 1364, 1366, 1367, 1368, 1371, 1375, 1376, 1377, 1380, 1387, 1389, 1391, 1393, 1396, 1399, 1402, 1404, 1405, 1406, 1407, 1412, 1420, 1421, 1423, 1426, 1431, 1432, 1433, 1435, 1438, 1440, 1441, 1442, 1447, 1451, 1453, 1458, 1459, 1461, 1462, 1464, 1466, 1471, 1472, 1475, 1484, 1488, 1490, 1491, 1493, 1497, 1498, 1499, 1501, 1503, 1506, 1508, 1510, 1511, 1512, 1514, 1518, 1525, 1526, 1527, 1528, 1530, 1539, 1543, 1545, 1548, 1549, 1550, 1551, 1553, 1555, 1556, 1560, 1561, 1563, 1567, 1570, 1575, 1578, 1579, 1584, 1585, 1586, 1590, 1591, 1597, 1598, 1599, 1600, 1601, 1602, 1604, 1605, 1608, 1609, 1610, 1612, 1614, 1615, 1616, 1617, 1623, 1625, 1634, 1635, 1637, 1638, 1641, 1642, 1643, 1650, 1651, 1653, 1654, 1658, 1659, 1662, 1663, 1669, 1671, 1673, 1675, 1678, 1681, 1682, 1684, 1687, 1688, 1689, 1690, 1691, 1696, 1698, 1705, 1706, 1707, 1708, 1710, 1712, 1716, 1717, 1718, 1723, 1732, 1735, 1750, 1755, 1759, 1761, 1764, 1769, 1770, 1771, 1773, 1774, 1776, 1777, 1785, 1786, 1791, 1793, 1798, 1807, 1809, 1811, 1812, 1820, 1822, 1826, 1828, 1830, 1832, 1837, 1839, 1840, 1845, 1846, 1848, 1851, 1852, 1854, 1855, 1859, 1861, 1863, 1866, 1867, 1869, 1872, 1873, 1876, 1879, 1882, 1886, 1888, 1891, 1897, 1900, 1901, 1902, 1905, 1906, 1910, 1911, 1913, 1915, 1916, 1918, 1920, 1922, 1923, 1924, 1930, 1931, 1936, 1939, 1940, 1945, 1949, 1950, 1951, 1952, 1953, 1956, 1958, 1968, 1970, 1971, 1972, 1973, 1979, 1986, 1990, 1993, 1999, 2000, 2007, 2008, 2009, 2010, 2012, 2014, 2015, 2017, 2019, 2021, 2026, 2031, 2032, 2033, 2037, 2038, 2040, 2041, 2043, 2045, 2048, 2057, 2060, 2062, 2064, 2071, 2072, 2074, 2077, 2078, 2085, 2087, 2088, 2089, 2091, 2092, 2093, 2094, 2097, 2103, 2106, 2111, 2112, 2116, 2117, 2119, 2122, 2123, 2125, 2128, 2130, 2132, 2133, 2139, 2142, 2143, 2144, 2146, 2147, 2150, 2151, 2156, 2157, 2161, 2164, 2167, 2170, 2175, 2177, 2179, 2185, 2188, 2189, 2193, 2195, 2196, 2200, 2202, 2203, 2206, 2207, 2210, 2215, 2216, 2218, 2221, 2223, 2232, 2240, 2241, 2242, 2243, 2244, 2245, 2253, 2257, 2258, 2260, 2263, 2265, 2267, 2274, 2276, 2280, 2282, 2283, 2284, 2288, 2291, 2293, 2295, 2296, 2297, 2298, 2300, 2303, 2306, 2308, 2309, 2310, 2313, 2314, 2322, 2323, 2326, 2328, 2329, 2331, 2333, 2339, 2342, 2343, 2348, 2353, 2361, 2362, 2363, 2366, 2371, 2372, 2376, 2379, 2380, 2381, 2382, 2383, 2384, 2387, 2398, 2399, 2400, 2401, 2402, 2405, 2406, 2410, 2412, 2413, 2414, 2418, 2419, 2420, 2422, 2423, 2430, 2431, 2432, 2433, 2434, 2435, 2437, 2439, 2440, 2441, 2442, 2443, 2445, 2449, 2451, 2452, 2453, 2454, 2456, 2457, 2458, 2465, 2469, 2470, 2472, 2474, 2476, 2477, 2479, 2480, 2481, 2482, 2483, 2485, 2487, 2489, 2490, 2495, 2496, 2497, 2498, 2500, 2505, 2506, 2507, 2509, 2513, 2514, 2515, 2516, 2517, 2519, 2521, 2525, 2528, 2529, 2531, 2532, 2533, 2534, 2536, 2537, 2538, 2539, 2541, 2543, 2546, 2549, 2550, 2551, 2552, 2554, 2555, 2557, 2559, 2560, 2567, 2568, 2570, 2571, 2573, 2578, 2579, 2581, 2589, 2590, 2594, 2596, 2599, 2600, 2601, 2609, 2611, 2613, 2614, 2616, 2619, 2620, 2625, 2626, 2627, 2632, 2634, 2635, 2636, 2639, 2644, 2649, 2652, 2655, 2656, 2658, 2663, 2671, 2672, 2674, 2685, 2687, 2688, 2689, 2690, 2691, 2692, 2694, 2700, 2702, 2704, 2708, 2709, 2715, 2719, 2720, 2721, 2722, 2725, 2726, 2728, 2729, 2735, 2738, 2739, 2740, 2745, 2746, 2747, 2749, 2752, 2756, 2758, 2762, 2764, 2765, 2770, 2775, 2776, 2780, 2784, 2785, 2787, 2791, 2794, 2796, 2798, 2800, 2801, 2802, 2805, 2808, 2812, 2814, 2819, 2821, 2822, 2823, 2824, 2826, 2827, 2828, 2831, 2833, 2838, 2840, 2844, 2845, 2850, 2860, 2861, 2865, 2869, 2871, 2876, 2878, 2888, 2889, 2890, 2893, 2894, 2895, 2896, 2897, 2898, 2901, 2902, 2903, 2906, 2909, 2915, 2916, 2917, 2919, 2922, 2923, 2926, 2929, 2930, 2931, 2935, 2941, 2942, 2943, 2946, 2947, 2948, 2955, 2959, 2963, 2966, 2968, 2976, 2979, 2980, 2982, 2987, 2992, 2994, 3003, 3005, 3006, 3007, 3009, 3013, 3015, 3017, 3018, 3020, 3023, 3024, 3029, 3031, 3039, 3041, 3042, 3044, 3045, 3047, 3048, 3049, 3051, 3052, 3053, 3055, 3058, 3059, 3061, 3064, 3068, 3069, 3070, 3072, 3080, 3083, 3084, 3085, 3087, 3090, 3094, 3095, 3097, 3100, 3106, 3110, 3115, 3118, 3119, 3120, 3121, 3122, 3123, 3127, 3128, 3137, 3138, 3139, 3143, 3145, 3153, 3167, 3169, 3170, 3171, 3172, 3177, 3181, 3191, 3192, 3194, 3196, 3205, 3206, 3208, 3210, 3217, 3219, 3220, 3221, 3224, 3225, 3228, 3230, 3237, 3240, 3242, 3246, 3249, 3250, 3254, 3261, 3263, 3266, 3269, 3271, 3272, 3278, 3280, 3283, 3286, 3288, 3289, 3290, 3291, 3294, 3295, 3297, 3299, 3301, 3308, 3310, 3312, 3313, 3324, 3325, 3327, 3331, 3332, 3333, 3337, 3338, 3340, 3342, 3343, 3345, 3347, 3351, 3353, 3355, 3356, 3357, 3358, 3359, 3360, 3361, 3363, 3368, 3370, 3374, 3377, 3378, 3379, 3382, 3383, 3386, 3394, 3396, 3397, 3399, 3403, 3405, 3413, 3415, 3416, 3418, 3419, 3422, 3424, 3425, 3426, 3428, 3429, 3435, 3438, 3445, 3446, 3447, 3449, 3452, 3458, 3466, 3468, 3469, 3470, 3471, 3474, 3477, 3484, 3486, 3487, 3488, 3493, 3497, 3498, 3500, 3502, 3503, 3504, 3507, 3510, 3516, 3517, 3518, 3523, 3524, 3533, 3535, 3537, 3538, 3540, 3541, 3544, 3545, 3549, 3554, 3558, 3560, 3561, 3569, 3571, 3574, 3576, 3580, 3587, 3588, 3589, 3591, 3592, 3594, 3595, 3597, 3603, 3604, 3607, 3611, 3613, 3616, 3620, 3621, 3624, 3629, 3633, 3634, 3640, 3642, 3643, 3644, 3645, 3646, 3647, 3648, 3659, 3661, 3664, 3665, 3667, 3672, 3674, 3677, 3681, 3682, 3684, 3685, 3690, 3693, 3707, 3709, 3710, 3712, 3713, 3715, 3718, 3719, 3720, 3721, 3722, 3723, 3725, 3726, 3729, 3730, 3731, 3732, 3738, 3739, 3744, 3749, 3751, 3752, 3754, 3756, 3757, 3758, 3761, 3764, 3765, 3766, 3775, 3778, 3783, 3785, 3791, 3792, 3793, 3794, 3801, 3806, 3808, 3817, 3818, 3819, 3823, 3825, 3829, 3830, 3832, 3833, 3837, 3838, 3839, 3843, 3844, 3845, 3846, 3847, 3849, 3852, 3858, 3859, 3860, 3867, 3868, 3870, 3871, 3872, 3873, 3878, 3881, 3882, 3884, 3887, 3889, 3890, 3892, 3894, 3896, 3902, 3903, 3904, 3907, 3908, 3912, 3913, 3917, 3918, 3928, 3929, 3933, 3938, 3941, 3943, 3947, 3950, 3954, 3958, 3962, 3967, 3968, 3970, 3971, 3974, 3975, 3979, 3983, 3985, 3987, 3988, 3990, 3994, 3996, 4007, 4008, 4013, 4014, 4017, 4019, 4020, 4021, 4030, 4033, 4037, 4039, 4041, 4042, 4043, 4044, 4046, 4047, 4048, 4049, 4050, 4051, 4052, 4054, 4056, 4057, 4062, 4066, 4067, 4068, 4070, 4075, 4084, 4088, 4092, 4094, 4095, 4096, 4098, 4099, 4102, 4105, 4106, 4109, 4110, 4113, 4116, 4126, 4128, 4132, 4133, 4134, 4139, 4140, 4143, 4144, 4146, 4147, 4148, 4149, 4150, 4160, 4163, 4164, 4165, 4166, 4167, 4168, 4171, 4178, 4181, 4183, 4185, 4187, 4188, 4189, 4191, 4195, 4201, 4202, 4204, 4205, 4206, 4207, 4208, 4210, 4211, 4212, 4213, 4218, 4219, 4227, 4228, 4229, 4233, 4234, 4235, 4237, 4245, 4246, 4250, 4251, 4252, 4255, 4257, 4261, 4266, 4269, 4270, 4272, 4275, 4280, 4281, 4284, 4288, 4290, 4292, 4294, 4296, 4298, 4301, 4302, 4305, 4309, 4312, 4314, 4317, 4320, 4321, 4324, 4329, 4330, 4335, 4337, 4339, 4341, 4347, 4355, 4356, 4357, 4358, 4360, 4369, 4370, 4378, 4380, 4383, 4388, 4390, 4391, 4392, 4393, 4396, 4397, 4401, 4402, 4403, 4404, 4405, 4409, 4410, 4422, 4423, 4425, 4430, 4432, 4439, 4440, 4442, 4443, 4446, 4448, 4450, 4453, 4456, 4458, 4461, 4462, 4463, 4466, 4468, 4470, 4471, 4474, 4475, 4479, 4492, 4494, 4498, 4500, 4502, 4507, 4508, 4512, 4514, 4515, 4519, 4521, 4522, 4525, 4529, 4531, 4535, 4536, 4541, 4548, 4549, 4551, 4554, 4556, 4557, 4558, 4560, 4562, 4563, 4565, 4566, 4568, 4575, 4576, 4580, 4582, 4583, 4590, 4591, 4594, 4597, 4598, 4601, 4606, 4616, 4618, 4623, 4625, 4628, 4630, 4632, 4634, 4635, 4639, 4641, 4643, 4644, 4645, 4646, 4647, 4650, 4651, 4653, 4654, 4655, 4656, 4658, 4659, 4662, 4664, 4667, 4669, 4671, 4673, 4674, 4676, 4677, 4680, 4682, 4685, 4691, 4692, 4693, 4694, 4697, 4699, 4700, 4704, 4706, 4708, 4710, 4711, 4713, 4716, 4719, 4721, 4722, 4723, 4724, 4729, 4730, 4734, 4736, 4737, 4738, 4739, 4740, 4741, 4745, 4749, 4753, 4754, 4755, 4756, 4760, 4761, 4762, 4767, 4769, 4770, 4771, 4773, 4775, 4779, 4780, 4784, 4787, 4788, 4789, 4790, 4794, 4795, 4796, 4801, 4803, 4804, 4805, 4806, 4807, 4813, 4814, 4818, 4822, 4827, 4828, 4830, 4831, 4834, 4838, 4840, 4841, 4842, 4854, 4855, 4856, 4857, 4858, 4861, 4862, 4863, 4864, 4869, 4874, 4875, 4876, 4879, 4881, 4887, 4889, 4891, 4896, 4897, 4900, 4904, 4905, 4907, 4909, 4910, 4913, 4914, 4920, 4921, 4922, 4928, 4935, 4936, 4941, 4942, 4944, 4954, 4956, 4958, 4959, 4960, 4967, 4969, 4971, 4972, 4974, 4975, 4985, 4987, 4993, 4994, 4996, 5007, 5013, 5015, 5016, 5021, 5023, 5024, 5026, 5029, 5030, 5034, 5036, 5037, 5038, 5039, 5040, 5042, 5043, 5044, 5045, 5046, 5049, 5051, 5052, 5054, 5057, 5060, 5067, 5068, 5072, 5075, 5078, 5082, 5084, 5088, 5089, 5094, 5100, 5101, 5102, 5106, 5113, 5114, 5116, 5119, 5120, 5123, 5125, 5129, 5131, 5132, 5140, 5143, 5145, 5147, 5151, 5159, 5160, 5163, 5164, 5165, 5168, 5169, 5170, 5174, 5180, 5181, 5184, 5185, 5187, 5188, 5189, 5190, 5191, 5192, 5195, 5196, 5198, 5200, 5202, 5206, 5209, 5212, 5213, 5218, 5219, 5224, 5225, 5229, 5234, 5240, 5241, 5243, 5244, 5245, 5251, 5253, 5254, 5255, 5256, 5257, 5258, 5260, 5261, 5262, 5263, 5268, 5269, 5273, 5275, 5276, 5280, 5281, 5282, 5283, 5286, 5293, 5297, 5298, 5299, 5300, 5301, 5308, 5311, 5314, 5315, 5317, 5318, 5319, 5321, 5322, 5324, 5329, 5330, 5332, 5333, 5334, 5339, 5344, 5345, 5346, 5348, 5349, 5352, 5366, 5367, 5369, 5371, 5386, 5388, 5389, 5391, 5393, 5395, 5396, 5397, 5398, 5400, 5402, 5405, 5409, 5413, 5414, 5418, 5422, 5427, 5428, 5431, 5433, 5434, 5438, 5444, 5445, 5446, 5448, 5449, 5452, 5453, 5456, 5458, 5459, 5461, 5462, 5472, 5475, 5483, 5487, 5491, 5493, 5495, 5496, 5505, 5506, 5508, 5510, 5512, 5513, 5515, 5517, 5518, 5519, 5524, 5530, 5531, 5532, 5533, 5535, 5543, 5545, 5549, 5554, 5558, 5563, 5566, 5568, 5569, 5572, 5575, 5579, 5581, 5582, 5584, 5585, 5587, 5589, 5593, 5594, 5597, 5602, 5608, 5610, 5613, 5614, 5615, 5616, 5620, 5623, 5624, 5627, 5632, 5633, 5635, 5638, 5640, 5643, 5647, 5648, 5649, 5650, 5651, 5652, 5653, 5656, 5659, 5660, 5663, 5664, 5667, 5669, 5673, 5675, 5676, 5680, 5681, 5689, 5690, 5694, 5695, 5697, 5698, 5702, 5706, 5711, 5712, 5713, 5714, 5718, 5719, 5721, 5722, 5729, 5730, 5731, 5732, 5734, 5735, 5736, 5737, 5742, 5744, 5746, 5748, 5751, 5768, 5770, 5771, 5775, 5778, 5780, 5782, 5783, 5785, 5787, 5791, 5792, 5794, 5803, 5806, 5807, 5808, 5810, 5811, 5817, 5820, 5826, 5828, 5832, 5833, 5834, 5835, 5836, 5839, 5842, 5844, 5853, 5854, 5859, 5864, 5866, 5867, 5869, 5871, 5872, 5873, 5876, 5877, 5878, 5879, 5881, 5882, 5883, 5888, 5889, 5892, 5893, 5900, 5902, 5906, 5910, 5912, 5918, 5919, 5921, 5923, 5925, 5926, 5927, 5928, 5930, 5931, 5932, 5933, 5936, 5938, 5939, 5941, 5943, 5944, 5945, 5948, 5952, 5954, 5956, 5957, 5959, 5961, 5968, 5971, 5978, 5980, 5985, 5986, 5988, 5991, 5992, 5994, 5996, 5997, 6000, 6002, 6003, 6004, 6005, 6006, 6007, 6008, 6012, 6013, 6016, 6017, 6025, 6026, 6038, 6040, 6041, 6044, 6045, 6047, 6048, 6051, 6053, 6054, 6058, 6059, 6060, 6061, 6062, 6063, 6065, 6068, 6069, 6070, 6072, 6073, 6074, 6075, 6080, 6081, 6083, 6085, 6088, 6092, 6093, 6094, 6095, 6096, 6098, 6107, 6108, 6109, 6110, 6112, 6113, 6116, 6118, 6119, 6122, 6125, 6129, 6130, 6131, 6132, 6133, 6136, 6137, 6143, 6145, 6146, 6147, 6151, 6152, 6153, 6156, 6160, 6163, 6164, 6165, 6168, 6170, 6182, 6183, 6186, 6188, 6189, 6190, 6191, 6193, 6196, 6197, 6198, 6200, 6205, 6207, 6209, 6212, 6215, 6219, 6220, 6221, 6223, 6224, 6227, 6228, 6230, 6231, 6234, 6238, 6241, 6243, 6246, 6249, 6250, 6251, 6255, 6257, 6258, 6259, 6264, 6265, 6269, 6270, 6271, 6272, 6273, 6275, 6278, 6279, 6280, 6281, 6282, 6283, 6284, 6285, 6286, 6292, 6294, 6296, 6299, 6300, 6302, 6309, 6310, 6311, 6315, 6317, 6319, 6321, 6322, 6325, 6326, 6328, 6330, 6333, 6338, 6345, 6351, 6352, 6353, 6354, 6359, 6360, 6362, 6363, 6364, 6367, 6370, 6372, 6375, 6378, 6381, 6383, 6394, 6396, 6397, 6398, 6399, 6403, 6405, 6407, 6412, 6414, 6415, 6419, 6420, 6422, 6429, 6430, 6431, 6434, 6436, 6437, 6440, 6441, 6442, 6454, 6458, 6459, 6464, 6466, 6467, 6468, 6469, 6470, 6471, 6474, 6478, 6480, 6482, 6484, 6486, 6488, 6493, 6495, 6499, 6500, 6501, 6502, 6503, 6504, 6505, 6510, 6513, 6516, 6517, 6519, 6524, 6526, 6530, 6533, 6534, 6535, 6537, 6539, 6543, 6544, 6547, 6548, 6549, 6554, 6555, 6558, 6560, 6561, 6563, 6567, 6572, 6574, 6576, 6577, 6579, 6581, 6582, 6584, 6587, 6588, 6595, 6597, 6598, 6600, 6603, 6611, 6621, 6622, 6624, 6626, 6627, 6628, 6630, 6634, 6635, 6637, 6638, 6639, 6643, 6644, 6649, 6650, 6652, 6655, 6656, 6658, 6662, 6666, 6671, 6673, 6679, 6691, 6692, 6695, 6699, 6703, 6705, 6706, 6711, 6714, 6716, 6718, 6720, 6724, 6729, 6731, 6734, 6736, 6737, 6739, 6746, 6747, 6748, 6749, 6758, 6759, 6761, 6766, 6778, 6779, 6780, 6786, 6788, 6793, 6794, 6795, 6799, 6803, 6804, 6805, 6807, 6810, 6811, 6812, 6813, 6816, 6817, 6819, 6820, 6821, 6824, 6827, 6828, 6830, 6831, 6834, 6836, 6839, 6840, 6841, 6843, 6845, 6851, 6852, 6859, 6864, 6869, 6870, 6872, 6874, 6875, 6876, 6878, 6879, 6880, 6886, 6888, 6897, 6903, 6904, 6906, 6907, 6909, 6914, 6915, 6919, 6920, 6921, 6930, 6933, 6936, 6941, 6943, 6946, 6948, 6950, 6952, 6959, 6960, 6963, 6969, 6970, 6979, 6980, 6984, 6985, 6987, 6988, 6990, 6993, 6994, 6999, 7006, 7010, 7012, 7013, 7015, 7022, 7031, 7032, 7038, 7042, 7043, 7045, 7046, 7051, 7052, 7053, 7056, 7057, 7064, 7069, 7072, 7074, 7075, 7077, 7083, 7085, 7086, 7097, 7103, 7105, 7106, 7107, 7108, 7109, 7112, 7113, 7116, 7117, 7118, 7124, 7130, 7132, 7134, 7135, 7137, 7140, 7142, 7144, 7146, 7149, 7155, 7163, 7164, 7165, 7166, 7169, 7173, 7176, 7177, 7181, 7182, 7184, 7187, 7188, 7192, 7193, 7194, 7196, 7201, 7203, 7206, 7207, 7209, 7212, 7216, 7217, 7218, 7219, 7227, 7228, 7230, 7232, 7233, 7234, 7236, 7239, 7240, 7243, 7244, 7245, 7248, 7255, 7257, 7258, 7259, 7262, 7267, 7268, 7274, 7276, 7277, 7278, 7281, 7282, 7284, 7287, 7288, 7290, 7291, 7292, 7293, 7298, 7299, 7300, 7301, 7303, 7304, 7305, 7306, 7307, 7308, 7310, 7313, 7315, 7317, 7321, 7328, 7330, 7334, 7340, 7344, 7345, 7348, 7354, 7355, 7356, 7357, 7358, 7361, 7365, 7371, 7373, 7379, 7382, 7383, 7388, 7389, 7392, 7398, 7400, 7407, 7409, 7411, 7415, 7425, 7427, 7428, 7430, 7434, 7436, 7438, 7441, 7443, 7444, 7446, 7447, 7452, 7453, 7454, 7458, 7459, 7466, 7470, 7472, 7474, 7475, 7483, 7486, 7487, 7490, 7492, 7493, 7504, 7505, 7506, 7512, 7514, 7515, 7517, 7518, 7523, 7524, 7525, 7528, 7533, 7537, 7538, 7542, 7546, 7547, 7548, 7554, 7557, 7561, 7570, 7577, 7578, 7579, 7580, 7583, 7585, 7586, 7590, 7591, 7595, 7601, 7605, 7611, 7619, 7620, 7621, 7623, 7624, 7633, 7639, 7640, 7642, 7643, 7652, 7653, 7658, 7661, 7663, 7664, 7665, 7666, 7667, 7674, 7677, 7678, 7679, 7680, 7682, 7685, 7687, 7689, 7695, 7699, 7700, 7703, 7704, 7708, 7712, 7713, 7717, 7718, 7719, 7724, 7725, 7727, 7729, 7736, 7737, 7738, 7739, 7740, 7743, 7744, 7745, 7747, 7751, 7753, 7761, 7762, 7763, 7764, 7768, 7769, 7770, 7774, 7775, 7777, 7778, 7779, 7782, 7785, 7786, 7788, 7791, 7793, 7796, 7800, 7802, 7803, 7804, 7806, 7807, 7812, 7815, 7818, 7819, 7820, 7824, 7825, 7832, 7833, 7834, 7838, 7841, 7844, 7845, 7848, 7849, 7856, 7859, 7860, 7862, 7863, 7865, 7870, 7876, 7878, 7880, 7881, 7888, 7890, 7893, 7896, 7900, 7908, 7910, 7911, 7917, 7918, 7923, 7925, 7927, 7929, 7933, 7934, 7935, 7936, 7938, 7942, 7944, 7945, 7946, 7947, 7948, 7952, 7955, 7956, 7960, 7964, 7972, 7974, 7976, 7977, 7978, 7980, 7981, 7983, 7984, 7986, 7989, 7990, 7991, 7993, 7998, 7999, 8004, 8006, 8009, 8012, 8023, 8026, 8029, 8036, 8039, 8042, 8044, 8047, 8052, 8053, 8056, 8058, 8059, 8061, 8063, 8067, 8068, 8071, 8075, 8076, 8077, 8078, 8080, 8082, 8084, 8088, 8091, 8093, 8095, 8097, 8100, 8103, 8105, 8106, 8112, 8116, 8118, 8121, 8126, 8136, 8137, 8143, 8148, 8150, 8151, 8159, 8162, 8163, 8164, 8165, 8168, 8170, 8176, 8178, 8179, 8182, 8184, 8185, 8187, 8188, 8189, 8192, 8193, 8195, 8199, 8202, 8204, 8207, 8208, 8211, 8213, 8216, 8219, 8222, 8223, 8225, 8227, 8231, 8234, 8235, 8236, 8237, 8239, 8242, 8245, 8250, 8252, 8253, 8257, 8258, 8266, 8268, 8269, 8270, 8272, 8274, 8282, 8289, 8292, 8293, 8294, 8300, 8301, 8304, 8310, 8311, 8312, 8317, 8318, 8319, 8320, 8329, 8331, 8339, 8340, 8349, 8350, 8352, 8353, 8355, 8361, 8363, 8367, 8368, 8373, 8379, 8385, 8387, 8389, 8390, 8392, 8395, 8401, 8402, 8403, 8404, 8405, 8409, 8410, 8413, 8414, 8415, 8416, 8423, 8432, 8433, 8435, 8436, 8438, 8439, 8441, 8442, 8444, 8446, 8447, 8448, 8450, 8451, 8452, 8456, 8458, 8459, 8472, 8473, 8474, 8476, 8480, 8481, 8482, 8485, 8486, 8490, 8493, 8498, 8501, 8505, 8509, 8511, 8513, 8515, 8517, 8520, 8523, 8524, 8525, 8527, 8528, 8531, 8533, 8535, 8537, 8538, 8539, 8542, 8544, 8546, 8549, 8550, 8552, 8553, 8554, 8561, 8562, 8565, 8566, 8568, 8575, 8576, 8579, 8580, 8581, 8582, 8589, 8590, 8592, 8593, 8594, 8596, 8597, 8599, 8600, 8601, 8602, 8603, 8605, 8609, 8611, 8612, 8614, 8617, 8618, 8624, 8630, 8631, 8634, 8637, 8638, 8640, 8642, 8644, 8648, 8650, 8654, 8657, 8658, 8659, 8663, 8665, 8669, 8672, 8676, 8677, 8685, 8693, 8694, 8700, 8703, 8704, 8706, 8708, 8709, 8714, 8715, 8716, 8717, 8720, 8721, 8726, 8728, 8729, 8732, 8734, 8736, 8741, 8742, 8743, 8744, 8745, 8746, 8748, 8752, 8757, 8764, 8766, 8767, 8770, 8772, 8773, 8776, 8777, 8779, 8782, 8783, 8784, 8789, 8792, 8797, 8803, 8805, 8810, 8818, 8821, 8822, 8824, 8829, 8830, 8831, 8832, 8834, 8835, 8838, 8843, 8846, 8848, 8853, 8854, 8859, 8861, 8865, 8866, 8867, 8878, 8881, 8883, 8886, 8888, 8890, 8891, 8892, 8896, 8899, 8900, 8902, 8907, 8908, 8909, 8910, 8911, 8913, 8914, 8917, 8924, 8926, 8929, 8930, 8935, 8938, 8941, 8942, 8945, 8946, 8949, 8951, 8954, 8956, 8957, 8960, 8961, 8962, 8963, 8967, 8968, 8969, 8972, 8974, 8976, 8977, 8979, 8980, 8981, 8985, 8986, 8992, 8998, 8999, 9001, 9002, 9003, 9006, 9009, 9012, 9015, 9018, 9020, 9021, 9023, 9029, 9030, 9033, 9037, 9044, 9052, 9056, 9057, 9058, 9059, 9060, 9061, 9066, 9069, 9071, 9072, 9073, 9074, 9076, 9084, 9091, 9092, 9095, 9096, 9097, 9107, 9108, 9110, 9111, 9112, 9114, 9118, 9123, 9124, 9125, 9128, 9129, 9133, 9134, 9138, 9139, 9140, 9141, 9142, 9146, 9149, 9151, 9152, 9155, 9172, 9173, 9174, 9175, 9177, 9181, 9183, 9185, 9187, 9188, 9190, 9191, 9195, 9199, 9206, 9207, 9210, 9211, 9213, 9215, 9216, 9223, 9226, 9229, 9233, 9241, 9243, 9247, 9249, 9252, 9253, 9254, 9255, 9263, 9265, 9267, 9270, 9273, 9278, 9284, 9285, 9288, 9290, 9292, 9293, 9298, 9299, 9300, 9304, 9308, 9311, 9314, 9316, 9318, 9320, 9321, 9323, 9325, 9326, 9327, 9328, 9329, 9330, 9336, 9337, 9338, 9339, 9340, 9341, 9345, 9346, 9347, 9348, 9354, 9355, 9359, 9366, 9367, 9373, 9374, 9375, 9376, 9378, 9382, 9383, 9388, 9389, 9391, 9392, 9393, 9394, 9396, 9398, 9400, 9402, 9403, 9404, 9406, 9407, 9412, 9413, 9414, 9415, 9423, 9432, 9433, 9434, 9439, 9440, 9442, 9444, 9449, 9451, 9452, 9455, 9456, 9460, 9468, 9471, 9472, 9473, 9478, 9481, 9483, 9488, 9490, 9494, 9495, 9497, 9500, 9501, 9502, 9503, 9504, 9505, 9509, 9514, 9515, 9517, 9518, 9519, 9528, 9531, 9533, 9534, 9536, 9540, 9545, 9546, 9548, 9549, 9553, 9555, 9563, 9564, 9565, 9568, 9571, 9577, 9582, 9583, 9587, 9589, 9590, 9591, 9596, 9602, 9606, 9609, 9613, 9614, 9617, 9618, 9620, 9623, 9624, 9626, 9627, 9628, 9629, 9632, 9633, 9635, 9640, 9641, 9642, 9644, 9645, 9646, 9648, 9653, 9655, 9656, 9658, 9660, 9663, 9668, 9670, 9677, 9681, 9682, 9686, 9692, 9698, 9700, 9706, 9707, 9715, 9718, 9722, 9723, 9724, 9725, 9726, 9729, 9730, 9731, 9733, 9734, 9746, 9750, 9751, 9753, 9754, 9756, 9763, 9764, 9767, 9768, 9770, 9776, 9780, 9781, 9782, 9784, 9786, 9792, 9793, 9794, 9796, 9799, 9812, 9813, 9816, 9819, 9824, 9825, 9830, 9833, 9836, 9845, 9847, 9849, 9850, 9851, 9853, 9854, 9861, 9864, 9866, 9871, 9873, 9882, 9886, 9887, 9892, 9897, 9901, 9902, 9906, 9907, 9908, 9909, 9910, 9912, 9916, 9924, 9928, 9930, 9935, 9938, 9940, 9946, 9947, 9949, 9950, 9953, 9955, 9957, 9960, 9962, 9963, 9964, 9967, 9968, 9971, 9972, 9979, 9980, 9982, 9984, 9985, 9987, 9988, 9990, 9997, 9998, 10000, 10009, 10010, 10017, 10019, 10021, 10022, 10026, 10033, 10034, 10035, 10037, 10038, 10041, 10042, 10043, 10045, 10048, 10051, 10052, 10054, 10056, 10058, 10059, 10060, 10062, 10063, 10064, 10068, 10075, 10077, 10078, 10083, 10089, 10091, 10092, 10093, 10095, 10097, 10101, 10102, 10103, 10105, 10106, 10107, 10108, 10109, 10110, 10112, 10114, 10115, 10116, 10117, 10118, 10119, 10122, 10127, 10128, 10131, 10132, 10136, 10143, 10146, 10149, 10151, 10152, 10158, 10162, 10163, 10165, 10166, 10168, 10170, 10174, 10176, 10178, 10181, 10182, 10187, 10191, 10192, 10193, 10194, 10195, 10196, 10197, 10199, 10203, 10209, 10214, 10218, 10219, 10220, 10222, 10223, 10225, 10228, 10231, 10233, 10236, 10237, 10238, 10239, 10247, 10252, 10253, 10255, 10257, 10258, 10259, 10275, 10284, 10286, 10291, 10292, 10293, 10295, 10300, 10302, 10306, 10307, 10311, 10321, 10323, 10324, 10325, 10326, 10328, 10330, 10331, 10333, 10334, 10335, 10336, 10344, 10346, 10352, 10353, 10357, 10359, 10360, 10362, 10364, 10368, 10371, 10373, 10375, 10376, 10378, 10380, 10381, 10384, 10385, 10388, 10389, 10397, 10398, 10399, 10400, 10401, 10405, 10408, 10410, 10413, 10414, 10416, 10421, 10422, 10423, 10425, 10427, 10430, 10435, 10437, 10438, 10440, 10442, 10443, 10446, 10448, 10449, 10450, 10451, 10452, 10453, 10463, 10464, 10465, 10466, 10468, 10469, 10470, 10472, 10473, 10474, 10478, 10480, 10482, 10492, 10494, 10495, 10496, 10504, 10506, 10508, 10513, 10514, 10515, 10518, 10521, 10525, 10527, 10528, 10530, 10531, 10533, 10535, 10536, 10541, 10542, 10543, 10544, 10547, 10548, 10549, 10550, 10551, 10555, 10556, 10558, 10560, 10561, 10563, 10564, 10565, 10567, 10569, 10571, 10580, 10581, 10582, 10583, 10585, 10593, 10595, 10596, 10597, 10599, 10600, 10601, 10602, 10606, 10609, 10610, 10611, 10613, 10614, 10615, 10616, 10617, 10621, 10622, 10623, 10626, 10628, 10629, 10630, 10631, 10633, 10637, 10638, 10639, 10640, 10641, 10642, 10645, 10646, 10648, 10649, 10650, 10655, 10657, 10659, 10663, 10665, 10668, 10671, 10674, 10675, 10677, 10678, 10681, 10682, 10683, 10684, 10685, 10686, 10687, 10689, 10693, 10697, 10698, 10699, 10700, 10702, 10703, 10705, 10707, 10708, 10710, 10711, 10712, 10715, 10716, 10722, 10723, 10725, 10726, 10732, 10734, 10735, 10736, 10737, 10738, 10740, 10744, 10748, 10749, 10752, 10753, 10756, 10761, 10762, 10763, 10766, 10775, 10778, 10779, 10782, 10784, 10787, 10788, 10790, 10791, 10792, 10795, 10796, 10798, 10800, 10801, 10802, 10803, 10805, 10809, 10810, 10811, 10813, 10815, 10818, 10819, 10820, 10821, 10824, 10825, 10826, 10831, 10833, 10836, 10838, 10839, 10840, 10841, 10843, 10845, 10846, 10850, 10852, 10853, 10858, 10860, 10861, 10862, 10864, 10867, 10871, 10874, 10877, 10880, 10881, 10892, 10896, 10897, 10898, 10899, 10902, 10903, 10905, 10912, 10917, 10920, 10926, 10930, 10933, 10934, 10935, 10936, 10937, 10938, 10940, 10941, 10944, 10947, 10948, 10950, 10954, 10957, 10960, 10962, 10963, 10964, 10965, 10967, 10972, 10977, 10978, 10985, 10988, 10993, 10995, 10996, 10997, 10998, 10999, 11002, 11004, 11005, 11006, 11008, 11009, 11010, 11015, 11016, 11018, 11022, 11024, 11032, 11039, 11044, 11046, 11047, 11053, 11056, 11060, 11061, 11066, 11068, 11070, 11071, 11072, 11078, 11080, 11082, 11083, 11086, 11090, 11095, 11098, 11100, 11102, 11105, 11107, 11108, 11110, 11114, 11116, 11118, 11119, 11123, 11124, 11125, 11126, 11127, 11129, 11131, 11135, 11137, 11138, 11145, 11146, 11153, 11154, 11158, 11159, 11160, 11161, 11162, 11163, 11166, 11168, 11169, 11175, 11177, 11178, 11179, 11180, 11184, 11187, 11188, 11190, 11191, 11192, 11198, 11199, 11200, 11201, 11202, 11203, 11207, 11214, 11217, 11218, 11222, 11226, 11227, 11232, 11233, 11234, 11235, 11236, 11237, 11238, 11239, 11246, 11247, 11248, 11254, 11255, 11256, 11257, 11258, 11259, 11260, 11262, 11263, 11264, 11266, 11274, 11275, 11278, 11286, 11288, 11289, 11290, 11291, 11292, 11293, 11294, 11295, 11298, 11305, 11306, 11307, 11308, 11312, 11313, 11315, 11318, 11319, 11320, 11322, 11324, 11326, 11329, 11332, 11337, 11339, 11340, 11345, 11346, 11348, 11352, 11356, 11358, 11363, 11365, 11366, 11370, 11371, 11373, 11376, 11377, 11378, 11381, 11382, 11388, 11389, 11391, 11392, 11394, 11395, 11397, 11402, 11403, 11405, 11406, 11409, 11416, 11418, 11420, 11423, 11424, 11428, 11430, 11431, 11434, 11437, 11438, 11443, 11446, 11449, 11451, 11458, 11459, 11463, 11465, 11466, 11467, 11468, 11471, 11472, 11473, 11475, 11476, 11478, 11481, 11482, 11485, 11487, 11490, 11494, 11496, 11497, 11498, 11500, 11506, 11507, 11508, 11509, 11512, 11513, 11516, 11518, 11520, 11523, 11526, 11527, 11528, 11530, 11531, 11532, 11533, 11534, 11538, 11540, 11541, 11544, 11545, 11546, 11548, 11551, 11553, 11558, 11560, 11561, 11567, 11568, 11571, 11576, 11577, 11578, 11579, 11580, 11583, 11589, 11593, 11594, 11595, 11596, 11597, 11599, 11604, 11610, 11615, 11618, 11620, 11621, 11623, 11625, 11628, 11629, 11632, 11633, 11638, 11639, 11642, 11650, 11652, 11654, 11655, 11656, 11657, 11658, 11663, 11667, 11668, 11669, 11673, 11678, 11681, 11682, 11683, 11689, 11691, 11692, 11693, 11694, 11695, 11701, 11703, 11705, 11707, 11711, 11712, 11721, 11725, 11726, 11730, 11731, 11733, 11736, 11741, 11743, 11744, 11753, 11755, 11756, 11759, 11760, 11761, 11762, 11763, 11764, 11765, 11766, 11767, 11770, 11771, 11776, 11781, 11782, 11783, 11785, 11786, 11790, 11792, 11799, 11800, 11809, 11812, 11813, 11814, 11816, 11818, 11819, 11821, 11823, 11826, 11828, 11830, 11837, 11839, 11841, 11846, 11849, 11850, 11851, 11856, 11858, 11863, 11868, 11870, 11872, 11876, 11877, 11878, 11881, 11886, 11890, 11891, 11894, 11895, 11898, 11899, 11903, 11908, 11909, 11913, 11919, 11920, 11921, 11922, 11923, 11926, 11928, 11929, 11930, 11934, 11935, 11939, 11940, 11941, 11943, 11946, 11947, 11948, 11949, 11952, 11953, 11955, 11957, 11958, 11959, 11960, 11961, 11962, 11963, 11965, 11976, 11977, 11978, 11979, 11980, 11983, 11988, 11993, 11994, 11995, 11996, 11997, 11998, 11999, 12002, 12004, 12016, 12017, 12018, 12019, 12020, 12021, 12023, 12024, 12025, 12030, 12032, 12042, 12043, 12044, 12047, 12050, 12051, 12054, 12059, 12060, 12061, 12064, 12068, 12078, 12079, 12080, 12081, 12082, 12083, 12086, 12091, 12092, 12093, 12097, 12098, 12104, 12106, 12109, 12110, 12112, 12115, 12118, 12120, 12122, 12128, 12129, 12131, 12134, 12135, 12136, 12138, 12139, 12140, 12143, 12144, 12145, 12146, 12147, 12148, 12151, 12155, 12161, 12162, 12165, 12166, 12167, 12170, 12171, 12174, 12179, 12181, 12186, 12192, 12197, 12202, 12204, 12208, 12212, 12214, 12215, 12217, 12223, 12227, 12230, 12233, 12234, 12237, 12240, 12241, 12243, 12245, 12246, 12249, 12250, 12252, 12253, 12254, 12255, 12256, 12259, 12265, 12268, 12269, 12271, 12278, 12280, 12284, 12285, 12286, 12287, 12293, 12295, 12296, 12310, 12311, 12312, 12313, 12314, 12315, 12317, 12319, 12321, 12323, 12325, 12328, 12331, 12333, 12334, 12339, 12342, 12343, 12345, 12347, 12350, 12354, 12356, 12359, 12364, 12366, 12375, 12376, 12379, 12380, 12381, 12385, 12390, 12393, 12397, 12400, 12401, 12403, 12404, 12406, 12410, 12411, 12414, 12415, 12416, 12419, 12420, 12423, 12424, 12425, 12426, 12427, 12437, 12438, 12440, 12444, 12445, 12450, 12451, 12455, 12456, 12457, 12459, 12461, 12462, 12465, 12467, 12468, 12470, 12472, 12473, 12475, 12478, 12481, 12487, 12488, 12489, 12492, 12494, 12495, 12497, 12499, 12501, 12502, 12503, 12508, 12510, 12511, 12512, 12513, 12514, 12515, 12518, 12519, 12527, 12529, 12530, 12531, 12535, 12536, 12537, 12538, 12540, 12546, 12547, 12548, 12551, 12552, 12554, 12555, 12556, 12561, 12563, 12565, 12567, 12568, 12570, 12572, 12577, 12578, 12583, 12585, 12586, 12588, 12589, 12590, 12591, 12600, 12603, 12605, 12608, 12609, 12610, 12616, 12620, 12622, 12623, 12626, 12628, 12629, 12634, 12638, 12639, 12640, 12641, 12644, 12648, 12651, 12654, 12655, 12663, 12664, 12668, 12670, 12674, 12679, 12681, 12683, 12684, 12685, 12688, 12689, 12691, 12695, 12696, 12697, 12699, 12701, 12702, 12705, 12706, 12708, 12714, 12723, 12731, 12732, 12733, 12739, 12740, 12741, 12742, 12752, 12753, 12754, 12755, 12757, 12758, 12760, 12764, 12766, 12771, 12775, 12777, 12782, 12790, 12794, 12797, 12799, 12802, 12804, 12807, 12810, 12812, 12813, 12817, 12818, 12819, 12820, 12822, 12823, 12824, 12826, 12827, 12828, 12830, 12834, 12835, 12837, 12838, 12839, 12843, 12844, 12848, 12849, 12853, 12858, 12860, 12861, 12866, 12870, 12873, 12878, 12882, 12883, 12884, 12887, 12891, 12898, 12899, 12900, 12901, 12902, 12903, 12904, 12905, 12906, 12908, 12910, 12912, 12921, 12923, 12928, 12929, 12932, 12933, 12934, 12935, 12945, 12946, 12947, 12950, 12952, 12956, 12958, 12959, 12960, 12961, 12963, 12967, 12968, 12969, 12973, 12978, 12984, 12986, 12987, 12988, 12990, 12991, 12999, 13001, 13003, 13004, 13005, 13007, 13010, 13013, 13014, 13015, 13017, 13018, 13022, 13027, 13030, 13031, 13033, 13034, 13035, 13040, 13041, 13047, 13049, 13053, 13054, 13055, 13056, 13060, 13061, 13062, 13064, 13066, 13071, 13075, 13079, 13083, 13085, 13086, 13087, 13099, 13101, 13102, 13105, 13106, 13110, 13111, 13112, 13114, 13115, 13117, 13118, 13120, 13121, 13123, 13124, 13125, 13128, 13131, 13134, 13135, 13136, 13148, 13149, 13151, 13154, 13159, 13160, 13169, 13170, 13175, 13182, 13186, 13187, 13189, 13190, 13197, 13198, 13199, 13206, 13209, 13212, 13215, 13217, 13220, 13221, 13224, 13227, 13228, 13232, 13234, 13235, 13236, 13237, 13239, 13241, 13250, 13251, 13255, 13256, 13259, 13261, 13262, 13263, 13264, 13265, 13268, 13271, 13274, 13281, 13283, 13284, 13293, 13297, 13298, 13301, 13303, 13304, 13312, 13313, 13315, 13317, 13326, 13329, 13332, 13340, 13343, 13345, 13346, 13347, 13348, 13350, 13352, 13361, 13363, 13367, 13368, 13369, 13370, 13377, 13380, 13381, 13385, 13386, 13388, 13391, 13393, 13394, 13395, 13396, 13397, 13398, 13403, 13407, 13408, 13410, 13416, 13417, 13419, 13423, 13424, 13429, 13430, 13433, 13439, 13441, 13444, 13448, 13456, 13463, 13467, 13469, 13473, 13474, 13475, 13477, 13478, 13480, 13484, 13489, 13492, 13499, 13503, 13504, 13513, 13514, 13515, 13516, 13519, 13521, 13522, 13524, 13525, 13526, 13528, 13539, 13540, 13543, 13544, 13546, 13547, 13549, 13551, 13552, 13553, 13555, 13558, 13559, 13561, 13568, 13569, 13574, 13580, 13584, 13587, 13597, 13599, 13600, 13601, 13602, 13604, 13605, 13606, 13612, 13613, 13620, 13621, 13623, 13628, 13630, 13631, 13632, 13634, 13636, 13637, 13638, 13639, 13641, 13643, 13647, 13650, 13651, 13652, 13653, 13654, 13662, 13663, 13665, 13668, 13669, 13677, 13678, 13679, 13683, 13684, 13687, 13688, 13689, 13690, 13693, 13697, 13698, 13699, 13700, 13706, 13710, 13712, 13713, 13714, 13715, 13716, 13719, 13720, 13722, 13727, 13729, 13734, 13739, 13742, 13745, 13747, 13749, 13750, 13753, 13756, 13764, 13767, 13772, 13773, 13775, 13777, 13779, 13780, 13782, 13783, 13785, 13786, 13787, 13791, 13794, 13796, 13799, 13806, 13809, 13816, 13817, 13818, 13819, 13822, 13823, 13828, 13830, 13834, 13835, 13843, 13849, 13852, 13858, 13866, 13869, 13872, 13873, 13875, 13877, 13879, 13885, 13887, 13888, 13891, 13892, 13895, 13897, 13898, 13899, 13901, 13904, 13906, 13908, 13909, 13910, 13911, 13915, 13917, 13918, 13919, 13930, 13934, 13944, 13947, 13950, 13953, 13954, 13958, 13960, 13961, 13963, 13969, 13970, 13975, 13984, 13986, 13987, 13991, 14000, 14001, 14005, 14006, 14008, 14014, 14017, 14018, 14022, 14027, 14028, 14030, 14031, 14036, 14038, 14040, 14043, 14051, 14052, 14054, 14059, 14062, 14063, 14066, 14067, 14069, 14070, 14071, 14073, 14074, 14075, 14076, 14078, 14081, 14085, 14086, 14087, 14088, 14092, 14094, 14096, 14097, 14106, 14112, 14115, 14116, 14117, 14118, 14119, 14121, 14122, 14124, 14129, 14132, 14133, 14135, 14138, 14139, 14140, 14141, 14142, 14143, 14145, 14146, 14147.

Promoters expressing in the endosperm at 15 days after pollination include SEQ IDs: 3, 7, 12, 14, 15, 17, 29, 31, 34, 36, 37, 48, 54, 57, 64, 65, 79, 80, 86, 88, 90, 93, 94, 95, 96, 98, 99, 102, 103, 104, 108, 110, 117, 123, 126, 128, 130, 131, 134, 136, 137, 143, 146, 152, 154, 156, 157, 159, 162, 165, 168, 169, 172, 174, 175, 176, 181, 183, 187, 191, 193, 194, 197, 199, 202, 203, 204, 205, 207, 210, 211, 212, 214, 232, 233, 235, 236, 237, 239, 240, 242, 246, 249, 250, 251, 256, 257, 259, 264, 267, 269, 270, 271, 280, 286, 288, 293, 294, 299, 301, 302, 305, 306, 308, 309, 316, 319, 320, 322, 323, 328, 329, 332, 334, 335, 338, 340, 349, 352, 354, 355, 356, 358, 359, 360, 362, 364, 365, 367, 371, 372, 373, 374, 381, 388, 389, 396, 401, 411, 412, 414, 416, 423, 428, 431, 432, 433, 434, 441, 448, 450, 452, 456, 459, 461, 462, 463, 466, 470, 471, 474, 478, 483, 485, 488, 489, 493, 496, 498, 504, 507, 509, 510, 511, 514, 516, 517, 523, 525, 528, 532, 537, 541, 543, 544, 546, 547, 548, 553, 554, 557, 560, 561, 562, 573, 578, 580, 582, 585, 589, 591, 594, 595, 596, 599, 601, 602, 604, 606, 607, 608, 613, 619, 620, 623, 629, 630, 631, 633, 635, 636, 637, 638, 643, 645, 647, 656, 661, 663, 664, 670, 671, 681, 683, 684, 692, 693, 694, 701, 702, 705, 706, 707, 708, 709, 717, 718, 719, 721, 722, 724, 727, 731, 732, 733, 734, 739, 740, 742, 744, 749, 753, 757, 759, 760, 761, 762, 764, 765, 779, 781, 783, 784, 786, 793, 795, 800, 804, 808, 809, 811, 812, 820, 821, 822, 824, 825, 826, 829, 830, 831, 832, 833, 834, 835, 841, 845, 846, 855, 856, 857, 858, 860, 862, 863, 865, 869, 870, 871, 875, 876, 877, 890, 891, 892, 893, 895, 897, 898, 899, 903, 907, 908, 910, 911, 912, 915, 916, 917, 919, 920, 924, 928, 929, 931, 932, 936, 938, 939, 942, 943, 947, 949, 951, 953, 955, 957, 958, 960, 961, 964, 971, 974, 975, 977, 978, 979, 980, 982, 984, 985, 987, 991, 996, 999, 1002, 1007, 1008, 1009, 1010, 1011, 1012, 1013, 1014, 1016, 1017, 1019, 1021, 1022, 1025, 1026, 1032, 1033, 1035, 1038, 1039, 1041, 1042, 1043, 1045, 1046, 1047, 1049, 1051, 1052, 1055, 1056, 1057, 1064, 1065, 1069, 1070, 1073, 1077, 1080, 1086, 1087, 1089, 1092, 1095, 1096, 1100, 1101, 1103, 1104, 1112, 1114, 1115, 1116, 1117, 1119, 1121, 1125, 1127, 1130, 1132, 1136, 1137, 1140, 1144, 1146, 1154, 1155, 1160, 1161, 1165, 1167, 1168, 1170, 1171, 1174, 1176, 1178, 1183, 1187, 1191, 1196, 1200, 1204, 1205, 1214, 1215, 1218, 1220, 1222, 1223, 1225, 1228, 1230, 1232, 1233, 1236, 1240, 1244, 1248, 1249, 1250, 1251, 1252, 1253, 1254, 1257, 1258, 1261, 1262, 1263, 1269, 1272, 1277, 1281, 1285, 1286, 1290, 1291, 1292, 1293, 1296, 1306, 1307, 1309, 1310, 1311, 1312, 1314, 1316, 1320, 1321, 1322, 1323, 1327, 1330, 1331, 1334, 1339, 1344, 1345, 1349, 1360, 1361, 1364, 1365, 1366, 1367, 1368, 1371, 1375, 1376, 1377, 1380, 1387, 1388, 1389, 1391, 1393, 1396, 1399, 1402, 1404, 1405, 1406, 1412, 1415, 1420, 1421, 1423, 1426, 1431, 1432, 1433, 1438, 1440, 1441, 1442, 1447, 1451, 1453, 1458, 1459, 1462, 1466, 1471, 1472, 1475, 1484, 1488, 1490, 1491, 1493, 1497, 1498, 1499, 1501, 1503, 1506, 1508, 1510, 1511, 1512, 1518, 1520, 1525, 1526, 1527, 1528, 1530, 1539, 1543, 1545, 1549, 1550, 1551, 1553, 1555, 1556, 1560, 1561, 1563, 1567, 1570, 1575, 1576, 1578, 1579, 1584, 1585, 1586, 1590, 1591, 1598, 1599, 1600, 1601, 1602, 1604, 1605, 1608, 1609, 1610, 1612, 1614, 1615, 1616, 1617, 1623, 1625, 1634, 1635, 1636, 1637, 1638, 1641, 1642, 1643, 1650, 1651, 1654, 1658, 1659, 1662, 1663, 1669, 1671, 1673, 1675, 1678, 1681, 1682, 1684, 1687, 1688, 1689, 1690, 1691, 1696, 1698, 1705, 1706, 1707, 1708, 1710, 1716, 1717, 1725, 1732, 1735, 1750, 1755, 1759, 1761, 1764, 1769, 1770, 1771, 1773, 1774, 1776, 1777, 1785, 1786, 1791, 1798, 1802, 1807, 1808, 1809, 1811, 1820, 1822, 1826, 1828, 1830, 1832, 1834, 1835, 1837, 1839, 1840, 1845, 1846, 1848, 1851, 1852, 1854, 1855, 1859, 1861, 1863, 1866, 1867, 1869, 1872, 1873, 1876, 1879, 1882, 1886, 1888, 1891, 1893, 1895, 1897, 1900, 1902, 1903, 1905, 1906, 1910, 1911, 1913, 1915, 1916, 1918, 1920, 1922, 1923, 1924, 1930, 1931, 1936, 1939, 1940, 1945, 1949, 1950, 1951, 1952, 1953, 1958, 1964, 1968, 1970, 1971, 1972, 1973, 1977, 1979, 1986, 1990, 1993, 1999, 2000, 2002, 2007, 2008, 2009, 2010, 2012, 2014, 2015, 2017, 2019, 2021, 2026, 2031, 2032, 2033, 2037, 2038, 2040, 2041, 2043, 2048, 2051, 2060, 2062, 2064, 2071, 2072, 2074, 2077, 2078, 2085, 2087, 2088, 2089, 2091, 2092, 2093, 2094, 2097, 2103, 2106, 2107, 2111, 2112, 2116, 2117, 2122, 2123, 2125, 2126, 2128, 2130, 2132, 2133, 2139, 2142, 2143, 2144, 2146, 2147, 2150, 2151, 2152, 2156, 2157, 2158, 2161, 2162, 2164, 2167, 2168, 2170, 2175, 2177, 2179, 2185, 2188, 2189, 2190, 2193, 2195, 2196, 2200, 2202, 2203, 2206, 2207, 2210, 2215, 2216, 2218, 2221, 2240, 2241, 2242, 2243, 2245, 2253, 2257, 2258, 2260, 2263, 2265, 2266, 2274, 2276, 2280, 2282, 2283, 2284, 2288, 2291, 2293, 2296, 2298, 2300, 2303, 2306, 2308, 2309, 2310, 2313, 2314, 2322, 2323, 2326, 2328, 2329, 2331, 2333, 2335, 2339, 2342, 2343, 2348, 2353, 2359, 2361, 2362, 2363, 2371, 2372, 2376, 2379, 2380, 2381, 2382, 2384, 2401, 2402, 2405, 2406, 2410, 2412, 2413, 2414, 2416, 2417, 2418, 2419, 2420, 2423, 2430, 2431, 2432, 2433, 2434, 2435, 2437, 2439, 2440, 2441, 2442, 2443, 2445, 2449, 2451, 2452, 2453, 2454, 2456, 2457, 2458, 2465, 2469, 2470, 2474, 2476, 2477, 2479, 2480, 2481, 2482, 2483, 2485, 2487, 2490, 2495, 2496, 2497, 2498, 2500, 2505, 2506, 2507, 2509, 2513, 2514, 2515, 2516, 2517, 2519, 2521, 2522, 2525, 2528, 2529, 2531, 2532, 2533, 2534, 2536, 2537, 2538, 2539, 2541, 2543, 2546, 2549, 2550, 2551, 2552, 2554, 2555, 2559, 2560, 2567, 2568, 2570, 2571, 2573, 2578, 2579, 2581, 2583, 2589, 2590, 2591, 2594, 2596, 2599, 2600, 2601, 2609, 2611, 2613, 2614, 2616, 2619, 2620, 2625, 2627, 2632, 2634, 2635, 2636, 2639, 2644, 2649, 2652, 2655, 2656, 2658, 2663, 2671, 2672, 2674, 2684, 2685, 2687, 2688, 2689, 2690, 2691, 2692, 2694, 2700, 2704, 2708, 2709, 2715, 2720, 2721, 2722, 2725, 2726, 2728, 2729, 2735, 2738, 2739, 2745, 2746, 2747, 2749, 2752, 2756, 2758, 2762, 2764, 2765, 2770, 2776, 2780, 2783, 2784, 2787, 2791, 2794, 2798, 2800, 2801, 2802, 2805, 2808, 2812, 2814, 2819, 2821, 2822, 2823, 2824, 2826, 2827, 2828, 2831, 2833, 2838, 2840, 2844, 2850, 2860, 2865, 2869, 2871, 2876, 2878, 2880, 2888, 2889, 2890, 2893, 2894, 2895, 2896, 2897, 2901, 2902, 2903, 2906, 2908, 2909, 2915, 2916, 2917, 2922, 2923, 2926, 2929, 2930, 2931, 2935, 2941, 2942, 2943, 2944, 2946, 2948, 2955, 2959, 2963, 2966, 2968, 2976, 2979, 2981, 2982, 2987, 2992, 2994, 3003, 3005, 3006, 3007, 3009, 3013, 3015, 3017, 3018, 3020, 3023, 3024, 3029, 3039, 3041, 3042, 3044, 3045, 3047, 3048, 3049, 3051, 3052, 3053, 3055, 3058, 3059, 3061, 3064, 3068, 3070, 3072, 3075, 3080, 3083, 3084, 3085, 3087, 3090, 3094, 3095, 3097, 3100, 3106, 3115, 3118, 3119, 3120, 3121, 3123, 3127, 3128, 3129, 3137, 3138, 3139, 3143, 3145, 3153, 3164, 3167, 3169, 3170, 3171, 3172, 3173, 3177, 3179, 3181, 3189, 3191, 3192, 3194, 3196, 3205, 3206, 3208, 3210, 3217, 3219, 3221, 3224, 3225, 3228, 3230, 3232, 3240, 3242, 3246, 3247, 3249, 3250, 3252, 3254, 3261, 3263, 3266, 3269, 3272, 3278, 3280, 3283, 3286, 3288, 3290, 3291, 3294, 3295, 3297, 3299, 3301, 3308, 3310, 3312, 3313, 3324, 3325, 3327, 3331, 3332, 3337, 3338, 3340, 3342, 3343, 3345, 3347, 3351, 3353, 3355, 3357, 3358, 3359, 3360, 3361, 3363, 3370, 3374, 3379, 3382, 3383, 3386, 3394, 3396, 3399, 3403, 3405, 3413, 3415, 3416, 3418, 3419, 3424, 3425, 3426, 3428, 3429, 3435, 3438, 3446, 3447, 3449, 3452, 3458, 3461, 3466, 3468, 3469, 3470, 3471, 3474, 3477, 3478, 3479, 3483, 3484, 3486, 3487, 3488, 3493, 3497, 3498, 3500, 3502, 3503, 3504, 3506, 3507, 3510, 3516, 3517, 3518, 3523, 3524, 3533, 3535, 3537, 3538, 3540, 3541, 3542, 3544, 3545, 3549, 3551, 3554, 3558, 3560, 3561, 3562, 3569, 3571, 3574, 3576, 3580, 3587, 3588, 3589, 3591, 3592, 3594, 3595, 3597, 3603, 3604, 3606, 3607, 3611, 3613, 3616, 3620, 3621, 3624, 3629, 3633, 3634, 3640, 3642, 3643, 3644, 3645, 3646, 3647, 3648, 3659, 3661, 3664, 3665, 3667, 3672, 3674, 3676, 3677, 3682, 3684, 3685, 3690, 3707, 3709, 3710, 3713, 3715, 3718, 3719, 3720, 3721, 3722, 3723, 3726, 3729, 3730, 3731, 3732, 3738, 3739, 3744, 3749, 3752, 3754, 3756, 3761, 3764, 3765, 3766, 3772, 3773, 3775, 3778, 3791, 3792, 3793, 3794, 3800, 3801, 3804, 3806, 3808, 3817, 3818, 3819, 3823, 3825, 3829, 3830, 3832, 3833, 3834, 3837, 3838, 3843, 3844, 3845, 3846, 3847, 3849, 3852, 3858, 3859, 3860, 3867, 3868, 3870, 3871, 3872, 3873, 3878, 3881, 3882, 3884, 3887, 3889, 3890, 3892, 3894, 3895, 3896, 3902, 3903, 3904, 3907, 3908, 3912, 3913, 3917, 3918, 3923, 3926, 3928, 3929, 3933, 3938, 3940, 3941, 3943, 3947, 3950, 3951, 3954, 3958, 3962, 3967, 3968, 3970, 3971, 3974, 3975, 3978, 3983, 3985, 3987, 3988, 3990, 3994, 3995, 3996, 4001, 4003, 4007, 4008, 4013, 4014, 4017, 4021, 4030, 4033, 4037, 4039, 4042, 4043, 4044, 4046, 4047, 4048, 4050, 4051, 4052, 4054, 4056, 4057, 4062, 4066, 4068, 4070, 4075, 4084, 4087, 4088, 4092, 4094, 4096, 4098, 4099, 4102, 4105, 4106, 4109, 4110, 4113, 4116, 4126, 4128, 4132, 4133, 4134, 4139, 4140, 4143, 4144, 4146, 4148, 4149, 4150, 4155, 4160, 4163, 4164, 4165, 4166, 4167, 4168, 4171, 4178, 4181, 4183, 4185, 4187, 4188, 4189, 4191, 4195, 4201, 4202, 4204, 4205, 4206, 4207, 4210, 4211, 4212, 4213, 4217, 4218, 4219, 4221, 4227, 4228, 4233, 4234, 4235, 4237, 4245, 4246, 4250, 4251, 4252, 4255, 4257, 4258, 4261, 4266, 4270, 4272, 4275, 4280, 4281, 4284, 4290, 4292, 4294, 4296, 4298, 4301, 4302, 4305, 4309, 4312, 4314, 4317, 4320, 4321, 4324, 4329, 4330, 4335, 4337, 4339, 4341, 4344, 4347, 4355, 4356, 4357, 4358, 4360, 4369, 4370, 4378, 4380, 4383, 4390, 4391, 4392, 4393, 4396, 4397, 4401, 4402, 4403, 4404, 4409, 4410, 4422, 4423, 4425, 4430, 4432, 4439, 4440, 4442, 4443, 4446, 4448, 4450, 4453, 4456, 4458, 4461, 4462, 4463, 4466, 4468, 4471, 4474, 4475, 4479, 4486, 4492, 4494, 4498, 4500, 4502, 4507, 4508, 4512, 4514, 4515, 4519, 4521, 4522, 4524, 4525, 4529, 4531, 4535, 4536, 4541, 4543, 4548, 4549, 4551, 4554, 4556, 4557, 4558, 4560, 4561, 4562, 4565, 4566, 4568, 4575, 4576, 4580, 4582, 4583, 4590, 4591, 4593, 4594, 4597, 4598, 4601, 4606, 4612, 4613, 4616, 4618, 4623, 4625, 4628, 4630, 4632, 4634, 4635, 4639, 4641, 4643, 4644, 4645, 4646, 4647, 4650, 4651, 4653, 4654, 4655, 4656, 4658, 4659, 4662, 4664, 4667, 4669, 4671, 4673, 4674, 4676, 4677, 4680, 4682, 4685, 4691, 4692, 4693, 4694, 4697, 4699, 4700, 4706, 4710, 4711, 4713, 4716, 4719, 4721, 4722, 4723, 4724, 4727, 4729, 4730, 4734, 4737, 4738, 4739, 4740, 4741, 4745, 4749, 4753, 4754, 4755, 4756, 4760, 4761, 4762, 4763, 4766, 4767, 4769, 4770, 4771, 4773, 4775, 4779, 4780, 4784, 4787, 4788, 4789, 4790, 4794, 4795, 4796, 4801, 4803, 4804, 4805, 4806, 4807, 4813, 4814, 4818, 4822, 4827, 4828, 4830, 4831, 4834, 4838, 4840, 4841, 4842, 4855, 4856, 4857, 4858, 4861, 4862, 4863, 4864, 4869, 4874, 4875, 4876, 4878, 4881, 4887, 4889, 4891, 4893, 4896, 4897, 4900, 4904, 4907, 4909, 4910, 4913, 4914, 4920, 4921, 4922, 4926, 4928, 4935, 4936, 4941, 4942, 4944, 4945, 4954, 4956, 4958, 4959, 4960, 4967, 4969, 4971, 4972, 4974, 4975, 4980, 4985, 4987, 4993, 4994, 4996, 5007, 5015, 5016, 5021, 5023, 5024, 5026, 5029, 5030, 5034, 5036, 5037, 5038, 5039, 5040, 5042, 5044, 5045, 5046, 5049, 5051, 5052, 5054, 5057, 5060, 5065, 5067, 5068, 5069, 5072, 5075, 5078, 5082, 5087, 5088, 5089, 5094, 5100, 5101, 5102, 5106, 5110, 5113, 5114, 5119, 5120, 5123, 5125, 5131, 5132, 5140, 5143, 5145, 5147, 5149, 5150, 5159, 5160, 5163, 5164, 5165, 5166, 5168, 5169, 5170, 5174, 5180, 5181, 5182, 5184, 5185, 5187, 5188, 5189, 5190, 5191, 5192, 5193, 5195, 5196, 5198, 5200, 5202, 5206, 5209, 5212, 5213, 5216, 5217, 5218, 5219, 5224, 5225, 5229, 5234, 5240, 5241, 5244, 5245, 5248, 5251, 5253, 5254, 5255, 5256, 5257, 5258, 5260, 5261, 5263, 5266, 5268, 5269, 5273, 5275, 5276, 5280, 5281, 5282, 5283, 5286, 5293, 5297, 5298, 5299, 5300, 5301, 5308, 5311, 5314, 5315, 5317, 5319, 5321, 5324, 5329, 5330, 5333, 5334, 5338, 5339, 5343, 5344, 5345, 5346, 5348, 5349, 5352, 5366, 5367, 5369, 5379, 5386, 5388, 5389, 5393, 5395, 5396, 5397, 5398, 5400, 5402, 5404, 5405, 5413, 5414, 5418, 5422, 5427, 5428, 5431, 5434, 5437, 5438, 5445, 5446, 5452, 5453, 5456, 5458, 5459, 5461, 5472, 5475, 5483, 5487, 5491, 5493, 5495, 5496, 5505, 5508, 5510, 5512, 5513, 5515, 5517, 5518, 5519, 5524, 5530, 5531, 5532, 5535, 5543, 5545, 5549, 5554, 5557, 5558, 5563, 5564, 5566, 5568, 5569, 5572, 5575, 5579, 5581, 5582, 5584, 5585, 5586, 5589, 5592, 5593, 5594, 5597, 5599, 5602, 5608, 5613, 5614, 5615, 5616, 5620, 5623, 5627, 5632, 5633, 5635, 5638, 5640, 5643, 5647, 5648, 5649, 5650, 5651, 5652, 5653, 5656, 5659, 5660, 5663, 5664, 5667, 5669, 5675, 5676, 5680, 5681, 5689, 5690, 5694, 5695, 5697, 5698, 5702, 5706, 5711, 5712, 5713, 5714, 5718, 5719, 5721, 5722, 5729, 5730, 5731, 5732, 5734, 5735, 5736, 5737, 5738, 5742, 5744, 5746, 5748, 5751, 5764, 5768, 5770, 5771, 5773, 5775, 5778, 5780, 5782, 5783, 5785, 5787, 5791, 5792, 5794, 5806, 5807, 5808, 5810, 5811, 5817, 5820, 5826, 5828, 5832, 5833, 5834, 5835, 5836, 5839, 5842, 5844, 5853, 5854, 5859, 5864, 5866, 5867, 5871, 5872, 5873, 5876, 5877, 5878, 5879, 5881, 5882, 5883, 5884, 5888, 5889, 5892, 5893, 5900, 5902, 5906, 5907, 5910, 5912, 5918, 5919, 5921, 5925, 5926, 5927, 5928, 5931, 5932, 5933, 5936, 5938, 5941, 5943, 5944, 5945, 5948, 5951, 5952, 5954, 5956, 5957, 5959, 5961, 5968, 5971, 5978, 5979, 5980, 5985, 5986, 5988, 5991, 5992, 5994, 5996, 5997, 6000, 6002, 6003, 6004, 6005, 6006, 6007, 6012, 6013, 6016, 6017, 6025, 6026, 6038, 6040, 6041, 6044, 6045, 6047, 6048, 6051, 6053, 6054, 6058, 6059, 6060, 6061, 6062, 6063, 6068, 6069, 6070, 6072, 6073, 6074, 6075, 6080, 6083, 6092, 6093, 6094, 6095, 6097, 6098, 6107, 6108, 6109, 6110, 6112, 6113, 6116, 6118, 6119, 6122, 6125, 6129, 6130, 6131, 6132, 6133, 6136, 6137, 6145, 6146, 6147, 6151, 6152, 6153, 6156, 6163, 6164, 6165, 6168, 6173, 6182, 6183, 6186, 6188, 6189, 6190, 6191, 6193, 6196, 6197, 6198, 6200, 6205, 6207, 6209, 6212, 6213, 6215, 6220, 6221, 6223, 6224, 6227, 6228, 6230, 6231, 6234, 6238, 6241, 6243, 6246, 6249, 6251, 6255, 6257, 6258, 6259, 6264, 6265, 6269, 6270, 6271, 6272, 6273, 6278, 6279, 6280, 6281, 6282, 6283, 6284, 6285, 6286, 6287, 6291, 6292, 6294, 6296, 6299, 6300, 6302, 6309, 6310, 6311, 6315, 6317, 6319, 6321, 6322, 6325, 6326, 6328, 6330, 6333, 6338, 6345, 6351, 6352, 6353, 6354, 6359, 6360, 6362, 6363, 6364, 6367, 6370, 6372, 6375, 6378, 6381, 6383, 6394, 6396, 6397, 6398, 6399, 6403, 6405, 6407, 6412, 6414, 6415, 6419, 6420, 6422, 6429, 6430, 6431, 6434, 6436, 6437, 6440, 6441, 6442, 6452, 6454, 6456, 6458, 6459, 6463, 6464, 6466, 6467, 6468, 6469, 6470, 6471, 6474, 6476, 6478, 6480, 6482, 6486, 6488, 6493, 6495, 6500, 6501, 6502, 6503, 6504, 6505, 6510, 6513, 6514, 6517, 6519, 6524, 6530, 6533, 6534, 6535, 6537, 6539, 6543, 6544, 6547, 6548, 6549, 6554, 6555, 6558, 6560, 6561, 6563, 6567, 6569, 6572, 6574, 6576, 6577, 6579, 6581, 6582, 6584, 6587, 6588, 6595, 6597, 6598, 6600, 6603, 6607, 6609, 6611, 6621, 6622, 6624, 6626, 6627, 6628, 6630, 6634, 6635, 6637, 6638, 6639, 6643, 6649, 6650, 6655, 6656, 6658, 6662, 6666, 6671, 6678, 6679, 6681, 6691, 6692, 6695, 6699, 6703, 6705, 6706, 6711, 6714, 6716, 6718, 6720, 6724, 6729, 6731, 6733, 6734, 6737, 6739, 6746, 6747, 6748, 6749, 6758, 6759, 6761, 6766, 6778, 6779, 6780, 6783, 6786, 6788, 6793, 6794, 6795, 6799, 6803, 6804, 6805, 6807, 6810, 6811, 6812, 6813, 6816, 6819, 6820, 6821, 6824, 6827, 6828, 6830, 6834, 6836, 6839, 6840, 6841, 6843, 6845, 6848, 6852, 6859, 6864, 6869, 6872, 6874, 6875, 6876, 6878, 6879, 6880, 6886, 6888, 6897, 6903, 6906, 6907, 6909, 6914, 6915, 6919, 6920, 6921, 6930, 6933, 6936, 6941, 6944, 6946, 6948, 6950, 6952, 6959, 6960, 6963, 6967, 6969, 6970, 6979, 6980, 6984, 6985, 6987, 6988, 6990, 6993, 6994, 6999, 7006, 7010, 7012, 7013, 7015, 7022, 7031, 7032, 7035, 7042, 7043, 7045, 7048, 7051, 7052, 7053, 7056, 7057, 7064, 7069, 7072, 7074, 7075, 7077, 7083, 7085, 7086, 7097, 7105, 7106, 7107, 7108, 7109, 7112, 7116, 7117, 7118, 7124, 7126, 7130, 7132, 7134, 7135, 7137, 7140, 7142, 7144, 7146, 7149, 7155, 7163, 7164, 7165, 7166, 7167, 7169, 7172, 7173, 7176, 7177, 7182, 7184, 7187, 7188, 7192, 7193, 7194, 7196, 7201, 7202, 7203, 7206, 7207, 7209, 7212, 7216, 7217, 7218, 7219, 7227, 7228, 7234, 7235, 7236, 7239, 7240, 7243, 7244, 7245, 7248, 7254, 7255, 7257, 7258, 7259, 7262, 7267, 7268, 7274, 7276, 7277, 7278, 7282, 7284, 7286, 7287, 7288, 7290, 7291, 7292, 7293, 7298, 7299, 7300, 7301, 7303, 7304, 7305, 7306, 7307, 7310, 7313, 7315, 7317, 7321, 7328, 7330, 7340, 7344, 7345, 7354, 7355, 7356, 7357, 7358, 7361, 7365, 7371, 7373, 7379, 7382, 7383, 7388, 7389, 7392, 7398, 7399, 7400, 7409, 7411, 7415, 7425, 7427, 7428, 7430, 7434, 7435, 7436, 7438, 7441, 7443, 7444, 7445, 7446, 7447, 7454, 7458, 7459, 7466, 7470, 7474, 7475, 7483, 7486, 7487, 7490, 7493, 7498, 7504, 7505, 7506, 7512, 7515, 7517, 7518, 7523, 7524, 7525, 7528, 7533, 7537, 7538, 7542, 7546, 7547, 7548, 7554, 7557, 7561, 7565, 7570, 7577, 7578, 7579, 7580, 7585, 7586, 7589, 7591, 7594, 7595, 7601, 7605, 7611, 7619, 7620, 7621, 7623, 7624, 7633, 7639, 7640, 7642, 7643, 7652, 7653, 7658, 7661, 7663, 7664, 7665, 7666, 7667, 7674, 7677, 7678, 7679, 7680, 7682, 7687, 7689, 7695, 7699, 7700, 7703, 7704, 7708, 7712, 7713, 7717, 7718, 7719, 7724, 7725, 7727, 7729, 7730, 7733, 7736, 7737, 7738, 7740, 7743, 7744, 7745, 7747, 7751, 7753, 7761, 7762, 7763, 7764, 7767, 7768, 7769, 7774, 7775, 7777, 7778, 7779, 7782, 7785, 7786, 7788, 7791, 7793, 7796, 7798, 7800, 7802, 7803, 7804, 7806, 7807, 7812, 7815, 7818, 7819, 7820, 7824, 7825, 7832, 7833, 7834, 7838, 7841, 7844, 7845, 7848, 7849, 7853, 7856, 7859, 7860, 7862, 7863, 7865, 7870, 7876, 7878, 7880, 7881, 7888, 7890, 7896, 7900, 7908, 7909, 7910, 7911, 7917, 7918, 7921, 7922, 7923, 7925, 7927, 7929, 7934, 7935, 7936, 7938, 7942, 7944, 7945, 7946, 7947, 7948, 7952, 7955, 7956, 7960, 7964, 7972, 7974, 7976, 7977, 7978, 7980, 7981, 7983, 7984, 7986, 7989, 7990, 7991, 7993, 7998, 8001, 8005, 8006, 8007, 8009, 8012, 8023, 8026, 8029, 8036, 8039, 8042, 8044, 8047, 8048, 8052, 8053, 8056, 8058, 8059, 8061, 8063, 8067, 8068, 8071, 8073, 8075, 8076, 8078, 8080, 8082, 8084, 8088, 8091, 8093, 8095, 8100, 8103, 8105, 8106, 8112, 8116, 8118, 8121, 8126, 8130, 8136, 8137, 8143, 8147, 8148, 8150, 8151, 8159, 8162, 8163, 8165, 8168, 8170, 8176, 8178, 8179, 8184, 8185, 8187, 8188, 8189, 8192, 8193, 8195, 8199, 8202, 8204, 8207, 8208, 8211, 8213, 8216, 8219, 8220, 8222, 8223, 8225, 8227, 8231, 8234, 8235, 8236, 8237, 8239, 8240, 8242, 8245, 8246, 8250, 8252, 8253, 8266, 8268, 8269, 8270, 8272, 8274, 8282, 8288, 8289, 8292, 8293, 8294, 8300, 8301, 8304, 8310, 8311, 8312, 8313, 8317, 8318, 8319, 8320, 8329, 8331, 8339, 8340, 8349, 8350, 8352, 8353, 8355, 8361, 8363, 8367, 8368, 8373, 8376, 8379, 8385, 8387, 8389, 8390, 8392, 8395, 8401, 8402, 8403, 8404, 8405, 8409, 8410, 8413, 8414, 8416, 8423, 8433, 8435, 8436, 8438, 8439, 8441, 8442, 8444, 8446, 8447, 8448, 8450, 8451, 8452, 8456, 8458, 8459, 8472, 8473, 8474, 8476, 8480, 8481, 8482, 8486, 8490, 8493, 8498, 8501, 8503, 8505, 8509, 8511, 8513, 8515, 8517, 8520, 8523, 8524, 8525, 8527, 8528, 8531, 8533, 8535, 8537, 8538, 8539, 8542, 8544, 8549, 8550, 8551, 8552, 8553, 8554, 8561, 8562, 8565, 8566, 8568, 8575, 8576, 8579, 8581, 8582, 8589, 8590, 8592, 8593, 8594, 8596, 8597, 8599, 8600, 8601, 8602, 8603, 8605, 8609, 8611, 8612, 8614, 8617, 8618, 8624, 8630, 8631, 8634, 8637, 8638, 8640, 8642, 8644, 8648, 8650, 8654, 8657, 8658, 8659, 8663, 8665, 8669, 8672, 8676, 8677, 8685, 8693, 8694, 8700, 8703, 8704, 8706, 8708, 8709, 8713, 8716, 8717, 8720, 8726, 8728, 8729, 8732, 8734, 8736, 8740, 8741, 8742, 8744, 8745, 8746, 8748, 8761, 8764, 8766, 8767, 8770, 8772, 8773, 8776, 8777, 8779, 8782, 8783, 8784, 8789, 8792, 8797, 8803, 8805, 8810, 8818, 8821, 8822, 8824, 8829, 8830, 8831, 8832, 8834, 8835, 8838, 8843, 8846, 8853, 8859, 8861, 8865, 8866, 8867, 8875, 8878, 8881, 8883, 8884, 8886, 8888, 8890, 8891, 8892, 8896, 8897, 8899, 8900, 8902, 8907, 8908, 8909, 8910, 8911, 8913, 8914, 8916, 8917, 8919, 8924, 8926, 8929, 8930, 8935, 8938, 8941, 8942, 8945, 8946, 8949, 8951, 8954, 8956, 8957, 8959, 8960, 8961, 8962, 8963, 8967, 8968, 8969, 8972, 8974, 8976, 8977, 8979, 8980, 8981, 8985, 8986, 8992, 8998, 8999, 9000, 9001, 9002, 9003, 9006, 9009, 9012, 9015, 9018, 9020, 9023, 9029, 9030, 9033, 9037, 9044, 9052, 9056, 9057, 9058, 9059, 9060, 9061, 9066, 9069, 9071, 9072, 9073, 9074, 9076, 9080, 9084, 9091, 9092, 9095, 9096, 9105, 9108, 9110, 9111, 9112, 9114, 9115, 9118, 9120, 9123, 9124, 9125, 9128, 9129, 9133, 9134, 9138, 9139, 9140, 9141, 9142, 9146, 9149, 9151, 9152, 9155, 9172, 9173, 9174, 9175, 9177, 9179, 9183, 9185, 9187, 9188, 9190, 9195, 9199, 9206, 9207, 9210, 9211, 9213, 9214, 9215, 9216, 9223, 9226, 9229, 9233, 9241, 9243, 9247, 9249, 9252, 9253, 9254, 9255, 9263, 9265, 9267, 9270, 9273, 9276, 9278, 9284, 9285, 9288, 9290, 9292, 9293, 9295, 9298, 9299, 9300, 9304, 9308, 9311, 9314, 9316, 9320, 9321, 9323, 9325, 9326, 9327, 9328, 9329, 9330, 9333, 9336, 9337, 9339, 9340, 9341, 9345, 9346, 9347, 9348, 9354, 9355, 9359, 9366, 9367, 9373, 9375, 9376, 9382, 9383, 9388, 9391, 9392, 9393, 9394, 9396, 9398, 9400, 9402, 9403, 9404, 9406, 9407, 9412, 9413, 9414, 9415, 9423, 9432, 9433, 9434, 9440, 9442, 9444, 9449, 9451, 9452, 9456, 9459, 9460, 9468, 9471, 9472, 9473, 9478, 9483, 9486, 9488, 9490, 9494, 9495, 9497, 9500, 9501, 9502, 9503, 9504, 9505, 9509, 9514, 9515, 9517, 9518, 9519, 9520, 9525, 9531, 9533, 9534, 9536, 9540, 9545, 9546, 9548, 9549, 9553, 9555, 9563, 9564, 9565, 9568, 9571, 9577, 9582, 9583, 9587, 9589, 9590, 9591, 9596, 9602, 9606, 9609, 9613, 9614, 9618, 9620, 9623, 9624, 9626, 9627, 9628, 9629, 9633, 9635, 9640, 9641, 9642, 9644, 9645, 9646, 9648, 9649, 9650, 9653, 9655, 9656, 9658, 9659, 9660, 9663, 9666, 9668, 9670, 9677, 9681, 9682, 9686, 9692, 9698, 9700, 9706, 9707, 9715, 9718, 9722, 9723, 9724, 9726, 9729, 9730, 9731, 9733, 9734, 9737, 9746, 9750, 9753, 9754, 9756, 9763, 9764, 9767, 9768, 9770, 9776, 9780, 9781, 9782, 9784, 9786, 9792, 9793, 9794, 9796, 9799, 9812, 9813, 9816, 9819, 9824, 9825, 9827, 9833, 9836, 9845, 9847, 9849, 9850, 9851, 9853, 9861, 9864, 9866, 9869, 9871, 9873, 9882, 9886, 9887, 9892, 9897, 9901, 9906, 9907, 9908, 9909, 9910, 9917, 9923, 9924, 9928, 9930, 9935, 9938, 9940, 9946, 9947, 9949, 9950, 9953, 9957, 9960, 9962, 9963, 9964, 9967, 9968, 9971, 9972, 9979, 9980, 9982, 9984, 9985, 9987, 9988, 9990, 9997, 9998, 10000, 10008, 10009, 10010, 10017, 10018, 10019, 10021, 10022, 10026, 10033, 10037, 10038, 10040, 10041, 10042, 10043, 10044, 10045, 10048, 10051, 10052, 10054, 10056, 10059, 10060, 10062, 10063, 10064, 10068, 10075, 10077, 10078, 10083, 10089, 10091, 10092, 10093, 10095, 10097, 10101, 10102, 10103, 10105, 10106, 10107, 10108, 10109, 10110, 10114, 10115, 10116, 10117, 10118, 10119, 10122, 10127, 10128, 10131, 10132, 10136, 10138, 10143, 10146, 10149, 10151, 10152, 10158, 10163, 10165, 10166, 10168, 10170, 10174, 10176, 10178, 10181, 10182, 10191, 10192, 10193, 10194, 10195, 10197, 10199, 10203, 10209, 10213, 10214, 10218, 10219, 10220, 10222, 10223, 10225, 10228, 10231, 10233, 10236, 10237, 10238, 10239, 10247, 10252, 10255, 10258, 10275, 10278, 10284, 10286, 10291, 10292, 10293, 10295, 10300, 10302, 10306, 10307, 10311, 10321, 10323, 10324, 10325, 10326, 10328, 10330, 10331, 10333, 10334, 10335, 10336, 10344, 10352, 10353, 10357, 10359, 10360, 10362, 10364, 10368, 10373, 10375, 10376, 10378, 10380, 10384, 10385, 10388, 10389, 10397, 10398, 10399, 10400, 10401, 10405, 10408, 10410, 10413, 10414, 10416, 10421, 10422, 10423, 10427, 10428, 10429, 10430, 10435, 10437, 10438, 10440, 10442, 10443, 10446, 10448, 10450, 10451, 10453, 10455, 10463, 10464, 10465, 10466, 10468, 10469, 10470, 10474, 10478, 10480, 10482, 10492, 10494, 10495, 10496, 10504, 10506, 10508, 10514, 10515, 10518, 10521, 10525, 10527, 10528, 10530, 10531, 10533, 10535, 10536, 10541, 10542, 10544, 10547, 10548, 10549, 10550, 10551, 10555, 10556, 10558, 10560, 10561, 10562, 10565, 10567, 10569, 10571, 10580, 10581, 10582, 10583, 10585, 10589, 10593, 10595, 10596, 10597, 10600, 10601, 10602, 10606, 10609, 10610, 10611, 10614, 10615, 10616, 10617, 10621, 10622, 10623, 10626, 10628, 10629, 10630, 10631, 10633, 10634, 10637, 10638, 10639, 10640, 10641, 10642, 10645, 10646, 10648, 10649, 10650, 10655, 10657, 10663, 10665, 10668, 10671, 10674, 10675, 10677, 10678, 10681, 10682, 10683, 10684, 10685, 10687, 10689, 10693, 10697, 10698, 10699, 10700, 10702, 10703, 10705, 10707, 10708, 10710, 10711, 10715, 10716, 10723, 10725, 10726, 10730, 10732, 10734, 10735, 10736, 10737, 10740, 10744, 10747, 10748, 10749, 10752, 10753, 10756, 10761, 10762, 10763, 10766, 10775, 10778, 10779, 10782, 10784, 10785, 10787, 10788, 10790, 10791, 10792, 10795, 10796, 10798, 10800, 10801, 10802, 10803, 10805, 10809, 10810, 10811, 10813, 10818, 10819, 10820, 10821, 10824, 10825, 10826, 10831, 10833, 10836, 10838, 10839, 10840, 10841, 10843, 10845, 10846, 10850, 10852, 10853, 10858, 10860, 10861, 10862, 10864, 10867, 10870, 10874, 10877, 10880, 10881, 10892, 10896, 10897, 10898, 10899, 10902, 10903, 10905, 10912, 10917, 10920, 10926, 10927, 10930, 10933, 10934, 10935, 10936, 10937, 10938, 10941, 10944, 10947, 10948, 10950, 10954, 10957, 10960, 10962, 10963, 10964, 10965, 10967, 10972, 10977, 10980, 10985, 10988, 10993, 10995, 10996, 10997, 10998, 10999, 11002, 11004, 11005, 11006, 11008, 11009, 11010, 11015, 11016, 11018, 11022, 11024, 11030, 11032, 11036, 11037, 11039, 11044, 11046, 11047, 11049, 11053, 11056, 11058, 11060, 11061, 11066, 11068, 11070, 11071, 11072, 11078, 11080, 11082, 11083, 11086, 11090, 11095, 11098, 11102, 11107, 11110, 11114, 11116, 11118, 11119, 11123, 11124, 11125, 11126, 11127, 11129, 11134, 11135, 11137, 11138, 11145, 11146, 11153, 11154, 11158, 11159, 11160, 11161, 11162, 11163, 11164, 11166, 11168, 11169, 11174, 11175, 11177, 11178, 11179, 11180, 11184, 11187, 11188, 11190, 11191, 11192, 11198, 11199, 11201, 11202, 11203, 11206, 11207, 11210, 11214, 11217, 11218, 11222, 11226, 11227, 11232, 11233, 11234, 11235, 11236, 11237, 11238, 11239, 11246, 11247, 11248, 11254, 11255, 11256, 11257, 11258, 11259, 11260, 11262, 11263, 11264, 11265, 11266, 11274, 11275, 11278, 11286, 11288, 11289, 11290, 11291, 11292, 11293, 11294, 11295, 11306, 11307, 11308, 11313, 11315, 11316, 11318, 11320, 11322, 11324, 11326, 11329, 11332, 11337, 11339, 11340, 11345, 11346, 11348, 11352, 11356, 11363, 11365, 11370, 11371, 11373, 11374, 11377, 11378, 11381, 11382, 11388, 11389, 11391, 11392, 11394, 11395, 11402, 11403, 11405, 11406, 11409, 11416, 11418, 11420, 11423, 11424, 11428, 11430, 11431, 11434, 11437, 11438, 11443, 11446, 11449, 11451, 11459, 11463, 11465, 11467, 11468, 11471, 11472, 11473, 11475, 11476, 11478, 11481, 11482, 11485, 11487, 11490, 11494, 11496, 11497, 11498, 11500, 11506, 11507, 11508, 11509, 11512, 11516, 11518, 11520, 11523, 11526, 11528, 11530, 11533, 11534, 11538, 11540, 11541, 11544, 11545, 11546, 11547, 11548, 11551, 11553, 11558, 11560, 11561, 11567, 11568, 11570, 11571, 11574, 11576, 11577, 11578, 11579, 11580, 11583, 11589, 11593, 11594, 11595, 11596, 11597, 11599, 11604, 11610, 11615, 11618, 11620, 11621, 11623, 11625, 11628, 11629, 11632, 11633, 11638, 11639, 11642, 11649, 11650, 11652, 11654, 11655, 11656, 11657, 11658, 11663, 11667, 11669, 11673, 11678, 11681, 11682, 11683, 11691, 11692, 11693, 11694, 11695, 11701, 11703, 11705, 11707, 11711, 11712, 11721, 11725, 11726, 11730, 11731, 11733, 11736, 11741, 11743, 11744, 11746, 11753, 11755, 11756, 11759, 11760, 11761, 11762, 11763, 11764, 11765, 11766, 11767, 11770, 11771, 11776, 11782, 11783, 11785, 11786, 11790, 11792, 11799, 11800, 11809, 11811, 11812, 11813, 11814, 11816, 11818, 11819, 11820, 11821, 11823, 11825, 11826, 11828, 11830, 11837, 11839, 11841, 11846, 11848, 11849, 11851, 11856, 11858, 11863, 11868, 11869, 11870, 11872, 11876, 11877, 11878, 11879, 11881, 11886, 11890, 11891, 11894, 11898, 11903, 11908, 11909, 11911, 11913, 11920, 11921, 11923, 11926, 11928, 11929, 11930, 11934, 11935, 11940, 11941, 11943, 11946, 11947, 11948, 11949, 11952, 11953, 11955, 11957, 11958, 11959, 11960, 11961, 11962, 11965, 11976, 11977, 11978, 11979, 11980, 11983, 11988, 11989, 11991, 11993, 11994, 11995, 11996, 11997, 11998, 11999, 12002, 12004, 12016, 12018, 12019, 12020, 12021, 12023, 12024, 12025, 12030, 12032, 12042, 12043, 12044, 12047, 12050, 12051, 12054, 12059, 12060, 12061, 12064, 12068, 12078, 12079, 12080, 12081, 12082, 12083, 12086, 12091, 12092, 12093, 12097, 12098, 12104, 12106, 12109, 12110, 12112, 12115, 12118, 12120, 12122, 12128, 12129, 12131, 12134, 12135, 12136, 12137, 12138, 12139, 12140, 12143, 12144, 12145, 12146, 12147, 12151, 12155, 12161, 12162, 12163, 12165, 12166, 12167, 12170, 12171, 12174, 12176, 12179, 12181, 12186, 12197, 12200, 12201, 12202, 12204, 12208, 12212, 12214, 12215, 12217, 12223, 12230, 12233, 12234, 12237, 12240, 12241, 12243, 12245, 12246, 12250, 12252, 12254, 12255, 12256, 12259, 12265, 12271, 12278, 12280, 12285, 12286, 12287, 12293, 12295, 12296, 12299, 12310, 12311, 12312, 12313, 12314, 12315, 12317, 12319, 12321, 12323, 12325, 12328, 12331, 12334, 12339, 12342, 12343, 12345, 12347, 12350, 12354, 12356, 12358, 12359, 12364, 12366, 12375, 12376, 12379, 12380, 12381, 12385, 12390, 12393, 12397, 12400, 12401, 12403, 12404, 12406, 12409, 12411, 12414, 12415, 12416, 12419, 12420, 12423, 12424, 12425, 12426, 12427, 12437, 12438, 12440, 12444, 12445, 12450, 12451, 12455, 12456, 12457, 12459, 12461, 12462, 12465, 12467, 12468, 12470, 12472, 12473, 12475, 12478, 12481, 12487, 12488, 12489, 12492, 12494, 12495, 12497, 12501, 12502, 12503, 12510, 12511, 12512, 12513, 12514, 12515, 12518, 12519, 12527, 12529, 12530, 12531, 12535, 12536, 12537, 12538, 12539, 12546, 12547, 12548, 12551, 12552, 12554, 12555, 12556, 12561, 12563, 12565, 12567, 12568, 12570, 12572, 12577, 12578, 12583, 12585, 12586, 12588, 12591, 12600, 12605, 12608, 12609, 12610, 12611, 12616, 12620, 12622, 12623, 12626, 12628, 12629, 12634, 12638, 12639, 12640, 12641, 12644, 12648, 12649, 12651, 12655, 12663, 12664, 12668, 12670, 12674, 12679, 12681, 12683, 12684, 12688, 12689, 12691, 12695, 12696, 12697, 12699, 12701, 12702, 12705, 12706, 12708, 12714, 12723, 12731, 12732, 12733, 12739, 12740, 12741, 12742, 12752, 12753, 12754, 12755, 12757, 12758, 12760, 12764, 12766, 12771, 12775, 12777, 12779, 12782, 12785, 12790, 12797, 12801, 12802, 12804, 12807, 12810, 12812, 12813, 12817, 12818, 12819, 12820, 12822, 12823, 12824, 12826, 12827, 12828, 12834, 12835, 12837, 12838, 12839, 12843, 12848, 12849, 12853, 12858, 12860, 12861, 12866, 12870, 12873, 12875, 12878, 12882, 12883, 12884, 12887, 12888, 12891, 12898, 12899, 12900, 12901, 12902, 12903, 12904, 12905, 12906, 12908, 12910, 12912, 12916, 12921, 12923, 12928, 12929, 12932, 12933, 12934, 12945, 12946, 12947, 12952, 12956, 12958, 12959, 12960, 12963, 12967, 12968, 12969, 12978, 12984, 12986, 12987, 12988, 12990, 12991, 12999, 13001, 13003, 13004, 13005, 13007, 13010, 13013, 13014, 13015, 13017, 13018, 13022, 13027, 13030, 13031, 13033, 13034, 13035, 13040, 13041, 13047, 13050, 13053, 13054, 13055, 13056, 13060, 13061, 13062, 13064, 13066, 13071, 13075, 13083, 13085, 13086, 13087, 13098, 13099, 13101, 13102, 13105, 13110, 13111, 13112, 13114, 13115, 13117, 13118, 13120, 13121, 13122, 13123, 13124, 13125, 13127, 13128, 13131, 13134, 13136, 13148, 13149, 13151, 13153, 13154, 13159, 13160, 13169, 13170, 13175, 13181, 13182, 13186, 13187, 13189, 13190, 13197, 13198, 13199, 13206, 13209, 13217, 13220, 13221, 13224, 13226, 13227, 13228, 13232, 13233, 13234, 13235, 13236, 13237, 13239, 13241, 13248, 13250, 13251, 13255, 13256, 13259, 13261, 13262, 13263, 13264, 13265, 13268, 13271, 13274, 13275, 13281, 13283, 13284, 13297, 13298, 13300, 13301, 13303, 13304, 13312, 13313, 13315, 13317, 13326, 13329, 13332, 13340, 13343, 13345, 13346, 13347, 13348, 13352, 13361, 13363, 13367, 13368, 13369, 13370, 13377, 13380, 13381, 13385, 13386, 13388, 13391, 13393, 13394, 13395, 13396, 13397, 13402, 13403, 13407, 13408, 13410, 13413, 13416, 13417, 13419, 13423, 13424, 13429, 13430, 13433, 13439, 13441, 13444, 13448, 13456, 13460, 13463, 13467, 13469, 13473, 13475, 13477, 13478, 13480, 13489, 13492, 13499, 13503, 13504, 13506, 13513, 13514, 13515, 13519, 13521, 13522, 13524, 13525, 13526, 13530, 13539, 13540, 13543, 13544, 13546, 13547, 13549, 13551, 13552, 13553, 13555, 13556, 13558, 13559, 13561, 13568, 13569, 13574, 13579, 13580, 13584, 13587, 13597, 13599, 13600, 13601, 13602, 13604, 13605, 13612, 13613, 13614, 13616, 13620, 13621, 13623, 13628, 13630, 13631, 13632, 13634, 13636, 13637, 13638, 13639, 13641, 13643, 13647, 13650, 13653, 13654, 13660, 13662, 13663, 13665, 13668, 13669, 13677, 13678, 13679, 13683, 13687, 13688, 13693, 13697, 13698, 13699, 13700, 13706, 13712, 13713, 13714, 13715, 13716, 13719, 13720, 13722, 13727, 13729, 13734, 13739, 13742, 13745, 13747, 13749, 13750, 13753, 13756, 13764, 13767, 13768, 13772, 13773, 13775, 13777, 13779, 13780, 13782, 13783, 13785, 13786, 13787, 13791, 13793, 13796, 13799, 13809, 13816, 13817, 13818, 13819, 13822, 13823, 13828, 13830, 13831, 13834, 13835, 13843, 13849, 13852, 13858, 13866, 13869, 13872, 13873, 13875, 13877, 13887, 13891, 13892, 13895, 13897, 13898, 13899, 13901, 13904, 13906, 13908, 13909, 13910, 13911, 13913, 13915, 13917, 13918, 13919, 13923, 13924, 13929, 13947, 13950, 13952, 13953, 13954, 13958, 13960, 13961, 13963, 13969, 13970, 13974, 13975, 13976, 13984, 13986, 13987, 13991, 14000, 14001, 14005, 14006, 14008, 14014, 14017, 14018, 14022, 14027, 14030, 14031, 14036, 14038, 14040, 14043, 14052, 14054, 14059, 14062, 14063, 14066, 14067, 14069, 14070, 14071, 14073, 14075, 14076, 14078, 14081, 14085, 14086, 14087, 14088, 14092, 14094, 14097, 14112, 14115, 14116, 14117, 14118, 14119, 14121, 14122, 14124, 14125, 14129, 14132, 14133, 14135, 14138, 14139, 14140, 14141, 14142, 14145, 14146, 14147.

Promoters expressing in the endosperm at 18 days after pollination include SEQ IDs: 3, 7, 12, 14, 15, 17, 19, 29, 31, 36, 37, 45, 48, 54, 57, 64, 65, 79, 80, 86, 88, 90, 93, 94, 95, 96, 98, 99, 102, 103, 104, 108, 110, 112, 117, 123, 126, 128, 130, 131, 132, 134, 136, 137, 143, 146, 152, 154, 156, 157, 159, 162, 165, 168, 169, 172, 174, 175, 176, 181, 183, 187, 191, 193, 194, 197, 199, 202, 203, 204, 205, 207, 210, 211, 212, 214, 232, 233, 235, 236, 237, 240, 242, 246, 249, 250, 251, 256, 257, 259, 262, 264, 267, 269, 270, 271, 273, 280, 281, 286, 288, 293, 294, 299, 301, 302, 305, 306, 308, 309, 316, 319, 320, 322, 323, 328, 329, 332, 334, 335, 338, 340, 346, 349, 352, 354, 355, 356, 358, 359, 360, 364, 365, 367, 371, 372, 373, 374, 379, 381, 388, 389, 396, 401, 411, 412, 414, 416, 423, 428, 431, 432, 433, 434, 436, 441, 448, 450, 452, 456, 459, 461, 462, 463, 466, 468, 470, 471, 474, 478, 483, 485, 488, 489, 493, 496, 498, 504, 507, 509, 510, 511, 514, 516, 517, 523, 525, 528, 532, 537, 541, 543, 544, 546, 547, 548, 553, 554, 557, 560, 561, 573, 578, 580, 582, 585, 589, 591, 594, 595, 596, 599, 601, 602, 606, 607, 608, 613, 619, 620, 623, 629, 630, 631, 633, 635, 636, 637, 638, 643, 645, 647, 656, 661, 662, 663, 664, 670, 671, 681, 683, 684, 692, 693, 694, 701, 702, 705, 706, 707, 708, 709, 716, 717, 718, 719, 721, 722, 724, 727, 731, 732, 733, 734, 739, 740, 742, 744, 749, 753, 757, 759, 760, 761, 762, 764, 765, 771, 779, 781, 783, 784, 786, 793, 798, 800, 804, 806, 808, 809, 811, 812, 820, 821, 822, 829, 830, 831, 832, 833, 834, 835, 841, 845, 846, 855, 856, 857, 858, 860, 862, 863, 865, 869, 870, 871, 875, 876, 877, 887, 890, 891, 892, 893, 895, 897, 898, 900, 903, 907, 908, 910, 911, 912, 915, 916, 919, 920, 924, 928, 929, 931, 932, 934, 936, 938, 939, 943, 944, 947, 949, 951, 953, 955, 957, 958, 960, 964, 971, 974, 975, 977, 978, 979, 980, 982, 984, 985, 987, 988, 991, 994, 995, 996, 997, 999, 1002, 1007, 1008, 1009, 1010, 1011, 1012, 1013, 1014, 1016, 1017, 1019, 1021, 1022, 1025, 1026, 1032, 1033, 1035, 1038, 1039, 1041, 1042, 1043, 1046, 1047, 1049, 1051, 1052, 1055, 1056, 1057, 1064, 1065, 1069, 1070, 1073, 1077, 1080, 1086, 1087, 1089, 1092, 1095, 1096, 1100, 1101, 1103, 1104, 1112, 1114, 1115, 1116, 1117, 1119, 1121, 1125, 1127, 1130, 1132, 1136, 1137, 1140, 1144, 1146, 1154, 1155, 1160, 1161, 1165, 1167, 1168, 1170, 1171, 1174, 1176, 1178, 1183, 1187, 1190, 1191, 1196, 1198, 1199, 1200, 1204, 1205, 1214, 1215, 1218, 1220, 1222, 1223, 1225, 1228, 1230, 1232, 1233, 1236, 1240, 1244, 1246, 1248, 1249, 1250, 1251, 1252, 1253, 1254, 1257, 1258, 1261, 1262, 1263, 1269, 1272, 1277, 1281, 1285, 1286, 1290, 1291, 1292, 1293, 1296, 1306, 1307, 1309, 1310, 1311, 1312, 1314, 1316, 1320, 1321, 1322, 1323, 1327, 1330, 1331, 1334, 1335, 1339, 1344, 1345, 1349, 1360, 1364, 1365, 1366, 1367, 1368, 1371, 1375, 1376, 1377, 1380, 1387, 1388, 1389, 1391, 1393, 1396, 1399, 1404, 1405, 1406, 1412, 1415, 1420, 1421, 1423, 1426, 1431, 1432, 1433, 1438, 1440, 1441, 1442, 1447, 1451, 1453, 1458, 1459, 1462, 1466, 1467, 1468, 1471, 1472, 1475, 1484, 1488, 1490, 1491, 1493, 1497, 1498, 1499, 1501, 1503, 1506, 1508, 1510, 1511, 1512, 1514, 1518, 1525, 1526, 1527, 1528, 1530, 1539, 1543, 1545, 1549, 1550, 1551, 1553, 1555, 1556, 1560, 1561, 1563, 1567, 1570, 1575, 1576, 1578, 1579, 1584, 1585, 1586, 1590, 1591, 1596, 1597, 1598, 1599, 1600, 1601, 1602, 1604, 1605, 1608, 1609, 1610, 1612, 1614, 1615, 1616, 1617, 1623, 1625, 1634, 1635, 1637, 1638, 1641, 1642, 1643, 1650, 1651, 1654, 1658, 1659, 1662, 1663, 1669, 1671, 1673, 1675, 1676, 1678, 1681, 1682, 1684, 1687, 1688, 1689, 1690, 1691, 1696, 1698, 1705, 1706, 1707, 1708, 1710, 1716, 1717, 1725, 1732, 1735, 1750, 1755, 1759, 1761, 1764, 1769, 1770, 1771, 1773, 1774, 1776, 1777, 1785, 1786, 1789, 1791, 1792, 1798, 1807, 1808, 1809, 1811, 1820, 1826, 1828, 1830, 1832, 1834, 1835, 1837, 1839, 1840, 1843, 1846, 1848, 1851, 1852, 1854, 1855, 1859, 1861, 1863, 1866, 1867, 1869, 1872, 1873, 1876, 1879, 1882, 1886, 1888, 1891, 1893, 1895, 1897, 1900, 1902, 1905, 1906, 1910, 1911, 1913, 1914, 1915, 1916, 1918, 1920, 1922, 1923, 1924, 1930, 1931, 1936, 1939, 1940, 1945, 1949, 1950, 1951, 1952, 1953, 1958, 1964, 1968, 1970, 1971, 1972, 1973, 1977, 1990, 1993, 1999, 2000, 2001, 2002, 2007, 2008, 2009, 2010, 2012, 2014, 2015, 2017, 2019, 2021, 2026, 2031, 2032, 2033, 2037, 2038, 2040, 2041, 2043, 2048, 2051, 2060, 2062, 2064, 2071, 2072, 2074, 2077, 2078, 2085, 2087, 2088, 2089, 2091, 2092, 2093, 2094, 2097, 2103, 2106, 2107, 2111, 2112, 2116, 2117, 2122, 2123, 2125, 2126, 2128, 2132, 2133, 2139, 2142, 2143, 2144, 2146, 2147, 2150, 2151, 2152, 2156, 2157, 2161, 2162, 2164, 2167, 2168, 2170, 2175, 2177, 2179, 2185, 2188, 2189, 2190, 2193, 2195, 2196, 2200, 2202, 2203, 2206, 2207, 2210, 2215, 2216, 2218, 2221, 2223, 2240, 2241, 2242, 2243, 2245, 2253, 2257, 2258, 2260, 2263, 2265, 2266, 2267, 2274, 2276, 2280, 2281, 2282, 2283, 2284, 2288, 2290, 2291, 2293, 2296, 2297, 2298, 2300, 2303, 2304, 2306, 2308, 2309, 2310, 2313, 2314, 2322, 2323, 2328, 2329, 2331, 2333, 2335, 2339, 2342, 2353, 2359, 2361, 2362, 2363, 2366, 2369, 2371, 2372, 2376, 2379, 2380, 2381, 2382, 2384, 2399, 2400, 2401, 2402, 2405, 2406, 2410, 2412, 2413, 2414, 2416, 2417, 2418, 2419, 2420, 2423, 2426, 2430, 2431, 2432, 2433, 2434, 2435, 2437, 2439, 2440, 2441, 2442, 2443, 2445, 2449, 2451, 2452, 2453, 2454, 2456, 2457, 2458, 2465, 2469, 2470, 2472, 2474, 2476, 2477, 2480, 2481, 2482, 2487, 2490, 2495, 2496, 2498, 2500, 2504, 2505, 2506, 2507, 2509, 2513, 2514, 2515, 2516, 2517, 2519, 2521, 2522, 2525, 2528, 2529, 2531, 2532, 2533, 2536, 2537, 2538, 2539, 2541, 2543, 2545, 2546, 2549, 2550, 2551, 2552, 2554, 2555, 2559, 2560, 2565, 2567, 2568, 2570, 2571, 2573, 2578, 2579, 2581, 2583, 2589, 2590, 2591, 2594, 2596, 2599, 2600, 2601, 2605, 2609, 2611, 2613, 2614, 2616, 2620, 2625, 2626, 2627, 2632, 2634, 2635, 2636, 2637, 2639, 2644, 2645, 2649, 2652, 2655, 2656, 2658, 2663, 2671, 2672, 2674, 2684, 2685, 2687, 2688, 2689, 2690, 2691, 2692, 2694, 2700, 2702, 2704, 2708, 2709, 2715, 2719, 2720, 2721, 2722, 2725, 2726, 2728, 2729, 2735, 2738, 2739, 2745, 2746, 2747, 2749, 2752, 2756, 2758, 2762, 2764, 2765, 2770, 2776, 2780, 2783, 2784, 2785, 2787, 2791, 2794, 2798, 2800, 2801, 2802, 2805, 2808, 2812, 2814, 2819, 2821, 2822, 2823, 2824, 2826, 2827, 2828, 2831, 2833, 2837, 2838, 2840, 2844, 2845, 2850, 2857, 2860, 2865, 2869, 2871, 2876, 2878, 2888, 2889, 2890, 2892, 2893, 2894, 2895, 2896, 2897, 2901, 2902, 2903, 2906, 2908, 2909, 2915, 2916, 2917, 2922, 2923, 2926, 2929, 2930, 2931, 2935, 2941, 2942, 2943, 2944, 2946, 2947, 2948, 2955, 2959, 2963, 2966, 2968, 2976, 2979, 2981, 2982, 2987, 2992, 2994, 3003, 3005, 3006, 3007, 3009, 3013, 3015, 3017, 3018, 3020, 3023, 3024, 3029, 3039, 3041, 3042, 3044, 3045, 3047, 3048, 3049, 3051, 3052, 3053, 3055, 3058, 3059, 3061, 3064, 3068, 3070, 3072, 3075, 3080, 3083, 3084, 3085, 3087, 3090, 3095, 3097, 3100, 3106, 3115, 3118, 3119, 3120, 3121, 3123, 3127, 3128, 3137, 3138, 3139, 3143, 3145, 3153, 3167, 3169, 3170, 3171, 3172, 3173, 3177, 3181, 3189, 3191, 3192, 3194, 3196, 3205, 3206, 3208, 3210, 3217, 3219, 3220, 3221, 3224, 3225, 3228, 3230, 3231, 3236, 3240, 3242, 3246, 3247, 3249, 3250, 3252, 3254, 3261, 3263, 3266, 3269, 3271, 3272, 3278, 3280, 3283, 3286, 3288, 3290, 3291, 3294, 3295, 3297, 3299, 3301, 3308, 3310, 3312, 3313, 3324, 3325, 3327, 3331, 3332, 3333, 3337, 3338, 3340, 3342, 3343, 3345, 3347, 3351, 3353, 3355, 3357, 3358, 3359, 3360, 3361, 3363, 3370, 3374, 3377, 3379, 3382, 3383, 3386, 3394, 3396, 3399, 3403, 3405, 3413, 3415, 3416, 3418, 3419, 3422, 3424, 3425, 3426, 3428, 3429, 3435, 3438, 3446, 3447, 3449, 3452, 3453, 3458, 3461, 3466, 3468, 3469, 3471, 3474, 3477, 3484, 3486, 3487, 3488, 3493, 3497, 3498, 3500, 3502, 3503, 3504, 3506, 3507, 3510, 3516, 3517, 3518, 3523, 3524, 3533, 3535, 3537, 3538, 3540, 3541, 3542, 3544, 3545, 3549, 3554, 3558, 3560, 3561, 3562, 3569, 3571, 3574, 3576, 3580, 3587, 3588, 3589, 3591, 3592, 3594, 3595, 3597, 3603, 3604, 3606, 3607, 3610, 3611, 3613, 3615, 3616, 3620, 3621, 3624, 3629, 3633, 3634, 3636, 3640, 3642, 3643, 3644, 3645, 3646, 3647, 3648, 3659, 3661, 3664, 3665, 3667, 3672, 3674, 3676, 3677, 3681, 3682, 3684, 3685, 3690, 3707, 3709, 3713, 3715, 3718, 3719, 3720, 3721, 3722, 3723, 3726, 3729, 3730, 3731, 3732, 3733, 3738, 3739, 3744, 3749, 3751, 3752, 3756, 3761, 3764, 3765, 3766, 3772, 3773, 3775, 3778, 3785, 3791, 3792, 3793, 3794, 3800, 3801, 3804, 3806, 3808, 3817, 3818, 3819, 3820, 3823, 3825, 3829, 3830, 3832, 3833, 3837, 3838, 3839, 3843, 3844, 3845, 3846, 3847, 3849, 3852, 3858, 3859, 3860, 3867, 3868, 3870, 3871, 3872, 3873, 3876, 3881, 3882, 3884, 3887, 3889, 3890, 3892, 3894, 3895, 3896, 3902, 3903, 3904, 3907, 3908, 3912, 3917, 3918, 3923, 3924, 3926, 3928, 3929, 3933, 3938, 3941, 3943, 3947, 3950, 3954, 3958, 3959, 3961, 3962, 3967, 3968, 3970, 3971, 3974, 3975, 3978, 3983, 3985, 3987, 3988, 3990, 3994, 3995, 3996, 3997, 4001, 4003, 4007, 4008, 4013, 4014, 4021, 4030, 4033, 4037, 4039, 4042, 4043, 4044, 4046, 4047, 4048, 4050, 4051, 4052, 4053, 4054, 4056, 4057, 4062, 4066, 4068, 4070, 4075, 4084, 4087, 4088, 4092, 4094, 4096, 4098, 4099, 4102, 4105, 4106, 4109, 4110, 4113, 4116, 4126, 4128, 4132, 4133, 4134, 4139, 4143, 4144, 4146, 4148, 4149, 4150, 4155, 4158, 4160, 4161, 4162, 4163, 4164, 4165, 4166, 4167, 4168, 4171, 4178, 4181, 4183, 4185, 4187, 4188, 4189, 4191, 4195, 4201, 4202, 4204, 4205, 4206, 4207, 4210, 4211, 4212, 4213, 4217, 4218, 4219, 4221, 4227, 4228, 4229, 4233, 4234, 4235, 4237, 4245, 4246, 4250, 4251, 4252, 4255, 4257, 4261, 4266, 4270, 4272, 4275, 4280, 4281, 4284, 4290, 4292, 4294, 4296, 4298, 4301, 4302, 4305, 4309, 4312, 4317, 4320, 4321, 4324, 4329, 4330, 4335, 4337, 4339, 4341, 4344, 4347, 4355, 4356, 4357, 4358, 4360, 4369, 4370, 4378, 4380, 4383, 4390, 4391, 4392, 4393, 4396, 4397, 4401, 4402, 4403, 4404, 4405, 4409, 4410, 4422, 4423, 4425, 4430, 4432, 4439, 4440, 4442, 4443, 4446, 4448, 4450, 4453, 4456, 4458, 4461, 4462, 4463, 4466, 4468, 4470, 4471, 4474, 4475, 4479, 4486, 4492, 4494, 4498, 4500, 4502, 4507, 4508, 4512, 4514, 4515, 4519, 4521, 4522, 4524, 4525, 4529, 4531, 4535, 4541, 4548, 4549, 4551, 4554, 4556, 4557, 4558, 4560, 4561, 4562, 4563, 4565, 4566, 4568, 4575, 4576, 4580, 4582, 4583, 4590, 4591, 4593, 4594, 4597, 4598, 4601, 4606, 4612, 4613, 4616, 4618, 4623, 4625, 4628, 4630, 4632, 4634, 4635, 4639, 4641, 4643, 4644, 4645, 4646, 4647, 4650, 4651, 4653, 4654, 4655, 4656, 4658, 4659, 4662, 4664, 4667, 4669, 4671, 4673, 4674, 4676, 4677, 4680, 4682, 4685, 4691, 4692, 4693, 4694, 4697, 4699, 4700, 4706, 4708, 4710, 4711, 4713, 4714, 4719, 4721, 4722, 4723, 4724, 4729, 4730, 4734, 4737, 4738, 4739, 4740, 4741, 4745, 4749, 4753, 4755, 4756, 4760, 4761, 4762, 4763, 4766, 4767, 4769, 4770, 4771, 4773, 4775, 4779, 4780, 4784, 4787, 4788, 4789, 4790, 4791, 4794, 4795, 4796, 4801, 4803, 4804, 4805, 4806, 4807, 4813, 4814, 4818, 4822, 4827, 4828, 4830, 4831, 4834, 4838, 4840, 4841, 4842, 4847, 4855, 4856, 4857, 4861, 4862, 4863, 4864, 4869, 4874, 4875, 4876, 4878, 4881, 4887, 4889, 4891, 4893, 4896, 4897, 4900, 4904, 4905, 4907, 4909, 4910, 4913, 4914, 4920, 4921, 4922, 4924, 4928, 4935, 4936, 4941, 4942, 4944, 4945, 4954, 4956, 4958, 4959, 4960, 4967, 4969, 4971, 4972, 4974, 4975, 4980, 4985, 4987, 4988, 4993, 4996, 5007, 5013, 5015, 5016, 5021, 5023, 5024, 5026, 5029, 5030, 5034, 5036, 5037, 5038, 5039, 5040, 5042, 5044, 5045, 5046, 5051, 5052, 5054, 5057, 5060, 5067, 5068, 5069, 5072, 5075, 5078, 5082, 5087, 5088, 5089, 5094, 5100, 5101, 5102, 5106, 5110, 5113, 5114, 5119, 5120, 5122, 5123, 5125, 5131, 5132, 5140, 5143, 5145, 5147, 5149, 5159, 5160, 5163, 5164, 5165, 5166, 5168, 5169, 5170, 5174, 5180, 5181, 5182, 5184, 5185, 5187, 5188, 5189, 5190, 5191, 5192, 5195, 5196, 5198, 5200, 5202, 5206, 5212, 5213, 5216, 5217, 5218, 5219, 5224, 5225, 5229, 5234, 5240, 5241, 5244, 5245, 5248, 5251, 5253, 5254, 5255, 5256, 5257, 5258, 5260, 5261, 5262, 5263, 5266, 5268, 5269, 5273, 5275, 5276, 5280, 5281, 5282, 5283, 5286, 5292, 5293, 5297, 5298, 5299, 5300, 5301, 5308, 5311, 5314, 5315, 5317, 5319, 5321, 5322, 5324, 5329, 5330, 5333, 5334, 5338, 5339, 5343, 5345, 5346, 5348, 5349, 5351, 5352, 5361, 5366, 5367, 5369, 5386, 5388, 5389, 5393, 5395, 5396, 5397, 5398, 5400, 5402, 5405, 5413, 5414, 5418, 5422, 5426, 5427, 5428, 5431, 5434, 5437, 5438, 5445, 5446, 5452, 5453, 5456, 5458, 5459, 5461, 5472, 5475, 5483, 5487, 5491, 5493, 5495, 5496, 5505, 5506, 5508, 5510, 5512, 5513, 5515, 5517, 5518, 5519, 5524, 5530, 5531, 5532, 5535, 5541, 5543, 5545, 5549, 5554, 5558, 5563, 5564, 5566, 5568, 5569, 5572, 5575, 5579, 5581, 5582, 5584, 5585, 5586, 5587, 5589, 5592, 5593, 5594, 5597, 5602, 5608, 5613, 5614, 5615, 5616, 5620, 5623, 5627, 5632, 5633, 5635, 5638, 5640, 5643, 5647, 5648, 5649, 5650, 5651, 5652, 5653, 5656, 5659, 5660, 5663, 5664, 5667, 5669, 5675, 5676, 5680, 5681, 5689, 5690, 5694, 5695, 5696, 5697, 5698, 5702, 5706, 5711, 5712, 5713, 5714, 5717, 5718, 5719, 5721, 5722, 5723, 5729, 5730, 5731, 5732, 5734, 5735, 5736, 5737, 5742, 5744, 5746, 5748, 5751, 5764, 5768, 5770, 5771, 5773, 5775, 5778, 5780, 5782, 5783, 5785, 5787, 5791, 5792, 5794, 5803, 5806, 5807, 5808, 5810, 5811, 5817, 5820, 5823, 5826, 5828, 5832, 5833, 5834, 5835, 5836, 5839, 5842, 5844, 5853, 5854, 5859, 5864, 5866, 5867, 5869, 5871, 5872, 5873, 5876, 5878, 5879, 5881, 5882, 5883, 5884, 5888, 5889, 5892, 5893, 5900, 5901, 5902, 5906, 5907, 5910, 5912, 5918, 5919, 5921, 5925, 5926, 5927, 5928, 5931, 5932, 5933, 5936, 5938, 5939, 5940, 5941, 5943, 5944, 5948, 5951, 5952, 5954, 5956, 5957, 5959, 5961, 5968, 5971, 5978, 5979, 5980, 5985, 5986, 5988, 5991, 5992, 5994, 5996, 5997, 6000, 6002, 6003, 6004, 6006, 6007, 6012, 6013, 6016, 6017, 6025, 6026, 6038, 6040, 6041, 6043, 6044, 6045, 6047, 6048, 6051, 6053, 6054, 6058, 6059, 6060, 6061, 6062, 6063, 6068, 6069, 6070, 6072, 6073, 6074, 6075, 6077, 6080, 6083, 6085, 6092, 6093, 6094, 6095, 6097, 6098, 6107, 6108, 6109, 6110, 6112, 6113, 6116, 6118, 6119, 6122, 6125, 6129, 6130, 6131, 6132, 6133, 6136, 6137, 6145, 6146, 6147, 6151, 6152, 6153, 6156, 6163, 6164, 6165, 6168, 6173, 6182, 6183, 6186, 6188, 6189, 6190, 6191, 6193, 6196, 6197, 6198, 6200, 6205, 6207, 6209, 6212, 6213, 6215, 6220, 6221, 6223, 6224, 6227, 6228, 6230, 6231, 6234, 6238, 6240, 6241, 6243, 6246, 6249, 6251, 6255, 6257, 6258, 6259, 6264, 6265, 6269, 6270, 6271, 6272, 6273, 6278, 6279, 6280, 6281, 6282, 6283, 6284, 6285, 6286, 6287, 6292, 6294, 6296, 6299, 6300, 6302, 6303, 6304, 6309, 6310, 6311, 6315, 6317, 6319, 6321, 6322, 6325, 6326, 6328, 6333, 6338, 6345, 6351, 6352, 6353, 6354, 6359, 6360, 6362, 6363, 6364, 6367, 6370, 6372, 6375, 6378, 6381, 6383, 6394, 6395, 6396, 6397, 6398, 6399, 6403, 6405, 6407, 6408, 6412, 6414, 6415, 6419, 6420, 6422, 6429, 6430, 6431, 6434, 6436, 6437, 6440, 6441, 6442, 6452, 6454, 6456, 6458, 6459, 6463, 6464, 6466, 6467, 6468, 6469, 6470, 6471, 6474, 6476, 6480, 6482, 6486, 6488, 6494, 6495, 6500, 6501, 6502, 6503, 6504, 6505, 6510, 6513, 6514, 6516, 6517, 6519, 6524, 6530, 6533, 6534, 6535, 6537, 6539, 6543, 6544, 6547, 6548, 6549, 6553, 6554, 6555, 6558, 6560, 6561, 6563, 6567, 6569, 6572, 6574, 6576, 6577, 6579, 6581, 6582, 6584, 6587, 6588, 6595, 6597, 6598, 6603, 6607, 6609, 6611, 6621, 6622, 6624, 6626, 6628, 6630, 6634, 6635, 6637, 6638, 6639, 6643, 6649, 6650, 6655, 6656, 6658, 6662, 6666, 6671, 6672, 6678, 6679, 6681, 6691, 6692, 6695, 6699, 6703, 6705, 6706, 6711, 6714, 6716, 6718, 6720, 6724, 6729, 6731, 6733, 6734, 6737, 6739, 6746, 6747, 6748, 6749, 6758, 6759, 6761, 6766, 6778, 6779, 6780, 6783, 6786, 6788, 6793, 6794, 6795, 6797, 6799, 6803, 6804, 6805, 6807, 6810, 6811, 6812, 6813, 6816, 6819, 6820, 6821, 6824, 6827, 6828, 6830, 6834, 6836, 6839, 6840, 6841, 6842, 6843, 6845, 6848, 6852, 6859, 6864, 6869, 6872, 6874, 6875, 6876, 6878, 6879, 6880, 6886, 6887, 6897, 6903, 6906, 6907, 6909, 6914, 6915, 6919, 6920, 6921, 6923, 6924, 6930, 6933, 6936, 6941, 6946, 6948, 6950, 6952, 6959, 6960, 6963, 6967, 6969, 6970, 6979, 6980, 6984, 6985, 6987, 6988, 6990, 6993, 6994, 6999, 7006, 7010, 7011, 7012, 7013, 7015, 7022, 7031, 7032, 7035, 7042, 7043, 7045, 7046, 7048, 7051, 7052, 7053, 7056, 7057, 7064, 7067, 7069, 7072, 7074, 7075, 7077, 7083, 7085, 7086, 7097, 7103, 7105, 7106, 7107, 7108, 7109, 7112, 7116, 7117, 7118, 7124, 7126, 7130, 7132, 7135, 7137, 7140, 7142, 7144, 7146, 7149, 7155, 7163, 7164, 7165, 7166, 7169, 7172, 7173, 7176, 7177, 7182, 7184, 7187, 7188, 7189, 7192, 7194, 7196, 7201, 7202, 7203, 7206, 7207, 7209, 7212, 7216, 7217, 7218, 7219, 7227, 7228, 7232, 7233, 7234, 7235, 7236, 7239, 7240, 7243, 7244, 7245, 7248, 7254, 7255, 7257, 7258, 7259, 7262, 7267, 7268, 7274, 7276, 7277, 7278, 7282, 7284, 7286, 7287, 7288, 7290, 7291, 7292, 7293, 7298, 7299, 7300, 7301, 7303, 7304, 7305, 7306, 7307, 7310, 7313, 7315, 7317, 7321, 7328, 7330, 7334, 7340, 7344, 7345, 7354, 7355, 7356, 7357, 7358, 7365, 7371, 7373, 7379, 7382, 7383, 7385, 7386, 7388, 7389, 7392, 7395, 7398, 7399, 7406, 7409, 7411, 7415, 7418, 7425, 7427, 7428, 7430, 7433, 7434, 7435, 7436, 7438, 7441, 7443, 7444, 7445, 7446, 7447, 7448, 7454, 7458, 7459, 7466, 7470, 7474, 7475, 7483, 7486, 7487, 7490, 7493, 7498, 7504, 7505, 7506, 7512, 7515, 7517, 7523, 7525, 7528, 7533, 7537, 7538, 7542, 7546, 7547, 7548, 7554, 7557, 7561, 7570, 7577, 7578, 7579, 7580, 7585, 7586, 7589, 7591, 7593, 7594, 7595, 7601, 7605, 7611, 7619, 7620, 7621, 7623, 7624, 7633, 7639, 7640, 7642, 7643, 7652, 7653, 7658, 7661, 7663, 7664, 7665, 7666, 7667, 7674, 7677, 7678, 7679, 7680, 7682, 7687, 7689, 7695, 7699, 7700, 7703, 7704, 7708, 7712, 7713, 7716, 7717, 7718, 7719, 7724, 7725, 7727, 7729, 7730, 7733, 7736, 7737, 7738, 7740, 7743, 7744, 7745, 7747, 7751, 7753, 7754, 7761, 7762, 7763, 7764, 7767, 7768, 7769, 7770, 7774, 7775, 7777, 7778, 7779, 7782, 7785, 7786, 7791, 7793, 7796, 7798, 7800, 7802, 7803, 7804, 7806, 7807, 7812, 7815, 7818, 7819, 7820, 7823, 7824, 7825, 7832, 7833, 7834, 7838, 7841, 7844, 7845, 7848, 7849, 7853, 7854, 7856, 7859, 7860, 7862, 7863, 7865, 7870, 7876, 7878, 7880, 7881, 7888, 7890, 7896, 7900, 7908, 7910, 7911, 7913, 7918, 7921, 7922, 7923, 7925, 7927, 7929, 7933, 7934, 7935, 7936, 7938, 7942, 7944, 7945, 7946, 7947, 7948, 7952, 7955, 7956, 7960, 7964, 7972, 7974, 7976, 7977, 7978, 7980, 7981, 7983, 7984, 7986, 7989, 7990, 7991, 7993, 7998, 7999, 8001, 8002, 8005, 8006, 8007, 8009, 8012, 8020, 8021, 8023, 8026, 8029, 8039, 8042, 8043, 8044, 8047, 8052, 8053, 8056, 8058, 8059, 8061, 8063, 8067, 8068, 8071, 8073, 8075, 8076, 8077, 8078, 8080, 8082, 8084, 8088, 8091, 8093, 8095, 8100, 8103, 8105, 8106, 8112, 8116, 8118, 8121, 8126, 8130, 8136, 8137, 8143, 8147, 8148, 8150, 8151, 8158, 8159, 8162, 8163, 8165, 8168, 8170, 8176, 8178, 8179, 8182, 8184, 8185, 8187, 8188, 8189, 8192, 8193, 8195, 8199, 8202, 8204, 8207, 8208, 8211, 8213, 8216, 8219, 8220, 8222, 8223, 8225, 8227, 8231, 8234, 8235, 8236, 8237, 8239, 8240, 8242, 8245, 8246, 8250, 8252, 8253, 8266, 8268, 8269, 8270, 8272, 8274, 8282, 8288, 8289, 8292, 8293, 8294, 8300, 8301, 8304, 8310, 8311, 8312, 8313, 8317, 8318, 8319, 8320, 8329, 8331, 8339, 8340, 8349, 8350, 8352, 8353, 8355, 8361, 8363, 8367, 8368, 8369, 8373, 8376, 8379, 8385, 8387, 8389, 8390, 8392, 8395, 8401, 8402, 8403, 8404, 8405, 8409, 8410, 8413, 8414, 8416, 8423, 8433, 8435, 8436, 8438, 8439, 8441, 8442, 8444, 8445, 8446, 8447, 8448, 8450, 8451, 8452, 8457, 8458, 8459, 8472, 8473, 8474, 8476, 8477, 8481, 8482, 8486, 8490, 8493, 8498, 8501, 8503, 8505, 8509, 8511, 8513, 8514, 8515, 8516, 8517, 8520, 8523, 8524, 8525, 8527, 8528, 8531, 8533, 8535, 8537, 8538, 8539, 8541, 8542, 8544, 8549, 8550, 8552, 8553, 8554, 8558, 8561, 8562, 8565, 8566, 8568, 8575, 8576, 8579, 8581, 8582, 8589, 8590, 8592, 8593, 8594, 8596, 8597, 8599, 8600, 8601, 8602, 8603, 8605, 8609, 8611, 8612, 8614, 8617, 8618, 8624, 8630, 8631, 8634, 8637, 8638, 8640, 8642, 8644, 8648, 8650, 8654, 8657, 8658, 8659, 8663, 8665, 8669, 8672, 8676, 8677, 8685, 8690, 8693, 8694, 8700, 8703, 8704, 8706, 8708, 8709, 8713, 8716, 8717, 8720, 8726, 8728, 8729, 8732, 8734, 8736, 8740, 8741, 8742, 8744, 8745, 8746, 8748, 8752, 8764, 8766, 8767, 8770, 8772, 8773, 8776, 8777, 8779, 8782, 8783, 8784, 8789, 8792, 8797, 8803, 8805, 8810, 8818, 8821, 8822, 8824, 8829, 8830, 8831, 8832, 8834, 8835, 8838, 8843, 8846, 8853, 8854, 8859, 8861, 8865, 8866, 8867, 8875, 8878, 8881, 8883, 8884, 8886, 8888, 8890, 8891, 8892, 8896, 8897, 8899, 8900, 8902, 8907, 8908, 8909, 8910, 8911, 8913, 8914, 8916, 8917, 8924, 8926, 8929, 8930, 8935, 8938, 8941, 8942, 8945, 8946, 8949, 8951, 8954, 8956, 8957, 8959, 8960, 8961, 8962, 8963, 8967, 8968, 8969, 8972, 8974, 8976, 8977, 8979, 8980, 8981, 8985, 8986, 8992, 8996, 8998, 8999, 9000, 9001, 9002, 9003, 9006, 9009, 9012, 9015, 9018, 9020, 9023, 9029, 9030, 9033, 9037, 9044, 9052, 9056, 9058, 9059, 9060, 9061, 9066, 9069, 9071, 9072, 9073, 9074, 9076, 9080, 9084, 9091, 9092, 9095, 9096, 9105, 9108, 9110, 9111, 9112, 9114, 9115, 9116, 9118, 9123, 9124, 9125, 9128, 9129, 9133, 9134, 9138, 9139, 9140, 9141, 9142, 9149, 9151, 9152, 9155, 9172, 9173, 9174, 9177, 9183, 9185, 9187, 9188, 9190, 9191, 9195, 9199, 9206, 9207, 9210, 9211, 9213, 9214, 9215, 9216, 9223, 9226, 9229, 9233, 9241, 9243, 9247, 9248, 9249, 9252, 9253, 9254, 9255, 9263, 9265, 9267, 9270, 9273, 9278, 9284, 9285, 9288, 9289, 9290, 9292, 9293, 9298, 9299, 9300, 9302, 9304, 9308, 9311, 9314, 9316, 9320, 9321, 9323, 9325, 9326, 9327, 9328, 9329, 9330, 9333, 9336, 9337, 9339, 9340, 9341, 9345, 9346, 9347, 9348, 9354, 9355, 9359, 9367, 9373, 9375, 9376, 9382, 9383, 9388, 9391, 9392, 9393, 9394, 9396, 9398, 9400, 9402, 9403, 9404, 9406, 9407, 9412, 9413, 9414, 9415, 9423, 9432, 9433, 9434, 9440, 9442, 9444, 9449, 9451, 9452, 9456, 9460, 9468, 9471, 9472, 9473, 9478, 9483, 9486, 9488, 9490, 9494, 9495, 9497, 9500, 9501, 9502, 9503, 9504, 9505, 9509, 9514, 9515, 9517, 9518, 9519, 9520, 9525, 9531, 9533, 9534, 9536, 9540, 9545, 9546, 9548, 9549, 9553, 9554, 9555, 9563, 9564, 9565, 9568, 9571, 9577, 9582, 9583, 9587, 9589, 9590, 9591, 9596, 9602, 9606, 9607, 9609, 9610, 9613, 9614, 9615, 9618, 9620, 9623, 9624, 9626, 9627, 9628, 9629, 9633, 9635, 9640, 9641, 9642, 9644, 9645, 9646, 9648, 9649, 9650, 9653, 9655, 9656, 9658, 9659, 9660, 9663, 9666, 9668, 9670, 9677, 9681, 9682, 9686, 9692, 9698, 9700, 9706, 9707, 9710, 9711, 9718, 9722, 9723, 9724, 9726, 9730, 9731, 9733, 9734, 9737, 9744, 9745, 9746, 9750, 9753, 9754, 9756, 9763, 9764, 9767, 9768, 9770, 9776, 9780, 9781, 9782, 9784, 9786, 9792, 9793, 9794, 9796, 9799, 9801, 9804, 9812, 9813, 9816, 9819, 9824, 9825, 9827, 9830, 9833, 9836, 9845, 9847, 9849, 9850, 9851, 9853, 9854, 9861, 9864, 9866, 9869, 9871, 9873, 9882, 9886, 9887, 9892, 9897, 9901, 9906, 9907, 9908, 9909, 9910, 9911, 9917, 9923, 9924, 9928, 9930, 9935, 9938, 9940, 9946, 9947, 9949, 9950, 9953, 9955, 9957, 9960, 9962, 9963, 9964, 9967, 9968, 9971, 9972, 9975, 9979, 9980, 9982, 9984, 9985, 9987, 9988, 9990, 9997, 9998, 10000, 10008, 10009, 10010, 10013, 10017, 10018, 10019, 10021, 10022, 10026, 10031, 10032, 10033, 10037, 10038, 10040, 10041, 10042, 10043, 10045, 10048, 10051, 10052, 10054, 10056, 10059, 10060, 10062, 10063, 10064, 10068, 10075, 10077, 10078, 10083, 10089, 10091, 10092, 10093, 10095, 10097, 10101, 10102, 10103, 10105, 10106, 10107, 10108, 10109, 10110, 10114, 10115, 10116, 10117, 10118, 10119, 10122, 10127, 10128, 10131, 10132, 10136, 10138, 10143, 10146, 10149, 10151, 10152, 10158, 10163, 10165, 10166, 10168, 10170, 10174, 10176, 10178, 10181, 10182, 10191, 10192, 10193, 10194, 10195, 10197, 10199, 10203, 10209, 10213, 10214, 10218, 10219, 10220, 10222, 10223, 10225, 10228, 10231, 10233, 10234, 10236, 10237, 10238, 10239, 10247, 10252, 10255, 10258, 10262, 10275, 10278, 10284, 10286, 10291, 10292, 10295, 10300, 10302, 10306, 10307, 10311, 10321, 10323, 10324, 10325, 10326, 10328, 10330, 10331, 10333, 10334, 10335, 10336, 10338, 10343, 10352, 10353, 10357, 10359, 10360, 10362, 10364, 10368, 10373, 10375, 10378, 10380, 10384, 10385, 10388, 10389, 10397, 10398, 10399, 10400, 10401, 10405, 10408, 10410, 10413, 10414, 10416, 10421, 10422, 10423, 10427, 10428, 10429, 10430, 10435, 10437, 10438, 10440, 10442, 10443, 10446, 10448, 10449, 10450, 10451, 10453, 10455, 10463, 10464, 10465, 10466, 10468, 10469, 10470, 10474, 10478, 10480, 10482, 10490, 10492, 10494, 10495, 10496, 10504, 10506, 10508, 10513, 10514, 10515, 10518, 10521, 10525, 10527, 10528, 10530, 10531, 10533, 10535, 10536, 10541, 10542, 10543, 10544, 10547, 10548, 10549, 10550, 10551, 10555, 10556, 10558, 10560, 10561, 10562, 10565, 10567, 10569, 10571, 10577, 10580, 10581, 10582, 10583, 10585, 10589, 10593, 10595, 10596, 10597, 10600, 10601, 10602, 10606, 10609, 10610, 10611, 10614, 10615, 10616, 10617, 10618, 10621, 10622, 10623, 10626, 10628, 10629, 10630, 10631, 10633, 10636, 10637, 10638, 10639, 10640, 10641, 10642, 10645, 10646, 10648, 10649, 10650, 10655, 10657,
10663, 10665, 10668, 10671, 10673, 10674, 10677, 10678,
10681, 10682, 10683, 10684, 10685, 10687, 10689, 10697,
10698, 10699, 10700, 10702, 10703, 10705, 10707, 10708,
10711, 10712, 10715, 10716, 10721, 10723, 10725, 10726,
10730, 10732, 10734, 10735, 10736, 10737, 10740, 10744,
10747, 10748, 10749, 10752, 10753, 10756, 10761, 10762,
10763, 10766, 10775, 10778, 10779, 10782, 10784, 10785,
10787, 10788, 10790, 10791, 10792, 10795, 10796, 10798,
10800, 10801, 10802, 10803, 10805, 10809, 10810, 10811,
10813, 10815, 10818, 10819, 10820, 10821, 10824, 10825,
10826, 10828, 10831, 10833, 10836, 10838, 10839, 10840,
10841, 10843, 10845, 10846, 10850, 10852, 10853, 10858,
10860, 10861, 10862, 10864, 10867, 10870, 10874, 10877,
10880, 10881, 10892, 10896, 10897, 10898, 10899, 10902,
10903, 10905, 10912, 10917, 10920, 10926, 10927, 10930,
10933, 10934, 10935, 10936, 10937, 10938, 10940, 10941,
10944, 10947, 10948, 10950, 10954, 10957, 10960, 10962,
10963, 10964, 10965, 10967, 10972, 10975, 10976, 10977,
10980, 10985, 10988, 10993, 10995, 10996, 10997, 10998,
10999, 11002, 11004, 11005, 11006, 11008, 11009, 11010,
11015, 11016, 11018, 11022, 11024, 11027, 11030, 11032,
11039, 11044, 11046, 11047, 11049, 11053, 11056, 11058,
11060, 11061, 11066, 11068, 11070, 11071, 11072, 11078,
11079, 11080, 11082, 11083, 11086, 11090, 11095, 11098,
11102, 11107, 11110, 11114, 11116, 11118, 11119, 11123,
11124, 11125, 11126, 11127, 11129, 11132, 11134, 11135,
11137, 11138, 11145, 11146, 11153, 11154, 11158, 11159,
11160, 11161, 11162, 11163, 11166, 11168, 11169, 11174,
11175, 11177, 11178, 11184, 11187, 11188, 11190, 11191,
11192, 11198, 11199, 11201, 11202, 11203, 11206, 11207,
11210, 11214, 11217, 11218, 11222, 11226, 11227, 11228,
11232, 11233, 11234, 11235, 11236, 11237, 11238, 11239,
11240, 11246, 11247, 11248, 11254, 11255, 11256, 11257,
11258, 11259, 11260, 11262, 11263, 11264, 11266, 11274,
11275, 11278, 11286, 11288, 11289, 11290, 11291, 11292,
11293, 11294, 11295, 11298, 11306, 11307, 11308, 11313,
11315, 11316, 11318, 11320, 11322, 11324, 11326, 11329,
11332, 11337, 11339, 11340, 11345, 11346, 11348, 11352,
11356, 11363, 11365, 11366, 11370, 11371, 11373, 11374,
11377, 11378, 11380, 11381, 11382, 11388, 11389, 11391,
11392, 11394, 11395, 11402, 11403, 11405, 11406, 11409,
11411, 11412, 11413, 11414, 11416, 11418, 11420, 11423,
11424, 11428, 11430, 11431, 11434, 11437, 11438, 11443,
11446, 11449, 11451, 11458, 11459, 11463, 11465, 11468,
11471, 11472, 11473, 11475, 11476, 11478, 11481, 11482,
11485, 11487, 11490, 11491, 11494, 11496, 11497, 11498,
11500, 11503, 11505, 11506, 11507, 11508, 11509, 11512,
11516, 11518, 11520, 11523, 11526, 11528, 11530, 11531,
11532, 11533, 11534, 11538, 11540, 11541, 11544, 11545,
11546, 11547, 11548, 11551, 11553, 11558, 11560, 11561,
11567, 11568, 11570, 11571, 11576, 11577, 11578, 11579,
11580, 11583, 11589, 11593, 11594, 11595, 11596, 11597,
11599, 11604, 11610, 11615, 11618, 11620, 11621, 11623,
11625, 11628, 11629, 11632, 11633, 11638, 11639, 11642,
11649, 11650, 11652, 11654, 11655, 11656, 11657, 11658,
11663, 11667, 11668, 11669, 11673, 11677, 11678, 11681,
11682, 11683, 11688, 11691, 11692, 11693, 11695, 11701,
11703, 11705, 11707, 11711, 11712, 11721, 11725, 11726,
11731, 11733, 11736, 11741, 11743, 11744, 11746, 11753,
11755, 11756, 11759, 11760, 11761, 11762, 11763, 11764,
11765, 11766, 11767, 11770, 11771, 11776, 11781, 11782,
11783, 11785, 11786, 11790, 11792, 11799, 11800, 11809,
11812, 11813, 11814, 11816, 11818, 11819, 11820, 11821,
11823, 11825, 11826, 11828, 11830, 11837, 11838, 11839,
11841, 11846, 11848, 11849, 11851, 11856, 11858, 11861,
11863, 11868, 11869, 11872, 11876, 11877, 11878, 11879,
11881, 11886, 11890, 11891, 11894, 11895, 11898, 11903,
11908, 11909, 11913, 11919, 11920, 11921, 11923, 11926,
11927, 11928, 11929, 11930, 11934, 11935, 11940, 11943,
11946, 11947, 11948, 11949, 11952, 11953, 11955, 11957,
11958, 11959, 11960, 11961, 11962, 11963, 11965, 11976,
11977, 11978, 11979, 11980, 11983, 11988, 11989, 11991,
11993, 11994, 11995, 11996, 11997, 11998, 11999, 12002,
12004, 12008, 12016, 12018, 12019, 12020, 12021, 12023,
12024, 12025, 12030, 12032, 12042, 12043, 12044, 12047,
12050, 12051, 12054, 12059, 12060, 12061, 12068, 12078,
12079, 12080, 12081, 12082, 12083, 12086, 12091, 12093,
12097, 12098, 12104, 12106, 12109, 12110, 12112, 12115,
12118, 12120, 12122, 12128, 12129, 12131, 12134, 12135,
12136, 12137, 12138, 12139, 12140, 12143, 12144, 12145,
12146, 12147, 12151, 12155, 12161, 12162, 12163, 12165,
12166, 12167, 12170, 12171, 12174, 12176, 12179, 12181,
12186, 12197, 12200, 12201, 12202, 12204, 12208, 12212,
12214, 12215, 12217, 12223, 12230, 12233, 12234, 12237,
12240, 12241, 12243, 12245, 12246, 12250, 12252, 12253,
12254, 12255, 12256, 12259, 12265, 12268, 12271, 12278,
12280, 12283, 12285, 12286, 12287, 12291, 12293, 12295,
12296, 12304, 12310, 12311, 12312, 12313, 12314, 12315,
12317, 12319, 12321, 12323, 12325, 12328, 12331, 12334,
12339, 12342, 12343, 12345, 12347, 12350, 12354, 12356,
12358, 12359, 12364, 12366, 12375, 12376, 12379, 12380,
12381, 12385, 12390, 12393, 12397, 12400, 12403, 12404,
12406, 12409, 12411, 12414, 12415, 12416, 12419, 12420,
12423, 12424, 12425, 12426, 12427, 12437, 12440, 12444,
12445, 12450, 12451, 12455, 12456, 12457, 12459, 12461,
12462, 12465, 12467, 12468, 12470, 12472, 12473, 12475,
12478, 12481, 12485, 12487, 12488, 12489, 12492, 12494,
12495, 12497, 12499, 12501, 12502, 12503, 12510, 12511,
12512, 12513, 12514, 12515, 12518, 12519, 12525, 12527,
12530, 12531, 12535, 12536, 12537, 12538, 12539, 12540,
12546, 12547, 12551, 12552, 12554, 12555, 12556, 12561,
12563, 12565, 12567, 12568, 12570, 12572, 12578, 12583,
12585, 12586, 12588, 12591, 12600, 12605, 12608, 12609,
12610, 12611, 12616, 12620, 12622, 12623, 12626, 12628,
12629, 12633, 12634, 12638, 12639, 12640, 12641, 12644,
12648, 12649, 12651, 12655, 12663, 12664, 12668, 12670,
12671, 12674, 12679, 12681, 12683, 12684, 12688, 12689,
12691, 12693, 12695, 12696, 12697, 12699, 12701, 12702,
12705, 12706, 12707, 12708, 12714, 12723, 12731, 12732,
12733, 12735, 12739, 12740, 12741, 12742, 12751, 12752,
12753, 12754, 12755, 12758, 12760, 12764, 12766, 12771,
12775, 12777, 12779, 12782, 12785, 12790, 12797, 12801,
12802, 12804, 12807, 12810, 12812, 12813, 12817, 12818,
12819, 12820, 12822, 12823, 12824, 12826, 12827, 12828,
12834, 12835, 12837, 12838, 12839, 12843, 12844, 12848,
12849, 12853, 12858, 12860, 12861, 12866, 12870, 12873,
12875, 12878, 12882, 12883, 12884, 12887, 12888, 12891,
12898, 12899, 12900, 12901, 12902, 12903, 12904, 12905,
12906, 12908, 12910, 12912, 12916, 12921, 12923, 12928,
12929, 12932, 12933, 12934, 12945, 12946, 12947, 12952,
12956, 12958, 12959, 12960, 12963, 12967, 12968, 12969,
12978, 12984, 12986, 12987, 12988, 12990, 12991, 12999,
13001, 13003, 13004, 13005, 13007, 13010, 13013, 13014,
13015, 13017, 13018, 13022, 13027, 13030, 13031, 13033,
13034, 13035, 13040, 13041, 13047, 13049, 13050, 13053,
13054, 13055, 13056, 13060, 13061, 13062, 13064, 13066,
13071, 13075, 13083, 13085, 13086, 13087, 13098, 13099,
13101, 13102, 13105, 13110, 13111, 13112, 13114, 13115,
13117, 13118, 13120, 13121, 13122, 13123, 13124, 13125,
13128, 13131, 13134, 13136, 13148, 13149, 13151, 13153,
13154, 13159, 13160, 13169, 13170, 13175, 13181, 13182,
13186, 13187, 13189, 13190, 13197, 13198, 13199, 13206,
13209, 13212, 13217, 13220, 13221, 13224, 13226, 13227, 13228, 13232, 13233, 13234, 13235, 13236, 13237, 13239, 13241, 13243, 13248, 13250, 13251, 13255, 13256, 13259, 13260, 13261, 13262, 13263, 13264, 13265, 13268, 13271, 13274, 13275, 13281, 13293, 13297, 13298, 13301, 13303, 13304, 13312, 13315, 13317, 13326, 13329, 13332, 13340, 13343, 13345, 13346, 13347, 13348, 13352, 13353, 13361, 13363, 13367, 13368, 13369, 13370, 13377, 13380, 13381, 13385, 13386, 13388, 13391, 13393, 13394, 13395, 13396, 13397, 13402, 13403, 13407, 13408, 13410, 13413, 13416, 13417, 13419, 13423, 13424, 13429, 13430, 13433, 13439, 13441, 13444, 13448, 13456, 13460, 13463, 13467, 13469, 13473, 13475, 13477, 13478, 13480, 13489, 13490, 13492, 13496, 13499, 13503, 13504, 13506, 13513, 13514, 13515, 13519, 13521, 13522, 13525, 13526, 13530, 13539, 13540, 13543, 13544, 13546, 13547, 13549, 13551, 13552, 13553, 13555, 13556, 13558, 13559, 13561, 13568, 13569, 13574, 13579, 13580, 13584, 13587, 13597, 13599, 13600, 13601, 13602, 13604, 13605, 13612, 13613, 13614, 13620, 13621, 13623, 13628, 13630, 13631, 13632, 13634, 13636, 13637, 13638, 13639, 13641, 13643, 13647, 13650, 13651, 13653, 13654, 13662, 13663, 13665, 13668, 13669, 13675, 13677, 13678, 13679, 13683, 13687, 13688, 13690, 13693, 13697, 13698, 13699, 13700, 13706, 13710, 13712, 13713, 13714, 13715, 13716, 13719, 13720, 13722, 13727, 13729, 13734, 13739, 13742, 13745, 13747, 13749, 13750, 13753, 13756, 13764, 13767, 13768, 13772, 13773, 13775, 13777, 13779, 13780, 13782, 13783, 13785, 13786, 13787, 13791, 13793, 13794, 13796, 13799, 13809, 13816, 13817, 13818, 13819, 13822, 13823, 13828, 13830, 13831, 13834, 13835, 13843, 13849, 13852, 13858, 13860, 13862, 13866, 13869, 13872, 13873, 13877, 13887, 13891, 13892, 13895, 13897, 13898, 13899, 13901, 13904, 13906, 13908, 13909, 13910, 13911, 13913, 13915, 13917, 13918, 13919, 13924, 13929, 13930, 13947, 13948, 13950, 13952, 13953, 13954, 13958, 13960, 13961, 13963, 13969, 13970, 13974, 13975, 13976, 13984, 13986, 13987, 13991, 14000, 14001, 14005, 14006, 14008, 14013, 14014, 14017, 14018, 14021, 14022, 14027, 14030, 14031, 14036, 14038, 14040, 14043, 14052, 14054, 14059, 14062, 14063, 14066, 14067, 14069, 14070, 14071, 14073, 14075, 14076, 14078, 14081, 14085, 14086, 14087, 14088, 14092, 14094, 14097, 14112, 14115, 14116, 14117, 14118, 14119, 14121, 14122, 14124, 14125, 14129, 14130, 14132, 14133, 14138, 14139, 14140, 14141, 14142, 14145, 14146, 14147.

Promoters expressing in the endosperm at 22 days after pollination include SEQ IDs: 3, 7, 12, 14, 15, 17, 26, 29, 31, 34, 36, 37, 45, 48, 54, 57, 64, 65, 79, 80, 86, 88, 90, 92, 93, 94, 95, 96, 98, 99, 102, 103, 104, 108, 110, 117, 123, 126, 128, 130, 131, 134, 136, 137, 143, 146, 148, 152, 154, 156, 157, 159, 162, 165, 168, 172, 174, 175, 176, 183, 187, 191, 193, 194, 197, 199, 202, 203, 204, 205, 207, 210, 211, 212, 214, 232, 233, 235, 236, 237, 239, 240, 242, 246, 249, 250, 251, 256, 257, 259, 262, 264, 267, 269, 270, 271, 280, 286, 288, 293, 294, 299, 301, 302, 305, 306, 308, 309, 316, 319, 320, 322, 323, 328, 329, 332, 334, 335, 338, 340, 349, 352, 354, 355, 356, 358, 359, 360, 364, 365, 367, 371, 372, 373, 374, 381, 388, 389, 396, 401, 411, 412, 414, 416, 423, 428, 431, 432, 433, 434, 441, 448, 450, 452, 456, 459, 461, 462, 463, 466, 468, 470, 471, 474, 478, 483, 485, 488, 489, 493, 496, 498, 504, 507, 509, 510, 511, 514, 515, 516, 517, 523, 525, 528, 532, 537, 541, 543, 544, 546, 547, 548, 554, 557, 560, 561, 562, 573, 578, 580, 582, 585, 589, 591, 594, 595, 596, 599, 601, 602, 606, 607, 608, 613, 619, 620, 623, 629, 630, 631, 633, 635, 636, 637, 638, 643, 645, 647, 661, 662, 663, 664, 670, 671, 681, 683, 684, 692, 693, 694, 701, 702, 705, 706, 707, 708, 709, 716, 717, 718, 719, 721, 722, 724, 727, 731, 732, 733, 734, 739, 740, 742, 744, 749, 753, 757, 759, 760, 761, 762, 764, 765, 771, 779, 781, 783, 786, 793, 795, 800, 804, 806, 808, 809, 811, 812, 820, 821, 822, 824, 825, 826, 829, 830, 831, 832, 833, 834, 835, 841, 845, 846, 855, 856, 857, 858, 859, 860, 862, 863, 865, 869, 870, 871, 875, 876, 877, 887, 890, 891, 892, 893, 895, 897, 898, 899, 903, 907, 908, 910, 911, 912, 915, 916, 917, 919, 920, 924, 928, 929, 931, 932, 936, 938, 939, 942, 943, 947, 949, 951, 953, 955, 957, 958, 960, 964, 971, 974, 975, 977, 978, 979, 980, 982, 984, 985, 987, 991, 996, 999, 1007, 1008, 1009, 1010, 1011, 1012, 1013, 1014, 1016, 1017, 1019, 1021, 1022, 1025, 1026, 1032, 1033, 1035, 1038, 1039, 1041, 1042, 1043, 1045, 1046, 1047, 1049, 1051, 1052, 1055, 1056, 1057, 1064, 1065, 1069, 1070, 1073, 1076, 1077, 1080, 1086, 1087, 1089, 1092, 1095, 1096, 1100, 1101, 1103, 1104, 1112, 1114, 1115, 1116, 1117, 1119, 1121, 1125, 1127, 1130, 1132, 1136, 1137, 1140, 1144, 1146, 1154, 1155, 1160, 1161, 1165, 1167, 1168, 1170, 1171, 1174, 1176, 1178, 1183, 1187, 1191, 1196, 1200, 1204, 1205, 1214, 1215, 1218, 1220, 1222, 1223, 1225, 1228, 1230, 1232, 1233, 1236, 1240, 1244, 1246, 1248, 1249, 1250, 1251, 1252, 1253, 1254, 1257, 1258, 1261, 1262, 1263, 1269, 1272, 1277, 1281, 1285, 1286, 1290, 1291, 1292, 1293, 1296, 1307, 1309, 1310, 1311, 1312, 1314, 1316, 1320, 1321, 1322, 1323, 1327, 1330, 1331, 1334, 1335, 1339, 1344, 1345, 1349, 1360, 1364, 1365, 1366, 1367, 1368, 1371, 1375, 1376, 1377, 1380, 1387, 1388, 1389, 1391, 1393, 1396, 1399, 1402, 1404, 1405, 1406, 1412, 1415, 1420, 1421, 1423, 1426, 1431, 1432, 1433, 1438, 1440, 1441, 1442, 1447, 1451, 1453, 1458, 1459, 1462, 1466, 1471, 1472, 1474, 1475, 1484, 1488, 1490, 1491, 1493, 1497, 1498, 1499, 1501, 1503, 1506, 1508, 1510, 1511, 1512, 1514, 1518, 1520, 1525, 1526, 1527, 1528, 1530, 1539, 1543, 1545, 1547, 1549, 1550, 1551, 1553, 1555, 1556, 1560, 1561, 1563, 1564, 1567, 1570, 1575, 1576, 1578, 1579, 1584, 1585, 1586, 1590, 1591, 1596, 1597, 1598, 1599, 1600, 1601, 1602, 1604, 1605, 1608, 1609, 1610, 1612, 1614, 1615, 1616, 1617, 1623, 1625, 1634, 1635, 1637, 1638, 1641, 1642, 1643, 1650, 1651, 1654, 1658, 1659, 1662, 1663, 1669, 1671, 1673, 1675, 1678, 1681, 1682, 1684, 1687, 1688, 1689, 1690, 1691, 1696, 1698, 1705, 1706, 1707, 1708, 1710, 1716, 1717, 1725, 1728, 1732, 1735, 1750, 1755, 1759, 1761, 1764, 1769, 1770, 1771, 1773, 1774, 1776, 1777, 1785, 1786, 1791, 1798, 1802, 1807, 1808, 1809, 1811, 1820, 1826, 1828, 1830, 1832, 1834, 1835, 1837, 1839, 1840, 1843, 1846, 1848, 1851, 1852, 1854, 1855, 1859, 1861, 1863, 1866, 1867, 1869, 1872, 1873, 1876, 1879, 1882, 1886, 1888, 1891, 1893, 1895, 1897, 1900, 1901, 1902, 1903, 1905, 1906, 1910, 1911, 1913, 1915, 1916, 1918, 1920, 1922, 1923, 1924, 1930, 1931, 1936, 1939, 1940, 1945, 1949, 1950, 1951, 1952, 1953, 1958, 1964, 1968, 1970, 1971, 1972, 1973, 1977, 1979, 1990, 1993, 1999, 2000, 2002, 2007, 2008, 2009, 2010, 2012, 2014, 2015, 2017, 2019, 2021, 2026, 2031, 2032, 2033, 2037, 2038, 2040, 2041, 2043, 2048, 2051, 2060, 2062, 2064, 2071, 2072, 2074, 2077, 2078, 2085, 2087, 2088, 2089, 2091, 2092, 2093, 2094, 2097, 2103, 2106, 2107, 2111, 2112, 2116, 2117, 2122, 2123, 2125, 2126, 2128, 2132, 2133, 2139, 2142, 2143, 2144, 2146, 2147, 2150, 2151, 2152, 2156, 2157, 2158, 2161, 2162, 2164, 2167, 2168, 2170, 2175, 2177, 2179, 2185, 2188, 2189, 2190, 2193, 2195, 2196, 2200, 2206, 2207, 2210, 2215, 2216, 2218, 2221, 2240, 2241, 2242, 2243, 2245, 2253, 2257, 2258, 2260, 2263, 2265, 2274, 2276, 2280, 2281, 2282, 2283, 2284, 2288, 2291, 2293, 2296, 2298, 2300, 2303, 2304, 2306, 2308, 2309, 2310, 2313, 2314, 2322, 2323, 2326, 2328, 2329, 2331, 2333, 2335, 2339, 2342, 2343, 2348, 2353, 2359, 2361, 2362, 2363, 2366, 2371, 2372, 2376, 2379, 2380, 2381, 2382, 2384, 2393, 2399, 2400, 2401, 2402, 2405, 2406, 2410, 2412, 2413, 2414, 2417, 2418, 2419, 2420, 2423, 2430, 2431, 2432, 2433, 2434, 2435, 2437, 2439, 2440, 2441, 2442, 2443, 2445, 2449, 2451, 2452, 2453, 2454, 2456, 2457, 2458, 2465, 2469, 2470, 2472, 2474, 2476, 2477, 2480, 2481, 2482, 2483, 2487, 2490, 2495, 2496, 2497, 2498, 2500, 2505,
2506, 2507, 2509, 2513, 2514, 2515, 2516, 2517, 2519, 2521,
2522, 2525, 2528, 2529, 2531, 2532, 2533, 2534, 2536, 2537,
2538, 2539, 2541, 2543, 2546, 2549, 2550, 2551, 2552, 2554,
2555, 2559, 2560, 2561, 2567, 2568, 2570, 2571, 2573, 2578,
2579, 2581, 2583, 2589, 2590, 2591, 2594, 2596, 2599, 2600,
2601, 2609, 2611, 2614, 2616, 2617, 2620, 2625, 2627, 2632,
2634, 2635, 2636, 2639, 2644, 2649, 2652, 2655, 2656, 2658,
2663, 2671, 2672, 2674, 2678, 2684, 2685, 2687, 2688, 2689,
2690, 2691, 2692, 2694, 2700, 2704, 2708, 2709, 2715, 2719,
2720, 2721, 2722, 2725, 2726, 2728, 2729, 2735, 2738, 2739,
2745, 2746, 2747, 2749, 2752, 2756, 2758, 2762, 2764, 2765,
2770, 2776, 2780, 2783, 2784, 2787, 2791, 2794, 2798, 2800,
2801, 2802, 2805, 2808, 2812, 2814, 2819, 2821, 2822, 2823,
2824, 2826, 2827, 2828, 2831, 2833, 2838, 2840, 2844, 2850,
2860, 2865, 2869, 2871, 2876, 2878, 2888, 2889, 2890, 2892,
2893, 2894, 2895, 2896, 2897, 2901, 2902, 2903, 2906, 2908,
2909, 2915, 2916, 2917, 2922, 2923, 2926, 2929, 2930, 2931,
2935, 2941, 2942, 2943, 2946, 2948, 2955, 2959, 2963, 2966,
2968, 2976, 2979, 2981, 2982, 2987, 2992, 2994, 3003, 3005,
3006, 3007, 3009, 3013, 3015, 3017, 3018, 3020, 3023, 3024,
3029, 3039, 3041, 3042, 3044, 3045, 3047, 3048, 3049, 3051,
3052, 3053, 3055, 3058, 3059, 3064, 3068, 3070, 3072, 3075,
3080, 3083, 3084, 3085, 3087, 3090, 3094, 3095, 3097, 3100,
3106, 3115, 3118, 3119, 3120, 3121, 3123, 3126, 3127, 3128,
3129, 3137, 3138, 3139, 3143, 3145, 3153, 3167, 3169, 3170,
3171, 3172, 3173, 3177, 3181, 3189, 3191, 3192, 3194, 3196,
3205, 3206, 3208, 3210, 3217, 3219, 3220, 3221, 3224, 3225,
3228, 3230, 3231, 3232, 3240, 3242, 3246, 3247, 3249, 3250,
3254, 3261, 3263, 3266, 3269, 3272, 3278, 3280, 3283, 3286,
3288, 3290, 3291, 3294, 3295, 3297, 3299, 3301, 3308, 3310,
3312, 3313, 3324, 3325, 3327, 3331, 3332, 3337, 3338, 3340,
3342, 3343, 3345, 3347, 3351, 3353, 3355, 3357, 3358, 3359,
3360, 3361, 3363, 3370, 3374, 3379, 3382, 3383, 3386, 3394,
3396, 3399, 3403, 3405, 3413, 3415, 3416, 3418, 3419, 3422,
3424, 3425, 3426, 3428, 3429, 3435, 3438, 3446, 3447, 3449,
3452, 3458, 3461, 3466, 3468, 3469, 3471, 3474, 3477, 3484,
3486, 3487, 3488, 3493, 3497, 3498, 3500, 3502, 3503, 3504,
3507, 3510, 3516, 3517, 3518, 3523, 3524, 3527, 3533, 3535,
3537, 3538, 3540, 3541, 3544, 3545, 3549, 3554, 3558, 3560,
3561, 3562, 3569, 3571, 3574, 3576, 3580, 3587, 3588, 3589,
3591, 3592, 3594, 3595, 3597, 3603, 3604, 3606, 3607, 3610,
3611, 3613, 3616, 3620, 3621, 3624, 3629, 3633, 3634, 3642,
3643, 3644, 3645, 3646, 3647, 3648, 3659, 3661, 3664, 3665,
3667, 3672, 3674, 3676, 3677, 3682, 3684, 3685, 3690, 3707,
3709, 3710, 3713, 3715, 3718, 3719, 3720, 3721, 3722, 3723,
3726, 3729, 3730, 3731, 3732, 3733, 3738, 3739, 3744, 3749,
3751, 3752, 3756, 3761, 3764, 3765, 3766, 3772, 3773, 3775,
3778, 3791, 3792, 3793, 3794, 3800, 3801, 3804, 3806, 3808,
3817, 3818, 3819, 3823, 3825, 3829, 3830, 3832, 3833, 3837,
3838, 3839, 3843, 3844, 3846, 3847, 3849, 3852, 3858, 3859,
3860, 3867, 3868, 3870, 3871, 3872, 3873, 3876, 3878, 3881,
3882, 3884, 3887, 3889, 3890, 3892, 3894, 3895, 3896, 3902,
3903, 3904, 3907, 3908, 3912, 3913, 3917, 3918, 3923, 3926,
3928, 3929, 3933, 3938, 3941, 3943, 3947, 3950, 3954, 3955,
3958, 3959, 3961, 3962, 3967, 3968, 3970, 3971, 3974, 3975,
3978, 3983, 3985, 3987, 3988, 3990, 3994, 3995, 3996, 3997,
4001, 4003, 4007, 4008, 4013, 4014, 4021, 4030, 4033, 4037,
4039, 4042, 4043, 4046, 4047, 4048, 4050, 4051, 4052, 4053,
4054, 4056, 4057, 4062, 4066, 4067, 4068, 4070, 4075, 4084,
4087, 4088, 4092, 4094, 4096, 4098, 4099, 4102, 4105, 4106,
4109, 4110, 4113, 4116, 4126, 4128, 4132, 4133, 4134, 4139,
4140, 4143, 4144, 4146, 4148, 4149, 4150, 4155, 4160, 4163,
4164, 4165, 4166, 4167, 4168, 4171, 4178, 4181, 4183, 4185,
4187, 4188, 4189, 4191, 4195, 4201, 4202, 4204, 4205, 4206,
4207, 4210, 4211, 4212, 4213, 4217, 4218, 4219, 4221, 4227,
4228, 4233, 4234, 4235, 4237, 4245, 4246, 4250, 4251, 4252,
4255, 4257, 4258, 4261, 4266, 4270, 4272, 4275, 4280, 4281,
4284, 4290, 4292, 4294, 4296, 4298, 4301, 4302, 4305, 4309,
4312, 4314, 4317, 4320, 4321, 4324, 4329, 4330, 4335, 4337,
4339, 4341, 4344, 4347, 4355, 4356, 4357, 4358, 4360, 4369,
4370, 4378, 4380, 4383, 4390, 4391, 4392, 4393, 4396, 4397,
4401, 4402, 4403, 4404, 4405, 4409, 4410, 4422, 4423, 4430,
4432, 4439, 4440, 4442, 4443, 4446, 4448, 4450, 4453, 4456,
4458, 4461, 4462, 4463, 4466, 4468, 4471, 4474, 4475, 4479,
4486, 4492, 4494, 4498, 4500, 4502, 4507, 4508, 4512, 4514,
4515, 4516, 4519, 4521, 4522, 4524, 4525, 4529, 4531, 4535,
4536, 4541, 4543, 4548, 4549, 4551, 4554, 4556, 4557, 4558,
4560, 4561, 4562, 4565, 4566, 4568, 4575, 4576, 4580, 4582,
4583, 4590, 4591, 4593, 4594, 4597, 4598, 4601, 4606, 4612,
4613, 4616, 4618, 4623, 4625, 4628, 4630, 4632, 4634, 4635,
4639, 4641, 4643, 4644, 4645, 4646, 4647, 4650, 4651, 4653,
4654, 4655, 4656, 4658, 4659, 4662, 4664, 4667, 4669, 4671,
4673, 4674, 4676, 4677, 4680, 4682, 4685, 4691, 4692, 4693,
4697, 4699, 4700, 4706, 4710, 4711, 4713, 4716, 4719, 4721,
4722, 4723, 4724, 4729, 4730, 4734, 4737, 4738, 4739, 4740,
4741, 4745, 4749, 4753, 4754, 4755, 4756, 4760, 4761, 4762,
4763, 4766, 4767, 4769, 4770, 4771, 4773, 4775, 4779, 4780,
4784, 4787, 4788, 4789, 4790, 4794, 4795, 4796, 4801, 4803,
4804, 4805, 4806, 4807, 4812, 4813, 4814, 4818, 4822, 4827,
4828, 4830, 4831, 4834, 4836, 4840, 4841, 4842, 4847, 4855,
4856, 4857, 4861, 4862, 4863, 4864, 4869, 4874, 4875, 4876,
4878, 4881, 4887, 4889, 4891, 4893, 4896, 4897, 4900, 4904,
4907, 4909, 4910, 4913, 4914, 4920, 4921, 4922, 4924, 4926,
4928, 4935, 4936, 4941, 4942, 4944, 4945, 4954, 4956, 4958,
4959, 4960, 4967, 4969, 4971, 4972, 4974, 4975, 4980, 4985,
4987, 4988, 4993, 4994, 4996, 5007, 5013, 5015, 5016, 5021,
5023, 5024, 5026, 5029, 5030, 5034, 5036, 5037, 5038, 5039,
5040, 5042, 5044, 5045, 5046, 5049, 5051, 5052, 5054, 5057,
5060, 5067, 5068, 5069, 5072, 5075, 5078, 5082, 5087, 5088,
5089, 5094, 5100, 5101, 5102, 5106, 5113, 5114, 5119, 5120,
5122, 5123, 5125, 5131, 5132, 5140, 5143, 5145, 5147, 5149,
5150, 5159, 5160, 5163, 5164, 5165, 5168, 5169, 5170, 5174,
5180, 5181, 5182, 5184, 5185, 5187, 5188, 5189, 5190, 5191,
5192, 5195, 5196, 5198, 5199, 5200, 5202, 5206, 5209, 5212,
5213, 5216, 5218, 5219, 5224, 5225, 5229, 5234, 5240, 5241,
5244, 5245, 5248, 5251, 5253, 5254, 5255, 5256, 5257, 5258,
5260, 5261, 5262, 5263, 5266, 5268, 5269, 5273, 5275, 5276,
5280, 5281, 5282, 5283, 5286, 5293, 5297, 5298, 5299, 5300,
5301, 5308, 5311, 5314, 5315, 5317, 5319, 5321, 5324, 5329,
5330, 5333, 5334, 5338, 5339, 5343, 5344, 5345, 5346, 5348,
5349, 5351, 5352, 5361, 5366, 5367, 5369, 5371, 5386, 5388,
5389, 5393, 5395, 5396, 5397, 5398, 5400, 5402, 5404, 5405,
5413, 5414, 5418, 5422, 5427, 5428, 5431, 5434, 5437, 5438,
5445, 5446, 5452, 5453, 5456, 5458, 5459, 5461, 5472, 5475,
5483, 5487, 5491, 5493, 5495, 5496, 5505, 5506, 5508, 5510,
5512, 5513, 5515, 5517, 5518, 5519, 5524, 5530, 5531, 5532,
5535, 5541, 5543, 5545, 5547, 5549, 5554, 5557, 5558, 5563,
5564, 5566, 5568, 5569, 5572, 5575, 5579, 5581, 5582, 5584,
5585, 5586, 5587, 5589, 5592, 5593, 5594, 5596, 5597, 5602,
5608, 5610, 5613, 5614, 5615, 5616, 5620, 5623, 5624, 5627,
5632, 5633, 5635, 5638, 5640, 5643, 5647, 5648, 5649, 5650,
5651, 5652, 5653, 5656, 5659, 5660, 5663, 5664, 5667, 5669,
5675, 5676, 5680, 5681, 5689, 5690, 5694, 5695, 5697, 5698,
5702, 5706, 5711, 5712, 5713, 5714, 5718, 5719, 5721, 5722,
5729, 5730, 5731, 5732, 5734, 5735, 5736, 5738, 5742, 5744,
5746, 5748, 5751, 5768, 5770, 5771, 5773, 5775, 5778, 5780,
5782, 5783, 5785, 5791, 5792, 5794, 5803, 5806, 5807, 5808,
5810, 5811, 5817, 5820, 5823, 5826, 5828, 5832, 5833, 5834,
5835, 5836, 5839, 5842, 5844, 5853, 5854, 5856, 5859, 5864,
5866, 5867, 5871, 5872, 5873, 5876, 5877, 5878, 5879, 5881,
5882, 5883, 5884, 5888, 5889, 5892, 5893, 5900, 5902, 5906,
5907, 5910, 5912, 5918, 5919, 5921, 5925, 5926, 5927, 5928,
5931, 5932, 5933, 5936, 5938, 5939, 5941, 5943, 5944, 5945, 5948, 5951, 5952, 5954, 5956, 5957, 5959, 5961, 5968, 5971,
5978, 5979, 5980, 5985, 5986, 5988, 5991, 5992, 5994, 5996,
5997, 6000, 6002, 6003, 6004, 6006, 6007, 6012, 6013, 6016,
6017, 6025, 6026, 6038, 6040, 6041, 6044, 6045, 6047, 6048,
6051, 6053, 6054, 6058, 6059, 6060, 6061, 6062, 6063, 6068,
6069, 6070, 6072, 6073, 6074, 6075, 6080, 6083, 6092, 6093,
6094, 6095, 6097, 6098, 6107, 6108, 6109, 6110, 6112, 6113,
6116, 6118, 6120, 6122, 6125, 6129, 6130, 6131, 6132, 6133,
6136, 6137, 6145, 6146, 6147, 6151, 6152, 6153, 6156, 6163,
6164, 6165, 6168, 6173, 6182, 6183, 6186, 6188, 6189, 6190,
6191, 6193, 6196, 6197, 6198, 6200, 6205, 6207, 6209, 6212,
6213, 6215, 6220, 6221, 6223, 6224, 6227, 6228, 6230, 6231,
6234, 6238, 6241, 6243, 6246, 6249, 6251, 6255, 6257, 6258,
6259, 6264, 6265, 6269, 6270, 6271, 6272, 6273, 6278, 6279,
6280, 6281, 6282, 6283, 6284, 6285, 6286, 6287, 6291, 6292,
6294, 6296, 6299, 6300, 6302, 6304, 6309, 6310, 6311, 6315,
6317, 6319, 6321, 6322, 6325, 6326, 6328, 6330, 6333, 6338,
6345, 6351, 6352, 6353, 6354, 6359, 6360, 6362, 6363, 6364,
6367, 6370, 6372, 6375, 6378, 6381, 6383, 6394, 6395, 6396,
6397, 6398, 6399, 6403, 6405, 6407, 6408, 6412, 6414, 6415,
6419, 6420, 6422, 6429, 6430, 6431, 6434, 6436, 6437, 6440,
6441, 6442, 6454, 6456, 6458, 6459, 6463, 6464, 6466, 6467,
6468, 6469, 6470, 6471, 6474, 6476, 6478, 6480, 6482, 6486,
6488, 6493, 6495, 6500, 6501, 6502, 6503, 6504, 6505, 6510,
6513, 6514, 6517, 6519, 6524, 6530, 6533, 6534, 6535, 6537,
6539, 6541, 6543, 6544, 6547, 6548, 6549, 6554, 6555, 6558,
6560, 6561, 6563, 6567, 6569, 6572, 6574, 6576, 6577, 6579,
6581, 6582, 6584, 6587, 6588, 6595, 6597, 6598, 6603, 6607,
6609, 6611, 6621, 6622, 6624, 6626, 6627, 6628, 6630, 6634,
6635, 6637, 6638, 6639, 6643, 6649, 6650, 6655, 6656, 6658,
6662, 6666, 6671, 6672, 6678, 6679, 6681, 6691, 6692, 6695,
6699, 6703, 6705, 6706, 6711, 6714, 6716, 6718, 6720, 6724,
6725, 6729, 6731, 6733, 6734, 6737, 6739, 6746, 6747, 6748,
6749, 6758, 6759, 6761, 6766, 6778, 6779, 6780, 6783, 6786,
6788, 6793, 6794, 6795, 6799, 6803, 6804, 6805, 6807, 6810,
6811, 6812, 6813, 6816, 6819, 6820, 6821, 6824, 6827, 6828,
6830, 6834, 6836, 6839, 6840, 6841, 6843, 6845, 6848, 6852,
6859, 6864, 6869, 6872, 6874, 6875, 6876, 6878, 6879, 6880,
6886, 6897, 6903, 6906, 6909, 6914, 6915, 6919, 6920, 6921,
6930, 6933, 6936, 6941, 6946, 6948, 6950, 6952, 6959, 6960,
6963, 6967, 6969, 6970, 6979, 6980, 6984, 6985, 6987, 6988,
6990, 6993, 6994, 6999, 7003, 7006, 7010, 7011, 7012, 7013,
7015, 7022, 7031, 7032, 7042, 7043, 7045, 7048, 7051, 7052,
7053, 7056, 7057, 7064, 7069, 7072, 7074, 7075, 7077, 7083,
7085, 7086, 7097, 7103, 7105, 7106, 7107, 7108, 7109, 7112,
7116, 7117, 7118, 7124, 7126, 7130, 7132, 7134, 7135, 7137,
7140, 7142, 7144, 7146, 7149, 7154, 7155, 7163, 7164, 7165,
7166, 7167, 7169, 7172, 7173, 7174, 7176, 7177, 7182, 7184,
7187, 7188, 7189, 7192, 7193, 7194, 7196, 7201, 7202, 7203,
7206, 7207, 7209, 7212, 7216, 7217, 7218, 7219, 7227, 7228,
7232, 7233, 7234, 7235, 7236, 7239, 7240, 7243, 7244, 7245,
7248, 7254, 7255, 7257, 7258, 7259, 7262, 7267, 7268, 7274,
7276, 7277, 7278, 7282, 7284, 7286, 7287, 7288, 7290, 7291,
7292, 7293, 7298, 7299, 7300, 7301, 7303, 7304, 7305, 7306,
7307, 7310, 7313, 7315, 7317, 7321, 7328, 7330, 7340, 7344,
7345, 7354, 7355, 7356, 7357, 7358, 7365, 7371, 7373, 7379,
7382, 7383, 7385, 7388, 7389, 7392, 7398, 7399, 7400, 7409,
7411, 7415, 7425, 7427, 7428, 7430, 7434, 7435, 7436, 7438,
7441, 7443, 7444, 7445, 7446, 7447, 7452, 7454, 7458, 7459,
7464, 7466, 7470, 7474, 7475, 7483, 7486, 7487, 7490, 7493,
7504, 7505, 7506, 7512, 7515, 7517, 7523, 7525, 7528, 7533,
7537, 7538, 7542, 7546, 7547, 7548, 7554, 7557, 7561, 7570,
7577, 7578, 7579, 7580, 7585, 7586, 7587, 7589, 7591, 7593,
7594, 7595, 7601, 7605, 7611, 7619, 7620, 7621, 7623, 7624,
7633, 7639, 7640, 7642, 7643, 7652, 7653, 7658, 7661, 7663,
7664, 7665, 7666, 7667, 7674, 7677, 7678, 7679, 7680, 7682,
7687, 7689, 7695, 7699, 7700, 7703, 7704, 7708, 7712, 7713,
7717, 7718, 7719, 7724, 7725, 7727, 7729, 7733, 7736, 7737,
7738, 7740, 7743, 7744, 7745, 7747, 7751, 7753, 7754, 7761,
7762, 7763, 7764, 7767, 7768, 7769, 7770, 7774, 7775, 7777,
7778, 7779, 7782, 7785, 7786, 7791, 7793, 7796, 7798, 7800,
7802, 7803, 7804, 7806, 7807, 7812, 7815, 7818, 7819, 7820,
7824, 7825, 7832, 7833, 7834, 7838, 7841, 7844, 7845, 7848,
7849, 7856, 7859, 7860, 7862, 7863, 7865, 7870, 7876, 7878,
7881, 7890, 7896, 7900, 7908, 7910, 7911, 7918, 7921, 7922,
7923, 7925, 7927, 7929, 7933, 7934, 7935, 7936, 7937, 7938,
7942, 7944, 7945, 7946, 7947, 7948, 7952, 7955, 7956, 7960,
7964, 7965, 7966, 7967, 7972, 7974, 7976, 7977, 7978, 7980,
7981, 7983, 7984, 7986, 7989, 7990, 7991, 7993, 7998, 7999,
8001, 8006, 8007, 8009, 8012, 8020, 8026, 8029, 8036, 8039,
8042, 8044, 8047, 8052, 8053, 8056, 8058, 8059, 8061, 8063,
8067, 8068, 8073, 8075, 8076, 8078, 8080, 8082, 8084, 8088,
8091, 8093, 8095, 8100, 8103, 8105, 8106, 8108, 8112, 8116,
8118, 8121, 8126, 8130, 8136, 8137, 8143, 8147, 8148, 8150,
8151, 8158, 8159, 8162, 8163, 8164, 8165, 8168, 8170, 8176,
8178, 8179, 8182, 8184, 8185, 8187, 8188, 8189, 8192, 8193,
8195, 8199, 8202, 8204, 8207, 8208, 8211, 8213, 8216, 8217,
8219, 8220, 8222, 8223, 8225, 8227, 8231, 8234, 8235, 8236,
8237, 8239, 8240, 8242, 8245, 8246, 8250, 8252, 8253, 8266,
8268, 8269, 8270, 8272, 8274, 8282, 8288, 8289, 8292, 8293,
8294, 8299, 8300, 8301, 8304, 8310, 8311, 8312, 8313, 8317, 8318,
8319, 8320, 8329, 8331, 8339, 8340, 8349, 8350, 8352, 8353,
8355, 8361, 8363, 8367, 8368, 8373, 8376, 8379, 8385, 8387,
8389, 8390, 8392, 8395, 8401, 8402, 8403, 8404, 8405, 8409,
8410, 8413, 8414, 8416, 8423, 8433, 8435, 8436, 8438, 8439,
8441, 8442, 8444, 8445, 8446, 8447, 8448, 8452, 8458, 8459,
8470, 8472, 8473, 8474, 8476, 8480, 8481, 8482, 8486, 8490,
8493, 8498, 8501, 8503, 8505, 8509, 8511, 8513, 8514, 8515,
8517, 8520, 8523, 8524, 8525, 8527, 8528, 8531, 8533, 8535,
8537, 8538, 8539, 8542, 8544, 8549, 8550, 8551, 8552, 8553,
8554, 8561, 8562, 8565, 8566, 8568, 8575, 8576, 8579, 8581,
8582, 8589, 8590, 8592, 8593, 8594, 8596, 8597, 8599, 8600,
8601, 8602, 8603, 8605, 8609, 8611, 8612, 8614, 8617, 8618,
8624, 8630, 8631, 8634, 8637, 8638, 8640, 8642, 8644, 8648,
8650, 8654, 8657, 8658, 8663, 8665, 8669, 8672, 8676, 8677,
8685, 8693, 8694, 8700, 8703, 8704, 8706, 8708, 8709, 8713,
8716, 8717, 8720, 8721, 8726, 8728, 8729, 8732, 8734, 8736,
8738, 8739, 8740, 8741, 8742, 8744, 8745, 8746, 8748, 8761,
8764, 8766, 8767, 8770, 8772, 8773, 8776, 8777, 8779, 8782,
8783, 8784, 8789, 8792, 8797, 8803, 8805, 8810, 8818, 8821,
8822, 8824, 8829, 8830, 8831, 8832, 8834, 8835, 8838, 8843,
8846, 8853, 8859, 8861, 8865, 8866, 8867, 8875, 8878, 8881,
8883, 8886, 8888, 8890, 8891, 8892, 8896, 8897, 8899, 8900,
8902, 8907, 8908, 8909, 8910, 8911, 8913, 8914, 8916, 8917,
8919, 8924, 8926, 8929, 8930, 8935, 8938, 8941, 8942, 8945,
8946, 8949, 8951, 8954, 8956, 8957, 8959, 8960, 8961, 8962,
8963, 8967, 8968, 8969, 8972, 8974, 8976, 8977, 8979, 8980,
8981, 8985, 8986, 8992, 8998, 8999, 9001, 9002, 9003, 9006,
9009, 9012, 9015, 9018, 9020, 9023, 9029, 9030, 9033, 9037,
9044, 9052, 9056, 9057, 9058, 9059, 9060, 9061, 9066, 9069,
9071, 9072, 9073, 9074, 9076, 9080, 9084, 9091, 9092, 9095,
9096, 9105, 9108, 9109, 9110, 9111, 9112, 9114, 9115, 9116,
9118, 9120, 9123, 9124, 9125, 9128, 9129, 9133, 9134, 9138,
9139, 9140, 9141, 9142, 9146, 9149, 9151, 9152, 9155, 9172,
9173, 9174, 9177, 9183, 9185, 9187, 9188, 9190, 9195, 9199,
9206, 9207, 9210, 9211, 9213, 9214, 9215, 9216, 9223, 9226,
9229, 9233, 9241, 9243, 9247, 9248, 9249, 9252, 9253, 9254,
9255, 9263, 9265, 9267, 9270, 9273, 9278, 9284, 9285, 9288,
9289, 9290, 9292, 9293, 9298, 9299, 9300, 9302, 9304, 9308,
9311, 9314, 9320, 9321, 9323, 9325, 9326, 9327, 9328, 9329,
9330, 9333, 9336, 9337, 9339, 9340, 9341, 9345, 9346, 9347,
9348, 9350, 9354, 9355, 9359, 9363, 9366, 9373, 9375, 9376,
9382, 9383, 9388, 9391, 9392, 9393, 9394, 9396, 9398, 9400,
9402, 9403, 9404, 9406, 9407, 9413, 9414, 9415, 9423, 9432, 9433, 9434, 9439, 9440, 9444, 9449, 9451, 9452, 9455, 9456, 9459, 9460, 9468, 9471, 9472, 9473, 9478, 9483, 9486, 9488, 9490, 9494, 9495, 9497, 9500, 9501, 9502, 9503, 9504, 9505, 9509, 9514, 9515, 9517, 9518, 9519, 9520, 9525, 9528, 9531, 9532, 9533, 9534, 9536, 9540, 9545, 9546, 9548, 9549, 9553, 9554, 9555, 9563, 9564, 9565, 9568, 9571, 9577, 9582, 9583, 9587, 9589, 9590, 9591, 9596, 9602, 9606, 9609, 9613, 9617, 9618, 9620, 9623, 9624, 9626, 9627, 9628, 9629, 9633, 9635, 9640, 9641, 9642, 9644, 9645, 9646, 9648, 9649, 9653, 9655, 9656, 9658, 9659, 9660, 9663, 9666, 9668, 9670, 9677, 9681, 9682, 9686, 9692, 9698, 9700, 9706, 9707, 9718, 9722, 9723, 9724, 9725, 9726, 9729, 9730, 9731, 9733, 9734, 9737, 9744, 9745, 9746, 9750, 9753, 9754, 9756, 9763, 9764, 9767, 9768, 9770, 9776, 9780, 9781, 9782, 9784, 9786, 9792, 9793, 9794, 9796, 9799, 9801, 9812, 9813, 9816, 9819, 9824, 9825, 9827, 9830, 9833, 9836, 9845, 9847, 9849, 9850, 9851, 9853, 9854, 9861, 9864, 9866, 9869, 9871, 9873, 9882, 9886, 9887, 9892, 9897, 9901, 9906, 9907, 9908, 9909, 9910, 9917, 9923, 9924, 9928, 9930, 9935, 9938, 9940, 9946, 9947, 9949, 9950, 9953, 9955, 9957, 9960, 9962, 9963, 9964, 9967, 9968, 9971, 9972, 9979, 9980, 9982, 9984, 9985, 9987, 9988, 9990, 9997, 9998, 10000, 10008, 10009, 10010, 10017, 10018, 10019, 10021, 10022, 10026, 10033, 10037, 10038, 10040, 10041, 10042, 10043, 10044, 10045, 10048, 10051, 10052, 10054, 10056, 10059, 10060, 10062, 10063, 10064, 10068, 10073, 10075, 10077, 10078, 10083, 10089, 10091, 10092, 10093, 10095, 10097, 10101, 10102, 10103, 10105, 10106, 10107, 10108, 10109, 10110, 10114, 10115, 10116, 10117, 10118, 10119, 10122, 10127, 10128, 10131, 10132, 10136, 10138, 10143, 10146, 10149, 10151, 10152, 10158, 10163, 10165, 10166, 10168, 10170, 10174, 10176, 10178, 10181, 10182, 10191, 10192, 10193, 10194, 10195, 10197, 10199, 10203, 10209, 10213, 10214, 10218, 10219, 10220, 10222, 10223, 10225, 10228, 10231, 10233, 10236, 10237, 10238, 10239, 10247, 10252, 10255, 10258, 10259, 10275, 10278, 10284, 10286, 10291, 10292, 10295, 10300, 10302, 10306, 10307, 10311, 10321, 10323, 10324, 10325, 10326, 10328, 10330, 10331, 10333, 10334, 10335, 10336, 10338, 10344, 10352, 10353, 10357, 10359, 10360, 10362, 10364, 10368, 10373, 10375, 10378, 10380, 10384, 10385, 10388, 10389, 10397, 10398, 10399, 10400, 10401, 10405, 10408, 10410, 10413, 10414, 10416, 10421, 10423, 10427, 10428, 10429, 10430, 10435, 10437, 10438, 10440, 10442, 10443, 10446, 10448, 10449, 10450, 10451, 10453, 10455, 10463, 10464, 10465, 10468, 10469, 10470, 10474, 10478, 10480, 10482, 10492, 10494, 10495, 10496, 10504, 10506, 10508, 10514, 10515, 10518, 10521, 10525, 10527, 10528, 10530, 10531, 10533, 10535, 10536, 10541, 10542, 10543, 10544, 10547, 10548, 10549, 10550, 10551, 10555, 10556, 10558, 10560, 10561, 10562, 10563, 10565, 10567, 10569, 10571, 10580, 10581, 10582, 10583, 10585, 10589, 10593, 10595, 10596, 10597, 10600, 10601, 10602, 10609, 10610, 10611, 10613, 10614, 10615, 10616, 10617, 10621, 10622, 10623, 10626, 10628, 10629, 10630, 10631, 10633, 10637, 10638, 10639, 10640, 10641, 10642, 10645, 10646, 10648, 10649, 10650, 10655, 10657, 10663, 10665, 10668, 10671, 10674, 10675, 10677, 10678, 10681, 10682, 10683, 10684, 10685, 10687, 10689, 10697, 10698, 10699, 10700, 10702, 10703, 10705, 10707, 10708, 10711, 10712, 10715, 10716, 10723, 10725, 10726, 10730, 10732, 10734, 10735, 10736, 10737, 10740, 10744, 10747, 10748, 10749, 10752, 10753, 10756, 10761, 10762, 10763, 10766, 10775, 10778, 10779, 10782, 10784, 10785, 10787, 10788, 10790, 10791, 10792, 10795, 10796, 10798, 10800, 10801, 10802, 10803, 10805, 10809, 10810, 10811, 10813, 10815, 10818, 10819, 10820, 10821, 10824, 10825, 10826, 10828, 10831, 10833, 10836, 10838, 10839, 10840, 10841, 10843, 10845, 10846, 10850, 10852, 10853, 10858, 10860, 10861, 10862, 10864, 10867, 10870, 10874, 10877, 10880, 10881, 10892, 10896, 10897, 10898, 10899, 10902, 10903, 10905, 10912, 10917, 10920, 10926, 10927, 10930, 10933, 10934, 10935, 10936, 10937, 10938, 10941, 10944, 10947, 10948, 10950, 10954, 10957, 10960, 10962, 10963, 10964, 10965, 10967, 10972, 10977, 10985, 10988, 10993, 10995, 10996, 10997, 10998, 10999, 11002, 11004, 11005, 11006, 11008, 11009, 11010, 11015, 11016, 11018, 11022, 11024, 11030, 11032, 11036, 11037, 11039, 11044, 11046, 11047, 11049, 11053, 11056, 11058, 11060, 11061, 11066, 11068, 11070, 11071, 11072, 11078, 11080, 11082, 11083, 11086, 11090, 11095, 11098, 11102, 11107, 11110, 11114, 11116, 11118, 11119, 11123, 11124, 11125, 11126, 11127, 11129, 11134, 11135, 11137, 11138, 11145, 11146, 11148, 11153, 11154, 11158, 11159, 11160, 11161, 11162, 11163, 11166, 11168, 11169, 11175, 11177, 11178, 11184, 11187, 11188, 11190, 11191, 11192, 11198, 11199, 11201, 11202, 11203, 11206, 11207, 11210, 11214, 11217, 11218, 11222, 11226, 11227, 11232, 11233, 11234, 11235, 11236, 11237, 11238, 11239, 11246, 11247, 11248, 11254, 11255, 11256, 11258, 11259, 11260, 11262, 11263, 11264, 11266, 11275, 11278, 11286, 11288, 11289, 11290, 11291, 11292, 11293, 11294, 11295, 11306, 11307, 11308, 11313, 11315, 11316, 11318, 11320, 11322, 11324, 11326, 11329, 11332, 11337, 11339, 11340, 11345, 11346, 11348, 11352, 11356, 11363, 11365, 11370, 11371, 11373, 11374, 11377, 11378, 11381, 11382, 11388, 11389, 11391, 11392, 11394, 11395, 11402, 11403, 11405, 11406, 11409, 11410, 11416, 11418, 11420, 11423, 11424, 11428, 11430, 11431, 11433, 11434, 11437, 11438, 11443, 11446, 11449, 11451, 11458, 11459, 11463, 11465, 11468, 11471, 11472, 11473, 11475, 11476, 11478, 11481, 11482, 11485, 11487, 11490, 11494, 11496, 11497, 11498, 11500, 11506, 11507, 11508, 11509, 11512, 11516, 11518, 11520, 11523, 11526, 11528, 11530, 11533, 11534, 11538, 11540, 11541, 11544, 11545, 11546, 11547, 11548, 11551, 11553, 11558, 11560, 11561, 11567, 11568, 11570, 11571, 11574, 11576, 11577, 11578, 11579, 11580, 11583, 11587, 11593, 11594, 11595, 11596, 11597, 11599, 11603, 11604, 11610, 11615, 11618, 11620, 11621, 11623, 11625, 11628, 11629, 11632, 11633, 11638, 11639, 11642, 11649, 11650, 11652, 11654, 11655, 11656, 11657, 11658, 11663, 11669, 11673, 11678, 11681, 11682, 11683, 11685, 11691, 11692, 11693, 11695, 11701, 11703, 11705, 11707, 11711, 11712, 11720, 11721, 11725, 11726, 11730, 11731, 11732, 11733, 11736, 11741, 11743, 11744, 11746, 11753, 11755, 11756, 11759, 11760, 11761, 11762, 11763, 11764, 11765, 11766, 11767, 11770, 11771, 11776, 11782, 11783, 11785, 11786, 11790, 11792, 11799, 11800, 11809, 11812, 11813, 11814, 11816, 11818, 11819, 11820, 11821, 11823, 11825, 11826, 11828, 11830, 11837, 11839, 11841, 11846, 11848, 11849, 11851, 11856, 11858, 11861, 11863, 11868, 11869, 11870, 11872, 11876, 11877, 11878, 11879, 11881, 11886, 11889, 11890, 11891, 11894, 11895, 11898, 11903, 11908, 11909, 11911, 11913, 11919, 11920, 11921, 11923, 11926, 11928, 11929, 11930, 11934, 11935, 11940, 11943, 11946, 11947, 11948, 11949, 11952, 11953, 11955, 11957, 11958, 11959, 11960, 11961, 11962, 11963, 11965, 11976, 11977, 11978, 11979, 11980, 11983, 11988, 11989, 11991, 11993, 11994, 11995, 11996, 11997, 11998, 11999, 12002, 12004, 12008, 12016, 12018, 12019, 12020, 12021, 12023, 12024, 12025, 12030, 12032, 12042, 12043, 12044, 12047, 12050, 12051, 12054, 12059, 12060, 12061, 12068, 12078, 12079, 12080, 12081, 12082, 12083, 12086, 12091, 12093, 12097, 12098, 12104, 12106, 12109, 12110, 12112, 12115, 12118, 12120, 12122, 12128, 12129, 12131, 12134, 12135, 12136, 12137, 12138, 12139, 12140, 12143, 12144, 12145, 12146, 12147, 12148, 12151, 12155, 12161, 12162, 12163, 12165, 12166, 12167, 12170, 12171, 12174, 12176, 12179, 12181, 12186, 12197, 12200, 12201, 12202, 12204, 12208, 12212, 12214, 12215, 12217, 12223, 12230, 12233, 12234, 12237, 12238, 12240, 12241, 12243, 12245, 12246, 12250, 12252, 12254, 12255, 12256, 12259, 12265, 12271, 12278, 12280, 12285, 12286, 12287, 12293, 12295, 12296, 12299, 12310, 12311, 12312, 12313, 12314, 12315, 12317, 12319, 12321, 12323, 12325, 12328, 12331, 12334, 12339, 12342, 12343, 12345, 12347, 12350, 12354, 12356, 12358, 12359, 12364, 12366, 12375, 12376, 12379, 12380, 12381, 12385, 12390, 12393, 12397, 12400, 12403, 12404, 12406, 12409, 12411, 12414, 12415, 12416, 12419, 12420, 12423, 12424, 12425, 12426, 12427, 12437, 12438, 12440, 12444, 12445, 12450, 12451, 12455, 12456, 12457, 12459, 12461, 12462, 12465, 12467, 12468, 12470, 12472, 12473, 12475, 12478, 12481, 12487, 12488, 12489, 12492, 12494, 12495, 12497, 12501, 12502, 12503, 12510, 12511, 12512, 12513, 12514, 12515, 12518, 12519, 12525, 12527, 12529, 12530, 12531, 12535, 12536, 12537, 12538, 12539, 12546, 12547, 12548, 12551, 12552, 12554, 12555, 12556, 12561, 12563, 12565, 12567, 12568, 12570, 12572, 12578, 12583, 12585, 12586, 12588, 12591, 12600, 12605, 12608, 12609, 12610, 12611, 12616, 12620, 12622, 12623, 12626, 12628, 12629, 12634, 12638, 12639, 12640, 12641, 12648, 12649, 12651, 12655, 12663, 12664, 12668, 12670, 12671, 12674, 12679, 12681, 12683, 12684, 12688, 12689, 12691, 12693, 12695, 12696, 12697, 12699, 12701, 12702, 12705, 12706, 12707, 12708, 12714, 12723, 12731, 12732, 12733, 12739, 12740, 12741, 12742, 12752, 12753, 12754, 12755, 12758, 12760, 12764, 12766, 12771, 12775, 12777, 12779, 12782, 12785, 12790, 12797, 12801, 12802, 12804, 12807, 12810, 12812, 12813, 12817, 12818, 12819, 12820, 12822, 12823, 12824, 12826, 12827, 12828, 12834, 12835, 12837, 12838, 12839, 12843, 12844, 12848, 12849, 12853, 12858, 12860, 12861, 12866, 12870, 12873, 12875, 12878, 12882, 12883, 12884, 12887, 12888, 12891, 12898, 12899, 12900, 12901, 12902, 12903, 12904, 12905, 12906, 12908, 12910, 12912, 12916, 12921, 12923, 12928, 12929, 12932, 12933, 12934, 12945, 12946, 12947, 12952, 12956, 12958, 12959, 12960, 12963, 12967, 12968, 12969, 12978, 12984, 12986, 12987, 12988, 12990, 12991, 12999, 13001, 13003, 13004, 13005, 13007, 13010, 13013, 13014, 13015, 13017, 13018, 13022, 13027, 13030, 13031, 13033, 13034, 13035, 13040, 13041, 13047, 13050, 13053, 13054, 13055, 13056, 13060, 13061, 13062, 13064, 13066, 13071, 13075, 13083, 13085, 13086, 13087, 13098, 13099, 13101, 13102, 13105, 13106, 13110, 13111, 13112, 13114, 13115, 13117, 13118, 13120, 13121, 13122, 13123, 13124, 13125, 13128, 13131, 13134, 13136, 13148, 13149, 13151, 13153, 13154, 13159, 13160, 13169, 13170, 13175, 13181, 13182, 13186, 13187, 13189, 13190, 13197, 13198, 13199, 13206, 13209, 13212, 13217, 13220, 13221, 13224, 13226, 13227, 13228, 13232, 13233, 13234, 13235, 13236, 13237, 13239, 13241, 13248, 13250, 13251, 13255, 13256, 13259, 13261, 13262, 13263, 13264, 13265, 13268, 13271, 13274, 13275, 13281, 13297, 13298, 13301, 13303, 13304, 13312, 13313, 13315, 13317, 13326, 13329, 13332, 13340, 13343, 13345, 13346, 13347, 13348, 13352, 13361, 13363, 13367, 13368, 13369, 13370, 13377, 13380, 13381, 13385, 13386, 13388, 13391, 13393, 13394, 13395, 13396, 13397, 13402, 13403, 13407, 13408, 13410, 13416, 13417, 13419, 13423, 13424, 13429, 13430, 13433, 13439, 13441, 13444, 13448, 13456, 13460, 13463, 13467, 13469, 13473, 13475, 13477, 13478, 13480, 13484, 13489, 13490, 13492, 13499, 13503, 13504, 13506, 13513, 13514, 13515, 13519, 13521, 13522, 13524, 13525, 13526, 13539, 13540, 13543, 13544, 13546, 13547, 13549, 13551, 13552, 13553, 13555, 13556, 13558, 13559, 13561, 13568, 13569, 13574, 13579, 13580, 13584, 13587, 13597, 13599, 13600, 13601, 13602, 13604, 13605, 13612, 13613, 13620, 13621, 13623, 13628, 13630, 13631, 13632, 13634, 13636, 13637, 13638, 13639, 13641, 13643, 13647, 13650, 13653, 13654, 13660, 13662, 13663, 13665, 13668, 13669, 13677, 13678, 13679, 13683, 13687, 13688, 13693, 13697, 13698, 13699, 13700, 13706, 13712, 13713, 13714, 13715, 13716, 13719, 13720, 13722, 13724, 13727, 13729, 13734, 13739, 13742, 13745, 13747, 13749, 13750, 13753, 13756, 13764, 13767, 13768, 13772, 13773, 13775, 13777, 13779, 13780, 13782, 13783, 13785, 13786, 13787, 13791, 13793, 13794, 13796, 13799, 13809, 13816, 13817, 13818, 13819, 13822, 13823, 13828, 13830, 13831, 13834, 13835, 13843, 13849, 13852, 13858, 13860, 13862, 13866, 13869, 13872, 13873, 13875, 13877, 13887, 13891, 13892, 13895, 13898, 13899, 13901, 13904, 13906, 13908, 13909, 13910, 13911, 13913, 13915, 13917, 13918, 13919, 13929, 13930, 13947, 13948, 13950, 13953, 13954, 13958, 13960, 13961, 13963, 13969, 13970, 13974, 13975, 13976, 13984, 13991, 14000, 14001, 14005, 14006, 14008, 14013, 14014, 14017, 14018, 14021, 14022, 14027, 14030, 14031, 14036, 14038, 14040, 14043, 14052, 14054, 14059, 14062, 14063, 14066, 14067, 14069, 14070, 14071, 14073, 14075, 14076, 14078, 14081, 14085, 14086, 14087, 14088, 14092, 14094, 14097, 14106, 14112, 14115, 14116, 14117, 14118, 14119, 14121, 14122, 14124, 14125, 14129, 14132, 14133, 14135, 14138, 14139, 14140, 14141, 14142, 14145, 14146, 14147.

Promoers expressing in the endosperm at 28 days after pollination include SEQ IDs: 3, 7, 12, 14, 15, 17, 20, 29, 31, 34, 36, 37, 48, 54, 56, 57, 64, 65, 79, 80, 86, 88, 90, 93, 94, 95, 96, 98, 99, 100, 102, 103, 104, 110, 112, 117, 123, 126, 130, 131, 136, 137, 138, 143, 146, 148, 152, 154, 156, 157, 159, 162, 165, 168, 169, 172, 174, 175, 176, 181, 183, 187, 191, 193, 199, 202, 203, 204, 205, 207, 210, 211, 212, 214, 232, 233, 235, 236, 237, 239, 240, 242, 246, 249, 250, 251, 257, 259, 262, 264, 267, 269, 270, 271, 286, 288, 293, 294, 299, 301, 302, 305, 306, 308, 309, 316, 319, 320, 322, 323, 328, 329, 332, 334, 335, 338, 340, 346, 349, 352, 354, 355, 356, 358, 359, 360, 362, 364, 365, 367, 371, 372, 373, 374, 381, 386, 388, 389, 396, 411, 412, 414, 416, 423, 424, 431, 432, 433, 436, 441, 448, 450, 452, 456, 459, 461, 462, 463, 466, 470, 471, 474, 478, 481, 483, 485, 488, 489, 493, 496, 498, 501, 507, 509, 510, 511, 514, 516, 517, 523, 525, 528, 532, 537, 541, 542, 543, 544, 546, 547, 548, 553, 554, 556, 557, 560, 561, 573, 578, 580, 582, 585, 589, 591, 594, 595, 596, 601, 602, 606, 607, 611, 613, 619, 620, 623, 629, 630, 631, 633, 635, 636, 637, 638, 643, 645, 647, 661, 662, 663, 664, 669, 671, 681, 683, 684, 692, 693, 694, 701, 702, 705, 706, 707, 708, 709, 716, 717, 718, 719, 721, 722, 723, 724, 727, 731, 732, 733, 734, 739, 740, 742, 744, 749, 753, 757, 759, 760, 761, 762, 764, 765, 779, 781, 783, 784, 786, 793, 798, 800, 804, 806, 808, 809, 811, 812, 814, 815, 820, 821, 822, 829, 830, 831, 832, 833, 834, 835, 841, 845, 846, 855, 856, 857, 858, 860, 862, 865, 869, 870, 871, 875, 876, 877, 883, 887, 890, 891, 892, 893, 895, 897, 898, 903, 907, 908, 910, 911, 912, 913, 915, 916, 919, 920, 924, 928, 929, 931, 932, 933, 936, 938, 939, 943, 947, 948, 949, 951, 953, 955, 958, 960, 961, 964, 971, 974, 975, 977, 978, 979, 980, 982, 984, 985, 987, 991, 994, 995, 996, 997, 999, 1005, 1007, 1008, 1009, 1010, 1011, 1012, 1013, 1014, 1016, 1017, 1019, 1021, 1022, 1025, 1026, 1032, 1033, 1035, 1038, 1039, 1041, 1042, 1043, 1046, 1047, 1049, 1051, 1052, 1055, 1057, 1064, 1065, 1069, 1070, 1073, 1077, 1080, 1085, 1086, 1087, 1089, 1092, 1095, 1096, 1097, 1100, 1101, 1103, 1104, 1111, 1112, 1114, 1115, 1116, 1117, 1119, 1122, 1125, 1127, 1130, 1132, 1136, 1137, 1140, 1144, 1146, 1154, 1155, 1160, 1161, 1165, 1167, 1168, 1170, 1171, 1174, 1176, 1178, 1180, 1183, 1187, 1191, 1196, 1200, 1204, 1205, 1213, 1214, 1215, 1218, 1220, 1222, 1223, 1225, 1227, 1228, 1230, 1232, 1233, 1236, 1240, 1244, 1248, 1249, 1250, 1251, 1252, 1253, 1254, 1257, 1258, 1261, 1262, 1263, 1269, 1272, 1275, 1277, 1281, 1285, 1286, 1290, 1291, 1292, 1293, 1296, 1299, 1306, 1307, 1309, 1310, 1311, 1312, 1314, 1316, 1320, 1321, 1322, 1323, 1325, 1327, 1330, 1331, 1334, 1339, 1344, 1345, 1349, 1360, 1361, 1364, 1365, 1366, 1367, 1368, 1371, 1375, 1376, 1377, 1380, 1382, 1387, 1388, 1389, 1391, 1393, 1396, 1399, 1404, 1405, 1406, 1410, 1412, 1415, 1420, 1421, 1423, 1426, 1431, 1432, 1433, 1435, 1438, 1440, 1441, 1442, 1443, 1444, 1447, 1451, 1453, 1458, 1459, 1466, 1467, 1468, 1471, 1472, 1475, 1484, 1486, 1488, 1489, 1490, 1491, 1493, 1497, 1499, 1501, 1503, 1506, 1512, 1517, 1518, 1525, 1526, 1527, 1528, 1530, 1539, 1543, 1545, 1549, 1550, 1551, 1553, 1555, 1556, 1560, 1561, 1563, 1567, 1570, 1575, 1576, 1578, 1584, 1585, 1586, 1588, 1590, 1591, 1596, 1598, 1599, 1600, 1601, 1602, 1604, 1605, 1608, 1609, 1610, 1612, 1614, 1615, 1616, 1617, 1623, 1625, 1634, 1635, 1636, 1637, 1638, 1641, 1642, 1643, 1648, 1651, 1653, 1654, 1658, 1659, 1662, 1663, 1668, 1669, 1671, 1673, 1675, 1678, 1681, 1682, 1684, 1687, 1688, 1689, 1690, 1691, 1696, 1698, 1700, 1705, 1706, 1707, 1708, 1710, 1716, 1717, 1732, 1735, 1750, 1755, 1759, 1761, 1764, 1769, 1770, 1771, 1773, 1774, 1776, 1777, 1785, 1786, 1791, 1798, 1802, 1807, 1808, 1809, 1811, 1820, 1822, 1826, 1828, 1830, 1832, 1834, 1835, 1837, 1839, 1840, 1843, 1845, 1846, 1851, 1852, 1854, 1855, 1859, 1861, 1863, 1866, 1867, 1869, 1872, 1873, 1876, 1879, 1882, 1886, 1888, 1891, 1893, 1895, 1897, 1900, 1902, 1904, 1905, 1906, 1910, 1911, 1915, 1916, 1918, 1920, 1922, 1923, 1924, 1930, 1931, 1939, 1940, 1944, 1945, 1949, 1950, 1952, 1953, 1958, 1964, 1968, 1970, 1971, 1972, 1973, 1977, 1979, 1981, 1986, 1990, 1991, 1993, 1994, 1995, 1996, 1999, 2000, 2001, 2002, 2007, 2008, 2009, 2010, 2012, 2014, 2015, 2019, 2021, 2026, 2031, 2032, 2033, 2034, 2037, 2038, 2040, 2041, 2043, 2048, 2051, 2055, 2060, 2062, 2064, 2071, 2072, 2074, 2077, 2078, 2085, 2087, 2088, 2089, 2091, 2092, 2093, 2094, 2096, 2097, 2103, 2106, 2107, 2112, 2116, 2117, 2119, 2122, 2123, 2125, 2126, 2128, 2130, 2132, 2133, 2139, 2142, 2143, 2144, 2146, 2147, 2150, 2151, 2152, 2156, 2157, 2158, 2161, 2162, 2164, 2167, 2170, 2173, 2175, 2177, 2179, 2185, 2188, 2189, 2190, 2193, 2195, 2196, 2200, 2202, 2203, 2206, 2207, 2210, 2215, 2216, 2218, 2221, 2240, 2241, 2242, 2243, 2245, 2253, 2257, 2258, 2260, 2263, 2265, 2266, 2274, 2276, 2280, 2282, 2283, 2284, 2288, 2291, 2293, 2294, 2297, 2298, 2300, 2303, 2304, 2306, 2308, 2309, 2310, 2313, 2314, 2322, 2323, 2326, 2328, 2329, 2331, 2333, 2335, 2339, 2342, 2343, 2348, 2353, 2359, 2361, 2362, 2363, 2371, 2372, 2376, 2379, 2380, 2381, 2382, 2384, 2398, 2401, 2402, 2405, 2406, 2410, 2412, 2413, 2414, 2416, 2417, 2418, 2419, 2420, 2423, 2430, 2431, 2432, 2433, 2434, 2435, 2436, 2437, 2439, 2440, 2441, 2442, 2443, 2445, 2449, 2451, 2452, 2453, 2454, 2456, 2457, 2458, 2465, 2469, 2470, 2474, 2476, 2477, 2480, 2481, 2482, 2483, 2487, 2489, 2490, 2495, 2496, 2497, 2498, 2500, 2505, 2506, 2507, 2509, 2510, 2513, 2515, 2516, 2517, 2519, 2521, 2522, 2525, 2528, 2529, 2531, 2532, 2533, 2534, 2536, 2537, 2538, 2539, 2541, 2543, 2549, 2550, 2551, 2552, 2554, 2555, 2559, 2560, 2567, 2568, 2570, 2573, 2578, 2579, 2581, 2589, 2590, 2594, 2596, 2599, 2600, 2601, 2609, 2611, 2613, 2614, 2616, 2619, 2620, 2625, 2626, 2627, 2632, 2634, 2635, 2636, 2639, 2644, 2645, 2649, 2652, 2655, 2656, 2658, 2663, 2666, 2671, 2672, 2674, 2684, 2685, 2687, 2688, 2689, 2690, 2691, 2692, 2694, 2700, 2704, 2708, 2709, 2711, 2715, 2720, 2721, 2722, 2725, 2726, 2728, 2729, 2735, 2738, 2739, 2745, 2746, 2747, 2749, 2752, 2756, 2758, 2762, 2764, 2765, 2770, 2780, 2783, 2784, 2787, 2791, 2793, 2794, 2798, 2800, 2801, 2802, 2805, 2808, 2812, 2814, 2819, 2821, 2822, 2823, 2824, 2827, 2828, 2831, 2833, 2837, 2838, 2840, 2844, 2845, 2850, 2857, 2860, 2865, 2869, 2871, 2876, 2878, 2888, 2889, 2890, 2892, 2893, 2894, 2895, 2896, 2897, 2901, 2902, 2903, 2906, 2908, 2909, 2911, 2915, 2916, 2917, 2922, 2923, 2926, 2929, 2930, 2931, 2935, 2941, 2942, 2943, 2944, 2946, 2948, 2951, 2955, 2959, 2962, 2963, 2966, 2968, 2976, 2979, 2982, 2987, 2992, 2994, 3003, 3005, 3006, 3007, 3009, 3013, 3015, 3017, 3018, 3020, 3024, 3029, 3039, 3041, 3042, 3044, 3045, 3047, 3048, 3049, 3051, 3052, 3053, 3055, 3058, 3059, 3064, 3068, 3070, 3072, 3075, 3080, 3083, 3084, 3085, 3087, 3090, 3094, 3095, 3097, 3100, 3106, 3115, 3118, 3119, 3120, 3121, 3123, 3127, 3128, 3129, 3137, 3138, 3139, 3143, 3145, 3153, 3167, 3169, 3170, 3171, 3172, 3173, 3177, 3179, 3181, 3189, 3191, 3192, 3194, 3196, 3205, 3206, 3208, 3210, 3217, 3219, 3221, 3225, 3228, 3230, 3231, 3240, 3242, 3246, 3247, 3249, 3250, 3254, 3261, 3263, 3266, 3269, 3272, 3278, 3280, 3283, 3286, 3288, 3290, 3291, 3294, 3295, 3297, 3299, 3301, 3308, 3310, 3312, 3313, 3324, 3325, 3327, 3331, 3332, 3337, 3338, 3340, 3342, 3343, 3345, 3347, 3351, 3353, 3355, 3357, 3358, 3359, 3360, 3363, 3368, 3370, 3374, 3377, 3379, 3380, 3382, 3383, 3386, 3394, 3396, 3399, 3403, 3405, 3413, 3415, 3416, 3418, 3419, 3424, 3425, 3426, 3428, 3429, 3435, 3438, 3441, 3446, 3447, 3449, 3452, 3453, 3457, 3458, 3459, 3461, 3462, 3466, 3468, 3469, 3471, 3474, 3477, 3484, 3486, 3487, 3488, 3493, 3497, 3498, 3500, 3502, 3503, 3504, 3506, 3507, 3510, 3516, 3517, 3518, 3523, 3524, 3533, 3535, 3536, 3537, 3538, 3540, 3541, 3542, 3544, 3545, 3546, 3549, 3551, 3554, 3558, 3560, 3561, 3569, 3571, 3574, 3576, 3580, 3585, 3587, 3588, 3589, 3591, 3592, 3594, 3595, 3597, 3603, 3604, 3606, 3607, 3610, 3611, 3613, 3616, 3620, 3621, 3624, 3629, 3633, 3634, 3636, 3640, 3642, 3643, 3644, 3645, 3646, 3647, 3648, 3659, 3661, 3664, 3665, 3667, 3672, 3674, 3676, 3677, 3682, 3684, 3685, 3690, 3707, 3709, 3710, 3713, 3715, 3718, 3719, 3720, 3721, 3722, 3723, 3726, 3729, 3730, 3731, 3732, 3733, 3738, 3739, 3744, 3749, 3752, 3754, 3756, 3761, 3764, 3765, 3766, 3771, 3772, 3773, 3775, 3778, 3791, 3792, 3793, 3794, 3796, 3800, 3801, 3804, 3806, 3808, 3817, 3818, 3819, 3823, 3825, 3829, 3830, 3832, 3833, 3834, 3837, 3838, 3839, 3843, 3844, 3845, 3846, 3847, 3849, 3852, 3858, 3859, 3860, 3867, 3868, 3870, 3871, 3872, 3873, 3876, 3881, 3882, 3884, 3885, 3887, 3889, 3890, 3892, 3894, 3895, 3896, 3902, 3903, 3904, 3907, 3908, 3912, 3917, 3918, 3923, 3926, 3928, 3929, 3931, 3933, 3938, 3941, 3947, 3950, 3954, 3958, 3962, 3967, 3968, 3970, 3971, 3974, 3975, 3979, 3983, 3985, 3987, 3988, 3990, 3994, 3995, 3996, 3997, 3998, 4001, 4003, 4007, 4008, 4013, 4014, 4021, 4026, 4030, 4033, 4037, 4039, 4041, 4042, 4043, 4044, 4046, 4047, 4048, 4050, 4051, 4052, 4053, 4054, 4056, 4057, 4062, 4066, 4068, 4070, 4075, 4081, 4084, 4088, 4092, 4094, 4096, 4098, 4099, 4102, 4103, 4105, 4106, 4109, 4110, 4113, 4115, 4116, 4126, 4128, 4132, 4133, 4134, 4139, 4140, 4143, 4144, 4146, 4148, 4149, 4150, 4151, 4160, 4163, 4164, 4165, 4166, 4167, 4168, 4171, 4178, 4181, 4183, 4185, 4187, 4188, 4189, 4191, 4193, 4194, 4195, 4201, 4202, 4204, 4205, 4206, 4207, 4210, 4211, 4212, 4217, 4218, 4219, 4221, 4227, 4228, 4229, 4233, 4234, 4235, 4237, 4245, 4246, 4250, 4251, 4252, 4255, 4257, 4261, 4266, 4270, 4272, 4275, 4278, 4280, 4281, 4282, 4284, 4290, 4292, 4296, 4298, 4301, 4302, 4303, 4305, 4309, 4312, 4317, 4320, 4321, 4324, 4329, 4330, 4335, 4336, 4337, 4339, 4341, 4347, 4355, 4357, 4358, 4360, 4369, 4378, 4380, 4383, 4390, 4391, 4392, 4393, 4396, 4397, 4401, 4402, 4403, 4404, 4405, 4409, 4410, 4422, 4423, 4425, 4430, 4432, 4437, 4439, 4440, 4443, 4446, 4448, 4450, 4453, 4456, 4458, 4461, 4462, 4463, 4466, 4467, 4468, 4471, 4474, 4475, 4477, 4479, 4486, 4492, 4494, 4498, 4500, 4502, 4507, 4508, 4512, 4514, 4515, 4519, 4521, 4522, 4524, 4525, 4529, 4531, 4535, 4541, 4543, 4548, 4549, 4551, 4554, 4556, 4557, 4558, 4560, 4561, 4562, 4565, 4566, 4568, 4575, 4576, 4580, 4582, 4583, 4590, 4591, 4594, 4597, 4598, 4601, 4606, 4612, 4613, 4616, 4618, 4623, 4625, 4628, 4630, 4632, 4634, 4635, 4639, 4641, 4643, 4644, 4645, 4646, 4647, 4650, 4653, 4654, 4655, 4656, 4658, 4659, 4662, 4664, 4667, 4669, 4671, 4673, 4674, 4676, 4677, 4680, 4682, 4685, 4691, 4692, 4693, 4694, 4697, 4699, 4700, 4703, 4706, 4708, 4710, 4711, 4713, 4715, 4716, 4719, 4721, 4722, 4723, 4724, 4727, 4729, 4730, 4734, 4737, 4738, 4739, 4740, 4741, 4745, 4749, 4753, 4754, 4755, 4756, 4760, 4761, 4762, 4764, 4765, 4766, 4767, 4769, 4770, 4771, 4773, 4775, 4779, 4780, 4784, 4787, 4788, 4789, 4790, 4794, 4795, 4796, 4801, 4803, 4804, 4805, 4806, 4807, 4813, 4814, 4818, 4822, 4827, 4828, 4830, 4831, 4834, 4836, 4840, 4841, 4842, 4847, 4855, 4856, 4857, 4858, 4861, 4862, 4863, 4864, 4869, 4874, 4875, 4878, 4881, 4887, 4889, 4891, 4893, 4896, 4897, 4900, 4904, 4907, 4909, 4910, 4913, 4914, 4920, 4921, 4922, 4924, 4926, 4928, 4930, 4935, 4936, 4937, 4941, 4942, 4944, 4945, 4954, 4956, 4958, 4959, 4960, 4967, 4969, 4971, 4972, 4974, 4975, 4983, 4985, 4993, 4996, 5007, 5015, 5016, 5021, 5023, 5024, 5026, 5027, 5029, 5030, 5034, 5036, 5037, 5038, 5039, 5040, 5042, 5044, 5045, 5046, 5051, 5052, 5054, 5057, 5060, 5067, 5068, 5069, 5072, 5075, 5078, 5082, 5087, 5088, 5089, 5094, 5100, 5101, 5102, 5106, 5110, 5113, 5114, 5119, 5120, 5122, 5123, 5125, 5131, 5132, 5140, 5143, 5145, 5147, 5149, 5153, 5159, 5160, 5163, 5164, 5165, 5166, 5168, 5170, 5171, 5172, 5174, 5180, 5181, 5184, 5185, 5187, 5188, 5189, 5190, 5191, 5192, 5193, 5195, 5196, 5198, 5199, 5200, 5202, 5206, 5209, 5213, 5216, 5217, 5218, 5219, 5224, 5225, 5229, 5234, 5240, 5241, 5244, 5245, 5248, 5251, 5253, 5254, 5255, 5256, 5257, 5258, 5260, 5261, 5262, 5263, 5266, 5268, 5269, 5275, 5276, 5280, 5281, 5282, 5283, 5286, 5293, 5297, 5298, 5299, 5300, 5301, 5308, 5311, 5313, 5314, 5315, 5317, 5319, 5321, 5322, 5324, 5329, 5330, 5333, 5334, 5338, 5339, 5343, 5344, 5345, 5346, 5348, 5349, 5352, 5366, 5367, 5369, 5379, 5386, 5388, 5389, 5393, 5395, 5396, 5398, 5400, 5402, 5404, 5405, 5413, 5414, 5418, 5422, 5427, 5428, 5431, 5434, 5437, 5438, 5445, 5446, 5450, 5452, 5453, 5456, 5458, 5459, 5461, 5472, 5475, 5483, 5491, 5493, 5495, 5496, 5498, 5505, 5508, 5510, 5512, 5513, 5515, 5517, 5518, 5519, 5524, 5529, 5530, 5531, 5532, 5535, 5543, 5545, 5547, 5549, 5554, 5563, 5566, 5568, 5569, 5572, 5575, 5578, 5579, 5581, 5582, 5584, 5585, 5586, 5589, 5592, 5593, 5594, 5597, 5602, 5608, 5611, 5613, 5614, 5615, 5616, 5620, 5623, 5624, 5627, 5632, 5633, 5635, 5638, 5640, 5643, 5647, 5648, 5649, 5650, 5651, 5652, 5653, 5656, 5659, 5660, 5663, 5664, 5667, 5669, 5680, 5681, 5689, 5690, 5694, 5695, 5697, 5698, 5702, 5706, 5711, 5712, 5713, 5714, 5717, 5718, 5719, 5721, 5722, 5724, 5729, 5730, 5731, 5734, 5735, 5736, 5737, 5738, 5742, 5744, 5748, 5751, 5768, 5770, 5771, 5775, 5778, 5780, 5782, 5783, 5785, 5787, 5791, 5792, 5794, 5806, 5807, 5808, 5810, 5811, 5817, 5820, 5826, 5828, 5832, 5833, 5834, 5835, 5836, 5839, 5842, 5844, 5846, 5853, 5854, 5859, 5864, 5866, 5867, 5869, 5871, 5872, 5873, 5876, 5878, 5879, 5881, 5882, 5883, 5884, 5887, 5888, 5889, 5892, 5893, 5900, 5901, 5902, 5906, 5907, 5910, 5912, 5913, 5914, 5918, 5919, 5921, 5925, 5926, 5927, 5928, 5931, 5932, 5936, 5938, 5939, 5940, 5941, 5943, 5944, 5945, 5948, 5951, 5952, 5954, 5956, 5957, 5959, 5961, 5968, 5971, 5978, 5979, 5980, 5985, 5986, 5988, 5990, 5991, 5992, 5994, 5996, 5997, 6000, 6002, 6003, 6004, 6005, 6006, 6007, 6012, 6013, 6016, 6017, 6025, 6026, 6038, 6040, 6041, 6044, 6045, 6047, 6048, 6051, 6053, 6054, 6058, 6059, 6060, 6061, 6062, 6063, 6068, 6069, 6070, 6072, 6073, 6074, 6075, 6080, 6088, 6093, 6094, 6095, 6097, 6098, 6107, 6108, 6109, 6110, 6112, 6113, 6116, 6118, 6122, 6125, 6129, 6130, 6131, 6132, 6133, 6136, 6137, 6138, 6145, 6146, 6147, 6151, 6152, 6153, 6156, 6163, 6164, 6165, 6168, 6173, 6182, 6183, 6186, 6188, 6189, 6190, 6191, 6193, 6196, 6197, 6198, 6200, 6203, 6205, 6207, 6209, 6212, 6213, 6220, 6221, 6223, 6224, 6227, 6228, 6230, 6231, 6234, 6238, 6241, 6243, 6246, 6249, 6251, 6255, 6257, 6258, 6259, 6264, 6265, 6269, 6270, 6271, 6272, 6273, 6278, 6279, 6280, 6282, 6283, 6284, 6285, 6286, 6287, 6289, 6292, 6294, 6296, 6299, 6300, 6302, 6303, 6304, 6309, 6310, 6311, 6315, 6317, 6319, 6321, 6322, 6325, 6326, 6328, 6333, 6338, 6345, 6350, 6351, 6352, 6353, 6354, 6358, 6359, 6360, 6362, 6363, 6364, 6367, 6370, 6378, 6381, 6394, 6395, 6396, 6397, 6398, 6399, 6403, 6405, 6407, 6412, 6414, 6415, 6419, 6420, 6422, 6429, 6430, 6431, 6434, 6435, 6436, 6437, 6440, 6442, 6454, 6456, 6458, 6459, 6463, 6464, 6466, 6467, 6468, 6469, 6470, 6471, 6474, 6476, 6480, 6482, 6486, 6488, 6495, 6500, 6501, 6502, 6503, 6504, 6505, 6510, 6513, 6514, 6516, 6517, 6519, 6524, 6530, 6533, 6534, 6535, 6537, 6539, 6543, 6544, 6545, 6547, 6548, 6549, 6554, 6555, 6558, 6560, 6561, 6563, 6567, 6569, 6572, 6574, 6576, 6577, 6579, 6581, 6582, 6584, 6587, 6588, 6594, 6595, 6597, 6598, 6603, 6607, 6609, 6611, 6621, 6622, 6624, 6626, 6628, 6630, 6634, 6635, 6637, 6638, 6639, 6643, 6649, 6650, 6655, 6656, 6658, 6662, 6666, 6667, 6671, 6678, 6679, 6681, 6691, 6692, 6695, 6699, 6703, 6705, 6706, 6711, 6714, 6716, 6718, 6720, 6724, 6731, 6733, 6734, 6737, 6739, 6746, 6747, 6748, 6749, 6757, 6758, 6759, 6760, 6761, 6766, 6767, 6778, 6779, 6780, 6783, 6786, 6788, 6793, 6794, 6795, 6799, 6803, 6804, 6805, 6807, 6810, 6811, 6812, 6813, 6816, 6819, 6820, 6821, 6824, 6827, 6828, 6829, 6830, 6834, 6836, 6837, 6839, 6840, 6841, 6843, 6848, 6852, 6859, 6864, 6865, 6869, 6872, 6874, 6875, 6878, 6879, 6880, 6882, 6883, 6886, 6897, 6903, 6906, 6909, 6914, 6915, 6917, 6919, 6920, 6921, 6930, 6933, 6936, 6941, 6944, 6946, 6948, 6950, 6952, 6959, 6960, 6963, 6967, 6969, 6974, 6979, 6980, 6984, 6985, 6987, 6988, 6990, 6993, 6994, 6999, 7006, 7010, 7012, 7013, 7015, 7022, 7031, 7032, 7035, 7042, 7043, 7045, 7048, 7052, 7053, 7056, 7057, 7060, 7062, 7064, 7069, 7072, 7073, 7074, 7075, 7077, 7083, 7085, 7086, 7097, 7105, 7106, 7107, 7108, 7109, 7112, 7116, 7117, 7118, 7124, 7126, 7130, 7132, 7134, 7135, 7137, 7140, 7142, 7144, 7146, 7149, 7154, 7155, 7163, 7164, 7167, 7169, 7172, 7173, 7176, 7177, 7182, 7184, 7187, 7188, 7189, 7194, 7201, 7202, 7203, 7206, 7207, 7209, 7212, 7216, 7217, 7218, 7219, 7227, 7228, 7232, 7233, 7234, 7235, 7236, 7239, 7240, 7243, 7244, 7245, 7248, 7254, 7255, 7257, 7258, 7259, 7262, 7267, 7268, 7274, 7276, 7277, 7278, 7282, 7284, 7286, 7287, 7288, 7290, 7291, 7292, 7293, 7298, 7299, 7300, 7301, 7303, 7304, 7305, 7306, 7307, 7310, 7315, 7317, 7328, 7330, 7336, 7340, 7344, 7345, 7354, 7355, 7356, 7357, 7358, 7360, 7361, 7365, 7371, 7373, 7379, 7382, 7383, 7388, 7389, 7392, 7395, 7398, 7400, 7409, 7411, 7415, 7425, 7430, 7434, 7435, 7436, 7438, 7441, 7443, 7444, 7445, 7446, 7447, 7448, 7454, 7458, 7459, 7464, 7466, 7470, 7472, 7474, 7475, 7476, 7483, 7486, 7487, 7490, 7493, 7504, 7505, 7506, 7512, 7515, 7517, 7518, 7523, 7525, 7528, 7533, 7534, 7537, 7538, 7542, 7546, 7547, 7548, 7554, 7557, 7561, 7565, 7570, 7574, 7577, 7578, 7579, 7580, 7585, 7586, 7591, 7593, 7594, 7595, 7596, 7601, 7605, 7611, 7619, 7620, 7621, 7623, 7624, 7633, 7639, 7640, 7642, 7643, 7652, 7653, 7658, 7661, 7663, 7664, 7665, 7666, 7667, 7674, 7677, 7678, 7679, 7680, 7682, 7685, 7687, 7689, 7694, 7695, 7699, 7700, 7703, 7704, 7708, 7712, 7713, 7717, 7718, 7719, 7724, 7725, 7727, 7729, 7733, 7736, 7737, 7738, 7740, 7743, 7744, 7745, 7747, 7751, 7753, 7761, 7762, 7763, 7764, 7767, 7768, 7769, 7774, 7775, 7777, 7778, 7779, 7782, 7783, 7785, 7786, 7791, 7793, 7798, 7800, 7803, 7804, 7806, 7807, 7812, 7815, 7818, 7819, 7820, 7825, 7832, 7833, 7834, 7838, 7841, 7844, 7845, 7848, 7849, 7850, 7853, 7856, 7859, 7860, 7862, 7863, 7865, 7870, 7876, 7878, 7888, 7890, 7896, 7900, 7908, 7910, 7911, 7918, 7921, 7922, 7923, 7925, 7927, 7929, 7934, 7935, 7936, 7937, 7938, 7942, 7944, 7945, 7946, 7947, 7948, 7955, 7956, 7960, 7962, 7964, 7965, 7966, 7967, 7972, 7974, 7976, 7978, 7980, 7981, 7983, 7984, 7986, 7989, 7990, 7991, 7993, 7998, 8001, 8006, 8008, 8009, 8012, 8023, 8026, 8029, 8039, 8042, 8044, 8047, 8052, 8053, 8056, 8058, 8059, 8061, 8063, 8067, 8068, 8073, 8075, 8076, 8078, 8080, 8082, 8084, 8088, 8091, 8093, 8095, 8100, 8103, 8105, 8106, 8112, 8116, 8118, 8121, 8126, 8130, 8134, 8136, 8137, 8143, 8147, 8148, 8150, 8151, 8159, 8162, 8163, 8165, 8168, 8170, 8176, 8178, 8179, 8182, 8185, 8187, 8188, 8189, 8192, 8193, 8195, 8199, 8202, 8204, 8207, 8208, 8211, 8213, 8215, 8216, 8219, 8220, 8222, 8223, 8225, 8227, 8231, 8234, 8235, 8236, 8239, 8240, 8242, 8245, 8246, 8250, 8252, 8253, 8266, 8268, 8269, 8270, 8272, 8274, 8282, 8288, 8289, 8292, 8293, 8294, 8300, 8301, 8304, 8310, 8311, 8312, 8313, 8317, 8318, 8319, 8320, 8329, 8331, 8336, 8339, 8340, 8349, 8350, 8352, 8353, 8355, 8361, 8363, 8367, 8368, 8369, 8373, 8376, 8379, 8382, 8385, 8387, 8389, 8390, 8392, 8395, 8401, 8402, 8403, 8404, 8405, 8409, 8410, 8413, 8414, 8416, 8423, 8433, 8435, 8436, 8438, 8439, 8441, 8442, 8444, 8446, 8447, 8448, 8450, 8451, 8452, 8456, 8457, 8458, 8459, 8466, 8472, 8473, 8474, 8476, 8481, 8482, 8486, 8490, 8493, 8498, 8499, 8501, 8503, 8505, 8509, 8511, 8513, 8515, 8517, 8524, 8525, 8527, 8528, 8531, 8532, 8533, 8535, 8537, 8538, 8539, 8542, 8543, 8549, 8550, 8551, 8552, 8553, 8554, 8561, 8562, 8565, 8568, 8575, 8576, 8579, 8581, 8582, 8589, 8590, 8592, 8593, 8594, 8596, 8597, 8599, 8600, 8601, 8603, 8605, 8607, 8609, 8611, 8612, 8613, 8614, 8617, 8618, 8624, 8630, 8631, 8634, 8635, 8637, 8638, 8640, 8642, 8644, 8648, 8650, 8654, 8657, 8658, 8659, 8663, 8665, 8669, 8672, 8685, 8693, 8694, 8700, 8703, 8704, 8706, 8708, 8709, 8713, 8716, 8717, 8720, 8721, 8726, 8729, 8732, 8734, 8736, 8741, 8742, 8744, 8745, 8746, 8748, 8752, 8761, 8764, 8766, 8767, 8770, 8772, 8773, 8776, 8777, 8779, 8782, 8783, 8784, 8789, 8792, 8803, 8805, 8810, 8818, 8821, 8822, 8824, 8829, 8830, 8831, 8832, 8834, 8835, 8838, 8839, 8843, 8846, 8853, 8859, 8861, 8865, 8866, 8867, 8875, 8877, 8878, 8881, 8883, 8884, 8886, 8888, 8890, 8891, 8892, 8896, 8897, 8899, 8900, 8902, 8907, 8908, 8909, 8910, 8911, 8913, 8914, 8916, 8917, 8924, 8926, 8929, 8935, 8941, 8942, 8945, 8946, 8949, 8951, 8954, 8956, 8957, 8959, 8960, 8961, 8962, 8963, 8967, 8968, 8969, 8972, 8974, 8976, 8977, 8979, 8980, 8981, 8985, 8986, 8992, 8996, 8998, 8999, 9000, 9001, 9002, 9003, 9006, 9009, 9012, 9015, 9018, 9020, 9023, 9029, 9030, 9033, 9037, 9044, 9052, 9056, 9058, 9059, 9060, 9061, 9066, 9069, 9071, 9072, 9073, 9074, 9076, 9080, 9084, 9091, 9092, 9095, 9096, 9105, 9108, 9109, 9110, 9111, 9112, 9114, 9115, 9118, 9120, 9123, 9124, 9125, 9128, 9129, 9133, 9134, 9138, 9139, 9140, 9141, 9142, 9149, 9151, 9152, 9167, 9168, 9172, 9173, 9174, 9177, 9179, 9183, 9185, 9187, 9188, 9190, 9195, 9199, 9206, 9207, 9210, 9211, 9213, 9214, 9215, 9216, 9223, 9226, 9229, 9231, 9233, 9241, 9243, 9247, 9249, 9252, 9253, 9254, 9255, 9257, 9263, 9265, 9267, 9270, 9273, 9276, 9278, 9284, 9285, 9288, 9290, 9292, 9293, 9298, 9299, 9300, 9302, 9304, 9308, 9311, 9314, 9316, 9320, 9323, 9325, 9326, 9327, 9328, 9329, 9330, 9333, 9336, 9337, 9339, 9340, 9341, 9345, 9346, 9347, 9348, 9350, 9353, 9354, 9355, 9359, 9367, 9373, 9375, 9376, 9382, 9383, 9388, 9391, 9392, 9393, 9394, 9396, 9398, 9400, 9402, 9403, 9404, 9406, 9407, 9412, 9413, 9414, 9415, 9423, 9432, 9433, 9434, 9440, 9442, 9444, 9449, 9451, 9452, 9456, 9460, 9468, 9470, 9471, 9472, 9473, 9475, 9478, 9479, 9483, 9488, 9490, 9494, 9495, 9497, 9500, 9501, 9502, 9503, 9504, 9505, 9509, 9514, 9515, 9517, 9518, 9519, 9520, 9525, 9528, 9531, 9533, 9534, 9536, 9540, 9545, 9546, 9548, 9549, 9553, 9554, 9555, 9559, 9563, 9564, 9565, 9568, 9571, 9577, 9582, 9587, 9589, 9590, 9591, 9596, 9602, 9606, 9609, 9613, 9617, 9618, 9620, 9623, 9624, 9626, 9627, 9628, 9629, 9632, 9633, 9635, 9640, 9641, 9642, 9644, 9645, 9646, 9648, 9649, 9650, 9653, 9655, 9656, 9658, 9659, 9660, 9663, 9666, 9668, 9670, 9677, 9681, 9682, 9686, 9692, 9698, 9700, 9706, 9707, 9710, 9711, 9715, 9718, 9722, 9723, 9724, 9726, 9729, 9730, 9731, 9733, 9734, 9737, 9744, 9745, 9746, 9750, 9753, 9754, 9756, 9763, 9764, 9767, 9768, 9770, 9776, 9780, 9781, 9782, 9784, 9786, 9792, 9793, 9794, 9796, 9799, 9806, 9808, 9809, 9810, 9812, 9813, 9814, 9816, 9819, 9824, 9825, 9827, 9829, 9833, 9836, 9845, 9847, 9849, 9850, 9851, 9853, 9854, 9861, 9864, 9866, 9869, 9873, 9882, 9886, 9887, 9892, 9894, 9897, 9901, 9906, 9907, 9908, 9909, 9910, 9917, 9924, 9928, 9929, 9930, 9935, 9938, 9940, 9946, 9947, 9949, 9950, 9953, 9957, 9960, 9962, 9963, 9964, 9967, 9968, 9971, 9972, 9979, 9980, 9982, 9984, 9985, 9987, 9988, 9990, 9997, 9998, 10000, 10009, 10010, 10013, 10017, 10018, 10019, 10021, 10026, 10031, 10033, 10037, 10038, 10041, 10042, 10043, 10044, 10045, 10048, 10051, 10052, 10054, 10056, 10059, 10060, 10062, 10063, 10064, 10068, 10073, 10075, 10077, 10078, 10083, 10089, 10091, 10092, 10093, 10094, 10095, 10097, 10101, 10102, 10103, 10105, 10106, 10107, 10108, 10109, 10110, 10114, 10115, 10116, 10117, 10118, 10119, 10122, 10127, 10128, 10131, 10132, 10136, 10138, 10143, 10146, 10149, 10151, 10152, 10158, 10163, 10165, 10166, 10168, 10170, 10174, 10176, 10178, 10181, 10182, 10191, 10192, 10193, 10194, 10195, 10197, 10199, 10203, 10206, 10209, 10213, 10214, 10218, 10219, 10220, 10222, 10223, 10225, 10228, 10231, 10233, 10236, 10237, 10238, 10239, 10242, 10247, 10252, 10255, 10258, 10259, 10275, 10278, 10284, 10286, 10291, 10292, 10293, 10295, 10300, 10302, 10306, 10307, 10321, 10322, 10323, 10324, 10325, 10326, 10328, 10330, 10331, 10333, 10334, 10335, 10336, 10338, 10344, 10346, 10352, 10353, 10357, 10359, 10360, 10362, 10364, 10368, 10373, 10375, 10378, 10380, 10384, 10385, 10388, 10389, 10397, 10398, 10399, 10400, 10401, 10405, 10408, 10410, 10412, 10413, 10414, 10416, 10421, 10422, 10423, 10425, 10427, 10428, 10429, 10430, 10435, 10437, 10438, 10440, 10442, 10443, 10446, 10448, 10450, 10451, 10453, 10455, 10463, 10464, 10465, 10466, 10468, 10469, 10470, 10474, 10478, 10480, 10482, 10490, 10492, 10494, 10495, 10496, 10497, 10504, 10506, 10508, 10514, 10515, 10518, 10521, 10525, 10527, 10528, 10531, 10533, 10535, 10536, 10541, 10542, 10543, 10544, 10547, 10548, 10549, 10550, 10551, 10555, 10556, 10558, 10560, 10561, 10562, 10563, 10564, 10565, 10567, 10569, 10571, 10580, 10581, 10582, 10583, 10585, 10589, 10593, 10595, 10596, 10597, 10599, 10600, 10601, 10602, 10609, 10610, 10611, 10614, 10615, 10616, 10617, 10621, 10622, 10623, 10626, 10628, 10629, 10630, 10631, 10633, 10637, 10638, 10639, 10640, 10641, 10642, 10645, 10646, 10649, 10650, 10655, 10657, 10663, 10665, 10668, 10671, 10674, 10677, 10678, 10681, 10682, 10683, 10684, 10685, 10687, 10689, 10693, 10697, 10698, 10699, 10700, 10702, 10703, 10705, 10707, 10708, 10711, 10712, 10715, 10716, 10723, 10725, 10726, 10727, 10730, 10732, 10734, 10735, 10736, 10737, 10740, 10741, 10744, 10748, 10749, 10752, 10753, 10756, 10761, 10762, 10763, 10766, 10768, 10775, 10778, 10779, 10782, 10784, 10785, 10787, 10788, 10790, 10791, 10795, 10796, 10798, 10800, 10801, 10802, 10803, 10805, 10809, 10810, 10811, 10813, 10815, 10818, 10819, 10820, 10821, 10824, 10825, 10826, 10831, 10832, 10833, 10836, 10838, 10839, 10840, 10841, 10843, 10845, 10850, 10853, 10858, 10860, 10861, 10862, 10864, 10867, 10870, 10874, 10876, 10877, 10880, 10881, 10892, 10896, 10897, 10898, 10902, 10903, 10905, 10912, 10917, 10920, 10926, 10927, 10930, 10933, 10934, 10935, 10936, 10937, 10938, 10941, 10944, 10947, 10948, 10950, 10954, 10957, 10960, 10962, 10963, 10964, 10967, 10972, 10975, 10976, 10977, 10978, 10980, 10981, 10985, 10988, 10993, 10995, 10996, 10997, 10998, 10999, 11002, 11004, 11005, 11006, 11008, 11009, 11010, 11015, 11016, 11018, 11022, 11024, 11027, 11032, 11036, 11037, 11039, 11044, 11045, 11046, 11047, 11049, 11053, 11056, 11061, 11066, 11068, 11070, 11071, 11072, 11078, 11079, 11080, 11082, 11083, 11086, 11090, 11095, 11098, 11102, 11103, 11107, 11110, 11114, 11116, 11117, 11118, 11119, 11123, 11124, 11125, 11126, 11127, 11128, 11129, 11134, 11135, 11137, 11138, 11141, 11145, 11146, 11148, 11153, 11154, 11158, 11159, 11160, 11161, 11162, 11163, 11166, 11168, 11169, 11174, 11175, 11177, 11178, 11179, 11180, 11184, 11185, 11187, 11188, 11190, 11191, 11198, 11199, 11201, 11202, 11203, 11206, 11207, 11210, 11214, 11217, 11218, 11222, 11226, 11227, 11232, 11233, 11234, 11235, 11236, 11237, 11238, 11239, 11242, 11246, 11247, 11248, 11254, 11255, 11256, 11257, 11258, 11259, 11260, 11262, 11263, 11264, 11265, 11266, 11274, 11275, 11278, 11286, 11288, 11289, 11290, 11291, 11292, 11293, 11294, 11295, 11306, 11307, 11308, 11313, 11315, 11316, 11318, 11319, 11320, 11322, 11324, 11326, 11329, 11332, 11337, 11339, 11340, 11345, 11346, 11348, 11352, 11356, 11363, 11365, 11366, 11370, 11371, 11373, 11374, 11377, 11378, 11381, 11382, 11388, 11389, 11391, 11392, 11394, 11395, 11397, 11401, 11403, 11405, 11406, 11409, 11416, 11418, 11420, 11423, 11424, 11428, 11431, 11433, 11437, 11438, 11442, 11443, 11449, 11451, 11458, 11459, 11463, 11465, 11468, 11470, 11471, 11472, 11473, 11475, 11476, 11478, 11481, 11482, 11485, 11487, 11490, 11494, 11496, 11497, 11498, 11500, 11505, 11506, 11507, 11508, 11509, 11512, 11516, 11518, 11520, 11523, 11526, 11528, 11530, 11531, 11532, 11533, 11534, 11538, 11540, 11541, 11544, 11545, 11546, 11547, 11548, 11550, 11551, 11553, 11558, 11560, 11561, 11567, 11568, 11570, 11571, 11574, 11576, 11577, 11578, 11579, 11580, 11583, 11587, 11588, 11589, 11593, 11594, 11595, 11596, 11597, 11598, 11599, 11604, 11615, 11618, 11620, 11621, 11623, 11625, 11628, 11629, 11632, 11633, 11638, 11639, 11642, 11649, 11650, 11651, 11652, 11654, 11655, 11656, 11657, 11658, 11663, 11667, 11668, 11669, 11673, 11678, 11680, 11681, 11682, 11683, 11684, 11685, 11688, 11691, 11692, 11693, 11695, 11701, 11703, 11705, 11707, 11711, 11712, 11721, 11725, 11726, 11731, 11733, 11736, 11740, 11741, 11743, 11744, 11753, 11755, 11756, 11759, 11760, 11761, 11762, 11763, 11764, 11765, 11766, 11767, 11770, 11771, 11776, 11782, 11783, 11785, 11786, 11790, 11792, 11799, 11800, 11809, 11811, 11812, 11813, 11814, 11816, 11818, 11819, 11820, 11821, 11825, 11826, 11828, 11830, 11831, 11832, 11837, 11839, 11841, 11846, 11848, 11849, 11851, 11853, 11856, 11857, 11858, 11861, 11863, 11868, 11869, 11870, 11872, 11876, 11877, 11878, 11879, 11881, 11886, 11890, 11891, 11894, 11895, 11898, 11903, 11908, 11909, 11913, 11915, 11920, 11921, 11923, 11926, 11928, 11929, 11930, 11934, 11935, 11940, 11941, 11943, 11946, 11947, 11948, 11949, 11952, 11953, 11955, 11957, 11958, 11959, 11960, 11961, 11962, 11963, 11965, 11976, 11977, 11978, 11979, 11980, 11983, 11988, 11991, 11993, 11994, 11995, 11996, 11997, 11998, 11999, 12002, 12004, 12008, 12016, 12018, 12019, 12020, 12021, 12023, 12024, 12025, 12030, 12032, 12042, 12043, 12044, 12047, 12050, 12051, 12054, 12059, 12060, 12061, 12063, 12064, 12066, 12068, 12077, 12078, 12079, 12080, 12081, 12083, 12086, 12091, 12093, 12097, 12098, 12104, 12106, 12109, 12110, 12112, 12115, 12118, 12120, 12122, 12128, 12129, 12131, 12134, 12135, 12136, 12138, 12139, 12140, 12143, 12144, 12145, 12146, 12147, 12151, 12155, 12161, 12162, 12163, 12165, 12166, 12167, 12170, 12171, 12174, 12179, 12181, 12186, 12187, 12197, 12200, 12201, 12202, 12204, 12208, 12212, 12214, 12215, 12217, 12220, 12223, 12230, 12233, 12234, 12237, 12238, 12240, 12241, 12243, 12245, 12246, 12250, 12252, 12254, 12255, 12259, 12265, 12271, 12278, 12280, 12283, 12285, 12286, 12287, 12293, 12295, 12296, 12299, 12310, 12311, 12312, 12313, 12314, 12315, 12317, 12319, 12321, 12323, 12325, 12328, 12331, 12334, 12339, 12342, 12343, 12345, 12347, 12350, 12354, 12356, 12358, 12359, 12364, 12366, 12369, 12375, 12376, 12379, 12380, 12381, 12385, 12390, 12393, 12397, 12400, 12403, 12404, 12406, 12409, 12411, 12414, 12415, 12416, 12419, 12420, 12423, 12424, 12425, 12426, 12427, 12437, 12438, 12440, 12441, 12444, 12445, 12446, 12450, 12451, 12455, 12456, 12457, 12459, 12461, 12462, 12465, 12467, 12468, 12470, 12472, 12473, 12475, 12478, 12479, 12480, 12481, 12487, 12488, 12489, 12492, 12494, 12495, 12497, 12501, 12502, 12503, 12510, 12511, 12512, 12513, 12514, 12515, 12518, 12519, 12527, 12530, 12531, 12535, 12536, 12537, 12538, 12539, 12540, 12546, 12547, 12548, 12551, 12552, 12554, 12555, 12556, 12561, 12563, 12565, 12567, 12568, 12570, 12572, 12577, 12578, 12583, 12585, 12586, 12588, 12591, 12600, 12608, 12609, 12610, 12611, 12616, 12620, 12622, 12623, 12626, 12628, 12629, 12634, 12638, 12639, 12640, 12641, 12644, 12648, 12649, 12651, 12655, 12658, 12663, 12664, 12668, 12670, 12674, 12675, 12679, 12681, 12683, 12684, 12688, 12689, 12691, 12693, 12694, 12695, 12696, 12697, 12699, 12701, 12702, 12705, 12706, 12707, 12708, 12710, 12714, 12723, 12731, 12732, 12733, 12739, 12740, 12741, 12742, 12752, 12753, 12754, 12755, 12758, 12760, 12764, 12766, 12771, 12772, 12773, 12775, 12777, 12779, 12782, 12785, 12790, 12793, 12797, 12801, 12802, 12804, 12807, 12810, 12812, 12813, 12817, 12818, 12819, 12820, 12822, 12823, 12824, 12826, 12827, 12828, 12835, 12837, 12838, 12839, 12843, 12848, 12849, 12853, 12858, 12860, 12861, 12866, 12869, 12870, 12873, 12875, 12882, 12883, 12884, 12887, 12888, 12891, 12893, 12898, 12899, 12900, 12901, 12902, 12903, 12904, 12905, 12906, 12908, 12912, 12918, 12921, 12923, 12928, 12929, 12932, 12933, 12934, 12945, 12946, 12947, 12952, 12956, 12957, 12958, 12959, 12960, 12963, 12967, 12968, 12969, 12978, 12983, 12984, 12986, 12987, 12988, 12990, 12991, 12999, 13001, 13003, 13004, 13005, 13007, 13010, 13014, 13015, 13017, 13018, 13022, 13027, 13030, 13031, 13033, 13034, 13035, 13040, 13041, 13047, 13053, 13054, 13055, 13056, 13060, 13061, 13062, 13064, 13066, 13071, 13075, 13083, 13085, 13086, 13087, 13098, 13099, 13101, 13102, 13105, 13110, 13111, 13112, 13114, 13115, 13117, 13118, 13120, 13121, 13122, 13123, 13124, 13125, 13128, 13131, 13134, 13136, 13143, 13148, 13149, 13151, 13153, 13154, 13159, 13160, 13169, 13170, 13175, 13181, 13182, 13186, 13187, 13189, 13190, 13193, 13197, 13198, 13199, 13206, 13209, 13212, 13217, 13220, 13221, 13224, 13226, 13227, 13228, 13232, 13233, 13234, 13235, 13236, 13237, 13239, 13241, 13248, 13250, 13251, 13255, 13256, 13259, 13260, 13261, 13262, 13263, 13264, 13265, 13268, 13271, 13274, 13281, 13297, 13298, 13301, 13303, 13304, 13312, 13313, 13315, 13317, 13326, 13329, 13332, 13340, 13343, 13345, 13346, 13347, 13348, 13352, 13361, 13363, 13367, 13368, 13369, 13370, 13377, 13380, 13381, 13385, 13386, 13388, 13391, 13393, 13394, 13395, 13396, 13397, 13402, 13403, 13407, 13408, 13410, 13416, 13417, 13418, 13419, 13423, 13429, 13430, 13433, 13439, 13441, 13444, 13448, 13454, 13456, 13460, 13463, 13467, 13469, 13473, 13475, 13477, 13478, 13480, 13484, 13489, 13491, 13492, 13496, 13499, 13503, 13506, 13513, 13514, 13515, 13519, 13521, 13522, 13524, 13525, 13526, 13530, 13539, 13540, 13543, 13544, 13546, 13547, 13549, 13551, 13552, 13553, 13555, 13556, 13558, 13559, 13561, 13568, 13569, 13574, 13579, 13580, 13584, 13587, 13597, 13599, 13600, 13601, 13602, 13604, 13605, 13612, 13613, 13614, 13620, 13621, 13623, 13628, 13630, 13631, 13632, 13634, 13636, 13637, 13638, 13639, 13641, 13643, 13647, 13650, 13653, 13654, 13662, 13663, 13665, 13668, 13669, 13677, 13678, 13679, 13683, 13688, 13689, 13693, 13696, 13697, 13698, 13699, 13700, 13706, 13712, 13713, 13714, 13715, 13716, 13719, 13720, 13722, 13727, 13729, 13734, 13737, 13739, 13742, 13745, 13747, 13749, 13750, 13753, 13755, 13756, 13763, 13764, 13766, 13767, 13768, 13772, 13773, 13775, 13777, 13779, 13780, 13782, 13783, 13785, 13786, 13787, 13788, 13791, 13793, 13794, 13796, 13799, 13801, 13809, 13816, 13817, 13818, 13819, 13822, 13823, 13828, 13830, 13831, 13834, 13835, 13843, 13849, 13852, 13858, 13866, 13869, 13872, 13873, 13875, 13877, 13887, 13891, 13892, 13895, 13897, 13898, 13899, 13901, 13906, 13908, 13909, 13910, 13911, 13913, 13915, 13917, 13918, 13919, 13924, 13932, 13934, 13944, 13947, 13948, 13950, 13952, 13953, 13954, 13958, 13960, 13961, 13963, 13969, 13970, 13974, 13975, 13984, 13986, 13987, 13991, 14000, 14001, 14005, 14006, 14008, 14013, 14014, 14017, 14018, 14021, 14022, 14027, 14030, 14031, 14036, 14038, 14040, 14052, 14054, 14059, 14062, 14063, 14066, 14067, 14069, 14070, 14071, 14073, 14075, 14076, 14078, 14081, 14084, 14085, 14086, 14087, 14088, 14092, 14094, 14097, 14104, 14112, 14115, 14116, 14117, 14118, 14119, 14121, 14122, 14124, 14125, 14129, 14130, 14132, 14133, 14138, 14139, 14140, 14145, 14146, 14147.

Promoters expressing in the endosperm at 40 days after pollination include SEQ IDs: 1, 3, 7, 12, 14, 15, 19, 27, 29, 31, 34, 36, 37, 48, 54, 56, 57, 64, 65, 79, 80, 86, 88, 90, 93, 94, 95, 96, 98, 99, 100, 102, 103, 104, 105, 108, 110, 111, 112, 117, 123, 126, 128, 130, 131, 137, 143, 144, 146, 148, 152, 154, 156, 157, 159, 162, 169, 172, 174, 175, 176, 179, 181, 183, 187, 191, 193, 194, 202, 203, 205, 207, 211, 212, 232, 233, 235, 236, 237, 240, 242, 244, 246, 248, 249, 250, 251, 257, 262, 264, 267, 269, 270, 271, 286, 288, 293, 294, 301, 302, 305, 306, 308, 309, 316, 319, 320, 322, 328, 329, 332, 334, 337, 338, 349, 352, 354, 355, 356, 358, 359, 364, 365, 371, 372, 373, 379, 381, 386, 388, 389, 401, 411, 412, 414, 416, 423, 428, 432, 434, 436, 441, 448, 450, 454, 456, 458, 459, 461, 462, 463, 465, 466, 468, 470, 474, 478, 481, 482, 483, 485, 488, 489, 493, 496, 501, 502, 507, 509, 511, 514, 515, 516, 517, 523, 525, 528, 532, 536, 537, 538, 541, 543, 544, 546, 547, 548, 554, 555, 556, 557, 560, 561, 578, 579, 580, 582, 585, 589, 591, 592, 594, 595, 596, 601, 606, 607, 608, 609, 610, 611, 613, 619, 620, 629, 630, 635, 636, 637, 638, 643, 645, 647, 661, 663, 664, 665, 669, 671, 681, 683, 693, 694, 695, 701, 702, 705, 706, 709, 717, 718, 719, 721, 722, 723, 724, 727, 731, 732, 733, 734, 736, 739, 740, 742, 744, 749, 753, 757, 759, 760, 762, 763, 764, 765, 771, 779, 783, 784, 792, 793, 795, 798, 800, 804, 806, 808, 809, 812, 814, 815, 816, 820, 821, 824, 825, 826, 829, 830, 833, 841, 845, 846, 855, 856, 857, 858, 862, 863, 865, 869, 870, 871, 875, 876, 877, 878, 890, 891, 892, 893, 895, 897, 898, 900, 903, 907, 908, 910, 911, 912, 913, 915, 916, 919, 920, 924, 928, 929, 931, 932, 936, 938, 939, 943, 947, 948, 949, 951, 953, 955, 957, 958, 960, 961, 964, 971, 973, 974, 975, 977, 978, 979, 980, 982, 984, 985, 987, 991, 994, 995, 996, 997, 999, 1005, 1007, 1008, 1009, 1010, 1011, 1013, 1014, 1016, 1017, 1019, 1021, 1022, 1025, 1026, 1032, 1033, 1035, 1041, 1042, 1043, 1046, 1047, 1049, 1051, 1052, 1055, 1056, 1057, 1064, 1065, 1069, 1070, 1085, 1086, 1087, 1089, 1092, 1095, 1096, 1097, 1100, 1101, 1103, 1104, 1106, 1110, 1111, 1112, 1114, 1115, 1116, 1117, 1119, 1122, 1126, 1127, 1130, 1132, 1136, 1137, 1140, 1142, 1144, 1146, 1153, 1160, 1164, 1165, 1167, 1168, 1170, 1171, 1174, 1176, 1178, 1180, 1183, 1187, 1191, 1196, 1200, 1201, 1204, 1205, 1213, 1214, 1215, 1218, 1220, 1221, 1222, 1223, 1225, 1227, 1228, 1229, 1232, 1233, 1234, 1236, 1240, 1244, 1248, 1250, 1251, 1252, 1253, 1257, 1258, 1261, 1262, 1263, 1269, 1272, 1275, 1277, 1281, 1285, 1286, 1290, 1292, 1293, 1296, 1299, 1306, 1307, 1309, 1310, 1311, 1312, 1314, 1316, 1320, 1322, 1323, 1325, 1331, 1334, 1344, 1345, 1349, 1354, 1355, 1360, 1361, 1365, 1366, 1368, 1371, 1375, 1376, 1377, 1380, 1382, 1387, 1388, 1389, 1391, 1393, 1396, 1399, 1400, 1402, 1404, 1405, 1406, 1410, 1412, 1421, 1423, 1426, 1431, 1433, 1437, 1440, 1441, 1442, 1443, 1444, 1450, 1451, 1453, 1458, 1459, 1461, 1466, 1468, 1475, 1484, 1486, 1488, 1489, 1490, 1491, 1493, 1497, 1499, 1501, 1503, 1506, 1508, 1510, 1511, 1512, 1518, 1527, 1528, 1530, 1533, 1543, 1545, 1548, 1549, 1550, 1551, 1555, 1556, 1560, 1561, 1563, 1564, 1567, 1570, 1575, 1578, 1584, 1585, 1586, 1588, 1590, 1591, 1598, 1599, 1600, 1601, 1602, 1604, 1605, 1608, 1609, 1610, 1612, 1614, 1615, 1616, 1617, 1623, 1625, 1634, 1635, 1636, 1637, 1638, 1641, 1642, 1648, 1650, 1651, 1653, 1654, 1658, 1659, 1662, 1663, 1669, 1671, 1673, 1675, 1678, 1681, 1682, 1684, 1687, 1688, 1689, 1690, 1691, 1696, 1697, 1698, 1700, 1705, 1706, 1707, 1708, 1710, 1712, 1716, 1717, 1720, 1723, 1732, 1735, 1749, 1750, 1755, 1759, 1761, 1764, 1770, 1771, 1773, 1774, 1776, 1777, 1778, 1785, 1786, 1791, 1798, 1802, 1807, 1808, 1809, 1811, 1813, 1814, 1820, 1826, 1828, 1830, 1832, 1834, 1837, 1839, 1843, 1846, 1851, 1852, 1854, 1855, 1859, 1861, 1863, 1866, 1868, 1869, 1872, 1873, 1876, 1878, 1879, 1880, 1882, 1886, 1888, 1891, 1895, 1897, 1900, 1902, 1903, 1904, 1905, 1906, 1910, 1911, 1913, 1915, 1916, 1918, 1920, 1922, 1923, 1924, 1930, 1931, 1933, 1934, 1939, 1940, 1944, 1945, 1949, 1950, 1951, 1952, 1953, 1958, 1964, 1968, 1969, 1970, 1971, 1972, 1973, 1981, 1990, 1991, 1993, 1999, 2000, 2001, 2002, 2007, 2008, 2010, 2012, 2014, 2015, 2019, 2021, 2026, 2031, 2032, 2033, 2037, 2038, 2040, 2041, 2043, 2048, 2060, 2062, 2064, 2071, 2072, 2074, 2077, 2078, 2085, 2087, 2088, 2089, 2091, 2092, 2093, 2094, 2097, 2103, 2106, 2107, 2111, 2112, 2119, 2122, 2123, 2125, 2126, 2128, 2130, 2133, 2137, 2139, 2141, 2142, 2143, 2144, 2146, 2147, 2150, 2151, 2152, 2156, 2158, 2159, 2161, 2162, 2164, 2166, 2167, 2168, 2170, 2172, 2175, 2177, 2179, 2183, 2185, 2189, 2190, 2193, 2195, 2196, 2200, 2201, 2207, 2210, 2214, 2216, 2218, 2221, 2227, 2229, 2230, 2231, 2240, 2241, 2242, 2245, 2253, 2257, 2258, 2263, 2274, 2276, 2283, 2284, 2293, 2294, 2297, 2298, 2300, 2304, 2306, 2308, 2309, 2310, 2313, 2314, 2322, 2323, 2328, 2331, 2335, 2339, 2342, 2343, 2352, 2358, 2359, 2361, 2362, 2363, 2366, 2369, 2371, 2372, 2379, 2380, 2381, 2382, 2384, 2393, 2397, 2401, 2405, 2410, 2413, 2414, 2416, 2417, 2418, 2419, 2420, 2423, 2430, 2431, 2432, 2433, 2434, 2435, 2436, 2437, 2439, 2441, 2442, 2443, 2445, 2449, 2451, 2452, 2453, 2454, 2456, 2457, 2458, 2465, 2469, 2470, 2472, 2474, 2476, 2477, 2480, 2481, 2482, 2483, 2487, 2489, 2490, 2492, 2495, 2496, 2498, 2500, 2505, 2506, 2507, 2509, 2510, 2515, 2516, 2517, 2519, 2521, 2525, 2528, 2529, 2531, 2532, 2533, 2538, 2539, 2541, 2543, 2544, 2546, 2549, 2550, 2552, 2554, 2555, 2559, 2560, 2567, 2568, 2570, 2573, 2578, 2579, 2581, 2589, 2590, 2591, 2594, 2596, 2599, 2601, 2605, 2609, 2611, 2614, 2616, 2618, 2619, 2620, 2625, 2627, 2632, 2635, 2636, 2639, 2644, 2645, 2649, 2652, 2655, 2656, 2658, 2661, 2662, 2663, 2666, 2670, 2671, 2672, 2673, 2674, 2679, 2680, 2684, 2685, 2688, 2689, 2690, 2691, 2692, 2694, 2700, 2704, 2708, 2709, 2711, 2720, 2721, 2722, 2725, 2726, 2728, 2729, 2735, 2739, 2745, 2746, 2747, 2749, 2752, 2756, 2758, 2759, 2760, 2762, 2765, 2766, 2770, 2783, 2784, 2786, 2787, 2791, 2793, 2794, 2798, 2800, 2801, 2802, 2805, 2808, 2812, 2814, 2816, 2818, 2819, 2821, 2822, 2823, 2824, 2827, 2828, 2831, 2832, 2837, 2838, 2840, 2844, 2850, 2860, 2865, 2866, 2869, 2870, 2871, 2876, 2878, 2886, 2888, 2889, 2890, 2892, 2893, 2894, 2895, 2897, 2901, 2902, 2903, 2908, 2909, 2911, 2914, 2915, 2916, 2917, 2918, 2922, 2923, 2926, 2929, 2930, 2931, 2935, 2938, 2941, 2942, 2943, 2944, 2946, 2948, 2951, 2955, 2959, 2962, 2963, 2965, 2966, 2968, 2976, 2979, 2982, 2987, 2992, 2994, 3003, 3005, 3006, 3007, 3009, 3013, 3014, 3015, 3017, 3018, 3020, 3023, 3024, 3026, 3029, 3031, 3033, 3039, 3042, 3044, 3045, 3047, 3048, 3049, 3051, 3053, 3055, 3058, 3059, 3061, 3064, 3068, 3070, 3072, 3080, 3083, 3084, 3085, 3090, 3097, 3100, 3101, 3106, 3107, 3115, 3118, 3119, 3120, 3121, 3123, 3127, 3128, 3129, 3137, 3138, 3139, 3143, 3145, 3148, 3153, 3164, 3167, 3169, 3170, 3171, 3172, 3177, 3179, 3181, 3189, 3191, 3192, 3194, 3204, 3205, 3206, 3208, 3210, 3217, 3219, 3220, 3221, 3224, 3225, 3228, 3230, 3231, 3232, 3240, 3242, 3246, 3247, 3249, 3250, 3252, 3253, 3254, 3261, 3263, 3266, 3267, 3268, 3269, 3272, 3280, 3283, 3286, 3288, 3289, 3290, 3291, 3294, 3295, 3297, 3299, 3301, 3310, 3312, 3313, 3324, 3325, 3327, 3331, 3332, 3333, 3337, 3338, 3340, 3342, 3343, 3345, 3351, 3353, 3354, 3355, 3357, 3359, 3360, 3368, 3370, 3371, 3376, 3378, 3379, 3380, 3382, 3383, 3386, 3394, 3396, 3399, 3402, 3403, 3405, 3413, 3415, 3416, 3418, 3424, 3425, 3426, 3427, 3428, 3429, 3432, 3441, 3442, 3446, 3447, 3449, 3450, 3452, 3453, 3457, 3458, 3459, 3466, 3468, 3471, 3473, 3474, 3477, 3482, 3483, 3484, 3486, 3488, 3493, 3497, 3498, 3500, 3501, 3502, 3503, 3504, 3507, 3510, 3516, 3517, 3518, 3523, 3524, 3533, 3536, 3537, 3538, 3540, 3541, 3542, 3544, 3545, 3549, 3554, 3558, 3560, 3561, 3562, 3569, 3571, 3574, 3576, 3580, 3585, 3587, 3588, 3591, 3592, 3594, 3603, 3604, 3606, 3607, 3611, 3612, 3613, 3616, 3618, 3620, 3622, 3624, 3625, 3629, 3633, 3634, 3636, 3640, 3642, 3643, 3644, 3645, 3646, 3648, 3659, 3660, 3661, 3664, 3665, 3667, 3674, 3676, 3677, 3682, 3684, 3685, 3690, 3702, 3704, 3706, 3707, 3709, 3710, 3713, 3715, 3717, 3718, 3719, 3721, 3722, 3723, 3725, 3726, 3729, 3730, 3731, 3733, 3744, 3752, 3756, 3761, 3764, 3766, 3771, 3772, 3773, 3775, 3778, 3791, 3792, 3793, 3794, 3796, 3801, 3804, 3806, 3808, 3817, 3818, 3819, 3820, 3823, 3829, 3830, 3831, 3832, 3833, 3834, 3837, 3838, 3839, 3843, 3844, 3845, 3846, 3847, 3849, 3852, 3858, 3859, 3860, 3867, 3868, 3870, 3872, 3873, 3875, 3881, 3884, 3885, 3887, 3889, 3890, 3892, 3894, 3895, 3896, 3902, 3903, 3904, 3907, 3908, 3912, 3917, 3918, 3923, 3924, 3926, 3928, 3929, 3931, 3933, 3937, 3938, 3940, 3941, 3947, 3950, 3954, 3955, 3958, 3962, 3964, 3967, 3968, 3969, 3970, 3971, 3975, 3987, 3988, 3994, 3995, 3996, 3998, 4001, 4003, 4007, 4008, 4013, 4014, 4021, 4030, 4033, 4039, 4040, 4041, 4042, 4043, 4046, 4047, 4048, 4049, 4050, 4051, 4052, 4054, 4056, 4057, 4062, 4066, 4068, 4070, 4079, 4081, 4084, 4087, 4088, 4092, 4094, 4096, 4099, 4102, 4105, 4106, 4109, 4110, 4113, 4126, 4128, 4132, 4133, 4134, 4139, 4140, 4143, 4144, 4146, 4148, 4149, 4150, 4151, 4154, 4155, 4160, 4161, 4162, 4163, 4164, 4165, 4166, 4167, 4168, 4171, 4178, 4181, 4183, 4185, 4187, 4188, 4189, 4191, 4193, 4194, 4195, 4198, 4201, 4202, 4204, 4205, 4206, 4207, 4210, 4211, 4212, 4213, 4216, 4217, 4218, 4219, 4221, 4227, 4228, 4232, 4233, 4237, 4245, 4246, 4251, 4252, 4255, 4257, 4258, 4261, 4263, 4266, 4270, 4272, 4275, 4276, 4278, 4281, 4282, 4284, 4290, 4292, 4296, 4298, 4301, 4302, 4303, 4305, 4309, 4312, 4314, 4317, 4320, 4321, 4324, 4326, 4329, 4330, 4335, 4336, 4337, 4339, 4344, 4347, 4355, 4357, 4358, 4359, 4360, 4369, 4374, 4378, 4380, 4383, 4390, 4391, 4396, 4397, 4401, 4402, 4403, 4405, 4409, 4410, 4415, 4422, 4423, 4426, 4430, 4432, 4436, 4437, 4439, 4442, 4443, 4446, 4448, 4450, 4453, 4458, 4461, 4462, 4463, 4466, 4467, 4468, 4470, 4474, 4475, 4477, 4479, 4484, 4486, 4492, 4494, 4498, 4500, 4502, 4507, 4508, 4512, 4514, 4515, 4519, 4521, 4522, 4524, 4525, 4529, 4531, 4535, 4541, 4543, 4548, 4549, 4554, 4556, 4557, 4558, 4560, 4561, 4562, 4563, 4565, 4566, 4567, 4568, 4575, 4576, 4578, 4579, 4580, 4582, 4583, 4590, 4591, 4597, 4598, 4601, 4606, 4608, 4612, 4613, 4616, 4618, 4623, 4625, 4628, 4632, 4634, 4635, 4638, 4639, 4641, 4643, 4644, 4646, 4647, 4650, 4651, 4656, 4657, 4658, 4659, 4662, 4664, 4667, 4669, 4671, 4673, 4674, 4676, 4677, 4679, 4680, 4682, 4685, 4691, 4692, 4693, 4696, 4697, 4699, 4700, 4703, 4706, 4710, 4711, 4713, 4715, 4716, 4719, 4721, 4722, 4723, 4724, 4728, 4730, 4734, 4739, 4741, 4745, 4749, 4752, 4753, 4755, 4756, 4758, 4760, 4761, 4762, 4764, 4765, 4767, 4769, 4770, 4771, 4773, 4775, 4776, 4778, 4779, 4780, 4784, 4787, 4788, 4789, 4790, 4791, 4795, 4796, 4801, 4803, 4804, 4805, 4806, 4807, 4813, 4815, 4818, 4822, 4827, 4828, 4830, 4831, 4834, 4836, 4840, 4841, 4845, 4854, 4856, 4857, 4861, 4862, 4863, 4866, 4869, 4874, 4875, 4878, 4880, 4881, 4887, 4891, 4893, 4896, 4897, 4900, 4904, 4907, 4909, 4910, 4914, 4918, 4920, 4921, 4924, 4926, 4930, 4931, 4935, 4936, 4937, 4938, 4941, 4943, 4944, 4954, 4955, 4956, 4967, 4969, 4971, 4972, 4974, 4975, 4983, 4985, 4988, 4996, 5007, 5011, 5013, 5015, 5016, 5021, 5026, 5027, 5029, 5030, 5034, 5036, 5038, 5039, 5040, 5042, 5044, 5045, 5046, 5049, 5051, 5052, 5054, 5057, 5060, 5065, 5067, 5068, 5069, 5072, 5078, 5082, 5087, 5088, 5089, 5091, 5094, 5100, 5101, 5102, 5106, 5109, 5110, 5113, 5114, 5116, 5119, 5120, 5125, 5132, 5140, 5143, 5145, 5147, 5149, 5151, 5153, 5159, 5160, 5164, 5165, 5166, 5168, 5169, 5170, 5171, 5172, 5174, 5180, 5181, 5182, 5185, 5187, 5188, 5189, 5190, 5191, 5192, 5193, 5195, 5196, 5198, 5200, 5202, 5203, 5206, 5209, 5212, 5213, 5216, 5217, 5218, 5219, 5224, 5225, 5234, 5237, 5238, 5241, 5244, 5245, 5248, 5251, 5253, 5254, 5255, 5256, 5257, 5258, 5260, 5261, 5262, 5263, 5264, 5266, 5268, 5269, 5275, 5276, 5280, 5281, 5282, 5283, 5286, 5289, 5292, 5293, 5294, 5297, 5298, 5299, 5300, 5301, 5308, 5311, 5313, 5315, 5317, 5319, 5321, 5324, 5329, 5330, 5331, 5334, 5339, 5342, 5345, 5346, 5348, 5349, 5351, 5352, 5366, 5367, 5369, 5383, 5386, 5388, 5389, 5393, 5398, 5404, 5405, 5413, 5414, 5418, 5422, 5427, 5431, 5434, 5437, 5438, 5446, 5447, 5450, 5452, 5453, 5456, 5458, 5459, 5461, 5462, 5467, 5475, 5476, 5483, 5484, 5488, 5491, 5493, 5495, 5496, 5498, 5505, 5508, 5510, 5512, 5513, 5515, 5517, 5518, 5519, 5524, 5530, 5531, 5532, 5533, 5535, 5539, 5543, 5545, 5547, 5554, 5558, 5563, 5564, 5566, 5568, 5569, 5572, 5575, 5579, 5581, 5582, 5584, 5589, 5591, 5593, 5594, 5597, 5599, 5602, 5610, 5611, 5613, 5614, 5615, 5616, 5620, 5622, 5623, 5627, 5633, 5635, 5638, 5640, 5642, 5643, 5646, 5647, 5648, 5649, 5650, 5651, 5654, 5655, 5656, 5657, 5659, 5660, 5663, 5664, 5667, 5669, 5680, 5681, 5689, 5690, 5691, 5694, 5695, 5696, 5697, 5702, 5706, 5709, 5711, 5712, 5713, 5714, 5717, 5718, 5719, 5720, 5721, 5722, 5723, 5729, 5730, 5731, 5734, 5735, 5736, 5737, 5742, 5744, 5748, 5751, 5764, 5768, 5770, 5771, 5775, 5778, 5782, 5783, 5785, 5786, 5787, 5788, 5791, 5792, 5794, 5807, 5808, 5810, 5811, 5817, 5820, 5823, 5826, 5828, 5832, 5833, 5834, 5835, 5836, 5837, 5839, 5842, 5844, 5846, 5853, 5859, 5864, 5866, 5867, 5868, 5869, 5871, 5872, 5878, 5879, 5881, 5882, 5883, 5884, 5887, 5888, 5889, 5892, 5893, 5900, 5901, 5902, 5906, 5907, 5910, 5912, 5913, 5914, 5919, 5921, 5925, 5926, 5927, 5928, 5931, 5932, 5938, 5941, 5944, 5945, 5950, 5951, 5952, 5954, 5956, 5957, 5959, 5961, 5967, 5968, 5971, 5978, 5980, 5985, 5986, 5988, 5990, 5991, 5992, 5994, 5996, 5999, 6000, 6002, 6004, 6005, 6006, 6007, 6012, 6013, 6016, 6019, 6025, 6026, 6038, 6040, 6041, 6043, 6044, 6045, 6047, 6048, 6051, 6053, 6058, 6059, 6060, 6061, 6062, 6063, 6068, 6069, 6070, 6072, 6073, 6074, 6075, 6077, 6080, 6088, 6089, 6093, 6094, 6095, 6098, 6107, 6108, 6109, 6110, 6112, 6113, 6116, 6119, 6122, 6125, 6129, 6130, 6132, 6137, 6138, 6145, 6146, 6147, 6151, 6152, 6153, 6163, 6164, 6165, 6168, 6173, 6176, 6178, 6182, 6186, 6189, 6190, 6191, 6193, 6196, 6197, 6198, 6200, 6203, 6204, 6205, 6207, 6209, 6212, 6213, 6220, 6221, 6223, 6224, 6227, 6228, 6230, 6231, 6238, 6241, 6243, 6246, 6247, 6249, 6251, 6255, 6257, 6258, 6259, 6264, 6265, 6269, 6271, 6272, 6273, 6278, 6279, 6282, 6286, 6287, 6288, 6289, 6294, 6296, 6299, 6300, 6302, 6309, 6310, 6311, 6312, 6314, 6315, 6317, 6319, 6321, 6322, 6325, 6326, 6328, 6333, 6334, 6338, 6345, 6350, 6351, 6352, 6353, 6354, 6358, 6359, 6360, 6362, 6363, 6364, 6366, 6367, 6370, 6372, 6375, 6378, 6381, 6394, 6397, 6398, 6399, 6403, 6405, 6407, 6412, 6414, 6415, 6419, 6420, 6421, 6422, 6429, 6430, 6431, 6434, 6435, 6436, 6437, 6440, 6442, 6454, 6456, 6458, 6459, 6463, 6464, 6466, 6467, 6468, 6469, 6470, 6471, 6474, 6476, 6480, 6482, 6486, 6488, 6493, 6495, 6501, 6502, 6504, 6505, 6506, 6513, 6514, 6516, 6517, 6519, 6524, 6530, 6533, 6534, 6537, 6539, 6543, 6544, 6545, 6547, 6548, 6549, 6554, 6556, 6557, 6558, 6560, 6561, 6563, 6567, 6572, 6574, 6576, 6577, 6579, 6581, 6582, 6584, 6587, 6589, 6594, 6595, 6597, 6598, 6599, 6603, 6607, 6609, 6610, 6611, 6621, 6624, 6626, 6627, 6628, 6630, 6634, 6635, 6637, 6638, 6639, 6643, 6646, 6647, 6649, 6655, 6656, 6660, 6662, 6666, 6671, 6672, 6677, 6678, 6679, 6681, 6691, 6692, 6695, 6696, 6699, 6703, 6705, 6706, 6711, 6714, 6716, 6718, 6720, 6724, 6733, 6734, 6737, 6739, 6740, 6741, 6746, 6747, 6757, 6758, 6759, 6760, 6761, 6766, 6767, 6776, 6778, 6779, 6780, 6781, 6783, 6786, 6788, 6793, 6794, 6799, 6803, 6804, 6805, 6807, 6810, 6811, 6812, 6813, 6816, 6819, 6820, 6821, 6824, 6827, 6828, 6829, 6830, 6834, 6836, 6837, 6840, 6841, 6842, 6843, 6845, 6852, 6855, 6859, 6864, 6865, 6869, 6872, 6874, 6875, 6876, 6878, 6879, 6880, 6882, 6883, 6885, 6886, 6888, 6897, 6903, 6904, 6909, 6914, 6915, 6917, 6919, 6920, 6921, 6922, 6923, 6924, 6930, 6933, 6936, 6944, 6946, 6948, 6950, 6952, 6959, 6960, 6967, 6969, 6972, 6979, 6980, 6984, 6985, 6987, 6990, 6993, 6994, 6999, 7003, 7006, 7009, 7012, 7013, 7019, 7020, 7022, 7033, 7035, 7038, 7043, 7048, 7051, 7052, 7053, 7056, 7057, 7060, 7062, 7064, 7067, 7069, 7072, 7073, 7074, 7075, 7077, 7083, 7085, 7086, 7097, 7105, 7106, 7107, 7108, 7109, 7113, 7116, 7117, 7118, 7124, 7126, 7129, 7130, 7132, 7135, 7137, 7140, 7142, 7144, 7146, 7154, 7155, 7164, 7167, 7169, 7172, 7176, 7177, 7182, 7183, 7184, 7187, 7188, 7192, 7194, 7201, 7202, 7203, 7206, 7207, 7209, 7212, 7216, 7217, 7219, 7226, 7227, 7228, 7231, 7232, 7233, 7234, 7235, 7236, 7239, 7243, 7244, 7245, 7248, 7249, 7250, 7254, 7255, 7257, 7258, 7259, 7262, 7267, 7268, 7269, 7276, 7277, 7278, 7282, 7284, 7286, 7288, 7290, 7291, 7292, 7293, 7299, 7300, 7301, 7306, 7307, 7310, 7312, 7313, 7315, 7317, 7328, 7330, 7340, 7344, 7345, 7354, 7355, 7356, 7357, 7358, 7360, 7363, 7365, 7371, 7373, 7379, 7380, 7383, 7388, 7389, 7392, 7395, 7396, 7398, 7399, 7400, 7409, 7411, 7415, 7418, 7425, 7428, 7430, 7433, 7434, 7435, 7436, 7441, 7443, 7444, 7445, 7447, 7454, 7458, 7459, 7464, 7466, 7470, 7472, 7474, 7476, 7483, 7486, 7487, 7490, 7492, 7493, 7504, 7505, 7506, 7508, 7512, 7515, 7517, 7523, 7525, 7528, 7533, 7534, 7537, 7538, 7546, 7547, 7548, 7554, 7557, 7561, 7570, 7572, 7574, 7577, 7578, 7585, 7586, 7591, 7595, 7596, 7598, 7600, 7605, 7615, 7619, 7620, 7621, 7623, 7624, 7633, 7634, 7639, 7640, 7642, 7643, 7649, 7652, 7653, 7661, 7663, 7664, 7665, 7666, 7667, 7674, 7677, 7678, 7679, 7680, 7682, 7685, 7686, 7687, 7689, 7694, 7695, 7703, 7704, 7708, 7712, 7713, 7718, 7719, 7724, 7725, 7727, 7729, 7733, 7736, 7737, 7738, 7739, 7740, 7744, 7745, 7751, 7760, 7761, 7762, 7763, 7764, 7767, 7768, 7769, 7774, 7775, 7777, 7778, 7779, 7781, 7782, 7783, 7785, 7786, 7788, 7791, 7798, 7803, 7804, 7807, 7811, 7812, 7815, 7820, 7825, 7832, 7833, 7834, 7836, 7838, 7841, 7845, 7846, 7847, 7848, 7849, 7850, 7856, 7859, 7860, 7862, 7863, 7865, 7870, 7873, 7876, 7878, 7890, 7895, 7896, 7900, 7908, 7909, 7910, 7911, 7916, 7918, 7921, 7922, 7923, 7925, 7927, 7929, 7934, 7935, 7936, 7937, 7938, 7942, 7944, 7945, 7947, 7948, 7950, 7955, 7956, 7960, 7962, 7964, 7965, 7966, 7967, 7972, 7974, 7976, 7977, 7978, 7979, 7980, 7981, 7983, 7984, 7988, 7989, 7990, 7991, 7998, 8001, 8002, 8006, 8007, 8008, 8012, 8021, 8026, 8029, 8030, 8038, 8040, 8042, 8044, 8047, 8048, 8052, 8053, 8056, 8058, 8059, 8061, 8063, 8065, 8068, 8072, 8073, 8075, 8077, 8078, 8080, 8084, 8088, 8091, 8093, 8095, 8099, 8100, 8103, 8112, 8118, 8121, 8126, 8129, 8133, 8134, 8136, 8137, 8148, 8150, 8151, 8159, 8162, 8163, 8164, 8165, 8170, 8176, 8178, 8181, 8189, 8193, 8195, 8199, 8202, 8204, 8207, 8208, 8211, 8213, 8216, 8217, 8219, 8220, 8225, 8227, 8231, 8234, 8235, 8239, 8240, 8245, 8246, 8250, 8252, 8253, 8266, 8268, 8269, 8270, 8272, 8274, 8282, 8289, 8292, 8293, 8294, 8300, 8301, 8304, 8310, 8311, 8312, 8313, 8318, 8319, 8320, 8321, 8323, 8329, 8330, 8336, 8339, 8340, 8349, 8350, 8351, 8352, 8353, 8361, 8363, 8367, 8368, 8369, 8373, 8376, 8379, 8382, 8385, 8387, 8389, 8390, 8392, 8393, 8398, 8401, 8402, 8403, 8404, 8405, 8407, 8409, 8410, 8413, 8414, 8416, 8423, 8433, 8435, 8436, 8438, 8439, 8441, 8442, 8444, 8446, 8448, 8452, 8456, 8457, 8458, 8459, 8463, 8466, 8470, 8472, 8473, 8474, 8476, 8481, 8482, 8486, 8490, 8493, 8498, 8499, 8501, 8503, 8505, 8509, 8511, 8513, 8515, 8524, 8527, 8528, 8531, 8532, 8533, 8535, 8537, 8538, 8539, 8543, 8549, 8550, 8551, 8552, 8553, 8554, 8561, 8565, 8568, 8575, 8576, 8579, 8581, 8582, 8589, 8590, 8593, 8594, 8596, 8597, 8600, 8601, 8602, 8603, 8605, 8607, 8610, 8611, 8612, 8613, 8614, 8617, 8618, 8621, 8624, 8625, 8631, 8634, 8635, 8638, 8640, 8642, 8644, 8648, 8650, 8654, 8657, 8665, 8669, 8670, 8671, 8675, 8685, 8693, 8694, 8695, 8700, 8704, 8706, 8708, 8709, 8713, 8716, 8717, 8720, 8721, 8726, 8729, 8732, 8734, 8735, 8736, 8740, 8741, 8742, 8743, 8746, 8748, 8752, 8761, 8764, 8765, 8766, 8767, 8772, 8773, 8776, 8777, 8779, 8782, 8783, 8784, 8789, 8792, 8797, 8803, 8805, 8810, 8822, 8824, 8830, 8831, 8832, 8833, 8834, 8835, 8838, 8839, 8843, 8846, 8853, 8859, 8861, 8865, 8867, 8877, 8878, 8880, 8881, 8883, 8884, 8886, 8888, 8890, 8891, 8892, 8897, 8899, 8900, 8902, 8905, 8907, 8909, 8910, 8911, 8913, 8914, 8917, 8919, 8923, 8924, 8926, 8928, 8929, 8930, 8933, 8934, 8935, 8938, 8941, 8942, 8943, 8945, 8946, 8949, 8951, 8954, 8956, 8957, 8959, 8960, 8962, 8967, 8968, 8969, 8972, 8974, 8976, 8977, 8979, 8980, 8981, 8985, 8986, 8992, 8996, 8998, 8999, 9002, 9003, 9006, 9009, 9012, 9015, 9018, 9020, 9021, 9023, 9029, 9030, 9033, 9037, 9044, 9052, 9056, 9058, 9059, 9060, 9066, 9069, 9071, 9072, 9073, 9074, 9076, 9080, 9084, 9088, 9092, 9095, 9096, 9109, 9110, 9111, 9112, 9114, 9115, 9116, 9118, 9119, 9120, 9123, 9125, 9128, 9129, 9133, 9134, 9139, 9140, 9141, 9142, 9149, 9151, 9152, 9157, 9159, 9167, 9168, 9172, 9173, 9174, 9177, 9179, 9183, 9185, 9187, 9188, 9190, 9195, 9196, 9206, 9207, 9210, 9211, 9213, 9214, 9215, 9216, 9223, 9226, 9229, 9231, 9233, 9237, 9241, 9243, 9247, 9248, 9249, 9255, 9257, 9263, 9265, 9267, 9270, 9273, 9276, 9278, 9282, 9284, 9285, 9287, 9288, 9290, 9292, 9293, 9299, 9302, 9304, 9308, 9311, 9314, 9320, 9323, 9325, 9326, 9327, 9328, 9329, 9330, 9336, 9337, 9338, 9339, 9340, 9341, 9346, 9347, 9348, 9355, 9366, 9367, 9369, 9373, 9375, 9376, 9377, 9382, 9383, 9387, 9388, 9391, 9393, 9394, 9395, 9396, 9398, 9400, 9402, 9403, 9404, 9406, 9407, 9413, 9415, 9423, 9432, 9433, 9434, 9442, 9444, 9449, 9451, 9452, 9456, 9459, 9460, 9466, 9468, 9470, 9471, 9472, 9473, 9475, 9478, 9482, 9483, 9488, 9490, 9494, 9495, 9497, 9500, 9501, 9502, 9503, 9504, 9509, 9514, 9515, 9517, 9518, 9519, 9522, 9525, 9531, 9533, 9534, 9536, 9540, 9545, 9546, 9548, 9549, 9553, 9554, 9555, 9559, 9561, 9563, 9565, 9568, 9571, 9573, 9577, 9579, 9582, 9586, 9587, 9589, 9590, 9591, 9602, 9606, 9608, 9609, 9613, 9614, 9618, 9620, 9624, 9626, 9627, 9628, 9629, 9630, 9633, 9635, 9640, 9641, 9642, 9644, 9645, 9646, 9648, 9649, 9650, 9653, 9655, 9656, 9657, 9658, 9659, 9660, 9666, 9668, 9674, 9675, 9681, 9682, 9686, 9692, 9698, 9706, 9710, 9711, 9715, 9716, 9718, 9722, 9723, 9724, 9726, 9730, 9731, 9734, 9737, 9742, 9743, 9746, 9750, 9753, 9754, 9755, 9756, 9763, 9764, 9767, 9768, 9770, 9776, 9778, 9780, 9782, 9784, 9786, 9793, 9794, 9796, 9798, 9799, 9801, 9808, 9809, 9810, 9812, 9813, 9814, 9816, 9817, 9824, 9825, 9827, 9829, 9833, 9845, 9847, 9849, 9850, 9851, 9853, 9854, 9861, 9864, 9866, 9869, 9873, 9882, 9886, 9887, 9892, 9894, 9897, 9900, 9901, 9906, 9907, 9908, 9909, 9910, 9928, 9935, 9936, 9938, 9940, 9946, 9947, 9949, 9950, 9957, 9960, 9962, 9963, 9967, 9971, 9974, 9979, 9980, 9982, 9984, 9985, 9988, 9990, 9996, 9997, 9998, 10000, 10008, 10009, 10010, 10013, 10017, 10018, 10019, 10021, 10022, 10026, 10031, 10035, 10037, 10038, 10041, 10042, 10043, 10045, 10048, 10051, 10052, 10054, 10056, 10058, 10060, 10062, 10063, 10064, 10072, 10077, 10078, 10083, 10086, 10089, 10091, 10092, 10093, 10094, 10095, 10097, 10101, 10102, 10103, 10105, 10106, 10107, 10108, 10109, 10110, 10114, 10115, 10116, 10117, 10118, 10119, 10122, 10127, 10128, 10132, 10135, 10136, 10138, 10141, 10143, 10146, 10149, 10151, 10152, 10158, 10160, 10163, 10165, 10166, 10168, 10170, 10174, 10176, 10178, 10181, 10182, 10184, 10191, 10192, 10193, 10194, 10195, 10197, 10199, 10203, 10206, 10209, 10214, 10218, 10219, 10220, 10222, 10223, 10228, 10231, 10233, 10234, 10236, 10237, 10238, 10240, 10242, 10246, 10247, 10252, 10255, 10258, 10275, 10278, 10284, 10286, 10291, 10292, 10293, 10295, 10300, 10302, 10306, 10307, 10321, 10323, 10325, 10326, 10328, 10330, 10331, 10333, 10334, 10335, 10343, 10346, 10353, 10356, 10357, 10359, 10360, 10362, 10364, 10365, 10368, 10373, 10375, 10377, 10380, 10384, 10385, 10388, 10389, 10397, 10398, 10399, 10400, 10401, 10405, 10408, 10410, 10413, 10414, 10416, 10421, 10422, 10423, 10425, 10426, 10427, 10428, 10430, 10435, 10437, 10438, 10446, 10448, 10450, 10451, 10452, 10453, 10455, 10463, 10464, 10465, 10468, 10469, 10474, 10478, 10480, 10490, 10494, 10496, 10497, 10498, 10504, 10506, 10513, 10514, 10515, 10518, 10521, 10523, 10524, 10525, 10527, 10528, 10533, 10535, 10536, 10537, 10541, 10542, 10543, 10544, 10547, 10548, 10549, 10550, 10551, 10555, 10556, 10558, 10560, 10561, 10562, 10565, 10571, 10577, 10580, 10581, 10582, 10583, 10585, 10587, 10589, 10593, 10596, 10597, 10599, 10601, 10602, 10610, 10611, 10613, 10615, 10616, 10617, 10618, 10619, 10621, 10622, 10623, 10626, 10628, 10634, 10637, 10638, 10639, 10640, 10641, 10642, 10645, 10646, 10649, 10650, 10655, 10657, 10663, 10665, 10668, 10673, 10674, 10677, 10678, 10681, 10682, 10683, 10684, 10685, 10687, 10697, 10698, 10699, 10700, 10703, 10705, 10707, 10708, 10709, 10712, 10715, 10716, 10720, 10723, 10725, 10726, 10727, 10730, 10732, 10734, 10735, 10740, 10744, 10747, 10748, 10749, 10752, 10753, 10756, 10761, 10762, 10763, 10768, 10770, 10776, 10779, 10784, 10787, 10788, 10790, 10791, 10795, 10796, 10798, 10800, 10801, 10802, 10803, 10804, 10805, 10809, 10810, 10811, 10813, 10818, 10819, 10820, 10821, 10822, 10823, 10824, 10825, 10826, 10829, 10830, 10831, 10832, 10833, 10836, 10838, 10839, 10840, 10843, 10845, 10850, 10853, 10858, 10860, 10862, 10867, 10872, 10874, 10877, 10880, 10881, 10892, 10896, 10897, 10898, 10902, 10903, 10905, 10912, 10917, 10920, 10926, 10927, 10930, 10933, 10934, 10935, 10936, 10937, 10938, 10940, 10941, 10942, 10947, 10948, 10950, 10954, 10957, 10960, 10962, 10964, 10967, 10972, 10975, 10976, 10977, 10978, 10980, 10981, 10985, 10988, 10993, 10995, 10996, 10997, 10998, 10999, 11002, 11004, 11005, 11006, 11008, 11010, 11015, 11016, 11018, 11023, 11024, 11026, 11027, 11032, 11036, 11037, 11039, 11046, 11047, 11049, 11053, 11058, 11060, 11066, 11070, 11071, 11072, 11078, 11079, 11080, 11082, 11083, 11086, 11090, 11095, 11098, 11102, 11103, 11105, 11107, 11108, 11110, 11114, 11116, 11117, 11118, 11119, 11121, 11123, 11124, 11125, 11126, 11127, 11128, 11129, 11132, 11134, 11135, 11137, 11138, 11141, 11145, 11146, 11148, 11153, 11154, 11158, 11159, 11160, 11161, 11162, 11163, 11164, 11166, 11175, 11177, 11178, 11179, 11180, 11184, 11185, 11187, 11188, 11191, 11198, 11199, 11201, 11202, 11203, 11204, 11206, 11207, 11214, 11217, 11218, 11222, 11226, 11227, 11228, 11232, 11233, 11235, 11236, 11237, 11239, 11242, 11246, 11247, 11248, 11254, 11255, 11256, 11257, 11258, 11259, 11260, 11262, 11263, 11264, 11266, 11274, 11275, 11278, 11282, 11286, 11288, 11289, 11290, 11292, 11293, 11294, 11295, 11306, 11307, 11308, 11313, 11315, 11316, 11317, 11318, 11320, 11322, 11326, 11330, 11331, 11339, 11340, 11345, 11346, 11348, 11349, 11352, 11355, 11356, 11358, 11363, 11365, 11369, 11370, 11371, 11373, 11374, 11377, 11379, 11380, 11381, 11382, 11388, 11389, 11391, 11392, 11394, 11395, 11397, 11402, 11403, 11405, 11406, 11408, 11409, 11411, 11412, 11413, 11414, 11416, 11418, 11423, 11428, 11431, 11437, 11438, 11442, 11443, 11449, 11459, 11463, 11465, 11468, 11471, 11472, 11473, 11475, 11476, 11478, 11479, 11481, 11482, 11483, 11484, 11485, 11487, 11490, 11491, 11496, 11497, 11498, 11501, 11505, 11506, 11507, 11508, 11509, 11512, 11516, 11518, 11520, 11521, 11523, 11524, 11526, 11528, 11530, 11533, 11538, 11540, 11541, 11544, 11545, 11546, 11547, 11548, 11551, 11553, 11558, 11560, 11561, 11563, 11567, 11568, 11574, 11576, 11577, 11578, 11579, 11580, 11585, 11593, 11594, 11595, 11596, 11597, 11598, 11599, 11604, 11610, 11615, 11618, 11620, 11621, 11623, 11628, 11629, 11632, 11633, 11639, 11642, 11649, 11650, 11651, 11652, 11654, 11655, 11656, 11657, 11658, 11667, 11669, 11673, 11678, 11681, 11682, 11683, 11684, 11688, 11691, 11692, 11693, 11694, 11695, 11699, 11701, 11703, 11705, 11707, 11711, 11712, 11720, 11721, 11725, 11726, 11731, 11732, 11733, 11736, 11740, 11743, 11744, 11753, 11755, 11756, 11759, 11760, 11761, 11762, 11763, 11764, 11766, 11767, 11770, 11771, 11774, 11776, 11782, 11783, 11785, 11786, 11789, 11790, 11792, 11799, 11800, 11809, 11811, 11812, 11813, 11814, 11816, 11818, 11819, 11820, 11821, 11823, 11825, 11826, 11828, 11829, 11830, 11831, 11832, 11837, 11841, 11846, 11848, 11849, 11851, 11853, 11856, 11857, 11858, 11863, 11868, 11869, 11870, 11872, 11876, 11877, 11879, 11886, 11890, 11891, 11898, 11899, 11903, 11908, 11909, 11913, 11915, 11919, 11920, 11921, 11923, 11926, 11928, 11929, 11930, 11934, 11935, 11940, 11941, 11943, 11946, 11947, 11948, 11949, 11952, 11953, 11955, 11957, 11959, 11960, 11961, 11962, 11963, 11965, 11968, 11977, 11980, 11983, 11987, 11988, 11993, 11997, 11998, 11999, 12004, 12005, 12006, 12008, 12014, 12019, 12020, 12021, 12023, 12024, 12025, 12029, 12032, 12042, 12043, 12044, 12047, 12050, 12054, 12059, 12060, 12061, 12066, 12068, 12077, 12078, 12079, 12080, 12081, 12083, 12091, 12093, 12094, 12097, 12098, 12104, 12106, 12109, 12112, 12115, 12118, 12120, 12122, 12128, 12129, 12131, 12134, 12135, 12136, 12138, 12144, 12145, 12146, 12147, 12148, 12151, 12155, 12161, 12162, 12163, 12165, 12166, 12167, 12170, 12171, 12174, 12175, 12179, 12181, 12186, 12187, 12189, 12197, 12200, 12201, 12202, 12204, 12208, 12212, 12214, 12215, 12217, 12220, 12223, 12228, 12229, 12233, 12234, 12238, 12240, 12241, 12245, 12249, 12250, 12252, 12254, 12255, 12259, 12265, 12271, 12278, 12280, 12283, 12285, 12286, 12287, 12291, 12293, 12295, 12296, 12299, 12304, 12306, 12310, 12311, 12313, 12314, 12315, 12317, 12319, 12321, 12323, 12325, 12331, 12334, 12335, 12337, 12339, 12342, 12343, 12345, 12347, 12350, 12354, 12356, 12358, 12359, 12366, 12369, 12370, 12373, 12375, 12376, 12379, 12380, 12381, 12385, 12390, 12393, 12397, 12400, 12401, 12403, 12406, 12407, 12409, 12411, 12414, 12415, 12416, 12419, 12420, 12423, 12424, 12425, 12426, 12427, 12437, 12439, 12440, 12441, 12444, 12445, 12446, 12447, 12450, 12451, 12454, 12456, 12457, 12459, 12465, 12467, 12468, 12472, 12473, 12475, 12478, 12479, 12480, 12481, 12487, 12488, 12490, 12492, 12494, 12497, 12499, 12501, 12502, 12503, 12510, 12511, 12512, 12513, 12514, 12515, 12518, 12527, 12529, 12530, 12531, 12535, 12536, 12537, 12538, 12539, 12546, 12547, 12551, 12552, 12554, 12556, 12563, 12565, 12568, 12570, 12572, 12577, 12578, 12583, 12585, 12586, 12588, 12589, 12591, 12600, 12603, 12608, 12609, 12610, 12611, 12616, 12620, 12622, 12623, 12624, 12626, 12628, 12629, 12634, 12637, 12639, 12640, 12641, 12648, 12649, 12651, 12658, 12663, 12664, 12668, 12670, 12674, 12675, 12677, 12683, 12684, 12685, 12688, 12693, 12695, 12696, 12699, 12701, 12702, 12705, 12706, 12707, 12708, 12710, 12714, 12716, 12723, 12729, 12731, 12732, 12733, 12735, 12739, 12740, 12741, 12742, 12752, 12753, 12754, 12755, 12756, 12758, 12760, 12764, 12765, 12766, 12771, 12772, 12773, 12775, 12777, 12782, 12790, 12791, 12793, 12797, 12799, 12800, 12801, 12802, 12804, 12807, 12810, 12812, 12813, 12817, 12818, 12819, 12820, 12822, 12823, 12824, 12826, 12827, 12828, 12835, 12837, 12838, 12839, 12843, 12848, 12849, 12850, 12853, 12858, 12860, 12861, 12866, 12870, 12873, 12878, 12882, 12884, 12885, 12887, 12891, 12898, 12900, 12901, 12903, 12904, 12905, 12908, 12912, 12913, 12916, 12921, 12928, 12929, 12932, 12933, 12935, 12939, 12945, 12946, 12947, 12950, 12952, 12956, 12957, 12958, 12959, 12960, 12961, 12963, 12968, 12969, 12978, 12983, 12984, 12986, 12987, 12988, 12990, 12991, 12999, 13000, 13001, 13003, 13004, 13007, 13010, 13012, 13014, 13015, 13017, 13018, 13022, 13027, 13030, 13031, 13033, 13034, 13035, 13040, 13041, 13047, 13050, 13053, 13054, 13055, 13056, 13060, 13061, 13062, 13064, 13066, 13071, 13075, 13079, 13083, 13085, 13086, 13087, 13102, 13105, 13106, 13110, 13111, 13112, 13115, 13117, 13118, 13122, 13123, 13124, 13125, 13127, 13128, 13131, 13134, 13136, 13143, 13147, 13148, 13149, 13151, 13153, 13160, 13164, 13169, 13170, 13175, 13177, 13181, 13182, 13185, 13186, 13187, 13189, 13193, 13197, 13198, 13199, 13206, 13209, 13213, 13217, 13221, 13226, 13227, 13228, 13232, 13234, 13235, 13236, 13237, 13239, 13241, 13243, 13248, 13250, 13255, 13258, 13259, 13260, 13261, 13262, 13263, 13264, 13265, 13268, 13271, 13274, 13281, 13283, 13284, 13297, 13298, 13300, 13301, 13303, 13304, 13313, 13315, 13317, 13326, 13329, 13332, 13340, 13343, 13345, 13346, 13347, 13348, 13352, 13358, 13361, 13363, 13367, 13368, 13369, 13370, 13374, 13377, 13379, 13380, 13381, 13386, 13388, 13391, 13393, 13394, 13395, 13396, 13397, 13403, 13407, 13408, 13410, 13413, 13416, 13417, 13418, 13419, 13420, 13423, 13429, 13430, 13433, 13434, 13439, 13441, 13444, 13446, 13448, 13454, 13456, 13463, 13467, 13469, 13473, 13475, 13477, 13478, 13479, 13480, 13489, 13491, 13492, 13494, 13496, 13497, 13499, 13503, 13513, 13514, 13515, 13518, 13519, 13521, 13522, 13524, 13526, 13530, 13533, 13539, 13540, 13543, 13544, 13546, 13547, 13549, 13552, 13553, 13555, 13556, 13558, 13559, 13561, 13568, 13569, 13574, 13579, 13580, 13584, 13587, 13597, 13598, 13599, 13600, 13601, 13602, 13604, 13605, 13606, 13612, 13613, 13616, 13620, 13621, 13623, 13627, 13628, 13630, 13631, 13632, 13634, 13636, 13637, 13638, 13641, 13647, 13650, 13653, 13654, 13660, 13662, 13663, 13665, 13668, 13677, 13678, 13679, 13683, 13688, 13689, 13693, 13696, 13698, 13699, 13700, 13706, 13714, 13715, 13716, 13719, 13720, 13729, 13730, 13734, 13736, 13737, 13739, 13742, 13745, 13747, 13749, 13750, 13753, 13755, 13756, 13763, 13764, 13765, 13766, 13767, 13768, 13769, 13772, 13773, 13775, 13777, 13779, 13782, 13783, 13785, 13786, 13787, 13788, 13791, 13793, 13796, 13798, 13801, 13809, 13816, 13817, 13818, 13819, 13820, 13822, 13823, 13828, 13830, 13834, 13835, 13839, 13843, 13849, 13852, 13858, 13860, 13862, 13866, 13869, 13870, 13872, 13873, 13877, 13887, 13891, 13892, 13895, 13898, 13899, 13901, 13906, 13909, 13910, 13911, 13915, 13917, 13919, 13920, 13923, 13924, 13932, 13934, 13944, 13947, 13948, 13949, 13950, 13952, 13954, 13958, 13960, 13961, 13962, 13963, 13969, 13970, 13974, 13976, 13984, 13991, 14000, 14001, 14005, 14006, 14008, 14013, 14014, 14017, 14018, 14022, 14027, 14030, 14031, 14036, 14037, 14038, 14040, 14049, 14054, 14059, 14060, 14062, 14063, 14066, 14067, 14069, 14070, 14071, 14073, 14075, 14078, 14079, 14080, 14081, 14085, 14086, 14088, 14092, 14094, 14095, 14102, 14104, 14112, 14116, 14117, 14118, 14119, 14121, 14122, 14124, 14125, 14129, 14130, 14132, 14133, 14137, 14138, 14139, 14140, 14145, 14146, 14147.

Promoters expressing in the internode tissue (below the flag leaf) at the tasseling stage at 2-3 days prior to silk emergence include SEQ IDs: 1, 3, 7, 8, 11, 12, 13, 14, 15, 16, 17, 19, 20, 24, 27, 29, 31, 32, 33, 34, 36, 37, 48, 51, 54, 57, 63, 64, 65, 79, 80, 88, 90, 93, 94, 96, 98, 99, 100, 102, 103, 104, 108, 110, 111, 112, 117, 123, 130, 131, 136, 141, 143, 148, 152, 155, 156, 157, 159, 160, 162, 165, 168, 172, 174, 175, 176, 179, 180, 182, 183, 187, 191, 193, 194, 196, 199, 202, 203, 205, 207, 211, 212, 214, 217, 223, 230, 232, 233, 235, 236, 237, 239, 240, 242, 244, 246, 249, 250, 251, 257, 259, 264, 267, 269, 270, 271, 273, 280, 281, 285, 286, 288, 289, 293, 294, 298, 299, 301, 302, 305, 306, 307, 308, 309, 314, 316, 319, 320, 322, 323, 328, 329, 332, 334, 335, 338, 346, 348, 349, 352, 353, 354, 356, 357, 358, 360, 364, 365, 371, 372, 373, 376, 379, 381, 382, 383, 388, 393, 396, 401, 405, 406, 407, 411, 412, 414, 423, 424, 428, 432, 433, 434, 436, 441, 448, 450, 452, 456, 459, 461, 463, 466, 470, 471, 474, 478, 483, 485, 488, 489, 492, 496, 501, 504, 507, 509, 510, 511, 514, 515, 516, 517, 522, 523, 525, 528, 532, 537, 538, 541, 543, 544, 546, 547, 548, 554, 557, 561, 563, 578, 580, 585, 591, 594, 595, 596, 599, 601, 602, 605, 606, 608, 613, 614, 619, 620, 630, 631, 633, 634, 635, 636, 637, 638, 643, 647, 650, 656, 659, 661, 662, 663, 664, 666, 667, 668, 669, 671, 681, 683, 687, 693, 694, 695, 701, 705, 706, 707, 708, 709, 716, 717, 718, 719, 721, 722, 723, 724, 727, 731, 732, 734, 735, 736, 739, 740, 741, 742, 744, 749, 752, 753, 757, 759, 760, 761, 762, 763, 764, 765, 770, 779, 781, 783, 784, 786, 792, 793, 798, 800, 804, 806, 808, 809, 811, 812, 819, 820, 821, 824, 825, 826, 829, 830, 833, 840, 846, 849, 855, 856, 857, 858, 859, 860, 862, 863, 865, 868, 870, 871, 875, 876, 877, 878, 887, 890, 891, 892, 893, 895, 897, 898, 899, 900, 903, 907, 908, 910, 911, 912, 913, 915, 916, 917, 919, 920, 924, 925, 928, 932, 934, 936, 939, 943, 944, 947, 951, 953, 955, 957, 958, 960, 964, 971, 974, 975, 976, 977, 978, 979, 980, 982, 983, 984, 987, 988, 991, 994, 995, 996, 997, 999, 1002, 1005, 1007, 1008, 1009, 1010, 1011, 1012, 1013, 1014, 1016, 1017, 1026, 1032, 1033, 1035, 1038, 1039, 1040, 1041, 1042, 1043, 1045, 1046, 1047, 1049, 1051, 1052, 1055, 1056, 1057, 1065, 1068, 1069, 1070, 1073, 1077, 1078, 1085, 1086, 1087, 1088, 1089, 1092, 1095, 1100, 1101, 1103, 1104, 1106, 1112, 1114, 1115, 1116, 1117, 1119, 1121, 1125, 1126, 1130, 1132, 1136, 1137, 1140, 1143, 1144, 1146, 1148, 1154, 1155, 1160, 1161, 1162, 1165, 1167, 1168, 1170, 1171, 1176, 1178, 1183, 1187, 1189, 1191, 1196, 1198, 1199, 1200, 1201, 1203, 1204, 1205, 1214, 1217, 1218, 1221, 1222, 1223, 1225, 1228, 1230, 1231, 1232, 1235, 1236, 1240, 1243, 1248, 1249, 1251, 1254, 1257, 1258, 1261, 1263, 1269, 1270, 1272, 1277, 1281, 1285, 1286, 1290, 1291, 1292, 1293, 1296, 1298, 1301, 1303, 1306, 1307, 1309, 1311, 1312, 1314, 1316, 1317, 1320, 1322, 1323, 1327, 1330, 1331, 1334, 1337, 1339, 1343, 1345, 1346, 1347, 1349, 1354, 1355, 1356, 1360, 1363, 1364, 1366, 1368, 1371, 1376, 1377, 1380, 1381, 1387, 1388, 1389, 1391, 1393, 1396, 1399, 1404, 1405, 1406, 1411, 1412, 1420, 1421, 1423, 1426, 1431, 1432, 1433, 1437, 1438, 1439, 1440, 1441, 1442, 1447, 1448, 1451, 1453, 1454, 1455, 1458, 1459, 1461, 1462, 1466, 1468, 1471, 1474, 1484, 1485, 1488, 1490, 1491, 1492, 1493, 1497, 1498, 1499, 1501, 1503, 1506, 1508, 1510, 1511, 1514, 1518, 1519, 1525, 1526, 1527, 1528, 1530, 1536, 1539, 1540, 1543, 1545, 1547, 1548, 1549, 1550, 1551, 1554, 1555, 1556, 1560, 1561, 1563, 1564, 1567, 1570, 1571, 1575, 1576, 1578, 1579, 1582, 1584, 1585, 1586, 1588, 1590, 1596, 1597, 1598, 1599, 1600, 1601, 1602, 1604, 1608, 1609, 1610, 1612, 1614, 1615, 1616, 1622, 1623, 1625, 1632, 1634, 1635, 1637, 1638, 1643, 1650, 1651, 1653, 1654, 1658, 1659, 1662, 1663, 1669, 1671, 1673, 1675, 1677, 1678, 1681, 1682, 1684, 1685, 1687, 1688, 1689, 1690, 1691, 1696, 1697, 1698, 1699, 1701, 1705, 1706, 1707, 1708, 1710, 1716, 1717, 1718, 1720, 1725, 1729, 1732, 1735, 1736, 1745, 1750, 1755, 1759, 1761, 1764, 1770, 1773, 1774, 1777, 1778, 1785, 1786, 1791, 1796, 1798, 1807, 1809, 1811, 1813, 1814, 1823, 1826, 1828, 1830, 1832, 1834, 1837, 1838, 1839, 1840, 1845, 1848, 1850, 1852, 1856, 1859, 1861, 1863, 1866, 1868, 1869, 1872, 1873, 1876, 1878, 1879, 1880, 1882, 1886, 1888, 1891, 1897, 1898, 1899, 1900, 1902, 1905, 1906, 1910, 1911, 1912, 1915, 1916, 1918, 1920, 1922, 1923, 1924, 1927, 1930, 1931, 1933, 1934, 1936, 1939, 1940, 1945, 1950, 1951, 1952, 1953, 1954, 1958, 1968, 1970, 1971, 1972, 1973, 1976, 1977, 1986, 1990, 1991, 1993, 1994, 1995, 1996, 1999, 2000, 2001, 2003, 2007, 2009, 2010, 2012, 2014, 2015, 2016, 2017, 2019, 2021, 2026, 2031, 2032, 2034, 2037, 2039, 2040, 2041, 2043, 2045, 2048, 2058, 2060, 2062, 2064, 2066, 2071, 2072, 2074, 2077, 2078, 2085, 2088, 2089, 2091, 2093, 2094, 2095, 2096, 2097, 2099, 2103, 2104, 2106, 2107, 2111, 2112, 2113, 2122, 2123, 2125, 2130, 2133, 2137, 2139, 2140, 2142, 2143, 2144, 2146, 2147, 2150, 2151, 2156, 2157, 2159, 2161, 2162, 2164, 2166, 2167, 2168, 2170, 2173, 2175, 2177, 2179, 2183, 2185, 2188, 2189, 2190, 2193, 2196, 2200, 2202, 2203, 2205, 2206, 2210, 2213, 2215, 2216, 2218, 2221, 2222, 2226, 2227, 2240, 2242, 2253, 2257, 2260, 2261, 2263, 2266, 2267, 2271, 2274, 2276, 2278, 2280, 2282, 2284, 2289, 2290, 2291, 2296, 2297, 2298, 2300, 2303, 2306, 2308, 2309, 2310, 2313, 2314, 2319, 2321, 2322, 2323, 2325, 2328, 2329, 2331, 2333, 2337, 2339, 2341, 2342, 2352, 2353, 2354, 2358, 2359, 2363, 2366, 2367, 2369, 2371, 2377, 2379, 2381, 2382, 2384, 2395, 2397, 2398, 2401, 2402, 2405, 2408, 2410, 2413, 2414, 2418, 2419, 2420, 2423, 2426, 2428, 2430, 2431, 2432, 2433, 2434, 2435, 2437, 2439, 2440, 2441, 2442, 2443, 2445, 2449, 2451, 2452, 2453, 2454, 2457, 2458, 2465, 2469, 2470, 2471, 2472, 2474, 2476, 2477, 2479, 2480, 2481, 2482, 2485, 2487, 2489, 2490, 2492, 2494, 2495, 2496, 2497, 2498, 2500, 2505, 2506, 2507, 2509, 2513, 2514, 2515, 2516, 2517, 2519, 2522, 2525, 2526, 2528, 2529, 2531, 2532, 2533, 2538, 2539, 2541, 2543, 2544, 2545, 2546, 2549, 2551, 2552, 2555, 2557, 2559, 2560, 2567, 2568, 2570, 2571, 2573, 2578, 2581, 2589, 2590, 2596, 2599, 2600, 2601, 2605, 2609, 2611, 2612, 2613, 2616, 2617, 2619, 2620, 2622, 2625, 2626, 2627, 2632, 2634, 2635, 2639, 2644, 2645, 2649, 2652, 2654, 2656, 2658, 2659, 2661, 2662, 2663, 2666, 2670, 2671, 2672, 2674, 2679, 2684, 2685, 2687, 2689, 2691, 2692, 2694, 2696, 2700, 2702, 2704, 2708, 2711, 2719, 2720, 2721, 2722, 2725, 2726, 2727, 2728, 2729, 2730, 2735, 2737, 2738, 2739, 2740, 2744, 2745, 2746, 2747, 2749, 2752, 2755, 2756, 2757, 2758, 2762, 2764, 2765, 2770, 2775, 2776, 2779, 2784, 2785, 2786, 2787, 2798, 2800, 2801, 2802, 2805, 2808, 2814, 2819, 2822, 2823, 2824, 2826, 2827, 2828, 2831, 2833, 2840, 2845, 2850, 2857, 2860, 2861, 2862, 2864, 2865, 2869, 2871, 2876, 2878, 2879, 2885, 2886, 2888, 2889, 2890, 2892, 2893, 2894, 2896, 2897, 2901, 2902, 2903, 2906, 2908, 2909, 2912, 2914, 2915, 2916, 2917, 2918, 2922, 2923, 2926, 2930, 2931, 2932, 2933, 2934, 2935, 2938, 2941, 2942, 2943, 2944, 2945, 2946, 2948, 2955, 2959, 2960, 2962, 2963, 2966, 2968, 2969, 2976, 2979, 2982, 2992, 2994, 3000, 3003, 3005, 3007, 3008, 3013, 3015, 3017, 3020, 3023, 3024, 3029, 3031, 3039, 3041, 3042, 3043, 3044, 3045, 3046, 3047, 3048, 3049, 3050, 3051, 3052, 3053, 3055, 3062, 3064, 3067, 3068, 3072, 3075, 3080, 3083, 3084, 3085, 3087, 3090, 3095, 3096, 3100, 3101, 3107, 3112, 3115, 3118, 3119, 3120, 3121, 3122, 3123, 3126, 3127, 3128, 3129, 3138, 3139, 3141, 3143, 3145, 3153, 3157, 3158, 3167, 3169, 3170, 3171, 3172, 3177, 3181, 3185, 3189, 3191, 3192, 3196, 3202, 3205, 3206, 3208, 3210, 3217, 3218, 3219, 3220, 3221, 3224, 3225, 3227, 3228, 3230, 3231, 3236, 3237, 3240, 3242, 3244, 3246, 3247, 3249, 3252, 3253, 3261, 3263, 3266, 3267, 3268, 3269, 3271, 3272, 3280, 3283, 3286, 3288, 3289, 3290, 3291, 3294, 3295, 3297, 3299, 3301, 3303, 3307, 3308, 3310, 3312, 3313, 3314, 3324, 3327, 3329, 3331, 3332, 3333, 3337, 3338, 3340, 3342, 3343, 3345, 3346, 3351, 3353, 3355, 3359, 3360, 3361, 3363, 3369, 3370, 3374, 3377, 3378, 3379, 3383, 3386, 3394, 3396, 3397, 3399, 3403, 3404, 3405, 3412, 3413, 3415, 3416, 3418, 3419, 3422, 3424, 3425, 3426, 3427, 3428, 3432, 3435, 3438, 3440, 3441, 3442, 3446, 3447, 3449, 3450, 3451, 3452, 3453, 3458, 3461, 3462, 3466, 3468, 3469, 3470, 3471, 3474, 3477, 3483, 3484, 3486, 3488, 3490, 3491, 3493, 3500, 3501, 3502, 3503, 3504, 3507, 3510, 3511, 3516, 3523, 3529, 3533, 3535, 3536, 3538, 3540, 3541, 3544, 3545, 3548, 3549, 3551, 3554, 3556, 3560, 3561, 3562, 3569, 3571, 3574, 3576, 3580, 3587, 3588, 3589, 3591, 3592, 3594, 3595, 3599, 3600, 3601, 3603, 3604, 3610, 3611, 3613, 3615, 3616, 3618, 3619, 3620, 3621, 3622, 3624, 3627, 3628, 3629, 3630, 3631, 3633, 3634, 3637, 3640, 3642, 3643, 3644, 3645, 3646, 3647, 3648, 3650, 3659, 3661, 3667, 3672, 3674, 3676, 3677, 3681, 3682, 3684, 3685, 3690, 3702, 3706, 3707, 3709, 3710, 3713, 3715, 3717, 3718, 3719, 3720, 3721, 3725, 3730, 3731, 3733, 3744, 3748, 3749, 3752, 3756, 3761, 3763, 3764, 3765, 3766, 3772, 3773, 3774, 3775, 3777, 3778, 3783, 3785, 3787, 3791, 3792, 3793, 3798, 3800, 3801, 3804, 3806, 3808, 3812, 3817, 3818, 3819, 3820, 3823, 3828, 3830, 3831, 3832, 3833, 3836, 3837, 3838, 3839, 3843, 3844, 3846, 3847, 3849, 3858, 3859, 3860, 3867, 3870, 3871, 3872, 3873, 3876, 3877, 3882, 3883, 3884, 3885, 3887, 3889, 3890, 3892, 3893, 3894, 3895, 3896, 3898, 3899, 3902, 3903, 3904, 3907, 3908, 3912, 3917, 3918, 3923, 3924, 3926, 3928, 3929, 3931, 3933, 3934, 3937, 3938, 3940, 3941, 3947, 3950, 3954, 3955, 3958, 3962, 3964, 3967, 3968, 3970, 3971, 3974, 3975, 3978, 3983, 3984, 3985, 3988, 3991, 3995, 3996, 3997, 3998, 4000, 4007, 4008, 4012, 4013, 4014, 4021, 4024, 4028, 4030, 4033, 4037, 4039, 4040, 4041, 4042, 4043, 4044, 4047, 4048, 4049, 4050, 4053, 4054, 4056, 4057, 4062, 4066, 4068, 4070, 4075, 4077, 4084, 4088, 4092, 4094, 4096, 4098, 4099, 4102, 4105, 4106, 4109, 4110, 4113, 4115, 4124, 4126, 4128, 4132, 4133, 4135, 4140, 4143, 4144, 4146, 4148, 4149, 4150, 4151, 4155, 4158, 4160, 4161, 4162, 4163, 4164, 4165, 4166, 4167, 4168, 4170, 4171, 4173, 4175, 4178, 4179, 4181, 4185, 4187, 4188, 4189, 4190, 4191, 4193, 4195, 4197, 4201, 4202, 4204, 4205, 4206, 4207, 4208, 4210, 4211, 4212, 4213, 4217, 4219, 4227, 4228, 4233, 4234, 4235, 4237, 4245, 4246, 4250, 4251, 4252, 4255, 4257, 4260, 4261, 4263, 4266, 4270, 4272, 4275, 4276, 4280, 4281, 4284, 4288, 4290, 4294, 4296, 4298, 4300, 4301, 4302, 4304, 4305, 4306, 4309, 4312, 4314, 4317, 4320, 4321, 4324, 4329, 4330, 4335, 4337, 4339, 4341, 4347, 4358, 4359, 4360, 4366, 4369, 4370, 4378, 4380, 4383, 4388, 4390, 4391, 4393, 4396, 4397, 4401, 4402, 4403, 4404, 4405, 4406, 4409, 4410, 4422, 4423, 4430, 4432, 4436, 4439, 4440, 4442, 4443, 4446, 4448, 4450, 4453, 4456, 4461, 4462, 4463, 4464, 4466, 4467, 4468, 4470, 4474, 4475, 4479, 4486, 4487, 4490, 4492, 4494, 4496, 4498, 4500, 4502, 4507, 4508, 4509, 4512, 4514, 4515, 4518, 4519, 4521, 4522, 4529, 4531, 4532, 4535, 4543, 4548, 4549, 4551, 4554, 4555, 4556, 4557, 4558, 4560, 4562, 4563, 4565, 4566, 4567, 4568, 4575, 4576, 4580, 4582, 4583, 4590, 4591, 4593, 4594, 4597, 4598, 4601, 4604, 4606, 4614, 4616, 4623, 4625, 4628, 4630, 4632, 4635, 4638, 4639, 4641, 4643, 4644, 4645, 4646, 4647, 4650, 4651, 4653, 4654, 4655, 4656, 4657, 4658, 4659, 4662, 4664, 4667, 4669, 4671, 4672, 4673, 4674, 4676, 4677, 4680, 4682, 4685, 4691, 4692, 4697, 4699, 4700, 4701, 4703, 4705, 4706, 4708, 4710, 4711, 4713, 4715, 4719, 4721, 4722, 4728, 4729, 4730, 4734, 4736, 4737, 4738, 4739, 4740, 4741, 4745, 4746, 4747, 4748, 4749, 4753, 4755, 4756, 4761, 4762, 4763, 4767, 4769, 4770, 4771, 4773, 4775, 4778, 4779, 4780, 4784, 4787, 4788, 4789, 4790, 4791, 4794, 4795, 4796, 4801, 4802, 4803, 4804, 4805, 4806, 4807, 4809, 4813, 4815, 4816, 4817, 4818, 4822, 4828, 4830, 4831, 4834, 4841, 4842, 4845, 4847, 4855, 4856, 4857, 4859, 4861, 4862, 4863, 4864, 4869, 4874, 4875, 4876, 4877, 4878, 4880, 4881, 4887, 4889, 4891, 4896, 4897, 4900, 4904, 4905, 4907, 4909, 4910, 4914, 4921, 4922, 4923, 4924, 4931, 4935, 4936, 4938, 4941, 4943, 4953, 4954, 4955, 4958, 4959, 4966, 4967, 4969, 4971, 4972, 4974, 4975, 4981, 4985, 4987, 4988, 4989, 4990, 4993, 4994, 4996, 5000, 5007, 5011, 5015, 5016, 5021, 5022, 5023, 5026, 5029, 5030, 5034, 5036, 5037, 5038, 5039, 5040, 5042, 5044, 5045, 5046, 5049, 5052, 5054, 5055, 5057, 5060, 5061, 5067, 5068, 5072, 5074, 5075, 5078, 5082, 5084, 5088, 5089, 5090, 5091, 5094, 5095, 5099, 5100, 5101, 5102, 5106, 5109, 5111, 5113, 5114, 5115, 5116, 5119, 5120, 5122, 5125, 5131, 5132, 5140, 5143, 5144, 5145, 5146, 5147, 5151, 5157, 5159, 5160, 5163, 5164, 5165, 5168, 5170, 5174, 5175, 5177, 5178, 5180, 5181, 5182, 5184, 5185, 5188, 5189, 5190, 5191, 5192, 5196, 5198, 5200, 5202, 5203, 5206, 5209, 5212, 5213, 5216, 5217, 5218, 5219, 5225, 5226, 5229, 5234, 5241, 5243, 5249, 5251, 5253, 5254, 5255, 5256, 5257, 5258, 5260, 5261, 5263, 5267, 5268, 5269, 5273, 5275, 5276, 5280, 5281, 5282, 5283, 5285, 5286, 5287, 5291, 5292, 5293, 5297, 5298, 5299, 5300, 5301, 5308, 5311, 5314, 5315, 5317, 5319, 5321, 5324, 5327, 5329, 5330, 5332, 5334, 5338, 5339, 5341, 5342, 5343, 5345, 5346, 5348, 5349, 5350, 5351, 5352, 5366, 5367, 5371, 5383, 5386, 5388, 5389, 5391, 5393, 5395, 5396, 5397, 5402, 5404, 5405, 5411, 5413, 5414, 5417, 5418, 5422, 5427, 5428, 5430, 5431, 5433, 5434, 5437, 5438, 5445, 5446, 5448, 5449, 5452, 5453, 5456, 5458, 5459, 5461, 5462, 5463, 5464, 5471, 5472, 5475, 5483, 5485, 5487, 5488, 5491, 5493, 5495, 5496, 5501, 5505, 5506, 5508, 5510, 5512, 5513, 5515, 5517, 5518, 5519, 5524, 5526, 5529, 5530, 5531, 5532, 5534, 5535, 5543, 5545, 5554, 5557, 5559, 5562, 5563, 5565, 5566, 5568, 5569, 5572, 5575, 5579, 5580, 5581, 5582, 5584, 5585, 5586, 5589, 5593, 5594, 5596, 5597, 5602, 5608, 5612, 5613, 5614, 5615, 5616, 5618, 5619, 5620, 5621, 5623, 5627, 5632, 5635, 5638, 5640, 5643, 5647, 5648, 5649, 5650, 5651, 5652, 5653, 5655, 5656, 5657, 5659, 5660, 5662, 5663, 5664, 5669, 5670, 5671, 5680, 5681, 5683, 5689, 5690, 5694, 5695, 5697, 5698, 5702, 5709, 5711, 5712, 5713, 5714, 5717, 5718, 5719, 5721, 5722, 5723, 5729, 5730, 5731, 5732, 5734, 5735, 5736, 5742, 5744, 5751, 5754, 5757, 5764, 5768, 5770, 5773, 5775, 5778, 5780, 5784, 5785, 5788, 5791, 5792, 5794, 5803, 5805, 5807, 5808, 5810, 5811, 5817, 5819, 5820, 5823, 5825, 5826, 5828, 5832, 5833, 5834, 5835, 5836, 5837, 5839, 5842, 5844, 5846, 5853, 5854, 5856, 5858, 5859, 5864, 5867, 5868, 5869, 5871, 5872, 5878, 5879, 5881, 5882, 5883, 5884, 5888, 5889, 5892, 5893, 5900, 5901, 5902, 5906, 5907, 5910, 5912, 5918, 5919, 5921, 5925, 5927, 5928, 5929, 5930, 5931, 5932, 5938, 5939, 5940, 5941, 5942, 5944, 5946, 5948, 5950, 5951, 5954, 5956, 5957, 5959, 5961, 5968, 5969, 5971, 5978, 5979, 5980, 5984, 5985, 5986, 5988, 5990, 5991, 5994, 5996, 5997, 5998, 6000, 6002, 6003, 6004, 6006, 6007, 6012, 6013, 6016, 6017, 6021, 6025, 6026, 6028, 6038, 6040, 6041, 6043, 6044, 6047, 6048, 6051, 6054, 6058, 6059, 6060, 6062, 6063, 6068, 6069, 6070, 6072, 6073, 6074, 6075, 6077, 6080, 6084, 6085, 6087, 6088, 6089, 6090, 6091, 6092, 6093, 6094, 6095, 6096, 6098, 6108, 6109, 6112, 6113, 6116, 6118, 6119, 6120, 6122, 6125, 6129, 6130, 6131, 6132, 6133, 6135, 6136, 6137, 6143, 6145, 6146, 6147, 6149, 6151, 6152, 6153, 6155, 6156, 6157, 6158, 6160, 6163, 6164, 6165, 6168, 6171, 6180, 6181, 6182, 6183, 6184, 6186, 6188, 6189, 6190, 6191, 6193, 6196, 6197, 6198, 6200, 6203, 6205, 6207, 6209, 6212, 6213, 6219, 6220, 6221, 6223, 6224, 6226, 6227, 6228, 6230, 6231, 6234, 6237, 6238, 6239, 6240, 6243, 6245, 6246, 6247, 6249, 6250, 6251, 6257, 6258, 6259, 6260, 6264, 6265, 6269, 6270, 6272, 6273, 6275, 6278, 6279, 6280, 6282, 6286, 6288, 6289, 6291, 6292, 6294, 6296, 6299, 6300, 6302, 6303, 6309, 6310, 6312, 6315, 6317, 6319, 6321, 6322, 6323, 6326, 6328, 6330, 6333, 6335, 6338, 6339, 6343, 6344, 6346, 6351, 6352, 6353, 6354, 6356, 6359, 6360, 6362, 6363, 6364, 6367, 6370, 6372, 6373, 6375, 6378, 6381, 6383, 6387, 6394, 6395, 6396, 6397, 6399, 6403, 6404, 6405, 6407, 6412, 6414, 6415, 6419, 6420, 6422, 6426, 6427, 6429, 6431, 6434, 6436, 6440, 6442, 6450, 6452, 6454, 6458, 6459, 6463, 6464, 6466, 6467, 6468, 6469, 6470, 6471, 6474, 6477, 6478, 6480, 6482, 6484, 6486, 6488, 6492, 6494, 6495, 6497, 6499, 6500, 6501, 6502, 6504, 6505, 6506, 6510, 6513, 6514, 6515, 6516, 6517, 6519, 6524, 6525, 6528, 6530, 6533, 6534, 6537, 6541, 6543, 6544, 6547, 6548, 6549, 6554, 6555, 6558, 6560, 6561, 6563, 6564, 6569, 6572, 6574, 6576, 6577, 6579, 6581, 6582, 6584, 6587, 6589, 6595, 6596, 6597, 6598, 6599, 6607, 6609, 6610, 6611, 6614, 6615, 6616, 6620, 6621, 6624, 6626, 6627, 6629, 6630, 6634, 6635, 6637, 6638, 6639, 6643, 6644, 6648, 6649, 6650, 6652, 6653, 6654, 6655, 6658, 6662, 6666, 6671, 6672, 6673, 6676, 6681, 6695, 6696, 6699, 6702, 6703, 6705, 6706, 6711, 6714, 6716, 6718, 6720, 6724, 6725, 6729, 6730, 6731, 6733, 6734, 6736, 6737, 6739, 6746, 6747, 6756, 6757, 6759, 6761, 6764, 6766, 6777, 6778, 6779, 6780, 6782, 6786, 6788, 6791, 6792, 6793, 6797, 6799, 6803, 6804, 6805, 6807, 6810, 6811, 6812, 6813, 6816, 6817, 6819, 6820, 6821, 6824, 6827, 6828, 6830, 6831, 6834, 6836, 6839, 6840, 6841, 6842, 6843, 6845, 6847, 6851, 6852, 6859, 6860, 6863, 6864, 6867, 6869, 6872, 6874, 6875, 6876, 6877, 6878, 6879, 6880, 6884, 6886, 6887, 6888, 6890, 6895, 6902, 6903, 6906, 6909, 6913, 6914, 6915, 6917, 6919, 6921, 6922, 6923, 6924, 6925, 6930, 6933, 6936, 6941, 6944, 6946, 6948, 6950, 6951, 6952, 6954, 6959, 6960, 6967, 6969, 6970, 6971, 6979, 6980, 6984, 6985, 6987, 6990, 6991, 6993, 6994, 6995, 6997, 6999, 7002, 7003, 7005, 7006, 7009, 7011, 7013, 7015, 7022, 7025, 7032, 7038, 7039, 7040, 7042, 7043, 7046, 7050, 7051, 7052, 7053, 7056, 7057, 7064, 7067, 7068, 7072, 7075, 7077, 7079, 7083, 7084, 7085, 7086, 7094, 7097, 7105, 7106, 7107, 7108, 7112, 7113, 7116, 7117, 7118, 7124, 7126, 7129, 7130, 7132, 7135, 7136, 7138, 7139, 7140, 7142, 7144, 7146, 7149, 7151, 7155, 7163, 7164, 7167, 7169, 7170, 7171, 7172, 7173, 7176, 7177, 7182, 7183, 7184, 7187, 7188, 7192, 7194, 7197, 7201, 7202, 7203, 7206, 7207, 7208, 7209, 7211, 7213, 7216, 7217, 7219, 7220, 7224, 7227, 7228, 7230, 7232, 7233, 7234, 7236, 7239, 7240, 7243, 7244, 7245, 7248, 7255, 7257, 7258, 7259, 7267, 7268, 7270, 7274, 7277, 7278, 7281, 7282, 7284, 7287, 7288, 7290, 7291, 7292, 7293, 7298, 7299, 7300, 7301, 7303, 7304, 7305, 7307, 7308, 7310, 7311, 7312, 7313, 7315, 7321, 7328, 7330, 7331, 7334, 7336, 7338, 7340, 7343, 7344, 7350, 7351, 7353, 7354, 7355, 7356, 7357, 7358, 7363, 7365, 7371, 7373, 7375, 7377, 7379, 7380, 7382, 7383, 7386, 7388, 7389, 7392, 7395, 7396, 7398, 7400, 7409, 7411, 7415, 7417, 7418, 7425, 7428, 7430, 7433, 7434, 7435, 7436, 7438, 7441, 7443, 7444, 7446, 7447, 7448, 7452, 7453, 7454, 7458, 7459, 7464, 7466, 7470, 7483, 7486, 7488, 7490, 7492, 7493, 7498, 7502, 7504, 7505, 7506, 7512, 7515, 7517, 7518, 7523, 7524, 7525, 7528, 7533, 7534, 7537, 7538, 7545, 7546, 7547, 7548, 7549, 7554, 7556, 7561, 7570, 7574, 7578, 7579, 7580, 7585, 7586, 7589, 7591, 7594, 7595, 7598, 7605, 7611, 7613, 7619, 7620, 7621, 7623, 7624, 7632, 7633, 7634, 7638, 7639, 7642, 7643, 7652, 7661, 7663, 7664, 7665, 7666, 7667, 7674, 7676, 7677, 7678, 7679, 7680, 7682, 7685, 7687, 7689, 7695, 7697, 7699, 7700, 7703, 7704, 7712, 7716, 7717, 7719, 7724, 7725, 7729, 7730, 7733, 7734, 7736, 7737, 7738, 7739, 7740, 7743, 7744, 7745, 7747, 7751, 7753, 7754, 7755, 7761, 7762, 7763, 7764, 7768, 7769, 7770, 7772, 7774, 7775, 7777, 7778, 7779, 7781, 7782, 7785, 7786, 7788, 7791, 7793, 7794, 7796, 7798, 7800, 7803, 7804, 7806, 7807, 7812, 7815, 7819, 7820, 7823, 7824, 7825, 7832, 7833, 7834, 7836, 7838, 7841, 7844, 7845, 7847, 7848, 7849, 7854, 7856, 7859, 7860, 7862, 7863, 7865, 7873, 7878, 7880, 7881, 7888, 7890, 7896, 7900, 7901, 7908, 7910, 7911, 7918, 7922, 7923, 7925, 7929, 7933, 7934, 7935, 7936, 7937, 7938, 7942, 7943, 7944, 7945, 7947, 7948, 7949, 7950, 7953, 7955, 7956, 7964, 7965, 7966, 7967, 7971, 7972, 7974, 7976, 7977, 7978, 7980, 7982, 7983, 7984, 7986, 7988, 7989, 7990, 7991, 7992, 7993, 7998, 7999, 8000, 8002, 8004, 8005, 8006, 8008, 8012, 8021, 8023, 8026, 8029, 8035, 8042, 8043, 8044, 8045, 8047, 8048, 8052, 8053, 8056, 8058, 8059, 8062, 8063, 8065, 8066, 8067, 8068, 8069, 8071, 8072, 8075, 8076, 8077, 8078, 8080, 8082, 8083, 8084, 8087, 8088, 8091, 8093, 8095, 8099, 8100, 8102, 8103, 8105, 8106, 8112, 8116, 8118, 8121, 8123, 8124, 8126, 8130, 8136, 8137, 8147, 8150, 8151, 8156, 8159, 8162, 8163, 8164, 8165, 8168, 8170, 8176, 8178, 8179, 8182, 8189, 8192, 8193, 8195, 8199, 8202, 8204, 8207, 8208, 8211, 8213, 8216, 8219, 8220, 8222, 8223, 8225, 8227, 8235, 8237, 8239, 8241, 8242, 8244, 8245, 8249, 8250, 8252, 8253, 8266, 8268, 8269, 8270, 8272, 8275, 8282, 8289, 8291, 8292, 8293, 8294, 8297, 8300, 8301, 8304, 8305, 8306, 8310, 8311, 8312, 8315, 8318, 8319, 8320, 8321, 8325, 8329, 8336, 8339, 8340, 8343, 8349, 8350, 8351, 8352, 8353, 8355, 8361, 8363, 8367, 8368, 8369, 8371, 8373, 8376, 8378, 8379, 8385, 8387, 8389, 8390, 8392, 8393, 8395, 8398, 8401, 8402, 8403, 8404, 8405, 8407, 8410, 8411, 8413, 8414, 8416, 8417, 8418, 8423, 8427, 8428, 8430, 8433, 8435, 8436, 8438, 8439, 8441, 8442, 8444, 8446, 8447, 8448, 8449, 8450, 8451, 8457, 8458, 8459, 8460, 8465, 8466, 8471, 8472, 8473, 8474, 8476, 8477, 8478, 8480, 8481, 8482, 8485, 8486, 8490, 8493, 8498, 8501, 8502, 8505, 8507, 8511, 8513, 8515, 8517, 8521, 8523, 8524, 8525, 8528, 8531, 8532, 8533, 8537, 8538, 8539, 8541, 8542, 8544, 8549, 8550, 8552, 8553, 8554, 8557, 8558, 8561, 8562, 8565, 8566, 8568, 8576, 8581, 8582, 8583, 8588, 8589, 8590, 8592, 8593, 8594, 8595, 8596, 8597, 8598, 8599, 8600, 8601, 8602, 8603, 8605, 8610, 8611, 8612, 8613, 8614, 8617, 8618, 8624, 8630, 8631, 8634, 8637, 8638, 8639, 8640, 8642, 8644, 8647, 8648, 8652, 8654, 8657, 8658, 8659, 8663, 8664, 8665, 8666, 8669, 8670, 8672, 8676, 8677, 8685, 8689, 8693, 8700, 8703, 8706, 8708, 8709, 8713, 8716, 8717, 8719, 8720, 8729, 8731, 8732, 8734, 8735, 8736, 8740, 8741, 8742, 8744, 8745, 8746, 8748, 8752, 8753, 8757, 8760, 8770, 8772, 8773, 8775, 8776, 8777, 8779, 8782, 8783, 8784, 8785, 8789, 8790, 8792, 8797, 8802, 8803, 8804, 8805, 8808, 8810, 8818, 8822, 8824, 8831, 8832, 8834, 8835, 8838, 8841, 8842, 8843, 8846, 8853, 8861, 8866, 8876, 8878, 8880, 8881, 8883, 8886, 8888, 8889, 8891, 8892, 8893, 8896, 8899, 8900, 8901, 8907, 8908, 8909, 8910, 8911, 8913, 8914, 8916, 8917, 8922, 8926, 8928, 8929, 8938, 8940, 8941, 8942, 8945, 8946, 8949, 8951, 8954, 8956, 8957, 8960, 8963, 8964, 8965, 8967, 8968, 8969, 8972, 8974, 8976, 8977, 8979, 8980, 8981, 8985, 8986, 8991, 8992, 8996, 8998, 8999, 9001, 9002, 9003, 9004, 9006, 9009, 9012, 9013, 9015, 9020, 9021, 9022, 9026, 9027, 9029, 9030, 9033, 9037, 9042, 9044, 9052, 9056, 9057, 9058, 9059, 9060, 9061, 9062, 9066, 9069, 9071, 9073, 9074, 9076, 9084, 9086, 9088, 9091, 9092, 9095, 9096, 9097, 9103, 9105, 9108, 9110, 9111, 9112, 9114, 9116, 9118, 9119, 9123, 9124, 9125, 9128, 9129, 9131, 9133, 9134, 9138, 9139, 9140, 9141, 9142, 9146, 9148, 9149, 9151, 9152, 9154, 9156, 9164, 9173, 9174, 9175, 9177, 9183, 9185, 9187, 9188, 9190, 9191, 9194, 9195, 9200, 9206, 9207, 9210, 9211, 9213, 9215, 9216, 9217, 9218, 9221, 9223, 9226, 9229, 9233, 9234, 9237, 9241, 9242, 9243, 9247, 9249, 9252, 9253, 9254, 9255, 9257, 9263, 9265, 9267, 9270, 9273, 9276, 9278, 9282, 9283, 9284, 9285, 9287, 9288, 9290, 9292, 9293, 9295, 9299, 9300, 9302, 9304, 9308, 9311, 9313, 9320, 9321, 9323, 9325, 9326, 9328, 9329, 9330, 9336, 9337, 9338, 9339, 9340, 9341, 9345, 9346, 9347, 9348, 9350, 9353, 9354, 9355, 9357, 9359, 9367, 9373, 9375, 9376, 9378, 9382, 9383, 9388, 9391, 9392, 9393, 9394, 9396, 9398, 9400, 9402, 9403, 9404, 9406, 9407, 9412, 9413, 9415, 9419, 9422, 9423, 9426, 9432, 9433, 9439, 9440, 9444, 9451, 9452, 9453, 9455, 9456, 9459, 9460, 9467, 9468, 9471, 9472, 9473, 9478, 9481, 9483, 9487, 9488, 9490, 9497, 9500, 9501, 9502, 9503, 9504, 9505, 9509, 9514, 9515, 9517, 9518, 9519, 9520, 9521, 9525, 9533, 9534, 9536, 9540, 9543, 9545, 9546, 9548, 9549, 9553, 9555, 9556, 9563, 9564, 9565, 9567, 9568, 9571, 9575, 9577, 9582, 9583, 9586, 9587, 9589, 9590, 9591, 9592, 9598, 9606, 9607, 9609, 9610, 9613, 9615, 9617, 9618, 9620, 9623, 9626, 9627, 9628, 9629, 9633, 9635, 9637, 9640, 9641, 9642, 9644, 9645, 9646, 9648, 9649, 9650, 9653, 9655, 9656, 9657, 9658, 9659, 9660, 9663, 9666, 9668, 9670, 9681, 9682, 9686, 9687, 9692, 9693, 9696, 9698, 9700, 9706, 9710, 9711, 9717, 9718, 9722, 9723, 9725, 9726, 9730, 9731, 9733, 9734, 9737, 9744, 9745, 9746, 9750, 9751, 9753, 9754, 9755, 9756, 9763, 9764, 9767, 9768, 9770, 9776, 9777, 9780, 9781, 9782, 9784, 9786, 9792, 9793, 9794, 9796, 9799, 9801, 9806, 9808, 9809, 9812, 9813, 9816, 9819, 9820, 9824, 9825, 9827, 9830, 9833, 9835, 9836, 9845, 9846, 9847, 9849, 9850, 9851, 9853, 9854, 9861, 9864, 9866, 9869, 9873, 9876, 9882, 9885, 9886, 9887, 9892, 9893, 9897, 9898, 9900, 9901, 9906, 9907, 9908, 9909, 9910, 9911, 9912, 9918, 9923, 9924, 9928, 9930, 9935, 9938, 9940, 9946, 9950, 9953, 9955, 9957, 9958, 9960, 9962, 9963, 9964, 9966, 9967, 9971, 9972, 9974, 9979, 9980, 9982, 9984, 9988, 9990, 9991, 9997, 9998, 10000, 10008, 10009, 10010, 10013, 10017, 10018, 10019, 10021, 10022, 10026, 10031, 10032, 10033, 10034, 10035, 10037, 10038, 10043, 10044, 10045, 10047, 10048, 10050, 10051, 10052, 10054, 10056, 10058, 10059, 10060, 10062, 10063, 10064, 10066, 10068, 10073, 10075, 10076, 10077, 10078, 10083, 10089, 10090, 10091, 10092, 10094, 10095, 10097, 10101, 10102, 10103, 10105, 10106, 10107, 10108, 10109, 10110, 10112, 10114, 10115, 10117, 10118, 10122, 10127, 10128, 10131, 10132, 10136, 10143, 10146, 10149, 10151, 10152, 10158, 10163, 10165, 10166, 10168, 10170, 10174, 10176, 10177, 10178, 10181, 10182, 10192, 10193, 10194, 10195, 10196, 10197, 10199, 10200, 10203, 10206, 10209, 10213, 10214, 10218, 10219, 10220, 10222, 10223, 10224, 10225, 10228, 10229, 10230, 10231, 10233, 10234, 10236, 10237, 10239, 10247, 10252, 10253, 10255, 10258, 10259, 10260, 10270, 10275, 10278, 10284, 10286, 10291, 10292, 10293, 10295, 10300, 10302, 10306, 10307, 10311, 10318, 10321, 10322, 10323, 10325, 10326, 10327, 10328, 10329, 10331, 10334, 10335, 10336, 10341, 10342, 10343, 10346, 10352, 10353, 10356, 10357, 10359, 10360, 10362, 10364, 10365, 10368, 10371, 10373, 10375, 10380, 10381, 10384, 10385, 10389, 10395, 10397, 10398, 10399, 10400, 10401, 10405, 10410, 10413, 10414, 10416, 10421, 10423, 10424, 10425, 10427, 10428, 10429, 10430, 10435, 10437, 10438, 10446, 10447, 10448, 10449, 10450, 10451, 10452, 10453, 10455, 10456, 10463, 10464, 10465, 10466, 10468, 10469, 10470, 10472, 10473, 10474, 10478, 10487, 10490, 10491, 10492, 10494, 10496, 10498, 10504, 10506, 10508, 10514, 10515, 10516, 10518, 10521, 10525, 10527, 10528, 10530, 10531, 10533, 10535, 10536, 10537, 10541, 10542, 10543, 10544, 10547, 10548, 10549, 10550, 10551, 10555, 10556, 10558, 10560, 10561, 10562, 10563, 10565, 10569, 10571, 10573, 10577, 10580, 10581, 10582, 10583, 10585, 10587, 10590, 10593, 10595, 10596, 10597, 10599, 10601, 10602, 10610, 10611, 10614, 10615, 10616, 10617, 10618, 10621, 10622, 10623, 10626, 10628, 10629, 10630, 10631, 10633, 10637, 10638, 10639, 10640, 10641, 10642, 10643, 10645, 10646, 10649, 10650, 10655, 10657, 10664, 10665, 10668, 10669, 10670, 10671, 10674, 10677, 10678, 10681, 10682, 10683, 10684, 10685, 10686, 10687, 10689, 10693, 10697, 10698, 10699, 10700, 10702, 10703, 10705, 10707, 10708, 10711, 10712, 10715, 10716, 10721, 10722, 10723, 10725, 10726, 10732, 10734, 10735, 10736, 10738, 10740, 10741, 10744, 10745, 10747, 10748, 10749, 10753, 10754, 10761, 10762, 10763, 10766, 10774, 10775, 10777, 10778, 10779, 10782, 10784, 10785, 10787, 10788, 10790, 10791, 10792, 10795, 10796, 10798, 10800, 10802, 10803, 10804, 10805, 10809, 10810, 10811, 10812, 10813, 10815, 10818, 10819, 10820, 10821, 10824, 10825, 10826, 10830, 10831, 10833, 10836, 10838, 10839, 10840, 10841, 10843, 10846, 10850, 10851, 10853, 10854, 10857, 10858, 10860, 10861, 10862, 10863, 10866, 10867, 10869, 10872, 10874, 10877, 10878, 10880, 10881, 10886, 10887, 10892, 10894, 10896, 10897, 10898, 10899, 10902, 10905, 10911, 10912, 10913, 10917, 10920, 10926, 10927, 10930, 10933, 10934, 10935, 10936, 10937, 10938, 10940, 10941, 10944, 10947, 10948, 10950, 10954, 10957, 10960, 10962, 10965, 10967, 10972, 10975, 10976, 10977, 10980, 10988, 10993, 10995, 10996, 10997, 10999, 11002, 11004, 11005, 11006, 11008, 11015, 11018, 11023, 11024, 11027, 11032, 11033, 11039, 11046, 11047, 11049, 11053, 11056, 11060, 11066, 11070, 11072, 11078, 11082, 11083, 11086, 11090, 11092, 11095, 11098, 11101, 11102, 11107, 11108, 11109, 11110, 11114, 11116, 11118, 11119, 11123, 11124, 11125, 11126, 11127, 11129, 11132, 11133, 11134, 11135, 11137, 11138, 11145, 11146, 11148, 11150, 11152, 11153, 11154, 11158, 11159, 11160, 11161, 11162, 11163, 11168, 11169, 11173, 11175, 11177, 11178, 11179, 11180, 11181, 11184, 11185, 11187, 11188, 11190, 11192, 11194, 11198, 11199, 11201, 11202, 11204, 11207, 11210, 11214, 11217, 11218, 11222, 11226, 11227, 11228, 11229, 11232, 11233, 11234, 11235, 11236, 11237, 11238, 11239, 11244, 11246, 11247, 11248, 11254, 11255, 11256, 11257, 11258, 11259, 11260, 11262, 11263, 11264, 11266, 11274, 11275, 11278, 11282, 11288, 11289, 11290, 11291, 11292, 11293, 11294, 11295, 11298, 11302, 11306, 11307, 11313, 11315, 11316, 11318, 11319, 11320, 11322, 11324, 11326, 11329, 11330, 11331, 11332, 11333, 11337, 11338, 11339, 11340, 11345, 11346, 11348, 11349, 11352, 11356, 11358, 11359, 11363, 11365, 11366, 11369, 11370, 11371, 11373, 11374, 11377, 11380, 11381, 11382, 11387, 11388, 11389, 11391, 11392, 11394, 11395, 11397, 11398, 11403, 11405, 11406, 11408, 11409, 11411, 11412, 11413, 11414, 11416, 11418, 11423, 11424, 11426, 11430, 11431, 11434, 11437, 11438, 11443, 11445, 11446, 11447, 11448, 11449, 11451, 11456, 11458, 11459, 11463, 11465, 11466, 11467, 11471, 11472, 11473, 11475, 11476, 11477, 11478, 11481, 11482, 11485, 11487, 11490, 11492, 11494, 11496, 11497, 11498, 11499, 11500, 11503, 11506, 11507, 11508, 11512, 11516, 11518, 11520, 11523, 11524, 11526, 11527, 11528, 11530, 11531, 11532, 11533, 11534, 11538, 11541, 11544, 11546, 11548, 11551, 11553, 11558, 11560, 11561, 11567, 11568, 11570, 11571, 11574, 11576, 11577, 11578, 11580, 11585, 11586, 11588, 11589, 11593, 11594, 11595, 11596, 11597, 11599, 11604, 11607, 11610, 11615, 11618, 11620, 11621, 11623, 11624, 11625, 11632, 11633, 11636, 11639, 11640, 11642, 11644, 11649, 11650, 11652, 11655, 11656, 11657, 11658, 11663, 11667, 11668, 11669, 11677, 11678, 11680, 11681, 11682, 11683, 11688, 11691, 11692, 11693, 11694, 11695, 11698, 11699, 11701, 11703, 11705, 11707, 11710, 11711, 11712, 11718, 11721, 11725, 11731, 11733, 11736, 11738, 11740, 11743, 11744, 11753, 11755, 11759, 11760, 11761, 11762, 11763, 11764, 11765, 11766, 11767, 11770, 11771, 11773, 11774, 11776, 11780, 11781, 11782, 11783, 11785, 11786, 11790, 11792, 11795, 11799, 11800, 11804, 11809, 11811, 11812, 11813, 11814, 11816, 11818, 11819, 11821, 11826, 11828, 11830, 11837, 11838, 11839, 11841, 11846, 11847, 11849, 11850, 11851, 11853, 11856, 11858, 11861, 11863, 11868, 11870, 11872, 11876, 11877, 11881, 11889, 11890, 11891, 11893, 11894, 11897, 11898, 11899, 11903, 11904, 11909, 11911, 11913, 11916, 11917, 11918, 11919, 11920, 11921, 11922, 11923, 11926, 11927, 11928, 11929, 11930, 11934, 11935, 11940, 11943, 11946, 11947, 11948, 11949, 11953, 11955, 11958, 11959, 11960, 11961, 11962, 11963, 11965, 11966, 11968, 11974, 11977, 11978, 11979, 11980, 11983, 11988, 11993, 11994, 11995, 11996, 11997, 11998, 11999, 12002, 12004, 12005, 12008, 12014, 12017, 12018, 12019, 12020, 12021, 12023, 12024, 12025, 12029, 12032, 12042, 12043, 12044, 12050, 12051, 12054, 12058, 12059, 12060, 12061, 12063, 12068, 12078, 12079, 12080, 12081, 12083, 12085, 12089, 12091, 12092, 12093, 12097, 12098, 12102, 12104, 12106, 12109, 12110, 12112, 12114, 12115, 12118, 12120, 12122, 12127, 12128, 12129, 12130, 12131, 12134, 12135, 12137, 12138, 12139, 12143, 12144, 12145, 12146, 12147, 12148, 12150, 12151, 12161, 12162, 12164, 12165, 12166, 12167, 12170, 12171, 12174, 12175, 12179, 12181, 12184, 12189, 12192, 12197, 12198, 12200, 12201, 12202, 12204, 12208, 12214, 12215, 12217, 12221, 12223, 12229, 12230, 12233, 12237, 12240, 12241, 12243, 12245, 12249, 12250, 12252, 12254, 12255, 12256, 12259, 12268, 12269, 12271, 12278, 12280, 12283, 12285, 12286, 12287, 12292, 12293, 12295, 12296, 12302, 12304, 12306, 12310, 12311, 12312, 12313, 12314, 12315, 12317, 12319, 12321, 12323, 12325, 12326, 12328, 12331, 12333, 12334, 12337, 12339, 12340, 12342, 12343, 12344, 12345, 12347, 12350, 12354, 12356, 12359, 12364, 12366, 12370, 12375, 12376, 12379, 12380, 12381, 12383, 12390, 12393, 12394, 12397, 12400, 12401, 12403, 12406, 12411, 12414, 12415, 12416, 12417, 12419, 12420, 12423, 12424, 12426, 12427, 12428, 12437, 12439, 12440, 12444, 12445, 12447, 12450, 12451, 12456, 12457, 12459, 12461, 12462, 12465, 12467, 12468, 12469, 12470, 12472, 12473, 12478, 12481, 12482, 12483, 12486, 12487, 12488, 12490, 12492, 12494, 12497, 12499, 12500, 12501, 12502, 12503, 12504, 12508, 12512, 12513, 12514, 12515, 12518, 12519, 12525, 12530, 12531, 12535, 12536, 12537, 12538, 12539, 12540, 12546, 12547, 12549, 12551, 12552, 12553, 12554, 12555, 12556, 12561, 12562, 12563, 12565, 12567, 12568, 12570, 12572, 12577, 12578, 12583, 12585, 12586, 12588, 12589, 12591, 12594, 12597, 12600, 12603, 12605, 12606, 12608, 12609, 12610, 12611, 12614, 12616, 12619, 12622, 12623, 12626, 12628, 12629, 12633, 12634, 12638, 12639, 12640, 12641, 12644, 12648, 12649, 12651, 12652, 12653, 12663, 12664, 12668, 12670, 12671, 12674, 12676, 12679, 12683, 12684, 12688, 12691, 12693, 12695, 12696, 12697, 12699, 12701, 12702, 12707, 12713, 12714, 12723, 12726, 12728, 12729, 12731, 12732, 12733, 12735, 12737, 12738, 12739, 12740, 12741, 12742, 12743, 12744, 12750, 12752, 12753, 12754, 12755, 12756, 12757, 12758, 12760, 12761, 12762, 12763, 12764, 12765, 12766, 12771, 12772, 12773, 12775, 12777, 12782, 12783, 12788, 12790, 12797, 12800, 12802, 12804, 12807, 12810, 12812, 12813, 12817, 12819, 12820, 12822, 12823, 12824, 12826, 12827, 12828, 12834, 12835, 12836, 12837, 12838, 12839, 12843, 12844, 12848, 12849, 12850, 12853, 12866, 12869, 12870, 12873, 12875, 12878, 12882, 12883, 12884, 12887, 12891, 12898, 12899, 12900, 12902, 12903, 12904, 12905, 12906, 12908, 12910, 12912, 12913, 12914, 12916, 12920, 12921, 12923, 12928, 12929, 12931, 12932, 12933, 12934, 12935, 12939, 12942, 12946, 12947, 12950, 12953, 12956, 12958, 12960, 12961, 12963, 12967, 12968, 12969, 12978, 12984, 12986, 12987, 12988, 12990, 12991, 12994, 12996, 12999, 13001, 13003, 13004, 13007, 13010, 13014, 13015, 13017, 13018, 13022, 13030, 13031, 13032, 13033, 13034, 13035, 13036, 13037, 13040, 13041, 13044, 13047, 13049, 13050, 13053, 13054, 13055, 13056, 13060, 13061, 13062, 13063, 13064, 13066, 13067, 13071, 13075, 13077, 13079, 13083, 13085, 13086, 13087, 13097, 13099, 13101, 13102, 13105, 13106, 13109, 13110, 13111, 13112, 13114, 13115, 13116, 13117, 13118, 13120, 13121, 13122, 13123, 13124, 13125, 13128, 13131, 13134, 13135, 13136, 13142, 13144, 13147, 13148, 13149, 13151, 13154, 13159, 13163, 13166, 13169, 13175, 13181, 13182, 13186, 13190, 13197, 13199, 13206, 13209, 13210, 13212, 13213, 13215, 13217, 13220, 13221, 13224, 13226, 13227, 13228, 13229, 13232, 13233, 13234, 13235, 13236, 13237, 13239, 13241, 13248, 13250, 13251, 13255, 13256, 13258, 13259, 13260, 13261, 13262, 13263, 13264, 13265, 13267, 13268, 13269, 13271, 13274, 13281, 13285, 13293, 13296, 13297, 13298, 13300, 13301, 13303, 13304, 13315, 13316, 13317, 13326, 13328, 13329, 13330, 13332, 13335, 13338, 13340, 13341, 13343, 13345, 13346, 13347, 13348, 13350, 13352, 13353, 13358, 13361, 13363, 13365, 13367, 13368, 13369, 13370, 13373, 13374, 13377, 13380, 13381, 13384, 13385, 13386, 13388, 13391, 13393, 13394, 13395, 13396, 13397, 13403, 13407, 13408, 13410, 13413, 13416, 13417, 13419, 13423, 13424, 13428, 13429, 13430, 13433, 13439, 13441, 13446, 13448, 13450, 13451, 13456, 13457, 13460, 13461, 13463, 13467, 13469, 13473, 13475, 13477, 13478, 13480, 13489, 13492, 13494, 13498, 13499, 13503, 13507, 13510, 13513, 13514, 13515, 13519, 13521, 13522, 13526, 13530, 13532, 13533, 13540, 13543, 13544, 13546, 13547, 13549, 13552, 13553, 13555, 13556, 13558, 13559, 13560, 13561, 13562, 13568, 13569, 13574, 13577, 13578, 13579, 13580, 13582, 13584, 13587, 13596, 13597, 13599, 13600, 13601, 13602, 13604, 13605, 13606, 13607, 13612, 13613, 13619, 13621, 13623, 13627, 13628, 13629, 13630, 13631, 13632, 13634, 13636, 13637, 13638, 13641, 13647, 13652, 13653, 13654, 13660, 13662, 13663, 13665, 13675, 13677, 13678, 13679, 13683, 13687, 13688, 13689, 13693, 13697, 13698, 13699, 13700, 13702, 13706, 13712, 13713, 13714, 13715, 13716, 13719, 13720, 13721, 13727, 13729, 13730, 13734, 13736, 13737, 13739, 13742, 13745, 13747, 13749, 13750, 13753, 13756, 13764, 13767, 13769, 13772, 13773, 13775, 13777, 13779, 13782, 13783, 13785, 13786, 13787, 13789, 13791, 13792, 13793, 13795, 13796, 13798, 13799, 13809, 13816, 13817, 13818, 13819, 13822, 13823, 13828, 13830, 13831, 13834, 13835, 13843, 13849, 13851, 13852, 13859, 13860, 13862, 13866, 13869, 13870, 13872, 13873, 13875, 13877, 13885, 13887, 13891, 13892, 13895, 13897, 13898, 13899, 13901, 13906, 13907, 13908, 13909, 13910, 13911, 13914, 13917, 13918, 13919, 13920, 13921, 13924, 13925, 13927, 13929, 13934, 13943, 13944, 13947, 13948, 13950, 13953, 13954, 13958, 13960, 13963, 13969, 13970, 13975, 13983, 13984, 13985, 13986, 13987, 13990, 13999, 14000, 14001, 14002, 14003, 14005, 14006, 14009, 14013, 14014, 14018, 14021, 14022, 14027, 14030, 14031, 14036, 14038, 14040, 14051, 14052, 14059, 14062, 14063, 14066, 14067, 14069, 14070, 14071, 14072, 14073, 14075, 14078, 14081, 14084, 14085, 14086, 14088, 14092, 14094, 14096, 14102, 14105, 14111, 14112, 14116, 14118, 14119, 14121, 14122, 14124, 14125, 14129, 14130, 14132, 14133, 14135, 14137, 14138, 14139, 14141, 14144, 14145, 14146, 14147.

Promoters expressing in the kernel at 2 days after pollination include SEQ IDs: 1, 3, 7, 9, 12, 13, 14, 15, 16, 17, 19, 20, 26, 27, 29, 33, 34, 36, 37, 38, 44, 45, 48, 54, 57, 63, 64, 65, 79, 88, 90, 93, 94, 96, 98, 99, 103, 104, 110, 111, 112, 115, 117, 121, 123, 130, 131, 141, 143, 147, 148, 152, 154, 155, 160, 162, 165, 168, 172, 174, 176, 179, 181, 183, 187, 191, 193, 194, 196, 197, 199, 202, 204, 205, 207, 210, 211, 212, 214, 232, 233, 234, 235, 236, 237, 239, 240, 242, 244, 246, 249, 250, 251, 256, 257, 259, 264, 267, 271, 273, 280, 281, 286, 288, 289, 293, 298, 299, 301, 302, 305, 306, 308, 309, 314, 316, 319, 322, 323, 328, 329, 332, 334, 335, 338, 339, 340, 346, 349, 352, 353, 354, 356, 357, 365, 367, 372, 373, 374, 378, 379, 381, 388, 396, 401, 405, 406, 407, 411, 412, 414, 423, 428, 429, 433, 434, 436, 441, 448, 450, 452, 456, 459, 460, 461, 462, 463, 468, 470, 471, 474, 478, 479, 483, 485, 488, 489, 496, 498, 504, 507, 509, 510, 514, 515, 516, 517, 522, 523, 525, 528, 532, 535, 537, 538, 541, 543, 544, 546, 547, 548, 553, 554, 557, 561, 563, 578, 580, 582, 585, 591, 594, 595, 596, 598, 599, 601, 602, 605, 606, 607, 613, 614, 619, 620, 623, 630, 631, 633, 634, 635, 636, 637, 638, 643, 650, 662, 663, 666, 670, 671, 680, 681, 683, 687, 693, 694, 695, 701, 702, 705, 706, 707, 708, 716, 717, 718, 719, 722, 723, 724, 727, 731, 732, 734, 735, 736, 740, 742, 744, 749, 750, 753, 757, 759, 760, 761, 762, 764, 765, 770, 771, 779, 781, 782, 783, 784, 792, 793, 800, 804, 806, 808, 809, 811, 812, 819, 820, 822, 824, 825, 826, 827, 829, 830, 833, 840, 849, 852, 855, 856, 857, 858, 860, 862, 863, 865, 869, 870, 871, 872, 875, 876, 877, 882, 883, 887, 890, 892, 893, 895, 897, 898, 899, 900, 903, 907, 908, 911, 912, 913, 915, 916, 917, 919, 924, 928, 932, 934, 936, 939, 943, 944, 951, 953, 954, 955, 957, 958, 960, 964, 971, 974, 976, 977, 978, 979, 980, 981, 982, 983, 984, 985, 987, 988, 989, 991, 993, 994, 995, 997, 999, 1002, 1003, 1005, 1006, 1007, 1008, 1009, 1010, 1011, 1012, 1013, 1014, 1016, 1022, 1025, 1026, 1032, 1035, 1038, 1040, 1041, 1043, 1046, 1047, 1049, 1051, 1052, 1055, 1056, 1057, 1059, 1064, 1065, 1068, 1069, 1070, 1073, 1074, 1076, 1077, 1079, 1080, 1085, 1086, 1087, 1088, 1089, 1092, 1095, 1096, 1098, 1100, 1101, 1103, 1104, 1110, 1112, 1114, 1115, 1116, 1117, 1119, 1120, 1121, 1125, 1130, 1132, 1136, 1137, 1140, 1146, 1148, 1154, 1155, 1160, 1161, 1162, 1165, 1167, 1168, 1170, 1171, 1176, 1178, 1183, 1189, 1191, 1196, 1198, 1200, 1201, 1203, 1204, 1214, 1217, 1218, 1220, 1223, 1225, 1228, 1230, 1231, 1233, 1236, 1239, 1240, 1248, 1249, 1251, 1253, 1254, 1258, 1261, 1263, 1269, 1277, 1281, 1285, 1286, 1290, 1292, 1293, 1296, 1303, 1305, 1306, 1307, 1309, 1311, 1316, 1320, 1321, 1322, 1323, 1327, 1331, 1334, 1339, 1345, 1347, 1349, 1354, 1355, 1360, 1364, 1366, 1368, 1371, 1375, 1376, 1377, 1380, 1381, 1383, 1387, 1388, 1389, 1393, 1394, 1396, 1398, 1399, 1403, 1404, 1406, 1407, 1417, 1420, 1421, 1423, 1426, 1431, 1432, 1433, 1435, 1438, 1439, 1441, 1442, 1447, 1448, 1451, 1453, 1454, 1455, 1458, 1459, 1461, 1462, 1464, 1466, 1467, 1468, 1469, 1471, 1472, 1475, 1484, 1485, 1488, 1490, 1493, 1498, 1499, 1501, 1503, 1504, 1508, 1510, 1511, 1514, 1518, 1519, 1523, 1525, 1526, 1527, 1528, 1530, 1536, 1543, 1545, 1546, 1547, 1549, 1550, 1551, 1554, 1555, 1556, 1560, 1561, 1563, 1564, 1567, 1568, 1570, 1571, 1575, 1578, 1579, 1582, 1584, 1586, 1590, 1591, 1594, 1597, 1598, 1599, 1600, 1601, 1602, 1604, 1605, 1608, 1609, 1610, 1612, 1614, 1615, 1616, 1617, 1622, 1623, 1625, 1634, 1635, 1637, 1638, 1639, 1642, 1643, 1650, 1654, 1658, 1659, 1662, 1663, 1668, 1669, 1671, 1673, 1675, 1676, 1677, 1678, 1681, 1682, 1684, 1685, 1687, 1689, 1690, 1691, 1696, 1697, 1698, 1699, 1703, 1705, 1706, 1707, 1708, 1709, 1710, 1716, 1717, 1718, 1719, 1720, 1725, 1729, 1732, 1735, 1736, 1750, 1755, 1759, 1761, 1764, 1769, 1773, 1776, 1778, 1785, 1786, 1791, 1792, 1793, 1796, 1798, 1807, 1809, 1811, 1812, 1813, 1826, 1828, 1830, 1832, 1834, 1835, 1837, 1838, 1839, 1840, 1848, 1852, 1859, 1861, 1863, 1866, 1867, 1869, 1872, 1879, 1880, 1882, 1886, 1888, 1891, 1894, 1897, 1898, 1899, 1900, 1902, 1905, 1906, 1910, 1911, 1915, 1916, 1918, 1920, 1922, 1923, 1924, 1928, 1930, 1931, 1933, 1934, 1936, 1939, 1940, 1945, 1949, 1950, 1951, 1952, 1953, 1954, 1958, 1968, 1970, 1971, 1972, 1973, 1977, 1986, 1990, 1991, 1993, 1994, 1995, 1996, 1999, 2000, 2001, 2003, 2007, 2009, 2010, 2012, 2014, 2015, 2016, 2017, 2019, 2021, 2031, 2032, 2037, 2040, 2041, 2043, 2045, 2048, 2058, 2060, 2062, 2064, 2066, 2072, 2074, 2077, 2078, 2088, 2089, 2091, 2093, 2094, 2097, 2099, 2103, 2104, 2106, 2107, 2111, 2112, 2116, 2117, 2119, 2122, 2123, 2125, 2130, 2132, 2133, 2137, 2139, 2140, 2142, 2143, 2144, 2146, 2147, 2150, 2151, 2156, 2157, 2161, 2164, 2166, 2167, 2168, 2170, 2173, 2175, 2177, 2179, 2183, 2185, 2188, 2189, 2190, 2193, 2196, 2200, 2202, 2203, 2205, 2206, 2210, 2213, 2215, 2216, 2218, 2221, 2222, 2223, 2226, 2235, 2237, 2240, 2241, 2242, 2243, 2244, 2247, 2253, 2257, 2260, 2263, 2267, 2274, 2276, 2278, 2279, 2280, 2282, 2283, 2284, 2289, 2291, 2296, 2297, 2298, 2300, 2303, 2304, 2305, 2308, 2309, 2310, 2314, 2322, 2323, 2328, 2329, 2331, 2333, 2337, 2339, 2342, 2343, 2345, 2348, 2353, 2358, 2363, 2366, 2369, 2371, 2372, 2379, 2380, 2381, 2382, 2383, 2384, 2395, 2401, 2402, 2405, 2406, 2410, 2412, 2413, 2414, 2417, 2418, 2419, 2420, 2422, 2423, 2428, 2430, 2433, 2435, 2437, 2439, 2440, 2441, 2442, 2443, 2445, 2446, 2449, 2451, 2452, 2453, 2454, 2457, 2458, 2469, 2470, 2471, 2472, 2474, 2476, 2477, 2479, 2480, 2481, 2482, 2485, 2487, 2489, 2490, 2492, 2494, 2495, 2496, 2497, 2498, 2500, 2505, 2506, 2507, 2509, 2513, 2514, 2515, 2516, 2517, 2519, 2522, 2525, 2526, 2528, 2529, 2531, 2532, 2533, 2534, 2536, 2537, 2538, 2539, 2541, 2544, 2545, 2546, 2549, 2550, 2551, 2552, 2553, 2555, 2556, 2557, 2559, 2567, 2568, 2570, 2571, 2573, 2576, 2578, 2579, 2581, 2583, 2589, 2590, 2596, 2599, 2601, 2605, 2609, 2611, 2613, 2616, 2617, 2620, 2622, 2625, 2626, 2627, 2632, 2634, 2635, 2636, 2639, 2644, 2645, 2649, 2652, 2655, 2658, 2661, 2662, 2663, 2671, 2672, 2674, 2676, 2678, 2679, 2684, 2685, 2690, 2691, 2692, 2694, 2696, 2700, 2702, 2704, 2708, 2711, 2712, 2715, 2719, 2720, 2722, 2725, 2727, 2728, 2729, 2730, 2735, 2736, 2738, 2739, 2746, 2747, 2749, 2752, 2755, 2756, 2757, 2763, 2764, 2765, 2766, 2770, 2775, 2776, 2779, 2784, 2785, 2787, 2789, 2791, 2794, 2796, 2798, 2800, 2802, 2805, 2808, 2812, 2814, 2819, 2821, 2822, 2823, 2824, 2826, 2827, 2828, 2831, 2832, 2834, 2837, 2840, 2844, 2845, 2850, 2857, 2859, 2860, 2861, 2862, 2865, 2869, 2871, 2876, 2878, 2888, 2889, 2890, 2893, 2894, 2896, 2897, 2898, 2902, 2903, 2905, 2906, 2908, 2909, 2914, 2915, 2916, 2917, 2918, 2919, 2922, 2923, 2926, 2929, 2930, 2931, 2935, 2937, 2941, 2942, 2943, 2944, 2946, 2947, 2948, 2955, 2959, 2960, 2963, 2966, 2968, 2976, 2979, 2982, 2992, 2994, 3000, 3003, 3005, 3007, 3008, 3009, 3013, 3015, 3017, 3020, 3023, 3024, 3029, 3031, 3039, 3041, 3042, 3044, 3045, 3047, 3048, 3049, 3051, 3052, 3053, 3055, 3058, 3059, 3064, 3068, 3070, 3072, 3075, 3080, 3083, 3084, 3085, 3087, 3090, 3095, 3100, 3101, 3106, 3112, 3115, 3118, 3119, 3120, 3121, 3122, 3123, 3126, 3127, 3128, 3129, 3139, 3143, 3145, 3149, 3153, 3156, 3157, 3158, 3167, 3169, 3170, 3171, 3172, 3177, 3181, 3185, 3187, 3189, 3191, 3192, 3194, 3196, 3200, 3202, 3205, 3206, 3208, 3210, 3217, 3218, 3219, 3220, 3221, 3224, 3225, 3228, 3230, 3231, 3232, 3237, 3240, 3242, 3249, 3252, 3255, 3261, 3263, 3266, 3267, 3268, 3269, 3271, 3272, 3273, 3280, 3286, 3288, 3289, 3290, 3291, 3294, 3295, 3297, 3299, 3301, 3303, 3308, 3310, 3312, 3313, 3324, 3327, 3331, 3332, 3333, 3337, 3338, 3340, 3342, 3343, 3345, 3346, 3347, 3351, 3353, 3354, 3355, 3356, 3358, 3361, 3363, 3370, 3373, 3374, 3376, 3377, 3378, 3383, 3384, 3386, 3394, 3396, 3399, 3402, 3403, 3404, 3405, 3413, 3416, 3418, 3419, 3422, 3424, 3426, 3427, 3428, 3435, 3438, 3440, 3441, 3442, 3445, 3446, 3447, 3449, 3450, 3452, 3453, 3458, 3461, 3465, 3466, 3468, 3469, 3470, 3471, 3474, 3477, 3483, 3484, 3486, 3488, 3490, 3493, 3494, 3499, 3500, 3501, 3502, 3503, 3504, 3507, 3516, 3521, 3522, 3523, 3524, 3533, 3535, 3536, 3537, 3538, 3540, 3541, 3544, 3545, 3549, 3552, 3554, 3556, 3558, 3560, 3561, 3562, 3569, 3574, 3576, 3580, 3587, 3588, 3589, 3591, 3592, 3594, 3595, 3600, 3601, 3603, 3604, 3607, 3610, 3611, 3613, 3615, 3616, 3618, 3619, 3620, 3621, 3624, 3627, 3628, 3630, 3631, 3633, 3634, 3640, 3642, 3643, 3644, 3645, 3646, 3648, 3653, 3655, 3657, 3659, 3660, 3661, 3667, 3672, 3674, 3677, 3681, 3682, 3684, 3685, 3690, 3693, 3694, 3702, 3704, 3706, 3707, 3709, 3710, 3713, 3715, 3717, 3718, 3720, 3721, 3725, 3730, 3731, 3732, 3744, 3748, 3749, 3752, 3756, 3757, 3760, 3764, 3765, 3766, 3772, 3773, 3775, 3777, 3778, 3785, 3791, 3792, 3793, 3798, 3801, 3806, 3808, 3809, 3812, 3817, 3818, 3819, 3820, 3823, 3825, 3828, 3830, 3831, 3832, 3833, 3837, 3838, 3843, 3844, 3845, 3846, 3849, 3858, 3859, 3862, 3867, 3868, 3870, 3871, 3872, 3873, 3876, 3881, 3882, 3883, 3884, 3887, 3889, 3892, 3893, 3894, 3895, 3897, 3898, 3902, 3904, 3907, 3908, 3910, 3912, 3913, 3917, 3918, 3924, 3926, 3928, 3929, 3933, 3934, 3938, 3940, 3941, 3947, 3950, 3952, 3954, 3958, 3959, 3962, 3964, 3967, 3968, 3970, 3971, 3974, 3975, 3978, 3979, 3983, 3985, 3988, 3990, 3995, 3996, 3997, 4000, 4007, 4008, 4013, 4014, 4019, 4020, 4021, 4028, 4030, 4033, 4037, 4039, 4040, 4041, 4042, 4043, 4044, 4046, 4047, 4048, 4049, 4050, 4051, 4052, 4053, 4054, 4056, 4057, 4062, 4066, 4068, 4070, 4071, 4072, 4075, 4079, 4080, 4084, 4088, 4092, 4094, 4096, 4098, 4099, 4105, 4106, 4109, 4110, 4111, 4113, 4115, 4116, 4117, 4124, 4128, 4132, 4133, 4135, 4139, 4140, 4143, 4144, 4146, 4147, 4148, 4149, 4155, 4160, 4163, 4164, 4165, 4166, 4167, 4168, 4170, 4171, 4173, 4175, 4178, 4185, 4187, 4188, 4189, 4191, 4192, 4193, 4198, 4201, 4202, 4204, 4205, 4206, 4207, 4208, 4210, 4211, 4212, 4213, 4215, 4219, 4221, 4227, 4228, 4229, 4233, 4234, 4235, 4244, 4245, 4246, 4250, 4251, 4255, 4257, 4261, 4263, 4266, 4269, 4270, 4272, 4275, 4276, 4279, 4280, 4284, 4290, 4292, 4294, 4295, 4296, 4298, 4300, 4301, 4302, 4304, 4305, 4306, 4309, 4312, 4319, 4320, 4321, 4324, 4329, 4330, 4335, 4337, 4338, 4341, 4344, 4347, 4356, 4358, 4359, 4360, 4366, 4369, 4370, 4371, 4373, 4375, 4378, 4380, 4383, 4388, 4390, 4391, 4393, 4396, 4397, 4401, 4402, 4403, 4404, 4405, 4409, 4410, 4417, 4422, 4423, 4425, 4430, 4436, 4439, 4440, 4442, 4443, 4446, 4448, 4449, 4450, 4453, 4456, 4461, 4462, 4463, 4466, 4468, 4470, 4474, 4475, 4479, 4486, 4490, 4492, 4494, 4497, 4498, 4500, 4502, 4507, 4508, 4509, 4512, 4514, 4515, 4518, 4519, 4521, 4531, 4535, 4545, 4548, 4549, 4551, 4554, 4555, 4556, 4557, 4558, 4560, 4562, 4563, 4565, 4566, 4567, 4568, 4575, 4576, 4580, 4582, 4583, 4590, 4591, 4593, 4594, 4597, 4598, 4601, 4606, 4608, 4614, 4616, 4618, 4623, 4625, 4628, 4630, 4632, 4633, 4639, 4641, 4643, 4644, 4645, 4646, 4647, 4650, 4651, 4653, 4654, 4655, 4656, 4657, 4659, 4664, 4667, 4669, 4671, 4672, 4673, 4674, 4676, 4677, 4680, 4682, 4685, 4688, 4691, 4692, 4694, 4697, 4700, 4703, 4706, 4708, 4711, 4713, 4714, 4715, 4719, 4721, 4723, 4725, 4729, 4734, 4736, 4737, 4738, 4739, 4740, 4745, 4746, 4749, 4750, 4753, 4755, 4756, 4761, 4762, 4763, 4766, 4769, 4770, 4771, 4773, 4775, 4778, 4779, 4780, 4784, 4787, 4788, 4789, 4790, 4791, 4794, 4795, 4801, 4804, 4805, 4806, 4807, 4813, 4814, 4816, 4817, 4818, 4822, 4828, 4830, 4831, 4834, 4838, 4841, 4842, 4845, 4855, 4856, 4857, 4859, 4861, 4862, 4863, 4864, 4869, 4871, 4874, 4875, 4876, 4878, 4880, 4881, 4887, 4889, 4891, 4896, 4900, 4902, 4904, 4905, 4909, 4910, 4914, 4921, 4922, 4923, 4924, 4931, 4935, 4936, 4938, 4941, 4942, 4943, 4947, 4950, 4954, 4958, 4959, 4963, 4967, 4969, 4971, 4972, 4974, 4975, 4985, 4987, 4988, 4989, 4990, 4993, 4994, 4996, 5000, 5005, 5007, 5011, 5014, 5015, 5016, 5022, 5026, 5029, 5030, 5034, 5036, 5037, 5038, 5039, 5040, 5042, 5044, 5045, 5046, 5051, 5052, 5054, 5057, 5060, 5061, 5067, 5072, 5074, 5075, 5077, 5078, 5079, 5082, 5084, 5088, 5089, 5090, 5091, 5094, 5099, 5100, 5101, 5102, 5111, 5114, 5115, 5116, 5120, 5122, 5125, 5129, 5131, 5132, 5140, 5144, 5145, 5147, 5148, 5151, 5157, 5159, 5160, 5164, 5165, 5168, 5169, 5170, 5174, 5180, 5181, 5184, 5185, 5187, 5188, 5189, 5190, 5191, 5192, 5196, 5198, 5200, 5202, 5203, 5206, 5212, 5213, 5216, 5217, 5218, 5219, 5225, 5228, 5229, 5234, 5241, 5247, 5249, 5253, 5254, 5256, 5257, 5258, 5260, 5261, 5263, 5267, 5268, 5269, 5273, 5274, 5275, 5276, 5279, 5280, 5281, 5282, 5283, 5286, 5287, 5290, 5293, 5297, 5298, 5299, 5300, 5301, 5308, 5311, 5315, 5317, 5319, 5321, 5324, 5327, 5329, 5330, 5332, 5333, 5334, 5338, 5339, 5342, 5343, 5345, 5346, 5348, 5350, 5351, 5352, 5360, 5361, 5366, 5367, 5371, 5386, 5388, 5389, 5391, 5393, 5395, 5396, 5397, 5402, 5405, 5409, 5411, 5413, 5414, 5417, 5418, 5422, 5427, 5428, 5430, 5431, 5433, 5434, 5437, 5438, 5445, 5446, 5448, 5449, 5452, 5453, 5456, 5458, 5459, 5461, 5463, 5464, 5471, 5472, 5475, 5476, 5482, 5483, 5485, 5487, 5488, 5491, 5493, 5495, 5496, 5497, 5505, 5506, 5508, 5510, 5513, 5515, 5517, 5518, 5519, 5524, 5526, 5529, 5530, 5532, 5534, 5535, 5543, 5545, 5549, 5554, 5557, 5558, 5562, 5563, 5565, 5566, 5568, 5569, 5572, 5575, 5579, 5581, 5582, 5583, 5584, 5585, 5586, 5589, 5591, 5593, 5594, 5597, 5608, 5612, 5613, 5614, 5615, 5616, 5620, 5621, 5623, 5627, 5632, 5633, 5635, 5638, 5640, 5643, 5647, 5648, 5651, 5652, 5653, 5656, 5657, 5659, 5660, 5662, 5663, 5669, 5670, 5671, 5680, 5681, 5689, 5690, 5694, 5695, 5697, 5698, 5702, 5706, 5709, 5711, 5718, 5719, 5721, 5722, 5723, 5729, 5730, 5731, 5732, 5734, 5735, 5736, 5742, 5744, 5746, 5749, 5751, 5764, 5768, 5770, 5773, 5775, 5780, 5784, 5785, 5788, 5791, 5792, 5794, 5804, 5805, 5808, 5810, 5811, 5814, 5815, 5816, 5820, 5826, 5832, 5834, 5835, 5836, 5837, 5842, 5844, 5846, 5853, 5854, 5859, 5864, 5867, 5868, 5869, 5871, 5872, 5876, 5877, 5878, 5879, 5881, 5882, 5883, 5884, 5888, 5889, 5892, 5893, 5900, 5901, 5902, 5906, 5907, 5910, 5912, 5919, 5921, 5922, 5923, 5925, 5927, 5928, 5929, 5930, 5931, 5932, 5938, 5939, 5941, 5942, 5944, 5946, 5947, 5948, 5951, 5952, 5954, 5956, 5957, 5959, 5961, 5967, 5968, 5969, 5971, 5978, 5979, 5980, 5984, 5985, 5986, 5988, 5989, 5990, 5991, 5994, 5996, 5997, 6000, 6003, 6004, 6006, 6007, 6010, 6012, 6013, 6016, 6017, 6023, 6025, 6026, 6028, 6034, 6038, 6040, 6041, 6044, 6047, 6048, 6051, 6054, 6058, 6059, 6062, 6063, 6065, 6068, 6069, 6070, 6072, 6073, 6074, 6075, 6080, 6085, 6088, 6089, 6090, 6092, 6093, 6094, 6095, 6096, 6098, 6099, 6107, 6108, 6109, 6112, 6113, 6116, 6118, 6119, 6120, 6122, 6129, 6130, 6131, 6132, 6133, 6135, 6136, 6137, 6143, 6145, 6146, 6147, 6149, 6151, 6152, 6153, 6156, 6158, 6160, 6163, 6164, 6165, 6168, 6178, 6181, 6182, 6183, 6184, 6186, 6188, 6189, 6191, 6193, 6197, 6198, 6200, 6205, 6207, 6209, 6212, 6213, 6215, 6220, 6223, 6224, 6227, 6228, 6230, 6231, 6233, 6234, 6237, 6238, 6240, 6243, 6244, 6245, 6246, 6247, 6248, 6249, 6251, 6255, 6257, 6258, 6259, 6264, 6265, 6270, 6272, 6273, 6275, 6278, 6279, 6280, 6281, 6282, 6286, 6288, 6291, 6292, 6294, 6295, 6299, 6302, 6303, 6309, 6310, 6312, 6315, 6316, 6317, 6319, 6321, 6322, 6323, 6325, 6326, 6328, 6330, 6333, 6338, 6346, 6351, 6352, 6353, 6354, 6356, 6358, 6360, 6362, 6363, 6367, 6370, 6372, 6375, 6376, 6378, 6379, 6381, 6383, 6387, 6394, 6395, 6396, 6397, 6398, 6399, 6403, 6405, 6407, 6408, 6410, 6413, 6414, 6415, 6419, 6420, 6422, 6425, 6426, 6428, 6429, 6430, 6431, 6434, 6436, 6440, 6441, 6442, 6452, 6454, 6459, 6463, 6464, 6466, 6467, 6469, 6470, 6471, 6474, 6476, 6480, 6481, 6482, 6484, 6488, 6492, 6495, 6499, 6500, 6501, 6502, 6503, 6504, 6505, 6510, 6513, 6515, 6517, 6519, 6524, 6525, 6526, 6530, 6532, 6533, 6534, 6535, 6537, 6543, 6544, 6547, 6548, 6549, 6554, 6555, 6558, 6559, 6560, 6561, 6563, 6564, 6567, 6569, 6571, 6574, 6576, 6577, 6579, 6581, 6582, 6584, 6587, 6588, 6589, 6592, 6595, 6598, 6599, 6607, 6609, 6611, 6614, 6620, 6621, 6624, 6625, 6626, 6628, 6629, 6630, 6634, 6635, 6637, 6638, 6639, 6640, 6643, 6644, 6649, 6650, 6652, 6653, 6655, 6662, 6666, 6671, 6672, 6673, 6677, 6681, 6696, 6699, 6701, 6703, 6705, 6706, 6710, 6711, 6714, 6716, 6718, 6720, 6724, 6725, 6729, 6731, 6734, 6736, 6737, 6739, 6746, 6747, 6752, 6756, 6757, 6759, 6761, 6764, 6766, 6778, 6779, 6780, 6782, 6786, 6788, 6793, 6795, 6797, 6799, 6803, 6804, 6805, 6807, 6810, 6811, 6812, 6813, 6816, 6819, 6820, 6821, 6824, 6827, 6828, 6830, 6831, 6834, 6836, 6839, 6840, 6841, 6842, 6843, 6845, 6851, 6852, 6859, 6860, 6863, 6869, 6872, 6874, 6875, 6876, 6877, 6878, 6879, 6880, 6884, 6888, 6890, 6894, 6897, 6903, 6904, 6907, 6913, 6914, 6915, 6917, 6919, 6920, 6921, 6922, 6923, 6924, 6930, 6933, 6936, 6941, 6944, 6946, 6948, 6951, 6959, 6960, 6963, 6967, 6969, 6970, 6979, 6980, 6984, 6985, 6987, 6988, 6990, 6991, 6993, 6994, 6995, 6997, 6999, 7002, 7003, 7006, 7009, 7011, 7012, 7013, 7015, 7017, 7022, 7032, 7038, 7039, 7042, 7043, 7045, 7046, 7050, 7051, 7052, 7053, 7056, 7057, 7064, 7067, 7068, 7077, 7079, 7083, 7085, 7086, 7094, 7105, 7106, 7107, 7108, 7112, 7113, 7116, 7117, 7118, 7119, 7124, 7130, 7132, 7135, 7140, 7142, 7144, 7149, 7155, 7163, 7164, 7165, 7166, 7169, 7173, 7176, 7177, 7182, 7184, 7187, 7188, 7192, 7194, 7196, 7197, 7198, 7201, 7202, 7203, 7206, 7207, 7208, 7210, 7211, 7216, 7217, 7219, 7220, 7227, 7228, 7230, 7231, 7232, 7233, 7234, 7236, 7239, 7241, 7244, 7245, 7248, 7255, 7257, 7258, 7259, 7262, 7267, 7268, 7274, 7276, 7277, 7279, 7281, 7282, 7287, 7288, 7290, 7291, 7292, 7293, 7298, 7299, 7300, 7301, 7303, 7304, 7305, 7306, 7307, 7308, 7313, 7315, 7317, 7328, 7330, 7334, 7336, 7338, 7339, 7344, 7348, 7350, 7351, 7353, 7354, 7355, 7357, 7358, 7363, 7365, 7371, 7373, 7375, 7377, 7380, 7381, 7382, 7383, 7386, 7388, 7389, 7392, 7396, 7398, 7409, 7410, 7411, 7417, 7418, 7424, 7425, 7430, 7431, 7433, 7434, 7435, 7436, 7438, 7441, 7443, 7444, 7445, 7446, 7447, 7448, 7452, 7454, 7458, 7459, 7464, 7466, 7470, 7483, 7484, 7486, 7490, 7492, 7493, 7498, 7501, 7502, 7504, 7505, 7506, 7512, 7515, 7517, 7523, 7524, 7525, 7528, 7529, 7533, 7537, 7538, 7542, 7546, 7547, 7554, 7560, 7561, 7563, 7570, 7574, 7578, 7579, 7580, 7582, 7585, 7586, 7587, 7589, 7590, 7593, 7594, 7598, 7601, 7605, 7611, 7613, 7617, 7619, 7620, 7621, 7623, 7624, 7633, 7638, 7639, 7642, 7643, 7647, 7652, 7658, 7661, 7663, 7664, 7665, 7674, 7676, 7677, 7678, 7679, 7680, 7682, 7686, 7687, 7689, 7695, 7699, 7700, 7703, 7704, 7712, 7713, 7716, 7717, 7718, 7719, 7724, 7725, 7726, 7729, 7730, 7733, 7734, 7736, 7737, 7738, 7743, 7744, 7745, 7747, 7749, 7751, 7753, 7755, 7761, 7762, 7763, 7764, 7768, 7769, 7770, 7772, 7774, 7775, 7779, 7780, 7781, 7785, 7786, 7788, 7791, 7792, 7793, 7794, 7796, 7798, 7800, 7801, 7802, 7803, 7804, 7806, 7807, 7812, 7815, 7818, 7819, 7820, 7823, 7824, 7825, 7832, 7833, 7834, 7838, 7839, 7841, 7844, 7845, 7847, 7848, 7852, 7856, 7858, 7859, 7860, 7862, 7863, 7865, 7873, 7875, 7876, 7878, 7881, 7888, 7890, 7896, 7900, 7908, 7910, 7911, 7917, 7918, 7920, 7923, 7925, 7927, 7928, 7933, 7934, 7935, 7936, 7937, 7938, 7942, 7944, 7945, 7946, 7947, 7948, 7949, 7950, 7952, 7955, 7956, 7964, 7971, 7972, 7974, 7976, 7977, 7978, 7980, 7984, 7986, 7988, 7993, 7998, 8002, 8004, 8005, 8006, 8007, 8012, 8021, 8026, 8035, 8039, 8042, 8044, 8045, 8047, 8048, 8052, 8053, 8056, 8058, 8059, 8061, 8063, 8067, 8068, 8071, 8076, 8077, 8078, 8079, 8080, 8082, 8084, 8088, 8091, 8093, 8095, 8099, 8100, 8102, 8103, 8105, 8106, 8112, 8116, 8118, 8120, 8123, 8124, 8126, 8136, 8137, 8145, 8146, 8147, 8150, 8151, 8154, 8155, 8156, 8159, 8162, 8163, 8165, 8168, 8170, 8177, 8178, 8179, 8181, 8182, 8185, 8189, 8192, 8193, 8199, 8202, 8204, 8207, 8208, 8210, 8211, 8213, 8216, 8219, 8220, 8223, 8225, 8227, 8230, 8234, 8235, 8237, 8239, 8242, 8245, 8250, 8252, 8253, 8257, 8258, 8262, 8265, 8266, 8268, 8269, 8270, 8272, 8274, 8289, 8291, 8292, 8293, 8294, 8295, 8300, 8301, 8304, 8306, 8310, 8311, 8312, 8318, 8319, 8320, 8321, 8323, 8324, 8325, 8329, 8331, 8337, 8339, 8340, 8349, 8350, 8351, 8352, 8353, 8355, 8367, 8368, 8369, 8373, 8378, 8379, 8385, 8386, 8387, 8389, 8392, 8393, 8395, 8396, 8398, 8401, 8402, 8403, 8404, 8405, 8407, 8410, 8411, 8413, 8414, 8416, 8427, 8428, 8430, 8433, 8435, 8436, 8438, 8439, 8441, 8442, 8444, 8446, 8447, 8448, 8449, 8450, 8451, 8458, 8459, 8460, 8469, 8470, 8472, 8473, 8474, 8476, 8477, 8480, 8481, 8482, 8485, 8486, 8490, 8494, 8498, 8501, 8502, 8505, 8507, 8509, 8511, 8513, 8515, 8517, 8520, 8523, 8524, 8525, 8527, 8528, 8531, 8532, 8533, 8539, 8541, 8542, 8544, 8546, 8549, 8550, 8551, 8554, 8557, 8558, 8561, 8562, 8565, 8566, 8568, 8576, 8577, 8579, 8580, 8581, 8582, 8584, 8589, 8590, 8592, 8593, 8594, 8595, 8596, 8597, 8598, 8600, 8601, 8602, 8603, 8604, 8605, 8610, 8611, 8612, 8614, 8617, 8618, 8624, 8631, 8634, 8637, 8638, 8639, 8640, 8642, 8644, 8647, 8648, 8650, 8654, 8657, 8658, 8659, 8660, 8663, 8664, 8665, 8669, 8670, 8672, 8675, 8676, 8677, 8681, 8685, 8693, 8700, 8703, 8704, 8706, 8707, 8708, 8709, 8712, 8713, 8716, 8717, 8719, 8720, 8728, 8729, 8731, 8734, 8735, 8736, 8740, 8741, 8742, 8744, 8745, 8746, 8748, 8749, 8751, 8753, 8757, 8760, 8767, 8770, 8772, 8773, 8775, 8777, 8779, 8782, 8783, 8784, 8789, 8790, 8792, 8796, 8797, 8804, 8805, 8807, 8808, 8810, 8817, 8818, 8821, 8822, 8824, 8829, 8831, 8832, 8834, 8835, 8838, 8841, 8843, 8846, 8848, 8853, 8854, 8861, 8865, 8866, 8876, 8878, 8881, 8883, 8886, 8888, 8889, 8892, 8896, 8899, 8900, 8905, 8907, 8908, 8909, 8910, 8911, 8913, 8914, 8916, 8917, 8922, 8926, 8928, 8929, 8930, 8938, 8941, 8942, 8945, 8946, 8949, 8951, 8952, 8956, 8957, 8958, 8959, 8960, 8961, 8963, 8967, 8968, 8969, 8971, 8972, 8974, 8976, 8977, 8979, 8980, 8981, 8985, 8986, 8992, 8996, 8998, 8999, 9001, 9002, 9003, 9006, 9009, 9012, 9020, 9029, 9030, 9033, 9037, 9042, 9044, 9052, 9056, 9058, 9059, 9060, 9061, 9069, 9071, 9072, 9073, 9074, 9076, 9084, 9086, 9088, 9091, 9092, 9095, 9096, 9097, 9103, 9105, 9108, 9110, 9111, 9112, 9114, 9118, 9119, 9124, 9125, 9128, 9129, 9131, 9133, 9134, 9139, 9140, 9141, 9142, 9146, 9149, 9151, 9152, 9154, 9155, 9156, 9157, 9173, 9174, 9175, 9177, 9183, 9185, 9187, 9188, 9190, 9191, 9195, 9200, 9205, 9206, 9207, 9210, 9211, 9213, 9215, 9216, 9218, 9220, 9222, 9223, 9226, 9229, 9232, 9233, 9234, 9237, 9241, 9242, 9243, 9247, 9248, 9249, 9252, 9253, 9254, 9257, 9262, 9265, 9267, 9269, 9270, 9273, 9276, 9278, 9284, 9287, 9288, 9290, 9292, 9295, 9299, 9300, 9302, 9304, 9308, 9311, 9320, 9321, 9323, 9325, 9326, 9327, 9328, 9329, 9330, 9336, 9337, 9338, 9339, 9340, 9341, 9345, 9346, 9347, 9348, 9350, 9354, 9355, 9359, 9362, 9366, 9373, 9375, 9376, 9378, 9382, 9383, 9386, 9388, 9391, 9392, 9394, 9396, 9398, 9400, 9402, 9403, 9404, 9406, 9413, 9414, 9415, 9417, 9422, 9423, 9425, 9432, 9433, 9434, 9439, 9440, 9443, 9444, 9451, 9452, 9453, 9455, 9456, 9460, 9468, 9469, 9471, 9478, 9483, 9488, 9490, 9497, 9501, 9502, 9503, 9504, 9505, 9509, 9513, 9514, 9515, 9517, 9518, 9519, 9525, 9531, 9532, 9533, 9534, 9536, 9540, 9546, 9548, 9553, 9554, 9555, 9560, 9563, 9564, 9565, 9568, 9571, 9577, 9582, 9583, 9587, 9589, 9590, 9591, 9592, 9596, 9602, 9606, 9607, 9609, 9610, 9613, 9615, 9618, 9620, 9623, 9626, 9627, 9628, 9629, 9635, 9640, 9641, 9642, 9644, 9645, 9646, 9648, 9649, 9651, 9652, 9653, 9655, 9656, 9657, 9658, 9660, 9663, 9666, 9668, 9670, 9675, 9677, 9679, 9681, 9682, 9686, 9692, 9693, 9694, 9696, 9698, 9700, 9717, 9718, 9723, 9725, 9726, 9729, 9730, 9731, 9733, 9734, 9737, 9744, 9745, 9746, 9750, 9751, 9753, 9754, 9755, 9756, 9763, 9764, 9766, 9767, 9768, 9770, 9776, 9777, 9780, 9781, 9782, 9784, 9786, 9791, 9792, 9794, 9796, 9797, 9799, 9801, 9802, 9806, 9808, 9812, 9813, 9816, 9819, 9820, 9824, 9825, 9826, 9827, 9830, 9833, 9835, 9836, 9845, 9846, 9847, 9849, 9854, 9861, 9864, 9866, 9869, 9873, 9882, 9885, 9886, 9887, 9892, 9897, 9900, 9901, 9906, 9907, 9908, 9909, 9910, 9911, 9912, 9921, 9923, 9924, 9928, 9930, 9932, 9934, 9935, 9938, 9940, 9944, 9946, 9949, 9950, 9953, 9955, 9957, 9958, 9960, 9962, 9963, 9964, 9967, 9968, 9971, 9972, 9974, 9979, 9980, 9982, 9984, 9985, 9987, 9988, 9990, 9991, 9997, 9998, 10000, 10008, 10009, 10010, 10012, 10013, 10016, 10017, 10018, 10019, 10021, 10022, 10026, 10031, 10032, 10033, 10034, 10035, 10037, 10038, 10040, 10043, 10045, 10047, 10048, 10050, 10051, 10052, 10054, 10056, 10058, 10059, 10060, 10062, 10063, 10064, 10066, 10068, 10073, 10075, 10078, 10082, 10089, 10090, 10091, 10092, 10095, 10097, 10101, 10102, 10103, 10105, 10106, 10107, 10108, 10109, 10110, 10112, 10114, 10115, 10116, 10118, 10122, 10128, 10131, 10132, 10134, 10142, 10143, 10146, 10149, 10150, 10151, 10152, 10158, 10162, 10163, 10165, 10166, 10168, 10174, 10176, 10178, 10181, 10182, 10191, 10192, 10193, 10194, 10195, 10196, 10197, 10199, 10200, 10201, 10203, 10206, 10209, 10212, 10213, 10214, 10218, 10219, 10220, 10222, 10223, 10224, 10225, 10228, 10230, 10231, 10232, 10233, 10235, 10236, 10237, 10239, 10247, 10252, 10253, 10255, 10258, 10259, 10260, 10262, 10268, 10270, 10275, 10278, 10284, 10291, 10292, 10293, 10295, 10300, 10302, 10306, 10307, 10311, 10319, 10321, 10322, 10323, 10325, 10326, 10327, 10328, 10329, 10331, 10333, 10334, 10335, 10336, 10338, 10341, 10343, 10346, 10353, 10354, 10356, 10357, 10359, 10360, 10362, 10364, 10365, 10368, 10371, 10373, 10375, 10378, 10380, 10381, 10383, 10384, 10385, 10388, 10395, 10397, 10398, 10399, 10401, 10406, 10409, 10410, 10413, 10414, 10416, 10421, 10423, 10427, 10428, 10430, 10435, 10437, 10438, 10440, 10442, 10443, 10446, 10447, 10448, 10449, 10450, 10451, 10453, 10455, 10456, 10463, 10464, 10465, 10466, 10468, 10469, 10470, 10472, 10473, 10474, 10482, 10487, 10488, 10490, 10492, 10494, 10496, 10498, 10504, 10506, 10508, 10513, 10514, 10518, 10521, 10525, 10527, 10528, 10530, 10531, 10533, 10535, 10536, 10537, 10541, 10542, 10543, 10544, 10547, 10548, 10549, 10550, 10551, 10555, 10556, 10558, 10560, 10561, 10564, 10565, 10567, 10569, 10571, 10573, 10577, 10580, 10581, 10582, 10583, 10585, 10590, 10593, 10595, 10596, 10597, 10599, 10601, 10602, 10606, 10610, 10611, 10613, 10614, 10615, 10616, 10617, 10619, 10621, 10622, 10623, 10626, 10628, 10629, 10630, 10631, 10633, 10634, 10637, 10638, 10639, 10640, 10642, 10643, 10645, 10646, 10648, 10649, 10650, 10655, 10657, 10659, 10663, 10665, 10666, 10668, 10669, 10670, 10671, 10674, 10676, 10678, 10681, 10682, 10683, 10684, 10685, 10689, 10697, 10699, 10700, 10702, 10703, 10705, 10707, 10708, 10711, 10715, 10716, 10721, 10722, 10723, 10726, 10729, 10732, 10734, 10735, 10736, 10738, 10740, 10741, 10744, 10745, 10747, 10748, 10749, 10753, 10761, 10762, 10763, 10766, 10774, 10775, 10776, 10777, 10778, 10779, 10782, 10784, 10785, 10787, 10788, 10790, 10791, 10792, 10795, 10796, 10799, 10801, 10803, 10804, 10805, 10809, 10810, 10811, 10812, 10815, 10818, 10819, 10820, 10821, 10823, 10824, 10825, 10826, 10831, 10833, 10836, 10838, 10839, 10840, 10843, 10846, 10850, 10852, 10853, 10854, 10857, 10858, 10860, 10861, 10862, 10866, 10867, 10869, 10872, 10874, 10877, 10878, 10880, 10881, 10892, 10896, 10897, 10898, 10899, 10902, 10911, 10912, 10913, 10917, 10920, 10926, 10927, 10930, 10933, 10934, 10935, 10936, 10937, 10938, 10940, 10941, 10944, 10947, 10948, 10949, 10954, 10957, 10960, 10961, 10962, 10963, 10964, 10965, 10966, 10967, 10972, 10975, 10976, 10977, 10979, 10980, 10988, 10993, 10995, 10996, 10997, 10999, 11002, 11004, 11005, 11006, 11008, 11009, 11010, 11018, 11024, 11027, 11032, 11033, 11039, 11046, 11047, 11049, 11052, 11053, 11056, 11058, 11060, 11068, 11070, 11078, 11080, 11082, 11083, 11086, 11090, 11092, 11095, 11098, 11101, 11107, 11109, 11110, 11114, 11116, 11118, 11119, 11123, 11124, 11125, 11126, 11127, 11129, 11132, 11133, 11135, 11137, 11138, 11146, 11148, 11152, 11153, 11154, 11158, 11160, 11161, 11162, 11163, 11165, 11166, 11168, 11169, 11173, 11175, 11177, 11178, 11181, 11184, 11185, 11187, 11188, 11190, 11191, 11192, 11194, 11198, 11199, 11201, 11202, 11207, 11210, 11214, 11217, 11218, 11222, 11226, 11227, 11228, 11229, 11232, 11233, 11234, 11235, 11236, 11237, 11238, 11239, 11244, 11246, 11247, 11248, 11251, 11254, 11255, 11256, 11257, 11258, 11259, 11260, 11261, 11262, 11263, 11264, 11266, 11274, 11275, 11278, 11283, 11286, 11289, 11290, 11291, 11292, 11293, 11294, 11295, 11298, 11306, 11307, 11313, 11315, 11316, 11319, 11320, 11322, 11324, 11328, 11329, 11330, 11331, 11332, 11333, 11337, 11339, 11340, 11345, 11346, 11348, 11349, 11352, 11356, 11358, 11359, 11363, 11364, 11365, 11366, 11369, 11370, 11371, 11373, 11377, 11380, 11381, 11382, 11387, 11388, 11391, 11394, 11395, 11397, 11398, 11401, 11403, 11405, 11406, 11408, 11409, 11411, 11412, 11413, 11414, 11416, 11420, 11423, 11424, 11426, 11428, 11430, 11434, 11437, 11438, 11443, 11445, 11446, 11449, 11451, 11459, 11463, 11465, 11467, 11471, 11472, 11473, 11475, 11476, 11477, 11478, 11481, 11482, 11485, 11487, 11490, 11491, 11494, 11496, 11497, 11498, 11499, 11500, 11501, 11503, 11506, 11507, 11508, 11512, 11518, 11523, 11524, 11526, 11527, 11528, 11530, 11531, 11532, 11533, 11534, 11535, 11538, 11541, 11544, 11546, 11548, 11551, 11553, 11558, 11560, 11561, 11567, 11570, 11571, 11576, 11577, 11578, 11580, 11583, 11585, 11586, 11593, 11594, 11595, 11596, 11597, 11599, 11603, 11604, 11607, 11612, 11615, 11618, 11621, 11623, 11625, 11628, 11629, 11632, 11633, 11636, 11637, 11639, 11642, 11644, 11650, 11652, 11656, 11657, 11658, 11663, 11664, 11668, 11669, 11673, 11678, 11681, 11682, 11688, 11691, 11692, 11693, 11694, 11695, 11699, 11701, 11703, 11705, 11707, 11708, 11711, 11712, 11718, 11720, 11721, 11722, 11723, 11725, 11731, 11733, 11736, 11740, 11743, 11744, 11753, 11755, 11759, 11760, 11761, 11762, 11763, 11764, 11765, 11766, 11767, 11770, 11771, 11776, 11780, 11781, 11782, 11783, 11784, 11785, 11786, 11790, 11792, 11795, 11799, 11800, 11802, 11809, 11810, 11812, 11814, 11816, 11818, 11819, 11821, 11823, 11826, 11828, 11830, 11837, 11839, 11841, 11845, 11846, 11849, 11850, 11851, 11853, 11856, 11858, 11863, 11867, 11868, 11870, 11872, 11876, 11877, 11878, 11881, 11887, 11889, 11890, 11891, 11893, 11894, 11898, 11909, 11911, 11913, 11916, 11917, 11918, 11919, 11920, 11921, 11923, 11926, 11927, 11928, 11929, 11930, 11934, 11935, 11939, 11940, 11941, 11943, 11946, 11947, 11948, 11949, 11953, 11957, 11958, 11959, 11960, 11961, 11962, 11963, 11965, 11966, 11968, 11976, 11977, 11978, 11979, 11980, 11983, 11988, 11993, 11994, 11995, 11996, 11997, 11998, 11999, 12002, 12004, 12008, 12014, 12017, 12019, 12020, 12021, 12023, 12024, 12025, 12026, 12032, 12042, 12043, 12044, 12050, 12058, 12059, 12061, 12076, 12078, 12079, 12080, 12081, 12083, 12085, 12086, 12087, 12089, 12091, 12092, 12093, 12097, 12098, 12102, 12104, 12106, 12109, 12110, 12112, 12115, 12118, 12120, 12122, 12126, 12128, 12129, 12130, 12131, 12134, 12135, 12137, 12138, 12139, 12143, 12144, 12145, 12146, 12147, 12148, 12150, 12151, 12153, 12161, 12165, 12166, 12167, 12170, 12171, 12174, 12175, 12179, 12181, 12186, 12189, 12197, 12200, 12201, 12202, 12204, 12208, 12212, 12214, 12217, 12221, 12223, 12227, 12230, 12234, 12237, 12240, 12241, 12243, 12245, 12249, 12250, 12252, 12253, 12255, 12256, 12259, 12268, 12269, 12271, 12278, 12280, 12281, 12283, 12285, 12286, 12287, 12288, 12291, 12295, 12302, 12304, 12310, 12311, 12312, 12313, 12314, 12315, 12317, 12319, 12321, 12323, 12325, 12326, 12328, 12331, 12333, 12334, 12339, 12342, 12344, 12345, 12347, 12350, 12354, 12356, 12359, 12364, 12366, 12368, 12370, 12375, 12376, 12379, 12380, 12381, 12383, 12385, 12394, 12397, 12400, 12401, 12403, 12406, 12411, 12414, 12415, 12416, 12419, 12420, 12423, 12424, 12426, 12427, 12428, 12437, 12440, 12443, 12448, 12450, 12451, 12455, 12456, 12457, 12459, 12461, 12462, 12465, 12467, 12468, 12470, 12472, 12478, 12481, 12483, 12487, 12488, 12492, 12494, 12497, 12500, 12501, 12502, 12503, 12504, 12508, 12509, 12512, 12513, 12514, 12515, 12518, 12519, 12529, 12530, 12531, 12535, 12536, 12537, 12538, 12539, 12540, 12546, 12547, 12548, 12549, 12551, 12552, 12553, 12554, 12555, 12556, 12557, 12561, 12563, 12565, 12567, 12568, 12570, 12572, 12577, 12580, 12583, 12585, 12586, 12588, 12589, 12591, 12594, 12597, 12600, 12603, 12605, 12608, 12609, 12610, 12611, 12622, 12623, 12626, 12628, 12629, 12630, 12631, 12633, 12634, 12638, 12639, 12640, 12641, 12644, 12648, 12649, 12650, 12651, 12654, 12663, 12664, 12668, 12670, 12671, 12674, 12676, 12679, 12681, 12683, 12684, 12688, 12689, 12691, 12692, 12693, 12695, 12696, 12697, 12699, 12701, 12702, 12713, 12714, 12723, 12726, 12729, 12731, 12732, 12733, 12735, 12737, 12738, 12739, 12740, 12741, 12742, 12743, 12744, 12752, 12753, 12754, 12755, 12757, 12758, 12761, 12762, 12764, 12765, 12766, 12771, 12772, 12773, 12775, 12777, 12783, 12790, 12794, 12797, 12800, 12802, 12803, 12807, 12810, 12812, 12813, 12817, 12819, 12820, 12822, 12823, 12824, 12826, 12827, 12828, 12834, 12835, 12836, 12837, 12838, 12839, 12843, 12844, 12848, 12849, 12850, 12853, 12861, 12866, 12870, 12873, 12875, 12878, 12882, 12883, 12884, 12887, 12891, 12895, 12898, 12899, 12900, 12901, 12903, 12904, 12905, 12906, 12908, 12910, 12912, 12913, 12916, 12920, 12921, 12928, 12929, 12932, 12933, 12934, 12935, 12940, 12942, 12945, 12946, 12947, 12950, 12953, 12960, 12961, 12963, 12967, 12968, 12969, 12973, 12978, 12983, 12984, 12986, 12987, 12989, 12990, 12991, 12994, 12999, 13003, 13004, 13010, 13014, 13015, 13017, 13018, 13022, 13030, 13032, 13033, 13034, 13035, 13036, 13037, 13038, 13040, 13041, 13047, 13049, 13050, 13053, 13054, 13055, 13056, 13059, 13061, 13062, 13064, 13066, 13071, 13075, 13077, 13079, 13082, 13083, 13085, 13086, 13087, 13097, 13099, 13101, 13102, 13105, 13106, 13110, 13111, 13112, 13114, 13115, 13116, 13117, 13118, 13120, 13121, 13122, 13123, 13124, 13125, 13128, 13130, 13131, 13134, 13136, 13144, 13147, 13148, 13149, 13151, 13154, 13159, 13160, 13166, 13169, 13175, 13181, 13182, 13186, 13190, 13197, 13199, 13203, 13206, 13209, 13210, 13212, 13213, 13215, 13217, 13221, 13224, 13226, 13227, 13228, 13229, 13231, 13232, 13233, 13234, 13235, 13236, 13237, 13239, 13241, 13243, 13248, 13250, 13251, 13255, 13256, 13259, 13260, 13261, 13262, 13263, 13264, 13265, 13267, 13268, 13269, 13271, 13274, 13279, 13280, 13281, 13283, 13284, 13296, 13297, 13298, 13300, 13301, 13303, 13304, 13313, 13315, 13316, 13317, 13323, 13326, 13328, 13329, 13330, 13332, 13337, 13340, 13343, 13344, 13345, 13346, 13347, 13348, 13350, 13352, 13358, 13361, 13363, 13365, 13367, 13368, 13369, 13370, 13374, 13377, 13381, 13384, 13385, 13386, 13391, 13393, 13394, 13396, 13397, 13398, 13401, 13402, 13403, 13404, 13408, 13410, 13416, 13417, 13419, 13423, 13424, 13428, 13430, 13433, 13439, 13448, 13450, 13451, 13456, 13457, 13460, 13461, 13463, 13467, 13469, 13473, 13475, 13477, 13478, 13479, 13480, 13484, 13492, 13496, 13499, 13503, 13504, 13505, 13512, 13513, 13514, 13515, 13519, 13521, 13522, 13526, 13529, 13530, 13532, 13533, 13539, 13540, 13543, 13544, 13545, 13546, 13547, 13549, 13551, 13552, 13553, 13555, 13558, 13559, 13560, 13561, 13568, 13569, 13572, 13574, 13577, 13578, 13580, 13582, 13584, 13587, 13597, 13598, 13599, 13600, 13601, 13602, 13604, 13605, 13606, 13612, 13613, 13621, 13623, 13627, 13628, 13630, 13631, 13632, 13634, 13636, 13637, 13641, 13643, 13647, 13650, 13651, 13652, 13653, 13654, 13662, 13663, 13665, 13668, 13675, 13676, 13677, 13678, 13679, 13683, 13687, 13688, 13689, 13697, 13698, 13700, 13702, 13706, 13710, 13713, 13714, 13715, 13716, 13719, 13720, 13722, 13726, 13727, 13729, 13734, 13736, 13739, 13742, 13745, 13747, 13750, 13753, 13756, 13761, 13764, 13767, 13769, 13772, 13773, 13774, 13775, 13777, 13779, 13780, 13782, 13783, 13786, 13787, 13791, 13793, 13794, 13796, 13798, 13799, 13807, 13809, 13816, 13817, 13818, 13819, 13822, 13823, 13828, 13830, 13831, 13834, 13835, 13840, 13843, 13849, 13852, 13853, 13860, 13862, 13866, 13869, 13870, 13872, 13873, 13875, 13877, 13879, 13885, 13887, 13888, 13891, 13892, 13895, 13897, 13898, 13901, 13906, 13907, 13908, 13909, 13910, 13911, 13917, 13918, 13919, 13920, 13921, 13924, 13925, 13929, 13930, 13934, 13938, 13943, 13944, 13947, 13949, 13950, 13953, 13954, 13958, 13960, 13961, 13963, 13969, 13970, 13971, 13975, 13981, 13983, 13984, 13985, 13986, 13987, 13990, 13991, 13999, 14000, 14001, 14002, 14005, 14006, 14008, 14009, 14013, 14014, 14017, 14018, 14021, 14022, 14027, 14030, 14031, 14035, 14038, 14040, 14049, 14052, 14059, 14062, 14063, 14066, 14067, 14069, 14070, 14071, 14072, 14073, 14074, 14075, 14081, 14084, 14085, 14086, 14088, 14091, 14092, 14093, 14094, 14096, 14111, 14112, 14114, 14115, 14116, 14118, 14119, 14122, 14124, 14129, 14130, 14132, 14133, 14135, 14137, 14138, 14139, 14140, 14142, 14143, 14145, 14146, 14147.

Promoters expressing in the kernel at 7 days after pollination include SEQ IDs: 3, 4, 7, 8, 12, 13, 14, 15, 16, 17, 19, 20, 27, 29, 33, 34, 36, 37, 38, 45, 48, 51, 54, 57, 61, 63, 64, 65, 69, 70, 71, 72, 73, 79, 88, 90, 93, 94, 96, 98, 99, 102, 103, 104, 108, 110, 111, 112, 115, 117, 123, 126, 130, 131, 141, 143, 148, 152, 154, 155, 162, 165, 168, 172, 174, 176, 179, 181, 183, 187, 191, 193, 194, 196, 197, 199, 202, 204, 205, 207, 210, 211, 212, 214, 217, 232, 233, 235, 236, 237, 239, 240, 242, 244, 246, 249, 250, 251, 256, 257, 259, 264, 267, 269, 270, 271, 273, 280, 281, 286, 288, 289, 293, 298, 299, 301, 302, 305, 306, 308, 309, 314, 316, 319, 322, 323, 328, 329, 332, 334, 335, 338, 339, 340, 346, 348, 349, 352, 353, 354, 355, 356, 357, 360, 365, 367, 371, 372, 373, 374, 378, 379, 381, 387, 388, 396, 401, 405, 406, 407, 411, 412, 414, 423, 424, 428, 432, 433, 434, 436, 441, 448, 450, 452, 456, 461, 462, 463, 468, 470, 471, 474, 478, 479, 483, 485, 488, 489, 496, 498, 501, 504, 505, 507, 509, 510, 514, 515, 516, 517, 522, 523, 525, 528, 532, 537, 538, 541, 543, 544, 546, 547, 548, 554, 557, 561, 563, 573, 578, 580, 582, 585, 591, 594, 595, 596, 598, 599, 601, 602, 606, 607, 608, 613, 614, 619, 620, 630, 631, 633, 634, 635, 636, 637, 638, 642, 643, 650, 655, 662, 663, 666, 667, 668, 670, 671, 680, 681, 683, 687, 693, 694, 695, 701, 702, 705, 706, 707, 708, 716, 717, 718, 719, 722, 723, 724, 727, 731, 732, 734, 736, 740, 741, 742, 744, 749, 752, 753, 757, 758, 759, 760, 761, 762, 764, 765, 770, 771, 779, 781, 782, 783, 784, 786, 792, 793, 800, 804, 806, 808, 809, 811, 812, 819, 820, 821, 822, 824, 825, 826, 827, 829, 830, 833, 840, 849, 855, 856, 857, 858, 860, 862, 863, 865, 870, 871, 875, 876, 877, 882, 883, 887, 890, 892, 893, 895, 897, 898, 899, 900, 903, 907, 908, 910, 911, 912, 913, 915, 916, 917, 919, 924, 925, 928, 932, 934, 936, 943, 944, 951, 953, 955, 957, 958, 960, 964, 971, 974, 975, 976, 978, 979, 980, 982, 983, 984, 987, 988, 991, 994, 995, 996, 997, 999, 1003, 1005, 1006, 1007, 1008, 1009, 1010, 1011, 1012, 1013, 1014, 1016, 1025, 1026, 1032, 1035, 1038, 1040, 1041, 1042, 1043, 1045, 1046, 1047, 1049, 1051, 1052, 1055, 1056, 1057, 1064, 1065, 1068, 1069, 1070, 1073, 1074, 1076, 1077, 1078, 1080, 1085, 1086, 1087, 1088, 1089, 1092, 1095, 1096, 1100, 1101, 1103, 1104, 1110, 1112, 1114, 1115, 1116, 1117, 1119, 1120, 1121, 1125, 1127, 1130, 1132, 1136, 1137, 1140, 1143, 1146, 1148, 1154, 1160, 1161, 1162, 1165, 1167, 1168, 1170, 1171, 1176, 1178, 1183, 1189, 1190, 1191, 1196, 1198, 1200, 1201, 1204, 1214, 1215, 1217, 1218, 1220, 1223, 1225, 1228, 1230, 1231, 1232, 1233, 1236, 1240, 1243, 1248, 1249, 1251, 1253, 1254, 1258, 1261, 1263, 1269, 1277, 1281, 1285, 1286, 1290, 1291, 1292, 1293, 1296, 1301, 1303, 1306, 1307, 1309, 1311, 1316, 1320, 1322, 1323, 1327, 1331, 1334, 1339, 1345, 1347, 1349, 1354, 1355, 1360, 1364, 1366, 1367, 1368, 1371, 1375, 1376, 1377, 1380, 1381, 1387, 1388, 1389, 1391, 1393, 1394, 1396, 1398, 1399, 1404, 1406, 1411, 1420, 1421, 1423, 1426, 1431, 1432, 1433, 1438, 1441, 1442, 1447, 1448, 1451, 1453, 1458, 1459, 1461, 1462, 1464, 1466, 1467, 1468, 1471, 1472, 1474, 1475, 1484, 1488, 1490, 1492, 1493, 1498, 1499, 1501, 1503, 1508, 1510, 1511, 1514, 1518, 1519, 1525, 1526, 1527, 1528, 1530, 1536, 1539, 1543, 1545, 1546, 1549, 1550, 1551, 1553, 1554, 1555, 1556, 1560, 1561, 1563, 1564, 1567, 1570, 1571, 1575, 1576, 1578, 1579, 1582, 1584, 1586, 1590, 1591, 1597, 1598, 1599, 1600, 1601, 1602, 1604, 1605, 1608, 1609, 1610, 1612, 1614, 1615, 1616, 1617, 1622, 1623, 1625, 1632, 1634, 1635, 1637, 1638, 1642, 1643, 1650, 1654, 1658, 1659, 1662, 1663, 1668, 1669, 1671, 1673, 1675, 1676, 1677, 1678, 1681, 1682, 1684, 1685, 1687, 1689, 1690, 1691, 1696, 1697, 1698, 1699, 1703, 1705, 1706, 1707, 1708, 1710, 1712, 1716, 1717, 1718, 1719, 1720, 1725, 1729, 1732, 1735, 1736, 1749, 1750, 1755, 1759, 1761, 1764, 1769, 1773, 1776, 1778, 1785, 1786, 1791, 1792, 1793, 1798, 1807, 1809, 1811, 1813, 1823, 1826, 1828, 1830, 1832, 1834, 1835, 1837, 1839, 1840, 1846, 1848, 1851, 1852, 1854, 1855, 1859, 1861, 1863, 1866, 1867, 1868, 1869, 1872, 1876, 1879, 1880, 1882, 1886, 1888, 1891, 1894, 1897, 1898, 1899, 1900, 1902, 1905, 1906, 1910, 1911, 1915, 1916, 1918, 1920, 1922, 1923, 1924, 1928, 1930, 1931, 1933, 1934, 1936, 1939, 1940, 1945, 1949, 1950, 1951, 1952, 1953, 1954, 1958, 1968, 1970, 1971, 1972, 1973, 1977, 1986, 1990, 1991, 1993, 1994, 1995, 1996, 1999, 2000, 2001, 2003, 2007, 2009, 2010, 2012, 2014, 2015, 2016, 2017, 2019, 2021, 2031, 2032, 2034, 2037, 2040, 2041, 2043, 2045, 2048, 2058, 2060, 2062, 2064, 2066, 2072, 2074, 2077, 2078, 2088, 2089, 2091, 2093, 2094, 2097, 2099, 2103, 2104, 2106, 2107, 2111, 2112, 2119, 2122, 2123, 2125, 2126, 2130, 2132, 2133, 2137, 2139, 2140, 2142, 2143, 2144, 2146, 2147, 2150, 2151, 2154, 2155, 2156, 2157, 2159, 2161, 2164, 2166, 2167, 2168, 2170, 2173, 2175, 2177, 2179, 2183, 2185, 2188, 2189, 2190, 2193, 2196, 2200, 2202, 2203, 2205, 2206, 2207, 2210, 2213, 2215, 2216, 2218, 2221, 2222, 2223, 2226, 2227, 2237, 2240, 2241, 2242, 2243, 2244, 2253, 2257, 2260, 2263, 2265, 2267, 2274, 2276, 2278, 2280, 2282, 2284, 2288, 2289, 2291, 2296, 2297, 2298, 2300, 2303, 2304, 2305, 2308, 2309, 2310, 2314, 2320, 2322, 2323, 2328, 2329, 2331, 2333, 2337, 2339, 2342, 2348, 2353, 2358, 2363, 2366, 2367, 2369, 2371, 2372, 2379, 2380, 2381, 2382, 2384, 2387, 2395, 2398, 2399, 2400, 2401, 2402, 2403, 2405, 2410, 2412, 2413, 2414, 2417, 2418, 2419, 2420, 2422, 2423, 2426, 2428, 2430, 2433, 2435, 2437, 2439, 2440, 2441, 2442, 2443, 2445, 2446, 2449, 2451, 2452, 2453, 2454, 2456, 2457, 2458, 2465, 2466, 2469, 2470, 2471, 2472, 2474, 2476, 2477, 2479, 2480, 2481, 2482, 2485, 2487, 2489, 2490, 2492, 2494, 2495, 2496, 2498, 2500, 2505, 2506, 2507, 2509, 2513, 2514, 2515, 2516, 2517, 2519, 2522, 2525, 2528, 2529, 2531, 2532, 2533, 2536, 2537, 2538, 2539, 2541, 2544, 2545, 2546, 2549, 2550, 2551, 2552, 2555, 2556, 2557, 2559, 2567, 2568, 2570, 2571, 2573, 2578, 2579, 2581, 2583, 2589, 2590, 2596, 2599, 2601, 2605, 2609, 2611, 2613, 2616, 2617, 2620, 2622, 2625, 2626, 2627, 2632, 2634, 2635, 2639, 2644, 2645, 2648, 2649, 2652, 2655, 2658, 2661, 2662, 2663, 2670, 2671, 2672, 2674, 2676, 2678, 2679, 2684, 2685, 2687, 2689, 2690, 2691, 2692, 2694, 2696, 2700, 2702, 2704, 2708, 2711, 2715, 2719, 2720, 2722, 2725, 2727, 2728, 2729, 2730, 2735, 2737, 2738, 2739, 2744, 2746, 2747, 2749, 2752, 2755, 2756, 2757, 2763, 2764, 2765, 2770, 2775, 2776, 2779, 2784, 2785, 2787, 2789, 2796, 2798, 2800, 2801, 2802, 2805, 2808, 2812, 2814, 2816, 2819, 2821, 2822, 2823, 2824, 2826, 2827, 2828, 2831, 2832, 2833, 2837, 2840, 2844, 2845, 2850, 2857, 2860, 2861, 2862, 2865, 2869, 2871, 2876, 2878, 2888, 2889, 2890, 2892, 2893, 2894, 2896, 2897, 2902, 2903, 2906, 2908, 2909, 2914, 2915, 2916, 2917, 2918, 2919, 2922, 2923, 2926, 2929, 2930, 2931, 2932, 2933, 2934, 2935, 2938, 2941, 2942, 2943, 2944, 2946, 2947, 2948, 2955, 2959, 2960, 2963, 2966, 2968, 2976, 2979, 2980, 2986, 2987, 2992, 2994, 3003, 3005, 3007, 3008, 3013, 3015, 3017, 3020, 3023, 3024, 3027, 3029, 3031, 3039, 3041, 3042, 3043, 3044, 3045, 3047, 3048, 3049, 3051, 3052, 3053, 3055, 3058, 3059, 3064, 3067, 3068, 3070, 3072, 3075, 3080, 3083, 3084, 3085, 3087, 3090, 3095, 3096, 3100, 3101, 3106, 3112, 3113, 3115, 3118, 3119, 3120, 3121, 3122, 3123, 3126, 3127, 3128, 3129, 3138, 3139, 3141, 3143, 3145, 3153, 3157, 3158, 3167, 3169, 3170, 3171, 3172, 3177, 3181, 3185, 3187, 3189, 3191, 3192, 3194, 3196, 3200, 3202, 3205, 3206, 3208, 3210, 3217, 3218, 3219, 3220, 3221, 3224, 3225, 3227, 3228, 3230, 3231, 3232, 3237, 3240, 3242, 3244, 3247, 3249, 3252, 3254, 3255, 3261, 3263, 3266, 3267, 3268, 3269, 3271, 3272, 3280, 3286, 3288, 3289, 3290, 3291, 3294, 3295, 3297, 3299, 3301, 3303, 3308, 3310, 3312, 3313, 3324, 3327, 3331, 3332, 3333, 3337, 3338, 3340, 3342, 3343, 3345, 3346, 3347, 3351, 3353, 3354, 3355, 3356, 3357, 3361, 3363, 3370, 3374, 3376, 3377, 3378, 3383, 3386, 3394, 3396, 3399, 3402, 3403, 3404, 3405, 3411, 3413, 3416, 3418, 3419, 3422, 3424, 3426, 3427, 3428, 3435, 3438, 3442, 3445, 3446, 3447, 3449, 3450, 3451, 3452, 3453, 3455, 3458, 3461, 3462, 3465, 3466, 3468, 3469, 3470, 3471, 3474, 3477, 3483, 3484, 3486, 3488, 3490, 3491, 3493, 3497, 3498, 3500, 3501, 3502, 3503, 3504, 3507, 3510, 3515, 3516, 3523, 3524, 3529, 3533, 3535, 3536, 3537, 3538, 3540, 3541, 3544, 3545, 3548, 3549, 3554, 3558, 3560, 3561, 3562, 3569, 3571, 3574, 3576, 3577, 3580, 3587, 3588, 3589, 3591, 3592, 3594, 3595, 3600, 3601, 3603, 3604, 3607, 3611, 3613, 3615, 3616, 3618, 3619, 3620, 3621, 3624, 3627, 3628, 3629, 3630, 3631, 3633, 3634, 3640, 3642, 3643, 3644, 3645, 3646, 3648, 3650, 3655, 3657, 3659, 3660, 3661, 3667, 3672, 3674, 3677, 3681, 3682, 3684, 3685, 3690, 3702, 3704, 3706, 3707, 3709, 3710, 3713, 3715, 3717, 3718, 3720, 3721, 3725, 3730, 3731, 3744, 3748, 3749, 3751, 3752, 3756, 3757, 3758, 3760, 3764, 3765, 3766, 3772, 3773, 3775, 3777, 3778, 3785, 3791, 3792, 3793, 3798, 3801, 3806, 3808, 3809, 3812, 3817, 3818, 3819, 3820, 3823, 3825, 3828, 3830, 3831, 3832, 3833, 3837, 3838, 3843, 3844, 3845, 3846, 3849, 3852, 3858, 3859, 3867, 3868, 3870, 3871, 3872, 3873, 3876, 3877, 3881, 3882, 3883, 3884, 3887, 3889, 3892, 3894, 3895, 3896, 3898, 3902, 3904, 3907, 3908, 3912, 3913, 3917, 3918, 3924, 3926, 3928, 3929, 3933, 3934, 3938, 3940, 3941, 3943, 3947, 3950, 3954, 3958, 3962, 3964, 3967, 3968, 3970, 3971, 3974, 3975, 3978, 3983, 3985, 3988, 3990, 3994, 3995, 3996, 3997, 4000, 4007, 4008, 4013, 4014, 4019, 4020, 4021, 4030, 4033, 4037, 4039, 4040, 4041, 4042, 4043, 4046, 4047, 4048, 4049, 4050, 4051, 4052, 4053, 4054, 4056, 4057, 4062, 4066, 4068, 4070, 4071, 4072, 4075, 4084, 4088, 4092, 4094, 4095, 4096, 4098, 4099, 4102, 4105, 4106, 4109, 4110, 4111, 4113, 4116, 4124, 4128, 4132, 4133, 4135, 4139, 4140, 4143, 4144, 4146, 4147, 4148, 4149, 4155, 4160, 4161, 4162, 4163, 4164, 4165, 4171, 4173, 4175, 4178, 4179, 4185, 4187, 4188, 4189, 4191, 4192, 4193, 4201, 4202, 4204, 4205, 4206, 4207, 4208, 4210, 4211, 4212, 4213, 4215, 4218, 4219, 4221, 4227, 4228, 4229, 4233, 4234, 4235, 4244, 4245, 4246, 4250, 4251, 4255, 4257, 4261, 4263, 4266, 4269, 4270, 4272, 4275, 4276, 4277, 4279, 4280, 4284, 4290, 4292, 4294, 4296, 4298, 4300, 4301, 4302, 4304, 4305, 4306, 4309, 4312, 4317, 4320, 4321, 4324, 4329, 4330, 4335, 4337, 4339, 4341, 4344, 4347, 4355, 4356, 4357, 4358, 4359, 4360, 4366, 4369, 4370, 4375, 4377, 4378, 4380, 4383, 4388, 4390, 4391, 4393, 4396, 4397, 4401, 4402, 4403, 4404, 4405, 4409, 4410, 4422, 4423, 4425, 4430, 4436, 4439, 4440, 4442, 4443, 4446, 4448, 4449, 4450, 4453, 4456, 4461, 4462, 4463, 4464, 4466, 4468, 4470, 4471, 4474, 4475, 4479, 4486, 4490, 4492, 4494, 4498, 4500, 4502, 4507, 4508, 4509, 4512, 4514, 4515, 4518, 4519, 4521, 4522, 4531, 4532, 4535, 4548, 4549, 4551, 4554, 4555, 4556, 4557, 4558, 4560, 4562, 4563, 4565, 4566, 4567, 4568, 4575, 4576, 4580, 4582, 4583, 4590, 4591, 4593, 4594, 4597, 4598, 4601, 4604, 4606, 4614, 4616, 4618, 4623, 4625, 4628, 4630, 4632, 4636, 4639, 4641, 4643, 4644, 4645, 4646, 4647, 4650, 4651, 4653, 4654, 4655, 4656, 4657, 4659, 4664, 4667, 4669, 4671, 4672, 4673, 4674, 4676, 4677, 4680, 4682, 4684, 4685, 4691, 4692, 4696, 4697, 4700, 4703, 4706, 4708, 4711, 4713, 4714, 4715, 4719, 4721, 4723, 4729, 4730, 4734, 4736, 4737, 4738, 4739, 4741, 4745, 4746, 4748, 4749, 4750, 4753, 4755, 4756, 4761, 4762, 4763, 4769, 4770, 4771, 4773, 4775, 4779, 4780, 4784, 4787, 4788, 4789, 4790, 4791, 4794, 4795, 4801, 4804, 4805, 4806, 4807, 4813, 4816, 4817, 4818, 4822, 4827, 4828, 4830, 4831, 4834, 4838, 4841, 4842, 4845, 4854, 4855, 4856, 4857, 4859, 4861, 4862, 4863, 4864, 4869, 4871, 4874, 4875, 4876, 4880, 4881, 4887, 4889, 4891, 4896, 4900, 4902, 4904, 4905, 4909, 4910, 4914, 4921, 4922, 4923, 4924, 4931, 4935, 4936, 4938, 4941, 4942, 4943, 4950, 4954, 4958, 4959, 4963, 4967, 4969, 4971, 4972, 4974, 4975, 4977, 4985, 4987, 4988, 4989, 4990, 4993, 4994, 4996, 5000, 5007, 5014, 5015, 5016, 5021, 5022, 5024, 5026, 5029, 5030, 5034, 5036, 5037, 5038, 5039, 5040, 5042, 5043, 5044, 5045, 5046, 5051, 5052, 5054, 5057, 5060, 5061, 5067, 5072, 5074, 5075, 5077, 5078, 5079, 5082, 5084, 5088, 5089, 5090, 5091, 5094, 5095, 5099, 5100, 5102, 5108, 5109, 5111, 5114, 5115, 5116, 5119, 5120, 5122, 5125, 5129, 5131, 5132, 5140, 5147, 5151, 5157, 5159, 5160, 5164, 5165, 5168, 5169, 5170, 5174, 5180, 5181, 5184, 5185, 5188, 5189, 5190, 5191, 5192, 5196, 5198, 5200, 5202, 5203, 5206, 5212, 5213, 5216, 5217, 5218, 5219, 5225, 5226, 5228, 5229, 5230, 5234, 5241, 5243, 5244, 5245, 5247, 5249, 5253, 5254, 5256, 5257, 5258, 5260, 5261, 5263, 5268, 5269, 5273, 5275, 5276, 5279, 5280, 5281, 5282, 5283, 5286, 5287, 5291, 5293, 5297, 5298, 5299, 5300, 5301, 5308, 5311, 5315, 5317, 5319, 5321, 5324, 5327, 5329, 5330, 5332, 5333, 5334, 5338, 5339, 5342, 5343, 5345, 5346, 5348, 5350, 5351, 5352, 5359, 5360, 5361, 5366, 5367, 5371, 5386, 5388, 5389, 5391, 5393, 5395, 5396, 5397, 5398, 5402, 5405, 5409, 5411, 5413, 5414, 5417, 5418, 5422, 5426, 5427, 5428, 5430, 5431, 5433, 5434, 5437, 5438, 5445, 5446, 5448, 5449, 5452, 5453, 5456, 5458, 5459, 5461, 5471, 5472, 5475, 5476, 5482, 5483, 5485, 5487, 5488, 5491, 5493, 5495, 5496, 5497, 5505, 5506, 5508, 5510, 5513, 5515, 5517, 5518, 5519, 5524, 5526, 5529, 5530, 5532, 5534, 5535, 5543, 5545, 5549, 5554, 5557, 5562, 5563, 5566, 5568, 5569, 5572, 5575, 5579, 5581, 5582, 5583, 5584, 5585, 5586, 5589, 5591, 5593, 5594, 5597, 5608, 5612, 5613, 5614, 5615, 5616, 5620, 5621, 5623, 5627, 5632, 5633, 5635, 5638, 5640, 5643, 5647, 5648, 5651, 5652, 5653, 5655, 5656, 5657, 5659, 5660, 5662, 5663, 5664, 5669, 5670, 5671, 5680, 5681, 5689, 5690, 5694, 5695, 5697, 5698, 5702, 5706, 5709, 5711, 5718, 5719, 5721, 5722, 5723, 5729, 5730, 5731, 5732, 5734, 5735, 5736, 5742, 5744, 5751, 5757, 5764, 5768, 5770, 5773, 5775, 5778, 5780, 5784, 5785, 5788, 5791, 5792, 5794, 5805, 5808, 5810, 5816, 5820, 5823, 5826, 5832, 5834, 5835, 5836, 5837, 5842, 5844, 5853, 5854, 5859, 5864, 5867, 5868, 5869, 5871, 5872, 5876, 5877, 5878, 5879, 5881, 5882, 5883, 5884, 5887, 5888, 5889, 5892, 5893, 5900, 5901, 5902, 5906, 5907, 5910, 5912, 5918, 5919, 5921, 5922, 5923, 5925, 5927, 5928, 5930, 5931, 5932, 5933, 5936, 5938, 5939, 5940, 5941, 5942, 5944, 5946, 5947, 5948, 5951, 5952, 5954, 5956, 5957, 5959, 5961, 5967, 5968, 5971, 5978, 5979, 5980, 5984, 5985, 5986, 5988, 5989, 5990, 5991, 5992, 5994, 5996, 5997, 6000, 6002, 6004, 6006, 6007, 6010, 6012, 6013, 6016, 6017, 6023, 6025, 6026, 6038, 6040, 6041, 6043, 6044, 6047, 6048, 6051, 6054, 6058, 6059, 6060, 6062, 6063, 6065, 6068, 6069, 6070, 6072, 6073, 6074, 6075, 6080, 6084, 6085, 6088, 6089, 6090, 6092, 6093, 6094, 6095, 6098, 6107, 6108, 6109, 6112, 6113, 6116, 6118, 6119, 6120, 6122, 6129, 6130, 6131, 6132, 6133, 6135, 6136, 6137, 6143, 6145, 6146, 6147, 6149, 6151, 6153, 6156, 6157, 6158, 6160, 6163, 6164, 6165, 6168, 6180, 6181, 6182, 6183, 6184, 6186, 6188, 6189, 6191, 6193, 6197, 6198, 6200, 6203, 6205, 6207, 6209, 6212, 6213, 6215, 6220, 6221, 6223, 6224, 6226, 6227, 6228, 6230, 6231, 6234, 6237, 6238, 6240, 6243, 6245, 6246, 6247, 6248, 6249, 6250, 6251, 6255, 6257, 6258, 6259, 6264, 6265, 6272, 6273, 6275, 6278, 6279, 6280, 6281, 6282, 6286, 6288, 6291, 6292, 6294, 6295, 6296, 6299, 6300, 6302, 6303, 6309, 6310, 6312, 6315, 6317, 6319, 6321, 6322, 6323, 6325, 6326, 6328, 6330, 6333, 6338, 6346, 6351, 6352, 6353, 6354, 6356, 6358, 6360, 6362, 6363, 6364, 6367, 6370, 6372, 6375, 6376, 6378, 6381, 6383, 6388, 6394, 6395, 6396, 6397, 6398, 6399, 6403, 6405, 6407, 6408, 6410, 6413, 6414, 6415, 6419, 6420, 6422, 6429, 6430, 6431, 6434, 6436, 6437, 6440, 6441, 6442, 6452, 6454, 6459, 6463, 6464, 6466, 6467, 6469, 6470, 6471, 6474, 6476, 6480, 6482, 6484, 6488, 6492, 6495, 6499, 6500, 6501, 6502, 6503, 6504, 6505, 6510, 6513, 6514, 6516, 6517, 6519, 6524, 6525, 6526, 6530, 6534, 6535, 6537, 6539, 6543, 6544, 6547, 6549, 6554, 6555, 6558, 6560, 6561, 6563, 6564, 6567, 6569, 6572, 6574, 6576, 6577, 6579, 6581, 6582, 6584, 6587, 6588, 6589, 6592, 6595, 6597, 6598, 6599, 6607, 6609, 6610, 6611, 6614, 6620, 6621, 6624, 6625, 6626, 6627, 6628, 6629, 6630, 6634, 6635, 6637, 6639, 6643, 6644, 6646, 6647, 6649, 6650, 6655, 6662, 6666, 6671, 6672, 6673, 6677, 6681, 6696, 6699, 6703, 6705, 6706, 6710, 6711, 6714, 6716, 6718, 6720, 6724, 6725, 6729, 6730, 6731, 6734, 6736, 6737, 6739, 6746, 6747, 6748, 6752, 6756, 6757, 6759, 6761, 6766, 6778, 6779, 6780, 6782, 6783, 6786, 6788, 6793, 6795, 6797, 6799, 6803, 6804, 6805, 6807, 6810, 6811, 6812, 6813, 6816, 6819, 6820, 6821, 6824, 6827, 6828, 6830, 6831, 6834, 6836, 6839, 6840, 6841, 6842, 6843, 6845, 6847, 6851, 6852, 6859, 6860, 6863, 6869, 6872, 6874, 6875, 6876, 6877, 6878, 6879, 6880, 6886, 6887, 6888, 6890, 6894, 6895, 6897, 6902, 6903, 6906, 6907, 6909, 6913, 6914, 6915, 6917, 6919, 6921, 6922, 6923, 6924, 6930, 6933, 6936, 6941, 6943, 6944, 6946, 6948, 6950, 6951, 6952, 6954, 6955, 6959, 6966, 6967, 6969, 6970, 6979, 6980, 6984, 6985, 6987, 6988, 6990, 6991, 6993, 6994, 6995, 6996, 6997, 6999, 7002, 7003, 7006, 7009, 7011, 7013, 7015, 7016, 7017, 7022, 7032, 7038, 7039, 7042, 7043, 7045, 7046, 7050, 7051, 7052, 7053, 7056, 7057, 7064, 7067, 7068, 7069, 7077, 7079, 7083, 7085, 7086, 7094, 7096, 7097, 7103, 7105, 7106, 7107, 7108, 7112, 7113, 7116, 7117, 7118, 7119, 7124, 7129, 7130, 7132, 7135, 7140, 7142, 7144, 7146, 7149, 7151, 7155, 7163, 7164, 7165, 7166, 7169, 7173, 7176, 7177, 7182, 7184, 7187, 7188, 7192, 7194, 7196, 7197, 7201, 7202, 7203, 7206, 7207, 7208, 7209, 7212, 7213, 7216, 7217, 7219, 7220, 7227, 7228, 7230, 7231, 7232, 7233, 7234, 7236, 7239, 7240, 7241, 7244, 7245, 7247, 7248, 7249, 7250, 7255, 7257, 7258, 7259, 7262, 7267, 7268, 7274, 7277, 7279, 7281, 7282, 7287, 7288, 7290, 7291, 7292, 7293, 7298, 7299, 7300, 7301, 7303, 7304, 7305, 7306, 7307, 7308, 7313, 7315, 7317, 7328, 7330, 7331, 7334, 7336, 7338, 7344, 7348, 7350, 7351, 7353, 7354, 7355, 7357, 7358, 7363, 7365, 7371, 7373, 7375, 7377, 7380, 7381, 7382, 7383, 7385, 7386, 7388, 7389, 7392, 7396, 7398, 7399, 7400, 7409, 7410, 7411, 7417, 7425, 7427, 7428, 7430, 7431, 7433, 7434, 7435, 7436, 7438, 7441, 7443, 7444, 7446, 7447, 7448, 7452, 7454, 7458, 7459, 7464, 7466, 7470, 7483, 7486, 7490, 7492, 7493, 7494, 7498, 7501, 7502, 7504, 7505, 7506, 7512, 7515, 7517, 7523, 7524, 7525, 7528, 7529, 7533, 7537, 7538, 7547, 7554, 7560, 7561, 7570, 7574, 7577, 7578, 7579, 7580, 7582, 7585, 7586, 7587, 7589, 7590, 7594, 7595, 7598, 7605, 7611, 7613, 7619, 7620, 7621, 7623, 7624, 7632, 7633, 7638, 7639, 7642, 7643, 7647, 7652, 7658, 7661, 7663, 7664, 7665, 7674, 7676, 7677, 7678, 7679, 7680, 7682, 7686, 7687, 7689, 7695, 7700, 7703, 7704, 7712, 7713, 7716, 7718, 7719, 7724, 7725, 7726, 7727, 7729, 7730, 7733, 7734, 7736, 7737, 7738, 7743, 7744, 7745, 7747, 7751, 7753, 7755, 7761, 7762, 7763, 7764, 7767, 7768, 7769, 7770, 7772, 7774, 7775, 7779, 7780, 7781, 7785, 7786, 7788, 7791, 7792, 7793, 7796, 7798, 7800, 7802, 7803, 7804, 7806, 7807, 7812, 7815, 7819, 7820, 7823, 7824, 7825, 7832, 7833, 7834, 7838, 7841, 7844, 7845, 7847, 7848, 7854, 7856, 7858, 7859, 7860, 7862, 7863, 7865, 7870, 7873, 7876, 7878, 7881, 7890, 7896, 7900, 7908, 7910, 7911, 7918, 7921, 7923, 7925, 7928, 7933, 7934, 7935, 7936, 7937, 7938, 7942, 7944, 7945, 7946, 7947, 7948, 7949, 7950, 7955, 7956, 7962, 7964, 7965, 7966, 7967, 7971, 7972, 7974, 7976, 7977, 7978, 7980, 7984, 7986, 7988, 7993, 7998, 8002, 8004, 8005, 8006, 8007, 8009, 8012, 8021, 8026, 8035, 8039, 8042, 8043, 8044, 8045, 8047, 8048, 8052, 8053, 8056, 8058, 8059, 8063, 8065, 8067, 8068, 8071, 8076, 8077, 8078, 8079, 8080, 8082, 8083, 8084, 8087, 8088, 8093, 8095, 8099, 8100, 8102, 8103, 8105, 8106, 8112, 8116, 8118, 8123, 8124, 8126, 8136, 8137, 8145, 8146, 8150, 8151, 8154, 8156, 8159, 8162, 8163, 8164, 8165, 8168, 8170, 8177, 8178, 8179, 8181, 8182, 8184, 8185, 8187, 8188, 8189, 8192, 8193, 8199, 8202, 8204, 8207, 8208, 8210, 8211, 8213, 8216, 8219, 8220, 8222, 8223, 8224, 8225, 8227, 8234, 8235, 8236, 8237, 8239, 8240, 8241, 8242, 8245, 8250, 8252, 8253, 8257, 8258, 8262, 8265, 8266, 8268, 8269, 8270, 8272, 8274, 8282, 8289, 8291, 8292, 8293, 8294, 8295, 8300, 8301, 8304, 8306, 8310, 8311, 8312, 8318, 8319, 8320, 8321, 8329, 8331, 8339, 8340, 8347, 8349, 8350, 8351, 8352, 8353, 8355, 8361, 8367, 8368, 8369, 8373, 8378, 8379, 8385, 8386, 8387, 8389, 8390, 8392, 8393, 8395, 8396, 8398, 8401, 8402, 8403, 8404, 8405, 8407, 8410, 8411, 8413, 8414, 8416, 8417, 8418, 8427, 8428, 8430, 8432, 8433, 8435, 8436, 8438, 8439, 8441, 8442, 8444, 8446, 8447, 8448, 8449, 8456, 8458, 8459, 8469, 8470, 8471, 8472, 8473, 8474, 8476, 8477, 8480, 8481, 8482, 8485, 8486, 8490, 8493, 8498, 8501, 8502, 8505, 8507, 8509, 8511, 8513, 8515, 8517, 8520, 8523, 8524, 8525, 8527, 8528, 8531, 8532, 8533, 8539, 8541, 8542, 8544, 8546, 8549, 8550, 8553, 8554, 8557, 8558, 8561, 8562, 8565, 8566, 8568, 8575, 8576, 8579, 8581, 8582, 8583, 8584, 8589, 8590, 8592, 8593, 8594, 8595, 8596, 8597, 8598, 8599, 8600, 8601, 8602, 8603, 8604, 8605, 8610, 8611, 8612, 8614, 8617, 8618, 8624, 8631, 8634, 8637, 8638, 8639, 8640, 8642, 8644, 8647, 8648, 8650, 8652, 8654, 8657, 8658, 8659, 8660, 8663, 8665, 8666, 8669, 8670, 8672, 8675, 8676, 8677, 8685, 8693, 8700, 8703, 8704, 8706, 8708, 8709, 8712, 8713, 8716, 8717, 8719, 8720, 8728, 8729, 8731, 8732, 8734, 8735, 8736, 8740, 8741, 8742, 8744, 8745, 8746, 8748, 8752, 8753, 8757, 8760, 8761, 8764, 8769, 8770, 8772, 8773, 8775, 8776, 8777, 8779, 8782, 8783, 8784, 8789, 8790, 8792, 8797, 8804, 8805, 8808, 8810, 8817, 8818, 8821, 8822, 8824, 8829, 8831, 8832, 8834, 8835, 8838, 8841, 8843, 8846, 8848, 8853, 8854, 8861, 8865, 8866, 8876, 8878, 8881, 8883, 8886, 8888, 8889, 8891, 8892, 8893, 8896, 8899, 8900, 8905, 8907, 8908, 8910, 8911, 8913, 8914, 8916, 8917, 8922, 8924, 8926, 8928, 8929, 8930, 8935, 8938, 8940, 8941, 8942, 8945, 8946, 8949, 8951, 8952, 8956, 8957, 8958, 8960, 8963, 8967, 8968, 8969, 8971, 8972, 8974, 8976, 8977, 8979, 8980, 8981, 8985, 8986, 8991, 8992, 8996, 8998, 8999, 9001, 9002, 9003, 9006, 9009, 9012, 9013, 9018, 9020, 9023, 9029, 9030, 9033, 9037, 9042, 9044, 9045, 9047, 9052, 9056, 9057, 9058, 9059, 9060, 9061, 9069, 9071, 9072, 9073, 9074, 9076, 9084, 9086, 9088, 9091, 9092, 9095, 9096, 9097, 9098, 9105, 9108, 9110, 9111, 9112, 9114, 9115, 9118, 9119, 9123, 9124, 9125, 9128, 9129, 9133, 9134, 9138, 9139, 9140, 9141, 9142, 9146, 9149, 9151, 9152, 9154, 9155, 9156, 9164, 9173, 9174, 9175, 9177, 9183, 9185, 9187, 9188, 9190, 9191, 9194, 9195, 9200, 9205, 9206, 9207, 9210, 9211, 9213, 9215, 9216, 9218, 9220, 9221, 9223, 9226, 9229, 9232, 9233, 9234, 9237, 9241, 9242, 9243, 9247, 9248, 9249, 9252, 9253, 9254, 9257, 9262, 9265, 9267, 9269, 9270, 9273, 9276, 9278, 9284, 9287, 9288, 9289, 9290, 9292, 9295, 9299, 9300, 9302, 9304, 9308, 9311, 9313, 9314, 9316, 9320, 9321, 9323, 9325, 9326, 9328, 9329, 9330, 9336, 9337, 9338, 9339, 9340, 9341, 9345, 9346, 9347, 9348, 9350, 9354, 9355, 9359, 9366, 9373, 9375, 9376, 9378, 9382, 9383, 9388, 9391, 9392, 9394, 9396, 9398, 9400, 9402, 9403, 9404, 9406, 9407, 9413, 9414, 9415, 9417, 9419, 9422, 9423, 9432, 9433, 9434, 9439, 9442, 9443, 9444, 9451, 9452, 9453, 9455, 9456, 9460, 9468, 9469, 9471, 9472, 9473, 9478, 9481, 9483, 9488, 9490, 9497, 9501, 9502, 9503, 9504, 9505, 9509, 9514, 9515, 9517, 9518, 9519, 9525, 9531, 9533, 9534, 9536, 9540, 9543, 9546, 9548, 9549, 9553, 9555, 9556, 9560, 9563, 9564, 9565, 9568, 9571, 9575, 9577, 9579, 9582, 9583, 9586, 9587, 9589, 9590, 9591, 9592, 9596, 9598, 9602, 9606, 9607, 9609, 9610, 9613, 9615, 9617, 9618, 9620, 9623, 9626, 9627, 9628, 9629, 9632, 9633, 9635, 9637, 9640, 9641, 9642, 9644, 9645, 9646, 9648, 9649, 9651, 9653, 9655, 9656, 9657, 9658, 9660, 9663, 9666, 9670, 9677, 9681, 9682, 9686, 9692, 9693, 9698, 9700, 9707, 9710, 9711, 9717, 9718, 9722, 9723, 9726, 9729, 9730, 9731, 9733, 9734, 9737, 9744, 9745, 9746, 9750, 9751, 9753, 9754, 9755, 9756, 9763, 9764, 9767, 9768, 9770, 9775, 9776, 9777, 9780, 9781, 9782, 9784, 9786, 9791, 9792, 9794, 9796, 9797, 9799, 9801, 9802, 9806, 9808, 9809, 9812, 9813, 9816, 9819, 9820, 9824, 9825, 9827, 9833, 9835, 9836, 9845, 9846, 9847, 9849, 9850, 9854, 9861, 9864, 9866, 9869, 9873, 9882, 9885, 9886, 9887, 9892, 9897, 9900, 9901, 9906, 9907, 9908, 9909, 9910, 9911, 9912, 9917, 9921, 9923, 9924, 9928, 9930, 9931, 9932, 9934, 9935, 9938, 9940, 9944, 9946, 9949, 9950, 9953, 9955, 9957, 9960, 9962, 9963, 9964, 9967, 9968, 9971, 9972, 9974, 9975, 9979, 9980, 9982, 9984, 9985, 9987, 9988, 9990, 9991, 9997, 9998, 10000, 10008, 10009, 10010, 10012, 10013, 10016, 10017, 10018, 10019, 10021, 10022, 10026, 10031, 10032, 10033, 10034, 10035, 10037, 10038, 10043, 10045, 10047, 10050, 10051, 10052, 10054, 10056, 10058, 10059, 10060, 10062, 10063, 10064, 10066, 10068, 10073, 10075, 10078, 10082, 10089, 10090, 10091, 10092, 10095, 10097, 10101, 10102, 10103, 10105, 10106, 10107, 10108, 10109, 10110, 10112, 10114, 10115, 10116, 10118, 10119, 10122, 10128, 10131, 10132, 10134, 10138, 10143, 10146, 10149, 10150, 10151, 10152, 10158, 10163, 10165, 10166, 10168, 10170, 10174, 10176, 10178, 10181, 10182, 10191, 10192, 10193, 10194, 10195, 10197, 10199, 10200, 10201, 10203, 10206, 10212, 10213, 10214, 10218, 10219, 10220, 10222, 10223, 10224, 10225, 10228, 10230, 10231, 10233, 10235, 10236, 10237, 10239, 10247, 10252, 10253, 10255, 10258, 10259, 10262, 10270, 10275, 10278, 10284, 10286, 10291, 10292, 10293, 10295, 10300, 10302, 10306, 10307, 10311, 10318, 10319, 10321, 10322, 10323, 10325, 10326, 10327, 10329, 10331, 10333, 10334, 10335, 10336, 10338, 10341, 10343, 10346, 10353, 10354, 10356, 10357, 10359, 10360, 10362, 10364, 10365, 10368, 10371, 10373, 10375, 10378, 10380, 10381, 10382, 10384, 10385, 10388, 10397, 10398, 10399, 10401, 10405, 10408, 10410, 10413, 10414, 10416, 10421, 10423, 10425, 10427, 10428, 10429, 10430, 10435, 10437, 10438, 10440, 10442, 10443, 10446, 10447, 10448, 10449, 10450, 10451, 10452, 10453, 10455, 10456, 10463, 10464, 10465, 10466, 10468, 10469, 10470, 10472, 10473, 10474, 10482, 10487, 10488, 10490, 10492, 10494, 10496, 10498, 10504, 10506, 10508, 10513, 10514, 10515, 10518, 10521, 10524, 10525, 10527, 10528, 10530, 10531, 10532, 10533, 10535, 10536, 10537, 10541, 10542, 10543, 10544, 10548, 10549, 10550, 10551, 10555, 10556, 10558, 10560, 10561, 10563, 10565, 10567, 10569, 10571, 10573, 10577, 10580, 10581, 10582, 10583, 10585, 10590, 10593, 10595, 10596, 10597, 10599, 10601, 10602, 10606, 10610, 10611, 10613, 10614, 10615, 10616, 10617, 10618, 10621, 10622, 10623, 10626, 10628, 10629, 10630, 10631, 10633, 10634, 10637, 10638, 10639, 10640, 10642, 10643, 10645, 10646, 10648, 10649, 10650, 10655, 10657, 10659, 10663, 10665, 10668, 10669, 10670, 10671, 10674, 10676, 10677, 10678, 10681, 10682, 10683, 10684, 10685, 10686, 10689, 10693, 10700, 10702, 10703, 10705, 10707, 10708, 10711, 10715, 10716, 10718, 10721, 10722, 10723, 10726, 10729, 10732, 10734, 10735, 10736, 10738, 10740, 10741, 10744, 10745, 10747, 10748, 10749, 10753, 10754, 10756, 10761, 10762, 10763, 10766, 10774, 10775, 10777, 10778, 10779, 10782, 10784, 10785, 10787, 10788, 10790, 10791, 10792, 10795, 10796, 10800, 10803, 10804, 10805, 10809, 10810, 10811, 10812, 10813, 10815, 10818, 10819, 10820, 10821, 10823, 10824, 10825, 10826, 10831, 10833, 10836, 10838, 10839, 10840, 10843, 10846, 10850, 10851, 10853, 10854, 10857, 10858, 10860, 10861, 10862, 10866, 10867, 10872, 10874, 10877, 10878, 10880, 10881, 10892, 10896, 10897, 10898, 10899, 10902, 10903, 10911, 10912, 10913, 10917, 10920, 10926, 10927, 10930, 10933, 10934, 10935, 10936, 10937, 10938, 10940, 10941, 10944, 10947, 10948, 10949, 10954, 10957, 10960, 10961, 10962, 10963, 10964, 10965, 10966, 10967, 10972, 10975, 10976, 10977, 10979, 10980, 10988, 10993, 10995, 10996, 10997, 10999, 11002, 11004, 11005, 11006, 11008, 11009, 11010, 11015, 11018, 11024, 11027, 11032, 11033, 11039, 11044, 11046, 11047, 11049, 11052, 11053, 11056, 11058, 11060, 11061, 11066, 11068, 11070, 11078, 11081, 11082, 11083, 11086, 11090, 11092, 11095, 11098, 11101, 11105, 11107, 11109, 11110, 11114, 11116, 11118, 11119, 11123, 11124, 11125, 11126, 11127, 11129, 11132, 11133, 11135, 11137, 11138, 11146, 11148, 11152, 11153, 11154, 11158, 11160, 11161, 11162, 11163, 11165, 11166, 11168, 11169, 11173, 11175, 11177, 11178, 11179, 11180, 11181, 11184, 11185, 11186, 11187, 11188, 11190, 11191, 11192, 11194, 11198, 11199, 11201, 11202, 11204, 11207, 11210, 11214, 11217, 11218, 11222, 11226, 11227, 11228, 11229, 11232, 11233, 11234, 11235, 11236, 11237, 11238, 11239, 11244, 11246, 11247, 11248, 11251, 11254, 11255, 11256, 11257, 11258, 11259, 11260, 11261, 11262, 11263, 11264, 11266, 11274, 11275, 11278, 11283, 11289, 11290, 11291, 11292, 11293, 11294, 11295, 11298, 11300, 11306, 11307, 11313, 11315, 11316, 11318, 11319, 11320, 11322, 11324, 11328, 11330, 11331, 11332, 11337, 11339, 11340, 11345, 11346, 11348, 11349, 11352, 11356, 11358, 11359, 11363, 11365, 11366, 11369, 11370, 11371, 11373, 11374, 11377, 11380, 11381, 11382, 11387, 11388, 11391, 11394, 11395, 11397, 11398, 11403, 11405, 11406, 11408, 11409, 11410, 11411, 11412, 11413, 11414, 11416, 11420, 11423, 11424, 11428, 11430, 11434, 11437, 11438, 11445, 11446, 11449, 11451, 11456, 11458, 11459, 11463, 11465, 11467, 11471, 11472, 11473, 11475, 11476, 11477, 11478, 11481, 11482, 11485, 11487, 11490, 11491, 11494, 11496, 11497, 11498, 11499, 11500, 11501, 11503, 11506, 11507, 11508, 11512, 11518, 11523, 11524, 11526, 11527, 11528, 11530, 11531, 11532, 11533, 11534, 11535, 11538, 11540, 11541, 11544, 11546, 11548, 11551, 11553, 11558, 11560, 11561, 11563, 11567, 11568, 11570, 11571, 11576, 11577, 11578, 11580, 11585, 11586, 11593, 11594, 11595, 11596, 11597, 11599, 11600, 11604, 11607, 11608, 11610, 11615, 11618, 11621, 11623, 11625, 11628, 11632, 11633, 11636, 11637, 11639, 11642, 11644, 11649, 11650, 11652, 11656, 11657, 11658, 11663, 11665, 11668, 11669, 11673, 11678, 11681, 11682, 11688, 11691, 11692, 11693, 11694, 11695, 11699, 11701, 11703, 11705, 11707, 11711, 11712, 11718, 11720, 11721, 11722, 11723, 11725, 11731, 11733, 11736, 11740, 11743, 11744, 11753, 11755, 11756, 11759, 11760, 11761, 11762, 11763, 11764, 11765, 11766, 11767, 11769, 11770, 11771, 11774, 11776, 11780, 11781, 11782, 11783, 11784, 11785, 11786, 11790, 11792, 11799, 11800, 11802, 11804, 11809, 11810, 11812, 11814, 11816, 11818, 11819, 11821, 11823, 11826, 11828, 11830, 11837, 11839, 11841, 11845, 11846, 11849, 11850, 11851, 11853, 11856, 11858, 11863, 11868, 11872, 11876, 11877, 11878, 11881, 11889, 11890, 11891, 11894, 11898, 11899, 11904, 11909, 11911, 11913, 11916, 11917, 11918, 11919, 11920, 11921, 11922, 11923, 11926, 11927, 11928, 11929, 11930, 11934, 11935, 11939, 11940, 11941, 11943, 11946, 11947, 11948, 11949, 11953, 11958, 11959, 11960, 11961, 11962, 11963, 11965, 11968, 11977, 11978, 11979, 11980, 11983, 11988, 11993, 11994, 11995, 11996, 11997, 11998, 11999, 12002, 12004, 12005, 12008, 12014, 12017, 12019, 12020, 12021, 12023, 12024, 12025, 12026, 12032, 12042, 12043, 12044, 12047, 12050, 12059, 12061, 12063, 12068, 12076, 12078, 12079, 12080, 12081, 12083, 12085, 12086, 12087, 12089, 12091, 12092, 12093, 12097, 12098, 12102, 12104, 12106, 12109, 12110, 12112, 12115, 12118, 12120, 12122, 12128, 12129, 12130, 12131, 12134, 12135, 12137, 12138, 12139, 12143, 12144, 12145, 12146, 12147, 12148, 12150, 12151, 12153, 12161, 12165, 12166, 12167, 12170, 12171, 12174, 12175, 12179, 12181, 12186, 12189, 12197, 12200, 12201, 12202, 12204, 12208, 12214, 12215, 12217, 12218, 12221, 12223, 12227, 12230, 12234, 12237, 12240, 12241, 12243, 12245, 12249, 12250, 12252, 12253, 12255, 12256, 12259, 12268, 12269, 12271, 12274, 12278, 12280, 12283, 12285, 12286, 12287, 12288, 12291, 12293, 12295, 12302, 12304, 12306, 12310, 12311, 12312, 12313, 12314, 12315, 12317, 12319, 12321, 12323, 12325, 12326, 12328, 12331, 12333, 12334, 12339, 12342, 12344, 12345, 12347, 12350, 12354, 12356, 12358, 12359, 12364, 12366, 12370, 12375, 12376, 12379, 12380, 12381, 12383, 12385, 12390, 12394, 12397, 12400, 12401, 12403, 12406, 12411, 12414, 12415, 12416, 12419, 12420, 12423, 12424, 12426, 12427, 12428, 12435, 12437, 12440, 12447, 12450, 12451, 12455, 12456, 12457, 12459, 12461, 12462, 12465, 12467, 12468, 12469, 12470, 12472, 12473, 12478, 12481, 12483, 12486, 12487, 12488, 12492, 12494, 12495, 12497, 12499, 12500, 12501, 12502, 12503, 12504, 12508, 12509, 12512, 12513, 12514, 12515, 12518, 12519, 12527, 12529, 12530, 12531, 12535, 12536, 12537, 12538, 12539, 12540, 12541, 12545, 12546, 12547, 12548, 12549, 12551, 12552, 12553, 12554, 12555, 12556, 12557, 12561, 12562, 12563, 12565, 12567, 12568, 12570, 12572, 12577, 12580, 12583, 12585, 12586, 12588, 12589, 12591, 12594, 12597, 12600, 12603, 12605, 12608, 12609, 12610, 12611, 12619, 12622, 12623, 12626, 12628, 12629, 12630, 12631, 12633, 12634, 12638, 12639, 12640, 12641, 12648, 12649, 12651, 12663, 12664, 12668, 12670, 12671, 12674, 12676, 12679, 12681, 12683, 12684, 12688, 12689, 12691, 12693, 12695, 12696, 12697, 12699, 12701, 12702, 12707, 12713, 12714, 12715, 12723, 12726, 12728, 12729, 12731, 12732, 12733, 12735, 12737, 12738, 12739, 12740, 12741, 12742, 12743, 12744, 12752, 12753, 12754, 12755, 12757, 12758, 12761, 12762, 12763, 12764, 12765, 12766, 12771, 12772, 12773, 12775, 12777, 12783, 12790, 12794, 12797, 12800, 12802, 12803, 12804, 12807, 12808, 12810, 12812, 12813, 12817, 12818, 12820, 12822, 12823, 12824, 12826, 12827, 12834, 12835, 12836, 12837, 12838, 12839, 12842, 12843, 12844, 12848, 12849, 12850, 12853, 12861, 12866, 12869, 12870, 12873, 12875, 12878, 12882, 12883, 12884, 12887, 12891, 12895, 12898, 12899, 12900, 12902, 12903, 12904, 12905, 12906, 12908, 12910, 12912, 12913, 12916, 12920, 12921, 12928, 12929, 12932, 12933, 12934, 12935, 12940, 12942, 12946, 12947, 12950, 12953, 12960, 12961, 12963, 12967, 12968, 12969, 12978, 12983, 12984, 12986, 12987, 12990, 12991, 12999, 13003, 13004, 13007, 13010, 13013, 13014, 13015, 13017, 13018, 13022, 13027, 13030, 13032, 13033, 13034, 13035, 13036, 13040, 13041, 13047, 13049, 13050, 13053, 13054, 13055, 13056, 13059, 13060, 13061, 13062, 13064, 13066, 13067, 13071, 13075, 13077, 13079, 13083, 13085, 13086, 13087, 13097, 13099, 13101, 13102, 13105, 13106, 13110, 13111, 13112, 13114, 13115, 13116, 13117, 13118, 13120, 13121, 13122, 13123, 13124, 13125, 13128, 13130, 13131, 13134, 13136, 13144, 13147, 13148, 13149, 13151, 13154, 13159, 13160, 13166, 13175, 13181, 13182, 13186, 13190, 13197, 13199, 13206, 13209, 13210, 13212, 13213, 13215, 13217, 13221, 13224, 13226, 13227, 13228, 13229, 13231, 13232, 13233, 13234, 13235, 13236, 13237, 13239, 13241, 13243, 13248, 13250, 13251, 13255, 13256, 13259, 13260, 13261, 13262, 13263, 13264, 13265, 13267, 13268, 13269, 13271, 13274, 13279, 13280, 13281, 13293, 13296, 13297, 13298, 13300, 13301, 13303, 13304, 13313, 13315, 13316, 13317, 13318, 13326, 13328, 13329, 13330, 13332, 13337, 13338, 13340, 13343, 13345, 13346, 13347, 13348, 13350, 13352, 13358, 13361, 13363, 13365, 13367, 13368, 13369, 13370, 13374, 13377, 13381, 13384, 13385, 13386, 13388, 13391, 13393, 13394, 13396, 13397, 13401, 13403, 13404, 13408, 13410, 13416, 13417, 13419, 13423, 13424, 13428, 13430, 13433, 13439, 13446, 13448, 13450, 13451, 13456, 13457, 13460, 13463, 13467, 13469, 13473, 13475, 13477, 13478, 13480, 13492, 13498, 13499, 13503, 13504, 13513, 13514, 13515, 13517, 13519, 13521, 13522, 13526, 13529, 13530, 13532, 13533, 13539, 13540, 13543, 13544, 13545, 13546, 13547, 13549, 13551, 13552, 13553, 13555, 13558, 13559, 13561, 13568, 13569, 13574, 13577, 13578, 13579, 13580, 13582, 13584, 13587, 13596, 13597, 13598, 13599, 13600, 13601, 13602, 13604, 13605, 13607, 13612, 13620, 13621, 13623, 13627, 13628, 13630, 13631, 13632, 13634, 13636, 13637, 13638, 13641, 13643, 13647, 13651, 13652, 13653, 13654, 13662, 13663, 13665, 13668, 13669, 13675, 13676, 13677, 13678, 13679, 13683, 13684, 13686, 13687, 13688, 13689, 13697, 13698, 13700, 13702, 13706, 13710, 13712, 13713, 13715, 13716, 13719, 13720, 13722, 13726, 13727, 13728, 13729, 13730, 13734, 13736, 13739, 13742, 13745, 13747, 13750, 13753, 13756, 13761, 13762, 13764, 13767, 13769, 13772, 13773, 13774, 13775, 13777, 13779, 13780, 13782, 13783, 13785, 13786, 13787, 13791, 13793, 13794, 13796, 13798, 13799, 13809, 13812, 13813, 13816, 13817, 13818, 13819, 13822, 13823, 13828, 13830, 13831, 13834, 13835, 13840, 13843, 13849, 13852, 13853, 13858, 13860, 13862, 13866, 13869, 13870, 13872, 13873, 13875, 13877, 13885, 13887, 13891, 13892, 13895, 13897, 13898, 13901, 13904, 13906, 13907, 13908, 13909, 13910, 13911, 13917, 13918, 13919, 13920, 13921, 13924, 13925, 13929, 13930, 13938, 13943, 13944, 13947, 13948, 13950, 13953, 13954, 13958, 13960, 13961, 13963, 13969, 13970, 13971, 13975, 13983, 13984, 13985, 13986, 13987, 13988, 1.3990, 13999, 14000, 14001, 14002, 14005, 14006, 14009, 14013, 14014, 14017, 14018, 14021, 14022, 14027, 14030, 14031, 14035, 14038, 14040, 14049, 14052, 14059, 14062, 14063, 14066, 14067, 14069, 14070, 14071, 14072, 14073, 14075, 14081, 14084, 14085, 14086, 14088, 14091, 14092, 14094, 14096, 14102, 14105, 14111, 14112, 14114, 14116, 14118, 14119, 14122, 14124, 14125, 14129, 14130, 14132, 14133, 14135, 14137, 14138, 14139, 14140, 14141, 14142, 14143, 14145, 14146, 14147.

Promoters expressing in the leaf at the V6 stage include SEQ IDs: 1, 3, 7, 8, 12, 13, 14, 15, 16, 19, 24, 27, 29, 31, 33, 34, 36, 41, 48, 51, 53, 56, 57, 61, 63, 64, 65, 79, 80, 88, 93, 94, 96, 97, 98, 99, 101, 102, 103, 104, 105, 108, 110, 111, 112, 115, 117, 123, 129, 131, 133, 136, 137, 141, 142, 143, 144, 152, 154, 155, 156, 157, 159, 160, 162, 165, 168, 172, 174, 175, 176, 179, 180, 181, 183, 187, 193, 194, 196, 199, 202, 203, 205, 207, 211, 212, 214, 230, 232, 233, 235, 236, 237, 240, 242, 244, 246, 249, 250, 251, 257, 259, 262, 267, 269, 270, 271, 273, 280, 281, 284, 286, 288, 289, 293, 294, 301, 302, 305, 306, 308, 309, 316, 319, 320, 322, 328, 329, 332, 335, 337, 338, 342, 346, 349, 352, 354, 356, 357, 358, 359, 364, 365, 371, 373, 376, 378, 379, 381, 382, 383, 386, 388, 389, 393, 396, 411, 412, 414, 416, 423, 427, 431, 432, 433, 434, 436, 441, 450, 452, 454, 456, 461, 462, 463, 466, 468, 470, 471, 474, 478, 482, 483, 484, 485, 488, 489, 492, 496, 501, 507, 509, 510, 511, 514, 515, 516, 517, 520, 523, 525, 532, 534, 537, 538, 541, 544, 546, 547, 554, 555, 560, 561, 577, 578, 579, 580, 585, 588, 591, 592, 594, 595, 596, 599, 601, 602, 605, 606, 609, 613, 614, 619, 620, 622, 629, 631, 633, 635, 636, 638, 642, 643, 645, 647, 655, 656, 659, 661, 664, 669, 671, 681, 683, 692, 693, 694, 699, 701, 702, 705, 706, 709, 716, 717, 718, 719, 721, 722, 723, 724, 727, 732, 734, 739, 740, 741, 742, 744, 749, 753, 757, 758, 759, 760, 762, 763, 764, 765, 770, 779, 783, 784, 786, 792, 793, 795, 798, 800, 804, 806, 808, 809, 811, 812, 816, 819, 820, 821, 829, 830, 833, 840, 845, 846, 855, 856, 857, 858, 860, 862, 863, 865, 868, 869, 870, 871, 876, 877, 878, 883, 887, 889, 890, 891, 892, 893, 895, 897, 898, 900, 903, 907, 908, 910, 911, 912, 913, 915, 916, 919, 920, 924, 925, 928, 929, 931, 932, 933, 936, 939, 943, 944, 947, 951, 953, 955, 957, 958, 960, 964, 971, 974, 975, 976, 977, 978, 979, 980, 982, 984, 985, 987, 989, 990, 991, 994, 995, 996, 997, 999, 1005, 1007, 1010, 1011, 1012, 1013, 1016, 1017, 1019, 1022, 1025, 1026, 1029, 1030, 1032, 1033, 1035, 1039, 1040, 1041, 1042, 1043, 1045, 1046, 1047, 1049, 1051, 1052, 1055, 1056, 1057, 1064, 1065, 1067, 1068, 1069, 1070, 1077, 1085, 1087, 1088, 1089, 1091, 1092, 1095, 1096, 1100, 1101, 1103, 1104, 1106, 1110, 1112, 1114, 1115, 1116, 1117, 1119, 1121, 1125, 1126, 1130, 1132, 1136, 1137, 1140, 1144, 1146, 1148, 1153, 1155, 1160, 1161, 1164, 1165, 1167, 1168, 1170, 1171, 1176, 1178, 1183, 1187, 1189, 1191, 1196, 1198, 1201, 1204, 1205, 1213, 1214, 1217, 1218, 1220, 1221, 1222, 1223, 1225, 1228, 1232, 1234, 1236, 1240, 1243, 1244, 1248, 1249, 1251, 1254, 1257, 1258, 1259, 1262, 1263, 1269, 1272, 1277, 1281, 1285, 1286, 1290, 1292, 1293, 1296, 1301, 1303, 1306, 1307, 1309, 1311, 1312, 1314, 1316, 1317, 1320, 1331, 1334, 1343, 1346, 1347, 1349, 1354, 1355, 1356, 1360, 1363, 1366, 1367, 1371, 1373, 1375, 1377, 1379, 1380, 1383, 1387, 1388, 1389, 1391, 1393, 1394, 1396, 1398, 1399, 1404, 1405, 1406, 1412, 1415, 1416, 1420, 1421, 1423, 1426, 1431, 1432, 1438, 1439, 1440, 1441, 1442, 1447, 1448, 1451, 1453, 1458, 1459, 1462, 1466, 1468, 1474, 1475, 1484, 1488, 1490, 1491, 1492, 1493, 1498, 1499, 1501, 1506, 1508, 1510, 1511, 1512, 1517, 1518, 1519, 1525, 1526, 1527, 1528, 1530, 1534, 1543, 1545, 1547, 1549, 1550, 1551, 1553, 1554, 1555, 1556, 1559, 1560, 1561, 1564, 1566, 1567, 1570, 1571, 1575, 1578, 1579, 1584, 1585, 1586, 1590, 1591, 1595, 1596, 1597, 1598, 1599, 1600, 1601, 1602, 1604, 1605, 1608, 1609, 1610, 1612, 1614, 1615, 1616, 1617, 1622, 1623, 1625, 1627, 1634, 1635, 1636, 1637, 1638, 1639, 1641, 1643, 1651, 1653, 1654, 1658, 1659, 1662, 1663, 1669, 1671, 1673, 1675, 1678, 1681, 1682, 1684, 1685, 1687, 1688, 1689, 1690, 1691, 1696, 1697, 1698, 1699, 1705, 1706, 1707, 1708, 1710, 1716, 1717, 1718, 1720, 1723, 1725, 1729, 1732, 1735, 1743, 1745, 1749, 1750, 1755, 1759, 1760, 1761, 1764, 1770, 1771, 1773, 1774, 1776, 1777, 1778, 1785, 1786, 1796, 1798, 1807, 1809, 1811, 1813, 1814, 1823, 1826, 1828, 1830, 1832, 1834, 1837, 1838, 1839, 1840, 1850, 1852, 1856, 1859, 1861, 1863, 1866, 1868, 1869, 1872, 1873, 1876, 1879, 1880, 1882, 1886, 1888, 1891, 1897, 1900, 1902, 1903, 1905, 1906, 1910, 1911, 1912, 1913, 1915, 1916, 1918, 1920, 1922, 1923, 1924, 1933, 1934, 1939, 1940, 1945, 1950, 1951, 1952, 1954, 1956, 1958, 1968, 1969, 1970, 1971, 1972, 1973, 1976, 1977, 1986, 1990, 1991, 1993, 1999, 2000, 2001, 2003, 2007, 2008, 2010, 2012, 2014, 2015, 2016, 2017, 2019, 2021, 2026, 2027, 2029, 2030, 2031, 2033, 2037, 2040, 2041, 2043, 2045, 2048, 2058, 2060, 2062, 2064, 2066, 2072, 2074, 2077, 2078, 2085, 2088, 2089, 2091, 2092, 2093, 2094, 2096, 2097, 2103, 2104, 2106, 2107, 2111, 2112, 2113, 2115, 2122, 2123, 2125, 2126, 2128, 2133, 2137, 2139, 2140, 2142, 2143, 2146, 2147, 2150, 2151, 2156, 2157, 2161, 2162, 2164, 2166, 2167, 2168, 2170, 2172, 2173, 2175, 2177, 2179, 2183, 2185, 2188, 2189, 2190, 2193, 2195, 2196, 2200, 2202, 2203, 2205, 2210, 2213, 2215, 2218, 2221, 2222, 2223, 2226, 2227, 2237, 2240, 2241, 2242, 2244, 2253, 2257, 2259, 2260, 2261, 2263, 2264, 2266, 2276, 2278, 2280, 2283, 2284, 2289, 2296, 2297, 2303, 2305, 2306, 2308, 2310, 2313, 2314, 2321, 2322, 2323, 2325, 2328, 2329, 2331, 2333, 2339, 2342, 2343, 2346, 2353, 2358, 2361, 2362, 2363, 2366, 2367, 2369, 2371, 2379, 2380, 2381, 2382, 2384, 2396, 2397, 2398, 2401, 2402, 2405, 2410, 2413, 2414, 2416, 2418, 2419, 2420, 2423, 2428, 2430, 2431, 2432, 2433, 2434, 2435, 2437, 2439, 2440, 2441, 2442, 2443, 2445, 2449, 2452, 2453, 2454, 2457, 2458, 2465, 2469, 2470, 2472, 2474, 2476, 2480, 2481, 2482, 2487, 2489, 2490, 2491, 2495, 2496, 2498, 2500, 2505, 2506, 2507, 2509, 2513, 2514, 2516, 2517, 2519, 2521, 2522, 2525, 2526, 2528, 2529, 2531, 2533, 2538, 2539, 2541, 2543, 2544, 2546, 2549, 2551, 2552, 2557, 2559, 2560, 2567, 2568, 2570, 2571, 2573, 2578, 2579, 2581, 2587, 2589, 2590, 2594, 2596, 2599, 2601, 2605, 2607, 2609, 2611, 2612, 2613, 2614, 2616, 2617, 2619, 2620, 2626, 2627, 2632, 2635, 2636, 2639, 2644, 2648, 2651, 2652, 2656, 2658, 2659, 2661, 2662, 2666, 2670, 2672, 2674, 2679, 2680, 2684, 2685, 2687, 2689, 2690, 2691, 2692, 2694, 2700, 2704, 2706, 2709, 2711, 2720, 2721, 2722, 2723, 2725, 2726, 2728, 2729, 2730, 2735, 2737, 2739, 2745, 2747, 2749, 2752, 2758, 2759, 2760, 2762, 2764, 2765, 2769, 2770, 2783, 2784, 2786, 2787, 2788, 2791, 2794, 2798, 2800, 2801, 2802, 2805, 2808, 2812, 2814, 2819, 2822, 2823, 2824, 2826, 2827, 2828, 2831, 2837, 2838, 2840, 2843, 2844, 2845, 2850, 2860, 2865, 2869, 2870, 2871, 2876, 2878, 2879, 2885, 2888, 2889, 2892, 2893, 2894, 2895, 2896, 2897, 2901, 2902, 2903, 2906, 2909, 2915, 2916, 2917, 2918, 2922, 2923, 2926, 2930, 2931, 2935, 2938, 2941, 2942, 2943, 2945, 2946, 2948, 2951, 2955, 2959, 2960, 2963, 2965, 2966, 2968, 2969, 2976, 2979, 2982, 2994, 3000, 3003, 3005, 3007, 3008, 3009, 3013, 3017, 3018, 3020, 3023, 3029, 3031, 3039, 3042, 3044, 3045, 3047, 3048, 3049, 3050, 3051, 3053, 3055, 3058, 3059, 3061, 3064, 3067, 3068, 3072, 3075, 3080, 3083, 3084, 3085, 3087, 3090, 3095, 3096, 3100, 3101, 3106, 3107, 3112, 3115, 3116, 3118, 3119, 3120, 3121, 3123, 3126, 3127, 3128, 3129, 3138, 3139, 3141, 3143, 3145, 3153, 3157, 3158, 3166, 3167, 3169, 3170, 3171, 3172, 3177, 3179, 3181, 3189, 3191, 3192, 3196, 3202, 3205, 3206, 3208, 3210, 3217, 3218, 3219, 3220, 3221, 3224, 3225, 3227, 3228, 3230, 3231, 3236, 3237, 3240, 3242, 3245, 3246, 3247, 3249, 3250, 3252, 3253, 3261, 3263, 3266, 3267, 3268, 3280, 3283, 3286, 3288, 3289, 3290, 3291, 3294, 3295, 3297, 3299, 3301, 3307, 3310, 3312, 3313, 3314, 3327, 3329, 3331, 3332, 3333, 3337, 3338, 3340, 3342, 3343, 3345, 3351, 3353, 3355, 3357, 3359, 3360, 3361, 3365, 3370, 3373, 3374, 3377, 3378, 3379, 3382, 3386, 3389, 3390, 3394, 3396, 3403, 3404, 3405, 3411, 3415, 3416, 3418, 3424, 3425, 3426, 3427, 3428, 3429, 3432, 3438, 3440, 3441, 3442, 3445, 3446, 3447, 3449, 3450, 3452, 3453, 3458, 3460, 3461, 3462, 3466, 3468, 3469, 3470, 3471, 3474, 3477, 3483, 3484, 3486, 3488, 3490, 3493, 3500, 3501, 3502, 3503, 3504, 3507, 3510, 3516, 3517, 3518, 3523, 3529, 3533, 3535, 3536, 3538, 3540, 3541, 3542, 3544, 3548, 3549, 3551, 3554, 3556, 3558, 3562, 3569, 3571, 3574, 3576, 3580, 3587, 3588, 3589, 3592, 3594, 3595, 3600, 3601, 3603, 3604, 3606, 3607, 3610, 3611, 3613, 3615, 3616, 3618, 3619, 3620, 3621, 3624, 3629, 3633, 3634, 3636, 3637, 3640, 3642, 3643, 3644, 3645, 3646, 3648, 3654, 3655, 3659, 3660, 3661, 3667, 3669, 3671, 3674, 3677, 3682, 3690, 3706, 3707, 3709, 3710, 3713, 3715, 3718, 3719, 3721, 3722, 3723, 3725, 3726, 3729, 3730, 3731, 3733, 3744, 3748, 3749, 3752, 3756, 3761, 3764, 3766, 3772, 3773, 3774, 3775, 3777, 3778, 3783, 3785, 3787, 3790, 3791, 3792, 3793, 3801, 3804, 3808, 3817, 3818, 3819, 3820, 3823, 3830, 3831, 3832, 3833, 3834, 3837, 3838, 3839, 3843, 3844, 3846, 3847, 3849, 3858, 3859, 3860, 3866, 3867, 3868, 3870, 3871, 3872, 3873, 3876, 3877, 3881, 3883, 3884, 3887, 3889, 3890, 3892, 3894, 3895, 3896, 3898, 3899, 3903, 3904, 3907, 3908, 3909, 3912, 3917, 3918, 3923, 3924, 3926, 3927, 3928, 3929, 3933, 3934, 3936, 3937, 3938, 3940, 3941, 3942, 3947, 3950, 3951, 3954, 3955, 3958, 3959, 3962, 3964, 3967, 3968, 3969, 3970, 3971, 3972, 3974, 3975, 3978, 3983, 3984, 3985, 3987, 3988, 3991, 3994, 3995, 3996, 3997, 4000, 4007, 4008, 4013, 4014, 4017, 4026, 4033, 4037, 4039, 4040, 4041, 4042, 4043, 4044, 4046, 4047, 4048, 4049, 4050, 4053, 4054, 4056, 4057, 4062, 4066, 4067, 4068, 4070, 4071, 4084, 4087, 4088, 4092, 4094, 4096, 4099, 4103, 4105, 4106, 4109, 4110, 4111, 4113, 4124, 4126, 4131, 4133, 4134, 4140, 4143, 4144, 4148, 4149, 4150, 4151, 4154, 4155, 4158, 4160, 4161, 4162, 4163, 4164, 4165, 4166, 4167, 4168, 4170, 4171, 4173, 4175, 4176, 4178, 4179, 4181, 4183, 4185, 4187, 4188, 4189, 4190, 4191, 4192, 4193, 4195, 4197, 4201, 4202, 4205, 4206, 4207, 4210, 4211, 4212, 4217, 4219, 4221, 4227, 4228, 4232, 4233, 4235, 4237, 4245, 4246, 4251, 4252, 4255, 4257, 4260, 4261, 4263, 4266, 4270, 4272, 4275, 4276, 4280, 4281, 4284, 4290, 4294, 4296, 4301, 4302, 4304, 4305, 4306, 4309, 4312, 4314, 4317, 4320, 4321, 4324, 4329, 4330, 4335, 4337, 4339, 4344, 4347, 4352, 4354, 4358, 4360, 4369, 4374, 4378, 4380, 4383, 4388, 4390, 4391, 4392, 4393, 4395, 4396, 4397, 4401, 4402, 4403, 4405, 4409, 4410, 4421, 4422, 4423, 4430, 4432, 4436, 4439, 4440, 4443, 4446, 4448, 4449, 4450, 4453, 4457, 4461, 4462, 4463, 4466, 4467, 4468, 4470, 4471, 4474, 4475, 4479, 4486, 4490, 4492, 4494, 4497, 4498, 4500, 4502, 4507, 4508, 4512, 4514, 4515, 4518, 4519, 4521, 4522, 4524, 4525, 4529, 4531, 4532, 4535, 4543, 4548, 4549, 4554, 4555, 4558, 4560, 4561, 4562, 4563, 4565, 4566, 4568, 4575, 4576, 4578, 4579, 4582, 4590, 4591, 4593, 4594, 4596, 4597, 4598, 4599, 4601, 4604, 4606, 4614, 4616, 4617, 4618, 4623, 4625, 4628, 4632, 4634, 4635, 4636, 4639, 4641, 4643, 4644, 4646, 4647, 4650, 4651, 4652, 4653, 4654, 4655, 4656, 4657, 4658, 4659, 4662, 4667, 4669, 4671, 4672, 4673, 4674, 4676, 4677, 4682, 4685, 4691, 4692, 4696, 4697, 4699, 4700, 4701, 4703, 4705, 4706, 4710, 4711, 4713, 4715, 4718, 4719, 4720, 4721, 4722, 4724, 4725, 4727, 4728, 4729, 4730, 4734, 4736, 4737, 4738, 4739, 4740, 4741, 4745, 4746, 4747, 4748, 4749, 4753, 4754, 4756, 4761, 4762, 4763, 4767, 4769, 4770, 4771, 4773, 4775, 4779, 4780, 4783, 4784, 4787, 4789, 4790, 4791, 4795, 4796, 4801, 4803, 4804, 4805, 4806, 4807, 4809, 4813, 4815, 4816, 4817, 4818, 4822, 4828, 4830, 4831, 4834, 4836, 4837, 4841, 4845, 4854, 4855, 4856, 4857, 4861, 4862, 4863, 4869, 4874, 4875, 4876, 4878, 4880, 4881, 4887, 4888, 4889, 4891, 4897, 4900, 4904, 4905, 4907, 4909, 4910, 4912, 4913, 4914, 4918, 4921, 4924, 4925, 4931, 4936, 4937, 4938, 4941, 4943, 4946, 4947, 4950, 4953, 4954, 4955, 4958, 4959, 4967, 4969, 4971, 4972, 4974, 4975, 4980, 4981, 4985, 4986, 4988, 4989, 4990, 4991, 4994, 4996, 5005, 5011, 5016, 5023, 5024, 5026, 5029, 5030, 5034, 5036, 5037, 5039, 5040, 5042, 5044, 5045, 5046, 5049, 5052, 5054, 5057, 5058, 5060, 5061, 5067, 5068, 5069, 5072, 5074, 5078, 5082, 5088, 5089, 5090, 5091, 5094, 5095, 5099, 5100, 5101, 5102, 5106, 5110, 5111, 5113, 5114, 5115, 5116, 5119, 5120, 5122, 5125, 5131, 5132, 5136, 5137, 5140, 5143, 5144, 5146, 5147, 5149, 5159, 5160, 5164, 5165, 5168, 5170, 5172, 5174, 5175, 5177, 5178, 5180, 5181, 5182, 5185, 5187, 5188, 5189, 5190, 5191, 5192, 5193, 5196, 5198, 5200, 5202, 5203, 5206, 5209, 5212, 5213, 5216, 5217, 5218, 5219, 5221, 5225, 5230, 5234, 5237, 5238, 5241, 5251, 5253, 5254, 5255, 5258, 5260, 5261, 5263, 5264, 5268, 5269, 5275, 5276, 5281, 5283, 5285, 5287, 5292, 5297, 5298, 5299, 5300, 5301, 5308, 5311, 5314, 5315, 5317, 5319, 5321, 5324, 5329, 5330, 5332, 5333, 5334, 5338, 5339, 5341, 5342, 5345, 5346, 5348, 5349, 5351, 5352, 5356, 5361, 5366, 5367, 5369, 5371, 5386, 5388, 5389, 5391, 5393, 5396, 5397, 5404, 5405, 5411, 5413, 5414, 5417, 5418, 5422, 5427, 5428, 5431, 5432, 5434, 5437, 5438, 5445, 5446, 5448, 5449, 5452, 5453, 5456, 5458, 5459, 5461, 5471, 5475, 5476, 5480, 5483, 5484, 5488, 5491, 5493, 5495, 5496, 5497, 5505, 5508, 5510, 5512, 5513, 5515, 5518, 5519, 5524, 5526, 5529, 5530, 5531, 5532, 5535, 5543, 5545, 5549, 5554, 5558, 5559, 5561, 5562, 5563, 5564, 5566, 5568, 5569, 5572, 5575, 5579, 5580, 5581, 5582, 5584, 5585, 5586, 5589, 5593, 5594, 5596, 5597, 5602, 5608, 5613, 5614, 5615, 5616, 5621, 5627, 5633, 5635, 5638, 5640, 5643, 5647, 5648, 5649, 5650, 5651, 5652, 5653, 5655, 5656, 5657, 5659, 5660, 5663, 5667, 5669, 5670, 5671, 5680, 5681, 5683, 5689, 5690, 5694, 5695, 5698, 5702, 5706, 5711, 5712, 5713, 5714, 5717, 5718, 5719, 5721, 5722, 5723, 5729, 5730, 5731, 5732, 5734, 5735, 5736, 5737, 5742, 5744, 5751, 5757, 5768, 5770, 5773, 5775, 5778, 5780, 5783, 5784, 5785, 5787, 5788, 5791, 5792, 5794, 5805, 5807, 5808, 5809, 5810, 5811, 5817, 5820, 5824, 5826, 5828, 5833, 5834, 5835, 5836, 5837, 5839, 5842, 5850, 5853, 5856, 5858, 5859, 5863, 5866, 5867, 5869, 5871, 5872, 5878, 5879, 5881, 5882, 5883, 5888, 5889, 5892, 5893, 5901, 5905, 5906, 5907, 5910, 5912, 5918, 5919, 5921, 5925, 5926, 5927, 5928, 5931, 5932, 5940, 5941, 5942, 5943, 5944, 5945, 5946, 5951, 5952, 5953, 5954, 5956, 5957, 5959, 5961, 5967, 5968, 5971, 5978, 5979, 5980, 5984, 5985, 5986, 5988, 5989, 5990, 5991, 5992, 5994, 5996, 5997, 5998, 6000, 6002, 6004, 6005, 6006, 6007, 6012, 6013, 6016, 6018, 6019, 6023, 6025, 6026, 6028, 6038, 6040, 6041, 6043, 6044, 6047, 6048, 6051, 6058, 6059, 6061, 6062, 6063, 6065, 6068, 6069, 6070, 6072, 6074, 6077, 6080, 6082, 6085, 6088, 6089, 6090, 6092, 6093, 6094, 6095, 6096, 6098, 6108, 6109, 6110, 6112, 6113, 6116, 6118, 6119, 6122, 6125, 6129, 6130, 6132, 6133, 6135, 6136, 6137, 6144, 6145, 6146, 6147, 6149, 6151, 6153, 6155, 6158, 6163, 6164, 6165, 6168, 6171, 6173, 6178, 6180, 6182, 6183, 6186, 6188, 6189, 6190, 6191, 6193, 6197, 6198, 6200, 6203, 6206, 6207, 6209, 6212, 6213, 6215, 6220, 6221, 6223, 6224, 6226, 6227, 6228, 6230, 6231, 6237, 6238, 6239, 6240, 6243, 6245, 6246, 6247, 6249, 6250, 6251, 6255, 6257, 6258, 6259, 6260, 6264, 6265, 6267, 6269, 6271, 6272, 6273, 6278, 6279, 6280, 6282, 6286, 6287, 6288, 6289, 6291, 6292, 6294, 6299, 6300, 6302, 6309, 6310, 6311, 6312, 6315, 6317, 6321, 6322, 6325, 6326, 6328, 6332, 6333, 6338, 6349, 6350, 6351, 6352, 6353, 6354, 6358, 6359, 6360, 6362, 6363, 6364, 6367, 6370, 6372, 6373, 6375, 6378, 6379, 6381, 6383, 6394, 6396, 6397, 6398, 6399, 6403, 6404, 6405, 6407, 6408, 6412, 6414, 6415, 6419, 6422, 6427, 6429, 6430, 6431, 6434, 6436, 6437, 6440, 6442, 6448, 6452, 6454, 6458, 6459, 6463, 6464, 6466, 6467, 6468, 6469, 6470, 6471, 6474, 6477, 6478, 6480, 6486, 6488, 6492, 6493, 6495, 6497, 6499, 6500, 6501, 6502, 6504, 6505, 6510, 6513, 6514, 6515, 6517, 6519, 6523, 6524, 6525, 6530, 6534, 6537, 6541, 6543, 6544, 6547, 6548, 6549, 6554, 6556, 6557, 6558, 6560, 6561, 6563, 6564, 6569, 6572, 6574, 6576, 6577, 6579, 6581, 6582, 6584, 6587, 6595, 6596, 6597, 6598, 6599, 6605, 6607, 6609, 6610, 6611, 6614, 6615, 6616, 6620, 6621, 6624, 6625, 6626, 6627, 6628, 6629, 6630, 6634, 6635, 6637, 6638, 6639, 6643, 6644, 6646, 6647, 6648, 6649, 6652, 6654, 6655, 6662, 6666, 6667, 6671, 6672, 6676, 6678, 6681, 6686, 6689, 6691, 6692, 6695, 6696, 6699, 6703, 6705, 6706, 6711, 6714, 6716, 6718, 6720, 6724, 6725, 6729, 6730, 6731, 6734, 6746, 6747, 6753, 6756, 6757, 6759, 6761, 6766, 6776, 6778, 6780, 6782, 6786, 6787, 6788, 6791, 6793, 6794, 6797, 6803, 6804, 6805, 6807, 6810, 6811, 6812, 6813, 6816, 6817, 6819, 6820, 6821, 6824, 6827, 6828, 6831, 6832, 6834, 6836, 6837, 6840, 6841, 6842, 6843, 6845, 6847, 6848, 6850, 6851, 6859, 6864, 6867, 6869, 6872, 6874, 6875, 6876, 6877, 6879, 6880, 6887, 6888, 6895, 6897, 6899, 6903, 6906, 6907, 6909, 6913, 6914, 6915, 6917, 6919, 6921, 6922, 6923, 6924, 6925, 6930, 6933, 6936, 6941, 6944, 6946, 6948, 6950, 6951, 6952, 6954, 6956, 6959, 6960, 6966, 6967, 6969, 6971, 6979, 6984, 6987, 6990, 6993, 6994, 6999, 7002, 7003, 7005, 7006, 7009, 7011, 7012, 7013, 7015, 7022, 7025, 7032, 7033, 7039, 7040, 7042, 7043, 7053, 7056, 7057, 7064, 7072, 7075, 7077, 7079, 7083, 7084, 7085, 7093, 7094, 7097, 7105, 7106, 7107, 7108, 7113, 7116, 7117, 7118, 7124, 7126, 7129, 7130, 7132, 7137, 7138, 7139, 7140, 7142, 7146, 7149, 7151, 7155, 7158, 7164, 7169, 7172, 7176, 7177, 7182, 7183, 7184, 7187, 7188, 7194, 7197, 7201, 7202, 7203, 7206, 7207, 7208, 7209, 7211, 7213, 7216, 7217, 7219, 7220, 7221, 7226, 7227, 7228, 7232, 7233, 7234, 7236, 7239, 7240, 7243, 7244, 7245, 7248, 7252, 7255, 7257, 7258, 7259, 7262, 7267, 7268, 7269, 7270, 7274, 7275, 7277, 7281, 7282, 7284, 7288, 7290, 7291, 7292, 7293, 7298, 7300, 7301, 7305, 7307, 7308, 7310, 7311, 7313, 7315, 7317, 7321, 7328, 7330, 7333, 7334, 7338, 7340, 7344, 7353, 7354, 7355, 7356, 7357, 7358, 7361, 7363, 7365, 7371, 7373, 7377, 7378, 7379, 7380, 7381, 7383, 7386, 7387, 7388, 7389, 7392, 7395, 7398, 7400, 7401, 7407, 7409, 7410, 7411, 7415, 7417, 7425, 7428, 7430, 7433, 7434, 7435, 7436, 7443, 7444, 7447, 7448, 7452, 7453, 7454, 7458, 7459, 7466, 7470, 7479, 7486, 7490, 7491, 7492, 7493, 7498, 7502, 7504, 7505, 7506, 7512, 7515, 7517, 7518, 7523, 7528, 7533, 7537, 7538, 7542, 7546, 7547, 7548, 7549, 7557, 7561, 7570, 7574, 7578, 7585, 7586, 7589, 7591, 7594, 7599, 7605, 7611, 7613, 7619, 7620, 7621, 7623, 7624, 7632, 7633, 7634, 7639, 7640, 7642, 7643, 7647, 7650, 7652, 7661, 7663, 7665, 7666, 7667, 7674, 7677, 7678, 7679, 7680, 7682, 7685, 7689, 7694, 7695, 7697, 7699, 7700, 7703, 7704, 7708, 7712, 7713, 7716, 7717, 7719, 7724, 7725, 7729, 7730, 7734, 7736, 7737, 7738, 7740, 7744, 7745, 7747, 7750, 7751, 7753, 7754, 7755, 7761, 7762, 7763, 7764, 7768, 7769, 7774, 7775, 7777, 7778, 7779, 7780, 7781, 7782, 7785, 7786, 7788, 7791, 7793, 7794, 7796, 7798, 7803, 7804, 7807, 7812, 7815, 7820, 7823, 7824, 7825, 7832, 7834, 7836, 7838, 7840, 7841, 7845, 7846, 7847, 7848, 7849, 7854, 7856, 7858, 7859, 7860, 7862, 7863, 7865, 7866, 7867, 7873, 7878, 7890, 7896, 7900, 7901, 7907, 7908, 7909, 7910, 7911, 7918, 7923, 7925, 7929, 7933, 7934, 7935, 7936, 7938, 7942, 7943, 7944, 7945, 7947, 7948, 7950, 7953, 7955, 7956, 7962, 7964, 7965, 7966, 7967, 7972, 7974, 7976, 7977, 7978, 7979, 7980, 7982, 7983, 7984, 7986, 7988, 7989, 7990, 7991, 7992, 7993, 8002, 8005, 8006, 8007, 8012, 8021, 8026, 8029, 8030, 8035, 8041, 8042, 8044, 8045, 8047, 8048, 8049, 8052, 8053, 8056, 8058, 8059, 8063, 8065, 8066, 8067, 8068, 8069, 8072, 8073, 8075, 8076, 8077, 8078, 8082, 8084, 8087, 8088, 8091, 8093, 8095, 8096, 8100, 8103, 8105, 8106, 8112, 8114, 8116, 8118, 8121, 8123, 8125, 8126, 8129, 8130, 8136, 8137, 8145, 8146, 8147, 8148, 8159, 8162, 8163, 8164, 8165, 8169, 8170, 8176, 8177, 8178, 8182, 8185, 8192, 8193, 8195, 8196, 8199, 8202, 8204, 8207, 8208, 8211, 8213, 8215, 8216, 8219, 8220, 8222, 8223, 8225, 8227, 8231, 8234, 8237, 8239, 8240, 8241, 8244, 8245, 8250, 8252, 8253, 8262, 8264, 8265, 8266, 8269, 8270, 8272, 8275, 8282, 8288, 8289, 8291, 8292, 8293, 8294, 8297, 8300, 8301, 8302, 8304, 8305, 8306, 8310, 8312, 8318, 8319, 8320, 8321, 8329, 8330, 8336, 8339, 8340, 8349, 8350, 8351, 8352, 8353, 8354, 8355, 8361, 8363, 8367, 8368, 8373, 8376, 8378, 8379, 8384, 8385, 8386, 8387, 8389, 8392, 8395, 8398, 8400, 8401, 8402, 8403, 8404, 8405, 8408, 8410, 8411, 8413, 8414, 8416, 8417, 8418, 8423, 8427, 8428, 8429, 8433, 8435, 8436, 8438, 8439, 8441, 8442, 8444, 8446, 8447, 8448, 8452, 8457, 8458, 8459, 8471, 8472, 8473, 8474, 8476, 8477, 8478, 8480, 8481, 8482, 8483, 8485, 8486, 8490, 8493, 8498, 8501, 8502, 8503, 8505, 8511, 8513, 8515, 8517, 8523, 8524, 8525, 8528, 8531, 8532, 8533, 8537, 8538, 8539, 8544, 8549, 8550, 8552, 8553, 8554, 8561, 8563, 8565, 8566, 8568, 8576, 8581, 8582, 8583, 8588, 8589, 8590, 8593, 8594, 8596, 8597, 8601, 8602, 8603, 8605, 8610, 8611, 8612, 8614, 8617, 8618, 8624, 8630, 8631, 8634, 8638, 8640, 8642, 8644, 8648, 8652, 8654, 8657, 8658, 8659, 8665, 8669, 8672, 8676, 8677, 8685, 8693, 8700, 8704, 8706, 8708, 8709, 8711, 8713, 8714, 8715, 8717, 8719, 8720, 8721, 8722, 8726, 8729, 8731, 8732, 8734, 8735, 8740, 8741, 8742, 8744, 8745, 8746, 8748, 8752, 8753, 8756, 8758, 8759, 8764, 8767, 8769, 8770, 8772, 8773, 8775, 8776, 8777, 8779, 8782, 8783, 8784, 8785, 8789, 8792, 8795, 8797, 8802, 8803, 8804, 8805, 8810, 8818, 8822, 8824, 8831, 8832, 8833, 8835, 8838, 8841, 8842, 8843, 8853, 8861, 8862, 8866, 8876, 8877, 8878, 8880, 8881, 8883, 8884, 8886, 8888, 8889, 8890, 8891, 8897, 8899, 8900, 8901, 8905, 8907, 8908, 8909, 8910, 8911, 8912, 8913, 8914, 8916, 8917, 8919, 8926, 8928, 8929, 8935, 8941, 8942, 8945, 8946, 8951, 8954, 8957, 8959, 8960, 8961, 8962, 8967, 8968, 8969, 8972, 8974, 8976, 8977, 8979, 8980, 8981, 8984, 8985, 8986, 8991, 8992, 8996, 8999, 9002, 9003, 9004, 9006, 9009, 9012, 9015, 9016, 9017, 9020, 9022, 9025, 9026, 9027, 9029, 9030, 9033, 9037, 9039, 9040, 9041, 9042, 9043, 9044, 9047, 9052, 9057, 9058, 9059, 9060, 9061, 9066, 9069, 9071, 9073, 9074, 9076, 9084, 9088, 9091, 9092, 9095, 9096, 9097, 9100, 9105, 9108, 9109, 9110, 9111, 9112, 9114, 9115, 9116, 9118, 9119, 9120, 9123, 9125, 9129, 9133, 9134, 9138, 9139, 9140, 9141, 9142, 9146, 9149, 9151, 9172, 9173, 9174, 9177, 9183, 9185, 9187, 9188, 9190, 9195, 9196, 9200, 9206, 9207, 9210, 9211, 9213, 9215, 9216, 9217, 9218, 9221, 9226, 9229, 9233, 9234, 9235, 9237, 9241, 9243, 9247, 9249, 9255, 9257, 9263, 9265, 9267, 9270, 9273, 9276, 9278, 9282, 9283, 9284, 9285, 9287, 9288, 9289, 9290, 9291, 9292, 9293, 9299, 9302, 9304, 9308, 9310, 9311, 9313, 9320, 9323, 9325, 9326, 9327, 9328, 9329, 9330, 9333, 9336, 9337, 9338, 9339, 9340, 9341, 9345, 9346, 9347, 9348, 9354, 9355, 9359, 9366, 9367, 9373, 9375, 9376, 9378, 9382, 9383, 9388, 9391, 9392, 9393, 9394, 9396, 9400, 9402, 9403, 9404, 9406, 9407, 9413, 9415, 9417, 9419, 9423, 9432, 9433, 9442, 9444, 9452, 9453, 9456, 9460, 9468, 9471, 9472, 9473, 9475, 9478, 9481, 9483, 9488, 9490, 9494, 9495, 9497, 9500, 9501, 9502, 9503, 9504, 9505, 9509, 9513, 9514, 9515, 9517, 9518, 9519, 9520, 9521, 9522, 9525, 9531, 9533, 9536, 9540, 9545, 9546, 9548, 9553, 9555, 9559, 9560, 9563, 9565, 9567, 9568, 9571, 9575, 9577, 9579, 9582, 9583, 9586, 9587, 9589, 9590, 9591, 9592, 9602, 9606, 9608, 9609, 9610, 9613, 9615, 9617, 9620, 9623, 9626, 9627, 9628, 9629, 9630, 9633, 9635, 9637, 9640, 9641, 9642, 9644, 9645, 9646, 9648, 9649, 9650, 9653, 9656, 9657, 9658, 9659, 9660, 9668, 9670, 9676, 9681, 9682, 9686, 9692, 9695, 9696, 9698, 9706, 9708, 9710, 9711, 9717, 9718, 9722, 9725, 9726, 9727, 9730, 9731, 9733, 9734, 9737, 9738, 9746, 9750, 9751, 9753, 9754, 9755, 9756, 9763, 9764, 9767, 9768, 9770, 9772, 9774, 9776, 9777, 9778, 9780, 9781, 9782, 9784, 9786, 9792, 9794, 9798, 9799, 9801, 9804, 9806, 9809, 9813, 9819, 9820, 9824, 9825, 9827, 9833, 9835, 9836, 9845, 9846, 9847, 9849, 9850, 9851, 9853, 9854, 9861, 9864, 9866, 9869, 9873, 9876, 9882, 9885, 9886, 9887, 9888, 9892, 9893, 9894, 9897, 9898, 9900, 9901, 9906, 9907, 9908, 9909, 9910, 9911, 9912, 9918, 9921, 9923, 9928, 9933, 9938, 9940, 9944, 9946, 9947, 9949, 9950, 9953, 9955, 9957, 9960, 9962, 9966, 9967, 9971, 9972, 9974, 9980, 9982, 9984, 9985, 9988, 9990, 9996, 9997, 9998, 10000, 10008, 10009, 10010, 10012, 10013, 10017, 10018, 10019, 10021, 10022, 10026, 10031, 10032, 10033, 10037, 10038, 10041, 10042, 10044, 10045, 10047, 10048, 10050, 10051, 10052, 10054, 10056, 10058, 10059, 10060, 10062, 10063, 10064, 10066, 10068, 10072, 10076, 10077, 10078, 10083, 10086, 10087, 10089, 10090, 10091, 10092, 10095, 10097, 10098, 10101, 10102, 10103, 10105, 10106, 10107, 10108, 10109, 10110, 10114, 10115, 10116, 10118, 10122, 10127, 10128, 10131, 10132, 10134, 10135, 10136, 10138, 10141, 10143, 10146, 10149, 10151, 10156, 10157, 10158, 10163, 10165, 10166, 10168, 10170, 10174, 10176, 10177, 10178, 10179, 10181, 10182, 10187, 10192, 10193, 10194, 10195, 10197, 10199, 10203, 10206, 10209, 10210, 10214, 10218, 10219, 10220, 10222, 10223, 10224, 10225, 10228, 10230, 10231, 10233, 10236, 10237, 10242, 10246, 10247, 10252, 10255, 10260, 10270, 10275, 10284, 10291, 10295, 10300, 10302, 10306, 10307, 10311, 10318, 10321, 10322, 10323, 10326, 10328, 10329, 10331, 10334, 10335, 10336, 10338, 10342, 10343, 10344, 10345, 10353, 10356, 10357, 10359, 10360, 10362, 10364, 10365, 10368, 10373, 10375, 10380, 10381, 10384, 10385, 10389, 10397, 10398, 10399, 10401, 10405, 10410, 10411, 10413, 10414, 10416, 10421, 10422, 10423, 10429, 10430, 10435, 10437, 10438, 10446, 10447, 10448, 10449, 10450, 10451, 10453, 10455, 10456, 10463, 10464, 10465, 10468, 10469, 10470, 10472, 10473, 10474, 10478, 10480, 10488, 10490, 10491, 10492, 10494, 10496, 10498, 10501, 10504, 10506, 10508, 10514, 10516, 10518, 10521, 10525, 10527, 10528, 10531, 10533, 10535, 10536, 10537, 10541, 10542, 10543, 10544, 10547, 10548, 10549, 10550, 10551, 10555, 10556, 10558, 10560, 10561, 10562, 10563, 10565, 10567, 10571, 10573, 10577, 10581, 10582, 10583, 10585, 10587, 10590, 10593, 10595, 10596, 10597, 10599, 10605, 10610, 10611, 10613, 10615, 10616, 10617, 10619, 10621, 10622, 10623, 10626, 10629, 10630, 10631, 10633, 10634, 10637, 10638, 10639, 10640, 10641, 10642, 10643, 10645, 10646, 10648, 10650, 10655, 10657, 10663, 10664, 10665, 10668, 10669, 10670, 10671, 10673, 10674, 10677, 10678, 10681, 10682, 10683, 10684, 10685, 10687, 10689, 10693, 10697, 10698, 10699, 10700, 10702, 10703, 10705, 10706, 10707, 10708, 10711, 10712, 10715, 10716, 10723, 10725, 10726, 10732, 10735, 10736, 10737, 10738, 10740, 10744, 10747, 10748, 10749, 10752, 10754, 10756, 10762, 10763, 10766, 10771, 10774, 10777, 10778, 10779, 10780, 10782, 10784, 10787, 10788, 10790, 10791, 10792, 10795, 10796, 10798, 10800, 10801, 10802, 10803, 10804, 10805, 10809, 10810, 10811, 10813, 10815, 10818, 10819, 10820, 10821, 10822, 10823, 10825, 10826, 10830, 10833, 10836, 10838, 10839, 10840, 10843, 10846, 10853, 10854, 10856, 10857, 10858, 10862, 10863, 10867, 10869, 10874, 10876, 10877, 10878, 10880, 10881, 10892, 10896, 10897, 10898, 10899, 10902, 10903, 10905, 10912, 10916, 10917, 10920, 10926, 10927, 10928, 10930, 10933, 10934, 10935, 10936, 10937, 10938, 10940, 10941, 10944, 10947, 10948, 10950, 10954, 10957, 10960, 10962, 10965, 10967, 10972, 10975, 10976, 10977, 10980, 10988, 10993, 10995, 10996, 10997, 10999, 11004, 11005, 11006, 11008, 11010, 11015, 11018, 11023, 11024, 11025, 11026, 11027, 11032, 11039, 11045, 11046, 11047, 11053, 11056, 11058, 11060, 11063, 11066, 11067, 11070, 11072, 11078, 11079, 11080, 11082, 11083, 11086, 11090, 11092, 11095, 11098, 11099, 11101, 11102, 11107, 11108, 11109, 11110, 11114, 11116, 11117, 11118, 11119, 11123, 11124, 11125, 11126, 11127, 11128, 11129, 11132, 11133, 11135, 11137, 11138, 11145, 11146, 11150, 11151, 11152, 11153, 11154, 11158, 11159, 11160, 11161, 11162, 11163, 11165, 11166, 11169, 11175, 11177, 11178, 11179, 11180, 11181, 11184, 11187, 11188, 11190, 11191, 11198, 11199, 11201, 11202, 11203, 11207, 11211, 11214, 11216, 11217, 11218, 11222, 11224, 11226, 11227, 11228, 11229, 11230, 11232, 11233, 11234, 11235, 11236, 11237, 11238, 11239, 11243, 11244, 11246, 11247, 11248, 11251, 11254, 11255, 11256, 11257, 11258, 11259, 11260, 11261, 11262, 11263, 11264, 11266, 11274, 11275, 11278, 11282, 11288, 11289, 11291, 11292, 11293, 11294, 11295, 11298, 11307, 11313, 11315, 11316, 11317, 11318, 11320, 11322, 11324, 11326, 11329, 11330, 11331, 11332, 11337, 11339, 11340, 11345, 11346, 11348, 11349, 11352, 11356, 11358, 11363, 11365, 11366, 11369, 11370, 11371, 11373, 11374, 11377, 11379, 11380, 11381, 11382, 11385, 11387, 11388, 11389, 11391, 11392, 11394, 11395, 11397, 11398, 11401, 11403, 11406, 11408, 11409, 11411, 11412, 11413, 11414, 11416, 11418, 11423, 11428, 11430, 11431, 11433, 11437, 11438, 11445, 11446, 11447, 11448, 11449, 11451, 11458, 11459, 11463, 11465, 11471, 11472, 11473, 11475, 11476, 11477, 11481, 11482, 11485, 11487, 11490, 11492, 11494, 11496, 11497, 11498, 11499, 11503, 11506, 11507, 11508, 11509, 11512, 11516, 11518, 11520, 11521, 11522, 11523, 11524, 11526, 11527, 11528, 11530, 11531, 11532, 11533, 11534, 11538, 11541, 11544, 11546, 11547, 11548, 11551, 11553, 11558, 11560, 11561, 11563, 11564, 11567, 11568, 11570, 11571, 11574, 11576, 11577, 11578, 11579, 11580, 11585, 11588, 11589, 11594, 11595, 11597, 11599, 11604, 11612, 11618, 11621, 11623, 11624, 11625, 11632, 11633, 11636, 11639, 11642, 11644, 11649, 11650, 11652, 11654, 11655, 11656, 11657, 11658, 11663, 11667, 11668, 11669, 11672, 11678, 11680, 11681, 11682, 11683, 11685, 11688, 11691, 11692, 11693, 11694, 11695, 11696, 11699, 11701, 11703, 11705, 11707, 11710, 11711, 11712, 11720, 11721, 11725, 11731, 11733, 11736, 11740, 11743, 11744, 11748, 11749, 11753, 11755, 11759, 11760, 11761, 11762, 11763, 11764, 11765, 11766, 11767, 11770, 11771, 11773, 11776, 11780, 11781, 11782, 11783, 11786, 11790, 11792, 11799, 11800, 11804, 11809, 11811, 11812, 11813, 11818, 11819, 11821, 11822, 11825, 11826, 11828, 11829, 11830, 11831, 11832, 11837, 11839, 11842, 11846, 11847, 11848, 11849, 11850, 11851, 11853, 11856, 11858, 11863, 11868, 11870, 11872, 11876, 11877, 11881, 11890, 11891, 11893, 11894, 11895, 11898, 11903, 11904, 11913, 11915, 11918, 11919, 11920, 11921, 11923, 11926, 11927, 11928, 11929, 11930, 11934, 11935, 11940, 11941, 11943, 11944, 11945, 11946, 11947, 11948, 11949, 11953, 11955, 11957, 11958, 11959, 11960, 11961, 11962, 11963, 11965, 11968, 11977, 11978, 11980, 11982, 11983, 11988, 11993, 11997, 11999, 12002, 12004, 12005, 12006, 12008, 12015, 12017, 12019, 12020, 12021, 12023, 12024, 12025, 12027, 12032, 12035, 12042, 12043, 12044, 12050, 12054, 12059, 12060, 12061, 12063, 12068, 12073, 12078, 12079, 12080, 12081, 12083, 12085, 12091, 12093, 12097, 12098, 12102, 12104, 12106, 12109, 12112, 12114, 12115, 12118, 12120, 12122, 12127, 12128, 12129, 12131, 12134, 12135, 12137, 12138, 12144, 12145, 12146, 12147, 12148, 12150, 12151, 12155, 12161, 12162, 12165, 12166, 12167, 12170, 12171, 12173, 12174, 12175, 12179, 12181, 12197, 12198, 12202, 12204, 12208, 12212, 12214, 12215, 12217, 12223, 12228, 12229, 12233, 12234, 12236, 12240, 12241, 12243, 12245, 12249, 12250, 12254, 12255, 12259, 12265, 12268, 12271, 12275, 12278, 12280, 12283, 12285, 12286, 12287, 12295, 12296, 12304, 12305, 12306, 12310, 12311, 12312, 12313, 12314, 12315, 12317, 12319, 12321, 12323, 12325, 12328, 12331, 12333, 12334, 12335, 12337, 12339, 12340, 12342, 12343, 12344, 12345, 12347, 12350, 12354, 12356, 12359, 12364, 12366, 12370, 12374, 12375, 12376, 12379, 12380, 12381, 12383, 12390, 12393, 12394, 12397, 12399, 12400, 12401, 12402, 12403, 12406, 12411, 12414, 12415, 12417, 12419, 12420, 12423, 12424, 12426, 12427, 12428, 12437, 12440, 12444, 12445, 12447, 12450, 12451, 12456, 12457, 12459, 12462, 12465, 12467, 12468, 12469, 12472, 12473, 12478, 12480, 12481, 12482, 12483, 12486, 12487, 12488, 12492, 12494, 12497, 12499, 12501, 12502, 12503, 12504, 12512, 12513, 12514, 12515, 12518, 12519, 12525, 12527, 12530, 12531, 12535, 12536, 12537, 12538, 12539, 12546, 12547, 12549, 12551, 12552, 12554, 12555, 12556, 12557, 12561, 12562, 12563, 12565, 12568, 12572, 12574, 12577, 12578, 12580, 12583, 12585, 12586, 12588, 12591, 12594, 12600, 12603, 12605, 12606, 12608, 12609, 12610, 12611, 12616, 12620, 12622, 12623, 12626, 12628, 12629, 12633, 12634, 12639, 12640, 12644, 12645, 12648, 12649, 12651, 12652, 12653, 12663, 12664, 12668, 12671, 12673, 12677, 12679, 12683, 12684, 12688, 12689, 12691, 12692, 12693, 12696, 12699, 12701, 12702, 12705, 12706, 12707, 12715, 12716, 12721, 12723, 12728, 12731, 12732, 12733, 12735, 12736, 12738, 12739, 12740, 12741, 12742, 12743, 12744, 12750, 12752, 12753, 12754, 12755, 12758, 12760, 12761, 12763, 12764, 12765, 12766, 12771, 12775, 12777, 12782, 12783, 12790, 12797, 12800, 12801, 12802, 12803, 12807, 12808, 12810, 12812, 12813, 12817, 12820, 12822, 12823, 12824, 12827, 12828, 12835, 12836, 12837, 12838, 12839, 12842, 12844, 12848, 12849, 12850, 12853, 12861, 12866, 12870, 12873, 12875, 12878, 12882, 12884, 12887, 12888, 12891, 12894, 12895, 12898, 12899, 12900, 12901, 12903, 12904, 12905, 12908, 12910, 12912, 12913, 12916, 12920, 12921, 12928, 12929, 12931, 12932, 12933, 12934, 12935, 12938, 12942, 12946, 12947, 12950, 12952, 12953, 12955, 12956, 12958, 12960, 12961, 12963, 12968, 12969, 12978, 12983, 12984, 12986, 12987, 12988, 12990, 12991, 12999, 13001, 13003, 13004, 13005, 13007, 13010, 13012, 13014, 13015, 13017, 13022, 13027, 13030, 13031, 13033, 13034, 13035, 13036, 13037, 13041, 13044, 13049, 13050, 13053, 13054, 13055, 13056, 13061, 13063, 13064, 13066, 13067, 13070, 13075, 13077, 13081, 13083, 13085, 13086, 13087, 13097, 13099, 13101, 13102, 13106, 13109, 13110, 13111, 13112, 13114, 13115, 13116, 13117, 13118, 13120, 13121, 13122, 13123, 13124, 13125, 13128, 13131, 13134, 13144, 13147, 13148, 13149, 13151, 13154, 13156, 13159, 13160, 13169, 13175, 13181, 13182, 13186, 13187, 13189, 13191, 13197, 13198, 13199, 13206, 13209, 13210, 13212, 13213, 13217, 13221, 13222, 13224, 13226, 13227, 13228, 13229, 13232, 13234, 13235, 13236, 13237, 13239, 13241, 13243, 13248, 13255, 13258, 13260, 13261, 13264, 13267, 13268, 13269, 13271, 13273, 13274, 13281, 13285, 13293, 13295, 13296, 13297, 13298, 13300, 13301, 13303, 13304, 13315, 13319, 13328, 13329, 13330, 13332, 13338, 13340, 13343, 13344, 13345, 13346, 13347, 13348, 13349, 13351, 13352, 13353, 13358, 13361, 13363, 13367, 13368, 13369, 13370, 13377, 13380, 13381, 13384, 13385, 13386, 13388, 13391, 13393, 13394, 13395, 13396, 13401, 13403, 13407, 13408, 13410, 13413, 13414, 13416, 13417, 13419, 13420, 13423, 13424, 13429, 13430, 13431, 13433, 13439, 13441, 13444, 13446, 13448, 13450, 13456, 13460, 13461, 13467, 13469, 13473, 13475, 13477, 13478, 13480, 13489, 13492, 13494, 13499, 13503, 13510, 13515, 13516, 13518, 13519, 13521, 13522, 13526, 13529, 13532, 13533, 13535, 13536, 13539, 13540, 13543, 13544, 13546, 13547, 13549, 13552, 13553, 13556, 13558, 13559, 13561, 13562, 13568, 13569, 13572, 13574, 13575, 13577, 13578, 13579, 13580, 13584, 13587, 13596, 13597, 13598, 13599, 13600, 13601, 13602, 13604, 13605, 13606, 13607, 13612, 13613, 13621, 13627, 13628, 13630, 13631, 13632, 13634, 13636, 13637, 13639, 13641, 13643, 13647, 13650, 13653, 13662, 13663, 13665, 13669, 13675, 13677, 13678, 13679, 13683, 13687, 13688, 13689, 13693, 13697, 13698, 13699, 13700, 13706, 13712, 13714, 13716, 13719, 13720, 13721, 13728, 13729, 13730, 13734, 13736, 13737, 13738, 13739, 13742, 13745, 13747, 13750, 13753, 13756, 13764, 13767, 13768, 13769, 13772, 13773, 13775, 13777, 13779, 13782, 13785, 13786, 13787, 13789, 13791, 13793, 13795, 13796, 13798, 13799, 13802, 13809, 13816, 13817, 13818, 13819, 13822, 13823, 13828, 13830, 13834, 13835, 13843, 13848, 13849, 13852, 13858, 13860, 13862, 13869, 13870, 13872, 13873, 13877, 13887, 13891, 13892, 13895, 13897, 13898, 13899, 13901, 13906, 13907, 13908, 13909, 13910, 13911, 13914, 13915, 13917, 13918, 13919, 13921, 13923, 13924, 13925, 13934, 13943, 13944, 13947, 13948, 13950, 13952, 13953, 13954, 13958, 13960, 13961, 13962, 13963, 13969, 13970, 13975, 13976, 13984, 13986, 13987, 13988, 13991, 13994, 13999, 14000, 14001, 14002, 14003, 14005, 14006, 14008, 14013, 14018, 14022, 14027, 14030, 14031, 14036, 14038, 14040, 14051, 14052, 14059, 14062, 14063, 14066, 14067, 14069, 14070, 14071, 14072, 14075, 14078, 14080, 14081, 14084, 14085, 14086, 14088, 14091, 14092, 14094, 14095, 14096, 14097, 14102, 14105, 14110, 14111, 14112, 14116, 14117, 14118, 14119, 14121, 14122, 14124, 14125, 14129, 14130, 14132, 14133, 14137, 14138, 14139, 14142, 14143, 14145, 14146, 14147.

Promoters expressing in the second fully expanded leaf tissue at the V5 stage at 11 a.m. include SEQ IDs: 1, 7, 11, 12, 13, 14, 15, 16, 17, 19, 20, 24, 27, 29, 31, 33, 34, 36, 37, 38, 48, 51, 53, 54, 57, 61, 64, 65, 79, 80, 88, 90, 93, 94, 95, 96, 98, 99, 100, 102, 103, 104, 108, 110, 111, 112, 115, 117, 123, 129, 130, 131, 133, 136, 137, 141, 144, 148, 152, 155, 156, 157, 159, 162, 165, 168, 172, 174, 175, 176, 179, 180, 181, 183, 187, 191, 193, 194, 196, 199, 202, 203, 205, 207, 211, 212, 214, 230, 232, 233, 236, 237, 239, 240, 242, 244, 246, 249, 250, 251, 257, 259, 267, 269, 270, 271, 273, 279, 280, 281, 284, 286, 288, 289, 293, 294, 298, 299, 301, 302, 305, 306, 308, 309, 316, 319, 320, 322, 328, 329, 332, 334, 335, 338, 342, 346, 348, 349, 352, 354, 356, 358, 359, 364, 365, 371, 373, 376, 378, 379, 381, 382, 386, 388, 393, 396, 401, 411, 414, 423, 428, 431, 433, 434, 436, 441, 448, 450, 452, 456, 459, 461, 462, 463, 466, 470, 471, 474, 478, 483, 484, 485, 488, 489, 492, 496, 501, 507, 509, 510, 511, 514, 516, 517, 520, 523, 525, 537, 538, 541, 542, 544, 546, 547, 548, 554, 556, 560, 561, 563, 578, 580, 585, 591, 594, 595, 596, 599, 601, 602, 606, 608, 609, 613, 619, 620, 630, 635, 636, 637, 638, 642, 643, 645, 647, 656, 658, 659, 661, 662, 664, 669, 671, 681, 683, 692, 693, 694, 701, 705, 706, 709, 716, 717, 718, 719, 721, 722, 723, 724, 727, 731, 732, 734, 735, 736, 740, 741, 742, 744, 749, 753, 757, 759, 760, 761, 762, 764, 765, 771, 779, 783, 784, 786, 792, 793, 794, 795, 798, 800, 804, 806, 808, 809, 811, 819, 820, 821, 829, 830, 833, 840, 845, 846, 849, 855, 856, 857, 858, 860, 862, 863, 865, 868, 869, 870, 871, 876, 877, 878, 887, 889, 890, 891, 892, 893, 895, 897, 898, 899, 900, 903, 907, 908, 910, 911, 912, 913, 915, 916, 919, 920, 924, 925, 928, 929, 931, 932, 936, 939, 943, 947, 948, 951, 953, 955, 957, 958, 960, 964, 971, 974, 975, 976, 977, 978, 979, 980, 982, 984, 985, 987, 989, 990, 991, 994, 995, 996, 997, 999, 1002, 1005, 1007, 1008, 1009, 1010, 1011, 1012, 1013, 1014, 1016, 1017, 1019, 1022, 1025, 1026, 1032, 1033, 1035, 1039, 1040, 1041, 1042, 1043, 1046, 1047, 1049, 1051, 1052, 1055, 1056, 1057, 1064, 1065, 1068, 1069, 1073, 1076, 1077, 1078, 1085, 1086, 1087, 1088, 1089, 1091, 1092, 1095, 1097, 1100, 1101, 1103, 1104, 1106, 1110, 1111, 1112, 1114, 1115, 1116, 1117, 1119, 1121, 1125, 1130, 1132, 1136, 1137, 1140, 1144, 1146, 1153, 1155, 1156, 1160, 1161, 1162, 1164, 1165, 1167, 1168, 1170, 1171, 1176, 1178, 1180, 1183, 1187, 1189, 1191, 1196, 1201, 1204, 1205, 1214, 1217, 1218, 1220, 1222, 1223, 1225, 1228, 1231, 1232, 1233, 1234, 1235, 1236, 1239, 1240, 1243, 1244, 1248, 1249, 1251, 1254, 1257, 1258, 1259, 1262, 1263, 1269, 1272, 1277, 1281, 1285, 1286, 1290, 1292, 1293, 1296, 1298, 1303, 1306, 1307, 1309, 1310, 1311, 1312, 1314, 1316, 1317, 1320, 1322, 1323, 1325, 1327, 1331, 1334, 1339, 1343, 1345, 1346, 1349, 1354, 1355, 1360, 1361, 1366, 1367, 1368, 1371, 1373, 1375, 1377, 1380, 1381, 1382, 1386, 1387, 1388, 1389, 1392, 1393, 1394, 1396, 1399, 1404, 1405, 1406, 1410, 1412, 1420, 1421, 1422, 1423, 1426, 1431, 1432, 1438, 1439, 1440, 1441, 1442, 1443, 1444, 1447, 1448, 1451, 1453, 1458, 1459, 1461, 1462, 1466, 1467, 1468, 1484, 1488, 1489, 1490, 1491, 1493, 1499, 1501, 1503, 1506, 1508, 1510, 1511, 1512, 1514, 1517, 1518, 1527, 1528, 1530, 1534, 1540, 1543, 1545, 1546, 1547, 1549, 1550, 1551, 1553, 1554, 1555, 1556, 1560, 1561, 1564, 1567, 1570, 1571, 1575, 1578, 1579, 1582, 1584, 1585, 1586, 1590, 1596, 1598, 1599, 1600, 1601, 1602, 1604, 1605, 1608, 1609, 1610, 1612, 1614, 1615, 1616, 1617, 1622, 1623, 1625, 1634, 1635, 1636, 1637, 1638, 1639, 1641, 1643, 1648, 1651, 1653, 1654, 1658, 1659, 1662, 1663, 1664, 1669, 1671, 1673, 1675, 1677, 1678, 1682, 1684, 1687, 1688, 1690, 1691, 1696, 1697, 1698, 1699, 1705, 1706, 1707, 1708, 1710, 1716, 1717, 1720, 1723, 1725, 1732, 1735, 1736, 1743, 1749, 1750, 1755, 1759, 1760, 1761, 1764, 1770, 1771, 1772, 1773, 1774, 1777, 1785, 1786, 1796, 1798, 1807, 1809, 1811, 1813, 1814, 1823, 1826, 1828, 1830, 1832, 1834, 1837, 1838, 1839, 1840, 1846, 1848, 1850, 1852, 1856, 1859, 1861, 1863, 1866, 1868, 1869, 1872, 1873, 1876, 1879, 1880, 1882, 1886, 1888, 1891, 1897, 1900, 1902, 1904, 1905, 1906, 1910, 1911, 1912, 1915, 1916, 1918, 1920, 1922, 1923, 1924, 1927, 1933, 1934, 1939, 1940, 1944, 1945, 1950, 1952, 1954, 1955, 1958, 1968, 1970, 1971, 1972, 1973, 1976, 1977, 1981, 1990, 1991, 1993, 1999, 2000, 2001, 2003, 2007, 2008, 2010, 2012, 2014, 2015, 2019, 2020, 2021, 2023, 2026, 2027, 2029, 2030, 2031, 2032, 2033, 2037, 2040, 2041, 2043, 2045, 2048, 2060, 2062, 2064, 2072, 2074, 2077, 2078, 2088, 2089, 2091, 2092, 2093, 2094, 2096, 2097, 2099, 2103, 2106, 2107, 2111, 2112, 2113, 2115, 2122, 2123, 2125, 2126, 2130, 2133, 2137, 2139, 2142, 2143, 2146, 2147, 2150, 2151, 2153, 2156, 2157, 2161, 2164, 2166, 2167, 2168, 2170, 2172, 2175, 2177, 2179, 2180, 2183, 2185, 2189, 2190, 2193, 2195, 2196, 2200, 2201, 2202, 2203, 2205, 2210, 2213, 2215, 2216, 2221, 2222, 2226, 2227, 2237, 2240, 2242, 2245, 2252, 2253, 2257, 2259, 2261, 2263, 2266, 2271, 2276, 2278, 2280, 2282, 2284, 2289, 2290, 2294, 2296, 2297, 2298, 2303, 2305, 2306, 2308, 2309, 2310, 2313, 2314, 2319, 2321, 2322, 2323, 2325, 2328, 2329, 2331, 2333, 2337, 2339, 2341, 2342, 2343, 2346, 2352, 2353, 2354, 2360, 2361, 2362, 2363, 2366, 2367, 2369, 2371, 2372, 2376, 2379, 2381, 2382, 2384, 2396, 2398, 2401, 2405, 2410, 2411, 2413, 2414, 2416, 2418, 2419, 2420, 2423, 2426, 2428, 2431, 2432, 2433, 2434, 2435, 2436, 2437, 2439, 2440, 2441, 2442, 2443, 2445, 2449, 2451, 2452, 2453, 2454, 2457, 2458, 2465, 2469, 2470, 2472, 2474, 2476, 2480, 2481, 2482, 2483, 2485, 2487, 2489, 2490, 2491, 2492, 2495, 2496, 2497, 2498, 2500, 2502, 2505, 2506, 2507, 2509, 2510, 2513, 2514, 2516, 2517, 2521, 2522, 2525, 2528, 2529, 2531, 2532, 2533, 2538, 2539, 2541, 2543, 2544, 2546, 2547, 2548, 2549, 2551, 2552, 2560, 2567, 2568, 2570, 2571, 2573, 2578, 2579, 2581, 2587, 2588, 2589, 2590, 2594, 2596, 2599, 2601, 2605, 2609, 2611, 2612, 2613, 2614, 2616, 2617, 2619, 2620, 2626, 2627, 2632, 2635, 2636, 2639, 2644, 2645, 2651, 2652, 2653, 2654, 2656, 2658, 2659, 2663, 2666, 2670, 2672, 2674, 2679, 2680, 2684, 2685, 2688, 2689, 2690, 2691, 2692, 2694, 2700, 2704, 2707, 2708, 2709, 2711, 2719, 2720, 2721, 2722, 2725, 2726, 2728, 2729, 2735, 2737, 2738, 2739, 2740, 2745, 2747, 2749, 2752, 2756, 2758, 2762, 2764, 2765, 2769, 2770, 2785, 2786, 2794, 2798, 2800, 2802, 2805, 2808, 2814, 2819, 2821, 2822, 2823, 2824, 2826, 2827, 2828, 2831, 2837, 2838, 2840, 2843, 2844, 2845, 2850, 2857, 2859, 2860, 2864, 2865, 2869, 2870, 2871, 2876, 2878, 2879, 2885, 2888, 2889, 2892, 2893, 2894, 2895, 2896, 2897, 2901, 2902, 2903, 2906, 2908, 2909, 2911, 2915, 2916, 2917, 2918, 2922, 2923, 2926, 2930, 2931, 2935, 2938, 2941, 2942, 2943, 2946, 2948, 2955, 2959, 2960, 2963, 2965, 2966, 2968, 2969, 2976, 2979, 2982, 2992, 2994, 3000, 3003, 3005, 3007, 3009, 3013, 3015, 3017, 3018, 3020, 3023, 3024, 3029, 3031, 3039, 3042, 3043, 3044, 3045, 3047, 3048, 3049, 3050, 3051, 3053, 3055, 3058, 3059, 3061, 3064, 3067, 3068, 3069, 3072, 3075, 3083, 3084, 3085, 3087, 3090, 3095, 3100, 3101, 3106, 3107, 3110, 3112, 3113, 3115, 3118, 3119, 3120, 3121, 3123, 3126, 3127, 3128, 3129, 3138, 3139, 3143, 3145, 3149, 3153, 3157, 3158, 3167, 3169, 3170, 3171, 3172, 3177, 3181, 3189, 3192, 3196, 3199, 3202, 3205, 3206, 3210, 3217, 3218, 3220, 3221, 3224, 3225, 3227, 3228, 3230, 3231, 3236, 3237, 3240, 3242, 3246, 3247, 3249, 3250, 3252, 3261, 3263, 3266, 3267, 3268, 3280, 3283, 3286, 3288, 3289, 3290, 3291, 3294, 3295, 3299, 3301, 3304, 3307, 3310, 3312, 3313, 3327, 3329, 3331, 3332, 3333, 3337, 3338, 3339, 3340, 3342, 3343, 3345, 3351, 3353, 3354, 3355, 3357, 3359, 3360, 3361, 3365, 3368, 3370, 3374, 3378, 3379, 3383, 3386, 3394, 3396, 3399, 3403, 3404, 3405, 3411, 3412, 3413, 3415, 3416, 3418, 3424, 3425, 3426, 3427, 3428, 3429, 3435, 3438, 3440, 3441, 3442, 3443, 3445, 3446, 3447, 3449, 3450, 3452, 3453, 3457, 3458, 3459, 3462, 3466, 3468, 3469, 3470, 3471, 3474, 3477, 3478, 3479, 3484, 3486, 3488, 3490, 3493, 3499, 3500, 3501, 3502, 3503, 3504, 3506, 3507, 3510, 3516, 3517, 3518, 3523, 3529, 3533, 3535, 3536, 3538, 3540, 3541, 3544, 3545, 3549, 3551, 3554, 3556, 3557, 3560, 3562, 3569, 3571, 3574, 3576, 3580, 3585, 3587, 3588, 3589, 3591, 3592, 3594, 3595, 3600, 3601, 3603, 3604, 3606, 3607, 3610, 3611, 3613, 3615, 3616, 3618, 3619, 3620, 3621, 3624, 3629, 3633, 3634, 3638, 3640, 3642, 3643, 3644, 3645, 3646, 3648, 3654, 3655, 3659, 3660, 3661, 3667, 3669, 3672, 3673, 3674, 3677, 3682, 3684, 3685, 3690, 3698, 3702, 3706, 3707, 3709, 3710, 3713, 3715, 3717, 3718, 3719, 3721, 3722, 3725, 3730, 3731, 3738, 3739, 3744, 3748, 3749, 3752, 3756, 3761, 3764, 3766, 3771, 3772, 3773, 3775, 3777, 3778, 3783, 3790, 3791, 3792, 3793, 3796, 3801, 3805, 3808, 3812, 3817, 3818, 3819, 3820, 3823, 3829, 3830, 3831, 3832, 3833, 3834, 3837, 3838, 3839, 3843, 3844, 3846, 3847, 3849, 3858, 3859, 3860, 3866, 3867, 3868, 3870, 3871, 3872, 3873, 3876, 3877, 3882, 3883, 3884, 3885, 3887, 3889, 3890, 3892, 3894, 3895, 3896, 3898, 3899, 3902, 3903, 3904, 3908, 3912, 3917, 3918, 3923, 3924, 3926, 3928, 3929, 3933, 3934, 3937, 3938, 3940, 3941, 3942, 3947, 3950, 3951, 3954, 3958, 3959, 3962, 3967, 3968, 3970, 3971, 3972, 3974, 3975, 3978, 3979, 3983, 3985, 3987, 3988, 3991, 3995, 3996, 3997, 3998, 4000, 4007, 4008, 4013, 4014, 4021, 4026, 4033, 4037, 4039, 4040, 4041, 4042, 4043, 4044, 4046, 4047, 4048, 4049, 4050, 4053, 4054, 4056, 4057, 4062, 4068, 4070, 4084, 4087, 4088, 4092, 4094, 4096, 4098, 4099, 4102, 4103, 4105, 4106, 4109, 4110, 4111, 4113, 4124, 4126, 4128, 4131, 4132, 4133, 4134, 4135, 4140, 4143, 4144, 4145, 4149, 4150, 4151, 4154, 4155, 4158, 4160, 4161, 4162, 4163, 4164, 4165, 4166, 4167, 4168, 4171, 4173, 4175, 4178, 4181, 4183, 4185, 4187, 4188, 4189, 4190, 4191, 4193, 4194, 4195, 4200, 4201, 4202, 4204, 4205, 4206, 4207, 4210, 4211, 4212, 4213, 4219, 4221, 4227, 4228, 4233, 4235, 4237, 4245, 4246, 4247, 4251, 4252, 4257, 4258, 4261, 4266, 4270, 4272, 4275, 4276, 4280, 4281, 4282, 4284, 4290, 4292, 4294, 4296, 4301, 4302, 4303, 4304, 4305, 4306, 4309, 4312, 4317, 4320, 4321, 4324, 4329, 4330, 4333, 4335, 4336, 4339, 4344, 4347, 4352, 4354, 4358, 4359, 4360, 4369, 4374, 4378, 4380, 4383, 4388, 4390, 4391, 4393, 4396, 4397, 4401, 4402, 4403, 4405, 4410, 4422, 4423, 4430, 4432, 4436, 4439, 4440, 4442, 4443, 4446, 4448, 4449, 4450, 4453, 4457, 4461, 4462, 4463, 4466, 4467, 4468, 4470, 4474, 4475, 4477, 4479, 4486, 4487, 4492, 4494, 4498, 4500, 4502, 4507, 4508, 4509, 4512, 4514, 4518, 4519, 4521, 4522, 4525, 4529, 4531, 4535, 4543, 4548, 4549, 4554, 4556, 4558, 4560, 4563, 4565, 4566, 4567, 4568, 4575, 4576, 4582, 4590, 4591, 4593, 4594, 4597, 4598, 4599, 4601, 4605, 4606, 4614, 4616, 4618, 4623, 4625, 4628, 4632, 4635, 4639, 4641, 4643, 4644, 4646, 4650, 4653, 4654, 4655, 4656, 4657, 4658, 4659, 4662, 4667, 4669, 4671, 4672, 4673, 4674, 4676, 4677, 4680, 4682, 4684, 4685, 4690, 4691, 4692, 4696, 4697, 4699, 4700, 4701, 4703, 4705, 4706, 4710, 4711, 4713, 4715, 4719, 4721, 4722, 4724, 4725, 4727, 4728, 4729, 4730, 4734, 4736, 4737, 4738, 4739, 4740, 4741, 4745, 4747, 4748, 4749, 4753, 4754, 4756, 4761, 4762, 4763, 4764, 4765, 4767, 4769, 4770, 4771, 4773, 4775, 4779, 4780, 4783, 4784, 4787, 4788, 4789, 4790, 4791, 4795, 4796, 4800, 4801, 4803, 4804, 4805, 4806, 4807, 4813, 4816, 4817, 4818, 4820, 4822, 4828, 4830, 4831, 4834, 4836, 4837, 4841, 4845, 4854, 4855, 4856, 4857, 4861, 4862, 4863, 4867, 4869, 4874, 4875, 4876, 4878, 4880, 4881, 4887, 4889, 4891, 4897, 4900, 4904, 4907, 4909, 4910, 4912, 4913, 4914, 4918, 4920, 4921, 4923, 4924, 4928, 4930, 4931, 4936, 4938, 4941, 4943, 4946, 4947, 4953, 4954, 4958, 4959, 4960, 4967, 4968, 4969, 4971, 4972, 4974, 4975, 4977, 4981, 4983, 4984, 4988, 4989, 4990, 4991, 4993, 4994, 4996, 5011, 5015, 5016, 5021, 5022, 5023, 5024, 5026, 5027, 5029, 5030, 5036, 5037, 5039, 5040, 5042, 5044, 5045, 5046, 5049, 5052, 5054, 5057, 5060, 5061, 5067, 5068, 5069, 5072, 5074, 5075, 5078, 5082, 5084, 5088, 5089, 5090, 5091, 5094, 5099, 5100, 5101, 5102, 5106, 5110, 5111, 5113, 5114, 5116, 5120, 5122, 5123, 5131, 5132, 5136, 5137, 5140, 5143, 5144, 5145, 5146, 5147, 5149, 5151, 5153, 5157, 5159, 5160, 5164, 5165, 5166, 5168, 5170, 5172, 5174, 5175, 5177, 5178, 5180, 5181, 5182, 5184, 5185, 5187, 5188, 5189, 5190, 5191, 5192, 5193, 5196, 5198, 5200, 5201, 5202, 5206, 5209, 5212, 5213, 5216, 5217, 5218, 5219, 5225, 5229, 5230, 5234, 5240, 5241, 5243, 5251, 5253, 5255, 5256, 5257, 5258, 5260, 5261, 5263, 5269, 5275, 5276, 5280, 5281, 5283, 5286, 5287, 5293, 5294, 5297, 5298, 5299, 5300, 5301, 5308, 5311, 5313, 5314, 5315, 5317, 5319, 5324, 5329, 5330, 5332, 5334, 5339, 5341, 5342, 5345, 5346, 5348, 5349, 5350, 5351, 5352, 5356, 5361, 5366, 5367, 5369, 5371, 5379, 5386, 5388, 5389, 5391, 5393, 5402, 5405, 5411, 5413, 5414, 5416, 5417, 5418, 5422, 5427, 5428, 5430, 5431, 5432, 5434, 5437, 5438, 5445, 5446, 5448, 5449, 5450, 5452, 5453, 5456, 5458, 5459, 5461, 5462, 5475, 5476, 5481, 5483, 5485, 5488, 5491, 5493, 5495, 5496, 5497, 5505, 5506, 5508, 5510, 5512, 5513, 5515, 5517, 5518, 5519, 5524, 5529, 5530, 5531, 5532, 5533, 5535, 5543, 5545, 5549, 5554, 5558, 5559, 5561, 5562, 5563, 5564, 5566, 5568, 5569, 5572, 5575, 5579, 5581, 5582, 5584, 5585, 5586, 5589, 5593, 5594, 5596, 5597, 5602, 5608, 5611, 5612, 5613, 5614, 5616, 5620, 5621, 5627, 5633, 5635, 5638, 5640, 5643, 5647, 5648, 5651, 5653, 5656, 5657, 5659, 5660, 5663, 5664, 5667, 5669, 5670, 5671, 5677, 5680, 5683, 5689, 5690, 5695, 5697, 5698, 5700, 5702, 5703, 5706, 5711, 5712, 5713, 5718, 5719, 5721, 5722, 5723, 5729, 5730, 5731, 5732, 5734, 5735, 5736, 5737, 5742, 5744, 5751, 5764, 5768, 5770, 5775, 5778, 5780, 5783, 5784, 5785, 5787, 5788, 5791, 5792, 5794, 5807, 5808, 5810, 5811, 5817, 5819, 5820, 5824, 5825, 5828, 5833, 5834, 5835, 5836, 5837, 5839, 5842, 5852, 5853, 5856, 5858, 5859, 5864, 5866, 5867, 5868, 5869, 5871, 5872, 5878, 5879, 5881, 5882, 5883, 5884, 5888, 5889, 5892, 5893, 5900, 5901, 5902, 5905, 5910, 5912, 5913, 5914, 5918, 5919, 5921, 5925, 5926, 5927, 5928, 5930, 5931, 5932, 5934, 5938, 5941, 5942, 5943, 5944, 5945, 5946, 5948, 5951, 5954, 5955, 5956, 5957, 5959, 5961, 5967, 5968, 5971, 5978, 5979, 5980, 5984, 5985, 5986, 5988, 5990, 5991, 5992, 5994, 5996, 5997, 6000, 6002, 6003, 6004, 6006, 6007, 6008, 6012, 6013, 6016, 6018, 6019, 6021, 6023, 6025, 6026, 6028, 6031, 6038, 6041, 6044, 6047, 6048, 6051, 6054, 6058, 6059, 6060, 6061, 6062, 6063, 6070, 6072, 6073, 6074, 6075, 6077, 6080, 6082, 6085, 6088, 6089, 6090, 6092, 6093, 6094, 6095, 6096, 6098, 6108, 6109, 6110, 6112, 6116, 6118, 6119, 6122, 6125, 6129, 6130, 6132, 6133, 6135, 6136, 6137, 6138, 6143, 6145, 6146, 6147, 6148, 6149, 6151, 6152, 6153, 6155, 6156, 6158, 6163, 6164, 6165, 6168, 6171, 6173, 6178, 6180, 6181, 6182, 6183, 6186, 6188, 6189, 6190, 6191, 6193, 6197, 6198, 6200, 6203, 6205, 6206, 6207, 6209, 6212, 6213, 6220, 6221, 6223, 6224, 6226, 6227, 6228, 6230, 6231, 6237, 6238, 6240, 6243, 6245, 6246, 6247, 6249, 6250, 6251, 6255, 6257, 6258, 6259, 6264, 6265, 6269, 6270, 6271, 6272, 6273, 6278, 6279, 6280, 6282, 6286, 6287, 6288, 6289, 6291, 6292, 6294, 6296, 6299, 6300, 6302, 6303, 6306, 6309, 6310, 6311, 6315, 6317, 6319, 6321, 6322, 6326, 6328, 6330, 6333, 6338, 6339, 6345, 6350, 6351, 6352, 6353, 6354, 6356, 6358, 6359, 6360, 6362, 6363, 6364, 6365, 6367, 6370, 6372, 6373, 6375, 6378, 6381, 6386, 6387, 6393, 6395, 6396, 6397, 6398, 6399, 6403, 6405, 6407, 6412, 6414, 6415, 6419, 6422, 6426, 6429, 6430, 6431, 6434, 6435, 6436, 6437, 6440, 6448, 6452, 6454, 6458, 6459, 6463, 6464, 6466, 6467, 6468, 6469, 6470, 6471, 6474, 6477, 6478, 6480, 6484, 6486, 6495, 6497, 6499, 6500, 6501, 6502, 6503, 6504, 6505, 6506, 6514, 6515, 6517, 6519, 6523, 6524, 6525, 6530, 6533, 6534, 6537, 6541, 6543, 6544, 6547, 6548, 6549, 6554, 6556, 6557, 6560, 6561, 6563, 6570, 6572, 6574, 6576, 6577, 6579, 6581, 6582, 6584, 6587, 6595, 6596, 6597, 6599, 6605, 6607, 6610, 6611, 6614, 6620, 6621, 6624, 6626, 6627, 6628, 6629, 6630, 6634, 6635, 6637, 6638, 6639, 6643, 6644, 6646, 6647, 6649, 6652, 6654, 6655, 6656, 6662, 6666, 6671, 6672, 6676, 6678, 6681, 6689, 6691, 6692, 6695, 6696, 6699, 6703, 6705, 6706, 6711, 6714, 6718, 6720, 6724, 6725, 6729, 6730, 6733, 6734, 6736, 6746, 6747, 6753, 6756, 6757, 6759, 6760, 6761, 6764, 6766, 6767, 6776, 6778, 6779, 6780, 6782, 6786, 6787, 6788, 6791, 6793, 6794, 6797, 6799, 6803, 6804, 6805, 6807, 6810, 6811, 6812, 6813, 6816, 6817, 6819, 6820, 6821, 6824, 6827, 6828, 6829, 6831, 6834, 6836, 6837, 6841, 6842, 6843, 6845, 6847, 6848, 6850, 6851, 6852, 6859, 6863, 6864, 6865, 6867, 6869, 6872, 6874, 6875, 6876, 6877, 6878, 6879, 6880, 6882, 6883, 6886, 6887, 6888, 6895, 6897, 6903, 6906, 6909, 6913, 6914, 6915, 6917, 6919, 6921, 6922, 6923, 6924, 6930, 6933, 6935, 6936, 6941, 6944, 6946, 6948, 6950, 6951, 6952, 6959, 6960, 6961, 6967, 6969, 6971, 6979, 6980, 6984, 6985, 6987, 6990, 6991, 6994, 6999, 7002, 7003, 7006, 7009, 7012, 7013, 7015, 7016, 7019, 7020, 7022, 7025, 7032, 7033, 7042, 7043, 7050, 7052, 7053, 7056, 7057, 7060, 7062, 7064, 7067, 7072, 7073, 7075, 7077, 7083, 7085, 7086, 7094, 7097, 7105, 7106, 7107, 7108, 7112, 7113, 7116, 7117, 7118, 7124, 7126, 7129, 7130, 7132, 7138, 7139, 7140, 7142, 7144, 7146, 7149, 7151, 7155, 7164, 7169, 7171, 7176, 7177, 7182, 7183, 7184, 7187, 7188, 7194, 7197, 7201, 7202, 7203, 7206, 7207, 7209, 7211, 7214, 7215, 7216, 7217, 7218, 7220, 7221, 7226, 7227, 7228, 7232, 7233, 7234, 7236, 7239, 7243, 7244, 7245, 7248, 7249, 7250, 7255, 7257, 7258, 7259, 7262, 7267, 7268, 7269, 7270, 7274, 7277, 7281, 7282, 7284, 7286, 7288, 7290, 7291, 7292, 7293, 7298, 7300, 7301, 7303, 7305, 7307, 7308, 7310, 7313, 7315, 7317, 7321, 7328, 7330, 7331, 7334, 7338, 7340, 7343, 7350, 7351, 7353, 7354, 7355, 7356, 7357, 7358, 7363, 7365, 7371, 7373, 7377, 7379, 7380, 7383, 7388, 7389, 7392, 7395, 7396, 7400, 7401, 7409, 7411, 7415, 7418, 7425, 7428, 7430, 7433, 7434, 7435, 7436, 7443, 7444, 7446, 7447, 7452, 7453, 7454, 7458, 7459, 7466, 7470, 7479, 7486, 7492, 7493, 7502, 7504, 7505, 7506, 7512, 7515, 7517, 7523, 7524, 7528, 7533, 7534, 7537, 7538, 7542, 7545, 7546, 7547, 7548, 7549, 7556, 7557, 7561, 7570, 7574, 7578, 7580, 7585, 7586, 7589, 7591, 7594, 7595, 7596, 7601, 7605, 7611, 7613, 7619, 7620, 7621, 7623, 7624, 7632, 7633, 7638, 7639, 7642, 7643, 7652, 7653, 7655, 7658, 7661, 7663, 7664, 7665, 7666, 7667, 7672, 7674, 7677, 7678, 7679, 7680, 7682, 7684, 7685, 7689, 7692, 7695, 7697, 7699, 7700, 7703, 7704, 7708, 7712, 7716, 7719, 7724, 7725, 7729, 7730, 7733, 7734, 7736, 7737, 7738, 7740, 7744, 7745, 7747, 7750, 7751, 7753, 7754, 7761, 7762, 7763, 7764, 7768, 7769, 7774, 7775, 7777, 7778, 7779, 7780, 7781, 7782, 7783, 7786, 7788, 7791, 7793, 7796, 7798, 7803, 7804, 7807, 7812, 7815, 7820, 7824, 7825, 7832, 7833, 7834, 7838, 7840, 7841, 7844, 7847, 7849, 7854, 7856, 7859, 7860, 7862, 7863, 7865, 7873, 7875, 7876, 7878, 7888, 7890, 7896, 7900, 7901, 7907, 7908, 7909, 7910, 7911, 7918, 7923, 7925, 7929, 7934, 7935, 7936, 7938, 7942, 7943, 7944, 7945, 7947, 7948, 7949, 7950, 7953, 7955, 7956, 7965, 7966, 7967, 7971, 7972, 7974, 7976, 7977, 7978, 7979, 7980, 7982, 7983, 7984, 7986, 7988, 7989, 7990, 7991, 7993, 7994, 8000, 8002, 8004, 8005, 8006, 8007, 8008, 8012, 8021, 8026, 8029, 8041, 8042, 8043, 8044, 8045, 8047, 8048, 8049, 8052, 8053, 8056, 8058, 8059, 8062, 8063, 8065, 8066, 8067, 8068, 8069, 8070, 8071, 8072, 8073, 8075, 8076, 8077, 8078, 8080, 8082, 8083, 8084, 8087, 8088, 8091, 8093, 8095, 8096, 8097, 8099, 8100, 8103, 8105, 8106, 8109, 8112, 8116, 8118, 8121, 8124, 8126, 8129, 8134, 8136, 8137, 8145, 8146, 8148, 8151, 8159, 8163, 8165, 8169, 8170, 8176, 8178, 8182, 8189, 8193, 8195, 8196, 8199, 8202, 8204, 8207, 8208, 8211, 8213, 8215, 8216, 8219, 8220, 8222, 8225, 8227, 8234, 8236, 8237, 8239, 8241, 8244, 8245, 8250, 8252, 8253, 8264, 8265, 8266, 8269, 8270, 8272, 8275, 8282, 8288, 8289, 8291, 8294, 8296, 8297, 8300, 8301, 8304, 8305, 8310, 8312, 8318, 8319, 8320, 8321, 8329, 8331, 8334, 8335, 8336, 8339, 8340, 8343, 8349, 8350, 8351, 8352, 8354, 8355, 8361, 8363, 8367, 8368, 8373, 8379, 8382, 8384, 8385, 8386, 8387, 8389, 8392, 8393, 8395, 8398, 8401, 8402, 8403, 8404, 8410, 8411, 8413, 8414, 8416, 8417, 8418, 8423, 8428, 8429, 8430, 8433, 8435, 8436, 8438, 8439, 8441, 8442, 8444, 8446, 8447, 8448, 8449, 8450, 8451, 8452, 8457, 8458, 8459, 8472, 8473, 8474, 8476, 8477, 8478, 8480, 8481, 8482, 8485, 8486, 8490, 8493, 8498, 8499, 8501, 8502, 8503, 8505, 8511, 8513, 8515, 8517, 8523, 8524, 8525, 8528, 8531, 8532, 8533, 8537, 8538, 8539, 8542, 8549, 8550, 8552, 8553, 8554, 8557, 8561, 8562, 8563, 8565, 8566, 8568, 8576, 8581, 8582, 8583, 8588, 8589, 8590, 8593, 8594, 8596, 8597, 8599, 8600, 8601, 8602, 8603, 8605, 8610, 8611, 8612, 8613, 8614, 8617, 8618, 8624, 8630, 8631, 8634, 8635, 8638, 8640, 8642, 8644, 8648, 8654, 8657, 8658, 8659, 8663, 8665, 8669, 8672, 8681, 8685, 8693, 8700, 8706, 8708, 8709, 8713, 8714, 8715, 8716, 8717, 8719, 8720, 8721, 8722, 8729, 8731, 8732, 8734, 8735, 8736, 8740, 8741, 8742, 8744, 8745, 8746, 8748, 8752, 8757, 8758, 8764, 8767, 8769, 8772, 8773, 8775, 8776, 8777, 8779, 8782, 8783, 8784, 8785, 8789, 8792, 8797, 8803, 8804, 8805, 8808, 8810, 8816, 8818, 8822, 8824, 8831, 8832, 8833, 8835, 8838, 8839, 8841, 8842, 8843, 8846, 8847, 8853, 8861, 8862, 8867, 8874, 8876, 8878, 8881, 8883, 8886, 8888, 8889, 8890, 8892, 8897, 8899, 8901, 8905, 8907, 8908, 8909, 8910, 8911, 8913, 8914, 8916, 8917, 8919, 8926, 8928, 8929, 8935, 8938, 8940, 8941, 8942, 8945, 8946, 8949, 8951, 8954, 8956, 8957, 8960, 8961, 8962, 8963, 8967, 8968, 8969, 8972, 8974, 8976, 8977, 8979, 8980, 8981, 8985, 8986, 8992, 8996, 8999, 9001, 9002, 9003, 9006, 9009, 9012, 9015, 9016, 9020, 9022, 9025, 9029, 9030, 9033, 9037, 9042, 9044, 9052, 9057, 9058, 9059, 9060, 9061, 9066, 9069, 9071, 9072, 9073, 9074, 9076, 9084, 9088, 9091, 9092, 9095, 9096, 9105, 9108, 9110, 9112, 9115, 9116, 9118, 9119, 9120, 9123, 9125, 9129, 9131, 9133, 9134, 9136, 9138, 9139, 9140, 9141, 9142, 9146, 9149, 9151, 9167, 9168, 9172, 9174, 9175, 9177, 9179, 9183, 9185, 9187, 9188, 9190, 9191, 9195, 9200, 9206, 9207, 9210, 9211, 9213, 9215, 9216, 9217, 9218, 9221, 9226, 9229, 9233, 9234, 9237, 9241, 9243, 9247, 9248, 9249, 9252, 9255, 9257, 9263, 9265, 9267, 9269, 9270, 9273, 9276, 9278, 9282, 9283, 9284, 9285, 9288, 9289, 9290, 9291, 9292, 9293, 9298, 9299, 9304, 9308, 9310, 9311, 9313, 9320, 9323, 9325, 9326, 9327, 9328, 9329, 9330, 9333, 9336, 9337, 9338, 9339, 9340, 9341, 9345, 9346, 9347, 9348, 9349, 9353, 9354, 9355, 9359, 9366, 9367, 9373, 9375, 9376, 9378, 9382, 9383, 9388, 9389, 9391, 9392, 9393, 9394, 9396, 9400, 9402, 9403, 9404, 9406, 9407, 9413, 9414, 9415, 9419, 9422, 9423, 9432, 9433, 9439, 9442, 9444, 9451, 9452, 9453, 9456, 9459, 9460, 9468, 9470, 9471, 9472, 9473, 9478, 9481, 9483, 9487, 9488, 9490, 9494, 9495, 9497, 9500, 9501, 9502, 9503, 9504, 9505, 9509, 9513, 9514, 9515, 9517, 9518, 9519, 9520, 9521, 9522, 9525, 9531, 9533, 9534, 9536, 9540, 9543, 9545, 9546, 9548, 9549, 9553, 9555, 9557, 9560, 9563, 9564, 9565, 9567, 9568, 9571, 9575, 9577, 9579, 9582, 9583, 9587, 9589, 9590, 9591, 9592, 9602, 9606, 9607, 9608, 9609, 9610, 9613, 9615, 9617, 9620, 9623, 9626, 9627, 9628, 9629, 9630, 9633, 9635, 9637, 9638, 9640, 9641, 9642, 9644, 9645, 9646, 9648, 9650, 9651, 9653, 9657, 9658, 9659, 9660, 9668, 9670, 9681, 9682, 9686, 9692, 9695, 9696, 9698, 9706, 9708, 9710, 9711, 9717, 9718, 9722, 9723, 9725, 9726, 9727, 9730, 9731, 9732, 9733, 9734, 9737, 9738, 9746, 9750, 9751, 9753, 9754, 9756, 9763, 9764, 9767, 9768, 9770, 9772, 9776, 9777, 9780, 9781, 9782, 9784, 9786, 9792, 9793, 9794, 9798, 9799, 9801, 9808, 9809, 9810, 9813, 9814, 9816, 9819, 9820, 9825, 9827, 9829, 9833, 9835, 9836, 9838, 9845, 9846, 9847, 9849, 9851, 9853, 9854, 9861, 9864, 9866, 9869, 9873, 9875, 9882, 9886, 9888, 9892, 9893, 9894, 9897, 9898, 9900, 9901, 9906, 9907, 9908, 9909, 9910, 9911, 9912, 9918, 9923, 9928, 9938, 9940, 9944, 9946, 9947, 9950, 9953, 9955, 9960, 9962, 9967, 9971, 9972, 9974, 9979, 9980, 9982, 9984, 9985, 9988, 9990, 9997, 9998, 10000, 10007, 10008, 10009, 10010, 10017, 10018, 10019, 10021, 10026, 10031, 10033, 10037, 10038, 10044, 10045, 10047, 10048, 10049, 10050, 10051, 10052, 10054, 10056, 10058, 10059, 10060, 10062, 10063, 10064, 10066, 10068, 10076, 10077, 10078, 10080, 10081, 10083, 10086, 10087, 10089, 10090, 10091, 10092, 10095, 10097, 10098, 10101, 10102, 10103, 10105, 10106, 10107, 10108, 10109, 10110, 10112, 10114, 10115, 10122, 10127, 10128, 10131, 10132, 10134, 10135, 10136, 10137, 10138, 10143, 10146, 10149, 10151, 10158, 10163, 10165, 10166, 10168, 10169, 10170, 10174, 10176, 10178, 10179, 10181, 10182, 10192, 10193, 10194, 10195, 10197, 10199, 10203, 10206, 10207, 10209, 10210, 10214, 10217, 10218, 10219, 10220, 10222, 10223, 10224, 10225, 10228, 10230, 10233, 10236, 10237, 10246, 10247, 10252, 10253, 10255, 10257, 10258, 10259, 10260, 10273, 10275, 10284, 10286, 10291, 10293, 10295, 10296, 10297, 10300, 10302, 10306, 10307, 10311, 10318, 10321, 10322, 10323, 10325, 10326, 10328, 10329, 10331, 10333, 10334, 10335, 10336, 10342, 10343, 10344, 10345, 10346, 10353, 10356, 10357, 10359, 10360, 10361, 10362, 10364, 10365, 10368, 10373, 10375, 10380, 10381, 10382, 10384, 10385, 10389, 10392, 10397, 10398, 10399, 10401, 10405, 10410, 10411, 10413, 10414, 10416, 10421, 10422, 10425, 10427, 10429, 10430, 10435, 10437, 10438, 10447, 10448, 10449, 10450, 10451, 10452, 10453, 10456, 10463, 10464, 10465, 10468, 10469, 10470, 10472, 10473, 10474, 10478, 10480, 10488, 10490, 10492, 10494, 10496, 10497, 10498, 10501, 10504, 10508, 10514, 10518, 10521, 10525, 10527, 10528, 10531, 10533, 10535, 10536, 10537, 10541, 10542, 10543, 10544, 10547, 10548, 10549, 10550, 10551, 10555, 10556, 10558, 10561, 10562, 10563, 10565, 10567, 10569, 10571, 10573, 10577, 10581, 10582, 10583, 10584, 10585, 10593, 10595, 10596, 10597, 10599, 10601, 10605, 10610, 10611, 10612, 10615, 10616, 10617, 10618, 10621, 10622, 10623, 10626, 10628, 10629, 10630, 10631, 10633, 10636, 10637, 10638, 10639, 10640, 10641, 10643, 10645, 10646, 10648, 10649, 10650, 10655, 10657, 10663, 10664, 10665, 10668, 10669, 10670, 10671, 10673, 10674, 10678, 10681, 10682, 10683, 10684, 10685, 10687, 10689, 10693, 10697, 10698, 10699, 10700, 10702, 10703, 10705, 10707, 10710, 10711, 10712, 10715, 10716, 10718, 10723, 10725, 10726, 10727, 10732, 10734, 10735, 10736, 10738, 10740, 10744, 10747, 10748, 10749, 10752, 10753, 10754, 10762, 10763, 10766, 10771, 10774, 10777, 10778, 10779, 10780, 10782, 10784, 10785, 10787, 10788, 10790, 10791, 10792, 10795, 10796, 10798, 10801, 10802, 10803, 10804, 10805, 10809, 10810, 10811, 10815, 10818, 10819, 10820, 10821, 10823, 10824, 10825, 10826, 10830, 10832, 10833, 10836, 10838, 10839, 10840, 10841, 10843, 10851, 10853, 10854, 10857, 10858, 10860, 10862, 10863, 10867, 10869, 10871, 10874, 10876, 10877, 10878, 10880, 10881, 10887, 10892, 10896, 10897, 10898, 10899, 10902, 10903, 10905, 10912, 10920, 10926, 10927, 10930, 10933, 10934, 10935, 10936, 10937, 10938, 10940, 10941, 10947, 10948, 10950, 10954, 10956, 10957, 10960, 10962, 10964, 10965, 10967, 10972, 10975, 10976, 10977, 10978, 10980, 10981, 10988, 10993, 10995, 10996, 10997, 10999, 11002, 11004, 11005, 11006, 11008, 11010, 11015, 11018, 11023, 11025, 11026, 11027, 11030, 11032, 11039, 11045, 11046, 11047, 11053, 11056, 11058, 11060, 11066, 11070, 11072, 11078, 11079, 11080, 11082, 11083, 11086, 11090, 11092, 11095, 11098, 11101, 11102, 11103, 11107, 11108, 11109, 11110, 11114, 11116, 11117, 11118, 11119, 11123, 11124, 11125, 11127, 11128, 11129, 11132, 11133, 11135, 11137, 11138, 11145, 11146, 11150, 11151, 11152, 11153, 11154, 11158, 11159, 11160, 11161, 11162, 11163, 11166, 11169, 11175, 11177, 11179, 11180, 11184, 11187, 11188, 11190, 11191, 11194, 11198, 11199, 11201, 11202, 11203, 11207, 11214, 11217, 11218, 11222, 11226, 11227, 11228, 11229, 11232, 11233, 11234, 11235, 11236, 11237, 11238, 11239, 11244, 11246, 11247, 11248, 11251, 11254, 11255, 11256, 11257, 11258, 11259, 11260, 11261, 11262, 11263, 11264, 11266, 11274, 11275, 11278, 11282, 11284, 11288, 11289, 11290, 11291, 11292, 11293, 11294, 11295, 11298, 11306, 11307, 11313, 11315, 11316, 11318, 11320, 11322, 11326, 11328, 11329, 11330, 11331, 11332, 11333, 11337, 11338, 11339, 11340, 11345, 11346, 11348, 11349, 11352, 11356, 11358, 11363, 11365, 11366, 11369, 11370, 11373, 11374, 11377, 11381, 11382, 11385, 11387, 11388, 11389, 11391, 11392, 11394, 11395, 11397, 11398, 11401, 11403, 11404, 11405, 11406, 11408, 11409, 11411, 11412, 11413, 11414, 11416, 11418, 11423, 11428, 11430, 11431, 11433, 11437, 11438, 11442, 11446, 11448, 11449, 11458, 11459, 11463, 11464, 11465, 11471, 11472, 11473, 11476, 11477, 11478, 11481, 11482, 11485, 11487, 11490, 11491, 11492, 11494, 11496, 11497, 11498, 11499, 11503, 11506, 11507, 11508, 11509, 11512, 11516, 11518, 11520, 11521, 11522, 11523, 11524, 11526, 11528, 11530, 11531, 11532, 11533, 11534, 11538, 11541, 11544, 11546, 11548, 11551, 11553, 11558, 11560, 11561, 11567, 11568, 11570, 11571, 11576, 11577, 11578, 11580, 11585, 11588, 11589, 11594, 11595, 11597, 11598, 11599, 11604, 11608, 11610, 11612, 11615, 11618, 11621, 11623, 11624, 11627, 11629, 11632, 11633, 11636, 11639, 11642, 11644, 11647, 11649, 11651, 11652, 11654, 11655, 11656, 11657, 11658, 11663, 11667, 11668, 11669, 11678, 11681, 11682, 11683, 11684, 11685, 11688, 11691, 11692, 11693, 11694, 11695, 11698, 11701, 11703, 11705, 11707, 11710, 11711, 11712, 11718, 11721, 11725, 11726, 11731, 11733, 11736, 11740, 11743, 11744, 11753, 11755, 11759, 11760, 11761, 11762, 11763, 11764, 11765, 11766, 11767, 11770, 11771, 11774, 11776, 11780, 11781, 11782, 11783, 11785, 11786, 11790, 11792, 11795, 11799, 11800, 11809, 11811, 11812, 11813, 11816, 11818, 11819, 11821, 11822, 11826, 11828, 11829, 11830, 11831, 11832, 11836, 11837, 11839, 11841, 11842, 11846, 11847, 11848, 11849, 11850, 11851, 11853, 11856, 11858, 11860, 11861, 11863, 11868, 11870, 11872, 11876, 11877, 11878, 11879, 11881, 11890, 11891, 11894, 11895, 11897, 11898, 11899, 11903, 11904, 11913, 11916, 11917, 11918, 11919, 11920, 11921, 11923, 11926, 11927, 11928, 11929, 11930, 11934, 11935, 11940, 11941, 11943, 11944, 11946, 11947, 11948, 11949, 11953, 11955, 11957, 11958, 11959, 11960, 11961, 11962, 11963, 11965, 11968, 11975, 11977, 11978, 11980, 11983, 11988, 11993, 11997, 11998, 11999, 12004, 12005, 12006, 12014, 12015, 12017, 12018, 12019, 12020, 12021, 12023, 12024, 12025, 12032, 12042, 12043, 12044, 12054, 12059, 12060, 12061, 12063, 12066, 12068, 12073, 12078, 12079, 12080, 12081, 12083, 12085, 12091, 12093, 12097, 12098, 12102, 12104, 12106, 12109, 12112, 12114, 12115, 12118, 12120, 12122, 12127, 12128, 12129, 12131, 12134, 12135, 12137, 12138, 12144, 12145, 12146, 12147, 12148, 12150, 12151, 12155, 12162, 12165, 12166, 12167, 12170, 12171, 12174, 12175, 12179, 12181, 12187, 12192, 12197, 12200, 12201, 12202, 12204, 12208, 12212, 12214, 12215, 12217, 12218, 12220, 12223, 12228, 12229, 12233, 12234, 12241, 12243, 12245, 12249, 12250, 12252, 12253, 12254, 12255, 12259, 12268, 12271, 12278, 12280, 12283, 12285, 12286, 12287, 12291, 12295, 12296, 12304, 12305, 12306, 12310, 12311, 12312, 12313, 12314, 12315, 12317, 12319, 12321, 12323, 12324, 12325, 12331, 12333, 12334, 12337, 12339, 12340, 12342, 12343, 12344, 12347, 12350, 12354, 12356, 12359, 12364, 12366, 12368, 12369, 12370, 12373, 12374, 12375, 12376, 12379, 12380, 12381, 12383, 12390, 12393, 12394, 12397, 12399, 12400, 12401, 12402, 12403, 12406, 12411, 12414, 12415, 12416, 12417, 12418, 12419, 12420, 12423, 12424, 12425, 12426, 12427, 12428, 12429, 12437, 12439, 12440, 12441, 12444, 12445, 12446, 12447, 12450, 12451, 12454, 12456, 12457, 12459, 12462, 12465, 12467, 12468, 12470, 12472, 12473, 12476, 12478, 12479, 12480, 12481, 12482, 12483, 12487, 12488, 12492, 12494, 12497, 12500, 12501, 12502, 12503, 12508, 12512, 12513, 12514, 12515, 12518, 12519, 12525, 12527, 12531, 12535, 12536, 12537, 12538, 12539, 12546, 12547, 12551, 12552, 12554, 12555, 12556, 12562, 12563, 12565, 12568, 12572, 12577, 12578, 12580, 12583, 12584, 12585, 12586, 12588, 12589, 12591, 12592, 12593, 12594, 12600, 12603, 12605, 12608, 12609, 12610, 12611, 12616, 12620, 12622, 12623, 12626, 12628, 12629, 12633, 12634, 12638, 12639, 12640, 12644, 12645, 12648, 12649, 12651, 12663, 12664, 12668, 12670, 12671, 12675, 12679, 12682, 12683, 12684, 12688, 12691, 12693, 12696, 12699, 12701, 12702, 12705, 12706, 12707, 12710, 12713, 12715, 12721, 12723, 12728, 12729, 12731, 12732, 12733, 12735, 12738, 12739, 12740, 12741, 12742, 12743, 12744, 12752, 12753, 12754, 12755, 12758, 12760, 12761, 12763, 12764, 12765, 12766, 12771, 12775, 12777, 12782, 12783, 12790, 12793, 12797, 12800, 12801, 12802, 12803, 12804, 12807, 12810, 12812, 12813, 12817, 12818, 12820, 12822, 12823, 12824, 12826, 12827, 12828, 12834, 12835, 12836, 12837, 12838, 12839, 12848, 12849, 12850, 12853, 12861, 12866, 12870, 12873, 12875, 12878, 12887, 12891, 12898, 12899, 12900, 12901, 12902, 12903, 12904, 12905, 12908, 12910, 12912, 12913, 12916, 12920, 12921, 12928, 12929, 12931, 12932, 12933, 12934, 12935, 12939, 12942, 12946, 12947, 12950, 12952, 12953, 12956, 12957, 12958, 12960, 12961, 12963, 12967, 12968, 12969, 12972, 12978, 12986, 12987, 12988, 12990, 12991, 12999, 13001, 13003, 13004, 13007, 13010, 13014, 13017, 13022, 13027, 13030, 13031, 13032, 13034, 13035, 13037, 13040, 13041, 13044, 13047, 13049, 13050, 13053, 13054, 13055, 13056, 13061, 13063, 13064, 13066, 13067, 13069, 13070, 13071, 13075, 13077, 13079, 13082, 13083, 13085, 13086, 13087, 13098, 13099, 13101, 13102, 13105, 13106, 13109, 13110, 13111, 13112, 13114, 13116, 13117, 13118, 13120, 13121, 13122, 13123, 13124, 13125, 13127, 13128, 13131, 13134, 13136, 13143, 13144, 13147, 13148, 13149, 13151, 13154, 13156, 13159, 13167, 13169, 13175, 13181, 13182, 13186, 13187, 13189, 13197, 13198, 13199, 13206, 13207, 13209, 13212, 13213, 13217, 13221, 13224, 13225, 13228, 13229, 13231, 13232, 13234, 13235, 13236, 13237, 13239, 13241, 13243, 13248, 13255, 13260, 13261, 13262, 13263, 13264, 13265, 13267, 13268, 13269, 13271, 13273, 13274, 13281, 13285, 13293, 13295, 13296, 13297, 13298, 13300, 13301, 13303, 13304, 13315, 13316, 13317, 13328, 13329, 13330, 13332, 13338, 13340, 13343, 13344, 13345, 13346, 13347, 13348, 13349, 13352, 13353, 13358, 13363, 13367, 13368, 13369, 13370, 13377, 13380, 13381, 13385, 13386, 13388, 13391, 13393, 13394, 13395, 13396, 13397, 13398, 13401, 13403, 13407, 13408, 13410, 13414, 13416, 13417, 13419, 13420, 13423, 13424, 13428, 13429, 13430, 13431, 13433, 13439, 13441, 13446, 13448, 13450, 13451, 13454, 13456, 13460, 13467, 13469, 13473, 13474, 13475, 13477, 13478, 13480, 13489, 13491, 13492, 13494, 13499, 13503, 13507, 13510, 13515, 13519, 13521, 13522, 13526, 13532, 13535, 13536, 13539, 13540, 13543, 13544, 13546, 13547, 13549, 13552, 13553, 13556, 13558, 13559, 13560, 13561, 13562, 13565, 13566, 13568, 13569, 13572, 13574, 13577, 13578, 13579, 13580, 13582, 13584, 13587, 13596, 13597, 13598, 13599, 13600, 13601, 13602, 13604, 13605, 13606, 13607, 13612, 13613, 13621, 13627, 13628, 13629, 13630, 13631, 13632, 13634, 13636, 13637, 13638, 13641, 13643, 13647, 13650, 13653, 13660, 13662, 13663, 13665, 13669, 13675, 13677, 13678, 13679, 13683, 13687, 13688, 13689, 13693, 13696, 13697, 13698, 13699, 13700, 13706, 13710, 13712, 13713, 13714, 13715, 13716, 13719, 13720, 13729, 13730, 13734, 13736, 13737, 13738, 13739, 13742, 13745, 13747, 13749, 13750, 13753, 13755, 13756, 13763, 13764, 13766, 13767, 13769, 13772, 13773, 13775, 13777, 13782, 13783, 13785, 13786, 13787, 13788, 13791, 13793, 13795, 13796, 13798, 13799, 13802, 13809, 13816, 13817, 13818, 13819, 13822, 13823, 13828, 13830, 13834, 13835, 13843, 13849, 13852, 13856, 13858, 13859, 13860, 13862, 13866, 13869, 13870, 13872, 13873, 13877, 13887, 13891, 13892, 13895, 13897, 13898, 13899, 13901, 13906, 13907, 13908, 13909, 13910, 13911, 13917, 13918, 13919, 13921, 13923, 13924, 13925, 13927, 13929, 13932, 13934, 13938, 13942, 13944, 13947, 13948, 13949, 13950, 13952, 13953, 13954, 13958, 13960, 13962, 13963, 13969, 13970, 13976, 13984, 13986, 13987, 13990, 13994, 13999, 14000, 14001, 14002, 14003, 14005, 14006, 14007, 14008, 14013, 14014, 14016, 14018, 14022, 14027, 14030, 14031, 14036, 14038, 14052, 14059, 14062, 14063, 14066, 14067, 14069, 14070, 14071, 14075, 14078, 14081, 14083, 14084, 14085, 14086, 14088, 14091, 14092, 14094, 14096, 14097, 14102, 14104, 14106, 14110, 14111, 14112, 14115, 14116, 14118, 14121, 14122, 14124, 14129, 14130, 14132, 14133, 14138, 14139, 14142, 14145, 14146, 14147.

Prmooters expressing in the second fully expanded leaf tissue a the V5 stage at 11 p.m. include SEQ IDs: 1, 7, 11, 12, 13, 14, 15, 16, 17, 19, 20, 24, 27, 29, 32, 33, 34, 36, 37, 38, 48, 51, 53, 54, 57, 61, 63, 64, 65, 76, 79, 88, 93, 94, 95, 96, 98, 99, 102, 103, 104, 108, 110, 111, 112, 115, 117, 123, 129, 130, 131, 133, 141, 142, 143, 144, 148, 152, 154, 155, 162, 165, 168, 172, 174, 176, 179, 180, 181, 183, 187, 191, 193, 194, 196, 199, 202, 205, 207, 211, 212, 214, 230, 232, 233, 235, 236, 237, 239, 240, 242, 244, 246, 249, 250, 251, 257, 259, 264, 267, 269, 270, 271, 273, 280, 281, 286, 288, 289, 293, 298, 299, 301, 302, 305, 306, 307, 308, 309, 316, 319, 322, 328, 329, 332, 334, 335, 338, 342, 346, 348, 349, 352, 354, 356, 357, 358, 359, 360, 364, 365, 371, 372, 373, 376, 378, 379, 381, 382, 388, 393, 396, 401, 411, 412, 414, 418, 423, 424, 427, 428, 431, 432, 433, 434, 436, 441, 450, 452, 454, 456, 459, 461, 463, 470, 471, 474, 478, 483, 484, 485, 488, 489, 492, 496, 501, 507, 509, 510, 514, 516, 517, 520, 523, 525, 532, 537, 538, 541, 542, 544, 546, 547, 548, 554, 560, 561, 563, 578, 580, 585, 591, 594, 595, 596, 599, 601, 602, 606, 609, 613, 619, 620, 633, 635, 636, 637, 638, 642, 643, 655, 656, 661, 664, 666, 667, 668, 669, 671, 681, 683, 687, 692, 693, 694, 695, 701, 702, 705, 706, 707, 708, 717, 718, 719, 721, 722, 723, 724, 725, 727, 731, 732, 734, 735, 736, 739, 740, 741, 742, 744, 749, 752, 753, 757, 759, 760, 761, 762, 763, 764, 765, 770, 771, 779, 783, 784, 786, 792, 793, 798, 800, 804, 806, 808, 809, 811, 819, 820, 821, 827, 829, 830, 833, 840, 845, 849, 855, 856, 857, 858, 860, 862, 863, 865, 868, 870, 871, 876, 877, 878, 887, 890, 892, 893, 895, 897, 898, 899, 900, 903, 907, 908, 910, 911, 912, 913, 915, 916, 919, 920, 924, 925, 928, 929, 931, 932, 934, 936, 939, 943, 947, 951, 953, 955, 957, 958, 960, 964, 971, 974, 975, 976, 977, 978, 979, 980, 982, 984, 987, 988, 989, 990, 991, 994, 995, 996, 997, 999, 1005, 1007, 1008, 1009, 1010, 1011, 1012, 1013, 1014, 1017, 1022, 1025, 1026, 1032, 1033, 1035, 1038, 1039, 1040, 1041, 1042, 1043, 1045, 1046, 1047, 1049, 1051, 1052, 1055, 1056, 1057, 1064, 1065, 1068, 1069, 1070, 1073, 1076, 1077, 1078, 1085, 1086, 1087, 1088, 1089, 1091, 1092, 1095, 1100, 1101, 1103, 1104, 1106, 1110, 1112, 1114, 1115, 1116, 1117, 1119, 1121, 1125, 1130, 1132, 1136, 1137, 1140, 1143, 1144, 1146, 1148, 1153, 1155, 1160, 1161, 1162, 1164, 1165, 1167, 1168, 1170, 1171, 1176, 1178, 1183, 1187, 1189, 1190, 1191, 1196, 1201, 1203, 1204, 1205, 1213, 1214, 1217, 1218, 1220, 1223, 1225, 1228, 1230, 1231, 1232, 1233, 1234, 1235, 1236, 1239, 1240, 1243, 1244, 1248, 1249, 1251, 1254, 1257, 1258, 1259, 1263, 1269, 1277, 1281, 1285, 1286, 1290, 1292, 1293, 1296, 1298, 1301, 1303, 1306, 1307, 1309, 1310, 1311, 1316, 1317, 1320, 1327, 1331, 1334, 1345, 1346, 1347, 1349, 1354, 1355, 1360, 1366, 1368, 1371, 1373, 1375, 1377, 1380, 1381, 1386, 1387, 1388, 1389, 1392, 1393, 1394, 1396, 1399, 1404, 1405, 1406, 1415, 1416, 1420, 1421, 1423, 1426, 1431, 1432, 1438, 1439, 1441, 1442, 1447, 1448, 1451, 1453, 1458, 1459, 1461, 1462, 1466, 1467, 1468, 1475, 1484, 1488, 1490, 1493, 1499, 1501, 1503, 1506, 1508, 1510, 1511, 1512, 1514, 1517, 1518, 1525, 1526, 1527, 1528, 1530, 1534, 1539, 1540, 1543, 1545, 1546, 1547, 1548, 1549, 1550, 1551, 1553, 1554, 1555, 1556, 1564, 1567, 1568, 1570, 1571, 1575, 1578, 1579, 1582, 1584, 1586, 1590, 1596, 1598, 1599, 1600, 1601, 1602, 1604, 1605, 1608, 1609, 1610, 1612, 1614, 1615, 1616, 1617, 1622, 1623, 1625, 1634, 1635, 1637, 1638, 1639, 1643, 1653, 1654, 1658, 1659, 1662, 1663, 1664, 1669, 1671, 1673, 1675, 1678, 1681, 1682, 1684, 1685, 1687, 1690, 1691, 1696, 1697, 1698, 1699, 1705, 1706, 1707, 1708, 1710, 1716, 1717, 1720, 1725, 1732, 1735, 1736, 1743, 1750, 1755, 1759, 1761, 1764, 1769, 1770, 1772, 1773, 1774, 1777, 1785, 1786, 1791, 1796, 1798, 1807, 1808, 1809, 1811, 1813, 1814, 1823, 1826, 1828, 1830, 1832, 1834, 1837, 1838, 1839, 1840, 1845, 1846, 1848, 1850, 1852, 1856, 1859, 1861, 1866, 1868, 1869, 1872, 1876, 1879, 1882, 1886, 1888, 1891, 1897, 1900, 1902, 1905, 1906, 1910, 1911, 1912, 1915, 1916, 1918, 1920, 1922, 1923, 1924, 1927, 1930, 1931, 1933, 1934, 1939, 1940, 1945, 1950, 1951, 1952, 1954, 1955, 1956, 1958, 1968, 1969, 1970, 1971, 1972, 1973, 1976, 1977, 1990, 1991, 1993, 1999, 2000, 2001, 2003, 2007, 2010, 2012, 2014, 2015, 2016, 2017, 2019, 2020, 2021, 2027, 2029, 2030, 2031, 2032, 2033, 2037, 2040, 2041, 2043, 2045, 2048, 2058, 2060, 2062, 2064, 2066, 2072, 2074, 2077, 2078, 2085, 2088, 2089, 2091, 2092, 2093, 2094, 2096, 2097, 2099, 2103, 2104, 2106, 2109, 2111, 2112, 2113, 2115, 2122, 2123, 2125, 2126, 2130, 2133, 2137, 2139, 2142, 2143, 2146, 2147, 2150, 2151, 2153, 2156, 2157, 2161, 2162, 2164, 2166, 2167, 2168, 2170, 2172, 2173, 2175, 2177, 2179, 2183, 2185, 2189, 2190, 2193, 2195, 2196, 2200, 2202, 2203, 2205, 2210, 2213, 2215, 2218, 2220, 2221, 2222, 2226, 2227, 2237, 2240, 2241, 2242, 2244, 2245, 2252, 2253, 2257, 2260, 2261, 2263, 2266, 2271, 2276, 2278, 2280, 2282, 2284, 2289, 2297, 2298, 2303, 2305, 2308, 2309, 2310, 2314, 2322, 2323, 2325, 2328, 2329, 2331, 2333, 2339, 2342, 2343, 2346, 2352, 2353, 2354, 2358, 2360, 2363, 2366, 2367, 2369, 2371, 2376, 2379, 2381, 2382, 2383, 2384, 2396, 2398, 2401, 2402, 2405, 2410, 2413, 2414, 2416, 2418, 2419, 2420, 2423, 2426, 2428, 2430, 2433, 2435, 2437, 2439, 2440, 2441, 2442, 2443, 2445, 2449, 2451, 2452, 2453, 2454, 2457, 2458, 2465, 2469, 2470, 2472, 2474, 2476, 2480, 2481, 2482, 2485, 2487, 2489, 2490, 2491, 2492, 2495, 2496, 2497, 2498, 2500, 2504, 2505, 2506, 2507, 2509, 2513, 2516, 2517, 2521, 2522, 2525, 2526, 2528, 2529, 2531, 2532, 2533, 2538, 2539, 2540, 2541, 2543, 2544, 2546, 2547, 2548, 2549, 2551, 2552, 2557, 2559, 2560, 2567, 2568, 2570, 2571, 2573, 2578, 2579, 2581, 2587, 2589, 2590, 2594, 2596, 2599, 2600, 2601, 2605, 2609, 2611, 2612, 2613, 2614, 2616, 2617, 2619, 2620, 2625, 2626, 2627, 2632, 2635, 2639, 2644, 2648, 2651, 2652, 2654, 2656, 2658, 2659, 2660, 2661, 2662, 2672, 2674, 2679, 2680, 2684, 2685, 2687, 2688, 2689, 2690, 2691, 2692, 2694, 2700, 2704, 2707, 2708, 2709, 2711, 2719, 2720, 2721, 2722, 2723, 2725, 2728, 2729, 2735, 2737, 2738, 2739, 2740, 2744, 2745, 2746, 2747, 2749, 2752, 2756, 2758, 2759, 2760, 2764, 2765, 2769, 2770, 2779, 2784, 2785, 2786, 2787, 2794, 2798, 2800, 2801, 2802, 2805, 2808, 2814, 2819, 2821, 2822, 2823, 2824, 2826, 2827, 2828, 2831, 2833, 2838, 2840, 2845, 2850, 2854, 2855, 2859, 2860, 2862, 2864, 2865, 2869, 2870, 2871, 2876, 2878, 2879, 2885, 2888, 2889, 2890, 2892, 2893, 2894, 2895, 2896, 2897, 2902, 2903, 2906, 2908, 2909, 2915, 2916, 2917, 2918, 2919, 2922, 2923, 2926, 2930, 2931, 2935, 2938, 2941, 2942, 2943, 2946, 2948, 2950, 2955, 2959, 2960, 2963, 2965, 2966, 2968, 2969, 2976, 2979, 2982, 2992, 2994, 3000, 3003, 3005, 3007, 3008, 3009, 3013, 3017, 3018, 3020, 3023, 3024, 3029, 3031, 3039, 3042, 3043, 3044, 3045, 3047, 3048, 3049, 3050, 3051, 3053, 3055, 3058, 3059, 3064, 3068, 3069, 3072, 3075, 3080, 3083, 3084, 3085, 3087, 3090, 3096, 3100, 3101, 3107, 3110, 3112, 3113, 3115, 3116, 3118, 3119, 3120, 3121, 3123, 3126, 3127, 3128, 3129, 3138, 3139, 3141, 3143, 3145, 3153, 3167, 3169, 3170, 3171, 3172, 3177, 3181, 3189, 3192, 3194, 3196, 3199, 3202, 3205, 3206, 3208, 3210, 3217, 3218, 3219, 3220, 3221, 3224, 3225, 3227, 3228, 3230, 3231, 3236, 3237, 3240, 3242, 3246, 3247, 3249, 3252, 3253, 3255, 3261, 3263, 3266, 3267, 3268, 3272, 3280, 3286, 3288, 3289, 3290, 3291, 3294, 3295, 3299, 3301, 3304, 3307, 3310, 3312, 3313, 3314, 3324, 3327, 3329, 3331, 3332, 3333, 3335, 3337, 3338, 3339, 3340, 3342, 3343, 3345, 3351, 3353, 3355, 3357, 3359, 3361, 3365, 3370, 3374, 3378, 3379, 3383, 3386, 3394, 3396, 3399, 3402, 3403, 3404, 3405, 3411, 3412, 3413, 3416, 3418, 3424, 3425, 3426, 3427, 3428, 3429, 3435, 3438, 3440, 3443, 3445, 3446, 3447, 3449, 3450, 3452, 3453, 3458, 3460, 3462, 3466, 3468, 3469, 3470, 3471, 3474, 3477, 3478, 3479, 3484, 3486, 3488, 3490, 3493, 3500, 3501, 3502, 3503, 3504, 3506, 3507, 3510, 3516, 3517, 3518, 3523, 3524, 3529, 3533, 3535, 3536, 3538, 3540, 3541, 3544, 3545, 3548, 3549, 3551, 3554, 3556, 3557, 3558, 3560, 3562, 3563, 3569, 3571, 3574, 3576, 3580, 3587, 3588, 3589, 3592, 3594, 3595, 3600, 3601, 3603, 3604, 3606, 3610, 3611, 3613, 3615, 3616, 3618, 3619, 3620, 3621, 3624, 3629, 3633, 3634, 3640, 3642, 3643, 3644, 3645, 3646, 3648, 3654, 3655, 3659, 3660, 3661, 3667, 3669, 3671, 3672, 3674, 3677, 3682, 3684, 3685, 3690, 3698, 3702, 3706, 3707, 3709, 3710, 3713, 3715, 3717, 3718, 3721, 3722, 3725, 3730, 3731, 3738, 3739, 3744, 3748, 3749, 3752, 3761, 3763, 3764, 3766, 3772, 3773, 3774, 3775, 3777, 3778, 3783, 3785, 3791, 3792, 3793, 3801, 3806, 3808, 3812, 3817, 3818, 3819, 3820, 3823, 3829, 3830, 3831, 3832, 3833, 3837, 3838, 3839, 3843, 3844, 3846, 3849, 3858, 3859, 3860, 3866, 3867, 3868, 3869, 3870, 3871, 3872, 3873, 3875, 3876, 3877, 3882, 3883, 3884, 3885, 3887, 3889, 3892, 3894, 3895, 3898, 3899, 3902, 3904, 3907, 3908, 3912, 3913, 3917, 3918, 3923, 3924, 3926, 3928, 3929, 3933, 3934, 3937, 3938, 3940, 3941, 3947, 3950, 3951, 3954, 3955, 3958, 3959, 3962, 3964, 3967, 3968, 3969, 3970, 3971, 3972, 3974, 3975, 3978, 3979, 3983, 3987, 3988, 3991, 3995, 3996, 4000, 4007, 4008, 4013, 4014, 4026, 4030, 4033, 4037, 4039, 4040, 4041, 4042, 4043, 4044, 4046, 4047, 4048, 4049, 4050, 4053, 4054, 4056, 4057, 4062, 4068, 4070, 4075, 4084, 4088, 4092, 4094, 4099, 4103, 4105, 4106, 4109, 4110, 4111, 4113, 4124, 4128, 4131, 4133, 4134, 4135, 4140, 4143, 4144, 4149, 4150, 4154, 4155, 4160, 4161, 4162, 4163, 4164, 4165, 4166, 4167, 4168, 4171, 4173, 4175, 4176, 4178, 4183, 4185, 4187, 4188, 4189, 4190, 4191, 4193, 4201, 4202, 4204, 4205, 4206, 4207, 4210, 4211, 4212, 4213, 4219, 4221, 4222, 4227, 4228, 4232, 4233, 4235, 4245, 4246, 4247, 4251, 4257, 4258, 4260, 4261, 4266, 4270, 4272, 4275, 4276, 4280, 4281, 4284, 4292, 4294, 4296, 4298, 4301, 4302, 4305, 4306, 4309, 4312, 4314, 4320, 4321, 4324, 4329, 4330, 4333, 4335, 4337, 4339, 4344, 4347, 4352, 4354, 4358, 4359, 4360, 4369, 4378, 4380, 4383, 4388, 4390, 4391, 4393, 4395, 4396, 4397, 4401, 4402, 4403, 4404, 4405, 4409, 4410, 4422, 4423, 4430, 4436, 4439, 4440, 4442, 4443, 4446, 4448, 4449, 4450, 4453, 4457, 4461, 4462, 4463, 4466, 4467, 4468, 4470, 4474, 4475, 4479, 4486, 4487, 4492, 4494, 4497, 4498, 4500, 4502, 4507, 4508, 4509, 4512, 4514, 4515, 4518, 4519, 4521, 4522, 4529, 4531, 4535, 4543, 4548, 4549, 4551, 4554, 4555, 4556, 4557, 4558, 4560, 4562, 4563, 4565, 4566, 4567, 4568, 4575, 4576, 4580, 4582, 4583, 4590, 4591, 4594, 4596, 4597, 4598, 4599, 4601, 4606, 4616, 4618, 4623, 4625, 4628, 4632, 4636, 4639, 4641, 4643, 4644, 4645, 4646, 4647, 4650, 4651, 4653, 4654, 4655, 4656, 4657, 4658, 4659, 4662, 4667, 4669, 4671, 4672, 4673, 4674, 4676, 4677, 4680, 4682, 4684, 4685, 4690, 4691, 4692, 4696, 4697, 4699, 4700, 4701, 4703, 4704, 4705, 4706, 4710, 4711, 4713, 4715, 4719, 4721, 4722, 4723, 4724, 4725, 4727, 4728, 4729, 4730, 4734, 4736, 4737, 4738, 4739, 4740, 4741, 4745, 4747, 4748, 4749, 4753, 4754, 4756, 4761, 4762, 4763, 4767, 4769, 4770, 4771, 4773, 4775, 4778, 4779, 4780, 4783, 4784, 4787, 4788, 4789, 4790, 4791, 4795, 4800, 4801, 4804, 4805, 4806, 4807, 4809, 4813, 4816, 4817, 4818, 4820, 4822, 4828, 4830, 4831, 4834, 4836, 4837, 4845, 4853, 4854, 4855, 4856, 4857, 4861, 4862, 4863, 4867, 4869, 4874, 4875, 4876, 4878, 4880, 4881, 4887, 4889, 4891, 4897, 4900, 4904, 4905, 4909, 4910, 4912, 4914, 4915, 4918, 4920, 4921, 4923, 4931, 4936, 4938, 4941, 4943, 4947, 4953, 4954, 4955, 4958, 4959, 4967, 4968, 4969, 4971, 4972, 4974, 4975, 4981, 4984, 4988, 4989, 4990, 4991, 4993, 4994, 4996, 5000, 5005, 5011, 5015, 5016, 5022, 5023, 5024, 5026, 5029, 5030, 5034, 5036, 5037, 5039, 5040, 5042, 5044, 5045, 5046, 5052, 5054, 5057, 5060, 5061, 5067, 5072, 5074, 5075, 5078, 5082, 5084, 5088, 5089, 5090, 5091, 5094, 5100, 5101, 5102, 5106, 5110, 5111, 5113, 5114, 5115, 5116, 5120, 5122, 5123, 5131, 5132, 5140, 5144, 5145, 5146, 5147, 5150, 5154, 5157, 5160, 5164, 5165, 5168, 5170, 5174, 5175, 5177, 5178, 5180, 5181, 5182, 5185, 5187, 5188, 5189, 5190, 5191, 5192, 5193, 5196, 5198, 5200, 5202, 5206, 5209, 5212, 5213, 5216, 5217, 5218, 5219, 5225, 5229, 5230, 5234, 5240, 5241, 5253, 5254, 5256, 5257, 5258, 5260, 5261, 5263, 5268, 5269, 5273, 5275, 5276, 5280, 5281, 5283, 5286, 5293, 5297, 5298, 5299, 5300, 5301, 5308, 5311, 5314, 5315, 5317, 5319, 5321, 5324, 5327, 5329, 5330, 5332, 5333, 5334, 5338, 5339, 5341, 5342, 5345, 5346, 5348, 5349, 5350, 5351, 5352, 5356, 5361, 5366, 5367, 5369, 5371, 5379, 5386, 5388, 5389, 5391, 5393, 5396, 5402, 5405, 5409, 5411, 5413, 5414, 5416, 5417, 5418, 5422, 5427, 5428, 5431, 5434, 5437, 5438, 5445, 5446, 5448, 5449, 5452, 5453, 5456, 5458, 5459, 5461, 5463, 5464, 5469, 5475, 5481, 5483, 5485, 5487, 5488, 5491, 5493, 5495, 5496, 5505, 5506, 5508, 5510, 5513, 5515, 5517, 5518, 5519, 5524, 5526, 5529, 5530, 5532, 5535, 5543, 5545, 5549, 5554, 5557, 5558, 5559, 5562, 5563, 5564, 5566, 5568, 5569, 5572, 5575, 5579, 5581, 5582, 5584, 5585, 5589, 5593, 5594, 5596, 5597, 5608, 5612, 5613, 5614, 5616, 5620, 5621, 5627, 5632, 5633, 5635, 5638, 5640, 5643, 5647, 5648, 5651, 5652, 5653, 5655, 5656, 5657, 5660, 5662, 5663, 5664, 5667, 5669, 5670, 5671, 5677, 5680, 5683, 5689, 5690, 5694, 5695, 5697, 5698, 5700, 5702, 5706, 5709, 5711, 5712, 5713, 5718, 5719, 5721, 5722, 5723, 5729, 5730, 5731, 5732, 5734, 5735, 5736, 5737, 5742, 5744, 5751, 5764, 5768, 5770, 5773, 5775, 5778, 5780, 5783, 5784, 5785, 5787, 5788, 5791, 5792, 5794, 5808, 5810, 5811, 5819, 5820, 5825, 5834, 5835, 5836, 5837, 5842, 5844, 5852, 5853, 5854, 5856, 5858, 5859, 5863, 5864, 5866, 5867, 5868, 5869, 5871, 5872, 5877, 5878, 5879, 5881, 5882, 5883, 5884, 5888, 5889, 5892, 5893, 5900, 5901, 5902, 5905, 5910, 5912, 5918, 5919, 5921, 5925, 5926, 5927, 5928, 5930, 5931, 5932, 5933, 5938, 5941, 5942, 5943, 5944, 5945, 5946, 5948, 5950, 5951, 5954, 5955, 5956, 5957, 5959, 5961, 5968, 5971, 5978, 5979, 5980, 5984, 5985, 5986, 5988, 5990, 5991, 5992, 5994, 5996, 5997, 6000, 6002, 6003, 6004, 6006, 6007, 6008, 6010, 6012, 6013, 6016, 6021, 6023, 6025, 6026, 6028, 6031, 6038, 6040, 6041, 6044, 6047, 6048, 6051, 6054, 6058, 6059, 6060, 6061, 6062, 6063, 6070, 6072, 6073, 6074, 6075, 6077, 6080, 6085, 6088, 6089, 6090, 6092, 6093, 6094, 6095, 6096, 6098, 6108, 6109, 6112, 6113, 6116, 6118, 6119, 6122, 6125, 6129, 6130, 6132, 6133, 6135, 6136, 6137, 6143, 6144, 6145, 6146, 6147, 6148, 6149, 6151, 6152, 6153, 6155, 6156, 6158, 6163, 6164, 6165, 6168, 6171, 6173, 6180, 6181, 6182, 6183, 6186, 6188, 6189, 6191, 6193, 6197, 6198, 6200, 6203, 6205, 6206, 6207, 6209, 6212, 6220, 6221, 6223, 6224, 6226, 6227, 6228, 6230, 6231, 6237, 6238, 6240, 6243, 6244, 6245, 6246, 6247, 6249, 6250, 6251, 6255, 6257, 6258, 6259, 6260, 6264, 6265, 6270, 6271, 6272, 6273, 6278, 6279, 6280, 6282, 6286, 6288, 6289, 6291, 6292, 6294, 6299, 6300, 6302, 6306, 6309, 6310, 6311, 6312, 6315, 6317, 6319, 6321, 6322, 6326, 6328, 6333, 6338, 6339, 6345, 6346, 6351, 6352, 6353, 6354, 6356, 6358, 6359, 6360, 6362, 6363, 6364, 6365, 6370, 6373, 6375, 6378, 6381, 6383, 6386, 6387, 6396, 6397, 6398, 6399, 6403, 6405, 6407, 6414, 6415, 6419, 6420, 6422, 6425, 6426, 6429, 6430, 6431, 6434, 6436, 6437, 6440, 6442, 6448, 6452, 6454, 6458, 6459, 6463, 6464, 6466, 6467, 6468, 6469, 6470, 6471, 6474, 6477, 6478, 6480, 6484, 6486, 6488, 6495, 6497, 6499, 6500, 6501, 6502, 6504, 6505, 6513, 6514, 6515, 6517, 6519, 6523, 6524, 6525, 6530, 6534, 6537, 6543, 6544, 6547, 6548, 6549, 6554, 6558, 6560, 6561, 6563, 6564, 6570, 6572, 6574, 6576, 6577, 6579, 6581, 6582, 6584, 6587, 6589, 6595, 6596, 6597, 6598, 6599, 6605, 6607, 6609, 6610, 6611, 6614, 6620, 6621, 6624, 6626, 6627, 6629, 6634, 6635, 6637, 6638, 6639, 6643, 6644, 6646, 6647, 6648, 6649, 6650, 6652, 6654, 6655, 6656, 6662, 6666, 6667, 6671, 6672, 6673, 6676, 6691, 6692, 6695, 6696, 6699, 6703, 6705, 6706, 6711, 6714, 6716, 6718, 6720, 6724, 6725, 6729, 6730, 6731, 6734, 6736, 6739, 6740, 6741, 6742, 6746, 6747, 6753, 6756, 6757, 6759, 6761, 6766, 6776, 6778, 6779, 6780, 6782, 6786, 6787, 6788, 6791, 6792, 6793, 6794, 6797, 6799, 6803, 6804, 6805, 6807, 6810, 6811, 6812, 6813, 6816, 6817, 6819, 6820, 6821, 6824, 6827, 6828, 6830, 6831, 6834, 6836, 6840, 6841, 6842, 6843, 6845, 6847, 6850, 6851, 6852, 6859, 6863, 6867, 6869, 6872, 6874, 6875, 6876, 6877, 6878, 6879, 6880, 6886, 6887, 6888, 6897, 6903, 6906, 6907, 6909, 6914, 6915, 6917, 6919, 6921, 6922, 6923, 6924, 6930, 6933, 6935, 6936, 6941, 6944, 6946, 6948, 6950, 6951, 6952, 6954, 6959, 6960, 6961, 6967, 6969, 6971, 6979, 6980, 6984, 6985, 6987, 6990, 6991, 6993, 6994, 6999, 7002, 7003, 7005, 7006, 7009, 7012, 7013, 7015, 7016, 7019, 7020, 7022, 7025, 7033, 7038, 7039, 7040, 7042, 7043, 7050, 7052, 7053, 7056, 7057, 7064, 7067, 7077, 7079, 7083, 7085, 7086, 7094, 7097, 7105, 7106, 7107, 7108, 7112, 7113, 7116, 7117, 7118, 7124, 7126, 7129, 7130, 7132, 7135, 7138, 7139, 7140, 7142, 7144, 7149, 7151, 7155, 7164, 7165, 7166, 7169, 7171, 7176, 7177, 7182, 7184, 7187, 7188, 7194, 7196, 7197, 7201, 7202, 7203, 7206, 7207, 7209, 7211, 7213, 7215, 7216, 7217, 7218, 7219, 7220, 7227, 7228, 7231, 7232, 7233, 7234, 7236, 7239, 7243, 7244, 7245, 7248, 7255, 7257, 7258, 7259, 7262, 7264, 7267, 7268, 7269, 7270, 7274, 7275, 7276, 7277, 7281, 7282, 7284, 7288, 7290, 7291, 7292, 7293, 7298, 7300, 7301, 7303, 7305, 7307, 7308, 7310, 7313, 7315, 7317, 7318, 7321, 7328, 7330, 7331, 7334, 7336, 7338, 7340, 7344, 7348, 7350, 7351, 7354, 7355, 7356, 7357, 7358, 7361, 7363, 7365, 7371, 7373, 7377, 7378, 7379, 7380, 7383, 7386, 7389, 7392, 7395, 7396, 7398, 7400, 7401, 7409, 7411, 7415, 7417, 7418, 7425, 7428, 7430, 7433, 7434, 7435, 7436, 7438, 7443, 7444, 7446, 7447, 7448, 7452, 7453, 7454, 7458, 7459, 7465, 7466, 7470, 7479, 7486, 7490, 7492, 7493, 7502, 7504, 7505, 7506, 7512, 7515, 7517, 7523, 7525, 7528, 7533, 7537, 7538, 7542, 7545, 7546, 7547, 7549, 7554, 7556, 7557, 7561, 7570, 7574, 7578, 7580, 7585, 7586, 7589, 7594, 7595, 7596, 7605, 7611, 7613, 7619, 7620, 7621, 7623, 7624, 7632, 7633, 7634, 7638, 7639, 7642, 7652, 7655, 7661, 7663, 7665, 7666, 7667, 7672, 7674, 7677, 7678, 7679, 7680, 7682, 7684, 7685, 7689, 7692, 7695, 7699, 7700, 7703, 7704, 7708, 7712, 7713, 7716, 7719, 7724, 7725, 7729, 7730, 7733, 7736, 7737, 7738, 7740, 7744, 7745, 7750, 7751, 7753, 7754, 7761, 7762, 7763, 7764, 7768, 7769, 7774, 7775, 7779, 7780, 7781, 7782, 7785, 7786, 7788, 7791, 7793, 7794, 7796, 7798, 7803, 7804, 7807, 7812, 7815, 7820, 7823, 7824, 7825, 7832, 7833, 7834, 7838, 7840, 7841, 7844, 7847, 7854, 7856, 7859, 7860, 7862, 7863, 7865, 7873, 7875, 7876, 7878, 7881, 7888, 7890, 7896, 7901, 7907, 7908, 7910, 7911, 7918, 7923, 7925, 7927, 7929, 7933, 7934, 7935, 7936, 7938, 7942, 7944, 7945, 7946, 7947, 7948, 7950, 7955, 7956, 7962, 7964, 7965, 7966, 7967, 7971, 7972, 7974, 7976, 7977, 7978, 7979, 7980, 7982, 7984, 7986, 7988, 7989, 7990, 7991, 7993, 7994, 8000, 8002, 8004, 8005, 8006, 8007, 8012, 8021, 8026, 8041, 8042, 8043, 8044, 8045, 8047, 8048, 8049, 8052, 8053, 8056, 8058, 8059, 8062, 8063, 8065, 8066, 8067, 8068, 8071, 8072, 8073, 8075, 8076, 8077, 8078, 8080, 8082, 8083, 8084, 8087, 8088, 8091, 8093, 8095, 8099, 8100, 8103, 8105, 8106, 8109, 8112, 8116, 8118, 8121, 8124, 8126, 8130, 8136, 8137, 8145, 8146, 8147, 8151, 8159, 8163, 8164, 8165, 8169, 8170, 8176, 8178, 8179, 8182, 8185, 8189, 8192, 8193, 8196, 8199, 8202, 8204, 8207, 8208, 8211, 8213, 8216, 8219, 8220, 8222, 8225, 8227, 8237, 8239, 8241, 8244, 8245, 8250, 8252, 8253, 8265, 8266, 8269, 8270, 8272, 8275, 8282, 8288, 8289, 8291, 8293, 8294, 8297, 8300, 8301, 8304, 8305, 8306, 8310, 8311, 8312, 8318, 8319, 8320, 8321, 8322, 8329, 8334, 8335, 8336, 8339, 8340, 8343, 8349, 8350, 8351, 8352, 8353, 8354, 8355, 8361, 8363, 8367, 8368, 8373, 8378, 8379, 8385, 8387, 8389, 8392, 8393, 8395, 8398, 8401, 8402, 8403, 8404, 8410, 8412, 8413, 8414, 8416, 8417, 8418, 8428, 8429, 8433, 8435, 8436, 8438, 8439, 8441, 8442, 8444, 8446, 8447, 8448, 8449, 8450, 8451, 8452, 8457, 8458, 8459, 8466, 8471, 8472, 8473, 8474, 8476, 8477, 8478, 8480, 8481;,8482, 8485, 8486, 8490, 8493, 8498, 8501, 8502, 8505, 8507, 8511, 8513, 8515, 8517, 8521, 8523, 8524, 8525, 8528, 8531, 8532, 8533, 8537, 8538, 8539, 8541, 8542, 8544, 8549, 8550, 8553, 8554, 8557, 8558, 8561, 8562, 8563, 8565, 8566, 8568, 8576, 8581, 8582, 8583, 8588, 8589, 8590, 8593, 8594, 8596, 8597, 8599, 8600, 8601, 8602, 8603, 8605, 8611, 8612, 8614, 8617, 8618, 8624, 8630, 8631, 8634, 8638, 8639, 8640, 8642, 8644, 8648, 8654, 8657, 8658, 8659, 8663, 8665, 8669, 8672, 8681, 8685, 8693, 8699, 8700, 8703, 8706, 8708, 8709, 8713, 8714, 8715, 8716, 8717, 8719, 8720, 8721, 8722, 8729, 8731, 8732, 8734, 8735, 8736, 8740, 8741, 8742, 8744, 8746, 8748, 8752, 8757, 8764, 8767, 8769, 8770, 8772, 8773, 8775, 8776, 8777, 8779, 8782, 8783, 8784, 8785, 8789, 8792, 8797, 8804, 8805, 8808, 8810, 8818, 8822, 8824, 8831, 8832, 8833, 8834, 8835, 8838, 8841, 8842, 8843, 8846, 8853, 8861, 8862, 8867, 8876, 8878, 8881, 8883, 8886, 8888, 8889, 8892, 8897, 8899, 8901, 8905, 8907, 8908, 8909, 8910, 8911, 8914, 8916, 8917, 8926, 8928, 8929, 8935, 8938, 8940, 8941, 8942, 8945, 8946, 8949, 8951, 8954, 8957, 8960, 8961, 8962, 8967, 8968, 8969, 8972, 8974, 8976, 8977, 8979, 8980, 8981, 8984, 8985, 8986, 8992, 8996, 8998, 8999, 9002, 9003, 9006, 9009, 9012, 9016, 9018, 9020, 9022, 9025, 9029, 9030, 9033, 9037, 9044, 9052, 9057, 9058, 9059, 9060, 9061, 9062, 9066, 9069, 9071, 9073, 9074, 9076, 9084, 9086, 9088, 9091, 9092, 9095, 9096, 9097, 9105, 9108, 9110, 9111, 9112, 9114, 9115, 9116, 9118, 9119, 9123, 9125, 9129, 9131, 9133, 9134, 9136, 9138, 9139, 9140, 9141, 9142, 9146, 9149, 9151, 9152, 9159, 9172, 9173, 9174, 9175, 9177, 9183, 9185, 9187, 9188, 9190, 9191, 9195, 9196, 9200, 9206, 9207, 9210, 9211, 9213, 9215, 9216, 9217, 9218, 9221, 9223, 9226, 9229, 9233, 9234, 9237, 9241, 9243, 9247, 9248, 9249, 9252, 9253, 9257, 9263, 9265, 9267, 9269, 9270, 9273, 9276, 9278, 9282, 9283, 9284, 9285, 9288, 9289, 9290, 9291, 9292, 9298, 9299, 9302, 9304, 9308, 9310, 9311, 9313, 9320, 9323, 9325, 9326, 9327, 9328, 9329, 9330, 9336, 9337, 9338, 9339, 9340, 9341, 9345, 9346, 9347, 9348, 9349, 9353, 9354, 9355, 9359, 9361, 9366, 9367, 9373, 9375, 9376, 9378, 9382, 9383, 9388, 9389, 9391, 9392, 9393, 9394, 9396, 9398, 9400, 9402, 9403, 9404, 9406, 9407, 9413, 9414, 9415, 9419, 9422, 9423, 9432, 9433, 9439, 9442, 9444, 9451, 9452, 9453, 9456, 9460, 9468, 9471, 9472, 9473, 9478, 9483, 9487, 9488, 9490, 9494, 9495, 9497, 9501, 9502, 9503, 9504, 9505, 9509, 9513, 9514, 9515, 9517, 9518, 9519, 9520, 9521, 9525, 9531, 9533, 9534, 9536, 9540, 9543, 9546, 9548, 9549, 9553, 9555, 9556, 9557, 9560, 9563, 9564, 9565, 9567, 9568, 9571, 9575, 9577, 9582, 9587, 9589, 9590, 9591, 9592, 9602, 9606, 9608, 9609, 9610, 9613, 9615, 9617, 9620, 9623, 9626, 9627, 9628, 9629, 9630, 9635, 9637, 9640, 9641, 9642, 9644, 9645, 9646, 9648, 9650, 9651, 9653, 9655, 9656, 9657, 9658, 9659, 9660, 9663, 9668, 9670, 9679, 9681, 9682, 9686, 9692, 9695, 9696, 9698, 9699, 9706, 9708, 9717, 9718, 9722, 9723, 9726, 9727, 9730, 9731, 9732, 9733, 9734, 9737, 9738, 9746, 9750, 9751, 9753, 9754, 9756, 9762, 9763, 9764, 9767, 9768, 9770, 9772, 9776, 9777, 9780, 9781, 9782, 9784, 9786, 9792, 9794, 9798, 9799, 9801, 9806, 9808, 9809, 9813, 9816, 9819, 9820, 9824, 9825, 9827, 9833, 9835, 9836, 9838, 9845, 9846, 9847, 9849, 9851, 9854, 9861, 9864, 9866, 9869, 9873, 9875, 9882, 9886, 9887, 9888, 9892, 9893, 9894, 9897, 9898, 9900, 9901, 9906, 9907, 9908, 9909, 9910, 9911, 9912, 9918, 9921, 9923, 9928, 9930, 9938, 9940, 9944, 9946, 9949, 9950, 9953, 9955, 9957, 9960, 9962, 9966, 9967, 9971, 9972, 9974, 9976, 9980, 9982, 9984, 9985, 9988, 9990, 9997, 9998, 10000, 10007, 10008, 10009, 10010, 10012, 10017, 10018, 10019, 10021, 10022, 10026, 10031, 10033, 10037, 10038, 10045, 10048, 10049, 10050, 10051, 10052, 10054, 10056, 10058, 10059, 10060, 10062, 10063, 10064, 10066, 10068, 10076, 10078, 10080, 10081, 10082, 10086, 10087, 10089, 10090, 10091, 10092, 10095, 10097, 10098, 10101, 10102, 10103, 10105, 10106, 10107, 10108, 10109, 10110, 10112, 10114, 10115, 10118, 10122, 10127, 10128, 10131, 10132, 10134, 10135, 10136, 10138, 10143, 10146, 10149, 10151, 10152, 10158, 10163, 10165, 10166, 10168, 10169, 10170, 10174, 10176, 10178, 10179, 10181, 10182, 10192, 10193, 10194, 10195, 10197, 10199, 10203, 10206, 10207, 10209, 10210, 10214, 10218, 10219, 10220, 10222, 10223, 10224, 10225, 10228, 10230, 10233, 10236, 10237, 10246, 10247, 10252, 10253, 10255, 10259, 10260, 10262, 10273, 10275, 10284, 10286, 10291, 10292, 10293, 10295, 10296, 10297, 10300, 10302, 10306, 10307, 10311, 10318, 10321, 10322, 10323, 10325, 10326, 10328, 10329, 10331, 10334, 10335, 10336, 10338, 10342, 10343, 10344, 10345, 10346, 10353, 10356, 10357, 10359, 10360, 10362, 10364, 10365, 10368, 10373, 10375, 10380, 10381, 10382, 10384, 10385, 10389, 10392, 10397, 10398, 10399, 10401, 10405, 10410, 10411, 10413, 10414, 10416, 10421, 10422, 10425, 10428, 10429, 10430, 10435, 10437, 10438, 10446, 10447, 10448, 10449, 10450, 10451, 10453, 10455, 10456, 10463, 10464, 10465, 10468, 10469, 10470, 10472, 10473, 10474, 10478, 10480, 10488, 10490, 10492, 10494, 10496, 10498, 10501, 10504, 10508, 10513, 10514, 10518, 10521, 10525, 10527, 10528, 10531, 10533, 10535, 10536, 10537, 10541, 10542, 10543, 10544, 10547, 10548, 10549, 10550, 10551, 10555, 10556, 10558, 10561, 10562, 10563, 10565, 10567, 10569, 10571, 10573, 10577, 10580, 10581, 10582, 10583, 10584, 10585, 10590, 10593, 10595, 10596, 10597, 10599, 10601, 10602, 10605, 10610, 10611, 10612, 10615, 10616, 10617, 10618, 10621, 10622, 10623, 10626, 10628, 10629, 10630, 10631, 10632, 10633, 10637, 10638, 10639, 10641, 10643, 10645, 10646, 10648, 10649, 10650, 10655, 10657, 10663, 10664, 10665, 10668, 10669, 10670, 10671, 10673, 10674, 10677, 10678, 10681, 10682, 10683, 10684, 10685, 10686, 10689, 10693, 10697, 10699, 10700, 10702, 10703, 10705, 10707, 10708, 10711, 10712, 10715, 10716, 10718, 10721, 10722, 10725, 10726, 10732, 10734, 10735, 10736, 10738, 10740, 10744, 10747, 10748, 10749, 10752, 10753, 10754, 10756, 10762, 10763, 10766, 10768, 10774, 10775, 10777, 10778, 10779, 10780, 10782, 10784, 10785, 10787, 10788, 10790, 10791, 10792, 10795, 10796, 10798, 10801, 10802, 10803, 10804, 10805, 10809, 10810, 10811, 10813, 10815, 10818, 10819, 10820, 10821, 10824, 10825, 10826, 10830, 10833, 10836, 10838, 10839, 10840, 10841, 10843, 10846, 10850, 10851, 10853, 10854, 10857, 10858, 10860, 10862, 10863, 10867, 10869, 10871, 10874, 10877, 10878, 10880, 10881, 10887, 10892, 10896, 10897, 10898, 10899, 10902, 10903, 10912, 10917, 10920, 10926, 10927, 10930, 10933, 10934, 10935, 10936, 10937, 10938, 10940, 10941, 10947, 10948, 10954, 10956, 10957, 10960, 10961, 10962, 10965, 10967, 10972, 10975, 10976, 10977, 10980, 10988, 10993, 10995, 10996, 10997, 10999, 11002, 11004, 11005, 11006, 11008, 11015, 11018, 11023, 11025, 11027, 11032, 11039, 11046, 11047, 11053, 11056, 11058, 11060, 11066, 11070, 11072, 11078, 11079, 11080, 11082, 11083, 11086, 11090, 11092, 11095, 11098, 11101, 11102, 11107, 11108, 11109, 11110, 11114, 11116, 11117, 11118, 11119, 11123, 11124, 11125, 11127, 11128, 11129, 11132, 11133, 11135, 11137, 11138, 11145, 11146, 11150, 11151, 11152, 11153, 11154, 11158, 11160, 11161, 11162, 11163, 11165, 11166, 11169, 11172, 11173, 11175, 11177, 11179, 11180, 11181, 11184, 11185, 11187, 11188, 11190, 11191, 11192, 11194, 11198, 11199, 11201, 11202, 11207, 11210, 11214, 11217, 11218, 11222, 11226, 11227, 11229, 11230, 11232, 11233, 11234, 11235, 11236, 11237, 11239, 11244, 11246, 11247, 11248, 11251, 11254, 11255, 11256, 11257, 11258, 11259, 11260, 11261, 11262, 11263, 11264, 11266, 11274, 11275, 11278, 11282, 11288, 11289, 11290, 11291, 11292, 11293, 11294, 11295, 11298, 11306, 11307, 11313, 11315, 11316, 11318, 11319, 11320, 11322, 11324, 11328, 11329, 11330, 11331, 11332, 11333, 11337, 11338, 11339, 11340, 11345, 11346, 11348, 11349, 11352, 11356, 11358, 11363, 11365, 11366, 11369, 11370, 11371, 11373, 11374, 11377, 11380, 11381, 11382, 11385, 11387, 11388, 11389, 11391, 11394, 11395, 11397, 11398, 11401, 11403, 11404, 11405, 11406, 11408, 11409, 11411, 11412, 11413, 11414, 11416, 11423, 11428, 11430, 11433, 11437, 11438, 11443, 11446, 11447, 11448, 11449, 11451, 11458, 11459, 11463, 11465, 11467, 11471, 11472, 11473, 11476, 11478, 11481, 11482, 11487, 11490, 11492, 11494, 11496, 11497, 11498, 11499, 11500, 11503, 11506, 11507, 11508, 11509, 11512, 11516, 11518, 11520, 11521, 11522, 11523, 11524, 11526, 11528, 11530, 11533, 11534, 11538, 11541, 11544, 11546, 11547, 11548, 11550, 11551, 11553, 11558, 11560, 11561, 11567, 11568, 11570, 11571, 11576, 11577, 11578, 11579, 11580, 11585, 11588, 11589, 11593, 11594, 11595, 11597, 11599, 11604, 11607, 11608, 11612, 11615, 11618, 11621, 11623, 11624, 11625, 11627, 11629, 11632, 11633, 11636, 11639, 11642, 11644, 11647, 11649, 11650, 11652, 11654, 11655, 11656, 11657, 11658, 11663, 11664, 11667, 11668, 11669, 11678, 11681, 11682, 11683, 11685, 11688, 11691, 11692, 11693, 11695, 11698, 11699, 11701, 11703, 11705, 11707, 11710, 11711, 11712, 11717, 11718, 11720, 11721, 11725, 11726, 11730, 11731, 11733, 11736, 11738, 11740, 11743, 11744, 11753, 11755, 11759, 11760, 11761, 11762, 11763, 11764, 11765, 11766, 11767, 11770, 11771, 11774, 11776, 11781, 11782, 11783, 11784, 11785, 11786, 11790, 11792, 11795, 11799, 11800, 11802, 11804, 11809, 11811, 11812, 11813, 11816, 11818, 11819, 11821, 11822, 11826, 11828, 11830, 11831, 11832, 11836, 11837, 11839, 11841, 11846, 11847, 11849, 11850, 11851, 11853, 11856, 11858, 11860, 11861, 11863, 11868, 11870, 11872, 11876, 11877, 11878, 11881, 11886, 11890, 11891, 11894, 11895, 11898, 11899, 11903, 11904, 11909, 11911, 11913, 11916, 11917, 11918, 11919, 11920, 11921, 11922, 11923, 11926, 11927, 11928, 11929, 11930, 11934, 11935, 11940, 11941, 11943, 11944, 11945, 11946, 11947, 11948, 11949, 11950, 11953, 11957, 11958, 11959, 11960, 11961, 11962, 11963, 11965, 11968, 11977, 11978, 11980, 11983, 11988, 11993, 11994, 11995, 11996, 11997, 11998, 11999, 12002, 12004, 12005, 12006, 12008, 12014, 12017, 12018, 12019, 12020, 12021, 12023, 12024, 12025, 12032, 12039, 12042, 12043, 12044, 12050, 12054, 12059, 12061, 12063, 12068, 12073, 12078, 12079, 12080, 12081, 12083, 12085, 12091, 12093, 12097, 12098, 12102, 12104, 12106, 12109, 12112, 12114, 12115, 12118, 12120, 12122, 12127, 12128, 12129, 12131, 12134, 12135, 12137, 12138, 12144, 12145, 12146, 12147, 12148, 12150, 12151, 12155, 12162, 12165, 12166, 12167, 12170, 12171, 12174, 12175, 12179, 12181, 12192, 12197, 12198, 12202, 12204, 12208, 12212, 12214, 12215, 12217, 12218, 12223, 12228, 12229, 12234, 12236, 12240, 12241, 12243, 12245, 12249, 12250, 12252, 12254, 12255, 12256, 12259, 12263, 12268, 12269, 12271, 12274, 12278, 12280, 12283, 12285, 12286, 12287, 12295, 12304, 12305, 12306, 12310, 12311, 12312, 12313, 12314, 12315, 12317, 12319, 12321, 12323, 12324, 12325, 12328, 12331, 12333, 12334, 12337, 12339, 12340, 12343, 12344, 12345, 12347, 12350, 12354, 12356, 12359, 12364, 12366, 12368, 12370, 12373, 12374, 12375, 12376, 12379, 12380, 12381, 12383, 12390, 12393, 12394, 12397, 12399, 12400, 12401, 12402, 12403, 12406, 12410, 12411, 12414, 12415, 12416, 12418, 12419, 12420, 12423, 12424, 12426, 12427, 12428, 12429, 12437, 12440, 12444, 12445, 12447, 12450, 12451, 12454, 12455, 12456, 12457, 12459, 12462, 12465, 12467, 12468, 12470, 12472, 12473, 12475, 12476, 12478, 12481, 12482, 12483, 12486, 12487, 12488, 12491, 12492, 12497, 12499, 12501, 12502, 12503, 12508, 12512, 12513, 12514, 12515, 12518, 12519, 12525, 12527, 12530, 12531, 12535, 12536, 12537, 12538, 12539, 12546, 12547, 12551, 12552, 12554, 12555, 12556, 12562, 12563, 12565, 12568, 12572, 12577, 12580, 12583, 12584, 12585, 12586, 12588, 12589, 12591, 12594, 12600, 12603, 12605, 12608, 12609, 12610, 12611, 12620, 12622, 12623, 12626, 12628, 12629, 12633, 12634, 12638, 12639, 12640, 12641, 12644, 12645, 12648, 12649, 12651, 12663, 12664, 12668, 12670, 12671, 12677, 12679, 12682, 12683, 12684, 12688, 12689, 12691, 12692, 12693, 12695, 12696, 12699, 12701, 12702, 12705, 12706, 12707, 12713, 12714, 12715, 12721, 12723, 12728, 12729, 12731, 12732, 12733, 12735, 12738, 12739, 12740, 12741, 12742, 12743, 12744, 12752, 12753, 12754, 12755, 12758, 12761, 12763, 12764, 12765, 12766, 12771, 12775, 12777, 12783, 12785, 12790, 12797, 12800, 12801, 12802, 12807, 12808, 12810, 12812, 12813, 12817, 12820, 12822, 12823, 12824, 12826, 12827, 12828, 12834, 12835, 12836, 12837, 12838, 12839, 12844, 12848, 12849, 12850, 12852, 12853, 12861, 12866, 12870, 12873, 12875, 12878, 12884, 12887, 12891, 12898, 12899, 12900, 12901, 12903, 12904, 12905, 12908, 12910, 12912, 12913, 12914, 12916, 12920, 12921, 12923, 12928, 12929, 12931, 12932, 12933, 12934, 12935, 12939, 12942, 12946, 12947, 12950, 12952, 12953, 12956, 12958, 12960, 12961, 12963, 12967, 12968, 12969, 12972, 12978, 12983, 12984, 12986, 12987, 12988, 12990, 12991, 12999, 13001, 13003, 13004, 13007, 13010, 13014, 13015, 13017, 13022, 13023, 13024, 13027, 13030, 13032, 13034, 13035, 13036, 13037, 13040, 13041, 13044, 13047, 13049, 13050, 13053, 13054, 13055, 13056, 13061, 13063, 13064, 13066, 13067, 13069, 13070, 13071, 13075, 13077, 13079, 13083, 13085, 13086, 13087, 13097, 13099, 13101, 13102, 13104, 13105, 13106, 13109, 13110, 13111, 13112, 13114, 13115, 13116, 13117, 13118, 13120, 13121, 13122, 13123, 13124, 13125, 13127, 13128, 13130, 13131, 13134, 13136, 13144, 13147, 13148, 13149, 13151, 13154, 13155, 13156, 13159, 13167, 13169, 13175, 13181, 13182, 13186, 13187, 13197, 13198, 13199, 13206, 13209, 13210, 13212, 13213, 13217, 13221, 13224, 13226, 13228, 13229, 13231, 13232, 13234, 13235, 13236, 13237, 13239, 13241, 13243, 13248, 13255, 13259, 13260, 13261, 13262, 13263, 13264, 13267, 13268, 13269, 13271, 13273, 13274, 13281, 13285, 13293, 13295, 13296, 13297, 13298, 13300, 13301, 13303, 13304, 13315, 13316, 13317, 13328, 13329, 13330, 13332, 13335, 13338, 13340, 13343, 13345, 13346, 13347, 13348, 13349, 13351, 13352, 13353, 13358, 13361, 13363, 13365, 13367, 13368, 13369, 13370, 13377, 13381, 13385, 13386, 13387, 13388, 13391, 13393, 13394, 13395, 13396, 13397, 13398, 13401, 13403, 13408, 13410, 13414, 13416, 13417, 13419, 13423, 13424, 13429, 13430, 13431, 13433, 13434, 13439, 13441, 13446, 13448, 13450, 13451, 13456, 13460, 13461, 13467, 13469, 13470, 13473, 13475, 13477, 13478, 13480, 13489, 13492, 13494, 13499, 13501, 13503, 13507, 13515, 13519, 13521, 13522, 13526, 13532, 13533, 13535, 13536, 13539, 13540, 13543, 13544, 13546, 13547, 13549, 13552, 13553, 13555, 13556, 13558, 13559, 13560, 13561, 13562, 13565, 13566, 13568, 13569, 13572, 13574, 13575, 13577, 13578, 13579, 13580, 13582, 13584, 13587, 13596, 13597, 13599, 13600, 13601, 13602, 13604, 13605, 13606, 13607, 13612, 13613, 13621, 13622, 13623, 13627, 13628, 13629, 13630, 13631, 13632, 13634, 13636, 13637, 13641, 13643, 13647, 13650, 13653, 13660, 13662, 13663, 13665, 13669, 13675, 13677, 13678, 13679, 13683, 13687, 13688, 13689, 13693, 13697, 13698, 13699, 13700, 13702, 13706, 13710, 13712, 13713, 13714, 13715, 13716, 13719, 13720, 13721, 13729, 13730, 13734, 13736, 13737, 13738, 13739, 13742, 13745, 13747, 13749, 13750, 13756, 13764, 13767, 13769, 13772, 13773, 13775, 13777, 13779, 13782, 13783, 13785, 13786, 13787, 13791, 13793, 13795, 13796, 13798, 13799, 13802, 13809, 13816, 13817, 13818, 13819, 13820, 13822, 13823, 13828, 13830, 13834, 13835, 13843, 13849, 13852, 13856, 13858, 13860, 13862, 13866, 13869, 13870, 13872, 13873, 13874, 13877, 13887, 13891, 13892, 13895, 13897, 13898, 13901, 13906, 13907, 13908, 13909, 13910, 13911, 13914, 13917, 13918, 13919, 13921, 13923, 13924, 13925, 13929, 13934, 13942, 13943, 13944, 13947, 13948, 13949, 13950, 13953, 13954, 13957, 13958, 13960, 13962, 13963, 13969, 13970, 13975, 13984, 13986, 13987, 13988, 13990, 13994, 13999, 14000, 14001, 14002, 14003, 14005, 14006, 14010, 14013, 14014, 14016, 14017, 14018, 14022, 14027, 14030, 14031, 14038, 14040, 14043, 14052, 14059, 14062, 14063, 14066, 14067, 14069, 14070, 14071, 14073, 14075, 14081, 14083, 14084, 14085, 14086, 14088, 14091, 14092, 14094, 14095, 14096, 14097, 14102, 14106, 14110, 14111, 14112, 14115, 14116, 14118, 14122, 14124, 14129, 14130, 14132, 14133, 14138, 14139, 14142, 14143, 14145, 14146, 14147.

Promoters expressing in the second fully expanded leaf tissue at the V5 stage at 5 a.m. include SEQ IDs: 1, 7, 11, 12, 13, 14, 15, 16, 19, 20, 24, 27, 29, 31, 33, 34, 36, 37, 38, 48, 51, 53, 54, 57, 61, 64, 65, 76, 79, 80, 88, 93, 94, 95, 96, 98, 99, 103, 104, 108, 110, 111, 112, 115, 117, 123, 129, 131, 133, 137, 141, 144, 146, 152, 155, 156, 157, 159, 162, 165, 168, 172, 174, 175, 176, 179, 180, 181, 183, 187, 191, 193, 194, 196, 199, 202, 203, 205, 207, 211, 212, 214, 230, 232, 233, 235, 236, 237, 239, 240, 242, 244, 246, 249, 250, 251, 257, 259, 262, 267, 269, 270, 271, 273, 280, 281, 286, 288, 289, 293, 294, 299, 301, 302, 305, 306, 308, 309, 316, 319, 320, 322, 328, 329, 332, 334, 335, 338, 342, 346, 348, 349, 352, 354, 356, 358, 359, 364, 365, 371, 373, 376, 378, 379, 381, 382, 386, 388, 393, 396, 401, 411, 412, 414, 423, 428, 431, 433, 434, 436, 441, 448, 450, 452, 456, 459, 461, 462, 463, 466, 470, 471, 474, 478, 483, 484, 485, 488, 489, 492, 496, 507, 509, 510, 511, 514, 516, 517, 520, 523, 525, 534, 538, 541, 544, 546, 547, 548, 554, 560, 561, 563, 578, 580, 585, 591, 594, 595, 596, 599, 601, 602, 606, 609, 613, 619, 620, 633, 635, 636, 637, 638, 642, 643, 645, 647, 655, 656, 662, 667, 668, 669, 671, 681, 683, 692, 693, 694, 695, 701, 705, 706, 709, 716, 717, 718, 719, 721, 722, 723, 724, 727, 732, 734, 735, 736, 740, 741, 744, 749, 753, 757, 759, 764, 765, 770, 771, 779, 783, 784, 786, 792, 793, 794, 795, 798, 800, 804, 806, 807, 808, 809, 811, 816, 819, 820, 821, 824, 825, 826, 829, 830, 833, 840, 845, 846, 855, 856, 857, 858, 860, 862, 863, 865, 868, 869, 870, 871, 875, 876, 877, 878, 887, 889, 890, 892, 893, 895, 897, 898, 899, 900, 903, 907, 908, 910, 911, 912, 913, 916, 919, 920, 924, 925, 928, 929, 931, 932, 934, 936, 939, 943, 944, 951, 953, 955, 957, 958, 960, 964, 971, 974, 975, 976, 977, 978, 979, 980, 982, 984, 985, 987, 988, 989, 990, 991, 994, 995, 996, 997, 999, 1005, 1007, 1008, 1010, 1011, 1012, 1013, 1014, 1017, 1019, 1022, 1025, 1026, 1029, 1030, 1032, 1035, 1039, 1040, 1041, 1042, 1043, 1046, 1047, 1049, 1051, 1052, 1055, 1056, 1057, 1064, 1065, 1068, 1069, 1070, 1073, 1076, 1077, 1078, 1085, 1086, 1087, 1088, 1089, 1091, 1092, 1095, 1100, 1101, 1103, 1104, 1106, 1110, 1112, 1114, 1115, 1116, 1117, 1119, 1121, 1125, 1130, 1132, 1136, 1137, 1140, 1143, 1144, 1146, 1153, 1154, 1155, 1156, 1160, 1161, 1162, 1164, 1165, 1167, 1168, 1170, 1171, 1172, 1176, 1178, 1183, 1187, 1189, 1191, 1196, 1198, 1201, 1203, 1204, 1205, 1214, 1217, 1218, 1220, 1222, 1223, 1225, 1228, 1230, 1231, 1232, 1234, 1235, 1236, 1239, 1240, 1243, 1244, 1248, 1249, 1251, 1254, 1258, 1259, 1263, 1269, 1272, 1277, 1281, 1285, 1290, 1292, 1293, 1296, 1298, 1301, 1303, 1306, 1307, 1309, 1310, 1311, 1312, 1314, 1316, 1317, 1320, 1331, 1334, 1345, 1346, 1349, 1354, 1355, 1360, 1361, 1366, 1367, 1368, 1371, 1373, 1375, 1380, 1381, 1386, 1387, 1388, 1389, 1392, 1393, 1394, 1396, 1399, 1404, 1405, 1406, 1420, 1421, 1422, 1423, 1426, 1431, 1432, 1438, 1439, 1440, 1441, 1442, 1448, 1451, 1453, 1458, 1459, 1461, 1462, 1466, 1467, 1468, 1484, 1488, 1490, 1491, 1493, 1499, 1501, 1503, 1508, 1510, 1511, 1512, 1517, 1518, 1527, 1528, 1530, 1534, 1540, 1543, 1545, 1547, 1548, 1549, 1551, 1553, 1554, 1555, 1556, 1560, 1561, 1564, 1567, 1568, 1570, 1571, 1575, 1578, 1579, 1582, 1584, 1585, 1586, 1590, 1596, 1598, 1599, 1600, 1601, 1604, 1605, 1608, 1609, 1610, 1612, 1614, 1615, 1616, 1617, 1622, 1623, 1625, 1634, 1635, 1637, 1638, 1639, 1641, 1643, 1651, 1653, 1654, 1658, 1659, 1662, 1663, 1664, 1669, 1671, 1673, 1675, 1677, 1678, 1681, 1682, 1684, 1685, 1687, 1688, 1689, 1690, 1691, 1696, 1697, 1698, 1699, 1701, 1705, 1706, 1707, 1708, 1710, 1716, 1717, 1718, 1720, 1723, 1725, 1732, 1735, 1736, 1743, 1749, 1750, 1755, 1759, 1761, 1764, 1769, 1770, 1772, 1773, 1785, 1786, 1791, 1796, 1798, 1807, 1809, 1811, 1813, 1814, 1823, 1826, 1828, 1830, 1832, 1834, 1837, 1838, 1839, 1840, 1845, 1846, 1848, 1850, 1852, 1856, 1859, 1861, 1863, 1866, 1868, 1869, 1872, 1873, 1876, 1879, 1880, 1882, 1888, 1891, 1897, 1900, 1902, 1903, 1905, 1906, 1910, 1911, 1912, 1915, 1916, 1918, 1920, 1922, 1923, 1924, 1927, 1933, 1934, 1940, 1945, 1950, 1951, 1952, 1954, 1955, 1958, 1968, 1970, 1971, 1972, 1973, 1976, 1977, 1990, 1991, 1993, 1999, 2000, 2001, 2003, 2007, 2008, 2010, 2012, 2014, 2015, 2016, 2017, 2019, 2020, 2021, 2023, 2026, 2027, 2029, 2030, 2031, 2033, 2037, 2040, 2041, 2043, 2045, 2048, 2060, 2062, 2064, 2066, 2072, 2074, 2075, 2077, 2078, 2088, 2089, 2091, 2092, 2093, 2094, 2096, 2097, 2099, 2103, 2106, 2107, 2111, 2112, 2113, 2115, 2122, 2125, 2126, 2130, 2133, 2137, 2139, 2142, 2143, 2146, 2147, 2150, 2151, 2153, 2156, 2157, 2161, 2164, 2166, 2167, 2168, 2170, 2172, 2175, 2177, 2179, 2180, 2183, 2185, 2189, 2190, 2193, 2195, 2196, 2200, 2201, 2202, 2203, 2205, 2210, 2213, 2215, 2218, 2221, 2222, 2226, 2227, 2237, 2240, 2242, 2245, 2252, 2253, 2257, 2259, 2261, 2263, 2264, 2266, 2271, 2276, 2278, 2282, 2284, 2289, 2290, 2296, 2297, 2303, 2305, 2306, 2308, 2310, 2313, 2314, 2321, 2322, 2323, 2325, 2328, 2329, 2331, 2333, 2337, 2339, 2342, 2346, 2352, 2353, 2354, 2360, 2363, 2366, 2367, 2369, 2371, 2376, 2379, 2381, 2382, 2383, 2384, 2396, 2398, 2401, 2405, 2410, 2411, 2413, 2414, 2416, 2418, 2419, 2420, 2423, 2426, 2428, 2430, 2431, 2432, 2433, 2434, 2435, 2437, 2439, 2440, 2441, 2442, 2443, 2445, 2449, 2450, 2451, 2452, 2453, 2454, 2457, 2458, 2465, 2469, 2470, 2472, 2474, 2476, 2480, 2481, 2482, 2487, 2489, 2490, 2491, 2492, 2495, 2496, 2497, 2498, 2500, 2504, 2505, 2506, 2507, 2509, 2512, 2513, 2514, 2516, 2517, 2521, 2522, 2525, 2528, 2529, 2531, 2532, 2533, 2538, 2539, 2541, 2543, 2544, 2546, 2547, 2548, 2549, 2551, 2552, 2555, 2556, 2557, 2560, 2567, 2568, 2570, 2571, 2573, 2578, 2579, 2581, 2587, 2589, 2590, 2594, 2596, 2597, 2599, 2601, 2605, 2608, 2609, 2611, 2612, 2613, 2614, 2616, 2617, 2619, 2620, 2626, 2627, 2632, 2635, 2636, 2639, 2644, 2648, 2651, 2652, 2653, 2654, 2658, 2659, 2660, 2661, 2662, 2663, 2670, 2672, 2674, 2679, 2680, 2684, 2685, 2688, 2689, 2690, 2691, 2692, 2694, 2700, 2704, 2708, 2709, 2711, 2719, 2720, 2722, 2725, 2726, 2728, 2729, 2735, 2737, 2738, 2739, 2740, 2746, 2747, 2749, 2752, 2756, 2759, 2760, 2762, 2764, 2765, 2770, 2779, 2785, 2786, 2787, 2794, 2798, 2802, 2805, 2808, 2814, 2819, 2821, 2822, 2823, 2824, 2826, 2827, 2828, 2831, 2838, 2840, 2843, 2844, 2845, 2850, 2859, 2860, 2864, 2865, 2869, 2870, 2871, 2876, 2878, 2879, 2885, 2888, 2889, 2890, 2892, 2893, 2894, 2895, 2896, 2897, 2901, 2902, 2903, 2906, 2909, 2915, 2916, 2917, 2918, 2922, 2923, 2926, 2930, 2931, 2932, 2933, 2934, 2935, 2938, 2940, 2941, 2942, 2943, 2946, 2948, 2950, 2955, 2959, 2960, 2963, 2965, 2966, 2968, 2969, 2976, 2979, 2982, 2992, 2994, 3003, 3005, 3007, 3009, 3013, 3017, 3018, 3020, 3023, 3024, 3029, 3031, 3039, 3042, 3043, 3044, 3045, 3047, 3048, 3049, 3050, 3051, 3052, 3053, 3055, 3058, 3059, 3061, 3064, 3068, 3069, 3072, 3080, 3083, 3084, 3085, 3087, 3090, 3095, 3100, 3101, 3107, 3110, 3112, 3113, 3115, 3118, 3119, 3120, 3121, 3123, 3126, 3127, 3128, 3129, 3138, 3143, 3145, 3149, 3153, 3157, 3158, 3167, 3169, 3170, 3171, 3172, 3175, 3177, 3181, 3189, 3192, 3196, 3199, 3202, 3205, 3206, 3210, 3217, 3218, 3220, 3221, 3224, 3225, 3227, 3228, 3230, 3231, 3232, 3236, 3237, 3240, 3242, 3246, 3247, 3249, 3250, 3252, 3253, 3261, 3263, 3266, 3267, 3268, 3280, 3283, 3286, 3288, 3289, 3290, 3291, 3294, 3295, 3299, 3301, 3304, 3307, 3310, 3312, 3313, 3327, 3329, 3331, 3332, 3333, 3337, 3338, 3339, 3340, 3342, 3343, 3345, 3351, 3353, 3355, 3357, 3359, 3360, 3361, 3365, 3370, 3374, 3378, 3379, 3383, 3386, 3394, 3396, 3399, 3402, 3404, 3405, 3411, 3412, 3413, 3415, 3416, 3418, 3424, 3425, 3426, 3427, 3428, 3429, 3435, 3438, 3440, 3441, 3442, 3443, 3445, 3446, 3447, 3449, 3450, 3452, 3453, 3458, 3461, 3462, 3466, 3468, 3469, 3470, 3471, 3474, 3477, 3478, 3479, 3484, 3486, 3488, 3490, 3493, 3499, 3500, 3501, 3502, 3503, 3504, 3506, 3507, 3510, 3516, 3517, 3518, 3520, 3523, 3524, 3529, 3533, 3535, 3536, 3538, 3540, 3541, 3544, 3545, 3548, 3549, 3551, 3554, 3556, 3557, 3560, 3562, 3569, 3571, 3574, 3576, 3580, 3587, 3588, 3589, 3592, 3594, 3595, 3600, 3601, 3603, 3604, 3606, 3610, 3611, 3613, 3615, 3616, 3618, 3619, 3620, 3621, 3624, 3629, 3633, 3634, 3638, 3640, 3642, 3643, 3644, 3645, 3646, 3648, 3654, 3655, 3659, 3660, 3661, 3667, 3669, 3672, 3673, 3674, 3677, 3682, 3684, 3685, 3690, 3698, 3702, 3706, 3707, 3709, 3710, 3713, 3715, 3717, 3718, 3719, 3721, 3722, 3723, 3725, 3730, 3731, 3738, 3739, 3744, 3748, 3749, 3752, 3756, 3761, 3763, 3764, 3765, 3766, 3772, 3773, 3775, 3777, 3778, 3790, 3791, 3792, 3793, 3801, 3805, 3808, 3809, 3817, 3818, 3819, 3820, 3823, 3828, 3830, 3831, 3832, 3833, 3834, 3837, 3838, 3839, 3843, 3844, 3846, 3847, 3849, 3858, 3859, 3866, 3867, 3868, 3870, 3871, 3872, 3873, 3876, 3877, 3882, 3883, 3884, 3885, 3887, 3889, 3890, 3892, 3894, 3895, 3898, 3899, 3902, 3903, 3904, 3908, 3910, 3912, 3913, 3917, 3918, 3923, 3924, 3926, 3929, 3933, 3934, 3937, 3938, 3940, 3941, 3942, 3947, 3950, 3951, 3954, 3958, 3959, 3962, 3964, 3967, 3968, 3970, 3971, 3972, 3974, 3975, 3978, 3983, 3987, 3988, 3991, 3995, 3996, 3997, 4000, 4007, 4008, 4013, 4014, 4026, 4030, 4033, 4039, 4040, 4041, 4042, 4043, 4044, 4047, 4048, 4049, 4050, 4053, 4054, 4056, 4057, 4062, 4068, 4070, 4084, 4088, 4092, 4094, 4096, 4099, 4102, 4103, 4105, 4106, 4109, 4110, 4111, 4113, 4124, 4126, 4128, 4131, 4132, 4133, 4134, 4135, 4140, 4143, 4144, 4145, 4149, 4150, 4154, 4155, 4158, 4160, 4161, 4162, 4163, 4164, 4165, 4166, 4167, 4168, 4171, 4173, 4175, 4178, 4181, 4183, 4185, 4187, 4188, 4189, 4190, 4191, 4193, 4195, 4200, 4201, 4202, 4205, 4206, 4207, 4210, 4211, 4212, 4213, 4219, 4221, 4222, 4227, 4228, 4233, 4235, 4237, 4245, 4246, 4247, 4251, 4257, 4258, 4260, 4261, 4266, 4270, 4272, 4275, 4276, 4280, 4281, 4284, 4290, 4292, 4294, 4296, 4298, 4301, 4302, 4304, 4305, 4306, 4309, 4312, 4314, 4317, 4320, 4321, 4324, 4329, 4330, 4333, 4337, 4339, 4344, 4346, 4347, 4352, 4354, 4358, 4359, 4360, 4369, 4374, 4378, 4380, 4383, 4388, 4390, 4391, 4393, 4396, 4397, 4401, 4402, 4403, 4405, 4410, 4422, 4423, 4430, 4432, 4436, 4439, 4440, 4442, 4443, 4446, 4448, 4449, 4450, 4457, 4461, 4462, 4463, 4464, 4466, 4467, 4468, 4470, 4474, 4475, 4479, 4486, 4487, 4492, 4494, 4497, 4498, 4502, 4507, 4508, 4512, 4514, 4518, 4519, 4521, 4522, 4525, 4529, 4531, 4532, 4535, 4543, 4548, 4549, 4554, 4556, 4560, 4563, 4565, 4566, 4567, 4568, 4575, 4576, 4582, 4583, 4590, 4593, 4594, 4596, 4597, 4598, 4601, 4605, 4606, 4616, 4618, 4623, 4625, 4628, 4632, 4635, 4639, 4640, 4641, 4643, 4644, 4646, 4647, 4650, 4651, 4653, 4654, 4655, 4656, 4657, 4658, 4659, 4662, 4669, 4671, 4672, 4673, 4674, 4676, 4677, 4680, 4682, 4684, 4685, 4690, 4691, 4692, 4696, 4697, 4699, 4700, 4701, 4703, 4705, 4706, 4710, 4711, 4713, 4715, 4719, 4721, 4722, 4723, 4725, 4727, 4729, 4730, 4734, 4736, 4737, 4738, 4739, 4740, 4741, 4745, 4748, 4749, 4753, 4754, 4756, 4761, 4762, 4763, 4767, 4769, 4770, 4771, 4773, 4775, 4779, 4780, 4784, 4787, 4788, 4789, 4790, 4791, 4795, 4796, 4800, 4801, 4803, 4804, 4805, 4806, 4807, 4813, 4816, 4817, 4818, 4820, 4822, 4828, 4830, 4831, 4834, 4836, 4837, 4845, 4854, 4855, 4856, 4857, 4861, 4862, 4863, 4867, 4869, 4875, 4876, 4878, 4880, 4881, 4887, 4889, 4891, 4900, 4904, 4905, 4907, 4909, 4910, 4912, 4913, 4914, 4915, 4918, 4920, 4921, 4922, 4923, 4924, 4928, 4931, 4936, 4938, 4941, 4943, 4947, 4949, 4953, 4954, 4958, 4959, 4960, 4966, 4967, 4968, 4969, 4971, 4972, 4974, 4975, 4977, 4981, 4984, 4988, 4989, 4990, 4991, 4993, 4994, 4996, 5000, 5005, 5010, 5011, 5015, 5016, 5022, 5023, 5024, 5026, 5029, 5030, 5036, 5037, 5038, 5039, 5040, 5042, 5044, 5045, 5046, 5049, 5052, 5054, 5057, 5058, 5060, 5061, 5067, 5068, 5072, 5074, 5078, 5082, 5088, 5089, 5090, 5091, 5094, 5095, 5100, 5101, 5102, 5106, 5110, 5111, 5113, 5114, 5115, 5116, 5120, 5122, 5123, 5131, 5132, 5136, 5137, 5140, 5143, 5144, 5145, 5146, 5147, 5150, 5157, 5159, 5160, 5164, 5165, 5166, 5168, 5170, 5174, 5175, 5177, 5178, 5180, 5181, 5182, 5185, 5187, 5188, 5189, 5190, 5191, 5192, 5193, 5196, 5198, 5200, 5202, 5206, 5209, 5212, 5213, 5216, 5217, 5218, 5219, 5224, 5225, 5226, 5229, 5230, 5234, 5237, 5238, 5240, 5241, 5251, 5253, 5254, 5255, 5256, 5257, 5258, 5260, 5261, 5263, 5269, 5275, 5276, 5280, 5281, 5283, 5286, 5287, 5294, 5297, 5298, 5299, 5300, 5301, 5308, 5311, 5314, 5315, 5317, 5319, 5321, 5324, 5329, 5330, 5332, 5334, 5339, 5341, 5342, 5343, 5345, 5346, 5348, 5350, 5351, 5352, 5356, 5361, 5366, 5367, 5369, 5371, 5379, 5386, 5388, 5389, 5391, 5393, 5396, 5402, 5405, 5411, 5413, 5414, 5416, 5417, 5418, 5422, 5426, 5427, 5428, 5431, 5432, 5434, 5437, 5438, 5445, 5446, 5448, 5449, 5452, 5453, 5456, 5458, 5459, 5461, 5462, 5475, 5476, 5481, 5483, 5485, 5487, 5488, 5491, 5493, 5495, 5496, 5497, 5505, 5506, 5508, 5510, 5512, 5513, 5515, 5517, 5518, 5519, 5520, 5521, 5524, 5526, 5529, 5530, 5531, 5532, 5533, 5535, 5543, 5545, 5549, 5554, 5557, 5558, 5559, 5561, 5562, 5563, 5566, 5568, 5569, 5572, 5575, 5579, 5581, 5582, 5584, 5585, 5586, 5589, 5593, 5594, 5596, 5597, 5602, 5612, 5613, 5614, 5616, 5621, 5627, 5632, 5633, 5635, 5638, 5640, 5643, 5647, 5648, 5651, 5652, 5653, 5656, 5657, 5659, 5660, 5663, 5664, 5667, 5669, 5670, 5671, 5677, 5680, 5689, 5690, 5694, 5695, 5697, 5698, 5700, 5702, 5703, 5706, 5711, 5712, 5713, 5714, 5718, 5719, 5721, 5722, 5723, 5729, 5730, 5731, 5732, 5734, 5735, 5736, 5737, 5742, 5744, 5751, 5764, 5768, 5770, 5775, 5778, 5780, 5783, 5784, 5785, 5787, 5788, 5791, 5792, 5794, 5807, 5808, 5811, 5817, 5819, 5820, 5824, 5828, 5833, 5834, 5835, 5836, 5837, 5839, 5842, 5853, 5854, 5856, 5858, 5859, 5863, 5864, 5866, 5867, 5868, 5869, 5871, 5872, 5877, 5878, 5879, 5881, 5882, 5883, 5884, 5888, 5889, 5892, 5893, 5900, 5901, 5902, 5905, 5910, 5912, 5918, 5919, 5921, 5925, 5926, 5927, 5928, 5930, 5931, 5932, 5933, 5934, 5938, 5941, 5942, 5943, 5944, 5945, 5946, 5947, 5948, 5951, 5954, 5955, 5956, 5957, 5959, 5961, 5968, 5971, 5978, 5979, 5980, 5984, 5985, 5986, 5988, 5990, 5991, 5992, 5994, 5996, 5997, 6000, 6002, 6003, 6004, 6006, 6007, 6008, 6010, 6012, 6013, 6016, 6017, 6021, 6023, 6025, 6026, 6028, 6031, 6038, 6040, 6041, 6043, 6044, 6047, 6048, 6051, 6058, 6059, 6060, 6061, 6062, 6063, 6070, 6072, 6073, 6074, 6075, 6077, 6080, 6082, 6085, 6088, 6089, 6090, 6093, 6094, 6095, 6096, 6098, 6108, 6109, 6110, 6112, 6113, 6116, 6118, 6119, 6122, 6125, 6129, 6130, 6132, 6133, 6135, 6136, 6137, 6143, 6144, 6145, 6146, 6147, 6149, 6151, 6152, 6155, 6156, 6158, 6163, 6164, 6165, 6168, 6171, 6173, 6178, 6180, 6181, 6182, 6183, 6186, 6188, 6189, 6190, 6191, 6193, 6197, 6198, 6200, 6203, 6206, 6207, 6209, 6212, 6213, 6220, 6221, 6223, 6224, 6226, 6227, 6228, 6230, 6231, 6237, 6238, 6240, 6243, 6245, 6246, 6247, 6249, 6250, 6251, 6255, 6257, 6258, 6259, 6260, 6264, 6265, 6269, 6270, 6271, 6272, 6273, 6278, 6279, 6280, 6282, 6286, 6288, 6289, 6291, 6292, 6294, 6296, 6299, 6302, 6306, 6309, 6310, 6311, 6315, 6317, 6319, 6321, 6322, 6326, 6328, 6330, 6333, 6338, 6339, 6345, 6350, 6351, 6352, 6353, 6354, 6356, 6358, 6360, 6362, 6363, 6364, 6365, 6370, 6373, 6375, 6378, 6381, 6386, 6387, 6395, 6396, 6397, 6398, 6399, 6403, 6405, 6407, 6412, 6414, 6415, 6419, 6422, 6426, 6429, 6431, 6434, 6436, 6437, 6440, 6442, 6448, 6452, 6454, 6458, 6459, 6464, 6466, 6467, 6468, 6469, 6470, 6471, 6474, 6476, 6477, 6478, 6480, 6481, 6486, 6495, 6497, 6499, 6500, 6501, 6502, 6504, 6505, 6506, 6513, 6514, 6517, 6519, 6523, 6524, 6525, 6530, 6533, 6534, 6537, 6543, 6544, 6547, 6548, 6549, 6554, 6560, 6561, 6563, 6570, 6572, 6574, 6576, 6577, 6579, 6581, 6582, 6584, 6587, 6595, 6596, 6597, 6599, 6605, 6607, 6609, 6610, 6611, 6614, 6620, 6621, 6624, 6625, 6626, 6627, 6628, 6629, 6634, 6635, 6637, 6638, 6639, 6643, 6644, 6646, 6647, 6649, 6652, 6654, 6655, 6656, 6662, 6666, 6671, 6672, 6673, 6676, 6681, 6689, 6691, 6692, 6695, 6696, 6703, 6705, 6706, 6711, 6714, 6716, 6718, 6720, 6724, 6725, 6729, 6730, 6731, 6733, 6734, 6736, 6739, 6746, 6747, 6753, 6756, 6757, 6759, 6761, 6764, 6766, 6776, 6777, 6778, 6779, 6780, 6782, 6786, 6787, 6788, 6791, 6793, 6794, 6797, 6799, 6803, 6804, 6805, 6807, 6810, 6811, 6812, 6813, 6816, 6817, 6819, 6820, 6821, 6824, 6827, 6828, 6830, 6831, 6832, 6836, 6841, 6842, 6843, 6845, 6847, 6850, 6852, 6859, 6864, 6867, 6869, 6872, 6874, 6875, 6876, 6877, 6878, 6879, 6880, 6886, 6887, 6888, 6897, 6902, 6903, 6904, 6906, 6907, 6909, 6913, 6914, 6915, 6917, 6919, 6921, 6922, 6923, 6924, 6930, 6933, 6935, 6936, 6941, 6944, 6946, 6948, 6950, 6951, 6952, 6954, 6959, 6960, 6961, 6967, 6969, 6971, 6979, 6980, 6984, 6985, 6987, 6990, 6991, 6993, 6994, 6999, 7002, 7003, 7006, 7009, 7012, 7013, 7015, 7016, 7019, 7020, 7022, 7025, 7032, 7033, 7039, 7042, 7043, 7050, 7053, 7056, 7057, 7064, 7067, 7072, 7075, 7077, 7079, 7083, 7085, 7086, 7094, 7097, 7105, 7106, 7107, 7108, 7112, 7113, 7116, 7117, 7118, 7124, 7126, 7129, 7130, 7132, 7134, 7135, 7138, 7139, 7140, 7142, 7144, 7149, 7151, 7155, 7164, 7169, 7170, 7171, 7176, 7177, 7182, 7183, 7184, 7187, 7188, 7194, 7197, 7198, 7201, 7202, 7203, 7206, 7207, 7209, 7211, 7213, 7214, 7215, 7216, 7217, 7218, 7219, 7220, 7221, 7227, 7228, 7232, 7233, 7234, 7236, 7239, 7243, 7244, 7245, 7248, 7249, 7250, 7255, 7257, 7258, 7259, 7262, 7264, 7267, 7268, 7269, 7270, 7274, 7275, 7277, 7281, 7282, 7286, 7288, 7290, 7291, 7292, 7293, 7298, 7300, 7301, 7303, 7305, 7307, 7308, 7313, 7315, 7317, 7321, 7328, 7330, 7331, 7334, 7338, 7340, 7350, 7351, 7353, 7354, 7355, 7356, 7357, 7358, 7363, 7365, 7371, 7373, 7377, 7380, 7383, 7386, 7388, 7389, 7392, 7395, 7400, 7401, 7408, 7409, 7411, 7415, 7417, 7418, 7425, 7428, 7430, 7433, 7434, 7435, 7436, 7443, 7444, 7447, 7448, 7452, 7453, 7454, 7458, 7459, 7465, 7466, 7470, 7479, 7486, 7490, 7492, 7493, 7502, 7504, 7505, 7506, 7512, 7515, 7517, 7523, 7524, 7525, 7528, 7533, 7537, 7538, 7542, 7545, 7546, 7547, 7548, 7549, 7554, 7556, 7557, 7559, 7561, 7570, 7574, 7578, 7580, 7585, 7586, 7589, 7591, 7594, 7595, 7596, 7601, 7605, 7611, 7613, 7619, 7620, 7621, 7623, 7624, 7632, 7633, 7639, 7642, 7643, 7652, 7653, 7655, 7658, 7661, 7663, 7665, 7672, 7674, 7677, 7678, 7679, 7680, 7682, 7684, 7685, 7689, 7692, 7695, 7697, 7699, 7700, 7703, 7704, 7708, 7712, 7713, 7716, 7719, 7724, 7725, 7729, 7730, 7733, 7734, 7736, 7737, 7738, 7740, 7744, 7745, 7747, 7750, 7751, 7754, 7761, 7762, 7763, 7764, 7768, 7769, 7774, 7775, 7777, 7778, 7779, 7780, 7781, 7786, 7788, 7791, 7793, 7795, 7796, 7798, 7803, 7804, 7807, 7811, 7812, 7815, 7820, 7824, 7825, 7832, 7833, 7834, 7838, 7840, 7841, 7844, 7845, 7847, 7848, 7849, 7854, 7856, 7859, 7860, 7862, 7863, 7865, 7873, 7875, 7876, 7878, 7888, 7890, 7896, 7901, 7907, 7908, 7909, 7910, 7911, 7918, 7923, 7925, 7927, 7933, 7934, 7935, 7936, 7938, 7942, 7943, 7944, 7945, 7947, 7948, 7949, 7950, 7953, 7955, 7956, 7962, 7964, 7965, 7966, 7967, 7971, 7972, 7974, 7976, 7977, 7978, 7979, 7980, 7982, 7983, 7984, 7986, 7988, 7993, 7994, 8002, 8004, 8005, 8006, 8007, 8012, 8021, 8023, 8026, 8029, 8038, 8041, 8042, 8043, 8044, 8045, 8047, 8048, 8049, 8052, 8053, 8056, 8058, 8059, 8062, 8063, 8065, 8066, 8067, 8068, 8070, 8071, 8072, 8073, 8075, 8076, 8077, 8078, 8080, 8082, 8083, 8084, 8087, 8088, 8091, 8093, 8095, 8096, 8097, 8099, 8100, 8103, 8105, 8106, 8109, 8112, 8116, 8118, 8121, 8126, 8129, 8136, 8137, 8145, 8146, 8150, 8151, 8159, 8163, 8165, 8169, 8170, 8178, 8179, 8182, 8192, 8193, 8195, 8196, 8199, 8202, 8204, 8207, 8208, 8211, 8213, 8215, 8216, 8219, 8220, 8222, 8225, 8227, 8234, 8235, 8237, 8239, 8241, 8244, 8245, 8250, 8252, 8253, 8265, 8266, 8269, 8270, 8272, 8275, 8282, 8288, 8289, 8291, 8293, 8294, 8296, 8297, 8300, 8301, 8304, 8305, 8310, 8312, 8318, 8319, 8320, 8321, 8322, 8329, 8334, 8335, 8336, 8339, 8340, 8343, 8349, 8350, 8351, 8352, 8354, 8355, 8361, 8367, 8368, 8373, 8376, 8379, 8384, 8385, 8387, 8389, 8392, 8395, 8398, 8401, 8402, 8403, 8404, 8410, 8411, 8413, 8414, 8416, 8417, 8418, 8423, 8428, 8429, 8433, 8435, 8436, 8438, 8439, 8441, 8442, 8444, 8446, 8447, 8448, 8450, 8451, 8452, 8456, 8457, 8458, 8459, 8466, 8472, 8473, 8474, 8476, 8477, 8478, 8480, 8482, 8483, 8485, 8486, 8490, 8493, 8498, 8501, 8502, 8505, 8507, 8511, 8513, 8515, 8517, 8521, 8523, 8524, 8525, 8528, 8531, 8532, 8533, 8539, 8541, 8549, 8550, 8552, 8553, 8554, 8557, 8558, 8562, 8563, 8565, 8566, 8568, 8576, 8581, 8582, 8583, 8588, 8589, 8590, 8593, 8594, 8596, 8597, 8599, 8600, 8601, 8602, 8603, 8605, 8611, 8612, 8614, 8618, 8624, 8630, 8631, 8634, 8638, 8640, 8642, 8644, 8647, 8648, 8652, 8654, 8657, 8658, 8659, 8663, 8665, 8669, 8672, 8675, 8681, 8685, 8693, 8699, 8700, 8706, 8708, 8709, 8713, 8714, 8715, 8716, 8717, 8719, 8720, 8721, 8722, 8729, 8731, 8732, 8734, 8735, 8736, 8740, 8741, 8742, 8744, 8745, 8748, 8752, 8753, 8757, 8758, 8764, 8767, 8769, 8770, 8772, 8773, 8775, 8776, 8777, 8779, 8782, 8783, 8784, 8785, 8789, 8792, 8795, 8797, 8803, 8804, 8805, 8808, 8810, 8818, 8822, 8824, 8831, 8832, 8833, 8835, 8838, 8841, 8842, 8843, 8846, 8847, 8853, 8861, 8862, 8867, 8876, 8878, 8880, 8881, 8883, 8884, 8886, 8888, 8889, 8892, 8897, 8899, 8901, 8902, 8905, 8907, 8908, 8909, 8910, 8911, 8913, 8914, 8916, 8917, 8919, 8926, 8928, 8929, 8930, 8935, 8938, 8940, 8941, 8942, 8945, 8946, 8949, 8951, 8954, 8957, 8960, 8961, 8962, 8967, 8968, 8969, 8972, 8974, 8976, 8977, 8979, 8980, 8981, 8984, 8985, 8986, 8992, 8998, 8999, 9002, 9003, 9006, 9009, 9012, 9015, 9016, 9020, 9022, 9025, 9029, 9030, 9033, 9037, 9042, 9044, 9052, 9057, 9058, 9059, 9060, 9061, 9066, 9069, 9071, 9073, 9074, 9076, 9084, 9088, 9091, 9092, 9095, 9096, 9105, 9108, 9110, 9112, 9115, 9116, 9118, 9119, 9123, 9125, 9129, 9131, 9133, 9134, 9138, 9139, 9140, 9141, 9142, 9146, 9149, 9151, 9152, 9159, 9164, 9172, 9173, 9174, 9175, 9177, 9183, 9185, 9187, 9188, 9190, 9191, 9195, 9200, 9206, 9207, 9210, 9211, 9213, 9215, 9216, 9217, 9218, 9221, 9226, 9229, 9233, 9234, 9237, 9241, 9243, 9247, 9248, 9252, 9253, 9255, 9257, 9265, 9267, 9269, 9270, 9273, 9276, 9278, 9282, 9283, 9284, 9285, 9288, 9289, 9290, 9291, 9292, 9293, 9295, 9298, 9299, 9300, 9304, 9308, 9310, 9311, 9313, 9320, 9323, 9325, 9326, 9327, 9328, 9329, 9330, 9333, 9336, 9337, 9338, 9339, 9340, 9341, 9345, 9346, 9347, 9348, 9353, 9354, 9355, 9359, 9366, 9367, 9373, 9375, 9376, 9378, 9382, 9383, 9388, 9389, 9391, 9392, 9393, 9394, 9396, 9400, 9402, 9403, 9404, 9406, 9407, 9412, 9413, 9414, 9415, 9422, 9423, 9432, 9433, 9442, 9444, 9449, 9452, 9453, 9456, 9459, 9460, 9468, 9471, 9472, 9473, 9478, 9481, 9483, 9487, 9488, 9490, 9494, 9495, 9497, 9500, 9501, 9502, 9503, 9504, 9505, 9509, 9513, 9514, 9515, 9517, 9518, 9519, 9520, 9521, 9522, 9525, 9531, 9533, 9534, 9536, 9540, 9543, 9545, 9546, 9548, 9549, 9553, 9555, 9557, 9560, 9563, 9564, 9565, 9567, 9568, 9571, 9575, 9577, 9579, 9582, 9583, 9586, 9587, 9589, 9590, 9591, 9592, 9602, 9606, 9607, 9608, 9609, 9610, 9613, 9615, 9617, 9620, 9623, 9626, 9627, 9628, 9629, 9630, 9633, 9635, 9637, 9640, 9641, 9642, 9644, 9645, 9646, 9648, 9650, 9651, 9652, 9653, 9657, 9658, 9659, 9660, 9668, 9670, 9674, 9679, 9681, 9682, 9686, 9692, 9695, 9696, 9698, 9708, 9710, 9711, 9717, 9718, 9722, 9723, 9726, 9727, 9730, 9731, 9732, 9733, 9734, 9737, 9738, 9746, 9750, 9751, 9753, 9754, 9755, 9756, 9763, 9764, 9767, 9768, 9770, 9776, 9777, 9780, 9781, 9782, 9784, 9786, 9792, 9794, 9798, 9799, 9801, 9808, 9813, 9816, 9819, 9820, 9824, 9825, 9827, 9833, 9835, 9836, 9838, 9845, 9846, 9847, 9849, 9853, 9854, 9861, 9864, 9866, 9869, 9873, 9876, 9882, 9886, 9888, 9892, 9893, 9894, 9897, 9898, 9900, 9901, 9906, 9907, 9908, 9909, 9910, 9911, 9912, 9918, 9921, 9923, 9928, 9930, 9938, 9940, 9944, 9946, 9947, 9950, 9953, 9955, 9958, 9960, 9962, 9967, 9971, 9972, 9974, 9976, 9980, 9982, 9984, 9985, 9988, 9990, 9997, 9998, 10000, 10007, 10008, 10009, 10010, 10012, 10017, 10018, 10019, 10021, 10022, 10026, 10031, 10032, 10033, 10035, 10037, 10038, 10044, 10045, 10048, 10049, 10050, 10051, 10052, 10054, 10056, 10058, 10059, 10060, 10062, 10063, 10064, 10066, 10068, 10072, 10076, 10077, 10078, 10083, 10086, 10087, 10089, 10090, 10091, 10092, 10095, 10097, 10098, 10101, 10102, 10103, 10105, 10106, 10107, 10108, 10109, 10110, 10114, 10115, 10118, 10122, 10127, 10128, 10131, 10132, 10134, 10135, 10138, 10143, 10149, 10151, 10152, 10158, 10163, 10165, 10166, 10168, 10169, 10170, 10174, 10176, 10178, 10179, 10181, 10182, 10191, 10192, 10193, 10194, 10195, 10197, 10199, 10203, 10206, 10207, 10209, 10210, 10213, 10214, 10217, 10218, 10219, 10220, 10222, 10223, 10224, 10225, 10228, 10230, 10233, 10234, 10236, 10237, 10239, 10246, 10247, 10252, 10253, 10255, 10257, 10260, 10262, 10273, 10278, 10284, 10286, 10291, 10293, 10295, 10296, 10297, 10300, 10302, 10306, 10307, 10311, 10318, 10321, 10322, 10323, 10325, 10326, 10328, 10329, 10331, 10334, 10335, 10336, 10342, 10343, 10344, 10345, 10353, 10356, 10357, 10359, 10360, 10361, 10362, 10364, 10365, 10368, 10373, 10380, 10381, 10382, 10384, 10385, 10392, 10397, 10398, 10399, 10401, 10405, 10410, 10411, 10413, 10414, 10416, 10421, 10422, 10425, 10429, 10430, 10435, 10437, 10447, 10448, 10449, 10450, 10451, 10453, 10455, 10456, 10463, 10464, 10465, 10468, 10469, 10470, 10472, 10473, 10474, 10488, 10490, 10492, 10494, 10496, 10498, 10501, 10504, 10508, 10514, 10518, 10525, 10527, 10528, 10531, 10532, 10533, 10535, 10536, 10537, 10541, 10542, 10543, 10544, 10547, 10548, 10549, 10550, 10551, 10555, 10556, 10558, 10560, 10561, 10562, 10563, 10565, 10567, 10569, 10571, 10573, 10577, 10580, 10581, 10582, 10583, 10584, 10585, 10590, 10593, 10595, 10596, 10597, 10599, 10601, 10602, 10605, 10610, 10611, 10612, 10615, 10616, 10617, 10618, 10621, 10622, 10623, 10626, 10629, 10630, 10631, 10633, 10636, 10637, 10638, 10639, 10643, 10645, 10646, 10648, 10649, 10650, 10655, 10657, 10663, 10664, 10665, 10668, 10669, 10670, 10671, 10673, 10674, 10678, 10681, 10682, 10683, 10684, 10685, 10687, 10689, 10693, 10697, 10698, 10699, 10700, 10702, 10703, 10705, 10707, 10710, 10711, 10712, 10715, 10716, 10718, 10722, 10723, 10725, 10726, 10732, 10734, 10735, 10736, 10738, 10740, 10744, 10747, 10748, 10749, 10752, 10753, 10754, 10756, 10762, 10763, 10766, 10774, 10777, 10778, 10779, 10780, 10782, 10784, 10785, 10787, 10788, 10790, 10791, 10792, 10795, 10796, 10801, 10802, 10803, 10804, 10805, 10809, 10810, 10811, 10815, 10818, 10819, 10820, 10821, 10822, 10823, 10824, 10825, 10826, 10830, 10833, 10836, 10838, 10839, 10840, 10843, 10846, 10851, 10853, 10854, 10856, 10857, 10858, 10860, 10862, 10863, 10867, 10869, 10871, 10874, 10876, 10877, 10878, 10880, 10881, 10887, 10892, 10896, 10897, 10898, 10902, 10903, 10905, 10912, 10917, 10920, 10926, 10927, 10930, 10933, 10934, 10935, 10936, 10937, 10938, 10940, 10941, 10947, 10948, 10950, 10954, 10957, 10960, 10962, 10964, 10965, 10967, 10972, 10975, 10976, 10977, 10980, 10988, 10993, 10995, 10996, 10997, 10999, 11002, 11004, 11005, 11006, 11008, 11010, 11015, 11018, 11019, 11023, 11025, 11026, 11027, 11030, 11032, 11039, 11045, 11046, 11047, 11053, 11056, 11058, 11060, 11070, 11072, 11078, 11079, 11080, 11082, 11083, 11086, 11090, 11092, 11095, 11098, 11101, 11102, 11107, 11108, 11109, 11110, 11114, 11116, 11117, 11118, 11119, 11123, 11124, 11125, 11127, 11128, 11129, 11132, 11133, 11135, 11137, 11138, 11145, 11146, 11149, 11150, 11151, 11152, 11154, 11158, 11159, 11160, 11161, 11162, 11163, 11166, 11169, 11175, 11177, 11178, 11179, 11180, 11184, 11187, 11188, 11190, 11191, 11192, 11194, 11198, 11199, 11201, 11202, 11203, 11207, 11210, 11211, 11214, 11217, 11218, 11222, 11226, 11227, 11228, 11232, 11233, 11234, 11235, 11236, 11237, 11239, 11244, 11246, 11247, 11248, 11251, 11254, 11255, 11256, 11257, 11258, 11259, 11260, 11261, 11262, 11263, 11264, 11266, 11274, 11275, 11278, 11282, 11284, 11289, 11290, 11291, 11292, 11293, 11294, 11295, 11298, 11302, 11306, 11307, 11313, 11315, 11316, 11318, 11319, 11320, 11322, 11323, 11326, 11328, 11329, 11330, 11331, 11332, 11333, 11337, 11338, 11339, 11340, 11345, 11346, 11348, 11349, 11352, 11356, 11358, 11363, 11365, 11366, 11369, 11370, 11371, 11373, 11374, 11377, 11380, 11381, 11382, 11385, 11387, 11388, 11391, 11392, 11394, 11395, 11397, 11398, 11403, 11405, 11406, 11408, 11409, 11411, 11412, 11413, 11414, 11416, 11418, 11423, 11428, 11430, 11431, 11433, 11437, 11438, 11446, 11448, 11449, 11451, 11456, 11458, 11459, 11463, 11464, 11465, 11471, 11472, 11473, 11476, 11477, 11478, 11481, 11482, 11485, 11487, 11490, 11491, 11492, 11494, 11496, 11497, 11498, 11499, 11503, 11506, 11507, 11508, 11509, 11512, 11518, 11521, 11522, 11523, 11524, 11526, 11528, 11530, 11533, 11534, 11538, 11541, 11544, 11546, 11547, 11548, 11551, 11553, 11558, 11560, 11561, 11567, 11568, 11570, 11571, 11576, 11577, 11578, 11580, 11585, 11588, 11589, 11594, 11595, 11597, 11599, 11604, 11607, 11608, 11612, 11615, 11618, 11620, 11621, 11623, 11624, 11625, 11627, 11632, 11633, 11636, 11639, 11642, 11644, 11647, 11649, 11652, 11654, 11655, 11656, 11657, 11658, 11667, 11668, 11669, 11673, 11678, 11681, 11683, 11685, 11688, 11691, 11692, 11693, 11695, 11698, 11699, 11701, 11703, 11705, 11707, 11710, 11711, 11712, 11717, 11718, 11720, 11721, 11725, 11726, 11730, 11731, 11733, 11736, 11740, 11743, 11744, 11753, 11755, 11759, 11760, 11761, 11762, 11763, 11764, 11765, 11766, 11767, 11770, 11771, 11774, 11776, 11780, 11781, 11782, 11783, 11786, 11790, 11792, 11795, 11799, 11800, 11804, 11809, 11811, 11812, 11813, 11814, 11816, 11818, 11819, 11821, 11822, 11826, 11828, 11830, 11831, 11832, 11836, 11837, 11839, 11841, 11842, 11846, 11847, 11848, 11849, 11850, 11851, 11853, 11856, 11858, 11860, 11861, 11863, 11868, 11870, 11872, 11876, 11877, 11878, 11881, 11890, 11891, 11894, 11895, 11898, 11899, 11904, 11909, 11911, 11913, 11918, 11919, 11920, 11921, 11923, 11926, 11927, 11928, 11929, 11930, 11934, 11935, 11940, 11941, 11943, 11946, 11947, 11948, 11949, 11950, 11953, 11955, 11957, 11958, 11959, 11960, 11961, 11962, 11963, 11965, 11968, 11975, 11977, 11978, 11980, 11983, 11988, 11993, 11997, 11998, 11999, 12002, 12004, 12005, 12006, 12014, 12015, 12017, 12018, 12019, 12020, 12021, 12023, 12024, 12025, 12032, 12042, 12043, 12044, 12050, 12051, 12059, 12060, 12061, 12063, 12068, 12073, 12078, 12079, 12080, 12081, 12083, 12085, 12091, 12093, 12097, 12098, 12104, 12106, 12109, 12112, 12114, 12115, 12118, 12120, 12122, 12127, 12128, 12129, 12131, 12134, 12137, 12138, 12144, 12145, 12146, 12147, 12148, 12150, 12151, 12153, 12155, 12163, 12165, 12166, 12167, 12170, 12171, 12174, 12175, 12179, 12181, 12189, 12192, 12197, 12198, 12200, 12201, 12202, 12204, 12208, 12212, 12214, 12215, 12217, 12218, 12221, 12223, 12228, 12229, 12233, 12234, 12236, 12241, 12243, 12245, 12246, 12249, 12250, 12252, 12253, 12255, 12256, 12259, 12263, 12268, 12271, 12275, 12278, 12280, 12283, 12285, 12286, 12287, 12291, 12295, 12296, 12304, 12305, 12306, 12310, 12311, 12312, 12315, 12317, 12319, 12321, 12323, 12324, 12325, 12328, 12331, 12333, 12334, 12337, 12339, 12340, 12342, 12343, 12344, 12347, 12350, 12354, 12356, 12359, 12364, 12366, 12368, 12370, 12373, 12374, 12375, 12376, 12379, 12380, 12381, 12383, 12390, 12394, 12397, 12399, 12400, 12401, 12402, 12403, 12406, 12410, 12411, 12414, 12415, 12416, 12417, 12418, 12419, 12420, 12423, 12424, 12425, 12426, 12427, 12428, 12429, 12437, 12439, 12440, 12444, 12447, 12450, 12451, 12456, 12457, 12459, 12462, 12465, 12467, 12468, 12469, 12470, 12472, 12473, 12476, 12478, 12481, 12482, 12483, 12487, 12488, 12492, 12494, 12497, 12499, 12500, 12501, 12502, 12503, 12508, 12512, 12513, 12514, 12515, 12518, 12519, 12525, 12527, 12531, 12535, 12536, 12537, 12538, 12539, 12546, 12547, 12549, 12551, 12552, 12554, 12555, 12556, 12562, 12563, 12565, 12568, 12572, 12577, 12578, 12580, 12583, 12584, 12585, 12586, 12588, 12589, 12591, 12594, 12600, 12603, 12605, 12608, 12609, 12610, 12611, 12620, 12622, 12623, 12626, 12628, 12629, 12631, 12633, 12634, 12638, 12639, 12640, 12641, 12644, 12645, 12648, 12651, 12663, 12664, 12668, 12671, 12673, 12679, 12683, 12684, 12688, 12691, 12693, 12696, 12699, 12701, 12702, 12705, 12706, 12707, 12715, 12721, 12723, 12728, 12729, 12731, 12732, 12733, 12735, 12738, 12739, 12740, 12741, 12742, 12743, 12744, 12752, 12753, 12754, 12755, 12758, 12760, 12761, 12763, 12764, 12765, 12766, 12771, 12775, 12777, 12782, 12783, 12785, 12790, 12797, 12800, 12801, 12802, 12804, 12805, 12807, 12810, 12812, 12813, 12817, 12818, 12820, 12822, 12823, 12824, 12827, 12828, 12834, 12835, 12836, 12837, 12838, 12839, 12848, 12849, 12850, 12853, 12861, 12866, 12870, 12873, 12875, 12878, 12882, 12884, 12887, 12891, 12895, 12898, 12899, 12900, 12901, 12902, 12903, 12904, 12905, 12908, 12910, 12912, 12913, 12916, 12920, 12921, 12928, 12931, 12932, 12933, 12934, 12935, 12939, 12942, 12946, 12947, 12950, 12952, 12953, 12960, 12961, 12963, 12968, 12969, 12972, 12977, 12978, 12986, 12987, 12990, 12991, 12999, 13003, 13004, 13007, 13010, 13014, 13017, 13022, 13027, 13030, 13031, 13032, 13034, 13035, 13036, 13040, 13041, 13044, 13047, 13049, 13050, 13053, 13054, 13055, 13056, 13061, 13063, 13064, 13066, 13067, 13069, 13070, 13071, 13075, 13077, 13079, 13082, 13083, 13085, 13086, 13087, 13097, 13098, 13099, 13101, 13102, 13105, 13106, 13109, 13110, 13111, 13112, 13114, 13115, 13116, 13117, 13118, 13120, 13121, 13122, 13123, 13124, 13125, 13127, 13128, 13130, 13131, 13136, 13144, 13147, 13148, 13149, 13151, 13154, 13155, 13156, 13159, 13160, 13167, 13169, 13175, 13181, 13182, 13186, 13187, 13189, 13197, 13198, 13199, 13206, 13207, 13209, 13210, 13212, 13213, 13217, 13221, 13222, 13224, 13226, 13228, 13229, 13231, 13232, 13233, 13234, 13235, 13236, 13237, 13239, 13243, 13248, 13255, 13260, 13261, 13262, 13263, 13264, 13267, 13268, 13269, 13271, 13273, 13274, 13275, 13281, 13285, 13293, 13295, 13296, 13297, 13298, 13300, 13301, 13303, 13304, 13313, 13315, 13316, 13317, 13326, 13328, 13329, 13330, 13332, 13338, 13340, 13343, 13345, 13346, 13347, 13348, 13349, 13352, 13353, 13358, 13361, 13363, 13367, 13368, 13369, 13370, 13377, 13380, 13381, 13385, 13386, 13387, 13388, 13391, 13393, 13394, 13396, 13397, 13398, 13401, 13403, 13407, 13408, 13410, 13414, 13416, 13417, 13419, 13423, 13424, 13428, 13429, 13430, 13431, 13433, 13439, 13441, 13446, 13448, 13450, 13456, 13460, 13467, 13469, 13470, 13473, 13474, 13475, 13477, 13478, 13480, 13492, 13494, 13499, 13503, 13507, 13510, 13515, 13519, 13521, 13522, 13526, 13532, 13535, 13536, 13539, 13540, 13543, 13544, 13546, 13547, 13549, 13552, 13553, 13556, 13558, 13559, 13561, 13562, 13565, 13566, 13568, 13569, 13572, 13574, 13579, 13580, 13582, 13584, 13587, 13596, 13597, 13599, 13600, 13601, 13602, 13604, 13605, 13606, 13607, 13612, 13613, 13623, 13627, 13628, 13629, 13630, 13631, 13632, 13634, 13636, 13637, 13641, 13643, 13647, 13650, 13653, 13660, 13662, 13663, 13665, 13669, 13675, 13676, 13677, 13678, 13679, 13683, 13687, 13688, 13689, 13693, 13697, 13698, 13699, 13700, 13706, 13710, 13712, 13713, 13714, 13715, 13716, 13719, 13720, 13721, 13729, 13730, 13734, 13736, 13737, 13738, 13739, 13742, 13745, 13747, 13749, 13750, 13753, 13756, 13764, 13767, 13769, 13772, 13773, 13775, 13777, 13779, 13782, 13783, 13785, 13786, 13787, 13791, 13793, 13795, 13796, 13798, 13799, 13802, 13809, 13816, 13817, 13818, 13819, 13820, 13822, 13823, 13830, 13834, 13835, 13843, 13849, 13852, 13856, 13858, 13859, 13860, 13862, 13866, 13870, 13872, 13873, 13877, 13887, 13891, 13892, 13895, 13897, 13898, 13899, 13901, 13906, 13907, 13908, 13909, 13910, 13911, 13917, 13918, 13919, 13921, 13923, 13924, 13925, 13929, 13934, 13938, 13942, 13943, 13944, 13947, 13948, 13949, 13950, 13953, 13954, 13957, 13958, 13960, 13962, 13963, 13969, 13970, 13975, 13984, 13986, 13987, 13994, 14000, 14001, 14002, 14003, 14005, 14006, 14008, 14013, 14016, 14017, 14018, 14022, 14027, 14030, 14031, 14036, 14038, 14040, 14051, 14052, 14059, 14062, 14063, 14066, 14067, 14069, 14070, 14071, 14075, 14078, 14081, 14083, 14084, 14085, 14086, 14088, 14091, 14092, 14094, 14096, 14097, 14102, 14106, 14111, 14112, 14115, 14116, 14118, 14120, 14121, 14122, 14124, 14125, 14129, 14130, 14132, 14133, 14138, 14139, 14142, 14145, 14146, 14147.

Promoters expressing in the second fully expanded leaf tissue at the V5 stage at 5 p.m. include SEQ IDs: 1, 7, 11, 12, 13, 14, 15, 16, 17, 19, 20, 24, 27, 29, 31, 33, 34, 36, 37, 48, 51, 53, 54, 57, 61, 63, 64, 65, 79, 80, 88, 90, 93, 94, 96, 98, 99, 102, 103, 104, 110, 111, 112, 115, 117, 123, 129, 130, 131, 133, 136, 141, 143, 144, 148, 152, 154, 155, 156, 157, 159, 160, 162, 165, 168, 172, 174, 175, 176, 179, 180, 181, 183, 187, 191, 193, 194, 196, 199, 202, 203, 205, 207, 211, 212, 214, 230, 232, 233, 236, 237, 239, 240, 242, 244, 246, 249, 250, 251, 257, 259, 267, 269, 270, 271, 273, 279, 280, 281, 286, 288, 289, 293, 294, 298, 299, 301, 302, 305, 306, 307, 308, 309, 316, 319, 320, 322, 328, 329, 332, 334, 335, 338, 342, 346, 348, 349, 352, 354, 356, 357, 358, 359, 364, 365, 371, 373, 376, 378, 379, 381, 382, 386, 388, 393, 401, 405, 411, 412, 423, 424, 428, 431, 433, 434, 436, 441, 450, 452, 456, 459, 461, 462, 463, 466, 470, 471, 474, 478, 483, 484, 485, 488, 489, 492, 496, 501, 507, 509, 510, 511, 514, 516, 517, 520, 523, 525, 532, 537, 538, 541, 544, 546, 547, 548, 554, 560, 561, 563, 578, 580, 585, 591, 594, 595, 596, 599, 601, 602, 606, 613, 619, 620, 630, 634, 635, 636, 637, 638, 642, 643, 647, 655, 656, 659, 669, 671, 681, 683, 692, 693, 694, 695, 701, 702, 705, 706, 709, 716, 717, 718, 719, 721, 722, 723, 724, 725, 727, 731, 732, 734, 735, 736, 739, 740, 741, 744, 749, 753, 759, 760, 761, 762, 763, 764, 765, 771, 779, 783, 784, 786, 792, 793, 794, 798, 800, 804, 806, 807, 808, 809, 811, 819, 820, 821, 829, 830, 833, 840, 845, 846, 849, 855, 856, 857, 858, 860, 862, 863, 865, 868, 869, 870, 871, 876, 877, 878, 887, 890, 892, 893, 895, 897, 898, 899, 900, 903, 907, 908, 910, 911, 912, 913, 915, 916, 919, 920, 924, 925, 928, 929, 931, 932, 934, 936, 938, 939, 943, 951, 953, 955, 957, 958, 960, 964, 971, 974, 975, 976, 977, 978, 979, 980, 981, 982, 984, 985, 987, 989, 990, 991, 994, 995, 996, 997, 999, 1002, 1005, 1007, 1008, 1009, 1010, 1011, 1012, 1013, 1014, 1016, 1017, 1022, 1025, 1026, 1029, 1030, 1032, 1035, 1038, 1039, 1040, 1041, 1042, 1043, 1046, 1047, 1049, 1051, 1052, 1055, 1056, 1057, 1064, 1065, 1068, 1069, 1073, 1076, 1077, 1085, 1086, 1087, 1088, 1089, 1091, 1092, 1095, 1100, 1101, 1103, 1104, 1106, 1110, 1112, 1114, 1115, 1116, 1117, 1119, 1121, 1125, 1130, 1132, 1136, 1137, 1140, 1143, 1144, 1146, 1148, 1153, 1155, 1160, 1161, 1162, 1164, 1165, 1167, 1168, 1170, 1171, 1176, 1178, 1183, 1187, 1189, 1191, 1196, 1201, 1203, 1204, 1205, 1214, 1217, 1218, 1220, 1222, 1223, 1225, 1228, 1230, 1232, 1233, 1234, 1235, 1236, 1239, 1240, 1243, 1244, 1248, 1249, 1251, 1254, 1258, 1259, 1262, 1263, 1269, 1272, 1275, 1277, 1281, 1285, 1286, 1290, 1292, 1293, 1296, 1298, 1301, 1303, 1306, 1307, 1309, 1310, 1311, 1312, 1314, 1316, 1317, 1320, 1327, 1331, 1334, 1337, 1345, 1346, 1349, 1354, 1355, 1360, 1366, 1367, 1368, 1371, 1375, 1377, 1380, 1381, 1386, 1387, 1388, 1389, 1393, 1394, 1396, 1399, 1404, 1405, 1406, 1420, 1421, 1423, 1426, 1431, 1432, 1438, 1439, 1440, 1441, 1442, 1447, 1448, 1451, 1453, 1458, 1459, 1461, 1462, 1466, 1467, 1468, 1484, 1488, 1490, 1491, 1493, 1499, 1501, 1503, 1508, 1510, 1511, 1512, 1514, 1517, 1518, 1525, 1526, 1527, 1528, 1530, 1534, 1539, 1540, 1543, 1545, 1547, 1549, 1550, 1551, 1553, 1554, 1555, 1556, 1564, 1567, 1570, 1571, 1575, 1578, 1579, 1582, 1584, 1585, 1586, 1590, 1596, 1598, 1599, 1600, 1601, 1602, 1604, 1605, 1608, 1609, 1610, 1612, 1614, 1615, 1616, 1617, 1622, 1623, 1625, 1634, 1635, 1637, 1638, 1639, 1641, 1643, 1651, 1653, 1654, 1658, 1659, 1662, 1663, 1664, 1669, 1671, 1673, 1675, 1678, 1681, 1682, 1684, 1685, 1687, 1688, 1690, 1691, 1696, 1697, 1698, 1699, 1705, 1706, 1707, 1708, 1710, 1716, 1717, 1720, 1723, 1725, 1732, 1735, 1736, 1743, 1750, 1755, 1759, 1760, 1761, 1764, 1770, 1773, 1785, 1786, 1796, 1798, 1807, 1808, 1809, 1811, 1813, 1814, 1823, 1826, 1828, 1830, 1832, 1834, 1837, 1838, 1839, 1840, 1845, 1848, 1850, 1852, 1856, 1859, 1861, 1863, 1866, 1868, 1869, 1872, 1873, 1876, 1878, 1879, 1880, 1882, 1886, 1888, 1891, 1897, 1900, 1902, 1903, 1905, 1906, 1910, 1911, 1912, 1915, 1916, 1918, 1920, 1922, 1923, 1924, 1927, 1933, 1934, 1939, 1940, 1945, 1950, 1951, 1952, 1954, 1955, 1958, 1968, 1969, 1970, 1971, 1972, 1973, 1976, 1977, 1990, 1991, 1993, 1999, 2000, 2003, 2007, 2008, 2010, 2012, 2014, 2015, 2019, 2020, 2021, 2023, 2026, 2027, 2031, 2032, 2033, 2037, 2040, 2041, 2043, 2045, 2048, 2049, 2058, 2060, 2062, 2064, 2072, 2074, 2077, 2078, 2088, 2089, 2091, 2092, 2093, 2094, 2096, 2097, 2103, 2106, 2109, 2111, 2112, 2113, 2115, 2116, 2117, 2122, 2123, 2125, 2126, 2130,
2133, 2137, 2139, 2142, 2143, 2146, 2147, 2150, 2151, 2156,
2157, 2161, 2164, 2166, 2167, 2168, 2170, 2172, 2175, 2177,
2179, 2183, 2185, 2189, 2190, 2193, 2195, 2196, 2200, 2202,
2203, 2205, 2210, 2213, 2215, 2218, 2221, 2222, 2226, 2233,
2237, 2240, 2241, 2242, 2245, 2252, 2253, 2257, 2260, 2261,
2263, 2264, 2266, 2271, 2276, 2278, 2280, 2282, 2284, 2289,
2290, 2297, 2298, 2303, 2305, 2306, 2308, 2309, 2310, 2313,
2314, 2321, 2322, 2323, 2325, 2328, 2329, 2331, 2333, 2337,
2339, 2342, 2343, 2346, 2352, 2353, 2354, 2360, 2363, 2366,
2367, 2369, 2371, 2372, 2376, 2379, 2381, 2382, 2384, 2396,
2398, 2401, 2402, 2405, 2410, 2413, 2414, 2416, 2417, 2418,
2419, 2420, 2423, 2426, 2431, 2432, 2433, 2434, 2435, 2437,
2439, 2440, 2441, 2442, 2443, 2445, 2449, 2450, 2452, 2453,
2454, 2457, 2458, 2465, 2469, 2470, 2472, 2474, 2476, 2480,
2481, 2482, 2485, 2487, 2489, 2490, 2491, 2492, 2495, 2496,
2497, 2498, 2500, 2505, 2506, 2507, 2509, 2513, 2516, 2517,
2521, 2522, 2525, 2526, 2528, 2529, 2531, 2532, 2533, 2538,
2539, 2540, 2541, 2543, 2544, 2546, 2547, 2548, 2549, 2551,
2552, 2557, 2560, 2567, 2568, 2570, 2571, 2573, 2578, 2579,
2581, 2587, 2589, 2590, 2594, 2596, 2599, 2601, 2605, 2609,
2611, 2612, 2613, 2614, 2616, 2617, 2619, 2620, 2625, 2626,
2627, 2632, 2635, 2636, 2639, 2644, 2645, 2648, 2651, 2652,
2654, 2658, 2659, 2660, 2661, 2662, 2663, 2670, 2672, 2674,
2679, 2680, 2684, 2685, 2687, 2688, 2689, 2690, 2691, 2692,
2694, 2700, 2704, 2707, 2708, 2709, 2711, 2719, 2720, 2722,
2723, 2725, 2726, 2728, 2729, 2730, 2735, 2737, 2738, 2739,
2740, 2746, 2747, 2749, 2752, 2756, 2762, 2764, 2765, 2770,
2784, 2785, 2786, 2787, 2791, 2794, 2798, 2800, 2801, 2802,
2805, 2808, 2814, 2816, 2819, 2821, 2822, 2823, 2824, 2826,
2827, 2828, 2831, 2838, 2840, 2844, 2845, 2850, 2857, 2859,
2860, 2862, 2864, 2865, 2866, 2869, 2870, 2871, 2876, 2878,
2879, 2883, 2885, 2888, 2889, 2892, 2893, 2894, 2895, 2896,
2897, 2901, 2902, 2903, 2906, 2908, 2909, 2915, 2916, 2917,
2918, 2922, 2923, 2926, 2930, 2931, 2935, 2938, 2941, 2942,
2943, 2946, 2948, 2950, 2955, 2959, 2960, 2963, 2965, 2966,
2968, 2969, 2976, 2979, 2982, 2992, 2994, 3000, 3003, 3005,
3007, 3009, 3013, 3015, 3017, 3018, 3020, 3023, 3024, 3029,
3031, 3039, 3042, 3044, 3045, 3047, 3048, 3049, 3050, 3051,
3053, 3055, 3058, 3059, 3062, 3064, 3067, 3068, 3069, 3072,
3075, 3080, 3083, 3084, 3085, 3087, 3090, 3095, 3100, 3101,
3106, 3107, 3110, 3112, 3113, 3115, 3118, 3119, 3120, 3121,
3123, 3126, 3127, 3128, 3138, 3141, 3143, 3145, 3153, 3164,
3167, 3169, 3170, 3171, 3172, 3177, 3181, 3189, 3192, 3194,
3196, 3199, 3202, 3205, 3206, 3208, 3210, 3217, 3218, 3220,
3221, 3224, 3225, 3227, 3228, 3230, 3231, 3236, 3237, 3240,
3242, 3246, 3247, 3249, 3250, 3252, 3261, 3263, 3266, 3267,
3268, 3271, 3272, 3280, 3283, 3286, 3288, 3289, 3290, 3291,
3294, 3295, 3299, 3301, 3304, 3307, 3310, 3312, 3313, 3314,
3324, 3327, 3329, 3331, 3332, 3333, 3335, 3337, 3338, 3339,
3340, 3342, 3343, 3345, 3346, 3351, 3353, 3355, 3357, 3359,
3360, 3361, 3365, 3370, 3374, 3378, 3379, 3383, 3386, 3394,
3396, 3399, 3403, 3404, 3405, 3411, 3412, 3413, 3415, 3416,
3424, 3425, 3426, 3427, 3428, 3429, 3435, 3438, 3440, 3441,
3442, 3443, 3445, 3446, 3447, 3449, 3450, 3452, 3453, 3458,
3462, 3466, 3468, 3469, 3470, 3471, 3474, 3477, 3484, 3486,
3488, 3490, 3493, 3500, 3501, 3502, 3503, 3504, 3506, 3507,
3510, 3516, 3517, 3518, 3523, 3524, 3529, 3533, 3535, 3536,
3538, 3540, 3541, 3544, 3545, 3548, 3549, 3551, 3554, 3556,
3557, 3560, 3562, 3569, 3571, 3574, 3576, 3580, 3587, 3588,
3589, 3591, 3592, 3594, 3595, 3600, 3601, 3603, 3604, 3606,
3607, 3610, 3611, 3613, 3615, 3616, 3618, 3619, 3620, 3621,
3624, 3629, 3633, 3634, 3640, 3642, 3643, 3644, 3645, 3646,
3648, 3650, 3654, 3655, 3659, 3660, 3661, 3667, 3669, 3671,
3672, 3673, 3674, 3677, 3682, 3684, 3685, 3690, 3698, 3702,
3706, 3707, 3709, 3710, 3713, 3715, 3717, 3718, 3719, 3721,
3725, 3730, 3731, 3738, 3739, 3744, 3748, 3749, 3752, 3756,
3761, 3764, 3766, 3772, 3773, 3775, 3777, 3778, 3783, 3790,
3791, 3792, 3793, 3801, 3805, 3806, 3808, 3812, 3817, 3818,
3819, 3820, 3823, 3829, 3830, 3831, 3832, 3833, 3837, 3838,
3839, 3843, 3844, 3846, 3847, 3849, 3858, 3859, 3866, 3867,
3868, 3870, 3871, 3872, 3873, 3876, 3877, 3882, 3883, 3884,
3885, 3887, 3889, 3890, 3892, 3894, 3895, 3896, 3898, 3899,
3902, 3903, 3904, 3907, 3908, 3912, 3917, 3918, 3923, 3924,
3926, 3928, 3929, 3933, 3934, 3937, 3938, 3940, 3941, 3947,
3950, 3951, 3954, 3955, 3958, 3959, 3962, 3967, 3968, 3970,
3971, 3974, 3975, 3978, 3979, 3983, 3985, 3987, 3988, 3991,
3996, 3997, 4000, 4007, 4008, 4013, 4014, 4026, 4030, 4033,
4037, 4039, 4040, 4041, 4042, 4043, 4044, 4047, 4048, 4049,
4050, 4053, 4054, 4056, 4057, 4062, 4068, 4070, 4084, 4087,
4088, 4092, 4094, 4098, 4099, 4102, 4103, 4105, 4106, 4109,
4110, 4111, 4113, 4124, 4126, 4128, 4133, 4134, 4135, 4140,
4143, 4144, 4149, 4150, 4155, 4158, 4160, 4161, 4162, 4163,
4164, 4165, 4166, 4167, 4168, 4171, 4173, 4175, 4176, 4178,
4181, 4183, 4185, 4187, 4188, 4189, 4190, 4191, 4193, 4195,
4201, 4202, 4204, 4205, 4206, 4207, 4210, 4211, 4212, 4213,
4219, 4221, 4227, 4228, 4229, 4233, 4235, 4237, 4245, 4246,
4251, 4252, 4257, 4258, 4260, 4261, 4266, 4270, 4272, 4275,
4276, 4280, 4281, 4284, 4290, 4292, 4294, 4296, 4301, 4302,
4305, 4306, 4309, 4312, 4317, 4320, 4321, 4324, 4329, 4330,
4333, 4339, 4344, 4347, 4352, 4354, 4358, 4359, 4360, 4369,
4370, 4374, 4378, 4380, 4383, 4388, 4390, 4391, 4393, 4396,
4397, 4401, 4402, 4403, 4405, 4410, 4421, 4422, 4423, 4430,
4432, 4436, 4439, 4440, 4442, 4443, 4446, 4448, 4449, 4450,
4453, 4457, 4461, 4462, 4463, 4466, 4467, 4468, 4470, 4474,
4475, 4479, 4486, 4487, 4492, 4494, 4497, 4498, 4500, 4502,
4507, 4508, 4509, 4512, 4514, 4518, 4519, 4521, 4522, 4524,
4531, 4535, 4548, 4549, 4551, 4554, 4556, 4557, 4558, 4560,
4562, 4563, 4565, 4566, 4567, 4568, 4575, 4576, 4580, 4582,
4583, 4590, 4594, 4596, 4597, 4598, 4599, 4601, 4606, 4614,
4616, 4623, 4625, 4628, 4632, 4635, 4636, 4639, 4641, 4643,
4644, 4645, 4646, 4647, 4650, 4651, 4653, 4654, 4655, 4656,
4657, 4658, 4659, 4662, 4667, 4669, 4671, 4672, 4673, 4674,
4676, 4677, 4680, 4682, 4684, 4685, 4690, 4691, 4692, 4696,
4697, 4699, 4700, 4701, 4703, 4705, 4706, 4710, 4711, 4713,
4715, 4719, 4721, 4722, 4723, 4725, 4727, 4728, 4729, 4730,
4734, 4736, 4737, 4738, 4739, 4740, 4741, 4745, 4748, 4749,
4753, 4754, 4756, 4761, 4762, 4763, 4767, 4769, 4770, 4771,
4773, 4775, 4779, 4780, 4783, 4784, 4788, 4789, 4790, 4791,
4795, 4796, 4800, 4801, 4803, 4804, 4805, 4806, 4807, 4813,
4816, 4817, 4818, 4820, 4822, 4828, 4830, 4831, 4834, 4836,
4837, 4841, 4842, 4845, 4854, 4855, 4856, 4857, 4861, 4862,
4863, 4864, 4867, 4869, 4874, 4875, 4876, 4878, 4880, 4881,
4887, 4889, 4891, 4900, 4904, 4907, 4909, 4910, 4912, 4913,
4914, 4918, 4920, 4921, 4923, 4924, 4931, 4936, 4938, 4941,
4943, 4947, 4953, 4954, 4955, 4958, 4959, 4960, 4967, 4969,
4971, 4972, 4974, 4975, 4977, 4981, 4984, 4988, 4989, 4990,
4991, 4993, 4994, 4996, 5011, 5015, 5016, 5023, 5024, 5026,
5029, 5030, 5034, 5036, 5037, 5039, 5040, 5042, 5044, 5045,
5046, 5049, 5052, 5054, 5057, 5058, 5059, 5060, 5061, 5067,
5068, 5072, 5074, 5075, 5078, 5082, 5084, 5088, 5089, 5090,
5091, 5094, 5100, 5101, 5102, 5106, 5110, 5111, 5113, 5114,
5116, 5120, 5122, 5123, 5131, 5132, 5140, 5143, 5144, 5145,
5146, 5147, 5151, 5154, 5157, 5159, 5160, 5164, 5165, 5166,
5168, 5170, 5174, 5175, 5177, 5178, 5180, 5181, 5182, 5184,
5185, 5187, 5188, 5189, 5190, 5191, 5192, 5196, 5198, 5200,
5201, 5202, 5206, 5209, 5212, 5213, 5216, 5217, 5218, 5219,
5224, 5225, 5229, 5230, 5234, 5237, 5238, 5240, 5241, 5243,
5251, 5253, 5254, 5255, 5256, 5257, 5258, 5260, 5261, 5263,
5269, 5273, 5275, 5276, 5280, 5281, 5283, 5286, 5293, 5294,
5297, 5298, 5299, 5300, 5301, 5308, 5311, 5314, 5315, 5317,
5319, 5321, 5324, 5329, 5330, 5332, 5334, 5339, 5341, 5342,
5343, 5345, 5346, 5348, 5351, 5352, 5361, 5366, 5367, 5369,
5371, 5379, 5386, 5388, 5389, 5391, 5393, 5396, 5402, 5405, 5411, 5413, 5414, 5416, 5417, 5418, 5422, 5427, 5428, 5430, 5431, 5432, 5434, 5437, 5438, 5445, 5446, 5448, 5449, 5452, 5453, 5456, 5458, 5459, 5461, 5462, 5463, 5464, 5469, 5475, 5481, 5483, 5485, 5487, 5488, 5491, 5493, 5495, 5496, 5505, 5506, 5508, 5510, 5512, 5513, 5515, 5517, 5518, 5519, 5524, 5526, 5529, 5530, 5531, 5532, 5534, 5535, 5543, 5545, 5549, 5554, 5557, 5558, 5559, 5561, 5562, 5563, 5564, 5566, 5568, 5569, 5572, 5575, 5579, 5581, 5582, 5584, 5585, 5586, 5589, 5593, 5594, 5596, 5597, 5602, 5608, 5612, 5613, 5614, 5616, 5620, 5621, 5627, 5633, 5635, 5638, 5640, 5643, 5647, 5648, 5649, 5650, 5651, 5653, 5657, 5660, 5662, 5663, 5664, 5667, 5669, 5670, 5671, 5677, 5680, 5683, 5689, 5690, 5694, 5695, 5697, 5698, 5700, 5702, 5706, 5711, 5712, 5713, 5718, 5719, 5721, 5722, 5723, 5729, 5730, 5731, 5732, 5734, 5735, 5736, 5737, 5742, 5744, 5751, 5764, 5768, 5770, 5775, 5778, 5780, 5783, 5784, 5785, 5791, 5792, 5794, 5807, 5808, 5810, 5811, 5817, 5819, 5820, 5824, 5825, 5828, 5833, 5834, 5835, 5836, 5837, 5839, 5842, 5844, 5852, 5853, 5854, 5856, 5858, 5859, 5864, 5866, 5867, 5868, 5869, 5871, 5872, 5878, 5879, 5881, 5882, 5883, 5884, 5888, 5889, 5892, 5893, 5900, 5901, 5902, 5905, 5910, 5912, 5918, 5919, 5921, 5925, 5926, 5927, 5928, 5930, 5931, 5932, 5933, 5941, 5942, 5944, 5945, 5946, 5948, 5951, 5954, 5956, 5957, 5959, 5961, 5967, 5968, 5971, 5978, 5979, 5980, 5984, 5985, 5986, 5988, 5990, 5991, 5992, 5994, 5996, 5997, 6000, 6002, 6003, 6004, 6006, 6007, 6008, 6012, 6013, 6016, 6021, 6023, 6025, 6026, 6028, 6031, 6038, 6040, 6041, 6044, 6047, 6048, 6051, 6054, 6058, 6059, 6060, 6061, 6062, 6063, 6070, 6072, 6073, 6074, 6075, 6077, 6080, 6085, 6088, 6089, 6090, 6092, 6093, 6094, 6095, 6096, 6098, 6107, 6108, 6109, 6112, 6113, 6116, 6118, 6119, 6122, 6125, 6129, 6130, 6132, 6133, 6135, 6136, 6137, 6145, 6146, 6147, 6148, 6149, 6151, 6152, 6153, 6155, 6156, 6158, 6163, 6164, 6165, 6168, 6171, 6173, 6178, 6180, 6181, 6182, 6183, 6186, 6188, 6189, 6190, 6191, 6193, 6197, 6198, 6200, 6203, 6205, 6206, 6207, 6209, 6212, 6213, 6220, 6221, 6223, 6224, 6226, 6227, 6228, 6230, 6231, 6237, 6238, 6240, 6241, 6243, 6244, 6245, 6246, 6247, 6249, 6250, 6251, 6255, 6257, 6258, 6259, 6260, 6264, 6265, 6269, 6270, 6271, 6272, 6273, 6278, 6279, 6280, 6282, 6286, 6288, 6289, 6291, 6292, 6294, 6296, 6299, 6300, 6302, 6303, 6306, 6309, 6310, 6311, 6312, 6315, 6317, 6319, 6321, 6322, 6326, 6328, 6333, 6338, 6339, 6345, 6346, 6350, 6351, 6352, 6353, 6354, 6356, 6358, 6360, 6362, 6363, 6364, 6365, 6367, 6370, 6375, 6378, 6381, 6386, 6387, 6395, 6396, 6397, 6398, 6399, 6403, 6405, 6407, 6412, 6414, 6415, 6419, 6420, 6422, 6426, 6429, 6431, 6434, 6436, 6437, 6440, 6442, 6448, 6452, 6454, 6458, 6459, 6463, 6464, 6466, 6467, 6468, 6469, 6470, 6471, 6474, 6477, 6478, 6480, 6484, 6486, 6488, 6495, 6497, 6499, 6500, 6501, 6502, 6504, 6505, 6506, 6514, 6515, 6516, 6517, 6519, 6523, 6524, 6525, 6530, 6533, 6534, 6537, 6541, 6543, 6544, 6547, 6548, 6549, 6554, 6558, 6560, 6561, 6563, 6564, 6572, 6574, 6576, 6577, 6579, 6581, 6582, 6584, 6587, 6595, 6596, 6597, 6599, 6600, 6605, 6607, 6609, 6610, 6611, 6614, 6620, 6621, 6624, 6626, 6627, 6629, 6630, 6634, 6635, 6637, 6638, 6639, 6643, 6644, 6646, 6647, 6648, 6649, 6650, 6652, 6654, 6655, 6656, 6662, 6666, 6671, 6672, 6673, 6676, 6686, 6691, 6692, 6695, 6696, 6699, 6703, 6705, 6706, 6711, 6714, 6716, 6718, 6720, 6724, 6725, 6729, 6730, 6731, 6733, 6734, 6736, 6737, 6739, 6740, 6741, 6742, 6746, 6747, 6753, 6756, 6757, 6759, 6761, 6764, 6766, 6776, 6778, 6779, 6780, 6782, 6786, 6788, 6791, 6792, 6793, 6794, 6797, 6799, 6803, 6804, 6805, 6807, 6810, 6811, 6812, 6813, 6816, 6817, 6819, 6820, 6821, 6824, 6827, 6828, 6831, 6834, 6836, 6840, 6841, 6842, 6843, 6845, 6847, 6848, 6850, 6851, 6852, 6859, 6863, 6864, 6867, 6869, 6872, 6874, 6875, 6876, 6877, 6878, 6879, 6880, 6886, 6887, 6888, 6895, 6897, 6903, 6906, 6909, 6913, 6914, 6915, 6917, 6919, 6921, 6922, 6923, 6924, 6930, 6933, 6935, 6936, 6941, 6943, 6944, 6946, 6948, 6951, 6959, 6960, 6961, 6967, 6971, 6979, 6980, 6984, 6987, 6990, 6991, 6993, 6994, 6999, 7002, 7003, 7005, 7006, 7009, 7012, 7013, 7015, 7016, 7019, 7020, 7022, 7025, 7032, 7033, 7035, 7039, 7042, 7043, 7050, 7052, 7053, 7056, 7057, 7064, 7067, 7068, 7072, 7074, 7075, 7077, 7079, 7083, 7085, 7086, 7094, 7097, 7105, 7106, 7107, 7108, 7112, 7113, 7116, 7117, 7118, 7124, 7126, 7129, 7130, 7132, 7135, 7138, 7139, 7140, 7142, 7144, 7146, 7149, 7151, 7155, 7164, 7165, 7166, 7169, 7176, 7177, 7182, 7183, 7184, 7187, 7188, 7194, 7196, 7197, 7201, 7202, 7203, 7206, 7207, 7209, 7211, 7215, 7216, 7217, 7218, 7219, 7220, 7227, 7228, 7232, 7233, 7234, 7236, 7239, 7243, 7244, 7245, 7248, 7249, 7250, 7252, 7255, 7257, 7258, 7259, 7262, 7267, 7268, 7269, 7270, 7274, 7275, 7276, 7277, 7281, 7282, 7287, 7288, 7290, 7291, 7292, 7293, 7298, 7300, 7301, 7303, 7304, 7305, 7307, 7308, 7313, 7315, 7317, 7318, 7321, 7328, 7330, 7331, 7334, 7338, 7340, 7343, 7348, 7350, 7351, 7354, 7355, 7356, 7357, 7358, 7363, 7365, 7371, 7373, 7377, 7378, 7380, 7381, 7383, 7386, 7388, 7389, 7392, 7395, 7396, 7398, 7399, 7400, 7401, 7409, 7411, 7415, 7417, 7418, 7425, 7428, 7430, 7433, 7434, 7435, 7436, 7443, 7444, 7445, 7446, 7447, 7448, 7452, 7453, 7454, 7458, 7459, 7464, 7466, 7470, 7479, 7486, 7490, 7492, 7493, 7502, 7504, 7505, 7506, 7512, 7515, 7517, 7523, 7528, 7533, 7537, 7538, 7542, 7545, 7546, 7547, 7549, 7554, 7556, 7557, 7561, 7570, 7574, 7578, 7580, 7585, 7586, 7589, 7591, 7594, 7595, 7596, 7598, 7605, 7611, 7613, 7619, 7620, 7621, 7623, 7624, 7632, 7633, 7634, 7638, 7639, 7640, 7642, 7652, 7653, 7655, 7661, 7663, 7665, 7672, 7674, 7677, 7678, 7679, 7680, 7682, 7684, 7685, 7689, 7692, 7695, 7699, 7700, 7703, 7704, 7708, 7712, 7713, 7716, 7719, 7724, 7725, 7729, 7730, 7733, 7736, 7737, 7738, 7740, 7744, 7745, 7747, 7750, 7751, 7753, 7754, 7761, 7762, 7763, 7764, 7768, 7769, 7770, 7774, 7775, 7777, 7778, 7779, 7780, 7781, 7785, 7786, 7788, 7791, 7793, 7796, 7798, 7803, 7804, 7807, 7812, 7815, 7820, 7824, 7825, 7832, 7833, 7834, 7838, 7840, 7841, 7844, 7847, 7849, 7854, 7856, 7859, 7860, 7862, 7863, 7865, 7873, 7875, 7876, 7878, 7888, 7890, 7896, 7900, 7901, 7907, 7908, 7910, 7911, 7918, 7922, 7923, 7925, 7933, 7934, 7935, 7936, 7937, 7938, 7942, 7944, 7945, 7946, 7947, 7948, 7949, 7950, 7955, 7956, 7962, 7964, 7971, 7972, 7974, 7976, 7977, 7978, 7979, 7980, 7982, 7983, 7984, 7986, 7988, 7993, 8000, 8002, 8004, 8005, 8006, 8007, 8012, 8021, 8026, 8029, 8038, 8040, 8041, 8042, 8043, 8044, 8045, 8047, 8048, 8049, 8052, 8053, 8056, 8058, 8059, 8062, 8063, 8065, 8066, 8067, 8068, 8069, 8071, 8072, 8073, 8075, 8076, 8077, 8078, 8080, 8082, 8083, 8084, 8087, 8088, 8091, 8093, 8095, 8099, 8100, 8103, 8105, 8106, 8109, 8112, 8116, 8118, 8121, 8124, 8126, 8129, 8136, 8137, 8145, 8146, 8147, 8150, 8151, 8159, 8163, 8165, 8170, 8174, 8178, 8179, 8182, 8185, 8189, 8193, 8195, 8196, 8199, 8202, 8204, 8207, 8208, 8211, 8213, 8216, 8219, 8220, 8222, 8225, 8227, 8234, 8236, 8237, 8239, 8240, 8241, 8244, 8245, 8250, 8252, 8253, 8265, 8266, 8268, 8269, 8270, 8272, 8275, 8282, 8288, 8289, 8291, 8293, 8294, 8297, 8300, 8301, 8304, 8305, 8306, 8310, 8311, 8312, 8318, 8319, 8320, 8321, 8329, 8334, 8335, 8336, 8339, 8340, 8343, 8349, 8350, 8351, 8352, 8353, 8354, 8355, 8361, 8367, 8368, 8373, 8376, 8378, 8379, 8384, 8385, 8387, 8389, 8392, 8393, 8395, 8398, 8401, 8402, 8403, 8404, 8405, 8410, 8413, 8414, 8416, 8417, 8418, 8423, 8428, 8429, 8433, 8435, 8436, 8438, 8439, 8441, 8442, 8444, 8446, 8447, 8448, 8449, 8450, 8451, 8452, 8457, 8458, 8459, 8466, 8471, 8472, 8473, 8474, 8476, 8477, 8478, 8480, 8481, 8482, 8485, 8486, 8490, 8493, 8498, 8501, 8502, 8503, 8504, 8505, 8511, 8513, 8515, 8517, 8521, 8523, 8524, 8525, 8528, 8531, 8532, 8533, 8539, 8542, 8544, 8549, 8550, 8552, 8553, 8554, 8557, 8561, 8562, 8563, 8565, 8566, 8568, 8574, 8576, 8581, 8582, 8583, 8588, 8589, 8590, 8593, 8594, 8596, 8597, 8599, 8600, 8601, 8602, 8603, 8605, 8611, 8612, 8614, 8617, 8618, 8624, 8631, 8634, 8638, 8639, 8640, 8642, 8644, 8648, 8654, 8657, 8658, 8659, 8663, 8665, 8669, 8672, 8685, 8693, 8699, 8700, 8703, 8706, 8708, 8709, 8713, 8714, 8715, 8716, 8717, 8719, 8720, 8721, 8722, 8729, 8731, 8732, 8734, 8735, 8736, 8741, 8742, 8744, 8746, 8748, 8752, 8757, 8767, 8769, 8770, 8772, 8773, 8775, 8776, 8777, 8779, 8782, 8783, 8784, 8785, 8789, 8792, 8797, 8803, 8804, 8805, 8808, 8810, 8818, 8822, 8824, 8831, 8832, 8833, 8834, 8835, 8838, 8841, 8842, 8843, 8846, 8847, 8853, 8861, 8862, 8867, 8869, 8876, 8878, 8881, 8883, 8886, 8888, 8889, 8892, 8897, 8899, 8900, 8901, 8902, 8905, 8907, 8908, 8909, 8910, 8911, 8913, 8914, 8916, 8917, 8926, 8928, 8929, 8935, 8938, 8940, 8941, 8942, 8945, 8946, 8949, 8951, 8954, 8957, 8960, 8961, 8962, 8967, 8968, 8969, 8972, 8974, 8976, 8977, 8979, 8980, 8981, 8985, 8986, 8992, 8996, 8998, 8999, 9001, 9002, 9003, 9006, 9009, 9012, 9013, 9015, 9016, 9020, 9022, 9025, 9029, 9030, 9033, 9037, 9042, 9044, 9052, 9057, 9058, 9059, 9060, 9061, 9066, 9069, 9071, 9073, 9074, 9076, 9084, 9088, 9091, 9092, 9095, 9096, 9097, 9105, 9108, 9110, 9112, 9114, 9115, 9116, 9118, 9119, 9123, 9125, 9129, 9131, 9133, 9134, 9136, 9138, 9139, 9140, 9141, 9142, 9146, 9149, 9151, 9152, 9154, 9159, 9172, 9173, 9174, 9175, 9177, 9179, 9181, 9183, 9185, 9187, 9188, 9190, 9191, 9195, 9200, 9206, 9207, 9210, 9211, 9213, 9215, 9216, 9217, 9218, 9221, 9223, 9226, 9229, 9233, 9234, 9237, 9241, 9243, 9247, 9248, 9249, 9252, 9253, 9255, 9257, 9265, 9267, 9269, 9270, 9273, 9276, 9278, 9282, 9283, 9284, 9285, 9288, 9289, 9290, 9291, 9292, 9293, 9299, 9302, 9304, 9308, 9311, 9320, 9323, 9325, 9326, 9327, 9328, 9329, 9330, 9336, 9337, 9338, 9339, 9340, 9341, 9345, 9346, 9347, 9348, 9349, 9353, 9354, 9355, 9359, 9361, 9366, 9367, 9373, 9375, 9376, 9378, 9382, 9383, 9388, 9389, 9391, 9392, 9393, 9394, 9396, 9400, 9402, 9403, 9404, 9406, 9407, 9413, 9415, 9419, 9422, 9423, 9432, 9433, 9439, 9440, 9442, 9444, 9451, 9452, 9453, 9456, 9460, 9468, 9471, 9472, 9473, 9478, 9483, 9487, 9488, 9490, 9494, 9495, 9497, 9500, 9501, 9502, 9503, 9504, 9505, 9509, 9513, 9514, 9515, 9517, 9518, 9519, 9520, 9521, 9522, 9525, 9531, 9533, 9534, 9536, 9540, 9543, 9545, 9546, 9548, 9549, 9553, 9555, 9560, 9563, 9564, 9565, 9567, 9568, 9571, 9575, 9577, 9582, 9583, 9587, 9589, 9590, 9591, 9592, 9602, 9606, 9607, 9608, 9609, 9610, 9613, 9615, 9617, 9620, 9623, 9626, 9627, 9628, 9629, 9630, 9633, 9635, 9637, 9640, 9641, 9642, 9644, 9645, 9646, 9648, 9653, 9656, 9657, 9658, 9659, 9660, 9663, 9668, 9670, 9681, 9682, 9686, 9692, 9695, 9696, 9698, 9708, 9717, 9718, 9723, 9726, 9727, 9730, 9731, 9732, 9733, 9734, 9737, 9738, 9746, 9750, 9751, 9753, 9754, 9756, 9762, 9763, 9764, 9767, 9768, 9770, 9772, 9776, 9777, 9780, 9781, 9782, 9784, 9786, 9792, 9794, 9799, 9801, 9808, 9809, 9813, 9816, 9819, 9820, 9825, 9827, 9833, 9835, 9836, 9838, 9845, 9846, 9847, 9849, 9853, 9854, 9861, 9864, 9866, 9869, 9873, 9875, 9882, 9886, 9888, 9892, 9893, 9894, 9897, 9898, 9900, 9901, 9906, 9907, 9908, 9909, 9910, 9911, 9912, 9918, 9923, 9928, 9938, 9940, 9944, 9946, 9947, 9950, 9953, 9955, 9960, 9962, 9967, 9971, 9972, 9974, 9976, 9979, 9980, 9982, 9984, 9985, 9988, 9990, 9997, 9998, 10000, 10007, 10008, 10009, 10010, 10012, 10017, 10018, 10019, 10021, 10022, 10026, 10033, 10035, 10037, 10038, 10041, 10045, 10047, 10048, 10049, 10050, 10051, 10052, 10054, 10056, 10058, 10059, 10060, 10062, 10063, 10064, 10068, 10076, 10077, 10078, 10080, 10081, 10082, 10083, 10086, 10087, 10089, 10090, 10091, 10092, 10095, 10097, 10098, 10101, 10102, 10103, 10105, 10106, 10107, 10108, 10109, 10110, 10112, 10114, 10115, 10118, 10122, 10127, 10128, 10131, 10132, 10134, 10135, 10138, 10143, 10146, 10149, 10151, 10152, 10158, 10163, 10165, 10166, 10168, 10169, 10170, 10174, 10176, 10178, 10179, 10181, 10182, 10191, 10192, 10193, 10194, 10195, 10197, 10199, 10203, 10206, 10207, 10209, 10213, 10214, 10218, 10219, 10220, 10222, 10223, 10224, 10225, 10228, 10230, 10233, 10236, 10237, 10240, 10247, 10252, 10255, 10259, 10260, 10273, 10275, 10278, 10284, 10286, 10291, 10293, 10295, 10296, 10297, 10300, 10302, 10306, 10307, 10311, 10318, 10321, 10322, 10323, 10325, 10326, 10328, 10329, 10330, 10331, 10333, 10334, 10335, 10336, 10342, 10343, 10344, 10345, 10346, 10353, 10356, 10357, 10359, 10360, 10362, 10364, 10365, 10368, 10373, 10375, 10380, 10381, 10382, 10384, 10385, 10392, 10397, 10398, 10399, 10401, 10405, 10410, 10411, 10413, 10414, 10416, 10421, 10422, 10425, 10427, 10428, 10429, 10430, 10435, 10437, 10438, 10447, 10448, 10449, 10450, 10451, 10452, 10453, 10455, 10456, 10463, 10464, 10465, 10468, 10469, 10470, 10472, 10473, 10474, 10488, 10492, 10494, 10496, 10498, 10501, 10504, 10508, 10513, 10514, 10518, 10521, 10525, 10527, 10528, 10531, 10533, 10535, 10536, 10537, 10541, 10542, 10543, 10544, 10547, 10548, 10549, 10550, 10551, 10555, 10556, 10558, 10561, 10562, 10563, 10565, 10567, 10569, 10571, 10573, 10577, 10580, 10581, 10582, 10583, 10584, 10585, 10590, 10593, 10596, 10597, 10599, 10601, 10602, 10605, 10610, 10611, 10615, 10616, 10617, 10621, 10622, 10623, 10626, 10628, 10629, 10630, 10631, 10633, 10637, 10638, 10639, 10643, 10645, 10646, 10648, 10649, 10650, 10655, 10657, 10660, 10663, 10664, 10665, 10668, 10669, 10670, 10671, 10673, 10674, 10678, 10681, 10682, 10683, 10684, 10685, 10686, 10687, 10689, 10693, 10697, 10698, 10699, 10700, 10702, 10703, 10705, 10707, 10711, 10712, 10715, 10716, 10718, 10722, 10725, 10726, 10732, 10735, 10736, 10738, 10740, 10744, 10747, 10748, 10749, 10752, 10753, 10754, 10756, 10761, 10762, 10763, 10766, 10771, 10774, 10775, 10777, 10778, 10779, 10780, 10782, 10784, 10787, 10788, 10790, 10791, 10792, 10795, 10796, 10801, 10802, 10803, 10804, 10805, 10809, 10810, 10811, 10813, 10815, 10818, 10819, 10820, 10821, 10823, 10824, 10825, 10826, 10830, 10833, 10836, 10838, 10839, 10840, 10841, 10843, 10850, 10853, 10854, 10857, 10858, 10860, 10862, 10863, 10867, 10869, 10872, 10874, 10877, 10878, 10880, 10881, 10887, 10892, 10896, 10897, 10898, 10899, 10902, 10903, 10905, 10912, 10917, 10920, 10926, 10927, 10930, 10933, 10934, 10935, 10936, 10937, 10938, 10940, 10941, 10947, 10948, 10950, 10954, 10957, 10960, 10961, 10962, 10965, 10967, 10972, 10976, 10977, 10980, 10988, 10993, 10995, 10996, 10997, 10999, 11002, 11004, 11005, 11006, 11008, 11010, 11015, 11018, 11023, 11025, 11027, 11032, 11033, 11039, 11046, 11047, 11049, 11053, 11056, 11058, 11060, 11066, 11070, 11072, 11078, 11079, 11080, 11082, 11083, 11086, 11090, 11092, 11095, 11098, 11101, 11102, 11107, 11108, 11109, 11110, 11114, 11116, 11117, 11118, 11119, 11123, 11124, 11125, 11127, 11128, 11129, 11132, 11133, 11135, 11137, 11138, 11145, 11146, 11148, 11150, 11151, 11152, 11153, 11154, 11158, 11159, 11160, 11161, 11162, 11163, 11166, 11169, 11172, 11173, 11175, 11177, 11179, 11180, 11184, 11185, 11187, 11188, 11190, 11191, 11192, 11194, 11198, 11199, 11201, 11202, 11207, 11210, 11211, 11214, 11217, 11218, 11222, 11226, 11227, 11228, 11229, 11230, 11232, 11233, 11234, 11235, 11236, 11237, 11239, 11244, 11246, 11247, 11248, 11251, 11254, 11255, 11256, 11257, 11258, 11259, 11260, 11261, 11262, 11263, 11264, 11266, 11274, 11275, 11278, 11282, 11289, 11290, 11291, 11292, 11293, 11294, 11295, 11298, 11306, 11307, 11313, 11315, 11316, 11318, 11319, 11320, 11322, 11324, 11326, 11328, 11329, 11330, 11331, 11332, 11333, 11337, 11338, 11339, 11340, 11345, 11346, 11348, 11349, 11352, 11356, 11358, 11363, 11365, 11366, 11369, 11370, 11371, 11373, 11374, 11377, 11380, 11381, 11382, 11385, 11387, 11388, 11391, 11392, 11394, 11395, 11397, 11398, 11401, 11403, 11404, 11405, 11406, 11408, 11409, 11411, 11412, 11413, 11414, 11416, 11418, 11423, 11428, 11430, 11431, 11433, 11434, 11437, 11438, 11446, 11448, 11449, 11451, 11459, 11463, 11465, 11471, 11472, 11473, 11476, 11478, 11481, 11482, 11487, 11490, 11492, 11494, 11496, 11497, 11498, 11499, 11500, 11503, 11506, 11507, 11508, 11509, 11512, 11518, 11522, 11523, 11524, 11526, 11528, 11530, 11533, 11534, 11538, 11541, 11544, 11546, 11548, 11550, 11551, 11553, 11558, 11560, 11561, 11567, 11568, 11570, 11576, 11577, 11578, 11579, 11580, 11585, 11588, 11589, 11593, 11594, 11595, 11596, 11597, 11599, 11603, 11604, 11607, 11612, 11615, 11618, 11620, 11621, 11623, 11624, 11625, 11627, 11629, 11632, 11633, 11636, 11639, 11642, 11644, 11649, 11650, 11652, 11654, 11655, 11656, 11657, 11658, 11663, 11667, 11668, 11669, 11673, 11678, 11681, 11683, 11685, 11688, 11691, 11692, 11693, 11694, 11695, 11698, 11699, 11701, 11703, 11705, 11707, 11710, 11711, 11712, 11718, 11720, 11721, 11725, 11730, 11731, 11733, 11736, 11740, 11743, 11744, 11753, 11755, 11759, 11760, 11761, 11762, 11763, 11764, 11765, 11766, 11767, 11770, 11771, 11774, 11776, 11781, 11782, 11783, 11784, 11785, 11786, 11790, 11792, 11799, 11800, 11809, 11811, 11812, 11813, 11816, 11818, 11819, 11821, 11822, 11826, 11828, 11830, 11836, 11837, 11839, 11841, 11846, 11847, 11849, 11850, 11851, 11853, 11856, 11858, 11861, 11863, 11868, 11870, 11872, 11876, 11877, 11878, 11881, 11889, 11890, 11891, 11894, 11895, 11898, 11899, 11904, 11909, 11911, 11913, 11916, 11917, 11918, 11919, 11920, 11921, 11922, 11923, 11926, 11927, 11928, 11929, 11930, 11934, 11935, 11940, 11941, 11943, 11946, 11947, 11948, 11949, 11953, 11955, 11957, 11958, 11959, 11960, 11961, 11962, 11963, 11965, 11968, 11975, 11977, 11978, 11980, 11983, 11988, 11993, 11994, 11995, 11996, 11997, 11998, 11999, 12004, 12005, 12006, 12014, 12015, 12017, 12018, 12019, 12020, 12021, 12023, 12024, 12025, 12029, 12032, 12042, 12043, 12044, 12050, 12059, 12060, 12061, 12063, 12068, 12073, 12078, 12079, 12080, 12081, 12083, 12085, 12091, 12092, 12093, 12097, 12098, 12102, 12104, 12106, 12109, 12112, 12114, 12115, 12118, 12120, 12122, 12127, 12128, 12129, 12131, 12134, 12135, 12137, 12138, 12143, 12144, 12145, 12146, 12147, 12148, 12150, 12151, 12155, 12164, 12165, 12166, 12167, 12171, 12174, 12175, 12179, 12181, 12191, 12192, 12197, 12198, 12200, 12201, 12202, 12204, 12208, 12212, 12214, 12215, 12217, 12223, 12228, 12229, 12233, 12234, 12241, 12243, 12245, 12249, 12250, 12252, 12255, 12256, 12259, 12268, 12271, 12278, 12280, 12283, 12285, 12286, 12287, 12295, 12296, 12302, 12304, 12305, 12306, 12310, 12311, 12312, 12313, 12314, 12315, 12317, 12319, 12321, 12323, 12325, 12328, 12331, 12333, 12334, 12337, 12339, 12340, 12342, 12343, 12344, 12345, 12347, 12350, 12354, 12356, 12359, 12364, 12366, 12368, 12370, 12374, 12375, 12376, 12379, 12380, 12381, 12383, 12390, 12394, 12397, 12399, 12400, 12401, 12402, 12403, 12404, 12406, 12410, 12411, 12414, 12415, 12416, 12418, 12419, 12420, 12423, 12424, 12426, 12427, 12428, 12429, 12437, 12439, 12440, 12444, 12450, 12451, 12454, 12456, 12457, 12459, 12462, 12465, 12467, 12468, 12470, 12472, 12473, 12476, 12478, 12481, 12482, 12483, 12487, 12488, 12489, 12492, 12497, 12499, 12501, 12502, 12503, 12508, 12512, 12513, 12514, 12515, 12518, 12519, 12525, 12527, 12529, 12530, 12531, 12535, 12536, 12537, 12538, 12539, 12546, 12547, 12551, 12552, 12554, 12555, 12556, 12562, 12563, 12565, 12567, 12568, 12572, 12577, 12578, 12580, 12583, 12584, 12585, 12586, 12588, 12591, 12592, 12593, 12594, 12600, 12603, 12605, 12608, 12609, 12610, 12611, 12614, 12620, 12622, 12623, 12626, 12628, 12629, 12633, 12634, 12638, 12639, 12640, 12641, 12644, 12645, 12648, 12649, 12651, 12663, 12664, 12668, 12670, 12671, 12674, 12679, 12682, 12683, 12684, 12688, 12689, 12691, 12693, 12695, 12696, 12699, 12701, 12702, 12705, 12706, 12707, 12713, 12714, 12715, 12721, 12723, 12728, 12729, 12731, 12732, 12733, 12735, 12738, 12739, 12740, 12741, 12742, 12743, 12744, 12752, 12753, 12754, 12755, 12758, 12760, 12761, 12763, 12764, 12765, 12766, 12771, 12775, 12777, 12782, 12783, 12790, 12797, 12800, 12802, 12804, 12807, 12810, 12812, 12813, 12817, 12818, 12820, 12822, 12823, 12824, 12826, 12827, 12828, 12835, 12836, 12837, 12838, 12839, 12844, 12848, 12849, 12850, 12852, 12853, 12861, 12866, 12870, 12873, 12875, 12878, 12884, 12887, 12891, 12898, 12899, 12900, 12901, 12902, 12903, 12904, 12905, 12906, 12908, 12910, 12912, 12913, 12916, 12920, 12921, 12928, 12929, 12931, 12932, 12933, 12934, 12935, 12938, 12939, 12942, 12946, 12947, 12950, 12952, 12953, 12960, 12961, 12963, 12967, 12968, 12969, 12972, 12983, 12986, 12987, 12990, 12991, 12999, 13003, 13004, 13007, 13010, 13014, 13015, 13017, 13022, 13023, 13024, 13027, 13030, 13031, 13032, 13034, 13035, 13036, 13037, 13040, 13041, 13044, 13047, 13049, 13050, 13053, 13054, 13055, 13056, 13061, 13063, 13064, 13066, 13067, 13069, 13070, 13071, 13075, 13077, 13079, 13083, 13085, 13086, 13087, 13097, 13099, 13101, 13102, 13105, 13106, 13109, 13110, 13111, 13112, 13114, 13116, 13117, 13118, 13120, 13121, 13122, 13123, 13124, 13125, 13127, 13128, 13131, 13134, 13136, 13147, 13148, 13149, 13151, 13154, 13155, 13156, 13159, 13167, 13169, 13175, 13181, 13182, 13186, 13187, 13197, 13198, 13199, 13206, 13209, 13210, 13212, 13213, 13217, 13221, 13224, 13226, 13228, 13229, 13231, 13232, 13233, 13234, 13235, 13236, 13237, 13239, 13241, 13243, 13248, 13255, 13258, 13260, 13261, 13262, 13263, 13264, 13265, 13267, 13268, 13269, 13271, 13273, 13274, 13281, 13285, 13293, 13295, 13296, 13297, 13298, 13300, 13301, 13303, 13304, 13315, 13316, 13317, 13326, 13328, 13329, 13330, 13332, 13338, 13340, 13343, 13344, 13345, 13346, 13347, 13348, 13349, 13350, 13352, 13353, 13358, 13363, 13367, 13368, 13369, 13370, 13377, 13380, 13381, 13385, 13386, 13387, 13388, 13391, 13393, 13394, 13396, 13397, 13398, 13401, 13403, 13407, 13408, 13410, 13414, 13416, 13417, 13419, 13423, 13424, 13429, 13430, 13431, 13433, 13439, 13441, 13446, 13448, 13450, 13456, 13460, 13461, 13463, 13467, 13469, 13470, 13473, 13474, 13475, 13477, 13478, 13480, 13492, 13494, 13499, 13503, 13510, 13515, 13519, 13521, 13522, 13526, 13532, 13533, 13535, 13536, 13539, 13540, 13543, 13544, 13546, 13547, 13549, 13552, 13553, 13555, 13556, 13558, 13559, 13560, 13561, 13562, 13565, 13566, 13568, 13569, 13572, 13574, 13577, 13578, 13579, 13580, 13582, 13584, 13587, 13596, 13597, 13599, 13600, 13601, 13602, 13604, 13605, 13606, 13607, 13612, 13613, 13621, 13627, 13628, 13629, 13630, 13631, 13632, 13634, 13636, 13637, 13641, 13643, 13647, 13650, 13653, 13660, 13662, 13663, 13665, 13669, 13675, 13677, 13678, 13679, 13683, 13687, 13688, 13689, 13693, 13697, 13698, 13699, 13700, 13702, 13706, 13710, 13712, 13713, 13714, 13715, 13716, 13719, 13720, 13729, 13730, 13734, 13736, 13737, 13738, 13739, 13742, 13745, 13747, 13749, 13750, 13753, 13756, 13764, 13767, 13769, 13772, 13773, 13775, 13777, 13779, 13782, 13783, 13785, 13786, 13787, 13791, 13793, 13795, 13796, 13798, 13799, 13809, 13816, 13817, 13818, 13819, 13822, 13823, 13828, 13830, 13834, 13835, 13843, 13849, 13852, 13856, 13858, 13859, 13860, 13862, 13866, 13869, 13870, 13872, 13873, 13877, 13887, 13891, 13892, 13895, 13897, 13898, 13899, 13901, 13906, 13907, 13908, 13909, 13910, 13911, 13917, 13918, 13919, 13921, 13923, 13924, 13925, 13927, 13929, 13934, 13942, 13943, 13944, 13947, 13948, 13949, 13950, 13953, 13954, 13957, 13958, 13960, 13962, 13963, 13969, 13970, 13975, 13976, 13984, 13988, 13990, 13994, 13999, 14000, 14001, 14002, 14003, 14005, 14006, 14008, 14013, 14016, 14017, 14018, 14022, 14027, 14030, 14031, 14036, 14038, 14043, 14052, 14059, 14062, 14063, 14066, 14067, 14069, 14070, 14071, 14073, 14075, 14078, 14081, 14083, 14084, 14085, 14086, 14088, 14091, 14092, 14094, 14095, 14096, 14097, 14102, 14106, 14110, 14111, 14112, 14115, 14116, 14118, 14121, 14122, 14124, 14129, 14130, 14132, 14133, 14138, 14139, 14142, 14145, 14146, 14147.

Promoters expressing in the flag leaf (top-most leaf) at the tasseling stage include SEQ IDs: 1, 3, 7, 11, 12, 13, 14, 15, 16, 17, 19, 20, 24, 27, 29, 31, 33, 34, 36, 37, 48, 51, 53, 54, 57, 61, 63, 64, 65, 76, 79, 80, 88, 90, 93, 94, 95, 96, 98, 99, 102, 103, 104, 110, 111, 112, 115, 117, 123, 129, 130, 131, 133, 136, 141, 143, 144, 146, 148, 152, 154, 155, 156, 157, 159, 160, 162, 165, 168, 172, 174, 175, 176, 179, 180, 181, 183, 187, 191, 193, 194, 196, 199, 203, 205, 207, 211, 212, 214, 228, 230, 232, 233, 236, 237, 239, 240, 242, 244, 246, 249, 250, 251, 257, 259, 267, 269, 270, 271, 273, 280, 286, 288, 289, 293, 294, 298, 299, 301, 302, 305, 306, 307, 309, 316, 319, 320, 322, 328, 329, 332, 334, 335, 338, 342, 346, 348, 349, 354, 356, 357, 358, 364, 365, 371, 372, 373, 376, 378, 379, 381, 382, 388, 393, 396, 401, 406, 407, 411, 414, 418, 423, 427, 428, 431, 433, 434, 436, 441, 450, 452, 456, 459, 461, 463, 466, 470, 471, 474, 478, 483, 484, 485, 488, 489, 492, 496, 507, 509, 510, 511, 514, 516, 517, 520, 523, 525, 532, 537, 538, 541, 542, 544, 546, 547, 548, 554, 560, 561, 563, 578, 580, 585, 594, 595, 596, 599, 601, 602, 606, 608, 613, 619, 620, 630, 633, 635, 636, 637, 638, 643, 645, 647, 655, 656, 659, 661, 664, 666, 669, 671, 681, 683, 687, 692, 693, 694, 695, 701, 705, 706, 707, 708, 709, 716, 717, 718, 719, 721, 722, 723, 724, 727, 731, 732, 734, 735, 736, 739, 740, 741, 742, 744, 749, 753, 757, 759, 760, 761, 762, 763, 764, 765, 770, 779, 783, 784, 786, 792, 793, 794, 800, 804, 806, 807, 808, 809, 811, 819, 820, 821, 827, 829, 830, 833, 840, 846, 849, 855, 856, 857, 858, 860, 862, 863, 865, 868, 869, 870, 871, 876, 877, 878, 887, 889, 890, 891, 892, 893, 895, 897, 898, 899, 900, 903, 907, 908, 910, 911, 912, 913, 915, 916, 919, 920, 924, 925, 928, 929, 931, 932, 936, 939, 942, 943, 947, 951, 953, 955, 957, 958, 960, 964, 971, 974, 975, 976, 977, 978, 979, 980, 981, 982, 983, 984, 987, 989, 991, 994, 995, 996, 997, 999, 1002, 1005, 1007, 1008, 1009, 1010, 1011, 1012, 1013, 1014, 1016, 1017, 1022, 1025, 1026, 1032, 1033, 1035, 1038, 1039, 1040, 1041, 1042, 1043, 1045, 1046, 1047, 1049, 1051, 1052, 1055, 1056, 1057, 1064, 1065, 1068, 1069, 1070, 1073, 1077, 1085, 1086, 1087, 1089, 1091, 1092, 1095, 1100, 1101, 1103, 1104, 1106, 1110, 1112, 1114, 1115, 1116, 1117, 1119, 1121, 1125, 1130, 1132, 1136, 1137, 1140, 1143, 1144, 1146, 1148, 1155, 1156, 1160, 1161, 1165, 1167, 1168, 1170, 1171, 1176, 1178, 1183, 1187, 1189, 1191, 1196, 1198, 1201, 1204, 1205, 1214, 1217, 1218, 1220, 1222, 1223, 1225, 1228, 1231, 1232, 1233, 1234, 1235, 1236, 1239, 1240, 1241, 1243, 1244, 1248, 1249, 1251, 1253, 1254, 1257, 1258, 1259, 1263, 1269, 1272, 1277, 1281, 1285, 1286, 1290, 1292, 1296, 1301, 1303, 1306, 1307, 1309, 1310, 1311, 1312, 1314, 1316, 1317, 1320, 1322, 1323, 1327, 1329, 1331, 1334, 1343, 1345, 1346, 1347, 1349, 1354, 1355, 1356, 1360, 1361, 1366, 1367, 1368, 1371, 1373, 1375, 1377, 1380, 1381, 1386, 1387, 1388, 1389, 1392, 1393, 1394, 1396, 1399, 1404, 1405, 1406, 1412, 1420, 1421, 1422, 1423, 1426, 1431, 1432, 1433, 1438, 1439, 1440, 1441, 1442, 1447, 1448, 1451, 1453, 1458, 1459, 1461, 1466, 1467, 1468, 1471, 1475, 1484, 1488, 1490, 1491, 1493, 1499, 1501, 1503, 1506, 1508, 1510, 1511, 1512, 1514, 1517, 1518, 1520, 1525, 1526, 1527, 1528, 1530, 1534, 1539, 1540, 1543, 1545, 1547, 1548, 1549, 1550, 1551, 1553, 1554, 1555, 1556, 1560, 1561, 1564, 1567, 1570, 1571, 1575, 1578, 1579, 1582, 1584, 1585, 1586, 1590, 1596, 1597, 1598, 1599, 1600, 1601, 1602, 1604, 1605, 1608, 1609, 1610, 1612, 1614, 1615, 1616, 1617, 1622, 1623, 1625, 1634, 1635, 1637, 1638, 1639, 1641, 1643, 1651, 1653, 1654, 1658, 1659, 1662, 1663, 1664, 1669, 1671, 1673, 1675, 1677, 1678, 1681, 1682, 1684, 1687, 1688, 1690, 1691, 1696, 1697, 1698, 1699, 1705, 1706, 1707, 1708, 1710, 1716, 1717, 1720, 1725, 1732, 1735, 1736, 1745, 1749, 1750, 1755, 1759, 1761, 1764, 1769, 1770, 1773, 1774, 1776, 1777, 1785, 1786, 1796, 1798, 1807, 1809, 1811, 1813, 1814, 1823, 1826, 1828, 1830, 1832, 1834, 1837, 1838, 1839, 1840, 1845, 1848, 1850, 1852, 1856, 1859, 1861, 1863, 1866, 1868, 1869, 1872, 1873, 1876, 1878, 1879, 1880, 1882, 1886, 1888, 1891, 1897, 1900, 1901, 1902, 1905, 1906, 1910, 1911, 1912, 1915, 1916, 1918, 1920, 1922, 1923, 1924, 1927, 1933, 1934, 1939, 1940, 1945, 1950, 1951, 1952, 1954, 1956, 1958, 1968, 1969, 1970, 1971, 1972, 1973, 1976, 1977, 1990, 1991, 1993, 1999, 2000, 2003, 2007, 2010, 2012, 2014, 2015, 2016, 2017, 2019, 2020, 2021, 2023, 2026, 2027, 2032, 2033, 2034, 2037, 2040, 2041, 2043, 2045, 2048, 2058, 2060, 2062, 2064, 2066, 2071, 2072, 2074, 2077, 2078, 2088, 2089, 2091, 2092, 2093, 2094, 2096, 2097, 2099, 2103, 2106, 2111, 2112, 2113, 2115, 2122, 2123, 2125, 2126, 2130, 2133, 2137, 2139, 2142, 2143, 2146, 2147, 2150, 2151, 2153, 2156, 2157, 2161, 2164, 2166, 2167, 2168, 2170, 2172, 2173, 2175, 2177, 2179, 2180, 2183, 2185, 2189, 2190, 2193, 2195, 2196, 2200, 2201, 2202, 2203, 2205, 2206, 2210, 2213, 2215, 2218, 2220, 2221, 2222, 2226, 2227, 2237, 2240, 2242, 2245, 2252, 2253, 2257, 2259, 2261, 2263, 2266, 2271, 2278, 2280, 2282, 2284, 2289, 2297, 2298, 2303, 2305, 2306, 2308, 2309, 2310, 2313, 2314, 2321, 2322, 2323, 2325, 2328, 2329, 2331, 2333, 2337, 2339, 2342, 2343, 2346, 2352, 2353, 2354, 2363, 2366, 2367, 2369, 2371, 2379, 2381, 2382, 2384, 2396, 2397, 2398, 2401, 2405, 2410, 2411, 2413, 2414, 2418, 2419, 2420, 2423, 2426, 2428, 2430, 2431, 2432, 2433, 2434, 2435, 2437, 2439, 2440, 2441, 2442, 2443, 2445, 2449, 2452, 2453, 2454, 2457, 2458, 2469, 2470, 2472, 2474, 2476, 2479, 2480, 2481, 2482, 2483, 2485, 2487, 2489, 2490, 2491, 2495, 2496, 2497, 2498, 2500, 2504, 2505, 2506, 2507, 2509, 2513, 2516, 2517, 2521, 2522, 2525, 2526, 2528, 2529, 2531, 2532, 2533, 2538, 2539, 2541, 2543, 2544, 2546, 2549, 2551, 2552, 2557, 2560, 2567, 2568, 2570, 2571, 2573, 2578, 2579, 2581, 2587, 2588, 2589, 2590, 2596, 2597, 2599, 2600, 2601, 2608, 2609, 2611, 2612, 2613, 2614, 2616, 2617, 2619, 2620, 2625, 2626, 2627, 2632, 2634, 2635, 2636, 2639, 2644, 2645, 2651, 2652, 2653, 2654, 2656, 2658, 2659, 2660, 2670, 2672, 2674, 2679, 2680, 2684, 2685, 2690, 2691, 2692, 2694, 2700, 2704, 2707, 2708, 2709, 2711, 2719, 2720, 2721, 2722, 2723, 2726, 2728, 2729, 2730, 2735, 2737, 2738, 2739, 2740, 2745, 2746, 2747, 2749, 2752, 2756, 2757, 2758, 2759, 2760, 2762, 2764, 2765, 2770, 2785, 2786, 2787, 2794, 2798, 2800, 2801, 2802, 2805, 2808, 2814, 2819, 2821, 2822, 2823, 2824, 2826, 2827, 2828, 2831, 2838, 2840, 2843, 2844, 2845, 2850, 2857, 2859, 2860, 2862, 2864, 2865, 2869, 2870, 2871, 2876, 2878, 2879, 2885, 2888, 2889, 2890, 2892, 2893, 2894, 2895, 2896, 2897, 2901, 2902, 2903, 2906, 2908, 2909, 2915, 2916, 2917, 2918, 2922, 2923, 2926, 2930, 2931, 2935, 2938, 2941, 2942, 2943, 2946, 2948, 2955, 2959, 2960, 2963, 2966, 2968, 2969, 2976, 2979, 2982, 2992, 2994, 3000, 3003, 3005, 3007, 3008, 3009, 3013, 3015, 3017, 3018, 3020, 3023, 3024, 3029, 3031, 3039, 3041, 3042, 3043, 3044, 3045, 3047, 3048, 3050, 3051, 3053, 3055, 3061, 3064, 3067, 3068, 3069, 3072, 3075, 3080, 3083, 3084, 3085, 3087, 3090, 3095, 3100, 3101, 3107, 3110, 3112, 3113, 3115, 3116, 3118, 3119, 3120, 3121, 3123, 3126, 3127, 3128, 3129, 3138, 3139, 3141, 3143, 3145, 3149, 3153, 3157, 3158, 3167, 3169, 3170, 3171, 3172, 3177, 3181, 3189, 3192, 3194, 3196, 3199, 3202, 3205, 3206, 3208, 3210, 3217, 3219, 3220, 3221, 3224, 3225, 3228, 3230, 3231, 3236, 3237, 3240, 3242, 3246, 3247, 3249, 3252, 3253, 3261, 3263, 3266, 3267, 3268, 3269, 3271, 3278, 3280, 3283, 3286, 3288, 3289, 3290, 3291, 3294, 3295, 3299, 3301, 3304, 3310, 3312, 3313, 3314, 3324, 3327, 3329, 3331, 3332, 3333, 3337, 3338, 3340, 3342, 3343, 3345, 3353, 3355, 3357, 3359, 3360, 3361, 3365, 3370, 3374, 3378, 3379, 3382, 3383, 3386, 3394, 3396, 3399, 3402, 3403, 3404, 3405, 3411, 3412, 3413, 3415, 3416, 3418, 3424, 3425, 3426, 3427, 3428, 3429, 3432, 3435, 3438, 3440, 3441, 3442, 3443, 3445, 3446, 3447, 3449, 3452, 3453, 3458, 3466, 3468, 3469, 3470, 3471, 3474, 3477, 3484, 3486, 3488, 3490, 3493, 3499, 3500, 3501, 3502, 3503, 3504, 3507, 3510, 3511, 3516, 3517, 3518, 3523, 3529, 3533, 3535, 3536, 3538, 3540, 3541, 3544, 3545, 3548, 3549, 3551, 3554, 3556, 3557, 3560, 3562, 3563, 3569, 3571, 3574, 3576, 3580, 3587, 3588, 3589, 3591, 3592, 3594, 3595, 3600, 3603, 3604, 3607, 3610, 3611, 3613, 3615, 3616, 3618, 3619, 3620, 3621, 3624, 3625, 3633, 3634, 3640, 3642, 3643, 3644, 3645, 3646, 3648, 3654, 3655, 3659, 3660, 3661, 3667, 3669, 3672, 3673, 3674, 3677, 3678, 3682, 3684, 3685, 3690, 3698, 3702, 3706, 3707, 3709, 3710, 3713, 3715, 3717, 3718, 3719, 3721, 3725, 3730, 3731, 3738, 3739, 3744, 3748, 3749, 3752, 3756, 3757, 3761, 3764, 3766, 3772, 3773, 3775, 3777, 3778, 3783, 3785, 3790, 3791, 3792, 3793, 3801, 3804, 3805, 3808, 3817, 3818, 3819, 3820, 3823, 3830, 3831, 3832, 3833, 3836, 3837, 3838, 3839, 3843, 3844, 3846, 3847, 3849, 3858, 3859, 3860, 3866, 3867, 3868, 3870, 3871, 3872, 3873, 3878, 3882, 3883, 3884, 3885, 3887, 3889, 3890, 3892, 3894, 3895, 3896, 3898, 3899, 3902, 3903, 3904, 3908, 3912, 3917, 3918, 3923, 3924, 3926, 3928, 3929, 3933, 3934, 3937, 3938, 3940, 3941, 3947, 3950, 3951, 3954, 3955, 3958, 3959, 3962, 3964, 3967, 3968, 3970, 3971, 3972, 3974, 3975, 3978, 3979, 3983, 3987, 3988, 3991, 3995, 3996, 3997, 4000, 4007, 4008, 4013, 4014, 4026, 4030, 4033, 4037, 4039, 4040, 4041, 4042, 4043, 4044, 4047, 4048, 4049, 4050, 4053, 4054, 4056, 4057, 4062, 4068, 4070, 4084, 4087, 4088, 4092, 4094, 4098, 4099, 4102, 4103, 4105, 4106, 4109, 4110, 4111, 4113, 4124, 4126, 4128, 4132, 4133, 4135, 4140, 4143, 4144, 4145, 4147, 4149, 4150, 4154, 4155, 4160, 4161, 4162, 4163, 4164, 4165, 4166, 4167, 4168, 4171, 4173, 4175, 4178, 4181, 4185, 4187, 4188, 4189, 4190, 4191, 4193, 4195, 4200, 4201, 4202, 4204, 4205, 4206, 4207, 4210, 4211, 4212, 4213, 4217, 4219, 4221, 4227, 4228, 4232, 4233, 4235, 4237, 4245, 4246, 4247, 4250, 4251, 4257, 4258, 4260, 4261, 4266, 4270, 4272, 4275, 4276, 4280, 4281, 4284, 4290, 4294, 4296, 4301, 4302, 4305, 4306, 4309, 4312, 4317, 4320, 4321, 4324, 4329, 4330, 4333, 4335, 4339, 4344, 4346, 4347, 4352, 4354, 4358, 4359, 4360, 4369, 4370, 4378, 4380, 4383, 4388, 4390, 4391, 4393, 4396, 4397, 4401, 4402, 4403, 4404, 4405, 4410, 4422, 4423, 4430, 4432, 4436, 4439, 4440, 4442, 4443, 4446, 4448, 4449, 4450, 4453, 4456, 4457, 4461, 4462, 4463, 4466, 4467, 4468, 4470, 4471, 4474, 4475, 4479, 4486, 4487, 4490, 4492, 4494, 4498, 4500, 4502, 4507, 4508, 4509, 4512, 4514, 4519, 4521, 4522, 4524, 4529, 4531, 4535, 4536, 4548, 4549, 4551, 4554, 4555, 4556, 4557, 4558, 4560, 4563, 4565, 4566, 4567, 4568, 4575, 4576, 4582, 4583, 4590, 4591, 4593, 4594, 4596, 4597, 4598, 4601, 4606, 4614, 4616, 4618, 4623, 4625, 4628, 4632, 4635, 4639, 4640, 4641, 4643, 4644, 4645, 4646, 4647, 4650, 4653, 4654, 4655, 4656, 4657, 4658, 4659, 4662, 4667, 4669, 4671, 4672, 4673, 4674, 4676, 4677, 4680, 4682, 4684, 4685, 4690, 4691, 4692, 4696, 4697, 4699, 4700, 4703, 4705, 4706, 4710, 4711, 4713, 4715, 4719, 4721, 4722, 4725, 4727, 4728, 4729, 4730, 4734, 4736, 4737, 4738, 4739, 4740, 4741, 4745, 4748, 4749, 4753, 4754, 4756, 4761, 4762, 4763, 4767, 4769, 4770, 4771, 4773, 4775, 4779, 4780, 4783, 4784, 4788, 4789, 4790, 4795, 4796, 4800, 4801, 4803, 4804, 4805, 4806, 4807, 4813, 4815, 4816, 4817, 4818, 4820, 4822, 4828, 4830, 4831, 4834, 4836, 4837, 4841, 4845, 4853, 4854, 4855, 4856, 4857, 4861, 4862, 4863, 4869, 4870, 4874, 4875, 4876, 4878, 4880, 4881, 4887, 4889, 4891, 4897, 4900, 4904, 4905, 4907, 4909, 4910, 4912, 4913, 4914, 4915, 4918, 4921, 4923, 4924, 4931, 4936, 4938, 4941, 4943, 4947, 4950, 4953, 4954, 4955, 4958, 4959, 4967, 4969, 4971, 4972, 4974, 4975, 4981, 4984, 4988, 4989, 4990, 4991, 4993, 4994, 4996, 5005, 5007, 5011, 5015, 5016, 5021, 5022, 5023, 5024, 5026, 5029, 5030, 5037, 5038, 5039, 5040, 5042, 5044, 5045, 5046, 5049, 5052, 5054, 5057, 5060, 5061, 5065, 5067, 5068, 5072, 5074, 5078, 5082, 5084, 5088, 5089, 5090, 5091, 5094, 5099, 5100, 5101, 5102, 5106, 5111, 5113, 5114, 5116, 5120, 5122, 5123, 5125, 5129, 5131, 5132, 5136, 5137, 5140, 5143, 5144, 5145, 5146, 5147, 5150, 5151, 5157, 5159, 5160, 5164, 5165, 5168, 5170, 5174, 5175, 5177, 5178, 5180, 5181, 5182, 5185, 5187, 5188, 5189, 5190, 5191, 5192, 5193, 5198, 5200, 5202, 5206, 5209, 5212, 5213, 5216, 5217, 5218, 5219, 5224, 5225, 5229, 5230, 5234, 5240, 5241, 5243, 5251, 5253, 5254, 5255, 5256, 5257, 5258, 5260, 5261, 5263, 5268, 5269, 5273, 5275, 5276, 5280, 5281, 5283, 5286, 5287, 5293, 5297, 5298, 5299, 5300, 5301, 5308, 5311, 5314, 5317, 5324, 5329, 5330, 5332, 5333, 5334, 5339, 5342, 5345, 5346, 5348, 5349, 5350, 5351, 5352, 5356, 5361, 5366, 5367, 5371, 5379, 5386, 5388, 5389, 5391, 5393, 5395, 5396, 5402, 5405, 5411, 5414, 5416, 5417, 5418, 5422, 5427, 5428, 5431, 5432, 5434, 5437, 5438, 5445, 5446, 5448, 5449, 5452, 5453, 5456, 5458, 5459, 5461, 5462, 5475, 5476, 5481, 5483, 5485, 5487, 5488, 5491, 5493, 5495, 5496, 5497, 5502, 5503, 5505, 5506, 5508, 5510, 5512, 5513, 5515, 5517, 5518, 5519, 5524, 5526, 5529, 5530, 5531, 5532, 5535, 5543, 5545, 5549, 5554, 5558, 5559, 5562, 5563, 5564, 5566, 5568, 5569, 5572, 5575, 5579, 5581, 5582, 5584, 5585, 5586, 5589, 5593, 5594, 5596, 5597, 5602, 5608, 5612, 5613, 5614, 5616, 5619, 5620, 5621, 5627, 5633, 5635, 5638, 5640, 5643, 5647, 5648, 5649, 5650, 5651, 5653, 5657, 5659, 5660, 5663, 5664, 5667, 5670, 5671, 5677, 5680, 5689, 5690, 5694, 5695, 5697, 5698, 5700, 5702, 5703, 5706, 5709, 5711, 5712, 5713, 5717, 5718, 5719, 5721, 5722, 5723, 5727, 5729, 5730, 5731, 5732, 5734, 5735, 5736, 5742, 5744, 5751, 5764, 5768, 5770, 5773, 5775, 5778, 5780, 5783, 5784, 5785, 5791, 5792, 5794, 5807, 5808, 5810, 5811, 5817, 5819, 5820, 5824, 5825, 5828, 5833, 5834, 5835, 5836, 5837, 5839, 5842, 5852, 5854, 5856, 5858, 5859, 5861, 5864, 5866, 5867, 5868, 5869, 5871, 5872, 5878, 5879, 5881, 5882, 5883, 5884, 5888, 5889, 5892, 5893, 5900, 5901, 5902, 5905, 5910, 5912, 5918, 5919, 5921, 5925, 5926, 5927, 5930, 5931, 5932, 5933, 5938, 5941, 5942, 5943, 5944, 5945, 5946, 5948, 5950, 5951, 5954, 5955, 5956, 5957, 5959, 5961, 5968, 5971, 5978, 5979, 5980, 5984, 5985, 5986, 5988, 5990, 5991, 5992, 5994, 5996, 5997, 6000, 6002, 6003, 6004, 6006, 6007, 6008, 6012, 6013, 6016, 6020, 6021, 6023, 6025, 6026, 6028, 6031, 6038, 6040, 6041, 6044, 6047, 6048, 6051, 6054, 6058, 6059, 6060, 6061, 6062, 6063, 6068, 6069, 6070, 6072, 6073, 6074, 6075, 6077, 6080, 6082, 6085, 6088, 6089, 6090, 6091, 6092, 6093, 6094, 6095, 6096, 6098, 6108, 6109, 6110, 6112, 6113, 6116, 6118, 6119, 6122, 6125, 6129, 6130, 6132, 6133, 6135, 6136, 6137, 6143, 6145, 6146, 6147, 6149, 6151, 6152, 6153, 6155, 6156, 6158, 6163, 6164, 6165, 6168, 6171, 6173, 6178, 6180, 6181, 6182, 6183, 6186, 6188, 6189, 6190, 6191, 6193, 6197, 6198, 6200, 6203, 6205, 6206, 6207, 6209, 6212, 6213, 6220, 6221, 6223, 6224, 6226, 6227, 6228, 6230, 6231, 6237, 6238, 6240, 6243, 6245, 6246, 6247, 6249, 6250, 6251, 6255, 6257, 6258, 6259, 6260, 6264, 6265, 6269, 6270, 6271, 6272, 6273, 6278, 6279, 6280, 6282, 6286, 6288, 6289, 6291, 6292, 6294, 6296, 6299, 6300, 6302, 6303, 6306, 6309, 6310, 6311, 6315, 6317, 6319, 6321, 6322, 6326, 6328, 6330, 6333, 6338, 6339, 6345, 6346, 6351, 6352, 6353, 6354, 6356, 6358, 6359, 6360, 6362, 6363, 6364, 6365, 6367, 6370, 6375, 6378, 6379, 6381, 6387, 6394, 6396, 6397, 6398, 6399, 6403, 6404, 6405, 6407, 6412, 6414, 6415, 6419, 6420, 6422, 6426, 6429, 6430, 6431, 6434, 6436, 6437, 6440, 6448, 6450, 6452, 6454, 6458, 6459, 6463, 6464, 6466, 6467, 6468, 6469, 6470, 6471, 6474, 6477, 6478, 6480, 6481, 6482, 6484, 6486, 6488, 6495, 6497, 6499, 6500, 6501, 6502, 6504, 6505, 6506, 6514, 6515, 6517, 6519, 6523, 6524, 6525, 6530, 6534, 6537, 6543, 6544, 6547, 6548, 6549, 6554, 6560, 6561, 6563, 6564, 6572, 6574, 6576, 6579, 6581, 6582, 6584, 6587, 6595, 6596, 6597, 6599, 6605, 6607, 6610, 6611, 6614, 6620, 6624, 6626, 6627, 6628, 6629, 6630, 6634, 6635, 6637, 6638, 6639, 6643, 6644, 6646, 6647, 6648, 6649, 6650, 6652, 6654, 6655, 6656, 6662, 6666, 6672, 6676, 6681, 6682, 6686, 6691, 6692, 6695, 6696, 6703, 6705, 6706, 6711, 6714, 6716, 6718, 6720, 6724, 6725, 6729, 6730, 6731, 6733, 6734, 6736, 6742, 6746, 6747, 6753, 6756, 6757, 6759, 6761, 6766, 6778, 6779, 6780, 6782, 6786, 6787, 6788, 6791, 6793, 6794, 6797, 6799, 6803, 6804, 6805, 6807, 6810, 6811, 6812, 6813, 6816, 6817, 6819, 6820, 6821, 6824, 6827, 6828, 6831, 6834, 6839, 6840, 6841, 6842, 6843, 6845, 6847, 6850, 6851, 6852, 6859, 6864, 6867, 6869, 6872, 6874, 6875, 6876, 6877, 6878, 6879, 6880, 6886, 6888, 6890, 6895, 6897, 6903, 6906, 6909, 6913, 6914, 6915, 6917, 6919, 6921, 6922, 6923, 6924, 6925, 6930, 6933, 6935, 6936, 6941, 6944, 6946, 6948, 6950, 6951, 6952, 6954, 6959, 6960, 6961, 6969, 6971, 6979, 6980, 6984, 6985, 6987, 6990, 6991, 6994, 6999, 7002, 7003, 7005, 7006, 7009, 7013, 7015, 7016, 7019, 7020, 7022, 7025, 7032, 7038, 7039, 7042, 7043, 7045, 7051, 7052, 7053, 7056, 7057, 7064, 7067, 7072, 7075, 7077, 7079, 7083, 7085, 7086, 7094, 7097, 7105, 7107, 7108, 7112, 7113, 7116, 7117, 7118, 7124, 7126, 7129, 7130, 7132, 7134, 7138, 7139, 7140, 7142, 7144, 7149, 7151, 7155, 7163, 7164, 7169, 7170, 7171, 7176, 7177, 7182, 7184, 7187, 7188, 7192, 7194, 7195, 7197, 7201, 7202, 7203, 7206, 7207, 7209, 7211, 7213, 7214, 7215, 7216, 7219, 7220, 7221, 7227, 7228, 7232, 7233, 7234, 7236, 7239, 7243, 7244, 7245, 7248, 7252, 7255, 7257, 7258, 7259, 7262, 7267, 7268, 7270, 7274, 7277, 7281, 7282, 7284, 7287, 7288, 7290, 7291, 7292, 7293, 7298, 7299, 7300, 7301, 7304, 7305, 7307, 7308, 7310, 7313, 7315, 7317, 7321, 7328, 7330, 7331, 7334, 7336, 7338, 7340, 7343, 7344, 7350, 7351, 7353, 7354, 7355, 7356, 7357, 7358, 7361, 7363, 7365, 7371, 7373, 7375, 7379, 7380, 7383, 7388, 7389, 7392, 7395, 7396, 7398, 7399, 7400, 7401, 7409, 7411, 7415, 7417, 7425, 7428, 7430, 7433, 7434, 7435, 7436, 7443, 7444, 7446, 7447, 7448, 7452, 7453, 7454, 7458, 7459, 7465, 7466, 7470, 7479, 7486, 7490, 7492, 7502, 7504, 7505, 7506, 7512, 7515, 7517, 7523, 7524, 7525, 7528, 7533, 7537, 7538, 7544, 7546, 7547, 7549, 7556, 7557, 7561, 7570, 7574, 7578, 7580, 7585, 7586, 7589, 7591, 7594, 7595, 7596, 7601, 7605, 7611, 7613, 7619, 7620, 7621, 7623, 7624, 7632, 7633, 7634, 7638, 7639, 7642, 7643, 7652, 7653, 7661, 7663, 7665, 7666, 7667, 7672, 7674, 7677, 7678, 7679, 7680, 7682, 7684, 7685, 7689, 7692, 7695, 7697, 7699, 7700, 7703, 7704, 7708, 7712, 7713, 7716, 7717, 7719, 7724, 7725, 7729, 7733, 7736, 7737, 7738, 7740, 7744, 7745, 7747, 7750, 7751, 7754, 7755, 7761, 7762, 7763, 7764, 7768, 7769, 7770, 7774, 7775, 7777, 7778, 7779, 7781, 7782, 7786, 7791, 7793, 7794, 7796, 7798, 7803, 7804, 7807, 7812, 7815, 7820, 7824, 7825, 7833, 7834, 7838, 7840, 7841, 7844, 7847, 7849, 7854, 7856, 7859, 7860, 7862, 7863, 7865, 7873, 7875, 7876, 7878, 7881, 7888, 7890, 7896, 7900, 7901, 7907, 7908, 7910, 7911, 7918, 7923, 7925, 7929, 7933, 7934, 7935, 7936, 7938, 7942, 7943, 7944, 7945, 7947, 7948, 7949, 7950, 7953, 7955, 7956, 7962, 7965, 7966, 7967, 7971, 7972, 7974, 7976, 7977, 7978, 7979, 7980, 7982, 7983, 7984, 7986, 7988, 7989, 7990, 7991, 7993, 8000, 8002, 8004, 8005, 8006, 8007, 8012, 8021, 8026, 8029, 8036, 8038, 8041, 8042, 8043, 8044, 8045, 8047, 8048, 8049, 8052, 8053, 8056, 8058, 8059, 8062, 8063, 8065, 8066, 8067, 8068, 8069, 8070, 8072, 8075, 8076, 8077, 8078, 8080, 8082, 8083, 8084, 8087, 8088, 8093, 8095, 8097, 8099, 8100, 8103, 8105, 8106, 8109, 8112, 8114, 8116, 8118, 8121, 8124, 8125, 8126, 8136, 8137, 8145, 8146, 8150, 8151, 8159, 8163, 8164, 8165, 8169, 8170, 8174, 8176, 8178, 8182, 8189, 8191, 8192, 8193, 8195, 8196, 8199, 8202, 8204, 8207, 8208, 8211, 8213, 8216, 8219, 8220, 8222, 8225, 8227, 8237, 8239, 8240, 8241, 8244, 8245, 8249, 8250, 8252, 8253, 8266, 8269, 8270, 8272, 8274, 8275, 8282, 8288, 8289, 8291, 8293, 8294, 8296, 8297, 8300, 8301, 8304, 8305, 8306, 8310, 8311, 8312, 8318, 8319, 8320, 8321, 8322, 8325, 8329, 8330, 8334, 8335, 8336, 8339, 8340, 8343, 8349, 8350, 8351, 8352, 8353, 8354, 8355, 8361, 8363, 8367, 8368, 8373, 8378, 8379, 8385, 8386, 8387, 8389, 8392, 8393, 8395, 8398, 8401, 8402, 8403, 8404, 8410, 8411, 8412, 8413, 8414, 8416, 8417, 8418, 8423, 8428, 8429, 8433, 8435, 8436, 8438, 8439, 8441, 8442, 8444, 8446, 8447, 8448, 8450, 8451, 8456, 8457, 8458, 8459, 8471, 8472, 8473, 8474, 8476, 8477, 8478, 8480, 8481, 8482, 8483, 8485, 8486, 8490, 8493, 8498, 8501, 8502, 8505, 8511, 8513, 8515, 8517, 8521, 8523, 8524, 8525, 8528, 8531, 8532, 8533, 8537, 8538, 8539, 8541, 8542, 8544, 8549, 8550, 8552, 8553, 8554, 8557, 8561, 8563, 8565, 8566, 8568, 8576, 8581, 8582, 8583, 8588, 8589, 8590, 8593, 8594, 8595, 8596, 8597, 8599, 8600, 8601, 8602, 8603, 8605, 8607, 8610, 8611, 8612, 8614, 8617, 8618, 8624, 8630, 8631, 8634, 8638, 8639, 8640, 8642, 8644, 8648, 8654, 8657, 8658, 8659, 8663, 8665, 8666, 8669, 8672, 8685, 8693, 8700, 8703, 8706, 8708, 8709, 8713, 8714, 8715, 8716, 8717, 8719, 8720, 8721, 8726, 8729, 8731, 8732, 8734, 8735, 8736, 8740, 8741, 8744, 8745, 8746, 8748, 8752, 8757, 8767, 8769, 8771, 8772, 8773, 8775, 8776, 8777, 8779, 8782, 8783, 8784, 8785, 8789, 8792, 8797, 8803, 8804, 8805, 8808, 8810, 8818, 8822, 8824, 8831, 8832, 8833, 8835, 8838, 8841, 8842, 8843, 8846, 8847, 8853, 8861, 8862, 8867, 8874, 8876, 8878, 8880, 8881, 8883, 8886, 8888, 8889, 8891, 8892, 8896, 8899, 8901, 8902, 8905, 8907, 8908, 8909, 8910, 8911, 8913, 8914, 8916, 8917, 8926, 8928, 8929, 8935, 8938, 8940, 8941, 8942, 8945, 8946, 8949, 8951, 8957, 8960, 8961, 8962, 8967, 8968, 8969, 8972, 8974, 8976, 8977, 8979, 8980, 8981, 8984, 8985, 8986, 8992, 8996, 8998, 8999, 9002, 9003, 9006, 9009, 9012, 9015, 9016, 9020, 9022, 9025, 9029, 9030, 9033, 9037, 9044, 9052, 9057, 9058, 9059, 9060, 9061, 9062, 9066, 9069, 9071, 9073, 9074, 9076, 9084, 9088, 9091, 9092, 9095, 9096, 9097, 9105, 9108, 9109, 9110, 9111, 9112, 9114, 9115, 9116, 9118, 9119, 9123, 9125, 9129, 9131, 9133, 9134, 9136, 9138, 9139, 9140, 9141, 9142, 9146, 9149, 9151, 9152, 9172, 9173, 9174, 9175, 9177, 9183, 9185, 9187, 9188, 9190, 9191, 9195, 9196, 9200, 9206, 9207, 9210, 9211, 9213, 9215, 9216, 9217, 9218, 9221, 9223, 9226, 9229, 9233, 9234, 9237, 9241, 9243, 9247, 9252, 9253, 9254, 9255, 9257, 9263, 9265, 9267, 9269, 9270, 9273, 9276, 9278, 9282, 9283, 9284, 9285, 9288, 9289, 9290, 9292, 9293, 9299, 9304, 9308, 9310, 9311, 9320, 9321, 9323, 9325, 9326, 9327, 9328, 9329, 9330, 9333, 9336, 9337, 9338, 9339, 9340, 9341, 9345, 9346, 9347, 9348, 9349, 9353, 9354, 9355, 9359, 9361, 9366, 9367, 9370, 9373, 9375, 9376, 9378, 9382, 9383, 9388, 9389, 9391, 9392, 9393, 9394, 9396, 9400, 9402, 9403, 9404, 9406, 9407, 9413, 9414, 9415, 9419, 9422, 9423, 9432, 9433, 9442, 9444, 9449, 9451, 9452, 9453, 9456, 9459, 9460, 9468, 9471, 9472, 9473, 9478, 9481, 9483, 9488, 9490, 9494, 9495, 9497, 9500, 9501, 9502, 9503, 9504, 9505, 9509, 9513, 9514, 9515, 9517, 9518, 9519, 9520, 9521, 9522, 9525, 9531, 9533, 9534, 9536, 9540, 9543, 9545, 9546, 9548, 9549, 9553, 9555, 9560, 9563, 9564, 9565, 9567, 9568, 9571, 9575, 9577, 9582, 9583, 9586, 9587, 9589, 9590, 9591, 9592, 9602, 9606, 9608, 9609, 9610, 9613, 9615, 9620, 9623, 9624, 9626, 9627, 9628, 9629, 9633, 9637, 9640, 9641, 9642, 9644, 9645, 9646, 9648, 9649, 9650, 9653, 9655, 9657, 9658, 9659, 9660, 9663, 9668, 9670, 9681, 9682, 9686, 9692, 9695, 9696, 9698, 9706, 9708, 9717, 9718, 9722, 9723, 9724, 9725, 9726, 9727, 9730, 9731, 9733, 9734, 9737, 9738, 9746, 9750, 9751, 9753, 9754, 9756, 9763, 9764, 9767, 9768, 9770, 9772, 9777, 9780, 9781, 9782, 9784, 9786, 9792, 9794, 9796, 9798, 9799, 9801, 9809, 9813, 9816, 9819, 9820, 9825, 9833, 9835, 9836, 9845, 9846, 9847, 9849, 9851, 9853, 9854, 9861, 9864, 9866, 9869, 9873, 9876, 9882, 9885, 9886, 9888, 9892, 9893, 9894, 9897, 9898, 9900, 9901, 9906, 9907, 9908, 9909, 9911, 9912, 9918, 9923, 9928, 9930, 9938, 9940, 9944, 9946, 9950, 9953, 9955, 9960, 9962, 9967, 9971, 9972, 9974, 9979, 9980, 9982, 9984, 9985, 9988, 9990, 9997, 9998, 10000, 10007, 10009, 10010, 10017, 10018, 10019, 10021, 10026, 10033, 10037, 10038, 10045, 10047, 10048, 10049, 10051, 10052, 10054, 10056, 10058, 10059, 10060, 10062, 10063, 10064, 10066, 10068, 10072, 10076, 10077, 10078, 10083, 10086, 10087, 10089, 10090, 10091, 10092, 10095, 10097, 10098, 10101, 10102, 10103, 10105, 10106, 10107, 10108, 10109, 10110, 10112, 10114, 10115, 10118, 10122, 10127, 10128, 10131, 10132, 10135, 10136, 10137, 10138, 10143, 10146, 10149, 10151, 10152, 10158, 10162, 10163, 10165, 10166, 10168, 10169, 10170, 10174, 10176, 10178, 10179, 10181, 10182, 10192, 10193, 10194, 10195, 10197, 10199, 10203, 10206, 10207, 10209, 10210, 10214, 10218, 10219, 10220, 10222, 10223, 10224, 10225, 10228, 10230, 10231, 10232, 10233, 10236, 10237, 10240, 10247, 10252, 10253, 10255, 10257, 10258, 10260, 10273, 10275, 10284, 10286, 10291, 10295, 10296, 10297, 10300, 10302, 10306, 10307, 10311, 10318, 10321, 10322, 10323, 10325, 10326, 10328, 10329, 10331, 10333, 10334, 10335, 10336, 10342, 10343, 10344, 10345, 10353, 10356, 10357, 10359, 10360, 10361, 10362, 10364, 10365, 10368, 10373, 10375, 10378, 10380, 10381, 10382, 10384, 10385, 10389, 10392, 10397, 10398, 10399, 10401, 10405, 10410, 10411, 10413, 10414, 10416, 10421, 10425, 10427, 10429, 10430, 10435, 10437, 10438, 10447, 10448, 10449, 10450, 10451, 10453, 10455, 10456, 10463, 10464, 10465, 10468, 10469, 10470, 10472, 10473, 10474, 10478, 10488, 10491, 10492, 10494, 10496, 10498, 10501, 10504, 10508, 10514, 10518, 10525, 10527, 10528, 10531, 10533, 10535, 10536, 10537, 10541, 10542, 10543, 10544, 10547, 10548, 10549, 10550, 10551, 10555, 10556, 10558, 10560, 10561, 10562, 10565, 10567, 10569, 10571, 10573, 10577, 10580, 10581, 10582, 10583, 10584, 10585, 10590, 10593, 10595, 10596, 10597, 10599, 10601, 10602, 10605, 10610, 10611, 10615, 10616, 10617, 10621, 10622, 10623, 10626, 10628, 10636, 10637, 10638, 10639, 10641, 10643, 10645, 10646, 10649, 10650, 10655, 10657, 10663, 10664, 10665, 10668, 10669, 10670, 10671, 10674, 10678, 10681, 10682, 10683, 10684, 10685, 10687, 10689, 10693, 10697, 10698, 10699, 10700, 10702, 10703, 10705, 10707, 10708, 10710, 10711, 10712, 10715, 10716, 10721, 10723, 10725, 10726, 10732, 10734, 10735, 10736, 10738, 10740, 10744, 10747, 10748, 10749, 10753, 10754, 10762, 10763, 10766, 10771, 10774, 10775, 10777, 10778, 10779, 10780, 10782, 10784, 10785, 10787, 10788, 10790, 10791, 10792, 10795, 10796, 10798, 10800, 10801, 10802, 10803, 10804, 10805, 10809, 10810, 10811, 10813, 10815, 10818, 10819, 10820, 10821, 10822, 10823, 10824, 10825, 10826, 10830, 10833, 10836, 10838, 10839, 10840, 10841, 10843, 10846, 10853, 10854, 10857, 10858, 10860, 10861, 10862, 10863, 10867, 10869, 10871, 10872, 10874, 10877, 10878, 10880, 10881, 10886, 10887, 10892, 10896, 10897, 10898, 10899, 10902, 10903, 10905, 10912, 10917, 10920, 10926, 10927, 10930, 10933, 10934, 10935, 10936, 10937, 10938, 10940, 10941, 10947, 10948, 10950, 10954, 10957, 10960, 10962, 10964, 10965, 10967, 10972, 10976, 10977, 10980, 10993, 10995, 10996, 10997, 10999, 11002, 11004, 11005, 11006, 11008, 11010, 11015, 11018, 11019, 11023, 11024, 11025, 11026, 11027, 11032, 11039, 11045, 11046, 11047, 11053, 11056, 11058, 11060, 11061, 11066, 11070, 11072, 11078, 11079, 11080, 11082, 11083, 11086, 11090, 11092, 11095, 11098, 11101, 11102, 11107, 11108, 11109, 11110, 11114, 11116, 11117, 11118, 11119, 11123, 11124, 11125, 11127, 11128, 11129, 11132, 11133, 11135, 11137, 11138, 11145, 11146, 11149, 11150, 11151, 11152, 11153, 11154, 11158, 11159, 11160, 11161, 11162, 11163, 11166, 11169, 11172, 11173, 11175, 11177, 11178, 11179, 11180, 11184, 11185, 11187, 11188, 11190, 11191, 11192, 11194, 11198, 11199, 11201, 11202, 11203, 11207, 11210, 11214, 11217, 11218, 11222, 11226, 11227, 11228, 11229, 11232, 11233, 11234, 11235, 11237, 11238, 11239, 11244, 11246, 11247, 11248, 11251, 11254, 11255, 11256, 11257, 11258, 11259, 11260, 11261, 11262, 11263, 11264, 11266, 11274, 11275, 11278, 11282, 11284, 11288, 11289, 11290, 11291, 11292, 11293, 11294, 11295, 11298, 11306, 11307, 11313, 11315, 11316, 11318, 11319, 11320, 11322, 11326, 11328, 11329, 11330, 11331, 11332, 11337, 11339, 11340, 11345, 11346, 11348, 11349, 11352, 11356, 11358, 11363, 11365, 11366, 11369, 11370, 11373, 11374, 11377, 11378, 11380, 11381, 11382, 11385, 11387, 11388, 11389, 11391, 11392, 11394, 11395, 11397, 11398, 11403, 11405, 11406, 11408, 11409, 11411, 11412, 11413, 11414, 11416, 11418, 11423, 11424, 11428, 11430, 11431, 11433, 11437, 11438, 11443, 11446, 11448, 11449, 11451, 11458, 11459, 11463, 11465, 11471, 11472, 11473, 11476, 11478, 11481, 11482, 11485, 11487, 11490, 11492, 11496, 11497, 11498, 11500, 11503, 11506, 11507, 11508, 11509, 11512, 11516, 11518, 11520, 11521, 11523, 11524, 11526, 11528, 11530, 11533, 11534, 11538, 11540, 11541, 11544, 11546, 11548, 11551, 11553, 11558, 11560, 11561, 11567, 11568, 11570, 11571, 11576, 11577, 11578, 11579, 11580, 11585, 11588, 11589, 11593, 11594, 11595, 11596, 11597, 11599, 11604, 11610, 11612, 11615, 11618, 11620, 11621, 11623, 11624, 11625, 11627, 11632, 11633, 11636, 11639, 11642, 11644, 11649, 11650, 11652, 11654, 11655, 11656, 11657, 11658, 11663, 11667, 11668, 11669, 11678, 11681, 11682, 11683, 11685, 11688, 11691, 11692, 11693, 11694, 11695, 11698, 11701, 11703, 11705, 11707, 11710, 11711, 11712, 11717, 11718, 11720, 11721, 11725, 11730, 11731, 11733, 11736, 11740, 11743, 11744, 11749, 11753, 11755, 11759, 11760, 11761, 11762, 11763, 11764, 11765, 11766, 11767, 11770, 11771, 11774, 11776, 11780, 11781, 11782, 11783, 11784, 11785, 11786, 11790, 11792, 11795, 11799, 11800, 11804, 11809, 11811, 11812, 11813, 11816, 11818, 11819, 11821, 11822, 11826, 11828, 11830, 11836, 11837, 11838, 11839, 11841, 11842, 11846, 11847, 11849, 11850, 11851, 11853, 11856, 11858, 11860, 11861, 11863, 11868, 11870, 11872, 11876, 11877, 11878, 11881, 11886, 11890, 11891, 11894, 11895, 11898, 11899, 11903, 11904, 11905, 11909, 11913, 11918, 11919, 11920, 11921, 11923, 11926, 11927, 11928, 11929, 11930, 11934, 11935, 11940, 11941, 11943, 11944, 11946, 11947, 11948, 11949, 11950, 11953, 11955, 11957, 11958, 11959, 11960, 11961, 11962, 11963, 11965, 11968, 11977, 11978, 11980, 11983, 11988, 11993, 11994, 11995, 11996, 11997, 11998, 11999, 12002, 12004, 12005, 12006, 12014, 12015, 12017, 12018, 12019, 12020, 12021, 12023, 12024, 12025, 12032, 12039, 12042, 12043, 12044, 12051, 12054, 12059, 12060, 12061, 12068, 12073, 12078, 12079, 12080, 12081, 12083, 12085, 12091, 12092, 12093, 12097, 12098, 12102, 12104, 12106, 12109, 12114, 12115, 12118, 12120, 12122, 12127, 12128, 12129, 12131, 12134, 12135, 12138, 12139, 12144, 12145, 12146, 12148, 12150, 12151, 12153, 12155, 12162, 12165, 12166, 12167, 12171, 12174, 12175, 12179, 12181, 12192, 12197, 12198, 12202, 12204, 12208, 12214, 12215, 12217, 12223, 12228, 12229, 12233, 12234, 12241, 12243, 12245, 12249, 12250, 12252, 12253, 12254, 12255, 12259, 12260, 12268, 12271, 12278, 12280, 12283, 12285, 12286, 12287, 12292, 12295, 12296, 12304, 12305, 12306, 12310, 12311, 12312, 12313, 12314, 12315, 12317, 12319, 12321, 12323, 12324, 12325, 12328, 12331, 12333, 12334, 12337, 12339, 12340, 12343, 12344, 12347, 12350, 12354, 12356, 12359, 12364, 12366, 12368, 12370, 12374, 12375, 12376, 12379, 12380, 12381, 12383, 12390, 12393, 12394, 12397, 12399, 12400, 12402, 12403, 12406, 12411, 12414, 12415, 12416, 12417, 12418, 12419, 12420, 12423, 12424, 12425, 12426, 12427, 12428, 12429, 12437, 12439, 12440, 12444, 12445, 12447, 12450, 12451, 12454, 12456, 12457, 12459, 12462, 12465, 12467, 12468, 12470, 12472, 12473, 12476, 12478, 12481, 12482, 12483, 12486, 12487, 12488, 12491, 12492, 12494, 12497, 12499, 12500, 12501, 12502, 12503, 12508, 12512, 12513, 12514, 12515, 12518, 12519, 12525, 12527, 12529, 12530, 12531, 12535, 12536, 12537, 12538, 12539, 12546, 12547, 12551, 12552, 12554, 12555, 12556, 12562, 12563, 12565, 12568, 12572, 12577, 12578, 12580, 12583, 12585, 12586, 12588, 12589, 12591, 12592, 12593, 12594, 12600, 12603, 12605, 12608, 12609, 12610, 12611, 12616, 12620, 12622, 12623, 12626, 12628, 12629, 12631, 12633, 12634, 12638, 12639, 12640, 12641, 12644, 12645, 12648, 12649, 12651, 12663, 12664, 12668, 12670, 12671, 12679, 12683, 12684, 12688, 12689, 12691, 12692, 12693, 12695, 12696, 12699, 12701, 12702, 12707, 12713, 12715, 12723, 12728, 12729, 12731, 12732, 12733, 12735, 12738, 12739, 12740, 12741, 12742, 12743, 12744, 12752, 12753, 12754, 12755, 12758, 12760, 12761, 12763, 12764, 12765, 12766, 12771, 12775, 12777, 12782, 12790, 12797, 12800, 12801, 12802, 12803, 12804, 12807, 12808, 12810, 12812, 12817, 12818, 12820, 12822, 12823, 12824, 12826, 12827, 12828, 12835, 12836, 12837, 12838, 12839, 12844, 12848, 12849, 12850, 12852, 12853, 12861, 12866, 12869, 12870, 12873, 12875, 12878, 12882, 12884, 12887, 12891, 12898, 12899, 12900, 12901, 12902, 12903, 12904, 12905, 12908, 12910, 12912, 12913, 12916, 12920, 12921, 12923, 12928, 12929, 12931, 12932, 12933, 12934, 12935, 12939, 12942, 12946, 12947, 12950, 12952, 12953, 12956, 12958, 12960, 12961, 12963, 12967, 12968, 12969, 12972, 12978, 12986, 12987, 12988, 12990, 12991, 12999, 13001, 13003, 13004, 13005, 13007, 13010, 13015, 13017, 13022, 13027, 13030, 13031, 13034, 13035, 13037, 13040, 13041, 13044, 13047, 13049, 13050, 13053, 13054, 13055, 13056, 13061, 13063, 13064, 13066, 13067, 13069, 13070, 13071, 13075, 13077, 13079, 13082, 13083, 13085, 13086, 13087, 13099, 13101, 13102, 13105, 13106, 13109, 13110, 13111, 13112, 13114, 13116, 13117, 13118, 13120, 13121, 13122, 13123, 13124, 13125, 13127, 13128, 13131, 13136, 13144, 13147, 13148, 13149, 13151, 13154, 13156, 13159, 13160, 13167, 13169, 13175, 13181, 13182, 13186, 13187, 13197, 13198, 13199, 13206, 13209, 13212, 13213, 13217, 13221, 13224, 13226, 13228, 13229, 13232, 13234, 13235, 13236, 13237, 13239, 13243, 13248, 13250, 13255, 13259, 13260, 13261, 13262, 13263, 13264, 13265, 13267, 13268, 13269, 13271, 13274, 13281, 13285, 13293, 13295, 13296, 13297, 13298, 13301, 13303, 13304, 13313, 13315, 13316, 13317, 13328, 13329, 13330, 13332, 13335, 13340, 13343, 13344, 13345, 13346, 13347, 13348, 13349, 13352, 13353, 13358, 13361, 13363, 13365, 13367, 13368, 13369, 13370, 13377, 13380, 13381, 13384, 13385, 13386, 13388, 13391, 13393, 13394, 13395, 13396, 13397, 13398, 13401, 13407, 13408, 13410, 13414, 13416, 13417, 13419, 13423, 13424, 13428, 13429, 13430, 13431, 13433, 13434, 13439, 13441, 13446, 13448, 13450, 13451, 13456, 13460, 13467, 13469, 13473, 13474, 13475, 13477, 13478, 13480, 13489, 13492, 13494, 13499, 13503, 13507, 13510, 13515, 13518, 13519, 13521, 13522, 13524, 13526, 13529, 13532, 13533, 13535, 13536, 13539, 13540, 13543, 13544, 13546, 13547, 13549, 13552, 13553, 13556, 13558, 13560, 13561, 13562, 13565, 13566, 13568, 13569, 13572, 13574, 13575, 13577, 13578, 13579, 13580, 13584, 13587, 13596, 13597, 13598, 13599, 13600, 13601, 13602, 13604, 13605, 13606, 13607, 13612, 13613, 13619, 13621, 13627, 13628, 13629, 13630, 13631, 13632, 13634, 13636, 13637, 13638, 13640, 13641, 13643, 13647, 13649, 13650, 13653, 13660, 13662, 13663, 13665, 13669, 13675, 13677, 13678, 13679, 13683, 13687, 13688, 13689, 13693, 13697, 13698, 13699, 13700, 13706, 13710, 13712, 13713, 13715, 13716, 13719, 13720, 13721, 13727, 13728, 13729, 13730, 13734, 13736, 13737, 13738, 13739, 13742, 13745, 13747, 13749, 13750, 13751, 13753, 13756, 13764, 13767, 13769, 13772, 13773, 13775, 13777, 13779, 13780, 13782, 13783, 13785, 13786, 13787, 13791, 13793, 13795, 13796, 13798, 13799, 13802, 13809, 13816, 13817, 13818, 13819, 13820, 13822, 13823, 13828, 13830, 13834, 13835, 13843, 13849, 13852, 13858, 13859, 13860, 13862, 13866, 13869, 13870, 13872, 13873, 13875, 13877, 13887, 13891, 13892, 13895, 13897, 13898, 13899, 13901, 13906, 13907, 13908, 13909, 13910, 13911, 13917, 13918, 13919, 13921, 13923, 13924, 13925, 13927, 13929, 13934, 13938, 13942, 13943, 13944, 13947, 13948, 13950, 13953, 13954, 13958, 13960, 13962, 13963, 13969, 13970, 13975, 13976, 13984, 13986, 13987, 13988, 13990, 13994, 13999, 14000, 14001, 14002, 14003, 14005, 14006, 14007, 14013, 14014, 14016, 14018, 14021, 14022, 14027, 14030, 14031, 14036, 14038, 14051, 14052, 14059, 14062, 14063, 14066, 14067, 14069, 14070, 14071, 14073, 14075, 14078, 14081, 14083, 14084, 14085, 14086, 14088, 14092, 14094, 14095, 14096, 14097, 14102, 14106, 14110, 14111, 14112, 14115, 14116, 14118, 14121, 14122, 14124, 14129, 14130, 14132, 14133, 14137, 14138, 14139, 14141, 14142, 14145, 14146, 14147.

Promoters expressing in the flag leaf (top most leaf) at the tasseling stage of hybrid genotype plants grown in a greenhouse include SEQ IDs: 1, 5, 7, 8, 11, 12, 13, 14, 15, 16, 17, 19, 20, 24, 27, 31, 33, 34, 36, 37, 38, 48, 51, 53, 54, 57, 61, 63, 64, 65, 79, 80, 88, 90, 93, 94, 95, 96, 97, 98, 99, 103, 104, 110, 111, 112, 115, 117, 123, 129, 130, 131, 133, 141, 143, 144, 148, 152, 154, 155, 156, 157, 159, 160, 162, 165, 168, 172, 174, 175, 176, 179, 180, 181, 183, 187, 191, 193, 194, 196, 199, 203, 205, 207, 211, 212, 214, 230, 232, 233, 236, 237, 239, 240, 242, 244, 246, 249, 250, 251, 257, 259, 262, 267, 269, 270, 271, 273, 280, 281, 286, 288, 289, 293, 294, 298, 299, 301, 302, 305, 306, 309, 314, 316, 319, 320, 322, 328, 329, 332, 334, 335, 337, 338, 342, 346, 348, 349, 353, 354, 356, 357, 358, 359, 360, 364, 365, 371, 373, 376, 378, 379, 381, 382, 386, 388, 393, 396, 401, 411, 412, 414, 418, 423, 427, 428, 431, 433, 434, 436, 441, 444, 450, 452, 454, 456, 459, 461, 463, 466, 468, 470, 471, 474, 478, 483, 484, 485, 488, 489, 496, 501, 507, 509, 510, 511, 514, 516, 517, 520, 523, 525, 532, 537, 538, 541, 542, 544, 546, 547, 548, 554, 560, 561, 563, 577, 578, 580, 585, 588, 589, 592, 594, 595, 596, 601, 602, 606, 608, 613, 614, 619, 620, 629, 630, 634, 635, 636, 637, 638, 643, 647, 655, 656, 659, 661, 664, 669, 671, 681, 683, 692, 693, 694, 695, 701, 705, 706, 709, 716, 717, 718, 719, 721, 722, 723, 724, 727, 731, 732, 734, 736, 739, 740, 741, 742, 744, 749, 753, 757, 759, 760, 762, 763, 764, 765, 779, 783, 784, 786, 792, 793, 794, 800, 804, 806, 808, 809, 811, 819, 820, 821, 829, 830, 833, 840, 845, 846, 849, 855, 856, 857, 858, 859, 860, 862, 863, 865, 868, 869, 870, 871, 876, 877, 878, 887, 889, 890, 891, 892, 893, 895, 897, 898, 900, 901, 903, 907, 908, 910, 911, 912, 913, 915, 916, 919, 920, 924, 925, 928, 929, 931, 936, 938, 939, 943, 947, 951, 953, 955, 957, 958, 960, 964, 971, 974, 975, 976, 977, 978, 979, 980, 981, 982, 984, 985, 987, 989, 990, 991, 994, 995, 996, 997, 999, 1005, 1007, 1008, 1009, 1010, 1011, 1012, 1013, 1014, 1016, 1017, 1022, 1025, 1026, 1032, 1033, 1035, 1038, 1039, 1040, 1041, 1042, 1043, 1046, 1047, 1049, 1051, 1052, 1055, 1056, 1057, 1064, 1065, 1068, 1069, 1070, 1073, 1077, 1085, 1086, 1087, 1089, 1091, 1092, 1095, 1096, 1100, 1101, 1103, 1104, 1106, 1110, 1112, 1114, 1115, 1116, 1117, 1119, 1121, 1125, 1127, 1130, 1132, 1136, 1137, 1140, 1143, 1144, 1146, 1148, 1153, 1155, 1156, 1160, 1161, 1164, 1165, 1167, 1168, 1170, 1171, 1176, 1178, 1182, 1183, 1187, 1191, 1196, 1198, 1201, 1204, 1205, 1214, 1217, 1218, 1220, 1222, 1223, 1225, 1228, 1232, 1235, 1236, 1239, 1240, 1243, 1244, 1248, 1249, 1251, 1254, 1257, 1258, 1259, 1263, 1269, 1272, 1277, 1281, 1285, 1286, 1290, 1292, 1296, 1301, 1303, 1306, 1307, 1309, 1310, 1311, 1312, 1314, 1316, 1317, 1320, 1322, 1323, 1327, 1331, 1334, 1343, 1345, 1346, 1347, 1349, 1354, 1355, 1356, 1360, 1363, 1366, 1367, 1368, 1371, 1373, 1375, 1377, 1380, 1381, 1387, 1388, 1389, 1391, 1393, 1394, 1396, 1399, 1404, 1405, 1406, 1412, 1415, 1420, 1421, 1422, 1423, 1426, 1431, 1432, 1433, 1438, 1439, 1440, 1441, 1442, 1447, 1448, 1451, 1453, 1458, 1459, 1461, 1466, 1467, 1468, 1469, 1471, 1475, 1484, 1488, 1490, 1491, 1493, 1499, 1501, 1506, 1508, 1510, 1511, 1512, 1514, 1517, 1518, 1519, 1527, 1528, 1530, 1534, 1540, 1543, 1545, 1547, 1549, 1550, 1551, 1553, 1554, 1555, 1556, 1559, 1560, 1564, 1567, 1570, 1571, 1575, 1578, 1579, 1582, 1584, 1585, 1586, 1590, 1596, 1598, 1599, 1600, 1601, 1602, 1604, 1605, 1608, 1609, 1610, 1612, 1615, 1616, 1617, 1622, 1623, 1625, 1626, 1634, 1635, 1637, 1638, 1639, 1643, 1651, 1653, 1654, 1658, 1659, 1662, 1663, 1664, 1669, 1671, 1673, 1675, 1677, 1678, 1681, 1682, 1684, 1685, 1687, 1688, 1690, 1691, 1696, 1697, 1698, 1699, 1705, 1706, 1707, 1708, 1710, 1716, 1717, 1720, 1725, 1729, 1732, 1733, 1735, 1736, 1743, 1745, 1749, 1750, 1755, 1759, 1760, 1761, 1764, 1769, 1770, 1773, 1774, 1776, 1777, 1785, 1786, 1796, 1798, 1807, 1808, 1809, 1811, 1813, 1814, 1823, 1826, 1828, 1830, 1832, 1834, 1837, 1838, 1839, 1840, 1848, 1850, 1852, 1859, 1861, 1863, 1866, 1868, 1869, 1872, 1873, 1876, 1879, 1880, 1882, 1886, 1888, 1891, 1897, 1900, 1902, 1905, 1906, 1910, 1911, 1912, 1915, 1916, 1918, 1920, 1922, 1923, 1924, 1927, 1933, 1934, 1939, 1940, 1945, 1950, 1951, 1952, 1954, 1956, 1958, 1968, 1969, 1970, 1971, 1972, 1973, 1976, 1977, 1990, 1991, 1993, 1999, 2000, 2001, 2003, 2007, 2008, 2010, 2012, 2014, 2015, 2016, 2017, 2019, 2020, 2021, 2023, 2026, 2027, 2032, 2033, 2037, 2039, 2040, 2041, 2043, 2045, 2048, 2049, 2055, 2060, 2062, 2064, 2066, 2072, 2074, 2077, 2078, 2085, 2088, 2089, 2091, 2092, 2093, 2094, 2096, 2097, 2103, 2106, 2109, 2111, 2112, 2113, 2122, 2123, 2124, 2125, 2126, 2133, 2137, 2139, 2140, 2142, 2143, 2146, 2147, 2150, 2151, 2153, 2156, 2157, 2161, 2162, 2164, 2166, 2167, 2168, 2170, 2172, 2173, 2175, 2177, 2179, 2183, 2185, 2189, 2190, 2193, 2196, 2200, 2201, 2202, 2203, 2205, 2210, 2213, 2215, 2218, 2221, 2222, 2226, 2227, 2237, 2240, 2242, 2244, 2245, 2253, 2257, 2259, 2261, 2263, 2266, 2276, 2278, 2280, 2282, 2284, 2289, 2291, 2296, 2298, 2303, 2305, 2306, 2308, 2309, 2310, 2313, 2314, 2321, 2322, 2323, 2325, 2328, 2329, 2331, 2333, 2337, 2339, 2342, 2343, 2346, 2352, 2353, 2354, 2358, 2360, 2361, 2362, 2363, 2366, 2367, 2369, 2371, 2379, 2380, 2381, 2382, 2384, 2396, 2397, 2398, 2401, 2402, 2405, 2410, 2413, 2414, 2416, 2417, 2418, 2419, 2420, 2423, 2428, 2430, 2431, 2432, 2433, 2434, 2435, 2437, 2440, 2441, 2442, 2443, 2445, 2449, 2452, 2453, 2454, 2457, 2458, 2469, 2470, 2472, 2474, 2476, 2480, 2481, 2482, 2485, 2487, 2489, 2490, 2491, 2492, 2495, 2496, 2497, 2498, 2500, 2505, 2506, 2507, 2509, 2513, 2514, 2516, 2517, 2521, 2522, 2525, 2526, 2528, 2529, 2531, 2532, 2533, 2538, 2539, 2541, 2543, 2544, 2546, 2547, 2548, 2549, 2551, 2552, 2557, 2560, 2567, 2568, 2570, 2571, 2573, 2578, 2579, 2581, 2584, 2585, 2587, 2589, 2590, 2594, 2596, 2599, 2601, 2605, 2609, 2611, 2612, 2613, 2614, 2616, 2617, 2620, 2622, 2625, 2626, 2627, 2632, 2635, 2636, 2639, 2644, 2645, 2648, 2649, 2651, 2652, 2656, 2658, 2659, 2660, 2661, 2662, 2663, 2665, 2670, 2672, 2674, 2679, 2680, 2684, 2685, 2687, 2689, 2691, 2692, 2694, 2700, 2704, 2708, 2709, 2711, 2720, 2721, 2722, 2723, 2725, 2726, 2728, 2729, 2730, 2735, 2737, 2738, 2739, 2740, 2745, 2747, 2749, 2752, 2756, 2758, 2759, 2760, 2762, 2763, 2764, 2765, 2770, 2783, 2785, 2786, 2787, 2788, 2791, 2794, 2798, 2800, 2802, 2805, 2808, 2814, 2816, 2819, 2821, 2822, 2823, 2824, 2826, 2827, 2828, 2831, 2837, 2840, 2843, 2845, 2850, 2857, 2860, 2865, 2869, 2870, 2871, 2876, 2878, 2879, 2888, 2889, 2892, 2893, 2894, 2895, 2896, 2897, 2901, 2902, 2903, 2906, 2908, 2909, 2915, 2916, 2917, 2918, 2922, 2923, 2930, 2931, 2935, 2938, 2941, 2942, 2943, 2945, 2946, 2948, 2955, 2959, 2960, 2963, 2965, 2966, 2968, 2969, 2976, 2979, 2982, 2992, 2994, 3003, 3005, 3007, 3008, 3009, 3013, 3017, 3018, 3020, 3023, 3024, 3029, 3031, 3039, 3040, 3041, 3042, 3043, 3044, 3045, 3047, 3048, 3050, 3051, 3053, 3055, 3064, 3067, 3068, 3069, 3072, 3075, 3080, 3083, 3084, 3085, 3087, 3090, 3094, 3095, 3096, 3100, 3101, 3107, 3110, 3112, 3113, 3115, 3118, 3119, 3120, 3121, 3123, 3126, 3127, 3128, 3129, 3138, 3139, 3141, 3143, 3149, 3153, 3157, 3158, 3167, 3169, 3170, 3171, 3172, 3177, 3181, 3189, 3192, 3196, 3202, 3205, 3206, 3208, 3210, 3217, 3218, 3219, 3220, 3221, 3224, 3225, 3228, 3230, 3231, 3236, 3237, 3240, 3242, 3246, 3247, 3249, 3250, 3252, 3253, 3261, 3263, 3266, 3267, 3268, 3272, 3280, 3283, 3286, 3288, 3289, 3290, 3291, 3294, 3295, 3299, 3301, 3304, 3310, 3312, 3313, 3314, 3327, 3329, 3331, 3332, 3333, 3337, 3338, 3340, 3342, 3343, 3345, 3346, 3351, 3353, 3355, 3357, 3359, 3360, 3361, 3365, 3370, 3373, 3374, 3378, 3379, 3381, 3382, 3386, 3394, 3396, 3399, 3402, 3403, 3404, 3405, 3411, 3412, 3413, 3415, 3416, 3418, 3424, 3425, 3426, 3427, 3428, 3429, 3432, 3435, 3438, 3440, 3441, 3442, 3443, 3445, 3446, 3447, 3449, 3452, 3453, 3458, 3461, 3462, 3466, 3468, 3469, 3470, 3471, 3474, 3477, 3482, 3483, 3484, 3486, 3488, 3490, 3493, 3499, 3500, 3501, 3502, 3503, 3504, 3506, 3507, 3510, 3511, 3516, 3517, 3518, 3523, 3529, 3533, 3535, 3536, 3537, 3538, 3540, 3541, 3544, 3545, 3548, 3549, 3551, 3554, 3556, 3557, 3560, 3561, 3562, 3563, 3569, 3571, 3574, 3576, 3580, 3587, 3588, 3589, 3591, 3592, 3594, 3600, 3601, 3603, 3604, 3606, 3610, 3611, 3613, 3615, 3616, 3618, 3619, 3620, 3621, 3624, 3633, 3634, 3637, 3640, 3642, 3643, 3644, 3645, 3646, 3648, 3650, 3654, 3655, 3659, 3660, 3661, 3667, 3669, 3671, 3672, 3673, 3674, 3677, 3682, 3684, 3685, 3690, 3698, 3702, 3706, 3707, 3709, 3710, 3713, 3715, 3717, 3718, 3719, 3721, 3722, 3725, 3730, 3731, 3733, 3738, 3739, 3744, 3748, 3749, 3752, 3756, 3761, 3764, 3766, 3772, 3773, 3774, 3775, 3777, 3778, 3783, 3790, 3791, 3792, 3793, 3801, 3804, 3805, 3806, 3808, 3817, 3818, 3819, 3823, 3830, 3831, 3832, 3833, 3834, 3835, 3837, 3838, 3839, 3843, 3844, 3846, 3847, 3849, 3852, 3858, 3859, 3860, 3866, 3867, 3868, 3869, 3870, 3871, 3872, 3873, 3876, 3881, 3882, 3883, 3884, 3887, 3889, 3890, 3892, 3894, 3895, 3898, 3899, 3902, 3903, 3904, 3908, 3912, 3917, 3918, 3923, 3924, 3926, 3928, 3929, 3933, 3934, 3937, 3938, 3940, 3941, 3942, 3947, 3950, 3951, 3954, 3955, 3958, 3959, 3962, 3964, 3967, 3968, 3969, 3970, 3971, 3972, 3974, 3975, 3978, 3983, 3987, 3988, 3991, 3995, 3996, 3997, 4000, 4001, 4002, 4003, 4007, 4008, 4012, 4013, 4014, 4021, 4026, 4030, 4033, 4037, 4039, 4040, 4041, 4042, 4043, 4044, 4046, 4047, 4048, 4049, 4050, 4053, 4054, 4056, 4057, 4062, 4066, 4068, 4070, 4075, 4084, 4087, 4088, 4092, 4094, 4096, 4098, 4099, 4103, 4105, 4106, 4109, 4110, 4111, 4113, 4124, 4126, 4128, 4131, 4132, 4133, 4134, 4140, 4143, 4144, 4145, 4149, 4150, 4155, 4157, 4158, 4160, 4161, 4162, 4163, 4164, 4165, 4166, 4167, 4168, 4171, 4173, 4175, 4176, 4178, 4181, 4183, 4185, 4187, 4188, 4189, 4190, 4191, 4193, 4195, 4197, 4198, 4200, 4201, 4202, 4204, 4205, 4206, 4207, 4210, 4211, 4212, 4213, 4217, 4219, 4221, 4227, 4228, 4232, 4233, 4235, 4237, 4245, 4246, 4247, 4250, 4251, 4252, 4257, 4260, 4261, 4266, 4270, 4272, 4275, 4276, 4280, 4281, 4284, 4290, 4296, 4301, 4302, 4305, 4306, 4309, 4312, 4314, 4317, 4320, 4321, 4324, 4329, 4330, 4333, 4335, 4339, 4344, 4347, 4352, 4354, 4358, 4360, 4369, 4370, 4374, 4378, 4380, 4383, 4388, 4390, 4391, 4393, 4396, 4397, 4401, 4402, 4403, 4404, 4405, 4410, 4422, 4423, 4430, 4432, 4436, 4439, 4440, 4442, 4443, 4446, 4448, 4449, 4450, 4453, 4457, 4461, 4462, 4463, 4466, 4467, 4468, 4470, 4471, 4474, 4475, 4479, 4486, 4490, 4492, 4494, 4498, 4500, 4502, 4507, 4508, 4509, 4512, 4513, 4514, 4519, 4521, 4522, 4524, 4525, 4529, 4531, 4535, 4543, 4548, 4549, 4554, 4555, 4556, 4557, 4558, 4560, 4563, 4565, 4566, 4568, 4575, 4578, 4579, 4580, 4582, 4583, 4590, 4591, 4594, 4597, 4598, 4601, 4606, 4614, 4616, 4623, 4625, 4628, 4632, 4635, 4638, 4639, 4641, 4643, 4644, 4646, 4647, 4650, 4653, 4654, 4655, 4656, 4657, 4658, 4659, 4662, 4667, 4669, 4671, 4672, 4673, 4674, 4676, 4677, 4680, 4682, 4684, 4685, 4688, 4690, 4691, 4692, 4693, 4696, 4697, 4699, 4700, 4703, 4705, 4706, 4710, 4711, 4713, 4715, 4719, 4721, 4722, 4724, 4725, 4727, 4728, 4729, 4734, 4736, 4737, 4738, 4739, 4740, 4745, 4747, 4748, 4749, 4753, 4754, 4755, 4756, 4761, 4762, 4763, 4767, 4769, 4770, 4771, 4773, 4775, 4779, 4780, 4781, 4783, 4784, 4787, 4788, 4789, 4790, 4791, 4795, 4796, 4800, 4801, 4803, 4804, 4805, 4806, 4807, 4813, 4815, 4816, 4817, 4818, 4820, 4822, 4828, 4830, 4831, 4834, 4836, 4837, 4841, 4845, 4847, 4854, 4855, 4856, 4857, 4861, 4862, 4863, 4864, 4867, 4869, 4874, 4875, 4876, 4878, 4880, 4881, 4887, 4889, 4891, 4897, 4900, 4904, 4905, 4907, 4909, 4910, 4912, 4913, 4914, 4918, 4921, 4923, 4924, 4928, 4931, 4936, 4938, 4941, 4943, 4947, 4950, 4953, 4954, 4955, 4958, 4959, 4967, 4969, 4971, 4972, 4974, 4975, 4981, 4984, 4985, 4986, 4988, 4989, 4990, 4991, 4993, 4994, 4996, 5005, 5007, 5011, 5015, 5016, 5022, 5023, 5024, 5026, 5029, 5030, 5034, 5036, 5037, 5039, 5040, 5042, 5044, 5045, 5046, 5049, 5052, 5054, 5057, 5060, 5061, 5067, 5068, 5072, 5074, 5075, 5078, 5082, 5084, 5088, 5089, 5090, 5091, 5094, 5095, 5099, 5100, 5101, 5102, 5106, 5110, 5111, 5113, 5114, 5115, 5116, 5119, 5120, 5122, 5123, 5125, 5131, 5132, 5136, 5137, 5140, 5143, 5144, 5145, 5146, 5147, 5150, 5151, 5157, 5159, 5160, 5164, 5165, 5168, 5170, 5174, 5175, 5177, 5178, 5180, 5181, 5182, 5184, 5185, 5187, 5188, 5189, 5190, 5191, 5192, 5193, 5196, 5198, 5200, 5202, 5206, 5209, 5212, 5213, 5216, 5217, 5218, 5219, 5221, 5225, 5229, 5230, 5234, 5236, 5240, 5241, 5251, 5253, 5254, 5255, 5256, 5257, 5258, 5260, 5261, 5263, 5264, 5268, 5269, 5273, 5275, 5276, 5280, 5281, 5282, 5283, 5285, 5286, 5287, 5292, 5293, 5297, 5298, 5299, 5300, 5301, 5308, 5311, 5314, 5317, 5319, 5324, 5327, 5329, 5330, 5331, 5332, 5334, 5339, 5341, 5342, 5345, 5346, 5348, 5349, 5351, 5352, 5361, 5366, 5367, 5369, 5371, 5379, 5386, 5388, 5389, 5391, 5393, 5396, 5402, 5404, 5405, 5411, 5414, 5416, 5417, 5418, 5422, 5427, 5428, 5430, 5431, 5432, 5434, 5437, 5438, 5445, 5446, 5448, 5449, 5452, 5453, 5456, 5458, 5459, 5461, 5462, 5475, 5476, 5481, 5483, 5485, 5488, 5491, 5493, 5495, 5496, 5497, 5502, 5503, 5505, 5506, 5508, 5510, 5512, 5513, 5515, 5518, 5519, 5524, 5526, 5529, 5530, 5531, 5532, 5534, 5535, 5543, 5545, 5549, 5554, 5557, 5558, 5559, 5562, 5563, 5564, 5566, 5568, 5569, 5572, 5575, 5579, 5581, 5582, 5584, 5585, 5586, 5589, 5593, 5594, 5596, 5597, 5602, 5608, 5612, 5613, 5614, 5615, 5616, 5618, 5620, 5621, 5627, 5632, 5633, 5635, 5638, 5640, 5643, 5647, 5648, 5649, 5650, 5651, 5652, 5653, 5655, 5657, 5659, 5660, 5663, 5664, 5667, 5669, 5670, 5671, 5677, 5680, 5681, 5689, 5690, 5694, 5695, 5696, 5697, 5698, 5700, 5702, 5703, 5706, 5709, 5711, 5712, 5713, 5717, 5718, 5719, 5721, 5722, 5723, 5728, 5729, 5730, 5731, 5732, 5734, 5735, 5736, 5737, 5742, 5744, 5751, 5764, 5768, 5770, 5773, 5775, 5778, 5780, 5783, 5784, 5785, 5787, 5791, 5792, 5794, 5805, 5807, 5808, 5810, 5811, 5817, 5819, 5820, 5824, 5826, 5828, 5833, 5834, 5835, 5836, 5837, 5839, 5842, 5852, 5856, 5858, 5859, 5863, 5864, 5866, 5867, 5869, 5871, 5872, 5878, 5879, 5881, 5882, 5883, 5888, 5889, 5892, 5893, 5900, 5901, 5902, 5905, 5906, 5907, 5910, 5912, 5918, 5919, 5921, 5925, 5926, 5927, 5928, 5930, 5931, 5932, 5938, 5939, 5941, 5942, 5943, 5944, 5946, 5948, 5950, 5951, 5954, 5956, 5957, 5959, 5961, 5967, 5968, 5971, 5975, 5978, 5979, 5980, 5984, 5985, 5986, 5988, 5990, 5991, 5992, 5994, 5996, 5997, 5999, 6000, 6002, 6003, 6004, 6005, 6006, 6007, 6008, 6012, 6013, 6016, 6019, 6020, 6021, 6023, 6025, 6026, 6028, 6031, 6038, 6040, 6041, 6044, 6045, 6047, 6048, 6051, 6054, 6058, 6059, 6060, 6061, 6062, 6063, 6065, 6069, 6070, 6072, 6073, 6074, 6075, 6077, 6080, 6082, 6085, 6088, 6089, 6090, 6092, 6093, 6094, 6095, 6096, 6098, 6108, 6109, 6110, 6112, 6116, 6118, 6119, 6122, 6125, 6129, 6130, 6132, 6133, 6135, 6136, 6137, 6143, 6145, 6146, 6147, 6149, 6151, 6153, 6155, 6156, 6158, 6163, 6164, 6165, 6168, 6171, 6173, 6178, 6180, 6181, 6182, 6183, 6186, 6188, 6189, 6190, 6191, 6193, 6197, 6198, 6200, 6203, 6206, 6207, 6209, 6212, 6213, 6215, 6220, 6221, 6223, 6224, 6226, 6227, 6228, 6230, 6231, 6237, 6238, 6240, 6241, 6243, 6245, 6246, 6247, 6249, 6250, 6251, 6255, 6257, 6258, 6259, 6260, 6264, 6265, 6269, 6270, 6271, 6272, 6273, 6278, 6279, 6280, 6282, 6286, 6287, 6288, 6289, 6291, 6292, 6294, 6296, 6299, 6300, 6302, 6303, 6309, 6310, 6312, 6315, 6317, 6319, 6321, 6322, 6326, 6328, 6332, 6333, 6338, 6345, 6349, 6351, 6352, 6353, 6354, 6356, 6358, 6359, 6360, 6362, 6363, 6364, 6365, 6367, 6370, 6372, 6375, 6378, 6379, 6381, 6387, 6394, 6396, 6397, 6398, 6399, 6403, 6404, 6405, 6407, 6408, 6412, 6414, 6415, 6419, 6420, 6422, 6426, 6429, 6430, 6431, 6434, 6436, 6437, 6440, 6448, 6452, 6454, 6458, 6459, 6463, 6464, 6466, 6467, 6468, 6469, 6470, 6471, 6474, 6477, 6478, 6480, 6481, 6484, 6486, 6488, 6492, 6493, 6495, 6497, 6499, 6500, 6501, 6502, 6503, 6504, 6505, 6513, 6514, 6515, 6517, 6519, 6523, 6524, 6525, 6530, 6534, 6537, 6541, 6543, 6544, 6547, 6548, 6549, 6554, 6558, 6560, 6561, 6563, 6564, 6570, 6572, 6574, 6576, 6577, 6579, 6581, 6582, 6584, 6587, 6588, 6595, 6596, 6597, 6598, 6599, 6605, 6607, 6610, 6611, 6614, 6615, 6616, 6620, 6621, 6624, 6626, 6627, 6628, 6629, 6630, 6634, 6635, 6637, 6638, 6639, 6643, 6644, 6646, 6647, 6648, 6649, 6652, 6654, 6655, 6656, 6662, 6666, 6671, 6672, 6676, 6681, 6686, 6689, 6691, 6692, 6695, 6696, 6699, 6703, 6705, 6706, 6711, 6714, 6716, 6718, 6720, 6724, 6725, 6729, 6730, 6731, 6734, 6736, 6746, 6747, 6753, 6756, 6757, 6759, 6761, 6766, 6778, 6779, 6780, 6782, 6786, 6787, 6788, 6791, 6792, 6793, 6794, 6797, 6799, 6803, 6804, 6805, 6807, 6810, 6811, 6812, 6813, 6816, 6817, 6819, 6820, 6821, 6824, 6827, 6828, 6831, 6834, 6840, 6841, 6842, 6843, 6845, 6847, 6848, 6850, 6851, 6852, 6859, 6863, 6864, 6867, 6869, 6872, 6874, 6875, 6876, 6877, 6878, 6879, 6880, 6885, 6886, 6888, 6897, 6903, 6906, 6909, 6913, 6914, 6915, 6917, 6919, 6921, 6922, 6923, 6924, 6925, 6930, 6933, 6935, 6936, 6941, 6944, 6946, 6948, 6950, 6951, 6952, 6959, 6960, 6961, 6967, 6969, 6971, 6979, 6980, 6984, 6985, 6987, 6990, 6991, 6994, 6997, 6999, 7002, 7003, 7005, 7006, 7009, 7011, 7012, 7013, 7015, 7019, 7020, 7022, 7025, 7032, 7038, 7039, 7042, 7043, 7051, 7052, 7053, 7056, 7057, 7064, 7067, 7068, 7072, 7075, 7077, 7079, 7083, 7085, 7086, 7093, 7094, 7097, 7105, 7107, 7108, 7112, 7113, 7115, 7116, 7117, 7118, 7124, 7126, 7129, 7130, 7132, 7138, 7139, 7140, 7142, 7144, 7146, 7149, 7151, 7155, 7164, 7169, 7171, 7176, 7177, 7182, 7183, 7184, 7187, 7188, 7192, 7194, 7197, 7201, 7202, 7203, 7206, 7207, 7209, 7211, 7214, 7216, 7217, 7219, 7220, 7221, 7227, 7228, 7232, 7233, 7234, 7236, 7239, 7243, 7244, 7245, 7248, 7252, 7255, 7257, 7258, 7259, 7262, 7267, 7268, 7269, 7270, 7274, 7275, 7277, 7281, 7282, 7284, 7288, 7290, 7291, 7292, 7293, 7298, 7300, 7301, 7305, 7307, 7308, 7310, 7313, 7315, 7317, 7321, 7328, 7330, 7331, 7333, 7334, 7338, 7340, 7344, 7353, 7354, 7355, 7356, 7357, 7358, 7363, 7365, 7371, 7373, 7375, 7379, 7380, 7381, 7383, 7388, 7389, 7392, 7395, 7396, 7398, 7400, 7401, 7409, 7411, 7415, 7417, 7425, 7428, 7430, 7434, 7435, 7436, 7438, 7443, 7444, 7447, 7448, 7452, 7453, 7454, 7458, 7459, 7464, 7465, 7466, 7470, 7479, 7483, 7486, 7490, 7492, 7502, 7504, 7505, 7506, 7512, 7515, 7517, 7518, 7523, 7524, 7528, 7533, 7537, 7538, 7542, 7544, 7546, 7547, 7549, 7556, 7557, 7561, 7570, 7574, 7578, 7580, 7585, 7586, 7589, 7591, 7596, 7605, 7611, 7613, 7619, 7620, 7621, 7623, 7624, 7632, 7633, 7634, 7639, 7642, 7647, 7652, 7653, 7655, 7658, 7661, 7663, 7665, 7666, 7667, 7672, 7674, 7676, 7677, 7678, 7679, 7680, 7682, 7685, 7689, 7695, 7697, 7699, 7700, 7703, 7708, 7712, 7713, 7716, 7719, 7724, 7725, 7729, 7730, 7733, 7734, 7736, 7737, 7738, 7740, 7744, 7745, 7747, 7750, 7751, 7754, 7761, 7762, 7763, 7764, 7768, 7769, 7770, 7774, 7775, 7777, 7778, 7779, 7781, 7782, 7785, 7786, 7788, 7791, 7793, 7796, 7798, 7800, 7803, 7804, 7807, 7812, 7815, 7820, 7823, 7824, 7825, 7832, 7833, 7834, 7838, 7840, 7841, 7844, 7847, 7848, 7849, 7854, 7856, 7859, 7860, 7862, 7863, 7865, 7873, 7875, 7876, 7878, 7881, 7888, 7890, 7893, 7896, 7900, 7901, 7907, 7908, 7909, 7910, 7911, 7918, 7923, 7925, 7929, 7933, 7934, 7935, 7936, 7937, 7938, 7942, 7943, 7944, 7945, 7947, 7948, 7949, 7950, 7953, 7955, 7956, 7965, 7966, 7967, 7971, 7972, 7974, 7976, 7977, 7978, 7979, 7980, 7982, 7983, 7984, 7986, 7988, 7989, 7990, 7991, 7993, 8000, 8002, 8004, 8005, 8006, 8007, 8012, 8020, 8021, 8026, 8029, 8041, 8042, 8044, 8045, 8047, 8048, 8049, 8052, 8053, 8056, 8058, 8059, 8063, 8065, 8066, 8067, 8068, 8069, 8073, 8075, 8076, 8077, 8078, 8080, 8082, 8083, 8084, 8087, 8088, 8091, 8093, 8095, 8097, 8100, 8103, 8105, 8106, 8109, 8112, 8116, 8118, 8121, 8123, 8124, 8126, 8129, 8130, 8136, 8137, 8145, 8146, 8147, 8148, 8150, 8151, 8159, 8162, 8163, 8164, 8165, 8169, 8170, 8176, 8178, 8182, 8185, 8189, 8192, 8193, 8195, 8196, 8199, 8202, 8204, 8207, 8208, 8211, 8213, 8216, 8219, 8220, 8222, 8225, 8227, 8234, 8236, 8237, 8239, 8240, 8241, 8242, 8244, 8245, 8250, 8252, 8253, 8264, 8265, 8266, 8269, 8270, 8272, 8274, 8275, 8282, 8288, 8289, 8291, 8292, 8293, 8294, 8296, 8297, 8300, 8301, 8304, 8305, 8306, 8310, 8311, 8312, 8318, 8319, 8320, 8321, 8325, 8329, 8331, 8336, 8337, 8339, 8340, 8343, 8349, 8350, 8351, 8352, 8353, 8354, 8355, 8361, 8363, 8367, 8368, 8373, 8378, 8379, 8382, 8384, 8385, 8386, 8387, 8389, 8392, 8393, 8395, 8398, 8401, 8402, 8403, 8404, 8405, 8410, 8411, 8413, 8414, 8416, 8417, 8418, 8423, 8427, 8428, 8429, 8433, 8435, 8436, 8438, 8439, 8441, 8442, 8444, 8446, 8447, 8448, 8450, 8451, 8452, 8457, 8458, 8459, 8471, 8472, 8473, 8474, 8476, 8477, 8478, 8480, 8481, 8482, 8485, 8486, 8490, 8493, 8498, 8501, 8502, 8505, 8511, 8513, 8515, 8517, 8523, 8524, 8525, 8528, 8531, 8532, 8533, 8537, 8538, 8539, 8541, 8542, 8544, 8549, 8550, 8552, 8553, 8554, 8557, 8561, 8565, 8566, 8568, 8576, 8581, 8582, 8583, 8588, 8589, 8590, 8592, 8593, 8594, 8596, 8597, 8598, 8599, 8600, 8601, 8602, 8603, 8605, 8610, 8611, 8612, 8614, 8617, 8618, 8622, 8624, 8630, 8631, 8634, 8638, 8640, 8642, 8644, 8648, 8654, 8657, 8658, 8659, 8663, 8665, 8669, 8672, 8675, 8685, 8693, 8700, 8703, 8706, 8708, 8709, 8713, 8714, 8715, 8716, 8717, 8719, 8720, 8721, 8726, 8729, 8731, 8732, 8734, 8735, 8736, 8740, 8741, 8744, 8746, 8748, 8752, 8757, 8758, 8767, 8769, 8770, 8772, 8773, 8775, 8776, 8777, 8779, 8782, 8783, 8784, 8785, 8789, 8792, 8795, 8797, 8802, 8803, 8804, 8805, 8808, 8810, 8818, 8822, 8824, 8831, 8832, 8833, 8834, 8835, 8838, 8841, 8842, 8843, 8846, 8847, 8853, 8861, 8862, 8867, 8876, 8878, 8880, 8881, 8883, 8886, 8888, 8889, 8891, 8892, 8897, 8899, 8900, 8901, 8905, 8907, 8908, 8909, 8910, 8911, 8913, 8914, 8916, 8917, 8922, 8926, 8928, 8929, 8935, 8938, 8940, 8941, 8942, 8945, 8946, 8949, 8951, 8954, 8956, 8957, 8960, 8961, 8963, 8967, 8968, 8969, 8972, 8974, 8976, 8977, 8979, 8980, 8981, 8984, 8985, 8986, 8991, 8992, 8996, 8999, 9001, 9002, 9003, 9006, 9009, 9012, 9013, 9014, 9015, 9016, 9017, 9020, 9022, 9025, 9026, 9027, 9029, 9030, 9033, 9037, 9038, 9042, 9044, 9047, 9050, 9052, 9057, 9058, 9059, 9060, 9061, 9066, 9069, 9071, 9073, 9074, 9076, 9084, 9086, 9088, 9091, 9092, 9095, 9096, 9097, 9098, 9105, 9108, 9109, 9110, 9111, 9112, 9114, 9115, 9116, 9118, 9119, 9123, 9125, 9129, 9131, 9133, 9134, 9138, 9139, 9140, 9141, 9142, 9146, 9149, 9151, 9152, 9172, 9173, 9174, 9175, 9177, 9183, 9185, 9187, 9188, 9190, 9195, 9196, 9200, 9206, 9207, 9210, 9211, 9213, 9215, 9216, 9217, 9218, 9221, 9223, 9226, 9229, 9233, 9234, 9237, 9241, 9243, 9247, 9249, 9252, 9253, 9255, 9257, 9263, 9265, 9267, 9270, 9273, 9276, 9278, 9282, 9283, 9284, 9285, 9288, 9289, 9290, 9291, 9292, 9293, 9299, 9302, 9304, 9308, 9311, 9313, 9320, 9321, 9323, 9325, 9326, 9327, 9328, 9329, 9330, 9333, 9336, 9337, 9338, 9339, 9340, 9341, 9345, 9346, 9347, 9348, 9349, 9350, 9354, 9355, 9359, 9361, 9366, 9367, 9370, 9373, 9375, 9376, 9378, 9382, 9383, 9388, 9389, 9391, 9392, 9393, 9394, 9396, 9400, 9402, 9403, 9404, 9406, 9407, 9413, 9415, 9419, 9422, 9423, 9432, 9433, 9439, 9440, 9442, 9444, 9451, 9452, 9453, 9456, 9460, 9467, 9468, 9471, 9472, 9473, 9475, 9478, 9481, 9483, 9487, 9488, 9490, 9494, 9495, 9497, 9500, 9501, 9502, 9503, 9504, 9505, 9509, 9513, 9514, 9515, 9517, 9518, 9519, 9521, 9522, 9525, 9533, 9534, 9536, 9540, 9543, 9545, 9546, 9548, 9549, 9553, 9555, 9560, 9563, 9564, 9565, 9567, 9568, 9571, 9575, 9577, 9579, 9582, 9583, 9586, 9587, 9589, 9590, 9591, 9592, 9602, 9606, 9608, 9609, 9610, 9613, 9615, 9620, 9623, 9626, 9627, 9628, 9629, 9630, 9633, 9635, 9638, 9640, 9641, 9642, 9644, 9645, 9646, 9648, 9649, 9650, 9651, 9652, 9653, 9655, 9657, 9658, 9659, 9660, 9663, 9668, 9670, 9681, 9682, 9686, 9692, 9695, 9696, 9698, 9706, 9708, 9710, 9711, 9717, 9718, 9722, 9723, 9725, 9726, 9727, 9730, 9731, 9733, 9734, 9737, 9738, 9744, 9745, 9746, 9750, 9751, 9753, 9754, 9755, 9756, 9763, 9764, 9767, 9768, 9770, 9772, 9776, 9777, 9780, 9781, 9782, 9784, 9786, 9792, 9794, 9798, 9799, 9801, 9806, 9809, 9813, 9816, 9819, 9820, 9824, 9825, 9827, 9833, 9835, 9836, 9845, 9846, 9847, 9849, 9851, 9853, 9854, 9861, 9864, 9866, 9869, 9873, 9876, 9882, 9885, 9886, 9888, 9892, 9893, 9894, 9897, 9898, 9900, 9901, 9906, 9907, 9908, 9909, 9910, 9911, 9912, 9918, 9923, 9928, 9938, 9940, 9944, 9946, 9947, 9950, 9953, 9955, 9960, 9962, 9967, 9969, 9971, 9972, 9974, 9979, 9980, 9982, 9984, 9985, 9988, 9990, 9996, 9997, 9998, 10000, 10007, 10008, 10009, 10010, 10013, 10017, 10018, 10019, 10021, 10026, 10031, 10033, 10037, 10038, 10041, 10044, 10045, 10047, 10048, 10049, 10050, 10051, 10052, 10054, 10056, 10058, 10059, 10060, 10062, 10063, 10064, 10068, 10072, 10076, 10077, 10078, 10082, 10083, 10086, 10087, 10089, 10090, 10091, 10092, 10095, 10097, 10098, 10101, 10102, 10103, 10105, 10106, 10107, 10108, 10109, 10110, 10112, 10114, 10115, 10116, 10118, 10122, 10127, 10128, 10131, 10132, 10135, 10136, 10137, 10138, 10143, 10146, 10149, 10151, 10158, 10163, 10165, 10166, 10168, 10169, 10170, 10174, 10176, 10178, 10181, 10182, 10192, 10193, 10194, 10195, 10197, 10199, 10203, 10206, 10207, 10209, 10210, 10214, 10217, 10218, 10219, 10220, 10221, 10222, 10223, 10224, 10225, 10228, 10230, 10231, 10232, 10233, 10236, 10237, 10238, 10247, 10252, 10255, 10258, 10259, 10260, 10273, 10275, 10284, 10286, 10291, 10292, 10293, 10295, 10296, 10297, 10300, 10302, 10306, 10307, 10311, 10318, 10321, 10322, 10323, 10325, 10326, 10327, 10328, 10329, 10331, 10333, 10334, 10335, 10336, 10342, 10343, 10345, 10352, 10353, 10356, 10357, 10359, 10360, 10362, 10364, 10368, 10373, 10375, 10380, 10381, 10382, 10384, 10385, 10389, 10392, 10397, 10398, 10399, 10401, 10405, 10410, 10411, 10413, 10414, 10416, 10421, 10422, 10423, 10425, 10427, 10429, 10430, 10435, 10437, 10438, 10447, 10448, 10449, 10450, 10451, 10452, 10453, 10455, 10456, 10463, 10464, 10465, 10468, 10469, 10470, 10472, 10473, 10474, 10478, 10480, 10488, 10491, 10492, 10494, 10496, 10498, 10501, 10504, 10508, 10514, 10515, 10518, 10521, 10525, 10527, 10528, 10531, 10533, 10535, 10536, 10537, 10541, 10542, 10543, 10544, 10547, 10548, 10549, 10550, 10551, 10555, 10556, 10558, 10560, 10561, 10562, 10565, 10567, 10569, 10571, 10573, 10577, 10580, 10581, 10582, 10583, 10584, 10585, 10587, 10590, 10593, 10595, 10596, 10597, 10599, 10601, 10605, 10610, 10611, 10615, 10616, 10617, 10621, 10622, 10623, 10625, 10626, 10628, 10636, 10637, 10638, 10639, 10640, 10641, 10643, 10645, 10646, 10648, 10649, 10650, 10655, 10657, 10663, 10664, 10665, 10668, 10669, 10670, 10671, 10673, 10674, 10677, 10678, 10681, 10682, 10683, 10684, 10685, 10687, 10689, 10693, 10697, 10698, 10699, 10700, 10702, 10703, 10705, 10707, 10708, 10711, 10712, 10715, 10716, 10721, 10723, 10725, 10726, 10732, 10735, 10736, 10738, 10740, 10744, 10747, 10748, 10749, 10752, 10753, 10754, 10756, 10762, 10763, 10766, 10768, 10771, 10774, 10777, 10778, 10779, 10780, 10782, 10784, 10787, 10788, 10790, 10791, 10792, 10795, 10796, 10798, 10800, 10803, 10804, 10805, 10809, 10810, 10811, 10813, 10815, 10818, 10819, 10820, 10821, 10822, 10823, 10824, 10825, 10826, 10830, 10833, 10836, 10838, 10839, 10840, 10841, 10843, 10850, 10853, 10854, 10856, 10857, 10858, 10860, 10861, 10862, 10863, 10867, 10869, 10871, 10872, 10874, 10877, 10878, 10880, 10881, 10886, 10887, 10892, 10896, 10897, 10898, 10899, 10902, 10903, 10905, 10912, 10913, 10917, 10920, 10926, 10927, 10930, 10933, 10934, 10935, 10936, 10937, 10938, 10940, 10941, 10947, 10948, 10950, 10954, 10957, 10960, 10962, 10965, 10967, 10972, 10975, 10976, 10977, 10980, 10988, 10995, 10996, 10997, 10999, 11002, 11004, 11005, 11006, 11008, 11010, 11015, 11018, 11023, 11024, 11025, 11026, 11027, 11032, 11033, 11039, 11046, 11047, 11049, 11053, 11056, 11058, 11070, 11072, 11078, 11079, 11080, 11082, 11083, 11086, 11090, 11092, 11095, 11098, 11100, 11102, 11107, 11108, 11109, 11110, 11114, 11116, 11117, 11118, 11119, 11123, 11124, 11125, 11127, 11128, 11129, 11132, 11133, 11135, 11137, 11138, 11145, 11146, 11148, 11150, 11151, 11152, 11153, 11154, 11158, 11159, 11160, 11161, 11162, 11163, 11166, 11175, 11177, 11178, 11179, 11180, 11184, 11185, 11187, 11188, 11190, 11191, 11192, 11194, 11198, 11199, 11201, 11202, 11203, 11207, 11210, 11214, 11216, 11217, 11218, 11222, 11226, 11227, 11228, 11229, 11230, 11232, 11233, 11234, 11235, 11237, 11239, 11244, 11246, 11247, 11248, 11251, 11254, 11255, 11256, 11257, 11258, 11259, 11260, 11261, 11262, 11263, 11264, 11266, 11274, 11275, 11278, 11282, 11284, 11288, 11289, 11290, 11291, 11292, 11293, 11294, 11295, 11298, 11306, 11307, 11313, 11315, 11316, 11317, 11318, 11319, 11320, 11322, 11324, 11326, 11328, 11329, 11330, 11331, 11332, 11337, 11339, 11340, 11345, 11346, 11348, 11349, 11352, 11356, 11358, 11359, 11363, 11365, 11366, 11369, 11370, 11373, 11374, 11377, 11379, 11380, 11381, 11382, 11385, 11387, 11388, 11389, 11391, 11392, 11394, 11395, 11397, 11398, 11399, 11403, 11405, 11406, 11408, 11409, 11411, 11412, 11413, 11414, 11416, 11418, 11423, 11428, 11430, 11431, 11433, 11437, 11438, 11446, 11448, 11449, 11458, 11459, 11463, 11465, 11471, 11472, 11473, 11475, 11476, 11478, 11481, 11482, 11487, 11490, 11492, 11496, 11497, 11498, 11500, 11503, 11506, 11507, 11508, 11509, 11512, 11516, 11518, 11520, 11522, 11523, 11524, 11526, 11528, 11530, 11533, 11534, 11538, 11541, 11544, 11546, 11548, 11551, 11553, 11558, 11560, 11561, 11564, 11567, 11568, 11570, 11571, 11574, 11576, 11577, 11578, 11579, 11580, 11585, 11588, 11589, 11593, 11594, 11595, 11596, 11597, 11599, 11603, 11604, 11607, 11610, 11612, 11618, 11620, 11621, 11623, 11624, 11625, 11632, 11633, 11636, 11639, 11642, 11644, 11649, 11650, 11652, 11654, 11655, 11656, 11657, 11658, 11663, 11667, 11668, 11669, 11678, 11680, 11681, 11682, 11683, 11685, 11688, 11691, 11692, 11693, 11694, 11695, 11698, 11701, 11703, 11705, 11707, 11710, 11711, 11712, 11718, 11720, 11721, 11725, 11731, 11733, 11736, 11740, 11743, 11744, 11753, 11755, 11759, 11760, 11761, 11762, 11763, 11764, 11765, 11766, 11767, 11770, 11771, 11773, 11774, 11776, 11780, 11781, 11782, 11783, 11786, 11792, 11795, 11799, 11800, 11809, 11812, 11813, 11816, 11818, 11819, 11820, 11821, 11822, 11826, 11828, 11829, 11830, 11836, 11837, 11839, 11841, 11846, 11847, 11848, 11849, 11850, 11851, 11853, 11856, 11858, 11861, 11863, 11868, 11870, 11872, 11876, 11877, 11881, 11889, 11890, 11891, 11893, 11894, 11895, 11897, 11898, 11899, 11903, 11904, 11909, 11911, 11913, 11918, 11919, 11920, 11921, 11923, 11926, 11927, 11928, 11929, 11930, 11934, 11935, 11940, 11941, 11943, 11945, 11946, 11947, 11948, 11949, 11953, 11955, 11957, 11958, 11959, 11960, 11961, 11962, 11963, 11965, 11968, 11977, 11978, 11979, 11980, 11983, 11988, 11993, 11997, 11998, 11999, 12002, 12004, 12005, 12006, 12014, 12015, 12017, 12018, 12019, 12020, 12021, 12023, 12024, 12025, 12032, 12035, 12040, 12042, 12043, 12044, 12054, 12059, 12060, 12061, 12063, 12068, 12073, 12078, 12079, 12080, 12081, 12083, 12085, 12091, 12093, 12097, 12098, 12102, 12104, 12106, 12109, 12112, 12114, 12115, 12118, 12120, 12122, 12127, 12128, 12129, 12131, 12134, 12135, 12138, 12139, 12144, 12145, 12146, 12147, 12148, 12150, 12151, 12162, 12165, 12166, 12167, 12170, 12171, 12173, 12174, 12175, 12179, 12181, 12192, 12197, 12198, 12202, 12204, 12208, 12212, 12214, 12215, 12217, 12223, 12228, 12229, 12233, 12234, 12237, 12241, 12243, 12245, 12249, 12250, 12252, 12253, 12254, 12255, 12259, 12268, 12271, 12278, 12280, 12283, 12285, 12286, 12287, 12295, 12296, 12302, 12304, 12305, 12306, 12310, 12311, 12312, 12313, 12314, 12317, 12319, 12321, 12323, 12324, 12325, 12326, 12328, 12331, 12333, 12334, 12337, 12339, 12340, 12342, 12343, 12344, 12347, 12350, 12354, 12356, 12359, 12364, 12366, 12368, 12370, 12373, 12374, 12375, 12376, 12379, 12380, 12381, 12383, 12390, 12393, 12394, 12397, 12399, 12400, 12401, 12402, 12403, 12406, 12411, 12414, 12415, 12416, 12417, 12419, 12420, 12423, 12424, 12425, 12426, 12427, 12428, 12437, 12440, 12444, 12445, 12447, 12450, 12451, 12454, 12456, 12457, 12459, 12462, 12465, 12467, 12468, 12470, 12472, 12473, 12476, 12478, 12481, 12482, 12483, 12487, 12488, 12489, 12491, 12492, 12494, 12497, 12499, 12501, 12502, 12503, 12508, 12512, 12513, 12514, 12515, 12518, 12519, 12525, 12527, 12530, 12531, 12535, 12536, 12537, 12539, 12546, 12547, 12551, 12552, 12554, 12555, 12556, 12563, 12565, 12568, 12572, 12577, 12578, 12580, 12583, 12585, 12586, 12588, 12589, 12591, 12594, 12597, 12600, 12603, 12605, 12608, 12609, 12610, 12611, 12616, 12620, 12622, 12623, 12626, 12628, 12629, 12631, 12633, 12634, 12638, 12639, 12640, 12641, 12645, 12648, 12649, 12651, 12652, 12653, 12663, 12664, 12668, 12670, 12671, 12677, 12679, 12683, 12684, 12688, 12689, 12691, 12693, 12695, 12696, 12699, 12701, 12702, 12705, 12706, 12707, 12713, 12714, 12715, 12721, 12722, 12723, 12729, 12731, 12732, 12733, 12735, 12738, 12739, 12740, 12741, 12742, 12744, 12750, 12752, 12753, 12754, 12755, 12758, 12760, 12761, 12763, 12764, 12765, 12766, 12771, 12775, 12777, 12782, 12788, 12790, 12797, 12800, 12801, 12802, 12803, 12804, 12805, 12807, 12808, 12810, 12812, 12817, 12818, 12820, 12822, 12823, 12824, 12826, 12827, 12828, 12830, 12834, 12835, 12836, 12837, 12838, 12839, 12844, 12848, 12849, 12850, 12853, 12861, 12866, 12870, 12873, 12875, 12878, 12882, 12884, 12887, 12891, 12898, 12899, 12900, 12901, 12902, 12903, 12904, 12905, 12908, 12910, 12912, 12913, 12916, 12920, 12921, 12928, 12929, 12931, 12932, 12933, 12934, 12935, 12939, 12942, 12946, 12947, 12950, 12952, 12953, 12956, 12958, 12960, 12961, 12963, 12968, 12969, 12972, 12978, 12983, 12986, 12987, 12988, 12990, 12991, 12999, 13001, 13003, 13004, 13007, 13008, 13009, 13010, 13014, 13015, 13017, 13022, 13023, 13027, 13030, 13031, 13034, 13035, 13036, 13037, 13040, 13041, 13044, 13047, 13049, 13050, 13053, 13054, 13055, 13056, 13059, 13061, 13063, 13064, 13066, 13067, 13069, 13070, 13071, 13075, 13077, 13079, 13081, 13082, 13083, 13085, 13086, 13087, 13099, 13101, 13102, 13105, 13106, 13109, 13110, 13111, 13112, 13114, 13116, 13117, 13118, 13120, 13121, 13122, 13123, 13124, 13125, 13127, 13128, 13131, 13134, 13136, 13142, 13144, 13147, 13148, 13149, 13151, 13154, 13156, 13159, 13160, 13167, 13169, 13175, 13181, 13182, 13186, 13187, 13197, 13198, 13199, 13206, 13209, 13212, 13213, 13217, 13221, 13226, 13228, 13229, 13231, 13232, 13234, 13235, 13236, 13237, 13239, 13241, 13243, 13248, 13250, 13255, 13259, 13260, 13261, 13262, 13263, 13264, 13265, 13267, 13268, 13269, 13271, 13273, 13274, 13281, 13285, 13293, 13295, 13296, 13297, 13298, 13300, 13301, 13303, 13304, 13315, 13316, 13319, 13326, 13328, 13329, 13330, 13332, 13340, 13343, 13344, 13345, 13346, 13347, 13348, 13349, 13350, 13351, 13352, 13353, 13358, 13363, 13367, 13368, 13369, 13370, 13377, 13380, 13381, 13384, 13385, 13386, 13388, 13391, 13393, 13394, 13395, 13396, 13397, 13398, 13401, 13403, 13407, 13408, 13410, 13413, 13414, 13416, 13417, 13419, 13420, 13423, 13424, 13428, 13429, 13430, 13431, 13433, 13439, 13441, 13444, 13446, 13448, 13456, 13460, 13461, 13463, 13467, 13469, 13470, 13473, 13474, 13475, 13477, 13478, 13480, 13489, 13492, 13494, 13499, 13501, 13503, 13507, 13510, 13515, 13518, 13519, 13521, 13522, 13526, 13532, 13533, 13535, 13536, 13539, 13540, 13543, 13544, 13546, 13547, 13549, 13552, 13553, 13556, 13558, 13559, 13560, 13561, 13562, 13565, 13566, 13568, 13569, 13572, 13574, 13575, 13577, 13578, 13579, 13580, 13582, 13584, 13587, 13597, 13598, 13599, 13600, 13601, 13602, 13604, 13605, 13606, 13612, 13613, 13621, 13627, 13628, 13630, 13631, 13632, 13634, 13636, 13637, 13638, 13640, 13641, 13643, 13647, 13649, 13650, 13653, 13660, 13662, 13665, 13669, 13675, 13677, 13678, 13679, 13683, 13687, 13688, 13689, 13693, 13697, 13698, 13699, 13700, 13706, 13710, 13712, 13713, 13714, 13715, 13716, 13719, 13720, 13721, 13729, 13730, 13734, 13736, 13737, 13738, 13739, 13742, 13745, 13747, 13750, 13751, 13753, 13764, 13767, 13768, 13769, 13772, 13773, 13775, 13777, 13779, 13782, 13783, 13785, 13786, 13787, 13791, 13793, 13795, 13796, 13798, 13799, 13802, 13809, 13816, 13817, 13818, 13819, 13820, 13822, 13823, 13828, 13830, 13834, 13835, 13843, 13849, 13852, 13858, 13859, 13860, 13862, 13866, 13869, 13870, 13872, 13873, 13877, 13887, 13891, 13892, 13895, 13897, 13898, 13899, 13901, 13906, 13908, 13909, 13910, 13911, 13914, 13915, 13917, 13918, 13919, 13921, 13923, 13924, 13925, 13927, 13929, 13934, 13938, 13942, 13943, 13944, 13947, 13948, 13950, 13952, 13953, 13954, 13958, 13960, 13961, 13962, 13963, 13969, 13970, 13975, 13976, 13983, 13984, 13985, 13986, 13987, 13988, 13990, 13994, 13999, 14000, 14001, 14002, 14003, 14005, 14006, 14008, 14013, 14014, 14017, 14018, 14022, 14027, 14030, 14031, 14036, 14038, 14040, 14043, 14052, 14059, 14062, 14063, 14066, 14067, 14069, 14070, 14071, 14075, 14078, 14080, 14081, 14083, 14084, 14085, 14086, 14088, 14091, 14092, 14094, 14095, 14096, 14097, 14102, 14105, 14106, 14110, 14111, 14112, 14115, 14116, 14118, 14121, 14122, 14124, 14129, 14130, 14132, 14133, 14137, 14138, 14139, 14142, 14143, 14145, 14146, 14147.

Promoters expressing in the flag leaf (top most leaf) at the tasseling stage of inbred genotype plants grown in the greenhouse: 1, 3, 5, 7, 8, 11, 12, 13, 14, 15, 16, 17, 19, 20, 24, 27, 29, 31, 33, 34, 36, 37, 48, 51, 53, 54, 57, 61, 63, 64, 65, 79, 80, 88, 90, 93, 94, 95, 96, 98, 99, 102, 103, 104, 108, 110, 111, 112, 115, 117, 123, 129, 130, 131, 133, 136, 137, 141, 143, 144, 148, 152, 154, 155, 156, 157, 159, 160, 162, 165, 168, 172, 174, 175, 176, 179, 180, 181, 183, 187, 191, 193, 194, 196, 199, 202, 203, 205, 207, 211, 212, 214, 230, 232, 233, 236, 237, 239, 240, 242, 244, 246, 249, 250, 251, 257, 259, 267, 269, 270, 271, 273, 280, 284, 286, 288, 289, 293, 294, 298, 299, 301, 302, 305, 306, 309, 314, 316, 319, 320, 322, 328, 329, 332, 334, 335, 338, 342, 346, 348, 349, 354, 356, 357, 358, 359, 360, 365, 371, 373, 376, 378, 379, 381, 382, 386, 388, 393, 401, 411, 414, 418, 423, 424, 427, 428, 431, 433, 434, 436, 441, 450, 452, 455, 456, 459, 461, 462, 463, 466, 470, 471, 474, 478, 483, 484, 485, 488, 489, 496, 501, 507, 509, 510, 511, 514, 516, 517, 520, 523, 525, 532, 537, 538, 541, 542, 546, 547, 548, 554, 560, 561, 563, 578, 580, 585, 594, 595, 596, 601, 602, 606, 608, 609, 613, 619, 620, 629, 630, 635, 636, 637, 638, 643, 647, 655, 656, 658, 659, 661, 664, 666, 669, 671, 681, 683, 692, 693, 694, 695, 701, 705, 706, 709, 716, 717, 718, 719, 721, 722, 723, 724, 725, 727, 731, 732, 734, 735, 736, 740, 741, 742, 744, 749, 753, 757, 759, 760, 761, 762, 763, 764, 765, 779, 783, 784, 786, 792, 793, 794, 800, 804, 806, 807, 808, 809, 811, 819, 820, 821, 829, 830, 833, 840, 845, 846, 849, 855, 856, 857, 858, 860, 862, 863, 865, 868, 869, 870, 871, 876, 877, 878, 887, 889, 890, 891, 892, 893, 895, 897, 898, 900, 903, 907, 908, 910, 911, 912, 913, 915, 916, 919, 920, 924, 925, 928, 929, 931, 932, 936, 939, 943, 947, 951, 953, 955, 957, 958, 960, 964, 965, 971, 974, 975, 976, 977, 978, 979, 980, 982, 984, 985, 987, 989, 991, 994, 995, 996, 997, 999, 1005, 1007, 1008, 1009, 1010, 1011, 1012, 1013, 1014, 1016, 1017, 1022, 1025, 1026, 1032, 1033, 1035, 1038, 1039, 1040, 1041, 1042, 1043, 1046, 1047, 1049, 1051, 1052, 1055, 1056, 1057, 1064, 1065, 1068, 1069, 1070, 1073, 1077, 1078, 1085, 1086, 1087, 1089, 1091, 1092, 1095, 1100, 1101, 1103, 1104, 1106, 1110, 1112, 1114, 1115, 1116, 1117, 1119, 1121, 1125, 1130, 1132, 1136, 1137, 1140, 1143, 1144, 1146, 1148, 1153, 1155, 1156, 1160, 1161, 1164, 1165, 1167, 1168, 1170, 1171, 1176, 1178, 1182, 1183, 1187, 1191, 1196, 1198, 1201, 1204, 1205, 1214, 1217, 1218, 1220, 1222, 1223, 1225, 1228, 1231, 1232, 1233, 1235, 1236, 1239, 1240, 1243, 1244, 1248, 1249, 1251, 1254, 1257, 1258, 1259, 1262, 1263, 1269, 1272, 1281, 1285, 1286, 1290, 1292, 1296, 1298, 1303, 1306, 1307, 1309, 1310, 1311, 1312, 1314, 1316, 1317, 1320, 1322, 1323, 1327, 1331, 1334, 1339, 1345, 1346, 1347, 1349, 1354, 1355, 1360, 1361, 1366, 1367, 1368, 1371, 1373, 1375, 1377, 1380, 1381, 1387, 1388, 1389, 1392, 1393, 1394, 1396, 1399, 1404, 1405, 1406, 1412, 1420, 1421, 1422, 1423, 1431, 1432, 1433, 1438, 1439, 1440, 1441, 1442, 1447, 1448, 1451, 1453, 1458, 1459, 1461, 1466, 1467, 1468, 1471, 1484, 1488, 1490, 1491, 1493, 1497, 1499, 1501, 1506, 1508, 1510, 1511, 1512, 1517, 1518, 1519, 1527, 1528, 1530, 1534, 1539, 1540, 1543, 1545, 1547, 1549, 1550, 1551, 1553, 1554, 1555, 1556, 1560, 1564, 1567, 1570, 1571, 1575, 1578, 1579, 1582, 1584, 1585, 1586, 1590, 1596, 1598, 1599, 1600, 1601, 1602, 1604, 1605, 1608, 1609, 1610, 1612, 1614, 1615, 1616, 1617, 1622, 1623, 1625, 1634, 1635, 1636, 1637, 1638, 1639, 1641, 1643, 1651, 1653, 1654, 1658, 1659, 1662, 1663, 1664, 1669, 1671, 1673, 1675, 1677, 1678, 1682, 1684, 1685, 1687, 1688, 1690, 1691, 1696, 1697, 1698, 1699, 1705, 1706, 1707, 1708, 1710, 1716, 1717, 1720, 1725, 1732, 1735, 1736, 1743, 1745, 1749, 1750, 1755, 1759, 1760, 1761, 1764, 1769, 1770, 1773, 1774, 1777, 1785, 1786, 1796, 1798, 1807, 1808, 1809, 1811, 1813, 1814, 1823, 1826, 1828, 1830, 1832, 1834, 1837, 1838, 1839, 1840, 1848, 1850, 1852, 1859, 1861, 1863, 1866, 1868, 1869, 1872, 1873, 1876, 1878, 1879, 1880, 1882, 1886, 1888, 1891, 1897, 1900, 1902, 1905, 1906, 1910, 1911, 1912, 1916, 1918, 1920, 1922, 1923, 1924, 1927, 1933, 1934, 1939, 1940, 1945, 1950, 1951, 1952, 1954, 1958, 1968, 1970, 1971, 1972, 1973, 1976, 1977, 1990, 1991, 1993, 1998, 1999, 2000, 2001, 2003, 2007, 2008, 2010, 2012, 2014, 2015, 2016, 2017, 2019, 2020, 2021, 2023, 2026, 2027, 2031, 2032, 2033, 2034, 2037, 2040, 2041, 2043, 2045, 2048, 2049, 2058, 2060, 2062, 2064, 2071, 2072, 2074, 2077, 2078, 2088, 2089, 2091, 2092, 2093, 2094, 2096, 2097, 2103, 2106, 2111,
2112, 2113, 2116, 2117, 2122, 2123, 2124, 2125, 2126, 2133,
2137, 2139, 2140, 2142, 2143, 2146, 2147, 2150, 2151, 2156,
2157, 2161, 2164, 2166, 2167, 2168, 2170, 2172, 2175, 2177,
2179, 2183, 2185, 2189, 2190, 2193, 2195, 2196, 2200, 2201,
2202, 2203, 2205, 2210, 2213, 2215, 2218, 2220, 2221, 2222,
2226, 2227, 2237, 2240, 2242, 2245, 2252, 2253, 2257, 2259,
2261, 2263, 2266, 2276, 2278, 2280, 2282, 2284, 2289, 2293,
2296, 2297, 2298, 2303, 2305, 2306, 2308, 2309, 2310, 2313,
2314, 2321, 2322, 2323, 2325, 2328, 2329, 2331, 2333, 2337,
2339, 2342, 2343, 2346, 2352, 2353, 2354, 2359, 2360, 2363,
2366, 2367, 2369, 2371, 2376, 2377, 2379, 2381, 2382, 2383,
2384, 2396, 2398, 2401, 2405, 2410, 2413, 2414, 2416, 2417,
2418, 2419, 2420, 2423, 2428, 2430, 2431, 2432, 2433, 2434,
2435, 2437, 2439, 2440, 2441, 2442, 2443, 2445, 2449, 2452,
2453, 2454, 2457, 2458, 2469, 2470, 2472, 2474, 2476, 2480,
2481, 2482, 2485, 2487, 2489, 2490, 2491, 2492, 2495, 2496,
2497, 2498, 2500, 2505, 2506, 2507, 2509, 2513, 2514, 2516,
2517, 2521, 2522, 2525, 2528, 2529, 2531, 2532, 2533, 2538,
2539, 2541, 2543, 2544, 2546, 2547, 2548, 2549, 2551, 2552,
2557, 2560, 2567, 2568, 2570, 2571, 2573, 2578, 2579, 2581,
2584, 2585, 2587, 2588, 2589, 2590, 2594, 2596, 2599, 2601,
2605, 2609, 2611, 2612, 2613, 2614, 2616, 2617, 2619, 2620,
2622, 2625, 2626, 2627, 2632, 2634, 2635, 2636, 2639, 2644,
2645, 2649, 2651, 2652, 2653, 2654, 2656, 2658, 2659, 2660,
2661, 2662, 2663, 2665, 2670, 2672, 2674, 2679, 2680, 2684,
2685, 2688, 2689, 2690, 2691, 2692, 2694, 2700, 2704, 2707,
2708, 2709, 2711, 2719, 2720, 2721, 2722, 2723, 2726, 2728,
2729, 2730, 2735, 2737, 2738, 2739, 2740, 2745, 2746, 2747,
2749, 2752, 2756, 2758, 2759, 2760, 2762, 2764, 2765, 2769,
2770, 2785, 2786, 2787, 2791, 2794, 2798, 2800, 2802, 2805,
2808, 2814, 2816, 2819, 2821, 2822, 2823, 2824, 2826, 2827,
2828, 2831, 2840, 2843, 2845, 2850, 2857, 2859, 2860, 2864,
2865, 2869, 2870, 2871, 2876, 2878, 2879, 2888, 2889, 2892,
2893, 2894, 2895, 2896, 2897, 2901, 2902, 2903, 2906, 2908,
2909, 2912, 2915, 2916, 2917, 2918, 2922, 2923, 2926, 2930,
2931, 2935, 2938, 2941, 2942, 2943, 2946, 2948, 2950, 2955,
2959, 2960, 2963, 2965, 2966, 2968, 2969, 2976, 2979, 2982,
2992, 2994, 3000, 3003, 3005, 3007, 3008, 3009, 3013, 3015,
3017, 3018, 3020, 3023, 3024, 3029, 3031, 3039, 3041, 3042,
3044, 3045, 3047, 3048, 3049, 3050, 3051, 3053, 3055, 3061,
3064, 3067, 3068, 3069, 3072, 3075, 3080, 3083, 3084, 3085,
3087, 3090, 3095, 3100, 3101, 3106, 3107, 3110, 3112, 3113,
3115, 3118, 3119, 3120, 3121, 3123, 3126, 3127, 3128, 3129,
3138, 3139, 3141, 3143, 3145, 3149, 3153, 3157, 3158, 3164,
3167, 3169, 3170, 3171, 3172, 3177, 3181, 3189, 3192, 3194,
3196, 3202, 3205, 3206, 3208, 3210, 3217, 3218, 3220, 3221,
3224, 3225, 3228, 3230, 3231, 3236, 3237, 3240, 3242, 3246,
3247, 3249, 3250, 3252, 3253, 3261, 3263, 3266, 3267, 3268,
3271, 3272, 3280, 3283, 3286, 3288, 3289, 3290, 3291, 3294,
3295, 3299, 3301, 3304, 3310, 3312, 3313, 3324, 3327, 3329,
3331, 3332, 3333, 3337, 3338, 3340, 3342, 3343, 3345, 3346,
3353, 3355, 3357, 3359, 3360, 3361, 3370, 3374, 3378, 3379,
3386, 3394, 3396, 3399, 3402, 3403, 3404, 3405, 3411, 3412,
3413, 3415, 3416, 3418, 3424, 3425, 3426, 3427, 3428, 3429,
3435, 3438, 3440, 3442, 3443, 3445, 3446, 3447, 3449, 3452,
3453, 3458, 3462, 3466, 3468, 3469, 3470, 3471, 3474, 3475,
3477, 3483, 3484, 3486, 3488, 3490, 3493, 3499, 3500, 3501,
3502, 3503, 3504, 3506, 3507, 3510, 3516, 3517, 3518, 3520,
3523, 3524, 3529, 3533, 3535, 3536, 3537, 3538, 3540, 3541,
3544, 3545, 3548, 3549, 3551, 3554, 3556, 3557, 3560, 3562,
3563, 3569, 3571, 3574, 3576, 3580, 3587, 3588, 3589, 3591,
3592, 3594, 3595, 3600, 3603, 3604, 3606, 3607, 3610, 3611,
3613, 3615, 3616, 3618, 3619, 3620, 3621, 3624, 3625, 3627,
3628, 3630, 3631, 3633, 3634, 3640, 3642, 3643, 3644, 3645,
3646, 3648, 3650, 3654, 3655, 3659, 3660, 3661, 3667, 3669,
3671, 3672, 3673, 3674, 3677, 3682, 3684, 3685, 3690, 3698,
3702, 3706, 3707, 3709, 3710, 3713, 3715, 3717, 3718, 3719,
3721, 3722, 3725, 3730, 3731, 3738, 3739, 3744, 3748, 3749,
3752, 3756, 3761, 3764, 3766, 3772, 3773, 3775, 3777, 3778,
3783, 3790, 3791, 3792, 3793, 3801, 3805, 3806, 3808, 3812,
3817, 3818, 3819, 3823, 3830, 3831, 3832, 3833, 3837, 3838,
3839, 3843, 3844, 3846, 3847, 3849, 3858, 3859, 3860, 3866,
3867, 3868, 3870, 3871, 3872, 3873, 3875, 3876, 3883, 3884,
3887, 3889, 3890, 3892, 3894, 3895, 3896, 3898, 3899, 3902,
3903, 3904, 3908, 3912, 3913, 3917, 3918, 3923, 3924, 3926,
3928, 3929, 3933, 3934, 3937, 3938, 3940, 3941, 3947, 3950,
3954, 3955, 3958, 3959, 3962, 3964, 3967, 3968, 3970, 3971,
3972, 3974, 3975, 3978, 3983, 3987, 3988, 3991, 3995, 3996,
3997, 4000, 4007, 4008, 4013, 4014, 4026, 4030, 4033, 4037,
4039, 4040, 4041, 4042, 4043, 4044, 4046, 4047, 4048, 4049,
4050, 4053, 4054, 4056, 4057, 4062, 4068, 4070, 4084, 4087,
4088, 4092, 4094, 4096, 4098, 4099, 4103, 4105, 4106, 4109,
4110, 4111, 4113, 4124, 4126, 4128, 4131, 4132, 4133, 4134,
4135, 4140, 4143, 4144, 4145, 4149, 4150, 4154, 4155, 4158,
4160, 4161, 4162, 4163, 4164, 4165, 4166, 4167, 4168, 4171,
4173, 4175, 4176, 4178, 4181, 4183, 4185, 4187, 4188, 4189,
4190, 4191, 4193, 4195, 4200, 4201, 4202, 4204, 4205, 4206,
4207, 4210, 4211, 4212, 4213, 4219, 4221, 4227, 4228, 4233,
4235, 4237, 4245, 4246, 4247, 4251, 4257, 4260, 4261, 4266,
4270, 4272, 4275, 4276, 4280, 4281, 4284, 4290, 4294, 4296,
4301, 4302, 4305, 4306, 4309, 4312, 4317, 4320, 4321, 4324,
4329, 4330, 4333, 4335, 4339, 4344, 4347, 4352, 4354, 4358,
4359, 4360, 4369, 4370, 4374, 4378, 4380, 4383, 4388, 4390,
4391, 4393, 4396, 4397, 4401, 4402, 4403, 4404, 4405, 4410,
4421, 4422, 4423, 4430, 4432, 4436, 4439, 4440, 4442, 4443,
4448, 4449, 4450, 4453, 4456, 4457, 4461, 4462, 4463, 4466,
4467, 4468, 4470, 4474, 4475, 4479, 4486, 4492, 4494, 4498,
4500, 4502, 4507, 4508, 4509, 4512, 4514, 4519, 4521, 4522,
4524, 4529, 4531, 4535, 4543, 4548, 4549, 4551, 4554, 4555,
4556, 4557, 4558, 4563, 4565, 4566, 4567, 4568, 4575, 4580,
4582, 4583, 4590, 4591, 4594, 4597, 4598, 4601, 4606, 4614,
4616, 4618, 4623, 4625, 4628, 4632, 4635, 4639, 4641, 4643,
4644, 4645, 4646, 4647, 4650, 4653, 4654, 4655, 4656, 4657,
4658, 4659, 4662, 4667, 4669, 4671, 4672, 4673, 4674, 4676,
4677, 4680, 4682, 4684, 4685, 4690, 4691, 4692, 4696, 4697,
4699, 4700, 4701, 4703, 4705, 4706, 4710, 4711, 4713, 4715,
4719, 4721, 4722, 4724, 4725, 4727, 4728, 4729, 4734, 4736,
4737, 4738, 4739, 4740, 4745, 4748, 4749, 4753, 4754, 4755,
4756, 4761, 4762, 4763, 4767, 4769, 4770, 4771, 4773, 4775,
4779, 4780, 4781, 4783, 4784, 4787, 4788, 4789, 4790, 4795,
4796, 4800, 4801, 4803, 4804, 4805, 4806, 4807, 4813, 4816,
4817, 4818, 4820, 4822, 4828, 4830, 4831, 4834, 4836, 4837,
4841, 4845, 4847, 4851, 4854, 4855, 4856, 4857, 4861, 4862,
4863, 4867, 4869, 4874, 4875, 4876, 4878, 4880, 4881, 4887,
4889, 4891, 4897, 4900, 4904, 4905, 4907, 4909, 4910, 4912,
4913, 4914, 4918, 4920, 4921, 4923, 4924, 4931, 4936, 4938,
4941, 4943, 4947, 4953, 4954, 4955, 4958, 4959, 4967, 4969,
4971, 4972, 4974, 4975, 4981, 4984, 4985, 4988, 4989, 4990,
4991, 4993, 4994, 4996, 5007, 5011, 5015, 5016, 5021, 5022,
5023, 5024, 5026, 5029, 5030, 5034, 5036, 5037, 5039, 5040,
5042, 5044, 5046, 5049, 5052, 5054, 5057, 5060, 5061, 5067,
5068, 5072, 5074, 5078, 5082, 5084, 5088, 5089, 5090, 5091,
5094, 5099, 5100, 5101, 5102, 5106, 5110, 5111, 5113, 5114,
5116, 5119, 5120, 5122, 5123, 5131, 5132, 5136, 5137, 5140,
5143, 5144, 5145, 5146, 5147, 5150, 5151, 5157, 5159, 5160,
5164, 5165, 5166, 5168, 5170, 5174, 5175, 5177, 5178, 5180,
5181, 5182, 5184, 5185, 5187, 5188, 5189, 5190, 5191, 5192,
5193, 5198, 5200, 5202, 5206, 5209, 5212, 5213, 5216, 5217,
5218, 5219, 5225, 5229, 5230, 5234, 5236, 5240, 5241, 5243,
5251, 5253, 5255, 5256, 5257, 5258, 5260, 5261, 5263, 5268,
5269, 5273, 5275, 5276, 5280, 5281, 5283, 5286, 5293, 5297,
5298, 5299, 5300, 5301, 5308, 5311, 5314, 5315, 5317, 5319,
5324, 5329, 5330, 5332, 5334, 5339, 5341, 5342, 5345, 5346, 5348, 5349, 5350, 5351, 5352, 5356, 5361, 5366, 5367, 5369, 5371, 5379, 5386, 5388, 5389, 5391, 5393, 5396, 5402, 5405, 5411, 5414, 5416, 5417, 5418, 5422, 5427, 5428, 5430, 5431, 5432, 5434, 5437, 5438, 5445, 5446, 5448, 5449, 5452, 5453, 5456, 5458, 5459, 5461, 5462, 5475, 5476, 5481, 5483, 5485, 5488, 5491, 5493, 5495, 5496, 5497, 5502, 5503, 5505, 5506, 5508, 5510, 5512, 5513, 5515, 5518, 5519, 5524, 5526, 5529, 5530, 5531, 5532, 5534, 5535, 5543, 5545, 5549, 5554, 5558, 5559, 5562, 5563, 5564, 5566, 5568, 5569, 5572, 5575, 5579, 5581, 5582, 5584, 5585, 5586, 5589, 5593, 5594, 5596, 5597, 5602, 5608, 5612, 5613, 5614, 5616, 5620, 5621, 5627, 5633, 5635, 5638, 5640, 5643, 5647, 5648, 5649, 5650, 5651, 5653, 5657, 5659, 5660, 5663, 5664, 5667, 5669, 5670, 5671, 5677, 5680, 5681, 5689, 5690, 5694, 5695, 5697, 5698, 5700, 5702, 5706, 5709, 5711, 5712, 5713, 5718, 5719, 5721, 5722, 5723, 5729, 5730, 5731, 5732, 5734, 5735, 5736, 5737, 5742, 5744, 5751, 5764, 5768, 5770, 5773, 5775, 5778, 5780, 5783, 5784, 5785, 5787, 5791, 5792, 5794, 5807, 5808, 5810, 5811, 5817, 5819, 5820, 5824, 5825, 5828, 5833, 5834, 5835, 5836, 5837, 5839, 5842, 5852, 5853, 5856, 5858, 5859, 5861, 5864, 5866, 5867, 5869, 5871, 5872, 5877, 5878, 5879, 5881, 5882, 5883, 5884, 5888, 5889, 5892, 5893, 5900, 5901, 5902, 5905, 5910, 5912, 5918, 5919, 5921, 5925, 5926, 5927, 5930, 5931, 5932, 5933, 5938, 5941, 5942, 5943, 5944, 5945, 5946, 5948, 5950, 5951, 5954, 5956, 5957, 5959, 5961, 5967, 5968, 5971, 5975, 5978, 5979, 5980, 5984, 5985, 5986, 5988, 5990, 5991, 5992, 5994, 5996, 5997, 6000, 6002, 6003, 6006, 6007, 6008, 6012, 6013, 6016, 6018, 6020, 6021, 6023, 6025, 6026, 6028, 6031, 6038, 6040, 6041, 6044, 6047, 6048, 6051, 6054, 6058, 6059, 6060, 6061, 6062, 6063, 6068, 6069, 6070, 6072, 6073, 6074, 6075, 6077, 6080, 6082, 6088, 6089, 6090, 6092, 6093, 6094, 6095, 6096, 6098, 6107, 6108, 6109, 6110, 6112, 6116, 6118, 6119, 6122, 6125, 6129, 6130, 6132, 6133, 6135, 6136, 6137, 6143, 6145, 6146, 6147, 6148, 6149, 6151, 6152, 6153, 6155, 6156, 6158, 6163, 6164, 6165, 6168, 6171, 6173, 6178, 6180, 6181, 6182, 6183, 6186, 6188, 6189, 6190, 6191, 6193, 6197, 6198, 6200, 6203, 6205, 6206, 6207, 6209, 6212, 6213, 6220, 6221, 6223, 6224, 6226, 6227, 6228, 6230, 6231, 6237, 6238, 6240, 6241, 6243, 6245, 6246, 6247, 6249, 6250, 6251, 6255, 6257, 6258, 6259, 6260, 6264, 6265, 6269, 6270, 6271, 6272, 6273, 6278, 6279, 6280, 6282, 6286, 6287, 6288, 6289, 6291, 6292, 6294, 6296, 6299, 6300, 6302, 6303, 6309, 6310, 6315, 6317, 6319, 6321, 6322, 6326, 6328, 6333, 6338, 6345, 6350, 6351, 6352, 6353, 6354, 6356, 6358, 6359, 6360, 6362, 6363, 6364, 6365, 6367, 6370, 6372, 6375, 6378, 6381, 6387, 6394, 6396, 6397, 6398, 6399, 6403, 6405, 6407, 6408, 6412, 6414, 6415, 6419, 6420, 6422, 6426, 6429, 6430, 6431, 6434, 6436, 6437, 6440, 6448, 6450, 6452, 6454, 6458, 6459, 6463, 6464, 6466, 6467, 6468, 6469, 6470, 6471, 6474, 6477, 6478, 6480, 6484, 6486, 6488, 6495, 6497, 6499, 6500, 6501, 6502, 6504, 6505, 6506, 6514, 6515, 6517, 6519, 6523, 6524, 6525, 6530, 6533, 6534, 6537, 6541, 6543, 6544, 6547, 6548, 6549, 6554, 6558, 6560, 6561, 6563, 6564, 6570, 6572, 6574, 6576, 6577, 6579, 6581, 6582, 6584, 6587, 6595, 6596, 6597, 6599, 6605, 6607, 6610, 6611, 6614, 6620, 6621, 6624, 6626, 6627, 6628, 6629, 6630, 6634, 6635, 6637, 6638, 6639, 6643, 6644, 6646, 6647, 6649, 6652, 6654, 6655, 6656, 6662, 6666, 6671, 6672, 6676, 6678, 6681, 6689, 6691, 6692, 6695, 6696, 6703, 6705, 6706, 6711, 6714, 6716, 6718, 6720, 6724, 6725, 6729, 6730, 6731, 6733, 6734, 6736, 6739, 6746, 6747, 6753, 6756, 6757, 6759, 6761, 6764, 6766, 6778, 6779, 6780, 6782, 6786, 6787, 6788, 6791, 6792, 6793, 6794, 6797, 6799, 6803, 6804, 6805, 6807, 6810, 6811, 6812, 6813, 6816, 6817, 6819, 6820, 6821, 6824, 6827, 6828, 6831, 6834, 6840, 6841, 6842, 6843, 6845, 6847, 6848, 6850, 6851, 6852, 6859, 6863, 6864, 6867, 6869, 6872, 6874, 6875, 6876, 6877, 6878, 6879, 6880, 6886, 6888, 6897, 6903, 6906, 6909, 6913, 6914, 6915, 6917, 6919, 6921, 6922, 6923, 6924, 6930, 6933, 6935, 6936, 6941, 6944, 6946, 6948, 6950, 6951, 6952, 6959, 6960, 6961, 6967, 6969, 6971, 6979, 6980, 6984, 6985, 6987, 6990, 6994, 6997, 6999, 7002, 7003, 7005, 7006, 7009, 7012, 7013, 7015, 7016, 7019, 7020, 7022, 7025, 7031, 7032, 7042, 7043, 7050, 7051, 7052, 7053, 7056, 7057, 7064, 7067, 7072, 7074, 7075, 7077, 7079, 7083, 7084, 7085, 7086, 7094, 7097, 7105, 7107, 7108, 7113, 7116, 7117, 7118, 7124, 7126, 7129, 7130, 7132, 7135, 7138, 7139, 7140, 7142, 7144, 7146, 7149, 7151, 7155, 7164, 7169, 7170, 7171, 7176, 7177, 7182, 7183, 7184, 7187, 7188, 7192, 7194, 7195, 7196, 7197, 7201, 7202, 7203, 7206, 7207, 7209, 7211, 7212, 7213, 7214, 7215, 7216, 7217, 7218, 7220, 7221, 7226, 7227, 7228, 7232, 7233, 7234, 7236, 7239, 7243, 7244, 7245, 7248, 7249, 7250, 7255, 7257, 7258, 7259, 7262, 7267, 7268, 7269, 7270, 7274, 7275, 7277, 7281, 7282, 7284, 7287, 7288, 7290, 7291, 7292, 7293, 7298, 7300, 7301, 7305, 7307, 7308, 7310, 7313, 7315, 7317, 7321, 7328, 7330, 7331, 7334, 7338, 7340, 7343, 7344, 7345, 7350, 7351, 7353, 7354, 7355, 7356, 7357, 7358, 7363, 7365, 7371, 7373, 7375, 7379, 7380, 7383, 7388, 7389, 7392, 7395, 7396, 7398, 7399, 7400, 7401, 7409, 7411, 7415, 7417, 7425, 7428, 7430, 7433, 7434, 7435, 7436, 7443, 7444, 7446, 7447, 7448, 7452, 7453, 7454, 7458, 7459, 7464, 7465, 7466, 7470, 7479, 7483, 7484, 7486, 7490, 7492, 7493, 7502, 7504, 7505, 7506, 7512, 7515, 7517, 7523, 7524, 7528, 7533, 7537, 7538, 7544, 7545, 7546, 7547, 7549, 7556, 7557, 7561, 7563, 7570, 7574, 7578, 7580, 7585, 7586, 7591, 7594, 7596, 7598, 7605, 7611, 7613, 7619, 7620, 7621, 7623, 7624, 7632, 7633, 7638, 7639, 7642, 7652, 7655, 7658, 7661, 7663, 7665, 7666, 7667, 7672, 7674, 7676, 7677, 7678, 7679, 7680, 7682, 7684, 7685, 7689, 7691, 7692, 7695, 7697, 7699, 7700, 7702, 7703, 7704, 7708, 7712, 7713, 7716, 7719, 7724, 7725, 7729, 7733, 7734, 7736, 7737, 7738, 7740, 7744, 7745, 7747, 7750, 7751, 7753, 7754, 7761, 7762, 7763, 7764, 7768, 7769, 7770, 7774, 7775, 7777, 7778, 7779, 7781, 7782, 7785, 7786, 7788, 7791, 7793, 7796, 7798, 7803, 7804, 7807, 7812, 7815, 7820, 7824, 7825, 7832, 7833, 7834, 7838, 7840, 7841, 7844, 7847, 7848, 7849, 7854, 7856, 7859, 7860, 7862, 7863, 7865, 7873, 7875, 7876, 7878, 7881, 7888, 7890, 7896, 7900, 7901, 7907, 7908, 7910, 7911, 7918, 7923, 7925, 7929, 7933, 7934, 7935, 7936, 7937, 7938, 7942, 7944, 7945, 7946, 7947, 7948, 7949, 7950, 7955, 7956, 7971, 7972, 7974, 7976, 7977, 7978, 7979, 7980, 7982, 7983, 7984, 7986, 7988, 7989, 7990, 7991, 7993, 8000, 8002, 8004, 8005, 8006, 8007, 8012, 8020, 8021, 8026, 8029, 8041, 8042, 8043, 8044, 8045, 8047, 8048, 8049, 8052, 8053, 8056, 8058, 8059, 8063, 8065, 8066, 8067, 8068, 8070, 8073, 8075, 8076, 8077, 8078, 8080, 8082, 8083, 8084, 8087, 8088, 8091, 8093, 8095, 8097, 8099, 8100, 8103, 8105, 8106, 8109, 8112, 8116, 8118, 8121, 8124, 8126, 8129, 8136, 8137, 8145, 8146, 8150, 8151, 8159, 8162, 8163, 8165, 8169, 8170, 8176, 8178, 8182, 8189, 8193, 8195, 8196, 8199, 8202, 8204, 8207, 8208, 8211, 8213, 8216, 8219, 8220, 8222, 8225, 8227, 8234, 8236, 8237, 8239, 8241, 8242, 8244, 8245, 8249, 8250, 8252, 8253, 8264, 8266, 8269, 8270, 8272, 8274, 8275, 8282, 8288, 8289, 8291, 8293, 8294, 8296, 8297, 8300, 8301, 8304, 8305, 8306, 8310, 8311, 8312, 8318, 8319, 8320, 8321, 8322, 8329, 8336, 8339, 8340, 8343, 8349, 8350, 8351, 8352, 8353, 8354, 8355, 8361, 8363, 8367, 8368, 8373, 8376, 8378, 8379, 8384, 8385, 8386, 8387, 8389, 8392, 8393, 8395, 8401, 8402, 8403, 8404, 8405, 8410, 8412, 8413, 8414, 8416, 8417, 8418, 8423, 8427, 8428, 8429, 8433, 8435, 8436, 8438, 8439, 8441, 8442, 8444, 8446, 8447, 8448, 8450, 8451, 8452, 8457, 8458, 8459, 8472, 8473, 8474, 8476, 8477, 8478, 8480, 8481, 8482, 8485, 8486, 8490, 8493, 8498, 8501, 8502, 8503, 8505, 8511, 8513, 8515, 8517, 8523, 8524, 8525, 8528, 8531, 8532, 8533, 8537, 8538, 8539, 8541, 8542, 8544, 8549, 8550, 8552, 8553, 8554, 8557, 8561, 8563, 8565, 8566, 8568, 8576, 8581, 8582, 8583, 8588, 8589, 8590, 8592, 8593, 8594, 8596, 8597, 8598, 8599, 8600, 8601, 8602, 8603, 8605, 8610, 8611, 8612, 8614, 8617, 8618, 8624, 8630, 8631, 8634, 8638, 8640, 8642, 8644, 8648, 8654, 8657, 8658, 8659, 8663, 8665, 8669, 8672, 8685, 8693, 8700, 8703, 8706, 8708, 8709, 8713, 8714, 8715, 8716, 8717, 8719, 8720, 8721, 8722, 8729, 8731, 8732, 8734, 8735, 8736, 8741, 8744, 8746, 8748, 8752, 8757, 8758, 8767, 8769, 8770, 8771, 8772, 8773, 8775, 8776, 8777, 8779, 8782, 8783, 8784, 8785, 8789, 8790, 8792, 8797, 8803, 8804, 8805, 8808, 8810, 8816, 8818, 8822, 8824, 8831, 8832, 8833, 8835, 8838, 8841, 8842, 8843, 8846, 8847, 8853, 8861, 8862, 8867, 8874, 8876, 8878, 8881, 8883, 8886, 8888, 8889, 8891, 8892, 8897, 8899, 8900, 8901, 8902, 8905, 8907, 8908, 8909, 8910, 8911, 8913, 8914, 8916, 8917, 8922, 8926, 8928, 8929, 8935, 8938, 8940, 8941, 8942, 8945, 8946, 8949, 8951, 8954, 8957, 8960, 8961, 8962, 8967, 8968, 8969, 8972, 8974, 8976, 8977, 8979, 8980, 8981, 8984, 8985, 8986, 8991, 8992, 8996, 8998, 8999, 9001, 9002, 9003, 9006, 9009, 9012, 9013, 9015, 9016, 9020, 9022, 9025, 9029, 9030, 9033, 9037, 9044, 9050, 9052, 9057, 9058, 9059, 9060, 9061, 9062, 9066, 9069, 9071, 9073, 9074, 9076, 9084, 9088, 9091, 9092, 9095, 9096, 9105, 9108, 9110, 9112, 9114, 9115, 9116, 9118, 9119, 9120, 9123, 9125, 9129, 9131, 9133, 9134, 9136, 9138, 9139, 9140, 9141, 9142, 9146, 9149, 9151, 9152, 9154, 9172, 9173, 9174, 9175, 9177, 9179, 9181, 9183, 9185, 9187, 9188, 9190, 9195, 9196, 9200, 9206, 9207, 9210, 9211, 9213, 9215, 9216, 9217, 9218, 9221, 9223, 9226, 9229, 9233, 9234, 9237, 9241, 9243, 9247, 9249, 9252, 9255, 9257, 9263, 9265, 9267, 9269, 9270, 9273, 9276, 9278, 9282, 9283, 9284, 9285, 9288, 9289, 9290, 9291, 9292, 9293, 9299, 9302, 9304, 9308, 9311, 9313, 9320, 9321, 9323, 9325, 9326, 9327, 9328, 9329, 9330, 9333, 9336, 9337, 9338, 9339, 9340, 9341, 9345, 9346, 9347, 9348, 9349, 9350, 9353, 9354, 9355, 9359, 9366, 9367, 9373, 9375, 9376, 9378, 9382, 9383, 9388, 9389, 9391, 9392, 9393, 9394, 9396, 9400, 9402, 9403, 9404, 9406, 9407, 9413, 9415, 9419, 9422, 9423, 9432, 9433, 9439, 9442, 9444, 9451, 9452, 9453, 9456, 9460, 9468, 9471, 9472, 9473, 9478, 9483, 9487, 9488, 9490, 9494, 9495, 9497, 9500, 9501, 9502, 9503, 9504, 9505, 9509, 9513, 9514, 9515, 9517, 9518, 9519, 9521, 9522, 9525, 9533, 9534, 9536, 9540, 9543, 9545, 9546, 9548, 9549, 9553, 9555, 9560, 9563, 9564, 9565, 9567, 9568, 9571, 9575, 9577, 9579, 9582, 9583, 9586, 9587, 9589, 9590, 9591, 9592, 9602, 9606, 9608, 9609, 9610, 9613, 9615, 9620, 9623, 9626, 9628, 9629, 9630, 9633, 9635, 9638, 9640, 9641, 9642, 9644, 9645, 9646, 9648, 9649, 9650, 9653, 9655, 9657, 9658, 9659, 9660, 9663, 9666, 9668, 9670, 9681, 9682, 9685, 9686, 9692, 9695, 9696, 9698, 9706, 9708, 9710, 9711, 9717, 9718, 9722, 9723, 9725, 9726, 9727, 9730, 9731, 9732, 9733, 9734, 9737, 9738, 9744, 9745, 9746, 9750, 9751, 9753, 9754, 9756, 9762, 9763, 9764, 9767, 9768, 9770, 9772, 9776, 9777, 9780, 9781, 9782, 9784, 9786, 9792, 9794, 9798, 9799, 9801, 9806, 9809, 9813, 9816, 9819, 9820, 9825, 9827, 9833, 9835, 9836, 9845, 9846, 9847, 9849, 9851, 9853, 9854, 9861, 9864, 9866, 9869, 9873, 9876, 9882, 9886, 9888, 9892, 9893, 9894, 9897, 9898, 9900, 9901, 9906, 9907, 9908, 9909, 9910, 9911, 9912, 9918, 9923, 9928, 9930, 9938, 9940, 9944, 9946, 9947, 9950, 9953, 9955, 9960, 9962, 9967, 9971, 9972, 9974, 9979, 9980, 9982, 9984, 9985, 9988, 9990, 9996, 9997, 9998, 10000, 10007, 10008, 10009, 10010, 10013, 10017, 10018, 10019, 10021, 10026, 10031, 10033, 10037, 10038, 10045, 10047, 10048, 10049, 10050, 10051, 10052, 10054, 10056, 10058, 10059, 10060, 10062, 10063, 10064, 10068, 10072, 10076, 10077, 10078, 10083, 10086, 10087, 10089, 10090, 10091, 10092, 10095, 10097, 10098, 10101, 10102, 10103, 10105, 10106, 10107, 10108, 10109, 10110, 10112, 10114, 10122, 10127, 10128, 10131, 10132, 10135, 10136, 10137, 10138, 10143, 10146, 10149, 10151, 10152, 10158, 10163, 10165, 10166, 10168, 10169, 10170, 10174, 10176, 10178, 10179, 10181, 10182, 10192, 10193, 10194, 10195, 10197, 10199, 10203, 10206, 10207, 10209, 10214, 10218, 10219, 10220, 10222, 10223, 10224, 10225, 10228, 10230, 10231, 10233, 10236, 10237, 10240, 10247, 10252, 10255, 10258, 10259, 10260, 10273, 10275, 10284, 10286, 10291, 10292, 10293, 10295, 10296, 10297, 10300, 10302, 10306, 10307, 10311, 10318, 10321, 10322, 10323, 10325, 10326, 10327, 10328, 10329, 10330, 10331, 10333, 10334, 10335, 10336, 10342, 10343, 10344, 10345, 10346, 10352, 10353, 10356, 10357, 10359, 10360, 10362, 10364, 10368, 10373, 10375, 10380, 10381, 10382, 10384, 10385, 10389, 10392, 10397, 10398, 10399, 10401, 10405, 10410, 10411, 10413, 10414, 10416, 10421, 10422, 10423, 10425, 10427, 10429, 10430, 10435, 10437, 10438, 10447, 10448, 10449, 10450, 10451, 10452, 10453, 10455, 10456, 10463, 10464, 10465, 10468, 10469, 10470, 10472, 10473, 10474, 10478, 10480, 10488, 10490, 10492, 10494, 10496, 10498, 10501, 10504, 10508, 10514, 10518, 10525, 10527, 10528, 10531, 10533, 10535, 10536, 10537, 10541, 10542, 10543, 10544, 10547, 10548, 10549, 10550, 10551, 10555, 10556, 10558, 10560, 10561, 10562, 10565, 10567, 10569, 10571, 10573, 10577, 10580, 10581, 10582, 10583, 10584, 10585, 10590, 10593, 10595, 10596, 10597, 10599, 10601, 10602, 10605, 10610, 10611, 10615, 10616, 10617, 10621, 10622, 10623, 10626, 10628, 10636, 10637, 10638, 10639, 10640, 10641, 10643, 10645, 10646, 10648, 10649, 10650, 10655, 10657, 10663, 10664, 10665, 10668, 10669, 10670, 10671, 10673, 10674, 10678, 10681, 10682, 10683, 10684, 10685, 10687, 10689, 10693, 10697, 10698, 10699, 10700, 10702, 10703, 10705, 10707, 10711, 10712, 10715, 10716, 10721, 10723, 10725, 10726, 10732, 10734, 10735, 10736, 10738, 10740, 10744, 10747, 10748, 10749, 10752, 10753, 10754, 10762, 10763, 10766, 10771, 10774, 10777, 10778, 10779, 10780, 10782, 10784, 10787, 10788, 10790, 10791, 10792, 10795, 10796, 10798, 10801, 10802, 10803, 10804, 10805, 10809, 10810, 10811, 10815, 10818, 10819, 10820, 10821, 10823, 10824, 10825, 10826, 10830, 10833, 10836, 10838, 10839, 10840, 10841, 10843, 10850, 10851, 10853, 10854, 10856, 10857, 10858, 10860, 10861, 10862, 10863, 10867, 10869, 10871, 10872, 10874, 10877, 10878, 10880, 10881, 10886, 10887, 10892, 10896, 10897, 10898, 10899, 10902, 10903, 10905, 10912, 10913, 10917, 10920, 10926, 10927, 10930, 10933, 10934, 10935, 10936, 10937, 10938, 10940, 10941, 10947, 10948, 10950, 10954, 10957, 10960, 10962, 10965, 10966, 10967, 10972, 10975, 10976, 10977, 10980, 10985, 10995, 10996, 10997, 10999, 11002, 11004, 11005, 11006, 11008, 11010, 11015, 11018, 11023, 11024, 11025, 11027, 11032, 11033, 11039, 11046, 11047, 11049, 11053, 11056, 11058, 11066, 11070, 11072, 11078, 11079, 11080, 11082, 11083, 11086, 11090, 11092, 11095, 11098, 11102, 11107, 11108, 11109, 11110, 11114, 11116, 11117, 11118, 11119, 11123, 11124, 11125, 11127, 11128, 11129, 11132, 11133, 11135, 11137, 11138, 11145, 11146, 11148, 11150, 11151, 11152, 11153, 11154, 11158, 11159, 11160, 11161, 11162, 11163, 11166, 11169, 11175, 11177, 11179, 11180, 11184, 11185, 11187, 11188, 11190, 11191, 11192, 11194, 11198, 11199, 11201, 11202, 11207, 11210, 11214, 11217, 11218, 11222, 11226, 11227, 11228, 11229, 11230, 11232, 11233, 11234, 11235, 11236, 11237, 11238, 11239, 11244, 11246, 11247, 11248, 11251, 11254, 11255, 11256, 11257, 11258, 11259, 11260, 11261, 11262, 11263, 11264, 11266, 11274, 11275, 11278, 11282, 11284, 11288, 11289, 11290, 11291, 11292, 11293, 11294, 11295, 11298, 11306, 11307, 11313, 11315, 11316, 11318, 11319, 11320, 11322, 11324, 11326, 11328, 11329, 11330, 11331, 11332, 11337, 11339, 11340, 11345, 11346, 11348, 11349, 11352, 11356, 11358, 11359, 11363, 11365, 11366, 11369, 11370, 11371, 11373, 11374, 11377, 11380, 11381, 11382, 11385, 11387, 11388, 11389, 11391, 11392, 11394, 11395, 11397, 11398, 11403, 11405, 11406, 11408, 11409, 11411, 11412, 11413, 11414, 11416, 11418, 11423, 11428, 11430, 11431, 11433, 11434, 11437, 11438, 11446, 11448, 11449, 11458, 11459, 11463, 11465, 11467, 11471, 11472, 11473, 11476, 11478, 11481, 11482, 11487, 11490, 11492, 11496, 11497, 11498, 11500, 11503, 11506, 11507, 11508, 11509, 11512, 11516, 11518, 11520, 11521, 11522, 11523, 11524, 11526, 11528, 11530, 11533, 11534, 11538, 11541, 11544, 11546, 11548, 11551, 11553, 11558, 11560, 11561, 11567, 11568, 11570, 11576, 11577, 11578, 11580, 11585, 11588, 11589, 11593, 11594, 11595, 11596, 11597, 11599, 11603, 11604, 11607, 11610, 11612, 11618, 11620, 11621, 11623, 11624, 11625, 11627, 11632, 11633, 11636, 11639, 11642, 11644, 11649, 11650, 11652, 11654, 11655, 11656, 11657, 11658, 11663, 11667, 11668, 11669, 11678, 11681, 11682, 11683, 11685, 11688, 11691, 11692, 11693, 11694, 11695, 11698, 11701, 11703, 11705, 11707, 11710, 11711, 11712, 11718, 11720, 11721, 11725, 11731, 11733, 11736, 11740, 11743, 11744, 11753, 11755, 11759, 11760, 11761, 11762, 11763, 11764, 11765, 11766, 11767, 11770, 11771, 11774, 11776, 11780, 11781, 11782, 11783, 11784, 11785, 11786, 11792, 11795, 11799, 11800, 11804, 11809, 11812, 11813, 11816, 11818, 11819, 11821, 11822, 11826, 11828, 11830, 11831, 11832, 11836, 11837, 11839, 11841, 11842, 11846, 11847, 11849, 11850, 11851, 11853, 11856, 11858, 11860, 11861, 11863, 11868, 11870, 11872, 11876, 11877, 11881, 11889, 11890, 11891, 11894, 11895, 11898, 11899, 11903, 11904, 11909, 11913, 11918, 11919, 11920, 11921, 11923, 11926, 11927, 11928, 11929, 11930, 11934, 11935, 11940, 11941, 11943, 11944, 11946, 11947, 11948, 11949, 11950, 11953, 11955, 11957, 11958, 11959, 11960, 11961, 11962, 11963, 11965, 11968, 11977, 11978, 11979, 11980, 11983, 11988, 11993, 11997, 11998, 11999, 12002, 12004, 12005, 12006, 12014, 12015, 12017, 12018, 12019, 12020, 12021, 12023, 12024, 12025, 12032, 12042, 12043, 12044, 12054, 12059, 12060, 12061, 12063, 12068, 12073, 12078, 12079, 12080, 12081, 12083, 12085, 12091, 12092, 12093, 12097, 12098, 12102, 12104, 12106, 12109, 12112, 12115, 12118, 12120, 12122, 12127, 12128, 12129, 12131, 12134, 12135, 12138, 12139, 12144, 12145, 12146, 12147, 12148, 12150, 12151, 12155, 12162, 12165, 12166, 12167, 12171, 12174, 12175, 12179, 12181, 12192, 12197, 12202, 12204, 12208, 12214, 12215, 12217, 12223, 12228, 12229, 12233, 12234, 12241, 12243, 12245, 12249, 12250, 12252, 12253, 12254, 12255, 12259, 12268, 12271, 12278, 12280, 12283, 12285, 12286, 12287, 12295, 12296, 12304, 12305, 12306, 12310, 12311, 12312, 12313, 12314, 12317, 12319, 12321, 12323, 12324, 12325, 12326, 12328, 12331, 12333, 12334, 12337, 12339, 12340, 12342, 12343, 12344, 12347, 12350, 12354, 12356, 12359, 12364, 12366, 12368, 12370, 12373, 12374, 12375, 12376, 12379, 12380, 12381, 12383, 12390, 12393, 12394, 12397, 12399, 12400, 12401, 12402, 12403, 12404, 12406, 12411, 12414, 12415, 12416, 12418, 12419, 12420, 12423, 12424, 12425, 12426, 12427, 12428, 12429, 12437, 12439, 12440, 12444, 12445, 12447, 12450, 12451, 12454, 12456, 12457, 12459, 12462, 12465, 12467, 12468, 12470, 12472, 12473, 12476, 12478, 12481, 12482, 12483, 12487, 12488, 12489, 12491, 12492, 12494, 12497, 12499, 12500, 12501, 12502, 12503, 12508, 12512, 12513, 12514, 12515, 12518, 12519, 12525, 12527, 12530, 12531, 12535, 12536, 12537, 12538, 12539, 12546, 12547, 12551, 12552, 12554, 12555, 12556, 12562, 12563, 12565, 12568, 12572, 12577, 12578, 12580, 12583, 12585, 12586, 12588, 12589, 12590, 12592, 12593, 12594, 12600, 12603, 12605, 12608, 12609, 12610, 12611, 12616, 12620, 12622, 12623, 12626, 12628, 12629, 12631, 12633, 12634, 12638, 12639, 12640, 12641, 12644, 12645, 12648, 12649, 12651, 12663, 12664, 12668, 12670, 12671, 12679, 12682, 12683, 12684, 12688, 12689, 12691, 12693, 12695, 12696, 12699, 12701, 12702, 12705, 12706, 12707, 12712, 12713, 12714, 12715, 12723, 12729, 12731, 12732, 12733, 12735, 12738, 12739, 12740, 12741, 12742, 12743, 12744, 12752, 12753, 12754, 12755, 12758, 12760, 12761, 12763, 12764, 12765, 12766, 12771, 12775, 12777, 12782, 12790, 12797, 12800, 12801, 12802, 12803, 12804, 12805, 12807, 12808, 12810, 12812, 12817, 12818, 12820, 12822, 12823, 12824, 12826, 12827, 12828, 12835, 12836, 12837, 12838, 12839, 12844, 12848, 12849, 12850, 12853, 12861, 12866, 12869, 12870, 12873, 12875, 12878, 12882, 12884, 12887, 12891, 12898, 12900, 12901, 12902, 12903, 12904, 12905, 12906, 12908, 12910, 12912, 12913, 12916, 12920, 12921, 12928, 12929, 12931, 12932, 12933, 12934, 12935, 12939, 12942, 12946, 12947, 12950, 12952, 12953, 12956, 12958, 12960, 12961, 12963, 12967, 12968, 12969, 12972, 12986, 12987, 12988, 12990, 12991, 12994, 12999, 13001, 13003, 13004, 13007, 13008, 13010, 13014, 13017, 13022, 13023, 13027, 13030, 13031, 13034, 13035, 13037, 13040, 13041, 13044, 13047, 13049, 13050, 13053, 13054, 13055, 13056, 13059, 13061, 13063, 13064, 13066, 13067, 13069, 13070, 13071, 13075, 13077, 13079, 13082, 13083, 13085, 13086, 13087, 13099, 13101, 13102, 13105, 13106, 13109, 13110, 13111, 13112, 13114, 13116, 13117, 13118, 13120, 13121, 13122, 13123, 13124, 13125, 13127, 13128, 13131, 13136, 13144, 13147, 13148, 13149, 13151, 13154, 13156, 13159, 13167, 13169, 13175, 13181, 13182, 13186, 13187, 13189, 13197, 13198, 13199, 13206, 13209, 13212, 13213, 13217, 13221, 13226, 13228, 13229, 13231, 13232, 13234, 13235, 13236, 13237, 13239, 13243, 13248, 13250, 13255, 13259, 13260, 13261, 13262, 13263, 13264, 13265, 13268, 13269, 13271, 13274, 13281, 13285, 13293, 13295, 13296, 13297, 13298, 13300, 13301, 13303, 13304, 13315, 13316, 13328, 13329, 13330, 13332, 13340, 13343, 13344, 13345, 13346, 13347, 13348, 13349, 13350, 13352, 13353, 13358, 13363, 13365, 13367, 13368, 13369, 13370, 13377, 13380, 13381, 13384, 13385, 13386, 13388, 13391, 13393, 13394, 13395, 13396, 13397, 13398, 13401, 13403, 13407, 13408, 13410, 13414, 13416, 13417, 13419, 13420, 13423, 13424, 13428, 13429, 13430, 13431, 13433, 13439, 13441, 13446, 13448, 13450, 13456, 13460, 13461, 13463, 13467, 13469, 13470, 13473, 13474, 13475, 13477, 13478, 13480, 13489, 13492, 13494, 13499, 13503, 13507, 13510, 13515, 13519, 13521, 13522, 13526, 13532, 13535, 13536, 13539, 13540, 13543, 13544, 13546, 13547, 13549, 13552, 13553, 13555, 13556, 13558, 13559, 13560, 13561, 13562, 13565, 13566, 13568, 13569, 13572, 13574, 13575, 13577, 13578, 13579, 13580, 13584, 13587, 13597, 13598, 13599, 13600, 13601, 13602, 13604, 13605, 13606, 13612, 13613, 13621, 13627, 13628, 13629, 13630, 13631, 13632, 13634, 13636, 13637, 13638, 13640, 13641, 13643, 13647, 13649, 13650, 13653, 13660, 13662, 13663, 13665, 13669, 13675, 13677, 13678, 13679, 13683, 13687, 13688, 13689, 13693, 13697, 13698, 13699, 13700, 13702, 13706, 13710, 13712, 13713, 13714, 13715, 13716, 13719, 13720, 13721, 13727, 13729, 13730, 13734, 13736, 13737, 13738, 13739, 13742, 13745, 13747, 13750, 13753, 13764, 13767, 13769, 13772, 13773, 13775, 13777, 13779, 13780, 13782, 13783, 13785, 13786, 13787, 13791, 13793, 13795, 13796, 13798, 13799, 13802, 13809, 13816, 13817, 13818, 13819, 13820, 13822, 13823, 13828, 13830, 13834, 13835, 13843, 13849, 13852, 13858, 13859, 13860, 13862, 13866, 13869, 13872, 13873, 13877, 13887, 13891, 13892, 13895, 13898, 13899, 13901, 13906, 13907, 13908, 13909, 13910, 13911, 13914, 13917, 13918, 13919, 13921, 13923, 13924, 13925, 13927, 13929, 13934, 13938, 13942, 13944, 13947, 13948, 13950, 13952, 13953, 13954, 13958, 13960, 13962, 13963, 13969, 13970, 13975, 13976, 13983, 13984, 13985, 13986, 13987, 13990, 13994, 13999, 14000, 14001, 14002, 14003, 14005, 14006, 14008, 14013, 14014, 14016, 14018, 14021, 14022, 14027, 14030, 14031, 14036, 14038, 14043, 14052, 14054, 14059, 14062, 14066, 14067, 14069, 14070, 14071, 14073, 14075, 14078, 14081, 14083, 14084, 14085, 14086, 14088, 14091, 14092, 14094, 14095, 14096, 14097, 14102, 14106, 14110, 14111, 14112, 14115, 14116, 14118, 14121, 14122, 14124, 14129, 14130, 14132, 14133, 14137, 14138, 14139, 14142, 14145, 14146, 14147.

Promoters expressing in the unpollinated ovule at the tasseling stage include SEQ IDs: 1, 3, 7, 9, 12, 14, 15, 16, 17, 20, 26, 27, 29, 31, 32, 33, 34, 36, 37, 38, 45, 48, 54, 57, 63, 64, 65, 79, 80, 88, 90, 93, 94, 96, 98, 99, 100, 102, 103, 104, 110, 112, 115, 117, 121, 123, 130, 131, 141, 143, 147, 148, 152, 154, 156, 157, 159, 160, 162, 165, 172, 174, 175, 176, 179, 181, 183, 187, 191, 193, 194, 196, 197, 199, 202, 203, 204, 205, 207, 210, 211, 212, 214, 232, 233, 234, 235, 236, 237, 239, 240, 242, 244, 246, 249, 250, 251, 256, 257, 259, 263, 264, 267, 271, 273, 280, 281, 286, 288, 289, 293, 294, 298, 299, 301, 302, 305, 306, 308, 309, 314, 316, 318, 319, 320, 322, 323, 328, 329, 332, 334, 335, 338, 339, 346, 349, 352, 353, 354, 356, 357, 358, 360, 365, 367, 371, 373, 374, 378, 379, 381, 388, 396, 401, 405, 406, 407, 411, 412, 414, 423, 424, 428, 429, 433, 434, 436, 441, 448, 450, 452, 456, 460, 461, 462, 463, 466, 468, 470, 471, 474, 478, 479, 483, 485, 488, 489, 493, 496, 498, 504, 507, 509, 510, 511, 514, 515, 516, 517, 522, 523, 525, 528, 532, 535, 537, 538, 541, 543, 544, 546, 547, 548, 553, 554, 556, 557, 561, 563, 574, 578, 580, 582, 585, 591, 594, 595, 596, 598, 599, 601, 602, 605, 606, 607, 613, 614, 619, 620, 623, 630, 631, 633, 634, 635, 636, 637, 638, 643, 647, 650, 659, 661, 662, 664, 666, 670, 671, 674, 676, 677, 680, 681, 683, 687, 693, 694, 695, 701, 702, 705, 706, 707, 708, 709, 716, 717, 718, 719, 721, 722, 723, 724, 727, 731, 732, 734, 735, 736, 740, 742, 744, 749, 750, 753, 757, 759, 760, 761, 762, 764, 765, 771, 779, 781, 782, 783, 784, 792, 793, 800, 804, 806, 808, 809, 811, 812, 820, 822, 824, 825, 826, 827, 829, 830, 833, 840, 846, 849, 852, 855, 856, 857, 858, 859, 860, 862, 863, 864, 865, 869, 870, 871, 872, 875, 876, 877, 883, 887, 890, 891, 892, 893, 895, 897, 898, 899, 900, 903, 907, 908, 910, 911, 912, 913, 915, 916, 917, 919, 920, 924, 928, 932, 934, 936, 939, 943, 944, 947, 948, 951, 953, 954, 955, 957, 958, 960, 964, 971, 974, 976, 977, 978, 979, 980, 981, 982, 983, 984, 987, 988, 989, 991, 993, 994, 995, 997, 999, 1002, 1003, 1005, 1007, 1008, 1009, 1010, 1011, 1012, 1013, 1014, 1016, 1017, 1022, 1025, 1026, 1032, 1033, 1035, 1038, 1039, 1040, 1041, 1043, 1046, 1047, 1049, 1051, 1052, 1054, 1055, 1056, 1057, 1059, 1064, 1065, 1067, 1068, 1069, 1070, 1073, 1074, 1076, 1077, 1079, 1080, 1085, 1086, 1087, 1089, 1092, 1095, 1096, 1097, 1100, 1101, 1103, 1104, 1110, 1111, 1112, 1114, 1115, 1116, 1117, 1119, 1121, 1122, 1125, 1126, 1130, 1132, 1136, 1137, 1140, 1146, 1148, 1154, 1155, 1160, 1161, 1165, 1167, 1168, 1170, 1171, 1176, 1178, 1180, 1183, 1189, 1191, 1196, 1198, 1200, 1201, 1203, 1204, 1205, 1214, 1217, 1218, 1220, 1221, 1222, 1223, 1225, 1228, 1230, 1231, 1233, 1235, 1236, 1237, 1239, 1240, 1248, 1249, 1251, 1253, 1254, 1257, 1258, 1261, 1263, 1269, 1272, 1277, 1281, 1282, 1285, 1286, 1290, 1292, 1293, 1296, 1305, 1306, 1307, 1309, 1311, 1312, 1314, 1316, 1320, 1321, 1322, 1323, 1325, 1327, 1331, 1334, 1339, 1345, 1347, 1349, 1354, 1355, 1358, 1360, 1364, 1366, 1367, 1368, 1371, 1375, 1376, 1377, 1380, 1381, 1387, 1388, 1389, 1393, 1396, 1398, 1399, 1404, 1405, 1406, 1407, 1410, 1412, 1415, 1417, 1420, 1421, 1423, 1426, 1431, 1432, 1433, 1435, 1438, 1439, 1440, 1441, 1442, 1443, 1444, 1447, 1448, 1451, 1453, 1454, 1455, 1458, 1459, 1461, 1462, 1464, 1466, 1468, 1469, 1471, 1472, 1475, 1484, 1485, 1486, 1488, 1489, 1490, 1491, 1493, 1497, 1498, 1499, 1501, 1503, 1504, 1506, 1508, 1510, 1511, 1514, 1518, 1519, 1525, 1526, 1527, 1528, 1530, 1536, 1543, 1545, 1546, 1547, 1549, 1550, 1551, 1554, 1555, 1556, 1560, 1561, 1563, 1564, 1566, 1567, 1568, 1570, 1571, 1575, 1576, 1578, 1579, 1582, 1584, 1585, 1586, 1590, 1591, 1594, 1596, 1597, 1598, 1599, 1600, 1601, 1602, 1604, 1605, 1608, 1609, 1610, 1612, 1614, 1615, 1616, 1617, 1622, 1623, 1625, 1634, 1635, 1637, 1638, 1639, 1642, 1643, 1648, 1650, 1651, 1653, 1654, 1658, 1659, 1662, 1663, 1668, 1669, 1671, 1673, 1675, 1676, 1677, 1678, 1681, 1682, 1684, 1685, 1687, 1688, 1689, 1690, 1691, 1696, 1697, 1698, 1699, 1703, 1705, 1706, 1707, 1708, 1709, 1710, 1716, 1717, 1718, 1719, 1720, 1725, 1729, 1732, 1735, 1736, 1750, 1755, 1758, 1759, 1760, 1761, 1764, 1769, 1773, 1774, 1776, 1777, 1778, 1779, 1785, 1786, 1791, 1792, 1793, 1796, 1798, 1807, 1809, 1811, 1812, 1813, 1814, 1826, 1828, 1830, 1832, 1834, 1835, 1837, 1838, 1839, 1840, 1848, 1849, 1852, 1859, 1861, 1863, 1866, 1867, 1869, 1872, 1873, 1876, 1879, 1880, 1882, 1886, 1888, 1891, 1894, 1897, 1898, 1899, 1900, 1902, 1904, 1905, 1906, 1910, 1911, 1914, 1915, 1916, 1918, 1920, 1922, 1923, 1924, 1928, 1930, 1931, 1933, 1934, 1936, 1939, 1940, 1944, 1945, 1949, 1950, 1951, 1952, 1953, 1954, 1955, 1958, 1968, 1970, 1971, 1972, 1973, 1977, 1981, 1986, 1990, 1991, 1993, 1994, 1995, 1996, 1999, 2000, 2001, 2003, 2007, 2009, 2010, 2012, 2014, 2015, 2016, 2017, 2019, 2021, 2026, 2031, 2032, 2037, 2040, 2041, 2043, 2045, 2048, 2057, 2058, 2060, 2062, 2064, 2066, 2072, 2074, 2077, 2078, 2088, 2089, 2091, 2093, 2094, 2096, 2097, 2099, 2103, 2104, 2106, 2107, 2111, 2112, 2116, 2117, 2122, 2123, 2125, 2130, 2132, 2133, 2137, 2139, 2140, 2142, 2143, 2144, 2146, 2147, 2150, 2151, 2154, 2155, 2156, 2157, 2159, 2161, 2164, 2166, 2167, 2168, 2170, 2173, 2177, 2179, 2183, 2185, 2188, 2189, 2193, 2196, 2200, 2202, 2203, 2205, 2206, 2210, 2213, 2215, 2216, 2218, 2221, 2222, 2223, 2226, 2235, 2240, 2241, 2242, 2243, 2247, 2253, 2257, 2260, 2263, 2267, 2274, 2276, 2278, 2280, 2282, 2283, 2284, 2289, 2291, 2294, 2296, 2297, 2298, 2300, 2303, 2304, 2305, 2306, 2308, 2309, 2310, 2313, 2314, 2322, 2323, 2328, 2329, 2331, 2337, 2339, 2342, 2345, 2348, 2353, 2358, 2361, 2362, 2363, 2366, 2367, 2371, 2372, 2377, 2379, 2380, 2381, 2382, 2383, 2384, 2401, 2402, 2405, 2406, 2410, 2412, 2413, 2414, 2418, 2419, 2420, 2422, 2423, 2428, 2430, 2431, 2432, 2433, 2434, 2435, 2436, 2437, 2439, 2440, 2441, 2442, 2443, 2445, 2446, 2449, 2451, 2452, 2453, 2454, 2457, 2458, 2469, 2470, 2471, 2472, 2474, 2476, 2477, 2479, 2480, 2481, 2482, 2483, 2485, 2487, 2489, 2490, 2492, 2494, 2495, 2496, 2497, 2498, 2500, 2505, 2506, 2507, 2509, 2510, 2513, 2514, 2515, 2516, 2517, 2519, 2522, 2525, 2526, 2528, 2529, 2531, 2532, 2533, 2534, 2536, 2537, 2538, 2539, 2541, 2544, 2545, 2546, 2549, 2550, 2551, 2552, 2555, 2556, 2557, 2559, 2561, 2567, 2568, 2570, 2571, 2573, 2576, 2578, 2581, 2583, 2589, 2590, 2596, 2599, 2600, 2601, 2605, 2607, 2609, 2611, 2613, 2616, 2617, 2620, 2622, 2625, 2626, 2627, 2632, 2634, 2635, 2639, 2644, 2645, 2649, 2651, 2652, 2654, 2655, 2656, 2658, 2659, 2661, 2662, 2663, 2666, 2670, 2671, 2672, 2674, 2676, 2678, 2679, 2684, 2685, 2690, 2691, 2692, 2694, 2696, 2700, 2702, 2704, 2708, 2711, 2712, 2715, 2719, 2720, 2721, 2722, 2723, 2725, 2726, 2728, 2729, 2730, 2735, 2736, 2738, 2739, 2745, 2746, 2747, 2749, 2752, 2755, 2756, 2757, 2758, 2762, 2764, 2765, 2766, 2770, 2775, 2776, 2784, 2787, 2789, 2791, 2793, 2796, 2798, 2800, 2802, 2805, 2808, 2812, 2814, 2819, 2821, 2822, 2823, 2824, 2826, 2827, 2828, 2831, 2832, 2840, 2844, 2845, 2850, 2857, 2860, 2861, 2865, 2869, 2871, 2876, 2878, 2888, 2889, 2890, 2892, 2893, 2894, 2896, 2897, 2898, 2901, 2902, 2903, 2905, 2906, 2908, 2909, 2911, 2915, 2916, 2917, 2918, 2919, 2922, 2923, 2926, 2929, 2930, 2931, 2935, 2937, 2941, 2942, 2943, 2944, 2946, 2947, 2948, 2955, 2959, 2963, 2966, 2968, 2976, 2979, 2982, 2987, 2992, 2994, 2998, 3000, 3003, 3005, 3007, 3008, 3013, 3015, 3017, 3020, 3023, 3024, 3029, 3031, 3039, 3041, 3042, 3044, 3045, 3047, 3048, 3049, 3051, 3052, 3053, 3055, 3058, 3059, 3064, 3067, 3068, 3070, 3072, 3075, 3080, 3083, 3084, 3085, 3087, 3090, 3094, 3095, 3100, 3101, 3106, 3112, 3115, 3118, 3119, 3120, 3121, 3122, 3123, 3126, 3127, 3128, 3129, 3137, 3139, 3143, 3145, 3149, 3153, 3156, 3157, 3158, 3167, 3169, 3170, 3171, 3172, 3177, 3181, 3185, 3187, 3189, 3191, 3192, 3194, 3196, 3200, 3202, 3205, 3206, 3208, 3210, 3217, 3218, 3219, 3220, 3221, 3224, 3225, 3228, 3230, 3232, 3237, 3239, 3240, 3242, 3246, 3252, 3255, 3261, 3263, 3266, 3267, 3268, 3269, 3271, 3272, 3273, 3280, 3283, 3286, 3288, 3289, 3290, 3291, 3294, 3295, 3297, 3299, 3301, 3303, 3308, 3310, 3312, 3313, 3324, 3327, 3331, 3332, 3333, 3337, 3338, 3340, 3342, 3343, 3345, 3346, 3347, 3351, 3353, 3354, 3355, 3356, 3358, 3359, 3360, 3361, 3363, 3368, 3370, 3374, 3376, 3377, 3378, 3381, 3383, 3386, 3394, 3396, 3399, 3403, 3404, 3405, 3413, 3415, 3416, 3418, 3419, 3422, 3424, 3426, 3427, 3428, 3435, 3438, 3440, 3441, 3442, 3445, 3446, 3447, 3449, 3450, 3452, 3453, 3457, 3458, 3459, 3461, 3465, 3466, 3468, 3469, 3470, 3471, 3474, 3477, 3483, 3484, 3486, 3488, 3490, 3493, 3494, 3499, 3500, 3502, 3503, 3504, 3507, 3510, 3516, 3523, 3524, 3529, 3533, 3535, 3536, 3537, 3538, 3540, 3541, 3544, 3545, 3548, 3549, 3552, 3554, 3556, 3558, 3560, 3561, 3562, 3569, 3571, 3574, 3576, 3580, 3585, 3587, 3588, 3589, 3591, 3592, 3594, 3595, 3600, 3601, 3603, 3604, 3607, 3610, 3611, 3613, 3615, 3616, 3618, 3619, 3620, 3621, 3624, 3627, 3628, 3630, 3631, 3633, 3634, 3640, 3642, 3643, 3644, 3645, 3646, 3648, 3650, 3653, 3655, 3659, 3660, 3661, 3667, 3672, 3674, 3677, 3681, 3682, 3684, 3685, 3690, 3693, 3694, 3702, 3706, 3707, 3709, 3710, 3713, 3715, 3717, 3718, 3719, 3720, 3721, 3723, 3725, 3730, 3731, 3732, 3744, 3748, 3749, 3752, 3756, 3757, 3760, 3761, 3764, 3765, 3766, 3771, 3772, 3773, 3775, 3777, 3778, 3783, 3784, 3785, 3791, 3792, 3793, 3794, 3796, 3798, 3801, 3806, 3808, 3809, 3812, 3817, 3818, 3819, 3820, 3823, 3825, 3828, 3830, 3831, 3832, 3833, 3837, 3838, 3843, 3844, 3845, 3846, 3847, 3849, 3858, 3859, 3860, 3867, 3868, 3870, 3871, 3872, 3873, 3876, 3881, 3882, 3883, 3884, 3885, 3887, 3889, 3890, 3892, 3893, 3894, 3895, 3896, 3897, 3898, 3899, 3902, 3903, 3904, 3907, 3908, 3910, 3912, 3913, 3917, 3918, 3924, 3928, 3929, 3931, 3933, 3934, 3938, 3940, 3941, 3947, 3950, 3952, 3954, 3958, 3959, 3962, 3964, 3967, 3968, 3970, 3971, 3974, 3975, 3978, 3983, 3985, 3987, 3988, 3990, 3995, 3996, 3997, 3998, 4000, 4007, 4008, 4013, 4014, 4019, 4020, 4021, 4028, 4030, 4033, 4037, 4039, 4040, 4041, 4042, 4043, 4044, 4048, 4049, 4050, 4051, 4052, 4053, 4054, 4056, 4057, 4062, 4066, 4068, 4070, 4071, 4072, 4077, 4079, 4080, 4081, 4084, 4088, 4092, 4094, 4096, 4098, 4099, 4105, 4106, 4109, 4110, 4111, 4113, 4115, 4116, 4117, 4122, 4124, 4126, 4128, 4132, 4133, 4135, 4139, 4140, 4143, 4144, 4146, 4147, 4149, 4150, 4151, 4155, 4160, 4163, 4164, 4165, 4166, 4167, 4168, 4170, 4171, 4173, 4175, 4178, 4181, 4185, 4187, 4188, 4189, 4190, 4191, 4192, 4193, 4194, 4195, 4201, 4202, 4204, 4205, 4206, 4207, 4208, 4210, 4211, 4212, 4213, 4215, 4219, 4221, 4227, 4228, 4229, 4233, 4234, 4235, 4237, 4244, 4245, 4246, 4250, 4251, 4255, 4257, 4261, 4263, 4266, 4270, 4272, 4275, 4276, 4278, 4280, 4281, 4282, 4284, 4290, 4292, 4294, 4295, 4296, 4298, 4300, 4301, 4302, 4303, 4304, 4305, 4306, 4309, 4312, 4320, 4321, 4324, 4329, 4330, 4335, 4336, 4337, 4338, 4339, 4341, 4343, 4344, 4347, 4356, 4358, 4359, 4360, 4366, 4369, 4370, 4371, 4373, 4375, 4378, 4380, 4383, 4388, 4390, 4391, 4393, 4396, 4397, 4401, 4402, 4403, 4404, 4405, 4409, 4410, 4419, 4422, 4423, 4425, 4430, 4432, 4436, 4439, 4440, 4442, 4443, 4446, 4448, 4449, 4450, 4453, 4456, 4461, 4462, 4463, 4466, 4468, 4470, 4474, 4475, 4477, 4479, 4486, 4490, 4492, 4494, 4497, 4498, 4500, 4502, 4507, 4508, 4509, 4512, 4514, 4515, 4519, 4521, 4529, 4531, 4535, 4541, 4545, 4548, 4549, 4551, 4554, 4555, 4556, 4557, 4558, 4560, 4562, 4563, 4565, 4566, 4567, 4568, 4575, 4576, 4580, 4582, 4583, 4590, 4591, 4594, 4595, 4597, 4598, 4601, 4606, 4614, 4616, 4623, 4625, 4628, 4630, 4632, 4633, 4634, 4635, 4639, 4641, 4643, 4644, 4645, 4646, 4647, 4650, 4651, 4653, 4654, 4655, 4656, 4657, 4659, 4664, 4667, 4669, 4671, 4672, 4673, 4674, 4676, 4677, 4680, 4682, 4685, 4691, 4692, 4694, 4697, 4699, 4700, 4703, 4706, 4708, 4710, 4711, 4713, 4714, 4715, 4719, 4721, 4722, 4723, 4725, 4729, 4730, 4734, 4736, 4737, 4738, 4739, 4740, 4741, 4745, 4746, 4749, 4750, 4753, 4755, 4756, 4761, 4762, 4763, 4764, 4765, 4766, 4769, 4770, 4771, 4773, 4775, 4778, 4779, 4780, 4784, 4787, 4788, 4789, 4790, 4791, 4794, 4795, 4796, 4801, 4803, 4804, 4805, 4806, 4807, 4813, 4814, 4816, 4818, 4822, 4828, 4830, 4831, 4834, 4838, 4841, 4842, 4845, 4847, 4851, 4854, 4855, 4856, 4857, 4858, 4859, 4861, 4862, 4863, 4864, 4869, 4871, 4874, 4875, 4876, 4878, 4880, 4881, 4887, 4889, 4891, 4895, 4896, 4897, 4900, 4902, 4904, 4905, 4907, 4909, 4910, 4914, 4921, 4922, 4923, 4924, 4930, 4935, 4936, 4938, 4941, 4942, 4947, 4950, 4954, 4958, 4959, 4963, 4967, 4969, 4971, 4972, 4974, 4975, 4983, 4985, 4987, 4988, 4989, 4990, 4993, 4994, 4996, 5000, 5011, 5014, 5015, 5016, 5021, 5022, 5026, 5027, 5029, 5030, 5034, 5036, 5037, 5038, 5039, 5040, 5042, 5044, 5045, 5046, 5051, 5052, 5054, 5057, 5060, 5061, 5067, 5068, 5069, 5072, 5074, 5075, 5077, 5078, 5079, 5082, 5084, 5088, 5089, 5090, 5094, 5100, 5101, 5102, 5106, 5109, 5111, 5114, 5115, 5116, 5120, 5125, 5129, 5131, 5132, 5140, 5143, 5144, 5145, 5146, 5147, 5149, 5151, 5153, 5157, 5159, 5160, 5164, 5165, 5168, 5169, 5170, 5172, 5174, 5180, 5181, 5184, 5185, 5187, 5188, 5189, 5190, 5191, 5192, 5196, 5198, 5200, 5202, 5203, 5206, 5212, 5213, 5216, 5217, 5218, 5219, 5225, 5228, 5229, 5234, 5241, 5247, 5249, 5251, 5252, 5253, 5254, 5255, 5256, 5257, 5258, 5260, 5261, 5263, 5267, 5268, 5269, 5273, 5274, 5275, 5276, 5279, 5280, 5281, 5282, 5283, 5286, 5287, 5290, 5292, 5293, 5297, 5298, 5299, 5300, 5301, 5308, 5311, 5313, 5317, 5319, 5321, 5324, 5327, 5329, 5330, 5332, 5333, 5334, 5338, 5339, 5342, 5343, 5345, 5346, 5348, 5349, 5351, 5352, 5366, 5367, 5371, 5386, 5388, 5389, 5391, 5393, 5395, 5396, 5397, 5402, 5405, 5409, 5411, 5413, 5414, 5417, 5418, 5422, 5428, 5430, 5431, 5433, 5434, 5437, 5438, 5445, 5446, 5448, 5449, 5450, 5452, 5453, 5456, 5458, 5459, 5461, 5463, 5464, 5471, 5472, 5475, 5476, 5482, 5483, 5485, 5487, 5488, 5491, 5493, 5495, 5496, 5497, 5505, 5506, 5508, 5510, 5512, 5513, 5515, 5517, 5518, 5519, 5524, 5526, 5529, 5530, 5531, 5532, 5534, 5535, 5543, 5545, 5554, 5557, 5558, 5562, 5563, 5565, 5566, 5568, 5569, 5572, 5575, 5579, 5581, 5582, 5584, 5585, 5586, 5589, 5591, 5593, 5594, 5597, 5602, 5608, 5611, 5612, 5613, 5614, 5615, 5616, 5620, 5621, 5623, 5627, 5632, 5633, 5635, 5638, 5640, 5643, 5647, 5648, 5651, 5652, 5653, 5656, 5657, 5659, 5660, 5662, 5663, 5669, 5680, 5681, 5689, 5690, 5694, 5695, 5697, 5698, 5702, 5706, 5709, 5711, 5717, 5718, 5719, 5721, 5722, 5723, 5729, 5730, 5731, 5732, 5734, 5735, 5736, 5742, 5744, 5746, 5749, 5751, 5757, 5764, 5768, 5770, 5773, 5775, 5780, 5784, 5785, 5788, 5791, 5792, 5794, 5803, 5804, 5805, 5807, 5808, 5810, 5811, 5814, 5815, 5817, 5820, 5826, 5828, 5832, 5833, 5834, 5835, 5836, 5837, 5839, 5842, 5844, 5846, 5853, 5854, 5859, 5864, 5867, 5868, 5869, 5871, 5872, 5876, 5877, 5878, 5879, 5881, 5882, 5883, 5884, 5888, 5889, 5892, 5893, 5900, 5901, 5902, 5906, 5907, 5910, 5912, 5913, 5914, 5918, 5919, 5921, 5922, 5923, 5925, 5927, 5928, 5929, 5930, 5931, 5932, 5934, 5938, 5939, 5941, 5942, 5944, 5946, 5947, 5948, 5951, 5954, 5956, 5957, 5959, 5961, 5968, 5969, 5971, 5978, 5979, 5980, 5984, 5985, 5986, 5988, 5989, 5990, 5991, 5992, 5994, 5996, 5997, 6000, 6003, 6004, 6006, 6007, 6010, 6012, 6013, 6016, 6017, 6021, 6023, 6025, 6026, 6028, 6034, 6038, 6040, 6041, 6044, 6047, 6048, 6051, 6053, 6054, 6058, 6059, 6062, 6063, 6065, 6068, 6069, 6070, 6072, 6073, 6074, 6075, 6080, 6085, 6088, 6089, 6092, 6093, 6094, 6095, 6096, 6098, 6099, 6107, 6108, 6109, 6112, 6113, 6116, 6118, 6119, 6120, 6122, 6129, 6130, 6131, 6132, 6133, 6135, 6136, 6137, 6138, 6143, 6145, 6146, 6147, 6149, 6151, 6152, 6153, 6156, 6158, 6160, 6163, 6164, 6165, 6168, 6178, 6181, 6182, 6183, 6186, 6188, 6189, 6190, 6191, 6193, 6197, 6198, 6200, 6205, 6207, 6209, 6212, 6213, 6215, 6220, 6223, 6224, 6227, 6228, 6230, 6231, 6233, 6234, 6237, 6238, 6240, 6243, 6244, 6245, 6246, 6247, 6248, 6249, 6251, 6255, 6257, 6258, 6259, 6260, 6264, 6265, 6269, 6270, 6271, 6272, 6273, 6275, 6278, 6279, 6280, 6281, 6282, 6286, 6288, 6289, 6292, 6294, 6295, 6299, 6302, 6303, 6308, 6309, 6310, 6312, 6315, 6317, 6319, 6321, 6322, 6325, 6326, 6328, 6330, 6333, 6338, 6343, 6344, 6346, 6351, 6352, 6353, 6354, 6356, 6359, 6360, 6362, 6363, 6367, 6370, 6372, 6375, 6376, 6378, 6379, 6381, 6383, 6387, 6394, 6395, 6396, 6397, 6398, 6399, 6403, 6405, 6407, 6408, 6410, 6412, 6413, 6414, 6415, 6419, 6420, 6422, 6425, 6426, 6427, 6428, 6429, 6430, 6431, 6434, 6435, 6436, 6440, 6442, 6449, 6452, 6454, 6459, 6463, 6464, 6466, 6467, 6468, 6469, 6470, 6471, 6474, 6476, 6480, 6481, 6482, 6484, 6488, 6492, 6495, 6499, 6500, 6501, 6502, 6503, 6504, 6505, 6510, 6513, 6514, 6515, 6516, 6517, 6519, 6524, 6525, 6526, 6530, 6532, 6533, 6534, 6535, 6537, 6543, 6544, 6547, 6549, 6554, 6555, 6558, 6560, 6561, 6563, 6564, 6567, 6569, 6574, 6576, 6577, 6579, 6581, 6582, 6584, 6587, 6588, 6589, 6592, 6594, 6595, 6596, 6597, 6598, 6599, 6607, 6609, 6611, 6614, 6620, 6621, 6624, 6625, 6626, 6627, 6628, 6629, 6630, 6634, 6635, 6637, 6638, 6639, 6640, 6643, 6644, 6649, 6650, 6652, 6655, 6662, 6666, 6671, 6672, 6673, 6677, 6681, 6696, 6702, 6703, 6705, 6706, 6710, 6711, 6714, 6716, 6718, 6720, 6724, 6725, 6729, 6731, 6734, 6736, 6737, 6739, 6746, 6747, 6749, 6752, 6756, 6757, 6759, 6760, 6761, 6764, 6766, 6767, 6778, 6779, 6780, 6786, 6788, 6793, 6795, 6797, 6799, 6801, 6803, 6804, 6805, 6807, 6810, 6811, 6812, 6813, 6815, 6816, 6819, 6820, 6821, 6824, 6827, 6828, 6829, 6830, 6831, 6834, 6836, 6837, 6839, 6840, 6841, 6842, 6843, 6845, 6851, 6852, 6859, 6860, 6863, 6864, 6865, 6867, 6869, 6872, 6874, 6875, 6876, 6877, 6878, 6879, 6880, 6882, 6883, 6884, 6888, 6890, 6892, 6894, 6897, 6903, 6904, 6913, 6914, 6915, 6917, 6919, 6920, 6921, 6922, 6923, 6924, 6930, 6933, 6936, 6941, 6943, 6946, 6948, 6951, 6955, 6959, 6960, 6963, 6967, 6970, 6971, 6979, 6980, 6984, 6985, 6987, 6988, 6990, 6991, 6994, 6995, 6997, 6999, 7002, 7003, 7006, 7009, 7011, 7012, 7013, 7015, 7017, 7022, 7032, 7038, 7039, 7042, 7043, 7045, 7046, 7051, 7052, 7053, 7056, 7057, 7060, 7062, 7064, 7067, 7068, 7072, 7073, 7074, 7075, 7077, 7079, 7083, 7085, 7086, 7094, 7097, 7106, 7107, 7108, 7112, 7113, 7116, 7117, 7118, 7124, 7130, 7132, 7135, 7140, 7142, 7144, 7146, 7149, 7155, 7163, 7164, 7165, 7166, 7169, 7172, 7176, 7177, 7182, 7184, 7187, 7188, 7192, 7194, 7196, 7197, 7198, 7201, 7202, 7203, 7206, 7207, 7208, 7210, 7212, 7216, 7217, 7219, 7220, 7227, 7228, 7230, 7231, 7232, 7233, 7234, 7236, 7239, 7241, 7243, 7244, 7245, 7248, 7255, 7257, 7258, 7259, 7267, 7268, 7274, 7276, 7277, 7279, 7281, 7282, 7284, 7287, 7288, 7290, 7291, 7292, 7293, 7298, 7299, 7300, 7301, 7303, 7304, 7305, 7306, 7307, 7308, 7310, 7312, 7313, 7315, 7317, 7328, 7330, 7334, 7336, 7338, 7339, 7340, 7344, 7348, 7353, 7354, 7355, 7357, 7358, 7363, 7365, 7371, 7373, 7375, 7377, 7379, 7380, 7381, 7382, 7383, 7386, 7388, 7389, 7391, 7392, 7396, 7398, 7399, 7409, 7410, 7411, 7417, 7418, 7424, 7425, 7430, 7431, 7433, 7434, 7435, 7436, 7441, 7443, 7444, 7445, 7446, 7447, 7448, 7452, 7454, 7458, 7459, 7464, 7466, 7470, 7472, 7476, 7483, 7484, 7486, 7490, 7492, 7493, 7498, 7502, 7504, 7505, 7506, 7512, 7515, 7517, 7518, 7523, 7524, 7525, 7528, 7529, 7533, 7534, 7537, 7538, 7542, 7546, 7547, 7554, 7560, 7561, 7563, 7574, 7577, 7578, 7579, 7580, 7582, 7585, 7586, 7587, 7588, 7589, 7590, 7591, 7593, 7594, 7598, 7605, 7611, 7613, 7617, 7619, 7620, 7621, 7623, 7624, 7633, 7634, 7638, 7639, 7642, 7652, 7655, 7658, 7661, 7663, 7664, 7665, 7666, 7667, 7671, 7674, 7676, 7677, 7678, 7679, 7680, 7682, 7685, 7686, 7687, 7689, 7695, 7699, 7700, 7703, 7704, 7712, 7713, 7716, 7717, 7718, 7719, 7724, 7725, 7726, 7729, 7733, 7734, 7736, 7737, 7738, 7740, 7743, 7744, 7745, 7747, 7748, 7749, 7751, 7753, 7754, 7755, 7761, 7762, 7763, 7764, 7768, 7769, 7770, 7772, 7774, 7775, 7777, 7778, 7779, 7780, 7781, 7782, 7783, 7785, 7786, 7788, 7791, 7792, 7793, 7796, 7798, 7800, 7801, 7802, 7803, 7804, 7806, 7807, 7812, 7815, 7818, 7819, 7820, 7823, 7824, 7825, 7832, 7833, 7834, 7836, 7838, 7841, 7844, 7845, 7847, 7848, 7849, 7852, 7856, 7858, 7859, 7860, 7862, 7863, 7865, 7873, 7875, 7876, 7878, 7881, 7888, 7890, 7896, 7900, 7908, 7910, 7911, 7913, 7917, 7918, 7920, 7923, 7925, 7929, 7933, 7934, 7935, 7936, 7937, 7938, 7942, 7944, 7945, 7946, 7947, 7948, 7949, 7950, 7952, 7955, 7956, 7964, 7971, 7972, 7974, 7976, 7977, 7978, 7980, 7983, 7984, 7986, 7988, 7989, 7990, 7991, 7993, 7998, 8002, 8004, 8006, 8007, 8008, 8012, 8021, 8026, 8029, 8035, 8039, 8042, 8044, 8045, 8047, 8048, 8052, 8053, 8056, 8058, 8059, 8061, 8063, 8064, 8067, 8068, 8071, 8075, 8076, 8077, 8078, 8079, 8080, 8082, 8084, 8088, 8093, 8095, 8099, 8100, 8102, 8103, 8105, 8106, 8112, 8116, 8118, 8120, 8121, 8123, 8124, 8126, 8134, 8136, 8137, 8145, 8146, 8147, 8148, 8150, 8151, 8154, 8155, 8159, 8162, 8163, 8165, 8168, 8170, 8174, 8176, 8178, 8179, 8181, 8182, 8189, 8192, 8193, 8195, 8199, 8202, 8204, 8207, 8208, 8210, 8211, 8213, 8216, 8219, 8220, 8223, 8225, 8227, 8230, 8234, 8235, 8236, 8237, 8239, 8242, 8245, 8250, 8252, 8253, 8257, 8258, 8262, 8265, 8266, 8268, 8269, 8270, 8272, 8274, 8289, 8291, 8292, 8293, 8294, 8295, 8300, 8301, 8304, 8306, 8310, 8311, 8312, 8318, 8319, 8320, 8321, 8324, 8329, 8331, 8334, 8335, 8336, 8337, 8339, 8340, 8349, 8350, 8351, 8352, 8353, 8355, 8363, 8367, 8368, 8369, 8371, 8373, 8378, 8379, 8382, 8386, 8389, 8390, 8392, 8393, 8395, 8396, 8398, 8401, 8402, 8403, 8404, 8405, 8407, 8410, 8411, 8413, 8414, 8416, 8417, 8418, 8423, 8427, 8428, 8430, 8435, 8436, 8438, 8439, 8441, 8442, 8444, 8446, 8447, 8448, 8449, 8450, 8451, 8458, 8459, 8460, 8466, 8469, 8470, 8472, 8473, 8474, 8476, 8477, 8480, 8481, 8482, 8485, 8486, 8490, 8493, 8494, 8498, 8499, 8501, 8502, 8505, 8507, 8509, 8511, 8513, 8515, 8517, 8520, 8521, 8523, 8524, 8525, 8527, 8528, 8531, 8532, 8533, 8537, 8538, 8539, 8541, 8542, 8543, 8544, 8549, 8550, 8552, 8554, 8557, 8561, 8562, 8565, 8566, 8568, 8576, 8579, 8581, 8582, 8584, 8589, 8590, 8592, 8593, 8594, 8595, 8596, 8597, 8598, 8599, 8600, 8601, 8602, 8603, 8604, 8605, 8610, 8611, 8612, 8613, 8614, 8617, 8622, 8624, 8631, 8634, 8635, 8637, 8638, 8640, 8641, 8642, 8644, 8647, 8650, 8654, 8657, 8658, 8659, 8660, 8663, 8664, 8665, 8669, 8670, 8672, 8676, 8677, 8681, 8685, 8693, 8700, 8703, 8704, 8706, 8707, 8708, 8709, 8713, 8716, 8717, 8720, 8722, 8727, 8728, 8729, 8731, 8734, 8735, 8736, 8740, 8741, 8742, 8744, 8746, 8748, 8749, 8751, 8753, 8757, 8760, 8770, 8772, 8773, 8775, 8777, 8779, 8782, 8783, 8784, 8789, 8790, 8792, 8796, 8797, 8803, 8804, 8805, 8807, 8808, 8810, 8817, 8818, 8822, 8824, 8829, 8831, 8832, 8834, 8835, 8838, 8839, 8841, 8843, 8846, 8853, 8854, 8861, 8865, 8866, 8876, 8878, 8881, 8883, 8886, 8888, 8889, 8892, 8896, 8899, 8900, 8905, 8907, 8908, 8910, 8911, 8913, 8914, 8916, 8917, 8922, 8926, 8928, 8929, 8930, 8938, 8941, 8942, 8945, 8946, 8949, 8951, 8952, 8956, 8957, 8959, 8960, 8961, 8963, 8967, 8968, 8969, 8971, 8972, 8974, 8976, 8977, 8979, 8980, 8981, 8985, 8986, 8992, 8996, 8998, 8999, 9001, 9003, 9006, 9009, 9012, 9013, 9015, 9020, 9029, 9030, 9033, 9037, 9042, 9044, 9052, 9056, 9058, 9059, 9060, 9062, 9069, 9071, 9072, 9073, 9074, 9076, 9084, 9086, 9088, 9092, 9095, 9096, 9097, 9100, 9105, 9108, 9110, 9111, 9112, 9114, 9118, 9125, 9129, 9131, 9133, 9134, 9139, 9140, 9141, 9142, 9146, 9149, 9151, 9152, 9154, 9155, 9157, 9167, 9168, 9173, 9174, 9175, 9177, 9183, 9185, 9187, 9188, 9190, 9191, 9195, 9200, 9205, 9206, 9207, 9210, 9211, 9213, 9215, 9216, 9218, 9220, 9222, 9223, 9226, 9229, 9231, 9232, 9233, 9234, 9237, 9241, 9242, 9243, 9247, 9248, 9249, 9252, 9253, 9254, 9255, 9257, 9262, 9263, 9265, 9267, 9269, 9270, 9273, 9276, 9278, 9284, 9285, 9287, 9288, 9290, 9292, 9293, 9299, 9300, 9302, 9304, 9308, 9311, 9313, 9320, 9321, 9323, 9325, 9327, 9328, 9329, 9330, 9336, 9337, 9338, 9339, 9340, 9341, 9345, 9346, 9347, 9348, 9350, 9353, 9354, 9355, 9359, 9362, 9366, 9367, 9373, 9375, 9376, 9378, 9382, 9383, 9386, 9388, 9391, 9392, 9393, 9394, 9396, 9398, 9400, 9402, 9403, 9404, 9406, 9407, 9413, 9414, 9415, 9422, 9423, 9425, 9432, 9433, 9434, 9439, 9440, 9443, 9444, 9451, 9452, 9453, 9455, 9456, 9460, 9468, 9470, 9471, 9478, 9481, 9483, 9484, 9488, 9490, 9497, 9500, 9501, 9502, 9503, 9504, 9505, 9509, 9514, 9515, 9517, 9518, 9519, 9525, 9531, 9532, 9533, 9534, 9536, 9540, 9545, 9546, 9548, 9553, 9554, 9555, 9560, 9563, 9564, 9565, 9568, 9571, 9577, 9582, 9586, 9587, 9589, 9590, 9591, 9592, 9596, 9602, 9606, 9607, 9609, 9610, 9613, 9618, 9620, 9623, 9626, 9628, 9629, 9635, 9640, 9641, 9642, 9644, 9645, 9646, 9648, 9649, 9651, 9652, 9653, 9655, 9656, 9657, 9658, 9659, 9660, 9663, 9666, 9668, 9670, 9681, 9682, 9686, 9692, 9693, 9694, 9696, 9698, 9700, 9706, 9717, 9718, 9722, 9723, 9725, 9726, 9729, 9730, 9731, 9733, 9734, 9737, 9744, 9745, 9746, 9750, 9751, 9753, 9754, 9755, 9756, 9762, 9763, 9764, 9766, 9767, 9768, 9770, 9776, 9780, 9781, 9782, 9784, 9786, 9791, 9792, 9793, 9794, 9796, 9799, 9801, 9802, 9806, 9808, 9809, 9810, 9812, 9813, 9814, 9816, 9819, 9820, 9824, 9825, 9826, 9827, 9829, 9830, 9833, 9835, 9836, 9845, 9846, 9847, 9849, 9851, 9853, 9854, 9861, 9864, 9866, 9869, 9873, 9882, 9885, 9886, 9887, 9892, 9897, 9900, 9901, 9906, 9907, 9908, 9909, 9910, 9911, 9912, 9921, 9923, 9924, 9928, 9930, 9934, 9935, 9938, 9940, 9944, 9946, 9949, 9950, 9953, 9955, 9957, 9958, 9960, 9962, 9963, 9964, 9967, 9968, 9971, 9974, 9979, 9980, 9982, 9984, 9985, 9987, 9988, 9990, 9991, 9997, 9998, 10000, 10008, 10009, 10010, 10012, 10013, 10016, 10017, 10018, 10019, 10021, 10022, 10026, 10032, 10033, 10034, 10035, 10037, 10038, 10040, 10043, 10045, 10047, 10048, 10050, 10051, 10052, 10054, 10056, 10058, 10059, 10060, 10062, 10063, 10064, 10066, 10068, 10073, 10075, 10077, 10078, 10080, 10081, 10082, 10083, 10089, 10090, 10091, 10092, 10095, 10097, 10101, 10102, 10103, 10105, 10106, 10107, 10108, 10109, 10110, 10112, 10114, 10115, 10116, 10118, 10122, 10127, 10128, 10131, 10132, 10136, 10141, 10142, 10143, 10146, 10149, 10151, 10152, 10158, 10162, 10163, 10165, 10166, 10168, 10174, 10176, 10178, 10181, 10182, 10191, 10192, 10193, 10194, 10196, 10197, 10199, 10200, 10201, 10203, 10206, 10212, 10213, 10214, 10218, 10219, 10220, 10222, 10223, 10225, 10228, 10230, 10231, 10232, 10233, 10235, 10236, 10237, 10239, 10247, 10252, 10253, 10255, 10258, 10259, 10260, 10262, 10268, 10270, 10275, 10278, 10284, 10286, 10291, 10292, 10293, 10295, 10296, 10297, 10300, 10302, 10306, 10307, 10311, 10319, 10321, 10322, 10323, 10325, 10326, 10327, 10328, 10329, 10331, 10333, 10334, 10335, 10336, 10338, 10341, 10343, 10346, 10352, 10353, 10354, 10356, 10357, 10359, 10360, 10362, 10364, 10368, 10371, 10373, 10375, 10378, 10380, 10381, 10383, 10384, 10385, 10388, 10389, 10395, 10397, 10398, 10399, 10401, 10406, 10409, 10410, 10413, 10414, 10416, 10421, 10423, 10427, 10428, 10430, 10435, 10437, 10438, 10440, 10442, 10443, 10446, 10447, 10448, 10449, 10450, 10451, 10452, 10453, 10456, 10460, 10463, 10464, 10465, 10466, 10468, 10469, 10470, 10472, 10473, 10474, 10478, 10482, 10487, 10488, 10490, 10491, 10492, 10494, 10496, 10497, 10498, 10504, 10506, 10508, 10513, 10514, 10518, 10525, 10527, 10528, 10530, 10531, 10533, 10535, 10536, 10537, 10541, 10542, 10543, 10544, 10548, 10549, 10550, 10551, 10555, 10556, 10558, 10560, 10561, 10562, 10564, 10565, 10567, 10569, 10571, 10573, 10580, 10581, 10582, 10583, 10585, 10590, 10593, 10595, 10596, 10597, 10599, 10601, 10602, 10606, 10610, 10611, 10612, 10614, 10615, 10616, 10617, 10621, 10622, 10623, 10626, 10628, 10629, 10630, 10631, 10633, 10634, 10637, 10638, 10639, 10640, 10641, 10642, 10643, 10645, 10646, 10648, 10649, 10650, 10651, 10655, 10657, 10659, 10665, 10668, 10669, 10670, 10671, 10674, 10676, 10678, 10681, 10682, 10683, 10684, 10685, 10687, 10689, 10698, 10700, 10702, 10703, 10705, 10707, 10708, 10711, 10715, 10716, 10721, 10722, 10726, 10727, 10729, 10732, 10734, 10735, 10738, 10740, 10741, 10744, 10745, 10748, 10749, 10753, 10761, 10762, 10763, 10766, 10774, 10775, 10776, 10777, 10778, 10779, 10782, 10784, 10785, 10787, 10788, 10790, 10791, 10792, 10795, 10796, 10798, 10799, 10801, 10802, 10803, 10804, 10805, 10809, 10810, 10811, 10812, 10815, 10818, 10819, 10820, 10821, 10824, 10825, 10826, 10831, 10832, 10833, 10836, 10838, 10839, 10840, 10841, 10843, 10846, 10850, 10852, 10853, 10854, 10857, 10858, 10860, 10861, 10862, 10866, 10867, 10869, 10872, 10874, 10877, 10878, 10880, 10881, 10892, 10896, 10897, 10898, 10899, 10902, 10905, 10911, 10912, 10913, 10917, 10920, 10926, 10927, 10930, 10933, 10934, 10935, 10936, 10937, 10938, 10940, 10941, 10944, 10947, 10948, 10949, 10950, 10954, 10957, 10960, 10961, 10962, 10963, 10964, 10965, 10966, 10967, 10972, 10975, 10976, 10977, 10978, 10979, 10980, 10981, 10987, 10988, 10993, 10995, 10996, 10997, 10999, 11002, 11004, 11005, 11006, 11008, 11010, 11018, 11024, 11027, 11030, 11032, 11033, 11039, 11046, 11047, 11049, 11052, 11053, 11056, 11058, 11060, 11066, 11068, 11070, 11078, 11080, 11082, 11083, 11086, 11090, 11092, 11095, 11098, 11101, 11102, 11103, 11107, 11110, 11114, 11116, 11118, 11119, 11123, 11124, 11125, 11126, 11127, 11129, 11132, 11133, 11135, 11137, 11138, 11141, 11145, 11146, 11148, 11152, 11153, 11154, 11155, 11156, 11157, 11158, 11159, 11160, 11161, 11162, 11163, 11165, 11166, 11168, 11169, 11175, 11177, 11178, 11181, 11184, 11185, 11187, 11188, 11190, 11191, 11192, 11194, 11198, 11199, 11201, 11202, 11204, 11207, 11214, 11217, 11218, 11222, 11226, 11227, 11228, 11229, 11232, 11233, 11234, 11235, 11236, 11237, 11238, 11239, 11242, 11244, 11246, 11247, 11248, 11251, 11254, 11255, 11256, 11257, 11258, 11259, 11260, 11262, 11263, 11264, 11266, 11274, 11275, 11278, 11288, 11289, 11290, 11291, 11292, 11293, 11294, 11295, 11298, 11305, 11306, 11307, 11313, 11315, 11316, 11319, 11320, 11322, 11324, 11326, 11328, 11329, 11330, 11331, 11332, 11333, 11345, 11346, 11348, 11352, 11356, 11358, 11359, 11363, 11364, 11365, 11366, 11369, 11370, 11371, 11373, 11377, 11380, 11381, 11382, 11387, 11388, 11389, 11391, 11392, 11394, 11395, 11397, 11401, 11403, 11404, 11405, 11406, 11408, 11409, 11411, 11412, 11413, 11414, 11416, 11418, 11420, 11423, 11424, 11426, 11428, 11430, 11431, 11434, 11437, 11438, 11442, 11443, 11445, 11446, 11449, 11451, 11459, 11463, 11465, 11467, 11471, 11472, 11473, 11475, 11476, 11477, 11478, 11482, 11487, 11490, 11491, 11494, 11496, 11497, 11498, 11499, 11500, 11501, 11503, 11506, 11507, 11508, 11512, 11513, 11516, 11518, 11520, 11523, 11524, 11526, 11528, 11530, 11531, 11532, 11533, 11534, 11535, 11538, 11540, 11541, 11544, 11546, 11548, 11551, 11553, 11558, 11560, 11561, 11567, 11570, 11571, 11576, 11577, 11578, 11583, 11585, 11586, 11588, 11589, 11593, 11594, 11595, 11596, 11597, 11598, 11599, 11603, 11604, 11607, 11612, 11615, 11618, 11620, 11621, 11623, 11625, 11628, 11629, 11632, 11633, 11636, 11637, 11639, 11642, 11644, 11647, 11650, 11651, 11652, 11656, 11657, 11658, 11663, 11664, 11668, 11669, 11672, 11673, 11677, 11678, 11680, 11681, 11682, 11683, 11684, 11688, 11691, 11692, 11694, 11695, 11699, 11701, 11703, 11705, 11707, 11711, 11712, 11718, 11720, 11721, 11722, 11725, 11726, 11731, 11733, 11736, 11740, 11743, 11744, 11753, 11755, 11759, 11760, 11761, 11762, 11763, 11764, 11765, 11766, 11767, 11770, 11771, 11776, 11780, 11781, 11782, 11783, 11784, 11785, 11786, 11790, 11792, 11795, 11799, 11800, 11802, 11809, 11812, 11814, 11816, 11818, 11819, 11821, 11823, 11826, 11828, 11830, 11837, 11839, 11841, 11845, 11846, 11849, 11850, 11851, 11853, 11854, 11856, 11858, 11863, 11868, 11872, 11876, 11877, 11878, 11879, 11881, 11889, 11890, 11891, 11894, 11895, 11898, 11903, 11909, 11911, 11913, 11916, 11917, 11919, 11920, 11921, 11923, 11926, 11927, 11928, 11929, 11930, 11934, 11935, 11940, 11941, 11943, 11946, 11947, 11948, 11949, 11953, 11955, 11958, 11959, 11960, 11961, 11962, 11963, 11965, 11966, 11968, 11974, 11977, 11978, 11979, 11980, 11983, 11988, 11993, 11994, 11995, 11996, 11997, 11998, 11999, 12002, 12004, 12005, 12008, 12014, 12017, 12019, 12020, 12021, 12023, 12024, 12025, 12026, 12029, 12032, 12042, 12043, 12044, 12050, 12054, 12058, 12059, 12060, 12061, 12066, 12076, 12077, 12078, 12079, 12080, 12081, 12082, 12083, 12085, 12086, 12087, 12089, 12091, 12092, 12093, 12097, 12098, 12102, 12104, 12106, 12109, 12110, 12112, 12115, 12118, 12120, 12122, 12128, 12129, 12130, 12131, 12134, 12135, 12137, 12138, 12139, 12143, 12144, 12145, 12146, 12147, 12148, 12150, 12151, 12153, 12161, 12162, 12165, 12166, 12170, 12171, 12174, 12175, 12179, 12181, 12186, 12187, 12189, 12197, 12200, 12201, 12202, 12204, 12208, 12214, 12217, 12218, 12220, 12221, 12223, 12229, 12230, 12233, 12237, 12240, 12241, 12243, 12245, 12249, 12250, 12252, 12253, 12254, 12255, 12256, 12259, 12268, 12269, 12271, 12278, 12280, 12281, 12283, 12284, 12285, 12286, 12287, 12288, 12291, 12295, 12296, 12302, 12304, 12306, 12310, 12311, 12312, 12313, 12314, 12315, 12317, 12319, 12321, 12323, 12325, 12326, 12328, 12331, 12333, 12334, 12339, 12342, 12345, 12347, 12350, 12354, 12356, 12359, 12364, 12366, 12368, 12369, 12370, 12375, 12376, 12379, 12380, 12381, 12383, 12385, 12393, 12394, 12397, 12400, 12401, 12403, 12404, 12406, 12411, 12414, 12415, 12416, 12419, 12420, 12423, 12424, 12426, 12427, 12428, 12437, 12439, 12440, 12441, 12444, 12445, 12446, 12450, 12451, 12455, 12456, 12457, 12459, 12461, 12462, 12465, 12467, 12468, 12470, 12472, 12478, 12479, 12480, 12481, 12483, 12487, 12488, 12489, 12492, 12494, 12497, 12500, 12501, 12502, 12503, 12504, 12508, 12512, 12513, 12514, 12515, 12518, 12519, 12521, 12525, 12530, 12531, 12535, 12536, 12537, 12538, 12539, 12540, 12546, 12547, 12548, 12549, 12551, 12552, 12554, 12555, 12556, 12557, 12561, 12563, 12565, 12567, 12568, 12570, 12572, 12577, 12578, 12580, 12583, 12585, 12586, 12588, 12589, 12591, 12594, 12597, 12600, 12603, 12605, 12608, 12609, 12610, 12611, 12616, 12622, 12623, 12626, 12628, 12629, 12631, 12633, 12634, 12638, 12639, 12640, 12641, 12644, 12649, 12650, 12651, 12654, 12663, 12664, 12668, 12670, 12671, 12674, 12675, 12679, 12681, 12683, 12684, 12685, 12688, 12689, 12691, 12692, 12693, 12694, 12695, 12696, 12697, 12699, 12701, 12702, 12707, 12710, 12713, 12714, 12723, 12726, 12729, 12731, 12732, 12733, 12735, 12737, 12738, 12739, 12740, 12741, 12742, 12744, 12750, 12751, 12752, 12753, 12754, 12755, 12757, 12758, 12760, 12761, 12762, 12764, 12765, 12766, 12771, 12772, 12773, 12775, 12777, 12782, 12783, 12790, 12793, 12794, 12797, 12800, 12802, 12803, 12807, 12808, 12810, 12812, 12813, 12817, 12819, 12820, 12822, 12823, 12824, 12826, 12827, 12828, 12834, 12835, 12836, 12837, 12838, 12839, 12843, 12844, 12848, 12849, 12850, 12853, 12861, 12862, 12866, 12870, 12873, 12875, 12878, 12882, 12883, 12884, 12887, 12891, 12895, 12898, 12899, 12900, 12901, 12903, 12904, 12905, 12906, 12908, 12910, 12912, 12913, 12916, 12920, 12921, 12923, 12929, 12932, 12933, 12934, 12935, 12940, 12942, 12945, 12946, 12947, 12950, 12953, 12956, 12957, 12958, 12960, 12961, 12963, 12967, 12968, 12969, 12972, 12973, 12978, 12983, 12984, 12986, 12987, 12988, 12989, 12990, 12991, 12994, 12999, 13001, 13003, 13004, 13010, 13014, 13015, 13017, 13018, 13022, 13030, 13031, 13032, 13033, 13034, 13035, 13036, 13037, 13038, 13040, 13041, 13044, 13047, 13049, 13050, 13053, 13054, 13055, 13056, 13061, 13062, 13064, 13066, 13071, 13075, 13077, 13079, 13082, 13083, 13085, 13086, 13087, 13097, 13099, 13101, 13102, 13105, 13106, 13109, 13111, 13112, 13114, 13115, 13116, 13117, 13118, 13120, 13121, 13122, 13123, 13124, 13125, 13128, 13131, 13134, 13136, 13143, 13144, 13147, 13148, 13149, 13151, 13154, 13159, 13160, 13163, 13166, 13167, 13175, 13181, 13182, 13186, 13190, 13197, 13199, 13203, 13206, 13209, 13210, 13212, 13213, 13215, 13217, 13221, 13224, 13227, 13228, 13230, 13231, 13232, 13233, 13234, 13235, 13236, 13237, 13239, 13241, 13248, 13250, 13251, 13255, 13256, 13259, 13260, 13261, 13262, 13263, 13264, 13265, 13267, 13268, 13269, 13271, 13274, 13281, 13283, 13284, 13296, 13297, 13298, 13300, 13301, 13303, 13304, 13313, 13315, 13316, 13317, 13323, 13326, 13328, 13329, 13330, 13332, 13337, 13340, 13343, 13344, 13345, 13346, 13347, 13348, 13350, 13352, 13358, 13361, 13363, 13365, 13367, 13368, 13369, 13370, 13377, 13380, 13381, 13384, 13385, 13386, 13391, 13393, 13394, 13395, 13397, 13398, 13401, 13402, 13403, 13404, 13407, 13408, 13410, 13416, 13417, 13419, 13423, 13424, 13428, 13430, 13433, 13439, 13441, 13448, 13451, 13454, 13456, 13457, 13460, 13461, 13463, 13467, 13469, 13473, 13475, 13477, 13478, 13480, 13489, 13491, 13492, 13496, 13499, 13503, 13504, 13512, 13513, 13514, 13515, 13519, 13521, 13522, 13524, 13526, 13529, 13530, 13532, 13533, 13539, 13540, 13543, 13544, 13545, 13546, 13547, 13549, 13551, 13552, 13553, 13555, 13558, 13559, 13560, 13561, 13568, 13569, 13572, 13574, 13577, 13578, 13580, 13584, 13587, 13589, 13597, 13599, 13600, 13601, 13602, 13604, 13605, 13612, 13613, 13621, 13623, 13627, 13628, 13630, 13631, 13632, 13634, 13636, 13637, 13641, 13643, 13647, 13650, 13651, 13652, 13653, 13654, 13662, 13663, 13665, 13668, 13675, 13676, 13677, 13678, 13679, 13683, 13687, 13688, 13689, 13696, 13697, 13698, 13700, 13702, 13706, 13710, 13713, 13714, 13715, 13716, 13719, 13720, 13727, 13729, 13734, 13736, 13737, 13739, 13742, 13745, 13747, 13750, 13753, 13755, 13756, 13761, 13763, 13764, 13766, 13767, 13772, 13773, 13774, 13775, 13777, 13779, 13780, 13782, 13783, 13785, 13786, 13787, 13788, 13791, 13793, 13794, 13796, 13798, 13799, 13807, 13809, 13816, 13817, 13818, 13819, 13822, 13823, 13828, 13830, 13831, 13834, 13835, 13840, 13843, 13849, 13852, 13859, 13860, 13862, 13866, 13869, 13870, 13872, 13873, 13875, 13877, 13879, 13885, 13887, 13888, 13891, 13892, 13895, 13897, 13898, 13899, 13901, 13906, 13907, 13908, 13909, 13910, 13911, 13917, 13918, 13919, 13920, 13921, 13924, 13925, 13927, 13929, 13932, 13934, 13937, 13944, 13947, 13949, 13950, 13953, 13954, 13958, 13960, 13961, 13963, 13969, 13970, 13971, 13975, 13983, 13984, 13985, 13986, 13987, 13990, 13991, 13999, 14000, 14001, 14005, 14006, 14009, 14013, 14014, 14017, 14021, 14022, 14027, 14030, 14031, 14035, 14036, 14038, 14040, 14049, 14051, 14052, 14062, 14063, 14066, 14067, 14069, 14070, 14071, 14072, 14073, 14074, 14075, 14078, 14080, 14081, 14084, 14085, 14086, 14088, 14092, 14093, 14094, 14096, 14104, 14106, 14107, 14111, 14112, 14114, 14115, 14116, 14118, 14119, 14121, 14122, 14124, 14129, 14130, 14132, 14133, 14135, 14137, 14138, 14139, 14140, 14141, 14142, 14145, 14146, 14147.

Promoters expressing in the pure pollen at the tasseling stage include SEQ IDs: 1, 3, 5, 6, 7, 13, 14, 19, 21, 31, 34, 41, 48, 56, 63, 65, 69, 70, 71, 79, 80, 86, 88, 92, 93, 94, 95, 96, 98, 100, 102, 103, 104, 108, 111, 115, 123, 128, 131, 134, 135, 137, 138, 139, 145, 146, 152, 155, 156, 157, 159, 169, 175, 176, 181, 183, 187, 189, 191, 193, 202, 203, 211, 212, 214, 232, 233, 236, 237, 240, 242, 246, 248, 249, 251, 256, 259, 262, 267, 280, 286, 288, 289, 293, 294, 299, 301, 302, 305, 306, 319, 320, 329, 332, 335, 338, 341, 343, 344, 346, 349, 354, 356, 358, 359, 362, 363, 364, 365, 373, 381, 386, 388, 389, 396, 404, 411, 418, 431, 432, 434, 441, 448, 450, 462, 463, 465, 466, 468, 470, 471, 474, 478, 483, 485, 489, 498, 507, 509, 511, 514, 517, 522, 523, 525, 529, 532, 541, 546, 547, 554, 557, 560, 561, 562, 571, 578, 579, 580, 585, 589, 591, 592, 594, 595, 596, 599, 604, 608, 609, 610, 611, 613, 620, 630, 631, 634, 636, 638, 643, 645, 647, 650, 658, 661, 664, 665, 666, 669, 671, 672, 681, 683, 693, 694, 701, 705, 706, 709, 717, 718, 722, 724, 727, 733, 734, 739, 741, 742, 749, 753, 757, 758, 759, 760, 762, 764, 765, 771, 784, 793, 795, 798, 800, 804, 808, 809, 811, 816, 818, 820, 824, 825, 826, 827, 830, 833, 845, 846, 855, 857, 858, 866, 868, 869, 870, 871, 873, 875, 876, 877, 878, 890, 891, 892, 893, 895, 898, 899, 908, 916, 917, 919, 920, 923, 924, 928, 929, 931, 932, 933, 936, 939, 942, 943, 947, 949, 951, 953, 955, 957, 958, 961, 962, 963, 966, 971, 972, 973, 974, 975, 976, 977, 979, 982, 985, 987, 990, 991, 994, 995, 996, 997, 999, 1006, 1007, 1008, 1011, 1012, 1014, 1016, 1017, 1019, 1021, 1022, 1024, 1025, 1032, 1033, 1040, 1043, 1044, 1045, 1046, 1047, 1049, 1051, 1052, 1054, 1055, 1056, 1057, 1069, 1070, 1071, 1073, 1076, 1077, 1078, 1079, 1084, 1087, 1089, 1091, 1092, 1095, 1098, 1100, 1103, 1104, 1106, 1115, 1117, 1119, 1120, 1121, 1122, 1123, 1126, 1131, 1132, 1136, 1137, 1140, 1142, 1146, 1153, 1154, 1164, 1166, 1167, 1176, 1178, 1180, 1182, 1183, 1187, 1190, 1191, 1193, 1196, 1197, 1200, 1201, 1202, 1204, 1205, 1214, 1215, 1218, 1220, 1221, 1222, 1223, 1224, 1225, 1228, 1232, 1233, 1234, 1240, 1244, 1246, 1253, 1254, 1257, 1258, 1261, 1262, 1272, 1275, 1290, 1291, 1292, 1293, 1295, 1296, 1297, 1299, 1303, 1305, 1307, 1309, 1310, 1311, 1312, 1314, 1316, 1329, 1330, 1331, 1334, 1346, 1349, 1360, 1361, 1365, 1366, 1367, 1371, 1375, 1380, 1381, 1382, 1383, 1385, 1388, 1389, 1391, 1393, 1394, 1396, 1400, 1404, 1405, 1406, 1412, 1421, 1431, 1440, 1442, 1445, 1448, 1458, 1466, 1475, 1476, 1478, 1480, 1481, 1483, 1484, 1488, 1490, 1491, 1493, 1499, 1501, 1503, 1506, 1508, 1510, 1511, 1512, 1520, 1525, 1526, 1527, 1530, 1543, 1546, 1548, 1551, 1555, 1556, 1560, 1567, 1575, 1578, 1584, 1585, 1586, 1590, 1591, 1593, 1596, 1598, 1600, 1601, 1604, 1608, 1610, 1612, 1614, 1615, 1617, 1623, 1627, 1634, 1635, 1636, 1637, 1638, 1641, 1642, 1643, 1651, 1654, 1658, 1669, 1671, 1673, 1675, 1678, 1684, 1687, 1688, 1690, 1696, 1698, 1701, 1702, 1703, 1705, 1706, 1707, 1709, 1716, 1717, 1718, 1723, 1731, 1732, 1735, 1736, 1739, 1743, 1749, 1750, 1755, 1763, 1765, 1766, 1769, 1770, 1771, 1773, 1774, 1776, 1777, 1786, 1790, 1791, 1798, 1802, 1808, 1811, 1822, 1824, 1830, 1837, 1839, 1843, 1845, 1846, 1851, 1852, 1866, 1869, 1871, 1872, 1873, 1876, 1878, 1879, 1880, 1882, 1886, 1891, 1892, 1900, 1902, 1903, 1905, 1906, 1916, 1918, 1921, 1922, 1923, 1933, 1934, 1937, 1939, 1940, 1945, 1950, 1951, 1952, 1954, 1955, 1958, 1959, 1967, 1968, 1970, 1971, 1972, 1973, 1976, 1990, 1991, 1993, 1998, 1999, 2000, 2001, 2002, 2003, 2007, 2008, 2009, 2012, 2013, 2014, 2015, 2026, 2027, 2033, 2036, 2037, 2038, 2041, 2043, 2045, 2048, 2051, 2058, 2060, 2062, 2072, 2074, 2075, 2077, 2085, 2088, 2091, 2092, 2093, 2094, 2097, 2106, 2112, 2114, 2122, 2124, 2125, 2128, 2132, 2133, 2138, 2140, 2142, 2143, 2146, 2147, 2152, 2156, 2159, 2161, 2164, 2166, 2167, 2170, 2172, 2175, 2177, 2182, 2189, 2193, 2194, 2195, 2200, 2205, 2206, 2213, 2214, 2215, 2218, 2219, 2221, 2222, 2226, 2229, 2230, 2231, 2237, 2240, 2242, 2245, 2252, 2253, 2258, 2263, 2266, 2271, 2280, 2283, 2284, 2290, 2293, 2296, 2297, 2300, 2304, 2306, 2308, 2310, 2313, 2314, 2320, 2321, 2326, 2328, 2335, 2339, 2342, 2343, 2358, 2359, 2361, 2362, 2366, 2367, 2369, 2372, 2375, 2376, 2380, 2381, 2382, 2383, 2384, 2393, 2398, 2401, 2405, 2411, 2414, 2416, 2418, 2420, 2423, 2431, 2432, 2433, 2434, 2435, 2437, 2439, 2443, 2445, 2446, 2451, 2452, 2453, 2454, 2457, 2469, 2476, 2479, 2480, 2481, 2483, 2484, 2487, 2489, 2490, 2491, 2492, 2495, 2502, 2505, 2506, 2507, 2514, 2516, 2519, 2521, 2525, 2528, 2533, 2534, 2545, 2546, 2549, 2555, 2560, 2561, 2565, 2568, 2570, 2571, 2572, 2573, 2579, 2581, 2584, 2585, 2588, 2589, 2590, 2591, 2594, 2597, 2599, 2601, 2605, 2608, 2611, 2612, 2615, 2619, 2627, 2635, 2636, 2643, 2644, 2656, 2660, 2661, 2662, 2663, 2665, 2672, 2673, 2675, 2676, 2678, 2679, 2680, 2685, 2688, 2689, 2690, 2691, 2692, 2696, 2697, 2700, 2704, 2707, 2709, 2715, 2720, 2721, 2722, 2725, 2726, 2728, 2729, 2735, 2736, 2737, 2738, 2745, 2746, 2749, 2752, 2755, 2758, 2759, 2760, 2762, 2765, 2766, 2769, 2770, 2779, 2780, 2783, 2786, 2791, 2794, 2800, 2801, 2802, 2805, 2808, 2814, 2816, 2818, 2819, 2821, 2822, 2823, 2824, 2826, 2833, 2837, 2838, 2844, 2850, 2854, 2855, 2857, 2858, 2860, 2862, 2865, 2870, 2871, 2876, 2878, 2880, 2881, 2885, 2886, 2890, 2892, 2893, 2895, 2901, 2903, 2905, 2924, 2927, 2930, 2938, 2941, 2943, 2944, 2948, 2952, 2954, 2955, 2957, 2959, 2965, 2966, 2968, 2971, 2976, 2980, 2982, 2986, 2994, 2996, 3003, 3005, 3012, 3018, 3020, 3024, 3026, 3031, 3033, 3039, 3044, 3047, 3048, 3049, 3050, 3051, 3053, 3057, 3061, 3065, 3067, 3068, 3072, 3082, 3083, 3084, 3085, 3100, 3101, 3106, 3107, 3115, 3116, 3118, 3121, 3123, 3128, 3129, 3138, 3139, 3142, 3143, 3145, 3148, 3150, 3164, 3167, 3170, 3172, 3177, 3179, 3189, 3191, 3192, 3196, 3209, 3217, 3220, 3221, 3225, 3231, 3232, 3237, 3240, 3242, 3245, 3246, 3249, 3250, 3251, 3263, 3266, 3268, 3275, 3278, 3280, 3283, 3286, 3287, 3288, 3289, 3291, 3294, 3295, 3297, 3299, 3300, 3301, 3310, 3312, 3320, 3322, 3324, 3325, 3332, 3334, 3337, 3338, 3342, 3343, 3345, 3351, 3353, 3354, 3355, 3357, 3359, 3360, 3361, 3363, 3365, 3368, 3370, 3371, 3378, 3379, 3383, 3386, 3396, 3399, 3401, 3404, 3405, 3409, 3413, 3415, 3416, 3424, 3426, 3429, 3432, 3445, 3449, 3455, 3458, 3466, 3468, 3470, 3471, 3473, 3474, 3477, 3478, 3479, 3483, 3486, 3490, 3493, 3500, 3502, 3507, 3516, 3517, 3518, 3521, 3522, 3524, 3527, 3533, 3536, 3540, 3541, 3542, 3544, 3545, 3548, 3549, 3554, 3558, 3560, 3561, 3570, 3574, 3580, 3586, 3588, 3592, 3594, 3603, 3606, 3607, 3610, 3615, 3616, 3623, 3624, 3629, 3633, 3634, 3636, 3637, 3638, 3643, 3644, 3645, 3646, 3648, 3655, 3659, 3671, 3672, 3674, 3677, 3681, 3682, 3689, 3690, 3693, 3702, 3704, 3707, 3709, 3710, 3713, 3715, 3718, 3719, 3722, 3723, 3726, 3729, 3730, 3731, 3733, 3740, 3742, 3744, 3748, 3749, 3752, 3764, 3766, 3772, 3773, 3778, 3785, 3791, 3792, 3794, 3801, 3808, 3816, 3817, 3819, 3828, 3831, 3833, 3834, 3837, 3838, 3839, 3843, 3844, 3845, 3846, 3847, 3858, 3860, 3862, 3868, 3870, 3872, 3873, 3875, 3878, 3880, 3881, 3882, 3883, 3884, 3887, 3890, 3892, 3896, 3903, 3907, 3912, 3914, 3924, 3931, 3934, 3936, 3938, 3940, 3941, 3951, 3954, 3955, 3962, 3967, 3968, 3970, 3971, 3976, 3977, 3985, 3991, 3996, 4000, 4001, 4003, 4007, 4008, 4014, 4021, 4038, 4039, 4042, 4043, 4046, 4047, 4048, 4050, 4054, 4056, 4061, 4066, 4075, 4087, 4092, 4095, 4096, 4098, 4099, 4106, 4110, 4113, 4115, 4124, 4126, 4131, 4134, 4135, 4139, 4140, 4144, 4145, 4146, 4148, 4150, 4151, 4154, 4155, 4156, 4160, 4161, 4162, 4165, 4166, 4167, 4168, 4178, 4181, 4183, 4185, 4187, 4189, 4193, 4195, 4200, 4201, 4205, 4206, 4207, 4210, 4211, 4212, 4213, 4214, 4219, 4221, 4227, 4228, 4229, 4233, 4237, 4241, 4246, 4247, 4250, 4251, 4252, 4256, 4257, 4258, 4261, 4263, 4266, 4272, 4275, 4280, 4281, 4284, 4290, 4292, 4296, 4301, 4302, 4306, 4309, 4312, 4314, 4319, 4320, 4321, 4324, 4327, 4329, 4330, 4335, 4345, 4346, 4347, 4349, 4358, 4359, 4368, 4369, 4370, 4374, 4375, 4377, 4378, 4383, 4387, 4388, 4389, 4390, 4391, 4392, 4393, 4397, 4401, 4403, 4405, 4409, 4415, 4419, 4422, 4426, 4432, 4438, 4439, 4440, 4443, 4445, 4446, 4448, 4449, 4455, 4458, 4461, 4462, 4463, 4466, 4471, 4474, 4479, 4484, 4486, 4492, 4497, 4498, 4500, 4507, 4508, 4512, 4514, 4515, 4516, 4521, 4522, 4524, 4525, 4527, 4529, 4531, 4535, 4543, 4544, 4547, 4549, 4554, 4560, 4561, 4563, 4565, 4567, 4573, 4575, 4576, 4582, 4590, 4591, 4597, 4598, 4601, 4604, 4605, 4606, 4608, 4616, 4618, 4619, 4625, 4629, 4634, 4635, 4636, 4638, 4639, 4643, 4644, 4646, 4650, 4651, 4653, 4654, 4655, 4656, 4657, 4658, 4662, 4669, 4673, 4676, 4677, 4679, 4685, 4688, 4691, 4693, 4697, 4699, 4700, 4701, 4703, 4710, 4712, 4713, 4716, 4718, 4719, 4721, 4723, 4724, 4725, 4727, 4728, 4730, 4735, 4739, 4741, 4745, 4746, 4749, 4753, 4754, 4756, 4758, 4760, 4762, 4767, 4769, 4770, 4771, 4776, 4779, 4780, 4781, 4783, 4787, 4790, 4791, 4794, 4796, 4801, 4803, 4805, 4806, 4807, 4813, 4815, 4818, 4822, 4828, 4829, 4832, 4834, 4836, 4840, 4841, 4857, 4861, 4864, 4866, 4875, 4878, 4880, 4881, 4887, 4888, 4889, 4891, 4896, 4897, 4901, 4902, 4904, 4907, 4910, 4913, 4914, 4920, 4927, 4928, 4935, 4937, 4938, 4940, 4941, 4946, 4947, 4949, 4954, 4966, 4967, 4969, 4971, 4972, 4980, 4985, 4989, 4990, 4991, 4996, 5013, 5016, 5024, 5026, 5029, 5037, 5038, 5039, 5040, 5043, 5044, 5045, 5051, 5052, 5054, 5057, 5060, 5064, 5065, 5068, 5072, 5078, 5085, 5088, 5089, 5090, 5099, 5100, 5101, 5106, 5110, 5113, 5114, 5116, 5120, 5143, 5146, 5147, 5148, 5149, 5150, 5154, 5160, 5164, 5165, 5166, 5170, 5174, 5180, 5181, 5182, 5184, 5185, 5187, 5188, 5189, 5192, 5193, 5198, 5199, 5202, 5213, 5216, 5217, 5218, 5219, 5224, 5225, 5236, 5237, 5238, 5241, 5251, 5255, 5256, 5257, 5260, 5262, 5264, 5275, 5276, 5283, 5285, 5290, 5294, 5297, 5299, 5300, 5301, 5308, 5311, 5315, 5317, 5319, 5321, 5324, 5330, 5334, 5339, 5342, 5344, 5345, 5346, 5347, 5348, 5349, 5352, 5369, 5372, 5379, 5388, 5389, 5392, 5397, 5398, 5402, 5404, 5405, 5413, 5414, 5418, 5422, 5427, 5431, 5432, 5433, 5434, 5438, 5444, 5446, 5447, 5453, 5459, 5461, 5462, 5466, 5467, 5471, 5477, 5481, 5484, 5485, 5488, 5493, 5496, 5498, 5505, 5509, 5510, 5512, 5513, 5516, 5518, 5519, 5529, 5530, 5531, 5532, 5533, 5535, 5539, 5545, 5547, 5554, 5557, 5558, 5559, 5561, 5564, 5566, 5568, 5569, 5575, 5579, 5580, 5581, 5582, 5584, 5585, 5589, 5591, 5593, 5594, 5599, 5602, 5610, 5612, 5613, 5614, 5616, 5620, 5623, 5624, 5627, 5633, 5634, 5635, 5638, 5639, 5642, 5643, 5646, 5648, 5649, 5650, 5651, 5652, 5654, 5655, 5656, 5657, 5662, 5663, 5664, 5667, 5680, 5683, 5687, 5689, 5690, 5691, 5694, 5699, 5702, 5706, 5711, 5712, 5713, 5714, 5718, 5719, 5721, 5722, 5729, 5730, 5731, 5732, 5734, 5735, 5737, 5738, 5742, 5744, 5746, 5748, 5754, 5760, 5763, 5764, 5770, 5771, 5775, 5778, 5787, 5788, 5792, 5795, 5798, 5799, 5806, 5807, 5808, 5809, 5810, 5811, 5817, 5820, 5823, 5828, 5833, 5837, 5839, 5846, 5858, 5859, 5864, 5866, 5867, 5871, 5872, 5873, 5878, 5879, 5881, 5883, 5885, 5886, 5888, 5890, 5892, 5893, 5896, 5912, 5918, 5919, 5921, 5925, 5926, 5928, 5931, 5932, 5937, 5941, 5944, 5945, 5947, 5952, 5953, 5954, 5957, 5959, 5961, 5964, 5971, 5975, 5980, 5983, 5985, 5990, 5991, 5996, 5999, 6002, 6003, 6004, 6005, 6007, 6012, 6013, 6014, 6017, 6019, 6021, 6023, 6025, 6026, 6038, 6041, 6043, 6044, 6045, 6047, 6048, 6051, 6053, 6058, 6059, 6060, 6061, 6072, 6074, 6075, 6078, 6080, 6083, 6085, 6087, 6090, 6091, 6093, 6094, 6095, 6098, 6107, 6108, 6109, 6110, 6113, 6116, 6120, 6121, 6122, 6129, 6130, 6132, 6133, 6137, 6139, 6145, 6146, 6151, 6163, 6165, 6168, 6178, 6181, 6182, 6188, 6190, 6191, 6193, 6200, 6203, 6205, 6209, 6212, 6223, 6224, 6227, 6233, 6237, 6238, 6241, 6243, 6246, 6249, 6250, 6255, 6257, 6258, 6259, 6260, 6264, 6265, 6267, 6269, 6271, 6272, 6273, 6279, 6287, 6291, 6293, 6299, 6302, 6303, 6304, 6307, 6310, 6315, 6317, 6325, 6326, 6333, 6334, 6338, 6342, 6345, 6350, 6351, 6353, 6354, 6358, 6359, 6362, 6363, 6364, 6366, 6372, 6375, 6381, 6395, 6396, 6397, 6399, 6403, 6405, 6407, 6408, 6412, 6414, 6415, 6419, 6428, 6430, 6436, 6437, 6442, 6454, 6456, 6459, 6463, 6464, 6467, 6468, 6469, 6470, 6471, 6472, 6476, 6480, 6481, 6482, 6485, 6486, 6492, 6499, 6501, 6503, 6505, 6506, 6507, 6517, 6519, 6524, 6525, 6528, 6533, 6535, 6537, 6543, 6544, 6547, 6548, 6549, 6554, 6555, 6556, 6557, 6559, 6560, 6561, 6567, 6569, 6574, 6575, 6576, 6577, 6579, 6581, 6582, 6584, 6587, 6588, 6594, 6597, 6607, 6611, 6620, 6621, 6624, 6626, 6627, 6628, 6634, 6637, 6638, 6639, 6643, 6646, 6647, 6652, 6654, 6656, 6660, 6661, 6662, 6666, 6667, 6671, 6672, 6676, 6677, 6678, 6679, 6682, 6691, 6692, 6695, 6696, 6699, 6703, 6705, 6711, 6713, 6714, 6716, 6718, 6720, 6723, 6724, 6731, 6733, 6740, 6741, 6746, 6747, 6750, 6752, 6756, 6757, 6758, 6759, 6760, 6774, 6776, 6777, 6781, 6786, 6787, 6789, 6793, 6794, 6795, 6797, 6801, 6803, 6813, 6816, 6819, 6821, 6827, 6836, 6840, 6842, 6843, 6845, 6847, 6848, 6851, 6852, 6855, 6859, 6864, 6869, 6872, 6875, 6876, 6878, 6879, 6880, 6886, 6887, 6888, 6889, 6890, 6897, 6900, 6903, 6904, 6906, 6907, 6909, 6915, 6917, 6918, 6919, 6920, 6921, 6922, 6930, 6933, 6936, 6944, 6948, 6950, 6952, 6959, 6966, 6967, 6969, 6974, 6979, 6987, 6990, 6993, 6994, 7003, 7006, 7009, 7011, 7012, 7013, 7017, 7032, 7043, 7050, 7054, 7057, 7064, 7068, 7072, 7075, 7077, 7083, 7085, 7086, 7089, 7095, 7105, 7106, 7107, 7108, 7109, 7115, 7117, 7118, 7129, 7134, 7135, 7140, 7142, 7144, 7145, 7149, 7154, 7155, 7164, 7167, 7169, 7174, 7176, 7177, 7182, 7183, 7188, 7190, 7193, 7197, 7202, 7203, 7206, 7209, 7217, 7218, 7219, 7222, 7224, 7226, 7227, 7228, 7231, 7232, 7233, 7234, 7243, 7244, 7245, 7246, 7249, 7250, 7254, 7258, 7259, 7262, 7267, 7269, 7274, 7277, 7284, 7286, 7287, 7288, 7289, 7290, 7292, 7293, 7299, 7300, 7306, 7310, 7311, 7312, 7313, 7315, 7317, 7319, 7320, 7328, 7329, 7330, 7332, 7338, 7340, 7343, 7345, 7353, 7355, 7356, 7357, 7361, 7363, 7365, 7371, 7373, 7379, 7383, 7387, 7395, 7396, 7398, 7399, 7400, 7409, 7411, 7428, 7430, 7435, 7436, 7438, 7443, 7444, 7445, 7454, 7458, 7459, 7466, 7470, 7473, 7474, 7486, 7493, 7504, 7505, 7506, 7508, 7510, 7511, 7512, 7515, 7518, 7530, 7533, 7538, 7542, 7544, 7546, 7548, 7554, 7557, 7562, 7565, 7567, 7570, 7578, 7585, 7586, 7589, 7591, 7593, 7594, 7595, 7596, 7601, 7604, 7605, 7621, 7622, 7623, 7635, 7639, 7640, 7642, 7643, 7650, 7652, 7653, 7662, 7665, 7666, 7667, 7677, 7682, 7686, 7687, 7689, 7691, 7699, 7702, 7703, 7704, 7708, 7713, 7719, 7724, 7725, 7729, 7730, 7733, 7737, 7740, 7742, 7743, 7744, 7745, 7747, 7748, 7749, 7753, 7754, 7755, 7760, 7768, 7769, 7774, 7777, 7778, 7782, 7786, 7788, 7796, 7798, 7803, 7804, 7807, 7811, 7815, 7824, 7825, 7832, 7836, 7841, 7846, 7849, 7855, 7856, 7860, 7862, 7863, 7873, 7876, 7890, 7895, 7900, 7907, 7916, 7917, 7922, 7927, 7929, 7934, 7935, 7936, 7943, 7944, 7945, 7947, 7948, 7950, 7952, 7953, 7955, 7956, 7962, 7965, 7966, 7967, 7972, 7974, 7976, 7977, 7978, 7980, 7983, 7984, 7986, 7988, 7989, 7990, 7991, 7993, 7998, 8000, 8001, 8005, 8006, 8008, 8012, 8020, 8021, 8023, 8026, 8027, 8029, 8032, 8036, 8038, 8039, 8041, 8042, 8043, 8047, 8048, 8049, 8052, 8058, 8061, 8062, 8063, 8067, 8068, 8072, 8073, 8075, 8076, 8078, 8080, 8082, 8084, 8091, 8093, 8095, 8096, 8097, 8100, 8102, 8103, 8110, 8115, 8118, 8121, 8126, 8129, 8130, 8133, 8136, 8137, 8143, 8145, 8146, 8148, 8151, 8156, 8158, 8162, 8163, 8164, 8169, 8170, 8176, 8177, 8178, 8181, 8190, 8193, 8195, 8199, 8202, 8204, 8207, 8208, 8211, 8215, 8217, 8219, 8222, 8225, 8227, 8231, 8234, 8235, 8238, 8239, 8244, 8245, 8252, 8253, 8259, 8268, 8269, 8270, 8272, 8282, 8289, 8291, 8293, 8294, 8300, 8301, 8304, 8310, 8312, 8318, 8322, 8323, 8329, 8331, 8349, 8350, 8351, 8353, 8363, 8367, 8368, 8369, 8372, 8376, 8384, 8385, 8387, 8389, 8392, 8401, 8402, 8403, 8406, 8407, 8410, 8414, 8416, 8417, 8418, 8423, 8430, 8433, 8435, 8436, 8438, 8441, 8442, 8444, 8445, 8446, 8449, 8452, 8453, 8456, 8457, 8458, 8459, 8460, 8463, 8470, 8472, 8474, 8476, 8477, 8481, 8483, 8488, 8489, 8494, 8498, 8501, 8503, 8509, 8511, 8515, 8521, 8524, 8528, 8531, 8533, 8537, 8538, 8539, 8543, 8549, 8550, 8551, 8552, 8553, 8554, 8562, 8563, 8565, 8566, 8568, 8576, 8577, 8580, 8582, 8585, 8586, 8590, 8594, 8596, 8597, 8600, 8601, 8602, 8603, 8605, 8610, 8614, 8618, 8621, 8622, 8628, 8630, 8638, 8639, 8640, 8642, 8644, 8647, 8648, 8650, 8654, 8659, 8665, 8669, 8670, 8672, 8685, 8690, 8693, 8704, 8707, 8708, 8709, 8710, 8713, 8714, 8715, 8721, 8722, 8726, 8732, 8734, 8738, 8739, 8740, 8741, 8743, 8745, 8746, 8748, 8752, 8758, 8761, 8765, 8767, 8769, 8770, 8771, 8773, 8774, 8775, 8776, 8779, 8783, 8784, 8785, 8789, 8792, 8797, 8803, 8805, 8810, 8824, 8831, 8832, 8833, 8835, 8838, 8843, 8851, 8853, 8861, 8865, 8877, 8878, 8881, 8883, 8884, 8886, 8888, 8890, 8892, 8897, 8900, 8902, 8909, 8910, 8913, 8914, 8916, 8917, 8918, 8919, 8923, 8926, 8928, 8929, 8930, 8933, 8934, 8935, 8941, 8943, 8946, 8948, 8954, 8956, 8957, 8960, 8961, 8962, 8963, 8966, 8967, 8968, 8972, 8973, 8974, 8976, 8977, 8980, 8981, 8984, 8985, 8986, 8996, 8997, 8998, 8999, 9001, 9002, 9009, 9015, 9029, 9030, 9037, 9044, 9045, 9050, 9052, 9057, 9058, 9059, 9066, 9068, 9071, 9073, 9074, 9076, 9077, 9078, 9084, 9091, 9092, 9095, 9096, 9103, 9105, 9106, 9109, 9110, 9111, 9112, 9113, 9115, 9116, 9118, 9119, 9120, 9125, 9129, 9133, 9134, 9140, 9141, 9142, 9148, 9149, 9153, 9157, 9159, 9172, 9174, 9175, 9177, 9179, 9180, 9181, 9183, 9186, 9187, 9188, 9191, 9195, 9196, 9199, 9206, 9207, 9214, 9215, 9216, 9221, 9222, 9225, 9226, 9229, 9231, 9232, 9233, 9242, 9243, 9247, 9248, 9249, 9252, 9255, 9262, 9263, 9267, 9270, 9273, 9276, 9278, 9284, 9285, 9287, 9289, 9290, 9292, 9293, 9298, 9299, 9300, 9302, 9308, 9309, 9311, 9313, 9314, 9318, 9320, 9323, 9325, 9326, 9327, 9330, 9333, 9334, 9336, 9337, 9340, 9341, 9345, 9348, 9350, 9354, 9355, 9366, 9368, 9369, 9373, 9375, 9376, 9385, 9387, 9391, 9392, 9393, 9394, 9395, 9402, 9403, 9404, 9406, 9407, 9412, 9413, 9414, 9417, 9423, 9425, 9432, 9433, 9439, 9441, 9442, 9444, 9449, 9459, 9460, 9461, 9468, 9472, 9473, 9474, 9475, 9478, 9479, 9482, 9483, 9487, 9488, 9490, 9494, 9495, 9500, 9501, 9503, 9504, 9509, 9510, 9511, 9514, 9515, 9517, 9518, 9519, 9520, 9524, 9525, 9528, 9531, 9533, 9536, 9538, 9540, 9545, 9546, 9548, 9549, 9554, 9555, 9556, 9559, 9563, 9564, 9565, 9568, 9571, 9573, 9577, 9582, 9586, 9587, 9589, 9590, 9602, 9606, 9608, 9609, 9610, 9613, 9617, 9618, 9620, 9623, 9624, 9626, 9627, 9629, 9630, 9633, 9635, 9638, 9640, 9641, 9642, 9644, 9645, 9646, 9650, 9653, 9656, 9660, 9675, 9679, 9680, 9681, 9682, 9686, 9692, 9694, 9695, 9698, 9706, 9715, 9716, 9722, 9723, 9724, 9730, 9733, 9734, 9743, 9744, 9745, 9746, 9748, 9750, 9751, 9755, 9756, 9763, 9764, 9767, 9768, 9770, 9774, 9778, 9781, 9782, 9784, 9786, 9793, 9794, 9799, 9813, 9817, 9819, 9820, 9824, 9825, 9827, 9835, 9845, 9847, 9851, 9853, 9854, 9858, 9860, 9861, 9864, 9869, 9873, 9878, 9882, 9886, 9887, 9889, 9892, 9893, 9897, 9901, 9905, 9907, 9908, 9909, 9910, 9912, 9916, 9917, 9923, 9928, 9933, 9940, 9942, 9945, 9947, 9950, 9955, 9957, 9960, 9962, 9971, 9980, 9981, 9982, 9984, 9985, 9986, 9990, 9996, 9997, 9998, 10000, 10001, 10009, 10010, 10013, 10015, 10017, 10018, 10019, 10021, 10022, 10024, 10026, 10031, 10032, 10035, 10038, 10041, 10042, 10044, 10046, 10048, 10049, 10051, 10052, 10053, 10054, 10056, 10058, 10060, 10062, 10063, 10064, 10068, 10076, 10077, 10078, 10083, 10086, 10092, 10093, 10095, 10097, 10101, 10103, 10106, 10107, 10108, 10109, 10110, 10114, 10117, 10122, 10127, 10128, 10136, 10141, 10143, 10147, 10148, 10149, 10151, 10158, 10163, 10165, 10166, 10170, 10173, 10176, 10178, 10181, 10184, 10192, 10193, 10194, 10195, 10197, 10200, 10202, 10209, 10210, 10214, 10218, 10220, 10221, 10222, 10228, 10229, 10231, 10233, 10234, 10236, 10237, 10240, 10242, 10246, 10252, 10266, 10284, 10289, 10291, 10292, 10293, 10295, 10300, 10302, 10306, 10311, 10319, 10323, 10326, 10328, 10331, 10334, 10335, 10336, 10338, 10343, 10344, 10353, 10357, 10359, 10361, 10362, 10364, 10365, 10368, 10377, 10378, 10380, 10389, 10397, 10398, 10399, 10400, 10405, 10408, 10409, 10410, 10414, 10416, 10421, 10422, 10423, 10428, 10430, 10437, 10447, 10448, 10455, 10463, 10464, 10468, 10469, 10471, 10474, 10478, 10480, 10481, 10488, 10490, 10494, 10497, 10498, 10500, 10504, 10506, 10508, 10514, 10521, 10522, 10523, 10525, 10527, 10528, 10531, 10532, 10533, 10535, 10541, 10543, 10544, 10547, 10555, 10558, 10559, 10560, 10561, 10563, 10565, 10566, 10569, 10570, 10573, 10577, 10580, 10581, 10582, 10583, 10585, 10587, 10591, 10593, 10596, 10599, 10601, 10602, 10610, 10611, 10613, 10615, 10616, 10617, 10618, 10621, 10622, 10623, 10626, 10634, 10636, 10637, 10638, 10639, 10641, 10642, 10646, 10648, 10650, 10655, 10663, 10666, 10668, 10671, 10673, 10674, 10675, 10677, 10678, 10687, 10689, 10693, 10697, 10698, 10699, 10700, 10702, 10703, 10705, 10706, 10707, 10709, 10710, 10711, 10712, 10715, 10716, 10720, 10725, 10728, 10729, 10735, 10737, 10738, 10740, 10747, 10748, 10749, 10750, 10752, 10753, 10756, 10757, 10763, 10766, 10768, 10770, 10771, 10775, 10777, 10778, 10779, 10781, 10783, 10788, 10790, 10795, 10796, 10798, 10801, 10804, 10805, 10808, 10809, 10811, 10818, 10820, 10821, 10823, 10824, 10825, 10826, 10829, 10833, 10836, 10838, 10839, 10840, 10845, 10848, 10851, 10853, 10854, 10858, 10862, 10864, 10867, 10871, 10872, 10876, 10877, 10878, 10880, 10881, 10886, 10892, 10898, 10902, 10905, 10918, 10927, 10928, 10933, 10934, 10935, 10936, 10937, 10938, 10940, 10941, 10942, 10947, 10950, 10954, 10960, 10962, 10963, 10966, 10967, 10972, 10973, 10975, 10977, 10980, 10985, 10993, 10994, 10995, 10996, 10997, 10999, 11002, 11004, 11005, 11006, 11008, 11009, 11010, 11012, 11018, 11027, 11028, 11029, 11036, 11037, 11039, 11045, 11046, 11047, 11049, 11060, 11063, 11066, 11071, 11078, 11079, 11080, 11081, 11083, 11086, 11090, 11095, 11102, 11104, 11110, 11114, 11115, 11116, 11117, 11118, 11121, 11124, 11125, 11127, 11128, 11129, 11134, 11135, 11136, 11137, 11138, 11145, 11146, 11149, 11152, 11153, 11154, 11158, 11159, 11160, 11161, 11162, 11164, 11165, 11173, 11174, 11175, 11177, 11178, 11179, 11180, 11181, 11184, 11187, 11188, 11190, 11191, 11194, 11201, 11203, 11204, 11207, 11214, 11216, 11218, 11222, 11224, 11230, 11232, 11233, 11235, 11236, 11237, 11239, 11246, 11247, 11256, 11257, 11258, 11260, 11261, 11262, 11263, 11265, 11266, 11274, 11275, 11278, 11282, 11283, 11286, 11288, 11289, 11290, 11292, 11293, 11294, 11295, 11304, 11307, 11313, 11316, 11317, 11326, 11339, 11340, 11345, 11346, 11348, 11352, 11355, 11356, 11358, 11359, 11363, 11365, 11369, 11370, 11378, 11382, 11383, 11385, 11389, 11391, 11392, 11394, 11397, 11401, 11403, 11406, 11408, 11409, 11415, 11416, 11418, 11423, 11431, 11433, 11438, 11444, 11446, 11449, 11451, 11459, 11463, 11471, 11472, 11475, 11476, 11479, 11480, 11481, 11483, 11484, 11485, 11487, 11490, 11492, 11496, 11497, 11498, 11505, 11506, 11507, 11509, 11512, 11516, 11520, 11521, 11524, 11526, 11527, 11528, 11529, 11530, 11531, 11532, 11533, 11534, 11535, 11538, 11539, 11541, 11544, 11548, 11551, 11553, 11558, 11560, 11561, 11563, 11567, 11568, 11571, 11574, 11576, 11577, 11580, 11585, 11587, 11594, 11597, 11599, 11604, 11610, 11615, 11618, 11620, 11621, 11625, 11628, 11633, 11634, 11639, 11640, 11642, 11643, 11647, 11649, 11650, 11654, 11655, 11656, 11657, 11658, 11662, 11667, 11669, 11673, 11681, 11682, 11683, 11685, 11687, 11688, 11691, 11692, 11693, 11705, 11707, 11717, 11726, 11730, 11732, 11733, 11741, 11744, 11753, 11756, 11759, 11760, 11761, 11764, 11765, 11766, 11767, 11771, 11776, 11780, 11783, 11784, 11785, 11786, 11789, 11790, 11799, 11803, 11807, 11812, 11813, 11814, 11818, 11819, 11820, 11821, 11825, 11828, 11829, 11831, 11832, 11835, 11837, 11839, 11847, 11848, 11850, 11853, 11859, 11860, 11863, 11869, 11870, 11876, 11877, 11879, 11886, 11887, 11890, 11891, 11892, 11898, 11899, 11900, 11903, 11911, 11914, 11915, 11916, 11917, 11920, 11921, 11924, 11927, 11928, 11929, 11930, 11937, 11940, 11941, 11944, 11947, 11949, 11952, 11955, 11957, 11958, 11962, 11965, 11966, 11968, 11970, 11974, 11975, 11976, 11977, 11980, 11987, 11988, 11993, 11997, 11998, 11999, 12004, 12006, 12016, 12018, 12020, 12023, 12024, 12029, 12038, 12042, 12044, 12047, 12050, 12051, 12054, 12058, 12059, 12060, 12061, 12062, 12064, 12068, 12074, 12080, 12081, 12083, 12091, 12093, 12094, 12095, 12097, 12098, 12104, 12108, 12109, 12112, 12117, 12118, 12120, 12128, 12130, 12131, 12134, 12135, 12136, 12138, 12140, 12145, 12146, 12147, 12153, 12155, 12162, 12163, 12165, 12166, 12167, 12171, 12176, 12179, 12181, 12183, 12187, 12189, 12197, 12202, 12204, 12208, 12212, 12214, 12215, 12217, 12223, 12224, 12228, 12229, 12233, 12234, 12237, 12238, 12240, 12245, 12246, 12249, 12252, 12253, 12254, 12255, 12259, 12268, 12274, 12280, 12283, 12285, 12293, 12295, 12296, 12302, 12309, 12310, 12311, 12313, 12314, 12321, 12325, 12328, 12331, 12334, 12335, 12337, 12339, 12340, 12342, 12343, 12347, 12350, 12364, 12366, 12372, 12373, 12375, 12376, 12377, 12379, 12381, 12383, 12390, 12391, 12393, 12397, 12400, 12401, 12402, 12403, 12405, 12406, 12409, 12411, 12414, 12415, 12419, 12420, 12423, 12424, 12425, 12426, 12427, 12430, 12432, 12437, 12438, 12440, 12443, 12444, 12445, 12450, 12451, 12457, 12461, 12467, 12468, 12472, 12473, 12475, 12478, 12481, 12487, 12488, 12489, 12492, 12497, 12503, 12510, 12511, 12512, 12513, 12514, 12515, 12518, 12525, 12527, 12531, 12536, 12538, 12540, 12547, 12549, 12551, 12552, 12554, 12555, 12556, 12557, 12563, 12565, 12568, 12572, 12577, 12578, 12580, 12585, 12588, 12590, 12604, 12610, 12611, 12616, 12620, 12622, 12623, 12624, 12628, 12630, 12631, 12632, 12634, 12636, 12637, 12645, 12648, 12657, 12658, 12663, 12664, 12668, 12677, 12683, 12684, 12685, 12689, 12693, 12695, 12696, 12697, 12699, 12702, 12705, 12706, 12707, 12716, 12723, 12727, 12731, 12732, 12733, 12737, 12738, 12740, 12750, 12755, 12758, 12760, 12764, 12765, 12766, 12771, 12772, 12773, 12775, 12777, 12782, 12784, 12785, 12791, 12797, 12799, 12801, 12802, 12807, 12808, 12810, 12812, 12813, 12817, 12821, 12822, 12823, 12824, 12827, 12828, 12838, 12839, 12842, 12848, 12849, 12853, 12856, 12858, 12861, 12870, 12873, 12879, 12884, 12887, 12888, 12889, 12891, 12892, 12894, 12896, 12898, 12900, 12901, 12903, 12904, 12905, 12907, 12908, 12910, 12916, 12917, 12928, 12932, 12935, 12947, 12950, 12952, 12956, 12958, 12959, 12960, 12961, 12962, 12963, 12967, 12969, 12978, 12985, 12986, 12988, 12992, 12996, 13000, 13001, 13004, 13005, 13010, 13012, 13014, 13015, 13017, 13022, 13027, 13030, 13031, 13035, 13044, 13047, 13049, 13053, 13054, 13055, 13056, 13061, 13064, 13065, 13066, 13075, 13083, 13085, 13106, 13110, 13111, 13112, 13115, 13120, 13123, 13125, 13127, 13128, 13136, 13151, 13154, 13155, 13160, 13164, 13169, 13170, 13175, 13177, 13180, 13182, 13185, 13186, 13187, 13189, 13193, 13195, 13198, 13199, 13207, 13210, 13213, 13220, 13221, 13226, 13228, 13235, 13236, 13237, 13239, 13243, 13248, 13258, 13260, 13261, 13262, 13263, 13264, 13266, 13268, 13269, 13271, 13274, 13275, 13279, 13281, 13283, 13284, 13293, 13301, 13303, 13304, 13306, 13313, 13317, 13329, 13333, 13340, 13341, 13348, 13352, 13363, 13368, 13369, 13370, 13373, 13377, 13379, 13380, 13381, 13386, 13387, 13391, 13393, 13394, 13395, 13396, 13397, 13400, 13407, 13408, 13412, 13413, 13414, 13417, 13419, 13420, 13423, 13424, 13429, 13430, 13433, 13439, 13441, 13443, 13446, 13448, 13456, 13460, 13463, 13464, 13467, 13469, 13473, 13474, 13475, 13477, 13478, 13479, 13480, 13481, 13489, 13492, 13499, 13501, 13503, 13504, 13506, 13507, 13509, 13515, 13519, 13522, 13524, 13529, 13530, 13532, 13535, 13536, 13539, 13540, 13543, 13544, 13546, 13549, 13552, 13558, 13559, 13565, 13566, 13580, 13585, 13587, 13589, 13594, 13598, 13599, 13600, 13604, 13605, 13606, 13612, 13613, 13616, 13630, 13632, 13633, 13634, 13637, 13639, 13640, 13641, 13647, 13649, 13650, 13654, 13659, 13660, 13662, 13663, 13665, 13667, 13669, 13675, 13677, 13678, 13683, 13687, 13697, 13699, 13700, 13708, 13714, 13716, 13719, 13720, 13726, 13727, 13729, 13734, 13739, 13742, 13745, 13747, 13749, 13751, 13753, 13756, 13758, 13764, 13765, 13767, 13768, 13769, 13772, 13773, 13776, 13779, 13780, 13786, 13787, 13788, 13789, 13799, 13805, 13809, 13810, 13816, 13817, 13818, 13819, 13821, 13822, 13823, 13830, 13831, 13834, 13835, 13840, 13848, 13849, 13856, 13858, 13872, 13873, 13874, 13877, 13885, 13887, 13892, 13895, 13897, 13899, 13900, 13901, 13906, 13908, 13909, 13911, 13917, 13919, 13925, 13934, 13944, 13950, 13952, 13961, 13962, 13963, 13969, 13970, 13976, 13984, 13986, 13987, 14001, 14005, 14006, 14008, 14017, 14018, 14022, 14027, 14030, 14031, 14033, 14036, 14037, 14049, 14051, 14054, 14057, 14059, 14060, 14063, 14066, 14068, 14069, 14070, 14071, 14078, 14079, 14081, 14084, 14085, 14088, 14091, 14094, 14095, 14097, 14102, 14106, 14107, 14112, 14116, 14117, 14118, 14119, 14121, 14122, 14124, 14125, 14126, 14129, 14130, 14132, 14137, 14138, 14139, 14146, 14147.

Promoters expressing in a mixture of all root tissues at the V5 stage at 11 a.m. include SEQ IDs: 3, 4, 7, 8, 12, 13, 14, 15, 16, 17, 19, 24, 27, 29, 31, 33, 34, 36, 37, 48, 51, 54, 57, 63, 64, 65, 73, 79, 80, 81, 82, 88, 90, 93, 94, 96, 98, 99, 102, 103, 104, 108, 110, 111, 112, 115, 117, 123, 128, 130, 131, 137, 141, 143, 148, 152, 154, 156, 157, 159, 160, 162, 172, 174, 175, 176, 179, 180, 181, 182, 183, 187, 189, 191, 193, 194, 196, 197, 199, 202, 203, 204, 205, 207, 211, 212, 214, 217, 223, 232, 233, 235, 236, 237, 239, 240, 242, 244, 246, 249, 250, 251, 257, 259, 262, 264, 267, 269, 270, 271, 273, 280, 281, 286, 288, 289, 293, 294, 298, 299, 301, 302, 308, 309, 314, 316, 319, 320, 322, 323, 328, 329, 332, 334, 335, 338, 340, 346, 348, 349, 352, 353, 354, 355, 356, 357, 358, 359, 360, 364, 365, 371, 372, 373, 374, 376, 378, 379, 381, 387, 388, 396, 401, 405, 411, 412, 414, 423, 424, 428, 429, 432, 433, 434, 436, 441, 448, 452, 454, 456, 461, 462, 463, 466, 468, 470, 471, 474, 478, 479, 483, 484, 485, 488, 489, 492, 496, 498, 505, 507, 509, 510, 511, 514, 516, 517, 522, 523, 525, 528, 532, 534, 537, 538, 541, 543, 544, 546, 547, 548, 553, 554, 557, 561, 563, 578, 580, 582, 585, 591, 594, 595, 596, 598, 599, 601, 602, 606, 607, 608, 609, 613, 619, 620, 623, 631, 633, 635, 636, 637, 638, 643, 647, 650, 655, 663, 664, 666, 667, 668, 671, 673, 681, 683, 685, 687, 692, 693, 694, 695, 701, 702, 705, 706, 707, 708, 709, 716, 717, 718, 719, 721, 722, 723, 724, 727, 732, 734, 735, 736, 739, 740, 742, 744, 749, 752, 753, 757, 758, 759, 760, 761, 762, 764, 765, 771, 779, 782, 783, 784, 785, 786, 792, 793, 800, 804, 806, 808, 809, 811, 819, 820, 821, 822, 824, 825, 826, 827, 829, 830, 833, 836, 840, 841, 846, 849, 855, 856, 857, 858, 860, 862, 863, 865, 869, 870, 871, 875, 876, 877, 879, 882, 883, 887, 890, 891, 892, 893, 895, 897, 898, 899, 900, 903, 907, 908, 910, 911, 912, 913, 915, 916, 919, 920, 922, 924, 925, 928, 932, 934, 936, 943, 944, 947, 951, 953, 955, 957, 958, 960, 964, 971, 974, 975, 976, 978, 979, 980, 981, 982, 983, 984, 987, 988, 991, 993, 994, 995, 996, 997, 999, 1002, 1005, 1006, 1007, 1008, 1009, 1010, 1011, 1012, 1013, 1014, 1016, 1017, 1022, 1024, 1026, 1032, 1033, 1035, 1038, 1041, 1042, 1043, 1045, 1046, 1047, 1049, 1051, 1052, 1054, 1055, 1056, 1057, 1059, 1064, 1065, 1067, 1069, 1070, 1073, 1076, 1077, 1080, 1085, 1086, 1087, 1088, 1089, 1092, 1095, 1096, 1100, 1101, 1103, 1104, 1106, 1110, 1112, 1114, 1115, 1116, 1117, 1119, 1120, 1121, 1125, 1126, 1127, 1130, 1132, 1136, 1137, 1140, 1144, 1146, 1147, 1148, 1153, 1154, 1160, 1161, 1162, 1164, 1165, 1167, 1168, 1170, 1171, 1175, 1176, 1178, 1183, 1187, 1189, 1190, 1191, 1196, 1198, 1200, 1201, 1203, 1204, 1205, 1213, 1214, 1217, 1218, 1221, 1222, 1223, 1224, 1225, 1228, 1230, 1231, 1232, 1233, 1236, 1240, 1243, 1248, 1249, 1250, 1251, 1252, 1254, 1257, 1258, 1263, 1269, 1272, 1277, 1281, 1285, 1286, 1290, 1291, 1292, 1293, 1296, 1298, 1301, 1303, 1306, 1307, 1309, 1312, 1314, 1316, 1317, 1320, 1322, 1323, 1327, 1331, 1334, 1337, 1343, 1345, 1347, 1349, 1354, 1355, 1360, 1364, 1366, 1367, 1368, 1371, 1376, 1377, 1380, 1381, 1388, 1389, 1391, 1392, 1393, 1396, 1398, 1399, 1400, 1403, 1404, 1405, 1406, 1412, 1416, 1420, 1421, 1423, 1426, 1431, 1432, 1433, 1437, 1438, 1439, 1440, 1441, 1442, 1447, 1448, 1451, 1453, 1458, 1459, 1461, 1462, 1466, 1467, 1468, 1471, 1472, 1474, 1475, 1483, 1484, 1485, 1488, 1490, 1491, 1492, 1493, 1498, 1499, 1501, 1503, 1504, 1508, 1510, 1511, 1514, 1517, 1518, 1519, 1525, 1526, 1527, 1528, 1530, 1539, 1543, 1545, 1546, 1547, 1549, 1550, 1551, 1554, 1555, 1556, 1560, 1561, 1563, 1564, 1567, 1570, 1571, 1575, 1576, 1578, 1579, 1584, 1585, 1586, 1590, 1591, 1595, 1596, 1598, 1599, 1600, 1601, 1602, 1604, 1605, 1608, 1609, 1610, 1612, 1614, 1615, 1616, 1617, 1622, 1623, 1625, 1632, 1634, 1635, 1637, 1638, 1639, 1642, 1643, 1650, 1651, 1652, 1653, 1654, 1658, 1659, 1662, 1663, 1668, 1669, 1671, 1673, 1675, 1676, 1678, 1681, 1682, 1684, 1685, 1687, 1688, 1689, 1690, 1691, 1697, 1698, 1699, 1703, 1705, 1706, 1707, 1708, 1710, 1712, 1716, 1717, 1718, 1720, 1723, 1725, 1729, 1731, 1732, 1735, 1736, 1739, 1745, 1750, 1755, 1759, 1761, 1764, 1770, 1773, 1774, 1776, 1785, 1786, 1791, 1792, 1796, 1798, 1807, 1809, 1811, 1813, 1814, 1826, 1828, 1830, 1832, 1834, 1835, 1837, 1838, 1839, 1840, 1845, 1848, 1852, 1854, 1855, 1856, 1859, 1861, 1863, 1866, 1867, 1868, 1869, 1872, 1873, 1876, 1879, 1880, 1882, 1886, 1888, 1891, 1897, 1898, 1899, 1900, 1902, 1905, 1906, 1910, 1911, 1915, 1916, 1918, 1920, 1921, 1922, 1923, 1924, 1928, 1930, 1931, 1933, 1934, 1936, 1939, 1940, 1945, 1949, 1950, 1952, 1953, 1954, 1958, 1968, 1970, 1971, 1972, 1973, 1976, 1977, 1990, 1992, 1993, 1994, 1995, 1996, 1999, 2000, 2001, 2003, 2007, 2010, 2012, 2013, 2014, 2015, 2016, 2017, 2019, 2020, 2021, 2026, 2027, 2031, 2032, 2034, 2036, 2037, 2040, 2041, 2043, 2045, 2046, 2058, 2060, 2062, 2064, 2066, 2071, 2072, 2074, 2077, 2078, 2085, 2088, 2089, 2091, 2093, 2094, 2095, 2097, 2099, 2103, 2104, 2106, 2107, 2111, 2112, 2122, 2123, 2125, 2126, 2128, 2132, 2133, 2137, 2138, 2139, 2140, 2142, 2143, 2144, 2146, 2147, 2150, 2151, 2156, 2157, 2161, 2162, 2164, 2166, 2167, 2168, 2170, 2172, 2173, 2175, 2177, 2179, 2185, 2188, 2189, 2190, 2193, 2196, 2200, 2202, 2203, 2205, 2206, 2210, 2213, 2215, 2216, 2218, 2221, 2222, 2223, 2225, 2226, 2227, 2237, 2240, 2241, 2242, 2243, 2244, 2253, 2257, 2260, 2263, 2265, 2267, 2271, 2273, 2274, 2276, 2278, 2280, 2282, 2284, 2289, 2290, 2291, 2296, 2298, 2300, 2303, 2304, 2305, 2306, 2308, 2309, 2310, 2313, 2314, 2322, 2323, 2328, 2329, 2331, 2333, 2337, 2338, 2339, 2342, 2343, 2345, 2352, 2353, 2358, 2363, 2366, 2367, 2369, 2371, 2375, 2379, 2380, 2381, 2382, 2383, 2384, 2398, 2401, 2402, 2403, 2405, 2410, 2412, 2413, 2414, 2418, 2419, 2420, 2423, 2426, 2428, 2430, 2431, 2432, 2433, 2434, 2435, 2437, 2439, 2440, 2441, 2442, 2443, 2445, 2446, 2449, 2451, 2452, 2453, 2454, 2455, 2457, 2458, 2465, 2466, 2469, 2470, 2472, 2474, 2476, 2477, 2479, 2480, 2481, 2485, 2487, 2489, 2490, 2492, 2494, 2495, 2496, 2498, 2500, 2504, 2505, 2506, 2507, 2509, 2513, 2514, 2515, 2516, 2517, 2519, 2522, 2525, 2528, 2529, 2531, 2532, 2533, 2536, 2537, 2538, 2539, 2541, 2544, 2546, 2549, 2551, 2552, 2554, 2555, 2556, 2557, 2559, 2567, 2568, 2571, 2573, 2578, 2579, 2581, 2583, 2589, 2590, 2599, 2600, 2601, 2605, 2609, 2611, 2612, 2613, 2614, 2616, 2617, 2618, 2620, 2625, 2626, 2627, 2632, 2634, 2635, 2639, 2644, 2645, 2648, 2652, 2654, 2655, 2658, 2661, 2662, 2663, 2666, 2671, 2672, 2674, 2678, 2679, 2684, 2685, 2687, 2689, 2690, 2691, 2692, 2694, 2696, 2700, 2702, 2704, 2708, 2711, 2719, 2720, 2721, 2722, 2723, 2725, 2726, 2727, 2728, 2729, 2730, 2731, 2735, 2737, 2738, 2739, 2744, 2745, 2746, 2747, 2749, 2752, 2755, 2756, 2757, 2762, 2763, 2764, 2765, 2770, 2775, 2776, 2779, 2784, 2785, 2786, 2787, 2789, 2794, 2798, 2800, 2801, 2802, 2805, 2808, 2812, 2814, 2819, 2823, 2824, 2827, 2828, 2829, 2831, 2832, 2833, 2834, 2837, 2838, 2840, 2845, 2850, 2860, 2861, 2862, 2864, 2865, 2869, 2871, 2876, 2878, 2881, 2886, 2888, 2889, 2890, 2892, 2893, 2894, 2895, 2896, 2901, 2902, 2903, 2906, 2908, 2909, 2914, 2915, 2916, 2917, 2918, 2919, 2922, 2923, 2926, 2930, 2931, 2932, 2933, 2934, 2935, 2941, 2942, 2943, 2944, 2945, 2946, 2947, 2948, 2955, 2959, 2962, 2963, 2964, 2966, 2968, 2976, 2979, 2982, 2992, 2994, 3003, 3005, 3007, 3008, 3009, 3013, 3015, 3017, 3018, 3020, 3023, 3024, 3027, 3029, 3031, 3039, 3042, 3043, 3044, 3045, 3047, 3048, 3049, 3051, 3052, 3053, 3055, 3058, 3059, 3064, 3068, 3070, 3072, 3075, 3076, 3077, 3078, 3080, 3083, 3085, 3087, 3090, 3095, 3096, 3100, 3101, 3112, 3115, 3118, 3119, 3120, 3121, 3122, 3123, 3126, 3127, 3128, 3129, 3138, 3139, 3141, 3143, 3145, 3153, 3157, 3158, 3167, 3169, 3170, 3171, 3172, 3177, 3181, 3185, 3187, 3189, 3191, 3192, 3194, 3201, 3202, 3205, 3206, 3208, 3210, 3215, 3217, 3219, 3220, 3221, 3224, 3225, 3227, 3228, 3230, 3231, 3235, 3236, 3237, 3239, 3240, 3242, 3246, 3247, 3252, 3261, 3263, 3266, 3267, 3269, 3271, 3272, 3280, 3282, 3283, 3286, 3288, 3289, 3290, 3291, 3294, 3295, 3297, 3299, 3301, 3303, 3308, 3310, 3312, 3313, 3324, 3327, 3331, 3332, 3333, 3337, 3338, 3340, 3342, 3343, 3345, 3351, 3353, 3354, 3355, 3357, 3358, 3359, 3360, 3361, 3363, 3370, 3373, 3377, 3378, 3379, 3383, 3386, 3394, 3396, 3399, 3403, 3404, 3405, 3413, 3415, 3416, 3418, 3419, 3424, 3425, 3426, 3427, 3428, 3435, 3438, 3441, 3442, 3445, 3446, 3447, 3449, 3450, 3451, 3452, 3453, 3458, 3461, 3462, 3465, 3466, 3468, 3469, 3470, 3471, 3474, 3477, 3484, 3488, 3490, 3491, 3493, 3494, 3500, 3502, 3503, 3504, 3507, 3510, 3515, 3516, 3517, 3518, 3523, 3524, 3529, 3533, 3535, 3536, 3538, 3540, 3541, 3542, 3544, 3545, 3548, 3549, 3554, 3558, 3560, 3562, 3569, 3571, 3574, 3576, 3577, 3580, 3587, 3588, 3589, 3591, 3592, 3594, 3595, 3597, 3600, 3601, 3603, 3604, 3607, 3610, 3611, 3613, 3615, 3616, 3618, 3619, 3620, 3621, 3624, 3629, 3633, 3634, 3640, 3642, 3643, 3644, 3645, 3646, 3648, 3655, 3657, 3659, 3660, 3661, 3662, 3667, 3672, 3674, 3676, 3677, 3678, 3681, 3682, 3684, 3685, 3690, 3693, 3694, 3702, 3706, 3707, 3709, 3713, 3715, 3717, 3718, 3719, 3721, 3723, 3725, 3726, 3730, 3731, 3738, 3739, 3743, 3744, 3748, 3749, 3752, 3756, 3764, 3765, 3766, 3772, 3773, 3774, 3775, 3777, 3778, 3783, 3785, 3787, 3791, 3792, 3793, 3794, 3798, 3800, 3801, 3804, 3806, 3808, 3817, 3818, 3819, 3820, 3823, 3828, 3829, 3830, 3831, 3832, 3833, 3835, 3837, 3838, 3839, 3843, 3844, 3845, 3846, 3847, 3849, 3852, 3858, 3859, 3860, 3867, 3868, 3870, 3871, 3872, 3873, 3876, 3877, 3882, 3883, 3884, 3885, 3887, 3889, 3890, 3892, 3894, 3895, 3896, 3898, 3902, 3903, 3904, 3907, 3908, 3910, 3912, 3913, 3916, 3917, 3918, 3923, 3924, 3928, 3929, 3933, 3934, 3938, 3940, 3941, 3947, 3950, 3951, 3952, 3954, 3958, 3962, 3967, 3968, 3971, 3972, 3974, 3975, 3978, 3983, 3985, 3988, 3994, 3995, 3996, 3997, 3998, 4000, 4005, 4007, 4008, 4012, 4013, 4014, 4019, 4020, 4026, 4028, 4030, 4033, 4037, 4038, 4039, 4040, 4041, 4042, 4044, 4046, 4047, 4048, 4049, 4050, 4051, 4052, 4053, 4054, 4056, 4057, 4061, 4062, 4066, 4068, 4070, 4071, 4075, 4079, 4080, 4084, 4088, 4092, 4094, 4096, 4099, 4102, 4103, 4105, 4106, 4109, 4110, 4113, 4124, 4126, 4128, 4132, 4133, 4135, 4139, 4140, 4143, 4144, 4146, 4147, 4148, 4149, 4150, 4155, 4157, 4158, 4160, 4161, 4162, 4163, 4165, 4166, 4167, 4168, 4170, 4171, 4173, 4175, 4178, 4179, 4181, 4183, 4185, 4187, 4188, 4189, 4191, 4192, 4193, 4195, 4201, 4202, 4204, 4205, 4206, 4207, 4208, 4210, 4211, 4212, 4217, 4219, 4221, 4222, 4227, 4228, 4229, 4233, 4234, 4235, 4237, 4242, 4245, 4246, 4250, 4251, 4252, 4253, 4257, 4258, 4260, 4261, 4263, 4266, 4270, 4272, 4275, 4276, 4280, 4281, 4284, 4288, 4290, 4292, 4294, 4296, 4298, 4301, 4302, 4304, 4306, 4309, 4312, 4314, 4317, 4320, 4321, 4324, 4329, 4330, 4333, 4335, 4338, 4339, 4341, 4344, 4347, 4352, 4354, 4356, 4358, 4359, 4360, 4369, 4370, 4371, 4373, 4377, 4378, 4380, 4383, 4388, 4390, 4391, 4393, 4395, 4396, 4397, 4401, 4402, 4403, 4404, 4405, 4409, 4410, 4422, 4423, 4425, 4430, 4432, 4436, 4437, 4439, 4440, 4443, 4446, 4448, 4449, 4450, 4453, 4461, 4462, 4463, 4464, 4466, 4467, 4468, 4470, 4474, 4475, 4479, 4486, 4492, 4494, 4496, 4497, 4498, 4500, 4502, 4507, 4508, 4512, 4513, 4514, 4515, 4518, 4519, 4521, 4531, 4532, 4535, 4543, 4548, 4549, 4551, 4554, 4555, 4556, 4557, 4558, 4560, 4562, 4563, 4565, 4566, 4567, 4568, 4575, 4576, 4580, 4582, 4583, 4584, 4590, 4591, 4593, 4594, 4596, 4597, 4598, 4601, 4604, 4606, 4608, 4616, 4623, 4625, 4628, 4630, 4632, 4633, 4635, 4639, 4641, 4643, 4644, 4645, 4646, 4647, 4650, 4651, 4653, 4654, 4655, 4657, 4658, 4659, 4662, 4664, 4667, 4669, 4671, 4672, 4673, 4674, 4676, 4677, 4680, 4682, 4685, 4691, 4692, 4694, 4696, 4697, 4699, 4700, 4701, 4703, 4705, 4706, 4708, 4710, 4711, 4712, 4713, 4715, 4719, 4721, 4723, 4729, 4730, 4734, 4736, 4737, 4738, 4739, 4740, 4741, 4746, 4747, 4749, 4750, 4753, 4755, 4756, 4758, 4761, 4762, 4766, 4767, 4769, 4770, 4771, 4779, 4780, 4784, 4787, 4788, 4789, 4790, 4791, 4794, 4795, 4796, 4801, 4802, 4803, 4804, 4805, 4806, 4807, 4809, 4813, 4815, 4816, 4817, 4818, 4822, 4828, 4829, 4830, 4831, 4834, 4838, 4841, 4842, 4845, 4855, 4856, 4857, 4859, 4861, 4862, 4863, 4864, 4869, 4874, 4875, 4876, 4880, 4881, 4887, 4889, 4891, 4896, 4900, 4902, 4904, 4905, 4907, 4909, 4910, 4913, 4914, 4918, 4921, 4922, 4924, 4925, 4935, 4936, 4938, 4941, 4942, 4943, 4944, 4950, 4954, 4958, 4959, 4960, 4967, 4969, 4971, 4972, 4974, 4975, 4977, 4984, 4985, 4987, 4988, 4993, 4994, 4996, 5000, 5005, 5007, 5011, 5015, 5016, 5021, 5022, 5024, 5026, 5029, 5030, 5032, 5034, 5036, 5037, 5038, 5039, 5040, 5042, 5044, 5045, 5046, 5051, 5052, 5054, 5057, 5060, 5067, 5068, 5072, 5074, 5075, 5078, 5079, 5082, 5084, 5088, 5089, 5090, 5091, 5094, 5100, 5101, 5102, 5106, 5109, 5111, 5113, 5114, 5115, 5116, 5120, 5122, 5123, 5129, 5131, 5132, 5140, 5143, 5147, 5149, 5150, 5151, 5160, 5164, 5165, 5168, 5170, 5174, 5180, 5181, 5184, 5185, 5188, 5189, 5190, 5191, 5192, 5196, 5198, 5200, 5202, 5203, 5206, 5209, 5212, 5213, 5214, 5216, 5217, 5218, 5219, 5225, 5226, 5228, 5229, 5234, 5240, 5241, 5243, 5249, 5251, 5253, 5254, 5255, 5256, 5257, 5258, 5260, 5261, 5263, 5264, 5267, 5268, 5269, 5273, 5274, 5275, 5276, 5280, 5281, 5283, 5286, 5287, 5291, 5293, 5297, 5298, 5299, 5300, 5301, 5308, 5311, 5314, 5315, 5317, 5319, 5321, 5324, 5329, 5330, 5331, 5333, 5334, 5339, 5342, 5343, 5345, 5346, 5348, 5350, 5351, 5352, 5359, 5361, 5366, 5367, 5371, 5383, 5386, 5388, 5389, 5393, 5395, 5396, 5397, 5402, 5405, 5409, 5411, 5413, 5414, 5417, 5418, 5422, 5426, 5427, 5428, 5430, 5431, 5433, 5434, 5437, 5438, 5446, 5448, 5449, 5452, 5453, 5456, 5458, 5459, 5461, 5463, 5464, 5467, 5471, 5472, 5475, 5483, 5484, 5485, 5487, 5488, 5491, 5493, 5495, 5496, 5497, 5505, 5506, 5508, 5510, 5512, 5513, 5515, 5517, 5518, 5519, 5524, 5526, 5529, 5530, 5531, 5532, 5534, 5535, 5541, 5543, 5545, 5554, 5555, 5562, 5563, 5566, 5568, 5569, 5572, 5575, 5579, 5581, 5582, 5583, 5584, 5585, 5586, 5589, 5591, 5593, 5594, 5597, 5602, 5608, 5612, 5613, 5614, 5615, 5616, 5618, 5620, 5623, 5627, 5632, 5633, 5635, 5638, 5640, 5643, 5647, 5648, 5649, 5650, 5651, 5652, 5653, 5656, 5657, 5659, 5660, 5662, 5663, 5664, 5669, 5670, 5671, 5680, 5681, 5689, 5690, 5694, 5695, 5697, 5698, 5702, 5705, 5706, 5709, 5711, 5714, 5717, 5718, 5719, 5721, 5722, 5723, 5729, 5730, 5731, 5732, 5734, 5735, 5736, 5742, 5744, 5751, 5754, 5757, 5768, 5770, 5773, 5775, 5780, 5784, 5785, 5788, 5791, 5792, 5794, 5805, 5807, 5808, 5809, 5810, 5811, 5814, 5815, 5817, 5820, 5823, 5826, 5828, 5832, 5833, 5834, 5835, 5836, 5837, 5839, 5842, 5844, 5850, 5853, 5854, 5859, 5864, 5867, 5868, 5869, 5871, 5872, 5876, 5877, 5878, 5879, 5881, 5882, 5883, 5884, 5888, 5889, 5892, 5893, 5900, 5901, 5902, 5906, 5907, 5910, 5912, 5918, 5919, 5921, 5922, 5923, 5925, 5927, 5928, 5930, 5931, 5932, 5933, 5934, 5938, 5939, 5941, 5942, 5944, 5946, 5948, 5950, 5951, 5954, 5955, 5956, 5957, 5959, 5961, 5967, 5968, 5971, 5978, 5979, 5980, 5985, 5986, 5988, 5990, 5991, 5994, 5996, 5997, 6000, 6002, 6004, 6006, 6007, 6010, 6012, 6013, 6016, 6017, 6025, 6026, 6031, 6038, 6040, 6041, 6042, 6043, 6044, 6047, 6048, 6051, 6053, 6054, 6058, 6059, 6060, 6062, 6063, 6068, 6069, 6070, 6072, 6073, 6074, 6075, 6077, 6080, 6084, 6085, 6088, 6089, 6090, 6092, 6093, 6094, 6095, 6098, 6100, 6108, 6109, 6112, 6113, 6116, 6118, 6119, 6120, 6122, 6125, 6129, 6130, 6131, 6132, 6133, 6136, 6137, 6143, 6145, 6146, 6147, 6149, 6150, 6151, 6152, 6153, 6155, 6156, 6160, 6163, 6164, 6165, 6168, 6181, 6182, 6183, 6184, 6186, 6188, 6189, 6190, 6191, 6193, 6196, 6197, 6198, 6200, 6203, 6205, 6207, 6209, 6212, 6213, 6220, 6221, 6223, 6224, 6226, 6227, 6228, 6230, 6231, 6234, 6237, 6238, 6240, 6242, 6243, 6246, 6247, 6249, 6250, 6251, 6257, 6258, 6259, 6260, 6264, 6265, 6269, 6270, 6271, 6272, 6273, 6275, 6278, 6279, 6280, 6281, 6282, 6286, 6288, 6291, 6292, 6295, 6296, 6297, 6299, 6300, 6302, 6309, 6310, 6311, 6312, 6315, 6316, 6317, 6319, 6321, 6322, 6323, 6325, 6326, 6328, 6333, 6335, 6338, 6343, 6344, 6346, 6351, 6352, 6353, 6354, 6360, 6362, 6363, 6364, 6367, 6370, 6373, 6375, 6378, 6379, 6381, 6383, 6393, 6394, 6395, 6396, 6397, 6399, 6403, 6404, 6405, 6407, 6412, 6413, 6414, 6415, 6419, 6420, 6422, 6426, 6429, 6430, 6431, 6434, 6436, 6440, 6441, 6442, 6452, 6454, 6459, 6464, 6466, 6467, 6468, 6469, 6470, 6471, 6474, 6476, 6477, 6478, 6480, 6482, 6484, 6488, 6492, 6493, 6494, 6495, 6497, 6499, 6500, 6501, 6502, 6504, 6505, 6510, 6513, 6514, 6516, 6517, 6519, 6524, 6525, 6526, 6530, 6533, 6534, 6535, 6537, 6543, 6544, 6547, 6548, 6549, 6551, 6553, 6554, 6555, 6556, 6557, 6558, 6560, 6561, 6563, 6564, 6567, 6569, 6572, 6574, 6576, 6577, 6579, 6581, 6582, 6584, 6587, 6588, 6589, 6592, 6595, 6596, 6597, 6598, 6599, 6607, 6609, 6610, 6611, 6617, 6620, 6621, 6624, 6625, 6626, 6627, 6628, 6629, 6630, 6634, 6635, 6637, 6638, 6639, 6643, 6644, 6646, 6647, 6649, 6650, 6655, 6662, 6666, 6671, 6672, 6673, 6681, 6693, 6695, 6696, 6703, 6704, 6705, 6706, 6711, 6714, 6716, 6718, 6720, 6722, 6724, 6725, 6729, 6730, 6734, 6736, 6737, 6739, 6742, 6746, 6747, 6757, 6759, 6761, 6764, 6766, 6778, 6779, 6780, 6781, 6782, 6786, 6788, 6792, 6793, 6794, 6795, 6797, 6799, 6803, 6804, 6805, 6807, 6810, 6811, 6812, 6813, 6816, 6817, 6819, 6820, 6821, 6824, 6826, 6827, 6828, 6830, 6831, 6834, 6836, 6839, 6840, 6841, 6842, 6843, 6845, 6851, 6859, 6860, 6863, 6864, 6869, 6872, 6874, 6875, 6876, 6877, 6878, 6879, 6880, 6884, 6886, 6887, 6888, 6890, 6891, 6894, 6902, 6903, 6904, 6906, 6907, 6909, 6913, 6914, 6915, 6917, 6919, 6920, 6921, 6922, 6923, 6924, 6930, 6933, 6936, 6941, 6943, 6944, 6946, 6948, 6950, 6951, 6952, 6954, 6959, 6960, 6963, 6966, 6967, 6971, 6979, 6980, 6984, 6985, 6987, 6988, 6990, 6991, 6993, 6994, 6995, 6997, 6999, 7000, 7002, 7003, 7006, 7009, 7011, 7012, 7013, 7015, 7016, 7022, 7031, 7032, 7038, 7039, 7040, 7042, 7043, 7046, 7049, 7050, 7051, 7052, 7053, 7056, 7057, 7064, 7067, 7072, 7075, 7077, 7079, 7083, 7084, 7085, 7086, 7094, 7096, 7097, 7106, 7107, 7108, 7112, 7113, 7116, 7117, 7118, 7124, 7126, 7128, 7129, 7130, 7132, 7135, 7138, 7139, 7140, 7142, 7144, 7146, 7149, 7151, 7155, 7163, 7164, 7165, 7166, 7169, 7172, 7173, 7176, 7177, 7182, 7183, 7184, 7187, 7188, 7192, 7194, 7196, 7197, 7201, 7202, 7203, 7206, 7207, 7208, 7209, 7211, 7212, 7216, 7217, 7219, 7223, 7224, 7227, 7228, 7230, 7232, 7233, 7234, 7236, 7239, 7240, 7241, 7243, 7244, 7245, 7248, 7249, 7250, 7255, 7257, 7258, 7259, 7262, 7264, 7267, 7268, 7270, 7274, 7277, 7278, 7281, 7282, 7287, 7288, 7290, 7291, 7292, 7293, 7298, 7299, 7300, 7301, 7303, 7304, 7305, 7306, 7307, 7313, 7315, 7317, 7328, 7330, 7331, 7334, 7340, 7343, 7344, 7348, 7350, 7351, 7354, 7355, 7356, 7357, 7358, 7361, 7363, 7365, 7369, 7371, 7373, 7377, 7380, 7382, 7383, 7386, 7388, 7389, 7392, 7395, 7396, 7398, 7400, 7406, 7409, 7410, 7411, 7415, 7417, 7418, 7425, 7428, 7430, 7433, 7434, 7435, 7436, 7438, 7441, 7443, 7444, 7446, 7447, 7448, 7452, 7453, 7454, 7458, 7459, 7464, 7466, 7470, 7486, 7490, 7492, 7493, 7498, 7499, 7504, 7505, 7506, 7508, 7512, 7515, 7517, 7523, 7524, 7525, 7528, 7533, 7534, 7537, 7538, 7542, 7546, 7547, 7548, 7554, 7556, 7561, 7568, 7574, 7578, 7580, 7585, 7586, 7587, 7589, 7590, 7591, 7594, 7595, 7605, 7613, 7619, 7620, 7621, 7623, 7624, 7625, 7632, 7633, 7638, 7639, 7640, 7642, 7643, 7647, 7652, 7658, 7661, 7663, 7664, 7665, 7671, 7674, 7676, 7677, 7678, 7679, 7680, 7682, 7685, 7686, 7687, 7689, 7695, 7699, 7700, 7703, 7704, 7708, 7712, 7713, 7716, 7718, 7719, 7724, 7725, 7726, 7727, 7729, 7730, 7733, 7734, 7736, 7737, 7738, 7740, 7743, 7744, 7745, 7747, 7750, 7751, 7753, 7755, 7761, 7762, 7763, 7764, 7768, 7769, 7770, 7772, 7774, 7775, 7777, 7778, 7779, 7780, 7781, 7782, 7785, 7786, 7788, 7791, 7793, 7796, 7798, 7800, 7801, 7803, 7804, 7806, 7807, 7812, 7815, 7819, 7820, 7823, 7824, 7825, 7832, 7833, 7834, 7836, 7838, 7841, 7844, 7845, 7847, 7848, 7849, 7852, 7854, 7856, 7858, 7859, 7860, 7862, 7863, 7865, 7873, 7875, 7878, 7880, 7881, 7888, 7890, 7896, 7900, 7908, 7909, 7910, 7911, 7918, 7923, 7925, 7933, 7934, 7935, 7936, 7937, 7938, 7942, 7944, 7945, 7946, 7947, 7948, 7950, 7955, 7956, 7962, 7964, 7972, 7974, 7976, 7977, 7978, 7980, 7983, 7984, 7986, 7988, 7989, 7990, 7991, 7993, 7998, 8002, 8004, 8005, 8006, 8007, 8012, 8021, 8026, 8029, 8030, 8039, 8042, 8043, 8044, 8045, 8047, 8048, 8052, 8053, 8056, 8058, 8059, 8062, 8063, 8065, 8067, 8068, 8069, 8071, 8072, 8075, 8076, 8077, 8078, 8079, 8080, 8082, 8083, 8084, 8087, 8088, 8090, 8091, 8093, 8095, 8100, 8102, 8103, 8105, 8106, 8112, 8114, 8116, 8118, 8121, 8123, 8124, 8125, 8126, 8130, 8136, 8137, 8145, 8146, 8147, 8150, 8151, 8156, 8159, 8163, 8164, 8165, 8168, 8170, 8176, 8178, 8179, 8181, 8182, 8185, 8189, 8192, 8193, 8195, 8199, 8202, 8204, 8207, 8208, 8210, 8211, 8213, 8216, 8219, 8220, 8222, 8223, 8225, 8227, 8234, 8235, 8237, 8239, 8240, 8241, 8242, 8245, 8248, 8250, 8252, 8253, 8265, 8266, 8268, 8269, 8270, 8272, 8282, 8288, 8289, 8291, 8293, 8294, 8300, 8301, 8304, 8306, 8310, 8311, 8312, 8318, 8319, 8320, 8321, 8324, 8325, 8329, 8339, 8340, 8347, 8349, 8350, 8351, 8352, 8353, 8355, 8361, 8367, 8368, 8369, 8372, 8373, 8376, 8379, 8385, 8387, 8389, 8392, 8393, 8395, 8398, 8401, 8402, 8403, 8404, 8405, 8408, 8410, 8411, 8413, 8414, 8416, 8417, 8418, 8423, 8433, 8436, 8438, 8439, 8441, 8442, 8444, 8447, 8448, 8449, 8450, 8451, 8452, 8456, 8457, 8458, 8459, 8465, 8466, 8469, 8470, 8472, 8473, 8474, 8476, 8477, 8480, 8481, 8482, 8485, 8486, 8490, 8493, 8498, 8501, 8502, 8505, 8507, 8509, 8511, 8513, 8515, 8516, 8517, 8520, 8523, 8524, 8525, 8527, 8528, 8531, 8532, 8533, 8535, 8539, 8541, 8542, 8544, 8549, 8550, 8552, 8553, 8554, 8558, 8561, 8562, 8565, 8566, 8568, 8575, 8576, 8579, 8581, 8582, 8589, 8590, 8592, 8593, 8594, 8596, 8597, 8598, 8599, 8600, 8601, 8602, 8603, 8604, 8605, 8610, 8611, 8612, 8613, 8614, 8617, 8618, 8624, 8628, 8630, 8631, 8634, 8637, 8638, 8639, 8640, 8641, 8642, 8644, 8647, 8648, 8652, 8654, 8657, 8658, 8659, 8663, 8665, 8669, 8670, 8672, 8675, 8676, 8677, 8681, 8685, 8689, 8690, 8693, 8694, 8699, 8700, 8703, 8704, 8706, 8708, 8709, 8713, 8716, 8717, 8720, 8726, 8728, 8729, 8731, 8734, 8735, 8736, 8740, 8741, 8742, 8744, 8746, 8747, 8748, 8751, 8752, 8753, 8757, 8761, 8767, 8768, 8770, 8771, 8772, 8773, 8774, 8775, 8776, 8777, 8779, 8782, 8783, 8784, 8785, 8789, 8792, 8795, 8796, 8797, 8803, 8805, 8808, 8810, 8817, 8818, 8822, 8824, 8829, 8831, 8832, 8833, 8834, 8835, 8838, 8841, 8843, 8846, 8853, 8854, 8859, 8861, 8865, 8866, 8867, 8869, 8876, 8878, 8880, 8881, 8883, 8886, 8888, 8889, 8892, 8896, 8897, 8899, 8900, 8905, 8907, 8908, 8909, 8910, 8911, 8913, 8914, 8916, 8917, 8926, 8928, 8929, 8930, 8935, 8938, 8940, 8941, 8942, 8945, 8946, 8949, 8951, 8957, 8960, 8961, 8962, 8964, 8965, 8967, 8968, 8969, 8971, 8972, 8974, 8976, 8977, 8979, 8980, 8981, 8985, 8986, 8991, 8992, 8996, 8998, 8999, 9001, 9002, 9003, 9006, 9009, 9012, 9015, 9020, 9021, 9022, 9029, 9030, 9033, 9037, 9042, 9044, 9047, 9052, 9056, 9057, 9058, 9059, 9060, 9066, 9069, 9071, 9073, 9074, 9076, 9084, 9088, 9091, 9092, 9095, 9096, 9097, 9103, 9104, 9105, 9108, 9110, 9112, 9114, 9116, 9118, 9124, 9125, 9128, 9129, 9131, 9133, 9134, 9139, 9140, 9141, 9142, 9146, 9149, 9151, 9152, 9154, 9155, 9156, 9164, 9173, 9174, 9175, 9177, 9183, 9185, 9186, 9187, 9188, 9190, 9191, 9194, 9195, 9205, 9206, 9207, 9210, 9211, 9213, 9215, 9216, 9218, 9221, 9226, 9229, 9233, 9234, 9237, 9241, 9242, 9243, 9244, 9247, 9248, 9249, 9252, 9253, 9254, 9255, 9257, 9259, 9262, 9265, 9267, 9269, 9270, 9273, 9275, 9276, 9278, 9282, 9284, 9285, 9287, 9288, 9290, 9291, 9292, 9293, 9295, 9298, 9299, 9300, 9302, 9304, 9308, 9311, 9313, 9320, 9321, 9323, 9325, 9326, 9327, 9328, 9329, 9330, 9332, 9336, 9337, 9339, 9340, 9341, 9345, 9346, 9347, 9348, 9349, 9353, 9354, 9355, 9357, 9359, 9366, 9367, 9373, 9375, 9376, 9378, 9382, 9383, 9388, 9391, 9392, 9393, 9394, 9396, 9398, 9400, 9402, 9403, 9404, 9406, 9407, 9413, 9414, 9415, 9422, 9423, 9426, 9432, 9433, 9434, 9439, 9440, 9443, 9444, 9451, 9452, 9453, 9456, 9460, 9467, 9468, 9471, 9472, 9473, 9475, 9476, 9478, 9481, 9483, 9488, 9490, 9497, 9500, 9501, 9502, 9503, 9504, 9505, 9509, 9513, 9514, 9515, 9517, 9518, 9519, 9520, 9525, 9531, 9533, 9534, 9536, 9540, 9543, 9545, 9546, 9548, 9549, 9553, 9555, 9557, 9563, 9564, 9565, 9568, 9571, 9575, 9577, 9582, 9583, 9586, 9587, 9589, 9590, 9591, 9597, 9606, 9607, 9609, 9610, 9613, 9614, 9615, 9617, 9618, 9620, 9623, 9626, 9627, 9628, 9629, 9632, 9633, 9635, 9637, 9640, 9641, 9642, 9644, 9645, 9646, 9649, 9653, 9655, 9656, 9657, 9658, 9659, 9660, 9663, 9666, 9670, 9675, 9679, 9681, 9682, 9686, 9688, 9692, 9693, 9698, 9701, 9710, 9711, 9718, 9723, 9726, 9729, 9730, 9731, 9732, 9733, 9734, 9737, 9746, 9750, 9751, 9753, 9754, 9755, 9756, 9763, 9764, 9767, 9768, 9770, 9774, 9776, 9777, 9780, 9781, 9782, 9784, 9786, 9787, 9792, 9793, 9794, 9796, 9799, 9801, 9802, 9804, 9808, 9812, 9813, 9816, 9819, 9820, 9824, 9825, 9830, 9833, 9845, 9846, 9847, 9849, 9850, 9853, 9854, 9861, 9864, 9866, 9869, 9873, 9876, 9882, 9886, 9887, 9892, 9893, 9897, 9900, 9901, 9906, 9907, 9908, 9909, 9910, 9911, 9912, 9918, 9923, 9924, 9928, 9934, 9935, 9938, 9940, 9946, 9949, 9950, 9953, 9955, 9957, 9958, 9960, 9962, 9963, 9964, 9967, 9971, 9972, 9974, 9975, 9976, 9979, 9980, 9982, 9984, 9985, 9987, 9988, 9990, 9991, 9997, 10000, 10008, 10009, 10010, 10013, 10015, 10017, 10018, 10019, 10021, 10022, 10026, 10027, 10031, 10032, 10033, 10034, 10035, 10037, 10038, 10042, 10043, 10044, 10045, 10047, 10048, 10051, 10052, 10053, 10054, 10056, 10058, 10059, 10060, 10062, 10063, 10064, 10066, 10068, 10072, 10073, 10075, 10077, 10078, 10080, 10081, 10083, 10087, 10089, 10090, 10091, 10092, 10095, 10097, 10101, 10103, 10105, 10106, 10107, 10108, 10109, 10110, 10112, 10114, 10115, 10116, 10118, 10122, 10127, 10128, 10131, 10132, 10138, 10143, 10146, 10147, 10149, 10151, 10152, 10158, 10163, 10165, 10166, 10168, 10170, 10174, 10176, 10178, 10180, 10181, 10182, 10192, 10193, 10194, 10195, 10197, 10199, 10200, 10201, 10203, 10206, 10209, 10213, 10218, 10219, 10220, 10222, 10223, 10224, 10225, 10228, 10229, 10231, 10233, 10235, 10236, 10237, 10238, 10239, 10240, 10247, 10252, 10253, 10254, 10255, 10257, 10258, 10259, 10262, 10268, 10275, 10278, 10284, 10291, 10292, 10293, 10295, 10300, 10302, 10306, 10307, 10311, 10318, 10319, 10321, 10322, 10323, 10325, 10326, 10328, 10331, 10334, 10335, 10336, 10341, 10342, 10343, 10353, 10354, 10356, 10357, 10359, 10360, 10362, 10364, 10368, 10371, 10373, 10375, 10378, 10380, 10381, 10384, 10385, 10388, 10395, 10397, 10398, 10399, 10400, 10401, 10405, 10410, 10413, 10414, 10416, 10421, 10423, 10425, 10426, 10427, 10428, 10429, 10430, 10435, 10437, 10438, 10440, 10446, 10447, 10448, 10449, 10450, 10451, 10452, 10453, 10455, 10456, 10463, 10464, 10465, 10466, 10468, 10469, 10470, 10474, 10482, 10487, 10488, 10490, 10492, 10494, 10496, 10504, 10506, 10508, 10512, 10513, 10514, 10515, 10518, 10525, 10527, 10528, 10530, 10531, 10532, 10533, 10535, 10536, 10537, 10541, 10542, 10543, 10544, 10547, 10548, 10555, 10556, 10558, 10560, 10561, 10563, 10565, 10567, 10569, 10573, 10577, 10580, 10581, 10582, 10583, 10585, 10590, 10593, 10595, 10596, 10597, 10599, 10601, 10602, 10603, 10604, 10606, 10610, 10611, 10612, 10613, 10615, 10616, 10617, 10618, 10619, 10621, 10622, 10623, 10625, 10626, 10628, 10629, 10630, 10631, 10633, 10634, 10636, 10637, 10638, 10639, 10640, 10642, 10643, 10645, 10646, 10648, 10649, 10650, 10655, 10657, 10659, 10663, 10665, 10668, 10670, 10671, 10673, 10674, 10676, 10677, 10678, 10681, 10682, 10683, 10684, 10685, 10686, 10687, 10689, 10693, 10697, 10698, 10699, 10700, 10702, 10703, 10705, 10707, 10711, 10712, 10715, 10716, 10722, 10723, 10725, 10726, 10732, 10734, 10735, 10738, 10739, 10740, 10741, 10744, 10745, 10747, 10748, 10749, 10754, 10756, 10761, 10762, 10763, 10766, 10771, 10775, 10777, 10778, 10779, 10782, 10784, 10785, 10787, 10788, 10790, 10791, 10792, 10795, 10796, 10799, 10800, 10802, 10803, 10804, 10805, 10809, 10810, 10811, 10812, 10813, 10815, 10818, 10819, 10820, 10821, 10823, 10824, 10825, 10826, 10831, 10833, 10836, 10838, 10839, 10840, 10843, 10846, 10850, 10852, 10853, 10854, 10857, 10858, 10860, 10862, 10863, 10866, 10867, 10871, 10872, 10874, 10877, 10880, 10881, 10887, 10892, 10896, 10897, 10898, 10899, 10902, 10903, 10905, 10912, 10917, 10920, 10926, 10927, 10928, 10930, 10933, 10934, 10935, 10936, 10937, 10938, 10939, 10940, 10941, 10944, 10945, 10947, 10948, 10950, 10954, 10956, 10957, 10960, 10962, 10964, 10965, 10967, 10968, 10972, 10975, 10976, 10977, 10980, 10988, 10993, 10995, 10996, 10997, 10999, 11002, 11004, 11005, 11006, 11008, 11009, 11010, 11015, 11018, 11023, 11024, 11025, 11026, 11027, 11032, 11033, 11039, 11044, 11046, 11047, 11049, 11052, 11053, 11056, 11058, 11060, 11066, 11067, 11068, 11070, 11071, 11072, 11078, 11080, 11081, 11082, 11083, 11086, 11090, 11092, 11095, 11098, 11101, 11102, 11107, 11110, 11114, 11116, 11118, 11119, 11123, 11124, 11125, 11127, 11129, 11132, 11133, 11135, 11137, 11138, 11145, 11146, 11148, 11151, 11153, 11154, 11155, 11156, 11157, 11158, 11159, 11160, 11161, 11162, 11163, 11165, 11166, 11168, 11169, 11173, 11174, 11175, 11177, 11179, 11180, 11181, 11184, 11185, 11187, 11188, 11190, 11192, 11194, 11198, 11199, 11201, 11202, 11203, 11207, 11210, 11214, 11216, 11217, 11218, 11222, 11226, 11227, 11228, 11229, 11232, 11233, 11234, 11235, 11236, 11237, 11239, 11240, 11244, 11246, 11247, 11248, 11254, 11255, 11256, 11257, 11258, 11259, 11260, 11261, 11262, 11263, 11264, 11266, 11274, 11275, 11278, 11289, 11290, 11292, 11293, 11294, 11295, 11296, 11298, 11302, 11306, 11307, 11313, 11315, 11316, 11318, 11319, 11320, 11322, 11324, 11326, 11329, 11330, 11331, 11332, 11333, 11337, 11338, 11339, 11340, 11345, 11346, 11348, 11349, 11352, 11356, 11358, 11363, 11365, 11366, 11370, 11371, 11373, 11374, 11377, 11380, 11381, 11382, 11387, 11388, 11391, 11392, 11394, 11395, 11397, 11398, 11401, 11403, 11404, 11405, 11406, 11409, 11411, 11412, 11413, 11414, 11416, 11418, 11423, 11424, 11428, 11430, 11431, 11434, 11436, 11437, 11438, 11445, 11446, 11447, 11449, 11451, 11456, 11458, 11459, 11461, 11463, 11464, 11465, 11471, 11472, 11475, 11476, 11477, 11478, 11481, 11482, 11487, 11489, 11490, 11491, 11494, 11496, 11497, 11498, 11499, 11500, 11503, 11506, 11507, 11508, 11512, 11518, 11523, 11526, 11527, 11528, 11530, 11531, 11532, 11533, 11534, 11538, 11541, 11544, 11546, 11547, 11548, 11551, 11553, 11558, 11560, 11561, 11567, 11568, 11570, 11571, 11576, 11577, 11578, 11580, 11583, 11585, 11586, 11593, 11594, 11595, 11596, 11597, 11599, 11604, 11610, 11612, 11615, 11618, 11620, 11621, 11623, 11625, 11626, 11628, 11632, 11633, 11636, 11637, 11639, 11642, 11644, 11647, 11650, 11652, 11656, 11657, 11658, 11663, 11668, 11669, 11673, 11677, 11678, 11680, 11681, 11682, 11683, 11688, 11691, 11692, 11693, 11694, 11695, 11698, 11699, 11701, 11703, 11705, 11707, 11711, 11712, 11718, 11720, 11721, 11722, 11723, 11725, 11731, 11733, 11736, 11740, 11743, 11744, 11753, 11755, 11756, 11759, 11760, 11761, 11762, 11763, 11764, 11765, 11766, 11767, 11770, 11771, 11773, 11774, 11776, 11780, 11781, 11782, 11783, 11784, 11785, 11786, 11790, 11792, 11799, 11800, 11802, 11804, 11807, 11809, 11810, 11811, 11812, 11813, 11814, 11816, 11818, 11819, 11820, 11821, 11826, 11828, 11830, 11837, 11839, 11841, 11846, 11848, 11849, 11850, 11851, 11853, 11856, 11858, 11863, 11868, 11870, 11872, 11876, 11877, 11881, 11889, 11890, 11891, 11894, 11898, 11899, 11903, 11905, 11909, 11912, 11913, 11916, 11917, 11918, 11919, 11920, 11921, 11922, 11923, 11926, 11927, 11928, 11929, 11930, 11934, 11935, 11939, 11940, 11941, 11943, 11945, 11946, 11947, 11948, 11949, 11953, 11955, 11957, 11958, 11959, 11960, 11961, 11962, 11963, 11965, 11968, 11975, 11976, 11977, 11978, 11979, 11980, 11983, 11987, 11988, 11993, 11994, 11995, 11996, 11997, 11998, 11999, 12002, 12004, 12008, 12014, 12017, 12019, 12020, 12021, 12023, 12024, 12025, 12032, 12042, 12043, 12044, 12050, 12054, 12059, 12060, 12061, 12063, 12068, 12076, 12078, 12079, 12080, 12081, 12083, 12085, 12086, 12087, 12089, 12091, 12092, 12093, 12097, 12098, 12102, 12104, 12106, 12109, 12110, 12112, 12115, 12118, 12120, 12122, 12128, 12129, 12131, 12134, 12135, 12137, 12138, 12139, 12141, 12143, 12144, 12145, 12146, 12147, 12148, 12150, 12151, 12153, 12161, 12162, 12165, 12166, 12167, 12170, 12171, 12174, 12175, 12176, 12179, 12181, 12186, 12197, 12200, 12201, 12202, 12204, 12208, 12214, 12215, 12217, 12218, 12221, 12223, 12229, 12233, 12234, 12237, 12240, 12241, 12243, 12245, 12249, 12250, 12252, 12255, 12256, 12259, 12260, 12268, 12269, 12271, 12274, 12278, 12280, 12283, 12285, 12286, 12287, 12288, 12291, 12293, 12295, 12296, 12304, 12310, 12311, 12312, 12313, 12314, 12315, 12317, 12319, 12321, 12323, 12325, 12331, 12333, 12334, 12339, 12340, 12342, 12345, 12347, 12350, 12354, 12356, 12358, 12359, 12364, 12366, 12367, 12368, 12370, 12374, 12375, 12376, 12379, 12380, 12381, 12385, 12390, 12396, 12397, 12399, 12400, 12401, 12403, 12406, 12410, 12411, 12414, 12415, 12416, 12419, 12420, 12423, 12424, 12426, 12427, 12435, 12437, 12439, 12440, 12444, 12445, 12447, 12450, 12451, 12455, 12456, 12457, 12459, 12462, 12465, 12467, 12468, 12469, 12470, 12472, 12473, 12478, 12481, 12486, 12487, 12488, 12489, 12492, 12495, 12497, 12499, 12500, 12501, 12502, 12503, 12504, 12505, 12508, 12512, 12513, 12514, 12515, 12518, 12519, 12527, 12530, 12531, 12535, 12536, 12537, 12538, 12539, 12540, 12546, 12547, 12548, 12549, 12551, 12552, 12554, 12555, 12556, 12560, 12561, 12562, 12563, 12565, 12567, 12568, 12570, 12572, 12577, 12578, 12583, 12585, 12586, 12588, 12589, 12591, 12594, 12597, 12600, 12602, 12603, 12605, 12606, 12608, 12609, 12610, 12611, 12616, 12619, 12622, 12623, 12626, 12628, 12629, 12631, 12633, 12634, 12638, 12639, 12640, 12641, 12644, 12648, 12649, 12651, 12654, 12663, 12664, 12668, 12670, 12671, 12674, 12676, 12677, 12679, 12681, 12683, 12684, 12685, 12687, 12688, 12689, 12691, 12693, 12695, 12696, 12697, 12699, 12701, 12702, 12705, 12706, 12707, 12713, 12714, 12715, 12719, 12721, 12723, 12726, 12728, 12731, 12732, 12733, 12735, 12737, 12738, 12739, 12740, 12741, 12742, 12743, 12752, 12753, 12754, 12755, 12757, 12758, 12760, 12761, 12762, 12763, 12764, 12765, 12766, 12771, 12772, 12773, 12775, 12777, 12782, 12790, 12794, 12797, 12800, 12801, 12802, 12804, 12807, 12810, 12812, 12813, 12817, 12818, 12820, 12822, 12823, 12824, 12827, 12828, 12834, 12835, 12836, 12837, 12838, 12839, 12843, 12844, 12848, 12849, 12850, 12852, 12853, 12861, 12866, 12869, 12870, 12873, 12875, 12878, 12882, 12883, 12884, 12887, 12891, 12895, 12898, 12899, 12900, 12901, 12902, 12903, 12904, 12905, 12906, 12908, 12910, 12912, 12913, 12916, 12921, 12923, 12928, 12929, 12932, 12933, 12934, 12935, 12938, 12939, 12940, 12942, 12945, 12946, 12947, 12950, 12953, 12956, 12958, 12960, 12961, 12967, 12968, 12969, 12972, 12978, 12983, 12984, 12986, 12987, 12990, 12991, 12999, 13001, 13003, 13004, 13007, 13010, 13014, 13015, 13017, 13018, 13022, 13030, 13031, 13033, 13034, 13035, 13036, 13040, 13041, 13047, 13049, 13050, 13053, 13054, 13055, 13056, 13060, 13061, 13062, 13064, 13066, 13067, 13071, 13075, 13077, 13079, 13083, 13085, 13086, 13087, 13097, 13101, 13102, 13105, 13106, 13110, 13111, 13112, 13114, 13115, 13116, 13117, 13118, 13120, 13121, 13122, 13123, 13124, 13125, 13128, 13131, 13134, 13136, 13142, 13144, 13147, 13148, 13149, 13151, 13154, 13158, 13159, 13163, 13166, 13167, 13169, 13175, 13181, 13182, 13185, 13186, 13188, 13190, 13197, 13199, 13206, 13209, 13210, 13212, 13213, 13215, 13217, 13221, 13222, 13224, 13226, 13227, 13228, 13229, 13232, 13233, 13234, 13235, 13236, 13237, 13239, 13241, 13243, 13248, 13250, 13251, 13255, 13256, 13258, 13259, 13260, 13261, 13262, 13263, 13264, 13265, 13267, 13268, 13269, 13274, 13279, 13280, 13281, 13285, 13291, 13292, 13293, 13296, 13297, 13298, 13300, 13301, 13303, 13304, 13313, 13315, 13317, 13318, 13323, 13326, 13328, 13329, 13330, 13332, 13335, 13337, 13338, 13340, 13343, 13344, 13345, 13346, 13347, 13348, 13350, 13352, 13353, 13358, 13361, 13363, 13367, 13368, 13369, 13370, 13374, 13377, 13380, 13381, 13384, 13385, 13386, 13388, 13391, 13393, 13394, 13396, 13397, 13398, 13401, 13402, 13403, 13404, 13407, 13408, 13410, 13416, 13417, 13419, 13423, 13428, 13429, 13430, 13433, 13434, 13439, 13441, 13448, 13450, 13456, 13457, 13460, 13461, 13463, 13467, 13469, 13473, 13475, 13477, 13478, 13479, 13480, 13481, 13492, 13494, 13496, 13498, 13499, 13503, 13510, 13513, 13514, 13515, 13519, 13521, 13522, 13526, 13530, 13532, 13539, 13540, 13543, 13544, 13546, 13547, 13549, 13552, 13553, 13555, 13556, 13558, 13559, 13560, 13561, 13562, 13568, 13569, 13574, 13577, 13578, 13579, 13580, 13582, 13584, 13587, 13596, 13597, 13598, 13599, 13600, 13601, 13602, 13604, 13605, 13606, 13607, 13612, 13613, 13621, 13623, 13627, 13628, 13630, 13631, 13632, 13634, 13636, 13637, 13638, 13641, 13647, 13650, 13651, 13652, 13653, 13654, 13660, 13662, 13663, 13665, 13668, 13675, 13676, 13677, 13678, 13679, 13683, 13687, 13688, 13693, 13697, 13698, 13699, 13700, 13702, 13706, 13710, 13712, 13713, 13715, 13716, 13719, 13720, 13727, 13729, 13730, 13734, 13736, 13739, 13742, 13745, 13747, 13749, 13750, 13753, 13756, 13764, 13767, 13769, 13772, 13773, 13775, 13777, 13779, 13782, 13783, 13785, 13786, 13787, 13791, 13793, 13796, 13798, 13809, 13816, 13817, 13818, 13819, 13821, 13822, 13823, 13828, 13830, 13831, 13834, 13835, 13843, 13849, 13852, 13853, 13858, 13859, 13860, 13862, 13866, 13869, 13870, 13872, 13873, 13874, 13875, 13877, 13880, 13884, 13885, 13887, 13891, 13892, 13895, 13897, 13898, 13899, 13901, 13904, 13906, 13907, 13908, 13909, 13910, 13911, 13914, 13915, 13917, 13918, 13919, 13920, 13921, 13924, 13925, 13927, 13929, 13930, 13934, 13938, 13943, 13944, 13947, 13948, 13949, 13950, 13954, 13958, 13960, 13962, 13963, 13969, 13970, 13975, 13981, 13984, 13986, 13987, 13990, 13999, 14000, 14001, 14002, 14005, 14006, 14010, 14013, 14014, 14018, 14022, 14027, 14030, 14031, 14035, 14036, 14038, 14040, 14049, 14052, 14059, 14062, 14063, 14066, 14067, 14069, 14070, 14071, 14073, 14075, 14078, 14080, 14081, 14084, 14085, 14086, 14088, 14092, 14093, 14094, 14096, 14106, 14111, 14112, 14116, 14117, 14118, 14119, 14120, 14121, 14122, 14124, 14125, 14129, 14130, 14132, 14133, 14135, 14137, 14138, 14139, 14140, 14141, 14143, 14144, 14145, 14146, 14147.

Promoters expressing in a mixture of all root tissues at the V5 stage at 11 p.m. include SEQ IDs: 3, 4, 5, 7, 12, 13, 14, 15, 16, 17, 19, 27, 29, 33, 34, 36, 37, 48, 51, 54, 57, 63, 64, 65, 73, 79, 81, 82, 88, 93, 94, 96, 98, 99, 100, 102, 103, 104, 108, 110, 111, 112, 115, 117, 123, 130, 131, 141, 143, 148, 152, 154, 160, 162, 164, 172, 174, 176, 179, 180, 181, 182, 183, 187, 189, 191, 193, 194, 196, 197, 199, 202, 205, 207, 210, 211, 212, 214, 217, 223, 232, 233, 235, 236, 237, 239, 240, 242, 244, 246, 249, 250, 251, 257, 259, 262, 264, 267, 271, 273, 280, 281, 286, 288, 289, 291, 293, 298, 299, 301, 302, 305, 306, 308, 309, 314, 316, 319, 322, 323, 328, 329, 332, 335, 338, 346, 348, 349, 352, 353, 354, 355, 356, 357, 360, 364, 365, 372, 373, 376, 378, 379, 381, 387, 388, 396, 401, 405, 411, 412, 414, 418, 423, 424, 428, 429, 432, 433, 434, 436, 441, 448, 450, 452, 454, 456, 461, 463, 468, 470, 471, 474, 478, 479, 483, 484, 485, 488, 489, 492, 496, 498, 507, 509, 510, 514, 516, 517, 522, 523, 525, 532, 534, 537, 538, 541, 543, 544, 546, 547, 548, 553, 554, 557, 561, 563, 578, 580, 582, 585, 591, 594, 595, 596, 598, 599, 601, 602, 605, 606, 607, 613, 619, 620, 623, 630, 631, 633, 635, 636, 637, 638, 643, 650, 661, 662, 663, 664, 667, 668, 669, 671, 681, 683, 685, 687, 693, 694, 695, 701, 702, 705, 706, 707, 708, 716, 717, 718, 719, 721, 722, 724, 727, 731, 732, 734, 735, 736, 739, 740, 742, 744, 749, 752, 753, 757, 758, 759, 760, 761, 762, 764, 765, 770, 771, 779, 782, 783, 784, 785, 786, 792, 793, 800, 804, 806, 808, 809, 811, 819, 820, 821, 822, 824, 825, 826, 827, 829, 830, 833, 840, 841, 849, 855, 856, 857, 858, 860, 862, 863, 865, 869, 870, 871, 875, 876, 877, 882, 887, 890, 891, 892, 893, 895, 897, 898, 899, 900, 903, 907, 908, 910, 911, 912, 915, 916, 919, 922, 924, 928, 932, 934, 936, 939, 943, 944, 947, 951, 953, 955, 957, 958, 960, 964, 971, 974, 975, 976, 978, 979, 980, 981, 982, 983, 984, 987, 988, 991, 993, 994, 995, 996, 997, 999, 1002, 1005, 1007, 1008, 1009, 1010, 1011, 1012, 1013, 1014, 1016, 1017, 1022, 1024, 1026, 1032, 1033, 1035, 1038, 1041, 1042, 1043, 1045, 1046, 1047, 1049, 1051, 1052, 1054, 1055, 1056, 1057, 1059, 1064, 1065, 1067, 1069, 1070, 1073, 1076, 1077, 1079, 1080, 1085, 1086, 1087, 1088, 1089, 1092, 1095, 1100, 1101, 1103, 1104, 1110, 1112, 1114, 1115, 1116, 1117, 1119, 1120, 1121, 1125, 1126, 1127, 1130, 1132, 1136, 1137, 1140, 1144, 1146, 1147, 1148, 1153, 1154, 1155, 1160, 1161, 1162, 1164, 1165, 1167, 1168, 1170, 1171, 1175, 1176, 1178, 1183, 1187, 1189, 1190, 1191, 1196, 1198, 1200, 1201, 1203, 1204, 1213, 1214, 1217, 1218, 1221, 1223, 1225, 1228, 1230, 1231, 1232, 1233, 1236, 1240, 1243, 1248, 1249, 1250, 1251, 1252, 1254, 1257, 1258, 1263, 1269, 1277, 1281, 1285, 1286, 1290, 1291, 1292, 1293, 1296, 1298, 1301, 1303, 1306, 1307, 1309, 1311, 1312, 1316, 1317, 1320, 1327, 1331, 1334, 1337, 1343, 1345, 1346, 1347, 1349, 1354, 1355, 1356, 1360, 1364, 1366, 1367, 1368, 1371, 1376, 1377, 1380, 1381, 1386, 1388, 1389, 1391, 1392, 1393, 1396, 1399, 1400, 1403, 1404, 1406, 1412, 1416, 1420,
1421, 1423, 1426, 1431, 1432, 1433, 1438, 1439, 1441, 1442,
1447, 1448, 1451, 1453, 1459, 1461, 1462, 1466, 1467, 1468,
1471, 1472, 1475, 1484, 1485, 1488, 1490, 1492, 1493, 1497,
1498, 1499, 1503, 1506, 1508, 1510, 1511, 1514, 1517, 1518,
1519, 1525, 1526, 1527, 1528, 1530, 1534, 1539, 1543, 1545,
1546, 1547, 1548, 1549, 1550, 1551, 1553, 1554, 1555, 1556,
1561, 1563, 1564, 1567, 1570, 1571, 1575, 1576, 1578, 1579,
1582, 1584, 1586, 1588, 1590, 1591, 1595, 1596, 1598, 1599,
1600, 1601, 1602, 1604, 1605, 1608, 1609, 1610, 1612, 1614,
1615, 1616, 1617, 1622, 1623, 1625, 1632, 1634, 1635, 1637,
1638, 1639, 1642, 1643, 1654, 1658, 1659, 1662, 1663, 1668,
1669, 1671, 1673, 1675, 1676, 1678, 1681, 1682, 1684, 1685,
1687, 1689, 1690, 1691, 1697, 1698, 1699, 1703, 1705, 1706,
1707, 1708, 1710, 1712, 1716, 1717, 1718, 1720, 1725, 1729,
1731, 1732, 1735, 1739, 1745, 1750, 1755, 1759, 1761, 1764,
1768, 1770, 1771, 1773, 1774, 1776, 1777, 1778, 1785, 1786,
1791, 1792, 1796, 1798, 1807, 1809, 1811, 1813, 1814, 1826,
1828, 1830, 1832, 1834, 1835, 1836, 1837, 1838, 1839, 1840,
1845, 1848, 1852, 1854, 1855, 1856, 1859, 1861, 1866, 1867,
1868, 1869, 1872, 1876, 1878, 1879, 1880, 1882, 1886, 1888,
1891, 1897, 1898, 1899, 1900, 1901, 1902, 1905, 1906, 1910,
1911, 1915, 1916, 1918, 1920, 1921, 1922, 1923, 1924, 1928,
1930, 1931, 1933, 1934, 1936, 1939, 1940, 1945, 1949, 1950,
1951, 1952, 1954, 1956, 1958, 1968, 1970, 1971, 1972, 1973,
1976, 1977, 1986, 1990, 1991, 1992, 1993, 1994, 1995, 1996,
1999, 2000, 2001, 2003, 2007, 2010, 2012, 2014, 2015, 2016,
2017, 2019, 2020, 2021, 2027, 2031, 2032, 2034, 2036, 2037,
2040, 2041, 2043, 2045, 2048, 2058, 2060, 2062, 2064, 2072,
2074, 2077, 2078, 2085, 2088, 2089, 2091, 2093, 2094, 2095,
2097, 2103, 2104, 2106, 2107, 2111, 2112, 2122, 2123, 2125,
2126, 2130, 2132, 2133, 2137, 2138, 2139, 2140, 2142, 2143,
2144, 2146, 2147, 2150, 2151, 2153, 2156, 2157, 2161, 2162,
2164, 2166, 2167, 2168, 2170, 2173, 2175, 2177, 2179, 2185,
2188, 2189, 2190, 2193, 2196, 2200, 2202, 2203, 2205, 2206,
2210, 2213, 2215, 2218, 2221, 2222, 2225, 2226, 2227, 2237,
2240, 2241, 2242, 2244, 2253, 2257, 2260, 2263, 2265, 2267,
2271, 2274, 2276, 2278, 2280, 2282, 2284, 2289, 2290, 2291,
2296, 2297, 2298, 2300, 2303, 2308, 2309, 2310, 2314, 2322,
2323, 2328, 2329, 2331, 2333, 2337, 2338, 2339, 2342, 2343,
2348, 2353, 2358, 2363, 2366, 2367, 2369, 2371, 2375, 2379,
2380, 2381, 2382, 2383, 2384, 2396, 2401, 2402, 2403, 2405,
2410, 2412, 2413, 2414, 2418, 2419, 2420, 2422, 2423, 2426,
2430, 2433, 2435, 2437, 2439, 2440, 2441, 2442, 2443, 2445,
2449, 2451, 2452, 2453, 2454, 2455, 2457, 2458, 2465, 2466,
2469, 2470, 2471, 2472, 2474, 2476, 2477, 2479, 2480, 2481,
2482, 2485, 2487, 2489, 2490, 2494, 2495, 2496, 2498, 2500,
2504, 2505, 2506, 2507, 2509, 2513, 2514, 2515, 2516, 2517,
2519, 2522, 2525, 2526, 2528, 2529, 2531, 2532, 2533, 2536,
2537, 2538, 2539, 2540, 2541, 2544, 2549, 2550, 2551, 2552,
2555, 2556, 2557, 2559, 2567, 2568, 2570, 2571, 2573, 2578,
2581, 2583, 2584, 2585, 2589, 2590, 2596, 2599, 2600, 2601,
2605, 2609, 2611, 2612, 2613, 2614, 2616, 2617, 2618, 2620,
2625, 2626, 2627, 2632, 2634, 2635, 2639, 2644, 2645, 2648,
2652, 2654, 2655, 2656, 2658, 2660, 2661, 2662, 2663, 2665,
2666, 2671, 2672, 2674, 2678, 2679, 2684, 2685, 2687, 2689,
2690, 2691, 2692, 2696, 2700, 2702, 2704, 2708, 2711, 2715,
2719, 2720, 2721, 2722, 2723, 2725, 2727, 2728, 2729, 2730,
2731, 2735, 2738, 2739, 2740, 2744, 2745, 2746, 2747, 2749,
2752, 2755, 2756, 2757, 2758, 2763, 2764, 2765, 2770, 2775,
2779, 2784, 2785, 2787, 2789, 2791, 2794, 2796, 2798, 2800,
2801, 2802, 2805, 2808, 2812, 2814, 2819, 2821, 2823, 2824,
2827, 2828, 2829, 2831, 2832, 2833, 2834, 2837, 2838, 2840,
2845, 2850, 2859, 2860, 2861, 2862, 2864, 2865, 2869, 2871,
2876, 2878, 2881, 2886, 2888, 2889, 2890, 2892, 2893, 2894,
2895, 2896, 2902, 2903, 2906, 2908, 2909, 2914, 2915, 2916,
2917, 2918, 2919, 2922, 2923, 2926, 2929, 2930, 2931, 2932,
2933, 2934, 2935, 2941, 2942, 2943, 2944, 2946, 2947, 2948,
2955, 2959, 2962, 2963, 2964, 2966, 2968, 2976, 2979, 2992,
2994, 3000, 3003, 3005, 3007, 3008, 3009, 3013, 3015, 3017,
3018, 3020, 3023, 3024, 3027, 3029, 3031, 3039, 3042, 3043,
3044, 3045, 3046, 3047, 3048, 3049, 3050, 3051, 3052, 3053,
3055, 3058, 3059, 3064, 3067, 3068, 3072, 3075, 3076, 3077,
3078, 3080, 3083, 3085, 3087, 3090, 3095, 3096, 3100, 3101,
3112, 3115, 3118, 3119, 3120, 3121, 3122, 3123, 3126, 3127,
3128, 3129, 3138, 3139, 3141, 3143, 3145, 3153, 3154, 3156,
3167, 3169, 3170, 3171, 3172, 3177, 3181, 3185, 3189, 3191,
3192, 3194, 3196, 3201, 3202, 3205, 3206, 3208, 3210, 3215,
3217, 3219, 3220, 3221, 3224, 3225, 3227, 3228, 3230, 3231,
3235, 3236, 3237, 3239, 3240, 3242, 3246, 3247, 3252, 3255,
3261, 3263, 3266, 3267, 3268, 3269, 3271, 3272, 3280, 3282,
3286, 3288, 3289, 3290, 3291, 3294, 3295, 3296, 3297, 3299,
3301, 3303, 3308, 3310, 3312, 3313, 3324, 3327, 3331, 3332,
3333, 3337, 3338, 3340, 3342, 3343, 3345, 3351, 3353, 3355,
3357, 3359, 3361, 3363, 3370, 3377, 3378, 3379, 3382, 3383,
3386, 3394, 3396, 3399, 3403, 3405, 3413, 3416, 3418, 3419,
3422, 3424, 3425, 3426, 3428, 3435, 3438, 3441, 3442, 3445,
3446, 3447, 3449, 3450, 3451, 3452, 3453, 3458, 3461, 3462,
3465, 3466, 3468, 3469, 3470, 3471, 3474, 3477, 3484, 3486,
3488, 3490, 3491, 3493, 3494, 3500, 3501, 3502, 3503, 3504,
3507, 3510, 3515, 3516, 3517, 3518, 3523, 3524, 3529, 3533,
3535, 3536, 3538, 3540, 3541, 3542, 3544, 3545, 3548, 3549,
3554, 3558, 3560, 3562, 3569, 3571, 3574, 3576, 3577, 3580,
3587, 3588, 3589, 3592, 3594, 3595, 3597, 3600, 3601, 3603,
3604, 3607, 3610, 3611, 3613, 3615, 3616, 3618, 3619, 3620,
3621, 3622, 3624, 3629, 3633, 3634, 3640, 3642, 3643, 3644,
3645, 3646, 3648, 3655, 3657, 3659, 3660, 3661, 3662, 3667,
3669, 3672, 3674, 3676, 3677, 3681, 3682, 3684, 3685, 3690,
3693, 3702, 3704, 3706, 3707, 3709, 3713, 3715, 3717, 3718,
3721, 3723, 3725, 3730, 3731, 3732, 3738, 3739, 3743, 3744,
3748, 3749, 3752, 3756, 3761, 3762, 3764, 3765, 3766, 3772,
3773, 3774, 3775, 3777, 3778, 3783, 3785, 3787, 3791, 3792,
3793, 3798, 3800, 3801, 3804, 3806, 3808, 3817, 3818, 3819,
3820, 3823, 3825, 3828, 3829, 3830, 3831, 3832, 3833, 3837,
3838, 3839, 3843, 3844, 3845, 3846, 3849, 3858, 3859, 3860,
3867, 3868, 3870, 3871, 3872, 3873, 3876, 3882, 3883, 3884,
3885, 3887, 3888, 3889, 3892, 3894, 3895, 3896, 3897, 3898,
3899, 3902, 3904, 3907, 3908, 3910, 3912, 3916, 3917, 3918,
3923, 3924, 3926, 3928, 3929, 3933, 3934, 3938, 3940, 3941,
3947, 3950, 3951, 3952, 3954, 3958, 3962, 3964, 3967, 3968,
3970, 3971, 3972, 3974, 3975, 3978, 3983, 3985, 3988, 3994,
3996, 3997, 4000, 4005, 4007, 4008, 4013, 4014, 4019, 4020,
4024, 4026, 4028, 4030, 4033, 4035, 4037, 4038, 4039, 4040,
4041, 4042, 4043, 4047, 4048, 4050, 4051, 4052, 4053, 4054,
4056, 4057, 4061, 4062, 4066, 4067, 4068, 4070, 4071, 4075,
4079, 4080, 4084, 4087, 4088, 4092, 4094, 4096, 4099, 4102,
4103, 4105, 4106, 4109, 4110, 4113, 4116, 4124, 4128, 4132,
4133, 4135, 4139, 4140, 4143, 4144, 4146, 4147, 4148, 4149,
4150, 4155, 4158, 4160, 4161, 4162, 4163, 4164, 4165, 4166,
4167, 4168, 4170, 4171, 4175, 4178, 4185, 4187, 4188, 4189,
4191, 4192, 4193, 4197, 4201, 4202, 4204, 4205, 4206, 4207,
4208, 4210, 4211, 4212, 4217, 4219, 4221, 4222, 4227, 4228,
4229, 4233, 4234, 4235, 4242, 4245, 4246, 4250, 4251, 4253,
4257, 4258, 4260, 4261, 4263, 4266, 4270, 4272, 4275, 4276,
4280, 4281, 4284, 4288, 4290, 4292, 4294, 4296, 4298, 4300,
4301, 4302, 4304, 4305, 4306, 4309, 4312, 4314, 4317, 4320,
4321, 4324, 4329, 4330, 4333, 4335, 4338, 4339, 4341, 4344,
4347, 4352, 4354, 4358, 4359, 4360, 4369, 4374, 4377, 4378,
4380, 4383, 4388, 4390, 4391, 4393, 4395, 4396, 4397, 4401,
4402, 4403, 4404, 4405, 4409, 4410, 4422, 4423, 4425, 4430,
4436, 4437, 4439, 4440, 4442, 4443, 4446, 4448, 4449, 4450,
4453, 4461, 4462, 4463, 4464, 4466, 4467, 4468, 4470, 4474,
4475, 4479, 4492, 4494, 4496, 4497, 4498, 4500, 4502, 4507,
4508, 4512, 4514, 4515, 4518, 4519, 4521, 4522, 4529, 4531, 4532, 4535, 4543, 4545, 4548, 4549, 4551, 4554, 4555, 4556, 4557, 4558, 4560, 4562, 4563, 4565, 4566, 4567, 4568, 4575, 4576, 4580, 4582, 4583, 4584, 4590, 4591, 4593, 4594, 4596, 4597, 4598, 4601, 4606, 4616, 4623, 4625, 4628, 4630, 4632, 4633, 4639, 4641, 4643, 4644, 4645, 4646, 4647, 4650, 4651, 4653, 4654, 4655, 4656, 4657, 4658, 4659, 4662, 4664, 4667, 4669, 4671, 4672, 4673, 4674, 4676, 4677, 4680, 4682, 4685, 4691, 4692, 4694, 4696, 4697, 4699, 4700, 4701, 4705, 4706, 4708, 4710, 4711, 4712, 4713, 4715, 4719, 4721, 4723, 4729, 4730, 4734, 4736, 4737, 4738, 4739, 4740, 4741, 4745, 4746, 4749, 4750, 4753, 4755, 4756, 4761, 4762, 4766, 4767, 4769, 4770, 4771, 4773, 4779, 4780, 4784, 4787, 4788, 4789, 4790, 4791, 4794, 4795, 4801, 4802, 4804, 4805, 4806, 4807, 4809, 4813, 4815, 4816, 4817, 4818, 4822, 4828, 4829, 4830, 4831, 4834, 4838, 4841, 4842, 4845, 4855, 4856, 4857, 4859, 4861, 4862, 4863, 4864, 4869, 4874, 4875, 4876, 4880, 4881, 4887, 4889, 4891, 4896, 4897, 4900, 4902, 4904, 4905, 4909, 4910, 4913, 4914, 4918, 4921, 4922, 4924, 4925, 4928, 4935, 4936, 4941, 4942, 4943, 4950, 4954, 4958, 4959, 4967, 4969, 4971, 4972, 4974, 4975, 4977, 4984, 4987, 4988, 4993, 4994, 4996, 5000, 5005, 5007, 5011, 5015, 5016, 5021, 5022, 5026, 5029, 5030, 5032, 5034, 5036, 5037, 5038, 5039, 5040, 5042, 5044, 5045, 5046, 5051, 5052, 5054, 5057, 5060, 5067, 5072, 5074, 5075, 5078, 5079, 5082, 5084, 5088, 5089, 5090, 5091, 5094, 5097, 5098, 5100, 5101, 5102, 5109, 5111, 5113, 5114, 5115, 5116, 5120, 5122, 5123, 5131, 5132, 5140, 5147, 5150, 5151, 5160, 5164, 5165, 5168, 5170, 5174, 5180, 5181, 5184, 5185, 5188, 5189, 5190, 5191, 5192, 5196, 5198, 5200, 5202, 5203, 5206, 5209, 5212, 5213, 5214, 5216, 5217, 5218, 5219, 5225, 5226, 5228, 5229, 5234, 5240, 5241, 5243, 5249, 5253, 5254, 5256, 5257, 5258, 5260, 5261, 5263, 5264, 5267, 5268, 5269, 5273, 5274, 5275, 5276, 5280, 5281, 5283, 5286, 5287, 5291, 5293, 5297, 5298, 5299, 5300, 5301, 5308, 5311, 5314, 5315, 5317, 5319, 5321, 5324, 5329, 5330, 5334, 5338, 5339, 5342, 5343, 5345, 5346, 5348, 5349, 5350, 5351, 5352, 5359, 5361, 5366, 5367, 5371, 5383, 5386, 5388, 5389, 5393, 5395, 5396, 5397, 5402, 5405, 5409, 5411, 5413, 5414, 5417, 5418, 5422, 5426, 5427, 5428, 5430, 5431, 5433, 5434, 5437, 5438, 5445, 5446, 5448, 5449, 5452, 5453, 5456, 5458, 5459, 5461, 5463, 5464, 5467, 5469, 5471, 5472, 5475, 5476, 5483, 5485, 5487, 5488, 5491, 5493, 5495, 5496, 5505, 5506, 5508, 5510, 5513, 5515, 5517, 5518, 5519, 5524, 5526, 5529, 5530, 5532, 5534, 5535, 5541, 5543, 5545, 5554, 5555, 5562, 5563, 5566, 5568, 5569, 5572, 5575, 5579, 5581, 5582, 5583, 5584, 5585, 5586, 5589, 5591, 5593, 5594, 5597, 5608, 5612, 5613, 5614, 5615, 5616, 5618, 5619, 5620, 5623, 5627, 5632, 5633, 5635, 5638, 5640, 5643, 5647, 5648, 5649, 5650, 5651, 5652, 5653, 5656, 5657, 5659, 5660, 5662, 5663, 5664, 5669, 5680, 5683, 5689, 5690, 5694, 5695, 5697, 5698, 5702, 5705, 5706, 5709, 5711, 5714, 5717, 5718, 5719, 5721, 5722, 5723, 5729, 5730, 5731, 5732, 5734, 5735, 5736, 5742, 5744, 5751, 5757, 5758, 5768, 5770, 5773, 5775, 5780, 5784, 5785, 5788, 5791, 5792, 5794, 5805, 5808, 5809, 5810, 5811, 5820, 5823, 5825, 5826, 5832, 5834, 5835, 5836, 5837, 5842, 5844, 5850, 5853, 5854, 5856, 5859, 5864, 5867, 5868, 5869, 5871, 5872, 5876, 5878, 5879, 5881, 5882, 5883, 5884, 5888, 5889, 5892, 5893, 5900, 5901, 5902, 5906, 5907, 5910, 5912, 5918, 5919, 5921, 5922, 5923, 5925, 5927, 5928, 5930, 5931, 5932, 5933, 5934, 5938, 5939, 5940, 5941, 5942, 5944, 5946, 5948, 5950, 5951, 5954, 5955, 5956, 5957, 5959, 5961, 5967, 5968, 5971, 5975, 5978, 5979, 5980, 5985, 5986, 5988, 5990, 5991, 5992, 5994, 5996, 5997, 6000, 6002, 6004, 6006, 6007, 6010, 6012, 6013, 6016, 6017, 6021, 6025, 6026, 6031, 6038, 6040, 6041, 6042, 6043, 6044, 6047, 6048, 6051, 6053, 6054, 6058, 6059, 6060, 6062, 6063, 6068, 6069, 6070, 6072, 6073, 6074, 6075, 6077, 6080, 6084, 6085, 6087, 6088, 6089, 6090, 6091, 6092, 6093, 6094, 6095, 6098, 6100, 6108, 6109, 6110, 6112, 6113, 6116, 6119, 6120, 6122, 6125, 6129, 6130, 6131, 6132, 6133, 6136, 6137, 6143, 6145, 6146, 6147, 6149, 6150, 6151, 6152, 6153, 6155, 6156, 6160, 6163, 6164, 6165, 6168, 6181, 6182, 6183, 6186, 6188, 6189, 6191, 6193, 6196, 6197, 6198, 6200, 6203, 6205, 6207, 6209, 6212, 6213, 6220, 6223, 6224, 6226, 6227, 6228, 6230, 6231, 6234, 6237, 6238, 6239, 6240, 6242, 6243, 6246, 6247, 6249, 6250, 6251, 6257, 6258, 6259, 6260, 6264, 6265, 6270, 6271, 6272, 6273, 6275, 6278, 6279, 6280, 6281, 6282, 6286, 6288, 6291, 6292, 6294, 6295, 6296, 6297, 6299, 6302, 6309, 6310, 6311, 6312, 6315, 6316, 6317, 6319, 6321, 6322, 6323, 6325, 6326, 6328, 6333, 6335, 6338, 6343, 6344, 6346, 6351, 6352, 6353, 6354, 6359, 6360, 6362, 6363, 6367, 6370, 6373, 6375, 6378, 6379, 6381, 6383, 6387, 6394, 6395, 6396, 6397, 6399, 6403, 6405, 6407, 6413, 6414, 6415, 6419, 6420, 6422, 6426, 6429, 6430, 6431, 6434, 6436, 6437, 6440, 6442, 6450, 6454, 6459, 6463, 6464, 6466, 6467, 6469, 6470, 6471, 6474, 6476, 6480, 6482, 6484, 6488, 6492, 6494, 6495, 6497, 6499, 6500, 6501, 6502, 6504, 6505, 6510, 6513, 6514, 6515, 6516, 6517, 6519, 6524, 6525, 6526, 6530, 6533, 6534, 6535, 6537, 6543, 6544, 6547, 6549, 6551, 6553, 6554, 6555, 6556, 6557, 6558, 6560, 6561, 6563, 6564, 6567, 6569, 6572, 6574, 6576, 6577, 6579, 6581, 6582, 6584, 6587, 6588, 6589, 6592, 6595, 6596, 6597, 6598, 6599, 6607, 6609, 6610, 6611, 6617, 6620, 6621, 6624, 6625, 6626, 6627, 6628, 6629, 6630, 6634, 6635, 6637, 6638, 6639, 6640, 6643, 6644, 6646, 6647, 6649, 6650, 6654, 6655, 6662, 6666, 6671, 6672, 6673, 6681, 6686, 6693, 6695, 6696, 6702, 6703, 6704, 6705, 6706, 6711, 6714, 6716, 6718, 6720, 6724, 6725, 6729, 6730, 6731, 6734, 6736, 6737, 6739, 6740, 6741, 6742, 6746, 6747, 6757, 6759, 6761, 6764, 6766, 6778, 6779, 6780, 6781, 6782, 6786, 6788, 6792, 6793, 6795, 6797, 6799, 6803, 6804, 6805, 6807, 6810, 6811, 6812, 6813, 6816, 6819, 6820, 6821, 6824; 6826, 6827, 6828, 6830, 6831, 6832, 6834, 6836, 6839, 6840, 6841, 6842, 6843, 6845, 6851, 6859, 6860, 6863, 6869, 6872, 6874, 6875, 6876, 6877, 6878, 6879, 6880, 6886, 6887, 6888, 6890, 6891, 6894, 6902, 6903, 6906, 6913, 6914, 6915, 6917, 6919, 6920, 6921, 6922, 6923, 6924, 6930, 6933, 6936, 6941, 6943, 6944, 6946, 6948, 6950, 6951, 6952, 6954, 6959, 6960, 6963, 6966, 6967, 6969, 6970, 6971, 6979, 6980, 6984, 6985, 6987, 6988, 6990, 6991, 6994, 6995, 6999, 7000, 7002, 7003, 7006, 7009, 7011, 7012, 7013, 7015, 7016, 7022, 7032, 7033, 7038, 7039, 7040, 7042, 7043, 7046, 7049, 7050, 7052, 7053, 7056, 7057, 7064, 7067, 7073, 7077, 7079, 7083, 7084, 7085, 7086, 7093, 7094, 7097, 7106, 7107, 7108, 7112, 7113, 7116, 7117, 7118, 7124, 7126, 7128, 7129, 7130, 7132, 7135, 7138, 7139, 7140, 7142, 7144, 7146, 7149, 7151, 7155, 7163, 7164, 7165, 7166, 7169, 7172, 7176, 7177, 7182, 7183, 7184, 7187, 7188, 7189, 7194, 7196, 7197, 7201, 7202, 7203, 7206, 7207, 7208, 7209, 7211, 7216, 7217, 7219, 7227, 7228, 7230, 7232, 7233, 7234, 7236, 7239, 7240, 7241, 7243, 7244, 7245, 7248, 7249, 7250, 7255, 7257, 7258, 7259, 7262, 7264, 7267, 7268, 7270, 7274, 7277, 7278, 7281, 7282, 7284, 7287, 7288, 7290, 7291, 7292, 7293, 7299, 7300, 7301, 7303, 7304, 7305, 7306, 7307, 7310, 7311, 7313, 7315, 7317, 7328, 7330, 7331, 7334, 7336, 7340, 7343, 7344, 7348, 7350, 7351, 7354, 7355, 7357, 7358, 7361, 7363, 7365, 7369, 7371, 7373, 7377, 7379, 7380, 7382, 7383, 7386, 7388, 7389, 7392, 7395, 7396, 7398, 7400, 7406, 7409, 7410, 7411, 7417, 7418, 7425, 7428, 7430, 7433, 7434, 7435, 7436, 7438, 7441, 7443, 7444, 7446, 7447, 7448, 7452, 7454, 7458, 7459, 7464, 7466, 7470, 7483, 7486, 7490, 7492, 7493, 7498, 7499, 7502, 7504, 7505, 7506, 7512, 7515, 7517, 7518, 7522, 7523, 7524, 7525, 7528, 7533, 7537, 7538, 7542, 7546, 7547, 7548, 7554, 7556, 7561, 7568, 7574, 7578, 7579, 7580, 7585, 7586, 7587, 7589, 7590, 7594, 7595, 7599, 7601, 7605, 7613, 7619, 7620, 7621, 7623, 7624, 7625, 7632, 7633, 7638, 7639, 7640, 7642, 7643, 7647, 7652, 7658, 7661, 7663, 7665, 7666, 7667, 7671, 7674, 7677, 7678, 7679, 7680, 7682, 7686, 7687, 7689, 7695, 7699, 7700, 7703, 7704, 7708, 7712, 7713, 7716, 7717, 7719, 7724, 7725, 7726, 7729, 7730, 7733, 7734, 7736, 7737, 7738, 7740, 7743, 7744, 7745, 7747, 7750, 7751, 7753, 7755, 7761, 7762, 7763, 7764, 7768, 7769, 7770, 7772, 7774, 7775, 7779, 7780, 7781, 7782, 7785, 7786, 7788, 7791, 7793, 7796, 7798, 7800, 7803, 7804, 7806, 7807, 7812, 7819, 7820, 7823, 7824, 7825, 7832, 7833, 7834, 7836, 7838, 7841, 7844, 7845, 7847, 7848, 7852, 7854, 7856, 7859, 7860, 7862, 7863, 7865, 7873, 7875, 7878, 7880, 7881, 7888, 7890, 7896, 7900, 7908, 7910, 7911, 7918, 7923, 7925, 7929, 7933, 7934, 7935, 7936, 7937, 7938, 7942, 7944, 7945, 7947, 7948, 7950, 7955, 7956, 7962, 7964, 7972, 7974, 7976, 7977, 7978, 7980, 7984, 7986, 7988, 7989, 7990, 7991, 7993, 7998, 8002, 8004, 8005, 8006, 8007, 8008, 8012, 8020, 8021, 8026, 8030, 8035, 8039, 8042, 8043, 8044, 8045, 8047, 8048, 8052, 8053, 8056, 8058, 8059, 8062, 8063, 8065, 8067, 8068, 8071, 8072, 8073, 8076, 8077, 8078, 8079, 8080, 8082, 8083, 8084, 8087, 8088, 8091, 8093, 8095, 8100, 8102, 8103, 8105, 8106, 8112, 8114, 8116, 8118, 8121, 8123, 8124, 8125, 8126, 8130, 8136, 8137, 8145, 8146, 8147, 8150, 8151, 8156, 8159, 8163, 8164, 8165, 8168, 8170, 8174, 8176, 8178, 8179, 8181, 8182, 8185, 8189, 8192, 8193, 8199, 8202, 8204, 8207, 8208, 8210, 8211, 8213, 8216, 8219, 8220, 8222, 8225, 8227, 8230, 8235, 8237, 8239, 8240, 8241, 8242, 8245, 8248, 8249, 8250, 8252, 8253, 8265, 8266, 8268, 8269, 8270, 8272, 8282, 8288, 8289, 8291, 8293, 8294, 8300, 8301, 8302, 8304, 8306, 8310, 8311, 8312, 8318, 8319, 8320, 8321, 8322, 8324, 8329, 8339, 8340, 8347, 8349, 8350, 8351, 8352, 8353, 8355, 8363, 8367, 8368, 8369, 8372, 8373, 8376, 8378, 8379, 8385, 8387, 8389, 8392, 8393, 8395, 8398, 8401, 8402, 8403, 8404, 8405, 8408, 8410, 8411, 8413, 8414, 8416, 8417, 8418, 8427, 8433, 8436, 8438, 8439, 8441, 8442, 8444, 8447, 8448, 8449, 8450, 8451, 8456, 8457, 8458, 8459, 8460, 8465, 8466, 8469, 8470, 8471, 8472, 8473, 8474, 8476, 8477, 8480, 8481, 8482, 8485, 8486, 8490, 8493, 8498, 8500, 8501, 8502, 8505, 8507, 8509, 8511, 8513, 8515, 8516, 8517, 8520, 8523, 8524, 8525, 8527, 8528, 8531, 8532, 8533, 8535, 8537, 8538, 8539, 8541, 8542, 8544, 8549, 8550, 8553, 8554, 8557, 8558, 8561, 8562, 8565, 8566, 8568, 8575, 8576, 8579, 8581, 8582, 8589, 8590, 8592, 8593, 8594, 8596, 8597, 8598, 8599, 8600, 8601, 8602, 8603, 8604, 8605, 8611, 8612, 8614, 8617, 8618, 8624, 8628, 8630, 8631, 8634, 8637, 8638, 8639, 8640, 8641, 8642, 8644, 8647, 8648, 8652, 8654, 8657, 8658, 8659, 8663, 8665, 8669, 8670, 8672, 8676, 8677, 8681, 8685, 8689, 8690, 8693, 8694, 8699, 8700, 8703, 8704, 8706, 8707, 8708, 8709, 8713, 8716, 8717, 8720, 8729, 8731, 8732, 8734, 8735, 8736, 8740, 8741, 8742, 8744, 8746, 8747, 8748, 8751, 8752, 8753, 8757, 8759, 8767, 8768, 8770, 8771, 8772, 8773, 8774, 8775, 8776, 8777, 8779, 8783, 8784, 8785, 8789, 8792, 8795, 8796, 8797, 8805, 8808, 8810, 8817, 8818, 8822, 8824, 8829, 8831, 8832, 8833, 8835, 8838, 8841, 8843, 8846, 8853, 8854, 8859, 8861, 8865, 8866, 8867, 8869, 8876, 8878, 8880, 8881, 8883, 8886, 8888, 8889, 8891, 8892, 8896, 8899, 8902, 8905, 8907, 8908, 8909, 8910, 8911, 8913, 8914, 8916, 8917, 8926, 8928, 8929, 8930, 8935, 8938, 8941, 8942, 8945, 8946, 8949, 8951, 8957, 8959, 8960, 8961, 8962, 8964, 8965, 8967, 8968, 8969, 8971, 8972, 8974, 8976, 8977, 8979, 8980, 8981, 8985, 8986, 8991, 8992, 8996, 8998, 8999, 9001, 9002, 9003, 9006, 9009, 9012, 9020, 9021, 9022, 9029, 9030, 9033, 9037, 9042, 9044, 9052, 9056, 9057, 9058, 9059, 9060, 9062, 9069, 9071, 9073, 9074, 9076, 9084, 9088, 9091, 9092, 9095, 9096, 9097, 9103, 9105, 9108, 9110, 9112, 9114, 9116, 9118, 9119, 9125, 9129, 9131, 9133, 9134, 9139, 9140, 9141, 9142, 9146, 9149, 9151, 9152, 9154, 9155, 9156, 9164, 9173, 9174, 9175, 9177, 9183, 9185, 9186, 9187, 9188, 9190, 9191, 9194, 9195, 9205, 9206, 9207, 9210, 9211, 9213, 9215, 9216, 9223, 9226, 9229, 9233, 9234, 9237, 9241, 9242, 9243, 9244, 9247, 9248, 9249, 9252, 9253, 9254, 9257, 9262, 9263, 9265, 9267, 9269, 9270, 9273, 9275, 9276, 9278, 9282, 9284, 9287, 9288, 9289, 9290, 9291, 9292, 9295, 9299, 9300, 9302, 9304, 9308, 9311, 9313, 9320, 9321, 9323, 9325, 9326, 9328, 9329, 9330, 9332, 9336, 9337, 9338, 9339, 9340, 9341, 9345, 9346, 9347, 9348, 9349, 9353, 9354, 9355, 9357, 9359, 9367, 9373, 9375, 9376, 9378, 9382, 9383, 9388, 9391, 9392, 9394, 9396, 9398, 9400, 9402, 9403, 9404, 9406, 9407, 9413, 9414, 9415, 9422, 9423, 9426, 9432, 9433, 9434, 9439, 9440, 9443, 9444, 9449, 9451, 9452, 9453, 9456, 9459, 9460, 9468, 9471, 9472, 9473, 9476, 9478, 9481, 9483, 9488, 9490, 9497, 9501, 9502, 9503, 9504, 9505, 9509, 9513, 9514, 9515, 9517, 9518, 9519, 9520, 9525, 9531, 9533, 9534, 9536, 9540, 9543, 9546, 9548, 9553, 9555, 9557, 9563, 9564, 9565, 9567, 9568, 9571, 9575, 9577, 9582, 9586, 9587, 9589, 9590, 9591, 9597, 9606, 9607, 9609, 9610, 9613, 9615, 9617, 9618, 9620, 9623, 9624, 9626, 9627, 9628, 9629, 9632, 9633, 9635, 9637, 9640, 9641, 9642, 9644, 9645, 9646, 9649, 9653, 9655, 9656, 9657, 9658, 9659, 9660, 9663, 9666, 9670, 9675, 9679, 9681, 9682, 9686, 9688, 9692, 9693, 9698, 9700, 9701, 9706, 9710, 9711, 9718, 9723, 9725, 9726, 9730, 9731, 9732, 9733, 9734, 9737, 9746, 9750, 9751, 9753, 9754, 9755, 9756, 9763, 9764, 9767, 9768, 9770, 9774, 9776, 9777, 9780, 9781, 9782, 9784, 9786, 9792, 9794, 9796, 9799, 9801, 9804, 9812, 9813, 9816, 9819, 9820, 9824, 9825, 9830, 9833, 9836, 9845, 9846, 9847, 9849, 9851, 9854, 9861, 9864, 9866, 9869, 9873, 9876, 9882, 9886, 9887, 9892, 9893, 9897, 9900, 9901, 9906, 9907, 9908, 9909, 9910, 9911, 9912, 9918, 9923, 9924, 9928, 9935, 9938, 9940, 9946, 9949, 9950, 9953, 9955, 9957, 9958, 9960, 9962, 9963, 9964, 9967, 9971, 9972, 9974, 9975, 9976, 9979, 9980, 9982, 9984, 9985, 9987, 9988, 9990, 9991, 9997, 10000, 10008, 10009, 10010, 10013, 10015, 10017, 10018, 10019, 10021, 10022, 10026, 10027, 10032, 10033, 10034, 10035, 10037, 10038, 10043, 10044, 10045, 10047, 10048, 10051, 10052, 10053, 10054, 10056, 10058, 10059, 10060, 10062, 10063, 10064, 10066, 10068, 10072, 10073, 10075, 10076, 10078, 10080, 10081, 10087, 10089, 10090, 10091, 10092, 10095, 10097, 10101, 10102, 10103, 10105, 10106, 10107, 10108, 10109, 10110, 10112, 10114, 10115, 10116, 10117, 10118, 10122, 10127, 10128, 10131, 10132, 10136, 10138, 10143, 10146, 10147, 10149, 10151, 10152, 10158, 10163, 10165, 10166, 10168, 10170, 10174, 10176, 10178, 10180, 10181, 10182, 10186, 10192, 10193, 10194, 10195, 10197, 10199, 10200, 10201, 10203, 10206, 10213, 10214, 10218, 10219, 10220, 10222, 10223, 10224, 10225, 10228, 10229, 10231, 10233, 10235, 10236, 10237, 10239, 10246, 10247, 10252, 10253, 10254, 10255, 10257, 10258, 10259, 10262, 10268, 10275, 10278, 10284, 10286, 10291, 10292, 10293, 10295, 10300, 10302, 10306, 10307, 10311, 10318, 10319, 10321, 10322, 10323, 10325, 10326, 10328, 10331, 10334, 10335, 10336, 10341, 10342, 10343, 10346, 10352, 10353, 10354, 10356, 10357, 10359, 10360, 10362, 10364, 10368, 10371, 10373, 10375, 10378, 10380, 10381, 10384, 10385, 10388, 10389, 10395, 10397, 10398, 10399, 10401, 10405, 10410, 10413, 10414, 10416, 10421, 10423, 10425, 10428, 10429, 10430, 10435, 10437, 10438, 10440, 10446, 10447, 10448, 10449, 10450, 10451, 10452, 10453, 10455, 10456, 10463, 10464, 10465, 10466, 10468, 10469, 10470, 10474, 10478, 10482, 10487, 10488, 10490, 10492, 10494, 10496, 10504, 10506, 10508, 10513, 10514, 10516, 10518, 10525, 10527, 10528, 10530, 10531, 10532, 10533, 10535, 10536, 10537, 10541, 10542, 10543, 10544, 10547, 10548, 10555, 10556, 10558, 10561, 10562, 10563, 10565, 10569, 10573, 10577, 10580, 10581, 10582, 10583, 10585, 10590, 10593, 10595, 10596, 10597, 10599, 10601, 10602, 10606, 10610, 10611, 10612, 10613, 10615, 10616, 10617, 10618, 10619, 10621, 10622, 10623, 10625, 10626, 10628, 10629, 10630, 10631, 10633, 10636, 10637, 10638, 10639, 10640, 10641, 10642, 10645, 10646, 10649, 10650, 10655, 10657, 10663, 10665, 10668, 10670, 10671, 10673, 10674, 10676, 10677, 10678, 10681, 10682, 10683, 10684, 10685, 10686, 10689, 10693, 10697, 10699, 10700, 10702, 10703, 10705, 10707, 10711, 10712, 10715, 10716, 10721, 10722, 10725, 10726, 10732, 10734, 10735, 10738, 10739, 10740, 10741, 10744, 10745, 10747, 10748, 10749, 10753, 10754, 10756, 10761, 10762, 10763, 10766, 10770, 10771, 10775, 10777, 10778, 10779, 10782, 10784, 10785, 10787, 10788, 10790, 10791, 10792, 10795, 10796, 10798, 10800, 10802, 10803, 10804, 10805, 10809, 10810, 10811, 10812, 10813, 10815, 10818, 10819, 10820, 10821, 10823, 10824, 10825, 10826, 10830, 10831, 10833, 10836, 10838, 10839, 10840, 10843, 10846, 10850, 10852, 10853, 10854, 10857, 10858, 10860, 10862, 10863, 10866, 10867, 10872, 10874, 10877, 10880, 10881, 10886, 10887, 10892, 10896, 10897, 10898, 10899, 10902, 10903, 10911, 10912, 10917, 10920, 10926, 10927, 10928, 10930, 10933, 10934, 10935, 10936, 10937, 10938, 10939, 10940, 10941, 10944, 10945, 10947, 10948, 10954, 10956, 10957, 10960, 10962, 10964, 10965, 10967, 10968, 10972, 10975, 10976, 10977, 10980, 10988, 10993, 10995, 10996, 10997, 10999, 11002, 11004, 11005, 11006, 11008, 11009, 11010, 11015, 11018, 11023, 11024, 11025, 11026, 11027, 11032, 11033, 11039, 11044, 11046, 11047, 11049, 11052, 11053, 11056, 11058, 11060, 11066, 11067, 11068, 11070, 11071, 11072, 11078, 11081, 11082, 11083, 11086, 11090, 11092, 11095, 11098, 11101, 11102, 11107, 11110, 11114, 11116, 11118, 11119, 11123, 11124, 11125, 11127, 11129, 11132, 11135, 11137, 11138, 11145, 11146, 11148, 11151, 11153, 11154, 11155, 11156, 11157, 11158, 11160, 11161, 11162, 11163, 11166, 11169, 11173, 11174, 11175, 11177, 11179, 11180, 11181, 11184, 11185, 11187, 11188, 11190, 11192, 11194, 11198, 11199, 11201, 11202, 11203, 11207, 11210, 11214, 11216, 11217, 11218, 11222, 11226, 11227, 11228, 11229, 11232, 11233, 11234, 11235, 11236, 11237, 11239, 11240, 11244, 11246, 11247, 11248, 11254, 11255, 11256, 11257, 11258, 11259, 11260, 11261, 11262, 11263, 11264, 11266, 11274, 11275, 11278, 11288, 11289, 11290, 11292, 11293, 11294, 11295, 11296, 11298, 11302, 11306, 11307, 11313, 11315, 11316, 11318, 11319, 11320, 11322, 11324, 11329, 11330, 11331, 11332, 11333, 11337, 11338, 11339, 11340, 11345, 11346, 11348, 11349, 11352, 11356, 11358, 11363, 11365, 11366, 11370, 11371, 11373, 11377, 11380, 11381, 11382, 11387, 11388, 11389, 11391, 11394, 11395, 11397, 11398, 11401, 11403, 11404, 11405, 11406, 11409, 11410, 11411, 11412, 11413, 11414, 11416, 11423, 11424, 11428, 11430, 11434, 11437, 11438, 11446, 11447, 11449, 11451, 11456, 11458, 11459, 11461, 11463, 11464, 11465, 11467, 11471, 11472, 11473, 11475, 11476, 11477, 11478, 11481, 11482, 11487, 11489, 11490, 11491, 11494, 11496, 11497, 11498, 11499, 11500, 11503, 11506, 11507, 11508, 11512, 11516, 11518, 11520, 11522, 11523, 11524, 11526, 11528, 11530, 11531, 11532, 11533, 11534, 11538, 11541, 11544, 11546, 11547, 11548, 11551, 11553, 11558, 11560, 11561, 11563, 11567, 11568, 11570, 11571, 11576, 11577, 11578, 11580, 11583, 11585, 11586, 11593, 11594, 11595, 11596, 11597, 11599, 11604, 11607, 11612, 11615, 11618, 11619, 11620, 11621, 11623, 11626, 11628, 11629, 11632, 11633, 11636, 11637, 11639, 11642, 11644, 11650, 11652, 11656, 11657, 11658, 11663, 11668, 11669, 11673, 11677, 11678, 11680, 11681, 11682, 11683, 11688, 11691, 11692, 11693, 11694, 11695, 11698, 11699, 11701, 11703, 11705, 11707, 11710, 11711, 11712, 11718, 11720, 11721, 11722, 11725, 11731, 11733, 11736, 11740, 11743, 11744, 11753, 11755, 11756, 11759, 11760, 11761, 11762, 11763, 11764, 11765, 11766, 11767, 11770, 11771, 11773, 11774, 11776, 11780, 11781, 11782, 11783, 11784, 11785, 11786, 11790, 11792, 11799, 11800, 11802, 11804, 11809, 11810, 11811, 11812, 11813, 11814, 11816, 11818, 11819, 11820, 11821, 11826, 11828, 11830, 11837, 11839, 11841, 11846, 11848, 11849, 11850, 11851, 11853, 11856, 11858, 11863, 11868, 11870, 11872, 11876, 11877, 11881, 11889, 11890, 11891, 11894, 11898, 11899, 11903, 11904, 11905, 11909, 11912, 11913, 11916, 11917, 11918, 11919, 11920, 11921, 11922, 11923, 11926, 11927, 11928, 11929, 11930, 11934, 11935, 11939, 11940, 11941, 11943, 11945, 11946, 11947, 11948, 11949, 11953, 11957, 11958, 11959, 11960, 11961, 11962, 11963, 11965, 11968, 11975, 11976, 11977, 11978, 11979, 11980, 11983, 11987, 11988, 11993, 11994, 11995, 11996, 11997, 11998, 11999, 12002, 12004, 12008, 12014, 12017, 12019, 12020, 12021, 12023, 12024, 12025, 12032, 12042, 12043, 12044, 12050, 12054, 12059, 12061, 12063, 12068, 12076, 12078, 12079, 12080, 12081, 12083, 12085, 12086, 12087, 12089, 12091, 12092, 12093, 12097, 12098, 12102, 12104, 12106, 12109, 12110, 12112, 12115, 12118, 12120, 12122, 12127, 12128, 12129, 12131, 12134, 12135, 12137, 12138, 12139, 12141, 12143, 12144, 12145, 12146, 12147, 12148, 12150, 12151, 12153, 12161, 12162, 12164, 12165, 12166, 12167, 12170, 12171, 12174, 12175, 12176, 12179, 12181, 12197, 12198, 12200, 12201, 12202, 12204, 12208, 12214, 12217, 12218, 12221, 12223, 12229, 12234, 12237, 12238, 12240, 12241, 12243, 12245, 12249, 12250, 12252, 12254, 12255, 12256, 12259, 12260, 12268, 12269, 12271, 12274, 12275, 12278, 12280, 12283, 12285, 12286, 12287, 12288, 12291, 12293, 12295, 12304, 12310, 12311, 12312, 12313, 12314, 12315, 12317, 12319, 12321, 12323, 12324, 12325, 12328, 12331, 12333, 12334, 12339, 12340, 12342, 12345, 12347, 12350, 12354, 12356, 12358, 12359, 12364, 12366, 12367, 12368, 12370, 12374, 12375, 12376, 12379, 12380, 12381, 12385, 12390, 12393, 12394, 12396, 12397, 12399, 12400, 12403, 12406, 12410, 12411, 12414, 12415, 12416, 12417, 12419, 12420, 12423, 12424, 12426, 12427, 12437, 12439, 12440, 12444, 12445, 12447, 12450, 12451, 12455, 12456, 12457, 12459, 12462, 12465, 12467, 12468, 12469, 12470, 12472, 12473, 12475, 12478, 12481, 12486, 12487, 12488, 12489, 12492, 12497, 12499, 12500, 12501, 12502, 12503, 12504, 12505, 12508, 12512, 12513, 12514, 12515, 12518, 12519, 12530, 12535, 12536, 12537, 12538, 12539, 12540, 12546, 12547, 12548, 12549, 12551, 12552, 12554, 12555, 12556, 12560, 12561, 12562, 12563, 12565, 12567, 12568, 12570, 12572, 12577, 12580, 12583, 12585, 12586, 12588, 12589, 12591, 12594, 12597, 12603, 12605, 12606, 12608, 12609, 12610, 12611, 12616, 12619, 12620, 12622, 12623, 12626, 12628, 12629, 12631, 12633, 12634, 12638, 12639, 12640, 12641, 12644, 12648, 12649, 12651, 12654, 12663, 12664, 12668, 12670, 12671, 12673, 12674, 12676, 12679, 12681, 12683, 12684, 12685, 12687, 12688, 12689, 12691, 12692, 12693, 12695, 12696, 12699, 12701, 12702, 12705, 12706, 12707, 12708, 12713, 12714, 12715, 12719, 12721, 12723, 12726, 12728, 12731, 12732, 12733, 12735, 12738, 12739, 12740, 12741, 12742, 12743, 12752, 12753, 12754, 12755, 12757, 12758, 12761, 12762, 12763, 12764, 12765, 12766, 12771, 12772, 12773, 12775, 12777, 12790, 12794, 12797, 12800, 12801, 12802, 12807, 12808, 12810, 12812, 12813, 12817, 12818, 12820, 12822, 12823, 12824, 12826, 12827, 12828, 12834, 12835, 12836, 12837, 12838, 12839, 12843, 12844, 12848, 12849, 12850, 12852, 12853, 12861, 12866, 12869, 12870, 12873, 12875, 12878, 12882, 12883, 12884, 12887, 12891, 12895, 12898, 12899, 12900, 12901, 12902, 12903, 12904, 12905, 12906, 12908, 12910, 12912, 12913, 12916, 12920, 12921, 12923, 12928, 12929, 12932, 12933, 12934, 12935, 12938, 12939, 12940, 12942, 12945, 12946, 12947, 12950, 12953, 12956, 12958, 12960, 12961, 12963, 12967, 12968, 12969, 12972, 12978, 12983, 12984, 12986, 12987, 12988, 12990, 12991, 12999, 13001, 13003, 13004, 13007, 13010, 13014, 13015, 13017, 13018, 13022, 13030, 13032, 13034, 13035, 13036, 13037, 13040, 13041, 13047, 13049, 13050, 13053, 13054, 13055, 13056, 13060, 13061, 13062, 13064, 13066, 13067, 13071, 13075, 13077, 13079, 13083, 13085, 13086, 13087, 13097, 13099, 13101, 13102, 13105, 13110, 13111, 13112, 13114, 13115, 13116, 13117, 13118, 13119, 13120, 13121, 13122, 13123, 13124, 13125, 13128, 13131, 13134, 13136, 13142, 13147, 13148, 13149, 13151, 13154, 13158, 13159, 13160, 13167, 13169, 13175, 13181, 13182, 13185, 13186, 13188, 13190, 13197, 13199, 13206, 13209, 13210, 13212, 13213, 13215, 13217, 13221, 13222, 13224, 13226, 13227, 13228, 13229, 13232, 13233, 13234, 13235, 13236, 13237, 13239, 13241, 13243, 13248, 13250, 13251, 13255, 13256, 13258, 13259, 13260, 13261, 13262, 13263, 13264, 13267, 13268, 13269, 13271, 13274, 13279, 13280, 13281, 13285, 13292, 13293, 13295, 13296, 13297, 13298, 13300, 13301, 13303, 13304, 13313, 13315, 13316, 13317, 13318, 13323, 13326, 13328, 13329, 13330, 13332, 13335, 13337, 13338, 13340, 13343, 13344, 13345, 13346, 13347, 13348, 13350, 13352, 13353, 13358, 13361, 13363, 13365, 13367, 13368, 13369, 13370, 13374, 13377, 13381, 13384, 13385, 13386, 13388, 13391, 13393, 13394, 13395, 13397, 13398, 13401, 13402, 13403, 13404, 13408, 13410, 13416, 13417, 13419, 13423, 13428, 13429, 13430, 13433, 13434, 13439, 13448, 13450, 13456, 13457, 13460, 13461, 13463, 13467, 13469, 13473, 13475, 13476, 13477, 13478, 13479, 13480, 13489, 13492, 13494, 13496, 13498, 13499, 13503, 13510, 13513, 13514, 13515, 13519, 13521, 13522, 13526, 13529, 13530, 13533, 13539, 13540, 13543, 13544, 13546, 13547, 13549, 13552, 13553, 13555, 13556, 13558, 13559, 13560, 13561, 13562, 13568, 13569, 13574, 13577, 13578, 13579, 13580, 13582, 13584, 13587, 13596, 13597, 13599, 13600, 13601, 13602, 13604, 13605, 13606, 13607, 13612, 13613, 13621, 13623, 13627, 13628, 13630, 13631, 13632, 13634, 13636, 13637, 13638, 13640, 13641, 13643, 13647, 13649, 13650, 13651, 13652, 13653, 13654, 13660, 13662, 13663, 13665, 13668, 13675, 13676, 13677, 13679, 13683, 13687, 13688, 13693, 13697, 13698, 13699, 13700, 13702, 13706, 13710, 13712, 13713, 13715, 13716, 13719, 13720, 13727, 13729, 13730, 13734, 13736, 13739, 13742, 13745, 13747, 13749, 13750, 13753, 13756, 13764, 13767, 13769, 13772, 13773, 13775, 13777, 13779, 13782, 13783, 13785, 13786, 13787, 13789, 13791, 13793, 13794, 13796, 13798, 13809, 13816, 13817, 13818, 13819, 13821, 13822, 13823, 13828, 13830, 13831, 13834, 13835, 13843, 13849, 13852, 13853, 13858, 13860, 13862, 13866, 13869, 13870, 13872, 13873, 13874, 13875, 13877, 13880, 13884, 13885, 13887, 13891, 13892, 13895, 13897, 13898, 13901, 13904, 13906, 13907, 13908, 13909, 13910, 13911, 13914, 13915, 13917, 13918, 13919, 13920, 13921, 13924, 13925, 13927, 13929, 13930, 13934, 13938, 13943, 13944, 13947, 13948, 13949, 13950, 13953, 13954, 13958, 13960, 13962, 13963, 13969, 13970, 13975, 13984, 13986, 13987, 13990, 13999, 14000, 14001, 14002, 14005, 14006, 14010, 14013, 14014, 14018, 14022, 14027, 14030, 14031, 14035, 14038, 14040, 14043, 14049, 14051, 14052, 14059, 14062, 14063, 14066, 14067, 14069, 14070, 14071, 14073, 14075, 14080, 14081, 14084, 14085, 14086, 14088, 14092, 14093, 14094, 14096, 14097, 14105, 14106, 14111, 14112, 14115, 14116, 14118, 14119, 14120, 14122, 14124, 14125, 14129, 14130, 14132, 14133, 14135, 14137, 14138, 14139, 14140, 14141, 14142, 14143, 14145, 14146, 14147.

Promoters expressing in a mixture of all root tissues at the V5 stage at 5 a.m. include SEQ IDs: 3, 4, 7, 11, 12, 13, 14, 15, 16, 17, 19, 27, 29, 33, 36, 37, 48, 51, 54, 57, 63, 64, 65, 73, 79, 81, 82, 88, 93, 94, 96, 98, 99, 102, 103, 104, 108, 110, 111, 112, 117, 123, 130, 131, 141, 143, 148, 152, 154, 162, 172, 174, 176, 179, 180, 181, 182, 183, 187, 191, 193, 194, 196, 197, 199, 202, 204, 205, 207, 210, 211, 212, 214, 217, 223, 232, 233, 235, 236, 237, 239, 240, 242, 244, 246, 249, 250, 251, 257, 259, 262, 264, 267, 269, 270, 271, 273, 280, 281, 286, 288, 289, 291, 293, 298, 299, 301, 302, 308, 309, 316, 319, 322, 323, 328, 329, 332, 334, 335, 338, 340, 346, 348, 349, 352, 353, 354, 355, 356, 357, 359, 360, 364, 365, 372, 373, 374, 376, 378, 379, 381, 383, 387, 388, 396, 401, 411, 412, 414, 423, 424, 428, 429, 432, 433, 434, 436, 441, 448, 450, 452, 454, 456, 461, 463, 468, 470, 471, 474, 478, 479, 483, 484, 485, 488, 489, 492, 496, 498, 507, 509, 510, 514, 516, 517, 522, 523, 525, 528, 532, 534, 535, 537, 538, 541, 543, 544, 546, 547, 548, 553, 554, 557, 561, 563, 578, 580, 582, 585, 591, 594, 595, 596, 598, 599, 601, 602, 605, 606, 607, 608, 613, 619, 620, 623, 630, 631, 633, 635, 636, 637, 638, 643, 650, 655, 662, 663, 666, 667, 668, 671, 673, 681, 683, 685, 687, 693, 694, 695, 701, 702, 705, 706, 707, 708, 716, 717, 718, 719, 721, 722, 724, 727, 732, 734, 735, 736, 740, 742, 744, 749, 753, 757, 758, 759, 760, 761, 762, 764, 765, 770, 771, 779, 782, 783, 784, 785, 786, 792, 793, 800, 804, 806, 809, 811, 812, 819, 820, 821, 822, 824, 825, 826, 827, 829, 830, 833, 836, 840, 841, 849, 855, 856, 857, 858, 860, 862, 863, 865, 870, 871, 875, 876, 877, 879, 882, 883, 887, 890, 892, 893, 895, 898, 899, 900, 903, 907, 908, 910, 911, 912, 915, 916, 919, 922, 924, 928, 932, 934, 936, 943, 944, 951, 953, 955, 957, 958, 960, 964, 971, 974, 975, 976, 978, 979, 980, 981, 982, 983, 984, 985, 987, 988, 991, 993, 994, 995, 996, 997, 999, 1002, 1005, 1006, 1007, 1008, 1009, 1010, 1011, 1012, 1013, 1014, 1016, 1019, 1024, 1026, 1032, 1035, 1038, 1041, 1042, 1043, 1046, 1047, 1049, 1051, 1052, 1054, 1055, 1056, 1057, 1059, 1065, 1069, 1070, 1073, 1076, 1077, 1080, 1085, 1086, 1087, 1088, 1089, 1092, 1095, 1100, 1101, 1103, 1104, 1110, 1112, 1114, 1115, 1116, 1117, 1119, 1120, 1121, 1125, 1127, 1130, 1132, 1136, 1137, 1140, 1143, 1144, 1146, 1148, 1153, 1154, 1160, 1161, 1162, 1164, 1165, 1167, 1168, 1170, 1171, 1175, 1176, 1178, 1183, 1189, 1190, 1191, 1196, 1198, 1200, 1201, 1203, 1204, 1213, 1214, 1217, 1218, 1223, 1224, 1225, 1228, 1230, 1231, 1232, 1233, 1235, 1236, 1240, 1248, 1249, 1251, 1254, 1258, 1263, 1269, 1277, 1281, 1285, 1286, 1290, 1291, 1292, 1293, 1296, 1298, 1301, 1303, 1306, 1307, 1309, 1310, 1311, 1316, 1317, 1320, 1322, 1323, 1327, 1331, 1334, 1337, 1343, 1345, 1349, 1354, 1355, 1360, 1361, 1364, 1366, 1367, 1368, 1371, 1375, 1376, 1377, 1380, 1381, 1388, 1389, 1391, 1392, 1393, 1396, 1398, 1399, 1400, 1403, 1404, 1406, 1416, 1420, 1421, 1422, 1423, 1426, 1431, 1432, 1433, 1438, 1439, 1441, 1442, 1447, 1448, 1451, 1453, 1458, 1459, 1461, 1462, 1466, 1467, 1468, 1472, 1474, 1475, 1483, 1484, 1485, 1488, 1490, 1493, 1498, 1499, 1501, 1503, 1504, 1508, 1510, 1511, 1514, 1517, 1518, 1519, 1525, 1526, 1527, 1528, 1530, 1539, 1543, 1545, 1546, 1547, 1548, 1549, 1550, 1551, 1554, 1555, 1556, 1560, 1561, 1563, 1564, 1567, 1570, 1575, 1576, 1578, 1579, 1582, 1584, 1586, 1590, 1591, 1596, 1597, 1598, 1599, 1600, 1601, 1602, 1604, 1605, 1608, 1609, 1610, 1612, 1614, 1615, 1616, 1617, 1622, 1623, 1625, 1632, 1634, 1635, 1637, 1638, 1639, 1642, 1643, 1650, 1654, 1658, 1659, 1662, 1663, 1668, 1669, 1671, 1673, 1675, 1676, 1678, 1681, 1682, 1684, 1685, 1687, 1689, 1690, 1691, 1697, 1698, 1699, 1703, 1705, 1706, 1707, 1708, 1710, 1712, 1716, 1717, 1718, 1720, 1723, 1725, 1729, 1731, 1732, 1735, 1736, 1739, 1743, 1750, 1755, 1759, 1761, 1764, 1769, 1770, 1773, 1776, 1778, 1785, 1786, 1791, 1792, 1793, 1796, 1798, 1807, 1809, 1811, 1813, 1826, 1828, 1830, 1832, 1834, 1836, 1837, 1838, 1839, 1840, 1845, 1848, 1852, 1854, 1855, 1856, 1859, 1861, 1863, 1866, 1867, 1869, 1872, 1876, 1879, 1882, 1886, 1888, 1891, 1897, 1898, 1899, 1900, 1901, 1902, 1905, 1906, 1910, 1911, 1915, 1916, 1918, 1920, 1921, 1922, 1923, 1924, 1928, 1930, 1931, 1933, 1934, 1936, 1939, 1940, 1945, 1949, 1950, 1951, 1952, 1953, 1954, 1958, 1968, 1970, 1971, 1972, 1973, 1976, 1977, 1990, 1991, 1992, 1993, 1994, 1995, 1996, 1999, 2000, 2001, 2003, 2007, 2010, 2012, 2013, 2014, 2015, 2016, 2017, 2019, 2020, 2021, 2027, 2031, 2032, 2037, 2040, 2041, 2043, 2045, 2048, 2058, 2060, 2062, 2064, 2066, 2072, 2074, 2077, 2078, 2085, 2088, 2089, 2091, 2093, 2094, 2097, 2103, 2104, 2106, 2107, 2111, 2112, 2122, 2123, 2125, 2128, 2132, 2133, 2137, 2138, 2139, 2140, 2142, 2143, 2144, 2146, 2147, 2150, 2151, 2156, 2157, 2161, 2162, 2164, 2166, 2167, 2168, 2170, 2173, 2175, 2177, 2179, 2185, 2188, 2189, 2190, 2193, 2196, 2200, 2202, 2203, 2205, 2206, 2210, 2213, 2215, 2216, 2218, 2221, 2222, 2223, 2225, 2226, 2240, 2241, 2242, 2243, 2244, 2253, 2257, 2260, 2263, 2267, 2271, 2273, 2274, 2276, 2278, 2282, 2283, 2284, 2289, 2290, 2291, 2296, 2297, 2298, 2300, 2303, 2304, 2308, 2309, 2310, 2314, 2322, 2323, 2328, 2329, 2331, 2333, 2337, 2338, 2339, 2342, 2343, 2345, 2348, 2352, 2353, 2358, 2363, 2366, 2369, 2371, 2372, 2375, 2379, 2380, 2381, 2382, 2383, 2384, 2395, 2401, 2402, 2403, 2405, 2410, 2412, 2413, 2414, 2418, 2419, 2420, 2423, 2426, 2430, 2433, 2435, 2437, 2439, 2440, 2441, 2442, 2443, 2445, 2446, 2449, 2451, 2452, 2453, 2454, 2457, 2458, 2465, 2469, 2470, 2471, 2472, 2474, 2476, 2477, 2479, 2480, 2481, 2485, 2487, 2489, 2490, 2492, 2494, 2495, 2496, 2498, 2500, 2504, 2505, 2506, 2507, 2509, 2513, 2514, 2515, 2516, 2517, 2519, 2522, 2525, 2528, 2529, 2531, 2532, 2533, 2536, 2537, 2540, 2541, 2544, 2545, 2546, 2549, 2551, 2552, 2555, 2556, 2557, 2559, 2561, 2567, 2568, 2570, 2571, 2573, 2578, 2579, 2581, 2583, 2589, 2590, 2599, 2600, 2601, 2605, 2609, 2611, 2613, 2614, 2616, 2617, 2618, 2620, 2625, 2626, 2627, 2632, 2634, 2635, 2636, 2639, 2644, 2645, 2648, 2652, 2654, 2655, 2658, 2660, 2661, 2662, 2663, 2671, 2672, 2674, 2678, 2679, 2684, 2685, 2687, 2689, 2690, 2691, 2692, 2694, 2696, 2700, 2702, 2704, 2711, 2715, 2719, 2720, 2722, 2723, 2725, 2727, 2728, 2729, 2730, 2731, 2735, 2738, 2739, 2746, 2747, 2749, 2752, 2755, 2756, 2757, 2763, 2764, 2765, 2769, 2770, 2775, 2776, 2779, 2784, 2785, 2787, 2789, 2794, 2798, 2800, 2802, 2805, 2808, 2812, 2814, 2819, 2823, 2824, 2826, 2827, 2828, 2829, 2831, 2832, 2833, 2834, 2837, 2838, 2840, 2845, 2850, 2859, 2860, 2861, 2862, 2864, 2865, 2869, 2871, 2876, 2878, 2881, 2888, 2889, 2890, 2892, 2893, 2894, 2895, 2896, 2898, 2902, 2903, 2906, 2909, 2914, 2915, 2916, 2917, 2918, 2919, 2922, 2923, 2926, 2930, 2931, 2932, 2933, 2934, 2935, 2942, 2943, 2944, 2946, 2947, 2948, 2955, 2959, 2962, 2963, 2964, 2966, 2968, 2976, 2979, 2982, 2992, 2994, 3002, 3003, 3005, 3007, 3008, 3009, 3013, 3015, 3017, 3018, 3020, 3023, 3024, 3027, 3029, 3031, 3039, 3042, 3043, 3044, 3045, 3046, 3047, 3048, 3049, 3050, 3051, 3052, 3053, 3055, 3058, 3059, 3064, 3068, 3070, 3072, 3075, 3076, 3077, 3078, 3083, 3085, 3087, 3090, 3095, 3096, 3100, 3101, 3112, 3115, 3118, 3119, 3120, 3121, 3122, 3123, 3126, 3127, 3128, 3129, 3138, 3139, 3143, 3145, 3153, 3154, 3156, 3167, 3169, 3170, 3171, 3172, 3177, 3181, 3185, 3187, 3189, 3191, 3192, 3194, 3196, 3201, 3202, 3205, 3206, 3208, 3210, 3217, 3218, 3219, 3220, 3221, 3224, 3225, 3227, 3228, 3230, 3231, 3236, 3237, 3239, 3240, 3242, 3247, 3252, 3261, 3263, 3266, 3267, 3269, 3271, 3272, 3280, 3282, 3286, 3288, 3289, 3290, 3291, 3294, 3295, 3297, 3299, 3301, 3303, 3308, 3310, 3312, 3313, 3324, 3327, 3331, 3332, 3333, 3337, 3338, 3340, 3342, 3343, 3345, 3347, 3351, 3353, 3354, 3355, 3357, 3358, 3361, 3363, 3370, 3373, 3377, 3378, 3379, 3383, 3386, 3394, 3396, 3397, 3399, 3403, 3404, 3405, 3413, 3416, 3418, 3419, 3422, 3424, 3425, 3426, 3427, 3428, 3435, 3438, 3441, 3442, 3445, 3446, 3447, 3449, 3450, 3451, 3452, 3453, 3458, 3461, 3462, 3465, 3466, 3468, 3469, 3470, 3471, 3474, 3477, 3484, 3488, 3490, 3491, 3493, 3494, 3500, 3502, 3503, 3504, 3507, 3510, 3516, 3523, 3524, 3529, 3533, 3535, 3536, 3537, 3538, 3540, 3541, 3542, 3544, 3545, 3548, 3549, 3554, 3558, 3560, 3562, 3569, 3571, 3574, 3576, 3577, 3580, 3587, 3588, 3589, 3592, 3594, 3595, 3597, 3600, 3601, 3603, 3604, 3607, 3610, 3611, 3613, 3615, 3616, 3618, 3619, 3620, 3621, 3624, 3629, 3633, 3634, 3640, 3642, 3643, 3644, 3645, 3646, 3648, 3655, 3657, 3659, 3660, 3661, 3662, 3667, 3672, 3674, 3677, 3681, 3682, 3684, 3685, 3690, 3693, 3694, 3706, 3707, 3709, 3713, 3715, 3717, 3718, 3720, 3721, 3723, 3725, 3726, 3730, 3731, 3732, 3738, 3739, 3743, 3744, 3748, 3749, 3752, 3758, 3763, 3764, 3765, 3766, 3772, 3773, 3775, 3777, 3778, 3783, 3785, 3787, 3791, 3792, 3793, 3794, 3798, 3800, 3801, 3804, 3806, 3808, 3809, 3817, 3818, 3819, 3820, 3823, 3828, 3829, 3830, 3831, 3832, 3833, 3837, 3838, 3839, 3843, 3844, 3845, 3846, 3849, 3858, 3859, 3867, 3868, 3870, 3871, 3872, 3873, 3876, 3877, 3878, 3882, 3883, 3884, 3885, 3887, 3889, 3892, 3893, 3894, 3895, 3896, 3898, 3902, 3904, 3907, 3908, 3910, 3912, 3913, 3916, 3917, 3918, 3923, 3924, 3928, 3929, 3933, 3934, 3938, 3940, 3941, 3947, 3950, 3952, 3954, 3958, 3962, 3967, 3968, 3970, 3971, 3972, 3974, 3975, 3978, 3983, 3985, 3988, 3990, 3995, 3996, 3997, 4000, 4005, 4007, 4008, 4013, 4014, 4019, 4020, 4026, 4028, 4030, 4033, 4037, 4039, 4040, 4041, 4042, 4043, 4044, 4046, 4047, 4048, 4050, 4051, 4052, 4053, 4054, 4056, 4057, 4061, 4062, 4066, 4068, 4070, 4071, 4075, 4079, 4080, 4084, 4088, 4092, 4094, 4096, 4099, 4102, 4103, 4105, 4106, 4109, 4110, 4113, 4116, 4124, 4128, 4132, 4133, 4135, 4139, 4140, 4143, 4144, 4146, 4147, 4148, 4149, 4155, 4158, 4160, 4161, 4162, 4163, 4165, 4166, 4167, 4168, 4170, 4171, 4173, 4175, 4178, 4179, 4183, 4185, 4187, 4188, 4189, 4191, 4192, 4193, 4201, 4202, 4204, 4205, 4206, 4207, 4208, 4210, 4211, 4212, 4213, 4217, 4219, 4221, 4222, 4227, 4228, 4229, 4233, 4234, 4235, 4242, 4245, 4246, 4250, 4251, 4252, 4253, 4257, 4261, 4263, 4266, 4270, 4272, 4275, 4276, 4280, 4284, 4288, 4290, 4292, 4294, 4296, 4298, 4301, 4302, 4304, 4306, 4309, 4312, 4314, 4317, 4320, 4321, 4324, 4329, 4330, 4333, 4335, 4338, 4339, 4341, 4344, 4347, 4352, 4354, 4358, 4359, 4360, 4369, 4370, 4371, 4373, 4377, 4378, 4380, 4383, 4388, 4390, 4391, 4393, 4395, 4396, 4397, 4401, 4402, 4403, 4404, 4405, 4409, 4410, 4422, 4423, 4425, 4430, 4436, 4437, 4439, 4440, 4443, 4445, 4446, 4448, 4450, 4453, 4461, 4462, 4463, 4464, 4466, 4467, 4468, 4470, 4474, 4475, 4479, 4486, 4492, 4494, 4496, 4497, 4498, 4502, 4507, 4508, 4512, 4514, 4515, 4518, 4519, 4521, 4522, 4531, 4532, 4535, 4536, 4543, 4545, 4548, 4549, 4551, 4554, 4555, 4556, 4557, 4558, 4560, 4562, 4563, 4565, 4566, 4567, 4568, 4575, 4576, 4580, 4582, 4583, 4590, 4591, 4593, 4594, 4596, 4597, 4598, 4601, 4604, 4606, 4608, 4616, 4623, 4625, 4628, 4630, 4632, 4633, 4639, 4641, 4643, 4644, 4645, 4646, 4647, 4650, 4651, 4653, 4654, 4655, 4656, 4657, 4658, 4659, 4667, 4669, 4671, 4672, 4673, 4674, 4676, 4677, 4680, 4682, 4684, 4685, 4691, 4692, 4694, 4696, 4697, 4700, 4706, 4708, 4710, 4711, 4713, 4715, 4719, 4721, 4723, 4724, 4730, 4734, 4736, 4737, 4738, 4739, 4740, 4741, 4745, 4746, 4749, 4750, 4753, 4755, 4756, 4761, 4762, 4766, 4769, 4770, 4771, 4779, 4780, 4784, 4787, 4788, 4789, 4790, 4791, 4794, 4795, 4801, 4802, 4804, 4805, 4806, 4807, 4809, 4813, 4816, 4817, 4818, 4822, 4828, 4829, 4830, 4831, 4834, 4838, 4841, 4842, 4845, 4855, 4856, 4857, 4859, 4861, 4862, 4863, 4864, 4868, 4869, 4874, 4875, 4876, 4880, 4881, 4887, 4889, 4891, 4896, 4900, 4902, 4904, 4905, 4909, 4910, 4913, 4914, 4918, 4921, 4922, 4924, 4925, 4928, 4935, 4936, 4941, 4942, 4943, 4944, 4950, 4954, 4958, 4959, 4960, 4966, 4967, 4969, 4971, 4972, 4974, 4975, 4977, 4984, 4985, 4987, 4988, 4989, 4990, 4993, 4994, 4996, 5000, 5005, 5011, 5015, 5016, 5021, 5022, 5024, 5026, 5029, 5030, 5032, 5034, 5036, 5038, 5039, 5040, 5042, 5044, 5045, 5046, 5051, 5052, 5054, 5057, 5060, 5067, 5072, 5074, 5075, 5078, 5079, 5082, 5084, 5088, 5089, 5090, 5091, 5094, 5100, 5101, 5102, 5109, 5111, 5113, 5114, 5116, 5120, 5122, 5123, 5131, 5132, 5140, 5147, 5148, 5150, 5151, 5160, 5164, 5165, 5168, 5170, 5174, 5180, 5181, 5184, 5185, 5187, 5188, 5189, 5190, 5191, 5192, 5193, 5196, 5198, 5200, 5202, 5203, 5206, 5212, 5213, 5216, 5217, 5218, 5219, 5225, 5226, 5228, 5229, 5234, 5240, 5241, 5243, 5249, 5253, 5254, 5256, 5257, 5258, 5260, 5261, 5263, 5264, 5267, 5268, 5269, 5273, 5274, 5275, 5276, 5280, 5281, 5283, 5286, 5287, 5291, 5293, 5297, 5298, 5299, 5300, 5301, 5308, 5311, 5314, 5315, 5317, 5319, 5321, 5324, 5329, 5330, 5334, 5338, 5339, 5342, 5343, 5345, 5346, 5348, 5350, 5351, 5352, 5359, 5361, 5366, 5367, 5371, 5383, 5386, 5388, 5389, 5393, 5395, 5396, 5397, 5402, 5405, 5409, 5411, 5413, 5414, 5417, 5418, 5422, 5426, 5427, 5428, 5431, 5433, 5434, 5437, 5438, 5446, 5448, 5449, 5452, 5453, 5456, 5458, 5459, 5461, 5463, 5464, 5471, 5472, 5475, 5483, 5484, 5485, 5487, 5488, 5491, 5493, 5495, 5496, 5505, 5506, 5508, 5510, 5513, 5515, 5517, 5518, 5519, 5524, 5526, 5529, 5530, 5532, 5534, 5535, 5541, 5543, 5545, 5554, 5555, 5562, 5563, 5564, 5566, 5568, 5569, 5572, 5575, 5579, 5580, 5581, 5582, 5583, 5584, 5585, 5586, 5589, 5591, 5593, 5594, 5597, 5608, 5612, 5613, 5614, 5615, 5616, 5618, 5620, 5623, 5627, 5632, 5633, 5635, 5638, 5640, 5643, 5647, 5648, 5651, 5652, 5653, 5656, 5657, 5659, 5660, 5662, 5663, 5664, 5669, 5680, 5689, 5690, 5694, 5695, 5697, 5698, 5702, 5706, 5709, 5711, 5714, 5718, 5719, 5721, 5722, 5723, 5729, 5730, 5731, 5732, 5734, 5735, 5736, 5742, 5744, 5751, 5754, 5757, 5768, 5770, 5773, 5775, 5780, 5784, 5785, 5788, 5791, 5792, 5794, 5803, 5805, 5808, 5809, 5810, 5814, 5815, 5820, 5823, 5826, 5832, 5834, 5835, 5836, 5837, 5842, 5844, 5853, 5854, 5856, 5859, 5864, 5866, 5867, 5868, 5869, 5871, 5872, 5876, 5877, 5878, 5879, 5881, 5882, 5883, 5884, 5888, 5889, 5892, 5893, 5900, 5901, 5902, 5906, 5907, 5910, 5912, 5918, 5919, 5921, 5922, 5923, 5925, 5927, 5928, 5930, 5931, 5932, 5933, 5934, 5938, 5939, 5940, 5941, 5942, 5944, 5946, 5948, 5950, 5951, 5954, 5955, 5956, 5957, 5959, 5961, 5967, 5968, 5971, 5978, 5979, 5980, 5985, 5986, 5988, 5990, 5991, 5994, 5996, 5997, 6000, 6002, 6004, 6006, 6007, 6010, 6012, 6013, 6016, 6017, 6021, 6025, 6026, 6031, 6038, 6040, 6041, 6042, 6043, 6044, 6047, 6048, 6051, 6053, 6054, 6058, 6059, 6062, 6063, 6068, 6069, 6070, 6072, 6073, 6074, 6075, 6077, 6080, 6084, 6085, 6088, 6089, 6090, 6092, 6093, 6094, 6095, 6098, 6100, 6108, 6109, 6110, 6112, 6113, 6116, 6118, 6119, 6120, 6122, 6125, 6129, 6130, 6131, 6132, 6133, 6136, 6137, 6140, 6143, 6145, 6146, 6147, 6149, 6150, 6151, 6153, 6155, 6156, 6160, 6163, 6164, 6165, 6168, 6181, 6182, 6183, 6184, 6186, 6188, 6189, 6191, 6193, 6196, 6197, 6198, 6200, 6203, 6205, 6207, 6209, 6212, 6220, 6221, 6223, 6224, 6226, 6227, 6228, 6230, 6231, 6234, 6237, 6238, 6240, 6243, 6246, 6247, 6249, 6250, 6251, 6255, 6257, 6258, 6259, 6260, 6264, 6265, 6270, 6271, 6272, 6273, 6275, 6278, 6279, 6280, 6281, 6282, 6286, 6288, 6291, 6292, 6294, 6295, 6296, 6297, 6299, 6300, 6302, 6309, 6310, 6311, 6312, 6315, 6316, 6317, 6319, 6321, 6322, 6323, 6325, 6326, 6328, 6333, 6338, 6343, 6344, 6346, 6351, 6352, 6353, 6354, 6358, 6360, 6362, 6363, 6364, 6367, 6370, 6373, 6375, 6378, 6379, 6381, 6383, 6393, 6394, 6395, 6396, 6397, 6399, 6403, 6405, 6407, 6413, 6414, 6415, 6419, 6420, 6422, 6426, 6429, 6431, 6434, 6436, 6437, 6440, 6441, 6442, 6452, 6454, 6459, 6464, 6466, 6467, 6469, 6470, 6471, 6474, 6476, 6480, 6482, 6484, 6488, 6492, 6493, 6494, 6495, 6497, 6499, 6500, 6501, 6502, 6504, 6505, 6510, 6513, 6514, 6515, 6516, 6517, 6519, 6524, 6525, 6526, 6530, 6533, 6534, 6535, 6537, 6543, 6544, 6547, 6548, 6549, 6551, 6553, 6554, 6555, 6556, 6557, 6558, 6560, 6561, 6563, 6564, 6567, 6569, 6572, 6574, 6576, 6577, 6579, 6581, 6582, 6584, 6587, 6588, 6589, 6592, 6595, 6596, 6598, 6599, 6600, 6607, 6609, 6611, 6617, 6620, 6621, 6624, 6625, 6626, 6627, 6628, 6629, 6630, 6634, 6635, 6637, 6638, 6639, 6643, 6644, 6646, 6647, 6649, 6650, 6652, 6655, 6662, 6666, 6671, 6672, 6673, 6677, 6681, 6693, 6695, 6696, 6702, 6703, 6704, 6705, 6706, 6711, 6714, 6716, 6718, 6720, 6724, 6725, 6729, 6730, 6731, 6734, 6736, 6737, 6739, 6742, 6746, 6747, 6757, 6759, 6761, 6764, 6766, 6778, 6779, 6780, 6781, 6782, 6786, 6788, 6792, 6793, 6794, 6795, 6797, 6799, 6803, 6804, 6805, 6807, 6810, 6811, 6812, 6813, 6816, 6819, 6820, 6821, 6824, 6826, 6827, 6828, 6830, 6831, 6834, 6836, 6839, 6840, 6841, 6842, 6843, 6845, 6851, 6859, 6860, 6863, 6869, 6872, 6874, 6875, 6876, 6877, 6878, 6879, 6880, 6884, 6886, 6887, 6888, 6890, 6891, 6894, 6902, 6903, 6904, 6906, 6907, 6913, 6914, 6915, 6917, 6919, 6920, 6921, 6922, 6923, 6924, 6930, 6933, 6936, 6941, 6943, 6944, 6946, 6948, 6950, 6951, 6952, 6954, 6959, 6960, 6963, 6966, 6967, 6969, 6970, 6971, 6979, 6980, 6984, 6985, 6987, 6988, 6990, 6991, 6993, 6994, 6995, 6999, 7000, 7002, 7003, 7006, 7009, 7011, 7012, 7013, 7015, 7016, 7022, 7031, 7032, 7038, 7039, 7040, 7042, 7043, 7045, 7046, 7049, 7050, 7052, 7053, 7056, 7057, 7064, 7067, 7077, 7079, 7083, 7084, 7085, 7086, 7094, 7097, 7106, 7107, 7108, 7112, 7113, 7116, 7117, 7118, 7124, 7126, 7128, 7129, 7130, 7132, 7135, 7136, 7138, 7139, 7140, 7142, 7144, 7146, 7151, 7155, 7163, 7164, 7165, 7166, 7167, 7169, 7172, 7176, 7177, 7182, 7183, 7184, 7187, 7188, 7189, 7194, 7196, 7197, 7198, 7201, 7202, 7203, 7206, 7207, 7208, 7209, 7211, 7216, 7217, 7219, 7224, 7227, 7228, 7230, 7231, 7232, 7233, 7234, 7236, 7239, 7240, 7241, 7244, 7245, 7248, 7249, 7250, 7255, 7257, 7258, 7259, 7262, 7264, 7267, 7268, 7274, 7277, 7281, 7282, 7287, 7288, 7290, 7291, 7292, 7293, 7298, 7299, 7300, 7301, 7303, 7304, 7305, 7306, 7307, 7311, 7313, 7315, 7317, 7328, 7330, 7331, 7334, 7336, 7343, 7344, 7348, 7350, 7351, 7354, 7355, 7356, 7357, 7358, 7361, 7363, 7365, 7371, 7373, 7377, 7380, 7382, 7383, 7386, 7388, 7389, 7392, 7395, 7396, 7398, 7399, 7400, 7406, 7409, 7410, 7411, 7417, 7418, 7425, 7428, 7430, 7433, 7434, 7435, 7436, 7438, 7441, 7443, 7444, 7446, 7447, 7448, 7452, 7454, 7458, 7459, 7466, 7470, 7486, 7488, 7490, 7492, 7493, 7498, 7504, 7505, 7506, 7508, 7512, 7515, 7517, 7518, 7523, 7525, 7528, 7533, 7537, 7538, 7542, 7546, 7547, 7548, 7554, 7556, 7561, 7568, 7574, 7578, 7579, 7580, 7585, 7586, 7587, 7588, 7589, 7590, 7594, 7595, 7599, 7605, 7619, 7620, 7621, 7623, 7624, 7625, 7632, 7633, 7638, 7639, 7640, 7642, 7643, 7647, 7652, 7658, 7661, 7663, 7664, 7665, 7671, 7674, 7676, 7677, 7678, 7679, 7680, 7682, 7686, 7687, 7689, 7695, 7699, 7700, 7703, 7704, 7708, 7712, 7713, 7716, 7719, 7724, 7725, 7726, 7729, 7730, 7733, 7734, 7736, 7737, 7738, 7740, 7743, 7744, 7745, 7747, 7751, 7753, 7755, 7761, 7762, 7763, 7764, 7768, 7769, 7770, 7772, 7774, 7775, 7779, 7780, 7781, 7785, 7786, 7788, 7791, 7793, 7796, 7798, 7800, 7803, 7804, 7806, 7807, 7812, 7815, 7818, 7819, 7820, 7823, 7824, 7825, 7832, 7833, 7834, 7838, 7841, 7844, 7845, 7847, 7848, 7852, 7854, 7856, 7859, 7860, 7862, 7863, 7865, 7873, 7875, 7878, 7880, 7888, 7890, 7896, 7900, 7908, 7909, 7910, 7911, 7917, 7918, 7923, 7925, 7927, 7928, 7933, 7934, 7935, 7936, 7938, 7942, 7944, 7945, 7947, 7948, 7949, 7950, 7955, 7956, 7964, 7972, 7974, 7976, 7977, 7978, 7980, 7984, 7986, 7988, 7993, 7998, 8002, 8004, 8005, 8006, 8007, 8012, 8021, 8023, 8026, 8030, 8038, 8039, 8042, 8043, 8044, 8047, 8048, 8052, 8053, 8056, 8058, 8059, 8062, 8063, 8067, 8068, 8071, 8072, 8073, 8076, 8077, 8078, 8079, 8080, 8082, 8083, 8084, 8087, 8088, 8090, 8091, 8093, 8095, 8100, 8102, 8103, 8105, 8106, 8112, 8114, 8116, 8118, 8120, 8123, 8124, 8125, 8126, 8136, 8137, 8145, 8146, 8147, 8150, 8151, 8156, 8159, 8163, 8165, 8168, 8170, 8178, 8179, 8181, 8182, 8185, 8189, 8192, 8193, 8199, 8202, 8204, 8207, 8208, 8210, 8211, 8213, 8216, 8219, 8220, 8222, 8223, 8224, 8225, 8227, 8230, 8234, 8235, 8237, 8239, 8240, 8241, 8242, 8245, 8248, 8250, 8252, 8253, 8265, 8266, 8268, 8269, 8270, 8272, 8282, 8289, 8291, 8293, 8294, 8300, 8301, 8304, 8306, 8310, 8311, 8312, 8318, 8319, 8320, 8321, 8324, 8329, 8339, 8340, 8347, 8349, 8350, 8351, 8352, 8353, 8355, 8367, 8368, 8369, 8372, 8373, 8376, 8379, 8385, 8387, 8389, 8392, 8393, 8395, 8398, 8401, 8402, 8403, 8404, 8405, 8410, 8411, 8413, 8414, 8416, 8417, 8418, 8436, 8438, 8439, 8441, 8442, 8444, 8447, 8448, 8449, 8450, 8451, 8456, 8457, 8458, 8459, 8465, 8466, 8469, 8472, 8473, 8474, 8476, 8477, 8480, 8481, 8482, 8485, 8486, 8490, 8498, 8501, 8502, 8505, 8507, 8511, 8513, 8515, 8516, 8517, 8520, 8521, 8523, 8524, 8525, 8527, 8528, 8531, 8532, 8533, 8535, 8539, 8541, 8542, 8544, 8549, 8550, 8553, 8554, 8558, 8561, 8562, 8565, 8566, 8568, 8575, 8576, 8579, 8581, 8582, 8589, 8590, 8592, 8593, 8594, 8596, 8597, 8599, 8600, 8601, 8602, 8603, 8604, 8605, 8611, 8612, 8614, 8617, 8624, 8628, 8631, 8634, 8637, 8638, 8639, 8640, 8641, 8642, 8644, 8647, 8648, 8652, 8654, 8657, 8658, 8659, 8663, 8665, 8669, 8670, 8672, 8676, 8677, 8681, 8685, 8690, 8693, 8694, 8699, 8700, 8703, 8704, 8706, 8708, 8709, 8713, 8716, 8717, 8720, 8729, 8731, 8732, 8734, 8735, 8736, 8740, 8741, 8742, 8744, 8745, 8746, 8748, 8751, 8752, 8753, 8757, 8767, 8768, 8770, 8771, 8772, 8773, 8774, 8775, 8776, 8777, 8779, 8783, 8784, 8785, 8789, 8792, 8795, 8796, 8797, 8805, 8808, 8810, 8817, 8818, 8822, 8824, 8829, 8831, 8832, 8833, 8835, 8838, 8841, 8843, 8846, 8853, 8854, 8859, 8861, 8865, 8866, 8867, 8869, 8876, 8878, 8880, 8881, 8883, 8886, 8888, 8889, 8891, 8892, 8896, 8897, 8899, 8905, 8907, 8908, 8909, 8910, 8911, 8914, 8916, 8917, 8926, 8928, 8929, 8930, 8935, 8938, 8941, 8942, 8945, 8946, 8949, 8951, 8957, 8960, 8961, 8964, 8965, 8967, 8968, 8969, 8971, 8972, 8974, 8976, 8977, 8979, 8980, 8981, 8985, 8986, 8991, 8992, 8996, 8998, 8999, 9001, 9002, 9003, 9006, 9009, 9012, 9020, 9021, 9022, 9029, 9030, 9033, 9037, 9042, 9044, 9052, 9056, 9057, 9058, 9059, 9060, 9066, 9069, 9071, 9072, 9073, 9074, 9076, 9084, 9088, 9091, 9092, 9095, 9096, 9097, 9103, 9104, 9105, 9108, 9110, 9112, 9114, 9116, 9118, 9125, 9128, 9129, 9131, 9133, 9134, 9139, 9140, 9141, 9142, 9146, 9149, 9151, 9152, 9154, 9155, 9156, 9164, 9173, 9174, 9175, 9177, 9183, 9184, 9185, 9187, 9188, 9190, 9191, 9194, 9195, 9206, 9207, 9210, 9211, 9213, 9215, 9216, 9218, 9221, 9226, 9229, 9233, 9234, 9237, 9241, 9242, 9243, 9244, 9247, 9248, 9249, 9252, 9253, 9254, 9257, 9259, 9262, 9265, 9267, 9269, 9270, 9273, 9275, 9276, 9278, 9282, 9284, 9287, 9288, 9290, 9291, 9292, 9295, 9299, 9300, 9302, 9304, 9308, 9311, 9313, 9316, 9320, 9321, 9323, 9325, 9326, 9327, 9328, 9329, 9330, 9332, 9336, 9337, 9338, 9339, 9340, 9341, 9345, 9346, 9347, 9348, 9349, 9353, 9354, 9355, 9357, 9359, 9366, 9367, 9375, 9376, 9378, 9382, 9383, 9388, 9391, 9392, 9394, 9396, 9398, 9400, 9402, 9403, 9404, 9406, 9407, 9412, 9413, 9414, 9415, 9422, 9423, 9432, 9433, 9434, 9439, 9440, 9443, 9444, 9451, 9452, 9453, 9456, 9460, 9468, 9471, 9472, 9473, 9476, 9478, 9481, 9483, 9488, 9490, 9497, 9501, 9502, 9503, 9504, 9505, 9509, 9513, 9514, 9515, 9517, 9518, 9519, 9520, 9525, 9531, 9533, 9534, 9536, 9540, 9543, 9546, 9548, 9549, 9553, 9555, 9557, 9563, 9564, 9565, 9568, 9571, 9575, 9577, 9582, 9583, 9587, 9589, 9590, 9591, 9597, 9602, 9606, 9607, 9609, 9610, 9613, 9615, 9617, 9618, 9620, 9623, 9626, 9627, 9628, 9629, 9632, 9635, 9637, 9640, 9641, 9642, 9644, 9645, 9646, 9649, 9653, 9655, 9656, 9657, 9658, 9660, 9663, 9666, 9670, 9675, 9679, 9681, 9682, 9686, 9687, 9692, 9693, 9698, 9701, 9718, 9723, 9725, 9726, 9730, 9731, 9732, 9733, 9734, 9737, 9746, 9750, 9751, 9753, 9754, 9755, 9756, 9763, 9764, 9767, 9768, 9770, 9774, 9776, 9777, 9780, 9781, 9782, 9784, 9786, 9792, 9794, 9796, 9799, 9801, 9802, 9804, 9806, 9808, 9812, 9813, 9816, 9819, 9820, 9824, 9825, 9827, 9830, 9833, 9836, 9845, 9846, 9847, 9849, 9850, 9854, 9861, 9864, 9866, 9869, 9871, 9873, 9882, 9886, 9887, 9892, 9893, 9897, 9900, 9901, 9906, 9907, 9908, 9909, 9910, 9911, 9912, 9918, 9923, 9924, 9928, 9934, 9935, 9938, 9940, 9946, 9947, 9949, 9950, 9953, 9955, 9957, 9958, 9960, 9962, 9963, 9964, 9967, 9968, 9971, 9972, 9974, 9975, 9979, 9980, 9982, 9984, 9987, 9988, 9990, 9991, 9997, 9998, 10000, 10008, 10009, 10010, 10013, 10015, 10017, 10018, 10019, 10021, 10022, 10026, 10027, 10031, 10032, 10033, 10034, 10035, 10037, 10038, 10042, 10043, 10045, 10047, 10048, 10050, 10051, 10052, 10053, 10054, 10056, 10058, 10059, 10060, 10062, 10063, 10064, 10066, 10068, 10072, 10073, 10075, 10078, 10080, 10081, 10082, 10087, 10089, 10090, 10091, 10092, 10093, 10095, 10097, 10101, 10103, 10105, 10106, 10107, 10108, 10109, 10110, 10112, 10114, 10115, 10116, 10118, 10122, 10128, 10131, 10132, 10138, 10143, 10146, 10147, 10149, 10151, 10152, 10158, 10163, 10165, 10166, 10168, 10170, 10174, 10176, 10178, 10180, 10181, 10182, 10192, 10193, 10194, 10195, 10197, 10199, 10200, 10201, 10203, 10206, 10209, 10213, 10214, 10218, 10219, 10220, 10222, 10223, 10224, 10225, 10228, 10229, 10231, 10233, 10235, 10236, 10237, 10239, 10247, 10252, 10254, 10255, 10257, 10262, 10268, 10275, 10278, 10284, 10291, 10292, 10293, 10295, 10300, 10302, 10306, 10307, 10311, 10318, 10319, 10321, 10322, 10323, 10325, 10326, 10328, 10331, 10334, 10335, 10336, 10338, 10341, 10342, 10343, 10352, 10353, 10354, 10356, 10357, 10359, 10360, 10362, 10364, 10368, 10371, 10373, 10375, 10378, 10380, 10381, 10384, 10385, 10388, 10395, 10397, 10398, 10399, 10401, 10405, 10410, 10413, 10414, 10416, 10421, 10423, 10425, 10428, 10429, 10430, 10435, 10437, 10438, 10440, 10446, 10447, 10448, 10449, 10450, 10451, 10452, 10453, 10456, 10463, 10464, 10465, 10466, 10468, 10469, 10470, 10474, 10482, 10487, 10488, 10490, 10492, 10494, 10496, 10504, 10506, 10508, 10513, 10514, 10518, 10525, 10527, 10528, 10530, 10531, 10532, 10533, 10535, 10536, 10537, 10541, 10542, 10543, 10544, 10547, 10548, 10549, 10550, 10551, 10555, 10556, 10558, 10560, 10561, 10563, 10565, 10567, 10569, 10573, 10577, 10580, 10581, 10582, 10583, 10585, 10590, 10593, 10595, 10596, 10597, 10599, 10601, 10602, 10603, 10604, 10606, 10610, 10611, 10612, 10613, 10614, 10615, 10616, 10617, 10618, 10619, 10621, 10622, 10623, 10625, 10626, 10628, 10629, 10630, 10631, 10633, 10634, 10636, 10637, 10638, 10639, 10640, 10642, 10645, 10646, 10649, 10650, 10655, 10657, 10659, 10663, 10665, 10668, 10670, 10673, 10674, 10676, 10677, 10678, 10681, 10682, 10683, 10684, 10685, 10686, 10689, 10697, 10699, 10700, 10702, 10703, 10705, 10707, 10708, 10711, 10712, 10715, 10716, 10722, 10725, 10726, 10732, 10734, 10735, 10738, 10739, 10740, 10741, 10744, 10745, 10747, 10748, 10749, 10753, 10754, 10761, 10762, 10763, 10766, 10770, 10771, 10775, 10777, 10778, 10779, 10782, 10784, 10785, 10787, 10788, 10790, 10791, 10792, 10795, 10796, 10800, 10803, 10804, 10805, 10809, 10810, 10811, 10812, 10813, 10815, 10818, 10819, 10820, 10821, 10823, 10824, 10825, 10826, 10831, 10833, 10836, 10838, 10839, 10840, 10843, 10846, 10850, 10852, 10853, 10854, 10857, 10858, 10860, 10862, 10863, 10866, 10867, 10871, 10874, 10877, 10880, 10881, 10887, 10892, 10896, 10897, 10898, 10899, 10902, 10903, 10911, 10912, 10917, 10920, 10926, 10927, 10928, 10930, 10933, 10934, 10935, 10936, 10937, 10938, 10939, 10940, 10941, 10944, 10945, 10947, 10948, 10954, 10957, 10960, 10962, 10963, 10964, 10965, 10967, 10968, 10972, 10975, 10976, 10977, 10980, 10988, 10993, 10995, 10996, 10997, 10999, 11002, 11004, 11005, 11006, 11008, 11009, 11010, 11018, 11024, 11026, 11027, 11032, 11033, 11039, 11046, 11047, 11052, 11053, 11056, 11058, 11060, 11066, 11067, 11068, 11070, 11072, 11078, 11080, 11081, 11082, 11083, 11086, 11090, 11092, 11095, 11098, 11101, 11107, 11110, 11114, 11116, 11118, 11119, 11123, 11124, 11125, 11127, 11129, 11132, 11133, 11135, 11137, 11138, 11146, 11151, 11153, 11154, 11155, 11156, 11157, 11158, 11160, 11161, 11162, 11163, 11165, 11166, 11169, 11173, 11174, 11175, 11177, 11179, 11180, 11181, 11184, 11185, 11187, 11188, 11190, 11192, 11194, 11198, 11199, 11201, 11202, 11203, 11207, 11210, 11214, 11217, 11218, 11222, 11226, 11227, 11228, 11229, 11232, 11233, 11234, 11235, 11236, 11237, 11239, 11240, 11244, 11246, 11247, 11248, 11254, 11255, 11256, 11257, 11258, 11259, 11260, 11262, 11263, 11264, 11266, 11274, 11275, 11278, 11286, 11289, 11290, 11292, 11293, 11294, 11295, 11296, 11298, 11302, 11306, 11307, 11313, 11315, 11316, 11318, 11319, 11320, 11322, 11324, 11329, 11330, 11331, 11332, 11333, 11337, 11338, 11339, 11340, 11345, 11346, 11348, 11349, 11352, 11356, 11358, 11363, 11365, 11366, 11370, 11371, 11373, 11377, 11380, 11381, 11382, 11387, 11388, 11391, 11394, 11395, 11397, 11398, 11401, 11403, 11404, 11405, 11406, 11409, 11411, 11412, 11413, 11414, 11416, 11423, 11424, 11426, 11428, 11430, 11434, 11437, 11438, 11446, 11447, 11449, 11451, 11456, 11458, 11459, 11461, 11463, 11464, 11465, 11471, 11472, 11475, 11476, 11477, 11478, 11481, 11482, 11485, 11487, 11489, 11490, 11491, 11494, 11496, 11497, 11498, 11499, 11500, 11503, 11506, 11507, 11508, 11512, 11518, 11522, 11523, 11524, 11526, 11527, 11528, 11530, 11531, 11532, 11533, 11534, 11535, 11538, 11541, 11544, 11546, 11548, 11551, 11553, 11558, 11560, 11561, 11563, 11567, 11568, 11570, 11571, 11576, 11577, 11578, 11580, 11583, 11585, 11593, 11594, 11595, 11596, 11597, 11599, 11600, 11604, 11610, 11612, 11615, 11618, 11619, 11620, 11621, 11623, 11625, 11626, 11628, 11629, 11632, 11633, 11636, 11637, 11639, 11640, 11642, 11647, 11650, 11652, 11654, 11656, 11657, 11658, 11668, 11669, 11673, 11678, 11681, 11682, 11688, 11691, 11692, 11693, 11694, 11695, 11698, 11699, 11701, 11703, 11705, 11707, 11708, 11711, 11712, 11718, 11721, 11722, 11723, 11725, 11731, 11733, 11736, 11740, 11743, 11744, 11753, 11755, 11759, 11760, 11761, 11762, 11763, 11764, 11765, 11766, 11767, 11770, 11771, 11773, 11774, 11776, 11780, 11781, 11782, 11783, 11784, 11785, 11786, 11790, 11792, 11799, 11800, 11802, 11804, 11807, 11809, 11810, 11811, 11812, 11813, 11814, 11816, 11818, 11819, 11821, 11826, 11828, 11830, 11837, 11841, 11845, 11846, 11848, 11849, 11850, 11851, 11853, 11856, 11858, 11863, 11868, 11870, 11872, 11876, 11877, 11878, 11881, 11890, 11891, 11894, 11898, 11899, 11904, 11909, 11912, 11913, 11916, 11917, 11919, 11920, 11921, 11922, 11923, 11926, 11927, 11928, 11929, 11930, 11934, 11935, 11939, 11940, 11941, 11943, 11945, 11946, 11947, 11948, 11949, 11953, 11958, 11959, 11960, 11961, 11962, 11963, 11965, 11966, 11968, 11975, 11976, 11977, 11978, 11979, 11980, 11983, 11987, 11988, 11993, 11994, 11995, 11996, 11997, 11998, 11999, 12002, 12004, 12008, 12017, 12018, 12019, 12020, 12021, 12023, 12024, 12025, 12032, 12042, 12043, 12044, 12050, 12059, 12061, 12063, 12068, 12076, 12078, 12079, 12080, 12081, 12083, 12085, 12086, 12087, 12089, 12091, 12092, 12093, 12097, 12098, 12102, 12104, 12106, 12109, 12110, 12112, 12115, 12118, 12120, 12122, 12127, 12128, 12129, 12130, 12131, 12134, 12135, 12137, 12138, 12139, 12141, 12143, 12144, 12145, 12146, 12147, 12148, 12149, 12150, 12151, 12153, 12161, 12165, 12166, 12167, 12170, 12171, 12174, 12175, 12176, 12179, 12181, 12197, 12200, 12201, 12202, 12204, 12208, 12214, 12215, 12217, 12218, 12221, 12223, 12227, 12229, 12234, 12237, 12240, 12241, 12243, 12245, 12249, 12250, 12252, 12255, 12256, 12259, 12260, 12268, 12269, 12271, 12274, 12278, 12280, 12283, 12285, 12286, 12287, 12291, 12293, 12295, 12304, 12310, 12311, 12312, 12313, 12314, 12315, 12317, 12319, 12321, 12323, 12325, 12328, 12331, 12333, 12334, 12339, 12342, 12345, 12347, 12350, 12354, 12356, 12358, 12359, 12364, 12366, 12367, 12368, 12374, 12375, 12376, 12379, 12380, 12381, 12385, 12390, 12397, 12399, 12400, 12401, 12403, 12406, 12410, 12411, 12414, 12415, 12416, 12419, 12420, 12423, 12424, 12426, 12427, 12435, 12437, 12439, 12440, 12444, 12450, 12451, 12455, 12456, 12457, 12459, 12462, 12465, 12467, 12468, 12469, 12470, 12472, 12473, 12475, 12478, 12481, 12486, 12487, 12488, 12489, 12492, 12495, 12497, 12499, 12500, 12501, 12502, 12503, 12504, 12505, 12508, 12512, 12513, 12514, 12515, 12518, 12519, 12523, 12527, 12530, 12535, 12536, 12537, 12538, 12539, 12540, 12546, 12547, 12548, 12549, 12551, 12552, 12553, 12554, 12555, 12556, 12557, 12560, 12561, 12562, 12563, 12565, 12567, 12568, 12570, 12572, 12577, 12583, 12585, 12586, 12588, 12589, 12591, 12594, 12597, 12602, 12603, 12605, 12606, 12608, 12609, 12610, 12611, 12619, 12622, 12623, 12626, 12628, 12629, 12631, 12633, 12634, 12638, 12639, 12640, 12641, 12644, 12648, 12649, 12651, 12654, 12663, 12664, 12668, 12670, 12671, 12674, 12676, 12679, 12680, 12681, 12683, 12684, 12685, 12688, 12689, 12691, 12693, 12695, 12696, 12697, 12699, 12701, 12702, 12705, 12706, 12707, 12713, 12714, 12715, 12721, 12723, 12726, 12728, 12731, 12732, 12733, 12735, 12737, 12738, 12739, 12740, 12741, 12742, 12743, 12752, 12753, 12754, 12755, 12756, 12757, 12758, 12761, 12762, 12763, 12764, 12765, 12766, 12771, 12772, 12773, 12775, 12777, 12790, 12794, 12797, 12800, 12801, 12802, 12807, 12808, 12810, 12812, 12813, 12817, 12818, 12820, 12822, 12823, 12824, 12827, 12828, 12834, 12835, 12836, 12837, 12838, 12839, 12844, 12848, 12849, 12850, 12853, 12861, 12866, 12870, 12873, 12875, 12878, 12882, 12883, 12884, 12887, 12891, 12895, 12898, 12899, 12900, 12902, 12903, 12904, 12905, 12906, 12908, 12910, 12912, 12913, 12916, 12921, 12923, 12928, 12929, 12932, 12933, 12934, 12935, 12938, 12942, 12945, 12946, 12947, 12950, 12953, 12960, 12961, 12967, 12968, 12969, 12978, 12983, 12984, 12986, 12987, 12990, 12991, 12999, 13003, 13004, 13007, 13010, 13014, 13015, 13017, 13018, 13022, 13030, 13032, 13033, 13034, 13035, 13036, 13037, 13040, 13041, 13047, 13049, 13050, 13053, 13054, 13055, 13056, 13060, 13061, 13062, 13064, 13066, 13067, 13069, 13071, 13075, 13077, 13083, 13085, 13086, 13087, 13097, 13098, 13101, 13102, 13105, 13106, 13110, 13111, 13112, 13114, 13115, 13116, 13117, 13118, 13120, 13121, 13122, 13123, 13124, 13125, 13128, 13131, 13134, 13135, 13136, 13142, 13144, 13147, 13148, 13149, 13151, 13154, 13158, 13159, 13163, 13166, 13167, 13169, 13175, 13180, 13181, 13182, 13186, 13188, 13190, 13197, 13198, 13199, 13206, 13209, 13210, 13213, 13215, 13217, 13221, 13222, 13224, 13226, 13227, 13228, 13229, 13231, 13232, 13233, 13234, 13235, 13236, 13237, 13239, 13241, 13243, 13248, 13250, 13251, 13255, 13256, 13258, 13259, 13260, 13261, 13262, 13263, 13264, 13267, 13268, 13269, 13271, 13274, 13279, 13280, 13281, 13285, 13292, 13293, 13296, 13297, 13298, 13300, 13301, 13303, 13304, 13313, 13315, 13317, 13318, 13323, 13326, 13328, 13329, 13330, 13332, 13335, 13337, 13338, 13340, 13341, 13343, 13345, 13346, 13347, 13348, 13350, 13352, 13353, 13358, 13361, 13363, 13365, 13367, 13368, 13369, 13370, 13374, 13377, 13381, 13384, 13385, 13386, 13388, 13391, 13393, 13394, 13396, 13397, 13398, 13401, 13402, 13403, 13404, 13408, 13410, 13416, 13417, 13419, 13423, 13424, 13428, 13429, 13430, 13433, 13439, 13444, 13448, 13450, 13456, 13457, 13460, 13461, 13463, 13467, 13469, 13471, 13473, 13475, 13476, 13477, 13478, 13479, 13480, 13481, 13484, 13492, 13496, 13499, 13503, 13507, 13513, 13514, 13515, 13519, 13521, 13522, 13526, 13530, 13532, 13539, 13540, 13543, 13544, 13546, 13547, 13549, 13552, 13553, 13555, 13556, 13558, 13559, 13560, 13561, 13562, 13568, 13569, 13574, 13577, 13578, 13579, 13580, 13582, 13584, 13587, 13596, 13597, 13598, 13599, 13600, 13601, 13602, 13604, 13605, 13606, 13607, 13612, 13619, 13621, 13623, 13627, 13628, 13630, 13631, 13632, 13634, 13636, 13637, 13638, 13641, 13647, 13650, 13651, 13652, 13653, 13654, 13660, 13662, 13663, 13665, 13668, 13675, 13676, 13677, 13679, 13683, 13687, 13688, 13697, 13698, 13700, 13702, 13706, 13710, 13712, 13713, 13715, 13716, 13719, 13720, 13727, 13729, 13730, 13734, 13736, 13739, 13742, 13745, 13747, 13749, 13750, 13756, 13764, 13767, 13769, 13772, 13773, 13775, 13777, 13779, 13782, 13783, 13785, 13786, 13787, 13789, 13791, 13793, 13796, 13798, 13799, 13809, 13816, 13817, 13818, 13819, 13821, 13822, 13823, 13828, 13830, 13831, 13834, 13835, 13843, 13849, 13852, 13853, 13858, 13860, 13862, 13866, 13869, 13870, 13872, 13873, 13874, 13875, 13877, 13879, 13880, 13885, 13887, 13891, 13892, 13895, 13897, 13898, 13901, 13904, 13906, 13907, 13908, 13909, 13910, 13911, 13917, 13918, 13919, 13920, 13921, 13924, 13925, 13927, 13929, 13930, 13943, 13944, 13947, 13948, 13949, 13950, 13954, 13958, 13960, 13962, 13963, 13969, 13970, 13975, 13981, 13984, 13986, 13987, 13990, 13999, 14000, 14001, 14002, 14005, 14006, 14008, 14013, 14014, 14018, 14022, 14027, 14030, 14031, 14035, 14038, 14040, 14049, 14052, 14059, 14062, 14063, 14066, 14067, 14069, 14070, 14071, 14073, 14074, 14075, 14081, 14084, 14085, 14086, 14088, 14092, 14094, 14096, 14106, 14111, 14112, 14116, 14117, 14118, 14119, 14120, 14122, 14124, 14125, 14129, 14130, 14132, 14133, 14135, 14137, 14138, 14139, 14140, 14141, 14143, 14144, 14145, 14146, 14147.

Promoters expressing in a mixture of all root tissues at the V5 stage at 5 p.m. include SEQ IDs: 3, 4, 7, 12, 13, 14, 15, 16, 17, 19, 27, 29, 33, 34, 36, 37, 48, 51, 54, 57, 63, 64, 65, 73, 79, 81, 82, 88, 90, 93, 94, 96, 98, 99, 102, 103, 104, 108, 110, 111, 112, 115, 117, 123, 128, 130, 131, 141, 143, 148, 152, 154, 160, 162, 164, 172, 174, 176, 179, 180, 181, 182, 183, 187, 189, 191, 193, 194, 196, 197, 199, 202, 205, 207, 211, 212, 214, 217, 223, 232, 233, 235, 236, 237, 239, 240, 242, 244, 246, 249, 250, 251, 257, 259, 264, 267, 271, 273, 280, 281, 286, 288, 289, 293, 298, 299, 301, 302, 305, 306, 308, 309, 314, 316, 319, 322, 323, 328, 329, 332, 334, 335, 338, 340, 346, 348, 349, 352, 353, 354, 355, 356, 357, 359, 360, 364, 365, 372, 373, 374, 376, 378, 379, 381, 387, 388, 396, 401, 405, 411, 412, 414, 423, 424, 428, 429, 432, 433, 434, 436, 441, 448, 450, 452, 454, 456, 461, 462, 463, 468, 470, 471, 474, 478, 479, 483, 484, 485, 488, 489, 492, 496, 498, 507, 509, 510, 514, 516, 517, 522, 523, 525, 532, 534, 537, 538, 541, 543, 544, 546, 547, 548, 553, 554, 557, 561, 563, 578, 580, 582, 585, 591, 594, 595, 596, 598, 599, 601, 602, 605, 606, 607, 608, 613, 619, 620, 623, 630, 631, 633, 635, 636, 637, 638, 642, 643, 650, 655, 663, 665, 666, 667, 668, 669, 671, 673, 681, 683, 685, 687, 693, 694, 695, 701, 702, 705, 706, 707, 708, 716, 717, 718, 719, 721, 722, 723, 724, 727, 731, 732, 734, 735, 736, 739, 740, 744, 749, 752, 753, 757, 758, 759, 760, 761, 762, 763, 764, 765, 771, 779, 782, 783, 784, 785, 786, 792, 793, 800, 804, 806, 809, 811, 819, 820, 821, 824, 825, 826, 827, 829, 830, 833, 840, 841, 849, 855, 856, 857, 858, 860, 862, 863, 865, 870, 871, 875, 876, 877, 879, 887, 890, 892, 893, 895, 897, 898, 899, 900, 903, 907, 908, 910, 911, 912, 915, 916, 919, 922, 924, 928, 932, 934, 936, 939, 943, 944, 951, 953, 955, 957, 958, 960, 964, 971, 974, 975, 976, 978, 979, 980, 981, 982, 984, 987, 988, 991, 993, 994, 995, 996, 997, 999, 1002, 1005, 1006, 1007, 1008, 1009, 1010, 1011, 1012, 1013, 1014, 1016, 1022, 1024, 1026, 1032, 1035, 1038, 1041, 1042, 1043, 1045, 1046, 1047, 1049, 1051, 1052, 1055, 1056, 1057, 1064, 1065, 1067, 1069, 1070, 1073, 1076, 1077, 1080, 1085, 1086, 1087, 1088, 1089, 1092, 1095, 1100, 1101, 1103, 1104, 1106, 1110, 1112, 1114, 1115, 1116, 1117, 1119, 1120, 1121, 1125, 1127, 1130, 1132, 1136, 1137, 1140, 1144, 1146, 1147, 1148, 1153, 1154, 1155, 1160, 1161, 1162, 1164, 1165, 1167, 1168, 1170, 1171, 1175, 1176, 1178, 1183, 1187, 1189, 1190, 1191, 1196, 1198, 1200, 1201, 1204, 1213, 1214, 1218, 1223, 1224, 1225, 1228, 1230, 1231, 1232, 1233, 1235, 1236, 1240, 1248, 1249, 1251, 1254, 1258, 1263, 1269, 1277, 1281, 1285, 1286, 1290, 1291, 1292, 1293, 1296, 1298, 1301, 1303, 1306, 1307, 1309, 1310, 1311, 1316, 1317, 1320, 1322, 1323, 1327, 1331, 1334, 1337, 1343, 1345, 1347, 1349, 1354, 1355, 1356, 1360, 1364, 1366, 1367, 1368, 1371, 1375, 1376, 1377, 1380, 1381, 1388, 1389, 1391, 1392, 1393, 1394, 1396, 1399, 1400, 1403, 1404, 1406, 1416, 1420, 1421, 1423, 1426, 1431, 1432, 1433, 1437, 1438, 1439, 1441, 1442, 1447, 1448, 1451, 1453, 1458, 1459, 1461, 1462, 1466, 1467, 1468, 1471, 1472, 1475, 1484, 1485, 1488, 1490, 1492, 1493, 1498, 1499, 1503, 1508, 1510, 1511, 1514, 1517, 1518, 1519, 1525, 1526, 1527, 1528, 1530, 1539, 1543, 1545, 1546, 1547, 1548, 1549, 1550, 1551, 1553, 1554, 1555, 1556, 1561, 1564, 1567, 1570, 1571, 1575, 1576, 1578, 1579, 1584, 1586, 1588, 1590, 1591, 1595, 1596, 1598, 1599, 1600, 1601, 1602, 1604, 1608, 1609, 1610, 1612, 1614, 1615, 1616, 1617, 1622, 1623, 1625, 1632, 1634, 1635, 1636, 1637, 1638, 1639, 1642, 1643, 1654, 1658, 1659, 1662, 1663, 1668, 1669, 1671, 1673, 1675, 1676, 1678, 1681, 1682, 1684, 1685, 1687, 1689, 1690, 1691, 1697, 1698, 1699, 1703, 1705, 1706, 1707, 1708, 1710, 1712, 1716, 1717, 1718, 1720, 1723, 1725, 1729, 1731, 1732, 1735, 1739, 1745, 1750, 1755, 1759, 1761, 1764, 1768, 1770, 1773, 1776, 1778, 1785, 1786, 1791, 1792, 1796, 1798, 1807, 1809, 1811, 1813, 1814, 1826, 1828, 1830, 1832, 1834, 1835, 1836, 1837, 1838, 1839, 1840, 1845, 1848, 1852, 1854, 1855, 1856, 1859, 1861, 1863, 1866, 1867, 1869, 1872, 1876, 1878, 1879, 1880, 1882, 1886, 1888, 1891, 1897, 1898, 1899, 1900, 1902, 1905, 1906, 1910, 1911, 1915, 1916, 1918, 1920, 1921, 1922, 1923, 1924, 1928, 1930, 1931, 1933, 1934, 1936, 1939, 1940, 1945, 1949, 1950, 1951, 1952, 1953, 1954, 1956, 1958, 1968, 1970, 1971, 1972, 1973, 1976, 1977, 1986, 1990, 1991, 1992, 1993, 1994, 1995, 1996, 1999, 2000, 2001, 2003, 2007, 2010, 2012, 2013, 2014, 2015, 2016, 2017, 2019, 2020, 2021, 2027, 2031, 2032, 2034, 2036, 2037, 2039, 2040, 2041, 2043, 2045, 2048, 2058, 2060, 2062, 2064, 2066, 2071, 2072, 2074, 2077, 2078, 2085, 2088, 2089, 2091, 2093, 2094, 2095, 2097, 2103, 2104, 2106, 2107, 2111, 2112, 2121, 2122, 2123, 2125, 2126, 2128, 2132, 2133, 2137, 2138, 2139, 2142, 2143, 2144, 2146, 2147, 2150, 2151, 2156, 2157, 2159, 2161, 2162, 2164, 2166, 2167, 2168, 2170, 2172, 2173, 2175, 2177, 2179, 2185, 2188, 2189, 2190, 2193, 2196, 2200, 2202, 2203, 2205, 2206, 2210, 2213, 2215, 2218, 2221, 2222, 2223, 2225, 2226, 2227, 2237, 2240, 2241, 2242, 2244, 2253, 2257, 2260, 2263, 2265, 2267, 2271, 2274, 2276, 2278, 2280, 2282, 2284, 2289, 2290, 2291, 2296, 2298, 2300, 2303, 2304, 2305, 2308, 2309, 2310, 2314, 2322, 2323, 2328, 2329, 2331, 2333, 2337, 2338, 2339, 2342, 2343, 2348, 2353, 2358, 2363, 2366, 2367, 2369, 2371, 2375, 2379, 2380, 2381, 2382, 2383, 2384, 2401, 2402, 2405, 2410, 2412, 2413, 2414, 2418, 2419, 2420, 2423, 2426, 2430, 2433, 2435, 2437, 2439, 2440, 2441, 2442, 2443, 2445, 2449, 2451, 2452, 2453, 2454, 2455, 2457, 2458, 2465, 2466, 2469, 2470, 2471, 2472, 2474, 2476, 2477, 2479, 2480, 2481, 2485, 2487, 2489, 2490, 2492, 2494, 2495, 2496, 2498, 2500, 2504, 2505, 2506, 2507, 2509, 2513, 2514, 2515, 2516, 2517, 2519, 2522, 2525, 2526, 2528, 2529, 2531, 2532, 2533, 2536, 2537, 2538, 2539, 2540, 2541, 2544, 2545, 2546, 2549, 2551, 2552, 2555, 2556, 2557, 2559, 2567, 2568, 2570, 2571, 2573, 2578, 2579, 2581, 2583, 2589, 2590, 2596, 2599, 2600, 2601, 2605, 2609, 2611, 2612, 2613, 2614, 2616, 2617, 2618, 2620, 2625, 2626, 2627, 2632, 2634, 2635, 2636, 2639, 2644, 2645, 2648, 2652, 2654, 2655, 2658, 2660, 2661, 2662, 2663, 2671, 2672, 2674, 2678, 2679, 2684, 2685, 2687, 2689, 2690, 2691, 2692, 2694, 2696, 2700, 2702, 2704, 2708, 2711, 2719, 2720, 2722, 2723, 2725, 2727, 2728, 2729, 2730, 2731, 2735, 2738, 2739, 2740, 2744, 2746, 2747, 2749, 2752, 2755, 2756, 2757, 2763, 2764, 2765, 2770, 2776, 2779, 2784, 2785, 2786, 2787, 2789, 2794, 2798, 2800, 2801, 2802, 2805, 2808, 2812, 2814, 2819, 2823, 2824, 2827, 2828, 2831, 2832, 2833, 2834, 2837, 2838, 2840, 2845, 2850, 2859, 2860, 2861, 2864, 2865, 2869, 2871, 2876, 2878, 2881, 2886, 2888, 2889, 2892, 2893, 2894, 2895, 2896, 2902, 2903, 2906, 2908, 2909, 2914, 2915, 2916, 2917, 2918, 2919, 2922, 2923, 2926, 2930, 2931, 2932, 2933, 2934, 2935, 2941, 2942, 2943, 2944, 2945, 2946, 2947, 2948, 2955, 2959, 2962, 2963, 2964, 2966, 2968, 2976, 2979, 2982, 2992, 2994, 3000, 3003, 3005, 3007, 3008, 3009, 3013, 3015, 3017, 3018, 3020, 3023, 3024, 3027, 3029, 3031, 3039, 3042, 3043, 3044, 3045, 3047, 3048, 3049, 3050, 3051, 3052, 3053, 3055, 3058, 3059, 3064, 3067, 3068, 3072, 3075, 3077, 3078, 3080, 3083, 3085, 3087, 3090, 3095, 3096, 3100, 3101, 3112, 3115, 3118, 3119, 3120, 3121, 3122, 3123, 3126, 3127, 3128, 3129, 3138, 3141, 3143, 3145, 3153, 3154, 3167, 3169, 3170, 3171, 3172, 3177, 3181, 3185, 3187, 3189, 3191, 3192, 3194, 3201, 3202, 3205, 3206, 3208, 3210, 3215, 3217, 3219, 3220, 3221, 3224, 3225, 3227, 3228, 3230, 3231, 3235, 3236, 3237, 3239, 3240, 3242, 3247, 3249, 3252, 3255, 3261, 3263, 3266, 3267, 3268, 3269, 3271, 3272, 3280, 3286, 3288, 3289, 3290, 3291, 3294, 3295, 3297, 3299, 3301, 3303, 3310, 3312, 3313, 3314, 3324, 3327, 3331, 3332, 3333, 3337, 3338, 3340, 3342, 3343, 3345, 3351, 3353, 3355, 3357, 3361, 3363, 3370, 3373, 3377, 3378, 3379, 3382, 3383, 3386, 3394, 3396, 3399, 3403, 3404, 3405, 3413, 3416, 3418, 3419, 3424, 3425, 3426, 3427, 3428, 3435, 3438, 3441, 3442, 3445, 3446, 3447, 3449, 3450, 3451, 3452, 3453, 3458, 3461, 3462, 3465, 3466, 3468, 3469, 3470, 3471, 3474, 3477, 3484, 3488, 3490, 3491, 3493, 3494, 3500, 3501, 3502, 3503, 3504, 3507, 3510, 3515, 3516, 3523, 3524, 3529, 3533, 3535, 3536, 3538, 3540, 3541, 3542, 3544, 3545, 3548, 3549, 3554, 3560, 3562, 3569, 3571, 3574, 3576, 3577, 3580, 3587, 3588, 3589, 3591, 3592, 3594, 3595, 3597, 3600, 3601, 3603, 3604, 3607, 3610, 3611, 3613, 3615, 3616, 3618, 3619, 3620, 3621, 3624, 3629, 3633, 3634, 3640, 3642, 3643, 3644, 3645, 3646, 3648, 3657, 3659, 3660, 3661, 3662, 3667, 3672, 3674, 3676, 3677, 3681, 3682, 3684, 3685, 3690, 3693, 3702, 3704, 3706, 3707, 3709, 3710, 3713, 3715, 3717, 3718, 3721, 3723, 3725, 3726, 3730, 3731, 3738, 3739, 3743, 3744, 3748, 3749, 3752, 3764, 3765, 3766, 3772, 3773, 3774, 3775, 3777, 3778, 3783, 3785, 3787, 3791, 3792, 3793, 3798, 3800, 3801, 3804, 3806, 3808, 3817, 3818, 3819, 3820, 3823, 3828, 3829, 3830, 3831, 3832, 3833, 3837, 3838, 3839, 3843, 3844, 3845, 3846, 3849, 3852, 3858, 3859, 3867, 3868, 3870, 3871, 3872, 3873, 3876, 3882, 3883, 3884, 3885, 3887, 3889, 3892, 3894, 3895, 3898, 3899, 3902, 3904, 3907, 3908, 3910, 3912, 3916, 3917, 3918, 3923, 3924, 3926, 3928, 3929, 3933, 3934, 3938, 3940, 3941, 3947, 3950, 3951, 3952, 3954, 3958, 3959, 3962, 3964, 3967, 3968, 3970, 3971, 3972, 3974, 3975, 3978, 3983, 3985, 3988, 3994, 3996, 3997, 4000, 4005, 4007, 4008, 4013, 4014, 4019, 4020, 4024, 4026, 4028, 4030, 4033, 4037, 4038, 4039, 4040, 4041, 4042, 4043, 4046, 4047, 4048, 4049, 4050, 4051, 4052, 4053, 4054, 4056, 4057, 4061, 4062, 4066, 4068, 4070, 4071, 4075, 4079, 4080, 4084, 4088, 4092, 4094, 4096, 4099, 4102, 4103, 4105, 4106, 4109, 4110, 4113, 4124, 4128, 4132, 4133, 4134, 4135, 4139, 4143, 4144, 4146, 4147, 4148, 4149, 4155, 4157, 4158, 4160, 4161, 4162, 4163, 4164, 4165, 4166, 4167, 4168, 4170, 4171, 4175, 4178, 4179, 4183, 4185, 4187, 4188, 4189, 4190, 4191, 4192, 4193, 4201, 4202, 4204, 4205, 4206, 4207, 4208, 4210, 4211, 4212, 4217, 4219, 4221, 4222, 4227, 4228, 4229, 4233, 4234, 4235, 4242, 4245, 4246, 4250, 4251, 4252, 4253, 4257, 4258, 4260, 4261, 4263, 4266, 4270, 4272, 4275, 4276, 4280, 4284, 4288, 4290, 4292, 4294, 4296, 4298, 4301, 4302, 4304, 4305, 4306, 4309, 4312, 4314, 4317, 4320, 4321, 4324, 4329, 4330, 4333, 4339, 4341, 4344, 4347, 4352, 4354, 4356, 4358, 4359, 4360, 4369, 4370, 4377, 4378, 4380, 4383, 4388, 4390, 4391, 4393, 4395, 4396, 4397, 4401, 4402, 4403, 4404, 4405, 4409, 4410, 4422, 4423, 4425, 4430, 4436, 4437, 4439, 4440, 4442, 4443, 4446, 4448, 4449, 4450, 4453, 4458, 4461, 4462, 4463, 4464, 4466, 4467, 4468, 4470, 4474, 4475, 4479, 4492, 4494, 4496, 4498, 4500, 4502, 4507, 4508, 4512, 4513, 4514, 4515, 4518, 4519, 4521, 4522, 4531, 4532, 4535, 4543, 4548, 4549, 4551, 4554, 4555, 4556, 4557, 4558, 4560, 4562, 4563, 4565, 4566, 4567, 4568, 4575, 4576, 4580, 4582, 4583, 4584, 4590, 4593, 4594, 4596, 4597, 4598, 4601, 4604, 4606, 4608, 4616, 4623, 4625, 4628, 4630, 4632, 4633, 4639, 4641, 4643, 4644, 4645, 4646, 4647, 4650, 4651, 4653, 4654, 4655, 4656, 4657, 4658, 4659, 4662, 4664, 4667, 4669, 4671, 4672, 4673, 4674, 4676, 4677, 4680, 4682, 4685, 4691, 4692, 4694, 4696, 4697, 4699, 4700, 4701, 4705, 4706, 4708, 4710, 4711, 4712, 4713, 4715, 4719, 4721, 4723, 4727, 4728, 4729, 4730, 4734, 4736, 4737, 4738, 4739, 4740, 4741, 4745, 4746, 4749, 4750, 4753, 4755, 4756, 4758, 4761, 4762, 4766, 4767, 4769, 4770, 4771, 4778, 4779, 4780, 4784, 4787, 4788, 4789, 4790, 4791, 4794, 4795, 4801, 4802, 4804, 4805, 4806, 4807, 4809, 4813, 4815, 4816, 4817, 4818, 4822, 4828, 4829, 4830, 4831, 4834, 4838, 4841, 4842, 4845, 4855, 4856, 4857, 4859, 4861, 4862, 4863, 4864, 4869, 4874, 4875, 4876, 4880, 4881, 4887, 4889, 4891, 4896, 4900, 4902, 4904, 4905, 4909, 4910, 4913, 4914, 4918, 4921, 4922, 4924, 4925, 4935, 4936, 4941, 4942, 4943, 4950, 4954, 4955, 4958, 4959, 4967, 4969, 4971, 4972, 4974, 4975, 4977, 4984, 4985, 4987, 4988, 4989, 4990, 4993, 4994, 4996, 5000, 5005, 5007, 5011, 5015, 5016, 5021, 5022, 5024, 5026, 5029, 5030, 5032, 5034, 5036, 5038, 5039, 5040, 5042, 5044, 5045, 5046, 5051, 5052, 5054, 5057, 5060, 5067, 5072, 5074, 5075, 5078, 5079, 5082, 5084, 5088, 5089, 5090, 5091, 5094, 5100, 5101, 5102, 5109, 5111, 5113, 5114, 5115, 5116, 5120, 5122, 5123, 5129, 5131, 5132, 5140, 5147, 5150, 5151, 5160, 5164, 5165, 5168, 5170, 5174, 5180, 5181, 5184, 5185, 5187, 5188, 5189, 5190, 5191, 5192, 5193, 5196, 5198, 5200, 5202, 5203, 5206, 5209, 5212, 5213, 5216, 5217, 5218, 5219, 5225, 5226, 5228, 5229, 5234, 5239, 5240, 5241, 5243, 5249, 5253, 5254, 5256, 5257, 5258, 5260, 5261, 5263, 5264, 5267, 5268, 5269, 5273, 5274, 5275, 5276, 5280, 5281, 5283, 5285, 5286, 5287, 5289, 5291, 5292, 5293, 5297, 5298, 5299, 5300, 5301, 5308, 5311, 5314, 5315, 5317, 5319, 5321, 5324, 5329, 5330, 5331, 5334, 5338, 5339, 5342, 5343, 5345, 5346, 5348, 5350, 5351, 5352, 5359, 5361, 5366, 5367, 5369, 5371, 5383, 5386, 5388, 5389, 5393, 5395, 5396, 5397, 5402, 5405, 5409, 5411, 5413, 5414, 5417, 5418, 5422, 5426, 5427, 5428, 5430, 5431, 5433, 5434, 5437, 5438, 5446, 5448, 5449, 5452, 5453, 5456, 5458, 5459, 5461, 5463, 5464, 5467, 5469, 5471, 5472, 5475, 5483, 5484, 5485, 5487, 5488, 5491, 5493, 5495, 5496, 5497, 5505, 5506, 5508, 5510, 5513, 5515, 5517, 5518, 5519, 5524, 5526, 5529, 5530, 5532, 5534, 5535, 5541, 5543, 5545, 5554, 5555, 5562, 5563, 5566, 5568, 5569, 5572, 5575, 5579, 5581, 5582, 5583, 5584, 5585, 5586, 5589, 5593, 5594, 5597, 5608, 5612, 5613, 5614, 5615, 5616, 5618, 5619, 5620, 5623, 5627, 5632, 5633, 5635, 5638, 5640, 5643, 5647, 5648, 5649, 5650, 5651, 5652, 5653, 5656, 5657, 5659, 5660, 5662, 5663, 5664, 5669, 5680, 5683, 5689, 5690, 5694, 5695, 5697, 5698, 5702, 5705, 5706, 5709, 5711, 5714, 5717, 5718, 5719, 5721, 5722, 5723, 5729, 5730, 5731, 5732, 5734, 5735, 5736, 5742, 5744, 5746, 5751, 5757, 5768, 5770, 5771, 5773, 5775, 5780, 5784, 5785, 5788, 5791, 5792, 5794, 5805, 5808, 5809, 5810, 5811, 5820, 5823, 5825, 5826, 5832, 5834, 5835, 5836, 5837, 5842, 5844, 5850, 5853, 5854, 5859, 5864, 5867, 5869, 5871, 5872, 5876, 5878, 5879, 5881, 5882, 5883, 5884, 5888, 5889, 5892, 5893, 5900, 5901, 5902, 5906, 5907, 5910, 5912, 5918, 5919, 5921, 5923, 5925, 5927, 5928, 5930, 5931, 5932, 5933, 5934, 5938, 5939, 5940, 5941, 5942, 5944, 5946, 5948, 5950, 5951, 5954, 5955, 5956, 5957, 5959, 5961, 5967, 5968, 5969, 5971, 5978, 5979, 5980, 5985, 5986, 5988, 5990, 5991, 5992, 5994, 5996, 5997, 6000, 6002, 6004, 6006, 6007, 6010, 6012, 6013, 6016, 6017, 6025, 6026, 6031, 6038, 6040, 6041, 6042, 6043, 6044, 6047, 6048, 6051, 6053, 6054, 6058, 6059, 6060, 6062, 6063, 6068, 6069, 6070, 6072, 6073, 6074, 6075, 6077, 6080, 6084, 6085, 6088, 6089, 6090, 6092, 6093, 6094, 6095, 6098, 6100, 6108, 6109, 6113, 6116, 6118, 6119, 6120, 6122, 6125, 6129, 6130, 6131, 6132, 6133, 6136, 6137, 6143, 6145, 6146, 6147, 6149, 6150, 6151, 6152, 6153, 6155, 6156, 6160, 6163, 6164, 6165, 6168, 6181, 6182, 6183, 6186, 6188, 6189, 6191, 6193, 6196, 6197, 6198, 6200, 6203, 6205, 6207, 6209, 6212, 6213, 6220, 6223, 6224, 6226, 6227, 6228, 6230, 6231, 6234, 6237, 6238, 6239, 6240, 6242, 6243, 6246, 6247, 6249, 6250, 6251, 6257, 6258, 6259, 6260, 6264, 6265, 6270, 6271, 6272, 6273, 6278, 6279, 6280, 6281, 6282, 6286, 6291, 6292, 6294, 6295, 6296, 6297, 6299, 6302, 6309, 6310, 6311, 6312, 6315, 6316, 6317, 6319, 6321, 6322, 6323, 6325, 6326, 6328, 6333, 6335, 6338, 6343, 6344, 6346, 6351, 6352, 6353, 6354, 6360, 6362, 6363, 6364, 6367, 6370, 6373, 6375, 6378, 6379, 6381, 6383, 6393, 6394, 6395, 6396, 6397, 6399, 6403, 6404, 6405, 6407, 6413, 6414, 6415, 6419, 6420, 6422, 6426, 6429, 6430, 6431, 6434, 6436, 6437, 6440, 6441, 6442, 6450, 6452, 6454, 6459, 6463, 6464, 6466, 6467, 6469, 6470, 6471, 6474, 6476, 6477, 6478, 6480, 6482, 6484, 6488, 6492, 6493, 6494, 6495, 6497, 6499, 6500, 6501, 6502, 6504, 6505, 6510, 6513, 6514, 6515, 6516, 6517, 6519, 6524, 6525, 6526, 6530, 6534, 6535, 6537, 6539, 6543, 6544, 6547, 6548, 6549, 6551, 6553, 6554, 6555, 6556, 6557, 6558, 6560, 6561, 6563, 6564, 6567, 6569, 6572, 6574, 6576, 6577, 6579, 6581, 6582, 6584, 6587, 6588, 6589, 6592, 6595, 6596, 6597, 6598, 6599, 6607, 6609, 6610, 6611, 6617, 6620, 6621, 6624, 6625, 6626, 6627, 6628, 6629, 6630, 6634, 6635, 6637, 6638, 6639, 6643, 6644, 6646, 6647, 6649, 6650, 6654, 6655, 6662, 6666, 6671, 6672, 6673, 6681, 6686, 6693, 6695, 6696, 6702, 6703, 6704, 6705, 6706, 6711, 6714, 6716, 6718, 6720, 6722, 6724, 6725, 6729, 6730, 6731, 6734, 6737, 6739, 6740, 6741, 6742, 6746, 6747, 6756, 6757, 6759, 6761, 6764, 6766, 6778, 6779, 6780, 6782, 6786, 6788, 6792, 6793, 6794, 6795, 6797, 6799, 6803, 6804, 6805, 6807, 6810, 6811, 6812, 6813, 6816, 6819, 6820, 6821, 6824, 6826, 6827, 6828, 6830, 6831, 6834, 6836, 6839, 6840, 6841, 6842, 6843, 6845, 6851, 6859, 6860, 6863, 6869, 6872, 6874, 6875, 6876, 6877, 6878, 6879, 6880, 6886, 6887, 6888, 6890, 6891, 6894, 6902, 6903, 6906, 6907, 6909, 6913, 6914, 6915, 6917, 6919, 6921, 6922, 6923, 6924, 6930, 6933, 6936, 6943, 6944, 6946, 6948, 6950, 6951, 6952, 6954, 6959, 6960, 6963, 6966, 6967, 6969, 6970, 6971, 6979, 6980, 6984, 6985, 6987, 6988, 6990, 6991, 6993, 6994, 6995, 6999, 7000, 7002, 7003, 7006, 7009, 7011, 7012, 7013, 7015, 7016, 7022, 7032, 7038, 7039, 7040, 7042, 7043, 7046, 7049, 7050, 7051, 7052, 7053, 7056, 7057, 7064, 7067, 7073, 7077, 7079, 7083, 7084, 7085, 7086, 7094, 7097, 7106, 7132, 7135, 7138, 7139, 7140, 7142, 7144, 7146, 7151, 7155, 7163, 7164, 7165, 7166, 7169, 7172, 7173, 7176, 7177, 7182, 7183, 7184, 7187, 7188, 7192, 7194, 7197, 7201, 7202, 7203, 7206, 7207, 7208, 7209, 7211, 7216, 7217, 7219, 7227, 7228, 7230, 7232, 7233, 7234, 7235, 7236, 7239, 7240, 7241, 7244, 7245, 7248, 7249, 7250, 7255, 7257, 7258, 7259, 7262, 7264, 7267, 7268, 7270, 7274, 7277, 7278, 7281, 7282, 7287, 7288, 7290, 7291, 7292, 7293, 7298, 7299, 7300, 7301, 7303, 7304, 7305, 7306, 7307, 7313, 7315, 7317, 7328, 7330, 7331, 7334, 7343, 7344, 7348, 7350, 7351, 7354, 7355, 7356, 7357, 7358, 7361, 7363, 7365, 7369, 7371, 7373, 7377, 7380, 7382, 7383, 7386, 7388, 7389, 7392, 7395, 7396, 7398, 7399, 7400, 7406, 7409, 7410, 7411, 7417, 7418, 7425, 7428, 7430, 7433, 7434, 7435, 7436, 7438, 7441, 7443, 7444, 7446, 7447, 7448, 7452, 7454, 7458, 7459, 7464, 7466, 7470, 7486, 7490, 7492, 7493, 7498, 7504, 7505, 7506, 7508, 7512, 7515, 7517, 7523, 7524, 7525, 7528, 7533, 7537, 7538, 7542, 7546, 7547, 7548, 7554, 7556, 7561, 7568, 7574, 7578, 7579, 7580, 7585, 7586, 7587, 7589, 7590, 7594, 7598, 7601, 7605, 7613, 7619, 7620, 7621, 7623, 7624, 7625, 7632, 7633, 7634, 7638, 7639, 7640, 7642, 7643, 7647, 7652, 7658, 7661, 7663, 7665, 7671, 7674, 7676, 7677, 7678, 7679, 7680, 7682, 7686, 7687, 7689, 7695, 7699, 7700, 7703, 7704, 7708, 7712, 7713, 7716, 7718, 7719, 7724, 7725, 7729, 7730, 7733, 7734, 7736, 7737, 7738, 7740, 7743, 7744, 7745, 7747, 7750, 7751, 7753, 7755, 7761, 7762, 7763, 7764, 7767, 7768, 7769, 7770, 7772, 7774, 7775, 7779, 7780, 7781, 7785, 7786, 7788, 7791, 7793, 7796, 7798, 7800, 7803, 7804, 7806, 7807, 7812, 7815, 7819, 7820, 7823, 7824, 7825, 7832, 7833, 7834, 7838, 7841, 7844, 7845, 7847, 7848, 7852, 7854, 7856, 7859, 7860, 7862, 7863, 7865, 7873, 7878, 7880, 7888, 7890, 7896, 7900, 7908, 7910, 7911, 7918, 7923, 7925, 7933, 7934, 7935, 7936, 7937, 7938, 7942, 7944, 7945, 7947, 7948, 7950, 7955, 7956, 7962, 7964, 7972, 7974, 7976, 7977, 7978, 7980, 7984, 7986, 7988, 7993, 8002, 8004, 8005, 8006, 8007, 8012, 8021, 8026, 8030, 8035, 8039, 8042, 8043, 8044, 8045, 8047, 8048, 8052, 8053, 8056, 8058, 8059, 8062, 8063, 8065, 8067, 8068, 8069, 8071, 8072, 8073, 8076, 8077, 8078, 8079, 8080, 8082, 8083, 8084, 8087, 8088, 8091, 8093, 8095, 8100, 8102, 8103, 8105, 8106, 8112, 8114, 8116, 8118, 8123, 8124, 8125, 8126, 8130, 8136, 8137, 8147, 8150, 8151, 8156, 8159, 8163, 8164, 8165, 8168, 8170, 8178, 8179, 8181, 8182, 8185, 8189, 8192, 8193, 8199, 8202, 8204, 8207, 8208, 8210, 8211, 8213, 8216, 8219, 8220, 8222, 8223, 8225, 8227, 8234, 8235, 8237, 8239, 8240, 8241, 8242, 8245, 8248, 8249, 8250, 8252, 8253, 8265, 8266, 8268, 8269, 8270, 8272, 8282, 8288, 8289, 8291, 8293, 8294, 8300, 8301, 8304, 8306, 8310, 8311, 8312, 8318, 8319, 8320, 8321, 8324, 8325, 8329, 8339, 8340, 8347, 8349, 8350, 8351, 8352, 8353, 8355, 8361, 8367, 8368, 8369, 8372, 8373, 8376, 8378, 8379, 8384, 8385, 8387, 8389, 8390, 8392, 8393, 8395, 8398, 8401, 8402, 8403, 8404, 8405, 8410, 8411, 8413, 8414, 8416, 8417, 8418, 8433, 8436, 8438, 8439, 8441, 8442, 8444, 8447, 8448, 8449, 8450, 8451, 8452, 8456, 8457, 8458, 8459, 8465, 8466, 8469, 8470, 8471, 8472, 8473, 8474, 8476, 8477, 8480, 8481, 8482, 8485, 8486, 8490, 8493, 8498, 8501, 8502, 8505, 8507, 8509, 8511, 8513, 8515, 8516, 8517, 8520, 8523, 8524, 8525, 8527, 8528, 8531, 8532, 8533, 8535, 8539, 8541, 8542, 8544, 8549, 8550, 8551, 8553, 8554, 8557, 8558, 8561, 8562, 8565, 8566, 8568, 8575, 8576, 8579, 8581, 8582, 8589, 8590, 8592, 8593, 8594, 8596, 8597, 8598, 8600, 8601, 8602, 8603, 8604, 8605, 8611, 8612, 8614, 8617, 8618, 8624, 8628, 8630, 8631, 8634, 8637, 8638, 8640, 8641, 8642, 8644, 8647, 8648, 8652, 8654, 8657, 8658, 8659, 8663, 8665, 8669, 8670, 8672, 8676, 8677, 8681, 8685, 8689, 8690, 8693, 8694, 8699, 8700, 8703, 8704, 8706, 8708, 8709, 8713, 8716, 8717, 8720, 8728, 8729, 8731, 8732, 8734, 8735, 8736, 8740, 8741, 8742, 8744, 8746, 8747, 8748, 8751, 8752, 8753, 8757, 8767, 8768, 8770, 8771, 8772, 8773, 8774, 8775, 8776, 8777, 8779, 8783, 8784, 8785, 8789, 8792, 8795, 8797, 8805, 8808, 8810, 8817, 8818, 8822, 8824, 8829, 8831, 8832, 8833, 8834, 8835, 8838, 8841, 8843, 8846, 8853, 8854, 8859, 8861, 8865, 8866, 8867, 8869, 8876, 8878, 8880, 8881, 8883, 8886, 8888, 8889, 8891, 8892, 8896, 8897, 8899, 8905, 8907, 8908, 8909, 8910, 8911, 8913, 8914, 8916, 8917, 8926, 8928, 8929, 8930, 8935, 8938, 8941, 8942, 8945, 8946, 8949, 8951, 8957, 8960, 8961, 8964, 8965, 8967, 8968, 8969, 8971, 8972, 8974, 8976, 8977, 8979, 8980, 8981, 8985, 8986, 8991, 8992, 8996, 8998, 8999, 9001, 9002, 9003, 9004, 9006, 9009, 9012, 9020, 9021, 9022, 9026, 9027, 9029, 9030, 9033, 9037, 9042, 9044, 9047, 9052, 9057, 9058, 9059, 9060, 9062, 9066, 9069, 9071, 9073, 9074, 9076, 9084, 9088, 9091, 9092, 9095, 9096, 9097, 9103, 9104, 9105, 9108, 9110, 9112, 9114, 9116, 9118, 9119, 9124, 9125, 9128, 9129, 9131, 9133, 9134, 9139, 9140, 9141, 9142, 9146, 9149, 9151, 9152, 9154, 9155, 9156, 9164, 9173, 9174, 9175, 9177, 9183, 9185, 9186, 9187, 9188, 9190, 9191, 9194, 9195, 9200, 9205, 9206, 9207, 9210, 9211, 9213, 9215, 9216, 9221, 9223, 9226, 9229, 9233, 9234, 9237, 9241, 9242, 9243, 9244, 9247, 9248, 9249, 9252, 9253, 9254, 9257, 9262, 9265, 9267, 9270, 9273, 9275, 9276, 9278, 9284, 9287, 9288, 9290, 9291, 9292, 9295, 9299, 9300, 9302, 9304, 9308, 9311, 9313, 9320, 9321, 9323, 9325, 9326, 9328, 9329, 9330, 9332, 9336, 9337, 9338, 9339, 9340, 9341, 9345, 9346, 9347, 9348, 9349, 9353, 9354, 9355, 9357, 9359, 9361, 9366, 9367, 9373, 9375, 9376, 9378, 9382, 9383, 9388, 9391, 9392, 9394, 9396, 9398, 9400, 9402, 9403, 9404, 9406, 9407, 9413, 9414, 9415, 9422, 9423, 9426, 9432, 9433, 9434, 9439, 9440, 9442, 9443, 9444, 9451, 9452, 9453, 9456, 9459, 9460, 9468, 9471, 9472, 9473, 9476, 9478, 9483, 9487, 9488, 9490, 9494, 9495, 9497, 9501, 9502, 9503, 9504, 9505, 9509, 9513, 9514, 9515, 9517, 9518, 9519, 9520, 9525, 9531, 9533, 9534, 9536, 9540, 9543, 9546, 9548, 9553, 9557, 9563, 9564, 9565, 9567, 9568, 9571, 9573, 9575, 9577, 9582, 9583, 9586, 9587, 9589, 9590, 9591, 9597, 9598, 9602, 9606, 9607, 9609, 9610, 9613, 9614, 9615, 9617, 9618, 9620, 9623, 9626, 9627, 9628, 9629, 9632, 9633, 9635, 9637, 9640, 9641, 9642, 9644, 9645, 9646, 9649, 9653, 9655, 9656, 9657, 9658, 9659, 9660, 9663, 9666, 9670, 9675, 9681, 9682, 9686, 9688, 9692, 9693, 9698, 9700, 9701, 9718, 9723, 9726, 9729, 9730, 9731, 9732, 9733, 9734, 9737, 9746, 9750, 9751, 9753, 9754, 9755, 9756, 9763, 9764, 9767, 9768, 9770, 9774, 9776, 9777, 9780, 9781, 9782, 9784, 9786, 9787, 9792, 9794, 9796, 9799, 9801, 9804, 9809, 9812, 9813, 9816, 9819, 9820, 9824, 9825, 9827, 9830, 9833, 9845, 9846, 9847, 9849, 9850, 9854, 9861, 9864, 9866, 9869, 9873, 9876, 9882, 9886, 9887, 9892, 9893, 9897, 9900, 9901, 9906, 9907, 9908, 9909, 9910, 9911, 9912, 9918, 9923, 9924, 9928, 9934, 9935, 9938, 9940, 9946, 9949, 9950, 9953, 9955, 9957, 9958, 9960, 9962, 9963, 9964, 9967, 9971, 9972, 9974, 9975, 9976, 9979, 9980, 9982, 9984, 9985, 9987, 9988, 9990, 9997, 10000, 10008, 10009, 10010, 10013, 10015, 10017, 10018, 10019, 10021, 10022, 10026, 10027, 10031, 10032, 10033, 10034, 10035, 10037, 10038, 10042, 10043, 10044, 10045, 10047, 10048, 10051, 10052, 10053, 10054, 10056, 10058, 10059, 10060, 10062, 10063, 10064, 10066, 10068, 10072, 10073, 10075, 10076, 10078, 10080, 10081, 10087, 10089, 10090, 10091, 10092, 10095, 10097, 10101, 10102, 10103, 10105, 10106, 10107, 10108, 10109, 10110, 10112, 10114, 10115, 10116, 10117, 10118, 10122, 10128, 10131, 10132, 10138, 10143, 10146, 10147, 10149, 10151, 10152, 10158, 10163, 10165, 10166, 10168, 10170, 10174, 10176, 10178, 10181, 10182, 10186, 10192, 10193, 10194, 10195, 10197, 10199, 10200, 10201, 10203, 10206, 10209, 10213, 10214, 10218, 10219, 10220, 10222, 10223, 10224, 10225, 10228, 10229, 10231, 10233, 10235, 10236, 10237, 10239, 10240, 10246, 10247, 10252, 10253, 10254, 10255, 10257, 10258, 10259, 10262, 10275, 10278, 10284, 10286, 10291, 10292, 10293, 10295, 10300, 10302, 10306, 10307, 10311, 10318, 10319, 10321, 10322, 10323, 10325, 10326, 10328, 10331, 10334, 10335, 10336, 10341, 10342, 10343, 10346, 10352, 10353, 10354, 10356, 10357, 10359, 10360, 10362, 10364, 10368, 10371, 10373, 10375, 10378, 10380, 10381, 10384, 10385, 10388, 10395, 10397, 10398, 10399, 10401, 10405, 10410, 10413, 10414, 10416, 10421, 10423, 10425, 10427, 10428, 10429, 10430, 10435, 10437, 10438, 10440, 10446, 10447, 10448, 10449, 10450, 10451, 10452, 10453, 10455, 10456, 10463, 10464, 10465, 10468, 10469, 10470, 10474, 10480, 10482, 10487, 10490, 10492, 10494, 10496, 10504, 10506, 10508, 10513, 10514, 10515, 10516, 10518, 10525, 10527, 10528, 10530, 10531, 10532, 10533, 10535, 10536, 10537, 10541, 10542, 10543, 10544, 10547, 10548, 10555, 10556, 10558, 10560, 10561, 10563, 10565, 10567, 10569, 10573, 10577, 10580, 10581, 10582, 10583, 10585, 10590, 10593, 10595, 10596, 10597, 10599, 10601, 10602, 10606, 10610, 10611, 10612, 10613, 10614, 10615, 10616, 10617, 10618, 10619, 10621, 10622, 10623, 10625, 10626, 10628, 10629, 10630, 10631, 10633, 10634, 10636, 10637, 10638, 10639, 10640, 10642, 10645, 10646, 10649, 10650, 10655, 10657, 10663, 10665, 10668, 10670, 10673, 10674, 10676, 10677, 10678, 10681, 10682, 10683, 10684, 10685, 10686, 10689, 10693, 10697, 10699, 10700, 10702, 10703, 10705, 10707, 10711, 10715, 10716, 10721, 10723, 10725, 10726, 10732, 10734, 10735, 10738, 10739, 10740, 10741, 10744, 10745, 10747, 10748, 10749, 10752, 10753, 10754, 10756, 10761, 10762, 10763, 10766, 10770, 10771, 10775, 10777, 10778, 10779, 10782, 10784, 10785, 10787, 10788, 10790, 10791, 10792, 10795, 10796, 10800, 10801, 10802, 10803, 10804, 10805, 10809, 10810, 10811, 10812, 10813, 10815, 10818, 10819, 10820, 10821, 10823, 10824, 10825, 10826, 10831, 10833, 10836, 10838, 10839, 10840, 10843, 10846, 10850, 10852, 10853, 10854, 10857, 10858, 10860, 10861, 10862, 10863, 10867, 10872, 10874, 10877, 10880, 10881, 10887, 10892, 10896, 10897, 10898, 10899, 10902, 10903, 10911, 10912, 10917, 10920, 10926, 10927, 10928, 10930, 10933, 10934, 10935, 10936, 10937, 10938, 10939, 10940, 10941, 10944, 10945, 10947, 10948, 10954, 10957, 10960, 10962, 10964, 10965, 10967, 10968, 10972, 10975, 10976, 10977, 10980, 10988, 10993, 10995, 10996, 10997, 10999, 11002, 11004, 11005, 11006, 11008, 11009, 11010, 11015, 11018, 11023, 11024, 11026, 11027, 11032, 11033, 11039, 11044, 11046, 11047, 11049, 11052, 11053, 11056, 11058, 11060, 11066, 11067, 11068, 11070, 11071, 11078, 11080, 11081, 11082, 11083, 11086, 11090, 11092, 11095, 11098, 11101, 11107, 11110, 11114, 11116, 11118, 11119, 11123, 11124, 11125, 11127, 11129, 11132, 11133, 11135, 11137, 11138, 11146, 11148, 11151, 11153, 11154, 11158, 11160, 11161, 11162, 11163, 11165, 11166, 11169, 11174, 11175, 11177, 11179, 11180, 11181, 11184, 11185, 11187, 11188, 11190, 11192, 11194, 11198, 11199, 11201, 11202, 11203, 11204, 11207, 11210, 11214, 11216, 11217, 11218, 11222, 11226, 11227, 11228, 11229, 11232, 11233, 11234, 11235, 11236, 11237, 11239, 11240, 11244, 11246, 11247, 11248, 11254, 11255, 11256, 11257, 11258, 11259, 11260, 11261, 11262, 11263, 11264, 11266, 11274, 11275, 11278, 11289, 11290, 11292, 11293, 11294, 11295, 11296, 11298, 11302, 11306, 11307, 11313, 11315, 11316, 11318, 11320, 11322, 11324, 11329, 11330, 11331, 11332, 11333, 11337, 11338, 11339, 11340, 11345, 11346, 11348, 11349, 11352, 11356, 11358, 11363, 11365, 11366, 11370, 11371, 11373, 11377, 11380, 11381, 11382, 11387, 11388, 11391, 11394, 11395, 11397, 11398, 11401, 11403, 11404, 11405, 11406, 11409, 11410, 11411, 11412, 11413, 11414, 11416, 11423, 11424, 11428, 11430, 11434, 11437, 11438, 11445, 11446, 11447, 11449, 11451, 11456, 11459, 11461, 11463, 11464, 11465, 11471, 11472, 11475, 11476, 11477, 11478, 11481, 11482, 11487, 11489, 11490, 11491, 11494, 11496, 11497, 11498, 11499, 11500, 11503, 11506, 11507, 11508, 11512, 11518, 11522, 11523, 11526, 11527, 11528, 11530, 11531, 11532, 11533, 11534, 11538, 11541, 11544, 11546, 11547, 11548, 11551, 11553, 11558, 11560, 11561, 11563, 11567, 11568, 11570, 11571, 11576, 11577, 11578, 11580, 11583, 11585, 11586, 11593, 11594, 11595, 11596, 11597, 11599, 11604, 11607, 11610, 11612, 11615, 11618, 11621, 11623, 11625, 11628, 11629, 11632, 11633, 11636, 11637, 11639, 11640, 11642, 11644, 11647, 11650, 11652, 11656, 11657, 11658, 11663, 11668, 11669, 11673, 11677, 11678, 11681, 11688, 11691, 11692, 11693, 11694, 11695, 11698, 11699, 11701, 11703, 11705, 11707, 11711, 11712, 11718, 11721, 11722, 11725, 11731, 11733, 11736, 11740, 11743, 11744, 11753, 11755, 11759, 11760, 11761, 11762, 11763, 11764, 11765, 11766, 11767, 11770, 11771, 11773, 11774, 11776, 11780, 11781, 11782, 11783, 11784, 11785, 11786, 11790, 11792, 11799, 11800, 11802, 11804, 11807, 11809, 11810, 11811, 11812, 11813, 11814, 11816, 11818, 11819, 11820, 11821, 11826, 11828, 11830, 11837, 11841, 11846, 11848, 11849, 11850, 11851, 11853, 11856, 11858, 11863, 11868, 11870, 11872, 11876, 11877, 11881, 11889, 11890, 11891, 11894, 11898, 11899, 11904, 11905, 11909, 11912, 11913, 11916, 11917, 11918, 11919, 11920, 11921, 11922, 11923, 11926, 11927, 11928, 11929, 11930, 11934, 11935, 11940, 11941, 11943, 11945, 11946, 11947, 11948, 11949, 11953, 11957, 11958, 11959, 11960, 11961, 11962, 11963, 11965, 11968, 11975, 11976, 11977, 11978, 11979, 11980, 11983, 11987, 11988, 11993, 11994, 11995, 11996, 11997, 11998, 11999, 12002, 12004, 12008, 12014, 12017, 12018, 12019, 12020, 12021, 12023, 12024, 12025, 12032, 12042, 12043, 12044, 12047, 12050, 12059, 12061, 12063, 12068, 12076, 12078, 12079, 12080, 12081, 12083, 12085, 12086, 12087, 12089, 12091, 12092, 12093, 12097, 12098, 12102, 12104, 12106, 12109, 12110, 12112, 12115, 12118, 12120, 12122, 12127, 12128, 12129, 12131, 12134, 12135, 12137, 12138, 12139, 12141, 12143, 12144, 12145, 12146, 12147, 12148, 12150, 12151, 12153, 12161, 12164, 12165, 12166, 12167, 12170, 12171, 12174, 12175, 12176, 12179, 12181, 12197, 12200, 12201, 12202, 12204, 12208, 12214, 12215, 12217, 12218, 12221, 12223, 12229, 12234, 12237, 12238, 12240, 12241, 12243, 12245, 12249, 12250, 12252, 12255, 12256, 12259, 12268, 12269, 12271, 12274, 12278, 12280, 12283, 12285, 12286, 12287, 12288, 12291, 12293, 12295, 12304, 12310, 12311, 12312, 12313, 12314, 12315, 12317, 12319, 12321, 12323, 12325, 12328, 12331, 12333, 12334, 12339, 12340, 12342, 12345, 12347, 12350, 12354, 12356, 12358, 12359, 12364, 12366, 12368, 12370, 12374, 12375, 12376, 12379, 12380, 12381, 12385, 12390, 12396, 12397, 12399, 12400, 12401, 12403, 12406, 12410, 12411, 12414, 12415, 12416, 12417, 12419, 12420, 12423, 12424, 12426, 12427, 12437, 12439, 12440, 12443, 12444, 12447, 12450, 12451, 12455, 12456, 12457, 12459, 12462, 12465, 12467, 12468, 12469, 12470, 12472, 12473, 12478, 12481, 12486, 12487, 12488, 12489, 12490, 12492, 12495, 12497, 12499, 12500, 12501, 12502, 12503, 12504, 12505, 12508, 12512, 12513, 12514, 12515, 12518, 12519, 12530, 12535, 12536, 12537, 12538, 12539, 12540, 12546, 12547, 12548, 12549, 12551, 12552, 12554, 12555, 12556, 12560, 12561, 12562, 12563, 12565, 12567, 12568, 12570, 12572, 12577, 12583, 12585, 12586, 12588, 12589, 12591, 12594, 12597, 12603, 12605, 12606, 12608, 12609, 12610, 12611, 12619, 12620, 12622, 12623, 12626, 12628, 12629, 12631, 12633, 12634, 12638, 12639, 12640, 12641, 12644, 12648, 12649, 12651, 12663, 12664, 12668, 12670, 12671, 12674, 12676, 12677, 12679, 12681, 12683, 12684, 12685, 12687, 12688, 12689, 12691, 12692, 12693, 12695, 12696, 12697, 12699, 12701, 12702, 12705, 12706, 12707, 12713, 12714, 12715, 12719, 12721, 12723, 12726, 12728, 12731, 12732, 12733, 12735, 12738, 12739, 12740, 12741, 12742, 12743, 12752, 12753, 12754, 12755, 12756, 12757, 12758, 12761, 12762, 12763, 12764, 12765, 12766, 12771, 12772, 12773, 12775, 12777, 12790, 12794, 12797, 12800, 12801, 12802, 12804, 12807, 12808, 12810, 12812, 12813, 12817, 12818, 12820, 12822, 12823, 12824, 12826, 12827, 12828, 12834, 12835, 12836, 12837, 12838, 12839, 12843, 12844, 12848, 12849, 12850, 12852, 12853, 12861, 12866, 12869, 12870, 12873, 12875, 12878, 12882, 12883, 12884, 12887, 12891, 12895, 12898, 12899, 12900, 12901, 12902, 12903, 12904, 12905, 12906, 12908, 12910, 12912, 12913, 12916, 12920, 12921, 12923, 12928, 12929, 12932, 12933, 12934, 12935, 12938, 12939, 12940, 12942, 12946, 12947, 12950, 12953, 12960, 12961, 12963, 12967, 12968, 12969, 12972, 12978, 12983, 12984, 12986, 12987, 12990, 12991, 12999, 13003, 13004, 13007, 13010, 13014, 13015, 13017, 13018, 13022, 13027, 13030, 13032, 13034, 13035, 13036, 13037, 13040, 13041, 13047, 13049, 13050, 13053, 13054, 13055, 13056, 13060, 13061, 13062, 13064, 13066, 13067, 13071, 13075, 13077, 13079, 13083, 13085, 13086, 13087, 13097, 13099, 13101, 13102, 13105, 13106, 13110, 13111, 13112, 13114, 13115, 13116, 13117, 13118, 13119, 13120, 13121, 13122, 13123, 13124, 13125, 13128, 13131, 13134, 13136, 13142, 13144, 13147, 13148, 13149, 13151, 13154, 13158, 13159, 13160, 13169, 13175, 13181, 13182, 13185, 13186, 13188, 13190, 13197, 13198, 13199, 13206, 13209, 13210, 13212, 13213, 13215, 13217, 13220, 13221, 13222, 13224, 13226, 13227, 13228, 13229, 13232, 13233, 13234, 13235, 13236, 13237, 13239, 13241, 13243, 13248, 13250, 13251, 13255, 13256, 13258, 13259, 13260, 13261, 13262, 13263, 13264, 13265, 13267, 13268, 13269, 13271, 13274, 13279, 13280, 13281, 13285, 13291, 13292, 13293, 13296, 13297, 13298, 13300, 13301, 13303, 13304, 13313, 13315, 13317, 13326, 13328, 13329, 13330, 13332, 13337, 13338, 13340, 13343, 13344, 13345, 13346, 13347, 13348, 13350, 13352, 13353, 13358, 13361, 13363, 13367, 13368, 13369, 13370, 13374, 13377, 13381, 13384, 13385, 13386, 13388, 13391, 13393, 13394, 13396, 13397, 13398, 13402, 13403, 13404, 13408, 13410, 13413, 13416, 13417, 13419, 13423, 13428, 13429, 13430, 13433, 13434, 13439, 13448, 13450, 13456, 13457, 13460, 13461, 13463, 13467, 13469, 13473, 13475, 13476, 13477, 13478, 13479, 13480, 13492, 13494, 13496, 13498, 13499, 13503, 13510, 13513, 13514, 13515, 13519, 13521, 13522, 13526, 13529, 13530, 13532, 13539, 13540, 13543, 13544, 13546, 13547, 13549, 13552, 13553, 13555, 13556, 13558, 13559, 13560, 13561, 13562, 13568, 13569, 13574, 13577, 13578, 13579, 13580, 13582, 13584, 13587, 13596, 13597, 13598, 13599, 13600, 13601, 13602, 13604, 13605, 13606, 13607, 13612, 13613, 13621, 13623, 13627, 13628, 13630, 13631, 13632, 13634, 13636, 13637, 13638, 13641, 13643, 13647, 13650, 13651, 13652, 13653, 13654, 13660, 13662, 13663, 13665, 13668, 13675, 13677, 13679, 13683, 13687, 13688, 13693, 13697, 13698, 13699, 13700, 13702, 13706, 13710, 13712, 13713, 13714, 13715, 13716, 13719, 13720, 13727, 13729, 13730, 13734, 13736, 13739, 13742, 13745, 13747, 13749, 13750, 13753, 13756, 13764, 13767, 13769, 13772, 13773, 13775, 13777, 13779, 13782, 13783, 13785, 13786, 13787, 13791, 13793, 13796, 13798, 13799, 13809, 13816, 13817, 13818, 13819, 13821, 13822, 13823, 13828, 13830, 13831, 13834, 13835, 13843, 13848, 13849, 13852, 13853, 13858, 13859, 13860, 13862, 13866, 13869, 13870, 13872, 13873, 13874, 13875, 13877, 13880, 13884, 13885, 13887, 13891, 13892, 13895, 13897, 13898, 13901, 13904, 13906, 13907, 13908, 13909, 13910, 13911, 13914, 13915, 13917, 13918, 13919, 13920, 13921, 13924, 13925, 13927, 13929, 13930, 13934, 13943, 13944, 13947, 13948, 13949, 13950, 13954, 13958, 13960, 13962, 13963, 13969, 13970, 13975, 13984, 13986, 13987, 13990, 13999, 14000, 14001, 14002, 14005, 14006, 14010, 14013, 14014, 14018, 14022, 14027, 14030, 14031, 14038, 14040, 14049, 14051, 14052, 14059, 14062, 14063, 14066, 14067, 14069, 14070, 14071, 14073, 14075, 14080, 14081, 14084, 14085, 14086, 14088, 14092, 14093, 14094, 14096, 14097, 14105, 14111, 14112, 14115, 14116, 14117, 14118, 14119, 14120, 14122, 14124, 14125, 14129, 14130, 14132, 14133, 14135, 14137, 14138, 14139, 14141, 14142, 14143, 14145, 14146, 14147.

Promoters expressing in a mixture of all root tissues at the tasseling stage include SEQ IDs: 3, 4, 7, 8, 12, 13, 14, 15, 16, 17, 19, 24, 27, 29, 31, 33, 34, 36, 37, 38, 48, 51, 53, 54, 57, 63, 64, 65, 69, 70, 71, 73, 79, 80, 81, 82, 88, 90, 93, 94, 96, 98, 99, 102, 103, 104, 108, 110, 111, 112, 117, 123, 128, 130, 131, 132, 141, 143, 148, 152, 154, 156, 157, 159, 160, 162, 168, 172, 174, 175, 176, 179, 180, 182, 183, 187, 189, 191, 193, 194, 196, 199, 202, 203, 205, 207, 211, 212, 214, 217, 223, 232, 233, 235, 236, 237, 239, 240, 242, 244, 246, 249, 250, 251, 257, 259, 264, 267, 269, 270, 271, 273, 280, 281, 284, 285, 286, 288, 289, 293, 294, 298, 299, 301, 302, 307, 308, 309, 314, 316, 319, 320, 322, 323, 328, 329, 332, 334, 335, 338, 348, 349, 352, 353, 354, 356, 357, 358, 359, 360, 364, 365, 371, 372, 373, 374, 376, 378, 379, 381, 387, 388, 389, 396, 401, 405, 411, 412, 414, 423, 424, 428, 432, 433, 434, 436, 441, 448, 450, 452, 454, 456, 461, 463, 466, 468, 470, 471, 474, 478, 483, 485, 488, 489, 492, 496, 498, 507, 509, 510, 511, 514, 515, 516, 517, 522, 523, 525, 528, 532, 534, 536, 537, 538, 541, 543, 544, 546, 547, 548, 554, 555, 557, 560, 561, 563, 578, 580, 585, 591, 592, 593, 594, 595, 596, 598, 599, 601, 602, 605, 606, 608, 609, 613, 614, 619, 620, 626, 631, 633, 635, 636, 637, 638, 642, 643, 645, 647, 650, 655, 661, 663, 664, 665, 666, 667, 668, 669, 671, 673, 681, 683, 685, 687, 692, 693, 694, 695, 701, 705, 706, 707, 708, 709, 716, 717, 718, 719, 721, 722, 723, 724, 727, 731, 732, 734, 735, 736, 739, 740, 742, 744, 746, 749, 752, 753, 757, 758, 759, 760, 761, 762, 763, 764, 765, 771, 779, 783, 784, 786, 792, 793, 800, 804, 806, 807, 808, 809, 811, 819, 820, 821, 824, 825, 826, 827, 829, 830, 833, 840, 845, 846, 849, 855, 856, 857, 858, 860, 862, 863, 865, 870, 871, 875, 876, 877, 883, 887, 890, 891, 892, 893, 895, 897, 898, 899, 900, 903, 907, 908, 910, 911, 912, 915, 916, 919, 920, 922, 924, 928, 932, 934, 936, 938, 939, 943, 944, 947, 951, 953, 955, 957, 958, 960, 964, 971, 974, 975, 976, 978, 979, 980, 981, 982, 983, 984, 985, 987, 988, 991, 994, 995, 996, 997, 999, 1002, 1005, 1007, 1008, 1009, 1010, 1011, 1012, 1013, 1014, 1016, 1017, 1025, 1026, 1032, 1033, 1035, 1038, 1039, 1040, 1041, 1042, 1043, 1045, 1046, 1047, 1049, 1051, 1052, 1055, 1056, 1057, 1064, 1065, 1069, 1070, 1073, 1077, 1085, 1086, 1087, 1089, 1092, 1095, 1096, 1100, 1101, 1103, 1104, 1106, 1110, 1112, 1114, 1115, 1116, 1117, 1119, 1120, 1121, 1125, 1126, 1127, 1130, 1132, 1136, 1137, 1140, 1143, 1144, 1146, 1148, 1153, 1154, 1160, 1161, 1164, 1165, 1167, 1168, 1170, 1171, 1176, 1178, 1183, 1190, 1191, 1196, 1198, 1201, 1203, 1204, 1205, 1213, 1214, 1217, 1218, 1221, 1222, 1223, 1224, 1225, 1228, 1230, 1231, 1232, 1235, 1236, 1240, 1243, 1248, 1249, 1251, 1254, 1257, 1258, 1262, 1263, 1269, 1272, 1277, 1281, 1283, 1285, 1286, 1290, 1291, 1292, 1293, 1296, 1298, 1301, 1303, 1306, 1307, 1309, 1310, 1311, 1312, 1314, 1316, 1317, 1320, 1322, 1323, 1327, 1329, 1331, 1334, 1337, 1343, 1345, 1347, 1349, 1354, 1355, 1356, 1360, 1363, 1364, 1366, 1368, 1371, 1375, 1376, 1377, 1380, 1381, 1386, 1387, 1388, 1389, 1391, 1392, 1393, 1394, 1396, 1399, 1400, 1404, 1405, 1406, 1411, 1412, 1416, 1420, 1421, 1423, 1426, 1431, 1432, 1433, 1438, 1439, 1440, 1441, 1442, 1444, 1445, 1447, 1448, 1451, 1453, 1458, 1459, 1461, 1462, 1466, 1467, 1468, 1471, 1472, 1474, 1475, 1484, 1487, 1488, 1490, 1491, 1492, 1493, 1497, 1498, 1499, 1501, 1503, 1506, 1508, 1510, 1511, 1514, 1517, 1518, 1519, 1525, 1526, 1527, 1528, 1530, 1534, 1539, 1543, 1545, 1547, 1548, 1549, 1550, 1551, 1554, 1555, 1556, 1559, 1561, 1563, 1564, 1567, 1570, 1571, 1575, 1578, 1579, 1582, 1584, 1585, 1586, 1588, 1590, 1591, 1596, 1597, 1598, 1599, 1600, 1601, 1602, 1604, 1608, 1609, 1610, 1612, 1614, 1615, 1616, 1617, 1620, 1622, 1623, 1625, 1634, 1635, 1637, 1638, 1639, 1641, 1642, 1643, 1651, 1654, 1658, 1659, 1662, 1663, 1669, 1671, 1673, 1675, 1676, 1678, 1681, 1682, 1684, 1685, 1687, 1688, 1689, 1690, 1691, 1696, 1697, 1698, 1699, 1705, 1706, 1707, 1708, 1710, 1716, 1717, 1718, 1720, 1725, 1729, 1731, 1732, 1735, 1736, 1739, 1745, 1750, 1755, 1759, 1761, 1764, 1768, 1770, 1771, 1773, 1774, 1776, 1777, 1785, 1786, 1791, 1792, 1796, 1798, 1807, 1809, 1811, 1813, 1814, 1826, 1828, 1830, 1832, 1834, 1837, 1838, 1839, 1840, 1848, 1852, 1856, 1859, 1861, 1863, 1866, 1867, 1868, 1869, 1872, 1873, 1876, 1878, 1879, 1880, 1882, 1886, 1888, 1891, 1897, 1898, 1899, 1900, 1902, 1905, 1906, 1909, 1910, 1911, 1915, 1916, 1918, 1920, 1921, 1922, 1923, 1924, 1930, 1931, 1933, 1934, 1936, 1939, 1940, 1945, 1950, 1951, 1952, 1953, 1954, 1956, 1958, 1968, 1969, 1970, 1971, 1972, 1973, 1974, 1976, 1977, 1990, 1991, 1992, 1993, 1999, 2000, 2001, 2003, 2007, 2008, 2010, 2012, 2014, 2015, 2016, 2017, 2019, 2020, 2021, 2026, 2027, 2031, 2032, 2034, 2037, 2040, 2041, 2043, 2045, 2048, 2058, 2060, 2062, 2064, 2066, 2067, 2071, 2072, 2074, 2077, 2078, 2085, 2088, 2089, 2091, 2092, 2093, 2094, 2095, 2097, 2099, 2103, 2104, 2106, 2111, 2112, 2122, 2123, 2125, 2126, 2128, 2132, 2133, 2137, 2139, 2142, 2143, 2146, 2147, 2148, 2150, 2151, 2153, 2156, 2157, 2161, 2162, 2164, 2166, 2167, 2168, 2170, 2172, 2173, 2175, 2177, 2179, 2183, 2185, 2186, 2188, 2189, 2190, 2193, 2195, 2196, 2200, 2202, 2203, 2205, 2206, 2210, 2213, 2215, 2216, 2218, 2221, 2222, 2223, 2225, 2226, 2227, 2229, 2230, 2231, 2237, 2240, 2241, 2242, 2244, 2253, 2257, 2260, 2263, 2267, 2271, 2274, 2276, 2278, 2280, 2282, 2284, 2289, 2290, 2291, 2296, 2297, 2298, 2303, 2305, 2306, 2308, 2309, 2310, 2313, 2314, 2322, 2323, 2328, 2329, 2331, 2337, 2339, 2342, 2343, 2353, 2358, 2363, 2366, 2369, 2371, 2375, 2379, 2380, 2381, 2382, 2384, 2396, 2397, 2401, 2402, 2405, 2408, 2410, 2412, 2413, 2414, 2418, 2419, 2420, 2423, 2426, 2428, 2430, 2431, 2432, 2433, 2434, 2435, 2437, 2439, 2440, 2441, 2442, 2443, 2445, 2449, 2451, 2452, 2453, 2454, 2457, 2458, 2465, 2466, 2469, 2470, 2472, 2474, 2476, 2477, 2479, 2480, 2481, 2482, 2485, 2487, 2489, 2490, 2494, 2495, 2496, 2498, 2500, 2504, 2505, 2506, 2507, 2509, 2513, 2514, 2515, 2516, 2517, 2522, 2523, 2525, 2526, 2528, 2529, 2531, 2532, 2533, 2538, 2539, 2541, 2544, 2546, 2549, 2551, 2552, 2555, 2556, 2557, 2559, 2567, 2568, 2570, 2571, 2573, 2578, 2579, 2581, 2589, 2590, 2594, 2596, 2599, 2600, 2601, 2605, 2609, 2611, 2612, 2613, 2614, 2616, 2617, 2618, 2619, 2620, 2625, 2626, 2627, 2632, 2634, 2635, 2639, 2644, 2645, 2648, 2652, 2655, 2656, 2658, 2661, 2662, 2663, 2671, 2672, 2674, 2679, 2684, 2685, 2687, 2689, 2690, 2691, 2692, 2694, 2700, 2702, 2704, 2708, 2711, 2720, 2721, 2722, 2723, 2725, 2726, 2727, 2728, 2729, 2730, 2735, 2737, 2738, 2739, 2744, 2745, 2746, 2747, 2749, 2752, 2755, 2756, 2757, 2758, 2759, 2760, 2762, 2763, 2764, 2765, 2770, 2775, 2779, 2784, 2785, 2786, 2787, 2789, 2791, 2794, 2798, 2800, 2801, 2802, 2805, 2808, 2812, 2814, 2819, 2821, 2823, 2824, 2827, 2828, 2831, 2833, 2834, 2837, 2838, 2840, 2845, 2850, 2860, 2861, 2864, 2865, 2869, 2871, 2876, 2878, 2881, 2888, 2889, 2890, 2892, 2893, 2894, 2895, 2896, 2897, 2901, 2902, 2903, 2906, 2908, 2909, 2914, 2915, 2916, 2917, 2918, 2919, 2922, 2923, 2926, 2930, 2931, 2932, 2933, 2934, 2935, 2941, 2942, 2943, 2944, 2945, 2946, 2948, 2955, 2959, 2962, 2963, 2966, 2968, 2976, 2979, 2982, 2987, 2992, 2994, 3000, 3003, 3005, 3007, 3008, 3009, 3013, 3015, 3017, 3018, 3020, 3023, 3024, 3027, 3029, 3031, 3039, 3041, 3042, 3043, 3044, 3045, 3046, 3047, 3048, 3049, 3050, 3051, 3052, 3053, 3055, 3058, 3059, 3064, 3067, 3068, 3072, 3077, 3078, 3080, 3083, 3084, 3085, 3087, 3090, 3095, 3096, 3100, 3101, 3106, 3107, 3112, 3115, 3118, 3119, 3120, 3121, 3122, 3123, 3126, 3127, 3128, 3129, 3137, 3138, 3139, 3141, 3143, 3145, 3153, 3154, 3157, 3158, 3166, 3167, 3169, 3170, 3171, 3172, 3177, 3181, 3185, 3189, 3191, 3192, 3194, 3201, 3202, 3205, 3206, 3208, 3210, 3215, 3217, 3219, 3220, 3221, 3224, 3225, 3227, 3228, 3231, 3235, 3236, 3237, 3240, 3242, 3245, 3246, 3247, 3249, 3250, 3252, 3253, 3261, 3263, 3266, 3267, 3269, 3271, 3272, 3280, 3283, 3286, 3288, 3289, 3290, 3291, 3294, 3295, 3297, 3299, 3301, 3308, 3310, 3312, 3313, 3314, 3322, 3324, 3327, 3331, 3332, 3333, 3337, 3338, 3340, 3342, 3343, 3345, 3351, 3353, 3355, 3357, 3359, 3360, 3361, 3363, 3369, 3370, 3373, 3377, 3378, 3379, 3382, 3383, 3386, 3389, 3390, 3394, 3396, 3399, 3402, 3403, 3404, 3405, 3411, 3413, 3415, 3416, 3418, 3419, 3424, 3425, 3426, 3427, 3428, 3432, 3435, 3438, 3441, 3442, 3446, 3447, 3449, 3450, 3451, 3452, 3453, 3458, 3461, 3462, 3466, 3468, 3469, 3470, 3471, 3474, 3477, 3484, 3488, 3490, 3491, 3493, 3494, 3500, 3501, 3502, 3503, 3504, 3507, 3510, 3511, 3515, 3516, 3517, 3518, 3523, 3524, 3529, 3533, 3535, 3536, 3537, 3538, 3540, 3541, 3542, 3544, 3545, 3548, 3549, 3554, 3560, 3562, 3569, 3571, 3574, 3576, 3577, 3580, 3587, 3588, 3589, 3592, 3594, 3595, 3597, 3599, 3600, 3601, 3603, 3604, 3606, 3607, 3610, 3611, 3613, 3615, 3616, 3618, 3619, 3620, 3621, 3622, 3624, 3629, 3633, 3634, 3637, 3640, 3642, 3643, 3644, 3645, 3646, 3648, 3655, 3659, 3661, 3662, 3667, 3671, 3672, 3674, 3676, 3677, 3681, 3682, 3684, 3685, 3690, 3697, 3702, 3704, 3706, 3707, 3709, 3710, 3713, 3715, 3717, 3718, 3719, 3721, 3725, 3730, 3731, 3738, 3739, 3744, 3748, 3749, 3752, 3756, 3761, 3764, 3765, 3766, 3772, 3773, 3774, 3775, 3777, 3778, 3783, 3785, 3791, 3792, 3793, 3796, 3798, 3800, 3801, 3804, 3805, 3806, 3808, 3812, 3817, 3818, 3819, 3820, 3823, 3828, 3829, 3830, 3831, 3832, 3833, 3835, 3837, 3838, 3839, 3843, 3844, 3846, 3847, 3849, 3852, 3858, 3859, 3860, 3867, 3868, 3870, 3871, 3872, 3873, 3876, 3882, 3883, 3884, 3887, 3889, 3890, 3892, 3894, 3895, 3898, 3902, 3903, 3904, 3907, 3908, 3912, 3917, 3918, 3923, 3924, 3926, 3928, 3929, 3933, 3934, 3936, 3937, 3938, 3940, 3941, 3947, 3950, 3951, 3954, 3958, 3962, 3964, 3967, 3968, 3969, 3970, 3971, 3972, 3974, 3975, 3978, 3983, 3985, 3988, 3994, 3995, 3996, 3997, 3998, 4000, 4005, 4007, 4008, 4012, 4013, 4014, 4019, 4020, 4026, 4028, 4030, 4033, 4035, 4037, 4038, 4039, 4040, 4041, 4042, 4043, 4044, 4046, 4047, 4048, 4049, 4050, 4053, 4054, 4056, 4057, 4061, 4062, 4066, 4068, 4070, 4071, 4075, 4080, 4084, 4088, 4092, 4094, 4096, 4099, 4102, 4103, 4105, 4106, 4109, 4110, 4113, 4124, 4126, 4128, 4132, 4133, 4134, 4135, 4143, 4144, 4146, 4148, 4149, 4150, 4151, 4155, 4157, 4158, 4160, 4161, 4162, 4163, 4164, 4165, 4166, 4167, 4168, 4170, 4171, 4175, 4178, 4181, 4183, 4185, 4187, 4188, 4189, 4191, 4193, 4195, 4197, 4201, 4202, 4204, 4205, 4206, 4207, 4208, 4210, 4211, 4212, 4213, 4217, 4219, 4221, 4222, 4227, 4228, 4229, 4233, 4235, 4237, 4242, 4245, 4246, 4250, 4251, 4252, 4253, 4257, 4258, 4260, 4261, 4263, 4266, 4270, 4272, 4275, 4276, 4280, 4281, 4284, 4290, 4292, 4294, 4296, 4298, 4300, 4301, 4302, 4305, 4306, 4309, 4312, 4314, 4317, 4320, 4321, 4324, 4329, 4330, 4333, 4335, 4339, 4341, 4347, 4352, 4354, 4358, 4359, 4360, 4369, 4370, 4374, 4378, 4380, 4383, 4388, 4390, 4391, 4393, 4395, 4396, 4397, 4401, 4402, 4403, 4404, 4405, 4406, 4409, 4410, 4422, 4423, 4430, 4432, 4436, 4437, 4439, 4440, 4442, 4443, 4446, 4448, 4449, 4450, 4453, 4461, 4462, 4463, 4466, 4467, 4468, 4470, 4474, 4475, 4479, 4490, 4492, 4494, 4496, 4498, 4500, 4502, 4507, 4508, 4512, 4513, 4514, 4515, 4518, 4519, 4521, 4522, 4524, 4529, 4531, 4532, 4534, 4535, 4543, 4548, 4549, 4551, 4554, 4555, 4556, 4557, 4558, 4560, 4562, 4563, 4565, 4566, 4567, 4568, 4575, 4576, 4580, 4582, 4583, 4590, 4591, 4593, 4594, 4596, 4597, 4598, 4601, 4606, 4616, 4618, 4623, 4625, 4628, 4630, 4632, 4635, 4636, 4638, 4639, 4641, 4643, 4644, 4645, 4646, 4647, 4650, 4651, 4653, 4654, 4655, 4656, 4657, 4658, 4659, 4662, 4664, 4667, 4668, 4669, 4671, 4672, 4673, 4674, 4676, 4677, 4680, 4682, 4684, 4685, 4691, 4692, 4696, 4697, 4699, 4700, 4701, 4703, 4705, 4706, 4708, 4710, 4711, 4713, 4715, 4718, 4719, 4721, 4722, 4724, 4727, 4729, 4730, 4734, 4736, 4737, 4738, 4739, 4740, 4741, 4745, 4746, 4747, 4749, 4753, 4755, 4756, 4761, 4762, 4763, 4766, 4767, 4769, 4770, 4771, 4773, 4778, 4779, 4780, 4784, 4787, 4788, 4789, 4790, 4791, 4794, 4795, 4796, 4801, 4802, 4803, 4804, 4805, 4806, 4807, 4809, 4813, 4815, 4816, 4817, 4818, 4822, 4828, 4829, 4830, 4831, 4834, 4838, 4842, 4845, 4853, 4855, 4856, 4857, 4861, 4862, 4863, 4864, 4869, 4874, 4875, 4876, 4880, 4881, 4887, 4889, 4891, 4896, 4897, 4900, 4904, 4905, 4907, 4909, 4910, 4913, 4914, 4918, 4921, 4922, 4923, 4924, 4925, 4936, 4937, 4938, 4941, 4942, 4943, 4950, 4954, 4955, 4958, 4959, 4967, 4969, 4971, 4972, 4974, 4975, 4977, 4984, 4985, 4987, 4988, 4993, 4994, 4996, 5005, 5007, 5011, 5015, 5016, 5021, 5022, 5024, 5026, 5029, 5030, 5032, 5034, 5036, 5037, 5038, 5039, 5040, 5042, 5044, 5045, 5046, 5049, 5051, 5052, 5054, 5057, 5060, 5067, 5068, 5069, 5072, 5074, 5075, 5078, 5082, 5084, 5088, 5089, 5090, 5091, 5094, 5097, 5098, 5100, 5101, 5102, 5106, 5108, 5109, 5111, 5113, 5114, 5115, 5116, 5120, 5122, 5123, 5125, 5131, 5132, 5140, 5143, 5145, 5147, 5150, 5151, 5160, 5164, 5165, 5168, 5170, 5172, 5174, 5175, 5177, 5178, 5180, 5181, 5185, 5187, 5188, 5189, 5190, 5191, 5192, 5193, 5196, 5198, 5200, 5202, 5203, 5206, 5209, 5212, 5213, 5214, 5216, 5217, 5218, 5219, 5222, 5225, 5226, 5228, 5229, 5234, 5237, 5238, 5240, 5241, 5243, 5244, 5245, 5249, 5251, 5253, 5254, 5255, 5256, 5257, 5258, 5260, 5261, 5263, 5264, 5267, 5268, 5269, 5273, 5275, 5276, 5280, 5281, 5282, 5283, 5285, 5287, 5289, 5291, 5292, 5293, 5297, 5298, 5299, 5300, 5301, 5308, 5311, 5314, 5317, 5319, 5321, 5324, 5327, 5329, 5330, 5333, 5334, 5338, 5339, 5342, 5343, 5345, 5346, 5348, 5349, 5351, 5352, 5359, 5366, 5367, 5369, 5383, 5386, 5388, 5389, 5393, 5395, 5396, 5397, 5402, 5404, 5405, 5409, 5411, 5413, 5414, 5417, 5418, 5422, 5426, 5427, 5428, 5430, 5431, 5433, 5434, 5437, 5438, 5446, 5448, 5449, 5452, 5453, 5456, 5458, 5459, 5461, 5463, 5464, 5467, 5472, 5475, 5483, 5484, 5485, 5487, 5488, 5491, 5493, 5495, 5496, 5502, 5503, 5505, 5506, 5508, 5510, 5512, 5513, 5515, 5517, 5518, 5519, 5524, 5526, 5529, 5530, 5531, 5532, 5534, 5535, 5541, 5543, 5545, 5554, 5562, 5563, 5564, 5566, 5568, 5569, 5572, 5575, 5579, 5580, 5581, 5582, 5584, 5585, 5586, 5589, 5593, 5594, 5597, 5602, 5608, 5612, 5613, 5614, 5615, 5616, 5618, 5619, 5620, 5621, 5623, 5627, 5635, 5638, 5640, 5643, 5647, 5648, 5649, 5650, 5651, 5652, 5653, 5656, 5657, 5659, 5660, 5662, 5663, 5664, 5669, 5670, 5671, 5680, 5681, 5683, 5689, 5690, 5694, 5695, 5697, 5698, 5702, 5705, 5706, 5709, 5711, 5714, 5717, 5718, 5719, 5721, 5722, 5723, 5729, 5730, 5731, 5732, 5734, 5735, 5736, 5742, 5744, 5751, 5752, 5757, 5764, 5768, 5770, 5773, 5775, 5778, 5780, 5784, 5785, 5787, 5788, 5791, 5792, 5794, 5805, 5807, 5808, 5810, 5811, 5817, 5820, 5823, 5826, 5828, 5832, 5833, 5834, 5835, 5836, 5837, 5839, 5842, 5844, 5846, 5850, 5853, 5854, 5859, 5867, 5869, 5871, 5872, 5878, 5879, 5880, 5881, 5882, 5883, 5884, 5888, 5892, 5893, 5900, 5901, 5902, 5906, 5907, 5910, 5912, 5918, 5919, 5921, 5925, 5927, 5928, 5930, 5931, 5932, 5938, 5939, 5940, 5941, 5942, 5944, 5946, 5948, 5950, 5951, 5954, 5956, 5957, 5959, 5961, 5967, 5968, 5971, 5978, 5979, 5980, 5985, 5986, 5988, 5990, 5991, 5994, 5996, 5997, 6000, 6002, 6004, 6005, 6006, 6007, 6012, 6013, 6016, 6018, 6025, 6026, 6031, 6038, 6040, 6041, 6042, 6043, 6044, 6045, 6047, 6048, 6051, 6053, 6054, 6058, 6059, 6060, 6062, 6063, 6068, 6069, 6070, 6072, 6073, 6074, 6075, 6077, 6080, 6084, 6085, 6088, 6089, 6090, 6091, 6092, 6093, 6094, 6095, 6098, 6108, 6109, 6110, 6112, 6113, 6116, 6118, 6119, 6122, 6125, 6129, 6130, 6131, 6132, 6133, 6135, 6136, 6137, 6143, 6145, 6146, 6147, 6149, 6150, 6151, 6152, 6153, 6155, 6156, 6158, 6160, 6163, 6164, 6165, 6168, 6181, 6182, 6183, 6184, 6186, 6188, 6189, 6190, 6191, 6193, 6196, 6197, 6198, 6200, 6203, 6205, 6207, 6209, 6212, 6213, 6215, 6219, 6220, 6221, 6223, 6224, 6226, 6227, 6228, 6230, 6231, 6234, 6237, 6238, 6239, 6240, 6243, 6246, 6247, 6249, 6250, 6251, 6257, 6258, 6259, 6260, 6264, 6265, 6269, 6270, 6271, 6272, 6273, 6275, 6278, 6279, 6280, 6282, 6286, 6288, 6291, 6292, 6294, 6295, 6296, 6299, 6300, 6302, 6309, 6310, 6311, 6312, 6315, 6316, 6317, 6319, 6321, 6322, 6323, 6325, 6326, 6328, 6332, 6333, 6335, 6338, 6343, 6344, 6345, 6346, 6350, 6351, 6352, 6353, 6354, 6359, 6360, 6362, 6363, 6364, 6367, 6370, 6373, 6375, 6378, 6379, 6381, 6383, 6393, 6394, 6395, 6396, 6397, 6399, 6403, 6404, 6405, 6407, 6412, 6414, 6415, 6419, 6420, 6422, 6426, 6427, 6429, 6430, 6431, 6434, 6436, 6437, 6440, 6452, 6454, 6459, 6463, 6464, 6466, 6467, 6468, 6469, 6470, 6471, 6474, 6476, 6477, 6478, 6480, 6482, 6484, 6488, 6495, 6497, 6499, 6500, 6501, 6502, 6504, 6505, 6510, 6513, 6514, 6515, 6516, 6517, 6519, 6524, 6525, 6530, 6534, 6537, 6541, 6543, 6544, 6547, 6548, 6549, 6552, 6553, 6554, 6555, 6558, 6560, 6561, 6563, 6564, 6569, 6572, 6574, 6576, 6577, 6579, 6581, 6582, 6584, 6587, 6588, 6589, 6595, 6597, 6598, 6599, 6607, 6609, 6610, 6611, 6614, 6615, 6616, 6617, 6620, 6621, 6624, 6625, 6626, 6627, 6628, 6629, 6630, 6634, 6635, 6637, 6638, 6639, 6643, 6644, 6646, 6647, 6648, 6649, 6650, 6652, 6654, 6655, 6656, 6662, 6666, 6671, 6672, 6673, 6681, 6686, 6690, 6693, 6695, 6696, 6699, 6702, 6703, 6704, 6705, 6706, 6711, 6714, 6716, 6718, 6720, 6724, 6725, 6729, 6730, 6731, 6734, 6737, 6739, 6742, 6746, 6747, 6756, 6757, 6759, 6761, 6764, 6766, 6778, 6779, 6780, 6782, 6786, 6788, 6792, 6793, 6794, 6795, 6797, 6799, 6803, 6804, 6805, 6807, 6810, 6811, 6812, 6813, 6816, 6819, 6820, 6821, 6824, 6826, 6827, 6828, 6830, 6831, 6834, 6836, 6837, 6839, 6840, 6841, 6842, 6843, 6845, 6851, 6859, 6860, 6863, 6864, 6867, 6869, 6872, 6874, 6875, 6876, 6877, 6878, 6879, 6880, 6884, 6886, 6887, 6888, 6890, 6891, 6894, 6903, 6906, 6909, 6913, 6914, 6915, 6917, 6919, 6921, 6922, 6923, 6924, 6925, 6930, 6933, 6936, 6938, 6941, 6944, 6946, 6948, 6950, 6951, 6952, 6954, 6959, 6960, 6963, 6966, 6967, 6969, 6971, 6979, 6980, 6984, 6985, 6987, 6990, 6991, 6993, 6994, 6997, 6999, 7000, 7002, 7003, 7005, 7006, 7009, 7011, 7012, 7013, 7015, 7016, 7022, 7032, 7038, 7039, 7040, 7042, 7043, 7046, 7049, 7051, 7052, 7053, 7056, 7057, 7064, 7067, 7072, 7073, 7075, 7077, 7079, 7083, 7084, 7085, 7086, 7094, 7096, 7097, 7105, 7106, 7107, 7108, 7112, 7113, 7116, 7117, 7118, 7124, 7126, 7129, 7130, 7132, 7135, 7138, 7139, 7140, 7142, 7144, 7146, 7149, 7151, 7155, 7163, 7164, 7169, 7172, 7173, 7176, 7177, 7182, 7183, 7184, 7187, 7188, 7192, 7194, 7196, 7197, 7201, 7202, 7203, 7206, 7207, 7208, 7209, 7211, 7212, 7213, 7216, 7217, 7219, 7223, 7225, 7227, 7228, 7230, 7232, 7233, 7234, 7236, 7239, 7240, 7243, 7244, 7245, 7248, 7249, 7250, 7252, 7255, 7257, 7258, 7259, 7262, 7264, 7267, 7268, 7269, 7270, 7274, 7277, 7282, 7284, 7287, 7288, 7290, 7291, 7292, 7293, 7298, 7299, 7300, 7301, 7303, 7304, 7305, 7306, 7307, 7310, 7313, 7315, 7317, 7328, 7330, 7331, 7334, 7337, 7338, 7340, 7343, 7344, 7350, 7351, 7354, 7355, 7356, 7357, 7358, 7361, 7363, 7365, 7369, 7371, 7373, 7375, 7377, 7379, 7380, 7381, 7382, 7383, 7386, 7387, 7388, 7389, 7392, 7395, 7396, 7398, 7399, 7400, 7406, 7407, 7409, 7411, 7417, 7418, 7425, 7428, 7430, 7433, 7434, 7435, 7436, 7438, 7441, 7443, 7444, 7446, 7447, 7448, 7452, 7454, 7458, 7459, 7464, 7466, 7470, 7486, 7488, 7490, 7492, 7493, 7502, 7504, 7505, 7506, 7512, 7515, 7517, 7523, 7524, 7525, 7528, 7533, 7534, 7537, 7538, 7546, 7547, 7548, 7549, 7554, 7561, 7568, 7570, 7574, 7577, 7578, 7580, 7585, 7586, 7591, 7594, 7605, 7613, 7619, 7620, 7621, 7623, 7624, 7632, 7633, 7634, 7639, 7640, 7642, 7643, 7647, 7652, 7658, 7661, 7663, 7664, 7665, 7666, 7667, 7674, 7677, 7678, 7679, 7680, 7682, 7686, 7687, 7689, 7694, 7695, 7697, 7700, 7703, 7704, 7708, 7712, 7716, 7717, 7719, 7724, 7725, 7729, 7730, 7733, 7734, 7736, 7737, 7738, 7740, 7743, 7744, 7745, 7747, 7750, 7751, 7753, 7761, 7762, 7763, 7764, 7768, 7769, 7770, 7772, 7774, 7775, 7777, 7778, 7779, 7781, 7782, 7785, 7786, 7788, 7791, 7793, 7794, 7796, 7798, 7800, 7803, 7804, 7806, 7807, 7812, 7819, 7820, 7823, 7824, 7825, 7832, 7833, 7834, 7836, 7838, 7841, 7844, 7845, 7847, 7848, 7849, 7854, 7856, 7859, 7860, 7862, 7863, 7865, 7866, 7867, 7873, 7878, 7880, 7881, 7888, 7890, 7896, 7900, 7908, 7909, 7910, 7911, 7918, 7923, 7925, 7927, 7929, 7933, 7934, 7935, 7936, 7937, 7938, 7942, 7944, 7945, 7946, 7947, 7948, 7950, 7955, 7956, 7962, 7964, 7965, 7966, 7967, 7971, 7972, 7974, 7976, 7977, 7978, 7980, 7983, 7984, 7986, 7988, 7989, 7990, 7991, 7992, 7993, 8002, 8004, 8005, 8006, 8012, 8021, 8026, 8029, 8030, 8035, 8042, 8043, 8044, 8045, 8047, 8048, 8052, 8053, 8056, 8058, 8059, 8062, 8063, 8065, 8066, 8067, 8068, 8069, 8071, 8072, 8073, 8075, 8076, 8077, 8078, 8080, 8082, 8083, 8084, 8087, 8088, 8091, 8093, 8095, 8100, 8102, 8103, 8105, 8112, 8114, 8116, 8118, 8121, 8123, 8124, 8125, 8126, 8130, 8136, 8137, 8147, 8150, 8151, 8156, 8159, 8163, 8164, 8165, 8168, 8170, 8176, 8178, 8179, 8182, 8185, 8189, 8192, 8193, 8195, 8196, 8199, 8202, 8204, 8207, 8208, 8211, 8213, 8216, 8219, 8220, 8222, 8223, 8225, 8227, 8234, 8235, 8237, 8239, 8240, 8241, 8245, 8250, 8252, 8253, 8265, 8266, 8268, 8269, 8270, 8272, 8282, 8288, 8289, 8291, 8293, 8294, 8300, 8301, 8304, 8306, 8310, 8311, 8312, 8318, 8319, 8320, 8321, 8322, 8325, 8329, 8330, 8339, 8340, 8349, 8350, 8351, 8352, 8353, 8355, 8361, 8363, 8367, 8368, 8369, 8372, 8373, 8378, 8379, 8384, 8385, 8387, 8389, 8390, 8392, 8393, 8395, 8398, 8401, 8402, 8403, 8404, 8405, 8410, 8411, 8413, 8414, 8416, 8417, 8418, 8423, 8427, 8433, 8436, 8438, 8439, 8441, 8442, 8444, 8447, 8448, 8450, 8451, 8452, 8456, 8457, 8458, 8459, 8460, 8465, 8466, 8471, 8472, 8473, 8474, 8476, 8477, 8480, 8481, 8482, 8485, 8486, 8490, 8493, 8498, 8501, 8502, 8505, 8507, 8509, 8511, 8513, 8515, 8516, 8517, 8523, 8524, 8525, 8527, 8528, 8531, 8532, 8533, 8537, 8538, 8539, 8541, 8542, 8544, 8549, 8550, 8552, 8553, 8554, 8557, 8558, 8561, 8562, 8565, 8566, 8568, 8575, 8576, 8577, 8581, 8582, 8589, 8590, 8593, 8594, 8596, 8597, 8598, 8599, 8600, 8601, 8602, 8603, 8605, 8610, 8611, 8612, 8613, 8614, 8617, 8618, 8624, 8628, 8630, 8631, 8634, 8638, 8640, 8642, 8644, 8647, 8648, 8652, 8654, 8657, 8658, 8659, 8663, 8665, 8669, 8672, 8676, 8677, 8685, 8689, 8693, 8699, 8700, 8703, 8704, 8706, 8708, 8709, 8713, 8716, 8717, 8719, 8720, 8721, 8726, 8729, 8731, 8732, 8734, 8735, 8736, 8740, 8741, 8742, 8744, 8745, 8746, 8748, 8752, 8753, 8757, 8764, 8767, 8768, 8770, 8771, 8772, 8773, 8774, 8775, 8776, 8777, 8779, 8782, 8783, 8784, 8785, 8789, 8792, 8795, 8797, 8802, 8803, 8805, 8810, 8817, 8818, 8822, 8824, 8829, 8830, 8831, 8832, 8833, 8834, 8835, 8838, 8841, 8843, 8846, 8853, 8861, 8866, 8867, 8869, 8874, 8876, 8877, 8878, 8880, 8881, 8883, 8886, 8888, 8889, 8891, 8892, 8896, 8897, 8899, 8900, 8902, 8905, 8907, 8908, 8909, 8910, 8911, 8913, 8914, 8916, 8917, 8926, 8928, 8929, 8930, 8935, 8938, 8940, 8941, 8942, 8945, 8946, 8951, 8954, 8957, 8960, 8961, 8967, 8968, 8969, 8972, 8974, 8976, 8977, 8979, 8980, 8981, 8985, 8986, 8991, 8992, 8996, 8998, 8999, 9002, 9003, 9006, 9009, 9012, 9015, 9020, 9021, 9022, 9026, 9027, 9029, 9030, 9033, 9037, 9039, 9040, 9041, 9042, 9043, 9044, 9052, 9056, 9058, 9059, 9060, 9061, 9062, 9066, 9069, 9071, 9073, 9074, 9076, 9084, 9086, 9088, 9091, 9092, 9095, 9096, 9097, 9103, 9104, 9105, 9108, 9110, 9111, 9112, 9114, 9115, 9116, 9118, 9119, 9124, 9125, 9128, 9129, 9131, 9133, 9134, 9139, 9140, 9141, 9142, 9146, 9148, 9149, 9151, 9152, 9156, 9164, 9173, 9174, 9175, 9177, 9183, 9185, 9187, 9188, 9190, 9191, 9194, 9195, 9196, 9200, 9206, 9207, 9210, 9211, 9213, 9215, 9216, 9218, 9221, 9223, 9226, 9229, 9233, 9234, 9237, 9241, 9243, 9244, 9247, 9248, 9249, 9252, 9253, 9255, 9257, 9262, 9263, 9265, 9267, 9270, 9273, 9276, 9278, 9284, 9285, 9287, 9288, 9290, 9291, 9292, 9293, 9295, 9299, 9300, 9302, 9304, 9308, 9311, 9320, 9321, 9323, 9325, 9326, 9328, 9329, 9330, 9332, 9336, 9337, 9338, 9339, 9340, 9341, 9345, 9346, 9347, 9348, 9349, 9354, 9355, 9357, 9359, 9361, 9367, 9373, 9375, 9376, 9378, 9382, 9383, 9388, 9391, 9392, 9393, 9394, 9396, 9399, 9400, 9402, 9403, 9404, 9406, 9407, 9413, 9414, 9415, 9422, 9423, 9426, 9432, 9433, 9439, 9442, 9444, 9451, 9452, 9453, 9456, 9459, 9460, 9467, 9468, 9471, 9472, 9473, 9476, 9478, 9483, 9488, 9490, 9497, 9500, 9501, 9502, 9503, 9504, 9505, 9509, 9513, 9514, 9515, 9517, 9518, 9519, 9520, 9525, 9531, 9533, 9534, 9536, 9540, 9543, 9545, 9546, 9548, 9549, 9553, 9555, 9556, 9561, 9563, 9564, 9565, 9567, 9568, 9571, 9573, 9575, 9577, 9582, 9583, 9586, 9587, 9589, 9590, 9591, 9602, 9606, 9607, 9608, 9609, 9610, 9613, 9614, 9615, 9617, 9620, 9623, 9624, 9626, 9627, 9628, 9629, 9630, 9632, 9633, 9635, 9637, 9640, 9641, 9642, 9644, 9645, 9646, 9649, 9650, 9651, 9653, 9655, 9656, 9657, 9658, 9659, 9660, 9663, 9666, 9670, 9675, 9681, 9682, 9686, 9688, 9692, 9693, 9698, 9706, 9717, 9718, 9723, 9725, 9726, 9730, 9731, 9733, 9734, 9737, 9746, 9750, 9751, 9753, 9754, 9755, 9756, 9763, 9764, 9767, 9768, 9770, 9772, 9776, 9777, 9780, 9781, 9782, 9784, 9786, 9787, 9792, 9794, 9796, 9799, 9801, 9804, 9806, 9808, 9809, 9812, 9813, 9816, 9819, 9820, 9824, 9825, 9827, 9833, 9845, 9846, 9847, 9849, 9850, 9851, 9853, 9854, 9861, 9864, 9866, 9869, 9873, 9876, 9882, 9885, 9886, 9887, 9892, 9893, 9897, 9898, 9900, 9901, 9906, 9907, 9908, 9909, 9910, 9911, 9912, 9917, 9918, 9923, 9924, 9928, 9935, 9938, 9940, 9946, 9947, 9949, 9950, 9953, 9955, 9957, 9960, 9962, 9963, 9964, 9966, 9967, 9971, 9974, 9975, 9976, 9979, 9980, 9982, 9984, 9985, 9988, 9990, 9997, 9998, 10000, 10008, 10009, 10010, 10013, 10015, 10017, 10018, 10019, 10021, 10022, 10026, 10027, 10031, 10032, 10033, 10034, 10035, 10037, 10038, 10041, 10043, 10044, 10045, 10047, 10048, 10051, 10052, 10053, 10054, 10056, 10058, 10059, 10060, 10062, 10063, 10064, 10068, 10072, 10073, 10075, 10076, 10077, 10078, 10080, 10081, 10083, 10086, 10087, 10089, 10090, 10091, 10092, 10094, 10095, 10097, 10101, 10102, 10103, 10105, 10106, 10107, 10108, 10109, 10110, 10112, 10114, 10115, 10116, 10118, 10122, 10127, 10128, 10131, 10132, 10134, 10135, 10136, 10138, 10143, 10146, 10147, 10149, 10151, 10152, 10158, 10163, 10165, 10166, 10168, 10170, 10174, 10176, 10177, 10178, 10181, 10182, 10192, 10193, 10194, 10195, 10197, 10199, 10201, 10203, 10206, 10209, 10213, 10214, 10218, 10219, 10220, 10222, 10223, 10224, 10225, 10228, 10231, 10232, 10233, 10236, 10237, 10239, 10240, 10247, 10252, 10253, 10254, 10255, 10258, 10259, 10262, 10275, 10278, 10284, 10286, 10291, 10292, 10293, 10295, 10300, 10302, 10306, 10307, 10311, 10318, 10319, 10321, 10322, 10323, 10325, 10326, 10327, 10328, 10329, 10331, 10333, 10334, 10335, 10336, 10341, 10342, 10343, 10346, 10353, 10356, 10357, 10359, 10360, 10362, 10364, 10368, 10371, 10373, 10375, 10376, 10380, 10381, 10384, 10385, 10389, 10395, 10397, 10398, 10399, 10400, 10401, 10405, 10410, 10413, 10414, 10416, 10421, 10423, 10424, 10425, 10426, 10428, 10429, 10430, 10435, 10437, 10438, 10446, 10447, 10448, 10449, 10450, 10451, 10453, 10455, 10456, 10463, 10464, 10465, 10468, 10469, 10470, 10472, 10473, 10474, 10478, 10480, 10482, 10487, 10490, 10492, 10494, 10496, 10504, 10506, 10508, 10514, 10516, 10518, 10521, 10525, 10527, 10528, 10530, 10531, 10533, 10535, 10536, 10537, 10541, 10542, 10543, 10544, 10547, 10548, 10555, 10556, 10558, 10561, 10562, 10563, 10565, 10569, 10573, 10577, 10580, 10581, 10582, 10583, 10585, 10587, 10590, 10593, 10595, 10596, 10597, 10599, 10601, 10602, 10610, 10611, 10614, 10615, 10616, 10617, 10618, 10621, 10622, 10623, 10626, 10628, 10629, 10630, 10631, 10633, 10636, 10637, 10638, 10639, 10640, 10641, 10642, 10643, 10645, 10646, 10649, 10650, 10655, 10657, 10663, 10665, 10668, 10670, 10671, 10673, 10674, 10677, 10678, 10681, 10682, 10683, 10684, 10685, 10686, 10687, 10689, 10693, 10697, 10698, 10699, 10700, 10702, 10703, 10705, 10707, 10708, 10711, 10712, 10715, 10716, 10721, 10723, 10725, 10726, 10732, 10734, 10735, 10738, 10740, 10741, 10744, 10745, 10747, 10748, 10749, 10753, 10754, 10756, 10761, 10762, 10763, 10766, 10770, 10775, 10777, 10778, 10779, 10782, 10784, 10785, 10787, 10788, 10790, 10791, 10792, 10795, 10796, 10798, 10800, 10801, 10802, 10803, 10804, 10805, 10809, 10810, 10811, 10812, 10815, 10818, 10819, 10820, 10821, 10823, 10824, 10825, 10826, 10830, 10831, 10833, 10836, 10838, 10839, 10840, 10841, 10843, 10846, 10850, 10853, 10854, 10857, 10858, 10860, 10862, 10863, 10867, 10872, 10874, 10877, 10878, 10880, 10881, 10886, 10887, 10892, 10896, 10897, 10898, 10899, 10902, 10903, 10905, 10912, 10917, 10920, 10926, 10927, 10928, 10930, 10933, 10934, 10935, 10936, 10937, 10938, 10940, 10941, 10945, 10947, 10948, 10950, 10954, 10956, 10957, 10960, 10962, 10964, 10965, 10967, 10968, 10972, 10975, 10976, 10977, 10980, 10988, 10993, 10995, 10996, 10997, 10998, 10999, 11002, 11004, 11005, 11006, 11008, 11010, 11015, 11018, 11023, 11024, 11025, 11026, 11027, 11032, 11033, 11039, 11046, 11047, 11049, 11053, 11056, 11060, 11066, 11067, 11070, 11078, 11080, 11081, 11082, 11083, 11086, 11090, 11092, 11095, 11098, 11099, 11101, 11102, 11107, 11108, 11110, 11111, 11114, 11116, 11117, 11118, 11119, 11123, 11124, 11125, 11127, 11128, 11129, 11132, 11133, 11135, 11137, 11138, 11145, 11146, 11148, 11151, 11152, 11153, 11154, 11158, 11159, 11160, 11161, 11162, 11163, 11166, 11169, 11175, 11177, 11178, 11179, 11180, 11181, 11184, 11185, 11187, 11188, 11190, 11191, 11192, 11194, 11198, 11199, 11201, 11202, 11203, 11207, 11210, 11214, 11216, 11217, 11218, 11222, 11226, 11227, 11228, 11229, 11230, 11232, 11233, 11234, 11235, 11236, 11237, 11239, 11240, 11244, 11246, 11247, 11248, 11254, 11255, 11256, 11257, 11258, 11259, 11260, 11261, 11262, 11263, 11264, 11266, 11274, 11275, 11278, 11288, 11289, 11290, 11292, 11293, 11294, 11295, 11298, 11302, 11306, 11307, 11313, 11315, 11316, 11318, 11320, 11322, 11324, 11326, 11329, 11330, 11331, 11332, 11333, 11337, 11338, 11339, 11340, 11345, 11346, 11348, 11349, 11352, 11356, 11358, 11363, 11365, 11366, 11370, 11371, 11373, 11377, 11380, 11381, 11382, 11387, 11388, 11389, 11391, 11392, 11394, 11395, 11397, 11398, 11403, 11404, 11405, 11406, 11409, 11410, 11411, 11412, 11413, 11414, 11416, 11418, 11423, 11424, 11426, 11428, 11430, 11431, 11434, 11436, 11437, 11438, 11446, 11447, 11449, 11451, 11458, 11459, 11461, 11463, 11465, 11467, 11471, 11472, 11473, 11475, 11476, 11478, 11481, 11482, 11485, 11487, 11490, 11491, 11494, 11496, 11497, 11498, 11499, 11500, 11503, 11506, 11507, 11508, 11509, 11512, 11513, 11516, 11518, 11520, 11523, 11526, 11527, 11528, 11530, 11531, 11532, 11533, 11534, 11538, 11541, 11544, 11546, 11548, 11551, 11553, 11558, 11560, 11561, 11563, 11567, 11568, 11570, 11571, 11574, 11576, 11577, 11578, 11579, 11580, 11585, 11586, 11593, 11594, 11595, 11596, 11597, 11599, 11604, 11608, 11610, 11612, 11615, 11618, 11620, 11621, 11623, 11625, 11632, 11633, 11636, 11639, 11642, 11650, 11652, 11654, 11656, 11657, 11658, 11663, 11665, 11667, 11668, 11669, 11677, 11678, 11680, 11681, 11682, 11683, 11688, 11691, 11692, 11693, 11694, 11695, 11698, 11699, 11701, 11703, 11705, 11707, 11710, 11711, 11712, 11718, 11721, 11722, 11723, 11725, 11731, 11733, 11736, 11740, 11743, 11744, 11749, 11753, 11755, 11759, 11760, 11761, 11762, 11763, 11764, 11765, 11766, 11767, 11769, 11770, 11771, 11773, 11774, 11776, 11780, 11781, 11782, 11783, 11785, 11786, 11790, 11792, 11799, 11800, 11802, 11804, 11809, 11811, 11812, 11814, 11816, 11818, 11819, 11821, 11826, 11828, 11830, 11837, 11838, 11839, 11841, 11846, 11848, 11849, 11850, 11851, 11853, 11856, 11858, 11860, 11863, 11868, 11870, 11872, 11876, 11877, 11881, 11890, 11891, 11893, 11894, 11897, 11898, 11899, 11903, 11904, 11909, 11912, 11913, 11918, 11919, 11920, 11921, 11922, 11923, 11926, 11927, 11928, 11929, 11930, 11934, 11935, 11940, 11941, 11943, 11945, 11946, 11947, 11948, 11949, 11953, 11955, 11957, 11958, 11959, 11960, 11961, 11962, 11963, 11965, 11968, 11974, 11977, 11978, 11980, 11983, 11987, 11988, 11993, 11994, 11995, 11996, 11997, 11998, 11999, 12002, 12004, 12008, 12014, 12017, 12019, 12020, 12021, 12023, 12024, 12025, 12032, 12042, 12043, 12044, 12047, 12050, 12054, 12059, 12060, 12061, 12063, 12068, 12073, 12076, 12078, 12079, 12080, 12081, 12083, 12085, 12086, 12087, 12091, 12092, 12093, 12097, 12098, 12102, 12104, 12106, 12109, 12112, 12114, 12115, 12118, 12120, 12122, 12127, 12128, 12129, 12131, 12134, 12135, 12137, 12138, 12139, 12141, 12143, 12144, 12145, 12146, 12147, 12148, 12150, 12151, 12153, 12155, 12161, 12162, 12164, 12165, 12166, 12167, 12170, 12171, 12174, 12175, 12176, 12177, 12179, 12181, 12197, 12198, 12200, 12201, 12202, 12204, 12208, 12214, 12215, 12217, 12218, 12221, 12223, 12229, 12233, 12234, 12237, 12240, 12241, 12243, 12245, 12249, 12250, 12252, 12254, 12255, 12256, 12259, 12260, 12261, 12262, 12265, 12268, 12269, 12271, 12274, 12278, 12280, 12283, 12285, 12286, 12287, 12288, 12291, 12292, 12293, 12295, 12296, 12304, 12310, 12311, 12312, 12313, 12314, 12315, 12317, 12319, 12321, 12323, 12325, 12328, 12331, 12333, 12334, 12339, 12342, 12344, 12345, 12347, 12350, 12354, 12356, 12358, 12359, 12364, 12366, 12370, 12374, 12375, 12376, 12379, 12380, 12381, 12383, 12385, 12390, 12393, 12394, 12396, 12397, 12399, 12400, 12401, 12403, 12406, 12410, 12411, 12414, 12415, 12416, 12417, 12419, 12420, 12423, 12424, 12426, 12427, 12437, 12439, 12440, 12444, 12445, 12447, 12448, 12450, 12451, 12456, 12457, 12459, 12462, 12465, 12467, 12468, 12469, 12470, 12472, 12473, 12478, 12480, 12481, 12482, 12483, 12486, 12487, 12488, 12492, 12497, 12499, 12500, 12501, 12502, 12503, 12504, 12505, 12508, 12512, 12513, 12514, 12515, 12518, 12519, 12527, 12530, 12531, 12535, 12536, 12537, 12538, 12539, 12546, 12547, 12549, 12551, 12552, 12554, 12555, 12556, 12560, 12561, 12563, 12564, 12565, 12567, 12568, 12570, 12572, 12577, 12578, 12580, 12583, 12585, 12586, 12588, 12589, 12591, 12594, 12600, 12603, 12605, 12606, 12608, 12609, 12610, 12611, 12616, 12620, 12622, 12623, 12626, 12628, 12629, 12631, 12633, 12634, 12638, 12639, 12640, 12641, 12644, 12648, 12649, 12651, 12652, 12653, 12663, 12664, 12668, 12670, 12671, 12674, 12676, 12677, 12679, 12683, 12684, 12688, 12689, 12691, 12692, 12693, 12695, 12696, 12699, 12701, 12702, 12705, 12706, 12707, 12713, 12714, 12715, 12721, 12722, 12723, 12726, 12728, 12731, 12732, 12733, 12735, 12738, 12739, 12740, 12741, 12742, 12743, 12744, 12750, 12752, 12753, 12754, 12755, 12758, 12760, 12761, 12763, 12764, 12765, 12766, 12771, 12772, 12773, 12775, 12777, 12782, 12783, 12790, 12797, 12800, 12801, 12802, 12804, 12807, 12808, 12810, 12812, 12813, 12817, 12818, 12820, 12822, 12823, 12824, 12826, 12827, 12828, 12835, 12836, 12837, 12838, 12839, 12843, 12844, 12848, 12849, 12850, 12852, 12853, 12861, 12866, 12869, 12870, 12873, 12875, 12878, 12882, 12883, 12884, 12887, 12888, 12891, 12895, 12898, 12899, 12900, 12902, 12903, 12904, 12905, 12906, 12908, 12910, 12912, 12913, 12916, 12920, 12921, 12923, 12928, 12929, 12932, 12933, 12934, 12935, 12938, 12939, 12940, 12942, 12946, 12947, 12950, 12953, 12956, 12958, 12960, 12961, 12963, 12967, 12968, 12969, 12972, 12978, 12983, 12984, 12986, 12987, 12988, 12990, 12991, 12996, 12999, 13001, 13003, 13004, 13006, 13007, 13010, 13014, 13015, 13017, 13018, 13022, 13027, 13030, 13031, 13033, 13034, 13035, 13036, 13037, 13040, 13041, 13047, 13049, 13050, 13053, 13054, 13055, 13056, 13059, 13060, 13061, 13062, 13064, 13066, 13067, 13071, 13075, 13077, 13079, 13083, 13085, 13086, 13087, 13097, 13099, 13101, 13102, 13105, 13106, 13109, 13110, 13111, 13112, 13114, 13115, 13116, 13117, 13118, 13119, 13120, 13121, 13122, 13123, 13124, 13125, 13128, 13131, 13134, 13136, 13142, 13144, 13147, 13148, 13149, 13151, 13154, 13159, 13169, 13174, 13175, 13181, 13182, 13185, 13186, 13190, 13197, 13198, 13199, 13206, 13209, 13210, 13212, 13213, 13215, 13217, 13220, 13221, 13224, 13226, 13227, 13228, 13229, 13232, 13233, 13234, 13235, 13236, 13237, 13239, 13241, 13243, 13248, 13250, 13251, 13255, 13256, 13258, 13259, 13260, 13261, 13262, 13263, 13264, 13265, 13267, 13268, 13269, 13271, 13274, 13280, 13281, 13285, 13291, 13293, 13296, 13297, 13298, 13300, 13301, 13303, 13304, 13315, 13317, 13326, 13328, 13329, 13330, 13332, 13335, 13338, 13340, 13343, 13344, 13345, 13346, 13347, 13348, 13352, 13353, 13358, 13361, 13363, 13365, 13367, 13368, 13369, 13370, 13374, 13377, 13380, 13381, 13384, 13385, 13386, 13388, 13390, 13391, 13393, 13394, 13395, 13397, 13398, 13402, 13403, 13407, 13408, 13410, 13413, 13416, 13417, 13419, 13423, 13428, 13429, 13430, 13433, 13434, 13439, 13441, 13446, 13448, 13450, 13456, 13460, 13461, 13463, 13467, 13469, 13473, 13475, 13477, 13478, 13479, 13480, 13489, 13492, 13494, 13496, 13499, 13503, 13507, 13510, 13513, 13514, 13515, 13519, 13521, 13522, 13526, 13529, 13530, 13532, 13533, 13539, 13540, 13543, 13544, 13546, 13547, 13549, 13552, 13553, 13555, 13556, 13558, 13559, 13561, 13562, 13568, 13569, 13574, 13575, 13577, 13578, 13579, 13580, 13582, 13584, 13587, 13596, 13597, 13599, 13600, 13601, 13602, 13604, 13605, 13606, 13607, 13612, 13613, 13619, 13621, 13622, 13623, 13627, 13628, 13630, 13631, 13632, 13634, 13636, 13637, 13641, 13647, 13650, 13651, 13652, 13653, 13654, 13660, 13662, 13663, 13665, 13675, 13677, 13678, 13679, 13683, 13684, 13687, 13688, 13693, 13697, 13698, 13699, 13700, 13702, 13706, 13712, 13713, 13714, 13715, 13716, 13719, 13720, 13721, 13729, 13730, 13734, 13736, 13739, 13742, 13745, 13747, 13750, 13753, 13755, 13756, 13764, 13767, 13769, 13772, 13773, 13775, 13777, 13779, 13782, 13783, 13785, 13786, 13787, 13791, 13793, 13796, 13798, 13809, 13816, 13817, 13818, 13819, 13820, 13821, 13822, 13823, 13828, 13830, 13834, 13835, 13843, 13848, 13849, 13852, 13853, 13858, 13859, 13860, 13862, 13866, 13869, 13870, 13872, 13873, 13875, 13877, 13887, 13891, 13892, 13895, 13897, 13898, 13899, 13901, 13904, 13906, 13907, 13908, 13909, 13910, 13911, 13914, 13915, 13917, 13918, 13919, 13921, 13924, 13925, 13927, 13929, 13934, 13938, 13943, 13944, 13947, 13948, 13949, 13950, 13954, 13958, 13960, 13961, 13962, 13963, 13969, 13970, 13975, 13984, 13986, 13987, 13988, 13990, 13999, 14000, 14001, 14002, 14005, 14006, 14008, 14010, 14013, 14014, 14018, 14021, 14022, 14027, 14030, 14031, 14036, 14038, 14040, 14051, 14052, 14059, 14062, 14063, 14066, 14067, 14069, 14070, 14071, 14072, 14073, 14075, 14078, 14081, 14084, 14085, 14086, 14088, 14091, 14092, 14094, 14095, 14096, 14105, 14110, 14111, 14112, 14116, 14118, 14119, 14120, 14121, 14122, 14124, 14125, 14129, 14130, 14132, 14133, 14135, 14137, 14138, 14139, 14141, 14143, 14145, 14146, 14147.

Promoters expressing in a mixture of all root tissues at the tasseling stage of hybrid genotype plants grown in the greenhouse include SEQ IDs: 1, 4, 7, 8, 12, 13, 14, 15, 16, 17, 19, 20, 27, 29, 33, 34, 36, 37, 38, 48, 53, 54, 57, 63, 64, 65, 69, 70, 71, 73, 79, 81, 82, 88, 90, 93, 94, 96, 97, 98, 99, 102, 103, 104, 108, 110, 111, 112, 117, 123, 126, 128, 130, 131, 137, 143, 148, 152, 154, 160, 162, 168, 172, 174, 176, 179, 180, 181, 182, 183, 187, 189, 191, 193, 194, 196, 197, 199, 202, 205, 207, 211, 212, 214, 217, 232, 233, 235, 236, 237, 239, 240, 242, 244, 246, 249, 250, 251, 257, 259, 262, 264, 267, 269, 270, 271, 273, 280, 281, 285, 286, 288, 289, 293, 298, 299, 301, 302, 305, 306, 308, 309, 314, 316, 319, 322, 323, 328, 329, 332, 335, 338, 340, 346, 348, 349, 352, 353, 354, 356, 357, 359, 364, 365, 367, 371, 372, 373, 374, 376, 378, 379, 381, 382, 383, 387, 388, 393, 401, 405, 411, 412, 414, 423, 424, 428, 429, 433, 434, 436, 441, 448, 450, 452, 454, 456, 461, 463, 468, 470, 471, 474, 478, 483, 484, 485, 488, 489, 492, 496, 498, 501, 504, 507, 509, 510, 514, 515, 516, 517, 523, 525, 528, 532, 534, 537, 538, 541, 543, 544, 546, 547, 548, 554, 557, 561, 563, 571, 578, 580, 585, 591, 594, 595, 596, 601, 602, 605, 606, 608, 609, 613, 614, 619, 620, 626, 630, 631, 633, 634, 635, 636, 637, 638, 642, 643, 650, 655, 663, 665, 666, 667, 668, 669, 671, 673, 681, 683, 685, 687, 693, 694, 695, 701, 705, 706, 716, 717, 718, 719, 721, 722, 723, 724, 727, 731, 732, 733, 734, 735, 736, 739, 744, 749, 753, 757, 758, 759, 760, 761, 762, 763, 764, 765, 771, 779, 782, 783, 784, 785, 786, 792, 793, 800, 804, 806, 808, 809, 819, 820, 821, 824, 825, 826, 827, 829, 830, 833, 840, 841, 845, 849, 855, 856, 857, 858, 860, 862, 863, 865, 870, 871, 875, 876, 877, 878, 883, 887, 890, 892, 893, 895, 897, 898, 900, 903, 907, 908, 910, 911, 912, 915, 916, 919, 922, 924, 928, 932, 934, 936, 938, 939, 943, 944, 951, 953, 955, 957, 958, 959, 960, 964, 971, 974, 975, 976, 979, 980, 981, 982, 984, 985, 987, 988, 991, 993, 994, 995, 996, 997, 999, 1005, 1006, 1007, 1008, 1009, 1010, 1011, 1012, 1013, 1014, 1016, 1026, 1032, 1035, 1038, 1039, 1040, 1041, 1042, 1043, 1045, 1046, 1047, 1049, 1051, 1052, 1055, 1056, 1057, 1064, 1065, 1069, 1070, 1073, 1077, 1079, 1085, 1086, 1087, 1089, 1092, 1095, 1096, 1100, 1101, 1103, 1104, 1106, 1110, 1112, 1114, 1115, 1116, 1117, 1119, 1120, 1121, 1125, 1130, 1132, 1136, 1137, 1140, 1144, 1146, 1147, 1148, 1153, 1154, 1160, 1161, 1164, 1165, 1167, 1168, 1170, 1171, 1175, 1176, 1178, 1183, 1190, 1191, 1196, 1200, 1201, 1204, 1213, 1214, 1218, 1223, 1224, 1225, 1228, 1230, 1231, 1232, 1235, 1236, 1240, 1248, 1249, 1251, 1254, 1258, 1263, 1269, 1277, 1281, 1285, 1286, 1290, 1291, 1292, 1293, 1296, 1298, 1301, 1303, 1306, 1307, 1309, 1311, 1316, 1317, 1320, 1322, 1323, 1327, 1331, 1334, 1337, 1343, 1345, 1347, 1349, 1354, 1355, 1356, 1360, 1363, 1366, 1368, 1371, 1375, 1376, 1377, 1380, 1381, 1386, 1388, 1389, 1391, 1392, 1393, 1394, 1396, 1399, 1400, 1404, 1406, 1411, 1416, 1417, 1420, 1421, 1422, 1423, 1426, 1431, 1432, 1433, 1437, 1438, 1439, 1441, 1442, 1444, 1445, 1447, 1448, 1451, 1453, 1458, 1459, 1461, 1462, 1466, 1467, 1468, 1471, 1472, 1475, 1484, 1488, 1490, 1492, 1493, 1498, 1499, 1501, 1503, 1508, 1510, 1511, 1514, 1517, 1518, 1519, 1527, 1528, 1530, 1539, 1543, 1545, 1547, 1548, 1549, 1550, 1551, 1554, 1555, 1556, 1559, 1560, 1561, 1563, 1564, 1567, 1570, 1571, 1575, 1576, 1578, 1579, 1584, 1586, 1588, 1590, 1591, 1596, 1598, 1599, 1600, 1601, 1602, 1604, 1608, 1609, 1610, 1612, 1614, 1615, 1616, 1617, 1620, 1622, 1623, 1625, 1632, 1634, 1635, 1637, 1638, 1639, 1643, 1652, 1654, 1658, 1659, 1662, 1663, 1668, 1669, 1671, 1673, 1675, 1678, 1681, 1682, 1684, 1685, 1687, 1689, 1690, 1691, 1697, 1698, 1699, 1703, 1705, 1706, 1707, 1708, 1710, 1716, 1717, 1718, 1720, 1725, 1729, 1731, 1732, 1735, 1736, 1739, 1745, 1749, 1750, 1755, 1759, 1760, 1761, 1764, 1768, 1769, 1770, 1771, 1773, 1776, 1785, 1786, 1791, 1792, 1796, 1798, 1807, 1809, 1811, 1813, 1814, 1826, 1828, 1830, 1832, 1834, 1837, 1838, 1839, 1840, 1848, 1852, 1856, 1859, 1861, 1863, 1866, 1867, 1868, 1869, 1872, 1876, 1879, 1880, 1882, 1886, 1888, 1891, 1897, 1900, 1902, 1905, 1906, 1910, 1911, 1915, 1916, 1918, 1920, 1921, 1922, 1923, 1924, 1928, 1930, 1931, 1933, 1934, 1936, 1939, 1940, 1945, 1949, 1950, 1952, 1954, 1958, 1968, 1969, 1970, 1971, 1972, 1973, 1974, 1977, 1990, 1991, 1992, 1993, 1999, 2000, 2001, 2003, 2007, 2010, 2012, 2014, 2015, 2016, 2017, 2019, 2020, 2021, 2027, 2031, 2032, 2037, 2040, 2041, 2043, 2045, 2048, 2058, 2060, 2062, 2064, 2066, 2072, 2074, 2077, 2078, 2085, 2088, 2089, 2091, 2092, 2093, 2094, 2095, 2097, 2099, 2103, 2104, 2106, 2111, 2112, 2122, 2123, 2124, 2125, 2126, 2128, 2133, 2137, 2138, 2139, 2140, 2142, 2143, 2146, 2147, 2150, 2151, 2156, 2157, 2161, 2162, 2164, 2166, 2167, 2168, 2170, 2172, 2173, 2175, 2177, 2179, 2185, 2188, 2189, 2190, 2193, 2196, 2200, 2202, 2203, 2205, 2206, 2210, 2213, 2215, 2218, 2221, 2222, 2225, 2226, 2227, 2237, 2240, 2241, 2242, 2244, 2253, 2257, 2259, 2260, 2261, 2263, 2265, 2267, 2271, 2274, 2276, 2278, 2280, 2282, 2284, 2289, 2290, 2291, 2296, 2298, 2303, 2304, 2305, 2308, 2309, 2310, 2314, 2322, 2323, 2328, 2329, 2331, 2337, 2339, 2342, 2343, 2353, 2358, 2363, 2366, 2369, 2371, 2375, 2379, 2380, 2381, 2382, 2384, 2397, 2398, 2401, 2402, 2405, 2410, 2412, 2413, 2414, 2417, 2418, 2419, 2420, 2423, 2426, 2428, 2430, 2433, 2435, 2437, 2439, 2440, 2441, 2442, 2443, 2445, 2446, 2449, 2451, 2452, 2453, 2454, 2455, 2457, 2458, 2465, 2466, 2469, 2470, 2472, 2474, 2476, 2477, 2479, 2480, 2481, 2485, 2487, 2489, 2490, 2495, 2496, 2498, 2504, 2505, 2506, 2507, 2509, 2513, 2514, 2515, 2516, 2517, 2521, 2522, 2525, 2526, 2528, 2529, 2531, 2532, 2533, 2537, 2538, 2539, 2541, 2544, 2546, 2549, 2551, 2552, 2556, 2557, 2559, 2567, 2568, 2570, 2571, 2573, 2578, 2579, 2581, 2583, 2589, 2590, 2594, 2596, 2599, 2600, 2601, 2605, 2609, 2611, 2612, 2613, 2616, 2617, 2618, 2620, 2625, 2626, 2627, 2632, 2634, 2635, 2636, 2639, 2644, 2645, 2648, 2652, 2655, 2658, 2661, 2662, 2663, 2670, 2671, 2672, 2674, 2676, 2679, 2684, 2685, 2687, 2688, 2689, 2690, 2691, 2692, 2694, 2700, 2702, 2704, 2708, 2711, 2719, 2720, 2722, 2723, 2725, 2727, 2728, 2729, 2730, 2731, 2735, 2737, 2738, 2739, 2746, 2747, 2749, 2752, 2755, 2756, 2757, 2763, 2764, 2765, 2770, 2775, 2776, 2779, 2783, 2784, 2785, 2786, 2787, 2788, 2789, 2791, 2794, 2798, 2800, 2801, 2802, 2805, 2808, 2812, 2814, 2816, 2819, 2821, 2822, 2823, 2824, 2827, 2828, 2831, 2834, 2837, 2838, 2840, 2845, 2850, 2857, 2860, 2861, 2865, 2869, 2871, 2876, 2878, 2881, 2888, 2889, 2892, 2893, 2894, 2895, 2896, 2897, 2902, 2903, 2906, 2908, 2909, 2912, 2915, 2916, 2917, 2918, 2919, 2922, 2923, 2926, 2930, 2931, 2932, 2933, 2934, 2935, 2942, 2943, 2944, 2945, 2946, 2948, 2955, 2959, 2962, 2963, 2966, 2968, 2976, 2979, 2982, 2992, 2994, 3000, 3003, 3005, 3007, 3008, 3009, 3013, 3015, 3017, 3018, 3020, 3023, 3024, 3027, 3029, 3031, 3039, 3040, 3042, 3043, 3044, 3045, 3047, 3048, 3049, 3050, 3051, 3052, 3053, 3055, 3058, 3059, 3064, 3067, 3068, 3072, 3075, 3077, 3078, 3080, 3083, 3084, 3085, 3087, 3090, 3095, 3096, 3100, 3101, 3107, 3112, 3115, 3118, 3119, 3120, 3121, 3122, 3123, 3126, 3127, 3128, 3129, 3138, 3141, 3143, 3145, 3153, 3154, 3167, 3169, 3170, 3171, 3172, 3177, 3181, 3185, 3189, 3191, 3192, 3194, 3201, 3202, 3205, 3206, 3208, 3210, 3215, 3217, 3218, 3219, 3220, 3221, 3224, 3225, 3227, 3228, 3231, 3235, 3236, 3237, 3240, 3242, 3245, 3247, 3252, 3253, 3261, 3263, 3266, 3267, 3269, 3271, 3272, 3280, 3286, 3288, 3289, 3290, 3291, 3294, 3295, 3297, 3299, 3301, 3303, 3307, 3308, 3310, 3312, 3313, 3314, 3324, 3327, 3331, 3332, 3333, 3337, 3338, 3340, 3342, 3343, 3345, 3346, 3351, 3353, 3355, 3357, 3361, 3363, 3369, 3370, 3373, 3377, 3378, 3379, 3382, 3383, 3386, 3389, 3390, 3394, 3396, 3399, 3402, 3403, 3404, 3405, 3411, 3413, 3416, 3418, 3419, 3424, 3425, 3426, 3427, 3428, 3435, 3438, 3441, 3442, 3445, 3446, 3447, 3449, 3450, 3451, 3452, 3453, 3458, 3461, 3462, 3465, 3466, 3468, 3469, 3470, 3471, 3474, 3477, 3482, 3483, 3484, 3488, 3490, 3491, 3493, 3494, 3500, 3501, 3502, 3503, 3504, 3507, 3510, 3515, 3516, 3523, 3524, 3529, 3533, 3535, 3536, 3537, 3538, 3540, 3541, 3542, 3544, 3545, 3548, 3549, 3554, 3560, 3561, 3562, 3569, 3571, 3574, 3576, 3577, 3580, 3587, 3588, 3589, 3591, 3592, 3594, 3595, 3597, 3599, 3600, 3601, 3603, 3604, 3607, 3611, 3613, 3615, 3616, 3618, 3620, 3621, 3622, 3624, 3627, 3628, 3629, 3630, 3631, 3633, 3634, 3637, 3640, 3642, 3643, 3644, 3645, 3646, 3648, 3650, 3655, 3657, 3659, 3660, 3661, 3662, 3667, 3671, 3672, 3674, 3676, 3677, 3678, 3681, 3682, 3684, 3685, 3688, 3690, 3697, 3702, 3704, 3706, 3707, 3709, 3710, 3713, 3715, 3717, 3718, 3720, 3721, 3725, 3726, 3730, 3731, 3733, 3738, 3739, 3744, 3748, 3749, 3752, 3756, 3764, 3765, 3766, 3772, 3773, 3774, 3775, 3777, 3778, 3784, 3785, 3791, 3792, 3793, 3798, 3800, 3801, 3804, 3805, 3806, 3808, 3812, 3817, 3818, 3819, 3820, 3823, 3828, 3829, 3830, 3831, 3832, 3833, 3835, 3837, 3838, 3839, 3843, 3844, 3845, 3846, 3849, 3852, 3858, 3859, 3867, 3868, 3870, 3871, 3872, 3873, 3876, 3882, 3883, 3884, 3887, 3889, 3892, 3894, 3895, 3898, 3902, 3904, 3907, 3908, 3912, 3916, 3917, 3918, 3923, 3924, 3926, 3928, 3929, 3933, 3934, 3936, 3937, 3938, 3940, 3941, 3947, 3950, 3951, 3954, 3955, 3958, 3962, 3964, 3967, 3968, 3969, 3970, 3971, 3972, 3974, 3975, 3978, 3983, 3985, 3994, 3995, 3996, 3997, 4000, 4005, 4007, 4008, 4012, 4013, 4014, 4019, 4020, 4024, 4026, 4030, 4033, 4037, 4038, 4039, 4040, 4041, 4042, 4043, 4044, 4046, 4047, 4048, 4049, 4050, 4053, 4054, 4056, 4057, 4061, 4062, 4066, 4068, 4070, 4071, 4075, 4084, 4088, 4092, 4094, 4096, 4099, 4102, 4103, 4105, 4106, 4109, 4110, 4113, 4124, 4128, 4132, 4133, 4134, 4135, 4143, 4144, 4146, 4148, 4149, 4155, 4157, 4158, 4160, 4161, 4162, 4163, 4164, 4165, 4166, 4167, 4168, 4170, 4171, 4173, 4175, 4176, 4178, 4179, 4183, 4185, 4187, 4188, 4189, 4191, 4193, 4197, 4198, 4201, 4202, 4205, 4206, 4207, 4208, 4210, 4211, 4212, 4217, 4219, 4221, 4222, 4227, 4228, 4229, 4232, 4233, 4234, 4235, 4242, 4245, 4246, 4250, 4251, 4253, 4257, 4258, 4260, 4261, 4263, 4266, 4270, 4272, 4275, 4276, 4280, 4284, 4290, 4294, 4296, 4298, 4300, 4301, 4302, 4305, 4306, 4309, 4312, 4314, 4317, 4320, 4321, 4324, 4329, 4330, 4333, 4339, 4341, 4344, 4347, 4352, 4354, 4356, 4358, 4359, 4360, 4369, 4374, 4375, 4378, 4380, 4383, 4388, 4390, 4391, 4395, 4396, 4397, 4401, 4402, 4403, 4404, 4405, 4409, 4410, 4421, 4422, 4423, 4430, 4436, 4437, 4439, 4440, 4443, 4446, 4448, 4449, 4450, 4453, 4461, 4462, 4463, 4466, 4467, 4468, 4470, 4474, 4475, 4479, 4485, 4492, 4494, 4498, 4500, 4502, 4507, 4508, 4512, 4513, 4514, 4515, 4518, 4519, 4521, 4522, 4524, 4529, 4531, 4532, 4534, 4535, 4543, 4548, 4549, 4551, 4554, 4555, 4556, 4557, 4558, 4560, 4562, 4563, 4565, 4566, 4567, 4568, 4575, 4576, 4578, 4579, 4580, 4582, 4583, 4590, 4594, 4596, 4597, 4598, 4601, 4606, 4616, 4618, 4623, 4625, 4628, 4630, 4632, 4636, 4639, 4641, 4643, 4644, 4645, 4646, 4647, 4650, 4651, 4653, 4654, 4655, 4656, 4657, 4658, 4659, 4662, 4664, 4667, 4669, 4671, 4672, 4673, 4674, 4676, 4677, 4680, 4682, 4685, 4688, 4691, 4692, 4696, 4697, 4699, 4700, 4701, 4703, 4705, 4706, 4708, 4710, 4711, 4712, 4713, 4715, 4718, 4719, 4721, 4722, 4724, 4727, 4728, 4729, 4730, 4734, 4736, 4737, 4738, 4739, 4740, 4741, 4745, 4746, 4747, 4749, 4750, 4753, 4755, 4756, 4761, 4762, 4766, 4767, 4769, 4770, 4771, 4773, 4779, 4780, 4784, 4787, 4788, 4789, 4790, 4791, 4794, 4795, 4801, 4802, 4804, 4805, 4806, 4807, 4809, 4813, 4815, 4816, 4817, 4818, 4822, 4828, 4829, 4830, 4831, 4834, 4838, 4841, 4842, 4845, 4851, 4855, 4856, 4857, 4859, 4861, 4862, 4863, 4864, 4869, 4874, 4875, 4876, 4880, 4881, 4887, 4889, 4891, 4896, 4900, 4902, 4904, 4905, 4909, 4910, 4913, 4914, 4918, 4921, 4922, 4924, 4925, 4935, 4936, 4938, 4941, 4942, 4943, 4944, 4950, 4954, 4955, 4958, 4959, 4967, 4969, 4971, 4972, 4974, 4975, 4977, 4984, 4985, 4987, 4988, 4989, 4990, 4994, 4996, 5005, 5007, 5011, 5015, 5016, 5021, 5024, 5026, 5029, 5030, 5032, 5034, 5036, 5039, 5040, 5042, 5044, 5045, 5046, 5049, 5052, 5054, 5057, 5060, 5067, 5072, 5074, 5075, 5078, 5079, 5082, 5084, 5087, 5088, 5089, 5090, 5091, 5094, 5097, 5098, 5100, 5101, 5102, 5108, 5111, 5113, 5114, 5115, 5116, 5119, 5120, 5122, 5123, 5125, 5131, 5132, 5140, 5145, 5147, 5150, 5151, 5160, 5164, 5165, 5168, 5170, 5174, 5180, 5181, 5184, 5185, 5187, 5188, 5189, 5190, 5191, 5192, 5196, 5198, 5200, 5202, 5203, 5206, 5209, 5212, 5213, 5214, 5216, 5217, 5218, 5219, 5221, 5225, 5226, 5228, 5229, 5234, 5240, 5241, 5249, 5253, 5254, 5256, 5257, 5258, 5260, 5261, 5263, 5264, 5267, 5268, 5269, 5273, 5275, 5276, 5280, 5281, 5282, 5283, 5285, 5286, 5287, 5289, 5291, 5292, 5293, 5297, 5298, 5299, 5300, 5301, 5308, 5311, 5314, 5317, 5319, 5321, 5324, 5327, 5329, 5330, 5334, 5338, 5339, 5342, 5345, 5346, 5348, 5350, 5351, 5352, 5359, 5366, 5367, 5371, 5383, 5386, 5388, 5389, 5393, 5395, 5396, 5397, 5402, 5405, 5409, 5411, 5413, 5414, 5417, 5418, 5422, 5426, 5427, 5430, 5431, 5433, 5434, 5437, 5438, 5446, 5448, 5449, 5452, 5453, 5456, 5458, 5459, 5461, 5462, 5463, 5464, 5467, 5471, 5475, 5476, 5483, 5485, 5487, 5488, 5491, 5493, 5495, 5496, 5497, 5502, 5503, 5505, 5506, 5508, 5510, 5513, 5515, 5517, 5518,.5519, 5524, 5526, 5529, 5530, 5532, 5534, 5535, 5537, 5541, 5543, 5545, 5554, 5555, 5562, 5563, 5566, 5568, 5569, 5572, 5575, 5579, 5581, 5582, 5583, 5584, 5585, 5586, 5589, 5593, 5594, 5597, 5608, 5612, 5613, 5614, 5615, 5616, 5618, 5619, 5620, 5621, 5623, 5627, 5632, 5633, 5635, 5638, 5640, 5643, 5647, 5648, 5649, 5650, 5651, 5652, 5653, 5655, 5656, 5657, 5659, 5660, 5662, 5663, 5664, 5669, 5670, 5671, 5680, 5681, 5689, 5690, 5694, 5695, 5697, 5698, 5702, 5703, 5705, 5706, 5709, 5711, 5717, 5718, 5719, 5721, 5722, 5723, 5728, 5729, 5730, 5731, 5732, 5734, 5735, 5736, 5742, 5744, 5751, 5752, 5754, 5757, 5768, 5770, 5773, 5775, 5778, 5780, 5781, 5784, 5785, 5788, 5791, 5792, 5794, 5805, 5808, 5809, 5810, 5811, 5820, 5823, 5826, 5834, 5835, 5836, 5837, 5842, 5844, 5850, 5854, 5859, 5864, 5867, 5869, 5871, 5872, 5876, 5878, 5879, 5881, 5882, 5883, 5884, 5887, 5888, 5892, 5893, 5900, 5901, 5902, 5906, 5907, 5910, 5912, 5918, 5919, 5921, 5923, 5925, 5927, 5928, 5930, 5931, 5932, 5938, 5939, 5940, 5941, 5942, 5944, 5946, 5948, 5950, 5951, 5954, 5956, 5957, 5959, 5961, 5967, 5968, 5971, 5978, 5979, 5980, 5985, 5986, 5988, 5990, 5991, 5994, 5996, 5997, 6000, 6002, 6004, 6005, 6006, 6007, 6010, 6012, 6013, 6016, 6017, 6025, 6026, 6031, 6038, 6040, 6041, 6042, 6043, 6044, 6047, 6048, 6051, 6053, 6054, 6058, 6059, 6060, 6062, 6063, 6065, 6068, 6069, 6070, 6072, 6073, 6074, 6075, 6077, 6080, 6084, 6085, 6088, 6089, 6090, 6092, 6093, 6094, 6095, 6098, 6100, 6108, 6109, 6112, 6113, 6116, 6118, 6119, 6122, 6125, 6129, 6130, 6131, 6132, 6133, 6135, 6136, 6137, 6143, 6145, 6146, 6147, 6149, 6150, 6151, 6152, 6153, 6156, 6158, 6160, 6163, 6164, 6165, 6168, 6173, 6181, 6182, 6183, 6184, 6186, 6188, 6189, 6191, 6193, 6196, 6197, 6198, 6200, 6203, 6207, 6209, 6212, 6213, 6220, 6221, 6223, 6224, 6226, 6227, 6228, 6230, 6231, 6234, 6237, 6238, 6239, 6240, 6242, 6243, 6246, 6247, 6249, 6250, 6251, 6257, 6258, 6259, 6260, 6264, 6265, 6270, 6271, 6272, 6273, 6275, 6278, 6279, 6281, 6282, 6286, 6288, 6291, 6292, 6294, 6295, 6296, 6299, 6300, 6302, 6303, 6309, 6310, 6311, 6312, 6315, 6316, 6317, 6319, 6321, 6322, 6323, 6325, 6326, 6328, 6332, 6333, 6335, 6338, 6343, 6344, 6350, 6351, 6352, 6353, 6354, 6356, 6360, 6362, 6364, 6367, 6370, 6372, 6373, 6375, 6376, 6378, 6379, 6381, 6383, 6393, 6394, 6396, 6397, 6398, 6399, 6403, 6404, 6405, 6407, 6414, 6415, 6419, 6420, 6422, 6426, 6429, 6430, 6431, 6434, 6436, 6437, 6440, 6442, 6452, 6454, 6459, 6463, 6464, 6466, 6467, 6469, 6470, 6471, 6474, 6476, 6477, 6478, 6480, 6482, 6484, 6488, 6495, 6497, 6499, 6500, 6501, 6502, 6504, 6505, 6510, 6513, 6514, 6517, 6519, 6524, 6525, 6530, 6533, 6534, 6537, 6541, 6543, 6544, 6547, 6548, 6549, 6552, 6553, 6554, 6555, 6558, 6560, 6561, 6563, 6564, 6567, 6569, 6572, 6574, 6576, 6577, 6579, 6581, 6582, 6584, 6587, 6588, 6589, 6595, 6597, 6599, 6607, 6609, 6610, 6611, 6614, 6615, 6616, 6617, 6620, 6621, 6624, 6625, 6626, 6627, 6628, 6629, 6630, 6634, 6635, 6637, 6638, 6639, 6643, 6644, 6646, 6647, 6649, 6650, 6652, 6654, 6655, 6662, 6666, 6671, 6672, 6673, 6681, 6686, 6690, 6691, 6692, 6693, 6695, 6696, 6703, 6704, 6705, 6706, 6711, 6714, 6716, 6718, 6720, 6724, 6725, 6729, 6730, 6731, 6734, 6737, 6739, 6742, 6746, 6747, 6752, 6757, 6759, 6761, 6764, 6766, 6778, 6779, 6780, 6782, 6786, 6787, 6788, 6792, 6793, 6794, 6795, 6797, 6799, 6803, 6804, 6805, 6807, 6810, 6811, 6812, 6813, 6816, 6817, 6819, 6820, 6821, 6824, 6826, 6827, 6828, 6830, 6831, 6832, 6834, 6836, 6839, 6840, 6841, 6842, 6843, 6845, 6851, 6859, 6860, 6863, 6869, 6872, 6874, 6875, 6876, 6877, 6878, 6879, 6880, 6884, 6885, 6886, 6887, 6888, 6890, 6891, 6894, 6903, 6906, 6913, 6914, 6915, 6917, 6919, 6921, 6922, 6923, 6924, 6930, 6933, 6936, 6938, 6941, 6944, 6946, 6948, 6950, 6951, 6952, 6959, 6960, 6963, 6966, 6967, 6969, 6971, 6979, 6980, 6984, 6985, 6987, 6990, 6991, 6993, 6994, 6997, 6999, 7002, 7003, 7005, 7006, 7009, 7011, 7012, 7013, 7015, 7022, 7032, 7038, 7039, 7040, 7042, 7043, 7046, 7049, 7051, 7052, 7053, 7056, 7057, 7064, 7067, 7068, 7077, 7079, 7083, 7084, 7085, 7086, 7093, 7094, 7096, 7097, 7105, 7106, 7107, 7108, 7112, 7113, 7115, 7116, 7117, 7118, 7124, 7126, 7128, 7129, 7130, 7132, 7135, 7137, 7138, 7139, 7140, 7142, 7144, 7146, 7151, 7155, 7164, 7169, 7172, 7173, 7176, 7177, 7182, 7183, 7184, 7187, 7188, 7192, 7194, 7197, 7201, 7202, 7203, 7206, 7207, 7208, 7209, 7212, 7216, 7217, 7219, 7223, 7224, 7227, 7228, 7230, 7231, 7232, 7233, 7234, 7236, 7239, 7244, 7245, 7248, 7249, 7250, 7255, 7257, 7258, 7259, 7262, 7264, 7267, 7268, 7269, 7270, 7274, 7277, 7278, 7281, 7282, 7287, 7288, 7290, 7291, 7292, 7293, 7298, 7299, 7300, 7301, 7303, 7304, 7305, 7306, 7307, 7313, 7315, 7317, 7328, 7330, 7331, 7334, 7344, 7350, 7351, 7354, 7355, 7356, 7357, 7358, 7360, 7361, 7363, 7365, 7369, 7371, 7373, 7377, 7380, 7381, 7383, 7386, 7388, 7389, 7391, 7392, 7395, 7396, 7398, 7400, 7406, 7407, 7409, 7411, 7415, 7417, 7418, 7425, 7428, 7430, 7433, 7434, 7435, 7436, 7438, 7441, 7443, 7444, 7446, 7447, 7448, 7452, 7453, 7454, 7458, 7459, 7464, 7466, 7470, 7483, 7486, 7490, 7492, 7493, 7498, 7502, 7504, 7505, 7506, 7512, 7515, 7517, 7518, 7523, 7524, 7525, 7528, 7533, 7537, 7538, 7542, 7546, 7547, 7548, 7549, 7554, 7561, 7568, 7570, 7574, 7578, 7580, 7585, 7586, 7589, 7590, 7594, 7595, 7598, 7599, 7605, 7613, 7619, 7620, 7621, 7623, 7624, 7632, 7633, 7638, 7639, 7640, 7642, 7643, 7647, 7652, 7658, 7661, 7663, 7665, 7671, 7674, 7676, 7677, 7678, 7679, 7680, 7682, 7686, 7687, 7689, 7694, 7695, 7697, 7700, 7703, 7704, 7708, 7712, 7713, 7716, 7719, 7724, 7725, 7729, 7730, 7733, 7734, 7736, 7737, 7738, 7740, 7742, 7743, 7744, 7745, 7747, 7749, 7750, 7751, 7753, 7755, 7761, 7762, 7763, 7764, 7768, 7769, 7770, 7772, 7774, 7775, 7779, 7781, 7785, 7786, 7788, 7791, 7793, 7794, 7796, 7798, 7800, 7801, 7803, 7804, 7806, 7807, 7812, 7819, 7820, 7823, 7824, 7825, 7832, 7833, 7834, 7838, 7841, 7844, 7845, 7847, 7848, 7850, 7854, 7856, 7859, 7860, 7862, 7863, 7865, 7866, 7867, 7873, 7878, 7881, 7888, 7890, 7896, 7900, 7908, 7909, 7910, 7911, 7918, 7923, 7925, 7927, 7933, 7934, 7935, 7936, 7937, 7938, 7942, 7943, 7944, 7945, 7946, 7947, 7948, 7949, 7950, 7953, 7955, 7956, 7962, 7964, 7965, 7966, 7967, 7971, 7972, 7974, 7976, 7977, 7978, 7980, 7984, 7986, 7988, 7993, 7998, 7999, 8002, 8004, 8005, 8006, 8007, 8012, 8021, 8026, 8030, 8035, 8042, 8043, 8044, 8045, 8047, 8048, 8052, 8053, 8056, 8058, 8059, 8062, 8063, 8065, 8066, 8067, 8068, 8069, 8072, 8073, 8076, 8077, 8078, 8080, 8082, 8083, 8084, 8087, 8088, 8091, 8093, 8095, 8100, 8102, 8103, 8105, 8106, 8112, 8114, 8116, 8118, 8123, 8124, 8125, 8126, 8130, 8136, 8137, 8147, 8150, 8151, 8159, 8163, 8164, 8165, 8168, 8169, 8170, 8178, 8179, 8182, 8185, 8189, 8193, 8199, 8202, 8204, 8207, 8208, 8211, 8213, 8216, 8219, 8220, 8222, 8223, 8225, 8227, 8234, 8235, 8237, 8239, 8240, 8241, 8242, 8245, 8250, 8252, 8253, 8265, 8266, 8268, 8269, 8270, 8272, 8276, 8282, 8288, 8289, 8291, 8292, 8293, 8294, 8300, 8301, 8304, 8306, 8310, 8311, 8312, 8318, 8319, 8320, 8321, 8325, 8329, 8339, 8340, 8349, 8350, 8351, 8352, 8353, 8355, 8361, 8367, 8368, 8369, 8372, 8373, 8376, 8378, 8379, 8382, 8384, 8385, 8387, 8389, 8392, 8393, 8395, 8396, 8401, 8402, 8403, 8404, 8405, 8407, 8410, 8411, 8413, 8414, 8416, 8417, 8418, 8427, 8433, 8436, 8438, 8439, 8441, 8442, 8444, 8447, 8448, 8450, 8451, 8452, 8456, 8457, 8458, 8459, 8465, 8470, 8471, 8472, 8473, 8474, 8476, 8477, 8481, 8482, 8485, 8486, 8490, 8493, 8498, 8501, 8502, 8505, 8507, 8509, 8511, 8513, 8515, 8516, 8517, 8520, 8523, 8524, 8525, 8527, 8528, 8531, 8532, 8533, 8535, 8539, 8541, 8542, 8549, 8550, 8553, 8554, 8557, 8558, 8561, 8562, 8565, 8566, 8568, 8575, 8576, 8581, 8582, 8589, 8590, 8592, 8593, 8594, 8596, 8597, 8598, 8599, 8600, 8601, 8602, 8603, 8605, 8610, 8611, 8612, 8614, 8617, 8618, 8624, 8628, 8630, 8631, 8634, 8638, 8640, 8642, 8644, 8647, 8648, 8652, 8654, 8657, 8658, 8659, 8663, 8665, 8669, 8670, 8672, 8675, 8676, 8677, 8685, 8689, 8690, 8693, 8700, 8703, 8706, 8707, 8708, 8709, 8713, 8716, 8717, 8720, 8726, 8728, 8729, 8731, 8732, 8734, 8735, 8736, 8740, 8741, 8742, 8744, 8745, 8746, 8748, 8751, 8752, 8753, 8761, 8767, 8770, 8771, 8772, 8773, 8774, 8775, 8776, 8777, 8779, 8782, 8783, 8784, 8785, 8789, 8790, 8792, 8795, 8797, 8802, 8805, 8810, 8817, 8818, 8822, 8824, 8829, 8830, 8831, 8832, 8833, 8834, 8835, 8838, 8841, 8843, 8846, 8853, 8859, 8861, 8866, 8876, 8878, 8880, 8881, 8883, 8886, 8888, 8889, 8892, 8896, 8897, 8899, 8900, 8902, 8907, 8908, 8909, 8910, 8911, 8913, 8914, 8916, 8917, 8922, 8923, 8926, 8928, 8929, 8930, 8934, 8935, 8938, 8941, 8942, 8945, 8946, 8951, 8954, 8957, 8959, 8960, 8961, 8962, 8964, 8965, 8967, 8968, 8969, 8971, 8972, 8974, 8976, 8977, 8979, 8980, 8981, 8985, 8986, 8991, 8992, 8996, 8998, 8999, 9001, 9002, 9003, 9004, 9006, 9009, 9012, 9013, 9017, 9020, 9021, 9022, 9026, 9027, 9029, 9030, 9033, 9037, 9042, 9044, 9052, 9056, 9057, 9058, 9059, 9060, 9062, 9066, 9069, 9071, 9072, 9073, 9074, 9076, 9084, 9086, 9088, 9091, 9092, 9095, 9096, 9103, 9105, 9108, 9110, 9111, 9112, 9114, 9115, 9116, 9118, 9124, 9125, 9129, 9131, 9133, 9134, 9138, 9139, 9140, 9141, 9142, 9148, 9149, 9151, 9152, 9155, 9156, 9164, 9173, 9174, 9175, 9177, 9183, 9185, 9186, 9187, 9188, 9190, 9191, 9194, 9195, 9196, 9206, 9207, 9210, 9211, 9213, 9214, 9215, 9216, 9218, 9220, 9221, 9226, 9229, 9233, 9234, 9237, 9241, 9242, 9243, 9244, 9247, 9248, 9249, 9252, 9253, 9254, 9257, 9262, 9265, 9267, 9270, 9273, 9275, 9276, 9278, 9284, 9287, 9288, 9290, 9291, 9292, 9295, 9299, 9300, 9302, 9304, 9308, 9311, 9313, 9320, 9321, 9323, 9325, 9326, 9328, 9329, 9330, 9332, 9336, 9337, 9338, 9339, 9340, 9341, 9345, 9346, 9347, 9348, 9349, 9350, 9354, 9355, 9359, 9361, 9366, 9367, 9373, 9375, 9376, 9378, 9382, 9383, 9385, 9388, 9391, 9392, 9394, 9396, 9400, 9402, 9403, 9404, 9406, 9407, 9413, 9414, 9415, 9422, 9423, 9426, 9432, 9433, 9439, 9440, 9443, 9444, 9451, 9452, 9453, 9456, 9459, 9460, 9467, 9468, 9471, 9472, 9473, 9475, 9476, 9478, 9481, 9483, 9488, 9490, 9497, 9501, 9502, 9503, 9504, 9505, 9509, 9513, 9514, 9515, 9517, 9518, 9519, 9520, 9525, 9531, 9533, 9534, 9536, 9540, 9543, 9546, 9548, 9549, 9553, 9556, 9561, 9563, 9564, 9565, 9567, 9568, 9571, 9575, 9577, 9582, 9583, 9586, 9587, 9589, 9590, 9591, 9592, 9602, 9606, 9607, 9608, 9609, 9610, 9613, 9614, 9615, 9617, 9618, 9620, 9623, 9626, 9627, 9628, 9629, 9630, 9632, 9633, 9635, 9637, 9640, 9646, 9648, 9649, 9650, 9651, 9653, 9655, 9656, 9657, 9658, 9660, 9663, 9666, 9670, 9675, 9681, 9682, 9685, 9686, 9688, 9692, 9693, 9698, 9710, 9711, 9717, 9718, 9722, 9723, 9725, 9726, 9730, 9731, 9733, 9734, 9737, 9744, 9745, 9746, 9750, 9751, 9753, 9754, 9755, 9756, 9763, 9764, 9767, 9770, 9772, 9776, 9777, 9780, 9781, 9782, 9784, 9786, 9787, 9792, 9794, 9796, 9799, 9801, 9804, 9808, 9809, 9812, 9813, 9816, 9819, 9820, 9824, 9825, 9827, 9833, 9845, 9846, 9847, 9849, 9854, 9861, 9864, 9866, 9869, 9873, 9876, 9880, 9882, 9886, 9887, 9892, 9893, 9897, 9898, 9900, 9901, 9906, 9907, 9908, 9909, 9910, 9911, 9912, 9923, 9924, 9928, 9935, 9938, 9940, 9946, 9947, 9949, 9950, 9955, 9960, 9962, 9963, 9967, 9969, 9971, 9974, 9975, 9976, 9979, 9980, 9982, 9984, 9985, 9988, 9990, 9996, 9997, 10000, 10008, 10009, 10010, 10013, 10015, 10017, 10018, 10019, 10021, 10022, 10026, 10027, 10031, 10032, 10033, 10034, 10035, 10037, 10038, 10041, 10042, 10043, 10044, 10045, 10047, 10048, 10050, 10051, 10052, 10054, 10056, 10058, 10059, 10060, 10062, 10063, 10064, 10068, 10072, 10073, 10075, 10076, 10078, 10082, 10086, 10087, 10089, 10090, 10091, 10092, 10094, 10095, 10097, 10101, 10102, 10103, 10105, 10106, 10107, 10108, 10109, 10110, 10112, 10114, 10115, 10116, 10118, 10122, 10128, 10131, 10132, 10135, 10138, 10143, 10146, 10149, 10151, 10152, 10158, 10163, 10165, 10166, 10168, 10170, 10174, 10176, 10178, 10181, 10182, 10192, 10193, 10194, 10195, 10197, 10199, 10201, 10203, 10206, 10209, 10214, 10218, 10219, 10220, 10222, 10223, 10224, 10225, 10228, 10231, 10233, 10236, 10237, 10239, 10240, 10247, 10252, 10254, 10255, 10258, 10259, 10262, 10275, 10284, 10286, 10291, 10292, 10293, 10295, 10300, 10302, 10306, 10307, 10311, 10318, 10319, 10321, 10322, 10323, 10325, 10326, 10327, 10328, 10331, 10333, 10334, 10335, 10336, 10338, 10341, 10342, 10343, 10346, 10352, 10353, 10354, 10356, 10357, 10359, 10360, 10362, 10364, 10368, 10371, 10373, 10375, 10380, 10381, 10384, 10385, 10395, 10397, 10398, 10399, 10401, 10405, 10406, 10410, 10413, 10414, 10416, 10421, 10423, 10424, 10426, 10427, 10428, 10429, 10430, 10435, 10437, 10438, 10440, 10446, 10447, 10448, 10449, 10450, 10451, 10452, 10453, 10455, 10456, 10463, 10464, 10465, 10468, 10469, 10470, 10474, 10480, 10482, 10487, 10490, 10492, 10494, 10496, 10504, 10506, 10508, 10514, 10516, 10518, 10525, 10527, 10528, 10530, 10531, 10533, 10535, 10536, 10537, 10541, 10542, 10543, 10544, 10547, 10548, 10555, 10556, 10558, 10561, 10562, 10563, 10564, 10565, 10567, 10569, 10573, 10577, 10580, 10581, 10582, 10583, 10585, 10590, 10593, 10595, 10596, 10597, 10599, 10601, 10602, 10610, 10611, 10612, 10613, 10615, 10616, 10617, 10618, 10619, 10621, 10622, 10623, 10626, 10628, 10629, 10630, 10631, 10633, 10637, 10638, 10639, 10640, 10642, 10643, 10645, 10646, 10649, 10650, 10655, 10657, 10659, 10663, 10665, 10668, 10670, 10671, 10673, 10674, 10677, 10678, 10681, 10682, 10683, 10684, 10685, 10686, 10689, 10697, 10699, 10700, 10702, 10703, 10705, 10707, 10708, 10711, 10715, 10716, 10721, 10723, 10725, 10726, 10732, 10734, 10735, 10738, 10740, 10741, 10744, 10747, 10748, 10749, 10752, 10753, 10754, 10756, 10761, 10762, 10763, 10766, 10775, 10777, 10778, 10779, 10782, 10784, 10785, 10787, 10788, 10790, 10791, 10792, 10795, 10796, 10800, 10801, 10802, 10803, 10804, 10805, 10809, 10810, 10811, 10812, 10813, 10815, 10818, 10819, 10820, 10821, 10823, 10824, 10825, 10826, 10830, 10831, 10833, 10836, 10838, 10839, 10840, 10841, 10843, 10846, 10850, 10853, 10854, 10857, 10858, 10860, 10861, 10862, 10867, 10872, 10874, 10877, 10878, 10880, 10881, 10887, 10892, 10896, 10897, 10898, 10899, 10902, 10903, 10912, 10917, 10920, 10926, 10927, 10930, 10933, 10934, 10935, 10936, 10937, 10938, 10940, 10941, 10945, 10947, 10948, 10954, 10956, 10957, 10960, 10962, 10964, 10965, 10967, 10968, 10972, 10975, 10976, 10977, 10980, 10988, 10993, 10995, 10996, 10997, 10999, 11002, 11004, 11005, 11006, 11008, 11010, 11015, 11018, 11023, 11024, 11025, 11027, 11032, 11033, 11039, 11044, 11046, 11047, 11049, 11052, 11053, 11056, 11058, 11060, 11066, 11067, 11068, 11070, 11071, 11078, 11079, 11080, 11081, 11082, 11083, 11086, 11090, 11092, 11095, 11098, 11100, 11101, 11107, 11110, 11114, 11116, 11118, 11119, 11124, 11125, 11127, 11129, 11132, 11133, 11135, 11137, 11138, 11146, 11148, 11151, 11153, 11154, 11158, 11160, 11161, 11162, 11163, 11165, 11166, 11169, 11175, 11177, 11178, 11179, 11180, 11181, 11184, 11187, 11188, 11190, 11191, 11192, 11194, 11198, 11199, 11201, 11202, 11203, 11207, 11210, 11214, 11216, 11217, 11218, 11222, 11226, 11227, 11228, 11229, 11230, 11232, 11233, 11235, 11236, 11237, 11239, 11240, 11244, 11246, 11247, 11248, 11254, 11255, 11256, 11257, 11258, 11259, 11260, 11261, 11262, 11263, 11264, 11266, 11274, 11275, 11278, 11289, 11290, 11292, 11293, 11294, 11295, 11296, 11298, 11302, 11306, 11307, 11313, 11315, 11316, 11318, 11319, 11320, 11322, 11324, 11329, 11330, 11331, 11332, 11333, 11337, 11338, 11339, 11340, 11345, 11346, 11348, 11349, 11352, 11356, 11358, 11359, 11363, 11365, 11366, 11370, 11371, 11373, 11374, 11377, 11379, 11380, 11381, 11382, 11387, 11388, 11391, 11394, 11395, 11397, 11398, 11399, 11403, 11405, 11406, 11409, 11410, 11411, 11412, 11413, 11414, 11416, 11423, 11424, 11426, 11428, 11430, 11434, 11436, 11437, 11438, 11446, 11447, 11449, 11451, 11456, 11458, 11459, 11461, 11463, 11465, 11471, 11472, 11475, 11476, 11478, 11481, 11482, 11485, 11487, 11489, 11490, 11491, 11494, 11496, 11497, 11498, 11499, 11500, 11503, 11506, 11507, 11508, 11509, 11512, 11518, 11522, 11523, 11526, 11528, 11530, 11531, 11532, 11533, 11534, 11538, 11541, 11544, 11546, 11547, 11548, 11551, 11553, 11558, 11560, 11561, 11563, 11564, 11567, 11568, 11570, 11576, 11577, 11578, 11579, 11580, 11585, 11593, 11594, 11595, 11596, 11597, 11599, 11603, 11604, 11610, 11612, 11615, 11618, 11620, 11621, 11623, 11625, 11628, 11632, 11633, 11636, 11639, 11642, 11650, 11652, 11654, 11656, 11657, 11658, 11663, 11668, 11669, 11673, 11677, 11678, 11680, 11681, 11688, 11691, 11692, 11693, 11694, 11695, 11698, 11699, 11701, 11703, 11705, 11707, 11711, 11712, 11718, 11721, 11722, 11723, 11725, 11731, 11733, 11736, 11740, 11743, 11744, 11753, 11755, 11759, 11760, 11761, 11762, 11763, 11764, 11765, 11766, 11767, 11769, 11770, 11771, 11773, 11774, 11776, 11780, 11781, 11782, 11783, 11784, 11785, 11786, 11790, 11792, 11795, 11799, 11800, 11802, 11804, 11809, 11810, 11811, 11812, 11813, 11814, 11816, 11818, 11819, 11820, 11821, 11826, 11828, 11829, 11830, 11837, 11839, 11841, 11846, 11848, 11849, 11850, 11851, 11853, 11856, 11858, 11863, 11868, 11870, 11872, 11876, 11877, 11881, 11889, 11890, 11891, 11893, 11894, 11898, 11899, 11909, 11912, 11913, 11918, 11919, 11920, 11921, 11922, 11923, 11926, 11927, 11928, 11929, 11930, 11934, 11935, 11940, 11943, 11945, 11946, 11947, 11948, 11949, 11953, 11957, 11958, 11959, 11960, 11961, 11962, 11963, 11965, 11966, 11968, 11977, 11978, 11979, 11980, 11983, 11987, 11988, 11993, 11994, 11995, 11996, 11997, 11998, 11999, 12002, 12004, 12005, 12008, 12014, 12017, 12018, 12019, 12020, 12021, 12023, 12024, 12025, 12032, 12035, 12042, 12043, 12044, 12050, 12059, 12061, 12063, 12068, 12076, 12078, 12079, 12080, 12081, 12083, 12085, 12086, 12087, 12091, 12092, 12093, 12097, 12098, 12102, 12104, 12106, 12109, 12112, 12115, 12118, 12120, 12122, 12127, 12128, 12129, 12130, 12131, 12134, 12135, 12136, 12137, 12138, 12139, 12141, 12143, 12144, 12145, 12146, 12147, 12148, 12149, 12150, 12151, 12153, 12161, 12164, 12165, 12166, 12167, 12170, 12171, 12173, 12174, 12175, 12176, 12179, 12181, 12197, 12198, 12202, 12204, 12208, 12214, 12215, 12217, 12218, 12221, 12223, 12229, 12234, 12237, 12240, 12241, 12243, 12245, 12249, 12250, 12252, 12255, 12256, 12259, 12260, 12265, 12268, 12271, 12274, 12275, 12278, 12280, 12283, 12285, 12286, 12287, 12291, 12293, 12295, 12299, 12302, 12304, 12306, 12310, 12311, 12312, 12313, 12314, 12315, 12317, 12319, 12321, 12323, 12325, 12326, 12328, 12331, 12333, 12334, 12339, 12342, 12345, 12347, 12350, 12354, 12356, 12358, 12359, 12364, 12366, 12370, 12374, 12375, 12376, 12379, 12380, 12381, 12385, 12390, 12394, 12396, 12397, 12399, 12400, 12401, 12403, 12406, 12410, 12411, 12414, 12415, 12416, 12417, 12419, 12420, 12423, 12424, 12426, 12427, 12437, 12439, 12440, 12444, 12447, 12450, 12451, 12454, 12456, 12457, 12459, 12462, 12465, 12467, 12468, 12469, 12470, 12472, 12473, 12478, 12481, 12482, 12486, 12487, 12488, 12489, 12492, 12497, 12499, 12500, 12501, 12502, 12503, 12504, 12505, 12512, 12513, 12514, 12515, 12518, 12519, 12521, 12527, 12530, 12531, 12535, 12536, 12537, 12538, 12539, 12540, 12546, 12547, 12549, 12551, 12552, 12554, 12555, 12556, 12560, 12561, 12563, 12565, 12567, 12568, 12570, 12572, 12577, 12583, 12585, 12586, 12588, 12591, 12594, 12597, 12600, 12603, 12605, 12606, 12608, 12609, 12610, 12611, 12619, 12620, 12622, 12623, 12626, 12628, 12629, 12631, 12633, 12634, 12638, 12639, 12640, 12641, 12644, 12648, 12649, 12651, 12652, 12653, 12663, 12664, 12668, 12670, 12671, 12673, 12674, 12676, 12677, 12679, 12681, 12683, 12684, 12685, 12688, 12689, 12691, 12692, 12693, 12695, 12696, 12697, 12699, 12701, 12702, 12705, 12706, 12713, 12714, 12715, 12719, 12721, 12722, 12723, 12726, 12728, 12731, 12732, 12733, 12735, 12738, 12739, 12740, 12741, 12742, 12743, 12744, 12750, 12752, 12753, 12754, 12755, 12758, 12761, 12762, 12763, 12764, 12765, 12766, 12771, 12772, 12773, 12775, 12777, 12783, 12790, 12797, 12800, 12802, 12804, 12807, 12808, 12810, 12812, 12813, 12817, 12818, 12819, 12820, 12822, 12823, 12824, 12826, 12827, 12828, 12834, 12835, 12836, 12837, 12838, 12839, 12844, 12848, 12849, 12850, 12853, 12861, 12866, 12870, 12873, 12875, 12878, 12882, 12883, 12884, 12887, 12888, 12891, 12895, 12898, 12899, 12900, 12902, 12903, 12904, 12905, 12906, 12908, 12910, 12912, 12913, 12916, 12920, 12921, 12923, 12928, 12929, 12932, 12933, 12934, 12935, 12938, 12939, 12940, 12942, 12946, 12947, 12952, 12953, 12960, 12967, 12968, 12969, 12972, 12978, 12983, 12984, 12986, 12987, 12990, 12991, 12994, 12996, 12999, 13003, 13004, 13006, 13007, 13010, 13014, 13015, 13017, 13018, 13022, 13030, 13033, 13034, 13035, 13040, 13041, 13047, 13049, 13050, 13053, 13054, 13055, 13056, 13059, 13060, 13061, 13062, 13064, 13066, 13067, 13071, 13075, 13077, 13079, 13083, 13085, 13086, 13087, 13097, 13099, 13101, 13102, 13105, 13106, 13111, 13112, 13114, 13115, 13116, 13117, 13118, 13119, 13120, 13121, 13122, 13123, 13124, 13125, 13128, 13131, 13134, 13136, 13142, 13144, 13147, 13148, 13149, 13151, 13154, 13159, 13166, 13169, 13175, 13181, 13182, 13185, 13186, 13190, 13197, 13198, 13199, 13206, 13209, 13210, 13212, 13213, 13217, 13221, 13224, 13226, 13227, 13228, 13229, 13232, 13234, 13235, 13236, 13237, 13239, 13241, 13243, 13248, 13250, 13251, 13255, 13256, 13258, 13259, 13260, 13261, 13262, 13263, 13264, 13265, 13267, 13268, 13269, 13271, 13273, 13274, 13275, 13278, 13280, 13281, 13285, 13291, 13293, 13296, 13297, 13298, 13300, 13301, 13303, 13304, 13313, 13315, 13317, 13318, 13319, 13326, 13328, 13329, 13330, 13332, 13338, 13340, 13341, 13343, 13344, 13345, 13346, 13347, 13348, 13350, 13352, 13353, 13358, 13361, 13363, 13365, 13367, 13368, 13369, 13370, 13374, 13377, 13381, 13384, 13385, 13386, 13388, 13390, 13391, 13393, 13394, 13396, 13397, 13398, 13402, 13403, 13408, 13410, 13413, 13416, 13417, 13419, 13423, 13428, 13429, 13430, 13433, 13434, 13439, 13444, 13448, 13450, 13456, 13460, 13461, 13463, 13467, 13469, 13473, 13475, 13477, 13478, 13479, 13480, 13492, 13494, 13496, 13499, 13503, 13510, 13513, 13514, 13515, 13518, 13519, 13521, 13522, 13526, 13530, 13532, 13533, 13539, 13540, 13543, 13544, 13546, 13547, 13549, 13552, 13553, 13555, 13556, 13558, 13559, 13560, 13561, 13562, 13568, 13569, 13574, 13575, 13577, 13578, 13579, 13580, 13582, 13584, 13587, 13596, 13597, 13599, 13600, 13601, 13602, 13604, 13605, 13606, 13607, 13612, 13613, 13621, 13623, 13627, 13628, 13630, 13631, 13632, 13634, 13636, 13637, 13641, 13647, 13650, 13651, 13652, 13653, 13654, 13660, 13662, 13663, 13665, 13675, 13677, 13678, 13679, 13683, 13687, 13688, 13693, 13697, 13698, 13699, 13700, 13702, 13706, 13713, 13714, 13715, 13716, 13719, 13720, 13721, 13727, 13729, 13730, 13734, 13736, 13739, 13742, 13745, 13747, 13749, 13750, 13753, 13756, 13764, 13767, 13768, 13769, 13772, 13773, 13775, 13777, 13779, 13782, 13785, 13786, 13787, 13791, 13793, 13796, 13798, 13809, 13816, 13817, 13818, 13819, 13820, 13821, 13822, 13823, 13828, 13830, 13831, 13834, 13835, 13843, 13848, 13849, 13852, 13853, 13858, 13859, 13860, 13862, 13866, 13869, 13870, 13872, 13873, 13875, 13877, 13885, 13887, 13891, 13892, 13895, 13897, 13898, 13901, 13904, 13906, 13908, 13909, 13910, 13911, 13914, 13915, 13917, 13918, 13919, 13921, 13924, 13925, 13927, 13929, 13930, 13934, 13943, 13944, 13947, 13948, 13949, 13950, 13954, 13958, 13960, 13961, 13963, 13969, 13970, 13975, 13983, 13984, 13985, 13986, 13987, 13990, 13999, 14000, 14001, 14002, 14005, 14006, 14008, 14010, 14013, 14014, 14017, 14018, 14021, 14022, 14027, 14030, 14031, 14038, 14040, 14043, 14051, 14052, 14059, 14062, 14063, 14066, 14067, 14069, 14070, 14071, 14073, 14075, 14080, 14081, 14084, 14085, 14086, 14088, 14091, 14092, 14094, 14095, 14096, 14100, 14105, 14110, 14111, 14112, 14116, 14117, 14118, 14119, 14120, 14122, 14124, 14125, 14129, 14130, 14132, 14133, 14134, 14135, 14137, 14138, 14139, 14141, 14142, 14143, 14145, 14146, 14147.

Promoters expressing in silk tissues at the tasseling stage include SEQ IDs: 1, 4, 7, 12, 14, 15, 16, 17, 20, 21, 26, 27, 29, 32, 33, 36, 37, 45, 48, 54, 57, 61, 63, 64, 65, 79, 84, 85, 88, 92, 93, 94, 96, 98, 99, 103, 104, 108, 110, 111, 112, 117, 123, 130, 131, 136, 137, 141, 143, 148, 152, 155, 160, 162, 165, 168, 172, 174, 176, 179, 181, 183, 187, 191, 193, 194, 196, 199, 202, 204, 205, 207, 211, 212, 214, 230, 232, 233, 235, 236, 237, 240, 242, 244, 246, 249, 250, 251, 256, 257, 259, 264, 267, 271, 273, 280, 281, 286, 288, 289, 293,.298, 299, 301, 302, 303, 305, 306, 307, 308, 309, 316, 319, 322, 323, 328, 329, 332, 334, 335, 338, 340, 346, 349, 352, 353, 354, 356, 359, 364, 365, 373, 374, 376, 378, 379, 381, 383, 386, 387, 388, 396, 401, 405, 406, 407, 411, 412, 414, 416, 423, 424, 428, 431, 433, 434, 436, 441, 448, 450, 452, 456, 459, 461, 462, 463, 468, 470, 471, 474, 478, 483, 485, 488, 489, 496, 502, 504, 507, 509, 510, 514, 516, 517, 522, 523, 525, 532, 537, 538, 541, 543, 544, 546, 547, 548, 553, 554, 557, 561, 563, 565, 578, 580, 582, 585, 587, 591, 594, 595, 596, 598, 599, 601, 602, 605, 607, 609, 613, 619, 620, 623, 630, 631, 633, 634, 635, 636, 637, 638, 643, 650, 655, 656, 669, 671, 680, 681, 683, 687, 693, 694, 699, 701, 702, 705, 706, 707, 708, 716, 717, 718, 719, 722, 723, 724, 727, 731, 732, 734, 735, 736, 740, 741, 742, 744, 749, 753, 757, 759, 760, 762, 764, 765, 779, 783, 784, 785, 786, 792, 793, 800, 804, 806, 808, 809, 811, 812, 814, 815, 819, 820, 824, 825, 826, 829, 830, 833, 840, 845, 849, 855, 856, 857, 858, 860, 862, 863, 865, 870, 871, 875, 876, 877, 882, 883, 887, 890, 892, 893, 895, 897, 898, 899, 900, 903, 907, 908, 911, 912, 913, 915, 916, 917, 919, 924, 928, 932, 936, 939, 943, 944, 951, 953, 955, 957, 958, 960, 964, 971, 974, 976, 977, 978, 979, 980, 982, 983, 984, 985, 987, 988, 991, 994, 995, 997, 999, 1002, 1003, 1005, 1006, 1007, 1008, 1009, 1010, 1011, 1012, 1013, 1014, 1016, 1019, 1022, 1025, 1026, 1032, 1035, 1038, 1040, 1041, 1042, 1043, 1046, 1047, 1049, 1051, 1052, 1054, 1055, 1056, 1057, 1064, 1065, 1068, 1069, 1070, 1073, 1077, 1080, 1085, 1086, 1087, 1088, 1089, 1092, 1095, 1098, 1100, 1101, 1103, 1104, 1112, 1114, 1115, 1116, 1117, 1118, 1119, 1120, 1125, 1130, 1132, 1136, 1137, 1140, 1146, 1148, 1154, 1155, 1160, 1161, 1167, 1168, 1170, 1171, 1176, 1178, 1183, 1187, 1189, 1190, 1191, 1196, 1198, 1199, 1201, 1203, 1204, 1214, 1215, 1217, 1218, 1220, 1223, 1225, 1228, 1230, 1231, 1232, 1233, 1236, 1240, 1248, 1249, 1251, 1254, 1258, 1261, 1263, 1269, 1277, 1281, 1285, 1286, 1290, 1292, 1293, 1296, 1298, 1301, 1306, 1307, 1309, 1310, 1311, 1316, 1320, 1322, 1323, 1327, 1331, 1333, 1334, 1339, 1347, 1349, 1354, 1355, 1360, 1364, 1366, 1368, 1371, 1375, 1376, 1377, 1380, 1381, 1387, 1388, 1389, 1393, 1394, 1396, 1398, 1399, 1403, 1404, 1406, 1420, 1421, 1422, 1423, 1426, 1431, 1436, 1438, 1441, 1442, 1448, 1451, 1453, 1454, 1455, 1458, 1459, 1461, 1462, 1466, 1467, 1468, 1469, 1471, 1472, 1475, 1484, 1488, 1490, 1492, 1493, 1498, 1499, 1501, 1503, 1508, 1510, 1511, 1512, 1514, 1518, 1519, 1523, 1525, 1526, 1527, 1528, 1530, 1543, 1545, 1546, 1547, 1548, 1549, 1550, 1551, 1554, 1555, 1556, 1560, 1561, 1563, 1564, 1566, 1567, 1568, 1570, 1575, 1576, 1578, 1579, 1582, 1584, 1586, 1590, 1591, 1598, 1599, 1600, 1601, 1602, 1604, 1605, 1608, 1609, 1610, 1612, 1615, 1616, 1617, 1622, 1623, 1625, 1634, 1635, 1637, 1638, 1639, 1642, 1643, 1650, 1653, 1654, 1658, 1659, 1662, 1663, 1668, 1669, 1671, 1673, 1675, 1676, 1677, 1678, 1681, 1682, 1684, 1685, 1687, 1689, 1690, 1691, 1696, 1697, 1698, 1699, 1703, 1705, 1706, 1707, 1708, 1709, 1710, 1716, 1717, 1718, 1720, 1725, 1729, 1731, 1732, 1735, 1745, 1750, 1755, 1759, 1761, 1764, 1769, 1770, 1773, 1776, 1778, 1785, 1786, 1791, 1792, 1796, 1798, 1807, 1809, 1811, 1813, 1823, 1826, 1828, 1830, 1832, 1834, 1837, 1839, 1840, 1845, 1848, 1852, 1859, 1861, 1863, 1866, 1867, 1868, 1869, 1872, 1876, 1879, 1882, 1886, 1888, 1891, 1894, 1897, 1898, 1899, 1900, 1902, 1905, 1906, 1910, 1911, 1912, 1916, 1918, 1920, 1922, 1923, 1924, 1928, 1930, 1931, 1933, 1934, 1936, 1939, 1940, 1945, 1949, 1950, 1951, 1952, 1954, 1958, 1968, 1970, 1971, 1972, 1973, 1977, 1986, 1990, 1993, 1994, 1995, 1996, 1999, 2000, 2001, 2007, 2009, 2010, 2012, 2014, 2015, 2016, 2017, 2019, 2021, 2031, 2032, 2037, 2040, 2041, 2043, 2045, 2048, 2055, 2058, 2060, 2062, 2064, 2066, 2072, 2074, 2077, 2078, 2079, 2088, 2089, 2091, 2092, 2093, 2094, 2096, 2097, 2101, 2103, 2104, 2106, 2111, 2112, 2122, 2123, 2125, 2128, 2132, 2133, 2137, 2139, 2142, 2143, 2144, 2146, 2147, 2150, 2151, 2156, 2157, 2158, 2161, 2164, 2166, 2167, 2168, 2170, 2173, 2175, 2177, 2179, 2180, 2183, 2185, 2188, 2189, 2190, 2193, 2195, 2196, 2200, 2202, 2203, 2206, 2210, 2213, 2215, 2216, 2218, 2221, 2222, 2226, 2237, 2240, 2241, 2242, 2244, 2245, 2253, 2257, 2260, 2261, 2263, 2266, 2267, 2274, 2276, 2278, 2279, 2280, 2282, 2283, 2284, 2289, 2291, 2296, 2298, 2303, 2304, 2308, 2309, 2310, 2314, 2322, 2323, 2328, 2329, 2331, 2337, 2339, 2342, 2353, 2358, 2363, 2366, 2367, 2371, 2379, 2380, 2381, 2382, 2383, 2384, 2393, 2395, 2396, 2398, 2401, 2402, 2405, 2406, 2410, 2412, 2413, 2414, 2417, 2418, 2419, 2420, 2423, 2428, 2430, 2433, 2435, 2437, 2439, 2440, 2441, 2442, 2443, 2445, 2449, 2451, 2452, 2453, 2454, 2455, 2457, 2458, 2469, 2470, 2472, 2474, 2476, 2477, 2479, 2480, 2481, 2482, 2485, 2487, 2489, 2490, 2492, 2494, 2495, 2496, 2497, 2498, 2505, 2506, 2507, 2509, 2513, 2514, 2515, 2516, 2517, 2521, 2522, 2525, 2526, 2528, 2529, 2531, 2532, 2533, 2534, 2536, 2537, 2538, 2539, 2541, 2544, 2546, 2549, 2550, 2551, 2552, 2555, 2556, 2557, 2559, 2560, 2561, 2567, 2568, 2570, 2571, 2573, 2578, 2579, 2581, 2588, 2589, 2590, 2596, 2599, 2601, 2605, 2607, 2609, 2611, 2613, 2616, 2617, 2620, 2625, 2626, 2627, 2632, 2634, 2635, 2636, 2639, 2644, 2649, 2651, 2655, 2658, 2661, 2662, 2663, 2670, 2671, 2672, 2674, 2679, 2684, 2685, 2687, 2688, 2689, 2690, 2691, 2692, 2694, 2700, 2702, 2704, 2708, 2709, 2711, 2719, 2720, 2722, 2725, 2728, 2729, 2730, 2735, 2738, 2739, 2746, 2747, 2749, 2752, 2755, 2756, 2757, 2764, 2765, 2770, 2776, 2784, 2785, 2787, 2789, 2794, 2796, 2798, 2802, 2805, 2808, 2812, 2814, 2819, 2821, 2822, 2823, 2824, 2827, 2828, 2831, 2832, 2833, 2838, 2840, 2844, 2850, 2857, 2859, 2860, 2861, 2862, 2865, 2869, 2871, 2876, 2878, 2888, 2889, 2890, 2892, 2893, 2894, 2895, 2896, 2897, 2902, 2903, 2906, 2908, 2909, 2915, 2916, 2917, 2918, 2919, 2922, 2923, 2926, 2929, 2930, 2931, 2932, 2933, 2934, 2935, 2938, 2941, 2942, 2943, 2944, 2947, 2948, 2955, 2959, 2960, 2962, 2963, 2966, 2968, 2976, 2979, 2982, 2987, 2992, 2994, 3000, 3003, 3005, 3007, 3008, 3009, 3013, 3017, 3020, 3024, 3029, 3031, 3039, 3041, 3042, 3043, 3044, 3045, 3047, 3048, 3049, 3051, 3052, 3053, 3055, 3058, 3059, 3064, 3067, 3068, 3070, 3072, 3075, 3080, 3083, 3084, 3085, 3087, 3090, 3095, 3100, 3101, 3106, 3112, 3115, 3118, 3119, 3120, 3121, 3122, 3123, 3126, 3127, 3128, 3129, 3138, 3139, 3143, 3145, 3153, 3156, 3167, 3169, 3170, 3172, 3177, 3181, 3185, 3189, 3191, 3192, 3194, 3196, 3200, 3202, 3205, 3206, 3208, 3210, 3217, 3218, 3219, 3220, 3221, 3224, 3225, 3228, 3230, 3232, 3237, 3240, 3242, 3249, 3252, 3261, 3263, 3266, 3267, 3269, 3271, 3272, 3280, 3286, 3288, 3289, 3290, 3291, 3294, 3295, 3297, 3299, 3301, 3303, 3310, 3312, 3313, 3324, 3329, 3331, 3332, 3333, 3337, 3338, 3340, 3342, 3343, 3345, 3347, 3351, 3353, 3354, 3355, 3356, 3357, 3361, 3363, 3370, 3374, 3376, 3377, 3378, 3379, 3382, 3383, 3386, 3394, 3396, 3399, 3403, 3404, 3405, 3413, 3416, 3418, 3419, 3422, 3424, 3426, 3427, 3428, 3435, 3438, 3445, 3446, 3447, 3449, 3450, 3452, 3453, 3455, 3458, 3461, 3466, 3468, 3469, 3470, 3471, 3474, 3477, 3483, 3484, 3486, 3488, 3490, 3493, 3494, 3500, 3501, 3502, 3503, 3504, 3507, 3510, 3516, 3517, 3518, 3523, 3524, 3529, 3533, 3535, 3536, 3537, 3538, 3540, 3541, 3544, 3545, 3548, 3549, 3551, 3554, 3556, 3558, 3560, 3561, 3562, 3569, 3574, 3576, 3577, 3580, 3587, 3588, 3589, 3592, 3594, 3595, 3600, 3601, 3603, 3604, 3607, 3610, 3611, 3613, 3615, 3616, 3618, 3620, 3621, 3624, 3627, 3628, 3630, 3631, 3633, 3634, 3640, 3642, 3643, 3644, 3645, 3646, 3648, 3654, 3655, 3659, 3660, 3661, 3667, 3671, 3672, 3674, 3677, 3681, 3682, 3684, 3685, 3690, 3702, 3706, 3707, 3709, 3710, 3713, 3715, 3717, 3718, 3720, 3721, 3723, 3725, 3726, 3730, 3731, 3744, 3748, 3749, 3752, 3756, 3757, 3760, 3761, 3764, 3765, 3766, 3772, 3773, 3775, 3777, 3778, 3783, 3785, 3787, 3791, 3792, 3793, 3801, 3806, 3808, 3809, 3812, 3817, 3818, 3819, 3820, 3823, 3825, 3828, 3830, 3831, 3832, 3833, 3834, 3837, 3838, 3839, 3843, 3844, 3845, 3846, 3849, 3852, 3858, 3859, 3867, 3868, 3870, 3871, 3872, 3873, 3877, 3878, 3881, 3882, 3883, 3884, 3887, 3889, 3892, 3893, 3894, 3895, 3898, 3899, 3902, 3904, 3907, 3908, 3912, 3913, 3916, 3917, 3918, 3924, 3926, 3928, 3929, 3933, 3934, 3938, 3940, 3941, 3947, 3950, 3954, 3958, 3959, 3962, 3967, 3968, 3970, 3971, 3974, 3975, 3978, 3983, 3987, 3988, 3994, 3995, 3996, 3997, 4000, 4007, 4008, 4012, 4013, 4014, 4019, 4020, 4021, 4030, 4033, 4037, 4039, 4040, 4041, 4042, 4043, 4048, 4049, 4050, 4051, 4052, 4053, 4054, 4056, 4057, 4062, 4066, 4068, 4070, 4071, 4075, 4079, 4084, 4088, 4090, 4092, 4094, 4096, 4098, 4099, 4105, 4106, 4109, 4110, 4111, 4113, 4116, 4124, 4128, 4131, 4132, 4133, 4135, 4140, 4143, 4144, 4146, 4147, 4149, 4155, 4158, 4160, 4163, 4164, 4165, 4166, 4167, 4168, 4170, 4171, 4173, 4175, 4178, 4183, 4185, 4187, 4188, 4189, 4191, 4192, 4193, 4201, 4202, 4204, 4205, 4206, 4207, 4208, 4210, 4211, 4212, 4213, 4218, 4219, 4221, 4227, 4228, 4229, 4233, 4234, 4235, 4245, 4246, 4250, 4251, 4252, 4255, 4257, 4260, 4261, 4266, 4270, 4272, 4275, 4276, 4280, 4284, 4292, 4294, 4295, 4296, 4298, 4301, 4302, 4304, 4305, 4306, 4309, 4312, 4314, 4320, 4321, 4324, 4329, 4330, 4335, 4339, 4341, 4344, 4347, 4352, 4354, 4356, 4358, 4359, 4360, 4364, 4365, 4366, 4369, 4370, 4374, 4378, 4380, 4383, 4388, 4390, 4391, 4393, 4395, 4396, 4397, 4401, 4402, 4403, 4404, 4405, 4406, 4409, 4410, 4417, 4422, 4423, 4425, 4430, 4434, 4436, 4439, 4440, 4442, 4443, 4446, 4448, 4450, 4453, 4458, 4461, 4462, 4463, 4466, 4467, 4468, 4470, 4474, 4475, 4479, 4486, 4490, 4491, 4492, 4494, 4496, 4498, 4500, 4502, 4507, 4508, 4512, 4514, 4515, 4518, 4519, 4521, 4522, 4529, 4531, 4535, 4548, 4549, 4554, 4555, 4556, 4557, 4558, 4560, 4562, 4563, 4565, 4566, 4567, 4568, 4575, 4576, 4580, 4582, 4583, 4590, 4591, 4593, 4594, 4597, 4598, 4599, 4601, 4606, 4608, 4614, 4616, 4618, 4623, 4625, 4628, 4630, 4632, 4639, 4641, 4643, 4644, 4645, 4646, 4647, 4650, 4651, 4653, 4654, 4655, 4656, 4658, 4659, 4662, 4667, 4669, 4671, 4672, 4673, 4674, 4676, 4677, 4680, 4682, 4685, 4691, 4692, 4694, 4696, 4697, 4699, 4700, 4703, 4706, 4708, 4710, 4711, 4713, 4714, 4719, 4721, 4722, 4723, 4724, 4730, 4734, 4736, 4737, 4738, 4739, 4741, 4745, 4746, 4749, 4750, 4753, 4755, 4756, 4761, 4762, 4763, 4766, 4769, 4770, 4771, 4773, 4775, 4778, 4779, 4780, 4784, 4787, 4788, 4789, 4790, 4791, 4794, 4795, 4801, 4804, 4805, 4806, 4807, 4813, 4815, 4818, 4822, 4828, 4830, 4831, 4834, 4838, 4841, 4842, 4845, 4854, 4855, 4856, 4857, 4859, 4861, 4862, 4863, 4864, 4868, 4869, 4871, 4874, 4875, 4876, 4878, 4880, 4881, 4887, 4889, 4891, 4896, 4900, 4902, 4904, 4905, 4909, 4910, 4913, 4914, 4918, 4921, 4922, 4923, 4924, 4925, 4931, 4935, 4936, 4938, 4941, 4942, 4947, 4950, 4954, 4958, 4959, 4967, 4969, 4971, 4972, 4974, 4975, 4977, 4980, 4981, 4985, 4987, 4988, 4989, 4990, 4993, 4994, 4996, 5000, 5011, 5014, 5015, 5016, 5021, 5022, 5023, 5024, 5026, 5029, 5030, 5034, 5036, 5037, 5038, 5039, 5040, 5042, 5044, 5045, 5046, 5049, 5051, 5052, 5054, 5057, 5060, 5061, 5067, 5072, 5074, 5075, 5078, 5082, 5084, 5088, 5089, 5090, 5091, 5094, 5095, 5100, 5101, 5102, 5109, 5111, 5114, 5116, 5122, 5125, 5129, 5131, 5132, 5140, 5145, 5147, 5148, 5151, 5154, 5159, 5160, 5164, 5165, 5168, 5169, 5170, 5174, 5180, 5181, 5184, 5185, 5187, 5188, 5189, 5190, 5191, 5192, 5193, 5196, 5198, 5200, 5202, 5203, 5206, 5212, 5213, 5216, 5217, 5218, 5219, 5224, 5225, 5228, 5229, 5234, 5243, 5247, 5253, 5254, 5256, 5257, 5258, 5260, 5261, 5263, 5264, 5269, 5273, 5274, 5275, 5276, 5279, 5280, 5281, 5282, 5283, 5286, 5287, 5292, 5293, 5297, 5298, 5299, 5300, 5301, 5308, 5311, 5314, 5315, 5317, 5319, 5321, 5324, 5327, 5329, 5330, 5332, 5334, 5338, 5339, 5342, 5343, 5345, 5346, 5348, 5350, 5351, 5352, 5360, 5366, 5367, 5371, 5386, 5388, 5389, 5391, 5393, 5396, 5397, 5402, 5404, 5405, 5409, 5411, 5413, 5414, 5417, 5418, 5422, 5426, 5427, 5428, 5430, 5431, 5433, 5434, 5437, 5438, 5445, 5446, 5448, 5449, 5452, 5453, 5456, 5458, 5459, 5461, 5469, 5471, 5472, 5475, 5476, 5483, 5484, 5485, 5487, 5488, 5491, 5493, 5495, 5496, 5505, 5506, 5508, 5510, 5513, 5515, 5517, 5518, 5519, 5520, 5521, 5524, 5526, 5529, 5530, 5532, 5534, 5535, 5536, 5545, 5549, 5554, 5557, 5558, 5559, 5562, 5563, 5566, 5568, 5569, 5572, 5575, 5579, 5581, 5582, 5583, 5584, 5585, 5586, 5589, 5591, 5593, 5594, 5596, 5597, 5608, 5612, 5613, 5614, 5615, 5616, 5618, 5620, 5621, 5623, 5627, 5632, 5633, 5635, 5638, 5640, 5643, 5647, 5648, 5651, 5652, 5653, 5656, 5657, 5659, 5660, 5662, 5663, 5669, 5680, 5689, 5690, 5694, 5695, 5697, 5698, 5702, 5706, 5709, 5711, 5712, 5713, 5717, 5718, 5719, 5721, 5722, 5723, 5729, 5730, 5731, 5732, 5734, 5735, 5736, 5742, 5744, 5749, 5751, 5757, 5764, 5768, 5770, 5771, 5773, 5775, 5780, 5784, 5785, 5788, 5791, 5792, 5794, 5805, 5808, 5810, 5811, 5816, 5820, 5823, 5826, 5832, 5834, 5835, 5836, 5837, 5842, 5844, 5854, 5859, 5864, 5866, 5867, 5868, 5869, 5871, 5872, 5877, 5878, 5879, 5881, 5882, 5883, 5884, 5887, 5888, 5889, 5892, 5893, 5900, 5902, 5906, 5907, 5910, 5912, 5918, 5919, 5921, 5922, 5925, 5927, 5928, 5930, 5931, 5932, 5938, 5939, 5941, 5942, 5944, 5945, 5946, 5947, 5948, 5951, 5952, 5954, 5956, 5957, 5959, 5961, 5967, 5968, 5969, 5971, 5978, 5979, 5980, 5984, 5985, 5986, 5988, 5989, 5990, 5991, 5992, 5994, 5996, 5997, 6000, 6002, 6004, 6006, 6007, 6010, 6012, 6013, 6016, 6017, 6023, 6025, 6026, 6028, 6038, 6040, 6041, 6044, 6047, 6048, 6051, 6053, 6054, 6058, 6059, 6060, 6062, 6063, 6065, 6068, 6069, 6070, 6072, 6073, 6074, 6075, 6077, 6080, 6085, 6088, 6089, 6090, 6091, 6092, 6093, 6094, 6095, 6098, 6099, 6107, 6108, 6109, 6112, 6113, 6116, 6118, 6119, 6120, 6122, 6129, 6130, 6131, 6132, 6133, 6135, 6136, 6137, 6140, 6144, 6145, 6146, 6147, 6149, 6150, 6151, 6153, 6156, 6158, 6160, 6163, 6164, 6165, 6168, 6180, 6181, 6182, 6183, 6186, 6188, 6189, 6191, 6193, 6197, 6198, 6200, 6205, 6206, 6207, 6209, 6212, 6215, 6220, 6223, 6224, 6227, 6228, 6230, 6231, 6234, 6238, 6239, 6240, 6243, 6245, 6246, 6247, 6249, 6251, 6255, 6257, 6258, 6259, 6264, 6265, 6270, 6271, 6272, 6273, 6278, 6279, 6280, 6281, 6282, 6286, 6288, 6291, 6292, 6294, 6299, 6300, 6302, 6303, 6309, 6310, 6315, 6317, 6321, 6322, 6326, 6328, 6333, 6338, 6345, 6346, 6351, 6352, 6353, 6354, 6356, 6358, 6360, 6362, 6363, 6364, 6367, 6370, 6373, 6375, 6378, 6381, 6383, 6388, 6394, 6395, 6396, 6397, 6398, 6399, 6400, 6403, 6405, 6407, 6410, 6413, 6414, 6415, 6419, 6420, 6422, 6429, 6430, 6431, 6434, 6436, 6437, 6440, 6441, 6442, 6452, 6454, 6459, 6463, 6464, 6466, 6467, 6469, 6470, 6471, 6474, 6476, 6477, 6478, 6480, 6482, 6484, 6486, 6488, 6495, 6497, 6499, 6500, 6501, 6502, 6504, 6505, 6510, 6513, 6514, 6515, 6517, 6519, 6524, 6525, 6526, 6530, 6533, 6534, 6537, 6539, 6543, 6544, 6547, 6548, 6549, 6554, 6555, 6558, 6560, 6561, 6563, 6564, 6567, 6569, 6574, 6576, 6577, 6579, 6581, 6582, 6584, 6587, 6589, 6592, 6595, 6598, 6599, 6607, 6609, 6611, 6614, 6620, 6621, 6624, 6625, 6626, 6628, 6629, 6630, 6634, 6635, 6637, 6638, 6639, 6643, 6644, 6646, 6647, 6649, 6650, 6654, 6655, 6662, 6666, 6671, 6672, 6673, 6676, 6681, 6691, 6692, 6695, 6696, 6699, 6703, 6705, 6706, 6711, 6714, 6716, 6718, 6720, 6724, 6725, 6729, 6734, 6736, 6737, 6739, 6746, 6747, 6756, 6757, 6759, 6761, 6766, 6776, 6778, 6779, 6780, 6781, 6782, 6786, 6788, 6793, 6794, 6795, 6797, 6799, 6803, 6804, 6805, 6807, 6810, 6811, 6812, 6813, 6816, 6819, 6820, 6821, 6824, 6827, 6828, 6830, 6831, 6834, 6836, 6839, 6841, 6842, 6843, 6845, 6847, 6851, 6852, 6859, 6860, 6863, 6869, 6872, 6874, 6875, 6876, 6877, 6878, 6879, 6880, 6887, 6888, 6890, 6897, 6903, 6907, 6909, 6913, 6914, 6915, 6917, 6919, 6921, 6922, 6923, 6924, 6930, 6933, 6936, 6941, 6944, 6946, 6948, 6950, 6951, 6952, 6959, 6960, 6967, 6969, 6970, 6971, 6979, 6980, 6984, 6985, 6987, 6988, 6990, 6993, 6994, 6995, 6999, 7000, 7002, 7003, 7006, 7009, 7011, 7012, 7013, 7015, 7016, 7022, 7025, 7032, 7038, 7039, 7042, 7043, 7046, 7050, 7051, 7053, 7056, 7057, 7064, 7067, 7068, 7077, 7079, 7083, 7085, 7086, 7094, 7097, 7105, 7106, 7107, 7108, 7112, 7113, 7116, 7117, 7118, 7124, 7130, 7132, 7135, 7140, 7142, 7144, 7149, 7151, 7155, 7164, 7165, 7166, 7169, 7172, 7173, 7176, 7177, 7182, 7184, 7187, 7188, 7192, 7194, 7196, 7197, 7201, 7202, 7203, 7206, 7207, 7208, 7210, 7211, 7216, 7217, 7219, 7220, 7227, 7228, 7230, 7232, 7233, 7234, 7235, 7236, 7239, 7241, 7244, 7245, 7248, 7249, 7250, 7255, 7257, 7258, 7259, 7267, 7268, 7274, 7277, 7278, 7281, 7282, 7287, 7288, 7290, 7291, 7292, 7293, 7298, 7299, 7300, 7301, 7303, 7304, 7305, 7306, 7307, 7308, 7312, 7313, 7315, 7317, 7328, 7330, 7334, 7338, 7339, 7353, 7354, 7355, 7357, 7358, 7361, 7363, 7365, 7371, 7373, 7377, 7380, 7382, 7383, 7386, 7388, 7389, 7392, 7398, 7400, 7409, 7411, 7417, 7425, 7428, 7430, 7431, 7433, 7434, 7435, 7436, 7438, 7441, 7443, 7444, 7446, 7447, 7448, 7452, 7454, 7458, 7459, 7464, 7466, 7470, 7483, 7486, 7490, 7492, 7493, 7501, 7502, 7504, 7505, 7506, 7512, 7515, 7523, 7525, 7528, 7529, 7531, 7532, 7533, 7537, 7538, 7546, 7547, 7554, 7560, 7561, 7568, 7572, 7574, 7578, 7580, 7585, 7586, 7589, 7594, 7599, 7601, 7605, 7611, 7617, 7619, 7620, 7621, 7623, 7624, 7633, 7639, 7642, 7643, 7652, 7653, 7658, 7661, 7663, 7664, 7665, 7674, 7677, 7678, 7679, 7680, 7682, 7685, 7686, 7687, 7689, 7695, 7699, 7700, 7703, 7704, 7708, 7712, 7716, 7718, 7719, 7724, 7725, 7726, 7729, 7730, 7733, 7734, 7736, 7737, 7738, 7741, 7743, 7744, 7745, 7747, 7751, 7753, 7755, 7761, 7762, 7763, 7764, 7767, 7768, 7769, 7770, 7774, 7775, 7779, 7780, 7785, 7786, 7788, 7791, 7792, 7793, 7796, 7798, 7799, 7800, 7801, 7802, 7803, 7804, 7806, 7807, 7812, 7815, 7819, 7820, 7823, 7824, 7825, 7832, 7833, 7834, 7838, 7839, 7841, 7844, 7845, 7847, 7848, 7852, 7856, 7858, 7859, 7860, 7862, 7863, 7865, 7873, 7875, 7876, 7878, 7890, 7896, 7900, 7908, 7909, 7910, 7918, 7923, 7925, 7927, 7928, 7933, 7934, 7935, 7936, 7937, 7938, 7942, 7944, 7945, 7946, 7947, 7948, 7950, 7955, 7956, 7964, 7965, 7966, 7967, 7972, 7974, 7976, 7977, 7978, 7980, 7982, 7984, 7986, 7988, 7993, 7998, 8002, 8004, 8005, 8006, 8007, 8012, 8020, 8026, 8035, 8042, 8043, 8044, 8045, 8047, 8048, 8052, 8053, 8056, 8058, 8059, 8063, 8067, 8068, 8071, 8076, 8077, 8078, 8080, 8082, 8083, 8084, 8088, 8091, 8093, 8095, 8099, 8100, 8102, 8103, 8105, 8106, 8112, 8116, 8118, 8123, 8124, 8126, 8130, 8136, 8137, 8145, 8146, 8147, 8150, 8151, 8154, 8159, 8162, 8163, 8164, 8165, 8170, 8177, 8178, 8179, 8182, 8185, 8189, 8192, 8193, 8199, 8202, 8204, 8207, 8208, 8211, 8213, 8216, 8219, 8220, 8222, 8223, 8225, 8227, 8230, 8231, 8234, 8235, 8237, 8239, 8240, 8241, 8242, 8244, 8245, 8250, 8252, 8253, 8262, 8265, 8266, 8268, 8269, 8270, 8272, 8275, 8289, 8291, 8292, 8293, 8294, 8295, 8297, 8300, 8301, 8304, 8305, 8306, 8310, 8311, 8312, 8318, 8319, 8320, 8321, 8324, 8325, 8329, 8337, 8339, 8340, 8347, 8349, 8350, 8352, 8353, 8355, 8367, 8368, 8369, 8372, 8373, 8376, 8378, 8379, 8385, 8386, 8387, 8389, 8392, 8393, 8395, 8401, 8402, 8403, 8404, 8407, 8410, 8411, 8413, 8414, 8416, 8428, 8430, 8433, 8436, 8438, 8439, 8441, 8442, 8444, 8446, 8447, 8448, 8449, 8452, 8456, 8458, 8459, 8460, 8469, 8472, 8473, 8474, 8476, 8477, 8480, 8481, 8482, 8485, 8486, 8490, 8496, 8498, 8501, 8502, 8505, 8507, 8509, 8511, 8513, 8515, 8517, 8520, 8523, 8524, 8525, 8527, 8528, 8531, 8532, 8533, 8539, 8541, 8542, 8544, 8549, 8550, 8554, 8557, 8558, 8561, 8562, 8565, 8566, 8568, 8576, 8577, 8579, 8581, 8582, 8583, 8589, 8590, 8592, 8593, 8594, 8596, 8597, 8599, 8600, 8601, 8602, 8603, 8605, 8610, 8611, 8612, 8614, 8617, 8618, 8624, 8631, 8634, 8637, 8638, 8639, 8640, 8642, 8644, 8648, 8650, 8654, 8657, 8658, 8659, 8663, 8664, 8665, 8666, 8669, 8670, 8672, 8676, 8677, 8685, 8693, 8699, 8700, 8703, 8706, 8708, 8709, 8712, 8713, 8716, 8717, 8719, 8720, 8722, 8726, 8728, 8729, 8731, 8732, 8734, 8735, 8736, 8740, 8741, 8742, 8744, 8745, 8746, 8748, 8749, 8752, 8753, 8757, 8758, 8760, 8767, 8768, 8771, 8772, 8773, 8775, 8776, 8777, 8779, 8782, 8783, 8784, 8785, 8789, 8792, 8797, 8804, 8805, 8807, 8808, 8810, 8817, 8818, 8821, 8822, 8824, 8829, 8831, 8832, 8834, 8835, 8838, 8841, 8842, 8843, 8846, 8848, 8853, 8861, 8865, 8867, 8876, 8878, 8881, 8883, 8886, 8888, 8889, 8891, 8892, 8896, 8897, 8899, 8900, 8902, 8905, 8907, 8908, 8909, 8910, 8911, 8913, 8914, 8916, 8917, 8922, 8926, 8928, 8929, 8930, 8935, 8938, 8940, 8941, 8942, 8945, 8946, 8949, 8951, 8952, 8956, 8957, 8958, 8960, 8961, 8962, 8963, 8967, 8968, 8969, 8971, 8972, 8974, 8976, 8977, 8979, 8980, 8981, 8985, 8986, 8991, 8992, 8996, 8998, 8999, 9001, 9002, 9003, 9006, 9009, 9012, 9020, 9029, 9030, 9033, 9037, 9042, 9044, 9045, 9052, 9056, 9057, 9058, 9059, 9060, 9066, 9069, 9071, 9072, 9073, 9074, 9076, 9084, 9086, 9088, 9092, 9095, 9096, 9097, 9098, 9100, 9105, 9108, 9110, 9111, 9112, 9114, 9116, 9118, 9119, 9123, 9124, 9125, 9129, 9131, 9133, 9134, 9139, 9140, 9141, 9142, 9146, 9149, 9151, 9152, 9154, 9155, 9157, 9173, 9174, 9175, 9177, 9183, 9185, 9187, 9188, 9190, 9191, 9195, 9200, 9205, 9206, 9207, 9210, 9211, 9213, 9215, 9216, 9218, 9221, 9226, 9229, 9233, 9234, 9237, 9241, 9242, 9243, 9247, 9249, 9252, 9253, 9254, 9257, 9262, 9265, 9267, 9269, 9270, 9273, 9275, 9276, 9278, 9284, 9287, 9288, 9290, 9292, 9299, 9300, 9302, 9308, 9311, 9313, 9320, 9321, 9323, 9325, 9326, 9328, 9329, 9330, 9333, 9336, 9337, 9338, 9339, 9340, 9341, 9345, 9346, 9347, 9348, 9350, 9354, 9355, 9357, 9359, 9366, 9373, 9375, 9376, 9378, 9382, 9383, 9388, 9391, 9392, 9394, 9396, 9398, 9400, 9402, 9403, 9404, 9406, 9413, 9414, 9415, 9417, 9423, 9432, 9433, 9439, 9444, 9449, 9451, 9452, 9453, 9455, 9456, 9460, 9468, 9471, 9478, 9481, 9483, 9488, 9490, 9497, 9501, 9502, 9503, 9504, 9509, 9513, 9514, 9515, 9517, 9518, 9519, 9525, 9531, 9532, 9533, 9534, 9536, 9540, 9546, 9548, 9553, 9554, 9555, 9559, 9560, 9563, 9564, 9565, 9568, 9571, 9574, 9577, 9579, 9582, 9583, 9587, 9589, 9590, 9591, 9592, 9596, 9602, 9606, 9607, 9610, 9613, 9617, 9620, 9623, 9626, 9627, 9628, 9629, 9632, 9635, 9640, 9641, 9642, 9644, 9645, 9646, 9648, 9649, 9653, 9655, 9657, 9658, 9660, 9663, 9666, 9668, 9670, 9676, 9681, 9682, 9686, 9692, 9693, 9696, 9698, 9701, 9710, 9711, 9717, 9718, 9723, 9726, 9729, 9730, 9731, 9733, 9734, 9737, 9738, 9746, 9750, 9751, 9753, 9754, 9755, 9756, 9763, 9764, 9767, 9768, 9770, 9774, 9776, 9780, 9781, 9782, 9784, 9786, 9792, 9794, 9796, 9797, 9799, 9808, 9809, 9813, 9816, 9819, 9820, 9824, 9825, 9827, 9833, 9836, 9845, 9846, 9847, 9849, 9854, 9861, 9864, 9866, 9869, 9873, 9882, 9885, 9886, 9887, 9892, 9893, 9897, 9900, 9901, 9906, 9907, 9908, 9909, 9910, 9911, 9912, 9921, 9923, 9924, 9928, 9930, 9931, 9935, 9938, 9940, 9944, 9946, 9947, 9949, 9950, 9953, 9955, 9957, 9960, 9962, 9963, 9964, 9967, 9968, 9971, 9974, 9979, 9980, 9982, 9984, 9985, 9987, 9988, 9990, 9991, 9997, 9998, 10000, 10001, 10008, 10009, 10010, 10012, 10013, 10017, 10018, 10019, 10021, 10022, 10026, 10031, 10032, 10033, 10034, 10035, 10037, 10038, 10042, 10043, 10045, 10047, 10048, 10050, 10051, 10052, 10053, 10054, 10056, 10058, 10059, 10060, 10062, 10063, 10064, 10066, 10068, 10073, 10075, 10076, 10078, 10089, 10090, 10091, 10092, 10095, 10097, 10101, 10102, 10103, 10105, 10106, 10107, 10108, 10109, 10110, 10112, 10114, 10115, 10116, 10118, 10119, 10128, 10131, 10132, 10134, 10143, 10146, 10149, 10151, 10152, 10156, 10157, 10158, 10162, 10163, 10165, 10166, 10168, 10170, 10174, 10176, 10177, 10178, 10181, 10182, 10191, 10192, 10193, 10194, 10195, 10196, 10197, 10199, 10201, 10203, 10206, 10209, 10212, 10213, 10214, 10217, 10218, 10219, 10220, 10222, 10223, 10224, 10225, 10228, 10230, 10231, 10233, 10235, 10236, 10237, 10239, 10247, 10252, 10253, 10255, 10258, 10260, 10262, 10268, 10270, 10275, 10278, 10284, 10291, 10292, 10293, 10295, 10300, 10302, 10306, 10307, 10311, 10318, 10319, 10321, 10322, 10323, 10325, 10326, 10327, 10328, 10329, 10331, 10333, 10334, 10335, 10336, 10338, 10341, 10343, 10353, 10354, 10355, 10356, 10357, 10359, 10360, 10361, 10362, 10364, 10365, 10368, 10371, 10373, 10375, 10378, 10380, 10381, 10383, 10384, 10385, 10388, 10397, 10398, 10399, 10401, 10405, 10410, 10413, 10414, 10416, 10421, 10423, 10424, 10425, 10428, 10429, 10430, 10435, 10437, 10438, 10440, 10442, 10443, 10446, 10447, 10448, 10449, 10450, 10452, 10453, 10455, 10456, 10463, 10464, 10465, 10466, 10468, 10469, 10470, 10472, 10473, 10474, 10482, 10487, 10488, 10490, 10491, 10492, 10494, 10496, 10498, 10504, 10506, 10508, 10514, 10515, 10518, 10521, 10525, 10527, 10528, 10531, 10533, 10535, 10536, 10537, 10541, 10542, 10543, 10544, 10547, 10548, 10549, 10550, 10551, 10555, 10556, 10558, 10561, 10563, 10564, 10565, 10567, 10569, 10571, 10573, 10579, 10580, 10581, 10582, 10583, 10585, 10590, 10593, 10596, 10597, 10599, 10601, 10602, 10606, 10610, 10611, 10613, 10615, 10616, 10617, 10619, 10621, 10622, 10623, 10625, 10626, 10628, 10629, 10630, 10631, 10633, 10634, 10637, 10638, 10639, 10640, 10642, 10643, 10645, 10646, 10648, 10649, 10650, 10651, 10655, 10657, 10659, 10663, 10665, 10668, 10669, 10670, 10674, 10676, 10677, 10678, 10681, 10682, 10683, 10684, 10685, 10689, 10693, 10697, 10699, 10700, 10702, 10703, 10705, 10707, 10708, 10711, 10712, 10715, 10716, 10718, 10721, 10723, 10725, 10726, 10732, 10734, 10735, 10736, 10738, 10740, 10744, 10745, 10747, 10748, 10749, 10752, 10753, 10754, 10756, 10761, 10762, 10763, 10766, 10771, 10774, 10775, 10777, 10778, 10779, 10782, 10784, 10785, 10787, 10788, 10790, 10791, 10792, 10795, 10796, 10800, 10801, 10803, 10804, 10805, 10809, 10810, 10811, 10812, 10813, 10815, 10818, 10819, 10820, 10821, 10823, 10824, 10825, 10826, 10831, 10833, 10836, 10838, 10839, 10840, 10841, 10843, 10846, 10850, 10853, 10854, 10857, 10858, 10860, 10861, 10862, 10866, 10867, 10869, 10874, 10877, 10878, 10880, 10881, 10892, 10896, 10897, 10898, 10899, 10902, 10912, 10917, 10920, 10926, 10927, 10930, 10933, 10934, 10935, 10936, 10937, 10938, 10940, 10941, 10944, 10947, 10948, 10954, 10956, 10957, 10960, 10961, 10962, 10963, 10965, 10967, 10972, 10975, 10976, 10977, 10980, 10988, 10993, 10995, 10996, 10997, 11002, 11004, 11005, 11006, 11008, 11009, 11010, 11015, 11018, 11024, 11025, 11027, 11032, 11033, 11039, 11046, 11047, 11053, 11056, 11058, 11060, 11070, 11078, 11080, 11082, 11083, 11086, 11090, 11095, 11098, 11101, 11107, 11109, 11110, 11114, 11116, 11118, 11119, 11123, 11124, 11125, 11126, 11127, 11129, 11132, 11133, 11135, 11137, 11138, 11146, 11148, 11150, 11151, 11152, 11153, 11154, 11155, 11156, 11157, 11158, 11160, 11161, 11162, 11163, 11166, 11168, 11169, 11173, 11174, 11175, 11177, 11178, 11179, 11180, 11181, 11184, 11185, 11187, 11188, 11190, 11192, 11194, 11198, 11199, 11201, 11202, 11203, 11207, 11214, 11216, 11217, 11218, 11222, 11226, 11227, 11228, 11229, 11230, 11232, 11233, 11234, 11235, 11236, 11237, 11239, 11244, 11246, 11247, 11248, 11251, 11254, 11255, 11256, 11257, 11258, 11259, 11260, 11262, 11263, 11264, 11265, 11266, 11274, 11275, 11278, 11283, 11289, 11290, 11291, 11292, 11293, 11294, 11295, 11298, 11306, 11307, 11313, 11315, 11316, 11318, 11319, 11320, 11322, 11324, 11328, 11330, 11331, 11332, 11337, 11339, 11340, 11345, 11346, 11348, 11349, 11352, 11356, 11358, 11363, 11365, 11369, 11370, 11371, 11373, 11377, 11380, 11381, 11382, 11385, 11387, 11388, 11391, 11394, 11395, 11397, 11398, 11401, 11403, 11405, 11406, 11408, 11409, 11416, 11423, 11424, 11428, 11430, 11434, 11437, 11438, 11445, 11446, 11449, 11451, 11459, 11463, 11465, 11471, 11472, 11473, 11475, 11476, 11477, 11478, 11481, 11482, 11485, 11487, 11490, 11491, 11494, 11496, 11497, 11498, 11499, 11500, 11501, 11503, 11506, 11507, 11508, 11509, 11512, 11518, 11523, 11526, 11527, 11528, 11530, 11531, 11532, 11533, 11534, 11538, 11541, 11544, 11546, 11548, 11550, 11551, 11553, 11558, 11560, 11561, 11563, 11567, 11568, 11570, 11571, 11574, 11576, 11577, 11578, 11580, 11583, 11585, 11586, 11588, 11593, 11594, 11595, 11596, 11597, 11599, 11604, 11607, 11608, 11615, 11618, 11620, 11621, 11623, 11625, 11626, 11628, 11629, 11632, 11633, 11636, 11637, 11639, 11642, 11644, 11650, 11652, 11654, 11655, 11656, 11657, 11658, 11663, 11667, 11669, 11672, 11673, 11678, 11680, 11681, 11682, 11688, 11691, 11692, 11693, 11694, 11695, 11699, 11701, 11703, 11705, 11707, 11711, 11712, 11718, 11720, 11721, 11722, 11725, 11731, 11733, 11736, 11740, 11743, 11744, 11749, 11753, 11755, 11756, 11759, 11760, 11761, 11762, 11763, 11764, 11765, 11766, 11767, 11770, 11771, 11776, 11780, 11781, 11782, 11783, 11784, 11785, 11786, 11790, 11792, 11795, 11799, 11800, 11802, 11809, 11810, 11811, 11812, 11813, 11814, 11816, 11818, 11819, 11821, 11823, 11825, 11826, 11828, 11830, 11831, 11832, 11837, 11841, 11845, 11846, 11849, 11850, 11851, 11856, 11858, 11863, 11868, 11870, 11872, 11876, 11877, 11881, 11887, 11889, 11890, 11891, 11894, 11898, 11899, 11904, 11909, 11911, 11913, 11916, 11917, 11918, 11919, 11920, 11921, 11923, 11926, 11927, 11928, 11929, 11930, 11934, 11935, 11939, 11940, 11941, 11943, 11946, 11947, 11948, 11949, 11953, 11957, 11958, 11959, 11960, 11961, 11962, 11963, 11965, 11966, 11968, 11976, 11977, 11978, 11979, 11980, 11983, 11988, 11993, 11994, 11995, 11996, 11997, 11998, 11999, 12002, 12004, 12006, 12008, 12017, 12018, 12019, 12020, 12021, 12023, 12024, 12025, 12026, 12029, 12032, 12042, 12043, 12044, 12050, 12059, 12061, 12068, 12076, 12078, 12079, 12080, 12081, 12083, 12085, 12086, 12087, 12091, 12092, 12093, 12097, 12098, 12102, 12104, 12106, 12109, 12110, 12112, 12115, 12118, 12120, 12122, 12126, 12128, 12129, 12131, 12134, 12135, 12137, 12138, 12139, 12140, 12143, 12144, 12145, 12146, 12147, 12148, 12150, 12151, 12153, 12155, 12161, 12165, 12166, 12167, 12170, 12171, 12174, 12175, 12179, 12181, 12186, 12189, 12192, 12194, 12197, 12200, 12201, 12202, 12204, 12208, 12212, 12214, 12215, 12217, 12221, 12223, 12237, 12240, 12241, 12243, 12245, 12249, 12250, 12252, 12253, 12255, 12256, 12259, 12268, 12269, 12271, 12278, 12280, 12283, 12285, 12286, 12287, 12288, 12291, 12295, 12302, 12304, 12310, 12311, 12312, 12313, 12314, 12315, 12317, 12319, 12321, 12323, 12325, 12326, 12331, 12333, 12334, 12339, 12340, 12342, 12345, 12347, 12350, 12354, 12356, 12359, 12364, 12366, 12368, 12370, 12374, 12375, 12376, 12379, 12380, 12381, 12383, 12385, 12390, 12397, 12400, 12401, 12403, 12406, 12411, 12414, 12415, 12416, 12419, 12420, 12423, 12424, 12426, 12427, 12428, 12435, 12437, 12440, 12444, 12450, 12451, 12455, 12456, 12457, 12459, 12461, 12462, 12465, 12467, 12468, 12470, 12472, 12473, 12478, 12481, 12483, 12486, 12487, 12488, 12492, 12497, 12500, 12501, 12502, 12503, 12504, 12508, 12509, 12512, 12513, 12514, 12515, 12518, 12529, 12530, 12531, 12535, 12536, 12537, 12538, 12539, 12540, 12546, 12547, 12549, 12551, 12552, 12554, 12555, 12556, 12557, 12559, 12561, 12562, 12563, 12565, 12567, 12568, 12570, 12572, 12577, 12580, 12583, 12585, 12586, 12588, 12589, 12591, 12594, 12597, 12600, 12602, 12603, 12605, 12608, 12609, 12610, 12611, 12620, 12622, 12623, 12626, 12628, 12629, 12630, 12631, 12634, 12638, 12639, 12640, 12641, 12648, 12649, 12651, 12663, 12664, 12668, 12670, 12671, 12674, 12679, 12681, 12683, 12684, 12688, 12689, 12691, 12693, 12695, 12696, 12697, 12699, 12701, 12702, 12707, 12713, 12714, 12715, 12723, 12729, 12731, 12732, 12733, 12735, 12738, 12739, 12740, 12741, 12742, 12743, 12750, 12752, 12753, 12754, 12755, 12757, 12758, 12761, 12762, 12763, 12764, 12765, 12766, 12771, 12772, 12773, 12775, 12777, 12783, 12784, 12790, 12794, 12797, 12800, 12802, 12803, 12807, 12808, 12810, 12812, 12813, 12817, 12820, 12822, 12823, 12824, 12826, 12827, 12834, 12835, 12836, 12837, 12838, 12839, 12843, 12844, 12848, 12849, 12850, 12853, 12858, 12861, 12866, 12870, 12873, 12875, 12878, 12882, 12884, 12887, 12888, 12891, 12895, 12898, 12899, 12900, 12901, 12902, 12903, 12904, 12905, 12906, 12908, 12910, 12912, 12913, 12916, 12920, 12921, 12922, 12928, 12929, 12931, 12932, 12933, 12934, 12935, 12940, 12946, 12947, 12950, 12953, 12960, 12961, 12963, 12967, 12968, 12969, 12978, 12983, 12984, 12986, 12987, 12990, 12991, 12999, 13003, 13004, 13010, 13014, 13015, 13017, 13018, 13022, 13027, 13030, 13032, 13033, 13034, 13035, 13036, 13037, 13040, 13041, 13047, 13049, 13050, 13053, 13054, 13055, 13056, 13061, 13062, 13064, 13066, 13071, 13075, 13079, 13081, 13082, 13085, 13086, 13087, 13097, 13099, 13101, 13102, 13105, 13106, 13110, 13111, 13112, 13114, 13115, 13116, 13117, 13118, 13120, 13121, 13122, 13123, 13124, 13125, 13128, 13131, 13134, 13136, 13142, 13147, 13148, 13149, 13151, 13154, 13156, 13159, 13160, 13166, 13169, 13175, 13181, 13182, 13185, 13186, 13190, 13197, 13198, 13199, 13206, 13209, 13210, 13212, 13213, 13215, 13217, 13220, 13221, 13222, 13224, 13226, 13227, 13228, 13231, 13232, 13233, 13234, 13235, 13236, 13237, 13239, 13241, 13243, 13248, 13250, 13251, 13255, 13259, 13260, 13261, 13262, 13263, 13264, 13267, 13268, 13269, 13271, 13274, 13280, 13281, 13296, 13297, 13298, 13300, 13301, 13303, 13304, 13315, 13316, 13317, 13323, 13326, 13328, 13329, 13330, 13332, 13340, 13343, 13345, 13346, 13347, 13348, 13350, 13352, 13358, 13361, 13363, 13367, 13368, 13369, 13370, 13373, 13377, 13381, 13384, 13385, 13386, 13388, 13391, 13393, 13394, 13396, 13397, 13401, 13402, 13403, 13408, 13410, 13416, 13417, 13419, 13423, 13429, 13430, 13433, 13439, 13448, 13450, 13451, 13456, 13457, 13460, 13463, 13467, 13469, 13473, 13475, 13477, 13478, 13480, 13492, 13494, 13496, 13498, 13499, 13503, 13513, 13514, 13515, 13519, 13521, 13522, 13526, 13529, 13530, 13532, 13533, 13539, 13540, 13543, 13544, 13545, 13546, 13547, 13549, 13552, 13553, 13555, 13558, 13559, 13561, 13562, 13568, 13569, 13572, 13574, 13577, 13578, 13580, 13582, 13584, 13587, 13597, 13598, 13599, 13600, 13601, 13602, 13604, 13605, 13606, 13612, 13613, 13621, 13623, 13627, 13628, 13630, 13631, 13632, 13634, 13636, 13637, 13638, 13641, 13643, 13647, 13650, 13651, 13652, 13653, 13654, 13662, 13663, 13665, 13668, 13669, 13675, 13676, 13677, 13678, 13679, 13683, 13686, 13687, 13688, 13689, 13697, 13698, 13699, 13700, 13702, 13706, 13710, 13712, 13713, 13714, 13715, 13716, 13719, 13720, 13727, 13729, 13736, 13739, 13742, 13745, 13747, 13749, 13750, 13753, 13756, 13761, 13764, 13767, 13772, 13773, 13775, 13777, 13779, 13782, 13783, 13786, 13787, 13791, 13793, 13795, 13796, 13798, 13799, 13809, 13812, 13813, 13816, 13817, 13818, 13819, 13822, 13823, 13828, 13830, 13831, 13834, 13835, 13840, 13843, 13849, 13852, 13858, 13860, 13862, 13866, 13869, 13870, 13872, 13873, 13875, 13877, 13885, 13887, 13891, 13892, 13895, 13897, 13898, 13901, 13906, 13908, 13909, 13910, 13911, 13917, 13918, 13919, 13920, 13921, 13924, 13925, 13927, 13929, 13934, 13938, 13947, 13948, 13950, 13952, 13953, 13954, 13958, 13960, 13961, 13963, 13969, 13970, 13971, 13975, 13981, 13984, 13986, 13987, 13990, 13991, 13999, 14000, 14001, 14005, 14006, 14008, 14009, 14013, 14014, 14017, 14018, 14022, 14027, 14030, 14031, 14035, 14038, 14040, 14051, 14052, 14059, 14062, 14063, 14066, 14067, 14069, 14070, 14071, 14072, 14073, 14075, 14080, 14081, 14085, 14086, 14088, 14091, 14092, 14093, 14094, 14096, 14097, 14111, 14112, 14116, 14117, 14118, 14119, 14122, 14124, 14125, 14129, 14130, 14132, 14133, 14135, 14137, 14138, 14139, 14142, 14143, 14145, 14146, 14147.

Promoters expressing in silk tissue at the tasseling stage in hybrid genotype plants grown in the greenhouse include SEQ IDs: 1, 4, 7, 11, 12, 13, 14, 15, 16, 17, 20, 26, 27, 32, 33, 36, 37, 45, 48, 53, 54, 57, 61, 63, 64, 65, 79, 84, 88, 90, 93, 94, 96, 97, 98, 99, 103, 104, 108, 110, 111, 112, 117, 123, 130, 131, 133, 137, 141, 143, 148, 152, 155, 160, 162, 165, 168, 172, 174, 176, 179, 181, 183, 187, 191, 193, 194, 196, 199, 202, 204, 205, 207, 211, 212, 214, 230, 232, 233, 235, 236, 237, 240, 242, 244, 246, 249, 250, 251, 257, 259, 264, 267, 269, 270, 271, 273, 280, 281, 286, 288, 289, 293, 298, 299, 301, 302, 303, 305, 306, 307, 308, 309, 316, 319, 322, 328, 329, 332, 334, 338, 340, 346, 349, 352, 353, 354, 356, 359, 364, 365, 367, 373, 374, 378, 379, 381, 382, 383, 386, 387, 388, 393, 401, 405, 406, 407, 411, 412, 414, 416, 423, 424, 428, 431, 433, 434, 436, 441, 448, 450, 452, 456, 459, 461, 462, 463, 468, 470, 471, 474, 478, 483, 484, 485, 488, 489, 496, 504, 507, 509, 510, 514, 516, 517, 522, 523, 525, 532, 537, 538, 541, 543, 544, 546, 547, 548, 554, 561, 563, 565, 578, 580, 582, 585, 587, 591, 594, 595, 596, 598, 599, 601, 602, 605, 606, 613, 619, 620, 623, 626, 630, 631, 633, 634, 635, 636, 637, 638, 643, 650, 655, 656, 669, 671, 680, 681, 683, 687, 693, 694, 699, 701, 702, 705, 706, 716, 717, 718, 719, 722, 723, 724, 727, 732, 734, 735, 740, 741, 742, 744, 746, 749, 753, 757, 759, 764, 765, 779, 783, 784, 785, 786, 792, 793, 800, 804, 806, 808, 809, 811, 812, 819, 820, 821, 829, 830, 833, 840, 845, 849, 855, 856, 857, 858, 859, 860, 862, 863, 865, 868, 870, 871, 875, 876, 877, 883, 887, 890, 892, 893, 895, 897, 898, 900, 903, 907, 908, 910, 911, 912, 916, 917, 919, 924, 925, 928, 932, 936, 939, 943, 944, 951, 953, 955, 957, 958, 960, 964, 965, 971, 974, 976, 977, 978, 979, 980, 982, 983, 984, 985, 987, 988, 991, 994, 995, 997, 999, 1005, 1006, 1007, 1008, 1009, 1010, 1011, 1012, 1013, 1014, 1016, 1019, 1022, 1025, 1026, 1032, 1038, 1039, 1040, 1041, 1042, 1043, 1046, 1047, 1049, 1051, 1052, 1054, 1055, 1056, 1057, 1064, 1065, 1068, 1069, 1070, 1073, 1077, 1079, 1080, 1085, 1086, 1087, 1088, 1089, 1092, 1095, 1096, 1100, 1101, 1103, 1104, 1112, 1114, 1115, 1116, 1117, 1119, 1125, 1130, 1132, 1136, 1137, 1140, 1146, 1147, 1148, 1154, 1155, 1160, 1161, 1165, 1167, 1168, 1169, 1170, 1171, 1176, 1178, 1183, 1189, 1190, 1191, 1196, 1198, 1199, 1201, 1203, 1204, 1214, 1217, 1218, 1220, 1223, 1225, 1228, 1230, 1231, 1232, 1236, 1240, 1243, 1244, 1248, 1249, 1251, 1254, 1258, 1261, 1263, 1269, 1277, 1281, 1285, 1286, 1290, 1292, 1293, 1296, 1298, 1301, 1303, 1306, 1307, 1309, 1310, 1311, 1316, 1320, 1322, 1323, 1327, 1331, 1333, 1334, 1339, 1343, 1346, 1347, 1349, 1354, 1355, 1360, 1364, 1366, 1367, 1368, 1371, 1375, 1376, 1377, 1380, 1381, 1387, 1388, 1389, 1393, 1394, 1396, 1398, 1399, 1404, 1406, 1417, 1420, 1421, 1422, 1423, 1426, 1431, 1433, 1436, 1438, 1441, 1442, 1448, 1451, 1453, 1454, 1455, 1458, 1459, 1461, 1462, 1466, 1467, 1468, 1469, 1471, 1472, 1475, 1484, 1488, 1490, 1493, 1498, 1499, 1501, 1503, 1508, 1510, 1511, 1514, 1518, 1519, 1525, 1526, 1527, 1528, 1530, 1543, 1545, 1546, 1547, 1549, 1550, 1551, 1553, 1554, 1555, 1556, 1560, 1561, 1563, 1564, 1566, 1567, 1568, 1570, 1575, 1576, 1578, 1579, 1582, 1584, 1586, 1590, 1591, 1597, 1598, 1599, 1601, 1602, 1604, 1605, 1608, 1609, 1610, 1612, 1614, 1615, 1616, 1617, 1622, 1623, 1625, 1634, 1635, 1636, 1637, 1638, 1639, 1642, 1643, 1653, 1654, 1658, 1659, 1662, 1663, 1668, 1669, 1671, 1673, 1675, 1676, 1677, 1678, 1681, 1682, 1684, 1685, 1687, 1689, 1690, 1691, 1696, 1697, 1698, 1699, 1703, 1705, 1706, 1707, 1708, 1709, 1710, 1716, 1717, 1720, 1723, 1725, 1731, 1732, 1735, 1750, 1755, 1759, 1760, 1761, 1764, 1769, 1770, 1773, 1776, 1785, 1786, 1791, 1792, 1796, 1798, 1807, 1809, 1811, 1813, 1823, 1826, 1828, 1830, 1832, 1834, 1837, 1839, 1840, 1848, 1852, 1859, 1861, 1863, 1866, 1868, 1869, 1872, 1876, 1879, 1882, 1886, 1888, 1891, 1894, 1897, 1900, 1902, 1905, 1906, 1910, 1911, 1912, 1916, 1918, 1920, 1922, 1923, 1924, 1928, 1933, 1934, 1936, 1939, 1940, 1945, 1949, 1950, 1951, 1952, 1954, 1958, 1968, 1970, 1971, 1972, 1973, 1977, 1986, 1990, 1991, 1993, 1994, 1995, 1996, 1999, 2000, 2001, 2007, 2009, 2010, 2012, 2014, 2015, 2016, 2017, 2019, 2021, 2031, 2032, 2037, 2040, 2041, 2043, 2045, 2048, 2055, 2058, 2060, 2062, 2064, 2066, 2072, 2074, 2077, 2078, 2079, 2088, 2089, 2091, 2092, 2093, 2094, 2096, 2099, 2101, 2103, 2104, 2106, 2111, 2112, 2116, 2117, 2122, 2123, 2124, 2125, 2128, 2132, 2133, 2137, 2139, 2140, 2142, 2143, 2144, 2146, 2147, 2150, 2151, 2154, 2155, 2156, 2157, 2161, 2164, 2166, 2167, 2168, 2170, 2172, 2173, 2175, 2177, 2179, 2180, 2183, 2185, 2188, 2189, 2190, 2193, 2195, 2196, 2200, 2202, 2203, 2206, 2210, 2213, 2215, 2216, 2218, 2221, 2222, 2226, 2237, 2240, 2242, 2244, 2245, 2253, 2257, 2260, 2261, 2263, 2267, 2274, 2276, 2278, 2280, 2282, 2284, 2289, 2291, 2296, 2298, 2303, 2304, 2305, 2308, 2309, 2310, 2314, 2322, 2323, 2328, 2329, 2331, 2337, 2339, 2342, 2353, 2358, 2363, 2366, 2367, 2371, 2379, 2381, 2382, 2383, 2384, 2393, 2395, 2396, 2398, 2401, 2402, 2405, 2406, 2410, 2412, 2413, 2414, 2417, 2418, 2419, 2420, 2422, 2423, 2428, 2430, 2433, 2435, 2437, 2439, 2440, 2441, 2442, 2443, 2445, 2446, 2449, 2451, 2452, 2453, 2454, 2455, 2457, 2458, 2465, 2469, 2470, 2471, 2472, 2474, 2476, 2477, 2479, 2480, 2481, 2482, 2485, 2487, 2489, 2490, 2491, 2492, 2494, 2495, 2496, 2497, 2498, 2505, 2506, 2507, 2509, 2513, 2514, 2515, 2516, 2517, 2521, 2522, 2525, 2526, 2528, 2529, 2531, 2532, 2533, 2537, 2538, 2539, 2541, 2544, 2546, 2547, 2548, 2549, 2551, 2552, 2555, 2557, 2567, 2568, 2570, 2571, 2573, 2578, 2579, 2581, 2588, 2589, 2590, 2594, 2596, 2599, 2601, 2605, 2607, 2609, 2611, 2613, 2616, 2617, 2620, 2625, 2626, 2627, 2632, 2634, 2635, 2636, 2639, 2644, 2645, 2648, 2649, 2650, 2651, 2658, 2661, 2662, 2663, 2670, 2671, 2672, 2674, 2679, 2684, 2685, 2687, 2688, 2689, 2691, 2692, 2694, 2696, 2700, 2702, 2704, 2708, 2709, 2711, 2719, 2720, 2722, 2725, 2728, 2729, 2730, 2735, 2737, 2738, 2739, 2746, 2747, 2749, 2752, 2755, 2756, 2757, 2764, 2765, 2770, 2776, 2783, 2784, 2785, 2787, 2788, 2789, 2791, 2798, 2800, 2802, 2805, 2808, 2812, 2814, 2816, 2819, 2821, 2822, 2823, 2824, 2827, 2828, 2831, 2832, 2833, 2838, 2840, 2844, 2845, 2850, 2857, 2860, 2861, 2862, 2865, 2869, 2871, 2876, 2878, 2888, 2889, 2890, 2892, 2893, 2894, 2896, 2897, 2902, 2903, 2906, 2908, 2909, 2912, 2914, 2915, 2916, 2917, 2918, 2919, 2922, 2923, 2926, 2930, 2931, 2932, 2933, 2934, 2935, 2938, 2941, 2942, 2943, 2944, 2945, 2946, 2947, 2948, 2955, 2959, 2960, 2962, 2963, 2966, 2968, 2969, 2976, 2979, 2982, 2992, 2994, 3000, 3003, 3005, 3007, 3008, 3009, 3013, 3017, 3018, 3020, 3023, 3024, 3029, 3031, 3039, 3042, 3043, 3044, 3045, 3047, 3048, 3049, 3051, 3053, 3055, 3058, 3059, 3064, 3067, 3068, 3069, 3070, 3072, 3075, 3080, 3083, 3084, 3085, 3087, 3090, 3095, 3100, 3101, 3106, 3112, 3115, 3118, 3119, 3120, 3121, 3122, 3123, 3126, 3127, 3128, 3129, 3138, 3139, 3141, 3143, 3145, 3153, 3156, 3167, 3169, 3170, 3171, 3172, 3177, 3181, 3185, 3189, 3191, 3192, 3194, 3196, 3202, 3205, 3206, 3208, 3210, 3217, 3218, 3219, 3220, 3221, 3224, 3225, 3228, 3230, 3232, 3237, 3240, 3242, 3249, 3254, 3260, 3261, 3263, 3266, 3267, 3268, 3269, 3272, 3280, 3286, 3288, 3289, 3290, 3291, 3294, 3295, 3297, 3299, 3301, 3303, 3310, 3312, 3313, 3324, 3327, 3329, 3331, 3332, 3333, 3337, 3338, 3340, 3342, 3343, 3345, 3346, 3351, 3353, 3354, 3355, 3357, 3361, 3363, 3369, 3370, 3374, 3376, 3377, 3378, 3379, 3381, 3382, 3383, 3386, 3394, 3396, 3399, 3403, 3404, 3405, 3413, 3416, 3418, 3419, 3422, 3424, 3426, 3427, 3428, 3435, 3440, 3445, 3446, 3447, 3449, 3450, 3452, 3453, 3455, 3458, 3461, 3462, 3466, 3468, 3469, 3470, 3471, 3474, 3477, 3482, 3483, 3484, 3486, 3488, 3490, 3493, 3494, 3500, 3501, 3502, 3503, 3504, 3507, 3516, 3523, 3524, 3529, 3533, 3535, 3536, 3537, 3538, 3540, 3541, 3544, 3545, 3548, 3549, 3551, 3552, 3554, 3556, 3560, 3561, 3562, 3569, 3571, 3574, 3576, 3577, 3580, 3587, 3588, 3589, 3592, 3594, 3595, 3599, 3600, 3601, 3603, 3604, 3607, 3610, 3611, 3613, 3615, 3616, 3618, 3620, 3621, 3624, 3627, 3628, 3630, 3631, 3633, 3634, 3640, 3642, 3643, 3644, 3645, 3646, 3648, 3650, 3654, 3655, 3659, 3660, 3661, 3663, 3667, 3669, 3671, 3672, 3673, 3674, 3677, 3681, 3684, 3685, 3688, 3690, 3697, 3702, 3706, 3707, 3709, 3710, 3713, 3715, 3717, 3718, 3720, 3721, 3725, 3730, 3731, 3733, 3744, 3748, 3749, 3752, 3756, 3760, 3761, 3762, 3764, 3765, 3766, 3772, 3773, 3775, 3777, 3778, 3784, 3785, 3791, 3792, 3793, 3801, 3804, 3808, 3809, 3812, 3817, 3818, 3819, 3820, 3823, 3825, 3828, 3830, 3831, 3832, 3833, 3834, 3837, 3838, 3839, 3843, 3844, 3846, 3849, 3852, 3858, 3859, 3867, 3868, 3870, 3871, 3872, 3873, 3877, 3881, 3883, 3884, 3887, 3889, 3892, 3893, 3894, 3895, 3896, 3898, 3899, 3902, 3904, 3907, 3908, 3912, 3913, 3916, 3917, 3918, 3923, 3924, 3926, 3928, 3929, 3933, 3934, 3938, 3940, 3941, 3947, 3950, 3954, 3958, 3959, 3962, 3967, 3968, 3970, 3971, 3974, 3975, 3978, 3983, 3987, 3988, 3994, 3995, 3996, 3997, 4000, 4005, 4007, 4008, 4012, 4013, 4014, 4021, 4030, 4033, 4037, 4039, 4040, 4041, 4042, 4043, 4044, 4047, 4048, 4049, 4050, 4053, 4054, 4056, 4057, 4062, 4066, 4068, 4070, 4075, 4079, 4084, 4088, 4090, 4092, 4094, 4096, 4098, 4099, 4105, 4106, 4109, 4110, 4111, 4113, 4115, 4124, 4128, 4131, 4132, 4133, 4134, 4135, 4140, 4143, 4144, 4146, 4149, 4155, 4158, 4160, 4163, 4164, 4165, 4166, 4167, 4168, 4170, 4171, 4173, 4175, 4176, 4178, 4179, 4183, 4185, 4187, 4188, 4189, 4191, 4192, 4193, 4201, 4202, 4205, 4206, 4207, 4208, 4210, 4211, 4212, 4217, 4219, 4221, 4227, 4228, 4229, 4233, 4234, 4235, 4245, 4246, 4250, 4251, 4255, 4257, 4260, 4261, 4266, 4270, 4272, 4275, 4276, 4280, 4284, 4292, 4294, 4295, 4296, 4298, 4301, 4302, 4304, 4305, 4306, 4309, 4312, 4314, 4317, 4320, 4321, 4324, 4329, 4330, 4335, 4337, 4341, 4343, 4344, 4347, 4352, 4354, 4356, 4358, 4360, 4364, 4365, 4366, 4367, 4369, 4370, 4374, 4378, 4380, 4383, 4390, 4391, 4393, 4395, 4396, 4397, 4401, 4402, 4403, 4404, 4405, 4409, 4410, 4417, 4419, 4422, 4423, 4425, 4430, 4434, 4436, 4439, 4440, 4443, 4446, 4448, 4450, 4453, 4461, 4462, 4463, 4466, 4467, 4468, 4470, 4471, 4474, 4475, 4479, 4486, 4490, 4492, 4494, 4496, 4498, 4500, 4502, 4507, 4512, 4514, 4515, 4518, 4519, 4521, 4522, 4529, 4531, 4535, 4548, 4549, 4554, 4555, 4556, 4557, 4558, 4560, 4562, 4563, 4565, 4566, 4568, 4575, 4576, 4578, 4579, 4580, 4582, 4583, 4590, 4591, 4593, 4594, 4597, 4598, 4599, 4601, 4606, 4608, 4614, 4616, 4618, 4623, 4625, 4628, 4630, 4632, 4636, 4639, 4641, 4643, 4644, 4645, 4646, 4647, 4650, 4651, 4653, 4654, 4655, 4656, 4658, 4659, 4667, 4669, 4671, 4672, 4673, 4674, 4676, 4677, 4680, 4684, 4685, 4691, 4692, 4696, 4697, 4699, 4700, 4703, 4706, 4708, 4710, 4711, 4713, 4714, 4719, 4721, 4722, 4724, 4725, 4729, 4730, 4732, 4734, 4736, 4737, 4738, 4739, 4740, 4741, 4745, 4746, 4749, 4750, 4753, 4755, 4756, 4761, 4762, 4763, 4766, 4769, 4770, 4771, 4773, 4775, 4778, 4779, 4780, 4783, 4784, 4787, 4788, 4789, 4790, 4791, 4794, 4795, 4804, 4805, 4806, 4807, 4809, 4813, 4818, 4820, 4822, 4828, 4830, 4831, 4834, 4841, 4842, 4845, 4851, 4854, 4855, 4856, 4857, 4859, 4861, 4862, 4863, 4864, 4868, 4869, 4870, 4874, 4875, 4876, 4878, 4880, 4881, 4887, 4888, 4889, 4891, 4900, 4902, 4904, 4905, 4909, 4910, 4913, 4914, 4918, 4921, 4922, 4923, 4924, 4925, 4931, 4935, 4936, 4938, 4941, 4947, 4953, 4954, 4958, 4959, 4967, 4969, 4971, 4972, 4974, 4975, 4977, 4980, 4981, 4985, 4987, 4988, 4989, 4990, 4991, 4993, 4994, 4996, 5000, 5011, 5014, 5015, 5016, 5022, 5023, 5024, 5026, 5029, 5030, 5036, 5037, 5038, 5039, 5040, 5042, 5044, 5046, 5049, 5051, 5052, 5054, 5057, 5060, 5061, 5067, 5072, 5074, 5075, 5078, 5082, 5084, 5088, 5089, 5091, 5094, 5100, 5101, 5102, 5110, 5111, 5114, 5115, 5116, 5122, 5125, 5131, 5132, 5140, 5144, 5145, 5147, 5148, 5151, 5154, 5160, 5164, 5165, 5168, 5169, 5170, 5174, 5180, 5181, 5184, 5185, 5187, 5188, 5189, 5190, 5191, 5192, 5196, 5198, 5200, 5202, 5203, 5206, 5212, 5213, 5216, 5217, 5218, 5219, 5221, 5225, 5229, 5230, 5234, 5247, 5253, 5254, 5256, 5257, 5258, 5260, 5261, 5263, 5264, 5269, 5273, 5275, 5276, 5279, 5280, 5281, 5282, 5283, 5286, 5287, 5293, 5297, 5298, 5299, 5300, 5301, 5308, 5311, 5314, 5315, 5317, 5319, 5321, 5324, 5327, 5329, 5330, 5332, 5334, 5338, 5339, 5342, 5343, 5345, 5346, 5348, 5350, 5351, 5352, 5360, 5366, 5367, 5369, 5371, 5386, 5388, 5389, 5391, 5393, 5396, 5402, 5405, 5409, 5411, 5413, 5414, 5417, 5418, 5422, 5426, 5427, 5428, 5430, 5431, 5433, 5434, 5437, 5438, 5445, 5446, 5448, 5449, 5452, 5453, 5456, 5458, 5459, 5461, 5469, 5471, 5472, 5475, 5476, 5483, 5485, 5487, 5488, 5491, 5493, 5495, 5496, 5497, 5505, 5506, 5508, 5510, 5513, 5515, 5517, 5518, 5519, 5520, 5521, 5524, 5526, 5529, 5530, 5532, 5534, 5535, 5536, 5537, 5545, 5549, 5554, 5557, 5558, 5559, 5562, 5563, 5566, 5568, 5569, 5572, 5575, 5579, 5581, 5582, 5584, 5585, 5586, 5589, 5591, 5593, 5594, 5596, 5597, 5608, 5612, 5613, 5614, 5615, 5616, 5618, 5620, 5621, 5627, 5632, 5633, 5635, 5638, 5640, 5643, 5647, 5648, 5651, 5652, 5653, 5656, 5657, 5659, 5660, 5662, 5663, 5664, 5669, 5670, 5671, 5677, 5680, 5689, 5690, 5694, 5695, 5697, 5698, 5702, 5706, 5709, 5711, 5718, 5719, 5721, 5722, 5723, 5729, 5730, 5731, 5732, 5734, 5735, 5736, 5737, 5742, 5744, 5749, 5751, 5757, 5764, 5768, 5770, 5773, 5775, 5780, 5784, 5785, 5786, 5787, 5788, 5791, 5792, 5794, 5805, 5808, 5810, 5811, 5816, 5820, 5826, 5832, 5834, 5835, 5836, 5837, 5842, 5844, 5854, 5856, 5858, 5859, 5864, 5866, 5867, 5868, 5871, 5872, 5877, 5878, 5879, 5881, 5882, 5883, 5884, 5887, 5888, 5889, 5892, 5893, 5900, 5901, 5902, 5906, 5907, 5910, 5912, 5918, 5919, 5921, 5922, 5925, 5926, 5927, 5928, 5930, 5931, 5932, 5938, 5939, 5941, 5942, 5944, 5945, 5946, 5947, 5948, 5951, 5952, 5954, 5956, 5957, 5959, 5961, 5967, 5968, 5969, 5971, 5978, 5979, 5980, 5984, 5985, 5986, 5988, 5989, 5990, 5991, 5992, 5994, 5996, 5997, 6000, 6002, 6004, 6006, 6007, 6012, 6013, 6016, 6017, 6021, 6023, 6025, 6026, 6028, 6038, 6040, 6041, 6044, 6047, 6048, 6051, 6054, 6058, 6059, 6060, 6062, 6063, 6065, 6068, 6069, 6070, 6072, 6073, 6074, 6075, 6080, 6085, 6088, 6089, 6090, 6092, 6093, 6094, 6095, 6098, 6107, 6108, 6109, 6110, 6112, 6113, 6116, 6118, 6119, 6120, 6122, 6129, 6130, 6131, 6132, 6133, 6135, 6136, 6137, 6144, 6145, 6146, 6147, 6150, 6151, 6153, 6156, 6158, 6160, 6163, 6164, 6165, 6168, 6173, 6180, 6181, 6182, 6183, 6186, 6188, 6189, 6191, 6193, 6197, 6198, 6200, 6205, 6206, 6207, 6209, 6212, 6215, 6220, 6221, 6223, 6224, 6227, 6228, 6230, 6231, 6233, 6234, 6237, 6238, 6240, 6243, 6245, 6246, 6247, 6249, 6251, 6257, 6258, 6259, 6264, 6265, 6271, 6272, 6273, 6278, 6279, 6280, 6282, 6286,
6288, 6291, 6292, 6294, 6299, 6300, 6302, 6303, 6309, 6310,
6315, 6317, 6321, 6322, 6326, 6328, 6330, 6333, 6338, 6346,
6351, 6352, 6353, 6354, 6356, 6358, 6360, 6362, 6363, 6364,
6367, 6370, 6373, 6375, 6376, 6378, 6381, 6383, 6388, 6392,
6394, 6395, 6396, 6397, 6398, 6399, 6400, 6403, 6405, 6407,
6408, 6410, 6413, 6414, 6415, 6419, 6420, 6422, 6429, 6430,
6431, 6434, 6436, 6437, 6440, 6442, 6452, 6454, 6458, 6459,
6463, 6464, 6466, 6467, 6469, 6470, 6471, 6474, 6476, 6477,
6478, 6480, 6482, 6484, 6486, 6488, 6495, 6497, 6499, 6500,
6501, 6502, 6504, 6505, 6510, 6513, 6514, 6515, 6517, 6519,
6524, 6525, 6526, 6530, 6533, 6534, 6537, 6541, 6543, 6544,
6547, 6548, 6549, 6554, 6555, 6558, 6560, 6561, 6563, 6564,
6567, 6569, 6574, 6576, 6577, 6579, 6581, 6582, 6584, 6587,
6589, 6592, 6595, 6597, 6598, 6599, 6607, 6609, 6610, 6611,
6614, 6620, 6621, 6624, 6625, 6626, 6627, 6628, 6629, 6630,
6634, 6635, 6637, 6638, 6639, 6643, 6644, 6646, 6647, 6649,
6650, 6652, 6654, 6655, 6662, 6666, 6671, 6672, 6673, 6674,
6676, 6681, 6691, 6692, 6695, 6696, 6703, 6705, 6706, 6711,
6714, 6716, 6718, 6720, 6724, 6725, 6729, 6730, 6731, 6734,
6736, 6737, 6739, 6746, 6747, 6756, 6757, 6759, 6761, 6766,
6776, 6778, 6779, 6780, 6781, 6782, 6786, 6788, 6791, 6793,
6794, 6795, 6797, 6799, 6803, 6804, 6805, 6807, 6810, 6811,
6812, 6813, 6816, 6819, 6820, 6821, 6824, 6827, 6828, 6830,
6831, 6834, 6836, 6839, 6841, 6842, 6843, 6845, 6847, 6848,
6851, 6852, 6859, 6860, 6863, 6869, 6872, 6874, 6875, 6876,
6877, 6878, 6879, 6880, 6887, 6888, 6890, 6897, 6903, 6906,
6907, 6909, 6913, 6914, 6915, 6917, 6919, 6921, 6922, 6923,
6924, 6930, 6933, 6936, 6941, 6944, 6946, 6948, 6950, 6951,
6952, 6955, 6959, 6960, 6967, 6969, 6971, 6979, 6980, 6984,
6985, 6987, 6990, 6993, 6994, 6995, 6997, 6999, 7000, 7002,
7003, 7006, 7009, 7011, 7012, 7013, 7015, 7016, 7022, 7025,
7032, 7038, 7039, 7042, 7043, 7045, 7046, 7053, 7056, 7057,
7064, 7067, 7068, 7077, 7079, 7083, 7085, 7086, 7093, 7097,
7105, 7106, 7107, 7108, 7112, 7113, 7116, 7117, 7118, 7124,
7126, 7130, 7132, 7140, 7142, 7144, 7149, 7151, 7155, 7164,
7165, 7166, 7169, 7172, 7173, 7176, 7177, 7182, 7184, 7187,
7188, 7194, 7201, 7202, 7203, 7206, 7207, 7208, 7210, 7211,
7216, 7217, 7219, 7220, 7227, 7228, 7230, 7232, 7233, 7234,
7236, 7239, 7241, 7244, 7245, 7248, 7249, 7250, 7255, 7257,
7258, 7259, 7264, 7267, 7268, 7274, 7277, 7278, 7281, 7282,
7287, 7290, 7291, 7292, 7293, 7298, 7299, 7300, 7301, 7303,
7304, 7305, 7307, 7308, 7312, 7313, 7315, 7317, 7328, 7330,
7331, 7334, 7336, 7338, 7339, 7353, 7354, 7355, 7356, 7357,
7358, 7361, 7363, 7365, 7371, 7373, 7375, 7377, 7380, 7381,
7382, 7383, 7386, 7388, 7389, 7391, 7392, 7395, 7398, 7400,
7409, 7411, 7417, 7425, 7428, 7430, 7431, 7433, 7434, 7435,
7436, 7438, 7441, 7443, 7444, 7447, 7448, 7452, 7454, 7458,
7459, 7464, 7466, 7470, 7479, 7483, 7486, 7490, 7492, 7493,
7502, 7504, 7505, 7506, 7512, 7515, 7517, 7518, 7523, 7528,
7531, 7532, 7533, 7537, 7538, 7546, 7547, 7554, 7560, 7561,
7563, 7568, 7570, 7574, 7578, 7580, 7585, 7586, 7589, 7595,
7598, 7599, 7605, 7611, 7613, 7619, 7620, 7621, 7623, 7624,
7633, 7639, 7642, 7652, 7658, 7661, 7663, 7664, 7665, 7674,
7677, 7678, 7679, 7680, 7682, 7685, 7686, 7687, 7689, 7693,
7695, 7697, 7699, 7700, 7703, 7712, 7716, 7718, 7719, 7724,
7725, 7726, 7729, 7730, 7733, 7734, 7736, 7737, 7738, 7744,
7745, 7747, 7751, 7753, 7761, 7762, 7763, 7764, 7767, 7768,
7769, 7770, 7774, 7775, 7779, 7785, 7786, 7788, 7791, 7792,
7793, 7796, 7798, 7799, 7800, 7802, 7803, 7804, 7806, 7807,
7812, 7819, 7820, 7823, 7824, 7825, 7832, 7833, 7834, 7838,
7841, 7845, 7847, 7848, 7856, 7858, 7859, 7860, 7862, 7863,
7865, 7873, 7875, 7876, 7878, 7881, 7884, 7888, 7890, 7896,
7900, 7901, 7908, 7909, 7910, 7911, 7918, 7923, 7925, 7928,
7933, 7934, 7935, 7936, 7937, 7938, 7942, 7944, 7945, 7946,
7947, 7948, 7950, 7955, 7956, 7964, 7965, 7966, 7967, 7971,
7972, 7974, 7976, 7977, 7978, 7980, 7982, 7984, 7986, 7988,
7993, 7998, 7999, 8002, 8005, 8006, 8007, 8012, 8020, 8021,
8026, 8035, 8041, 8042, 8044, 8045, 8047, 8048, 8049, 8052,
8053, 8056, 8058, 8059, 8063, 8065, 8067, 8068, 8071, 8073,
8076, 8077, 8078, 8080, 8082, 8084, 8087, 8088, 8091, 8093,
8095, 8099, 8100, 8102, 8103, 8105, 8106, 8112, 8116, 8118,
8123, 8124, 8126, 8130, 8136, 8137, 8150, 8151, 8159, 8162,
8163, 8164, 8165, 8170, 8177, 8178, 8179, 8182, 8189, 8192,
8193, 8199, 8202, 8204, 8207, 8208, 8211, 8213, 8216, 8219,
8220, 8222, 8223, 8225, 8227, 8230, 8231, 8234, 8235, 8237,
8239, 8240, 8241, 8242, 8244, 8245, 8250, 8252, 8253, 8265,
8266, 8268, 8269, 8270, 8272, 8275, 8289, 8291, 8292, 8294,
8295, 8297, 8300, 8301, 8304, 8305, 8306, 8310, 8311, 8312,
8318, 8319, 8320, 8321, 8325, 8329, 8337, 8339, 8340, 8349,
8350, 8352, 8353, 8355, 8367, 8368, 8369, 8371, 8372, 8373,
8376, 8378, 8379, 8385, 8386, 8387, 8389, 8392, 8393, 8395,
8396, 8398, 8401, 8402, 8403, 8404, 8405, 8407, 8410, 8413,
8414, 8416, 8417, 8418, 8427, 8428, 8430, 8433, 8436, 8438,
8439, 8441, 8442, 8444, 8445, 8446, 8447, 8448, 8449, 8450,
8451, 8452, 8456, 8458, 8459, 8472, 8473, 8474, 8476, 8477,
8478, 8480, 8481, 8482, 8485, 8486, 8490, 8493, 8496, 8498,
8501, 8502, 8503, 8505, 8507, 8509, 8511, 8513, 8515, 8517,
8523, 8524, 8525, 8528, 8531, 8532, 8533, 8539, 8541, 8542,
8549, 8550, 8553, 8554, 8557, 8558, 8561, 8562, 8565, 8566,
8568, 8576, 8577, 8581, 8582, 8583, 8588, 8589, 8590, 8592,
8593, 8594, 8595, 8596, 8597, 8598, 8599, 8600, 8601, 8602,
8603, 8605, 8610, 8611, 8612, 8614, 8617, 8618, 8622, 8624,
8631, 8634, 8638, 8639, 8640, 8642, 8644, 8648, 8650, 8652,
8654, 8657, 8658, 8659, 8663, 8664, 8665, 8666, 8669, 8670,
8672, 8676, 8677, 8685, 8693, 8700, 8703, 8704, 8706, 8707,
8708, 8709, 8712, 8713, 8716, 8717, 8719, 8720, 8722, 8728,
8729, 8731, 8732, 8734, 8735, 8736, 8740, 8741, 8742, 8746,
8748, 8749, 8752, 8753, 8760, 8767, 8768, 8770, 8771, 8772,
8773, 8775, 8777, 8779, 8782, 8783, 8784, 8785, 8789, 8790,
8792, 8797, 8804, 8805, 8808, 8810, 8817, 8818, 8822, 8824,
8831, 8832, 8834, 8835, 8838, 8841, 8842, 8843, 8846, 8848,
8853, 8859, 8861, 8866, 8867, 8876, 8878, 8881, 8883, 8884,
8886, 8888, 8889, 8891, 8892, 8896, 8897, 8899, 8900, 8902,
8905, 8907, 8908, 8909, 8910, 8911, 8913, 8914, 8916, 8917,
8922, 8923, 8926, 8928, 8929, 8930, 8934, 8935, 8938, 8940,
8941, 8942, 8945, 8946, 8949, 8951, 8952, 8956, 8957, 8960,
8961, 8962, 8967, 8968, 8969, 8972, 8974, 8976, 8977, 8979,
8980, 8981, 8985, 8986, 8991, 8992, 8996, 8998, 8999, 9001,
9002, 9003, 9006, 9009, 9012, 9013, 9020, 9029, 9030, 9033,
9037, 9042, 9044, 9045, 9052, 9056, 9057, 9058, 9059, 9060,
9066, 9069, 9071, 9072, 9073, 9074, 9076, 9084, 9086, 9088,
9091, 9092, 9095, 9096, 9097, 9098, 9100, 9105, 9108, 9110,
9111, 9112, 9114, 9116, 9118, 9119, 9124, 9125, 9129, 9131,
9133, 9134, 9139, 9140, 9141, 9142, 9149, 9151, 9152, 9154,
9155, 9157, 9172, 9173, 9174, 9175, 9177, 9183, 9185, 9187,
9188, 9190, 9191, 9194, 9195, 9200, 9205, 9206, 9207, 9210,
9211, 9213, 9215, 9216, 9218, 9220, 9223, 9226, 9229, 9232,
9233, 9234, 9237, 9241, 9243, 9247, 9249, 9252, 9253, 9254,
9257, 9262, 9265, 9267, 9269, 9270, 9273, 9275, 9276, 9278,
9284, 9287, 9288, 9289, 9290, 9292, 9299, 9300, 9302, 9304,
9308, 9311, 9313, 9320, 9321, 9323, 9325, 9326, 9327, 9328,
9329, 9330, 9336, 9337, 9338, 9339, 9340, 9341, 9345, 9346,
9347, 9348, 9350, 9354, 9355, 9359, 9366, 9373, 9375, 9376,
9378, 9382, 9383, 9388, 9391, 9392, 9394, 9396, 9398, 9400,
9402, 9403, 9404, 9406, 9413, 9414, 9415, 9417, 9419, 9423,
9432, 9433, 9439, 9444, 9451, 9452, 9453, 9455, 9456, 9460,
9468, 9471, 9477, 9478, 9481, 9483, 9484, 9487, 9488, 9490,
9497, 9501, 9502, 9503, 9504, 9509, 9513, 9514, 9515, 9517,
9518, 9519, 9521, 9525, 9531, 9532, 9534, 9536, 9540, 9543,
9546, 9548, 9549, 9553, 9554, 9555, 9559, 9560, 9563, 9564,
9565, 9568, 9571, 9574, 9577, 9579, 9582, 9583, 9587, 9589,
9590, 9591, 9592, 9596, 9602, 9605, 9606, 9607, 9610, 9613,
9620, 9623, 9626, 9627, 9628, 9629, 9632, 9635, 9640, 9641, 9642, 9644, 9645, 9646, 9648, 9649, 9653, 9655, 9657, 9658, 9659, 9660, 9666, 9668, 9670, 9676, 9681, 9682, 9686, 9692, 9693, 9695, 9696, 9698, 9701, 9710, 9711, 9717, 9718, 9722, 9723, 9725, 9726, 9730, 9731, 9733, 9734, 9737, 9738, 9744, 9745, 9746, 9750, 9751, 9753, 9754, 9755, 9756, 9763, 9764, 9767, 9768, 9770, 9774, 9775, 9776, 9780, 9781, 9782, 9784, 9786, 9792, 9794, 9796, 9797, 9799, 9808, 9809, 9813, 9816, 9819, 9820, 9824, 9825, 9827, 9833, 9836, 9845, 9846, 9847, 9849, 9854, 9861, 9864, 9866, 9869, 9873, 9882, 9886, 9887, 9892, 9893, 9894, 9897, 9900, 9901, 9906, 9907, 9908, 9909, 9910, 9911, 9912, 9921, 9923, 9924, 9928, 9930, 9931, 9935, 9938, 9940, 9944, 9946, 9947, 9949, 9950, 9953, 9955, 9957, 9960, 9962, 9963, 9964, 9967, 9971, 9974, 9979, 9980, 9982, 9984, 9985, 9987, 9988, 9990, 9991, 9997, 9998, 10000, 10001, 10009, 10010, 10012, 10013, 10017, 10018, 10019, 10021, 10022, 10026, 10027, 10031, 10032, 10033, 10034, 10035, 10037, 10038, 10040, 10043, 10045, 10047, 10048, 10050, 10051, 10052, 10053, 10054, 10056, 10058, 10059, 10060, 10062, 10063, 10064, 10066, 10068, 10073, 10076, 10078, 10086, 10089, 10090, 10091, 10092, 10095, 10097, 10101, 10102, 10103, 10105, 10106, 10107, 10108, 10109, 10110, 10112, 10114, 10115, 10116, 10118, 10122, 10128, 10131, 10132, 10134, 10143, 10149, 10151, 10152, 10156, 10157, 10158, 10162, 10163, 10165, 10166, 10168, 10170, 10174, 10176, 10178, 10181, 10182, 10192, 10193, 10194, 10195, 10196, 10197, 10199, 10203, 10206, 10209, 10212, 10213, 10214, 10217, 10218, 10219, 10220, 10222, 10223, 10224, 10225, 10228, 10230, 10231, 10233, 10235, 10236, 10237, 10239, 10243, 10247, 10252, 10253, 10255, 10258, 10259, 10260, 10262, 10270, 10275, 10278, 10284, 10286, 10291, 10292, 10293, 10295, 10300, 10302, 10306, 10307, 10311, 10318, 10319, 10321, 10322, 10323, 10325, 10326, 10327, 10328, 10329, 10330, 10331, 10333, 10334, 10335, 10336, 10338, 10341, 10343, 10345, 10346, 10352, 10353, 10354, 10355, 10356, 10357, 10359, 10360, 10361, 10362, 10364, 10368, 10371, 10373, 10375, 10378, 10380, 10381, 10384, 10385, 10388, 10395, 10397, 10398, 10399, 10401, 10405, 10406, 10410, 10413, 10414, 10416, 10421, 10422, 10423, 10428, 10429, 10430, 10435, 10437, 10438, 10440, 10442, 10443, 10446, 10447, 10448, 10449, 10450, 10451, 10452, 10453, 10455, 10456, 10463, 10464, 10465, 10466, 10468, 10469, 10470, 10472, 10473, 10474, 10480, 10487, 10490, 10491, 10492, 10494, 10496, 10498, 10504, 10506, 10508, 10514, 10515, 10518, 10525, 10527, 10528, 10531, 10532, 10533, 10535, 10536, 10537, 10541, 10542, 10543, 10544, 10547, 10548, 10549, 10550, 10551, 10555, 10556, 10558, 10560, 10561, 10562, 10564, 10565, 10567, 10569, 10571, 10573, 10579, 10580, 10581, 10582, 10583, 10584, 10585, 10590, 10593, 10596, 10597, 10599, 10601, 10602, 10610, 10611, 10613, 10615, 10616, 10617, 10619, 10621, 10622, 10623, 10625, 10626, 10628, 10629, 10630, 10631, 10633, 10634, 10637, 10638, 10639, 10640, 10642, 10643, 10645, 10646, 10648, 10649, 10650, 10651, 10655, 10657, 10659, 10663, 10665, 10668, 10669, 10670, 10671, 10674, 10676, 10677, 10678, 10681, 10682, 10683, 10684, 10685, 10689, 10697, 10699, 10700, 10702, 10703, 10705, 10707, 10708, 10711, 10712, 10715, 10716, 10718, 10721, 10723, 10725, 10726, 10732, 10734, 10735, 10738, 10740, 10744, 10745, 10747, 10748, 10749, 10752, 10753, 10754, 10756, 10761, 10762, 10763, 10766, 10771, 10774, 10775, 10777, 10778, 10779, 10782, 10784, 10785, 10787, 10788, 10790, 10791, 10792, 10795, 10796, 10801, 10803, 10804, 10805, 10809, 10810, 10811, 10812, 10815, 10818, 10819, 10820, 10821, 10823, 10824, 10825, 10826, 10831, 10833, 10836, 10838, 10839, 10840, 10841, 10843, 10846, 10850, 10853, 10854, 10857, 10858, 10860, 10861, 10862, 10866, 10867, 10869, 10872, 10874, 10877, 10878, 10880, 10881, 10887, 10892, 10896, 10897, 10898, 10899, 10902, 10903, 10911, 10912, 10917, 10920, 10926, 10927, 10930, 10933, 10934, 10935, 10936, 10937, 10938, 10940, 10941, 10944, 10947, 10948, 10954, 10956, 10957, 10960, 10961, 10962, 10963, 10965, 10966, 10967, 10972, 10975, 10976, 10977, 10980, 10988, 10993, 10995, 10996, 10997, 10999, 11002, 11004, 11005, 11006, 11008, 11009, 11015, 11018, 11024, 11025, 11027, 11032, 11033, 11039, 11046, 11047, 11049, 11053, 11056, 11058, 11060, 11070, 11078, 11080, 11082, 11083, 11086, 11090, 11095, 11098, 11100, 11101, 11107, 11109, 11110, 11114, 11116, 11117, 11118, 11119, 11123, 11124, 11125, 11126, 11127, 11128, 11129, 11132, 11133, 11135, 11137, 11138, 11146, 11148, 11150, 11151, 11152, 11153, 11154, 11155, 11156, 11157, 11158, 11160, 11161, 11162, 11163, 11165, 11166, 11168, 11169, 11173, 11175, 11177, 11178, 11179, 11180, 11181, 11184, 11185, 11187, 11188, 11190, 11191, 11192, 11194, 11198, 11199, 11201, 11202, 11203, 11207, 11214, 11216, 11217, 11218, 11222, 11226, 11229, 11230, 11232, 11233, 11234, 11235, 11236, 11237, 11239, 11244, 11246, 11247, 11248, 11251, 11254, 11255, 11256, 11257, 11258, 11259, 11260, 11262, 11263, 11264, 11265, 11266, 11274, 11275, 11278, 11283, 11289, 11290, 11291, 11292, 11293, 11294, 11295, 11298, 11306, 11307, 11313, 11315, 11316, 11318, 11319, 11320, 11322, 11324, 11328, 11329, 11330, 11331, 11332, 11337, 11338, 11339, 11340, 11345, 11346, 11348, 11349, 11352, 11356, 11359, 11363, 11365, 11366, 11369, 11370, 11371, 11373, 11374, 11377, 11378, 11380, 11381, 11382, 11387, 11388, 11391, 11394, 11395, 11397, 11398, 11401, 11403, 11405, 11406, 11408, 11409, 11416, 11423, 11428, 11430, 11434, 11437, 11438, 11445, 11446, 11448, 11449, 11451, 11459, 11463, 11465, 11471, 11472, 11473, 11475, 11476, 11478, 11481, 11482, 11487, 11490, 11491, 11494, 11496, 11497, 11498, 11499, 11500, 11501, 11503, 11506, 11507, 11508, 11509, 11512, 11518, 11523, 11526, 11527, 11528, 11530, 11531, 11532, 11533, 11534, 11538, 11541, 11544, 11546, 11550, 11551, 11553, 11558, 11560, 11561, 11564, 11567, 11570, 11576, 11577, 11578, 11580, 11585, 11588, 11593, 11594, 11595, 11596, 11597, 11599, 11603, 11604, 11607, 11608, 11615, 11618, 11620, 11621, 11623, 11625, 11628, 11629, 11632, 11633, 11639, 11641, 11642, 11644, 11650, 11652, 11654, 11655, 11656, 11657, 11658, 11663, 11667, 11668, 11669, 11672, 11673, 11678, 11680, 11681, 11682, 11688, 11691, 11692, 11693, 11694, 11695, 11699, 11701, 11703, 11705, 11707, 11711, 11712, 11718, 11720, 11721, 11722, 11725, 11731, 11733, 11736, 11740, 11743, 11744, 11749, 11753, 11755, 11759, 11760, 11761, 11762, 11763, 11764, 11765, 11766, 11767, 11770, 11771, 11776, 11780, 11781, 11782, 11783, 11784, 11785, 11786, 11790, 11792, 11795, 11799, 11800, 11802, 11809, 11810, 11811, 11812, 11813, 11814, 11816, 11818, 11819, 11821, 11822, 11823, 11825, 11826, 11828, 11830, 11831, 11832, 11837, 11839, 11841, 11845, 11846, 11847, 11849, 11850, 11851, 11856, 11858, 11863, 11868, 11870, 11872, 11876, 11877, 11881, 11889, 11890, 11891, 11894, 11895, 11898, 11904, 11909, 11911, 11913, 11916, 11917, 11918, 11919, 11920, 11921, 11923, 11926, 11927, 11928, 11929, 11930, 11934, 11935, 11940, 11941, 11943, 11946, 11947, 11948, 11949, 11953, 11957, 11958, 11959, 11960, 11961, 11962, 11963, 11965, 11966, 11968, 11977, 11979, 11980, 11983, 11988, 11993, 11994, 11995, 11996, 11997, 11998, 11999, 12002, 12004, 12005, 12006, 12008, 12017, 12018, 12019, 12020, 12021, 12023, 12024, 12025, 12026, 12029, 12032, 12035, 12042, 12043, 12044, 12050, 12054, 12059, 12061, 12063, 12068, 12075, 12078, 12079, 12080, 12081, 12083, 12085, 12091, 12093, 12097, 12098, 12102, 12104, 12106, 12109, 12110, 12112, 12115, 12118, 12120, 12122, 12126, 12128, 12129, 12131, 12134, 12135, 12137, 12138, 12139, 12143, 12144, 12145, 12146, 12147, 12148, 12150, 12151, 12155, 12161, 12165, 12166, 12167, 12170, 12171, 12173, 12174, 12175, 12179, 12181, 12185, 12192, 12194, 12197, 12200, 12201, 12202, 12204, 12208, 12212, 12214, 12215, 12217, 12221, 12223, 12229, 12237, 12240, 12241, 12243, 12245, 12249, 12250, 12252, 12255, 12259, 12268, 12269, 12271, 12278, 12280, 12283, 12285, 12286, 12287, 12288, 12291, 12293, 12295, 12302, 12304, 12306, 12310, 12311, 12312, 12313, 12314, 12315, 12317, 12319, 12321, 12323, 12325, 12326, 12328, 12331, 12333, 12334, 12339, 12340, 12342, 12345, 12347, 12350, 12354, 12356, 12359, 12364, 12366, 12370, 12374, 12375, 12376, 12379, 12380, 12381, 12383, 12385, 12390, 12397, 12400, 12401, 12403, 12406, 12411, 12414, 12415, 12416, 12419, 12420, 12423, 12424, 12426, 12427, 12428, 12437, 12440, 12444, 12450, 12451, 12456, 12457, 12459, 12461, 12462, 12465, 12467, 12468, 12470, 12472, 12473, 12478, 12481, 12483, 12486, 12488, 12492, 12497, 12499, 12500, 12501, 12502, 12503, 12509, 12512, 12513, 12514, 12515, 12518, 12519, 12521, 12530, 12531, 12535, 12536, 12537, 12538, 12539, 12540, 12545, 12546, 12547, 12549, 12551, 12552, 12554, 12555, 12556, 12557, 12561, 12562, 12563, 12565, 12567, 12568, 12570, 12572, 12580, 12583, 12585, 12586, 12588, 12591, 12594, 12597, 12600, 12602, 12603, 12605, 12608, 12609, 12610, 12611, 12620, 12622, 12623, 12626, 12628, 12629, 12630, 12631, 12634, 12638, 12639, 12640, 12641, 12648, 12651, 12663, 12664, 12668, 12670, 12671, 12674, 12679, 12681, 12683, 12684, 12688, 12689, 12691, 12693, 12695, 12696, 12697, 12699, 12701, 12702, 12705, 12706, 12707, 12713, 12715, 12723, 12729, 12731, 12732, 12733, 12735, 12738, 12739, 12740, 12741, 12742, 12743, 12744, 12752, 12753, 12754, 12755, 12757, 12758, 12761, 12762, 12763, 12764, 12766, 12771, 12772, 12773, 12775, 12777, 12783, 12790, 12794, 12797, 12800, 12802, 12803, 12807, 12808, 12810, 12812, 12813, 12817, 12819, 12820, 12822, 12823, 12824, 12826, 12827, 12830, 12834, 12835, 12836, 12837, 12838, 12839, 12843, 12844, 12848, 12849, 12850, 12853, 12862, 12866, 12870, 12873, 12875, 12878, 12882, 12884, 12887, 12888, 12891, 12895, 12898, 12899, 12900, 12901, 12902, 12903, 12904, 12905, 12906, 12908, 12910, 12912, 12913, 12916, 12920, 12921, 12928, 12929, 12931, 12932, 12933, 12934, 12935, 12939, 12940, 12942, 12946, 12947, 12950, 12952, 12953, 12960, 12961, 12963, 12967, 12968, 12969, 12978, 12983, 12984, 12986, 12987, 12990, 12991, 12994, 12999, 13003, 13004, 13006, 13010, 13014, 13015, 13017, 13018, 13022, 13027, 13030, 13032, 13033, 13034, 13035, 13036, 13037, 13040, 13041, 13044, 13047, 13049, 13050, 13053, 13054, 13055, 13056, 13061, 13062, 13063, 13064, 13066, 13071, 13075, 13079, 13081, 13082, 13085, 13086, 13087, 13097, 13099, 13101, 13102, 13105, 13106, 13110, 13111, 13112, 13114, 13115, 13116, 13117, 13118, 13120, 13121, 13122, 13123, 13124, 13125, 13128, 13131, 13134, 13136, 13142, 13144, 13147, 13148, 13149, 13151, 13154, 13156, 13159, 13166, 13169, 13175, 13181, 13182, 13185, 13186, 13189, 13190, 13197, 13198, 13199, 13206, 13209, 13210, 13212, 13213, 13217, 13221, 13224, 13226, 13227, 13228, 13229, 13231, 13232, 13233, 13234, 13235, 13236, 13237, 13239, 13241, 13243, 13248, 13250, 13251, 13255, 13259, 13260, 13261, 13262, 13263, 13264, 13265, 13267, 13268, 13269, 13271, 13274, 13280, 13281, 13295, 13296, 13297, 13298, 13300, 13301, 13303, 13304, 13315, 13316, 13317, 13319, 13326, 13328, 13329, 13330, 13332, 13340, 13343, 13345, 13346, 13347, 13348, 13350, 13352, 13353, 13358, 13361, 13363, 13367, 13368, 13369, 13370, 13373, 13377, 13381, 13384, 13385, 13386, 13388, 13391, 13393, 13394, 13396, 13397, 13401, 13402, 13403, 13408, 13410, 13416, 13417, 13419, 13423, 13429, 13430, 13433, 13439, 13448, 13450, 13451, 13456, 13457, 13460, 13463, 13467, 13469, 13473, 13475, 13477, 13478, 13480, 13492, 13494, 13496, 13498, 13499, 13503, 13506, 13513, 13514, 13515, 13519, 13521, 13522, 13526, 13530, 13532, 13533, 13539, 13540, 13543, 13544, 13545, 13546, 13547, 13549, 13552, 13553, 13555, 13556, 13558, 13559, 13561, 13562, 13568, 13569, 13572, 13574, 13577, 13578, 13579, 13580, 13582, 13584, 13587, 13597, 13599, 13600, 13601, 13602, 13603, 13604, 13605, 13606, 13612, 13613, 13621, 13623, 13627, 13628, 13630, 13631, 13632, 13634, 13636, 13637, 13638, 13643, 13647, 13650, 13652, 13653, 13654, 13662, 13663, 13665, 13668, 13669, 13675, 13676, 13677, 13678, 13679, 13683, 13686, 13687, 13688, 13689, 13697, 13698, 13699, 13700, 13702, 13706, 13710, 13712, 13713, 13714, 13715, 13716, 13719, 13720, 13727, 13729, 13736, 13738, 13739, 13742, 13745, 13747, 13749, 13750, 13753, 13756, 13761, 13764, 13767, 13768, 13772, 13773, 13775, 13777, 13779, 13782, 13785, 13786, 13787, 13791, 13793, 13795, 13796, 13798, 13799, 13809, 13812, 13813, 13816, 13817, 13818, 13819, 13822, 13823, 13828, 13830, 13831, 13834, 13835, 13840, 13843, 13849, 13852, 13859, 13860, 13862, 13866, 13869, 13870, 13872, 13873, 13876, 13877, 13885, 13887, 13891, 13892, 13895, 13897, 13898, 13901, 13906, 13908, 13909, 13910, 13911, 13914, 13917, 13918, 13919, 13920, 13921, 13924, 13925, 13927, 13929, 13934, 13938, 13947, 13948, 13950, 13952, 13953, 13954, 13958, 13960, 13961, 13963, 13969, 13970, 13971, 13975, 13983, 13984, 13985, 13986, 13987, 13990, 13991, 13999, 14000, 14001, 14002, 14003, 14005, 14006, 14008, 14009, 14013, 14014, 14017, 14018, 14022, 14027, 14030, 14031, 14035, 14038, 14040, 14043, 14051, 14052, 14059, 14062, 14063, 14066, 14067, 14069, 14070, 14071, 14072, 14073, 14075, 14076, 14081, 14085, 14086, 14087, 14088, 14091, 14092, 14093, 14094, 14096, 14097, 14102, 14107, 14111, 14112, 14116, 14118, 14119, 14122, 14124, 14129, 14132, 14133, 14134, 14135, 14137, 14138, 14139, 14142, 14143, 14145, 14146, 14147.

Promoters expressing in immature stem at the V6 sgate (top few un-elongated internodes) include SEQ IDs: 1, 3, 4, 7, 12, 13, 14, 15, 16, 20, 26, 27, 29, 31, 33, 36, 37, 48, 54, 57, 63, 64, 65, 79, 80, 88, 93, 94, 96, 97, 98, 99, 100, 101, 102, 103, 104, 105, 108, 110, 111, 112, 117, 123, 128, 131, 132, 143, 148, 152, 156, 157, 159, 160, 162, 164, 165, 172, 174, 175, 176, 179, 181, 183, 187, 191, 193, 194, 196, 197, 199, 202, 203, 204, 205, 207, 211, 212, 214, 232, 233, 235, 236, 237, 240, 242, 246, 249, 250, 251, 254, 257, 259, 262, 267, 269, 270, 271, 280, 281, 286, 288, 289, 293, 294, 301, 302, 305, 306, 308, 309, 316, 319, 320, 322, 323, 328, 329, 332, 338, 340, 346, 349, 352, 353, 354, 356, 357, 358, 359, 360, 364, 365, 371, 373, 374, 376, 378, 379, 381, 386, 388, 389, 396, 401, 411, 412, 414, 423, 428, 432, 433, 434, 436, 441, 448, 450, 452, 456, 461, 462, 463, 466, 468, 470, 471, 474, 478, 479, 481, 483, 485, 488, 489, 496, 501, 507, 509, 510, 511, 514, 515, 516, 517, 523, 525, 532, 534, 537, 541, 542, 543, 544, 546, 547, 548, 554, 556, 557, 560, 561, 563, 571, 578, 580, 582, 585, 591, 592, 593, 594, 595, 596, 598, 599, 601, 602, 605, 606, 607, 609, 613, 614, 619, 620, 623, 631, 633, 634, 635, 636, 637, 638, 643, 647, 650, 655, 661, 662, 663, 664, 665, 671, 681, 683, 687, 693, 694, 701, 702, 705, 706, 709, 716, 717, 718, 719, 721, 722, 723, 724, 727, 731, 732, 734, 736, 739, 742, 744, 749, 753, 757, 759, 760, 761, 762, 763, 764, 765, 771, 779, 783, 784, 785, 792, 793, 800, 804, 808, 809, 811, 812, 819, 820, 821, 822, 824, 825, 826, 827, 829, 830, 833, 840, 845, 846, 849, 855, 856, 857, 858, 860, 862, 863, 865, 869, 870, 871, 872, 875, 876, 877, 883, 887, 890, 891, 892, 893, 895, 897, 898, 899, 903, 907, 908, 911, 912, 913, 916, 917, 919, 920, 924, 928, 932, 936, 938, 939, 943, 944, 947, 948, 951, 953, 955, 957, 958, 960, 964, 971, 972, 974, 975, 976, 978, 979, 980, 981, 982, 984, 985, 987, 988, 989, 991, 993, 994, 995, 996, 997, 999, 1003, 1007, 1008, 1009, 1010, 1011, 1012, 1013, 1016, 1017, 1019, 1022, 1024, 1025, 1026, 1032, 1033, 1038, 1039, 1040, 1041, 1042, 1043, 1046, 1047, 1049, 1051, 1052, 1054, 1055, 1056, 1057, 1064, 1065, 1067, 1069, 1070, 1073, 1076, 1077, 1080, 1085, 1086, 1087, 1088, 1089, 1092, 1095, 1097, 1100, 1101, 1103, 1104, 1106, 1110, 1111, 1112, 1114, 1115, 1116, 1117, 1119, 1120, 1121, 1122, 1125, 1126, 1130, 1132, 1136, 1137, 1140, 1144, 1146, 1148, 1153, 1154, 1160, 1161, 1162, 1164, 1165, 1167, 1168, 1170, 1171, 1175, 1176, 1178, 1180, 1183, 1187, 1191, 1193, 1196, 1201, 1204, 1205, 1213, 1214, 1218, 1220, 1221, 1222, 1223, 1225, 1228, 1232, 1236, 1240, 1244, 1246, 1249, 1251, 1253, 1254, 1257, 1258, 1261, 1262, 1263, 1269, 1272, 1277, 1281, 1285, 1286, 1290, 1292, 1293, 1296, 1299, 1303, 1307, 1309, 1310, 1311, 1312, 1314, 1316, 1320, 1325, 1327, 1331, 1334, 1337, 1339, 1347, 1349, 1354, 1355, 1356, 1360, 1363, 1364, 1366, 1367, 1368, 1371, 1375, 1376, 1377, 1380, 1387, 1388, 1389, 1393, 1394, 1396, 1398, 1399, 1404, 1405, 1406, 1410, 1412, 1420, 1421, 1423, 1426, 1431, 1432, 1435, 1438, 1440, 1441, 1442, 1443, 1444, 1447, 1448, 1451, 1453, 1458, 1459, 1466, 1468, 1475, 1483, 1484, 1485, 1486, 1488, 1489, 1490, 1491, 1492, 1493, 1498, 1499, 1503, 1504, 1506, 1508, 1510, 1511, 1512, 1514, 1518, 1519, 1525, 1526, 1527, 1528, 1530, 1543, 1545, 1548, 1549, 1550, 1551, 1554, 1555, 1556, 1559, 1560, 1561, 1564, 1566, 1567, 1570, 1571, 1575, 1576, 1578, 1579, 1584, 1585, 1586, 1588, 1590, 1591, 1594, 1597, 1598, 1599, 1600, 1601, 1602, 1604, 1605, 1608, 1609, 1610, 1612, 1614, 1615, 1616, 1617, 1622, 1623, 1625, 1627, 1634, 1635, 1636, 1637, 1638, 1639, 1641, 1643, 1648, 1651, 1653, 1654, 1658, 1659, 1662, 1663, 1669, 1671, 1673, 1675, 1676, 1678, 1681, 1682, 1684, 1687, 1688, 1689, 1690, 1691, 1696, 1697, 1698, 1699, 1703, 1705, 1706, 1707, 1708, 1710, 1716, 1717, 1718, 1725, 1729, 1732, 1735, 1739, 1743, 1749, 1750, 1755, 1759, 1760, 1761, 1764, 1769, 1770, 1773, 1774, 1776, 1777, 1778, 1785, 1786, 1791, 1792, 1793, 1796, 1798, 1807, 1809, 1811, 1812, 1813, 1822, 1825, 1826, 1828, 1830, 1832, 1837, 1839, 1840, 1843, 1848, 1852, 1856, 1859, 1861, 1863, 1866, 1867, 1869, 1872, 1873, 1876, 1879, 1880, 1882, 1886, 1888, 1891, 1894, 1897, 1900, 1902, 1904, 1905, 1906, 1910, 1911, 1915, 1916, 1918, 1920, 1922, 1923, 1924, 1928, 1930, 1931, 1933, 1934, 1936, 1939, 1940, 1944, 1945, 1949, 1950, 1951, 1952, 1954, 1958, 1968, 1970, 1971, 1972, 1973, 1974, 1977, 1979, 1981, 1986, 1990, 1993, 1994, 1995, 1996, 1999, 2000, 2001, 2003, 2007, 2008, 2009, 2010, 2012, 2014, 2015, 2016, 2017, 2021, 2026, 2031, 2032, 2033, 2037, 2040, 2042, 2043, 2048, 2057, 2058, 2060, 2062, 2064, 2066, 2072, 2074, 2077, 2078, 2085, 2088, 2089, 2091, 2092, 2093, 2094, 2096, 2097, 2099, 2103, 2104, 2106, 2107, 2112, 2122, 2123, 2125, 2126, 2128, 2132, 2133, 2137, 2139, 2142, 2143, 2146, 2147, 2150, 2151, 2156, 2157, 2161, 2162, 2164, 2167, 2168, 2170, 2173, 2175, 2177, 2179, 2185, 2188, 2189, 2190, 2193, 2195, 2202, 2203, 2205, 2206, 2210, 2215, 2216, 2221, 2222, 2223, 2235, 2237, 2240, 2241, 2242, 2243, 2244, 2253, 2257, 2259, 2260, 2263, 2266, 2267, 2274, 2276, 2278, 2282, 2283, 2284, 2288, 2289, 2291, 2293, 2294, 2296, 2297, 2298, 2300, 2303, 2304, 2305, 2306, 2308, 2309, 2310, 2313, 2314, 2322, 2323, 2328, 2329, 2331, 2333, 2339, 2342, 2353, 2358, 2361, 2362, 2363, 2366, 2371, 2372, 2379, 2380, 2381, 2382, 2383, 2384, 2395, 2397, 2401, 2402, 2405, 2410, 2412, 2413, 2414, 2418, 2419, 2420, 2423, 2428, 2431, 2432, 2433, 2434, 2435, 2436, 2437, 2439, 2440, 2441, 2442, 2443, 2445, 2449, 2451, 2452, 2453, 2454, 2457, 2458, 2465, 2469, 2470, 2471, 2472, 2474, 2476, 2477, 2479, 2480, 2481, 2482, 2483, 2485, 2487, 2489, 2490, 2494, 2495, 2496, 2498, 2505, 2506, 2507, 2509, 2510, 2513, 2514, 2515, 2516, 2517, 2519, 2521, 2522, 2525, 2528, 2529, 2531, 2533, 2534, 2536, 2537, 2541, 2544, 2545, 2546, 2549, 2550, 2551, 2552, 2554, 2555, 2556, 2559, 2560, 2567, 2568, 2570, 2571, 2573, 2578, 2579, 2581, 2583, 2589, 2590, 2594, 2596, 2599, 2601, 2605, 2607, 2609, 2611, 2613, 2614, 2616, 2617, 2620, 2626, 2627, 2632, 2634, 2635, 2636, 2639, 2644, 2645, 2648, 2649, 2652, 2655, 2656, 2658, 2661, 2662, 2663, 2666, 2670, 2671, 2672, 2674, 2676, 2679, 2684, 2685, 2687, 2688, 2689, 2690, 2691, 2694, 2696, 2700, 2702, 2704, 2709, 2711, 2720, 2721, 2722, 2723, 2725, 2726, 2728, 2729, 2730, 2735, 2745, 2746, 2747, 2749, 2752, 2755, 2758, 2759, 2760, 2762, 2764, 2765, 2770, 2775, 2776, 2784, 2786, 2787, 2788, 2789, 2791, 2794, 2798, 2800, 2802, 2805, 2808, 2812, 2814, 2819, 2821, 2822, 2823, 2824, 2826, 2827, 2828, 2832, 2838, 2840, 2844, 2845, 2850, 2860, 2861, 2865, 2869, 2871, 2876, 2878, 2888, 2889, 2892, 2893, 2894, 2895, 2896, 2897, 2898, 2901, 2902, 2903, 2906, 2908, 2909, 2911, 2915, 2916, 2917, 2918, 2919, 2922, 2923, 2926, 2929, 2930, 2931, 2932, 2933, 2934, 2935, 2941, 2942, 2943, 2944, 2946, 2948, 2954, 2955, 2959, 2962, 2963, 2966, 2968, 2976, 2979, 2982, 2985, 2987, 2994, 2998, 3000, 3003, 3005, 3007, 3009, 3013, 3015, 3017, 3018, 3019, 3020, 3029, 3031, 3038, 3039, 3040, 3041, 3042, 3044, 3045, 3047, 3048, 3051, 3052, 3053, 3055, 3062, 3064, 3065, 3068, 3072, 3075, 3083, 3085, 3087, 3090, 3096, 3100, 3101, 3106, 3115, 3118, 3119, 3121, 3122, 3123, 3126, 3127, 3128, 3137, 3138, 3139, 3141, 3143, 3145, 3149, 3153, 3157, 3158, 3166, 3167, 3169, 3170, 3172, 3177, 3181, 3187, 3189, 3191, 3192, 3196, 3202, 3205, 3206, 3208, 3210, 3217, 3218, 3219, 3220, 3221, 3224, 3225, 3228, 3230, 3231, 3236, 3237, 3240, 3242, 3246, 3247, 3249, 3250, 3252, 3254, 3261, 3263, 3266, 3267, 3269, 3272, 3278, 3280, 3283, 3286, 3288, 3289, 3290, 3291, 3294, 3295, 3297, 3299, 3301, 3307, 3308, 3310, 3312, 3313, 3314, 3324, 3327, 3331, 3332, 3337, 3338, 3340, 3342, 3343, 3345, 3347, 3351, 3353, 3354, 3355, 3356, 3357, 3358, 3359, 3360, 3361, 3363, 3368, 3369, 3370, 3373, 3376, 3377, 3378, 3379, 3380, 3382, 3383, 3384, 3386, 3389, 3390, 3394, 3396, 3399, 3403, 3405, 3411, 3413, 3415, 3416, 3418, 3419, 3424, 3426, 3427, 3428, 3432, 3438, 3446, 3447, 3449, 3450, 3452, 3453, 3454, 3457, 3458, 3459, 3461, 3465, 3466, 3468, 3469, 3470, 3471, 3474, 3477, 3484, 3486, 3488, 3490, 3493, 3494, 3499, 3500, 3502, 3503, 3504, 3507, 3516, 3517, 3518, 3523, 3529, 3533, 3535, 3536, 3537, 3538, 3540, 3541, 3542, 3544, 3545, 3548, 3549, 3554, 3558, 3560, 3562, 3569, 3571, 3574, 3576, 3580, 3585, 3586, 3587, 3588, 3592, 3594, 3595, 3599, 3600, 3601, 3603, 3604, 3606, 3607, 3610, 3611, 3613, 3615, 3616, 3618, 3620, 3621, 3622, 3624, 3629, 3633, 3634, 3637, 3640, 3642, 3643, 3644, 3645, 3646, 3648, 3655, 3659, 3661, 3667, 3671, 3672, 3674, 3677, 3681, 3682, 3684, 3685, 3689, 3690, 3693, 3704, 3706, 3707, 3709, 3713, 3715, 3718, 3719, 3721, 3723, 3725, 3726, 3729, 3730, 3731, 3733, 3738, 3739, 3744, 3749, 3752, 3756, 3761, 3764, 3765, 3766, 3771, 3772, 3773, 3774, 3775, 3777, 3778, 3783, 3787, 3791, 3792, 3793, 3796, 3801, 3808, 3809, 3817, 3818, 3819, 3820, 3823, 3825, 3828, 3830, 3831, 3832, 3833, 3837, 3838, 3843, 3844, 3845, 3846, 3847, 3849, 3852, 3858, 3859, 3860, 3867, 3868, 3870, 3871, 3872, 3873, 3876, 3877, 3880, 3882, 3883, 3884, 3885, 3887, 3889, 3890, 3892, 3893, 3894, 3896, 3897, 3898, 3902, 3903, 3904, 3907, 3908, 3909, 3912, 3917, 3918, 3924, 3926, 3928, 3929, 3931, 3933, 3934, 3935, 3937, 3938, 3941, 3947, 3951, 3952, 3954, 3958, 3962, 3964, 3967, 3968, 3970, 3971, 3972, 3974, 3975, 3978, 3983, 3985, 3988, 3990, 3994, 3995, 3996, 3997, 3998, 4000, 4001, 4002, 4003, 4007, 4008, 4009, 4012, 4013, 4014, 4019, 4020, 4024, 4030, 4033, 4037, 4039, 4040, 4041, 4042, 4043, 4046, 4047, 4048, 4050, 4051, 4052, 4053, 4054, 4056, 4057, 4058, 4062, 4066, 4067, 4068, 4070, 4071, 4080, 4084, 4087, 4088, 4092, 4094, 4096, 4098, 4105, 4106, 4109, 4110, 4113, 4116, 4124, 4126, 4132, 4133, 4134, 4135, 4140, 4143, 4144, 4146, 4149, 4150, 4151, 4155, 4160, 4163, 4164, 4165, 4166, 4167, 4168, 4170, 4171, 4175, 4178, 4179, 4181, 4183, 4185, 4187, 4188, 4189, 4191, 4192, 4193, 4194, 4195, 4197, 4201, 4202, 4205, 4206, 4207, 4208, 4210, 4211, 4212, 4213, 4218, 4219, 4221, 4227, 4228, 4229, 4232, 4233, 4235, 4237, 4245, 4246, 4250, 4251, 4252, 4257, 4260, 4261, 4266, 4270, 4272, 4275, 4276, 4278, 4280, 4281, 4282, 4283, 4284, 4288, 4290, 4292, 4295, 4296, 4298, 4301, 4302, 4303, 4304, 4305, 4306, 4309, 4312, 4314, 4316, 4317, 4320, 4321, 4324, 4329, 4330, 4335, 4336, 4338, 4339, 4341, 4347, 4358, 4359, 4360, 4369, 4371, 4373, 4375, 4378, 4383, 4388, 4390, 4391, 4396, 4397, 4401, 4402, 4403, 4404, 4405, 4406, 4409, 4410, 4421, 4422, 4423, 4425, 4432, 4436, 4439, 4440, 4442, 4443, 4446, 4448, 4450, 4453, 4461, 4462, 4463, 4466, 4467, 4468, 4474, 4475, 4477, 4479, 4486, 4490, 4492, 4494, 4497, 4498, 4500, 4502, 4507, 4508, 4512, 4513, 4514, 4515, 4518, 4519, 4521, 4522, 4524, 4525, 4529, 4531, 4535, 4541, 4543, 4545, 4548, 4549, 4554, 4555, 4556, 4557, 4558, 4560, 4562, 4563, 4565, 4567, 4568, 4575, 4578, 4579, 4580, 4582, 4583, 4590, 4591, 4594, 4597, 4598, 4601, 4606, 4608, 4614, 4616, 4623, 4625, 4628, 4630, 4632, 4633, 4634, 4635, 4639, 4641, 4643, 4644, 4646, 4647, 4650, 4651, 4653, 4654, 4655, 4656, 4658, 4659, 4662, 4664, 4667, 4669, 4671, 4672, 4673, 4674, 4676, 4677, 4685, 4688, 4691, 4692, 4697, 4699, 4700, 4703, 4705, 4706, 4708, 4710, 4711, 4713, 4715, 4718, 4719, 4720, 4721, 4722, 4724, 4730, 4734, 4736, 4737, 4738, 4739, 4741, 4745, 4746, 4747, 4748, 4749, 4750, 4751, 4753, 4755, 4756, 4760, 4761, 4762, 4764, 4765, 4766, 4767, 4769, 4770, 4771, 4775, 4779, 4780, 4784, 4787, 4789, 4790, 4791, 4794, 4795, 4796, 4801, 4803, 4804, 4805, 4806, 4807, 4809, 4813, 4814, 4815, 4816, 4818, 4822, 4823, 4828, 4830, 4831, 4834, 4838, 4841, 4842, 4854, 4856, 4857, 4858, 4859, 4861, 4862, 4863, 4864, 4869, 4874, 4875, 4876, 4878, 4881, 4887, 4889, 4890, 4891, 4895, 4896, 4897, 4900, 4902, 4904, 4905, 4907, 4909, 4910, 4914, 4918, 4921, 4922, 4924, 4925, 4930, 4935, 4936, 4937, 4938, 4941, 4943, 4950, 4954, 4955, 4958, 4959, 4967, 4969, 4971, 4972, 4974, 4975, 4980, 4983, 4986, 4987, 4988, 4989, 4990, 4993, 4994, 4996, 5000, 5011, 5015, 5016, 5021, 5024, 5026, 5027, 5029, 5030, 5034, 5036, 5037, 5039, 5040, 5042, 5044, 5045, 5046, 5049, 5052, 5054, 5057, 5060, 5061, 5063, 5067, 5068, 5069, 5072, 5074, 5075, 5078, 5079, 5082, 5088, 5089, 5090, 5091, 5094, 5097, 5098, 5100, 5101, 5102, 5106, 5109, 5110, 5113, 5114, 5115, 5116, 5122, 5123, 5125, 5131, 5132, 5140, 5143, 5147, 5148, 5149, 5153, 5159, 5160, 5164, 5165, 5168, 5170, 5172, 5174, 5180, 5181, 5184, 5185, 5187, 5188, 5189, 5190, 5191, 5192, 5193, 5196, 5198, 5200, 5202, 5203, 5206, 5209, 5212, 5213, 5216, 5217, 5218, 5219, 5221, 5222, 5225, 5234, 5240, 5244, 5245, 5248, 5249, 5251, 5253, 5254, 5255, 5258, 5260, 5261, 5263, 5264, 5267, 5268, 5269, 5273, 5275, 5276, 5280, 5281, 5283, 5285, 5286, 5287, 5292, 5297, 5298, 5299, 5300, 5301, 5308, 5309, 5311, 5313, 5315, 5317, 5319, 5321, 5324, 5329, 5330, 5333, 5334, 5338, 5339, 5342, 5343, 5345, 5346, 5348, 5349, 5351, 5352, 5366, 5367, 5369, 5386, 5388, 5389, 5391, 5393, 5396, 5397, 5404, 5405, 5409, 5411, 5413, 5414, 5417, 5418, 5422, 5427, 5428, 5431, 5434, 5438, 5446, 5448, 5449, 5450, 5452, 5453, 5455, 5456, 5458, 5459, 5461, 5463, 5464, 5472, 5475, 5483, 5487, 5488, 5491, 5493, 5495, 5496, 5505, 5508, 5510, 5512, 5513, 5515, 5517, 5518, 5519, 5524, 5526, 5529, 5530, 5531, 5532, 5535, 5537, 5543, 5545, 5554, 5561, 5562, 5563, 5564, 5566, 5568, 5569, 5572, 5575, 5579, 5581, 5582, 5584, 5585, 5586, 5589, 5593, 5594, 5597, 5602, 5608, 5611, 5613, 5614, 5615, 5616, 5620, 5621, 5623, 5627, 5630, 5632, 5633, 5635, 5638, 5640, 5643, 5647, 5648, 5649, 5650, 5651, 5652, 5653, 5656, 5657, 5659, 5660, 5662, 5663, 5669, 5680, 5681, 5683, 5689, 5690, 5694, 5695, 5696, 5697, 5698, 5702, 5706, 5711, 5712, 5713, 5714, 5717, 5718, 5719, 5721, 5722, 5723, 5729, 5730, 5731, 5732, 5734, 5735, 5736, 5737, 5742, 5744, 5748, 5751, 5768, 5770, 5773, 5775, 5778, 5780, 5784, 5785, 5787, 5791, 5792, 5794, 5803, 5804, 5805, 5806, 5807, 5808, 5811, 5814, 5815, 5817, 5820, 5825, 5826, 5828, 5832, 5833, 5834, 5835, 5836, 5837, 5839, 5842, 5844, 5846, 5854, 5859, 5864, 5866, 5867, 5869, 5871, 5872, 5873, 5876, 5878, 5879, 5881, 5882, 5883, 5884, 5888, 5889, 5892, 5893, 5901, 5906, 5907, 5910, 5912, 5913, 5914, 5918, 5919, 5921, 5922, 5923, 5925, 5926, 5927, 5928, 5931, 5932, 5938, 5939, 5940, 5941, 5942, 5944, 5948, 5951, 5954, 5956, 5957, 5959, 5961, 5964, 5967, 5968, 5971, 5973, 5978, 5979, 5980, 5985, 5986, 5990, 5991, 5992, 5994, 5996, 5999, 6000, 6003, 6004, 6005, 6006, 6007, 6010, 6012, 6013, 6016, 6017, 6023, 6025, 6026, 6031, 6038, 6040, 6041, 6044, 6047, 6048, 6051, 6053, 6058, 6059, 6061, 6062, 6063, 6065, 6068, 6069, 6070, 6072, 6073, 6074, 6077, 6080, 6081, 6084, 6089, 6092, 6093, 6094, 6095, 6098, 6107, 6108, 6109, 6110, 6112, 6113, 6116, 6118, 6119, 6120, 6122, 6129, 6130, 6131, 6132, 6133, 6135, 6136, 6137, 6138, 6140, 6143, 6145, 6146, 6147, 6149, 6150, 6151, 6152, 6153, 6156, 6158, 6160, 6163, 6164, 6165, 6168, 6176, 6182, 6183, 6186, 6190, 6191, 6193, 6197, 6198, 6200, 6203, 6204, 6205, 6207, 6209, 6212, 6213, 6220, 6221, 6223, 6224, 6226, 6227, 6228, 6230, 6231, 6234, 6237, 6238, 6239, 6240, 6241, 6243, 6245, 6246, 6247, 6249, 6251, 6255, 6257, 6258, 6259, 6260, 6264, 6265, 6269, 6271, 6272, 6273, 6275, 6278, 6279, 6282, 6286, 6288, 6289, 6292, 6294, 6299, 6300, 6302, 6308, 6309, 6310, 6312, 6315, 6317, 6319, 6321, 6322, 6325, 6328, 6332, 6333, 6334, 6338, 6346, 6351, 6352, 6353, 6354, 6359, 6362, 6363, 6364, 6367, 6370, 6372, 6373, 6375, 6378, 6379, 6381, 6383, 6394, 6395, 6396, 6397, 6398, 6399, 6403, 6405, 6407, 6408, 6412, 6413, 6414, 6415, 6419, 6420, 6422, 6426, 6428, 6430, 6431, 6434, 6435, 6436, 6437, 6440, 6442, 6454, 6459, 6463, 6464, 6466, 6467, 6468, 6469, 6470, 6471, 6474, 6476, 6480, 6482, 6484, 6486, 6488, 6492, 6495, 6497, 6499, 6500, 6501, 6502, 6503, 6504, 6505, 6510, 6513, 6514, 6515, 6516, 6517, 6519, 6524, 6525, 6526, 6530, 6532, 6533, 6534, 6535, 6537, 6543, 6544, 6547, 6549, 6552, 6554, 6555, 6558, 6560, 6561, 6563, 6567, 6569, 6572, 6574, 6576, 6577, 6579, 6581, 6582, 6584, 6587, 6588, 6594, 6595, 6597, 6598, 6607, 6609, 6611, 6614, 6617, 6621, 6622, 6624, 6625, 6626, 6627, 6628, 6630, 6635, 6637, 6638, 6639, 6643, 6644, 6648, 6649, 6652, 6655, 6656, 6662, 6666, 6671, 6672, 6673, 6678, 6681, 6686, 6691, 6692, 6695, 6696, 6701, 6702, 6703, 6705, 6706, 6711, 6713, 6714, 6716, 6718, 6720, 6724, 6725, 6729, 6731, 6734, 6737, 6739, 6746, 6747, 6752, 6757, 6759, 6760, 6761, 6764, 6766, 6767, 6776, 6778, 6779, 6780, 6786, 6788, 6792, 6793, 6794, 6797, 6799, 6803, 6804, 6805, 6807, 6810, 6811, 6812, 6813, 6816, 6819, 6820, 6821, 6824, 6827, 6828, 6829, 6830, 6831, 6834, 6836, 6837, 6841, 6842, 6843, 6845, 6848, 6859, 6860, 6863, 6864, 6865, 6867, 6869, 6872, 6874, 6875, 6876, 6878, 6879, 6880, 6882, 6883, 6884, 6888, 6890, 6894, 6897, 6903, 6904, 6906, 6907, 6913, 6914, 6915, 6917, 6919, 6921, 6922, 6925, 6930, 6933, 6936, 6941, 6944, 6946, 6948, 6950, 6951, 6952, 6959, 6960, 6963, 6966, 6967, 6969, 6974, 6979, 6980, 6984, 6985, 6987, 6988, 6990, 6991, 6993, 6994, 6995, 6999, 7002, 7003, 7006, 7009, 7011, 7012, 7013, 7015, 7017, 7022, 7032, 7033, 7039, 7040, 7042, 7043, 7046, 7052, 7053, 7056, 7057, 7060, 7062, 7064, 7067, 7068, 7072, 7073, 7075, 7077, 7079, 7083, 7084, 7085, 7093, 7097, 7105, 7106, 7107, 7108, 7117, 7118, 7124, 7130, 7132, 7135, 7137, 7138, 7139, 7140, 7142, 7146, 7149, 7151, 7155, 7164, 7165, 7166, 7167, 7169, 7173, 7176, 7177, 7182, 7183, 7184, 7187, 7188, 7197, 7198, 7201, 7202, 7203, 7206, 7207, 7208, 7209, 7212, 7216, 7217, 7219, 7227, 7228, 7232, 7233, 7234, 7235, 7236, 7239, 7240, 7241, 7243, 7244, 7245, 7248, 7255, 7257, 7258, 7259, 7262, 7267, 7268, 7269, 7270, 7274, 7277, 7281, 7282, 7284, 7287, 7288, 7290, 7291, 7292, 7293, 7298, 7299, 7300, 7301, 7303, 7304, 7305, 7306, 7307, 7308, 7310, 7311, 7312, 7315, 7317, 7328, 7330, 7334, 7338, 7339, 7340, 7344, 7345, 7348, 7354, 7355, 7356, 7357, 7358, 7361, 7363, 7365, 7371, 7373, 7377, 7379, 7380, 7381, 7382, 7383, 7386, 7387, 7388, 7389, 7392, 7395, 7398, 7400, 7407, 7410, 7411, 7417, 7425, 7428, 7430, 7434, 7435, 7436, 7443, 7444, 7446, 7447, 7448, 7452, 7454, 7458, 7459, 7466, 7470, 7474, 7476, 7486, 7490, 7492, 7493, 7498, 7502, 7504, 7505, 7506, 7512, 7515, 7517, 7518, 7522, 7523, 7525, 7528, 7533, 7534, 7537, 7538, 7546, 7547, 7548, 7561, 7570, 7574, 7577, 7578, 7579, 7580, 7583, 7585, 7586, 7587, 7588, 7591, 7593, 7594, 7599, 7601, 7605, 7611, 7617, 7619, 7620, 7621, 7623, 7624, 7632, 7633, 7634, 7638, 7639, 7640, 7642, 7643, 7652, 7658, 7661, 7663, 7664, 7665, 7666, 7667, 7674, 7677, 7678, 7679, 7680, 7682, 7685, 7686, 7687, 7689, 7695, 7699, 7700, 7703, 7704, 7708, 7712, 7713, 7716, 7717, 7718, 7719, 7724, 7725, 7729, 7730, 7734, 7736, 7737, 7738, 7740, 7744, 7745, 7747, 7751, 7753, 7761, 7762, 7763, 7764, 7768, 7769, 7770, 7774, 7775, 7777, 7778, 7779, 7780, 7781, 7782, 7783, 7785, 7786, 7788, 7791, 7793, 7794, 7796, 7798, 7800, 7803, 7804, 7806, 7807, 7818, 7819, 7820, 7823, 7824, 7825, 7832, 7833, 7834, 7836, 7838, 7841, 7844, 7845, 7847, 7848, 7849, 7852, 7856, 7859, 7860, 7862, 7863, 7865, 7866, 7867, 7873, 7876, 7878, 7888, 7890, 7896, 7900, 7908, 7909, 7910, 7911, 7918, 7920, 7923, 7925, 7927, 7929, 7933, 7936, 7938, 7942, 7944, 7945, 7946, 7947, 7948, 7949, 7950, 7955, 7956, 7964, 7965, 7966, 7967, 7972, 7974, 7976, 7977, 7978, 7980, 7983, 7984, 7986, 7988, 7989, 7990, 7991, 7992, 7993, 8002, 8004, 8005, 8006, 8008, 8009, 8012, 8021, 8026, 8029, 8035, 8039, 8042, 8044, 8047, 8052, 8053, 8056, 8058, 8059, 8063, 8064, 8066, 8067, 8068, 8071, 8072, 8073, 8075, 8076, 8077, 8078, 8079, 8080, 8082, 8084, 8088, 8091, 8093, 8095, 8099, 8100, 8102, 8103, 8105, 8106, 8112, 8116, 8118, 8120, 8121, 8126, 8130, 8134, 8136, 8137, 8145, 8146, 8148, 8150, 8155, 8159, 8162, 8163, 8164, 8165, 8170, 8176, 8178, 8179, 8189, 8193, 8195, 8199, 8202, 8204, 8206, 8207, 8208, 8211, 8213, 8215, 8216, 8219, 8220, 8222, 8223, 8225, 8227, 8234, 8235, 8237, 8239, 8245, 8250, 8252, 8253, 8257, 8258, 8262, 8265, 8266, 8268, 8269, 8270, 8272, 8282, 8289, 8291, 8292, 8293, 8300, 8301, 8304, 8306, 8310, 8312, 8318, 8319, 8320, 8321, 8324, 8325, 8329, 8331, 8334, 8335, 8336, 8339, 8340, 8349, 8350, 8351, 8352, 8353, 8355, 8363, 8367, 8368, 8369, 8373, 8379, 8382, 8385, 8386, 8387, 8389, 8392, 8393, 8400, 8401, 8402, 8403, 8404, 8405, 8407, 8410, 8411, 8413, 8414, 8416, 8417, 8418, 8423, 8428, 8430, 8433, 8435, 8436, 8438, 8439, 8441, 8444, 8446, 8447, 8448, 8449, 8450, 8451, 8452, 8456, 8457, 8460, 8465, 8466, 8469, 8472, 8473, 8474, 8476, 8477, 8480, 8481, 8482, 8485, 8486, 8490, 8493, 8498, 8499, 8501, 8502, 8505, 8509, 8511, 8513, 8515, 8517, 8520, 8523, 8524, 8525, 8528, 8531, 8532, 8533, 8537, 8538, 8539, 8541, 8543, 8544, 8549, 8550, 8551, 8552, 8554, 8557, 8561, 8562, 8565, 8566, 8568, 8575, 8576, 8579, 8581, 8582, 8589, 8590, 8593, 8594, 8596, 8597, 8600, 8601, 8602, 8603, 8605, 8609, 8610, 8611, 8612, 8613, 8614, 8617, 8618, 8624, 8628, 8631, 8634, 8635, 8638, 8640, 8641, 8642, 8644, 8650, 8654, 8657, 8658, 8659, 8660, 8665, 8669, 8670, 8672, 8676, 8677, 8685, 8693, 8700, 8704, 8706, 8708, 8709, 8711, 8713, 8716, 8717, 8719, 8720, 8726, 8727, 8729, 8730, 8731, 8732, 8734, 8735, 8740, 8741, 8742, 8744, 8745, 8746, 8748, 8751, 8752, 8753, 8764, 8767, 8772, 8773, 8775, 8777, 8779, 8782, 8783, 8784, 8789, 8792, 8795, 8797, 8803, 8804, 8805, 8810, 8817, 8818, 8822, 8824, 8829, 8831, 8832, 8835, 8838, 8839, 8841, 8843, 8846, 8853, 8854, 8861, 8865, 8866, 8867, 8877, 8878, 8880, 8881, 8883, 8886, 8888, 8889, 8892, 8897, 8899, 8900, 8902, 8905, 8907, 8908, 8909, 8910, 8911, 8912, 8914, 8916, 8917, 8925, 8926, 8929, 8930, 8935, 8938, 8941, 8942, 8945, 8946, 8949, 8951, 8954, 8957, 8959, 8960, 8961, 8962, 8963, 8967, 8968, 8972, 8974, 8976, 8977, 8979, 8980, 8981, 8985, 8986, 8992, 8996, 8998, 8999, 9001, 9002, 9003, 9004, 9006, 9009, 9012, 9015, 9017, 9020, 9023, 9026, 9027, 9029, 9030, 9033, 9037, 9044, 9047, 9052, 9057, 9058, 9059, 9060, 9062, 9066, 9069, 9071, 9072, 9073, 9074, 9076, 9084, 9088, 9092, 9095, 9096, 9100, 9103, 9105, 9108, 9110, 9111, 9112, 9114, 9115, 9118, 9120, 9123, 9124, 9125, 9128, 9129, 9133, 9134, 9139, 9140, 9141, 9142, 9146, 9149, 9151, 9154, 9155, 9157, 9167, 9168, 9173, 9174, 9177, 9180, 9183, 9185, 9187, 9188, 9190, 9191, 9195, 9200, 9204, 9206, 9207, 9210, 9211, 9213, 9215, 9216, 9218, 9226, 9229, 9231, 9233, 9234, 9237, 9241, 9242, 9243, 9247, 9248, 9249, 9252, 9253, 9254, 9255, 9263, 9265, 9267, 9270, 9273, 9276, 9278, 9284, 9285, 9287, 9288, 9290, 9291, 9292, 9293, 9299, 9300, 9302, 9304, 9308, 9311, 9320, 9323, 9325, 9326, 9327, 9328, 9329, 9330, 9336, 9337, 9338, 9339, 9340, 9341, 9346, 9347, 9348, 9355, 9357, 9359, 9366, 9367, 9373, 9375, 9376, 9378, 9382, 9383, 9385, 9388, 9391, 9392, 9393, 9394, 9396, 9398, 9400, 9402, 9403, 9404, 9406, 9407, 9413, 9414, 9415, 9417, 9423, 9432, 9433, 9434, 9440, 9442, 9443, 9444, 9452, 9453, 9456, 9460, 9468, 9470, 9471, 9472, 9473, 9478, 9481, 9483, 9486, 9488, 9490, 9494, 9495, 9497, 9500, 9501, 9502, 9503, 9504, 9509, 9514, 9515, 9517, 9518, 9519, 9520, 9525, 9531, 9532, 9533, 9534, 9536, 9540, 9545, 9548, 9553, 9555, 9557, 9559, 9563, 9564, 9565, 9567, 9568, 9571, 9577, 9579, 9582, 9583, 9586, 9587, 9589, 9590, 9591, 9592, 9602, 9606, 9608, 9609, 9610, 9613, 9614, 9615, 9620, 9623, 9626, 9627, 9628, 9629, 9630, 9633, 9635, 9640, 9641, 9642, 9644, 9645, 9646, 9649, 9650, 9653, 9655, 9656, 9657, 9658, 9660, 9663, 9666, 9668, 9670, 9675, 9677, 9681, 9682, 9686, 9692, 9693, 9696, 9698, 9700, 9701, 9706, 9710, 9711, 9718, 9722, 9723, 9725, 9726, 9730, 9731, 9733, 9734, 9737, 9746, 9750, 9751, 9753, 9754, 9755, 9756, 9763, 9764, 9767, 9768, 9770, 9774, 9776, 9780, 9781, 9782, 9784, 9786, 9792, 9793, 9794, 9796, 9799, 9804, 9806, 9809, 9810, 9812, 9813, 9814, 9816, 9819, 9820, 9824, 9825, 9827, 9829, 9830, 9833, 9836, 9845, 9846, 9847, 9849, 9850, 9851, 9853, 9854, 9858, 9860, 9861, 9864, 9866, 9869, 9873, 9876, 9880, 9882, 9885, 9886, 9887, 9892, 9897, 9900, 9901, 9906, 9907, 9908, 9909, 9910, 9911, 9912, 9917, 9923, 9924, 9928, 9935, 9938, 9940, 9946, 9947, 9949, 9950, 9953, 9955, 9957, 9958, 9960, 9962, 9963, 9964, 9967, 9968, 9969, 9971, 9972, 9979, 9980, 9982, 9984, 9985, 9987, 9988, 9990, 9991, 9996, 9997, 9998, 10000, 10008, 10009, 10010, 10013, 10017, 10018, 10019, 10021, 10022, 10026, 10031, 10032, 10033, 10034, 10035, 10037, 10038, 10041, 10042, 10045, 10047, 10048, 10050, 10051, 10052, 10054, 10056, 10058, 10059, 10060, 10062, 10064, 10066, 10068, 10073, 10077, 10078, 10082, 10083, 10086, 10089, 10090, 10091, 10092, 10095, 10097, 10101, 10102, 10103, 10105, 10106, 10107, 10108, 10109, 10110, 10114, 10115, 10116, 10118, 10119, 10122, 10127, 10128, 10131, 10132, 10136, 10143, 10146, 10149, 10151, 10152, 10154, 10158, 10163, 10165, 10166, 10168, 10170, 10174, 10176, 10177, 10178, 10181, 10182, 10187, 10191, 10192, 10193, 10194, 10195, 10197, 10199, 10203, 10206, 10213, 10214, 10218, 10219, 10220, 10222, 10223, 10224, 10225, 10228, 10232, 10233, 10236, 10237, 10239, 10247, 10252, 10253, 10255, 10270, 10275, 10278, 10284, 10291, 10292, 10293, 10295, 10300, 10302, 10306, 10311, 10312, 10321, 10322, 10323, 10325, 10326, 10328, 10329, 10331, 10333, 10334, 10335, 10338, 10342, 10343, 10344, 10346, 10351, 10352, 10353, 10357, 10359, 10360, 10362, 10364, 10365, 10368, 10369, 10371, 10373, 10375, 10380, 10381, 10384, 10385, 10388, 10389, 10395, 10397, 10398, 10399, 10401, 10405, 10410, 10413, 10414, 10416, 10421, 10422, 10423, 10424, 10430, 10435, 10437, 10438, 10440, 10446, 10447, 10448, 10449, 10450, 10451, 10453, 10455, 10456, 10463, 10464, 10465, 10466, 10468, 10469, 10470, 10472, 10473, 10474, 10478, 10480, 10482, 10487, 10488, 10490, 10491, 10492, 10494, 10496, 10497, 10498, 10499, 10506, 10508, 10513, 10514, 10516, 10518, 10525, 10527, 10528, 10531, 10532, 10533, 10535, 10536, 10537, 10541, 10542, 10543, 10544, 10547, 10548, 10549, 10550, 10551, 10555, 10556, 10558, 10560, 10561, 10562, 10565, 10567, 10569, 10571, 10573, 10579, 10580, 10581, 10582, 10583, 10585, 10587, 10590, 10593, 10595, 10596, 10597, 10599, 10601, 10602, 10606, 10609, 10610, 10611, 10612, 10613, 10615, 10616, 10617, 10621, 10622, 10623, 10626, 10628, 10629, 10630, 10631, 10633, 10634, 10637, 10638, 10639, 10640, 10641, 10642, 10643, 10645, 10646, 10650, 10655, 10657, 10659, 10663, 10665, 10668, 10670, 10673, 10674, 10677, 10678, 10681, 10682, 10683, 10684, 10685, 10686, 10687, 10689, 10693, 10697, 10698, 10699, 10700, 10702, 10703, 10705, 10706, 10707, 10708, 10711, 10715, 10716, 10723, 10725, 10726, 10727, 10732, 10735, 10736, 10737, 10738, 10739, 10740, 10741, 10744, 10745, 10747, 10748, 10749, 10752, 10756, 10761, 10762, 10763, 10766, 10779, 10782, 10784, 10785, 10787, 10788, 10790, 10791, 10792, 10795, 10796, 10798, 10800, 10801, 10802, 10803, 10805, 10809, 10810, 10811, 10812, 10815, 10818, 10819, 10820, 10821, 10822, 10823, 10824, 10825, 10826, 10831, 10832, 10833, 10836, 10838, 10839, 10840, 10841, 10843, 10846, 10847, 10850, 10852, 10853, 10854, 10857, 10858, 10860, 10862, 10866, 10867, 10877, 10878, 10880, 10881, 10887, 10891, 10892, 10893, 10896, 10897, 10898, 10899, 10902, 10905, 10911, 10912, 10915, 10916, 10917, 10920, 10926, 10927, 10928, 10930, 10933, 10934, 10935, 10936, 10937, 10938, 10940, 10941, 10944, 10947, 10948, 10950, 10954, 10957, 10960, 10962, 10963, 10965, 10967, 10972, 10975, 10976, 10977, 10978, 10979, 10980, 10981, 10985, 10988, 10993, 10995, 10996, 10997, 10999, 11004, 11005, 11006, 11008, 11010, 11018, 11024, 11027, 11032, 11039, 11045, 11046, 11047, 11052, 11053, 11056, 11060, 11063, 11066, 11068, 11070, 11071, 11072, 11078, 11079, 11080, 11082, 11083, 11086, 11090, 11095, 11098, 11099, 11100, 11101, 11102, 11103, 11107, 11110, 11114, 11116, 11118, 11119, 11123, 11124, 11125, 11127, 11129, 11132, 11135, 11137, 11138, 11141, 11145, 11146, 11152, 11154, 11158, 11159, 11160, 11161, 11162, 11163, 11165, 11166, 11168, 11169, 11175, 11177, 11178, 11179, 11180, 11181, 11184, 11185, 11187, 11188, 11190, 11191, 11192, 11194, 11198, 11199, 11201, 11202, 11203, 11207, 11210, 11214, 11217, 11218, 11222, 11226, 11227, 11228, 11229, 11230, 11232, 11233, 11234, 11235, 11237, 11239, 11240, 11242, 11246, 11247, 11248, 11254, 11255, 11256, 11257, 11258, 11259, 11260, 11261, 11262, 11263, 11264, 11266, 11274, 11275, 11278, 11288, 11289, 11290, 11291, 11292, 11293, 11294, 11295, 11298, 11306, 11307, 11313, 11315, 11316, 11320, 11322, 11324, 11326, 11330, 11331, 11332, 11337, 11339, 11340, 11341, 11345, 11346, 11348, 11349, 11352, 11356, 11358, 11363, 11364, 11365, 11366, 11369, 11370, 11371, 11373, 11377, 11381, 11382, 11387, 11388, 11389, 11391, 11392, 11394, 11395, 11397, 11398, 11403, 11405, 11406, 11408, 11409, 11411, 11412, 11413, 11414, 11416, 11418, 11423, 11426, 11428, 11431, 11434, 11437, 11438, 11442, 11445, 11446, 11449, 11451, 11459, 11463, 11465, 11471, 11472, 11473, 11475, 11476, 11477, 11481, 11482, 11485, 11487, 11490, 11494, 11496, 11497, 11498, 11500, 11506, 11507, 11508, 11509, 11512, 11516, 11518, 11520, 11522, 11523, 11524, 11526, 11527, 11528, 11530, 11531, 11532, 11533, 11534, 11538, 11541, 11544, 11546, 11548, 11551, 11553, 11558, 11560, 11561, 11563, 11564, 11567, 11568, 11570, 11571, 11574, 11576, 11577, 11580, 11583, 11585, 11588, 11589, 11594, 11595, 11597, 11598, 11599, 11604, 11612, 11618, 11620, 11621, 11623, 11625, 11628, 11629, 11632, 11633, 11637, 11639, 11642, 11650, 11651, 11652, 11653, 11654, 11655, 11656, 11657, 11658, 11663, 11664, 11667, 11668, 11669, 11672, 11673, 11677, 11678, 11681, 11682, 11683, 11684, 11688, 11691, 11692, 11693, 11694, 11695, 11696, 11701, 11703, 11705, 11707, 11711, 11712, 11721, 11725, 11726, 11731, 11733, 11736, 11740, 11741, 11743, 11744, 11748, 11753, 11755, 11759, 11760, 11761, 11762, 11763, 11764, 11766, 11767, 11770, 11771, 11773, 11776, 11780, 11781, 11782, 11783, 11785, 11786, 11790, 11792, 11795, 11799, 11800, 11809, 11811, 11812, 11813, 11814, 11818, 11819, 11820, 11825, 11826, 11828, 11829, 11830, 11831, 11832, 11833, 11837, 11838, 11841, 11846, 11848, 11849, 11850, 11851, 11853, 11856, 11857, 11858, 11863, 11868, 11870, 11872, 11876, 11877, 11879, 11881, 11890, 11891, 11893, 11894, 11898, 11903, 11904, 11909, 11913, 11915, 11916, 11917, 11918, 11919, 11920, 11921, 11922, 11923, 11926, 11927, 11928, 11929, 11930, 11934, 11935, 11940, 11941, 11943, 11945, 11946, 11947, 11948, 11949, 11953, 11955, 11957, 11958, 11959, 11960, 11961, 11962, 11963, 11965, 11966, 11968, 11977, 11978, 11980, 11983, 11988, 11993, 11997, 11999, 12002, 12004, 12008, 12017, 12019, 12020, 12023, 12024, 12025, 12029, 12032, 12042, 12043, 12044, 12047, 12050, 12051, 12054, 12059, 12060, 12061, 12064, 12066, 12068, 12077, 12078, 12079, 12080, 12081, 12082, 12083, 12085, 12091, 12092, 12093, 12094, 12097, 12098, 12102, 12104, 12106, 12108, 12109, 12112, 12114, 12115, 12118, 12120, 12122, 12127, 12128, 12129, 12130, 12131, 12134, 12135, 12138, 12139, 12143, 12144, 12145, 12146, 12147, 12149, 12150, 12151, 12161, 12162, 12163, 12165, 12166, 12170, 12171, 12173, 12174, 12175, 12179, 12181, 12186, 12187, 12197, 12198, 12200, 12201, 12202, 12204, 12208, 12212, 12217, 12218, 12220, 12223, 12233, 12237, 12240, 12241, 12243, 12245, 12249, 12250, 12252, 12254, 12255, 12259, 12265, 12268, 12269, 12271, 12278, 12280, 12283, 12285, 12286, 12287, 12293, 12295, 12296, 12302, 12304, 12310, 12311, 12312, 12313, 12314, 12315, 12317, 12319, 12321, 12323, 12325, 12328, 12331, 12334, 12335, 12337, 12339, 12342, 12343, 12345, 12347, 12350, 12354, 12356, 12358, 12359, 12364, 12366, 12367, 12369, 12370, 12375, 12376, 12379, 12380, 12381, 12383, 12385, 12390, 12393, 12394, 12397, 12400, 12401, 12403, 12406, 12411, 12414, 12415, 12417, 12419, 12420, 12423, 12424, 12426, 12427, 12430, 12432, 12437, 12440, 12441, 12444, 12445, 12446, 12450, 12451, 12456, 12457, 12461, 12462, 12465, 12467, 12468, 12472, 12473, 12478, 12479, 12480, 12481, 12483, 12487, 12488, 12492, 12494, 12497, 12501, 12502, 12503, 12504, 12512, 12513, 12514, 12515, 12518, 12527, 12530, 12531, 12535, 12536, 12537, 12538, 12539, 12540, 12546, 12547, 12549, 12551, 12552, 12554, 12555, 12556, 12557, 12559, 12561, 12563, 12565, 12567, 12568, 12570, 12572, 12578, 12580, 12583, 12585, 12586, 12588, 12591, 12600, 12603, 12605, 12606, 12610, 12611, 12616, 12620, 12622, 12623, 12626, 12628, 12629, 12633, 12634, 12639, 12640, 12641, 12648, 12649, 12651, 12652, 12653, 12654, 12658, 12663, 12664, 12668, 12670, 12671, 12674, 12675, 12679, 12683, 12684, 12685, 12688, 12691, 12692, 12693, 12695, 12696, 12697, 12699, 12701, 12702, 12705, 12706, 12710, 12716, 12723, 12727, 12731, 12732, 12733, 12735, 12738, 12739, 12740, 12741, 12742, 12743, 12750, 12752, 12753, 12754, 12755, 12757, 12758, 12760, 12761, 12764, 12765, 12766, 12771, 12775, 12777, 12782, 12790, 12793, 12794, 12797, 12800, 12802, 12803, 12807, 12808, 12810, 12812, 12813, 12817, 12820, 12822, 12823, 12824, 12826, 12827, 12828, 12835, 12836, 12837, 12838, 12839, 12843, 12844, 12848, 12849, 12850, 12853, 12861, 12863, 12866, 12870, 12873, 12875, 12878, 12882, 12883, 12884, 12887, 12888, 12891, 12894, 12895, 12898, 12899, 12900, 12901, 12903, 12904, 12905, 12906, 12908, 12910, 12912, 12913, 12916, 12920, 12921, 12928, 12929, 12932, 12933, 12934, 12935, 12938, 12940, 12945, 12946, 12947, 12950, 12952, 12956, 12957, 12958, 12959, 12960, 12961, 12963, 12967, 12968, 12969, 12978, 12983, 12984, 12985, 12986, 12987, 12988, 12990, 12991, 12999, 13001, 13003, 13004, 13005, 13007, 13010, 13014, 13015, 13017, 13018, 13022, 13027, 13030, 13031, 13032, 13033, 13034, 13035, 13037, 13040, 13041, 13049, 13050, 13053, 13054, 13055, 13056, 13059, 13061, 13062, 13064, 13066, 13067, 13071, 13075, 13079, 13083, 13085, 13086, 13087, 13097, 13099, 13101, 13102, 13105, 13106, 13109, 13110, 13111, 13112, 13114, 13115, 13116, 13117, 13118, 13120, 13121, 13122, 13123, 13124, 13125, 13128, 13131, 13134, 13143, 13144, 13147, 13148, 13149, 13151, 13154, 13159, 13160, 13166, 13169, 13175, 13181, 13182, 13186, 13188, 13189, 13193, 13197, 13198, 13199, 13203, 13205, 13206, 13209, 13210, 13212, 13213, 13217, 13221, 13224, 13226, 13227, 13228, 13232, 13233, 13234, 13235, 13236, 13237, 13239, 13241, 13248, 13250, 13251, 13255, 13256, 13258, 13259, 13260, 13261, 13262, 13263, 13264, 13267, 13268, 13269, 13271, 13273, 13274, 13280, 13281, 13283, 13284, 13296, 13297, 13298, 13300, 13301, 13303, 13304, 13313, 13315, 13317, 13319, 13329, 13332, 13335, 13337, 13340, 13343, 13344, 13345, 13346, 13347, 13348, 13350, 13352, 13361, 13363, 13367, 13368, 13369, 13370, 13377, 13380, 13381, 13384, 13385, 13386, 13388, 13390, 13391, 13393, 13394, 13395, 13396, 13397, 13398, 13401, 13402, 13403, 13404, 13407, 13408, 13410, 13412, 13413, 13416, 13417, 13419, 13423, 13424, 13428, 13430, 13433, 13439, 13441, 13444, 13448, 13451, 13454, 13456, 13457, 13460, 13461, 13463, 13467, 13469, 13473, 13474, 13475, 13477, 13478, 13479, 13480, 13489, 13491, 13492, 13496, 13499, 13503, 13507, 13513, 13514, 13515, 13519, 13521, 13522, 13524, 13526, 13530, 13532, 13533, 13535, 13536, 13539, 13540, 13543, 13544, 13545, 13546, 13547, 13549, 13552, 13553, 13555, 13558, 13559, 13561, 13562, 13568, 13569, 13574, 13575, 13577, 13578, 13580, 13584, 13587, 13597, 13599, 13600, 13601, 13602, 13604, 13605, 13606, 13612, 13613, 13614, 13621, 13623, 13630, 13631, 13632, 13634, 13636, 13637, 13641, 13647, 13650, 13651, 13653, 13654, 13662, 13663, 13665, 13675, 13676, 13677, 13678, 13679, 13683, 13687, 13688, 13689, 13696, 13697, 13698, 13699, 13700, 13706, 13710, 13714, 13716, 13719, 13720, 13721, 13722, 13729, 13730, 13734, 13736, 13737, 13739, 13742, 13745, 13747, 13750, 13755, 13756, 13763, 13764, 13766, 13767, 13772, 13773, 13775, 13777, 13779, 13782, 13783, 13786, 13787, 13788, 13789, 13791, 13793, 13794, 13796, 13798, 13799, 13801, 13802, 13809, 13816, 13817, 13818, 13819, 13822, 13823, 13828, 13830, 13831, 13834, 13835, 13843, 13848, 13849, 13852, 13858, 13869, 13870, 13872, 13873, 13874, 13875, 13877, 13879, 13885, 13887, 13891, 13892, 13895, 13897, 13898, 13899, 13901, 13906, 13909, 13910, 13911, 13915, 13917, 13918, 13919, 13920, 13921, 13924, 13925, 13932, 13934, 13938, 13947, 13948, 13949, 13950, 13952, 13953, 13954, 13958, 13960, 13961, 13963, 13969, 13970, 13975, 13976, 13984, 13986, 13987, 13991, 14000, 14001, 14005, 14006, 14008, 14009, 14013, 14014, 14017, 14022, 14027, 14030, 14031, 14035, 14036, 14038, 14040, 14049, 14051, 14052, 14059, 14062, 14063, 14066, 14067, 14069, 14070, 14071, 14072, 14073, 14074, 14075, 14078, 14081, 14084, 14085, 14086, 14088, 14092, 14093, 14094, 14095, 14096, 14097, 14104, 14105, 14112, 14116, 14117, 14118, 14119, 14121, 14122, 14124, 14125, 14129, 14130, 14132, 14133, 14135, 14138, 14139, 14143, 14145, 14146, 14147.

The tissue-enhanced promoters that were identified by ROSETTA analysis include the following. In the following descriptions, a reference to a "Vn" stage means plant development stage at which the nth leaf has emerged. A reference to the "Flag" leaf means the top-most leaf.

Promoters expressing in the callus tissue at harvest include SEQ IDs: 1, 3, 4, 7, 9, 11, 13, 14, 15, 27, 29, 31, 32, 34, 36, 48, 54, 63, 64, 65, 67, 68, 69, 70, 71, 88, 96, 99, 102, 103, 107, 110, 111, 112, 121, 126, 130, 131, 132, 134, 139, 140, 143, 147, 148, 152, 154, 156, 157, 159, 162, 165, 175, 176, 177, 183, 187, 191, 194, 197, 199, 203, 204, 205, 207, 210, 211, 212, 223, 232, 235, 236, 237, 240, 243, 244, 246, 248, 249, 250, 251, 257, 259, 262, 264, 273, 280, 286, 288, 289, 291, 294, 301, 302, 303, 305, 306, 309, 316, 319, 320, 322, 323, 328, 329, 332, 335, 341, 346, 348, 349, 352, 353, 354, 356, 358, 360, 365, 367, 371, 373, 374, 378, 379, 387, 388, 396, 401, 405, 406, 407, 412, 414, 419, 420, 423, 424, 428, 429, 433, 434, 452, 456, 460, 461, 466, 471, 474, 478, 479, 481, 483, 484, 485, 488, 496, 498, 504, 509, 510, 512, 513, 514, 516, 517, 520, 522, 523, 525, 529, 532, 534, 535, 536, 537, 538, 539, 541, 542, 543, 544, 546, 547, 548, 557, 564, 565, 569, 574, 576, 580, 585, 591, 594, 595, 596, 598, 599, 604, 605, 607, 611, 613, 623, 626, 630, 631, 633, 635, 638, 641, 643, 650, 662, 663, 666, 667, 668, 670, 681, 686, 693, 694, 701, 705, 707, 708, 716, 717, 719, 722, 723, 724, 726, 727, 731, 734, 736, 740, 742, 749, 753, 757, 759, 760, 761, 762, 763, 765, 768, 770, 771, 782, 783, 784, 792, 793, 795, 800, 804, 806, 808, 812, 813, 819, 821, 822, 824, 825, 826, 829, 830, 833, 836, 840, 841, 842, 844, 855, 857, 858, 859, 862, 863, 865, 871, 872, 877, 884, 885, 887, 890, 891, 892, 893, 895, 897, 898, 899, 901, 903, 907, 908, 911, 912, 913, 916, 917, 919, 920, 924, 928, 929, 931, 936, 940, 943, 944, 949, 951, 953, 954, 958, 962, 964, 966, 974, 979, 980, 981, 982, 987, 993, 994, 995, 997, 999, 1003, 1006, 1007, 1011, 1014, 1017, 1026, 1028, 1032, 1035, 1038, 1041, 1042, 1043, 1044, 1045, 1047, 1049, 1050, 1051, 1052, 1055, 1056, 1057, 1065, 1069, 1070, 1072, 1073, 1077, 1078, 1086, 1087, 1089, 1092, 1095, 1103, 1104, 1106, 1108, 1110, 1111, 1112, 1114, 1115, 1117, 1118, 1119, 1120, 1121, 1122, 1127, 1130, 1132, 1133, 1136, 1137, 1144, 1146, 1147, 1148, 1154, 1160, 1166, 1168, 1169, 1170, 1171, 1174, 1176, 1178, 1182, 1183, 1187, 1189, 1190, 1191, 1196, 1199, 1200, 1201, 1205, 1213, 1214, 1217, 1218, 1219, 1220, 1223, 1225, 1227, 1228, 1230, 1231, 1233, 1236, 1240, 1241, 1244, 1248, 1250, 1252, 1253, 1254, 1256, 1257, 1258, 1261, 1264, 1265, 1272, 1277, 1281, 1282, 1283, 1285, 1286, 1292, 1293, 1298, 1299, 1305, 1306, 1309, 1312, 1316, 1317, 1320, 1321, 1325, 1327, 1330, 1331, 1334, 1339, 1340, 1347, 1349, 1351, 1354, 1355, 1360, 1364, 1367, 1368, 1371, 1372, 1373, 1376, 1377, 1380, 1382, 1383, 1388, 1392, 1393, 1396, 1397, 1398, 1402, 1403, 1404, 1405, 1407, 1409, 1410, 1412, 1415, 1421, 1423, 1426, 1431, 1436, 1438, 1440, 1441, 1442, 1444, 1447, 1451, 1453, 1454, 1455, 1459, 1462, 1466, 1468, 1471, 1474, 1475, 1481, 1485, 1490, 1493, 1498, 1499, 1501, 1504, 1514, 1518, 1519, 1525, 1526, 1527, 1530, 1539, 1543, 1545, 1546, 1548, 1549, 1555, 1556, 1560, 1563, 1567, 1568, 1571, 1575, 1576, 1584, 1586, 1590, 1592, 1594, 1599, 1600, 1602, 1604, 1605, 1608, 1609, 1612, 1614, 1615, 1616, 1622, 1624, 1625, 1628, 1629, 1634, 1635, 1637, 1638, 1641, 1648, 1650, 1658, 1659, 1662, 1668, 1671, 1673, 1675, 1676, 1677, 1680, 1683, 1684, 1685, 1688, 1689, 1691, 1705, 1706, 1707, 1708, 1709, 1710, 1712, 1714, 1717, 1719, 1721, 1723, 1725, 1731, 1732, 1735, 1740, 1755, 1758, 1759, 1762, 1764, 1768, 1771, 1776, 1778, 1779, 1785, 1791, 1793, 1813, 1815, 1816, 1820, 1826, 1830, 1832, 1834, 1835, 1840, 1845, 1850, 1852, 1858, 1859, 1861, 1865, 1867, 1869, 1870, 1872, 1873, 1876, 1879, 1882, 1883, 1884, 1886, 1888, 1893, 1897, 1898, 1899, 1900, 1901, 1902, 1903, 1904, 1905, 1906, 1911, 1914, 1917, 1918, 1920, 1922, 1923, 1924, 1936, 1940, 1944, 1950, 1952, 1953, 1954, 1973, 1981, 1991, 1993, 1994, 1995, 1996, 1999, 2000, 2007, 2008, 2009, 2010, 2012, 2013, 2016, 2017, 2026, 2027, 2031, 2032, 2039, 2041, 2043, 2048, 2054, 2062, 2064, 2066, 2072, 2074, 2077, 2082, 2083, 2088, 2089, 2094, 2095, 2096, 2097, 2099, 2103, 2104, 2112, 2116, 2117, 2119, 2121, 2126, 2132, 2133, 2134, 2136, 2139, 2140, 2141, 2142, 2143, 2144, 2147, 2150, 2152, 2154, 2155, 2156, 2157, 2159, 2161, 2162, 2164, 2165, 2167, 2170, 2177, 2178, 2179, 2185, 2191, 2193, 2196, 2202, 2203, 2205, 2206, 2215, 2216, 2218, 2221, 2226, 2229, 2230, 2231, 2232, 2235, 2240, 2243, 2244, 2247, 2253, 2257, 2260, 2262, 2263, 2273, 2274, 2276, 2278, 2280, 2282, 2283, 2288, 2291, 2293, 2295, 2296, 2297, 2298, 2303, 2304, 2305, 2306, 2308, 2309, 2314, 2322, 2323, 2328, 2329, 2331, 2333, 2339, 2342, 2345, 2348, 2351, 2352, 2353, 2359, 2361, 2362, 2363, 2366, 2371, 2379, 2381, 2382, 2384, 2385, 2398, 2401, 2402, 2403, 2405, 2406, 2410, 2411, 2412, 2413, 2418, 2419, 2422, 2423, 2431, 2435, 2437, 2438, 2440, 2441, 2442, 2443, 2445, 2450, 2451, 2452, 2453, 2454, 2457, 2458, 2471, 2472, 2474, 2476, 2479, 2481, 2482, 2483, 2485, 2490, 2492, 2494, 2495, 2496, 2498, 2500, 2504, 2505, 2509, 2510, 2511, 2514, 2515, 2517, 2519, 2525, 2528, 2529, 2531, 2533, 2536, 2537, 2538, 2539, 2541, 2542, 2547, 2548, 2549, 2551, 2552, 2554, 2555, 2556, 2557, 2567, 2568, 2573, 2576, 2580, 2581, 2583, 2588, 2589, 2590, 2594, 2596, 2599, 2601, 2605, 2609, 2611, 2613, 2617, 2618, 2625, 2627, 2632, 2634, 2636, 2637, 2639, 2641, 2644, 2648, 2650, 2652, 2655, 2661, 2662, 2663, 2671, 2674, 2675, 2684, 2685, 2687, 2689, 2691, 2692, 2696, 2700, 2702, 2705, 2715, 2718, 2719, 2722, 2723, 2725, 2726, 2728, 2729, 2730, 2738, 2740, 2742, 2746, 2747, 2749, 2752, 2755, 2756, 2757, 2764, 2770, 2775, 2780, 2782, 2784, 2786, 2787, 2791, 2798, 2800, 2801, 2802, 2805, 2808, 2812, 2819, 2820, 2821, 2822, 2823, 2824, 2826, 2827, 2828, 2831, 2832, 2840, 2844, 2850, 2857, 2858, 2861, 2862, 2865, 2866, 2871, 2873, 2876, 2878, 2888, 2890, 2894, 2898, 2901, 2902, 2906, 2908, 2909, 2910, 2911, 2912, 2915, 2916, 2917, 2919, 2923, 2926, 2930, 2931, 2935, 2944, 2946, 2948, 2950, 2953, 2955, 2959, 2962, 2963, 2966, 2968, 2976, 2980, 2984, 2992, 2994, 2998, 3002, 3003, 3005, 3007, 3008, 3010, 3014, 3015, 3016, 3019, 3038, 3039, 3042, 3043, 3044, 3045, 3048, 3049, 3051, 3052, 3053, 3055, 3061, 3064, 3067, 3072, 3075, 3078, 3080, 3081, 3083, 3084, 3085, 3087, 3095, 3096, 3097, 3100, 3102, 3105, 3106, 3114, 3118, 3119, 3120, 3121, 3122, 3123, 3126, 3127, 3128, 3137, 3139, 3140, 3143, 3147, 3148, 3149, 3153, 3170, 3177, 3181, 3185, 3191, 3192, 3194, 3200, 3202, 3204, 3205, 3206, 3210, 3212, 3220, 3224, 3225, 3226, 3228, 3236, 3237, 3240, 3246, 3250, 3252, 3254, 3255, 3258, 3260, 3261, 3262, 3263, 3268, 3271, 3272, 3273, 3278, 3280, 3286, 3288, 3289, 3290, 3291, 3294, 3295, 3296, 3297, 3299, 3301, 3312, 3313, 3324, 3331, 3332, 3333, 3337, 3340, 3343, 3345, 3347, 3349, 3351, 3353, 3355, 3356, 3357, 3358, 3359, 3360, 3363, 3370, 3374, 3376, 3377, 3380, 3382, 3383, 3386, 3392, 3394, 3397, 3399, 3405, 3414, 3415, 3416, 3418, 3419, 3422, 3424, 3426, 3428, 3435, 3438, 3440, 3445, 3446, 3447, 3454, 3455, 3458, 3460, 3461, 3464, 3465, 3466, 3468, 3469, 3470, 3471, 3474, 3475, 3477, 3482, 3486, 3487, 3488, 3496, 3499, 3503, 3504, 3506, 3510, 3516, 3517, 3518, 3531, 3533, 3536, 3537, 3541, 3544, 3545, 3548, 3549, 3551, 3552, 3554, 3558, 3560, 3562, 3563, 3569, 3574, 3577, 3582, 3587, 3588, 3589, 3592, 3593, 3594, 3595, 3597, 3600, 3603, 3606, 3607, 3611, 3612, 3613, 3616, 3618, 3620, 3623, 3624, 3627, 3628, 3629, 3630, 3631, 3633, 3637, 3638, 3640, 3642, 3643, 3644, 3645, 3646, 3647, 3650, 3655, 3657, 3659, 3660, 3661, 3662, 3663, 3667, 3668, 3671, 3672, 3674, 3677, 3682, 3684, 3685, 3693, 3694, 3704, 3706, 3707, 3713, 3715, 3717, 3718, 3719, 3720, 3725, 3738, 3739, 3748, 3749, 3752, 3754, 3757, 3761, 3762, 3764, 3766, 3777, 3778, 3781, 3783, 3784, 3788, 3789, 3790, 3791, 3792, 3793, 3794, 3796, 3798, 3804, 3806, 3808, 3810, 3812, 3818, 3820, 3823, 3825, 3828, 3829, 3830, 3831, 3832, 3833, 3836, 3837, 3842, 3843, 3844, 3845, 3847, 3849, 3858, 3859, 3860, 3862, 3867, 3870, 3871, 3872, 3873, 3874, 3876, 3882, 3883, 3887, 3889, 3890, 3891, 3892, 3893, 3894, 3895, 3902, 3908, 3910, 3911, 3912, 3914, 3917, 3924, 3928, 3929, 3934, 3935, 3938, 3941, 3947, 3950, 3952, 3954, 3958, 3962, 3967, 3975, 3978, 3983, 3984, 3985, 3987, 3988, 3994, 3996, 3997, 4001, 4002, 4003, 4006, 4008, 4010, 4013, 4014, 4019, 4020, 4024, 4030, 4033, 4034, 4037, 4039, 4040, 4042, 4046, 4048, 4050, 4051, 4052, 4054, 4056, 4057, 4062, 4066, 4067, 4068, 4069, 4072, 4075, 4077, 4078, 4079, 4080, 4081, 4084, 4088, 4092, 4096, 4102, 4105, 4107, 4109, 4111, 4113, 4115, 4116, 4121, 4122, 4124, 4128, 4133, 4139, 4146, 4148, 4149, 4150, 4154, 4156, 4160, 4161, 4162, 4163, 4164, 4165, 4166, 4167, 4168, 4171, 4178, 4184, 4187, 4188, 4191, 4197, 4201, 4202, 4205, 4206, 4207, 4208, 4210, 4211, 4212, 4214, 4217, 4218, 4219, 4221, 4227, 4228, 4233, 4235, 4244, 4246, 4250, 4251, 4257, 4260, 4261, 4266, 4270, 4272, 4279, 4280, 4281, 4283, 4288, 4292, 4294, 4296, 4298, 4301, 4302, 4304, 4305, 4309, 4312, 4320, 4321, 4324, 4329, 4330, 4331, 4332, 4335, 4336, 4337, 4338, 4341, 4343, 4344, 4347, 4349, 4360, 4365, 4369, 4378, 4380, 4383, 4387, 4390, 4391, 4397, 4398, 4401, 4402, 4403, 4404, 4405, 4406, 4410, 4415, 4417, 4422, 4423, 4427, 4431, 4439, 4440, 4442, 4443, 4444, 4446, 4448, 4450, 4453, 4456, 4458, 4460, 4461, 4462, 4463, 4468, 4472, 4474, 4475, 4479, 4485, 4491, 4492, 4494, 4499, 4502, 4506, 4507, 4512, 4515, 4518, 4519, 4522, 4531, 4535, 4543, 4545, 4548, 4549, 4551, 4554, 4555, 4556, 4557, 4558, 4559, 4560, 4562, 4565, 4566, 4568, 4575, 4580, 4583, 4584, 4586, 4590, 4591, 4596, 4604, 4618, 4621, 4623, 4625, 4630, 4632, 4633, 4635, 4641, 4643, 4644, 4650, 4659, 4666, 4667, 4669, 4670, 4671, 4674, 4676, 4677, 4680, 4685, 4687, 4692, 4697, 4699, 4700, 4702, 4704, 4706, 4708, 4710, 4716, 4719, 4721, 4725, 4729, 4730, 4737, 4738, 4740, 4741, 4747, 4749, 4750, 4751, 4753, 4754, 4755, 4756, 4759, 4760, 4761, 4762, 4765, 4767, 4771, 4775, 4779, 4789, 4790, 4791, 4794, 4795, 4804, 4813, 4814, 4818, 4823, 4824, 4828, 4829, 4830, 4831, 4832, 4833, 4834, 4835, 4838, 4842, 4851, 4856, 4857, 4859, 4861, 4862, 4864, 4868, 4869, 4872, 4875, 4878, 4880, 4881, 4887, 4889, 4891, 4895, 4901, 4902, 4905, 4914, 4915, 4921, 4922, 4923, 4924, 4926, 4930, 4935, 4936, 4939, 4941, 4950, 4955, 4965, 4971, 4972, 4975, 4977, 4979, 4980, 4987, 4988, 4993, 4994, 4996, 5000, 5005, 5010, 5015, 5026, 5028, 5029, 5030, 5034, 5038, 5039, 5040, 5041, 5042, 5044, 5046, 5048, 5052, 5054, 5057, 5063, 5067, 5068, 5072, 5075, 5079, 5082, 5085, 5087, 5088, 5089, 5094, 5095, 5100, 5102, 5106, 5111, 5123, 5129, 5131, 5132, 5140, 5143, 5145, 5147, 5149, 5152, 5153, 5157, 5164, 5165, 5168, 5170, 5174, 5180, 5181, 5182, 5183, 5184, 5185, 5188, 5189, 5190, 5191, 5192, 5196, 5198, 5199, 5200, 5201, 5202, 5206, 5208, 5212, 5219, 5225, 5228, 5229, 5240, 5241, 5243, 5249, 5251, 5253, 5255, 5258, 5261, 5263, 5265, 5266, 5267, 5268, 5273, 5275, 5276, 5281, 5282, 5283, 5286, 5289, 5292, 5293, 5298, 5299, 5300, 5301, 5303, 5308, 5311, 5313, 5317, 5319, 5321, 5324, 5329, 5330, 5334, 5338, 5344, 5346, 5348, 5350, 5351, 5359, 5361, 5363, 5364, 5372, 5375, 5376, 5382, 5384, 5386, 5388, 5389, 5394, 5395, 5396, 5397, 5403, 5407, 5409, 5411, 5414, 5417, 5428, 5430, 5431, 5438, 5448, 5449, 5450, 5452, 5456, 5457, 5458, 5459, 5463, 5464, 5466, 5472, 5474, 5476, 5479, 5482, 5483, 5485, 5493, 5495, 5496, 5498, 5506, 5508, 5509, 5510, 5512, 5513, 5515, 5516, 5517, 5518, 5519, 5524, 5526, 5529, 5530, 5531, 5534, 5535, 5537, 5539, 5541, 5543, 5557, 5561, 5562, 5563, 5568, 5569, 5571, 5574, 5579, 5581, 5585, 5588, 5589, 5591, 5592, 5597, 5604, 5608, 5612, 5613, 5615, 5616, 5618, 5619, 5620, 5623, 5627, 5632, 5633, 5635, 5638, 5640, 5642, 5647, 5648, 5651, 5652, 5653, 5659, 5660, 5662, 5663, 5675, 5676, 5677, 5680, 5683, 5689, 5690, 5694, 5695, 5697, 5698, 5702, 5703, 5706, 5709, 5717, 5718, 5721, 5722, 5726, 5731, 5734, 5735, 5738, 5744, 5748, 5751, 5763, 5768, 5770, 5771, 5773, 5775, 5780, 5784, 5785, 5791, 5794, 5803, 5806, 5807, 5808, 5811, 5813, 5814, 5815, 5817, 5820, 5826, 5828, 5831, 5833, 5834, 5835, 5836, 5837, 5839, 5844, 5846, 5852, 5853, 5854, 5857, 5859, 5864, 5865, 5866, 5867, 5869, 5870, 5872, 5876, 5878, 5881, 5883, 5886, 5887, 5888, 5892, 5893, 5906, 5907, 5912, 5919, 5922, 5923, 5925, 5926, 5927, 5928, 5932, 5934, 5938, 5939, 5941, 5944, 5948, 5954, 5956, 5959, 5961, 5968, 5974, 5978, 5982, 5987, 5988, 5989, 5991, 5996, 5997, 6000, 6002, 6003, 6004, 6006, 6009, 6013, 6014, 6016, 6017, 6023, 6024, 6025, 6026, 6033, 6038, 6041, 6044, 6047, 6048, 6051, 6058, 6059, 6060, 6062, 6063, 6065, 6068, 6069, 6070, 6072, 6073, 6075, 6080, 6081, 6085, 6086, 6087, 6088, 6089, 6092, 6093, 6097, 6098, 6099, 6107, 6108, 6109, 6110, 6113, 6116, 6118, 6119, 6120, 6123, 6124, 6131, 6132, 6133, 6135, 6136, 6138, 6139, 6143, 6145, 6146, 6148, 6149, 6151, 6153, 6160, 6162, 6163, 6164, 6165, 6176, 6181, 6183, 6186, 6188, 6189, 6191, 6193, 6197, 6198, 6203, 6204, 6205, 6209, 6220, 6223, 6224, 6227, 6228, 6234, 6242, 6243, 6246, 6247, 6250, 6251, 6264, 6265, 6266, 6267, 6270, 6272, 6273, 6275, 6278, 6281, 6282, 6286, 6292, 6295, 6297, 6299, 6303, 6309, 6310, 6311, 6315, 6317, 6319, 6321, 6322, 6323, 6325, 6328, 6330, 6333, 6338, 6342, 6354, 6356, 6360, 6362, 6363, 6367, 6370, 6372, 6375, 6376, 6381, 6383, 6386, 6394, 6397, 6399, 6403, 6404, 6405, 6408, 6410, 6412, 6414, 6415, 6419, 6420, 6425, 6426, 6427, 6428, 6429, 6430, 6436, 6440, 6449, 6456, 6463, 6464, 6466, 6467, 6468, 6469, 6470, 6472, 6474, 6475, 6476, 6478, 6480, 6482, 6484, 6485, 6488, 6494, 6501, 6502, 6504, 6510, 6512, 6513, 6516, 6517, 6519, 6523, 6526, 6530, 6531, 6532, 6533, 6534, 6537, 6539, 6544, 6545, 6547, 6549, 6553, 6555, 6558, 6559, 6564, 6567, 6571, 6572, 6574, 6576, 6577, 6579, 6581, 6584, 6587, 6588, 6589, 6592, 6594, 6597, 6599, 6600, 6603, 6606, 6607, 6609, 6614, 6620, 6623, 6628, 6633, 6635, 6639, 6640, 6644, 6646, 6647, 6649, 6652, 6655, 6656, 6658, 6661, 6666, 6671, 6672, 6681, 6682, 6686, 6693, 6696, 6701, 6703, 6705, 6716, 6718, 6720, 6729, 6730, 6734, 6736, 6737, 6739, 6742, 6747, 6748, 6749, 6756, 6757, 6759, 6764, 6766, 6767, 6779, 6783, 6786, 6793, 6794, 6795, 6797, 6799, 6803, 6804, 6805, 6807, 6810, 6811, 6813, 6815, 6816, 6817, 6819, 6820, 6824, 6826, 6827, 6828, 6830, 6831, 6834, 6836, 6840, 6841, 6843, 6848, 6851, 6863, 6868, 6869, 6875, 6878, 6880, 6881, 6882, 6883, 6884, 6888, 6903, 6904, 6905, 6906, 6913, 6914, 6917, 6919, 6920, 6921, 6922, 6925, 6930, 6932, 6936, 6939, 6946, 6950, 6952, 6955, 6959, 6963, 6967, 6970, 6971, 6979, 6980, 6981, 6984, 6985, 6987, 6988, 6990, 6994, 6997, 7002, 7003, 7010, 7013, 7018, 7022, 7023, 7029, 7038, 7039, 7043, 7045, 7046, 7051, 7052, 7053, 7054, 7057, 7059, 7060, 7062, 7064, 7067, 7072, 7073, 7075, 7077, 7079, 7083, 7084, 7085, 7094, 7105, 7106, 7107, 7108, 7110, 7112, 7113, 7117, 7118, 7119, 7128, 7130, 7138, 7139, 7142, 7143, 7144, 7151, 7154, 7163, 7164, 7165, 7166, 7169, 7172, 7182, 7184, 7191, 7192, 7194, 7196, 7197, 7201, 7206, 7208, 7212, 7215, 7217, 7219, 7227, 7228, 7230, 7231, 7235, 7236, 7244, 7245, 7246, 7249, 7250, 7255, 7257, 7258, 7262, 7263, 7264, 7267, 7268, 7270, 7274, 7276, 7281, 7282, 7287, 7291, 7292, 7293, 7298, 7299, 7300, 7301, 7303, 7304, 7306, 7307, 7311, 7312, 7313, 7318, 7328, 7340, 7344, 7345, 7350, 7351, 7356, 7357, 7358, 7360, 7361, 7365, 7369, 7371, 7376, 7380, 7382, 7383, 7386, 7397, 7398, 7399, 7400, 7409, 7410, 7411, 7417, 7418, 7425, 7429, 7430, 7435, 7436, 7437, 7438, 7441, 7447, 7452, 7453, 7454, 7456, 7457, 7458, 7459, 7462, 7464, 7470, 7472, 7476, 7481, 7483, 7486, 7490, 7492, 7493, 7498, 7502, 7503, 7504, 7506, 7512, 7514, 7515, 7521, 7522, 7523, 7524, 7525, 7533, 7538, 7546, 7547, 7556, 7559, 7561, 7574, 7576, 7578, 7579, 7583, 7585, 7586, 7589, 7594, 7596, 7598, 7604, 7605, 7609, 7619, 7620, 7622, 7624, 7625, 7633, 7638, 7640, 7642, 7643, 7647, 7652, 7655, 7656, 7658, 7661, 7662, 7664, 7665, 7673, 7674, 7678, 7679, 7680, 7682, 7686, 7687, 7689, 7695, 7699, 7700, 7703, 7712, 7716, 7718, 7724, 7726, 7736, 7737, 7738, 7741, 7742, 7744, 7745, 7748, 7749, 7753, 7756, 7763, 7764, 7767, 7768, 7770, 7774, 7775, 7777, 7778, 7781, 7785, 7786, 7788, 7791, 7792, 7793, 7798, 7799, 7800, 7803, 7804, 7805, 7806, 7807, 7808, 7818, 7819, 7820, 7823, 7825, 7826, 7833, 7834, 7841, 7844, 7845, 7850, 7854, 7856, 7865, 7873, 7877, 7878, 7880, 7881, 7887, 7888, 7890, 7896, 7908, 7909, 7911, 7913, 7918, 7923, 7925, 7928, 7934, 7935, 7937, 7938, 7942, 7944, 7946, 7949, 7952, 7974, 7976, 7977, 7981, 7983, 7984, 7986, 7996, 7999, 8004, 8006, 8007, 8021, 8026, 8029, 8031, 8036, 8040, 8041, 8042, 8044, 8047, 8048, 8053, 8056, 8059, 8061, 8063, 8064, 8067, 8068, 8072, 8075, 8076, 8077, 8078, 8079, 8081, 8084, 8088, 8091, 8093, 8095, 8100, 8102, 8103, 8106, 8110, 8112, 8113, 8118, 8121, 8126, 8129, 8130, 8134, 8145, 8146, 8147, 8148, 8150, 8151, 8152, 8155, 8163, 8166, 8170, 8178, 8179, 8181, 8189, 8193, 8197, 8202, 8204, 8208, 8210, 8213, 8217, 8219, 8220, 8223, 8230, 8234, 8235, 8237, 8239, 8242, 8246, 8248, 8250, 8252, 8253, 8264, 8265, 8266, 8268, 8269, 8272, 8273, 8274, 8276, 8282, 8288, 8289, 8292, 8300, 8304, 8308, 8310, 8311, 8312, 8315, 8318, 8319, 8320, 8323, 8329, 8340, 8341, 8347, 8350, 8351, 8353, 8355, 8358, 8367, 8368, 8371, 8373, 8378, 8379, 8380, 8382, 8385, 8386, 8387, 8389, 8392, 8393, 8395, 8396, 8401, 8404, 8406, 8410, 8413, 8414, 8416, 8417, 8418, 8430, 8436, 8438, 8439, 8440, 8443, 8444, 8445, 8446, 8447, 8448, 8449, 8450, 8451, 8455, 8457, 8458, 8459, 8465, 8469, 8470, 8473, 8474, 8476, 8477, 8481, 8482, 8485, 8486, 8498, 8501, 8502, 8503, 8505, 8507, 8509, 8511, 8513, 8517, 8523, 8524, 8525, 8526, 8527, 8528, 8531, 8532, 8533, 8535, 8542, 8543, 8554, 8557, 8561, 8562, 8565, 8568, 8574, 8575, 8576, 8579, 8581, 8582, 8585, 8592, 8594, 8596, 8597, 8598, 8599, 8600, 8601, 8602, 8603, 8605, 8609, 8611, 8612, 8614, 8622, 8631, 8634, 8635, 8638, 8639, 8641, 8642, 8644, 8646, 8648, 8650, 8654, 8658, 8659, 8660, 8663, 8665, 8669, 8670, 8672, 8673, 8674, 8676, 8677, 8685, 8686, 8693, 8694, 8695, 8699, 8700, 8703, 8706, 8708, 8709, 8713, 8717, 8720, 8722, 8726, 8729, 8731, 8736, 8743, 8744, 8746, 8747, 8748, 8755, 8757, 8761, 8763, 8773, 8777, 8779, 8783, 8784, 8786, 8789, 8792, 8803, 8810, 8811, 8818, 8821, 8822, 8824, 8828, 8829, 8831, 8834, 8835, 8839, 8841, 8843, 8846, 8853, 8865, 8866, 8874, 8876, 8877, 8878, 8881, 8888, 8889, 8892, 8896, 8899, 8908, 8911, 8913, 8916, 8917, 8919, 8922, 8926, 8929, 8930, 8935, 8937, 8938, 8941, 8946, 8949, 8951, 8953, 8957, 8960, 8961, 8967, 8968, 8974, 8979, 8980, 8981, 8985, 8986, 8992, 8996, 8998, 9001, 9006, 9009, 9011, 9012, 9013, 9015, 9018, 9020, 9023, 9026, 9027, 9029, 9030, 9033, 9045, 9052, 9056, 9058, 9059, 9060, 9063, 9065, 9069, 9071, 9072, 9076, 9078, 9080, 9087, 9088, 9092, 9096, 9097, 9098, 9103, 9104, 9105, 9106, 9107, 9112, 9114, 9116, 9118, 9125, 9129, 9139, 9140, 9141, 9142, 9144, 9152, 9154, 9155, 9167, 9168, 9175, 9177, 9179, 9180, 9183, 9185, 9188, 9190, 9191, 9195, 9205, 9206, 9207, 9210, 9211, 9213, 9215, 9216, 9217, 9218, 9220, 9223, 9226, 9229, 9231, 9233, 9237, 9243, 9248, 9249, 9253, 9267, 9269, 9270, 9273, 9275, 9282, 9284, 9285, 9288, 9290, 9292, 9293, 9296, 9300, 9306, 9308, 9311, 9316, 9320, 9321, 9323, 9326, 9328, 9332, 9336, 9337, 9338, 9339, 9340, 9341, 9346, 9347, 9350, 9359, 9360, 9366, 9371, 9372, 9373, 9375, 9376, 9380, 9382, 9391, 9392, 9393, 9394, 9400, 9402, 9403, 9406, 9413, 9414, 9421, 9423, 9425, 9426, 9429, 9434, 9439, 9440, 9443, 9449, 9451, 9456, 9460, 9471, 9472, 9473, 9474, 9481, 9484, 9486, 9488, 9490, 9500, 9504, 9509, 9514, 9517, 9518, 9519, 9520, 9522, 9534, 9536, 9537, 9538, 9540, 9545, 9546, 9550, 9551, 9553, 9555, 9560, 9564, 9568, 9571, 9574, 9577, 9581, 9587, 9590, 9591, 9593, 9594, 9596, 9601, 9602, 9606, 9609, 9614, 9615, 9618, 9620, 9621, 9623, 9624, 9626, 9629, 9630, 9632, 9633, 9641, 9642, 9644, 9645, 9652, 9653, 9655, 9657, 9658, 9659, 9663, 9666, 9668, 9670, 9682, 9686, 9687, 9688, 9698, 9700, 9701, 9706, 9710, 9711, 9721, 9722, 9723, 9725, 9726, 9727, 9729, 9731, 9734, 9737, 9742, 9744, 9745, 9746, 9750, 9753, 9754, 9756, 9763, 9764, 9770, 9774, 9776, 9777, 9782, 9786, 9791, 9792, 9793, 9794, 9798, 9799, 9804, 9810, 9811, 9812, 9813, 9816, 9819, 9820, 9825, 9828, 9829, 9830, 9833, 9835, 9845, 9847, 9850, 9869, 9873, 9875, 9878, 9879, 9882, 9886, 9887, 9892, 9897, 9900, 9907, 9909, 9910, 9921, 9923, 9924, 9928, 9930, 9935, 9938, 9940, 9946, 9949, 9950, 9952, 9953, 9960, 9962, 9963, 9968, 9969, 9972, 9973, 9975, 9979, 9980, 9982, 9984, 9985, 9987, 9988, 9990, 9991, 9992, 9997, 10000, 10001, 10008, 10009, 10010, 10012, 10013, 10017, 10018, 10019, 10020, 10026, 10027, 10032, 10033, 10034, 10040, 10049, 10051, 10055, 10058, 10059, 10060, 10062, 10064, 10072, 10073, 10077, 10078, 10083, 10091, 10092, 10095, 10097, 10101, 10102, 10103, 10106, 10109, 10110, 10113, 10115, 10116, 10117, 10119, 10122, 10128, 10129, 10130, 10131, 10136, 10140, 10143, 10151, 10158, 10160, 10163, 10165, 10166, 10168, 10174, 10176, 10178, 10181, 10184, 10192, 10193, 10194, 10196, 10199, 10206, 10207, 10212, 10218, 10219, 10220, 10221, 10222, 10223, 10224, 10225, 10233, 10236, 10237, 10240, 10247, 10249, 10253, 10254, 10255, 10259, 10264, 10269, 10270, 10275, 10278, 10284, 10286, 10291, 10292, 10293, 10295, 10300, 10302, 10306, 10307, 10312, 10314, 10318, 10321, 10323, 10324, 10325, 10326, 10331, 10333, 10334, 10335, 10336, 10340, 10341, 10346, 10351, 10352, 10353, 10357, 10364, 10370, 10371, 10375, 10376, 10378, 10380, 10383, 10388, 10393, 10395, 10397, 10398, 10399, 10401, 10410, 10411, 10413, 10414, 10416, 10417, 10419, 10421, 10423, 10425, 10426, 10435, 10436, 10438, 10440, 10446, 10449, 10450, 10452, 10453, 10456, 10460, 10463, 10464, 10465, 10468, 10469, 10471, 10472, 10473, 10474, 10482, 10487, 10488, 10490, 10492, 10494, 10496, 10506, 10508, 10514, 10518, 10523, 10527, 10528, 10530, 10531, 10535, 10537, 10541, 10542, 10543, 10544, 10547, 10548, 10555, 10556, 10558, 10564, 10567, 10569, 10573, 10580, 10581, 10582, 10583, 10584, 10587, 10588, 10593, 10596, 10597, 10599, 10601, 10602, 10608, 10611, 10613, 10615, 10621, 10622, 10625, 10628, 10636, 10637, 10638, 10639, 10640, 10645, 10646, 10649, 10651, 10655, 10657, 10665, 10666, 10668, 10670, 10676, 10677, 10678, 10679, 10681, 10682, 10683, 10684, 10685, 10687, 10698, 10701, 10705, 10707, 10711, 10715, 10716, 10721, 10722, 10724, 10726, 10729, 10732, 10734, 10738, 10740, 10741, 10744, 10748, 10749, 10752, 10753, 10754, 10756, 10761, 10762, 10766, 10770, 10772, 10775, 10776, 10778, 10779, 10785, 10787, 10788, 10791, 10792, 10795, 10801, 10802, 10803, 10805, 10809, 10810, 10811, 10815, 10818, 10819, 10820, 10822, 10823, 10824, 10827, 10831, 10833, 10836, 10838, 10839, 10841, 10843, 10844, 10847, 10850, 10851, 10852, 10853, 10854, 10857, 10858, 10860, 10866, 10867, 10874, 10877, 10880, 10886, 10887, 10888, 10889, 10897, 10898, 10899, 10902, 10910, 10911, 10917, 10918, 10920, 10924, 10926, 10927, 10928, 10929, 10930, 10933, 10934, 10940, 10947, 10960, 10962, 10965, 10966, 10967, 10972, 10976, 10977, 10979, 10985, 10988, 10993, 10996, 11008, 11015, 11021, 11024, 11032, 11033, 11036, 11037, 11039, 11046, 11047, 11050, 11051, 11052, 11053, 11056, 11058, 11060, 11063, 11066, 11067, 11068, 11078, 11082, 11083, 11090, 11095, 11098, 11100, 11101, 11103, 11107, 11109, 11114, 11118, 11122, 11124, 11129, 11133, 11135, 11136, 11137, 11145, 11147, 11148, 11149, 11153, 11154, 11155, 11156, 11157, 11160, 11163, 11165, 11166, 11168, 11169, 11173, 11177, 11178, 11181, 11184, 11187, 11188, 11190, 11191, 11192, 11194, 11198, 11203, 11204, 11208, 11213, 11214, 11216, 11217, 11218, 11222, 11224, 11226, 11227, 11228, 11230, 11233, 11235, 11236, 11238, 11239, 11242, 11243, 11246, 11247, 11251, 11253, 11254, 11255, 11260, 11262, 11263, 11266, 11290, 11292, 11293, 11295, 11297, 11298, 11299, 11302, 11304, 11305, 11306, 11313, 11330, 11331, 11337, 11340, 11345, 11346, 11348, 11349, 11356, 11358, 11362, 11363, 11364, 11365, 11370, 11371, 11373, 11377, 11380, 11382, 11387, 11392, 11394, 11395, 11401, 11405, 11406, 11416, 11417, 11424, 11430, 11431, 11435, 11438, 11439, 11440, 11443, 11446, 11449, 11451, 11461, 11465, 11466, 11475, 11478, 11487, 11488, 11489, 11490, 11496, 11497, 11498, 11500, 11501, 11505, 11506, 11507, 11513, 11520, 11521, 11524, 11526, 11527, 11528, 11530, 11531, 11532, 11533, 11535, 11540, 11541, 11544, 11548, 11551, 11553, 11558, 11560, 11561, 11562, 11567, 11568, 11570, 11571, 11576, 11577, 11578, 11586, 11588, 11593, 11594, 11595, 11596, 11597, 11603, 11604, 11607, 11611, 11612, 11617, 11618, 11623, 11625, 11628, 11631, 11639, 11650, 11656, 11658, 11659, 11663, 11664, 11669, 11673, 11677, 11678, 11681, 11682, 11688, 11691, 11692, 11694, 11695, 11696, 11701, 11703, 11705, 11707, 11712, 11720, 11721, 11725, 11726, 11730, 11731, 11733, 11736, 11737, 11740, 11743, 11744, 11753, 11756, 11759, 11760, 11761, 11762, 11763, 11765, 11770, 11771, 11776, 11777, 11782, 11783, 11785, 11786, 11788, 11792, 11794, 11797, 11799, 11800, 11805, 11809, 11811, 11812, 11814, 11818, 11820, 11826, 11828, 11830, 11846, 11848, 11849, 11851, 11854, 11856, 11858, 11861, 11863, 11864, 11865, 11868, 11870, 11872, 11876, 11877, 11878, 11879, 11881, 11889, 11891, 11892, 11894, 11898, 11901, 11902, 11906, 11909, 11911, 11913, 11914, 11916, 11917, 11919, 11920, 11921, 11923, 11926, 11927, 11928, 11929, 11930, 11934, 11935, 11940, 11943, 11946, 11947, 11948, 11949, 11953, 11955, 11956, 11958, 11959, 11960, 11961, 11962, 11963, 11965, 11966, 11968, 11973, 11974, 11975, 11976, 11977, 11978, 11979, 11983, 11988, 11993, 11997, 11998, 11999, 12004, 12008, 12014, 12017, 12019, 12021, 12023, 12024, 12026, 12027, 12032, 12042, 12043, 12044, 12047, 12052, 12059, 12060, 12068, 12076, 12077, 12080, 12081, 12083, 12087, 12091, 12092, 12093, 12095, 12098, 12102, 12104, 12106, 12109, 12110, 12112, 12114, 12115, 12118, 12122, 12126, 12128, 12129, 12130, 12131, 12134, 12137, 12139, 12143, 12145, 12146, 12147, 12149, 12151, 12161, 12166, 12167, 12170, 12171, 12174, 12175, 12176, 12181, 12183, 12185, 12191, 12197, 12200, 12201, 12204, 12207, 12208, 12217, 12219, 12220, 12227, 12233, 12234, 12240, 12241, 12243, 12245, 12249, 12250, 12252, 12253, 12255, 12256, 12259, 12260, 12263, 12267, 12268, 12269, 12271, 12274, 12278, 12281, 12283, 12284, 12286, 12287, 12293, 12297, 12298, 12299, 12310, 12311, 12312, 12313, 12314, 12315, 12317, 12321, 12323, 12324, 12326, 12329, 12331, 12334, 12345, 12347, 12354, 12356, 12358, 12359, 12369, 12370, 12372, 12379, 12380, 12381, 12385, 12391, 12397, 12400, 12401, 12403, 12404, 12405, 12406, 12410, 12411, 12414, 12416, 12419, 12420, 12421, 12424, 12426, 12427, 12437, 12440, 12441, 12445, 12450, 12451, 12455, 12456, 12457, 12462, 12467, 12468, 12470, 12476, 12478, 12479, 12481, 12487, 12488, 12489, 12491, 12495, 12497, 12505, 12508, 12510, 12511, 12512, 12514, 12519, 12521, 12530, 12536, 12539, 12545, 12546, 12547, 12549, 12555, 12556, 12557, 12561, 12563, 12564, 12565, 12567, 12568, 12570, 12574, 12578, 12583, 12588, 12591, 12605, 12608, 12609, 12610, 12611, 12614, 12616, 12619, 12623, 12631, 12634, 12635, 12638, 12639, 12641, 12649, 12651, 12654, 12655, 12663, 12668, 12670, 12671, 12672, 12674, 12675, 12676, 12679, 12680, 12681, 12682, 12684, 12685, 12691, 12695, 12698, 12699, 12701, 12702, 12703, 12705, 12706, 12713, 12714, 12718, 12719, 12731, 12732, 12733, 12735, 12737, 12739, 12741, 12742, 12743, 12748, 12751, 12752, 12754, 12755, 12757, 12758, 12760, 12762, 12764, 12766, 12769, 12771, 12772, 12773, 12783, 12790, 12794, 12797, 12802, 12803, 12805, 12808, 12810, 12812, 12813, 12814, 12817, 12819, 12820, 12822, 12824, 12826, 12827, 12828, 12834, 12835, 12836, 12838, 12839, 12843, 12844, 12849, 12853, 12856, 12858, 12861, 12866, 12873, 12882, 12883, 12887, 12888, 12893, 12898, 12899, 12900, 12904, 12905, 12906, 12910, 12916, 12917, 12918, 12920, 12921, 12926, 12928, 12929, 12932, 12933, 12939, 12940, 12944, 12945, 12946, 12947, 12966, 12968, 12969, 12972, 12973, 12974, 12975, 12976, 12978, 12983, 12984, 12987, 12990, 12991, 12992, 13006, 13007, 13008, 13010, 13011, 13014, 13015, 13017, 13018, 13022, 13023, 13030, 13032, 13033, 13035, 13038, 13040, 13041, 13042, 13044, 13049, 13050, 13053, 13054, 13055, 13056, 13061, 13062, 13064, 13065, 13066, 13071, 13074, 13075, 13077, 13079, 13083, 13085, 13086, 13087, 13095, 13100, 13101, 13102, 13105, 13112, 13114, 13115, 13116, 13117, 13118, 13120, 13123, 13124, 13131, 13135, 13142, 13147, 13148, 13149, 13151, 13153, 13160, 13169, 13174, 13175, 13177, 13181, 13182, 13186, 13197, 13199, 13205, 13209, 13212, 13213, 13215, 13217, 13221, 13222, 13224, 13227, 13230, 13232, 13234, 13235, 13236, 13237, 13238, 13243, 13249, 13251, 13255, 13259, 13260, 13261, 13263, 13264, 13269, 13276, 13279, 13292, 13296, 13297, 13298, 13303, 13304, 13313, 13315, 13317, 13325, 13328, 13330, 13332, 13335, 13337, 13343, 13346, 13348, 13350, 13354, 13361, 13367, 13369, 13377, 13380, 13381, 13384, 13385, 13388, 13391, 13393, 13394, 13397, 13401, 13410, 13414, 13416, 13419, 13423, 13424, 13433, 13439, 13441, 13448, 13449, 13451, 13454, 13456, 13463, 13466, 13468, 13469, 13472, 13473, 13475, 13490, 13492, 13494, 13496, 13497, 13498, 13499, 13500, 13503, 13504, 13505, 13506, 13512, 13513, 13514, 13515, 13516, 13517, 13519, 13520, 13521, 13524, 13530, 13532, 13539, 13540, 13543, 13544, 13545, 13546, 13547, 13549, 13552, 13553, 13555, 13568, 13569, 13574, 13584, 13589, 13590, 13595, 13597, 13599, 13601, 13602, 13603, 13611, 13612, 13614, 13621, 13623, 13628, 13631, 13632, 13634, 13635, 13636, 13637, 13638, 13641, 13647, 13652, 13654, 13660, 13661, 13662, 13663, 13668, 13671, 13675, 13676, 13677, 13678, 13684, 13687, 13688, 13693, 13695, 13697, 13698, 13700, 13702, 13703, 13706, 13710, 13713, 13715, 13716, 13721, 13725, 13727, 13729, 13730, 13739, 13745, 13748, 13750, 13753, 13754, 13755, 13756, 13758, 13764, 13766, 13767, 13772, 13773, 13775, 13776, 13781, 13782, 13783, 13789, 13790, 13791, 13794, 13796, 13798, 13800, 13816, 13818, 13819, 13820, 13822, 13823, 13828, 13830, 13831, 13833, 13834, 13835, 13843, 13849, 13852, 13859, 13860, 13862, 13864, 13866, 13869, 13870, 13872, 13873, 13874, 13875, 13877, 13879, 13880, 13881, 13882, 13888, 13891, 13892, 13896, 13898, 13901, 13906, 13909, 13910, 13911, 13917, 13918, 13919, 13927, 13933, 13947, 13948, 13952, 13954, 13956, 13961, 13963, 13969, 13970, 13975, 13976, 13980, 13981, 13983, 13984, 13990, 13991, 13992, 13999, 14000, 14001, 14008, 14009, 14010, 14013, 14014, 14017, 14018, 14022, 14026, 14027, 14030, 14031, 14036, 14041, 14043, 14049, 14050, 14051, 14052, 14062, 14066, 14067, 14069, 14070, 14071, 14073, 14074, 14076, 14081, 14082, 14086, 14087, 14088, 14092, 14094, 14096, 14099, 14105, 14106, 14112, 14115, 14116, 14118, 14119, 14120, 14122, 14129, 14132, 14133, 14134, 14135, 14138, 14139, 14142, 14143, 14145, 14146, 14148, 14149, 14150.

Promoters expressing in whole cob tissue at 14 days after pollination include SEQ IDs: 1, 3, 4, 7, 8, 13, 14, 15, 27, 31, 32, 34, 36, 38, 45, 54, 64, 65, 69, 70, 71, 76, 81, 82, 88, 96, 97, 99, 102, 103, 107, 110, 111, 112, 117, 121, 126, 130, 131, 132, 134, 141, 143, 148, 152, 154, 162, 165, 174, 176, 177, 179, 181, 183, 187, 191, 193, 194, 195, 196, 197, 199, 202, 204, 205, 207, 210, 211, 212, 217, 223, 233, 235, 236, 237, 240, 242, 243, 244, 246, 249, 250, 251, 257, 262, 263, 264, 269, 270, 271, 273, 274, 280, 281, 286, 288, 289, 292, 294, 299, 301, 302, 305, 306, 309, 314, 316, 319, 320, 323, 328, 329, 332, 335, 339, 346, 348, 349, 352, 353, 354, 356, 357, 359, 360, 365, 367, 371, 373, 374, 378, 379, 382, 387, 388, 393, 396, 401, 402, 405, 406, 407, 419, 420, 423, 424, 428, 429, 433, 434, 436, 452, 456, 460, 461, 463, 466, 478, 479, 483, 484, 485, 488, 496, 498, 501, 502, 504, 509, 510, 513, 514, 515, 516, 517, 522, 523, 525, 529, 532, 533, 536, 537, 541, 542, 544, 546, 547, 554, 557, 564, 569, 573, 577, 578, 580, 585, 588, 591, 594, 595, 596, 598, 599, 602, 604, 607, 613, 614, 620, 623, 631, 633, 635, 638, 641, 643, 644, 650, 653, 662, 663, 665, 666, 667, 668, 670, 674, 676, 677, 681, 686, 693, 694, 701, 705, 716, 717, 719, 722, 723, 724, 726, 731, 734, 736, 740, 742, 749, 753, 759, 760, 761, 762, 763, 765, 768, 771, 782, 783, 792, 793, 795, 797, 800, 806, 808, 812, 819, 820, 821, 824, 825, 826, 829, 830, 833, 840, 841, 842, 844, 855, 857, 858, 859, 860, 862, 863, 865, 870, 871, 872, 878, 883, 884, 885, 887, 890, 891, 892, 895, 897, 898, 899, 901, 902, 903, 907, 908, 910, 911, 912, 913, 916, 917, 919, 924, 929, 931, 936, 938, 940, 943, 944, 951, 953, 957, 958, 959, 961, 962, 964, 966, 971, 974, 976, 979, 980, 981, 982, 983, 991, 994, 995, 996, 997, 999, 1003, 1006, 1007, 1009, 1010, 1011, 1014, 1028, 1032, 1035, 1039, 1041, 1042, 1043, 1045, 1047, 1049, 1050, 1051, 1052, 1055, 1056, 1057, 1064, 1065, 1068, 1069, 1070, 1072, 1077, 1078, 1086, 1087, 1088, 1089, 1092, 1095, 1101, 1103, 1104, 1108, 1110, 1111, 1112, 1114, 1115, 1117, 1118, 1119, 1120, 1122, 1127, 1130, 1132, 1133, 1136, 1137, 1144, 1146, 1147, 1148, 1154, 1160, 1166, 1168, 1170, 1171, 1176, 1178, 1182, 1187, 1189, 1191, 1196, 1198, 1199, 1200, 1201, 1204, 1214, 1217, 1218, 1219, 1223, 1225, 1227, 1228, 1230, 1231, 1233, 1236, 1239, 1240, 1241, 1243, 1248, 1250, 1251, 1252, 1253, 1254, 1256, 1258, 1261, 1262, 1269, 1272, 1275, 1277, 1281, 1282, 1283, 1285, 1286, 1292, 1293, 1295, 1296, 1297, 1306, 1307, 1309, 1316, 1317, 1320, 1321, 1327, 1330, 1331, 1334, 1339, 1340, 1346, 1347, 1349, 1351, 1354, 1355, 1360, 1364, 1367, 1373, 1376, 1377, 1380, 1381, 1382, 1386, 1396, 1398, 1403, 1404, 1407, 1411, 1415, 1421, 1423, 1426, 1431, 1432, 1438, 1441, 1442, 1444, 1448, 1451, 1453, 1454, 1455, 1459, 1462, 1466, 1468, 1471, 1474, 1475, 1481, 1486, 1487, 1490, 1493, 1499, 1508, 1510, 1511, 1513, 1514, 1518, 1525, 1526, 1527, 1539, 1540, 1543, 1545, 1546, 1549, 1550, 1555, 1556, 1563, 1567, 1570, 1571, 1575, 1576, 1578, 1584, 1586, 1590, 1592, 1593, 1594, 1599, 1600, 1602, 1604, 1605, 1608, 1609, 1612, 1614, 1615, 1616, 1622, 1624, 1625, 1632, 1634, 1635, 1637, 1638, 1650, 1658, 1659, 1662, 1668, 1669, 1671, 1673, 1675, 1676, 1677, 1680, 1682, 1683, 1685, 1688, 1689, 1691, 1696, 1698, 1699, 1705, 1706, 1707, 1708, 1710, 1714, 1717, 1719, 1723, 1725, 1726, 1727, 1729, 1731, 1732, 1735, 1740, 1745, 1755, 1759, 1761, 1764, 1768, 1771, 1776, 1778, 1782, 1784, 1785, 1791, 1813, 1815, 1820, 1828, 1830, 1832, 1834, 1835, 1837, 1838, 1839, 1840, 1845, 1850, 1852, 1856, 1859, 1861, 1865, 1867, 1868, 1869, 1870, 1872, 1882, 1883, 1886, 1888, 1893, 1894, 1897, 1898, 1899, 1900, 1902, 1903, 1905, 1906, 1911, 1914, 1918, 1920, 1922, 1923, 1924, 1930, 1931, 1933, 1934, 1936, 1940, 1945, 1950, 1952, 1953, 1955, 1973, 1977, 1981, 1990, 1991, 1993, 1994, 1995, 1996, 1999, 2000, 2007, 2008, 2009, 2010, 2012, 2013, 2015, 2016, 2017, 2026, 2031, 2032, 2039, 2041, 2043, 2045, 2048, 2054, 2055, 2060, 2062, 2064, 2066, 2069, 2072, 2074, 2077, 2079, 2082, 2083, 2088, 2089, 2094, 2096, 2097, 2099, 2103, 2104, 2113, 2119, 2126, 2132, 2133, 2134, 2137, 2139, 2140, 2142, 2143, 2144, 2147, 2150, 2152, 2156, 2157, 2159, 2161, 2162, 2164, 2166, 2167, 2168, 2170, 2172, 2173, 2177, 2178, 2179, 2185, 2189, 2190, 2191, 2193, 2196, 2202, 2203, 2205, 2207, 2215, 2221, 2222, 2226, 2227, 2229, 2230, 2231, 2232, 2235, 2240, 2242, 2247, 2253, 2257, 2260, 2262, 2263, 2265, 2273, 2274, 2276, 2278, 2280, 2282, 2288, 2291, 2295, 2296, 2297, 2298, 2301, 2303, 2304, 2305, 2309, 2310, 2314, 2322, 2323, 2328, 2329, 2331, 2333, 2339, 2342, 2349, 2351, 2352, 2353, 2359, 2360, 2363, 2367, 2371, 2375, 2379, 2381, 2382, 2384, 2396, 2398, 2401, 2403, 2405, 2406, 2410, 2411, 2412, 2418, 2419, 2420, 2422, 2423, 2430, 2435, 2437, 2438, 2441, 2442, 2443, 2445, 2451, 2452, 2453, 2454, 2457, 2458, 2465, 2470, 2471, 2472, 2474, 2476, 2481, 2482, 2486, 2490, 2492, 2494, 2495, 2496, 2498, 2500, 2504, 2505, 2506, 2509, 2514, 2515, 2517, 2519, 2522, 2525, 2528, 2531, 2532, 2533, 2535, 2536, 2537, 2538, 2539, 2541, 2547, 2548, 2549, 2551, 2552, 2554, 2555, 2556, 2557, 2559, 2567, 2568, 2573, 2577, 2578, 2580, 2581, 2589, 2590, 2594, 2596, 2601, 2605, 2609, 2611, 2616, 2617, 2618, 2622, 2626, 2627, 2632, 2634, 2639, 2644, 2648, 2650, 2652, 2655, 2663, 2671, 2674, 2675, 2679, 2684, 2685, 2687, 2689, 2691, 2692, 2694, 2696, 2700, 2702, 2707, 2711, 2718, 2719, 2720, 2723, 2725, 2726, 2727, 2728, 2729, 2730, 2731, 2735, 2739, 2740, 2742, 2746, 2747, 2749, 2752, 2755, 2756, 2757, 2763, 2764, 2765, 2770, 2773, 2775, 2780, 2784, 2787, 2788, 2800, 2801, 2802, 2805, 2808, 2812, 2820, 2821, 2822, 2823, 2824, 2826, 2827, 2828, 2831, 2832, 2840, 2842, 2844, 2850, 2857, 2858, 2861, 2862, 2864, 2865, 2871, 2873, 2876, 2878, 2885, 2888, 2889, 2890, 2894, 2902, 2908, 2909, 2910, 2915, 2916, 2917, 2923, 2926, 2930, 2931, 2932, 2933, 2934, 2935, 2938, 2942, 2944, 2945, 2946, 2948, 2950, 2955, 2959, 2963, 2966, 2968, 2976, 2979, 2980, 2994, 2998, 3000, 3002, 3003, 3005, 3006, 3007, 3008, 3015, 3023, 3024, 3038, 3039, 3042, 3043, 3044, 3048, 3049, 3051, 3052, 3053, 3055, 3062, 3064, 3067, 3070, 3072, 3075, 3076, 3080, 3081, 3083, 3084, 3085, 3087, 3088, 3090, 3096, 3100, 3101, 3102, 3105, 3106, 3109, 3114, 3118, 3119, 3120, 3121, 3123, 3126, 3127, 3128, 3129, 3137, 3138, 3139, 3143, 3147, 3148, 3153, 3157, 3158, 3170, 3177, 3181, 3185, 3188, 3191, 3192, 3194, 3199, 3200, 3202, 3205, 3206, 3210, 3212, 3215, 3219, 3220, 3224, 3225, 3226, 3227, 3228, 3232, 3237, 3240, 3247, 3250, 3252, 3255, 3258, 3261, 3262, 3263, 3266, 3268, 3271, 3272, 3273, 3278, 3280, 3286, 3288, 3290, 3291, 3294, 3295, 3296, 3297, 3299, 3301, 3305, 3312, 3313, 3324, 3327, 3331, 3332, 3333, 3335, 3340, 3343, 3345, 3347, 3349, 3351, 3353, 3355, 3358, 3361, 3363, 3370, 3374, 3377, 3383, 3386, 3397, 3399, 3404, 3415, 3416, 3418, 3419, 3422, 3424, 3426, 3428, 3429, 3435, 3438, 3441, 3442, 3445, 3446, 3447, 3450, 3451, 3452, 3455, 3458, 3460, 3461, 3464, 3468, 3469, 3470, 3471, 3474, 3477, 3482, 3483, 3487, 3488, 3490, 3491, 3496, 3503, 3504, 3506, 3510, 3511, 3516, 3517, 3518, 3529, 3531, 3533, 3536, 3537, 3541, 3544, 3545, 3548, 3549, 3552, 3554, 3558, 3560, 3562, 3563, 3569, 3572, 3574, 3576, 3577, 3582, 3587, 3588, 3589, 3592, 3593, 3594, 3595, 3597, 3600, 3603, 3604, 3606, 3607, 3611, 3613, 3616, 3618, 3619, 3620, 3621, 3623, 3624, 3629, 3633, 3637, 3640, 3642, 3643, 3644, 3645, 3646, 3647, 3648, 3655, 3657, 3659, 3662, 3663, 3667, 3668, 3671, 3672, 3674, 3682, 3684, 3685, 3702, 3704, 3706, 3707, 3713, 3715, 3717, 3718, 3719, 3720, 3724, 3725, 3731, 3732, 3738, 3739, 3742, 3748, 3749, 3750, 3752, 3754, 3757, 3761, 3764, 3765, 3766, 3772, 3773, 3775, 3777, 3778, 3783, 3785, 3788, 3790, 3791, 3792, 3794, 3798, 3800, 3804, 3806, 3808, 3810, 3812, 3818, 3820, 3823, 3825, 3828, 3830, 3831, 3832, 3833, 3836, 3837, 3842, 3843, 3844, 3849, 3858, 3859, 3860, 3862, 3866, 3867, 3871, 3872, 3873, 3874, 3876, 3877, 3881, 3882, 3883, 3885, 3887, 3889, 3891, 3893, 3895, 3908, 3910, 3914, 3917, 3923, 3924, 3926, 3928, 3929, 3933, 3934, 3938, 3941, 3947, 3950, 3954, 3958, 3962, 3967, 3974, 3975, 3978, 3983, 3987, 3988, 3994, 3995, 3996, 3997, 4000, 4001, 4002, 4003, 4006, 4008, 4013, 4024, 4030, 4034, 4039, 4040, 4041, 4042, 4045, 4046, 4047, 4048, 4049, 4050, 4051, 4052, 4054, 4056, 4062, 4066, 4067, 4068, 4069, 4072, 4075, 4077, 4078, 4079, 4084, 4092, 4095, 4099, 4102, 4105, 4109, 4110, 4111, 4113, 4115, 4116, 4122, 4124, 4128, 4133, 4139, 4143, 4146, 4148, 4149, 4154, 4155, 4156, 4160, 4161, 4162, 4163, 4164, 4165, 4166, 4167, 4168, 4169, 4171, 4176, 4178, 4185, 4187, 4188, 4189, 4197, 4201, 4202, 4205, 4206, 4207, 4208, 4210, 4211, 4212, 4214, 4217, 4219, 4221, 4227, 4228, 4233, 4235, 4241, 4244, 4250, 4251, 4257, 4260, 4263, 4266, 4269, 4270, 4272, 4279, 4280, 4281, 4288, 4294, 4296, 4298, 4301, 4302, 4304, 4305, 4309, 4312, 4320, 4321, 4324, 4329, 4330, 4331, 4332, 4337, 4341, 4344, 4347, 4349, 4352, 4354, 4358, 4360, 4365, 4369, 4378, 4380, 4383, 4387, 4390, 4391, 4393, 4397, 4398, 4401, 4402, 4403, 4404, 4405, 4406, 4410, 4415, 4422, 4423, 4439, 4442, 4443, 4444, 4446, 4448, 4450, 4453, 4456, 4458, 4463, 4464, 4465, 4466, 4468, 4472, 4474, 4479, 4485, 4490, 4491, 4492, 4494, 4499, 4502, 4506, 4507, 4512, 4514, 4515, 4518, 4519, 4531, 4535, 4543, 4548, 4549, 4551, 4552, 4554, 4556, 4557, 4558, 4560, 4562, 4565, 4566, 4568, 4574, 4575, 4580, 4582, 4583, 4590, 4596, 4601, 4604, 4606, 4611, 4618, 4621, 4625, 4633, 4634, 4635, 4641, 4643, 4644, 4650, 4653, 4654, 4655, 4659, 4666, 4667, 4669, 4670, 4671, 4674, 4677, 4680, 4682, 4685, 4687, 4693, 4699, 4700, 4704, 4705, 4706, 4708, 4710, 4714, 4716, 4719, 4721, 4725, 4729, 4730, 4732, 4737, 4738, 4739, 4740, 4741, 4747, 4748, 4749, 4750, 4751, 4753, 4754, 4755, 4756, 4759, 4761, 4762, 4763, 4767, 4771, 4775, 4778, 4779, 4789, 4790, 4791, 4794, 4795, 4802, 4804, 4813, 4814, 4815, 4817, 4818, 4822, 4823, 4824, 4828, 4833, 4834, 4842, 4855, 4856, 4857, 4858, 4859, 4861, 4862, 4864, 4869, 4870, 4872, 4875, 4876, 4877, 4878, 4880, 4887, 4889, 4891, 4895, 4901, 4902, 4905, 4909, 4912, 4914, 4917, 4920, 4921, 4923, 4924, 4925, 4926, 4935, 4936, 4938, 4943, 4950, 4955, 4963, 4965, 4971, 4972, 4975, 4980, 4987, 4988, 4993, 4994, 4996, 5000, 5015, 5022, 5026, 5029, 5030, 5034, 5039, 5040, 5042, 5044, 5046, 5052, 5053, 5054, 5057, 5067, 5068, 5072, 5082, 5088, 5089, 5090, 5091, 5094, 5095, 5100, 5102, 5109, 5111, 5122, 5123, 5129, 5131, 5132, 5136, 5137, 5140, 5145, 5147, 5152, 5157, 5160, 5163, 5164, 5165, 5168, 5169, 5170, 5174, 5180, 5181, 5182, 5184, 5185, 5188, 5189, 5190, 5191, 5192, 5195, 5196, 5198, 5200, 5201, 5202, 5206, 5208, 5212, 5216, 5217, 5219, 5225, 5226, 5229, 5230, 5234, 5240, 5241, 5247, 5249, 5253, 5255, 5258, 5261, 5263, 5267, 5268, 5273, 5275, 5276, 5280, 5281, 5283, 5292, 5293, 5298, 5299, 5300, 5301, 5303, 5308, 5311, 5315, 5317, 5319, 5324, 5329, 5330, 5334, 5338, 5344, 5346, 5347, 5348, 5351, 5359, 5360, 5361, 5362, 5371, 5372, 5374, 5386, 5388, 5389, 5393, 5395, 5396, 5397, 5398, 5403, 5407, 5411, 5414, 5417, 5430, 5431, 5438, 5448, 5449, 5452, 5456, 5457, 5458, 5459, 5466, 5467, 5469, 5472, 5474, 5476, 5482, 5483, 5493, 5495, 5496, 5498, 5506, 5508, 5510, 5513, 5515, 5516, 5517, 5518, 5519, 5520, 5521, 5524, 5526, 5530, 5534, 5535, 5537, 5539, 5543, 5557, 5561, 5562, 5563, 5566, 5568, 5569, 5571, 5572, 5579, 5581, 5585, 5586, 5588, 5589, 5591, 5592, 5597, 5598, 5612, 5613, 5615, 5616, 5618, 5619, 5620, 5621, 5623, 5627, 5632, 5633, 5635, 5638, 5640, 5642, 5643, 5647, 5648, 5651, 5652, 5657, 5659, 5660, 5662, 5663, 5664, 5670, 5671, 5675, 5676, 5677, 5679, 5683, 5689, 5694, 5695, 5697, 5698, 5702, 5703, 5706, 5709, 5711, 5717, 5718, 5721, 5722, 5731, 5734, 5735, 5739, 5744, 5751, 5754, 5756, 5757, 5763, 5768, 5770, 5771, 5773, 5775, 5780, 5784, 5785, 5786, 5788, 5791, 5794, 5803, 5805, 5806, 5808, 5810, 5813, 5820, 5826, 5833, 5835, 5836, 5837, 5844, 5846, 5852, 5853, 5854, 5859, 5861, 5864, 5865, 5866, 5867, 5869, 5872, 5876, 5878, 5879, 5881, 5883, 5886, 5887, 5888, 5892, 5893, 5906, 5907, 5912, 5925, 5926, 5927, 5928, 5931, 5932, 5934, 5936, 5938, 5941, 5944, 5948, 5954, 5956, 5959, 5968, 5969, 5971, 5975, 5978, 5982, 5988, 5991, 5994, 5996, 5997, 6000, 6002, 6004, 6006, 6008, 6013, 6016, 6017, 6023, 6024, 6025, 6026, 6038, 6041, 6043, 6044, 6048, 6051, 6058, 6059, 6062, 6068, 6069, 6072, 6073, 6075, 6080, 6081, 6084, 6085, 6086, 6087, 6088, 6089, 6090, 6092, 6093, 6097, 6098, 6099, 6107, 6108, 6109, 6110, 6116, 6118, 6119, 6120, 6124, 6129, 6131, 6132, 6133, 6137, 6138, 6139, 6145, 6146, 6147, 6149, 6151, 6153, 6160, 6162, 6163, 6164, 6165, 6181, 6183, 6184, 6186, 6188, 6189, 6191, 6194, 6195, 6196, 6197, 6198, 6203, 6204, 6205, 6209, 6215, 6220, 6221, 6223, 6224, 6226, 6227, 6228, 6230, 6231, 6234, 6237, 6239, 6243, 6246, 6247, 6250, 6251, 6262, 6264, 6265, 6267, 6272, 6273, 6275, 6278, 6281, 6282, 6286, 6288, 6292, 6293, 6294, 6296, 6299, 6300, 6303, 6311, 6315, 6317, 6319, 6322, 6325, 6328, 6333, 6338, 6342, 6343, 6344, 6353, 6354, 6356, 6360, 6363, 6365, 6367, 6370, 6372, 6375, 6381, 6383, 6394, 6397, 6399, 6400, 6403, 6404, 6405, 6408, 6410, 6412, 6414, 6415, 6419, 6420, 6422, 6425, 6426, 6427, 6428, 6429, 6430, 6431, 6436, 6440, 6443, 6449, 6456, 6463, 6464, 6466, 6467, 6470, 6474, 6476, 6478, 6480, 6482, 6484, 6485, 6488, 6494, 6501, 6504, 6505, 6510, 6516, 6517, 6519, 6523, 6526, 6528, 6530, 6531, 6532, 6533, 6534, 6537, 6539, 6543, 6544, 6547, 6549, 6553, 6555, 6558, 6564, 6567, 6569, 6571, 6572, 6574, 6576, 6577, 6579, 6581, 6584, 6588, 6589, 6592, 6594, 6595, 6597, 6599, 6600, 6603, 6607, 6609, 6610, 6615, 6616, 6617, 6620, 6623, 6625, 6626, 6629, 6633, 6634, 6635, 6638, 6639, 6644, 6646, 6647, 6649, 6655, 6656, 6658, 6661, 6666, 6672, 6681, 6682, 6703, 6705, 6706, 6716, 6718, 6720, 6729, 6730, 6734, 6736, 6737, 6739, 6742, 6747, 6749, 6756, 6757, 6758, 6759, 6761, 6764, 6766, 6767, 6778, 6779, 6782, 6783, 6788, 6792, 6793, 6794, 6795, 6799, 6803, 6804, 6805, 6806, 6807, 6810, 6811, 6812, 6813, 6814, 6815, 6816, 6817, 6819, 6820, 6821, 6824, 6827, 6828, 6830, 6831, 6834, 6836, 6840, 6841, 6842, 6843, 6848, 6851, 6859, 6863, 6869, 6875, 6876, 6877, 6880, 6881, 6884, 6886, 6887, 6888, 6892, 6895, 6902, 6903, 6907, 6909, 6913, 6917, 6919, 6921, 6924, 6925, 6930, 6939, 6946, 6950, 6952, 6954, 6955, 6959, 6960, 6963, 6967, 6970, 6971, 6979, 6981, 6984, 6985, 6987, 6988, 6990, 6991, 6994, 6997, 6999, 7009, 7013, 7022, 7029, 7033, 7038, 7039, 7041, 7043, 7045, 7046, 7048, 7049, 7051, 7052, 7053, 7054, 7057, 7064, 7067, 7077, 7083, 7084, 7085, 7094, 7096, 7105, 7106, 7107, 7108, 7110, 7113, 7117, 7118, 7124, 7126, 7129, 7130, 7138, 7139, 7141, 7142, 7143, 7144, 7151, 7152, 7154, 7163, 7164, 7165, 7166, 7169, 7170, 7171, 7172, 7173, 7182, 7184, 7187, 7192, 7194, 7196, 7197, 7198, 7201, 7202, 7203, 7206, 7207, 7208, 7210, 7212, 7214, 7215, 7217, 7219, 7220, 7224, 7227, 7228, 7230, 7235, 7236, 7244, 7245, 7246, 7249, 7250, 7255, 7257, 7258, 7262, 7264, 7267, 7268, 7270, 7274, 7276, 7281, 7282, 7287, 7291, 7292, 7293, 7298, 7299, 7300, 7301, 7303, 7304, 7305, 7306, 7307, 7308, 7311, 7312, 7313, 7315, 7318, 7319, 7323, 7324, 7328, 7331, 7338, 7339, 7344, 7345, 7356, 7357, 7358, 7361, 7365, 7371, 7373, 7375, 7376, 7377, 7380, 7382, 7383, 7386, 7396, 7398, 7399, 7400, 7409, 7411, 7417, 7418, 7425, 7430, 7434, 7435, 7436, 7438, 7441, 7443, 7444, 7447, 7448, 7452, 7453, 7454, 7457, 7458, 7459, 7466, 7470, 7472, 7481, 7483, 7485, 7486, 7487, 7490, 7492, 7493, 7498, 7499, 7502, 7506, 7512, 7514, 7515, 7523, 7524, 7533, 7537, 7538, 7546, 7549, 7556, 7560, 7561, 7572, 7574, 7579, 7583, 7585, 7586, 7589, 7590, 7596, 7598, 7604, 7605, 7609, 7612, 7619, 7620, 7622, 7624, 7625, 7633, 7642, 7643, 7647, 7649, 7652, 7655, 7656, 7658, 7661, 7662, 7665, 7674, 7678, 7679, 7680, 7682, 7687, 7689, 7695, 7700, 7703, 7712, 7715, 7716, 7718, 7724, 7726, 7727, 7730, 7736, 7737, 7738, 7741, 7744, 7745, 7748, 7749, 7753, 7763, 7764, 7768, 7770, 7772, 7774, 7775, 7779, 7780, 7781, 7785, 7786, 7788, 7791, 7792, 7793, 7798, 7799, 7800, 7803, 7804, 7805, 7806, 7807, 7812, 7818, 7819, 7820, 7823, 7825, 7833, 7834, 7839, 7840, 7841, 7844, 7845, 7850, 7854, 7856, 7860, 7865, 7873, 7877, 7878, 7880, 7881, 7885, 7887, 7888, 7890, 7896, 7908, 7910, 7911, 7913, 7918, 7923, 7925, 7928, 7933, 7934, 7935, 7938, 7942, 7944, 7946, 7949, 7952, 7965, 7966, 7967, 7972, 7973, 7974, 7976, 7977, 7981, 7984, 7986, 7992, 7994, 7996, 7999, 8006, 8007, 8009, 8012, 8020, 8023, 8024, 8026, 8031, 8036, 8041, 8042, 8043, 8044, 8045, 8047, 8048, 8052, 8053, 8056, 8059, 8063, 8068, 8076, 8077, 8078, 8083, 8088, 8091, 8099, 8100, 8102, 8103, 8106, 8110, 8112, 8113, 8118, 8123, 8126, 8129, 8130, 8136, 8148, 8150, 8151, 8155, 8156, 8159, 8163, 8166, 8177, 8178, 8179, 8181, 8187, 8188, 8189, 8191, 8193, 8202, 8204, 8208, 8211, 8213, 8217, 8219, 8222, 8223, 8230, 8234, 8237, 8239, 8241, 8242, 8246, 8248, 8250, 8252, 8253, 8264, 8265, 8268, 8269, 8274, 8276, 8282, 8289, 8291, 8296, 8300, 8304, 8308, 8310, 8311, 8312, 8315, 8318, 8319, 8320, 8322, 8329, 8339, 8340, 8341, 8347, 8350, 8351, 8353, 8355, 8367, 8368, 8371, 8373, 8378, 8379, 8380, 8385, 8386, 8387, 8389, 8390, 8392, 8395, 8398, 8401, 8404, 8406, 8407, 8408, 8410, 8413, 8414, 8415, 8416, 8417, 8418, 8428, 8430, 8435, 8436, 8438, 8439, 8442, 8444, 8445, 8446, 8447, 8448, 8449, 8450, 8451, 8458, 8459, 8465, 8470, 8472, 8473, 8474, 8476, 8477, 8481, 8482, 8483, 8485, 8486, 8490, 8498, 8501, 8502, 8503, 8505, 8507, 8509, 8511, 8513, 8515, 8520, 8521, 8523, 8524, 8525, 8526, 8528, 8532, 8533, 8535, 8541, 8542, 8543, 8546, 8553, 8554, 8557, 8561, 8562, 8565, 8574, 8575, 8576, 8579, 8581, 8585, 8588, 8592, 8593, 8594, 8596, 8597, 8598, 8600, 8601, 8602, 8603, 8604, 8605, 8609, 8610, 8611, 8612, 8614, 8622, 8631, 8634, 8638, 8639, 8642, 8644, 8648, 8650, 8652, 8658, 8659, 8660, 8663, 8664, 8665, 8669, 8672, 8676, 8677, 8685, 8686, 8693, 8699, 8700, 8703, 8705, 8706, 8708, 8709, 8713, 8717, 8719, 8720, 8722, 8726, 8729, 8731, 8736, 8741, 8744, 8746, 8747, 8748, 8753, 8755, 8757, 8761, 8763, 8769, 8770, 8772, 8773, 8774, 8777, 8779, 8783, 8784, 8786, 8789, 8792, 8802, 8803, 8810, 8811, 8818, 8821, 8822, 8824, 8828, 8829, 8830, 8834, 8835, 8841, 8843, 8845, 8846, 8853, 8865, 8866, 8874, 8876, 8877, 8878, 8881, 8883, 8886, 8888, 8889, 8892, 8896, 8897, 8900, 8901, 8905, 8907, 8908, 8911, 8916, 8917, 8919, 8922, 8924, 8926, 8928, 8929, 8935, 8937, 8938, 8941, 8945, 8946, 8949, 8951, 8960, 8968, 8979, 8980, 8981, 8985, 8986, 8991, 8992, 8996, 8998, 9000, 9001, 9006, 9009, 9011, 9012, 9018, 9020, 9022, 9026, 9027, 9029, 9030, 9033, 9045, 9050, 9052, 9056, 9058, 9059, 9060, 9068, 9069, 9071, 9072, 9076, 9078, 9084, 9087, 9088, 9091, 9092, 9095, 9097, 9098, 9103, 9104, 9105, 9106, 9107, 9112, 9114, 9115, 9116, 9118, 9120, 9123, 9124, 9125, 9129, 9131, 9133, 9134, 9139, 9140, 9141, 9142, 9144, 9151, 9152, 9154, 9175, 9177, 9180, 9183, 9185, 9188, 9190, 9191, 9194, 9195, 9200, 9205, 9206, 9207, 9210, 9211, 9213, 9215, 9216, 9223, 9226, 9229, 9233, 9237, 9243, 9248, 9253, 9257, 9259, 9265, 9267, 9270, 9273, 9282, 9284, 9285, 9287, 9288, 9290, 9292, 9295, 9296, 9300, 9304, 9306, 9308, 9311, 9314, 9320, 9321, 9322, 9323, 9326, 9328, 9336, 9337, 9338, 9339, 9340, 9346, 9347, 9350, 9352, 9366, 9371, 9375, 9376, 9382, 9388, 9391, 9392, 9394, 9400, 9402, 9403, 9404, 9406, 9407, 9412, 9413, 9414, 9415, 9419, 9421, 9423, 9425, 9429, 9439, 9440, 9443, 9446, 9449, 9451, 9452, 9453, 9456, 9460, 9467, 9468, 9471, 9472, 9473, 9474, 9477, 9481, 9488, 9490, 9500, 9503, 9504, 9509, 9514, 9517, 9518, 9519, 9522, 9534, 9536, 9537, 9538, 9540, 9543, 9546, 9550, 9551, 9553, 9554, 9555, 9560, 9564, 9565, 9567, 9568, 9571, 9577, 9586, 9587, 9590, 9591, 9595, 9596, 9598, 9601, 9602, 9606, 9609, 9614, 9615, 9617, 9618, 9620, 9621, 9623, 9624, 9626, 9629, 9632, 9633, 9640, 9648, 9649, 9651, 9655, 9656, 9657, 9658, 9659, 9663, 9666, 9668, 9670, 9682, 9686, 9698, 9701, 9710, 9711, 9715, 9717, 9718, 9721, 9723, 9726, 9727, 9729, 9731, 9732, 9733, 9734, 9738, 9742, 9743, 9744, 9745, 9746, 9750, 9754, 9763, 9764, 9768, 9770, 9772, 9774, 9776, 9782, 9786, 9791, 9792, 9794, 9798, 9799, 9808, 9809, 9810, 9811, 9812, 9813, 9819, 9820, 9825, 9828, 9833, 9845, 9846, 9847, 9850, 9861, 9866, 9869, 9873, 9875, 9878, 9882, 9886, 9887, 9889, 9892, 9894, 9897, 9900, 9907, 9909, 9910, 9911, 9921, 9923, 9924, 9928, 9930, 9932, 9935, 9936, 9938, 9940, 9946, 9949, 9950, 9952, 9953, 9960, 9962, 9963, 9967, 9968, 9972, 9974, 9975, 9976, 9980, 9982, 9984, 9985, 9987, 9988, 9990, 9991, 9992, 9997, 10000, 10008, 10009, 10010, 10017, 10018, 10019, 10021, 10026, 10027, 10032, 10037, 10038, 10041, 10049, 10051, 10052, 10054, 10055, 10058, 10059, 10060, 10062, 10064, 10066, 10073, 10075, 10077, 10078, 10080, 10081, 10083, 10091, 10092, 10094, 10095, 10097, 10101, 10102, 10103, 10106, 10109, 10110, 10115, 10116, 10117, 10122, 10125, 10128, 10129, 10131, 10151, 10158, 10160, 10163, 10165, 10166, 10168, 10174, 10176, 10178, 10181, 10192, 10193, 10194, 10195, 10196, 10199, 10206, 10207, 10212, 10214, 10218, 10219, 10220, 10221, 10223, 10224, 10225, 10228, 10231, 10233, 10234, 10235, 10236, 10237, 10239, 10249, 10252, 10253, 10255, 10259, 10262, 10263, 10266, 10269, 10270, 10275, 10276, 10284, 10286, 10291, 10292, 10293, 10295, 10300, 10302, 10306, 10307, 10311, 10312, 10314, 10318, 10323, 10325, 10326, 10327, 10330, 10331, 10333, 10334, 10335, 10336, 10340, 10341, 10343, 10346, 10353, 10356, 10357, 10364, 10371, 10373, 10375, 10378, 10380, 10381, 10383, 10384, 10388, 10393, 10397, 10398, 10399, 10400, 10401, 10408, 10410, 10411, 10413, 10414, 10416, 10417, 10419, 10421, 10423, 10424, 10425, 10430, 10435, 10436, 10438, 10440, 10446, 10447, 10448, 10449, 10450, 10451, 10452, 10453, 10456, 10460, 10463, 10464, 10465, 10466, 10468, 10469, 10471, 10474, 10480, 10482, 10487, 10490, 10494, 10496, 10506, 10508, 10514, 10518, 10522, 10523, 10524, 10527, 10528, 10530, 10531, 10532, 10535, 10536, 10537, 10541, 10542, 10543, 10544, 10547, 10555, 10556, 10558, 10560, 10563, 10567, 10569, 10571, 10573, 10580, 10581, 10582, 10583, 10587, 10588, 10593, 10595, 10596, 10599, 10601, 10602, 10615, 10616, 10617, 10621, 10622, 10626, 10629, 10630, 10631, 10633, 10637, 10638, 10639, 10640, 10642, 10645, 10646, 10650, 10651, 10652, 10655, 10657, 10668, 10670, 10676, 10678, 10679, 10682, 10683, 10684, 10685, 10700, 10701, 10705, 10707, 10711, 10716, 10721, 10722, 10724, 10726, 10729, 10734, 10738, 10740, 10741, 10744, 10747, 10748, 10749, 10752, 10753, 10754, 10756, 10761, 10762, 10768, 10769, 10772, 10775, 10778, 10779, 10781, 10782, 10785, 10787, 10788, 10790, 10792, 10795, 10801, 10802, 10803, 10804, 10805, 10809, 10810, 10811, 10812, 10820, 10822, 10823, 10824, 10827, 10831, 10833, 10836, 10837, 10838, 10839, 10843, 10850, 10851, 10853, 10854, 10857, 10858, 10860, 10864, 10866, 10867, 10870, 10874, 10877, 10880, 10881, 10886, 10887, 10888, 10889, 10896, 10897, 10898, 10899, 10901, 10902, 10911, 10913, 10917, 10918, 10920, 10926, 10927, 10928, 10929, 10930, 10933, 10934, 10940, 10941, 10947, 10949, 10965, 10966, 10967, 10972, 10976, 10977, 10979, 10987, 10988, 10993, 10996, 10998, 10999, 11002, 11008, 11015, 11021, 11022, 11023, 11024, 11030, 11032, 11036, 11037, 11040, 11044, 11046, 11047, 11050, 11051, 11053, 11056, 11058, 11060, 11063, 11066, 11078, 11082, 11083, 11090, 11095, 11100, 11107, 11114, 11118, 11119, 11122, 11124, 11129, 11133, 11135, 11136, 11137, 11138, 11147, 11149, 11150, 11152, 11153, 11154, 11160, 11163, 11165, 11168, 11169, 11173, 11177, 11178, 11181, 11184, 11187, 11188, 11190, 11192, 11193, 11194, 11198, 11204, 11208, 11213, 11214, 11216, 11217, 11218, 11222, 11224, 11226, 11227, 11228, 11229, 11230, 11233, 11235, 11236, 11237, 11238, 11239, 11242, 11243, 11246, 11247, 11251, 11253, 11254, 11255, 11256, 11258, 11260, 11262, 11263, 11266, 11290, 11292, 11293, 11294, 11295, 11297, 11299, 11302, 11304, 11306, 11313, 11315, 11316, 11317, 11318, 11321, 11323, 11330, 11331, 11337, 11339, 11340, 11345, 11346, 11348, 11349, 11358, 11359, 11363, 11365, 11369, 11371, 11373, 11377, 11380, 11382, 11385, 11387, 11388, 11394, 11395, 11398, 11401, 11404, 11405, 11406, 11408, 11416, 11424, 11430, 11431, 11435, 11438, 11443, 11446, 11447, 11449, 11451, 11456, 11459, 11462, 11465, 11466, 11472, 11475, 11478, 11485, 11487, 11488, 11489, 11490, 11492, 11494, 11496, 11497, 11498, 11499, 11500, 11501, 11505, 11506, 11507, 11508, 11520, 11521, 11523, 11524, 11526, 11527, 11531, 11532, 11533, 11534, 11535, 11540, 11544, 11547, 11548, 11550, 11551, 11553, 11558, 11560, 11561, 11567, 11568, 11570, 11571, 11576, 11577, 11586, 11587, 11588, 11593, 11594, 11595, 11597, 11604, 11607, 11611, 11615, 11617, 11623, 11628, 11636, 11647, 11649, 11650, 11656, 11658, 11659, 11663, 11669, 11678, 11681, 11682, 11688, 11691, 11692, 11694, 11695, 11696, 11699, 11701, 11703, 11705, 11707, 11712, 11718, 11721, 11725, 11730, 11731, 11733, 11736, 11738, 11740, 11743, 11753, 11759, 11760, 11761, 11762, 11763, 11764, 11765, 11766, 11767, 11770, 11771, 11777, 11781, 11782, 11786, 11788, 11792, 11794, 11797, 11799, 11800, 11804, 11809, 11810, 11811, 11814, 11818, 11820, 11821, 11823, 11826, 11830, 11840, 11841, 11846, 11848, 11851, 11856, 11858, 11861, 11863, 11864, 11865, 11868, 11872, 11876, 11877, 11881, 11889, 11891, 11892, 11894, 11899, 11901, 11906, 11909, 11911, 11913, 11914, 11915, 11916, 11917, 11919, 11920, 11921, 11923, 11926, 11927, 11928, 11929, 11930, 11934, 11940, 11943, 11947, 11949, 11950, 11953, 11956, 11958, 11959, 11960, 11961, 11962, 11965, 11966, 11973, 11974, 11975, 11976, 11977, 11978, 11979, 11980, 11983, 11988, 11989, 11993, 11997, 11998, 11999, 12004, 12005, 12008, 12014, 12016, 12017, 12019, 12021, 12023, 12024, 12026, 12027, 12032, 12033, 12042, 12043, 12044, 12047, 12052, 12059, 12068, 12076, 12081, 12083, 12087, 12091, 12092, 12093, 12098, 12102, 12104, 12106, 12108, 12109, 12110, 12112, 12114, 12116, 12118, 12122, 12126, 12128, 12129, 12130, 12134, 12137, 12138, 12139, 12143, 12147, 12149, 12151, 12161, 12165, 12166, 12167, 12170, 12171, 12173, 12174, 12175, 12181, 12183, 12185, 12189, 12197, 12198, 12204, 12207, 12208, 12215, 12217, 12219, 12221, 12227, 12234, 12240, 12245, 12250, 12252, 12255, 12256, 12259, 12263, 12267, 12268, 12269, 12274, 12278, 12280, 12281, 12283, 12284, 12286, 12287, 12288, 12292, 12293, 12304, 12306, 12307, 12310, 12311, 12312, 12313, 12314, 12315, 12317, 12321, 12323, 12326, 12329, 12331, 12333, 12334, 12342, 12344, 12345, 12347, 12354, 12356, 12358, 12359, 12364, 12368, 12370, 12372, 12373, 12374, 12375, 12376, 12379, 12380, 12381, 12383, 12391, 12397, 12400, 12401, 12403, 12404, 12405, 12406, 12410, 12411, 12414, 12416, 12419, 12420, 12421, 12424, 12425, 12427, 12437, 12439, 12440, 12445, 12447, 12451, 12454, 12455, 12456, 12457, 12459, 12462, 12467, 12468, 12470, 12472, 12473, 12478, 12481, 12487, 12488, 12491, 12497, 12499, 12504, 12508, 12509, 12514, 12530, 12531, 12536, 12539, 12545, 12546, 12547, 12549, 12555, 12556, 12559, 12561, 12563, 12564, 12565, 12567, 12568, 12572, 12574, 12583, 12585, 12588, 12597, 12605, 12606, 12608, 12609, 12611, 12614, 12616, 12619, 12623, 12631, 12634, 12636, 12638, 12639, 12641, 12649, 12651, 12655, 12663, 12668, 12670, 12671, 12672, 12679, 12680, 12681, 12684, 12691, 12693, 12695, 12698, 12699, 12701, 12702, 12707, 12711, 12713, 12714, 12718, 12719, 12729, 12731, 12732, 12733, 12737, 12739, 12741, 12742, 12743, 12751, 12752, 12754, 12755, 12758, 12760, 12762, 12764, 12766, 12769, 12771, 12772, 12773, 12783, 12790, 12794, 12797, 12800, 12801, 12802, 12803, 12805, 12810, 12812, 12813, 12814, 12817, 12819, 12820, 12822, 12824, 12826, 12827, 12828, 12834, 12836, 12838, 12839, 12843, 12844, 12849, 12850, 12853, 12860, 12861, 12866, 12875, 12882, 12883, 12887, 12888, 12895, 12898, 12900, 12904, 12905, 12906, 12910, 12913, 12914, 12916, 12917, 12918, 12920, 12921, 12926, 12929, 12932, 12933, 12939, 12940, 12941, 12942, 12945, 12946, 12947, 12950, 12953, 12961, 12966, 12967, 12968, 12969, 12973, 12974, 12975, 12976, 12978, 12982, 12984, 12987, 12990, 12991, 12992, 13004, 13007, 13010, 13011, 13014, 13015, 13017, 13018, 13022, 13023, 13024, 13030, 13032, 13035, 13038, 13040, 13041, 13042, 13044, 13049, 13050, 13053, 13054, 13055, 13056, 13061, 13064, 13066, 13067, 13069, 13071, 13075, 13079, 13085, 13086, 13087, 13095, 13098, 13101, 13102, 13105, 13106, 13112, 13114, 13115, 13116, 13117, 13118, 13120, 13123, 13124, 13128, 13131, 13135, 13142, 13147, 13148, 13149, 13151, 13169, 13174, 13175, 13182, 13185, 13197, 13199, 13209, 13210, 13212, 13213, 13215, 13217, 13221, 13224, 13227, 13230, 13232, 13234, 13235, 13236, 13237, 13238, 13243, 13248, 13249, 13251, 13255, 13259, 13260, 13261, 13263, 13264, 13267, 13268, 13269, 13276, 13279, 13281, 13285, 13293, 13296, 13297, 13298, 13303, 13304, 13313, 13315, 13317, 13318, 13319, 13320, 13321, 13323, 13326, 13328, 13330, 13332, 13335, 13338, 13343, 13345, 13346, 13348, 13354, 13358, 13359, 13361, 13367, 13368, 13369, 13370, 13381, 13384, 13388, 13393, 13394, 13396, 13397, 13401, 13408, 13410, 13416, 13419, 13420, 13423, 13424, 13429, 13430, 13433, 13439, 13444, 13446, 13448, 13450, 13451, 13456, 13463, 13466, 13468, 13469, 13473, 13475, 13492, 13494, 13497, 13499, 13500, 13501, 13503, 13504, 13506, 13513, 13514, 13515, 13516, 13517, 13519, 13520, 13521, 13522, 13530, 13532, 13540, 13543, 13544, 13545, 13546, 13547, 13549, 13552, 13553, 13556, 13568, 13569, 13574, 13580, 13582, 13583, 13584, 13587, 13589, 13597, 13599, 13601, 13602, 13604, 13612, 13621, 13623, 13628, 13631, 13632, 13634, 13636, 13637, 13641, 13647, 13650, 13652, 13654, 13661, 13662, 13663, 13668, 13671, 13675, 13677, 13678, 13679, 13681, 13683, 13684, 13687, 13688, 13695, 13698, 13700, 13702, 13703, 13706, 13710, 13713, 13715, 13716, 13720, 13721, 13725, 13728, 13729, 13739, 13745, 13747, 13750, 13756, 13764, 13767, 13769, 13772, 13773, 13774, 13775, 13776, 13779, 13781, 13782, 13783, 13785, 13786, 13787, 13789, 13791, 13792, 13793, 13794, 13796, 13798, 13807, 13809, 13816, 13817, 13818, 13819, 13820, 13822, 13823, 13828, 13830, 13831, 13834, 13835, 13843, 13849, 13852, 13859, 13866, 13869, 13870, 13872, 13873, 13877, 13881, 13891, 13892, 13894, 13897, 13898, 13901, 13906, 13908, 13909, 13910, 13911, 13914, 13917, 13918, 13919, 13920, 13925, 13927, 13930, 13933, 13938, 13944, 13947, 13948, 13952, 13954, 13963, 13965, 13969, 13970, 13971, 13975, 13976, 13980, 13983, 13984, 13988, 13990, 13991, 13999, 14000, 14009, 14010, 14014, 14016, 14017, 14018, 14022, 14027, 14030, 14031, 14036, 14041, 14043, 14049, 14050, 14051, 14052, 14062, 14063, 14066, 14067, 14069, 14070, 14071, 14073, 14075, 14084, 14086, 14088, 14091, 14092, 14094, 14096, 14102, 14105, 14106, 14112, 14116, 14118, 14119, 14120, 14122, 14125, 14128, 14129, 14130, 14132, 14133, 14135, 14138, 14139, 14142, 14145, 14146, 14148, 14149, 14150.

Promoters expressing in ear leaf tissue at the tasseling stage include SEQ IDs: 1, 3, 4, 7, 8, 11, 13, 14, 15, 29, 31, 34, 36, 48, 53, 56, 64, 65, 81, 82, 88, 93, 96, 97, 101, 102, 103, 107, 110, 111, 112, 121, 126, 129, 130, 131, 132, 143, 144, 147, 148, 152, 154, 160, 165, 168, 172, 176, 179, 181, 186, 187, 191, 193, 194, 195, 196, 199, 204, 205, 207, 210, 211, 230, 231, 232, 234, 235, 236, 240, 243, 244, 246, 249, 250, 251, 257, 262, 264, 268, 269, 270, 271, 273, 274, 280, 281, 284, 286, 288, 289, 295, 299, 301, 302, 305, 306, 309, 314, 316, 318, 319, 320, 322, 328, 329, 332, 334, 335, 337, 338, 341, 348, 349, 354, 357, 359, 360, 371, 376, 378, 379, 380, 382, 387, 388, 393, 396, 401, 406, 407, 423, 424, 428, 429, 433, 434, 436, 452, 455, 456, 460, 461, 466, 468, 471, 473, 478, 479, 481, 483, 485, 488, 496, 498, 501, 502, 504, 507, 509, 510, 512, 513, 514, 516, 517, 520, 522, 523, 525, 529, 532, 533, 536, 538, 541, 542, 544, 546, 547, 554, 557, 564, 565, 573, 580, 585, 591, 594, 595, 596, 598, 604, 608, 613, 614, 620, 623, 626, 629, 630, 633, 634, 635, 643, 644, 653, 656, 662, 663, 666, 674, 676, 677, 681, 686, 693, 694, 701, 705, 716, 717, 718, 719, 721, 722, 723, 724, 727, 733, 734, 736, 739, 740, 742, 757, 765, 768, 771, 782, 783, 791, 792, 793, 794, 795, 797, 800, 806, 808, 819, 820, 821, 830, 833, 840, 842, 844, 845, 850, 855, 857, 859, 860, 862, 863, 865, 868, 870, 878, 883, 884, 885, 887, 888, 890, 891, 892, 895, 897, 898, 901, 903, 907, 910, 911, 912, 913, 916, 917, 924, 925, 929, 931, 936, 938, 940, 943, 944, 951, 953, 954, 955, 957, 958, 961, 962, 964, 966, 969, 971, 974, 977, 979, 980, 981, 982, 983, 987, 989, 991, 994, 995, 996, 997, 999, 1006, 1007, 1009, 1011, 1014, 1026, 1028, 1035, 1039, 1041, 1042, 1043, 1045, 1046, 1047, 1049, 1050, 1051, 1052, 1055, 1056, 1064, 1065, 1068, 1069, 1073, 1077, 1078, 1086, 1087, 1088, 1089, 1092, 1095, 1098, 1103, 1104, 1108, 1110, 1111, 1112, 1114, 1118, 1119, 1120, 1122, 1127, 1130, 1132, 1133, 1136, 1137, 1144, 1146, 1147, 1148, 1155, 1165, 1166, 1169, 1171, 1176, 1178, 1182, 1185, 1187, 1191, 1196, 1199, 1201, 1202, 1204, 1210, 1214, 1217, 1218, 1219, 1223, 1225, 1227, 1228, 1230, 1231, 1233, 1234, 1235, 1236, 1239, 1241, 1243, 1248, 1249, 1250, 1252, 1253, 1256, 1258, 1261, 1264, 1265, 1269, 1272, 1275, 1281, 1282, 1283, 1285, 1286, 1292, 1295, 1296, 1297, 1303, 1304, 1305, 1306, 1307, 1309, 1312, 1316, 1325, 1327, 1330, 1331, 1334, 1335, 1337, 1339, 1340, 1346, 1347, 1349, 1351, 1354, 1355, 1360, 1364, 1367, 1371, 1373, 1377, 1380, 1381, 1382, 1385, 1386, 1388, 1393, 1394, 1396, 1398, 1403, 1404, 1407, 1415, 1421, 1423, 1426, 1431, 1432, 1438, 1439, 1441, 1442, 1444, 1448, 1451, 1453, 1454, 1455, 1458, 1459, 1462, 1466, 1468, 1481, 1486, 1487, 1490, 1499, 1501, 1508, 1510, 1511, 1514, 1517, 1518, 1525, 1526, 1527, 1534, 1539, 1540, 1543, 1545, 1546, 1547, 1549, 1550, 1556, 1560, 1567, 1570, 1571, 1575, 1577, 1578, 1582, 1584, 1586, 1590, 1592, 1593, 1594, 1599, 1600, 1602, 1604, 1605, 1609, 1612, 1614, 1615, 1616, 1622, 1625, 1630, 1634, 1635, 1636, 1637, 1638, 1639, 1648, 1650, 1652, 1653, 1658, 1659, 1661, 1662, 1669, 1671, 1675, 1676, 1677, 1680, 1683, 1685, 1688, 1689, 1691, 1696, 1697, 1698, 1699, 1705, 1706, 1708, 1710, 1714, 1717, 1723, 1726, 1727, 1729, 1731, 1732, 1735, 1740, 1745, 1755, 1759, 1761, 1762, 1764, 1771, 1776, 1785, 1789, 1791, 1807, 1813, 1815, 1820, 1823, 1826, 1828, 1830, 1832, 1834, 1835, 1837, 1838, 1840, 1845, 1850, 1852, 1859, 1865, 1868, 1869, 1870, 1872, 1876, 1882, 1888, 1889, 1891, 1897, 1898, 1899, 1900, 1902, 1905, 1906, 1910, 1911, 1912, 1914, 1916, 1918, 1920, 1922, 1923, 1924, 1930, 1931, 1933, 1934, 1936, 1940, 1944, 1950, 1952, 1955, 1973, 1974, 1977, 1981, 1991, 1993, 1999, 2000, 2007, 2008, 2009, 2010, 2012, 2013, 2014, 2015, 2016, 2017, 2020, 2023, 2026, 2027, 2033, 2034, 2039, 2041, 2043, 2045, 2048, 2049, 2055, 2060, 2062, 2064, 2066, 2069, 2071, 2072, 2074, 2075, 2077, 2081, 2082, 2083, 2088, 2089, 2090, 2094, 2095, 2096, 2097, 2099, 2103, 2109, 2113, 2116, 2117, 2126, 2132, 2133, 2134, 2137, 2139, 2140, 2142, 2143, 2144, 2147, 2150, 2152, 2156, 2157, 2159, 2161, 2164, 2166, 2167, 2168, 2172, 2173, 2178, 2179, 2182, 2185, 2190, 2193, 2196, 2201, 2202, 2203, 2206, 2207, 2213, 2215, 2216, 2221, 2222, 2226, 2227, 2229, 2230, 2231, 2232, 2233, 2235, 2237, 2240, 2244, 2247, 2252, 2253, 2257, 2260, 2262, 2263, 2273, 2274, 2279, 2280, 2281, 2282, 2283, 2288, 2295, 2296, 2297, 2298, 2300, 2301, 2303, 2304, 2305, 2308, 2309, 2310, 2314, 2322, 2323, 2325, 2328, 2329, 2331, 2333, 2335, 2339, 2342, 2346, 2348, 2349, 2351, 2352, 2353, 2354, 2359, 2360, 2363, 2366, 2367, 2371, 2377, 2379, 2381, 2382, 2384, 2396, 2397, 2398, 2401, 2403, 2405, 2408, 2411, 2412, 2418, 2419, 2420, 2422, 2435, 2437, 2441, 2442, 2443, 2445, 2450, 2452, 2453, 2454, 2457, 2458, 2465, 2470, 2471, 2472, 2476, 2480, 2482, 2485, 2492, 2494, 2495, 2496, 2498, 2500, 2504, 2505, 2506, 2507, 2509, 2510, 2511, 2512, 2514, 2517, 2519, 2522, 2525, 2528, 2529, 2531, 2532, 2533, 2535, 2538, 2539, 2541, 2547, 2548, 2549, 2552, 2555, 2557, 2560, 2567, 2568, 2573, 2576, 2578, 2581, 2583, 2589, 2590, 2594, 2606, 2614, 2616, 2617, 2619, 2626, 2627, 2634, 2637, 2639, 2644, 2647, 2651, 2652, 2653, 2654, 2655, 2663, 2665, 2671, 2674, 2675, 2679, 2680, 2684, 2685, 2687, 2689, 2691, 2692, 2694, 2700, 2704, 2711, 2715, 2718, 2719, 2725, 2726, 2728, 2729, 2737, 2739, 2740, 2742, 2749, 2752, 2756, 2757, 2763, 2764, 2765, 2768, 2770, 2773, 2775, 2780, 2785, 2787, 2791, 2800, 2801, 2802, 2805, 2812, 2814, 2819, 2820, 2822, 2823, 2824, 2826, 2827, 2829, 2833, 2837, 2839, 2840, 2844, 2845, 2850, 2857, 2858, 2861, 2864, 2865, 2871, 2873, 2876, 2878, 2879, 2885, 2886, 2888, 2889, 2890, 2893, 2894, 2902, 2903, 2905, 2906, 2908, 2909, 2910, 2911, 2923, 2935, 2938, 2942, 2944, 2945, 2946, 2948, 2950, 2955, 2959, 2960, 2963, 2966, 2968, 2969, 2976, 2979, 2980, 2992, 2994, 2998, 3000, 3002, 3003, 3005, 3006, 3007, 3008, 3009, 3010, 3012, 3015, 3016, 3019, 3023, 3024, 3026, 3038, 3039, 3042, 3044, 3048, 3049, 3050, 3051, 3053, 3055, 3062, 3064, 3067, 3072, 3075, 3076, 3080, 3081, 3083, 3084, 3085, 3087, 3088, 3094, 3096, 3101, 3105, 3106, 3109, 3112, 3114, 3118, 3119, 3120, 3121, 3123, 3126, 3127, 3128, 3137, 3138, 3139, 3143, 3147, 3148, 3149, 3153, 3154, 3157, 3158, 3167, 3170, 3181, 3185, 3189, 3192, 3194, 3199, 3202, 3205, 3206, 3210, 3212, 3218, 3219, 3220, 3221, 3224, 3225, 3226, 3227, 3228, 3231, 3236, 3237, 3240, 3250, 3252, 3253, 3255, 3256, 3261, 3263, 3266, 3268, 3271, 3273, 3280, 3282, 3286, 3288, 3289, 3290, 3294, 3295, 3299, 3312, 3313, 3327, 3329, 3331, 3332, 3333, 3335, 3340, 3345, 3349, 3353, 3355, 3358, 3361, 3363, 3370, 3374, 3377, 3379, 3380, 3383, 3386, 3396, 3397, 3399, 3402, 3404, 3405, 3412, 3414, 3415, 3416, 3418, 3419, 3422, 3426, 3427, 3428, 3429, 3435, 3438, 3440, 3445, 3446, 3447, 3449, 3451, 3452, 3455, 3458, 3460, 3461, 3464, 3465, 3468, 3470, 3471, 3473, 3474, 3475, 3477, 3482, 3483, 3486, 3487, 3488, 3490, 3491, 3499, 3500, 3503, 3504, 3506, 3510, 3511, 3516, 3517, 3518, 3529, 3533, 3536, 3541, 3544, 3545, 3548, 3549, 3551, 3552, 3554, 3558, 3560, 3561, 3562, 3563, 3569, 3572, 3574, 3576, 3582, 3587, 3588, 3589, 3592, 3593, 3594, 3595, 3597, 3600, 3603, 3606, 3607, 3610, 3611, 3616, 3618, 3619, 3621, 3623, 3624, 3626, 3629, 3633, 3637, 3640, 3642, 3643, 3644, 3645, 3646, 3648, 3654, 3655, 3657, 3659, 3660, 3663, 3667, 3668, 3669, 3671, 3674, 3682, 3702, 3706, 3707, 3710, 3713, 3715, 3717, 3718, 3719, 3721, 3724, 3731, 3732, 3738, 3739, 3742, 3748, 3749, 3752, 3754, 3757, 3760, 3761, 3762, 3764, 3766, 3775, 3777, 3778, 3783, 3785, 3788, 3790, 3791, 3792, 3794, 3798, 3804, 3808, 3812, 3818, 3823, 3825, 3828, 3831, 3832, 3833, 3834, 3836, 3839, 3842, 3843, 3844, 3845, 3849, 3858, 3859, 3860, 3862, 3866, 3867, 3870, 3871, 3872, 3876, 3883, 3885, 3887, 3889, 3890, 3891, 3895, 3896, 3898, 3899, 3908, 3910, 3912, 3914, 3917, 3923, 3924, 3926, 3928, 3929, 3934, 3937, 3938, 3941, 3947, 3950, 3954, 3958, 3962, 3967, 3968, 3974, 3975, 3978, 3983, 3984, 3991, 3995, 3996, 3997, 4000, 4001, 4002, 4003, 4006, 4008, 4013, 4024, 4026, 4030, 4038, 4039, 4040, 4044, 4047, 4048, 4049, 4050, 4051, 4052, 4053, 4054, 4056, 4057, 4058, 4060, 4062, 4067, 4068, 4069, 4072, 4075, 4077, 4078, 4084, 4087, 4092, 4094, 4099, 4103, 4105, 4109, 4110, 4111, 4113, 4115, 4122, 4128, 4133, 4137, 4139, 4143, 4148, 4149, 4154, 4155, 4156, 4158, 4160, 4161, 4162, 4163, 4165, 4166, 4167, 4168, 4169, 4171, 4175, 4176, 4178, 4184, 4187, 4188, 4189, 4190, 4197, 4198, 4201, 4202, 4205, 4206, 4210, 4211, 4212, 4214, 4217, 4219, 4221, 4227, 4228, 4233, 4235, 4247, 4250, 4251, 4255, 4257, 4258, 4260, 4263, 4266, 4267, 4270, 4272, 4276, 4279, 4280, 4281, 4289, 4295, 4296, 4297, 4298, 4301, 4302, 4304, 4309, 4312, 4320, 4321, 4324, 4329, 4330, 4331, 4332, 4333, 4335, 4337, 4339, 4341, 4343, 4344, 4347, 4349, 4352, 4354, 4358, 4359, 4360, 4369, 4371, 4373, 4374, 4378, 4380, 4383, 4387, 4388, 4390, 4391, 4393, 4394, 4397, 4401, 4402, 4403, 4404, 4405, 4406, 4410, 4412, 4415, 4422, 4423, 4426, 4427, 4434, 4436, 4439, 4442, 4443, 4444, 4446, 4448, 4450, 4453, 4456, 4457, 4458, 4460, 4461, 4462, 4463, 4464, 4465, 4468, 4472, 4479, 4483, 4485, 4491, 4492, 4494, 4498, 4500, 4502, 4506, 4507, 4512, 4513, 4515, 4518, 4519, 4522, 4524, 4531, 4535, 4549, 4551, 4554, 4555, 4556, 4557, 4558, 4559, 4562, 4563, 4565, 4566, 4567, 4568, 4570, 4575, 4580, 4582, 4583, 4586, 4590, 4591, 4594, 4595, 4596, 4601, 4604, 4605, 4606, 4608, 4623, 4625, 4633, 4635, 4641, 4643, 4644, 4650, 4651, 4653, 4654, 4655, 4657, 4659, 4666, 4667, 4669, 4670, 4671, 4672, 4677, 4680, 4682, 4684, 4685, 4687, 4697, 4699, 4700, 4704, 4705, 4706, 4710, 4712, 4719, 4721, 4722, 4725, 4729, 4730, 4732, 4737, 4738, 4739, 4740, 4741, 4747, 4748, 4749, 4750, 4751, 4753, 4754, 4756, 4761, 4762, 4763, 4765, 4767, 4771, 4775, 4779, 4789, 4790, 4791, 4794, 4795, 4804, 4813, 4817, 4818, 4820, 4822, 4823, 4824, 4828, 4833, 4834, 4842, 4855, 4857, 4861, 4862, 4864, 4870, 4872, 4875, 4877, 4878, 4880, 4881, 4887, 4888, 4889, 4891, 4901, 4905, 4909, 4912, 4914, 4917, 4918, 4920, 4921, 4923, 4924, 4926, 4931, 4935, 4936, 4938, 4941, 4947, 4950, 4956, 4965, 4971, 4972, 4973, 4975, 4980, 4981, 4988, 4992, 4993, 4994, 4996, 5005, 5010, 5011, 5015, 5026, 5029, 5030, 5034, 5037, 5039, 5040, 5042, 5044, 5046, 5049, 5052, 5054, 5057, 5061, 5067, 5068, 5072, 5082, 5088, 5089, 5090, 5091, 5094, 5095, 5100, 5102, 5111, 5114, 5121, 5123, 5129, 5130, 5131, 5132, 5136, 5137, 5140, 5144, 5145, 5147, 5152, 5154, 5157, 5159, 5160, 5164, 5165, 5168, 5170, 5174, 5180, 5181, 5182, 5184, 5185, 5188, 5189, 5190, 5191, 5192, 5195, 5196, 5198, 5199, 5201, 5202, 5206, 5208, 5212, 5216, 5217, 5219, 5225, 5229, 5234, 5236, 5240, 5241, 5243, 5249, 5253, 5255, 5258, 5261, 5263, 5267, 5273, 5275, 5276, 5281, 5283, 5292, 5293, 5298, 5299, 5300, 5301, 5303, 5308, 5311, 5314, 5317, 5324, 5325, 5327, 5329, 5330, 5332, 5334, 5338, 5342, 5344, 5346, 5347, 5348, 5350, 5351, 5361, 5366, 5367, 5372, 5382, 5386, 5388, 5389, 5391, 5393, 5394, 5395, 5397, 5398, 5400, 5403, 5405, 5411, 5414, 5417, 5427, 5428, 5431, 5434, 5437, 5438, 5439, 5446, 5448, 5449, 5452, 5456, 5457, 5458, 5459, 5463, 5464, 5466, 5472, 5476, 5481, 5482, 5483, 5493, 5495, 5496, 5497, 5498, 5501, 5502, 5503, 5506, 5508, 5510, 5513, 5515, 5516, 5518, 5519, 5520, 5521, 5524, 5530, 5535, 5537, 5539, 5543, 5549, 5557, 5558, 5559, 5562, 5565, 5566, 5568, 5569, 5571, 5572, 5574, 5579, 5581, 5585, 5586, 5588, 5589, 5592, 5596, 5597, 5604, 5612, 5613, 5614, 5615, 5616, 5618, 5620, 5621, 5627, 5631, 5632, 5635, 5640, 5642, 5643, 5647, 5648, 5651, 5653, 5657, 5659, 5660, 5663, 5664, 5670, 5671, 5675, 5676, 5677, 5689, 5690, 5694, 5695, 5697, 5698, 5699, 5700, 5702, 5703, 5706, 5709, 5711, 5712, 5713, 5718, 5721, 5722, 5730, 5731, 5734, 5735, 5739, 5744, 5751, 5753, 5756, 5758, 5763, 5768, 5771, 5773, 5775, 5780, 5783, 5784, 5785, 5786, 5787, 5791, 5794, 5806, 5808, 5810, 5813, 5820, 5826, 5831, 5833, 5834, 5835, 5836, 5837, 5846, 5852, 5854, 5856, 5857, 5859, 5861, 5863, 5864, 5865, 5866, 5868, 5869, 5872, 5875, 5878, 5880, 5881, 5883, 5886, 5888, 5889, 5891, 5892, 5893, 5905, 5907, 5912, 5925, 5926, 5927, 5931, 5932, 5934, 5936, 5938, 5941, 5944, 5951, 5954, 5956, 5957, 5959, 5961, 5967, 5968, 5971, 5975, 5978, 5979, 5982, 5984, 5988, 5991, 5992, 5994, 5996, 5997, 6000, 6002, 6006, 6008, 6013, 6016, 6017, 6018, 6020, 6023, 6024, 6025, 6026, 6028, 6031, 6033, 6038, 6041, 6044, 6045, 6048, 6051, 6054, 6058, 6059, 6062, 6063, 6069, 6072, 6073, 6074, 6075, 6080, 6081, 6082, 6084, 6085, 6087, 6088, 6089, 6090, 6092, 6093, 6096, 6098, 6099, 6107, 6108, 6109, 6110, 6116, 6118, 6124, 6129, 6131, 6132, 6135, 6138, 6139, 6143, 6145, 6146, 6148, 6149, 6151, 6153, 6155, 6158, 6160, 6162, 6163, 6164, 6165, 6180, 6181, 6182, 6183, 6186, 6188, 6189, 6194, 6195, 6196, 6197, 6198, 6203, 6204, 6205, 6209, 6212, 6220, 6221, 6223, 6224, 6226, 6227, 6230, 6231, 6234, 6237, 6243, 6246, 6247, 6250, 6251, 6255, 6264, 6265, 6267, 6270, 6272, 6273, 6275, 6280, 6281, 6282, 6286, 6288, 6289, 6292, 6294, 6295, 6296, 6299, 6300, 6303, 6307, 6309, 6310, 6311, 6315, 6317, 6322, 6323, 6325, 6328, 6333, 6338, 6342, 6343, 6344, 6349, 6353, 6354, 6356, 6358, 6360, 6363, 6365, 6368, 6370, 6372, 6375, 6387, 6394, 6397, 6398, 6399, 6403, 6405, 6408, 6412, 6414, 6415, 6419, 6425, 6426, 6428, 6429, 6430, 6431, 6436, 6440, 6442, 6448, 6449, 6450, 6456, 6457, 6458, 6463, 6464, 6466, 6467, 6469, 6470, 6474, 6475, 6476, 6477, 6478, 6480, 6482, 6484, 6485, 6486, 6494, 6495, 6501, 6502, 6504, 6510, 6514, 6516, 6519, 6523, 6530, 6531, 6532, 6534, 6539, 6541, 6547, 6549, 6552, 6553, 6558, 6564, 6567, 6571, 6572, 6574, 6576, 6577, 6579, 6581, 6584, 6588, 6589, 6592, 6594, 6595, 6596, 6597, 6599, 6600, 6603, 6605, 6606, 6607, 6610, 6614, 6615, 6616, 6620, 6623, 6629, 6633, 6634, 6635, 6638, 6639, 6644, 6646, 6647, 6648, 6649, 6652, 6654, 6655, 6656, 6658, 6661, 6666, 6672, 6681, 6696, 6701, 6703, 6705, 6706, 6711, 6717, 6718, 6720, 6723, 6729, 6730, 6733, 6734, 6736, 6742, 6747, 6749, 6753, 6756, 6757, 6758, 6759, 6764, 6766, 6767, 6779, 6782, 6783, 6786, 6788, 6789, 6792, 6793, 6794, 6795, 6797, 6798, 6799, 6801, 6803, 6804, 6805, 6806, 6811, 6813, 6815, 6816, 6817, 6819, 6820, 6824, 6827, 6830, 6834, 6836, 6840, 6841, 6847, 6848, 6851, 6855, 6863, 6867, 6875, 6876, 6877, 6878, 6880, 6881, 6886, 6888, 6895, 6902, 6903, 6906, 6907, 6909, 6917, 6919, 6921, 6924, 6925, 6930, 6931, 6935, 6939, 6940, 6946, 6954, 6955, 6959, 6960, 6963, 6970, 6971, 6979, 6984, 6985, 6987, 6988, 6990, 6991, 6994, 6997, 6999, 7009, 7010, 7013, 7017, 7018, 7019, 7020, 7022, 7025, 7027, 7029, 7038, 7039, 7040, 7043, 7045, 7048, 7051, 7052, 7053, 7054, 7057, 7059, 7064, 7067, 7068, 7073, 7077, 7079, 7083, 7084, 7085, 7094, 7097, 7105, 7106, 7107, 7108, 7110, 7117, 7118, 7126, 7130, 7136, 7138, 7139, 7140, 7142, 7143, 7144, 7150, 7151, 7154, 7163, 7164, 7165, 7166, 7169, 7170, 7171, 7172, 7182, 7184, 7187, 7192, 7194, 7195, 7196, 7197, 7198, 7201, 7202, 7206, 7208, 7209, 7210, 7212, 7214, 7215, 7217, 7219, 7220, 7227, 7228, 7235, 7236, 7240, 7246, 7249, 7250, 7252, 7255, 7257, 7258, 7262, 7263, 7264, 7268, 7270, 7274, 7281, 7282, 7287, 7291, 7293, 7296, 7298, 7299, 7300, 7301, 7303, 7304, 7305, 7306, 7307, 7308, 7311, 7312, 7313, 7315, 7318, 7320, 7321, 7328, 7338, 7345, 7353, 7355, 7357, 7358, 7361, 7363, 7365, 7369, 7371, 7373, 7376, 7377, 7380, 7383, 7392, 7395, 7396, 7398, 7399, 7400, 7409, 7418, 7425, 7428, 7430, 7434, 7435, 7436, 7438, 7447, 7448, 7450, 7453, 7454, 7457, 7458, 7459, 7466, 7470, 7472, 7475, 7481, 7483, 7484, 7485, 7486, 7492, 7499, 7502, 7506, 7512, 7515, 7517, 7521, 7523, 7524, 7528, 7533, 7538, 7541, 7546, 7549, 7556, 7557, 7572, 7574, 7576, 7579, 7583, 7585, 7586, 7587, 7589, 7590, 7596, 7597, 7598, 7604, 7609, 7611, 7612, 7614, 7619, 7624, 7633, 7638, 7642, 7643, 7647, 7649, 7655, 7656, 7658, 7661, 7662, 7664, 7665, 7673, 7674, 7682, 7685, 7689, 7691, 7692, 7695, 7697, 7699, 7700, 7702, 7703, 7712, 7715, 7716, 7724, 7734, 7736, 7737, 7738, 7741, 7742, 7744, 7745, 7750, 7753, 7754, 7763, 7764, 7767, 7770, 7774, 7775, 7779, 7780, 7781, 7785, 7786, 7788, 7791, 7793, 7798, 7799, 7800, 7803, 7804, 7806, 7807, 7815, 7818, 7819, 7820, 7825, 7826, 7833, 7834, 7840, 7841, 7844, 7845, 7850, 7865, 7873, 7877, 7878, 7879, 7880, 7885, 7887, 7888, 7890, 7893, 7896, 7901, 7908, 7910, 7911, 7913, 7918, 7923, 7925, 7928, 7933, 7934, 7935, 7938, 7942, 7944, 7949, 7950, 7952, 7965, 7966, 7967, 7971, 7973, 7974, 7976, 7977, 7981, 7982, 7984, 7986, 7988, 7993, 7994, 7996, 7999, 8000, 8006, 8007, 8012, 8020, 8021, 8023, 8024, 8025, 8031, 8036, 8041, 8042, 8044, 8045, 8047, 8048, 8049, 8052, 8056, 8059, 8063, 8066, 8068, 8074, 8076, 8077, 8078, 8080, 8081, 8083, 8088, 8095, 8099, 8100, 8102, 8105, 8106, 8109, 8110, 8112, 8113, 8120, 8126, 8129, 8130, 8137, 8141, 8145, 8146, 8148, 8151, 8155, 8163, 8164, 8166, 8170, 8178, 8179, 8181, 8182, 8189, 8191, 8193, 8194, 8196, 8198, 8202, 8204, 8208, 8213, 8216, 8217, 8219, 8220, 8222, 8234, 8236, 8237, 8239, 8241, 8242, 8248, 8249, 8250, 8252, 8253, 8264, 8265, 8268, 8269, 8274, 8275, 8289, 8291, 8296, 8297, 8300, 8304, 8305, 8308, 8310, 8311, 8315, 8318, 8319, 8322, 8326, 8329, 8334, 8335, 8339, 8340, 8341, 8347, 8349, 8350, 8351, 8352, 8353, 8358, 8367, 8368, 8371, 8373, 8378, 8379, 8380, 8385, 8387, 8389, 8392, 8393, 8395, 8396, 8401, 8404, 8406, 8408, 8410, 8413, 8414, 8415, 8416, 8417, 8418, 8428, 8430, 8433, 8435, 8436, 8438, 8439, 8442, 8443, 8444, 8445, 8446, 8447, 8448, 8449, 8450, 8451, 8457, 8458, 8459, 8465, 8470, 8472, 8473, 8474, 8476, 8477, 8478, 8480, 8481, 8482, 8483, 8490, 8498, 8501, 8502, 8503, 8505, 8509, 8513, 8515, 8520, 8521, 8523, 8524, 8525, 8526, 8531, 8532, 8533, 8541, 8542, 8543, 8549, 8550, 8553, 8554, 8557, 8561, 8565, 8574, 8576, 8581, 8582, 8583, 8588, 8592, 8593, 8594, 8596, 8597, 8598, 8600, 8602, 8603, 8605, 8611, 8612, 8622, 8631, 8634, 8635, 8638, 8641, 8642, 8644, 8646, 8648, 8652, 8654, 8657, 8658, 8659, 8663, 8665, 8669, 8672, 8676, 8677, 8685, 8686, 8693, 8699, 8700, 8703, 8705, 8706, 8708, 8709, 8712, 8713, 8714, 8715, 8717, 8722, 8726, 8731, 8732, 8736, 8741, 8744, 8746, 8747, 8748, 8755, 8757, 8761, 8769, 8771, 8773, 8774, 8777, 8779, 8782, 8783, 8784, 8786, 8789, 8795, 8797, 8802, 8803, 8804, 8808, 8810, 8817, 8818, 8821, 8822, 8824, 8828, 8831, 8833, 8834, 8835, 8838, 8841, 8842, 8843, 8844, 8850, 8853, 8865, 8866, 8874, 8876, 8877, 8878, 8881, 8883, 8888, 8889, 8891, 8892, 8896, 8897, 8900, 8901, 8907, 8908, 8911, 8913, 8916, 8917, 8918, 8919, 8922, 8924, 8926, 8928, 8929, 8937, 8938, 8941, 8945, 8946, 8948, 8949, 8951, 8953, 8960, 8961, 8967, 8968, 8979, 8980, 8981, 8985, 8986, 8991, 8992, 8993, 8996, 8998, 9001, 9003, 9006, 9009, 9011, 9012, 9016, 9018, 9020, 9021, 9022, 9025, 9026, 9027, 9029, 9030, 9033, 9045, 9050, 9052, 9057, 9058, 9059, 9060, 9061, 9063, 9065, 9066, 9068, 9069, 9071, 9072, 9075, 9076, 9078, 9083, 9084, 9086, 9087, 9088, 9091, 9092, 9095, 9096, 9097, 9098, 9104, 9105, 9106, 9107, 9114, 9115, 9116, 9118, 9119, 9120, 9123, 9125, 9129, 9131, 9133, 9134, 9138, 9139, 9140, 9141, 9142, 9143, 9144, 9145, 9151, 9152, 9154, 9159, 9167, 9168, 9172, 9175, 9177, 9180, 9183, 9185, 9186, 9188, 9189, 9195, 9200, 9205, 9206, 9207, 9210, 9211, 9213, 9214, 9215, 9216, 9218, 9220, 9223, 9226, 9229, 9233, 9237, 9240, 9243, 9248, 9249, 9253, 9257, 9259, 9267, 9269, 9270, 9273, 9275, 9282, 9284, 9285, 9288, 9290, 9291, 9292, 9296, 9300, 9304, 9306, 9308, 9310, 9311, 9314, 9320, 9321, 9323, 9326, 9327, 9328, 9333, 9336, 9337, 9338, 9339, 9341, 9346, 9347, 9348, 9350, 9352, 9355, 9359, 9360, 9366, 9368, 9371, 9375, 9376, 9382, 9389, 9391, 9392, 9394, 9400, 9402, 9403, 9406, 9407, 9412, 9413, 9414, 9415, 9419, 9421, 9423, 9426, 9429, 9439, 9440, 9443, 9449, 9451, 9452, 9453, 9456, 9460, 9467, 9468, 9471, 9477, 9481, 9484, 9488, 9490, 9497, 9500, 9503, 9504, 9509, 9514, 9517, 9518, 9519, 9520, 9521, 9522, 9534, 9535, 9536, 9537, 9538, 9540, 9545, 9546, 9548, 9550, 9551, 9553, 9555, 9560, 9564, 9565, 9567, 9568, 9571, 9575, 9577, 9587, 9590, 9591, 9592, 9596, 9601, 9602, 9606, 9608, 9609, 9615, 9617, 9620, 9621, 9623, 9624, 9626, 9629, 9633, 9638, 9648, 9652, 9655, 9656, 9657, 9658, 9659, 9663, 9668, 9670, 9682, 9686, 9692, 9695, 9696, 9698, 9706, 9708, 9710, 9711, 9715, 9717, 9718, 9723, 9726, 9727, 9729, 9731, 9732, 9733, 9734, 9737, 9738, 9742, 9743, 9744, 9745, 9746, 9749, 9750, 9751, 9754, 9761, 9763, 9768, 9770, 9772, 9774, 9776, 9777, 9782, 9786, 9791, 9794, 9798, 9799, 9804, 9809, 9810, 9811, 9812, 9813, 9816, 9819, 9820, 9827, 9828, 9829, 9833, 9835, 9836, 9845, 9846, 9847, 9856, 9861, 9866, 9869, 9873, 9875, 9878, 9879, 9882, 9886, 9887, 9889, 9892, 9894, 9896, 9897, 9898, 9900, 9907, 9909, 9910, 9911, 9921, 9923, 9928, 9930, 9931, 9934, 9935, 9936, 9940, 9944, 9946, 9950, 9952, 9953, 9962, 9967, 9968, 9969, 9972, 9973, 9974, 9975, 9980, 9981, 9982, 9984, 9985, 9988, 9990, 9992, 9997, 10000, 10009, 10010, 10012, 10013, 10017, 10018, 10019, 10022, 10026, 10027, 10033, 10037, 10041, 10047, 10049, 10050, 10051, 10054, 10055, 10058, 10059, 10060, 10062, 10063, 10064, 10075, 10076, 10077, 10078, 10080, 10081, 10083, 10087, 10090, 10091, 10092, 10095, 10097, 10098, 10103, 10106, 10110, 10114, 10115, 10116, 10120, 10122, 10125, 10128, 10129, 10131, 10135, 10136, 10137, 10143, 10151, 10158, 10160, 10163, 10165, 10166, 10168, 10169, 10174, 10176, 10178, 10181, 10192, 10193, 10194, 10196, 10199, 10206, 10207, 10214, 10217, 10218, 10219, 10220, 10221, 10222, 10223, 10224, 10225, 10228, 10230, 10231, 10233, 10236, 10237, 10252, 10253, 10255, 10258, 10259, 10260, 10266, 10269, 10275, 10276, 10278, 10284, 10286, 10292, 10293, 10295, 10300, 10302, 10306, 10307, 10311, 10312, 10314, 10315, 10318, 10323, 10325, 10326, 10331, 10333, 10334, 10335, 10336, 10340, 10341, 10345, 10346, 10353, 10356, 10357, 10361, 10362, 10364, 10371, 10373, 10375, 10376, 10380, 10381, 10384, 10392, 10397, 10398, 10399, 10401, 10402, 10408, 10413, 10414, 10416, 10417, 10419, 10423, 10425, 10426, 10435, 10436, 10438, 10446, 10447, 10449, 10450, 10451, 10452, 10453, 10456, 10460, 10463, 10464, 10465, 10468, 10469, 10471, 10472, 10473, 10474, 10480, 10487, 10488, 10494, 10495, 10496, 10498, 10504, 10508, 10514, 10518, 10522, 10523, 10527, 10528, 10530, 10531, 10532, 10536, 10537, 10540, 10541, 10542, 10543, 10544, 10548, 10549, 10550, 10551, 10555, 10556, 10560, 10563, 10564, 10567, 10571, 10581, 10582, 10583, 10584, 10588, 10593, 10595, 10596, 10597, 10599, 10601, 10605, 10611, 10615, 10616, 10617, 10621, 10622, 10626, 10636, 10640, 10643, 10645, 10646, 10650, 10651, 10652, 10657, 10665, 10668, 10669, 10671, 10676, 10678, 10679, 10682, 10683, 10684, 10685, 10686, 10689, 10694, 10700, 10701, 10705, 10707, 10711, 10721, 10722, 10724, 10726, 10729, 10734, 10736, 10738, 10740, 10741, 10744, 10747, 10752, 10753, 10754, 10756, 10757, 10762, 10763, 10768, 10770, 10772, 10774, 10775, 10778, 10779, 10780, 10785, 10787, 10788, 10795, 10801, 10802, 10803, 10804, 10809, 10810, 10811, 10822, 10823, 10824, 10827, 10831, 10833, 10836, 10837, 10838, 10841, 10843, 10850, 10851, 10853, 10854, 10856, 10857, 10858, 10860, 10863, 10864, 10867, 10870, 10874, 10877, 10878, 10886, 10887, 10897, 10899, 10901, 10902, 10911, 10918, 10920, 10924, 10926, 10927, 10928, 10929, 10930, 10933, 10934, 10938, 10940, 10947, 10966, 10967, 10972, 10974, 10976, 10977, 10979, 10988, 10993, 10996, 10999, 11002, 11008, 11015, 11021, 11022, 11023, 11024, 11030, 11032, 11036, 11037, 11040, 11046, 11047, 11053, 11058, 11066, 11078, 11082, 11083, 11090, 11095, 11100, 11107, 11109, 11111, 11114, 11116, 11117, 11118, 11119, 11122, 11123, 11124, 11126, 11128, 11129, 11133, 11136, 11137, 11138, 11147, 11149, 11150, 11151, 11152, 11153, 11154, 11160, 11163, 11172, 11177, 11178, 11179, 11180, 11181, 11184, 11187, 11188, 11190, 11191, 11192, 11193, 11194, 11198, 11199, 11204, 11214, 11217, 11218, 11222, 11228, 11229, 11230, 11233, 11236, 11237, 11238, 11239, 11242, 11243, 11246, 11247, 11251, 11253, 11254, 11255, 11256, 11258, 11260, 11263, 11266, 11274, 11278, 11282, 11290, 11291, 11292, 11293, 11294, 11298, 11304, 11313, 11315, 11316, 11318, 11328, 11329, 11330, 11331, 11332, 11337, 11339, 11340, 11345, 11346, 11348, 11349, 11352, 11358, 11359, 11362, 11363, 11364, 11365, 11366, 11369, 11371, 11373, 11380, 11382, 11385, 11387, 11391, 11394, 11395, 11398, 11401, 11404, 11405, 11406, 11408, 11417, 11424, 11430, 11431, 11435, 11438, 11439, 11440, 11443, 11446, 11447, 11448, 11449, 11451, 11459, 11465, 11466, 11472, 11478, 11481, 11487, 11488, 11489, 11490, 11492, 11496, 11498, 11500, 11501, 11505, 11506, 11507, 11508, 11520, 11521, 11523, 11524, 11526, 11527, 11533, 11534, 11538, 11540, 11544, 11546, 11548, 11550, 11551, 11553, 11558, 11560, 11561, 11567, 11568, 11570, 11571, 11576, 11577, 11578, 11585, 11586, 11588, 11593, 11594, 11595, 11596, 11597, 11599, 11603, 11604, 11605, 11606, 11607, 11610, 11611, 11615, 11617, 11618, 11619, 11621, 11623, 11625, 11628, 11634, 11636, 11638, 11647, 11649, 11650, 11655, 11656, 11658, 11659, 11663, 11668, 11669, 11678, 11681, 11682, 11688, 11691, 11692, 11694, 11695, 11696, 11698, 11699, 11701, 11703, 11705, 11707, 11712, 11718, 11720, 11721, 11725, 11730, 11731, 11733, 11736, 11737, 11743, 11744, 11748, 11753, 11759, 11760, 11761, 11762, 11765, 11771, 11776, 11777, 11781, 11782, 11783, 11785, 11786, 11792, 11794, 11797, 11799, 11800, 11804, 11805, 11809, 11811, 11818, 11820, 11826, 11829, 11830, 11836, 11837, 11839, 11840, 11842, 11846, 11847, 11848, 11854, 11856, 11858, 11861, 11863, 11864, 11865, 11868, 11872, 11876, 11877, 11878, 11881, 11886, 11887, 11889, 11891, 11892, 11894, 11895, 11897, 11898, 11901, 11902, 11906, 11909, 11911, 11913, 11914, 11915, 11916, 11917, 11918, 11919, 11920, 11921, 11922, 11923, 11926, 11927, 11928, 11929, 11930, 11933, 11934, 11940, 11943, 11945, 11947, 11949, 11950, 11953, 11956, 11958, 11959, 11960, 11961, 11962, 11963, 11965, 11974, 11975, 11976, 11977, 11978, 11979, 11980, 11983, 11987, 11988, 11989, 11993, 11997, 11998, 11999, 12004, 12008, 12014, 12015, 12016, 12017, 12018, 12019, 12020, 12021, 12023, 12024, 12026, 12027, 12032, 12033, 12038, 12042, 12043, 12044, 12052, 12059, 12083, 12092, 12093, 12098, 12102, 12104, 12106, 12108, 12109, 12110, 12114, 12115, 12117, 12118, 12122, 12127, 12128, 12129, 12134, 12137, 12138, 12139, 12143, 12147, 12148, 12149, 12151, 12161, 12163, 12165, 12166, 12170, 12171, 12174, 12175, 12176, 12181, 12183, 12185, 12197, 12200, 12201, 12204, 12207, 12208, 12215, 12217, 12219, 12220, 12223, 12227, 12228, 12234, 12241, 12245, 12249, 12250, 12252, 12253, 12256, 12259, 12260, 12263, 12267, 12268, 12269, 12274, 12278, 12280, 12281, 12283, 12284, 12286, 12287, 12292, 12293, 12297, 12304, 12311, 12313, 12314, 12317, 12321, 12323, 12324, 12326, 12329, 12331, 12333, 12334, 12337, 12340, 12343, 12344, 12345, 12347, 12354, 12356, 12359, 12364, 12368, 12369, 12370, 12372, 12373, 12374, 12376, 12379, 12380, 12381, 12383, 12391, 12397, 12399, 12400, 12403, 12404, 12405, 12406, 12410, 12411, 12414, 12416, 12418, 12419, 12420, 12421, 12424, 12425, 12426, 12427, 12428, 12429, 12437, 12439, 12440, 12441, 12445, 12447, 12451, 12454, 12455, 12456, 12457, 12459, 12461, 12462, 12465, 12467, 12468, 12472, 12473, 12476, 12478, 12479, 12481, 12482, 12485, 12487, 12488, 12489, 12491, 12494, 12497, 12499, 12503, 12504, 12508, 12514, 12515, 12521, 12523, 12525, 12531, 12536, 12539, 12546, 12547, 12549, 12554, 12555, 12556, 12557, 12559, 12561, 12562, 12563, 12564, 12565, 12567, 12568, 12570, 12572, 12585, 12588, 12590, 12597, 12600, 12605, 12608, 12609, 12611, 12616, 12619, 12622, 12623, 12626, 12628, 12631, 12633, 12634, 12636, 12638, 12639, 12641, 12645, 12649, 12651, 12655, 12658, 12668, 12670, 12671, 12672, 12679, 12680, 12681, 12682, 12683, 12684, 12691, 12693, 12695, 12698, 12699, 12701, 12702, 12707, 12708, 12711, 12713, 12718, 12719, 12722, 12729, 12731, 12732, 12733, 12735, 12737, 12738, 12739, 12740, 12742, 12749, 12751, 12752, 12754, 12758, 12760, 12761, 12764, 12766, 12771, 12783, 12788, 12790, 12797, 12801, 12802, 12805, 12810, 12812, 12813, 12814, 12817, 12819, 12820, 12822, 12824, 12826, 12827, 12828, 12834, 12836, 12838, 12839, 12844, 12849, 12853, 12866, 12869, 12879, 12883, 12884, 12887, 12898, 12900, 12904, 12905, 12906, 12912, 12916, 12917, 12918, 12920, 12921, 12926, 12932, 12933, 12938, 12939, 12942, 12946, 12947, 12950, 12953, 12954, 12961, 12963, 12966, 12968, 12969, 12972, 12973, 12974, 12975, 12976, 12977, 12978, 12982, 12983, 12987, 12989, 12990, 12991, 12994, 13004, 13006, 13007, 13010, 13011, 13017, 13022, 13023, 13024, 13030, 13032, 13035, 13038, 13040, 13044, 13049, 13050, 13053, 13055, 13056, 13060, 13061, 13066, 13069, 13070, 13074, 13077, 13079, 13083, 13085, 13086, 13087, 13095, 13100, 13101, 13102, 13105, 13106, 13109, 13112, 13114, 13115, 13116, 13117, 13118, 13120, 13123, 13124, 13125, 13128, 13131, 13135, 13142, 13151, 13156, 13169, 13175, 13177, 13182, 13189, 13191, 13197, 13199, 13206, 13209, 13210, 13212, 13213, 13215, 13217, 13221, 13222, 13224, 13227, 13230, 13232, 13234, 13235, 13236, 13237, 13238, 13239, 13243, 13249, 13251, 13255, 13258, 13259, 13260, 13261, 13263, 13267, 13268, 13269, 13270, 13273, 13276, 13279, 13280, 13281, 13285, 13293, 13295, 13296, 13298, 13303, 13304, 13313, 13315, 13317, 13319, 13320, 13321, 13323, 13326, 13328, 13330, 13332, 13335, 13338, 13347, 13348, 13349, 13353, 13354, 13358, 13361, 13367, 13368, 13369, 13384, 13393, 13396, 13397, 13401, 13410, 13416, 13417, 13419, 13420, 13423, 13424, 13429, 13431, 13433, 13439, 13440, 13444, 13446, 13449, 13451, 13454, 13456, 13460, 13463, 13466, 13468, 13469, 13473, 13475, 13494, 13496, 13499, 13500, 13501, 13503, 13504, 13506, 13510, 13513, 13514, 13515, 13516, 13517, 13519, 13520, 13521, 13522, 13529, 13530, 13532, 13535, 13536, 13540, 13543, 13544, 13546, 13547, 13549, 13552, 13556, 13565, 13566, 13568, 13569, 13574, 13579, 13580, 13583, 13584, 13587, 13589, 13597, 13598, 13599, 13601, 13602, 13603, 13621, 13623, 13627, 13628, 13631, 13632, 13634, 13636, 13637, 13638, 13641, 13643, 13647, 13650, 13652, 13654, 13660, 13661, 13662, 13663, 13669, 13671, 13675, 13677, 13678, 13683, 13684, 13686, 13688, 13689, 13693, 13698, 13700, 13703, 13706, 13710, 13712, 13713, 13715, 13716, 13720, 13721, 13725, 13727, 13728, 13729, 13730, 13737, 13738, 13739, 13742, 13745, 13747, 13750, 13751, 13753, 13756, 13764, 13766, 13767, 13769, 13773, 13775, 13776, 13781, 13783, 13785, 13786, 13787, 13789, 13791, 13794, 13795, 13796, 13798, 13802, 13809, 13816, 13817, 13818, 13819, 13820, 13822, 13823, 13824, 13827, 13830, 13831, 13833, 13834, 13835, 13843, 13859, 13860, 13862, 13866, 13869, 13870, 13872, 13873, 13874, 13877, 13881, 13883, 13886, 13888, 13891, 13892, 13894, 13896, 13897, 13898, 13901, 13904, 13906, 13908, 13909, 13910, 13911, 13917, 13919, 13923, 13925, 13927, 13930, 13933, 13938, 13944, 13947, 13948, 13952, 13953, 13956, 13961, 13963, 13965, 13969, 13970, 13975, 13976, 13980, 13983, 13984, 13988, 13990, 13991, 13994, 13999, 14000, 14003, 14013, 14014, 14016, 14017, 14018, 14022, 14027, 14030, 14031, 14036, 14040, 14041, 14043, 14049, 14050, 14051, 14052, 14054, 14059, 14062, 14063, 14066, 14069, 14070, 14071, 14073, 14075, 14082, 14084, 14086, 14088, 14092, 14093, 14094, 14102, 14105, 14106, 14110, 14111, 14115, 14116, 14118, 14122, 14128, 14129, 14132, 14134, 14138, 14139, 14142, 14143, 14145, 14146, 14148, 14149, 14150.

Promoters expressing in ear tissue at the tasseling stage include SEQ IDs: 1, 3, 4, 7, 9, 11, 15, 27, 29, 31, 34, 36, 38, 45, 48, 54, 63, 64, 65, 68, 81, 82, 88, 96, 97, 99, 102, 103, 107, 110, 111, 112, 121, 130, 131, 132, 134, 139, 140, 143, 147, 148, 152, 156, 157, 159, 162, 164, 165, 175, 176, 181, 183, 187, 191, 194, 195, 196, 197, 199, 202, 203, 204, 205, 207, 210, 211, 212, 215, 217, 223, 231, 232, 233, 235, 236, 237, 240, 243, 244, 246, 248, 249, 250, 251, 257, 259, 262, 264, 271, 273, 280, 286, 288, 289, 291, 294, 301, 302, 303, 305, 306, 309, 314, 316, 319, 320, 322, 323, 328, 329, 332, 335, 339, 341, 346, 349, 352, 353, 354, 356, 357, 358, 360, 364, 367, 371, 373, 374, 378, 379, 380, 387, 388, 396, 401, 405, 406, 407, 412, 419, 420, 423, 424, 428, 429, 433, 434, 452, 456, 460, 461, 466, 468, 471, 474, 478, 479, 481, 483, 485, 488, 493, 496, 498, 504, 507, 509, 510, 512, 513, 514, 515, 516, 517, 520, 522, 523, 525, 529, 531, 532, 533, 536, 537, 538, 539, 541, 542, 543, 544, 546, 547, 548, 554, 557, 564, 565, 574, 576, 580, 585, 591, 594, 595, 596, 598, 599, 601, 602, 604, 605, 607, 611, 613, 614, 623, 630, 631, 633, 635, 638, 644, 650, 656, 662, 663, 666, 670, 674, 676, 677, 681, 686, 693, 694, 701, 705, 707, 708, 716, 717, 719, 722, 723, 724, 727, 731, 734, 735, 736, 742, 744, 749, 753, 759, 760, 761, 762, 765, 768, 770, 771, 782, 783, 784, 793, 795, 800, 801, 804, 806, 808, 812, 813, 820, 822, 824, 825, 826, 829, 830, 833, 836, 840, 842, 844, 849, 855, 857, 859, 860, 862, 863, 865, 868, 869, 872, 873, 877, 883, 884, 885, 887, 890, 891, 892, 893, 895, 897, 898, 901, 903, 907, 908, 911, 912, 913, 915, 916, 917, 919, 920, 924, 928, 929, 931, 936, 940, 943, 944, 951, 953, 954, 957, 958, 961, 964, 966, 971, 974, 977, 979, 980, 981, 982, 983, 987, 989, 991, 993, 994, 995, 997, 999, 1003, 1006, 1007, 1009, 1011, 1014, 1015, 1017, 1026, 1028, 1032, 1035, 1038, 1041, 1042, 1043, 1044, 1047, 1049, 1050, 1051, 1052, 1054, 1055, 1056, 1057, 1062, 1065, 1069, 1072, 1073, 1076, 1077, 1078, 1086, 1087, 1088, 1089, 1092, 1095, 1101, 1103, 1104, 1108, 1110, 1111, 1112, 1114, 1115, 1117, 1118, 1119, 1120, 1122, 1125, 1127, 1130, 1132, 1133, 1136, 1137, 1143, 1146, 1147, 1148, 1154, 1160, 1162, 1168, 1169, 1170, 1176, 1178, 1182, 1183, 1189, 1191, 1196, 1198, 1199, 1200, 1204, 1205, 1214, 1217, 1218, 1219, 1220, 1223, 1225, 1228, 1230, 1231, 1233, 1236, 1239, 1240, 1241, 1248, 1249, 1250, 1252, 1253, 1254, 1256, 1257, 1258, 1261, 1263, 1264, 1265, 1272, 1277, 1281, 1282, 1283, 1285, 1286, 1293, 1305, 1306, 1309, 1312, 1316, 1317, 1320, 1321, 1325, 1327, 1330, 1331, 1334, 1339, 1347, 1349, 1351, 1360, 1364, 1368, 1371, 1372, 1373, 1376, 1377, 1380, 1381, 1382, 1387, 1388, 1393, 1396, 1397, 1398, 1403, 1404, 1405, 1407, 1409, 1410, 1412, 1415, 1420, 1421, 1423, 1426, 1431, 1435, 1436, 1438, 1439, 1440, 1441, 1442, 1447, 1448, 1451, 1453, 1454, 1455, 1459, 1462, 1466, 1471, 1475, 1485, 1486, 1488, 1490, 1493, 1498, 1499, 1503, 1504, 1508, 1510, 1511, 1513, 1514, 1518, 1519, 1525, 1526, 1527, 1530, 1539, 1543, 1545, 1546, 1549, 1550, 1555, 1556, 1560, 1563, 1566, 1567, 1568, 1571, 1575, 1576, 1578, 1584, 1586, 1590, 1592, 1593, 1594, 1595, 1599, 1600, 1602, 1604, 1605, 1608, 1609, 1612, 1614, 1615, 1616, 1618, 1622, 1625, 1630, 1634, 1635, 1637, 1638, 1639, 1641, 1648, 1650, 1654, 1658, 1659, 1662, 1668, 1669, 1671, 1673, 1675, 1676, 1677, 1678, 1680, 1683, 1685, 1688, 1689, 1691, 1696, 1699, 1705, 1706, 1707, 1708, 1709, 1710, 1714, 1717, 1719, 1721, 1723, 1725, 1729, 1731, 1732, 1735, 1740, 1755, 1758, 1759, 1761, 1762, 1764, 1776, 1778, 1779, 1785, 1791, 1793, 1807, 1813, 1815, 1816, 1820, 1826, 1830, 1832, 1834, 1835, 1839, 1840, 1845, 1849, 1850, 1852, 1858, 1859, 1861, 1865, 1867, 1869, 1870, 1872, 1873, 1879, 1882, 1883, 1886, 1888, 1891, 1894, 1895, 1897, 1898, 1899, 1900, 1901, 1902, 1903, 1904, 1905, 1906, 1911, 1914, 1915, 1918, 1920, 1922, 1923, 1924, 1933, 1934, 1936, 1940, 1944, 1945, 1950, 1952, 1953, 1955, 1973, 1974, 1981, 1986, 1991, 1993, 1994, 1995, 1996, 1999, 2000, 2007, 2008, 2009, 2010, 2012, 2013, 2015, 2016, 2017, 2026, 2031, 2032, 2039, 2041, 2043, 2045, 2048, 2054, 2060, 2062, 2064, 2066, 2069, 2072, 2074, 2077, 2079, 2081, 2082, 2083, 2088, 2089, 2093, 2094, 2096, 2097, 2099, 2101, 2103, 2104, 2112, 2114, 2116, 2117, 2119, 2125, 2132, 2133, 2134, 2140, 2142, 2143, 2144, 2147, 2150, 2152, 2154, 2155, 2156, 2157, 2159, 2161, 2164, 2165, 2166, 2167, 2170, 2173, 2177, 2178, 2179, 2185, 2193, 2196, 2202, 2203, 2213, 2215, 2216, 2218, 2221, 2222, 2226, 2227, 2229, 2230, 2231, 2235, 2240, 2243, 2244, 2247, 2252, 2253, 2257, 2260, 2262, 2263, 2273, 2274, 2278, 2280, 2282, 2283, 2288, 2291, 2293, 2295, 2296, 2297, 2298, 2303, 2304, 2305, 2306, 2308, 2309, 2314, 2322, 2323, 2328, 2329, 2331, 2333, 2339, 2345, 2348, 2349, 2351, 2352, 2353, 2361, 2362, 2363, 2366, 2367, 2371, 2379, 2381, 2382, 2383, 2384, 2385, 2396, 2398, 2401, 2402, 2403, 2405, 2406, 2410, 2411, 2412, 2413, 2418, 2419, 2420, 2422, 2423, 2430, 2431, 2435, 2437, 2438, 2440, 2443, 2445, 2450, 2451, 2452, 2453, 2454, 2457, 2458, 2470, 2471, 2472, 2474, 2476, 2479, 2481, 2482, 2483, 2485, 2490, 2492, 2494, 2495, 2496, 2498, 2500, 2505, 2506, 2509, 2510, 2511, 2514, 2515, 2517, 2519, 2525, 2528, 2529, 2531, 2532, 2533, 2536, 2537, 2538, 2539, 2541, 2542, 2547, 2548, 2549, 2551, 2552, 2555, 2556, 2557, 2567, 2568, 2573, 2576, 2577, 2581, 2583, 2588, 2589, 2590, 2594, 2596, 2599, 2601, 2605, 2609, 2617, 2622, 2626, 2627, 2632, 2634, 2637, 2639, 2641, 2644, 2652, 2653, 2655, 2661, 2662, 2663, 2671, 2674, 2675, 2684, 2685, 2687, 2689, 2691, 2692, 2696, 2700, 2702, 2707, 2712, 2715, 2718, 2719, 2723, 2725, 2726, 2728, 2729, 2730, 2735, 2740, 2742, 2746, 2747, 2749, 2752, 2755, 2756, 2757, 2763, 2764, 2770, 2775, 2780, 2782, 2784, 2787, 2788, 2791, 2798, 2800, 2801, 2802, 2805, 2808, 2812, 2820, 2821, 2822, 2823, 2824, 2826, 2827, 2828, 2829, 2831, 2832, 2840, 2844, 2850, 2856, 2857, 2858, 2861, 2862, 2865, 2871, 2873, 2876, 2878, 2888, 2889, 2890, 2894, 2898, 2901, 2902, 2903, 2905, 2906, 2908, 2909, 2910, 2911, 2912, 2915, 2916, 2917, 2919, 2923, 2926, 2930, 2931, 2932, 2933, 2934, 2935, 2942, 2944, 2945, 2946, 2948, 2950, 2953, 2955, 2959, 2963, 2966, 2968, 2976, 2979, 2980, 2985, 2994, 2998, 3000, 3002, 3003, 3007, 3008, 3015, 3016, 3019, 3038, 3039, 3042, 3044, 3045, 3048, 3049, 3051, 3052, 3053, 3055, 3058, 3059, 3062, 3064, 3067, 3070, 3072, 3075, 3080, 3081, 3083, 3084, 3085, 3087, 3088, 3090, 3094, 3095, 3096, 3097, 3100, 3102, 3105, 3106, 3109, 3114, 3118, 3119, 3120, 3121, 3123, 3126, 3127, 3128, 3129, 3137, 3139, 3140, 3143, 3145, 3147, 3148, 3149, 3153, 3156, 3167, 3170, 3177, 3181, 3185, 3188, 3189, 3191, 3192, 3194, 3200, 3202, 3205, 3206, 3210, 3212, 3219, 3220, 3224, 3225, 3226, 3228, 3232, 3236, 3237, 3239, 3240, 3246, 3250, 3252, 3255, 3256, 3258, 3261, 3263, 3266, 3268, 3271, 3272, 3273, 3278, 3280, 3286, 3289, 3290, 3291, 3294, 3295, 3296, 3297, 3299, 3301, 3303, 3312, 3331, 3332, 3333, 3337, 3340, 3343, 3345, 3347, 3349, 3351, 3353, 3355, 3356, 3358, 3359, 3360, 3361, 3363, 3370, 3373, 3374, 3376, 3377, 3379, 3380, 3383, 3386, 3397, 3399, 3404, 3405, 3414, 3415, 3416, 3418, 3419, 3422, 3424, 3426, 3427, 3428, 3435, 3438, 3440, 3441, 3442, 3445, 3446, 3447, 3450, 3452, 3454, 3455, 3458, 3460, 3461, 3464, 3465, 3466, 3468, 3470, 3471, 3474, 3475, 3477, 3482, 3483, 3486, 3487, 3488, 3490, 3494, 3496, 3499, 3500, 3503, 3504, 3506, 3510, 3511, 3516, 3517, 3518, 3531, 3533, 3536, 3537, 3541, 3544, 3545, 3548, 3549, 3552, 3554, 3558, 3560, 3562, 3563, 3569, 3574, 3582, 3587, 3588, 3589, 3590, 3592, 3593, 3595, 3597, 3600, 3603, 3604, 3606, 3607, 3611, 3613, 3616, 3618, 3620, 3621, 3623, 3624, 3626, 3627, 3628, 3629, 3630, 3631, 3633, 3637, 3640, 3642, 3643, 3644, 3645, 3646, 3647, 3648, 3650, 3653, 3655, 3657, 3659, 3660, 3661, 3663, 3667, 3671, 3672, 3674, 3677, 3682, 3684, 3685, 3693, 3694, 3706, 3707, 3713, 3715, 3717, 3718, 3719, 3720, 3725, 3742, 3748, 3749, 3752, 3754, 3757, 3761, 3764, 3765, 3766, 3772, 3773, 3777, 3778, 3781, 3784, 3785, 3788, 3789, 3790, 3791, 3792, 3794, 3796, 3798, 3806, 3808, 3809, 3812, 3818, 3820, 3823, 3825, 3828, 3830, 3831, 3832, 3833, 3836, 3837, 3842, 3843, 3844, 3845, 3847, 3849, 3858, 3859, 3860, 3862, 3867, 3868, 3870, 3871, 3872, 3873, 3876, 3882, 3883, 3887, 3889, 3890, 3891, 3892, 3893, 3894, 3895, 3902, 3908, 3910, 3911, 3912, 3914, 3917, 3924, 3929, 3933, 3934, 3935, 3938, 3941, 3947, 3950, 3952, 3953, 3954, 3958, 3962, 3967, 3975, 3976, 3977, 3978, 3983, 3985, 3987, 3988, 3995, 3996, 3997, 4000, 4006, 4008, 4013, 4014, 4019, 4020, 4030, 4032, 4033, 4034, 4037, 4039, 4040, 4041, 4042, 4046, 4047, 4048, 4050, 4051, 4052, 4054, 4056, 4057, 4062, 4066, 4067, 4068, 4069, 4072, 4075, 4077, 4078, 4079, 4080, 4081, 4084, 4088, 4092, 4096, 4099, 4102, 4105, 4107, 4109, 4111, 4113, 4115, 4116, 4121, 4122, 4124, 4128, 4133, 4139, 4143, 4146, 4149, 4150, 4154, 4155, 4156, 4158, 4160, 4161, 4162, 4163, 4164, 4165, 4166, 4167, 4168, 4170, 4171, 4175, 4176, 4178, 4184, 4187, 4188, 4189, 4191, 4197, 4198, 4201, 4202, 4205, 4206, 4207, 4208, 4210, 4211, 4212, 4214, 4219, 4221, 4227, 4228, 4233, 4235, 4244, 4246, 4250, 4251, 4257, 4261, 4263, 4266, 4270, 4272, 4279, 4280, 4281, 4283, 4288, 4292, 4294, 4295, 4296, 4298, 4302, 4304, 4305, 4309, 4312, 4319, 4320, 4321, 4324, 4329, 4330, 4331, 4332, 4335, 4336, 4337, 4338, 4341, 4343, 4344, 4347, 4349, 4360, 4365, 4369, 4371, 4373, 4378, 4380, 4383, 4391, 4394, 4397, 4398, 4401, 4402, 4403, 4404, 4405, 4407, 4410, 4415, 4417, 4422, 4423, 4426, 4427, 4431, 4439, 4440, 4442, 4443, 4444, 4446, 4448, 4450, 4453, 4456, 4458, 4460, 4461, 4462, 4463, 4464, 4465, 4468, 4472, 4474, 4475, 4479, 4485, 4491, 4492, 4494, 4502, 4506, 4507, 4512, 4515, 4518, 4519, 4531, 4545, 4548, 4549, 4551, 4552, 4554, 4555, 4556, 4557, 4558, 4559, 4560, 4562, 4563, 4565, 4566, 4568, 4574, 4575, 4580, 4583, 4584, 4586, 4590, 4591, 4601, 4604, 4606, 4611, 4618, 4621, 4625, 4630, 4632, 4633, 4634, 4635, 4641, 4643, 4644, 4650, 4653, 4654, 4655, 4659, 4664, 4666, 4667, 4669, 4670, 4671, 4674, 4676, 4677, 4680, 4682, 4685, 4687, 4692, 4697, 4700, 4702, 4704, 4706, 4708, 4710, 4712, 4714, 4716, 4719, 4721, 4725, 4729, 4730, 4737, 4738, 4740, 4741, 4749, 4750, 4751, 4753, 4754, 4755, 4756, 4759, 4761, 4762, 4763, 4765, 4766, 4771, 4775, 4778, 4779, 4789, 4790, 4791, 4794, 4795, 4804, 4813, 4814, 4818, 4822, 4824, 4828, 4832, 4833, 4834, 4835, 4838, 4842, 4855, 4856, 4857, 4858, 4859, 4861, 4862, 4864, 4868, 4869, 4870, 4872, 4875, 4878, 4880, 4887, 4890, 4891, 4895, 4901, 4902, 4905, 4914, 4915, 4921, 4922, 4923, 4924, 4926, 4930, 4935, 4936, 4938, 4941, 4950, 4958, 4959, 4963, 4965, 4971, 4972, 4973, 4975, 4979, 4980, 4987, 4988, 4993, 4994, 4996, 5000, 5010, 5015, 5022, 5026, 5029, 5030, 5034, 5037, 5038, 5039, 5040, 5042, 5044, 5046, 5052, 5054, 5057, 5059, 5061, 5063, 5067, 5068, 5072, 5075, 5078, 5079, 5082, 5088, 5089, 5090, 5094, 5095, 5100, 5102, 5106, 5111, 5115, 5129, 5131, 5132, 5140, 5143, 5145, 5147, 5151, 5152, 5153, 5157, 5159, 5164, 5165, 5168, 5169, 5170, 5174, 5180, 5181, 5182, 5183, 5184, 5185, 5188, 5189, 5190, 5191, 5192, 5196, 5198, 5199, 5200, 5201, 5202, 5206, 5208, 5212, 5217, 5219, 5225, 5226, 5229, 5234, 5241, 5247, 5249, 5251, 5253, 5255, 5258, 5260, 5261, 5263, 5267, 5268, 5273, 5275, 5276, 5280, 5281, 5282, 5283, 5286, 5290, 5292, 5293, 5298, 5299, 5300, 5301, 5303, 5308, 5311, 5313, 5317, 5319, 5321, 5324, 5327, 5329, 5330, 5334, 5338, 5339, 5344, 5346, 5348, 5351, 5359, 5360, 5361, 5371, 5372, 5374, 5375, 5376, 5386, 5388, 5389, 5391, 5393, 5394, 5395, 5396, 5397, 5398, 5403, 5407, 5409, 5411, 5413, 5414, 5417, 5428, 5430, 5431, 5448, 5449, 5450, 5451, 5452, 5456, 5457, 5458, 5459, 5463, 5464, 5466, 5467, 5472, 5474, 5476, 5482, 5483, 5485, 5491, 5493, 5495, 5496, 5498, 5506, 5508, 5510, 5512, 5513, 5515, 5516, 5517, 5518, 5519, 5524, 5526, 5529, 5530, 5531, 5534, 5535, 5537, 5539, 5543, 5557, 5562, 5563, 5568, 5569, 5571, 5579, 5585, 5588, 5589, 5591, 5592, 5597, 5604, 5608, 5612, 5613, 5615, 5616, 5618, 5620, 5627, 5632, 5635, 5638, 5640, 5642, 5643, 5647, 5648, 5651, 5652, 5653, 5657, 5659, 5660, 5662, 5663, 5669, 5670, 5671, 5675, 5676, 5677, 5680, 5689, 5694, 5695, 5697, 5698, 5702, 5703, 5706, 5709, 5711, 5718, 5721, 5722, 5731, 5732, 5734, 5735, 5738, 5744, 5751, 5753, 5768, 5770, 5771, 5775, 5780, 5784, 5785, 5791, 5794, 5803, 5805, 5806, 5807, 5808, 5811, 5813, 5814, 5815, 5817, 5820, 5826, 5828, 5831, 5833, 5835, 5836, 5837, 5839, 5846, 5852, 5854, 5859, 5864, 5865, 5866, 5867, 5868, 5869, 5870, 5872, 5876, 5878, 5879, 5881, 5883, 5884, 5887, 5888, 5889, 5892, 5893, 5906, 5907, 5912, 5919, 5922, 5923, 5925, 5926, 5927, 5928, 5931, 5932, 5934, 5935, 5938, 5939, 5941, 5944, 5947, 5948, 5954, 5956, 5957, 5959, 5961, 5964, 5968, 5969, 5971, 5979, 5980, 5982, 5987, 5989, 5991, 5996, 5997, 6000, 6002, 6004, 6006, 6007, 6009, 6010, 6013, 6017, 6023, 6024, 6025, 6026, 6038, 6041, 6044, 6048, 6051, 6058, 6059, 6062, 6063, 6065, 6068, 6069, 6070, 6072, 6073, 6075, 6080, 6081, 6085, 6086, 6087, 6088, 6089, 6092, 6093, 6097, 6098, 6099, 6107, 6108, 6109, 6110, 6113, 6116, 6118, 6119, 6120, 6123, 6124, 6129, 6131, 6132, 6136, 6137, 6138, 6139, 6143, 6145, 6146, 6147, 6148, 6149, 6153, 6158, 6160, 6162, 6163, 6164, 6165, 6181, 6183, 6186, 6188, 6189, 6193, 6194, 6195, 6197, 6198, 6203, 6204, 6205, 6209, 6215, 6220, 6223, 6224, 6227, 6228, 6234, 6237, 6243, 6246, 6247, 6250, 6251, 6264, 6265, 6267, 6270, 6275, 6278, 6280, 6281, 6282, 6286, 6288, 6292, 6295, 6297, 6299, 6303, 6310, 6315, 6317, 6319, 6321, 6322, 6323, 6328, 6330, 6333, 6338, 6342, 6346, 6354, 6356, 6362, 6363, 6365, 6370, 6372, 6375, 6376, 6381, 6383, 6386, 6393, 6394, 6397, 6399, 6400, 6403, 6405, 6408, 6410, 6412, 6414, 6415, 6419, 6420, 6425, 6426, 6427, 6428, 6429, 6430, 6431, 6436, 6440, 6449, 6456, 6463, 6464, 6466, 6467, 6468, 6469, 6470, 6474, 6475, 6476, 6478, 6480, 6482, 6484, 6488, 6494, 6501, 6504, 6505, 6510, 6513, 6516, 6517, 6519, 6523, 6526, 6528, 6530, 6531, 6532, 6534, 6535, 6537, 6543, 6547, 6549, 6552, 6553, 6555, 6558, 6564, 6567, 6569, 6571, 6572, 6574, 6576, 6577, 6579, 6581, 6584, 6588, 6589, 6592, 6594, 6595, 6596, 6597, 6599, 6600, 6603, 6606, 6607, 6609, 6620, 6623, 6625, 6629, 6633, 6634, 6635, 6638, 6639, 6640, 6644, 6649, 6655, 6656, 6658, 6661, 6662, 6666, 6671, 6672, 6679, 6701, 6703, 6705, 6706, 6716, 6718, 6720, 6729, 6730, 6734, 6736, 6737, 6739, 6747, 6748, 6749, 6756, 6757, 6759, 6761, 6764, 6766, 6767, 6778, 6779, 6782, 6783, 6788, 6793, 6794, 6795, 6797, 6799, 6803, 6804, 6805, 6807, 6810, 6811, 6813, 6815, 6816, 6817, 6820, 6824, 6827, 6828, 6830, 6831, 6834, 6836, 6840, 6841, 6842, 6843, 6848, 6851, 6859, 6863, 6868, 6869, 6875, 6876, 6877, 6878, 6880, 6881, 6882, 6883, 6884, 6888, 6892, 6894, 6895, 6897, 6902, 6903, 6904, 6907, 6914, 6917, 6919, 6920, 6921, 6925, 6930, 6936, 6939, 6946, 6955, 6959, 6960, 6963, 6970, 6971, 6979, 6980, 6981, 6984, 6985, 6987, 6988, 6990, 6991, 6994, 6997, 7009, 7013, 7017, 7018, 7022, 7029, 7038, 7039, 7041, 7043, 7045, 7046, 7051, 7052, 7053, 7054, 7057, 7059, 7064, 7067, 7072, 7073, 7075, 7077, 7079, 7083, 7084, 7085, 7105, 7106, 7107, 7108, 7110, 7117, 7118, 7130, 7138, 7139, 7142, 7143, 7144, 7151, 7154, 7163, 7164, 7165, 7166, 7169, 7172, 7182, 7184, 7192, 7194, 7196, 7197, 7199, 7201, 7202, 7206, 7207, 7208, 7209, 7210, 7212, 7214, 7215, 7217, 7219, 7220, 7227, 7228, 7230, 7231, 7235, 7236, 7244, 7245, 7246, 7249, 7250, 7255, 7257, 7258, 7262, 7263, 7264, 7267, 7268, 7274, 7276, 7281, 7287, 7291, 7292, 7293, 7298, 7299, 7300, 7301, 7303, 7304, 7305, 7306, 7307, 7308, 7311, 7312, 7313, 7318, 7324, 7328, 7338, 7340, 7344, 7345, 7349, 7353, 7356, 7358, 7361, 7365, 7371, 7373, 7375, 7376, 7377, 7380, 7382, 7383, 7386, 7392, 7398, 7399, 7400, 7409, 7410, 7411, 7417, 7418, 7425, 7430, 7434, 7436, 7438, 7441, 7447, 7448, 7452, 7453, 7454, 7457, 7458, 7459, 7464, 7470, 7472, 7476, 7483, 7486, 7490, 7492, 7493, 7498, 7499, 7502, 7503, 7504, 7506, 7512, 7514, 7515, 7521, 7523, 7524, 7525, 7528, 7533, 7538, 7546, 7560, 7561, 7574, 7576, 7578, 7579, 7583, 7585, 7586, 7589, 7596, 7597, 7598, 7604, 7605, 7609, 7611, 7612, 7619, 7620, 7622, 7624, 7625, 7633, 7642, 7643, 7644, 7649, 7652, 7655, 7656, 7658, 7661, 7662, 7664, 7665, 7671, 7673, 7674, 7678, 7679, 7680, 7682, 7686, 7687, 7689, 7695, 7700, 7703, 7712, 7715, 7716, 7718, 7724, 7726, 7736, 7737, 7738, 7741, 7744, 7745, 7748, 7749, 7753, 7763, 7764, 7768, 7770, 7774, 7775, 7777, 7778, 7779, 7780, 7781, 7785, 7786, 7788, 7791, 7792, 7793, 7798, 7799, 7800, 7803, 7804, 7806, 7807, 7818, 7819, 7820, 7823, 7824, 7825, 7826, 7833, 7834, 7838, 7839, 7841, 7844, 7845, 7850, 7854, 7856, 7860, 7865, 7873, 7877, 7878, 7880, 7881, 7887, 7888, 7890, 7896, 7908, 7911, 7913, 7918, 7923, 7925, 7928, 7933, 7934, 7935, 7937, 7938, 7942, 7944, 7946, 7949, 7952, 7965, 7966, 7967, 7972, 7973, 7974, 7976, 7977, 7983, 7984, 7986, 7993, 7994, 7996, 7999, 8006, 8007, 8021, 8026, 8029, 8031, 8035, 8036, 8041, 8042, 8044, 8045, 8047, 8048, 8053, 8056, 8058, 8059, 8061, 8063, 8064, 8068, 8075, 8076, 8077, 8078, 8079, 8081, 8084, 8087, 8088, 8091, 8093, 8095, 8099, 8100, 8102, 8103, 8105, 8106, 8110, 8112, 8113, 8118, 8121, 8123, 8126, 8129, 8130, 8134, 8145, 8146, 8147, 8148, 8150, 8151, 8152, 8155, 8163, 8166, 8170, 8178, 8179, 8181, 8182, 8189, 8193, 8194, 8197, 8202, 8204, 8208, 8210, 8211, 8213, 8219, 8223, 8227, 8230, 8234, 8235, 8237, 8239, 8242, 8246, 8248, 8250, 8252, 8253, 8262, 8264, 8265, 8266, 8268, 8269, 8270, 8272, 8273, 8274, 8275, 8289, 8291, 8292, 8295, 8296, 8300, 8301, 8304, 8308, 8310, 8311, 8312, 8315, 8318, 8319, 8320, 8323, 8329, 8339, 8340, 8341, 8347, 8350, 8353, 8355, 8358, 8367, 8368, 8371, 8373, 8378, 8379, 8380, 8382, 8386, 8389, 8392, 8393, 8395, 8396, 8398, 8401, 8404, 8405, 8406, 8408, 8410, 8413, 8414, 8415, 8416, 8417, 8418, 8428, 8430, 8436, 8438, 8439, 8440, 8443, 8444, 8445, 8446, 8447, 8448, 8449, 8450, 8451, 8458, 8459, 8465, 8469, 8470, 8472, 8473, 8474, 8476, 8477, 8481, 8482, 8485, 8486, 8490, 8494, 8498, 8501, 8502, 8503, 8505, 8507, 8509, 8511, 8515, 8517, 8521, 8523, 8524, 8525, 8526, 8527, 8528, 8531, 8532, 8533, 8539, 8541, 8542, 8543, 8551, 8553, 8554, 8557, 8561, 8562, 8565, 8568, 8574, 8575, 8576, 8579, 8581, 8582, 8585, 8592, 8594, 8596, 8597, 8598, 8600, 8601, 8602, 8603, 8604, 8605, 8609, 8611, 8612, 8614, 8622, 8631, 8634, 8635, 8638, 8639, 8641, 8642, 8644, 8646, 8650, 8652, 8654, 8658, 8659, 8660, 8663, 8665, 8669, 8670, 8672, 8676, 8677, 8685, 8686, 8693, 8699, 8700, 8703, 8706, 8708, 8709, 8710, 8713, 8717, 8720, 8722, 8727, 8729, 8731, 8736, 8741, 8743, 8744, 8746, 8747, 8748, 8753, 8755, 8756, 8757, 8761, 8770, 8772, 8773, 8777, 8779, 8780, 8783, 8784, 8786, 8789, 8792, 8803, 8804, 8810, 8817, 8818, 8821, 8822, 8824, 8829, 8831, 8834, 8835, 8836, 8839, 8841, 8843, 8846, 8853, 8865, 8874, 8876, 8877, 8878, 8881, 8883, 8884, 8886, 8888, 8889, 8892, 8896, 8899, 8900, 8901, 8908, 8911, 8916, 8917, 8919, 8922, 8926, 8929, 8930, 8937, 8938, 8941, 8946, 8949, 8951, 8953, 8957, 8960, 8961, 8968, 8971, 8979, 8980, 8981, 8985, 8986, 8992, 8996, 8998, 9001, 9006, 9009, 9011, 9012, 9013, 9015, 9018, 9026, 9027, 9029, 9030, 9033, 9045, 9052, 9056, 9058, 9059, 9060, 9063, 9065, 9069, 9071, 9072, 9073, 9076, 9078, 9086, 9087, 9088, 9091, 9092, 9096, 9097, 9098, 9103, 9104, 9105, 9106, 9107, 9110, 9112, 9114, 9118, 9123, 9125, 9129, 9131, 9139, 9140, 9141, 9142, 9144, 9145, 9151, 9152, 9154, 9155, 9167, 9168, 9175, 9177, 9179, 9180, 9183, 9185, 9186, 9188, 9190, 9191, 9195, 9205, 9206, 9207, 9210, 9211, 9213, 9215, 9216, 9220, 9223, 9226, 9229, 9231, 9233, 9237, 9243, 9248, 9249, 9253, 9262, 9267, 9269, 9270, 9273, 9282, 9284, 9285, 9287, 9288, 9290, 9292, 9293, 9296, 9300, 9304, 9306, 9308, 9311, 9313, 9320, 9321, 9322, 9323, 9326, 9327, 9328, 9336, 9337, 9338, 9339, 9340, 9346, 9347, 9350, 9352, 9353, 9359, 9366, 9371, 9373, 9375, 9376, 9382, 9388, 9391, 9392, 9393, 9394, 9400, 9402, 9403, 9406, 9413, 9414, 9415, 9421, 9423, 9425, 9429, 9434, 9439, 9440, 9443, 9449, 9453, 9456, 9460, 9469, 9471, 9474, 9481, 9482, 9484, 9486, 9488, 9490, 9497, 9500, 9504, 9509, 9514, 9517, 9518, 9519, 9534, 9536, 9537, 9538, 9540, 9545, 9546, 9550, 9551, 9553, 9554, 9555, 9559, 9560, 9564, 9568, 9571, 9577, 9587, 9590, 9591, 9595, 9596, 9601, 9602, 9606, 9607, 9609, 9614, 9615, 9618, 9620, 9621, 9623, 9624, 9626, 9629, 9632, 9633, 9635, 9641, 9642, 9644, 9645, 9649, 9651, 9652, 9653, 9655, 9657, 9658, 9663, 9666, 9668, 9670, 9677, 9682, 9686, 9687, 9696, 9698, 9700, 9706, 9710, 9711, 9715, 9721, 9723, 9724, 9726, 9727, 9729, 9730, 9731, 9734, 9737, 9738, 9742, 9744, 9745, 9746, 9750, 9753, 9754, 9756, 9763, 9764, 9768, 9770, 9774, 9776, 9782, 9786, 9791, 9792, 9793, 9794, 9798, 9799, 9802, 9809, 9810, 9811, 9812, 9813, 9816, 9819, 9820, 9825, 9827, 9828, 9829, 9830, 9831, 9833, 9835, 9845, 9846, 9847, 9850, 9861, 9866, 9869, 9873, 9875, 9878, 9879, 9882, 9886, 9887, 9892, 9897, 9900, 9907, 9909, 9910, 9911, 9912, 9921, 9923, 9924, 9928, 9930, 9932, 9935, 9938, 9940, 9944, 9946, 9949, 9950, 9952, 9953, 9960, 9962, 9963, 9967, 9968, 9972, 9973, 9975, 9979, 9980, 9982, 9984, 9985, 9987, 9988, 9990, 9991, 9992, 9997, 10000, 10008, 10009, 10010, 10012, 10013, 10017, 10019, 10026, 10027, 10032, 10033, 10034, 10035, 10049, 10051, 10052, 10053, 10055, 10058, 10059, 10060, 10062, 10064, 10066, 10073, 10075, 10077, 10078, 10080, 10081, 10083, 10091, 10092, 10095, 10101, 10102, 10103, 10106, 10109, 10110, 10113, 10115, 10116, 10122, 10128, 10129, 10130, 10131, 10136, 10140, 10142, 10143, 10151, 10158, 10160, 10163, 10165, 10166, 10168, 10174, 10176, 10178, 10181, 10191, 10192, 10193, 10194, 10196, 10199, 10206, 10207, 10212, 10218, 10219, 10220, 10222, 10223, 10225, 10233, 10235, 10236, 10237, 10239, 10247, 10249, 10252, 10253, 10255, 10259, 10262, 10263, 10268, 10269, 10270, 10275, 10276, 10278, 10284, 10286, 10291, 10292, 10293, 10295, 10300, 10302, 10306, 10307, 10311, 10312, 10314, 10318, 10319, 10323, 10325, 10326, 10327, 10331, 10333, 10334, 10335, 10336, 10340, 10341, 10343, 10346, 10353, 10356, 10357, 10362, 10364, 10371, 10375, 10378, 10380, 10381, 10384, 10388, 10395, 10397, 10398, 10399, 10401, 10410, 10411, 10413, 10414, 10416, 10417, 10419, 10421, 10423, 10425, 10430, 10435, 10436, 10438, 10440, 10446, 10447, 10449, 10450, 10452, 10453, 10456, 10460, 10463, 10464, 10465, 10466, 10468, 10469, 10471, 10474, 10480, 10482, 10487, 10488, 10490, 10494, 10496, 10506, 10508, 10514, 10518, 10522, 10523, 10527, 10528, 10530, 10531, 10532, 10535, 10536, 10537, 10541, 10542, 10543, 10544, 10547, 10548, 10556, 10558, 10560, 10564, 10567, 10569, 10573, 10580, 10581, 10582, 10583, 10588, 10593, 10596, 10597, 10599, 10601, 10602, 10611, 10612, 10615, 10616, 10617, 10621, 10622, 10626, 10637, 10638, 10639, 10640, 10642, 10645, 10646, 10651, 10655, 10657, 10665, 10666, 10668, 10670, 10676, 10678, 10679, 10681, 10682, 10683, 10684, 10685, 10687, 10698, 10700, 10701, 10705, 10707, 10711, 10715, 10716, 10721, 10722, 10724, 10726, 10729, 10732, 10734, 10738, 10740, 10741, 10744, 10748, 10749, 10752, 10753, 10754, 10761, 10762, 10766, 10775, 10776, 10778, 10779, 10782, 10785, 10787, 10788, 10790, 10792, 10795, 10799, 10801, 10802, 10803, 10804, 10805, 10809, 10810, 10815, 10818, 10819, 10820, 10822, 10823, 10824, 10827, 10831, 10833, 10836, 10838, 10839, 10840, 10841, 10843, 10850, 10851, 10852, 10853, 10854, 10857, 10858, 10860, 10866, 10867, 10874, 10877, 10880, 10886, 10888, 10889, 10896, 10898, 10899, 10901, 10902, 10910, 10911, 10913, 10917, 10918, 10920, 10924, 10926, 10927, 10928, 10929, 10930, 10933, 10934, 10938, 10940, 10947, 10949, 10960, 10961, 10962, 10965, 10966, 10967, 10972, 10976, 10977, 10979, 10985, 10987, 10988, 10993, 10995, 10996, 11008, 11015, 11021, 11024, 11027, 11030, 11032, 11033, 11036, 11037, 11039, 11046, 11047, 11050, 11051, 11052, 11053, 11056, 11058, 11060, 11063, 11066, 11070, 11078, 11082, 11083, 11090, 11095, 11100, 11103, 11107, 11114, 11118, 11119, 11122, 11129, 11133, 11135, 11136, 11137, 11138, 11145, 11147, 11148, 11149, 11150, 11152, 11153, 11154, 11155, 11156, 11157, 11160, 11163, 11165, 11166, 11168, 11169, 11173, 11177, 11178, 11181, 11184, 11187, 11188, 11190, 11191, 11192, 11194, 11198, 11204, 11208, 11213, 11214, 11217, 11218, 11222, 11226, 11227, 11228, 11229, 11230, 11233, 11235, 11236, 11237, 11238, 11239, 11241, 11242, 11243, 11246, 11247, 11248, 11251, 11253, 11254, 11255, 11260, 11262, 11263, 11266, 11278, 11290, 11291, 11292, 11293, 11294, 11295, 11297, 11299, 11304, 11305, 11306, 11313, 11316, 11321, 11330, 11331, 11332, 11333, 11340, 11345, 11346, 11348, 11349, 11356, 11358, 11359, 11362, 11363, 11364, 11365, 11370, 11371, 11373, 11377, 11380, 11382, 11385, 11387, 11392, 11394, 11395, 11401, 11404, 11405, 11406, 11416, 11417, 11424, 11430, 11431, 11435, 11438, 11439, 11440, 11443, 11446, 11449, 11451, 11459, 11465, 11466, 11472, 11475, 11477, 11478, 11481, 11487, 11488, 11489, 11490, 11491, 11496, 11497, 11498, 11499, 11500, 11501, 11505, 11506, 11507, 11513, 11520, 11521, 11523, 11524, 11526, 11527, 11528, 11530, 11531, 11532, 11533, 11534, 11535, 11540, 11541, 11544, 11546, 11548, 11550, 11551, 11558, 11560, 11561, 11567, 11570, 11571, 11576, 11577, 11578, 11585, 11586, 11587, 11588, 11593, 11594, 11595, 11596, 11597, 11599, 11603, 11604, 11607, 11611, 11612, 11615, 11617, 11618, 11623, 11625, 11628, 11631, 11639, 11647, 11650, 11656, 11658, 11659, 11663, 11664, 11669, 11673, 11677, 11678, 11681, 11682, 11688, 11691, 11692, 11694, 11695, 11696, 11701, 11703, 11705, 11707, 11712, 11718, 11720, 11721, 11725, 11726, 11730, 11731, 11733, 11736, 11737, 11740, 11743, 11753, 11756, 11760, 11761, 11762, 11763, 11765, 11770, 11771, 11776, 11777, 11781, 11782, 11785, 11786, 11788, 11792, 11794, 11797, 11799, 11800, 11805, 11809, 11810, 11812, 11814, 11818, 11819, 11823, 11826, 11828, 11830, 11837, 11840, 11842, 11846, 11849, 11851, 11854, 11856, 11858, 11861, 11864, 11865, 11868, 11869, 11872, 11876, 11877, 11878, 11879, 11881, 11886, 11889, 11891, 11892, 11894, 11895, 11898, 11901, 11906, 11909, 11911, 11913, 11914, 11916, 11917, 11919, 11920, 11921, 11923, 11927, 11928, 11929, 11930, 11934, 11935, 11940, 11943, 11946, 11947, 11953, 11955, 11956, 11958, 11959, 11960, 11961, 11962, 11963, 11965, 11966, 11968, 11974, 11975, 11976, 11977, 11978, 11979, 11983, 11988, 11993, 11997, 11998, 11999, 12004, 12014, 12017, 12019, 12020, 12023, 12024, 12026, 12027, 12032, 12033, 12041, 12042, 12043, 12044, 12052, 12058, 12059, 12060, 12077, 12081, 12083, 12091, 12092, 12093, 12095, 12098, 12102, 12104, 12106, 12109, 12110, 12112, 12118, 12122, 12126, 12128, 12129, 12130, 12134, 12135, 12137, 12139, 12143, 12147, 12149, 12151, 12161, 12165, 12166, 12170, 12171, 12173, 12174, 12175, 12181, 12183, 12185, 12189, 12191, 12197, 12198, 12200, 12201, 12204, 12207, 12208, 12217, 12218, 12219, 12220, 12221, 12223, 12227, 12233, 12234, 12241, 12243, 12245, 12249, 12250, 12252, 12253, 12255, 12256, 12259, 12263, 12267, 12268, 12269, 12271, 12274, 12278, 12280, 12283, 12284, 12286, 12287, 12288, 12291, 12293, 12297, 12298, 12304, 12307, 12310, 12311, 12312, 12313, 12314, 12315, 12317, 12321, 12323, 12324, 12326, 12329, 12331, 12333, 12334, 12342, 12343, 12347, 12354, 12356, 12358, 12359, 12364, 12367, 12368, 12369, 12370, 12372, 12379, 12380, 12381, 12383, 12385, 12391, 12397, 12400, 12401, 12403, 12404, 12405, 12406, 12411, 12414, 12419, 12420, 12421, 12424, 12426, 12427, 12428, 12437, 12439, 12440, 12441, 12445, 12447, 12451, 12455, 12456, 12457, 12459, 12461, 12462, 12467, 12468, 12470, 12472, 12478, 12479, 12481, 12487, 12488, 12491, 12494, 12497, 12503, 12504, 12508, 12509, 12514, 12521, 12530, 12531, 12536, 12539, 12545, 12546, 12547, 12549, 12555, 12556, 12557, 12559, 12561, 12563, 12564, 12565, 12567, 12568, 12570, 12572, 12574, 12578, 12583, 12585, 12588, 12591, 12597, 12605, 12608, 12609, 12610, 12611, 12614, 12616, 12619, 12622, 12623, 12631, 12633, 12634, 12635, 12636, 12638, 12639, 12641, 12649, 12651, 12655, 12663, 12668, 12670, 12671, 12672, 12674, 12675, 12679, 12680, 12681, 12682, 12684, 12685, 12691, 12695, 12698, 12699, 12701, 12702, 12703, 12705, 12706, 12713, 12714, 12718, 12719, 12729, 12731, 12732, 12733, 12735, 12737, 12738, 12739, 12741, 12742, 12748, 12751, 12752, 12754, 12755, 12757, 12758, 12760, 12761, 12762, 12764, 12766, 12767, 12771, 12783, 12790, 12794, 12797, 12800, 12802, 12803, 12805, 12810, 12812, 12813, 12814, 12817, 12819, 12820, 12822, 12824, 12826, 12827, 12828, 12834, 12835, 12836, 12838, 12839, 12844, 12849, 12850, 12853, 12856, 12858, 12861, 12866, 12882, 12883, 12887, 12888, 12895, 12898, 12899, 12900, 12904, 12905, 12906, 12910, 12913, 12916, 12917, 12918, 12920, 12921, 12926, 12929, 12932, 12933, 12938, 12939, 12940, 12941, 12945, 12946, 12947, 12950, 12961, 12966, 12968, 12969, 12972, 12973, 12974, 12975, 12978, 12983, 12984, 12985, 12987, 12990, 12991, 12996, 13010, 13011, 13014, 13017, 13018, 13022, 13023, 13030, 13032, 13033, 13035, 13036, 13038, 13040, 13042, 13044, 13049, 13050, 13053, 13054, 13055, 13056, 13061, 13062, 13064, 13065, 13066, 13067, 13071, 13074, 13075, 13079, 13085, 13086, 13087, 13095, 13101, 13102, 13105, 13106, 13112, 13114, 13115, 13116, 13117, 13118, 13120, 13123, 13124, 13128, 13131, 13135, 13142, 13147, 13148, 13149, 13151, 13153, 13154, 13159, 13160, 13166, 13169, 13174, 13175, 13182, 13188, 13191, 13197, 13199, 13205, 13209, 13212, 13213, 13215, 13217, 13221, 13222, 13224, 13227, 13230, 13232, 13234, 13235, 13236, 13237, 13238, 13249, 13251, 13255, 13259, 13260, 13261, 13263, 13264, 13268, 13269, 13276, 13279, 13296, 13298, 13301, 13303, 13304, 13313, 13315, 13317, 13325, 13326, 13328, 13329, 13330, 13332, 13337, 13340, 13343, 13345, 13346, 13348, 13349, 13350, 13352, 13354, 13361, 13363, 13367, 13368, 13369, 13377, 13380, 13381, 13384, 13385, 13388, 13391, 13393, 13394, 13396, 13397, 13401, 13402, 13403, 13410, 13416, 13419, 13420, 13423, 13424, 13430, 13433, 13439, 13441, 13448, 13449, 13451, 13454, 13456, 13460, 13463, 13466, 13468, 13469, 13473, 13475, 13490, 13492, 13494, 13496, 13498, 13499, 13500, 13503, 13504, 13505, 13506, 13512, 13513, 13514, 13515, 13516, 13519, 13520, 13521, 13524, 13529, 13530, 13532, 13539, 13540, 13543, 13544, 13545, 13546, 13547, 13549, 13552, 13553, 13559, 13568, 13569, 13574, 13580, 13582, 13583, 13584, 13587, 13589, 13595, 13597, 13601, 13602, 13603, 13605, 13612, 13621, 13623, 13628, 13631, 13632, 13634, 13635, 13636, 13637, 13641, 13643, 13647, 13652, 13654, 13660, 13661, 13662, 13663, 13668, 13671, 13675, 13676, 13677, 13678, 13681, 13683, 13684, 13687, 13688, 13691, 13695, 13697, 13698, 13700, 13702, 13703, 13706, 13710, 13713, 13715, 13716, 13720, 13721, 13725, 13727, 13728, 13729, 13733, 13739, 13742, 13745, 13748, 13750, 13755, 13756, 13758, 13764, 13766, 13767, 13769, 13772, 13773, 13774, 13775, 13776, 13781, 13782, 13783, 13786, 13787, 13789, 13790, 13791, 13793, 13794, 13796, 13807, 13809, 13816, 13817, 13818, 13819, 13820, 13822, 13823, 13828, 13830, 13831, 13833, 13834, 13835, 13849, 13852, 13853, 13859, 13864, 13866, 13869, 13872, 13873, 13874, 13875, 13877, 13881, 13882, 13885, 13888, 13891, 13892, 13896, 13898, 13901, 13906, 13908, 13909, 13910, 13911, 13917, 13918, 13919, 13920, 13925, 13927, 13930, 13933, 13944, 13947, 13952, 13954, 13956, 13961, 13965, 13969, 13970, 13971, 13975, 13976, 13980, 13981, 13983, 13984, 13990, 13991, 13992, 13999, 14000, 14001, 14008, 14009, 14014, 14017, 14022, 14026, 14027, 14030, 14031, 14036, 14041, 14043, 14049, 14050, 14051, 14052, 14059, 14062, 14063, 14066, 14067, 14069, 14070, 14071, 14073, 14075, 14081, 14084, 14086, 14088, 14091, 14092, 14093, 14094, 14096, 14099, 14105, 14106, 14110, 14112, 14115, 14116, 14118, 14119, 14122, 14126, 14129, 14130, 14132, 14134, 14135, 14138, 14139, 14142, 14143, 14145, 14146, 14148, 14149, 14150.

Promoters expressing in endosperm/embryo tissue at 2 days after planting include SEQ IDs: 1, 3, 4, 7, 13, 14, 29, 31, 34, 36, 48, 54, 64, 65, 68, 88, 93, 96, 97, 99, 102, 103, 107, 110, 112, 121, 130, 131, 132, 139, 143, 148, 152, 156, 157, 159, 162, 165, 174, 175, 176, 177, 181, 183, 187, 194, 195, 196, 197, 199, 203, 204, 205, 207, 211, 215, 223, 231, 232, 235, 236, 237, 240, 243, 244, 246, 249, 250, 251, 257, 259, 262, 264, 271, 273, 280, 281, 286, 288, 289, 291, 294, 299, 303, 305, 306, 319, 320, 323, 328, 329, 332, 335, 341, 346, 348, 349, 352, 354, 356, 358, 360, 364, 365, 368, 371, 374, 379, 388, 401, 406, 407, 419, 420, 423, 424, 428, 429, 433, 436, 444, 452, 456, 461, 466, 473, 474, 478, 479, 481, 483, 484, 485, 488, 498, 501, 502, 509, 510, 512, 513, 514, 516, 517, 520, 522, 525, 529, 532, 533, 536, 538, 544, 546, 547, 553, 557, 560, 564, 569, 574, 578, 585, 591, 594, 595, 596, 598, 599, 601, 604, 605, 607, 611, 613, 614, 620, 623, 630, 631, 633, 635, 641, 643, 644, 650, 653, 663, 665, 670, 681, 683, 686, 693, 699, 701, 717, 718, 719, 722, 724, 727, 733, 734, 736, 742, 745, 753, 757, 760, 761, 762, 765, 768, 770, 771, 782, 783, 784, 793, 797, 800, 804, 806, 808, 812, 813, 820, 821, 830, 833, 839, 840, 842, 844, 845, 855, 857, 859, 862, 865, 868, 872, 877, 878, 879, 883, 884, 885, 887, 890, 891, 892, 893, 895, 902, 903, 907, 911, 912, 913, 916, 917, 919, 920, 928, 929, 931, 936, 938, 943, 944, 951, 953, 954, 958, 959, 962, 964, 966, 969, 974, 979, 980, 982, 987, 994, 995, 997, 999, 1006, 1007, 1009, 1011, 1014, 1017, 1026, 1032, 1035, 1038, 1042, 1043, 1045, 1047, 1049, 1050, 1051, 1052, 1054, 1055, 1064, 1065, 1069, 1072, 1073, 1077, 1078, 1086, 1087, 1088, 1089, 1092, 1095, 1101, 1103, 1104, 1108, 1110, 1111, 1112, 1114, 1115, 1117, 1118, 1119, 1120, 1122, 1125, 1127, 1130, 1132, 1133, 1136, 1137, 1143, 1144, 1146, 1148, 1154, 1165, 1170, 1174, 1175, 1176, 1178, 1189, 1190, 1191, 1193, 1196, 1199, 1200, 1204, 1205, 1208, 1213, 1214, 1218, 1220, 1223, 1227, 1228, 1230, 1231, 1233, 1236, 1239, 1241, 1244, 1248, 1250, 1252, 1253, 1254, 1256, 1257, 1264, 1265, 1272, 1275, 1281, 1282, 1285, 1286, 1291, 1292, 1293, 1295, 1297, 1309, 1312, 1316, 1317, 1325, 1327, 1331, 1335, 1337, 1349, 1351, 1352, 1354, 1355, 1360, 1364, 1365, 1368, 1371, 1373, 1376, 1377, 1380, 1382, 1388, 1394, 1396, 1398, 1402, 1404, 1405, 1407, 1409, 1410, 1412, 1420, 1421, 1423, 1426, 1431, 1436, 1438, 1440, 1441, 1442, 1448, 1451, 1453, 1454, 1455, 1466, 1475, 1481, 1486, 1488, 1490, 1493, 1496, 1498, 1499, 1514, 1517, 1518, 1525, 1526, 1527, 1530, 1533, 1536, 1539, 1543, 1545, 1546, 1548, 1549, 1560, 1566, 1567, 1568, 1575, 1584, 1586, 1589, 1590, 1592, 1593, 1595, 1599, 1600, 1604, 1605, 1609, 1612, 1614, 1615, 1616, 1625, 1628, 1629, 1634, 1635, 1636, 1637, 1638, 1639, 1648, 1653, 1658, 1662, 1669, 1671, 1675, 1676, 1677, 1683, 1685, 1688, 1689, 1691, 1705, 1706, 1707, 1708, 1710, 1712, 1714, 1717, 1721, 1723, 1729, 1731, 1732, 1735, 1740, 1750, 1755, 1758, 1759, 1764, 1765, 1766, 1768, 1771, 1776, 1779, 1782, 1784, 1785, 1816, 1820, 1830, 1832, 1840, 1845, 1850, 1852, 1858, 1859, 1865, 1867, 1869, 1870, 1872, 1873, 1883, 1886, 1888, 1891, 1893, 1894, 1895, 1897, 1898, 1899, 1900, 1901, 1902, 1903, 1904, 1905, 1906, 1911, 1914, 1916, 1918, 1920, 1923, 1936, 1940, 1944, 1945, 1950, 1953, 1955, 1973, 1981, 1986, 1990, 1991, 1993, 1994, 1995, 1996, 1999, 2000, 2003, 2007, 2008, 2009, 2010, 2011, 2012, 2013, 2014, 2015, 2017, 2026, 2031, 2032, 2033, 2039, 2040, 2041, 2048, 2064, 2066, 2067, 2072, 2074, 2077, 2083, 2089, 2091, 2092, 2094, 2096, 2097, 2103, 2104, 2107, 2112, 2119, 2122, 2126, 2133, 2134, 2140, 2142, 2143, 2144, 2147, 2150, 2152, 2156, 2161, 2162, 2163, 2164, 2165, 2166, 2170, 2172, 2177, 2178, 2179, 2185, 2191, 2193, 2196, 2202, 2203, 2206, 2215, 2216, 2221, 2222, 2226, 2232, 2240, 2253, 2257, 2260, 2262, 2263, 2274, 2279, 2281, 2283, 2288, 2293, 2295, 2296, 2298, 2303, 2304, 2305, 2306, 2308, 2314, 2322, 2323, 2328, 2329, 2333, 2335, 2339, 2342, 2343, 2348, 2349, 2351, 2352, 2353, 2361, 2362, 2363, 2367, 2379, 2381, 2382, 2384, 2385, 2398, 2401, 2405, 2411, 2412, 2418, 2419, 2420, 2423, 2431, 2435, 2437, 2438, 2441, 2442, 2443,
2445, 2451, 2452, 2453, 2465, 2471, 2472, 2474, 2476, 2479,
2481, 2482, 2483, 2490, 2492, 2494, 2498, 2500, 2504, 2505,
2509, 2510, 2511, 2514, 2517, 2525, 2528, 2531, 2533, 2536,
2537, 2538, 2539, 2541, 2542, 2543, 2549, 2552, 2554, 2555,
2556, 2557, 2565, 2568, 2573, 2578, 2581, 2583, 2588, 2589,
2590, 2592, 2594, 2599, 2605, 2609, 2616, 2617, 2618, 2625,
2627, 2632, 2634, 2636, 2637, 2639, 2644, 2653, 2655, 2661,
2662, 2663, 2671, 2674, 2675, 2684, 2685, 2687, 2689, 2691,
2700, 2707, 2719, 2723, 2725, 2726, 2729, 2740, 2742, 2746,
2747, 2749, 2752, 2756, 2757, 2770, 2780, 2782, 2783, 2787,
2794, 2800, 2802, 2805, 2812, 2814, 2819, 2820, 2821, 2823,
2824, 2826, 2827, 2829, 2832, 2833, 2837, 2840, 2844, 2850,
2858, 2861, 2865, 2866, 2871, 2873, 2876, 2888, 2889, 2901,
2902, 2903, 2905, 2909, 2910, 2911, 2919, 2923, 2926, 2930,
2932, 2933, 2934, 2935, 2944, 2948, 2952, 2953, 2955, 2959,
2962, 2963, 2966, 2968, 2976, 2980, 2985, 2992, 2994, 3002,
3007, 3008, 3015, 3016, 3020, 3023, 3029, 3038, 3039, 3040,
3043, 3048, 3049, 3051, 3052, 3053, 3055, 3064, 3067, 3072,
3078, 3080, 3081, 3083, 3084, 3085, 3087, 3100, 3105, 3106,
3109, 3112, 3118, 3121, 3123, 3126, 3127, 3128, 3137, 3138,
3139, 3143, 3150, 3153, 3170, 3173, 3187, 3192, 3194, 3204,
3205, 3206, 3210, 3212, 3214, 3219, 3220, 3224, 3225, 3228,
3236, 3239, 3240, 3244, 3245, 3246, 3250, 3252, 3255, 3260,
3261, 3266, 3271, 3280, 3283, 3286, 3288, 3290, 3294, 3295,
3296, 3299, 3301, 3303, 3312, 3324, 3331, 3332, 3333, 3340,
3343, 3345, 3349, 3351, 3353, 3355, 3357, 3358, 3359, 3360,
3363, 3365, 3377, 3379, 3380, 3383, 3386, 3387, 3397, 3399,
3402, 3404, 3409, 3414, 3415, 3416, 3418, 3419, 3424, 3426,
3428, 3435, 3438, 3441, 3442, 3445, 3449, 3450, 3451, 3455,
3458, 3460, 3461, 3464, 3465, 3466, 3468, 3470, 3471, 3473,
3474, 3482, 3486, 3488, 3491, 3496, 3503, 3504, 3506, 3509,
3510, 3511, 3516, 3517, 3518, 3521, 3523, 3531, 3533, 3536,
3537, 3541, 3544, 3545, 3548, 3552, 3554, 3560, 3562, 3569,
3574, 3576, 3577, 3587, 3588, 3592, 3595, 3596, 3597, 3598,
3600, 3603, 3606, 3607, 3611, 3612, 3613, 3616, 3618, 3620,
3621, 3624, 3629, 3633, 3635, 3637, 3638, 3640, 3642, 3643,
3644, 3645, 3646, 3650, 3655, 3657, 3659, 3660, 3663, 3667,
3671, 3672, 3674, 3678, 3682, 3684, 3685, 3693, 3697, 3707,
3713, 3717, 3719, 3724, 3738, 3739, 3742, 3749, 3752, 3761,
3762, 3764, 3765, 3766, 3774, 3777, 3778, 3783, 3790, 3791,
3792, 3794, 3796, 3798, 3800, 3804, 3808, 3813, 3818, 3820,
3823, 3825, 3828, 3829, 3830, 3831, 3832, 3842, 3843, 3844,
3845, 3847, 3849, 3858, 3860, 3862, 3867, 3868, 3871, 3872,
3873, 3876, 3882, 3883, 3885, 3887, 3889, 3890, 3891, 3892,
3893, 3895, 3896, 3908, 3910, 3911, 3912, 3914, 3917, 3924,
3929, 3938, 3947, 3950, 3954, 3958, 3962, 3967, 3972, 3974,
3975, 3983, 3987, 3988, 3990, 3994, 3997, 4001, 4002, 4003,
4006, 4008, 4013, 4014, 4019, 4020, 4021, 4024, 4026, 4030,
4032, 4034, 4039, 4040, 4041, 4046, 4048, 4051, 4052, 4054,
4056, 4057, 4058, 4062, 4066, 4067, 4068, 4069, 4072, 4074,
4075, 4079, 4081, 4092, 4096, 4099, 4103, 4105, 4108, 4109,
4110, 4113, 4116, 4122, 4128, 4133, 4143, 4146, 4148, 4149,
4150, 4156, 4158, 4160, 4161, 4162, 4163, 4165, 4166, 4167,
4168, 4170, 4171, 4178, 4184, 4187, 4188, 4189, 4198, 4201,
4202, 4205, 4206, 4208, 4210, 4211, 4212, 4214, 4217, 4219,
4221, 4227, 4228, 4233, 4235, 4244, 4246, 4250, 4255, 4257,
4260, 4261, 4263, 4265, 4266, 4270, 4275, 4281, 4288, 4292,
4296, 4298, 4301, 4302, 4304, 4312, 4320, 4324, 4329, 4330,
4331, 4335, 4336, 4338, 4341, 4343, 4344, 4349, 4352, 4354,
4356, 4359, 4360, 4365, 4369, 4371, 4373, 4378, 4380, 4383,
4388, 4394, 4402, 4404, 4405, 4410, 4415, 4419, 4422, 4423,
4426, 4428, 4439, 4443, 4444, 4446, 4448, 4450, 4453, 4458,
4460, 4461, 4462, 4463, 4464, 4468, 4472, 4474, 4479, 4485,
4492, 4494, 4506, 4507, 4508, 4512, 4514, 4515, 4516, 4518,
4519, 4522, 4531, 4535, 4542, 4545, 4548, 4549, 4551, 4554,
4555, 4556, 4557, 4558, 4562, 4565, 4566, 4567, 4568, 4570,
4575, 4586, 4588, 4590, 4591, 4595, 4596, 4597, 4598, 4604,
4606, 4611, 4621, 4625, 4626, 4630, 4633, 4634, 4635, 4641,
4643, 4644, 4645, 4650, 4659, 4666, 4667, 4668, 4669, 4670,
4671, 4677, 4680, 4682, 4684, 4685, 4687, 4694, 4697, 4700,
4702, 4704, 4706, 4708, 4719, 4721, 4725, 4729, 4740, 4748,
4749, 4750, 4753, 4754, 4755, 4756, 4759, 4761, 4762, 4765,
4775, 4779, 4789, 4790, 4791, 4794, 4795, 4803, 4804, 4813,
4817, 4818, 4824, 4828, 4830, 4831, 4833, 4836, 4837, 4838,
4842, 4856, 4857, 4859, 4861, 4862, 4864, 4869, 4872, 4875,
4876, 4878, 4880, 4881, 4887, 4891, 4895, 4900, 4902, 4904,
4905, 4914, 4917, 4921, 4924, 4926, 4930, 4935, 4936, 4938,
4939, 4943, 4944, 4950, 4958, 4959, 4966, 4971, 4972, 4973,
4975, 4977, 4979, 4980, 4984, 4988, 4989, 4990, 4992, 4994,
4996, 5000, 5007, 5010, 5015, 5029, 5030, 5034, 5039, 5040,
5042, 5044, 5046, 5049, 5052, 5054, 5057, 5059, 5063, 5067,
5068, 5072, 5074, 5078, 5082, 5088, 5089, 5091, 5100, 5102,
5106, 5111, 5114, 5123, 5129, 5131, 5132, 5140, 5143, 5145,
5149, 5152, 5153, 5157, 5160, 5164, 5165, 5168, 5171, 5173,
5174, 5180, 5182, 5185, 5186, 5189, 5190, 5191, 5192, 5196,
5198, 5199, 5200, 5206, 5208, 5211, 5212, 5217, 5219, 5228,
5229, 5230, 5239, 5240, 5241, 5243, 5248, 5249, 5251, 5253,
5255, 5263, 5264, 5265, 5266, 5267, 5273, 5275, 5276, 5280,
5281, 5283, 5289, 5290, 5291, 5292, 5293, 5298, 5299, 5300,
5301, 5303, 5308, 5311, 5313, 5317, 5321, 5324, 5329, 5330,
5334, 5339, 5344, 5346, 5347, 5348, 5350, 5351, 5359, 5360,
5361, 5363, 5364, 5372, 5382, 5384, 5386, 5388, 5389, 5394,
5395, 5396, 5397, 5398, 5403, 5404, 5409, 5411, 5414, 5417,
5426, 5431, 5438, 5439, 5448, 5449, 5450, 5451, 5452, 5456,
5457, 5458, 5459, 5461, 5463, 5464, 5467, 5472, 5474, 5476,
5482, 5483, 5493, 5496, 5498, 5506, 5508, 5510, 5512, 5513,
5515, 5516, 5517, 5518, 5519, 5520, 5521, 5530, 5531, 5535,
5537, 5547, 5557, 5561, 5565, 5568, 5569, 5579, 5583, 5585,
5588, 5589, 5591, 5597, 5598, 5604, 5612, 5613, 5615, 5616,
5618, 5627, 5635, 5640, 5642, 5643, 5644, 5648, 5651, 5652,
5656, 5657, 5659, 5660, 5662, 5663, 5675, 5676, 5677, 5680,
5688, 5689, 5694, 5695, 5697, 5698, 5699, 5702, 5703, 5706,
5709, 5718, 5721, 5722, 5731, 5734, 5735, 5744, 5748, 5751,
5756, 5763, 5768, 5771, 5775, 5779, 5780, 5789, 5791, 5794,
5803, 5807, 5808, 5809, 5811, 5817, 5820, 5828, 5831, 5833,
5835, 5836, 5837, 5839, 5850, 5852, 5853, 5854, 5855, 5859,
5864, 5865, 5866, 5867, 5869, 5870, 5872, 5873, 5875, 5876,
5878, 5881, 5883, 5884, 5885, 5888, 5890, 5892, 5907, 5919,
5922, 5925, 5926, 5928, 5932, 5934, 5936, 5938, 5944, 5948,
5954, 5956, 5959, 5961, 5967, 5968, 5982, 5988, 5989, 5991,
5996, 6000, 6002, 6004, 6006, 6009, 6013, 6016, 6017, 6023,
6025, 6026, 6033, 6038, 6041, 6044, 6045, 6048, 6051, 6058,
6059, 6062, 6063, 6065, 6072, 6073, 6074, 6075, 6081, 6085,
6092, 6093, 6097, 6098, 6099, 6107, 6108, 6109, 6110, 6113,
6118, 6124, 6129, 6130, 6131, 6132, 6133, 6137, 6138, 6143,
6145, 6146, 6151, 6157, 6158, 6162, 6163, 6165, 6168, 6176,
6181, 6183, 6186, 6188, 6189, 6193, 6196, 6197, 6198, 6203,
6204, 6205, 6215, 6220, 6223, 6224, 6228, 6234, 6243, 6246,
6247, 6250, 6251, 6262, 6265, 6267, 6272, 6273, 6281, 6289,
6292, 6295, 6296, 6297, 6309, 6310, 6311, 6315, 6317, 6319,
6322, 6328, 6333, 6338, 6340, 6343, 6344, 6349, 6354, 6358,
6360, 6363, 6365, 6367, 6368, 6370, 6375, 6383, 6397, 6400,
6403, 6404, 6405, 6412, 6414, 6415, 6416, 6419, 6420, 6425,
6426, 6428, 6429, 6431, 6436, 6440, 6442, 6456, 6457, 6464,
6466, 6467, 6468, 6469, 6472, 6474, 6475, 6476, 6477, 6478,
6480, 6484, 6485, 6494, 6495, 6501, 6504, 6506, 6510, 6513,
6516, 6519, 6530, 6533, 6534, 6537, 6539, 6541, 6543, 6544,
6545, 6549, 6553, 6555, 6558, 6559, 6560, 6561, 6562, 6568,
6569, 6571, 6572, 6574, 6576, 6579, 6584, 6588, 6589, 6592,
6594, 6595, 6597, 6600, 6603, 6606, 6607, 6609, 6611, 6617,
6620, 6623, 6625, 6629, 6633, 6635, 6638, 6655, 6656, 6658,
6666, 6672, 6681, 6686, 6703, 6704, 6705, 6710, 6718, 6720,
6729, 6730, 6734, 6739, 6747, 6749, 6756, 6757, 6759, 6764, 6767, 6779, 6781, 6782, 6783, 6786, 6793, 6794, 6795, 6797, 6799, 6803, 6804, 6805, 6807, 6811, 6813, 6816, 6817, 6819, 6820, 6824, 6827, 6830, 6834, 6836, 6841, 6842, 6843, 6848, 6868, 6869, 6874, 6875, 6877, 6879, 6882, 6883, 6884, 6888, 6894, 6902, 6905, 6914, 6917, 6919, 6920, 6921, 6930, 6931, 6939, 6946, 6959, 6960, 6963, 6967, 6971, 6979, 6984, 6985, 6987, 6988, 6990, 6991, 6994, 6999, 7013, 7022, 7027, 7029, 7033, 7038, 7040, 7043, 7045, 7046, 7048, 7049, 7051, 7052, 7053, 7057, 7059, 7060, 7062, 7067, 7072, 7073, 7075, 7077, 7079, 7083, 7094, 7095, 7097, 7105, 7106, 7107, 7108, 7110, 7117, 7118, 7128, 7130, 7136, 7138, 7139, 7142, 7143, 7144, 7150, 7151, 7154, 7163, 7164, 7165, 7166, 7169, 7172, 7182, 7191, 7192, 7193, 7194, 7197, 7201, 7202, 7207, 7208, 7209, 7210, 7212, 7214, 7217, 7219, 7226, 7227, 7235, 7236, 7244, 7245, 7255, 7258, 7262, 7263, 7264, 7268, 7279, 7281, 7287, 7291, 7292, 7293, 7296, 7298, 7299, 7300, 7301, 7303, 7304, 7306, 7307, 7308, 7311, 7312, 7313, 7318, 7323, 7324, 7330, 7339, 7340, 7345, 7348, 7357, 7358, 7360, 7361, 7371, 7376, 7377, 7382, 7383, 7386, 7395, 7398, 7400, 7406, 7410, 7418, 7425, 7430, 7434, 7436, 7437, 7438, 7447, 7452, 7453, 7454, 7457, 7458, 7459, 7462, 7466, 7470, 7472, 7476, 7481, 7485, 7493, 7498, 7499, 7503, 7504, 7506, 7512, 7515, 7517, 7523, 7524, 7533, 7546, 7553, 7559, 7561, 7572, 7574, 7576, 7579, 7585, 7586, 7589, 7596, 7604, 7609, 7617, 7620, 7622, 7624, 7625, 7626, 7633, 7642, 7644, 7661, 7664, 7665, 7671, 7672, 7673, 7674, 7682, 7685, 7687, 7689, 7695, 7700, 7703, 7704, 7707, 7712, 7716, 7724, 7726, 7734, 7736, 7737, 7738, 7742, 7744, 7745, 7749, 7753, 7763, 7764, 7767, 7768, 7770, 7774, 7775, 7776, 7777, 7778, 7779, 7780, 7781, 7785, 7786, 7787, 7791, 7798, 7799, 7800, 7801, 7803, 7804, 7805, 7806, 7807, 7818, 7819, 7820, 7823, 7825, 7826, 7839, 7840, 7841, 7845, 7850, 7854, 7856, 7858, 7860, 7865, 7873, 7877, 7878, 7879, 7880, 7885, 7887, 7888, 7890, 7896, 7911, 7913, 7918, 7922, 7923, 7925, 7928, 7938, 7942, 7944, 7949, 7952, 7965, 7966, 7967, 7974, 7976, 7977, 7981, 7983, 7984, 7986, 7992, 7996, 8007, 8012, 8021, 8023, 8025, 8029, 8030, 8031, 8036, 8040, 8042, 8043, 8044, 8050, 8056, 8059, 8063, 8068, 8074, 8075, 8076, 8077, 8078, 8079, 8080, 8081, 8084, 8088, 8089, 8091, 8093, 8095, 8099, 8100, 8102, 8106, 8108, 8112, 8113, 8118, 8121, 8123, 8126, 8129, 8130, 8134, 8145, 8146, 8148, 8151, 8159, 8163, 8170, 8178, 8179, 8181, 8189, 8193, 8194, 8198, 8202, 8204, 8208, 8210, 8213, 8219, 8223, 8226, 8227, 8230, 8234, 8237, 8239, 8242, 8247, 8248, 8250, 8252, 8263, 8264, 8265, 8266, 8268, 8269, 8270, 8273, 8276, 8282, 8289, 8292, 8296, 8300, 8310, 8311, 8315, 8318, 8319, 8324, 8329, 8334, 8335, 8339, 8340, 8346, 8349, 8350, 8351, 8352, 8353, 8358, 8367, 8368, 8373, 8379, 8380, 8382, 8385, 8386, 8387, 8389, 8390, 8393, 8395, 8401, 8402, 8403, 8404, 8407, 8410, 8413, 8414, 8415, 8416, 8417, 8418, 8430, 8436, 8438, 8439, 8443, 8444, 8447, 8448, 8449, 8450, 8451, 8465, 8470, 8472, 8473, 8474, 8476, 8477, 8481, 8482, 8486, 8490, 8496, 8498, 8501, 8503, 8504, 8505, 8513, 8516, 8520, 8521, 8524, 8525, 8531, 8532, 8533, 8539, 8543, 8553, 8554, 8561, 8562, 8565, 8574, 8576, 8579, 8581, 8582, 8592, 8596, 8597, 8602, 8603, 8605, 8611, 8612, 8621, 8631, 8634, 8635, 8638, 8641, 8644, 8646, 8650, 8652, 8654, 8658, 8659, 8660, 8663, 8665, 8669, 8672, 8676, 8677, 8686, 8690, 8695, 8699, 8700, 8703, 8706, 8708, 8709, 8713, 8717, 8719, 8721, 8722, 8726, 8729, 8731, 8736, 8738, 8739, 8741, 8743, 8747, 8748, 8753, 8761, 8769, 8773, 8774, 8777, 8779, 8783, 8784, 8785, 8786, 8789, 8792, 8803, 8810, 8811, 8822, 8824, 8829, 8839, 8842, 8843, 8846, 8853, 8863, 8865, 8866, 8872, 8875, 8876, 8877, 8878, 8881, 8884, 8888, 8891, 8892, 8901, 8907, 8908, 8911, 8916, 8917, 8922, 8924, 8926, 8930, 8935, 8937, 8938, 8941, 8946, 8949, 8951, 8953, 8959, 8960, 8961, 8967, 8968, 8972, 8979, 8981, 8985, 8986, 8991, 8992, 8998, 9006, 9009, 9011, 9012, 9013, 9015, 9018, 9020, 9022, 9026, 9027, 9029, 9030, 9045, 9052, 9058, 9059, 9060, 9062, 9063, 9065, 9066, 9068, 9069, 9071, 9072, 9073, 9074, 9076, 9080, 9087, 9092, 9103, 9104, 9111, 9118, 9120, 9123, 9125, 9129, 9131, 9133, 9134, 9139, 9140, 9141, 9142, 9144, 9145, 9147, 9152, 9159, 9167, 9168, 9175, 9177, 9185, 9188, 9189, 9190, 9191, 9195, 9206, 9207, 9213, 9214, 9216, 9218, 9225, 9226, 9229, 9231, 9233, 9237, 9240, 9243, 9248, 9253, 9257, 9267, 9270, 9273, 9275, 9282, 9284, 9285, 9288, 9290, 9291, 9292, 9293, 9300, 9308, 9311, 9321, 9323, 9326, 9327, 9328, 9332, 9336, 9338, 9340, 9346, 9347, 9352, 9353, 9357, 9359, 9360, 9368, 9373, 9375, 9376, 9380, 9381, 9382, 9391, 9393, 9394, 9398, 9400, 9402, 9403, 9404, 9406, 9412, 9413, 9421, 9423, 9429, 9434, 9438, 9439, 9443, 9449, 9455, 9456, 9460, 9464, 9467, 9471, 9481, 9482, 9484, 9488, 9490, 9497, 9500, 9504, 9509, 9514, 9517, 9518, 9525, 9534, 9535, 9536, 9539, 9543, 9545, 9546, 9550, 9551, 9553, 9555, 9571, 9577, 9586, 9587, 9590, 9591, 9593, 9595, 9596, 9597, 9598, 9601, 9602, 9606, 9609, 9614, 9615, 9617, 9618, 9620, 9623, 9627, 9629, 9632, 9641, 9642, 9644, 9645, 9655, 9658, 9663, 9668, 9671, 9674, 9679, 9680, 9682, 9686, 9698, 9699, 9701, 9706, 9710, 9711, 9718, 9721, 9723, 9729, 9730, 9731, 9737, 9742, 9744, 9745, 9746, 9750, 9756, 9758, 9763, 9770, 9774, 9776, 9777, 9782, 9786, 9791, 9792, 9793, 9794, 9798, 9799, 9804, 9807, 9810, 9811, 9812, 9813, 9819, 9821, 9825, 9828, 9829, 9835, 9847, 9869, 9873, 9878, 9882, 9886, 9887, 9889, 9892, 9897, 9907, 9909, 9912, 9923, 9924, 9928, 9930, 9935, 9936, 9938, 9940, 9946, 9949, 9950, 9952, 9953, 9962, 9963, 9964, 9967, 9968, 9969, 9972, 9973, 9975, 9976, 9980, 9982, 9984, 9985, 9987, 9988, 9990, 9991, 9992, 9995, 9997, 10000, 10008, 10012, 10013, 10017, 10018, 10019, 10020, 10026, 10027, 10032, 10033, 10034, 10035, 10037, 10041, 10047, 10049, 10051, 10053, 10055, 10058, 10059, 10062, 10064, 10066, 10073, 10077, 10078, 10080, 10081, 10083, 10091, 10092, 10094, 10095, 10101, 10103, 10106, 10110, 10115, 10116, 10120, 10122, 10127, 10128, 10131, 10136, 10140, 10143, 10151, 10156, 10157, 10158, 10160, 10163, 10165, 10166, 10168, 10174, 10176, 10178, 10181, 10184, 10187, 10191, 10192, 10193, 10194, 10196, 10199, 10200, 10201, 10206, 10212, 10217, 10218, 10219, 10220, 10222, 10223, 10225, 10231, 10233, 10236, 10237, 10239, 10249, 10253, 10254, 10259, 10262, 10263, 10266, 10267, 10269, 10270, 10275, 10277, 10278, 10284, 10286, 10291, 10292, 10293, 10295, 10300, 10302, 10306, 10307, 10312, 10314, 10318, 10323, 10324, 10326, 10331, 10334, 10336, 10340, 10343, 10346, 10353, 10356, 10357, 10362, 10364, 10371, 10374, 10375, 10376, 10380, 10388, 10392, 10393, 10397, 10398, 10399, 10401, 10402, 10408, 10414, 10416, 10417, 10421, 10423, 10425, 10426, 10435, 10438, 10440, 10446, 10450, 10452, 10453, 10456, 10463, 10464, 10465, 10468, 10469, 10471, 10474, 10480, 10482, 10487, 10488, 10490, 10494, 10496, 10499, 10500, 10504, 10506, 10508, 10513, 10518, 10522, 10523, 10524, 10527, 10528, 10530, 10531, 10532, 10536, 10537, 10541, 10542, 10543, 10544, 10548, 10555, 10562, 10563, 10567, 10569, 10573, 10580, 10581, 10582, 10588, 10593, 10596, 10599, 10601, 10602, 10611, 10613, 10615, 10616, 10621, 10622, 10637, 10638, 10639, 10640, 10645, 10646, 10655, 10665, 10670, 10671, 10676, 10678, 10679, 10682, 10683, 10684, 10685, 10687, 10693, 10698, 10701, 10705, 10707, 10716, 10721, 10726, 10729, 10738, 10740, 10741, 10744, 10747, 10748, 10749, 10752, 10756, 10770, 10775, 10776, 10778, 10779, 10784, 10785, 10787, 10788, 10801, 10802, 10803, 10804, 10805, 10813, 10818, 10819, 10823, 10824, 10827, 10831, 10833, 10836, 10838, 10839, 10843, 10844, 10850, 10851, 10853, 10854, 10858, 10860, 10866, 10867, 10870, 10877, 10880, 10898, 10899, 10901, 10902, 10911, 10917, 10918, 10920, 10926, 10927, 10928, 10929, 10930, 10933, 10934, 10938, 10940, 10941, 10942, 10947, 10955, 10966, 10967, 10972, 10974, 10976, 10977, 10978, 10979, 10985, 10988, 10993, 10996, 11004, 11008, 11021, 11022, 11027, 11039, 11046, 11047, 11050, 11051, 11052, 11053, 11056, 11058, 11060, 11066, 11067, 11078, 11082, 11083, 11086, 11100, 11103, 11107, 11110, 11114, 11116, 11117, 11118, 11122, 11123, 11126, 11128, 11129, 11131, 11133, 11136, 11137, 11138, 11141, 11145, 11147, 11149, 11152, 11154, 11160, 11161, 11163, 11165, 11168, 11169, 11177, 11181, 11187, 11188, 11190, 11192, 11194, 11198, 11202, 11214, 11217, 11218, 11222, 11224, 11226, 11227, 11228, 11230, 11233, 11236, 11237, 11238, 11239, 11241, 11242, 11243, 11246, 11247, 11251, 11253, 11254, 11255, 11256, 11258, 11260, 11262, 11263, 11266, 11274, 11284, 11292, 11293, 11295, 11296, 11297, 11299, 11304, 11305, 11306, 11313, 11315, 11318, 11330, 11331, 11337, 11338, 11345, 11346, 11348, 11352, 11362, 11363, 11364, 11365, 11371, 11373, 11377, 11380, 11382, 11387, 11388, 11391, 11392, 11394, 11395, 11401, 11404, 11405, 11417, 11424, 11427, 11428, 11430, 11431, 11435, 11443, 11445, 11446, 11449, 11456, 11459, 11461, 11465, 11466, 11472, 11475, 11477, 11478, 11487, 11489, 11490, 11491, 11496, 11497, 11498, 11499, 11500, 11501, 11505, 11507, 11520, 11523, 11524, 11526, 11527, 11531, 11532, 11533, 11540, 11541, 11548, 11551, 11553, 11558, 11560, 11561, 11567, 11568, 11574, 11576, 11577, 11578, 11588, 11593, 11594, 11595, 11596, 11597, 11599, 11604, 11607, 11611, 11612, 11615, 11617, 11618, 11619, 11623, 11628, 11639, 11640, 11647, 11656, 11657, 11658, 11673, 11678, 11682, 11688, 11691, 11692, 11694, 11695, 11696, 11699, 11701, 11703, 11705, 11707, 11712, 11718, 11720, 11721, 11725, 11726, 11730, 11731, 11733, 11736, 11740, 11743, 11753, 11756, 11760, 11763, 11765, 11768, 11770, 11771, 11776, 11777, 11778, 11783, 11784, 11786, 11788, 11789, 11792, 11794, 11797, 11799, 11800, 11805, 11806, 11809, 11811, 11814, 11818, 11828, 11830, 11835, 11837, 11839, 11846, 11848, 11858, 11861, 11864, 11865, 11867, 11868, 11870, 11872, 11876, 11877, 11879, 11891, 11892, 11894, 11895, 11897, 11898, 11901, 11902, 11906, 11909, 11911, 11913, 11915, 11916, 11917, 11919, 11920, 11921, 11923, 11924, 11926, 11928, 11929, 11930, 11934, 11940, 11943, 11945, 11947, 11953, 11955, 11956, 11959, 11960, 11961, 11962, 11963, 11965, 11966, 11973, 11974, 11975, 11977, 11978, 11979, 11983, 11988, 11991, 11993, 11997, 11998, 11999, 12002, 12004, 12008, 12015, 12021, 12026, 12032, 12033, 12038, 12042, 12043, 12044, 12052, 12059, 12060, 12068, 12077, 12080, 12081, 12083, 12092, 12093, 12098, 12104, 12106, 12109, 12110, 12112, 12118, 12122, 12126, 12128, 12129, 12137, 12138, 12140, 12143, 12145, 12146, 12149, 12161, 12165, 12166, 12167, 12170, 12171, 12174, 12175, 12176, 12181, 12185, 12186, 12191, 12197, 12200, 12201, 12204, 12207, 12208, 12213, 12215, 12217, 12218, 12219, 12220, 12221, 12223, 12227, 12228, 12233, 12234, 12237, 12240, 12243, 12245, 12250, 12252, 12256, 12259, 12260, 12263, 12267, 12269, 12274, 12278, 12283, 12287, 12291, 12297, 12298, 12304, 12310, 12311, 12313, 12314, 12315, 12317, 12321, 12323, 12329, 12333, 12341, 12342, 12347, 12354, 12356, 12358, 12359, 12364, 12367, 12368, 12369, 12370, 12374, 12379, 12380, 12381, 12383, 12397, 12400, 12401, 12403, 12406, 12410, 12414, 12419, 12420, 12421, 12424, 12426, 12437, 12440, 12441, 12445, 12450, 12451, 12454, 12455, 12456, 12457, 12462, 12467, 12468, 12476, 12478, 12479, 12481, 12487, 12488, 12489, 12490, 12497, 12499, 12503, 12504, 12508, 12509, 12530, 12536, 12545, 12546, 12547, 12549, 12555, 12559, 12561, 12563, 12564, 12565, 12567, 12572, 12578, 12585, 12588, 12605, 12608, 12609, 12611, 12616, 12619, 12622, 12623, 12633, 12634, 12635, 12636, 12638, 12641, 12649, 12651, 12658, 12663, 12668, 12670, 12671, 12672, 12675, 12676, 12679, 12680, 12681, 12683, 12684, 12685, 12691, 12695, 12699, 12701, 12702, 12703, 12713, 12718, 12719, 12726, 12729, 12731, 12732, 12733, 12737, 12738, 12739, 12741, 12742, 12749, 12751, 12752, 12754, 12755, 12757, 12758, 12760, 12762, 12764, 12766, 12771, 12772, 12773, 12778, 12783, 12788, 12790, 12794, 12797, 12802, 12803, 12810, 12812, 12813, 12817, 12822, 12824, 12826, 12827, 12828, 12834, 12836, 12838, 12839, 12843, 12844, 12849, 12858, 12861, 12866, 12873, 12887, 12888, 12893, 12895, 12898, 12900, 12904, 12905, 12906, 12910, 12913, 12914, 12916, 12917, 12918, 12920, 12921, 12926, 12927, 12929, 12932, 12938, 12939, 12944, 12945, 12946, 12947, 12963, 12966, 12967, 12968, 12969, 12973, 12976, 12978, 12982, 12983, 12984, 12986, 12987, 12998, 13010, 13011, 13014, 13017, 13022, 13024, 13030, 13033, 13035, 13038, 13040, 13041, 13042, 13050, 13053, 13055, 13056, 13057, 13060, 13061, 13064, 13065, 13066, 13071, 13074, 13079, 13085, 13086, 13087, 13095, 13100, 13102, 13115, 13117, 13118, 13123, 13124, 13131, 13135, 13142, 13148, 13149, 13153, 13160, 13169, 13175, 13177, 13182, 13189, 13197, 13199, 13205, 13207, 13209, 13210, 13213, 13215, 13217, 13221, 13222, 13224, 13227, 13232, 13234, 13235, 13236, 13237, 13238, 13243, 13248, 13249, 13251, 13255, 13258, 13259, 13260, 13261, 13263, 13264, 13269, 13273, 13275, 13276, 13301, 13303, 13304, 13315, 13317, 13318, 13320, 13321, 13322, 13323, 13326, 13328, 13329, 13330, 13332, 13335, 13337, 13340, 13343, 13346, 13348, 13351, 13352, 13353, 13354, 13361, 13363, 13367, 13369, 13375, 13380, 13381, 13384, 13393, 13394, 13396, 13397, 13401, 13408, 13415, 13416, 13417, 13419, 13420, 13423, 13424, 13429, 13433, 13439, 13441, 13444, 13448, 13450, 13454, 13456, 13466, 13467, 13468, 13473, 13475, 13494, 13496, 13498, 13499, 13500, 13504, 13505, 13506, 13513, 13514, 13515, 13516, 13517, 13519, 13520, 13521, 13524, 13530, 13532, 13539, 13543, 13544, 13546, 13547, 13549, 13552, 13567, 13568, 13569, 13574, 13584, 13587, 13589, 13595, 13598, 13601, 13604, 13612, 13621, 13623, 13626, 13631, 13632, 13635, 13636, 13637, 13640, 13641, 13647, 13649, 13650, 13652, 13654, 13661, 13662, 13663, 13668, 13671, 13675, 13677, 13683, 13684, 13687, 13688, 13689, 13695, 13697, 13698, 13700, 13702, 13704, 13713, 13716, 13720, 13721, 13726, 13728, 13729, 13730, 13733, 13737, 13739, 13742, 13745, 13748, 13750, 13755, 13756, 13761, 13764, 13766, 13768, 13769, 13773, 13775, 13781, 13782, 13783, 13786, 13787, 13789, 13790, 13791, 13794, 13796, 13798, 13809, 13816, 13817, 13818, 13819, 13820, 13822, 13823, 13827, 13828, 13830, 13831, 13833, 13835, 13839, 13843, 13849, 13852, 13853, 13859, 13860, 13862, 13866, 13869, 13870, 13872, 13873, 13874, 13877, 13881, 13882, 13891, 13892, 13894, 13896, 13901, 13904, 13906, 13909, 13910, 13911, 13917, 13927, 13930, 13938, 13948, 13949, 13952, 13954, 13956, 13969, 13970, 13975, 13976, 13981, 13984, 13991, 14000, 14001, 14008, 14009, 14021, 14022, 14026, 14027, 14028, 14030, 14031, 14036, 14041, 14043, 14049, 14052, 14062, 14063, 14064, 14066, 14069, 14070, 14071, 14075, 14076, 14081, 14084, 14086, 14087, 14092, 14093, 14094, 14106, 14107, 14110, 14115, 14116, 14118, 14120, 14122, 14129, 14132, 14135, 14138, 14139, 14145, 14146, 14148, 14149, 14150.

Promoters expressing in endosperm/embryo tissue at 3 days after planting include SEQ IDs: 1, 3, 4, 7, 13, 14, 15, 29, 31, 32, 36, 48, 53, 54, 56, 64, 65, 68, 69, 70, 71, 81, 82, 88, 93, 96, 97, 99, 101, 102, 103, 107, 108, 110, 112, 117, 130, 131, 132, 143, 148, 152, 153, 156, 157, 159, 162, 164, 174, 175, 176, 177, 179, 181, 183, 187, 194, 195, 196, 197, 199, 202, 203, 204, 205, 210, 211, 212, 215, 217, 223, 231, 232, 235, 236, 237, 240, 242, 243, 244, 246, 249, 250, 251, 257, 259, 262, 264, 271, 273, 274, 279, 280, 281, 286, 288, 289, 291, 294, 299, 301, 302, 303, 305, 306, 316, 319, 320, 323, 328, 329, 332, 335, 341, 346, 348, 349, 352, 354, 356, 358, 360, 364, 365, 368, 371, 373, 374, 378, 379, 387, 388, 396, 401, 406, 407, 412, 419, 420, 423, 424, 429, 433, 434, 436, 444, 452, 454, 456, 461, 463, 466, 471, 474, 478, 479, 481, 483, 484, 485, 488, 498, 501, 502, 509, 510, 512, 513, 514, 515, 516, 517, 520, 522, 523, 525, 529, 532, 533, 534, 536, 538, 541, 544, 546, 547, 553, 554, 557, 560, 564, 565, 569, 580, 585, 591, 593, 594, 595, 596, 598, 599, 601, 602, 604, 605, 607, 611, 613, 614, 620, 623, 630, 631, 633, 635, 641, 643, 644, 650, 653, 662, 663, 665, 666, 670, 671, 681, 683, 686, 693, 694, 699, 701, 705, 707, 708, 716, 717, 719, 722, 724, 726, 727, 733, 734, 736, 739, 742, 744, 749, 753, 757, 759, 763, 765, 768, 770, 771, 782, 783, 784, 785, 792, 793, 795, 797, 800, 806, 808, 812, 813, 819, 820, 821, 823, 829, 830, 833, 836, 839, 840, 842, 844, 845, 850, 855, 857, 859, 860, 862, 863, 864, 865, 868, 871, 872, 877, 878, 883, 884, 885, 887, 890, 891, 892, 893, 895, 898, 902, 903, 907, 910, 911, 912, 913, 916, 917, 920, 924, 928, 929, 931, 932, 936, 938, 943, 944, 951, 953, 954, 958, 959, 961, 962, 964, 966, 974, 979, 980, 982, 987, 994, 995, 997, 999, 1006, 1007, 1009, 1011, 1014, 1017, 1022, 1026, 1032, 1035, 1038, 1041, 1042, 1043, 1045, 1047, 1049, 1050, 1051, 1052, 1054, 1055, 1056, 1064, 1065, 1069, 1072, 1073, 1077, 1078, 1085, 1086, 1087, 1088, 1089, 1092, 1095, 1101, 1103, 1104, 1108, 1110, 1111, 1112, 1114, 1115, 1117, 1118, 1119, 1120, 1122, 1125, 1127, 1130, 1132, 1133, 1136, 1137, 1143, 1144, 1146, 1147, 1148, 1154, 1162, 1165, 1170, 1171, 1174, 1175, 1176, 1178, 1189, 1190, 1191, 1196, 1199, 1200, 1202, 1204, 1205, 1208, 1213, 1214, 1217, 1218, 1220, 1223, 1225, 1227, 1228, 1230, 1231, 1233, 1236, 1239, 1240, 1241, 1244, 1248, 1250, 1252, 1253, 1254, 1256, 1257, 1258, 1261, 1264, 1265, 1272, 1281, 1282, 1285, 1286, 1291, 1292, 1293, 1295, 1296, 1297, 1306, 1307, 1309, 1312, 1316, 1317, 1320, 1325, 1327, 1330, 1331, 1334, 1335, 1337, 1346, 1349, 1351, 1354, 1355, 1360, 1364, 1368, 1371, 1373, 1376, 1377, 1380, 1381, 1382, 1388, 1393, 1394, 1396, 1398, 1399, 1403, 1404, 1405, 1407, 1409, 1410, 1412, 1415, 1420, 1421, 1423, 1426, 1431, 1439, 1440, 1441, 1442, 1444, 1448, 1451, 1453, 1454, 1455, 1459, 1462, 1466, 1474, 1475, 1481, 1486, 1488, 1490, 1493, 1498, 1499, 1501, 1503, 1514, 1517, 1518, 1525, 1526, 1527, 1530, 1533, 1539, 1540, 1543, 1545, 1546, 1548, 1549, 1556, 1560, 1567, 1568, 1571, 1575, 1584, 1586, 1589, 1590, 1592, 1593, 1594, 1599, 1600, 1602, 1604, 1605, 1608, 1612, 1614, 1615, 1616, 1622, 1625, 1628, 1629, 1630, 1634, 1635, 1637, 1638, 1639, 1648, 1650, 1658, 1659, 1662, 1663, 1668, 1669, 1671, 1673, 1675, 1676, 1677, 1680, 1683, 1685, 1688, 1689, 1691, 1699, 1705, 1706, 1707, 1708, 1709, 1710, 1712, 1717, 1721, 1723, 1725, 1726, 1727, 1729, 1731, 1732, 1735, 1740, 1755, 1759, 1764, 1765, 1766, 1768, 1771, 1782, 1784, 1785, 1813, 1815, 1816, 1820, 1828, 1830, 1832, 1834, 1835, 1836, 1839, 1840, 1845, 1850, 1852, 1858, 1859, 1867, 1868, 1869, 1870, 1872, 1873, 1874, 1883, 1886, 1888, 1894, 1895, 1897, 1898, 1899, 1900, 1902, 1903, 1904, 1905, 1906, 1911, 1916, 1918, 1920, 1923, 1924, 1936, 1940, 1944, 1945, 1950, 1952, 1953, 1955, 1973, 1981, 1990, 1991, 1992, 1993, 1994, 1995, 1996, 1999, 2000, 2003, 2007, 2008, 2009, 2010, 2012, 2013, 2014, 2015, 2017, 2026, 2031, 2032, 2033, 2039, 2041, 2043, 2045, 2048, 2060, 2062, 2064, 2066, 2071, 2072, 2074, 2077, 2082, 2083, 2088, 2089, 2091, 2094, 2096, 2097, 2099, 2103, 2104, 2107, 2109, 2112, 2119, 2122, 2126, 2128, 2132, 2133, 2134, 2136, 2140, 2142, 2143, 2144, 2147, 2150, 2152, 2154, 2155, 2156, 2157, 2159, 2161, 2162, 2163, 2164, 2165, 2166, 2168, 2170, 2172, 2177, 2178, 2179, 2185, 2191, 2193, 2196, 2201, 2202, 2203, 2205, 2206, 2215, 2216, 2221, 2222, 2225, 2226, 2227, 2229, 2230, 2231, 2240, 2253, 2257, 2260, 2262, 2263, 2265, 2273, 2274, 2278, 2280, 2281, 2282, 2283, 2288, 2293, 2295, 2296, 2298, 2303, 2304, 2305, 2306, 2314, 2322, 2323, 2328, 2329, 2331, 2335, 2339, 2342, 2349, 2351, 2352, 2353, 2354, 2360, 2361, 2362, 2363, 2366, 2367, 2371, 2375, 2379, 2381, 2382, 2384, 2385, 2398, 2401, 2403, 2405, 2410, 2411, 2412, 2413, 2418, 2419, 2420, 2422, 2423, 2430, 2431, 2435, 2437, 2438, 2439, 2441, 2442, 2443, 2445, 2451, 2452, 2453, 2454, 2457, 2465, 2466, 2470, 2471, 2472, 2474, 2476, 2481, 2482, 2483, 2490, 2492, 2494, 2495, 2496, 2498, 2500, 2504, 2505, 2507, 2509, 2510, 2511, 2514, 2517, 2525, 2528, 2529, 2531, 2532, 2533, 2535, 2536, 2538, 2539, 2541, 2543, 2549, 2551, 2552, 2554, 2555, 2556, 2557, 2564, 2567, 2568, 2573, 2576, 2577, 2578, 2581, 2583, 2588, 2589, 2590, 2592, 2594, 2599, 2601, 2605, 2609, 2611, 2613, 2616, 2617, 2618, 2625, 2626, 2627, 2632, 2634, 2636, 2637, 2639, 2644, 2648, 2652, 2655, 2671, 2674, 2675, 2684, 2685, 2687, 2689, 2691, 2694, 2700, 2707, 2719, 2725, 2726, 2727, 2728, 2729, 2735, 2739, 2740, 2742, 2746, 2747, 2749, 2752, 2756, 2757, 2763, 2764, 2770, 2773, 2780, 2782, 2784, 2787, 2800, 2801, 2802, 2805, 2808, 2812, 2819, 2820, 2821, 2822, 2824, 2826, 2827, 2828, 2829, 2831, 2832, 2840, 2844, 2850, 2858, 2861, 2862, 2864, 2865, 2866, 2871, 2873, 2876, 2888, 2889, 2901, 2902, 2903, 2909, 2910, 2911, 2915, 2916, 2917, 2919, 2923, 2926, 2930, 2932, 2933, 2934, 2935, 2944, 2946, 2948, 2953, 2955, 2959, 2962, 2963, 2966, 2968, 2972, 2976, 2979, 2980, 2985, 2993, 2994, 2998, 3002, 3003, 3005, 3007, 3008, 3015, 3023, 3029, 3038, 3039, 3043, 3044, 3048, 3049, 3051, 3052, 3053, 3055, 3062, 3064, 3067, 3072, 3076, 3078, 3080, 3081, 3083, 3084, 3085, 3087, 3090, 3096, 3100, 3105, 3106, 3109, 3114, 3118, 3119, 3120, 3121, 3123, 3126, 3127, 3128, 3137, 3138, 3139, 3143, 3147, 3153, 3154, 3156, 3167, 3170, 3173, 3177, 3181, 3185, 3187, 3189, 3192, 3194, 3204, 3205, 3206, 3210, 3212, 3214, 3219, 3220, 3224, 3225, 3227, 3228, 3236, 3237, 3239, 3240, 3244, 3245, 3246, 3250, 3252, 3255, 3261, 3263, 3266, 3268, 3271, 3280, 3283, 3286, 3288, 3290, 3291, 3294, 3295, 3299, 3301, 3303, 3310, 3312, 3327, 3331, 3332, 3333, 3340, 3343, 3345, 3347, 3349, 3351, 3353, 3355, 3357, 3358, 3359, 3360, 3361, 3363, 3370, 3374, 3377, 3380, 3383, 3386, 3397, 3399, 3402, 3404, 3405, 3409, 3415, 3416, 3418, 3422, 3424, 3426, 3428, 3435, 3438, 3441, 3442, 3445, 3446, 3447, 3449, 3450, 3451, 3452, 3455, 3458, 3460, 3461, 3464, 3466, 3468, 3470, 3471, 3473, 3474, 3477, 3482, 3486, 3488, 3490, 3491, 3496, 3500, 3503, 3504, 3506, 3509, 3510, 3511, 3516, 3517, 3518, 3533, 3536, 3537, 3541, 3544, 3545, 3548, 3549, 3552, 3554, 3558, 3560, 3562, 3563, 3569, 3572, 3574, 3576, 3577, 3587, 3588, 3589, 3592, 3593, 3595, 3596, 3597, 3598, 3600, 3603, 3604, 3606, 3607, 3610, 3611, 3612, 3613, 3616, 3618, 3620, 3621, 3624, 3629, 3633, 3635, 3637, 3638, 3640, 3642, 3643, 3644, 3645, 3646, 3655, 3657, 3659, 3660, 3662, 3663, 3667, 3668, 3669, 3671, 3672, 3674, 3677, 3682, 3684, 3685, 3697, 3704, 3706, 3707, 3713, 3715, 3717, 3718, 3719, 3720, 3724, 3732, 3738, 3739, 3748, 3749, 3752, 3754, 3761, 3762, 3764, 3765, 3766, 3777, 3778, 3783, 3784, 3788, 3790, 3791, 3792, 3794, 3796, 3798, 3800, 3804, 3808, 3812, 3818, 3820, 3823, 3825, 3828, 3829, 3830, 3831, 3832, 3833, 3836, 3839, 3842, 3843, 3844, 3845, 3847, 3849, 3858, 3860, 3862, 3867, 3868, 3871, 3872, 3873, 3876, 3877, 3882, 3883, 3885, 3887, 3889, 3890, 3891, 3892, 3895, 3908, 3910, 3911, 3912, 3914, 3917, 3923, 3924, 3926, 3929, 3938, 3947, 3950, 3954, 3958, 3962, 3967, 3972, 3974, 3975, 3983, 3985, 3987, 3988, 3994, 3996, 3997, 4000, 4001, 4002, 4003, 4006, 4008, 4013, 4014, 4015, 4021, 4024, 4026, 4030, 4032, 4034, 4039, 4040, 4041, 4045, 4047, 4048, 4050, 4054, 4056, 4057, 4058, 4062, 4066, 4067, 4068, 4069, 4072, 4074, 4075, 4077, 4078, 4079, 4081, 4084, 4092, 4096, 4099, 4102, 4103, 4105, 4108, 4110, 4113, 4116, 4122, 4124, 4128, 4133, 4143, 4146, 4148, 4149, 4150, 4156, 4158, 4160, 4161, 4162, 4163, 4165, 4166, 4167, 4168, 4169, 4170, 4171, 4175, 4178, 4184, 4187, 4188, 4189, 4198, 4201, 4202, 4205, 4206, 4207, 4208, 4210, 4211, 4212, 4214, 4217, 4219, 4221, 4222, 4227, 4228, 4231, 4233, 4235, 4244, 4250, 4251, 4255, 4257, 4260, 4261, 4263, 4265, 4266, 4270, 4272, 4275, 4279, 4280, 4281, 4292, 4294, 4296, 4298, 4301, 4302, 4304, 4309, 4312, 4320, 4321, 4324, 4329, 4330, 4331, 4333, 4335, 4336, 4341, 4343, 4344, 4347, 4349, 4352, 4354, 4355, 4356, 4357, 4359, 4360, 4365, 4369, 4378, 4380, 4382, 4383, 4388, 4390, 4391, 4394, 4397, 4402, 4404, 4405, 4410, 4415, 4419, 4422, 4423, 4426, 4431, 4439, 4444, 4446, 4448, 4450, 4453, 4456, 4458, 4460, 4461, 4462, 4463, 4464, 4466, 4468, 4472, 4474, 4479, 4485, 4492, 4494, 4502, 4506, 4507, 4508, 4512, 4513, 4514, 4515, 4518, 4519, 4522, 4531, 4534, 4535, 4545, 4548, 4549, 4554, 4555, 4556, 4557, 4558, 4562, 4565, 4566, 4567, 4568, 4570, 4575, 4582, 4583, 4584, 4586, 4590, 4591, 4595, 4596, 4601, 4604, 4606, 4611, 4621, 4625, 4632, 4633, 4634, 4635, 4641, 4643, 4644, 4645, 4650, 4653, 4654, 4655, 4659, 4666, 4667, 4669, 4670, 4671, 4677, 4680, 4682, 4684, 4685, 4687, 4694, 4697, 4699, 4700, 4702, 4704, 4706, 4708, 4710, 4719, 4721, 4725, 4729, 4737, 4738, 4740, 4747, 4748, 4749, 4750, 4751, 4753, 4754, 4755, 4756, 4759, 4761, 4762, 4763, 4765, 4766, 4771, 4775, 4779, 4789, 4790, 4794, 4795, 4803, 4804, 4813, 4814, 4817, 4818, 4822, 4823, 4824, 4828, 4829, 4830, 4831, 4833, 4834, 4836, 4837, 4838, 4856, 4857, 4862, 4864, 4869, 4870, 4872, 4875, 4878, 4880, 4881, 4887, 4891, 4895, 4901, 4902, 4904, 4905, 4909, 4914, 4918, 4921, 4923, 4924, 4925, 4926, 4930, 4935, 4936, 4938, 4939, 4940, 4943, 4950, 4955, 4960, 4965, 4971, 4972, 4973, 4975, 4977, 4979, 4980, 4984, 4988, 4989, 4990, 4992, 4994, 4996, 5000, 5022, 5026, 5029, 5030, 5034, 5039, 5040, 5042, 5044, 5046, 5052, 5054, 5057, 5059, 5063, 5067, 5068, 5072, 5078, 5082, 5086, 5088, 5089, 5091, 5094, 5095, 5100, 5102, 5106, 5111, 5114, 5122, 5123, 5129, 5131, 5132, 5136, 5137, 5140, 5143, 5145, 5147, 5149, 5151, 5152, 5153, 5157, 5160, 5164, 5165, 5168, 5170, 5171, 5174, 5180, 5182, 5185, 5188, 5189, 5190, 5191, 5192, 5196, 5198, 5199, 5200, 5202, 5203, 5206, 5208, 5211, 5212, 5214, 5216, 5217, 5219, 5225, 5226, 5228, 5229, 5230, 5234, 5239, 5240, 5241, 5243, 5248, 5249, 5251, 5253, 5255, 5263, 5264, 5265, 5266, 5267, 5273, 5275, 5276, 5280, 5281, 5283, 5289, 5290, 5291, 5292, 5293, 5298, 5299, 5300, 5301, 5303, 5308, 5311, 5313, 5317, 5324, 5329, 5330, 5334, 5339, 5344, 5346, 5347, 5348, 5350, 5351, 5359, 5360, 5361, 5363, 5364, 5372, 5382, 5383, 5386, 5388, 5389, 5393, 5394, 5395, 5396, 5397, 5398, 5403, 5407, 5409, 5411, 5414, 5417, 5426, 5431, 5434, 5438, 5439, 5448, 5449, 5450, 5452, 5456, 5457, 5458, 5459, 5463, 5464, 5467, 5469, 5474, 5476, 5482, 5483, 5493, 5495, 5496, 5498, 5506, 5508, 5510, 5512, 5513, 5515, 5516, 5517, 5518, 5519, 5520, 5521, 5524, 5529, 5530, 5531, 5535, 5537, 5543, 5547, 5557, 5558, 5561, 5562, 5565, 5568, 5569, 5579, 5583, 5585, 5588, 5589, 5591, 5597, 5598, 5604, 5612, 5613, 5616, 5618, 5627, 5631, 5632, 5633, 5635, 5638, 5640, 5642, 5643, 5647, 5648, 5651, 5652, 5657, 5659, 5660, 5662, 5663, 5670, 5671, 5675, 5676, 5677, 5680, 5688, 5689, 5694, 5695, 5697, 5698, 5702, 5703, 5706, 5709, 5711, 5717, 5718, 5721, 5722, 5731, 5734, 5735, 5739, 5744, 5751, 5756, 5757, 5763, 5768, 5771, 5775, 5779, 5780, 5784, 5785, 5788, 5789, 5791, 5794, 5803, 5807, 5808, 5809, 5811, 5813, 5817, 5820, 5823, 5828, 5831, 5833, 5835, 5836, 5837, 5839, 5846, 5850, 5852, 5853, 5854, 5855, 5859, 5861, 5864, 5865, 5866, 5867, 5869, 5870, 5872, 5878, 5879, 5881, 5883, 5884, 5885, 5886, 5887, 5888, 5890, 5892, 5893, 5907, 5919, 5922, 5925, 5926, 5927, 5928, 5932, 5934, 5936, 5938, 5941, 5944, 5948, 5951, 5954, 5956, 5957, 5959, 5961, 5967, 5968, 5971, 5982, 5988, 5989, 5991, 5994, 5996, 6000, 6002, 6004, 6006, 6009, 6013, 6016, 6017, 6023, 6025, 6026, 6033, 6038, 6041, 6044, 6045, 6048, 6051, 6058, 6059, 6062, 6063, 6065, 6069, 6070, 6073, 6074, 6075, 6080, 6081, 6084, 6085, 6087, 6088, 6089, 6090, 6092, 6093, 6097, 6098, 6099, 6107, 6108, 6109, 6110, 6113, 6116, 6118, 6121, 6124, 6129, 6131, 6132, 6133, 6137, 6138, 6143, 6145, 6146, 6151, 6153, 6157, 6158, 6160, 6162, 6163, 6164, 6165, 6176, 6181, 6183, 6186, 6188, 6189, 6193, 6194, 6195, 6196, 6197, 6198, 6203, 6204, 6205, 6215, 6220, 6223, 6224, 6227, 6228, 6234, 6237, 6243, 6246, 6247, 6250, 6251, 6262, 6264, 6265, 6267, 6272, 6273, 6281, 6282, 6286, 6288, 6289, 6292, 6297, 6299, 6300, 6309, 6310, 6311, 6315, 6317, 6319, 6322, 6323, 6328, 6333, 6342, 6343, 6344, 6349, 6353, 6354, 6356, 6358, 6360, 6363, 6365, 6367, 6370, 6372, 6373, 6375, 6381, 6383, 6394, 6397, 6399, 6403, 6404, 6405, 6408, 6412, 6414, 6415, 6419, 6420, 6422, 6425, 6426, 6427, 6428, 6429, 6430, 6431, 6436, 6440, 6442, 6449, 6456, 6463, 6464, 6466, 6467, 6468, 6470, 6472, 6474, 6475, 6476, 6477, 6478, 6480, 6482, 6484, 6485, 6488, 6494, 6495, 6501, 6504, 6510, 6513, 6517, 6519, 6530, 6532, 6533, 6534, 6535, 6537, 6539, 6543, 6544, 6545, 6547, 6549, 6553, 6555, 6558, 6559, 6562, 6564, 6567, 6569, 6571, 6572, 6574, 6576, 6579, 6581, 6584, 6588, 6589, 6592, 6594, 6595, 6596, 6597, 6599, 6600, 6607, 6609, 6610, 6611, 6615, 6616, 6617, 6620, 6623, 6625, 6626, 6629, 6633, 6634, 6635, 6638, 6639, 6646, 6647, 6649, 6653, 6655, 6656, 6658, 6661, 6666, 6672, 6681, 6682, 6686, 6693, 6703, 6704, 6705, 6716, 6718, 6720, 6729, 6730, 6734, 6736, 6739, 6742, 6747, 6749, 6756, 6757, 6759, 6761, 6764, 6767, 6778, 6779, 6782, 6783, 6786, 6788, 6793, 6794, 6795, 6797, 6799, 6803, 6804, 6805, 6807, 6811, 6813, 6816, 6817, 6819, 6820, 6824, 6826, 6827, 6828, 6830, 6831, 6834, 6836, 6840, 6841, 6842, 6843, 6848, 6851, 6859, 6863, 6868, 6869, 6874, 6875, 6877, 6879, 6881, 6882, 6883, 6884, 6886, 6887, 6888, 6894, 6902, 6903, 6907, 6909, 6913, 6917, 6919, 6921, 6924, 6925, 6930, 6939, 6946, 6950, 6952, 6954, 6959, 6960, 6963, 6967, 6970, 6971, 6979, 6980, 6981, 6984, 6985, 6987, 6988, 6990, 6991, 6994, 6999, 7003, 7013, 7022, 7027, 7029, 7033, 7038, 7039, 7040, 7043, 7045, 7046, 7048, 7049, 7051, 7053, 7057, 7059, 7060, 7062, 7064, 7067, 7072, 7073, 7075, 7077, 7079, 7083, 7084, 7094, 7096, 7097, 7105, 7106, 7107, 7108, 7110, 7113, 7117, 7118, 7126, 7128, 7129, 7130, 7136, 7138, 7139, 7142, 7144, 7150, 7151, 7154, 7163, 7164, 7165, 7166, 7169, 7171, 7172, 7176, 7182, 7184, 7191, 7192, 7194, 7197, 7201, 7202, 7206, 7207, 7208, 7209, 7210, 7212, 7214, 7217, 7219, 7220, 7227, 7228, 7235, 7236, 7244, 7245, 7246, 7249, 7250, 7255, 7257, 7258, 7262, 7263, 7264, 7268, 7274, 7281, 7287, 7291, 7292, 7293, 7296, 7298, 7299, 7300, 7301, 7303, 7304, 7306, 7307, 7311, 7312, 7313, 7318, 7320, 7323, 7328, 7330, 7331, 7339, 7340, 7345, 7350, 7351, 7356, 7357, 7358, 7360, 7361, 7365, 7369, 7371, 7376, 7377, 7382, 7383, 7386, 7395, 7396, 7398, 7399, 7400, 7409, 7411, 7418, 7425, 7430, 7434, 7436, 7437, 7438, 7447, 7453, 7454, 7457, 7458, 7459, 7462, 7466, 7470, 7472, 7476, 7481, 7486, 7490, 7492, 7493, 7498, 7499, 7503, 7504, 7506, 7512, 7515, 7517, 7521, 7522, 7523, 7524, 7533, 7538, 7546, 7553, 7556, 7559, 7561, 7572, 7574, 7576, 7579, 7583, 7585, 7586, 7587, 7589, 7594, 7596, 7599, 7604, 7605, 7609, 7612, 7619, 7620, 7622, 7624, 7625, 7626, 7633, 7635, 7642, 7643, 7649, 7658, 7661, 7664, 7665, 7671, 7672, 7673, 7674, 7678, 7679, 7680, 7682, 7687, 7689, 7695, 7700, 7703, 7704, 7707, 7712, 7715, 7716, 7724, 7727, 7730, 7736, 7737, 7738, 7742, 7744, 7745, 7749, 7753, 7763, 7764, 7768, 7770, 7774, 7775, 7776, 7777, 7778, 7779, 7780, 7781, 7785, 7786, 7787, 7788, 7791, 7793, 7798, 7799, 7800, 7801, 7803, 7804, 7805, 7806, 7807, 7819, 7820, 7823, 7825, 7826, 7840, 7841, 7845, 7850, 7854, 7856, 7860, 7865, 7870, 7873, 7877, 7878, 7880, 7885, 7887, 7888, 7890, 7896, 7910, 7911, 7918, 7923, 7925, 7928, 7933, 7934, 7935, 7936, 7938, 7942, 7944, 7946, 7949, 7952, 7974, 7976, 7977, 7981, 7983, 7984, 7986, 7992, 7996, 8007, 8012, 8021, 8023, 8024, 8025, 8029, 8030, 8031, 8036, 8040, 8041, 8042, 8043, 8044, 8047, 8048, 8053, 8056, 8059, 8063, 8066, 8068, 8072, 8074, 8075, 8076, 8077, 8078, 8080, 8081, 8083, 8084, 8088, 8089, 8091, 8095, 8102, 8105, 8106, 8110, 8112, 8113, 8118, 8121, 8123, 8126, 8129, 8130, 8134, 8141, 8145, 8146, 8147, 8148, 8151, 8155, 8159, 8163, 8164, 8170, 8178, 8179, 8181, 8189, 8191, 8193, 8194, 8202, 8204, 8208, 8213, 8216, 8217, 8219, 8220, 8223, 8230, 8234, 8237, 8239, 8241, 8242, 8247, 8248, 8250, 8252, 8253, 8264, 8265, 8266, 8268, 8269, 8270, 8272, 8273, 8276, 8282, 8289, 8291, 8292, 8296, 8300, 8304, 8310, 8311, 8312, 8315, 8318, 8319, 8320, 8322, 8326, 8329, 8339, 8340, 8346, 8347, 8349, 8350, 8351, 8353, 8358, 8367, 8368, 8372, 8373, 8379, 8380, 8382, 8385, 8386, 8387, 8389, 8392, 8393, 8395, 8401, 8404, 8408, 8410, 8413, 8414, 8415, 8416, 8417, 8418, 8430, 8436, 8438, 8439, 8443, 8444, 8445, 8447, 8448, 8449, 8450, 8451, 8458, 8459, 8465, 8470, 8472, 8473, 8474, 8476, 8477, 8481, 8482, 8486, 8490, 8496, 8498, 8501, 8502, 8503, 8504, 8505, 8507, 8511, 8513, 8516, 8520, 8521, 8524, 8525, 8526, 8528, 8531, 8532, 8533, 8539, 8542, 8543, 8553, 8554, 8558, 8561, 8562, 8565, 8574, 8576, 8579, 8581, 8582, 8592, 8593, 8596, 8597, 8600, 8602, 8603, 8605, 8611, 8612, 8621, 8622, 8631, 8634, 8635, 8638, 8639, 8642, 8644, 8646, 8648, 8650, 8652, 8654, 8657, 8659, 8660, 8663, 8665, 8669, 8672, 8676, 8677, 8685, 8686, 8690, 8693, 8695, 8699, 8700, 8703, 8708, 8709, 8713, 8717, 8719, 8721, 8722, 8726, 8729, 8731, 8736, 8741, 8743, 8744, 8747, 8748, 8757, 8761, 8769, 8770, 8773, 8774, 8777, 8779, 8783, 8784, 8785, 8786, 8789, 8792, 8802, 8803, 8810, 8811, 8821, 8822, 8824, 8829, 8830, 8833, 8834, 8839, 8841, 8842, 8843, 8853, 8865, 8869, 8874, 8876, 8877, 8878, 8881, 8883, 8888, 8892, 8901, 8907, 8908, 8911, 8916, 8917, 8919, 8922, 8926, 8929, 8930, 8935, 8937, 8938, 8941, 8945, 8946, 8951, 8953, 8960, 8961, 8967, 8968, 8972, 8979, 8980, 8981, 8985, 8986, 8991, 8992, 8996, 8998, 9006, 9009, 9011, 9012, 9015, 9018, 9022, 9026, 9027, 9029, 9030, 9033, 9045, 9050, 9052, 9058, 9059, 9060, 9063, 9065, 9066, 9068, 9069, 9071, 9072, 9073, 9076, 9078, 9080, 9087, 9088, 9091, 9092, 9095, 9103, 9104, 9105, 9107, 9111, 9116, 9118, 9120, 9123, 9125, 9129, 9131, 9133, 9134, 9139, 9140, 9141, 9142, 9144, 9145, 9147, 9152, 9154, 9159, 9167, 9168, 9175, 9177, 9180, 9185, 9188, 9189, 9191, 9194, 9195, 9200, 9205, 9206, 9207, 9210, 9211, 9213, 9214, 9215, 9216, 9218, 9223, 9226, 9229, 9231, 9233, 9237, 9240, 9243, 9248, 9249, 9253, 9257, 9259, 9262, 9265, 9267, 9270, 9273, 9275, 9276, 9282, 9284, 9285, 9287, 9288, 9290, 9291, 9292, 9293, 9295, 9296, 9300, 9304, 9306, 9308, 9311, 9313, 9320, 9321, 9322, 9323, 9326, 9327, 9328, 9332, 9336, 9337, 9338, 9339, 9340, 9346, 9347, 9350, 9352, 9353, 9359, 9360, 9366, 9371, 9373, 9375, 9376, 9380, 9382, 9391, 9393, 9394, 9398, 9400, 9402, 9403, 9406, 9407, 9412, 9413, 9414, 9415, 9419, 9421, 9423, 9429, 9434, 9438, 9439, 9443, 9449, 9452, 9453, 9456, 9460, 9464, 9468, 9471, 9481, 9482, 9484, 9488, 9490, 9497, 9500, 9503, 9504, 9509, 9514, 9517, 9518, 9519, 9525, 9534, 9535, 9536, 9537, 9543, 9545, 9546, 9550, 9551, 9553, 9555, 9564, 9565, 9571, 9573, 9577, 9587, 9590, 9591, 9593, 9595, 9596, 9597, 9598, 9601, 9602, 9606, 9609, 9614, 9615, 9617, 9618, 9620, 9621, 9623, 9624, 9626, 9627, 9629, 9632, 9633, 9648, 9655, 9656, 9657, 9658, 9660, 9663, 9666, 9668, 9670, 9671, 9674, 9680, 9686, 9688, 9698, 9699, 9706, 9710, 9711, 9715, 9718, 9721, 9723, 9724, 9726, 9727, 9729, 9730, 9731, 9732, 9733, 9734, 9737, 9742, 9744, 9745, 9746, 9750, 9756, 9758, 9763, 9770, 9774, 9776, 9777, 9782, 9786, 9791, 9792, 9793, 9794, 9798, 9799, 9804, 9807, 9809, 9810, 9811, 9812, 9813, 9819, 9820, 9821, 9825, 9828, 9829, 9846, 9847, 9866, 9869, 9875, 9878, 9882, 9886, 9887, 9892, 9894, 9897, 9900, 9907, 9909, 9910, 9923, 9928, 9930, 9932, 9935, 9940, 9944, 9946, 9949, 9950, 9952, 9953, 9962, 9963, 9967, 9968, 9969, 9973, 9975, 9976, 9980, 9982, 9984, 9985, 9988, 9990, 9991, 9992, 9995, 9997, 10000, 10012, 10013, 10015, 10017, 10018, 10019, 10020, 10026, 10027, 10032, 10033, 10035, 10037, 10041, 10047, 10049, 10051, 10052, 10053, 10055, 10059, 10060, 10062, 10064, 10066, 10068, 10073, 10075, 10077, 10078, 10080, 10081, 10083, 10091, 10092, 10094, 10095, 10097, 10101, 10103, 10106, 10110, 10115, 10116, 10122, 10127, 10128, 10129, 10131, 10132, 10136, 10138, 10140, 10142, 10143, 10151, 10156, 10157, 10158, 10160, 10163, 10165, 10166, 10168, 10174, 10176, 10178, 10181, 10184, 10186, 10187, 10191, 10192, 10193, 10194, 10195, 10196, 10199, 10206, 10217, 10218, 10219, 10220, 10222, 10223, 10224, 10225, 10228, 10231, 10233, 10234, 10235, 10236, 10237, 10239, 10247, 10252, 10253, 10254, 10259, 10262, 10263, 10266, 10269, 10275, 10278, 10284, 10286, 10291, 10292, 10293, 10295, 10300, 10302, 10306, 10307, 10311, 10312, 10314, 10318, 10319, 10322, 10323, 10324, 10325, 10326, 10331, 10333, 10334, 10335, 10336, 10340, 10341, 10343, 10346, 10353, 10356, 10357, 10361, 10364, 10365, 10371, 10374, 10375, 10376, 10378, 10380, 10385, 10388, 10393, 10397, 10398, 10399, 10401, 10402, 10408, 10414, 10416, 10417, 10421, 10423, 10425, 10435, 10436, 10438, 10446, 10450, 10451, 10452, 10453, 10456, 10463, 10464, 10465, 10468, 10469, 10471, 10474, 10480, 10482, 10487, 10488, 10490, 10494, 10506, 10508, 10518, 10522, 10523, 10524, 10527, 10528, 10530, 10531, 10532, 10536, 10537, 10541, 10542, 10543, 10544, 10548, 10555, 10556, 10558, 10562, 10563, 10567, 10569, 10573, 10580, 10581, 10582, 10583, 10588, 10593, 10596, 10599, 10601, 10602, 10611, 10612, 10613, 10615, 10616, 10621, 10622, 10626, 10629, 10630, 10631, 10633, 10637, 10638, 10639, 10640, 10646, 10655, 10665, 10668, 10670, 10671, 10676, 10678, 10679, 10682, 10683, 10684, 10685, 10687, 10693, 10698, 10700, 10701, 10705, 10707, 10716, 10721, 10722, 10726, 10729, 10732, 10734, 10738, 10740, 10741, 10744, 10747, 10748, 10749, 10752, 10753, 10756, 10768, 10770, 10772, 10775, 10776, 10777, 10778, 10779, 10784, 10785, 10787, 10788, 10792, 10801, 10802, 10803, 10804, 10805, 10809, 10810, 10811, 10818, 10819, 10822, 10823, 10824, 10827, 10831, 10833, 10836, 10838, 10839, 10843, 10850, 10851, 10853, 10854, 10857, 10858, 10860, 10866, 10867, 10870, 10877, 10880, 10892, 10898, 10899, 10901, 10902, 10911, 10917, 10918, 10920, 10926, 10927, 10928, 10929, 10930, 10933, 10934, 10938, 10940, 10941, 10947, 10965, 10967, 10972, 10974, 10976, 10977, 10978, 10979, 10985, 10988, 10993, 10996, 10998, 10999, 11004, 11008, 11015, 11021, 11022, 11024, 11027, 11030, 11036, 11037, 11039, 11040, 11044, 11046, 11047, 11050, 11051, 11053, 11056, 11058, 11060, 11063, 11066, 11067, 11078, 11082, 11083, 11090, 11100, 11103, 11107, 11110, 11114, 11117, 11118, 11123, 11126, 11128, 11129, 11133, 11136, 11137, 11138, 11141, 11145, 11147, 11149, 11152, 11153, 11154, 11160, 11161, 11163, 11165, 11168, 11169, 11173, 11177, 11179, 11180, 11181, 11184, 11187, 11188, 11190, 11192, 11194, 11198, 11199, 11204, 11214, 11216, 11217, 11218, 11222, 11226, 11227, 11230, 11231, 11233, 11236, 11238, 11239, 11241, 11242, 11243, 11246, 11247, 11251, 11253, 11254, 11255, 11256, 11258, 11260, 11263, 11266, 11274, 11278, 11290, 11292, 11293, 11295, 11297, 11299, 11302, 11304, 11306, 11313, 11315, 11316, 11318, 11321, 11323, 11330, 11331, 11337, 11338, 11340, 11345, 11346, 11348, 11349, 11352, 11358, 11362, 11363, 11364, 11365, 11371, 11373, 11377, 11380, 11382, 11387, 11388, 11391, 11392, 11394, 11395, 11401, 11404, 11405, 11406, 11411, 11412, 11413, 11414, 11417, 11424, 11427, 11430, 11431, 11435, 11438, 11439, 11440, 11443, 11446, 11447, 11449, 11451, 11456, 11459, 11461, 11465, 11466, 11472, 11475, 11477, 11478, 11481, 11487, 11488, 11489, 11490, 11491, 11494, 11496, 11497, 11498, 11499, 11500, 11501, 11505, 11506, 11507, 11508, 11513, 11520, 11523, 11524, 11526, 11527, 11531, 11532, 11533, 11541, 11544, 11548, 11550, 11551, 11553, 11558, 11560, 11561, 11567, 11568, 11570, 11571, 11576, 11577, 11578, 11585, 11588, 11593, 11594, 11595, 11596, 11597, 11599, 11604, 11607, 11611, 11612, 11615, 11617, 11618, 11619, 11623, 11628, 11639, 11640, 11645, 11647, 11649, 11650, 11656, 11657, 11658, 11659, 11663, 11669, 11673, 11678, 11681, 11682, 11688, 11691, 11692, 11694, 11695, 11696, 11699, 11701, 11703, 11705, 11707, 11712, 11718, 11721, 11725, 11726, 11730, 11731, 11733, 11736, 11740, 11743, 11744, 11753, 11759, 11760, 11762, 11763, 11764, 11765, 11766, 11767, 11768, 11770, 11771, 11776, 11777, 11778, 11781, 11784, 11786, 11788, 11789, 11790, 11792, 11794, 11797, 11799, 11800, 11805, 11806, 11809, 11810, 11811, 11814, 11818, 11821, 11826, 11828, 11830, 11839, 11840, 11844, 11846, 11851, 11856, 11858, 11861, 11864, 11865, 11868, 11872, 11876, 11877, 11879, 11881, 11891, 11892, 11894, 11898, 11901, 11902, 11906, 11909, 11911, 11913, 11914, 11916, 11917, 11919, 11920, 11921, 11923, 11924, 11926, 11928, 11929, 11930, 11934, 11940, 11943, 11945, 11947, 11949, 11953, 11955, 11956, 11958, 11959, 11960, 11961, 11962, 11963, 11964, 11965, 11966, 11973, 11974, 11975, 11976, 11977, 11978, 11979, 11983, 11988, 11989, 11993, 11997, 11998, 11999, 12004, 12005, 12015, 12017, 12021, 12023, 12024, 12026, 12027, 12032, 12033, 12038, 12042, 12043, 12044, 12051, 12052, 12059, 12060, 12068, 12076, 12077, 12081, 12083, 12087, 12092, 12093, 12098, 12102, 12104, 12106, 12109, 12110, 12112, 12118, 12122, 12128, 12129, 12130, 12134, 12137, 12138, 12139, 12140, 12143, 12145, 12146, 12149, 12151, 12161, 12163, 12166, 12167, 12170, 12171, 12174, 12175, 12176, 12181, 12185, 12197, 12200, 12201, 12204, 12207, 12208, 12215, 12217, 12218, 12219, 12220, 12221, 12227, 12228, 12233, 12234, 12240, 12245, 12249, 12250, 12252, 12256, 12259, 12260, 12263, 12267, 12268, 12269, 12274, 12278, 12280, 12286, 12287, 12291, 12293, 12295, 12297, 12298, 12299, 12304, 12306, 12310, 12311, 12313, 12314, 12315, 12317, 12321, 12323, 12329, 12331, 12333, 12334, 12337, 12344, 12347, 12354, 12356, 12358, 12359, 12367, 12368, 12369, 12370, 12373, 12374, 12379, 12380, 12381, 12383, 12385, 12397, 12400, 12401, 12403, 12406, 12410, 12414, 12419, 12420, 12421, 12424, 12425, 12426, 12427, 12437, 12439, 12440, 12441, 12445, 12447, 12450, 12451, 12454, 12455, 12456, 12457, 12458, 12459, 12462, 12467, 12468, 12472, 12476, 12478, 12479, 12481, 12487, 12488, 12491, 12495, 12497, 12499, 12503, 12504, 12508, 12509, 12514, 12530, 12536, 12545, 12546, 12547, 12549, 12555, 12561, 12564, 12565, 12567, 12568, 12572, 12578, 12585, 12588, 12605, 12608, 12609, 12611, 12616, 12619, 12623, 12626, 12629, 12631, 12633, 12634, 12635, 12636, 12638, 12639, 12641, 12649, 12651, 12658, 12663, 12668, 12670, 12671, 12672, 12674, 12675, 12676, 12679, 12680, 12681, 12683, 12684, 12685, 12688, 12691, 12693, 12695, 12699, 12701, 12702, 12703, 12707, 12718, 12719, 12722, 12726, 12729, 12731, 12732, 12733, 12737, 12738, 12739, 12741, 12742, 12743, 12754, 12757, 12758, 12760, 12761, 12762, 12764, 12766, 12771, 12772, 12773, 12783, 12785, 12788, 12790, 12794, 12797, 12800, 12801, 12802, 12803, 12805, 12810, 12812, 12813, 12814, 12817, 12818, 12820, 12822, 12824, 12826, 12827, 12828, 12834, 12836, 12838, 12839, 12843, 12844, 12847, 12849, 12850, 12853, 12858, 12861, 12866, 12873, 12883, 12887, 12888, 12893, 12895, 12898, 12900, 12901, 12902, 12904, 12905, 12906, 12910, 12912, 12913, 12914, 12916, 12917, 12918, 12920, 12921, 12926, 12928, 12929, 12932, 12938, 12939, 12940, 12942, 12944, 12945, 12946, 12947, 12966, 12967, 12968, 12969, 12972, 12973, 12976, 12978, 12982, 12984, 12987, 12990, 12991, 12998, 13010, 13011, 13012, 13014, 13017, 13022, 13024, 13030, 13032, 13033, 13035, 13038, 13040, 13041, 13042, 13049, 13050, 13053, 13055, 13056, 13057, 13060, 13061, 13064, 13066, 13071, 13074, 13075, 13077, 13079, 13085, 13086, 13087, 13095, 13101, 13102, 13106, 13112, 13115, 13116, 13117, 13118, 13123, 13124, 13128, 13131, 13135, 13142, 13148, 13149, 13151, 13152, 13153, 13160, 13169, 13175, 13177, 13182, 13185, 13189, 13191, 13197, 13199, 13205, 13206, 13209, 13210, 13213, 13215, 13217, 13221, 13222, 13224, 13227, 13232, 13234, 13235, 13236, 13237, 13238, 13240, 13243, 13248, 13249, 13251, 13255, 13258, 13259, 13260, 13261, 13263, 13264, 13267, 13268, 13269, 13273, 13275, 13276, 13278, 13280, 13281, 13293, 13295, 13296, 13298, 13301, 13303, 13304, 13313, 13315, 13317, 13318, 13320, 13321, 13322, 13323, 13326, 13328, 13329, 13330, 13332, 13335, 13338, 13340, 13341, 13343, 13346, 13348, 13351, 13352, 13353, 13354, 13359, 13361, 13363, 13369, 13370, 13375, 13380, 13381, 13384, 13393, 13394, 13396, 13397, 13401, 13402, 13408, 13415, 13416, 13417, 13419, 13420, 13423, 13424, 13429, 13433, 13439, 13441, 13444, 13448, 13450, 13454, 13456, 13463, 13466, 13468, 13469, 13473, 13475, 13492, 13494, 13496, 13497, 13498, 13499, 13500, 13503, 13504, 13506, 13513, 13514, 13515, 13516, 13517, 13519, 13520, 13521, 13524, 13530, 13532, 13535, 13536, 13539, 13540, 13543, 13544, 13546, 13547, 13549, 13552, 13553, 13556, 13558, 13568, 13569, 13574, 13580, 13582, 13584, 13587, 13589, 13595, 13597, 13598, 13599, 13601, 13602, 13604, 13612, 13621, 13622, 13623, 13628, 13631, 13632, 13634, 13635, 13636, 13637, 13641, 13647, 13650, 13652, 13654, 13661, 13662, 13663, 13671, 13675, 13677, 13678, 13684, 13687, 13688, 13695, 13698, 13700, 13702, 13703, 13704, 13706, 13712, 13713, 13715, 13716, 13720, 13721, 13725, 13726, 13729, 13730, 13733, 13737, 13739, 13745, 13747, 13750, 13755, 13756, 13764, 13766, 13767, 13769, 13772, 13773, 13775, 13776, 13781, 13782, 13783, 13785, 13786, 13787, 13789, 13790, 13791, 13792, 13793, 13794, 13796, 13798, 13809, 13816, 13817, 13818, 13819, 13820, 13822, 13823, 13827, 13828, 13830, 13831, 13833, 13834, 13835, 13839, 13843, 13849, 13852, 13853, 13858, 13859, 13860, 13862, 13866, 13869, 13870, 13872, 13873, 13874, 13877, 13881, 13882, 13891, 13892, 13894, 13896, 13897, 13901, 13904, 13906, 13907, 13909, 13910, 13911, 13917, 13925, 13927, 13930, 13933, 13938, 13944, 13947, 13948, 13949, 13952, 13954, 13956, 13963, 13965, 13969, 13970, 13975, 13976, 13984, 13990, 13999, 14000, 14001, 14009, 14010, 14014, 14017, 14018, 14022, 14027, 14028, 14030, 14031, 14036, 14041, 14043, 14049, 14050, 14051, 14052, 14059, 14062, 14063, 14066, 14069, 14070, 14071, 14075, 14076, 14081, 14084, 14086, 14087, 14092, 14093, 14094, 14096, 14106, 14107, 14110, 14112, 14116, 14118, 14120, 14122, 14124, 14125, 14128, 14129, 14132, 14138, 14139, 14145, 14146, 14148, 14149, 14150.

Promoters expressing in the flag leaf at 14 days after pollination include SEQ IDs: 1, 3, 4, 7, 11, 12, 13, 14, 15, 26, 31, 34, 36, 48, 53, 56, 64, 65, 81, 82, 88, 93, 96, 97, 101, 102, 103, 107, 110, 111, 112, 121, 126, 129, 130, 131, 132, 134, 143, 147, 148, 152, 154, 160, 165, 168, 172, 174, 176, 179, 181, 183, 186, 188, 194, 195, 196, 202, 204, 205, 207, 210, 211, 223, 230, 231, 232, 234, 235, 236, 240, 243, 244, 246, 248, 249, 250, 251, 257, 259, 262, 264, 268, 269, 270, 271, 273, 274, 279, 280, 281, 284, 286, 288, 289, 295, 299, 301, 302, 305, 306, 314, 316, 318, 319, 320, 322, 328, 329, 332, 335, 337, 348, 349, 353, 354, 357, 359, 360, 367, 371, 376, 378, 379, 382, 387, 388, 393, 396, 401, 402, 406, 407, 423, 424, 428, 429, 431, 433, 434, 452, 455, 456, 461, 463, 466, 471, 479, 481, 483, 485, 488, 496, 498, 502, 504, 507, 509, 510, 513, 514, 516, 517, 520, 522, 523, 525, 529, 532, 533, 536, 538, 541, 542, 544, 546, 547, 554, 557, 564, 565, 573, 576, 580, 585, 591, 598, 608, 613, 614, 620, 623, 626, 630, 633, 634, 635, 643, 644, 653, 656, 662, 663, 666, 674, 676, 677, 681, 686, 693, 694, 701, 705, 716, 717, 719, 721, 723, 724, 733, 734, 736, 740, 742, 749, 765, 768, 782, 783, 791, 792, 793, 794, 795, 797, 800, 806, 808, 819, 820, 821, 830, 833, 840, 842, 844, 845, 855, 857, 859, 860, 862, 863, 865, 868, 869, 870, 872, 878, 883, 884, 885, 887, 888, 890, 891, 892, 895, 897, 898, 899, 901, 903, 907, 910, 911, 912, 913, 916, 917, 919, 924, 925, 929, 931, 936, 938, 940, 943, 944, 951, 953, 954, 955, 957, 958, 961, 962, 964, 966, 969, 971, 974, 977, 979, 980, 982, 983, 987, 989, 991, 994, 995, 997, 999, 1007, 1009, 1011, 1014, 1026, 1028, 1039, 1041, 1042, 1043, 1045, 1047, 1049, 1051, 1052, 1055, 1064, 1065, 1068, 1069, 1073, 1077, 1078, 1086, 1087, 1089, 1092, 1095, 1098, 1103, 1104, 1108, 1110, 1111, 1112, 1114, 1118, 1119, 1122, 1127, 1130, 1132, 1133, 1136, 1137, 1144, 1146, 1147, 1148, 1155, 1165, 1166, 1169, 1176, 1178, 1182, 1185, 1191, 1196, 1198, 1199, 1201, 1204, 1210, 1214, 1217, 1218, 1219, 1225, 1227, 1228, 1230, 1231, 1233, 1235, 1236, 1239, 1241, 1243, 1248, 1249, 1250, 1252, 1253, 1256, 1261, 1264, 1265, 1269, 1272, 1281, 1282, 1283, 1285, 1286, 1292, 1295, 1296, 1297, 1298, 1303, 1305, 1306, 1307, 1309, 1312, 1316, 1321, 1327, 1330, 1331, 1334, 1335, 1337, 1339, 1340, 1346, 1347, 1351, 1354, 1355, 1360, 1364, 1367, 1371, 1373, 1377, 1380, 1381, 1382, 1386, 1387, 1388, 1393, 1394, 1396, 1397, 1398, 1404, 1407, 1415, 1421, 1426, 1431, 1432, 1438, 1441, 1442, 1444, 1451, 1453, 1454, 1455, 1458, 1459, 1468, 1481, 1486, 1487, 1490, 1499, 1501, 1514, 1517, 1518, 1525, 1526, 1527, 1534, 1539, 1540, 1543, 1545, 1546, 1547, 1549, 1550, 1556, 1560, 1567, 1571, 1575, 1578, 1582, 1584, 1586, 1590, 1592, 1593, 1594, 1599, 1600, 1602, 1604, 1605, 1609, 1612, 1614, 1616, 1618, 1622, 1625, 1630, 1634, 1635, 1636, 1637, 1638, 1639, 1650, 1653, 1658, 1659, 1661, 1662, 1664, 1669, 1671, 1675, 1677, 1680, 1683, 1685, 1688, 1691, 1696, 1698, 1699, 1705, 1708, 1709, 1710, 1714, 1717, 1719, 1723, 1726, 1727, 1729, 1731, 1732, 1733, 1735, 1740, 1745, 1755, 1759, 1760, 1764, 1771, 1776, 1779, 1785, 1791, 1807, 1813, 1815, 1820, 1823, 1826, 1828, 1830, 1832, 1834, 1835, 1837, 1838, 1840, 1845, 1850, 1852, 1859, 1865, 1868, 1869, 1870, 1872, 1876, 1882, 1883, 1888, 1889, 1891, 1895, 1898, 1899, 1900, 1902, 1905, 1906, 1910, 1912, 1914, 1916, 1918, 1920, 1922, 1923, 1924, 1930, 1931, 1933, 1934, 1936, 1940, 1950, 1952, 1955, 1968, 1977, 1981, 1991, 1993, 1999, 2000, 2007, 2008, 2009, 2010, 2012, 2013, 2014, 2015, 2020, 2023, 2026, 2033, 2034, 2039, 2041, 2043, 2045, 2048, 2049, 2060, 2062, 2064, 2066, 2069, 2071, 2072, 2074, 2075, 2077, 2081, 2082, 2083, 2089, 2090, 2094, 2096, 2099, 2103, 2109, 2113, 2116, 2117, 2126, 2132, 2133, 2134, 2137, 2139, 2140, 2142, 2144, 2147, 2150, 2152, 2157, 2159, 2161, 2166, 2168, 2172, 2174, 2178, 2179, 2182, 2185, 2190, 2193, 2196, 2201, 2202, 2203, 2206, 2207, 2213, 2215, 2221, 2222, 2226, 2227, 2229, 2230, 2231, 2232, 2233, 2235, 2237, 2240, 2243, 2244, 2247, 2252, 2253, 2260, 2261, 2262, 2263, 2274, 2279, 2280, 2281, 2282, 2283, 2288, 2295, 2296, 2297, 2298, 2300, 2301, 2303, 2304, 2305, 2308, 2309, 2310, 2314, 2322, 2323, 2325, 2328, 2329, 2333, 2335, 2339, 2342, 2346, 2349, 2351, 2352, 2353, 2354, 2359, 2360, 2363, 2366, 2367, 2371, 2377, 2379, 2381, 2382, 2383, 2384, 2396, 2397, 2398, 2401, 2403, 2405, 2408, 2411, 2412, 2418, 2420, 2422, 2435, 2438, 2441, 2442, 2443, 2445, 2450, 2452, 2453, 2454, 2458, 2465, 2470, 2471, 2472, 2476, 2480, 2482, 2485, 2492, 2494, 2495, 2498, 2500, 2504, 2505, 2507, 2509, 2512, 2514, 2517, 2519, 2522, 2528, 2529, 2531, 2532, 2533, 2535, 2538, 2539, 2547, 2548, 2549, 2552, 2555, 2557, 2560, 2567, 2568, 2573, 2576, 2578, 2580, 2581, 2583, 2590, 2594, 2601, 2606, 2609, 2614, 2616, 2617, 2619, 2622, 2626, 2627, 2632, 2634, 2637, 2639, 2644, 2647, 2651, 2652, 2653, 2655, 2661, 2662, 2663, 2671, 2674, 2675, 2679, 2680, 2684, 2687, 2689, 2691, 2696, 2700, 2704, 2715, 2718, 2719, 2723, 2726, 2728, 2729, 2730, 2737, 2738, 2740, 2747, 2749, 2752, 2756, 2763, 2764, 2765, 2768, 2770, 2775, 2780, 2785, 2791, 2798, 2801, 2802, 2805, 2812, 2814, 2819, 2822, 2824, 2826, 2827, 2829, 2833, 2837, 2839, 2840, 2844, 2845, 2850, 2857, 2861, 2864, 2865, 2871, 2873, 2876, 2878, 2879, 2885, 2886, 2888, 2889, 2890, 2893, 2894, 2902, 2905, 2906, 2908, 2909, 2910, 2912, 2918, 2923, 2935, 2938, 2942, 2943, 2944, 2945, 2946, 2948, 2950, 2955, 2959, 2960, 2963, 2966, 2968, 2969, 2976, 2979, 2980, 2994, 2998, 3000, 3002, 3005, 3007, 3010, 3015, 3016, 3023, 3024, 3026, 3038, 3039, 3042, 3044, 3048, 3049, 3050, 3055, 3062, 3064, 3067, 3070, 3072, 3075, 3076, 3080, 3081, 3083, 3084, 3085, 3087, 3088, 3094, 3095, 3105, 3106, 3109, 3112, 3114, 3118, 3119, 3120, 3121, 3123, 3126, 3127, 3128, 3137, 3139, 3140, 3143, 3147, 3148, 3149, 3153, 3154, 3157, 3158, 3170, 3181, 3185, 3192, 3194, 3199, 3202, 3205, 3206, 3210, 3212, 3215, 3218, 3219, 3220, 3221, 3224, 3225, 3226, 3227, 3228, 3236, 3237, 3240, 3244, 3247, 3250, 3252, 3253, 3255, 3258, 3261, 3262, 3266, 3268, 3271, 3273, 3278, 3280, 3282, 3286, 3288, 3290, 3294, 3295, 3299, 3312, 3313, 3324, 3329, 3331, 3332, 3333, 3335, 3340, 3345, 3347, 3349, 3353, 3355, 3356, 3358, 3361, 3363, 3374, 3377, 3380, 3383, 3386, 3393, 3396, 3397, 3399, 3402, 3404, 3412, 3414, 3415, 3416, 3418, 3419, 3422, 3426, 3427, 3428, 3429, 3435, 3438, 3440, 3445, 3446, 3447, 3449, 3451, 3455, 3458, 3460, 3461, 3464, 3465, 3470, 3471, 3473, 3474, 3475, 3477, 3482, 3483, 3486, 3487, 3488, 3490, 3491, 3496, 3499, 3503, 3504, 3506, 3509, 3510, 3516, 3517, 3518, 3533, 3536, 3541, 3544, 3545, 3548, 3549, 3551, 3552, 3554, 3557, 3558, 3560, 3561, 3562, 3563, 3569, 3572, 3574, 3576, 3582, 3588, 3589, 3592, 3593, 3594, 3595, 3597, 3600, 3603, 3606, 3607, 3611, 3616, 3618, 3621, 3623, 3624, 3626, 3627, 3628, 3629, 3630, 3631, 3633, 3637, 3640, 3642, 3643, 3644, 3645, 3646, 3648, 3650, 3654, 3655, 3657, 3659, 3660, 3663, 3667, 3668, 3669, 3671, 3674, 3682, 3702, 3706, 3707, 3710, 3713, 3715, 3717, 3718, 3719, 3720, 3721, 3724, 3731, 3738, 3739, 3742, 3748, 3749, 3752, 3754, 3760, 3761, 3763, 3764, 3766, 3775, 3777, 3778, 3781, 3783, 3784, 3785, 3788, 3789, 3790, 3791, 3792, 3794, 3798, 3804, 3808, 3812, 3818, 3820, 3823, 3825, 3828, 3831, 3832, 3833, 3834, 3836, 3837, 3839, 3842, 3843, 3844, 3845, 3849, 3858, 3859, 3860, 3862, 3866, 3867, 3870, 3871, 3872, 3876, 3882, 3883, 3885, 3887, 3889, 3891, 3895, 3896, 3898, 3899, 3908, 3910, 3912, 3914, 3917, 3923, 3924, 3926, 3928, 3929, 3934, 3941, 3947, 3950, 3954, 3958, 3962, 3967, 3968, 3974, 3975, 3983, 3991, 3995, 3997, 4000, 4001, 4002, 4003, 4006, 4008, 4022, 4024, 4026, 4030, 4038, 4039, 4040, 4044, 4045, 4047, 4048, 4049, 4050, 4051, 4052, 4054, 4056, 4058, 4060, 4067, 4068, 4069, 4072, 4077, 4078, 4084, 4087, 4092, 4094, 4099, 4103, 4105, 4109, 4110, 4111, 4113, 4115, 4122, 4128, 4133, 4137, 4143, 4149, 4154, 4155, 4156, 4158, 4160, 4161, 4162, 4163, 4165, 4166, 4167, 4168, 4171, 4175, 4176, 4178, 4184, 4187, 4188, 4189, 4190, 4197, 4201, 4202, 4205, 4206, 4207, 4210, 4211, 4214, 4217, 4219, 4221, 4227, 4228, 4233, 4235, 4246, 4247, 4250, 4251, 4255, 4257, 4266, 4270, 4272, 4276, 4279, 4280, 4281, 4296, 4297, 4298, 4301, 4302, 4309, 4312, 4320, 4321, 4324, 4329, 4330, 4331, 4332, 4333, 4339, 4341, 4343, 4344, 4347, 4349, 4352, 4354, 4358, 4359, 4360, 4365, 4369, 4374, 4378, 4380, 4383, 4390, 4391, 4393, 4397, 4401, 4402, 4403, 4404, 4406, 4412, 4415, 4419, 4422, 4423, 4426, 4427, 4436, 4439, 4442, 4443, 4444, 4446, 4448, 4449, 4450, 4453, 4456, 4457, 4458, 4461, 4462, 4463, 4464, 4468, 4472, 4479, 4483, 4485, 4490, 4491, 4492, 4494, 4500, 4502, 4506, 4507, 4512, 4515, 4518, 4519, 4531, 4535, 4543, 4548, 4549, 4551, 4554, 4556, 4557, 4558, 4559, 4562, 4563, 4565, 4566, 4567, 4568, 4570, 4575, 4580, 4582, 4583, 4590, 4594, 4595, 4596, 4601, 4604, 4605, 4606, 4625, 4633, 4635, 4641, 4643, 4644, 4650, 4651, 4657, 4659, 4666, 4667, 4669, 4670, 4671, 4676, 4677, 4680, 4682, 4684, 4685, 4687, 4697, 4699, 4700, 4704, 4706, 4712, 4714, 4716, 4719, 4721, 4725, 4729, 4732, 4737, 4738, 4739, 4740, 4748, 4749, 4750, 4751, 4753, 4754, 4755, 4756, 4761, 4762, 4763, 4767, 4775, 4779, 4789, 4790, 4791, 4795, 4800, 4804, 4813, 4817, 4818, 4820, 4822, 4823, 4824, 4828, 4832, 4833, 4834, 4842, 4851, 4857, 4861, 4862, 4864, 4868, 4870, 4872, 4875, 4877, 4878, 4880, 4881, 4887, 4888, 4889, 4890, 4891, 4901, 4905, 4909, 4912, 4914, 4917, 4920, 4921, 4923, 4924, 4926, 4931, 4935, 4936, 4938, 4941, 4943, 4947, 4950, 4971, 4972, 4973, 4975, 4980, 4981, 4988, 4992, 4993, 4994, 4996, 5010, 5011, 5029, 5030, 5034, 5037, 5039, 5040, 5042, 5044, 5046, 5048, 5049, 5052, 5054, 5057, 5061, 5067, 5068, 5072, 5082, 5088, 5089, 5091, 5095, 5100, 5102, 5111, 5114, 5121, 5123, 5129, 5130, 5131, 5132, 5136, 5137, 5140, 5144, 5145, 5147, 5152, 5154, 5157, 5159, 5164, 5165, 5168, 5170, 5174, 5180, 5181, 5182, 5184, 5185, 5188, 5189, 5190, 5192, 5195, 5196, 5198, 5199, 5201, 5206, 5208, 5212, 5217, 5219, 5225, 5226, 5229, 5234, 5240, 5241, 5243, 5253, 5255, 5258, 5261, 5263, 5267, 5273, 5275, 5276, 5281, 5283, 5292, 5293, 5299, 5300, 5301, 5303, 5308, 5311, 5314, 5317, 5319, 5324, 5325, 5327, 5329, 5330, 5332, 5334, 5342, 5344, 5346, 5347, 5348, 5351, 5361, 5366, 5367, 5372, 5379, 5382, 5386, 5388, 5389, 5391, 5395, 5398, 5400, 5403, 5405, 5411, 5414, 5417, 5427, 5430, 5431, 5438, 5446, 5448, 5449, 5452, 5456, 5457, 5459, 5463, 5464, 5466, 5467, 5472, 5475, 5476, 5481, 5482, 5483, 5493, 5495, 5496, 5497, 5498, 5506, 5508, 5509, 5510, 5513, 5515, 5516, 5518, 5519, 5520, 5521, 5524, 5530, 5535, 5537, 5539, 5543, 5549, 5557, 5565, 5566, 5568, 5569, 5571, 5572, 5574, 5575, 5581, 5585, 5586, 5588, 5591, 5592, 5596, 5597, 5604, 5612, 5613, 5614, 5615, 5616, 5618, 5620, 5621, 5627, 5631, 5632, 5633, 5635, 5640, 5642, 5647, 5648, 5651, 5653, 5657, 5659, 5660, 5663, 5664, 5670, 5671, 5675, 5676, 5677, 5689, 5690, 5695, 5697, 5699, 5700, 5702, 5703, 5706, 5709, 5711, 5712, 5713, 5718, 5721, 5722, 5726, 5730, 5731, 5734, 5735, 5739, 5744, 5751, 5753, 5756, 5763, 5768, 5771, 5773, 5775, 5780, 5783, 5784, 5785, 5787, 5791, 5794, 5806, 5810, 5813, 5820, 5826, 5833, 5834, 5835, 5836, 5837, 5846, 5852, 5854, 5856, 5857, 5859, 5861, 5863, 5864, 5865, 5866, 5868, 5869, 5872, 5875, 5878, 5881, 5883, 5886, 5889, 5892, 5893, 5905, 5907, 5912, 5925, 5926, 5927, 5931, 5932, 5934, 5935, 5936, 5938, 5941, 5944, 5951, 5954, 5956, 5959, 5961, 5968, 5971, 5974, 5975, 5978, 5982, 5984, 5988, 5991, 5992, 5994, 5996, 5997, 6000, 6002, 6006, 6008, 6013, 6016, 6018, 6020, 6023, 6024, 6025, 6026, 6028, 6031, 6033, 6038, 6041, 6044, 6045, 6047, 6048, 6051, 6054, 6058, 6059, 6062, 6063, 6065, 6069, 6072, 6073, 6074, 6075, 6080, 6081, 6084, 6085, 6087, 6088, 6089, 6090, 6093, 6096, 6098, 6099, 6107, 6108, 6109, 6110, 6116, 6118, 6124, 6129, 6131, 6132, 6133, 6135, 6138, 6139, 6143, 6145, 6146, 6148, 6149, 6151, 6153, 6155, 6157, 6158, 6160, 6162, 6163, 6164, 6165, 6180, 6181, 6182, 6183, 6188, 6189, 6194, 6195, 6196, 6197, 6198, 6203, 6204, 6205, 6206, 6209, 6212, 6220, 6221, 6223, 6224, 6226, 6227, 6234, 6237, 6243, 6246, 6247, 6250, 6251, 6255, 6264, 6265, 6267, 6270, 6272, 6273, 6275, 6280, 6281, 6282, 6286, 6288, 6289, 6290, 6292, 6294, 6296, 6299, 6300, 6303, 6306, 6310, 6317, 6322, 6328, 6333, 6338, 6342, 6349, 6353, 6354, 6356, 6358, 6360, 6363, 6368, 6370, 6372, 6375, 6376, 6381, 6387, 6394, 6397, 6399, 6403, 6405, 6408, 6412, 6414, 6415, 6419, 6425, 6426, 6427, 6429, 6430, 6436, 6440, 6442, 6448, 6449, 6450, 6456, 6457, 6458, 6463, 6464, 6466, 6467, 6469, 6474, 6476, 6478, 6480, 6482, 6484, 6485, 6486, 6494, 6501, 6502, 6504, 6510, 6516, 6517, 6519, 6523, 6528, 6530, 6531, 6532, 6534, 6541, 6547, 6549, 6553, 6558, 6559, 6567, 6571, 6572, 6574, 6576, 6577, 6579, 6581, 6587, 6588, 6589, 6592, 6594, 6595, 6596, 6597, 6599, 6600, 6603, 6605, 6606, 6607, 6610, 6614, 6620, 6623, 6628, 6629, 6633, 6634, 6635, 6638, 6639, 6644, 6646, 6647, 6649, 6652, 6654, 6655, 6656, 6658, 6661, 6666, 6670, 6672, 6681, 6696, 6701, 6703, 6705, 6716, 6718, 6720, 6729, 6730, 6734, 6736, 6742, 6747, 6748, 6749, 6753, 6756, 6757, 6759, 6764, 6766, 6767, 6779, 6782, 6783, 6786, 6788, 6792, 6793, 6794, 6795, 6797, 6798, 6799, 6801, 6803, 6804, 6805, 6806, 6813, 6815, 6816, 6817, 6819, 6820, 6824, 6826, 6827, 6834, 6836, 6840, 6841, 6847, 6848, 6851, 6854, 6855, 6863, 6867, 6875, 6877, 6878, 6880, 6881, 6886, 6888, 6895, 6902, 6903, 6906, 6907, 6909, 6917, 6919, 6921, 6924, 6925, 6930, 6931, 6935, 6939, 6940, 6946, 6955, 6959, 6963, 6971, 6979, 6984, 6985, 6987, 6988, 6990, 6991, 6994, 6997, 6999, 7009, 7010, 7013, 7018, 7019, 7020, 7022, 7025, 7027, 7029, 7038, 7039, 7040, 7043, 7045, 7051, 7053, 7054, 7057, 7059, 7064, 7067, 7068, 7077, 7083, 7084, 7085, 7097, 7105, 7106, 7107, 7108, 7110, 7113, 7117, 7118, 7126, 7130, 7136, 7138, 7139, 7140, 7144, 7151, 7154, 7163, 7164, 7165, 7166, 7169, 7170, 7171, 7172, 7182, 7187, 7192, 7194, 7195, 7196, 7197, 7198, 7201, 7202, 7206, 7212, 7214, 7215, 7220, 7230, 7231, 7235, 7236, 7240, 7246, 7249, 7250, 7255, 7257, 7258, 7259, 7262, 7263, 7264, 7267, 7268, 7270, 7274, 7281, 7282, 7287, 7291, 7293, 7296, 7298, 7299, 7300, 7301, 7303, 7304, 7306, 7307, 7308, 7312, 7313, 7318, 7321, 7328, 7338, 7345, 7353, 7355, 7357, 7358, 7363, 7365, 7371, 7373, 7375, 7376, 7377, 7380, 7383, 7392, 7395, 7396, 7398, 7399, 7400, 7409, 7418, 7425, 7430, 7434, 7436, 7447, 7450, 7453, 7454, 7457, 7458, 7459, 7462, 7464, 7466, 7470, 7472, 7475, 7481, 7483, 7485, 7486, 7492, 7493, 7499, 7502, 7506, 7512, 7514, 7515, 7517, 7521, 7523, 7524, 7528, 7533, 7538, 7541, 7546, 7547, 7549, 7556, 7557, 7572, 7574, 7579, 7583, 7585, 7586, 7587, 7589, 7590, 7596, 7597, 7598, 7604, 7609, 7611, 7612, 7614, 7619, 7620, 7624, 7633, 7638, 7642, 7643, 7647, 7649, 7655, 7656, 7658, 7661, 7662, 7665, 7673, 7674, 7678, 7679, 7680, 7682, 7685, 7687, 7689, 7692, 7695, 7697, 7699, 7700, 7703, 7712, 7715, 7716, 7724, 7734, 7736, 7737, 7738, 7741, 7742, 7744, 7745, 7749, 7750, 7753, 7754, 7756, 7761, 7763, 7764, 7767, 7770, 7774, 7775, 7779, 7781, 7785, 7786, 7788, 7791, 7793, 7798, 7799, 7800, 7801, 7803, 7804, 7806, 7807, 7815, 7819, 7825, 7826, 7833, 7834, 7840, 7841, 7844, 7850, 7860, 7865, 7873, 7877, 7880, 7881, 7885, 7887, 7888, 7890, 7893, 7896, 7901, 7908, 7911, 7913, 7918, 7923, 7925, 7928, 7933, 7934, 7935, 7938, 7942, 7944, 7949, 7950, 7952, 7965, 7966, 7967, 7971, 7974, 7976, 7977, 7981, 7982, 7984, 7986, 7993, 7994, 7999, 8000, 8006, 8007, 8012, 8020, 8023, 8025, 8031, 8036, 8041, 8042, 8044, 8045, 8047, 8048, 8049, 8052, 8056, 8059, 8063, 8068, 8074, 8076, 8077, 8078, 8080, 8083, 8088, 8095, 8099, 8102, 8103, 8106, 8109, 8110, 8112, 8113, 8126, 8129, 8130, 8137, 8141, 8150, 8151, 8155, 8166, 8170, 8178, 8179, 8181, 8182, 8189, 8193, 8196, 8198, 8202, 8204, 8208, 8213, 8219, 8220, 8230, 8234, 8237, 8239, 8241, 8242, 8246, 8248, 8249, 8250, 8252, 8264, 8265, 8268, 8269, 8274, 8275, 8289, 8291, 8292, 8296, 8297, 8300, 8304, 8305, 8308, 8311, 8315, 8318, 8319, 8322, 8326, 8329, 8334, 8335, 8339, 8341, 8347, 8349, 8350, 8351, 8352, 8353, 8367, 8368, 8371, 8373, 8378, 8379, 8380, 8385, 8387, 8389, 8392, 8395, 8396, 8397, 8401, 8402, 8403, 8404, 8406, 8408, 8410, 8413, 8414, 8415, 8416, 8417, 8418, 8428, 8430, 8433, 8435, 8436, 8438, 8439, 8440, 8442, 8444, 8445, 8446, 8447, 8448, 8449, 8450, 8451, 8455, 8457, 8458, 8459, 8465, 8470, 8473, 8474, 8476, 8477, 8478, 8481, 8482, 8485, 8490, 8498, 8501, 8502, 8503, 8505, 8509, 8517, 8520, 8521, 8523, 8524, 8525, 8526, 8531, 8532, 8533, 8541, 8542, 8543, 8549, 8550, 8553, 8554, 8557, 8561, 8565, 8574, 8576, 8581, 8582, 8583, 8588, 8592, 8593, 8594, 8596, 8597, 8598, 8600, 8602, 8603, 8605, 8612, 8622, 8631, 8634, 8638, 8641, 8642, 8644, 8648, 8652, 8657, 8658, 8659, 8663, 8665, 8669, 8672, 8676, 8677, 8685, 8686, 8693, 8699, 8700, 8703, 8705, 8706, 8708, 8709, 8712, 8713, 8714, 8715, 8717, 8719, 8720, 8722, 8726, 8731, 8732, 8736, 8741, 8746, 8748, 8755, 8757, 8761, 8769, 8770, 8773, 8774, 8777, 8779, 8782, 8783, 8784, 8786, 8789, 8803, 8804, 8808, 8810, 8817, 8818, 8821, 8822, 8824, 8831, 8834, 8835, 8841, 8842, 8843, 8844, 8847, 8853, 8865, 8866, 8874, 8876, 8877, 8878, 8881, 8883, 8886, 8888, 8891, 8892, 8896, 8897, 8901, 8905, 8907, 8908, 8911, 8916, 8917, 8919, 8922, 8924, 8926, 8928, 8929, 8937, 8938, 8941, 8945, 8946, 8949, 8951, 8957, 8960, 8961, 8967, 8968, 8979, 8980, 8981, 8986, 8992, 8993, 8996, 8998, 9001, 9003, 9009, 9011, 9012, 9013, 9016, 9018, 9020, 9021, 9022, 9025, 9026, 9027, 9029, 9030, 9033, 9045, 9050, 9052, 9057, 9058, 9059, 9060, 9061, 9063, 9065, 9066, 9068, 9069, 9071, 9072, 9075, 9078, 9083, 9086, 9087, 9088, 9091, 9092, 9095, 9097, 9098, 9106, 9107, 9112, 9114, 9115, 9116, 9118, 9119, 9120, 9123, 9125, 9129, 9131, 9133, 9134, 9138, 9140, 9141, 9142, 9143, 9144, 9145, 9147, 9151, 9152, 9154, 9159, 9167, 9168, 9172, 9175, 9177, 9180, 9183, 9185, 9186, 9188, 9189, 9195, 9205, 9206, 9207, 9210, 9211, 9213, 9214, 9215, 9216, 9218, 9220, 9223, 9226, 9229, 9233, 9237, 9240, 9243, 9249, 9253, 9257, 9259, 9267, 9269, 9270, 9273, 9275, 9282, 9284, 9285, 9288, 9292, 9300, 9306, 9308, 9311, 9314, 9321, 9323, 9326, 9327, 9328, 9336, 9337, 9338, 9339, 9341, 9346, 9347, 9350, 9355, 9359, 9360, 9366, 9371, 9375, 9376, 9382, 9389, 9391, 9392, 9394, 9400, 9402, 9403, 9406, 9407, 9412, 9413, 9414, 9419, 9421, 9422, 9423, 9425, 9429, 9439, 9440, 9443, 9449, 9451, 9452, 9453, 9456, 9460, 9467, 9471, 9477, 9481, 9484, 9490, 9497, 9500, 9502, 9503, 9504, 9509, 9517, 9518, 9519, 9521, 9522, 9534, 9535, 9536, 9538, 9540, 9545, 9546, 9548, 9550, 9551, 9553, 9555, 9560, 9564, 9567, 9568, 9571, 9575, 9577, 9587, 9592, 9595, 9596, 9601, 9602, 9605, 9606, 9609, 9615, 9617, 9620, 9621, 9623, 9624, 9626, 9629, 9633, 9638, 9641, 9642, 9644, 9645, 9648, 9652, 9653, 9655, 9656, 9657, 9658, 9659, 9663, 9666, 9668, 9670, 9682, 9686, 9692, 9695, 9696, 9698, 9706, 9708, 9710, 9711, 9715, 9717, 9718, 9721, 9723, 9726, 9727, 9729, 9731, 9732, 9733, 9737, 9738, 9742, 9743, 9744, 9745, 9746, 9749, 9750, 9754, 9761, 9763, 9768, 9770, 9772, 9774, 9776, 9777, 9782, 9786, 9791, 9794, 9799, 9804, 9810, 9811, 9812, 9813, 9816, 9819, 9820, 9827, 9828, 9829, 9830, 9835, 9836, 9845, 9846, 9847, 9861, 9869, 9875, 9878, 9879, 9882, 9886, 9887, 9889, 9892, 9894, 9896, 9897, 9898, 9900, 9907, 9909, 9910, 9921, 9923, 9928, 9930, 9934, 9935, 9936, 9944, 9946, 9950, 9952, 9953, 9956, 9962, 9967, 9968, 9969, 9972, 9974, 9975, 9979, 9980, 9984, 9985, 9988, 9990, 9992, 9997, 10000, 10012, 10013, 10017, 10018, 10019, 10022, 10026, 10027, 10033, 10040, 10041, 10047, 10049, 10050, 10051, 10055, 10058, 10059, 10060, 10062, 10063, 10064, 10075, 10076, 10077, 10078, 10080, 10081, 10083, 10087, 10090, 10091, 10092, 10095, 10097, 10098, 10103, 10106, 10110, 10114, 10115, 10116, 10117, 10120, 10122, 10125, 10128, 10129, 10131, 10135, 10136, 10137, 10143, 10151, 10158, 10160, 10163, 10165, 10166, 10168, 10169, 10174, 10176, 10178, 10181, 10192, 10193, 10194, 10196, 10199, 10206, 10207, 10214, 10217, 10218, 10219, 10220, 10221, 10222, 10223, 10224, 10228, 10230, 10233, 10236, 10237, 10252, 10253, 10259, 10260, 10266, 10269, 10275, 10276, 10284, 10286, 10292, 10293, 10295, 10300, 10302, 10306, 10307, 10311, 10312, 10314, 10315, 10318, 10323, 10325, 10326, 10327, 10330, 10331, 10333, 10334, 10335, 10336, 10340, 10341, 10345, 10346, 10353, 10356, 10357, 10361, 10362, 10364, 10370, 10371, 10373, 10375, 10376, 10380, 10381, 10384, 10392, 10397, 10398, 10399, 10401, 10402, 10408, 10413, 10414, 10417, 10419, 10423, 10425, 10435, 10436, 10446, 10449, 10450, 10452, 10453, 10456, 10463, 10464, 10465, 10468, 10469, 10471, 10472, 10473, 10474, 10480, 10487, 10492, 10494, 10496, 10498, 10504, 10508, 10514, 10518, 10522, 10523, 10527, 10528, 10530, 10531, 10532, 10535, 10537, 10540, 10541, 10542, 10544, 10548, 10549, 10550, 10551, 10555, 10556, 10563, 10564, 10567, 10571, 10581, 10582, 10583, 10584, 10593, 10595, 10596, 10597, 10599, 10601, 10605, 10608, 10615, 10616, 10617, 10621, 10622, 10626, 10628, 10632, 10636, 10640, 10643, 10645, 10646, 10650, 10651, 10657, 10665, 10668, 10669, 10671, 10676, 10678, 10679, 10682, 10683, 10684, 10685, 10686, 10689, 10694, 10700, 10701, 10705, 10711, 10715, 10721, 10722, 10726, 10729, 10734, 10736, 10738, 10740, 10741, 10744, 10752, 10753, 10754, 10756, 10763, 10768, 10772, 10774, 10775, 10778, 10779, 10780, 10781, 10785, 10787, 10788, 10795, 10801, 10802, 10803, 10804, 10809, 10810, 10811, 10822, 10823, 10824, 10827, 10833, 10836, 10838, 10841, 10843, 10850, 10851, 10853, 10854, 10856, 10857, 10858, 10860, 10863, 10867, 10870, 10874, 10877, 10878, 10886, 10887, 10888, 10889, 10897, 10901, 10902, 10911, 10913, 10918, 10920, 10924, 10926, 10927, 10928, 10929, 10930, 10933, 10934, 10938, 10940, 10941, 10947, 10966, 10967, 10972, 10974, 10976, 10977, 10979, 10993, 10996, 10999, 11002, 11004, 11008, 11015, 11017, 11021, 11022, 11023, 11024, 11027, 11030, 11032, 11036, 11037, 11040, 11046, 11047, 11053, 11058, 11066, 11078, 11082, 11083, 11090, 11095, 11100, 11107, 11109, 11111, 11114, 11116, 11117, 11118, 11119, 11122, 11123, 11124, 11126, 11128, 11129, 11133, 11136, 11137, 11147, 11149, 11150, 11151, 11152, 11153, 11154, 11160, 11163, 11172, 11177, 11178, 11179, 11180, 11181, 11184, 11187, 11188, 11190, 11191, 11192, 11193, 11194, 11198, 11204, 11213, 11214, 11217, 11222, 11224, 11228, 11229, 11230, 11233, 11235, 11236, 11237, 11238, 11239, 11242, 11243, 11246, 11247, 11251, 11253, 11254, 11255, 11258, 11260, 11263, 11266, 11274, 11282, 11290, 11291, 11292, 11293, 11298, 11304, 11315, 11318, 11328, 11329, 11330, 11331, 11332, 11337, 11339, 11340, 11345, 11346, 11348, 11349, 11352, 11358, 11359, 11362, 11363, 11365, 11366, 11369, 11371, 11373, 11380, 11382, 11385, 11387, 11391, 11394, 11395, 11401, 11404, 11405, 11406, 11408, 11424, 11430, 11431, 11435, 11438, 11439, 11440, 11443, 11447, 11448, 11449, 11451, 11459, 11465, 11466, 11472, 11477, 11478, 11487, 11489, 11490, 11492, 11496, 11500, 11501, 11506, 11507, 11508, 11520, 11521, 11523, 11524, 11526, 11527, 11533, 11534, 11540, 11544, 11546, 11548, 11550, 11551, 11553, 11558, 11560, 11561, 11567, 11568, 11570, 11571, 11576, 11577, 11578, 11586, 11588, 11593, 11595, 11596, 11597, 11603, 11604, 11605, 11606, 11607, 11610, 11611, 11615, 11617, 11618, 11619, 11621, 11623, 11625, 11628, 11636, 11638, 11647, 11649, 11650, 11655, 11656, 11658, 11659, 11663, 11668, 11669, 11673, 11678, 11681, 11682, 11688, 11691, 11692, 11694, 11695, 11696, 11698, 11703, 11705, 11707, 11712, 11718, 11720, 11721, 11725, 11730, 11731, 11736, 11737, 11743, 11744, 11748, 11753, 11760, 11761, 11765, 11771, 11776, 11777, 11781, 11782, 11783, 11785, 11786, 11792, 11794, 11797, 11799, 11800, 11809, 11811, 11818, 11820, 11830, 11836, 11837, 11839, 11840, 11842, 11846, 11847, 11848, 11851, 11854, 11856, 11858, 11861, 11864, 11865, 11868, 11872, 11876, 11877, 11878, 11879, 11881, 11886, 11887, 11889, 11891, 11892, 11894, 11895, 11897, 11901, 11902, 11906, 11909, 11911, 11913, 11914, 11915, 11916, 11917, 11919, 11920, 11921, 11922, 11923, 11926, 11928, 11929, 11930, 11933, 11934, 11940, 11943, 11947, 11949, 11950, 11953, 11956, 11959, 11960, 11961, 11962, 11963, 11965, 11974, 11975, 11976, 11977, 11978, 11979, 11983, 11987, 11988, 11989, 11993, 11997, 11998, 11999, 12004, 12008, 12014, 12015, 12017, 12018, 12019, 12020, 12021, 12023, 12024, 12026, 12027, 12032, 12033, 12042, 12043, 12044, 12052, 12059, 12075, 12080, 12083, 12091, 12092, 12093, 12098, 12102, 12104, 12106, 12108, 12109, 12110, 12112, 12115, 12118, 12126, 12128, 12129, 12134, 12137, 12138, 12139, 12143, 12147, 12148, 12149, 12151, 12163, 12165, 12166, 12167, 12171, 12174, 12175, 12176, 12181, 12183, 12185, 12197, 12204, 12207, 12208, 12215, 12217, 12219, 12223, 12227, 12228, 12229, 12234, 12241, 12245, 12249, 12250, 12253, 12256, 12259, 12260, 12263, 12267, 12268, 12269, 12278, 12281, 12283, 12284, 12286, 12293, 12304, 12307, 12311, 12313, 12314, 12315, 12317, 12321, 12323, 12324, 12326, 12329, 12333, 12337, 12340, 12343, 12344, 12345, 12347, 12356, 12359, 12364, 12368, 12369, 12370, 12372, 12374, 12379, 12380, 12381, 12383, 12391, 12397, 12399, 12400, 12401, 12403, 12404, 12405, 12406, 12410, 12411, 12414, 12416, 12418, 12420, 12421, 12424, 12425, 12426, 12427, 12428, 12429, 12437, 12439, 12440, 12445, 12447, 12451, 12454, 12455, 12456, 12457, 12461, 12462, 12465, 12467, 12468, 12473, 12476, 12478, 12481, 12482, 12487, 12488, 12489, 12491, 12494, 12495, 12497, 12503, 12504, 12508, 12515, 12521, 12525, 12531, 12536, 12539, 12546, 12547, 12549, 12555, 12556, 12557, 12559, 12561, 12562, 12564, 12565, 12567, 12568, 12570, 12572, 12585, 12588, 12590, 12597, 12600, 12608, 12609, 12611, 12614, 12616, 12619, 12623, 12626, 12628, 12631, 12633, 12634, 12636, 12638, 12639, 12641, 12645, 12649, 12651, 12655, 12658, 12668, 12670, 12671, 12672, 12679, 12680, 12681, 12682, 12684, 12691, 12698, 12699, 12701, 12702, 12707, 12713, 12718, 12719, 12722, 12729, 12731, 12732, 12733, 12735, 12737, 12738, 12739, 12740, 12742, 12749, 12751, 12752, 12754, 12755, 12758, 12760, 12761, 12764, 12766, 12768, 12771, 12772, 12773, 12783, 12788, 12790, 12797, 12801, 12802, 12805, 12810, 12812, 12813, 12819, 12820, 12822, 12824, 12826, 12827, 12828, 12834, 12836, 12838, 12839, 12844, 12849, 12853, 12854, 12866, 12869, 12876, 12882, 12883, 12887, 12888, 12898, 12900, 12904, 12905, 12906, 12912, 12916, 12917, 12918, 12920, 12921, 12926, 12932, 12933, 12938, 12939, 12942, 12946, 12947, 12950, 12953, 12961, 12963, 12968, 12969, 12972, 12973, 12974, 12975, 12976, 12977, 12978, 12982, 12983, 12986, 12987, 12989, 12990, 12991, 12994, 13004, 13006, 13010, 13011, 13017, 13022, 13023, 13024, 13030, 13032, 13035, 13038, 13040, 13049, 13050, 13053, 13055, 13056, 13060, 13061, 13066, 13069, 13070, 13071, 13077, 13079, 13085, 13086, 13087, 13095, 13100, 13101, 13102, 13105, 13106, 13109, 13112, 13114, 13115, 13116, 13117, 13118, 13124, 13128, 13135, 13142, 13156, 13169, 13175, 13182, 13191, 13197, 13199, 13206, 13209, 13210, 13212, 13213, 13215, 13217, 13221, 13222, 13227, 13230, 13232, 13234, 13235, 13236, 13237, 13238, 13249, 13251, 13255, 13258, 13259, 13260, 13261, 13263, 13267, 13268, 13269, 13270, 13276, 13279, 13280, 13281, 13285, 13295, 13296, 13298, 13303, 13304, 13313, 13315, 13317, 13320, 13321, 13323, 13326, 13328, 13330, 13332, 13338, 13347, 13348, 13349, 13353, 13354, 13358, 13361, 13367, 13368, 13369, 13384, 13393, 13396, 13397, 13401, 13410, 13414, 13416, 13419, 13420, 13423, 13424, 13429, 13431, 13433, 13439, 13440, 13446, 13449, 13451, 13456, 13460, 13463, 13466, 13468, 13469, 13472, 13473, 13475, 13494, 13498, 13499, 13500, 13501, 13503, 13504, 13506, 13510, 13513, 13514, 13515, 13516, 13517, 13519, 13520, 13521, 13522, 13529, 13530, 13532, 13535, 13536, 13540, 13543, 13544, 13546, 13547, 13549, 13552, 13556, 13568, 13569, 13574, 13579, 13580, 13583, 13584, 13589, 13597, 13598, 13599, 13601, 13602, 13603, 13604, 13621, 13623, 13627, 13628, 13631, 13632, 13634, 13636, 13637, 13638, 13641, 13643, 13647, 13650, 13652, 13654, 13660, 13661, 13662, 13663, 13669, 13671, 13675, 13677, 13678, 13683, 13684, 13687, 13688, 13693, 13700, 13702, 13703, 13706, 13710, 13712, 13713, 13715, 13716, 13720, 13721, 13725, 13727, 13728, 13729, 13730, 13733, 13737, 13738, 13739, 13742, 13745, 13747, 13748, 13750, 13751, 13756, 13764, 13766, 13767, 13769, 13773, 13775, 13776, 13781, 13783, 13785, 13786, 13787, 13791, 13794, 13795, 13796, 13798, 13802, 13809, 13816, 13817, 13818, 13819, 13820, 13822, 13823, 13827, 13830, 13831, 13834, 13835, 13843, 13852, 13859, 13860, 13862, 13864, 13866, 13869, 13872, 13873, 13874, 13877, 13881, 13886, 13888, 13891, 13892, 13894, 13898, 13901, 13904, 13906, 13909, 13910, 13911, 13917, 13919, 13923, 13925, 13927, 13930, 13933, 13944, 13947, 13948, 13952, 13953, 13954, 13956, 13961, 13963, 13965, 13969, 13970, 13971, 13975, 13976, 13980, 13983, 13984, 13990, 13991, 13994, 13999, 14000, 14003, 14009, 14014, 14016, 14017, 14018, 14022, 14027, 14030, 14031, 14036, 14040, 14041, 14043, 14049, 14050, 14051, 14052, 14062, 14063, 14066, 14073, 14075, 14084, 14086, 14088, 14092, 14093, 14094, 14102, 14106, 14107, 14109, 14110, 14115, 14116, 14118, 14122, 14126, 14129, 14132, 14134, 14138, 14139, 14142, 14143, 14145, 14146, 14148, 14149, 14150.

Promoters expressing in the flag leaf at the tasseling stage include SEQ IDs: 1, 3, 4, 7, 8, 13, 14, 15, 19, 31, 34, 36, 48, 53, 56, 64, 65, 81, 82, 88, 93, 96, 97, 99, 101, 102, 103, 107, 110, 111, 112, 117, 121, 126, 129, 130, 131, 132, 141, 143, 144, 146, 147, 148, 152, 154, 160, 162, 165, 168, 172, 174, 176, 179, 181, 186, 187, 188, 193, 194, 195, 196, 202, 204, 205, 207, 210, 211, 215, 223, 230, 232, 233, 234, 235, 236, 237, 240, 243, 244, 246, 248, 249, 250, 251, 257, 262, 264, 269, 270, 271, 273, 274, 280, 281, 284, 286, 288, 289, 299, 301, 302, 303, 305, 306, 309, 314, 316, 318, 319, 320, 328, 329, 332, 335, 337, 340, 341, 348, 349, 354, 357, 359, 360, 367, 371, 376, 378, 379, 387, 388, 396, 401, 402, 406, 407, 418, 423, 424, 428, 429, 431, 433, 434, 436, 452, 455, 456, 461, 466, 468, 478, 479, 483, 485, 488, 496, 498, 501, 502, 507, 509, 510, 512, 513, 514, 516, 517, 520, 522, 523, 525, 529, 532, 533, 536, 538, 541, 542, 544, 546, 547, 554, 557, 564, 565, 573, 580, 585, 591, 594, 595, 596, 598, 599, 604, 608, 613, 614, 620, 623, 626, 629, 630, 633, 634, 635, 643, 644, 653, 656, 662, 663, 666, 670, 674, 676, 677, 681, 686, 693, 694, 701, 705, 716, 717, 719, 721, 722, 723, 724, 733, 734, 736, 739, 740, 742, 744, 753, 757, 763, 765, 768, 771, 782, 783, 791, 792, 793, 794, 795, 797, 800, 806, 808, 813, 819, 820, 821, 829, 830, 833, 840, 842, 844, 845, 850, 855, 857, 859, 860, 862, 863, 865, 868, 869, 870, 871, 878, 883, 884, 885, 887, 888, 890, 891, 892, 895, 897, 898, 899, 901, 903, 907, 908, 911, 912, 913, 916, 917, 919, 924, 925, 929, 931, 936, 938, 943, 944, 951, 953, 954, 957, 958, 961, 962, 964, 966, 969, 971, 974, 977, 979, 980, 982, 983, 987, 989, 991, 994, 995, 997, 999, 1006, 1007, 1009, 1011, 1014, 1028, 1039, 1041, 1042, 1043, 1045, 1046, 1047, 1049, 1050, 1051, 1052, 1055, 1056, 1064, 1065, 1068, 1069, 1070, 1077, 1078, 1086, 1087, 1088, 1089, 1092, 1095, 1098, 1103, 1104, 1108, 1110, 1111, 1112, 1114, 1118, 1119, 1120, 1122, 1127, 1130, 1131, 1132, 1133, 1136, 1137, 1144, 1146, 1147, 1148, 1155, 1165, 1166, 1169, 1171, 1176, 1178, 1182, 1185, 1187, 1191, 1193, 1196, 1199, 1201, 1204, 1210, 1214, 1217, 1218, 1219, 1220, 1223, 1225, 1227, 1228, 1230, 1231, 1233, 1235, 1236, 1241, 1243, 1248, 1249, 1250, 1252, 1253, 1256, 1258, 1261, 1264, 1265, 1269, 1272, 1277, 1281, 1282, 1283, 1285, 1286, 1292, 1295, 1297, 1303, 1305, 1306, 1307, 1309, 1312, 1316, 1317, 1327, 1330, 1331, 1334, 1335, 1337, 1339, 1340, 1346, 1347, 1349, 1351, 1354, 1355, 1360, 1364, 1367, 1371, 1373, 1377, 1380, 1381, 1382, 1385, 1386, 1387, 1388, 1393, 1396, 1398, 1403, 1404, 1407, 1415, 1421, 1426, 1431, 1438, 1439, 1441, 1442, 1444, 1451, 1453, 1454, 1455, 1458, 1459, 1466, 1467, 1468, 1475, 1481, 1486, 1490, 1499, 1501, 1508, 1510, 1511, 1514, 1517, 1518, 1525, 1526, 1527, 1539, 1540, 1543, 1545, 1546, 1547, 1549, 1556, 1560, 1567, 1570, 1571, 1575, 1578, 1582, 1584, 1586, 1590, 1592, 1593, 1594, 1599, 1600, 1602, 1604, 1605, 1612, 1614, 1616, 1618, 1622, 1625, 1634, 1635, 1636, 1637, 1638, 1639, 1650, 1653, 1658, 1659, 1661, 1662, 1664, 1669, 1671, 1675, 1676, 1677, 1680, 1683, 1685, 1688, 1691, 1696, 1697, 1698, 1699, 1705, 1706, 1708, 1714, 1717, 1719, 1723, 1726, 1727, 1729, 1731, 1732, 1733, 1735, 1740, 1745, 1755, 1759, 1761, 1764, 1776, 1778, 1785, 1789, 1791, 1807, 1813, 1815, 1820, 1823, 1828, 1830, 1832, 1834, 1835, 1837, 1838, 1840, 1845, 1852, 1859, 1868, 1869, 1870, 1872, 1876, 1882, 1883, 1888, 1891, 1897, 1900, 1902, 1903, 1905, 1906, 1912, 1914, 1916, 1918, 1920, 1922, 1923, 1924, 1930, 1931, 1933, 1934, 1936, 1940, 1944, 1950, 1952, 1977, 1981, 1991, 1993, 1999, 2000, 2007, 2008, 2009, 2010, 2012, 2013, 2014, 2015, 2016, 2017, 2023, 2026, 2027, 2034, 2039, 2041, 2043, 2045, 2048, 2049, 2055, 2060, 2062, 2064, 2066, 2069, 2071, 2072, 2074, 2075, 2077, 2081, 2082, 2083, 2089, 2090, 2094, 2096, 2097, 2099, 2103, 2104, 2109, 2113, 2116, 2117, 2126, 2132, 2133, 2134, 2137, 2139, 2140, 2142, 2144, 2147, 2150, 2152, 2157, 2159, 2161, 2162, 2164, 2166, 2167, 2168, 2172, 2173, 2178, 2179, 2182, 2185, 2190, 2191, 2193, 2196, 2201, 2202, 2203, 2205, 2206, 2207, 2213, 2215, 2216, 2221, 2222, 2226, 2227, 2229, 2230, 2231, 2232, 2237, 2240, 2243, 2244, 2247, 2252, 2253, 2257, 2259, 2260, 2261, 2262, 2263, 2273, 2274, 2276, 2279, 2280, 2281, 2282, 2283, 2288, 2295, 2296, 2297, 2298, 2300, 2301, 2303, 2304, 2305, 2308, 2309, 2310, 2314, 2322, 2323, 2325, 2328, 2329, 2331, 2333, 2339, 2342, 2346, 2348, 2349, 2351, 2352, 2353, 2359, 2360, 2363, 2366, 2367, 2369, 2371, 2377, 2379, 2382, 2384, 2396, 2397, 2398, 2401, 2402, 2403, 2405, 2408, 2411, 2412, 2418, 2420, 2422, 2423, 2430, 2435, 2437, 2438, 2441, 2442, 2443, 2445, 2450, 2452, 2453, 2454, 2457, 2458, 2465, 2470, 2471, 2472, 2474, 2476, 2479, 2480, 2481, 2482, 2490, 2492, 2494, 2495, 2498, 2500, 2504, 2505, 2506, 2507, 2509, 2510, 2511, 2512, 2514, 2517, 2519, 2522, 2525, 2528, 2529, 2531, 2532, 2533, 2535, 2538, 2539, 2541, 2547, 2548, 2549, 2552, 2554, 2555, 2557, 2560, 2567, 2568, 2573, 2578, 2580, 2581, 2589, 2590, 2594, 2596, 2601, 2609, 2614, 2616, 2617, 2622, 2626, 2627, 2632, 2634, 2637, 2639, 2644, 2647, 2651, 2652, 2653, 2655, 2663, 2665, 2671, 2674, 2675, 2679, 2680, 2684, 2685, 2687, 2689, 2691, 2694, 2696, 2700, 2704, 2711, 2715, 2718, 2719, 2723, 2725, 2726, 2728, 2729, 2737, 2738, 2739, 2740, 2747, 2749, 2752, 2755, 2756, 2763, 2764, 2765, 2768, 2770, 2775, 2780, 2783, 2787, 2791, 2801, 2802, 2805, 2812, 2814, 2819, 2820, 2822, 2823, 2824, 2826, 2827, 2829, 2833, 2837, 2840, 2844, 2850, 2857, 2858, 2861, 2864, 2865, 2871, 2873, 2876, 2878, 2879, 2885, 2886, 2888, 2889, 2890, 2893, 2894, 2902, 2903, 2905, 2906, 2908, 2909, 2910, 2911, 2918, 2923, 2932, 2933, 2934, 2935, 2938, 2942, 2944, 2945, 2946, 2948, 2950, 2953, 2955, 2959, 2960, 2963, 2966, 2968, 2969, 2979, 2980, 2992, 2994, 2998, 3000, 3002, 3003, 3005, 3006, 3007, 3010, 3012, 3015, 3016, 3019, 3023, 3024, 3026, 3038, 3039, 3042, 3044, 3048, 3049, 3050, 3051, 3052, 3053, 3055, 3062, 3064, 3067, 3072, 3075, 3076, 3080, 3081, 3083, 3084, 3085, 3087, 3088, 3094, 3095, 3096, 3101, 3105, 3106, 3109, 3112, 3114, 3118, 3119, 3120, 3121, 3123, 3126, 3127, 3128, 3129, 3137, 3138, 3139, 3143, 3147, 3153, 3154, 3157, 3158, 3170, 3181, 3185, 3192, 3194, 3199, 3202, 3205, 3206, 3210, 3212, 3215, 3219, 3220, 3221, 3224, 3225, 3228, 3231, 3236, 3237, 3240, 3247, 3250, 3252, 3253, 3255, 3256, 3261, 3263, 3266, 3268, 3271, 3273, 3278, 3280, 3282, 3286, 3288, 3289, 3290, 3294, 3295, 3299, 3305, 3312, 3313, 3327, 3329, 3331, 3332, 3333, 3335, 3340, 3345, 3347, 3349, 3351, 3353, 3355, 3358, 3361, 3363, 3370, 3373, 3374, 3377, 3379, 3383, 3386, 3393, 3396, 3397, 3399, 3402, 3404, 3405, 3412, 3414, 3415, 3416, 3418, 3419, 3420, 3422, 3426, 3427, 3428, 3429, 3435, 3438, 3440, 3445, 3446, 3447, 3451, 3452, 3455, 3458, 3460, 3461, 3464, 3465, 3466, 3470, 3471, 3473, 3474, 3475, 3477, 3482, 3483, 3486, 3487, 3488, 3490, 3491, 3503, 3504, 3506, 3510, 3511, 3516, 3517, 3518, 3521, 3529, 3533, 3536, 3541, 3544, 3545, 3548, 3549, 3551, 3552, 3554, 3558, 3560, 3561, 3562, 3563, 3569, 3571, 3572, 3574, 3576, 3582, 3588, 3589, 3592, 3593, 3594, 3595, 3597, 3600, 3603, 3606, 3607, 3610, 3611, 3613, 3616, 3618, 3619, 3620, 3621, 3623, 3624, 3626, 3627, 3628, 3629, 3630, 3631, 3633, 3637, 3640, 3642, 3643, 3644, 3645, 3646, 3648, 3650, 3654, 3655, 3657, 3659, 3660, 3663, 3667, 3668, 3669, 3671, 3674, 3682, 3706, 3710, 3713, 3715, 3717, 3718, 3719, 3721, 3731, 3738, 3739, 3742, 3748, 3749, 3752, 3754, 3757, 3760, 3761, 3764, 3766, 3772, 3773, 3775, 3777, 3778, 3783, 3785, 3788, 3790, 3791, 3792, 3794, 3798, 3804, 3808, 3812, 3818, 3823, 3825, 3828, 3830, 3831, 3832, 3833, 3834, 3836, 3839, 3842, 3843, 3844, 3845, 3849, 3858, 3860, 3862, 3866, 3867, 3870, 3871, 3872, 3873, 3876, 3883, 3887, 3889, 3890, 3891, 3895, 3896, 3899, 3908, 3910, 3912, 3914, 3917, 3923, 3924, 3926, 3928, 3929, 3934, 3935, 3937, 3941, 3947, 3950, 3954, 3962, 3967, 3968, 3974, 3975, 3983, 3991, 3995, 3996, 3997, 4000, 4001, 4002, 4003, 4006, 4008, 4013, 4022, 4024, 4026, 4030, 4038, 4039, 4040, 4044, 4047, 4048, 4049, 4050, 4053, 4054, 4056, 4057, 4060, 4062, 4067, 4068, 4069, 4072, 4077, 4078, 4084, 4087, 4092, 4094, 4096, 4099, 4103, 4105, 4109, 4110, 4111, 4113, 4115, 4122, 4124, 4128, 4132, 4133, 4137, 4143, 4149, 4154, 4155, 4156, 4158, 4160, 4161, 4162, 4163, 4164, 4165, 4166, 4167, 4168, 4169, 4171, 4175, 4178, 4184, 4187, 4188, 4189, 4190, 4197, 4198, 4201, 4202, 4205, 4206, 4210, 4211, 4214, 4217, 4219, 4221, 4227, 4228, 4233, 4235, 4246, 4247, 4250, 4255, 4257, 4260, 4266, 4270, 4272, 4276, 4279, 4281, 4295, 4296, 4297, 4298, 4301, 4302, 4305, 4309, 4312, 4317, 4320, 4321, 4324, 4329, 4330, 4331, 4332, 4333, 4335, 4337, 4339, 4341, 4343, 4344, 4347, 4349, 4352, 4354, 4358, 4360, 4369, 4371, 4373, 4374, 4378, 4380, 4382, 4383, 4387, 4390, 4391, 4393, 4397, 4401, 4402, 4403, 4404, 4405, 4406, 4410, 4415, 4422, 4423, 4426, 4427, 4434, 4436, 4439, 4442, 4443, 4444, 4446, 4448, 4450, 4453, 4456, 4457, 4458, 4461, 4462, 4463, 4464, 4465, 4468, 4472, 4479, 4485, 4490, 4491, 4492, 4494, 4498, 4500, 4502, 4506, 4507, 4512, 4513, 4515, 4518, 4519, 4524, 4528, 4531, 4543, 4548, 4549, 4554, 4556, 4557, 4558, 4559, 4562, 4563, 4565, 4566, 4568, 4575, 4580, 4582, 4583, 4590, 4591, 4594, 4595, 4596, 4601, 4604, 4605, 4606, 4608, 4625, 4633, 4635, 4641, 4643, 4644, 4650, 4651, 4653, 4654, 4655, 4659, 4666, 4667, 4669, 4670, 4671, 4672, 4674, 4677, 4680, 4682, 4685, 4687, 4688, 4692, 4697, 4699, 4700, 4704, 4705, 4706, 4712, 4719, 4721, 4722, 4725, 4729, 4732, 4737, 4738, 4739, 4740, 4747, 4748, 4749, 4750, 4753, 4754, 4756, 4761, 4762, 4763, 4765, 4767, 4775, 4779, 4789, 4790, 4791, 4794, 4795, 4804, 4813, 4814, 4815, 4818, 4820, 4822, 4823, 4824, 4828, 4830, 4831, 4832, 4834, 4842, 4855, 4857, 4861, 4862, 4864, 4868, 4870, 4872, 4875, 4876, 4877, 4878, 4880, 4881, 4887, 4888, 4889, 4890, 4891, 4901, 4905, 4909, 4912, 4914, 4917, 4918, 4920, 4921, 4923, 4924, 4926, 4928, 4931, 4935, 4936, 4938, 4941, 4943, 4947, 4950, 4955, 4956, 4965, 4971, 4972, 4973, 4975, 4980, 4981, 4985, 4986, 4988, 4992, 4993, 4994, 4996, 5010, 5026, 5029, 5030, 5034, 5037, 5039, 5040, 5042, 5044, 5046, 5049, 5052, 5053, 5054, 5057, 5061, 5067, 5068, 5072, 5082, 5088, 5089, 5090, 5091, 5095, 5100, 5102, 5111, 5119, 5121, 5123, 5129, 5130, 5132, 5136, 5137, 5140, 5144, 5145, 5147, 5152, 5154, 5157, 5159, 5164, 5165, 5168, 5170, 5171, 5174, 5180, 5181, 5182, 5184, 5185, 5189, 5190, 5192, 5195, 5196, 5198, 5199, 5201, 5202, 5206, 5208, 5212, 5216, 5217, 5219, 5226, 5229, 5234, 5236, 5240, 5241, 5243, 5249, 5250, 5253, 5255, 5258, 5261, 5263, 5264, 5267, 5268, 5273, 5275, 5276, 5281, 5283, 5292, 5293, 5299, 5300, 5301, 5303, 5308, 5311, 5313, 5314, 5317, 5319, 5324, 5325, 5327, 5329, 5330, 5332, 5334, 5341, 5342, 5346, 5348, 5351, 5359, 5361, 5366, 5367, 5372, 5379, 5382, 5386, 5388, 5389, 5391, 5394, 5395, 5398, 5400, 5403, 5405, 5411, 5414, 5417, 5427, 5431, 5438, 5446, 5448, 5449, 5452, 5456, 5457, 5458, 5459, 5463, 5464, 5466, 5467, 5472, 5476, 5481, 5482, 5483, 5493, 5495, 5496, 5497, 5498, 5506, 5508, 5510, 5513, 5515, 5516, 5518, 5519, 5520, 5521, 5524, 5530, 5535, 5537, 5539, 5543, 5549, 5557, 5559, 5562, 5565, 5566, 5568, 5569, 5571, 5572, 5574, 5575, 5579, 5581, 5585, 5586, 5588, 5591, 5592, 5596, 5597, 5604, 5612, 5613, 5614, 5615, 5616, 5618, 5620, 5621, 5627, 5631, 5632, 5635, 5640, 5642, 5643, 5647, 5648, 5649, 5650, 5653, 5657, 5659, 5660, 5663, 5664, 5670, 5671, 5675, 5676, 5677, 5683, 5689, 5694, 5695, 5697, 5698, 5699, 5700, 5702, 5703, 5706, 5709, 5711, 5712, 5713, 5717, 5718, 5721, 5722, 5728, 5730, 5731, 5734, 5735, 5751, 5753, 5756, 5758, 5763, 5768, 5771, 5775, 5778, 5780, 5783, 5784, 5786, 5787, 5791, 5794, 5798, 5799, 5806, 5808, 5810, 5813, 5820, 5833, 5834, 5835, 5836, 5837, 5846, 5852, 5854, 5856, 5857, 5859, 5863, 5864, 5865, 5866, 5869, 5872, 5878, 5881, 5883, 5884, 5886, 5888, 5889, 5892, 5893, 5907, 5912, 5925, 5926, 5927, 5928, 5931, 5932, 5934, 5938, 5941, 5944, 5951, 5954, 5956, 5957, 5959, 5961, 5967, 5968, 5971, 5975, 5978, 5979, 5982, 5984, 5991, 5992, 5994, 5996, 5997, 6000, 6002, 6006, 6008, 6013, 6016, 6017, 6018, 6020, 6023, 6024, 6025, 6026, 6028, 6031, 6033, 6038, 6041, 6044, 6045, 6047, 6048, 6051, 6058, 6059, 6062, 6063, 6065, 6069, 6072, 6073, 6074, 6075, 6080, 6081, 6084, 6085, 6087, 6088, 6089, 6090, 6092, 6093, 6096, 6098, 6099, 6107, 6108, 6109, 6110, 6113, 6116, 6118, 6124, 6129, 6131, 6132, 6133, 6135, 6138, 6139, 6143, 6145, 6146, 6148, 6149, 6151, 6153, 6155, 6158, 6160, 6162, 6163, 6164, 6165, 6173, 6180, 6181, 6182, 6183, 6186, 6188, 6189, 6194, 6195, 6196, 6197, 6198, 6203, 6204, 6205, 6206, 6209, 6212, 6215, 6220, 6221, 6223, 6224, 6226, 6227, 6234, 6237, 6243, 6246, 6247, 6250, 6251, 6255, 6264, 6265, 6267, 6272, 6273, 6275, 6281, 6282, 6286, 6288, 6289, 6292, 6295, 6296, 6299, 6300, 6303, 6306, 6307, 6310, 6315, 6317, 6321, 6322, 6328, 6333, 6338, 6342, 6349, 6353, 6354, 6356, 6358, 6360, 6363, 6368, 6370, 6372, 6375, 6387, 6394, 6397, 6399, 6403, 6405, 6408, 6412, 6414, 6415, 6419, 6425, 6426, 6427, 6429, 6430, 6431, 6436, 6440, 6442, 6449, 6450, 6452, 6456, 6457, 6458, 6463, 6464, 6466, 6467, 6469, 6470, 6474, 6475, 6476, 6477, 6478, 6480, 6482, 6484, 6485, 6486, 6493, 6494, 6495, 6501, 6502, 6504, 6510, 6514, 6516, 6517, 6523, 6528, 6530, 6531, 6532, 6534, 6541, 6543, 6545, 6547, 6549, 6553, 6554, 6558, 6564, 6571, 6572, 6574, 6576, 6577, 6579, 6584, 6588, 6589, 6592, 6594, 6595, 6596, 6597, 6599, 6600, 6605, 6606, 6607, 6609, 6610, 6614, 6615, 6616, 6620, 6623, 6625, 6626, 6628, 6629, 6633, 6634, 6635, 6638, 6639, 6642, 6644, 6646, 6647, 6648, 6649, 6652, 6654, 6655, 6656, 6658, 6661, 6662, 6666, 6670, 6681, 6696, 6699, 6701, 6703, 6704, 6705, 6706, 6716, 6718, 6720, 6723, 6729, 6730, 6734, 6736, 6742, 6747, 6749, 6756, 6757, 6758, 6759, 6764, 6766, 6767, 6779, 6782, 6783, 6786, 6788, 6789, 6792, 6793, 6794, 6795, 6797, 6798, 6799, 6801, 6803, 6804, 6805, 6806, 6807, 6811, 6813, 6815, 6816, 6817, 6819, 6820, 6824, 6826, 6828, 6830, 6831, 6834, 6836, 6840, 6841, 6847, 6848, 6851, 6855, 6863, 6875, 6876, 6877, 6878, 6880, 6886, 6888, 6902, 6903, 6906, 6907, 6909, 6913, 6917, 6919, 6921, 6924, 6925, 6930, 6931, 6939, 6940, 6946, 6955, 6959, 6960, 6963, 6971, 6979, 6984, 6985, 6987, 6988, 6990, 6991, 6994, 6997, 6999, 7009, 7010, 7013, 7018, 7019, 7020, 7022, 7025, 7027, 7029, 7031, 7038, 7039, 7040, 7043, 7045, 7051, 7053, 7054, 7057, 7059, 7064, 7067, 7068, 7077, 7079, 7083, 7084, 7085, 7093, 7096, 7105, 7106, 7107, 7108, 7110, 7117, 7118, 7126, 7130, 7136, 7138, 7139, 7140, 7142, 7144, 7150, 7151, 7154, 7163, 7164, 7165, 7166, 7169, 7170, 7171, 7172, 7182, 7184, 7187, 7192, 7194, 7196, 7197, 7198, 7201, 7202, 7206, 7207, 7208, 7210, 7212, 7214, 7215, 7219, 7220, 7230, 7234, 7235, 7236, 7240, 7244, 7245, 7246, 7249, 7250, 7252, 7255, 7257, 7258, 7262, 7263, 7264, 7268, 7270, 7274, 7281, 7282, 7287, 7291, 7293, 7296, 7298, 7299, 7300, 7301, 7303, 7304, 7306, 7307, 7308, 7312, 7313, 7315, 7318, 7323, 7328, 7334, 7338, 7344, 7345, 7353, 7355, 7357, 7358, 7360, 7361, 7363, 7365, 7369, 7371, 7373, 7375, 7376, 7377, 7380, 7383, 7392, 7395, 7396, 7398, 7399, 7400, 7409, 7410, 7415, 7425, 7428, 7430, 7434, 7435, 7436, 7441, 7447, 7448, 7450, 7453, 7454, 7457, 7458, 7459, 7466, 7470, 7475, 7483, 7485, 7486, 7492, 7493, 7499, 7502, 7506, 7512, 7515, 7517, 7521, 7524, 7533, 7541, 7546, 7549, 7553, 7556, 7557, 7572, 7574, 7576, 7579, 7583, 7585, 7586, 7589, 7590, 7596, 7597, 7598, 7599, 7601, 7604, 7609, 7611, 7612, 7614, 7619, 7620, 7624, 7633, 7638, 7642, 7643, 7647, 7649, 7652, 7655, 7658, 7661, 7662, 7664, 7665, 7673, 7674, 7678, 7679, 7680, 7682, 7685, 7687, 7689, 7691, 7695, 7699, 7700, 7702, 7703, 7712, 7715, 7716, 7718, 7724, 7734, 7736, 7737, 7738, 7741, 7742, 7744, 7745, 7749, 7750, 7753, 7754, 7756, 7763, 7764, 7767, 7770, 7774, 7775, 7779, 7780, 7781, 7785, 7786, 7788, 7791, 7793, 7798, 7799, 7800, 7801, 7803, 7804, 7806, 7807, 7818, 7819, 7820, 7823, 7825, 7826, 7833, 7834, 7841, 7844, 7845, 7846, 7850, 7854, 7856, 7860, 7865, 7873, 7877, 7878, 7880, 7881, 7885, 7887, 7888, 7890, 7893, 7896, 7901, 7908, 7910, 7911, 7913, 7918, 7923, 7925, 7928, 7933, 7934, 7935, 7938, 7942, 7944, 7949, 7950, 7952, 7965, 7966, 7967, 7971, 7973, 7974, 7976, 7977, 7981, 7982, 7984, 7986, 7988, 7993, 7994, 7996, 7999, 8000, 8007, 8012, 8020, 8023, 8024, 8025, 8031, 8036, 8041, 8042, 8044, 8045, 8047, 8048, 8049, 8052, 8056, 8059, 8063, 8068, 8076, 8077, 8078, 8080, 8081, 8083, 8088, 8095, 8099, 8100, 8102, 8105, 8106, 8109, 8110, 8112, 8113, 8118, 8126, 8129, 8130, 8137, 8141, 8145, 8146, 8148, 8151, 8155, 8163, 8164, 8166, 8170, 8179, 8181, 8182, 8189, 8193, 8196, 8198, 8202, 8204, 8208, 8213, 8217, 8219, 8220, 8222, 8234, 8237, 8239, 8241, 8242, 8248, 8249, 8250, 8252, 8253, 8264, 8265, 8268, 8269, 8274, 8275, 8289, 8291, 8292, 8296, 8297, 8300, 8304, 8305, 8308, 8311, 8315, 8318, 8319, 8322, 8326, 8329, 8334, 8335, 8339, 8340, 8347, 8349, 8350, 8351, 8352, 8353, 8355, 8358, 8367, 8368, 8371, 8373, 8378, 8379, 8380, 8382, 8389, 8392, 8395, 8396, 8401, 8402, 8403, 8404, 8406, 8408, 8410, 8413, 8414, 8415, 8416, 8417, 8418, 8428, 8430, 8433, 8435, 8438, 8439, 8440, 8442, 8443, 8444, 8445, 8446, 8447, 8448, 8449, 8450, 8451, 8457, 8458, 8459, 8465, 8470, 8472, 8473, 8474, 8476, 8477, 8478, 8481, 8482, 8483, 8490, 8498, 8501, 8502, 8503, 8505, 8507, 8509, 8513, 8515, 8521, 8523, 8524, 8525, 8526, 8531, 8532, 8533, 8541, 8542, 8543, 8549, 8550, 8553, 8554, 8557, 8561, 8565, 8574, 8576, 8581, 8582, 8583, 8585, 8588, 8592, 8593, 8594, 8596, 8597, 8598, 8600, 8602, 8603, 8605, 8610, 8612, 8622, 8631, 8634, 8635, 8638, 8642, 8644, 8646, 8648, 8652, 8657, 8658, 8659, 8663, 8665, 8669, 8672, 8675, 8676, 8677, 8685, 8686, 8693, 8699, 8700, 8703, 8705, 8706, 8708, 8709, 8712, 8713, 8714, 8715, 8717, 8719, 8720, 8722, 8726, 8731, 8732, 8736, 8741, 8746, 8748, 8755, 8757, 8761, 8769, 8770, 8773, 8774, 8777, 8779, 8782, 8783, 8784, 8786, 8789, 8792, 8795, 8802, 8803, 8804, 8808, 8810, 8818, 8821, 8822, 8824, 8828, 8830, 8831, 8833, 8834, 8835, 8838, 8841, 8842, 8843, 8844, 8845, 8853, 8865, 8866, 8874, 8876, 8877, 8878, 8881, 8883, 8886, 8888, 8891, 8892, 8896, 8897, 8900, 8901, 8905, 8907, 8908, 8911, 8916, 8917, 8918, 8919, 8922, 8924, 8926, 8928, 8929, 8937, 8938, 8941, 8945, 8946, 8948, 8951, 8957, 8960, 8961, 8967, 8968, 8969, 8979, 8980, 8981, 8985, 8986, 8991, 8992, 8993, 8998, 9001, 9003, 9009, 9011, 9012, 9013, 9014, 9016, 9018, 9020, 9021, 9022, 9025, 9026, 9027, 9029, 9030, 9033, 9045, 9050, 9052, 9057, 9058, 9059, 9060, 9061, 9063, 9065, 9066, 9068, 9069, 9071, 9072, 9075, 9076, 9078, 9083, 9084, 9086, 9087, 9088, 9091, 9092, 9095, 9096, 9097, 9106, 9107, 9114, 9115, 9116, 9118, 9120, 9123, 9125, 9129, 9131, 9133, 9134, 9138, 9140, 9141, 9142, 9143, 9145, 9147, 9151, 9152, 9154, 9159, 9167, 9168, 9172, 9175, 9177, 9180, 9183, 9185, 9186, 9188, 9189, 9195, 9200, 9205, 9206, 9207, 9213, 9214, 9215, 9216, 9218, 9220, 9223, 9226, 9229, 9233, 9237, 9240, 9243, 9248, 9249, 9253, 9257, 9259, 9267, 9269, 9270, 9273, 9275, 9282, 9284, 9285, 9287, 9288, 9290, 9291, 9292, 9300, 9304, 9306, 9308, 9310, 9311, 9314, 9320, 9321, 9323, 9326, 9327, 9328, 9333, 9336, 9337, 9338, 9339, 9346, 9347, 9348, 9350, 9355, 9359, 9360, 9366, 9371, 9375, 9376, 9382, 9389, 9391, 9392, 9394, 9400, 9402, 9403, 9406, 9407, 9412, 9413, 9415, 9419, 9421, 9423, 9439, 9440, 9443, 9449, 9451, 9452, 9453, 9456, 9460, 9467, 9468, 9471, 9472, 9473, 9477, 9481, 9484, 9490, 9497, 9500, 9503, 9504, 9509, 9514, 9517, 9518, 9519, 9521, 9522, 9534, 9535, 9536, 9538, 9545, 9546, 9548, 9550, 9551, 9553, 9555, 9560, 9564, 9565, 9567, 9568, 9571, 9575, 9577, 9586, 9587, 9590, 9591, 9592, 9595, 9596, 9601, 9602, 9606, 9608, 9609, 9614, 9615, 9617, 9620, 9621, 9623, 9624, 9626, 9629, 9632, 9633, 9638, 9648, 9649, 9652, 9653, 9655, 9657, 9658, 9659, 9663, 9666, 9668, 9670, 9674, 9682, 9686, 9692, 9695, 9696, 9698, 9706, 9708, 9710, 9711, 9715, 9718, 9721, 9723, 9726, 9727, 9729, 9731, 9732, 9733, 9737, 9738, 9742, 9743, 9744, 9745, 9746, 9749, 9750, 9754, 9761, 9763, 9768, 9770, 9772, 9774, 9776, 9777, 9782, 9786, 9787, 9791, 9794, 9798, 9799, 9809, 9810, 9811, 9812, 9813, 9816, 9819, 9820, 9827, 9828, 9829, 9835, 9836, 9845, 9846, 9847, 9861, 9869, 9873, 9875, 9878, 9879, 9882, 9886, 9887, 9892, 9894, 9896, 9897, 9898, 9900, 9907, 9909, 9911, 9921, 9923, 9928, 9930, 9935, 9936, 9940, 9944, 9946, 9950, 9952, 9953, 9960, 9962, 9967, 9968, 9969, 9972, 9973, 9974, 9975, 9980, 9981, 9984, 9985, 9988, 9990, 9991, 9992, 9996, 9997, 10000, 10008, 10013, 10017, 10018, 10019, 10022, 10026, 10027, 10032, 10033, 10041, 10049, 10051, 10054, 10055, 10058, 10059, 10060, 10062, 10063, 10064, 10072, 10075, 10076, 10077, 10078, 10080, 10081, 10083, 10090, 10091, 10092, 10095, 10097, 10098, 10101, 10102, 10103, 10106, 10110, 10114, 10115, 10116, 10117, 10120, 10122, 10125, 10128, 10129, 10131, 10135, 10136, 10137, 10143, 10151, 10158, 10160, 10163, 10165, 10166, 10168, 10169, 10174, 10176, 10178, 10179, 10181, 10192, 10193, 10194, 10195, 10196, 10199, 10206, 10207, 10217, 10218, 10219, 10220, 10221, 10222, 10223, 10224, 10225, 10228, 10230, 10231, 10233, 10236, 10237, 10240, 10252, 10253, 10255, 10258, 10259, 10260, 10266, 10269, 10275, 10276, 10278, 10284, 10286, 10292, 10295, 10300, 10302, 10306, 10307, 10311, 10312, 10314, 10315, 10318, 10323, 10325, 10326, 10327, 10331, 10333, 10334, 10335, 10336, 10340, 10341, 10345, 10346, 10353, 10356, 10357, 10361, 10362, 10364, 10371, 10373, 10375, 10376, 10380, 10381, 10384, 10392, 10397, 10398, 10399, 10401, 10402, 10405, 10408, 10414, 10416, 10417, 10419, 10421, 10423, 10425, 10426, 10435, 10436, 10446, 10447, 10449, 10450, 10451, 10452, 10453, 10456, 10460, 10463, 10464, 10465, 10468, 10469, 10471, 10474, 10480, 10487, 10488, 10494, 10495, 10496, 10498, 10504, 10508, 10514, 10518, 10521, 10522, 10523, 10527, 10528, 10530, 10531, 10532, 10536, 10537, 10540, 10541, 10542, 10543, 10544, 10548, 10549, 10550, 10551, 10555, 10556, 10563, 10564, 10567, 10571, 10577, 10581, 10582, 10583, 10588, 10593, 10595, 10596, 10597, 10599, 10601, 10608, 10613, 10615, 10616, 10617, 10621, 10622, 10626, 10628, 10636, 10637, 10638, 10639, 10640, 10643, 10645, 10646, 10650, 10651, 10657, 10665, 10668, 10669, 10671, 10676, 10678, 10679, 10682, 10683, 10684, 10685, 10686, 10689, 10694, 10700, 10701, 10705, 10707, 10711, 10721, 10723, 10724, 10726, 10729, 10734, 10736, 10738, 10740, 10741, 10744, 10747, 10752, 10753, 10754, 10756, 10757, 10763, 10768, 10770, 10772, 10774, 10775, 10778, 10779, 10780, 10785, 10787, 10788, 10795, 10801, 10802, 10803, 10804, 10805, 10809, 10810, 10811, 10822, 10823, 10824, 10827, 10833, 10836, 10837, 10838, 10843, 10850, 10851, 10853, 10854, 10856, 10857, 10858, 10860, 10863, 10866, 10867, 10870, 10877, 10878, 10886, 10887, 10897, 10899, 10901, 10902, 10911, 10913, 10918, 10920, 10924, 10926, 10927, 10928, 10929, 10930, 10933, 10934, 10938, 10940, 10941, 10947, 10960, 10966, 10967, 10972, 10976, 10977, 10979, 10988, 10993, 10996, 10999, 11008, 11015, 11017, 11021, 11022, 11023, 11024, 11030, 11032, 11036, 11037, 11040, 11046, 11047, 11050, 11051, 11053, 11058, 11066, 11078, 11082, 11083, 11090, 11095, 11100, 11107, 11109, 11111, 11114, 11116, 11117, 11118, 11119, 11122, 11124, 11126, 11128, 11129, 11133, 11134, 11136, 11137, 11138, 11147, 11149, 11150, 11151, 11152, 11153, 11154, 11160, 11162, 11163, 11168, 11172, 11177, 11178, 11181, 11184, 11187, 11188, 11190, 11191, 11192, 11193, 11194, 11198, 11203, 11204, 11214, 11216, 11217, 11222, 11224, 11226, 11228, 11229, 11230, 11232, 11233, 11236, 11237, 11238, 11239, 11242, 11243, 11246, 11247, 11251, 11253, 11254, 11255, 11258, 11260, 11263, 11266, 11274, 11282, 11291, 11292, 11293, 11298, 11304, 11313, 11315, 11316, 11317, 11318, 11328, 11329, 11330, 11331, 11332, 11337, 11339, 11340, 11345, 11346, 11348, 11349, 11352, 11358, 11359, 11363, 11365, 11369, 11371, 11373, 11374, 11377, 11379, 11380, 11382, 11385, 11387, 11391, 11394, 11395, 11398, 11401, 11404, 11405, 11406, 11408, 11417, 11424, 11431, 11435, 11438, 11439, 11440, 11443, 11446, 11447, 11448, 11449, 11451, 11459, 11465, 11466, 11472, 11477, 11487, 11489, 11490, 11492, 11496, 11498, 11499, 11500, 11501, 11505, 11506, 11507, 11508, 11520, 11521, 11523, 11524, 11526, 11527, 11531, 11532, 11533, 11534, 11540, 11544, 11546, 11548, 11550, 11551, 11553, 11558, 11560, 11561, 11567, 11568, 11570, 11571, 11576, 11577, 11578, 11585, 11586, 11588, 11593, 11594, 11595, 11596, 11597, 11599, 11603, 11604, 11605, 11606, 11607, 11610, 11611, 11612, 11615, 11617, 11618, 11619, 11621, 11623, 11625, 11628, 11634, 11636, 11638, 11647, 11649, 11650, 11655, 11656, 11658, 11659, 11663, 11669, 11678, 11681, 11682, 11688, 11691, 11692, 11694, 11695, 11696, 11698, 11699, 11703, 11705, 11707, 11712, 11718, 11720, 11721, 11725, 11730, 11731, 11733, 11736, 11737, 11740, 11743, 11744, 11748, 11753, 11759, 11760, 11761, 11765, 11771, 11776, 11777, 11781, 11782, 11783, 11785, 11786, 11792, 11794, 11797, 11799, 11800, 11805, 11809, 11811, 11818, 11820, 11829, 11830, 11836, 11837, 11839, 11840, 11842, 11846, 11847, 11848, 11851, 11854, 11856, 11858, 11861, 11864, 11865, 11868, 11872, 11876, 11877, 11878, 11881, 11886, 11887, 11889, 11891, 11892, 11894, 11895, 11897, 11901, 11906, 11909, 11911, 11913, 11914, 11915, 11916, 11917, 11918, 11919, 11920, 11921, 11922, 11923, 11926, 11927, 11928, 11929, 11930, 11933, 11934, 11940, 11943, 11945, 11947, 11949, 11950, 11953, 11956, 11959, 11960, 11961, 11962, 11965, 11974, 11975, 11976, 11977, 11978, 11979, 11980, 11983, 11987, 11988, 11989, 11993, 11997, 11998, 11999, 12004, 12008, 12014, 12015, 12017, 12018, 12019, 12020, 12021, 12023, 12024, 12026, 12027, 12032, 12033, 12042, 12043, 12044, 12051, 12059, 12068, 12080, 12081, 12083, 12092, 12093, 12098, 12102, 12104, 12106, 12108, 12109, 12110, 12112, 12114, 12115, 12117, 12118, 12126, 12127, 12128, 12129, 12134, 12137, 12138, 12139, 12143, 12147, 12148, 12149, 12151, 12161, 12163, 12165, 12166, 12171, 12174, 12175, 12176, 12181, 12183, 12185, 12197, 12198, 12200, 12201, 12204, 12207, 12208, 12215, 12217, 12218, 12219, 12223, 12227, 12228, 12234, 12241, 12245, 12249, 12250, 12253, 12256, 12259, 12260, 12263, 12267, 12268, 12269, 12274, 12278, 12280, 12283, 12284, 12286, 12287, 12293, 12297, 12298, 12299, 12304, 12311, 12313, 12314, 12317, 12321, 12323, 12324, 12326, 12329, 12331, 12333, 12334, 12337, 12340, 12343, 12344, 12345, 12347, 12356, 12359, 12364, 12368, 12369, 12370, 12373, 12374, 12375, 12380, 12381, 12383, 12391, 12397, 12400, 12401, 12403, 12404, 12405, 12406, 12410, 12411, 12414, 12416, 12418, 12420, 12421, 12424, 12426, 12427, 12428, 12429, 12437, 12440, 12441, 12445, 12447, 12451, 12454, 12455, 12456, 12457, 12461, 12462, 12465, 12467, 12468, 12472, 12473, 12476, 12478, 12481, 12482, 12487, 12488, 12489, 12491, 12494, 12495, 12497, 12503, 12504, 12508, 12521, 12525, 12530, 12531, 12536, 12539, 12546, 12547, 12549, 12554, 12555, 12556, 12557, 12559, 12561, 12562, 12563, 12564, 12565, 12567, 12568, 12572, 12585, 12588, 12590, 12597, 12600, 12605, 12608, 12609, 12611, 12616, 12619, 12622, 12623, 12626, 12628, 12631, 12633, 12634, 12636, 12638, 12639, 12641, 12645, 12649, 12651, 12655, 12668, 12670, 12671, 12672, 12675, 12679, 12680, 12681, 12682, 12684, 12691, 12693, 12695, 12698, 12699, 12701, 12702, 12707, 12711, 12713, 12718, 12719, 12722, 12729, 12731, 12732, 12733, 12735, 12737, 12738, 12739, 12740, 12741, 12742, 12749, 12751, 12752, 12754, 12758, 12760, 12761, 12762, 12764, 12766, 12768, 12769, 12771, 12783, 12788, 12789, 12790, 12797, 12801, 12802, 12805, 12810, 12812, 12813, 12814, 12819, 12820, 12822, 12824, 12826, 12827, 12828, 12834, 12835, 12836, 12838, 12839, 12844, 12849, 12850, 12853, 12854, 12866, 12869, 12883, 12884, 12887, 12888, 12895, 12898, 12900, 12904, 12905, 12906, 12910, 12912, 12916, 12917, 12918, 12920, 12921, 12932, 12938, 12939, 12941, 12942, 12946, 12947, 12950, 12953, 12954, 12961, 12963, 12966, 12968, 12969, 12972, 12973, 12974, 12975, 12977, 12978, 12982, 12986, 12987, 12989, 12990, 12991, 12994, 13006, 13007, 13010, 13011, 13012, 13017, 13022, 13023, 13024, 13030, 13032, 13035, 13038, 13040, 13044, 13049, 13050, 13053, 13055, 13056, 13060, 13061, 13066, 13067, 13069, 13070, 13074, 13077, 13079, 13085, 13086, 13087, 13095, 13100, 13101, 13102, 13105, 13106, 13112, 13114, 13115, 13116, 13117, 13118, 13123, 13124, 13128, 13131, 13135, 13142, 13144, 13147, 13151, 13156, 13169, 13175, 13182, 13189, 13191, 13197, 13199, 13205, 13206, 13209, 13210, 13212, 13213, 13215, 13217, 13222, 13224, 13227, 13230, 13232, 13234, 13235, 13236, 13237, 13238, 13239, 13243, 13249, 13255, 13258, 13259, 13260, 13261, 13263, 13264, 13268, 13269, 13270, 13273, 13276, 13280, 13281, 13285, 13291, 13295, 13296, 13298, 13303, 13304, 13313, 13315, 13317, 13319, 13320, 13321, 13323, 13326, 13328, 13330, 13332, 13347, 13348, 13349, 13353, 13354, 13361, 13367, 13368, 13369, 13384, 13393, 13396, 13397, 13401, 13408, 13410, 13414, 13416, 13419, 13420, 13423, 13424, 13429, 13431, 13433, 13439, 13440, 13444, 13446, 13449, 13451, 13454, 13456, 13460, 13463, 13466, 13468, 13469, 13473, 13475, 13494, 13499, 13500, 13501, 13503, 13504, 13506, 13510, 13513, 13514, 13515, 13516, 13517, 13519, 13520, 13521, 13522, 13529, 13530, 13532, 13535, 13536, 13540, 13543, 13544, 13546, 13547, 13549, 13552, 13556, 13568, 13569, 13574, 13577, 13578, 13579, 13580, 13582, 13583, 13584, 13587, 13589, 13597, 13598, 13599, 13601, 13602, 13603, 13604, 13621, 13623, 13628, 13631, 13632, 13634, 13637, 13638, 13641, 13643, 13647, 13650, 13652, 13654, 13660, 13661, 13662, 13663, 13669, 13671, 13675, 13677, 13678, 13683, 13684, 13688, 13698, 13700, 13703, 13704, 13706, 13710, 13712, 13713, 13715, 13716, 13720, 13721, 13725, 13727, 13728, 13729, 13730, 13737, 13738, 13742, 13745, 13747, 13750, 13751, 13756, 13764, 13766, 13767, 13768, 13769, 13773, 13775, 13781, 13783, 13786, 13787, 13790, 13791, 13794, 13795, 13796, 13798, 13802, 13809, 13816, 13817, 13818, 13819, 13820, 13822, 13823, 13824, 13827, 13830, 13831, 13833, 13834, 13835, 13843, 13859, 13866, 13869, 13870, 13872, 13873, 13874, 13877, 13881, 13886, 13888, 13891, 13892, 13894, 13896, 13898, 13901, 13904, 13906, 13908, 13909, 13910, 13911, 13917, 13919, 13923, 13925, 13927, 13930, 13933, 13938, 13944, 13947, 13948, 13952, 13954, 13956, 13961, 13963, 13965, 13969, 13970, 13971, 13975, 13976, 13980, 13983, 13984, 13988, 13990, 13991, 13999, 14000, 14003, 14009, 14013, 14014, 14016, 14017, 14018, 14022, 14027, 14030, 14031, 14036, 14041, 14043, 14049, 14050, 14051, 14052, 14062, 14063, 14066, 14069, 14070, 14071, 14073, 14075, 14081, 14082, 14084, 14086, 14088, 14091, 14092, 14093, 14094, 14096, 14102, 14105, 14106, 14110, 14112, 14115, 14116, 14118, 14122, 14126, 14128, 14129, 14130, 14132, 14134, 14137, 14138, 14139, 14142, 14143, 14145, 14148, 14149, 14150.

Promoters expressing in the flag leaf at the tasseling stage of the LH244 corn line include SEQ IDs: 1, 3, 7, 11, 12, 13, 14, 15, 19, 29, 31, 34, 36, 48, 53, 56, 64, 65, 81, 82, 88, 93, 96, 101, 102, 107, 110, 111, 112, 117, 121, 126, 129, 130, 131, 132, 143, 144, 147, 148, 152, 154, 160, 162, 165, 168, 172, 174, 176, 179, 181, 186, 187, 194, 195, 196, 199, 202, 204, 205, 207, 210, 211, 215, 223, 230, 231, 232, 234, 235, 236, 237, 240, 243, 244, 246, 249, 250, 251, 257, 262, 264, 268, 269, 270, 271, 273, 274, 279, 280, 281, 284, 286, 288, 289, 295, 299, 301, 302, 305, 306, 314, 316, 318, 319, 320, 322, 323, 328, 329, 332, 335, 338, 341, 346, 348, 349, 354, 357, 359, 360, 371, 376, 378, 379, 387, 388, 396, 401, 402, 406, 407, 415, 423, 424, 428, 429, 431, 433, 434, 436, 452, 455, 456, 460, 461, 463, 466, 468, 470, 471, 479, 481, 483, 485, 488, 496, 498, 501, 502, 504, 507, 509, 510, 512, 513, 514, 516, 517, 520, 522, 523, 525, 529, 532, 533, 536, 537, 538, 541, 542, 544, 546, 547, 554, 557, 564, 565, 573, 580, 585, 590, 591, 598, 608, 613, 614, 620, 623, 626, 630, 633, 634, 635, 643, 653, 656, 662, 663, 666, 674, 676, 677, 681, 686, 693, 694, 701, 705, 716, 717, 718, 719, 721, 723, 724, 733, 734, 736, 739, 740, 742, 744, 749, 757, 765, 768, 782, 783, 791, 792, 793, 794, 795, 797, 800, 806, 808, 813, 819, 820, 821, 829, 830, 833, 840, 842, 844, 855, 857, 859, 860, 862, 863, 865, 868, 870, 878, 883, 884, 885, 887, 890, 891, 892, 895, 897, 898, 901, 903, 907, 911, 912, 913, 916, 917, 919, 924, 925, 929, 931, 936, 938, 940, 943, 951, 953, 954, 955, 957, 958, 961, 962, 964, 966, 969, 971, 974, 977, 979, 980, 982, 983, 987, 989, 991, 994, 995, 997, 999, 1005, 1006, 1007, 1009, 1011, 1014, 1015, 1026, 1028, 1039, 1041, 1042, 1043, 1045, 1046, 1047, 1049, 1050, 1051, 1052, 1055, 1064, 1065, 1068, 1069, 1077, 1078, 1086, 1087, 1088, 1089, 1092, 1095, 1098, 1101, 1103, 1104, 1108, 1110, 1111, 1112, 1114, 1118, 1119, 1122, 1127, 1130, 1132, 1133, 1136, 1137, 1144, 1146, 1147, 1148, 1155, 1156, 1165, 1166, 1169, 1171, 1176, 1178, 1182, 1185, 1191, 1196, 1199, 1201, 1202, 1204, 1210, 1214, 1217, 1218, 1219, 1220, 1223, 1227, 1228, 1230, 1231, 1233, 1235, 1236, 1239, 1241, 1243, 1248, 1249, 1250, 1252, 1253, 1256, 1258, 1261, 1264, 1265, 1269, 1272, 1281, 1282, 1283, 1285, 1286, 1292, 1295, 1296, 1297, 1301, 1303, 1304, 1305, 1306, 1307, 1309, 1312, 1316, 1317, 1321, 1327, 1330, 1331, 1334, 1335, 1337, 1339, 1340, 1345, 1346, 1347, 1349, 1351, 1354, 1355, 1360, 1364, 1367, 1371, 1373, 1377, 1380, 1381, 1382, 1385, 1388, 1393, 1394, 1396, 1398, 1403, 1404, 1407, 1415, 1421, 1426, 1431, 1433, 1438, 1439, 1441, 1442, 1444, 1451, 1453, 1454, 1455, 1458, 1459, 1468, 1481, 1486, 1487, 1490, 1499, 1501, 1508, 1510, 1511, 1514, 1517, 1518, 1525, 1526, 1527, 1539, 1540, 1543, 1545, 1546, 1547, 1549, 1550, 1556, 1560, 1567, 1570, 1571, 1575, 1578, 1582, 1584, 1586, 1589, 1590, 1592, 1593, 1594, 1599, 1600, 1602, 1604, 1605, 1609, 1612, 1614, 1615, 1616, 1618, 1622, 1625, 1630, 1634, 1635, 1636, 1637, 1638, 1639, 1650, 1652, 1653, 1658, 1659, 1661, 1662, 1664, 1669, 1671, 1675, 1676, 1677, 1680, 1683, 1685, 1688, 1691, 1696, 1698, 1699, 1705, 1706, 1708, 1710, 1712, 1715, 1717, 1719, 1723, 1726, 1727, 1729, 1731, 1732, 1735, 1740, 1755, 1759, 1762, 1764, 1771, 1776, 1779, 1785, 1791, 1807, 1813, 1815, 1820, 1823, 1826, 1828, 1830, 1832, 1834, 1835, 1840, 1845, 1850, 1852, 1854, 1855, 1859, 1865, 1868, 1869, 1870, 1872, 1874, 1876, 1882, 1883, 1886, 1888, 1891, 1898, 1899, 1900, 1902, 1903, 1905, 1906, 1910, 1912, 1914, 1916, 1918, 1920, 1922, 1923, 1924, 1933, 1934, 1936, 1940, 1944, 1950, 1952, 1954, 1955, 1973, 1977, 1981, 1991, 1993, 1999, 2000, 2007, 2008, 2009, 2010, 2012, 2013, 2014, 2015, 2020, 2023, 2026, 2033, 2034, 2039, 2041, 2043, 2045, 2048, 2049, 2060, 2062, 2064, 2066, 2069, 2071, 2072, 2074, 2075, 2077, 2082, 2083, 2089, 2090, 2091, 2094, 2096, 2097, 2099, 2101, 2103, 2104, 2109, 2113, 2116, 2117, 2126, 2132, 2133, 2134, 2137, 2139, 2140, 2142, 2143, 2144, 2147, 2150, 2152, 2156, 2157, 2159, 2161, 2164, 2166, 2167, 2168, 2170, 2172, 2174, 2178, 2179, 2182, 2185, 2190, 2191, 2193, 2196, 2201, 2202, 2203, 2206, 2207, 2213, 2215, 2216, 2221, 2222, 2226, 2227, 2229, 2230, 2231, 2232, 2233, 2237, 2240, 2243, 2244, 2247, 2252, 2253, 2257, 2260, 2261, 2262, 2263, 2265, 2273, 2274, 2279, 2280, 2281, 2282, 2283, 2288, 2295, 2296, 2297, 2298, 2300, 2301, 2303, 2304, 2305, 2308, 2309, 2310, 2314, 2322, 2323, 2325, 2328, 2329, 2331, 2333, 2335, 2339, 2342, 2346, 2349, 2351, 2352, 2353, 2354, 2359, 2360, 2363, 2366, 2367, 2369, 2371, 2377, 2379, 2381, 2382, 2383, 2384, 2396, 2397, 2398, 2401, 2403, 2405, 2408, 2411, 2412, 2418, 2419, 2420, 2422, 2430, 2435, 2437, 2438, 2441, 2442, 2443, 2445, 2450, 2452, 2453, 2454, 2458, 2465, 2470, 2471, 2472, 2474, 2476, 2480, 2482, 2485, 2492, 2494, 2495, 2498, 2500, 2504, 2505, 2506, 2507, 2509, 2510, 2511, 2512, 2514, 2515, 2517, 2519, 2522, 2528, 2529, 2531, 2532, 2533, 2535, 2538, 2539, 2540, 2541, 2547, 2548, 2549, 2552, 2555, 2557, 2560, 2567, 2568, 2573, 2576, 2578, 2579, 2581, 2583, 2589, 2590, 2594, 2601, 2606, 2609, 2614, 2616, 2617, 2619, 2622, 2626, 2627, 2632, 2634, 2637, 2639, 2644, 2647, 2651, 2652, 2653, 2654, 2655, 2663, 2665, 2671, 2674, 2675, 2679, 2680, 2684, 2685, 2687, 2689, 2691, 2694, 2696, 2700, 2704, 2715, 2718, 2719, 2723, 2725, 2726, 2728, 2729, 2730, 2737, 2739, 2740, 2742, 2746, 2747, 2749, 2752, 2756, 2763, 2764, 2765, 2768, 2770, 2775, 2780, 2787, 2791, 2800, 2801, 2802, 2805, 2812, 2814, 2819, 2820, 2822, 2823, 2824, 2826, 2827, 2829, 2831, 2833, 2837, 2839, 2840, 2844, 2845, 2850, 2857, 2858, 2861, 2862, 2864, 2865, 2871, 2873, 2876, 2878, 2879, 2885, 2886, 2888, 2889, 2890, 2893, 2894, 2897, 2902, 2905, 2906, 2908, 2909, 2910, 2911, 2923, 2935, 2938, 2942, 2944, 2945, 2946, 2948, 2950, 2952, 2955, 2959, 2960, 2963, 2966, 2968, 2969, 2976, 2979, 2980, 2992, 2994, 2998, 3000, 3002, 3005, 3006, 3007, 3009, 3010, 3012, 3015, 3016, 3020, 3023, 3024, 3026, 3038, 3039, 3042, 3044, 3048, 3049, 3050, 3055, 3062, 3064, 3067, 3070, 3072, 3075, 3076, 3080, 3081, 3083, 3084, 3085, 3087, 3088, 3094, 3095, 3105, 3106, 3109, 3110, 3112, 3114, 3118, 3119, 3120, 3121, 3123, 3126, 3127, 3128, 3129, 3137, 3139, 3143, 3147, 3148, 3149, 3153, 3154, 3157, 3158, 3167, 3170, 3181, 3185, 3187, 3192, 3194, 3199, 3202, 3205, 3206, 3210, 3212, 3219, 3220, 3221, 3224, 3225, 3227, 3228, 3236, 3237, 3240, 3244, 3247, 3250, 3252, 3253, 3255, 3261, 3263, 3266, 3268, 3271, 3273, 3280, 3282, 3286, 3288, 3289, 3290, 3294, 3295, 3299, 3303, 3312, 3313, 3324, 3327, 3329, 3331, 3332, 3333, 3335, 3340, 3345, 3347, 3349, 3351, 3353, 3355, 3358, 3361, 3363, 3374, 3377, 3379, 3380, 3383, 3386, 3393, 3396, 3397, 3399, 3402, 3404, 3412, 3414, 3415, 3416, 3418, 3419, 3422, 3426, 3427, 3428, 3429, 3435, 3438, 3440, 3445, 3446, 3447, 3449, 3451, 3452, 3455, 3458, 3460, 3461, 3464, 3465, 3468, 3470, 3471, 3473, 3474, 3475, 3477, 3482, 3483, 3486, 3487, 3488, 3490, 3491, 3496, 3499, 3503, 3504, 3506, 3510, 3511, 3516, 3517, 3518, 3529, 3533, 3536, 3537, 3541, 3544, 3545, 3548, 3549, 3551, 3552, 3554, 3557, 3558, 3560, 3561, 3562, 3563, 3569, 3571, 3572, 3574, 3576, 3582, 3587, 3588, 3589, 3592, 3593, 3594, 3595, 3597, 3600, 3603, 3606, 3607, 3610, 3611, 3613, 3616, 3618, 3619, 3620, 3621, 3623, 3624, 3626, 3627, 3628, 3629, 3630, 3631, 3633, 3637, 3640, 3642, 3643, 3644, 3645, 3646, 3648, 3650, 3654, 3655, 3657, 3659, 3660, 3663, 3667, 3668, 3669, 3671, 3672, 3674, 3682, 3697, 3702, 3706, 3707, 3710, 3713, 3715, 3717, 3718, 3719, 3721, 3724, 3731, 3732, 3738, 3739, 3742, 3748, 3749, 3752, 3754, 3757, 3760, 3761, 3764, 3766, 3775, 3777, 3778, 3783, 3785, 3788, 3789, 3790, 3791, 3792, 3794, 3798, 3808, 3812, 3818, 3819, 3823, 3825, 3828, 3831, 3832, 3833, 3834, 3836, 3839, 3842, 3843, 3844, 3845, 3849, 3858, 3859, 3860, 3862, 3866, 3867, 3870, 3871, 3872, 3876, 3883, 3887, 3889, 3890, 3891, 3894, 3895, 3896, 3898, 3899, 3908, 3910, 3912, 3914, 3917, 3923, 3924, 3926, 3928, 3929, 3934, 3938, 3947, 3950, 3954, 3958, 3959, 3962, 3967, 3968, 3974, 3975, 3983, 3991, 3995, 3996, 3997, 4000, 4001, 4002, 4003, 4006, 4008, 4022, 4026, 4030, 4038, 4039, 4040, 4044, 4047, 4048, 4049, 4050, 4051, 4052, 4054, 4056, 4057, 4058, 4060, 4067, 4068, 4069, 4072, 4077, 4078, 4084, 4087, 4092, 4094, 4099, 4103, 4105, 4109, 4110, 4111, 4113, 4115, 4122, 4128, 4133, 4137, 4139, 4143, 4148, 4149, 4154, 4155, 4156, 4158, 4160, 4161, 4162, 4163, 4165, 4166, 4167, 4168, 4171, 4175, 4176, 4178, 4184, 4187, 4188, 4189, 4190, 4198, 4201, 4202, 4205, 4206, 4207, 4210, 4211, 4212, 4214, 4219, 4221, 4227, 4228, 4233, 4235, 4244, 4246, 4247, 4250, 4251, 4255, 4257, 4260, 4263, 4266, 4270, 4272, 4276, 4279, 4280, 4281, 4294, 4296, 4297, 4301, 4302, 4309, 4312, 4320, 4321, 4324, 4329, 4330, 4331, 4332, 4333, 4335, 4337, 4339, 4341, 4343, 4344, 4347, 4349, 4352, 4354, 4358, 4359, 4360, 4369, 4371, 4373, 4374, 4378, 4380, 4382, 4383, 4388, 4391, 4393, 4394, 4397, 4401, 4402, 4403, 4404, 4405, 4406, 4410, 4412, 4415, 4422, 4423, 4426, 4427, 4436, 4439, 4442, 4443, 4444, 4446, 4448, 4449, 4450, 4453, 4456, 4457, 4458, 4460, 4461, 4462, 4463, 4464, 4466, 4468, 4472, 4479, 4485, 4491, 4492, 4494, 4498, 4500, 4502, 4506, 4507, 4512, 4514, 4515, 4519, 4522, 4531, 4535, 4543, 4548, 4549, 4551, 4554, 4556, 4557, 4558, 4559, 4562, 4563, 4565, 4566, 4567, 4568, 4570, 4575, 4580, 4582, 4583, 4590, 4591, 4594, 4595, 4596, 4601, 4604, 4605, 4606, 4608, 4623, 4625, 4633, 4635, 4641, 4643, 4644, 4650, 4651, 4657, 4659, 4666, 4667, 4669, 4670, 4671, 4677, 4680, 4682, 4684, 4685, 4687, 4692, 4697, 4699, 4700, 4704, 4706, 4712, 4719, 4721, 4722, 4725, 4729, 4732, 4737, 4738, 4739, 4740, 4748, 4749, 4750, 4751, 4753, 4754, 4756, 4761, 4762, 4763, 4765, 4767, 4775, 4779, 4789, 4790, 4791, 4794, 4795, 4800, 4804, 4813, 4817, 4818, 4820, 4822, 4823, 4824, 4828, 4830, 4831, 4834, 4835, 4842, 4855, 4857, 4861, 4862, 4864, 4868, 4870, 4872, 4875, 4877, 4878, 4880, 4881, 4887, 4888, 4889, 4891, 4900, 4901, 4905, 4909, 4912, 4914, 4917, 4920, 4921, 4923, 4924, 4926, 4931, 4935, 4936, 4938, 4943, 4947, 4950, 4956, 4960, 4965, 4971, 4972, 4973, 4975, 4980, 4981, 4988, 4992, 4993, 4994, 4996, 5010, 5011, 5026, 5029, 5030, 5034, 5037, 5039, 5040, 5042, 5044, 5046, 5049, 5052, 5054, 5057, 5061, 5067, 5068, 5072, 5082, 5088, 5089, 5091, 5095, 5100, 5102, 5111, 5114, 5121, 5123, 5129, 5130, 5131, 5132, 5136, 5137, 5140, 5144, 5145, 5147, 5152, 5154, 5157, 5159, 5164, 5165, 5168, 5170, 5174, 5180, 5181, 5182, 5184, 5185, 5188, 5189, 5190, 5191, 5192, 5195, 5196, 5198, 5199, 5201, 5202, 5206, 5208, 5211, 5212, 5216, 5217, 5219, 5225, 5226, 5229, 5234, 5236, 5240, 5241, 5243, 5250, 5253, 5255, 5258, 5261, 5263, 5267, 5273, 5275, 5276, 5280, 5281, 5283, 5292, 5293, 5299, 5300, 5301, 5303, 5308, 5311, 5314, 5317, 5324, 5325, 5327, 5329, 5330, 5332, 5334, 5338, 5342, 5344, 5346, 5347, 5348, 5350, 5351, 5361, 5366, 5367, 5372, 5379, 5382, 5386, 5388, 5389, 5391, 5394, 5395, 5398, 5400, 5403, 5405, 5411, 5414, 5417, 5427, 5428, 5431, 5437, 5438, 5446, 5448, 5449, 5452, 5456, 5457, 5458, 5459, 5463, 5464, 5466, 5467, 5472, 5475, 5476, 5481, 5482, 5483, 5487, 5493, 5495, 5496, 5497, 5498, 5501, 5506, 5508, 5510, 5513, 5515, 5516, 5517, 5518, 5519, 5520, 5521, 5524, 5530, 5535, 5537, 5539, 5543, 5549, 5556, 5557, 5558, 5565, 5566, 5568, 5569, 5571, 5572, 5574, 5575, 5579, 5585, 5586, 5588, 5589, 5591, 5592, 5596, 5597, 5604, 5612, 5613, 5614, 5615, 5616, 5618, 5620, 5621, 5627, 5631, 5632, 5633, 5635, 5640, 5642, 5643, 5647, 5648, 5651, 5653, 5657, 5659, 5660, 5663, 5664, 5670, 5671, 5675, 5676, 5677, 5689, 5690, 5694, 5695, 5697, 5699, 5700, 5702, 5703, 5706, 5709, 5711, 5712, 5713, 5718, 5721, 5722, 5726, 5730, 5731, 5734, 5735, 5739, 5744, 5751, 5753, 5756, 5763, 5768, 5771, 5773, 5775, 5780, 5783, 5784, 5785, 5787, 5791, 5794, 5806, 5808, 5810, 5813, 5820, 5826, 5833, 5834, 5835, 5836, 5837, 5846, 5852, 5854, 5856, 5857, 5859, 5861, 5863, 5864, 5865, 5866, 5869, 5872, 5875, 5878, 5880, 5881, 5883, 5886, 5888, 5889, 5891, 5892, 5893, 5905, 5907, 5912, 5925, 5926, 5927, 5928, 5931, 5932, 5934, 5936, 5938, 5941, 5944, 5951, 5954, 5956, 5957, 5959, 5961, 5968, 5971, 5974, 5975, 5978, 5979, 5982, 5984, 5988, 5991, 5992, 5994, 5996, 5997, 6000, 6002, 6006, 6008, 6013, 6016, 6017, 6018, 6020, 6023, 6024, 6025, 6026, 6028, 6031, 6033, 6038, 6041, 6044, 6045, 6048, 6051, 6054, 6058, 6059, 6061, 6062, 6063, 6069, 6072, 6073, 6074, 6075, 6080, 6081, 6084, 6085, 6087, 6088, 6089, 6090, 6092, 6093, 6096, 6098, 6099, 6107, 6108, 6109, 6110, 6113, 6116, 6118, 6124, 6129, 6131, 6132, 6133, 6135, 6138, 6139, 6143, 6145, 6146, 6148, 6149, 6151, 6153, 6157, 6158, 6160, 6162, 6163, 6164, 6165, 6173, 6180, 6181, 6182, 6183, 6186, 6188, 6189, 6194, 6195, 6196, 6197, 6198, 6203, 6204, 6205, 6206, 6209, 6212, 6220, 6221, 6223, 6224, 6226, 6227, 6234, 6237, 6243, 6246, 6247, 6250, 6251, 6255, 6264, 6265, 6267, 6270, 6272, 6273, 6275, 6280, 6281, 6282, 6286, 6288, 6289, 6292, 6294, 6296, 6299, 6300, 6303, 6306, 6307, 6310, 6315, 6317, 6319, 6321, 6322, 6323, 6328, 6333, 6338, 6342, 6349, 6353, 6354, 6356, 6358, 6360, 6363, 6365, 6368, 6370, 6372, 6375, 6381, 6387, 6394, 6397, 6398, 6399, 6403, 6405, 6408, 6412, 6414, 6415, 6419, 6420, 6425, 6426, 6427, 6429, 6431, 6436, 6440, 6442, 6448, 6449, 6450, 6456, 6457, 6458, 6463, 6464, 6466, 6467, 6469, 6470, 6474, 6475, 6476, 6477, 6478, 6480, 6482, 6484, 6485, 6486, 6494, 6495, 6501, 6502, 6504, 6510, 6516, 6517, 6519, 6523, 6528, 6530, 6531, 6532, 6534, 6537, 6541, 6547, 6548, 6549, 6553, 6558, 6567, 6571, 6572, 6574, 6576, 6577, 6579, 6581, 6584, 6588, 6589, 6592, 6594, 6595, 6596, 6597, 6599, 6600, 6603, 6605, 6606, 6607, 6610, 6614, 6620, 6623, 6629, 6633, 6634, 6635, 6639, 6644, 6646, 6647, 6649, 6652, 6654, 6655, 6656, 6658, 6661, 6666, 6681, 6696, 6701, 6703, 6705, 6711, 6718, 6720, 6723, 6729, 6730, 6733, 6734, 6736, 6742, 6747, 6749, 6753, 6756, 6757, 6758, 6759, 6764, 6767, 6778, 6779, 6782, 6783, 6786, 6788, 6789, 6791, 6792, 6793, 6794, 6795, 6797, 6798, 6799, 6803, 6804, 6805, 6806, 6811, 6813, 6815, 6816, 6817, 6819, 6820, 6824, 6826, 6827, 6830, 6834, 6836, 6840, 6841, 6847, 6848, 6851, 6854, 6855, 6863, 6875, 6876, 6877, 6878, 6880, 6881, 6886, 6888, 6902, 6903, 6906, 6907, 6909, 6917, 6919, 6921, 6924, 6925, 6930, 6931, 6935, 6939, 6940, 6946, 6954, 6955, 6959, 6960, 6963, 6971, 6979, 6984, 6985, 6987, 6988, 6990, 6991, 6994, 6997, 6999, 7009, 7010, 7013, 7018, 7019, 7020, 7022, 7025, 7027, 7029, 7038, 7039, 7040, 7043, 7045, 7048, 7051, 7052, 7053, 7054, 7057, 7059, 7064, 7067, 7068, 7077, 7083, 7084, 7085, 7097, 7105, 7106, 7107, 7108, 7110, 7113, 7117, 7118, 7126, 7130, 7136, 7138, 7139, 7140, 7142, 7143, 7144, 7151, 7154, 7163, 7164, 7165, 7166, 7169, 7170, 7171, 7172, 7182, 7184, 7187, 7192, 7194, 7195, 7196, 7197, 7198, 7201, 7202, 7206, 7208, 7209, 7212, 7214, 7215, 7217, 7220, 7228, 7230, 7231, 7235, 7236, 7240, 7246, 7249, 7250, 7255, 7257, 7258, 7262, 7263, 7264, 7267, 7268, 7270, 7274, 7276, 7281, 7282, 7287, 7291, 7293, 7296, 7298, 7299, 7300, 7301, 7303, 7304, 7306, 7307, 7308, 7311, 7312, 7313, 7315, 7318, 7320, 7321, 7328, 7338, 7345, 7353, 7355, 7357, 7358, 7361, 7363, 7365, 7369, 7371, 7373, 7375, 7376, 7377, 7380, 7383, 7392, 7395, 7396, 7398, 7399, 7400, 7409, 7411, 7415, 7425, 7430, 7436, 7447, 7453, 7454, 7457, 7458, 7459, 7466, 7470, 7472, 7475, 7481, 7483, 7484, 7485, 7486, 7490, 7492, 7493, 7499, 7502, 7503, 7506, 7512, 7515, 7517, 7521, 7523, 7524, 7528, 7533, 7541, 7545, 7546, 7547, 7549, 7553, 7556, 7557, 7572, 7574, 7576, 7579, 7583, 7585, 7586, 7587, 7589, 7590, 7596, 7597, 7598, 7604, 7607, 7609, 7611, 7612, 7614, 7618, 7619, 7620, 7624, 7633, 7638, 7642, 7643, 7647, 7649, 7652, 7655, 7658, 7661, 7662, 7664, 7665, 7673, 7674, 7678, 7679, 7680, 7682, 7685, 7689, 7692, 7695, 7697, 7699, 7700, 7703, 7704, 7712, 7715, 7716, 7724, 7734, 7736, 7737, 7738, 7741, 7742, 7744, 7745, 7748, 7749, 7750, 7753, 7754, 7763, 7764, 7767, 7768, 7770, 7772, 7774, 7775, 7779, 7780, 7781, 7785, 7786, 7788, 7791, 7793, 7798, 7799, 7800, 7801, 7803, 7804, 7806, 7807, 7815, 7819, 7820, 7825, 7826, 7833, 7834, 7840, 7841, 7844, 7845, 7850, 7857, 7860, 7865, 7873, 7877, 7880, 7881, 7887, 7888, 7890, 7893, 7896, 7901, 7908, 7911, 7913, 7918, 7923, 7925, 7928, 7933, 7934, 7935, 7938, 7942, 7944, 7949, 7950, 7952, 7971, 7973, 7974, 7976, 7977, 7981, 7982, 7984, 7986, 7993, 7994, 7996, 7999, 8000, 8006, 8007, 8012, 8020, 8025, 8031, 8036, 8041, 8042, 8044, 8045, 8047, 8048, 8049, 8052, 8053, 8056, 8059, 8063, 8066, 8067, 8068, 8074, 8076, 8077, 8078, 8080, 8081, 8083, 8088, 8095, 8099, 8100, 8102, 8105, 8106, 8109, 8110, 8112, 8113, 8120, 8126, 8129, 8130, 8137, 8141, 8145, 8146, 8148, 8151, 8155, 8163, 8166, 8170, 8178, 8179, 8181, 8182, 8189, 8193, 8194, 8196, 8198, 8202, 8204, 8208, 8213, 8217, 8219, 8220, 8223, 8234, 8236, 8237, 8239, 8241, 8242, 8248, 8249, 8250, 8252, 8253, 8264, 8265, 8268, 8269, 8274, 8275, 8289, 8291, 8296, 8297, 8300, 8304, 8305, 8308, 8311, 8315, 8318, 8319, 8322, 8326, 8329, 8334, 8335, 8339, 8340, 8341, 8347, 8349, 8350, 8351, 8352, 8353, 8355, 8358, 8367, 8368, 8371, 8372, 8373, 8379, 8380, 8385, 8387, 8389, 8392, 8393, 8395, 8396, 8401, 8402, 8403, 8404, 8406, 8408, 8410, 8413, 8414, 8415, 8416, 8417, 8418, 8428, 8430, 8433, 8435, 8436, 8438, 8439, 8440, 8442, 8443, 8444, 8445, 8446, 8447, 8448, 8449, 8450, 8451, 8457, 8458, 8459, 8465, 8470, 8473, 8477, 8478, 8480, 8481, 8482, 8485, 8490, 8498, 8501, 8502, 8503, 8505, 8507, 8509, 8513, 8515, 8521, 8523, 8524, 8525, 8526, 8531, 8532, 8533, 8541, 8542, 8543, 8549, 8550, 8553, 8554, 8557, 8558, 8561, 8565, 8574, 8576, 8581, 8582, 8583, 8588, 8592, 8593, 8594, 8596, 8597, 8598, 8600, 8682, 8603, 8605, 8611, 8612, 8621, 8622, 8631, 8634, 8635, 8638, 8639, 8641, 8642, 8644, 8646, 8648, 8652, 8657, 8658, 8659, 8663, 8664, 8665, 8669, 8672, 8676, 8677, 8685, 8686, 8693, 8699, 8700, 8703, 8705, 8706, 8708, 8709, 8712, 8713, 8714, 8715, 8717, 8719, 8720, 8722, 8726, 8731, 8732, 8736, 8741, 8746, 8748, 8755, 8757, 8761, 8769, 8773, 8774, 8777, 8779, 8780, 8782, 8783, 8784, 8785, 8786, 8789, 8792, 8803, 8804, 8808, 8810, 8817, 8818, 8821, 8822, 8824, 8831, 8834, 8835, 8838, 8841, 8842, 8843, 8844, 8850, 8853, 8865, 8866, 8874, 8876, 8877, 8878, 8881, 8883, 8886, 8888, 8889, 8891, 8892, 8896, 8897, 8899, 8901, 8907, 8908, 8911, 8913, 8916, 8917, 8918, 8919, 8922, 8924, 8926, 8928, 8929, 8937, 8938, 8941, 8945, 8946, 8948, 8949, 8951, 8953, 8960, 8961, 8967, 8968, 8979, 8980, 8981, 8985, 8986, 8991, 8992, 8993, 8996, 8998, 9001, 9003, 9009, 9011, 9012, 9013, 9014, 9016, 9018, 9020, 9021, 9022, 9025, 9026, 9027, 9029, 9030, 9033, 9045, 9050, 9052, 9057, 9058, 9059, 9060, 9061, 9063, 9065, 9066, 9068, 9069, 9071, 9072, 9075, 9076, 9078, 9083, 9086, 9087, 9088, 9091, 9092, 9095, 9097, 9098, 9103, 9104, 9105, 9106, 9107, 9112, 9114, 9115, 9116, 9118, 9119, 9120, 9123, 9125, 9129, 9131, 9133, 9134, 9138, 9140, 9141, 9142, 9144, 9145, 9151, 9152, 9154, 9159, 9167, 9168, 9172, 9175, 9177, 9180, 9183, 9185, 9186, 9188, 9189, 9195, 9200, 9205, 9206, 9207, 9213, 9214, 9215, 9216, 9218, 9220, 9223, 9226, 9229, 9233, 9237, 9240, 9243, 9249, 9253, 9257, 9259, 9267, 9269, 9270, 9273, 9275, 9282, 9284, 9285, 9288, 9290, 9292, 9300, 9304, 9306, 9308, 9310, 9311, 9314, 9320, 9321, 9323, 9326, 9327, 9328, 9336, 9337, 9338, 9339, 9341, 9346, 9347, 9348, 9350, 9352, 9355, 9359, 9360, 9366, 9368, 9371, 9375, 9376, 9381, 9382, 9389, 9391, 9392, 9394, 9400, 9402, 9403, 9406, 9407, 9413, 9415, 9419, 9421, 9422, 9423, 9425, 9429, 9439, 9440, 9443, 9449, 9451, 9452, 9453, 9456, 9460, 9467, 9468, 9471, 9477, 9481, 9484, 9490, 9497, 9500, 9503, 9504, 9509, 9514, 9517, 9518, 9519, 9521, 9522, 9534, 9535, 9536, 9538, 9540, 9545, 9546, 9548, 9550, 9551, 9553, 9555, 9560, 9564, 9565, 9567, 9568, 9571, 9575, 9577, 9587, 9590, 9591, 9592, 9596, 9601, 9602, 9606, 9609, 9615, 9617, 9620, 9621, 9623, 9624, 9626, 9629, 9633, 9638, 9641, 9642, 9644, 9645, 9648, 9652, 9653, 9655, 9656, 9657, 9658, 9659, 9663, 9666, 9668, 9670, 9680, 9682, 9686, 9692, 9695, 9696, 9698, 9706, 9708, 9710, 9711, 9715, 9717, 9718, 9721, 9723, 9726, 9727, 9729, 9731, 9732, 9733, 9734, 9737, 9738, 9742, 9743, 9744, 9745, 9746, 9749, 9750, 9754, 9761, 9763, 9768, 9770, 9772, 9774, 9776, 9777, 9782, 9786, 9791, 9794, 9798, 9799, 9807, 9810, 9811, 9812, 9813, 9816, 9819, 9820, 9827, 9828, 9829, 9833, 9835, 9836, 9845, 9846, 9847, 9861, 9866, 9869, 9873, 9875, 9878, 9882, 9886, 9887, 9889, 9892, 9894, 9896, 9897, 9898, 9900, 9907, 9909, 9921, 9923, 9928, 9930, 9931, 9934, 9935, 9936, 9940, 9944, 9946, 9950, 9952, 9953, 9962, 9967, 9968, 9969, 9972, 9973, 9974, 9975, 9980, 9981, 9984, 9985, 9988, 9990, 9992, 9997, 10000, 10012, 10013, 10017, 10018, 10019, 10022, 10026, 10027, 10033, 10041, 10047, 10049, 10051, 10055, 10058, 10059, 10060, 10062, 10063, 10064, 10075, 10076, 10077, 10078, 10080, 10081, 10083, 10090, 10091, 10092, 10095, 10097, 10098, 10103, 10106, 10110, 10114, 10115, 10116, 10117, 10120, 10122, 10125, 10128, 10129, 10131, 10135, 10136, 10137, 10143, 10151, 10158, 10160, 10163, 10165, 10166, 10168, 10169, 10174, 10176, 10178, 10179, 10181, 10192, 10193, 10194, 10196, 10199, 10201, 10206, 10207, 10209, 10214, 10217, 10218, 10219, 10220, 10221, 10222, 10223, 10224, 10228, 10230, 10233, 10236, 10237, 10240, 10252, 10253, 10259, 10260, 10266, 10269, 10275, 10276, 10278, 10284, 10286, 10292, 10295, 10300, 10302, 10306, 10307, 10311, 10312, 10314, 10318, 10323, 10325, 10326, 10327, 10331, 10333, 10334, 10335, 10336, 10340, 10341, 10345, 10346, 10353, 10356, 10357, 10361, 10362, 10364, 10371, 10373, 10375, 10376, 10380, 10381, 10392, 10397, 10398, 10399, 10401, 10402, 10408, 10413, 10414, 10417, 10419, 10423, 10425, 10435, 10436, 10438, 10446, 10447, 10449, 10450, 10451, 10452, 10453, 10456, 10460, 10463, 10464, 10465, 10468, 10469, 10471, 10472, 10473, 10474, 10480, 10487, 10488, 10492, 10493, 10494, 10496, 10498, 10504, 10508, 10514, 10518, 10522, 10523, 10527, 10528, 10530, 10531, 10532, 10535, 10536, 10537, 10540, 10541, 10542, 10543, 10544, 10548, 10549, 10550, 10551, 10555, 10556, 10563, 10564, 10566, 10567, 10571, 10573, 10577, 10581, 10582, 10583, 10584, 10588, 10593, 10595, 10596, 10597, 10599, 10601, 10602, 10605, 10608, 10615, 10616, 10617, 10621, 10622, 10626, 10628, 10636, 10637, 10638, 10639, 10640, 10643, 10645, 10646, 10650, 10651, 10652, 10657, 10665, 10668, 10669, 10671, 10676, 10678, 10679, 10682, 10683, 10684, 10685, 10686, 10689, 10694, 10700, 10701, 10705, 10707, 10711, 10716, 10721, 10722, 10723, 10724, 10726, 10729, 10734, 10736, 10737, 10738, 10740, 10741, 10744, 10752, 10753, 10754, 10756, 10757, 10762, 10763, 10768, 10770, 10772, 10774, 10775, 10778, 10779, 10780, 10781, 10785, 10787, 10788, 10801, 10802, 10803, 10804, 10809, 10810, 10811, 10819, 10822, 10823, 10824, 10827, 10833, 10836, 10837, 10838, 10839, 10841, 10843, 10850, 10851, 10853, 10854, 10856, 10857, 10858, 10860, 10867, 10870, 10877, 10878, 10880, 10886, 10887, 10888, 10889, 10897, 10898, 10899, 10902, 10911, 10913, 10918, 10920, 10924, 10926, 10927, 10928, 10929, 10930, 10933, 10934, 10938, 10940, 10942, 10947, 10966, 10967, 10972, 10974, 10976, 10977, 10979, 10988, 10993, 10996, 10999, 11002, 11008, 11015, 11017, 11021, 11022, 11023, 11024, 11027, 11030, 11032, 11036, 11037, 11040, 11044, 11046, 11047, 11050, 11051, 11053, 11058, 11066, 11078, 11082, 11083, 11090, 11095, 11100, 11107, 11109, 11111, 11114, 11116, 11117, 11118, 11119, 11122, 11123, 11124, 11126, 11128, 11129, 11133, 11136, 11137, 11138, 11147, 11149, 11150, 11151, 11152, 11153, 11154, 11160, 11163, 11168, 11172, 11173, 11177, 11178, 11179, 11180, 11181, 11184, 11187, 11188, 11190, 11191, 11192, 11193, 11194, 11198, 11202, 11204, 11213, 11214, 11217, 11218, 11222, 11227, 11228, 11229, 11230, 11233, 11235, 11236, 11238, 11239, 11242, 11243, 11246, 11247, 11251, 11253, 11254, 11255, 11256, 11258, 11260, 11263, 11266, 11274, 11282, 11290, 11291, 11292, 11293, 11295, 11298, 11304, 11306, 11313, 11315, 11316, 11318, 11328, 11329, 11330, 11331, 11332, 11337, 11339, 11340, 11345, 11346, 11348, 11349, 11352, 11358, 11359, 11362, 11363, 11364, 11365, 11366, 11369, 11371, 11373, 11374, 11380, 11382, 11385, 11387, 11388, 11391, 11394, 11395, 11401, 11404, 11405, 11406, 11408, 11417, 11424, 11430, 11431, 11435, 11438, 11439, 11440, 11443, 11447, 11448, 11449, 11451, 11459, 11465, 11466, 11472, 11478, 11481, 11487, 11489, 11490, 11492, 11496, 11498, 11500, 11501, 11505, 11506, 11507, 11508, 11518, 11520, 11521, 11523, 11524, 11526, 11527, 11533, 11534, 11538, 11539, 11540, 11544, 11546, 11548, 11550, 11551, 11553, 11555, 11558, 11560, 11561, 11567, 11568, 11570, 11571, 11576, 11577, 11578, 11585, 11586, 11588, 11593, 11595, 11596, 11597, 11599, 11603, 11604, 11605, 11606, 11607, 11610, 11611, 11615, 11617, 11618, 11619, 11621, 11623, 11625, 11628, 11634, 11636, 11638, 11647, 11649, 11650, 11655, 11656, 11658, 11659, 11663, 11668, 11669, 11678, 11681, 11682, 11688, 11691, 11692, 11694, 11695, 11696, 11698, 11701, 11703, 11705, 11707, 11712, 11718, 11720, 11721, 11725, 11726, 11730, 11731, 11733, 11736, 11743, 11744, 11748, 11753, 11760, 11761, 11765, 11771, 11776, 11777, 11781, 11782, 11783, 11785, 11786, 11789, 11792, 11794, 11797, 11799, 11800, 11805, 11809, 11811, 11818, 11826, 11830, 11836, 11837, 11839, 11840, 11842, 11844, 11846, 11847, 11848, 11851, 11854, 11856, 11858, 11861, 11863, 11864, 11865, 11868, 11872, 11876, 11877, 11878, 11881, 11886, 11887, 11889, 11891, 11892, 11894, 11895, 11897, 11901, 11902, 11906, 11909, 11911, 11913, 11914, 11915, 11916, 11917, 11919, 11920, 11921, 11922, 11923, 11926, 11928, 11929, 11930, 11933, 11934, 11935, 11940, 11943, 11946, 11947, 11950, 11953, 11956, 11958, 11959, 11960, 11961, 11962, 11963, 11965, 11974, 11975, 11976, 11977, 11978, 11979, 11980, 11983, 11987, 11988, 11989, 11993, 11997, 11998, 11999, 12004, 12008, 12014, 12015, 12017, 12018, 12019, 12020, 12021, 12023, 12024, 12026, 12027, 12032, 12033, 12042, 12043, 12044, 12059, 12083, 12092, 12093, 12098, 12102, 12104, 12106, 12108, 12109, 12110, 12112, 12115, 12117, 12118, 12127, 12128, 12129, 12134, 12137, 12138, 12139, 12143, 12147, 12148, 12149, 12151, 12163, 12165, 12166, 12171, 12174, 12175, 12176, 12181, 12183, 12185, 12197, 12200, 12201, 12204, 12207, 12208, 12215, 12217, 12219, 12223, 12227, 12228, 12229, 12234, 12241, 12245, 12249, 12250, 12252, 12253, 12256, 12259, 12260, 12263, 12267, 12268, 12269, 12278, 12281, 12283, 12284, 12286, 12287, 12293, 12297, 12298, 12304, 12311, 12313, 12314, 12315, 12317, 12321, 12323, 12324, 12326, 12329, 12331, 12333, 12334, 12337, 12340, 12343, 12344, 12345, 12347, 12354, 12356, 12359, 12364, 12368, 12369, 12370, 12372, 12373, 12374, 12379, 12380, 12381, 12383, 12391, 12397, 12400, 12401, 12403, 12404, 12405, 12406, 12411, 12414, 12416, 12418, 12419, 12420, 12421, 12424, 12426, 12427, 12428, 12429, 12437, 12439, 12440, 12441, 12445, 12447, 12451, 12454, 12455, 12456, 12457, 12459, 12461, 12462, 12465, 12467, 12468, 12470, 12472, 12473, 12476, 12478, 12481, 12482, 12483, 12487, 12488, 12489, 12491, 12494, 12495, 12497, 12499, 12503, 12504, 12508, 12512, 12515, 12521, 12523, 12525, 12531, 12536, 12539, 12546, 12547, 12549, 12554, 12555, 12556, 12559, 12561, 12562, 12564, 12565, 12567, 12568, 12570, 12572, 12585, 12588, 12590, 12597, 12600, 12605, 12608, 12609, 12611, 12614, 12616, 12619, 12623, 12626, 12628, 12631, 12633, 12634, 12636, 12638, 12639, 12641, 12645, 12649, 12651, 12655, 12658, 12668, 12670, 12671, 12672, 12679, 12680, 12681, 12682, 12684, 12691, 12693, 12695, 12698, 12699, 12701, 12702, 12707, 12711, 12713, 12718, 12719, 12722, 12729, 12731, 12732, 12733, 12735, 12737, 12738, 12739, 12740, 12741, 12742, 12749, 12751, 12752, 12754, 12755, 12758, 12760, 12761, 12762, 12764, 12766, 12768, 12769, 12771, 12783, 12788, 12789, 12790, 12794, 12797, 12801, 12802, 12805, 12810, 12812, 12813, 12814, 12817, 12819, 12820, 12822, 12824, 12826, 12827, 12828, 12834, 12836, 12838, 12839, 12844, 12847, 12849, 12853, 12866, 12869, 12879, 12883, 12884, 12887, 12898, 12900, 12904, 12905, 12906, 12912, 12916, 12917, 12918, 12920, 12921, 12926, 12932, 12938, 12939, 12942, 12946, 12947, 12950, 12953, 12954, 12961, 12963, 12966, 12968, 12969, 12973, 12974, 12975, 12976, 12977, 12978, 12982, 12986, 12987, 12989, 12990, 12991, 12994, 13004, 13006, 13007, 13010, 13011, 13012, 13017, 13022, 13023, 13024, 13030, 13032, 13035, 13038, 13040, 13044, 13049, 13050, 13053, 13055, 13056, 13060, 13061, 13066, 13067, 13069, 13070, 13074, 13077, 13079, 13085, 13086, 13087, 13095, 13100, 13101, 13102, 13105, 13106, 13112, 13114, 13115, 13116, 13117, 13118, 13123, 13124, 13125, 13128, 13131, 13135, 13142, 13147, 13151, 13156, 13160, 13169, 13175, 13177, 13182, 13189, 13197, 13199, 13206, 13209, 13210, 13212, 13213, 13215, 13217, 13221, 13222, 13224, 13227, 13230, 13232, 13234, 13235, 13236, 13237, 13238, 13249, 13251, 13255, 13258, 13259, 13260, 13261, 13263, 13264, 13267, 13268, 13269, 13270, 13276, 13279, 13280, 13281, 13285, 13293, 13295, 13296, 13298, 13303, 13304, 13313, 13315, 13317, 13320, 13321, 13322, 13323, 13326, 13328, 13330, 13332, 13338, 13343, 13346, 13347, 13348, 13349, 13353, 13354, 13358, 13361, 13367, 13368, 13369, 13384, 13393, 13396, 13397, 13401, 13410, 13411, 13416, 13417, 13419, 13420, 13423, 13424, 13429, 13431, 13433, 13439, 13440, 13444, 13446, 13449, 13451, 13454, 13456, 13460, 13463, 13466, 13468, 13469, 13473, 13475, 13494, 13496, 13499, 13500, 13501, 13503, 13504, 13506, 13510, 13513, 13514, 13515, 13516, 13517, 13519, 13520, 13521, 13522, 13529, 13530, 13532, 13535, 13536, 13540, 13543, 13544, 13546, 13547, 13549, 13552, 13556, 13568, 13569, 13574, 13579, 13580, 13582, 13583, 13584, 13587, 13589, 13597, 13598, 13599, 13601, 13602, 13603, 13621, 13623, 13627, 13628, 13631, 13632, 13634, 13636, 13637, 13638, 13641, 13643, 13647, 13650, 13652, 13654, 13660, 13661, 13662, 13663, 13669, 13671, 13675, 13677, 13678, 13683, 13684, 13685, 13686, 13688, 13689, 13698, 13700, 13702, 13703, 13704, 13706, 13710, 13712, 13713, 13715, 13716, 13720, 13721, 13725, 13727, 13728, 13729, 13730, 13733, 13737, 13738, 13739, 13742, 13745, 13747, 13748, 13750, 13751, 13753, 13756, 13764, 13766, 13767, 13769, 13773, 13775, 13776, 13781, 13783, 13786, 13787, 13789, 13790, 13791, 13793, 13794, 13795, 13796, 13798, 13809, 13816, 13817, 13818, 13819, 13820, 13822, 13823, 13824, 13827, 13830, 13831, 13833, 13834, 13835, 13843, 13849, 13852, 13859, 13860, 13862, 13866, 13869, 13870, 13872, 13873, 13874, 13877, 13886, 13888, 13891, 13892, 13894, 13896, 13898, 13901, 13904, 13906, 13908, 13909, 13910, 13911, 13917, 13919, 13923, 13925, 13927, 13930, 13933, 13938, 13944, 13947, 13948, 13952, 13953, 13954, 13956, 13961, 13963, 13965, 13969, 13970, 13975, 13976, 13980, 13983, 13984, 13990, 13991, 13999, 14000, 14003, 14009, 14014, 14016, 14017, 14018, 14022, 14027, 14030, 14031, 14036, 14040, 14041, 14043, 14049, 14050, 14051, 14052, 14054, 14059, 14062, 14063, 14066, 14071, 14073, 14075, 14081, 14082, 14084, 14086, 14088, 14091, 14092, 14093, 14094, 14102, 14105, 14106, 14110, 14111, 14115, 14116, 14118, 14122, 14126, 14128, 14129, 14132, 14134, 14135, 14138, 14139, 14142, 14143, 14145, 14146, 14148, 14149, 14150.

Promoters expressing in the internode tissue at the V7 stage include SEQ IDs: 1, 3, 4, 7, 11, 13, 14, 15, 19, 26, 27, 31, 34, 36, 38, 48, 51, 53, 56, 64, 76, 81, 82, 88, 93, 96, 97, 99, 102, 103, 107, 108, 110, 111, 112, 121, 126, 129, 130, 131, 132, 143, 146, 147, 148, 152, 154, 162, 164, 165, 168, 174, 176, 179, 181, 186, 187, 191, 194, 195, 196, 199, 204, 205, 207, 210, 211, 215, 217, 223, 230, 232, 233, 235, 236, 240, 242, 243, 244, 246, 248, 249, 250, 251, 257, 259, 262, 264, 268, 269, 270, 271, 273, 274, 279, 280, 281, 284, 286, 288, 289, 299, 301, 302, 305, 306, 307, 316, 319, 320, 322, 328, 329, 332, 335, 337, 341, 348, 349, 353, 354, 357, 359, 360, 367, 371, 378, 379, 382, 387, 388, 393, 396, 401, 402, 405, 406, 407, 423, 424, 428, 429, 433, 434, 436, 452, 456, 461, 463, 466, 471, 478, 479, 481, 483, 485, 488, 496, 498, 502, 507, 509, 510, 512, 513, 514, 516, 517, 520, 522, 523, 525, 529, 532, 533, 534, 536, 538, 541, 542, 544, 546, 547, 554, 557, 564, 565, 569, 573, 576, 580, 585, 591, 598, 602, 613, 614, 620, 623, 626, 630, 631, 633, 635, 643, 644, 650, 653, 656, 662, 663, 666, 667, 668, 674, 676, 677, 681, 686, 693, 694, 701, 705, 716, 717, 718, 719, 721, 722, 723, 724, 727, 734, 736, 740, 742, 749, 753, 759, 765, 768, 771, 782, 783, 791, 792, 793, 794, 795, 797, 800, 806, 808, 819, 820, 821, 829, 830, 833, 840, 842, 844, 855, 857, 859, 860, 862, 863, 865, 868, 870, 872, 873, 878, 883, 884, 885, 887, 890, 891, 892, 895, 897, 898, 901, 903, 907, 908, 910, 911, 912, 913, 916, 917, 919, 924, 925, 929, 931, 936, 938, 940, 943, 944, 951, 953, 954, 957, 958, 961, 962, 964, 966, 969, 971, 974, 977, 979, 980, 981, 982, 983, 987, 989, 991, 994, 995, 997, 999, 1006, 1007, 1009, 1011, 1014, 1022, 1026, 1028, 1029, 1030, 1039, 1041, 1042, 1043, 1045, 1047, 1049, 1050, 1051, 1052, 1055, 1056, 1064, 1065, 1068, 1069, 1070, 1077, 1078, 1086, 1087, 1088, 1089, 1092, 1095, 1101, 1103, 1104, 1106, 1108, 1110, 1111, 1112, 1114, 1115, 1118, 1119, 1120, 1122, 1127, 1130, 1132, 1133, 1136, 1137, 1144, 1146, 1147, 1148, 1154, 1155, 1160, 1161, 1162, 1165, 1166, 1168, 1169, 1171, 1176, 1178, 1182, 1185, 1187, 1189, 1191, 1196, 1199, 1201, 1204, 1214, 1217, 1218, 1219, 1220, 1223, 1225, 1227, 1228, 1230, 1231, 1233, 1234, 1235, 1236, 1239, 1240, 1241, 1243, 1248, 1249, 1250, 1251, 1252, 1253, 1256, 1257, 1264, 1265, 1269, 1272, 1281, 1282, 1283, 1285, 1286, 1291, 1292, 1293, 1295, 1296, 1297, 1298, 1301, 1303, 1305, 1306, 1307, 1309, 1312, 1316, 1317, 1320, 1325, 1327, 1330, 1331, 1334, 1337, 1340, 1346, 1347, 1349, 1351, 1354, 1355, 1360, 1364, 1367, 1371, 1373, 1376, 1377, 1380, 1381, 1382, 1386, 1388, 1392, 1393, 1394, 1396, 1398, 1404, 1407, 1415, 1421, 1423, 1426, 1431, 1432, 1438, 1439, 1441, 1442, 1444, 1448, 1451, 1453, 1454, 1455, 1458, 1459, 1462, 1466, 1468, 1474, 1481, 1486, 1490, 1493, 1499, 1501, 1513, 1514, 1517, 1518, 1525, 1526, 1527, 1534, 1539, 1540, 1543, 1545, 1546, 1547, 1549, 1550, 1556, 1560, 1563, 1567, 1570, 1571, 1575, 1576, 1578, 1582, 1584, 1586, 1590, 1592, 1593, 1594, 1599, 1600, 1602, 1604, 1609, 1612, 1614, 1615, 1616, 1622, 1625, 1635, 1636, 1637, 1638, 1639, 1648, 1650, 1653, 1658, 1659, 1662, 1663, 1668, 1669, 1671, 1673, 1675, 1677, 1680, 1683, 1684, 1685, 1688, 1689, 1691, 1696, 1697, 1698, 1699, 1701, 1705, 1706, 1708, 1710, 1714, 1717, 1719, 1723, 1725, 1726, 1727, 1729, 1731, 1732, 1735, 1740, 1745, 1755, 1759, 1762, 1764, 1771, 1776, 1785, 1791, 1813, 1815, 1820, 1821, 1823, 1826, 1828, 1830, 1832, 1834, 1835, 1837, 1838, 1839, 1840, 1845, 1850, 1852, 1856, 1858, 1859, 1868, 1869, 1870, 1872, 1876, 1882, 1883, 1888, 1891, 1897, 1898, 1899, 1900, 1902, 1904, 1905, 1906, 1911, 1912, 1914, 1916, 1917, 1918, 1920, 1922, 1923, 1924, 1933, 1934, 1936, 1940, 1944, 1950, 1952, 1953, 1954, 1955, 1968, 1977, 1981, 1990, 1991, 1992, 1993, 1999, 2000, 2007, 2008, 2009, 2010, 2012, 2013, 2014, 2015, 2020, 2026, 2031, 2039, 2041, 2043, 2045, 2048, 2049, 2055, 2060, 2062, 2064, 2066, 2069, 2071, 2072, 2074, 2075, 2077, 2081, 2082, 2083, 2089, 2090, 2094, 2096, 2097, 2099, 2103, 2104, 2109, 2113, 2114, 2116, 2117, 2125, 2126, 2132, 2133, 2134, 2137, 2139, 2140, 2142, 2143, 2144, 2147, 2150, 2151, 2152, 2156, 2157, 2159, 2161, 2162, 2164, 2166, 2168, 2170, 2172, 2173, 2178, 2179, 2185, 2190, 2193, 2196, 2201, 2202, 2203, 2206, 2207, 2213, 2215, 2216, 2221, 2222, 2226, 2227, 2229, 2230, 2231, 2232, 2235, 2240, 2244, 2247, 2252, 2253, 2257, 2260, 2262, 2263, 2264, 2274, 2276, 2278, 2280, 2282, 2283, 2288, 2295, 2296, 2297, 2298, 2301, 2303, 2304, 2305, 2308, 2309, 2310, 2314, 2322, 2323, 2325, 2328, 2329, 2333, 2335, 2339, 2342, 2346, 2349, 2351, 2352, 2353, 2359, 2360, 2363, 2366, 2367, 2369, 2371, 2377, 2379, 2382, 2384, 2397, 2398, 2401, 2403, 2405, 2410, 2411, 2412, 2418, 2419, 2422, 2423, 2430, 2435, 2437, 2438, 2443, 2445, 2451, 2452, 2453, 2454, 2457, 2458, 2465, 2466, 2470, 2471, 2472, 2474, 2476, 2479, 2480, 2482, 2485, 2492, 2494, 2495, 2498, 2500, 2504, 2505, 2506, 2507, 2509, 2510, 2511, 2512, 2514, 2517, 2519, 2522, 2525, 2528, 2531, 2532, 2533, 2535, 2538, 2539, 2541, 2547, 2548, 2549, 2552, 2555, 2557, 2560, 2567, 2568, 2573, 2578, 2581, 2589, 2590, 2594, 2605, 2609, 2616, 2617, 2619, 2626, 2627, 2632, 2634, 2637, 2639, 2644, 2647, 2648, 2651, 2652, 2653, 2663, 2671, 2674, 2675, 2679, 2680, 2684, 2685, 2687, 2689, 2691, 2692, 2696, 2700, 2711, 2718, 2719, 2725, 2726, 2727, 2728, 2729, 2730, 2735, 2737, 2738, 2739, 2740, 2742, 2746, 2747, 2749, 2752, 2755, 2756, 2757, 2763, 2764, 2765, 2768, 2770, 2775, 2780, 2785, 2786, 2787, 2791, 2800, 2801, 2802, 2805, 2812, 2814, 2819, 2820, 2821, 2822, 2823, 2824, 2826, 2827, 2828, 2829, 2831, 2840, 2844, 2845, 2850, 2857, 2858, 2861, 2862, 2864, 2865, 2871, 2873, 2876, 2878, 2879, 2885, 2886, 2888, 2889, 2890, 2893, 2894, 2902, 2905, 2906, 2908, 2909, 2910, 2911, 2915, 2916, 2917, 2919, 2923, 2926, 2930, 2931, 2932, 2933, 2934, 2935, 2938, 2943, 2944, 2945, 2946, 2948, 2950, 2955, 2959, 2963, 2966, 2968, 2969, 2976, 2979, 2980, 2992, 2994, 2998, 3000, 3002, 3005, 3006, 3007, 3008, 3010, 3015, 3016, 3019, 3023, 3024, 3026, 3027, 3038, 3039, 3042, 3043, 3044, 3048, 3049, 3051, 3052, 3053, 3055, 3058, 3059, 3062, 3064, 3067, 3075, 3076, 3080, 3081, 3083, 3084, 3085, 3087, 3088, 3095, 3096, 3100, 3101, 3102, 3105, 3106, 3109, 3112, 3114, 3118, 3119, 3120, 3121, 3123, 3126, 3127, 3128, 3137, 3138, 3139, 3143, 3147, 3148, 3153, 3154, 3157, 3158, 3167, 3170, 3177, 3181, 3185, 3189, 3192, 3194, 3199, 3202, 3205, 3206, 3210, 3212, 3215, 3219, 3220, 3221, 3224, 3225, 3226, 3227, 3228, 3231, 3236, 3237, 3240, 3247, 3250, 3252, 3253, 3255, 3258, 3261, 3262, 3266, 3268, 3271, 3273, 3278, 3280, 3282, 3286, 3288, 3289, 3290, 3294, 3295, 3296, 3299, 3307, 3310, 3312, 3313, 3327, 3329, 3331, 3332, 3333, 3340, 3343, 3345, 3347, 3349, 3351, 3353, 3355, 3358, 3361, 3363, 3369, 3374, 3377, 3380, 3383, 3386, 3392, 3393, 3397, 3399, 3402, 3404, 3412, 3415, 3416, 3418, 3419, 3420, 3422, 3424, 3426, 3428, 3429, 3435, 3438, 3440, 3445, 3446, 3447, 3449, 3450, 3451, 3452, 3455, 3458, 3460, 3461, 3464, 3465, 3468, 3470, 3471, 3474, 3475, 3477, 3482, 3483, 3486, 3487, 3488, 3490, 3491, 3496, 3500, 3503, 3504, 3506, 3510, 3516, 3517, 3518, 3533, 3536, 3541, 3544, 3545, 3548, 3549, 3551, 3552, 3554, 3558, 3560, 3561, 3562, 3563, 3569, 3572, 3574, 3576, 3582, 3588, 3589, 3592, 3593, 3594, 3595, 3597, 3599, 3600, 3603, 3604, 3606, 3607, 3611, 3613, 3616, 3618, 3620, 3621, 3623, 3624, 3626, 3627, 3628, 3629, 3630, 3631, 3633, 3640, 3642, 3643, 3644, 3645, 3646, 3647, 3648, 3650, 3655, 3657, 3659, 3660, 3663, 3667, 3668, 3669, 3671, 3672, 3674, 3702, 3706, 3707, 3710, 3713, 3715, 3717, 3718, 3719, 3720, 3721, 3724, 3731, 3738, 3739, 3742, 3748, 3749, 3752, 3754, 3760, 3761, 3762, 3764, 3765, 3766, 3775, 3777, 3778, 3783, 3784, 3785, 3788, 3790, 3791, 3792, 3794, 3798, 3804, 3808, 3812, 3818, 3820, 3823, 3825, 3828, 3829, 3830, 3831, 3832, 3833, 3834, 3836, 3839, 3842, 3843, 3844, 3845, 3849, 3858, 3859, 3860, 3862, 3866, 3867, 3870; 3871, 3872, 3876, 3877, 3883, 3887, 3889, 3890, 3891, 3893, 3895, 3896, 3899, 3908, 3910, 3912, 3914, 3917, 3923, 3924, 3926, 3928, 3929, 3934, 3938, 3941, 3947, 3950, 3951, 3954, 3958, 3962, 3967, 3968, 3974, 3975, 3976, 3977, 3978, 3983, 3985, 3987, 3988, 3991, 3995, 3996, 3997, 4000, 4001, 4002, 4003, 4006, 4008, 4013, 4022, 4024, 4026, 4030, 4034, 4038, 4039, 4040, 4044, 4047, 4048, 4049, 4050, 4053, 4054, 4056, 4057, 4058, 4060, 4062, 4067, 4068, 4069, 4072, 4075, 4077, 4078, 4084, 4087, 4092, 4094, 4099, 4102, 4103, 4105, 4109, 4110, 4111, 4113, 4115, 4122, 4128, 4132, 4133, 4139, 4143, 4146, 4148, 4149, 4154, 4155, 4156, 4158, 4160, 4161, 4162, 4163, 4165, 4166, 4167, 4168, 4169, 4171, 4175, 4176, 4178, 4184, 4188, 4189, 4190, 4198, 4201, 4202, 4205, 4206, 4207, 4208, 4210, 4211, 4212, 4214, 4217, 4219, 4221, 4227, 4228, 4233, 4234, 4235, 4246, 4250, 4251, 4255, 4257, 4258, 4260, 4266, 4270, 4272, 4276, 4279, 4280, 4281, 4284, 4296, 4297, 4298, 4301, 4302, 4304, 4309, 4312, 4317, 4320, 4321, 4324, 4329, 4330, 4331, 4333, 4335, 4339, 4341, 4343, 4344, 4347, 4349, 4352, 4354, 4356, 4358, 4360, 4365, 4369, 4371, 4373, 4374, 4378, 4380, 4383, 4387, 4390, 4391, 4393, 4394, 4397, 4401, 4402, 4403, 4404, 4405, 4410, 4412, 4415, 4422, 4423, 4426, 4436, 4439, 4442, 4443, 4444, 4446, 4448, 4449, 4450, 4453, 4456, 4458, 4461, 4462, 4463, 4464, 4465, 4466, 4468, 4472, 4479, 4485, 4491, 4492, 4494, 4498, 4500, 4502, 4506, 4507, 4512, 4513, 4514, 4515, 4518, 4519, 4531, 4543, 4548, 4549, 4554, 4556, 4557, 4558, 4559, 4562, 4563, 4565, 4566, 4568, 4575, 4580, 4582, 4583, 4586, 4590, 4591, 4595, 4596, 4601, 4604, 4606, 4611, 4618, 4621, 4625, 4630, 4632, 4633, 4635, 4641, 4643, 4644, 4650, 4651, 4653, 4654, 4655, 4659, 4666, 4667, 4669, 4670, 4671, 4672, 4674, 4677, 4680, 4682, 4684, 4685, 4687, 4697, 4699, 4700, 4704, 4706, 4708, 4710, 4716, 4719, 4721, 4725, 4729, 4732, 4737, 4738, 4739, 4740, 4747, 4748, 4749, 4750, 4751, 4753, 4754, 4756, 4759, 4761, 4762, 4763, 4765, 4767, 4771, 4775, 4779, 4789, 4790, 4791, 4794, 4795, 4804, 4813, 4814, 4816, 4818, 4820, 4822, 4823, 4824, 4828, 4832, 4834, 4851, 4855, 4857, 4861, 4862, 4864, 4868, 4869, 4872, 4875, 4877, 4878, 4880, 4881, 4887, 4888, 4891, 4901, 4902, 4909, 4912, 4914, 4917, 4918, 4921, 4923, 4924, 4926, 4930, 4931, 4935, 4936, 4938, 4941, 4943, 4950, 4965, 4971, 4972, 4973, 4975, 4977, 4979, 4980, 4981, 4984, 4988, 4992, 4993, 4994, 4996, 5011, 5022, 5029, 5030, 5034, 5037, 5039, 5040, 5042, 5044, 5046, 5052, 5053, 5054, 5057, 5058, 5061, 5067, 5068, 5072, 5082, 5086, 5088, 5089, 5090, 5091, 5095, 5100, 5102, 5111, 5122, 5123, 5129, 5130, 5131, 5132, 5136, 5137, 5140, 5144, 5145, 5147, 5152, 5153, 5174, 5180, 5181, 5182, 5184, 5185, 5189, 5190, 5191, 5192, 5195, 5196, 5198, 5199, 5200, 5201, 5202, 5206, 5208, 5211, 5212, 5216, 5217, 5219, 5225, 5226, 5229, 5234, 5240, 5241, 5249, 5253, 5255, 5258, 5261, 5263, 5267, 5273, 5275, 5276, 5280, 5281, 5283, 5286, 5292, 5293, 5298, 5299, 5300, 5301, 5303, 5308, 5311, 5313, 5317, 5324, 5329, 5330, 5332, 5334, 5338, 5341, 5342, 5344, 5346, 5348, 5351, 5359, 5360, 5361, 5366, 5367, 5372, 5379, 5382, 5386, 5388, 5389, 5395, 5397, 5398, 5403, 5405, 5407, 5409, 5411, 5414, 5417, 5431, 5437, 5438, 5446, 5448, 5449, 5452, 5456, 5457, 5458, 5459, 5463, 5464, 5466, 5467, 5469, 5472, 5476, 5479, 5481, 5482, 5483, 5493, 5495, 5496, 5498, 5506, 5508, 5510, 5513, 5515, 5516, 5517, 5518, 5519, 5520, 5521, 5524, 5526, 5530, 5535, 5536, 5537, 5539, 5543, 5557, 5558, 5559, 5562, 5565, 5566, 5568, 5569, 5571, 5572, 5574, 5575, 5579, 5585, 5586, 5588, 5589, 5591, 5592, 5596, 5604, 5612, 5613, 5616, 5618, 5619, 5620, 5621, 5627, 5631, 5632, 5633, 5635, 5638, 5640, 5642, 5643, 5647, 5648, 5651, 5652, 5653, 5657, 5659, 5660, 5662, 5663, 5664, 5670, 5671, 5675, 5676, 5677, 5689, 5690, 5694, 5695, 5697, 5698, 5700, 5702, 5703, 5706, 5709, 5711, 5712, 5713, 5718, 5721, 5722, 5730, 5731, 5734, 5735, 5744, 5751, 5753, 5754, 5756, 5763, 5768, 5770, 5771, 5775, 5779, 5780, 5783, 5784, 5785, 5786, 5787, 5788, 5791, 5794, 5803, 5806, 5808, 5810, 5813, 5820, 5826, 5833, 5834, 5835, 5836, 5837, 5846, 5852, 5853, 5854, 5856, 5857, 5859, 5861, 5863, 5864, 5865, 5866, 5868, 5869, 5872, 5878, 5879, 5881, 5883, 5884, 5886, 5888, 5889, 5892, 5893, 5907, 5912, 5925, 5926, 5927, 5928, 5932, 5934, 5936, 5938, 5941, 5944, 5951, 5954, 5956, 5957, 5959, 5961, 5968, 5971, 5975, 5978, 5982, 5984, 5991, 5994, 5996, 5997, 6000, 6002, 6006, 6008, 6013, 6016, 6017, 6018, 6020, 6023, 6024, 6025, 6026, 6028, 6031, 6033, 6038, 6041, 6043, 6044, 6045, 6047, 6048, 6051, 6054, 6058, 6059, 6062, 6063, 6069, 6072, 6073, 6074, 6075, 6080, 6081, 6084, 6085, 6086, 6087, 6088, 6089, 6090, 6092, 6093, 6096, 6098, 6099, 6107, 6108, 6109, 6110, 6113, 6116, 6118, 6120, 6124, 6129, 6131, 6132, 6133, 6135, 6137, 6138, 6139, 6143, 6145, 6146, 6148, 6149, 6151, 6153, 6155, 6158, 6160, 6162, 6163, 6164, 6165, 6180, 6181, 6182, 6183, 6186, 6188, 6189, 6194, 6195, 6196, 6197, 6198, 6203, 6204, 6205, 6206, 6209, 6212, 6215, 6220, 6221, 6223, 6224, 6226, 6227, 6228, 6230, 6231, 6234, 6237, 6243, 6246, 6247, 6250, 6251, 6264, 6265, 6267, 6272, 6273, 6275, 6281, 6282, 6286, 6288, 6289, 6292, 6295, 6296, 6299, 6300, 6303, 6306, 6310, 6315, 6317, 6322, 6328, 6330, 6333, 6338, 6342, 6343, 6344, 6349, 6353, 6354, 6356, 6358, 6360, 6363, 6368, 6370, 6372, 6375, 6381, 6383, 6387, 6394, 6397, 6399, 6403, 6405, 6408, 6412, 6414, 6415, 6419, 6422, 6425, 6426, 6427, 6429, 6431, 6436, 6440, 6448, 6449, 6456, 6457, 6463, 6464, 6466, 6467, 6469, 6474, 6475, 6476, 6478, 6480, 6482, 6484, 6485, 6486, 6488, 6494, 6501, 6502, 6504, 6510, 6516, 6517, 6519, 6523, 6528, 6530, 6531, 6532, 6534, 6541, 6543, 6547, 6549, 6553, 6555, 6558, 6559, 6564, 6571, 6572, 6574, 6576, 6577, 6579, 6584, 6588, 6589, 6592, 6594, 6595, 6596, 6597, 6599, 6600, 6605, 6606, 6607, 6609, 6610, 6614, 6615, 6616, 6620, 6623, 6629, 6633, 6634, 6635, 6639, 6642, 6644, 6646, 6647, 6649, 6654, 6655, 6656, 6658, 6661, 6662, 6666, 6670, 6672, 6681, 6696, 6703, 6705, 6716, 6718, 6720, 6729, 6730, 6734, 6736, 6742, 6747, 6749, 6756, 6757, 6759, 6764, 6766, 6767, 6777, 6779, 6782, 6783, 6786, 6788, 6792, 6793, 6794, 6795, 6797, 6799, 6803, 6804, 6805, 6806, 6811, 6812, 6813, 6816, 6817, 6819, 6820, 6824, 6827, 6828, 6830, 6831, 6834, 6836, 6841, 6842, 6843, 6847, 6848, 6851, 6855, 6859, 6861, 6863, 6867, 6869, 6875, 6877, 6878, 6880, 6881, 6882, 6883, 6886, 6887, 6888, 6895, 6902, 6903, 6906, 6907, 6909, 6917, 6919, 6921, 6924, 6925, 6930, 6931, 6936, 6939, 6940, 6946, 6954, 6955, 6959, 6960, 6963, 6971, 6979, 6984, 6985, 6987, 6988, 6990, 6991, 6994, 6997, 6999, 7009, 7010, 7013, 7018, 7019, 7020, 7022, 7025, 7029, 7038, 7039, 7040, 7043, 7045, 7048, 7051, 7053, 7054, 7057, 7059, 7064, 7067, 7077, 7083, 7084, 7085, 7094, 7096, 7097, 7105, 7106, 7107, 7108, 7110, 7117, 7118, 7122, 7124, 7126, 7130, 7136, 7138, 7139, 7140, 7142, 7143, 7144, 7150, 7151, 7154, 7163, 7164, 7165, 7166, 7169, 7170, 7171, 7172, 7176, 7182, 7184, 7187, 7194, 7196, 7197, 7198, 7201, 7202, 7206, 7207, 7208, 7209, 7212, 7214, 7215, 7217, 7220, 7224, 7227, 7228, 7230, 7235, 7236, 7246, 7248, 7249, 7250, 7255, 7257, 7258, 7262, 7263, 7264, 7268, 7270, 7274, 7281, 7282, 7287, 7291, 7292, 7293, 7296, 7298, 7299, 7300, 7301, 7303, 7304, 7306, 7307, 7308, 7311, 7312, 7313, 7315, 7318, 7328, 7331, 7338, 7345, 7350, 7351, 7353, 7355, 7357, 7358, 7361, 7363, 7365, 7371, 7373, 7376, 7377, 7380, 7383, 7386, 7395, 7396, 7398, 7399, 7400, 7411, 7417, 7425, 7428, 7430, 7434, 7435, 7436, 7438, 7441, 7447, 7448, 7450, 7453, 7454, 7457, 7458, 7459, 7462, 7466, 7470, 7481, 7483, 7485, 7486, 7492, 7498, 7499, 7502, 7506, 7512, 7515, 7517, 7521, 7523, 7524, 7533, 7535, 7538, 7541, 7546, 7547, 7549, 7557, 7561, 7572, 7574, 7576, 7579, 7583, 7585, 7586, 7587, 7589, 7590, 7594, 7596, 7597, 7598, 7599, 7604, 7605, 7609, 7611, 7612, 7617, 7619, 7620, 7622, 7624, 7633, 7635, 7638, 7642, 7643, 7647, 7649, 7655, 7656, 7658, 7661, 7662, 7664, 7665, 7673, 7674, 7678, 7679, 7680, 7682, 7685, 7687, 7689, 7692, 7695, 7697, 7699, 7700, 7703, 7712, 7715, 7716, 7724, 7727, 7730, 7734, 7736, 7737, 7738, 7740, 7741, 7742, 7744, 7745, 7746, 7749, 7753, 7754, 7763, 7764, 7767, 7770, 7772, 7774, 7775, 7779, 7781, 7786, 7788, 7791, 7793, 7798, 7799, 7800, 7801, 7803, 7804, 7806, 7807, 7811, 7815, 7819, 7820, 7823, 7825, 7826, 7833, 7834, 7841, 7844, 7845, 7854, 7860, 7865, 7873, 7877, 7878, 7880, 7881, 7885, 7887, 7888, 7890, 7893, 7896, 7901, 7906, 7908, 7910, 7911, 7913, 7918, 7923, 7925, 7928, 7933, 7934, 7935, 7938, 7942, 7944, 7949, 7950, 7952, 7965, 7966, 7967, 7973, 7974, 7976, 7977, 7982, 7984, 7986, 7993, 7994, 7996, 7999, 8000, 8006, 8007, 8012, 8020, 8021, 8023, 8024, 8025, 8030, 8031, 8036, 8041, 8042, 8044, 8045, 8048, 8049, 8052, 8053, 8056, 8059, 8063, 8066, 8068, 8072, 8076, 8077, 8078, 8081, 8083, 8088, 8091, 8095, 8100, 8102, 8105, 8106, 8109, 8110, 8112, 8113, 8118, 8126, 8129, 8130, 8134, 8136, 8137, 8145, 8146, 8150, 8151, 8155, 8159, 8163, 8166, 8170, 8178, 8179, 8181, 8182, 8189, 8193, 8194, 8196, 8198, 8202, 8204, 8208, 8213, 8216, 8217, 8219, 8220, 8234, 8237, 8239, 8241, 8242, 8247, 8248, 8250, 8252, 8264, 8265, 8268, 8269, 8272, 8274, 8275, 8282, 8289, 8291, 8296, 8300, 8304, 8305, 8308, 8311, 8312, 8315, 8318, 8319, 8322, 8326, 8329, 8334, 8335, 8339, 8340, 8341, 8347, 8349, 8350, 8351, 8353, 8358, 8367, 8368, 8371, 8373, 8378, 8379, 8380, 8382, 8385, 8387, 8389, 8392, 8395, 8396, 8398, 8401, 8402, 8403, 8404, 8406, 8410, 8413, 8414, 8415, 8416, 8417, 8418, 8428, 8430, 8433, 8435, 8438, 8439, 8440, 8442, 8443, 8444, 8445, 8446, 8447, 8448, 8449, 8450, 8451, 8457, 8458, 8459, 8465, 8470, 8472, 8473, 8474, 8476, 8477, 8478, 8481, 8482, 8483, 8486, 8490, 8498, 8501, 8502, 8503, 8505, 8507, 8509, 8513, 8515, 8521, 8523, 8524, 8525, 8526, 8531, 8532, 8533, 8542, 8543, 8549, 8550, 8553, 8554, 8557, 8561, 8565, 8574, 8576, 8581, 8582, 8583, 8588, 8592, 8593, 8596, 8597, 8598, 8600, 8601, 8602, 8603, 8605, 8612, 8622, 8631, 8634, 8635, 8638, 8639, 8642, 8644, 8646, 8648, 8652, 8654, 8657, 8658, 8659, 8663, 8664, 8665, 8669, 8672, 8675, 8685, 8686, 8689, 8693, 8699, 8700, 8703, 8705, 8706, 8708, 8709, 8712, 8713, 8714, 8715, 8717, 8719, 8722, 8728, 8729, 8731, 8736, 8741, 8744, 8746, 8748, 8755, 8757, 8769, 8773, 8774, 8777, 8779, 8782, 8783, 8784, 8785, 8786, 8789, 8795, 8797, 8802, 8803, 8804, 8808, 8810, 8818, 8821, 8822, 8824, 8831, 8834, 8835, 8838, 8841, 8842, 8843, 8844, 8847, 8853, 8865, 8866, 8872, 8874, 8876, 8877, 8878, 8881, 8883, 8888, 8889, 8892, 8896, 8897, 8899, 8901, 8907, 8908, 8910, 8911, 8913, 8916, 8917, 8919, 8922, 8924, 8926, 8928, 8929, 8937, 8938, 8941, 8945, 8946, 8951, 8957, 8960, 8961, 8967, 8968, 8979, 8980, 8981, 8985, 8986, 8991, 8992, 8993, 8998, 9001, 9006, 9009, 9011, 9012, 9013, 9016, 9018, 9020, 9021, 9022, 9025, 9026, 9027, 9029, 9030, 9033, 9045, 9050, 9052, 9056, 9057, 9058, 9059, 9060, 9063, 9065, 9068, 9069, 9071, 9072, 9075, 9076, 9078, 9083, 9084, 9087, 9088, 9091, 9092, 9095, 9097, 9098, 9103, 9105, 9106, 9107, 9115, 9116, 9118, 9119, 9120, 9123, 9125, 9129, 9131, 9133, 9134, 9138, 9139, 9140, 9141, 9142, 9144, 9145, 9151, 9152, 9154, 9159, 9167, 9168, 9172, 9175, 9177, 9180, 9183, 9185, 9188, 9189, 9190, 9191, 9194, 9195, 9205, 9206, 9207, 9210, 9211, 9213, 9215, 9216, 9218, 9220, 9223, 9226, 9229, 9233, 9237, 9240, 9243, 9248, 9249, 9253, 9257, 9259, 9262, 9265, 9267, 9269, 9270, 9273, 9284, 9285, 9287, 9288, 9290, 9291, 9292, 9295, 9296, 9300, 9304, 9306, 9308, 9310, 9311, 9314, 9320, 9321, 9322, 9323, 9326, 9327, 9328, 9336, 9337, 9338, 9346, 9347, 9350, 9352, 9355, 9359, 9360, 9371, 9375, 9376, 9382, 9389, 9391, 9392, 9394, 9400, 9402, 9403, 9404, 9406, 9407, 9412, 9413, 9414, 9415, 9419, 9421, 9423, 9429, 9439, 9440, 9443, 9451, 9452, 9453, 9455, 9456, 9460, 9467, 9468, 9471, 9472, 9473, 9477, 9481, 9484, 9488, 9490, 9497, 9500, 9503, 9504, 9509, 9514, 9517, 9518, 9519, 9520, 9521, 9522, 9534, 9535, 9536, 9538, 9540, 9543, 9545, 9546, 9548, 9550, 9551, 9553, 9555, 9560, 9564, 9565, 9567, 9568, 9571, 9575, 9577, 9587, 9590, 9591, 9592, 9596, 9601, 9602, 9606, 9609, 9615, 9617, 9620, 9621, 9623, 9624, 9626, 9629, 9632, 9648, 9651, 9652, 9653, 9655, 9657, 9658, 9659, 9663, 9666, 9668, 9670, 9682, 9686, 9692, 9696, 9698, 9699, 9706, 9708, 9710, 9711, 9715, 9717, 9718, 9721, 9723, 9724, 9726, 9727, 9729, 9731, 9732, 9733, 9734, 9737, 9738, 9742, 9744, 9745, 9746, 9750, 9754, 9763, 9770, 9772, 9774, 9776, 9777, 9782, 9786, 9794, 9798, 9799, 9808, 9810, 9811, 9813, 9819, 9820, 9827, 9828, 9829, 9835, 9836, 9845, 9846, 9847, 9861, 9866, 9869, 9873, 9875, 9878, 9880, 9882, 9886, 9887, 9892, 9894, 9896, 9897, 9898, 9900, 9907, 9909, 9910, 9911, 9923, 9924, 9928, 9930, 9931, 9932, 9934, 9935, 9936, 9940, 9944, 9946, 9950, 9952, 9953, 9962, 9963, 9967, 9968, 9969, 9972, 9973, 9974, 9975, 9980, 9981, 9982, 9984, 9985, 9988, 9990, 9991, 9992, 9997, 10000, 10008, 10013, 10015, 10017, 10018, 10019, 10021, 10022, 10026, 10027, 10032, 10033, 10037, 10038, 10041, 10047, 10049, 10051, 10055, 10058, 10059, 10060, 10062, 10063, 10064, 10066, 10073, 10075, 10076, 10077, 10078, 10080, 10081, 10083, 10090, 10091, 10092, 10095, 10097, 10098, 10101, 10103, 10106, 10110, 10114, 10115, 10116, 10117, 10120, 10122, 10125, 10128, 10129, 10131, 10136, 10137, 10143, 10151, 10158, 10160, 10163, 10165, 10166, 10168, 10169, 10174, 10176, 10178, 10179, 10181, 10192, 10193, 10194, 10195, 10196, 10199, 10206, 10207, 10217, 10218, 10219, 10220, 10221, 10222, 10223, 10224, 10225, 10228, 10230, 10233, 10236, 10237, 10239, 10247, 10249, 10252, 10253, 10255, 10259, 10260, 10266, 10269, 10275, 10276, 10278, 10284, 10286, 10292, 10293, 10295, 10300, 10302, 10306, 10307, 10311, 10312, 10314, 10318, 10319, 10323, 10325, 10326, 10331, 10333, 10334, 10335, 10336, 10340, 10341, 10343, 10346, 10353, 10356, 10357, 10361, 10362, 10364, 10365, 10371, 10373, 10375, 10376, 10380, 10381, 10393, 10397, 10398, 10399, 10401, 10414, 10417, 10419, 10421, 10423, 10425, 10435, 10436, 10438, 10446, 10447, 10450, 10451, 10452, 10453, 10456, 10463, 10464, 10465, 10466, 10468, 10469, 10471, 10472, 10473, 10474, 10480, 10487, 10488, 10490, 10492, 10494, 10496, 10498, 10506, 10508, 10514, 10518, 10522, 10523, 10527, 10528, 10530, 10531, 10532, 10536, 10537, 10541, 10542, 10543, 10544, 10548, 10549, 10550, 10551, 10555, 10556, 10560, 10563, 10567, 10569, 10571, 10573, 10577, 10579, 10580, 10581, 10582, 10583, 10588, 10593, 10595, 10596, 10597, 10599, 10601, 10602, 10608, 10611, 10615, 10616, 10617, 10621, 10622, 10626, 10628, 10636, 10637, 10638, 10639, 10643, 10645, 10646, 10650, 10651, 10652, 10655, 10657, 10665, 10668, 10669, 10670, 10671, 10676, 10678, 10679, 10682, 10683, 10684, 10685, 10686, 10689, 10694, 10700, 10701, 10705, 10711, 10716, 10721, 10723, 10724, 10726, 10729, 10732, 10734, 10736, 10738, 10740, 10741, 10744, 10747, 10752, 10753, 10754, 10756, 10762, 10763, 10766, 10769, 10770, 10772, 10774, 10775, 10778, 10779, 10780, 10781, 10785, 10787, 10788, 10792, 10795, 10801, 10802, 10803, 10804, 10809, 10810, 10811, 10812, 10822, 10823, 10824, 10827, 10831, 10833, 10836, 10838, 10839, 10840, 10841, 10843, 10850, 10851, 10853, 10854, 10857, 10858, 10860, 10863, 10866, 10870, 10874, 10877, 10878, 10880, 10886, 10887, 10897, 10898, 10899, 10901, 10902, 10911, 10918, 10920, 10924, 10927, 10928, 10929, 10930, 10933, 10934, 10938, 10940, 10941, 10945, 10947, 10965, 10966, 10967, 10972, 10974, 10976, 10977, 10979, 10988, 10993, 10996, 10999, 11008, 11015, 11017, 11021, 11022, 11023, 11024, 11025, 11030, 11032, 11040, 11046, 11047, 11053, 11058, 11066, 11070, 11078, 11081, 11082, 11083, 11090, 11095, 11098, 11100, 11101, 11107, 11109, 11114, 11117, 11118, 11119, 11122, 11123, 11124, 11126, 11128, 11129, 11133, 11136, 11137, 11138, 11147, 11149, 11150, 11151, 11152, 11153, 11154, 11155, 11156, 11157, 11160, 11163, 11168, 11169, 11172, 11173, 11177, 11179, 11180, 11181, 11184, 11187, 11188, 11190, 11192, 11193, 11194, 11198, 11199, 11203, 11204, 11211, 11213, 11214, 11216, 11217, 11218, 11222, 11224, 11227, 11228, 11229, 11230, 11233, 11236, 11238, 11239, 11242, 11243, 11246, 11247, 11251, 11253, 11254, 11255, 11256, 11258, 11260, 11263, 11266, 11274, 11278, 11290, 11291, 11292, 11293, 11294, 11297, 11298, 11304, 11306, 11313, 11315, 11316, 11318, 11328, 11329, 11330, 11331, 11332, 11337, 11338, 11339, 11340, 11346, 11348, 11349, 11358, 11359, 11362, 11363, 11364, 11365, 11366, 11369, 11371, 11373, 11377, 11380, 11382, 11385, 11387, 11391, 11394, 11395, 11398, 11401, 11404, 11405, 11406, 11408, 11417, 11424, 11430, 11431, 11435, 11438, 11439, 11440, 11443, 11446, 11447, 11448, 11449, 11451, 11456, 11459, 11465, 11466, 11475, 11478, 11487, 11488, 11489, 11490, 11492, 11496, 11497, 11498, 11499, 11500, 11501, 11505, 11506, 11507, 11508, 11520, 11521, 11523, 11524, 11526, 11527, 11533, 11534, 11538, 11540, 11544, 11546, 11548, 11550, 11551, 11553, 11558, 11560, 11561, 11567, 11568, 11570, 11571, 11576, 11577, 11578, 11585, 11586, 11588, 11593, 11594, 11595, 11596, 11597, 11603, 11604, 11605, 11606, 11607, 11611, 11615, 11617, 11618, 11619, 11621, 11623, 11625, 11628, 11636, 11638, 11639, 11647, 11649, 11650, 11655, 11656, 11658, 11659, 11663, 11668, 11669, 11673, 11678, 11681, 11682, 11688, 11691, 11692, 11695, 11696, 11698, 11699, 11701, 11703, 11705, 11707, 11712, 11718, 11720, 11725, 11726, 11730, 11731, 11733, 11736, 11737, 11738, 11743, 11744, 11753, 11759, 11760, 11761, 11762, 11765, 11770, 11771, 11776, 11777, 11778, 11781, 11782, 11783, 11785, 11786, 11792, 11794, 11797, 11799, 11800, 11804, 11805, 11809, 11810, 11811, 11814, 11818, 11826, 11830, 11836, 11837, 11839, 11840, 11842, 11846, 11847, 11848, 11851, 11854, 11856, 11858, 11861, 11863, 11864, 11865, 11868, 11872, 11876, 11877, 11878, 11881, 11886, 11889, 11891, 11892, 11894, 11895, 11897, 11899, 11901, 11906, 11909, 11911, 11913, 11914, 11915, 11916, 11917, 11918, 11919, 11920, 11921, 11922, 11923, 11926, 11927, 11928, 11929, 11930, 11933, 11934, 11935, 11940, 11943, 11945, 11946, 11947, 11949, 11950, 11953, 11956, 11957, 11958, 11959, 11960, 11961, 11962, 11963, 11965, 11974, 11975, 11976, 11977, 11978, 11979, 11980, 11983, 11988, 11989, 11993, 11997, 11998, 11999, 12004, 12008, 12014, 12015, 12017, 12018, 12019, 12020, 12021, 12023, 12024, 12026, 12027, 12031, 12032, 12033, 12043, 12044, 12059, 12068, 12080, 12081, 12083, 12091, 12092, 12093, 12098, 12102, 12104, 12106, 12109, 12110, 12112, 12115, 12118, 12126, 12127, 12128, 12129, 12130, 12134, 12137, 12138, 12139, 12141, 12143, 12147, 12149, 12151, 12161, 12165, 12166, 12167, 12170, 12171, 12174, 12175, 12181, 12183, 12185, 12197, 12200, 12201, 12204, 12207, 12208, 12215, 12217, 12219, 12220, 12221, 12223, 12227, 12228, 12234, 12241, 12245, 12249, 12250, 12253, 12256, 12259, 12263, 12267, 12268, 12274, 12278, 12280, 12283, 12286, 12287, 12292, 12293, 12304, 12307, 12310, 12311, 12313, 12314, 12317, 12321, 12323, 12324, 12326, 12329, 12331, 12333, 12334, 12337, 12340, 12343, 12344, 12345, 12347, 12354, 12356, 12359, 12364, 12368, 12369, 12370, 12372, 12373, 12374, 12379, 12380, 12381, 12383, 12391, 12397, 12400, 12403, 12404, 12405, 12406, 12411, 12414, 12416, 12418, 12420, 12421, 12424, 12425, 12426, 12427, 12428, 12429, 12437, 12439, 12440, 12441, 12445, 12447, 12451, 12454, 12455, 12456, 12457, 12461, 12462, 12465, 12467, 12468, 12472, 12476, 12478, 12479, 12481, 12482, 12487, 12488, 12489, 12491, 12497, 12499, 12503, 12504, 12505, 12508, 12509, 12514, 12521, 12525, 12530, 12531, 12536, 12539, 12545, 12546, 12547, 12549, 12555, 12556, 12559, 12561, 12563, 12564, 12565, 12567, 12568, 12585, 12588, 12591, 12597, 12600, 12605, 12608, 12609, 12611, 12616, 12619, 12622, 12623, 12626, 12628, 12631, 12633, 12634, 12636, 12638, 12639, 12641, 12645, 12649, 12651, 12655, 12668, 12670, 12671, 12672, 12675, 12679, 12680, 12681, 12682, 12684, 12691, 12698, 12699, 12701, 12702, 12705, 12706, 12707, 12713, 12718, 12719, 12722, 12729, 12731, 12732, 12733, 12737, 12738, 12739, 12740, 12741, 12742, 12744, 12749, 12751, 12752, 12754, 12758, 12760, 12761, 12764, 12766, 12768, 12771, 12783, 12788, 12789, 12790, 12797, 12800, 12801, 12802, 12805, 12810, 12812, 12813, 12814, 12819, 12820, 12822, 12824, 12826, 12827, 12828, 12834, 12836, 12838, 12839, 12844, 12849, 12850, 12853, 12854, 12858, 12866, 12875, 12882, 12883, 12884, 12887, 12888, 12898, 12900, 12901, 12902, 12904, 12905, 12906, 12912, 12913, 12914, 12916, 12917, 12918, 12920, 12921, 12926, 12932, 12933, 12938, 12939, 12942, 12946, 12947, 12950, 12953, 12961, 12963, 12966, 12968, 12969, 12973, 12974, 12975, 12976, 12977, 12978, 12982, 12987, 12990, 12991, 12994, 13004, 13006, 13007, 13010, 13011, 13017, 13022, 13023, 13024, 13030, 13032, 13035, 13038, 13040, 13044, 13049, 13050, 13053, 13054, 13055, 13056, 13061, 13065, 13066, 13067, 13069, 13070, 13071, 13074, 13077, 13079, 13085, 13086, 13087, 13095, 13100, 13101, 13102, 13105, 13106, 13109, 13112, 13114, 13115, 13116, 13117, 13118, 13120, 13123, 13124, 13128, 13135, 13142, 13148, 13149, 13153, 13154, 13156, 13159, 13160, 13169, 13175, 13182, 13185, 13191, 13197, 13199, 13206, 13209, 13210, 13212, 13213, 13215, 13217, 13221, 13222, 13224, 13227, 13230, 13232, 13234, 13235, 13236, 13237, 13238, 13239, 13249, 13251, 13255, 13258, 13259, 13260, 13261, 13263, 13269, 13270, 13273, 13276, 13279, 13281, 13285, 13293, 13295, 13296, 13298, 13303, 13304, 13313, 13315, 13317, 13320, 13321, 13323, 13326, 13328, 13330, 13332, 13338, 13348, 13349, 13353, 13354, 13358, 13359, 13361, 13367, 13368, 13369, 13373, 13380, 13384, 13393, 13394, 13396, 13397, 13401, 13408, 13410, 13416, 13419, 13420, 13423, 13424, 13429, 13430, 13431, 13433, 13439, 13444, 13446, 13448, 13449, 13450, 13451, 13454, 13456, 13460, 13463, 13466, 13468, 13469, 13472, 13473, 13475, 13492, 13494, 13496, 13498, 13499, 13500, 13501, 13504, 13506, 13510, 13513, 13514, 13515, 13516, 13517, 13519, 13520, 13521, 13529, 13530, 13532, 13540, 13543, 13544, 13546, 13547, 13549, 13552, 13553, 13556, 13568, 13569, 13574, 13579, 13580, 13582, 13583, 13584, 13589, 13597, 13599, 13601, 13602, 13603, 13604, 13612, 13621, 13623, 13627, 13628, 13631, 13632, 13634, 13636, 13637, 13641, 13643, 13647, 13650, 13652, 13654, 13660, 13661, 13662, 13671, 13675, 13676, 13677, 13678, 13679, 13683, 13684, 13686, 13687, 13688, 13695, 13698, 13700, 13703, 13706, 13710, 13712, 13713, 13715, 13716, 13720, 13721, 13725, 13727, 13728, 13729, 13730, 13733, 13737, 13742, 13745, 13747, 13748, 13750, 13751, 13753, 13756, 13764, 13766, 13767, 13769, 13773, 13775, 13776, 13781, 13785, 13786, 13787, 13789, 13791, 13793, 13794, 13795, 13796, 13798, 13802, 13809, 13816, 13817, 13818, 13819, 13820, 13822, 13823, 13827, 13830, 13831, 13833, 13834, 13835, 13843, 13852, 13856, 13859, 13866, 13869, 13870, 13872, 13873, 13874, 13877, 13881, 13882, 13888, 13891, 13892, 13894, 13897, 13898, 13901, 13904, 13906, 13908, 13909, 13910, 13911, 13912, 13914, 13917, 13919, 13923, 13925, 13927, 13930, 13933, 13938, 13944, 13947, 13948, 13949, 13952, 13954, 13956, 13962, 13965, 13969, 13970, 13971, 13975, 13976, 13980, 13983, 13984, 13988, 13990, 13991, 13994, 13999, 14000, 14003, 14009, 14010, 14013, 14014, 14016, 14017, 14018, 14022, 14027, 14030, 14031, 14036, 14041, 14043, 14049, 14050, 14051, 14052, 14054, 14062, 14063, 14066, 14069, 14070, 14071, 14073, 14075, 14081, 14086, 14088, 14091, 14092, 14093, 14094, 14096, 14102, 14106, 14110, 14116, 14118, 14120, 14122, 14125, 14126, 14128, 14129, 14132, 14134, 14138, 14139, 14142, 14143, 14145, 14146, 14148, 14149, 14150.

Promoters expressing in the internode tissue at the tasseling stage include SEQ IDs: 1, 3, 4, 7, 8, 9, 13, 15, 26, 27, 29, 31, 34, 36, 38, 45, 48, 53, 54, 63, 64, 65, 68, 81, 82, 88, 93, 96, 97, 99, 102, 103, 107, 108, 110, 111, 112, 121, 126, 129, 130, 131, 132, 134, 139, 140, 143, 147, 148, 152, 156, 157, 159, 162, 165, 172, 174, 175, 176, 179, 181, 183, 187, 191, 194, 195, 196, 197, 199, 202, 203, 204, 205, 207, 210, 211, 215, 217, 223, 230, 231, 232, 233, 235, 236, 237, 240, 242, 243, 244, 246, 248, 249, 250, 251, 257, 259, 262, 263, 264, 269, 270, 271, 273, 274, 280, 281, 284, 286, 288, 289, 294, 299, 301, 302, 303, 305, 306, 307, 309, 314, 316, 319, 320, 322, 323, 328, 329, 332, 335, 339, 341, 346, 348, 349, 352, 353, 354, 356, 357, 358, 360, 364, 367, 371, 373, 374, 378, 379, 380, 382, 387, 388, 393, 396, 401, 402, 405, 406, 407, 412, 419, 420, 423, 424, 428, 429, 433, 434, 436, 452, 456, 461, 463, 466, 468, 471, 474, 478, 479, 481, 482, 483, 485, 488, 496, 498, 502, 504, 507, 509, 510, 512, 513, 514, 515, 516, 517, 520, 522, 523, 525, 529, 531, 532, 534, 536, 537, 538, 541, 542, 544, 546, 547, 548, 554, 557, 564, 565, 573, 574, 576, 580, 585, 591, 594, 595, 596, 598, 599, 602, 604, 607, 611, 613, 614, 620, 623, 626, 630, 631, 633, 635, 638, 641, 643, 644, 650, 656, 662, 663, 666, 667, 668, 670, 674, 676, 677, 681, 686, 693, 694, 701, 705, 707, 708, 716, 717, 719, 722, 723, 724, 727, 734, 735, 736, 740, 742, 744, 749, 753, 759, 760, 761, 762, 763, 765, 768, 770, 771, 782, 783, 784, 792, 793, 794, 795, 797, 800, 801, 804, 806, 808, 812, 813, 819, 820, 821, 822, 824, 825, 826, 829, 830, 833, 840, 842, 844, 855, 857, 859, 860, 862, 863, 865, 868, 870, 871, 872, 873, 877, 883, 884, 885, 887, 890, 891, 892, 895, 897, 898, 899, 901, 903, 907, 908, 910, 911, 912, 913, 916, 917, 920, 924, 925, 928, 929, 931, 936, 938, 940, 943, 944, 951, 953, 954, 957, 958, 959, 961, 962, 964, 966, 971, 974, 977, 979, 980, 981, 982, 983, 987, 989, 991, 993, 994, 995, 997, 999, 1003, 1006, 1007, 1009, 1011, 1014, 1017, 1026, 1028, 1032, 1035, 1038, 1039, 1041, 1042, 1043, 1045, 1047, 1049, 1050, 1051, 1052, 1055, 1056, 1064, 1065, 1068, 1069, 1072, 1077, 1078, 1086, 1087, 1088, 1089, 1092, 1095, 1101, 1103, 1104, 1106, 1108, 1110, 1111, 1112, 1114, 1115, 1117, 1118, 1119, 1120, 1122, 1125, 1127, 1130, 1132, 1133, 1136, 1137, 1146, 1147, 1148, 1154, 1155, 1160, 1162, 1165, 1166, 1168, 1169, 1170, 1171, 1174, 1176, 1178, 1182, 1189, 1191, 1196, 1198, 1199, 1200, 1201, 1204, 1205, 1214, 1217, 1218, 1219, 1220, 1223, 1225, 1228, 1230, 1231, 1233, 1235, 1236, 1239, 1240, 1241, 1243, 1248, 1249, 1250, 1252, 1253, 1254, 1256, 1257, 1258, 1261, 1264, 1265, 1269, 1272, 1277, 1281, 1282, 1283, 1285, 1286, 1293, 1295, 1297, 1298, 1303, 1305, 1306, 1309, 1312, 1316, 1317, 1320, 1321, 1325, 1327, 1330, 1331, 1334, 1339, 1346, 1347, 1349, 1351, 1354, 1355, 1360, 1364, 1367, 1368, 1371, 1372, 1373, 1376, 1377, 1380, 1381, 1382, 1387, 1388, 1393, 1396, 1397, 1398, 1403, 1404, 1405, 1407, 1409, 1410, 1411, 1412, 1415, 1420, 1421, 1423, 1426, 1431, 1438, 1439, 1440, 1441, 1442, 1444, 1447, 1448, 1451, 1453, 1454, 1455, 1458, 1459, 1462, 1466, 1468, 1471, 1474, 1475, 1481, 1486, 1488, 1490, 1493, 1498, 1499, 1501, 1504, 1508, 1510, 1511, 1513, 1514, 1518, 1519, 1525, 1526, 1527, 1530, 1539, 1540, 1543, 1545, 1546, 1547, 1549, 1550, 1555, 1556, 1560, 1563, 1566, 1567, 1570, 1571, 1575, 1576, 1578, 1584, 1586, 1590, 1592, 1593, 1594, 1599, 1600, 1602, 1604, 1605, 1608, 1609, 1612, 1614, 1615, 1616, 1618, 1622, 1625, 1634, 1635, 1637, 1638, 1641, 1648, 1650, 1653, 1658, 1659, 1662, 1663, 1668, 1669, 1671, 1673, 1675, 1676, 1677, 1678, 1680, 1683, 1684, 1685, 1688, 1689, 1691, 1696, 1698, 1699, 1701, 1705, 1706, 1707, 1708, 1709, 1710, 1714, 1717, 1719, 1721, 1723, 1725, 1729, 1731, 1732, 1733, 1735, 1740, 1755, 1758, 1759, 1761, 1764, 1771, 1776, 1778, 1779, 1782, 1784, 1785, 1791, 1793, 1807, 1813, 1815, 1816, 1820, 1821, 1826, 1828, 1830, 1832, 1834, 1835, 1839, 1840, 1845, 1850, 1852, 1856, 1858, 1859, 1861, 1865, 1867, 1868, 1869, 1870, 1872, 1873, 1876, 1882, 1883, 1886, 1888, 1891, 1893, 1894, 1895, 1897, 1898, 1899, 1900, 1902, 1903, 1904, 1905, 1906, 1911, 1912, 1914, 1915, 1918, 1920, 1922, 1923, 1924, 1930, 1931, 1933, 1934, 1936, 1940, 1944, 1945, 1950, 1952, 1953, 1954, 1955, 1981, 1986, 1990, 1991, 1993, 1994, 1995, 1996, 1999, 2000, 2007, 2008, 2009, 2010, 2012, 2013, 2014, 2015, 2016, 2017, 2026, 2031, 2032, 2039, 2041, 2043, 2045, 2048, 2049, 2054, 2055, 2060, 2062, 2064, 2066, 2069, 2072, 2074, 2077, 2079, 2081, 2082, 2083, 2088, 2089, 2090, 2094, 2096, 2097, 2099, 2101, 2103, 2104, 2112, 2113, 2114, 2116, 2117, 2132, 2133, 2134, 2137, 2139, 2140, 2142, 2143, 2144, 2147, 2150, 2152, 2154, 2155, 2156, 2157, 2159, 2161, 2162, 2164, 2165, 2166, 2167, 2168, 2170, 2172, 2173, 2177, 2178, 2179, 2185, 2188, 2193, 2196, 2201, 2202, 2203, 2205, 2207, 2213, 2215, 2216, 2218, 2221, 2222, 2226, 2227, 2229, 2230, 2231, 2232, 2235, 2240, 2242, 2243, 2244, 2247, 2252, 2253, 2257, 2259, 2260, 2261, 2262, 2263, 2273, 2274, 2276, 2278, 2280, 2282, 2283, 2288, 2291, 2293, 2295, 2296, 2297, 2298, 2303, 2304, 2305, 2306, 2309, 2310, 2314, 2322, 2323, 2328, 2329, 2331, 2333, 2339, 2342, 2345, 2348, 2349, 2351, 2352, 2353, 2359, 2360, 2361, 2362, 2363, 2366, 2367, 2371, 2377, 2379, 2381, 2382, 2383, 2384, 2385, 2396, 2397, 2398, 2401, 2402, 2403, 2405, 2406, 2410, 2411, 2412, 2413, 2418, 2419, 2420, 2422, 2423, 2430, 2431, 2435, 2437, 2438, 2440, 2441, 2442, 2443, 2445, 2450, 2451, 2452, 2453, 2454, 2457, 2458, 2465, 2470, 2471, 2472, 2474, 2476, 2479, 2480, 2481, 2482, 2483, 2490, 2492, 2494, 2495, 2496, 2498, 2500, 2505, 2506, 2509, 2510, 2511, 2514, 2517, 2519, 2525, 2528, 2529, 2531, 2532, 2533, 2536, 2537, 2538, 2539, 2541, 2542, 2547, 2548, 2549, 2551, 2552, 2555, 2556, 2557, 2560, 2567, 2568, 2573, 2576, 2577, 2578, 2580, 2581, 2583, 2589, 2590, 2594, 2596, 2599, 2601, 2605, 2609, 2616, 2617, 2622, 2626, 2627, 2632, 2634, 2637, 2639, 2644, 2648, 2650, 2652, 2653, 2655, 2661, 2662, 2663, 2671, 2674, 2675, 2679, 2684, 2685, 2687, 2689, 2691, 2696, 2700, 2702, 2707, 2711, 2712, 2715, 2718, 2719, 2723, 2725, 2726, 2727, 2728, 2729, 2730, 2735, 2737, 2739, 2740, 2742, 2746, 2747, 2749, 2752, 2755, 2756, 2757, 2763, 2764, 2768, 2770, 2775, 2780, 2782, 2784, 2786, 2787, 2788, 2791, 2798, 2800, 2801, 2802, 2805, 2808, 2812, 2814, 2819, 2820, 2821, 2822, 2823, 2824, 2826, 2827, 2828, 2829, 2831, 2832, 2840, 2842, 2844, 2850, 2856, 2857, 2858, 2861, 2862, 2864, 2865, 2866, 2871, 2873, 2876, 2878, 2888, 2889, 2890, 2894, 2898, 2901, 2902, 2903, 2906, 2908, 2909, 2910, 2911, 2912, 2915, 2916, 2917, 2919, 2923, 2926, 2930, 2931, 2932, 2933, 2934, 2935, 2938, 2942, 2944, 2945, 2946, 2948, 2950, 2953, 2955, 2959, 2960, 2963, 2966, 2968, 2969, 2976, 2979, 2980, 2985, 2994, 2998, 3000, 3002, 3003, 3005, 3007, 3008, 3010, 3015, 3016, 3019, 3023, 3024, 3026, 3038, 3039, 3042, 3043, 3044, 3048, 3049, 3051, 3052, 53053, 3055, 3058, 3059, 3062, 3064, 3067, 3070, 3072, 3075, 3076, 3080, 3081, 3083, 3084, 3085, 3087, 3088, 3090, 3094, 3095, 3096, 3100, 3101, 3102, 3105, 3106, 3109, 3114, 3118, 3119, 3120, 3121, 3123, 3126, 3127, 3128, 3129, 3137, 3138, 3139, 3140, 3143, 3147, 3148, 3153, 3157, 3158, 3167, 3170, 3177, 3181, 3185, 3189, 3192, 3194, 3199, 3200, 3202, 3205, 3206, 3210, 3212, 3215, 3219, 3220, 3224, 3225, 3226, 3227, 3228, 3232, 3236, 3237, 3239, 3240, 3244, 3246, 3247, 3250, 3252, 3255, 3256, 3258, 3261, 3262, 3263, 3266, 3268, 3271, 3273, 3278, 3280, 3286, 3288, 3289, 3290, 3291, 3294, 3295, 3296, 3299, 3301, 3303, 3307, 3312, 3313, 3327, 3331, 3332, 3333, 3337, 3340, 3343, 3345, 3347, 3349, 3351, 3353, 3355, 3356, 3358, 3359, 3360, 3361, 3363, 3369, 3370, 3373, 3374, 3376, 3377, 3379, 3380, 3383, 3386, 3392, 3393, 3397, 3399, 3404, 3405, 3412, 3414, 3415, 3416, 3418, 3419, 3420, 3422, 3424, 3426, 3427, 3428, 3429, 3435, 3438, 3440, 3441, 3442, 3445, 3446, 3447, 3450, 3451, 3452, 3455, 3458, 3460, 3461, 3464, 3465, 3468, 3470, 3471, 3473, 3474, 3475, 3477, 3482, 3483, 3486, 3487, 3488, 3490, 3491, 3494, 3496, 3500, 3503, 3504, 3506, 3510, 3511, 3516, 3517, 3518, 3529, 3531, 3533, 3536, 3537, 3541, 3544, 3545, 3548, 3549, 3551, 3552, 3554, 3558, 3560, 3562, 3563, 3569, 3572, 3574, 3576, 3582, 3587, 3588, 3589, 3592, 3593, 3594, 3595, 3597, 3599, 3600, 3603, 3604, 3606, 3607, 3611, 3613, 3616, 3618, 3620, 3621, 3623, 3624, 3626, 3627, 3628, 3629, 3630, 3631, 3633, 3637, 3640, 3642, 3643, 3644, 3645, 3646, 3647, 3648, 3650, 3653, 3654, 3655, 3657, 3659, 3660, 3663, 3667, 3668, 3671, 3672, 3674, 3682, 3684, 3685, 3693, 3694, 3697, 3702, 3706, 3707, 3710, 3713, 3715, 3717, 3718, 3719, 3720, 3725, 3730, 3731, 3732, 3738, 3739, 3742, 3748, 3749, 3752, 3754, 3757, 3761, 3764, 3765, 3766, 3772, 3773, 3774, 3775, 3777, 3778, 3781, 3783, 3784, 3785, 3788, 3789, 3790, 3791, 3792, 3794, 3796, 3798, 3804, 3806, 3808, 3809, 3810, 3812, 3818, 3820, 3823, 3825, 3828, 3830, 3831, 3832, 3833, 3834, 3836, 3837, 3842, 3843, 3844, 3845, 3847, 3849, 3858, 3859, 3860, 3862, 3866, 3867, 3868, 3870, 3871, 3872, 3873, 3874, 3876, 3877, 3882, 3883, 3887, 3889, 3890, 3891, 3892, 3893, 3894, 3895, 3902, 3908, 3910, 3911, 3912, 3914, 3917, 3923, 3924, 3926, 3928, 3929, 3933, 3934, 3938, 3941, 3947, 3950, 3952, 3954, 3958, 3962, 3967, 3975, 3976, 3977, 3978, 3983, 3985, 3987, 3988, 3995, 3996, 3997, 4000, 4001, 4002, 4003, 4006, 4008, 4013, 4014, 4022, 4024, 4030, 4032, 4034, 4039, 4040, 4041, 4042, 4044, 4047, 4048, 4049, 4050, 4051, 4052, 4054, 4056, 4057, 4062, 4066, 4067, 4068, 4069, 4072, 4075, 4077, 4078, 4079, 4081, 4084, 4087, 4092, 4095, 4096, 4099, 4102, 4105, 4109, 4110, 4111, 4113, 4115, 4116, 4121, 4122, 4124, 4128, 4133, 4139, 4143, 4146, 4149, 4150, 4154, 4155, 4156, 4158, 4160, 4161, 4162, 4163, 4164, 4165, 4166, 4167, 4168, 4170, 4171, 4175, 4178, 4184, 4187, 4188, 4189, 4191, 4197, 4198, 4201, 4202, 4205, 4206, 4207, 4208, 4210, 4211, 4212, 4214, 4217, 4219, 4221, 4227, 4228, 4233, 4235, 4244, 4246, 4250, 4251, 4257, 4260, 4261, 4263, 4266, 4270, 4272, 4277, 4279, 4280, 4281, 4283, 4288, 4292, 4294, 4295, 4296, 4298, 4301, 4302, 4304, 4305, 4309, 4312, 4320, 4321, 4324, 4329, 4330, 4331, 4332, 4335, 4336, 4337, 4338, 4339, 4341, 4343, 4344, 4347, 4349, 4352, 4354, 4356, 4358, 4360, 4365, 4369, 4371, 4373, 4374, 4378, 4380, 4383, 4390, 4391, 4394, 4397, 4398, 4401, 4402, 4403, 4404, 4405, 4407, 4410, 4415, 4417, 4422, 4423, 4426, 4427, 4439, 4440, 4442, 4443, 4444, 4446, 4448, 4450, 4453, 4456, 4458, 4460, 4461, 4462, 4463, 4464, 4465, 4466, 4468, 4472, 4474, 4475, 4479, 4485, 4491, 4492, 4494, 4498, 4500, 4502, 4506, 4507, 4512, 4515, 4518, 4519, 4531, 4535, 4543, 4545, 4548, 4549, 4552, 4554, 4555, 4556, 4557, 4558, 4559, 4560, 4562, 4563, 4565, 4566, 4568, 4574, 4575, 4578, 4579, 4580, 4582, 4583, 4586, 4590, 4591, 4596, 4601, 4604, 4606, 4611, 4618, 4621, 4625, 4633, 4634, 4635, 4641, 4643, 4644, 4645, 4650, 4651, 4653, 4654, 4655, 4659, 4666, 4667, 4669, 4670, 4671, 4674, 4676, 4677, 4680, 4682, 4685, 4687, 4688, 4697, 4699, 4700, 4702, 4704, 4706, 4708, 4710, 4714, 4716, 4719, 4721, 4725, 4728, 4729, 4730, 4732, 4737, 4738, 4740, 4741, 4747, 4748, 4749, 4750, 4751, 4753, 4754, 4755, 4756, 4759, 4761, 4762, 4763, 4765, 4767, 4771, 4775, 4778, 4779, 4789, 4790, 4791, 4794, 4795, 4804, 4813, 4814, 4818, 4820, 4822, 4823, 4824, 4828, 4829, 4832, 4833, 4834, 4838, 4842, 4855, 4856, 4857, 4858, 4859, 4861, 4862, 4864, 4868, 4869, 4870, 4872, 4875, 4877, 4878, 4880, 4887, 4888, 4891, 4895, 4901, 4902, 4905, 4909, 4914, 4917, 4921, 4922, 4923, 4924, 4926, 4930, 4931, 4935, 4936, 4938, 4941, 4943, 4950, 4955, 4960, 4963, 4965, 4971, 4972, 4973, 4975, 4979, 4980, 4981, 4987, 4988, 4992, 4993, 4994, 4996, 5000, 5010, 5011, 5015, 5022, 5026, 5029, 5030, 5034, 5037, 5038, 5039, 5040, 5042, 5044, 5046, 5048, 5049, 5052, 5053, 5054, 5055, 5057, 5061, 5063, 5067, 5068, 5072, 5075, 5082, 5088, 5089, 5090, 5091, 5094, 5095, 5100, 5102, 5106, 5111, 5119, 5122, 5123, 5129, 5130, 5131, 5132, 5140, 5143, 5144, 5145, 5147, 5149, 5151, 5152, 5153, 5157, 5159, 5160, 5164, 5165, 5168, 5169, 5170, 5174, 5180, 5181, 5182, 5183, 5184, 5185, 5188, 5189, 5190, 5191, 5192, 5195, 5196, 5198, 5199, 5200, 5201, 5202, 5206, 5208, 5212, 5216, 5217, 5219, 5225, 5226, 5229, 5234, 5236, 5240, 5241, 5247, 5249, 5251, 5253, 5255, 5258, 5261, 5263, 5264, 5265, 5266, 5267, 5268, 5273, 5275, 5276, 5280, 5281, 5282, 5283, 5286, 5289, 5290, 5292, 5293, 5298, 5299, 5300, 5301, 5303, 5308, 5311, 5313, 5315, 5317, 5319, 5324, 5327, 5329, 5330, 5332, 5334, 5338, 5341, 5342, 5344, 5346, 5348, 5351, 5359, 5360, 5361, 5366, 5367, 5371, 5372, 5375, 5376, 5386, 5388, 5389, 5391, 5393, 5394, 5395, 5396, 5397, 5403, 5407, 5409, 5411, 5413, 5414, 5415, 5428, 5430, 5431, 5437, 5438, 5446, 5448, 5449, 5450, 5452, 5456, 5457, 5458, 5459, 5463, 5464, 5466, 5469, 5472, 5474, 5476, 5481, 5482, 5483, 5485, 5493, 5495, 5496, 5498, 5506, 5508, 5509, 5510, 5512, 5513, 5515, 5516, 5517, 5518, 5519, 5520, 5521, 5524, 5526, 5529, 5530, 5531, 5534, 5535, 5537, 5539, 5543, 5557, 5562, 5563, 5568, 5569, 5571, 5572, 5574, 5579, 5585, 5586, 5588, 5589, 5591, 5592, 5596, 5597, 5604, 5612, 5613, 5615, 5616, 5618, 5620, 5621, 5627, 5632, 5633, 5635, 5638, 5640, 5642, 5643, 5647, 5648, 5651, 5652, 5653, 5657, 5659, 5660, 5662, 5663, 5664, 5670, 5671, 5675, 5676, 5677, 5680, 5689, 5694, 5695, 5697, 5698, 5699, 5702, 5703, 5706, 5709, 5711, 5717, 5718, 5721, 5722, 5731, 5734, 5735, 5744, 5751, 5753, 5754, 5756, 5763, 5768, 5770, 5771, 5775, 5778, 5780, 5784, 5785, 5788, 5789, 5791, 5794, 5803, 5805, 5806, 5807, 5808, 5810, 5811, 5813, 5817, 5820, 5826, 5828, 5831, 5833, 5835, 5836, 5837, 5839, 5846, 5852, 5853, 5854, 5859, 5861, 5863, 5864, 5865, 5866, 5867, 5868, 5869, 5870, 5872, 5876, 5878, 5879, 5881, 5883, 5884, 5886, 5887, 5888, 5889, 5892, 5893, 5906, 5907, 5912, 5919, 5922, 5923, 5925, 5926, 5927, 5928, 5931, 5932, 5934, 5938, 5941, 5944, 5947, 5948, 5951, 5954, 5956, 5957, 5959, 5961, 5967, 5968, 5969, 5971, 5975, 5978, 5979, 5980, 5982, 5984, 5987, 5988, 5989, 5991, 5994, 5996, 5997, 6000, 6002, 6004, 6006, 6007, 6009, 6013, 6016, 6017, 6018, 6023, 6024, 6025, 6026, 6028, 6038, 6041, 6043, 6044, 6048, 6051, 6058, 6059, 6062, 6063, 6065, 6068, 6069, 6070, 6072, 6073, 6075, 6080, 6081, 6084, 6085, 6086, 6087, 6088, 6089, 6090, 6092, 6093, 6097, 6098, 6099, 6107, 6108, 6109, 6110, 6113, 6116, 6118, 6119, 6120, 6124, 6129, 6131, 6132, 6133, 6135, 6136, 6137, 6138, 6139, 6143, 6145, 6146, 6147, 6148, 6149, 6151, 6153, 6157, 6158, 6160, 6162, 6163, 6164, 6165, 6173, 6180, 6181, 6182, 6183, 6184, 6186, 6188, 6189, 6193, 6194, 6195, 6196, 6197, 6198, 6203, 6204, 6205, 6209, 6212, 6215, 6220, 6221, 6223, 6224, 6226, 6227, 6228, 6230, 6231, 6234, 6237, 6239, 6243, 6246, 6247, 6250, 6251, 6264, 6265, 6267, 6270, 6272, 6273, 6275, 6278, 6281, 6282, 6286, 6288, 6292, 6293, 6295, 6296, 6299, 6300, 6303, 6309, 6310, 6315, 6317, 6319, 6322, 6328, 6330, 6333, 6338, 6342, 6349, 6353, 6354, 6356, 6360, 6363, 6365, 6367, 6370, 6372, 6375, 6376, 6381, 6383, 6386, 6393, 6394, 6397, 6399, 6400, 6403, 6404, 6405, 6408, 6410, 6412, 6414, 6415, 6419, 6420, 6425, 6426, 6427, 6428, 6429, 6430, 6431, 6436, 6440, 6449, 6456, 6463, 6464, 6466, 6467, 6468, 6469, 6470, 6474, 6475, 6476, 6478, 6480, 6482, 6484, 6485, 6486, 6488, 6494, 6501, 6504, 6505, 6510, 6513, 6516, 6517, 6519, 6523, 6526, 6528, 6530, 6531, 6532, 6534, 6537, 6541, 6543, 6545, 6547, 6549, 6553, 6554, 6555, 6558, 6559, 6564, 6567, 6569, 6571, 6572, 6574, 6576, 6577, 6579, 6581, 6584, 6588, 6589, 6592, 6594, 6595, 6596, 6597, 6599, 6600, 6603, 6606, 6607, 6609, 6610, 6614, 6615, 6616, 6617, 6620, 6623, 6625, 6628, 6629, 6633, 6634, 6635, 6638, 6639, 6640, 6644, 6646, 6647, 6649, 6655, 6656, 6658, 6661, 6662, 6666, 6671, 6672, 6681, 6682, 6701, 6703, 6705, 6706, 6716, 6718, 6720, 6729, 6730, 6734, 6736, 6737, 6739, 6742, 6747, 6748, 6749, 6756, 6757, 6759, 6761, 6764, 6766, 6767, 6777, 6778, 6779, 6782, 6783, 6786, 6788, 6792, 6793, 6794, 6795, 6797, 6799, 6803, 6804, 6805, 6807, 6810, 6811, 6813, 6815, 6816, 6817, 6819, 6820, 6821, 6824, 6826, 6827, 6828, 6830, 6831, 6834, 6836, 6840, 6841, 6842, 6843, 6848, 6851, 6855, 6863, 6867, 6868, 6869, 6875, 6876, 6877, 6878, 6880, 6881, 6882, 6883, 6884, 6885, 6886, 6887, 6888, 6892, 6895, 6897, 6902, 6903, 6906, 6907, 6909, 6913, 6914, 6917, 6919, 6920, 6921, 6924, 6925, 6930, 6931, 6936, 6939, 6946, 6954, 6955, 6959, 6960, 6963, 6970, 6971, 6979, 6981, 6984, 6985, 6987, 6988, 6990, 6991, 6994, 6997, 6999, 7003, 7009, 7013, 7018, 7022, 7025, 7029, 7038, 7039, 7040, 7041, 7043, 7045, 7046, 7051, 7052, 7053, 7054, 7057, 7059, 7060, 7062, 7064, 7067, 7072, 7073, 7075, 7077, 7083, 7084, 7085, 7093, 7096, 7105, 7106, 7107, 7108, 7110, 7117, 7118, 7124, 7126, 7128, 7130, 7136, 7138, 7139, 7140, 7142, 7143, 7144, 7151, 7154, 7163, 7164, 7165, 7166, 7169, 7170, 7171, 7172, 7182, 7184, 7191, 7192, 7194, 7196, 7197, 7198, 7201, 7202, 7206, 7207, 7208, 7210, 7212, 7214, 7215, 7217, 7219, 7220, 7224, 7227, 7228, 7230, 7231, 7235, 7236, 7244, 7245, 7246, 7249, 7250, 7255, 7257, 7258, 7262, 7263, 7264, 7267, 7268, 7270, 7274, 7276, 7281, 7282, 7287, 7291, 7292, 7293, 7298, 7299, 7300, 7301, 7303, 7304, 7306, 7307, 7308, 7311, 7312, 7313, 7315, 7318, 7323, 7324, 7328, 7331, 7338, 7340, 7344, 7345, 7353, 7356, 7357, 7358, 7361, 7365, 7371, 7373, 7375, 7376, 7377, 7380, 7382, 7383, 7386, 7392, 7395, 7398, 7399, 7400, 7409, 7410, 7411, 7415, 7417, 7418, 7425, 7430, 7434, 7435, 7436, 7437, 7438, 7441, 7443, 7444, 7447, 7448, 7450, 7452, 7453, 7454, 7457, 7458, 7459, 7464, 7466, 7470, 7472, 7475, 7476, 7481, 7483, 7485, 7486, 7490, 7492, 7493, 7498, 7499, 7502, 7503, 7504, 7506, 7512, 7514, 7515, 7517, 7521, 7523, 7524, 7533, 7538, 7541, 7545, 7546, 7549, 7556, 7560, 7561, 7572, 7574, 7576, 7579, 7583, 7585, 7586, 7589, 7590, 7594, 7596, 7597, 7598, 7599, 7601, 7604, 7605, 7609, 7611, 7612, 7619, 7620, 7622, 7624, 7625, 7633, 7642, 7643, 7644, 7647, 7649, 7652, 7655, 7656, 7658, 7661, 7662, 7664, 7665, 7671, 7673, 7674, 7678, 7679, 7680, 7682, 7685, 7687, 7689, 7695, 7700, 7703, 7712, 7715, 7716, 7718, 7724, 7726, 7730, 7736, 7737, 7738, 7741, 7744, 7745, 7746, 7748, 7749, 7753, 7754, 7756, 7763, 7764, 7768, 7770, 7772, 7774, 7775, 7777, 7778, 7779, 7780, 7781, 7785, 7786, 7788, 7791, 7792, 7793, 7798, 7799, 7800, 7803, 7804, 7806, 7807, 7818, 7819, 7820, 7823, 7825, 7833, 7834, 7838, 7839, 7841, 7844, 7845, 7850, 7854, 7856, 7860, 7865, 7873, 7877, 7878, 7880, 7881, 7885, 7887, 7888, 7890, 7896, 7908, 7911, 7913, 7918, 7923, 7925, 7928, 7933, 7934, 7935, 7937, 7938, 7942, 7944, 7946, 7949, 7950, 7952, 7965, 7966, 7967, 7972, 7973, 7974, 7976, 7977, 7982, 7983, 7984, 7986, 7988, 7993, 7994, 7996, 7999, 8000, 8006, 8007, 8012, 8020, 8023, 8024, 8026, 8029, 8031, 8036, 8040, 8041, 8042, 8044, 8045, 8047, 8048, 8052, 8053, 8056, 8058, 8059, 8061, 8063, 8064, 8068, 8075, 8076, 8077, 8078, 8079, 8080, 8081, 8083, 8084, 8088, 8091, 8093, 8095, 8099, 8100, 8102, 8103, 8105, 8106, 8110, 8112, 8113, 8118, 8121, 8123, 8126, 8129, 8130, 8134, 8136, 8145, 8147, 8148, 8150, 8151, 8155, 8163, 8166, 8170, 8178, 8179, 8181, 8182, 8189, 8193, 8194, 8197, 8202, 8204, 8208, 8210, 8211, 8213, 8217, 8219, 8220, 8223, 8230, 8234, 8235, 8237, 8239, 8241, 8242, 8246, 8248, 8250, 8252, 8253, 8257, 8258, 8262, 8264, 8265, 8268, 8269, 8272, 8273, 8274, 8275, 8289, 8291, 8292, 8295, 8296, 8300, 8301, 8304, 8305, 8308, 8310, 8311, 8312, 8315, 8318, 8319, 8322, 8323, 8326, 8329, 8339, 8340, 8341, 8347, 8349, 8350, 8351, 8353, 8355, 8358, 8367, 8368, 8371, 8373, 8378, 8379, 8380, 8382, 8385, 8386, 8387, 8389, 8392, 8395, 8396, 8397, 8398, 8401, 8404, 8406, 8408, 8410, 8413, 8414, 8415, 8416, 8417, 8418, 8427, 8428, 8430, 8435, 8436, 8438, 8439, 8440, 8442, 8443, 8444, 8445, 8446, 8447, 8448, 8449, 8450, 8451, 8458, 8459, 8465, 8469, 8470, 8472, 8473, 8474, 8476, 8477, 8478, 8481, 8482, 8483, 8485, 8486, 8490, 8494, 8498, 8501, 8502, 8503, 8505, 8507, 8509, 8511, 8513, 8515, 8517, 8521, 8523, 8524, 8525, 8526, 8528, 8531, 8532, 8533, 8541, 8542, 8543, 8553, 8554, 8557, 8561, 8562, 8565, 8568, 8574, 8575, 8576, 8579, 8581, 8583, 8585, 8588, 8592, 8594, 8596, 8597, 8598, 8600, 8601, 8602, 8603, 8604, 8605, 8609, 8611, 8612, 8614, 8622, 8631, 8634, 8635, 8638, 8639, 8642, 8644, 8646, 8648, 8650, 8652, 8654, 8657, 8658, 8659, 8660, 8663, 8665, 8669, 8670, 8672, 8675, 8676, 8677, 8685, 8686, 8693, 8700, 8703, 8706, 8708, 8709, 8710, 8713, 8717, 8719, 8720, 8722, 8726, 8728, 8729, 8731, 8736, 8741, 8743, 8744, 8746, 8747, 8748, 8753, 8755, 8757, 8761, 8763, 8769, 8770, 8772, 8773, 8774, 8777, 8779, 8782, 8783, 8784, 8786, 8789, 8792, 8795, 8802, 8803, 8804, 8808, 8810, 8817, 8818, 8821, 8822, 8824, 8828, 8829, 8830, 8831, 8834, 8835, 8836, 8839, 8841, 8842, 8843, 8845, 8846, 8853, 8865, 8866, 8872, 8874, 8876, 8877, 8878, 8881, 8883, 8886, 8888, 8889, 8892, 8896, 8899, 8900, 8901, 8907, 8908, 8911, 8916, 8917, 8919, 8922, 8926, 8928, 8929, 8930, 8937, 8938, 8941, 8945, 8946, 8949, 8951, 8953, 8960, 8961, 8967, 8968, 8971, 8979, 8980, 8981, 8985, 8986, 8991, 8992, 8996, 8998, 9001, 9006, 9009, 9011, 9012, 9013, 9015, 9016, 9018, 9022, 9026, 9027, 9029, 9030, 9033, 9045, 9050, 9052, 9056, 9057, 9058, 9059, 9060, 9063, 9065, 9068, 9069, 9071, 9072, 9075, 9076, 9078, 9084, 9086, 9087, 9088, 9091, 9092, 9095, 9096, 9097, 9098, 9103, 9104, 9105, 9106, 9107, 9114, 9115, 9116, 9118, 9120, 9123, 9125, 9129, 9131, 9133, 9134, 9138, 9139, 9140, 9141, 9142, 9144, 9145, 9151, 9152, 9154, 9155, 9167, 9168, 9175, 9177, 9179, 9180, 9183, 9185, 9188, 9190, 9191, 9194, 9195, 9200, 9205, 9206, 9207, 9210, 9211, 9213, 9215, 9216, 9218, 9220, 9223, 9226, 9229, 9231, 9233, 9237, 9240, 9243, 9248, 9249, 9253, 9257, 9262, 9267, 9269, 9270, 9273, 9282, 9284, 9285, 9287, 9288, 9290, 9292, 9293, 9295, 9296, 9300, 9304, 9306, 9308, 9311, 9313, 9314, 9320, 9321, 9323, 9326, 9328, 9336, 9337, 9338, 9339, 9340, 9346, 9347, 9350, 9352, 9359, 9366, 9371, 9373, 9375, 9376, 9380, 9382, 9388, 9391, 9392, 9393, 9394, 9400, 9402, 9403, 9404, 9406, 9407, 9412, 9413, 9414, 9415, 9419, 9421, 9423, 9425, 9429, 9434, 9439, 9440, 9443, 9449, 9451, 9452, 9453, 9456, 9460, 9467, 9468, 9471, 9472, 9473, 9474, 9481, 9484, 9488, 9490, 9500, 9504, 9509, 9514, 9517, 9518, 9519, 9522, 9534, 9536, 9537, 9538, 9540, 9545, 9546, 9548, 9550, 9551, 9553, 9554, 9555, 9559, 9560, 9564, 9567, 9568, 9571, 9577, 9587, 9590, 9591, 9593, 9595, 9596, 9598, 9601, 9602, 9606, 9607, 9609, 9614, 9615, 9617, 9618, 9620, 9621, 9623, 9624, 9626, 9632, 9633, 9635, 9648, 9649, 9651, 9652, 9653, 9655, 9657, 9658, 9659, 9663, 9666, 9668, 9670, 9682, 9686, 9687, 9696, 9698, 9699, 9706, 9710, 9711, 9715, 9721, 9722, 9723, 9726, 9727, 9729, 9730, 9731, 9732, 9734, 9737, 9738, 9742, 9744, 9745, 9746, 9750, 9751, 9753, 9754, 9756, 9763, 9764, 9768, 9770, 9772, 9774, 9776, 9777, 9782, 9786, 9791, 9792, 9793, 9794, 9798, 9799, 9802, 9808, 9810, 9811, 9812, 9813, 9819, 9820, 9825, 9827, 9828, 9829, 9830, 9833, 9835, 9836, 9845, 9846, 9847, 9850, 9861, 9866, 9869, 9873, 9875, 9878, 9879, 9882, 9886, 9887, 9892, 9894, 9897, 9900, 9907, 9909, 9910, 9911, 9921, 9923, 9924, 9928, 9930, 9932, 9935, 9938, 9940, 9944, 9946, 9949, 9950, 9952, 9953, 9960, 9962, 9963, 9967, 9968, 9969, 9972, 9973, 9974, 9975, 9976, 9979, 9980, 9982, 9984, 9985, 9987, 9988, 9990, 9991, 9992, 9996, 9997, 10000, 10008, 10009, 10010, 10012, 10013, 10015, 10017, 10018, 10019, 10021, 10022, 10026, 10027, 10032, 10033, 10034, 10035, 10037, 10040, 10041, 10049, 10051, 10052, 10053, 10054, 10055, 10058, 10059, 10060, 10062, 10064, 10066, 10073, 10075, 10077, 10078, 10080, 10081, 10083, 10091, 10092, 10095, 10097, 10101, 10102, 10103, 10106, 10109, 10110, 10113, 10115, 10116, 10117, 10122, 10128, 10129, 10130, 10131, 10136, 10140, 10143, 10149, 10151, 10158, 10160, 10163, 10165, 10166, 10168, 10174, 10176, 10178, 10181, 10191, 10192, 10193, 10194, 10195, 10196, 10199, 10206, 10207, 10212, 10217, 10218, 10219, 10220, 10221, 10222, 10223, 10224, 10225, 10228, 10230, 10231, 10233, 10234, 10235, 10236, 10237, 10239, 10247, 10249, 10252, 10253, 10255, 10259, 10260, 10262, 10266, 10269, 10270, 10275, 10276, 10278, 10284, 10286, 10291, 10292, 10293, 10295, 10300, 10302, 10306, 10307, 10311, 10312, 10314, 10318, 10319, 10322, 10323, 10325, 10326, 10327, 10331, 10333, 10334, 10335, 10336, 10340, 10341, 10343, 10346, 10353, 10356, 10357, 10361, 10362, 10364, 10365, 10371, 10375, 10376, 10378, 10380, 10381, 10384, 10388, 10397, 10398, 10399, 10400, 10401, 10405, 10410, 10411, 10413, 10414, 10416, 10417, 10419, 10421, 10423, 10425, 10426, 10430, 10435, 10436, 10438, 10440, 10446, 10447, 10449, 10450, 10451, 10452, 10453, 10456, 10460, 10463, 10464, 10465, 10466, 10468, 10469, 10471, 10474, 10480, 10482, 10487, 10490, 10492, 10494, 10496, 10498, 10506, 10508, 10514, 10518, 10522, 10523, 10527, 10528, 10530, 10531, 10532, 10535, 10536, 10537, 10541, 10542, 10543, 10544, 10547, 10555, 10556, 10558, 10560, 10563, 10564, 10567, 10569, 10571, 10573, 10579, 10580, 10581, 10582, 10583, 10588, 10593, 10596, 10597, 10599, 10601, 10602, 10608, 10611, 10615, 10616, 10617, 10621, 10622, 10626, 10636, 10637, 10638, 10639, 10640, 10643, 10645, 10646, 10650, 10651, 10655, 10657, 10668, 10670, 10676, 10678, 10679, 10682, 10683, 10684, 10685, 10686, 10687, 10698, 10700, 10701, 10705, 10707, 10711, 10715, 10716, 10721, 10722, 10724, 10726, 10729, 10734, 10736, 10738, 10740, 10741, 10744, 10747, 10748, 10749, 10752, 10753, 10754, 10756, 10761, 10762, 10763, 10768, 10769, 10772, 10774, 10775, 10776, 10778, 10779, 10782, 10785, 10787, 10788, 10790, 10792, 10795, 10799, 10801, 10802, 10803, 10804, 10805, 10809, 10810, 10811, 10815, 10818, 10819, 10820, 10822, 10823, 10824, 10827, 10831, 10833, 10836, 10837, 10838, 10839, 10840, 10841, 10843, 10850, 10851, 10852, 10853, 10854, 10856, 10857, 10858, 10860, 10866, 10867, 10870, 10874, 10877, 10878, 10879, 10880, 10886, 10896, 10897, 10898, 10899, 10901, 10902, 10911, 10913, 10917, 10918, 10920, 10924, 10926, 10927, 10928, 10929, 10930, 10933, 10934, 10940, 10941, 10947, 10949, 10960, 10962, 10965, 10966, 10967, 10972, 10976, 10977, 10978, 10979, 10985, 10987, 10988, 10993, 10996, 10999, 11008, 11015, 11021, 11023, 11024, 11027, 11030, 11032, 11033, 11036, 11037, 11039, 11040, 11046, 11047, 11050, 11051, 11052, 11053, 11056, 11058, 11060, 11063, 11066, 11070, 11078, 11082, 11083, 11090, 11095, 11098, 11100, 11101, 11103, 11107, 11109, 11114, 11117, 11118, 11119, 11122, 11124, 11128, 11129, 11133, 11136, 11137, 11138, 11145, 11147, 11148, 11149, 11150, 11151, 11152, 11153, 11154, 11160, 11163, 11165, 11168, 11169, 11173, 11177, 11178, 11181, 11184, 11187, 11188, 11190, 11192, 11193, 11194, 11198, 11203, 11204, 11208, 11213, 11214, 11217, 11218, 11222, 11226, 11227, 11228, 11229, 11230, 11231, 11232, 11233, 11235, 11236, 11237, 11238, 11239, 11242, 11243, 11246, 11247, 11251, 11253, 11254, 11255, 11256, 11258, 11260, 11262, 11263, 11266, 11278, 11290, 11291, 11292, 11293, 11294, 11295, 11297, 11299, 11304, 11305, 11306, 11313, 11315, 11316, 11317, 11318, 11321, 11330, 11331, 11337, 11339, 11340, 11345, 11346, 11348, 11349, 11358, 11359, 11363, 11364, 11365, 11369, 11371, 11373, 11374, 11377, 11379, 11380, 11382, 11385, 11387, 11391, 11392, 11394, 11395, 11398, 11401, 11404, 11405, 11406, 11408, 11416, 11417, 11424, 11427, 11430, 11431, 11435, 11438, 11439, 11440, 11443, 11446, 11447, 11448, 11449, 11451, 11456, 11459, 11465, 11466, 11472, 11475, 11477, 11478, 11487, 11488, 11489, 11490, 11492, 11496, 11497, 11498, 11499, 11500, 11501, 11505, 11506, 11507, 11508, 11513, 11520, 11521, 11523, 11524, 11526, 11527, 11528, 11531, 11532, 11533, 11534, 11535, 11540, 11541, 11544, 11546, 11548, 11550, 11551, 11553, 11558, 11560, 11561, 11567, 11568, 11570, 11571, 11576, 11577, 11578, 11585, 11586, 11588, 11593, 11594, 11595, 11596, 11597, 11599, 11603, 11604, 11605, 11606, 11607, 11611, 11612, 11615, 11617, 11618, 11621, 11623, 11625, 11628, 11631, 11634, 11636, 11639, 11640, 11647, 11649, 11650, 11655, 11656, 11658, 11659, 11663, 11664, 11669, 11673, 11678, 11681, 11682, 11688, 11691, 11692, 11694, 11695, 11696, 11699, 11701, 11703, 11705, 11707, 11712, 11718, 11721, 11725, 11726, 11730, 11731, 11733, 11736, 11737, 11738, 11743, 11744, 11753, 11756, 11759, 11760, 11761, 11762, 11763, 11765, 11770, 11771, 11777, 11778, 11781, 11782, 11785, 11786, 11788, 11792, 11794, 11797, 11799, 11800, 11804, 11805, 11809, 11810, 11811, 11812, 11814, 11818, 11819, 11820, 11821, 11823, 11826, 11828, 11829, 11830, 11836, 11837, 11840, 11841, 11842, 11846, 11848, 11849, 11851, 11854, 11856, 11858, 11861, 11863, 11864, 11865, 11868, 11869, 11872, 11876, 11877, 11878, 11879, 11881, 11886, 11889, 11891, 11892, 11894, 11895, 11898, 11899, 11901, 11906, 11909, 11911, 11913, 11914, 11915, 11916, 11917, 11919, 11920, 11921, 11922, 11923, 11926, 11927, 11928, 11929, 11930, 11934, 11935, 11940, 11943, 11946, 11947, 11948, 11949, 11953, 11955, 11956, 11958, 11959, 11960, 11961, 11962, 11963, 11965, 11966, 11968, 11974, 11975, 11976, 11977, 11978, 11979, 11980, 11983, 11988, 11989, 11993, 11997, 11998, 11999, 12002, 12004, 12008, 12014, 12015, 12017, 12019, 12020, 12021, 12023, 12024, 12026, 12027, 12032, 12033, 12042, 12043, 12044, 12052, 12058, 12059, 12060, 12068, 12075, 12076, 12077, 12081, 12083, 12087, 12091, 12092, 12093, 12095, 12098, 12102, 12104, 12106, 12109, 12110, 12112, 12114, 12118, 12122, 12126, 12127, 12128, 12129, 12130, 12134, 12135, 12137, 12138, 12139, 12143, 12147, 12149, 12151, 12161, 12163, 12165, 12166, 12170, 12171, 12173, 12174, 12175, 12181, 12183, 12185, 12189, 12191, 12197, 12198, 12200, 12201, 12204, 12207, 12208, 12215, 12217, 12218, 12219, 12220, 12221, 12223, 12227, 12228, 12229, 12233, 12234, 12240, 12241, 12245, 12249, 12250, 12252, 12253, 12255, 12256, 12259, 12263, 12267, 12268, 12269, 12271, 12274, 12278, 12280, 12283, 12284, 12286, 12287, 12288, 12293, 12297, 12298, 12304, 12310, 12311, 12313, 12314, 12315, 12317, 12321, 12323, 12324, 12326, 12329, 12331, 12333, 12334, 12342, 12343, 12344, 12345, 12347, 12354, 12356, 12358, 12359, 12364, 12367, 12368, 12369, 12370, 12372, 12374, 12375, 12376, 12379, 12380, 12381, 12383, 12385, 12391, 12397, 12400, 12401, 12403, 12404, 12405, 12406, 12411, 12414, 12419, 12420, 12421, 12424, 12425, 12426, 12427, 12428, 12437, 12439, 12440, 12441, 12445, 12447, 12451, 12454, 12455, 12456, 12457, 12459, 12462, 12465, 12467, 12468, 12470, 12472, 12478, 12479, 12481, 12482, 12487, 12488, 12489, 12491, 12497, 12499, 12503, 12504, 12508, 12509, 12514, 12521, 12525, 12530, 12531, 12536, 12539, 12545, 12546, 12547, 12549, 12555, 12556, 12559, 12561, 12563, 12564, 12565, 12567, 12568, 12570, 12578, 12583, 12585, 12588, 12591, 12597, 12600, 12605, 12608, 12609, 12611, 12614, 12616, 12619, 12622, 12623, 12631, 12633, 12634, 12635, 12636, 12638, 12639, 12641, 12649, 12651, 12655, 12663, 12668, 12670, 12671, 12672, 12675, 12679, 12680, 12681, 12682, 12684, 12691, 12693, 12695, 12698, 12699, 12701, 12702, 12703, 12705, 12706, 12707, 12713, 12714, 12715, 12718, 12719, 12729, 12731, 12732, 12733, 12737, 12738, 12739, 12741, 12742, 12743, 12748, 12751, 12752, 12754, 12755, 12757, 12758, 12760, 12761, 12762, 12764, 12766, 12767, 12771, 12783, 12790, 12794, 12797, 12800, 12802, 12803, 12805, 12810, 12812, 12813, 12817, 12819, 12820, 12822, 12824, 12826, 12827, 12828, 12834, 12835, 12836, 12838, 12839, 12843, 12844, 12849, 12850, 12853, 12856, 12861, 12866, 12873, 12875, 12882, 12883, 12884, 12887, 12888, 12895, 12898, 12899, 12900, 12904, 12905, 12906, 12910, 12913, 12914, 12916, 12917, 12918, 12920, 12921, 12926, 12929, 12932, 12933, 12938, 12939, 12940, 12941, 12942, 12945, 12946, 12947, 12950, 12953, 12961, 12966, 12968, 12969, 12972, 12973, 12974, 12975, 12976, 12977, 12978, 12983, 12984, 12987, 12990, 12991, 12992, 12994, 12996, 12998, 13004, 13006, 13007, 13010, 13011, 13014, 13017, 13018, 13022, 13023, 13024, 13030, 13032, 13033, 13035, 13036, 13038, 13040, 13041, 13044, 13049, 13050, 13053, 13054, 13055, 13056, 13061, 13062, 13064, 13065, 13066, 13067, 13069, 13071, 13074, 13075, 13077, 13079, 13083, 13085, 13086, 13087, 13095, 13101, 13102, 13105, 13106, 13109, 13112, 13114, 13115, 13116, 13117, 13118, 13120, 13123, 13124, 13128, 13131, 13135, 13142, 13147, 13148, 13149, 13151, 13153, 13154, 13156, 13160, 13169, 13175, 13181, 13182, 13191, 13197, 13199, 13209, 13212, 13213, 13215, 13217, 13221, 13222, 13224, 13227, 13230, 13232, 13234, 13235, 13236, 13237, 13238, 13239, 13243, 13249, 13251, 13255, 13259, 13260, 13261, 13263, 13264, 13269, 13273, 13276, 13279, 13281, 13285, 13293, 13296, 13298, 13301, 13303, 13304, 13313, 13315, 13317, 13320, 13321, 13325, 13326, 13328, 13330, 13332, 13337, 13338, 13343, 13345, 13348, 13349, 13353, 13354, 13358, 13359, 13361, 13367, 13368, 13369, 13373, 13375, 13380, 13381, 13384, 13385, 13388, 13393, 13394, 13396, 13397, 13401, 13408, 13410, 13416, 13419, 13420, 13423, 13424, 13429, 13430, 13431, 13433, 13439, 13441, 13444, 13446, 13448, 13449, 13450, 13451, 13454, 13456, 13460, 13463, 13466, 13468, 13469, 13472, 13473, 13475, 13492, 13494, 13496, 13498, 13499, 13500, 13501, 13503, 13504, 13505, 13506, 13510, 13512, 13513, 13514, 13515, 13516, 13517, 13519, 13520, 13521, 13524, 13529, 13530, 13532, 13539, 13540, 13543, 13544, 13545, 13546, 13547, 13549, 13552, 13553, 13556, 13559, 13568, 13569, 13574, 13580, 13582, 13583, 13584, 13587, 13589, 13595, 13597, 13599, 13601, 13602, 13603, 13604, 13605, 13612, 13621, 13623, 13628, 13631, 13632, 13634, 13635, 13636, 13637, 13641, 13643, 13647, 13650, 13652, 13654, 13660, 13661, 13662, 13663, 13668, 13671, 13675, 13676, 13677, 13678, 13679, 13681, 13683, 13684, 13687, 13688, 13695, 13698, 13700, 13702, 13703, 13706, 13710, 13712, 13713, 13715, 13716, 13720, 13721, 13725, 13727, 13728, 13729, 13733, 13739, 13742, 13745, 13747, 13748, 13750, 13755, 13756, 13764, 13766, 13767, 13769, 13772, 13773, 13774, 13775, 13776, 13779, 13781, 13782, 13783, 13785, 13786, 13787, 13789, 13790, 13791, 13792, 13793, 13794, 13795, 13796, 13798, 13807, 13809, 13816, 13817, 13818, 13819, 13820, 13822, 13823, 13830, 13831, 13833, 13834, 13835, 13843, 13849, 13851, 13852, 13859, 13864, 13866, 13869, 13870, 13872, 13873, 13874, 13875, 13877, 13881, 13883, 13888, 13891, 13892, 13896, 13897, 13898, 13901, 13906, 13908, 13909, 13910, 13911, 13912, 13917, 13918, 13919, 13920, 13925, 13927, 13930, 13933, 13938, 13944, 13947, 13949, 13952, 13954, 13956, 13961, 13963, 13965, 13969, 13970, 13971, 13975, 13976, 13980, 13981, 13983, 13984, 13988, 13990, 13991, 13999, 14000, 14001, 14003, 14009, 14014, 14016, 14017, 14018, 14022, 14026, 14027, 14030, 14031, 14036, 14041, 14043, 14049, 14050, 14051, 14052, 14062, 14063, 14066, 14067, 14069, 14070, 14071, 14073, 14075, 14081, 14084, 14086, 14088, 14091, 14092, 14093, 14094, 14096, 14099, 14105, 14106, 14110, 14112, 14115, 14116, 14118, 14122, 14125, 14126, 14129, 14130, 14132, 14134, 14135, 14137, 14138, 14139, 14142, 14143, 14145, 14146, 14148, 14149, 14150.

Promoters expressing in the dried kernel tissue after harvest include SEQ IDs: 1, 7, 14, 27, 29, 31, 32, 34, 36, 45, 48, 54, 56, 64, 65, 68, 69, 70, 71, 86, 88, 96, 97, 99, 101, 102, 103, 107, 110, 111, 126, 130, 131, 132, 133, 140, 143, 144, 146, 148, 152, 154, 156, 157, 159, 162, 172, 174, 175, 176, 177, 179, 181, 183, 184, 187, 197, 199, 202, 203, 205, 207, 211, 223, 232, 235, 236, 239, 240, 244, 246, 249, 250, 251, 257, 262, 264, 280, 286, 288, 291, 294, 301, 302, 303, 305, 306, 319, 320, 321, 323, 328, 329, 332, 335, 341, 346, 348, 349, 352, 356, 357, 358, 359, 364, 368, 371, 373, 388, 401, 406, 407, 415, 416, 419, 420, 423, 424, 428, 429, 434, 444, 452, 454, 456, 461, 466, 468, 473, 481, 482, 483, 484, 485, 488, 498, 501, 502, 509, 512, 513, 514, 515, 516, 517, 520, 522, 523, 525, 529, 532, 533, 536, 538, 544, 548, 553, 554, 557, 560, 564, 578, 585, 591, 594, 595, 596, 604, 607, 608, 611, 613, 614, 620, 626, 630, 631, 633, 635, 638, 641, 643, 644, 650, 653, 663, 665, 670, 681, 686, 693, 695, 701, 705, 717, 718, 719, 722, 723, 724, 726, 733, 734, 736, 739, 742, 749, 753, 757, 765, 768, 770, 771, 773, 782, 783, 793, 795, 797, 800, 801, 806, 808, 812, 813, 819, 820, 821, 824, 825, 826, 829, 830, 833, 839, 840, 841, 842, 844, 845, 855, 857, 865, 868, 873, 877, 878, 883, 884, 885, 887, 890, 891, 892, 895, 897, 902, 903, 908, 911, 912, 913, 916, 917, 919, 920, 922, 929, 931, 936, 938, 943, 944, 949, 951, 953, 954, 958, 959, 961, 962, 964, 966, 969, 974, 979, 982, 991, 994, 995, 997, 999, 1006, 1007, 1008, 1009, 1010, 1011, 1014, 1017, 1026, 1032, 1038, 1041, 1042, 1043, 1045, 1047, 1049, 1050, 1051, 1052, 1056, 1057, 1064, 1065, 1069, 1072, 1077, 1086, 1087, 1089, 1103, 1104, 1108, 1110, 1111, 1112, 1114, 1117, 1118, 1119, 1120, 1122, 1127, 1133, 1136, 1137, 1143, 1144, 1148, 1166, 1170, 1171, 1174, 1175, 1176, 1178, 1182, 1187, 1191, 1193, 1196, 1199, 1200, 1204, 1205, 1208, 1213, 1214, 1217, 1218, 1220, 1225, 1227, 1228, 1230, 1231, 1233, 1236, 1241, 1244, 1248, 1250, 1252, 1253, 1254, 1256, 1257, 1261, 1262, 1264, 1265, 1272, 1275, 1281, 1282, 1285, 1286, 1292, 1293, 1295, 1297, 1309, 1312, 1316, 1317, 1325, 1327, 1330, 1331, 1334, 1335, 1337, 1340, 1347, 1351, 1352, 1354, 1355, 1360, 1364, 1365, 1371, 1373, 1376, 1377, 1380, 1382, 1387, 1388, 1394, 1396, 1398, 1402, 1404, 1405, 1409, 1410, 1412, 1415, 1426, 1431, 1438, 1440, 1441, 1442, 1451, 1453, 1454, 1455, 1459, 1471, 1475, 1481, 1486, 1487, 1488, 1490, 1493, 1496, 1498, 1508, 1510, 1511, 1514, 1517, 1518, 1525, 1526, 1527, 1530, 1533, 1536, 1539, 1543, 1545, 1548, 1549, 1559, 1567, 1571, 1575, 1578, 1586, 1589, 1590, 1592, 1593, 1595, 1599, 1600, 1604, 1609, 1612, 1614, 1616, 1618, 1622, 1624, 1625, 1628, 1629, 1634, 1635, 1636, 1637, 1638, 1639, 1648, 1650, 1653, 1658, 1662, 1671, 1675, 1676, 1677, 1680, 1683, 1685, 1688, 1689, 1691, 1707, 1708, 1710, 1712, 1714, 1717, 1721, 1723, 1729, 1731, 1732, 1735, 1740, 1755, 1759, 1761, 1765, 1766, 1768, 1771, 1776, 1779, 1782, 1784, 1785, 1816, 1820, 1828, 1830, 1832, 1834, 1835, 1837, 1838, 1843, 1845, 1849, 1850, 1852, 1858, 1859, 1867, 1868, 1869, 1870, 1872, 1873, 1886, 1891, 1893, 1895, 1897, 1898, 1899, 1900, 1902, 1903, 1904, 1905, 1906, 1913, 1914, 1916, 1918, 1920, 1923, 1930, 1931, 1936, 1940, 1944, 1945, 1952, 1953, 1955, 1964, 1973, 1974, 1981, 1986, 1990, 1991, 1993, 2003, 2007, 2008, 2009, 2010, 2012, 2013, 2015, 2017, 2026, 2033, 2034, 2039, 2041, 2048, 2060, 2062, 2064, 2066, 2069, 2071, 2074, 2077, 2082, 2083, 2088, 2089, 2091, 2092, 2093, 2094, 2096, 2097, 2098, 2103, 2104, 2107, 2112, 2114, 2122, 2125, 2126, 2133, 2134, 2137, 2140, 2141, 2142, 2144, 2147, 2150, 2152, 2157, 2158, 2159, 2161, 2162, 2164, 2165, 2166, 2167, 2168, 2170, 2172, 2178, 2179, 2185, 2189, 2191, 2193, 2196, 2201, 2202, 2203, 2206, 2207, 2214, 2215, 2216, 2221, 2226, 2227, 2229, 2230, 2231, 2232, 2237, 2240, 2253, 2260, 2261, 2262, 2263, 2265, 2274, 2280, 2281, 2283, 2288, 2293, 2296, 2298, 2304, 2306, 2308, 2309, 2314, 2322, 2323, 2328, 2329, 2331, 2333, 2335, 2339, 2342, 2351, 2352, 2358, 2359, 2360, 2361, 2362, 2363, 2367, 2371, 2375, 2379, 2381, 2382, 2384, 2385, 2397, 2398, 2401, 2403, 2405, 2411, 2412, 2418, 2420, 2423, 2430, 2431, 2435, 2438, 2441, 2442, 2443, 2445, 2452, 2453, 2454, 2457, 2458, 2465, 2470, 2471, 2472, 2474, 2476, 2479, 2481, 2482, 2483, 2490, 2494, 2495, 2498, 2500, 2504, 2505, 2509, 2510, 2511, 2514, 2517, 2525, 2528, 2529, 2531, 2532, 2533, 2534, 2537, 2538, 2539, 2541, 2543, 2547, 2548, 2549, 2552, 2553, 2554, 2555, 2557, 2565, 2568, 2573, 2576, 2581, 2583, 2588, 2589, 2590, 2594, 2596, 2599, 2605, 2611, 2614, 2617, 2618, 2627, 2634, 2636, 2637, 2639, 2644, 2653, 2654, 2655, 2661, 2662, 2665, 2671, 2675, 2684, 2685, 2687, 2689, 2691, 2700, 2707, 2719, 2723, 2725, 2726, 2729, 2736, 2740, 2746, 2747, 2749, 2752, 2756, 2765, 2770, 2775, 2780, 2783, 2787, 2788, 2794, 2800, 2801, 2802, 2805, 2812, 2814, 2819, 2821, 2822, 2826, 2827, 2828, 2829, 2832, 2833, 2837, 2840, 2843, 2844, 2850, 2857, 2858, 2861, 2865, 2866, 2871, 2873, 2876, 2878, 2883, 2888, 2889, 2890, 2894, 2901, 2902, 2903, 2905, 2909, 2910, 2911, 2923, 2935, 2938, 2944, 2948, 2952, 2953, 2955, 2957, 2959, 2962, 2963, 2966, 2968, 2976, 2980, 2998, 3002, 3003, 3005, 3006, 3007, 3012, 3014, 3015, 3020, 3026, 3029, 3038, 3039, 3040, 3042, 3043, 3045, 3048, 3049, 3055, 3064, 3067, 3072, 3080, 3081, 3083, 3084, 3085, 3087, 3096, 3097, 3105, 3106, 3109, 3112, 3118, 3119, 3120, 3121, 3123, 3126, 3127, 3128, 3137, 3138, 3139, 3143, 3145, 3147, 3148, 3150, 3153, 3154, 3167, 3170, 3173, 3181, 3187, 3191, 3192, 3194, 3202, 3204, 3205, 3206, 3210, 3212, 3214, 3218, 3220, 3224, 3225, 3226, 3227, 3228, 3237, 3245, 3246, 3247, 3250, 3252, 3253, 3255, 3256, 3261, 3266, 3268, 3271, 3278, 3280, 3282, 3283, 3286, 3288, 3290, 3294, 3295, 3297, 3299, 3301, 3305, 3312, 3327, 3331, 3332, 3333, 3337, 3345, 3349, 3353, 3355, 3357, 3358, 3359, 3360, 3363, 3365, 3374, 3377, 3379, 3380, 3383, 3386, 3387, 3397, 3399, 3402, 3404, 3409, 3414, 3415, 3416, 3418, 3420, 3422, 3426, 3427, 3428, 3429, 3442, 3445, 3446, 3447, 3449, 3450, 3451, 3455, 3458, 3460, 3464, 3471, 3473, 3474, 3482, 3483, 3486, 3488, 3491, 3503, 3504, 3506, 3509, 3510, 3516, 3517, 3518, 3521, 3529, 3533, 3536, 3537, 3541, 3544, 3545, 3551, 3552, 3554, 3558, 3560, 3561, 3562, 3563, 3569, 3572, 3574, 3576, 3588, 3590, 3592, 3594, 3595, 3596, 3597, 3598, 3603, 3606, 3607, 3611, 3612, 3616, 3618, 3620, 3622, 3623, 3629, 3633, 3635, 3637, 3640, 3642, 3643, 3644, 3645, 3646, 3647, 3650, 3655, 3657, 3659, 3662, 3663, 3667, 3671, 3674, 3675, 3678, 3682, 3684, 3685, 3697, 3706, 3713, 3715, 3717, 3719, 3725, 3726, 3742, 3749, 3752, 3760, 3761, 3764, 3766, 3772, 3773, 3774, 3777, 3778, 3781, 3788, 3790, 3791, 3792, 3794, 3796, 3800, 3804, 3808, 3809, 3813, 3818, 3820, 3825, 3828, 3830, 3831, 3832, 3834, 3836, 3837, 3842, 3843, 3844, 3845, 3847, 3849, 3858, 3860, 3862, 3866, 3867, 3870, 3872, 3876, 3882, 3885, 3887, 3889, 3890, 3891, 3892, 3895, 3896, 3902, 3908, 3910, 3911, 3912, 3914, 3917, 3924, 3926, 3928, 3929, 3938, 3947, 3950, 3951, 3954, 3958, 3962, 3967, 3972, 3974, 3975, 3983, 3984, 3987, 3988, 3990, 3994, 3996, 3997, 4001, 4002, 4003, 4006, 4008, 4013, 4014, 4021, 4024, 4026, 4032, 4039, 4040, 4045, 4046, 4048, 4049, 4054, 4056, 4057, 4058, 4066, 4068, 4069, 4072, 4074, 4079, 4081, 4092, 4099, 4102, 4103, 4105, 4108, 4109, 4110, 4111, 4113, 4116, 4122, 4132, 4133, 4137, 4140, 4143, 4146, 4148, 4149, 4150, 4156, 4158, 4160, 4161, 4162, 4163, 4164, 4165, 4166, 4167, 4168, 4169, 4171, 4175, 4178, 4184, 4187, 4188, 4197, 4198, 4201, 4202, 4205, 4206, 4211, 4212, 4214, 4217, 4219, 4221, 4232, 4233, 4235, 4241, 4244, 4250, 4257, 4260, 4261, 4265, 4266, 4270, 4275, 4281, 4289, 4296, 4298, 4301, 4305, 4309, 4312, 4324, 4329, 4330, 4331, 4333, 4335, 4336, 4337, 4341, 4343, 4344, 4349, 4352, 4354, 4356, 4359, 4360, 4365, 4369, 4374, 4378, 4383, 4388, 4394, 4397, 4401, 4402, 4403, 4404, 4405, 4415, 4419, 4422, 4423, 4426, 4428, 4439, 4442, 4443, 4448, 4450, 4453, 4456, 4458, 4460, 4461, 4462, 4463, 4464, 4468, 4472, 4474, 4479, 4483, 4485, 4490, 4491, 4492, 4494, 4499, 4502, 4506, 4507, 4508, 4512, 4514, 4515, 4519, 4522, 4524, 4531, 4535, 4542, 4548, 4549, 4554, 4555, 4557, 4558, 4562, 4565, 4566, 4567, 4568, 4570, 4575, 4578, 4579, 4582, 4583, 4586, 4588, 4590, 4591, 4594, 4595, 4597, 4598, 4604, 4605, 4606, 4625, 4626, 4633, 4634, 4635, 4643, 4644, 4645, 4659, 4666, 4667, 4668, 4669, 4670, 4677, 4680, 4682, 4685, 4687, 4694, 4697, 4699, 4702, 4704, 4706, 4712, 4716, 4719, 4721, 4725, 4729, 4730, 4737, 4738, 4740, 4741, 4750, 4753, 4754, 4755, 4756, 4758, 4762, 4765, 4775, 4789, 4790, 4791, 4795, 4803, 4804, 4813, 4817, 4818, 4819, 4822, 4824, 4828, 4830, 4831, 4833, 4834, 4836, 4837, 4838, 4853, 4857, 4861, 4862, 4869, 4872, 4875, 4876, 4878, 4880, 4887, 4888, 4891, 4895, 4900, 4901, 4902, 4904, 4905, 4909, 4914, 4917, 4918, 4924, 4925, 4926, 4930, 4935, 4936, 4938, 4939, 4943, 4944, 4946, 4950, 4956, 4966, 4971, 4972, 4979, 4980, 4985, 4988, 4989, 4990, 4992, 4996, 5005, 5007, 5026, 5029, 5034, 5039, 5040, 5042, 5044, 5046, 5049, 5052, 5054, 5057, 5059, 5063, 5067, 5068, 5072, 5074, 5085, 5087, 5088, 5091, 5097, 5098, 5100, 5102, 5106, 5109, 5114, 5119, 5129, 5130, 5132, 5140, 5143, 5145, 5147, 5149, 5151, 5153, 5154, 5164, 5165, 5168, 5170, 5171, 5174, 5180, 5182, 5185, 5186, 5189, 5190, 5195, 5196, 5198, 5199, 5208, 5211, 5217, 5219, 5228, 5230, 5236, 5237, 5238, 5241, 5248, 5249, 5251, 5253, 5255, 5258, 5263, 5265, 5266, 5267, 5268, 5271, 5275, 5280, 5281, 5283, 5285, 5289, 5291, 5292, 5293, 5298, 5299, 5300, 5301, 5303, 5308, 5311, 5313, 5317, 5329, 5330, 5332, 5334, 5344, 5347, 5348, 5350, 5359, 5361, 5372, 5388, 5389, 5393, 5394, 5396, 5397, 5403, 5414, 5417, 5430, 5431, 5438, 5439, 5450, 5451, 5452, 5456, 5457, 5458, 5461, 5463, 5464, 5466, 5467, 5474, 5476, 5482, 5483, 5487, 5493, 5496, 5498, 5508, 5510, 5512, 5513, 5515, 5516, 5517, 5520, 5521, 5530, 5531, 5537, 5539, 5547, 5557, 5561, 5565, 5568, 5569, 5581, 5583, 5585, 5588, 5589, 5604, 5612, 5613, 5615, 5616, 5620, 5627, 5633, 5635, 5640, 5642, 5643, 5648, 5656, 5657, 5659, 5660, 5675, 5676, 5677, 5680, 5688, 5689, 5690, 5694, 5695, 5697, 5698, 5699, 5703, 5706, 5709, 5717, 5718, 5721, 5722, 5728, 5731, 5734, 5735, 5739, 5744, 5748, 5751, 5756, 5763, 5768, 5770, 5771, 5775, 5779, 5786, 5787, 5789, 5791, 5794, 5807, 5813, 5817, 5820, 5826, 5828, 5831, 5833, 5835, 5836, 5837, 5839, 5844, 5853, 5854, 5855, 5864, 5865, 5866, 5867, 5868, 5869, 5870, 5872, 5875, 5876, 5878, 5880, 5881, 5883, 5884, 5885, 5887, 5891, 5892, 5893, 5906, 5907, 5912, 5918, 5919, 5925, 5926, 5932, 5934, 5936, 5938, 5944, 5951, 5954, 5956, 5961, 5967, 5968, 5971, 5975, 5978, 5982, 5988, 5991, 5993, 5996, 6000, 6002, 6006, 6009, 6013, 6016, 6023, 6024, 6025, 6026, 6033, 6038, 6041, 6042, 6044, 6045, 6047, 6048, 6051, 6053, 6058, 6059, 6060, 6061, 6062, 6063, 6072, 6073, 6080, 6081, 6085, 6087, 6088, 6092, 6093, 6097, 6099, 6107, 6108, 6109, 6110, 6113, 6118, 6123, 6129, 6130, 6131, 6132, 6133, 6135, 6137, 6138, 6139, 6142, 6145, 6146, 6151, 6153, 6162, 6163, 6164, 6165, 6168, 6181, 6184, 6186, 6189, 6193, 6196, 6197, 6198, 6203, 6204, 6205, 6209, 6212, 6214, 6215, 6220, 6223, 6224, 6227, 6234, 6246, 6247, 6250, 6251, 6262, 6264, 6267, 6275, 6281, 6286, 6288, 6289, 6292, 6293, 6296, 6300, 6303, 6310, 6311, 6315, 6317, 6319, 6322, 6328, 6333, 6338, 6340, 6342, 6343, 6344, 6349, 6354, 6356, 6358, 6360, 6363, 6365, 6367, 6370, 6372, 6376, 6394, 6400, 6403, 6404, 6405, 6408, 6412, 6414, 6415, 6416, 6419, 6420, 6425, 6426, 6429, 6430, 6433, 6436, 6440, 6442, 6449, 6456, 6457, 6458, 6464, 6466, 6467, 6468, 6469, 6470, 6474, 6475, 6476, 6477, 6478, 6480, 6482, 6484, 6485, 6486, 6488, 6493, 6494, 6501, 6502, 6504, 6506, 6510, 6517, 6519, 6523, 6528, 6530, 6533, 6534, 6535, 6537, 6539, 6541, 6544, 6545, 6549, 6552, 6553, 6554, 6558, 6559, 6560, 6561, 6562, 6567, 6568, 6571, 6572, 6574, 6576, 6577, 6579, 6581, 6588, 6589, 6592, 6594, 6595, 6597, 6599, 6600, 6603, 6607, 6609, 6610, 6611, 6614, 6615, 6616, 6623, 6633, 6634, 6635, 6638, 6639, 6646, 6647, 6655, 6656, 6658, 6661, 6666, 6672, 6681, 6693, 6703, 6705, 6706, 6710, 6718, 6720, 6729, 6730, 6733, 6734, 6737, 6740, 6741, 6747, 6749, 6756, 6757, 6758, 6764, 6767, 6781, 6782, 6783, 6786, 6788, 6789, 6793, 6794, 6795, 6799, 6804, 6805, 6807, 6811, 6812, 6813, 6817, 6820, 6824, 6830, 6834, 6836, 6840, 6841, 6848, 6851, 6855, 6868, 6869, 6874, 6876, 6878, 6879, 6881, 6882, 6883, 6884, 6885, 6886, 6887, 6888, 6902, 6903, 6905, 6907, 6909, 6913, 6914, 6917, 6919, 6921, 6930, 6931, 6939, 6946, 6954, 6955, 6959, 6967, 6970, 6971, 6979, 6981, 6984, 6985, 6987, 6988, 6990, 6991, 6997, 7013, 7022, 7027, 7033, 7035, 7038, 7039, 7040, 7045, 7048, 7049, 7051, 7053, 7054, 7057, 7059, 7060, 7062, 7064, 7072, 7073, 7075, 7077, 7079, 7085, 7095, 7096, 7097, 7105, 7106, 7107, 7108, 7110, 7113, 7130, 7136, 7138, 7139, 7142, 7143, 7144, 7151, 7154, 7164, 7169, 7172, 7182, 7184, 7191, 7192, 7193, 7194, 7197, 7201, 7202, 7206, 7209, 7210, 7212, 7217, 7219, 7220, 7226, 7227, 7235, 7236, 7246, 7248, 7249, 7250, 7255, 7257, 7258, 7262, 7263, 7264, 7267, 7268, 7279, 7282, 7287, 7291, 7292, 7293, 7296, 7298, 7299, 7300, 7301, 7303, 7306, 7307, 7308, 7311, 7312, 7313, 7318, 7320, 7323, 7324, 7328, 7339, 7340, 7344, 7345, 7348, 7357, 7358, 7360, 7361, 7363, 7365, 7371, 7376, 7382, 7383, 7386, 7398, 7400, 7410, 7418, 7425, 7430, 7434, 7436, 7437, 7447, 7452, 7453, 7454, 7457, 7458, 7459, 7464, 7470, 7472, 7476, 7481, 7484, 7485, 7487, 7490, 7493, 7499, 7503, 7504, 7506, 7508, 7512, 7515, 7523, 7524, 7533, 7538, 7546, 7547, 7553, 7556, 7557, 7559, 7561, 7564, 7572, 7574, 7576, 7579, 7585, 7586, 7587, 7589, 7596, 7598, 7604, 7609, 7619, 7622, 7624, 7625, 7633, 7642, 7643, 7649, 7655, 7658, 7662, 7664, 7665, 7672, 7673, 7674, 7678, 7679, 7680, 7685, 7687, 7689, 7695, 7703, 7704, 7707, 7712, 7716, 7718, 7724, 7734, 7736, 7737, 7738, 7741, 7742, 7744, 7745, 7749, 7753, 7756, 7763, 7764, 7767, 7768, 7770, 7774, 7775, 7776, 7777, 7778, 7779, 7780, 7781, 7785, 7786, 7787, 7788, 7791, 7798, 7799, 7800, 7801, 7803, 7804, 7805, 7806, 7807, 7818, 7819, 7820, 7825, 7840, 7841, 7845, 7850, 7858, 7860, 7865, 7873, 7877, 7878, 7880, 7885, 7888, 7890, 7896, 7908, 7909, 7910, 7911, 7913, 7918, 7922, 7923, 7925, 7933, 7937, 7938, 7942, 7944, 7949, 7952, 7972, 7973, 7974, 7976, 7977, 7981, 7983, 7984, 7986, 7992, 7996, 7998, 8007, 8012, 8020, 8021, 8023, 8025, 8029, 8030, 8031, 8036, 8040, 8042, 8043, 8044, 8047, 8048, 8050, 8056, 8059, 8066, 8068, 8074, 8075, 8076, 8078, 8080, 8081, 8084, 8089, 8095, 8099, 8103, 8108, 8112, 8113, 8120, 8121, 8126, 8129, 8130, 8134, 8136, 8145, 8148, 8164, 8178, 8181, 8191, 8193, 8194, 8201, 8202, 8204, 8208, 8213, 8217, 8219, 8223, 8226, 8234, 8241, 8242, 8246, 8247, 8248, 8250, 8252, 8253, 8265, 8266, 8268, 8269, 8273, 8274, 8276, 8282, 8289, 8300, 8304, 8308, 8311, 8312, 8315, 8318, 8319, 8322, 8324, 8329, 8334, 8335, 8339, 8340, 8341, 8346, 8350, 8351, 8352, 8353, 8355, 8358, 8367, 8368, 8373, 8380, 8382, 8385, 8387, 8389, 8390, 8395, 8398, 8401, 8404, 8407, 8410, 8413, 8414, 8415, 8416, 8417, 8418, 8436, 8438, 8439, 8442, 8443, 8444, 8445, 8446, 8447, 8449, 8450, 8451, 8458, 8459, 8465, 8470, 8472, 8474, 8476, 8481, 8482, 8485, 8486, 8490, 8498, 8501, 8502, 8503, 8504, 8505, 8507, 8509, 8511, 8513, 8520, 8521, 8524, 8525, 8531, 8532, 8535, 8543, 8549, 8550, 8553, 8554, 8561, 8565, 8574, 8576, 8579, 8581, 8582, 8585, 8592, 8593, 8596, 8597, 8603, 8605, 8610, 8612, 8621, 8622, 8631, 8634, 8635, 8638, 8644, 8646, 8648, 8650, 8652, 8654, 8658, 8660, 8663, 8665, 8669, 8672, 8675, 8676, 8677, 8685, 8686, 8693, 8695, 8700, 8706, 8713, 8716, 8717, 8722, 8726, 8729, 8732, 8736, 8738, 8739, 8743, 8746, 8747, 8748, 8753, 8761, 8769, 8773, 8774, 8777, 8779, 8782, 8783, 8784, 8786, 8789, 8802, 8803, 8810, 8811, 8818, 8822, 8824, 8829, 8833, 8834, 8835, 8839, 8841, 8842, 8843, 8845, 8846, 8853, 8863, 8865, 8866, 8869, 8875, 8876, 8877, 8878, 8881, 8886, 8892, 8897, 8905, 8908, 8911, 8919, 8922, 8924, 8929, 8930, 8935, 8937, 8938, 8941, 8945, 8946, 8948, 8949, 8951, 8953, 8959, 8960, 8967, 8968, 8969, 8972, 8974, 8979, 8981, 8985, 8986, 8991, 8993, 8996, 8998, 8999, 9009, 9011, 9012, 9013, 9015, 9018, 9026, 9027, 9029, 9030, 9045, 9050, 9052, 9058, 9059, 9060, 9063, 9065, 9066, 9068, 9069, 9071, 9072, 9073, 9074, 9076, 9080, 9087, 9088, 9091, 9092, 9095, 9103, 9104, 9107, 9111, 9112, 9114, 9115, 9118, 9120, 9123, 9129, 9139, 9140, 9141, 9142, 9144, 9147, 9154, 9167, 9168, 9175, 9177, 9180, 9183, 9185, 9186, 9188, 9189, 9191, 9195, 9205, 9206, 9213, 9214, 9215, 9216, 9217, 9223, 9225, 9226, 9229, 9231, 9233, 9237, 9240, 9243, 9248, 9249, 9253, 9257, 9259, 9267, 9270, 9273, 9275, 9282, 9284, 9285, 9287, 9288, 9290, 9292, 9293, 9296, 9311, 9314, 9321, 9323, 9325, 9326, 9327, 9328, 9336, 9338, 9339, 9340, 9341, 9346, 9347, 9350, 9357, 9360, 9366, 9368, 9371, 9373, 9375, 9376, 9380, 9381, 9382, 9391, 9393, 9394, 9398, 9400, 9402, 9403, 9406, 9407, 9412, 9415, 9419, 9423, 9429, 9438, 9440, 9443, 9452, 9453, 9455, 9456, 9460, 9464, 9467, 9468, 9472, 9473, 9475, 9481, 9482, 9484, 9490, 9497, 9500, 9503, 9504, 9509, 9517, 9518, 9519, 9522, 9525, 9534, 9535, 9536, 9543, 9545, 9546, 9553, 9555, 9560, 9568, 9571, 9577, 9579, 9587, 9591, 9593, 9596, 9597, 9598, 9601, 9602, 9606, 9609, 9614, 9618, 9620, 9621, 9623, 9627, 9629, 9630, 9632, 9633, 9648, 9655, 9658, 9659, 9663, 9666, 9668, 9671, 9674, 9676, 9686, 9695, 9698, 9699, 9706, 9707, 9710, 9711, 9715, 9718, 9723, 9726, 9727, 9729, 9731, 9737, 9742, 9743, 9744, 9745, 9746, 9750, 9753, 9758, 9763, 9768, 9770, 9777, 9781, 9782, 9786, 9791, 9793, 9794, 9798, 9799, 9804, 9807, 9808, 9809, 9810, 9811, 9812, 9813, 9819, 9820, 9821, 9825, 9827, 9829, 9835, 9845, 9847, 9850, 9866, 9867, 9869, 9873, 9878, 9882, 9886, 9887, 9889, 9891, 9892, 9896, 9897, 9909, 9923, 9928, 9930, 9931, 9934, 9935, 9936, 9938, 9940, 9946, 9949, 9950, 9952, 9953, 9956, 9960, 9962, 9963, 9967, 9968, 9969, 9972, 9973, 9975, 9976, 9980, 9982, 9984, 9985, 9987, 9988, 9990, 9991, 9992, 9994, 9995, 9997, 10012, 10017, 10019, 10020, 10026, 10027, 10037, 10041, 10042, 10047, 10049, 10051, 10055, 10058, 10059, 10060, 10062, 10064, 10066, 10075, 10077, 10078, 10083, 10091, 10092, 10094, 10095, 10101, 10102, 10103, 10106, 10110, 10115, 10116, 10117, 10120, 10122, 10125, 10127, 10128, 10131, 10136, 10140, 10151, 10158, 10160, 10163, 10165, 10166, 10168, 10169, 10174, 10176, 10178, 10181, 10192, 10193, 10194, 10195, 10196, 10199, 10201, 10206, 10207, 10212, 10218, 10219, 10220, 10221, 10222, 10223, 10224, 10225, 10231, 10233, 10236, 10259, 10263, 10266, 10267, 10269, 10270, 10275, 10277, 10278, 10284, 10286, 10291, 10293, 10295, 10300, 10306, 10307, 10312, 10314, 10315, 10318, 10323, 10324, 10326, 10330, 10331, 10334, 10335, 10340, 10346, 10353, 10356, 10362, 10371, 10375, 10376, 10380, 10388, 10392, 10393, 10397, 10398, 10399, 10401, 10402, 10408, 10414, 10416, 10417, 10425, 10426, 10435, 10438, 10440, 10446, 10449, 10450, 10451, 10452, 10455, 10463, 10464, 10465, 10468, 10469, 10471, 10474, 10479, 10480, 10482, 10487, 10494, 10496, 10500, 10506, 10513, 10517, 10518, 10522, 10523, 10524, 10527, 10528, 10532, 10537, 10541, 10542, 10543, 10548, 10555, 10556, 10562, 10567, 10580, 10581, 10582, 10583, 10584, 10587, 10588, 10596, 10599, 10601, 10602, 10611, 10615, 10617, 10621, 10622, 10628, 10638, 10639, 10640, 10646, 10651, 10652, 10665, 10671, 10676, 10678, 10679, 10682, 10683, 10684, 10685, 10686, 10687, 10693, 10698, 10701, 10707, 10710, 10716, 10721, 10729, 10734, 10740, 10741, 10744, 10748, 10749, 10753, 10754, 10756, 10761, 10762, 10763, 10770, 10772, 10776, 10781, 10785, 10787, 10788, 10795, 10800, 10801, 10802, 10803, 10804, 10809, 10810, 10813, 10822, 10823, 10824, 10825, 10827, 10837, 10838, 10839, 10840, 10843, 10850, 10853, 10857, 10858, 10864, 10866, 10867, 10870, 10877, 10886, 10892, 10899, 10901, 10902, 10911, 10918, 10920, 10927, 10929, 10933, 10934, 10938, 10940, 10941, 10942, 10944, 10947, 10953, 10955, 10966, 10972, 10974, 10976, 10977, 10978, 10979, 10985, 10993, 10996, 10997, 10999, 11002, 11004, 11008, 11015, 11021, 11022, 11024, 11032, 11036, 11037, 11039, 11044, 11046, 11047, 11050, 11051, 11053, 11058, 11060, 11066, 11078, 11082, 11083, 11086, 11095, 11100, 11103, 11107, 11110, 11114, 11116, 11117, 11118, 11122, 11124, 11128, 11129, 11136, 11137, 11138, 11141, 11145, 11147, 11148, 11149, 11152, 11153, 11154, 11160, 11161, 11163, 11165, 11168, 11172, 11177, 11178, 11181, 11187, 11188, 11190, 11193, 11194, 11198, 11202, 11204, 11214, 11217, 11222, 11224, 11226, 11227, 11228, 11230, 11233, 11236, 11237, 11239, 11241, 11242, 11243, 11246, 11247, 11251, 11254, 11255, 11256, 11258, 11260, 11263, 11266, 11274, 11284, 11289, 11292, 11293, 11295, 11296, 11297, 11299, 11304, 11306, 11313, 11315, 11318, 11323, 11325, 11330, 11331, 11337, 11340, 11346, 11348, 11349, 11352, 11362, 11363, 11364, 11365, 11371, 11373, 11377, 11379, 11380, 11382, 11392, 11395, 11401, 11405, 11406, 11417, 11427, 11428, 11431, 11435, 11438, 11443, 11445, 11446, 11449, 11459, 11462, 11465, 11477, 11481, 11487, 11488, 11489, 11490, 11496, 11498, 11500, 11501, 11505, 11506, 11507, 11508, 11520, 11524, 11526, 11527, 11531, 11532, 11533, 11544, 11547, 11548, 11551, 11553, 11558, 11567, 11568, 11570, 11576, 11577, 11578, 11586, 11587, 11588, 11593, 11594, 11595, 11596, 11597, 11604, 11610, 11611, 11612, 11615, 11617, 11618, 11619, 11623, 11628, 11634, 11638, 11641, 11642, 11647, 11655, 11656, 11657, 11658, 11663, 11669, 11682, 11688, 11691, 11692, 11694, 11696, 11703, 11705, 11707, 11712, 11720, 11730, 11731, 11736, 11740, 11743, 11753, 11756, 11763, 11764, 11765, 11766, 11767, 11768, 11770, 11771, 11776, 11777, 11778, 11782, 11783, 11784, 11786, 11788, 11789, 11792, 11797, 11799, 11800, 11805, 11806, 11809, 11811, 11812, 11814, 11818, 11823, 11825, 11826, 11828, 11829, 11830, 11835, 11837, 11839, 11841, 11846, 11848, 11849, 11856, 11858, 11861, 11864, 11865, 11868, 11872, 11876, 11877, 11879, 11889, 11891, 11894, 11898, 11901, 11902, 11906, 11909, 11911, 11913, 11915, 11916, 11917, 11919, 11920, 11921, 11922, 11923, 11926, 11928, 11929, 11930, 11933, 11934, 11943, 11947, 11953, 11955, 11956, 11957, 11959, 11960, 11961, 11962, 11965, 11973, 11974, 11975, 11977, 11978, 11979, 11983, 11988, 11991, 11993, 11997, 11999, 12002, 12004, 12005, 12008, 12014, 12016, 12020, 12021, 12023, 12024, 12026, 12027, 12032, 12033, 12038, 12042, 12043, 12044, 12047, 12052, 12059, 12060, 12076, 12077, 12080, 12081, 12083, 12087, 12092, 12093, 12098, 12102, 12104, 12106, 12108, 12109, 12110, 12112, 12113, 12115, 12122, 12126, 12128, 12129, 12137, 12138, 12139, 12142, 12143, 12147, 12149, 12151, 12163, 12165, 12166, 12167, 12170, 12171, 12173, 12174, 12175, 12181, 12183, 12185, 12186, 12191, 12194, 12197, 12200, 12201, 12204, 12207, 12208, 12215, 12217, 12218, 12219, 12220, 12223, 12228, 12233, 12234, 12237, 12240, 12243, 12245, 12250, 12252, 12259, 12263, 12267, 12269, 12274, 12278, 12280, 12281, 12283, 12284, 12286, 12287, 12297, 12298, 12299, 12306, 12310, 12313, 12314, 12317, 12321, 12323, 12341, 12342, 12347, 12356, 12358, 12359, 12364, 12369, 12370, 12372, 12374, 12379, 12380, 12383, 12397, 12400, 12401, 12403, 12406, 12411, 12414, 12416, 12419, 12420, 12421, 12425, 12426, 12427, 12440, 12441, 12445, 12447, 12448, 12450, 12451, 12454, 12457, 12461, 12465, 12467, 12468, 12473, 12476, 12478, 12479, 12481, 12487, 12488, 12490, 12491, 12497, 12499, 12503, 12504, 12508, 12521, 12523, 12530, 12536, 12546, 12547, 12554, 12559, 12561, 12562, 12563, 12564, 12565, 12567, 12572, 12574, 12578, 12588, 12600, 12608, 12609, 12611, 12616, 12619, 12622, 12623, 12628, 12633, 12634, 12635, 12636, 12638, 12641, 12649, 12651, 12658, 12663, 12668, 12670, 12672, 12675, 12676, 12679, 12686, 12688, 12691, 12693, 12695, 12701, 12702, 12703, 12708, 12713, 12718, 12719, 12729, 12731, 12732, 12733, 12737, 12739, 12740, 12742, 12749, 12751, 12752, 12754, 12760, 12761, 12762, 12764, 12766, 12769, 12771, 12772, 12773, 12778, 12783, 12788, 12790, 12797, 12802, 12810, 12812, 12813, 12814, 12817, 12820, 12822, 12824, 12826, 12827, 12828, 12838, 12839, 12843, 12844, 12849, 12850, 12858, 12860, 12861, 12869, 12873, 12883, 12884, 12887, 12888, 12893, 12898, 12900, 12904, 12905, 12906, 12913, 12917, 12918, 12920, 12921, 12926, 12927, 12929, 12933, 12938, 12939, 12941, 12944, 12945, 12946, 12947, 12950, 12954, 12960, 12961, 12963, 12966, 12968, 12969, 12972, 12973, 12974, 12975, 12976, 12978, 12982, 12983, 12984, 12987, 12990, 12991, 12992, 12998, 13006, 13010, 13011, 13014, 13015, 13017, 13022, 13024, 13030, 13032, 13033, 13035, 13038, 13040, 13041, 13042, 13050, 13053, 13054, 13055, 13056, 13057, 13061, 13065, 13066, 13074, 13075, 13079, 13085, 13095, 13102, 13114, 13115, 13116, 13117, 13118, 13119, 13124, 13151, 13153, 13156, 13159, 13160, 13165, 13169, 13175, 13177, 13182, 13191, 13197, 13199, 13205, 13207, 13209, 13210, 13213, 13217, 13222, 13227, 13232, 13234, 13235, 13236, 13237, 13238, 13239, 13243, 13248, 13249, 13251, 13255, 13258, 13260, 13261, 13264, 13267, 13268, 13269, 13275, 13276, 13279, 13281, 13301, 13303, 13304, 13313, 13315, 13317, 13322, 13323, 13326, 13328, 13330, 13335, 13338, 13343, 13345, 13348, 13354, 13359, 13361, 13367, 13368, 13369, 13375, 13380, 13381, 13384, 13393, 13396, 13397, 13401, 13408, 13413, 13415, 13416, 13418, 13419, 13420, 13424, 13429, 13433, 13439, 13441, 13444, 13448, 13454, 13456, 13464, 13466, 13467, 13468, 13469, 13473, 13474, 13475, 13494, 13498, 13499, 13500, 13503, 13504, 13506, 13513, 13514, 13515, 13516, 13519, 13520, 13521, 13524, 13530, 13532, 13539, 13543, 13544, 13546, 13547, 13549, 13552, 13567, 13568, 13569, 13574, 13580, 13583, 13584, 13587, 13589, 13595, 13597, 13598, 13599, 13601, 13604, 13612, 13614, 13621, 13623, 13626, 13628, 13631, 13632, 13634, 13635, 13636, 13637, 13638, 13641, 13647, 13650, 13651, 13652, 13654, 13661, 13662, 13663, 13668, 13671, 13677, 13678, 13683, 13684, 13686, 13689, 13697, 13700, 13702, 13704, 13715, 13716, 13719, 13720, 13721, 13725, 13728, 13730, 13737, 13739, 13742, 13745, 13750, 13755, 13756, 13761, 13764, 13766, 13767, 13768, 13769, 13773, 13781, 13783, 13786, 13787, 13789, 13790, 13791, 13794, 13796, 13798, 13809, 13816, 13819, 13820, 13822, 13823, 13827, 13828, 13830, 13831, 13833, 13834, 13835, 13839, 13843, 13849, 13853, 13859, 13860, 13862, 13866, 13869, 13870, 13872, 13873, 13877, 13882, 13891, 13892, 13894, 13895, 13896, 13901, 13906, 13909, 13910, 13911, 13917, 13919, 13924, 13927, 13933, 13938, 13949, 13952, 13954, 13956, 13960, 13963, 13965, 13969, 13970, 13975, 13976, 13991, 14001, 14008, 14010, 14014, 14017, 14018, 14021, 14022, 14027, 14028, 14030, 14031, 14036, 14041, 14043, 14049, 14050, 14051, 14054, 14059, 14062, 14063, 14066, 14071, 14075, 14081, 14088, 14092, 14094, 14106, 14107, 14110, 14112, 14117, 14118, 14119, 14120, 14122, 14129, 14132, 14133, 14137, 14138, 14139, 14142, 14146, 14148, 14149, 14150.

Promoters expressing in kernel tissue at 14 days after pollination include SEQ IDs: 1, 3, 7, 13, 14, 15, 29, 31, 32, 34, 36, 45, 48, 54, 64, 65, 86, 88, 96, 97, 102, 103, 107, 110, 111, 112, 121, 130, 131, 132, 139, 143, 144, 146, 147, 148, 152, 154, 162, 164, 165, 176, 177, 183, 187, 191, 194, 195, 196, 197, 202, 204, 205, 207, 210, 211, 212, 223, 232, 234, 235, 236, 237, 240, 241, 242, 243, 244, 246, 249, 250, 251, 257, 262, 264, 271, 273, 274, 280, 286, 288, 305, 306, 309, 316, 319, 320, 322, 323, 328, 329, 332, 335, 339, 340, 341, 346, 348, 349, 352, 353, 354, 356, 360, 364, 367, 371, 373, 374, 378, 379, 387, 388, 396, 401, 404, 406, 407, 412, 415, 419, 420, 423, 424, 428, 429, 433, 434, 448, 452, 456, 459, 461, 466, 474, 478, 479, 481, 483, 484, 485, 488, 496, 498, 502, 504, 509, 510, 512, 513, 514, 516, 517, 520, 522, 523, 525, 529, 532, 536, 537, 538, 542, 543, 544, 546, 547, 553, 557, 560, 564, 565, 573, 580, 585, 591, 594, 595, 596, 598, 599, 604, 607, 613, 614, 623, 630, 631, 633, 635, 638, 641, 643, 650, 653, 662, 663, 666, 667, 668, 670, 674, 676, 677, 681, 686, 693, 694, 701, 705, 707, 708, 717, 719, 722, 724, 727, 731, 734, 736, 739, 740, 742, 749, 750, 753, 759, 765, 768, 771, 773, 782, 783, 784, 793, 795, 797, 800, 801, 804, 808, 813, 820, 821, 829, 830, 833, 840, 841, 842, 844, 855, 857, 858, 859, 860, 862, 865, 871, 872, 884, 885, 887, 890, 891, 892, 895, 897, 898, 903, 907, 911, 912, 913, 916, 917, 919, 924, 928, 929, 931, 936, 938, 940, 943, 944, 949, 951, 953, 955, 957, 958, 962, 964, 966, 971, 974, 979, 980, 982, 987, 994, 995, 997, 999, 1003, 1006, 1007, 1008, 1009, 1011, 1014, 1017, 1032, 1035, 1038, 1041, 1042, 1043, 1045, 1047, 1049, 1050, 1051, 1052, 1054, 1055, 1056, 1057, 1064, 1065, 1069, 1072, 1077, 1078, 1086, 1087, 1088, 1089, 1092, 1095, 1096, 1101, 1103, 1104, 1108, 1110, 1111, 1112, 1114, 1115, 1117, 1118, 1119, 1120, 1122, 1125, 1127, 1130, 1132, 1133, 1136, 1137, 1144, 1146, 1147, 1148, 1154, 1160, 1162, 1165, 1166, 1170, 1171, 1176, 1178, 1182, 1183, 1187, 1190, 1191, 1196, 1198, 1199, 1200, 1201, 1204, 1205, 1214, 1215, 1218, 1223, 1225, 1227, 1228, 1230, 1231, 1233, 1236, 1239, 1240, 1241, 1248, 1250, 1252, 1253, 1254, 1256, 1258, 1261, 1264, 1265, 1272, 1275, 1277, 1281, 1282, 1283, 1285, 1286, 1291, 1292, 1293, 1309, 1312, 1316, 1317, 1320, 1321, 1325, 1327, 1330, 1331, 1334, 1339, 1340, 1349, 1351, 1352, 1360, 1364, 1367, 1368, 1371, 1372, 1373, 1376, 1377, 1380, 1382, 1383, 1388, 1393, 1396, 1398, 1402, 1403, 1404, 1405, 1407, 1412, 1415, 1420, 1421, 1426, 1431, 1432, 1436, 1438, 1441, 1442, 1447, 1451, 1453, 1454, 1455, 1459, 1462, 1466, 1471, 1474, 1475, 1481, 1486, 1490, 1493, 1498, 1499, 1513, 1514, 1518, 1525, 1526, 1527, 1539, 1543, 1545, 1546, 1549, 1550, 1556, 1563, 1567, 1571, 1575, 1578, 1584, 1586, 1590, 1594, 1599, 1600, 1602, 1604, 1605, 1608, 1612, 1614, 1615, 1616, 1622, 1625, 1628, 1629, 1634, 1635, 1637, 1638, 1639, 1648, 1650, 1658, 1659, 1662, 1668, 1669, 1671, 1673, 1675, 1676, 1678, 1680, 1683, 1684, 1685, 1688, 1689, 1691, 1705, 1706, 1707, 1708, 1710, 1712, 1717, 1723, 1729, 1731, 1732, 1733, 1735, 1740, 1755, 1758, 1759, 1761, 1771, 1776, 1778, 1785, 1789, 1791, 1793, 1815, 1816, 1820, 1826, 1828, 1830, 1832, 1834, 1835, 1839, 1840, 1845, 1851, 1852, 1858, 1859, 1861, 1865, 1867, 1869, 1870, 1872, 1882, 1883, 1886, 1888, 1893, 1894, 1895, 1897, 1898, 1899, 1900, 1901, 1902, 1903, 1904, 1905, 1906, 1911, 1914, 1917, 1918, 1920, 1922, 1923, 1924, 1930, 1931, 1936, 1940, 1944, 1950, 1952, 1953, 1954, 1957, 1958, 1964, 1973, 1981, 1990, 1991, 1993, 1994, 1995, 1996, 1999, 2000, 2007, 2008, 2009, 2010, 2012, 2013, 2017, 2019, 2026, 2027, 2032, 2039, 2041, 2043, 2048, 2054, 2060, 2062, 2064, 2066, 2071, 2072, 2074, 2077, 2082, 2083, 2087, 2088, 2089, 2094, 2095, 2096, 2097, 2103, 2104, 2116, 2117, 2119, 2126, 2132, 2133, 2134, 2139, 2140, 2141, 2142, 2143, 2144, 2147, 2150, 2152, 2156, 2157, 2159, 2161, 2164, 2167, 2168, 2170, 2177, 2178, 2179, 2185, 2189, 2193, 2196, 2202, 2203, 2206, 2207, 2214, 2215, 2216, 2221, 2226, 2229, 2230, 2231, 2232, 2240, 2242, 2243, 2247, 2253, 2257, 2260, 2262, 2263, 2265, 2273, 2274, 2276, 2280, 2282, 2283, 2288, 2291, 2296, 2297, 2298, 2303, 2304, 2308, 2309, 2310, 2314, 2322, 2323, 2328, 2329, 2331, 2333, 2339, 2342, 2348, 2351, 2352, 2353, 2359, 2363, 2371, 2379, 2381, 2382, 2384, 2398, 2399, 2400, 2401, 2403, 2405, 2406, 2408, 2410, 2411, 2412, 2413, 2418, 2419, 2420, 2422, 2423, 2435, 2437, 2438, 2441, 2442, 2443, 2445, 2451, 2452, 2453, 2454, 2457, 2458, 2465, 2470, 2471, 2472, 2474, 2476, 2481, 2482, 2490, 2492, 2494, 2495, 2496, 2498, 2500, 2504, 2505, 2507, 2509, 2510, 2511, 2514, 2515, 2517, 2519, 2525, 2528, 2531, 2532, 2533, 2536, 2537, 2538, 2539, 2541, 2547, 2548, 2549, 2551, 2552, 2554, 2555, 2556, 2557, 2560, 2567, 2568, 2572, 2573, 2578, 2581, 2583, 2589, 2590, 2594, 2596, 2599, 2605, 2609, 2617, 2627, 2632, 2634, 2637, 2639, 2644, 2652, 2655, 2663, 2671, 2674, 2675, 2684, 2685, 2687, 2689, 2691, 2692, 2694, 2696, 2702, 2715, 2718, 2719, 2722, 2725, 2726, 2728, 2729, 2740, 2742, 2746, 2747, 2749, 2752, 2756, 2757, 2763, 2764, 2765, 2770, 2775, 2780, 2782, 2784, 2785, 2787, 2788, 2798, 2800, 2801, 2802, 2805, 2808, 2812, 2820, 2821, 2822, 2823, 2824, 2826, 2827, 2829, 2832, 2840, 2844, 2850, 2856, 2857, 2858, 2861, 2864, 2865, 2871, 2873, 2876, 2888, 2890, 2894, 2898, 2902, 2903, 2906, 2909, 2910, 2911, 2915, 2916, 2917, 2923, 2926, 2930, 2935, 2944, 2946, 2948, 2953, 2955, 2959, 2962, 2963, 2966, 2968, 2976, 2979, 2980, 2981, 2992, 2994, 2998, 3002, 3003, 3006, 3007, 3009, 3014, 3015, 3016, 3029, 3038, 3039, 3041, 3044, 3045, 3048, 3049, 3051, 3052, 3053, 3055, 3061, 3064, 3067, 3070, 3072, 3080, 3081, 3083, 3084, 3085, 3087, 3088, 3096, 3097, 3100, 3102, 3105, 3106, 3109, 3114, 3118, 3119, 3120, 3121, 3123, 3126, 3127, 3128, 3137, 3138, 3139, 3140, 3143, 3145, 3147, 3148, 3153, 3154, 3167, 3170, 3177, 3181, 3185, 3192, 3194, 3204, 3205, 3206, 3210, 3212, 3219, 3220, 3224, 3225, 3226, 3228, 3237, 3240, 3247, 3250, 3252, 3254, 3255, 3261, 3263, 3266, 3271, 3272, 3278, 3280, 3286, 3288, 3290, 3291, 3294, 3295, 3299, 3301, 3310, 3312, 3313, 3325, 3331, 3332, 3333, 3337, 3340, 3343, 3345, 3347, 3349, 3351, 3353, 3355, 3357, 3358, 3359, 3360, 3363, 3365, 3370, 3374, 3376, 3377, 3380, 3382, 3383, 3386, 3397, 3399, 3405, 3414, 3415, 3416, 3418, 3419, 3422, 3424, 3426, 3428, 3435, 3438, 3445, 3446, 3447, 3452, 3455, 3458, 3460, 3461, 3464, 3465, 3466, 3468, 3470, 3471, 3474, 3475, 3477, 3482, 3486, 3487, 3488, 3496, 3497, 3498, 3503, 3504, 3506, 3510, 3516, 3517, 3518, 3531, 3533, 3536, 3541, 3544, 3545, 3548, 3549, 3552, 3554, 3558, 3560, 3562, 3563, 3569, 3574, 3582, 3587, 3588, 3589, 3592, 3593, 3594, 3595, 3597, 3600, 3603, 3604, 3606, 3607, 3611, 3612, 3613, 3616, 3618, 3620, 3621, 3623, 3624, 3629, 3633, 3637, 3640, 3642, 3643, 3644, 3645, 3646, 3647, 3648, 3652, 3655, 3657, 3659, 3667, 3668, 3672, 3674, 3676, 3677, 3682, 3684, 3685, 3693, 3707, 3712, 3713, 3715, 3717, 3718, 3719, 3720, 3732, 3738, 3739, 3749, 3751, 3752, 3754, 3757, 3761, 3764, 3765, 3766, 3777, 3778, 3781, 3784, 3788, 3790, 3791, 3792, 3794, 3798, 3804, 3806, 3808, 3810, 3812, 3818, 3820, 3823, 3825, 3828, 3829, 3830, 3831, 3832, 3833, 3834, 3837, 3842, 3843, 3844, 3845, 3849, 3858, 3859, 3860, 3862, 3867, 3868, 3871, 3872, 3873, 3874, 3876, 3881, 3882, 3883, 3887, 3889, 3890, 3891, 3894, 3895, 3908, 3910, 3911, 3912, 3914, 3917, 3924, 3929, 3933, 3938, 3941, 3947, 3950, 3954, 3958, 3961, 3962, 3967, 3975, 3983, 3984, 3987, 3988, 3994, 3995, 3996, 3997, 4001, 4002, 4003, 4006, 4008, 4013, 4024, 4030, 4032, 4033, 4034, 4037, 4039, 4040, 4041, 4042, 4045, 4046, 4047, 4048, 4050, 4051, 4052, 4054, 4056, 4057, 4058, 4062, 4066, 4067, 4068, 4069, 4072, 4075, 4077, 4078, 4079, 4092, 4096, 4099, 4102, 4105, 4109, 4111, 4113, 4115, 4116, 4122, 4128, 4133, 4139, 4143, 4146, 4148, 4149, 4150, 4154, 4155, 4156, 4160, 4161, 4162, 4163, 4164, 4165, 4166, 4167, 4168, 4171, 4178, 4184, 4187, 4188, 4189, 4201, 4202, 4205, 4206, 4207, 4208, 4210, 4211, 4212, 4214, 4217, 4218, 4219, 4221, 4227, 4228, 4233, 4235, 4246, 4250, 4251, 4255, 4257, 4266, 4269, 4270, 4272, 4279, 4280, 4281, 4283, 4288, 4292, 4294, 4296, 4298, 4301, 4302, 4305, 4309, 4317, 4320, 4321, 4324, 4329, 4330, 4331, 4332, 4335, 4337, 4341, 4344, 4347, 4349, 4355, 4356, 4357, 4360, 4369, 4378, 4380, 4383, 4390, 4391, 4393, 4394, 4397, 4401, 4402, 4403, 4404, 4405, 4410, 4415, 4422, 4423, 4426, 4427, 4439, 4442, 4443, 4444, 4446, 4448, 4450, 4453, 4456, 4458, 4461, 4462, 4463, 4464, 4466, 4468, 4472, 4474, 4475, 4479, 4485, 4491, 4492, 4494, 4500, 4502, 4506, 4507, 4512, 4515, 4519, 4522, 4531, 4535, 4545, 4548, 4549, 4551, 4552, 4554, 4555, 4556, 4557, 4558, 4560, 4562, 4565, 4566, 4568, 4575, 4580, 4583, 4585, 4586, 4590, 4591, 4604, 4606, 4618, 4621, 4625, 4630, 4633, 4635, 4643, 4644, 4650, 4653, 4654, 4655, 4659, 4664, 4666, 4667, 4669, 4670, 4671, 4676, 4677, 4680, 4685, 4687, 4692, 4693, 4694, 4697, 4699, 4700, 4702, 4704, 4706, 4708, 4710, 4714, 4716, 4719, 4721, 4729, 4730, 4737, 4738, 4739, 4740, 4741, 4750, 4751, 4753, 4754, 4755, 4756, 4759, 4761, 4762, 4765, 4766, 4771, 4775, 4779, 4789, 4790, 4791, 4794, 4795, 4804, 4813, 4814, 4818, 4822, 4824, 4828, 4830, 4831, 4833, 4834, 4835, 4836, 4838, 4842, 4856, 4857, 4858, 4859, 4861, 4862, 4864, 4869, 4872, 4875, 4878, 4880, 4887, 4891, 4895, 4901, 4902, 4905, 4909, 4914, 4917, 4920, 4921, 4922, 4923, 4924, 4926, 4930, 4935, 4936, 4939, 4944, 4950, 4956, 4958, 4959, 4960, 4971, 4972, 4973, 4975, 4980, 4987, 4988, 4994, 4996, 5000, 5015, 5026, 5029, 5030, 5034, 5039, 5040, 5042, 5044, 5046, 5052, 5054, 5057, 5059, 5063, 5067, 5068, 5072, 5082, 5085, 5087, 5088, 5089, 5091, 5094, 5095, 5100, 5102, 5119, 5123, 5129, 5131, 5132, 5136, 5137, 5140, 5145, 5152, 5153, 5157, 5163, 5164, 5165, 5168, 5169, 5170, 5174, 5180, 5181, 5182, 5184, 5185, 5189, 5190, 5191, 5192, 5195, 5196, 5198, 5199, 5200, 5202, 5206, 5208, 5219, 5225, 5226, 5228, 5229, 5230, 5234, 5240, 5241, 5243, 5249, 5253, 5255, 5258, 5260, 5261, 5263, 5267, 5268, 5273, 5275, 5276, 5280, 5281, 5282, 5283, 5290, 5291, 5292, 5293, 5298, 5299, 5300, 5301, 5303, 5308, 5311, 5317, 5319, 5321, 5324, 5329, 5330, 5334, 5338, 5344, 5346, 5347, 5348, 5350, 5351, 5359, 5361, 5372, 5386, 5388, 5389, 5394, 5395, 5397, 5398, 5400, 5407, 5413, 5414, 5417, 5428, 5431, 5438, 5448, 5449, 5456, 5457, 5458, 5459, 5463, 5464, 5466, 5467, 5472, 5474, 5476, 5482, 5483, 5491, 5493, 5495, 5496, 5498, 5506, 5508, 5510, 5513, 5515, 5516, 5517, 5518, 5519, 5524, 5530, 5535, 5537, 5539, 5543, 5557, 5563, 5566, 5568, 5569, 5571, 5579, 5581, 5585, 5588, 5589, 5591, 5592, 5597, 5604, 5608, 5612, 5613, 5615, 5616, 5620, 5623, 5627, 5632, 5633, 5635, 5638, 5640, 5642, 5643, 5648, 5651, 5652, 5659, 5660, 5662, 5663, 5675, 5676, 5677, 5689, 5694, 5695, 5697, 5698, 5702, 5703, 5706, 5709, 5711, 5717, 5718, 5721, 5722, 5728, 5730, 5731, 5734, 5735, 5739, 5744, 5748, 5751, 5763, 5768, 5770, 5771, 5775, 5778, 5780, 5783, 5784, 5785, 5786, 5791, 5794, 5803, 5806, 5807, 5808, 5811, 5813, 5817, 5820, 5826, 5828, 5832, 5833, 5834, 5835, 5836, 5837, 5839, 5844, 5846, 5853, 5854, 5859, 5864, 5865, 5866, 5867, 5869, 5870, 5872, 5876, 5878, 5879, 5881, 5883, 5887, 5888, 5892, 5893, 5906, 5907, 5912, 5918, 5922, 5923, 5925, 5926, 5927, 5928, 5931, 5932, 5934, 5936, 5938, 5941, 5944, 5948, 5954, 5956, 5959, 5962, 5963, 5968, 5971, 5978, 5982, 5988, 5991, 5992, 5996, 5997, 6000, 6002, 6003, 6004, 6006, 6009, 6013, 6014, 6017, 6024, 6025, 6026, 6034, 6038, 6041, 6044, 6048, 6051, 6058, 6059, 6062, 6063, 6065, 6068, 6069, 6070, 6072, 6073, 6074, 6075, 6080, 6081, 6085, 6086, 6087, 6093, 6097, 6098, 6099, 6107, 6108, 6109, 6110, 6113, 6118, 6124, 6129, 6131, 6132, 6133, 6135, 6136, 6138, 6139, 6143, 6145, 6146, 6147, 6151, 6153, 6160, 6162, 6163, 6164, 6165, 6176, 6181, 6183, 6186, 6188, 6189, 6191, 6193, 6196, 6197, 6198, 6203, 6204, 6205, 6215, 6220, 6223, 6224, 6228, 6234, 6243, 6246, 6250, 6251, 6255, 6262, 6264, 6265, 6267, 6270, 6272, 6273, 6275, 6281, 6282, 6286, 6292, 6293, 6296, 6299, 6300, 6303, 6311, 6315, 6317, 6319, 6321, 6322, 6328, 6333, 6338, 6342, 6343, 6344, 6354, 6356, 6360, 6362, 6363, 6367, 6370, 6372, 6381, 6383, 6386, 6394, 6397, 6398, 6399, 6403, 6404, 6405, 6408, 6410, 6412, 6414, 6415, 6419, 6420, 6422, 6425, 6426, 6427, 6428, 6429, 6430, 6431, 6436, 6440, 6449, 6456, 6463, 6466, 6467, 6469, 6470, 6472, 6474, 6475, 6476, 6477, 6478, 6480, 6482, 6484, 6485, 6488, 6494, 6495, 6501, 6502, 6504, 6505, 6510, 6513, 6516, 6517, 6519, 6526, 6530, 6531, 6532, 6534, 6537, 6539, 6541, 6543, 6545, 6547, 6548, 6549, 6554, 6555, 6558, 6567, 6571, 6572, 6574, 6576, 6577, 6579, 6581, 6584, 6588, 6592, 6594, 6595, 6597, 6600, 6603, 6614, 6620, 6623, 6626, 6633, 6634, 6635, 6638, 6639, 6649, 6655, 6656, 6658, 6661, 6662, 6666, 6671, 6681, 6682, 6701, 6703, 6705, 6706, 6716, 6718, 6720, 6729, 6730, 6734, 6736, 6737, 6739, 6747, 6748, 6749, 6756, 6757, 6758, 6759, 6764, 6767, 6778, 6779, 6783, 6786, 6793, 6794, 6795, 6799, 6803, 6804, 6805, 6807, 6810, 6811, 6812, 6813, 6815, 6816, 6817, 6820, 6824, 6826, 6828, 6830, 6834, 6836, 6840, 6841, 6843, 6848, 6851, 6869, 6875, 6880, 6881, 6884, 6886, 6887, 6888, 6894, 6897, 6902, 6903, 6904, 6907, 6913, 6914, 6917, 6919, 6920, 6921, 6922, 6925, 6930, 6939, 6946, 6950, 6952, 6959, 6960, 6963, 6970, 6971, 6973, 6979, 6981, 6984, 6985, 6987, 6988, 6990, 6991, 6994, 6999, 7007, 7008, 7010, 7013, 7022, 7025, 7029, 7038, 7039, 7041, 7043, 7045, 7046, 7049, 7051, 7052, 7053, 7057, 7064, 7077, 7083, 7084, 7085, 7096, 7103, 7105, 7106, 7107, 7108, 7110, 7112, 7113, 7117, 7118, 7128, 7130, 7138, 7139, 7141, 7142, 7143, 7144, 7151, 7152, 7154, 7155, 7163, 7164, 7165, 7166, 7169, 7172, 7176, 7182, 7184, 7187, 7192, 7194, 7197, 7201, 7206, 7207, 7208, 7209, 7212, 7217, 7219, 7220, 7227, 7235, 7236, 7244, 7245, 7246, 7248, 7249, 7250, 7255, 7257, 7258, 7262, 7263, 7264, 7267, 7268, 7274, 7276, 7281, 7282, 7287, 7291, 7292, 7293, 7296, 7298, 7299, 7300, 7301, 7303, 7304, 7306, 7307, 7308, 7311, 7312, 7313, 7318, 7328, 7330, 7340, 7344, 7345, 7356, 7357, 7358, 7361, 7365, 7371, 7373, 7376, 7377, 7382, 7383, 7385, 7386, 7398, 7399, 7400, 7409, 7410, 7411, 7415, 7418, 7425, 7427, 7430, 7436, 7438, 7441, 7443, 7444, 7447, 7452, 7453, 7454, 7457, 7458, 7459, 7470, 7472, 7475, 7481, 7483, 7486, 7487, 7490, 7492, 7493, 7499, 7504, 7506, 7512, 7515, 7517, 7523, 7524, 7525, 7533, 7538, 7546, 7547, 7556, 7557, 7559, 7560, 7561, 7562, 7572, 7574, 7576, 7579, 7583, 7585, 7586, 7589, 7595, 7596, 7598, 7604, 7605, 7609, 7619, 7620, 7622, 7624, 7625, 7626, 7633, 7642, 7643, 7649, 7656, 7658, 7661, 7664, 7665, 7673, 7674, 7682, 7687, 7689, 7695, 7700, 7703, 7712, 7716, 7718, 7724, 7727, 7736, 7737, 7738, 7741, 7742, 7744, 7745, 7749, 7753, 7763, 7764, 7768, 7770, 7774, 7775, 7780, 7781, 7785, 7786, 7788, 7791, 7792, 7793, 7798, 7799, 7800, 7801, 7803, 7804, 7806, 7807, 7812, 7818, 7819, 7820, 7825, 7833, 7834, 7841, 7844, 7845, 7850, 7854, 7856, 7860, 7862, 7865, 7873, 7877, 7878, 7880, 7881, 7885, 7888, 7890, 7896, 7908, 7911, 7913, 7918, 7923, 7925, 7928, 7933, 7938, 7942, 7944, 7946, 7949, 7952, 7960, 7965, 7966, 7967, 7973, 7974, 7976, 7977, 7981, 7984, 7986, 7996, 7998, 7999, 8007, 8009, 8023, 8026, 8031, 8036, 8042, 8044, 8047, 8048, 8053, 8056, 8059, 8061, 8063, 8068, 8076, 8077, 8078, 8079, 8081, 8084, 8088, 8091, 8093, 8095, 8100, 8102, 8106, 8110, 8112, 8113, 8118, 8121, 8126, 8134, 8148, 8150, 8151, 8163, 8166, 8177, 8178, 8179, 8181, 8184, 8187, 8188, 8189, 8191, 8193, 8194, 8204, 8208, 8210, 8213, 8217, 8219, 8223, 8234, 8235, 8236, 8237, 8239, 8242, 8246, 8248, 8250, 8252, 8263, 8265, 8266, 8268, 8269, 8273, 8274, 8289, 8292, 8300, 8304, 8308, 8311, 8312, 8315, 8318, 8319, 8320, 8329, 8340, 8341, 8347, 8350, 8351, 8353, 8355, 8358, 8366, 8367, 8368, 8371, 8373, 8380, 8385, 8386, 8387, 8389, 8390, 8392, 8395, 8401, 8402, 8403, 8404, 8410, 8413, 8414, 8415, 8416, 8417, 8418, 8430, 8435, 8436, 8438, 8439, 8442, 8443, 8444, 8445, 8446, 8447, 8448, 8449, 8450, 8451, 8458, 8459, 8470, 8473, 8474, 8476, 8477, 8481, 8482, 8486, 8490, 8496, 8498, 8500, 8501, 8503, 8505, 8507, 8509, 8511, 8513, 8514, 8520, 8524, 8526, 8527, 8528, 8531, 8532, 8533, 8535, 8539, 8541, 8542, 8543, 8546, 8553, 8554, 8561, 8562, 8565, 8568, 8574, 8575, 8576, 8579, 8581, 8582, 8585, 8592, 8593, 8596, 8597, 8600, 8603, 8604, 8605, 8609, 8611, 8612, 8620, 8631, 8634, 8635, 8638, 8642, 8644, 8646, 8648, 8650, 8654, 8658, 8659, 8660, 8663, 8665, 8669, 8672, 8676, 8677, 8685, 8686, 8693, 8700, 8703, 8706, 8708, 8709, 8713, 8717, 8720, 8722, 8726, 8728, 8729, 8731, 8736, 8743, 8744, 8746, 8747, 8748, 8753, 8761, 8769, 8770, 8773, 8774, 8777, 8779, 8783, 8784, 8786, 8789, 8792, 8794, 8803, 8810, 8811, 8818, 8821, 8822, 8824, 8828, 8829, 8830, 8831, 8834, 8835, 8843, 8844, 8846, 8853, 8865, 8866, 8874, 8876, 8877, 8878, 8881, 8883, 8886, 8888, 8892, 8896, 8899, 8900, 8901, 8908, 8911, 8913, 8916, 8917, 8919, 8922, 8924, 8926, 8929, 8930, 8935, 8937, 8938, 8941, 8945, 8946, 8949, 8951, 8953, 8960, 8967, 8968, 8979, 8981, 8985, 8986, 8991, 8992, 8996, 8998, 9001, 9006, 9009, 9011, 9012, 9018, 9020, 9023, 9026, 9027, 9029, 9030, 9033, 9045, 9052, 9056, 9058, 9059, 9060, 9063, 9065, 9068, 9069, 9071, 9072, 9076, 9078, 9080, 9087, 9091, 9092, 9095, 9098, 9104, 9107, 9114, 9115, 9118, 9123, 9125, 9129, 9139, 9140, 9141, 9142, 9144, 9152, 9155, 9167, 9168, 9175, 9177, 9180, 9183, 9185, 9188, 9190, 9191, 9194, 9195, 9199, 9205, 9206, 9207, 9213, 9215, 9216, 9217, 9223, 9226, 9229, 9231, 9233, 9237, 9243, 9248, 9249, 9253, 9257, 9259, 9265, 9267, 9270, 9273, 9282, 9284, 9285, 9287, 9288, 9290, 9292, 9296, 9300, 9304, 9308, 9311, 9314, 9320, 9321, 9323, 9326, 9328, 9334, 9336, 9337, 9339, 9340, 9341, 9346, 9347, 9350, 9352, 9359, 9366, 9371, 9373, 9375, 9376, 9382, 9388, 9391, 9392, 9394, 9400, 9402, 9403, 9406, 9407, 9412, 9413, 9414, 9415, 9421, 9423, 9426, 9434, 9439, 9440, 9443, 9449, 9451, 9452, 9455, 9456, 9460, 9467, 9471, 9472, 9473, 9474, 9481, 9482, 9486, 9488, 9490, 9497, 9500, 9504, 9509, 9514, 9517, 9518, 9519, 9534, 9536, 9537, 9540, 9545, 9546, 9550, 9551, 9553, 9554, 9555, 9560, 9563, 9564, 9571, 9577, 9587, 9590, 9591, 9595, 9596, 9598, 9601, 9602, 9606, 9609, 9614, 9615, 9617, 9618, 9620, 9621, 9623, 9624, 9626, 9632, 9633, 9648, 9655, 9663, 9668, 9670, 9676, 9677, 9682, 9686, 9694, 9698, 9706, 9710, 9711, 9718, 9721, 9723, 9726, 9729, 9731, 9734, 9737, 9742, 9746, 9750, 9753, 9756, 9758, 9763, 9767, 9770, 9776, 9782, 9786, 9791, 9792, 9794, 9799, 9810, 9811, 9812, 9813, 9819, 9820, 9822, 9825, 9828, 9829, 9830, 9833, 9835, 9845, 9847, 9869, 9873, 9878, 9882, 9886, 9887, 9889, 9892, 9897, 9907, 9909, 9910, 9923, 9924, 9928, 9930, 9932, 9935, 9938, 9940, 9946, 9949, 9950, 9952, 9953, 9960, 9962, 9963, 9967, 9968, 9972, 9973, 9975, 9980, 9982, 9984, 9985, 9987, 9988, 9990, 9991, 9992, 9997, 10000, 10008, 10009, 10010, 10013, 10017, 10019, 10020, 10026, 10027, 10032, 10033, 10037, 10041, 10049, 10051, 10054, 10055, 10059, 10060, 10062, 10064, 10073, 10075, 10077, 10078, 10083, 10091, 10092, 10094, 10095, 10101, 10102, 10103, 10106, 10109, 10110, 10115, 10116, 10117, 10119, 10122, 10128, 10129, 10131, 10136, 10151, 10158, 10160, 10163, 10165, 10166, 10168, 10174, 10176, 10178, 10181, 10191, 10192, 10193, 10194, 10196, 10199, 10206, 10209, 10212, 10218, 10219, 10220, 10221, 10222, 10223, 10225, 10233, 10234, 10236, 10237, 10239, 10247, 10249, 10252, 10253, 10255, 10259, 10262, 10263, 10269, 10270, 10275, 10276, 10278, 10284, 10286, 10291, 10292, 10293, 10295, 10300, 10302, 10306, 10307, 10312, 10314, 10323, 10324, 10325, 10326, 10330, 10331, 10333, 10334, 10335, 10336, 10340, 10341, 10346, 10353, 10357, 10362, 10364, 10371, 10373, 10375, 10376, 10378, 10380, 10381, 10383, 10388, 10393, 10397, 10398, 10399, 10400, 10401, 10405, 10408, 10410, 10411, 10413, 10414, 10416, 10417, 10421, 10423, 10425, 10435, 10438, 10440, 10446, 10449, 10450, 10452, 10453, 10456, 10460, 10463, 10464, 10465, 10468, 10469, 10471, 10474, 10480, 10482, 10487, 10490, 10492, 10494, 10496, 10499, 10506, 10508, 10514, 10518, 10522, 10523, 10524, 10527, 10528, 10530, 10531, 10532, 10536, 10541, 10542, 10543, 10547, 10548, 10555, 10556, 10558, 10560, 10563, 10567, 10569, 10580, 10581, 10582, 10583, 10584, 10587, 10588, 10593, 10595, 10596, 10597, 10599, 10601, 10602, 10611, 10615, 10616, 10617, 10621, 10622, 10626, 10628, 10637, 10638, 10639, 10640, 10642, 10646, 10655, 10657, 10665, 10668, 10676, 10678, 10679, 10682, 10683, 10684, 10685, 10700, 10701, 10705, 10707, 10715, 10716, 10721, 10723, 10726, 10729, 10734, 10737, 10738, 10740, 10741, 10744, 10748, 10749, 10752, 10753, 10754, 10756, 10761, 10762, 10766, 10768, 10770, 10772, 10775, 10776, 10778, 10779, 10781, 10784, 10785, 10787, 10788, 10792, 10795, 10800, 10801, 10802, 10803, 10804, 10805, 10809, 10810, 10815, 10818, 10819, 10820, 10822, 10824, 10827, 10831, 10833, 10836, 10838, 10839, 10840, 10841, 10843, 10844, 10845, 10850, 10851, 10852, 10853, 10854, 10858, 10860, 10864, 10866, 10867, 10874, 10877, 10880, 10886, 10897, 10898, 10901, 10902, 10911, 10917, 10918, 10920, 10926, 10927, 10928, 10929, 10930, 10933, 10934, 10938, 10940, 10941, 10942, 10947, 10949, 10960, 10962, 10965, 10966, 10967, 10972, 10976, 10977, 10979, 10988, 10993, 10996, 10997, 10998, 10999, 11008, 11009, 11015, 11016, 11021, 11022, 11024, 11030, 11032, 11036, 11037, 11039, 11044, 11046, 11047, 11052, 11053, 11056, 11058, 11060, 11063, 11066, 11078, 11082, 11083, 11086, 11090, 11095, 11100, 11101, 11107, 11114, 11118, 11119, 11122, 11126, 11135, 11136, 11137, 11145, 11147, 11149, 11154, 11155, 11156, 11157, 11160, 11163, 11165, 11166, 11168, 11169, 11177, 11178, 11181, 11184, 11187, 11188, 11190, 11192, 11193, 11194, 11198, 11203, 11204, 11208, 11213, 11214, 11217, 11218, 11222, 11224, 11226, 11227, 11228, 11233, 11235, 11236, 11238, 11239, 11242, 11243, 11246, 11247, 11248, 11251, 11253, 11254, 11255, 11256, 11258, 11260, 11262, 11263, 11286, 11290, 11292, 11293, 11294, 11295, 11297, 11299, 11304, 11305, 11306, 11313, 11315, 11316, 11318, 11324, 11330, 11331, 11332, 11337, 11340, 11345, 11346, 11348, 11356, 11362, 11363, 11364, 11365, 11371, 11373, 11377, 11380, 11382, 11387, 11394, 11395, 11401, 11405, 11406, 11424, 11430, 11431, 11435, 11438, 11443, 11445, 11446, 11449, 11451, 11456, 11462, 11465, 11466, 11472, 11475, 11477, 11478, 11487, 11488, 11490, 11496, 11498, 11500, 11505, 11506, 11507, 11508, 11518, 11520, 11521, 11523, 11524, 11526, 11527, 11533, 11534, 11540, 11541, 11544, 11546, 11548, 11550, 11551, 11553, 11558, 11560, 11561, 11567, 11568, 11570, 11571, 11576, 11577, 11578, 11588, 11593, 11594, 11595, 11596, 11597, 11604, 11607, 11615, 11617, 11618, 11623, 11628, 11639, 11647, 11650, 11656, 11658, 11659, 11663, 11669, 11678, 11682, 11688, 11691, 11692, 11694, 11695, 11696, 11701, 11703, 11705, 11707, 11712, 11721, 11725, 11726, 11730, 11731, 11733, 11736, 11743, 11753, 11756, 11760, 11762, 11763, 11765, 11770, 11771, 11776, 11777, 11782, 11785, 11786, 11788, 11790, 11792, 11799, 11800, 11805, 11809, 11811, 11812, 11814, 11818, 11820, 11821, 11823, 11830, 11841, 11846, 11848, 11849, 11851, 11854, 11856, 11858, 11861, 11863, 11864, 11865, 11868, 11872, 11876, 11877, 11878, 11881, 11886, 11891, 11892, 11894, 11895, 11898, 11901, 11902, 11906, 11908, 11909, 11911, 11913, 11914, 11915, 11916, 11917, 11919, 11920, 11921, 11923, 11926, 11928, 11929, 11930, 11934, 11935, 11940, 11943, 11946, 11947, 11948, 11949, 11953, 11956, 11958, 11959, 11960, 11961, 11962, 11965, 11974, 11975, 11976, 11977, 11978, 11979, 11983, 11988, 11989, 11993, 11997, 11998, 11999, 12004, 12008, 12014, 12016, 12019, 12020, 12021, 12023, 12024, 12026, 12027, 12032, 12033, 12042, 12043, 12044, 12047, 12052, 12059, 12076, 12080, 12081, 12083, 12087, 12091, 12092, 12093, 12098, 12104, 12106, 12109, 12110, 12112, 12113, 12115, 12122, 12126, 12128, 12129, 12134, 12137, 12138, 12139, 12140, 12143, 12147, 12149, 12151, 12161, 12166, 12167, 12170, 12171, 12173, 12174, 12176, 12181, 12183, 12191, 12197, 12200, 12201, 12204, 12207, 12208, 12217, 12219, 12220, 12226, 12227, 12234, 12240, 12241, 12243, 12245, 12250, 12252, 12253, 12255, 12256, 12259, 12263, 12267, 12269, 12274, 12278, 12280, 12283, 12284, 12286, 12293, 12295, 12297, 12298, 12310, 12311, 12312, 12313, 12314, 12315, 12317, 12321, 12323, 12329, 12331, 12334, 12345, 12347, 12354, 12356, 12358, 12359, 12369, 12370, 12372, 12375, 12379, 12380, 12381, 12385, 12391, 12397, 12400, 12401, 12403, 12404, 12405, 12406, 12410, 12411, 12414, 12416, 12419, 12420, 12421, 12426, 12427, 12437, 12440, 12441, 12445, 12450, 12451, 12455, 12456, 12457, 12459, 12462, 12467, 12468, 12473, 12478, 12479, 12481, 12487, 12488, 12491, 12494, 12495, 12497, 12504, 12508, 12510, 12511, 12512, 12514, 12521, 12530, 12531, 12536, 12539, 12545, 12546, 12547, 12549, 12554, 12555, 12556, 12561, 12563, 12564, 12565, 12567, 12568, 12570, 12572, 12583, 12585, 12588, 12591, 12605, 12608, 12609, 12610, 12611, 12616, 12619, 12623, 12634, 12638, 12639, 12641, 12649, 12651, 12655, 12663, 12668, 12670, 12671, 12672, 12674, 12676, 12679, 12680, 12681, 12684, 12688, 12691, 12695, 12699, 12701, 12702, 12707, 12711, 12714, 12718, 12719, 12729, 12731, 12732, 12733, 12737, 12739, 12740, 12741, 12742, 12751, 12754, 12755, 12757, 12758, 12760, 12762, 12764, 12766, 12769, 12771, 12783, 12785, 12790, 12794, 12797, 12802, 12803, 12810, 12812, 12813, 12814, 12817, 12818, 12819, 12820, 12822, 12824, 12826, 12827, 12828, 12834, 12835, 12838, 12839, 12843, 12844, 12849, 12853, 12858, 12860, 12861, 12866, 12873, 12882, 12883, 12887, 12898, 12900, 12902, 12904, 12905, 12906, 12910, 12917, 12918, 12920, 12921, 12926, 12928, 12929, 12932, 12933, 12934, 12939, 12940, 12945, 12946, 12947, 12966, 12968, 12969, 12973, 12974, 12975, 12976, 12978, 12984, 12987, 12989, 12990, 12991, 12992, 13007, 13008, 13011, 13014, 13015, 13017, 13018, 13022, 13024, 13030, 13032, 13033, 13034, 13035, 13038, 13040, 13041, 13042, 13050, 13053, 13054, 13055, 13056, 13061, 13062, 13064, 13066, 13071, 13074, 13075, 13079, 13085, 13086, 13087, 13095, 13098, 13100, 13101, 13102, 13105, 13112, 13114, 13115, 13117, 13118, 13120, 13123, 13124, 13128, 13131, 13135, 13148, 13149, 13151, 13160, 13169, 13174, 13175, 13177, 13182, 13191, 13197, 13199, 13209, 13210, 13212, 13213, 13215, 13217, 13221, 13222, 13224, 13227, 13230, 13232, 13234, 13235, 13236, 13237, 13238, 13243, 13249, 13251, 13255, 13259, 13260, 13261, 13263, 13264, 13268, 13269, 13276, 13279, 13296, 13298, 13303, 13304, 13313, 13315, 13317, 13320, 13321, 13322, 13323, 13326, 13328, 13330, 13332, 13337, 13343, 13345, 13346, 13348, 13354, 13359, 13361, 13367, 13368, 13369, 13377, 13380, 13381, 13384, 13385, 13388, 13393, 13397, 13401, 13402, 13408, 13410, 13414, 13416, 13417, 13419, 13423, 13424, 13433, 13439, 13444, 13448, 13451, 13454, 13456, 13460, 13463, 13464, 13466, 13468, 13469, 13473, 13475, 13490, 13492, 13497, 13498, 13499, 13503, 13504, 13506, 13513, 13514, 13515, 13516, 13517, 13519, 13520, 13521, 13530, 13532, 13539, 13540, 13543, 13544, 13546, 13547, 13549, 13552, 13553, 13555, 13568, 13569, 13574, 13584, 13587, 13597, 13599, 13601, 13602, 13604, 13612, 13621, 13623, 13628, 13631, 13632, 13634, 13635, 13636, 13637, 13638, 13641, 13643, 13647, 13650, 13652, 13654, 13661, 13662, 13663, 13668, 13669, 13671, 13675, 13677, 13678, 13681, 13684, 13687, 13688, 13693, 13695, 13698, 13700, 13702, 13703, 13706, 13710, 13712, 13713, 13715, 13716, 13720, 13725, 13727, 13729, 13733, 13739, 13745, 13750, 13753, 13756, 13764, 13766, 13767, 13772, 13773, 13775, 13776, 13779, 13781, 13782, 13783, 13789, 13790, 13791, 13794, 13796, 13809, 13810, 13816, 13817, 13818, 13819, 13820, 13822, 13823, 13828, 13830, 13831, 13833, 13834, 13835, 13843, 13849, 13852, 13853, 13858, 13859, 13866, 13869, 13870, 13872, 13873, 13877, 13881, 13882, 13888, 13891, 13892, 13896, 13898, 13901, 13904, 13906, 13909, 13910, 13911, 13913, 13917, 13919, 13920, 13930, 13933, 13947, 13952, 13954, 13956, 13961, 13963, 13965, 13969, 13970, 13975, 13976, 13984, 13990, 14000, 14008, 14009, 14014, 14017, 14018, 14022, 14026, 14027, 14030, 14031, 14036, 14041, 14043, 14049, 14050, 14051, 14062, 14066, 14067, 14069, 14070, 14071, 14073, 14075, 14076, 14086, 14087, 14088, 14092, 14094, 14099, 14105, 14106, 14110, 14112, 14115, 14116, 14118, 14122, 14128, 14129, 14132, 14133, 14134, 14135, 14138, 14139, 14141, 14142, 14145, 14146, 14148, 14149, 14150.

Promoters expressing in kernel tissue at 30 days after pollination include SEQ IDs: 1, 3, 7, 13, 14, 15, 27, 29, 31, 32, 34, 36, 38, 45, 48, 54, 56, 64, 65, 68, 69, 70, 71, 81, 82, 86, 88, 96, 97, 99, 102, 103, 107, 110, 111, 112, 117, 121, 130, 131, 132, 139, 143, 146, 148, 152, 154, 156, 157, 159, 160, 162, 164, 165, 174, 175, 176, 177, 179, 181, 183, 187, 191, 194, 195, 196, 197, 202, 203, 204, 205, 207, 210, 211, 223, 231, 232, 235, 236, 237, 240, 243, 244, 246, 249, 250, 251, 257, 262, 264, 271, 273, 274, 280, 281, 286, 288, 289, 291, 294, 301, 302, 303, 305, 306, 309, 316, 319, 320, 323, 328, 329, 332, 334, 335, 341, 346, 348, 349, 352, 353, 354, 356, 358, 359, 360, 364, 365, 367, 368, 371, 373, 374, 378, 379, 388, 401, 404, 406, 407, 412, 414, 415, 416, 419, 420, 423, 424, 428, 429, 433, 434, 436, 452, 454, 456, 459, 461, 466, 474, 478, 479, 481, 482, 483, 484, 485, 488, 498, 501, 502, 504, 509, 510, 512, 513, 514, 515, 516, 517, 520, 522, 523, 525, 529, 532, 533, 536, 537, 538, 541, 542, 543, 544, 546, 547, 553, 557, 560, 564, 565, 569, 573, 580, 585, 591, 594, 595, 596, 599, 604, 607, 611, 613, 614, 620, 623, 631, 633, 635, 638, 641, 643, 644, 650, 653, 662, 663, 665, 666, 670, 674, 676, 677, 681, 686, 693, 694, 701, 705, 707, 708, 716, 717, 719, 722, 723, 724, 726, 727, 733, 734, 736, 739, 740, 742, 749, 753, 757, 759, 763, 765, 768, 770, 771, 773, 783, 784, 793, 795, 797, 800, 801, 806, 808, 812, 813, 819, 820, 821, 824, 825, 826, 829, 830, 833, 839, 840, 841, 842, 844, 845, 855, 857, 858, 859, 860, 862, 865, 868, 871, 872, 877, 884, 885, 887, 890, 891, 892, 895, 897, 898, 903, 907, 911, 912, 913, 916, 917, 919, 920, 924, 928, 929, 931, 932, 936, 938, 940, 943, 944, 949, 951, 953, 954, 958, 959, 961, 962, 964, 966, 974, 979, 980, 982, 987, 991, 994, 995, 996, 997, 999, 1006, 1008, 1009, 1011, 1014, 1017, 1026, 1032, 1035, 1038, 1039, 1041, 1042, 1043, 1045, 1047, 1049, 1050, 1051, 1052, 1055, 1056, 1057, 1064, 1065, 1069, 1072, 1077, 1078, 1086, 1087, 1089, 1092, 1095, 1101, 1103, 1104, 1108, 1110, 1111, 1112, 1114, 1115, 1117, 1118, 1119, 1120, 1122, 1127, 1130, 1132, 1133, 1136, 1137, 1143, 1144, 1146, 1148, 1154, 1160, 1162, 1165, 1166, 1170, 1171, 1174, 1176, 1178, 1182, 1187, 1190, 1191, 1196, 1198, 1199, 1200, 1204, 1205, 1208, 1213, 1214, 1215, 1217, 1218, 1220, 1223, 1225, 1227, 1228, 1230, 1231, 1233, 1236, 1239, 1240, 1241, 1244, 1248, 1250, 1252, 1253, 1254, 1256, 1257, 1258, 1261, 1264, 1265, 1272, 1281, 1282, 1283, 1285, 1286, 1291, 1293, 1306, 1309, 1312, 1316, 1317, 1320, 1321, 1325, 1327, 1330, 1331, 1339, 1340, 1347, 1349, 1351, 1352, 1354, 1355, 1360, 1364, 1367, 1368, 1371, 1373, 1376, 1377, 1380, 1381, 1382, 1387, 1388, 1394, 1396, 1398, 1402, 1403, 1404, 1405, 1407, 1409, 1410, 1412, 1415, 1421, 1423, 1426, 1431, 1440, 1441, 1442, 1451, 1453, 1454, 1455, 1458, 1459, 1462, 1466, 1471, 1474, 1475, 1481, 1486, 1488, 1490, 1493, 1498, 1499, 1513, 1514, 1517, 1518, 1525, 1526, 1530, 1533, 1539, 1543, 1545, 1548, 1549, 1550, 1556, 1559, 1563, 1567, 1570, 1571, 1575, 1576, 1578, 1584, 1586, 1589, 1590, 1593, 1594, 1595, 1599, 1600, 1602, 1604, 1605, 1608, 1609, 1612, 1614, 1615, 1616, 1622, 1625, 1628, 1629, 1634, 1635, 1637, 1638, 1642, 1648, 1650, 1658, 1659, 1662, 1668, 1669, 1671, 1673, 1675, 1676, 1677, 1680, 1683, 1685, 1688, 1689, 1691, 1705, 1706, 1707, 1708, 1710, 1712, 1717, 1721, 1723, 1729, 1731, 1732, 1735, 1740, 1755, 1759, 1761, 1762, 1768, 1771, 1776, 1778, 1779, 1785, 1791, 1793, 1815, 1816, 1820, 1828, 1830, 1832, 1834, 1835, 1839, 1840, 1845, 1850, 1851, 1852, 1858, 1859, 1861, 1865, 1867, 1869, 1870, 1872, 1873, 1883, 1886, 1888, 1893, 1895, 1897, 1898, 1899, 1900, 1901, 1902, 1903, 1904, 1905, 1906, 1911, 1913, 1916, 1918, 1920, 1923, 1924, 1930, 1931, 1936, 1940, 1944, 1945, 1950, 1952, 1953, 1964, 1973, 1981, 1990, 1991, 1993, 1994, 1995, 1996, 1999, 2000, 2003, 2007, 2008, 2009, 2010, 2012, 2013, 2015, 2017, 2026, 2031, 2032, 2033, 2039, 2041, 2043, 2048, 2054, 2060, 2062, 2064, 2066, 2071, 2072, 2074, 2077, 2082, 2083, 2088, 2089, 2094, 2096, 2097, 2099, 2103, 2104, 2107, 2119, 2122, 2126, 2133, 2134, 2139, 2140, 2142, 2143, 2144, 2147, 2150, 2152, 2156, 2157, 2158, 2159, 2161, 2162, 2164, 2165, 2167, 2168, 2170, 2172, 2177, 2178, 2179, 2185, 2189, 2193, 2196, 2201, 2202, 2203, 2207, 2214, 2215, 2216, 2221, 2226, 2227, 2229, 2230, 2231, 2232, 2235, 2240, 2242, 2243, 2247, 2253, 2257, 2260, 2261, 2262, 2263, 2265, 2273, 2274, 2276, 2280, 2282, 2283, 2288, 2291, 2293, 2296, 2297, 2298, 2303, 2304, 2305, 2306, 2308, 2309, 2314, 2322, 2323, 2328, 2329, 2331, 2333, 2335, 2339, 2342, 2348, 2351, 2352, 2353, 2358, 2359, 2361, 2362, 2363, 2367, 2371, 2379, 2381, 2382, 2384, 2385, 2397, 2398, 2401, 2403, 2405, 2406, 2408, 2410, 2411, 2412, 2413, 2418, 2419, 2420, 2423, 2430, 2431, 2435, 2437, 2438, 2439, 2441, 2442, 2443, 2445, 2451, 2452, 2453, 2454, 2457, 2458, 2465, 2470, 2471, 2472, 2474, 2476, 2481, 2482, 2483, 2490, 2494, 2495, 2496, 2498, 2500, 2504, 2505, 2509, 2510, 2511, 2514, 2515, 2517, 2519, 2525, 2527, 2528, 2531, 2532, 2533, 2536, 2537, 2538, 2539, 2541, 2543, 2547, 2548, 2549, 2552, 2554, 2555, 2556, 2557, 2567, 2568, 2572, 2573, 2576, 2577, 2578, 2581, 2583, 2589, 2590, 2594, 2596, 2599, 2605, 2609, 2611, 2616, 2617, 2618, 2627, 2632, 2634, 2636, 2637, 2639, 2644, 2652, 2655, 2663, 2665, 2671, 2674, 2675, 2684, 2685, 2687, 2689, 2691, 2696, 2700, 2707, 2718, 2719, 2722, 2725, 2726, 2728, 2729, 2740, 2742, 2746, 2747, 2749, 2752, 2756, 2757, 2763, 2765, 2770, 2775, 2780, 2783, 2784, 2787, 2788, 2800, 2801, 2802, 2805, 2808, 2812, 2819, 2820, 2821, 2822, 2824, 2826, 2827, 2828, 2829, 2832, 2840, 2844, 2850, 2857, 2858, 2861, 2864, 2865, 2866, 2871, 2873, 2876, 2888, 2889, 2890, 2894, 2901, 2902, 2903, 2909, 2910, 2911, 2915, 2916, 2917, 2923, 2926, 2930, 2932, 2933, 2934, 2935, 2938, 2944, 2946, 2948, 2953, 2955, 2959, 2962, 2963, 2966, 2968, 2976, 2979, 2980, 2992, 2993, 2994, 2998, 3002, 3003, 3005, 3006, 3007, 3014, 3015, 3020, 3024, 3026, 3038, 3039, 3040, 3041, 3042, 3044, 3045, 3048, 3049, 3051, 3052, 3053, 3055, 3064, 3070, 3072, 3080, 3081, 3083, 3084, 3085, 3087, 3088, 3096, 3097, 3100, 3102, 3105, 3106, 3109, 3114, 3118, 3119, 3120, 3121, 3123, 3126, 3127, 3128, 3137, 3138, 3139, 3140, 3143, 3145, 3147, 3148, 3153, 3167, 3170, 3173, 3181, 3185, 3189, 3192, 3194, 3204, 3205, 3206, 3210, 3212, 3214, 3219, 3220, 3224, 3225, 3226, 3228, 3240, 3246, 3247, 3250, 3252, 3253, 3254, 3255, 3261, 3263, 3266, 3268, 3271, 3272, 3278, 3280, 3283, 3286, 3288, 3290, 3291, 3294, 3295, 3299, 3310, 3312, 3313, 3325, 3327, 3331, 3332, 3333, 3340, 3343, 3345, 3347, 3349, 3353, 3355, 3357, 3358, 3359, 3360, 3363, 3365, 3370, 3374, 3377, 3380, 3383, 3386, 3397, 3399, 3402, 3405, 3415, 3416, 3418, 3419, 3422, 3424, 3426, 3427, 3428, 3438, 3441, 3442, 3445, 3446, 3447, 3449, 3451, 3455, 3458, 3460, 3461, 3464, 3468, 3470, 3471, 3473, 3474, 3475, 3477, 3482, 3483, 3486, 3487, 3488, 3491, 3494, 3496, 3497, 3498, 3503, 3504, 3506, 3510, 3516, 3517, 3518, 3533, 3536, 3537, 3541, 3544, 3545, 3548, 3549, 3552, 3554, 3558, 3560, 3562, 3563, 3569, 3572, 3574, 3576, 3587, 3588, 3589, 3592, 3593, 3594, 3595, 3597, 3598, 3600, 3603, 3604, 3606, 3607, 3611, 3612, 3613, 3616, 3618, 3620, 3621, 3623, 3624, 3629, 3633, 3635, 3637, 3640, 3642, 3643, 3644, 3645, 3646, 3647, 3648, 3652, 3655, 3657, 3659, 3662, 3663, 3667, 3668, 3669, 3671, 3672, 3674, 3676, 3682, 3684, 3685, 3707, 3713, 3715, 3717, 3718, 3719, 3720, 3724, 3731, 3738, 3739, 3748, 3749, 3752, 3754, 3757, 3761, 3764, 3765, 3766, 3772, 3773, 3777, 3778, 3781, 3783, 3788, 3790, 3791, 3792, 3794, 3796, 3798, 3800, 3804, 3806, 3808, 3810, 3812, 3813, 3818, 3820, 3823, 3825, 3828, 3830, 3831, 3832, 3833, 3836, 3837, 3842, 3843, 3844, 3845, 3847, 3849, 3858, 3859, 3860, 3862, 3867, 3871, 3872, 3873, 3874, 3876, 3881, 3883, 3885, 3887, 3889, 3890, 3891, 3892, 3895, 3908, 3910, 3911, 3912, 3914, 3917, 3923, 3924, 3926, 3929, 3933, 3938, 3941, 3947, 3950, 3951, 3954, 3958, 3961, 3962, 3967, 3975, 3983, 3987, 3988, 3994, 3995, 3996, 3997, 4006, 4008, 4013, 4014, 4024, 4026, 4030, 4032, 4034, 4039, 4040, 4041, 4042, 4046, 4048, 4049, 4050, 4051, 4052, 4054, 4056, 4057, 4058, 4062, 4066, 4067, 4068, 4069, 4072, 4074, 4075, 4077, 4078, 4079, 4080, 4081, 4092, 4096, 4099, 4102, 4103, 4105, 4108, 4109, 4110, 4111, 4113, 4115, 4116, 4122, 4128, 4132, 4133, 4139, 4143, 4146, 4148, 4149, 4150, 4154, 4156, 4160, 4161, 4162, 4163, 4164, 4165, 4166, 4169, 4171, 4178, 4184, 4185, 4187, 4188, 4189, 4197, 4198, 4201, 4202, 4205, 4206, 4207, 4208, 4210, 4211, 4212, 4214, 4217, 4218, 4219, 4221, 4227, 4228, 4233, 4235, 4244, 4246, 4250, 4251, 4255, 4257, 4260, 4265, 4266, 4269, 4270, 4272, 4275, 4280, 4281, 4283, 4289, 4292, 4296, 4298, 4301, 4302, 4304, 4305, 4309, 4312, 4320, 4321, 4324, 4329, 4330, 4331, 4332, 4335, 4336, 4337, 4341, 4344, 4347, 4349, 4352, 4354, 4355, 4357, 4358, 4360, 4365, 4369, 4378, 4380, 4383, 4390, 4391, 4394, 4397, 4401, 4402, 4403, 4404, 4405, 4406, 4410, 4415, 4419, 4422, 4423, 4439, 4442, 4443, 4444, 4446, 4448, 4450, 4453, 4456, 4458, 4460, 4461, 4462, 4463, 4464, 4466, 4468, 4472, 4474, 4475, 4479, 4483, 4485, 4490, 4491, 4492, 4494, 4500, 4502, 4506, 4507, 4512, 4513, 4514, 4515, 4519, 4522, 4524, 4531, 4535, 4548, 4549, 4552, 4554, 4555, 4556, 4557, 4558, 4560, 4562, 4565, 4566, 4568, 4570, 4575, 4580, 4582, 4583, 4586, 4590, 4591, 4596, 4604, 4606, 4618, 4621, 4625, 4630, 4632, 4633, 4635, 4641, 4643, 4644, 4645, 4650, 4659, 4666, 4667, 4669, 4670, 4671, 4674, 4677, 4680, 4682, 4685, 4687, 4692, 4693, 4694, 4697, 4699, 4700, 4702, 4704, 4706, 4708, 4710, 4714, 4716, 4719, 4721, 4725, 4729, 4730, 4737, 4738, 4740, 4741, 4749, 4750, 4751, 4753, 4754, 4755, 4756, 4759, 4761, 4762, 4765, 4771, 4775, 4779, 4789, 4790, 4791, 4794, 4795, 4803, 4804, 4813, 4814, 4818, 4822, 4824, 4828, 4829, 4830, 4831, 4833, 4834, 4836, 4838, 4842, 4856, 4857, 4858, 4859, 4861, 4862, 4864, 4869, 4872, 4875, 4878, 4880, 4881, 4887, 4888, 4891, 4895, 4901, 4902, 4905, 4909, 4913, 4914, 4917, 4920, 4921, 4922, 4923, 4924, 4925, 4926, 4930, 4935, 4936, 4939, 4944, 4946, 4950, 4955, 4956, 4960, 4971, 4972, 4973, 4975, 4979, 4980, 4985, 4987, 4988, 4989, 4990, 4994, 4996, 5026, 5029, 5030, 5034, 5039, 5040, 5042, 5044, 5046, 5051, 5052, 5054, 5057, 5059, 5063, 5067, 5068, 5082, 5086, 5087, 5088, 5089, 5091, 5094, 5095, 5100, 5102, 5106, 5111, 5114, 5119, 5123, 5129, 5130, 5132, 5140, 5143, 5145, 5147, 5149, 5152, 5153, 5160, 5164, 5165, 5168, 5169, 5170, 5171, 5174, 5180, 5181, 5182, 5184, 5185, 5188, 5189, 5190, 5191, 5192, 5195, 5196, 5198, 5199, 5200, 5202, 5206, 5208, 5212, 5217, 5219, 5225, 5226, 5228, 5229, 5234, 5239, 5240, 5241, 5248, 5249, 5251, 5253, 5255, 5258, 5261, 5263, 5265, 5266, 5267, 5268, 5273, 5275, 5276, 5280, 5281, 5282, 5283, 5285, 5289, 5292, 5293, 5298, 5299, 5300, 5301, 5303, 5308, 5311, 5313, 5317, 5321, 5324, 5329, 5330, 5334, 5338, 5344, 5346, 5347, 5348, 5350, 5351, 5359, 5361, 5372, 5383, 5386, 5388, 5389, 5394, 5395, 5396, 5397, 5398, 5400, 5403, 5411, 5413, 5414, 5417, 5428, 5431, 5438, 5439, 5448, 5449, 5450, 5451, 5452, 5456, 5457, 5458, 5459, 5463, 5464, 5466, 5472, 5474, 5476, 5482, 5483, 5491, 5493, 5495, 5496, 5498, 5506, 5508, 5510, 5512, 5513, 5515, 5516, 5517, 5518, 5519, 5524, 5530, 5531, 5535, 5537, 5539, 5543, 5547, 5557, 5561, 5563, 5568, 5569, 5571, 5579, 5581, 5585, 5588, 5589, 5591, 5592, 5597, 5604, 5612, 5613, 5615, 5616, 5618, 5620, 5623, 5627, 5632, 5633, 5635, 5638, 5640, 5642, 5643, 5648, 5651, 5652, 5659, 5660, 5662, 5663, 5664, 5675, 5676, 5677, 5680, 5683, 5688, 5689, 5694, 5695, 5697, 5698, 5702, 5703, 5706, 5709, 5711, 5717, 5718, 5721, 5722, 5728, 5731, 5734, 5735, 5739, 5744, 5751, 5756, 5763, 5768, 5770, 5771, 5775, 5778, 5780, 5783, 5784, 5785, 5786, 5789, 5791, 5794, 5803, 5806, 5807, 5808, 5810, 5813, 5817, 5820, 5826, 5828, 5831, 5833, 5834, 5835, 5836, 5837, 5839, 5844, 5850, 5853, 5854, 5855, 5863, 5864, 5865, 5866, 5867, 5868, 5869, 5870, 5872, 5876, 5878, 5879, 5881, 5883, 5887, 5888, 5892, 5893, 5906, 5907, 5912, 5918, 5919, 5925, 5926, 5927, 5932, 5934, 5936, 5938, 5941, 5944, 5948, 5954, 5956, 5959, 5968, 5969, 5971, 5978, 5982, 5988, 5991, 5996, 5997, 6000, 6002, 6004, 6006, 6009, 6013, 6016, 6017, 6023, 6024, 6025, 6026, 6038, 6041, 6044, 6045, 6047, 6048, 6051, 6053, 6058, 6059, 6062, 6063, 6068, 6069, 6072, 6073, 6075, 6080, 6081, 6084, 6085, 6086, 6087, 6088, 6089, 6092, 6093, 6097, 6098, 6099, 6107, 6108, 6109, 6110, 6113, 6116, 6118, 6119, 6123, 6124, 6129, 6131, 6132, 6133, 6135, 6137, 6138, 6139, 6143, 6145, 6146, 6147, 6151, 6153, 6160, 6162, 6163, 6164, 6165, 6168, 6173, 6176, 6181, 6183, 6186, 6188, 6189, 6193, 6196, 6197, 6198, 6203, 6204, 6205, 6214, 6215, 6220, 6223, 6224, 6227, 6228, 6234, 6243, 6246, 6247, 6250, 6251, 6262, 6264, 6265, 6267, 6272, 6273, 6275, 6281, 6282, 6286, 6288, 6289, 6292, 6293, 6296, 6299, 6300, 6303, 6310, 6311, 6315, 6317, 6319, 6321, 6322, 6328, 6333, 6338, 6342, 6343, 6344, 6349, 6354, 6356, 6360, 6362, 6363, 6365, 6367, 6370, 6372, 6381, 6383, 6394, 6397, 6399, 6403, 6404, 6405, 6408, 6412, 6414, 6415, 6416, 6419, 6420, 6422, 6425, 6426, 6427, 6428, 6429, 6430, 6431, 6436, 6440, 6442, 6449, 6456, 6463, 6466, 6467, 6468, 6469, 6470, 6472, 6474, 6475, 6476, 6477, 6478, 6480, 6482, 6484, 6485, 6486, 6488, 6493, 6494, 6501, 6504, 6510, 6513, 6516, 6517, 6519, 6530, 6531, 6532, 6534, 6535, 6537, 6539, 6545, 6547, 6548, 6549, 6553, 6555, 6558, 6559, 6567, 6571, 6572, 6574, 6576, 6577, 6579, 6581, 6584, 6588, 6589, 6592, 6594, 6595, 6597, 6599, 6600, 6603, 6607, 6609, 6610, 6614, 6615, 6616, 6620, 6623, 6625, 6629, 6633, 6634, 6635, 6638, 6639, 6646, 6647, 6649, 6655, 6656, 6658, 6661, 6662, 6666, 6671, 6672, 6681, 6682, 6693, 6701, 6703, 6705, 6706, 6716, 6718, 6720, 6729, 6730, 6734, 6736, 6737, 6739, 6742, 6747, 6748, 6749, 6756, 6757, 6758, 6759, 6764, 6767, 6779, 6781, 6782, 6783, 6786, 6788, 6789, 6793, 6794, 6795, 6799, 6803, 6804, 6805, 6806, 6807, 6810, 6811, 6812, 6813, 6815, 6816, 6817, 6819, 6820, 6821, 6824, 6828, 6830, 6834, 6836, 6840, 6841, 6843, 6848, 6851, 6855, 6868, 6869, 6875, 6877, 6879, 6880, 6881, 6882, 6883, 6884, 6886, 6887, 6888, 6897, 6902, 6903, 6904, 6906, 6907, 6909, 6913, 6914, 6917, 6919, 6921, 6925, 6930, 6936, 6939, 6946, 6950, 6952, 6954, 6955, 6959, 6960, 6963, 6967, 6970, 6971, 6979, 6981, 6984, 6985, 6987, 6988, 6990, 6991, 6994, 6997, 6999, 7010, 7013, 7022, 7027, 7029, 7038, 7039, 7041, 7043, 7045, 7048, 7051, 7052, 7053, 7054, 7057, 7059, 7060, 7062, 7064, 7072, 7073, 7075, 7077, 7083, 7084, 7085, 7096, 7105, 7106, 7107, 7108, 7110, 7113, 7117, 7118, 7124, 7126, 7128, 7130, 7138, 7139, 7142, 7143, 7144, 7151, 7154, 7163, 7164, 7165, 7166, 7169, 7172, 7176, 7182, 7184, 7187, 7191, 7192, 7194, 7197, 7198, 7201, 7206, 7207, 7212, 7214, 7217, 7219, 7220, 7227, 7235, 7236, 7244, 7245, 7246, 7249, 7250, 7255, 7257, 7258, 7262, 7263, 7264, 7267, 7268, 7274, 7276, 7281, 7287, 7291, 7292, 7293, 7298, 7299, 7300, 7301, 7303, 7304, 7306, 7307, 7311, 7312, 7313, 7318, 7323, 7328, 7339, 7340, 7344, 7345, 7356, 7357, 7358, 7360, 7361, 7365, 7371, 7375, 7376, 7377, 7382, 7383, 7385, 7386, 7398, 7399, 7400, 7405, 7409, 7411, 7415, 7418, 7425, 7430, 7434, 7436, 7437, 7438, 7443, 7444, 7447, 7452, 7453, 7454, 7457, 7458, 7459, 7462, 7466, 7470, 7472, 7476, 7481, 7483, 7485, 7486, 7487, 7490, 7492, 7493, 7499, 7502, 7503, 7504, 7506, 7512, 7514, 7515, 7517, 7523, 7524, 7533, 7538, 7546, 7547, 7556, 7557, 7559, 7560, 7561, 7572, 7574, 7576, 7579, 7583, 7585, 7586, 7589, 7596, 7598, 7604, 7609, 7614, 7619, 7620, 7622, 7624, 7625, 7626, 7633, 7642, 7643, 7644, 7649, 7656, 7658, 7661, 7662, 7664, 7665, 7672, 7673, 7674, 7678, 7679, 7680, 7682, 7687, 7689, 7695, 7700, 7703, 7707, 7712, 7716, 7718, 7724, 7727, 7736, 7737, 7738, 7741, 7742, 7744, 7745, 7749, 7753, 7763, 7764, 7768, 7770, 7774, 7775, 7776, 7777, 7778, 7779, 7781, 7785, 7786, 7787, 7788, 7791, 7793, 7798, 7799, 7800, 7803, 7804, 7805, 7806, 7807, 7815, 7818, 7819, 7820, 7825, 7833, 7840, 7841, 7844, 7845, 7850, 7854, 7856, 7860, 7862, 7865, 7873, 7877, 7878, 7880, 7881, 7885, 7888, 7890, 7896, 7908, 7909, 7910, 7911, 7918, 7923, 7925, 7934, 7935, 7936, 7938, 7942, 7944, 7946, 7949, 7952, 7960, 7965, 7966, 7967, 7972, 7973, 7974, 7976, 7977, 7981, 7983, 7984, 7986, 7992, 7996, 7998, 8007, 8009, 8012, 8020, 8021, 8023, 8025, 8026, 8029, 8030, 8031, 8036, 8040, 8042, 8043, 8044, 8047, 8048, 8052, 8053, 8056, 8059, 8061, 8063, 8068, 8075, 8076, 8077, 8078, 8080, 8081, 8084, 8088, 8091, 8093, 8095, 8099, 8102, 8106, 8110, 8112, 8113, 8118, 8121, 8126, 8129, 8130, 8134, 8141, 8145, 8148, 8150, 8151, 8155, 8159, 8163, 8166, 8177, 8178, 8179, 8181, 8184, 8189, 8191, 8193, 8194, 8202, 8204, 8208, 8213, 8217, 8219, 8223, 8234, 8235, 8237, 8239, 8241, 8242, 8246, 8247, 8248, 8250, 8252, 8253, 8265, 8266, 8268, 8269, 8273, 8274, 8276, 8282, 8289, 8291, 8296, 8300, 8304, 8308, 8310, 8311, 8312, 8315, 8318, 8319, 8322, 8329, 8339, 8340, 8346, 8347, 8350, 8351, 8353, 8355, 8358, 8366, 8367, 8368, 8373, 8380, 8382, 8385, 8386, 8387, 8389, 8390, 8392, 8393, 8395, 8401, 8404, 8407, 8410, 8413, 8414, 8415, 8416, 8417, 8418, 8430, 8435, 8436, 8438, 8439, 8442, 8443, 8444, 8445, 8446, 8447, 8448, 8449, 8450, 8451, 8458, 8459, 8465, 8470, 8472, 8473, 8474, 8476, 8477, 8481, 8482, 8486, 8490, 8498, 8500, 8501, 8502, 8503, 8504, 8505, 8507, 8509, 8511, 8513, 8514, 8518, 8521, 8524, 8525, 8526, 8527, 8531, 8532, 8533, 8535, 8541, 8542, 8543, 8546, 8553, 8554, 8561, 8562, 8565, 8574, 8575, 8576, 8579, 8581, 8585, 8592, 8593, 8596, 8597, 8600, 8603, 8604, 8605, 8609, 8610, 8611, 8612, 8614, 8621, 8631, 8634, 8635, 8638, 8642, 8644, 8646, 8648, 8650, 8652, 8654, 8659, 8660, 8663, 8665, 8669, 8672, 8675, 8676, 8677, 8685, 8686, 8693, 8694, 8700, 8703, 8706, 8708, 8709, 8713, 8717, 8720, 8722, 8726, 8729, 8731, 8736, 8743, 8744, 8746, 8747, 8748, 8753, 8761, 8769, 8770, 8773, 8774, 8777, 8779, 8782, 8783, 8784, 8786, 8789, 8792, 8802, 8803, 8810, 8811, 8818, 8821, 8822, 8824, 8828, 8829, 8830, 8834, 8839, 8841, 8842, 8843, 8844, 8846, 8853, 8865, 8866, 8869, 8874, 8876, 8877, 8878, 8881, 8883, 8886, 8888, 8892, 8896, 8897, 8900, 8901, 8905, 8907, 8908, 8911, 8917, 8919, 8922, 8924, 8926, 8929, 8935, 8937, 8938, 8941, 8945, 8946, 8949, 8951, 8953, 8959, 8960, 8961, 8967, 8968, 8972, 8979, 8980, 8981, 8985, 8986, 8991, 8992, 8996, 8998, 9001, 9006, 9009, 9011, 9012, 9015, 9018, 9020, 9023, 9026, 9027, 9029, 9030, 9033, 9045, 9050, 9052, 9056, 9058, 9059, 9060, 9063, 9065, 9068, 9069, 9071, 9072, 9076, 9078, 9080, 9087, 9091, 9092, 9095, 9104, 9107, 9111, 9112, 9115, 9116, 9118, 9120, 9123, 9125, 9129, 9139, 9140, 9141, 9142, 9144, 9147, 9152, 9154, 9155, 9167, 9168, 9175, 9177, 9179, 9180, 9183, 9185, 9188, 9190, 9191, 9194, 9195, 9206, 9207, 9213, 9214, 9215, 9216, 9217, 9223, 9226, 9229, 9231, 9233, 9237, 9240, 9243, 9248, 9249, 9253, 9257, 9259, 9265, 9267, 9270, 9273, 9282, 9284, 9285, 9287, 9288, 9290, 9292, 9293, 9296, 9300, 9304, 9308, 9311, 9314, 9320, 9321, 9323, 9326, 9327, 9328, 9334, 9336, 9339, 9340, 9341, 9346, 9347, 9350, 9352, 9360, 9366, 9371, 9373, 9375, 9376, 9380, 9382, 9388, 9391, 9392, 9393, 9394, 9400, 9402, 9403, 9404, 9406, 9407, 9412, 9413, 9414, 9415, 9421, 9423, 9429, 9438, 9440, 9443, 9449, 9451, 9452, 9453, 9455, 9456, 9460, 9464, 9467, 9468, 9471, 9472, 9473, 9474, 9475, 9477, 9481, 9482, 9488, 9490, 9500, 9504, 9509, 9514, 9517, 9518, 9519, 9522, 9525, 9534, 9535, 9536, 9537, 9545, 9546, 9550, 9551, 9553, 9554, 9555, 9560, 9571, 9577, 9587, 9590, 9591, 9593, 9595, 9596, 9597, 9598, 9601, 9602, 9605, 9606, 9609, 9614, 9615, 9618, 9620, 9621, 9623, 9624, 9626, 9627, 9629, 9632, 9633, 9648, 9651, 9652, 9655, 9658, 9659, 9663, 9666, 9668, 9671, 9674, 9679, 9682, 9686, 9695, 9698, 9699, 9706, 9710, 9711, 9715, 9722, 9723, 9726, 9727, 9729, 9731, 9734, 9737, 9742, 9744, 9745, 9746, 9750, 9753, 9754, 9756, 9758, 9763, 9767, 9768, 9770, 9776, 9777, 9781, 9782, 9786, 9787, 9791, 9792, 9793, 9794, 9799, 9804, 9807, 9808, 9810, 9811, 9812, 9813, 9819, 9820, 9821, 9822, 9825, 9828, 9829, 9833, 9845, 9847, 9850, 9866, 9869, 9878, 9882, 9886, 9887, 9892, 9894, 9897, 9900, 9907, 9909, 9910, 9923, 9924, 9928, 9930, 9932, 9935, 9938, 9940, 9946, 9949, 9950, 9952, 9953, 9956, 9960, 9962, 9963, 9967, 9968, 9969, 9972, 9973, 9975, 9980, 9981, 9982, 9984, 9985, 9987, 9988, 9990, 9991, 9992, 9997, 10000, 10008, 10009, 10010, 10012, 10017, 10019, 10020, 10026, 10027, 10037, 10041, 10047, 10049, 10051, 10053, 10054, 10055, 10058, 10059, 10060, 10062, 10064, 10073, 10075, 10077, 10078, 10080, 10081, 10083, 10091, 10092, 10094, 10095, 10097, 10101, 10102, 10103, 10106, 10110, 10115, 10116, 10117, 10119, 10122, 10125, 10127, 10128, 10129, 10131, 10136, 10140, 10151, 10158, 10160, 10163, 10165, 10166, 10168, 10174, 10176, 10178, 10181, 10191, 10192, 10193, 10194, 10195, 10196, 10199, 10206, 10209, 10212, 10218, 10219, 10220, 10221, 10222, 10223, 10224, 10225, 10231, 10233, 10234, 10236, 10237, 10239, 10247, 10252, 10253, 10255, 10259, 10262, 10263, 10269, 10270, 10275, 10276, 10278, 10284, 10286, 10291, 10292, 10293, 10295, 10300, 10302, 10306, 10307, 10312, 10314, 10315, 10318, 10321, 10323, 10324, 10325, 10326, 10330, 10331, 10333, 10334, 10335, 10336, 10340, 10341, 10346, 10353, 10356, 10357, 10362, 10364, 10371, 10373, 10375, 10376, 10378, 10380, 10381, 10384, 10388, 10393, 10397, 10398, 10399, 10400, 10401, 10402, 10405, 10408, 10410, 10411, 10413, 10414, 10416, 10417, 10421, 10423, 10425, 10426, 10435, 10436, 10438, 10440, 10446, 10449, 10450, 10451, 10452, 10453, 10455, 10456, 10463, 10464, 10465, 10468, 10469, 10471, 10474, 10480, 10482, 10487, 10490, 10492, 10494, 10496, 10506, 10508, 10514, 10518, 10522, 10523, 10524, 10527, 10528, 10530, 10531, 10532, 10536, 10537, 10541, 10542, 10543, 10547, 10548, 10555, 10556, 10558, 10562, 10567, 10573, 10580, 10581, 10582, 10583, 10584, 10588, 10593, 10596, 10597, 10599, 10601, 10602, 10611, 10615, 10616, 10617, 10621, 10622, 10626, 10628, 10637, 10638, 10639, 10640, 10642, 10646, 10655, 10657, 10665, 10668, 10670, 10671, 10676, 10678, 10679, 10682, 10683, 10684, 10685, 10687, 10698, 10700, 10701, 10705, 10707, 10715, 10716, 10721, 10722, 10723, 10724, 10726, 10729, 10732, 10734, 10738, 10740, 10741, 10744, 10747, 10748, 10749, 10752, 10753, 10754, 10756, 10761, 10762, 10766, 10768, 10770, 10772, 10775, 10776, 10778, 10779, 10781, 10785, 10787, 10788, 10792, 10795, 10800, 10801, 10802, 10803, 10804, 10805, 10809, 10810, 10811, 10819, 10822, 10823, 10824, 10827, 10831, 10836, 10837, 10838, 10839, 10840, 10841, 10843, 10844, 10850, 10851, 10853, 10854, 10857, 10858, 10860, 10864, 10866, 10867, 10870, 10874, 10877, 10880, 10886, 10897, 10898, 10899, 10901, 10902, 10911, 10913, 10917, 10918, 10920, 10926, 10927, 10928, 10929, 10930, 10933, 10934, 10938, 10940, 10941, 10942, 10947, 10949, 10962, 10965, 10966, 10967, 10972, 10974, 10976, 10977, 10978, 10979, 10985, 10988, 10993, 10996, 10997, 10998, 10999, 11008, 11015, 11016, 11021, 11022, 11024, 11030, 11032, 11036, 11037, 11044, 11046, 11047, 11050, 11051, 11053, 11056, 11058, 11060, 11063, 11066, 11078, 11082, 11083, 11090, 11095, 11100, 11103, 11107, 11110, 11114, 11118, 11119, 11124, 11126, 11129, 11133, 11136, 11137, 11138, 11141, 11145, 11147, 11149, 11152, 11153, 11154, 11160, 11161, 11163, 11165, 11168, 11169, 11177, 11178, 11181, 11184, 11187, 11188, 11190, 11192, 11193, 11194, 11198, 11203, 11204, 11208, 11214, 11217, 11218, 11222, 11226, 11227, 11228, 11230, 11233, 11236, 11237, 11238, 11239, 11242, 11243, 11246, 11247, 11251, 11253, 11254, 11255, 11256, 11258, 11260, 11262, 11263, 11266, 11274, 11290, 11292, 11293, 11294, 11295, 11297, 11299, 11304, 11305, 11306, 11313, 11315, 11316, 11318, 11321, 11330, 11331, 11337, 11340, 11345, 11346, 11348, 11349, 11352, 11356, 11362, 11363, 11364, 11365, 11371, 11373, 11374, 11377, 11380, 11382, 11385, 11387, 11388, 11392, 11394, 11395, 11401, 11404, 11405, 11406, 11417, 11424, 11427, 11431, 11435, 11438, 11443, 11445, 11446, 11447, 11449, 11451, 11456, 11462, 11465, 11466, 11472, 11475, 11478, 11488, 11489, 11490, 11496, 11497, 11498, 11499, 11500, 11501, 11505, 11506, 11507, 11508, 11518, 11520, 11521, 11523, 11524, 11526, 11527, 11533, 11539, 11540, 11541, 11544, 11546, 11547, 11548, 11550, 11551, 11553, 11558, 11560, 11561, 11567, 11568, 11570, 11576, 11577, 11578, 11585, 11587, 11588, 11593, 11594, 11595, 11596, 11597, 11604, 11607, 11611, 11612, 11615, 11617, 11618, 11619, 11623, 11628, 11638, 11639, 11647, 11650, 11655, 11656, 11658, 11659, 11663, 11669, 11678, 11681, 11682, 11688, 11691, 11692, 11694, 11695, 11696, 11701, 11703, 11705, 11707, 11712, 11718, 11720, 11721, 11725, 11726, 11730, 11731, 11733, 11736, 11740, 11743, 11753, 11756, 11759, 11760, 11761, 11762, 11763, 11765, 11768, 11770, 11771, 11776, 11777, 11778, 11782, 11784, 11786, 11788, 11789, 11792, 11794, 11797, 11799, 11800, 11805, 11806, 11809, 11811, 11812, 11814, 11818, 11820, 11821, 11823, 11826, 11828, 11829, 11830, 11839, 11841, 11846, 11848, 11849, 11851, 11854, 11856, 11858, 11861, 11863, 11864, 11865, 11868, 11872, 11876, 11877, 11878, 11879, 11881, 11886, 11889, 11891, 11894, 11895, 11898, 11901, 11906, 11908, 11909, 11911, 11913, 11914, 11915, 11916, 11917, 11919, 11920, 11921, 11923, 11926, 11928, 11929, 11930, 11934, 11940, 11943, 11947, 11953, 11955, 11956, 11958, 11959, 11960, 11961, 11962, 11965, 11973, 11974, 11975, 11976, 11977, 11978, 11979, 11983, 11988, 11989, 11993, 11997, 11998, 11999, 12004, 12016, 12017, 12019, 12021, 12023, 12024, 12026, 12027, 12032, 12033, 12038, 12042, 12043, 12044, 12047, 12052, 12059, 12060, 12076, 12077, 12081, 12083, 12087, 12092, 12093, 12098, 12104, 12106, 12108, 12109, 12110, 12112, 12113, 12118, 12122, 12126, 12128, 12129, 12134, 12137, 12138, 12139, 12140, 12143, 12147, 12149, 12151, 12161, 12165, 12166, 12167, 12170, 12171, 12173, 12174, 12175, 12176, 12181, 12183, 12185, 12191, 12197, 12198, 12200, 12201, 12204, 12207, 12208, 12217, 12218, 12219, 12220, 12221, 12227, 12228, 12233, 12234, 12240, 12245, 12250, 12252, 12253, 12255, 12256, 12259, 12263, 12267, 12269, 12274, 12278, 12280, 12283, 12284, 12286, 12287, 12293, 12295, 12297, 12298, 12299, 12304, 12310, 12311, 12313, 12314, 12315, 12317, 12321, 12323, 12329, 12331, 12334, 12345, 12347, 12354, 12356, 12358, 12359, 12364, 12369, 12370, 12372, 12374, 12379, 12380, 12381, 12383, 12397, 12400, 12401, 12403, 12404, 12406, 12411, 12414, 12416, 12419, 12420, 12421, 12424, 12426, 12427, 12437, 12440, 12441, 12445, 12447, 12450, 12451, 12454, 12455, 12456, 12457, 12459, 12462, 12467, 12468, 12473, 12475, 12476, 12478, 12479, 12481, 12487, 12488, 12491, 12494, 12495, 12497, 12499, 12504, 12508, 12514, 12530, 12531, 12536, 12539, 12545, 12546, 12547, 12549, 12554, 12555, 12561, 12563, 12564, 12565, 12567, 12568, 12570, 12572, 12574, 12578, 12583, 12585, 12588, 12600, 12605, 12608, 12609, 12611, 12616, 12619, 12623, 12634, 12635, 12636, 12638, 12639, 12641, 12649, 12651, 12655, 12658, 12663, 12668, 12670, 12672, 12675, 12679, 12680, 12681, 12684, 12686, 12688, 12691, 12693, 12695, 12699, 12701, 12702, 12703, 12707, 12708, 12711, 12713, 12714, 12718, 12719, 12723, 12729, 12731, 12732, 12733, 12737, 12739, 12740, 12741, 12742, 12748, 12754, 12755, 12758, 12760, 12762, 12764, 12766, 12769, 12771, 12772, 12773, 12783, 12785, 12790, 12794, 12797, 12802, 12803, 12810, 12812, 12813, 12814, 12817, 12818, 12819, 12820, 12822, 12824, 12826, 12827, 12828, 12834, 12835, 12838, 12839, 12843, 12844, 12849, 12850, 12853, 12858, 12860, 12861, 12866, 12873, 12882, 12883, 12884, 12887, 12888, 12893, 12895, 12898, 12900, 12904, 12905, 12906, 12910, 12917, 12918, 12920, 12921, 12926, 12929, 12932, 12933, 12938, 12939, 12940, 12944, 12945, 12946, 12947, 12950, 12954, 12961, 12966, 12968, 12969, 12972, 12973, 12974, 12975, 12976, 12978, 12982, 12983, 12984, 12987, 12989, 12990, 12991, 12992, 12998, 13007, 13010, 13011, 13014, 13015, 13017, 13018, 13022, 13024, 13030, 13032, 13033, 13035, 13038, 13040, 13041, 13042, 13050, 13053, 13054, 13055, 13056, 13061, 13062, 13064, 13065, 13066, 13071, 13074, 13075, 13077, 13079, 13083, 13085, 13086, 13087, 13095, 13098, 13100, 13101, 13102, 13105, 13114, 13115, 13116, 13117, 13118, 13119, 13123, 13124, 13128, 13131, 13135, 13142, 13148, 13149, 13151, 13153, 13156, 13169, 13175, 13177, 13182, 13191, 13197, 13199, 13201, 13209, 13212, 13213, 13215, 13217, 13221, 13222, 13224, 13227, 13230, 13232, 13234, 13235, 13236, 13237, 13238, 13243, 13248, 13249, 13251, 13255, 13259, 13260, 13261, 13263, 13264, 13269, 13275, 13276, 13279, 13281, 13285, 13291, 13295, 13296, 13298, 13301, 13303, 13304, 13313, 13315, 13317, 13318, 13320, 13321, 13322, 13323, 13326, 13328, 13330, 13332, 13335, 13343, 13345, 13346, 13348, 13354, 13361, 13367, 13368, 13369, 13375, 13380, 13381, 13384, 13393, 13394, 13396, 13397, 13401, 13408, 13410, 13413, 13415, 13416, 13418, 13419, 13420, 13423, 13424, 13429, 13433, 13439, 13441, 13444, 13448, 13451, 13454, 13456, 13460, 13463, 13464, 13466, 13468, 13469, 13473, 13474, 13475, 13492, 13494, 13497, 13498, 13499, 13500, 13503, 13504, 13506, 13513, 13514, 13515, 13516, 13517, 13519, 13520, 13521, 13524, 13530, 13532, 13539, 13540, 13543, 13544, 13546, 13547, 13549, 13552, 13553, 13556, 13568, 13569, 13574, 13584, 13587, 13595, 13597, 13598, 13601, 13602, 13604, 13612, 13621, 13623, 13628, 13631, 13632, 13634, 13635, 13636, 13637, 13638, 13641, 13647, 13650, 13651, 13652, 13654, 13661, 13662, 13663, 13668, 13671, 13675, 13677, 13678, 13679, 13681, 13684, 13687, 13688, 13693, 13695, 13698, 13700, 13702, 13703, 13706, 13710, 13713, 13715, 13716, 13720, 13721, 13725, 13729, 13733, 13737, 13739, 13745, 13750, 13755, 13756, 13761, 13764, 13766, 13767, 13768, 13769, 13772, 13773, 13775, 13776, 13779, 13781, 13782, 13783, 13786, 13787, 13789, 13790, 13791, 13792, 13794, 13796, 13798, 13809, 13810, 13816, 13817, 13818, 13819, 13820, 13822, 13823, 13827, 13828, 13830, 13831, 13833, 13834, 13835, 13839, 13843, 13849, 13852, 13853, 13858, 13859, 13860, 13862, 13866, 13869, 13870, 13872, 13873, 13877, 13882, 13891, 13892, 13894, 13896, 13897, 13898, 13901, 13904, 13906, 13909, 13910, 13911, 13913, 13917, 13919, 13920, 13927, 13930, 13933, 13938, 13947, 13948, 13949, 13952, 13954, 13956, 13961, 13963, 13965, 13969, 13970, 13971, 13975, 13976, 13984, 13991, 14000, 14001, 14008, 14009, 14010, 14013, 14014, 14017, 14018, 14022, 14026, 14027, 14028, 14030, 14031, 14036, 14041, 14043, 14049, 14050, 14051, 14052, 14062, 14066, 14067, 14069, 14070, 14071, 14073, 14075, 14076, 14081, 14084, 14086, 14087, 14088, 14092, 14094, 14105, 14106, 14107, 14110, 14112, 14115, 14116, 14118, 14120, 14122, 14126, 14128, 14129, 14132, 14133, 14138, 14139, 14141, 14142, 14145, 14146, 14148, 14149, 14150.

Promoters expressing in leaf 2 below the flag leaf at the V3 stage include SEQ IDs: 1, 3, 4, 7, 13, 14, 15, 19, 26, 31, 34, 36, 48, 53, 56, 64, 65, 81, 82, 88, 93, 96, 97, 101, 102, 103, 107, 110, 111, 112, 121, 126, 129, 130, 131, 132, 141, 143, 144, 147, 148, 152, 154, 160, 165, 168, 172, 176, 179, 181, 186, 188, 194, 195, 196, 199, 204, 207, 210, 211, 230, 231, 232, 234, 235, 236, 240, 243, 244, 246, 249, 250, 251, 257, 259, 262, 264, 269, 270, 271, 274, 279, 280, 281, 284, 286, 288, 289, 295, 299, 305, 306, 307, 309, 316, 318, 319, 320, 328, 329, 332, 335, 337, 338, 341, 348, 349, 354, 357, 359, 360, 371, 378, 379, 382, 387, 388, 393, 396, 401, 402, 406, 407, 419, 420, 424, 428, 429, 431, 436, 455, 456, 459, 460, 461, 463, 466, 468, 479, 481, 483, 485, 488, 496, 498, 502, 504, 507, 509, 512, 513, 514, 516, 517, 520, 522, 523, 525, 529, 532, 533, 534, 536, 538, 541, 542, 544, 546, 547, 554, 557, 564, 565, 569, 573, 576, 580, 585, 591, 598, 608, 611, 613, 614, 623, 626, 629, 630, 633, 634, 635, 643, 644, 653, 656, 662, 663, 666, 670, 674, 676, 677, 681, 686, 693, 694, 701, 705, 716, 717, 718, 719, 721, 722, 723, 724, 733, 734, 735, 736, 740, 742, 753, 765, 768, 771, 782, 783, 791, 792, 793, 794, 795, 797, 800, 806, 808, 813, 819, 820, 821, 830, 833, 840, 842, 844, 845, 855, 857, 859, 860, 862, 863, 865, 868, 869, 870, 878, 883, 884, 885, 888, 890, 891, 892, 895, 897, 898, 901, 903, 907, 911, 912, 913, 916, 919, 924, 925, 929, 931, 936, 938, 940, 943, 944, 951, 953, 954, 955, 958, 964, 966, 969, 971, 974, 977, 979, 980, 982, 987, 989, 991, 994, 995, 997, 999, 1006, 1007, 1009, 1011, 1014, 1017, 1022, 1026, 1028, 1029, 1030, 1039, 1041, 1042, 1043, 1045, 1046, 1047, 1049, 1050, 1051, 1052, 1054, 1055, 1056, 1065, 1068, 1069, 1077, 1078, 1086, 1087, 1088, 1089, 1092, 1095, 1098, 1103, 1104, 1108, 1110, 1111, 1112, 1114, 1118, 1119, 1120, 1122, 1130, 1132, 1133, 1136, 1137, 1146, 1147, 1148, 1155, 1156, 1161, 1165, 1166, 1169, 1171, 1176, 1178, 1182, 1185, 1187, 1191, 1196, 1199, 1201, 1202, 1204, 1205, 1210, 1214, 1217, 1218, 1219, 1223, 1225, 1227, 1228, 1230, 1231, 1233, 1235, 1236, 1239, 1241, 1243, 1249, 1250, 1252, 1253, 1256, 1257, 1261, 1262, 1264, 1265, 1269, 1272, 1281, 1282, 1283, 1285, 1286, 1292, 1295, 1297, 1301, 1303, 1304, 1305, 1306, 1307, 1309, 1312, 1316, 1317, 1325, 1327, 1330, 1331, 1334, 1335, 1337, 1339, 1345, 1346, 1347, 1349, 1351, 1354, 1355, 1360, 1364, 1367, 1371, 1373, 1377, 1380, 1381, 1382, 1386, 1388, 1393, 1394, 1396, 1398, 1404, 1405, 1407, 1409, 1410, 1412, 1415, 1421, 1426, 1431, 1432, 1438, 1439, 1441, 1442, 1444, 1448, 1451, 1453, 1454, 1455, 1458, 1459, 1462, 1468, 1481, 1486, 1487, 1490, 1499, 1501, 1514, 1517, 1518, 1525, 1526, 1527, 1539, 1540, 1543, 1545, 1546, 1547, 1549, 1550, 1556, 1560, 1567, 1570, 1571, 1578, 1582, 1584, 1586, 1590, 1592, 1593, 1594, 1599, 1600, 1602, 1604, 1605, 1612, 1614, 1615, 1616, 1622, 1635, 1636, 1637, 1638, 1639, 1648, 1650, 1652, 1653, 1658, 1661, 1662, 1669, 1671, 1675, 1677, 1680, 1684, 1685, 1688, 1689, 1691, 1696, 1697, 1698, 1701, 1706, 1707, 1708, 1714, 1717, 1719, 1721, 1723, 1726, 1727, 1729, 1731, 1732, 1735, 1740, 1745, 1755, 1759, 1762, 1764, 1771, 1776, 1785, 1791, 1796, 1815, 1820, 1821, 1823, 1828, 1830, 1832, 1834, 1835, 1837, 1840, 1845, 1850, 1852, 1856, 1858, 1859, 1868, 1869, 1870, 1872, 1876, 1882, 1888, 1891, 1897, 1900, 1902, 1903, 1904, 1905, 1906, 1912, 1914, 1916, 1918, 1920, 1922, 1923, 1924, 1930, 1931, 1933, 1934, 1936, 1940, 1944, 1950, 1952, 1954, 1955, 1977, 1981, 1991, 1993, 1999, 2000, 2007, 2009, 2010, 2012, 2013, 2014, 2015, 2023, 2026, 2033, 2034, 2039, 2041, 2043, 2045, 2048, 2049, 2060, 2062, 2064, 2066, 2067, 2069, 2072, 2074, 2075, 2077, 2081, 2082, 2083, 2089, 2090, 2091, 2094, 2096, 2097, 2099, 2103, 2109, 2112, 2113, 2116, 2117, 2132, 2133, 2134, 2137, 2140, 2142, 2144, 2147, 2150, 2152, 2157, 2159, 2161, 2164, 2166, 2167, 2168, 2170, 2172, 2174, 2178, 2179, 2182, 2185, 2188, 2190, 2193, 2196, 2201, 2202, 2203, 2206, 2207, 2213, 2215, 2216, 2221, 2222, 2226, 2227, 2229, 2230, 2231, 2232, 2235, 2240, 2243, 2244, 2247, 2252, 2253, 2259, 2260, 2261, 2262, 2263, 2264, 2279, 2280, 2281, 2283, 2288, 2295, 2296, 2297, 2300, 2303, 2304, 2305, 2308, 2309, 2310, 2314, 2322, 2323, 2325, 2328, 2329, 2333, 2335, 2339, 2342, 2346, 2348, 2349, 2351, 2353, 2354, 2359, 2360, 2361, 2362, 2363, 2366, 2367, 2369, 2371, 2377, 2379, 2382, 2383, 2384, 2385, 2396, 2397, 2398, 2401, 2403, 2405, 2408, 2411, 2412, 2413, 2418, 2420, 2422, 2435, 2437, 2438, 2443, 2445, 2450, 2452, 2453, 2454, 2457, 2458, 2465, 2470, 2471, 2472, 2476, 2479, 2480, 2482, 2483, 2485, 2492, 2494, 2495, 2498, 2500, 2504, 2505, 2507, 2509, 2510, 2511, 2512, 2514, 2517, 2519, 2522, 2525, 2527, 2528, 2531, 2532, 2533, 2535, 2538, 2539, 2547, 2548, 2549, 2552, 2554, 2555, 2557, 2560, 2567, 2568, 2573, 2578, 2581, 2583, 2589, 2590, 2594, 2601, 2614, 2616, 2617, 2619, 2626, 2627, 2634, 2637, 2639, 2644, 2647, 2648, 2651, 2652, 2653, 2655, 2661, 2662, 2663, 2674, 2675, 2679, 2680, 2684, 2685, 2687, 2689, 2691, 2694, 2704, 2715, 2719, 2722, 2725, 2726, 2728, 2729, 2735, 2737, 2739, 2740, 2742, 2749, 2752, 2756, 2763, 2764, 2765, 2768, 2770, 2775, 2780, 2785, 2791, 2801, 2802, 2805, 2812, 2814, 2819, 2820, 2822, 2823, 2824, 2826, 2827, 2828, 2829, 2833, 2837, 2839, 2840, 2844, 2845, 2850, 2857, 2858, 2861, 2864, 2865, 2871, 2873, 2876, 2878, 2879, 2885, 2886, 2888, 2889, 2890, 2894, 2902, 2903, 2905, 2906, 2908, 2909, 2910, 2911, 2918, 2923, 2935, 2938, 2942, 2944, 2945, 2946, 2948, 2950, 2955, 2959, 2960, 2963, 2966, 2968, 2969, 2976, 2979, 2980, 2992, 2994, 2998, 3000, 3002, 3005, 3006, 3007, 3010, 3014, 3015, 3016, 3020, 3023, 3024, 3026, 3038, 3039, 3042, 3044, 3045, 3048, 3049, 3050, 3051, 3053, 3055, 3058, 3059, 3064, 3067, 3072, 3075, 3076, 3080, 3081, 3083, 3084, 3085, 3087, 3088, 3094, 3095, 3101, 3105, 3106, 3109, 3110, 3112, 3114, 3118, 3119, 3120, 3121, 3123, 3126, 3127, 3128, 3137, 3139, 3140, 3143, 3147, 3153, 3154, 3157, 3158, 3170, 3181, 3185, 3189, 3192, 3194, 3202, 3205, 3210, 3212, 3215, 3220, 3221, 3224, 3225, 3226, 3227, 3228, 3236, 3237, 3240, 3252, 3253, 3255, 3261, 3266, 3268, 3271, 3273, 3278, 3280, 3282, 3286, 3287, 3288, 3289, 3290, 3294, 3295, 3296, 3299, 3312, 3313, 3329, 3331, 3332, 3333, 3340, 3345, 3347, 3349, 3353, 3355, 3358, 3359, 3360, 3361, 3363, 3374, 3377, 3380, 3386, 3393, 3396, 3397, 3399, 3402, 3404, 3412, 3414, 3415, 3416, 3418, 3420, 3422, 3426, 3427, 3428, 3429, 3435, 3438, 3440, 3445, 3446, 3447, 3449, 3451, 3452, 3455, 3458, 3460, 3461, 3464, 3465, 3466, 3470, 3471, 3473, 3474, 3475, 3477, 3482, 3483, 3486, 3487, 3488, 3490, 3491, 3496, 3503, 3504, 3506, 3509, 3510, 3516, 3517, 3518, 3523, 3529, 3533, 3536, 3537, 3541, 3544, 3545, 3548, 3549, 3551, 3552, 3554, 3558, 3560, 3561, 3562, 3563, 3569, 3571, 3572, 3574, 3576, 3582, 3588, 3589, 3592, 3593, 3594, 3595, 3597, 3600, 3603, 3606, 3607, 3610, 3611, 3616, 3618, 3619, 3620, 3621, 3623, 3624, 3626, 3627, 3628, 3629, 3630, 3631, 3633, 3637, 3640, 3642, 3643, 3644, 3645, 3646, 3648, 3650, 3654, 3655, 3657, 3659, 3660, 3663, 3667, 3668, 3669, 3671, 3674, 3696, 3702, 3706, 3710, 3713, 3715, 3717, 3718, 3719, 3720, 3721, 3724, 3731, 3732, 3738, 3739, 3748, 3749, 3752, 3754, 3760, 3761, 3762, 3764, 3766, 3775, 3777, 3778, 3783, 3785, 3788, 3789, 3790, 3791, 3792, 3794, 3796, 3798, 3808, 3812, 3818, 3819, 3823, 3825, 3828, 3829, 3831, 3832, 3833, 3834, 3836, 3839, 3842, 3843, 3844, 3845, 3849, 3858, 3859, 3860, 3862, 3866, 3867, 3870, 3871, 3872, 3873, 3876, 3877, 3883, 3887, 3889, 3890, 3891, 3895, 3896, 3898, 3899, 3908, 3910, 3912, 3914, 3917, 3923, 3924, 3928, 3929, 3934, 3941, 3947, 3950, 3954, 3959, 3962, 3967, 3968, 3974, 3975, 3978, 3983, 3985, 3991, 3995, 3997, 4000, 4001, 4002, 4003, 4006, 4007, 4008, 4022, 4024, 4026, 4030, 4038, 4039, 4040, 4044, 4045, 4047, 4048, 4049, 4050, 4054, 4056, 4057, 4058, 4060, 4067, 4068, 4069, 4072, 4077, 4078, 4081, 4084, 4087, 4092, 4099, 4102, 4103, 4105, 4109, 4110, 4111, 4113, 4115, 4122, 4124, 4128, 4132, 4133, 4139, 4143, 4148, 4149, 4150, 4154, 4156, 4158, 4160, 4161, 4162, 4163, 4165, 4166, 4167, 4168, 4169, 4175, 4178, 4184, 4187, 4188, 4189, 4190, 4198, 4201, 4202, 4205, 4206, 4210, 4211, 4214, 4219, 4221, 4227, 4228, 4233, 4235, 4246, 4247, 4250, 4251, 4255, 4257, 4258, 4260, 4263, 4266, 4270, 4272, 4276, 4279, 4281, 4295, 4296, 4297, 4298, 4301, 4302, 4304, 4309, 4312, 4320, 4321, 4324, 4329, 4330, 4331, 4332, 4333, 4335, 4336, 4339, 4341, 4343, 4344, 4347, 4349, 4352, 4354, 4359, 4360, 4369, 4371, 4373, 4374, 4378, 4383, 4388, 4390, 4391, 4393, 4394, 4397, 4401, 4402, 4403, 4404, 4410, 4412, 4415, 4419, 4422, 4423, 4426, 4427, 4436, 4439, 4442, 4443, 4444, 4446, 4448, 4450, 4453, 4456, 4457, 4458, 4460, 4461, 4462, 4463, 4464, 4465, 4466, 4468, 4472, 4474, 4479, 4485, 4491, 4492, 4494, 4498, 4500, 4506, 4507, 4512, 4514, 4515, 4518, 4519, 4522, 4531, 4543, 4548, 4549, 4554, 4556, 4557, 4558, 4559, 4562, 4563, 4565, 4566, 4567, 4568, 4575, 4580, 4582, 4583, 4586, 4590, 4591, 4594, 4595, 4596, 4601, 4604, 4605, 4606, 4608, 4625, 4633, 4635, 4641, 4643, 4644, 4650, 4651, 4657, 4659, 4666, 4667, 4669, 4670, 4671, 4672, 4677, 4680, 4682, 4684, 4685, 4687, 4697, 4699, 4700, 4704, 4706, 4712, 4719, 4721, 4725, 4729, 4732, 4737, 4738, 4739, 4740, 4747, 4748, 4749, 4750, 4751, 4754, 4755, 4756, 4761, 4762, 4763, 4765, 4767, 4775, 4779, 4789, 4790, 4791, 4794, 4795, 4800, 4804, 4813, 4817, 4818, 4820, 4822, 4823, 4824, 4828, 4830, 4831, 4834, 4851, 4857, 4861, 4862, 4864, 4875, 4877, 4878, 4880, 4881, 4887, 4888, 4889, 4890, 4891, 4901, 4905, 4909, 4912, 4914, 4917, 4918, 4920, 4923, 4924, 4926, 4930, 4931, 4935, 4936, 4938, 4941, 4947, 4950, 4956, 4960, 4971, 4972, 4973, 4975, 4979, 4980, 4981, 4984, 4988, 4992, 4993, 4994, 4996, 5010, 5011, 5029, 5030, 5034, 5037, 5039, 5040, 5042, 5044, 5046, 5049, 5052, 5053, 5054, 5057, 5058, 5061, 5063, 5067, 5068, 5072, 5088, 5089, 5090, 5091, 5095, 5100, 5102, 5111, 5121, 5123, 5129, 5130, 5132, 5136, 5137, 5140, 5144, 5145, 5147, 5152, 5153, 5154, 5157, 5159, 5164, 5165, 5168, 5170, 5171, 5174, 5180, 5181, 5182, 5184, 5185, 5190, 5192, 5195, 5196, 5198, 5199, 5201, 5206, 5208, 5212, 5217, 5219, 5225, 5228, 5229, 5234, 5236, 5240, 5241, 5243, 5250, 5253, 5255, 5258, 5261, 5263, 5267, 5273, 5275, 5276, 5280, 5281, 5283, 5292, 5293, 5299, 5300, 5301, 5303, 5308, 5311, 5313, 5317, 5319, 5324, 5325, 5327, 5329, 5330, 5332, 5334, 5341, 5344, 5346, 5347, 5348, 5350, 5351, 5361, 5366, 5367, 5372, 5379, 5386, 5388, 5389, 5394, 5395, 5396, 5398, 5400, 5403, 5405, 5411, 5414, 5417, 5427, 5431, 5437, 5438, 5439, 5446, 5448, 5449, 5450, 5452, 5456, 5457, 5458, 5459, 5463, 5464, 5466, 5467, 5472, 5474, 5476, 5479, 5481, 5482, 5483, 5493, 5495, 5496, 5497, 5498, 5501, 5506, 5508, 5510, 5513, 5515, 5516, 5517, 5518, 5519, 5520, 5521, 5524, 5530, 5535, 5536, 5537, 5543, 5549, 5557, 5558, 5565, 5566, 5568, 5569, 5571, 5572, 5574, 5575, 5581, 5585, 5586, 5588, 5589, 5591, 5592, 5596, 5604, 5612, 5613, 5614, 5615, 5616, 5618, 5620, 5621, 5627, 5631, 5632, 5635, 5640, 5642, 5643, 5647, 5648, 5653, 5657, 5659, 5660, 5663, 5664, 5670, 5671, 5675, 5676, 5677, 5689, 5690, 5695, 5697, 5699, 5700, 5702, 5703, 5706, 5709, 5711, 5712, 5713, 5718, 5721, 5722, 5730, 5731, 5734, 5735, 5739, 5751, 5753, 5756, 5763, 5768, 5771, 5780, 5783, 5784, 5786, 5787, 5788, 5791, 5794, 5806, 5807, 5810, 5813, 5817, 5820, 5828, 5831, 5833, 5834, 5835, 5836, 5837, 5839, 5846, 5852, 5854, 5856, 5857, 5859, 5861, 5863, 5864, 5865, 5866, 5868, 5869, 5872, 5878, 5881, 5883, 5886, 5888, 5889, 5892, 5893, 5905, 5907, 5912, 5925, 5926, 5927, 5931, 5932, 5934, 5936, 5938, 5941, 5951, 5954, 5956, 5959, 5961, 5968, 5971, 5975, 5978, 5982, 5984, 5991, 5992, 5994, 5996, 5997, 6003, 6006, 6007, 6008, 6013, 6016, 6017, 6018, 6020, 6023, 6024, 6025, 6026, 6028, 6031, 6033, 6038, 6041, 6044, 6045, 6047, 6051, 6058, 6059, 6061, 6062, 6063, 6072, 6073, 6074, 6075, 6077, 6080, 6081, 6082, 6084, 6085, 6087, 6088, 6089, 6090, 6092, 6093, 6096, 6098, 6099, 6107, 6108, 6109, 6110, 6113, 6116, 6118, 6124, 6129, 6131, 6132, 6133, 6135, 6138, 6139, 6145, 6146, 6148, 6149, 6151, 6153, 6155, 6158, 6160, 6162, 6163, 6165, 6180, 6181, 6182, 6183, 6188, 6189, 6194, 6195, 6196, 6197, 6198, 6203, 6204, 6205, 6206, 6209, 6212, 6220, 6221, 6223, 6224, 6226, 6227, 6234, 6237, 6243, 6246, 6247, 6250, 6251, 6255, 6264, 6265, 6267, 6270, 6275, 6280, 6281, 6282, 6286, 6288, 6289, 6290, 6292, 6296, 6299, 6300, 6303, 6306, 6307, 6310, 6317, 6322, 6328, 6330, 6333, 6338, 6349, 6353, 6354, 6356, 6358, 6360, 6363, 6368, 6370, 6372, 6375, 6387, 6394, 6397, 6399, 6403, 6405, 6408, 6412, 6414, 6415, 6419, 6425, 6426, 6428, 6429, 6436, 6440, 6442, 6448, 6450, 6452, 6456, 6457, 6458, 6463, 6464, 6466, 6467, 6469, 6474, 6475, 6476, 6477, 6478, 6480, 6482, 6484, 6485, 6486, 6494, 6495, 6501, 6502, 6504, 6510, 6517, 6519, 6523, 6528, 6530, 6531, 6532, 6534, 6539, 6541, 6545, 6547, 6548, 6549, 6553, 6558, 6559, 6571, 6572, 6574, 6576, 6577, 6579, 6588, 6589, 6592, 6594, 6595, 6596, 6597, 6599, 6600, 6605, 6606, 6607, 6610, 6614, 6620, 6623, 6629, 6633, 6634, 6635, 6639, 6644, 6646, 6647, 6649, 6652, 6654, 6655, 6656, 6658, 6661, 6666, 6672, 6681, 6701, 6703, 6705, 6718, 6720, 6729, 6730, 6734, 6736, 6747, 6749, 6753, 6756, 6757, 6758, 6759, 6764, 6766, 6767, 6777, 6779, 6782, 6783, 6786, 6788, 6792, 6793, 6794, 6795, 6797, 6798, 6799, 6801, 6803, 6804, 6805, 6806, 6813, 6816, 6817, 6819, 6820, 6824, 6826, 6830, 6834, 6836, 6841, 6847, 6848, 6851, 6855, 6861, 6863, 6867, 6868, 6875, 6877, 6878, 6880, 6882, 6883, 6886, 6902, 6903, 6906, 6907, 6909, 6913, 6917, 6919, 6921, 6924, 6925, 6930, 6931, 6936, 6939, 6940, 6946, 6955, 6959, 6960, 6963, 6971, 6979, 6984, 6985, 6987, 6988, 6990, 6991, 6994, 6997, 6999, 7009, 7010, 7013, 7018, 7019, 7020, 7022, 7025, 7027, 7029, 7038, 7039, 7040, 7043, 7045, 7053, 7054, 7057, 7059, 7064, 7067, 7068, 7077, 7084, 7085, 7097, 7103, 7105, 7106, 7107, 7108, 7110, 7117, 7118, 7126, 7130, 7136, 7138, 7139, 7140, 7142, 7143, 7144, 7150, 7154, 7163, 7164, 7165, 7166, 7169, 7170, 7171, 7172, 7182, 7184, 7187, 7194, 7196, 7197, 7201, 7202, 7206, 7208, 7209, 7210, 7212, 7214, 7215, 7217, 7219, 7220, 7228, 7234, 7235, 7236, 7240, 7246, 7249, 7250, 7255, 7257, 7258, 7262, 7263, 7264, 7267, 7268, 7270, 7274, 7281, 7282, 7287, 7291, 7293, 7296, 7298, 7300, 7301, 7303, 7306, 7307, 7308, 7311, 7312, 7313, 7315, 7318, 7319, 7320, 7328, 7334, 7338, 7340, 7343, 7345, 7353, 7355, 7357, 7360, 7363, 7365, 7371, 7373, 7376, 7377, 7383, 7395, 7396, 7398, 7399, 7400, 7425, 7428, 7430, 7434, 7436, 7441, 7453, 7454, 7457, 7458, 7459, 7462, 7464, 7466, 7470, 7472, 7476, 7483, 7484, 7485, 7486, 7487, 7492, 7499, 7502, 7503, 7504, 7506, 7512, 7515, 7517, 7521, 7522, 7523, 7524, 7528, 7541, 7546, 7547, 7549, 7553, 7556, 7557, 7559, 7560, 7572, 7574, 7576, 7579, 7583, 7585, 7586, 7587, 7589, 7590, 7596, 7597, 7598, 7601, 7604, 7609, 7611, 7612, 7614, 7619, 7622, 7624, 7633, 7638, 7642, 7643, 7649, 7655, 7658, 7661, 7662, 7664, 7665, 7671, 7673, 7674, 7682, 7685, 7687, 7689, 7692, 7695, 7699, 7700, 7703, 7712, 7715, 7716, 7724, 7727, 7734, 7736, 7737, 7738, 7741, 7742, 7744, 7745, 7749, 7753, 7754, 7763, 7764, 7767, 7768, 7770, 7772, 7774, 7775, 7779, 7781, 7786, 7788, 7791, 7793, 7798, 7799, 7800, 7801, 7803, 7804, 7806, 7807, 7811, 7815, 7819, 7820, 7825, 7826, 7833, 7834, 7840, 7841, 7844, 7845, 7850, 7856, 7857, 7860, 7865, 7873, 7877, 7880, 7881, 7885, 7887, 7888, 7890, 7893, 7896, 7901, 7908, 7910, 7911, 7913, 7918, 7923, 7925, 7928, 7934, 7935, 7938, 7942, 7944, 7949, 7950, 7952, 7971, 7973, 7974, 7976, 7977, 7981, 7982, 7984, 7986, 7988, 7993, 7994, 7996, 7999, 8000, 8006, 8007, 8012, 8020, 8021, 8023, 8024, 8031, 8036, 8041, 8042, 8044, 8045, 8047, 8048, 8049, 8052, 8056, 8059, 8063, 8066, 8067, 8068, 8074, 8076, 8077, 8078, 8081, 8083, 8088, 8095, 8099, 8100, 8103, 8106, 8109, 8110, 8112, 8113, 8121, 8126, 8129, 8130, 8134, 8136, 8141, 8145, 8146, 8148, 8151, 8166, 8170, 8179, 8181, 8182, 8189, 8193, 8194, 8196, 8198, 8202, 8204, 8208, 8213, 8217, 8219, 8220, 8234, 8236, 8237, 8239, 8241, 8242, 8248, 8249, 8250, 8252, 8253, 8264, 8265, 8268, 8269, 8274, 8275, 8289, 8291, 8296, 8297, 8300, 8304, 8305, 8308, 8311, 8315, 8318, 8319, 8322, 8326, 8329, 8334, 8335, 8339, 8341, 8347, 8349, 8350, 8351, 8352, 8353, 8355, 8358, 8367, 8368, 8371, 8373, 8378, 8379, 8380, 8382, 8389, 8392, 8395, 8396, 8402, 8403, 8404, 8406, 8408, 8410, 8413, 8414, 8415, 8416, 8417, 8418, 8428, 8430, 8433, 8435, 8438, 8439, 8443, 8444, 8445, 8446, 8447, 8448, 8449, 8450, 8451, 8457, 8458, 8459, 8465, 8470, 8473, 8474, 8476, 8477, 8478, 8480, 8482, 8483, 8490, 8498, 8501, 8502, 8503, 8505, 8509, 8520, 8521, 8523, 8524, 8525, 8526, 8531, 8532, 8533, 8542, 8543, 8549, 8550, 8553, 8554, 8557, 8561, 8565, 8574, 8576, 8581, 8582, 8583, 8588, 8592, 8593, 8594, 8596, 8597, 8598, 8602, 8603, 8605, 8612, 8622, 8631, 8634, 8635, 8638, 8641, 8642, 8644, 8646, 8648, 8652, 8654, 8657, 8658, 8659, 8663, 8664, 8665, 8669, 8672, 8676, 8677, 8685, 8686, 8693, 8699, 8700, 8703, 8705, 8706, 8708, 8709, 8712, 8713, 8714, 8715, 8717, 8722, 8726, 8731, 8732, 8736, 8741, 8748, 8755, 8757, 8761, 8769, 8773, 8774, 8777, 8779, 8782, 8783, 8784, 8785, 8786, 8789, 8803, 8804, 8808, 8810, 8817, 8818, 8822, 8824, 8831, 8835, 8838, 8839, 8841, 8842, 8843, 8844, 8847, 8853, 8865, 8866, 8874, 8876, 8877, 8878, 8881, 8883, 8888, 8889, 8891, 8892, 8896, 8897, 8901, 8907, 8908, 8911, 8913, 8914, 8916, 8917, 8919, 8922, 8924, 8926, 8928, 8929, 8937, 8938, 8941, 8945, 8946, 8951, 8953, 8957, 8960, 8961, 8967, 8968, 8979, 8980, 8981, 8985, 8986, 8991, 8992, 8993, 8996, 8998, 9001, 9003, 9009, 9011, 9012, 9013, 9016, 9018, 9020, 9021, 9022, 9026, 9027, 9029, 9030, 9045, 9050, 9052, 9057, 9058, 9059, 9060, 9061, 9063, 9065, 9066, 9068, 9069, 9071, 9072, 9075, 9083, 9084, 9086, 9087, 9088, 9091, 9092, 9095, 9096, 9097, 9098, 9104, 9105, 9106, 9107, 9115, 9116, 9118, 9119, 9120, 9123, 9125, 9129, 9131, 9133, 9134, 9138, 9140, 9141, 9142, 9143, 9144, 9145, 9147, 9151, 9152, 9154, 9159, 9167, 9168, 9172, 9175, 9177, 9180, 9183, 9185, 9186, 9188, 9189, 9195, 9205, 9206, 9207, 9210, 9211, 9213, 9214, 9215, 9216, 9218, 9220, 9223, 9226, 9229, 9231, 9233, 9237, 9240, 9243, 9248, 9249, 9253, 9257, 9259, 9267, 9269, 9270, 9273, 9275, 9282, 9284, 9285, 9287, 9288, 9290, 9291, 9292, 9300, 9304, 9306, 9308, 9310, 9311, 9314, 9320, 9321, 9323, 9326, 9327, 9328, 9337, 9338, 9341, 9346, 9350, 9352, 9355, 9359, 9360, 9366, 9368, 9371, 9373, 9375, 9376, 9382, 9389, 9391, 9392, 9394, 9400, 9402, 9403, 9406, 9407, 9412, 9413, 9415, 9419, 9421, 9423, 9425, 9429, 9439, 9440, 9443, 9449, 9451, 9452, 9453, 9455, 9456, 9460, 9467, 9471, 9477, 9481, 9484, 9490, 9497, 9500, 9503, 9504, 9509, 9514, 9517, 9518, 9519, 9520, 9521, 9522, 9534, 9535, 9536, 9538, 9543, 9545, 9546, 9548, 9550, 9551, 9553, 9555, 9560, 9564, 9565, 9567, 9568, 9571, 9575, 9577, 9587, 9590, 9592, 9596, 9598, 9601, 9602, 9606, 9609, 9615, 9617, 9620, 9621, 9623, 9624, 9626, 9629, 9633, 9638, 9648, 9652, 9653, 9655, 9658, 9659, 9663, 9668, 9670, 9674, 9680, 9682, 9686, 9692, 9695, 9696, 9698, 9706, 9708, 9710, 9711, 9717, 9718, 9723, 9726, 9727, 9729, 9731, 9732, 9733, 9734, 9737, 9738, 9742, 9743, 9744, 9745, 9746, 9749, 9750, 9754, 9761, 9763, 9770, 9772, 9774, 9776, 9777, 9782, 9786, 9787, 9791, 9793, 9794, 9798, 9799, 9807, 9808, 9809, 9812, 9813, 9816, 9819, 9820, 9827, 9828, 9829, 9835, 9836, 9845, 9846, 9847, 9861, 9869, 9875, 9878, 9882, 9886, 9887, 9889, 9892, 9894, 9896, 9897, 9898, 9900, 9907, 9909, 9910, 9911, 9921, 9923, 9928, 9930, 9931, 9934, 9936, 9940, 9944, 9946, 9950, 9952, 9953, 9956, 9962, 9967, 9968, 9969, 9972, 9973, 9974, 9975, 9976, 9980, 9981, 9984, 9985, 9988, 9990, 9992, 9997, 10000, 10012, 10013, 10017, 10019, 10022, 10026, 10027, 10033, 10040, 10041, 10047, 10049, 10051, 10055, 10058, 10059, 10060, 10062, 10063, 10064, 10066, 10076, 10077, 10078, 10080, 10081, 10083, 10090, 10091, 10092, 10095, 10097, 10098, 10103, 10106, 10110, 10114, 10115, 10116, 10117, 10120, 10122, 10125, 10128, 10129, 10131, 10136, 10137, 10140, 10143, 10151, 10158, 10160, 10163, 10165, 10166, 10168, 10169, 10174, 10176, 10178, 10179, 10181, 10192, 10193, 10194, 10196, 10199, 10206, 10207, 10209, 10217, 10218, 10219, 10220, 10221, 10222, 10223, 10224, 10228, 10230, 10231, 10233, 10236, 10237, 10247, 10252, 10253, 10258, 10259, 10260, 10263, 10266, 10269, 10275, 10276, 10278, 10284, 10286, 10292, 10295, 10300, 10302, 10306, 10307, 10311, 10312, 10314, 10315, 10318, 10323, 10325, 10326, 10331, 10333, 10334, 10335, 10336, 10341, 10346, 10353, 10356, 10357, 10361, 10362, 10364, 10371, 10373, 10375, 10376, 10380, 10381, 10392, 10397, 10398, 10399, 10401, 10402, 10408, 10414, 10417, 10419, 10423, 10425, 10426, 10435, 10436, 10446, 10449, 10450, 10452, 10453, 10456, 10463, 10464, 10465, 10468, 10469, 10471, 10472, 10473, 10474, 10480, 10487, 10488, 10494, 10496, 10498, 10504, 10508, 10514, 10518, 10522, 10523, 10527, 10528, 10530, 10531, 10532, 10537, 10540, 10541, 10542, 10544, 10548, 10549, 10550, 10551, 10555, 10556, 10563, 10567, 10571, 10577, 10579, 10581, 10582, 10583, 10584, 10588, 10593, 10596, 10597, 10599, 10601, 10605, 10608, 10611, 10615, 10616, 10617, 10621, 10622, 10626, 10628, 10636, 10640, 10643, 10645, 10646, 10650, 10651, 10657, 10665, 10668, 10669, 10671, 10676, 10678, 10679, 10682, 10683, 10684, 10685, 10686, 10689, 10694, 10700, 10701, 10705, 10711, 10721, 10723, 10724, 10726, 10729, 10734, 10736, 10737, 10738, 10740, 10741, 10744, 10752, 10753, 10754, 10756, 10757, 10763, 10768, 10770, 10772, 10774, 10775, 10778, 10779, 10780, 10781, 10785, 10787, 10788, 10795, 10801, 10802, 10803, 10804, 10809, 10811, 10822, 10823, 10824, 10826, 10827, 10833, 10836, 10837, 10838, 10840, 10841, 10843, 10850, 10851, 10853, 10854, 10857, 10858, 10860, 10863, 10867, 10870, 10877, 10878, 10886, 10887, 10897, 10899, 10901, 10902, 10911, 10918, 10924, 10927, 10929, 10930, 10933, 10934, 10938, 10940, 10941, 10966, 10967, 10972, 10974, 10976, 10977, 10979, 10988, 10993, 10996, 10997, 10999, 11002, 11008, 11015, 11021, 11022, 11023, 11024, 11025, 11030, 11032, 11040, 11046, 11047, 11050, 11051, 11053, 11058, 11066, 11078, 11082, 11083, 11090, 11095, 11098, 11100, 11101, 11107, 11109, 11114, 11116, 11117, 11118, 11119, 11122, 11123, 11124, 11126, 11128, 11129, 11133, 11136, 11137, 11138, 11145, 11147, 11149, 11150, 11151, 11152, 11153, 11154, 11160, 11162, 11163, 11168, 11172, 11177, 11178, 11179, 11180, 11181, 11184, 11187, 11188, 11190, 11192, 11193, 11194, 11204, 11211, 11214, 11217, 11222, 11224, 11228, 11230, 11233, 11236, 11238, 11239, 11242, 11243, 11246, 11247, 11251, 11254, 11255, 11256, 11258, 11260, 11263, 11266, 11274, 11282, 11284, 11291, 11292, 11293, 11298, 11304, 11315, 11318, 11323, 11328, 11329, 11330, 11331, 11332, 11337, 11338, 11339, 11340, 11346, 11348, 11349, 11352, 11358, 11359, 11362, 11363, 11364, 11365, 11366, 11369, 11373, 11380, 11382, 11385, 11387, 11391, 11394, 11395, 11398, 11401, 11404, 11406, 11408, 11417, 11424, 11430, 11431, 11435, 11438, 11439, 11440, 11443, 11447, 11448, 11449, 11451, 11459, 11465, 11466, 11477, 11487, 11489, 11490, 11492, 11496, 11498, 11500, 11506, 11507, 11508, 11520, 11521, 11523, 11524, 11526, 11527, 11533, 11534, 11538, 11539, 11540, 11544, 11546, 11548, 11550, 11551, 11553, 11558, 11560, 11561, 11567, 11568, 11570, 11571, 11576, 11577, 11578, 11585, 11586, 11588, 11593, 11595, 11596, 11597, 11599, 11603, 11604, 11605, 11606, 11607, 11610, 11611, 11615, 11617, 11618, 11619, 11621, 11623, 11625, 11628, 11634, 11636, 11638, 11647, 11649, 11650, 11655, 11656, 11658, 11663, 11668, 11669, 11673, 11678, 11681, 11682, 11688, 11691, 11692, 11695, 11696, 11698, 11703, 11705, 11707, 11712, 11718, 11720, 11725, 11730, 11731, 11733, 11736, 11737, 11738, 11743, 11744, 11748, 11753, 11760, 11761, 11765, 11771, 11776, 11777, 11781, 11782, 11783, 11785, 11786, 11789, 11792, 11794, 11797, 11799, 11800, 11805, 11809, 11811, 11818, 11830, 11836, 11837, 11839, 11840, 11842, 11844, 11846, 11847, 11848, 11854, 11856, 11858, 11861, 11863, 11864, 11865, 11868, 11872, 11876, 11877, 11878, 11881, 11886, 11887, 11889, 11891, 11892, 11894, 11895, 11897, 11901, 11906, 11909, 11911, 11913, 11915, 11916, 11917, 11918, 11919, 11920, 11921, 11922, 11923, 11926, 11927, 11928, 11929, 11930, 11933, 11934, 11940, 11943, 11947, 11949, 11950, 11956, 11959, 11960, 11961, 11962, 11965, 11969, 11974, 11975, 11976, 11977, 11978, 11979, 11980, 11982, 11987, 11988, 11989, 11993, 11997, 11998, 11999, 12004, 12008, 12014, 12015, 12017, 12018, 12019, 12020, 12021, 12023, 12024, 12026, 12027, 12032, 12033, 12042, 12043, 12044, 12059, 12068, 12077, 12080, 12083, 12092, 12093, 12098, 12102, 12104, 12106, 12108, 12109, 12110, 12112, 12115, 12126, 12128, 12129, 12134, 12137, 12138, 12139, 12141, 12143, 12147, 12148, 12149, 12151, 12165, 12166, 12171, 12174, 12175, 12181, 12183, 12185, 12197, 12200, 12201, 12204, 12207, 12208, 12215, 12217, 12219, 12220, 12221, 12223, 12227, 12228, 12229, 12234, 12241, 12245, 12249, 12250, 12253, 12256, 12259, 12263, 12267, 12268, 12269, 12274, 12278, 12283, 12284, 12286, 12287, 12293, 12297, 12298, 12299, 12304, 12305, 12311, 12313, 12314, 12315, 12317, 12321, 12323, 12324, 12326, 12331, 12333, 12334, 12337, 12340, 12341, 12342, 12343, 12344, 12345, 12347, 12356, 12359, 12364, 12368, 12369, 12370, 12372, 12373, 12374, 12380, 12381, 12382, 12383, 12391, 12397, 12400, 12401, 12403, 12404, 12405, 12406, 12411, 12412, 12414, 12416, 12418, 12420, 12421, 12424, 12426, 12427, 12428, 12429, 12437, 12439, 12440, 12441, 12445, 12447, 12451, 12454, 12455, 12457, 12461, 12462, 12465, 12467, 12468, 12473, 12476, 12478, 12479, 12481, 12482, 12487, 12488, 12489, 12491, 12494, 12497, 12503, 12504, 12508, 12515, 12521, 12523, 12525, 12531, 12536, 12546, 12547, 12549, 12554, 12555, 12556, 12559, 12561, 12562, 12563, 12564, 12565, 12567, 12568, 12570, 12572, 12585, 12588, 12590, 12597, 12600, 12608, 12609, 12611, 12616, 12619, 12623, 12626, 12628, 12631, 12633, 12634, 12636, 12638, 12639, 12641, 12645, 12649, 12651, 12655, 12658, 12668, 12670, 12671, 12672, 12675, 12679, 12680, 12681, 12682, 12683, 12684, 12691, 12698, 12699, 12701, 12702, 12705, 12706, 12707, 12713, 12715, 12719, 12729, 12731, 12732, 12733, 12737, 12738, 12739, 12740, 12742, 12749, 12751, 12752, 12754, 12755, 12758, 12760, 12761, 12764, 12766, 12768, 12771, 12783, 12788, 12790, 12791, 12797, 12801, 12802, 12805, 12810, 12812, 12813, 12814, 12819, 12820, 12822, 12824, 12826, 12827, 12828, 12834, 12836, 12838, 12839, 12844, 12849, 12853, 12854, 12860, 12866, 12869, 12883, 12884, 12887, 12898, 12900, 12901, 12902, 12904, 12905, 12906, 12912, 12916, 12917, 12918, 12920, 12921, 12932, 12938, 12939, 12942, 12946, 12947, 12950, 12953, 12961, 12963, 12966, 12968, 12969, 12972, 12973, 12974, 12975, 12977, 12978, 12982, 12983, 12987, 12989, 12990, 12991, 12994, 13004, 13006, 13007, 13010, 13011, 13017, 13022, 13023, 13024, 13030, 13032, 13035, 13038, 13044, 13049, 13050, 13053, 13055, 13056, 13060, 13061, 13066, 13067, 13069, 13070, 13074, 13077, 13079, 13085, 13086, 13087, 13095, 13100, 13102, 13105, 13106, 13109, 13114, 13115, 13116, 13117, 13118, 13123, 13124, 13128, 13131, 13135, 13142, 13153, 13156, 13160, 13169, 13175, 13177, 13182, 13191, 13197, 13199, 13206, 13207, 13209, 13210, 13212, 13213, 13215, 13217, 13222, 13224, 13227, 13230, 13232, 13234, 13235, 13236, 13237, 13238, 13239, 13243, 13249, 13251, 13255, 13258, 13259, 13260, 13261, 13263, 13267, 13268, 13269, 13270, 13273, 13276, 13279, 13280, 13281, 13285, 13291, 13293, 13295, 13296, 13298, 13303, 13304, 13313, 13315, 13317, 13320, 13321, 13322, 13323, 13325, 13326, 13328, 13330, 13338, 13347, 13348, 13349, 13353, 13354, 13358, 13361, 13367, 13369, 13380, 13384, 13393, 13396, 13397, 13401, 13410, 13411, 13416, 13418, 13419, 13420, 13423, 13424, 13429, 13431, 13433, 13440, 13444, 13446, 13449, 13451, 13454, 13456, 13460, 13463, 13466, 13468, 13469, 13472, 13473, 13475, 13494, 13496, 13498, 13499, 13500, 13501, 13504, 13506, 13510, 13513, 13514, 13515, 13516, 13517, 13519, 13520, 13521, 13522, 13524, 13529, 13530, 13532, 13535, 13536, 13540, 13543, 13544, 13546, 13547, 13549, 13552, 13556, 13568, 13574, 13579, 13580, 13582, 13583, 13584, 13589, 13597, 13598, 13601, 13602, 13603, 13604, 13621, 13623, 13631, 13634, 13637, 13641, 13643, 13647, 13650, 13652, 13654, 13660, 13661, 13662, 13663, 13669, 13671, 13677, 13678, 13683, 13684, 13686, 13688, 13689, 13698, 13699, 13700, 13703, 13704, 13706, 13710, 13712, 13713, 13715, 13716, 13720, 13721, 13725, 13727, 13728, 13729, 13730, 13733, 13737, 13738, 13742, 13745, 13747, 13750, 13751, 13753, 13755, 13756, 13764, 13766, 13767, 13769, 13773, 13775, 13781, 13783, 13786, 13787, 13789, 13790, 13791, 13794, 13795, 13796, 13798, 13802, 13809, 13816, 13817, 13818, 13819, 13820, 13822, 13823, 13827, 13831, 13833, 13834, 13835, 13843, 13856, 13859, 13860, 13862, 13866, 13869, 13872, 13873, 13874, 13877, 13881, 13886, 13888, 13891, 13892, 13894, 13896, 13898, 13901, 13904, 13906, 13909, 13910, 13911, 13917, 13919, 13923, 13925, 13927, 13930, 13933, 13944, 13947, 13952, 13956, 13961, 13963, 13965, 13969, 13970, 13975, 13976, 13980, 13983, 13984, 13990, 13991, 13994, 13999, 14000, 14003, 14009, 14014, 14016, 14017, 14018, 14022, 14027, 14030, 14031, 14036, 14040, 14041, 14043, 14049, 14050, 14051, 14052, 14054, 14062, 14063, 14066, 14069, 14070, 14071, 14073, 14084, 14086, 14088, 14092, 14093, 14094, 14102, 14106, 14107, 14110, 14111, 14116, 14118, 14122, 14128, 14129, 14132, 14134, 14138, 14139, 14142, 14143, 14145, 14148, 14149, 14150.

Promoters expressing in leaf 2 below the flag leaf at the V7 stage include SEQ IDs: 1, 3, 4, 7, 11, 13, 14, 15, 26, 31, 34, 36, 48, 53, 56, 64, 81, 82, 88, 93, 96, 97, 101, 102, 103, 107, 110, 111, 112, 121, 126, 129, 130, 131, 132, 134, 143, 146, 147, 148, 152, 154, 160, 164, 165, 168, 176, 181, 186, 187, 188, 194, 195, 196, 199, 204, 205, 207, 210, 211, 215, 230, 232, 234, 235, 236, 240, 241, 243, 244, 246, 248, 249, 250, 251, 257, 259, 262, 264, 268, 269, 270, 271, 273, 274, 279, 280, 281, 284, 286, 288, 289, 295, 299, 301, 302, 305, 306, 307, 314, 316, 318, 319, 320, 322, 328, 329, 332, 334, 335, 337, 348, 349, 353, 354, 357, 359, 360, 367, 371, 378, 379, 380, 382, 387, 388, 393, 396, 401, 402, 406, 407, 423, 424, 428, 429, 433, 434, 436, 444, 456, 459, 461, 463, 466, 468, 471, 473, 479, 481, 483, 485, 488, 496, 498, 502, 504, 507, 509, 510, 512, 513, 514, 516, 517, 520, 523, 525, 529, 532, 533, 534, 536, 538, 541, 542, 544, 546, 547, 554, 557, 564, 565, 569, 573, 576, 580, 585, 591, 598, 608, 611, 613, 614, 620, 623, 626, 629, 630, 633, 634, 635, 643, 644, 650, 653, 656, 662, 663, 666, 674, 676, 677, 681, 686, 693, 694, 701, 705, 716, 717, 718, 719, 721, 722, 723, 724, 733, 734, 735, 736, 740, 742, 753, 757, 759, 765, 768, 771, 782, 783, 791, 792, 793, 794, 795, 797, 800, 806, 808, 813, 819, 820, 821, 829, 830, 833, 840, 842, 844, 845, 855, 857, 859, 860, 862, 863, 865, 868, 869, 870, 878, 883, 884, 885, 887, 888, 890, 891, 892, 895, 897, 898, 901, 902, 903, 907, 911, 912, 913, 916, 917, 919, 924, 925, 929, 931, 936, 938, 943, 944, 951, 953, 954, 955, 957, 958, 962, 964, 966, 969, 971, 974, 977, 979, 980, 982, 987, 989, 991, 994, 995, 997, 999, 1006, 1007, 1009, 1011, 1014, 1017, 1022, 1026, 1029, 1030, 1039, 1041, 1042, 1043, 1045, 1047, 1049, 1051, 1052, 1055, 1056, 1064, 1065, 1068, 1069, 1077, 1078, 1087, 1088, 1089, 1092, 1095, 1098, 1103, 1104, 1106, 1108, 1110, 1111, 1112, 1114, 1118, 1119, 1120, 1122, 1127, 1130, 1132, 1133, 1136, 1137, 1146, 1147, 1148, 1155, 1156, 1161, 1165, 1166, 1169, 1171, 1176, 1178, 1182, 1185, 1187, 1189, 1191, 1196, 1199, 1201, 1205, 1210, 1214, 1217, 1218, 1219, 1223, 1225, 1227, 1228, 1230, 1231, 1233, 1234, 1235, 1236, 1239, 1241, 1243, 1248, 1249, 1250, 1252, 1253, 1256, 1257, 1261, 1264, 1265, 1269, 1272, 1281, 1282, 1283, 1285, 1286, 1292, 1295, 1297, 1301, 1303, 1304, 1305, 1306, 1307, 1309, 1312, 1316, 1317, 1325, 1327, 1330, 1331, 1334, 1335, 1337, 1339, 1340, 1346, 1347, 1349, 1351, 1354, 1355, 1360, 1364, 1367, 1371, 1373, 1377, 1380, 1381, 1382, 1386, 1388, 1392, 1393, 1394, 1396, 1398, 1404, 1405, 1407, 1409, 1410, 1412, 1415, 1423, 1426, 1431, 1432, 1438, 1439, 1441, 1442, 1444, 1448, 1451, 1453, 1454, 1455, 1458, 1459, 1468, 1474, 1481, 1486, 1487, 1490, 1499, 1501, 1508, 1510, 1511, 1514, 1517, 1518, 1525, 1526, 1527, 1534, 1539, 1540, 1543, 1545, 1546, 1547, 1549, 1550, 1555, 1556, 1560, 1567, 1570, 1571, 1578, 1582, 1584, 1586, 1589, 1590, 1592, 1593, 1594, 1599, 1600, 1602, 1604, 1605, 1612, 1614, 1615, 1616, 1618, 1622, 1625, 1635, 1636, 1637, 1638, 1639, 1648, 1650, 1652, 1653, 1658, 1661, 1662, 1669, 1671, 1675, 1677, 1680, 1683, 1684, 1685, 1688, 1689, 1691, 1696, 1697, 1698, 1699, 1705, 1706, 1708, 1714, 1717, 1719, 1721, 1723, 1726, 1727, 1729, 1731, 1732, 1733, 1735, 1740, 1755, 1759, 1760, 1762, 1764, 1771, 1776, 1785, 1791, 1807, 1813, 1815, 1820, 1823, 1826, 1828, 1830, 1832, 1834, 1835, 1837, 1840, 1845, 1850, 1852, 1854, 1855, 1856, 1858, 1859, 1868, 1869, 1870, 1872, 1876, 1882, 1888, 1889, 1891, 1897, 1900, 1902, 1903, 1904, 1905, 1906, 1910, 1911, 1912, 1914, 1916, 1918, 1920, 1922, 1923, 1924, 1930, 1931, 1933, 1934, 1936, 1940, 1944, 1950, 1952, 1954, 1955, 1968, 1977, 1981, 1991, 1993, 1999, 2000, 2007, 2008, 2009, 2010, 2012, 2013, 2014, 2015, 2020, 2026, 2033, 2034, 2039, 2041, 2043, 2045, 2048, 2049, 2060, 2062, 2064, 2066, 2067, 2069, 2071, 2072, 2074, 2075, 2077, 2081, 2082, 2083, 2089, 2090, 2091, 2094, 2096, 2097, 2099, 2101, 2103, 2109, 2112, 2113, 2116, 2117, 2125, 2126, 2132, 2133, 2134, 2137, 2139, 2140, 2142, 2144, 2147, 2150, 2151, 2152, 2156, 2157, 2159, 2161, 2164, 2166, 2167, 2168, 2172, 2173, 2174, 2178, 2179, 2182, 2185, 2190, 2193, 2196, 2201, 2202, 2203, 2206, 2207, 2213, 2214, 2215, 2216, 2221, 2222, 2226, 2227, 2229, 2230, 2231, 2232, 2233, 2235, 2237, 2240, 2244, 2247, 2252, 2253, 2257, 2260, 2262, 2263, 2264, 2279, 2280, 2281, 2282, 2283, 2288, 2295, 2296, 2297, 2300, 2301, 2303, 2304, 2305, 2308, 2309, 2310, 2314, 2322, 2323, 2325, 2328, 2329, 2333, 2335, 2339, 2342, 2346, 2349, 2351, 2352, 2353, 2359, 2360, 2361, 2362, 2363, 2366, 2367, 2371, 2375, 2377, 2379, 2382, 2384, 2385, 2396, 2397, 2398, 2401, 2403, 2405, 2408, 2411, 2412, 2413, 2418, 2422, 2435, 2437, 2443, 2445, 2450, 2452, 2453, 2454, 2457, 2458, 2465, 2470, 2471, 2472, 2474, 2476, 2479, 2480, 2482, 2483, 2485, 2492, 2494, 2495, 2498, 2500, 2504, 2505, 2507, 2509, 2510, 2511, 2512, 2514, 2517, 2519, 2522, 2525, 2527, 2528, 2531, 2532, 2533, 2535, 2538, 2539, 2541, 2547, 2548, 2549, 2552, 2555, 2557, 2560, 2567, 2568, 2573, 2576, 2578, 2579, 2581, 2583, 2589, 2590, 2594, 2601, 2606, 2614, 2616, 2617, 2619, 2626, 2627, 2632, 2634, 2637, 2639, 2644, 2647, 2648, 2651, 2652, 2653, 2654, 2655, 2661, 2662, 2663, 2665, 2675, 2679, 2680, 2684, 2685, 2687, 2689, 2691, 2696, 2704, 2707, 2711, 2715, 2718, 2719, 2723, 2725, 2726, 2728, 2729, 2735, 2737, 2738, 2739, 2740, 2742, 2747, 2749, 2752, 2756, 2763, 2764, 2765, 2768, 2770, 2775, 2780, 2785, 2786, 2787, 2791, 2800, 2801, 2802, 2805, 2812, 2814, 2819, 2822, 2823, 2824, 2826, 2827, 2828, 2829, 2833, 2837, 2839, 2840, 2844, 2845, 2850, 2857, 2858, 2861, 2862, 2864, 2865, 2871, 2873, 2876, 2878, 2879, 2885, 2886, 2888, 2889, 2890, 2894, 2897, 2902, 2903, 2905, 2906, 2908, 2909, 2910, 2911, 2915, 2916, 2917, 2918, 2923, 2935, 2938, 2942, 2943, 2944, 2945, 2946, 2948, 2950, 2955, 2959, 2960, 2963, 2966, 2968, 2969, 2976, 2979, 2980, 2992, 2994, 2998, 3000, 3002, 3005, 3006, 3007, 3010, 3012, 3015, 3016, 3020, 3023, 3024, 3026, 3038, 3039, 3042, 3044, 3045, 3048, 3049, 3050, 3052, 3055, 3062, 3064, 3067, 3075, 3076, 3078, 3080, 3081, 3083, 3084, 3085, 3087, 3088, 3095, 3096, 3101, 3105, 3106, 3109, 3112, 3114, 3118, 3119, 3120, 3121, 3123, 3126, 3127, 3128, 3137, 3139, 3140, 3143, 3145, 3147, 3149, 3150, 3153, 3154, 3157, 3158, 3167, 3170, 3181, 3185, 3189, 3192, 3194, 3199, 3202, 3205, 3206, 3210, 3212, 3215, 3218, 3219, 3220, 3221, 3224, 3225, 3226, 3227, 3228, 3231, 3236, 3237, 3240, 3250, 3252, 3253, 3255, 3258, 3261, 3262, 3266, 3268, 3271, 3273, 3278, 3280, 3282, 3286, 3287, 3288, 3289, 3290, 3294, 3295, 3296, 3299, 3307, 3312, 3313, 3327, 3329, 3331, 3332, 3333, 3335, 3340, 3345, 3347, 3349, 3353, 3355, 3358, 3359, 3360, 3361, 3363, 3364, 3374, 3377, 3380, 3383, 3386, 3393, 3396, 3397, 3399, 3402, 3412, 3414, 3415, 3416, 3418, 3420, 3422, 3424, 3426, 3428, 3429, 3435, 3438, 3440, 3445, 3446, 3447, 3449, 3451, 3452, 3455, 3458, 3460, 3461, 3464, 3465, 3470, 3471, 3473, 3474, 3475, 3477, 3482, 3483, 3486, 3487, 3488, 3490, 3491, 3499, 3500, 3503, 3504, 3506, 3509, 3510, 3511, 3516, 3517, 3518, 3523, 3533, 3536, 3537, 3541, 3544, 3545, 3548, 3549, 3551, 3552, 3554, 3557, 3558, 3560, 3561, 3562, 3563, 3569, 3572, 3574, 3576, 3582, 3588, 3589, 3592, 3593, 3594, 3595, 3597, 3600, 3603, 3606, 3607, 3611, 3613, 3616, 3618, 3619, 3620, 3621, 3623, 3624, 3626, 3627, 3628, 3629, 3630, 3631, 3633, 3640, 3642, 3643, 3644, 3645, 3646, 3648, 3650, 3654, 3655, 3657, 3659, 3660, 3663, 3667, 3668, 3669, 3671, 3674, 3696, 3702, 3706, 3707, 3710, 3713, 3715, 3717, 3718, 3719, 3720, 3721, 3724, 3725, 3731, 3738, 3739, 3742, 3748, 3749, 3754, 3760, 3761, 3762, 3764, 3766, 3775, 3777, 3778, 3783, 3785, 3788, 3789, 3790, 3791, 3792, 3794, 3796, 3798, 3808, 3812, 3818, 3823, 3825, 3828, 3829, 3830, 3831, 3832, 3833, 3834, 3836, 3839, 3842, 3843, 3844, 3845, 3849, 3858, 3859, 3860, 3862, 3866, 3867, 3870, 3871, 3872, 3876, 3883, 3887, 3889, 3890, 3891, 3895, 3896, 3899, 3908, 3910, 3912, 3914, 3917, 3923, 3924, 3926, 3928, 3929, 3934, 3941, 3947, 3950, 3951, 3954, 3959, 3962, 3967, 3968, 3974, 3975, 3978, 3983, 3985, 3987, 3988, 3991, 3996, 3997, 4000, 4001, 4002, 4003, 4006, 4007, 4008, 4022, 4024, 4026, 4030, 4038, 4039, 4040, 4044, 4047, 4048, 4049, 4050, 4051, 4052, 4053, 4054, 4056, 4057, 4058, 4060, 4067, 4068, 4069, 4072, 4077, 4078, 4081, 4084, 4087, 4092, 4094, 4099, 4102, 4103, 4105, 4109, 4110, 4111, 4113, 4115, 4122, 4124, 4128, 4132, 4133, 4139, 4143, 4148, 4149, 4150, 4154, 4155, 4156, 4158, 4160, 4161, 4162, 4163, 4165, 4166, 4167, 4168, 4169, 4171, 4175, 4178, 4184, 4188, 4189, 4190, 4198, 4201, 4202, 4205, 4206, 4207, 4210, 4211, 4214, 4219, 4221, 4227, 4228, 4233, 4235, 4246, 4247, 4250, 4251, 4255, 4257, 4258, 4260, 4266, 4270, 4272, 4276, 4279, 4281, 4294, 4296, 4297, 4298, 4301, 4302, 4304, 4309, 4312, 4317, 4320, 4321, 4324, 4329, 4330, 4331, 4333, 4335, 4336, 4337, 4339, 4341, 4343, 4344, 4347, 4349, 4352, 4354, 4358, 4359, 4360, 4369, 4374, 4378, 4380, 4383, 4387, 4388, 4391, 4393, 4394, 4397, 4401, 4402, 4403, 4404, 4412, 4415, 4419, 4422, 4423, 4426, 4427, 4436, 4439, 4442, 4443, 4444, 4446, 4448, 4449, 4450, 4453, 4456, 4457, 4458, 4460, 4461, 4462, 4463, 4464, 4468, 4472, 4479, 4485, 4490, 4491, 4492, 4494, 4498, 4500, 4506, 4507, 4512, 4514, 4515, 4518, 4519, 4522, 4531, 4535, 4543, 4548, 4549, 4554, 4556, 4557, 4558, 4559, 4562, 4563, 4565, 4566, 4567, 4568, 4570, 4574, 4575, 4580, 4582, 4583, 4586, 4590, 4591, 4594, 4595, 4596, 4601, 4604, 4605, 4606, 4608, 4625, 4633, 4635, 4641, 4643, 4644, 4650, 4651, 4653, 4654, 4655, 4657, 4659, 4666, 4667, 4669, 4670, 4671, 4672, 4677, 4680, 4682, 4684, 4685, 4687, 4692, 4697, 4699, 4700, 4704, 4705, 4706, 4710, 4712, 4719, 4721, 4725, 4729, 4732, 4737, 4738, 4739, 4740, 4747, 4748, 4749, 4750, 4751, 4753, 4754, 4756, 4761, 4762, 4763, 4765, 4767, 4771, 4775, 4779, 4789, 4790, 4791, 4794, 4795, 4800, 4804, 4813, 4816, 4817, 4818, 4820, 4822, 4823, 4824, 4828, 4829, 4832, 4833, 4834, 4851, 4855, 4856, 4857, 4861, 4862, 4864, 4868, 4870, 4875, 4877, 4878, 4880, 4881, 4887, 4888, 4889, 4891, 4900, 4901, 4905, 4909, 4912, 4914, 4917, 4918, 4920, 4923, 4924, 4926, 4930, 4931, 4935, 4936, 4938, 4941, 4943, 4947, 4950, 4956, 4971, 4972, 4975, 4979, 4980, 4981, 4984, 4988, 4992, 4993, 4994, 4996, 5000, 5010, 5011, 5029, 5030, 5034, 5037, 5039, 5040, 5042, 5044, 5046, 5052, 5053, 5054, 5057, 5058, 5061, 5063, 5067, 5068, 5072, 5088, 5089, 5091, 5095, 5100, 5102, 5111, 5122, 5123, 5129, 5130, 5131, 5132, 5136, 5137, 5140, 5144, 5145, 5147, 5152, 5153, 5154, 5157, 5159, 5164, 5165, 5168, 5170, 5174, 5180, 5181, 5182, 5184, 5185, 5188, 5189, 5190, 5192, 5195, 5196, 5198, 5199, 5201, 5202, 5206, 5208, 5212, 5216, 5217, 5219, 5225, 5226, 5228, 5229, 5234, 5236, 5240, 5241, 5253, 5255, 5258, 5263, 5267, 5268, 5273, 5275, 5276, 5280, 5281, 5283, 5292, 5293, 5299, 5300, 5301, 5303, 5308, 5311, 5313, 5314, 5317, 5319, 5324, 5325, 5327, 5329, 5330, 5332, 5334, 5341, 5342, 5344, 5346, 5347, 5348, 5350, 5351, 5359, 5361, 5366, 5367, 5372, 5379, 5382, 5386, 5388, 5389, 5394, 5395, 5396, 5398, 5400, 5403, 5405, 5411, 5414, 5417, 5427, 5431, 5437, 5438, 5439, 5446, 5448, 5449, 5450, 5452, 5456, 5457, 5458, 5459, 5463, 5464, 5466, 5467, 5472, 5476, 5479, 5481, 5482, 5483, 5493, 5495, 5496, 5497, 5498, 5499, 5500, 5501, 5506, 5508, 5510, 5513, 5515, 5516, 5517, 5518, 5519, 5520, 5521, 5524, 5530, 5535, 5537, 5543, 5549, 5556, 5557, 5558, 5565, 5566, 5568, 5569, 5571, 5572, 5574, 5575, 5579, 5581, 5585, 5586, 5588, 5589, 5592, 5596, 5604, 5612, 5613, 5614, 5615, 5616, 5618, 5619, 5620, 5621, 5627, 5631, 5632, 5633, 5635, 5640, 5642, 5647, 5648, 5651, 5653, 5657, 5659, 5660, 5663, 5664, 5670, 5671, 5675, 5676, 5677, 5689, 5690, 5695, 5697, 5698, 5699, 5700, 5702, 5703, 5706, 5709, 5711, 5712, 5713, 5718, 5721, 5722, 5730, 5731, 5734, 5735, 5739, 5751, 5753, 5754, 5763, 5768, 5771, 5773, 5779, 5780, 5783, 5784, 5785, 5786, 5787, 5791, 5794, 5806, 5807, 5810, 5813, 5817, 5820, 5826, 5828, 5831, 5833, 5834, 5835, 5836, 5837, 5839, 5846, 5852, 5854, 5856, 5857, 5859, 5861, 5863, 5864, 5865, 5866, 5868, 5869, 5872, 5873, 5875, 5878, 5881, 5883, 5886, 5888, 5889, 5892, 5893, 5901, 5905, 5907, 5912, 5925, 5926, 5927, 5932, 5934, 5936, 5938, 5941, 5951, 5954, 5956, 5959, 5961, 5968, 5971, 5975, 5978, 5982, 5984, 5988, 5991, 5992, 5994, 5996, 5997, 6000, 6002, 6006, 6007, 6008, 6013, 6016, 6017, 6018, 6020, 6023, 6024, 6025, 6026, 6028, 6031, 6033, 6038, 6041, 6043, 6044, 6045, 6047, 6048, 6051, 6058, 6059, 6061, 6062, 6063, 6069, 6072, 6073, 6074, 6075, 6080, 6081, 6082, 6084, 6085, 6087, 6088, 6089, 6090, 6092, 6093, 6096, 6098, 6099, 6107, 6108, 6109, 6110, 6113, 6116, 6118, 6124, 6129, 6131, 6132, 6133, 6135, 6138, 6139, 6143, 6145, 6146, 6148, 6149, 6151, 6153, 6155, 6158, 6160, 6162, 6163, 6164, 6165, 6173, 6180, 6181, 6182, 6183, 6186, 6188, 6189, 6194, 6195, 6196, 6197, 6198, 6203, 6204, 6205, 6206, 6209, 6212, 6220, 6221, 6223, 6224, 6226, 6227, 6234, 6237, 6243, 6246, 6247, 6250, 6251, 6255, 6264, 6265, 6267, 6270, 6272, 6273, 6275, 6281, 6282, 6286, 6288, 6289, 6290, 6292, 6295, 6296, 6299, 6300, 6303, 6306, 6307, 6310, 6311, 6317, 6321, 6322, 6328, 6330, 6333, 6338, 6342, 6349, 6353, 6354, 6356, 6358, 6360, 6363, 6365, 6368, 6370, 6372, 6375, 6381, 6387, 6394, 6397, 6399, 6403, 6405, 6408, 6412, 6414, 6415, 6419, 6425, 6426, 6428, 6429, 6430, 6436, 6440, 6442, 6448, 6449, 6450, 6456, 6457, 6458, 6463, 6464, 6466, 6467, 6469, 6470, 6474, 6475, 6476, 6477, 6478, 6480, 6482, 6484, 6485, 6486, 6494, 6501, 6502, 6504, 6510, 6517, 6519, 6523, 6528, 6530, 6531, 6532, 6534, 6541, 6547, 6549, 6553, 6558, 6559, 6567, 6571, 6572, 6574, 6576, 6577, 6579, 6581, 6587, 6588, 6589, 6592, 6594, 6595, 6596, 6597, 6599, 6600, 6605, 6606, 6607, 6610, 6614, 6615, 6616, 6620, 6623, 6628, 6629, 6633, 6634, 6635, 6638, 6639, 6644, 6646, 6647, 6649, 6652, 6654, 6655, 6656, 6658, 6662, 6666, 6672, 6681, 6696, 6703, 6705, 6711, 6718, 6720, 6729, 6730, 6733, 6734, 6736, 6742, 6747, 6749, 6753, 6756, 6757, 6759, 6764, 6766, 6767, 6779, 6782, 6783, 6786, 6788, 6791, 6792, 6793, 6794, 6795, 6798, 6799, 6801, 6803, 6804, 6805, 6806, 6813, 6816, 6817, 6819, 6820, 6824, 6826, 6827, 6834, 6836, 6841, 6847, 6848, 6851, 6854, 6855, 6861, 6863, 6867, 6868, 6875, 6876, 6877, 6878, 6880, 6881, 6882, 6883, 6886, 6895, 6902, 6903, 6906, 6907, 6909, 6917, 6919, 6921, 6924, 6925, 6930, 6931, 6935, 6936, 6939, 6940, 6946, 6954, 6955, 6959, 6960, 6963, 6971, 6979, 6984, 6985, 6987, 6988, 6990, 6991, 6994, 6997, 6999, 7009, 7010, 7013, 7018, 7019, 7020, 7022, 7025, 7027, 7029, 7038, 7039, 7040, 7043, 7045, 7051, 7053, 7054, 7057, 7059, 7060, 7062, 7064, 7067, 7068, 7077, 7084, 7085, 7094, 7097, 7103, 7105, 7106, 7107, 7108, 7110, 7117, 7118, 7124, 7126, 7130, 7138, 7139, 7140, 7142, 7143, 7144, 7150, 7151, 7154, 7163, 7164, 7165, 7166, 7169, 7170, 7171, 7172, 7182, 7184, 7187, 7194, 7196, 7197, 7201, 7202, 7206, 7212, 7214, 7215, 7217, 7220, 7224, 7228, 7235, 7236, 7240, 7246, 7249, 7250, 7255, 7257, 7258, 7262, 7263, 7264, 7267, 7268, 7270, 7274, 7281, 7282, 7286, 7287, 7291, 7293, 7296, 7298, 7300, 7301, 7303, 7305, 7306, 7307, 7308, 7311, 7312, 7313, 7315, 7318, 7320, 7321, 7328, 7331, 7334, 7338, 7340, 7344, 7345, 7353, 7355, 7357, 7361, 7363, 7365, 7371, 7373, 7376, 7377, 7380, 7383, 7389, 7392, 7395, 7398, 7400, 7415, 7425, 7428, 7430, 7434, 7436, 7448, 7450, 7453, 7454, 7457, 7458, 7459, 7462, 7464, 7466, 7470, 7476, 7481, 7483, 7484, 7485, 7486, 7492, 7499, 7502, 7503, 7504, 7506, 7512, 7515, 7517, 7521, 7522, 7523, 7524, 7528, 7533, 7538, 7541, 7544, 7546, 7547, 7549, 7556, 7557, 7559, 7560, 7572, 7574, 7576, 7579, 7583, 7585, 7586, 7587, 7589, 7590, 7596, 7597, 7598, 7604, 7609, 7611, 7612, 7614, 7619, 7624, 7633, 7638, 7642, 7643, 7649, 7655, 7656, 7658, 7661, 7662, 7664, 7665, 7673, 7674, 7682, 7685, 7688, 7689, 7692, 7695, 7697, 7699, 7700, 7703, 7712, 7715, 7716, 7724, 7727, 7734, 7736, 7737, 7738, 7741, 7742, 7744, 7745, 7750, 7753, 7754, 7756, 7761, 7763, 7764, 7767, 7770, 7775, 7779, 7780, 7781, 7786, 7788, 7791, 7793, 7798, 7799, 7800, 7801, 7803, 7804, 7806, 7807, 7811, 7815, 7818, 7819, 7820, 7825, 7826, 7833, 7834, 7840, 7841, 7844, 7845, 7857, 7860, 7865, 7873, 7875, 7877, 7878, 7880, 7881, 7885, 7887, 7888, 7890, 7893, 7896, 7901, 7908, 7910, 7911, 7913, 7918, 7923, 7925, 7928, 7934, 7935, 7938, 7942, 7944, 7949, 7950, 7952, 7965, 7966, 7967, 7971, 7973, 7974, 7976, 7977, 7981, 7982, 7984, 7986, 7988, 7993, 7994, 7996, 7999, 8000, 8006, 8007, 8012, 8020, 8021, 8023, 8024, 8025, 8031, 8036, 8041, 8042, 8044, 8045, 8047, 8048, 8049, 8052, 8056, 8059, 8063, 8066, 8067, 8068, 8072, 8074, 8076, 8077, 8078, 8081, 8083, 8088, 8095, 8099, 8100, 8102, 8106, 8109, 8110, 8112, 8113, 8120, 8121, 8126, 8129, 8130, 8134, 8136, 8137, 8145, 8146, 8148, 8150, 8151, 8155, 8166, 8170, 8179, 8181, 8182, 8189, 8193, 8194, 8196, 8198, 8202, 8204, 8208, 8213, 8216, 8217, 8219, 8220, 8222, 8234, 8236, 8237, 8239, 8241, 8242, 8248, 8249, 8250, 8252, 8264, 8265, 8268, 8269, 8272, 8274, 8275, 8289, 8291, 8296, 8297, 8300, 8304, 8305, 8308, 8311, 8315, 8318, 8319, 8322, 8326, 8329, 8334, 8335, 8339, 8340, 8341, 8347, 8349, 8350, 8351, 8352, 8353, 8355, 8358, 8367, 8368, 8371, 8372, 8373, 8378, 8379, 8380, 8382, 8385, 8387, 8389, 8392, 8395, 8396, 8401, 8402, 8403, 8404, 8406, 8410, 8413, 8414, 8415, 8416, 8417, 8418, 8428, 8433, 8435, 8436, 8438, 8439, 8443, 8444, 8445, 8446, 8447, 8448, 8449, 8450, 8451, 8457, 8458, 8459, 8465, 8470, 8473, 8474, 8476, 8477, 8478, 8481, 8482, 8490, 8498, 8501, 8502, 8503, 8505, 8509, 8515, 8517, 8520, 8523, 8524, 8525, 8526, 8531, 8532, 8533, 8542, 8543, 8549, 8550, 8553, 8554, 8557, 8561, 8565, 8574, 8576, 8581, 8582, 8583, 8588, 8592, 8593, 8594, 8596, 8597, 8598, 8600, 8602, 8603, 8605, 8612, 8621, 8622, 8631, 8634, 8635, 8638, 8639, 8641, 8642, 8644, 8646, 8648, 8652, 8654, 8657, 8658, 8659, 8663, 8664, 8665, 8669, 8672, 8675, 8685, 8686, 8693, 8699, 8700, 8703, 8705, 8706, 8708, 8709, 8712, 8713, 8714, 8715, 8717, 8719, 8722, 8726, 8731, 8732, 8741, 8744, 8746, 8748, 8755, 8757, 8761, 8769, 8773, 8774, 8777, 8779, 8782, 8783, 8784, 8785, 8786, 8789, 8797, 8802, 8803, 8804, 8808, 8810, 8817, 8818, 8822, 8824, 8831, 8834, 8835, 8838, 8839, 8841, 8842, 8843, 8844, 8847, 8853, 8865, 8866, 8872, 8874, 8876, 8877, 8878, 8881, 8883, 8888, 8889, 8892, 8896, 8897, 8901, 8905, 8907, 8908, 8911, 8913, 8916, 8917, 8918, 8919, 8922, 8924, 8926, 8928, 8929, 8930, 8937, 8938, 8941, 8945, 8946, 8948, 8951, 8957, 8960, 8961, 8967, 8968, 8979, 8980, 8981, 8985, 8986, 8991, 8992, 8993, 8996, 8998, 9001, 9003, 9009, 9011, 9012, 9013, 9016, 9018, 9020, 9021, 9022, 9025, 9026, 9027, 9029, 9030, 9033, 9045, 9050, 9052, 9057, 9058, 9059, 9060, 9061, 9063, 9065, 9066, 9068, 9069, 9071, 9072, 9075, 9076, 9078, 9080, 9083, 9084, 9086, 9087, 9088, 9091, 9092, 9095, 9096, 9097, 9098, 9103, 9105, 9106, 9107, 9115, 9116, 9118, 9119, 9120, 9123, 9125, 9129, 9131, 9133, 9134, 9138, 9139, 9140, 9141, 9142, 9143, 9144, 9145, 9147, 9151, 9152, 9159, 9167, 9168, 9172, 9175, 9177, 9180, 9183, 9185, 9186, 9188, 9189, 9190, 9194, 9195, 9205, 9206, 9207, 9210, 9211, 9213, 9214, 9215, 9216, 9218, 9220, 9223, 9226, 9229, 9231, 9233, 9237, 9240, 9243, 9248, 9249, 9253, 9257, 9259, 9267, 9269, 9270, 9273, 9275, 9282, 9284, 9285, 9288, 9291, 9292, 9300, 9306, 9308, 9310, 9311, 9314, 9320, 9321, 9323, 9326, 9327, 9328, 9336, 9337, 9338, 9339, 9341, 9346, 9350, 9355, 9359, 9360, 9366, 9368, 9371, 9373, 9375, 9376, 9382, 9389, 9391, 9392, 9394, 9400, 9402, 9403, 9404, 9406, 9407, 9412, 9413, 9414, 9419, 9422, 9423, 9429, 9439, 9440, 9443, 9449, 9451, 9453, 9455, 9456, 9460, 9467, 9471, 9477, 9481, 9484, 9490, 9497, 9500, 9502, 9503, 9504, 9509, 9517, 9518, 9519, 9520, 9521, 9522, 9534, 9535, 9536, 9538, 9543, 9545, 9546, 9548, 9550, 9551, 9553, 9555, 9560, 9564, 9565, 9567, 9568, 9571, 9575, 9577, 9587, 9590, 9591, 9592, 9596, 9601, 9602, 9606, 9609, 9615, 9617, 9620, 9621, 9623, 9624, 9626, 9629, 9633, 9648, 9652, 9653, 9655, 9656, 9657, 9658, 9659, 9663, 9668, 9670, 9682, 9686, 9692, 9695, 9696, 9698, 9706, 9708, 9710, 9711, 9718, 9721, 9722, 9723, 9726, 9727, 9729, 9731, 9732, 9733, 9734, 9737, 9738, 9742, 9743, 9744, 9745, 9746, 9749, 9750, 9754, 9761, 9763, 9770, 9772, 9774, 9776, 9777, 9782, 9786, 9787, 9791, 9793, 9794, 9798, 9799, 9807, 9810, 9811, 9813, 9819, 9820, 9827, 9828, 9829, 9830, 9835, 9836, 9845, 9846, 9847, 9861, 9869, 9875, 9878, 9880, 9882, 9886, 9887, 9892, 9894, 9896, 9897, 9898, 9900, 9907, 9909, 9910, 9911, 9921, 9923, 9928, 9930, 9931, 9934, 9936, 9944, 9946, 9950, 9952, 9953, 9962, 9967, 9968, 9969, 9972, 9973, 9974, 9975, 9976, 9980, 9981, 9984, 9985, 9988, 9990, 9992, 9997, 10000, 10013, 10017, 10018, 10019, 10022, 10026, 10027, 10033, 10037, 10040, 10041, 10047, 10049, 10050, 10051, 10055, 10058, 10059, 10060, 10062, 10063, 10064, 10066, 10076, 10077, 10078, 10080, 10081, 10083, 10090, 10091, 10092, 10095, 10097, 10098, 10103, 10106, 10110, 10114, 10115, 10116, 10117, 10120, 10122, 10125, 10128, 10129, 10131, 10136, 10137, 10140, 10143, 10151, 10158, 10160, 10163, 10165, 10166, 10168, 10169, 10174, 10176, 10178, 10179, 10181, 10192, 10193, 10194, 10196, 10199, 10206, 10207, 10218, 10219, 10220, 10221, 10222, 10223, 10224, 10225, 10228, 10230, 10233, 10236, 10237, 10247, 10252, 10253, 10254, 10259, 10260, 10263, 10266, 10269, 10275, 10276, 10278, 10284, 10286, 10292, 10293, 10295, 10300, 10302, 10306, 10307, 10311, 10312, 10314, 10315, 10318, 10321, 10323, 10325, 10326, 10331, 10333, 10334, 10335, 10336, 10340, 10345, 10346, 10353, 10356, 10357, 10361, 10362, 10364, 10371, 10373, 10375, 10376, 10380, 10381, 10392, 10397, 10398, 10399, 10401, 10402, 10408, 10413, 10414, 10417, 10419, 10421, 10423, 10425, 10430, 10435, 10436, 10438, 10446, 10447, 10449, 10450, 10451, 10452, 10453, 10456, 10463, 10464, 10465, 10468, 10469, 10471, 10472, 10473, 10474, 10480, 10487, 10488, 10493, 10494, 10496, 10498, 10504, 10508, 10514, 10518, 10522, 10523, 10527, 10528, 10531, 10532, 10537, 10541, 10542, 10544, 10548, 10549, 10550, 10551, 10555, 10556, 10560, 10563, 10564, 10567, 10571, 10581, 10582, 10583, 10584, 10593, 10595, 10596, 10597, 10599, 10601, 10605, 10608, 10611, 10615, 10616, 10617, 10621, 10622, 10626, 10628, 10632, 10636, 10637, 10638, 10639, 10640, 10643, 10645, 10646, 10650, 10651, 10652, 10657, 10665, 10668, 10669, 10671, 10676, 10678, 10679, 10682, 10683, 10684, 10685, 10686, 10689, 10694, 10700, 10701, 10705, 10711, 10716, 10721, 10723, 10724, 10726, 10729, 10734, 10736, 10737, 10738, 10740, 10741, 10744, 10752, 10753, 10754, 10756, 10757, 10762, 10763, 10769, 10770, 10772, 10774, 10775, 10778, 10779, 10780, 10781, 10785, 10787, 10788, 10795, 10801, 10802, 10803, 10804, 10809, 10811, 10822, 10824, 10826, 10827, 10836, 10837, 10838, 10840, 10841, 10843, 10850, 10851, 10853, 10854, 10857, 10858, 10860, 10863, 10867, 10870, 10877, 10878, 10886, 10887, 10897, 10898, 10899, 10901, 10902, 10911, 10918, 10920, 10924, 10927, 10928, 10929, 10930, 10933, 10934, 10938, 10940, 10947, 10966, 10967, 10972, 10974, 10976, 10977, 10979, 10988, 10993, 10996, 10999, 11004, 11008, 11015, 11021, 11022, 11023, 11024, 11025, 11030, 11032, 11040, 11046, 11047, 11053, 11058, 11066, 11078, 11082, 11083, 11090, 11095, 11098, 11100, 11101, 11107, 11109, 11114, 11116, 11117, 11118, 11119, 11122, 11123, 11124, 11126, 11128, 11129, 11133, 11136, 11137, 11138, 11145, 11147, 11149, 11150, 11151, 11152, 11153, 11154, 11155, 11156, 11157, 11160, 11163, 11172, 11173, 11177, 11178, 11179, 11180, 11181, 11184, 11187, 11188, 11190, 11192, 11193, 11194, 11198, 11199, 11202, 11203, 11204, 11211, 11214, 11216, 11217, 11222, 11227, 11228, 11230, 11233, 11236, 11238, 11239, 11242, 11243, 11246, 11247, 11251, 11254, 11255, 11258, 11260, 11263, 11266, 11274, 11278, 11282, 11290, 11291, 11292, 11293, 11294, 11298, 11304, 11313, 11315, 11316, 11318, 11328, 11329, 11330, 11331, 11332, 11337, 11339, 11340, 11346, 11348, 11349, 11352, 11358, 11359, 11362, 11363, 11364, 11365, 11366, 11369, 11373, 11374, 11377, 11380, 11382, 11385, 11387, 11391, 11394, 11395, 11398, 11401, 11404, 11405, 11406, 11408, 11417, 11424, 11428, 11430, 11431, 11435, 11438, 11439, 11440, 11443, 11446, 11447, 11448, 11449, 11451, 11456, 11459, 11465, 11466, 11472, 11487, 11489, 11490, 11492, 11496, 11498, 11500, 11505, 11506, 11507, 11508, 11518, 11520, 11521, 11523, 11524, 11526, 11527, 11533, 11534, 11538, 11540, 11544, 11546, 11548, 11550, 11551, 11553, 11558, 11560, 11561, 11567, 11568, 11570, 11571, 11576, 11577, 11578, 11585, 11588, 11593, 11595, 11596, 11597, 11603, 11604, 11605, 11606, 11607, 11610, 11611, 11615, 11617, 11618, 11619, 11621, 11623, 11625, 11628, 11634, 11636, 11638, 11647, 11649, 11650, 11655, 11656, 11658, 11659, 11663, 11668, 11669, 11673, 11678, 11681, 11682, 11688, 11691, 11692, 11695, 11696, 11699, 11703, 11705, 11707, 11712, 11718, 11720, 11725, 11730, 11731, 11733, 11736, 11737, 11738, 11743, 11744, 11748, 11753, 11760, 11761, 11762, 11765, 11771, 11776, 11777, 11781, 11782, 11783, 11785, 11786, 11789, 11792, 11794, 11797, 11799, 11800, 11805, 11809, 11811, 11818, 11830, 11836, 11837, 11839, 11840, 11842, 11846, 11847, 11848, 11851, 11854, 11856, 11858, 11861, 11863, 11864, 11865, 11868, 11872, 11876, 11877, 11878, 11881, 11886, 11887, 11889, 11891, 11892, 11894, 11895, 11897, 11898, 11901, 11902, 11906, 11909, 11911, 11913, 11914, 11915, 11916, 11917, 11918, 11919, 11920, 11921, 11922, 11923, 11926, 11927, 11928, 11929, 11930, 11933, 11934, 11940, 11943, 11945, 11947, 11948, 11949, 11950, 11952, 11956, 11959, 11960, 11961, 11962, 11963, 11965, 11969, 11974, 11975, 11976, 11977, 11978, 11979, 11980, 11983, 11987, 11988, 11989, 11993, 11997, 11998, 11999, 12004, 12008, 12014, 12015, 12017, 12018, 12019, 12020, 12021, 12023, 12024, 12026, 12027, 12032, 12033, 12042, 12043, 12044, 12059, 12077, 12083, 12092, 12093, 12098, 12102, 12104, 12106, 12108, 12109, 12110, 12112, 12115, 12118, 12128, 12129, 12134, 12137, 12138, 12139, 12147, 12148, 12149, 12151, 12165, 12166, 12167, 12171, 12174, 12175, 12181, 12183, 12185, 12197, 12200, 12201, 12204, 12207, 12208, 12215, 12217, 12219, 12220, 12223, 12227, 12228, 12229, 12234, 12241, 12245, 12249, 12250, 12252, 12253, 12256, 12259, 12263, 12267, 12268, 12269, 12274, 12278, 12280, 12281, 12283, 12284, 12286, 12287, 12293, 12297, 12298, 12304, 12307, 12311, 12313, 12314, 12315, 12317, 12321, 12323, 12324, 12326, 12331, 12333, 12334, 12337, 12340, 12342, 12343, 12344, 12345, 12347, 12356, 12359, 12364, 12368, 12369, 12370, 12372, 12373, 12374, 12380, 12381, 12382, 12383, 12391, 12397, 12400, 12401, 12403, 12404, 12405, 12406, 12411, 12414, 12416, 12418, 12420, 12421, 12424, 12425, 12426, 12427, 12428, 12429, 12437, 12439, 12440, 12441, 12445, 12447, 12451, 12454, 12455, 12456, 12457, 12461, 12462, 12465, 12467, 12468, 12472, 12473, 12476, 12478, 12479, 12481, 12482, 12487, 12488, 12489, 12491, 12497, 12499, 12503, 12504, 12505, 12508, 12514, 12515, 12519, 12521, 12523, 12525, 12531, 12536, 12546, 12547, 12549, 12554, 12555, 12556, 12559, 12561, 12562, 12563, 12564, 12565, 12567, 12568, 12572, 12585, 12588, 12590, 12597, 12600, 12605, 12608, 12609, 12611, 12616, 12619, 12622, 12623, 12626, 12628, 12633, 12634, 12636, 12638, 12639, 12641, 12645, 12649, 12651, 12655, 12658, 12668, 12670, 12671, 12672, 12675, 12679, 12680, 12681, 12682, 12684, 12691, 12698, 12699, 12701, 12702, 12705, 12706, 12707, 12713, 12715, 12719, 12722, 12729, 12731, 12732, 12733, 12735, 12737, 12738, 12739, 12740, 12742, 12749, 12751, 12752, 12754, 12755, 12758, 12760, 12761, 12764, 12766, 12768, 12771, 12783, 12788, 12790, 12791, 12792, 12797, 12801, 12802, 12805, 12810, 12812, 12813, 12814, 12819, 12820, 12822, 12824, 12826, 12827, 12828, 12834, 12836, 12838, 12839, 12844, 12849, 12850, 12853, 12854, 12858, 12861, 12866, 12869, 12882, 12883, 12884, 12887, 12888, 12898, 12900, 12901, 12902, 12904, 12905, 12912, 12914, 12916, 12917, 12918, 12920, 12921, 12926, 12932, 12938, 12939, 12942, 12946, 12947, 12950, 12953, 12961, 12963, 12966, 12968, 12969, 12973, 12974, 12975, 12976, 12977, 12978, 12982, 12983, 12987, 12989, 12990, 12991, 12994, 13004, 13006, 13007, 13010, 13011, 13017, 13022, 13023, 13024, 13030, 13032, 13035, 13038, 13040, 13044, 13049, 13050, 13053, 13055, 13056, 13060, 13061, 13063, 13065, 13066, 13067, 13069, 13070, 13074, 13077, 13079, 13085, 13095, 13100, 13101, 13102, 13105, 13106, 13109, 13114, 13115, 13116, 13117, 13118, 13120, 13123, 13124, 13128, 13135, 13142, 13147, 13153, 13156, 13159, 13169, 13175, 13177, 13182, 13191, 13197, 13199, 13206, 13209, 13210, 13212, 13213, 13215, 13217, 13222, 13224, 13227, 13230, 13232, 13234, 13235, 13236, 13237, 13238, 13239, 13243, 13249, 13251, 13255, 13258, 13259, 13260, 13261, 13263, 13267, 13269, 13270, 13273, 13276, 13279, 13280, 13281, 13285, 13291, 13293, 13295, 13296, 13298, 13303, 13304, 13313, 13315, 13317, 13320, 13321, 13323, 13326, 13328, 13330, 13338, 13347, 13348, 13349, 13353, 13354, 13358, 13361, 13367, 13368, 13369, 13370, 13380, 13384, 13393, 13396, 13397, 13401, 13408, 13410, 13411, 13414, 13416, 13419, 13420, 13423, 13424, 13429, 13431, 13433, 13439, 13440, 13444, 13446, 13448, 13449, 13451, 13454, 13456, 13460, 13463, 13466, 13468, 13469, 13472, 13473, 13475, 13494, 13496, 13498, 13499, 13500, 13501, 13503, 13504, 13506, 13510, 13513, 13514, 13515, 13516, 13517, 13519, 13520, 13521, 13524, 13529, 13530, 13532, 13535, 13536, 13540, 13543, 13544, 13546, 13547, 13549, 13552, 13553, 13556, 13568, 13569, 13574, 13579, 13580, 13582, 13583, 13584, 13589, 13597, 13599, 13601, 13602, 13603, 13621, 13623, 13627, 13628, 13631, 13632, 13634, 13637, 13640, 13641, 13643, 13647, 13649, 13650, 13652, 13654, 13660, 13661, 13662, 13663, 13669, 13671, 13675, 13677, 13678, 13679, 13683, 13684, 13685, 13686, 13687, 13688, 13689, 13698, 13699, 13700, 13703, 13706, 13710, 13712, 13715, 13716, 13720, 13721, 13725, 13727, 13728, 13729, 13730, 13733, 13737, 13738, 13742, 13745, 13747, 13748, 13750, 13751, 13753, 13755, 13756, 13764, 13766, 13767, 13773, 13775, 13781, 13782, 13783, 13786, 13787, 13789, 13790, 13791, 13793, 13794, 13795, 13796, 13798, 13802, 13809, 13816, 13817, 13818, 13819, 13820, 13822, 13823, 13824, 13827, 13831, 13833, 13834, 13835, 13843, 13855, 13856, 13859, 13860, 13862, 13866, 13869, 13872, 13873, 13874, 13877, 13888, 13891, 13892, 13894, 13896, 13898, 13901, 13904, 13906, 13908, 13909, 13910, 13911, 13917, 13919, 13923, 13925, 13927, 13930, 13933, 13944, 13947, 13952, 13953, 13956, 13961, 13963, 13965, 13969, 13970, 13975, 13976, 13980, 13983, 13984, 13990, 13991, 13994, 13999, 14000, 14003, 14013, 14014, 14016, 14017, 14018, 14022, 14027, 14030, 14031, 14036, 14040, 14041, 14043, 14049, 14050, 14051, 14052, 14054, 14062, 14063, 14066, 14069, 14070, 14071, 14073, 14086, 14088, 14092, 14093, 14094, 14102, 14106, 14107, 14110, 14116, 14118, 14120, 14122, 14126, 14128, 14129, 14132, 14134, 14138, 14139, 14142, 14143, 14145, 14146, 14148, 14149, 14150.

Promoters expressing in leaf 3 below the flag leaf at the tasseling stage include SEQ IDs: 1, 3, 4, 7, 8, 11, 13, 14, 15, 19, 26, 27, 31, 34, 36, 48, 53, 56, 64, 65, 81, 82, 88, 93, 96, 97, 101, 102, 103, 107, 110, 111, 112, 121, 126, 129, 130, 131, 132, 143, 144, 147, 148, 152, 160, 162, 165, 172, 174, 176, 179, 181, 186, 187, 188, 194, 195, 196, 199, 204, 205, 210, 211, 223, 230, 231, 232, 234, 235, 236, 240, 243, 244, 246, 248, 249, 250, 251, 257, 259, 262, 264, 269, 270, 271, 273, 274, 279, 280, 281, 284, 286, 288, 289, 295, 299, 301, 302, 305, 306, 309, 314, 318, 319, 320, 322, 328, 329, 332, 335, 337, 341, 348, 349, 353, 354, 357, 359, 360, 367, 371, 376, 378, 379, 380, 382, 387, 388, 393, 396, 401, 402, 406, 407, 423, 424, 428, 429, 431, 433, 434, 436, 452, 455, 456, 460, 461, 466, 468, 471, 473, 478, 479, 481, 483, 485, 488, 496, 498, 501, 502, 504, 507, 509, 510, 512, 513, 514, 516, 517, 520, 522, 523, 525, 529, 532, 533, 536, 538, 541, 542, 544, 546, 547, 554, 557, 564, 565, 573, 576, 577, 580, 585, 588, 591, 598, 599, 604, 608, 613, 614, 620, 623, 626, 629, 630, 633, 634, 635, 643, 644, 653, 656, 662, 663, 666, 670, 674, 676, 677, 681, 686, 693, 694, 701, 705, 716, 717, 719, 721, 722, 723, 724, 733, 734, 736, 739, 740, 742, 753, 757, 763, 765, 768, 770, 771, 782, 783, 791, 792, 793, 794, 795, 797, 800, 806, 808, 813, 819, 820, 821, 830, 833, 840, 842, 844, 845, 850, 855, 857, 859, 860, 862, 863, 865, 868, 869, 870, 878, 883, 884, 885, 887, 888, 890, 891, 892, 895, 897, 898, 899, 901, 902, 903, 907, 911, 912, 913, 916, 917, 919, 924, 925, 929, 931, 936, 938, 940, 943, 944, 951, 953, 954, 955, 957, 958, 961, 962, 964, 966, 969, 971, 974, 977, 979, 980, 982, 983, 987, 989, 991, 994, 995, 997, 999, 1006, 1007, 1009, 1011, 1014, 1026, 1028, 1039, 1041, 1042, 1043, 1045, 1046, 1047, 1049, 1050, 1051, 1052, 1055, 1056, 1064, 1065, 1068, 1069, 1073, 1077, 1078, 1086, 1087, 1088, 1089, 1092, 1095, 1098, 1103, 1104, 1108, 1110, 1111, 1112, 1114, 1118, 1119, 1120, 1122, 1127, 1130, 1132, 1133, 1136, 1137, 1144, 1146, 1147, 1148, 1155, 1165, 1166, 1169, 1171, 1176, 1178, 1182, 1185, 1187, 1191, 1196, 1199, 1201, 1204, 1210, 1214, 1217, 1218, 1219, 1220, 1223, 1225, 1227, 1230, 1231, 1233, 1234, 1235, 1236, 1239, 1241, 1243, 1248, 1249, 1250, 1252, 1253, 1256, 1258, 1261, 1264, 1265, 1269, 1272, 1281, 1282, 1283, 1285, 1286, 1292, 1295, 1297, 1303, 1304, 1305, 1306, 1307, 1309, 1312, 1316, 1321, 1327, 1330, 1331, 1334, 1335, 1337, 1339, 1340, 1346, 1347, 1349, 1351, 1354, 1355, 1360, 1364, 1367, 1371, 1373, 1377, 1380, 1381, 1382, 1385, 1386, 1387, 1388, 1393, 1394, 1396, 1398, 1403, 1404, 1407, 1415, 1426, 1431, 1432, 1438, 1439, 1442, 1444, 1451, 1453, 1454, 1455, 1458, 1459, 1466, 1468, 1481, 1486, 1487, 1490, 1499, 1501, 1508, 1510, 1511, 1514, 1517, 1518, 1525, 1526, 1527, 1534, 1539, 1540, 1543, 1545, 1546, 1547, 1549, 1550, 1554, 1555, 1556, 1560, 1567, 1570, 1571, 1575, 1578, 1584, 1586, 1590, 1592, 1593, 1594, 1599, 1600, 1602, 1604, 1605, 1612, 1614, 1616, 1618, 1622, 1625, 1630, 1634, 1635, 1636, 1637, 1638, 1639, 1650, 1653, 1658, 1659, 1661, 1662, 1664, 1669, 1671, 1675, 1677, 1680, 1683, 1685, 1688, 1691, 1696, 1698, 1706, 1708, 1709, 1714, 1717, 1719, 1723, 1726, 1727, 1729, 1731, 1732, 1733, 1735, 1740, 1745, 1755, 1759, 1762, 1764, 1771, 1776, 1779, 1785, 1791, 1807, 1815, 1820, 1823, 1826, 1828, 1830, 1832, 1834, 1835, 1837, 1838, 1840, 1845, 1852, 1859, 1868, 1869, 1870, 1872, 1876, 1882, 1888, 1891, 1897, 1898, 1899, 1900, 1902, 1905, 1906, 1910, 1912, 1914, 1916, 1918, 1920, 1922, 1923, 1924, 1930, 1931, 1933, 1934, 1936, 1940, 1944, 1950, 1952, 1955, 1973, 1977, 1981, 1991, 1993, 1999, 2000, 2007, 2008, 2009, 2010, 2012, 2013, 2014, 2015, 2016, 2017, 2020, 2023, 2026, 2027, 2033, 2034, 2039, 2041, 2043, 2048, 2049, 2060, 2062, 2064, 2066, 2067, 2069, 2071, 2072, 2074, 2075, 2077, 2081, 2082, 2083, 2089, 2090, 2094, 2096, 2097, 2099, 2103, 2109, 2113, 2116, 2117, 2126, 2132, 2133, 2134, 2137, 2139, 2140, 2142, 2144, 2147, 2150, 2152, 2157, 2159, 2161, 2166, 2167, 2168, 2170, 2172, 2173, 2178, 2179, 2182, 2185, 2190, 2191, 2193, 2196, 2201, 2202, 2203, 2205, 2206, 2207, 2213, 2215, 2216, 2221, 2222, 2226, 2227, 2229, 2230, 2231, 2232, 2235, 2237, 2240, 2243, 2244, 2247, 2252, 2253, 2257, 2259, 2260, 2261, 2262, 2263, 2273, 2276, 2279, 2280, 2281, 2282, 2283, 2288, 2295, 2296, 2297, 2298, 2300, 2301, 2303, 2304, 2305, 2308, 2309, 2310, 2314, 2322, 2323, 2325, 2328, 2329, 2331, 2333, 2335, 2339, 2342, 2346, 2348, 2349, 2351, 2352, 2353, 2359, 2360, 2361, 2362, 2363, 2366, 2367, 2369, 2371, 2377, 2379, 2381, 2382, 2383, 2384, 2396, 2397, 2398, 2401, 2402, 2403, 2405, 2408, 2411, 2412, 2418, 2420, 2422, 2435, 2437, 2443, 2445, 2450, 2452, 2453, 2454, 2457, 2458, 2465, 2470, 2471, 2472, 2476, 2480, 2482, 2485, 2492, 2494, 2495, 2498, 2500, 2504, 2505, 2506, 2507, 2509, 2510, 2511, 2512, 2514, 2517, 2519, 2522, 2527, 2528, 2529, 2531, 2532, 2533, 2535, 2538, 2539, 2541, 2547, 2548, 2549, 2552, 2555, 2557, 2560, 2567, 2568, 2573, 2576, 2578, 2580, 2581, 2583, 2589, 2590, 2594, 2601, 2609, 2614, 2616, 2617, 2619, 2626, 2627, 2632, 2634, 2637, 2644, 2647, 2651, 2652, 2653, 2654, 2655, 2661, 2662, 2663, 2665, 2671, 2674, 2675, 2679, 2680, 2684, 2687, 2689, 2691, 2694, 2696, 2700, 2704, 2711, 2715, 2718, 2719, 2723, 2725, 2726, 2728, 2729, 2737, 2739, 2740, 2747, 2749, 2752, 2756, 2763, 2764, 2768, 2770, 2775, 2780, 2785, 2787, 2791, 2801, 2802, 2805, 2812, 2814, 2819, 2822, 2823, 2824, 2826, 2827, 2828, 2829, 2833, 2837, 2839, 2840, 2844, 2845, 2850, 2857, 2858, 2861, 2864, 2865, 2871, 2873, 2876, 2878, 2879, 2885, 2886, 2888, 2889, 2890, 2893, 2894, 2902, 2903, 2905, 2906, 2908, 2909, 2910, 2911, 2912, 2918, 2923, 2935, 2938, 2942, 2944, 2945, 2946, 2948, 2950, 2955, 2959, 2960, 2963, 2966, 2968, 2969, 2979, 2980, 2994, 2998, 3000, 3002, 3003, 3005, 3006, 3007, 3008, 3010, 3012, 3015, 3016, 3023, 3024, 3026, 3038, 3039, 3042, 3044, 3048, 3049, 3050, 3055, 3058, 3059, 3062, 3064, 3067, 3070, 3072, 3075, 3076, 3080, 3081, 3083, 3084, 3085, 3087, 3088, 3094, 3095, 3096, 3101, 3105, 3106, 3109, 3112, 3114, 3118, 3119, 3120, 3121, 3123, 3126, 3127, 3128, 3137, 3138, 3139, 3140, 3143, 3147, 3148, 3149, 3150, 3153, 3154, 3157, 3158, 3170, 3181, 3185, 3187, 3192, 3194, 3199, 3202, 3205, 3206, 3210, 3212, 3215, 3219, 3220, 3221, 3224, 3225, 3226, 3227, 3228, 3231, 3236, 3237, 3240, 3244, 3247, 3250, 3252, 3253, 3255, 3261, 3266, 3268, 3271, 3273, 3278, 3280, 3282, 3286, 3287, 3288, 3289, 3290, 3294, 3295, 3299, 3303, 3312, 3313, 3329, 3331, 3332, 3333, 3335, 3340, 3345, 3347, 3349, 3353, 3355, 3358, 3361, 3363, 3370, 3374, 3377, 3380, 3383, 3386, 3393, 3396, 3397, 3399, 3402, 3405, 3412, 3414, 3415, 3416, 3418, 3419, 3422, 3426, 3427, 3428, 3429, 3435, 3438, 3440, 3445, 3446, 3447, 3449, 3451, 3452, 3455, 3458, 3460, 3461, 3464, 3465, 3470, 3471, 3473, 3474, 3475, 3477, 3482, 3483, 3486, 3487, 3488, 3490, 3491, 3496, 3499, 3500, 3503, 3504, 3506, 3509, 3510, 3511, 3516, 3517, 3518, 3529, 3533, 3536, 3537, 3541, 3544, 3545, 3548, 3549, 3551, 3552, 3554, 3557, 3558, 3560, 3561, 3562, 3563, 3569, 3572, 3576, 3582, 3588, 3589, 3592, 3593, 3594, 3595, 3597, 3598, 3600, 3603, 3606, 3607, 3610, 3611, 3613, 3616, 3618, 3619, 3621, 3623, 3624, 3626, 3627, 3628, 3629, 3630, 3631, 3633, 3637, 3640, 3642, 3643, 3644, 3645, 3646, 3648, 3650, 3654, 3655, 3657, 3659, 3660, 3663, 3667, 3668, 3669, 3671, 3674, 3682, 3696, 3706, 3707, 3710, 3713, 3715, 3717, 3718, 3719, 3721, 3724, 3731, 3738, 3739, 3742, 3748, 3749, 3752, 3754, 3760, 3761, 3762, 3764, 3766, 3775, 3777, 3778, 3781, 3783, 3785, 3788, 3789, 3790, 3791, 3792, 3794, 3798, 3804, 3808, 3812, 3818, 3823, 3825, 3828, 3831, 3832, 3833, 3834, 3836, 3839, 3842, 3843, 3844, 3845, 3849, 3858, 3860, 3862, 3866, 3867, 3870, 3871, 3872, 3876, 3883, 3885, 3887, 3889, 3890, 3891, 3895, 3896, 3898, 3899, 3908, 3910, 3911, 3912, 3914, 3917, 3923, 3924, 3926, 3928, 3929, 3937, 3941, 3947, 3950, 3954, 3962, 3967, 3968, 3972, 3974, 3975, 3983, 3984, 3991, 3995, 3996, 3997, 4000, 4001, 4002, 4003, 4006, 4008, 4013, 4022, 4024, 4026, 4030, 4038, 4039, 4040, 4044, 4045, 4047, 4048, 4049, 4050, 4053, 4054, 4056, 4057, 4058, 4060, 4067, 4068, 4069, 4072, 4077, 4078, 4081, 4084, 4087, 4092, 4094, 4099, 4103, 4105, 4109, 4110, 4111, 4113, 4115, 4122, 4124, 4128, 4132, 4133, 4137, 4139, 4143, 4148, 4149, 4154, 4155, 4156, 4158, 4160, 4161, 4162, 4163, 4165, 4166, 4167, 4168, 4169, 4171, 4175, 4178, 4184, 4187, 4188, 4189, 4190, 4197, 4201, 4202, 4205, 4206, 4210, 4211, 4214, 4217, 4219, 4221, 4227, 4228, 4233, 4235, 4246, 4247, 4250, 4251, 4255, 4257, 4258, 4260, 4266, 4270, 4272, 4276, 4279, 4281, 4295, 4296, 4297, 4298, 4301, 4302, 4309, 4312, 4320, 4321, 4324, 4329, 4330, 4331, 4332, 4333, 4335, 4337, 4339, 4341, 4343, 4344, 4347, 4349, 4352, 4354, 4356, 4358, 4359, 4360, 4369, 4371, 4373, 4374, 4378, 4380, 4383, 4390, 4391, 4393, 4394, 4397, 4401, 4402, 4403, 4404, 4405, 4406, 4410, 4412, 4415, 4419, 4422, 4423, 4426, 4427, 4434, 4436, 4439, 4442, 4443, 4444, 4446, 4448, 4450, 4453, 4456, 4457, 4458, 4460, 4461, 4462, 4463, 4464, 4465, 4468, 4472, 4474, 4479, 4483, 4485, 4491, 4492, 4494, 4498, 4500, 4502, 4506, 4507, 4512, 4515, 4518, 4519, 4524, 4531, 4535, 4543, 4548, 4549, 4554, 4555, 4556, 4557, 4558, 4559, 4562, 4563, 4565, 4566, 4567, 4568, 4570, 4575, 4578, 4579, 4580, 4582, 4583, 4590, 4591, 4594, 4595, 4596, 4601, 4604, 4605, 4606, 4608, 4625, 4633, 4635, 4641, 4643, 4644, 4650, 4651, 4657, 4659, 4666, 4667, 4669, 4670, 4671, 4677, 4680, 4682, 4684, 4685, 4687, 4692, 4697, 4699, 4700, 4704, 4705, 4706, 4712, 4716, 4719, 4721, 4722, 4725, 4729, 4732, 4737, 4738, 4740, 4747, 4748, 4749, 4750, 4751, 4753, 4754, 4756, 4761, 4762, 4763, 4765, 4767, 4775, 4779, 4789, 4790, 4791, 4794, 4795, 4804, 4813, 4814, 4817, 4818, 4820, 4822, 4823, 4824, 4828, 4830, 4831, 4832, 4834, 4835, 4842, 4851, 4857, 4861, 4862, 4864, 4868, 4872, 4875, 4877, 4878, 4880, 4881, 4887, 4888, 4889, 4890, 4891, 4900, 4901, 4905, 4909, 4912, 4914, 4917, 4918, 4920, 4923, 4924, 4926, 4931, 4935, 4938, 4941, 4943, 4947, 4950, 4955, 4956, 4965, 4971, 4972, 4973, 4975, 4980, 4981, 4986, 4988, 4992, 4993, 4994, 4996, 5010, 5011, 5029, 5030, 5034, 5037, 5039, 5040, 5042, 5044, 5046, 5048, 5049, 5052, 5054, 5057, 5061, 5067, 5068, 5072, 5088, 5089, 5090, 5091, 5095, 5100, 5102, 5111, 5119, 5123, 5129, 5130, 5131, 5132, 5136, 5137, 5140, 5144, 5145, 5147, 5152, 5154, 5157, 5159, 5164, 5165, 5168, 5170, 5171, 5174, 5180, 5181, 5182, 5184, 5185, 5188, 5189, 5190, 5192, 5195, 5196, 5198, 5199, 5201, 5206, 5208, 5212, 5217, 5219, 5225, 5229, 5234, 5236, 5240, 5241, 5243, 5249, 5253, 5255, 5258, 5261, 5263, 5267, 5273, 5275, 5276, 5281, 5283, 5292, 5293, 5299, 5300, 5301, 5303, 5308, 5311, 5313, 5314, 5317, 5319, 5324, 5325, 5327, 5329, 5330, 5332, 5334, 5342, 5344, 5346, 5347, 5348, 5351, 5359, 5361, 5366, 5367, 5372, 5379, 5382, 5386, 5388, 5389, 5391, 5394, 5395, 5397, 5400, 5403, 5405, 5411, 5414, 5417, 5427, 5430, 5431, 5437, 5438, 5446, 5448, 5449, 5452, 5456, 5457, 5458, 5459, 5463, 5464, 5466, 5467, 5472, 5475, 5476, 5481, 5482, 5483, 5493, 5495, 5496, 5497, 5498, 5501, 5506, 5508, 5510, 5513, 5515, 5516, 5518, 5519, 5520, 5521, 5524, 5530, 5535, 5537, 5539, 5543, 5549, 5557, 5558, 5561, 5562, 5565, 5568, 5569, 5571, 5572, 5574, 5575, 5579, 5581, 5585, 5586, 5588, 5591, 5592, 5596, 5597, 5604, 5612, 5613, 5614, 5615, 5616, 5618, 5620, 5621, 5627, 5631, 5632, 5635, 5640, 5642, 5643, 5647, 5648, 5653, 5657, 5659, 5660, 5663, 5664, 5670, 5671, 5675, 5676, 5677, 5689, 5690, 5695, 5697, 5699, 5700, 5702, 5703, 5706, 5709, 5711, 5712, 5713, 5718, 5721, 5722, 5730, 5731, 5734, 5735, 5739, 5744, 5751, 5753, 5763, 5768, 5770, 5771, 5773, 5780, 5783, 5784, 5785, 5787, 5791, 5794, 5798, 5799, 5806, 5808, 5810, 5813, 5820, 5826, 5831, 5833, 5835, 5836, 5837, 5846, 5852, 5854, 5856, 5857, 5859, 5861, 5863, 5864, 5865, 5866, 5869, 5872, 5878, 5881, 5883, 5886, 5888, 5889, 5892, 5893, 5905, 5907, 5912, 5925, 5926, 5927, 5931, 5932, 5934, 5935, 5936, 5938, 5941, 5944, 5951, 5954, 5956, 5959, 5961, 5967, 5968, 5971, 5975, 5978, 5982, 5984, 5991, 5992, 5994, 5996, 5997, 6000, 6002, 6006, 6008, 6013, 6016, 6017, 6018, 6020, 6023, 6024, 6025, 6026, 6028, 6031, 6033, 6038, 6041, 6044, 6045, 6047, 6048, 6051, 6058, 6059, 6062, 6063, 6065, 6069, 6072, 6073, 6075, 6080, 6081, 6082, 6084, 6085, 6087, 6088, 6089, 6090, 6093, 6096, 6098, 6099, 6107, 6108, 6109, 6110, 6113, 6116, 6124, 6129, 6131, 6132, 6133, 6135, 6138, 6139, 6143, 6145, 6146, 6148, 6149, 6151, 6153, 6155, 6157, 6158, 6160, 6162, 6163, 6164, 6165, 6180, 6181, 6182, 6183, 6186, 6188, 6189, 6194, 6195, 6196, 6197, 6198, 6203, 6204, 6205, 6206, 6209, 6212, 6220, 6221, 6223, 6224, 6226, 6227, 6234, 6237, 6246, 6247, 6250, 6251, 6255, 6264, 6265, 6267, 6270, 6272, 6273, 6275, 6280, 6281, 6282, 6286, 6288, 6289, 6290, 6292, 6294, 6295, 6296, 6299, 6300, 6303, 6306, 6307, 6310, 6315, 6317, 6321, 6322, 6323, 6328, 6333, 6338, 6340, 6342, 6349, 6353, 6354, 6356, 6358, 6360, 6363, 6368, 6370, 6372, 6375, 6376, 6386, 6387, 6394, 6397, 6398, 6399, 6403, 6405, 6408, 6412, 6414, 6415, 6419, 6425, 6426, 6429, 6430, 6431, 6436, 6440, 6442, 6448, 6449, 6450, 6456, 6457, 6458, 6463, 6464, 6466, 6467, 6469, 6470, 6474, 6475, 6476, 6477, 6478, 6480, 6482, 6484, 6485, 6486, 6494, 6495, 6501, 6502, 6504, 6510, 6514, 6516, 6517, 6523, 6528, 6530, 6531, 6532, 6534, 6539, 6541, 6547, 6549, 6553, 6558, 6564, 6567, 6571, 6572, 6574, 6576, 6577, 6579, 6581, 6587, 6588, 6589, 6592, 6594, 6595, 6596, 6597, 6599, 6600, 6603, 6605, 6606, 6607, 6610, 6614, 6615, 6616, 6620, 6623, 6625, 6629, 6633, 6634, 6635, 6638, 6639, 6646, 6647, 6648, 6649, 6652, 6655, 6656, 6658, 6661, 6666, 6681, 6701, 6703, 6705, 6717, 6718, 6720, 6723, 6729, 6730, 6734, 6736, 6742, 6747, 6749, 6756, 6757, 6758, 6759, 6764, 6766, 6767, 6779, 6782, 6783, 6786, 6788, 6789, 6792, 6793, 6794, 6795, 6797, 6799, 6801, 6803, 6804, 6805, 6806, 6807, 6811, 6813, 6815, 6816, 6817, 6819, 6820, 6824, 6826, 6828, 6830, 6834, 6836, 6840, 6841, 6847, 6848, 6851, 6855, 6863, 6875, 6876, 6877, 6878, 6880, 6886, 6888, 6895, 6902, 6903, 6906, 6907, 6909, 6913, 6917, 6919, 6921, 6924, 6925, 6930, 6931, 6935, 6939, 6940, 6955, 6959, 6960, 6963, 6971, 6979, 6984, 6985, 6987, 6988, 6990, 6991, 6994, 6997, 6999, 7009, 7010, 7013, 7018, 7019, 7020, 7022, 7025, 7027, 7029, 7035, 7038, 7039, 7040, 7043, 7045, 7051, 7053, 7054, 7057, 7059, 7064, 7067, 7068, 7077, 7079, 7083, 7084, 7085, 7103, 7105, 7106, 7107, 7108, 7110, 7113, 7117, 7118, 7126, 7130, 7136, 7138, 7139, 7140, 7142, 7144, 7150, 7151, 7154, 7163, 7164, 7165, 7166, 7169, 7170, 7171, 7172, 7182, 7184, 7187, 7192, 7194, 7195, 7196, 7197, 7198, 7201, 7202, 7203, 7206, 7208, 7210, 7212, 7214, 7215, 7217, 7219, 7220, 7235, 7236, 7240, 7246, 7249, 7250, 7252, 7255, 7257, 7258, 7262, 7263, 7264, 7267, 7268, 7270, 7274, 7281, 7282, 7287, 7291, 7293, 7296, 7299, 7300, 7301, 7303, 7304, 7305, 7306, 7307, 7308, 7312, 7313, 7315, 7318, 7319, 7320, 7321, 7328, 7338, 7345, 7353, 7355, 7357, 7358, 7360, 7361, 7363, 7365, 7369, 7371, 7373, 7376, 7377, 7380, 7383, 7392, 7395, 7396, 7398, 7399, 7400, 7425, 7430, 7434, 7435, 7436, 7447, 7448, 7450, 7453, 7454, 7457, 7458, 7459, 7462, 7464, 7466, 7470, 7472, 7475, 7483, 7485, 7486, 7487, 7492, 7499, 7502, 7506, 7512, 7514, 7515, 7517, 7521, 7523, 7524, 7528, 7533, 7538, 7541, 7544, 7546, 7549, 7556, 7557, 7560, 7572, 7574, 7576, 7579, 7583, 7585, 7586, 7587, 7589, 7596, 7597, 7598, 7601, 7604, 7609, 7611, 7612, 7614, 7619, 7620, 7624, 7633, 7638, 7642, 7643, 7647, 7649, 7655, 7656, 7658, 7661, 7662, 7664, 7665, 7673, 7674, 7678, 7679, 7680, 7682, 7685, 7687, 7689, 7691, 7692, 7695, 7697, 7699, 7700, 7702, 7703, 7712, 7715, 7716, 7724, 7734, 7736, 7737, 7738, 7741, 7742, 7744, 7745, 7749, 7750, 7753, 7754, 7756, 7763, 7764, 7767, 7770, 7775, 7779, 7781, 7785, 7786, 7788, 7791, 7793, 7798, 7799, 7800, 7803, 7804, 7806, 7807, 7815, 7819, 7820, 7825, 7826, 7833, 7834, 7840, 7841, 7844, 7850, 7865, 7873, 7877, 7879, 7880, 7881, 7885, 7887, 7888, 7890, 7893, 7896, 7901, 7908, 7910, 7911, 7913, 7918, 7923, 7925, 7928, 7933, 7934, 7935, 7938, 7942, 7944, 7949, 7950, 7952, 7965, 7966, 7967, 7971, 7973, 7974, 7976, 7977, 7981, 7982, 7984, 7986, 7988, 7993, 7994, 7996, 7999, 8000, 8006, 8007, 8012, 8020, 8023, 8024, 8025, 8031, 8036, 8041, 8042, 8044, 8045, 8047, 8048, 8049, 8052, 8056, 8059, 8063, 8066, 8068, 8074, 8076, 8077, 8078, 8080, 8081, 8083, 8088, 8095, 8099, 8100, 8102, 8106, 8109, 8110, 8111, 8112, 8113, 8118, 8120, 8126, 8129, 8137, 8141, 8145, 8146, 8148, 8151, 8155, 8163, 8164, 8166, 8170, 8179, 8181, 8182, 8189, 8193, 8194, 8196, 8198, 8202, 8204, 8208, 8213, 8217, 8219, 8220, 8222, 8234, 8237, 8239, 8241, 8242, 8246, 8248, 8249, 8250, 8252, 8253, 8264, 8265, 8268, 8269, 8274, 8275, 8289, 8291, 8292, 8296, 8297, 8300, 8304, 8305, 8308, 8311, 8315, 8318, 8319, 8322, 8326, 8329, 8334, 8335, 8339, 8340, 8341, 8347, 8349, 8350, 8351, 8352, 8353, 8367, 8368, 8371, 8372, 8373, 8378, 8379, 8380, 8389, 8392, 8395, 8396, 8397, 8401, 8402, 8403, 8404, 8406, 8408, 8410, 8413, 8414, 8415, 8416, 8417, 8418, 8428, 8430, 8433, 8435, 8436, 8438, 8439, 8440, 8442, 8443, 8444, 8445, 8446, 8447, 8448, 8449, 8450, 8451, 8457, 8458, 8459, 8465, 8470, 8472, 8473, 8474, 8476, 8477, 8478, 8481, 8482, 8483, 8490, 8498, 8501, 8502, 8503, 8505, 8509, 8513, 8517, 8520, 8521, 8523, 8524, 8525, 8526, 8531, 8532, 8533, 8541, 8542, 8543, 8549, 8550, 8553, 8554, 8557, 8561, 8565, 8574, 8576, 8581, 8582, 8583, 8585, 8588, 8592, 8593, 8594, 8596, 8597, 8598, 8600, 8602, 8603, 8605, 8612, 8622, 8631, 8634, 8635, 8638, 8641, 8642, 8644, 8648, 8652, 8654, 8657, 8658, 8659, 8663, 8665, 8669, 8672, 8676, 8677, 8685, 8686, 8693, 8699, 8700, 8703, 8705, 8708, 8709, 8712, 8713, 8714, 8715, 8717, 8720, 8722, 8726, 8731, 8732, 8736, 8741, 8744, 8746, 8748, 8755, 8757, 8761, 8769, 8770, 8773, 8774, 8777, 8779, 8782, 8783, 8784, 8786, 8789, 8792, 8795, 8797, 8802, 8803, 8804, 8808, 8810, 8817, 8818, 8821, 8822, 8824, 8831, 8833, 8834, 8835, 8841, 8842, 8843, 8844, 8853, 8865, 8866, 8874, 8876, 8877, 8878, 8881, 8883, 8886, 8888, 8891, 8892, 8896, 8897, 8900, 8901, 8907, 8908, 8911, 8914, 8916, 8917, 8918, 8919, 8922, 8924, 8926, 8928, 8929, 8937, 8938, 8941, 8945, 8946, 8948, 8951, 8957, 8960, 8961, 8967, 8968, 8969, 8979, 8980, 8981, 8985, 8986, 8992, 8993, 8996, 8998, 9001, 9003, 9009, 9011, 9012, 9013, 9014, 9016, 9018, 9021, 9022, 9025, 9026, 9027, 9029, 9030, 9033, 9045, 9050, 9052, 9057, 9058, 9059, 9060, 9061, 9063, 9065, 9066, 9068, 9069, 9071, 9072, 9075, 9078, 9083, 9084, 9086, 9087, 9088, 9091, 9092, 9095, 9096, 9098, 9103, 9104, 9106, 9107, 9114, 9115, 9116, 9118, 9119, 9120, 9123, 9125, 9129, 9131, 9133, 9134, 9138, 9140, 9141, 9142, 9143, 9144, 9145, 9147, 9151, 9152, 9154, 9159, 9167, 9168, 9172, 9175, 9177, 9180, 9183, 9185, 9186, 9188, 9189, 9195, 9200, 9205, 9206, 9207, 9210, 9211, 9213, 9214, 9215, 9216, 9218, 9220, 9223, 9226, 9229, 9233, 9237, 9240, 9243, 9248, 9249, 9253, 9257, 9259, 9267, 9269, 9270, 9273, 9275, 9282, 9284, 9285, 9288, 9290, 9292, 9300, 9304, 9306, 9308, 9310, 9311, 9314, 9320, 9321, 9323, 9326, 9327, 9328, 9336, 9337, 9338, 9339, 9341, 9346, 9348, 9350, 9352, 9355, 9359, 9360, 9366, 9368, 9371, 9375, 9376, 9382, 9389, 9391, 9392, 9394, 9400, 9402, 9403, 9406, 9407, 9412, 9413, 9414, 9415, 9419, 9421, 9423, 9425, 9439, 9440, 9443, 9449, 9451, 9453, 9456, 9460, 9467, 9471, 9477, 9481, 9484, 9490, 9497, 9500, 9503, 9504, 9509, 9514, 9517, 9518, 9519, 9521, 9522, 9534, 9535, 9536, 9537, 9538, 9545, 9546, 9548, 9550, 9551, 9553, 9555, 9560, 9564, 9567, 9568, 9571, 9575, 9577, 9587, 9591, 9592, 9595, 9596, 9601, 9602, 9606, 9609, 9615, 9617, 9620, 9621, 9623, 9624, 9626, 9629, 9632, 9633, 9638, 9648, 9652, 9655, 9658, 9659, 9663, 9666, 9668, 9670, 9682, 9686, 9692, 9695, 9696, 9698, 9706, 9708, 9710, 9711, 9715, 9717, 9718, 9723, 9726, 9727, 9729, 9731, 9732, 9733, 9734, 9737, 9738, 9742, 9743, 9744, 9745, 9746, 9749, 9750, 9754, 9761, 9763, 9768, 9770, 9772, 9774, 9776, 9777, 9782, 9786, 9787, 9791, 9794, 9798, 9799, 9804, 9807, 9810, 9811, 9812, 9813, 9816, 9819, 9820, 9825, 9827, 9828, 9829, 9835, 9836, 9845, 9846, 9847, 9869, 9875, 9878, 9879, 9882, 9886, 9887, 9889, 9892, 9894, 9896, 9897, 9898, 9900, 9907, 9909, 9910, 9911, 9921, 9923, 9928, 9930, 9931, 9934, 9935, 9936, 9944, 9946, 9950, 9952, 9953, 9956, 9960, 9962, 9967, 9968, 9969, 9972, 9973, 9974, 9975, 9976, 9980, 9984, 9985, 9988, 9990, 9992, 9997, 10000, 10013, 10017, 10018, 10019, 10022, 10026, 10027, 10033, 10040, 10041, 10047, 10049, 10051, 10054, 10055, 10058, 10059, 10060, 10062, 10063, 10064, 10066, 10072, 10075, 10077, 10078, 10080, 10081, 10083, 10087, 10090, 10091, 10092, 10095, 10097, 10098, 10103, 10106, 10110, 10114, 10115, 10116, 10117, 10120, 10122, 10125, 10128, 10129, 10131, 10135, 10136, 10137, 10143, 10151, 10158, 10160, 10163, 10165, 10166, 10168, 10169, 10174, 10176, 10178, 10181, 10192, 10193, 10194, 10196, 10199, 10206, 10207, 10214, 10217, 10218, 10219, 10220, 10221, 10222, 10223, 10224, 10228, 10230, 10231, 10233, 10236, 10237, 10240, 10247, 10252, 10253, 10258, 10259, 10260, 10263, 10266, 10269, 10275, 10276, 10284, 10286, 10292, 10293, 10295, 10300, 10302, 10306, 10307, 10311, 10312, 10314, 10315, 10318, 10325, 10326, 10327, 10330, 10331, 10333, 10334, 10335, 10336, 10340, 10341, 10345, 10346, 10353, 10356, 10357, 10361, 10362, 10364, 10371, 10373, 10375, 10376, 10380, 10381, 10384, 10392, 10397, 10398, 10399, 10401, 10402, 10408, 10413, 10414, 10416, 10417, 10419, 10423, 10425, 10435, 10436, 10446, 10447, 10449, 10450, 10452, 10453, 10456, 10460, 10463, 10464, 10465, 10468, 10469, 10471, 10472, 10473, 10474, 10480, 10487, 10488, 10492, 10493, 10494, 10495, 10498, 10504, 10508, 10514, 10518, 10522, 10523, 10527, 10528, 10530, 10531, 10532, 10535, 10536, 10537, 10540, 10541, 10542, 10543, 10544, 10548, 10549, 10550, 10551, 10553, 10555, 10556, 10560, 10563, 10564, 10566, 10567, 10571, 10577, 10581, 10582, 10583, 10593, 10595, 10596, 10597, 10599, 10601, 10605, 10608, 10615, 10616, 10617, 10621, 10622, 10626, 10636, 10640, 10643, 10645, 10646, 10650, 10651, 10652, 10657, 10668, 10669, 10671, 10676, 10678, 10679, 10682, 10683, 10684, 10685, 10686, 10689, 10694, 10700, 10701, 10705, 10711, 10721, 10723, 10726, 10729, 10734, 10736, 10737, 10738, 10740, 10741, 10744, 10752, 10753, 10754, 10756, 10757, 10763, 10768, 10770, 10772, 10774, 10775, 10778, 10779, 10780, 10785, 10787, 10788, 10795, 10801, 10802, 10803, 10804, 10809, 10810, 10811, 10815, 10822, 10823, 10824, 10825, 10827, 10833, 10836, 10837, 10838, 10839, 10841, 10843, 10850, 10851, 10853, 10854, 10856, 10857, 10858, 10863, 10867, 10870, 10874, 10877, 10878, 10886, 10887, 10897, 10901, 10902, 10911, 10913, 10918, 10920, 10924, 10926, 10927, 10928, 10929, 10930, 10933, 10934, 10938, 10940, 10947, 10966, 10967, 10972, 10974, 10976, 10977, 10979, 10988, 10993, 10996, 10999, 11002, 11004, 11008, 11015, 11017, 11021, 11022, 11023, 11024, 11030, 11032, 11040, 11046, 11047, 11050, 11051, 11053, 11058, 11066, 11078, 11082, 11083, 11090, 11095, 11100, 11107, 11109, 11111, 11114, 11116, 11117, 11118, 11119, 11122, 11123, 11124, 11126, 11128, 11129, 11133, 11136, 11137, 11138, 11147, 11149, 11150, 11151, 11152, 11153, 11154, 11160, 11163, 11172, 11177, 11179, 11180, 11181, 11184, 11187, 11188, 11190, 11191, 11192, 11193, 11194, 11198, 11202, 11204, 11214, 11217, 11218, 11222, 11228, 11229, 11230, 11233, 11235, 11236, 11237, 11238, 11239, 11242, 11243, 11246, 11247, 11251, 11253, 11254, 11255, 11256, 11258, 11260, 11263, 11266, 11274, 11278, 11282, 11291, 11292, 11293, 11295, 11298, 11304, 11315, 11316, 11318, 11328, 11329, 11330, 11331, 11332, 11337, 11339, 11340, 11345, 11346, 11348, 11349, 11352, 11358, 11359, 11362, 11363, 11364, 11365, 11366, 11369, 11371, 11373, 11377, 11380, 11382, 11385, 11387, 11391, 11394, 11395, 11398, 11401, 11404, 11405, 11406, 11408, 11417, 11424, 11430, 11431, 11435, 11438, 11439, 11440, 11443, 11446, 11447, 11448, 11449, 11451, 11459, 11465, 11466, 11472, 11477, 11487, 11489, 11490, 11492, 11496, 11498, 11500, 11501, 11505, 11506, 11507, 11508, 11520, 11521, 11523, 11524, 11526, 11527, 11533, 11534, 11538, 11540, 11544, 11546, 11548, 11550, 11551, 11553, 11558, 11560, 11561, 11567, 11568, 11570, 11571, 11576, 11577, 11578, 11585, 11586, 11588, 11593, 11595, 11596, 11597, 11599, 11603, 11604, 11605, 11606, 11607, 11610, 11611, 11615, 11617, 11618, 11619, 11621, 11623, 11625, 11628, 11634, 11636, 11638, 11642, 11647, 11649, 11650, 11655, 11656, 11658, 11659, 11663, 11668, 11669, 11678, 11681, 11682, 11688, 11691, 11692, 11694, 11695, 11696, 11698, 11701, 11703, 11705, 11707, 11712, 11718, 11720, 11721, 11725, 11730, 11731, 11733, 11736, 11737, 11743, 11744, 11748, 11753, 11760, 11761, 11765, 11771, 11776, 11777, 11781, 11782, 11783, 11785, 11786, 11789, 11792, 11794, 11797, 11799, 11800, 11809, 11811, 11818, 11820, 11823, 11830, 11836, 11837, 11839, 11840, 11842, 11846, 11847, 11848, 11851, 11854, 11856, 11858, 11861, 11863, 11864, 11865, 11868, 11872, 11876, 11877, 11878, 11881, 11886, 11887, 11889, 11891, 11892, 11894, 11895, 11901, 11902, 11906, 11909, 11911, 11913, 11914, 11915, 11916, 11917, 11918, 11919, 11920, 11921, 11922, 11923, 11926, 11928, 11929, 11930, 11933, 11934, 11940, 11943, 11945, 11947, 11949, 11950, 11953, 11956, 11959, 11960, 11961, 11962, 11963, 11965, 11974, 11975, 11976, 11977, 11978, 11979, 11980, 11982, 11983, 11987, 11988, 11989, 11993, 11997, 11998, 11999, 12004, 12008, 12014, 12015, 12017, 12018, 12019, 12020, 12021, 12023, 12024, 12026, 12027, 12032, 12033, 12042, 12043, 12044, 12051, 12059, 12083, 12092, 12093, 12098, 12102, 12104, 12106, 12108, 12109, 12110, 12112, 12114, 12115, 12117, 12118, 12126, 12127, 12128, 12129, 12134, 12137, 12138, 12139, 12143, 12149, 12151, 12161, 12165, 12166, 12171, 12174, 12175, 12181, 12183, 12185, 12197, 12204, 12207, 12208, 12215, 12217, 12219, 12223, 12227, 12228, 12229, 12234, 12241, 12245, 12249, 12250, 12252, 12253, 12256, 12259, 12260, 12263, 12267, 12268, 12269, 12274, 12278, 12281, 12283, 12284, 12286, 12287, 12293, 12297, 12298, 12304, 12311, 12313, 12314, 12315, 12317, 12321, 12323, 12324, 12326, 12329, 12333, 12337, 12340, 12343, 12344, 12345, 12347, 12356, 12359, 12364, 12368, 12369, 12370, 12372, 12374, 12379, 12380, 12381, 12383, 12391, 12397, 12399, 12400, 12401, 12403, 12404, 12405, 12406, 12410, 12411, 12412, 12414, 12416, 12418, 12420, 12421, 12424, 12426, 12427, 12428, 12429, 12437, 12439, 12440, 12441, 12442, 12445, 12447, 12451, 12454, 12455, 12456, 12457, 12461, 12462, 12465, 12467, 12468, 12472, 12473, 12476, 12478, 12481, 12482, 12487, 12488, 12489, 12491, 12494, 12495, 12497, 12503, 12504, 12508, 12513, 12515, 12521, 12523, 12525, 12531, 12536, 12539, 12546, 12547, 12549, 12554, 12555, 12557, 12559, 12561, 12562, 12563, 12564, 12565, 12567, 12568, 12572, 12585, 12588, 12590, 12597, 12600, 12605, 12608, 12609, 12611, 12616, 12619, 12623, 12626, 12628, 12631, 12633, 12634, 12636, 12638, 12639, 12641, 12645, 12649, 12651, 12655, 12658, 12663, 12668, 12670, 12671, 12672, 12675, 12679, 12680, 12681, 12682, 12684, 12691, 12693, 12698, 12701, 12702, 12707, 12711, 12713, 12718, 12719, 12722, 12729, 12731, 12732, 12733, 12735, 12737, 12738, 12739, 12740, 12742, 12744, 12749, 12751, 12752, 12754, 12755, 12758, 12760, 12761, 12764, 12766, 12769, 12771, 12783, 12788, 12790, 12797, 12801, 12802, 12805, 12810, 12812, 12813, 12814, 12819, 12820, 12822, 12824, 12826, 12827, 12828, 12834, 12836, 12838, 12839, 12844, 12849, 12853, 12854, 12860, 12866, 12869, 12882, 12883, 12884, 12887, 12895, 12898, 12900, 12904, 12905, 12906, 12912, 12916, 12917, 12918, 12920, 12921, 12926, 12932, 12933, 12938, 12939, 12942, 12946, 12947, 12950, 12953, 12961, 12963, 12966, 12968, 12969, 12972, 12973, 12974, 12975, 12977, 12978, 12982, 12983, 12987, 12989, 12990, 12991, 12994, 13004, 13006, 13007, 13010, 13011, 13014, 13017, 13022, 13023, 13024, 13030, 13032, 13035, 13038, 13040, 13044, 13049, 13050, 13053, 13055, 13056, 13060, 13061, 13065, 13066, 13067, 13069, 13070, 13074, 13077, 13079, 13085, 13086, 13087, 13095, 13100, 13101, 13102, 13105, 13106, 13112, 13114, 13115, 13116, 13117, 13118, 13124, 13128, 13135, 13142, 13147, 13151, 13156, 13160, 13169, 13175, 13182, 13189, 13191, 13197, 13199, 13206, 13209, 13210, 13212, 13213, 13215, 13217, 13221, 13222, 13224, 13227, 13230, 13232, 13234, 13235, 13236, 13237, 13238, 13239, 13243, 13249, 13251, 13255, 13258, 13259, 13260, 13261, 13263, 13267, 13268, 13269, 13270, 13273, 13276, 13279, 13280, 13281, 13285, 13291, 13293, 13295, 13296, 13298, 13303, 13304, 13313, 13315, 13317, 13319, 13320, 13321, 13323, 13326, 13328, 13330, 13338, 13347, 13348, 13349, 13353, 13354, 13358, 13361, 13368, 13369, 13384, 13393, 13396, 13397, 13401, 13410, 13411, 13414, 13416, 13419, 13420, 13423, 13424, 13428, 13429, 13431, 13433, 13439, 13440, 13444, 13446, 13449, 13451, 13454, 13456, 13460, 13463, 13466, 13468, 13469, 13472, 13473, 13475, 13494, 13496, 13498, 13499, 13500, 13501, 13503, 13504, 13506, 13510, 13513, 13514, 13515, 13516, 13517, 13519, 13520, 13521, 13529, 13530, 13532, 13535, 13536, 13540, 13543, 13544, 13546, 13547, 13549, 13552, 13556, 13568, 13569, 13574, 13579, 13580, 13583, 13584, 13587, 13589, 13597, 13598, 13599, 13601, 13602, 13603, 13621, 13623, 13627, 13631, 13632, 13634, 13637, 13638, 13641, 13643, 13647, 13650, 13652, 13654, 13660, 13661, 13662, 13663, 13669, 13671, 13675, 13677, 13678, 13683, 13684, 13686, 13688, 13693, 13698, 13699, 13700, 13703, 13706, 13710, 13712, 13713, 13715, 13716, 13720, 13721, 13725, 13727, 13728, 13729, 13730, 13733, 13737, 13738, 13739, 13742, 13745, 13747, 13748, 13750, 13751, 13756, 13764, 13766, 13767, 13773, 13775, 13781, 13783, 13786, 13787, 13790, 13791, 13794, 13795, 13796, 13798, 13802, 13809, 13816, 13817, 13818, 13819, 13820, 13822, 13823, 13824, 13827, 13830, 13831, 13833, 13834, 13835, 13843, 13852, 13856, 13859, 13860, 13862, 13866, 13869, 13870, 13872, 13873, 13874, 13877, 13883, 13886, 13888, 13891, 13892, 13894, 13896, 13898, 13901, 13904, 13906, 13909, 13910, 13911, 13917, 13919, 13923, 13925, 13927, 13930, 13933, 13938, 13944, 13947, 13948, 13952, 13953, 13954, 13956, 13961, 13963, 13965, 13969, 13970, 13971, 13975, 13976, 13980, 13983, 13984, 13988, 13990, 13991, 13994, 13999, 14000, 14003, 14009, 14013, 14014, 14016, 14017, 14018, 14022, 14027, 14030, 14031, 14036, 14040, 14041, 14043, 14049, 14050, 14051, 14052, 14054, 14062, 14063, 14066, 14069, 14070, 14071, 14073, 14081, 14084, 14086, 14088, 14091, 14092, 14093, 14094, 14102, 14105, 14106, 14107, 14110, 14111, 14115, 14116, 14118, 14122, 14126, 14128, 14129, 14130, 14132, 14133, 14134, 14138, 14139, 14142, 14143, 14145, 14146, 14148, 14149, 14150.

Promoters expressing in the flag leaf at the VI stage include SEQ IDs: 1, 3, 4, 7, 11, 13, 14, 31, 34, 36, 48, 51, 53, 56, 65, 68, 88, 93, 96, 97, 101, 102, 103, 107, 110, 111, 112, 126, 129, 130, 131, 132, 133, 143, 146, 148, 152, 156, 157, 159, 160, 162, 165, 175, 176, 177, 181, 183, 186, 187, 194, 195, 196, 197, 199, 202, 203, 204, 211, 230, 232, 234, 235, 236, 240, 241, 243, 244, 246, 249, 250, 251, 257, 259, 262, 264, 269, 270, 271, 273, 274, 279, 280, 281, 284, 286, 288, 289, 294, 295, 299, 305, 306, 307, 316, 318, 319, 320, 321, 328, 329, 332, 335, 341, 346, 349, 354, 357, 358, 360, 364, 378, 379, 388, 396, 401, 402, 406, 407, 419, 420, 423, 424, 429, 431, 434, 444, 452, 456, 461, 463, 466, 468, 471, 473, 479, 481, 483, 484, 485, 488, 498, 501, 502, 504, 507, 509, 512, 513, 514, 516, 517, 520, 525, 529, 532, 533, 534, 538, 541, 542, 544, 546, 547, 553, 554, 557, 560, 564, 565, 569, 573, 585, 591, 598, 599, 608, 611, 613, 614, 620, 623, 630, 631, 633, 634, 635, 643, 650, 653, 656, 662, 663, 666, 670, 674, 676, 677, 681, 683, 686, 693, 699, 705, 717, 718, 719, 722, 723, 724, 727, 733, 734, 735, 736, 740, 742, 753, 757, 765, 768, 770, 771, 782, 783, 791, 792, 793, 794, 795, 797, 800, 806, 808, 813, 820, 821, 829, 830, 833, 839, 840, 842, 844, 845, 855, 859, 860, 862, 863, 865, 868, 869, 877, 878, 883, 884, 885, 887, 888, 890, 891, 892, 895, 897, 898, 902, 903, 907, 911, 912, 913, 916, 917, 919, 920, 925, 929, 931, 936, 938, 943, 944, 951, 953, 954, 958, 962, 964, 966, 969, 971, 974, 977, 979, 980, 981, 982, 987, 989, 991, 994, 995, 997, 999, 1006, 1007, 1009, 1011, 1014, 1017, 1022, 1026, 1039, 1041, 1042, 1043, 1045, 1047, 1051, 1052, 1054, 1055, 1056, 1064, 1065, 1068, 1069, 1077, 1078, 1087, 1088, 1089, 1092, 1095, 1098, 1103, 1104, 1106, 1108, 1110, 1111, 1112, 1114, 1118, 1119, 1120, 1122, 1125, 1127, 1130, 1133, 1136, 1137, 1146, 1147, 1148, 1155, 1162, 1165, 1169, 1171, 1174, 1175, 1176, 1178, 1185, 1189, 1191, 1196, 1199, 1201, 1205, 1208, 1210, 1214, 1218, 1223, 1225, 1228, 1230, 1231, 1233, 1234, 1235, 1236, 1239, 1241, 1243, 1244, 1248, 1249, 1250, 1252, 1253, 1256, 1257, 1262, 1264, 1265, 1272, 1275, 1281, 1282, 1283, 1285, 1286, 1292, 1295, 1297, 1298, 1303, 1306, 1307, 1312, 1316, 1317, 1325, 1327, 1331, 1334, 1335, 1337, 1339, 1345, 1346, 1347, 1349, 1351, 1354, 1355, 1360, 1364, 1367, 1371, 1373, 1376, 1377, 1380, 1381, 1382, 1386, 1388, 1393, 1394, 1396, 1398, 1404, 1405, 1409, 1410, 1412, 1420, 1421, 1426, 1438, 1439, 1440, 1442, 1451, 1453, 1454, 1455, 1458, 1459, 1468, 1474, 1475, 1481, 1486, 1487, 1488, 1490, 1496, 1499, 1501, 1503, 1514, 1517, 1518, 1527, 1530, 1536, 1539, 1540, 1543, 1545, 1546, 1547, 1549, 1550, 1556, 1560, 1571, 1578, 1584, 1586, 1589, 1590, 1593, 1594, 1599, 1600, 1602, 1605, 1612, 1614, 1615, 1616, 1622, 1635, 1636, 1637, 1638, 1639, 1648, 1652, 1653, 1654, 1658, 1661, 1662, 1669, 1671, 1675, 1676, 1677, 1680, 1683, 1685, 1688, 1689, 1691, 1696, 1698, 1705, 1707, 1708, 1714, 1717, 1721, 1723, 1731, 1732, 1735, 1740, 1755, 1759, 1764, 1771, 1776, 1778, 1779, 1785, 1816, 1820, 1823, 1828, 1830, 1832, 1834, 1835, 1840, 1845, 1850, 1852, 1854, 1855, 1858, 1859, 1868, 1869, 1870, 1872, 1873, 1882, 1888, 1891, 1895, 1897, 1902, 1903, 1904, 1905, 1906, 1910, 1912, 1914, 1916, 1918, 1920, 1922, 1923, 1924, 1933, 1934, 1936, 1940, 1944, 1950, 1952, 1955, 1973, 1981, 1986, 1990, 1991, 1993, 1999, 2000, 2003, 2007, 2008, 2010, 2012, 2013, 2014, 2015, 2017, 2026, 2031, 2033, 2034, 2039, 2041, 2043, 2045, 2048, 2049, 2060, 2062, 2064, 2066, 2067, 2069, 2072, 2074, 2075, 2077, 2081, 2082, 2083, 2089, 2091, 2094, 2096, 2098, 2099, 2101, 2103, 2104, 2107, 2109, 2112, 2113, 2122, 2132, 2133, 2137, 2140, 2142, 2144, 2147, 2150, 2152, 2157, 2158, 2161, 2163, 2164, 2165, 2168, 2170, 2172, 2178, 2179, 2182, 2185, 2190, 2193, 2196, 2201, 2202, 2203, 2206, 2215, 2216, 2221, 2222, 2226, 2227, 2229, 2230, 2231, 2233, 2237, 2240, 2252, 2253, 2260, 2261, 2262, 2263, 2279, 2281, 2283, 2288, 2293, 2295, 2296, 2297, 2298, 2300, 2303, 2304, 2305, 2306, 2308, 2309, 2310, 2314, 2322, 2323, 2325, 2328, 2329, 2333, 2335, 2339, 2342, 2346, 2348, 2349, 2351, 2352, 2354, 2359, 2360, 2361, 2362, 2367, 2371, 2375, 2377, 2379, 2382, 2384, 2385, 2396, 2398, 2401, 2403, 2405, 2406, 2408, 2411, 2412, 2418, 2423, 2431, 2435, 2437, 2441, 2442, 2443, 2445, 2450, 2452, 2453, 2454, 2465, 2470, 2471, 2472, 2476, 2479, 2480, 2482, 2483, 2492, 2494, 2495, 2498, 2500, 2504, 2505, 2507, 2509, 2510, 2511, 2512, 2514, 2517, 2525, 2527, 2528, 2529, 2531, 2532, 2533, 2538, 2539, 2547, 2548, 2549, 2552, 2554, 2555, 2556, 2557, 2560, 2567, 2568, 2573, 2578, 2579, 2581, 2583, 2588, 2589, 2590, 2594, 2599, 2601, 2616, 2617, 2619, 2626, 2627, 2632, 2634, 2636, 2637, 2639, 2644, 2648, 2651, 2653, 2654, 2655, 2663, 2671, 2675, 2679, 2680, 2684, 2685, 2687, 2689, 2691, 2700, 2704, 2707, 2712, 2719, 2722, 2723, 2725, 2726, 2728, 2729, 2735, 2737, 2739, 2740, 2749, 2753, 2756, 2757, 2764, 2768, 2770, 2773, 2780, 2786, 2787, 2794, 2801, 2802, 2805, 2812, 2814, 2819, 2822, 2826, 2827, 2829, 2830, 2833, 2837, 2839, 2840, 2844, 2845, 2850, 2857, 2858, 2861, 2864, 2865, 2866, 2871, 2873, 2876, 2879, 2885, 2886, 2888, 2889, 2890, 2901, 2902, 2903, 2905, 2906, 2909, 2910, 2911, 2923, 2932, 2933, 2934, 2935, 2938, 2944, 2945, 2946, 2948, 2950, 2952, 2953, 2955, 2959, 2960, 2963, 2966, 2968, 2969, 2976, 2979, 2980, 2994, 2998, 3000, 3002, 3007, 3015, 3020, 3023, 3038, 3039, 3042, 3044, 3048, 3049, 3051, 3053, 3055, 3062, 3064, 3067, 3070, 3076, 3080, 3081, 3083, 3084, 3087, 3088, 3096, 3101, 3105, 3106, 3109, 3110, 3112, 3114, 3118, 3120, 3121, 3123, 3126, 3127, 3128, 3137, 3139, 3143, 3145, 3147, 3150, 3153, 3154, 3167, 3170, 3173, 3181, 3187, 3192, 3199, 3205, 3210, 3212, 3214, 3220, 3221, 3224, 3225, 3226, 3227, 3228, 3236, 3237, 3240, 3244, 3245, 3246, 3250, 3252, 3255, 3261, 3266, 3268, 3271, 3273, 3280, 3282, 3283, 3286, 3288, 3290, 3294, 3295, 3299, 3303, 3307, 3308, 3312, 3313, 3329, 3331, 3332, 3333, 3335, 3345, 3349, 3353, 3355, 3358, 3359, 3360, 3361, 3363, 3370, 3374, 3377, 3379, 3380, 3383, 3386, 3387, 3396, 3397, 3399, 3402, 3404, 3409, 3414, 3415, 3416, 3418, 3420, 3422, 3424, 3428, 3429, 3438, 3440, 3441, 3445, 3446, 3447, 3449, 3450, 3451, 3452, 3455, 3458, 3460, 3461, 3464, 3465, 3466, 3470, 3471, 3473, 3474, 3475, 3477, 3482, 3486, 3487, 3488, 3490, 3491, 3503, 3504, 3506, 3509, 3510, 3516, 3517, 3518, 3533, 3536, 3537, 3541, 3544, 3545, 3548, 3551, 3552, 3554, 3558, 3560, 3561, 3562, 3563, 3569, 3572, 3574, 3576, 3577, 3589, 3592, 3593, 3594, 3595, 3596, 3597, 3598, 3600, 3603, 3606, 3607, 3616, 3618, 3620, 3621, 3624, 3629, 3633, 3637, 3640, 3642, 3643, 3644, 3645, 3646, 3654, 3655, 3657, 3659, 3660, 3661, 3663, 3667, 3668, 3669, 3671, 3672, 3697, 3707, 3710, 3713, 3715, 3717, 3718, 3719, 3721, 3724, 3731, 3732, 3738, 3739, 3748, 3749, 3754, 3760, 3761, 3762, 3764, 3765, 3766, 3778, 3788, 3790, 3791, 3792, 3794, 3796, 3798, 3808, 3812, 3816, 3820, 3823, 3825, 3828, 3829, 3831, 3832, 3833, 3834, 3836, 3839, 3842, 3843, 3844, 3845, 3847, 3849, 3858, 3860, 3862, 3866, 3867, 3868, 3870, 3871, 3872, 3876, 3882, 3883, 3887, 3889, 3890, 3891, 3895, 3896, 3899, 3908, 3910, 3911, 3912, 3914, 3917, 3923, 3924, 3929, 3947, 3950, 3954, 3959, 3962, 3967, 3968, 3972, 3974, 3975, 3983, 3985, 3990, 3991, 3996, 3997, 4000, 4001, 4002, 4003, 4006, 4008, 4014, 4021, 4022, 4024, 4026, 4032, 4038, 4039, 4040, 4044, 4045, 4047, 4048, 4049, 4050, 4051, 4052, 4054, 4056, 4057, 4058, 4060, 4068, 4069, 4072, 4077, 4078, 4079, 4081, 4084, 4087, 4092, 4099, 4102, 4103, 4105, 4108, 4110, 4111, 4113, 4122, 4133, 4139, 4143, 4148, 4149, 4150, 4154, 4156, 4158, 4160, 4161, 4162, 4163, 4165, 4166, 4167, 4168, 4169, 4171, 4175, 4178, 4184, 4188, 4189, 4190, 4198, 4201, 4202, 4205, 4206, 4210, 4211, 4214, 4221, 4227, 4228, 4233, 4235, 4241, 4250, 4251, 4257, 4258, 4260, 4263, 4266, 4270, 4272, 4275, 4276, 4279, 4292, 4294, 4297, 4298, 4301, 4302, 4304, 4309, 4312, 4317, 4320, 4324, 4329, 4330, 4331, 4335, 4336, 4337, 4341, 4343, 4344, 4347, 4349, 4352, 4354, 4359, 4360, 4365, 4369, 4374, 4378, 4383, 4388, 4391, 4393, 4394, 4397, 4404, 4415, 4419, 4422, 4423, 4426, 4436, 4439, 4442, 4443, 4444, 4446, 4448, 4449, 4450, 4453, 4457, 4460, 4461, 4462, 4463, 4464, 4466, 4468, 4472, 4479, 4485, 4491, 4492, 4498, 4506, 4507, 4508, 4512, 4514, 4515, 4518, 4519, 4522, 4531, 4542, 4543, 4548, 4549, 4554, 4558, 4562, 4565, 4566, 4567, 4568, 4575, 4582, 4586, 4588, 4590, 4591, 4594, 4595, 4596, 4601, 4604, 4606, 4608, 4621, 4625, 4633, 4635, 4641, 4643, 4644, 4645, 4647, 4650, 4651, 4659, 4666, 4667, 4669, 4670, 4671, 4677, 4680, 4682, 4685, 4687, 4694, 4697, 4699, 4700, 4702, 4705, 4708, 4712, 4719, 4721, 4725, 4729, 4730, 4732, 4737, 4738, 4740, 4741, 4747, 4748, 4750, 4751, 4754, 4756, 4761, 4762, 4763, 4765, 4772, 4775, 4779, 4789, 4790, 4791, 4795, 4800, 4803, 4804, 4813, 4817, 4818, 4820, 4822, 4823, 4824, 4828, 4829, 4833, 4834, 4836, 4837, 4838, 4857, 4861, 4862, 4864, 4870, 4872, 4878, 4880, 4881, 4887, 4888, 4891, 4895, 4900, 4901, 4902, 4904, 4905, 4909, 4912, 4914, 4917, 4920, 4923, 4924, 4926, 4930, 4931, 4935, 4938, 4947, 4950, 4971, 4972, 4973, 4979, 4980, 4981, 4984, 4988, 4989, 4990, 4992, 4993, 4994, 4996, 5000, 5007, 5010, 5026, 5029, 5030, 5034, 5037, 5039, 5040, 5042, 5044, 5046, 5052, 5053, 5054, 5057, 5059, 5060, 5061, 5063, 5067, 5068, 5072, 5074, 5088, 5089, 5091, 5095, 5100, 5102, 5106, 5111, 5114, 5122, 5123, 5129, 5132, 5140, 5143, 5144, 5145, 5147, 5149, 5152, 5153, 5154, 5157, 5164, 5168, 5174, 5180, 5181, 5182, 5185, 5190, 5192, 5196, 5198, 5199, 5208, 5217, 5219, 5225, 5229, 5230, 5234, 5240, 5241, 5248, 5249, 5250, 5251, 5255, 5258, 5263, 5264, 5265, 5266, 5267, 5273, 5275, 5276, 5280, 5281, 5283, 5292, 5299, 5300, 5301, 5303, 5308, 5311, 5313, 5317, 5319, 5324, 5327, 5329, 5330, 5332, 5334, 5341, 5346, 5347, 5348, 5350, 5351, 5359, 5361, 5363, 5364, 5366, 5367, 5372, 5379, 5386, 5388, 5389, 5393, 5394, 5396, 5397, 5403, 5405, 5411, 5414, 5417, 5426, 5427, 5431, 5437, 5438, 5439, 5448, 5449, 5450, 5452, 5456, 5457, 5458, 5459, 5463, 5464, 5467, 5469, 5472, 5474, 5475, 5476, 5479, 5481, 5482, 5483, 5487, 5493, 5495, 5496, 5498, 5501, 5506, 5508, 5510, 5512, 5513, 5515, 5516, 5517, 5518, 5519, 5520, 5521, 5524, 5530, 5531, 5535, 5536, 5537, 5549, 5557, 5565, 5568, 5569, 5572, 5574, 5575, 5583, 5585, 5588, 5589, 5591, 5596, 5604, 5612, 5613, 5614, 5616, 5620, 5627, 5632, 5633, 5635, 5640, 5642, 5643, 5647, 5656, 5657, 5659, 5660, 5663, 5675, 5676, 5677, 5680, 5688, 5689, 5695, 5697, 5699, 5700, 5702, 5703, 5706, 5709, 5711, 5712, 5713, 5718, 5721, 5722, 5730, 5731, 5734, 5735, 5739, 5748, 5751, 5756, 5763, 5764, 5768, 5771, 5780, 5783, 5784, 5786, 5787, 5788, 5789, 5791, 5794, 5806, 5807, 5809, 5810, 5813, 5817, 5820, 5822, 5828, 5831, 5833, 5834, 5835, 5836, 5837, 5839, 5852, 5853, 5854, 5855, 5861, 5863, 5864, 5865, 5866, 5869, 5870, 5872, 5875, 5878, 5880, 5881, 5883, 5884, 5886, 5887, 5888, 5889, 5891, 5892, 5893, 5905, 5907, 5912, 5919, 5925, 5926, 5927, 5932, 5934, 5936, 5941, 5951, 5954, 5956, 5959, 5961, 5968, 5971, 5978, 5982, 5984, 5989, 5991, 5992, 5994, 5996, 5997, 6000, 6002, 6006, 6008, 6009, 6010, 6013, 6014, 6016, 6017, 6018, 6020, 6023, 6025, 6026, 6028, 6031, 6033, 6038, 6041, 6044, 6045, 6047, 6051, 6058, 6059, 6060, 6061, 6062, 6063, 6072, 6073, 6074, 6080, 6081, 6082, 6083, 6084, 6085, 6087, 6088, 6090, 6092, 6093, 6098, 6099, 6107, 6108, 6109, 6110, 6113, 6116, 6118, 6124, 6129, 6131, 6132, 6133, 6135, 6138, 6145, 6146, 6147, 6148, 6149, 6151, 6157, 6158, 6160, 6162, 6163, 6165, 6173, 6180, 6181, 6182, 6183, 6188, 6189, 6196, 6197, 6198, 6203, 6204, 6205, 6206, 6212, 6220, 6221, 6223, 6224, 6234, 6246, 6247, 6250, 6251, 6255, 6262, 6264, 6265, 6267, 6272, 6273, 6280, 6281, 6282, 6286, 6288, 6289, 6292, 6293, 6299, 6300, 6303, 6306, 6309, 6310, 6311, 6317, 6322, 6328, 6333, 6338, 6340, 6342, 6349, 6354, 6356, 6358, 6360, 6363, 6365, 6368, 6370, 6372, 6375, 6397, 6403, 6404, 6405, 6408, 6412, 6414, 6415, 6419, 6420, 6425, 6426, 6428, 6429, 6436, 6440, 6442, 6448, 6456, 6457, 6458, 6463, 6464, 6466, 6467, 6468, 6469, 6474, 6475, 6476, 6477, 6478, 6480, 6482, 6484, 6485, 6486, 6494, 6501, 6502, 6504, 6506, 6510, 6517, 6519, 6523, 6530, 6531, 6532, 6534, 6535, 6541, 6543, 6547, 6548, 6549, 6553, 6554, 6555, 6558, 6559, 6568, 6571, 6572, 6574, 6577, 6587, 6588, 6592, 6594, 6595, 6596, 6597, 6599, 6600, 6605, 6606, 6607, 6609, 6610, 6614, 6617, 6620, 6623, 6629, 6633, 6634, 6635, 6639, 6644, 6646, 6647, 6649, 6652, 6655, 6656, 6658, 6666, 6671, 6672, 6681, 6682, 6695, 6703, 6704, 6705, 6718, 6720, 6729, 6730, 6736, 6747, 6749, 6756, 6757, 6759, 6764, 6778, 6781, 6783, 6786, 6788, 6791, 6794, 6795, 6798, 6799, 6803, 6804, 6805, 6811, 6813, 6816, 6817, 6819, 6820, 6826, 6830, 6834, 6836, 6841, 6847, 6848, 6851, 6863, 6868, 6874, 6875, 6877, 6879, 6881, 6882, 6883, 6886, 6888, 6902, 6903, 6907, 6909, 6917, 6919, 6921, 6924, 6925, 6930, 6931, 6936, 6939, 6940, 6955, 6959, 6960, 6963, 6971, 6984, 6987, 6988, 6990, 6991, 6999, 7009, 7013, 7019, 7020, 7022, 7025, 7027, 7029, 7033, 7035, 7038, 7039, 7040, 7043, 7045, 7048, 7049, 7053, 7054, 7057, 7059, 7060, 7062, 7068, 7072, 7073, 7075, 7077, 7084, 7096, 7097, 7105, 7106, 7107, 7108, 7113, 7117, 7118, 7126, 7130, 7136, 7138, 7139, 7140, 7144, 7150, 7151, 7154, 7163, 7164, 7165, 7166, 7169, 7171, 7172, 7182, 7184, 7187, 7191, 7194, 7197, 7201, 7202, 7206, 7207, 7208, 7209, 7210, 7211, 7212, 7214, 7215, 7217, 7220, 7235, 7236, 7244, 7245, 7249, 7250, 7255, 7258, 7262, 7263, 7264, 7268, 7270, 7274, 7281, 7282, 7287, 7291, 7292, 7293, 7296, 7298, 7300, 7301, 7303, 7306, 7307, 7308, 7311, 7312, 7315, 7318, 7320, 7321, 7328, 7334, 7337, 7338, 7339, 7340, 7345, 7355, 7357, 7361, 7363, 7365, 7371, 7373, 7376, 7377, 7383, 7386, 7395, 7398, 7399, 7400, 7415, 7418, 7425, 7430, 7436, 7437, 7453, 7454, 7457, 7459, 7466, 7470, 7472, 7476, 7481, 7483, 7484, 7485, 7486, 7492, 7493, 7499, 7502, 7503, 7504, 7506, 7512, 7515, 7517, 7523, 7524, 7528, 7545, 7546, 7553, 7556, 7557, 7559, 7572, 7574, 7576, 7579, 7583, 7585, 7586, 7587, 7589, 7596, 7597, 7604, 7607, 7609, 7611, 7614, 7618, 7619, 7624, 7625, 7633, 7638, 7642, 7649, 7652, 7655, 7656, 7658, 7662, 7664, 7665, 7671, 7672, 7673, 7674, 7682, 7685, 7687, 7689, 7692, 7695, 7699, 7700, 7703, 7704, 7707, 7712, 7715, 7716, 7724, 7729, 7730, 7734, 7736, 7737, 7738, 7740, 7741, 7742, 7744, 7745, 7749, 7753, 7754, 7763, 7764, 7767, 7776, 7777, 7778, 7779, 7780, 7781, 7786, 7787, 7788, 7791, 7793, 7798, 7799, 7800, 7803, 7804, 7806, 7807, 7819, 7820, 7833, 7840, 7841, 7844, 7845, 7857, 7860, 7865, 7873, 7875, 7877, 7878, 7880, 7885, 7888, 7890, 7893, 7896, 7901, 7908, 7910, 7911, 7913, 7918, 7923, 7925, 7928, 7934, 7935, 7938, 7942, 7944, 7949, 7950, 7952, 7971, 7974, 7976, 7977, 7982, 7983, 7984, 7986, 7993, 7994, 8006, 8007, 8012, 8021, 8023, 8024, 8025, 8029, 8031, 8036, 8040, 8041, 8042, 8043, 8044, 8045, 8047, 8048, 8049, 8052, 8056, 8059, 8063, 8066, 8067, 8068, 8074, 8075, 8076, 8077, 8080, 8081, 8083, 8084, 8088, 8095, 8099, 8106, 8109, 8110, 8112, 8113, 8118, 8120, 8121, 8126, 8129, 8130, 8134, 8148, 8151, 8170, 8177, 8179, 8181, 8182, 8191, 8193, 8194, 8198, 8202, 8204, 8208, 8213, 8219, 8220, 8234, 8237, 8239, 8241, 8242, 8248, 8250, 8252, 8264, 8265, 8268, 8269, 8273, 8274, 8275, 8276, 8289, 8296, 8297, 8300, 8304, 8305, 8311, 8315, 8318, 8319, 8322, 8324, 8326, 8329, 8334, 8335, 8339, 8341, 8346, 8349, 8350, 8351, 8352, 8353, 8355, 8358, 8367, 8368, 8373, 8379, 8380, 8382, 8389, 8392, 8395, 8404, 8408, 8410, 8413, 8414, 8416, 8417, 8418, 8428, 8430, 8433, 8435, 8438, 8439, 8443, 8445, 8446, 8447, 8449, 8450, 8451, 8457, 8458, 8459, 8465, 8470, 8474, 8476, 8477, 8478, 8481, 8482, 8496, 8498, 8501, 8502, 8503, 8504, 8505, 8507, 8513, 8516, 8520, 8521, 8523, 8524, 8526, 8531, 8532, 8533, 8542, 8543, 8549, 8550, 8553, 8554, 8557, 8558, 8561, 8562, 8565, 8574, 8576, 8581, 8582, 8583, 8588, 8592, 8596, 8597, 8602, 8603, 8605, 8612, 8621, 8622, 8634, 8635, 8641, 8644, 8646, 8648, 8652, 8654, 8657, 8658, 8659, 8664, 8665, 8669, 8672, 8676, 8677, 8685, 8686, 8700, 8708, 8709, 8712, 8713, 8714, 8715, 8719, 8722, 8731, 8732, 8741, 8744, 8746, 8748, 8769, 8773, 8774, 8777, 8779, 8783, 8784, 8785, 8786, 8789, 8803, 8804, 8810, 8817, 8818, 8822, 8824, 8835, 8838, 8839, 8841, 8842, 8843, 8844, 8853, 8863, 8865, 8874, 8876, 8877, 8878, 8881, 8883, 8888, 8889, 8891, 8892, 8901, 8907, 8908, 8911, 8913, 8917, 8919, 8922, 8924, 8926, 8928, 8929, 8930, 8938, 8941, 8943, 8945, 8946, 8951, 8953, 8960, 8961, 8967, 8968, 8972, 8979, 8980, 8981, 8986, 8987, 8991, 8993, 8996, 9003, 9009, 9011, 9012, 9015, 9016, 9018, 9021, 9022, 9026, 9027, 9029, 9030, 9033, 9045, 9050, 9052, 9057, 9058, 9059, 9060, 9061, 9062, 9063, 9065, 9066, 9068, 9069, 9071, 9072, 9073, 9078, 9083, 9084, 9086, 9087, 9088, 9091, 9092, 9098, 9103, 9104, 9107, 9111, 9116, 9118, 9119, 9120, 9123, 9125, 9129, 9131, 9133, 9134, 9138, 9140, 9141, 9142, 9144, 9147, 9151, 9152, 9159, 9167, 9168, 9172, 9175, 9177, 9180, 9183, 9185, 9186, 9188, 9189, 9195, 9206, 9207, 9213, 9214, 9215, 9216, 9223, 9225, 9226, 9229, 9231, 9233, 9237, 9240, 9243, 9248, 9249, 9253, 9257, 9259, 9267, 9269, 9273, 9275, 9282, 9284, 9285, 9287, 9288, 9291, 9292, 9293, 9300, 9308, 9310, 9311, 9321, 9323, 9326, 9327, 9328, 9332, 9337, 9338, 9346, 9353, 9359, 9360, 9366, 9368, 9371, 9373, 9375, 9380, 9381, 9382, 9389, 9391, 9392, 9393, 9394, 9398, 9400, 9402, 9403, 9404, 9406, 9407, 9412, 9413, 9419, 9421, 9423, 9429, 9434, 9438, 9439, 9440, 9443, 9447, 9449, 9453, 9456, 9460, 9464, 9467, 9471, 9481, 9484, 9490, 9497, 9500, 9503, 9504, 9509, 9514, 9517, 9518, 9519, 9521, 9522, 9525, 9534, 9535, 9536, 9538, 9543, 9545, 9546, 9548, 9550, 9551, 9553, 9555, 9560, 9564, 9567, 9568, 9571, 9575, 9577, 9587, 9592, 9593, 9595, 9596, 9597, 9601, 9602, 9606, 9609, 9615, 9617, 9620, 9621, 9623, 9624, 9626, 9629, 9632, 9633, 9648, 9655, 9658, 9659, 9663, 9668, 9670, 9674, 9682, 9688, 9695, 9696, 9698, 9706, 9708, 9710, 9711, 9718, 9721, 9723, 9726, 9727, 9729, 9731, 9732, 9734, 9737, 9738, 9742, 9744, 9745, 9746, 9749, 9750, 9754, 9758, 9761, 9763, 9770, 9772, 9774, 9776, 9777, 9782, 9786, 9793, 9794, 9798, 9799, 9804, 9807, 9809, 9810, 9811, 9813, 9819, 9821, 9825, 9827, 9828, 9829, 9835, 9836, 9845, 9847, 9869, 9875, 9878, 9882, 9886, 9887, 9889, 9892, 9894, 9896, 9897, 9898, 9907, 9909, 9911, 9921, 9928, 9930, 9931, 9934, 9935, 9936, 9944, 9946, 9950, 9952, 9953, 9962, 9967, 9968, 9969, 9972, 9973, 9974, 9975, 9976, 9984, 9985, 9988, 9990, 9991, 9992, 9997, 10000, 10008, 10012, 10013, 10017, 10018, 10019, 10020, 10022, 10026, 10027, 10032, 10033, 10037, 10041, 10047, 10049, 10051, 10055, 10058, 10059, 10060, 10062, 10064, 10066, 10077, 10078, 10080, 10081, 10083, 10090, 10091, 10092, 10095, 10098, 10103, 10106, 10110, 10115, 10116, 10120, 10122, 10127, 10128, 10129, 10131, 10136, 10137, 10140, 10143, 10151, 10156, 10157, 10158, 10160, 10163, 10165, 10166, 10168, 10169, 10174, 10176, 10178, 10181, 10191, 10192, 10193, 10194, 10195, 10196, 10201, 10206, 10207, 10209, 10217, 10218, 10219, 10220, 10222, 10223, 10228, 10230, 10233, 10235, 10236, 10239, 10252, 10253, 10259, 10260, 10262, 10263, 10266, 10269, 10270, 10275, 10276, 10278, 10284, 10286, 10291, 10292, 10293, 10295, 10300, 10302, 10306, 10307, 10311, 10312, 10314, 10318, 10323, 10325, 10326, 10331, 10335, 10336, 10340, 10341, 10345, 10346, 10353, 10356, 10357, 10361, 10362, 10364, 10371, 10373, 10375, 10376, 10380, 10381, 10392, 10393, 10397, 10398, 10399, 10401, 10402, 10414, 10416, 10417, 10421, 10423, 10425, 10435, 10436, 10446, 10449, 10452, 10453, 10456, 10465, 10468, 10469, 10471, 10472, 10473, 10479, 10480, 10487, 10490, 10493, 10498, 10501, 10504, 10508, 10514, 10518, 10522, 10523, 10527, 10528, 10531, 10532, 10537, 10540, 10541, 10542, 10544, 10548, 10549, 10550, 10551, 10553, 10562, 10563, 10567, 10571, 10581, 10582, 10583, 10584, 10587, 10588, 10593, 10596, 10597, 10599, 10601, 10611, 10615, 10616, 10621, 10622, 10636, 10637, 10638, 10639, 10643, 10646, 10650, 10651, 10655, 10657, 10665, 10669, 10671, 10676, 10678, 10679, 10682, 10683, 10684, 10685, 10686, 10687, 10689, 10693, 10698, 10700, 10701, 10705, 10721, 10723, 10726, 10729, 10734, 10737, 10738, 10740, 10741, 10744, 10747, 10752, 10753, 10754, 10756, 10763, 10769, 10770, 10772, 10774, 10775, 10778, 10779, 10780, 10785, 10787, 10788, 10801, 10802, 10803, 10804, 10809, 10822, 10823, 10824, 10827, 10836, 10838, 10839, 10840, 10843, 10850, 10851, 10853, 10854, 10857, 10858, 10866, 10867, 10870, 10877, 10878, 10887, 10897, 10898, 10899, 10901, 10902, 10911, 10918, 10924, 10926, 10927, 10928, 10929, 10930, 10933, 10934, 10938, 10940, 10942, 10961, 10967, 10972, 10974, 10976, 10977, 10978, 10979, 10985, 10988, 10993, 10996, 10997, 10999, 11002, 11004, 11008, 11015, 11016, 11021, 11022, 11023, 11030, 11039, 11040, 11046, 11047, 11053, 11058, 11066, 11078, 11082, 11083, 11090, 11095, 11100, 11103, 11109, 11110, 11114, 11116, 11117, 11118, 11119, 11122, 11123, 11128, 11129, 11133, 11137, 11141, 11145, 11147, 11149, 11150, 11151, 11152, 11153, 11154, 11160, 11161, 11163, 11168, 11169, 11172, 11177, 11179, 11180, 11181, 11184, 11187, 11188, 11190, 11192, 11194, 11198, 11202, 11203, 11214, 11216, 11217, 11218, 11224, 11228, 11229, 11230, 11232, 11233, 11235, 11236, 11238, 11239, 11241, 11242, 11243, 11246, 11247, 11251, 11253, 11254, 11255, 11256, 11258, 11260, 11263, 11266, 11274, 11282, 11284, 11291, 11292, 11293, 11296, 11297, 11299, 11304, 11315, 11318, 11323, 11325, 11329, 11330, 11331, 11332, 11337, 11339, 11340, 11346, 11348, 11349, 11352, 11362, 11363, 11364, 11365, 11366, 11369, 11373, 11374, 11380, 11382, 11387, 11392, 11394, 11395, 11398, 11401, 11404, 11406, 11408, 11417, 11424, 11428, 11431, 11435, 11438, 11443, 11446, 11447, 11448, 11449, 11451, 11456, 11459, 11465, 11477, 11487, 11489, 11490, 11491, 11492, 11496, 11498, 11499, 11500, 11505, 11507, 11518, 11521, 11523, 11524, 11526, 11527, 11529, 11531, 11532, 11533, 11534, 11544, 11548, 11551, 11553, 11558, 11560, 11561, 11567, 11568, 11569, 11570, 11571, 11576, 11577, 11578, 11585, 11588, 11593, 11594, 11595, 11596, 11597, 11604, 11605, 11606, 11607, 11610, 11611, 11615, 11617, 11618, 11619, 11621, 11623, 11625, 11636, 11647, 11649, 11650, 11655, 11656, 11657, 11658, 11663, 11668, 11669, 11673, 11678, 11681, 11682, 11688, 11691, 11692, 11695, 11696, 11699, 11701, 11703, 11705, 11707, 11712, 11718, 11721, 11730, 11731, 11736, 11738, 11740, 11743, 11744, 11748, 11753, 11760, 11761, 11771, 11776, 11777, 11778, 11781, 11783, 11784, 11785, 11786, 11789, 11792, 11794, 11797, 11799, 11800, 11805, 11809, 11811, 11818, 11828, 11830, 11836, 11837, 11839, 11841, 11842, 11846, 11847, 11848, 11854, 11856, 11861, 11864, 11865, 11868, 11872, 11876, 11877, 11878, 11879, 11881, 11886, 11887, 11889, 11891, 11892, 11894, 11895, 11897, 11898, 11901, 11902, 11906, 11911, 11914, 11915, 11916, 11917, 11919, 11922, 11923, 11926, 11927, 11928, 11929, 11930, 11933, 11940, 11945, 11947, 11949, 11950, 11955, 11956, 11959, 11960, 11961, 11962, 11965, 11969, 11975, 11976, 11977, 11978, 11979, 11980, 11987, 11988, 11989, 11993, 11997, 11998, 11999, 12004, 12008, 12015, 12017, 12018, 12019, 12021, 12023, 12024, 12026, 12027, 12032, 12033, 12038, 12042, 12043, 12044, 12052, 12059, 12060, 12068, 12076, 12077, 12081, 12083, 12087, 12092, 12093, 12098, 12102, 12104, 12106, 12109, 12110, 12112, 12115, 12118, 12126, 12128, 12129, 12134, 12137, 12138, 12139, 12141, 12143, 12148, 12149, 12165, 12166, 12167, 12170, 12171, 12174, 12175, 12176, 12181, 12185, 12197, 12200, 12201, 12204, 12207, 12208, 12215, 12217, 12218, 12219, 12220, 12221, 12223, 12228, 12229, 12233, 12234, 12240, 12241, 12245, 12249, 12250, 12253, 12259, 12263, 12267, 12268, 12269, 12274, 12278, 12281, 12283, 12286, 12287, 12291, 12297, 12298, 12304, 12311, 12313, 12314, 12315, 12317, 12321, 12323, 12324, 12326, 12331, 12333, 12334, 12337, 12340, 12341, 12342, 12343, 12344, 12345, 12347, 12359, 12364, 12367, 12368, 12369, 12372, 12374, 12380, 12381, 12382, 12383, 12397, 12400, 12401, 12403, 12404, 12406, 12411, 12412, 12414, 12416, 12418, 12419, 12420, 12421, 12426, 12427, 12428, 12429, 12439, 12440, 12441, 12447, 12448, 12451, 12454, 12455, 12456, 12457, 12459, 12461, 12462, 12467, 12468, 12472, 12476, 12478, 12479, 12481, 12487, 12488, 12490, 12491, 12497, 12503, 12508, 12515, 12523, 12525, 12536, 12545, 12546, 12547, 12555, 12556, 12559, 12561, 12562, 12564, 12565, 12567, 12570, 12578, 12585, 12588, 12590, 12600, 12608, 12609, 12611, 12616, 12619, 12622, 12623, 12633, 12634, 12635, 12636, 12638, 12639, 12641, 12645, 12649, 12651, 12655, 12658, 12663, 12668, 12671, 12675, 12676, 12679, 12682, 12683, 12684, 12691, 12698, 12701, 12702, 12703, 12705, 12706, 12707, 12713, 12715, 12719, 12729, 12731, 12732, 12733, 12735, 12737, 12738, 12739, 12740, 12742, 12743, 12749, 12751, 12752, 12754, 12761, 12764, 12766, 12771, 12778, 12783, 12788, 12789, 12790, 12791, 12797, 12802, 12805, 12810, 12812, 12813, 12822, 12824, 12826, 12827, 12828, 12834, 12836, 12838, 12839, 12844, 12849, 12853, 12861, 12866, 12869, 12883, 12884, 12887, 12888, 12898, 12900, 12901, 12904, 12905, 12912, 12917, 12918, 12920, 12921, 12928, 12932, 12938, 12939, 12942, 12946, 12947, 12950, 12953, 12961, 12963, 12966, 12968, 12969, 12972, 12973, 12974, 12975, 12976, 12977, 12978, 12982, 12989, 12990, 12991, 12994, 12998, 13004, 13007, 13010, 13011, 13014, 13017, 13022, 13023, 13024, 13030, 13032, 13035, 13038, 13044, 13049, 13050, 13053, 13055, 13056, 13057, 13060, 13061, 13066, 13069, 13070, 13074, 13079, 13085, 13095, 13100, 13101, 13102, 13105, 13106, 13114, 13115, 13116, 13117, 13118, 13123, 13124, 13128, 13153, 13156, 13160, 13165, 13169, 13175, 13177, 13182, 13191, 13192, 13197, 13199, 13205, 13209, 13210, 13212, 13213, 13217, 13222, 13224, 13227, 13232, 13234, 13235, 13236, 13237, 13238, 13243, 13249, 13251, 13258, 13260, 13261, 13263, 13267, 13268, 13269, 13270, 13273, 13275, 13276, 13279, 13280, 13281, 13285, 13293, 13295, 13296, 13298, 13301, 13303, 13304, 13313, 13315, 13317, 13320, 13321, 13322, 13323, 13326, 13328, 13330, 13338, 13341, 13347, 13348, 13349, 13353, 13354, 13358, 13361, 13369, 13375, 13380, 13384, 13393, 13396, 13397, 13401, 13408, 13411, 13416, 13419, 13420, 13423, 13424, 13429, 13431, 13433, 13434, 13439, 13441, 13446, 13448, 13449, 13450, 13451, 13454, 13456, 13463, 13466, 13468, 13469, 13473, 13475, 13494, 13496, 13499, 13500, 13501, 13504, 13506, 13510, 13513, 13514, 13515, 13516, 13517, 13519, 13520, 13521, 13524, 13529, 13530, 13532, 13539, 13540, 13543, 13544, 13546, 13547, 13549, 13552, 13556, 13568, 13574, 13579, 13580, 13582, 13583, 13584, 13589, 13595, 13597, 13601, 13623, 13627, 13628, 13631, 13634, 13635, 13637, 13640, 13641, 13643, 13647, 13649, 13650, 13652, 13654, 13661, 13662, 13663, 13666, 13669, 13671, 13677, 13678, 13683, 13684, 13686, 13687, 13688, 13689, 13697, 13700, 13704, 13706, 13710, 13712, 13716, 13720, 13725, 13728, 13729, 13733, 13737, 13738, 13742, 13745, 13750, 13753, 13755, 13756, 13764, 13766, 13767, 13769, 13773, 13775, 13781, 13783, 13786, 13787, 13789, 13790, 13793, 13794, 13795, 13796, 13798, 13807, 13809, 13816, 13817, 13818, 13819, 13822, 13823, 13827, 13830, 13831, 13833, 13835, 13843, 13856, 13859, 13860, 13862, 13866, 13869, 13870, 13872, 13873, 13874, 13877, 13886, 13891, 13892, 13894, 13896, 13900, 13901, 13904, 13906, 13909, 13911, 13917, 13919, 13923, 13925, 13927, 13938, 13944, 13947, 13948, 13949, 13952, 13953, 13956, 13961, 13965, 13969, 13970, 13975, 13976, 13980, 13984, 13990, 13994, 13999, 14001, 14003, 14009, 14016, 14018, 14021, 14022, 14027, 14030, 14031, 14036, 14041, 14043, 14049, 14050, 14051, 14054, 14062, 14063, 14066, 14069, 14070, 14084, 14086, 14088, 14092, 14093, 14094, 14102, 14106, 14107, 14109, 14110, 14115, 14116, 14118, 14122, 14128, 14129, 14132, 14138, 14139, 14145, 14146, 14148, 14149, 14150.

Promoters expressing in pollen tissue at the tasseling stage include SEQ IDs: 1, 13, 14, 22, 31, 34, 38, 48, 53, 56, 69, 70, 71, 81, 82, 88, 91, 93, 96, 97, 102, 103, 107, 111, 112, 121, 126, 131, 134, 135, 139, 140, 152, 160, 162, 172, 176, 177, 181, 184, 187, 193, 197, 199, 211, 217, 231, 232, 234, 235, 236, 237, 240, 244, 246, 248, 249, 250, 251, 259, 262, 264, 272, 280, 283, 286, 288, 289, 305, 306, 314, 316, 318, 319, 320, 321, 328, 329, 332, 335, 338, 343, 344, 349, 354, 356, 359, 365, 372, 373, 387, 388, 389, 396, 404, 406, 407, 418, 424, 429, 431, 448, 456, 461, 466, 468, 471, 478, 481, 483, 485, 498, 501, 502, 509, 512, 514, 517, 520, 522, 525, 529, 532, 533, 535, 544, 546, 547, 554, 557, 560, 561, 562, 565, 585, 587, 592, 593, 594, 595, 596, 606, 608, 611, 613, 630, 635, 641, 643, 650, 653, 663, 666, 681, 686, 693, 694, 717, 722, 724, 726, 727, 736, 739, 742, 749, 757, 759, 760, 761, 762, 763, 765, 768, 771, 781, 793, 800, 801, 808, 813, 819, 827, 830, 839, 842, 844, 845, 855, 857, 858, 860, 862, 866, 868, 869, 873, 877, 878, 879, 883, 884, 885, 887, 891, 892, 911, 912, 916, 919, 923, 929, 931, 932, 936, 938, 943, 944, 951, 953, 954, 955, 958, 963, 964, 966, 971, 974, 979, 982, 987, 994, 995, 996, 997, 999, 1006, 1007, 1009, 1010, 1011, 1014, 1017, 1042, 1043, 1044, 1045, 1046, 1047, 1051, 1052, 1054, 1056, 1070, 1077, 1078, 1087, 1089, 1092, 1103, 1104, 1111, 1115, 1118, 1119, 1120, 1121, 1122, 1125, 1127, 1131, 1133, 1143, 1146, 1147, 1154, 1162, 1166, 1173, 1176, 1178, 1182, 1187, 1191, 1196, 1197, 1198, 1199, 1200, 1201, 1204, 1205, 1214, 1218, 1220, 1223, 1228, 1230, 1233, 1236, 1248, 1253, 1256, 1257, 1261, 1269, 1272, 1275, 1281, 1285, 1286, 1292, 1293, 1303, 1305, 1309, 1312, 1317, 1325, 1330, 1331, 1334, 1335, 1337, 1346, 1349, 1351, 1360, 1364, 1365, 1367, 1371, 1373, 1377, 1381, 1382, 1385, 1388, 1393, 1394, 1396, 1398, 1404, 1405, 1406, 1409, 1410, 1412, 1416, 1420, 1425, 1426, 1438, 1442, 1466, 1475, 1481, 1487, 1496, 1499, 1514, 1517, 1519, 1520, 1527, 1536, 1543, 1550, 1552, 1554, 1556, 1560, 1584, 1586, 1589, 1590, 1593, 1594, 1595, 1596, 1600, 1608, 1612, 1614, 1615, 1622, 1628, 1629, 1635, 1636, 1637, 1638, 1639, 1642, 1648, 1652, 1658, 1676, 1677, 1680, 1683, 1684, 1685, 1688, 1698, 1701, 1702, 1705, 1707, 1708, 1712, 1717, 1721, 1723, 1731, 1732, 1735, 1740, 1749, 1750, 1756, 1759, 1761, 1763, 1771, 1776, 1779, 1796, 1813, 1815, 1816, 1820, 1821, 1830, 1835, 1840, 1843, 1845, 1850, 1852, 1854, 1855, 1858, 1869, 1870, 1872, 1882, 1889, 1894, 1895, 1897, 1900, 1902, 1903, 1904, 1905, 1916, 1917, 1918, 1922, 1930, 1931, 1936, 1937, 1940, 1942, 1944, 1950, 1954, 1955, 1959, 1967, 1973, 1981, 1991, 1992, 1999, 2003, 2009, 2012, 2014, 2015, 2026, 2033, 2034, 2036, 2039, 2041, 2045, 2048, 2051, 2060, 2062, 2066, 2069, 2071, 2072, 2074, 2075, 2077, 2080, 2082, 2083, 2091, 2092, 2097, 2101, 2107, 2112, 2114, 2122, 2128, 2133, 2140, 2142, 2143, 2147, 2152, 2156, 2158, 2159, 2161, 2162, 2164, 2167, 2175, 2180, 2188, 2191, 2193, 2194, 2202, 2203, 2204, 2206, 2207, 2214, 2215, 2216, 2218, 2221, 2222, 2226, 2227, 2229, 2230, 2231, 2235, 2237, 2240, 2244, 2253, 2260, 2261, 2262, 2263, 2279, 2280, 2281, 2282, 2283, 2288, 2304, 2308, 2314, 2320, 2333, 2335, 2339, 2342, 2343, 2344, 2351, 2358, 2359, 2360, 2366, 2367, 2375, 2382, 2383, 2384, 2397, 2401, 2405, 2411, 2412, 2418, 2420, 2435, 2437, 2438, 2439, 2441, 2442, 2445, 2452, 2453, 2471, 2476, 2480, 2482, 2483, 2486, 2500, 2504, 2505, 2510, 2511, 2519, 2527, 2528, 2529, 2532, 2534, 2541, 2547, 2548, 2549, 2557, 2565, 2568, 2581, 2583, 2584, 2585, 2588, 2590, 2594, 2599, 2611, 2615, 2627, 2634, 2637, 2644, 2647, 2653, 2654, 2655, 2661, 2662, 2663, 2665, 2675, 2676, 2678, 2679, 2685, 2696, 2700, 2705, 2707, 2719, 2725, 2726, 2729, 2738, 2740, 2746, 2753, 2755, 2769, 2780, 2781, 2782, 2794, 2798, 2800, 2802, 2821, 2822, 2823, 2826, 2829, 2833, 2837, 2839, 2843, 2844, 2850, 2857, 2858, 2861, 2862, 2865, 2866, 2871, 2873, 2876, 2878, 2889, 2890, 2896, 2902, 2903, 2905, 2911, 2923, 2924, 2935, 2944, 2948, 2952, 2955, 2957, 2959, 2962, 2963, 2966, 2976, 2980, 2982, 3001, 3002, 3007, 3008, 3010, 3012, 3020, 3024, 3026, 3040, 3043, 3048, 3049, 3050, 3054, 3055, 3064, 3065, 3067, 3072, 3078, 3080, 3083, 3084, 3090, 3097, 3098, 3099, 3100, 3118, 3120, 3126, 3127, 3128, 3135, 3137, 3138, 3139, 3142, 3143, 3145, 3148, 3150, 3153, 3154, 3170, 3185, 3191, 3192, 3212, 3220, 3225, 3226, 3227, 3228, 3229, 3237, 3245, 3252, 3253, 3263, 3266, 3268, 3271, 3280, 3282, 3286, 3288, 3291, 3294, 3295, 3297, 3299, 3312, 3320, 3325, 3327, 3331, 3333, 3349, 3350, 3353, 3355, 3357, 3359, 3360, 3361, 3363, 3365, 3370, 3377, 3379, 3380, 3385, 3386, 3387, 3393, 3396, 3397, 3399, 3401, 3402, 3404, 3409, 3413, 3414, 3415, 3422, 3424, 3426, 3442, 3445, 3449, 3451, 3455, 3458, 3460, 3461, 3464, 3465, 3468, 3470, 3473, 3474, 3478, 3479, 3482, 3487, 3490, 3491, 3507, 3516, 3517, 3518, 3521, 3527, 3529, 3536, 3541, 3544, 3545, 3548, 3551, 3552, 3554, 3560, 3561, 3574, 3590, 3592, 3594, 3595, 3597, 3606, 3607, 3608, 3616, 3618, 3623, 3624, 3629, 3633, 3635, 3636, 3637, 3640, 3643, 3644, 3646, 3648, 3650, 3655, 3657, 3669, 3671, 3674, 3675, 3678, 3682, 3697, 3700, 3704, 3713, 3717, 3718, 3719, 3722, 3727, 3728, 3732, 3740, 3741, 3742, 3748, 3749, 3760, 3761, 3764, 3766, 3772, 3773, 3774, 3778, 3785, 3789, 3790, 3791, 3792, 3794, 3796, 3800, 3808, 3809, 3810, 3816, 3828, 3831, 3833, 3834, 3843, 3844, 3858, 3860, 3862, 3868, 3872, 3883, 3887, 3890, 3891, 3892, 3896, 3898, 3910, 3911, 3912, 3914, 3920, 3924, 3928, 3933, 3934, 3938, 3951, 3962, 3968, 3974, 3976, 3977, 3984, 3985, 3990, 3994, 3996, 4000, 4001, 4002, 4003, 4006, 4008, 4024, 4026, 4032, 4039, 4042, 4048, 4054, 4055, 4056, 4057, 4058, 4060, 4061, 4066, 4069, 4072, 4075, 4087, 4092, 4098, 4099, 4103, 4109, 4111, 4113, 4115, 4124, 4131, 4134, 4139, 4143, 4146, 4148, 4149, 4150, 4156, 4160, 4161, 4162, 4165, 4166, 4167, 4168, 4175, 4178, 4184, 4185, 4187, 4189, 4197, 4205, 4206, 4209, 4211, 4212, 4214, 4219, 4221, 4223, 4227, 4228, 4241, 4246, 4250, 4251, 4256, 4257, 4260, 4261, 4266, 4289, 4292, 4296, 4301, 4302, 4310, 4312, 4319, 4320, 4324, 4331, 4335, 4336, 4337, 4343, 4344, 4345, 4352, 4354, 4356, 4359, 4369, 4374, 4375, 4378, 4383, 4387, 4388, 4390, 4391, 4392, 4394, 4397, 4404, 4419, 4422, 4426, 4428, 4437, 4438, 4439, 4443, 4446, 4448, 4455, 4458, 4460, 4461, 4462, 4463, 4464, 4466, 4468, 4472, 4474, 4483, 4485, 4491, 4492, 4498, 4500, 4506, 4507, 4508, 4512, 4513, 4514, 4515, 4516, 4519, 4522, 4524, 4535, 4542, 4543, 4549, 4552, 4554, 4560, 4562, 4563, 4565, 4566, 4567, 4575, 4582, 4585, 4586, 4588, 4591, 4594, 4595, 4604, 4605, 4626, 4634, 4635, 4638, 4643, 4644, 4646, 4651, 4652, 4653, 4654, 4655, 4657, 4659, 4666, 4668, 4669, 4670, 4674, 4677, 4685, 4687, 4697, 4699, 4700, 4714, 4718, 4721, 4725, 4728, 4730, 4741, 4746, 4747, 4748, 4750, 4754, 4756, 4759, 4760, 4765, 4781, 4789, 4790, 4791, 4794, 4795, 4803, 4804, 4805, 4806, 4807, 4817, 4818, 4819, 4822, 4824, 4829, 4832, 4833, 4834, 4836, 4837, 4856, 4857, 4861, 4862, 4864, 4876, 4880, 4881, 4887, 4888, 4891, 4895, 4904, 4914, 4917, 4920, 4921, 4926, 4927, 4928, 4930, 4941, 4942, 4947, 4950, 4955, 4957, 4966, 4971, 4972, 4973, 4977, 4979, 4980, 4987, 4992, 4996, 5007, 5013, 5016, 5026, 5039, 5040, 5046, 5051, 5054, 5057, 5059, 5060, 5063, 5068, 5072, 5074, 5075, 5085, 5088, 5097, 5098, 5100, 5102, 5114, 5120, 5130, 5140, 5146, 5147, 5153, 5154, 5155, 5160, 5164, 5165, 5169, 5170, 5171, 5173, 5180, 5182, 5184, 5188, 5189, 5190, 5192, 5195, 5198, 5199, 5216, 5225, 5234, 5236, 5241, 5253, 5255, 5262, 5267, 5276, 5280, 5283, 5285, 5290, 5292, 5293, 5303, 5308, 5309, 5311, 5317, 5319, 5321, 5332, 5334, 5339, 5342, 5344, 5347, 5348, 5350, 5359, 5361, 5362, 5363, 5364, 5369, 5372, 5388, 5389, 5392, 5394, 5396, 5397, 5402, 5403, 5414, 5417, 5431, 5438, 5439, 5444, 5450, 5451, 5452, 5463, 5464, 5466, 5467, 5476, 5479, 5482, 5485, 5487, 5496, 5498, 5510, 5513, 5515, 5516, 5518, 5519, 5530, 5532, 5539, 5554, 5556, 5557, 5559, 5561, 5565, 5566, 5569, 5578, 5585, 5588, 5589, 5591, 5604, 5612, 5613, 5616, 5632, 5634, 5635, 5642, 5643, 5649, 5650, 5652, 5656, 5657, 5659, 5662, 5663, 5675, 5676, 5677, 5679, 5689, 5690, 5697, 5700, 5702, 5703, 5705, 5706, 5709, 5711, 5717, 5721, 5722, 5726, 5730, 5731, 5735, 5737, 5739, 5748, 5756, 5758, 5760, 5763, 5764, 5770, 5771, 5775, 5780, 5784, 5786, 5787, 5791, 5794, 5798, 5799, 5807, 5808, 5810, 5817, 5820, 5828, 5831, 5833, 5837, 5839, 5854, 5855, 5857, 5859, 5865, 5867, 5870, 5872, 5875, 5879, 5880, 5881, 5883, 5886, 5888, 5890, 5891, 5892, 5893, 5907, 5919, 5925, 5932, 5934, 5936, 5937, 5954, 5956, 5957, 5968, 5974, 5975, 5982, 5983, 5986, 5991, 5996, 6003, 6006, 6007, 6009, 6013, 6014, 6017, 6023, 6025, 6026, 6033, 6038, 6041, 6042, 6044, 6045, 6047, 6051, 6058, 6060, 6061, 6065, 6067, 6072, 6080, 6081, 6084, 6085, 6087, 6091, 6092, 6093, 6098, 6110, 6113, 6114, 6116, 6121, 6129, 6130, 6131, 6132, 6138, 6139, 6142, 6145, 6146, 6148, 6162, 6163, 6165, 6168, 6181, 6189, 6196, 6203, 6204, 6205, 6216, 6223, 6224, 6234, 6237, 6246, 6247, 6250, 6255, 6262, 6264, 6267, 6281, 6282, 6292, 6300, 6303, 6307, 6315, 6322, 6328, 6333, 6338, 6343, 6344, 6349, 6356, 6358, 6360, 6365, 6368, 6370, 6372, 6375, 6397, 6399, 6400, 6408, 6412, 6414, 6415, 6419, 6420, 6425, 6426, 6428, 6430, 6436, 6442, 6443, 6449, 6456, 6457, 6463, 6466, 6469, 6470, 6475, 6476, 6480, 6482, 6484, 6485, 6492, 6494, 6505, 6506, 6507, 6510, 6517, 6519, 6528, 6533, 6535, 6538, 6540, 6541, 6543, 6544, 6549, 6553, 6555, 6560, 6561, 6567, 6568, 6571, 6572, 6574, 6577, 6584, 6587, 6588, 6592, 6594, 6595, 6597, 6606, 6607, 6609, 6610, 6623, 6633, 6634, 6638, 6646, 6647, 6652, 6654, 6655, 6656, 6661, 6666, 6674, 6681, 6699, 6705, 6706, 6710, 6717, 6718, 6723, 6730, 6733, 6736, 6738, 6740, 6741, 6747, 6752, 6756, 6757, 6759, 6774, 6776, 6777, 6781, 6783, 6786, 6789, 6793, 6794, 6795, 6797, 6799, 6803, 6805, 6811, 6813, 6816, 6817, 6819, 6820, 6826, 6830, 6840, 6842, 6848, 6851, 6852, 6855, 6868, 6875, 6878, 6880, 6882, 6883, 6888, 6890, 6895, 6897, 6902, 6903, 6904, 6906, 6907, 6909, 6911, 6913, 6917, 6919, 6920, 6921, 6930, 6931, 6936, 6939, 6950, 6952, 6959, 6960, 6968, 6970, 6971, 6979, 6988, 6990, 6991, 6993, 6997, 7003, 7010, 7011, 7012, 7013, 7017, 7027, 7035, 7039, 7040, 7041, 7043, 7045, 7048, 7049, 7054, 7057, 7059, 7063, 7079, 7097, 7105, 7106, 7107, 7110, 7117, 7122, 7130, 7132, 7136, 7138, 7139, 7144, 7154, 7164, 7165, 7166, 7169, 7182, 7183, 7190, 7193, 7197, 7206, 7207, 7209, 7210, 7217, 7219, 7223, 7227, 7230, 7235, 7236, 7246, 7248, 7249, 7250, 7252, 7255, 7258, 7261, 7262, 7264, 7267, 7269, 7274, 7279, 7293, 7296, 7307, 7311, 7312, 7313, 7318, 7319, 7320, 7324, 7328, 7340, 7345, 7348, 7357, 7361, 7365, 7371, 7376, 7380, 7383, 7385, 7386, 7396, 7398, 7400, 7410, 7430, 7435, 7436, 7438, 7447, 7453, 7454, 7457, 7461, 7466, 7467, 7470, 7472, 7481, 7483, 7485, 7499, 7504, 7506, 7511, 7512, 7515, 7523, 7544, 7546, 7548, 7557, 7564, 7567, 7572, 7574, 7576, 7579, 7583, 7585, 7586, 7587, 7589, 7595, 7598, 7604, 7605, 7607, 7609, 7614, 7618, 7625, 7626, 7633, 7635, 7655, 7656, 7662, 7664, 7665, 7672, 7682, 7687, 7688, 7689, 7691, 7693, 7699, 7702, 7703, 7704, 7705, 7716, 7724, 7734, 7737, 7740, 7741, 7742, 7744, 7745, 7749, 7753, 7754, 7757, 7767, 7774, 7780, 7781, 7788, 7791, 7796, 7798, 7801, 7803, 7804, 7806, 7807, 7811, 7820, 7822, 7825, 7840, 7841, 7845, 7846, 7850, 7855, 7858, 7870, 7873, 7877, 7885, 7888, 7890, 7896, 7911, 7916, 7922, 7925, 7938, 7944, 7952, 7955, 7956, 7965, 7966, 7967, 7973, 7974, 7976, 7977, 7984, 7986, 7992, 7993, 8006, 8007, 8012, 8020, 8023, 8025, 8026, 8031, 8032, 8036, 8040, 8041, 8042, 8043, 8044, 8047, 8052, 8055, 8056, 8058, 8066, 8067, 8070, 8074, 8076, 8081, 8089, 8091, 8095, 8099, 8100, 8102, 8103, 8108, 8110, 8112, 8118, 8121, 8126, 8129, 8130, 8134, 8136, 8137, 8145, 8146, 8163, 8164, 8170, 8177, 8178, 8180, 8181, 8186, 8194, 8198, 8201, 8202, 8204, 8205, 8211, 8219, 8224, 8231, 8234, 8235, 8236, 8238, 8239, 8242, 8246, 8250, 8252, 8253, 8263, 8264, 8265, 8266, 8268, 8273, 8276, 8288, 8289, 8291, 8292, 8300, 8301, 8304, 8308, 8310, 8318, 8322, 8324, 8329, 8341, 8349, 8350, 8351, 8353, 8358, 8367, 8368, 8396, 8401, 8402, 8403, 8410, 8415, 8416, 8417, 8418, 8435, 8438, 8443, 8445, 8450, 8451, 8455, 8457, 8458, 8459, 8465, 8470, 8471, 8474, 8476, 8477, 8481, 8482, 8486, 8498, 8501, 8503, 8511, 8515, 8520, 8524, 8531, 8532, 8543, 8549, 8550, 8553, 8554, 8558, 8565, 8582, 8585, 8592, 8596, 8597, 8599, 8600, 8601, 8605, 8610, 8620, 8621, 8622, 8634, 8635, 8638, 8639, 8644, 8646, 8648, 8652, 8654, 8658, 8665, 8669, 8670, 8672, 8698, 8700, 8708, 8709, 8713, 8716, 8722, 8726, 8732, 8740, 8746, 8747, 8748, 8753, 8755, 8756, 8765, 8769, 8770, 8771, 8773, 8774, 8779, 8783, 8784, 8785, 8786, 8788, 8789, 8803, 8810, 8811, 8824, 8828, 8833, 8835, 8838, 8839, 8841, 8844, 8845, 8853, 8863, 8865, 8866, 8875, 8877, 8878, 8879, 8881, 8883, 8884, 8888, 8892, 8897, 8899, 8900, 8902, 8908, 8917, 8918, 8924, 8926, 8929, 8935, 8941, 8943, 8948, 8953, 8960, 8967, 8968, 8969, 8974, 8979, 8980, 8981, 8985, 8986, 8993, 8996, 8998, 8999, 9000, 9001, 9009, 9011, 9013, 9015, 9018, 9026, 9027, 9029, 9030, 9045, 9050, 9052, 9057, 9058, 9059, 9060, 9066, 9068, 9069, 9071, 9072, 9073, 9076, 9078, 9080, 9087, 9091, 9092, 9095, 9096, 9103, 9104, 9105, 9107, 9109, 9110, 9111, 9115, 9118, 9119, 9120, 9129, 9133, 9134, 9140, 9141, 9142, 9144, 9147, 9149, 9159, 9167, 9168, 9171, 9175, 9177, 9180, 9189, 9195, 9206, 9215, 9216, 9220, 9225, 9226, 9229, 9231, 9233, 9236, 9240, 9244, 9248, 9253, 9257, 9267, 9273, 9282, 9285, 9287, 9292, 9298, 9300, 9304, 9308, 9311, 9313, 9314, 9320, 9326, 9327, 9336, 9338, 9345, 9349, 9355, 9357, 9360, 9363, 9366, 9368, 9373, 9375, 9382, 9391, 9392, 9402, 9403, 9404, 9406, 9407, 9411, 9412, 9414, 9419, 9423, 9425, 9429, 9439, 9440, 9447, 9449, 9453, 9455, 9456, 9460, 9461, 9467, 9474, 9481, 9484, 9496, 9497, 9500, 9503, 9504, 9509, 9514, 9517, 9518, 9519, 9520, 9525, 9526, 9534, 9535, 9538, 9539, 9543, 9545, 9546, 9553, 9554, 9555, 9559, 9560, 9561, 9564, 9571, 9577, 9587, 9592, 9593, 9598, 9601, 9602, 9606, 9609, 9617, 9618, 9620, 9623, 9627, 9629, 9630, 9633, 9651, 9657, 9658, 9667, 9671, 9679, 9682, 9686, 9687, 9695, 9698, 9706, 9710, 9711, 9718, 9723, 9727, 9731, 9732, 9737, 9738, 9742, 9744, 9745, 9746, 9750, 9756, 9758, 9763, 9768, 9770, 9772, 9775, 9781, 9782, 9786, 9793, 9794, 9797, 9798, 9804, 9809, 9810, 9811, 9813, 9819, 9820, 9825, 9829, 9830, 9835, 9845, 9847, 9867, 9869, 9878, 9882, 9886, 9887, 9891, 9892, 9896, 9897, 9901, 9907, 9908, 9909, 9910, 9911, 9916, 9921, 9923, 9928, 9931, 9934, 9936, 9940, 9942, 9945, 9950, 9953, 9956, 9962, 9964, 9968, 9972, 9973, 9975, 9976, 9980, 9981, 9984, 9985, 9989, 9990, 9992, 9995, 9996, 9997, 10000, 10001, 10009, 10010, 10013, 10017, 10019, 10022, 10026, 10027, 10035, 10041, 10047, 10049, 10051, 10052, 10053, 10055, 10058, 10060, 10062, 10064, 10070, 10072, 10076, 10077, 10083, 10092, 10095, 10097, 10098, 10101, 10103, 10106, 10108, 10109, 10110, 10117, 10120, 10122, 10125, 10136, 10140, 10143, 10148, 10151, 10158, 10165, 10166, 10168, 10169, 10176, 10181, 10192, 10193, 10194, 10196, 10206, 10207, 10218, 10220, 10221, 10222, 10223, 10224, 10231, 10233, 10237, 10240, 10249, 10253, 10254, 10263, 10266, 10269, 10278, 10284, 10292, 10300, 10311, 10314, 10315, 10323, 10326, 10331, 10334, 10335, 10340, 10343, 10346, 10361, 10362, 10364, 10375, 10376, 10380, 10397, 10398, 10399, 10400, 10402, 10405, 10407, 10408, 10410, 10414, 10416, 10417, 10419, 10421, 10422, 10423, 10425, 10428, 10442, 10443, 10446, 10447, 10451, 10455, 10465, 10468, 10469, 10471, 10480, 10481, 10488, 10493, 10495, 10504, 10506, 10512, 10514, 10517, 10521, 10522, 10523, 10525, 10527, 10531, 10535, 10544, 10548, 10555, 10556, 10557, 10563, 10566, 10567, 10573, 10580, 10582, 10583, 10587, 10588, 10593, 10596, 10599, 10602, 10611, 10615, 10621, 10622, 10626, 10637, 10638, 10639, 10642, 10646, 10651, 10655, 10665, 10666, 10668, 10671, 10677, 10678, 10679, 10686, 10700, 10701, 10705, 10710, 10711, 10717, 10718, 10729, 10734, 10737, 10738, 10741, 10752, 10753, 10754, 10756, 10757, 10766, 10775, 10777, 10778, 10779, 10781, 10787, 10788, 10790, 10801, 10804, 10811, 10818, 10820, 10822, 10823, 10827, 10833, 10836, 10837, 10838, 10840, 10843, 10845, 10848, 10850, 10851, 10853, 10854, 10857, 10858, 10864, 10867, 10870, 10877, 10886, 10899, 10902, 10911, 10917, 10918, 10924, 10927, 10928, 10931, 10938, 10940, 10941, 10942, 10944, 10953, 10955, 10956, 10958, 10962, 10967, 10972, 10974, 10977, 10979, 10993, 10994, 10995, 10996, 11004, 11008, 11009, 11012, 11015, 11016, 11022, 11028, 11029, 11036, 11037, 11045, 11046, 11047, 11058, 11060, 11063, 11066, 11078, 11082, 11083, 11086, 11089, 11100, 11101, 11104, 11116, 11117, 11118, 11122, 11128, 11129, 11133, 11134, 11135, 11136, 11137, 11145, 11146, 11147, 11149, 11153, 11154, 11159, 11161, 11165, 11172, 11173, 11174, 11177, 11181, 11184, 11190, 11193, 11194, 11204, 11213, 11216, 11217, 11218, 11224, 11229, 11230, 11233, 11236, 11238, 11239, 11241, 11242, 11243, 11246, 11247, 11254, 11255, 11258, 11260, 11263, 11266, 11274, 11282, 11284, 11286, 11289, 11292, 11297, 11299, 11302, 11304, 11313, 11316, 11323, 11325, 11330, 11331, 11337, 11345, 11346, 11348, 11352, 11359, 11360, 11362, 11363, 11364, 11365, 11369, 11378, 11379, 11380, 11382, 11384, 11385, 11394, 11397, 11401, 11406, 11408, 11415, 11416, 11417, 11424, 11428, 11431, 11435, 11438, 11443, 11445, 11446, 11459, 11462, 11475, 11487, 11489, 11490, 11492, 11496, 11498, 11500, 11505, 11507, 11512, 11524, 11526, 11527, 11533, 11534, 11535, 11538, 11539, 11544, 11551, 11553, 11558, 11560, 11561, 11562, 11564, 11567, 11568, 11571, 11576, 11577, 11578, 11585, 11593, 11597, 11610, 11615, 11618, 11619, 11625, 11628, 11631, 11632, 11634, 11643, 11647, 11649, 11650, 11656, 11657, 11669, 11681, 11682, 11688, 11691, 11694, 11696, 11705, 11707, 11720, 11722, 11723, 11733, 11737, 11740, 11741, 11744, 11752, 11753, 11756, 11759, 11760, 11765, 11768, 11771, 11776, 11777, 11783, 11784, 11785, 11786, 11789, 11794, 11797, 11799, 11805, 11809, 11811, 11812, 11818, 11819, 11823, 11829, 11834, 11835, 11839, 11848, 11854, 11859, 11863, 11864, 11865, 11869, 11876, 11884, 11889, 11890, 11891, 11892, 11898, 11901, 11902, 11906, 11911, 11913, 11914, 11915, 11920, 11921, 11922, 11924, 11927, 11928, 11929, 11930, 11933, 11935, 11946, 11947, 11949, 11956, 11957, 11962, 11965, 11966, 11968, 11970, 11974, 11975, 11976, 11977, 11979, 11981, 11982, 11988, 11991, 11993, 11997, 11999, 12004, 12006, 12008, 12015, 12016, 12018, 12020, 12026, 12027, 12038, 12042, 12047, 12050, 12058, 12059, 12075, 12077, 12080, 12083, 12086, 12091, 12092, 12093, 12095, 12102, 12104, 12108, 12109, 12110, 12113, 12114, 12115, 12117, 12118, 12126, 12128, 12134, 12137, 12138, 12140, 12145, 12146, 12165, 12167, 12171, 12176, 12181, 12183, 12186, 12188, 12189, 12200, 12201, 12204, 12207, 12215, 12217, 12218, 12219, 12220, 12224, 12230, 12245, 12252, 12253, 12255, 12261, 12262, 12263, 12268, 12269, 12280, 12283, 12284, 12297, 12298, 12310, 12317, 12321, 12326, 12329, 12341, 12342, 12347, 12364, 12367, 12368, 12369, 12372, 12373, 12374, 12375, 12377, 12380, 12381, 12382, 12390, 12391, 12396, 12401, 12405, 12411, 12414, 12419, 12420, 12426, 12427, 12440, 12441, 12447, 12448, 12451, 12456, 12457, 12461, 12467, 12468, 12472, 12473, 12476, 12478, 12479, 12481, 12485, 12487, 12488, 12496, 12497, 12503, 12512, 12513, 12514, 12521, 12525, 12531, 12536, 12540, 12547, 12549, 12553, 12555, 12561, 12562, 12564, 12565, 12567, 12570, 12574, 12585, 12588, 12592, 12593, 12602, 12616, 12622, 12623, 12628, 12631, 12633, 12634, 12636, 12658, 12668, 12672, 12676, 12679, 12682, 12684, 12686, 12695, 12697, 12701, 12702, 12707, 12713, 12731, 12732, 12733, 12740, 12746, 12748, 12749, 12750, 12761, 12764, 12766, 12769, 12778, 12785, 12788, 12792, 12802, 12810, 12813, 12820, 12822, 12824, 12827, 12828, 12833, 12835, 12838, 12839, 12840, 12848, 12849, 12853, 12856, 12866, 12869, 12876, 12884, 12887, 12888, 12896, 12898, 12900, 12913, 12917, 12918, 12932, 12938, 12939, 12947, 12954, 12962, 12963, 12966, 12968, 12969, 12972, 12973, 12978, 12982, 12983, 12989, 12990, 12991, 12992, 12993, 12997, 12998, 13000, 13010, 13014, 13022, 13030, 13035, 13038, 13044, 13049, 13053, 13054, 13055, 13056, 13061, 13066, 13074, 13085, 13086, 13087, 13095, 13101, 13102, 13110, 13120, 13123, 13128, 13153, 13154, 13155, 13156, 13160, 13165, 13169, 13175, 13177, 13182, 13186, 13189, 13191, 13199, 13207, 13210, 13227, 13232, 13236, 13237, 13238, 13243, 13248, 13249, 13251, 13258, 13259, 13260, 13263, 13267, 13269, 13276, 13278, 13279, 13293, 13295, 13296, 13303, 13304, 13313, 13315, 13317, 13322, 13323, 13328, 13329, 13330, 13332, 13338, 13340, 13341, 13347, 13348, 13351, 13352, 13354, 13358, 13359, 13363, 13369, 13370, 13380, 13381, 13384, 13387, 13392, 13393, 13394, 13396, 13397, 13398, 13401, 13408, 13411, 13413, 13415, 13419, 13420, 13423, 13424, 13433, 13439, 13443, 13444, 13448, 13451, 13454, 13456, 13460, 13464, 13466, 13467, 13468, 13469, 13473, 13475, 13492, 13494, 13496, 13500, 13501, 13503, 13504, 13506, 13508, 13509, 13513, 13514, 13515, 13519, 13520, 13524, 13529, 13530, 13532, 13535, 13536, 13537, 13543, 13544, 13546, 13552, 13568, 13574, 13583, 13584, 13587, 13589, 13598, 13604, 13606, 13612, 13623, 13626, 13627, 13630, 13639, 13640, 13647, 13649, 13650, 13652, 13653, 13654, 13661, 13662, 13663, 13666, 13667, 13669, 13675, 13677, 13678, 13683, 13686, 13690, 13697, 13700, 13703, 13708, 13716, 13719, 13725, 13727, 13738, 13745, 13750, 13751, 13755, 13756, 13758, 13762, 13766, 13767, 13769, 13775, 13779, 13781, 13782, 13783, 13786, 13787, 13789, 13790, 13796, 13799, 13806, 13809, 13810, 13816, 13817, 13818, 13819, 13820, 13822, 13823, 13824, 13828, 13831, 13833, 13834, 13835, 13849, 13856, 13860, 13862, 13872, 13877, 13885, 13892, 13894, 13896, 13901, 13909, 13911, 13921, 13924, 13925, 13930, 13935, 13944, 13952, 13956, 13960, 13961, 13965, 13969, 13973, 13976, 13984, 14008, 14017, 14018, 14021, 14022, 14027, 14030, 14031, 14036, 14040, 14042, 14045, 14049, 14050, 14051, 14054, 14061, 14062, 14063, 14064, 14066, 14071, 14081, 14084, 14086, 14088, 14090, 14094, 14106, 14107, 14110, 14118, 14119, 14122, 14126, 14130, 14132, 14137, 14138, 14139, 14143, 14146.

Promoters expressing in the radicle (emerging root) 2 days after planting include SEQ IDs: 1, 3, 4, 7, 11, 12, 13, 14, 15, 29, 31, 32, 36, 48, 54, 63, 64, 65, 68, 69, 70, 71, 81, 82, 88, 93, 96, 97, 99, 101, 102, 103, 107, 110, 112, 121, 126, 130, 131, 132, 139, 143, 148, 152, 153, 157, 162, 174, 176, 177, 179, 181, 184, 187, 191, 194, 197, 199, 204, 205, 207, 210, 211, 212, 223, 231, 232, 235, 236, 237, 240, 242, 243, 244, 246, 248, 249, 250, 251, 257, 259, 262, 263, 264, 271, 273, 274, 280, 281, 286, 288, 289, 291, 299, 305, 306, 309, 316, 319, 320, 323, 328, 329, 332, 335, 341, 346, 349, 352, 353, 354, 356, 357, 360, 364, 365, 374, 378, 379, 387, 388, 396, 401, 402, 405, 406, 407, 419, 420, 423, 424, 428, 429, 433, 434, 436, 452, 456, 461, 466, 468, 471, 474, 478, 479, 481, 483, 484, 485, 488, 498, 502, 505, 509, 510, 512, 513, 514, 516, 517, 522, 523, 525, 529, 532, 533, 534, 536, 537, 541, 543, 544, 546, 547, 557, 560, 564, 565, 574, 578, 580, 585, 591, 594, 595, 596, 598, 599, 601, 602, 604, 607, 611, 613, 614, 620, 623, 630, 631, 633, 635, 641, 643, 650, 662, 663, 666, 671, 681, 683, 686, 693, 694, 701, 705, 707, 708, 716, 717, 719, 722, 724, 727, 734, 736, 739, 740, 742, 744, 749, 753, 757, 759, 760, 761, 762, 765, 768, 770, 771, 782, 783, 784, 792, 793, 795, 800, 801, 804, 806, 808, 813, 820, 823, 829, 830, 833, 836, 840, 841, 842, 844, 849, 855, 859, 860, 862, 865, 868, 869, 870, 871, 872, 877, 878, 883, 884, 885, 887, 890, 891, 892, 893, 895, 903, 907, 910, 911, 912, 913, 915, 916, 917, 919, 924, 928, 929, 931, 936, 938, 943, 944, 951, 953, 958, 962, 963, 964, 966, 976, 979, 980, 981, 982, 987, 991, 993, 994, 995, 997, 999, 1003, 1006, 1007, 1009, 1011, 1014, 1017, 1026, 1028, 1032, 1035, 1038, 1042, 1043, 1044, 1047, 1049, 1050, 1051, 1052, 1054, 1055, 1056, 1065, 1069, 1072, 1073, 1077, 1078, 1085, 1086, 1087, 1088, 1089, 1092, 1095, 1101, 1103, 1104, 1108, 1110, 1111, 1112, 1114, 1115, 1117, 1119, 1120, 1122, 1125, 1127, 1130, 1132, 1133, 1136, 1137, 1144, 1146, 1147, 1148, 1154, 1160, 1162, 1168, 1170, 1171, 1176, 1178, 1189, 1190, 1191, 1196, 1199, 1200, 1201, 1204, 1205, 1214, 1218, 1219, 1223, 1225, 1228, 1230, 1231, 1233, 1234, 1236, 1239, 1240, 1241, 1248, 1250, 1252, 1253, 1254, 1256, 1257, 1258, 1272, 1281, 1282, 1285, 1286, 1291, 1293, 1295, 1297, 1306, 1309, 1312, 1316, 1320, 1321, 1325, 1327, 1330, 1331, 1334, 1339, 1346, 1349, 1351, 1360, 1364, 1368, 1371, 1373, 1376, 1377, 1380, 1382, 1388, 1392, 1396, 1398, 1403, 1404, 1405, 1407, 1409, 1410, 1412, 1420, 1421, 1423, 1426, 1431, 1438, 1441, 1442, 1451, 1453, 1454, 1455, 1459, 1462, 1466, 1467, 1468, 1474, 1475, 1481, 1485, 1486, 1488, 1490, 1493, 1498, 1499, 1503, 1504, 1513, 1514, 1518, 1525, 1526, 1527, 1539, 1543, 1545, 1546, 1549, 1555, 1556, 1560, 1563, 1567, 1571, 1575, 1576, 1578, 1584, 1586, 1590, 1592, 1593, 1595, 1599, 1600, 1604, 1605, 1608, 1609, 1612, 1614, 1615, 1616, 1622, 1625, 1634, 1635, 1637, 1638, 1639, 1648, 1650, 1658, 1659, 1662, 1663, 1668, 1669, 1671, 1673, 1675, 1676, 1677, 1680, 1683, 1684, 1685, 1688, 1689, 1691, 1699, 1705, 1706, 1707, 1708, 1710, 1717, 1721, 1723, 1725, 1729, 1731, 1732, 1735, 1740, 1750, 1755, 1758, 1759, 1761, 1764, 1771, 1776, 1779, 1785, 1791, 1807, 1813, 1815, 1816, 1820, 1830, 1832, 1835, 1836, 1837, 1838, 1840, 1845, 1850, 1852, 1858, 1859, 1865, 1867, 1869, 1870, 1872, 1883, 1886, 1888, 1891, 1894, 1897, 1898, 1899, 1900, 1901, 1902, 1903, 1904, 1905, 1906, 1911, 1917, 1918, 1920, 1923, 1924, 1933, 1934, 1936, 1940, 1944, 1950, 1952, 1981, 1990, 1991, 1992, 1993, 1994, 1995, 1996, 1999, 2000, 2003, 2007, 2008, 2009, 2010, 2012, 2013, 2014, 2015, 2017, 2019, 2026, 2031, 2032, 2039, 2041, 2043, 2048, 2062, 2064, 2066, 2072, 2074, 2077, 2081, 2082, 2083, 2089, 2094, 2096, 2097, 2099, 2103, 2104, 2132, 2133, 2134, 2136, 2140, 2142, 2143, 2144, 2147, 2150, 2152, 2154, 2155, 2156, 2157, 2161, 2162, 2163, 2164, 2165, 2170, 2173, 2177, 2178, 2179, 2185, 2188, 2191, 2193, 2196, 2202, 2203, 2206, 2215, 2216, 2219, 2221, 2222, 2225, 2226, 2229, 2230, 2231, 2235, 2240, 2244, 2253, 2257, 2260, 2262, 2263, 2273, 2274, 2278, 2282, 2283, 2288, 2291, 2293, 2295, 2296, 2298, 2301, 2303, 2304, 2309, 2314, 2322, 2323, 2328, 2329, 2331, 2333, 2339, 2342, 2345, 2348, 2349, 2351, 2352, 2353, 2358, 2363, 2366, 2379, 2381, 2382, 2384, 2385, 2398, 2401, 2403, 2405, 2410, 2411, 2412, 2413, 2418, 2419, 2421, 2423, 2435, 2437, 2438, 2440, 2443, 2445, 2451, 2457, 2465, 2470, 2471, 2472, 2474, 2476, 2479, 2481, 2482, 2483, 2490, 2492, 2494, 2495, 2496, 2498, 2500, 2504, 2505, 2509, 2510, 2511, 2514, 2515, 2516, 2517, 2525, 2528, 2531, 2532, 2533, 2536, 2537, 2538, 2539, 2541, 2542, 2547, 2548, 2549, 2551, 2552, 2555, 2556, 2557, 2567, 2568, 2573, 2581, 2583, 2589, 2590, 2592, 2594, 2599, 2601, 2605, 2609, 2616, 2617, 2618, 2625, 2627, 2632, 2634, 2637, 2639, 2641, 2644, 2648, 2653, 2655, 2663, 2665, 2671, 2674, 2675, 2684, 2685, 2687, 2689, 2691, 2692, 2696, 2700, 2702, 2704, 2705, 2707, 2712, 2715, 2718, 2719, 2723, 2725, 2726, 2728, 2729, 2735, 2740, 2742, 2746, 2747, 2749, 2752, 2755, 2757, 2770, 2775, 2780, 2782, 2784, 2785, 2787, 2800, 2801, 2802, 2805, 2808, 2812, 2820, 2821, 2823, 2824, 2826, 2827, 2831, 2832, 2833, 2840, 2844, 2850, 2858, 2861, 2862, 2864, 2865, 2871, 2873, 2876, 2888, 2889, 2890, 2894, 2898, 2902, 2903, 2905, 2906, 2909, 2910, 2911, 2915, 2916, 2917, 2919, 2922, 2923, 2924, 2926, 2930, 2931, 2932, 2933, 2934, 2935, 2944, 2946, 2948, 2953, 2955, 2959, 2963, 2966, 2968, 2976, 2979, 2980, 2985, 2992, 2994, 2998, 3002, 3005, 3007, 3008, 3015, 3016, 3023, 3024, 3038, 3039, 3042, 3043, 3044, 3048, 3049, 3051, 3052, 3053, 3055, 3064, 3070, 3072, 3078, 3080, 3081, 3083, 3084, 3085, 3087, 3088, 3090, 3095, 3096, 3100, 3105, 3106, 3109, 3114, 3117, 3118, 3119, 3120, 3121, 3123, 3126, 3127, 3128, 3137, 3138, 3139, 3143, 3145, 3147, 3153, 3154, 3156, 3170, 3181, 3185, 3191, 3192, 3194, 3205, 3206, 3210, 3212, 3219, 3220, 3224, 3225, 3227, 3228, 3236, 3237, 3239, 3240, 3244, 3250, 3252, 3255, 3260, 3261, 3263, 3266, 3271, 3272, 3278, 3280, 3286, 3288, 3290, 3291, 3294, 3295, 3296, 3297, 3299, 3301, 3303, 3312, 3324, 3331, 3332, 3333, 3340, 3343, 3345, 3347, 3349, 3351, 3353, 3355, 3358, 3359, 3360, 3361, 3363, 3370, 3377, 3379, 3380, 3383, 3386, 3397, 3399, 3400, 3404, 3405, 3413, 3415, 3416, 3418, 3419, 3422, 3424, 3426, 3428, 3435, 3438, 3442, 3445, 3447, 3450, 3451, 3452, 3455, 3458, 3460, 3461, 3464, 3465, 3466, 3468, 3470, 3471, 3474, 3475, 3477, 3482, 3486, 3487, 3488, 3490, 3491, 3494, 3496, 3500, 3503, 3504, 3506, 3510, 3511, 3516, 3517, 3518, 3524, 3527, 3531, 3533, 3536, 3537, 3541, 3544, 3545, 3548, 3549, 3552, 3554, 3558, 3560, 3562, 3569, 3574, 3576, 3577, 3587, 3588, 3589, 3592, 3595, 3596, 3597, 3598, 3600, 3603, 3604, 3606, 3607, 3610, 3611, 3613, 3616, 3618, 3620, 3621, 3624, 3629, 3633, 3637, 3640, 3643, 3644, 3645, 3646, 3647, 3648, 3655, 3657, 3659, 3662, 3667, 3669, 3671, 3672, 3674, 3677, 3682, 3684, 3685, 3693, 3694, 3706, 3707, 3713, 3715, 3717, 3718, 3719, 3720, 3725, 3732, 3738, 3739, 3748, 3749, 3752, 3754, 3757, 3761, 3762, 3764, 3765, 3766, 3777, 3778, 3781, 3783, 3788, 3790, 3791, 3792, 3794, 3796, 3798, 3808, 3810, 3818, 3820, 3823, 3825, 3828, 3829, 3830, 3831, 3832, 3833, 3842, 3843, 3844, 3845, 3849, 3858, 3860, 3862, 3867, 3871, 3872, 3873, 3876, 3882, 3883, 3887, 3889, 3890, 3891, 3892, 3893, 3894, 3895, 3908, 3910, 3911, 3912, 3914, 3917, 3923, 3924, 3928, 3934, 3935, 3938, 3947, 3950, 3952, 3954, 3958, 3962, 3967, 3975, 3983, 3985, 3987, 3988, 3997, 4006, 4008, 4013, 4019, 4020, 4024, 4030, 4032, 4033, 4034, 4037, 4039, 4040, 4041, 4045, 4047, 4048, 4051, 4052, 4054, 4056, 4057, 4062, 4066, 4067, 4068, 4069, 4072, 4075, 4080, 4092, 4096, 4105, 4110, 4111, 4113, 4116, 4122, 4128, 4133, 4146, 4148, 4149, 4150, 4156, 4158, 4160, 4161, 4162, 4163, 4165, 4166, 4167, 4168, 4170, 4171, 4175, 4178, 4184, 4185, 4187, 4188, 4189, 4191, 4198, 4201, 4202, 4205, 4206, 4208, 4210, 4211, 4212, 4214, 4219, 4221, 4222, 4227, 4228, 4231, 4233, 4235, 4244, 4250, 4251, 4257, 4260, 4261, 4263, 4266, 4270, 4272, 4279, 4280, 4281, 4283, 4288, 4294, 4296, 4298, 4301, 4302, 4304, 4309, 4312, 4320, 4324, 4329, 4330, 4331, 4335, 4336, 4337, 4338, 4341, 4344, 4347, 4349, 4352, 4354, 4358, 4359, 4360, 4365, 4369, 4371, 4373, 4378, 4380, 4383, 4390, 4394, 4397, 4401, 4402, 4403, 4404, 4405, 4410, 4415, 4418, 4422, 4423, 4439, 4443, 4444, 4446, 4448, 4450, 4453, 4456, 4460, 4461, 4462, 4463, 4464, 4468, 4472, 4474, 4475, 4479, 4485, 4491, 4492, 4494, 4498, 4506, 4507, 4512, 4514, 4515, 4516, 4518, 4519, 4522, 4531, 4543, 4545, 4548, 4549, 4551, 4554, 4555, 4556, 4557, 4558, 4560, 4562, 4565, 4566, 4567, 4570, 4575, 4580, 4583, 4584, 4586, 4590, 4591, 4596, 4601, 4604, 4606, 4611, 4621, 4625, 4630, 4632, 4633, 4634, 4635, 4641, 4643, 4644, 4650, 4653, 4654, 4655, 4659, 4667, 4669, 4671, 4674, 4676, 4677, 4680, 4685, 4687, 4692, 4697, 4700, 4702, 4704, 4706, 4708, 4710, 4719, 4721, 4723, 4725, 4729, 4732, 4737, 4738, 4740, 4749, 4750, 4753, 4754, 4755, 4756, 4759, 4761, 4762, 4765, 4771, 4775, 4779, 4789, 4790, 4791, 4794, 4795, 4804, 4809, 4813, 4814, 4818, 4823, 4824, 4828, 4829, 4832, 4833, 4834, 4835, 4838, 4842, 4857, 4859, 4862, 4864, 4868, 4869, 4872, 4875, 4877, 4880, 4881, 4887, 4889, 4891, 4895, 4901, 4902, 4905, 4909, 4914, 4915, 4917, 4921, 4922, 4924, 4926, 4930, 4935, 4936, 4940, 4943, 4950, 4958, 4959, 4960, 4971, 4972, 4973, 4975, 4977, 4979, 4984, 4987, 4994, 4996, 5000, 5005, 5010, 5015, 5022, 5026, 5029, 5030, 5034, 5038, 5039, 5040, 5042, 5044, 5046, 5052, 5054, 5057, 5063, 5067, 5068, 5072, 5075, 5078, 5079, 5082, 5088, 5089, 5091, 5094, 5095, 5100, 5102, 5111, 5114, 5123, 5129, 5131, 5132, 5140, 5145, 5151, 5153, 5160, 5164, 5165, 5168, 5170, 5174, 5180, 5181, 5182, 5184, 5185, 5188, 5189, 5190, 5191, 5192, 5196, 5198, 5199, 5200, 5203, 5206, 5208, 5214, 5217, 5219, 5225, 5226, 5229, 5234, 5240, 5241, 5243, 5249, 5255, 5258, 5261, 5263, 5264, 5267, 5273, 5275, 5276, 5280, 5281, 5283, 5286, 5290, 5292, 5293, 5298, 5299, 5300, 5301, 5303, 5308, 5311, 5313, 5317, 5319, 5321, 5324, 5329, 5330, 5334, 5338, 5344, 5346, 5348, 5350, 5351, 5359, 5361, 5363, 5364, 5371, 5372, 5382, 5386, 5388, 5389, 5393, 5394, 5395, 5396, 5397, 5402, 5403, 5407, 5409, 5411, 5413, 5414, 5417, 5426, 5431, 5434, 5439, 5448, 5449, 5450, 5452, 5456, 5457, 5458, 5459, 5463, 5464, 5467, 5472, 5474, 5476, 5479, 5482, 5483, 5485, 5491, 5493, 5496, 5498, 5506, 5508, 5510, 5513, 5515, 5516, 5517, 5518, 5519, 5524, 5526, 5529, 5530, 5534, 5535, 5537, 5541, 5557, 5561, 5562, 5563, 5568, 5569, 5571, 5579, 5585, 5588, 5589, 5591, 5592, 5597, 5604, 5608, 5612, 5613, 5616, 5618, 5627, 5631, 5632, 5633, 5635, 5638, 5640, 5642, 5643, 5647, 5648, 5651, 5652, 5659, 5660, 5662, 5663, 5665, 5666, 5675, 5676, 5677, 5689, 5690, 5694, 5695, 5697, 5698, 5702, 5703, 5706, 5709, 5711, 5718, 5721, 5722, 5731, 5732, 5734, 5735, 5739, 5744, 5751, 5754, 5756, 5768, 5771, 5775, 5780, 5784, 5785, 5791, 5794, 5803, 5807, 5808, 5809, 5813, 5814, 5815, 5817, 5820, 5823, 5828, 5831, 5833, 5835, 5836, 5837, 5839, 5850, 5852, 5853, 5854, 5859, 5861, 5864, 5866, 5868, 5869, 5870, 5872, 5876, 5879, 5881, 5883, 5884, 5887, 5888, 5892, 5893, 5907, 5912, 5919, 5922, 5923, 5925, 5926, 5927, 5928, 5932, 5934, 5935, 5938, 5939, 5941, 5944, 5948, 5954, 5956, 5959, 5967, 5968, 5969, 5979, 5982, 5987, 5991, 5994, 5996, 6000, 6002, 6004, 6006, 6009, 6012, 6013, 6016, 6017, 6023, 6024, 6025, 6026, 6031, 6038, 6041, 6043, 6044, 6048, 6051, 6058, 6059, 6062, 6063, 6068, 6069, 6070, 6072, 6073, 6075, 6081, 6085, 6088, 6089, 6092, 6093, 6097, 6098, 6099, 6107, 6108, 6109, 6110, 6113, 6116, 6119, 6120, 6124, 6129, 6131, 6132, 6136, 6137, 6138, 6143, 6145, 6146, 6157, 6160, 6162, 6163, 6164, 6165, 6181, 6183, 6186, 6188, 6189, 6193, 6198, 6204, 6205, 6220, 6223, 6224, 6227, 6228, 6234, 6242, 6243, 6246, 6247, 6250, 6251, 6264, 6265, 6267, 6270, 6275, 6281, 6286, 6292, 6293, 6295, 6297, 6299, 6300, 6303, 6309, 6311, 6315, 6317, 6321, 6322, 6328, 6333, 6338, 6342, 6343, 6344, 6346, 6353, 6354, 6356, 6362, 6363, 6365, 6367, 6370, 6372, 6375, 6383, 6386, 6394, 6397, 6399, 6403, 6404, 6405, 6408, 6412, 6414, 6415, 6416, 6417, 6419, 6420, 6422, 6425, 6426, 6428, 6429, 6430, 6431, 6436, 6440, 6449, 6456, 6464, 6466, 6467, 6470, 6474, 6475, 6476, 6478, 6480, 6482, 6484, 6485, 6494, 6495, 6501, 6502, 6504, 6510, 6512, 6513, 6516, 6519, 6526, 6530, 6534, 6535, 6537, 6543, 6547, 6549, 6553, 6555, 6558, 6567, 6569, 6571, 6572, 6574, 6576, 6577, 6579, 6584, 6588, 6589, 6592, 6594, 6595, 6597, 6600, 6603, 6606, 6609, 6617, 6623, 6625, 6628, 6629, 6633, 6635, 6639, 6640, 6644, 6646, 6647, 6649, 6655, 6656, 6658, 6666, 6671, 6672, 6673, 6682, 6693, 6703, 6704, 6705, 6706, 6716, 6718, 6720, 6729, 6730, 6734, 6736, 6737, 6739, 6742, 6747, 6749, 6756, 6757, 6759, 6761, 6764, 6766, 6767, 6778, 6779, 6780, 6782, 6783, 6793, 6794, 6795, 6797, 6799, 6803, 6804, 6805, 6807, 6810, 6811, 6813, 6816, 6817, 6819, 6820, 6821, 6824, 6826, 6827, 6828, 6830, 6831, 6834, 6836, 6841, 6842, 6843, 6848, 6851, 6863, 6868, 6869, 6875, 6877, 6880, 6881, 6882, 6883, 6884, 6887, 6894, 6902, 6903, 6904, 6907, 6914, 6917, 6919, 6920, 6921, 6924, 6930, 6936, 6939, 6946, 6959, 6960, 6963, 6967, 6970, 6971, 6973, 6979, 6980, 6981, 6984, 6985, 6987, 6988, 6990, 6991, 6994, 6999, 7009, 7013, 7022, 7029, 7033, 7038, 7041, 7043, 7045, 7046, 7049, 7051, 7052, 7053, 7057, 7064, 7067, 7073, 7083, 7084, 7094, 7105, 7106, 7107, 7108, 7110, 7112, 7113, 7117, 7118, 7126, 7129, 7130, 7138, 7139, 7142, 7143, 7144, 7150, 7151, 7154, 7163, 7164, 7165, 7166, 7169, 7172, 7176, 7182, 7184, 7192, 7194, 7196, 7197, 7201, 7202, 7206, 7207, 7208, 7209, 7210, 7211, 7212, 7217, 7219, 7224, 7227, 7228, 7230, 7231, 7235, 7236, 7244, 7245, 7255, 7257, 7258, 7262, 7263, 7264, 7267, 7268, 7274, 7276, 7281, 7282, 7287, 7291, 7292, 7293, 7296, 7299, 7300, 7303, 7304, 7306, 7307, 7311, 7312, 7313, 7318, 7320, 7323, 7328, 7330, 7340, 7345, 7350, 7351, 7357, 7358, 7361, 7365, 7369, 7371, 7373, 7376, 7377, 7382, 7383, 7386, 7392, 7395, 7396, 7398, 7399, 7400, 7406, 7409, 7410, 7411, 7417, 7418, 7430, 7434, 7436, 7438, 7441, 7447, 7448, 7452, 7453, 7454, 7456, 7457, 7466, 7467, 7470, 7472, 7476, 7481, 7483, 7490, 7492, 7493, 7499, 7503, 7504, 7506, 7512, 7514, 7515, 7521, 7522, 7523, 7524, 7525, 7533, 7538, 7546, 7561, 7562, 7572, 7574, 7576, 7579, 7583, 7585, 7586, 7589, 7594, 7596, 7599, 7604, 7609, 7612, 7619, 7620, 7622, 7624, 7625, 7633, 7642, 7643, 7644, 7649, 7658, 7661, 7664, 7665, 7671, 7674, 7678, 7679, 7680, 7682, 7686, 7687, 7689, 7695, 7700, 7703, 7712, 7715, 7716, 7724, 7726, 7730, 7736, 7737, 7738, 7741, 7742, 7744, 7745, 7749, 7763, 7764, 7768, 7770, 7772, 7774, 7775, 7780, 7781, 7786, 7788, 7791, 7793, 7798, 7799, 7800, 7803, 7804, 7805, 7806, 7807, 7818, 7819, 7820, 7822, 7823, 7824, 7825, 7826, 7833, 7839, 7841, 7844, 7845, 7854, 7856, 7865, 7873, 7875, 7877, 7878, 7880, 7881, 7887, 7888, 7890, 7911, 7918, 7923, 7925, 7928, 7933, 7934, 7935, 7938, 7942, 7944, 7947, 7948, 7952, 7974, 7976, 7977, 7984, 7986, 7996, 8004, 8006, 8007, 8012, 8021, 8024, 8026, 8031, 8036, 8042, 8044, 8047, 8053, 8056, 8059, 8061, 8063, 8068, 8072, 8076, 8078, 8079, 8080, 8081, 8083, 8084, 8088, 8089, 8090, 8091, 8093, 8095, 8100, 8102, 8106, 8110, 8112, 8113, 8118, 8121, 8126, 8129, 8130, 8134, 8145, 8147, 8148, 8150, 8151, 8163, 8170, 8177, 8178, 8179, 8181, 8182, 8189, 8191, 8193, 8194, 8202, 8204, 8208, 8210, 8213, 8217, 8219, 8220, 8223, 8227, 8230, 8234, 8235, 8237, 8239, 8241, 8242, 8248, 8250, 8252, 8253, 8263, 8264, 8265, 8266, 8268, 8269, 8270, 8272, 8273, 8274, 8276, 8282, 8289, 8300, 8304, 8310, 8311, 8315, 8318, 8319, 8320, 8323, 8329, 8340, 8341, 8347, 8350, 8353, 8358, 8367, 8368, 8373, 8379, 8380, 8382, 8385, 8387, 8389, 8392, 8393, 8395, 8401, 8402, 8403, 8404, 8408, 8410, 8413, 8414, 8415, 8416, 8417, 8418, 8430, 8436, 8438, 8439, 8443, 8444, 8445, 8447, 8448, 8449, 8450, 8451, 8457, 8465, 8470, 8472, 8473, 8474, 8476, 8477, 8481, 8482, 8485, 8486, 8498, 8500, 8501, 8503, 8505, 8507, 8513, 8515, 8516, 8520, 8521, 8524, 8525, 8526, 8527, 8533, 8535, 8539, 8542, 8543, 8553, 8554, 8561, 8562, 8565, 8574, 8575, 8576, 8579, 8581, 8582, 8585, 8592, 8596, 8597, 8600, 8601, 8603, 8604, 8605, 8609, 8611, 8612, 8630, 8631, 8634, 8635, 8638, 8639, 8641, 8644, 8646, 8650, 8654, 8658, 8659, 8663, 8665, 8669, 8672, 8676, 8677, 8685, 8686, 8689, 8690, 8693, 8699, 8700, 8703, 8706, 8708, 8709, 8713, 8717, 8720, 8722, 8731, 8736, 8741, 8743, 8744, 8747, 8748, 8757, 8771, 8773, 8774, 8777, 8779, 8783, 8784, 8785, 8786, 8789, 8792, 8803, 8808, 8810, 8821, 8822, 8824, 8828, 8829, 8830, 8831, 8835, 8839, 8843, 8846, 8853, 8865, 8874, 8876, 8877, 8878, 8881, 8888, 8889, 8892, 8896, 8907, 8908, 8911, 8916, 8917, 8919, 8922, 8924, 8926, 8929, 8930, 8937, 8938, 8941, 8945, 8946, 8951, 8953, 8960, 8961, 8967, 8968, 8979, 8980, 8981, 8985, 8986, 8991, 8992, 8998, 8999, 9001, 9006, 9009, 9011, 9012, 9018, 9020, 9022, 9026, 9027, 9029, 9030, 9045, 9052, 9056, 9058, 9059, 9060, 9063, 9065, 9069, 9071, 9072, 9076, 9078, 9080, 9087, 9088, 9092, 9096, 9103, 9104, 9105, 9107, 9112, 9118, 9123, 9125, 9129, 9131, 9133, 9134, 9139, 9140, 9141, 9142, 9144, 9152, 9154, 9155, 9159, 9167, 9168, 9175, 9177, 9179, 9180, 9185, 9190, 9191, 9194, 9195, 9205, 9206, 9207, 9210, 9211, 9213, 9215, 9216, 9223, 9226, 9229, 9231, 9233, 9237, 9243, 9246, 9247, 9248, 9249, 9253, 9257, 9259, 9262, 9265, 9267, 9269, 9270, 9273, 9275, 9282, 9284, 9285, 9288, 9290, 9292, 9295, 9296, 9300, 9304, 9308, 9311, 9320, 9321, 9323, 9326, 9328, 9332, 9336, 9337, 9339, 9340, 9341, 9346, 9347, 9350, 9352, 9353, 9359, 9360, 9366, 9371, 9373, 9375, 9376, 9380, 9382, 9391, 9392, 9394, 9400, 9402, 9403, 9406, 9413, 9414, 9415, 9421, 9422, 9423, 9425, 9429, 9434, 9439, 9440, 9443, 9451, 9452, 9453, 9456, 9460, 9471, 9474, 9476, 9481, 9488, 9490, 9500, 9504, 9509, 9514, 9517, 9518, 9534, 9536, 9537, 9538, 9540, 9545, 9546, 9550, 9551, 9553, 9555, 9560, 9564, 9571, 9574, 9577, 9587, 9590, 9591, 9593, 9595, 9596, 9597, 9598, 9601, 9602, 9606, 9607, 9609, 9615, 9617, 9618, 9620, 9623, 9626, 9629, 9632, 9641, 9642, 9644, 9645, 9655, 9657, 9658, 9663, 9666, 9670, 9676, 9682, 9686, 9687, 9688, 9698, 9701, 9706, 9710, 9711, 9721, 9723, 9724, 9726, 9729, 9730, 9731, 9732, 9733, 9737, 9742, 9746, 9750, 9753, 9756, 9763, 9764, 9767, 9770, 9774, 9776, 9777, 9782, 9786, 9791, 9792, 9793, 9794, 9798, 9799, 9804, 9810, 9811, 9812, 9813, 9816, 9819, 9820, 9828, 9829, 9830, 9835, 9845, 9847, 9861, 9869, 9873, 9875, 9878, 9879, 9882, 9886, 9887, 9892, 9900, 9907, 9909, 9910, 9911, 9912, 9923, 9924, 9928, 9932, 9935, 9938, 9940, 9946, 9949, 9950, 9952, 9953, 9962, 9963, 9967, 9968, 9972, 9973, 9975, 9980, 9982, 9984, 9985, 9987, 9988, 9990, 9991, 9992, 9997, 10000, 10009, 10010, 10013, 10015, 10017, 10019, 10020, 10026, 10027, 10032, 10033, 10034, 10035, 10041, 10047, 10049, 10051, 10052, 10053, 10054, 10055, 10058, 10059, 10062, 10064, 10066, 10068, 10073, 10077, 10078, 10080, 10081, 10083, 10090, 10091, 10092, 10094, 10095, 10101, 10103, 10106, 10110, 10115, 10116, 10122, 10128, 10129, 10131, 10132, 10136, 10140, 10143, 10151, 10158, 10160, 10163, 10165, 10166, 10168, 10174, 10176, 10178, 10181, 10184, 10192, 10193, 10194, 10195, 10196, 10199, 10212, 10218, 10219, 10220, 10222, 10223, 10225, 10233, 10235, 10236, 10237, 10239, 10240, 10247, 10249, 10253, 10254, 10255, 10259, 10262, 10263, 10268, 10269, 10275, 10278, 10284, 10286, 10291, 10292, 10293, 10300, 10302, 10306, 10307, 10311, 10312, 10314, 10318, 10319, 10323, 10324, 10325, 10326, 10331, 10333, 10334, 10336, 10340, 10341, 10343, 10346, 10353, 10354, 10356, 10357, 10364, 10371, 10375, 10376, 10378, 10380, 10381, 10385, 10388, 10393, 10395, 10397, 10398, 10399, 10401, 10410, 10411, 10414, 10416, 10417, 10421, 10423, 10425, 10435, 10436, 10438, 10440, 10446, 10447, 10449, 10450, 10452, 10453, 10456, 10463, 10464, 10465, 10466, 10468, 10469, 10471, 10474, 10480, 10482, 10487, 10490, 10494, 10496, 10506, 10508, 10514, 10518, 10522, 10523, 10527, 10528, 10530, 10531, 10532, 10536, 10537, 10541, 10542, 10543, 10544, 10547, 10548, 10556, 10558, 10560, 10563, 10567, 10569, 10573, 10580, 10581, 10582, 10583, 10587, 10588, 10593, 10596, 10599, 10601, 10602, 10603, 10604, 10611, 10612, 10613, 10616, 10621, 10622, 10625, 10629, 10630, 10631, 10633, 10637, 10638, 10639, 10645, 10646, 10649, 10655, 10665, 10666, 10668, 10670, 10676, 10678, 10679, 10682, 10683, 10684, 10685, 10686, 10700, 10701, 10705, 10707, 10711, 10715, 10716, 10721, 10722, 10724, 10726, 10729, 10732, 10734, 10738, 10740, 10741, 10744, 10747, 10748, 10749, 10752, 10756, 10761, 10762, 10766, 10769, 10770, 10775, 10776, 10777, 10778, 10779, 10784, 10785, 10788, 10790, 10792, 10801, 10803, 10805, 10809, 10812, 10815, 10818, 10819, 10822, 10823, 10824, 10827, 10831, 10833, 10836, 10838, 10840, 10843, 10850, 10851, 10852, 10853, 10854, 10858, 10860, 10866, 10867, 10877, 10880, 10886, 10887, 10888, 10889, 10896, 10898, 10899, 10901, 10902, 10911, 10917, 10918, 10920, 10926, 10927, 10928, 10929, 10930, 10933, 10934, 10940, 10941, 10945, 10947, 10962, 10965, 10966, 10967, 10972, 10976, 10977, 10985, 10988, 10993, 10995, 10996, 11008, 11009, 11015, 11021, 11024, 11027, 11032, 11033, 11039, 11040, 11046, 11047, 11052, 11053, 11056, 11058, 11060, 11063, 11066, 11067, 11078, 11082, 11083, 11090, 11095, 11098, 11100, 11101, 11103, 11107, 11114, 11118, 11122, 11129, 11133, 11135, 11137, 11145, 11146, 11147, 11149, 11151, 11152, 11153, 11154, 11160, 11161, 11163, 11165, 11168, 11169, 11173, 11174, 11177, 11181, 11187, 11188, 11190, 11192, 11194, 11198, 11203, 11208, 11214, 11216, 11217, 11218, 11222, 11224, 11226, 11227, 11229, 11230, 11231, 11233, 11235, 11236, 11238, 11239, 11242, 11243, 11246, 11247, 11248, 11253, 11254, 11255, 11256, 11258, 11260, 11262, 11263, 11266, 11278, 11290, 11292, 11295, 11297, 11299, 11302, 11304, 11305, 11306, 11313, 11318, 11323, 11330, 11331, 11332, 11337, 11340, 11345, 11346, 11348, 11349, 11356, 11358, 11362, 11363, 11364, 11365, 11370, 11371, 11373, 11377, 11380, 11382, 11387, 11388, 11391, 11394, 11401, 11404, 11405, 11417, 11424, 11430, 11431, 11435, 11438, 11439, 11440, 11443, 11446, 11447, 11449, 11456, 11459, 11461, 11465, 11466, 11475, 11478, 11487, 11488, 11489, 11490, 11491, 11494, 11496, 11497, 11498, 11499, 11500, 11505, 11506, 11507, 11508, 11518, 11520, 11524, 11526, 11527, 11528, 11530, 11531, 11532, 11533, 11535, 11540, 11541, 11544, 11548, 11551, 11553, 11558, 11560, 11561, 11562, 11564, 11567, 11568, 11570, 11571, 11576, 11577, 11578, 11583, 11585, 11588, 11593, 11594, 11595, 11596, 11597, 11599, 11604, 11607, 11612, 11618, 11623, 11626, 11628, 11631, 11639, 11640, 11647, 11650, 11656, 11658, 11659, 11663, 11665, 11669, 11673, 11678, 11681, 11682, 11688, 11691, 11692, 11694, 11695, 11696, 11699, 11701, 11705, 11707, 11712, 11718, 11720, 11721, 11725, 11726, 11730, 11731, 11732, 11733, 11736, 11740, 11743, 11744, 11753, 11756, 11759, 11760, 11761, 11762, 11763, 11765, 11770, 11771, 11776, 11777, 11781, 11783, 11785, 11786, 11788, 11792, 11794, 11799, 11800, 11802, 11805, 11809, 11810, 11811, 11814, 11818, 11821, 11826, 11830, 11837, 11840, 11841, 11844, 11846, 11848, 11849, 11851, 11856, 11858, 11861, 11864, 11865, 11868, 11870, 11872, 11876, 11877, 11878, 11886, 11889, 11891, 11892, 11894, 11898, 11901, 11902, 11906, 11909, 11911, 11913, 11914, 11916, 11917, 11919, 11920, 11921, 11922, 11923, 11926, 11927, 11928, 11929, 11930, 11934, 11940, 11943, 11945, 11947, 11949, 11953, 11956, 11958, 11959, 11960, 11961, 11962, 11963, 11964, 11965, 11968, 11973, 11974, 11976, 11977, 11978, 11979, 11983, 11988, 11989, 11993, 11997, 11998, 11999, 12004, 12017, 12023, 12026, 12032, 12033, 12043, 12044, 12059, 12068, 12076, 12077, 12080, 12081, 12083, 12087, 12091, 12092, 12093, 12095, 12098, 12102, 12104, 12106, 12109, 12110, 12112, 12115, 12118, 12122, 12126, 12128, 12129, 12130, 12137, 12138, 12139, 12143, 12145, 12146, 12147, 12149, 12151, 12161, 12166, 12170, 12171, 12174, 12175, 12176, 12181, 12194, 12197, 12200, 12201, 12204, 12207, 12208, 12217, 12218, 12219, 12220, 12221, 12226, 12227, 12234, 12240, 12241, 12243, 12245, 12249, 12250, 12252, 12253, 12256, 12259, 12260, 12263, 12267, 12268, 12269, 12278, 12283, 12284, 12286, 12287, 12288, 12291, 12293, 12295, 12297, 12298, 12304, 12310, 12311, 12312, 12313, 12314, 12315, 12317, 12321, 12323, 12329, 12331, 12334, 12347, 12354, 12356, 12358, 12359, 12364, 12367, 12368, 12369, 12370, 12374, 12376, 12379, 12380, 12381, 12383, 12385, 12397, 12400, 12403, 12404, 12406, 12410, 12414, 12419, 12420, 12421, 12424, 12426, 12427, 12435, 12437, 12439, 12440, 12441, 12445, 12451, 12455, 12456, 12457, 12459, 12462, 12467, 12468, 12470, 12472, 12478, 12479, 12481, 12487, 12488, 12489, 12495, 12497, 12499, 12504, 12505, 12508, 12514, 12521, 12530, 12536, 12539, 12545, 12547, 12549, 12555, 12559, 12561, 12563, 12564, 12565, 12567, 12572, 12578, 12585, 12588, 12591, 12597, 12605, 12608, 12609, 12610, 12611, 12614, 12616, 12619, 12622, 12623, 12626, 12631, 12633, 12634, 12635, 12636, 12638, 12639, 12641, 12649, 12651, 12663, 12668, 12670, 12671, 12672, 12674, 12675, 12676, 12679, 12680, 12681, 12683, 12684, 12685, 12688, 12691, 12693, 12695, 12698, 12699, 12701, 12702, 12703, 12713, 12718, 12719, 12729, 12731, 12732, 12733, 12737, 12738, 12739, 12741, 12742, 12743, 12748, 12754, 12755, 12758, 12760, 12761, 12764, 12766, 12767, 12771, 12783, 12790, 12794, 12797, 12800, 12801, 12802, 12810, 12812, 12813, 12814, 12817, 12819, 12820, 12822, 12824, 12826, 12827, 12828, 12834, 12836, 12838, 12839, 12843, 12844, 12849, 12856, 12858, 12861, 12866, 12883, 12884, 12887, 12888, 12895, 12898, 12900, 12904, 12905, 12906, 12910, 12912, 12913, 12916, 12917, 12921, 12926, 12928, 12929, 12932, 12933, 12938, 12939, 12945, 12946, 12947, 12966, 12968, 12969, 12973, 12976, 12978, 12982, 12983, 12984, 12987, 12994, 13010, 13011, 13012, 13014, 13017, 13018, 13022, 13030, 13032, 13033, 13035, 13038, 13040, 13041, 13042, 13049, 13050, 13053, 13055, 13056, 13060, 13061, 13065, 13066, 13067, 13069, 13071, 13074, 13075, 13085, 13086, 13087, 13095, 13098, 13101, 13102, 13105, 13115, 13117, 13118, 13120, 13123, 13124, 13131, 13135, 13142, 13148, 13149, 13151, 13152, 13153, 13158, 13160, 13169, 13174, 13175, 13177, 13181, 13182, 13188, 13197, 13199, 13205, 13206, 13209, 13210, 13213, 13215, 13217, 13221, 13222, 13224, 13227, 13230, 13232, 13234, 13235, 13236, 13237, 13238, 13243, 13249, 13251, 13255, 13259, 13261, 13263, 13264, 13268, 13269, 13276, 13280, 13281, 13292, 13295, 13296, 13301, 13303, 13304, 13315, 13317, 13318, 13319, 13320, 13321, 13323, 13326, 13328, 13330, 13332, 13337, 13338, 13343, 13346, 13351, 13353, 13354, 13361, 13368, 13369, 13370, 13373, 13377, 13380, 13381, 13384, 13385, 13391, 13393, 13394, 13396, 13397, 13401, 13408, 13410, 13416, 13417, 13419, 13423, 13424, 13433, 13448, 13451, 13454, 13456, 13460, 13463, 13466, 13468, 13469, 13473, 13475, 13490, 13492, 13496, 13498, 13499, 13500, 13503, 13504, 13505, 13506, 13513, 13514, 13515, 13516, 13517, 13519, 13520, 13521, 13524, 13529, 13530, 13532, 13540, 13543, 13544, 13546, 13547, 13549, 13552, 13553, 13555, 13556, 13568, 13569, 13582, 13584, 13589, 13595, 13597, 13601, 13602, 13604, 13612, 13621, 13623, 13628, 13631, 13632, 13634, 13636, 13637, 13641, 13647, 13650, 13652, 13654, 13661, 13662, 13663, 13668, 13671, 13675, 13676, 13677, 13681, 13684, 13687, 13688, 13691, 13695, 13697, 13698, 13700, 13702, 13706, 13710, 13712, 13713, 13715, 13716, 13720, 13721, 13727, 13729, 13739, 13745, 13748, 13750, 13755, 13756, 13758, 13764, 13766, 13769, 13772, 13773, 13775, 13776, 13779, 13781, 13785, 13786, 13787, 13789, 13790, 13791, 13793, 13794, 13796, 13798, 13809, 13816, 13817, 13818, 13819, 13820, 13822, 13823, 13828, 13830, 13831, 13833, 13835, 13843, 13849, 13852, 13853, 13859, 13860, 13862, 13866, 13869, 13870, 13872, 13873, 13874, 13875, 13877, 13880, 13881, 13882, 13883, 13885, 13891, 13892, 13894, 13896, 13897, 13901, 13904, 13906, 13909, 13910, 13911, 13917, 13919, 13921, 13927, 13930, 13938, 13947, 13948, 13949, 13952, 13956, 13963, 13965, 13969, 13970, 13975, 13976, 13981, 13984, 13990, 13992, 13999, 14000, 14008, 14009, 14014, 14017, 14022, 14026, 14027, 14030, 14031, 14036, 14041, 14043, 14049, 14050, 14051, 14052, 14062, 14063, 14066, 14069, 14070, 14071, 14073, 14075, 14082, 14086, 14092, 14093, 14094, 14096, 14099, 14100, 14102, 14105, 14106, 14112, 14116, 14118, 14119, 14120, 14122, 14124, 14125, 14128, 14129, 14132, 14134, 14135, 14138, 14139, 14143, 14145, 14146, 14148, 14149, 14150.

Promoters expressing in root tissue at 14 days after pollination include SEQ IDs: 1, 3, 4, 7, 8, 13, 14, 15, 27, 29, 31, 34, 36, 48, 54, 64, 65, 68, 69, 70, 71, 81, 82, 88, 96, 97, 99, 101, 102, 103, 107, 108, 110, 112, 117, 121, 126, 130, 131, 132, 134, 143, 147, 148, 152, 157, 162, 164, 174, 176, 179, 181, 187, 191, 194, 195, 196, 197, 199, 202, 204, 205, 210, 211, 212, 217, 223, 232, 233, 235, 236, 237, 240, 242, 243, 244, 246, 248, 249, 250, 251, 254, 257, 259, 262, 264, 271, 273, 274, 280, 281, 284, 286, 288, 289, 299, 301, 302, 305, 306, 307, 309, 314, 316, 319, 320, 323, 328, 329, 332, 334, 335, 346, 348, 349, 352, 353, 354, 356, 357, 360, 364, 367, 368, 371, 376, 378, 379, 387, 388, 396, 401, 402, 405, 406, 407, 412, 419, 420, 423, 424, 428, 429, 433, 434, 436, 448, 452, 454, 456, 461, 466, 474, 478, 479, 481, 483, 485, 488, 498, 501, 502, 504, 509, 510, 512, 513, 514, 515, 516, 517, 522, 523, 525, 529, 532, 533, 534, 536, 537, 538, 541, 542, 544, 546, 547, 554, 557, 564, 565, 569, 576, 577, 585, 588, 591, 593, 594, 595, 596, 598, 599, 601, 604, 607, 611, 613, 614, 620, 623, 626, 630, 631, 633, 635, 638, 641, 643, 644, 650, 653, 662, 663, 665, 666, 667, 668, 671, 674, 676, 677, 681, 683, 686, 693, 694, 701, 705, 716, 717, 719, 722, 724, 727, 734, 736, 739, 742, 749, 753, 759, 763, 765, 768, 771, 782, 783, 792, 793, 795, 797, 800, 802, 806, 808, 813, 819, 820, 821, 823, 829, 830, 833, 840, 842, 844, 850, 855, 857, 859,
860, 862, 863, 865, 868, 870, 871, 872, 877, 884, 885, 887,
890, 891, 892, 895, 897, 901, 902, 903, 907, 908, 911, 912,
916, 917, 919, 924, 929, 931, 936, 938, 943, 944, 951, 953,
954, 957, 958, 959, 961, 962, 963, 964, 966, 974, 976, 979,
980, 981, 982, 983, 987, 993, 994, 995, 996, 997, 999, 1003,
1006, 1007, 1009, 1010, 1011, 1014, 1017, 1028, 1032, 1039,
1041, 1042, 1043, 1045, 1047, 1049, 1050, 1051, 1052, 1054,
1055, 1056, 1064, 1065, 1069, 1077, 1078, 1086, 1087, 1088,
1089, 1092, 1095, 1103, 1104, 1108, 1110, 1111, 1112, 1114,
1115, 1117, 1118, 1119, 1120, 1122, 1127, 1130, 1132, 1133,
1136, 1137, 1144, 1146, 1147, 1148, 1154, 1160, 1166, 1169,
1170, 1176, 1178, 1182, 1190, 1191, 1196, 1198, 1199, 1200,
1204, 1205, 1214, 1217, 1218, 1219, 1223, 1225, 1227, 1228,
1230, 1231, 1233, 1236, 1239, 1240, 1241, 1248, 1249, 1250,
1252, 1253, 1256, 1257, 1258, 1269, 1272, 1275, 1277, 1281,
1282, 1285, 1286, 1291, 1292, 1293, 1306, 1309, 1312, 1316,
1317, 1320, 1325, 1327, 1330, 1331, 1334, 1346, 1347, 1349,
1351, 1354, 1355, 1360, 1364, 1368, 1371, 1373, 1376, 1377,
1380, 1381, 1382, 1386, 1388, 1392, 1396, 1397, 1398, 1403,
1404, 1405, 1407, 1409, 1410, 1411, 1412, 1415, 1421, 1423,
1426, 1431, 1438, 1441, 1442, 1444, 1451, 1453, 1454, 1455,
1459, 1462, 1466, 1468, 1471, 1474, 1475, 1481, 1486, 1487,
1488, 1490, 1493, 1496, 1498, 1499, 1508, 1510, 1511, 1514,
1517, 1518, 1525, 1526, 1527, 1539, 1543, 1545, 1546, 1548,
1549, 1550, 1556, 1560, 1563, 1567, 1571, 1575, 1576, 1578,
1584, 1586, 1590, 1592, 1593, 1594, 1599, 1600, 1602, 1604,
1609, 1612, 1614, 1615, 1616, 1622, 1624, 1625, 1634, 1635,
1637, 1638, 1639, 1641, 1648, 1650, 1652, 1658, 1662, 1668,
1669, 1671, 1673, 1675, 1676, 1677, 1680, 1683, 1685, 1688,
1689, 1691, 1698, 1701, 1705, 1706, 1707, 1708, 1710, 1717,
1719, 1721, 1723, 1725, 1726, 1727, 1729, 1731, 1732, 1735,
1740, 1745, 1755, 1758, 1759, 1761, 1768, 1771, 1778, 1779,
1782, 1784, 1785, 1791, 1807, 1813, 1815, 1816, 1820, 1830,
1832, 1834, 1835, 1837, 1838, 1840, 1845, 1850, 1852, 1856,
1858, 1859, 1861, 1865, 1867, 1868, 1869, 1870, 1872, 1874,
1876, 1882, 1883, 1886, 1888, 1897, 1898, 1899, 1900, 1902,
1903, 1904, 1905, 1906, 1911, 1914, 1915, 1918, 1920, 1922,
1923, 1924, 1930, 1931, 1933, 1934, 1936, 1940, 1944, 1945,
1950, 1952, 1953, 1973, 1981, 1990, 1991, 1992, 1993, 1994,
1995, 1996, 1999, 2000, 2007, 2008, 2009, 2010, 2012, 2013,
2016, 2017, 2020, 2026, 2031, 2032, 2039, 2041, 2043, 2045,
2048, 2060, 2062, 2064, 2066, 2071, 2072, 2074, 2077, 2080,
2081, 2082, 2083, 2089, 2094, 2096, 2097, 2099, 2103, 2104,
2119, 2126, 2132, 2133, 2134, 2137, 2140, 2142, 2143, 2144,
2147, 2150, 2152, 2156, 2157, 2159, 2161, 2162, 2164, 2165,
2170, 2172, 2173, 2177, 2178, 2179, 2185, 2190, 2191, 2193,
2202, 2203, 2205, 2206, 2207, 2214, 2215, 2216, 2221, 2225,
2226, 2227, 2229, 2230, 2231, 2232, 2235, 2240, 2244, 2247,
2253, 2257, 2260, 2262, 2263, 2265, 2273, 2274, 2276, 2280,
2282, 2288, 2293, 2295, 2296, 2298, 2301, 2303, 2304, 2308,
2309, 2310, 2314, 2322, 2323, 2328, 2329, 2339, 2342, 2348,
2349, 2351, 2352, 2353, 2360, 2361, 2362, 2363, 2366, 2371,
2377, 2379, 2381, 2382, 2383, 2384, 2385, 2398, 2401, 2403,
2405, 2410, 2411, 2412, 2418, 2419, 2420, 2422, 2423, 2430,
2435, 2438, 2441, 2442, 2443, 2445, 2451, 2452, 2453, 2454,
2455, 2457, 2458, 2465, 2470, 2471, 2472, 2474, 2476, 2479,
2481, 2482, 2483, 2490, 2492, 2494, 2495, 2496, 2498, 2500,
2504, 2505, 2509, 2510, 2511, 2514, 2517, 2519, 2525, 2528,
2531, 2532, 2533, 2536, 2537, 2538, 2539, 2541, 2542, 2547,
2548, 2551, 2552, 2554, 2555, 2556, 2557, 2559, 2567, 2568,
2573, 2577, 2578, 2581, 2583, 2589, 2590, 2592, 2594, 2599,
2601, 2605, 2609, 2613, 2616, 2617, 2618, 2625, 2626, 2627,
2632, 2634, 2637, 2639, 2644, 2648, 2650, 2652, 2653, 2655,
2661, 2662, 2671, 2674, 2675, 2684, 2685, 2687, 2689, 2691,
2696, 2700, 2707, 2711, 2718, 2719, 2720, 2723, 2725, 2726,
2727, 2728, 2729, 2735, 2740, 2746, 2747, 2749, 2752, 2755,
2757, 2763, 2764, 2770, 2775, 2780, 2782, 2784, 2785, 2787,
2791, 2798, 2800, 2801, 2802, 2805, 2808, 2812, 2819, 2820,
2821, 2822, 2823, 2824, 2827, 2828, 2829, 2840, 2842, 2844,
2850, 2857, 2858, 2861, 2864, 2865, 2866, 2871, 2873, 2876,
2878, 2881, 2888, 2889, 2890, 2893, 2902, 2906, 2908, 2909,
2910, 2911, 2919, 2923, 2924, 2926, 2930, 2931, 2932, 2933,
2934, 2935, 2944, 2945, 2946, 2948, 2955, 2959, 2962, 2963,
2966, 2968, 2976, 2979, 2980, 2994, 2998, 3000, 3002, 3005,
3007, 3010, 3014, 3015, 3016, 3023, 3024, 3027, 3038, 3039,
3042, 3043, 3044, 3046, 3048, 3049, 3050, 3051, 3052, 3053,
3055, 3064, 3067, 3072, 3075, 3078, 3080, 3081, 3083, 3084,
3085, 3087, 3088, 3094, 3095, 3096, 3100, 3101, 3102, 3105,
3106, 3109, 3114, 3118, 3119, 3120, 3121, 3123, 3126, 3127,
3128, 3129, 3137, 3138, 3139, 3143, 3147, 3153, 3154, 3157,
3158, 3166, 3170, 3177, 3181, 3185, 3189, 3191, 3194, 3199,
3202, 3205, 3206, 3210, 3212, 3215, 3219, 3220, 3224, 3225,
3227, 3228, 3236, 3237, 3239, 3240, 3244, 3245, 3247, 3250,
3252, 3255, 3258, 3260, 3261, 3262, 3263, 3266, 3271, 3278,
3280, 3286, 3288, 3290, 3291, 3294, 3295, 3296, 3297, 3299,
3301, 3305, 3312, 3313, 3324, 3327, 3331, 3332, 3333, 3340,
3343, 3345, 3347, 3349, 3351, 3353, 3355, 3356, 3357, 3358,
3359, 3360, 3361, 3363, 3369, 3370, 3374, 3377, 3379, 3380,
3383, 3386, 3392, 3393, 3397, 3399, 3402, 3404, 3415, 3416,
3418, 3419, 3420, 3422, 3426, 3428, 3432, 3438, 3441, 3445,
3447, 3450, 3451, 3455, 3458, 3460, 3461, 3464, 3465, 3468,
3470, 3471, 3474, 3475, 3477, 3482, 3483, 3487, 3488, 3490,
3491, 3494, 3496, 3503, 3504, 3506, 3510, 3516, 3517, 3518,
3523, 3529, 3533, 3536, 3541, 3544, 3545, 3548, 3549, 3551,
3552, 3554, 3558, 3560, 3562, 3563, 3569, 3572, 3574, 3576,
3577, 3579, 3582, 3587, 3588, 3592, 3593, 3595, 3597, 3598,
3599, 3600, 3603, 3606, 3607, 3610, 3611, 3613, 3616, 3618,
3620, 3621, 3623, 3624, 3626, 3627, 3628, 3629, 3630, 3631,
3633, 3637, 3640, 3642, 3643, 3644, 3645, 3646, 3647, 3648,
3650, 3655, 3657, 3659, 3662, 3663, 3668, 3671, 3672, 3674,
3682, 3684, 3685, 3693, 3697, 3704, 3706, 3707, 3713, 3715,
3717, 3718, 3719, 3720, 3724, 3725, 3731, 3738, 3739, 3748,
3749, 3752, 3754, 3761, 3762, 3764, 3765, 3766, 3772, 3773,
3774, 3775, 3777, 3778, 3781, 3783, 3784, 3785, 3788, 3789,
3790, 3791, 3792, 3794, 3796, 3798, 3803, 3804, 3806, 3808,
3812, 3818, 3820, 3823, 3825, 3828, 3829, 3830, 3831, 3832,
3833, 3836, 3839, 3842, 3843, 3844, 3845, 3849, 3858, 3859,
3860, 3862, 3867, 3870, 3871, 3872, 3873, 3876, 3882, 3883,
3887, 3889, 3890, 3891, 3893, 3895, 3908, 3910, 3911, 3912,
3914, 3917, 3923, 3924, 3928, 3929, 3938, 3947, 3950, 3954,
3958, 3962, 3967, 3974, 3975, 3978, 3983, 3987, 3988, 3994,
3995, 3997, 4000, 4001, 4002, 4003, 4006, 4008, 4013, 4024,
4026, 4030, 4032, 4034, 4039, 4040, 4046, 4047, 4048, 4049,
4050, 4053, 4054, 4056, 4057, 4058, 4061, 4062, 4066, 4067,
4068, 4069, 4072, 4075, 4079, 4081, 4092, 4096, 4099, 4102,
4103, 4105, 4111, 4113, 4115, 4116, 4122, 4124, 4128, 4133,
4139, 4143, 4146, 4148, 4149, 4150, 4155, 4156, 4158, 4160,
4161, 4162, 4163, 4165, 4166, 4167, 4168, 4169, 4170, 4171,
4175, 4178, 4184, 4187, 4188, 4189, 4197, 4201, 4202, 4205,
4206, 4207, 4208, 4210, 4211, 4212, 4214, 4217, 4219, 4221,
4222, 4227, 4228, 4233, 4235, 4244, 4246, 4250, 4251, 4257,
4258, 4260, 4263, 4266, 4270, 4272, 4279, 4281, 4294, 4296,
4298, 4301, 4302, 4304, 4309, 4312, 4320, 4321, 4324, 4329,
4330, 4331, 4332, 4333, 4335, 4336, 4337, 4341, 4343, 4344,
4347, 4349, 4352, 4354, 4358, 4360, 4369, 4374, 4378, 4380,
4383, 4387, 4390, 4391, 4394, 4397, 4401, 4402, 4403, 4404,
4405, 4406, 4410, 4412, 4415, 4417, 4419, 4422, 4423, 4439,
4443, 4444, 4446, 4448, 4450, 4453, 4456, 4458, 4460, 4461,
4462, 4463, 4464, 4465, 4468, 4472, 4474, 4479, 4485, 4491,
4492, 4494, 4498, 4502, 4506, 4507, 4512, 4513, 4514, 4515,
4518, 4519, 4524, 4531, 4534, 4535, 4543, 4548, 4549, 4551,
4554, 4556, 4557, 4558, 4559, 4560, 4562, 4565, 4566, 4568,
4575, 4580, 4582, 4583, 4584, 4586, 4590, 4591, 4595, 4596, 4601, 4604, 4606, 4621, 4625, 4633, 4634, 4635, 4641, 4643, 4644, 4650, 4653, 4654, 4655, 4659, 4666, 4667, 4669, 4670, 4671, 4672, 4677, 4680, 4682, 4685, 4687, 4693, 4697, 4699, 4700, 4702, 4704, 4705, 4706, 4708, 4710, 4714, 4719, 4721, 4725, 4729, 4732, 4737, 4738, 4740, 4747, 4749, 4750, 4751, 4753, 4754, 4755, 4756, 4759, 4761, 4762, 4765, 4767, 4771, 4775, 4779, 4789, 4790, 4791, 4794, 4795, 4804, 4813, 4814, 4815, 4817, 4818, 4822, 4823, 4824, 4828, 4829, 4832, 4833, 4834, 4838, 4842, 4856, 4857, 4859, 4861, 4862, 4864, 4868, 4869, 4872, 4875, 4876, 4877, 4880, 4881, 4887, 4889, 4891, 4895, 4901, 4902, 4905, 4909, 4913, 4914, 4917, 4920, 4921, 4923, 4924, 4925, 4926, 4930, 4935, 4936, 4941, 4943, 4950, 4955, 4965, 4971, 4972, 4973, 4975, 4977, 4979, 4984, 4986, 4987, 4988, 4992, 4993, 4994, 4996, 5010, 5011, 5022, 5026, 5029, 5030, 5034, 5039, 5040, 5042, 5044, 5046, 5049, 5052, 5054, 5057, 5059, 5063, 5067, 5068, 5072, 5079, 5082, 5086, 5088, 5089, 5090, 5091, 5100, 5102, 5109, 5111, 5122, 5123, 5129, 5131, 5132, 5140, 5145, 5147, 5153, 5164, 5165, 5168, 5170, 5173, 5174, 5180, 5182, 5184, 5185, 5190, 5191, 5192, 5195, 5196, 5198, 5199, 5200, 5201, 5206, 5208, 5212, 5214, 5216, 5217, 5219, 5225, 5226, 5229, 5230, 5234, 5240, 5241, 5243, 5249, 5253, 5255, 5258, 5261, 5263, 5264, 5267, 5268, 5273, 5275, 5276, 5280, 5281, 5283, 5289, 5292, 5293, 5298, 5299, 5300, 5301, 5303, 5308, 5309, 5311, 5313, 5317, 5324, 5327, 5329, 5330, 5334, 5342, 5344, 5346, 5347, 5348, 5351, 5359, 5361, 5362, 5372, 5382, 5383, 5386, 5388, 5389, 5393, 5394, 5395, 5396, 5397, 5403, 5407, 5409, 5411, 5414, 5417, 5426, 5431, 5434, 5439, 5446, 5448, 5449, 5450, 5452, 5456, 5457, 5459, 5463, 5464, 5466, 5467, 5469, 5472, 5474, 5476, 5477, 5482, 5483, 5493, 5495, 5496, 5498, 5502, 5503, 5506, 5508, 5509, 5510, 5513, 5515, 5516, 5517, 5518, 5519, 5524, 5529, 5530, 5532, 5534, 5535, 5537, 5541, 5543, 5557, 5562, 5568, 5569, 5571, 5579, 5585, 5588, 5589, 5591, 5592, 5597, 5604, 5612, 5613, 5615, 5616, 5618, 5619, 5620, 5627, 5632, 5635, 5638, 5640, 5642, 5643, 5647, 5648, 5649, 5650, 5651, 5652, 5657, 5659, 5660, 5662, 5663, 5664, 5670, 5671, 5675, 5676, 5677, 5683, 5689, 5690, 5694, 5695, 5697, 5698, 5702, 5703, 5705, 5706, 5709, 5711, 5717, 5718, 5721, 5722, 5731, 5734, 5735, 5738, 5739, 5744, 5748, 5751, 5752, 5753, 5754, 5756, 5763, 5768, 5770, 5771, 5773, 5775, 5779, 5780, 5784, 5785, 5788, 5789, 5791, 5794, 5803, 5806, 5807, 5808, 5809, 5810, 5813, 5817, 5820, 5826, 5828, 5831, 5833, 5835, 5836, 5837, 5839, 5846, 5850, 5852, 5853, 5854, 5857, 5859, 5861, 5864, 5865, 5866, 5869, 5870, 5872, 5876, 5878, 5880, 5881, 5883, 5884, 5886, 5888, 5892, 5893, 5907, 5912, 5922, 5925, 5926, 5927, 5928, 5931, 5932, 5934, 5936, 5938, 5941, 5944, 5948, 5954, 5956, 5959, 5967, 5968, 5971, 5978, 5980, 5982, 5988, 5991, 5994, 5996, 5997, 6000, 6002, 6004, 6006, 6007, 6009, 6013, 6016, 6017, 6018, 6023, 6024, 6025, 6026, 6031, 6033, 6038, 6041, 6043, 6044, 6045, 6048, 6051, 6058, 6059, 6062, 6069, 6072, 6073, 6075, 6080, 6081, 6084, 6085, 6086, 6087, 6088, 6089, 6090, 6092, 6093, 6097, 6098, 6099, 6107, 6108, 6109, 6110, 6113, 6116, 6119, 6124, 6129, 6131, 6132, 6133, 6137, 6138, 6139, 6143, 6145, 6146, 6147, 6148, 6149, 6151, 6153, 6157, 6160, 6162, 6163, 6164, 6165, 6181, 6183, 6184, 6186, 6189, 6194, 6195, 6196, 6198, 6203, 6204, 6205, 6209, 6220, 6223, 6224, 6226, 6227, 6228, 6230, 6231, 6233, 6234, 6237, 6239, 6243, 6246, 6247, 6250, 6251, 6262, 6264, 6265, 6267, 6272, 6273, 6275, 6281, 6282, 6286, 6292, 6293, 6295, 6296, 6299, 6300, 6303, 6315, 6317, 6319, 6322, 6323, 6325, 6328, 6332, 6333, 6338, 6342, 6343, 6344, 6349, 6350, 6353, 6354, 6356, 6360, 6365, 6370, 6372, 6375, 6376, 6381, 6383, 6394, 6397, 6399, 6403, 6405, 6406, 6408, 6412, 6414, 6415, 6419, 6420, 6422, 6425, 6426, 6427, 6428, 6429, 6430, 6431, 6436, 6440, 6443, 6449, 6456, 6463, 6464, 6466, 6467, 6470, 6474, 6475, 6476, 6477, 6478, 6480, 6482, 6484, 6485, 6488, 6494, 6501, 6502, 6504, 6510, 6514, 6516, 6517, 6518, 6519, 6528, 6530, 6531, 6532, 6534, 6537, 6547, 6549, 6553, 6555, 6558, 6559, 6564, 6567, 6571, 6572, 6574, 6576, 6577, 6579, 6581, 6584, 6587, 6588, 6589, 6592, 6594, 6595, 6597, 6599, 6600, 6603, 6607, 6609, 6610, 6615, 6616, 6617, 6620, 6623, 6625, 6626, 6629, 6633, 6634, 6635, 6638, 6639, 6640, 6644, 6646, 6647, 6648, 6649, 6653, 6655, 6656, 6658, 6661, 6666, 6671, 6672, 6690, 6693, 6699, 6703, 6704, 6705, 6706, 6716, 6718, 6720, 6729, 6730, 6734, 6736, 6739, 6742, 6747, 6749, 6756, 6757, 6759, 6764, 6767, 6777, 6779, 6782, 6783, 6786, 6792, 6793, 6794, 6795, 6797, 6799, 6803, 6804, 6805, 6807, 6811, 6813, 6815, 6816, 6817, 6819, 6820, 6821, 6824, 6826, 6827, 6828, 6830, 6831, 6834, 6836, 6841, 6843, 6848, 6851, 6863, 6868, 6869, 6875, 6876, 6877, 6878, 6881, 6882, 6883, 6884, 6886, 6887, 6888, 6894, 6902, 6903, 6906, 6909, 6913, 6917, 6919, 6921, 6924, 6925, 6930, 6936, 6939, 6946, 6950, 6952, 6954, 6955, 6959, 6960, 6963, 6966, 6967, 6971, 6979, 6984, 6985, 6987, 6988, 6990, 6991, 6994, 6997, 6999, 7009, 7013, 7018, 7022, 7029, 7038, 7039, 7040, 7043, 7045, 7046, 7049, 7051, 7052, 7053, 7054, 7057, 7059, 7060, 7062, 7067, 7073, 7077, 7079, 7083, 7084, 7096, 7105, 7106, 7107, 7108, 7110, 7117, 7118, 7119, 7122, 7126, 7129, 7130, 7138, 7139, 7142, 7143, 7144, 7150, 7151, 7154, 7163, 7164, 7165, 7166, 7169, 7170, 7171, 7172, 7182, 7184, 7191, 7192, 7194, 7196, 7197, 7198, 7201, 7202, 7203, 7206, 7207, 7208, 7209, 7210, 7212, 7215, 7217, 7219, 7220, 7224, 7227, 7228, 7230, 7231, 7235, 7236, 7244, 7245, 7246, 7249, 7250, 7252, 7255, 7257, 7258, 7262, 7263, 7264, 7267, 7268, 7270, 7274, 7281, 7282, 7287, 7291, 7292, 7293, 7296, 7299, 7300, 7301, 7303, 7304, 7306, 7307, 7311, 7312, 7313, 7315, 7318, 7320, 7323, 7328, 7331, 7340, 7344, 7345, 7350, 7351, 7356, 7357, 7358, 7360, 7361, 7365, 7369, 7371, 7376, 7377, 7380, 7382, 7383, 7386, 7387, 7392, 7396, 7398, 7400, 7406, 7409, 7410, 7411, 7418, 7425, 7430, 7434, 7435, 7436, 7438, 7447, 7448, 7450, 7452, 7453, 7454, 7457, 7458, 7464, 7466, 7470, 7472, 7475, 7476, 7481, 7483, 7485, 7486, 7490, 7492, 7493, 7497, 7499, 7502, 7503, 7504, 7506, 7512, 7514, 7515, 7521, 7522, 7523, 7524, 7533, 7541, 7546, 7549, 7556, 7561, 7572, 7574, 7576, 7579, 7583, 7585, 7586, 7589, 7596, 7598, 7604, 7605, 7609, 7612, 7617, 7619, 7620, 7622, 7624, 7625, 7633, 7638, 7640, 7642, 7643, 7647, 7649, 7652, 7655, 7658, 7661, 7662, 7664, 7665, 7671, 7674, 7678, 7679, 7680, 7682, 7686, 7687, 7689, 7695, 7697, 7700, 7703, 7712, 7715, 7716, 7724, 7726, 7727, 7730, 7734, 7736, 7737, 7738, 7741, 7742, 7744, 7745, 7749, 7750, 7753, 7763, 7764, 7768, 7770, 7772, 7774, 7775, 7779, 7781, 7785, 7786, 7788, 7791, 7793, 7798, 7799, 7800, 7801, 7803, 7804, 7805, 7806, 7807, 7818, 7819, 7820, 7822, 7823, 7825, 7833, 7834, 7840, 7841, 7844, 7845, 7846, 7850, 7854, 7856, 7865, 7873, 7877, 7878, 7880, 7881, 7884, 7887, 7888, 7890, 7896, 7908, 7910, 7911, 7913, 7918, 7923, 7925, 7928, 7933, 7934, 7935, 7936, 7938, 7942, 7944, 7949, 7952, 7965, 7966, 7967, 7974, 7976, 7977, 7981, 7984, 7986, 7992, 7996, 7999, 8006, 8007, 8012, 8020, 8021, 8024, 8030, 8031, 8036, 8040, 8041, 8042, 8044, 8045, 8047, 8048, 8053, 8056, 8059, 8063, 8068, 8072, 8074, 8076, 8077, 8078, 8080, 8081, 8083, 8084, 8088, 8091, 8093, 8095, 8100, 8102, 8106, 8110, 8112, 8113, 8118, 8120, 8121, 8123, 8126, 8129, 8130, 8134, 8141, 8148, 8150, 8151, 8155, 8163, 8164, 8170, 8178, 8179, 8181, 8189, 8191, 8193, 8194, 8202, 8204, 8208, 8213, 8217, 8219, 8220, 8222, 8223, 8230, 8234, 8237, 8239, 8241, 8242, 8248, 8250, 8252, 8253, 8263, 8264, 8265, 8268, 8269, 8272, 8273, 8274, 8276, 8282, 8289, 8291, 8300, 8304, 8308, 8310, 8311, 8315, 8318, 8319, 8322, 8329, 8339, 8340, 8347, 8350, 8351, 8353, 8358, 8367, 8368, 8371, 8373, 8378, 8379, 8380, 8382, 8385, 8387, 8389, 8390, 8392, 8393, 8395, 8396, 8401, 8402, 8403, 8404, 8406, 8410, 8413, 8414, 8415, 8416, 8417, 8418, 8430, 8436, 8438, 8439, 8440, 8442, 8443, 8444, 8445, 8447, 8448, 8449, 8450, 8451, 8457, 8458, 8459, 8465, 8470, 8472, 8473, 8474, 8476, 8477, 8481, 8482, 8486, 8490, 8498, 8501, 8502, 8503, 8505, 8507, 8509, 8513, 8515, 8516, 8520, 8521, 8523, 8524, 8525, 8526, 8527, 8532, 8533, 8541, 8542, 8543, 8553, 8554, 8557, 8561, 8562, 8565, 8566, 8574, 8575, 8576, 8577, 8579, 8581, 8582, 8592, 8594, 8596, 8597, 8598, 8600, 8602, 8603, 8605, 8609, 8612, 8622, 8631, 8634, 8635, 8638, 8641, 8642, 8644, 8646, 8648, 8652, 8654, 8658, 8659, 8663, 8665, 8669, 8672, 8676, 8677, 8685, 8686, 8689, 8693, 8695, 8699, 8700, 8703, 8705, 8706, 8708, 8709, 8713, 8717, 8720, 8722, 8726, 8729, 8731, 8736, 8741, 8743, 8744, 8746, 8748, 8750, 8755, 8757, 8761, 8763, 8769, 8770, 8773, 8774, 8777, 8779, 8783, 8784, 8785, 8786, 8789, 8792, 8795, 8797, 8802, 8803, 8810, 8818, 8821, 8822, 8824, 8828, 8829, 8830, 8831, 8833, 8834, 8835, 8836, 8839, 8841, 8843, 8845, 8846, 8853, 8865, 8866, 8874, 8875, 8876, 8877, 8878, 8881, 8883, 8888, 8892, 8896, 8900, 8901, 8907, 8908, 8911, 8916, 8917, 8919, 8922, 8924, 8926, 8928, 8929, 8930, 8935, 8937, 8938, 8941, 8945, 8946, 8951, 8953, 8960, 8961, 8967, 8968, 8971, 8979, 8980, 8981, 8985, 8986, 8991, 8992, 8996, 8998, 9001, 9009, 9011, 9012, 9013, 9018, 9020, 9022, 9026, 9027, 9029, 9030, 9033, 9045, 9050, 9052, 9056, 9057, 9058, 9059, 9060, 9063, 9065, 9068, 9069, 9071, 9072, 9076, 9078, 9084, 9086, 9087, 9088, 9092, 9095, 9103, 9104, 9105, 9106, 9107, 9112, 9114, 9115, 9118, 9120, 9123, 9125, 9129, 9131, 9133, 9134, 9139, 9140, 9141, 9142, 9144, 9145, 9152, 9154, 9155, 9167, 9168, 9175, 9177, 9180, 9185, 9188, 9190, 9191, 9194, 9195, 9205, 9206, 9207, 9210, 9211, 9213, 9215, 9216, 9220, 9223, 9226, 9229, 9231, 9233, 9237, 9243, 9244, 9248, 9249, 9253, 9257, 9259, 9262, 9265, 9267, 9270, 9273, 9282, 9284, 9285, 9287, 9288, 9290, 9292, 9295, 9300, 9304, 9306, 9308, 9311, 9314, 9320, 9321, 9323, 9326, 9328, 9332, 9339, 9346, 9347, 9350, 9352, 9353, 9359, 9360, 9366, 9371, 9373, 9375, 9376, 9380, 9382, 9391, 9392, 9394, 9399, 9400, 9402, 9403, 9404, 9406, 9407, 9411, 9413, 9414, 9415, 9421, 9423, 9425, 9429, 9439, 9440, 9443, 9449, 9451, 9452, 9453, 9456, 9460, 9467, 9471, 9472, 9473, 9476, 9481, 9484, 9488, 9490, 9497, 9500, 9503, 9504, 9509, 9514, 9517, 9518, 9519, 9520, 9522, 9534, 9536, 9537, 9538, 9540, 9543, 9545, 9546, 9550, 9551, 9553, 9555, 9560, 9564, 9567, 9571, 9573, 9577, 9586, 9587, 9590, 9595, 9596, 9598, 9601, 9602, 9606, 9609, 9614, 9615, 9617, 9618, 9620, 9621, 9623, 9624, 9626, 9629, 9632, 9638, 9640, 9649, 9650, 9653, 9655, 9657, 9658, 9663, 9666, 9668, 9670, 9679, 9680, 9682, 9686, 9688, 9698, 9701, 9706, 9710, 9711, 9715, 9718, 9721, 9723, 9724, 9726, 9727, 9729, 9731, 9733, 9734, 9737, 9742, 9744, 9745, 9746, 9750, 9754, 9763, 9770, 9772, 9774, 9776, 9782, 9786, 9787, 9791, 9793, 9794, 9798, 9799, 9804, 9809, 9810, 9811, 9812, 9813, 9819, 9820, 9828, 9829, 9833, 9845, 9847, 9866, 9869, 9875, 9878, 9879, 9882, 9886, 9887, 9889, 9891, 9892, 9900, 9907, 9909, 9910, 9911, 9923, 9924, 9928, 9930, 9932, 9935, 9940, 9946, 9949, 9950, 9952, 9953, 9960, 9962, 9963, 9967, 9968, 9973, 9974, 9975, 9976, 9979, 9980, 9982, 9984, 9985, 9987, 9988, 9990, 9991, 9992, 9997, 10000, 10008, 10013, 10015, 10017, 10018, 10019, 10020, 10021, 10026, 10027, 10032, 10033, 10034, 10035, 10037, 10041, 10044, 10049, 10051, 10053, 10054, 10055, 10058, 10059, 10060, 10062, 10064, 10072, 10073, 10075, 10077, 10078, 10080, 10081, 10083, 10091, 10092, 10094, 10095, 10097, 10101, 10103, 10106, 10110, 10115, 10116, 10117, 10122, 10128, 10129, 10131, 10135, 10136, 10138, 10140, 10143, 10151, 10158, 10160, 10163, 10165, 10166, 10168, 10174, 10176, 10178, 10181, 10184, 10186, 10192, 10193, 10194, 10195, 10196, 10199, 10206, 10212, 10218, 10219, 10220, 10221, 10223, 10224, 10225, 10228, 10231, 10233, 10234, 10236, 10237, 10239, 10247, 10249, 10252, 10253, 10254, 10255, 10259, 10262, 10263, 10266, 10269, 10270, 10275, 10276, 10278, 10284, 10286, 10291, 10292, 10293, 10295, 10300, 10302, 10306, 10307, 10311, 10312, 10314, 10315, 10318, 10319, 10323, 10325, 10326, 10327, 10331, 10333, 10334, 10335, 10340, 10341, 10346, 10353, 10356, 10357, 10364, 10371, 10375, 10380, 10384, 10388, 10393, 10397, 10398, 10399, 10401, 10408, 10410, 10411, 10413, 10414, 10416, 10417, 10419, 10421, 10423, 10424, 10425, 10426, 10435, 10436, 10438, 10440, 10446, 10447, 10448, 10449, 10450, 10451, 10452, 10453, 10456, 10460, 10463, 10464, 10465, 10468, 10469, 10471, 10474, 10479, 10480, 10482, 10487, 10490, 10494, 10499, 10506, 10508, 10514, 10518, 10521, 10522, 10523, 10526, 10527, 10528, 10530, 10531, 10532, 10536, 10537, 10541, 10542, 10543, 10544, 10548, 10555, 10560, 10563, 10564, 10567, 10580, 10581, 10582, 10583, 10584, 10588, 10593, 10596, 10599, 10601, 10602, 10608, 10611, 10613, 10615, 10616, 10617, 10621, 10622, 10636, 10637, 10638, 10639, 10640, 10645, 10646, 10652, 10657, 10665, 10668, 10670, 10676, 10678, 10679, 10682, 10683, 10684, 10685, 10700, 10701, 10705, 10706, 10715, 10716, 10721, 10722, 10726, 10729, 10734, 10738, 10740, 10741, 10744, 10747, 10748, 10749, 10752, 10753, 10754, 10756, 10762, 10768, 10769, 10770, 10775, 10778, 10779, 10785, 10787, 10788, 10790, 10792, 10795, 10801, 10802, 10803, 10804, 10805, 10809, 10810, 10811, 10812, 10818, 10822, 10823, 10824, 10827, 10831, 10833, 10836, 10838, 10839, 10843, 10850, 10851, 10853, 10854, 10857, 10858, 10860, 10866, 10867, 10870, 10877, 10880, 10881, 10886, 10887, 10897, 10898, 10899, 10901, 10902, 10911, 10913, 10918, 10920, 10924, 10926, 10927, 10928, 10929, 10930, 10933, 10934, 10938, 10940, 10941, 10947, 10965, 10966, 10967, 10972, 10976, 10977, 10978, 10979, 10985, 10988, 10993, 10996, 10999, 11008, 11015, 11017, 11021, 11022, 11023, 11024, 11027, 11030, 11032, 11033, 11036, 11037, 11039, 11040, 11044, 11046, 11047, 11052, 11053, 11058, 11063, 11066, 11067, 11078, 11081, 11082, 11083, 11090, 11095, 11100, 11103, 11107, 11111, 11114, 11118, 11122, 11124, 11129, 11132, 11133, 11135, 11136, 11137, 11138, 11145, 11147, 11149, 11151, 11153, 11154, 11160, 11163, 11165, 11168, 11169, 11177, 11178, 11179, 11180, 11181, 11184, 11187, 11188, 11190, 11191, 11192, 11193, 11194, 11198, 11203, 11204, 11208, 11214, 11216, 11217, 11218, 11222, 11224, 11226, 11227, 11228, 11229, 11230, 11233, 11236, 11238, 11239, 11242, 11243, 11246, 11247, 11253, 11254, 11255, 11256, 11258, 11260, 11263, 11266, 11274, 11290, 11292, 11293, 11294, 11295, 11297, 11298, 11299, 11302, 11304, 11305, 11306, 11313, 11315, 11318, 11321, 11330, 11331, 11337, 11338, 11340, 11346, 11348, 11349, 11358, 11362, 11363, 11364, 11365, 11371, 11373, 11377, 11380, 11382, 11385, 11387, 11388, 11394, 11395, 11398, 11401, 11404, 11405, 11406, 11417, 11424, 11427, 11430, 11431, 11435, 11436, 11438, 11439, 11440, 11443, 11446, 11447, 11449, 11451, 11456, 11459, 11461, 11465, 11466, 11472, 11478, 11485, 11487, 11489, 11490, 11496, 11498, 11499, 11500, 11505, 11507, 11513, 11520, 11523, 11524, 11526, 11527, 11531, 11532, 11533, 11540, 11544, 11548, 11551, 11553, 11558, 11560, 11561, 11567, 11568, 11570, 11571, 11576, 11577, 11588, 11593, 11594, 11595, 11596, 11597, 11603, 11604, 11607, 11611, 11615, 11617, 11618, 11623, 11625, 11628, 11636, 11647, 11650, 11653, 11656, 11658, 11659, 11663, 11673, 11677, 11678, 11681, 11682, 11688, 11691, 11692, 11694, 11695, 11696, 11699, 11701, 11703, 11705, 11707, 11712, 11718, 11721, 11725, 11730, 11731, 11733, 11736, 11737, 11740, 11743, 11753, 11759, 11760, 11761, 11765, 11770, 11771, 11776, 11777, 11781, 11782, 11785, 11786, 11789, 11792, 11794, 11797, 11799, 11800, 11804, 11805, 11809, 11810, 11811, 11814, 11818, 11820, 11821, 11826, 11829, 11830, 11840, 11841, 11846, 11848, 11851, 11856, 11858, 11861, 11863, 11864, 11865, 11868, 11870, 11872, 11876, 11877, 11881, 11886, 11889, 11891, 11892, 11894, 11895, 11898, 11899, 11901, 11906, 11909, 11911, 11913, 11914, 11915, 11916, 11917, 11918, 11919, 11920, 11921, 11923, 11926, 11927, 11928, 11929, 11930, 11934, 11940, 11943, 11945, 11947, 11949, 11950, 11953, 11956, 11957, 11958, 11959, 11960, 11961, 11962, 11963, 11965, 11966, 11973, 11974, 11975, 11976, 11977, 11978, 11979, 11980, 11983, 11988, 11989, 11993, 11997, 11998, 11999, 12004, 12008, 12014, 12017, 12019, 12020, 12021, 12023, 12024, 12026, 12027, 12032, 12033, 12043, 12044, 12047, 12050, 12059, 12068, 12077, 12080, 12081, 12083, 12092, 12093, 12098, 12102, 12104, 12106, 12109, 12110, 12112, 12114, 12115, 12118, 12122, 12126, 12128, 12129, 12130, 12134, 12137, 12138, 12139, 12141, 12143, 12145, 12146, 12147, 12149, 12151, 12161, 12166, 12171, 12174, 12175, 12176, 12181, 12183, 12185, 12194, 12197, 12200, 12201, 12204, 12207, 12208, 12215, 12217, 12219, 12220, 12221, 12227, 12234, 12240, 12243, 12245, 12249, 12250, 12252, 12253, 12256, 12259, 12260, 12263, 12267, 12268, 12269, 12274, 12278, 12281, 12283, 12284, 12286, 12287, 12292, 12293, 12295, 12297, 12298, 12299, 12304, 12311, 12312, 12313, 12314, 12315, 12317, 12321, 12323, 12324, 12326, 12329, 12331, 12333, 12334, 12347, 12354, 12356, 12358, 12359, 12364, 12368, 12369, 12370, 12372, 12374, 12379, 12380, 12381, 12385, 12391, 12397, 12400, 12401, 12403, 12404, 12405, 12406, 12410, 12411, 12414, 12416, 12419, 12420, 12421, 12424, 12425, 12426, 12427, 12437, 12439, 12440, 12441, 12445, 12447, 12451, 12454, 12455, 12456, 12457, 12459, 12462, 12465, 12467, 12468, 12470, 12472, 12473, 12476, 12478, 12479, 12481, 12487, 12488, 12489, 12491, 12497, 12499, 12504, 12505, 12508, 12510, 12511, 12521, 12530, 12536, 12539, 12545, 12546, 12547, 12549, 12555, 12559, 12561, 12563, 12564, 12565, 12567, 12568, 12572, 12578, 12588, 12605, 12606, 12608, 12609, 12611, 12616, 12619, 12623, 12626, 12631, 12633, 12634, 12635, 12636, 12638, 12639, 12641, 12649, 12651, 12655, 12663, 12668, 12670, 12671, 12672, 12675, 12679, 12680, 12681, 12682, 12684, 12685, 12691, 12693, 12695, 12698, 12699, 12701, 12702, 12703, 12707, 12711, 12713, 12714, 12718, 12719, 12722, 12731, 12732, 12733, 12737, 12739, 12741, 12742, 12743, 12748, 12751, 12754, 12755, 12758, 12760, 12761, 12762, 12764, 12766, 12769, 12771, 12772, 12773, 12783, 12788, 12790, 12794, 12797, 12800, 12801, 12802, 12805, 12810, 12812, 12813, 12819, 12820, 12822, 12824, 12826, 12827, 12828, 12834, 12835, 12836, 12838, 12839, 12843, 12844, 12847, 12849, 12853, 12858, 12861, 12866, 12875, 12882, 12883, 12884, 12887, 12888, 12895, 12898, 12900, 12904, 12905, 12906, 12910, 12913, 12914, 12916, 12917, 12918, 12920, 12921, 12926, 12929, 12932, 12938, 12939, 12940, 12941, 12942, 12944, 12945, 12946, 12947, 12966, 12968, 12969, 12972, 12973, 12978, 12982, 12984, 12987, 12990, 12991, 12996, 13006, 13007, 13010, 13011, 13015, 13017, 13018, 13022, 13023, 13030, 13032, 13035, 13038, 13040, 13041, 13049, 13050, 13053, 13054, 13055, 13056, 13061, 13066, 13067, 13071, 13074, 13075, 13077, 13079, 13085, 13086, 13087, 13095, 13100, 13101, 13102, 13105, 13106, 13112, 13114, 13115, 13116, 13117, 13118, 13123, 13124, 13131, 13135, 13142, 13144, 13148, 13149, 13151, 13152, 13153, 13156, 13169, 13174, 13175, 13177, 13182, 13185, 13197, 13199, 13205, 13206, 13209, 13210, 13212, 13213, 13215, 13217, 13222, 13224, 13227, 13230, 13232, 13234, 13235, 13236, 13237, 13238, 13239, 13240, 13243, 13249, 13251, 13255, 13259, 13260, 13261, 13263, 13264, 13268, 13269, 13270, 13276, 13278, 13281, 13285, 13291, 13293, 13296, 13297, 13298, 13301, 13303, 13304, 13313, 13315, 13317, 13320, 13321, 13323, 13326, 13328, 13330, 13332, 13338, 13343, 13346, 13348, 13353, 13354, 13359, 13361, 13369, 13370, 13373, 13380, 13381, 13384, 13388, 13393, 13394, 13396, 13397, 13401, 13408, 13410, 13413, 13416, 13417, 13419, 13423, 13429, 13430, 13433, 13439, 13448, 13449, 13451, 13454, 13456, 13463, 13466, 13468, 13469, 13472, 13473, 13475, 13490, 13492, 13494, 13496, 13498, 13499, 13500, 13503, 13504, 13506, 13510, 13513, 13514, 13515, 13516, 13517, 13519, 13520, 13521, 13524, 13530, 13532, 13539, 13540, 13543, 13544, 13545, 13546, 13547, 13549, 13552, 13556, 13568, 13569, 13574, 13580, 13582, 13584, 13587, 13595, 13597, 13599, 13601, 13602, 13603, 13604, 13605, 13612, 13621, 13623, 13628, 13631, 13632, 13634, 13635, 13636, 13637, 13641, 13647, 13650, 13652, 13654, 13661, 13662, 13668, 13671, 13675, 13677, 13684, 13687, 13688, 13693, 13695, 13698, 13700, 13702, 13703, 13706, 13713, 13715, 13716, 13720, 13721, 13725, 13727, 13728, 13729, 13730, 13739, 13745, 13747, 13750, 13755, 13756, 13761, 13764, 13766, 13767, 13769, 13772, 13773, 13775, 13779, 13781, 13782, 13783, 13789, 13790, 13791, 13793, 13794, 13796, 13798, 13809, 13816, 13817, 13818, 13819, 13820, 13822, 13823, 13828, 13830, 13831, 13833, 13834, 13835, 13843, 13849, 13851, 13852, 13853, 13859, 13860, 13862, 13866, 13869, 13870, 13872, 13873, 13874, 13877, 13881, 13883, 13888, 13891, 13892, 13894, 13896, 13897, 13898, 13901, 13904, 13906, 13909, 13910, 13911, 13913, 13917, 13919, 13925, 13927, 13930, 13933, 13938, 13944, 13947, 13948, 13949, 13952, 13954, 13956, 13961, 13963, 13965, 13969, 13970, 13971, 13975, 13976, 13981, 13983, 13984, 13990, 13991, 13999, 14000, 14009, 14010, 14013, 14014, 14017, 14018, 14022, 14026, 14027, 14030, 14031, 14036, 14041, 14043, 14049, 14050, 14051, 14052, 14062, 14063, 14066, 14069, 14070, 14071, 14073, 14075, 14086, 14091, 14092, 14094, 14096, 14100, 14105, 14106, 14107, 14110, 14116, 14118, 14119, 14120, 14122, 14124, 14125, 14128, 14129, 14130, 14132, 14134, 14135, 14138, 14139, 14142, 14143, 14145, 14146, 14148, 14149, 14150.

Promoters expressing in root tissue 3 days after planting include SEQ IDs: 1, 3, 4, 7, 12, 14, 29, 31, 36, 48, 54, 63, 64, 65, 68, 81, 82, 88, 93, 96, 97, 101, 102, 103, 107, 108, 110, 112, 121, 130, 131, 132, 139, 143, 148, 152, 153, 162, 164, 174, 176, 177, 181, 187, 194, 195, 196, 197, 199, 202, 204, 205, 207, 210, 211, 215, 217, 223, 231, 232, 233, 235, 236, 237, 240, 242, 243, 244, 246, 248, 249, 251, 257, 259, 262, 264, 271, 273, 274, 280, 281, 286, 288, 289, 291, 299, 305, 306, 316, 319, 320, 323, 328, 329, 332, 335, 346, 349, 352, 354, 356, 357, 360, 364, 365, 378, 379, 387, 388, 401, 402, 405, 406, 407, 419, 420, 423, 424, 428, 429, 433, 434, 436, 452, 456, 461, 466, 468, 471, 474, 478, 479, 481, 483, 485, 488, 498, 502, 509, 510, 512, 513, 514, 516, 517, 522, 523, 525, 529, 532, 533, 534, 541, 544, 557, 560, 564, 565, 578, 580, 585, 591, 594, 595, 596, 598, 599, 601, 602, 604, 607, 611, 613, 614, 623, 630, 631, 633, 635, 641, 643, 650, 662, 663, 666, 667, 668, 671, 681, 683, 686, 693, 701, 705, 707, 708, 716, 717, 719, 722, 724, 727, 734, 736, 742, 749, 753, 757, 759, 760, 761, 762, 765, 768, 771, 782, 783, 784, 785, 792, 793, 800, 801, 804, 806, 808, 813, 820, 823, 829, 830, 833, 836, 840, 842, 844, 855, 859, 860, 862, 865, 869, 870, 871, 872, 883, 884, 885, 887, 890, 891, 892, 893, 895, 898, 902, 903, 907, 911, 912, 913, 915, 916, 919, 924, 928, 929, 931, 936, 938, 943, 944, 951, 953, 958, 963, 964, 966, 974, 979, 980, 982, 987, 991, 993, 994, 995, 997, 999, 1003, 1006, 1009, 1011, 1014, 1015, 1017, 1026, 1028, 1032, 1035, 1038, 1042, 1043, 1047, 1049, 1050, 1051, 1052, 1054, 1055, 1065, 1069, 1072, 1073, 1077, 1078, 1080, 1085, 1086, 1087, 1088, 1089, 1092, 1095, 1103, 1104, 1108, 1110, 1111, 1112, 1114, 1115, 1117, 1119, 1120, 1122, 1125, 1127, 1130, 1132, 1133, 1136, 1137, 1144, 1146, 1147, 1148, 1154, 1160, 1162, 1170, 1176, 1178, 1189, 1190, 1191, 1196, 1199, 1200, 1204, 1205, 1214, 1218, 1219, 1223, 1225, 1228, 1230, 1231, 1233, 1236, 1239, 1240, 1241, 1248, 1250, 1252, 1253, 1254, 1256, 1257, 1258, 1272, 1277, 1281, 1282, 1285, 1286, 1291, 1292, 1293, 1295, 1297, 1306, 1309, 1312, 1316, 1320, 1325, 1327, 1330, 1331, 1334, 1339, 1346, 1349, 1351, 1354, 1355, 1360, 1364, 1368, 1371, 1373, 1376, 1377, 1380, 1382, 1388, 1392, 1396, 1398, 1403, 1404, 1405, 1407, 1412, 1420, 1421, 1423, 1426, 1431, 1432, 1438, 1441, 1442, 1451, 1453, 1454, 1455, 1462, 1466, 1467, 1468, 1474, 1475, 1481, 1488, 1490, 1498, 1499, 1503, 1504, 1513, 1514, 1518, 1525, 1526, 1527, 1539, 1543, 1545, 1546, 1549, 1555, 1556, 1560, 1563, 1567, 1571, 1575, 1576, 1578, 1584, 1586, 1590, 1592, 1593, 1594, 1595, 1599, 1600, 1604, 1605, 1608, 1609, 1612, 1614, 1615, 1616, 1622, 1625, 1634, 1635, 1637, 1638, 1639, 1648, 1650, 1659, 1662, 1663, 1668, 1669, 1671, 1673, 1675, 1676, 1677, 1678, 1684, 1685, 1688, 1689, 1691, 1705, 1706, 1707, 1708, 1710, 1712, 1717, 1719, 1721, 1723, 1725, 1729, 1731, 1732, 1735, 1740, 1750, 1755, 1758, 1759, 1761, 1764, 1771, 1776, 1779, 1785, 1791, 1813, 1815, 1820, 1830, 1832, 1835, 1836, 1840, 1845, 1850, 1852, 1859, 1865, 1867, 1869, 1870, 1872, 1883, 1886, 1888, 1894, 1897, 1898, 1899, 1900, 1901, 1902, 1903, 1904, 1905, 1906, 1911, 1918, 1920, 1923, 1924, 1933, 1934, 1936, 1940, 1944, 1950, 1955, 1973, 1981, 1990, 1991, 1992, 1993, 1994, 1995, 1996, 1999, 2000, 2007, 2008, 2009, 2012, 2013, 2014, 2015, 2017, 2026, 2031, 2032, 2039, 2041, 2043, 2048, 2062, 2064, 2066, 2072, 2074, 2077, 2081, 2082, 2083, 2089, 2094, 2096, 2097, 2099, 2103, 2104, 2119, 2132, 2133, 2134, 2136, 2140, 2142, 2143, 2144, 2147, 2150, 2152, 2154, 2155, 2156, 2157, 2161, 2162, 2163, 2164, 2170, 2173, 2177, 2178, 2179, 2185, 2193, 2196, 2202, 2203, 2206, 2215, 2216, 2221, 2222, 2225, 2226, 2227, 2229, 2230, 2231, 2240, 2244, 2253, 2257, 2260, 2262, 2263, 2265, 2273, 2274, 2278, 2280, 2282, 2283, 2288, 2291, 2295, 2296, 2298, 2301, 2303, 2304, 2308, 2309, 2314, 2322, 2323, 2328, 2329, 2331, 2333, 2339, 2342, 2345, 2348, 2349, 2351, 2352, 2353, 2358, 2363, 2366, 2381, 2382, 2384, 2385, 2398, 2401, 2403, 2405, 2410, 2411, 2412, 2418, 2419, 2423, 2430, 2435, 2437, 2438, 2443, 2445, 2451, 2452, 2453, 2455, 2457, 2465, 2470, 2471, 2472, 2474, 2476, 2479, 2481, 2482, 2483, 2490, 2492, 2494, 2495, 2496, 2498, 2500, 2504, 2505, 2509, 2510, 2511, 2514, 2516, 2517, 2525, 2528, 2531, 2532, 2533, 2536, 2537, 2538, 2539, 2541, 2542, 2551, 2552, 2555, 2556, 2557, 2567, 2568, 2573, 2577, 2581, 2583, 2589, 2590, 2592, 2594, 2599, 2601, 2605, 2609, 2617, 2618, 2625, 2627, 2632, 2634, 2637, 2639, 2641, 2644, 2647, 2648, 2653, 2655, 2663, 2671, 2674, 2675, 2684, 2685, 2687, 2689, 2691, 2692, 2696, 2700, 2702, 2704, 2705, 2707, 2712, 2715, 2718, 2719, 2723, 2725, 2726, 2727, 2728, 2729, 2735, 2739, 2740, 2742, 2746, 2747, 2749, 2752, 2755, 2757, 2770, 2775, 2780, 2782, 2784, 2785, 2787, 2800, 2801, 2802, 2805, 2812, 2820, 2821, 2823, 2824, 2827, 2829, 2831, 2832, 2840, 2844, 2850, 2858, 2861, 2862, 2864, 2865, 2871, 2873, 2876, 2886, 2888, 2889, 2890, 2894, 2898, 2902, 2903, 2905, 2906, 2909, 2910, 2911, 2919, 2923, 2924, 2926, 2930, 2931, 2932, 2933, 2934, 2935, 2944, 2946, 2948, 2953, 2955, 2959, 2963, 2966, 2968, 2972, 2976, 2979, 2985, 2994, 2998, 3002, 3005, 3007, 3008, 3015, 3016, 3023, 3027, 3038, 3039, 3043, 3044, 3045, 3048, 3049, 3051, 3052, 3053, 3055, 3064, 3072, 3076, 3078, 3080, 3081, 3083, 3084, 3085, 3087, 3088, 3090, 3095, 3096, 3105, 3106, 3114, 3118, 3119, 3120, 3123, 3126, 3127, 3128, 3137, 3139, 3147, 3153, 3156, 3170, 3181, 3185, 3189, 3191, 3192, 3194, 3200, 3205, 3206, 3210, 3212, 3218, 3219, 3220, 3224, 3225, 3227, 3228, 3236, 3237, 3239, 3240, 3244, 3247, 3250, 3252, 3255, 3260, 3261, 3266, 3271, 3272, 3280, 3286, 3288, 3290, 3291, 3294, 3295, 3296, 3297, 3299, 3301, 3303, 3312, 3324, 3327, 3331, 3332, 3333, 3340, 3343, 3345, 3347, 3349, 3351, 3353, 3355, 3358, 3359, 3360, 3361, 3363, 3370, 3377, 3379, 3380, 3383, 3386, 3397, 3399, 3400, 3404, 3415, 3416, 3418, 3419, 3420, 3422, 3424, 3426, 3428, 3435, 3438, 3442, 3445, 3447, 3450, 3451, 3455, 3458, 3460, 3461, 3464, 3465, 3466, 3468, 3470, 3471, 3474, 3475, 3477, 3482, 3486, 3487, 3488, 3490, 3491, 3494, 3496, 3503, 3504, 3506, 3510, 3511, 3516, 3517, 3518, 3524, 3531, 3533, 3536, 3537, 3541, 3544, 3545, 3548, 3549, 3552, 3554, 3558, 3560, 3562, 3569, 3574, 3576, 3577, 3587, 3588, 3589, 3592, 3593, 3595, 3596, 3597, 3598, 3600, 3603, 3604, 3606, 3607, 3610, 3611, 3613, 3616, 3618, 3620, 3621, 3624, 3629, 3633, 3637, 3640, 3642, 3643, 3644, 3645, 3646, 3648, 3650, 3655, 3657, 3659, 3662, 3663, 3671, 3672, 3674, 3677, 3682, 3684, 3685, 3693, 3694, 3706, 3707, 3713, 3715, 3717, 3718, 3719, 3720, 3724, 3732, 3738, 3739, 3749, 3752, 3754, 3761, 3762, 3764, 3765, 3766, 3777, 3778, 3781, 3783, 3788, 3790, 3791, 3792, 3794, 3796, 3798, 3808, 3818, 3820, 3823, 3825, 3828, 3829, 3830, 3831, 3832, 3833, 3843, 3844, 3845, 3849, 3858, 3860, 3862, 3867, 3871, 3872, 3873, 3876, 3877, 3882, 3883, 3887, 3889, 3890, 3891, 3892, 3893, 3895, 3908, 3910, 3911, 3912, 3914, 3917, 3923, 3924, 3928, 3934, 3935, 3938, 3947, 3950, 3952, 3954, 3958, 3962, 3967, 3974, 3975, 3978, 3983, 3985, 3987, 3988, 3997, 4008, 4013, 4019, 4020, 4024, 4030, 4033, 4034, 4037, 4038, 4039, 4040, 4041, 4045, 4047, 4048, 4051, 4052, 4054, 4056, 4057, 4062, 4066, 4067, 4068, 4069, 4072, 4075, 4079, 4080, 4092, 4096, 4105, 4107, 4111, 4113, 4116, 4122, 4128, 4133, 4139, 4146, 4148, 4149, 4150, 4156, 4158, 4160, 4161, 4162, 4163, 4165, 4166, 4170, 4171, 4175, 4178, 4184, 4187, 4188, 4189, 4201, 4202, 4205, 4206, 4208, 4210, 4211, 4212, 4214, 4219, 4221, 4222, 4227, 4228, 4231, 4233, 4235, 4244, 4250, 4251, 4257, 4258, 4260, 4261, 4263, 4266, 4270, 4272, 4279, 4280, 4281, 4283, 4288, 4296, 4298, 4302, 4304, 4309, 4320, 4324, 4329, 4330, 4331, 4335, 4336, 4338, 4341, 4344, 4347, 4349, 4352, 4354, 4358, 4359, 4360, 4365, 4369, 4371, 4373, 4378, 4380, 4383, 4390, 4394, 4397, 4401, 4402, 4403, 4404, 4405, 4410, 4415, 4418, 4422, 4423, 4439, 4443, 4444, 4446, 4448, 4450, 4453, 4461, 4462, 4463, 4464, 4468, 4472, 4474, 4479, 4485, 4491, 4492, 4494, 4506, 4507, 4512, 4514, 4515, 4516, 4518, 4519, 4522, 4531, 4535, 4543, 4545, 4548, 4549, 4551, 4554, 4555, 4556, 4557, 4558, 4560, 4562, 4565, 4566, 4561, 4568, 4570, 4575, 4580, 4583, 4586, 4590, 4591, 4596, 4601, 4604, 4621, 4625, 4630, 4632, 4633, 4634, 4635, 4641, 4643, 4644, 4650, 4653, 4654, 4655, 4659, 4667, 4669, 4671, 4677, 4680, 4682, 4685, 4687, 4697, 4700, 4702, 4704, 4706, 4708, 4710, 4719, 4721, 4723, 4725, 4729, 4732, 4737, 4738, 4740, 4749, 4750, 4751, 4753, 4754, 4755, 4756, 4759, 4761, 4762, 4765, 4771, 4775, 4779, 4789, 4790, 4791, 4794, 4795, 4804, 4809, 4813, 4814, 4818, 4823, 4824, 4828, 4829, 4832, 4833, 4834, 4835, 4838, 4842, 4856, 4857, 4859, 4861, 4862, 4864, 4868, 4869, 4872, 4875, 4880, 4881, 4887, 4889, 4891, 4895, 4901, 4902, 4905, 4909, 4921, 4922, 4924, 4930, 4935, 4936, 4940, 4943, 4950, 4958, 4959, 4960, 4971, 4972, 4973, 4975, 4977, 4979, 4984, 4987, 4988, 4994, 4996, 5000, 5005, 5010, 5015, 5022, 5026, 5029, 5030, 5034, 5038, 5039, 5040, 5042, 5044, 5052, 5054, 5057, 5063, 5067, 5068, 5072, 5075, 5078, 5079, 5082, 5088, 5089, 5091, 5094, 5095, 5100, 5102, 5111, 5123, 5129, 5131, 5132, 5140, 5145, 5151, 5153, 5160, 5164, 5165, 5168, 5170, 5174, 5180, 5181, 5182, 5185, 5189, 5190, 5191, 5192, 5196, 5198, 5199, 5200, 5206, 5208, 5217, 5219, 5225, 5226, 5229, 5234, 5239, 5240, 5241, 5243, 5249, 5255, 5258, 5261, 5263, 5264, 5267, 5273, 5275, 5276, 5280, 5281, 5283, 5292, 5293, 5298, 5299, 5300, 5301, 5303, 5308, 5311, 5315, 5317, 5319, 5321, 5324, 5329, 5330, 5334, 5344, 5346, 5348, 5350, 5351, 5359, 5361, 5363, 5364, 5371, 5372, 5382, 5386, 5388, 5389, 5393, 5394, 5395, 5396, 5397, 5403, 5407, 5409, 5411, 5413, 5414, 5417, 5426, 5431, 5434, 5448, 5449, 5450, 5452, 5456, 5457, 5459, 5463, 5464, 5467, 5472, 5474, 5476, 5479, 5482, 5483, 5491, 5493, 5496, 5498, 5506, 5508, 5510, 5513, 5515, 5516, 5517, 5518, 5519, 5524, 5529, 5530, 5535, 5537, 5541, 5557, 5562, 5563, 5568, 5569, 5579, 5585, 5588, 5589, 5591, 5592, 5597, 5604, 5608, 5612, 5613, 5616, 5618, 5627, 5632, 5633, 5635, 5638, 5640, 5642, 5643, 5647, 5648, 5651, 5652, 5660, 5662, 5663, 5665, 5666, 5675, 5676, 5677, 5689, 5690, 5694, 5695, 5697, 5698, 5702, 5703, 5706, 5709, 5711, 5718, 5721, 5722, 5731, 5732, 5734, 5735, 5739, 5744, 5751, 5756, 5763, 5768, 5771, 5775, 5780, 5784, 5785, 5788, 5791, 5794, 5803, 5807, 5808, 5809, 5813, 5814, 5815, 5817, 5820, 5823, 5828, 5831, 5833, 5835, 5836, 5837, 5839, 5846, 5852, 5853, 5854, 5859, 5861, 5864, 5866, 5868, 5869, 5872, 5876, 5878, 5879, 5881, 5883, 5884, 5887, 5888, 5892, 5893, 5907, 5912, 5922, 5923, 5925, 5926, 5927, 5928, 5932, 5934, 5935, 5938, 5939, 5941, 5944, 5948, 5954, 5956, 5959, 5967, 5968, 5979, 5982, 5987, 5991, 5994, 5996, 6000, 6002, 6004, 6006, 6013, 6016, 6017, 6023, 6024, 6025, 6026, 6031, 6038, 6041, 6043, 6044, 6048, 6051, 6058, 6059, 6062, 6068, 6069, 6070, 6073, 6075, 6081, 6085, 6088, 6089, 6092, 6093, 6097, 6098, 6099, 6107, 6108, 6109, 6110, 6113, 6116, 6119, 6120, 6124, 6129, 6131, 6132, 6137, 6138, 6143, 6145, 6146, 6157, 6160, 6162, 6163, 6164, 6165, 6181, 6183, 6186, 6189, 6193, 6198, 6204, 6205, 6220, 6223, 6224, 6227, 6228, 6234, 6243, 6246, 6247, 6250, 6251, 6264, 6265, 6267, 6270, 6275, 6281, 6282, 6286, 6292, 6293, 6295, 6297, 6299, 6303, 6309, 6311, 6315, 6317, 6319, 6322, 6328, 6333, 6338, 6342, 6343, 6344, 6346, 6353, 6354, 6356, 6362, 6365, 6367, 6370, 6372, 6375, 6383, 6394, 6397, 6399, 6403, 6405, 6408, 6412, 6414, 6415, 6416, 6417, 6419, 6420, 6422, 6425, 6426, 6428, 6429, 6431, 6436, 6440, 6449, 6456, 6463, 6464, 6466, 6467, 6472, 6474, 6475, 6476, 6478, 6480, 6484, 6485, 6494, 6495, 6501, 6504, 6510, 6512, 6513, 6516, 6519, 6530, 6534, 6535, 6537, 6541, 6543, 6547, 6549, 6553, 6555, 6558, 6567, 6569, 6571, 6574, 6576, 6577, 6579, 6584, 6588, 6589, 6592, 6594, 6595, 6597, 6600, 6603, 6606, 6609, 6617, 6623, 6625, 6626, 6633, 6635, 6639, 6640, 6644, 6646, 6647, 6649, 6655, 6656, 6658, 6666, 6672, 6673, 6681, 6693, 6703, 6704, 6705, 6706, 6716, 6718, 6720, 6729, 6734, 6736, 6739, 6742, 6747, 6749, 6756, 6757, 6759, 6764, 6766, 6767, 6778, 6779, 6780, 6782, 6783, 6793, 6794, 6795, 6797, 6799, 6803, 6804, 6805, 6807, 6811, 6813, 6816, 6817, 6819, 6820, 6821, 6824, 6826, 6827, 6828, 6830, 6834, 6836, 6841, 6842, 6843, 6848, 6851, 6855, 6861, 6863, 6868, 6875, 6881, 6882, 6883, 6884, 6886, 6887, 6894, 6902, 6903, 6904, 6913, 6914, 6917, 6919, 6920, 6921, 6924, 6925, 6930, 6936, 6939, 6946, 6959, 6960, 6963, 6970, 6971, 6979, 6980, 6981, 6984, 6985, 6987, 6988, 6990, 6991, 6994, 6999, 7009, 7013, 7022, 7029, 7033, 7038, 7041, 7043, 7045, 7046, 7049, 7051, 7052, 7053, 7057, 7064, 7067, 7073, 7077, 7079, 7083, 7084, 7094, 7096, 7105, 7106, 7107, 7108, 7110, 7112, 7113, 7117, 7118, 7126, 7129, 7130, 7138, 7139, 7142, 7143, 7144, 7150, 7151, 7154, 7163, 7164, 7165, 7166, 7169, 7171, 7172, 7182, 7184, 7192, 7194, 7196, 7197, 7201, 7202, 7206, 7207, 7208, 7209, 7210, 7211, 7212, 7217, 7219, 7220, 7227, 7228, 7230, 7235, 7236, 7244, 7245, 7246, 7255, 7258, 7262, 7263, 7268, 7274, 7276, 7281, 7287, 7291, 7292, 7293, 7296, 7299, 7300, 7303, 7304, 7305, 7306, 7307, 7311, 7312, 7313, 7318, 7330, 7340, 7345, 7350, 7351, 7357, 7358, 7361, 7365, 7369, 7371, 7373, 7376, 7377, 7382, 7383, 7386, 7395, 7398, 7399, 7400, 7406, 7410, 7418, 7425, 7430, 7436, 7438, 7441, 7447, 7448, 7452, 7453, 7454, 7456, 7457, 7466, 7470, 7472, 7481, 7483, 7486, 7490, 7492, 7493, 7499, 7503, 7504, 7506, 7512, 7514, 7515, 7521, 7522, 7523, 7524, 7525, 7533, 7546, 7556, 7561, 7572, 7574, 7576, 7579, 7583, 7585, 7586, 7589, 7594, 7596, 7599, 7604, 7605, 7609, 7619, 7620, 7622, 7624, 7625, 7633, 7642, 7643, 7644, 7649, 7658, 7661, 7664, 7665, 7671, 7674, 7678, 7679, 7680, 7682, 7686, 7687, 7689, 7695, 7700, 7703, 7712, 7715, 7716, 7724, 7726, 7727, 7730, 7736, 7737, 7738, 7741, 7742, 7744, 7745, 7749, 7763, 7764, 7768, 7770, 7772, 7774, 7775, 7780, 7781, 7785, 7786, 7788, 7791, 7798, 7799, 7800, 7801, 7803, 7804, 7806, 7807, 7818, 7819, 7820, 7822, 7823, 7824, 7825, 7826, 7833, 7839, 7840, 7841, 7844, 7845, 7854, 7856, 7865, 7873, 7877, 7878, 7880, 7887, 7888, 7890, 7896, 7911, 7918, 7923, 7925, 7928, 7933, 7934, 7935, 7938, 7942, 7944, 7949, 7952, 7976, 7977, 7984, 7986, 7996, 8004, 8007, 8012, 8021, 8026, 8031, 8036, 8042, 8044, 8047, 8053, 8056, 8059, 8061, 8063, 8068, 8072, 8076, 8078, 8079, 8080, 8081, 8083, 8084, 8088, 8089, 8090, 8091, 8093, 8095, 8100, 8102, 8106, 8110, 8112, 8113, 8118, 8121, 8126, 8130, 8134, 8141, 8145, 8147, 8148, 8150, 8156, 8163, 8170, 8178, 8179, 8181, 8182, 8189, 8191, 8193, 8194, 8202, 8204, 8208, 8210, 8217, 8219, 8220, 8223, 8227, 8230, 8234, 8235, 8237, 8239, 8241, 8242, 8248, 8250, 8252, 8253, 8263, 8264, 8265, 8266, 8268, 8269, 8270, 8272, 8273, 8276, 8282, 8289, 8300, 8310, 8311, 8315, 8318, 8319, 8320, 8323, 8329, 8340, 8347, 8350, 8353, 8358, 8367, 8368, 8371, 8373, 8379, 8380, 8385, 8387, 8389, 8392, 8393, 8395, 8401, 8402, 8403, 8404, 8408, 8410, 8413, 8414, 8415, 8416, 8417, 8418, 8430, 8436, 8438, 8439, 8443, 8444, 8445, 8447, 8448, 8449, 8450, 8451, 8457, 8458, 8459, 8465, 8470, 8472, 8473, 8474, 8476, 8477, 8481, 8482, 8485, 8486, 8498, 8500, 8501, 8503, 8505, 8513, 8515, 8516, 8521, 8524, 8526, 8527, 8533, 8539, 8542, 8543, 8553, 8554, 8561, 8562, 8565, 8566, 8574, 8575, 8576, 8579, 8581, 8582, 8592, 8596, 8597, 8600, 8601, 8602, 8603, 8604, 8605, 8609, 8612, 8631, 8634, 8635, 8638, 8639, 8641, 8644, 8646, 8650, 8654, 8658, 8659, 8663, 8665, 8669, 8672, 8676, 8677, 8686, 8689, 8690, 8693, 8699, 8700, 8703, 8706, 8708, 8709, 8713, 8717, 8720, 8722, 8731, 8736, 8741, 8744, 8747, 8748, 8757, 8771, 8773, 8774, 8777, 8779, 8780, 8783, 8784, 8785, 8786, 8789, 8792, 8795, 8803, 8808, 8810, 8821, 8822, 8824, 8829, 8830, 8831, 8843, 8846, 8853, 8865, 8874, 8876, 8877, 8878, 8881, 8888, 8889, 8892, 8896, 8908, 8911, 8916, 8917, 8922, 8924, 8926, 8929, 8930, 8937, 8938, 8945, 8946, 8951, 8953, 8961, 8967, 8968, 8971, 8979, 8980, 8981, 8985, 8986, 8991, 8992, 8996, 8998, 8999, 9006, 9009, 9011, 9012, 9013, 9018, 9020, 9022, 9026, 9027, 9029, 9030, 9045, 9052, 9056, 9058, 9059, 9060, 9063, 9065, 9069, 9071, 9072, 9076, 9078, 9088, 9091, 9092, 9096, 9103, 9104, 9105, 9107, 9116, 9118, 9123, 9125, 9129, 9131, 9133, 9134, 9139, 9140, 9141, 9142, 9144, 9145, 9152, 9154, 9155, 9167, 9168, 9175, 9177, 9179, 9180, 9185, 9188, 9190, 9191, 9194, 9195, 9206, 9207, 9210, 9211, 9213, 9215, 9216, 9223, 9226, 9229, 9231, 9233, 9237, 9243, 9246, 9248, 9249, 9253, 9257, 9259, 9262, 9265, 9267, 9269, 9270, 9273, 9275, 9284, 9285, 9288, 9290, 9292, 9295, 9300, 9308, 9311, 9320, 9321, 9323, 9326, 9328, 9332, 9336, 9337, 9339, 9340, 9346, 9347, 9352, 9353, 9359, 9360, 9366, 9371, 9373, 9375, 9376, 9382, 9391, 9392, 9394, 9400, 9402, 9403, 9406, 9413, 9414, 9421, 9422, 9423, 9429, 9434, 9439, 9440, 9443, 9451, 9453, 9456, 9460, 9471, 9474, 9476, 9481, 9482, 9488, 9490, 9497, 9500, 9504, 9509, 9514, 9517, 9518, 9534, 9536, 9537, 9538, 9540, 9545, 9546, 9550, 9551, 9553, 9555, 9560, 9564, 9571, 9573, 9577, 9587, 9590, 9591, 9595, 9596, 9597, 9598, 9601, 9602, 9606, 9607, 9609, 9615, 9617, 9618, 9620, 9621, 9623, 9626, 9629, 9632, 9640, 9655, 9657, 9658, 9663, 9666, 9670, 9686, 9687, 9688, 9698, 9701, 9706, 9710, 9711, 9718, 9721, 9723, 9724, 9726, 9729, 9730, 9731, 9732, 9733, 9737, 9742, 9746, 9750, 9753, 9756, 9763, 9764, 9770, 9774, 9776, 9777, 9782, 9786, 9789, 9791, 9792, 9794, 9798, 9799, 9804, 9810, 9811, 9812, 9813, 9816, 9819, 9820, 9828, 9829, 9830, 9835, 9847, 9869, 9873, 9875, 9878, 9879, 9882, 9886, 9887, 9891, 9892, 9900, 9907, 9909, 9910, 9911, 9912, 9923, 9924, 9928, 9932, 9935, 9938, 9940, 9946, 9949, 9950, 9952, 9953, 9962, 9963, 9967, 9968, 9972, 9973, 9975, 9980, 9982, 9984, 9987, 9988, 9990, 9991, 9992, 9997, 10000, 10013, 10015, 10017, 10019, 10020, 10026, 10027, 10032, 10033, 10034, 10035, 10041, 10049, 10051, 10052, 10053, 10055, 10058, 10059, 10062, 10064, 10066, 10068, 10073, 10077, 10078, 10080, 10081, 10083, 10090, 10091, 10092, 10095, 10101, 10103, 10106, 10110, 10115, 10116, 10122, 10128, 10129, 10131, 10132, 10136, 10143, 10151, 10158, 10160, 10163, 10165, 10166, 10168, 10174, 10176, 10178, 10181, 10184, 10192, 10193, 10194, 10195, 10196, 10199, 10212, 10218, 10219, 10220, 10222, 10223, 10225, 10233, 10235, 10236, 10237, 10239, 10249, 10252, 10253, 10254, 10255, 10259, 10262, 10269, 10275, 10278, 10284, 10286, 10291, 10292, 10293, 10295, 10300, 10302, 10306, 10307, 10311, 10312, 10314, 10318, 10319, 10323, 10325, 10326, 10331, 10334, 10335, 10341, 10343, 10346, 10353, 10354, 10356, 10357, 10364, 10371, 10375, 10378, 10380, 10385, 10388, 10393, 10395, 10397, 10398, 10399, 10401, 10410, 10411, 10414, 10416, 10417, 10421, 10423, 10425, 10435, 10436, 10438, 10440, 10446, 10451, 10452, 10453, 10456, 10463, 10464, 10465, 10466, 10468, 10469, 10471, 10474, 10480, 10482, 10487, 10490, 10494, 10496, 10506, 10508, 10514, 10518, 10522, 10523, 10527, 10528, 10530, 10531, 10532, 10536, 10537, 10541, 10542, 10543, 10544, 10547, 10548, 10558, 10560, 10563, 10567, 10569, 10573, 10580, 10581, 10583, 10588, 10593, 10596, 10599, 10601, 10602, 10603, 10604, 10611, 10612, 10613, 10615, 10616, 10621, 10622, 10625, 10636, 10637, 10638, 10639, 10640, 10645, 10646, 10652, 10655, 10665, 10666, 10668, 10670, 10676, 10678, 10679, 10682, 10683, 10684, 10685, 10686, 10700, 10701, 10705, 10707, 10711, 10715, 10716, 10721, 10722, 10724, 10726, 10729, 10732, 10734, 10738, 10740, 10744, 10747, 10748, 10749, 10752, 10753, 10756, 10766, 10770, 10775, 10776, 10777, 10778, 10779, 10784, 10785, 10788, 10790, 10792, 10801, 10803, 10805, 10809, 10812, 10818, 10819, 10822, 10824, 10827, 10831, 10836, 10838, 10843, 10850, 10851, 10852, 10853, 10854, 10858, 10860, 10866, 10867, 10877, 10880, 10886, 10887, 10888, 10889, 10896, 10898, 10899, 10901, 10911, 10917, 10918, 10920, 10926, 10927, 10928, 10929, 10930, 10933, 10934, 10938, 10940, 10941, 10947, 10962, 10965, 10967, 10972, 10976, 10977, 10988, 10993, 10995, 10996, 11008, 11009, 11021, 11024, 11027, 11030, 11032, 11033, 11039, 11040, 11044, 11046, 11047, 11052, 11053, 11056, 11058, 11060, 11063, 11066, 11067, 11078, 11082, 11083, 11090, 11095, 11098, 11100, 11101, 11103, 11107, 11114, 11118, 11122, 11129, 11133, 11137, 11145, 11146, 11147, 11149, 11151, 11152, 11153, 11154, 11160, 11163, 11165, 11168, 11169, 11173, 11174, 11177, 11181, 11187, 11188, 11190, 11192, 11194, 11198, 11203, 11208, 11214, 11217, 11218, 11222, 11224, 11226, 11227, 11229, 11230, 11231, 11233, 11235, 11236, 11238, 11239, 11242, 11243, 11246, 11247, 11253, 11254, 11255, 11256, 11258, 11260, 11262, 11263, 11266, 11290, 11292, 11293, 11295, 11297, 11302, 11304, 11305, 11306, 11313, 11318, 11321, 11330, 11331, 11338, 11340, 11345, 11346, 11348, 11349, 11356, 11358, 11363, 11364, 11365, 11370, 11371, 11373, 11377, 11380, 11382, 11385, 11387, 11388, 11391, 11394, 11401, 11404, 11405, 11424, 11430, 11431, 11435, 11438, 11439, 11440, 11443, 11446, 11447, 11449, 11451, 11456, 11459, 11461, 11465, 11466, 11475, 11478, 11487, 11489, 11490, 11491, 11496, 11497, 11498, 11499, 11500, 11505, 11506, 11507, 11508, 11518, 11520, 11523, 11524, 11526, 11527, 11528, 11531, 11532, 11533, 11535, 11540, 11541, 11544, 11548, 11551, 11553, 11558, 11560, 11561, 11567, 11568, 11570, 11576, 11577, 11578, 11583, 11585, 11588, 11593, 11594, 11595, 11596, 11597, 11599, 11604, 11607, 11612, 11615, 11618, 11628, 11631, 11639, 11640, 11647, 11650, 11656, 11658, 11659, 11665, 11673, 11678, 11681, 11682, 11688, 11691, 11692, 11694, 11696, 11699, 11701, 11703, 11705, 11707, 11712, 11718, 11721, 11725, 11726, 11730, 11732, 11733, 11736, 11740, 11744, 11753, 11756, 11759, 11760, 11763, 11765, 11770, 11771, 11776, 11781, 11785, 11786, 11788, 11792, 11794, 11799, 11800, 11805, 11809, 11810, 11811, 11814, 11818, 11820, 11821, 11826, 11830, 11841, 11844, 11846, 11848, 11849, 11851, 11856, 11858, 11861, 11868, 11870, 11872, 11876, 11877, 11878, 11886, 11889, 11891, 11892, 11894, 11898, 11902, 11906, 11909, 11911, 11913, 11914, 11916, 11917, 11919, 11920, 11921, 11922, 11923, 11926, 11927, 11928, 11929, 11930, 11934, 11940, 11943, 11945, 11947, 11949, 11953, 11956, 11957, 11958, 11959, 11960, 11961, 11962, 11963, 11965, 11968, 11974, 11975, 11976, 11977, 11978, 11979, 11983, 11988, 11989, 11993, 11997, 11998, 11999, 12004, 12017, 12023, 12026, 12032, 12033, 12043, 12044, 12059, 12068, 12076, 12080, 12081, 12083, 12087, 12092, 12093, 12095, 12098, 12102, 12104, 12106, 12109, 12110, 12112, 12115, 12118, 12122, 12126, 12128, 12129, 12137, 12138, 12139, 12143, 12145, 12146, 12147, 12149, 12151, 12161, 12166, 12170, 12171, 12174, 12175, 12176, 12181, 12185, 12194, 12197, 12200, 12201, 12204, 12207, 12208, 12217, 12218, 12219, 12220, 12221, 12227, 12234, 12240, 12243, 12249, 12250, 12252, 12253, 12256, 12259, 12260, 12263, 12267, 12268, 12269, 12278, 12283, 12284, 12287, 12288, 12291, 12293, 12295, 12297, 12298, 12304, 12310, 12311, 12313, 12314, 12315, 12317, 12321, 12323, 12329, 12331, 12334, 12342, 12347, 12354, 12356, 12358, 12359, 12364, 12367, 12368, 12369, 12374, 12379, 12380, 12381, 12383, 12385, 12400, 12403, 12404, 12406, 12410, 12411, 12414, 12419, 12420, 12421, 12424, 12426, 12427, 12435, 12437, 12439, 12440, 12441, 12445, 12447, 12451, 12455, 12456, 12457, 12459, 12462, 12467, 12468, 12470, 12478, 12479, 12481, 12487, 12488, 12489, 12495, 12497, 12499, 12504, 12505, 12508, 12510, 12511, 12514, 12530, 12536, 12545, 12547, 12549, 12561, 12564, 12565, 12567, 12572, 12585, 12588, 12591, 12597, 12605, 12608, 12609, 12610, 12611, 12614, 12616, 12619, 12623, 12626, 12631, 12633, 12634, 12635, 12636, 12638, 12639, 12641, 12649, 12651, 12663, 12668, 12670, 12671, 12672, 12674, 12676, 12679, 12680, 12681, 12684, 12685, 12691, 12695, 12699, 12701, 12702, 12713, 12718, 12729, 12731, 12732, 12733, 12737, 12738, 12739, 12741, 12742, 12743, 12748, 12754, 12755, 12758, 12760, 12761, 12764, 12766, 12767, 12771, 12772, 12773, 12790, 12794, 12797, 12800, 12801, 12802, 12810, 12812, 12813, 12817, 12819, 12820, 12822, 12824, 12826, 12827, 12828, 12834, 12836, 12838, 12839, 12843, 12844, 12849, 12858, 12861, 12866, 12883, 12887, 12888, 12895, 12898, 12900, 12904, 12905, 12906, 12910, 12912, 12913, 12916, 12917, 12921, 12926, 12928, 12929, 12932, 12938, 12939, 12945, 12946, 12947, 12966, 12968, 12969, 12973, 12976, 12978, 12982, 12983, 12984, 12987, 12994, 13010, 13011, 13012, 13014, 13017, 13018, 13022, 13030, 13032, 13033, 13035, 13038, 13040, 13041, 13042, 13049, 13053, 13055, 13056, 13060, 13061, 13066, 13067, 13069, 13071, 13074, 13075, 13085, 13086, 13087, 13095, 13098, 13101, 13102, 13105, 13115, 13117, 13118, 13120, 13123, 13124, 13131, 13135, 13142, 13148, 13149, 13151, 13158, 13160, 13169, 13174, 13175, 13182, 13185, 13188, 13197, 13199, 13206, 13209, 13210, 13213, 13215, 13217, 13221, 13222, 13224, 13227, 13230, 13232, 13234, 13235, 13236, 13237, 13238, 13243, 13249, 13251, 13255, 13256, 13259, 13261, 13263, 13264, 13268, 13269, 13276, 13280, 13285, 13292, 13296, 13301, 13304, 13315, 13317, 13318, 13320, 13321, 13323, 13325, 13326, 13328, 13330, 13332, 13337, 13338, 13343, 13346, 13348, 13351, 13353, 13354, 13361, 13369, 13370, 13373, 13377, 13380, 13381, 13384, 13391, 13393, 13394, 13396, 13397, 13401, 13408, 13410, 13416, 13417, 13419, 13423, 13430, 13433, 13439, 13448, 13451, 13454, 13456, 13460, 13463, 13466, 13468, 13469, 13473, 13475, 13490, 13492, 13496, 13498, 13499, 13500, 13503, 13504, 13505, 13506, 13513, 13514, 13515, 13516, 13517, 13519, 13520, 13521, 13524, 13530, 13532, 13539, 13540, 13543, 13544, 13546, 13547, 13549, 13552, 13556, 13558, 13569, 13574, 13582, 13584, 13589, 13597, 13601, 13602, 13604, 13612, 13621, 13623, 13631, 13632, 13634, 13636, 13637, 13641, 13647, 13650, 13652, 13654, 13661, 13662, 13663, 13668, 13671, 13675, 13676, 13677, 13684, 13687, 13688, 13691, 13695, 13697, 13698, 13700, 13702, 13710, 13713, 13715, 13716, 13720, 13721, 13727, 13729, 13739, 13745, 13748, 13750, 13755, 13756, 13764, 13766, 13769, 13773, 13775, 13776, 13779, 13781, 13782, 13786, 13787, 13789, 13790, 13791, 13793, 13794, 13796, 13798, 13809, 13816, 13817, 13818, 13819, 13822, 13823, 13828, 13830, 13831, 13833, 13835, 13849, 13852, 13853, 13859, 13860, 13862, 13866, 13869, 13870, 13872, 13873, 13874, 13875, 13877, 13880, 13881, 13882, 13883, 13885, 13891, 13892, 13894, 13896, 13897, 13901, 13904, 13906, 13909, 13910, 13911, 13917, 13919, 13921, 13927, 13930, 13947, 13948, 13949, 13952, 13956, 13963, 13965, 13969, 13970, 13975, 13976, 13981, 13984, 13990, 13992, 13999, 14000, 14008, 14009, 14010, 14014, 14017, 14022, 14026, 14027, 14030, 14031, 14036, 14041, 14043, 14049, 14050, 14051, 14052, 14062, 14063, 14066, 14069, 14070, 14071, 14073, 14075, 14086, 14092, 14093, 14094, 14099, 14106, 14112, 14116, 14118, 14119, 14120, 14122, 14124, 14125, 14128, 14129, 14132, 14135, 14138, 14139, 14143, 14145, 14148, 14149, 14150.

Promoters expressing in root tissue at the VI stage include SEQ IDs: 1, 3, 4, 7, 9, 13, 14, 19, 29, 31, 34, 36, 48, 54, 63, 64, 65, 69, 70, 71, 81, 82, 88, 93, 96, 97, 99, 101, 102, 103, 107, 108, 110, 112, 121, 126, 130, 131, 132, 139, 143, 148, 152, 153, 162, 164, 174, 176, 177, 179, 181, 187, 194, 195, 196, 197, 199, 202, 204, 205, 207, 210, 211, 212, 215, 223, 231, 232, 233, 235, 236, 237, 240, 242, 243, 244, 246, 248, 249, 250, 251, 257, 259, 262, 264, 271, 273, 280, 281, 286, 288, 289, 291, 299, 301, 302, 305, 306, 316, 319, 320, 323, 328, 329, 332, 335, 346, 348, 349, 352, 354, 356, 357, 360, 364, 365, 371, 376, 378, 379, 380, 387, 388, 396, 401, 402, 405, 406, 407, 412, 419, 420, 423, 424, 428, 429, 433, 434, 452, 456, 461, 463, 466, 468, 471, 474, 478, 479, 481, 483, 485, 488, 498, 502, 509, 510, 512, 513, 514, 516, 517, 522, 523, 525, 529, 532, 533, 534, 537, 538, 541, 544, 557, 560, 564, 565, 569, 580, 585, 591, 594, 595, 596, 598, 599, 601, 602, 604, 607, 611, 613, 614, 620, 623, 630, 631, 633, 635, 641, 643, 644, 650, 662, 663, 665, 666, 667, 668, 671, 681, 683, 686, 693, 694, 701, 705, 707, 708, 716, 717, 719, 722, 724, 727, 734, 735, 736, 742, 749, 753, 757, 759, 760, 761, 762, 763, 765, 768, 770, 771, 782, 783, 784, 792, 793, 795, 797, 800, 804, 806, 808, 813, 820, 821, 823, 829, 830, 833, 836, 840, 842, 844, 855, 859, 860, 862, 865, 870, 871, 872, 877, 878, 883, 884, 885, 887, 890, 891, 892, 893, 895, 898, 902, 903, 907, 911, 912, 913, 916, 917, 919, 924, 928, 929, 931, 936, 938, 943, 944, 951, 953, 954, 958, 961, 962, 963, 964, 966, 974, 976, 979, 980, 981, 982, 987, 993, 994, 995, 997, 999, 1003, 1006, 1007, 1009, 1011, 1014, 1026, 1028, 1032, 1035, 1038, 1041, 1042, 1043, 1045, 1047, 1049, 1050, 1051, 1052, 1054, 1055, 1056, 1065, 1069, 1072, 1073, 1077, 1078, 1085, 1086, 1087, 1088, 1089, 1092, 1095, 1103, 1104, 1108, 1110, 1111, 1112, 1114, 1115, 1117, 1118, 1119, 1120, 1122, 1127, 1130, 1132, 1133, 1136, 1137, 1144, 1146, 1147, 1148, 1154, 1160, 1162, 1170, 1171, 1176, 1178, 1189, 1190, 1191, 1196, 1199, 1200, 1204, 1214, 1217, 1218, 1223, 1225, 1227, 1228, 1230, 1231, 1233, 1234, 1236, 1239, 1240, 1241, 1248, 1250, 1252, 1253, 1256, 1258, 1272, 1273, 1275, 1277, 1281, 1282, 1285, 1286, 1291, 1292, 1293, 1295, 1297, 1306, 1309, 1312, 1316, 1320, 1325, 1327, 1330, 1331, 1334, 1346, 1347, 1349, 1351, 1354, 1355, 1360, 1364, 1368, 1371, 1373, 1376, 1377, 1380, 1382, 1386, 1388, 1392, 1396, 1398, 1403, 1404, 1407, 1421, 1423, 1426, 1431, 1438, 1441, 1442, 1444, 1451, 1453, 1454, 1455, 1462, 1466, 1467, 1468, 1474, 1475, 1481, 1486, 1488, 1490, 1493, 1498, 1499, 1503, 1504, 1514, 1518, 1525, 1526, 1527, 1539, 1543, 1545, 1546, 1549, 1556, 1560, 1567, 1571, 1575, 1576, 1578, 1584, 1586, 1590, 1592, 1593, 1594, 1595, 1599, 1600, 1604, 1605, 1608, 1609, 1612, 1614, 1615, 1616, 1622, 1625, 1634, 1635, 1637, 1638, 1639, 1641, 1648, 1650, 1652, 1662, 1668, 1669, 1671, 1673, 1675, 1676, 1678, 1680, 1683, 1684, 1685, 1688, 1689, 1691, 1697, 1705, 1706, 1708, 1710, 1712, 1717, 1719, 1723, 1725, 1729, 1731, 1732, 1735, 1740, 1750, 1755, 1758, 1759, 1764, 1768, 1771, 1776, 1779, 1785, 1791, 1793, 1807, 1813, 1815, 1816, 1820, 1830, 1832, 1834, 1835, 1836, 1840, 1845, 1850, 1852, 1859, 1865, 1867, 1869, 1870, 1872, 1876, 1883, 1886, 1888, 1897, 1898, 1899, 1900, 1901, 1902, 1903, 1905, 1906, 1911, 1918, 1920, 1922, 1923, 1924, 1936, 1940, 1944, 1950, 1952, 1953, 1955, 1973, 1981, 1990, 1991, 1992, 1993, 1994, 1995, 1996, 1999, 2000, 2003, 2007, 2008, 2009, 2010, 2012, 2013, 2014, 2015, 2017, 2026, 2031, 2032, 2036, 2039, 2041, 2043, 2048, 2060, 2062, 2064, 2066, 2072, 2074, 2077, 2080, 2081, 2082, 2083, 2089, 2094, 2096, 2097, 2099, 2103, 2104, 2119, 2125, 2126, 2132, 2133, 2134, 2140, 2142, 2143, 2144, 2147, 2150, 2152, 2156, 2157, 2161, 2162, 2163, 2164, 2166, 2170, 2172, 2173, 2177, 2178, 2179, 2185, 2193, 2196, 2202, 2203, 2205, 2206, 2214, 2215, 2216, 2221, 2222, 2225, 2226, 2227, 2229, 2230, 2231, 2235, 2240, 2242, 2244, 2253, 2257, 2260, 2262, 2263, 2265, 2273, 2274, 2280, 2282, 2283, 2288, 2295, 2296, 2298, 2301, 2303, 2304, 2308, 2309, 2310, 2314, 2322, 2323, 2328, 2329, 2331, 2339, 2342, 2345, 2348, 2349, 2351, 2352, 2353, 2360, 2363, 2366, 2367, 2369, 2379, 2381, 2382, 2384, 2398, 2401, 2403, 2405, 2410, 2411, 2412, 2418, 2419, 2422, 2423, 2430, 2435, 2437, 2438, 2441, 2442, 2443, 2445, 2451, 2452, 2453, 2455, 2457, 2465, 2466, 2470, 2471, 2472, 2474, 2476, 2479, 2481, 2482, 2490, 2492, 2494, 2495, 2496, 2498, 2500, 2504, 2505, 2509, 2510, 2511, 2514, 2517, 2525, 2528, 2529, 2531, 2532, 2533, 2536, 2537, 2538, 2539, 2541, 2542, 2549, 2551, 2552, 2554, 2555, 2556, 2557, 2567, 2568, 2573, 2577, 2581, 2583, 2589, 2590, 2592, 2594, 2599, 2601, 2605, 2609, 2617, 2618, 2625, 2627, 2632, 2634, 2637, 2639, 2641, 2644, 2648, 2650, 2652, 2653, 2655, 2663, 2671, 2675, 2679, 2684, 2685, 2687, 2689, 2691, 2692, 2696, 2700, 2702, 2704, 2707, 2715, 2718, 2719, 2723, 2725, 2726, 2727, 2728, 2729, 2735, 2740, 2742, 2746, 2747, 2752, 2755, 2756, 2757, 2763, 2764, 2770, 2773, 2775, 2780, 2782, 2784, 2785, 2787, 2798, 2801, 2802, 2805, 2808, 2812, 2823, 2824, 2826, 2827, 2829, 2832, 2840, 2844, 2850, 2858, 2861, 2862, 2864, 2865, 2871, 2873, 2876, 2881, 2886, 2888, 2889, 2890, 2898, 2902, 2903, 2906, 2909, 2910, 2911, 2919, 2923, 2924, 2926, 2930, 2932, 2933, 2934, 2935, 2944, 2945, 2946, 2948, 2952, 2953, 2955, 2959, 2963, 2966, 2968, 2972, 2985, 2994, 2998, 3002, 3005, 3007, 3008, 3015, 3016, 3023, 3024, 3027, 3038, 3039, 3042, 3043, 3044, 3048, 3049, 3051, 3052, 3053, 3055, 3064, 3067, 3072, 3076, 3078, 3080, 3081, 3083, 3084, 3085, 3087, 3088, 3090, 3095, 3096, 3101, 3105, 3106, 3109, 3114, 3118, 3119, 3120, 3121, 3123, 3126, 3127, 3128, 3129, 3137, 3138, 3139, 3143, 3145, 3147, 3153, 3156, 3170, 3181, 3185, 3189, 3191, 3194, 3205, 3206, 3210, 3212, 3215, 3218, 3219, 3220, 3224, 3225, 3227, 3228, 3236, 3237, 3239, 3240, 3244, 3250, 3252, 3255, 3260, 3261, 3263, 3266, 3271, 3272, 3278, 3280, 3286, 3288, 3290, 3291, 3294, 3295, 3296, 3297, 3299, 3301, 3303, 3312, 3324, 3327, 3331, 3332, 3333, 3340, 3345, 3347, 3349, 3351, 3353, 3355, 3358, 3361, 3363, 3370, 3374, 3377, 3380, 3383, 3386, 3397, 3399, 3400, 3404, 3409, 3415, 3416, 3418, 3419, 3422, 3424, 3426, 3428, 3435, 3438, 3441, 3445, 3446, 3447, 3450, 3451, 3452, 3455, 3458, 3460, 3461, 3465, 3466, 3468, 3470, 3471, 3474, 3475, 3477, 3482, 3486, 3487, 3488, 3490, 3491, 3494, 3496, 3503, 3504, 3506, 3510, 3511, 3516, 3517, 3518, 3531, 3533, 3536, 3537, 3541, 3544, 3545, 3548, 3549, 3552, 3554, 3558, 3560, 3562, 3569, 3572, 3574, 3576, 3577, 3587, 3588, 3589, 3592, 3593, 3594, 3595, 3596, 3597, 3598, 3600, 3603, 3604, 3606, 3607, 3610, 3611, 3613, 3616, 3618, 3620, 3621, 3624, 3629, 3633, 3637, 3640, 3642, 3643, 3644, 3645, 3646, 3650, 3655, 3657, 3659, 3660, 3662, 3663, 3667, 3668, 3671, 3672, 3677, 3682, 3684, 3685, 3693, 3694, 3695, 3697, 3704, 3706, 3707, 3713, 3715, 3717, 3718, 3719, 3720, 3724, 3725, 3732, 3738, 3739, 3748, 3749, 3752, 3754, 3761, 3762, 3764, 3765, 3766, 3777, 3778, 3781, 3788, 3789, 3790, 3791, 3792, 3794, 3798, 3804, 3808, 3818, 3820, 3823, 3825, 3828, 3829, 3830, 3831, 3832, 3833, 3836, 3842, 3843, 3844, 3845, 3849, 3858, 3860, 3862, 3867, 3871, 3872, 3873, 3876, 3882, 3883, 3887, 3889, 3890, 3892, 3893, 3895, 3908, 3910, 3911, 3912, 3914, 3917, 3923, 3924, 3928, 3929, 3935, 3938, 3947, 3950, 3952, 3954, 3958, 3962, 3967, 3974, 3975, 3983, 3985, 3987, 3988, 3997, 4006, 4008, 4013, 4019, 4020, 4024, 4030, 4033, 4034, 4038, 4039, 4040, 4041, 4045, 4047, 4048, 4051, 4052, 4054, 4056, 4057, 4061, 4062, 4066, 4067, 4068, 4069, 4072, 4075, 4079, 4084, 4092, 4096, 4105, 4111, 4113, 4116, 4122, 4128, 4133, 4139, 4143, 4146, 4148, 4149, 4156, 4158, 4160, 4161, 4162, 4163, 4165, 4166, 4167, 4168, 4169, 4170, 4171, 4175, 4178, 4184, 4187, 4188, 4189, 4201, 4202, 4205, 4206, 4208, 4210, 4211, 4212, 4214, 4217, 4219, 4221, 4222, 4227, 4228, 4231, 4233, 4235, 4244, 4250, 4251, 4257, 4258, 4260, 4261, 4263, 4266, 4270, 4272, 4279, 4280, 4281, 4283, 4288, 4297, 4298, 4301, 4302, 4304, 4309, 4312, 4320, 4324, 4329, 4330, 4331, 4335, 4337, 4338, 4341, 4343, 4344, 4347, 4349, 4352, 4354, 4358, 4359, 4360, 4369, 4371, 4373, 4378, 4380, 4383, 4387, 4390, 4391, 4394, 4397, 4401, 4402, 4403, 4404, 4405, 4410, 4415, 4418, 4419, 4422, 4423, 4439, 4443, 4444, 4446, 4448, 4450, 4453, 4460, 4461, 4462, 4463, 4464, 4465, 4468, 4472, 4474, 4475, 4479, 4485, 4491, 4492, 4494, 4506, 4507, 4512, 4514, 4515, 4516, 4518, 4519, 4522, 4531, 4535, 4543, 4545, 4548, 4549, 4551, 4554, 4555, 4556, 4557, 4558, 4562, 4565, 4566, 4567, 4568, 4570, 4575, 4580, 4583, 4584, 4586, 4590, 4591, 4596, 4601, 4604, 4606, 4621, 4625, 4630, 4632, 4633, 4634, 4635, 4641, 4643, 4644, 4650, 4653, 4654, 4655, 4659, 4667, 4669, 4671, 4672, 4677, 4680, 4682, 4685, 4687, 4697, 4699, 4700, 4704, 4706, 4708, 4710, 4719, 4721, 4723, 4725, 4729, 4732, 4737, 4738, 4740, 4747, 4748, 4749, 4750, 4751, 4753, 4754, 4755, 4756, 4759, 4761, 4762, 4765, 4766, 4767, 4771, 4775, 4778, 4779, 4789, 4790, 4791, 4794, 4795, 4804, 4809, 4813, 4814, 4817, 4818, 4822, 4823, 4824, 4828, 4829, 4832, 4833, 4834, 4835, 4838, 4842, 4856, 4857, 4859, 4861, 4862, 4864, 4868, 4869, 4870, 4872, 4875, 4880, 4881, 4887, 4889, 4891, 4895, 4901, 4902, 4905, 4909, 4914, 4920, 4921, 4923, 4924, 4926, 4935, 4936, 4938, 4940, 4943, 4950, 4955, 4958, 4959, 4971, 4972, 4973, 4975, 4977, 4984, 4987, 4988, 4992, 4994, 4996, 5000, 5005, 5010, 5015, 5026, 5029, 5030, 5034, 5038, 5039, 5040, 5042, 5044, 5046, 5052, 5054, 5057, 5059, 5063, 5067, 5068, 5072, 5078, 5079, 5082, 5088, 5089, 5090, 5091, 5094, 5095, 5100, 5102, 5111, 5122, 5123, 5129, 5131, 5132, 5140, 5145, 5160, 5164, 5168, 5170, 5173, 5174, 5180, 5181, 5182, 5185, 5188, 5189, 5190, 5191, 5192, 5196, 5198, 5200, 5201, 5206, 5208, 5217, 5219, 5225, 5226, 5229, 5230, 5234, 5239, 5240, 5241, 5243, 5249, 5253, 5255, 5258, 5261, 5263, 5267, 5273, 5275, 5276, 5280, 5281, 5283, 5289, 5292, 5293, 5298, 5299, 5300, 5301, 5303, 5308, 5311, 5317, 5319, 5321, 5324, 5329, 5330, 5334, 5344, 5346, 5347, 5348, 5350, 5351, 5359, 5361, 5363, 5364, 5371, 5372, 5382, 5383, 5386, 5388, 5389, 5393, 5394, 5395, 5396, 5397, 5403, 5407, 5409, 5411, 5413, 5414, 5417, 5426, 5431, 5434, 5439, 5448, 5449, 5452, 5456, 5457, 5458, 5459, 5463, 5464, 5467, 5469, 5472, 5474, 5476, 5479, 5482, 5483, 5493, 5496, 5498, 5506, 5508, 5510, 5513, 5515, 5516, 5517, 5518, 5519, 5524, 5529, 5530, 5535, 5537, 5541, 5543, 5557, 5562, 5563, 5568, 5569, 5579, 5585, 5588, 5589, 5591, 5592, 5597, 5604, 5612, 5613, 5615, 5616, 5618, 5627, 5632, 5633, 5635, 5638, 5640, 5642, 5643, 5647, 5648, 5651, 5652, 5657, 5659, 5660, 5662, 5663, 5665, 5666, 5675, 5676, 5677, 5683, 5689, 5690, 5694, 5695, 5697, 5698, 5702, 5703, 5706, 5709, 5711, 5718, 5721, 5722, 5731, 5732, 5734, 5735, 5739, 5744, 5751, 5756, 5763, 5768, 5771, 5773, 5775, 5780, 5784, 5785, 5788, 5791, 5794, 5803, 5808, 5809, 5813, 5814, 5815, 5817, 5820, 5833, 5835, 5836, 5837, 5839, 5846, 5850, 5852, 5853, 5854, 5859, 5861, 5864, 5865, 5866, 5867, 5869, 5870, 5872, 5876, 5879, 5881, 5883, 5884, 5885, 5887, 5888, 5892, 5893, 5907, 5912, 5922, 5923, 5925, 5926, 5927, 5928, 5932, 5934, 5938, 5941, 5944, 5948, 5954, 5956, 5959, 5967, 5968, 5978, 5982, 5987, 5988, 5991, 5994, 5996, 6000, 6002, 6004, 6006, 6008, 6009, 6013, 6016, 6017, 6023, 6024, 6025, 6026, 6031, 6038, 6041, 6043, 6044, 6048, 6051, 6058, 6059, 6062, 6068, 6069, 6070, 6073, 6075, 6081, 6084, 6085, 6088, 6089, 6092, 6093, 6097, 6098, 6099, 6107, 6108, 6109, 6110, 6113, 6116, 6119, 6120, 6124, 6129, 6131, 6132, 6133, 6137, 6138, 6143, 6145, 6146, 6149, 6151, 6157, 6160, 6162, 6163, 6164, 6165, 6181, 6183, 6186, 6188, 6189, 6193, 6198, 6204, 6205, 6220, 6223, 6224, 6227, 6228, 6234, 6242, 6243, 6246, 6247, 6250, 6251, 6262, 6264, 6265, 6267, 6272, 6273, 6275, 6281, 6282, 6286, 6292, 6295, 6297, 6299, 6300, 6309, 6311, 6315, 6317, 6319, 6322, 6323, 6328, 6333, 6338, 6342, 6343, 6344, 6346, 6353, 6354, 6356, 6362, 6365, 6367, 6370, 6372, 6375, 6383, 6386, 6394, 6397, 6399, 6403, 6404, 6405, 6408, 6412, 6414, 6415, 6416, 6417, 6419, 6420, 6422, 6425, 6426, 6428, 6429, 6431, 6436, 6440, 6449, 6456, 6463, 6464, 6466, 6467, 6470, 6472, 6474, 6475, 6476, 6477, 6478, 6480, 6482, 6484, 6485, 6494, 6495, 6501, 6504, 6510, 6512, 6513, 6516, 6519, 6530, 6531, 6532, 6534, 6537, 6543, 6547, 6549, 6553, 6555, 6558, 6564, 6567, 6569, 6571, 6572, 6574, 6576, 6577, 6579, 6584, 6587, 6588, 6589, 6592, 6594, 6595, 6596, 6597, 6600, 6603, 6606, 6607, 6609, 6610, 6615, 6616, 6617, 6620, 6623, 6625, 6626, 6629, 6633, 6634, 6635, 6639, 6640, 6642, 6644, 6646, 6647, 6649, 6655, 6656, 6658, 6666, 6670, 6671, 6672, 6673, 6693, 6701, 6703, 6704, 6705, 6716, 6718, 6720, 6729, 6730, 6734, 6736, 6737, 6739, 6742, 6747, 6749, 6756, 6757, 6759, 6764, 6766, 6767, 6778, 6779, 6782, 6783, 6786, 6793, 6794, 6795, 6797, 6799, 6803, 6804, 6805, 6807, 6811, 6813, 6815, 6816, 6817, 6819, 6820, 6821, 6824, 6826, 6827, 6828, 6830, 6831, 6834, 6836, 6841, 6842, 6843, 6848, 6851, 6861, 6863, 6868, 6869, 6875, 6877, 6878, 6881, 6884, 6886, 6887, 6894, 6902, 6903, 6904, 6913, 6914, 6917, 6919, 6920, 6921, 6924, 6925, 6930, 6936, 6939, 6946, 6954, 6959, 6960, 6963, 6967, 6970, 6971, 6979, 6980, 6981, 6984, 6985, 6987, 6988, 6990, 6994, 6999, 7013, 7022, 7029, 7038, 7039, 7040, 7043, 7045, 7046, 7049, 7051, 7052, 7053, 7057, 7059, 7064, 7067, 7073, 7077, 7079, 7083, 7084, 7094, 7096, 7105, 7106, 7107, 7108, 7110, 7112, 7113, 7117, 7118, 7122, 7126, 7129, 7130, 7138, 7139, 7142, 7143, 7144, 7150, 7151, 7154, 7163, 7164, 7165, 7166, 7169, 7170, 7171, 7172, 7182, 7184, 7192, 7194, 7195, 7197, 7201, 7202, 7206, 7207, 7208, 7209, 7210, 7211, 7212, 7217, 7219, 7220, 7227, 7228, 7230, 7235, 7236, 7244, 7245, 7246, 7249, 7250, 7255, 7258, 7262, 7263, 7264, 7268, 7270, 7274, 7276, 7281, 7282, 7287, 7291, 7292, 7293, 7296, 7299, 7300, 7301, 7303, 7304, 7305, 7306, 7307, 7311, 7312, 7313, 7318, 7320, 7328, 7330, 7331, 7339, 7345, 7350, 7351, 7356, 7357, 7358, 7361, 7365, 7369, 7371, 7376, 7377, 7382, 7383, 7386, 7392, 7398, 7399, 7400, 7406, 7411, 7418, 7425, 7430, 7434, 7436, 7438, 7444, 7447, 7448, 7452, 7453, 7454, 7457, 7458, 7466, 7470, 7472, 7481, 7483, 7486, 7490, 7492, 7493, 7499, 7503, 7506, 7512, 7514, 7515, 7521, 7522, 7523, 7524, 7525, 7533, 7546, 7556, 7561, 7572, 7574, 7576, 7579, 7583, 7585, 7586, 7589, 7594, 7596, 7599, 7604, 7605, 7609, 7612, 7619, 7620, 7622, 7624, 7625, 7633, 7640, 7642, 7643, 7644, 7647, 7649, 7652, 7656, 7658, 7661, 7664, 7665, 7671, 7674, 7678, 7679, 7680, 7682, 7686, 7687, 7689, 7695, 7700, 7703, 7712, 7715, 7716, 7724, 7726, 7727, 7736, 7737, 7738, 7741, 7742, 7744, 7745, 7749, 7753, 7763, 7764, 7768, 7770, 7772, 7774, 7775, 7779, 7780, 7781, 7786, 7788, 7791, 7798, 7799, 7800, 7801, 7803, 7804, 7806, 7807, 7818, 7819, 7820, 7822, 7823, 7824, 7825, 7826, 7833, 7839, 7840, 7841, 7844, 7845, 7850, 7854, 7856, 7860, 7865, 7873, 7877, 7878, 7880, 7887, 7888, 7890, 7896, 7910, 7911, 7918, 7923, 7925, 7928, 7933, 7934, 7935, 7936, 7938, 7942, 7944, 7949, 7952, 7965, 7966, 7967, 7974, 7976, 7977, 7984, 7986, 7996, 8004, 8006, 8007, 8012, 8021, 8024, 8026, 8030, 8031, 8036, 8042, 8044, 8047, 8048, 8053, 8056, 8059, 8061, 8063, 8068, 8072, 8074, 8076, 8077, 8078, 8079, 8080, 8081, 8083, 8084, 8088, 8089, 8090, 8091, 8093, 8095, 8100, 8102, 8106, 8110, 8112, 8113, 8118, 8123, 8126, 8129, 8130, 8141, 8145, 8147, 8148, 8150, 8151, 8163, 8170, 8178, 8179, 8181, 8189, 8191, 8193, 8194, 8202, 8204, 8208, 8210, 8213, 8217, 8219, 8220, 8223, 8227, 8230, 8234, 8235, 8237, 8239, 8241, 8242, 8248, 8250, 8252, 8253, 8263, 8264, 8265, 8266, 8268, 8269, 8270, 8272, 8273, 8274, 8276, 8282, 8289, 8291, 8300, 8304, 8310, 8311, 8315, 8318, 8319, 8323, 8329, 8339, 8340, 8347, 8350, 8353, 8358, 8367, 8368, 8373, 8378, 8379, 8380, 8385, 8387, 8389, 8392, 8393, 8395, 8401, 8402, 8403, 8404, 8406, 8408, 8410, 8413, 8414, 8415, 8416, 8417, 8418, 8430, 8436, 8438, 8439, 8443, 8444, 8445, 8447, 8448, 8449, 8450, 8451, 8457, 8458, 8459, 8465, 8470, 8472, 8473, 8474, 8476, 8477, 8481, 8482, 8486, 8498, 8501, 8503, 8505, 8507, 8509, 8513, 8515, 8516, 8520, 8521, 8524, 8525, 8526, 8527, 8528, 8532, 8533, 8539, 8542, 8543, 8553, 8554, 8561, 8562, 8565, 8574, 8575, 8576, 8579, 8581, 8582, 8592, 8596, 8597, 8598, 8600, 8601, 8603, 8604, 8605, 8612, 8631, 8634, 8635, 8638, 8639, 8641, 8644, 8646, 8650, 8652, 8654, 8658, 8659, 8663, 8665, 8669, 8672, 8676, 8677, 8685, 8686, 8689, 8690, 8693, 8695, 8699, 8700, 8703, 8706, 8708, 8709, 8713, 8717, 8720, 8722, 8729, 8731, 8736, 8741, 8743, 8744, 8748, 8755, 8757, 8761, 8769, 8773, 8774, 8777, 8779, 8783, 8784, 8785, 8786, 8789, 8792, 8795, 8802, 8803, 8808, 8810, 8821, 8822, 8824, 8829, 8830, 8835, 8841, 8843, 8846, 8853, 8865, 8874, 8876, 8877, 8878, 8881, 8888, 8889, 8892, 8896, 8901, 8908, 8911, 8916, 8917, 8919, 8922, 8924, 8926, 8929, 8930, 8937, 8938, 8945, 8946, 8951, 8953, 8960, 8961, 8967, 8968, 8979, 8980, 8981, 8986, 8991, 8992, 8996, 8998, 9006, 9009, 9011, 9012, 9013, 9018, 9022, 9026, 9027, 9029, 9030, 9033, 9045, 9052, 9058, 9059, 9060, 9062, 9063, 9065, 9068, 9069, 9071, 9072, 9076, 9078, 9084, 9087, 9088, 9091, 9092, 9103, 9104, 9105, 9106, 9107, 9114, 9116, 9118, 9122, 9123, 9125, 9129, 9131, 9133, 9134, 9139, 9140, 9141, 9142, 9144, 9152, 9154, 9155, 9167, 9168, 9175, 9177, 9179, 9180, 9185, 9190, 9191, 9194, 9195, 9205, 9206, 9210, 9211, 9213, 9215, 9216, 9223, 9226, 9229, 9233, 9237, 9243, 9244, 9246, 9248, 9249, 9253, 9257, 9259, 9262, 9265, 9267, 9269, 9270, 9273, 9275, 9284, 9285, 9287, 9288, 9290, 9292, 9295, 9300, 9308, 9311, 9320, 9321, 9323, 9326, 9328, 9332, 9336, 9337, 9340, 9346, 9347, 9350, 9352, 9353, 9359, 9360, 9366, 9371, 9373, 9375, 9376, 9382, 9391, 9392, 9394, 9400, 9402, 9403, 9406, 9407, 9413, 9414, 9415, 9421, 9423, 9429, 9434, 9439, 9440, 9443, 9449, 9451, 9453, 9456, 9460, 9471, 9472, 9473, 9474, 9476, 9481, 9482, 9484, 9488, 9490, 9497, 9500, 9503, 9504, 9509, 9514, 9517, 9518, 9534, 9536, 9537, 9538, 9540, 9545, 9546, 9550, 9551, 9553, 9555, 9560, 9564, 9567, 9571, 9573, 9577, 9581, 9587, 9590, 9591, 9595, 9596, 9597, 9598, 9601, 9602, 9606, 9609, 9614, 9615, 9617, 9618, 9620, 9621, 9623, 9624, 9626, 9629, 9632, 9640, 9652, 9653, 9655, 9657, 9658, 9663, 9666, 9670, 9676, 9686, 9687, 9688, 9698, 9701, 9706, 9710, 9711, 9715, 9718, 9721, 9723, 9724, 9726, 9727, 9729, 9730, 9731, 9732, 9733, 9734, 9737, 9742, 9746, 9750, 9753, 9756, 9763, 9764, 9770, 9772, 9774, 9776, 9777, 9782, 9786, 9787, 9791, 9792, 9794, 9798, 9799, 9804, 9808, 9810, 9811, 9812, 9813, 9816, 9819, 9820, 9828, 9829, 9830, 9835, 9847, 9869, 9873, 9875, 9878, 9879, 9882, 9886, 9887, 9889, 9891, 9892, 9900, 9907, 9909, 9910, 9911, 9912, 9923, 9924, 9928, 9934, 9935, 9938, 9940, 9944, 9946, 9949, 9950, 9952, 9953, 9960, 9962, 9963, 9967, 9968, 9973, 9974, 9975, 9976, 9980, 9982, 9984, 9987, 9988, 9990, 9991, 9992, 9997, 10000, 10008, 10013, 10015, 10017, 10018, 10019, 10020, 10026, 10027, 10032, 10033, 10034, 10035, 10037, 10041, 10044, 10047, 10049, 10051, 10052, 10053, 10055, 10058, 10059, 10060, 10062, 10064, 10066, 10073, 10075, 10077, 10078, 10080, 10081, 10083, 10090, 10091, 10092, 10094, 10095, 10101, 10103, 10106, 10110, 10115, 10116, 10122, 10128, 10129, 10131, 10136, 10138, 10143, 10151, 10158, 10160, 10163, 10165, 10166, 10168, 10174, 10176, 10178, 10181, 10184, 10186, 10192, 10193, 10194, 10195, 10196, 10199, 10206, 10212, 10218, 10219, 10220, 10222, 10223, 10225, 10231, 10233, 10234, 10235, 10236, 10237, 10239, 10249, 10252, 10253, 10254, 10259, 10262, 10263, 10266, 10269, 10270, 10275, 10278, 10284, 10286, 10291, 10292, 10293, 10295, 10300, 10302, 10306, 10307, 10311, 10312, 10314, 10318, 10319, 10323, 10324, 10325, 10326, 10331, 10333, 10334, 10335, 10336, 10340, 10341, 10343, 10346, 10353, 10356, 10357, 10364, 10371, 10375, 10378, 10380, 10385, 10388, 10393, 10397, 10398, 10399, 10401, 10402, 10410, 10411, 10414, 10416, 10417, 10421, 10423, 10425, 10426, 10435, 10436, 10438, 10440, 10446, 10448, 10449, 10450, 10451, 10452, 10453, 10456, 10460, 10463, 10464, 10465, 10466, 10468, 10469, 10471, 10474, 10480, 10482, 10487, 10490, 10494, 10496, 10506, 10508, 10518, 10522, 10523, 10527, 10528, 10530, 10531, 10532, 10536, 10537, 10541, 10542, 10543, 10544, 10547, 10548, 10558, 10560, 10563, 10564, 10567, 10569, 10573, 10577, 10580, 10581, 10582, 10583, 10588, 10593, 10596, 10599, 10601, 10602, 10603, 10604, 10611, 10612, 10613, 10615, 10616, 10621, 10622, 10636, 10637, 10638, 10639, 10640, 10645, 10646, 10652, 10655, 10665, 10666, 10668, 10670, 10676, 10678, 10679, 10682, 10683, 10684, 10685, 10700, 10701, 10705, 10707, 10711, 10715, 10716, 10721, 10722, 10726, 10729, 10732, 10734, 10738, 10740, 10744, 10747, 10748, 10749, 10752, 10753, 10754, 10756, 10761, 10762, 10766, 10769, 10770, 10775, 10776, 10777, 10778, 10779, 10784, 10785, 10787, 10788, 10790, 10792, 10800, 10801, 10802, 10803, 10804, 10805, 10809, 10812, 10815, 10818, 10819, 10822, 10823, 10824, 10827, 10831, 10836, 10838, 10839, 10843, 10850, 10851, 10852, 10853, 10854, 10857, 10858, 10860, 10866, 10867, 10877, 10880, 10886, 10887, 10888, 10889, 10898, 10899, 10901, 10902, 10911, 10917, 10918, 10920, 10926, 10927, 10928, 10929, 10930, 10933, 10934, 10938, 10940, 10941, 10945, 10947, 10962, 10965, 10967, 10968, 10972, 10976, 10977, 10979, 10988, 10993, 10996, 10999, 11008, 11009, 11015, 11017, 11021, 11022, 11023, 11024, 11027, 11030, 11032, 11033, 11036, 11037, 11039, 11040, 11044, 11046, 11047, 11052, 11053, 11056, 11058, 11060, 11063, 11066, 11067, 11078, 11081, 11082, 11083, 11090, 11095, 11100, 11101, 11107, 11111, 11114, 11118, 11129, 11133, 11137, 11147, 11149, 11151, 11152, 11153, 11154, 11160, 11163, 11165, 11168, 11169, 11173, 11177, 11181, 11184, 11187, 11188, 11190, 11192, 11194, 11198, 11203, 11208, 11214, 11216, 11217, 11218, 11222, 11224, 11226, 11228, 11229, 11230, 11231, 11233, 11235, 11236, 11238, 11239, 11242, 11243, 11246, 11247, 11251, 11253, 11254, 11255, 11256, 11258, 11260, 11262, 11263, 11266, 11290, 11292, 11293, 11295, 11296, 11297, 11298, 11302, 11304, 11305, 11306, 11313, 11315, 11318, 11321, 11323, 11330, 11331, 11337, 11338, 11340, 11345, 11346, 11348, 11349, 11356, 11358, 11362, 11363, 11364, 11365, 11371, 11373, 11377, 11380, 11382, 11387, 11388, 11391, 11394, 11395, 11401, 11404, 11405, 11424, 11430, 11431, 11435, 11438, 11439, 11440, 11443, 11446, 11447, 11449, 11451, 11456, 11459, 11461, 11465, 11466, 11478, 11487, 11489, 11490, 11491, 11496, 11498, 11499, 11500, 11505, 11506, 11507, 11518, 11520, 11523, 11524, 11526, 11527, 11531, 11532, 11533, 11535, 11540, 11541, 11544, 11547, 11548, 11551, 11553, 11558, 11560, 11561, 11562, 11567, 11568, 11570, 11571, 11576, 11577, 11578, 11583, 11585, 11588, 11593, 11594, 11595, 11596, 11597, 11599, 11604, 11607, 11612, 11615, 11617, 11618, 11623, 11628, 11639, 11640, 11647, 11650, 11656, 11658, 11659, 11663, 11665, 11673, 11678, 11681, 11682, 11688, 11691, 11692, 11694, 11695, 11696, 11699, 11701, 11703, 11705, 11707, 11712, 11718, 11721, 11725, 11726, 11730, 11731, 11732, 11733, 11736, 11738, 11740, 11743, 11744, 11753, 11756, 11759, 11760, 11763, 11765, 11770, 11771, 11776, 11777, 11781, 11783, 11785, 11786, 11788, 11792, 11794, 11797, 11799, 11800, 11805, 11809, 11810, 11811, 11814, 11818, 11820, 11821, 11826, 11830, 11840, 11844, 11846, 11848, 11849, 11851, 11856, 11858, 11861, 11864, 11865, 11868, 11870, 11872, 11876, 11877, 11886, 11889, 11891, 11892, 11894, 11898, 11901, 11902, 11906, 11909, 11911, 11913, 11914, 11916, 11917, 11919, 11920, 11921, 11923, 11926, 11927, 11928, 11929, 11930, 11934, 11940, 11943, 11945, 11947, 11949, 11953, 11956, 11957, 11959, 11960, 11961, 11962, 11963, 11965, 11966, 11968, 11974, 11976, 11977, 11978, 11979, 11983, 11988, 11989, 11993, 11997, 11998, 11999, 12004, 12014, 12017, 12021, 12023, 12024, 12026, 12032, 12033, 12043, 12044, 12059, 12068, 12076, 12080, 12081, 12083, 12087, 12092, 12093, 12095, 12098, 12102, 12104, 12106, 12109, 12110, 12112, 12115, 12118, 12122, 12126, 12128, 12129, 12134, 12137, 12138, 12139, 12141, 12143, 12145, 12146, 12147, 12149, 12151, 12161, 12166, 12170, 12171, 12174, 12175, 12176, 12181, 12185, 12197, 12200, 12201, 12204, 12207, 12208, 12217, 12218, 12219, 12220, 12221, 12227, 12228, 12234, 12240, 12243, 12249, 12250, 12252, 12256, 12259, 12260, 12263, 12267, 12268, 12269, 12278, 12283, 12284, 12286, 12287, 12291, 12293, 12295, 12297, 12298, 12304, 12310, 12311, 12313, 12314, 12315, 12317, 12321, 12323, 12329, 12331, 12334, 12342, 12347, 12354, 12356, 12358, 12359, 12367, 12368, 12369, 12370, 12374, 12379, 12380, 12381, 12383, 12385, 12397, 12400, 12403, 12404, 12406, 12410, 12411, 12414, 12419, 12420, 12421, 12424, 12426, 12427, 12437, 12439, 12440, 12441, 12445, 12447, 12451, 12455, 12456, 12457, 12459, 12461, 12462, 12467, 12468, 12470, 12472, 12476, 12478, 12479, 12481, 12487, 12488, 12489, 12495, 12497, 12499, 12504, 12505, 12508, 12510, 12511, 12514, 12530, 12536, 12545, 12546, 12547, 12549, 12556, 12559, 12561, 12563, 12564, 12565, 12567, 12572, 12585, 12588, 12597, 12605, 12608, 12609, 12610, 12611, 12614, 12616, 12619, 12623, 12626, 12631, 12633, 12634, 12636, 12638, 12639, 12641, 12649, 12651, 12663, 12668, 12670, 12671, 12672, 12674, 12676, 12679, 12680, 12681, 12684, 12685, 12691, 12695, 12698, 12699, 12701, 12702, 12705, 12706, 12713, 12718, 12719, 12722, 12731, 12732, 12733, 12737, 12738, 12739, 12741, 12742, 12743, 12748, 12754, 12755, 12757, 12758, 12760, 12761, 12762, 12764, 12766, 12771, 12772, 12773, 12783, 12790, 12794, 12797, 12800, 12801, 12802, 12805, 12810, 12812, 12813, 12817, 12818, 12819, 12820, 12822, 12824, 12826, 12827, 12828, 12834, 12836, 12838, 12839, 12843, 12844, 12849, 12858, 12861, 12866, 12883, 12887, 12888, 12895, 12898, 12900, 12904, 12905, 12906, 12910, 12912, 12913, 12914, 12916, 12917, 12920, 12921, 12926, 12928, 12929, 12932, 12938, 12939, 12940, 12941, 12945, 12946, 12947, 12966, 12968, 12969, 12972, 12973, 12976, 12978, 12982, 12983, 12984, 12987, 12990, 12991, 12994, 13007, 13010, 13011, 13014, 13017, 13018, 13022, 13030, 13032, 13035, 13038, 13040, 13041, 13049, 13050, 13053, 13055, 13056, 13057, 13061, 13066, 13067, 13069, 13071, 13074, 13075, 13079, 13085, 13086, 13087, 13095, 13101, 13102, 13105, 13112, 13115, 13117, 13118, 13120, 13123, 13124, 13131, 13135, 13142, 13148, 13149, 13152, 13158, 13160, 13169, 13174, 13175, 13177, 13181, 13182, 13185, 13188, 13197, 13199, 13206, 13209, 13210, 13212, 13213, 13215, 13217, 13221, 13222, 13224, 13227, 13230, 13232, 13234, 13235, 13236, 13237, 13238, 13243, 13249, 13251, 13255, 13259, 13260, 13261, 13263, 13264, 13268, 13269, 13270, 13276, 13280, 13285, 13291, 13296, 13301, 13304, 13315, 13317, 13318, 13320, 13321, 13323, 13326, 13328, 13330, 13332, 13337, 13338, 13343, 13346, 13348, 13353, 13354, 13361, 13369, 13370, 13377, 13381, 13384, 13391, 13393, 13394, 13397, 13401, 13402, 13408, 13410, 13416, 13417, 13419, 13423, 13424, 13429, 13433, 13439, 13448, 13449, 13451, 13454, 13456, 13460, 13463, 13466, 13468, 13469, 13473, 13475, 13490, 13492, 13494, 13496, 13499, 13500, 13503, 13504, 13505, 13506, 13513, 13514, 13515, 13516, 13517, 13519, 13520, 13521, 13530, 13532, 13540, 13543, 13544, 13546, 13547, 13549, 13552, 13556, 13568, 13569, 13574, 13580, 13582, 13584, 13587, 13589, 13597, 13601, 13602, 13604, 13612, 13621, 13623, 13631, 13632, 13634, 13636, 13637, 13641, 13647, 13650, 13652, 13654, 13660, 13661, 13662, 13663, 13668, 13671, 13675, 13677, 13684, 13687, 13688, 13691, 13695, 13697, 13698, 13700, 13702, 13703, 13710, 13713, 13715, 13716, 13720, 13721, 13727, 13729, 13730, 13739, 13745, 13748, 13750, 13756, 13764, 13766, 13767, 13769, 13772, 13773, 13775, 13776, 13779, 13781, 13782, 13783, 13786, 13787, 13789, 13790, 13791, 13793, 13794, 13796, 13798, 13809, 13816, 13817, 13818, 13819, 13820, 13822, 13823, 13828, 13830, 13831, 13833, 13835, 13843, 13849, 13852, 13853, 13859, 13860, 13862, 13866, 13869, 13870, 13872, 13873, 13874, 13875, 13877, 13881, 13882, 13883, 13891, 13892, 13894, 13896, 13897, 13901, 13904, 13906, 13909, 13910, 13911, 13912, 13917, 13919, 13921, 13927, 13930, 13933, 13938, 13944, 13947, 13948, 13949, 13952, 13954, 13956, 13963, 13969, 13970, 13975, 13976, 13981, 13984, 13990, 13992, 13999, 14000, 14008, 14009, 14010, 14014, 14017, 14022, 14026, 14027, 14030, 14031, 14036, 14041, 14043, 14049, 14050, 14051, 14052, 14062, 14063, 14066, 14069, 14070, 14071, 14073, 14075, 14082, 14086, 14092, 14093, 14094, 14096, 14099, 14100, 14105, 14106, 14107, 14112, 14116, 14118, 14119, 14120, 14122, 14124, 14125, 14128, 14129, 14132, 14135, 14138, 14139, 14143, 14145, 14146, 14148, 14149, 14150.

Promoters expressing in root tissue at the V3 stage include SEQ IDs: 1, 3, 4, 7, 8, 9, 12, 13, 14, 15, 27, 29, 31, 34, 36, 48, 54, 63, 64, 65, 69, 70, 71, 81, 82, 88, 96, 97, 99, 101, 102, 103, 107, 108, 110, 111, 112, 121, 126, 130, 131, 132, 139, 143, 147, 148, 152, 153, 162, 164, 174, 176, 177, 179, 181, 187, 191, 194, 195, 196, 197, 199, 202, 204, 205, 207, 210, 211, 212, 215, 217, 223, 231, 232, 233, 235, 236, 237, 240, 242, 243, 244, 246, 248, 249, 250, 251, 254, 257, 259, 262, 264, 271, 273, 274, 280, 281, 286, 288, 289, 291, 299, 301, 302, 305, 306, 309, 316, 319, 320, 323, 328, 329, 332, 335, 346, 348, 349, 352, 353, 354, 356, 357, 360, 364, 365, 371, 373, 374, 378, 379, 387, 388, 396, 401, 402, 405, 406, 407, 412, 419, 420, 423, 424, 428, 429, 433, 434, 436, 452, 456, 461, 466, 468, 471, 474, 478, 479, 482, 483, 485, 488, 498, 502, 504, 509, 510, 512, 513, 514, 516, 517, 522, 523, 525, 529, 532, 533, 534, 536, 537, 538, 541, 544, 546, 547, 554, 557, 564, 565, 578, 580, 585, 591, 593, 594, 595, 596, 598, 599, 601, 602, 604, 607, 613, 614, 620, 623, 626, 630, 631, 633, 635, 638, 641, 643, 644, 650, 662, 663, 665, 666, 671, 674, 676, 677, 681, 683, 686, 693, 694, 701, 705, 707, 708, 716, 717, 719, 722, 724, 727, 734, 735, 736, 739, 742, 749, 753, 759, 760, 761, 762, 763, 765, 768, 771, 782, 783, 784, 785, 792, 793, 795, 797, 800, 804, 806, 808, 819, 820, 821, 823, 824, 825, 826, 829, 830, 833, 836, 840, 841, 842, 844, 850, 855, 857, 859, 860, 862, 863, 865, 868, 870, 871, 872, 877, 883, 884, 885, 887, 890, 891, 892, 893, 895, 897, 898, 903, 907, 908, 911, 912, 916, 917, 919, 924, 928, 929, 931, 936, 938, 943, 944, 951, 953, 957, 958, 959, 961, 962, 963, 964, 966, 974, 976, 979, 980, 981, 982, 987, 991, 993, 994, 995, 997, 999, 1003, 1006, 1007, 1009, 1010, 1011, 1014, 1028, 1032, 1035, 1038, 1039, 1041, 1042, 1043, 1044, 1045, 1047, 1049, 1050, 1051, 1052, 1055, 1056, 1064, 1065, 1069, 1073, 1077, 1078, 1085, 1086, 1087, 1088, 1089, 1092, 1095, 1101, 1103, 1104, 1108, 1110, 1111, 1112, 1114, 1115, 1117, 1118, 1119, 1120, 1122, 1125, 1127, 1130, 1132, 1133, 1136, 1137, 1144, 1146, 1147, 1148, 1154, 1160, 1162, 1166, 1170, 1176, 1178, 1182, 1189, 1190, 1191, 1193, 1196, 1199, 1200, 1204, 1214, 1217, 1218, 1219, 1223, 1225, 1227, 1228, 1230, 1231, 1233, 1236, 1240, 1241, 1248, 1249, 1250, 1252, 1253, 1256, 1258, 1269, 1272, 1273, 1277, 1281, 1282, 1285, 1286, 1291, 1293, 1295, 1297, 1306, 1309, 1312, 1316, 1317, 1320, 1321, 1327, 1330, 1331, 1334, 1339, 1346, 1347, 1349, 1351, 1354, 1355, 1360, 1364, 1368, 1371, 1373, 1376, 1377, 1380, 1381, 1382, 1388, 1392, 1393, 1396, 1398, 1403, 1404, 1407, 1415, 1420, 1421, 1423, 1426, 1431, 1438, 1441, 1442, 1444, 1447, 1451, 1453, 1454, 1455, 1458, 1459, 1462, 1466, 1467, 1468, 1474, 1475, 1481, 1486, 1488, 1490, 1493, 1498, 1499, 1503, 1504, 1508, 1510, 1511, 1513, 1514, 1517, 1518, 1525, 1526, 1527, 1539, 1543, 1545, 1546, 1549, 1555, 1556, 1560, 1563, 1567, 1571, 1575, 1576, 1578, 1584, 1586, 1590, 1592, 1594, 1599, 1600, 1602, 1604, 1605, 1608, 1609, 1612, 1614, 1615, 1616, 1622, 1624, 1625, 1634, 1635, 1637, 1638, 1639, 1641, 1650, 1652, 1658, 1659, 1662, 1663, 1668, 1669, 1671, 1673, 1675, 1676, 1680, 1683, 1684, 1685, 1688, 1689, 1691, 1698, 1699, 1701, 1705, 1706, 1707, 1708, 1710, 1712, 1717, 1719, 1723, 1725, 1729, 1731, 1732, 1735, 1740, 1745, 1755, 1758, 1759, 1761, 1764, 1768, 1771, 1776, 1778, 1779, 1785, 1791, 1807, 1813, 1815, 1816, 1820, 1830, 1832, 1834, 1835, 1839, 1840, 1845, 1850, 1852, 1859, 1861, 1865, 1867, 1868, 1869, 1870, 1872, 1874, 1876, 1882, 1883, 1886, 1888, 1897, 1898, 1899, 1900, 1901, 1902, 1903, 1905, 1906, 1911, 1917, 1918, 1920, 1922, 1923, 1924, 1933, 1934, 1936, 1940, 1944, 1945, 1950, 1952, 1953, 1955, 1958, 1973, 1981, 1990, 1991, 1992, 1993, 1994, 1995, 1996, 1999, 2000, 2007, 2008, 2009, 2010, 2012, 2013, 2017, 2026, 2031, 2032, 2039, 2041, 2043, 2048, 2060, 2062, 2064, 2066, 2072, 2074, 2077, 2080, 2081, 2082, 2083, 2088, 2089, 2094, 2096, 2097, 2099, 2103, 2104, 2119, 2126, 2132, 2133, 2134, 2140, 2142, 2143, 2144, 2147, 2150, 2152, 2156, 2157, 2159, 2161, 2162, 2163, 2164, 2166, 2167, 2170, 2172, 2173, 2177, 2178, 2179, 2185, 2191, 2193, 2196, 2202, 2203, 2214, 2215, 2216, 2218, 2221, 2222, 2225, 2226, 2227, 2229, 2230, 2231, 2232, 2235, 2240, 2243, 2244, 2247, 2253, 2257, 2260, 2262, 2263, 2265, 2273, 2274, 2276, 2278, 2280, 2282, 2283, 2288, 2291, 2295, 2296, 2297, 2298, 2301, 2303, 2304, 2308, 2309, 2310, 2314, 2322, 2323, 2328, 2329, 2331, 2339, 2342, 2345, 2348, 2349, 2351, 2352, 2353, 2358, 2360, 2363, 2366, 2371, 2379, 2381, 2382, 2384, 2398, 2401, 2402, 2403, 2405, 2410, 2411, 2412, 2413, 2418, 2419, 2420, 2422, 2423, 2430, 2435, 2437, 2438, 2440, 2441, 2442, 2443, 2445, 2451, 2452, 2453, 2455, 2457, 2465, 2466, 2470, 2471, 2472, 2474, 2476, 2479, 2481, 2482, 2490, 2492, 2494, 2495, 2496, 2498, 2500, 2504, 2505, 2509, 2510, 2511, 2514, 2515, 2517, 2519, 2525, 2528, 2529, 2531, 2532, 2533, 2536, 2537, 2538, 2539, 2541, 2542, 2547, 2548, 2551, 2552, 2554, 2555, 2556, 2557, 2567, 2568, 2573, 2577, 2578, 2581, 2583, 2589, 2590, 2592, 2594, 2601, 2605, 2609, 2613, 2616, 2617, 2618, 2625, 2626, 2627, 2632, 2634, 2639, 2641, 2644, 2648, 2652, 2653, 2655, 2661, 2662, 2663, 2671, 2674, 2675, 2679, 2684, 2685, 2687, 2689, 2691, 2692, 2696, 2700, 2702, 2704, 2711, 2715, 2718, 2719, 2723, 2725, 2726, 2727, 2728, 2729, 2730, 2735, 2740, 2742, 2746, 2747, 2749, 2752, 2755, 2756, 2757, 2763, 2764, 2770, 2775, 2780, 2782, 2784, 2785, 2787, 2800, 2801, 2802, 2805, 2812, 2820, 2821, 2823, 2824, 2826, 2827, 2828, 2831, 2832, 2840, 2842, 2844, 2850, 2857, 2858, 2861, 2862, 2864, 2865, 2871, 2873, 2876, 2878, 2881, 2888, 2889, 2890, 2893, 2898, 2902, 2903, 2906, 2908, 2909, 2910, 2911, 2915, 2916, 2917, 2919, 2923, 2924, 2926, 2930, 2931, 2932, 2933, 2934, 2935, 2944, 2945, 2946, 2948, 2953, 2955, 2959, 2962, 2963, 2966, 2968, 2972, 2976, 2979, 2980, 2985, 2992, 2994, 2998, 3002, 3003, 3005, 3007, 3008, 3014, 3015, 3016, 3023, 3024, 3026, 3027, 3038, 3039, 3042, 3043, 3044, 3046, 3048, 3049, 3050, 3051, 3052, 3053, 3055, 3064, 3067, 3072, 3075, 3076, 3078, 3080, 3081, 3083, 3084, 3085, 3087, 3088, 3090, 3094, 3096, 3100, 3101, 3102, 3105, 3106, 3109, 3114, 3118, 3119, 3120, 3121, 3123, 3126, 3127, 3128, 3129, 3137, 3138, 3139, 3143, 3147, 3148, 3153, 3156, 3157, 3158, 3170, 3181, 3185, 3189, 3191, 3192, 3194, 3202, 3205, 3206, 3210, 3212, 3215, 3219, 3220, 3224, 3225, 3227, 3228, 3236, 3237, 3239, 3240, 3245, 3247, 3250, 3252, 3255, 3258, 3260, 3261, 3263, 3266, 3268, 3271, 3272, 3273, 3278, 3280, 3286, 3288, 3290, 3291, 3294, 3295, 3296, 3297, 3299, 3301, 3303, 3305, 3312, 3313, 3324, 3327, 3331, 3332, 3333, 3340, 3343, 3345, 3347, 3349, 3351, 3353, 3355, 3358, 3361, 3363, 3369, 3370, 3377, 3383, 3386, 3397, 3399, 3400, 3404, 3405, 3415, 3416, 3418, 3419, 3420, 3422, 3424, 3426, 3427, 3428, 3435, 3438, 3441, 3442, 3445, 3447, 3450, 3451, 3452, 3455, 3458, 3460, 3461, 3464, 3465, 3466, 3468, 3470, 3471, 3474, 3475, 3477, 3482, 3483, 3487, 3488, 3490, 3491, 3494, 3496, 3500, 3503, 3504, 3506, 3510, 3511, 3516, 3517, 3518, 3529, 3531, 3533, 3536, 3541, 3544, 3545, 3548, 3549, 3551, 3552, 3554, 3558, 3566, 3562, 3563, 3569, 3572, 3574, 3576, 3577, 3587, 3588, 3589, 3592, 3593, 3594, 3595, 3597, 3598, 3599, 3600, 3603, 3604, 3606, 3607, 3610, 3611, 3613, 3616, 3618, 3620, 3621, 3623, 3624, 3626, 3627, 3628, 3629, 3630, 3631, 3637, 3640, 3642, 3643, 3644, 3645, 3646, 3647, 3648, 3650, 3655, 3657, 3659, 3660, 3662, 3663, 3668, 3671, 3672, 3674, 3677, 3682, 3684, 3685, 3693, 3694, 3704, 3706, 3707, 3713, 3715, 3717, 3718, 3719, 3720, 3725, 3732, 3738, 3739, 3748, 3749, 3752, 3754, 3757, 3761, 3762, 3764, 3765, 3766, 3772, 3773, 3777, 3778, 3781, 3783, 3784, 3788, 3789, 3790, 3791, 3792, 3794, 3798, 3804, 3806, 3808, 3812, 3818, 3820, 3823, 3825, 3828, 3829, 3830, 3831, 3832, 3833, 3836, 3837, 3839, 3842, 3843, 3844, 3845, 3849, 3858, 3860, 3862, 3866, 3867, 3870, 3871, 3872, 3873, 3876, 3882, 3883, 3887, 3889, 3890, 3891, 3892, 3893, 3894, 3895, 3908, 3910, 3911, 3912, 3914, 3917, 3923, 3924, 3928, 3929, 3933, 3934, 3935, 3938, 3941, 3947, 3950, 3951, 3952, 3954, 3958, 3962, 3967, 3975, 3983, 3985, 3987, 3988, 3995, 3996, 3997, 4000, 4001, 4002, 4003, 4006, 4008, 4013, 4019, 4020, 4024, 4026, 4030, 4032, 4033, 4034, 4037, 4039, 4040, 4041, 4047, 4048, 4049, 4050, 4051, 4052, 4053, 4054, 4056, 4057, 4061, 4062, 4066, 4067, 4068, 4069, 4072, 4075, 4079, 4092, 4096, 4099, 4102, 4103, 4105, 4111, 4113, 4115, 4116, 4122, 4124, 4128, 4132, 4133, 4139, 4143, 4146, 4148, 4149, 4155, 4156, 4158, 4160, 4161, 4162, 4163, 4165, 4166, 4167, 4168, 4169, 4170, 4171, 4175, 4178, 4184, 4185, 4187, 4188, 4189, 4191, 4197, 4198, 4201, 4202, 4205, 4206, 4207, 4208, 4210, 4211, 4212, 4214, 4217, 4219, 4221, 4222, 4227, 4228, 4231, 4233, 4235, 4244, 4246, 4250, 4251, 4257, 4258, 4261, 4263, 4266, 4270, 4272, 4279, 4280, 4281, 4283, 4288, 4294, 4295, 4296, 4298, 4301, 4302, 4304, 4309, 4312, 4320, 4324, 4329, 4330, 4331, 4332, 4333, 4335, 4337, 4338, 4341, 4344, 4347, 4349, 4352, 4354, 4358, 4360, 4369, 4371, 4373, 4378, 4380, 4383, 4387, 4390, 4391, 4397, 4401, 4402, 4403, 4404, 4405, 4406, 4410, 4415, 4418, 4422, 4423, 4427, 4439, 4443, 4444, 4446, 4448, 4450, 4453, 4456, 4458, 4461, 4462, 4463, 4464, 4465, 4466, 4468, 4472, 4474, 4475, 4479, 4485, 4492, 4494, 4502, 4506, 4507, 4512, 4513, 4515, 4516, 4518, 4519, 4524, 4531, 4534, 4535, 4543, 4545, 4548, 4549, 4551, 4552, 4554, 4556, 4557, 4558, 4560, 4562, 4565, 4566, 4568, 4570, 4575, 4580, 4582, 4583, 4584, 4590, 4591, 4596, 4601, 4604, 4606, 4621, 4625, 4630, 4632, 4633, 4635, 4641, 4643, 4644, 4650, 4653, 4654, 4655, 4659, 4666, 4667, 4669, 4670, 4671, 4672, 4674, 4676, 4677, 4680, 4682, 4685, 4687, 4697, 4699, 4700, 4704, 4706, 4708, 4710, 4716, 4719, 4721, 4725, 4729, 4732, 4737, 4738, 4740, 4747, 4748, 4749, 4750, 4751, 4753, 4754, 4755, 4756, 4759, 4761, 4762, 4765, 4766, 4767, 4771, 4775, 4779, 4789, 4790, 4791, 4794, 4795, 4804, 4809, 4813, 4814, 4815, 4818, 4822, 4823, 4824, 4828, 4829, 4832, 4834, 4835, 4838, 4842, 4856, 4857, 4859, 4861, 4862, 4864, 4868, 4869, 4872, 4875, 4877, 4878, 4880, 4881, 4887, 4889, 4891, 4895, 4901, 4902, 4905, 4909, 4914, 4916, 4917, 4918, 4920, 4921, 4922, 4923, 4924, 4926, 4935, 4936, 4938, 4940, 4941, 4943, 4944, 4950, 4955, 4971, 4972, 4973, 4975, 4977, 4984, 4986, 4987, 4988, 4992, 4993, 4994, 4996, 5000, 5005, 5010, 5015, 5022, 5026, 5029, 5030, 5034, 5039, 5040, 5042, 5044, 5046, 5049, 5052, 5054, 5057, 5067, 5068, 5072, 5075, 5078, 5079, 5082, 5087, 5088, 5089, 5090, 5091, 5094, 5095, 5100, 5102, 5111, 5122, 5123, 5129, 5131, 5132, 5140, 5145, 5147, 5151, 5160, 5164, 5165, 5168, 5170, 5174, 5180, 5182, 5184, 5185, 5188, 5189, 5190, 5191, 5192, 5196, 5198, 5199, 5200, 5201, 5202, 5206, 5208, 5212, 5214, 5217, 5219, 5225, 5226, 5229, 5234, 5240, 5241, 5243, 5249, 5253, 5255, 5258, 5261, 5263, 5264, 5267, 5268, 5273, 5275, 5276, 5280, 5281, 5283, 5286, 5289, 5292, 5293, 5298, 5299, 5300, 5301, 5303, 5308, 5311, 5317, 5319, 5321, 5324, 5327, 5329, 5330, 5334, 5338, 5344, 5346, 5348, 5351, 5359, 5361, 5372, 5382, 5383, 5386, 5388, 5389, 5393, 5395, 5397, 5403, 5407, 5409, 5411, 5413, 5414, 5417, 5426, 5430, 5431, 5434, 5446, 5448, 5449, 5452, 5456, 5457, 5459, 5463, 5464, 5466, 5467, 5472, 5474, 5476, 5479, 5482, 5483, 5485, 5493, 5496, 5498, 5506, 5508, 5510, 5513, 5515, 5516, 5517, 5518, 5519, 5524, 5526, 5529, 5530, 5534, 5535, 5537, 5539, 5541, 5543, 5557, 5562, 5563, 5568, 5569, 5571, 5579, 5585, 5586, 5588, 5589, 5591, 5592, 5597, 5598, 5608, 5612, 5613, 5615, 5616, 5618, 5620, 5627, 5631, 5632, 5635, 5638, 5640, 5642, 5643, 5647, 5648, 5649, 5650, 5651, 5652, 5659, 5660, 5662, 5663, 5665, 5666, 5675, 5676, 5677, 5683, 5689, 5690, 5694, 5695, 5697, 5698, 5702, 5703, 5706, 5709, 5711, 5717, 5718, 5721, 5722, 5731, 5732, 5734, 5735, 5744, 5748, 5751, 5753, 5754, 5756, 5757, 5763, 5768, 5770, 5771, 5775, 5780, 5784, 5785, 5788, 5791, 5794, 5803, 5806, 5808, 5809, 5810, 5813, 5814, 5815, 5820, 5823, 5826, 5833, 5835, 5836, 5837, 5846, 5850, 5852, 5853, 5854, 5859, 5861, 5864, 5865, 5866, 5867, 5868, 5869, 5870, 5872, 5876, 5878, 5879, 5881, 5883, 5884, 5886, 5887, 5888, 5892, 5893, 5906, 5907, 5912, 5922, 5923, 5925, 5926, 5927, 5928, 5932, 5934, 5938, 5939, 5941, 5944, 5948, 5954, 5956, 5959, 5967, 5968, 5975, 5979, 5980, 5982, 5987, 5988, 5991, 5994, 5996, 5997, 6000, 6002, 6004, 6006, 6007, 6009, 6013, 6017, 6023, 6024, 6025, 6026, 6031, 6038, 6041, 6043, 6044, 6048, 6051, 6058, 6059, 6062, 6063, 6065, 6068, 6069, 6070, 6072, 6073, 6075, 6080, 6081, 6084, 6085, 6086, 6087, 6088, 6089, 6090, 6092, 6093, 6097, 6098, 6099, 6107, 6108, 6109, 6110, 6113, 6116, 6119, 6120, 6124, 6129, 6131, 6132, 6133, 6136, 6137, 6138, 6139, 6143, 6145, 6146, 6147, 6151, 6153, 6160, 6162, 6163, 6164, 6165, 6181, 6183, 6186, 6188, 6189, 6193, 6194, 6195, 6196, 6198, 6204, 6205, 6209, 6220, 6223, 6224, 6227, 6228, 6233, 6234, 6237, 6239, 6242, 6243, 6246, 6247, 6250, 6251, 6264, 6265, 6267, 6270, 6272, 6273, 6275, 6278, 6281, 6282, 6286, 6292, 6293, 6295, 6297, 6299, 6300, 6303, 6307, 6309, 6311, 6315, 6317, 6319, 6322, 6323, 6328, 6332, 6333, 6338, 6342, 6343, 6344, 6346, 6353, 6354, 6356, 6362, 6367, 6370, 6372, 6375, 6376, 6381, 6383, 6386, 6393, 6394, 6397, 6399, 6403, 6405, 6408, 6412, 6414, 6415, 6416, 6417, 6419, 6420, 6422, 6425, 6426, 6428, 6429, 6430, 6431, 6436, 6440, 6449, 6456, 6463, 6464, 6466, 6467, 6470, 6474, 6475, 6476, 6478, 6480, 6482, 6484, 6488, 6493, 6494, 6495, 6501, 6504, 6505, 6510, 6512, 6513, 6514, 6516, 6517, 6519, 6526, 6530, 6531, 6532, 6534, 6537, 6543, 6547, 6549, 6553, 6555, 6558, 6564, 6567, 6569, 6571, 6574, 6576, 6577, 6579, 6584, 6588, 6589, 6592, 6594, 6595, 6597, 6599, 6600, 6603, 6606, 6607, 6609, 6610, 6615, 6616, 6617, 6620, 6623, 6625, 6628, 6629, 6633, 6634, 6635, 6639, 6640, 6644, 6646, 6647, 6648, 6649, 6655, 6656, 6658, 6661, 6666, 6671, 6672, 6673, 6681, 6693, 6703, 6704, 6705, 6706, 6716, 6718, 6720, 6729, 6730, 6734, 6736, 6737, 6739, 6742, 6747, 6749, 6756, 6757, 6759, 6764, 6766, 6767, 6777, 6779, 6782, 6783, 6786, 6792, 6793, 6794, 6795, 6797, 6799, 6803, 6804, 6805, 6807, 6810, 6811, 6813, 6815, 6816, 6817, 6819, 6820, 6821, 6824, 6826, 6827, 6828, 6830, 6831, 6834, 6836, 6841, 6842, 6843, 6848, 6851, 6861, 6863, 6869, 6875, 6876, 6877, 6880, 6884, 6886, 6887, 6891, 6894, 6902, 6903, 6904, 6906, 6907, 6913, 6914, 6917, 6919, 6920, 6921, 6924, 6925, 6930, 6936, 6939, 6946, 6954, 6955, 6959, 6960, 6963, 6967, 6970, 6971, 6979, 6980, 6981, 6984, 6985, 6987, 6988, 6990, 6994, 6997, 6999, 7003, 7009, 7013, 7018, 7022, 7029, 7038, 7039, 7041, 7043, 7045, 7046, 7049, 7051, 7052, 7053, 7054, 7057, 7064, 7067, 7073, 7077, 7079, 7083, 7084, 7094, 7096, 7105, 7106, 7107, 7108, 7110, 7112, 7113, 7117, 7118, 7119, 7122, 7126, 7129, 7130, 7138, 7139, 7142, 7143, 7144, 7150, 7151, 7154, 7163, 7164, 7165, 7166, 7169, 7171, 7172, 7176, 7182, 7184, 7192, 7194, 7195, 7196, 7197, 7201, 7202, 7203, 7206, 7207, 7208, 7210, 7212, 7217, 7219, 7224, 7227, 7228, 7230, 7231, 7234, 7235, 7236, 7244, 7245, 7246, 7249, 7250, 7252, 7255, 7257, 7258, 7262, 7263, 7264, 7267, 7268, 7270, 7274, 7276, 7281, 7282, 7287, 7291, 7292, 7293, 7296, 7299, 7300, 7301, 7303, 7304, 7306, 7307, 7311, 7312, 7313, 7318, 7320, 7323, 7328, 7330, 7331, 7344, 7345, 7350, 7351, 7357, 7358, 7360, 7361, 7365, 7369, 7371, 7376, 7377, 7380, 7382, 7383, 7386, 7392, 7395, 7398, 7399, 7400, 7406, 7409, 7410, 7411, 7417, 7418, 7425, 7430, 7434, 7435, 7436, 7438, 7441, 7447, 7448, 7452, 7453, 7454, 7457, 7458, 7466, 7470, 7472, 7483, 7486, 7490, 7492, 7493, 7499, 7503, 7506, 7512, 7515, 7521, 7522, 7523, 7524, 7525, 7533, 7538, 7546, 7556, 7561, 7572, 7574, 7576, 7579, 7583, 7585, 7586, 7589, 7594, 7596, 7599, 7604, 7605, 7609, 7612, 7619, 7620, 7622, 7624, 7625, 7633, 7638, 7640, 7642, 7643, 7647, 7649, 7652, 7655, 7658, 7661, 7662, 7664, 7665, 7671, 7674, 7678, 7679, 7680, 7682, 7686, 7687, 7689, 7695, 7700, 7703, 7712, 7715, 7716, 7724, 7726, 7727, 7730, 7736, 7737, 7738, 7742, 7744, 7745, 7749, 7753, 7763, 7764, 7768, 7770, 7772, 7774, 7775, 7779, 7781, 7786, 7788, 7791, 7793, 7798, 7799, 7800, 7803, 7804, 7806, 7807, 7818, 7819, 7820, 7822, 7823, 7824, 7825, 7826, 7833, 7834, 7839, 7841, 7844, 7845, 7850, 7854, 7856, 7860, 7865, 7873, 7877, 7878, 7880, 7881, 7887, 7888, 7890, 7896, 7909, 7910, 7911, 7918, 7923, 7925, 7928, 7933, 7934, 7935, 7936, 7938, 7942, 7944, 7949, 7952, 7965, 7966, 7967, 7974, 7976, 7977, 7984, 7986, 7992, 7996, 7999, 8004, 8006, 8007, 8012, 8020, 8021, 8024, 8025, 8026, 8030, 8031, 8036, 8041, 8042, 8044, 8047, 8048, 8053, 8056, 8059, 8061, 8063, 8068, 8072, 8076, 8077, 8078, 8079, 8080, 8081, 8083, 8084, 8088, 8089, 8090, 8091, 8093, 8095, 8100, 8102, 8103, 8106, 8110, 8112, 8113, 8118, 8123, 8126, 8129, 8130, 8141, 8145, 8146, 8147, 8148, 8150, 8155, 8163, 8164, 8170, 8178, 8179, 8181, 8189, 8193, 8202, 8204, 8208, 8210, 8213, 8217, 8219, 8220, 8223, 8227, 8230, 8234, 8235, 8237, 8239, 8241, 8242, 8246, 8248, 8250, 8252, 8253, 8263, 8264, 8265, 8266, 8268, 8269, 8270, 8272, 8273, 8274, 8282, 8289, 8291, 8292, 8300, 8304, 8308, 8310, 8311, 8312, 8315, 8318, 8319, 8320, 8323, 8329, 8339, 8340, 8347, 8349, 8350, 8353, 8358, 8367, 8368, 8373, 8378, 8379, 8380, 8385, 8387, 8389, 8392, 8393, 8395, 8396, 8401, 8404, 8406, 8408, 8410, 8413, 8414, 8415, 8416, 8417, 8418, 8430, 8436, 8438, 8439, 8440, 8443, 8444, 8445, 8447, 8448, 8449, 8450, 8451, 8457, 8458, 8465, 8470, 8472, 8473, 8474, 8476, 8477, 8481, 8482, 8485, 8486, 8490, 8498, 8501, 8502, 8503, 8505, 8507, 8509, 8511, 8513, 8515, 8516, 8521, 8523, 8524, 8525, 8526, 8527, 8528, 8532, 8533, 8535, 8539, 8542, 8543, 8553, 8554, 8561, 8562, 8565, 8566, 8574, 8575, 8576, 8577, 8579, 8581, 8582, 8585, 8592, 8594, 8596, 8597, 8598, 8600, 8601, 8602, 8603, 8604, 8605, 8609, 8611, 8612, 8631, 8634, 8635, 8638, 8639, 8641, 8642, 8644, 8646, 8648, 8650, 8658, 8659, 8663, 8665, 8669, 8672, 8676, 8677, 8685, 8686, 8689, 8690, 8693, 8695, 8699, 8700, 8703, 8705, 8706, 8708, 8709, 8713, 8717, 8720, 8722, 8726, 8729, 8731, 8736, 8741, 8743, 8744, 8748, 8750, 8757, 8761, 8763, 8769, 8770, 8773, 8777, 8779, 8783, 8784, 8785, 8786, 8789, 8792, 8795, 8802, 8803, 8808, 8810, 8811, 8818, 8821, 8822, 8824, 8828, 8829, 8830, 8831, 8833, 8834, 8835, 8836, 8841, 8843, 8846, 8853, 8865, 8866, 8874, 8875, 8876, 8877, 8878, 8881, 8883, 8884, 8888, 8889, 8892, 8896, 8900, 8907, 8908, 8911, 8916, 8917, 8919, 8922, 8924, 8926, 8929, 8930, 8935, 8937, 8938, 8941, 8945, 8946, 8948, 8951, 8953, 8960, 8961, 8967, 8968, 8971, 8979, 8980, 8981, 8985, 8986, 8991, 8992, 8996, 8998, 9001, 9006, 9009, 9011, 9012, 9013, 9018, 9020, 9022, 9026, 9027, 9028, 9029, 9030, 9045, 9050, 9052, 9056, 9058, 9059, 9060, 9068, 9069, 9071, 9072, 9076, 9084, 9086, 9087, 9088, 9091, 9092, 9095, 9096, 9103, 9104, 9105, 9106, 9107, 9112, 9114, 9116, 9118, 9122, 9123, 9125, 9129, 9131, 9133, 9134, 9139, 9140, 9141, 9142, 9144, 9145, 9152, 9154, 9155, 9159, 9167, 9168, 9175, 9177, 9179, 9180, 9182, 9185, 9188, 9190, 9191, 9194, 9195, 9205, 9206, 9207, 9210, 9211, 9213, 9215, 9216, 9220, 9223, 9226, 9229, 9233, 9237, 9243, 9244, 9246, 9248, 9249, 9253, 9257, 9259, 9262, 9265, 9267, 9269, 9270, 9273, 9275, 9284, 9285, 9287, 9288, 9290, 9292, 9295, 9300, 9304, 9306, 9308, 9311, 9313, 9320, 9321, 9323, 9326, 9328, 9332, 9336, 9337, 9339, 9340, 9346, 9347, 9350, 9352, 9353, 9359, 9360, 9366, 9371, 9375, 9376, 9382, 9391, 9392, 9394, 9400, 9402, 9403, 9404, 9406, 9407, 9413, 9414, 9415, 9421, 9423, 9425, 9429, 9439, 9440, 9443, 9449, 9451, 9452, 9453, 9456, 9460, 9468, 9471, 9472, 9473, 9474, 9475, 9476, 9481, 9488, 9490, 9497, 9500, 9504, 9509, 9514, 9517, 9518, 9519, 9520, 9522, 9534, 9536, 9537, 9538, 9540, 9543, 9545, 9546, 9550, 9551, 9553, 9555, 9560, 9564, 9567, 9571, 9573, 9577, 9586, 9587, 9590, 9591, 9595, 9596, 9597, 9598, 9601, 9602, 9606, 9607, 9609, 9614, 9615, 9617, 9618, 9620, 9621, 9623, 9624, 9626, 9629, 9630, 9632, 9633, 9649, 9652, 9653, 9655, 9657, 9658, 9663, 9666, 9668, 9670, 9682, 9686, 9688, 9698, 9701, 9706, 9710, 9711, 9715, 9721, 9723, 9724, 9726, 9727, 9729, 9730, 9731, 9732, 9733, 9734, 9737, 9742, 9744, 9745, 9746, 9750, 9753, 9754, 9756, 9763, 9764, 9767, 9770, 9772, 9774, 9776, 9777, 9782, 9786, 9787, 9791, 9792, 9794, 9798, 9799, 9804, 9808, 9809, 9810, 9811, 9812, 9813, 9816, 9819, 9820, 9827, 9828, 9829, 9830, 9835, 9845, 9847, 9861, 9866, 9869, 9873, 9875, 9878, 9879, 9882, 9886, 9887, 9891, 9892, 9900, 9907, 9909, 9910, 9911, 9912, 9923, 9924, 9928, 9932, 9935, 9938, 9940, 9946, 9949, 9950, 9952, 9953, 9960, 9962, 9963, 9967, 9968, 9973, 9975, 9976, 9980, 9982, 9984, 9985, 9987, 9988, 9990, 9991, 9992, 9997, 10000, 10008, 10015, 10017, 10018, 10019, 10020, 10026, 10027, 10032, 10033, 10034, 10035, 10037, 10041, 10044, 10049, 10051, 10052, 10053, 10054, 10055, 10058, 10059, 10060, 10062, 10064, 10066, 10068, 10073, 10075, 10077, 10078, 10080, 10081, 10083, 10091, 10092, 10095, 10097, 10101, 10103, 10106, 10110, 10115, 10116, 10117, 10122, 10128, 10129, 10130, 10131, 10136, 10138, 10143, 10151, 10158, 10160, 10163, 10165, 10166, 10168, 10174, 10176, 10178, 10181, 10184, 10192, 10193, 10194, 10195, 10196, 10199, 10206, 10212, 10218, 10219, 10220, 10221, 10222, 10223, 10224, 10225, 10231, 10233, 10234, 10235, 10236, 10237, 10239, 10240, 10249, 10252, 10253, 10254, 10255, 10259, 10262, 10263, 10266, 10269, 10270, 10275, 10276, 10278, 10284, 10286, 10291, 10292, 10295, 10300, 10302, 10306, 10307, 10311, 10312, 10314, 10318, 10319, 10323, 10325, 10326, 10331, 10333, 10334, 10335, 10336, 10340, 10341, 10343, 10346, 10353, 10356, 10357, 10364, 10371, 10375, 10376, 10378, 10380, 10384, 10385, 10388, 10393, 10397, 10398, 10399, 10401, 10410, 10411, 10413, 10414, 10416, 10417, 10419, 10421, 10423, 10424, 10425, 10426, 10435, 10436, 10438, 10440, 10446, 10449, 10450, 10451, 10452, 10453, 10456, 10460, 10463, 10464, 10465, 10466, 10468, 10469, 10471, 10474, 10480, 10482, 10487, 10488, 10490, 10494, 10496, 10506, 10508, 10514, 10518, 10523, 10527, 10528, 10530, 10531, 10532, 10536, 10537, 10541, 10542, 10543, 10544, 10547, 10548, 10556, 10558, 10563, 10567, 10569, 10573, 10580, 10581, 10583, 10584, 10588, 10593, 10596, 10599, 10601, 10602, 10603, 10604, 10612, 10613, 10615, 10616, 10617, 10621, 10622, 10629, 10630, 10631, 10633, 10636, 10637, 10638, 10639, 10640, 10645, 10646, 10652, 10655, 10665, 10666, 10668, 10670, 10676, 10678, 10679, 10682, 10683, 10684, 10685, 10686, 10700, 10701, 10705, 10707, 10711, 10715, 10716, 10721, 10722, 10724, 10726, 10729, 10732, 10734, 10738, 10741, 10744, 10747, 10748, 10749, 10752, 10754, 10756, 10757, 10761, 10762, 10766, 10768, 10769, 10770, 10775, 10777, 10778, 10779, 10784, 10785, 10787, 10788, 10790, 10792, 10795, 10801, 10802, 10803, 10804, 10805, 10809, 10810, 10811, 10812, 10815, 10818, 10819, 10820, 10822, 10823, 10824, 10827, 10831, 10833, 10836, 10837, 10838, 10839, 10840, 10843, 10850, 10851, 10852, 10853, 10854, 10857, 10858, 10860, 10866, 10867, 10877, 10880, 10881, 10886, 10887, 10888, 10889, 10892, 10896, 10897, 10898, 10899, 10901, 10902, 10911, 10917, 10918, 10920, 10924, 10926, 10927, 10928, 10929, 10930, 10933, 10934, 10940, 10941, 10945, 10947, 10960, 10962, 10965, 10966, 10967, 10968, 10972, 10976, 10977, 10988, 10994, 10996, 10999, 11008, 11009, 11015, 11021, 11024, 11027, 11030, 11032, 11033, 11036, 11037, 11039, 11040, 11044, 11046, 11047, 11052, 11053, 11056, 11059, 11060, 11063, 11066, 11067, 11070, 11078, 11081, 11082, 11083, 11090, 11095, 11098, 11100, 11101, 11107, 11114, 11118, 11119, 11124, 11129, 11133, 11135, 11136, 11137, 11138, 11151, 11153, 11154, 11160, 11162, 11163, 11165, 11166, 11168, 11169, 11173, 11174, 11177, 11178, 11181, 11184, 11187, 11188, 11190, 11192, 11193, 11194, 11198, 11203, 11204, 11208, 11213, 11214, 11216, 11217, 11218, 11222, 11226, 11227, 11228, 11230, 11231, 11233, 11235, 11236, 11238, 11239, 11242, 11243, 11246, 11247, 11253, 11254, 11255, 11256, 11258, 11260, 11262, 11263, 11266, 11278, 11290, 11292, 11293, 11295, 11297, 11298, 11302, 11304, 11305, 11306, 11313, 11315, 11318, 11321, 11330, 11331, 11337, 11338, 11340, 11345, 11346, 11348, 11349, 11356, 11358, 11362, 11363, 11364, 11365, 11370, 11371, 11373, 11377, 11380, 11382, 11385, 11387, 11388, 11391, 11394, 11395, 11401, 11404, 11405, 11406, 11417, 11424, 11430, 11431, 11435, 11436, 11438, 11439, 11440, 11443, 11446, 11447, 11449, 11451, 11456, 11459, 11461, 11465, 11466, 11478, 11485, 11487, 11489, 11490, 11491, 11494, 11496, 11497, 11498, 11499, 11500, 11505, 11506, 11507, 11508, 11513, 11518, 11520, 11523, 11524, 11526, 11527, 11531, 11532, 11533, 11535, 11540, 11541, 11544, 11548, 11551, 11553, 11558, 11560, 11561, 11562, 11567, 11568, 11570, 11571, 11576, 11577, 11578, 11583, 11585, 11588, 11593, 11594, 11595, 11596, 11597, 11599, 11603, 11604, 11607, 11612, 11617, 11618, 11623, 11628, 11634, 11639, 11640, 11647, 11649, 11650, 11656, 11658, 11659, 11663, 11669, 11673, 11677, 11678, 11681, 11682, 11688, 11691, 11692, 11694, 11695, 11696, 11699, 11701, 11703, 11705, 11707, 11712, 11718, 11721, 11725, 11726, 11730, 11731, 11732, 11733, 11736, 11737, 11740, 11743, 11744, 11753, 11756, 11759, 11760, 11761, 11762, 11763, 11764, 11765, 11766, 11767, 11770, 11771, 11776, 11777, 11781, 11782, 11783, 11785, 11786, 11788, 11792, 11794, 11797, 11799, 11800, 11802, 11805, 11809, 11810, 11811, 11812, 11814, 11818, 11820, 11821, 11826, 11829, 11830, 11840, 11841, 11846, 11848, 11849, 11851, 11854, 11856, 11858, 11861, 11863, 11864, 11865, 11868, 11870, 11872, 11876, 11877, 11878, 11881, 11886, 11889, 11891, 11892, 11894, 11898, 11901, 11906, 11909, 11911, 11913, 11916, 11917, 11918, 11919, 11920, 11921, 11922, 11923, 11926, 11927, 11928, 11929, 11930, 11934, 11940, 11943, 11945, 11947, 11948, 11949, 11953, 11956, 11957, 11958, 11959, 11960, 11961, 11962, 11963, 11964, 11965, 11968, 11973, 11974, 11975, 11976, 11977, 11978, 11979, 11980, 11983, 11988, 11989, 11993, 11997, 11998, 11999, 12002, 12004, 12008, 12014, 12017, 12019, 12020, 12021, 12023, 12024, 12026, 12027, 12032, 12033, 12043, 12044, 12059, 12068, 12076, 12081, 12083, 12087, 12091, 12092, 12093, 12095, 12098, 12102, 12104, 12106, 12109, 12110, 12112, 12114, 12115, 12118, 12122, 12128, 12129, 12130, 12134, 12137, 12138, 12139, 12141, 12143, 12145, 12146, 12147, 12149, 12151, 12161, 12166, 12170, 12171, 12174, 12175, 12176, 12181, 12183, 12185, 12189, 12197, 12200, 12201, 12204, 12207, 12208, 12215, 12217, 12218, 12219, 12221, 12227, 12234, 12240, 12241, 12243, 12245, 12249, 12250, 12252, 12253, 12256, 12259, 12260, 12263, 12267, 12268, 12269, 12274, 12278, 12283, 12284, 12286, 12287, 12291, 12293, 12295, 12304, 12310, 12311, 12312, 12313, 12314, 12315, 12317, 12321, 12323, 12324, 12326, 12329, 12331, 12333, 12334, 12347, 12354, 12356, 12358, 12359, 12364, 12367, 12368, 12369, 12370, 12374, 12379, 12380, 12381, 12385, 12396, 12397, 12400, 12403, 12404, 12406, 12410, 12411, 12414, 12416, 12419, 12420, 12421, 12424, 12426, 12427, 12437, 12439, 12440, 12441, 12445, 12447, 12451, 12455, 12456, 12457, 12459, 12462, 12465, 12467, 12468, 12470, 12472, 12478, 12481, 12487, 12488, 12489, 12491, 12495, 12497, 12499, 12504, 12505, 12508, 12510, 12511, 12514, 12521, 12530, 12536, 12545, 12546, 12547, 12549, 12555, 12559, 12561, 12563, 12564, 12565, 12567, 12568, 12572, 12583, 12585, 12588, 12591, 12597, 12605, 12606, 12608, 12609, 12610, 12611, 12616, 12619, 12623, 12626, 12629, 12631, 12633, 12634, 12638, 12639, 12641, 12649, 12651, 12663, 12668, 12670, 12671, 12672, 12674, 12676, 12679, 12680, 12681, 12684, 12685, 12688, 12691, 12693, 12695, 12698, 12699, 12701, 12702, 12713, 12714, 12718, 12719, 12722, 12731, 12732, 12733, 12737, 12738, 12739, 12741, 12742, 12743, 12748, 12754, 12755, 12757, 12758, 12760, 12761, 12762, 12764, 12766, 12771, 12772, 12773, 12783, 12790, 12794, 12797, 12800, 12801, 12802, 12805, 12810, 12812, 12813, 12817, 12818, 12819, 12820, 12822, 12824, 12826, 12827, 12828, 12834, 12835, 12836, 12838, 12839, 12843, 12844, 12847, 12849, 12850, 12853, 12861, 12866, 12882, 12883, 12887, 12888, 12895, 12898, 12900, 12904, 12905, 12906, 12910, 12912, 12913, 12916, 12917, 12918, 12920, 12921, 12926, 12929, 12932, 12933, 12938, 12939, 12940, 12941, 12944, 12945, 12946, 12947, 12954, 12966, 12968, 12969, 12972, 12973, 12978, 12982, 12983, 12984, 12985, 12987, 12990, 12991, 12996, 13006, 13007, 13010, 13011, 13012, 13014, 13015, 13017, 13018, 13022, 13023, 13030, 13032, 13033, 13035, 13038, 13040, 13041, 13049, 13050, 13053, 13054, 13055, 13056, 13060, 13061, 13064, 13065, 13066, 13067, 13069, 13071, 13074, 13075, 13079, 13085, 13086, 13087, 13095, 13098, 13101, 13102, 13105, 13106, 13112, 13114, 13115, 13116, 13117, 13118, 13120, 13123, 13124, 13131, 13135, 13142, 13147, 13148, 13149, 13151, 13156, 13158, 13160, 13169, 13174, 13175, 13181, 13182, 13185, 13197, 13199, 13206, 13209, 13210, 13212, 13213, 13215, 13217, 13221, 13222, 13224, 13227, 13230, 13232, 13234, 13235, 13236, 13237, 13238, 13239, 13240, 13243, 13249, 13251, 13255, 13259, 13260, 13261, 13263, 13264, 13268, 13269, 13270, 13276, 13280, 13281, 13285, 13291, 13292, 13293, 13296, 13298, 13301, 13303, 13304, 13313, 13315, 13317, 13318, 13319, 13320, 13321, 13325, 13326, 13328, 13330, 13332, 13337, 13338, 13343, 13345, 13346, 13348, 13353, 13354, 13359, 13361, 13369, 13370, 13373, 13377, 13381, 13384, 13385, 13391, 13393, 13394, 13396, 13397, 13401, 13402, 13408, 13410, 13413, 13416, 13417, 13419, 13423, 13424, 13430, 13433, 13439, 13448, 13449, 13451, 13454, 13456, 13460, 13463, 13466, 13469, 13473, 13475, 13490, 13492, 13494, 13496, 13498, 13499, 13500, 13503, 13504, 13505, 13506, 13510, 13513, 13514, 13515, 13516, 13517, 13519, 13520, 13521, 13530, 13532, 13539, 13540, 13543, 13544, 13545, 13546, 13547, 13549, 13552, 13555, 13556, 13568, 13569, 13574, 13580, 13582, 13583, 13584, 13587, 13597, 13598, 13601, 13602, 13603, 13604, 13605, 13612, 13621, 13623, 13628, 13631, 13632, 13634, 13636, 13637, 13641, 13647, 13650, 13652, 13654, 13661, 13662, 13663, 13668, 13671, 13675, 13676, 13677, 13684, 13687, 13688, 13691, 13695, 13697, 13698, 13700, 13702, 13703, 13706, 13710, 13713, 13715, 13716, 13720, 13721, 13725, 13727, 13728, 13729, 13730, 13739, 13745, 13747, 13748, 13750, 13758, 13761, 13764, 13766, 13767, 13769, 13773, 13775, 13776, 13779, 13781, 13782, 13789, 13791, 13792, 13793, 13794, 13796, 13798, 13809, 13816, 13817, 13818, 13819, 13820, 13822, 13823, 13828, 13830, 13831, 13833, 13835, 13843, 13849, 13852, 13853, 13859, 13860, 13862, 13866, 13869, 13870, 13872, 13873, 13874, 13875, 13877, 13881, 13882, 13883, 13888, 13891, 13892, 13897, 13901, 13904, 13906, 13909, 13910, 13911, 13917, 13919, 13921, 13925, 13927, 13930, 13933, 13938, 13944, 13947, 13948, 13949, 13952, 13954, 13956, 13962, 13963, 13965, 13969, 13970, 13975, 13976, 13981, 13983, 13984, 13990, 13991, 13999, 14000, 14008, 14009, 14010, 14013, 14014, 14017, 14018, 14022, 14026, 14027, 14030, 14031, 14036, 14041, 14043, 14049, 14050, 14051, 14052, 14062, 14063, 14066, 14069, 14070, 14071, 14073, 14075, 14082, 14086, 14088, 14092, 14093, 14094, 14096, 14099, 14100, 14105, 14106, 14112, 14115, 14116, 14118, 14119, 14120, 14122, 14124, 14125, 14128, 14129, 14130, 14132, 14134, 14135, 14138, 14139, 14142, 14143, 14145, 14146, 14148, 14149, 14150.

Promoters expressing in root tissue at the V7 stage include SEQ IDs: 1, 3, 4, 7, 8, 9, 13, 14, 15, 29, 31, 34, 36, 48, 53, 54, 64, 65, 69, 70, 71, 81, 82, 88, 96, 97, 99, 101, 102, 103, 107, 108, 110, 111, 112, 121, 126, 130, 131, 132, 139, 143, 147, 148, 152, 162, 164, 165, 174, 176, 181, 187, 191, 194, 195, 196, 197, 199, 202, 204, 205, 207, 210, 211, 212, 215, 217, 223, 231, 232, 233, 235, 236, 237, 240, 242, 243, 244, 246, 248, 249, 251, 254, 257, 259, 262, 264, 271, 273, 280, 281, 284, 286, 288, 289, 291, 299, 301, 302, 305, 306, 309, 316, 319, 320, 323, 328, 329, 332, 335, 346, 348, 349, 352, 353, 354, 356, 357, 360, 364, 365, 367, 371, 373, 376, 378, 379, 380, 387, 388, 401, 402, 405, 406, 407, 412, 419, 420, 423, 424, 428, 429, 433, 434, 436, 452, 456, 461, 463, 466, 468, 471, 474, 478, 479, 481, 483, 485, 488, 498, 502, 504, 509, 510, 512, 513, 514, 516, 517, 522, 523, 525, 529, 532, 533, 534, 536, 537, 538, 541, 544, 546, 547, 548, 554, 557, 564, 565, 569, 576, 580, 585, 591, 593, 594, 595, 596, 598, 599, 601, 602, 604, 607, 613, 614, 620, 623, 626, 630, 631, 633, 635, 638, 641, 643, 644, 650, 653, 662, 663, 665, 666, 667, 668, 671, 681, 683, 686, 693, 694, 701, 705, 707, 708, 716, 717, 719, 722, 724, 727, 734, 735, 736, 739, 742, 749, 753, 759, 760, 761, 762, 763, 765, 768, 771, 782, 783, 784, 792, 793, 795, 797, 800, 802, 804, 806, 808, 819, 820, 821, 823, 829, 830, 833, 836, 840, 842, 844, 850, 855, 857, 859, 860, 862, 865, 870, 871, 872, 877, 884, 885, 887, 890, 891, 892, 893, 895, 897, 901, 902, 903, 907, 911, 912, 916, 917, 919, 924, 928, 929, 931, 936, 938, 943, 944, 951, 953, 957, 958, 959, 961, 962, 963, 964, 966, 974, 976, 979, 980, 981, 982, 987, 993, 994, 995, 997, 999, 1003, 1006, 1007, 1009, 1010, 1011, 1014, 1017, 1028, 1032, 1035, 1038, 1039, 1041, 1042, 1043, 1044, 1045, 1047, 1049, 1050, 1051, 1052, 1055, 1056, 1065, 1069, 1072, 1077, 1078, 1085, 1086, 1087, 1088, 1089, 1092, 1095, 1103, 1104, 1108, 1110, 1111, 1112, 1114, 1115, 1117, 1118, 1119, 1120, 1122, 1127, 1130, 1132, 1133, 1136, 1137, 1144, 1146, 1147, 1148, 1154, 1160, 1162, 1166, 1169, 1170, 1176, 1178, 1182, 1189, 1190, 1191, 1196, 1199, 1200, 1204, 1205, 1214, 1217, 1218, 1219, 1223, 1225, 1227, 1228, 1230, 1231, 1233, 1236, 1240, 1241, 1248, 1250, 1252, 1253, 1256, 1257, 1258, 1269, 1272, 1273, 1275, 1277, 1281, 1282, 1285, 1286, 1291, 1292, 1293, 1295, 1297, 1306, 1309, 1312, 1316, 1320, 1325, 1327, 1330, 1331, 1334, 1339, 1346, 1347, 1349, 1351, 1354, 1355, 1360, 1364, 1368, 1371, 1373, 1376, 1377, 1380, 1382, 1386, 1388, 1392, 1396, 1397, 1398, 1403, 1404, 1405, 1407, 1411, 1415, 1421, 1423, 1426, 1431, 1438, 1441, 1442, 1444, 1447, 1451, 1453, 1454, 1455, 1459, 1462, 1466, 1467, 1468, 1471, 1474, 1475, 1481, 1486, 1488, 1490, 1493, 1498, 1499, 1503, 1504, 1514, 1517, 1518, 1525, 1526, 1527, 1539, 1543, 1545, 1546, 1548, 1549, 1550, 1555, 1556, 1560, 1563, 1567, 1571, 1575, 1576, 1578, 1584, 1586, 1590, 1592, 1593, 1594, 1599, 1600, 1602, 1604, 1605, 1608, 1609, 1612, 1614, 1615, 1616, 1622, 1624, 1625, 1634, 1635, 1637, 1638, 1639, 1641, 1648, 1650, 1652, 1658, 1659, 1662, 1663, 1668, 1669, 1671, 1673, 1675, 1676, 1677, 1680, 1683, 1684, 1685, 1688, 1689, 1691, 1698, 1701, 1705, 1706, 1707, 1708, 1710, 1712, 1717, 1719, 1723, 1725, 1726, 1727, 1729, 1731, 1732, 1735, 1740, 1745, 1755, 1758, 1759, 1761, 1764, 1768, 1771, 1776, 1778, 1779, 1785, 1791, 1793, 1807, 1813, 1815, 1816, 1820, 1830, 1832, 1834, 1835, 1836, 1839, 1840, 1845, 1850, 1852, 1859, 1861, 1865, 1867, 1869, 1870, 1872, 1874, 1876, 1883, 1886, 1888, 1897, 1898, 1899, 1900, 1901, 1902, 1905, 1906, 1911, 1918, 1920, 1922, 1923, 1924, 1933, 1934, 1936, 1940, 1944, 1945, 1950, 1952, 1953, 1955, 1973, 1981, 1990, 1991, 1992, 1993, 1994, 1995, 1996, 1999, 2000, 2007, 2008, 2009, 2010, 2012, 2013, 2016, 2017, 2020, 2026, 2031, 2032, 2036, 2039, 2041, 2043, 2048, 2060, 2062, 2064, 2066, 2072, 2074, 2077, 2080, 2081, 2082, 2083, 2089, 2094, 2096, 2097, 2099, 2103, 2104, 2116, 2117, 2119, 2126, 2132, 2133, 2134, 2137, 2140, 2142, 2143, 2144, 2147, 2150, 2152, 2156, 2157, 2159, 2161, 2162, 2163, 2164, 2166, 2170, 2172, 2173, 2177, 2178, 2179, 2185, 2191, 2193, 2196, 2202, 2203, 2205, 2206, 2215, 2216, 2221, 2222, 2225, 2226, 2227, 2229, 2230, 2231, 2235, 2240, 2243, 2244, 2247, 2253, 2257, 2260, 2262, 2263, 2265, 2273, 2274, 2278, 2280, 2282, 2283, 2288, 2291, 2295, 2296, 2298, 2301, 2303, 2304, 2308, 2309, 2314, 2322, 2323, 2328, 2329, 2331, 2339, 2342, 2345, 2348, 2349, 2351, 2352, 2353, 2360, 2363, 2366, 2371, 2379, 2381, 2382, 2384, 2385, 2398, 2401, 2402, 2403, 2405, 2406, 2410, 2411, 2412, 2413, 2418, 2419, 2422, 2423, 2430, 2435, 2437, 2440, 2441, 2442, 2443, 2445, 2451, 2452, 2453, 2455, 2457, 2465, 2466, 2470, 2472, 2474, 2476, 2479, 2481, 2482, 2490, 2492, 2494, 2495, 2496, 2498, 2500, 2504, 2505, 2509, 2510, 2511, 2514, 2517, 2519, 2525, 2528, 2529, 2531, 2532, 2533, 2536, 2537, 2538, 2539, 2541, 2542, 2547, 2548, 2551, 2552, 2554, 2555, 2556, 2557, 2567, 2568, 2573, 2577, 2578, 2581, 2583, 2589, 2590, 2592, 2594, 2601, 2605, 2616, 2617, 2618, 2625, 2626, 2627, 2632, 2634, 2637, 2639, 2641, 2644, 2648, 2650, 2652, 2653, 2655, 2661, 2662, 2663, 2665, 2671, 2674, 2675, 2684, 2685, 2687, 2689, 2691, 2692, 2696, 2700, 2702, 2707, 2711, 2715, 2718, 2719, 2723, 2725, 2726, 2727, 2728, 2729, 2730, 2735, 2740, 2746, 2747, 2749, 2752, 2755, 2756, 2757, 2763, 2764, 2770, 2775, 2780, 2782, 2784, 2785, 2787, 2798, 2800, 2801, 2802, 2805, 2808, 2812, 2820, 2821, 2823, 2824, 2826, 2827, 2828, 2831, 2832, 2840, 2842, 2844, 2850, 2857, 2858, 2861, 2862, 2864, 2865, 2871, 2873, 2876, 2878, 2881, 2888, 2889, 2890, 2893, 2898, 2902, 2903, 2906, 2908, 2909, 2910, 2911, 2912, 2915, 2916, 2917, 2919, 2923, 2924, 2926, 2930, 2931, 2932, 2933, 2934, 2935, 2944, 2945, 2946, 2948, 2953, 2955, 2959, 2963, 2966, 2968, 2972, 2979, 2980, 2985, 2994, 2998, 3000, 3002, 3005, 3007, 3008, 3010, 3014, 3015, 3016, 3023, 3024, 3026, 3027, 3038, 3039, 3042, 3043, 3044, 3048, 3049, 3051, 3052, 3053, 3055, 3064, 3067, 3072, 3075, 3076, 3078, 3080, 3081, 3083, 3084, 3085, 3087, 3090, 3095, 3096, 3100, 3101, 3102, 3105, 3106, 3109, 3114, 3118, 3119, 3120, 3121, 3123, 3126, 3127, 3128, 3129, 3137, 3138, 3139, 3143, 3147, 3153, 3156, 3157, 3158, 3170, 3181, 3185, 3189, 3191, 3192, 3194, 3202, 3204, 3205, 3206, 3210, 3212, 3215, 3218, 3219, 3220, 3224, 3225, 3227, 3228, 3236, 3237, 3239, 3240, 3245, 3247, 3250, 3252, 3255, 3258, 3260, 3261, 3263, 3266, 3271, 3272, 3273, 3278, 3280, 3286, 3288, 3290, 3291, 3294, 3295, 3296, 3297, 3299, 3301, 3303, 3312, 3313, 3324, 3327, 3331, 3332, 3333, 3340, 3343, 3345, 3347, 3349, 3351, 3353, 3355, 3356, 3358, 3359, 3360, 3361, 3363, 3369, 3370, 3377, 3379, 3380, 3383, 3386, 3397, 3399, 3400, 3404, 3405, 3415, 3416, 3418, 3419, 3420, 3422, 3424, 3426, 3428, 3435, 3438, 3441, 3442, 3445, 3446, 3447, 3450, 3451, 3455, 3458, 3460, 3461, 3464, 3465, 3468, 3470, 3471, 3474, 3475, 3477, 3482, 3483, 3486, 3488, 3490, 3491, 3494, 3496, 3503, 3504, 3506, 3510, 3516, 3517, 3518, 3529, 3531, 3533, 3536, 3541, 3544, 3545, 3548, 3549, 3551, 3552, 3554, 3558, 3560, 3562, 3563, 3569, 3572, 3574, 3576, 3577, 3582, 3587, 3588, 3592, 3593, 3594, 3595, 3597, 3599, 3600, 3603, 3606, 3607, 3610, 3611, 3613, 3616, 3618, 3620, 3621, 3623, 3624, 3626, 3627, 3628, 3629, 3630, 3631, 3637, 3640, 3642, 3643, 3644, 3645, 3646, 3647, 3648, 3650, 3655, 3657, 3659, 3660, 3662, 3663, 3667, 3668, 3671, 3672, 3674, 3677, 3682, 3684, 3685, 3693, 3694, 3697, 3704, 3706, 3707, 3713, 3715, 3717, 3718, 3719, 3720, 3724, 3725, 3731, 3732, 3738, 3739, 3748, 3749, 3752, 3754, 3761, 3762, 3764, 3765, 3766, 3775, 3777, 3778, 3781, 3783, 3784, 3788, 3789, 3790, 3791, 3792, 3794, 3798, 3804, 3806, 3808, 3812, 3818, 3820, 3823, 3825, 3828, 3829, 3830, 3831, 3832, 3833, 3836, 3839, 3842, 3843, 3844, 3845, 3849, 3858, 3860, 3862, 3867, 3870, 3871, 3872, 3873, 3876, 3882, 3883, 3887, 3889, 3890, 3892, 3893, 3894, 3895, 3902, 3908, 3910, 3911, 3912, 3914, 3917, 3923, 3924, 3928, 3929, 3934, 3935, 3938, 3947, 3950, 3951, 3952, 3954, 3958, 3962, 3967, 3974, 3975, 3983, 3985, 3987, 3988, 3995, 3997, 4000, 4001, 4002, 4003, 4006, 4008, 4013, 4019, 4020, 4024, 4026, 4030, 4032, 4033, 4034, 4039, 4040, 4046, 4047, 4048, 4049, 4050, 4051, 4052, 4053, 4054, 4056, 4057, 4061, 4062, 4066, 4067, 4068, 4069, 4072, 4075, 4079, 4092, 4096, 4099, 4103, 4105, 4111, 4113, 4115, 4116, 4122, 4124, 4128, 4133, 4139, 4143, 4146, 4148, 4149, 4150, 4155, 4156, 4158, 4160, 4161, 4162, 4163, 4165, 4166, 4167, 4168, 4169, 4170, 4171, 4175, 4178, 4184, 4187, 4188, 4189, 4191, 4197, 4201, 4202, 4205, 4206, 4208, 4210, 4211, 4212, 4214, 4217, 4219, 4221, 4222, 4227, 4228, 4231, 4233, 4235, 4244, 4246, 4250, 4251, 4257, 4258, 4260, 4261, 4263, 4266, 4270, 4272, 4279, 4280, 4281, 4283, 4288, 4294, 4296, 4298, 4301, 4302, 4304, 4309, 4312, 4317, 4320, 4321, 4324, 4329, 4330, 4331, 4333, 4335, 4337, 4338, 4341, 4343, 4344, 4347, 4349, 4352, 4354, 4358, 4360, 4369, 4371, 4373, 4378, 4380, 4383, 4387, 4390, 4391, 4394, 4397, 4401, 4402, 4403, 4404, 4405, 4410, 4415, 4422, 4423, 4439, 4443, 4444, 4446, 4448, 4450, 4453, 4456, 4458, 4460, 4461, 4462, 4463, 4464, 4465, 4466, 4468, 4472, 4474, 4475, 4479, 4491, 4492, 4494, 4502, 4506, 4507, 4512, 4515, 4516, 4518, 4519, 4524, 4531, 4534, 4535, 4543, 4545, 4548, 4549, 4551, 4554, 4555, 4556, 4557, 4558, 4560, 4562, 4565, 4566, 4568, 4570, 4575, 4580, 4582, 4583, 4584, 4586, 4590, 4591, 4596, 4601, 4604, 4606, 4621, 4625, 4630, 4632, 4633, 4634, 4635, 4641, 4643, 4644, 4650, 4653, 4654, 4655, 4659, 4666, 4667, 4669, 4670, 4671, 4672, 4677, 4680, 4682, 4685, 4687, 4697, 4699, 4700, 4704, 4705, 4706, 4708, 4710, 4719, 4721, 4725, 4729, 4732, 4737, 4738, 4740, 4747, 4749, 4750, 4751, 4753, 4754, 4755, 4756, 4759, 4761, 4762, 4765, 4766, 4767, 4771, 4775, 4778, 4779, 4789, 4790, 4791, 4794, 4795, 4804, 4809, 4813, 4814, 4815, 4817, 4818, 4822, 4823, 4824, 4828, 4829, 4832, 4834, 4835, 4838, 4842, 4856, 4857, 4859, 4861, 4862, 4864, 4868, 4869, 4870, 4872, 4875, 4878, 4880, 4881, 4887, 4889, 4891, 4895, 4901, 4902, 4905, 4909, 4913, 4914, 4918, 4920, 4921, 4923, 4924, 4925, 4926, 4935, 4936, 4938, 4940, 4941, 4943, 4950, 4955, 4971, 4972, 4973, 4975, 4977, 4984, 4986, 4987, 4988, 4992, 4993, 4994, 4996, 5000, 5005, 5010, 5011, 5015, 5026, 5029, 5030, 5034, 5038, 5039, 5040, 5042, 5044, 5046, 5052, 5054, 5057, 5063, 5067, 5068, 5072, 5075, 5078, 5079, 5082, 5086, 5088, 5089, 5090, 5091, 5094, 5100, 5102, 5111, 5122, 5123, 5129, 5131, 5132, 5140, 5145, 5164, 5165, 5168, 5170, 5173, 5174, 5180, 5181, 5182, 5184, 5185, 5188, 5189, 5190, 5191, 5192, 5196, 5198, 5199, 5200, 5201, 5206, 5208, 5212, 5214, 5217, 5219, 5225, 5226, 5229, 5234, 5240, 5241, 5243, 5249, 5253, 5255, 5258, 5261, 5263, 5264, 5267, 5268, 5273, 5275, 5276, 5280, 5281, 5283, 5286, 5289, 5292, 5293, 5298, 5299, 5300, 5301, 5303, 5308, 5311, 5317, 5319, 5321, 5324, 5327, 5329, 5330, 5334, 5342, 5344, 5346, 5348, 5351, 5359, 5361, 5372, 5382, 5383, 5386, 5388, 5389, 5393, 5394, 5395, 5397, 5403, 5407, 5409, 5411, 5413, 5414, 5417, 5426, 5430, 5431, 5434, 5448, 5449, 5452, 5456, 5457, 5459, 5463, 5464, 5466, 5467, 5469, 5472, 5474, 5476, 5477, 5479, 5482, 5483, 5485, 5493, 5496, 5498, 5506, 5508, 5509, 5510, 5513, 5515, 5516, 5517, 5518, 5519, 5524, 5526, 5529, 5530, 5534, 5535, 5537, 5541, 5543, 5557, 5562, 5563, 5568, 5569, 5571, 5579, 5585, 5588, 5589, 5591, 5592, 5597, 5604, 5612, 5613, 5615, 5616, 5618, 5619, 5620, 5627, 5631, 5632, 5635, 5638, 5640, 5642, 5643, 5647, 5648, 5649, 5650, 5651, 5652, 5659, 5660, 5662, 5663, 5664, 5665, 5674, 5675, 5676, 5677, 5683, 5689, 5690, 5694, 5695, 5697, 5698, 5702, 5703, 5706, 5709, 5711, 5717, 5718, 5721, 5722, 5731, 5734, 5735, 5744, 5751, 5752, 5753, 5754, 5756, 5763, 5768, 5770, 5771, 5775, 5779, 5780, 5784, 5785, 5788, 5791, 5794, 5803, 5806, 5807, 5808, 5809, 5810, 5813, 5814, 5815, 5817, 5820, 5826, 5828, 5833, 5835, 5836, 5837, 5839, 5846, 5850, 5852, 5853, 5854, 5859, 5861, 5864, 5865, 5866, 5867, 5869, 5870, 5872, 5876, 5878, 5879, 5881, 5883, 5884, 5886, 5887, 5888, 5892, 5893, 5907, 5912, 5922, 5923, 5925, 5926, 5927, 5928, 5932, 5934, 5938, 5939, 5941, 5944, 5948, 5954, 5956, 5959, 5967, 5968, 5975, 5978, 5979, 5980, 5982, 5987, 5988, 5991, 5994, 5996, 6000, 6002, 6004, 6006, 6009, 6013, 6017, 6018, 6023, 6024, 6025, 6026, 6038, 6041, 6043, 6044, 6048, 6051, 6058, 6059, 6062, 6065, 6068, 6069, 6070, 6072, 6073, 6075, 6081, 6084, 6085, 6086, 6087, 6088, 6089, 6090, 6092, 6093, 6097, 6098, 6099, 6107, 6108, 6109, 6110, 6113, 6116, 6119, 6120, 6124, 6129, 6131, 6132, 6133, 6136, 6137, 6138, 6139, 6143, 6145, 6146, 6147, 6148, 6149, 6151, 6153, 6160, 6162, 6163, 6164, 6165, 6181, 6183, 6184, 6186, 6188, 6189, 6193, 6194, 6195, 6196, 6198, 6204, 6205, 6209, 6220, 6223, 6224, 6227, 6228, 6233, 6234, 6237, 6239, 6242, 6243, 6246, 6247, 6250, 6251, 6264, 6265, 6267, 6270, 6272, 6273, 6275, 6281, 6282, 6286, 6292, 6293, 6295, 6297, 6299, 6300, 6303, 6309, 6311, 6315, 6317, 6322, 6323, 6328, 6333, 6338, 6343, 6344, 6353, 6354, 6356, 6360, 6365, 6367, 6370, 6372, 6375, 6376, 6383, 6386, 6394, 6397, 6399, 6403, 6405, 6408, 6412, 6414, 6415, 6416, 6417, 6419, 6420, 6422, 6425, 6426, 6427, 6428, 6429, 6430, 6431, 6436, 6440, 6449, 6456, 6463, 6464, 6466, 6467, 6470, 6472, 6474, 6475, 6476, 6477, 6478, 6480, 6482, 6484, 6485, 6488, 6494, 6501, 6504, 6510, 6512, 6513, 6516, 6517, 6519, 6526, 6528, 6530, 6531, 6532, 6534, 6537, 6543, 6547, 6549, 6553, 6555, 6558, 6559, 6564, 6567, 6569, 6571, 6574, 6576, 6577, 6579, 6581, 6584, 6588, 6589, 6592, 6594, 6595, 6597, 6599, 6600, 6603, 6606, 6607, 6609, 6610, 6615, 6616, 6617, 6620, 6623, 6625, 6628, 6629, 6633, 6634, 6635, 6639, 6640, 6642, 6644, 6646, 6647, 6648, 6649, 6655, 6656, 6658, 6661, 6666, 6670, 6671, 6672, 6681, 6690, 6693, 6703, 6704, 6705, 6706, 6716, 6718, 6720, 6729, 6730, 6734, 6736, 6737, 6739, 6742, 6747, 6749, 6756, 6757, 6759, 6764, 6766, 6767, 6777, 6779, 6782, 6783, 6792, 6793, 6794, 6795, 6797, 6799, 6803, 6804, 6805, 6807, 6810, 6811, 6813, 6815, 6816, 6817, 6819, 6820, 6821, 6824, 6826, 6827, 6828, 6830, 6831, 6834, 6836, 6841, 6843, 6848, 6851, 6863, 6869, 6875, 6877, 6878, 6884, 6886, 6887, 6891, 6894, 6902, 6903, 6904, 6906, 6909, 6913, 6914, 6917, 6919, 6920, 6921, 6924, 6925, 6930, 6936, 6939, 6946, 6954, 6955, 6959, 6960, 6963, 6967, 6970, 6971, 6979, 6980, 6981, 6984, 6985, 6987, 6988, 6990, 6994, 6997, 6999, 7009, 7013, 7018, 7022, 7029, 7038, 7039, 7040, 7043, 7045, 7046, 7049, 7051, 7052, 7053, 7054, 7057, 7067, 7073, 7077, 7079, 7083, 7084, 7094, 7096, 7105, 7106, 7107, 7108, 7110, 7117, 7118, 7122, 7126, 7129, 7130, 7138, 7139, 7142, 7143, 7144, 7150, 7151, 7154, 7163, 7164, 7165, 7166, 7169, 7171, 7172, 7176, 7182, 7184, 7192, 7194, 7195, 7196, 7197, 7198, 7201, 7202, 7206, 7207, 7208, 7209, 7210, 7212, 7217, 7219, 7220, 7224, 7227, 7228, 7230, 7231, 7234, 7235, 7236, 7244, 7245, 7246, 7249, 7250, 7252, 7255, 7257, 7258, 7262, 7263, 7264, 7267, 7268, 7270, 7274, 7276, 7281, 7282, 7287, 7291, 7292, 7293, 7296, 7299, 7300, 7301, 7303, 7304, 7306, 7307, 7311, 7312, 7313, 7318, 7320, 7323, 7328, 7331, 7340, 7344, 7345, 7350, 7351, 7356, 7357, 7358, 7361, 7365, 7369, 7371, 7376, 7377, 7380, 7382, 7383, 7386, 7392, 7398, 7400, 7406, 7410, 7411, 7417, 7418, 7425, 7430, 7434, 7435, 7436, 7438, 7441, 7447, 7448, 7450, 7452, 7453, 7454, 7457, 7458, 7466, 7467, 7470, 7472, 7475, 7483, 7486, 7490, 7492, 7493, 7499, 7502, 7503, 7504, 7506, 7512, 7514, 7515, 7521, 7522, 7523, 7524, 7525, 7533, 7546, 7561, 7572, 7574, 7576, 7579, 7583, 7585, 7586, 7589, 7594, 7596, 7599, 7604, 7605, 7609, 7612, 7619, 7622, 7624, 7625, 7633, 7638, 7640, 7642, 7643, 7647, 7649, 7652, 7655, 7658, 7661, 7662, 7664, 7665, 7671, 7674, 7678, 7679, 7680, 7682, 7686, 7687, 7689, 7695, 7700, 7703, 7712, 7715, 7716, 7724, 7726, 7727, 7730, 7736, 7737, 7738, 7741, 7742, 7744, 7745, 7749, 7750, 7753, 7763, 7764, 7768, 7770, 7772, 7774, 7775, 7779, 7781, 7786, 7788, 7791, 7793, 7798, 7799, 7800, 7801, 7803, 7804, 7806, 7807, 7818, 7819, 7820, 7822, 7823, 7825, 7826, 7833, 7834, 7839, 7841, 7844, 7845, 7850, 7854, 7856, 7860, 7865, 7873, 7877, 7878, 7880, 7881, 7887, 7888, 7890, 7896, 7910, 7911, 7918, 7923, 7925, 7928, 7934, 7935, 7936, 7938, 7942, 7944, 7949, 7952, 7965, 7966, 7967, 7974, 7976, 7977, 7984, 7986, 7996, 7999, 8006, 8007, 8012, 8020, 8021, 8024, 8026, 8030, 8031, 8036, 8041, 8042, 8044, 8048, 8053, 8056, 8059, 8061, 8063, 8068, 8072, 8076, 8077, 8078, 8079, 8080, 8081, 8083, 8084, 8088, 8090, 8091, 8093, 8095, 8100, 8102, 8106, 8110, 8112, 8113, 8118, 8121, 8126, 8129, 8130, 8141, 8145, 8147, 8148, 8150, 8155, 8163, 8170, 8178, 8179, 8181, 8189, 8193, 8194, 8202, 8204, 8208, 8210, 8213, 8217, 8219, 8220, 8223, 8227, 8230, 8234, 8235, 8237, 8239, 8241, 8242, 8248, 8250, 8252, 8253, 8263, 8264, 8265, 8266, 8268, 8269, 8270, 8272, 8273, 8274, 8282, 8289, 8291, 8292, 8300, 8302, 8304, 8308, 8310, 8311, 8315, 8318, 8319, 8322, 8323, 8329, 8339, 8340, 8347, 8350, 8351, 8353, 8358, 8367, 8368, 8371, 8373, 8378, 8379, 8380, 8385, 8387, 8389, 8392, 8393, 8395, 8396, 8401, 8402, 8403, 8404, 8406, 8408, 8410, 8413, 8414, 8415, 8416, 8417, 8418, 8430, 8436, 8438, 8439, 8440, 8443, 8444, 8445, 8447, 8448, 8449, 8450, 8451, 8457, 8458, 8459, 8465, 8470, 8472, 8473, 8474, 8476, 8477, 8481, 8482, 8486, 8490, 8498, 8501, 8502, 8503, 8505, 8507, 8509, 8513, 8515, 8516, 8520, 8521, 8523, 8524, 8525, 8526, 8527, 8528, 8532, 8533, 8539, 8541, 8542, 8543, 8553, 8554, 8561, 8562, 8565, 8566, 8574, 8575, 8576, 8579, 8581, 8582, 8592, 8594, 8596, 8597, 8598, 8600, 8601, 8603, 8605, 8609, 8612, 8622, 8631, 8634, 8635, 8638, 8639, 8641, 8642, 8644, 8646, 8648, 8650, 8658, 8659, 8663, 8665, 8669, 8672, 8676, 8677, 8685, 8686, 8689, 8690, 8693, 8695, 8699, 8700, 8703, 8705, 8706, 8708, 8709, 8713, 8717, 8720, 8722, 8726, 8729, 8731, 8736, 8741, 8746, 8748, 8755, 8759, 8761, 8769, 8770, 8773, 8777, 8779, 8783, 8784, 8785, 8786, 8789, 8792, 8795, 8802, 8803, 8808, 8810, 8818, 8821, 8822, 8824, 8828, 8829, 8830, 8831, 8835, 8836, 8841, 8843, 8846, 8853, 8865, 8866, 8874, 8875, 8876, 8877, 8878, 8881, 8888, 8889, 8892, 8896, 8900, 8901, 8907, 8908, 8911, 8916, 8917, 8919, 8922, 8924, 8926, 8929, 8930, 8935, 8937, 8938, 8941, 8945, 8946, 8951, 8953, 8960, 8961, 8967, 8968, 8971, 8979, 8980, 8981, 8985, 8986, 8991, 8992, 8996, 8998, 9001, 9006, 9009, 9011, 9012, 9013, 9018, 9022, 9026, 9027, 9029, 9030, 9045, 9050, 9052, 9056, 9058, 9059, 9060, 9063, 9065, 9068, 9069, 9071, 9072, 9076, 9084, 9086, 9088, 9091, 9092, 9095, 9096, 9103, 9104, 9105, 9106, 9107, 9112, 9114, 9116, 9118, 9125, 9129, 9131, 9133, 9134, 9139, 9140, 9141, 9142, 9144, 9145, 9152, 9154, 9155, 9159, 9167, 9168, 9175, 9177, 9179, 9180, 9185, 9188, 9190, 9191, 9194, 9195, 9205, 9206, 9207, 9210, 9211, 9213, 9215, 9216, 9220, 9223, 9226, 9229, 9231, 9233, 9237, 9243, 9244, 9246, 9248, 9249, 9253, 9257, 9262, 9265, 9267, 9269, 9270, 9273, 9275, 9282, 9284, 9285, 9287, 9288, 9290, 9292, 9295, 9300, 9306, 9308, 9311, 9313, 9320, 9321, 9323, 9326, 9328, 9332, 9336, 9339, 9346, 9347, 9350, 9352, 9353, 9359, 9360, 9366, 9371, 9373, 9375, 9376, 9382, 9391, 9392, 9394, 9399, 9400, 9402, 9403, 9404, 9406, 9407, 9413, 9414, 9415, 9421, 9423, 9425, 9429, 9434, 9439, 9440, 9443, 9449, 9451, 9453, 9456, 9460, 9467, 9468, 9471, 9472, 9473, 9474, 9476, 9481, 9484, 9488, 9490, 9497, 9500, 9503, 9504, 9509, 9514, 9517, 9518, 9520, 9534, 9536, 9537, 9538, 9540, 9545, 9546, 9550, 9551, 9553, 9555, 9560, 9564, 9567, 9571, 9573, 9577, 9581, 9586, 9587, 9590, 9591, 9595, 9596, 9597, 9598, 9601, 9602, 9606, 9609, 9614, 9615, 9617, 9618, 9620, 9621, 9623, 9624, 9626, 9629, 9630, 9632, 9640, 9649, 9652, 9653, 9655, 9657, 9658, 9663, 9666, 9668, 9670, 9679, 9686, 9688, 9698, 9701, 9706, 9710, 9711, 9715, 9718, 9721, 9723, 9724, 9726, 9727, 9729, 9730, 9731, 9732, 9733, 9734, 9737, 9742, 9744, 9745, 9746, 9750, 9754, 9763, 9764, 9770, 9772, 9774, 9776, 9777, 9782, 9786, 9787, 9791, 9794, 9798, 9799, 9804, 9808, 9810, 9811, 9812, 9813, 9816, 9819, 9820, 9827, 9828, 9829, 9830, 9833, 9835, 9845, 9847, 9866, 9869, 9873, 9875, 9878, 9879, 9882, 9886, 9887, 9889, 9891, 9892, 9900, 9907, 9909, 9910, 9911, 9912, 9923, 9924, 9928, 9932, 9934, 9935, 9938, 9940, 9946, 9949, 9950, 9952, 9953, 9960, 9962, 9963, 9967, 9968, 9973, 9974, 9975, 9976, 9979, 9980, 9982, 9984, 9985, 9987, 9988, 9990, 9991, 9992, 9997, 10000, 10008, 10013, 10015, 10017, 10018, 10019, 10020, 10026, 10027, 10032, 10033, 10034, 10035, 10037, 10041, 10044, 10049, 10051, 10052, 10053, 10054, 10055, 10058, 10059, 10060, 10062, 10064, 10072, 10073, 10075, 10077, 10078, 10080, 10081, 10083, 10091, 10092, 10095, 10097, 10101, 10103, 10106, 10110, 10115, 10116, 10122, 10128, 10129, 10130, 10131, 10136, 10138, 10143, 10151, 10158, 10160, 10163, 10165, 10166, 10168, 10174, 10176, 10178, 10181, 10184, 10192, 10193, 10194, 10195, 10196, 10199, 10206, 10212, 10218, 10219, 10220, 10221, 10222, 10223, 10224, 10225, 10231, 10233, 10234, 10236, 10237, 10239, 10240, 10247, 10249, 10252, 10253, 10254, 10259, 10262, 10269, 10270, 10275, 10276, 10278, 10284, 10286, 10291, 10292, 10295, 10300, 10302, 10306, 10307, 10311, 10312, 10314, 10318, 10319, 10323, 10324, 10325, 10326, 10331, 10333, 10334, 10335, 10336, 10340, 10341, 10346, 10353, 10356, 10357, 10364, 10371, 10375, 10376, 10378, 10380, 10385, 10388, 10393, 10397, 10398, 10399, 10401, 10410, 10411, 10413, 10414, 10416, 10417, 10419, 10421, 10423, 10424, 10425, 10426, 10435, 10436, 10438, 10440, 10446, 10448, 10449, 10451, 10452, 10453, 10456, 10460, 10463, 10464, 10465, 10466, 10468, 10469, 10471, 10474, 10480, 10482, 10487, 10490, 10494, 10496, 10506, 10508, 10514, 10518, 10523, 10527, 10528, 10530, 10531, 10532, 10536, 10537, 10541, 10542, 10543, 10544, 10548, 10560, 10563, 10564, 10567, 10569, 10573, 10580, 10581, 10583, 10584, 10588, 10593, 10596, 10599, 10601, 10602, 10603, 10604, 10608, 10611, 10613, 10615, 10616, 10617, 10621, 10622, 10636, 10637, 10638, 10639, 10640, 10645, 10646, 10652, 10655, 10665, 10668, 10670, 10676, 10678, 10679, 10682, 10683, 10684, 10685, 10700, 10701, 10705, 10707, 10711, 10715, 10716, 10721, 10722, 10726, 10729, 10732, 10734, 10738, 10740, 10741, 10744, 10747, 10748, 10749, 10752, 10753, 10754, 10756, 10761, 10762, 10766, 10769, 10770, 10775, 10778, 10779, 10785, 10787, 10788, 10790, 10792, 10795, 10801, 10802, 10803, 10804, 10805, 10809, 10810, 10811, 10812, 10815, 10818, 10819, 10822, 10823, 10824, 10827, 10831, 10836, 10838, 10839, 10843, 10850, 10851, 10852, 10853, 10854, 10857, 10858, 10860, 10866, 10867, 10877, 10880, 10881, 10886, 10887, 10897, 10898, 10899, 10901, 10902, 10910, 10917, 10918, 10920, 10924, 10926, 10927, 10928, 10929, 10930, 10933, 10934, 10938, 10940, 10941, 10945, 10947, 10960, 10962, 10965, 10967, 10972, 10976, 10977, 10979, 10988, 10993, 10996, 10999, 11008, 11015, 11017, 11021, 11022, 11023, 11024, 11027, 11030, 11032, 11033, 11036, 11037, 11039, 11040, 11044, 11046, 11047, 11052, 11053, 11056, 11058, 11060, 11063, 11066, 11067, 11078, 11081, 11082, 11083, 11090, 11095, 11098, 11100, 11101, 11107, 11114, 11118, 11122, 11124, 11129, 11133, 11135, 11136, 11137, 11138, 11145, 11151, 11153, 11154, 11160, 11162, 11163, 11165, 11168, 11169, 11173, 11177, 11178, 11181, 11184, 11187, 11188, 11190, 11192, 11193, 11194, 11198, 11203, 11204, 11208, 11213, 11214, 11216, 11217, 11218, 11222, 11224, 11226, 11227, 11228, 11230, 11231, 11233, 11235, 11236, 11238, 11239, 11242, 11243, 11246, 11247, 11253, 11254, 11255, 11256, 11258, 11260, 11262, 11263, 11266, 11290, 11292, 11293, 11295, 11297, 11298, 11299, 11302, 11304, 11305, 11306, 11313, 11315, 11318, 11321, 11330, 11331, 11337, 11338, 11340, 11345, 11346, 11348, 11349, 11358, 11362, 11363, 11364, 11365, 11371, 11373, 11377, 11380, 11382, 11385, 11387, 11388, 11391, 11394, 11395, 11401, 11404, 11405, 11406, 11424, 11430, 11431, 11435, 11436, 11438, 11439, 11440, 11443, 11446, 11447, 11449, 11451, 11456, 11459, 11461, 11465, 11466, 11478, 11485, 11487, 11489, 11490, 11491, 11496, 11497, 11498, 11499, 11500, 11505, 11507, 11513, 11520, 11523, 11524, 11526, 11527, 11528, 11531, 11532, 11533, 11535, 11540, 11541, 11544, 11548, 11551, 11553, 11558, 11560, 11561, 11567, 11568, 11570, 11576, 11577, 11578, 11585, 11586, 11588, 11593, 11594, 11595, 11596, 11597, 11599, 11603, 11604, 11607, 11611, 11612, 11617, 11618, 11623, 11628, 11634, 11639, 11640, 11647, 11650, 11656, 11658, 11659, 11663, 11673, 11677, 11678, 11681, 11682, 11688, 11691, 11692, 11694, 11695, 11696, 11699, 11701, 11703, 11705, 11707, 11712, 11718, 11721, 11725, 11726, 11730, 11731, 11732, 11733, 11736, 11737, 11740, 11743, 11744, 11753, 11756, 11759, 11760, 11763, 11765, 11770, 11771, 11776, 11777, 11781, 11785, 11786, 11788, 11792, 11794, 11799, 11800, 11802, 11805, 11809, 11810, 11811, 11814, 11818, 11820, 11821, 11826, 11830, 11840, 11841, 11846, 11848, 11851, 11856, 11858, 11861, 11864, 11865, 11868, 11870, 11872, 11876, 11877, 11881, 11886, 11889, 11891, 11892, 11894, 11898, 11899, 11901, 11906, 11909, 11911, 11913, 11916, 11917, 11919, 11920, 11921, 11923, 11926, 11927, 11928, 11929, 11930, 11934, 11940, 11943, 11945, 11947, 11948, 11949, 11953, 11956, 11957, 11958, 11959, 11960, 11961, 11962, 11963, 11965, 11968, 11973, 11974, 11975, 11976, 11977, 11978, 11979, 11980, 11983, 11988, 11989, 11993, 11997, 11998, 11999, 12004, 12008, 12014, 12017, 12019, 12020, 12021, 12023, 12024, 12026, 12032, 12033, 12043, 12044, 12059, 12068, 12080, 12081, 12083, 12091, 12092, 12093, 12095, 12098, 12102, 12104, 12106, 12109, 12110, 12112, 12114, 12115, 12118, 12122, 12126, 12128, 12129, 12130, 12134, 12137, 12138, 12139, 12141, 12143, 12145, 12146, 12147, 12149, 12151, 12161, 12166, 12170, 12171, 12174, 12175, 12176, 12181, 12183, 12185, 12197, 12200, 12201, 12204, 12207, 12208, 12217, 12218, 12219, 12220, 12221, 12227, 12234, 12240, 12243, 12245, 12249, 12250, 12252, 12253, 12256, 12259, 12260, 12263, 12267, 12268, 12269, 12274, 12278, 12283, 12284, 12286, 12287, 12291, 12293, 12295, 12304, 12311, 12312, 12313, 12314, 12315, 12317, 12321, 12323, 12324, 12326, 12329, 12331, 12333, 12334, 12347, 12354, 12356, 12358, 12359, 12364, 12367, 12368, 12369, 12370, 12372, 12374, 12379, 12380, 12381, 12385, 12391, 12396, 12397, 12400, 12403, 12404, 12406, 12410, 12411, 12414, 12416, 12419, 12420, 12421, 12424, 12426, 12427, 12437, 12439, 12440, 12441, 12445, 12447, 12451, 12454, 12455, 12456, 12457, 12459, 12462, 12467, 12468, 12470, 12472, 12478, 12479, 12481, 12487, 12488, 12489, 12491, 12495, 12497, 12499, 12504, 12505, 12508, 12510, 12511, 12521, 12530, 12536, 12545, 12546, 12547, 12549, 12555, 12559, 12561, 12563, 12564, 12565, 12567, 12568, 12572, 12585, 12588, 12597, 12605, 12606, 12608, 12609, 12611, 12616, 12619, 12623, 12626, 12633, 12634, 12636, 12638, 12639, 12641, 12649, 12651, 12663, 12668, 12670, 12671, 12672, 12674, 12679, 12680, 12681, 12682, 12683, 12684, 12685, 12691, 12695, 12698, 12699, 12701, 12702, 12713, 12714, 12715, 12718, 12719, 12722, 12731, 12732, 12733, 12737, 12738, 12739, 12741, 12742, 12743, 12748, 12754, 12755, 12758, 12760, 12761, 12762, 12764, 12766, 12771, 12772, 12773, 12778, 12783, 12790, 12794, 12797, 12800, 12801, 12802, 12805, 12810, 12812, 12813, 12817, 12819, 12820, 12822, 12824, 12826, 12827, 12828, 12834, 12836, 12838, 12839, 12843, 12844, 12847, 12849, 12850, 12858, 12861, 12866, 12882, 12883, 12887, 12888, 12895, 12898, 12900, 12902, 12904, 12905, 12906, 12910, 12912, 12913, 12914, 12916, 12917, 12918, 12920, 12921, 12926, 12929, 12932, 12938, 12939, 12940, 12941, 12942, 12944, 12945, 12946, 12947, 12966, 12968, 12969, 12972, 12973, 12978, 12982, 12983, 12984, 12987, 12990, 12991, 12996, 13006, 13007, 13010, 13011, 13014, 13015, 13017, 13018, 13022, 13023, 13030, 13032, 13033, 13035, 13038, 13040, 13041, 13049, 13050, 13053, 13054, 13055, 13056, 13060, 13061, 13066, 13067, 13071, 13074, 13075, 13077, 13079, 13085, 13086, 13087, 13095, 13100, 13101, 13102, 13105, 13106, 13112, 13114, 13115, 13116, 13117, 13118, 13120, 13123, 13124, 13131, 13135, 13142, 13148, 13149, 13151, 13152, 13153, 13156, 13160, 13169, 13174, 13175, 13181, 13182, 13185, 13188, 13197, 13199, 13206, 13209, 13210, 13212, 13213, 13215, 13217, 13221, 13222, 13224, 13227, 13230, 13232, 13234, 13235, 13236, 13237, 13238, 13240, 13243, 13249, 13251, 13255, 13259, 13260, 13261, 13263, 13264, 13268, 13269, 13270, 13276, 13280, 13281, 13285, 13291, 13293, 13296, 13297, 13298, 13301, 13303, 13304, 13315, 13317, 13318, 13319, 13320, 13321, 13323, 13325, 13326, 13328, 13330, 13332, 13337, 13338, 13343, 13346, 13348, 13353, 13354, 13361, 13369, 13370, 13373, 13377, 13380, 13381, 13384, 13385, 13388, 13391, 13393, 13394, 13396, 13397, 13401, 13402, 13408, 13410, 13416, 13417, 13419, 13423, 13424, 13429, 13430, 13433, 13439, 13448, 13449, 13451, 13454, 13456, 13460, 13463, 13466, 13468, 13469, 13472, 13473, 13475, 13490, 13492, 13494, 13496, 13498, 13499, 13500, 13503, 13504, 13505, 13506, 13510, 13513, 13514, 13515, 13516, 13517, 13519, 13520, 13521, 13530, 13532, 13540, 13543, 13544, 13545, 13546, 13547, 13549, 13552, 13556, 13568, 13569, 13574, 13580, 13582, 13583, 13584, 13589, 13597, 13601, 13602, 13603, 13604, 13612, 13621, 13623, 13631, 13632, 13634, 13635, 13636, 13637, 13641, 13647, 13650, 13652, 13654, 13660, 13661, 13662, 13663, 13668, 13671, 13675, 13677, 13684, 13687, 13688, 13691, 13695, 13697, 13698, 13700, 13702, 13703, 13706, 13710, 13713, 13715, 13716, 13720, 13721, 13725, 13727, 13728, 13729, 13730, 13739, 13745, 13747, 13748, 13750, 13756, 13758, 13764, 13766, 13767, 13769, 13772, 13773, 13775, 13776, 13779, 13781, 13782, 13789, 13791, 13793, 13794, 13796, 13798, 13809, 13816, 13817, 13818, 13819, 13820, 13822, 13823, 13828, 13830, 13831, 13833, 13834, 13835, 13843, 13849, 13852, 13853, 13859, 13860, 13862, 13866, 13869, 13870, 13872, 13873, 13874, 13875, 13877, 13881, 13882, 13883, 13888, 13891, 13892, 13894, 13896, 13897, 13898, 13901, 13904, 13906, 13909, 13910, 13911, 13917, 13919, 13921, 13925, 13927, 13930, 13933, 13938, 13944, 13947, 13948, 13949, 13952, 13954, 13956, 13962, 13963, 13965, 13969, 13970, 13975, 13976, 13981, 13983, 13984, 13990, 13992, 13999, 14000, 14008, 14009, 14010, 14013, 14014, 14017, 14018, 14022, 14026, 14027, 14030, 14031, 14036, 14041, 14043, 14049, 14050, 14051, 14052, 14062, 14063, 14066, 14069, 14070, 14071, 14073, 14075, 14086, 14088, 14092, 14093, 14094, 14096, 14100, 14105, 14106, 14110, 14112, 14116, 14118, 14119, 14120, 14122, 14124, 14125, 14128, 14129, 14132, 14134, 14135, 14138, 14139, 14142, 14143, 14145, 14148, 14149, 14150.

Promoters expressing in root tissue at the emergence stage include SEQ IDs: 1, 3, 4, 7, 11, 12, 13, 14, 15, 27, 29, 31, 34, 36, 48, 54, 63, 64, 65, 69, 70, 71, 81, 82, 88, 96, 97, 99, 101, 102, 103, 107, 108, 110, 112, 117, 121, 126, 130, 131, 132, 139, 143, 147, 148, 152, 153, 162, 164, 174, 176, 177, 179, 181, 187, 194, 195, 196, 197, 199, 204, 205, 207, 210, 211, 212, 215, 217, 223, 231, 232, 233, 235, 236, 237, 240, 242, 243, 244, 246, 248, 249, 250, 251, 254, 257, 259, 262, 264, 271, 273, 274, 280, 281, 286, 288, 289, 291, 299, 305, 306, 309, 316, 319, 320, 323, 328, 329, 332, 335, 341, 346, 349, 352, 353, 354, 356, 357, 360, 364, 365, 367, 371, 376, 378, 379, 387, 388, 389, 396, 401, 402, 405, 406, 407, 412, 419, 420, 423, 424, 427, 428, 429, 433, 434, 436, 452, 454, 456, 460, 461, 466, 468, 471, 474, 478, 479, 483, 485, 488, 498, 502, 504, 509, 510, 513, 516, 517, 520, 522, 523, 525, 529, 532, 533, 534, 536, 537, 541, 544, 546, 547, 554, 557, 560, 564, 565, 578, 585, 591, 593, 594, 595, 596, 598, 599, 601, 602, 604, 605, 607, 608, 611, 613, 614, 619, 620, 623, 626, 630, 631, 633, 635, 638, 641, 643, 644, 650, 653, 662, 663, 665, 666, 671, 683, 686, 694, 701, 705, 707, 708, 716, 717, 719, 722, 724, 727, 734, 735, 736, 739, 742, 744, 749, 753, 759, 760, 761, 762, 763, 765, 768, 770, 771, 782, 783, 784, 785, 792, 793, 795, 800, 802, 804, 806, 808, 819, 820, 821, 822, 823, 829, 830, 833, 836, 840, 841, 842, 844, 849, 850, 855, 857, 859, 860, 862, 865, 868, 870, 871, 872, 877, 878, 883, 884, 885, 887, 890, 891, 892, 893, 895, 897, 903, 907, 911, 912, 915, 916, 917, 924, 928, 929, 931, 936, 938, 944, 951, 953, 958, 959, 961, 962, 963, 964, 966, 974, 976, 979, 980, 982, 987, 991, 993, 994, 995, 997, 999, 1003, 1006, 1007, 1008, 1009, 1010, 1011, 1014, 1028, 1032, 1035, 1038, 1039, 1042, 1043, 1045, 1047, 1049, 1050, 1051, 1052, 1054, 1055, 1056, 1064, 1065, 1069, 1070, 1073, 1077, 1078, 1085, 1086, 1087, 1088, 1089, 1092, 1095, 1101, 1103, 1104, 1108, 1110, 1112, 1114, 1115, 1117, 1118, 1119, 1120, 1122, 1127, 1130, 1132, 1133, 1136, 1137, 1144, 1146, 1147, 1148, 1154, 1160, 1162, 1166, 1170, 1176, 1178, 1182, 1188, 1189, 1190, 1191, 1193, 1196, 1199, 1200, 1201, 1202, 1204, 1213, 1214, 1218, 1223, 1225, 1227, 1228, 1230, 1231, 1233, 1236, 1240, 1241, 1248, 1250, 1252, 1253, 1254, 1256, 1258, 1261, 1269, 1272, 1273, 1277, 1281, 1282, 1285, 1286, 1291, 1293, 1295, 1297, 1306, 1309, 1316, 1320, 1327, 1330, 1331, 1349, 1351, 1354, 1355, 1360, 1364, 1368, 1373, 1376, 1377, 1380, 1382, 1388, 1392, 1393, 1396, 1398, 1399, 1403, 1404, 1407, 1415, 1421, 1423, 1426, 1431, 1432, 1438, 1441, 1442, 1444, 1451, 1453, 1454, 1455, 1459, 1462, 1466, 1467, 1468, 1474, 1475, 1481, 1486, 1487, 1488, 1490, 1493, 1496, 1498, 1499, 1503, 1504, 1508, 1510, 1511, 1514, 1517, 1518, 1520, 1525, 1526, 1527, 1539, 1543, 1545, 1546, 1548, 1549, 1550, 1555, 1556, 1560, 1563, 1567, 1571, 1575, 1576, 1578, 1584, 1586, 1590, 1592, 1593, 1594, 1595, 1599, 1600, 1602, 1604, 1605, 1608, 1609, 1612, 1614, 1615, 1616, 1622, 1624, 1625, 1634, 1635, 1637, 1638, 1641, 1650, 1656, 1658, 1659, 1662, 1663, 1668, 1669, 1671, 1673, 1675, 1676, 1677, 1680, 1681, 1683, 1684, 1685, 1688, 1689, 1691, 1697, 1698, 1701, 1705, 1706, 1707, 1708, 1710, 1712, 1717, 1719, 1723, 1725, 1729, 1731, 1732, 1735, 1740, 1745, 1750, 1755, 1758, 1759, 1761, 1764, 1768, 1771, 1776, 1778, 1779, 1782, 1784, 1785, 1791, 1793, 1807, 1813, 1815, 1820, 1821, 1830, 1832, 1834, 1835, 1836, 1840, 1845, 1850, 1852, 1859, 1865, 1867, 1869, 1870, 1872, 1874, 1876, 1882, 1883, 1886, 1888, 1897, 1898, 1899, 1900, 1901, 1902, 1903, 1905, 1906, 1911, 1917, 1918, 1920, 1922, 1923, 1924, 1933, 1934, 1936, 1940, 1950, 1952, 1953, 1955, 1958, 1973, 1981, 1990, 1991, 1992, 1994, 1995, 1996, 1999, 2000, 2007, 2008, 2009, 2010, 2012, 2013, 2017, 2026, 2032, 2039, 2041, 2043, 2048, 2060, 2062, 2064, 2066, 2072, 2074, 2077, 2081, 2082, 2083, 2089, 2093, 2094, 2096, 2097, 2099, 2103, 2104, 2109, 2119, 2126, 2132, 2133, 2134, 2140, 2142, 2143, 2144, 2147, 2150, 2152, 2154, 2155, 2156, 2157, 2159, 2161, 2162, 2163, 2164, 2167, 2170, 2172, 2173, 2177, 2178, 2179, 2185, 2189, 2191, 2193, 2196, 2202, 2203, 2207, 2214, 2215, 2216, 2219, 2221, 2222, 2225, 2226, 2229, 2230, 2231, 2232, 2235, 2240, 2243, 2244, 2253, 2257, 2259, 2260, 2262, 2263, 2265, 2273, 2274, 2276, 2278, 2282, 2283, 2288, 2291, 2295, 2296, 2298, 2301, 2303, 2304, 2308, 2309, 2322, 2323, 2326, 2328, 2329, 2331, 2333, 2339, 2342, 2345, 2348, 2349, 2351, 2352, 2353, 2358, 2360, 2363, 2366, 2371, 2379, 2380, 2381, 2382, 2384, 2398, 2402, 2403, 2405, 2406, 2410, 2411, 2412, 2413, 2418, 2419, 2420, 2422, 2423, 2430, 2435, 2437, 2438, 2440, 2441, 2442, 2443, 2445, 2451, 2452, 2453, 2455, 2457, 2465, 2466, 2470, 2471, 2472, 2474, 2476, 2479, 2481, 2482, 2490, 2492, 2494, 2495, 2496, 2498, 2500, 2504, 2505, 2506, 2509, 2514, 2515, 2516, 2517, 2519, 2525, 2528, 2529, 2531, 2532, 2533, 2536, 2537, 2538, 2539, 2541, 2542, 2547, 2548, 2551, 2552, 2554, 2555, 2556, 2557, 2559, 2567, 2573, 2577, 2578, 2581, 2583, 2589, 2590, 2592, 2594, 2601, 2605, 2609, 2616, 2617, 2618, 2625, 2627, 2632, 2634, 2637, 2639, 2641, 2644, 2647, 2648, 2652, 2653, 2655, 2661, 2662, 2663, 2671, 2674, 2675, 2684, 2685, 2687, 2689, 2691, 2692, 2696, 2700, 2702, 2707, 2711, 2715, 2718, 2719, 2723, 2725, 2726, 2727, 2728, 2729, 2730, 2735, 2740, 2742, 2746, 2747, 2749, 2752, 2755, 2757, 2763, 2770, 2775, 2780, 2782, 2784, 2785, 2787, 2800, 2801, 2802, 2805, 2808, 2812, 2820, 2821, 2823, 2824, 2826, 2827, 2828, 2831, 2832, 2840, 2842, 2844, 2850, 2857, 2858, 2861, 2862, 2864, 2865, 2871, 2876, 2878, 2881, 2888, 2889, 2890, 2893, 2898, 2902, 2903, 2906, 2908, 2909, 2910, 2915, 2916, 2917, 2919, 2923, 2924, 2926, 2930, 2931, 2932, 2933, 2934, 2935, 2944, 2946, 2948, 2953, 2955, 2959, 2962, 2963, 2966, 2968, 2972, 2976, 2979, 2980, 2985, 2992, 2994, 2998, 3002, 3005, 3006, 3007, 3014, 3015, 3016, 3023, 3027, 3033, 3038, 3039, 3042, 3043, 3046, 3048, 3049, 3050, 3051, 3052, 3053, 3055, 3064, 3072, 3075, 3076, 3078, 3080, 3081, 3083, 3085, 3087, 3090, 3094, 3095, 3096, 3100, 3101, 3102, 3105, 3106, 3109, 3114, 3117, 3118, 3119, 3120, 3121, 3123, 3126, 3127, 3128, 3137, 3138, 3139, 3143, 3147, 3148, 3153, 3154, 3156, 3166, 3170, 3181, 3185, 3189, 3191, 3192, 3194, 3202, 3205, 3206, 3210, 3212, 3215, 3219, 3220, 3224, 3225, 3227, 3228, 3236, 3237, 3239, 3240, 3245, 3250, 3252, 3255, 3258, 3260, 3261, 3263, 3266, 3271, 3272, 3273, 3278, 3280, 3286, 3287, 3288, 3290, 3291, 3294, 3295, 3296, 3297, 3299, 3301, 3303, 3305, 3312, 3313, 3324, 3327, 3331, 3332, 3333, 3340, 3343, 3345, 3347, 3349, 3351, 3353, 3355, 3357, 3358, 3361, 3363, 3369, 3370, 3373, 3377, 3379, 3382, 3383, 3385, 3386, 3397, 3399, 3400, 3404, 3405, 3415, 3416, 3418, 3419, 3420, 3422, 3424, 3426, 3427, 3428, 3435, 3438, 3441, 3445, 3447, 3450, 3451, 3452, 3455, 3458, 3460, 3461, 3464, 3465, 3466, 3468, 3470, 3471, 3474, 3475, 3477, 3482, 3483, 3488, 3490, 3491, 3494, 3496, 3503, 3504, 3506, 3510, 3511, 3516, 3517, 3518, 3529, 3531, 3533, 3536, 3541, 3544, 3545, 3548, 3549, 3552, 3558, 3560, 3562, 3563, 3569, 3572, 3574, 3576, 3577, 3587, 3588, 3589, 3592, 3593, 3594, 3595, 3596, 3597, 3598, 3599, 3600, 3603, 3604, 3606, 3607, 3610, 3611, 3613, 3616, 3618, 3620, 3621, 3623, 3624, 3627, 3628, 3629, 3630, 3631, 3633, 3637, 3640, 3642, 3643, 3644, 3645, 3646, 3647, 3648, 3650, 3655, 3657, 3659, 3660, 3662, 3663, 3669, 3671, 3672, 3674, 3677, 3682, 3684, 3685, 3693, 3694, 3704, 3706, 3707, 3713, 3715, 3717, 3718, 3720, 3724, 3725, 3732, 3738, 3739, 3748, 3749, 3752, 3754, 3761, 3762, 3764, 3765, 3766, 3775, 3777, 3778, 3781, 3783, 3784, 3788, 3789, 3790, 3791, 3792, 3794, 3798, 3804, 3808, 3812, 3818, 3820, 3823, 3825, 3828, 3829, 3830, 3831, 3832, 3833, 3836, 3837, 3842, 3843, 3844, 3845, 3849, 3858, 3862, 3867, 3871, 3872, 3873, 3876, 3882, 3883, 3887, 3889, 3891, 3892, 3893, 3894, 3895, 3908, 3910, 3911, 3914, 3917, 3923, 3924, 3928, 3933, 3934, 3935, 3937, 3938, 3947, 3950, 3952, 3954, 3958, 3962, 3967, 3974, 3975, 3983, 3985, 3987, 3988, 3994, 3995, 3997, 4001, 4002, 4003, 4006, 4008, 4013, 4019, 4020, 4026, 4030, 4032, 4033, 4034, 4037, 4038, 4039, 4040, 4041, 4042, 4045, 4046, 4047, 4048, 4049, 4050, 4051, 4052, 4053, 4054, 4056, 4057, 4062, 4066, 4067, 4068, 4069, 4072, 4075, 4079, 4080, 4088, 4092, 4096, 4099, 4103, 4105, 4109, 4111, 4113, 4115, 4116, 4121, 4122, 4128, 4133, 4139, 4146, 4148, 4149, 4156, 4158, 4160, 4161, 4162, 4163, 4165, 4166, 4167, 4168, 4169, 4170, 4171, 4175, 4178, 4185, 4187, 4188, 4189, 4191, 4197, 4201, 4202, 4205, 4206, 4207, 4208, 4210, 4211, 4212, 4214, 4217, 4219, 4221, 4222, 4227, 4228, 4231, 4233, 4235, 4244, 4246, 4250, 4251, 4257, 4258, 4261, 4263, 4270, 4272, 4279, 4280, 4281, 4283, 4288, 4294, 4295, 4296, 4297, 4298, 4301, 4302, 4304, 4309, 4312, 4317, 4320, 4321, 4324, 4329, 4330, 4331, 4332, 4335, 4337, 4338, 4341, 4344, 4347, 4349, 4352, 4354, 4358, 4360, 4369, 4371, 4373, 4378, 4380, 4383, 4387, 4390, 4391, 4394, 4397, 4401, 4402, 4403, 4404, 4405, 4406, 4410, 4415, 4422, 4423, 4434, 4439, 4443, 4444, 4446, 4448, 4450, 4453, 4456, 4458, 4460, 4461, 4462, 4463, 4464, 4465, 4468, 4472, 4474, 4475, 4479, 4485, 4491, 4492, 4494, 4498, 4502, 4506, 4507, 4512, 4513, 4514, 4515, 4516, 4518, 4519, 4522, 4524, 4528, 4531, 4534, 4535, 4543, 4545, 4548, 4549, 4551, 4552, 4554, 4556, 4557, 4558, 4560, 4562, 4565, 4566, 4568, 4575, 4580, 4583, 4584, 4590, 4591, 4596, 4601, 4604, 4606, 4621, 4625, 4630, 4632, 4633, 4634, 4635, 4641, 4643, 4644, 4650, 4653, 4654, 4655, 4659, 4666, 4667, 4669, 4670, 4671, 4672, 4676, 4677, 4680, 4685, 4687, 4692, 4699, 4700, 4704, 4705, 4706, 4708, 4710, 4716, 4719, 4721, 4722, 4723, 4725, 4728, 4729, 4730, 4737, 4738, 4740, 4741, 4747, 4748, 4749, 4750, 4751, 4753, 4754, 4755, 4756, 4759, 4761, 4762, 4766, 4767, 4771, 4775, 4779, 4789, 4790, 4791, 4794, 4795, 4804, 4813, 4814, 4815, 4818, 4823, 4824, 4828, 4829, 4832, 4833, 4834, 4835, 4838, 4842, 4856, 4857, 4859, 4861, 4862, 4864, 4868, 4869, 4872, 4875, 4876, 4880, 4881, 4887, 4889, 4891, 4895, 4901, 4902, 4905, 4909, 4914, 4917, 4920, 4921, 4922, 4923, 4924, 4926, 4928, 4935, 4936, 4940, 4941, 4943, 4950, 4955, 4960, 4965, 4971, 4972, 4973, 4975, 4977, 4984, 4986, 4987, 4988, 4992, 4994, 4996, 5000, 5005, 5010, 5022, 5026, 5029, 5030, 5034, 5039, 5040, 5042, 5044, 5046, 5049, 5052, 5054, 5057, 5067, 5068, 5072, 5075, 5078, 5079, 5082, 5088, 5089, 5090, 5091, 5094, 5095, 5100, 5102, 5109, 5111, 5122, 5123, 5129, 5131, 5132, 5140, 5145, 5147, 5151, 5160, 5164, 5165, 5168, 5170, 5171, 5174, 5180, 5182, 5184, 5185, 5188, 5189, 5190, 5191, 5192, 5195, 5196, 5198, 5199, 5200, 5201, 5203, 5206, 5208, 5212, 5216, 5217, 5219, 5222, 5225, 5226, 5228, 5229, 5230, 5234, 5239, 5240, 5243, 5249, 5253, 5255, 5258, 5261, 5263, 5264, 5267, 5268, 5273, 5275, 5276, 5280, 5281, 5283, 5286, 5289, 5290, 5292, 5293, 5298, 5299, 5300, 5301, 5303, 5308, 5309, 5311, 5314, 5317, 5319, 5321, 5324, 5329, 5330, 5334, 5338, 5344, 5346, 5347, 5350, 5351, 5359, 5361, 5372, 5382, 5383, 5386, 5388, 5389, 5393, 5395, 5396, 5397, 5398, 5403, 5407, 5409, 5413, 5414, 5417, 5426, 5430, 5431, 5434, 5446, 5448, 5449, 5452, 5456, 5457, 5459, 5463, 5464, 5466, 5467, 5472, 5474, 5476, 5477, 5482, 5483, 5485, 5493, 5496, 5498, 5502, 5503, 5506, 5508, 5510, 5513, 5515, 5516, 5517, 5518, 5519, 5524, 5526, 5529, 5530, 5532, 5534, 5535, 5537, 5539, 5541, 5543, 5557, 5562, 5563, 5568, 5569, 5571, 5579, 5585, 5588, 5589, 5591, 5592, 5597, 5608, 5612, 5613, 5615, 5616, 5618, 5620, 5623, 5627, 5631, 5632, 5635, 5638, 5640, 5642, 5643, 5647, 5648, 5649, 5650, 5651, 5652, 5653, 5659, 5660, 5662, 5663, 5675, 5676, 5677, 5683, 5689, 5690, 5694, 5695, 5697, 5698, 5702, 5703, 5706, 5709, 5711, 5717, 5718, 5721, 5731, 5732, 5734, 5735, 5738, 5739, 5744, 5748, 5751, 5754, 5756, 5763, 5768, 5771, 5775, 5780, 5784, 5785, 5788, 5791, 5794, 5803, 5805, 5808, 5809, 5813, 5814, 5815, 5820, 5826, 5833, 5834, 5835, 5836, 5837, 5846, 5850, 5852, 5853, 5854, 5859, 5861, 5862, 5864, 5865, 5866, 5867, 5869, 5872, 5876, 5878, 5879, 5881, 5883, 5884, 5886, 5888, 5893, 5906, 5907, 5912, 5922, 5923, 5925, 5926, 5927, 5928, 5932, 5934, 5938, 5939, 5941, 5944, 5948, 5954, 5956, 5959, 5967, 5968, 5978, 5979, 5980, 5982, 5987, 5988, 5991, 5994, 5996, 5997, 6000, 6002, 6004, 6006, 6007, 6013, 6016, 6017, 6023, 6024, 6025, 6026, 6031, 6038, 6041, 6043, 6044, 6048, 6051, 6058, 6059, 6062, 6063, 6065, 6068, 6069, 6070, 6072, 6073, 6075, 6081, 6084, 6085, 6086, 6088, 6089, 6092, 6093, 6097, 6098, 6099, 6107, 6108, 6109, 6113, 6116, 6119, 6121, 6124, 6129, 6131, 6132, 6137, 6138, 6139, 6143, 6145, 6146, 6151, 6153, 6160, 6162, 6163, 6164, 6165, 6181, 6183, 6186, 6189, 6191, 6193, 6196, 6198, 6204, 6205, 6209, 6220, 6223, 6224, 6227, 6228, 6233, 6234, 6239, 6242, 6243, 6246, 6247, 6250, 6251, 6264, 6265, 6267, 6270, 6272, 6273, 6275, 6281, 6282, 6286, 6292, 6293, 6295, 6297, 6299, 6300, 6303, 6309, 6311, 6315, 6317, 6319, 6321, 6322, 6325, 6328, 6330, 6332, 6333, 6338, 6342, 6343, 6344, 6346, 6349, 6353, 6354, 6356, 6362, 6363, 6365, 6367, 6370, 6372, 6375, 6376, 6381, 6383, 6386, 6393, 6394, 6397, 6399, 6403, 6405, 6408, 6414, 6415, 6419, 6420, 6422, 6425, 6426, 6428, 6429, 6431, 6436, 6440, 6449, 6456, 6463, 6464, 6466, 6467, 6469, 6470, 6472, 6474, 6476, 6478, 6480, 6482, 6484, 6485, 6488, 6493, 6494, 6495, 6501, 6502, 6504, 6505, 6510, 6512, 6513, 6514, 6516, 6517, 6518, 6519, 6526, 6530, 6531, 6532, 6534, 6535, 6537, 6547, 6549, 6553, 6554, 6555, 6558, 6564, 6567, 6569, 6571, 6572, 6574, 6576, 6577, 6579, 6581, 6584, 6588, 6589, 6592, 6594, 6595, 6597, 6600, 6603, 6606, 6607, 6609, 6610, 6615, 6616, 6617, 6620, 6623, 6625, 6626, 6628, 6629, 6633, 6635, 6639, 6640, 6644, 6646, 6647, 6648, 6649, 6655, 6656, 6658, 6661, 6666, 6671, 6672, 6673, 6681, 6686, 6693, 6696, 6701, 6703, 6704, 6705, 6706, 6716, 6718, 6720, 6729, 6730, 6734, 6736, 6737, 6739, 6742, 6747, 6749, 6756, 6757, 6759, 6764, 6766, 6767, 6777, 6779, 6782, 6783, 6786, 6792, 6793, 6794, 6795, 6797, 6799, 6803, 6804, 6805, 6807, 6810, 6811, 6813, 6815, 6816, 6817, 6819, 6820, 6821, 6824, 6826, 6827, 6828, 6830, 6831, 6834, 6836, 6841, 6842, 6843, 6848, 6851, 6861, 6863, 6869, 6875, 6876, 6877, 6880, 6884, 6886, 6887, 6894, 6897, 6902, 6903, 6904, 6905, 6906, 6907, 6913, 6914, 6917, 6919, 6920, 6921, 6924, 6925, 6930, 6936, 6939, 6946, 6955, 6959, 6960, 6963, 6966, 6967, 6971, 6979, 6980, 6981, 6984, 6985, 6987, 6988, 6990, 6991, 6994, 6997, 6999, 7003, 7009, 7018, 7022, 7029, 7038, 7039, 7040, 7041, 7043, 7045, 7046, 7049, 7051, 7052, 7053, 7059, 7064, 7067, 7073, 7077, 7079, 7083, 7084, 7094, 7096, 7105, 7106, 7107, 7108, 7110, 7112, 7113, 7117, 7118, 7122, 7126, 7129, 7130, 7138, 7139, 7142, 7143, 7144, 7150, 7151, 7154, 7163, 7164, 7165, 7166, 7169, 7172, 7176, 7182, 7184, 7192, 7194, 7197, 7201, 7202, 7203, 7206, 7207, 7208, 7210, 7212, 7217, 7219, 7224, 7227, 7228, 7230, 7231, 7235, 7236, 7244, 7245, 7246, 7249, 7250, 7252, 7255, 7257, 7258, 7262, 7263, 7264, 7267, 7268, 7270, 7274, 7276, 7281, 7282, 7287, 7291, 7292, 7293, 7296, 7299, 7300, 7301, 7303, 7304, 7306, 7307, 7311, 7312, 7313, 7318, 7320, 7328, 7330, 7344, 7345, 7350, 7351, 7357, 7358, 7361, 7365, 7369, 7371, 7377, 7380, 7382, 7383, 7386, 7387, 7392, 7398, 7400, 7406, 7409, 7410, 7411, 7417, 7418, 7425, 7429, 7430, 7434, 7435, 7436, 7438, 7441, 7447, 7448, 7452, 7453, 7454, 7456, 7457, 7458, 7464, 7466, 7467, 7472, 7483, 7485, 7486, 7487, 7490, 7492, 7493, 7499, 7503, 7506, 7512, 7514, 7515, 7521, 7522, 7523, 7524, 7525, 7533, 7538, 7546, 7561, 7572, 7574, 7579, 7583, 7585, 7586, 7589, 7594, 7596, 7598, 7599, 7605, 7609, 7612, 7619, 7620, 7622, 7624, 7625, 7633, 7642, 7643, 7644, 7647, 7649, 7652, 7656, 7658, 7661, 7664, 7665, 7671, 7674, 7678, 7679, 7680, 7682, 7686, 7687, 7689, 7695, 7700, 7703, 7712, 7715, 7716, 7720, 7724, 7726, 7727, 7730, 7736, 7737, 7738, 7741, 7742, 7744, 7745, 7749, 7753, 7763, 7764, 7768, 7770, 7772, 7774, 7775, 7779, 7780, 7781, 7785, 7786, 7788, 7791, 7793, 7798, 7799, 7800, 7801, 7803, 7804, 7806, 7807, 7818, 7819, 7820, 7822, 7823, 7824, 7825, 7826, 7833, 7834, 7839, 7840, 7841, 7844, 7845, 7850, 7854, 7856, 7865, 7873, 7877, 7878, 7880, 7881, 7887, 7888, 7890, 7896, 7910, 7911, 7918, 7923, 7925, 7928, 7933, 7934, 7935, 7936, 7937, 7938, 7942, 7944, 7949, 7952, 7965, 7966, 7967, 7974, 7976, 7977, 7981, 7984, 7986, 7992, 7996, 7999, 8004, 8007, 8012, 8021, 8024, 8025, 8026, 8030, 8031, 8035, 8036, 8041, 8042, 8044, 8045, 8047, 8053, 8056, 8059, 8061, 8063, 8068, 8072, 8074, 8076, 8077, 8078, 8079, 8080, 8083, 8084, 8088, 8091, 8093, 8100, 8102, 8103, 8106, 8110, 8112, 8113, 8118, 8126, 8129, 8130, 8141, 8145, 8147, 8148, 8150, 8159, 8163, 8164, 8170, 8178, 8179, 8181, 8189, 8191, 8193, 8194, 8202, 8204, 8208, 8210, 8213, 8217, 8219, 8220, 8223, 8227, 8230, 8234, 8235, 8237, 8239, 8241, 8242, 8246, 8248, 8250, 8252, 8253, 8263, 8264, 8265, 8266, 8268, 8269, 8270, 8273, 8274, 8276, 8282, 8289, 8292, 8300, 8304, 8308, 8310, 8311, 8312, 8315, 8318, 8319, 8320, 8323, 8329, 8339, 8340, 8341, 8347, 8350, 8351, 8353, 8367, 8368, 8371, 8373, 8378, 8379, 8380, 8385, 8387, 8389, 8390, 8392, 8393, 8395, 8396, 8401, 8404, 8406, 8408, 8410, 8413, 8414, 8415, 8416, 8417, 8418, 8430, 8436, 8438, 8439, 8444, 8445, 8447, 8448, 8449, 8450, 8451, 8457, 8458, 8465, 8470, 8472, 8473, 8474, 8476, 8477, 8481, 8482, 8485, 8486, 8490, 8498, 8501, 8503, 8505, 8507, 8511, 8513, 8515, 8516, 8520, 8521, 8524, 8525, 8526, 8527, 8532, 8533, 8535, 8539, 8542, 8543, 8553, 8554, 8561, 8562, 8565, 8566, 8568, 8574, 8575, 8576, 8577, 8579, 8581, 8585, 8592, 8594, 8596, 8597, 8598, 8600, 8603, 8604, 8605, 8609, 8611, 8612, 8631, 8634, 8638, 8639, 8641, 8644, 8648, 8650, 8658, 8659, 8663, 8665, 8669, 8672, 8676, 8677, 8680, 8685, 8686, 8689, 8690, 8693, 8694, 8695, 8699, 8700, 8703, 8706, 8708, 8709, 8713, 8717, 8720, 8722, 8726, 8729, 8731, 8736, 8740, 8741, 8743, 8744, 8747, 8748, 8750, 8761, 8769, 8770, 8773, 8774, 8777, 8779, 8783, 8784, 8785, 8786, 8789, 8792, 8795, 8802, 8803, 8808, 8810, 8811, 8821, 8822, 8824, 8828, 8829, 8830, 8831, 8833, 8835, 8836, 8841, 8843, 8846, 8853, 8865, 8866, 8874, 8875, 8876, 8878, 8881, 8884, 8888, 8889, 8892, 8896, 8900, 8907, 8908, 8911, 8916, 8917, 8919, 8922, 8926, 8929, 8930, 8935, 8937, 8938, 8941, 8945, 8946, 8951, 8953, 8957, 8960, 8961, 8967, 8968, 8971, 8979, 8980, 8981, 8985, 8991, 8992, 8996, 8998, 8999, 9001, 9006, 9009, 9012, 9013, 9017, 9018, 9020, 9022, 9026, 9027, 9029, 9030, 9033, 9035, 9045, 9050, 9052, 9056, 9058, 9059, 9060, 9063, 9065, 9069, 9071, 9072, 9076, 9084, 9087, 9088, 9092, 9095, 9096, 9103, 9104, 9105, 9106, 9107, 9112, 9114, 9116, 9118, 9120, 9123, 9125, 9129, 9131, 9133, 9134, 9139, 9140, 9141, 9142, 9144, 9145, 9149, 9152, 9154, 9155, 9159, 9175, 9177, 9179, 9180, 9185, 9188, 9190, 9191, 9194, 9195, 9205, 9206, 9207, 9210, 9211, 9213, 9215, 9216, 9220, 9226, 9229, 9236, 9237, 9243, 9246, 9248, 9249, 9253, 9257, 9259, 9262, 9265, 9267, 9269, 9270, 9273, 9275, 9282, 9284, 9285, 9287, 9288, 9290, 9291, 9292, 9295, 9296, 9300, 9304, 9306, 9308, 9311, 9313, 9314, 9320, 9321, 9323, 9326, 9328, 9332, 9336, 9339, 9340, 9341, 9346, 9347, 9350, 9352, 9353, 9359, 9360, 9366, 9368, 9371, 9375, 9376, 9382, 9391, 9392, 9394, 9400, 9402, 9403, 9406, 9407, 9411, 9413, 9414, 9415, 9421, 9423, 9425, 9429, 9439, 9440, 9443, 9449, 9451, 9452, 9453, 9456, 9460, 9468, 9471, 9472, 9473, 9474, 9476, 9481, 9488, 9490, 9500, 9504, 9509, 9514, 9517, 9518, 9534, 9536, 9537, 9540, 9546, 9550, 9551, 9553, 9555, 9560, 9564, 9567, 9571, 9573, 9574, 9577, 9586, 9587, 9590, 9591, 9595, 9596, 9597, 9598, 9601, 9602, 9606, 9607, 9609, 9614, 9615, 9617, 9618, 9620, 9621, 9623, 9624, 9626, 9629, 9630, 9632, 9633, 9638, 9649, 9650, 9652, 9653, 9655, 9657, 9658, 9663, 9666, 9668, 9670, 9680, 9686, 9688, 9692, 9698, 9701, 9709, 9710, 9711, 9721, 9723, 9724, 9726, 9727, 9729, 9730, 9731, 9732, 9733, 9734, 9737, 9744, 9745, 9746, 9750, 9753, 9756, 9763, 9764, 9767, 9770, 9774, 9776, 9782, 9786, 9787, 9791, 9792, 9794, 9798, 9799, 9804, 9809, 9810, 9811, 9812, 9813, 9816, 9819, 9820, 9828, 9830, 9835, 9845, 9847, 9869, 9873, 9875, 9878, 9879, 9882, 9886, 9887, 9889, 9891, 9892, 9900, 9907, 9909, 9910, 9911, 9912, 9923, 9924, 9928, 9931, 9932, 9934, 9935, 9938, 9940, 9944, 9946, 9949, 9950, 9952, 9953, 9960, 9962, 9963, 9967, 9968, 9972, 9975, 9976, 9979, 9980, 9982, 9984, 9987, 9988, 9990, 9991, 9992, 10000, 10008, 10015, 10017, 10019, 10020, 10026, 10027, 10032, 10033, 10034, 10035, 10037, 10038, 10041, 10049, 10051, 10052, 10053, 10054, 10055, 10058, 10059, 10060, 10062, 10064, 10066, 10068, 10072, 10073, 10078, 10080, 10081, 10083, 10090, 10091, 10092, 10095, 10097, 10101, 10103, 10106, 10109, 10110, 10115, 10116, 10122, 10128, 10129, 10130, 10131, 10138, 10143, 10151, 10158, 10160, 10163, 10165, 10166, 10168, 10174, 10176, 10178, 10181, 10184, 10192, 10193, 10194, 10195, 10196, 10199, 10206, 10212, 10218, 10219, 10220, 10221, 10222, 10223, 10224, 10225, 10228, 10231, 10233, 10234, 10235, 10236, 10237, 10239, 10240, 10247, 10249, 10253, 10254, 10255, 10259, 10262, 10263, 10269, 10270, 10275, 10284, 10286, 10291, 10292, 10293, 10295, 10300, 10302, 10306, 10307, 10311, 10312, 10314, 10318, 10319, 10323, 10324, 10325, 10326, 10331, 10333, 10334, 10335, 10340, 10341, 10343, 10346, 10353, 10354, 10356, 10357, 10364, 10371, 10375, 10376, 10378, 10380, 10384, 10385, 10388, 10393, 10397, 10398, 10399, 10401, 10405, 10408, 10410, 10411, 10413, 10414, 10416, 10417, 10419, 10421, 10423, 10424, 10425, 10426, 10435, 10436, 10438, 10440, 10446, 10447, 10449, 10450, 10451, 10452, 10453, 10456, 10463, 10464, 10465, 10466, 10468, 10469, 10471, 10474, 10480, 10482, 10487, 10490, 10494, 10496, 10499, 10506, 10508, 10514, 10518, 10522, 10523, 10527, 10528, 10530, 10531, 10532, 10536, 10537, 10541, 10542, 10543, 10544, 10547, 10548, 10555, 10556, 10558, 10560, 10563, 10567, 10569, 10573, 10580, 10581, 10582, 10583, 10584, 10588, 10593, 10596, 10599, 10601, 10602, 10612, 10613, 10615, 10616, 10621, 10622, 10625, 10629, 10630, 10631, 10633, 10636, 10637, 10638, 10639, 10640, 10645, 10646, 10649, 10652, 10655, 10665, 10666, 10668, 10670, 10676, 10677, 10678, 10679, 10682, 10683, 10684, 10685, 10686, 10700, 10701, 10705, 10706, 10707, 10715, 10716, 10721, 10722, 10724, 10726, 10729, 10732, 10734, 10737, 10738, 10744, 10747, 10748, 10749, 10752, 10754, 10756, 10761, 10762, 10766, 10769, 10770, 10775, 10777, 10778, 10779, 10784, 10785, 10787, 10788, 10790, 10792, 10795, 10801, 10802, 10803, 10805, 10809, 10810, 10811, 10812, 10815, 10818, 10819, 10822, 10823, 10824, 10827, 10831, 10833, 10836, 10838, 10839, 10840, 10843, 10844, 10846, 10850, 10851, 10852, 10853, 10854, 10857, 10858, 10860, 10866, 10867, 10870, 10877, 10880, 10881, 10886, 10887, 10896, 10897, 10898, 10899, 10901, 10902, 10911, 10917, 10918, 10920, 10924, 10926, 10927, 10928, 10929, 10930, 10933, 10934, 10938, 10940, 10941, 10945, 10947, 10960, 10962, 10965, 10966, 10967, 10968, 10972, 10976, 10977, 10979, 10988, 10993, 10995, 10996, 11002, 11008, 11009, 11015, 11017, 11021, 11022, 11024, 11027, 11030, 11032, 11033, 11039, 11040, 11044, 11046, 11047, 11052, 11053, 11056, 11058, 11060, 11063, 11066, 11067, 11078, 11081, 11082, 11083, 11090, 11095, 11098, 11100, 11101, 11107, 11111, 11114, 11118, 11122, 11124, 11129, 11135, 11137, 11138, 11147, 11148, 11149, 11151, 11153, 11154, 11160, 11163, 11165, 11166, 11168, 11169, 11173, 11177, 11178, 11181, 11184, 11187, 11188, 11190, 11192, 11193, 11194, 11198, 11203, 11204, 11208, 11213, 11214, 11216, 11217, 11218, 11222, 11226, 11227, 11230, 11231, 11232, 11233, 11235, 11236, 11238, 11239, 11243, 11246, 11247, 11248, 11253, 11254, 11255, 11256, 11258, 11260, 11262, 11263, 11266, 11290, 11292, 11293, 11295, 11297, 11298, 11302, 11304, 11305, 11306, 11313, 11315, 11318, 11321, 11330, 11331, 11337, 11338, 11340, 11345, 11346, 11348, 11349, 11356, 11358, 11362, 11363, 11364, 11365, 11370, 11371, 11373, 11377, 11380, 11382, 11385, 11387, 11388, 11394, 11395, 11401, 11404, 11405, 11406, 11417, 11424, 11430, 11431, 11435, 11436, 11438, 11439, 11440, 11443, 11446, 11447, 11449, 11451, 11456, 11459, 11461, 11465, 11466, 11475, 11478, 11485, 11487, 11488, 11489, 11490, 11491, 11494, 11496, 11497, 11498, 11499, 11500, 11505, 11506, 11507, 11518, 11520, 11523, 11524, 11526, 11527, 11528, 11530, 11531, 11532, 11533, 11535, 11539, 11540, 11541, 11544, 11548, 11551, 11553, 11558, 11560, 11561, 11562, 11567, 11568, 11570, 11571, 11576, 11577, 11578, 11585, 11588, 11593, 11594, 11595, 11596, 11597, 11599, 11603, 11604, 11607, 11610, 11612, 11617, 11618, 11623, 11626, 11628, 11639, 11640, 11647, 11650, 11656, 11658, 11659, 11663, 11665, 11669, 11673, 11678, 11681, 11682, 11688, 11691, 11692, 11694, 11695, 11696, 11701, 11703, 11705, 11707, 11712, 11718, 11721, 11725, 11726, 11730, 11731, 11732, 11733, 11736, 11737, 11740, 11743, 11744, 11753, 11756, 11759, 11760, 11761, 11762, 11763, 11765, 11770, 11771, 11776, 11777, 11781, 11783, 11785, 11786, 11788, 11792, 11794, 11797, 11799, 11800, 11809, 11810, 11811, 11814, 11818, 11820, 11821, 11826, 11829, 11830, 11840, 11841, 11846, 11848, 11849, 11851, 11856, 11858, 11861, 11864, 11865, 11868, 11870, 11872, 11876, 11877, 11878, 11886, 11889, 11891, 11892, 11894, 11895, 11898, 11901, 11902, 11906, 11909, 11911, 11913, 11916, 11917, 11918, 11919, 11920, 11921, 11922, 11923, 11926, 11927, 11928, 11929, 11930, 11934, 11940, 11943, 11945, 11947, 11949, 11953, 11956, 11957, 11958, 11959, 11960, 11961, 11962, 11963, 11964, 11965, 11968, 11973, 11974, 11975, 11976, 11977, 11978, 11979, 11980, 11983, 11988, 11989, 11993, 11997, 11998, 11999, 12002, 12004, 12008, 12017, 12019, 12023, 12024, 12026, 12032, 12033, 12043, 12044, 12050, 12059, 12068, 12076, 12081, 12083, 12087, 12091, 12092, 12093, 12095, 12098, 12102, 12104, 12106, 12109, 12110, 12112, 12114, 12118, 12122, 12127, 12128, 12129, 12130, 12131, 12134, 12137, 12138, 12139, 12141, 12143, 12145, 12146, 12147, 12149, 12151, 12161, 12166, 12170, 12171, 12174, 12175, 12176, 12181, 12183, 12185, 12189, 12197, 12204, 12207, 12208, 12217, 12218, 12219, 12221, 12227, 12234, 12240, 12241, 12243, 12249, 12250, 12252, 12253, 12255, 12256, 12259, 12260, 12263, 12267, 12268, 12269, 12278, 12283, 12284, 12287, 12288, 12291, 12293, 12295, 12304, 12310, 12311, 12312, 12313, 12314, 12315, 12317, 12321, 12323, 12326, 12329, 12331, 12334, 12354, 12356, 12358, 12359, 12364, 12367, 12368, 12370, 12374, 12375, 12379, 12380, 12381, 12382, 12385, 12396, 12397, 12400, 12403, 12404, 12406, 12410, 12414, 12416, 12419, 12420, 12421, 12424, 12427, 12437, 12438, 12439, 12440, 12445, 12451, 12455, 12456, 12457, 12462, 12465, 12467, 12468, 12470, 12472, 12473, 12478, 12481, 12487, 12488, 12489, 12491, 12494, 12495, 12497, 12499, 12504, 12505, 12508, 12510, 12511, 12514, 12521, 12523, 12530, 12536, 12545, 12546, 12547, 12549, 12555, 12557, 12559, 12561, 12563, 12564, 12565, 12567, 12583, 12585, 12588, 12591, 12592, 12593, 12597, 12605, 12606, 12608, 12609, 12610, 12611, 12614, 12619, 12623, 12626, 12629, 12631, 12633, 12634, 12636, 12638, 12639, 12641, 12649, 12651, 12655, 12663, 12668, 12670, 12671, 12672, 12674, 12676, 12679, 12680, 12681, 12683, 12684, 12685, 12688, 12691, 12693, 12695, 12698, 12699, 12701, 12702, 12713, 12718, 12719, 12722, 12731, 12732, 12733, 12737, 12738, 12739, 12741, 12742, 12743, 12748, 12750, 12754, 12755, 12758, 12760, 12761, 12764, 12766, 12771, 12772, 12773, 12783, 12790, 12794, 12797, 12800, 12802, 12805, 12808, 12810, 12812, 12813, 12814, 12817, 12819, 12822, 12824, 12826, 12827, 12828, 12834, 12835, 12836, 12838, 12839, 12843, 12844, 12847, 12849, 12850, 12858, 12860, 12861, 12866, 12882, 12883, 12884, 12887, 12888, 12895, 12898, 12900, 12904, 12905, 12906, 12910, 12913, 12916, 12917, 12918, 12920, 12921, 12926, 12929, 12932, 12933, 12938, 12939, 12940, 12941, 12944, 12945, 12946, 12947, 12966, 12968, 12969, 12972, 12973, 12978, 12982, 12983, 12984, 12985, 12987, 12990, 12991, 12993, 12994, 12996, 13006, 13007, 13010, 13011, 13012, 13014, 13015, 13017, 13018, 13022, 13023, 13024, 13030, 13032, 13033, 13034, 13038, 13040, 13041, 13042, 13049, 13050, 13053, 13055, 13056, 13060, 13061, 13065, 13066, 13067, 13069, 13071, 13075, 13079, 13085, 13086, 13087, 13095, 13101, 13102, 13105, 13106, 13112, 13115, 13117, 13118, 13120, 13123, 13124, 13131, 13134, 13135, 13142, 13148, 13149, 13151, 13160, 13169, 13174, 13175, 13177, 13181, 13182, 13185, 13197, 13206, 13209, 13210, 13212, 13213, 13215, 13217, 13221, 13222, 13224, 13227, 13230, 13232, 13234, 13235, 13236, 13237, 13238, 13241, 13243, 13249, 13251, 13255, 13259, 13260, 13261, 13263, 13264, 13267, 13269, 13270, 13273, 13276, 13278, 13280, 13281, 13285, 13291, 13295, 13296, 13298, 13301, 13303, 13313, 13315, 13317, 13318, 13319, 13320, 13321, 13323, 13325, 13326, 13328, 13330, 13332, 13337, 13338, 13343, 13345, 13346, 13348, 13353, 13354, 13359, 13361, 13369, 13370, 13377, 13381, 13384, 13391, 13392, 13393, 13394, 13396, 13397, 13401, 13402, 13408, 13410, 13413, 13416, 13417, 13419, 13423, 13424, 13428, 13430, 13433, 13439, 13444, 13448, 13449, 13451, 13456, 13460, 13463, 13466, 13468, 13469, 13473, 13475, 13490, 13492, 13496, 13498, 13499, 13500, 13503, 13504, 13505, 13506, 13513, 13514, 13515, 13516, 13517, 13519, 13520, 13521, 13530, 13532, 13540, 13543, 13544, 13545, 13546, 13547, 13549, 13552, 13555, 13556, 13568, 13569, 13574, 13582, 13583, 13584, 13587, 13589, 13597, 13598, 13601, 13602, 13604, 13612, 13614, 13621, 13623, 13628, 13631, 13632, 13634, 13636, 13637, 13641, 13647, 13650, 13652, 13654, 13661, 13662, 13663, 13668, 13671, 13675, 13676, 13677, 13681, 13684, 13686, 13687, 13688, 13691, 13695, 13697, 13698, 13700, 13702, 13703, 13706, 13710, 13713, 13715, 13716, 13720, 13721, 13727, 13729, 13730, 13739, 13745, 13747, 13748, 13750, 13756, 13764, 13769, 13772, 13773, 13776, 13779, 13781, 13782, 13783, 13789, 13791, 13793, 13794, 13796, 13798, 13809, 13816, 13817, 13818, 13819, 13820, 13822, 13823, 13828, 13830, 13831, 13835, 13843, 13849, 13852, 13853, 13859, 13860, 13862, 13866, 13869, 13870, 13872, 13873, 13874, 13875, 13877, 13880, 13881, 13882, 13883, 13888, 13891, 13892, 13894, 13897, 13901, 13904, 13906, 13910, 13911, 13917, 13919, 13921, 13927, 13930, 13938, 13944, 13947, 13948, 13949, 13952, 13954, 13961, 13962, 13963, 13965, 13969, 13970, 13975, 13976, 13981, 13983, 13984, 13988, 13990, 13991, 13992, 13999, 14000, 14008, 14009, 14010, 14013, 14014, 14017, 14018, 14022, 14026, 14030, 14031, 14036, 14041, 14043, 14049, 14050, 14051, 14052, 14062, 14066, 14069, 14070, 14071, 14073, 14075, 14082, 14086, 14092, 14093, 14094, 14096, 14099, 14100, 14105, 14106, 14112, 14116, 14118, 14119, 14120, 14122, 14124, 14125, 14128, 14129, 14130, 14132, 14134, 14135, 14138, 14139, 14142, 14143, 14145, 14146, 14148, 14149, 14150.

Promoters expressing in root tissue at the tasseling stage include SEQ IDs: 1, 3, 4, 7, 8, 9, 13, 14, 15, 26, 27, 29, 31, 34, 36, 38, 48, 53, 54, 63, 64, 65, 69, 70, 71, 81, 82, 88, 96, 97, 99, 102, 103, 107, 108, 110, 111, 112, 117, 121, 126, 130, 131, 132, 134, 139, 143, 147, 148, 152, 154, 162, 164, 174, 176, 179, 181, 187, 191, 194, 195, 196, 197, 199, 202, 204, 205, 207, 210, 211, 212, 215, 217, 223, 231, 232, 233, 235, 236, 237, 240, 242, 243, 244, 246, 248, 249, 250, 251, 254, 257, 259, 262, 264, 271, 273, 274, 280, 281, 284, 286, 288, 289, 291, 299, 301, 302, 305, 306, 309, 314, 316, 319, 320, 323, 328, 329, 332, 334, 335, 346, 348, 349, 352, 353, 354, 356, 357, 360, 364, 367, 371, 373, 376, 378, 379, 382, 387, 388, 393, 396, 401, 402, 405, 406, 407, 412, 418, 419, 420, 423, 424, 428, 429, 433, 434, 436, 452, 454, 456, 461, 463, 466, 471, 474, 478, 479, 483, 485, 488, 498, 501, 502, 504, 509, 510, 512, 513, 514, 516, 517, 522, 523, 525, 529, 532, 533, 534, 536, 537, 538, 541, 542, 544, 546, 547, 548, 554, 557, 564, 565, 569, 576, 580, 585, 591, 593, 594, 595, 596, 598, 599, 601, 602, 604, 607, 613, 614, 620, 623, 626, 630, 631, 633, 635, 638, 641, 643, 644, 650, 653, 662, 663, 665, 666, 667, 668, 671, 674, 676, 677, 681, 683, 686, 693, 694, 701, 705, 707, 708, 716, 717, 719, 722, 723, 724, 727, 734, 736, 739, 742, 749, 753, 759, 760, 761, 762, 763, 765, 768, 770, 771, 782, 783, 785, 792, 793, 795, 797, 800, 804, 806, 808, 819, 820, 821, 823, 824, 825, 826, 829, 830, 833, 836, 840, 842, 844, 850, 855, 857, 859, 860, 862, 863, 865, 870, 871, 872, 877, 883, 884, 885, 887, 890, 891, 892, 895, 897, 901, 902, 903, 907, 908, 911, 912, 916, 917, 919, 924, 928, 929, 931, 936, 938, 943, 944, 951, 953, 957, 958, 959, 961, 962, 963, 964, 966, 974, 979, 980, 981, 982, 983, 987, 993, 994, 995, 996, 997, 999, 1003, 1006, 1007, 1009, 1010, 1011, 1014, 1028, 1032, 1038, 1039, 1041, 1042, 1043, 1045, 1047, 1049, 1050, 1051, 1052, 1055, 1056, 1064, 1065, 1069, 1077, 1078, 1085, 1086, 1087, 1088, 1089, 1092, 1095, 1103, 1104, 1106, 1108, 1110, 1111, 1112, 1114, 1115, 1117, 1118, 1119, 1120, 1122, 1127, 1130, 1132, 1133, 1136, 1137, 1144, 1146, 1147, 1148, 1154, 1160, 1166, 1169, 1170, 1176, 1178, 1182, 1189, 1190, 1191, 1193, 1196, 1198, 1199, 1200, 1204, 1214, 1217, 1218, 1219, 1223, 1225, 1227, 1228, 1230, 1231, 1233, 1236, 1240, 1241, 1248, 1249, 1250, 1252, 1253, 1256, 1258, 1269, 1272, 1273, 1275, 1277, 1281, 1282, 1283, 1285, 1286, 1291, 1292, 1293, 1295, 1297, 1306, 1309, 1316, 1317, 1320, 1327, 1330, 1331, 1334, 1346, 1347, 1349, 1351, 1354, 1355, 1360, 1364, 1368, 1372, 1373, 1376, 1377, 1380, 1381, 1382, 1386, 1388, 1392, 1396, 1397, 1398, 1403, 1404, 1407, 1411, 1415, 1421, 1423, 1426, 1431, 1438, 1441, 1442, 1444, 1447, 1451, 1453, 1454, 1455, 1459, 1462, 1466, 1468, 1471, 1474, 1475, 1481, 1488, 1490, 1493, 1498, 1499, 1503, 1508, 1510, 1511, 1514, 1517, 1518, 1525, 1526, 1527, 1539, 1543, 1545, 1546, 1548, 1549, 1550, 1555, 1556, 1560, 1563, 1567, 1570, 1571, 1575, 1576, 1578, 1584, 1586, 1590, 1592, 1593, 1594, 1599, 1600, 1602, 1604, 1608, 1609, 1612, 1614, 1615, 1616, 1622, 1624, 1625, 1634, 1635, 1637, 1638, 1639, 1641, 1650, 1652, 1658, 1662, 1663, 1668, 1669, 1671, 1673, 1675, 1676, 1680, 1683, 1685, 1688, 1689, 1691, 1698, 1699, 1701, 1705, 1706, 1707, 1708, 1710, 1712, 1717, 1719, 1723, 1725, 1726, 1727, 1729, 1731, 1732, 1735, 1740, 1745, 1755, 1758, 1759, 1761, 1764, 1768, 1771, 1776, 1778, 1779, 1782, 1784, 1785, 1791, 1807, 1813, 1815, 1816, 1820, 1830, 1832, 1834, 1835, 1836, 1837, 1838, 1839, 1840, 1845, 1850, 1852, 1856, 1859, 1861, 1863, 1865, 1867, 1868, 1869, 1870, 1872, 1874, 1876, 1882, 1883, 1886, 1888, 1897, 1898, 1899, 1900, 1901, 1902, 1905, 1906, 1911, 1914, 1915, 1918, 1920, 1922, 1923, 1924, 1933, 1934, 1936, 1940, 1945, 1950, 1952, 1953, 1955, 1973, 1981, 1990, 1991, 1992, 1993, 1994, 1995, 1996, 1999, 2000, 2007, 2008, 2009, 2010, 2012, 2013, 2015, 2016, 2017, 2020, 2026, 2027, 2031, 2032, 2039, 2041, 2043, 2045, 2048, 2060, 2062, 2064, 2066, 2071, 2072, 2074, 2077, 2080, 2081, 2082, 2083, 2088, 2089, 2094, 2096, 2097, 2099, 2103, 2104, 2116, 2117, 2119, 2126, 2132, 2133, 2134, 2137, 2139, 2140, 2142, 2143, 2144, 2147, 2150, 2152, 2154, 2155, 2156, 2157, 2159, 2161, 2162, 2164, 2166, 2168, 2172, 2173, 2177, 2178, 2179, 2185, 2190, 2191, 2193, 2196, 2202, 2203, 2205, 2206, 2213, 2214, 2215, 2216, 2218, 2221, 2222, 2225, 2226, 2227, 2229, 2230, 2231, 2235, 2240, 2243, 2244, 2247, 2253, 2257, 2259, 2260, 2261, 2262, 2263, 2265, 2273, 2274, 2276, 2278, 2280, 2282, 2288, 2291, 2295, 2296, 2297, 2298, 2301, 2303, 2304, 2308, 2309, 2310, 2314, 2322, 2323, 2328, 2329, 2331, 2339, 2342, 2345, 2348, 2349, 2351, 2352, 2353, 2360, 2363, 2366, 2367, 2371, 2377, 2379, 2381, 2382, 2384, 2397, 2398, 2401, 2402, 2403, 2405, 2406, 2410, 2411, 2412, 2413, 2418, 2419, 2420, 2422, 2423, 2430, 2435, 2437, 2438, 2441, 2442, 2443, 2445, 2451, 2452, 2453, 2454, 2455, 2457, 2458, 2465, 2466, 2470, 2471, 2472, 2474, 2476, 2479, 2481, 2482, 2490, 2492, 2494, 2495, 2496, 2498, 2500, 2504, 2505, 2509, 2514, 2515, 2517, 2519, 2525, 2528, 2529, 2531, 2532, 2533, 2536, 2537, 2538, 2539, 2541, 2542, 2547, 2548, 2551, 2552, 2554, 2555, 2556, 2557, 2567, 2573, 2577, 2578, 2581, 2583, 2589, 2590, 2592, 2594, 2601, 2605, 2613, 2616, 2617, 2618, 2625, 2626, 2627, 2632, 2634, 2637, 2639, 2641, 2644, 2648, 2650, 2652, 2653, 2655, 2661, 2662, 2663, 2665, 2671, 2674, 2675, 2679, 2684, 2685, 2687, 2689, 2691, 2692, 2696, 2700, 2702, 2707, 2711, 2718, 2719, 2723, 2725, 2726, 2727, 2728, 2729, 2735, 2737, 2740, 2742, 2746, 2747, 2749, 2750, 2752, 2755, 2756, 2757, 2763, 2764, 2770, 2775, 2780, 2782, 2783, 2784, 2785, 2786, 2787, 2791, 2798, 2800, 2801, 2802, 2805, 2808, 2812, 2819, 2820, 2821, 2822, 2823, 2824, 2826, 2827, 2828, 2831, 2832, 2840, 2842, 2844, 2850, 2857, 2858, 2861, 2864, 2865, 2871, 2873, 2876, 2878, 2881, 2888, 2889, 2890, 2893, 2898, 2902, 2903, 2906, 2908, 2909, 2910, 2912, 2915, 2916, 2917, 2919, 2923, 2924, 2926, 2930, 2931, 2932, 2933, 2934, 2935, 2944, 2945, 2946, 2948, 2953, 2955, 2959, 2963, 2966, 2968, 2972, 2979, 2980, 2985, 2994, 2998, 3000, 3002, 3003, 3005, 3006, 3007, 3008, 3010, 3014, 3015, 3016, 3019, 3023, 3024, 3026, 3027, 3038, 3039, 3042, 3043, 3044, 3048, 3049, 3051, 3052, 3053, 3055, 3058, 3059, 3064, 3067, 3072, 3075, 3078, 3080, 3081, 3083, 3084, 3085, 3087, 3088, 3090, 3094, 3096, 3100, 3101, 3102, 3105, 3106, 3114, 3118, 3119, 3120, 3121, 3123, 3126, 3127, 3128, 3129, 3137, 3138, 3139, 3143, 3147, 3148, 3153, 3154, 3157, 3158, 3170, 3177, 3181, 3185, 3189, 3192, 3194, 3199, 3202, 3205, 3206, 3210, 3212, 3215, 3218, 3219, 3220, 3224, 3225, 3226, 3227, 3228, 3236, 3237, 3239, 3240, 3244, 3245, 3247, 3250, 3252, 3255, 3258, 3260, 3261, 3262, 3263, 3266, 3271, 3278, 3280, 3286, 3288, 3290, 3291, 3294, 3295, 3296, 3299, 3301, 3312, 3313, 3327, 3331, 3332, 3333, 3337, 3340, 3343, 3345, 3347, 3349, 3351, 3353, 3355, 3356, 3358, 3361, 3363, 3370, 3373, 3374, 3377, 3383, 3386, 3392, 3393, 3397, 3399, 3404, 3405, 3414, 3415, 3416, 3418, 3419, 3422, 3424, 3426, 3427, 3428, 3435, 3438, 3441, 3442, 3445, 3446, 3447, 3450, 3451, 3452, 3455, 3458, 3460, 3461, 3464, 3465, 3468, 3470, 3471, 3474, 3475, 3477, 3482, 3483, 3487, 3488, 3490, 3491, 3494, 3503, 3504, 3506, 3510, 3516, 3517, 3518, 3529, 3533, 3536, 3537, 3541, 3544, 3545, 3548, 3549, 3552, 3554, 3558, 3560, 3562, 3563, 3569, 3572, 3574, 3576, 3577, 3579, 3582, 3587, 3588, 3592, 3593, 3594, 3595, 3597, 3598, 3600, 3603, 3604, 3606, 3607, 3610, 3611, 3613, 3616, 3618, 3620, 3621, 3623, 3624, 3626, 3627, 3628, 3629, 3630, 3631, 3633, 3637, 3640, 3642, 3643, 3644, 3645, 3646, 3647, 3648, 3650, 3655, 3657, 3659, 3661, 3662, 3663, 3667, 3668, 3671, 3672, 3674, 3682, 3684, 3685, 3693, 3694, 3697, 3704, 3706, 3707, 3713, 3715, 3717, 3718, 3719, 3720, 3724, 3725, 3731, 3732, 3738, 3739, 3742, 3748, 3749, 3752, 3754, 3761, 3762, 3764, 3765, 3766, 3772, 3773, 3774, 3775, 3777, 3778, 3781, 3783, 3784, 3785, 3788, 3789, 3790, 3791, 3792, 3794, 3798, 3800, 3804, 3806, 3808, 3812, 3818, 3820, 3823, 3825, 3828, 3829, 3830, 3831, 3832, 3833, 3836, 3839, 3842, 3843, 3844, 3845, 3849, 3858, 3859, 3860, 3862, 3866, 3867, 3870, 3871, 3872, 3873, 3876, 3882, 3883, 3887, 3889, 3891, 3892, 3893, 3894, 3895, 3902, 3908, 3910, 3914, 3917, 3923, 3924, 3926, 3928, 3929, 3933, 3934, 3938, 3947, 3950, 3954, 3958, 3962, 3967, 3974, 3975, 3983, 3985, 3987, 3988, 3994, 3995, 3996, 3997, 4000, 4001, 4002, 4003, 4006, 4008, 4013, 4024, 4026, 4030, 4034, 4035, 4039, 4040, 4042, 4046, 4047, 4048, 4049, 4050, 4053, 4054, 4056, 4057, 4061, 4062, 4066, 4067, 4068, 4069, 4072, 4075, 4077, 4078, 4079, 4092, 4096, 4099, 4103, 4105, 4111, 4113, 4115, 4116, 4122, 4124, 4128, 4133, 4139, 4143, 4146, 4148, 4149, 4154, 4155, 4156, 4158, 4160, 4161, 4162, 4163, 4165, 4166, 4167, 4168, 4169, 4171, 4175, 4178, 4187, 4188, 4189, 4191, 4197, 4198, 4201, 4202, 4205, 4206, 4207, 4208, 4210, 4211, 4212, 4214, 4217, 4219, 4221, 4222, 4227, 4228, 4233, 4235, 4244, 4246, 4250, 4251, 4257, 4258, 4260, 4263, 4270, 4272, 4279, 4280, 4281, 4294, 4296, 4298, 4301, 4302, 4304, 4309, 4312, 4320, 4321, 4324, 4329, 4330, 4331, 4333, 4335, 4337, 4338, 4341, 4343, 4344, 4347, 4349, 4352, 4354, 4358, 4360, 4369, 4374, 4378, 4380, 4383, 4387, 4390, 4391, 4394, 4397, 4401, 4402, 4403, 4404, 4405, 4407, 4410, 4412, 4415, 4422, 4423, 4439, 4443, 4444, 4446, 4448, 4450, 4453, 4456, 4458, 4460, 4461, 4462, 4463, 4464, 4466, 4468, 4472, 4474, 4475, 4479, 4485, 4491, 4492, 4494, 4502, 4506, 4507, 4512, 4513, 4514, 4515, 4518, 4519, 4524, 4531, 4534, 4535, 4543, 4545, 4548, 4549, 4551, 4554, 4555, 4556, 4557, 4558, 4559, 4562, 4565, 4566, 4568, 4575, 4578, 4579, 4580, 4582, 4583, 4590, 4591, 4596, 4601, 4604, 4621, 4625, 4630, 4633, 4635, 4641, 4643, 4644, 4650, 4653, 4654, 4655, 4659, 4666, 4667, 4669, 4670, 4671, 4672, 4674, 4676, 4677, 4680, 4682, 4685, 4687, 4688, 4699, 4700, 4704, 4705, 4706, 4708, 4710, 4714, 4719, 4721, 4725, 4728, 4729, 4732, 4737, 4738, 4740, 4747, 4749, 4750, 4751, 4753, 4754, 4755, 4756, 4759, 4761, 4762, 4765, 4766, 4767, 4771, 4775, 4778, 4779, 4789, 4790, 4791, 4794, 4795, 4804, 4809, 4813, 4814, 4817, 4818, 4822, 4823, 4824, 4828, 4829, 4832, 4833, 4834, 4838, 4842, 4855, 4856, 4857, 4859, 4861, 4862, 4864, 4868, 4869, 4870, 4872, 4875, 4876, 4877, 4880, 4881, 4887, 4889, 4891, 4895, 4901, 4902, 4905, 4909, 4913, 4914, 4918, 4920, 4921, 4923, 4924, 4925, 4926, 4935, 4936, 4938, 4940, 4941, 4943, 4944, 4950, 4955, 4965, 4971, 4972, 4973, 4975, 4977, 4985, 4986, 4987, 4988, 4992, 4993, 4994, 4996, 5005, 5010, 5011, 5026, 5029, 5030, 5034, 5039, 5040, 5042, 5044, 5046, 5049, 5052, 5054, 5057, 5067, 5068, 5072, 5074, 5075, 5078, 5079, 5082, 5086, 5087, 5088, 5089, 5091, 5094, 5095, 5100, 5102, 5111, 5119, 5122, 5123, 5129, 5130, 5131, 5132, 5140, 5145, 5147, 5164, 5165, 5168, 5170, 5173, 5174, 5180, 5181, 5182, 5184, 5185, 5188, 5189, 5190, 5191, 5192, 5195, 5196, 5198, 5200, 5201, 5202, 5206, 5208, 5212, 5214, 5216, 5217, 5219, 5225, 5226, 5229, 5234, 5236, 5240, 5241, 5243, 5249, 5253, 5255, 5258, 5261, 5263, 5264, 5267, 5268, 5273, 5275, 5276, 5280, 5281, 5283, 5289, 5292, 5293, 5298, 5299, 5300, 5301, 5303, 5308, 5311, 5317, 5319, 5324, 5327, 5329, 5330, 5334, 5342, 5344, 5346, 5348, 5351, 5359, 5361, 5372, 5382, 5383, 5386, 5388, 5389, 5393, 5395, 5396, 5397, 5403, 5407, 5409, 5411, 5414, 5417, 5426, 5430, 5431, 5434, 5437, 5448, 5449, 5452, 5456, 5457, 5459, 5463, 5464, 5466, 5467, 5469, 5472, 5474, 5476, 5477, 5479, 5482, 5483, 5493, 5495, 5496, 5498, 5502, 5503, 5506, 5508, 5509, 5510, 5513, 5515, 5516, 5517, 5518, 5519, 5524, 5526, 5529, 5530, 5532, 5534, 5535, 5537, 5539, 5541, 5543, 5557, 5562, 5563, 5568, 5569, 5571, 5579, 5583, 5585, 5586, 5588, 5589, 5591, 5592, 5597, 5612, 5613, 5615, 5616, 5618, 5619, 5620, 5627, 5632, 5633, 5635, 5638, 5640, 5642, 5643, 5647, 5648, 5649, 5650, 5651, 5652, 5657, 5659, 5660, 5662, 5663, 5664, 5665, 5666, 5670, 5671, 5675, 5676, 5677, 5683, 5689, 5690, 5694, 5695, 5697, 5698, 5702, 5703, 5705, 5706, 5709, 5711, 5717, 5718, 5721, 5722, 5731, 5734, 5735, 5739, 5744, 5751, 5752, 5753, 5754, 5756, 5757, 5763, 5768, 5770, 5771, 5775, 5779, 5780, 5784, 5785, 5788, 5791, 5794, 5803, 5805, 5806, 5808, 5809, 5810, 5813, 5820, 5826, 5833, 5834, 5835, 5836, 5837, 5846, 5850, 5852, 5853, 5854, 5857, 5859, 5861, 5864, 5865, 5866, 5867, 5869, 5870, 5872, 5876, 5879, 5880, 5881, 5883, 5884, 5886, 5887, 5888, 5892, 5893, 5907, 5912, 5922, 5925, 5926, 5927, 5928, 5932, 5934, 5936, 5938, 5941, 5944, 5948, 5954, 5956, 5959, 5967, 5968, 5975, 5978, 5979, 5980, 5982, 5987, 5988, 5991, 5994, 5996, 5997, 6000, 6002, 6004, 6006, 6008, 6009, 6013, 6017, 6018, 6023, 6024, 6025, 6026, 6031, 6038, 6041, 6043, 6044, 6048, 6051, 6058, 6059, 6062, 6068, 6069, 6072, 6073, 6075, 6080, 6081, 6084, 6085, 6086, 6087, 6088, 6089, 6090, 6092, 6093, 6097, 6098, 6099, 6107, 6108, 6109, 6110, 6113, 6116, 6118, 6119, 6120, 6124, 6129, 6131, 6132, 6133, 6136, 6137, 6138, 6139, 6143, 6145, 6146, 6147, 6148, 6149, 6151, 6153, 6157, 6160, 6162, 6163, 6164, 6165, 6181, 6183, 6184, 6186, 6188, 6189, 6194, 6195, 6196, 6198, 6203, 6204, 6205, 6209, 6220, 6223, 6224, 6226, 6227, 6228, 6230, 6231, 6233, 6234, 6237, 6239, 6242, 6243, 6246, 6247, 6250, 6251, 6262, 6264, 6265, 6267, 6270, 6272, 6273, 6275, 6281, 6282, 6286, 6292, 6295, 6296, 6297, 6299, 6300, 6303, 6309, 6311, 6315, 6317, 6319, 6322, 6323, 6325, 6328, 6333, 6338, 6342, 6343, 6344, 6349, 6353, 6354, 6356, 6360, 6365, 6367, 6370, 6372, 6375, 6376, 6381, 6383, 6386, 6394, 6397, 6399, 6403, 6404, 6405, 6408, 6412, 6414, 6415, 6416, 6417, 6419, 6420, 6422, 6425, 6426, 6427, 6428, 6429, 6430, 6431, 6436, 6440, 6449, 6456, 6463, 6464, 6466, 6467, 6470, 6474, 6476, 6478, 6480, 6482, 6484, 6485, 6488, 6494, 6501, 6502, 6504, 6505, 6510, 6512, 6513, 6514, 6516, 6517, 6519, 6528, 6530, 6531, 6532, 6534, 6537, 6541, 6543, 6545, 6547, 6549, 6553, 6555, 6558, 6559, 6564, 6567, 6571, 6572, 6574, 6576, 6577, 6579, 6581, 6584, 6587, 6588, 6589, 6592, 6594, 6595, 6597, 6599, 6600, 6603, 6607, 6609, 6610, 6615, 6616, 6617, 6620, 6623, 6625, 6628, 6629, 6633, 6634, 6635, 6639, 6640, 6646, 6647, 6649, 6655, 6656, 6658, 6661, 6662, 6666, 6671, 6672, 6690, 6693, 6699, 6703, 6704, 6705, 6706, 6716, 6718, 6720, 6729, 6730, 6734, 6736, 6739, 6742, 6747, 6749, 6756, 6757, 6759, 6764, 6766, 6767, 6777, 6779, 6782, 6783, 6786, 6792, 6793, 6794, 6795, 6797, 6799, 6801, 6803, 6804, 6805, 6807, 6810, 6811, 6813, 6815, 6816, 6817, 6819, 6820, 6821, 6824, 6826, 6827, 6828, 6830, 6831, 6834, 6836, 6840, 6841, 6842, 6843, 6848, 6851, 6863, 6869, 6875, 6876, 6877, 6878, 6880, 6881, 6884, 6886, 6887, 6888, 6894, 6902, 6903, 6906, 6907, 6909, 6913, 6914, 6917, 6919, 6920, 6921, 6924, 6925, 6930, 6936, 6939, 6946, 6950, 6952, 6954, 6955, 6959, 6960, 6963, 6967, 6971, 6979, 6980, 6981, 6984, 6985, 6987, 6988, 6990, 6991, 6994, 6997, 6999, 7009, 7010, 7013, 7018, 7022, 7029, 7038, 7039, 7040, 7043, 7045, 7046, 7049, 7051, 7052, 7053, 7054, 7057, 7064, 7067, 7077, 7079, 7083, 7084, 7085, 7093, 7094, 7096, 7105, 7106, 7107, 7108, 7110, 7117, 7118, 7119, 7122, 7124, 7126, 7129, 7130, 7138, 7139, 7142, 7143, 7144, 7150, 7151, 7154, 7163, 7164, 7165, 7166, 7169, 7170, 7171, 7172, 7176, 7182, 7184, 7192, 7194, 7195, 7196, 7197, 7198, 7201, 7202, 7206, 7207, 7208, 7210, 7212, 7215, 7217, 7219, 7220, 7224, 7227, 7228, 7230, 7231, 7234, 7235, 7236, 7244, 7245, 7246, 7249, 7250, 7255, 7257, 7258, 7262, 7263, 7264, 7267, 7268, 7270, 7274, 7276, 7281, 7282, 7287, 7291, 7292, 7293, 7296, 7298, 7299, 7300, 7301, 7303, 7304, 7305, 7306, 7307, 7311, 7312, 7313, 7315, 7318, 7320, 7323, 7328, 7331, 7339, 7344, 7345, 7350, 7351, 7356, 7357, 7358, 7360, 7361, 7365, 7369, 7371, 7376, 7377, 7380, 7382, 7383, 7386, 7392, 7398, 7400, 7406, 7409, 7410, 7411, 7417, 7418, 7425, 7430, 7434, 7435, 7436, 7438, 7447, 7448, 7450, 7452, 7453, 7454, 7457, 7458, 7464, 7466, 7470, 7472, 7475, 7481, 7483, 7486, 7490, 7492, 7493, 7497, 7499, 7502, 7503, 7506, 7512, 7514, 7515, 7521, 7522, 7523, 7524, 7533, 7538, 7544, 7546, 7561, 7572, 7574, 7576, 7579, 7583, 7585, 7586, 7589, 7596, 7598, 7599, 7604, 7605, 7609, 7612, 7619, 7622, 7624, 7625, 7633, 7638, 7640, 7642, 7643, 7647, 7649, 7652, 7655, 7656, 7658, 7661, 7662, 7664, 7665, 7671, 7674, 7678, 7679, 7680, 7682, 7686, 7687, 7689, 7695, 7697, 7700, 7703, 7712, 7715, 7716, 7724, 7726, 7727, 7730, 7734, 7736, 7737, 7738, 7741, 7742, 7744, 7745, 7746, 7749, 7750, 7753, 7763, 7764, 7768, 7770, 7772, 7774, 7775, 7779, 7781, 7786, 7788, 7791, 7793, 7798, 7799, 7800, 7801, 7803, 7804, 7806, 7807, 7818, 7819, 7820, 7822, 7823, 7825, 7833, 7834, 7839, 7840, 7841, 7844, 7845, 7850, 7854, 7856, 7860, 7865, 7873, 7877, 7878, 7880, 7881, 7885, 7887, 7888, 7890, 7893, 7896, 7907, 7908, 7909, 7910, 7911, 7913, 7918, 7923, 7925, 7928, 7934, 7935, 7936, 7937, 7938, 7942, 7944, 7946, 7949, 7952, 7965, 7966, 7967, 7972, 7973, 7974, 7976, 7977, 7984, 7986, 7988, 7992, 7996, 7999, 8006, 8007, 8012, 8020, 8021, 8023, 8024, 8030, 8031, 8035, 8036, 8041, 8042, 8044, 8045, 8048, 8052, 8053, 8056, 8059, 8063, 8068, 8072, 8074, 8076, 8077, 8078, 8079, 8080, 8081, 8083, 8084, 8088, 8090, 8091, 8093, 8100, 8102, 8106, 8110, 8112, 8113, 8118, 8123, 8126, 8129, 8130, 8141, 8147, 8148, 8150, 8151, 8155, 8163, 8164, 8170, 8178, 8179, 8181, 8189, 8191, 8193, 8194, 8202, 8204, 8208, 8210, 8213, 8217, 8219, 8220, 8223, 8234, 8235, 8237, 8239, 8241, 8242, 8248, 8250, 8252, 8253, 8263, 8264, 8265, 8268, 8269, 8272, 8273, 8274, 8282, 8289, 8291, 8300, 8304, 8308, 8310, 8311, 8315, 8318, 8319, 8322, 8329, 8339, 8340, 8341, 8347, 8350, 8351, 8353, 8367, 8368, 8371, 8373, 8378, 8379, 8380, 8385, 8387, 8389, 8392, 8393, 8395, 8396, 8397, 8401, 8402, 8403, 8404, 8405, 8406, 8410, 8413, 8414, 8415, 8416, 8417, 8418, 8427, 8430, 8436, 8438, 8439, 8440, 8442, 8443, 8444, 8445, 8447, 8448, 8449, 8450, 8451, 8457, 8458, 8459, 8465, 8470, 8472, 8473, 8474, 8476, 8477, 8481, 8482, 8483, 8485, 8486, 8490, 8498, 8501, 8502, 8503, 8505, 8507, 8509, 8513, 8515, 8516, 8517, 8520, 8521, 8523, 8524, 8525, 8526, 8527, 8528, 8532, 8533, 8541, 8542, 8543, 8553, 8554, 8557, 8561, 8562, 8565, 8566, 8574, 8575, 8576, 8577, 8579, 8581, 8582, 8585, 8592, 8594, 8596, 8597, 8598, 8600, 8601, 8602, 8603, 8605, 8609, 8611, 8612, 8622, 8624, 8631, 8634, 8638, 8641, 8642, 8644, 8648, 8658, 8659, 8663, 8665, 8669, 8672, 8675, 8676, 8677, 8685, 8686, 8689, 8690, 8693, 8695, 8699, 8700, 8703, 8705, 8706, 8708, 8709, 8713, 8717, 8720, 8722, 8726, 8729, 8731, 8736, 8741, 8743, 8744, 8746, 8748, 8750, 8755, 8761, 8763, 8765, 8769, 8770, 8772, 8773, 8774, 8777, 8779, 8783, 8784, 8785, 8786, 8789, 8792, 8795, 8802, 8803, 8810, 8818, 8821, 8822, 8824, 8828, 8829, 8830, 8831, 8833, 8834, 8835, 8836, 8841, 8843, 8845, 8846, 8853, 8865, 8866, 8874, 8875, 8876, 8877, 8878, 8881, 8888, 8889, 8892, 8896, 8900, 8901, 8907, 8908, 8911, 8916, 8917, 8919, 8922, 8924, 8926, 8929, 8930, 8935, 8937, 8938, 8941, 8945, 8946, 8948, 8951, 8953, 8960, 8961, 8967, 8968, 8971, 8979, 8980, 8981, 8985, 8986, 8991, 8992, 8996, 8998, 9001, 9006, 9009, 9011, 9012, 9013, 9018, 9022, 9026, 9027, 9029, 9030, 9033, 9045, 9050, 9052, 9056, 9057, 9058, 9059, 9060, 9068, 9069, 9071, 9072, 9076, 9078, 9084, 9086, 9087, 9088, 9091, 9092, 9095, 9096, 9103, 9104, 9105, 9106, 9107, 9112, 9114, 9115, 9116, 9118, 9123, 9125, 9129, 9131, 9133, 9134, 9138, 9139, 9140, 9141, 9142, 9144, 9145, 9152, 9154, 9155, 9159, 9175, 9177, 9179, 9180, 9185, 9190, 9191, 9194, 9195, 9205, 9206, 9207, 9210, 9211, 9213, 9215, 9216, 9220, 9223, 9226, 9229, 9233, 9237, 9243, 9244, 9248, 9249, 9253, 9257, 9259, 9262, 9265, 9267, 9269, 9270, 9273, 9275, 9282, 9284, 9285, 9287, 9288, 9290, 9292, 9295, 9300, 9304, 9306, 9308, 9311, 9313, 9314, 9320, 9321, 9323, 9326, 9328, 9332, 9336, 9339, 9346, 9347, 9350, 9352, 9359, 9360, 9366, 9371, 9375, 9376, 9382, 9391, 9392, 9394, 9399, 9400, 9402, 9403, 9404, 9406, 9407, 9411, 9412, 9413, 9414, 9415, 9421, 9422, 9423, 9425, 9429, 9439, 9440, 9443, 9449, 9451, 9453, 9456, 9460, 9467, 9471, 9472, 9473, 9474, 9475, 9476, 9481, 9484, 9488, 9490, 9497, 9500, 9503, 9504, 9509, 9514, 9517, 9518, 9519, 9520, 9522, 9534, 9536, 9537, 9538, 9540, 9543, 9546, 9550, 9551, 9553, 9555, 9560, 9567, 9568, 9571, 9573, 9577, 9586, 9587, 9590, 9591, 9595, 9596, 9597, 9598, 9601, 9602, 9606, 9607, 9609, 9614, 9615, 9617, 9618, 9620, 9621, 9623, 9624, 9626, 9629, 9630, 9632, 9633, 9635, 9640, 9649, 9651, 9652, 9653, 9655, 9657, 9658, 9663, 9666, 9668, 9670, 9682, 9686, 9688, 9698, 9701, 9710, 9711, 9715, 9718, 9721, 9722, 9723, 9724, 9725, 9726, 9727, 9729, 9730, 9731, 9732, 9733, 9737, 9742, 9744, 9745, 9746, 9750, 9751, 9754, 9763, 9764, 9770, 9772, 9774, 9776, 9782, 9786, 9787, 9791, 9792, 9794, 9798, 9799, 9804, 9808, 9809, 9810, 9811, 9812, 9813, 9819, 9820, 9827, 9828, 9833, 9835, 9845, 9847, 9850, 9866, 9869, 9873, 9875, 9878, 9879, 9882, 9886, 9887, 9889, 9891, 9892, 9900, 9907, 9909, 9910, 9911, 9912, 9923, 9924, 9928, 9932, 9934, 9935, 9938, 9940, 9946, 9949, 9950, 9952, 9953, 9960, 9962, 9963, 9967, 9968, 9973, 9974, 9975, 9976, 9979, 9980, 9982, 9984, 9985, 9987, 9988, 9990, 9991, 9992, 9996, 9997, 10000, 10008, 10015, 10017, 10018, 10019, 10020, 10021, 10026, 10027, 10032, 10033, 10034, 10035, 10037, 10041, 10044, 10049, 10051, 10052, 10053, 10054, 10055, 10058, 10059, 10060, 10062, 10064, 10072, 10073, 10075, 10077, 10078, 10080, 10081, 10083, 10091, 10092, 10095, 10097, 10101, 10103, 10106, 10109, 10110, 10115, 10116, 10117, 10122, 10128, 10129, 10131, 10135, 10138, 10143, 10151, 10158, 10160, 10163, 10165, 10166, 10168, 10174, 10176, 10178, 10181, 10184, 10192, 10193, 10194, 10195, 10196, 10199, 10206, 10212, 10218, 10219, 10220, 10221, 10222, 10223, 10224, 10225, 10228, 10231, 10233, 10236, 10237, 10239, 10240, 10247, 10249, 10252, 10253, 10254, 10255, 10259, 10262, 10263, 10269, 10270, 10275, 10276, 10284, 10286, 10291, 10292, 10293, 10295, 10300, 10302, 10306, 10307, 10311, 10312, 10314, 10318, 10319, 10321, 10323, 10325, 10326, 10327, 10331, 10333, 10334, 10335, 10336, 10340, 10341, 10343, 10346, 10353, 10356, 10357, 10364, 10371, 10375, 10378, 10380, 10384, 10393, 10397, 10398, 10399, 10401, 10405, 10410, 10411, 10413, 10414, 10416, 10417, 10419, 10421, 10423, 10424, 10425, 10426, 10435, 10436, 10438, 10440, 10446, 10447, 10448, 10449, 10450, 10451, 10452, 10453, 10456, 10460, 10463, 10464, 10465, 10468, 10469, 10471, 10474, 10479, 10480, 10482, 10487, 10490, 10494, 10496, 10506, 10508, 10514, 10518, 10521, 10522, 10523, 10526, 10527, 10528, 10530, 10531, 10532, 10536, 10537, 10541, 10542, 10543, 10544, 10548, 10555, 10556, 10563, 10564, 10567, 10569, 10573, 10580, 10581, 10583, 10584, 10588, 10593, 10596, 10597, 10599, 10601, 10602, 10603, 10604, 10608, 10613, 10615, 10616, 10617, 10621, 10622, 10636, 10637, 10638, 10639, 10640, 10645, 10646, 10651, 10652, 10655, 10657, 10665, 10668, 10670, 10676, 10678, 10679, 10682, 10683, 10684, 10685, 10700, 10701, 10705, 10707, 10711, 10715, 10716, 10721, 10722, 10726, 10729, 10734, 10738, 10740, 10741, 10744, 10747, 10748, 10749, 10752, 10753, 10754, 10756, 10762, 10766, 10768, 10769, 10770, 10775, 10778, 10779, 10781, 10782, 10785, 10787, 10788, 10790, 10792, 10795, 10799, 10801, 10802, 10803, 10804, 10805, 10809, 10810, 10811, 10812, 10815, 10818, 10819, 10820, 10822, 10823, 10824, 10827, 10831, 10833, 10836, 10837, 10838, 10839, 10843, 10850, 10851, 10852, 10853, 10854, 10857, 10858, 10860, 10866, 10867, 10877, 10880, 10886, 10887, 10897, 10898, 10899, 10901, 10902, 10911, 10913, 10918, 10920, 10924, 10926, 10927, 10928, 10929, 10930, 10933, 10934, 10938, 10940, 10941, 10945, 10947, 10960, 10962, 10965, 10966, 10967, 10972, 10976, 10977, 10979, 10988, 10993, 10996, 10999, 11008, 11015, 11017, 11021, 11022, 11023, 11024, 11027, 11030, 11032, 11033, 11036, 11037, 11039, 11040, 11044, 11046, 11047, 11050, 11051, 11052, 11053, 11056, 11058, 11060, 11063, 11066, 11067, 11078, 11081, 11082, 11083, 11090, 11095, 11100, 11107, 11111, 11114, 11118, 11122, 11124, 11129, 11133, 11136, 11137, 11138, 11147, 11148, 11149, 11151, 11152, 11153, 11154, 11160, 11162, 11163, 11165, 11168, 11169, 11177, 11178, 11179, 11180, 11181, 11184, 11187, 11188, 11190, 11191, 11192, 11193, 11194, 11198, 11203, 11204, 11208, 11214, 11216, 11217, 11218, 11222, 11224, 11226, 11227, 11228, 11229, 11230, 11231, 11233, 11235, 11236, 11237, 11238, 11239, 11242, 11243, 11246, 11247, 11253, 11254, 11255, 11256, 11258, 11260, 11262, 11263, 11266, 11290, 11292, 11293, 11294, 11295, 11297, 11298, 11302, 11304, 11305, 11306, 11313, 11315, 11316, 11318, 11321, 11330, 11331, 11337, 11338, 11340, 11346, 11348, 11349, 11358, 11359, 11362, 11363, 11364, 11365, 11371, 11373, 11377, 11379, 11380, 11382, 11385, 11387, 11388, 11391, 11394, 11395, 11398, 11401, 11404, 11405, 11406, 11416, 11417, 11424, 11430, 11431, 11435, 11436, 11438, 11439, 11440, 11443, 11446, 11447, 11449, 11451, 11456, 11459, 11461, 11465, 11466, 11472, 11478, 11487, 11489, 11490, 11491, 11496, 11497, 11498, 11499, 11500, 11505, 11506, 11507, 11513, 11520, 11521, 11523, 11524, 11526, 11527, 11531, 11532, 11533, 11534, 11540, 11541, 11544, 11548, 11550, 11551, 11553, 11558, 11560, 11561, 11562, 11567, 11568, 11570, 11571, 11576, 11577, 11578, 11585, 11586, 11588, 11593, 11594, 11595, 11596, 11597, 11599, 11603, 11604, 11607, 11611, 11612, 11615, 11617, 11618, 11623, 11625, 11628, 11634, 11639, 11640, 11647, 11650, 11656, 11658, 11659, 11663, 11669, 11673, 11677, 11678, 11681, 11682, 11688, 11691, 11692, 11694, 11695, 11696, 11699, 11701, 11703, 11705, 11707, 11712, 11718, 11721, 11725, 11730, 11731, 11733, 11736, 11737, 11740, 11743, 11744, 11753, 11756, 11759, 11760, 11761, 11762, 11763, 11765, 11770, 11771, 11776, 11777, 11781, 11782, 11785, 11786, 11789, 11792, 11794, 11797, 11799, 11800, 11802, 11804, 11809, 11810, 11811, 11812, 11814, 11818, 11820, 11821, 11826, 11829, 11830, 11840, 11846, 11848, 11851, 11854, 11856, 11858, 11861, 11863, 11864, 11865, 11868, 11870, 11872, 11876, 11877, 11881, 11886, 11889, 11891, 11892, 11894, 11898, 11899, 11901, 11906, 11909, 11911, 11913, 11914, 11915, 11916, 11917, 11918, 11919, 11920, 11921, 11923, 11926, 11927, 11928, 11929, 11930, 11934, 11940, 11943, 11945, 11947, 11948, 11949, 11950, 11953, 11956, 11957, 11958, 11959, 11960, 11961, 11962, 11963, 11965, 11966, 11973, 11974, 11975, 11976, 11977, 11978, 11979, 11980, 11983, 11988, 11989, 11993, 11997, 11998, 11999, 12004, 12008, 12014, 12017, 12019, 12020, 12021, 12023, 12024, 12026, 12027, 12032, 12033, 12043, 12044, 12052, 12059, 12068, 12080, 12081, 12083, 12091, 12092, 12093, 12095, 12098, 12102, 12104, 12106, 12109, 12110, 12112, 12114, 12118, 12122, 12126, 12128, 12129, 12130, 12134, 12137, 12138, 12139, 12141, 12143, 12145, 12146, 12147, 12149, 12151, 12161, 12166, 12170, 12171, 12174, 12175, 12176, 12181, 12183, 12185, 12197, 12204, 12207, 12208, 12215, 12217, 12218, 12219, 12221, 12227, 12234, 12240, 12243, 12245, 12249, 12250, 12252, 12253, 12255, 12256, 12259, 12260, 12263, 12267, 12268, 12269, 12271, 12274, 12278, 12281, 12283, 12284, 12286, 12287, 12291, 12293, 12295, 12299, 12304, 12311, 12312, 12313, 12314, 12315, 12317, 12321, 12323, 12324, 12326, 12329, 12331, 12333, 12334, 12347, 12354, 12356, 12358, 12359, 12364, 12367, 12368, 12370, 12372, 12374, 12379, 12380, 12381, 12383, 12385, 12391, 12397, 12400, 12403, 12404, 12405, 12406, 12410, 12411, 12414, 12416, 12419, 12420, 12421, 12424, 12425, 12427, 12437, 12439, 12440, 12445, 12447, 12451, 12454, 12455, 12456, 12457, 12459, 12462, 12465, 12467, 12468, 12470, 12472, 12473, 12478, 12481, 12482, 12487, 12488, 12489, 12491, 12495, 12497, 12499, 12500, 12503, 12504, 12505, 12508, 12510, 12511, 12514, 12521, 12530, 12536, 12539, 12545, 12546, 12547, 12549, 12555, 12556, 12559, 12561, 12563, 12564, 12565, 12567, 12568, 12572, 12574, 12585, 12588, 12591, 12597, 12605, 12606, 12608, 12609, 12611, 12616, 12619, 12623, 12626, 12629, 12631, 12633, 12634, 12636, 12638, 12639, 12641, 12649, 12651, 12655, 12663, 12668, 12670, 12671, 12672, 12679, 12680, 12681, 12682, 12684, 12685, 12691, 12693, 12695, 12698, 12699, 12701, 12702, 12705, 12706, 12713, 12714, 12715, 12718, 12719, 12722, 12731, 12732, 12733, 12737, 12738, 12739, 12741, 12742, 12743, 12748, 12751, 12754, 12755, 12758, 12760, 12761, 12762, 12764, 12766, 12771, 12772, 12773, 12778, 12783, 12788, 12790, 12794, 12797, 12800, 12801, 12802, 12805, 12808, 12810, 12812, 12813, 12817, 12819, 12820, 12822, 12824, 12826, 12827, 12828, 12834, 12835, 12836, 12838, 12839, 12843, 12844, 12847, 12849, 12850, 12853, 12856, 12861, 12866, 12873, 12875, 12882, 12883, 12887, 12888, 12895, 12898, 12899, 12900, 12904, 12905, 12906, 12910, 12913, 12914, 12916, 12917, 12918, 12920, 12921, 12926, 12929, 12932, 12933, 12938, 12939, 12940, 12941, 12942, 12944, 12945, 12946, 12947, 12966, 12968, 12969, 12972, 12973, 12976, 12978, 12982, 12983, 12984, 12985, 12987, 12990, 12991, 12996, 13006, 13007, 13010, 13011, 13014, 13017, 13018, 13022, 13023, 13024, 13030, 13032, 13033, 13035, 13038, 13040, 13041, 13049, 13050, 13053, 13054, 13055, 13056, 13057, 13060, 13061, 13064, 13065, 13066, 13067, 13071, 13074, 13075, 13077, 13079, 13085, 13086, 13087, 13095, 13100, 13101, 13102, 13105, 13106, 13112, 13114, 13115, 13116, 13117, 13118, 13120, 13123, 13124, 13131, 13135, 13142, 13147, 13148, 13149, 13151, 13152, 13169, 13174, 13175, 13181, 13182, 13185, 13197, 13199, 13205, 13206, 13209, 13210, 13212, 13213, 13215, 13217, 13221, 13222, 13224, 13227, 13230, 13232, 13234, 13235, 13236, 13237, 13238, 13239, 13240, 13243, 13249, 13251, 13255, 13258, 13259, 13260, 13261, 13263, 13264, 13268, 13269, 13273, 13276, 13279, 13280, 13281, 13285, 13291, 13293, 13296, 13297, 13298, 13301, 13303, 13304, 13313, 13315, 13317, 13318, 13319, 13320, 13321, 13323, 13326, 13328, 13330, 13332, 13337, 13338, 13343, 13345, 13346, 13348, 13353, 13354, 13361, 13367, 13369, 13370, 13373, 13381, 13384, 13385, 13388, 13391, 13393, 13394, 13396, 13397, 13401, 13402, 13408, 13416, 13417, 13419, 13423, 13424, 13429, 13430, 13433, 13439, 13444, 13448, 13449, 13451, 13454, 13456, 13460, 13463, 13466, 13468, 13469, 13472, 13473, 13475, 13490, 13492, 13494, 13496, 13499, 13500, 13503, 13504, 13505, 13506, 13510, 13513, 13514, 13515, 13516, 13517, 13519, 13520, 13521, 13530, 13532, 13540, 13543, 13544, 13545, 13546, 13547, 13549, 13552, 13556, 13559, 13568, 13569, 13574, 13580, 13582, 13583, 13584, 13587, 13597, 13599, 13601, 13602, 13603, 13604, 13612, 13621, 13623, 13628, 13631, 13632, 13634, 13636, 13637, 13641, 13647, 13650, 13652, 13654, 13660, 13661, 13662, 13663, 13668, 13671, 13675, 13677, 13679, 13684, 13687, 13688, 13693, 13695, 13698, 13700, 13702, 13703, 13706, 13713, 13715, 13716, 13720, 13721, 13725, 13727, 13728, 13729, 13730, 13739, 13745, 13748, 13750, 13753, 13756, 13761, 13764, 13767, 13768, 13769, 13772, 13773, 13775, 13776, 13779, 13781, 13782, 13786, 13787, 13789, 13791, 13792, 13793, 13794, 13796, 13798, 13809, 13816, 13817, 13818, 13819, 13820, 13822, 13823, 13828, 13830, 13831, 13833, 13834, 13835, 13843, 13849, 13852, 13853, 13859, 13860, 13862, 13866, 13869, 13870, 13872, 13873, 13874, 13877, 13881, 13882, 13883, 13888, 13891, 13892, 13894, 13897, 13898, 13901, 13904, 13906, 13908, 13909, 13910, 13911, 13913, 13917, 13919, 13925, 13927, 13930, 13933, 13938, 13944, 13947, 13948, 13949, 13952, 13954, 13956, 13961, 13963, 13965, 13969, 13970, 13975, 13976, 13981, 13983, 13984, 13990, 13991, 13999, 14000, 14009, 14010, 14013, 14014, 14017, 14018, 14022, 14026, 14030, 14031, 14036, 14041, 14043, 14049, 14050, 14051, 14052, 14062, 14063, 14066, 14067, 14069, 14070, 14071, 14073, 14075, 14086, 14088, 14091, 14092, 14093, 14094, 14096, 14100, 14105, 14106, 14110, 14112, 14116, 14118, 14120, 14122, 14124, 14125, 14128, 14129, 14130, 14132, 14133, 14134, 14135, 14137, 14138, 14139, 14142, 14143, 14145, 14146, 14148, 14149, 14150.

Promoters expressing in seed tissue at 1 day after planting include SEQ IDs: 1, 3, 4, 7, 11, 12, 13, 14, 15, 29, 31, 32, 34, 36, 48, 54, 64, 65, 68, 88, 93, 96, 97, 99, 102, 103, 107, 108, 110, 112, 121, 130, 131, 132, 139, 143, 148, 152, 156, 157, 159, 162, 164, 165, 174, 175, 176, 177, 179, 181, 183, 187, 194, 195, 196, 197, 199, 202, 203, 204, 205, 207, 210, 211, 215, 223, 231, 232, 235, 236, 237, 240, 242, 243, 244, 246, 248, 249, 250, 251, 257, 259, 262, 264, 271, 273, 274, 280, 281, 286, 288, 289, 291, 294, 299, 303, 305, 306, 309, 316, 319, 320, 323, 328, 329, 332, 335, 341, 346, 348, 349, 352, 354, 356, 357, 358, 360, 364, 365, 368, 371, 374, 379, 380, 387, 388, 401, 405, 406, 407, 419, 420, 423, 424, 428, 429, 433, 434, 436, 452, 454, 456, 461, 466, 468, 471, 473, 474, 478, 479, 481, 483, 484, 485, 488, 498, 501, 505, 509, 510, 512, 513, 514, 516, 517, 522, 523, 525, 529, 532, 533, 536, 538, 541, 544, 546, 547, 557, 560, 564, 565, 569, 574, 578, 585, 591, 593, 594, 595, 596, 598, 599, 601, 604, 605, 607, 611, 613, 614, 620, 623, 630, 631, 633, 635, 638, 641, 643, 644, 650, 662, 663, 665, 666, 670, 681, 683, 686, 693, 701, 705, 707, 708, 717, 719, 722, 724, 726, 727, 733, 734, 736, 739, 742, 744, 749, 753, 757, 759, 760, 761, 762, 763, 765, 768, 770, 771, 773, 782, 783, 784, 792, 793, 795, 797, 800, 804, 806, 808, 812, 813, 819, 820, 821, 823, 829, 830, 833, 836, 839, 840, 842, 844, 855, 857, 859, 860, 862, 863, 865, 868, 871, 872, 877, 884, 885, 887, 890, 891, 892, 893, 895, 898, 903, 907, 910, 911, 912, 913, 916, 917, 919, 920, 924, 928, 929, 931, 932, 936, 943, 944, 949, 951, 953, 954, 958, 959, 961, 962, 964, 966, 974, 979, 980, 981, 982, 987, 991, 993, 994, 995, 997, 999, 1003, 1006, 1009, 1011, 1014, 1017, 1022, 1026, 1028, 1032, 1035, 1038, 1042, 1043, 1045, 1047, 1049, 1050, 1051, 1052, 1055, 1056, 1064, 1065, 1069, 1072, 1073, 1077, 1078, 1085, 1086, 1087, 1088, 1089, 1092, 1095, 1101, 1103, 1104, 1108, 1110, 1111, 1112, 1114, 1115, 1117, 1119, 1120, 1122, 1125, 1127, 1130, 1132, 1133, 1136, 1137, 1144, 1146, 1148, 1154, 1162, 1165, 1170, 1171, 1174, 1176, 1178, 1187, 1189, 1190, 1191, 1193, 1196, 1199, 1200, 1202, 1204, 1205, 1213, 1214, 1218, 1219, 1220, 1223, 1225, 1227, 1228, 1230, 1231, 1233, 1236, 1239, 1240, 1241, 1244, 1248, 1250, 1252, 1253, 1254, 1256, 1257, 1258, 1264, 1265, 1272, 1281, 1282, 1285, 1286, 1291, 1293, 1295, 1297, 1298, 1306, 1309, 1312, 1316, 1317, 1320, 1321, 1325, 1327, 1330, 1331, 1334, 1339, 1349, 1351, 1354, 1355, 1360, 1364, 1368, 1371, 1373, 1376, 1377, 1380, 1382, 1388, 1396, 1398, 1402, 1403, 1404, 1405, 1407, 1409, 1410, 1412, 1415, 1420, 1421, 1423, 1426, 1431, 1436, 1439, 1440, 1441, 1442, 1448, 1451, 1453, 1454, 1455, 1459, 1466, 1467, 1468, 1474, 1475, 1481, 1486, 1488, 1490, 1493, 1498, 1499, 1503, 1513, 1514, 1518, 1525, 1526, 1527, 1530, 1539, 1543, 1545, 1546, 1548, 1549, 1556, 1560, 1566, 1567, 1568, 1571, 1575, 1576, 1578, 1584, 1586, 1590, 1592, 1593, 1594, 1595, 1599, 1600, 1602, 1604, 1605, 1608, 1609, 1612, 1614, 1615, 1616, 1625, 1628, 1629, 1634, 1635, 1637, 1638, 1648, 1650, 1658, 1662, 1663, 1668, 1669, 1671, 1673, 1675, 1676, 1677, 1680, 1683, 1685, 1688, 1689, 1691, 1705, 1706, 1707, 1708, 1709, 1710, 1712, 1717, 1721, 1725, 1729, 1731, 1732, 1735, 1740, 1750, 1755, 1758, 1761, 1764, 1768, 1771, 1776, 1778, 1779, 1782, 1784, 1785, 1815, 1816, 1820, 1830, 1832, 1839, 1840, 1845, 1849, 1850, 1852, 1858, 1859, 1865, 1867, 1869, 1870, 1872, 1873, 1883, 1886, 1888, 1893, 1894, 1895, 1897, 1898, 1899, 1900, 1901, 1902, 1903, 1904, 1905, 1906, 1911, 1917, 1918, 1920, 1923, 1924, 1936, 1940, 1944, 1945, 1950, 1953, 1955, 1981, 1990, 1991, 1993, 1994, 1995, 1996, 1999, 2000, 2007, 2008, 2009, 2010, 2012, 2013, 2014, 2015, 2017, 2026, 2031, 2032, 2033, 2039, 2041, 2043, 2048, 2060, 2062, 2064, 2066, 2072, 2074, 2077, 2081, 2082, 2083, 2088, 2089, 2094, 2096, 2097, 2099, 2103, 2104, 2112, 2119, 2122, 2126, 2132, 2133, 2134, 2136, 2139, 2140, 2142, 2143, 2144, 2147, 2150, 2152, 2154, 2155, 2156, 2157, 2159, 2161, 2162, 2163, 2164, 2165, 2166, 2168, 2170, 2172, 2173, 2177, 2178, 2179, 2185, 2191, 2193, 2196, 2201, 2202, 2203, 2206, 2215, 2216, 2221, 2222, 2225, 2226, 2232, 2235, 2240, 2244, 2253, 2257, 2260, 2262, 2263, 2273, 2274, 2282, 2283, 2288, 2291, 2293, 2295, 2296, 2298, 2303, 2304, 2305, 2306, 2309, 2314, 2322, 2323, 2328, 2329, 2331, 2333, 2339, 2342, 2348, 2349, 2351, 2352, 2353, 2361, 2362, 2363, 2371, 2379, 2381, 2382, 2384, 2385, 2398, 2401, 2403, 2405, 2410, 2411, 2412, 2413, 2418, 2419, 2420, 2422, 2423, 2431, 2435, 2437, 2438, 2439, 2441, 2442, 2443, 2445, 2451, 2452, 2453, 2465, 2470, 2472, 2474, 2476, 2479, 2481, 2482, 2483, 2490, 2492, 2494, 2495, 2496, 2498, 2500, 2504, 2505, 2507, 2509, 2510, 2511, 2514, 2515, 2516, 2517, 2525, 2528, 2529, 2531, 2532, 2533, 2536, 2537, 2538, 2539, 2541, 2542, 2543, 2549, 2552, 2554, 2555, 2556, 2557, 2567, 2568, 2573, 2578, 2581, 2583, 2588, 2589, 2590, 2592, 2594, 2599, 2601, 2605, 2609, 2613, 2616, 2617, 2618, 2625, 2627, 2632, 2634, 2636, 2637, 2639, 2641, 2644, 2655, 2663, 2671, 2674, 2675, 2684, 2685, 2687, 2689, 2691, 2700, 2702, 2707, 2712, 2715, 2718, 2719, 2723, 2725, 2726, 2729, 2740, 2742, 2746, 2747, 2749, 2752, 2755, 2756, 2757, 2770, 2775, 2780, 2782, 2784, 2787, 2800, 2801, 2802, 2805, 2812, 2820, 2821, 2823, 2824, 2826, 2827, 2829, 2831, 2832, 2840, 2844, 2850, 2858, 2861, 2862, 2864, 2865, 2866, 2871, 2873, 2876, 2888, 2890, 2898, 2901, 2902, 2903, 2905, 2909, 2910, 2911, 2915, 2916, 2917, 2919, 2923, 2926, 2930, 2932, 2933, 2934, 2935, 2938, 2944, 2948, 2953, 2955, 2959, 2962, 2963, 2966, 2968, 2976, 2979, 2980, 2985, 2992, 2993, 2994, 2998, 3002, 3003, 3005, 3007, 3008, 3014, 3015, 3016, 3023, 3038, 3039, 3042, 3043, 3044, 3048, 3049, 3051, 3052, 3053, 3055, 3062, 3064, 3070, 3072, 3078, 3080, 3081, 3083, 3084, 3085, 3087, 3088, 3095, 3096, 3100, 3105, 3106, 3109, 3114, 3118, 3119, 3120, 3121, 3123, 3126, 3127, 3128, 3137, 3138, 3139, 3143, 3147, 3153, 3156, 3170, 3173, 3181, 3185, 3191, 3192, 3194, 3204, 3205, 3206, 3210, 3212, 3214, 3219, 3220, 3224, 3225, 3228, 3236, 3239, 3240, 3244, 3246, 3250, 3252, 3255, 3260, 3261, 3263, 3266, 3268, 3271, 3272, 3278, 3280, 3283, 3286, 3288, 3290, 3291, 3294, 3295, 3296, 3297, 3299, 3301, 3303, 3312, 3324, 3331, 3332, 3333, 3340, 3343, 3345, 3347, 3349, 3351, 3353, 3355, 3357, 3358, 3359, 3360, 3361, 3363, 3370, 3374, 3376, 3377, 3379, 3380, 3383, 3386, 3397, 3399, 3404, 3405, 3415, 3416, 3418, 3419, 3422, 3424, 3426, 3428, 3435, 3438, 3441, 3442, 3445, 3446, 3447, 3450, 3452, 3455, 3458, 3460, 3461, 3464, 3465, 3466, 3468, 3470, 3471, 3473, 3474, 3475, 3477, 3482, 3483, 3486, 3488, 3491, 3494, 3496, 3503, 3504, 3506, 3510, 3511, 3516, 3517, 3518, 3531, 3533, 3536, 3537, 3541, 3544, 3545, 3548, 3549, 3552, 3554, 3558, 3560, 3562, 3563, 3569, 3572, 3574, 3576, 3577, 3587, 3588, 3589, 3592, 3595, 3596, 3597, 3600, 3603, 3604, 3606, 3607, 3611, 3612, 3613, 3616, 3618, 3620, 3621, 3624, 3629, 3633, 3635, 3637, 3638, 3640, 3642, 3643, 3644, 3645, 3646, 3647, 3648, 3655, 3657, 3659, 3660, 3662, 3667, 3671, 3672, 3674, 3677, 3682, 3684, 3685, 3693, 3707, 3713, 3715, 3717, 3718, 3719, 3720, 3725, 3738, 3739, 3748, 3749, 3752, 3754, 3757, 3761, 3762, 3764, 3765, 3766, 3777, 3778, 3783, 3788, 3790, 3791, 3792, 3794, 3796, 3798, 3800, 3804, 3808, 3809, 3818, 3820, 3823, 3825, 3828, 3829, 3830, 3831, 3832, 3833, 3839, 3842, 3843, 3844, 3845, 3847, 3849, 3858, 3860, 3862, 3867, 3868, 3871, 3872, 3873, 3876, 3882, 3883, 3885, 3887, 3889, 3890, 3891, 3892, 3893, 3894, 3895, 3908, 3910, 3911, 3912, 3914, 3917, 3924, 3928, 3929, 3938, 3947, 3950, 3954, 3958, 3962, 3967, 3975, 3983, 3985, 3987, 3988, 3994, 3997, 4001, 4002, 4003, 4006, 4008, 4013, 4014, 4021, 4024, 4030, 4032, 4033, 4034, 4037, 4039, 4040, 4041, 4046, 4048, 4051, 4052, 4054, 4056, 4057, 4062, 4066, 4067, 4068, 4069, 4072, 4074, 4075, 4079, 4081, 4092, 4096, 4099, 4102, 4105, 4108, 4109, 4110, 4113, 4116, 4122, 4124, 4128, 4133, 4139, 4143, 4146, 4148, 4149, 4150, 4156, 4158, 4160, 4161, 4162, 4163, 4165, 4166, 4170, 4171, 4175, 4178, 4184, 4185, 4187, 4188, 4189, 4197, 4198, 4201, 4202, 4205, 4206, 4208, 4210, 4211, 4212, 4214, 4217, 4219, 4221, 4227, 4228, 4231, 4233, 4235, 4244, 4246, 4250, 4251, 4255, 4257, 4260, 4261, 4263, 4266, 4270, 4272, 4275, 4279, 4281, 4283, 4288, 4292, 4295, 4296, 4298, 4301, 4302, 4304, 4309, 4312, 4320, 4321, 4324, 4329, 4330, 4331, 4335, 4336, 4337, 4338, 4341, 4344, 4347, 4349, 4352, 4354, 4355, 4357, 4359, 4360, 4365, 4369, 4371, 4373, 4378, 4380, 4383, 4388, 4390, 4391, 4394, 4397, 4401, 4402, 4403, 4404, 4405, 4410, 4415, 4422, 4423, 4426, 4439, 4443, 4444, 4446, 4448, 4450, 4453, 4456, 4458, 4460, 4461, 4462, 4463, 4464, 4468, 4472, 4474, 4475, 4479, 4485, 4491, 4492, 4494, 4502, 4506, 4507, 4512, 4514, 4515, 4518, 4519, 4522, 4528, 4531, 4535, 4545, 4548, 4549, 4551, 4554, 4555, 4556, 4557, 4558, 4562, 4565, 4566, 4567, 4570, 4575, 4580, 4582, 4583, 4584, 4586, 4590, 4591, 4596, 4604, 4606, 4611, 4618, 4621, 4625, 4630, 4632, 4633, 4634, 4635, 4641, 4643, 4644, 4645, 4650, 4659, 4667, 4669, 4671, 4676, 4677, 4680, 4682, 4684, 4685, 4687, 4692, 4697, 4699, 4700, 4702, 4704, 4706, 4708, 4710, 4719, 4721, 4723, 4725, 4729, 4737, 4738, 4740, 4747, 4748, 4749, 4750, 4751, 4753, 4754, 4755, 4756, 4759, 4761, 4762, 4763, 4765, 4771, 4775, 4779, 4789, 4790, 4791, 4794, 4795, 4803, 4804, 4813, 4814, 4817, 4818, 4823, 4824, 4828, 4829, 4830, 4831, 4832, 4833, 4834, 4835, 4836, 4837, 4838, 4842, 4856, 4857, 4859, 4861, 4862, 4864, 4868, 4869, 4872, 4875, 4877, 4878, 4880, 4881, 4887, 4889, 4890, 4891, 4895, 4901, 4902, 4905, 4909, 4914, 4915, 4918, 4920, 4921, 4922, 4923, 4924, 4925, 4926, 4930, 4935, 4936, 4939, 4940, 4943, 4944, 4950, 4955, 4960, 4965, 4971, 4972, 4975, 4977, 4979, 4980, 4984, 4987, 4988, 4989, 4990, 4994, 4996, 5000, 5005, 5010, 5015, 5026, 5029, 5030, 5034, 5038, 5039, 5040, 5042, 5044, 5046, 5049, 5052, 5054, 5057, 5059, 5063, 5067, 5068, 5072, 5078, 5079, 5082, 5087, 5088, 5089, 5091, 5094, 5100, 5102, 5106, 5111, 5114, 5123, 5129, 5131, 5132, 5136, 5137, 5140, 5143, 5145, 5147, 5149, 5151, 5152, 5153, 5157, 5160, 5164, 5165, 5168, 5170, 5171, 5174, 5180, 5181, 5182, 5185, 5188, 5189, 5190, 5191, 5192, 5196, 5198, 5200, 5203, 5206, 5208, 5211, 5212, 5217, 5219, 5225, 5226, 5228, 5229, 5230, 5234, 5239, 5240, 5241, 5243, 5248, 5249, 5251, 5253, 5255, 5258, 5263, 5264, 5265, 5266, 5267, 5268, 5273, 5275, 5276, 5280, 5281, 5283, 5286, 5289, 5290, 5292, 5293, 5298, 5299, 5300, 5301, 5303, 5308, 5311, 5313, 5317, 5319, 5321, 5324, 5329, 5330, 5334, 5338, 5339, 5344, 5346, 5348, 5350, 5351, 5359, 5360, 5361, 5363, 5364, 5372, 5382, 5383, 5386, 5388, 5389, 5393, 5394, 5395, 5396, 5397, 5398, 5403, 5407, 5409, 5411, 5413, 5414, 5417, 5426, 5431, 5434, 5439, 5448, 5449, 5450, 5451, 5452, 5456, 5457, 5458, 5459, 5463, 5464, 5467, 5472, 5474, 5476, 5479, 5482, 5483, 5491, 5493, 5495, 5496, 5498, 5506, 5508, 5510, 5512, 5513, 5515, 5516, 5517, 5518, 5519, 5520, 5521, 5524, 5529, 5530, 5531, 5534, 5535, 5537, 5547, 5557, 5561, 5562, 5563, 5568, 5569, 5579, 5585, 5588, 5589, 5591, 5592, 5597, 5598, 5604, 5608, 5612, 5613, 5615, 5616, 5618, 5627, 5631, 5632, 5633, 5635, 5638, 5640, 5642, 5643, 5647, 5648, 5651, 5652, 5657, 5660, 5662, 5663, 5675, 5676, 5677, 5680, 5689, 5694, 5695, 5697, 5698, 5702, 5703, 5706, 5709, 5711, 5717, 5718, 5721, 5722, 5731, 5734, 5735, 5739, 5744, 5751, 5756, 5763, 5768, 5771, 5775, 5780, 5784, 5785, 5786, 5789, 5791, 5794, 5803, 5807, 5808, 5809, 5811, 5813, 5817, 5820, 5823, 5828, 5831, 5833, 5835, 5836, 5837, 5839, 5850, 5852, 5853, 5854, 5855, 5859, 5861, 5864, 5865, 5866, 5867, 5868, 5869, 5870, 5872, 5875, 5876, 5879, 5881, 5883, 5884, 5888, 5890, 5892, 5893, 5907, 5912, 5919, 5922, 5923, 5925, 5926, 5927, 5928, 5932, 5934, 5935, 5936, 5938, 5941, 5944, 5948, 5954, 5956, 5959, 5967, 5968, 5971, 5982, 5987, 5988, 5989, 5991, 5996, 6000, 6002, 6004, 6006, 6009, 6013, 6016, 6017, 6023, 6024, 6025, 6026, 6038, 6041, 6044, 6047, 6048, 6051, 6058, 6059, 6062, 6063, 6065, 6068, 6069, 6070, 6072, 6073, 6074, 6075, 6081, 6085, 6087, 6088, 6089, 6092, 6093, 6097, 6098, 6099, 6107, 6108, 6109, 6110, 6113, 6119, 6120, 6124, 6129, 6131, 6132, 6133, 6137, 6138, 6143, 6145, 6146, 6151, 6157, 6158, 6162, 6163, 6164, 6165, 6176, 6181, 6183, 6186, 6188, 6189, 6193, 6194, 6195, 6196, 6197, 6198, 6204, 6205, 6215, 6220, 6223, 6224, 6227, 6228, 6234, 6243, 6246, 6247, 6250, 6251, 6264, 6265, 6267, 6270, 6272, 6273, 6275, 6281, 6282, 6286, 6289, 6292, 6295, 6297, 6299, 6300, 6303, 6309, 6310, 6311, 6315, 6317, 6319, 6321, 6322, 6328, 6333, 6338, 6342, 6343, 6344, 6353, 6354, 6356, 6360, 6362, 6363, 6365, 6367, 6370, 6375, 6383, 6386, 6394, 6397, 6399, 6400, 6403, 6404, 6405, 6408, 6412, 6414, 6415, 6419, 6420, 6425, 6426, 6428, 6429, 6430, 6431, 6436, 6440, 6442, 6456, 6463, 6464, 6466, 6467, 6468, 6470, 6472, 6474, 6475, 6476, 6478, 6480, 6482, 6484, 6485, 6488, 6494, 6495, 6501, 6502, 6504, 6510, 6512, 6513, 6516, 6519, 6530, 6533, 6534, 6537, 6539, 6543, 6544, 6545, 6547, 6549, 6553, 6555, 6558, 6559, 6567, 6569, 6571, 6572, 6574, 6576, 6577, 6579, 6584, 6588, 6589, 6592, 6594, 6595, 6597, 6599, 6600, 6603, 6606, 6607, 6609, 6611, 6617, 6620, 6623, 6625, 6629, 6633, 6635, 6638, 6639, 6640, 6644, 6646, 6647, 6649, 6655, 6656, 6658, 6661, 6666, 6671, 6672, 6682, 6686, 6703, 6704, 6705, 6706, 6716, 6718, 6720, 6729, 6730, 6734, 6736, 6739, 6742, 6747, 6749, 6756, 6757, 6759, 6764, 6767, 6778, 6779, 6782, 6783, 6793, 6794, 6795, 6797, 6799, 6803, 6804, 6805, 6807, 6810, 6811, 6813, 6816, 6817, 6819, 6820, 6821, 6824, 6826, 6827, 6828, 6830, 6831, 6834, 6836, 6841, 6842, 6843, 6848, 6851, 6859, 6861, 6863, 6868, 6869, 6875, 6877, 6879, 6880, 6881, 6882, 6883, 6884, 6888, 6894, 6897, 6902, 6903, 6904, 6907, 6914, 6917, 6919, 6920, 6921, 6925, 6930, 6932, 6939, 6946, 6959, 6960, 6963, 6967, 6970, 6971, 6979, 6980, 6981, 6984, 6985, 6987, 6988, 6990, 6991, 6994, 6997, 6999, 7003, 7010, 7013, 7022, 7027, 7029, 7033, 7038, 7039, 7043, 7045, 7046, 7049, 7051, 7052, 7053, 7057, 7059, 7060, 7062, 7064, 7067, 7072, 7073, 7075, 7077, 7079, 7083, 7084, 7094, 7105, 7106, 7107, 7108, 7110, 7112, 7113, 7117, 7118, 7128, 7130, 7138, 7139, 7142, 7143, 7144, 7150, 7151, 7154, 7163, 7164, 7165, 7166, 7169, 7172, 7182, 7184, 7191, 7192, 7194, 7196, 7197, 7201, 7202, 7206, 7207, 7208, 7210, 7212, 7214, 7217, 7219, 7227, 7228, 7230, 7235, 7236, 7244, 7245, 7246, 7255, 7257, 7258, 7262, 7263, 7264, 7267, 7268, 7274, 7276, 7281, 7282, 7287, 7291, 7292, 7293, 7296, 7299, 7300, 7301, 7303, 7304, 7306, 7307, 7308, 7311, 7312, 7313, 7318, 7328, 7330, 7339, 7340, 7344, 7345, 7350, 7351, 7357, 7358, 7360, 7361, 7365, 7369, 7371, 7373, 7376, 7377, 7382, 7383, 7386, 7396, 7398, 7399, 7400, 7406, 7409, 7418, 7425, 7430, 7434, 7436, 7437, 7438, 7447, 7448, 7452, 7453, 7454, 7457, 7458, 7459, 7462, 7466, 7470, 7472, 7476, 7481, 7490, 7492, 7493, 7498, 7499, 7503, 7504, 7506, 7512, 7514, 7515, 7517, 7521, 7523, 7524, 7525, 7533, 7538, 7546, 7547, 7556, 7559, 7561, 7574, 7576, 7579, 7583, 7585, 7586, 7589, 7596, 7604, 7609, 7619, 7620, 7622, 7624, 7625, 7633, 7642, 7643, 7644, 7649, 7658, 7661, 7664, 7665, 7671, 7672, 7673, 7674, 7682, 7687, 7689, 7695, 7700, 7703, 7707, 7712, 7715, 7716, 7724, 7726, 7736, 7737, 7738, 7741, 7742, 7744, 7745, 7749, 7763, 7764, 7768, 7770, 7772, 7774, 7775, 7776, 7777, 7778, 7779, 7780, 7781, 7785, 7786, 7787, 7788, 7791, 7793, 7798, 7799, 7800, 7801, 7803, 7804, 7805, 7806, 7807, 7818, 7819, 7820, 7823, 7825, 7826, 7839, 7840, 7841, 7844, 7845, 7850, 7854, 7856, 7865, 7873, 7877, 7878, 7880, 7881, 7887, 7888, 7890, 7908, 7911, 7918, 7923, 7925, 7928, 7933, 7934, 7935, 7938, 7942, 7944, 7949, 7952, 7973, 7974, 7976, 7977, 7981, 7983, 7984, 7986, 7996, 8004, 8007, 8012, 8021, 8024, 8025, 8029, 8030, 8031, 8036, 8040, 8042, 8043, 8044, 8047, 8048, 8053, 8056, 8059, 8061, 8063, 8068, 8075, 8076, 8077, 8078, 8079, 8080, 8081, 8083, 8084, 8088, 8091, 8093, 8095, 8100, 8102, 8106, 8110, 8112, 8113, 8118, 8121, 8123, 8126, 8129, 8130, 8134, 8141, 8145, 8146, 8147, 8148, 8150, 8159, 8163, 8164, 8170, 8178, 8179, 8181, 8189, 8193, 8194, 8202, 8204, 8208, 8210, 8213, 8217, 8219, 8220, 8223, 8227, 8230, 8234, 8235, 8237, 8239, 8241, 8242, 8247, 8248, 8250, 8252, 8253, 8263, 8264, 8265, 8266, 8268, 8269, 8270, 8272, 8273, 8276, 8282, 8289, 8291, 8292, 8296, 8300, 8304, 8310, 8311, 8312, 8315, 8318, 8319, 8320, 8329, 8339, 8340, 8347, 8349, 8350, 8351, 8353, 8358, 8367, 8368, 8373, 8379, 8380, 8382, 8385, 8386, 8387, 8389, 8392, 8393, 8395, 8401, 8404, 8406, 8407, 8410, 8413, 8414, 8415, 8416, 8417, 8418, 8430, 8436, 8438, 8439, 8443, 8444, 8445, 8447, 8448, 8449, 8450, 8451, 8458, 8459, 8465, 8470, 8472, 8473, 8474, 8476, 8477, 8481, 8482, 8486, 8490, 8496, 8498, 8501, 8503, 8504, 8505, 8507, 8511, 8513, 8515, 8516, 8521, 8524, 8526, 8527, 8528, 8531, 8532, 8533, 8539, 8542, 8543, 8553, 8554, 8561, 8562, 8565, 8568, 8574, 8575, 8576, 8579, 8581, 8582, 8592, 8593, 8594, 8596, 8597, 8600, 8602, 8603, 8604, 8605, 8609, 8611, 8612, 8621, 8631, 8634, 8635, 8638, 8639, 8641, 8642, 8644, 8646, 8648, 8650, 8652, 8654, 8659, 8660, 8663, 8665, 8669, 8672, 8673, 8674, 8676, 8677, 8685, 8686, 8690, 8693, 8695, 8699, 8700, 8703, 8706, 8708, 8709, 8713, 8717, 8719, 8722, 8726, 8729, 8731, 8736, 8741, 8743, 8744, 8747, 8748, 8757, 8761, 8773, 8774, 8777, 8779, 8783, 8784, 8785, 8786, 8789, 8792, 8803, 8808, 8810, 8811, 8821, 8822, 8824, 8829, 8830, 8833, 8834, 8839, 8841, 8842, 8843, 8846, 8853, 8865, 8874, 8876, 8877, 8878, 8881, 8888, 8892, 8896, 8901, 8907, 8908, 8911, 8916, 8917, 8919, 8922, 8924, 8926, 8929, 8930, 8935, 8937, 8938, 8941, 8945, 8946, 8949, 8951, 8953, 8960, 8961, 8967, 8968, 8972, 8979, 8980, 8981, 8985, 8986, 8991, 8992, 8998, 8999, 9006, 9009, 9011, 9012, 9015, 9020, 9022, 9026, 9027, 9029, 9030, 9045, 9052, 9058, 9059, 9060, 9063, 9065, 9066, 9069, 9071, 9072, 9073, 9076, 9078, 9080, 9087, 9088, 9092, 9097, 9103, 9104, 9106, 9107, 9112, 9114, 9118, 9120, 9123, 9125, 9129, 9131, 9133, 9134, 9139, 9140, 9141, 9142, 9144, 9145, 9147, 9152, 9154, 9155, 9167, 9168, 9175, 9177, 9180, 9185, 9189, 9190, 9191, 9195, 9206, 9207, 9213, 9214, 9216, 9218, 9223, 9226, 9229, 9231, 9233, 9237, 9240, 9243, 9246, 9248, 9249, 9253, 9257, 9259, 9267, 9269, 9270, 9273, 9275, 9276, 9282, 9284, 9285, 9288, 9290, 9291, 9292, 9293, 9296, 9300, 9304, 9308, 9311, 9320, 9321, 9322, 9323, 9326, 9328, 9332, 9336, 9338, 9339, 9340, 9341, 9346, 9347, 9350, 9352, 9353, 9359, 9360, 9366, 9371, 9373, 9375, 9376, 9380, 9382, 9391, 9392, 9393, 9394, 9399, 9400, 9402, 9403, 9406, 9407, 9413, 9414, 9421, 9423, 9429, 9434, 9438, 9439, 9440, 9443, 9449, 9451, 9452, 9456, 9460, 9464, 9468, 9471, 9472, 9473, 9474, 9475, 9476, 9481, 9482, 9488, 9490, 9500, 9504, 9509, 9514, 9517, 9518, 9525, 9534, 9536, 9537, 9540, 9545, 9546, 9550, 9551, 9553, 9555, 9564, 9571, 9573, 9574, 9577, 9587, 9590, 9591, 9593, 9595, 9596, 9597, 9598, 9601, 9602, 9606, 9607, 9609, 9614, 9615, 9617, 9618, 9620, 9621, 9623, 9626, 9627, 9629, 9632, 9633, 9641, 9642, 9644, 9645, 9648, 9652, 9655, 9658, 9663, 9666, 9668, 9670, 9671, 9674, 9679, 9682, 9686, 9698, 9699, 9701, 9706, 9710, 9711, 9715, 9721, 9723, 9726, 9727, 9729, 9730, 9731, 9732, 9733, 9734, 9737, 9742, 9746, 9750, 9756, 9763, 9764, 9768, 9770, 9774, 9776, 9777, 9782, 9786, 9791, 9792, 9793, 9794, 9799, 9804, 9808, 9810, 9811, 9812, 9813, 9816, 9819, 9820, 9821, 9825, 9828, 9829, 9830, 9847, 9861, 9869, 9873, 9878, 9882, 9886, 9887, 9892, 9900, 9907, 9909, 9910, 9912, 9921, 9923, 9924, 9928, 9930, 9932, 9935, 9938, 9940, 9944, 9946, 9949, 9950, 9952, 9953, 9960, 9962, 9963, 9967, 9968, 9969, 9972, 9973, 9975, 9976, 9980, 9982, 9984, 9985, 9987, 9988, 9990, 9991, 9992, 9997, 10000, 10012, 10017, 10018, 10019, 10020, 10026, 10027, 10032, 10033, 10034, 10035, 10037, 10047, 10049, 10051, 10053, 10055, 10058, 10059, 10062, 10064, 10066, 10072, 10073, 10075, 10077, 10078, 10080, 10081, 10083, 10091, 10092, 10094, 10095, 10101, 10103, 10106, 10110, 10115, 10116, 10117, 10122, 10127, 10128, 10129, 10131, 10132, 10136, 10140, 10143, 10151, 10158, 10160, 10163, 10165, 10166, 10168, 10174, 10176, 10178, 10181, 10187, 10191, 10192, 10193, 10194, 10195, 10196, 10199, 10206, 10212, 10217, 10218, 10219, 10220, 10222, 10223, 10224, 10225, 10231, 10233, 10236, 10237, 10239, 10247, 10249, 10252, 10253, 10254, 10259, 10262, 10263, 10269, 10270, 10275, 10278, 10284, 10286, 10291, 10292, 10293, 10295, 10300, 10302, 10306, 10307, 10311, 10312, 10314, 10318, 10322, 10323, 10324, 10325, 10326, 10331, 10333, 10334, 10336, 10340, 10341, 10343, 10346, 10353, 10356, 10357, 10364, 10371, 10374, 10375, 10378, 10380, 10385, 10388, 10393, 10397, 10398, 10399, 10401, 10408, 10410, 10411, 10414, 10416, 10417, 10421, 10423, 10425, 10426, 10435, 10436, 10438, 10440, 10446, 10450, 10452, 10453, 10456, 10460, 10463, 10464, 10465, 10468, 10469, 10471, 10474, 10480, 10482, 10487, 10488, 10490, 10494, 10496, 10499, 10506, 10508, 10518, 10522, 10523, 10524, 10527, 10528, 10530, 10531, 10532, 10536, 10537, 10541, 10542, 10543, 10544, 10547, 10548, 10555, 10556, 10558, 10562, 10563, 10567, 10569, 10573, 10579, 10580, 10581, 10582, 10583, 10584, 10588, 10593, 10596, 10599, 10601, 10602, 10611, 10613, 10615, 10616, 10621, 10622, 10625, 10636, 10637, 10638, 10639, 10640, 10645, 10646, 10655, 10665, 10668, 10670, 10671, 10676, 10678, 10679, 10682, 10683, 10684, 10685, 10686, 10687, 10698, 10700, 10701, 10705, 10707, 10715, 10716, 10721, 10722, 10724, 10725, 10726, 10729, 10732, 10734, 10738, 10740, 10741, 10744, 10747, 10748, 10749, 10752, 10753, 10756, 10762, 10766, 10770, 10772, 10775, 10776, 10777, 10778, 10779, 10784, 10785, 10787, 10788, 10790, 10792, 10801, 10802, 10803, 10804, 10805, 10809, 10810, 10815, 10818, 10819, 10822, 10823, 10824, 10827, 10831, 10833, 10836, 10838, 10840, 10843, 10844, 10850, 10851, 10852, 10853, 10854, 10857, 10858, 10860, 10866, 10867, 10870, 10877, 10880, 10888, 10889, 10898, 10899, 10901, 10902, 10917, 10918, 10920, 10926, 10927, 10928, 10929, 10930, 10933, 10934, 10938, 10940, 10941, 10947, 10965, 10966, 10967, 10972, 10976, 10977, 10978, 10979, 10985, 10988, 10993, 10996, 10999, 11008, 11009, 11015, 11021, 11022, 11024, 11027, 11030, 11032, 11036, 11037, 11039, 11046, 11047, 11052, 11053, 11056, 11058, 11060, 11063, 11066, 11067, 11078, 11082, 11083, 11090, 11095, 11100, 11103, 11107, 11110, 11114, 11117, 11118, 11123, 11126, 11128, 11129, 11133, 11136, 11137, 11138, 11141, 11145, 11147, 11149, 11152, 11153, 11154, 11160, 11161, 11163, 11165, 11168, 11169, 11172, 11173, 11177, 11181, 11187, 11188, 11190, 11192, 11193, 11194, 11198, 11204, 11214, 11217, 11218, 11222, 11226, 11227, 11230, 11233, 11235, 11236, 11238, 11239, 11242, 11243, 11246, 11247, 11251, 11253, 11254, 11255, 11256, 11258, 11260, 11262, 11263, 11266, 11274, 11290, 11292, 11293, 11295, 11297, 11299, 11304, 11305, 11306, 11313, 11315, 11318, 11330, 11331, 11337, 11338, 11340, 11345, 11346, 11348, 11349, 11356, 11358, 11363, 11364, 11365, 11370, 11371, 11373, 11377, 11380, 11382, 11387, 11388, 11391, 11392, 11394, 11395, 11401, 11404, 11405, 11417, 11424, 11427, 11430, 11431, 11435, 11438, 11439, 11440, 11443, 11446, 11449, 11456, 11459, 11461, 11465, 11466, 11472, 11475, 11477, 11478, 11487, 11488, 11489, 11490, 11491, 11496, 11497, 11498, 11499, 11500, 11501, 11505, 11506, 11507, 11520, 11523, 11524, 11526, 11527, 11530, 11531, 11532, 11533, 11540, 11541, 11544, 11548, 11551, 11553, 11558, 11560, 11561, 11567, 11568, 11570, 11576, 11577, 11578, 11585, 11588, 11593, 11594, 11595, 11596, 11597, 11599, 11604, 11607, 11611, 11612, 11615, 11617, 11618, 11623, 11628, 11639, 11640, 11647, 11650, 11656, 11658, 11659, 11665, 11669, 11673, 11678, 11682, 11688, 11691, 11692, 11694, 11695, 11696, 11699, 11701, 11703, 11705, 11707, 11712, 11718, 11720, 11721, 11725, 11726, 11730, 11731, 11733, 11736, 11740, 11743, 11744, 11753, 11756, 11759, 11760, 11762, 11763, 11765, 11770, 11771, 11776, 11777, 11778, 11781, 11785, 11786, 11788, 11789, 11792, 11794, 11799, 11800, 11805, 11806, 11809, 11810, 11811, 11812, 11814, 11818, 11826, 11828, 11829, 11830, 11839, 11846, 11848, 11851, 11856, 11858, 11861, 11864, 11865, 11868, 11870, 11872, 11876, 11877, 11879, 11889, 11891, 11892, 11894, 11898, 11901, 11906, 11909, 11911, 11913, 11914, 11916, 11917, 11919, 11920, 11921, 11922, 11923, 11924, 11926, 11928, 11929, 11930, 11934, 11940, 11943, 11945, 11947, 11953, 11955, 11956, 11958, 11959, 11960, 11961, 11962, 11963, 11965, 11966, 11968, 11973, 11974, 11976, 11977, 11978, 11979, 11983, 11988, 11989, 11993, 11997, 11998, 11999, 12004, 12021, 12023, 12024, 12026, 12032, 12033, 12042, 12043, 12044, 12052, 12059, 12060, 12068, 12076, 12077, 12081, 12083, 12087, 12092, 12093, 12095, 12098, 12102, 12104, 12106, 12109, 12110, 12112, 12118, 12122, 12126, 12128, 12129, 12130, 12137, 12139, 12140, 12143, 12145, 12146, 12147, 12149, 12151, 12161, 12165, 12166, 12167, 12170, 12171, 12174, 12175, 12176, 12181, 12197, 12200, 12201, 12204, 12207, 12208, 12217, 12218, 12219, 12220, 12221, 12227, 12228, 12233, 12234, 12240, 12241, 12243, 12245, 12250, 12252, 12256, 12259, 12260, 12263, 12267, 12269, 12278, 12284, 12286, 12287, 12288, 12291, 12293, 12297, 12298, 12299, 12304, 12310, 12311, 12313, 12314, 12315, 12317, 12321, 12323, 12329, 12331, 12333, 12334, 12345, 12347, 12354, 12356, 12358, 12359, 12364, 12367, 12368, 12369, 12370, 12374, 12379, 12380, 12381, 12383, 12397, 12400, 12403, 12404, 12406, 12410, 12414, 12419, 12420, 12421, 12424, 12426, 12437, 12440, 12441, 12445, 12450, 12451, 12454, 12455, 12456, 12457, 12459, 12462, 12467, 12468, 12470, 12478, 12479, 12481, 12487, 12488, 12489, 12491, 12497, 12499, 12504, 12508, 12509, 12510, 12511, 12514, 12521, 12530, 12536, 12539, 12545, 12546, 12547, 12549, 12555, 12561, 12563, 12564, 12565, 12567, 12568, 12572, 12578, 12583, 12585, 12588, 12597, 12605, 12608, 12609, 12610, 12611, 12614, 12616, 12619, 12622, 12623, 12626, 12631, 12633, 12634, 12635, 12636, 12638, 12639, 12641, 12649, 12651, 12658, 12663, 12668, 12670, 12671, 12672, 12674, 12675, 12676, 12679, 12680, 12681, 12684, 12685, 12688, 12691, 12693, 12695, 12698, 12699, 12701, 12702, 12703, 12713, 12718, 12719, 12729, 12731, 12732, 12733, 12737, 12738, 12739, 12741, 12742, 12743, 12748, 12754, 12755, 12757, 12758, 12760, 12761, 12762, 12764, 12766, 12771, 12772, 12773, 12783, 12790, 12794, 12797, 12800, 12802, 12803, 12810, 12812, 12813, 12814, 12817, 12822, 12824, 12826, 12827, 12828, 12834, 12836, 12838, 12839, 12843, 12844, 12849, 12858, 12861, 12866, 12873, 12883, 12887, 12888, 12893, 12895, 12898, 12900, 12901, 12904, 12905, 12906, 12910, 12912, 12913, 12914, 12916, 12917, 12920, 12921, 12926, 12929, 12932, 12933, 12938, 12939, 12944, 12945, 12946, 12947, 12966, 12967, 12968, 12969, 12973, 12976, 12978, 12982, 12983, 12984, 12986, 12987, 12990, 12991, 12998, 13010, 13011, 13014, 13017, 13022, 13024, 13030, 13032, 13033, 13035, 13038, 13040, 13041, 13042, 13044, 13050, 13053, 13055, 13056, 13057, 13060, 13061, 13062, 13064, 13065, 13066, 13071, 13074, 13075, 13079, 13085, 13086, 13087, 13095, 13101, 13102, 13112, 13115, 13117, 13118, 13123, 13124, 13131, 13135, 13142, 13148, 13149, 13151, 13153, 13169, 13175, 13177, 13182, 13189, 13197, 13199, 13205, 13206, 13209, 13210, 13213, 13215, 13217, 13221, 13222, 13224, 13227, 13230, 13232, 13234, 13235, 13236, 13237, 13238, 13243, 13248, 13249, 13251, 13255, 13259, 13260, 13261, 13263, 13264, 13269, 13273, 13275, 13276, 13281, 13296, 13298, 13301, 13303, 13304, 13315, 13317, 13318, 13320, 13321, 13323, 13326, 13328, 13329, 13330, 13332, 13335, 13337, 13340, 13343, 13346, 13352, 13353, 13354, 13359, 13361, 13363, 13368, 13369, 13373, 13375, 13380, 13381, 13384, 13391, 13393, 13394, 13396, 13397, 13401, 13415, 13416, 13417, 13418, 13419, 13420, 13423, 13424, 13429, 13433, 13439, 13441, 13448, 13450, 13454, 13456, 13460, 13463, 13466, 13468, 13469, 13473, 13475, 13494, 13496, 13498, 13499, 13500, 13503, 13504, 13505, 13506, 13513, 13514, 13515, 13516, 13517, 13519, 13520, 13521, 13524, 13530, 13532, 13539, 13540, 13543, 13544, 13546, 13547, 13549, 13552, 13568, 13569, 13574, 13582, 13584, 13587, 13589, 13595, 13597, 13598, 13601, 13602, 13604, 13612, 13621, 13623, 13628, 13631, 13632, 13634, 13635, 13636, 13637, 13641, 13647, 13652, 13654, 13661, 13662, 13663, 13668, 13671, 13675, 13677, 13684, 13687, 13688, 13695, 13697, 13698, 13700, 13702, 13710, 13712, 13713, 13715, 13716, 13720, 13721, 13726, 13727, 13729, 13730, 13737, 13739, 13748, 13750, 13755, 13756, 13764, 13766, 13769, 13773, 13775, 13779, 13781, 13782, 13783, 13785, 13786, 13787, 13789, 13790, 13791, 13794, 13796, 13798, 13809, 13816, 13817, 13818, 13819, 13820, 13822, 13823, 13828, 13830, 13831, 13833, 13835, 13843, 13849, 13852, 13853, 13858, 13859, 13860, 13862, 13866, 13869, 13870, 13872, 13873, 13874, 13877, 13881, 13882, 13891, 13892, 13894, 13896, 13901, 13904, 13906, 13909, 13910, 13911, 13917, 13919, 13920, 13921, 13927, 13930, 13933, 13938, 13944, 13947, 13948, 13949, 13952, 13954, 13956, 13963, 13965, 13969, 13970, 13971, 13975, 13976, 13981, 13984, 13990, 13991, 13999, 14000, 14001, 14008, 14009, 14014, 14017, 14018, 14022, 14026, 14027, 14028, 14030, 14031, 14036, 14041, 14043, 14049, 14050, 14051, 14052, 14062, 14063, 14066, 14069, 14070, 14071, 14073, 14075, 14076, 14081, 14082, 14084, 14086, 14087, 14092, 14093, 14094, 14096, 14099, 14105, 14106, 14110, 14112, 14116, 14118, 14119, 14120, 14122, 14129, 14132, 14135, 14138, 14139, 14143, 14145, 14146, 14148, 14149, 14150.

Promoters expressing in shoot tissue at 3 days after planting include SEQ IDs: 1, 3, 4, 7, 9, 11, 12, 13, 14, 15, 29, 31, 34, 36, 48, 54, 63, 64, 65, 67, 68, 88, 93, 96, 97, 99, 102, 103, 107, 108, 110, 112, 121, 126, 130, 131, 132, 139, 140, 143, 147, 148, 152, 156, 157, 159, 162, 165, 174, 175, 176, 177, 181, 183, 187, 191, 194, 195, 196, 197, 199, 202, 203, 204, 205, 207, 211, 223, 230, 231, 232, 235, 236, 237, 240, 242, 243, 244, 246, 248, 249, 250, 251, 257, 259, 262, 263, 264, 271, 273, 274, 280, 281, 286, 288, 289, 291, 294, 299, 303, 305, 306, 309, 316, 319, 320, 323, 328, 329, 332, 335, 341, 346, 349, 352, 353, 354, 356, 357, 358, 360, 364, 365, 374, 378, 379, 380, 387, 388, 401, 406, 407, 419, 420, 423, 424, 428, 429, 433, 434, 452, 456, 461, 466, 468, 471, 473, 474, 478, 479, 481, 483, 485, 488, 498, 502, 509, 510, 512, 513, 514, 516, 517, 520, 522, 523, 525, 529, 532, 533, 534, 536, 538, 543, 544, 546, 547, 557, 560, 564, 574, 578, 580, 585, 591, 594, 595, 596, 598, 599, 601, 602, 604, 607, 611, 613, 614, 620, 623, 629, 630, 631, 633, 635, 638, 643, 650, 656, 662, 663, 666, 670, 681, 683, 686, 693, 701, 705, 707, 708, 716, 717, 719, 722, 724, 727, 734, 736, 740, 742, 744, 749, 753, 757, 759, 760, 761, 762, 765, 768, 770, 771, 782, 783, 784, 792, 793, 795, 800, 801, 804, 806, 808, 812, 813, 820, 822, 823, 829, 830, 833, 836, 839, 840, 842, 844, 849, 855, 859, 860, 862, 863, 865, 868, 870, 872, 877, 883, 884, 885, 887, 890, 891, 892, 893, 895, 903, 907, 908, 910, 911, 912, 913, 915, 916, 917, 919, 920, 924, 928, 929, 931, 932, 936, 938, 943, 944, 951, 953, 954, 958, 961, 963, 964, 966, 978, 979, 980, 981, 982, 987, 989, 991, 993, 994, 995, 997, 999, 1003, 1006, 1009, 1011, 1014, 1017, 1022, 1026, 1028, 1032, 1035, 1038, 1042, 1043, 1044, 1047, 1049, 1050, 1051, 1052, 1055, 1056, 1064, 1065, 1069, 1072, 1073, 1077, 1078, 1080, 1086, 1087, 1088, 1089, 1092, 1095, 1101, 1103, 1104, 1108, 1110, 1111, 1112, 1114, 1115, 1117, 1119, 1120, 1122, 1125, 1127, 1130, 1132, 1133, 1136, 1137, 1143, 1146, 1147, 1148, 1154, 1155, 1160, 1162, 1168, 1170, 1174, 1176, 1178, 1189, 1190, 1191, 1196, 1199, 1200, 1201, 1204, 1205, 1214, 1218, 1220, 1223, 1225, 1228, 1230, 1231, 1233, 1235, 1236, 1239, 1240, 1241, 1244, 1248, 1250, 1252, 1253, 1254, 1256, 1257, 1258, 1264, 1265, 1272, 1281, 1282, 1285, 1286, 1293, 1295, 1297, 1305, 1306, 1309, 1312, 1316, 1320, 1321, 1325, 1327, 1330, 1331, 1334, 1339, 1346, 1349, 1351, 1360, 1364, 1368, 1371, 1373, 1376, 1377, 1380, 1382, 1388, 1393, 1396, 1398, 1403, 1404, 1405, 1407, 1409, 1410, 1412, 1415, 1420, 1421, 1423, 1426, 1431, 1436, 1438, 1439, 1440, 1441, 1442, 1448, 1451, 1453, 1454, 1455, 1462, 1467, 1468, 1474, 1475, 1481, 1485, 1486, 1488, 1490, 1493, 1498, 1499, 1501, 1503, 1512, 1513, 1514, 1518, 1519, 1525, 1526, 1527, 1530, 1539, 1543, 1545, 1546, 1549, 1555, 1556, 1560, 1563, 1566, 1567, 1571, 1575, 1576, 1578, 1584, 1586, 1590, 1592, 1593, 1595, 1599, 1600, 1602, 1604, 1605, 1608, 1609, 1612, 1614, 1615, 1616, 1618, 1622, 1625, 1634, 1635, 1637, 1638, 1639, 1641, 1648, 1650, 1658, 1659, 1662, 1663, 1668, 1669, 1671, 1673, 1675, 1676, 1677, 1680, 1684, 1685, 1688, 1689, 1691, 1705, 1706, 1707, 1708, 1709, 1710, 1714, 1717, 1721, 1723, 1725, 1729, 1731, 1732, 1734, 1735, 1740, 1750, 1755, 1758, 1759, 1761, 1764, 1771, 1776, 1778, 1779, 1785, 1791, 1793, 1813, 1815, 1816, 1820, 1830, 1832, 1835, 1836, 1837, 1838, 1840, 1845, 1850, 1852, 1858, 1859, 1865, 1867, 1869, 1870, 1872, 1873, 1883, 1886, 1888, 1891, 1893, 1894, 1895, 1897, 1898, 1899, 1900, 1901, 1902, 1903, 1904, 1905, 1906, 1910, 1911, 1917, 1918, 1920, 1923, 1924, 1936, 1940, 1944, 1950, 1952, 1953, 1973, 1981, 1990, 1991, 1993, 1994, 1995, 1996, 1999, 2000, 2007, 2008, 2009, 2010, 2012, 2013, 2014, 2015, 2017, 2026, 2031, 2032, 2039, 2041, 2043, 2045, 2048, 2062, 2064, 2066, 2069, 2072, 2074, 2075, 2077, 2081, 2082, 2083, 2088, 2089, 2094, 2096, 2097, 2099, 2101, 2103, 2104, 2112, 2122, 2132, 2133, 2134, 2140, 2142, 2143, 2144, 2147, 2150, 2152, 2154, 2155, 2156, 2157, 2161, 2162, 2163, 2164, 2165, 2166, 2170, 2172, 2173, 2177, 2178, 2179, 2185, 2193, 2196, 2202, 2203, 2206, 2215, 2216, 2221, 2222, 2226, 2229, 2230, 2231, 2235, 2240, 2243, 2244, 2253, 2257, 2260, 2261, 2262, 2263, 2273, 2274, 2278, 2282, 2283, 2288, 2291, 2293, 2295, 2296, 2297, 2298, 2303, 2304, 2306, 2309, 2314, 2322, 2323, 2328, 2329, 2331, 2333, 2339, 2342, 2345, 2348, 2349, 2351, 2352, 2353, 2361, 2362, 2363, 2366, 2367, 2379, 2381, 2382, 2384, 2385, 2396, 2398, 2401, 2403, 2405, 2406, 2410, 2411, 2412, 2413, 2418, 2419, 2420, 2422, 2423, 2431, 2435, 2437, 2438, 2439, 2440, 2441, 2442, 2443, 2445, 2450, 2451, 2452, 2453, 2457, 2465, 2471, 2472, 2474, 2476, 2479, 2480, 2481, 2482, 2483, 2490, 2492, 2494, 2495, 2496, 2498, 2500, 2504, 2505, 2509, 2510, 2511, 2514, 2515, 2516, 2517, 2525, 2528, 2531, 2532, 2533, 2536, 2537, 2538, 2539, 2541, 2542, 2549, 2551, 2552, 2555, 2556, 2557, 2567, 2568, 2573, 2577, 2581, 2583, 2588, 2589, 2590, 2592, 2594, 2599, 2601, 2605, 2609, 2616, 2617, 2618, 2625, 2627, 2632, 2634, 2636, 2637, 2639, 2641, 2644, 2655, 2663, 2671, 2674, 2675, 2684, 2685, 2687, 2689, 2691, 2692, 2696, 2700, 2702, 2705, 2707, 2712, 2718, 2719, 2723, 2725, 2726, 2728, 2729, 2730, 2735, 2740, 2742, 2746, 2747, 2752, 2755, 2756, 2757, 2768, 2770, 2775, 2780, 2782, 2784, 2787, 2800, 2801, 2802, 2805, 2812, 2820, 2821, 2823, 2824, 2826, 2827, 2829, 2831, 2832, 2840, 2844, 2850, 2858, 2861, 2862, 2864, 2865, 2866, 2871, 2873, 2876, 2888, 2889, 2890, 2894, 2898, 2901, 2902, 2903, 2906, 2909, 2910, 2911, 2915, 2916, 2917, 2919, 2923, 2924, 2926, 2930, 2931, 2932, 2933, 2934, 2935, 2944, 2948, 2953, 2955, 2959, 2963, 2966, 2968, 2976, 2979, 2980, 2985, 2994, 2998, 3002, 3003, 3007, 3015, 3016, 3023, 3038, 3039, 3042, 3044, 3048, 3049, 3051, 3052, 3053, 3055, 3064, 3070, 3072, 3076, 3080, 3081, 3083, 3084, 3085, 3087, 3088, 3090, 3095, 3096, 3100, 3105, 3106, 3109, 3112, 3118, 3119, 3120, 3121, 3123, 3126, 3127, 3128, 3137, 3139, 3143, 3147, 3149, 3153, 3156, 3170, 3173, 3181, 3185, 3191, 3192, 3194, 3205, 3206, 3210, 3212, 3214, 3219, 3220, 3224, 3225, 3227, 3228, 3236, 3237, 3239, 3240, 3244, 3246, 3247, 3250, 3252, 3255, 3260, 3261, 3263, 3266, 3271, 3272, 3273, 3278, 3280, 3283, 3286, 3288, 3289, 3290, 3291, 3294, 3295, 3296, 3297, 3299, 3301, 3303, 3312, 3331, 3332, 3333, 3340, 3343, 3345, 3347, 3349, 3351, 3353, 3355, 3358, 3359, 3360, 3361, 3363, 3370, 3374, 3376, 3377, 3380, 3383, 3386, 3397, 3399, 3404, 3415, 3416, 3418, 3419, 3420, 3422, 3424, 3426, 3428, 3435, 3438, 3440, 3445, 3447, 3455, 3458, 3460, 3461, 3464, 3465, 3466, 3468, 3470, 3471, 3473, 3474, 3475, 3477, 3482, 3486, 3487, 3488, 3490, 3491, 3494, 3496, 3499, 3500, 3503, 3504, 3506, 3510, 3511, 3516, 3517, 3518, 3531, 3533, 3536, 3537, 3541, 3544, 3545, 3548, 3549, 3552, 3554, 3558, 3560, 3562, 3569, 3574, 3576, 3577, 3587, 3588, 3589, 3592, 3593, 3594, 3595, 3596, 3598, 3600, 3603, 3604, 3606, 3607, 3611, 3613, 3616, 3618, 3620, 3621, 3624, 3629, 3633, 3637, 3640, 3642, 3643, 3644, 3645, 3646, 3647, 3648, 3655, 3657, 3659, 3660, 3661, 3667, 3671, 3672, 3674, 3677, 3682, 3684, 3685, 3693, 3694, 3707, 3713, 3715, 3717, 3718, 3719, 3720, 3730, 3742, 3748, 3749, 3752, 3754, 3757, 3761, 3762, 3764, 3765, 3766, 3777, 3778, 3781, 3783, 3790, 3791, 3792, 3794, 3796, 3798, 3808, 3809, 3818, 3820, 3823, 3825, 3828, 3829, 3830, 3831, 3832, 3833, 3834, 3843, 3844, 3845, 3847, 3849, 3858, 3860, 3862, 3867, 3868, 3871, 3872, 3873, 3876, 3877, 3882, 3883, 3887, 3889, 3890, 3891, 3892, 3893, 3894, 3895, 3908, 3910, 3911, 3912, 3914, 3917, 3924, 3928, 3929, 3934, 3935, 3938, 3947, 3950, 3952, 3954, 3958, 3962, 3967, 3975, 3978, 3983, 3985, 3987, 3988, 3997, 4001, 4002, 4003, 4006, 4008, 4013, 4014, 4019, 4020, 4024, 4030, 4032, 4033, 4034, 4037, 4039, 4040, 4041, 4042, 4047, 4048, 4049, 4051, 4052, 4054, 4056, 4057, 4062, 4066, 4067, 4068, 4069, 4072, 4075, 4079, 4080, 4081, 4088, 4092, 4096, 4105, 4107, 4108, 4111, 4113, 4116, 4122, 4128, 4132, 4133, 4139, 4146, 4148, 4149, 4150, 4156, 4158, 4160, 4161, 4162, 4163, 4165, 4166, 4170, 4171, 4175, 4176, 4178, 4184, 4187, 4188, 4189, 4198, 4201, 4202, 4205, 4206, 4208, 4210, 4211, 4212, 4214, 4218, 4219, 4221, 4222, 4227, 4228, 4231, 4233, 4235, 4244, 4250, 4251, 4257, 4260, 4261, 4263, 4266, 4270, 4272, 4275, 4279, 4280, 4281, 4283, 4288, 4292, 4294, 4295, 4296, 4298, 4302, 4304, 4309, 4312, 4320, 4324, 4329, 4330, 4331, 4335, 4336, 4337, 4338, 4341, 4344, 4347, 4349, 4352, 4354, 4356, 4358, 4360, 4365, 4369, 4371, 4373, 4378, 4380, 4383, 4390, 4394, 4397, 4398, 4401, 4402, 4403, 4404, 4405, 4410, 4418, 4422, 4423, 4439, 4443, 4444, 4446, 4448, 4450, 4453, 4460, 4461, 4462, 4463, 4464, 4465, 4468, 4472, 4474, 4475, 4479, 4485, 4491, 4492, 4494, 4502, 4506, 4507, 4512, 4514, 4515, 4518, 4519, 4522, 4531, 4545, 4548, 4549, 4551, 4554, 4555, 4556, 4557, 4558, 4560, 4562, 4565, 4566, 4570, 4575, 4580, 4583, 4584, 4586, 4590, 4591, 4596, 4601, 4604, 4606, 4611, 4618, 4621, 4625, 4630, 4632, 4633, 4634, 4635, 4641, 4643, 4644, 4645, 4650, 4653, 4654, 4655, 4659, 4667, 4669, 4671, 4676, 4677, 4680, 4685, 4687, 4692, 4697, 4700, 4702, 4704, 4706, 4708, 4710, 4719, 4721, 4723, 4725, 4729, 4730, 4737, 4738, 4740, 4741, 4749, 4750, 4753, 4754, 4755, 4756, 4759, 4761, 4762, 4763, 4765, 4766, 4771, 4775, 4778, 4779, 4789, 4790, 4791, 4794, 4795, 4803, 4804, 4813, 4814, 4818, 4824, 4828, 4832, 4833, 4834, 4835, 4836, 4837, 4838, 4842, 4857, 4859, 4861, 4862, 4864, 4868, 4869, 4872, 4875, 4878, 4880, 4881, 4887, 4889, 4890, 4891, 4895, 4901, 4902, 4905, 4909, 4915, 4916, 4920, 4921, 4922, 4924, 4930, 4935, 4936, 4938, 4939, 4943, 4950, 4958, 4959, 4960, 4965, 4971, 4972, 4973, 4975, 4977, 4979, 4980, 4984, 4987, 4989, 4990, 4994, 4996, 5000, 5005, 5010, 5015, 5022, 5026, 5029, 5030, 5034, 5037, 5038, 5039, 5040, 5042, 5044, 5046, 5049, 5052, 5054, 5055, 5057, 5059, 5061, 5063, 5067, 5068, 5072, 5075, 5078, 5082, 5088, 5089, 5090, 5091, 5094, 5100, 5102, 5106, 5111, 5114, 5129, 5131, 5132, 5140, 5143, 5145, 5149, 5151, 5153, 5157, 5160, 5164, 5165, 5168, 5170, 5174, 5180, 5181, 5182, 5184, 5185, 5188, 5189, 5190, 5191, 5192, 5196, 5198, 5199, 5200, 5206, 5208, 5212, 5217, 5219, 5225, 5226, 5229, 5234, 5241, 5243, 5247, 5248, 5249, 5251, 5253, 5255, 5258, 5261, 5263, 5264, 5265, 5266, 5267, 5273, 5275, 5276, 5280, 5281, 5283, 5286, 5290, 5292, 5293, 5298, 5299, 5300, 5301, 5303, 5308, 5311, 5313, 5317, 5319, 5321, 5324, 5329, 5330, 5334, 5339, 5344, 5346, 5348, 5350, 5351, 5359, 5360, 5361, 5363, 5364, 5366, 5367, 5372, 5382, 5386, 5388, 5389, 5391, 5393, 5394, 5395, 5396, 5397, 5403, 5407, 5409, 5411, 5413, 5414, 5417, 5426, 5431, 5434, 5439, 5448, 5449, 5450, 5451, 5452, 5456, 5457, 5458, 5459, 5463, 5464, 5467, 5469, 5472, 5474, 5476, 5479, 5481, 5482, 5483, 5485, 5491, 5493, 5495, 5496, 5498, 5506, 5508, 5510, 5512, 5513, 5515, 5516, 5517, 5518, 5519, 5524, 5526, 5529, 5530, 5531, 5534, 5535, 5536, 5537, 5547, 5549, 5557, 5562, 5563, 5568, 5569, 5571, 5579, 5585, 5588, 5589, 5591, 5597, 5599, 5604, 5608, 5612, 5613, 5615, 5616, 5618, 5627, 5632, 5633, 5635, 5638, 5640, 5642, 5643, 5647, 5648, 5651, 5652, 5657, 5659, 5660, 5662, 5663, 5665, 5666, 5675, 5676, 5677, 5680, 5689, 5694, 5695, 5697, 5698, 5700, 5702, 5703, 5706, 5709, 5711, 5717, 5718, 5721, 5722, 5731, 5732, 5734, 5735, 5744, 5751, 5753, 5756, 5768, 5771, 5775, 5780, 5784, 5785, 5786, 5789, 5791, 5794, 5803, 5806, 5807, 5808, 5809, 5811, 5813, 5814, 5815, 5817, 5820, 5823, 5828, 5831, 5832, 5833, 5835, 5836, 5837, 5839, 5846, 5852, 5853, 5854, 5859, 5861, 5863, 5864, 5865, 5866, 5868, 5869, 5870, 5872, 5875, 5876, 5878, 5879, 5881, 5883, 5884, 5887, 5888, 5889, 5892, 5893, 5906, 5907, 5912, 5919, 5922, 5923, 5925, 5926, 5927, 5928, 5932, 5934, 5935, 5938, 5939, 5941, 5944, 5948, 5951, 5954, 5956, 5959, 5961, 5967, 5968, 5979, 5982, 5984, 5987, 5988, 5989, 5991, 5992, 5994, 5996, 6000, 6002, 6004, 6006, 6009, 6013, 6016, 6017, 6023, 6024, 6025, 6026, 6028, 6031, 6038, 6041, 6044, 6045, 6048, 6051, 6058, 6059, 6062, 6063, 6068, 6069, 6070, 6072, 6073, 6075, 6081, 6084, 6085, 6087, 6088, 6089, 6092, 6093, 6097, 6098, 6099, 6107, 6108, 6109, 6110, 6113, 6116, 6118, 6119, 6120, 6124, 6129, 6131, 6132, 6137, 6138, 6143, 6145, 6146, 6157, 6158, 6160, 6162, 6163, 6164, 6165, 6181, 6183, 6186, 6188, 6189, 6193, 6194, 6195, 6197, 6198, 6204, 6205, 6215, 6220, 6223, 6224, 6227, 6228, 6234, 6237, 6243, 6246, 6247, 6250, 6251, 6265, 6267, 6275, 6281, 6286, 6289, 6292, 6293, 6295, 6297, 6299, 6303, 6306, 6309, 6310, 6311, 6315, 6317, 6321, 6322, 6328, 6330, 6333, 6338, 6346, 6349, 6354, 6356, 6358, 6362, 6363, 6365, 6370, 6372, 6375, 6383, 6386, 6394, 6397, 6399, 6400, 6403, 6404, 6405, 6408, 6412, 6414, 6415, 6419, 6420, 6425, 6426, 6428, 6429, 6431, 6436, 6440, 6442, 6449, 6456, 6458, 6463, 6464, 6466, 6467, 6468, 6470, 6474, 6475, 6476, 6478, 6480, 6482, 6484, 6485, 6488, 6494, 6495, 6501, 6504, 6510, 6513, 6516, 6519, 6530, 6532, 6534, 6535, 6537, 6541, 6543, 6547, 6549, 6553, 6555, 6558, 6559, 6562, 6567, 6569, 6571, 6572, 6574, 6576, 6577, 6579, 6581, 6584, 6588, 6589, 6592, 6594, 6595, 6597, 6599, 6600, 6603, 6605, 6606, 6609, 6617, 6623, 6625, 6629, 6633, 6635, 6639, 6640, 6644, 6649, 6655, 6656, 6658, 6661, 6666, 6671, 6672, 6673, 6701, 6703, 6704, 6705, 6706, 6716, 6718, 6720, 6729, 6734, 6736, 6737, 6739, 6742, 6747, 6749, 6756, 6757, 6759, 6761, 6764, 6766, 6767, 6772, 6779, 6782, 6783, 6788, 6793, 6794, 6795, 6797, 6799, 6803, 6804, 6805, 6807, 6811, 6813, 6816, 6817, 6819, 6820, 6821, 6824, 6828, 6830, 6831, 6834, 6836, 6841, 6843, 6848, 6851, 6855, 6859, 6863, 6868, 6869, 6874, 6875, 6879, 6881, 6882, 6883, 6884, 6887, 6888, 6894, 6897, 6902, 6904, 6907, 6914, 6917, 6919, 6920, 6921, 6925, 6930, 6936, 6939, 6946, 6959, 6960, 6963, 6970, 6971, 6979, 6980, 6981, 6984, 6985, 6987, 6988, 6990, 6991, 6994, 6999, 7003, 7013, 7022, 7027, 7029, 7038, 7041, 7043, 7045, 7046, 7049, 7051, 7052, 7053, 7057, 7059, 7060, 7062, 7064, 7067, 7072, 7073, 7075, 7077, 7079, 7083, 7084, 7094, 7105, 7106, 7107, 7108, 7110, 7117, 7118, 7130, 7138, 7139, 7142, 7143, 7144, 7150, 7151, 7154, 7163, 7164, 7165, 7166, 7169, 7182, 7184, 7191, 7192, 7194, 7197, 7201, 7202, 7206, 7207, 7208, 7209, 7210, 7212, 7215, 7217, 7219, 7227, 7228, 7230, 7231, 7235, 7236, 7244, 7245, 7255, 7257, 7258, 7262, 7263, 7264, 7268, 7274, 7276, 7281, 7287, 7291, 7292, 7293, 7296, 7298, 7299, 7300, 7303, 7304, 7306, 7307, 7308, 7311, 7312, 7313, 7318, 7323, 7328, 7338, 7340, 7345, 7350, 7351, 7356, 7357, 7358, 7361, 7365, 7369, 7371, 7373, 7376, 7377, 7382, 7383, 7386, 7395, 7398, 7399, 7400, 7410, 7411, 7417, 7418, 7430, 7434, 7436, 7437, 7438, 7447, 7448, 7452, 7453, 7454, 7457, 7458, 7459, 7466, 7470, 7476, 7481, 7483, 7490, 7492, 7493, 7502, 7503, 7504, 7506, 7512, 7515, 7521, 7522, 7523, 7524, 7525, 7528, 7533, 7546, 7561, 7572, 7574, 7576, 7579, 7583, 7585, 7586, 7589, 7594, 7596, 7599, 7604, 7609, 7611, 7612, 7619, 7620, 7622, 7624, 7625, 7633, 7642, 7643, 7644, 7649, 7652, 7658, 7661, 7664, 7665, 7671, 7673, 7674, 7678, 7679, 7680, 7682, 7686, 7687, 7689, 7695, 7700, 7703, 7712, 7715, 7716, 7718, 7724, 7726, 7736, 7737, 7738, 7741, 7742, 7744, 7745, 7749, 7753, 7763, 7764, 7768, 7770, 7774, 7775, 7776, 7777, 7778, 7779, 7780, 7781, 7785, 7786, 7787, 7788, 7791, 7793, 7798, 7799, 7800, 7801, 7803, 7804, 7805, 7806, 7807, 7818, 7819, 7820, 7823, 7824, 7825, 7826, 7833, 7839, 7840, 7841, 7844, 7845, 7854, 7856, 7860, 7865, 7873, 7875, 7877, 7878, 7880, 7881, 7887, 7888, 7890, 7896, 7908, 7911, 7918, 7923, 7925, 7928, 7933, 7934, 7935, 7938, 7942, 7944, 7949, 7952, 7965, 7966, 7967, 7973, 7976, 7977, 7982, 7983, 7984, 7986, 7993, 7994, 7996, 8004, 8006, 8007, 8021, 8025, 8026, 8029, 8031, 8036, 8040, 8042, 8044, 8047, 8053, 8056, 8059, 8061, 8063, 8068, 8075, 8076, 8077, 8078, 8079, 8080, 8081, 8084, 8088, 8090, 8091, 8093, 8095, 8100, 8102, 8106, 8110, 8112, 8113, 8118, 8121, 8126, 8129, 8130, 8134, 8145, 8146, 8147, 8148, 8150, 8151, 8159, 8163, 8170, 8178, 8179, 8181, 8182, 8189, 8193, 8194, 8202, 8204, 8208, 8210, 8213, 8219, 8220, 8223, 8227, 8230, 8234, 8235, 8237, 8239, 8242, 8247, 8248, 8250, 8252, 8253, 8262, 8263, 8264, 8265, 8266, 8268, 8269, 8270, 8272, 8273, 8274, 8275, 8276, 8291, 8295, 8300, 8304, 8310, 8311, 8312, 8315, 8318, 8319, 8320, 8323, 8326, 8329, 8339, 8340, 8347, 8349, 8350, 8353, 8358, 8367, 8368, 8373, 8379, 8380, 8382, 8385, 8386, 8387, 8389, 8392, 8393, 8395, 8401, 8402, 8403, 8404, 8407, 8410, 8413, 8414, 8415, 8417, 8418, 8428, 8430, 8436, 8438, 8439, 8443, 8444, 8445, 8447, 8448, 8449, 8450, 8451, 8465, 8470, 8472, 8473, 8474, 8476, 8477, 8481, 8482, 8485, 8486, 8494, 8496, 8498, 8500, 8501, 8503, 8504, 8505, 8507, 8509, 8511, 8513, 8515, 8516, 8521, 8524, 8525, 8526, 8527, 8531, 8533, 8539, 8542, 8543, 8553, 8554, 8557, 8561, 8562, 8565, 8568, 8574, 8575, 8576, 8579, 8581, 8582, 8583, 8592, 8594, 8596, 8597, 8598, 8600, 8601, 8603, 8604, 8605, 8609, 8611, 8612, 8631, 8634, 8635, 8638, 8639, 8641, 8644, 8646, 8650, 8652, 8654, 8658, 8659, 8660, 8663, 8665, 8669, 8670, 8672, 8676, 8677, 8686, 8693, 8699, 8700, 8703, 8706, 8708, 8709, 8713, 8717, 8720, 8722, 8727, 8728, 8731, 8736, 8741, 8744, 8747, 8748, 8750, 8757, 8773, 8774, 8777, 8779, 8783, 8784, 8785, 8786, 8789, 8792, 8795, 8803, 8804, 8808, 8810, 8817, 8821, 8822, 8824, 8829, 8830, 8831, 8839, 8841, 8842, 8843, 8846, 8853, 8865, 8874, 8876, 8877, 8878, 8881, 8884, 8888, 8889, 8892, 8896, 8899, 8901, 8907, 8908, 8911, 8916, 8917, 8919, 8922, 8926, 8929, 8930, 8937, 8938, 8941, 8945, 8946, 8949, 8951, 8953, 8961, 8967, 8968, 8971, 8972, 8979, 8980, 8981, 8985, 8986, 8991, 8992, 8998, 8999, 9001, 9003, 9006, 9009, 9011, 9012, 9015, 9018, 9020, 9026, 9027, 9028, 9029, 9030, 9045, 9052, 9056, 9058, 9059, 9060, 9063, 9065, 9069, 9071, 9072, 9076, 9078, 9088, 9092, 9097, 9103, 9104, 9107, 9118, 9123, 9125, 9129, 9131, 9133, 9134, 9139, 9140, 9141, 9142, 9144, 9147, 9151, 9152, 9154, 9155, 9159, 9167, 9168, 9175, 9177, 9179, 9180, 9183, 9185, 9188, 9190, 9191, 9195, 9205, 9206, 9207, 9210, 9211, 9213, 9215, 9216, 9223, 9226, 9229, 9231, 9233, 9237, 9240, 9243, 9246, 9248, 9249, 9253, 9257, 9262, 9267, 9269, 9270, 9273, 9275, 9282, 9284, 9285, 9288, 9290, 9292, 9293, 9295, 9300, 9308, 9311, 9320, 9321, 9323, 9326, 9328, 9336, 9338, 9339, 9340, 9346, 9347, 9350, 9352, 9353, 9359, 9366, 9371, 9373, 9375, 9376, 9380, 9382, 9391, 9392, 9393, 9394, 9400, 9402, 9403, 9406, 9413, 9414, 9415, 9421, 9423, 9425, 9429, 9434, 9438, 9439, 9440, 9443, 9449, 9453, 9456, 9460, 9471, 9474, 9481, 9488, 9490, 9497, 9500, 9504, 9509, 9514, 9517, 9518, 9534, 9536, 9537, 9538, 9540, 9545, 9546, 9550, 9551, 9553, 9555, 9560, 9564, 9568, 9571, 9573, 9577, 9587, 9590, 9591, 9593, 9595, 9596, 9597, 9601, 9602, 9606, 9607, 9609, 9615, 9617, 9618, 9620, 9623, 9624, 9626, 9629, 9632, 9641, 9642, 9644, 9645, 9648, 9652, 9655, 9657, 9658, 9659, 9663, 9666, 9668, 9670, 9676, 9677, 9682, 9686, 9687, 9696, 9698, 9701, 9706, 9710, 9711, 9721, 9723, 9726, 9727, 9729, 9730, 9731, 9733, 9737, 9738, 9742, 9746, 9750, 9753, 9756, 9763, 9764, 9770, 9774, 9776, 9777, 9782, 9786, 9791, 9792, 9793, 9794, 9798, 9799, 9804, 9810, 9811, 9812, 9813, 9816, 9819, 9820, 9821, 9825, 9827, 9828, 9829, 9830, 9845, 9846, 9847, 9861, 9869, 9873, 9878, 9882, 9886, 9887, 9892, 9897, 9900, 9907, 9909, 9910, 9911, 9912, 9921, 9923, 9924, 9928, 9930, 9932, 9935, 9938, 9940, 9944, 9946, 9949, 9950, 9952, 9953, 9962, 9963, 9967, 9968, 9972, 9973, 9975, 9980, 9982, 9984, 9985, 9987, 9988, 9990, 9991, 9992, 9997, 10000, 10009, 10010, 10012, 10013, 10017, 10019, 10020, 10026, 10027, 10032, 10033, 10034, 10035, 10041, 10047, 10049, 10051, 10052, 10053, 10055, 10058, 10059, 10062, 10064, 10066, 10073, 10077, 10078, 10080, 10081, 10083, 10091, 10092, 10095, 10101, 10103, 10106, 10110, 10115, 10116, 10119, 10122, 10127, 10128, 10129, 10130, 10131, 10136, 10140, 10143, 10151, 10158, 10160, 10163, 10165, 10166, 10168, 10174, 10176, 10178, 10181, 10191, 10192, 10193, 10194, 10196, 10199, 10207, 10212, 10217, 10218, 10219, 10220, 10222, 10223, 10225, 10233, 10235, 10236, 10237, 10239, 10249, 10253, 10259, 10262, 10263, 10268, 10269, 10270, 10275, 10278, 10284, 10286, 10291, 10292, 10293, 10295, 10300, 10302, 10306, 10307, 10311, 10312, 10314, 10318, 10319, 10323, 10325, 10326, 10331, 10333, 10334, 10336, 10341, 10346, 10353, 10354, 10356, 10357, 10361, 10364, 10365, 10371, 10375, 10376, 10378, 10380, 10381, 10385, 10388, 10393, 10397, 10398, 10399, 10401, 10410, 10411, 10414, 10416, 10417, 10421, 10423, 10424, 10425, 10435, 10436, 10438, 10440, 10446, 10447, 10450, 10452, 10453, 10456, 10463, 10464, 10465, 10466, 10468, 10469, 10471, 10474, 10480, 10482, 10487, 10488, 10490, 10494, 10496, 10506, 10508, 10514, 10518, 10522, 10523, 10527, 10528, 10530, 10531, 10532, 10536, 10537, 10541, 10542, 10543, 10544, 10547, 10548, 10549, 10550, 10551, 10556, 10558, 10560, 10563, 10567, 10569, 10573, 10579, 10580, 10581, 10582, 10583, 10588, 10593, 10596, 10599, 10601, 10602, 10603, 10604, 10611, 10612, 10613, 10616, 10621, 10622, 10629, 10630, 10631, 10633, 10637, 10638, 10639, 10645, 10646, 10655, 10665, 10666, 10668, 10670, 10671, 10676, 10678, 10679, 10681, 10682, 10683, 10684, 10685, 10687, 10698, 10700, 10701, 10705, 10707, 10711, 10715, 10716, 10721, 10722, 10724, 10726, 10729, 10732, 10734, 10738, 10740, 10741, 10744, 10747, 10748, 10749, 10752, 10753, 10756, 10761, 10762, 10766, 10770, 10775, 10776, 10777, 10778, 10779, 10785, 10788, 10790, 10792, 10801, 10802, 10803, 10805, 10810, 10812, 10815, 10818, 10819, 10820, 10823, 10824, 10827, 10831, 10833, 10836, 10838, 10839, 10841, 10843, 10850, 10851, 10852, 10853, 10854, 10857, 10858, 10860, 10866, 10867, 10877, 10880, 10896, 10898, 10899, 10901, 10910, 10911, 10917, 10918, 10920, 10926, 10927, 10928, 10929, 10930, 10933, 10934, 10938, 10940, 10947, 10965, 10966, 10967, 10972, 10976, 10977, 10978, 10979, 10985, 10988, 10993, 10995, 10996, 11008, 11009, 11015, 11021, 11024, 11027, 11030, 11032, 11039, 11046, 11047, 11052, 11053, 11056, 11058, 11060, 11063, 11066, 11078, 11082, 11083, 11095, 11100, 11101, 11103, 11107, 11110, 11114, 11118, 11129, 11133, 11137, 11141, 11145, 11146, 11147, 11149, 11151, 11152, 11153, 11154, 11160, 11161, 11163, 11165, 11166, 11168, 11169, 11173, 11177, 11181, 11187, 11188, 11190, 11192, 11194, 11198, 11203, 11208, 11214, 11216, 11217, 11218, 11222, 11224, 11226, 11227, 11230, 11231, 11233, 11235, 11236, 11238, 11239, 11242, 11243, 11246, 11247, 11248, 11251, 11253, 11254, 11255, 11256, 11258, 11260, 11262, 11263, 11266, 11278, 11283, 11290, 11291, 11292, 11293, 11295, 11297, 11299, 11304, 11305, 11306, 11313, 11318, 11321, 11330, 11331, 11337, 11345, 11346, 11348, 11356, 11362, 11363, 11364, 11365, 11369, 11370, 11371, 11373, 11377, 11380, 11382, 11387, 11388, 11391, 11392, 11394, 11395, 11401, 11404, 11405, 11408, 11417, 11424, 11430, 11431, 11435, 11439, 11440, 11443, 11446, 11449, 11451, 11456, 11459, 11465, 11466, 11472, 11475, 11477, 11478, 11487, 11489, 11490, 11491, 11494, 11496, 11497, 11498, 11499, 11500, 11501, 11505, 11506, 11507, 11518, 11520, 11523, 11524, 11526, 11527, 11528, 11530, 11531, 11532, 11533, 11534, 11535, 11540, 11541, 11544, 11548, 11551, 11553, 11558, 11560, 11561, 11567, 11568, 11570, 11576, 11577, 11578, 11583, 11585, 11588, 11593, 11594, 11595, 11596, 11597, 11599, 11604, 11607, 11611, 11612, 11615, 11617, 11618, 11623, 11628, 11639, 11640, 11647, 11650, 11656, 11658, 11659, 11663, 11665, 11673, 11678, 11681, 11682, 11688, 11691, 11692, 11694, 11695, 11696, 11701, 11705, 11707, 11712, 11718, 11720, 11721, 11725, 11726, 11730, 11731, 11732, 11733, 11736, 11740, 11743, 11744, 11753, 11756, 11760, 11761, 11762, 11763, 11765, 11770, 11771, 11776, 11778, 11781, 11783, 11784, 11785, 11786, 11788, 11789, 11792, 11794, 11799, 11800, 11805, 11809, 11811, 11814, 11818, 11826, 11828, 11830, 11837, 11839, 11840, 11841, 11846, 11848, 11849, 11851, 11856, 11858, 11861, 11864, 11865, 11868, 11872, 11876, 11877, 11878, 11879, 11881, 11886, 11889, 11891, 11892, 11894, 11895, 11898, 11901, 11906, 11909, 11911, 11913, 11914, 11916, 11917, 11919, 11920, 11921, 11923, 11927, 11928, 11929, 11930, 11934, 11935, 11940, 11943, 11945, 11946, 11947, 11953, 11955, 11956, 11958, 11959, 11960, 11961, 11962, 11963, 11964, 11965, 11966, 11968, 11974, 11976, 11977, 11978, 11979, 11983, 11988, 11993, 11997, 11998, 11999, 12004, 12017, 12023, 12026, 12032, 12033, 12038, 12041, 12042, 12043, 12044, 12059, 12060, 12068, 12076, 12077, 12081, 12083, 12087, 12091, 12092, 12093, 12095, 12098, 12102, 12104, 12106, 12109, 12110, 12112, 12118, 12122, 12126, 12128, 12129, 12130, 12134, 12137, 12139, 12143, 12145, 12146, 12147, 12149, 12151, 12161, 12165, 12166, 12167, 12170, 12171, 12174, 12175, 12176, 12181, 12197, 12200, 12201, 12204, 12207, 12208, 12217, 12218, 12219, 12220, 12221, 12223, 12227, 12233, 12234, 12240, 12241, 12243, 12245, 12249, 12250, 12252, 12253, 12255, 12256, 12259, 12263, 12267, 12268, 12269, 12274, 12278, 12280, 12284, 12286, 12287, 12288, 12291, 12297, 12298, 12310, 12311, 12312, 12313, 12314, 12315, 12317, 12321, 12323, 12326, 12329, 12331, 12334, 12347, 12354, 12356, 12358, 12359, 12364, 12367, 12368, 12369, 12370, 12374, 12376, 12379, 12380, 12381, 12383, 12396, 12397, 12400, 12403, 12404, 12406, 12414, 12416, 12419, 12420, 12421, 12424, 12426, 12427, 12428, 12437, 12439, 12440, 12441, 12445, 12451, 12455, 12456, 12457, 12459, 12462, 12467, 12468, 12470, 12473, 12478, 12479, 12481, 12487, 12488, 12489, 12497, 12499, 12504, 12508, 12509, 12510, 12511, 12521, 12530, 12536, 12539, 12545, 12546, 12547, 12549, 12555, 12557, 12559, 12561, 12563, 12564, 12565, 12567, 12578, 12585, 12588, 12591, 12597, 12605, 12608, 12609, 12610, 12611, 12616, 12619, 12622, 12623, 12626, 12630, 12631, 12633, 12634, 12635, 12636, 12638, 12639, 12641, 12649, 12651, 12663, 12668, 12670, 12671, 12672, 12674, 12675, 12676, 12679, 12680, 12681, 12684, 12685, 12688, 12691, 12693, 12695, 12699, 12701, 12702, 12703, 12713, 12718, 12729, 12731, 12732, 12733, 12737, 12738, 12739, 12741, 12742, 12743, 12748, 12752, 12754, 12755, 12757, 12758, 12760, 12761, 12764, 12766, 12767, 12769, 12771, 12783, 12790, 12794, 12797, 12800, 12802, 12803, 12805, 12810, 12812, 12813, 12814, 12817, 12819, 12820, 12822, 12824, 12826, 12827, 12828, 12834, 12836, 12838, 12839, 12843, 12844, 12849, 12850, 12858, 12861, 12866, 12873, 12882, 12883, 12887, 12888, 12895, 12898, 12900, 12901, 12904, 12905, 12906, 12910, 12913, 12916, 12917, 12918, 12920, 12921, 12926, 12928, 12929, 12932, 12938, 12939, 12944, 12945, 12946, 12947, 12966, 12968, 12969, 12973, 12974, 12975, 12976, 12978, 12982, 12983, 12984, 12986, 12987, 12998, 13010, 13011, 13014, 13017, 13018, 13022, 13023, 13030, 13032, 13033, 13035, 13038, 13040, 13042, 13044, 13049, 13053, 13054, 13055, 13056, 13061, 13062, 13064, 13066, 13067, 13069, 13071, 13074, 13075, 13079, 13085, 13086, 13087, 13095, 13101, 13102, 13105, 13106, 13115, 13117, 13118, 13120, 13123, 13124, 13131, 13135, 13142, 13148, 13149, 13151, 13153, 13156, 13160, 13169, 13174, 13175, 13177, 13182, 13188, 13197, 13199, 13205, 13206, 13209, 13210, 13212, 13213, 13215, 13217, 13221, 13222, 13224, 13227, 13230, 13232, 13234, 13235, 13236, 13237, 13238, 13243, 13248, 13249, 13251, 13255, 13259, 13260, 13261, 13263, 13264, 13268, 13269, 13276, 13280, 13296, 13298, 13301, 13303, 13304, 13315, 13317, 13318, 13320, 13321, 13323, 13326, 13328, 13329, 13330, 13332, 13337, 13338, 13340, 13343, 13346, 13348, 13352, 13353, 13354, 13361, 13363, 13369, 13370, 13373, 13375, 13377, 13380, 13381, 13384, 13391, 13393, 13394, 13396, 13397, 13401, 13402, 13408, 13416, 13417, 13419, 13420, 13423, 13424, 13430, 13433, 13439, 13441, 13448, 13451, 13454, 13456, 13460, 13463, 13466, 13468, 13469, 13473, 13475, 13490, 13492, 13496, 13498, 13499, 13500, 13503, 13504, 13505, 13506, 13512, 13513, 13514, 13515, 13516, 13519, 13520, 13521, 13524, 13529, 13530, 13532, 13539, 13540, 13543, 13544, 13546, 13547, 13549, 13552, 13568, 13569, 13574, 13580, 13582, 13584, 13589, 13595, 13597, 13601, 13602, 13603, 13612, 13621, 13623, 13628, 13631, 13632, 13634, 13635, 13636, 13637, 13638, 13641, 13643, 13647, 13652, 13654, 13661, 13662, 13663, 13668, 13671, 13675, 13676, 13677, 13678, 13681, 13684, 13687, 13688, 13689, 13695, 13697, 13698, 13700, 13702, 13706, 13710, 13713, 13715, 13716, 13720, 13727, 13729, 13730, 13737, 13739, 13742, 13745, 13747, 13748, 13750, 13755, 13756, 13758, 13764, 13766, 13769, 13773, 13774, 13775, 13776, 13779, 13781, 13785, 13786, 13787, 13789, 13790, 13791, 13793, 13794, 13795, 13796, 13798, 13809, 13816, 13817, 13818, 13819, 13822, 13823, 13828, 13830, 13831, 13833, 13835, 13843, 13849, 13852, 13853, 13859, 13866, 13869, 13870, 13872, 13873, 13874, 13875, 13877, 13881, 13882, 13885, 13888, 13891, 13892, 13894, 13896, 13901, 13904, 13906, 13909, 13910, 13911, 13917, 13919, 13920, 13921, 13927, 13930, 13933, 13938, 13944, 13947, 13948, 13949, 13952, 13954, 13956, 13961, 13963, 13965, 13969, 13975, 13976, 13981, 13984, 13990, 13991, 13992, 13999, 14000, 14001, 14009, 14014, 14017, 14026, 14027, 14030, 14031, 14036, 14041, 14043, 14049, 14050, 14051, 14052, 14062, 14063, 14066, 14067, 14069, 14070, 14071, 14073, 14075, 14081, 14086, 14092, 14093, 14094, 14096, 14099, 14102, 14105, 14106, 14112, 14115, 14116, 14118, 14119, 14120, 14122, 14125, 14129, 14132, 14135, 14138, 14139, 14143, 14145, 14148, 14149, 14150.

Promoters expressing in shoot tissue at the emergence stage include SEQ IDs: 1, 3, 4, 7, 11, 13, 14, 15, 29, 31, 34, 36, 38, 48, 53, 54, 64, 65, 68, 69, 70, 71, 88, 93, 96, 97, 99, 101, 102, 107, 108, 110, 111, 112, 115, 117, 126, 129, 130, 131, 132, 139, 143, 144, 146, 147, 148, 152, 157, 160, 162, 165, 174, 176, 181, 183, 186, 187, 194, 195, 196, 197, 199, 202, 204, 205, 207, 211, 230, 231, 232, 233, 235, 236, 240, 242, 243, 244, 246, 249, 250, 251, 257, 259, 262, 264, 269, 270, 271, 273, 274, 280, 281, 286, 288, 289, 291, 299, 303, 305, 306, 309, 316, 319, 320, 328, 329, 332, 335, 341, 346, 349, 352, 353, 354, 357, 360, 367, 368, 371, 378, 379, 387, 388, 389, 396, 401, 402, 405, 406, 407, 412, 424, 428, 429, 431, 433, 434, 444, 452, 456, 459, 461, 463, 466, 468, 471, 473, 474, 478, 479, 481, 483, 485, 488, 498, 502, 507, 509, 510, 512, 513, 514, 516, 517, 520, 522, 523, 525, 529, 532, 533, 534, 536, 538, 542, 544, 546, 547, 554, 557, 560, 564, 565, 574, 585, 590, 591, 593, 594, 595, 596, 598, 599, 601, 602, 604, 605, 607, 608, 611, 613, 614, 620, 623, 626, 629, 630, 631, 633, 635, 641, 643, 644, 650, 653, 656, 662, 663, 666, 670, 671, 681, 686, 693, 701, 705, 707, 708, 716, 717, 718, 719, 722, 723, 724, 727, 733, 734, 735, 736, 739, 740, 742, 744, 749, 753, 760, 761, 762, 763, 765, 768, 770, 771, 782, 783, 784, 785, 791, 792, 793, 795, 800, 801, 804, 806, 808, 813, 820, 821, 829, 830, 833, 840, 842, 844, 845, 850, 855, 857, 859, 860, 862, 865, 868, 870, 871, 872, 873, 877, 878, 883, 884, 885, 887, 890, 891, 892, 895, 897, 903, 907, 908, 911, 912, 913, 916, 917, 919, 928, 929, 931, 936, 938, 943, 944, 951, 953, 954, 957, 958, 964, 966, 969, 971, 974, 976, 977, 978, 979, 980, 982, 987, 989, 991, 993, 994, 995, 997, 999, 1003, 1006, 1007, 1008, 1009, 1011, 1014, 1017, 1022, 1035, 1038, 1039, 1042, 1043, 1045, 1047, 1049, 1050, 1051, 1052, 1054, 1055, 1056, 1062, 1064, 1068, 1069, 1073, 1077, 1078, 1086, 1087, 1088, 1089, 1092, 1095, 1098, 1103, 1104, 1106, 1108, 1110, 1111, 1112, 1114, 1115, 1117, 1118, 1119, 1120, 1122, 1125, 1130, 1132, 1133, 1136, 1137, 1144, 1146, 1147, 1148, 1155, 1160, 1162, 1165, 1166, 1169, 1170, 1171, 1176, 1178, 1182, 1185, 1189, 1191, 1193, 1196, 1199, 1201, 1204, 1205, 1213, 1214, 1218, 1220, 1223, 1228, 1230, 1231, 1233, 1235, 1236, 1240, 1241, 1243, 1248, 1250, 1252, 1253, 1254, 1256, 1257, 1264, 1265, 1272, 1277, 1281, 1282, 1285, 1286, 1292, 1293, 1295, 1297, 1303, 1305, 1306, 1307, 1309, 1312, 1316, 1317, 1320, 1325, 1327, 1331, 1334, 1337, 1345, 1346, 1347, 1349, 1351, 1360, 1364, 1368, 1371, 1373, 1376, 1377, 1380, 1381, 1382, 1388, 1393, 1394, 1396, 1398, 1404, 1405, 1407, 1409, 1410, 1412, 1415, 1420, 1421, 1423, 1426, 1431, 1436, 1438, 1441, 1442, 1451, 1453, 1454, 1455, 1458, 1459, 1467, 1468, 1474, 1475, 1481, 1486, 1488, 1490, 1493, 1496, 1498, 1499, 1501, 1503, 1512, 1514, 1517, 1518, 1519, 1523, 1525, 1526, 1527, 1539, 1540, 1543, 1545, 1546, 1547, 1549, 1550, 1556, 1560, 1566, 1567, 1568, 1571, 1575, 1578, 1584, 1586, 1590, 1592, 1593, 1599, 1600, 1602, 1604, 1605, 1608, 1612, 1614, 1615, 1616, 1622, 1624, 1625, 1634, 1635, 1636, 1637, 1638, 1639, 1641, 1648, 1652, 1653, 1658, 1659, 1662, 1664, 1668, 1669, 1671, 1673, 1675, 1676, 1677, 1680, 1681, 1684, 1685, 1688, 1689, 1691, 1696, 1698, 1705, 1706, 1707, 1708, 1709, 1710, 1714, 1715, 1717, 1719, 1721, 1723, 1725, 1729, 1731, 1732, 1734, 1735, 1740, 1755, 1758, 1759, 1761, 1764, 1768, 1771, 1778, 1785, 1791, 1813, 1815, 1816, 1820, 1821, 1823, 1830, 1832, 1834, 1835, 1840, 1845, 1850, 1852, 1858, 1859, 1867, 1868, 1869, 1870, 1872, 1882, 1883, 1888, 1891, 1894, 1895, 1897, 1898, 1899, 1900, 1902, 1903, 1904, 1905, 1906, 1910, 1912, 1918, 1920, 1923, 1924, 1933, 1934, 1936, 1940, 1944, 1950, 1952, 1954, 1955, 1973, 1977, 1981, 1986, 1990, 1991, 1994, 1995, 1996, 1999, 2000, 2007, 2009, 2010, 2012, 2013, 2014, 2015, 2017, 2023, 2026, 2034, 2039, 2041, 2043, 2048, 2060, 2062, 2064, 2066, 2069, 2072, 2074, 2075, 2077, 2081, 2082, 2083, 2089, 2090, 2091, 2094, 2096, 2097, 2099, 2101, 2103, 2104, 2109, 2112, 2113, 2114, 2126, 2132, 2133, 2137, 2140, 2142, 2143, 2144, 2147, 2150, 2152, 2156, 2157, 2158, 2161, 2162, 2164, 2165, 2166, 2167, 2168, 2170, 2172, 2173, 2177, 2178, 2179, 2182, 2185, 2188, 2190, 2193, 2196, 2202, 2203, 2206, 2213, 2215, 2216, 2221, 2222, 2226, 2227, 2229, 2230, 2231, 2232, 2235, 2237, 2240, 2244, 2252, 2253, 2257, 2260, 2262, 2263, 2265, 2276, 2278, 2282, 2283, 2288, 2293, 2295, 2296, 2298, 2300, 2304, 2309, 2314, 2322, 2323, 2325, 2329, 2333, 2335, 2339, 2342, 2345, 2346, 2348, 2349, 2351, 2353, 2354, 2358, 2360, 2361, 2362, 2363, 2366, 2367, 2371, 2379, 2382, 2383, 2384, 2385, 2396, 2401, 2402, 2403, 2405, 2406, 2410, 2411, 2412, 2418, 2420, 2423, 2435, 2437, 2438, 2441, 2442, 2443, 2445, 2450, 2451, 2452, 2453, 2455, 2465, 2466, 2470, 2471, 2472, 2474, 2476, 2479, 2480, 2481, 2482, 2483, 2490, 2492, 2494, 2495, 2497, 2498, 2500, 2504, 2505, 2507, 2509, 2510, 2511, 2514, 2517, 2522, 2525, 2527, 2528, 2531, 2532, 2533, 2535, 2536, 2537, 2538, 2539, 2541, 2549, 2551, 2552, 2554, 2555, 2556, 2557, 2560, 2567, 2568, 2573, 2577, 2581, 2583, 2589, 2590, 2592, 2594, 2599, 2605, 2609, 2616, 2617, 2618, 2627, 2632, 2634, 2637, 2639, 2644, 2647, 2651, 2653, 2655, 2661, 2662, 2663, 2671, 2674, 2675, 2680, 2684, 2685, 2687, 2689, 2691, 2692, 2696, 2700, 2702, 2707, 2711, 2712, 2718, 2719, 2720, 2722, 2725, 2726, 2728, 2729, 2730, 2735, 2740, 2742, 2746, 2749, 2755, 2756, 2757, 2768, 2770, 2780, 2782, 2784, 2786, 2787, 2798, 2800, 2802, 2812, 2819, 2820, 2821, 2822, 2824, 2826, 2827, 2828, 2829, 2831, 2832, 2840, 2842, 2844, 2850, 2857, 2858, 2861, 2864, 2865, 2871, 2873, 2876, 2878, 2879, 2885, 2886, 2888, 2889, 2890, 2894, 2902, 2903, 2905, 2909, 2910, 2911, 2919, 2923, 2926, 2930, 2931, 2932, 2933, 2934, 2935, 2938, 2944, 2945, 2948, 2950, 2953, 2955, 2959, 2962, 2963, 2966, 2968, 2969, 2972, 2976, 2979, 2980, 2985, 2993, 2994, 2998, 3002, 3006, 3007, 3009, 3015, 3016, 3020, 3023, 3027, 3039, 3042, 3043, 3044, 3048, 3049, 3051, 3052, 3053, 3055, 3064, 3069, 3070, 3072, 3076, 3080, 3081, 3083, 3084, 3085, 3087, 3094, 3096, 3100, 3105, 3106, 3109, 3110, 3112, 3114, 3118, 3119, 3120, 3121, 3123, 3126, 3127, 3128, 3129, 3137, 3138, 3139, 3140, 3143, 3153, 3154, 3156, 3170, 3181, 3185, 3189, 3192, 3194, 3202, 3205, 3210, 3212, 3219, 3220, 3221, 3224, 3225, 3227, 3228, 3232, 3236, 3237, 3239, 3240, 3244, 3245, 3247, 3252, 3255, 3256, 3258, 3261, 3263, 3266, 3268, 3271, 3280, 3282, 3286, 3288, 3290, 3291, 3294, 3295, 3296, 3299, 3301, 3305, 3307, 3312, 3329, 3331, 3332, 3333, 3340, 3345, 3347, 3349, 3351, 3353, 3355, 3357, 3358, 3359, 3360, 3361, 3363, 3364, 3369, 3370, 3373, 3374, 3376, 3377, 3379, 3380, 3383, 3385, 3386, 3397, 3399, 3402, 3404, 3405, 3415, 3416, 3418, 3419, 3420, 3422, 3424, 3426, 3428, 3429, 3435, 3438, 3440, 3445, 3446, 3447, 3449, 3450, 3451, 3455, 3458, 3460, 3461, 3464, 3465, 3466, 3468, 3470, 3471, 3473, 3474, 3477, 3482, 3483, 3486, 3487, 3488, 3490, 3491, 3494, 3503, 3504, 3506, 3510, 3515, 3516, 3517, 3518, 3529, 3533, 3536, 3537, 3541, 3544, 3545, 3548, 3551, 3552, 3554, 3557, 3560, 3561, 3562, 3563, 3569, 3574, 3587, 3588, 3589, 3592, 3593, 3594, 3595, 3596, 3597, 3599, 3600, 3603, 3604, 3606, 3607, 3610, 3611, 3613, 3616, 3618, 3620, 3621, 3623, 3629, 3633, 3637, 3640, 3642, 3643, 3644, 3645, 3646, 3647, 3650, 3654, 3655, 3657, 3659, 3660, 3662, 3663, 3667, 3669, 3671, 3672, 3674, 3677, 3684, 3685, 3693, 3694, 3696, 3704, 3707, 3710, 3713, 3717, 3718, 3719, 3720, 3721, 3724, 3732, 3738, 3739, 3742, 3748, 3749, 3752, 3754, 3761, 3762, 3764, 3765, 3766, 3772, 3773, 3777, 3778, 3783, 3788, 3790, 3791, 3792, 3794, 3796, 3798, 3804, 3808, 3809, 3812, 3819, 3820, 3823, 3825, 3828, 3829, 3830, 3831, 3832, 3833, 3834, 3836, 3839, 3843, 3844, 3845, 3849, 3858, 3860, 3862, 3867, 3868, 3870, 3871, 3872, 3873, 3876, 3877, 3882, 3887, 3889, 3890, 3891, 3892, 3893, 3895, 3896, 3899, 3908, 3910, 3911, 3912, 3914, 3917, 3923, 3924, 3928, 3929, 3934, 3937, 3938, 3947, 3950, 3954, 3958, 3962, 3967, 3974, 3975, 3983, 3985, 3987, 3988, 3991, 3997, 4000, 4001, 4002, 4003, 4006, 4008, 4013, 4024, 4026, 4030, 4032, 4033, 4039, 4040, 4041, 4044, 4046, 4048, 4049, 4051, 4052, 4053, 4054, 4056, 4057, 4062, 4066, 4067, 4068, 4069, 4072, 4075, 4081, 4087, 4088, 4092, 4096, 4099, 4102, 4103, 4105, 4110, 4111, 4113, 4115, 4116, 4122, 4128, 4132, 4133, 4139, 4143, 4146, 4148, 4149, 4150, 4155, 4156, 4158, 4160, 4161, 4162, 4163, 4165, 4166, 4167, 4168, 4169, 4171, 4175, 4178, 4184, 4187, 4188, 4189, 4190, 4197, 4198, 4201, 4202, 4205, 4206, 4208, 4210, 4211, 4212, 4214, 4217, 4218, 4219, 4221, 4227, 4228, 4231, 4233, 4235, 4244, 4250, 4257, 4260, 4261, 4263, 4266, 4270, 4272, 4276, 4279, 4281, 4283, 4292, 4294, 4295, 4296, 4297, 4298, 4301, 4302, 4304, 4309, 4312, 4317, 4320, 4321, 4324, 4329, 4330, 4331, 4332, 4335, 4336, 4341, 4343, 4344, 4347, 4349, 4352, 4354, 4356, 4360, 4365, 4369, 4371, 4373, 4378, 4383, 4387, 4388, 4390, 4391, 4394, 4397, 4401, 4402, 4403, 4404, 4405, 4410, 4415, 4419, 4422, 4423, 4426, 4427, 4434, 4439, 4443, 4444, 4446, 4448, 4450, 4453, 4458, 4460, 4461, 4462, 4463, 4464, 4465, 4468, 4470, 4472, 4474, 4479, 4483, 4485, 4491, 4492, 4494, 4502, 4506, 4507, 4508, 4512, 4513, 4514, 4515, 4518, 4519, 4522, 4524, 4531, 4543, 4545, 4548, 4549, 4554, 4556, 4557, 4558, 4560, 4562, 4565, 4566, 4568, 4575, 4580, 4582, 4583, 4586, 4590, 4591, 4595, 4596, 4601, 4604, 4606, 4608, 4621, 4625, 4630, 4633, 4634, 4635, 4641, 4643, 4644, 4650, 4651, 4659, 4667, 4669, 4671, 4672, 4676, 4677, 4680, 4684, 4685, 4687, 4697, 4699, 4700, 4702, 4704, 4705, 4706, 4708, 4719, 4721, 4722, 4725, 4729, 4737, 4738, 4740, 4747, 4748, 4749, 4750, 4751, 4753, 4754, 4755, 4756, 4759, 4761, 4762, 4763, 4765, 4766, 4767, 4775, 4779, 4789, 4790, 4791, 4794, 4795, 4800, 4804, 4813, 4814, 4820, 4822, 4824, 4828, 4833, 4834, 4835, 4836, 4837, 4838, 4857, 4858, 4859, 4861, 4862, 4864, 4868, 4869, 4870, 4872, 4875, 4877, 4878, 4880, 4881, 4887, 4888, 4891, 4902, 4905, 4909, 4912, 4914, 4915, 4917, 4920, 4921, 4923, 4924, 4926, 4928, 4930, 4931, 4935, 4936, 4938, 4941, 4943, 4947, 4950, 4955, 4971, 4972, 4973, 4975, 4977, 4979, 4980, 4981, 4984, 4986, 4992, 4993, 4994, 4996, 5000, 5010, 5022, 5029, 5030, 5034, 5037, 5039, 5040, 5042, 5044, 5046, 5049, 5052, 5053, 5054, 5057, 5061, 5063, 5067, 5068, 5072, 5078, 5082, 5088, 5089, 5090, 5091, 5094, 5095, 5100, 5102, 5111, 5114, 5122, 5123, 5129, 5131, 5132, 5140, 5144, 5145, 5147, 5152, 5153, 5154, 5157, 5160, 5164, 5165, 5168, 5170, 5174, 5180, 5181, 5182, 5184, 5185, 5190, 5191, 5192, 5196, 5198, 5199, 5206, 5208, 5212, 5217, 5219, 5226, 5229, 5234, 5240, 5241, 5243, 5247, 5249, 5250, 5253, 5255, 5258, 5263, 5264, 5267, 5273, 5275, 5276, 5280, 5281, 5283, 5286, 5290, 5292, 5293, 5298, 5299, 5300, 5301, 5303, 5308, 5309, 5311, 5313, 5317, 5319, 5324, 5327, 5329, 5330, 5332, 5334, 5344, 5346, 5347, 5348, 5350, 5359, 5361, 5366, 5367, 5372, 5379, 5386, 5388, 5389, 5391, 5394, 5395, 5396, 5397, 5403, 5407, 5409, 5411, 5413, 5414, 5416, 5417, 5431, 5438, 5439, 5446, 5448, 5449, 5450, 5451, 5452, 5456, 5457, 5458, 5459, 5463, 5464, 5466, 5467, 5472, 5474, 5475, 5476, 5481, 5482, 5483, 5485, 5493, 5495, 5496, 5498, 5502, 5503, 5506, 5508, 5510, 5513, 5515, 5516, 5517, 5518, 5519, 5520, 5521, 5524, 5530, 5535, 5536, 5537, 5549, 5557, 5559, 5562, 5563, 5565, 5568, 5569, 5571, 5574, 5575, 5579, 5581, 5585, 5588, 5589, 5591, 5592, 5596, 5597, 5599, 5604, 5612, 5613, 5615, 5616, 5618, 5620, 5623, 5627, 5631, 5632, 5635, 5640, 5642, 5643, 5647, 5648, 5649, 5650, 5651, 5652, 5653, 5657, 5659, 5660, 5662, 5663, 5669, 5675, 5676, 5677, 5683, 5689, 5694, 5695, 5697, 5699, 5700, 5702, 5703, 5706, 5709, 5711, 5712, 5713, 5717, 5718, 5721, 5722, 5731, 5734, 5735, 5744, 5748, 5751, 5756, 5763, 5768, 5771, 5775, 5780, 5783, 5784, 5785, 5786, 5788, 5791, 5794, 5803, 5805, 5806, 5807, 5808, 5811, 5813, 5817, 5820, 5824, 5826, 5828, 5831, 5833, 5834, 5835, 5836, 5837, 5839, 5846, 5850, 5853, 5854, 5857, 5859, 5863, 5864, 5865, 5866, 5868, 5869, 5870, 5872, 5876, 5878, 5879, 5881, 5883, 5884, 5886, 5887, 5888, 5889, 5892, 5893, 5907, 5922, 5925, 5926, 5927, 5928, 5932, 5934, 5936, 5938, 5941, 5944, 5948, 5951, 5954, 5956, 5959, 5961, 5962, 5963, 5967, 5968, 5969, 5971, 5978, 5982, 5984, 5988, 5989, 5991, 5992, 5994, 5996, 5997, 6000, 6002, 6004, 6006, 6009, 6013, 6016, 6017, 6021, 6023, 6024, 6025, 6026, 6028, 6031, 6033, 6038, 6041, 6043, 6044, 6045, 6051, 6058, 6059, 6062, 6063, 6065, 6069, 6072, 6073, 6074, 6075, 6081, 6084, 6085, 6088, 6092, 6093, 6096, 6097, 6098, 6099, 6107, 6108, 6109, 6110, 6113, 6116, 6118, 6124, 6129, 6131, 6132, 6133, 6135, 6137, 6138, 6139, 6143, 6145, 6146, 6148, 6157, 6158, 6160, 6162, 6163, 6164, 6165, 6180, 6181, 6182, 6183, 6186, 6188, 6189, 6194, 6195, 6196, 6197, 6198, 6204, 6205, 6206, 6212, 6220, 6221, 6223, 6224, 6226, 6227, 6228, 6234, 6239, 6246, 6247, 6250, 6251, 6264, 6265, 6267, 6280, 6281, 6286, 6288, 6289, 6292, 6293, 6299, 6303, 6306, 6309, 6311, 6315, 6317, 6322, 6323, 6328, 6332, 6333, 6338, 6349, 6353, 6354, 6356, 6358, 6360, 6363, 6365, 6370, 6372, 6375, 6386, 6394, 6397, 6399, 6403, 6405, 6408, 6412, 6414, 6415, 6419, 6422, 6425, 6426, 6428, 6429, 6436, 6440, 6442, 6448, 6456, 6458, 6463, 6466, 6467, 6470, 6474, 6475, 6476, 6477, 6478, 6480, 6482, 6484, 6485, 6486, 6493, 6494, 6495, 6501, 6502, 6504, 6510, 6513, 6518, 6519, 6523, 6530, 6534, 6535, 6541, 6543, 6547, 6549, 6553, 6554, 6555, 6558, 6559, 6567, 6571, 6572, 6574, 6576, 6577, 6579, 6581, 6584, 6588, 6589, 6592, 6594, 6595, 6597, 6599, 6605, 6606, 6607, 6609, 6610, 6614, 6617, 6620, 6623, 6625, 6629, 6633, 6634, 6635, 6640, 6644, 6646, 6647, 6648, 6649, 6655, 6656, 6658, 6661, 6666, 6672, 6681, 6689, 6695, 6696, 6701, 6703, 6705, 6706, 6716, 6718, 6720, 6729, 6734, 6736, 6737, 6739, 6747, 6749, 6756, 6757, 6759, 6761, 6764, 6767, 6779, 6782, 6783, 6786, 6788, 6791, 6794, 6795, 6797, 6798, 6799, 6803, 6804, 6805, 6807, 6811, 6813, 6816, 6817, 6819, 6820, 6824, 6826, 6828, 6830, 6834, 6836, 6841, 6842, 6843, 6845, 6848, 6851, 6863, 6868, 6869, 6875, 6877, 6878, 6882, 6883, 6886, 6887, 6888, 6894, 6897, 6902, 6903, 6904, 6907, 6909, 6913, 6914, 6917, 6919, 6921, 6925, 6930, 6931, 6935, 6936, 6939, 6946, 6955, 6959, 6963, 6967, 6971, 6979, 6984, 6985, 6987, 6988, 6990, 6994, 6997, 6999, 7009, 7013, 7022, 7025, 7027, 7029, 7033, 7038, 7039, 7040, 7041, 7043, 7045, 7046, 7051, 7052, 7053, 7054, 7057, 7059, 7060, 7062, 7064, 7066, 7067, 7073, 7077, 7079, 7083, 7093, 7094, 7105, 7106, 7107, 7108, 7117, 7118, 7122, 7126, 7130, 7136, 7138, 7139, 7140, 7142, 7143, 7144, 7150, 7151, 7154, 7163, 7164, 7165, 7166, 7169, 7172, 7182, 7184, 7192, 7194, 7197, 7202, 7206, 7207, 7208, 7210, 7211, 7212, 7214, 7215, 7217, 7219, 7220, 7227, 7230, 7235, 7236, 7244, 7245, 7246, 7249, 7250, 7252, 7255, 7257, 7258, 7262, 7263, 7264, 7267, 7268, 7270, 7274, 7275, 7276, 7281, 7282, 7287, 7291, 7292, 7293, 7296, 7298, 7299, 7300, 7301, 7303, 7304, 7306, 7307, 7308, 7311, 7312, 7313, 7318, 7321, 7323, 7328, 7338, 7340, 7341, 7345, 7355, 7356, 7357, 7358, 7361, 7363, 7365, 7369, 7371, 7373, 7376, 7377, 7382, 7383, 7386, 7387, 7395, 7398, 7400, 7401, 7410, 7411, 7415, 7418, 7425, 7430, 7434, 7435, 7436, 7438, 7447, 7448, 7452, 7453, 7454, 7457, 7458, 7459, 7466, 7467, 7470, 7472, 7476, 7483, 7485, 7486, 7492, 7493, 7499, 7503, 7504, 7506, 7512, 7515, 7517, 7522, 7523, 7524, 7525, 7528, 7533, 7546, 7547, 7556, 7557, 7561, 7572, 7574, 7576, 7579, 7583, 7585, 7586, 7587, 7589, 7596, 7597, 7598, 7599, 7601, 7604, 7609, 7611, 7612, 7619, 7620, 7622, 7624, 7625, 7633, 7638, 7642, 7643, 7649, 7652, 7655, 7658, 7661, 7662, 7664, 7665, 7671, 7672, 7673, 7674, 7678, 7679, 7680, 7682, 7685, 7686, 7687, 7689, 7695, 7700, 7703, 7712, 7715, 7716, 7724, 7726, 7730, 7734, 7736, 7737, 7738, 7741, 7742, 7744, 7745, 7749, 7753, 7754, 7756, 7761, 7763, 7764, 7767, 7770, 7774, 7775, 7779, 7780, 7781, 7785, 7786, 7788, 7791, 7793, 7798, 7799, 7800, 7801, 7803, 7804, 7806, 7807, 7815, 7818, 7819, 7820, 7823, 7826, 7833, 7839, 7840, 7841, 7844, 7845, 7854, 7856, 7865, 7873, 7875, 7877, 7880, 7888, 7890, 7893, 7896, 7901, 7908, 7910, 7911, 7918, 7925, 7928, 7933, 7934, 7935, 7936, 7938, 7942, 7944, 7949, 7950, 7952, 7965, 7966, 7967, 7974, 7976, 7977, 7982, 7984, 7986, 7993, 7994, 8006, 8007, 8012, 8020, 8025, 8030, 8031, 8036, 8041, 8042, 8044, 8047, 8049, 8056, 8059, 8063, 8064, 8067, 8068, 8074, 8076, 8077, 8078, 8080, 8081, 8083, 8084, 8087, 8088, 8093, 8095, 8099, 8102, 8106, 8109, 8110, 8112, 8113, 8118, 8121, 8126, 8129, 8130, 8134, 8145, 8146, 8148, 8150, 8151, 8163, 8170, 8177, 8178, 8179, 8180, 8181, 8182, 8189, 8193, 8194, 8198, 8202, 8204, 8208, 8210, 8213, 8215, 8217, 8219, 8220, 8223, 8230, 8234, 8235, 8237, 8239, 8242, 8248, 8250, 8252, 8253, 8262, 8263, 8264, 8265, 8266, 8268, 8269, 8273, 8274, 8275, 8276, 8282, 8289, 8291, 8292, 8295, 8296, 8297, 8300, 8304, 8305, 8308, 8310, 8311, 8312, 8318, 8319, 8326, 8329, 8334, 8335, 8339, 8340, 8341, 8347, 8349, 8350, 8351, 8352, 8353, 8355, 8358, 8367, 8368, 8371, 8373, 8378, 8379, 8380, 8382, 8385, 8386, 8387, 8389, 8390, 8392, 8393, 8395, 8401, 8402, 8403, 8404, 8406, 8410, 8413, 8414, 8415, 8416, 8417, 8418, 8428, 8430, 8433, 8435, 8436, 8438, 8439, 8442, 8443, 8444, 8445, 8446, 8447, 8448, 8449, 8450, 8451, 8457, 8458, 8465, 8470, 8473, 8474, 8476, 8477, 8478, 8481, 8482, 8483, 8486, 8494, 8498, 8501, 8502, 8503, 8505, 8507, 8509, 8511, 8513, 8520, 8521, 8524, 8525, 8526, 8527, 8531, 8532, 8542, 8543, 8553, 8554, 8557, 8561, 8562, 8563, 8565, 8568, 8576, 8579, 8581, 8582, 8583, 8588, 8592, 8593, 8596, 8597, 8598, 8600, 8603, 8604, 8605, 8612, 8621, 8622, 8631, 8634, 8635, 8638, 8644, 8646, 8648, 8650, 8652, 8654, 8658, 8659, 8660, 8665, 8669, 8670, 8672, 8675, 8676, 8677, 8686, 8693, 8700, 8703, 8705, 8706, 8708, 8709, 8710, 8712, 8713, 8717, 8719, 8722, 8726, 8728, 8731, 8732, 8736, 8740, 8741, 8744, 8748, 8769, 8773, 8774, 8777, 8779, 8782, 8783, 8784, 8785, 8786, 8789, 8792, 8795, 8803, 8804, 8810, 8811, 8817, 8822, 8824, 8829, 8830, 8831, 8835, 8839, 8841, 8842, 8843, 8844, 8853, 8865, 8876, 8877, 8878, 8881, 8883, 8888, 8889, 8892, 8896, 8899, 8900, 8901, 8902, 8907, 8908, 8911, 8916, 8917, 8919, 8922, 8924, 8926, 8928, 8929, 8930, 8935, 8937, 8938, 8941, 8945, 8946, 8951, 8953, 8957, 8960, 8961, 8967, 8968, 8971, 8979, 8980, 8981, 8985, 8986, 8991, 8992, 8998, 9001, 9003, 9006, 9009, 9011, 9012, 9013, 9018, 9026, 9027, 9029, 9030, 9045, 9050, 9052, 9058, 9059, 9060, 9063, 9065, 9066, 9069, 9071, 9072, 9076, 9083, 9086, 9088, 9091, 9092, 9095, 9104, 9106, 9107, 9110, 9116, 9118, 9120, 9123, 9125, 9129, 9131, 9133, 9134, 9138, 9139, 9140, 9141, 9142, 9144, 9145, 9149, 9151, 9152, 9154, 9159, 9167, 9168, 9175, 9177, 9179, 9180, 9183, 9185, 9188, 9190, 9191, 9194, 9195, 9205, 9206, 9207, 9210, 9211, 9213, 9214, 9215, 9216, 9218, 9226, 9229, 9231, 9233, 9236, 9237, 9240, 9243, 9246, 9248, 9249, 9253, 9257, 9259, 9262, 9265, 9267, 9270, 9273, 9282, 9284, 9285, 9288, 9290, 9291, 9292, 9295, 9300, 9304, 9306, 9308, 9311, 9321, 9323, 9326, 9327, 9328, 9337, 9338, 9341, 9346, 9347, 9350, 9352, 9359, 9360, 9366, 9368, 9373, 9375, 9376, 9380, 9382, 9389, 9391, 9392, 9394, 9400, 9402, 9403, 9406, 9407, 9411, 9413, 9414, 9415, 9419, 9421, 9423, 9425, 9429, 9434, 9439, 9443, 9449, 9453, 9456, 9460, 9467, 9471, 9472, 9473, 9481, 9484, 9488, 9490, 9497, 9500, 9502, 9503, 9504, 9509, 9514, 9517, 9518, 9521, 9525, 9534, 9535, 9536, 9537, 9540, 9543, 9545, 9546, 9548, 9553, 9555, 9560, 9564, 9567, 9568, 9571, 9573, 9574, 9577, 9579, 9586, 9587, 9591, 9592, 9595, 9596, 9598, 9601, 9602, 9605, 9606, 9607, 9608, 9609, 9614, 9615, 9617, 9620, 9623, 9624, 9626, 9629, 9630, 9632, 9641, 9642, 9644, 9645, 9648, 9649, 9650, 9651, 9653, 9655, 9657, 9658, 9659, 9663, 9668, 9677, 9682, 9686, 9696, 9698, 9701, 9706, 9709, 9710, 9711, 9721, 9723, 9726, 9727, 9729, 9731, 9733, 9734, 9737, 9738, 9742, 9744, 9745, 9746, 9749, 9750, 9756, 9758, 9763, 9764, 9770, 9774, 9776, 9777, 9782, 9785, 9786, 9791, 9792, 9793, 9794, 9798, 9799, 9804, 9808, 9812, 9813, 9816, 9819, 9820, 9825, 9827, 9828, 9829, 9833, 9835, 9836, 9845, 9847, 9869, 9875, 9878, 9880, 9882, 9886, 9887, 9889, 9891, 9892, 9894, 9897, 9907, 9909, 9911, 9921, 9923, 9924, 9928, 9930, 9931, 9932, 9934, 9935, 9944, 9946, 9949, 9950, 9952, 9953, 9956, 9960, 9962, 9963, 9967, 9968, 9969, 9972, 9973, 9975, 9976, 9980, 9982, 9984, 9987, 9988, 9990, 9991, 9992, 9997, 10000, 10001, 10008, 10012, 10013, 10017, 10019, 10020, 10022, 10026, 10027, 10032, 10033, 10034, 10035, 10037, 10041, 10049, 10051, 10054, 10055, 10058, 10059, 10062, 10064, 10066, 10073, 10077, 10078, 10083, 10090, 10091, 10092, 10095, 10098, 10101, 10103, 10106, 10110, 10115, 10116, 10119, 10122, 10128, 10131, 10136, 10140, 10143, 10151, 10158, 10160, 10163, 10165, 10166, 10168, 10169, 10174, 10176, 10177, 10179, 10181, 10191, 10192, 10193, 10194, 10195, 10196, 10199, 10201, 10206, 10207, 10212, 10217, 10218, 10219, 10220, 10221, 10222, 10223, 10228, 10230, 10231, 10233, 10235, 10236, 10237, 10239, 10249, 10253, 10259, 10260, 10262, 10263, 10266, 10269, 10270, 10275, 10278, 10284, 10286, 10291, 10292, 10295, 10300, 10302, 10306, 10307, 10311, 10314, 10318, 10319, 10323, 10325, 10326, 10331, 10333, 10334, 10335, 10336, 10341, 10343, 10345, 10346, 10353, 10354, 10356, 10357, 10361, 10362, 10364, 10365, 10371, 10375, 10376, 10378, 10380, 10381, 10388, 10397, 10398, 10399, 10400, 10401, 10402, 10405, 10410, 10411, 10414, 10416, 10417, 10419, 10421, 10423, 10425, 10435, 10436, 10438, 10440, 10446, 10447, 10450, 10452, 10453, 10456, 10463, 10464, 10465, 10466, 10468, 10469, 10471, 10472, 10473, 10474, 10480, 10482, 10487, 10488, 10490, 10492, 10494, 10496, 10498, 10499, 10501, 10506, 10508, 10514, 10518, 10522, 10523, 10527, 10528, 10530, 10531, 10532, 10535, 10537, 10541, 10542, 10543, 10544, 10547, 10548, 10549, 10550, 10551, 10553, 10555, 10563, 10564, 10567, 10571, 10579, 10580, 10581, 10582, 10588, 10593, 10596, 10597, 10599, 10601, 10602, 10611, 10612, 10615, 10616, 10621, 10622, 10625, 10632, 10637, 10638, 10639, 10640, 10643, 10645, 10646, 10651, 10655, 10665, 10668, 10669, 10670, 10676, 10678, 10679, 10682, 10683, 10684, 10685, 10686, 10689, 10694, 10700, 10701, 10705, 10707, 10716, 10721, 10723, 10724, 10726, 10729, 10734, 10737, 10738, 10740, 10741, 10744, 10747, 10748, 10749, 10752, 10754, 10756, 10761, 10762, 10770, 10772, 10774, 10775, 10778, 10779, 10780, 10781, 10785, 10787, 10788, 10801, 10802, 10803, 10810, 10815, 10818, 10819, 10822, 10823, 10824, 10827, 10831, 10833, 10836, 10837, 10838, 10839, 10843, 10844, 10850, 10851, 10852, 10853, 10856, 10857, 10858, 10860, 10866, 10867, 10870, 10877, 10878, 10881, 10886, 10898, 10899, 10901, 10902, 10911, 10917, 10918, 10920, 10924, 10926, 10927, 10928, 10929, 10930, 10933, 10934, 10938, 10940, 10941, 10947, 10961, 10966, 10967, 10972, 10974, 10976, 10977, 10979, 10985, 10988, 10993, 10996, 10999, 11008, 11015, 11017, 11021, 11022, 11024, 11027, 11030, 11032, 11039, 11044, 11046, 11047, 11052, 11053, 11058, 11066, 11078, 11082, 11083, 11090, 11100, 11101, 11103, 11109, 11114, 11118, 11122, 11123, 11124, 11129, 11136, 11137, 11145, 11147, 11149, 11151, 11152, 11153, 11154, 11160, 11161, 11163, 11165, 11166, 11168, 11169, 11177, 11178, 11181, 11184, 11187, 11188, 11190, 11192, 11194, 11198, 11203, 11214, 11216, 11217, 11218, 11222, 11226, 11228, 11230, 11232, 11233, 11235, 11236, 11238, 11239, 11241, 11242, 11243, 11246, 11247, 11251, 11254, 11255, 11256, 11258, 11260, 11262, 11263, 11266, 11274, 11282, 11286, 11290, 11291, 11292, 11293, 11295, 11297, 11299, 11302, 11304, 11306, 11313, 11315, 11318, 11320, 11321, 11323, 11329, 11330, 11331, 11337, 11340, 11345, 11346, 11348, 11349, 11352, 11362, 11363, 11364, 11365, 11369, 11371, 11373, 11380, 11382, 11387, 11394, 11395, 11398, 11401, 11405, 11406, 11408, 11417, 11430, 11431, 11435, 11438, 11443, 11446, 11447, 11448, 11449, 11451, 11459, 11465, 11472, 11475, 11477, 11478, 11485, 11487, 11489, 11490, 11491, 11492, 11496, 11498, 11500, 11501, 11505, 11506, 11507, 11508, 11518, 11520, 11523, 11524, 11526, 11527, 11531, 11532, 11533, 11535, 11541, 11544, 11548, 11550, 11551, 11553, 11558, 11560, 11561, 11562, 11567, 11568, 11571, 11576, 11577, 11578, 11585, 11588, 11593, 11594, 11595, 11596, 11597, 11599, 11603, 11604, 11607, 11610, 11612, 11615, 11617, 11618, 11621, 11623, 11625, 11626, 11628, 11634, 11636, 11639, 11647, 11649, 11650, 11655, 11656, 11658, 11659, 11663, 11669, 11673, 11678, 11681, 11682, 11688, 11691, 11692, 11694, 11696, 11699, 11701, 11703, 11705, 11707, 11712, 11718, 11721, 11723, 11725, 11726, 11730, 11731, 11733, 11736, 11740, 11743, 11744, 11753, 11760, 11761, 11763, 11765, 11770, 11771, 11776, 11777, 11778, 11781, 11783, 11784, 11786, 11789, 11792, 11794, 11797, 11799, 11800, 11805, 11809, 11810, 11811, 11814, 11818, 11829, 11830, 11836, 11837, 11840, 11841, 11842, 11846, 11847, 11848, 11856, 11858, 11859, 11861, 11864, 11865, 11868, 11869, 11872, 11877, 11878, 11879, 11886, 11887, 11891, 11892, 11894, 11895, 11897, 11898, 11902, 11906, 11909, 11911, 11913, 11916, 11917, 11918, 11919, 11920, 11921, 11922, 11923, 11926, 11927, 11928, 11929, 11930, 11933, 11934, 11935, 11940, 11943, 11945, 11946, 11947, 11949, 11953, 11956, 11959, 11960, 11961, 11962, 11963, 11965, 11966, 11975, 11976, 11977, 11978, 11979, 11980, 11983, 11987, 11988, 11993, 11997, 11998, 11999, 12004, 12015, 12018, 12019, 12023, 12024, 12026, 12027, 12032, 12033, 12042, 12043, 12044, 12059, 12068, 12077, 12081, 12083, 12092, 12093, 12095, 12098, 12104, 12106, 12109, 12110, 12112, 12114, 12115, 12118, 12126, 12127, 12128, 12129, 12130, 12134, 12137, 12138, 12139, 12143, 12147, 12148, 12161, 12165, 12166, 12170, 12174, 12175, 12181, 12183, 12185, 12189, 12194, 12197, 12200, 12201, 12204, 12207, 12208, 12215, 12217, 12218, 12219, 12220, 12221, 12223, 12227, 12228, 12229, 12234, 12240, 12241, 12245, 12249, 12250, 12252, 12253, 12256, 12259, 12263, 12267, 12268, 12269, 12274, 12278, 12283, 12287, 12291, 12293, 12295, 12297, 12298, 12310, 12311, 12313, 12314, 12315, 12317, 12321, 12323, 12324, 12326, 12329, 12333, 12337, 12340, 12347, 12354, 12356, 12358, 12359, 12364, 12367, 12368, 12369, 12370, 12372, 12374, 12375, 12379, 12380, 12381, 12382, 12383, 12397, 12400, 12403, 12404, 12406, 12410, 12411, 12414, 12416, 12419, 12420, 12421, 12426, 12427, 12428, 12437, 12440, 12441, 12445, 12447, 12448, 12451, 12455, 12456, 12457, 12462, 12467, 12468, 12476, 12478, 12479, 12481, 12483, 12487, 12488, 12491, 12494, 12497, 12503, 12504, 12508, 12515, 12521, 12523, 12525, 12530, 12536, 12539, 12545, 12546, 12547, 12549, 12555, 12559, 12561, 12563, 12565, 12567, 12570, 12578, 12585, 12588, 12591, 12597, 12600, 12605, 12608, 12609, 12611, 12616, 12619, 12622, 12623, 12629, 12631, 12633, 12634, 12635, 12636, 12638, 12639, 12641, 12645, 12652, 12653, 12655, 12663, 12668, 12670, 12671, 12672, 12675, 12679, 12680, 12681, 12682, 12684, 12685, 12688, 12691, 12693, 12698, 12699, 12701, 12702, 12715, 12718, 12729, 12731, 12732, 12733, 12737, 12738, 12739, 12740, 12741, 12742, 12743, 12748, 12749, 12752, 12754, 12755, 12758, 12760, 12761, 12764, 12766, 12769, 12771, 12772, 12773, 12783, 12790, 12791, 12794, 12797, 12802, 12803, 12805, 12808, 12810, 12812, 12813, 12817, 12819, 12822, 12824, 12826, 12827, 12828, 12834, 12836, 12838, 12839, 12843, 12844, 12849, 12854, 12858, 12861, 12866, 12869, 12882, 12883, 12887, 12888, 12895, 12898, 12900, 12901, 12904, 12905, 12906, 12910, 12912, 12916, 12917, 12918, 12920, 12921, 12926, 12932, 12938, 12939, 12940, 12944, 12945, 12946, 12947, 12950, 12961, 12963, 12966, 12968, 12969, 12974, 12975, 12977, 12978, 12982, 12983, 12984, 12987, 12992, 12993, 12994, 12996, 12998, 13006, 13010, 13011, 13014, 13015, 13017, 13018, 13022, 13023, 13024, 13030, 13032, 13033, 13035, 13036, 13038, 13040, 13044, 13049, 13050, 13053, 13055, 13056, 13060, 13061, 13065, 13066, 13067, 13069, 13071, 13074, 13079, 13085, 13086, 13087, 13100, 13102, 13105, 13106, 13115, 13116, 13117, 13118, 13123, 13124, 13128, 13131, 13142, 13148, 13149, 13151, 13153, 13156, 13160, 13169, 13174, 13175, 13177, 13181, 13182, 13192, 13197, 13199, 13205, 13207, 13209, 13210, 13212, 13213, 13217, 13221, 13222, 13224, 13227, 13232, 13234, 13235, 13236, 13237, 13238, 13243, 13249, 13251, 13255, 13258, 13259, 13260, 13261, 13263, 13267, 13268, 13269, 13270, 13276, 13278, 13280, 13281, 13293, 13295, 13296, 13298, 13301, 13303, 13304, 13313, 13315, 13317, 13322, 13323, 13326, 13328, 13330, 13332, 13338, 13348, 13349, 13351, 13353, 13354, 13361, 13369, 13370, 13375, 13380, 13384, 13391, 13392, 13393, 13394, 13396, 13397, 13401, 13402, 13403, 13408, 13411, 13416, 13417, 13419, 13420, 13423, 13424, 13430, 13431, 13433, 13439, 13444, 13448, 13449, 13450, 13451, 13454, 13456, 13460, 13463, 13466, 13468, 13469, 13470, 13473, 13475, 13496, 13498, 13499, 13500, 13501, 13504, 13505, 13506, 13510, 13513, 13514, 13515, 13516, 13517, 13519, 13520, 13521, 13524, 13529, 13530, 13532, 13539, 13540, 13543, 13544, 13546, 13547, 13549, 13552, 13556, 13568, 13569, 13574, 13579, 13580, 13582, 13584, 13587, 13589, 13597, 13598, 13601, 13604, 13612, 13621, 13623, 13631, 13634, 13635, 13636, 13637, 13641, 13643, 13647, 13650, 13652, 13654, 13661, 13662, 13663, 13668, 13669, 13671, 13676, 13677, 13678, 13681, 13683, 13684, 13686, 13687, 13688, 13689, 13691, 13698, 13699, 13700, 13703, 13706, 13710, 13712, 13713, 13715, 13716, 13720, 13729, 13730, 13733, 13737, 13738, 13742, 13745, 13747, 13750, 13755, 13756, 13764, 13766, 13767, 13769, 13773, 13774, 13781, 13783, 13786, 13787, 13789, 13790, 13791, 13793, 13794, 13795, 13796, 13798, 13809, 13816, 13817, 13818, 13819, 13820, 13822, 13828, 13830, 13831, 13833, 13835, 13843, 13849, 13852, 13853, 13859, 13860, 13862, 13866, 13869, 13870, 13872, 13873, 13874, 13876, 13877, 13881, 13882, 13886, 13888, 13891, 13892, 13894, 13896, 13901, 13904, 13906, 13909, 13910, 13911, 13917, 13921, 13923, 13925, 13927, 13930, 13938, 13944, 13947, 13948, 13949, 13952, 13953, 13954, 13956, 13961, 13962, 13963, 13965, 13969, 13970, 13971, 13975, 13976, 13981, 13983, 13984, 13990, 13991, 13992, 13999, 14000, 14003, 14005, 14009, 14013, 14016, 14017, 14018, 14022, 14026, 14027, 14030, 14031, 14036, 14041, 14043, 14049, 14050, 14051, 14052, 14054, 14062, 14063, 14066, 14067, 14069, 14070, 14071, 14075, 14081, 14084, 14086, 14091, 14092, 14093, 14094, 14099, 14102, 14105, 14106, 14107, 14112, 14115, 14116, 14118, 14120, 14122, 14125, 14126, 14128, 14129, 14130, 14132, 14134, 14135, 14138, 14139, 14143, 14145, 14148, 14149, 14150.

Promoters expressing in silk tissue at the tasseling stage include SEQ IDs: 1, 3, 4, 7, 11, 13, 15, 26, 27, 29, 31, 34, 36, 45, 48, 53, 54, 61, 63, 64, 65, 88, 93, 96, 97, 102, 103, 107, 108, 110, 111, 112, 117, 121, 126, 129, 130, 131, 132, 134, 139, 140, 141, 143, 147, 148, 152, 162, 164, 165, 172, 174, 176, 179, 181, 183, 184, 187, 191, 194, 196, 199, 202, 204, 205, 207, 210, 211, 212, 223, 230, 232, 233, 235, 236, 237, 240, 242, 244, 246, 249, 251, 257, 259, 262, 264, 271, 273, 274, 280, 281, 286, 288, 289, 293, 299, 303, 305, 306, 307, 309, 316, 319, 320, 322, 323, 328, 329, 332, 335, 341, 346, 348, 352, 353, 354, 356, 359, 360, 367, 373, 374, 378, 379, 382, 387, 388, 393, 396, 401, 405, 406, 407, 416, 419, 420, 423, 424, 428, 429, 433, 434, 452, 456, 461, 466, 474, 478, 479, 483, 485, 488, 498, 502, 504, 507, 509, 510, 512, 513, 514, 516, 517, 520, 522, 523, 525, 529, 532, 533, 534, 536, 537, 541, 542, 543, 544, 546, 547, 557, 564, 565, 576, 578, 580, 585, 591, 593, 594, 595, 596, 598, 599, 601, 602, 604, 607, 611, 613, 614, 620, 623, 626, 630, 631, 633, 635, 638, 643, 644, 650, 653, 656, 662, 663, 666, 674, 676, 677, 681, 686, 693, 694, 701, 702, 705, 707, 708, 716, 717, 719, 722, 723, 724, 727, 734, 736, 740, 742, 744, 749, 753, 759, 765, 768, 770, 782, 783, 784, 785, 792, 793, 795, 800, 806, 808, 819, 820, 821, 829, 830, 833, 840, 842, 844, 855, 857, 859, 860, 862, 863, 865, 870, 872, 873, 883, 887, 890, 892, 895, 897, 901, 903, 907, 910, 911, 912, 913, 916, 917, 924, 928, 929, 931, 936, 940, 943, 944, 951, 953, 954, 957, 958, 961, 962, 964, 966, 971, 974, 977, 979, 980, 982, 983, 987, 991, 994, 995, 997, 999, 1003, 1006, 1007, 1009, 1011, 1014, 1022, 1028, 1038, 1039, 1041, 1042, 1043, 1044, 1045, 1047, 1049, 1050, 1051, 1052, 1055, 1056, 1062, 1064, 1065, 1068, 1069, 1077, 1078, 1086, 1087, 1088, 1089, 1092, 1095, 1101, 1103, 1104, 1108, 1110, 1111, 1112, 1114, 1115, 1117, 1118, 1119, 1120, 1122, 1125, 1127, 1130, 1132, 1133, 1136, 1137, 1143, 1146, 1147, 1148, 1154, 1160, 1162, 1166, 1168, 1169, 1170, 1171, 1176, 1178, 1182, 1189, 1190, 1191, 1196, 1198, 1199, 1202, 1204, 1214, 1217, 1218, 1220, 1223, 1225, 1228, 1230, 1231, 1233, 1236, 1240, 1241, 1243, 1248, 1249, 1250, 1251, 1252, 1253, 1254, 1256, 1258, 1261, 1264, 1265, 1269, 1272, 1281, 1283, 1285, 1286, 1293, 1295, 1297, 1298, 1305, 1306, 1309, 1312, 1316, 1317, 1320, 1321, 1327, 1330, 1331, 1334, 1337, 1339, 1346, 1347, 1349, 1351, 1354, 1355, 1360, 1364, 1367, 1371, 1372, 1373, 1376, 1377, 1380, 1381, 1382, 1388, 1393, 1396, 1397, 1398, 1403, 1404, 1407, 1415, 1420, 1421, 1423, 1426, 1431, 1436, 1438, 1441, 1442, 1448, 1451, 1453, 1454, 1455, 1458, 1459, 1462, 1466, 1467, 1468, 1471, 1474, 1475, 1486, 1490, 1493, 1498, 1499, 1501, 1508, 1510, 1511, 1513, 1514, 1518, 1523, 1525, 1526, 1527, 1533, 1539, 1543, 1545, 1546, 1547, 1549, 1550, 1555, 1556, 1560, 1563, 1566, 1567, 1568, 1570, 1571, 1575, 1576, 1578, 1584, 1586, 1590, 1592, 1593, 1594, 1599, 1602, 1604, 1605, 1608, 1612, 1614, 1615, 1616, 1622, 1625, 1634, 1635, 1636, 1637, 1638, 1641, 1642, 1650, 1653, 1654, 1658, 1659, 1662, 1668, 1669, 1671, 1673, 1675, 1676, 1680, 1682, 1683, 1684, 1685, 1688, 1689, 1691, 1696, 1698, 1699, 1705, 1706, 1707, 1708, 1709, 1710, 1714, 1717, 1719, 1723, 1725, 1729, 1731, 1732, 1735, 1740, 1755, 1758, 1759, 1761, 1764, 1771, 1776, 1778, 1779, 1785, 1791, 1813, 1815, 1816, 1820, 1821, 1823, 1826, 1830, 1832, 1834, 1835, 1837, 1838, 1839, 1840, 1845, 1850, 1852, 1859, 1861, 1865, 1867, 1868, 1869, 1870, 1872, 1876, 1882, 1883, 1886, 1888, 1894, 1895, 1897, 1898, 1899, 1900, 1902, 1903, 1905, 1906, 1911, 1912, 1914, 1917, 1918, 1920, 1922, 1923, 1924, 1933, 1934, 1936, 1940, 1944, 1950, 1952, 1954, 1955, 1959, 1976, 1981, 1986, 1991, 1993, 1994, 1995, 1996, 1999, 2000, 2007, 2008, 2009, 2010, 2012, 2013, 2014, 2015, 2016, 2017, 2026, 2031, 2032, 2039, 2041, 2043, 2045, 2048, 2054, 2055, 2060, 2062, 2064, 2066, 2072, 2074, 2077, 2079, 2080, 2081, 2082, 2083, 2088, 2089, 2094, 2096, 2099, 2101, 2103, 2104, 2112, 2114, 2116, 2117, 2132, 2133, 2134, 2140, 2142, 2143, 2144, 2147, 2150, 2152, 2154, 2155, 2156, 2157, 2159, 2161, 2164, 2166, 2167, 2168, 2170, 2172, 2173, 2177, 2179, 2185, 2188, 2190, 2191, 2193, 2196, 2202, 2203, 2214, 2215, 2216, 2218, 2221, 2222, 2226, 2227, 2229, 2230, 2231, 2232, 2235, 2240, 2247, 2252, 2253, 2257, 2260, 2261, 2262, 2263, 2273, 2274, 2278, 2280, 2282, 2283, 2288, 2291, 2295, 2296, 2297, 2298, 2301, 2303, 2304, 2305, 2309, 2310, 2314, 2322, 2323, 2328, 2329, 2331, 2339, 2342, 2348, 2349, 2351, 2352, 2353, 2363, 2366, 2367, 2371, 2377, 2379, 2382, 2384, 2396, 2398, 2401, 2403, 2405, 2406, 2410, 2411, 2412, 2413, 2418, 2419, 2420, 2422, 2423, 2435, 2437, 2438, 2440, 2443, 2445, 2451, 2452, 2453, 2454, 2455, 2457, 2458, 2465, 2470, 2471, 2472, 2474, 2476, 2479, 2480, 2481, 2482, 2485, 2490, 2492, 2494, 2495, 2496, 2498, 2500, 2505, 2506, 2509, 2510, 2511, 2514, 2515, 2517, 2519, 2525, 2527, 2528, 2531, 2532, 2533, 2536, 2537, 2538, 2539, 2541, 2547, 2548, 2549, 2552, 2555, 2557, 2567, 2568, 2573, 2577, 2578, 2580, 2581, 2589, 2590, 2594, 2599, 2601, 2605, 2609, 2611, 2616, 2617, 2625, 2626, 2627, 2632, 2634, 2637, 2639, 2644, 2650, 2655, 2661, 2662, 2663, 2671, 2674, 2675, 2679, 2684, 2685, 2687, 2689, 2691, 2692, 2696, 2702, 2705, 2707, 2715, 2718, 2719, 2720, 2725, 2726, 2728, 2729, 2730, 2735, 2739, 2740, 2742, 2746, 2747, 2749, 2752, 2755, 2756, 2757, 2763, 2764, 2765, 2768, 2770, 2775, 2780, 2784, 2785, 2787, 2791, 2798, 2800, 2801, 2802, 2805, 2808, 2812, 2820, 2821, 2822, 2823, 2824, 2826, 2827, 2828, 2831, 2832, 2840, 2844, 2850, 2857, 2858, 2861, 2862, 2865, 2871, 2873, 2876, 2878, 2888, 2889, 2890, 2893, 2894, 2902, 2903, 2906, 2908, 2909, 2910, 2911, 2912, 2915, 2916, 2917, 2919, 2923, 2926, 2930, 2931, 2932, 2933, 2934, 2935, 2938, 2944, 2945, 2948, 2950, 2953, 2955, 2960, 2962, 2963, 2966, 2968, 2969, 2976, 2979, 2980, 2985, 2994, 2998, 3000, 3002, 3003, 3007, 3008, 3010, 3015, 3016, 3023, 3024, 3038, 3039, 3040, 3042, 3044, 3048, 3049, 3051, 3052, 3053, 3055, 3058, 3059, 3064, 3067, 3070, 3072, 3075, 3080, 3081, 3083, 3084, 3085, 3087, 3088, 3090, 3094, 3095, 3096, 3100, 3101, 3102, 3105, 3106, 3109, 3112, 3114, 3118, 3119, 3120, 3121, 3123, 3126, 3127, 3128, 3135, 3137, 3138, 3139, 3140, 3143, 3147, 3148, 3153, 3156, 3157, 3158, 3167, 3170, 3181, 3185, 3192, 3194, 3200, 3202, 3205, 3206, 3210, 3212, 3219, 3220, 3221, 3224, 3225, 3226, 3228, 3232, 3237, 3240, 3250, 3252, 3255, 3258, 3260, 3261, 3263, 3266, 3268, 3271, 3273, 3278, 3280, 3286, 3288, 3289, 3290, 3291, 3294, 3295, 3299, 3301, 3303, 3305, 3310, 3312, 3329, 3331, 3332, 3333, 3340, 3343, 3345, 3347, 3349, 3351, 3353, 3355, 3358, 3361, 3363, 3370, 3374, 3376, 3377, 3383, 3385, 3386, 3392, 3393, 3397, 3399, 3404, 3405, 3414, 3415, 3416, 3418, 3419, 3420, 3422, 3424, 3426, 3427, 3428, 3435, 3438, 3440, 3445, 3446, 3447, 3450, 3452, 3455, 3458, 3460, 3461, 3464, 3465, 3468, 3470, 3471, 3474, 3475, 3477, 3482, 3483, 3486, 3487, 3488, 3490, 3494, 3496, 3500, 3503, 3504, 3506, 3510, 3511, 3516, 3517, 3518, 3533, 3536, 3537, 3541, 3544, 3545, 3548, 3549, 3551, 3552, 3554, 3558, 3560, 3562, 3563, 3569, 3572, 3576, 3577, 3582, 3587, 3588, 3589, 3592, 3593, 3595, 3597, 3600, 3603, 3604, 3606, 3607, 3610, 3611, 3613, 3616, 3618, 3620, 3621, 3623, 3624, 3626, 3627, 3628, 3630, 3631, 3633, 3637, 3640, 3642, 3643, 3644, 3645, 3646, 3647, 3648, 3650, 3654, 3655, 3657, 3659, 3660, 3663, 3667, 3668, 3671, 3672, 3674, 3684, 3685, 3697, 3706, 3707, 3710, 3713, 3715, 3717, 3718, 3719, 3720, 3725, 3742, 3748, 3749, 3752, 3754, 3757, 3761, 3762, 3764, 3765, 3766, 3772, 3773, 3775, 3777, 3778, 3783, 3784, 3785, 3788, 3789, 3790, 3791, 3792, 3794, 3798, 3804, 3808, 3809, 3810, 3812, 3818, 3820, 3823, 3825, 3828, 3830, 3831, 3832, 3833, 3834, 3837, 3842, 3843, 3844, 3849, 3858, 3860, 3862, 3866, 3867, 3868, 3870, 3871, 3872, 3873, 3874, 3876, 3877, 3881, 3883, 3887, 3889, 3890, 3891, 3892, 3893, 3894, 3895, 3896, 3908, 3910, 3911, 3912, 3914, 3917, 3923, 3924, 3928, 3929, 3933, 3934, 3938, 3941, 3947, 3950, 3954, 3958, 3962, 3967, 3975, 3978, 3983, 3987, 3988, 3994, 3995, 3996, 3997, 4000, 4006, 4008, 4013, 4030, 4034, 4039, 4040, 4041, 4042, 4047, 4048, 4049, 4050, 4051, 4052, 4054, 4056, 4057, 4061, 4062, 4066, 4067, 4068, 4069, 4072, 4075, 4077, 4078, 4079, 4084, 4087, 4092, 4096, 4099, 4105, 4107, 4110, 4111, 4113, 4115, 4116, 4122, 4124, 4128, 4132, 4133, 4143, 4146, 4149, 4154, 4155, 4156, 4158, 4160, 4161, 4162, 4163, 4165, 4166, 4167, 4168, 4169, 4170, 4171, 4175, 4176, 4178, 4184, 4185, 4187, 4188, 4189, 4191, 4197, 4198, 4200, 4201, 4202, 4205, 4206, 4207, 4208, 4210, 4211, 4212, 4214, 4217, 4219, 4221, 4227, 4228, 4233, 4235, 4241, 4244, 4246, 4250, 4251, 4255, 4257, 4258, 4260, 4261, 4266, 4270, 4272, 4279, 4280, 4281, 4292, 4294, 4295, 4296, 4298, 4301, 4302, 4304, 4309, 4312, 4319, 4320, 4321, 4324, 4329, 4330, 4331, 4335, 4337, 4341, 4343, 4344, 4347, 4349, 4352, 4354, 4356, 4358, 4360, 4365, 4369, 4371, 4373, 4378, 4380, 4383, 4390, 4391, 4393, 4394, 4397, 4401, 4402, 4403, 4404, 4405, 4410, 4415, 4417, 4422, 4423, 4426, 4431, 4434, 4439, 4440, 4443, 4444, 4446, 4448, 4450, 4453, 4456, 4458, 4460, 4461, 4462, 4463, 4466, 4468, 4472, 4474, 4479, 4485, 4490, 4491, 4492, 4494, 4498, 4500, 4506, 4507, 4512, 4515, 4516, 4518, 4519, 4531, 4548, 4549, 4552, 4554, 4555, 4556, 4557, 4558, 4559, 4562, 4565, 4566, 4568, 4574, 4575, 4580, 4582, 4583, 4590, 4591, 4596, 4599, 4601, 4604, 4606, 4611, 4618, 4621, 4625, 4630, 4633, 4635, 4641, 4643, 4644, 4650, 4653, 4654, 4655, 4659, 4666, 4667, 4669, 4670, 4671, 4672, 4674, 4676, 4677, 4680, 4684, 4685, 4687, 4697, 4700, 4706, 4708, 4710, 4714, 4716, 4719, 4721, 4725, 4729, 4732, 4737, 4738, 4739, 4740, 4749, 4750, 4753, 4754, 4755, 4756, 4759, 4761, 4762, 4763, 4765, 4766, 4771, 4775, 4778, 4779, 4788, 4789, 4790, 4791, 4794, 4795, 4804, 4813, 4814, 4818, 4820, 4822, 4824, 4828, 4833, 4834, 4835, 4842, 4853, 4855, 4856, 4857, 4859, 4862, 4864, 4868, 4869, 4870, 4872, 4875, 4878, 4880, 4881, 4887, 4888, 4891, 4895, 4901, 4902, 4905, 4909, 4914, 4915, 4917, 4918, 4920, 4921, 4922, 4923, 4924, 4926, 4931, 4935, 4936, 4938, 4941, 4947, 4950, 4958, 4959, 4971, 4972, 4973, 4975, 4977, 4979, 4980, 4981, 4987, 4988, 4992, 4993, 4994, 4996, 5000, 5015, 5022, 5026, 5029, 5030, 5034, 5037, 5039, 5040, 5042, 5044, 5046, 5049, 5051, 5052, 5054, 5055, 5057, 5061, 5067, 5068, 5072, 5074, 5075, 5082, 5088, 5089, 5091, 5095, 5100, 5102, 5111, 5122, 5129, 5131, 5132, 5140, 5145, 5147, 5148, 5151, 5152, 5154, 5160, 5164, 5165, 5168, 5169, 5170, 5174, 5180, 5181, 5182, 5184, 5185, 5188, 5189, 5190, 5191, 5192, 5196, 5198, 5200, 5202, 5203, 5206, 5208, 5212, 5214, 5216, 5217, 5219, 5225, 5226, 5229, 5234, 5247, 5250, 5253, 5255, 5258, 5261, 5263, 5264, 5273, 5275, 5276, 5280, 5281, 5282, 5283, 5286, 5289, 5292, 5293, 5299, 5300, 5301, 5303, 5308, 5311, 5315, 5317, 5319, 5327, 5329, 5330, 5332, 5334, 5338, 5344, 5346, 5348, 5351, 5359, 5360, 5361, 5366, 5367, 5371, 5372, 5374, 5386, 5388, 5389, 5391, 5393, 5396, 5398, 5403, 5407, 5409, 5411, 5413, 5414, 5417, 5426, 5430, 5431, 5438, 5446, 5448, 5449, 5451, 5452, 5456, 5457, 5458, 5459, 5466, 5469, 5472, 5474, 5476, 5479, 5481, 5482, 5483, 5485, 5491, 5493, 5495, 5496, 5498, 5506, 5508, 5510, 5513, 5515, 5516, 5517, 5518, 5519, 5520, 5521, 5524, 5526, 5530, 5534, 5535, 5536, 5537, 5539, 5554, 5557, 5558, 5561, 5562, 5563, 5566, 5568, 5569, 5571, 5575, 5579, 5585, 5588, 5589, 5591, 5592, 5597, 5612, 5613, 5615, 5616, 5618, 5620, 5621, 5627, 5632, 5633, 5635, 5638, 5640, 5642, 5643, 5647, 5648, 5651, 5652, 5657, 5659, 5660, 5662, 5663, 5670, 5671, 5675, 5676, 5677, 5689, 5694, 5695, 5697, 5698, 5702, 5703, 5706, 5709, 5711, 5718, 5721, 5722, 5731, 5734, 5735, 5744, 5751, 5753, 5756, 5763, 5768, 5770, 5771, 5775, 5780, 5784, 5785, 5786, 5788, 5791, 5794, 5797, 5803, 5805, 5806, 5808, 5810, 5811, 5813, 5820, 5822, 5826, 5832, 5833, 5835, 5836, 5837, 5846, 5852, 5854, 5856, 5859, 5864, 5865, 5866, 5867, 5868, 5869, 5870, 5872, 5878, 5879, 5881, 5883, 5884, 5885, 5886, 5887, 5888, 5889, 5892, 5893, 5907, 5912, 5919, 5922, 5925, 5926, 5927, 5928, 5931, 5932, 5934, 5935, 5938, 5941, 5944, 5947, 5948, 5951, 5954, 5956, 5957, 5959, 5961, 5967, 5968, 5969, 5971, 5980, 5982, 5984, 5987, 5988, 5989, 5991, 5992, 5994, 5996, 5997, 6000, 6002, 6004, 6006, 6007, 6009, 6013, 6016, 6017, 6023, 6024, 6025, 6026, 6028, 6038, 6041, 6044, 6048, 6051, 6058, 6059, 6062, 6063, 6065, 6068, 6069, 6070, 6072, 6073, 6074, 6075, 6080, 6081, 6085, 6086, 6087, 6088, 6089, 6092, 6093, 6097, 6098, 6099, 6107, 6108, 6109, 6110, 6113, 6116, 6118, 6119, 6120, 6123, 6124, 6129, 6131, 6132, 6135, 6136, 6137, 6138, 6139, 6145, 6146, 6147, 6148, 6153, 6158, 6160, 6162, 6163, 6164, 6165, 6168, 6180, 6181, 6182, 6183, 6186, 6188, 6189, 6194, 6195, 6197, 6198, 6203, 6204, 6205, 6206, 6209, 6220, 6223, 6224, 6227, 6228, 6234, 6243, 6246, 6247, 6250, 6251, 6264, 6265, 6267, 6275, 6278, 6281, 6282, 6286, 6288, 6292, 6295, 6299, 6300, 6303, 6309, 6315, 6317, 6322, 6328, 6330, 6333, 6338, 6342, 6351, 6353, 6354, 6356, 6358, 6360, 6362, 6363, 6365, 6367, 6370, 6372, 6375, 6376, 6381, 6383, 6393, 6394, 6397, 6399, 6400, 6403, 6404, 6405, 6408, 6410, 6412, 6413, 6414, 6415, 6419, 6420, 6425, 6426, 6427, 6429, 6430, 6431, 6436, 6440, 6456, 6463, 6464, 6466, 6467, 6469, 6470, 6472, 6474, 6475, 6476, 6478, 6480, 6482, 6484, 6485, 6488, 6494, 6501, 6504, 6505, 6510, 6513, 6516, 6517, 6519, 6523, 6526, 6528, 6530, 6531, 6532, 6534, 6537, 6543, 6547, 6549, 6553, 6554, 6555, 6558, 6564, 6567, 6569, 6571, 6572, 6574, 6576, 6577, 6579, 6584, 6588, 6589, 6592, 6594, 6595, 6597, 6599, 6600, 6603, 6606, 6607, 6609, 6610, 6614, 6617, 6620, 6623, 6625, 6628, 6629, 6633, 6634, 6635, 6638, 6639, 6644, 6646, 6647, 6649, 6655, 6656, 6658, 6661, 6662, 6666, 6671, 6672, 6681, 6696, 6703, 6705, 6706, 6716, 6718, 6720, 6729, 6730, 6734, 6736, 6737, 6739, 6747, 6749, 6756, 6757, 6759, 6761, 6764, 6766, 6767, 6772, 6778, 6779, 6782, 6783, 6786, 6788, 6794, 6795, 6797, 6799, 6803, 6804, 6805, 6806, 6807, 6811, 6812, 6813, 6815, 6816, 6817, 6819, 6820, 6824, 6827, 6828, 6830, 6831, 6834, 6836, 6841, 6842, 6843, 6847, 6848, 6851, 6859, 6863, 6869, 6875, 6876, 6877, 6878, 6880, 6881, 6887, 6888, 6903, 6906, 6907, 6909, 6913, 6914, 6917, 6919, 6921, 6925, 6930, 6931, 6939, 6946, 6954, 6955, 6959, 6960, 6967, 6970, 6971, 6979, 6981, 6984, 6985, 6987, 6988, 6990, 6994, 6997, 6999, 7003, 7009, 7013, 7018, 7022, 7029, 7038, 7039, 7041, 7043, 7045, 7046, 7051, 7053, 7054, 7057, 7059, 7064, 7067, 7077, 7079, 7083, 7084, 7085, 7093, 7105, 7106, 7107, 7108, 7110, 7117, 7118, 7126, 7128, 7130, 7136, 7138, 7139, 7142, 7143, 7144, 7150, 7151, 7154, 7163, 7164, 7165, 7166, 7169, 7172, 7173, 7182, 7184, 7192, 7194, 7197, 7198, 7201, 7202, 7206, 7207, 7208, 7210, 7212, 7214, 7215, 7219, 7220, 7227, 7228, 7230, 7235, 7236, 7244, 7245, 7246, 7249, 7250, 7255, 7257, 7258, 7262, 7263, 7264, 7267, 7268, 7274, 7276, 7281, 7287, 7291, 7292, 7293, 7298, 7299, 7300, 7301, 7303, 7304, 7306, 7307, 7308, 7311, 7312, 7313, 7315, 7318, 7328, 7330, 7345, 7349, 7353, 7355, 7358, 7361, 7365, 7369, 7371, 7376, 7377, 7380, 7382, 7383, 7386, 7398, 7399, 7400, 7409, 7411, 7415, 7417, 7425, 7430, 7434, 7435, 7436, 7438, 7441, 7447, 7448, 7452, 7453, 7454, 7457, 7458, 7459, 7464, 7466, 7470, 7481, 7483, 7485, 7486, 7490, 7492, 7493, 7499, 7502, 7506, 7512, 7515, 7521, 7523, 7524, 7533, 7538, 7546, 7556, 7560, 7561, 7572, 7574, 7576, 7579, 7583, 7585, 7586, 7589, 7590, 7596, 7597, 7599, 7604, 7605, 7609, 7611, 7614, 7619, 7620, 7622, 7624, 7625, 7633, 7638, 7642, 7643, 7649, 7655, 7656, 7658, 7661, 7662, 7664, 7665, 7671, 7673, 7674, 7678, 7679, 7680, 7682, 7685, 7686, 7687, 7689, 7695, 7699, 7700, 7703, 7712, 7716, 7718, 7724, 7726, 7736, 7737, 7738, 7741, 7742, 7744, 7745, 7746, 7749, 7763, 7764, 7768, 7770, 7774, 7775, 7779, 7781, 7785, 7786, 7788, 7791, 7792, 7793, 7798, 7799, 7800, 7803, 7804, 7806, 7807, 7819, 7820, 7823, 7825, 7833, 7834, 7839, 7841, 7845, 7850, 7854, 7856, 7860, 7865, 7873, 7877, 7880, 7881, 7884, 7887, 7888, 7890, 7893, 7896, 7908, 7910, 7911, 7913, 7918, 7923, 7925, 7928, 7933, 7934, 7935, 7937, 7938, 7942, 7944, 7946, 7949, 7952, 7965, 7966, 7967, 7972, 7973, 7974, 7976, 7977, 7982, 7984, 7986, 7993, 7994, 7996, 7999, 8006, 8007, 8012, 8020, 8024, 8025, 8031, 8032, 8035, 8036, 8041, 8042, 8044, 8048, 8052, 8053, 8056, 8059, 8061, 8063, 8068, 8071, 8076, 8077, 8078, 8080, 8081, 8083, 8087, 8088, 8095, 8099, 8100, 8102, 8103, 8105, 8106, 8110, 8112, 8113, 8118, 8123, 8126, 8129, 8130, 8145, 8150, 8151, 8155, 8163, 8166, 8170, 8177, 8178, 8179, 8181, 8182, 8189, 8193, 8194, 8202, 8204, 8208, 8213, 8219, 8220, 8223, 8230, 8234, 8235, 8237, 8239, 8241, 8242, 8246, 8247, 8248, 8250, 8252, 8257, 8258, 8262, 8264, 8265, 8266, 8268, 8269, 8273, 8274, 8275, 8291, 8292, 8295, 8296, 8300, 8304, 8305, 8308, 8310, 8311, 8312, 8315, 8318, 8319, 8329, 8339, 8340, 8347, 8349, 8350, 8353, 8358, 8367, 8368, 8371, 8373, 8378, 8379, 8380, 8385, 8386, 8387, 8389, 8392, 8395, 8396, 8401, 8404, 8406, 8408, 8410, 8413, 8414, 8415, 8416, 8417, 8418, 8428, 8430, 8436, 8438, 8439, 8440, 8443, 8444, 8445, 8447, 8448, 8449, 8450, 8451, 8457, 8458, 8459, 8470, 8472, 8473, 8474, 8476, 8477, 8481, 8482, 8485, 8486, 8490, 8496, 8498, 8500, 8501, 8502, 8503, 8505, 8507, 8509, 8511, 8513, 8515, 8518, 8521, 8523, 8524, 8525, 8526, 8528, 8531, 8532, 8539, 8541, 8542, 8543, 8553, 8554, 8557, 8558, 8561, 8562, 8565, 8568, 8574, 8576, 8579, 8581, 8583, 8585, 8588, 8592, 8596, 8597, 8598, 8600, 8601, 8603, 8605, 8610, 8611, 8612, 8614, 8622, 8631, 8634, 8635, 8638, 8639, 8642, 8644, 8646, 8648, 8650, 8658, 8659, 8663, 8664, 8665, 8669, 8672, 8675, 8676, 8677, 8685, 8686, 8689, 8693, 8699, 8700, 8703, 8706, 8708, 8709, 8713, 8717, 8719, 8720, 8722, 8728, 8729, 8731, 8736, 8741, 8743, 8744, 8746, 8747, 8748, 8749, 8761, 8769, 8771, 8772, 8773, 8777, 8779, 8783, 8784, 8786, 8789, 8792, 8803, 8804, 8808, 8810, 8811, 8817, 8818, 8821, 8822, 8824, 8829, 8830, 8831, 8834, 8835, 8841, 8842, 8843, 8846, 8853, 8865, 8866, 8869, 8876, 8877, 8878, 8881, 8883, 8886, 8888, 8889, 8892, 8896, 8897, 8900, 8901, 8905, 8907, 8908, 8911, 8916, 8917, 8919, 8922, 8926, 8928, 8929, 8935, 8937, 8938, 8941, 8945, 8946, 8949, 8951, 8960, 8961, 8968, 8971, 8979, 8980, 8981, 8985, 8986, 8991, 8992, 8996, 8998, 9001, 9006, 9009, 9011, 9012, 9013, 9018, 9026, 9027, 9029, 9030, 9033, 9045, 9050, 9052, 9056, 9057, 9058, 9059, 9060, 9063, 9065, 9068, 9069, 9071, 9072, 9073, 9076, 9078, 9084, 9086, 9087, 9088, 9092, 9095, 9096, 9097, 9098, 9104, 9105, 9106, 9107, 9114, 9118, 9120, 9123, 9124, 9125, 9129, 9131, 9133, 9134, 9139, 9140, 9141, 9142, 9152, 9154, 9155, 9159, 9167, 9168, 9175, 9177, 9180, 9183, 9185, 9188, 9190, 9191, 9194, 9195, 9205, 9206, 9207, 9210, 9211, 9213, 9215, 9216, 9218, 9220, 9223, 9226, 9229, 9233, 9237, 9243, 9247, 9249, 9253, 9257, 9262, 9267, 9269, 9270, 9273, 9275, 9282, 9284, 9285, 9287, 9288, 9290, 9292, 9296, 9300, 9306, 9308, 9311, 9313, 9320, 9321, 9322, 9323, 9326, 9328, 9336, 9337, 9338, 9339, 9340, 9346, 9347, 9350, 9352, 9359, 9366, 9371, 9375, 9376, 9382, 9391, 9392, 9394, 9400, 9402, 9403, 9404, 9406, 9413, 9414, 9415, 9419, 9421, 9423, 9425, 9429, 9439, 9440, 9443, 9449, 9451, 9453, 9456, 9460, 9468, 9471, 9474, 9477, 9481, 9484, 9488, 9490, 9500, 9503, 9504, 9509, 9514, 9517, 9518, 9519, 9522, 9534, 9536, 9537, 9538, 9540, 9545, 9546, 9550, 9551, 9553, 9554, 9555, 9559, 9560, 9564, 9565, 9568, 9571, 9577, 9579, 9587, 9590, 9591, 9595, 9596, 9598, 9601, 9602, 9605, 9606, 9607, 9609, 9617, 9618, 9620, 9621, 9623, 9624, 9626, 9629, 9632, 9648, 9649, 9652, 9653, 9655, 9657, 9658, 9663, 9666, 9668, 9670, 9676, 9682, 9686, 9692, 9695, 9696, 9698, 9701, 9706, 9710, 9711, 9717, 9721, 9722, 9723, 9726, 9727, 9729, 9731, 9734, 9737, 9738, 9742, 9743, 9744, 9745, 9746, 9750, 9751, 9754, 9756, 9758, 9763, 9764, 9768, 9770, 9774, 9776, 9782, 9786, 9791, 9794, 9798, 9799, 9808, 9810, 9811, 9812, 9813, 9819, 9820, 9825, 9827, 9828, 9829, 9836, 9845, 9847, 9861, 9866, 9869, 9873, 9875, 9878, 9882, 9886, 9887, 9892, 9894, 9897, 9900, 9907, 9909, 9910, 9911, 9921, 9923, 9924, 9928, 9930, 9932, 9935, 9940, 9944, 9946, 9949, 9950, 9952, 9953, 9956, 9962, 9963, 9967, 9968, 9973, 9975, 9976, 9979, 9980, 9981, 9982, 9984, 9985, 9987, 9988, 9990, 9991, 9992, 9997, 10000, 10001, 10009, 10010, 10012, 10013, 10017, 10018, 10019, 10021, 10026, 10027, 10032, 10033, 10034, 10035, 10040, 10049, 10052, 10053, 10055, 10059, 10060, 10062, 10064, 10066, 10068, 10073, 10075, 10077, 10078, 10080, 10081, 10083, 10090, 10091, 10092, 10095, 10097, 10098, 10101, 10103, 10106, 10109, 10110, 10115, 10116, 10117, 10122, 10128, 10129, 10130, 10131, 10134, 10136, 10143, 10151, 10158, 10160, 10163, 10165, 10166, 10168, 10174, 10176, 10178, 10181, 10192, 10193, 10194, 10196, 10199, 10206, 10207, 10212, 10217, 10218, 10219, 10220, 10221, 10222, 10223, 10224, 10225, 10228, 10230, 10233, 10235, 10236, 10237, 10239, 10247, 10249, 10252, 10253, 10255, 10259, 10262, 10266, 10269, 10270, 10275, 10276, 10278, 10284, 10286, 10291, 10292, 10293, 10295, 10300, 10302, 10306, 10307, 10311, 10312, 10314, 10318, 10319, 10323, 10325, 10326, 10327, 10331, 10333, 10334, 10335, 10336, 10340, 10341, 10343, 10346, 10353, 10356, 10357, 10361, 10362, 10364, 10371, 10375, 10378, 10380, 10381, 10388, 10397, 10398, 10399, 10401, 10410, 10411, 10413, 10414, 10416, 10417, 10419, 10421, 10423, 10425, 10430, 10435, 10436, 10438, 10440, 10446, 10447, 10450, 10452, 10453, 10456, 10460, 10463, 10464, 10465, 10466, 10468, 10469, 10471, 10474, 10480, 10482, 10487, 10490, 10492, 10494, 10496, 10498, 10506, 10508, 10514, 10518, 10522, 10523, 10527, 10528, 10530, 10531, 10532, 10535, 10536, 10537, 10541, 10542, 10543, 10544, 10556, 10558, 10563, 10564, 10565, 10567, 10569, 10571, 10573, 10579, 10580, 10581, 10582, 10583, 10587, 10588, 10593, 10596, 10597, 10599, 10601, 10602, 10608, 10613, 10615, 10616, 10617, 10621, 10622, 10625, 10626, 10637, 10638, 10639, 10640, 10643, 10645, 10646, 10651, 10655, 10657, 10664, 10668, 10669, 10670, 10676, 10678, 10679, 10682, 10683, 10684, 10685, 10686, 10700, 10701, 10705, 10707, 10711, 10716, 10718, 10721, 10722, 10724, 10725, 10726, 10729, 10734, 10738, 10740, 10741, 10744, 10747, 10748, 10749, 10752, 10753, 10754, 10756, 10761, 10762, 10766, 10770, 10772, 10774, 10775, 10778, 10779, 10782, 10784, 10785, 10787, 10788, 10790, 10792, 10795, 10801, 10802, 10803, 10804, 10805, 10809, 10811, 10812, 10818, 10819, 10820, 10822, 10823, 10824, 10827, 10831, 10836, 10838, 10839, 10840, 10841, 10843, 10850, 10851, 10853, 10854, 10856, 10857, 10858, 10860, 10864, 10866, 10867, 10870, 10874, 10878, 10880, 10886, 10887, 10896, 10898, 10899, 10901, 10902, 10911, 10917, 10918, 10920, 10924, 10926, 10927, 10929, 10930, 10933, 10934, 10940, 10941, 10947, 10961, 10965, 10966, 10967, 10972, 10976, 10977, 10988, 10993, 10996, 10999, 11008, 11015, 11016, 11021, 11024, 11027, 11032, 11033, 11036, 11037, 11039, 11046, 11047, 11050, 11051, 11053, 11058, 11060, 11063, 11078, 11082, 11083, 11090, 11095, 11100, 11101, 11107, 11109, 11114, 11117, 11118, 11119, 11122, 11126, 11128, 11129, 11133, 11135, 11136, 11137, 11148, 11150, 11151, 11152, 11153, 11154, 11160, 11163, 11165, 11168, 11169, 11173, 11177, 11178, 11181, 11184, 11187, 11188, 11190, 11192, 11194, 11198, 11203, 11204, 11213, 11214, 11216, 11217, 11218, 11222, 11226, 11227, 11230, 11232, 11233, 11235, 11236, 11237, 11238, 11239, 11242, 11243, 11246, 11247, 11251, 11253, 11254, 11255, 11256, 11260, 11262, 11263, 11265, 11266, 11278, 11283, 11290, 11291, 11292, 11293, 11294, 11295, 11297, 11304, 11306, 11313, 11315, 11316, 11318, 11321, 11328, 11330, 11331, 11338, 11339, 11340, 11345, 11346, 11348, 11349, 11352, 11356, 11359, 11362, 11363, 11364, 11365, 11369, 11370, 11371, 11373, 11377, 11380, 11382, 11385, 11387, 11388, 11391, 11394, 11395, 11398, 11401, 11404, 11405, 11406, 11408, 11416, 11424, 11427, 11430, 11431, 11435, 11438, 11443, 11446, 11447, 11448, 11449, 11451, 11456, 11459, 11465, 11466, 11475, 11478, 11487, 11488, 11489, 11490, 11491, 11496, 11497, 11498, 11499, 11500, 11501, 11503, 11505, 11506, 11507, 11508, 11518, 11520, 11521, 11523, 11524, 11526, 11527, 11530, 11531, 11532, 11533, 11534, 11541, 11544, 11548, 11550, 11551, 11553, 11558, 11560, 11561, 11570, 11571, 11576, 11577, 11578, 11585, 11586, 11587, 11588, 11593, 11594, 11595, 11597, 11603, 11604, 11607, 11608, 11611, 11612, 11615, 11617, 11618, 11621, 11623, 11626, 11628, 11631, 11639, 11647, 11650, 11656, 11658, 11659, 11663, 11669, 11673, 11678, 11681, 11682, 11688, 11691, 11692, 11694, 11695, 11696, 11699, 11701, 11703, 11705, 11707, 11712, 11718, 11721, 11725, 11726, 11730, 11731, 11733, 11736, 11737, 11740, 11743, 11753, 11756, 11760, 11761, 11762, 11763, 11765, 11768, 11770, 11771, 11776, 11777, 11781, 11782, 11785, 11786, 11788, 11792, 11794, 11799, 11800, 11802, 11805, 11809, 11810, 11811, 11814, 11818, 11823, 11826, 11830, 11836, 11842, 11846, 11851, 11856, 11858, 11861, 11864, 11865, 11868, 11869, 11872, 11877, 11881, 11889, 11891, 11892, 11894, 11895, 11898, 11901, 11906, 11909, 11911, 11913, 11914, 11915, 11916, 11917, 11918, 11919, 11920, 11921, 11922, 11923, 11926, 11927, 11928, 11929, 11930, 11934, 11940, 11943, 11947, 11948, 11949, 11953, 11956, 11958, 11959, 11960, 11961, 11962, 11963, 11965, 11966, 11973, 11974, 11975, 11976, 11977, 11978, 11979, 11983, 11988, 11993, 11997, 11998, 11999, 12002, 12004, 12014, 12016, 12017, 12019, 12021, 12023, 12024, 12026, 12027, 12032, 12042, 12043, 12044, 12051, 12052, 12059, 12068, 12075, 12076, 12081, 12083, 12087, 12091, 12092, 12093, 12095, 12098, 12102, 12104, 12106, 12109, 12110, 12112, 12115, 12118, 12122, 12128, 12129, 12134, 12137, 12138, 12139, 12140, 12143, 12145, 12146, 12147, 12149, 12151, 12161, 12163, 12165, 12166, 12167, 12170, 12171, 12174, 12175, 12176, 12181, 12183, 12185, 12189, 12191, 12197, 12200, 12201, 12204, 12207, 12208, 12215, 12217, 12218, 12219, 12221, 12227, 12240, 12241, 12245, 12249, 12250, 12252, 12253, 12255, 12256, 12259, 12263, 12268, 12269, 12274, 12278, 12280, 12283, 12286, 12287, 12288, 12291, 12293, 12304, 12307, 12310, 12311, 12312, 12313, 12314, 12315, 12317, 12321, 12323, 12324, 12326, 12329, 12331, 12333, 12334, 12347, 12354, 12356, 12358, 12359, 12364, 12367, 12368, 12369, 12370, 12372, 12374, 12376, 12379, 12381, 12383, 12391, 12397, 12400, 12401, 12403, 12404, 12405, 12406, 12411, 12414, 12419, 12420, 12421, 12424, 12426, 12427, 12428, 12435, 12437, 12440, 12441, 12445, 12447, 12451, 12455, 12456, 12457, 12459, 12462, 12465, 12467, 12468, 12470, 12472, 12478, 12481, 12487, 12488, 12491, 12497, 12499, 12503, 12504, 12508, 12509, 12514, 12515, 12521, 12530, 12531, 12536, 12539, 12545, 12546, 12547, 12549, 12554, 12555, 12556, 12557, 12559, 12561, 12563, 12564, 12565, 12567, 12568, 12570, 12585, 12588, 12591, 12592, 12593, 12597, 12600, 12605, 12608, 12609, 12610, 12611, 12619, 12622, 12623, 12630, 12631, 12634, 12636, 12638, 12639, 12641, 12649, 12651, 12655, 12663, 12668, 12670, 12671, 12672, 12676, 12679, 12680, 12681, 12682, 12684, 12691, 12693, 12695, 12698, 12699, 12701, 12702, 12707, 12713, 12718, 12719, 12729, 12731, 12732, 12733, 12737, 12738, 12739, 12741, 12742, 12743, 12751, 12752, 12754, 12755, 12757, 12758, 12760, 12761, 12762, 12764, 12766, 12768, 12769, 12771, 12783, 12790, 12794, 12797, 12800, 12802, 12803, 12805, 12810, 12812, 12813, 12814, 12817, 12819, 12820, 12822, 12824, 12826, 12827, 12834, 12836, 12838, 12839, 12843, 12844, 12849, 12850, 12853, 12856, 12858, 12861, 12866, 12875, 12882, 12884, 12887, 12888, 12895, 12898, 12900, 12901, 12902, 12904, 12905, 12906, 12910, 12913, 12916, 12917, 12918, 12920, 12921, 12926, 12929, 12932, 12933, 12939, 12940, 12941, 12942, 12945, 12946, 12947, 12950, 12961, 12966, 12968, 12969, 12973, 12976, 12977, 12978, 12983, 12984, 12986, 12987, 12990, 12991, 12992, 12994, 13006, 13010, 13011, 13012, 13014, 13017, 13018, 13022, 13023, 13024, 13030, 13032, 13033, 13034, 13035, 13038, 13040, 13042, 13044, 13049, 13050, 13053, 13054, 13055, 13056, 13061, 13062, 13064, 13066, 13071, 13074, 13075, 13079, 13081, 13085, 13086, 13087, 13095, 13101, 13102, 13105, 13106, 13112, 13114, 13115, 13116, 13117, 13118, 13120, 13123, 13124, 13128, 13131, 13135, 13142, 13148, 13149, 13151, 13154, 13156, 13166, 13169, 13175, 13181, 13182, 13185, 13191, 13197, 13199, 13209, 13212, 13213, 13215, 13217, 13221, 13222, 13224, 13227, 13230, 13231, 13232, 13234, 13235, 13236, 13237, 13238, 13243, 13248, 13249, 13251, 13255, 13259, 13260, 13261, 13263, 13264, 13268, 13269, 13276, 13278, 13279, 13280, 13281, 13296, 13298, 13303, 13313, 13315, 13317, 13326, 13328, 13330, 13332, 13348, 13349, 13354, 13358, 13359, 13361, 13367, 13368, 13369, 13370, 13373, 13375, 13377, 13380, 13381, 13384, 13385, 13388, 13391, 13392, 13393, 13394, 13396, 13397, 13401, 13402, 13410, 13416, 13417, 13419, 13423, 13424, 13430, 13433, 13439, 13448, 13449, 13450, 13451, 13454, 13456, 13460, 13463, 13466, 13468, 13469, 13473, 13475, 13492, 13494, 13496, 13498, 13499, 13500, 13503, 13504, 13506, 13513, 13514, 13515, 13516, 13519, 13520, 13521, 13530, 13532, 13539, 13540, 13543, 13544, 13545, 13546, 13547, 13549, 13552, 13553, 13556, 13568, 13569, 13574, 13580, 13582, 13584, 13587, 13589, 13597, 13601, 13602, 13603, 13604, 13612, 13621, 13623, 13628, 13631, 13632, 13634, 13636, 13637, 13641, 13643, 13647, 13652, 13654, 13660, 13661, 13662, 13663, 13668, 13669, 13671, 13675, 13676, 13677, 13678, 13681, 13684, 13687, 13688, 13695, 13698, 13699, 13700, 13702, 13703, 13706, 13710, 13712, 13713, 13715, 13716, 13720, 13721, 13725, 13727, 13728, 13729, 13733, 13745, 13747, 13750, 13756, 13758, 13764, 13766, 13767, 13769, 13772, 13773, 13775, 13776, 13779, 13781, 13782, 13785, 13786, 13787, 13789, 13791, 13792, 13793, 13794, 13795, 13796, 13798, 13809, 13816, 13817, 13818, 13819, 13820, 13822, 13823, 13830, 13831, 13833, 13835, 13839, 13843, 13849, 13852, 13859, 13866, 13869, 13870, 13872, 13873, 13876, 13877, 13881, 13882, 13883, 13885, 13888, 13891, 13892, 13894, 13898, 13901, 13906, 13908, 13909, 13910, 13911, 13917, 13918, 13919, 13920, 13925, 13927, 13930, 13933, 13938, 13947, 13952, 13954, 13956, 13961, 13963, 13965, 13969, 13970, 13971, 13975, 13976, 13981, 13983, 13984, 13990, 13991, 13999, 14000, 14003, 14008, 14009, 14014, 14017, 14018, 14022, 14026, 14027, 14030, 14031, 14036, 14041, 14043, 14049, 14050, 14051, 14052, 14054, 14062, 14063, 14066, 14067, 14069, 14070, 14073, 14075, 14076, 14081, 14086, 14087, 14088, 14091, 14092, 14093, 14094, 14096, 14102, 14105, 14106, 14112, 14115, 14116, 14118, 14122, 14129, 14132, 14134, 14135, 14137, 14138, 14139, 14142, 14145, 14146, 14148, 14149, 14150.

Promoters expressing in tassel tissue at the tasseling stage include SEQ IDs: 1, 3, 7, 13, 14, 22, 27, 31, 34, 36, 45, 48, 56, 64, 65, 69, 70, 71, 81, 82, 88, 93, 96, 97, 102, 103, 107, 110, 111, 112, 121, 126, 130, 131, 134, 139, 140, 143, 148, 152, 157, 162, 165, 176, 179, 181, 183, 187, 193, 194, 195, 196, 204, 210, 211, 217, 230, 231, 232, 233, 235, 236, 237, 240, 243, 244, 246, 248, 249, 250, 251, 257, 262, 264, 269, 270, 271, 272, 273, 274, 280, 283, 286, 288, 289, 299, 305, 306, 309, 318, 319, 320, 321, 328, 329, 332, 334, 335, 349, 354, 356, 357, 359, 371, 373, 378, 379, 388, 389, 396, 401, 402, 404, 405, 406, 407, 418, 419, 420, 423, 424, 427, 428, 429, 433, 448, 452, 456, 461, 466, 468, 471, 478, 481, 483, 485, 488, 498, 502, 507, 509, 510, 512, 513, 514, 516, 517, 520, 522, 523, 525, 529, 532, 533, 535, 538, 541, 544, 546, 547, 557, 560, 564, 565, 585, 587, 591, 593, 594, 595, 596, 599, 608, 611, 613, 614, 620, 623, 630, 633, 635, 641, 643, 644, 650, 653, 656, 662, 663, 666, 667, 668, 670, 681, 686, 693, 694, 701, 705, 717, 719, 722, 723, 724, 726, 727, 734, 736, 739, 740, 742, 749, 757, 759, 763, 765, 768, 771, 792, 793, 797, 800, 801, 806, 808, 813, 819, 820, 821, 824, 825, 826, 830, 833, 840, 842, 844, 855, 857, 858, 859, 860, 862, 865, 866, 868, 869, 870, 871, 873, 877, 878, 879, 883, 884, 885, 887, 890, 891, 892, 895, 897, 898, 903, 907, 911, 912, 913, 916, 917, 919, 923, 925, 929, 931, 932, 936, 937, 938, 943, 944, 949, 951, 953, 954, 955, 957, 958, 959, 961, 963, 964, 966, 971, 974, 977, 979, 980, 982, 987, 991, 994, 995, 996, 997, 999, 1006, 1007, 1009, 1010, 1011, 1014, 1017, 1029, 1030, 1035, 1039, 1041, 1042, 1043, 1045, 1046, 1047, 1049, 1050, 1051, 1052, 1055, 1056, 1064, 1065, 1068, 1069, 1070, 1073, 1077, 1078, 1087, 1088, 1089, 1092, 1095, 1103, 1104, 1108, 1110, 1111, 1112, 1114, 1115, 1117, 1118, 1119, 1120, 1121, 1122, 1125, 1130, 1133, 1136, 1137, 1146, 1147, 1148, 1154, 1162, 1165, 1166, 1169, 1170, 1173, 1176, 1178, 1182, 1187, 1191, 1196, 1197, 1198, 1199, 1200, 1201, 1204, 1205, 1214, 1217, 1218, 1220, 1223, 1225, 1227, 1228, 1230, 1233, 1236, 1241, 1243, 1248, 1250, 1252, 1253, 1256, 1257, 1258, 1261, 1269, 1272, 1277, 1281, 1285, 1286, 1292, 1303, 1305, 1306, 1309, 1312, 1316, 1317, 1325, 1330, 1331, 1334, 1337, 1346, 1347, 1349, 1351, 1354, 1355, 1360, 1364, 1365, 1371, 1373, 1377, 1380, 1381, 1382, 1385, 1387, 1388, 1394, 1396, 1398, 1404, 1405, 1407, 1409, 1410, 1412, 1415, 1420, 1421, 1426, 1431, 1438, 1442, 1451, 1453, 1454, 1455, 1459, 1466, 1474, 1475, 1481, 1486, 1490, 1493, 1496, 1499, 1501, 1504, 1508, 1510, 1511, 1514, 1517, 1518, 1525, 1526, 1527, 1540, 1543, 1545, 1547, 1549, 1550, 1556, 1560, 1563, 1567, 1570, 1571, 1575, 1576, 1578, 1584, 1586, 1590, 1593, 1594, 1599, 1600, 1602, 1608, 1612, 1614, 1615, 1616, 1622, 1625, 1634, 1635, 1636, 1637, 1638, 1639, 1642, 1648, 1650, 1652, 1653, 1658, 1662, 1669, 1671, 1675, 1676, 1677, 1680, 1683, 1685, 1688, 1689, 1691, 1696, 1698, 1701, 1702, 1705, 1706, 1707, 1708, 1712, 1714, 1717, 1719, 1721, 1723, 1729, 1731, 1732, 1735, 1740, 1749, 1750, 1755, 1756, 1759, 1761, 1768, 1771, 1776, 1778, 1779, 1785, 1791, 1813, 1815, 1816, 1820, 1823, 1830, 1832, 1834, 1835, 1839, 1840, 1845, 1850, 1852, 1858, 1859, 1868, 1869, 1870, 1872, 1876, 1882, 1892, 1895, 1897, 1900, 1902, 1903, 1904, 1905, 1906, 1912, 1916, 1917, 1918, 1920, 1922, 1923, 1930, 1931, 1933, 1934, 1936, 1937, 1940, 1944, 1945, 1950, 1953, 1954, 1959, 1967, 1973, 1981, 1991, 1999, 2000, 2003, 2007, 2008, 2009, 2010, 2012, 2013, 2014, 2015, 2016, 2017, 2026, 2033, 2036, 2039, 2041, 2043, 2045, 2048, 2049, 2051, 2060, 2062, 2064, 2066, 2069, 2072, 2074, 2077, 2080, 2082, 2083, 2089, 2091, 2094, 2096, 2097, 2099, 2103, 2104, 2107, 2109, 2113, 2114, 2125, 2126, 2132, 2133, 2140, 2142, 2143, 2144, 2147, 2152, 2156, 2157, 2158, 2159, 2161, 2162, 2164, 2166, 2167, 2172, 2175, 2178, 2179, 2185, 2188, 2189, 2190, 2191, 2193, 2194, 2201, 2202, 2203, 2206, 2207, 2214, 2215, 2216, 2218, 2221, 2222, 2226, 2227, 2229, 2230, 2231, 2240, 2246, 2247, 2253, 2257, 2260, 2261, 2262, 2263, 2264, 2274, 2276, 2280, 2282, 2283, 2288, 2291, 2295, 2297, 2303, 2304, 2308, 2309, 2314, 2320, 2322, 2323, 2328, 2333, 2335, 2339, 2342, 2343, 2348, 2349, 2351, 2352, 2353, 2359, 2360, 2361, 2362, 2363, 2366, 2367, 2371, 2375, 2379, 2382, 2383, 2384, 2385, 2396, 2397, 2398, 2401, 2403, 2405, 2411, 2412, 2418, 2420, 2422, 2423, 2435, 2437, 2438, 2439, 2441, 2442, 2443, 2445, 2451, 2452, 2453, 2454, 2457, 2465, 2466, 2470, 2471, 2472, 2474, 2476, 2479, 2480, 2481, 2482, 2483, 2490, 2492, 2494, 2495, 2500, 2504, 2505, 2507, 2509, 2510, 2511, 2517, 2519, 2525, 2527, 2528, 2532, 2533, 2538, 2539, 2541, 2547, 2548, 2549, 2552, 2554, 2555, 2557, 2560, 2568, 2573, 2577, 2578, 2581, 2584, 2585, 2589, 2590, 2594, 2599, 2601, 2605, 2611, 2615, 2617, 2622, 2626, 2627, 2634, 2644, 2648, 2650, 2652, 2655, 2661, 2662, 2663, 2665, 2671, 2674, 2675, 2676, 2678, 2679, 2680, 2684, 2685, 2687, 2689, 2691, 2696, 2700, 2704, 2705, 2707, 2711, 2718, 2719, 2725, 2726, 2728, 2729, 2735, 2737, 2739, 2740, 2746, 2749, 2752, 2753, 2755, 2756, 2757, 2763, 2764, 2768, 2769, 2770, 2780, 2781, 2782, 2784, 2787, 2794, 2798, 2800, 2801, 2802, 2805, 2812, 2814, 2819, 2821, 2822, 2823, 2824, 2826, 2827, 2828, 2829, 2832, 2833, 2837, 2839, 2840, 2842, 2844, 2850, 2857, 2858, 2861, 2862, 2864, 2865, 2871, 2873, 2876, 2878, 2888, 2889, 2890, 2894, 2902, 2903, 2905, 2908, 2909, 2910, 2911, 2923, 2924, 2931, 2932, 2933, 2934, 2935, 2938, 2942, 2944, 2946, 2948, 2952, 2953, 2955, 2959, 2960, 2962, 2963, 2966, 2968, 2969, 2976, 2979, 2980, 2982, 2994, 2998, 3001, 3002, 3006, 3007, 3008, 3010, 3012, 3014, 3020, 3024, 3026, 3027, 3038, 3039, 3042, 3044, 3048, 3049, 3050, 3051, 3052, 3053, 3054, 3055, 3064, 3067, 3072, 3075, 3078, 3080, 3081, 3083, 3084, 3085, 3087, 3090, 3094, 3098, 3099, 3100, 3101, 3105, 3106, 3109, 3114, 3118, 3119, 3120, 3121, 3123, 3126, 3127, 3128, 3137, 3138, 3139, 3143, 3145, 3147, 3148, 3153, 3154, 3156, 3157, 3158, 3170, 3181, 3189, 3192, 3194, 3199, 3202, 3205, 3206, 3210, 3212, 3220, 3224, 3225, 3227, 3228, 3236, 3237, 3240, 3244, 3245, 3247, 3250, 3252, 3255, 3261, 3263, 3266, 3268, 3271, 3280, 3282, 3286, 3288, 3289, 3290, 3291, 3294, 3295, 3299, 3303, 3310, 3312, 3320, 3325, 3331, 3332, 3333, 3345, 3347, 3349, 3351, 3353, 3355, 3359, 3360, 3361, 3363, 3365, 3370, 3374, 3377, 3380, 3385, 3386, 3393, 3396, 3397, 3399, 3402, 3404, 3405, 3409, 3413, 3414, 3415, 3416, 3422, 3424, 3426, 3427, 3428, 3429, 3438, 3440, 3441, 3445, 3446, 3447, 3449, 3450, 3451, 3455, 3458, 3460, 3461, 3464, 3465, 3468, 3470, 3471, 3473, 3474, 3475, 3477, 3482, 3483, 3486, 3488, 3490, 3491, 3503, 3504, 3506, 3510, 3516, 3517, 3518, 3521, 3527, 3529, 3533, 3536, 3541, 3544, 3545, 3548, 3551, 3552, 3554, 3558, 3560, 3561, 3562, 3563, 3569, 3572, 3574, 3576, 3582, 3588, 3589, 3592, 3593, 3594, 3595, 3597, 3600, 3603, 3606, 3607, 3608, 3611, 3612, 3613, 3616, 3618, 3620, 3621, 3623, 3624, 3626, 3627, 3628, 3629, 3630, 3631, 3633, 3635, 3636, 3637, 3640, 3642, 3643, 3644, 3645, 3646, 3648, 3650, 3655, 3657, 3659, 3667, 3668, 3669, 3671, 3672, 3674, 3675, 3682, 3697, 3700, 3702, 3704, 3706, 3707, 3710, 3713, 3715, 3717, 3718, 3719, 3724, 3731, 3738, 3739, 3741, 3742, 3748, 3749, 3752, 3754, 3761, 3764, 3765, 3766, 3772, 3773, 3777, 3778, 3785, 3788, 3790, 3791, 3792, 3794, 3796, 3798, 3800, 3804, 3808, 3812, 3818, 3820, 3825, 3828, 3830, 3831, 3832, 3833, 3834, 3836, 3842, 3843, 3844, 3849, 3858, 3860, 3862, 3866, 3867, 3870, 3871, 3872, 3873, 3876, 3882, 3883, 3887, 3889, 3890, 3891, 3892, 3895, 3896, 3908, 3910, 3911, 3912, 3914, 3917, 3920, 3923, 3924, 3926, 3933, 3934, 3938, 3941, 3947, 3950, 3954, 3962, 3967, 3968, 3974, 3975, 3976, 3977, 3983, 3984, 3985, 3987, 3988, 3990, 3991, 3994, 3995, 3996, 4000, 4001, 4002, 4003, 4006, 4008, 4013, 4024, 4026, 4032, 4039, 4040, 4041, 4044, 4047, 4048, 4049, 4050, 4054, 4056, 4057, 4058, 4060, 4061, 4066, 4068, 4069, 4072, 4075, 4077, 4078, 4079, 4081, 4087, 4092, 4096, 4099, 4103, 4105, 4110, 4111, 4113, 4115, 4122, 4124, 4139, 4140, 4143, 4146, 4148, 4149, 4150, 4154, 4155, 4156, 4158, 4160, 4161, 4162, 4163, 4165, 4166, 4167, 4168, 4171, 4175, 4178, 4184, 4187, 4188, 4189, 4197, 4198, 4201, 4202, 4205, 4206, 4207, 4211, 4212, 4214, 4217, 4219, 4221, 4223, 4227, 4228, 4233, 4235, 4241, 4246, 4250, 4255, 4257, 4260, 4261, 4266, 4270, 4272, 4281, 4296, 4298, 4301, 4302, 4304, 4309, 4312, 4319, 4320, 4324, 4329, 4330, 4331, 4335, 4336, 4337, 4341, 4343, 4344, 4347, 4349, 4352, 4354, 4356, 4360, 4365, 4369, 4374, 4375, 4378, 4383, 4387, 4388, 4390, 4391, 4393, 4394, 4397, 4402, 4404, 4405, 4422, 4423, 4426, 4438, 4439, 4440, 4443, 4444, 4446, 4448, 4453, 4455, 4458, 4460, 4463, 4464, 4465, 4466, 4468, 4472, 4474, 4479, 4483, 4485, 4491, 4492, 4494, 4498, 4500, 4506, 4507, 4508, 4512, 4513, 4514, 4515, 4519, 4522, 4524, 4531, 4535, 4542, 4543, 4548, 4549, 4552, 4554, 4557, 4558, 4559, 4560, 4562, 4563, 4565, 4566, 4568, 4575, 4580, 4582, 4583, 4586, 4588, 4590, 4591, 4595, 4596, 4601, 4604, 4605, 4606, 4621, 4625, 4633, 4635, 4638, 4641, 4643, 4644, 4650, 4651, 4653, 4654, 4655, 4657, 4659, 4666, 4667, 4669, 4670, 4671, 4672, 4674, 4677, 4680, 4685, 4687, 4688, 4697, 4699, 4700, 4702, 4708, 4714, 4718, 4719, 4721, 4725, 4728, 4729, 4730, 4737, 4738, 4740, 4741, 4747, 4748, 4750, 4751, 4754, 4756, 4759, 4760, 4761, 4762, 4763, 4765, 4767, 4779, 4781, 4789, 4790, 4791, 4794, 4795, 4803, 4804, 4813, 4815, 4817, 4818, 4822, 4823, 4824, 4828, 4829, 4832, 4833, 4834, 4836, 4837, 4841, 4857, 4858, 4859, 4861, 4862, 4864, 4869, 4870, 4872, 4875, 4878, 4880, 4887, 4888, 4891, 4904, 4905, 4909, 4914, 4917, 4920, 4921, 4926, 4927, 4928, 4930, 4931, 4935, 4938, 4941, 4947, 4950, 4955, 4957, 4963, 4966, 4971, 4972, 4973, 4975, 4977, 4979, 4980, 4981, 4986, 4988, 4992, 4994, 4996, 5013, 5026, 5029, 5030, 5034, 5037, 5039, 5040, 5042, 5044, 5046, 5049, 5051, 5052, 5053, 5054, 5057, 5058, 5061, 5063, 5067, 5068, 5072, 5082, 5088, 5089, 5090, 5091, 5095, 5100, 5102, 5111, 5114, 5122, 5123, 5129, 5130, 5132, 5136, 5137, 5140, 5144, 5145, 5146, 5147, 5152, 5153, 5154, 5155, 5157, 5159, 5160, 5164, 5165, 5168, 5169, 5170, 5173, 5174, 5180, 5181, 5182, 5184, 5185, 5188, 5189, 5190, 5192, 5195, 5196, 5198, 5199, 5206, 5208, 5216, 5217, 5219, 5226, 5228, 5229, 5236, 5240, 5241, 5249, 5253, 5255, 5258, 5263, 5267, 5273, 5275, 5276, 5280, 5281, 5283, 5290, 5292, 5293, 5299, 5300, 5301, 5303, 5308, 5309, 5311, 5313, 5317, 5319, 5324, 5327, 5329, 5330, 5332, 5334, 5339, 5341, 5346, 5347, 5348, 5350, 5351, 5359, 5361, 5369, 5372, 5386, 5388, 5389, 5392, 5394, 5395, 5396, 5397, 5402, 5403, 5411, 5414, 5417, 5431, 5438, 5439, 5444, 5446, 5448, 5449, 5450, 5452, 5456, 5457, 5459, 5463, 5464, 5466, 5467, 5469, 5474, 5476, 5479, 5481, 5482, 5483, 5485, 5493, 5495, 5496, 5498, 5506, 5508, 5510, 5513, 5515, 5516, 5518, 5519, 5529, 5530, 5532, 5535, 5537, 5539, 5543, 5556, 5557, 5561, 5562, 5565, 5568, 5569, 5571, 5579, 5585, 5588, 5589, 5591, 5596, 5604, 5612, 5613, 5615, 5616, 5618, 5620, 5621, 5627, 5632, 5634, 5635, 5640, 5642, 5643, 5648, 5649, 5650, 5651, 5652, 5657, 5659, 5660, 5662, 5663, 5664, 5670, 5671, 5675, 5676, 5677, 5683, 5689, 5690, 5694, 5695, 5697, 5698, 5702, 5703, 5705, 5706, 5709, 5711, 5717, 5718, 5721, 5722, 5726, 5731, 5734, 5735, 5737, 5748, 5751, 5756, 5760, 5763, 5768, 5770, 5771, 5780, 5784, 5786, 5787, 5789, 5791, 5794, 5798, 5799, 5806, 5807, 5808, 5810, 5813, 5817, 5820, 5828, 5831, 5833, 5835, 5836, 5837, 5839, 5846, 5852, 5853, 5854, 5855, 5857, 5859, 5863, 5864, 5865, 5866, 5869, 5870, 5872, 5875, 5878, 5879, 5881, 5883, 5884, 5886, 5888, 5889, 5890, 5892, 5893, 5907, 5912, 5925, 5926, 5927, 5928, 5932, 5934, 5936, 5937, 5938, 5941, 5944, 5951, 5954, 5956, 5957, 5959, 5961, 5967, 5968, 5971, 5974, 5975, 5978, 5980, 5982, 5983, 5984, 5989, 5991, 5994, 5996, 5997, 6000, 6002, 6003, 6004, 6006, 6007, 6009, 6013, 6016, 6017, 6023, 6025, 6026, 6028, 6033, 6038, 6041, 6044, 6045, 6047, 6048, 6051, 6058, 6059, 6061, 6062, 6065, 6069, 6072, 6075, 6080, 6081, 6084, 6085, 6087, 6088, 6090, 6091, 6092, 6093, 6097, 6098, 6099, 6107, 6108, 6109, 6110, 6116, 6121, 6124, 6129, 6131, 6132, 6135, 6137, 6138, 6139, 6145, 6146, 6148, 6149, 6151, 6153, 6157, 6158, 6160, 6162, 6163, 6164, 6165, 6168, 6173, 6180, 6181, 6182, 6183, 6186, 6188, 6189, 6194, 6195, 6196, 6197, 6198, 6204, 6205, 6209, 6212, 6216, 6221, 6222, 6223, 6224, 6226, 6228, 6234, 6237, 6239, 6243, 6246, 6247, 6250, 6251, 6255, 6262, 6264, 6265, 6267, 6272, 6273, 6281, 6282, 6286, 6288, 6292, 6299, 6300, 6303, 6307, 6315, 6317, 6322, 6328, 6330, 6333, 6338, 6349, 6353, 6354, 6356, 6360, 6363, 6365, 6367, 6368, 6370, 6372, 6375, 6376, 6381, 6383, 6397, 6399, 6403, 6405, 6408, 6412, 6414, 6415, 6419, 6420, 6425, 6426, 6428, 6429, 6430, 6436, 6440, 6442, 6456, 6457, 6463, 6464, 6466, 6467, 6469, 6470, 6474, 6475, 6476, 6480, 6482, 6484, 6485, 6486, 6492, 6494, 6501, 6504, 6505, 6507, 6510, 6517, 6519, 6528, 6530, 6531, 6533, 6534, 6535, 6540, 6541, 6544, 6547, 6549, 6553, 6554, 6555, 6558, 6564, 6567, 6568, 6571, 6572, 6574, 6576, 6577, 6579, 6580, 6581, 6584, 6587, 6588, 6589, 6592, 6594, 6595, 6596, 6597, 6599, 6600, 6605, 6606, 6607, 6609, 6610, 6614, 6615, 6616, 6617, 6620, 6623, 6633, 6634, 6635, 6638, 6639, 6646, 6647, 6649, 6652, 6654, 6655, 6656, 6658, 6661, 6666, 6672, 6681, 6703, 6705, 6706, 6717, 6718, 6720, 6723, 6729, 6730, 6734, 6736, 6747, 6749, 6752, 6756, 6757, 6759, 6764, 6767, 6777, 6779, 6781, 6782, 6783, 6786, 6788, 6789, 6793, 6794, 6795, 6797, 6799, 6803, 6804, 6805, 6811, 6813, 6816, 6817, 6819, 6820, 6821, 6824, 6827, 6830, 6834, 6836, 6840, 6841, 6848, 6851, 6855, 6863, 6868, 6869, 6875, 6876, 6877, 6878, 6880, 6882, 6883, 6884, 6885, 6886, 6888, 6890, 6895, 6897, 6902, 6903, 6904, 6906, 6907, 6909, 6913, 6917, 6919, 6920, 6921, 6925, 6930, 6931, 6939, 6950, 6952, 6955, 6959, 6960, 6970, 6971, 6979, 6984, 6985, 6987, 6988, 6990, 6991, 6993, 6997, 6999, 7009, 7010, 7011, 7013, 7017, 7018, 7022, 7027, 7035, 7038, 7039, 7041, 7043, 7045, 7046, 7048, 7049, 7053, 7054, 7057, 7059, 7064, 7073, 7077, 7079, 7083, 7084, 7093, 7105, 7106, 7107, 7108, 7110, 7113, 7117, 7118, 7119, 7122, 7126, 7130, 7138, 7139, 7142, 7144, 7151, 7154, 7163, 7164, 7165, 7166, 7169, 7172, 7182, 7183, 7184, 7190, 7194, 7197, 7198, 7201, 7202, 7206, 7207, 7208, 7209, 7210, 7212, 7214, 7215, 7217, 7219, 7220, 7227, 7228, 7230, 7235, 7236, 7244, 7245, 7246, 7248, 7249, 7250, 7252, 7255, 7258, 7261, 7262, 7263, 7264, 7267, 7268, 7270, 7274, 7282, 7287, 7291, 7292, 7293, 7296, 7299, 7300, 7301, 7303, 7306, 7307, 7308, 7311, 7312, 7313, 7318, 7319, 7320, 7328, 7338, 7340, 7345, 7357, 7358, 7361, 7365, 7371, 7373, 7375, 7376, 7377, 7380, 7383, 7385, 7386, 7395, 7398, 7400, 7410, 7418, 7425, 7430, 7434, 7435, 7436, 7438, 7441, 7447, 7452, 7453, 7454, 7457, 7458, 7459, 7466, 7470, 7472, 7475, 7476, 7483, 7485, 7486, 7492, 7493, 7498, 7499, 7502, 7504, 7506, 7511, 7512, 7515, 7517, 7523, 7533, 7544, 7546, 7548, 7549, 7557, 7561, 7564, 7567, 7572, 7574, 7576, 7579, 7583, 7585, 7586, 7587, 7589, 7595, 7596, 7598, 7604, 7605, 7609, 7611, 7612, 7614, 7619, 7624, 7625, 7633, 7635, 7642, 7655, 7658, 7661, 7662, 7664, 7665, 7672, 7674, 7678, 7679, 7680, 7682, 7685, 7686, 7687, 7689, 7691, 7695, 7699, 7700, 7702, 7703, 7704, 7712, 7716, 7724, 7727, 7730, 7734, 7736, 7737, 7738, 7741, 7742, 7744, 7745, 7749, 7750, 7753, 7754, 7763, 7764, 7774, 7779, 7781, 7786, 7788, 7791, 7793, 7798, 7799, 7800, 7801, 7803, 7804, 7806, 7807, 7815, 7819, 7820, 7825, 7840, 7841, 7845, 7846, 7850, 7855, 7856, 7860, 7865, 7873, 7877, 7880, 7885, 7887, 7888, 7890, 7893, 7896, 7908, 7911, 7918, 7922, 7923, 7925, 7934, 7935, 7936, 7938, 7942, 7944, 7949, 7950, 7952, 7965, 7966, 7967, 7972, 7973, 7974, 7976, 7977, 7982, 7984, 7986, 7992, 7993, 7994, 7996, 7999, 8006, 8007, 8012, 8020, 8021, 8023, 8024, 8026, 8030, 8031, 8032, 8036, 8041, 8042, 8043, 8044, 8047, 8048, 8052, 8056, 8059, 8063, 8066, 8067, 8068, 8074, 8076, 8077, 8078, 8081, 8083, 8088, 8091, 8095, 8099, 8100, 8102, 8103, 8106, 8108, 8110, 8112, 8113, 8118, 8121, 8126, 8129, 8130, 8134, 8136, 8137, 8145, 8146, 8148, 8151, 8163, 8164, 8170, 8178, 8179, 8180, 8181, 8193, 8194, 8197, 8202, 8204, 8208, 8211, 8213, 8217, 8219, 8224, 8230, 8231, 8234, 8235, 8237, 8238, 8239, 8241, 8242, 8248, 8250, 8252, 8253, 8264, 8265, 8268, 8269, 8273, 8274, 8275, 8276, 8282, 8288, 8289, 8291, 8292, 8296, 8300, 8304, 8305, 8308, 8310, 8311, 8318, 8319, 8322, 8326, 8329, 8339, 8340, 8341, 8349, 8350, 8351, 8353, 8358, 8367, 8368, 8371, 8373, 8379, 8380, 8382, 8389, 8392, 8395, 8396, 8401, 8402, 8403, 8404, 8406, 8410, 8413, 8414, 8415, 8416, 8417, 8418, 8430, 8435, 8438, 8439, 8442, 8443, 8444, 8445, 8446, 8447, 8448, 8449, 8450, 8451, 8452, 8457, 8458, 8459, 8465, 8470, 8471, 8472, 8473, 8474, 8476, 8477, 8478, 8481, 8482, 8490, 8496, 8498, 8500, 8501, 8502, 8503, 8505, 8507, 8509, 8511, 8513, 8515, 8520, 8521, 8523, 8524, 8525, 8526, 8527, 8528, 8531, 8532, 8533, 8541, 8542, 8543, 8549, 8550, 8553, 8554, 8558, 8561, 8565, 8566, 8576, 8581, 8582, 8583, 8585, 8592, 8596, 8597, 8598, 8600, 8601, 8602, 8603, 8605, 8610, 8612, 8621, 8622, 8634, 8635, 8638, 8639, 8644, 8646, 8648, 8652, 8654, 8658, 8659, 8663, 8665, 8669, 8672, 8676, 8677, 8685, 8686, 8693, 8698, 8700, 8705, 8708, 8709, 8713, 8720, 8722, 8726, 8728, 8731, 8732, 8740, 8741, 8746, 8748, 8753, 8756, 8765, 8769, 8770, 8771, 8773, 8774, 8777, 8779, 8782, 8783, 8784, 8785, 8786, 8789, 8795, 8802, 8803, 8804, 8810, 8811, 8817, 8818, 8822, 8824, 8828, 8833, 8834, 8835, 8839, 8841, 8842, 8843, 8844, 8845, 8853, 8863, 8865, 8866, 8874, 8875, 8876, 8877, 8878, 8879, 8881, 8883, 8884, 8886, 8888, 8892, 8897, 8900, 8901, 8902, 8908, 8911, 8916, 8917, 8918, 8922, 8924, 8926, 8928, 8929, 8935, 8937, 8941, 8943, 8945, 8946, 8948, 8950, 8951, 8953, 8960, 8961, 8967, 8968, 8979, 8980, 8981, 8985, 8986, 8991, 8993, 8998, 8999, 9001, 9009, 9011, 9012, 9013, 9015, 9016, 9018, 9026, 9027, 9029, 9030, 9045, 9050, 9052, 9056, 9057, 9058, 9059, 9060, 9063, 9065, 9066, 9068, 9069, 9071, 9072, 9073, 9076, 9084, 9086, 9087, 9091, 9092, 9095, 9096, 9103, 9104, 9105, 9106, 9107, 9110, 9115, 9116, 9118, 9119, 9120, 9123, 9125, 9129, 9133, 9134, 9138, 9139, 9140, 9141, 9142, 9144, 9147, 9149, 9152, 9167, 9168, 9175, 9177, 9180, 9183, 9185, 9188, 9189, 9194, 9195, 9206, 9207, 9213, 9215, 9216, 9218, 9220, 9223, 9225, 9226, 9229, 9231, 9233, 9236, 9237, 9240, 9243, 9248, 9249, 9253, 9257, 9259, 9267, 9270, 9273, 9282, 9284, 9285, 9287, 9288, 9290, 9292, 9298, 9300, 9304, 9306, 9308, 9311, 9313, 9314, 9320, 9321, 9323, 9326, 9327, 9328, 9336, 9338, 9341, 9345, 9346, 9350, 9355, 9359, 9360, 9366, 9368, 9371, 9373, 9375, 9376, 9380, 9382, 9391, 9392, 9394, 9400, 9402, 9403, 9406, 9407, 9412, 9413, 9414, 9415, 9419, 9421, 9423, 9425, 9429, 9439, 9440, 9443, 9449, 9453, 9455, 9456, 9460, 9461, 9467, 9471, 9474, 9481, 9484, 9488, 9490, 9496, 9497, 9500, 9503, 9504, 9509, 9514, 9517, 9518, 9519, 9520, 9522, 9525, 9526, 9534, 9535, 9536, 9537, 9538, 9543, 9545, 9546, 9548, 9550, 9551, 9553, 9554, 9555, 9560, 9564, 9567, 9568, 9571, 9577, 9587, 9590, 9591, 9593, 9595, 9596, 9598, 9601, 9602, 9606, 9609, 9617, 9618, 9620, 9621, 9623, 9624, 9626, 9629, 9632, 9633, 9638, 9648, 9649, 9655, 9657, 9658, 9663, 9668, 9671, 9679, 9680, 9686, 9687, 9692, 9698, 9703, 9706, 9710, 9711, 9715, 9718, 9720, 9723, 9726, 9727, 9731, 9732, 9733, 9737, 9738, 9742, 9744, 9745, 9746, 9750, 9756, 9758, 9763, 9764, 9770, 9772, 9774, 9775, 9776, 9782, 9786, 9792, 9793, 9794, 9797, 9798, 9799, 9804, 9809, 9810, 9811, 9812, 9813, 9819, 9820, 9825, 9827, 9828, 9829, 9835, 9836, 9845, 9846, 9847, 9869, 9875, 9878, 9882, 9886, 9887, 9891, 9892, 9894, 9897, 9898, 9907, 9908, 9909, 9910, 9911, 9921, 9923, 9928, 9930, 9931, 9932, 9935, 9940, 9942, 9944, 9946, 9950, 9952, 9953, 9956, 9962, 9967, 9968, 9969, 9972, 9973, 9974, 9975, 9976, 9980, 9981, 9982, 9984, 9985, 9988, 9989, 9990, 9991, 9992, 9995, 9996, 9997, 10000, 10001, 10008, 10009, 10010, 10012, 10013, 10017, 10018, 10019, 10020, 10021, 10022, 10026, 10027, 10033, 10035, 10041, 10049, 10051, 10052, 10054, 10055, 10058, 10059, 10060, 10062, 10064, 10066, 10068, 10075, 10076, 10077, 10078, 10082, 10083, 10091, 10092, 10095, 10097, 10098, 10101, 10103, 10106, 10110, 10115, 10116, 10117, 10120, 10122, 10125, 10128, 10129, 10131, 10136, 10137, 10140, 10143, 10148, 10151, 10158, 10163, 10165, 10166, 10168, 10169, 10174, 10176, 10178, 10181, 10192, 10193, 10194, 10195, 10196, 10199, 10206, 10207, 10217, 10218, 10219, 10220, 10221, 10222, 10223, 10224, 10225, 10228, 10230, 10231, 10233, 10236, 10237, 10239, 10240, 10249, 10252, 10253, 10254, 10259, 10260, 10262, 10263, 10264, 10266, 10269, 10270, 10275, 10276, 10278, 10284, 10286, 10291, 10292, 10293, 10295, 10300, 10302, 10306, 10307, 10311, 10312, 10314, 10318, 10322, 10323, 10324, 10325, 10326, 10327, 10331, 10333, 10334, 10335, 10336, 10340, 10341, 10346, 10353, 10356, 10357, 10361, 10362, 10364, 10371, 10375, 10376, 10380, 10381, 10384, 10393, 10397, 10398, 10399, 10400, 10401, 10405, 10407, 10408, 10414, 10416, 10417, 10419, 10421, 10422, 10423, 10425, 10428, 10435, 10436, 10447, 10452, 10455, 10456, 10463, 10464, 10465, 10468, 10469, 10471, 10474, 10480, 10481, 10487, 10488, 10493, 10494, 10495, 10506, 10508, 10512, 10514, 10517, 10518, 10522, 10523, 10524, 10527, 10528, 10530, 10531, 10532, 10535, 10537, 10541, 10542, 10543, 10544, 10548, 10555, 10556, 10563, 10566, 10567, 10571, 10573, 10580, 10581, 10582, 10583, 10584, 10587, 10588, 10593, 10596, 10599, 10601, 10602, 10608, 10611, 10615, 10616, 10617, 10621, 10622, 10623, 10626, 10637, 10638, 10639, 10642, 10646, 10650, 10651, 10655, 10665, 10666, 10668, 10671, 10676, 10677, 10678, 10679, 10682, 10683, 10684, 10685, 10686, 10700, 10701, 10705, 10707, 10711, 10721, 10726, 10729, 10734, 10738, 10741, 10744, 10747, 10748, 10749, 10752, 10753, 10754, 10756, 10757, 10766, 10768, 10775, 10777, 10778, 10779, 10781, 10785, 10787, 10788, 10790, 10801, 10802, 10803, 10804, 10805, 10809, 10811, 10822, 10823, 10824, 10827, 10833, 10836, 10837, 10838, 10839, 10840, 10843, 10848, 10850, 10851, 10853, 10854, 10857, 10858, 10864, 10866, 10867, 10870, 10877, 10878, 10880, 10886, 10899, 10901, 10902, 10911, 10913, 10918, 10924, 10926, 10927, 10928, 10929, 10930, 10933, 10934, 10938, 10940, 10941, 10944, 10945, 10947, 10949, 10962, 10966, 10967, 10972, 10974, 10976, 10977, 10978, 10979, 10988, 10993, 10994, 10995, 10996, 10999, 11004, 11008, 11012, 11015, 11021, 11022, 11028, 11029, 11036, 11037, 11046, 11047, 11053, 11058, 11060, 11063, 11066, 11078, 11082, 11083, 11090, 11095, 11100, 11103, 11104, 11109, 11116, 11117, 11118, 11122, 11123, 11124, 11126, 11128, 11129, 11133, 11135, 11136, 11137, 11138, 11145, 11146, 11147, 11149, 11150, 11151, 11153, 11154, 11160, 11161, 11163, 11165, 11168, 11169, 11172, 11173, 11177, 11178, 11181, 11184, 11187, 11188, 11190, 11191, 11192, 11194, 11198, 11203, 11204, 11211, 11214, 11216, 11217, 11218, 11222, 11227, 11228, 11229, 11230, 11232, 11233, 11236, 11238, 11239, 11241, 11242, 11243, 11246, 11247, 11251, 11254, 11255, 11256, 11258, 11260, 11263, 11266, 11274, 11283, 11291, 11292, 11293, 11294, 11295, 11297, 11299, 11304, 11313, 11315, 11316, 11318, 11321, 11323, 11330, 11331, 11337, 11340, 11345, 11346, 11348, 11349, 11352, 11359, 11360, 11362, 11363, 11364, 11365, 11369, 11371, 11373, 11374, 11378, 11380, 11382, 11384, 11385, 11387, 11394, 11395, 11397, 11398, 11401, 11405, 11406, 11408, 11415, 11417, 11424, 11428, 11430, 11431, 11435, 11438, 11443, 11445, 11446, 11447, 11449, 11451, 11456, 11459, 11462, 11465, 11472, 11475, 11487, 11489, 11490, 11492, 11496, 11498, 11499, 11500, 11501, 11505, 11506, 11507, 11520, 11521, 11523, 11524, 11526, 11527, 11533, 11534, 11535, 11539, 11544, 11548, 11551, 11553, 11558, 11560, 11561, 11564, 11567, 11568, 11570, 11571, 11576, 11577, 11578, 11585, 11588, 11593, 11594, 11595, 11596, 11597, 11603, 11604, 11605, 11606, 11607, 11610, 11611, 11612, 11615, 11617, 11618, 11619, 11621, 11623, 11625, 11628, 11631, 11634, 11639, 11643, 11649, 11650, 11655, 11656, 11657, 11658, 11659, 11663, 11669, 11681, 11682, 11688, 11691, 11692, 11694, 11695, 11696, 11699, 11703, 11705, 11707, 11712, 11718, 11721, 11722, 11725, 11726, 11733, 11736, 11737, 11740, 11744, 11753, 11756, 11760, 11761, 11765, 11771, 11776, 11777, 11781, 11784, 11785, 11786, 11789, 11792, 11794, 11797, 11799, 11800, 11805, 11809, 11811, 11818, 11820, 11823, 11829, 11830, 11835, 11839, 11840, 11844, 11846, 11848, 11851, 11853, 11854, 11856, 11858, 11859, 11861, 11863, 11864, 11865, 11868, 11869, 11872, 11876, 11877, 11889, 11891, 11892, 11894, 11895, 11901, 11902, 11906, 11911, 11913, 11916, 11917, 11918, 11919, 11920, 11921, 11922, 11923, 11924, 11926, 11927, 11928, 11929, 11930, 11933, 11940, 11947, 11949, 11953, 11956, 11958, 11959, 11960, 11961, 11962, 11965, 11966, 11968, 11974, 11975, 11976, 11977, 11978, 11979, 11983, 11988, 11989, 11993, 11997, 11998, 11999, 12004, 12006, 12008, 12014, 12015, 12016, 12017, 12018, 12019, 12020, 12021, 12023, 12024, 12026, 12027, 12032, 12042, 12043, 12044, 12047, 12058, 12059, 12075, 12077, 12080, 12081, 12083, 12091, 12092, 12093, 12095, 12098, 12104, 12106, 12108, 12109, 12110, 12112, 12113, 12114, 12115, 12117, 12118, 12126, 12127, 12128, 12129, 12134, 12137, 12138, 12139, 12140, 12143, 12149, 12161, 12165, 12166, 12167, 12170, 12171, 12174, 12175, 12176, 12181, 12183, 12186, 12188, 12197, 12200, 12201, 12204, 12207, 12208, 12215, 12217, 12218, 12219, 12220, 12224, 12227, 12228, 12229, 12234, 12240, 12241, 12245, 12249, 12250, 12252, 12253, 12259, 12263, 12267, 12268, 12278, 12280, 12283, 12287, 12288, 12293, 12297, 12298, 12304, 12310, 12311, 12313, 12314, 12317, 12321, 12323, 12326, 12329, 12331, 12333, 12334, 12335, 12343, 12344, 12347, 12354, 12358, 12359, 12364, 12368, 12369, 12373, 12374, 12379, 12380, 12381, 12382, 12391, 12396, 12397, 12400, 12403, 12405, 12406, 12411, 12414, 12419, 12420, 12421, 12426, 12427, 12428, 12440, 12441, 12445, 12447, 12448, 12451, 12454, 12455, 12456, 12457, 12462, 12467, 12468, 12472, 12473, 12475, 12476, 12478, 12479, 12481, 12482, 12487, 12488, 12491, 12494, 12497, 12499, 12504, 12508, 12514, 12521, 12523, 12525, 12530, 12531, 12536, 12540, 12545, 12546, 12547, 12549, 12555, 12556, 12559, 12561, 12562, 12563, 12564, 12565, 12567, 12578, 12585, 12588, 12597, 12600, 12605, 12608, 12609, 12611, 12616, 12619, 12623, 12628, 12629, 12630, 12631, 12633, 12634, 12636, 12638, 12641, 12649, 12651, 12655, 12658, 12663, 12668, 12670, 12672, 12675, 12676, 12679, 12682, 12684, 12691, 12698, 12701, 12702, 12707, 12718, 12719, 12729, 12731, 12732, 12733, 12737, 12739, 12740, 12741, 12742, 12743, 12749, 12750, 12752, 12754, 12758, 12760, 12761, 12762, 12764, 12766, 12769, 12771, 12783, 12785, 12788, 12789, 12790, 12797, 12802, 12805, 12810, 12812, 12813, 12819, 12820, 12822, 12824, 12826, 12827, 12828, 12834, 12836, 12838, 12839, 12844, 12848, 12849, 12853, 12856, 12861, 12876, 12884, 12887, 12888, 12896, 12898, 12900, 12904, 12905, 12906, 12910, 12913, 12917, 12918, 12920, 12921, 12932, 12938, 12939, 12940, 12941, 12942, 12946, 12947, 12950, 12954, 12961, 12962, 12963, 12966, 12968, 12969, 12972, 12973, 12978, 12982, 12983, 12987, 12990, 12991, 12992, 12993, 12997, 13007, 13010, 13011, 13014, 13017, 13022, 13030, 13032, 13035, 13038, 13040, 13041, 13044, 13049, 13050, 13053, 13054, 13055, 13056, 13060, 13061, 13066, 13067, 13069, 13074, 13075, 13077, 13079, 13085, 13086, 13087, 13095, 13102, 13106, 13112, 13114, 13115, 13116, 13117, 13118, 13120, 13123, 13124, 13128, 13135, 13142, 13147, 13151, 13153, 13154, 13155, 13156, 13160, 13165, 13169, 13175, 13177, 13182, 13186, 13189, 13191, 13197, 13199, 13207, 13209, 13210, 13213, 13217, 13221, 13222, 13224, 13227, 13230, 13232, 13234, 13235, 13236, 13237, 13238, 13239, 13243, 13249, 13251, 13255, 13259, 13260, 13261, 13263, 13264, 13267, 13269, 13276, 13278, 13281, 13293, 13295, 13296, 13298, 13303, 13304, 13313, 13315, 13317, 13318, 13319, 13322, 13323, 13326, 13328, 13329, 13330, 13332, 13338, 13340, 13341, 13348, 13352, 13353, 13354, 13358, 13359, 13361, 13363, 13369, 13370, 13380, 13381, 13384, 13387, 13392, 13393, 13394, 13396, 13397, 13398, 13401, 13408, 13415, 13416, 13419, 13420, 13423, 13424, 13429, 13433, 13439, 13443, 13444, 13446, 13448, 13451, 13454, 13456, 13460, 13463, 13464, 13466, 13468, 13469, 13473, 13475, 13492, 13494, 13499, 13500, 13501, 13503, 13504, 13506, 13508, 13509, 13513, 13514, 13515, 13517, 13519, 13520, 13521, 13524, 13529, 13530, 13532, 13535, 13536, 13537, 13540, 13543, 13544, 13546, 13547, 13549, 13552, 13556, 13560, 13568, 13574, 13580, 13584, 13587, 13597, 13598, 13601, 13602, 13603, 13604, 13612, 13623, 13626, 13627, 13631, 13632, 13634, 13635, 13637, 13640, 13641, 13643, 13647, 13649, 13650, 13652, 13654, 13660, 13661, 13662, 13663, 13669, 13671, 13675, 13677, 13678, 13683, 13684, 13686, 13688, 13700, 13703, 13706, 13708, 13712, 13715, 13716, 13719, 13720, 13725, 13727, 13728, 13729, 13730, 13745, 13747, 13750, 13755, 13756, 13761, 13762, 13764, 13766, 13767, 13769, 13773, 13775, 13779, 13781, 13783, 13786, 13787, 13789, 13790, 13791, 13794, 13795, 13796, 13798, 13809, 13810, 13816, 13817, 13818, 13819, 13820, 13822, 13823, 13824, 13830, 13831, 13833, 13834, 13835, 13843, 13849, 13856, 13859, 13866, 13869, 13870, 13872, 13873, 13877, 13881, 13885, 13891, 13892, 13894, 13896, 13897, 13901, 13904, 13906, 13909, 13910, 13911, 13917, 13919, 13921, 13925, 13927, 13930, 13935, 13944, 13947, 13948, 13952, 13954, 13956, 13963, 13965, 13969, 13970, 13971, 13975, 13976, 13983, 13984, 13988, 13991, 13999, 14000, 14008, 14009, 14014, 14017, 14018, 14022, 14027, 14030, 14031, 14036, 14041, 14043, 14049, 14050, 14051, 14054, 14062, 14063, 14066, 14069, 14070, 14071, 14076, 14081, 14084, 14086, 14087, 14088, 14092, 14094, 14102, 14105, 14106, 14110, 14116, 14118, 14122, 14126, 14129, 14130, 14132, 14134, 14138, 14139, 14146, 14148, 14149, 14150.

Stress-Enhanced Promoter Expression Patterns

Data sets from ten corn stress experiments were used in an AFFYMETRIX analysis of promoter activity under different stress conditions, including but not limited to cold, drought and low nitrogen conditions.

Promoters were tested in Youngest Fully Expanded Leaf tissue from corn hybrid plants (LH244×LH59) during drought conditions at the V7 stage. Wet and Drought samples are grown under normal conditions; water is withheld from Drought samples until the onset of drought and then harvested. Wet Samples are compared to Drought samples. Promoters expressing under these conditions at this stage include SEQ IDs: 8, 19, 27, 111, 126, 137, 144, 174, 179, 211, 232, 240, 244, 273, 309, 328, 332, 371, 388, 434, 482, 483, 488, 523, 608, 613, 614, 638, 717, 722, 740, 744, 749, 753, 765, 800, 808, 830, 844, 855, 878, 879, 907, 911, 912, 925, 957, 960, 964, 980, 989, 994, 995, 997, 1008, 1011, 1052, 1070, 1087, 1096, 1110, 1170, 1171, 1185, 1204, 1218, 1220, 1347, 1349, 1391, 1468, 1471, 1555, 1590, 1610, 1658, 1659, 1662, 1676, 1715, 1720, 1749, 1798, 1850, 1859, 1905, 1923, 1933, 1934, 1977, 2023, 2066, 2089, 2097, 2107, 2133, 2150, 2162, 2166, 2178, 2193, 2196, 2202, 2203, 2314, 2369, 2398, 2420, 2443, 2457, 2522, 2538, 2539, 2590, 2679, 2691, 2735, 2749, 2763, 2816, 2843, 2860, 2889, 2959, 2979, 3003, 3050, 3055, 3072, 3083, 3115, 3129, 3202, 3225, 3244, 3247, 3337, 3353, 3382, 3427, 3429, 3469, 3482, 3506, 3576, 3591, 3592, 3611, 3621, 3642, 3674, 3706, 3772, 3773, 3820, 3885, 3926, 3928, 3962, 3969, 3995, 4013, 4088, 4099, 4110, 4155, 4158, 4187, 4193, 4232, 4296, 4309, 4378, 4405, 4410, 4450, 4494, 4531, 4568, 4599, 4643, 4644, 4650, 4673, 4725, 4758, 4775, 4784, 4828, 4830, 4831, 4863, 4881, 4888, 4918, 4944, 4971, 4972, 4985, 5005, 5007, 5042, 5044, 5049, 5074, 5100, 5119, 5144, 5151, 5159, 5165, 5168, 5190, 5213, 5217, 5253, 5263, 5280, 5283, 5301, 5324, 5331, 5391, 5414, 5458, 5496, 5497, 5535, 5615, 5659, 5681, 5689, 5700, 5709, 5718, 5734, 5826, 5837, 5853, 5872, 5878, 5881, 5925, 5931, 5941, 5957, 5967, 5980, 6048, 6069, 6093, 6098, 6145, 6157, 6227, 6244, 6349, 6386, 6404, 6470, 6486, 6493, 6554, 6625, 6630, 6662, 6676, 6705, 6734, 6739, 6807, 6816, 6894, 6951, 6987, 7009, 7042, 7043, 7051, 7112, 7142, 7183, 7192, 7213, 7221, 7234, 7255, 7291, 7308, 7357, 7395, 7447, 7458, 7703, 7718, 7736, 7785, 7786, 7798, 7800, 7807, 7815, 7900, 7918, 7971, 7976, 7988, 8030, 8056, 8088, 8103, 8105, 8174, 8177, 8192, 8208, 8236, 8241, 8253, 8282, 8292, 8361, 8379, 8389, 8441, 8442, 8511, 8513, 8524, 8566, 8590, 8593, 8610, 8631, 8669, 8713, 8726, 8741, 8748, 8824, 8834, 8835, 8891, 8900, 8913, 8941, 8949, 9014, 9017, 9021, 9069, 9118, 9123, 9129, 9140, 9141, 9142, 9151, 9183, 9188, 9215, 9218, 9226, 9234, 9267, 9291, 9313, 9346, 9347, 9415, 9419, 9460, 9497, 9502, 9505, 9514, 9517, 9518, 9522, 9563, 9648, 9666, 9710, 9711, 9717, 9746, 9776, 9845, 9866, 9907, 9909, 9962, 9982, 10013, 10075, 10098, 10103, 10106, 10115, 10151, 10231, 10238, 10240, 10326, 10331, 10398, 10410, 10427, 10447, 10450, 10465, 10474, 10494, 10504, 10515, 10518, 10543, 10577, 10593, 10617, 10632, 10634, 10705, 10750, 10813, 10815, 10823, 10833, 10856, 10874, 10912, 10927, 10936, 11082, 11108, 11151, 11162, 11168, 11178, 11226, 11232, 11234, 11237, 11246, 11295, 11320, 11322, 11348, 11379, 11380, 11381, 11438, 11477, 11508, 11522, 11548, 11558, 11593, 11594, 11610, 11655, 11694, 11718, 11761, 11770, 11780, 11822, 11841, 11858, 11943, 12059, 12098, 12150, 12197, 12215, 12249, 12268, 12305, 12323, 12333, 12456, 12482, 12483, 12530, 12531, 12570, 12634, 12640, 12677, 12708, 12735, 12739, 12790, 12810, 12824, 12837, 12838, 12839, 12849, 12850, 12895, 12916, 12921, 12978, 12983, 13036, 13040, 13049, 13067, 13131, 13148, 13149, 13167, 13169, 13239, 13243, 13255, 13268, 13298, 13300, 13303, 13315, 13393, 13470, 13579, 13582, 13587, 13598, 13632, 13641, 13643, 13688, 13706, 13720, 13747, 13753, 13816, 13828, 13917, 13970, 13984, 14017, 14031, 14073, 14081, 14088, 14115, 14122.

Promoters were tested in Root tissue from corn hybrid plants (LH200×LH59) during vegetative emergence. Wet and Drought samples grown under normal conditions; water is witheld from Drought samples for four days. Samples are taken 1 hr after 4th day of drought. Wet Samples are compared to Drought samples. Promoters expressing under these conditions at this stage include SEQ IDs: 8, 111, 112, 160, 168, 183, 196, 235, 378, 434, 502, 634, 1106, 1172, 1303, 1467, 1622, 1663, 1836, 1976, 2027, 2060, 2140, 2371, 2446, 2544, 2661, 2662, 2786, 2948, 3003, 3106, 3266, 3307, 3351, 3369, 3373, 3399, 3427, 3501, 3599, 3618, 3620, 3637, 3777, 3820, 3914, 3940, 3994, 4157, 4158, 4314, 4434, 4436, 5264, 5359, 5483, 5562, 5670, 5671, 5809, 5872, 5928, 5967, 5994, 6065, 6176, 6309, 6364, 6486, 6724, 6966, 7040, 7068, 7096, 7137, 7400, 7407, 7464, 7572, 7599, 7678, 7679, 7680, 7734, 7740, 7762, 7900, 7909, 7937, 7943, 7953, 7972, 8237, 8276, 8292, 8457, 8474, 8476, 8628, 8634, 9138, 9234, 9275, 9291, 9330, 9422, 9732, 9755, 9764, 9774, 9854, 9869, 9878, 9996, 10047, 10619, 10988, 11067, 11148, 11160, 11178, 11391, 11395, 11436, 11522, 11655, 11773, 11780, 12004, 12127, 12150, 12167, 12265, 12302, 12478, 12634, 12692, 12721, 12824, 12827, 12884, 13041, 13228, 13273, 13386, 13397, 13420, 13444, 13460, 13558, 13961.

Promoters were tested in Shoot tissue from corn hybrid plants (LH200×LH59) during vegetative emergence. Wet and Drought samples are grown under normal conditions; water is withheld from Drought samples for four days. Samples are taken 1 hr after 4th day of drought. Wet Samples are compared to Drought samples. Promoters expressing under these conditions at this stage include SEQ IDs: 383, 3296, 3654, 5562, 7032, 7747.

Promoters were tested in Root tissue from corn hybrid plants (LH200×LH59) during vegetative emergence. Wet and Drought samples are grown under normal conditions; water is withheld from Drought samples for four days. Samples are taken 8 hrs after 4th day of drought. Wet Samples are compared to Drought samples. Promoters expressing under these conditions at this stage include SEQ IDs: 8, 111, 280, 305, 306, 371, 434, 830, 1011, 1096, 1349, 1363, 1389, 1439, 1448, 1590, 1622, 1701, 1915, 2420, 2446, 2661, 2662, 2735, 3046, 3307, 3427, 3674, 3820, 3995, 4296, 4985, 5165, 5253, 5327, 5474, 5670, 5671, 5826, 5872, 5980, 6093, 6486, 6662, 6777, 6811, 7096, 7126, 7395, 7750, 7909, 8048, 8361, 9086, 9141, 9142, 9582, 9607, 10231, 10426, 10621, 11129, 11436, 11655, 12299, 12333, 12788, 12837, 13044, 13064, 13558, 13927, 13949.

Promoters were tested in Shoot tissue from corn hybrid plants (LH200×LH59) during vegetative emergence. Wet and Drought samples are grown under normal conditions; water is withheld from Drought samples for four days. Samples are taken 8 hrs after 4th day of drought. Wet Samples are compared to Drought samples. Promoters expressing under these conditions at this stage include SEQ IDs: 211, 280, 305, 306, 830, 925, 1218, 1349, 1439, 1712, 1749, 2202, 2203, 2802, 2843, 3115, 3199, 3427, 3576, 3831, 3951, 3995, 5159, 5327, 5659, 5826, 5906, 7353, 8048, 8523, 9086, 9653, 10465, 11237, 11379, 12024, 12333, 12536, 12651, 12788, 13957, 14076, 14087.

Promoters were tested in Leaf tissue from corn hybrid plants (LH244×LH59) during V6 stage. HN (sample grown in sufficient nitrogen conditions) are compared to LN (samples grown under low nitrogen conditions). Promoters expressing under these conditions at this stage include SEQ IDs: 14, 38, 61, 76, 95, 96, 104, 108, 112, 131, 133, 160, 211, 234, 249, 250, 262, 269, 270, 271, 299, 348, 352, 376, 461, 485, 488, 528, 534, 538, 579, 613, 614, 622, 636, 638, 692, 716, 753, 808, 824, 825, 826, 855, 860, 869, 873, 898, 980, 1010, 1026, 1041, 1073, 1091, 1096, 1117, 1120, 1146, 1187, 1217, 1218, 1235, 1251, 1269, 1291, 1345, 1347, 1367, 1392, 1432, 1448, 1458, 1468, 1475, 1483, 1484, 1490, 1499, 1539, 1547, 1552, 1570, 1582, 1600, 1610, 1635, 1658, 1662, 1671, 1677, 1749, 1759, 1772, 1796, 1807, 1863, 1876, 1882, 1912, 2023, 2027, 2060, 2114, 2133, 2143, 2150, 2168, 2227, 2237, 2259, 2303, 2321, 2322, 2323, 2353, 2397, 2443, 2528, 2543, 2544, 2560, 2587, 2617, 2653, 2659, 2663, 2756, 2770, 2786, 2843, 2860, 2897, 2903, 2918, 2940, 2942, 2948, 2955, 2969, 2979, 3027, 3029, 3045, 3048, 3050, 3090, 3106, 3126, 3141, 3157, 3158, 3181, 3225, 3235, 3247, 3253, 3327, 3337, 3361, 3394, 3399, 3402, 3425, 3427, 3440, 3441, 3468, 3507, 3515, 3551, 3591, 3594, 3619, 3621, 3643, 3654, 3655, 3669, 3673, 3731, 3772, 3773, 3792, 3804, 3805, 3819, 3837, 3858, 3866, 3873, 3881, 3917, 3926, 3941, 3972, 3995, 3997, 4013, 4040, 4044, 4049, 4098, 4099, 4111, 4131, 4132, 4149, 4161, 4162, 4166, 4188, 4201, 4206, 4211, 4217, 4219, 4247, 4284, 4339, 4352, 4354, 4369, 4370, 4371, 4373, 4422, 4442, 4494, 4549, 4582, 4605, 4636, 4638, 4644, 4669, 4673, 4719, 4739, 4749, 4755, 4804, 4805, 4806, 4807, 4879, 4881, 4918, 4924, 4947, 4960, 4981, 4988, 4994, 5011, 5024, 5049, 5055, 5067, 5074, 5102, 5113, 5136, 5137, 5140, 5144, 5146, 5203, 5219, 5230, 5253, 5257, 5287, 5311, 5328, 5332, 5351, 5371, 5446, 5482, 5497, 5508, 5547, 5559, 5566, 5655, 5657, 5677, 5681, 5712, 5713, 5734, 5768, 5834, 5837, 5858, 5882, 5883, 5912, 5931, 5942, 6006, 6031, 6051, 6082, 6085, 6090, 6107, 6125, 6132, 6145, 6155, 6221, 6237, 6319, 6343, 6344, 6349, 6358, 6378, 6398, 6422, 6444, 6452, 6464, 6476, 6480, 6486, 6493, 6505, 6523, 6525, 6534, 6662, 6681, 6689, 6695, 6724, 6761, 6779, 6804, 6819, 6842, 6850, 6867, 6925, 6959, 6960, 7094, 7107, 7129, 7142, 7170, 7171, 7209, 7214, 7221, 7234, 7248, 7308, 7315, 7317, 7353, 7357, 7383, 7392, 7395, 7396, 7408, 7434, 7454, 7458, 7483, 7486, 7524, 7549, 7568, 7632, 7763, 7767, 7780, 7786, 7796, 7800, 7803, 7815, 7856, 7859, 7909, 7943, 7953, 7971, 7976, 7982, 7988, 8000, 8002, 8045, 8059, 8080, 8087, 8103, 8145, 8146, 8199, 8213, 8227, 8236, 8296, 8300, 8361, 8411, 8414, 8429, 8438, 8455, 8482, 8490, 8513, 8532, 8610, 8631, 8648, 8706, 8782, 8831, 8833, 8862, 8878, 8880, 8900, 8913, 8928, 8961, 8984, 9002, 9003, 9021, 9022, 9038, 9111, 9115, 9118, 9129, 9131, 9140, 9174, 9218, 9229, 9234, 9310, 9329, 9361, 9367, 9432, 9433, 9453, 9546, 9560, 9579, 9586, 9633, 9637, 9651, 9652, 9692, 9695, 9722, 9733, 9754, 9755, 9761, 9798, 9799, 9824, 9835, 9869, 9876, 9888, 9897, 9908, 9911, 9918, 9976, 10021, 10052, 10060, 10090, 10098, 10107, 10206, 10273, 10311, 10343, 10398, 10427, 10447, 10451, 10470, 10488, 10494, 10542, 10582, 10585, 10595, 10597, 10617, 10636, 10645, 10648, 10664, 10723, 10740, 10747, 10780, 10822, 10825, 10833, 10838, 10863, 10871, 10886, 10892, 10903, 10956, 11018, 11021, 11026, 11027, 11095, 11119, 11124, 11127, 11150, 11151, 11162, 11207, 11214, 11228, 11255, 11258, 11263, 11323, 11337, 11377, 11391, 11411, 11412, 11413, 11414, 11438, 11500, 11503, 11508, 11527, 11534, 11538, 11546, 11551, 11578, 11623, 11642, 11655, 11703, 11705, 11710, 11720, 11763, 11795, 11836, 11841, 11858, 11918, 11926, 11927, 11980, 11988, 12015, 12040, 12068, 12094, 12150, 12161, 12194, 12214, 12252, 12253, 12259, 12304, 12305, 12323, 12368, 12374, 12402, 12414, 12447, 12468, 12478, 12482, 12483, 12503, 12551, 12552, 12600, 12611, 12631, 12634, 12679, 12728, 12765, 12790, 12812, 12818, 12824, 12827, 12882, 12898, 12902, 12913, 12972, 12978, 12989, 13030, 13075, 13081, 13106, 13109, 13156, 13159, 13228, 13229, 13231, 13239, 13248, 13273, 13295, 13303, 13349, 13353, 13397, 13401, 13414, 13420, 13428, 13446, 13448, 13451, 13456, 13460, 13510, 13535, 13536, 13543, 13546, 13552, 13558, 13572, 13579, 13596, 13606, 13607, 13730, 13747, 13753, 13802, 13812, 13813, 13816, 13851, 13875, 13917, 13919, 13938, 13944, 13948, 13960, 14002, 14018, 14040, 14052, 14072, 14086, 14118, 14144.

Promoters were tested in Seedling Root tissue from corn hybrid plants (LH200×LH59) during vegetative emergence. Cold plants exposed to 10 C 20 days after imbibition were compared to plants grown at 23 C and harvested a similar development stage as the cold plants. Promoters expressing under these conditions at this stage include SEQ IDs: 1, 11, 16, 20, 24, 49, 53, 64, 69, 70, 71, 73, 86, 108, 111, 126, 130, 134, 137, 141, 143, 152, 154, 172, 174, 180, 189, 191, 202, 211, 232, 240, 244, 249, 262, 285, 301, 302, 314, 319, 328, 329, 335, 337, 360, 365, 370, 371, 372, 373, 416, 431, 434, 436, 454, 458, 461, 482, 485, 496, 502, 513, 515, 523, 534, 537, 538, 548, 554, 563, 565, 611, 630, 638, 655, 665, 687, 694, 695, 705, 723, 731, 753, 757, 758, 763, 779, 793, 806, 808, 819, 824, 825, 826, 830, 833, 841, 857, 871, 898, 901, 907, 915, 924, 932, 949, 951, 957, 959, 983, 994, 995, 996, 997, 1002, 1005, 1008, 1010, 1013, 1016, 1038, 1052, 1088, 1100, 1110, 1121, 1127, 1130, 1133, 1144, 1171, 1187, 1200, 1213, 1215, 1218, 1220, 1227, 1229, 1248, 1254, 1261, 1330, 1331, 1334, 1339, 1345, 1346, 1347, 1349, 1373, 1381, 1387, 1389, 1393, 1396, 1402, 1415, 1439, 1458, 1466, 1468, 1471, 1497, 1499, 1518, 1519, 1539, 1568, 1570, 1571, 1588, 1596, 1600, 1609, 1622, 1628, 1629, 1634, 1659, 1696, 1699, 1703, 1720, 1732, 1733, 1745, 1749, 1755, 1768, 1808, 1814, 1834, 1839, 1845, 1848, 1861, 1868, 1876, 1882, 1886, 1888, 1909, 1913, 1915, 1922, 1940, 1945, 1953, 1991, 1993, 2000, 2009, 2010, 2016, 2017, 2027, 2043, 2060, 2078, 2091, 2099, 2107, 2119, 2122, 2123, 2126, 2134, 2137, 2139, 2143, 2148, 2156, 2158, 2185, 2193, 2200, 2205, 2214, 2221, 2223, 2227, 2243, 2271, 2276, 2296, 2309, 2322, 2323, 2325, 2333, 2337, 2371, 2376, 2379, 2380, 2405, 2413, 2414, 2420, 2423, 2426, 2430, 2439, 2441, 2442, 2443, 2454, 2457, 2458, 2466, 2472, 2474, 2486, 2514, 2544, 2554, 2571, 2573, 2576, 2589, 2600, 2605, 2606, 2607, 2609, 2611, 2614, 2618, 2636, 2649, 2652, 2661, 2662, 2670, 2692, 2694, 2735, 2740, 2747, 2752, 2764, 2765, 2770, 2783, 2784, 2798, 2801, 2805, 2814, 2826, 2827, 2831, 2832, 2845, 2850, 2860, 2861, 2862, 2869, 2876, 2878, 2883, 2888, 2892, 2897, 2942, 2944, 2948, 2951, 2959, 2962, 2969, 2987, 3000, 3005, 3013, 3015, 3020, 3027, 3038, 3042, 3043, 3062, 3067, 3072, 3080, 3084, 3115, 3127, 3128, 3129, 3137, 3138, 3141, 3143, 3157, 3158, 3159, 3177, 3204, 3205, 3225, 3228, 3268, 3271, 3290, 3299, 3312, 3314, 3324, 3337, 3353, 3357, 3374, 3381, 3382, 3391, 3402, 3403, 3416, 3422, 3428, 3429, 3458, 3460, 3462, 3468, 3469, 3482, 3483, 3515, 3521, 3522, 3523, 3549, 3551, 3557, 3558, 3574, 3594, 3603, 3615, 3619, 3645, 3648, 3655, 3660, 3669, 3674, 3676, 3697, 3702, 3733, 3754, 3772, 3773, 3775, 3781, 3792, 3793, 3804, 3818, 3831, 3832, 3858, 3869, 3870, 3872, 3895, 3899, 3902, 3917, 3918, 3924, 3928, 3929, 3951, 3958, 3964, 3974, 3983, 3987, 3988, 3995, 4006, 4021, 4034, 4044, 4053, 4067, 4088, 4092, 4094, 4099, 4109, 4111, 4133, 4140, 4143, 4155, 4171, 4175, 4176, 4187, 4202, 4216, 4217, 4233, 4296, 4301, 4312, 4347, 4358, 4392, 4395, 4401, 4403, 4422, 4430, 4436, 4442, 4458, 4461, 4462, 4463, 4470, 4494, 4498, 4508, 4513, 4519, 4528, 4548, 4549, 4555, 4576, 4578, 4579, 4582, 4632, 4639, 4643, 4657, 4669, 4677, 4684, 4685, 4692, 4704, 4706, 4711, 4725, 4747, 4750, 4756, 4769, 4770, 4773, 4775, 4788, 4789, 4812, 4816, 4822, 4830, 4831, 4856, 4870, 4888, 4909, 4914, 4918, 4921, 4926, 4944, 4955, 4971, 4972, 4985, 4987, 4988, 4996, 5007, 5016, 5021, 5052, 5067, 5078, 5087, 5091, 5094, 5100, 5108, 5119, 5125, 5140, 5159, 5165, 5169, 5170, 5181, 5184, 5189, 5202, 5219, 5253, 5256, 5258, 5261, 5289, 5293, 5297, 5298, 5311, 5332, 5339, 5351, 5382, 5395, 5428, 5446, 5458, 5479, 5487, 5496, 5515, 5517, 5518, 5519, 5520, 5521, 5537, 5543, 5569, 5615, 5619, 5638, 5646, 5653, 5657, 5659, 5664, 5675, 5676, 5677, 5681, 5728, 5734, 5735, 5744, 5770, 5771, 5773, 5783, 5785, 5791, 5826, 5844, 5860, 5882, 5883, 5910, 5912, 5931, 5938, 5940, 5950, 5954, 5956, 5957, 5971, 5974, 5980, 5992, 6000, 6017, 6047, 6048, 6053, 6060, 6063, 6069, 6088, 6090, 6096, 6119, 6124, 6130, 6132, 6146, 6151, 6153, 6155, 6165, 6176, 6205, 6215, 6219, 6220, 6226, 6227, 6228, 6237, 6240, 6270, 6280, 6299, 6303, 6321, 6323, 6360, 6362, 6364, 6407, 6414, 6429, 6430, 6452, 6458, 6477, 6478, 6482, 6486, 6500, 6515, 6516, 6524, 6530, 6539, 6545, 6599, 6626, 6629, 6634, 6637, 6639, 6646, 6647, 6652, 6654, 6662, 6671, 6693, 6696, 6722, 6731, 6736, 6747, 6759, 6779, 6795, 6807, 6808, 6810, 6812, 6832, 6841, 6874, 6884, 6885, 6888, 6890, 6909, 6913, 6967, 6968, 6980, 6985, 7025, 7035, 7038, 7039, 7043, 7045, 7048, 7052, 7074, 7077, 7084, 7085, 7096, 7097, 7110, 7113, 7115, 7116, 7122, 7124, 7142, 7183, 7184, 7187, 7195, 7196, 7218, 7235, 7236, 7269, 7287, 7323, 7336, 7360, 7369, 7380, 7389, 7407, 7418, 7441, 7450, 7454, 7479, 7491, 7508, 7514, 7533, 7547, 7572, 7588, 7593, 7620, 7633, 7634, 7642, 7655, 7663, 7665, 7674, 7695, 7703, 7704, 7717, 7736, 7750, 7754, 7767, 7779, 7785, 7791, 7798, 7815, 7820, 7841, 7847, 7848, 7850, 7859, 7884, 7908, 7909, 7910, 7911, 7921, 7949, 7952, 7965, 7966, 7967, 7977, 7979, 7981, 7988, 7998, 8002, 8048, 8052, 8053, 8056, 8059, 8062, 8066, 8068, 8072, 8078, 8137, 8162, 8166, 8174, 8184, 8208, 8211, 8213, 8216, 8217, 8222, 8223, 8236, 8240, 8244, 8272, 8275, 8288, 8294, 8297, 8315, 8319, 8339, 8354, 8355, 8361, 8367, 8368, 8386, 8392, 8401, 8429, 8442, 8446, 8458, 8459, 8463, 8471, 8478, 8480, 8482, 8490, 8493, 8498, 8501, 8502, 8515, 8517, 8535, 8568, 8577, 8593, 8594, 8599, 8609, 8611, 8624, 8638, 8639, 8648, 8657, 8663, 8669, 8676, 8677, 8700, 8704, 8713, 8720, 8721, 8726, 8729, 8732, 8735, 8761, 8766, 8782, 8797, 8834, 8866, 8869, 8884, 8900, 8926, 8928, 8942, 8945, 8949, 8956, 8982, 8985, 9001, 9020, 9033, 9057, 9062, 9069, 9074, 9100, 9111, 9118, 9119, 9129, 9136, 9140, 9154, 9183, 9200, 9216, 9217, 9222, 9226, 9269, 9270, 9284, 9290, 9316, 9336, 9345, 9349, 9354, 9363, 9382, 9419, 9423, 9451, 9475, 9504, 9505, 9509, 9513, 9515, 9517, 9518, 9525, 9556, 9560, 9568, 9575, 9586, 9590, 9592, 9608, 9618, 9620, 9623, 9624, 9628, 9630, 9632, 9633, 9635, 9646, 9663, 9674, 9679, 9687, 9692, 9725, 9746, 9754, 9763, 9780, 9786, 9808, 9812, 9830, 9835, 9845, 9846, 9850, 9866, 9873, 9880, 9882, 9886, 9893, 9894, 9897, 9907, 9908, 9909, 9910, 9918, 9928, 9930, 9946, 9957, 9967, 9972, 9980, 9985, 9998, 10056, 10060, 10072, 10076, 10089, 10097, 10109, 10115, 10122, 10135, 10152, 10158, 10163, 10165, 10166, 10178, 10182, 10201, 10202, 10207, 10224, 10231, 10232, 10240, 10258, 10260, 10273, 10286, 10292, 10306, 10307, 10312, 10324, 10329, 10342, 10373, 10378, 10388, 10398, 10426, 10450, 10494, 10504, 10518, 10527, 10541, 10555, 10556, 10561, 10571, 10580, 10583, 10597, 10601, 10621, 10628, 10636, 10642, 10649, 10650, 10689, 10706, 10722, 10732, 10734, 10735, 10744, 10745, 10753, 10766, 10780, 10787, 10790, 10796, 10800, 10801, 10804, 10811, 10813, 10820, 10823, 10830, 10863, 10917, 10927, 10928, 10936, 10956, 10957, 11002, 11004, 11046, 11047, 11056, 11078, 11081, 11092, 11095, 11100, 11107, 11109, 11127, 11132, 11133, 11150, 11166, 11171, 11173, 11175, 11184, 11187, 11188, 11199, 11227, 11237, 11254, 11255, 11274, 11282, 11305, 11307, 11313, 11315, 11330, 11331, 11332, 11337, 11341, 11356, 11371, 11385, 11406, 11438, 11458, 11466, 11467, 11497, 11513, 11534, 11578, 11592, 11594, 11623, 11625, 11649, 11652, 11655, 11656, 11672, 11677, 11698, 11705, 11707, 11740, 11753, 11756, 11759, 11785, 11795, 11802, 11847, 11853, 11858, 11863, 11872, 11876, 11909, 11912, 11926, 11958, 11974, 11988, 11997, 12006, 12021, 12024, 12025, 12050, 12063, 12080, 12128, 12130, 12139, 12144, 12147, 12148, 12151, 12181, 12204, 12216, 12217, 12243, 12245, 12253, 12260, 12274, 12275, 12284, 12286, 12299, 12311, 12319, 12328, 12342, 12358, 12370, 12375, 12380, 12411, 12414, 12417, 12420, 12447, 12456, 12461, 12468, 12470, 12481, 12482, 12483, 12492, 12495, 12497, 12499, 12525, 12531, 12535, 12537, 12553, 12554, 12568, 12574, 12589, 12600, 12608, 12609, 12639, 12651, 12673, 12680, 12681, 12689, 12695, 12723, 12726, 12731, 12732, 12744, 12752, 12753, 12754, 12797, 12803, 12826, 12837, 12844, 12849, 12866, 12873, 12875, 12884, 12894, 12898, 12923, 12929, 12931, 12934, 12969, 12973, 12987, 12990, 12991, 13015, 13017, 13033, 13037, 13040, 13041, 13047, 13054, 13056, 13075, 13097, 13102, 13106, 13116, 13136, 13152, 13155, 13163, 13175, 13182, 13197, 13210, 13212, 13213, 13215, 13232, 13234, 13236, 13237, 13239, 13250, 13256, 13260, 13264, 13281, 13295, 13300, 13312, 13316, 13329, 13332, 13340, 13343, 13345, 13346, 13351, 13352, 13358, 13359, 13363, 13367, 13374, 13377, 13384, 13387, 13390, 13418, 13424, 13460, 13492, 13501, 13507, 13517, 13519, 13530, 13535, 13536, 13553, 13558, 13559, 13561, 13572, 13574, 13575, 13577, 13578, 13586, 13587, 13602, 13619, 13621, 13628, 13632, 13639, 13641, 13654, 13660, 13662, 13669, 13677, 13679, 13684, 13699, 13700, 13719, 13720, 13724, 13727, 13767, 13768, 13774, 13780, 13782, 13783, 13791, 13795, 13798, 13820, 13859, 13874, 13887, 13891, 13915, 13929, 13933, 13938, 13944, 13953, 13957, 14013, 14018, 14022, 14030, 14031, 14073, 14081, 14088, 14111, 14118, 14133.

Promoters were tested in Leaf tissue from corn hybrid plants (LH244×LH59) during V6 stage. N02(samples grown under low nitrogen conditions) are compared to N20 (sample grown in sufficient nitrogen conditions). Both sample populations are harvested at 10 am. Promoters expressing under these conditions at this stage include SEQ IDs: 14, 32, 61, 76, 99, 144, 183, 196, 211, 269, 270, 305, 306, 334, 348, 352, 365, 376, 401, 434, 485, 528, 534, 537, 608, 614, 629, 638, 674, 676, 677, 731, 753, 783, 793, 808, 819, 855, 862, 873, 898, 907, 958, 960, 975, 1007, 1008, 1010, 1052, 1069, 1087, 1091, 1116, 1171, 1178, 1189, 1201, 1203, 1218, 1286, 1322, 1323, 1345, 1354, 1355, 1360, 1431, 1439, 1448, 1484, 1490, 1499, 1543, 1546, 1552, 1575, 1609, 1610, 1615, 1635, 1662, 1669, 1671, 1677, 1681, 1749, 1750, 1759, 1807, 1808, 1863, 1876, 1906, 1930, 1931, 1933, 1934, 1936, 2000, 2023, 2027, 2060, 2062, 2103, 2114, 2133, 2142, 2150, 2161, 2167, 2179, 2202, 2203, 2227, 2237, 2242, 2321, 2322, 2323, 2352, 2353, 2354, 2397, 2443, 2505, 2543, 2544, 2560, 2616, 2620, 2659, 2663, 2729, 2749, 2770, 2843, 2860, 2878, 2894, 2903, 2948, 2950, 2966, 3008, 3013, 3045, 3050, 3072, 3076, 3101, 3120, 3123, 3181, 3253, 3264, 3266, 3299, 3322, 3337, 3340, 3361, 3402, 3425, 3427, 3435, 3441, 3507, 3538, 3551, 3591, 3592, 3594, 3673, 3674, 3707, 3710, 3725, 3731, 3738, 3739, 3772, 3773, 3805, 3858, 3867, 3870, 3881, 3885, 3887, 3895, 3908, 3917, 3926, 3941, 3995, 4008, 4013, 4037, 4040, 4044, 4099, 4111, 4143, 4149, 4157, 4166, 4167, 4168, 4173, 4187, 4189, 4198, 4201, 4211, 4219, 4221, 4247, 4251, 4260, 4286, 4296, 4339, 4344, 4369, 4371, 4373, 4422, 4423, 4467, 4549, 4554, 4565, 4599, 4605, 4623, 4669, 4671, 4673, 4676, 4685, 4691, 4696, 4715, 4719, 4723, 4725, 4728, 4775, 4804, 4813, 4830, 4831, 4879, 4881, 4918, 4936, 4947, 4960, 4981, 5005, 5011, 5026, 5067, 5074, 5082, 5102, 5119, 5123, 5140, 5144, 5159, 5165, 5219, 5225, 5240, 5241, 5243, 5253, 5283, 5287, 5301, 5308, 5311, 5339, 5371, 5414, 5446, 5458, 5515, 5536, 5547, 5559, 5572, 5608, 5619, 5655, 5657, 5712, 5713, 5858, 5881, 5912, 5921, 5931, 5941, 5942, 5967, 5968, 6003, 6006, 6031, 6041, 6085, 6090, 6125, 6221, 6314, 6315, 6343, 6344, 6364, 6392, 6398, 6452, 6464, 6476, 6480, 6486, 6493, 6501, 6505, 6523, 6525, 6558, 6598, 6626, 6639, 6724, 6733, 6779, 6780, 6811, 6816, 6819, 6824, 6850, 6925, 6939, 6959, 6960, 6980, 7005, 7009, 7019, 7020, 7042, 7043, 7094, 7124, 7169, 7170, 7171, 7212, 7214, 7248, 7255, 7257, 7262, 7291, 7308, 7317, 7353, 7357, 7373, 7388, 7389, 7392, 7433, 7434, 7436, 7443, 7444, 7446, 7454, 7458, 7537, 7586, 7633, 7704, 7736, 7738, 7754, 7767, 7780, 7786, 7791, 7796, 7798, 7800, 7833, 7838, 7840, 7860, 7909, 7933, 7976, 8006, 8007, 8042, 8045, 8059, 8080, 8087, 8099, 8145, 8146, 8211, 8213, 8236, 8241, 8253, 8274, 8296, 8300, 8306, 8411, 8413, 8429, 8436, 8513, 8524, 8532, 8533, 8611, 8657, 8665, 8699, 8700, 8706, 8756, 8789, 8831, 8833, 8846, 8869, 8907, 8913, 8928, 8974, 8980, 9002, 9003, 9016, 9060, 9069, 9084, 9115, 9118, 9129, 9140, 9146, 9234, 9243, 9247, 9291, 9308, 9310, 9329, 9348, 9349, 9389, 9396, 9398, 9404, 9406, 9453, 9536, 9546, 9560, 9563, 9565, 9608, 9620, 9637, 9649, 9718, 9751, 9754, 9761, 9770, 9780, 9784, 9798, 9816, 9833, 9845, 9869, 9909, 9918, 9956, 9957, 9967, 9996, 10000, 10018, 10049, 10058, 10060, 10080, 10081, 10098, 10101, 10106, 10169, 10206, 10220, 10224, 10240, 10311, 10335, 10342, 10374, 10384, 10398, 10410, 10413, 10416, 10427, 10447, 10488, 10494, 10515, 10542, 10544, 10581, 10595, 10596, 10597, 10616, 10623, 10664, 10747, 10750, 10791, 10813, 10825, 10833, 10838, 10894, 10898, 10903, 10912, 10977, 11021, 11027, 11053, 11058, 11072, 11095, 11109, 11125, 11151, 11168, 11190, 11214, 11255, 11261, 11263, 11275, 11371, 11377, 11391, 11395, 11398, 11401, 11404, 11411, 11412, 11413, 11414, 11428, 11482, 11500, 11503, 11522, 11527, 11534, 11538, 11546, 11548, 11550, 11551, 11568, 11576, 11577, 11578, 11610, 11615, 11623, 11642, 11655, 11678, 11710, 11720, 11731, 11743, 11761, 11762, 11786, 11830, 11841, 11877, 11926, 11927, 11959, 11960, 11961, 12032, 12059, 12068, 12085, 12094, 12106, 12150, 12161, 12202, 12208, 12214, 12259, 12287, 12310, 12323, 12333, 12359, 12414, 12447, 12457, 12459, 12468, 12483, 12525, 12531, 12563, 12568, 12611, 12634, 12651, 12684, 12728, 12754, 12765, 12771, 12818, 12820, 12824, 12835, 12882, 12908, 12913, 12972, 13030, 13034, 13041, 13075, 13105, 13148, 13149, 13156, 13228, 13229, 13231, 13236, 13237, 13248, 13329, 13340, 13349, 13352, 13353, 13363, 13369, 13401, 13414, 13429, 13446, 13448, 13451, 13457, 13460, 13503, 13518, 13535, 13536, 13543, 13552, 13561, 13572, 13587, 13596, 13598, 13601, 13606, 13607, 13631, 13638, 13641, 13677, 13679, 13688, 13716, 13720, 13730, 13753, 13777, 13780, 13798, 13816, 13817, 13828, 13858, 13875, 13911, 13917, 13919, 13938, 13944, 13948, 13960, 13970, 13984, 14002, 14013, 14017, 14073, 14086, 14088, 14094, 14144, 14145.

Promoters were tested in Leaf tissue from corn hybrid plants (LH244×LH59) during V6 stage. N02(samples grown under low nitrogen conditions) are compared to N20 (sample grown in sufficient nitrogen conditions). Both sample populations are harvested at 11 pm. Promoters expressing under these conditions at this stage include SEQ IDs: 13, 14, 76, 99, 108, 131, 183, 232, 305, 306, 328, 334, 338, 342, 348, 381, 431, 432, 434, 485, 528, 538, 571, 614, 620, 622, 630, 671, 740, 757, 783, 809, 873, 898, 907, 925, 974, 975, 981, 989, 991, 1007, 1009, 1069, 1073, 1091, 1106, 1112, 1114, 1171, 1203, 1233, 1236, 1345, 1360, 1389, 1407, 1416, 1441, 1448, 1458, 1499, 1549, 1552, 1568, 1575, 1599, 1630, 1671, 1691, 1707, 1759, 1876, 1888, 1906, 1912, 1936, 1970, 1971, 1991, 2000, 2023, 2060, 2111, 2114, 2143, 2240, 2242, 2310, 2321, 2352, 2354, 2507, 2517, 2543, 2549, 2560, 2587, 2617, 2620, 2659, 2663, 2749, 2770, 2786, 2923, 2960, 3013, 3027, 3042, 3045, 3071, 3076, 3083, 3107, 3126, 3177, 3230, 3231, 3235, 3247, 3286, 3288, 3301, 3322, 3324, 3386, 3399, 3402, 3435, 3446, 3458, 3460, 3468, 3503, 3504, 3506, 3524, 3551, 3558, 3615, 3677, 3707, 3731, 3738, 3739, 3790, 3837, 3885, 3889, 3908, 3941, 3975, 4007, 4008, 4030, 4033, 4040, 4088, 4099, 4109, 4111, 4146, 4149, 4167, 4168, 4176, 4198, 4201, 4204, 4221, 4247, 4251, 4301, 4324, 4329, 4330, 4360, 4378, 4492, 4549, 4551, 4556, 4565, 4568, 4593, 4597, 4598, 4623, 4677, 4680, 4691, 4692, 4715, 4725, 4728, 4867, 4870, 4878, 4912, 4918, 4920, 4947, 4954, 4981, 5037, 5044, 5072, 5094, 5097, 5098, 5108, 5123, 5131, 5144, 5157, 5168, 5225, 5240, 5283, 5299, 5300, 5301, 5308, 5366, 5367, 5416, 5458, 5469, 5475, 5510, 5520, 5521, 5597, 5619, 5648, 5655, 5657, 5695, 5711, 5712, 5713, 5858, 5881, 5893, 5912, 5933, 5947, 6006, 6038, 6041, 6144, 6308, 6315, 6321, 6365, 6379, 6398, 6420, 6425, 6444, 6476, 6501, 6517, 6523, 6525, 6583, 6598, 6610, 6686, 6734, 6739, 6753, 6820, 6939, 6959, 7019, 7020, 7086, 7094, 7149, 7176, 7214, 7244, 7245, 7308, 7317, 7336, 7373, 7395, 7399, 7425, 7433, 7443, 7444, 7634, 7689, 7780, 7786, 7791, 7838, 7840, 7860, 7896, 7908, 7933, 7951, 7976, 8080, 8099, 8185, 8204, 8236, 8240, 8241, 8269, 8296, 8297, 8351, 8373, 8393, 8428, 8436, 8444, 8448, 8478, 8513, 8532, 8612, 8618, 8665, 8740, 8741, 8789, 8869, 8899, 8949, 8951, 8999, 9018, 9022, 9069, 9097, 9112, 9119, 9310, 9333, 9349, 9376, 9385, 9453, 9490, 9497, 9540, 9546, 9560, 9563, 9564, 9586, 9608, 9620, 9641, 9642, 9644, 9645, 9659, 9682, 9718, 9756, 9761, 9780, 9784, 9798, 9909, 9911, 9921, 9967, 10018, 10049, 10060, 10080, 10081, 10098, 10110, 10174, 10204, 10206, 10284, 10335, 10342, 10360, 10416, 10466, 10518, 10528, 10542, 10595, 10596, 10601, 10674, 10700, 10708, 10747, 10791, 10818, 10826, 10838, 10843, 10894, 10903, 10947, 11021, 11095, 11114, 11151, 11185, 11261, 11263, 11266, 11282, 11306, 11307, 11346, 11360, 11371, 11398, 11404, 11405, 11437, 11443, 11500, 11503, 11524, 11538, 11576, 11578, 11608, 11615, 11619, 11703, 11720, 11763, 11774, 11818, 11830, 11935, 11945, 11946, 11950, 12059, 12094, 12098, 12161, 12164, 12165, 12191, 12194, 12202, 12208, 12214, 12217, 12256, 12317, 12321, 12325, 12402, 12403, 12410, 12456, 12457, 12459, 12483, 12551, 12552, 12641, 12681, 12688, 12695, 12764, 12765, 12826, 12835, 12866, 12882, 12913, 12921, 12972, 13030, 13032, 13034, 13036, 13075, 13117, 13118, 13148, 13149, 13152, 13156, 13164, 13228, 13229, 13231, 13234, 13255, 13281, 13349, 13353, 13397, 13401, 13414, 13419, 13429, 13446, 13448, 13521, 13526, 13535, 13536, 13543, 13561, 13572, 13601, 13660, 13677, 13688, 13700, 13779, 13795, 13828, 13858, 13917, 13919, 13942, 13948, 13957, 13960, 13970, 14000, 14002, 14010, 14073, 14144.

Promoters were tested in Leaf tissue from corn hybrid plants (LH244×LH59) during V6 stage. N02(samples grown under low nitrogen conditions) are compared to N20 (sample grown in sufficient nitrogen conditions). Both sample populations are harvested at 10 am on the following day of treatment (24 hrs low Nitrogen vs. sufficient nitrogen). Promoters expressing under these conditions at this stage include SEQ IDs: 14, 32, 34, 61, 65, 76, 183, 196, 207, 211, 250, 269, 270, 305, 306, 328, 348, 376, 381, 401, 431, 485, 514, 520, 528, 534, 537, 548, 614, 638, 671, 740, 744, 753, 757, 793, 806, 809, 819, 873, 898, 907, 960, 974, 975, 989, 1002, 1007, 1009, 1014, 1016, 1069, 1087, 1091, 1095, 1116, 1178, 1189, 1201, 1203, 1217, 1218, 1233, 1286, 1305, 1309, 1327, 1345, 1354, 1355, 1360, 1407, 1432, 1439, 1444, 1484, 1499, 1546, 1547, 1552, 1575, 1609, 1610, 1659, 1662, 1664, 1671, 1677, 1710, 1749, 1750, 1759, 1807, 1808, 1876, 1891, 1910, 1912, 1918, 1936, 2027, 2032, 2060, 2111, 2114, 2193, 2202, 2203, 2227, 2237, 2242, 2298, 2331, 2352, 2354, 2384, 2397, 2405, 2443, 2500, 2505, 2543, 2549, 2560, 2620, 2625, 2659, 2663, 2722, 2756, 2770, 2800, 2826, 2843, 2878, 2889, 2894, 2896, 2908, 2923, 2947, 2948, 2950, 2955, 2960, 3007, 3008, 3013, 3039, 3041, 3045, 3069, 3076, 3230, 3231, 3235, 3264, 3301, 3304, 3324, 3333, 3337, 3339, 3340, 3361, 3386, 3425, 3427, 3435, 3503, 3504, 3506, 3538, 3545, 3550, 3551, 3556, 3568, 3591, 3592, 3594, 3600, 3613, 3661, 3663, 3673, 3674, 3677, 3698, 3707, 3710, 3720, 3738, 3739, 3831, 3858, 3881, 3885, 3889, 3902, 3926, 3928, 3941, 4008, 4013, 4030, 4033, 4040, 4088, 4110, 4111, 4139, 4149, 4166, 4167, 4168, 4175, 4190, 4198, 4246, 4247, 4251, 4276, 4296, 4329, 4330, 4344, 4371, 4373, 4422, 4443, 4467, 4492, 4498, 4513, 4549, 4565, 4568, 4594, 4599, 4605, 4623, 4636, 4664, 4669, 4671, 4680, 4691, 4696, 4719, 4722, 4725, 4728, 4736, 4749, 4750, 4775, 4784, 4804, 4813, 4854, 4867, 4877, 4878, 4879, 4881, 4918, 4936, 4947, 4984, 5011, 5037, 5044, 5049, 5067, 5072, 5075, 5097, 5098, 5123, 5144, 5157, 5159, 5165, 5225, 5230, 5240, 5243, 5253, 5260, 5282, 5283, 5308, 5311, 5366, 5367, 5379, 5416, 5419, 5432, 5459, 5475, 5481, 5559, 5572, 5608, 5615, 5619, 5648, 5655, 5657, 5677, 5681, 5695, 5712, 5713, 5718, 5734, 5819, 5878, 5881, 5912, 5931, 5968, 6003, 6006, 6031, 6044, 6068, 6096, 6125, 6148, 6163, 6182, 6206, 6221, 6227, 6250, 6270, 6308, 6343, 6344, 6364, 6392, 6398, 6420, 6422, 6444, 6448, 6464, 6476, 6480, 6501, 6504, 6523, 6525, 6598, 6626, 6662, 6718, 6734, 6779, 6780, 6807, 6811, 6816, 6820, 6850, 6914, 6946, 6959, 6980, 6981, 7019, 7020, 7025, 7042, 7043, 7144, 7149, 7170, 7212, 7214, 7257, 7275, 7281, 7287, 7291, 7308, 7317, 7388, 7389, 7392, 7425, 7433, 7434, 7436, 7443, 7444, 7452, 7454, 7537, 7547, 7556, 7594, 7598, 7611, 7638, 7736, 7754, 7767, 7768, 7786, 7791, 7796, 7798, 7838, 7840, 7876, 7896, 7909, 7933, 7949, 7951, 7993, 8006, 8007, 8042, 8059, 8080, 8099, 8145, 8146, 8236, 8272, 8296, 8297, 8343, 8351, 8361, 8373, 8389, 8393, 8428, 8433, 8436, 8444, 8478, 8504, 8531, 8557, 8612, 8665, 8699, 8700, 8706, 8789, 8831, 8833, 8834, 8891, 8928, 8967, 9002, 9016, 9021, 9038, 9069, 9074, 9102, 9112, 9115, 9146, 9152, 9172, 9188, 9234, 9247, 9269, 9310, 9348, 9349, 9378, 9382, 9389, 9396, 9398, 9403, 9404, 9406, 9453, 9513, 9536, 9546, 9560, 9563, 9564, 9571, 9574, 9608, 9620, 9659, 9698, 9718, 9726, 9733, 9746, 9756, 9761, 9776, 9780, 9784, 9798, 9816, 9833, 9838, 9845, 9873, 9918, 9921, 9940, 9957, 9984, 9990, 9992, 9996, 10000, 10007, 10018, 10080, 10081, 10098, 10106, 10110, 10151, 10169, 10174, 10179, 10182, 10207, 10224, 10240, 10311, 10326, 10342, 10345, 10374, 10375, 10392, 10413, 10427, 10488, 10492, 10494, 10496, 10501, 10518, 10537, 10542, 10585, 10595, 10596, 10664, 10674, 10750, 10791, 10792, 10813, 10818, 10825, 10838, 10869, 10894, 10898, 10912, 10965, 10977, 11021, 11058, 11072, 11095, 11098, 11117, 11119, 11127, 11128, 11151, 11226, 11259, 11261, 11263, 11266, 11291, 11307, 11323, 11325, 11328, 11346, 11360, 11371, 11377, 11404, 11437, 11500, 11503, 11538, 11548, 11550, 11576, 11577, 11578, 11608, 11642, 11658, 11703, 11720, 11744, 11753, 11774, 11812, 11816, 11818, 11830, 11837, 11928, 11929, 11930, 11950, 11988, 12025, 12032, 12092, 12094, 12150, 12151, 12164, 12167, 12185, 12192, 12194, 12202, 12208, 12214, 12223, 12249, 12256, 12259, 12305, 12317, 12321, 12325, 12402, 12405, 12414, 12447, 12454, 12456, 12457, 12468, 12483, 12500, 12525, 12531, 12547, 12567, 12568, 12634, 12680, 12682, 12688, 12695, 12708, 12761, 12764, 12789, 12818, 12824, 12835, 12882, 12906, 12921, 12946, 13024, 13034, 13075, 13117, 13148, 13149, 13156, 13228, 13229, 13231, 13255, 13259, 13298, 13346, 13349, 13353, 13414, 13419, 13424, 13448, 13451, 13457, 13501, 13503, 13521, 13526, 13535, 13536, 13561, 13572, 13601, 13636, 13641, 13677, 13688, 13699, 13730, 13742, 13750, 13777, 13779, 13780, 13795, 13812, 13813, 13823, 13828, 13835, 13875, 13911, 13917, 13919, 13923, 13944, 13948, 13984, 14002, 14007, 14013, 14017, 14052, 14073, 14086, 14144.

Promoters were tested in Leaf tissue from corn hybrid plants (LH244×LH59) during V6 stage. N02(samples grown under low nitrogen conditions) are compared to N20 (sample grown in sufficient nitrogen conditions). Promoters expressing under these conditions at this stage include SEQ IDs: 12, 14, 32, 34, 76, 103, 131, 154, 194, 202, 211, 239, 240, 249, 269, 270, 305, 306, 337, 348, 352, 357, 381, 471, 514, 528, 638, 671, 732, 740, 753, 760, 761, 762, 765, 819, 862, 898, 951, 971, 975, 979, 987, 989, 1011, 1041, 1043, 1069, 1073, 1095, 1116, 1168, 1176, 1178, 1189, 1201, 1203, 1217, 1218, 1225, 1231, 1239, 1286, 1293, 1345, 1347, 1354, 1355, 1415, 1423, 1432, 1439, 1444, 1447, 1467, 1484, 1498, 1508, 1510, 1511, 1539, 1543, 1552, 1554, 1590, 1602, 1617, 1662, 1671, 1677, 1707, 1708, 1725, 1732, 1759, 1807, 1834, 1856, 1876, 1891, 1912, 1923, 1936, 2000, 2060, 2062, 2066, 2094, 2097, 2103, 2111, 2190, 2227, 2242, 2280, 2300, 2322, 2323, 2328, 2352, 2384, 2457, 2458, 2465, 2489, 2500, 2532, 2560, 2567, 2581, 2616, 2620, 2653, 2659, 2663, 2680, 2725, 2728, 2749, 2756, 2770, 2802, 2860, 2878, 2894, 2903, 2926, 2931, 2945, 2950, 2955, 2960, 3008, 3013, 3024, 3045, 3047, 3076, 3101, 3167, 3171, 3177, 3181, 3230, 3235, 3247, 3299, 3307, 3310, 3322, 3337, 3361, 3377, 3402, 3435, 3441, 3451, 3458, 3462, 3470, 3516, 3538, 3545, 3551, 3556, 3592, 3594, 3604, 3612, 3613, 3661, 3673, 3674, 3682, 3698, 3702, 3710, 3713, 3720, 3731, 3733, 3738, 3739, 3757, 3806, 3812, 3820, 3837, 3866, 3871, 3881, 3892, 3894, 3895, 3908, 3917, 3926, 3940, 3941, 3968, 4013, 4037, 4040, 4062, 4068, 4110, 4131, 4143, 4149, 4166, 4190, 4198, 4201, 4204, 4208, 4221, 4227, 4228, 4247, 4251, 4272, 4276, 4296, 4298, 4300, 4324, 4370, 4371, 4373, 4378, 4422, 4430, 4467, 4470, 4475, 4549, 4565, 4594, 4599, 4616, 4666, 4669, 4670, 4671, 4677, 4682, 4696, 4719, 4725, 4728, 4740, 4750, 4804, 4813, 4854, 4867, 4878, 4918, 4936, 4947, 4984, 5011, 5016, 5072, 5075, 5082, 5091, 5097, 5098, 5102, 5123, 5140, 5144, 5150, 5154, 5157, 5159, 5164, 5165, 5202, 5216, 5219, 5225, 5240, 5253, 5282, 5291, 5311, 5328, 5334, 5339, 5346, 5351, 5366, 5367, 5371, 5396, 5432, 5475, 5482, 5515, 5520, 5521, 5526, 5608, 5632, 5651, 5655, 5657, 5670, 5671, 5711, 5712, 5713, 5768, 5783, 5819, 5858, 5881, 5883, 5901, 5912, 5921, 5931, 5941, 5942, 5984, 6003, 6006, 6016, 6020, 6041, 6073, 6093, 6095, 6132, 6143, 6160, 6221, 6228, 6250, 6288, 6315, 6343, 6344, 6358, 6360, 6414, 6464, 6476, 6480, 6505, 6506, 6510, 6523, 6525, 6534, 6558, 6577, 6598, 6609, 6639, 6655, 6662, 6779, 6780, 6786, 6812, 6816, 6850, 6876, 6943, 6959, 6981, 7019, 7020, 7042, 7043, 7050, 7094, 7113, 7124, 7155, 7169, 7171, 7176, 7209, 7212, 7214, 7248, 7262, 7275, 7292, 7308, 7317, 7328, 7330, 7353, 7373, 7377, 7389, 7392, 7411, 7415, 7417, 7428, 7434, 7436, 7443, 7444, 7446, 7454, 7458, 7523, 7533, 7537, 7544, 7547, 7633, 7665, 7704, 7712, 7737, 7740, 7754, 7780, 7786, 7791, 7800, 7807, 7838, 7848, 7933, 7951, 7972, 8002, 8006, 8042, 8059, 8072, 8080, 8087, 8099, 8147, 8148, 8185, 8211, 8236, 8241, 8270, 8272, 8293, 8296, 8304, 8306, 8343, 8351, 8361, 8413, 8416, 8470, 8478, 8539, 8549, 8550, 8590, 8618, 8624, 8647, 8657, 8699, 8700, 8706, 8713, 8722, 8776, 8797, 8833, 8834, 8876, 8878, 8899, 8907, 8941, 8951, 8974, 8976, 8980, 9004, 9016, 9060, 9069, 9074, 9076, 9084, 9131, 9247, 9269, 9282, 9292, 9295, 9308, 9310, 9329, 9337, 9339, 9382, 9388, 9389, 9396, 9398, 9404, 9406, 9453, 9536, 9546, 9553, 9564, 9565, 9591, 9617, 9637, 9718, 9744, 9745, 9761, 9763, 9770, 9780, 9784, 9798, 9845, 9909, 9918, 9957, 10000, 10018, 10026, 10049, 10058, 10060, 10064, 10066, 10080, 10081, 10092, 10098, 10101, 10106, 10132, 10135, 10151, 10217, 10219, 10224, 10252, 10255, 10258, 10284, 10286, 10307, 10311, 10325, 10326, 10341, 10374, 10398, 10410, 10421, 10447, 10453, 10455, 10466, 10492, 10537, 10542, 10544, 10563, 10580, 10581, 10582, 10595, 10596, 10597, 10623, 10648, 10664, 10678, 10700, 10705, 10768, 10791, 10792, 10804, 10809, 10813, 10833, 10838, 10864, 10894, 10903, 10912, 10927, 10947, 10965, 10977, 10999, 11021, 11053, 11072, 11078, 11095, 11098, 11117, 11128, 11151, 11163, 11190, 11214, 11227, 11234, 11255, 11263, 11275, 11360, 11377, 11399, 11404, 11428, 11443, 11478, 11500, 11503, 11524, 11526, 11527, 11538, 11546, 11560, 11561, 11607, 11642, 11658, 11680, 11710, 11720, 11731, 11743, 11744, 11762, 11774, 11837, 11841, 11877, 11927, 11935, 11946, 11948, 11962, 12002, 12015, 12016, 12032, 12043, 12063, 12085, 12094, 12102, 12106, 12109, 12135, 12164, 12166, 12167, 12214, 12223, 12259, 12278, 12280, 12293, 12305, 12310, 12403, 12411, 12414, 12420, 12427, 12447, 12457, 12468, 12470, 12521, 12525, 12535, 12536, 12537, 12539, 12546, 12568, 12611, 12628, 12651, 12684, 12714, 12721, 12728, 12765, 12766, 12771, 12789, 12820, 12828, 12835, 12850, 12882, 12913, 12929, 12934, 12972, 12978, 13030, 13034, 13054, 13075, 13085, 13117, 13122, 13156, 13228, 13229, 13231, 13235, 13236, 13237, 13248, 13298, 13329, 13340, 13349, 13352, 13363, 13369, 13394, 13401, 13410, 13414, 13429, 13446, 13448, 13451, 13457, 13475, 13492, 13501, 13503, 13543, 13561, 13572, 13574, 13582, 13596, 13601, 13606, 13607, 13631, 13638, 13647, 13677, 13679, 13699, 13730, 13736, 13742, 13777, 13809, 13812, 13813, 13828, 13849, 13852, 13858, 13911, 13917, 13919, 13921, 13942, 13944, 13947, 13948, 13969, 13970, 13984, 13988, 14002, 14010, 14017, 14088, 14116.

Promoters were tested in Corn seedlings from a cold sensitive line and placed at 12 C for 1 hr. These were compared to seedling tissue from a cold sensitive line at 12 C for 0 hrs. Promoters expressing under these conditions at this stage include SEQ IDs: 4, 1039, 1546, 1809, 1915, 1969, 3440, 3615, 3940, 3994, 4132, 4436, 4560, 4728, 5209, 5230, 5677, 5887, 6112, 7138, 7139, 7217, 7234, 7400, 7786, 7909, 7949, 8935, 10747, 11083, 11162, 11258, 11949, 13303, 13747.

Promoters were tested in Corn seedlings from a cold sensitive line and placed at 12 C for 25 hrs. These were compared to seedling tissue from a cold sensitive line at 12 C for 0 hrs. Promoters expressing under these conditions at this stage include SEQ IDs: 24, 93, 230, 244, 299, 507, 548, 613, 758, 808, 868, 1088, 1165, 1346, 1474, 1501, 1634, 1772, 1808, 1837, 1838, 2000, 2014, 2015, 2060, 2091, 2111, 2122, 2261, 2265, 2367, 2560, 2897, 2948, 3076, 3115, 3157, 3158, 3429, 3460, 3551, 3615, 3621, 3731, 3775, 3929, 3940, 4088, 4111, 4246, 4276, 4301, 4436, 4457, 4684, 4947, 4981, 4989, 4990, 5016, 5078, 5100, 5108, 5184, 5339, 5479, 5493, 5515, 5712, 5713, 5734, 5863, 5869, 6060, 6072, 6182, 6237, 6323, 6354, 6358, 6476, 6554, 6652, 6696, 6909, 7338, 7517, 7594, 7633, 7798, 7873, 7909, 7949, 8048, 8056, 8136, 8156, 8190, 8288, 8305, 8498, 8797, 8953, 9001, 9098, 9119, 9218, 9449, 9505, 9560, 9608, 9635, 9717, 9785, 9897, 9907, 9911, 9967, 9998, 10073, 10134, 10201, 10270, 10329, 10504, 10518, 10621, 10645, 10650, 10718, 10780, 10871, 11044, 11092, 11109, 11150, 11152, 11181, 11232, 11503, 11652, 11656, 11723, 12026, 12032, 12147, 12151, 12189, 12337, 12380, 12383, 12459, 12483, 12495, 12497, 12503, 12600, 12765, 12783, 12824, 12826, 12875, 13106, 13236, 13237, 13281, 13316, 13329, 13340, 13347, 13352, 13363, 13401, 13450, 13559, 13786, 13787, 13953, 14030, 14094, 14111.

Promoters were tested in Corn seedlings from a cold sensitive line and placed at 12 C for 2 hrs. These were compared to seedling tissue from a cold sensitive line at 12 C for 0 hrs. Promoters expressing under these conditions at this stage include SEQ IDs: 4, 141, 801, 975, 1039, 1189, 1398, 1546, 1915, 1969, 2202, 2203, 2242, 2725, 2822, 3289, 3440, 3615, 3940, 3994, 4132, 4436, 4560, 4728, 4801, 4918, 4967, 4977, 5159, 5209, 5230, 5493, 5559, 5677, 5869, 5887, 6031, 6112, 6515, 6609, 6689, 7138, 7139, 7195, 7217, 7234, 7248, 7307, 7400, 7443, 7444, 7633, 7786, 7909, 7949, 8190, 8835, 8935, 9854, 10066, 10161, 10747, 11072, 11083, 11133, 11135, 11162, 11181, 11258, 11395, 11411, 11412, 11413, 11414, 11619, 11740, 11949, 12221, 12337, 12848, 13037, 13388, 13747, 13761, 13961, 14084, 14094.

Promoters were tested in Corn seedlings from a cold sensitive line and placed at 12 C for 1 hr. These were compared to seedling tissue from cold sensitive line at 12 C for 0 hrs. Promoters expressing under these conditions at this stage include SEQ IDs: 262, 376, 538, 763, 982, 1010, 1144, 1356, 1432, 1546, 1761, 1876, 1915, 1991, 2202, 2203, 2614, 2684, 2692, 2814, 2826, 2892, 3033, 3217, 3231, 3252, 3382, 3432, 3529, 3548, 3615, 3702, 3790, 3924, 3972, 4132, 4165, 4317, 4390, 4467, 4560, 4646, 4705, 4728, 4767, 4801, 4815, 4891, 4955, 4967, 5109, 5113, 5125, 5159, 5209, 5253, 5285, 5562, 5569, 5649, 5650, 5714, 5717, 5792, 5842, 5918, 5994, 6060, 6112, 6203, 6213, 6294, 6463, 6497, 6502, 6514, 6515, 6572, 6648, 6706, 7138, 7139, 7252, 7270, 7282, 7333, 7786, 7791, 7977, 7992, 8417, 8418, 9525, 9567, 9608, 9750, 10037, 10158, 10214, 10335, 10342, 10804, 10881, 11023, 11083, 11132, 11133, 11135, 11307, 11330, 11331, 11406, 11740, 11773, 11838, 11949, 11980, 11997, 12114, 12292, 12305, 12337, 12401, 12417, 12497, 12731, 12732, 12750, 12826, 12848, 13037, 13413, 13424, 13685, 13747, 13963, 14130.

Promoters were tested in Corn seedlings from a cold sensitive line and placed at 12 C for 1 hr. These were compared to seedling tissue from cold sensitive line at 12 C for 0 hrs. Promoters expressing under these conditions at this stage include SEQ IDs: 160, 376, 383, 514, 655, 763, 982, 1010, 1013, 1056, 1144, 1356, 1432, 1729, 1761, 1915, 1948, 1991, 2202, 2203, 2210, 2526, 2614, 2684, 2692, 2814, 2822, 2892, 3033, 3217, 3231, 3252, 3286, 3288, 3382, 3389, 3390, 3432, 3529, 3548, 3615, 3790, 3924, 3972, 4132, 4165, 4390, 4524, 4705, 4728, 4767, 4801, 4815, 4899, 4900, 4955, 4975, 5090, 5109, 5113, 5125, 5159, 5209, 5253, 5547, 5562, 5569, 5649, 5650, 5714, 5842, 5869, 5918, 5994, 6038, 6112, 6203, 6213, 6294, 6434, 6463, 6497, 6515, 6572, 6648, 6706, 6860, 6913, 7032, 7184, 7203, 7270, 7282, 7333, 7747, 7786, 7791, 7798, 7866, 7867, 7992, 8045, 8066, 8118, 8222, 8378, 8417, 8418, 8862, 8959, 9017, 9033, 9525, 9608, 9750, 9809, 9888, 10158, 10161, 10214, 10342, 10706, 10881, 11023, 11027, 11083, 11132, 11181, 11202, 11307, 11395, 11406, 11438, 11553, 11579, 11740, 11773, 11893, 11896, 11949, 11980, 12114, 12292, 12417, 12731, 12732, 12826, 12849, 13015, 13037, 13344, 13734, 13747, 13848, 13963, 14069, 14070, 14072.

Promoters were tested in Corn seedlings from a cold sensitive line and placed at 12 C for 25 hrs. These were compared to seedling tissue from cold sensitive line at 12 C for 0 hrs. Promoters expressing under these conditions at this stage include SEQ IDs: 11, 27, 48, 54, 64, 88, 108, 117, 130, 148, 183, 196, 207, 211, 232, 236, 301, 302, 309, 328, 329, 332, 352, 360, 365, 376, 388, 461, 478, 501, 523, 594, 595, 596, 608, 635, 637, 670, 731, 757, 763, 783, 804, 806, 819, 830, 833, 852, 893, 907, 924, 925, 974, 979, 987, 1002, 1038, 1039, 1049, 1089, 1114, 1115, 1116, 1130, 1144, 1171, 1187, 1218, 1220, 1230, 1236, 1309, 1327, 1331, 1349, 1387, 1439, 1441, 1475, 1488, 1490, 1534, 1549, 1555, 1567, 1570, 1575, 1596, 1599, 1609, 1676, 1677, 1690, 1691, 1710, 1717, 1732, 1735, 1755, 1761, 1772, 1786, 1791, 1792, 1808, 1861, 1867, 1910, 1911, 1915, 1918, 1922, 1936, 1991, 2000, 2012, 2032, 2060, 2074, 2103, 2123, 2139, 2140, 2147, 2153, 2205, 2233, 2243, 2253, 2257, 2274, 2298, 2309, 2333, 2353, 2354, 2363, 2419, 2421, 2443, 2509, 2536, 2537, 2540, 2544, 2590, 2600, 2614, 2625, 2649, 2652, 2674, 2720, 2747, 2749, 2775, 2798, 2814, 2822, 2824, 2826, 2850, 2919, 2931, 2937, 2948, 2955, 2960, 2963, 2966, 3039, 3064, 3085, 3115, 3122, 3199, 3205, 3217, 3240, 3271, 3272, 3286, 3288, 3295, 3296, 3308, 3335, 3353, 3374, 3403, 3419, 3425, 3440, 3460, 3466, 3474, 3544, 3546, 3549, 3551, 3569, 3571, 3587, 3603, 3615, 3619, 3642, 3645, 3655, 3661, 3684, 3685, 3693, 3738, 3739, 3748, 3752, 3775, 3790, 3818, 3823, 3867, 3870, 3872, 3887, 3889, 3893, 3917, 3918, 3924, 3933, 3935, 3940, 3995, 4019, 4020, 4030, 4053, 4066, 4071, 4088, 4102, 4105, 4128, 4132, 4133, 4149, 4163, 4175, 4234, 4245, 4246, 4251, 4270, 4301, 4320, 4324, 4358, 4371, 4373, 4404, 4467, 4475, 4492, 4494, 4513, 4549, 4551, 4580, 4594, 4598, 4623, 4632, 4643, 4647, 4692, 4708, 4711, 4723, 4749, 4813, 4848, 4862, 4863, 4881, 4896, 4920, 4921, 4936, 4955, 5014, 5016, 5059, 5078, 5100, 5123, 5125, 5131, 5159, 5168, 5184, 5189, 5200, 5219, 5225, 5240, 5267, 5273, 5301, 5308, 5321, 5330, 5334, 5386, 5409, 5414, 5433, 5434, 5458, 5487, 5491, 5493, 5529, 5543, 5562, 5563, 5569, 5582, 5597, 5619, 5633, 5660, 5677, 5689, 5694, 5734, 5744, 5751, 5863, 5876, 5881, 5906, 5948, 5971, 6038, 6060, 6068, 6119, 6125, 6130, 6143, 6219, 6223, 6228, 6237, 6240, 6264, 6275, 6294, 6299, 6309, 6321, 6353, 6354, 6362, 6364, 6372, 6403, 6502, 6504, 6515, 6516, 6646, 6647, 6652, 6671, 6686, 6706, 6734, 6766, 6779, 6780, 6793, 6819, 6827, 6914, 6946, 6980, 6984, 6994, 7043, 7045, 7052, 7056, 7077, 7118, 7135, 7184, 7188, 7231, 7257, 7269, 7282, 7287, 7304, 7357, 7408, 7424, 7486, 7529, 7549, 7617, 7642, 7661, 7674, 7725, 7736, 7775, 7786, 7791, 7798, 7804, 7818, 7832, 7909, 7949, 7964, 7988, 8059, 8078, 8145, 8146, 8159, 8236, 8237, 8269, 8310, 8319, 8350, 8402, 8410, 8417, 8418, 8473, 8480, 8513, 8524, 8557, 8700, 8717, 8720, 8727, 8789, 8797, 8822, 8829, 8833, 8846, 8878, 8896, 8942, 8949, 8998, 9001, 9020, 9033, 9058, 9072, 9092, 9096, 9119, 9216, 9252, 9253, 9316, 9323, 9328, 9329, 9336, 9347, 9403, 9414, 9440, 9449, 9515, 9579, 9606, 9608, 9630, 9638, 9646, 9663, 9679, 9693, 9717, 9734, 9756, 9762, 9763, 9780, 9816, 9827, 9830, 9849, 9873, 9893, 9897, 9902, 9907, 9908, 9921, 9924, 9960, 9969, 9972, 10045, 10058, 10078, 10082, 10089, 10142, 10152, 10158, 10162, 10168, 10182, 10199, 10214, 10224, 10253, 10291, 10300, 10302, 10307, 10342, 10364, 10375, 10385, 10398, 10409, 10416, 10438, 10440, 10482, 10488, 10494, 10496, 10504, 10513, 10518, 10530, 10544, 10645, 10646, 10668, 10682, 10683, 10684, 10685, 10705, 10715, 10718, 10722, 10732, 10744, 10745, 10747, 10748, 10749, 10766, 10790, 10831, 10850, 10860, 10888, 10889, 10892, 10898, 10902, 10926, 10936, 10964, 10967, 10988, 11018, 11078, 11107, 11109, 11114, 11133, 11166, 11178, 11191, 11192, 11222, 11246, 11253, 11266, 11275, 11293, 11307, 11356, 11364, 11374, 11388, 11395, 11438, 11463, 11497, 11500, 11507, 11508, 11530, 11533, 11550, 11551, 11558, 11576, 11583, 11608, 11610, 11618, 11652, 11656, 11658, 11694, 11721, 11733, 11736, 11753, 11770, 11780, 11785, 11816, 11830, 11860, 11863, 11868, 11909, 11919, 11998, 12025, 12032, 12043, 12151, 12192, 12194, 12202, 12256, 12284, 12419, 12420, 12450, 12454, 12470, 12481, 12488, 12489, 12495, 12497, 12499, 12503, 12608, 12609, 12626, 12634, 12639, 12644, 12654, 12693, 12695, 12708, 12713, 12731, 12732, 12755, 12761, 12824, 12826, 12838, 12839, 12849, 12870, 12898, 12900, 12923, 12932, 12946, 12967, 12993, 13003, 13008, 13033, 13037, 13054, 13055, 13062, 13071, 13085, 13124, 13155, 13206, 13212, 13217, 13255, 13259, 13269, 13281, 13301, 13303, 13312, 13332, 13343, 13346, 13348, 13358, 13387, 13419, 13424, 13499, 13513, 13514, 13519, 13521, 13535, 13536, 13539, 13546, 13547, 13555, 13600, 13628, 13636, 13641, 13660, 13662, 13697, 13698, 13729, 13750, 13783, 13822, 13823, 13830, 13835, 13887, 13911, 13917, 13929, 13948, 13957, 13961, 13963, 13970, 14013, 14052, 14066, 14073, 14081, 14084, 14086, 14094, 14116, 14122, 14133.

Promoters were tested in Corn seedlings from a cold sensitive line and placed at 12 C for 25 hrs. These were compared to seedling tissue from a cold sensitive line at 12 C for 0 hrs. Promoters expressing under these conditions at this stage include SEQ IDs: 11, 13, 27, 54, 64, 108, 147, 148, 207, 235, 236, 309, 329, 332, 352, 360, 365, 388, 461, 478, 485, 501, 514, 523, 536, 544, 548, 594, 595, 596, 635, 669, 731, 757, 763, 819, 830, 915, 924, 974, 979, 987, 1035, 1038, 1039, 1073, 1091, 1115, 1132, 1144, 1155, 1171, 1190, 1214, 1305, 1309, 1331, 1346, 1349, 1438, 1439, 1475, 1490, 1534, 1568, 1575, 1584, 1609, 1634, 1677, 1710, 1717, 1732, 1735, 1755, 1761, 1786, 1792, 1869, 1910, 1915, 1922, 1924, 1991, 2000, 2001, 2010, 2060, 2074, 2139, 2142, 2167, 2201, 2205, 2354, 2384, 2413, 2443, 2480, 2544, 2590, 2614, 2652, 2692, 2720, 2739, 2747, 2770, 2775, 2798, 2805, 2822, 2826, 2850, 2888, 2919, 2931, 2942, 2948, 2955, 2960, 2963, 3039, 3042, 3043, 3085, 3199, 3217, 3240, 3272, 3286, 3288, 3289, 3295, 3296, 3327, 3353, 3374, 3425, 3427, 3440, 3460, 3523, 3549, 3551, 3569, 3592, 3611, 3615, 3619, 3645, 3655, 3660, 3661, 3684, 3685, 3713, 3738, 3739, 3775, 3867, 3870, 3917, 3918, 3995, 4007, 4053, 4071, 4088, 4092, 4102, 4128, 4132, 4163, 4165, 4175, 4245, 4246, 4294, 4301, 4358, 4371, 4373, 4430, 4475, 4498, 4513, 4549, 4551, 4580, 4594, 4623, 4632, 4643, 4644, 4650, 4684, 4692, 4723, 4794, 4833, 4863, 4880, 4881, 4920, 4921, 4936, 4954, 4955, 4999, 5078, 5100, 5123, 5125, 5159, 5168, 5184, 5189, 5209, 5219, 5240, 5264, 5301, 5315, 5321, 5330, 5334, 5339, 5386, 5396, 5409, 5414, 5434, 5458, 5475, 5479, 5493, 5529, 5543, 5559, 5562, 5597, 5677, 5734, 5744, 5751, 5775, 5808, 5863, 5869, 5906, 5925, 5947, 5956, 6038, 6048, 6060, 6112, 6125, 6146, 6164, 6228, 6260, 6275, 6309, 6321, 6325, 6354, 6362, 6364, 6375, 6403, 6413, 6422, 6492, 6513, 6515, 6587, 6605, 6646, 6647, 6652, 6706, 6766, 6780, 6819, 6827, 6872, 6874, 6913, 6914, 6959, 7043, 7045, 7056, 7126, 7129, 7130, 7183, 7188, 7215, 7357, 7380, 7549, 7586, 7609, 7642, 7689, 7736, 7786, 7791, 7798, 7804, 7841, 7845, 7909, 7949, 7964, 7971, 8059, 8078, 8145, 8146, 8159, 8222, 8237, 8310, 8372, 8402, 8410, 8447, 8473, 8474, 8476, 8480, 8496, 8513, 8524, 8658, 8699, 8700, 8720, 8773, 8797, 8822, 8833, 8862, 8880, 8926, 8942, 9001, 9012, 9017, 9033, 9058, 9092, 9096, 9108, 9114, 9119, 9125, 9252, 9253, 9329, 9336, 9347, 9403, 9419, 9453, 9488, 9513, 9515, 9590, 9608, 9620, 9679, 9693, 9717, 9756, 9763, 9780, 9804, 9816, 9849, 9854, 9873, 9882, 9886, 9888, 9897, 9907, 9921, 10000, 10045, 10054, 10063, 10072, 10078, 10082, 10089, 10109, 10128, 10135, 10158, 10163, 10168, 10224, 10257, 10286, 10300, 10342, 10364, 10375, 10384, 10385, 10402, 10409, 10451, 10488, 10494, 10496, 10504, 10518, 10544, 10645, 10646, 10668, 10682, 10683, 10684, 10685, 10705, 10715, 10718, 10732, 10747, 10753, 10790, 10813, 10874, 10888, 10889, 10892, 10898, 10936, 10960, 10975, 10988, 11002, 11008, 11018, 11078, 11082, 11109, 11123, 11152, 11187, 11188, 11191, 11254, 11255, 11266, 11275, 11293, 11295, 11307, 11356, 11371, 11388, 11395, 11430, 11438, 11463, 11496, 11503, 11507, 11518, 11530, 11533, 11550, 11551, 11553, 11608, 11652, 11656, 11694, 11723, 11740, 11748, 11759, 11780, 11781, 11783, 11830, 11853, 11909, 11919, 11945, 11947, 12025, 12032, 12043, 12083, 12118, 12147, 12151, 12192, 12194, 12202, 12204, 12337, 12383, 12410, 12420, 12437, 12450, 12454, 12459, 12470, 12488, 12495, 12499, 12503, 12518, 12589, 12605, 12634, 12639, 12693, 12735, 12761, 12824, 12826, 12838, 12839, 12849, 12870, 12875, 12898, 12904, 12905, 12912, 12932, 12967, 13030, 13037, 13054, 13055, 13085, 13155, 13158, 13212, 13269, 13281, 13316, 13329, 13332, 13340, 13343, 13347, 13351, 13355, 13363, 13387, 13424, 13460, 13503, 13519, 13535, 13536, 13547, 13552, 13555, 13575, 13579, 13606, 13632, 13636, 13641, 13662, 13697, 13700, 13719, 13750, 13822, 13828, 13835, 13888, 13917, 13929, 13938, 13948, 13957, 13961, 13999, 14086, 14094, 14122, 14133.

Promoters were tested in Corn seedlings from a cold sensitive line and placed at 12 C for 2 hrs. These were compared to seedling tissue from a cold sensitive line at 12 C for 0 hrs. Promoters expressing under these conditions and at this stage include SEQ IDs: 376, 461, 514, 538, 655, 763, 871, 982, 987, 1039, 1144, 1356, 1398, 1546, 1761, 1876, 1915, 1991, 2060, 2202, 2203, 2233, 2449, 2578, 2614, 2649, 2692, 2814, 2822, 2826, 2861, 2892, 3217, 3231, 3276, 3286, 3288, 3289, 3382, 3529, 3548, 3615, 3702, 3790, 3801, 3924, 3940, 3972, 3984, 4053, 4092, 4132, 4165, 4169, 4371, 4373, 4390, 4467, 4524, 4560, 4646, 4728, 4767, 4801, 4848, 4891, 4920, 4955, 4975, 4986, 5059, 5125, 5159, 5209, 5230, 5253, 5285, 5301, 5414, 5469, 5481, 5493, 5495, 5515, 5517, 5562, 5569, 5649, 5650, 5714, 5842, 5918, 5968, 5994, 6031, 6038, 6060, 6112, 6203, 6260, 6294, 6463, 6497, 6514, 6515, 6572, 6605, 6648, 6706, 7039, 7221, 7252, 7270, 7282, 7400, 7786, 7791, 7798, 7876, 7949, 7977, 7992, 8002, 8035, 8216, 8222, 8378, 8417, 8418, 8457, 8524, 8797, 8900, 9017, 9033, 9072, 9119, 9133, 9134, 9229, 9366, 9525, 9608, 9638, 9750, 9854, 9934, 10018, 10037, 10054, 10082, 10158, 10169, 10200, 10214, 10335, 10342, 10405, 10409, 10416, 10504, 10747, 10804, 10926, 11023, 11083, 11132, 11133, 11179, 11180, 11181, 11191, 11199, 11258, 11307, 11330, 11331, 11395, 11406, 11438, 11553, 11721, 11740, 11860, 11876, 11945, 11949, 11980, 11997, 12089, 12114, 12292, 12401, 12497, 12731, 12732, 12750, 12826, 12849, 13015, 13037, 13358, 13413, 13424, 13535, 13536, 13558, 13685, 13734, 13747, 13875, 13927, 13963, 13999, 14013, 14069, 14070, 14130.

Promoters were tested in Corn seedlings from a cold sensitive line and placed at 12 C for 2 hrs. These were compared to seedling tissue from a cold sensitive line at 12 C for 0 hrs. Promoters expressing under these conditions at this stage include SEQ IDs: 4, 63, 160, 280, 376, 383, 514, 655, 739, 763, 915, 982, 987, 1013, 1039, 1056, 1073, 1144, 1356, 1371, 1398, 1570, 1729, 1761, 1915, 1922, 1923, 1948, 1991, 2060, 2202, 2203, 2210, 2233, 2242, 2526, 2578, 2614, 2692, 2814, 2822, 2826, 2845, 2850, 2861, 2888, 2892, 2987, 3029, 3033, 3067, 3122, 3217, 3220, 3231, 3252, 3276, 3286, 3288, 3289, 3353, 3369, 3382, 3389, 3390, 3432, 3529, 3548, 3599, 3615, 3702, 3738, 3739, 3790, 3924, 3972, 4132, 4165, 4371, 4373, 4390, 4524, 4596, 4643, 4705, 4728, 4767, 4848, 4891, 4900, 4920, 4955, 4975, 5049, 5059, 5090, 5111, 5113, 5123, 5125, 5159, 5209, 5219, 5240, 5253, 5301, 5469, 5493, 5515, 5547, 5559, 5562, 5569, 5649, 5650, 5714, 5842, 5869, 5918, 5994, 6031, 6038, 6051, 6112, 6203, 6260, 6294, 6434, 6463, 6497, 6515, 6564, 6572, 6605, 6648, 6706, 6860, 6913, 6966, 7032, 7079, 7129, 7184, 7219, 7221, 7252, 7270, 7282, 7333, 7400, 7435, 7443, 7444, 7609, 7747, 7786, 7791, 7798, 7866, 7867, 7876, 7934, 7935, 7949, 8045, 8066, 8118, 8199, 8222, 8270, 8417, 8418, 8460, 8493, 8700, 8711, 8862, 8900, 9017, 9033, 9119, 9229, 9419, 9525, 9608, 9750, 9774, 9804, 9809, 9854, 9888, 9949, 10082, 10095, 10158, 10161, 10173, 10214, 10342, 10416, 10504, 10747, 10790, 10804, 10881, 10926, 11021, 11023, 11027, 11083, 11099, 11132, 11181, 11191, 11202, 11237, 11258, 11307, 11395, 11406, 11438, 11547, 11553, 11579, 11721, 11740, 11773, 11893, 11896, 11919, 11945, 11949, 11980, 11997, 12114, 12292, 12337, 12417, 12731, 12732, 12750, 12826, 12828, 12849, 13015, 13037, 13158, 13212, 13269, 13344, 13351, 13424, 13575, 13630, 13734, 13747, 13848, 13875, 13957, 13963, 14069, 14070, 14130.

Promoters were tested in Corn R1 ear tissue during severe drought and compared to an irrigated ear tissue at R1 stage. Promoters expressing under these conditions and at this stage include SEQ IDs: 3494, 7405, 9825.

Promoters were tested in Corn R2 kernel tissue during severe drought and compared to an irrigated kernel tissue at R2 stage. Promoters expressing under these conditions and at this stage include SEQ IDs: 949, 1130, 1402, 1952, 3029, 3591, 4269, 4355, 4357, 4956, 5398, 6053, 6783, 7427, 8350, 8546, 10427, 10941, 11707, 12047, 12128, 12873, 13418, 13830, 13930.

Promoters were tested in Corn V9 leaf tissue during severe drought and compared to an irrigated leaf tissue at V9 stage. Promoters expressing under these conditions and at this stage include SEQ IDs: 8, 16, 126, 144, 174, 211, 234, 269, 270, 273, 284, 319, 412, 454, 461, 482, 483, 608, 614, 634, 638, 722, 734, 744, 753, 765, 812, 820, 821, 830, 910, 919, 957, 964, 983, 1008, 1011, 1016, 1041, 1052, 1096, 1170, 1171, 1204, 1218, 1293, 1349, 1363, 1389, 1439, 1555, 1564, 1590, 1618, 1643, 1659, 1664, 1759, 1761, 1798, 1808, 1835, 1837, 1839, 1850, 1897, 1915, 1923, 1933, 1934, 1954, 1991, 2016, 2017, 2055, 2066, 2125, 2193, 2196, 2202, 2203, 2205, 2325, 2352, 2397, 2398, 2420, 2422, 2423, 2457, 2479, 2500, 2538, 2539, 2557, 2661, 2662, 2679, 2691, 2708, 2735, 2816, 2821, 2831, 2843, 2862, 2903, 2959, 3042, 3115, 3116, 3167, 3202, 3244, 3337, 3386, 3427, 3429, 3447, 3483, 3545, 3557, 3674, 3702, 3715, 3772, 3773, 3808, 3820, 3830, 3843, 3907, 3926, 3955, 3962, 3968, 3988, 3995, 4041, 4048, 4067, 4148, 4155, 4157, 4193, 4198, 4296, 4309, 4317, 4578, 4579, 4582, 4643, 4672, 4685, 4756, 4758, 4761, 4769, 4770, 4805, 4806, 4807, 4828, 4830, 4831, 4888, 4912, 4918, 4985, 5007, 5059, 5097, 5098, 5119, 5144, 5145, 5147, 5159, 5165, 5214, 5219, 5282, 5324, 5327, 5346, 5379, 5458, 5475, 5481, 5483, 5496, 5615, 5655, 5659, 5709, 5824, 5837, 5852, 5881, 5901, 5941, 6018, 6033, 6047, 6048, 6069, 6157, 6173, 6186, 6221, 6315, 6379, 6386, 6397, 6452, 6458, 6470, 6493, 6549, 6570, 6581, 6662, 6676, 6705, 6706, 6782, 6807, 6845, 6850, 6888, 6935, 6951, 6961, 7009, 7032, 7043, 7068, 7183, 7184, 7213, 7234, 7245, 7257, 7275, 7308, 7353, 7355, 7388, 7400, 7415, 7479, 7589, 7619, 7695, 7747, 7798, 7900, 7911, 7934, 7935, 7943, 7953, 7971, 7976, 7979, 7988, 8000, 8116, 8241, 8253, 8340, 8351, 8379, 8442, 8528, 8531, 8566, 8590, 8593, 8610, 8639, 8726, 8756, 8771, 8834, 8900, 8941, 8979, 9014, 9074, 9076, 9086, 9118, 9129, 9140, 9183, 9194, 9215, 9218, 9226, 9276, 9313, 9370, 9502, 9517, 9518, 9628, 9649, 9666, 9698, 9746, 9820, 9824, 9845, 9876, 9892, 9962, 9982, 10041, 10075, 10098, 10135, 10151, 10220, 10231, 10326, 10331, 10398, 10494, 10504, 10515, 10597, 10632, 10648, 10677, 10694, 10705, 10754, 10768, 10800, 10804, 10815, 10823, 10912, 10956, 10999, 11108, 11129, 11151, 11162, 11173, 11203, 11226, 11267, 11363, 11374, 11379, 11380, 11399, 11553, 11610, 11627, 11649, 11688, 11699, 11761, 11858, 11897, 11983, 12005, 12006, 12021, 12040, 12081, 12215, 12252, 12302, 12305, 12306, 12333, 12343, 12457, 12482, 12552, 12554, 12677, 12684, 12805, 12837, 12850, 12882, 12913, 12983, 12989, 13036, 13044, 13067, 13232, 13243, 13298, 13300, 13396, 13398, 13499, 13517, 13562, 13572, 13587, 13598, 13632, 13720, 13728, 13764, 13785, 13802, 13816, 13843, 13944, 13954, 13963, 14003, 14010, 14031, 14088.

Promoters were tested in Corn silk tissue at VT stage during severe drought, and compared to an irrigated silk tissue at VT stage. Promoters expressing under these conditions and at this stage include SEQ IDs: 251, 262, 416, 1171, 1333, 1347, 1488, 1503, 1600, 2241, 2423, 2525, 2821, 3177, 3205, 3235, 3332, 3450, 3521, 3522, 3633, 3792, 3988, 4719, 5026, 5351, 5458, 5697, 5734, 5985, 6112, 6249, 6830, 6971, 7281, 7339, 7767, 7921, 8262, 8523, 8734, 8891, 9284, 9372, 9582, 9586, 9801, 9962, 10162, 10365, 12043, 12375, 12388, 12986, 13301, 13304, 13688, 13747.

Promoters were tested in Corn tassel tissue at VT stage during severe drought, and compared to an irrigated tassel tissue at VT stage. Promoters expressing under these conditions and at this stage include SEQ IDs: 16, 284, 608, 685, 1992, 2398, 2420, 3244, 3995, 4309, 5119, 5615, 5861, 5999, 6018, 6157, 6662, 8351, 9880, 10135, 10945, 11129, 11243, 11399, 11610, 11627, 11897, 12837, 13004, 13059, 13587, 13838.

Promoters were tested in Leaf tissue from corn hybrid plants (LH200×LH59) during V6 stage. N02(samples grown under low nitrogen conditions) are compared to N20 (sample grown in sufficient nitrogen conditions). Both sample populations are harvested at 10 pm. Promoters expressing under these conditions and at this stage include SEQ IDs: 24, 76, 95, 129, 131, 133, 165, 280, 342, 348, 459, 484, 507, 528, 565, 656, 740, 741, 752, 760, 761, 762, 806, 808, 855, 873, 898, 907, 971, 975, 977, 987, 989, 1040, 1068, 1091, 1100, 1116, 1161, 1199, 1201, 1217, 1232, 1239, 1345, 1393, 1432, 1547, 1552, 1553, 1568, 1671, 1760, 1891, 1912, 2040, 2049, 2099, 2109, 2114, 2157, 2226, 2242, 2261, 2321, 2325, 2344, 2352, 2354, 2377, 2423, 2452, 2453, 2480, 2497, 2505, 2543, 2547, 2548, 2549, 2560, 2587, 2617, 2659, 2680, 2712, 2722, 2744, 2749, 2779, 2879, 2889, 2897, 2950, 2969, 3013, 3069, 3071, 3076, 3077, 3083, 3126, 3230, 3235, 3253, 3322, 3329, 3399, 3402, 3412, 3440, 3441, 3503, 3504, 3506, 3556, 3557, 3589, 3600, 3612, 3647, 3710, 3746, 3791, 3858, 3881, 3899, 3952, 4041, 4088, 4099, 4111, 4149, 4166, 4198, 4244, 4247, 4279, 4344, 4378, 4388, 4470, 4487, 4498, 4513, 4549, 4644, 4690, 4696, 4713, 4722, 4725, 4736, 4737, 4738, 4740, 4800, 4820, 4836, 4837, 4845, 4854, 4867, 4878, 4912, 4920, 4931, 4947, 4981, 5011, 5037, 5061, 5075, 5102, 5144, 5154, 5157, 5191, 5216, 5275, 5332, 5356, 5366, 5367, 5371, 5379, 5389, 5481, 5549, 5657, 5677, 5700, 5712, 5713, 5783, 5824, 5834, 5853, 5856, 5858, 5912, 6003, 6020, 6021, 6044, 6060, 6072, 6095, 6135, 6137, 6144, 6148, 6160, 6180, 6182, 6188, 6206, 6288, 6308, 6319, 6328, 6339, 6343, 6344, 6365, 6370, 6426, 6444, 6476, 6480, 6523, 6525, 6614, 6718, 6756, 6781, 6817, 6820, 6847, 6899, 6909, 6939, 6959, 6990, 6995, 7025, 7042, 7140, 7149, 7171, 7214, 7215, 7275, 7281, 7308, 7317, 7328, 7330, 7338, 7389, 7401, 7443, 7444, 7453, 7528, 7533, 7611, 7672, 7720, 7753, 7754, 7780, 7786, 7791, 7796, 7840, 7860, 7875, 7907, 7911, 7927, 7982, 7993, 8007, 8049, 8059, 8080, 8099, 8182, 8227, 8237, 8275, 8296, 8297, 8304, 8355, 8416, 8428, 8429, 8470, 8477, 8478, 8504, 8531, 8532, 8580, 8588, 8804, 8841, 8891, 8901, 8976, 8980, 8984, 9003, 9016, 9021, 9038, 9057, 9081, 9115, 9116, 9131, 9136, 9308, 9310, 9359, 9389, 9394, 9398, 9404, 9405, 9502, 9535, 9536, 9543, 9560, 9564, 9579, 9592, 9626, 9659, 9668, 9761, 9774, 9780, 9798, 9801, 9836, 9909, 9974, 9990, 10007, 10033, 10080, 10081, 10087, 10206, 10230, 10255, 10296, 10297, 10307, 10336, 10338, 10345, 10392, 10437, 10469, 10498, 10501, 10518, 10584, 10595, 10597, 10632, 10664, 10669, 10671, 10678, 10726, 10791, 10818, 10857, 10869, 10878, 10894, 10961, 10972, 11021, 11058, 11095, 11098, 11111, 11117, 11119, 11128, 11150, 11259, 11263, 11264, 11291, 11323, 11360, 11369, 11401, 11404, 11408, 11411, 11412, 11413, 11414, 11443, 11448, 11513, 11607, 11619, 11621, 11644, 11707, 11710, 11720, 11763, 11764, 11766, 11767, 11837, 11839, 11863, 11891, 11962, 11997, 12029, 12032, 12094, 12161, 12164, 12165, 12166, 12167, 12214, 12223, 12249, 12305, 12340, 12399, 12402, 12403, 12404, 12427, 12457, 12476, 12483, 12525, 12568, 12608, 12609, 12633, 12682, 12707, 12708, 12752, 12753, 12754, 12824, 12882, 12884, 12887, 12931, 12938, 12955, 13106, 13110, 13122, 13156, 13228, 13229, 13231, 13236, 13237, 13298, 13349, 13353, 13397, 13401, 13429, 13431, 13460, 13470, 13501, 13535, 13536, 13543, 13552, 13561, 13572, 13601, 13685, 13687, 13738, 13742, 13795, 13856, 13860, 13862, 13907, 13919, 13953, 13970, 14002, 14016, 14042, 14045, 14073, 14144.

Promoters were tested in Leaf tissue from corn hybrid plants (LH200×LH59) during V6 stage. N02(samples grown under low nitrogen conditions) are compared to N20 (sample grown in sufficient nitrogen conditions). Both sample populations are harvested at 3 am. Promoters expressing under these conditions at this stage include SEQ IDs: 14, 61, 76, 108, 129, 131, 133, 165, 196, 211, 230, 269, 270, 305, 306, 309, 342, 348, 354, 365, 381, 431, 434, 452, 501, 509, 510, 514, 528, 534, 565, 571, 614, 622, 629, 740, 757, 808, 819, 855, 873, 887, 898, 907, 925, 974, 975, 981, 987, 989, 1028, 1091, 1095, 1132, 1171, 1199, 1203, 1217, 1218, 1258, 1282, 1291, 1301, 1305, 1345, 1393, 1407, 1415, 1539, 1552, 1568, 1609, 1610, 1626, 1662, 1671, 1677, 1725, 1733, 1735, 1759, 1807, 1879, 1912, 1933, 1934, 1936, 1968, 1977, 2016, 2017, 2049, 2060, 2099, 2114, 2132, 2143, 2150, 2157, 2168, 2185, 2226, 2232, 2242, 2321, 2322, 2323, 2352, 2354, 2376, 2384, 2480, 2497, 2500, 2522, 2543, 2549, 2587, 2613, 2617, 2625, 2661, 2662, 2663, 2720, 2738, 2749, 2833, 2864, 2869, 2889, 2890, 2894, 2943, 2950, 2960, 2969, 2978, 3010, 3013, 3042, 3045, 3052, 3069, 3076, 3077, 3083, 3126, 3167, 3171, 3181, 3218, 3224, 3230, 3235, 3253, 3299, 3310, 3339, 3361, 3363, 3399, 3402, 3435, 3440, 3468, 3490, 3506, 3538, 3551, 3556, 3591, 3594, 3615, 3674, 3710, 3720, 3749, 3763, 3774, 3798, 3804, 3870, 3881, 3908, 3934, 3941, 3952, 3975, 4040, 4049, 4098, 4109, 4111, 4149, 4166, 4176, 4198, 4211, 4212, 4217, 4247, 4296, 4298, 4301, 4333, 4343, 4370, 4371, 4373, 4450, 4468, 4498, 4509, 4549, 4565, 4594, 4599, 4636, 4643, 4651, 4676, 4696, 4725, 4728, 4737, 4738, 4740, 4775, 4779, 4784, 4800, 4804, 4854, 4863, 4867, 4870, 4912, 4918, 4920, 4947, 4981, 5011, 5022, 5037, 5055, 5072, 5074, 5097, 5098, 5108, 5115, 5144, 5154, 5157, 5165, 5203, 5219, 5257, 5282, 5339, 5400, 5416, 5417, 5446, 5458, 5475, 5481, 5482, 5495, 5510, 5520, 5521, 5526, 5549, 5563, 5586, 5597, 5655, 5657, 5677, 5681, 5806, 5825, 5856, 5858, 5881, 5933, 5947, 5956, 6006, 6012, 6031, 6044, 6045, 6093, 6095, 6108, 6109, 6160, 6163, 6206, 6221, 6288, 6308, 6315, 6328, 6360, 6364, 6392, 6398, 6414, 6444, 6452, 6476, 6523, 6525, 6534, 6538, 6554, 6703, 6736, 6739, 6803, 6812, 6816, 6820, 6824, 6850, 6880, 6907, 6939, 6959, 6995, 7009, 7025, 7040, 7094, 7113, 7116, 7149, 7170, 7176, 7187, 7195, 7214, 7218, 7221, 7244, 7245, 7275, 7291, 7308, 7317, 7328, 7330, 7331, 7336, 7392, 7395, 7399, 7417, 7433, 7443, 7444, 7533, 7537, 7549, 7563, 7586, 7633, 7674, 7689, 7720, 7738, 7770, 7780, 7786, 7791, 7799, 7800, 7815, 7818, 7819, 7838, 7840, 7908, 7909, 7933, 7947, 7948, 7949, 7950, 7964, 7976, 7993, 8059, 8072, 8080, 8099, 8145, 8146, 8185, 8236, 8240, 8241, 8296, 8297, 8304, 8410, 8428, 8429, 8448, 8477, 8478, 8496, 8513, 8515, 8531, 8596, 8741, 8757, 8782, 8789, 8797, 8831, 8876, 8878, 8951, 8976, 8982, 8984, 9003, 9060, 9069, 9112, 9115, 9119, 9218, 9247, 9269, 9313, 9385, 9389, 9404, 9422, 9459, 9484, 9490, 9502, 9513, 9534, 9535, 9536, 9546, 9549, 9560, 9564, 9571, 9626, 9668, 9682, 9692, 9717, 9733, 9756, 9761, 9770, 9780, 9798, 9836, 9838, 9911, 9921, 9924, 9953, 9957, 9974, 10022, 10050, 10063, 10080, 10081, 10098, 10106, 10169, 10179, 10204, 10207, 10224, 10307, 10311, 10360, 10373, 10427, 10447, 10488, 10492, 10504, 10542, 10580, 10595, 10596, 10597, 10623, 10632, 10646, 10664, 10718, 10791, 10813, 10823, 10838, 10846, 10861, 10864, 10894, 10903, 10947, 10956, 10972, 11021, 11046, 11047, 11098, 11109, 11133, 11150, 11151, 11153, 11168, 11185, 11214, 11232, 11254, 11255, 11263, 11264, 11275, 11323, 11337, 11360, 11404, 11405, 11465, 11503, 11524, 11528, 11534, 11608, 11619, 11638, 11678, 11680, 11703, 11710, 11720, 11770, 11795, 11836, 11977, 11983, 12016, 12025, 12094, 12161, 12166, 12194, 12202, 12214, 12337, 12399, 12402, 12427, 12437, 12456, 12483, 12495, 12539, 12547, 12586, 12592, 12593, 12617, 12744, 12775, 12777, 12805, 12866, 12882, 12884, 12900, 12922, 12972, 13004, 13030, 13034, 13061, 13075, 13106, 13156, 13181, 13200, 13231, 13261, 13281, 13298, 13329, 13340, 13352, 13353, 13363, 13397, 13401, 13414, 13416, 13419, 13429, 13446, 13448, 13460, 13470, 13501, 13535, 13536, 13555, 13558, 13561, 13565, 13566, 13572, 13603, 13628, 13687, 13779, 13795, 13828, 13849, 13860, 13862, 13917, 13919, 13938, 13944, 13948, 13955, 13960, 13970, 13981, 13984, 14000, 14073, 14094, 14126, 14144, 14145.

Promoters were tested in Leaf tissue from corn hybrid plants (LH200×LH59) during V6 stage. N02(samples grown under low nitrogen conditions) are compared to N20 (sample grown in sufficient nitrogen conditions). Both sample populations are harvested at 3 pm. Promoters expressing under these conditions at this stage include SEQ IDs: 11, 51, 133, 152, 165, 210, 211, 214, 249, 250, 257, 293, 303, 342, 348, 381, 431, 455, 459, 514, 520, 528, 534, 538, 565, 638, 656, 662, 671, 740, 753, 760, 761, 762, 794, 795, 806, 809, 811, 868, 872, 898, 907, 908, 964, 971, 977, 987, 989, 1007, 1014, 1068, 1069, 1087, 1088, 1091, 1095, 1106, 1112, 1115, 1116, 1155, 1161, 1176, 1201, 1203, 1217, 1218, 1235, 1239, 1246, 1247, 1291, 1305, 1327, 1345, 1347, 1354, 1355, 1360, 1393, 1407, 1432, 1447, 1501, 1546, 1552, 1571, 1582, 1609, 1617, 1671, 1677, 1736, 1750, 1759, 1760, 1796, 1834, 1856, 1861, 1891, 1902, 1910, 1912, 1916, 1922, 1936, 2003, 2010, 2049, 2099, 2109, 2111, 2113, 2157, 2168, 2185, 2227, 2237, 2240, 2297, 2300, 2333, 2346, 2354, 2359, 2376, 2408, 2419, 2450, 2480, 2494, 2497, 2500, 2507, 2513, 2543, 2547, 2548, 2549, 2560, 2576, 2587, 2613, 2644, 2645, 2651, 2659, 2680, 2712, 2719, 2722, 2728, 2749, 2764, 2785, 2786, 2819, 2833, 2864, 2866, 2889, 2903, 2909, 2919, 2926, 2948, 2950, 2959, 3013, 3015, 3023, 3039, 3045, 3048, 3069, 3076, 3083, 3090, 3094, 3177, 3221, 3230, 3235, 3253, 3289, 3322, 3343, 3374, 3394, 3435, 3440, 3441, 3502, 3503, 3504, 3506, 3535, 3545, 3556, 3557, 3571, 3574, 3594, 3624, 3661, 3673, 3720, 3738, 3739, 3774, 3790, 3791, 3819, 3820, 3829, 3858, 3881, 3889, 3899, 3942, 3955, 3975, 4000, 4044, 4088, 4099, 4111, 4139, 4140, 4149, 4166, 4167, 4168, 4173, 4190, 4201, 4221, 4251, 4276, 4279, 4288, 4344, 4360, 4422, 4443, 4461, 4462, 4463, 4470, 4492, 4498, 4549, 4568, 4669, 4691, 4692, 4703, 4713, 4715, 4722, 4728, 4736, 4737, 4738, 4740, 4749, 4754, 4763, 4775, 4800, 4804, 4812, 4813, 4817, 4820, 4836, 4837, 4863, 4867, 4870, 4878, 4909, 4912, 4915, 4920, 4931, 4938, 4947, 4994, 5011, 5015, 5037, 5072, 5074, 5111, 5123, 5154, 5157, 5198, 5225, 5230, 5240, 5241, 5260, 5283, 5311, 5339, 5366, 5367, 5371, 5379, 5389, 5391, 5409, 5416, 5417, 5419, 5420, 5428, 5431, 5433, 5445, 5467, 5469, 5481, 5482, 5518, 5519, 5547, 5549, 5572, 5597, 5620, 5653, 5657, 5677, 5712, 5713, 5718, 5770, 5783, 5806, 5810, 5819, 5825, 5835, 5836, 5856, 5863, 5883, 5888, 5889, 5905, 5912, 5931, 5951, 5956, 5992, 6003, 6006, 6020, 6021, 6028, 6041, 6044, 6093, 6095, 6099, 6118, 6132, 6135, 6144, 6148, 6160, 6182, 6206, 6227, 6250, 6255, 6306, 6308, 6319, 6321, 6328, 6339, 6343, 6344, 6360, 6363, 6370, 6381, 6398, 6414, 6444, 6448, 6458, 6464, 6471, 6476, 6480, 6505, 6523, 6525, 6614, 6672, 6696, 6701, 6718, 6739, 6779, 6781, 6791, 6799, 6817, 6820, 6842, 6843, 6850, 6899, 6930, 6935, 6939, 6959, 7019, 7020, 7025, 7042, 7107, 7124, 7138, 7139, 7144, 7149, 7209, 7214, 7215, 7218, 7241, 7275, 7281, 7290, 7292, 7308, 7317, 7330, 7331, 7338, 7343, 7350, 7351, 7399, 7401, 7430, 7453, 7454, 7491, 7502, 7528, 7533, 7547, 7556, 7557, 7611, 7633, 7655, 7672, 7699, 7737, 7739, 7754, 7761, 7780, 7786, 7791, 7796, 7803, 7840, 7860, 7875, 7901, 7911, 7921, 7927, 7933, 7982, 8006, 8007, 8040, 8042, 8049, 8059, 8067, 8080, 8099, 8182, 8272, 8275, 8296, 8297, 8343, 8351, 8379, 8410, 8428, 8429, 8433, 8455, 8477, 8478, 8504, 8531, 8532, 8557, 8580, 8588, 8618, 8657, 8665, 8699, 8730, 8804, 8896, 8901, 8912, 8919, 8945, 8980, 8984, 8998, 9003, 9004, 9016, 9021, 9038, 9057, 9060, 9092, 9119, 9136, 9151, 9269, 9304, 9308, 9310, 9338, 9339, 9353, 9386, 9389, 9392, 9398, 9404, 9406, 9422, 9453, 9459, 9502, 9520, 9521, 9536, 9543, 9546, 9548, 9560, 9579, 9637, 9640, 9659, 9668, 9718, 9754, 9756, 9761, 9774, 9776, 9780, 9784, 9798, 9801, 9813, 9816, 9828, 9835, 9836, 9854, 9869, 9897, 9909, 9918, 9957, 9972, 9998, 10007, 10052, 10058, 10080, 10081, 10087, 10106, 10115, 10161, 10169, 10206, 10207, 10230, 10296, 10297, 10307, 10335, 10343, 10345, 10374, 10381, 10392, 10410, 10411, 10413, 10472, 10473, 10492, 10498, 10501, 10518, 10542, 10544, 10571, 10584, 10595, 10597, 10632, 10646, 10649, 10664, 10686, 10689, 10702, 10711, 10712, 10740, 10803, 10838, 10864, 10869, 10894, 10898, 10993, 11021, 11023, 11046, 11047, 11058, 11070, 11072, 11095, 11098, 11110, 11117, 11123, 11128, 11185, 11207, 11242, 11254, 11255, 11257, 11259, 11263, 11264, 11282, 11290, 11291, 11306, 11320, 11328, 11360, 11369, 11377, 11394, 11404, 11408, 11411, 11412, 11413, 11414, 11443, 11448, 11513, 11518, 11528, 11570, 11615, 11636, 11641, 11644, 11703, 11710, 11718, 11733, 11764, 11766, 11767, 11770, 11774, 11816, 11830, 11837, 11853, 11861, 11878, 11895, 11909, 11922, 11928, 11929, 11930, 11948, 11965, 12016, 12019, 12025, 12032, 12059, 12091, 12094, 12161, 12164, 12165, 12167, 12192, 12208, 12214, 12223, 12228, 12229, 12241, 12245, 12249, 12259, 12263, 12280, 12337, 12342, 12344, 12364, 12399, 12401, 12402, 12404, 12414, 12418, 12427, 12429, 12447, 12459, 12468, 12483, 12515, 12525, 12535, 12537, 12562, 12567, 12568, 12592, 12593, 12628, 12633, 12681, 12682, 12707, 12728, 12743, 12752, 12753, 12754, 12764, 12797, 12818, 12852, 12866, 12878, 12882, 12884, 12887, 12906, 12912, 12921, 12932, 12938, 12955, 12963, 12972, 13023, 13024, 13030, 13054, 13075, 13122, 13148, 13149, 13156, 13167, 13228, 13229, 13231, 13236, 13237, 13285, 13298, 13329, 13340, 13349, 13352, 13363, 13401, 13416, 13420, 13429, 13448, 13451, 13460, 13470, 13501, 13543, 13555, 13561, 13572, 13579, 13596, 13601, 13606, 13607, 13628, 13634, 13660, 13662, 13679, 13687, 13688, 13699, 13724, 13736, 13738, 13742, 13756, 13795, 13812, 13813, 13856, 13860, 13862, 13875, 13907, 13911, 13919, 13925, 13947, 13953, 13960, 13970, 13975, 14002, 14003, 14016, 14030, 14042, 14045, 14052, 14073, 14084, 14126, 14133, 14141, 14142, 14144.

Promoters were tested in Leaf tissue from corn hybrid plants (LH200×LH59) during V6 stage. N02(samples grown under low nitrogen conditions) are compared to N20 (sample grown in sufficient nitrogen conditions). Both sample populations are harvested at 9 am. Promoters expressing under these conditions at this stage include SEQ IDs: 7, 14, 29, 37, 46, 61, 76, 98, 129, 148, 182, 196, 207, 211, 214, 215, 230, 236, 240, 250, 257, 263, 269, 270, 288, 293, 305, 306, 308, 328, 335, 337, 348, 352, 365, 381, 401, 431, 436, 459, 485, 489, 501, 510, 513, 514, 528, 534, 542, 544, 548, 565, 585, 614, 619, 638, 701, 707, 708, 716, 719, 731, 732, 742, 744, 753, 757, 765, 806, 808, 809, 819, 820, 873, 890, 892, 895, 898, 907, 960, 975, 978, 979, 987, 989, 1002, 1007, 1009, 1014, 1016, 1049, 1069, 1087, 1091, 1095, 1112, 1114, 1115, 1116, 1118, 1132, 1154, 1167, 1171, 1176, 1178, 1201, 1203, 1217, 1218, 1231, 1236, 1239, 1259, 1286, 1291, 1293, 1309, 1316, 1320, 1322, 1323, 1327, 1345, 1354, 1355, 1360, 1391, 1407, 1421, 1423, 1426, 1439, 1441, 1447, 1484, 1539, 1546, 1549, 1552, 1554, 1568, 1575, 1582, 1584, 1599, 1602, 1609, 1610, 1630, 1659, 1662, 1669, 1671, 1677, 1691, 1710, 1725, 1729, 1732, 1735, 1749, 1755, 1759, 1760, 1776, 1807, 1808, 1834, 1840, 1848, 1861, 1869, 1888, 1891, 1910, 1911, 1918, 1936, 1937, 1977, 1990, 1991, 2000, 2023, 2032, 2049, 2060, 2062, 2066, 2094, 2099, 2114, 2132, 2143, 2147, 2157, 2183, 2185, 2193, 2202, 2203, 2216, 2226, 2227, 2242, 2260, 2298, 2304, 2322, 2323, 2328, 2333, 2352, 2353, 2354, 2384, 2410, 2419, 2440, 2487, 2494, 2500, 2505, 2513, 2517, 2522, 2528, 2533, 2543, 2544, 2549, 2552, 2617, 2620, 2625, 2634, 2663, 2674, 2715, 2719, 2722, 2749, 2770, 2800, 2801, 2860, 2865, 2894, 2903, 2918, 2926, 2948, 2950, 2959, 2960, 2968, 3007, 3008, 3013, 3015, 3039, 3041, 3045, 3069, 3072, 3076, 3083, 3085, 3120, 3126, 3139, 3169, 3171, 3177, 3181, 3189, 3199, 3218, 3224, 3225, 3230, 3235, 3237, 3253, 3264, 3272, 3288, 3295, 3301, 3322, 3324, 3337, 3353, 3361, 3399, 3403, 3425, 3427, 3428, 3435, 3442, 3446, 3458, 3462, 3466, 3468, 3484, 3503, 3504, 3506, 3521, 3522, 3523, 3538, 3545, 3551, 3556, 3558, 3571, 3591, 3592, 3594, 3604, 3613, 3619, 3620, 3643, 3648, 3661, 3673, 3674, 3698, 3707, 3710, 3720, 3748, 3749, 3790, 3820, 3836, 3870, 3871, 3872, 3881, 3889, 3902, 3904, 3908, 3917, 3928, 3934, 3947, 3958, 3962, 3975, 3997, 4007, 4008, 4013, 4030, 4033, 4037, 4040, 4044, 4057, 4070, 4088, 4099, 4102, 4109, 4110, 4111, 4128, 4139, 4143, 4149, 4166, 4167, 4168, 4176, 4185, 4187, 4189, 4198, 4201, 4204, 4208, 4211, 4247, 4250, 4251, 4272, 4276, 4286, 4296, 4298, 4324, 4329, 4330, 4335, 4360, 4371, 4373, 4397, 4401, 4403, 4422, 4443, 4450, 4475, 4492, 4498, 4519, 4549, 4551, 4557, 4565, 4568, 4580, 4591, 4593, 4594, 4597, 4598, 4599, 4623, 4636, 4643, 4644, 4664, 4669, 4671, 4676, 4677, 4680, 4685, 4691, 4692, 4696, 4713, 4719, 4722, 4723, 4725, 4736, 4737, 4738, 4740, 4749, 4754, 4775, 4779, 4784, 4789, 4804, 4813, 4817, 4854, 4863, 4867, 4909, 4920, 4924, 4936, 4947, 4954, 4960, 4981, 4987, 4988, 4993, 5011, 5015, 5022, 5037, 5044, 5055, 5072, 5074, 5075, 5082, 5088, 5094, 5100, 5132, 5144, 5154, 5157, 5159, 5165, 5168, 5170, 5174, 5196, 5202, 5203, 5216, 5219, 5225, 5230, 5241, 5256, 5257, 5260, 5269, 5282, 5283, 5293, 5299, 5300, 5301, 5311, 5334, 5339, 5366, 5367, 5371, 5379, 5395, 5396, 5414, 5416, 5417, 5418, 5432, 5434, 5458, 5475, 5481, 5482, 5513, 5518, 5519, 5526, 5549, 5563, 5586, 5597, 5608, 5620, 5638, 5640, 5648, 5655, 5657, 5670, 5671, 5677, 5681, 5695, 5709, 5731, 5751, 5773, 5794, 5804, 5819, 5825, 5835, 5836, 5853, 5858, 5878, 5881, 5912, 5921, 5929, 5931, 5942, 5948, 5952, 5955, 5956, 6003, 6006, 6038, 6041, 6044, 6073, 6090, 6093, 6094, 6119, 6125, 6156, 6160, 6163, 6182, 6207, 6221, 6227, 6237, 6282, 6288, 6308, 6315, 6319, 6321, 6323, 6343, 6344, 6360, 6362, 6392, 6398, 6399, 6403, 6414, 6415, 6420, 6429, 6444, 6448, 6454, 6464, 6476, 6480, 6501, 6504, 6506, 6510, 6523, 6525, 6534, 6537, 6581, 6595, 6598, 6605, 6672, 6689, 6703, 6739, 6764, 6779, 6780, 6799, 6811, 6812, 6816, 6819, 6820, 6824, 6836, 6841, 6850, 6880, 6899, 6914, 6930, 6939, 6946, 6959, 6980, 6981, 6984, 6994, 7025, 7042, 7043, 7113, 7116, 7144, 7149, 7164, 7170, 7171, 7214, 7221, 7244, 7245, 7255, 7274, 7275, 7281, 7287, 7288, 7308, 7317, 7328, 7330, 7353, 7354, 7383, 7392, 7399, 7417, 7428, 7433, 7434, 7436, 7443, 7444, 7446, 7454, 7498, 7502, 7523, 7528, 7533, 7547, 7556, 7580, 7598, 7599, 7633, 7661, 7664, 7689, 7699, 7707, 7725, 7736, 7737, 7754, 7768, 7774, 7786, 7791, 7796, 7800, 7819, 7840, 7860, 7896, 7908, 7909, 7911, 7925, 7933, 7949, 7950, 7980, 8005, 8006, 8049, 8059, 8080, 8087, 8099, 8145, 8146, 8182, 8189, 8204, 8236, 8241, 8272, 8296, 8297, 8304, 8306, 8315, 8343, 8389, 8393, 8400, 8404, 8429, 8436, 8439, 8447, 8465, 8501, 8504, 8513, 8524, 8531, 8532, 8539, 8557, 8561, 8611, 8612, 8618, 8631, 8634, 8642, 8647, 8657, 8663, 8665, 8706, 8736, 8740, 8742, 8744, 8757, 8763, 8773, 8789, 8822, 8831, 8843, 8846, 8869, 8874, 8876, 8878, 8889, 8891, 8896, 8899, 8913, 8941, 8945, 8946, 8951, 8967, 8974, 8976, 8979, 8981, 8992, 9003, 9016, 9020, 9021, 9038, 9042, 9069, 9097, 9098, 9112, 9114, 9115, 9119, 9139, 9152, 9188, 9191, 9210, 9211, 9216, 9247, 9254, 9269, 9295, 9300, 9337, 9338, 9349, 9376, 9382, 9386, 9389, 9396, 9404, 9432, 9433, 9459, 9497, 9513, 9533, 9534, 9536, 9540, 9543, 9546, 9555, 9560, 9563, 9564, 9571, 9617, 9620, 9655, 9659, 9663, 9668, 9717, 9718, 9737, 9746, 9754, 9756, 9761, 9770, 9780, 9791, 9798, 9813, 9816, 9830, 9845, 9873, 9911, 9912, 9918, 9940, 9956, 9957, 9972, 10007, 10026, 10049, 10050, 10058, 10063, 10080, 10081, 10092, 10103, 10106, 10107, 10132, 10135, 10169, 10174, 10182, 10206, 10207, 10218, 10224, 10236, 10237, 10240, 10270, 10296, 10297, 10300, 10307, 10311, 10325, 10360, 10374, 10375, 10392, 10413, 10427, 10447, 10488, 10492, 10494, 10496, 10501, 10518, 10528, 10542, 10544, 10563, 10571, 10580, 10582, 10593, 10595, 10596, 10597, 10599, 10616, 10664, 10674, 10702, 10791, 10792, 10803, 10819, 10825, 10826, 10833, 10838, 10843, 10846, 10861, 10864, 10869, 10871, 10894, 10896, 10898, 10912, 10920, 10947, 10965, 10977, 10988, 11021, 11095, 11098, 11109, 11117, 11125, 11128, 11129, 11137, 11151, 11153, 11154, 11168, 11177, 11185, 11201, 11207, 11214, 11233, 11254, 11255, 11263, 11266, 11275, 11293, 11295, 11306, 11307, 11320, 11323, 11328, 11346, 11356, 11360, 11370, 11377, 11382, 11394, 11404, 11416, 11437, 11443, 11465, 11467, 11471, 11500, 11503, 11513, 11527, 11528, 11533, 11546, 11558, 11576, 11607, 11608, 11615, 11619, 11620, 11642, 11658, 11678, 11682, 11703, 11710, 11720, 11725, 11731, 11736, 11743, 11762, 11763, 11764, 11766, 11767, 11770, 11774, 11809, 11812, 11816, 11818, 11830, 11837, 11858, 11877, 11909, 11913, 11926, 11928, 11929, 11930, 11934, 11935, 11946, 11977, 12002, 12004, 12016, 12025, 12032, 12044, 12059, 12063, 12092, 12094, 12102, 12106, 12110, 12164, 12165, 12192, 12202, 12208, 12214, 12217, 12221, 12223, 12252, 12287, 12317, 12321, 12333, 12342, 12406, 12411, 12414, 12419, 12420, 12427, 12437, 12447, 12457, 12459, 12465, 12468, 12483, 12495, 12497, 12501, 12502, 12504, 12525, 12531, 12535, 12537, 12539, 12547, 12562, 12567, 12568, 12592, 12593, 12608, 12609, 12617, 12623, 12634, 12641, 12679, 12680, 12681, 12684, 12695, 12744, 12755, 12763, 12764, 12765, 12771, 12804, 12818, 12820, 12824, 12866, 12878, 12882, 12884, 12898, 12906, 12921, 12946, 12955, 12972, 12978, 13003, 13004, 13009, 13017, 13030, 13034, 13054, 13061, 13075, 13085, 13117, 13118, 13128, 13148, 13149, 13152, 13156, 13159, 13228, 13229, 13231, 13234, 13255, 13259, 13298, 13329, 13340, 13346, 13347, 13349, 13352, 13363, 13369, 13394, 13397, 13416, 13417, 13419, 13429, 13430, 13446, 13448, 13451, 13457, 13460, 13470, 13475, 13501, 13504, 13521, 13526, 13535, 13536, 13555, 13558, 13561, 13569, 13572, 13601, 13606, 13628, 13631, 13636, 13688, 13698, 13700, 13702, 13730, 13742, 13750, 13753, 13777, 13780, 13795, 13798, 13812, 13813, 13817, 13822, 13827, 13828, 13835, 13849, 13860, 13862, 13873, 13875, 13887, 13907, 13911, 13917, 13919, 13938, 13944, 13958, 13960, 13969, 13970, 13984, 14002, 14013, 14014, 14016, 14017, 14052, 14073, 14086, 14088, 14094, 14111, 14116, 14126, 14133, 14144, 14145.

The present invention thus provides DNA constructs comprising regulatory elements that can modulate expression of an operably linked transcribable polynucleotide molecule and a transgenic plant stably transformed with the DNA construct. From the examples given, the present invention thus provides isolated regulatory elements and isolated promoter fragments from *Zea mays*, that are useful for modulating the expression of an operably linked transcribable polynucleotide molecule. The present invention also provides a method for assembling DNA constructs comprising the isolated regulatory elements and isolated promoter fragments, and for creating a transgenic plant stably transformed with the DNA construct.

Having illustrated and described the principles of the present invention, it should be apparent to persons skilled in the art that the invention can be modified in arrangement and detail without departing from such principles. We claim all modifications that are within the spirit and scope of the appended claims. All publications and published patent documents cited in this specification are incorporated herein by reference to the same extent as if each individual publication or patent application is specifically and individually indicated to be incorporated by reference.

SEQUENCE LISTING (14151 sequences)

SEQ ID NO: 1 - DNA, 1500 bp, Zea mays
actagtatttagtggaaagagcattctgtggcacccagtgacaaatcctaggtgctgaagctgacatgttatgctactacggagtcccgttgtcttgtcacgattgttgttgatgatttcaggtttgtaccattactgatttttgttgtcagtgtaaaaatgtgctggtgccccataaggtaggcacctaggtctgtgtttgaagcatcgacagatttgtaaacatgttcctatgaacctatttctgattgataatttgtcaaaactcatcatttgtcttcatccttgcctgcttgcgttcacgtgacaaagtacgtgtatgtcttcggcctttgctgtgtatgtttcgcattgcttagatgtggtgaaagaacatcagaagatgcattgatggcgtgcttaaaccagtgatgtgctccaggtgttcctgcagtctgcagagatatttactcttgtagtcttgttgacagcacagttgtatgtgatttcttggatgtaatgtaaaccaaatgaaagataggaacagttcgtcctcttccgtatacgaaggtcactgtatcatttgtcgtggcacaagatgatctgcaggcaggactgcaacatggtttcttggactgtcctgaatgccagttcttgttctttagctgagccagagcagcagcctggtgtcggtgcctgagacctgacgaagcacacggcaaacaaacaagtcgcagcagcagctagcaggcgttgccatcgccacaagcccccaagagacccgccgaggaaaagaaaaaaaaactacggccgccgttgccaagccgagcgtgcgaaccgatccacggatgggagatcagagatcacccaccgcaggcgggcggcagtggctggcgaggtgcgtccacagaacctgctgcaggtccctgtccgtcccggcgaccccttttctaggcgagcaactccccatggcagagctgcacgcagcagggcccgtcgttggttgcagctttaaccctttttgttttaaccatacaatgcagagtcgcagaggtgaaacaggacggaaattacagaaaagatggtggtgtgccagcagccccagcatgaagaagatcaggacaaaagaaaagcttgtgattggtgacagcaacaggattggattggagccaagctaggcagtgagaggcaggcagcaagacgcgtcagccactgaaatccagagggcaacctcggcctcacaactcatatccccttgtgctgttgcgcgccgtggttagccaggtgtgctgcaggcctcctccttgtttatatatgggagatgctctcaccctctaaggtaaggaaggagaagaagacgagtgtcaagtgaacctgaaacttgcggtgtcactggctggtacagcctgagtgtgagtgagtgatcgagctagctgagctccgatcctcgctagctagctaggataccgccataccacaagtcttcttcacaagtttaggagtgacagcaacaagagatcg

SEQ ID NO: 2 - DNA, 486 bp, Zea mays
ggttagtttgatcatttaaccttgttctggtaccaaaagaaacaaatgataaatgaagaaaaaagagagaacacctgttttcaaccaattctcaccccgagtgtcaaattttcgacgacatacgaattaaatgtcaaatgttcactggtgcgcagattgggtgtcaaatattcaattttctcaatgattctccatccaaaggagttatcactgaccgctcgatcaactataggcggccttgattgagcaaaaggaaacggcgaagggatgcaagcaccctggaacccttctattttgcactgacttccacggctcgcctcgcttccccatcccactctctgtccctccggcgagtggcggcggcagagacggaggccgagtgagcagtacaacgccgccgacaccaatcacgagggtatatcaactacaagtagagggaggccaagcacgaaaccatcaaagctgaccaactgagcgcccgccgca

SEQ ID NO: 3 - DNA, 579 bp, Zea mays
ggacgctggatataagatcaaatcctatatgtatgtggcagctaggattaatgaaattacaaaaacattggcttctatgccgacccctaccacatttagggctagttcggaagtgattggagggattaggatccctagtctactccggttttatgacttccaaactagcttttgcatagggcttatgactttcaattagggtacgaggtcgttgcaggctcagtccgacaacttgatattaacttattggagactcggataagtgaaagtgatgctgtagaaggtaattcaagtgcccgtaaaaatacttaaggttctgtttgtttggactttttaagcttatgactagctaaagctgttgcattgtcgtgcaccacaccttgtcgtgcaccacaccgacaccttcacttacagtgattctggaaagtacttcaatcatccatatcgtctataaatagacatcttgttgtgcaccacacctacaccgacacactacatccagcactgtcacagtgtcaccttatttagctagcctgtcgtagcagctagccaccagcccaccacccaccacccagcagc

SEQ ID NO: 4 - DNA, 1500 bp, Zea mays
ttataaaataggcactattggaagggtggtttatgattctaaaccctatatttaaaatagggtcacatttagagcttctcttgaagatgctctaaagtactaaatgtaggaccccatatgttggagtcatatcctcgttttgtacaatattcttaacattttatttcctaaataacatgatctatttacaataacatgatataggactcaactgttggaactgcagatgattattaccctaaacacttcaaatcagctattatttttaaattttagatatattttacataactactgaagctgctctaattataggttgtagcagtacaagaaaagcttttgtttccgaaagcactgacctctttcttgcctctgctttagtactgctcatgaagcacagtgtggtttccaaaaggcacatatatatagtttgatgcacatacatacaccgtgttgaatcatgagccaaatctttaagccaggggaccatgcactttatttagggagaagctagcacggcgagacaatgctttgcgtgtgaagttcttttttttttttttggtaacgagcaactcccacttggctttgttgggcctttaccggaccaaaaagatgcaacggcagcagcgagagagatttgccggacaatagcatctcgtctaatggttaaaaaaaaaaagaggccgggggaagtggagtcgtagacgacgagagcggtgccgaaagggaacgacgacgacagctcatagtaatgcttctccgatctctctaatcatcaacacaggattctgcttctgtcttgcgaacctcagatgatatagattaacaaaacatatccaactaatacatatgataaagtcggatcgccaaataaatcgtacaaattaacccaacccgtgacgagcgacaacccgttaacacgccatgttctccgctggattggaaaaaaaaaaaaccaaccagcctgcccgggagcccgaaaaccgcgtatgcagccacccattttggtccaactaatgaaattatgaaagccaccacccggcgtgtagttttttctacatataaaaatctgtaccctagagatcggtatgatatgtgtatccctggccacatgggctgcctccggatccgatggccgtgaccccgtcgaccgaggaacccatgtcgccggccgacccggcaggccgctcgtgggtgctgcccgcggtcaccctcgcagcacagccagcctagcccacgccccggccgcgacgtcgctgcgtgcatgtgtatgtgtctctacaggcagcccggctgacgacccactccttcgtccttcctcttcctcctataaaacatgcgccccgcccccgagaggccaaacacacacaacaccagctcatcacatccatctcattctactactgcctcagagaccaagctgctgcaaccggagaaggagatctattctacaaagtgaagtacttagcttgggacatggaaaccgtcgtgggagacctc

SEQ ID NO: 5 - DNA, 1500 bp, Zea mays
tagtaataactagctcctattattgaggtgcaccctaaatggccataagatgcattgttcttgcattggaaactagactcatgcatattaatttccaatgacatactccctccaggttacaaattctcgtcgtactagcgttttcgtcgaagtgtactaattctcgtcgttcagtgtttgctttccatacttgcgatctagttgttttaaaattgtataaaacaaaaacaaagtcagaaaatcatgaaacttgttgacatgtcatgatatcatatgtagagactctaataaaaatttgagattgtttcatgaaagttgtcacgcgctatgtgtagaaacctagcccgtctacattgaggttctatgatttcatgtgaaggacatctaggcatcaatgtttatgataatatcttatgtttgtttggacgaaatattaaaaacaaataaaaaggggtccttgatcactttgacgagcattgcactcagcaaagggtgcctttgctgagtgcaatggtcatagaactcggtagaaaagacatacatagatatcgggaaacttgctttaccgcgtgctatggccaagacactcggcaaactaggctcctttgtcgagttccatcccaagcactcgacattggaactgcgactgggcctcacggaagctttctttgccgagtgccactaagcgaggaactcggacactcagcaaaggctytgtcatcgtcacgatgtcttttctttgtcgtgtaccagttggcactcggtaaagactttactgagtgcccgatagaaagtactcggcaaagagaccgttgccgacgtttggttcactgagggctctttgctgccttttggacttgacaaagaagccgtctccagtagtgtctcctgggaggcgggatttatgttttttcccggagctcgatctgtgggacatcacagatggtccaatctggtgatctaaaatggacggtttgccaagcccacagagaagtctttaagatcttccacgatgcacgcatgctttaaggttagatagtgtttggtccaaaaaagcgtcaacaatcaggaaattagaactaaaattattaaaggacagatcaggaagcatgcatgttcttcttctatagtgtgtgttgagcctgagtttggccttttaggctttattagggggctcacagtctaactaaggagttgtattgatgtgctgacaaatattatgttcgatcgtcacagtgttcttatgcggatcgattaggcccgatcatggtgaaataaactaaccaccggtaagcccgggcaaccccagagcatgcagcggcctacgtgaagcccgcacatcgcatcgtcgtccgtcaggcgctaacggccggccgctgcatgcgtcgccggcgaactctctgctgagccacccgtcctccctataagtagctatcccagcaccgtcgtctatcaaccacacacagagcggcatttcgaataacacaggtgagcgcgacg

SEQ ID NO: 6 - DNA, 555 bp, Zea mays
ccccttcccaagtctcttccatcttttgccagtgtcagtgtgatgtgctctcgcagtgcacgcgtggtaaatttcaccagatgtccaccgatccgcaccccaggtccagacgtcctgacccgttattgctccgacaagctcggcgtgagatccaccggtatgaataaaattagcacggaatgtacactggcaggctcacgagcccgaggagagttcatcccctagcgtacgttttatatgccgcggcgccgacagaccccgacgtgcctgtcccccccgcgcgccgtcccaccccgccggtgcagtgtacgtgcgcgcgcgggcggcgatggccgctccgcaagcaacgcagcactgtctacgtgtcgctcgacctgcgcgacagcggcgtcagagaccgaagccttggaatgtttccggccgtccacgcagcgtttcccccgtgctccgtgtatgtctgcctccctcccccgctccgcgcgggcgagctgagcgcctgagccccataataaataggcggccagccacgtagcagcaccggccggacgcgacgca

SEQ ID NO: 7 - DNA, 326 bp, Zea mays
ttgcactgattttgttcttggcacatgttctttgcactttacagatttgttgatcaaagaaccatggaaggatcgttccagtgaatcccaacgccagtcctttcatacctggattgctgggttcatctgcacaaaaagccccagaaaaacaaggaggtgagactaaagatttttctattggctctgtaggttttgaactctcagatttgctttattcatatgattgcgctgagagctcagcaggtcttatcatttctgcagggtcatcatcaaagggagagccttctggtagcacctttgatccttctgagtatgaggaaaatgac

SEQ ID NO: 8 - DNA, 704 bp, Zea mays
gaaaaacagcgacccctcaccggccagacgtagcatgagtatagtaggagtacgacaggagccttccacgcgagccaccgcgctgacgcaccatgacaaatgtcgtgccacctcggcgtctcgttcaggagaagctccccgccgccgacgtcgacgctgtcccggccagccccccacgccccacccccacctagctagtatgccgcgctacgcatcgcccctctggaaaccctcccacccggggggcgggggtggcggggggggggggcatccggcccatgccaacggaaactcgcgcactccagccgctgcgggagcaccacgtgtaagggccgaaccagtcgcaactctcaagacggataaccattccgtccgtgcatgcggtgattgatccgggccgggggaagaggggcgcgaccggcccgcccggtgcgcaacacctggacgcggcgccaagccatcgaggggcctacatgttctccgtcgcggggagtggcgccacgtgtgcgcgtcgcgccggccagacccgtgcgccgagcactggtataaagagctaccccgccgtgtcccgagcgccagccactccacttgctactactacacacaaacacagctagccggcgctgccaggttggctttggcgagcaacgacgacgacgacggcgctcaggactcaggtgctttcggttcaggcggaggagggc

SEQ ID NO: 9 - DNA, 592 bp, Zea mays
ttgtcctgatgtatgcagtagaccaagaaagggtaggcacgaaaagcccctacccacttcactggtcattcggagacggacggagaggcactagctagtgtgcagagtgcagtgcagctgctgcgcgtcgctgctcctgcctggggaacccaaaaagatgttggagggaagcccgaaaatcaaaaagccatggactggacacaagctcggcccctctccctctccacgccgcggcaataaagaagccgctgtgcagcatgcgtgtcacactctcccgctcgtccctcccgcattctctctctatctcttcgtcttcctttcctcctctcgaaccccaataaaacctcactttccctccttgccacttcggattctcctcctctgcctttcgcttcgtcactcgccacgccacgccaaagaccaagaaaaaaaaggacgattttttcctagctgcaacttccctcacgccatggaggaggagatgccgctgcagctgctctccgcttcctccgccgccgtcgctgtctgagctcccccttcgctcgatctctccatcgggccgggcctacctctcctagcagtgaatcaaacc

SEQ ID NO: 10 - DNA, 537 bp, Zea mays
caatgacctgtgccagtatgccggatatcatgcaaacaccgatgaggagaagaggacaggtttcaggaggggactcagcactaaactccgtgacccgtctcaacatagtcagggccaacagctacaaatgagttagtcaacatggccatttcccaggaggactgtatcacagctcgtcaggcagaaaagaagaggaagacccctgtggcaggaccttcagctcagccacagcgcttcaggatcgtatctgacacttagagcaaaggacctcagcagcagcaaggatgtttggtgatccgaccacagcagcagcagcaggcacccaaccgcacccagtttccagtgcagaggaacaatcagccacagcagcagcagtaccgccaggacaatgacaacaagtgtttcacttgtggtaacaccggacattatgccaagaattgccccagaaaccagcagctgtagggacagaatgccaaccagaaccaaggcaagaggcagaaggtgcaagtgaggcaaggcagactgaacttcaccacc

SEQ ID NO: 11 - DNA, 167 bp, Zea mays
ggtactccttgcctaaagcccaactgatcaatttgactgtcgtagcagttttctcagcgatataactactggattaacccatgtgactgagttctaatttcttttagcttccagccatcgaagttctctctgcattacctcgttcaacttctataaatttgctggtg

SEQ ID NO: 12 - DNA, 924 bp, Zea mays
cgagctccgcgacggcgatcctccctacgccgccaagttctacgactgctgcggcgccgaggaccccgacgctccgggctgcaccactgacttgcaccgttcctacgacgacgcccaagactagcaaacctttgctgcttccacaggcctcatcttaatctcaagtctcatctaccgtttcgcttttgcatcccctccttatcctctctagtcagctatcaaattaaaccatctatgtacacttaaataaattttgcttcagatatgttacctactggagctttttttttcctttttttttgcaattgatcaaacatatctctcttcatctatacaccgtctgtttggttggcttgcctctcaggatgctttaagtatcatacgagtctgactccacatctgcacgtaggtaaccaaacacacacctcgcacacgtaaagcctggaaccaaacacatgaatactaaactggaacataaggcgccccctatctgaactcccaaaaaaagccagcaattcataaaagtttatgtcatacaaactttgattcagtaattctgattcattgtaataacatcgatcttgtttggaataaacatttcactgggatatagaatatccaaatgtaaatagtttctgtccatgcatatcccacacctgtttttataaaaaaaaaatcaggccgtcagtattctctttcagttcttcattcaaatgataattcagggacttcaagggaaggtggtgcatcacttttaacagcaagggcacgtgggtatagatctgatcggcgcgatttttttctttctttctttccggacagcggcaccgcaccgggtactattttgacctcggtcgctcaaaatctctgtctgtcggcccgccagaccccagacctagaccctccaaaaacaactcaacaaca

SEQ ID NO: 13 - DNA, 423 bp, Zea mays
agttttagggcatgtacaactctagcgggcgataaatattcgaaaataaagataatagttatcaagtcatgtgcaactctagcgaaagataaatattcgagaccgaagatattagttatcaaggcatgtatgtacaactctaaaccctgataattgttttctaaatataagaggtactacgatcccgagcctttcaataataaatacaatcaaaatacaataagtataagagagtcctcttcaggaagacttcgtctattgatttcaatagtagcgtttgagtgcgtgcgaacatcgctgtcactggggaaactcagtcacgggcatctggggcgcaggaatctctcgcggagaccgcgacgtcctgcaattaaaatatatatgcttattcatgtgccaagactgtgtcagctaacagcgaca

SEQ ID NO: 14 - DNA, 410 bp, Zea mays
gacatgtgtagggtcgtagggtcatgccacacctgcgtagaggcggcaacaaaaatgcagaccgaagtaccgaactgtagccgacgtgagctcagccatagaaatattcgggtcaaggtccacgtggcaccactcgccggaggaatctccgtgcagcctggcgtgttcacaacttcacacacgcccctacccctcggccccggctggatcgatctgggttcctcccggccgcacgatcgccgccccaacggcctcgatccacctactagaagcttccggtctacgtacgtaatatataatacgatgcgcactgcgtcggccggctggctcccaccgaattcattccacccccgtctcctccgatcggacggaccaccgggccagcagcggggcggatcgcgtcagcagcc

SEQ ID NO: 15 - DNA, 486 bp, Zea mays
ggtgtgtgtgtttgtgtcattgtgtgggtgactgagacgcttgcgcgacatgcggggcgtggattcgctggacgggggtgggggtgggtgggtggatagatgaattagattagatacgatcgatgtgaagataacatgtcttgtgggccattccaaacaataaaagaggttatttgtaaaaatatgacgtgaaataacagttaaaactgatgttttaatatagtacagatacagaataaagaataccattaaatataattatgtatgataacatatagacatttagagcgtgtttttaatagatatctcatttaaataaaatctattcatatactatatagtaatgcatggacatttaactaggcgaggtttaagggcctccgctgtataatcagaccagaaagtgaactaaacacgcaaaagttagaaaattaattctgcgttagttactccaggcttaaggttaagcacctcccaaacacgcct

SEQ ID NO: 16 - DNA, 1472 bp, Zea mays
gttttagtttctctggtgcatcttctcactccatggagaggcatcgatatttgcagagaggaatgttgtcgtcatcaaaggcccttcgaactgcttttgaatcgaacattgcttcaaggtacctgctgtttcatagtataacataacatgcatatctgtgatccaatattatcgtttgtcgaaaggattttttttaaaaaaaaaactgatactgtctgctgctcccaggtcagaaaagcaagcgcagccgctaaacagattgatttgaagtgaagttcagccgtatcatcagacatcatgcacacaaccatcatggtaaattcctgttcagcacgcacagtaggtctccgtgtgctctgtacggcctagtgctgctgcgctagctggttgggtgcgtccgtgcgtggacgcgctgtagcaaccagggcacccctgtccatggtcgcgatcgcggcctccgctggcctgscccttggcgtgtgcggggcgtagagacggaggagaatgttgtactatgtgcgggcgcggcgagcgaagccggctggaccagaccagaccacaccagggccagagccagggccacgtggcattggctcggcgtagagaacgtcctcccaatatctatgaatttactacaatatacgtctcattatttttagattcatatatgtatccatcacgggggcctccggcctcgttatagcaagtatgggctgactgtaatataatatccaactccgattcaaaactgtaatgtttattacaaaatttgacttagaagtagtgtctaaaaagtggcatggcaattggcatttggcaagtacaatatgcttgcatttttacgaaggcaaggcagagaattcgtccaagtgaaagcgagggtttccggtaaatctatctacaaaaatgctgggaatgttgaaaacgcgatgcccgcattttggagttgcttgtcacgtgtacagtgtactccgcagtttgttgacgcacccgacccgctccgtcctgatgaaagccaatggcatgatggtgtggtcagcgacggacgtgtgggcgtagtttctcggctaaaagttgcttgacacgtgggctagtatcttcattagctccaggcctccagacagcggtctgcctggcccgaagtgggtcccacttccacatgtctgcctggcataccataccccgcctccgccagtccgcccacgcccataaaaagtactcggaccaagcagcggcagcaaagccacgacagcagtcgaagcgcgcggcgcgcctgcctagccatcccggccacccggggccagggcccagggggaggggaaaccgaggcaggcggcggccgcagcagcggcagcgcagggcgcacgcgcttctcgtttcgtgtccccacaccccagccgagggggagttggagggaagtaaccggaggcgcagcttcaaggaggaggctggcggccgagcgttcgtgcggc

SEQ ID NO: 17 - DNA, 707 bp, Zea mays
ctagaaaacaatcagtgaaccagcaaagcagtttatttttttctaaactcaaaacatgtttatgcgtctttcctatctatattcatctgttttcagtgttggtccgtttctgcatgagttcatccttgacgacgtatatagatttgcttatgacattgttcacatcttctgacggacatagaaagagctacactccggaggaaacacggaatcgtcgacgatgaacattcccaattggctttttgtacactcaatttttgtattggtaattgatatagtctgtagtgagactatatcggtgtagacctaagcaaagctcatgaactttgcatttccttggatgatccgtagcagttgcaatttttcatttcaagtgatggatatgaactttgatgttttctggcacaatgttttgtaccctcgagttttctggcacttcgattgatgtacacacttctcaatgcttcaactgatcgagtcactgttaactagccatgtgcgtcttttgggaggaactacccatgttatttccaaatcaaaatgcgtccgtgatctaagaagcttcagcactgctaactgaacccatctcttcttatcaggccgaaattttctacacgggcctaagcccagatccaaacttccaaacgcatcttcctctcccatgctgcatcccgcagccagaaccctagccagctagcctcgtcgcc

SEQ ID NO: 18 - DNA, 1000 bp, Zea mays
tcttgattctaggaatttgattgatgttttgcacacatagctcatttacatacctttgatcatatctctttcatttgctatgactaatgtgtttttcaagtgcatttcatgctaagtcatagatkgaaagggaaatggagtcttcggcgaagacaaggcttccactccacttcgtcgaattattcatccttcgccgtcactctgtcctgctctccaatttggtataatcttcactcatatattgtttgccaaagggggagagagtttgtaaaagggcttatatttcactcacaagtatccgtttttggcgattcatgccaaagggggagaaagtattagcccaaagcaaaaggaccgcaccaccacgccaatttcaaaaaatttcaaaacaagtttaagtttttaaatgtttttcaattggtatctttgaaaattctattggtaaaaccctcttgaacactaagaggagaatttcattaaggggggagttttgtttagtcaaaggaaaaagcatttgaaacagggggagaaaatttcaaatcttaaaaatgcttctcgaaatctcattcatctacctttgactatttgcaaaaggattttgaaaagaattttacaaagaatttgcaaaaacaaaactagtggtgcaagcgtggtccaaaatgttaaaatgaagaaagcaattcatgcatatcttatgaaaatgtaaattggtttaattccaagtaacctttgcacttaccttatgcaaactagttcaattctgcacttgtatatttgctttggtttgtgttggcatcaatcaccaaaaaggggtagattgaaagggaaatagggtcaaaccttttcctaaatgattttgatggttgaattgcctaacacaaataattggactaactagtttgctctagattataagttctacaggtgccgaaggttcacaacaaaccaatacaaagataaaataaagggttcaaatcaaaggagaaaagaaaaccgaagg

SEQ ID NO: 19 - DNA, 233 bp, Zea mays
ctgcagctcactcctggaggacctggctctggcctctccctagctataaatacctcctgccggccgagtgctcactacctcgaagagcaagcaagagaggcagacacagatagctgccagtagagcttcttcttcttcttcttcttccgcttcctcttgccgagcgcagtgctacgtaggaaggagttcacgccctcgcgcacgcgtcgtagctcgtcggtcgatcgccggaa

SEQ ID NO: 20 - DNA, 698 bp, Zea mays
cacctagccctttgtactggctatccactctaatgattgtggtgacagccttgatcccattctttgtctacaaaatatcgagaacactctattatccacagtatcatgatcaagttcagagggctaactcaaagaattggtagtgcctgttgtataagatgctactgaatgaggggatgtacagtcagtaatttggtttaacataccacatgctttgctttgtagatcatgatgcagaggtagtgtatataaacaaagttggctgtttaacagatcttgtatttacggtctatgcccacaaagttacagtttcaggttgtggcagtgcgtctgtcaaatatcagaacacaatggtgacttcgcagtcacgcgaaggaactgcaagcggcaaattgattctttggacctattaccccactaggacacgtttttcttcggggtgccatcatggaagcagattgcaattaggatttatatagaatgatgtatagcatgtcgataactcgaacatgacttcctcgatatatgtagtactgtcttccaaaaaatagcattcttgtagcatcaaacggccaaacctatgttcgtggaagcatagttaataccctttattgctccaatggtttgtacatagttgtatgaatatatgagatggatcttgatgttgtttaacatttgatatgaaatgaataaatgat

SEQ ID NO: 21 - DNA, 1022 bp, Zea mays
tctcttccaccggccgacgtgcaccaccgtgcttcgtctatcggagctaccctgcgtgcactaaattctgtgcactgttgtttcctgcctcacagatattgcgttgcagtgtttatcatgaatagctaggacactgcttaccattacattagtgccacgcaggcaataatactacaagaagtgacgatgtacagatggttagtacgtaaagcgtcgtcgatcccaacttgtgaatccgttcaaggccaacgtgtatatattctgagtctgatacacatacaatgtgtaaggctgtacgtcttcaattcaacaggcaacgtatcttcctcatccatgctcttccggcgatgtgcacgtcttggagacccctatttttcacgtacggggcgccggagagctcctaaccgccttaactccgatccactactcctcagttacagctcctgccaaccttctgaacaggcgaaccaccaacaccatctcagttacagccgctgccctgcccaggcacctgcacctgcacctgctcctgccgctgaacgcgcttcaaatcctaccagcctacatagagcttacatgcagggcaagcaaggccatgcgacagtagtactagattttgtggtggctctcctgggctgggctgggctggcattatgacgtgtacgtacagcccgggcatgtagagaggcctattaataaatggagtggaggtggggagatttgcgacatttattaaggtcactctagctagctactcgccaccttcaatgccggcctgccctcccgttaatgcgggttggatgaaggccattgaagcctcctccctcccctgcatgaactctcagcatgagcatcacccctcccatcaatcaaaaccacagtgctgtgctactacccctctagtccaccaattgtcagttctctcctcctcctagctagctatatattaattcttcatacaccaagggtatgtacgtatataaatagacccgtggtgtggtggtggccagccacgaccggcc

SEQ ID NO: 22 - DNA, 544 bp, Zea mays
ataccagcagtaccggccatcgatcagatcagtgcaagcaatgcatgcctacctagtttttagcggcacggtcgcaggttgttatgatattacaaacgcatgcttatctaattaatagatcggacttgatattacaaacacgcataggcatgcatgttcagatcaaactagatacatataccagcagtaccggcaatcgatcagtgcaagcaatgcatgcctgcctacctagtttttagcggccatcgatcagtgcatgcaatcggtacctctatttacgttttaccggccatcagtgcatgcatgcaaagggatcaggcgcctgttcaagcggatcggaaacgaagagacctaatcctcatccaattccatcgatcatctatctcatcaccatatgtatatatatatatatatatctatctatctatctacagagatgagacctagcagcgcatcttctcctcgacctgtatcgacacgttcagtccaccaccatcatatccttaagggaagagatcatcatattctcaagggaagggaagag

SEQ ID NO: 23 - DNA, 1500 bp, Zea mays
gggacggacgtggggaaatgcccaatggcaatgggacgacggcgctgggcccgtactggacagacgttaggtgcggtgcggggaggtccatcgtgcactgttgcttggggccttatccggtttctatctagaaagggagggagctggttggattaggagagaaacagcgacagtggtggttgttaattactagcgatcttctcgtgtcgtgattatggaaggataggacagaggccgtacttctttgctacaagccttgtacgtagtagttgatatcaagcactgcacagtggtggtggatacggcaggagcagtggagcgtcgctaagattgatgatgacattctctgcgccagcatggttcgcggtggtgaggcggcagggtgtgtctgtctgtgtatgtgcccgtgaggacgacggtcctgttctccttttaagtggcgtcgaactgacgatggtagtaggatgagcagacgagagaagggttctgttcgctgttgcatttattttagacttggtgggccgttcggtctggctgttggtcagcccaactcatgccccatttgttgctctcgtatcacacggttcagcgatgtaaagaaagtccataataagctctcatagaggtgagtaggaaagcccatggtgggcgttgggtccggtcttggcgaaagctggggttaggcgtgctgccaatgtgcatatgggcctaggaactgaaaggcccacgcaagtgtacatctcgcctgacacacaagcagccccatatatggcccggtctcctacccagacaacccgtccgtctctcgttctctccttcctatcggctccacacctccacgcaactggaagcttcgctgcaatctgccctactcctcttccgccgcctccaacaccgcagacgcagctgccgcgggcgggagcttggacgtgctacgctgctctcatctcgtttccgcgcaggtaatcccaaagctctctgatccagtattccagtctcatgtctgattccgtacctgtgtttgtccccacaacgttttgcaaccctaaaaagcgtaacagttgttgcgcattcaggcgaaaatccgcctggcgtttattatattgttacatcattgtttctttgggtcagtaggaccctggtttaaggaattggggtctagctttggttgcaaggaacgaaaattctctagtattccaaatatgactctgacgctttatgctggctgtagcagcaaagcatcgactgacgactggcactatttctttttttgtttagaacattgttgggttacgaatctggttggctatgatgaattgtggcgggtgttttgtttagaacattattggttacgaatctggttggctatttataactaccctcaatatcctttggacatgaaaattgtttgtaatgtggtcttttggctgattgtttgggagtactaatttgaattaactctatttgtttctcttgtgacaagttcaggaattgttctca

SEQ ID NO: 24 - DNA, 1500 bp, Zea mays
gaactttctaaatttagcaacttctcatataacctcattttctctctacatttggcaaccatttagcaactccctaaacaaaaatgtggaaatgtggactgcattatgtagataatgaaggtaattggtgacatttgtgacttatttttttgatgtggataaacacaaaacaaaactacaatctatatttagagaactattagagaactcacatttttttactcccaaagttacttagcaatttcttaaatctgtgttttaaagagctaaaatttacataactattggagttgctcttaggccctgttccaagcctctagagctaattattagcaagctaataagggactctccagttttgactatctatttatctctctataaagactaaactctatatgtatcatcttattgcaacagactctccagcagccaagttagtttggctagccaagtttggctagagagagggccaatttggagagtcagatgacttgatgagttggatggctagtctattagagaattgttttgcaagtagctaaattttagcttgatgggtcattttgctagtctcttggagatgccctaacaacagctactactaacaattagttggtcttagcaggtattccacatcctagtttataagacataactactttttgttcttatcctataatataagatgtgttctctttaagtatacatacatcgatataatattatgagggtgtttggtttctagggactaacttttagtctctccattttattctatttcagtccctaaattatcaaatatgaaaactatgttttagttttcgtatttagcaatttagagactaaaataaaataaaatataagattaaaaattagtccctagaaaccaaacacactctatataaagatttaaatatattttttagtctttaaatcaaaagggtaccttgtatatcaggacgggtggagaaacttcaacgtgtccaatcactgcacagaataagccacccaaggccacaaacaatgcaccacgctccttcccaaccggagcggcgcccctatccacccacgtgcatcgcgcgaccttcgcctatctatgccacagcctggtgccgaggcgcgaggcctccccccgatgaccggaccgtccggacgttcaccggctccccactccccagtccccaccccacacctgcactgcacagtgccctgcccaccaagagcgagagcgacgcgggcccaagcctccaaagtccaaacccttccccacacccaaacccgtggcgcggggcagccggcagggcgcgccttcgccaccacaattccacaaagagacctcgcgccccaccagcctaatctcccgcgggcgggggcgggcagataacggctcgcggtacggaaagggcgagagagggggagcggagagcaccagtccaccgagaggcgcggagcaggagggcacacatggaactggaggaggcggtgccgccggccgcg

SEQ ID NO: 25 - DNA, 248 bp, Zea mays
ctgcataatgttcatgtcaaaggctgtcggaagagagattgttgttagagatgttagacggtttcaccatttcaaggatggagaatgttcgtgtggtaactattggtgaatacttttgtcatagcatatgttcttcaggtcctggcctgaacttcaattttgagccagcttgggttccaactaaacaaggagacttgaattggaatttaacgagtggacccacttcaatctgagagactcgggttggt

SEQ ID NO: 26 - DNA, 261 bp, Zea mays
aggtgtcagtgcggtcagcagctttaatacgaacccggcctcgctcccgatggagaagaaaacgaaacagaacggccagtggaagccgccgtgccgtgccgaggcggacggacagtcggacactgtccgaggaagccaggaaggatacccacccgcaccgactccgccgcggaggaatgcggcgacgaccagcgccgccgccgccgctgtaacggtagctagctggccgctcgggtcggagggaggaggaggaggaggcta

SEQ ID NO: 27 - DNA, 761 bp, Zea mays
ctgcagaggatcttgttcccgctctcccgcgtcgcggcctcgcgggaatgatggcgcatggagcacacacgaaagtgccacctgaatcccagccagttttcaggcatttgaagcgcagaagaagtgttgtttctgtagttgaccagtaggagagtaaagaaagctagcgaccacttataccaacctatcagcaaagtagtagatcacgcaatgcagtagtacttatattattgtactacgtatataatatagggtgcgtccaaacttccctttaggctttaccgagtttaagatgataggaacagccaaaggtccttctcacggtcacggccaaggccaacagacaacagcccaacaccgaacgaaaaacgcgaccggaattcctcctctcctcctagtggggacacggactagtcaactgttactactccaccaaaacgtccaaacgccggccacgagagcagagcgaaatcccccgaacgaaccgagtactcgagtggcggctggcgctcgttcgccccgcaggtccgccgcccgccggggttatattccactgatgctgtgacgcatcgagtccagacaccaggcaaatgcggcgaaggcactgaagaagccacaccgccgccgctgtagcctgtaggctgtcgccacgacccacgcccgcgcgcgcgctgctgccgtgctgcggtctgctgccactgccacgcacctgacctgtcagcagcctccggaggaggcccggcccggggcagtgcggcggc

SEQ ID NO: 28 - DNA, 1500 bp, Zea mays
gaggagattgtaaggaaaatggaccccgggccatttggctaattgagttttggtgtttgatgattaacacaacctgtggactaatatgtttgctagtgtttataattatagttcacaggatgcgaagagaattggaccaaggcaatgaggatgcaacacctcaaaagaagacataaaaagatgcataggagtccaatactcaagaacaaaagaagcccgaagaaatcagcaaaggaatccaagaaacgggctgtcagccagcgcctggtggcgcaccggacattggtgtccggtgtgcaccggactgtccggtgaggcaccggacagtctgcgcagagaggccgcagacaggcgctctctggctgtagcaccggactgtccggtgtgcaccggactgtccggtgtgccaacgggcagacggcaacggtcggatccaacggtcgactgctacaggcgccaacggtcggctgacgtggcgtgcaccggacactgcacagtagatgtccggtggtgcaccggactgtccggtgcacccgacgacagaaagctgctgctttctgtccaacggctagttgggggtgtggaggctataaataccaccccaaccggccattctctagtgtgggagcccaagcaacataccaaggcatattgtagacatttccaagtgctcaaacacccaagtgcttaatagaatcactcggtgattagcgtaggtgctttgcgaagtgcttaggttagttagaccgcattagcgcttgctctaggtgaatcctagttagttgagtgagtttagacaaaccacacaacccctcggctcttgcgtgggccgttgtaattgtatcgagtggggcgagagtcttgcgagaccgtgacaaccgtgtttgtgtcacggccgccaccgtgtaccggagggaacgaggcccgcggcgtttcggccgaaagctcgatagtggagacggcgggaagcgtccgagaggagccggaagcggagcaccacttgtgcgtggagaaggcccatggctctctacggagttactcgaccgaggtgcttggccctcacgtgggcttccctttgcgtaggggcaccaacgaggattagtcgggaccttgcgcggttccggatacctcggtaaaaataccgacgtcatccacgagagtttgcttctctactttgctgcttaagtttccgcatttatattaagcatttaagtttcaatcttgtattcatgcttatatagtgtaggttgaaacttagacattgcggtagagatagcaacacttagacaaaacctagtttgcacattctagtttgattattggcataggatttgctctagggatttaattgtggcctagtttagtaaaagttttagaagtcctaattcaccccctcttaggcgtcacccgtttcctacaagtggtatcagagcctggtttggatcatttgaaacgctttagcttcaccgctaaaagagccggcgctttttagaggaaggg

SEQ ID NO: 29 - DNA, 1500 bp, Zea mays
gggcaaataaagagtgagacacgatgatttgttttaccgaggttcggttcttgcaaacctactccccgttgaggtggtcacaaagaccgggtctctttcaaccctttccctctctcaaacgatcacttagaccaagtgagcttctcttctcaatcaaacggaacacaaagttcccgcaaggaccaccacacaattggtgtctcttgccttggttacaattgagtttgatcacaagaagaatgagaaagaaaagaagcaatccaagtgcaagagctcaaatgaacacaaatgtcgctctctctagtcactatttgatttggagtgattccggacttgggagaggatttgatctctttggttgtgtctagaattgaatgctatagctcttgtaatgtgttggaaggtggaaaacttggatgcaatgaatggtggggtggttggggtatttatagctccaaccaccaaaagtggtcgttggaagattgtctgtcgcatggcgcaccggacagtccagtgcgccagccacgtcagcaggccgttagggttcgaccgttggagctctgactggtggggcctctgggctgtccggtggtgcaccggacaggtcctgtggactgtccggtgcgccaactgcgcgtgctctgactctggcgcgcactgtagcgcattgaatgcggttgcagtcgaccgttggcgcgaagtagccattgctccgctggcacaccggacagtccggtgaattatagcggagcggcctcccattttcccgaaggtggcaagttcagcttcgagttccctggtgcaccgaacacagtccggtggtgcaccggacagtccggtggtgcaccggacagtccggtggtgcaccggacagtccggtggtgcaccggacagtccggtgcgccagaccagggtgcctttgggatgtctttagctctctttatttgaactcatctttggtctttttattggcttgttgtgaacctttggcacctgtaaaacttatagactagagcaaactagttagtccaattatttgtgttggacaatttaaccaccaaaatcaatctaggaaaaggtgtaagcctatttccctttcaccctaccacctgcaccgttttttaacattttacgcggatgattgttgaaactggtgctttaagtataaaaaaaaataaaaaagtagagagtagagatgtagtggactcatgcttgggcttctatgcaaaagatgctgccccggtttacgactacaggagcccaacaaacaggcaggcccatcttggccggcatggaaggaggaaaccctagcgctcctgctccctccaacactataaaaaccacggccgcagccgtttatcagctaggttaaagcgacgccgccgccgcaagccgtccgccttgcccttcacgaaggcttggtcctcctccttgtatcccgacctcccccgcgacagacccgtttccccgctaggctagagttatcgttcctctgcagcg

SEQ ID NO: 30 - DNA, 445 bp, Zea mays
cctgttttcagcaacagaagtggagaaatagcatctagaacaacacatccttaattccactgcttctctacagaataattccccttgtgtacaaaagaatgagcagagacaccagggtgaccatattgatcagtctcttcactttctccactctccagctcccatcagacgacgtactacgatcagcatcatcttccagcatttctcggttcgactccaaaaaggacacgtcctcttcctcgctcgccgatgtcgaaatagaagaagaagaaccgctcgtctccccgtgacgaacaacactgcacttgtcttccacctgcacaaccacgacctgaacaggtggagccatgatggtcgtttcgtcatgaatgacaaccagacgatgaccacttgccgccgactgctgtgacactgcaaccgtgtccgctgcactaaaaacgtcacg

SEQ ID NO: 31 - DNA, 967 bp, Zea mays
gtccgctataattcaccggacatgtccggtgcacaccggactgtctggtgtgacatcgaagcaacggatacttcggcgccaacgactacctgcagcgcattgaatgcgcgccagcgcgcgcagaggtcaggcacgcccatgctggcgcaccggacaccctacagttcatgtccggtgcgccaccggacatccaggcgggcccagaagtcagagctccaacggtcggaaccctaacggccaggtgacgtggctgtcgcaccggacatgtccggtgtgcaccggactgtccggtgcgccatacgacaaacaacttccaccaaacggctagtttggtggttggggctataaatacccccaaccaccccacattcaagtcatccaagttttccacttctcacccacttacaagagctaggcattcaattctagacacattcaagtgatcaaatcctctccaattccacacaaggctttagtgattagcgagagagatttgtcgtgttcttttgagctcttgcgcttggattgcttcttttctttctcacttgttcttgtgatcaaaactccattgtaatcgaggcaagagacaccaattgtgtggtggtccttgcgaggaagttttgcttccggttttgatttgagaagagaagctcactcggtgcgagggaccgtttgagagagggtaagggttggaagagacccggcctttgtggcctcctcaacggggagtaggtttgcgagaactgaacctcggtaaaacaaatcatcgtgtctcactccgcttttggttacgatttgttttgcaccctctctctcagactcattattatttctaacgctaacccgacttgtagttgtgattaattttgtaaatttcagtttcgccctattcaccccccccccctctaggcgactttcaattggtatcggagcccggtgcttcattagagcctaaccgctcgaagtg

SEQ ID NO: 32 - DNA, 598 bp, Zea mays
ttctaacagataacctatagtcacatttaacaatgacatagaatctatgcgctgtgacataaaaaactagcatgcagcaggatcaggtgtcccgtccgtcgtccaccaagcgatgaacctcggcgtggcacgccggccacgtgcgggcgacacctcctttgggtcccggcagagctcgcaggctccacgcgcccccatgtcgtcccacccacatgccgtgcaccccttggctggccttgacgtcgttgcctgatggccaccgcagctaaccaagcaccattcgggcccggtagaaatatcatggccatctctgtcgctgtggtctcgcaccgtcgtcagtccggtgccaccgttgttaacagactagtaatatatagaggagcttgctcccgccattattgccttaaaagacaaccctccgcaccggctcctcgccgcagctataaatacacggggccgccatttccagtcctccaagacttgaaccacgcaaccctctctggtctctggtcgtcctactttcttccacagcagaaggaaacttgagtcgtgagcgcagtggtgcatccaatccacaaagagctgaggttagtcagcc

SEQ ID NO: 33 - DNA, 128 bp, Zea mays
ggtacgcccttagcggccgagacggtttggtccagacatctgggttctgccaaatgtaaccggctttacgatttcgtagctatagctgtagctggtgctcgggcagctgcggtttagcactgccactg

SEQ ID NO: 34 - DNA, 1063 bp, Zea mays
attatactagtagtaagtatattatttatctaccacatgtttgggaggtctgggagcgtagatgtcactgcgatcgtagcacctgatccggccgcctgcatcaagggcgctagctgctatgcaccggacgaaattacaggccgaataatgcgtgagactagctagagattatcctcctcctccagaacccaggagccatctcccttgtttgtaactgctcatacgttatttgaaaaatacggtgggtacagtatgaaacaaacgcatgcaaaaaaaaaaaaaactgaaccatcacctcgaatttacagttcatactgaccaccctgaagcctggaatcgtagaagaacgaagacccatagtactccagtgaccgacaacctctgcgtgcatgtcaggtttggaagaacctggcggaccactggtgtatgactacgagcagccgccgagccgagcaacaccgtcacttgaattcgctactaggttcccggccggccggggaccctcaagacgctagcggagtagcgccgccgtctcgccgccccgatcccgcgcgaggcacgagggggggccgagtacatcgaccacacgtctcgcatctcgcgctacccgccgccggcgcggcgcatcgctcctcccccccttgcatgcatggccatcacgtgcccaaccacacccctcggcgccacgcgggagtccctccccctccctaccgccgccatagccgtacgtgtgtccccgccccggcgcagcctccgcctcccgtcccgttacgcgtgccggagtacaaatatctcgcgcgcggtctcgcctcgcagtaaccagaaaccataggcatcggccttgggcgccacacgatttccggcagcatcaacaaccgttcaggctttactccatagtccatacaaatatttatacggcccttaccgcctcgagcctataaaagcgccgcgcctcgcccctgcacagctcacctcacctcactcaaaccgagcgccagttgccagcacgaagagtaggagtaggaatcgaagagtgagtgaaactgaaagacgaggaggagcc

SEQ ID NO: 35 - DNA, 210 bp, Zea mays
tgtgtgcagagtgcagtgaacagtgaaacattggaggacacgatacagaaaggcgtcaaccgtcgacattgagaaactgaatcctgcctttcttttcatgcgggagctgccagagcttcacatggtttcactgtgaagacaggtgcggaggtccctcttcaccatggatttatatagagaatagagggcatcatagtacttcgcatctca

SEQ ID NO: 36 - DNA, 226 bp, Zea mays
cttgccgctttgattgccttctccttcccgcaactactcatcctttccatcaaaactgagcaaacccctcatcctattctcgcgcccggcgtctcccttctccaacctccgtttctaatccgcgctgctaatcccactcccagtcccagctcgtccgctgagatggacagtagcagcctcaaatccgcgcagctcctggagctgatgcgccagcacctggccaccg

SEQ ID NO: 37 - DNA, 115 bp, Zea mays
tgttggctccttggctttgttatcgaacctttgagggattagagttcatgataagttgacatctgtttaactgtttaaagtgtttctaactaaactctctacatttgatgatagc

SEQ ID NO: 38 - DNA, 712 bp, Zea mays
ctgcaggtaccacacgcctgggtgaccccacatgtcactcggacatgaatgaatgcaggaggagtactcggcaccaacctcatgtcctgggctgggcccctcgctagcgcttaggctatccgcaacccttactcctaaaattttccccctatatcactttttcccctattttctcccctatttttttatctcccgcaacggttctccctaaatacttcccctatatctcactaccactataaaatatcattttctgtaccaactatcaattttttatctactaacaattattcgaggacccatagcatagtatttgaggatgaatagtgacacactatatctagagagagagaaagggaccggcgcgtagggggcgtcgtaggggcaccgttgcggcggtagagtgccccctacgcgccgcatgcaaggggagggggctgaatggggcagcgttgcgcatagccttacactattctgcggtcagacgaagagaaggccgcatctaccaccgccagtcgcgacccccgtggctccatccatccgcgggcccgcgcggcatctaccaccggcgcggggccaccgaggacttggacttgcgttcgccttgcatttgcacgtgacgtgaacgcgacgtcgctcgctcgaccactgcaccaccgtggctcggtcgacagtgtatacaactgctctccatttggaggcagcagattga

SEQ ID NO: 39 - DNA, 515 bp, Zea mays
gagccataagccacccactttctctagctcctcagatccactccaggctgatgattggttgaagtcaatggagaagatgctcaacattgcccaatgcactgacagagagaaggtcctatatgcatcgggtcattgtatgctcaacagagaaggtcctatatgcatcgggtcattgtatgcttgtcggcgtttcgagaccggggggtccctaagccgacgagtgaatgtcgccgcgtgccccagcccagatgggtcggcgcgaggccgagcgcgaaggggggaagtgaggcggccggagtccggcgtgagagaggtgggaatcccgcggccttcgtgttcgtcccgcacccaggtcgggtgcgcttgtagtagggggttacaagcgtccacgcgggagagggagcgagcggcctcacgcgggcgcctgtctcgtcctcgtccccgcgcggccaaccctctctaagagggccctagtccttccttttataggcgtaaggagaggatccaggtgtaca

SEQ ID NO: 40 - DNA, 1500 bp, Zea mays
ctttagcagtatactatcgaacctataaattataaacatagatagttttactagttatagacacaaaattatataataacgtagagtcaaaactagcaaatttctggtctgctgggtttcggtggagcttaaacaaccaacgagacgtacatgtgcagtgggacccagcgtggggctgcagtgtccagggacgaggggtggacgtggctagggctgcaaaaaaagctcgaggctcgcgagccggctcgggctcgatcaggctcggctcggctcggtgaggctcgcgagcctaaacgagcccgagccgagcctaattccatggctcgctacactaacgagccgagcccgagccggctcgtgagccagacaactcatgtagtacttatgttgtgacactattatatgactatgttattgatttatttccttattttttatggacctaatgctatatatagtttaaaatatgttgctagatgttttatatacatatttttattttatatataataaaaatatacaatttatgctctaaattggacttcgtgtggtggctcgcgagccagcttgagagcctaagcgagcttaattagatcctgattttcgagctcgtaatatgatggaaccgagctgagtcgagacaagcctggctcggtaggttaccgagccgcaccaagatgagccgagtcggctcgtatctagtcctaaatggcgcccctggtagcgcacagcttgtgtcgttcattcagcaagctatcgttcgtttaacaagcagctctatctctatttatttattctattagatgttggcccctctcgtttctaggcctcaacggtcacctgtgttagttcggctctgttctcgagttagctgtatatcatcagttcattcgyttttatattaagaactagtttaggagcgataaaatctaagaaaattagagagactagggcttgtttggtttgtggctaactgtgccccactttgcttaaggttagtcgttcgaattgaataattaaccttatactgaaaagttaggtaaagtgtgataattggggtaacgaaccaaacgtgccctagattctcttgcgagggagtaactttccctttttttttttctggccttccccttccgctgcttacccagaagagatacggccgtgcaaccgtgacgtcagcgcacaatgacagccgttcaatacacttgtacttccgatccgacggctactactatcgaagcatcagccagccatcagtgtgtgacctttttcttcctccggaaggaggcacgacgccatcgaaccgcctctccccgagtcccgtaccgtactcttgcggtcttgccgctccaacatttcagcccccacccctcatcaatttttcctcatccgccttcgtcccgcacgcttgccgtccaaccgctcccacaggtcgaggcggggagggggaggaggaggagttgctggtgggtgtggattcgccgtcgattcgagtctgcg

SEQ ID NO: 41 - DNA, 1350 bp, Zea mays
gtccattatgtaatcgatgtgtacgtgaatttttttttatcctgacacgtacatggttcgcattcggtttaccttctaaaaccaggtgtgacaacgcgcttgttcgattccagcaggataaccgggacatgtttatagggagctagccgagcacaagttgaaattctatcctcaggcgaagccgattcggcagaaattgtgtcgacccctagcaagagagaagcaatccgagcagagttggctcggctagtagctgcagggttcattagagaggttatgcaccccgagtatgtggcatgcaaatcatgtttttatactaaaaaagaataatgtaggccgacgcatgtgccaaatcaatctattatcactgcctttacattcttgccttaggagtagcaggtagtcatcctcatcctcaatcttcacctcccctcaactctacgttgtttagaagcgtatgatccggacccaagacaaccctatgatctttcctcctgatgggatccctccccgagggcgagatccaggttctgtaagagctcatcgctttctccccacacatcgtggacggtccggtgacctaccgcggatggtccatcgcctcacagagaggttcctcaaggtggtctcgttcctcgtgaacgggatctagagatagtaagtgcttggcccgaaagggtgccaacacaagttctatgtagcattagcaactgaatatatgtaaaagttatagcagtacaaaaatgatgagaaccaaatataggaacatgccaatatgccgtccgctagagctctttttactgttcagcgcggggacttcaaaactgttgaacgcacatgccacatggatgcatgcatgcagtgtgctgaaagggtaagtgacaatacatccatgcagtcaaactcgtcgtgtgcccgttctcggcatctagttagcacttagcacttgcagtagtcgttgtagctagtaggacttctacatctagcacggttggttgttagaatccttggaacagtcaaacacaaaagttaataacgatggagaagcgcggcggccggttcaaagtttacgcgaggaagccaatcactcccaccaaccatttcttagcccccgcgcgcttcgtacgtactcctatataaaccgcacggcacgagtgcatcagaacgtacaccccaaggcgccaaagcaaagcaaggaaaaggaaagcaacaaggaggactcacgcagtacgcgcgagacctcgagctcaagtccttgcttatctttcttgctgcaaatagcttgaagtcgatccgcgaaaggacgaccgcaccagctagcattcgttaccttcatcagcttcgacagca

SEQ ID NO: 42 - DNA, 201 bp, Zea mays
tgacacctggtatctcagtctcgtcgatcctcttccaccacctccacccaatctttcatcgcagcctcaccaccattccaaccgccgcctccatctccttcctcgtcgtccacggcaacgtccgcaccgtcaaccatgggcgatggcgatcaacacaccatggccgaggtgatgacaatgctctagtccctgaccaccgcc

SEQ ID NO: 43 - DNA, 1500 bp, Zea mays
atagccgtttgcactttggtcccgctgaaatgatttatttatgtgatgcgccttgggtcacaaaaacgtgtcttctaggtcaacgctcaaccgtcttgatcaataagtagcttctaatattctaatatggacacctaaaatatatattggtacatttgcaactaaaatgcttgcgaatcctataaaccgaatgatttaatatctccactgtaggagacgttagtgatcaaaagaagcaaagttaaatgttacaagcactccctctatctatcgtgaaaaaaggaaattaatcctcacatatagcatctacacgacaaggtgccattatttggtggtaagatagattctctgattgttatcgggttcatgataagatagattctaaagtttctaaactcgcggtggcacgccgttgagatagatgcacgtaggagtgggttcccagaataatgtgagcgccgccgccgtcagcgcttcgggaaggccgtgttgtgatcttatcctctcaaagaacagacagggccatcaatcatgacccatagaatggatccgtctggtccgccaccccccggaatttgccgcacaccgttttctctttctttcttaccttgctttcttttttttttctcccgattatatttgttaataactacatctttttcttctttgttttttcttttcttgagaacttttgaaattcaaactgacttaacatgtttcgaattcgagcacgtggagcgccgtctaccgaaggcgaagcgaagcgatgcgaggtgacagttgggcgaggatggtgaggtgtgagaggaccacaagacagcagcagtttcgtagaggacgtgcgatcactggcgagcacacgctgcaactaacagaaatagtggctgtggcctgtggttgtggcccaaatcctactgccaatggtggtcttcccttgttgcacttcttttaaggctaaggccccctttggaatggaggataggaaaaaatataggaataggaaaaatataggaattgagatggtggattttttgaatcctataggaattgaaaacaaaggaactgagataagaatgtctttggtagcactataggaaaaataaaggaatcactttgctgtgtttttgaatttgaaacaaggtagccgttgcataaaagtagcccgacgcgcgaacattttcgccaggaatcgttccaagaggtctgacctcttggtagatttcctataaaatcagaccacggaacggcaatcctatggattctttcctttatttttttggaaccaaagggggaaccaaagggacagataggaaaaaatccttagcaacagtgatcctacgaatttcctttgccaaccctccgttccaaagggggcctaaccctrtgggcgccctcggcagctgttctgctcatgccagagctacttttttttctcccaaaagggagttccacagccatcttccatcaaactatccaaaagtcagctgttgactgaaatcc

SEQ ID NO: 44 - DNA, 1104 bp, Zea mays
ggtaagcaagggcttctccgctcatcgccttcggcatccattctaatttcttggtctggtgcggtctgcgggattgctgtttcgtcttctttttccccccttttgaaatggaggcgtggtggttgggtttrgtttggtggatcgtttcgtttcttcctggaacttttgcttttttgctgtgaaaaaaaggaggggcgcggccgtcttcttcttcctcctccacctcccatccacgtccgaaaatcccgtcctcctccggtttctcccggcataccaagcccaaattcccggcacaccgtcatcgtcgcccggcggcgggagaaggtctgggtcctcgagacgggcgatgagagctcgtaatccttttgcccccctcccctccacgccatcctcatttcgtcgtgccgtggggtgcggggatccgtccggatgtgtttgatttcttaataagtttcgatgttgttcgcatacaataaggtagaccgagcccgaccatgtcagcacggattgttcaaagcacttggctttctactctacttgggcgcgttctcattctttgcgttcgtgactccatgcatttagtgcaggattttcttttttttttcctgcgacctgctgggtgtgtagggcagactaattcctccatggttcattaggttcttcagcccacgcacgattgcagcatggatcatcttaagtcattttcgccatataggttaattcttggcaggcaactaaacccgctgtgcaattctgttttatatacataaaaaaattcagggattcaactgaatcccaatgcggcaatgccccagtgagcgtcgtgtctacgaatagcattatagcaatgcttatgtgcatttgtaacgagttatctagcagcagcccctcgggtgggaggggaggggaatgatagtccctcttgcccccactttctctccccccctaacttccgcactttccctcagcaaatttctatcactggtgtgtgtgtgtgaactttactcacacctcatcacttttctcttttgcagttaaagcagttgaaaacatttccgatacagctggcaagctttacttccgataacatttgtgcttatcagg

SEQ ID NO: 45 - DNA, 1500 bp, Zea mays
ccttttgcccttgcccctctctctcacctctcttttctcagccttgcttccgatggatcccatcccactgccatcctttctttcccttgcgcgcattgcctagccggccggccggcctgctattaaaccactttacccgccccctctcgctcacgctcgacgcagctcccttttccttgtttgcttattgcaagtctctgcaagaacctgctagagaggaacaaggtagagtagtatcgcttttttccatctaggttatctctttttacatgaaaaatttcagccgtatttcgttctccatcagtcctgcgataatatatacgcgcgtcttgtgtgatccggcatatgtatagttcctgctaactgatcgagatcgctctcgtttgtactttctccctttgaggaaagagtttccccttttctgtgcttcaagttcttgtaaggaaaaccatgcctgccagcttcttctgctacttgtatgatgattcttatttgcttattacttgatttccgttttttttcttgctttctatatgtatgtatctgggctgtcttcccctgcgtctcgttactgctaagctttggaaggtttcaactctttgtatacgatgaggtttctgctcctagtagcagatccgcgcatatgactagatgtttgaggaaaagaaaagggcaagacgctatatatatatgcagcacgcagtcgcacatatattcagttttccaatctgcctcttgctttatgataattcaacttgcgctgattatattcttggctacctagaaatgtctaattaaactttgtttgctagctagattttgttgcttcctttcgcatctgatctttttatctcttctgagtgctccgcaaagccttccagtgttgaagaagctgctggaagaacgaagagatgagctttctcttgaaggaaaaagagatgatcattgctggtttgttgttgtttcgtgtttttttagcttcttgtcccccatttatatttcgcgcctaatgaacgagctcgtagatcttgtgttcttgtggctggttttgttggatctcgatctcggttacgtttacatgagtctactcttgcctaacatacatctgtgttctttttctaggctgagagaaacttaactgatcgagtctgcctggcaggcatcgatctatccagtcgtcagttcgtcacatccgctttttcgtatatatcatcttcagattttaattgtccatctgtcaaatcatggaaaatctgtcgtctttgcttgtattctcttctgtcattcctgctgcctccggcggatcaattcttgaatcgacccgtgttcctattcccttttgttagacagcccaaatcgcttgctcgatcgtagtgtactgtactactgcggctagctagatcttccaagctagctagttcgtcggtccctttgatctgctccacttgaactcttttgcgcttatgagaaaacttgctgctttcagctggtatcgccagc

SEQ ID NO: 46 - DNA, 1437 bp, Zea mays
tcataatgagtctattgcttttgtcgaatcctttgcctcttcttttcctttgtcttgtctagctcattagcaaagaatttctttattcaagaggaacagatggataattcttggcatcctccctcgatgtgctaaatactccttgaaacgagtagcactgccaccactctttccttcatgacaatacttgcacctgaaaccttgaccaatcttcccttgatacacccacactaggtctggcattttacctacaacaatgcaaataattatgaaactaatactaatactaatagggaacaaatacatttaaacatctactatcaactatttttaaaataccaactcacaactatccacaacaaacgaataccagaaacatatacgataatatactagtaaggaatatatgctgctcactataaaataaatttaaaatgtcaagtacgatgcaaataattgtctgaaaacactgaactatattatctcacctacatcaatgaaaataattgtgaaactatactatcatgtaataataacaactaacaaatagatttgaaatatgaactatcaactattttaaaaaaatcaactaacaaatgtacaccaatcgtcatcttctaccactgaacatataatactactaataaatgtgcacaaacctaaaaacgagtggaaaacagtgattaccgagcagttatcaacgaatcttgtcgttagtgtgccgaatctcgtccgtgtctaaagctggcgcgccctcgcttgatatgtcagaatccggtgttttcttgtcaagaaacgatgaaatctgaccgaatctcgatgtattttgggcgagatctctcattagtgtcacttgcgacagccgaaagctgagggagtggaagaaagagagagaatgaaatgagtggagttgtcgggtgaaggctgtgaagtacataggagattttttattaataggttcgagtttcggttaacggttcagaacaattgaatttgaattttagtttgtatgaaaatatagattttttttaacaataaatatacttctgaacttctaagaacctctaatttttataaactcttttcaaaacttttatatttttttaaatttcaaacgaaaaatttcaaaaaatcagtgaatttcgtttccgtcgtttgtcgggaacgggaaaaaacgcccaaacccgtcgaatcccgagcgggatttatatcccaacgacacaaaactctggaagtcccgcatctcccgataaaacgccgcgaccacacaagaagtgacctctgacctccacagtctataacggcacgaccctcgctcatgttctcatcttcccactccttccatttgtcctcttcctctccctcccacgccaccgtcaacgagctccagagccccgcaccgcgccgcccgccagcaaccaccccctcctcacccag

SEQ ID NO: 47 - DNA, 480 bp, Zea mays
tctagagatccccctgtgccacagcgaattcaaaacagtagaattgtccatacagctctagcaaatagaagttggctaaatgacattaaaggagccctcactgtggaagttcttgctgattttcttgatctttgggatgcaattctcacagtaaacttaaatccaaaagagaggacaaacgcatcttcagatttgctcataatggaaagtattctgcaaaagtagcctatgaaagtctcttcattggattaacatacttcgaacattgcgataggatttgacactcctcccccccccccaaatgcaaattttccttatagctcgtggcgcttcagagatgttgtaccgctgatagacttcagaggagggggctggatcacccagatcagtgtcctctctgtgaccaggaaccagaaaccattgaccatctccttgtgggatgtgcgttcgcgagaagctactggttcaggatgctgggac

SEQ ID NO: 48 - DNA, 206 bp, Zea mays
taattttacgaatgtgtttgatggtgatgacaaatatcaaattgtctgaacgaaaggctgccgtatggaggaggggaacagctgaaatttctccaaaaataccaatccgccttccatgttctcgtcgctgcctccgtctgacggctcgaagctccctccagttccgatctaaacccgccgaaaccctaatccccatggctgccgcc

SEQ ID NO: 49 - DNA, 1500 bp, Zea mays
tctcctttacacgccaacagctcgcccctctccgtctgcttgattctgctccaggctccagcctcagaccggcactcgctcaaaaatgtcattacgcacccaatccgcttgtagctgtatgctggaacctactctgccttgtcttcttgcatcacactaagaatgcgcgcaacccccacccacccacgggccacgactaggccggcctttgctgctgtcctactttgccacccacgacattggccggcgacgagcaccaccaggacaccaggtattttctcccccttggtcttcccttcctgctgtgcgaagtcgtgcgcccaaactgtaacgtaattcgtaggtcaaaacatgcgcccaaaccctaaaatactattcgtaatcggatctgaatccaattacaagtgtatatgcatgtgagaaaattgcatttttaggactccttttatcgccgcttcgacaaaacgagtcagctttagttgttttcgcgaaaatgacacaaatacgtcgtccgtccttgattttttaggacatgaatagtttagatagcagatttcaatcctttttaataagttttatagttttttgtctctccagaacataagaaaggaccaaattaacccaagcagatagatctcacggaaccctacgttctttcctcctgttccagtaacctctattcttttctcaggatttcctgatggtttgcaacaccgtggaatccttctttcttctttccagagctagcagtgtcagcaaaagcagacacggtccgtctttgcttgttacatatacatgaaaattaaaaaggaacaatgtcttttgagtttttaaacaataaagtcctaaaaattaaaccgccacacattatttatgccattttctagaactcaaacataagtgtgtcaaatggtcgaagcggcacgaagatcctaaaaagtaaaaaaaaaactcgatgcatgtattattatgcctactaaatttggttgctttgcaaaaattattgggtgtacatgtgtaggcacgaagatcctaaaaagtcaaaaaaaactcgatgcatgcattattatgcctactaaattcggttgttttgcaaaaattattgggtgtacatgtgtacgtccatgtcctttactagatccgcccctgctgtcccaaaccctaatttaagctatttgtatttggatctgaactagttgcaagctcaagcatatacatgagctgcacctactaacttcgatttgttgcaaaattatcaggtgtacatgcgtacttgtccacccatgtcttatactgggtccacccctgttaacaggtttcaagtttcacaattttaattaacatttgtttcctcctgggcagggtttgaaaacttctcatatgctcatgcgttcggcgctgattgttgaaagtagctttgggactccgaggacctaaattctaatcaattgtgaaatctgaaaggtgtagctatttgtacttctggaggtgtgggaagaa

SEQ ID NO: 50 - DNA, 1487 bp, Zea mays
ctatatcagagtatgaaaggcgggaggagaacatgaatatcactaataaagaaaatgtaagtgcaacagactgtcttcctcatcttttgttgcttccagttaataccgttgatgaaatagtccactatccttagtctggtttgctcgtcgtaccttatgaatttatgagttcctgttttatcacatgtaggtacattttgttttgtgattcttgaattgcctaatgtgttttgccaaccagtgaagttagactcaattgggttgcctttgttcttgagttctacctagcattggaatggacacattattaaccacagtgtatgatgtgtggattgtgcttgctacttcttgtggtgctctttctagaggtttaaccattgtcacatctctcatggtattgttttcatgtaagcactagatgtctgcatgatgttgaagttgagggacacgtcataaattaaataaacttggacaatgttgatacatggtctatacatgcagatttagggaacattcatttcccagaaattaacaatcatgtgcctgaaatcccgttttcatattctgctagcgatcagtgatcacaaacctagatagggtatggtttcatcaggtgttaatgaacccaatacggttggtaggaaaacatcctagatttagaaactaattatctttttcctaagaatttgtttcctatagatacttatagctgcaatcttgaaatgacatcttcaaagtagttctatagtctcatgaagcacatatgtttttatcgttccatttgtttatgccacatttcagagataggccaatgaaatgcatttgttgggggacaaaagaacaactaaaccagatagttgggcatttgaacattaatgagattgccttccaaaattagagctgacagactgatggacacctctcatgtgtcatctaacatgagcgcatataatagaaaaaaaatccagtcccactgaatatcttctcagttttgggatggaatcttgattgctgtgcatggaataaagcatttgtctcaagacatttagctgctactcattgttaattggtaataacaatttgaacatggttagcagactaacagtttcatctatgtaagatagtcagcttcgcccaaagctgcatgcaagagacatcaggccttgagtgctcttgcgtcttcgattctatctatccacagcccgttcattttgcatgttatgactgctaggtagaactccagtactatgaggatcaatggtcaaacataaaaaattgaagctggatcagagaattttatagcgcctgactccagtactaccatgtcagtcacatgtttatgactgcagttcacaggaattttatgactgcagttcattttgtatcttctttgcatcactattttatatgttctcaacgcacaccttaccaactccagtactatcatgtcagtcacatttttatgtaggtgccatgcttgataaaga

SEQ ID NO: 51 - DNA, 303 bp, Zea mays
tatatatatatatatatactacaaggcgcggtggggacgacatgccattgtcatgtggggaacgaccatggaaagcgagacatcaccaaccaaccagaaccagcaggcgaggcggatcaaatatgcaaagcatggagagagatatagctagagcctagagcgagcaccagcaaaccaaacaagcagaccaccttctccacccggccggccttcgtcttcctccgatccccaggccccagccactccccgtacaagccaaagagaccagtaggtaggcaggcagttcatcgtcgatcgagcaag

SEQ ID NO: 52 - DNA, 67 bp, Zea mays
tggtacaaagaataggaaaggaaggggcataactaagaaggatgacatattctcaaggacacctgac

SEQ ID NO: 53 - DNA, 389 bp, Zea mays
ctaaatttatgatttagagagctaaaatttacataaatattggagggggtattttgatcctacatgaatccaacatgctttcgtcgttccctacttcattcagacagacagagacagtcagcagcggtgtgattgtgtgaacatagaagaatcaacagatcctttccttggagacgatcggaggcaactcgccatctttgaccgaccatgcgcagtctccaatcgtgtaagtacgtcttccattacttgggggcgggggcgggggcggctataaatatacacggccagctagcagcatccaagtcagttgaggagttgagttccgctccgccacaccaaaaagaaacaaaagcctacggcgatcgatcgagaagctggtcatcgtcagg

SEQ ID NO: 54 - DNA, 283 bp, Zea mays
ctgcagctagcttttggtcaatatattagctattgagagaactttgataattatgaaattactatgttgaataggtaaaaagtaattagcatcattgtgtttcatagtggagtatgatgttcattgccattactaacagatacatgttgatattaatttatctgaccctgcataatggtatactgcatacagatattagctacagagagaactttgataattatgaaattactatgttgaataggtaaaaagtaattagcatcattgtgtttcatagtggagt

SEQ ID NO: 55 - DNA, 1409 bp, Zea mays
aggttggagttgctccgaagctacgcgcaagagagctttggctaaataacggaaaaaggaaccgacttaaagggaaagaggctatctagtcctcatagatttgcctatgagtcaatagtaaatataaagggcatgaatgtaatttctcacaggccgcgtactgtgcctataaatagatgaacagtacccccgtactgttcacgctgacttgtattcacttgtgcgtcacgcttatacttttaccttctatcaaaccaaaggtacatttgtaattcaatattgtttgtctttctatgataatataatgagaatgaattaataatgttacatgattgtttacgttgtttcttatatttcgtatgctttttctcttattaacatatattgctatcatgaaggtatgtccttcatgaccttcgtctgaagatcattatatcctaaaggaaataatgcttcgtaggacgaaggatattaacatttaacattttgtgttggcttattcttaattcatagcatttgagaacaaattctcaacatatatatagttgtgtagtccgtctcttatttttttacttagctttctaaagacctcttaaccgaccctccctcaacatgctctttcacgctaaaattttctctgataaacgtgcattcttgtcggttagattatcattcaacaatatattatatttaatactttaaatctttcatcacgtagattttaaaaagctcctaaaggcatgtacaaactaaagaccctaggataattatataatacaaaagacaactaataaattgtatgatataatctaatcttctagatcgtaaatatagttaagagacaataaacatataaaatcgtgaaaagacgcgaagaatctgtctcttttttacttaaccccttagagcagtcccaacccaagatacttataattttttatagccttcacgtcatctaaaaactactactcctcttcaatgtaaatatcaatattattgaactgaaattaatacacctcttctcttattgtgtcttagatatcgtgttgaaattaagtcttatgtaagatccagttttttactctttcttcatttagttgtttatcactatgtggcagctgaattaatactataaaaactgaatgacgcggagggttatgattgctcttgttagatcgaagaggattggaggagcacctttgatcgacgtaactgaataagtacttagatgagatagtatataccataataaaccatagtttatatctgcgtttagatcactcgtttggtcgcttccatctcaagtgctggttgtgcaacagtcattgccatcctccatccctctgaactccgaaggccgaaccagttccgacgaaacggtacggtgacggctcacctcgggggtctcc

SEQ ID NO: 56 - DNA, 1500 bp, Zea mays
agttttgtaccataaaaatatagccatttattatggcaatcttctttttcgtatctgagttgcagagtgtttggcattctgtccattgtacatataataatatatttaacaccatgcactaggccgtgcgttctgttcccaagttccgatgccatggagtgcattctggtcgtgtttcagtcgctgttgtgagggtgtgatctacagatagtactgacagatgacaatgctgtgctcgacgtacacggggagggagcgatgaatttggactggattttgcaaattcatcgccaaagcttacagatgtgcagaatacttttatccatgaaaaggtctagaagttgaatatcaatcatgtcttgattatgtctataagctagacaggcactgaaacaagcaaacaatcttctcgtgcatggtatgccgggttgagtaagaaactttatgctcttgatttcattggatatctttttattttattgcgataagaatgatatatctatgtttattctagtatatgtttacgatataatcatagatgtttaaaacatgactaccacaacgttgttgtaggatcttaacaagacttcttctcatwgaaggattctatagaatgttcactgttctctatctctctacaattatttgtcgaaaatccacgttgtccactgcgcgcaggcggtgccgccgccacgtcggcccgccgcggttgctccgccttgcacggtcgccattattcctgccgccggtgaccggtccccttccacgtctccccgtcgcggcagaatttgaggcggatgtatgtagcgaaagatggcgatcaaggagacgacgagaaacgccacgttcgttgtcgagacgtccaacggtgagaggccgccggagtcctgcccctgtgaggcctgcggcgtgcccgctgagggcggggtcgccgggtggccggcgtcctcctgccgcggacattacgggcatcggtagaacaggaaacggccactcatattgagacgaacttgcatccatcgagtacgaataaatacttatctacgtacgtaattataagacgatgattcttgaagaacaagaataaaacccggatgagaagcatcagccggtgtagtgccatttcaataataaaggagataagagatgaaactttgcagcattccaacaacattttgcagattcacacaaatacagacataggttggaaggtttcttcttcatcgtcctcgatcgatgcagatctcacaatggcacaattatggttatcaaggatcatgcatttctttctttgctatgaattagatagactgtcgaattactaaaacctaagtcgcacgggccggtctaatcttaaccaaagtacatacatgaagcggttgcatcttcgcgagagacaaaattcactccaagagccacctaattattcctagctaggctgagctgaggtttgggtccaccctccgccgccggcgacgtcgacctctggccgcggtggca

SEQ ID NO: 57 - DNA, 1306 bp, Zea mays
aagccattcctccccggggtgagagcactccattgtccctggcaatctcaaggcggtgcagatatggccttgtaatctacctgtttgtttttatctagattctttaagattaatctaggcatgtttcgctaatgttattagctttctacttagaaagatacataaagacggtaaaatcaagcctataaaatcaactttttaaggttatggattttcgaaaattaaataaaaagctagcggtttgttttagcttatgacttttactctaagaaatagctatctagaagctcaaacaaatagagccttaagagcatttgtaacaaggtgactcaaataatgcaaaaaattaaaatactacatcatttacatcattcaaagtgtttaggtcactaaaaacaaattgcgctccaacaattaagtaaaaaatcatgtattttaggaagtaaaatatattattaggaaagaaaatgatgagaataatgtaaaaacaaggatagagcactagtttagggtgtggtatatttaggtcacttcatggtgtgtcytatatttttatgtgttaatctttatattttaaaaggcaatgtatcacgtgcaaaccaagttttcgtgcaaacaaactaacaaaagtcacaaaaaattctaagaaaactacagataacttaattgcctactctaccactatgtaaaatttcaaattcatcatgtattttaaaatacaaattctgagatagttttcacatttttatatcatagaattttatctttttttgtatcttataacatatgatgaatttaaatttgaaattttatatagtgttagagtgggcaatggaagtacatccataattttttgtgattcttgtaacttttgttagttagtttgcacctgacacgttgccattttaaaaaacgacactcatttaaggcacgatcacagacgatctaagaacatgtttgatttttggagactaattttagatcctctattttattttatttagtttataaatgatcaaatatgaaaactagaatagaatttagttatcataattagtaatttaaaaataaaataaaataatattgagtaactaaaaattagtccctaaaactaaacacccctagatcgaacatgttctttctttacttcagccgctctttcccactcttcacttcgcccaatttctctcccaccctcctgctcctcctcccgcggtcccgccatttcgtcccccgctcaccaactcaaaccccctccgctctcaaaccctaaccctagccctagcccgctcccggcggaccgacg

SEQ ID NO: 58 - DNA, 483 bp, Zea mays
ggtgggttttctgcggcgctgatgttttcctttggtttgatagctacaaattttaatacataatccttggtgctctgcatgagttgcattcaagctaagcaaggcgtagctgctgcctaggttccccgtccaccgtccaacgcttgcagctgcatccctctgccagccaggtggtggtgggtttagggtttagggttcctatatgactgggatggagcacgggccgatgtggctgcctgctttaccgaatctgctcacctatgtgactatgtgagcatgcaggtgtgggttgagccgtcggcgaccaaggacatgatggacaaggtggagtaggtacgacaacggaggaaggccgagaagtccctgctcagcttgcaacgaaggttggctacgacaagcgcagaagaattggagaatagtggctgtcagaagacatatgcgagccctggaaaaagtggtgaggcatcatttgctaatgcatcc

SEQ ID NO: 59 - DNA, 134 bp, Zea mays
gccctgccgatatcgaggataggcccacataccaacgataacagtggtgaccaaaggtcagaacggcgcgttgacgccgactgatcgtttcgcggcagggacgctcgcaaacactacttctgagagctccccct

SEQ ID NO: 60 - DNA, 270 bp, Zea mays
catgctgcatgcacacttgcacctatcaacaacaagagcccagcagccagcaccggccgtagaaattgaacttaattagtagttgcgacttgcgatagtaagtaagcactaagcaggaaggaagattcattgaaagaatatataggcccggcccggatcaatcagactgtaccatgcacaaggtgaatcacctaagaacgaaaaagatagaccattgaggttttatagatttattaggtatgtaaaaaagcgaagataattcatccggcc

SEQ ID NO: 61 - DNA, 1500 bp, Zea mays
attcatacaatattatatatatatatatatgtattatatatgtatatagatttattgtcatctattgaacatggacacaaaaaaaataaagaggtagaatgaaccatatattaagacagagaatataatctagatagataatattctgtgcatacgaaagattagtacacacgtgcatttatggaatcttgatctttaaaatcaagtctctccggcacttatcctactcagtagtcagtactcactctctatcagtacattctacgttcatatatatacactctgctataaacgcacgtgaacgattgcagcaccacgcatgcatctcccattggccattgcagccctatttgggaccaaaatgtcgttggtgtgtacggtccagatttcgtgctagggtctgcctctgcctttggactagtgtagtgtctaagtctttctcataccttacacattattatcttctatcctaaacgttattttgtaagcaatatagtctagatataaaataatgttttgtataaccatataaataatctgctggctatagactaaataaaaccctattttagactgctacagggctaaaaaagttagtcgagttgatgaaaaatggatctacgaacctttagatcacatttaaataaataaattatttattgtttaaattttaaataattttaaactatttaaatttatattataaaatacaactctacaatagagctggaatctataagactgtctgtagtctatctatagtttactcaaaagcattgttttacctatttatagtttactcaaaagcattgttttaccttgtaggttgcattgttcgtagagtagagtttaaatatgaatataaggatagataaactgttaaagatagtctaaacggctgattcgtttactgcgcccgcatatccagtcccatgtgagcctagctggccagatacagtcatttctgacgtatatgtagatgcatataaatgatttttttacatccactcatgcagccatcgtttctcgcgtaaatgcaaccaaacacacatacgctcgaccaaagttaacgcacacgatgattcataatagaatgtgagggtaaccaatcatgcggtaatagtccaaacgccctctaaatacattattggccctgtttggcacagcttatttttagcttcttcacaaatttaagccgaagttctgccaaacagacagcttctgcagcagcttattagttcagctgattctcaaaatgaactaaaagcagccaacaaacagaagctgctttttaccagcttatcagataagctgctttttcaacaagcagcagttgtaccaaacaaggggccattgtctgcccatcacaggaaatgaggaaacgaatgggccagacagagatgaatcaatggccttcaatagttgatataaccaactggctaatgttattcggcgccggtaagacacacaccagcgtggagggaaagattagacgccgac

SEQ ID NO: 62 - DNA, 340 bp, Zea mays
caccgcgccgctgaccggaagctccaccaccggagacgccgtgaaccgcatctccgccggcggcccgtgaagacactgaagcgaagctaagggttttggacggatgcgattccgtgagcggcggtggaggagacagtgaagagaatcttaggcgtgagacccttgtcaaattttatattcatcaagcaaagtaagtaccttagggaaacaaatgtaatagtaataagtaaaacattacagggcagaactgcaaaaaacagaagcaacagcgcaccgccaagacctctccctctccgtctcgtctctccccgcacggtcgcccctcttccggttctccctg

SEQ ID NO: 63 - DNA, 414 bp, Zea mays
tggcatacgctggttagctggtagcagcgacctgacaatggcaattgtatatcctcctccgatccagccggagcagcggcacacacagcgcgactgcagcaaagcagccttcgcttcgctttcctcgcagcgtgaccgactgaccgcgaagccgccgtgaaccctcctcatccccgtcccccctgctccggcttcgccgggctcctctctcccacttgcgccaacattcaagccccgaccccaattcacatccgaggcgctcgcccctttccatctccatcgcccacgcccacgcccgcgcgtctcgtgtccacgcctcgccgcgacttctcccccctaaaccccgcgagaggccgaggtacatgagagagtgatcggcctcgccttcgcgcccacgctcgcgccgagagtgtg

SEQ ID NO: 64 - DNA, 505 bp, Zea mays
ctggctgcagtttaagtggcagccgaacaacttgttaatctctagatcatggttgcatgggtattatattatcggtggtatgtttctgttatatgttttggatgtacaattgtactgattggccatctagtaagggatgtatagttcttgcttggttatgtggtacatgtttagtttagtttagtttaactaacgattgtaatctacacttgcctttcagaggaaaatattgctgcagtgtctgctttgaaggatgccacgtcacctcaacaaaagagtggcataccaaacagtccagcacaagatgtctccccgctgcaaaatggggaaaactatacaaatggtgttaacgaatcaaaaattgaaaggaatgcagctgtcatgcctgttctaactggcaaccaaagcaaatctaggtttcctatacttcttcatacatcattctttgtgcttactgcttctggaagcggtgtttcatctgacattgataagcaggagccagagc

SEQ ID NO: 65 - DNA, 127 bp, Zea mays
gctgctcatttcgtgcactaaacctgaacgccttttgagctgagcagagcctgagcagctagtagtggtagcttctcggttgcctgcaacttgcaggaggcggggcaagggtccaagacattaggcg

SEQ ID NO: 66 - DNA, 1500 bp, Zea mays
actcctttttgatccattccagttgcattaatctcatattaatattgtttataatcaagtaactttattttgttatgaaacytaggatgaaattaagcacttaatttccttttgtatccaacacttaaaccttcggaaaatcataactttataaccgtaactccgaatttagtggttctcgaacctaggacctagttgcaaagcatagatcattattattagggatgaaaatggaaacggtaattttcggatatcggaaatcatttttgaagttttaccgaaatttaggtctaaacggaaatggttaccgaaaatatgaaaacggaatcggtagaaaaactcggaatcggaaatggtttgggtctcttccgaacgtttccggaaattaccgtttttattcggtattttaccgtcggtaataaattcggtatttttcagaaaaaatattaaatctgaattgatctttataaattcataataatttcatcttagcttagaaaaatatgaaactaattttattatttttctaaaatcaagatctatcttatctaatggtatatagtttgaaatcatttgaaacttttataaatcttatttatgttttcttacctgttattactattgatacatatattcatactttgcacgagaacttaagaaatactaagaggacactaattatattgactataccaagtagtagaagtacaaatagaatgtaagtgacatatcattatacatatcttgattctactttatttaaatacgtaataatgattttattattttatacttcttaccttatatatttattgtgacctcctaccttatatattactactaattttatatgaatgtatgacttgcgtgattttttgaagtcaattgagggtacatgttaaagtttttaccgatcgaattttagattccgatcgtaaccgatgtaattttcgtaccgaactttcatttccgatgtttccgaattaccgatgtcgttttcgtttccggagttaccgttttcgatctcgtttccgagaaaaaaatatgaaaacgaaaatggttttaatgtttaccgatcgtttccgaccgttttcacctctagctatttccctatcccttgacttgaaacaggagtaggtcagatgtggaaagggaccagactcacggagcacgtgccatgactttctctgtcggccattcttgccgtggagataagagacccggtgtaattcagagcattttcggattttgattactgtggtgctggggtagagttgtttaagtcggtgcctatgtttgtaaacaatttaggtgggacactgaggctaagaaggtctgtcctgaactgtgtctgtgcagcttaatgctcaagggtttagttaacgaaaaacacttatgcaaggagtttatttgacaacacgaagagtttggcatctcactcagtgtctactcttgttctgtcttgatgagcatgtacacacaaaaaagtaaagagaggtt

SEQ ID NO: 67 - DNA, 1495 bp, Zea mays
tcagtttcgccctattcccccctcttaggcgactatcacttattcatagagaaatcagatttaacaacaccctttcattcacatcgaataaaaaccatactttaagggttcagagttactggaccatctaaacatgggccaggcctaaatgtgcgaatgaggtggatccttgatttaaatcttgaacgaacatcgataattttcgccaaaaaaaaatcatcctcgctatgtgtcggttttgaaaaggctcattttttgaattctttgattttgatttttaaaaataataaaaaatttggaaaactctattaaaaactagagggtcccaagagtttaaatatatattgtttaaaaaattcaccttttagtgtcaaagaagtggattcgtttaaacccgttaacccaaaaaacaaacccgtacacataatcattgaaatccgtcgataaatcaacgaaatccggtgattcaattttgaaattgtaaatcgttcgaaaactacaaaattcgagtggatttcgctaatataccgttatcgcgtgacgacaagagacgacataaaaactcctttagaatgcaagattgataaaacatagggatagaaaaatatagaaatatgacactctattggaaaaaaatttaagagtttgagcggcatgtaaaacatcttacgacaatggtctattccatagaaattttatatgatttatagaaatccagtccattattttaaaaggtcacatagaaaagttttcaataggattttaatccttcataactatttcacttttatttttttacaaaggaggcctaaccctgggtggaggtgggcttgtatcgtagcagacacgtggcaggctccatcagccaccgctcaatcgacggcggtgaccgtcccgcagccgcgggaagccaaaacaacgaaacgaaaagttctcgaagccgccggccgcgggaaacattttgcgcgccgcgctcccttctccttccgcatgcgcgcgcgcccgccccaccgcccgttacaaatactccattcccggttcggcgcttcctctcttccaaatctctagtcttctccagttcccaccccgcgccccaaatccagatccactgcccaccacccgcctattagtctccaacgcggacgcccccgcccccggctgcactcgtcgcgccatcctctggtgcctggtctccgggattctgcaggttcggctccgaacttgggcagaaatgggctctcgtgcagtttatctcttgcagaaatgaacttgcttcatctctattgcagtttatttcttttctcataactcctagtttctatgacgtgcaaaatcctagcgcaccagtgtgtctataacgccatgtctgaatgcatccgcttttcgttatcctggttcaggttcagttgagtagaccagtgtttgagcaagggttgaacataggaatgcgctgtttgttcctagagtagcagttcaaaatccaaacccgcccgcg

SEQ ID NO: 68 - DNA, 1452 bp, Zea mays
tatatatttagtttgtgtgaatgtcaaatgaatgtactttttagtttgttcttggtgagctccgtcccactataatttcaatatctaaggctatgtttgaatgtactaaagctaatagttagctactaaaattaggcgagtacattcaaaaagtatatctaatagtttagctattagctaattttagtaatttaactaatagttacctatctatttattagctagctaatttcaccgataatttctagctatctattagctctagtgtattcaccccttaaatattttacaaattgtttagtttcttatgcctcttataaatttgggaccattctatgcgttctcttgtgtatttagttaccttccccgctgaagcgttgctagccatcattgtaacacctcaaaatcatagttctaggatttaaataaaaatctccaaagattttgaattaaataagaattctcttacctctaaaatcactcttgaaaaaaatatatttcaataaaagattgaataaaaagtcactatgtaaattattaaactatatatctctactacttattaaggaggtaagggatagactgccattccgtgttctgccattcctattctccctccattcccatttcccctccccgcactgtctttctcattctcccctctccgcaaagctcattcttctcattctcccctctccgcaaagctcattcccattcccggctgtcattccgtgttctgccattgttctgtcattcccattacccctcctcgcactgtctttctcattcccccctccccgcaaatctcattcccattcccacgtgcatctcacgcctagctaaaattaaattaaaaaaacacaaatgtggctccaatgggattcaaacccgcaacttctcaagcaaatgtgctcgtagctaccactacaccacatgtgtgtttatgtcaatatctgttacagtaaaaatatatactacatctctcccaaagcccacctgctacctttgcacaatgtgtagtagtagataattatcaacgagattcttgaattatattttggatggagggagtagtatttaaaaaagagccttgcatgcaattttttttgtttgaataatgttttcaacttattctttttatatgtgtgacatttattctccataatattttttcatggatctgacttgtgagtcattttcataaaccaatgccaaagatgaatccatgtttcttacatggaaaccccgaacaaacaccactggcaggaggcgctcgcgttggcgtcgctcatcgacgacgagaagaagcttggtgactgccagttcgacctctggaagcagtactacgtggccgcatgcgtcactgtgttcggcaagctccggcgcagccgccgcttggacacggtccagagcggctgcaccgcgctgtccatcttctaacagggggacctc

SEQ ID NO: 69 - DNA, 121 bp, Zea mays
ggtatacattgcaacttttagcctcaaaccgagcaatgttagattgacttactcaaatatgtcttaactatgtacactccacttgctgcagatattaggactagagatatgtgcagacaca

SEQ ID NO: 70 - DNA, 1138 bp, Zea mays
gatatacatcatgtctaagtacatagtaaaatatatgtatctagaatttcatctacatacaagtaggcaacataatacattgatcctgatgtcacaatgtttaatgcagtccaccgctgccgcgcctgctcgcggttcccaggcctccggtgcccctcactgttgtttatagtaacagatattgattcttgacaaaggaattgtaggatattgagattgatgatagtatatatgtttagtttctatgtaaccattatatattaatattttgtatgttgttgcaacccatccccactcttagacccttattaatgtgaacaacatcgaggaatagatgcgtacgaatcaggctcatgttgttcaggaggtgtatgggaggataacgagatgtgtagtgctctttaagtgtgcaagtgcatctatggattgtatggttctttggtttttgttgttcgctgaggtgcaaagtaggaagaaaatgtggccctaaccttgcaagcggggaatgtatcgttttttggtgtaactgaaatatgtggtgttatttttttgtgcattaacaatttgttgaatattttgtataccgttgcaacgcacgggcatctacctagtgccctaaaaaggtgcaaccgaaaccttctagaaggcaggtcaatttacgattaaatttaagtcccttaattaacgattcctccccaattcccacaagaaaacaggtgaccttctagaagcracaagcggcccagcccggtccaacaatgcaggcatgcagcgactcgcgccaggcccaggggcgcgaggtgtcttctcggcgccaactggaggaggaagcaagctgagcctctgaccgtctgtcacgacttaccagccacgaccgatggcaaacggcattacggcaagaggtctcttacggcaaacccctgcctctttcccccgttccaactcccaacgcgccacccctacaaaaacctcccgtcacgcctgagcgctcttccatcgttaagcggggcaagccgcaagcgcacgcacgcaccggaatcccattggtaagtggcaacccagtggcatctcggcgttgtggtgcggggcgcggattggtaggggtgcaggaggcggcggcagcagcagggatagcgag

SEQ ID NO: 71 - DNA, 121 bp, Zea mays; identical to SEQ ID NO: 69

SEQ ID NO: 72 - DNA, 332 bp, Zea mays
tcatgtacaaatggacatatttttctcaccaacccatgccaatggacactagtggtcaaataattattccatatcctcaccaactcataatccaactactacaattattatgcataagggaacaacttggaactaggtgattgcatgcatgagcctataaggtgacaactagcacataatgtgttgtatgagcatgacccctttacccatggaacaaatacaccgtgctatgagggcatccgaggctctaagcctataaatgagaccattgacagtaacttcacaagtaagaacccatatactaggtaagagggacaaagaaaattgtgctc

SEQ ID NO: 73 - DNA, 689 bp, Zea mays
tctcgaggacggtgcactcctatatatattcctgaagaacgcgtgcgctgaacctgtagtcgatgacccgtatatatatctgcagactgcagtgcaggccgcaggatcaaccgacgtgcaaactgaacttccgtataagattagcgatgtcttgcacgagatcggtgagcagcctaagcaggcaggctcggcctggacgaaacagactagcaacaccacctcctggcggtttgtgttgtaccaccgtctggaacggcgcgcggtggtggttccctctgtttgcccaaaaggaaaccagcagtggatctgctcgctactagtctatatacgtcccttcgttgagcagagcagagcgagcatagcaagtcaagggaattttctcgtcttgcccaacaaatcatggtaccgagacattgacatgctagacagaaaaaggcccctggcccctgcagcatgggtataattaagtcaagacgaagttgcttaccagcaaacctgctcccaggtttccttcctgctctgatcttggcgtgtcttcctccacgcagatcgcagagctgctgaaccaccaagactactggaaagcaaccggtcggtacggcgcagctatatttaacatggccacatacacaagacaaactggctgagggtcagggagtggcctggcagagactcgactcgactcgaca

SEQ ID NO: 74 - DNA, 88 bp, Zea mays
accacgagtagcggcatcttcgtgactccgtgtgattcaccctgcagtgatagtgaaactcgatgtaaattgttgcgtgacacaaaca

SEQ ID NO: 75 - DNA, 120 bp, Zea mays
tctgcgccaaccccaagtcagactcccagaatgtcatgtctggcacgcatgctcttaggcgacaacagcctgctcttggcggcgtccagcagtcggaggtgccggtggagactggagacg

SEQ ID NO: 76 - DNA, 82 bp, Zea mays
gaccctctagaaagccaagaaaactcactcctctctcctctctctctctctctctcgcctctcgcctccgtcggccgtcgcc

SEQ ID NO: 77 - DNA, 743 bp, Zea mays
ccagcccattaggcccactaagggaaccctaaccctagggcttcttctataaatagcagccctctctccttgcacttggttattttgcactcccacccctccttttctttcagccgccggcagcttcttcctccctgctccacggctgcagcagccagtgcgcaggagctcctccccctcggccagccatggcgcggcgcccctgctccttcttcctcgcacagcagcagctccattcccctgcttgcgtgctgctgcgtagtgcgccattgacacttgctatgcgcttgatgaaatgcacaacaagccacgcgtcgtcgatcccccgcagcagcaccgttcttcgccttgcgttgtcgtcgaacttcgctgctgcttttccctcccataaccagcacccccgcagcagcccccgcccgctcggccctccaccccgcagcgccgtcgttgtccctgcctaagtgtcggccaaattgctgcagcaagcctcacccagcaacacccagtggcggcatgctccttcgcctcgcgcgttgagtgctcgacgaatcgccgcagcgagccacgccctccggcgtcggtttggtctcccgagtgcgacgacgcattcttctttacgccacatgtgcagcaaccacgacggagatttgatatggtgagcccatgtataattttgctgttggattggatatatacggcggctacgataggtacttttgtgcatagcacagaattgctcgcgg

SEQ ID NO: 78 - DNA, 625 bp, Zea mays
ggtatgattccatttgaacgattgtggacagactgacgaaagtggctcacttcataccagtgaggactaattacatgggagccaagctaacatacttgtatatgactcggataatttgtctacatggggtgcctaagaagatcgtgtcagactgaggatcacagtttacttatcggtttcggaagaagttgcacgagtgcttggacacacagttgaatttcagttcgtcctaccatcctcaaactaatgggcagaccgagaggaccaaccaagtactgtaggatatgttaagagcttgtgctcttaaacatggtggcagttgggataagagcttaccgtatgtggagttctcctacaataatagctacaaggccagtttgaagatgtcaccgtttgaggctctatatggcagaaaatgcaggactccattgtattgggatcaaactggtgaaaggcagttgtttgggcctgagattatacaagaagcagaagaacaaattcacagatcaaggagaatttgagaactgcacagtcaaggcagaagagttatgctgatacccgaagaagacagctagagtttaaagagggtgattatgtctatttgaaggtgtcaccactccggggt

SEQ ID NO: 79 - DNA, 385 bp, Zea mays
tgactagaaaaatcaaatgtattgtagtttttttacaagtattgtattgtactattgtagtttggaattgagggaccatatgaaagagccagtgatttttggagttttgacctgtcactttcccgtatttgactcattagcgacgcatgtttgatgccgccaaacatgttttctgttccgcgagcgagcaagtgtggtgtggagtgttgaccccacagtacagaggccaccaaccttttgacaccccacagtcactctctcccactcattaaatacgcgcgcacgagccccacaacgctctcacgacactccacactccaagcgagctagagctagagctatagagatcactctccttctccgcgtgaggtagtgacgcccagcc

SEQ ID NO: 80 - DNA, 172 bp, Zea mays
tgttttcgcactctcgttcggacttggttttatttctaacgctaaccccggcttgtagttgtgcttaaagtttgtaaatttcagattcgccctattcaccccccccccctctaggcmactttcaattggtatcagaacccggtacttcattagagcctaaccgcttgaagtg

SEQ ID NO: 81 - DNA, 118 bp, Zea mays
gcaacctctatatatatacgtacttgcaataatccgcgctatatccacaagtgtgtgtaacctactaacctacatacatttgtgagcagcagcatcaatcatacgcgcgtgtgatgcc

SEQ ID NO: 82 - DNA, 124 bp, Zea mays
taaacctgccctatggtgtagtataaatacaccaggcctgtccattgttgttaccaacgcacagactagctaaacatcacagtattacacactgacagatcaacgacaataagctttgtcagca

SEQ ID NO: 83 - DNA, 261 bp, Zea mays
actgaatgatgaattggctagtcttaatgcccaacttaagactagcaagagtgattttgataaactaaaatttgcaagggatgcctacacgattggtagacacccctcaattaaggatggacttggcttcaagaaggaagccaaggacttaacgctgatgaatcccctaatgattttggtaaaaatcattaagttaaggtggatacacatcttgtcatatgatcaaatggtttcgcgaaaaatcaataatcagacaacaag

SEQ ID NO: 84 - DNA, 859 bp, Zea mays
agagggccagactagttcggctagacgtagcacagtccgatattgacaaccgaagtccatgtcggaatccctttccgtttgggggtgcaagtgtcgagactgcggaaacttcgctgatatgggcgccatgaacgtgcctgtcattatcagttagttgcctagttgcaatcttgtaggttcatgtaagaaaaaaaacaacgaaaatgtagttcacatgagatgctgataatccaatagaccgccaattgaagaagtgatatgaagtgtcggccacattgttgtgtcgttcagatactctgggcatgaacaattgtcagaacattttcctgagctggggatccaatttataagtttaaatagggcatactagctacccagaaatttcgatatttcactgcccaagcacagaatgaattggtactgacgcaatggacccactttacacatggtctttatgaagcatgcttctttgacaaggttggtcattggtcagtatggcagcaaattgtggtacccaagcactcgcgttgtgtcggtatggtccgacattgacactgctactagtggctccaacaagtggccagcatatgtccatagaattcaaatccaatcaaaatcaggctgctttttcttgcaacattgcatgttctgatctcatgtccttgtcccttgccagcctgagttgaaagctgcacttgagtaacagcatgcttctcttcatcctcacttataaatccatgaggcagccacggtagcaccaacactcaatcaactagctcaacaacacctgacctgatacaaaaggagccctagagttccagagacgaagaaaggagaagaagccaatcagccaccagcc

SEQ ID NO: 85 - DNA, 535 bp, Zea mays
ttgagggattggtgctgaatttttagttaattgtaatcaaataggtgttagcaaaaaagaaggtagggcctgaatcatttagaaataattgcttttgagtgaacctaaccggcttatctctgaaccacttcaaacaggacactgaaacagatatgagcagctaggccataaaagcagaacccaggatgattgcactatgtctcagcccaattcagcagctagtactgtagtacatatctcattgcccaaccactagtccactatctttgccttcaaagtggagtaagtgatggcccagcaaatcagatctgaatctcaagtgtcaacatctgcagctagcaatgcacgtacccagctcatggccatgtcccctgacaatcagtctgagaagagcacaactgcactcaagacatggaccatttcttcacctatatatacaggagctagcaaccaagacaccatcactacaatcacagccacaaactaaacatttccaagcactagcctgagaatcaagaagaaccaagcagcaacc

SEQ ID NO: 86 - DNA, 419 bp, Zea mays
ctcacaaaatagctctttacaaaccaagcttgaatatcagtttaacttataaaaaaattcaacgagtcagagttaaattgagctcacgagcatttcgttctgtctacttctaccatcaagcaccaaaaccagcggagcgggccggacgagggacgacaagaaaccatttctggtacggctcgcgacacgttacagcctagcagggacggccgccatgcacgcgcccacgtcgcgtccgctgacgcgccacgtcccgcgccaccgccgagccgctttatatatctgtactacaccgcagccggcgcagcggaatacacgccagaaactaatccagatagctagcctttgatttctcacttcaatctgacgaagtgcacacctaggcaacaaactcgaacgcgcgcggtagtggagccgag

SEQ ID NO: 87 - DNA, 1500 bp, Zea mays
ccatttggtggaagccgctaaaagctactaaaagatcttctatatatagttgtatagtttcatccaaaaggtctatatatagttgtatagtttcattcaaaagtttagacgtgcttttaattttgcactgtgaaaaagccgtcggctgaaaaaatggtttctgtttaaggctctttggtttggtttttagcagacaaaagacatccaaaagttaaaccaaacacactcattattaatcacctaaatgcgcagaatgtcttcggctacccaaattctcgaaatgtcaactggtctaagtgagaatgagggaattacttctctatttatattgggagccatgaagttagatatttggtaattaattttcattaggtctctactctactcttttatgaatcctatataatcattccatcgaagagtcattctatgaaaccattccatcaaagaatcaaagggcaagactaaagaactgggaaagatagctcttccaacgaatcattctgtaaaaccattccatcaaagaatcaagtagcatcgaagaatcgaagagcacataaaactgaacgtatgtttatttacatatagagctggtaataatgtctctagcctatgaatgaaattgaaattattttatggtgtgtttggttgcaatgatgtaacagaataggataagacaatcctttatataagcttataaggttgtttggtttaagatgttgtttgatttaaggtcagaagttaggataggaccgttctagtcgacgacgtttagactatctccagcagacttattatcccattttttatctcgctctttatttcaaacttcactataaaaacaatgttatctacagtgcaaaatartattttacacgactgattacacggcctgccttgaacttgcatatacatcttctttaaataggatcttggatggtcaatctcacacgttcgttagagtttattcgttttgctctcaatccacatagactggatgaaattgagtgtgatttaaatttcaaataaatcaaaatcttaaaaaaattcaatctcatttaatataggaataaccgaacaagccctaacgaagacactcacttgattgtgcatacgcgtgtaatcaaagtctctccgccgactcaccagtttgatgggtcggaacgattcatagccggattgcttctctaatttatactcccttgcactatccagcgacaaataaaaagaaacggagggagtataaactttgattagttggaacgattccgggtgcaatcggacgtaaaccaacgaggcaagggtctcccgccccgcctctcccctggcgataccccgccgcctctcgcttgtccccgttcttgagcaatcatctgcctccctttgttcccgcacaatccctagttgggaggggggccatggggcggctgcggccagatggccagtaacgtgcaaagatgagcagtagattactatcggtctgctccatcgccggcgtcc

SEQ ID NO: 88 - DNA, 995 bp, Zea mays
ggtgcgtctccctcccccgtccgcctctggctgcctgattgccgtgcgtatgtctacttattaagatttgttgcggattgcacggcggttgctccccctggcgtccggcggcgattggtagatctgtgtcgccccagggacgaattgcgatggtaatcttgcgggtctgtcgatcctagtatggagtaggcgtgactagcgtggtggcaatgctggagttggagcaatgccgcaggcctgattgaatgtctgtcgtcgtgctcggcttttactaggtgggaacagtggacgttccagtttctgctggattctgtatcctgttcttactggcagtattagaaacttcagtttctgctgattggctaaaattgcaggtggtctgaaattaatgcagctagtcccgtagtttcactttggcaatggtcttgatcagtcaattggaccgatcggtaccgcctacacggatatgatagctattttcttgctctataagcacagagtattagatttgtggttgactttgccatgtagcagcacctgtatcgatggatgggagtcatacgactctgttggagtgaacgactttgccatgtctgctgcttgctgcacaacataatcatagaccttcaggaaacagcagcggacaaggcacaatcaccgaggagcagcaacgggacggtagccggcaggaggtactccatgacgatgcgatgtgctaacgatcgggtattgagcgtgccaagcggcgatgcgcgtgtctagggctcacactcgttttcatgggttggtaaggtcgtctaattcaaaggtggtcgagggattggttggcgtcatcctggatttgagtcgcattttgccggaagctctatcctctctgtttctcttcctatctagtctatgattgattcgacctgttttttgggacaagttagagtagtcttcagtcgatggagttaatgcaaagctgagttgctgcacgttggctttcttcagag

SEQ ID NO: 89 - DNA, 918 bp, Zea mays
agaacaaggcaacataaaaagtgttaagtgttaaagtcctccgtccttcgaagcattatgtcccttcgggaaataatgagtttcggacgaaggtcataagagacataccttcgtaaacataacaagtaatgacgaaggattcatataaagcatgaaatataatataagcatcttcatagaatcatttctattttattaacatggaaaaatagaaatgatttcaaattacaaatgtaccttcggtcctgagagaagataaaaagtacaaacgtgacgcaaaagcaaatgccaagtcagcgtgaacagtacgggaatactgttcatctatttatagacgcgggacgcagcccacgtaaaattacatttatgtccattacatttgtcaataacttatggaaatctgacaaggttcacgtagtcttttcatctttaagtcggttcccctctctgctatcgcgacgaagcttccctgcgcacagcttcggctgtgcaccatccttcgtggagcttggtaatcagcccgtccttcgtctggttcaggcttcgtcctgaccgcacttcatgttcgtaattctgagtccgaaggtacctgttcacataatccacttggaaaacattgtcaaatcatgtttttgaggaccttcggaggacgaaggcccccaacagaatccttccttcctcatcatttattgtgcttatgaaggttttttccttcacaaccttcgtccggaattcattttatccgaagggaaataatgtcttgaaggacgaaggactttaacatttaacaatcttcatgttgccttgttcttaactcttagcatttgagaacaagtctccaacattggcgcccacctctggtgaactcacttccactttttgagttttgaacacctttggcaagcatagaccttcgtc

SEQ ID NO: 90 - DNA, 742 bp, Zea mays
tgacgaaggtctatgcttgccaaaggtgttcaaaactcaaaaagtggaagtgagttcaccagaggtgggcgccaatgttggagacttgttctcaaatgctaagagttaagaacaaggcaacatgaagattgttaaatgttaaagtccttcgtccttcaagacattatttcccttcggataaaatgaattccggacgaaggttgtgaaggaaaaaaccttcataagcacaataaatgatgaggaaggaaggattctgttgggggccttcgtcctccgaaggtcctcaaaaacatgatttgacaatgttttccaagtggattatgtgaacaggtaccttcggactcagaattacgaacatgaagtgcggtcaggacgaagcctgaaccagacgaaggacgggctgattaccaagctccacgaaggatggtgcacagccgaagctgtgcgcagggaagcttcgtcgcgatagcagagaggggaaccgacttaaagatgaaaagactacgtgaaccttgtcagatttccataagttattgacaaatgtaatggacataaatgtaattttacgtgggctgcgtcccgcgtctataaatagatgaacagtattcccgtactgttcacgctgacttggcatttgcttttgcgtcacgtttgtactttttatcttctctcaggaccgaaggtacatttgtaatttgaaatcatttctatttttccatgttaataaaatagaaatgattct

SEQ ID NO: 91 - DNA, 391 bp, Zea mays
ggtgagcaccctttttaaatgtagagaccggctgactgtgaagagagagccttttcaattccctggacttgtgtaagctgagtgcacatccagcttttcttcactttcttggaaagttaagcagatatataatcaccacaccatgcataaataaagcaggaaagcatcagtgctcggctgaatgaagatccagcaattaactagggatgatgctcctcatagcatttaccagaatgaaggagggccgtcgctttattttgcattcagaaacattggctagccagcccagcctctttgtgtatacttaatatatatatacatacatagtgtcccgagacattgacacatacaggagttaattgttgggggatgccacactagctcctcacac

SEQ ID NO: 92 - DNA, 1500 bp, Zea mays
agatgttcttcctcgtctcgattaatcttgtaatttatatagggtttctatgaattcttttgtattaatataatatatatcgatttagtgttataaatattatttttttataaatttcgtaaacttaaaatagtttgatttagaaatattaaaaaaaaatataccagtgaattcaaacctgatctcagaaacatatgcgcataagggctgtttgagtgtactaggctaaaaatttactagtagaattagttagctacaaatagctagctaactagtaactaatttactaaaaatagctaataactgaaatattagctaggctatttgatgtctctaagactctaactaattttagccactaactattagatctagtatattcaaatatcctctaagtcaccggtagaaaaaaaaacattggcatcaactgccgtggcccgtcatactgctacgctctttccagctttagttactagctaagctgctaagtagaatcgatcccgctgtcactcttccaaatcgacatccgaattccatttctgtaattgacaggcaagtgaaaacatgcagcgacaggtgaacgtgaatgcaagtatctcactcctcaatgaatgcctgcgtcacgtttacaccaggcgaatggctttggacgcattgcaaattctgggaccagccatgtgctgacaggcctctcgtgtgagtttcgcgcgaattgtgtcccaggacagggtggtcacagaataaaatagactgaggtaagtatcaaggtgttgtttgattcacgaaatataacgtaaatatatacttcatccgtttctttttatttgtcgctggatagtataaaattgcactatccagcaataaataaaaagaaacggagagagtataagtttaagttttgattagctagaatagtttctgcaaacaaacaaaacctaaaggaactaacaagagaagttagtaatgggtgaagaagtgaagaatttgaaactcttaacttttttgcttgatttcacagcggcggaattggtccgattctcatagataagatgaaatccgttggcaacagtttgcgtgcgcaaccatgaaacggagagacgcatggttgaggaaagctcctagcgctagccatggccatgctgcccgacataaatggaagttagatcatggaagcattaattaataataagaagaaaatgccacaggcgtacagcgcttgccaaattgacagctagaaacatttccaaaatcttgagactccagtcagctgcccagctcgtcgatcgcagccagcaacagcaacagccagcaagctaagattcatcatggcttacgaaatctctcggcctccataaatcacccatcgcaagcatgctctagcattagcattaccttgcccccgaaacgccagggcggccatcgaaacgcgagagccattcgaggataggtggaggcagcagtggcaaggaacgcgagggcaacaagaaactgcggctagcg

SEQ ID NO: 93 - DNA, 151 bp, Zea mays
agcgagggcatgatgcttgcatgcgtgtaccgtagacgtaccgtattcctacgtactgcaggttgcaccagtatttgtgaagggagctgtgcgtgggagccagagattgtaccgctagtgtatttttgtatgcacgccgtggagctgatca

SEQ ID NO: 94 - DNA, 374 bp, Zea mays
cgaattgaacgatgtggcgcaccttttttgacgcggtcatcatggcggatgtgaagcgtcgcccgcttcgcctgccaaaggtgtcgcctgccctgccgtggagttaatgcgacgggacgagtggttcgcggggcagcagttgtgcgagccgttcgaggaacgggcgtttcgtcttcgagtctgaattttgcagcgggttcgggcgaagcgttgaacgggtcttgcccgggcctttatatatccggaagggggaccagtggtggttctttactctgctgctcgcctcctgctttggtttccgcaacccaagggattaggcagagaaagaaaaccacacaccttgtccgctccgccgccacccccttcgcttggcg

SEQ ID NO: 95 - DNA, 1500 bp, Zea mays
gtccagctataagttgtgaaaaaatgttataagttgtctactatgaaaaggttgttgtgagttgtctgcagtaaaaactttgtttaattatgtctcttaatcaatgtatctaattaaaattcatatttgtgtgttttatatttttacaaataaaagctgactgtgcttgctctatttttttattaaaaacatttttatttcatttattctaatagttaactattttaaattttattttattttctatttccggtatctcttcattaacatattaaattaacaaatcaatgttacaattacatttcactagttttttaaaaattaaaatacaatttatttttttattgtatcacttaattacttttagtcccattttaatttttatttattgtatctatttattagtatatcaaacttggataagcaacgaaaatagaggttcaaatttctatcaaattcgtagtataaaaaacatcatttttataatagcagtagaaaagctcaacatcttcggtttagcttctgcctttttaaagcagaagcatgataaaaaaagctaaaccaaatacaccttaagagcttcttcaaccatgcctgaagttaatgccttatcttgaattatatgacttaattaataaaaaaatagctccaaacgatgtcctattttataagtttttatcaaaaaaaaatatggcagaccattaaacgacttaagtatactacaccccgaattaatgttgtattcttattttctacatcattatcgacctttttctttttcaaacaatataatttattttttctaaaatacattatttagaccttaactattggagcacaatttatttcgagtgtcctaaatattttaaataatataatattttaatttttagaataatattttgtgatagattgttggatgtgagtgcgcattctaaggctggctcagtaaatatcgaatgtgagtgcgcatccaacgtgacgctagatccatttgtgcaatgcgaaaaggaggtgcgttccgcagctcgcgaatgcgacgcgtacgtatcatttcccgtagaggagagagaacgcgcgcgaatgcgtgaccgtgcggccgaacgcgcgcgaattttacaccacgatatttgtgatctgcttaaaaacgtgaacactacgataatgacgcgcaaaatgtgcatccggggccgtgacgggatacgcattctgctgacatagcctaggcatcatttcttgtttgcttgccctggaaaaagtctgttgctctccgtgatcgtccacgcgcatctcgtcgtcgtcgaaataataacccactgcctcttgaagtctacaaggcaacgcttccatggaccaacaccacgcagaggcaatcccactcccacgtctgtccgcgcgcggtgtggtcacactactacggcaccgcccaacgccatacttgccttctccatcctcctgcggtcctgccgtcctctcgtccagtccgccaggccacttctc

SEQ ID NO: 96 - DNA, 1337 bp, Zea mays
tgcagtgcgcctttagtagagttccattagcgtcccatttgtattaaataagctgtcatatatataagtgcttttaataatttgacaaaggtttagtaagatagagagaagtgagttctatggagatgaaattcttttgacatgatgtaccagctctccgtgttatagaattaagtatttactataaagttacggaataaaactttctatttaaacccagtgtttcatctatgttttatttcattctatacaacgtgcagtgttgaagacagtaatagacaactcaccataagactggcatgagtagtaaacactaaatagcgcaccttgaattgtttataaagactgcaaacaagtttcaccatggagatcacattgaagacagtagtatgtatgcacgtacatagatagcattgggtcaataactataggacaaaagtagccttgggtagttgggtcaataaactacttcaggctagcaacgttttagcacatgaagggacagcaagggcaccaggcgcccactccactccatctcgctgccagctgctctgcccggcccggcctggcctgcatcaaaggagcaatggcgcagtaggagtgcaggaagtcccattccgccttcgttttccacgtgagccctgcgcgcgtgcaaacagaaacagcgcatgcatcagtccagctcaggacgtgatctcccccttgttttttttttgcttgcagactcttgcatcatgtcggcaccaataattcaggagcgttccttcagaggacgtaccctggtcctggcgcatcaaattgcgtccagttgcggctgcgtcagcgtctgcgagaaacacgaggagcgcaggcattgtttgcagtggccatttggggtgtctggtctcagcgatcagttgatgtaaattgagcggcagcaaaaggacgtgcgagcaacttgatgctgcaatcaccgtgcacatgatgataatatatttttccctgctacgtggttggtacctctagcacaagtgcatatgaacatatacgtccagcaagaccagatagtagataggcctcccacgacagcaactcacctcccgggcctaccaagcagtctctagaaacaaacaaacagcggcaatgtgctaatctcttctgcatttgggcacggcaatcctgacccgaccctccagatttcccgtcgccgagccacgcggatcgagtacccgtcgaactcgccgctgtcggatcgagtacccgtcgaactcgccgctgtcggatcgttctcgcttggggcgatcaagctaacgggatttgaggagatctaggccagccgcgggcagcagccatcagcc

SEQ ID NO: 97 - DNA, 1500 bp, Zea mays
agataaacaggaagagctaggtgagttcttcctacctgcctggacctcctacccttcccagttcttgtgtggctggtcctccttttcttcgctgatcttcttcttcccttgctgcttgtgctactggagtgtggtcgcctgattatctgatggatatgtagagtgatattttttttccccaggagatcttttttcctctctagattttttttttcagtatcctgtagcttcccgaggtggccaattcccgtttgagttccgatccttcttttcccttgctgatgttctgtcctccagcgtaatagctgcggctaaatccacgacagagttccaaggttgatgccttcgatgattttgcagctcccatccaaaaacctgagtttcttacatctctttcctcttttttttccccttctacaagtttcggttggatctcaataccacaattagtcaaaggctcagctcgttctacggttctaggaagtgtctaacagccgggtgtgatggaaacattctgttcctgcatcatcttcggaggcgcaaaatttgaccagttttcgttaggtttgatacgtgtttagtccatttagtcccttgttttcttccctttcatgtatgaccttgattccccctttcaagcacatgggtgcatgttctttgttaccaactgtcagttcgtgcttggctggttgaaaaaaaaatgactacttatttttttttcctgaaaagctttccttccctgccctttgatctttttttagctttcccccttgtgattcaaccagagcttgtgaacatgctttcgtaaaaaaagggggaaagatgcaactttacctgcttgttccgtgaaccggcatatgagtagtttttttatggaactatttatatattctcataagttttcatgctttaattccttcttccacaagtatgtgtgatgcatatttctcacccatgctgtgtaatctgtttcttttatgtcgaaacaataagggccatgctatatttggccatgtatagtttgatcagatcaaggccctgttctgtttcaccagacacatgccaggttgctaactttggcctcccggctgttgcttcagtaggcaatcttgcctttttctgctacacgattgtctcctgtagctgtgtagatctatgatgccaaggcaaaaggccctcatgtaatcaccaaattaagatgccacagtagcgttcactggaccatctttaattaccttttttactaacacgcaatcgtgttgcacatgtttacccttgccctgcacttattgtctgtgcactgaattgctgacagtaaacacagcagctgacgtgttcgtcgtgttgcttccgcgcaggtgaatacttggagaaaaaggtcccccacaccccccacgcaggtgaatactacaagtagcagtacaaggaagagagccaatctgcccgtgactgccagtgagttgctcgggtgtggtggttagttgaaaacttgaggtcacg

SEQ ID NO: 98 - DNA, 867 bp, Zea mays
ggtatgttcttttttcctctttattgtctcgcattttctgtccatgtaatgttacattcttattcaagatttttgtgtactttgatgttcagtttaaactggaaaactggatcagacatgaggtggaaaacatcaggatatgtttaacacaatgcacctcaaatagccgtcatgtagtctctagtctgtccaatgttttttttcgaacaacgcaggagagctgcgtgtcatttcattaagacagaaaacaccaagtacaaagggaggagccagacctccctgaactcataacagcacttacaaaacactgcggctaatggctatgggacaggcgcactccatgagagggatcttgctgtccaaaggccccggttagacaccacaagtgaccctctacagccacttgggcaagaactatttgtgcctgaggccggattccatcaaacacgcaggcattcctgtgctgccacaattcccaggtgactaggatgaccaaggaattgaaacctttctgctgaccttttttgatagaaacggttgcctttctccaccaagaacagaagtggctcgagtagctgggcggcaaaatgttcagcccgagttccctcaataaacatgcaatacctccctggagagcacacaggcagaaagaatgtggttgattgaggagcagatggatggtgtgcgcagatgggtcacagatggtgtgccatggagcagaggcacaggtgaggggtgctgtgcatgcaaaaagcatagggcaggcgaacggcatggcttggggagacaggacaggtgatgcagctgcatgagaatgaaggcagcagctgttaatcggtggtggtagaggtaggccgtacgggattg

SEQ ID NO: 99 - DNA, 655 bp, Zea mays
agtaagcagcaggtgtcatgtcatgcactgacactgctcttcattgtgtgaaagcacgaaacctcaatcatcatcgttaatcaacgaggaaaagactggagaagcgatggaagggagcggccaccaaaccggttcaaaaattccagtttcttcttctcttttcttcccggtgataatctccattttcttttgtccattaccagcggcgaccacttccggagcgagagagctcacaccgccacacgactgcaccaccatcagcacggtccacggcggcggatgacggtatacccatacactggagtatgtctacatggctacgtctctatcctcccacttcgacccggccggccctatcaaaagctggccccttccacagcgcactccctcaccttcctccacggctccaccatcccctctcccctgccctgcccccaccgccccgcttccttccgccttgctccgttgcttcctcccaccacagtccactccactcgccggccctgcagctcagtatttgactgagactggtggtggagctgctagcagcgagcctgctacttcctggtcctgacggtgcgttcagacctcagaccagtgccgacgacgagctgtgaggagagggcaaggaagcaagcctgtgaggaaggcggcg

SEQ ID NO: 100 - DNA, 175 bp, Zea mays
atcctgtgaaactttaaaaacttaagccacaaaaacttggttaagtgttagcacaataaccgccaagtggctagagaggaatcttcaacaaaacacaataaccaacaaggatcaatcacagagatggcacggtggttatcccgtggttcggccaagaccaacgcttgcctactcc

SEQ ID NO: 101 - DNA, 489 bp, Zea mays
tgatatcttaagtagtaaatataattatattttatgttgtggaatattgttttctgatttttgtttctttgttgtgtgttgcatgtatgtattttgtagatatagacatgagatatgacaagactgtctattattaaaaaaatcgagtgtgacacgcgtgcgtgcttcgtcctcccgcgatttcaagtgtggacactggtcagcgccggctaccccgatcccgtttccttccggccttgttccacagtccacacgctagtactgtactgcactgcacgtctgcacaccccaaccaacgaccgtcgaccggcctcaagccctcaactctagtatattattttcttgcttccttcttgaatagaatagtcgcaatgcaatagacacgcacgcgcagacgcgggtccatatatatagggaatatcctgccaccgtcactggtcacttgctcggagtcggaggtcggagctactgcaagctaggcctacagca

SEQ ID NO: 102 - DNA, 700 bp, Zea mays
aagttggtggtactggtggcgggttgggagtatcctccctactacaggaagtccccgcatcatcatgtgcgcgagtccgtgatggcatctgaggcaaagaaacatttggaacaaatataacatgccagcatacaccatcatattacattaccaaaatgtaataattatacagactccagtgtacaacttgacttcaagacttattttacataagtataatatctaaactatactattctagtctttgttattctttgttgcttcatttcctgctgcaggagaccgttcgttagaaaggttcatggaaggagggggtctaaaaaggtctagctgtaatatcccaaaaaaaatgttgaccaaaagttaatctctggtgcgtggatgaggtaaagggttgtgggccattggatgcaaagatagaagtcatctgaggcgtcgtttctttctcccacaaaaaccctaggtggccaccctttttttcccttcaccccccctcttggccgccaccccctttttctcccccttggctggacgcccctccccctatggcagccatcctccattgcttcctcccccaagatctccccctacgcagcaaggatcgagaaaaggaggggcacgttgaattgaagaggaagagaggatcaaggagatgttcttccccatctcctcttgaagatttcttggggaaaccctaggt

SEQ ID NO: 103 - DNA, 442 bp, Zea mays
agtcagatttcaacatatattgcatgtaatgtatagacaggttggccagtaaaaagaaaaagaaaaaagataaaaacgtagggcctagtgatcagcacagcatgcagaattgcagatgcggcgcacatgcgaacgtaacaaacacagcaacacgcccacgctagcggtttccatttccggccctgcaatcctgcaccggcgcgaaagccccctcacggcctcacctccactccggtgatggccgcctctcctttacttctcagatctcagtgctcacgccgtccacggtccactagttgcatcggctcccgcataaagatccacaccacttgagcagcagctagctcaagggaaggagaaggctggaagtggaaagaagtgggttcttgcttgagctgagctcttgctgcccttgaatctgttagggagtggagaacggagt

SEQ ID NO: 104 - DNA, 557 bp, Zea mays
ctgaaatagaaaagctgacgtggctatagcctgaggctgtagcctgctgcagcctgtgcactggagcagcaggagcgagagtggaggcgagagctgacgtggtaggggcgagagggaggcggtgcactggactcagcctaagaatcagtagtagaacacgtcatcgtgtagccacacttccacggctgtcaagtgtcaaccgaatcgctatccccggtctccgccacaacacgtgtcgtcgaccacctgctccgcgcccggcgcctccgacactcatttcctgcgaccttccggcgagccggcggacgcttcccccaaccacgtcgccttcaatccaacgcacacgaaccaccaaccctaccctacccgtcatactcacgaaacgcacaaaaaatcgcgaacaaatattttaaagcggatagataactcgtgcacgcaagagcttggccactccattttaccactccttgtctcactctccgccacaacgtcagccgccccgcgccgagcagacctcctccactagccgccgggccgcacaccaaacgctcctggga

SEQ ID NO: 105 - DNA, 1348 bp, Zea mays
ccggggtacctgtagagacgacctgcagcccaggcttgctcgcttcacgttatcagggcatgtacgtaaatgtcacgtatctttaaggactattataagagaataataaaaaaagagacagcatcttgttattataagagaataataaaaaaaacataagatacagcatttcgttaaaagaacgtctctaactcagttttctaaatctatatatgattttactcatataactcacgtaaatgagttatattttaatagattctagtaaataagatacaatgtttaaatttattaagttatatgaagatgtttcatagatacatctagtgtttgaagaaccataatatagtatttaggttttatgtgccctcgtggctataacgtcgtcatgctcttcaatataggtgtacatttgggtcggacctgatgggtcggcccgaagcacggaaaaaaacacgactcagacacgacacgacccaaaatattttagtgtcgggtcgatacggcccgttatttcgggccgggtttggaccgaggtcacggcccatgggcgggcacgagcacgacccgtttaaggcaggcacgaaatggcccatataggggcacgaaaaggcccatatatttattaaaaccacacttcattccacactttcatatatttgataaagaacacaaagctagagataatgctagttagatgttttttgtagctttgaattagagtgtgtgatgtaattttacttttgttatgcacattagccaataaactgaacttatgagctttgtatagagctgattatactctttttccttctaacaaaataatttataaacgaggtagtcattgcatagctgtggtaactttaatacaaatattaagtttgattttgttccaagttatttgtcttatcttttatgtgtttttttgaatttagggctcgaatgtgaattgtgggccaaaaactgaattttgggccaaaaattgaatttcgggcttttataattttgggccgcccagaatgagccctacacgtttaagcaattacggcccgtgggccgagggctaggcccatgggcagaaaaggcacggcccaaaattcaaacaggccgggtcggcccgaaattcaaacaatacgggcccttttcgggcttgggccgggccgggccgggcggcccgaatgtacacctatagtcactacccagtagtagagcttgtattcctaccagctattcttccaacgtttccatatatgccgtagggctttcagtgacgttgaagccttgccgaactagactcggctaaaccctttgctttctcctgcctctcctagaagaccaattaagtccc

SEQ ID NO: 106 - DNA, 781 bp, Zea mays
ctgcaggggtcgtagagttggagggcccagtccatctgggaggtcccagtgccgcccgctcaccagttaccagccaggccgtcgggaggggagagagagagagagagacgaaaagatcgagacccatacgctcagatcgaagttcgacttctcctctccccctcccccaacctaacagattcgtgtagcacagatccatccgactttgggttgatttcttcctttgctgctggtaagtgatctttcttgggatgtcggtgagagaagtgaggagaaatgctattttatttctgtggatgcaaagcttatggtggattttggtgtcagattcttgcggtgtggctgcacagagctatggtcaatcaccgtagcagcatttaatgtttaatcatacattgtgattgcccttggaactacattggtttttaatgataggcgctgggccctggaagcattccccaattcatatgcttctagactctttagctatgtcctatattacttgcctaagtgcttctctcgtgtgttaaataacatttactaaagaacttttattttctcagaaacttggacctcaaagcctgggttttatgaaatttattatcttaaaattgtattgagctaaaaggtcttgtgaacatgagaacatctatttgcagggcttttgtttcagcaatcgcatggtcgattgggtcattgggtgacatgaccccgatttatgattgtcatttgccagctaatatataatttttttatgctttaccagatcagaaagttacag

SEQ ID NO: 107 - DNA, 315 bp, Zea mays
atcgagtgccaagaatgctttgcaaatgttgttaacatgcccccatgttaaggtgcctcaggcatgggatctttccaggtgttagttttccatggagaggagagagtggtgtttccatacgggttggatcaatttttcatgcttgttcttttcggagcctcgatgaggtttcccttataatcggcatatgctgctggataattttgtacttgcttataccgttttgagccttaaaaaccgtcacgacgttgcgattggtacagctgtgttcgctatgaatcctgaaatggtgcccatgcataaagtggcaaataa

SEQ ID NO: 108 - DNA, 1500 bp, Zea mays
tattaaaacaagataaatcgaagcatataagcatacagatggagcaatataatcttcattcttttattatctttccttttatgacacacaattacaaagataccttcgtgtagctcctgtcaacggttcaaagacatgtatatcgtgtagcttcgaatgctaagcggtttcgtagaaagtatgaatatctagcatgttctcatggatatacattgtacatctatttataatagcaacatggcgtattattttgtatgaaattacatccatactctcaagttttacataccagctgarggcaatgttgtaattttcagttggagtcataatgtatatacttttctaagccttccttcgccttcttggttgtatgcttttttttcaggttgtgatgccgtttctatcacattctttctatactcatggagtcatgggtgtcaccaaggtgaaggttactttattatccctgaaacaaattcaaagatgtctgtgatttattgttttttttaggccgaagacatatcccaacacttggcaaatttgtttaatggttattgcttgaatatatataaaaaaactctccaatactgaagcgtaaagacatatcaagaaatcaagaggctcaggtgagaagttttatagagccagtagtaaaagcattacgtagttgcaaaacgcgttcacgtgtctgatctctgtccaaacaaagggaggatccttcagcgtcgttgactgataatcagcgcatttgcttcagctgcctgattggtctctgtccaaacttcaaacaaaggcgttttaatcctcatgctccacagaaaatctgctccgaagttctgaccattcacctaaccaggttttttcgtaaacgattgtctcagcgaacctctaactacccccaaggatactgggttttatgttcgttggaagatcaatatgcccccgtttttttttcttgccagatgaaatcattgttgctgacaccaatgacccttcaaaacgttgtgagctaccggtaccttactcgcctgatacgcatccacaatacgacagttcagtgtgcatgcgcccatcctatccgggaatcagtgcaaaaccaaaagatcagaacagagtgcagaaacgactagcagcaaactgtagcgaagtgagccgaagcgagcaccgtggacggagccctgccaacccccgcgcagtcgccgggtgcaccaacccccggtcctcgcgacctgagccgccctctgcgaccttgcggccatcacgagcactcgtgctgttggtaggaaaagggccaaaggcgaccaacccccaagccgcgctggcgcagcccgtcgctatttaagcgcggcctgcgcctacatttcgctccaagaagagcagcaccatccagtgcatcacgagctcttctgcaccagattagcaggccatcgcctacttttggcttccaaatcatttatttacggcgtacgtgccttctgttcaaaccccagccccgctgca

SEQ ID NO: 109 - DNA, 509 bp, Zea mays
attttacatgagttgcgtcccgtgcctataaataaatgaacagtaaccctgtactgttcacgctgacttggcatttgcttttgcgtcacgtttgtacttttaccttctttcaagtcaaaggtattgtcggcatttcgagacccagggggtccctcgaccgacgagtaaattgtcgccgcgtgccccagcccagatgggtcggcgcgagacggagcgcgaaggggggaggaagccggagggagacgggcgtgagaggtggaatcccgcggccttcgtgtttgtcccgcgcccaggtcgggtgcgcttgcagtagggggttacaagcgcccacgcgggagggagcgagcggcctcacgcgagcgccgtcccgtccttccccgcgcggccaaccctctataagagggccctggtccttccttttataggcgtatggagaggatccaggtgtacaatgggggtgtagcagtgtgctaacgtgtctagcggaggagagctagcgccctaagtac

SEQ ID NO: 110 - DNA, 1300 bp, Zea mays
tggatggatgcagaggtcagtctcggtggcttggttctgtctggtggtcagaggtgcagtgcgccggcaaatttataatagtaggcaggcacgcggagttggctcgtccgtccttgtcgcttctcggcacatcttaaaaaaatgtaagattcatcttataacaagctcattaattaatctaaaaagcagaattcattaataaatctaaaaagcagaatacaaataaattagatcttttttacatgtattaacgtataggagatgaaatataacaaattttgaaaagaaataaaatatagaggatagacgcggcgccggacggactaatcaatatagggctggacgaaatgcttgtgtgtcgttggctcgctcgttttatgatcagctcggttcggctcggatcggctcgtttgaatttttttacgagctgagctgatatctcctagctcgattcgttaacgagccagctcgcgagctaaacaagctaccacattccaggaaaacgaaactatatgcatatcatttacagaataattgatgaaaatattatatatatgtgaggtgtctatttcttataagttaaactagtgattaatgaactatgtttatgtgttaatttggtttatgcaaatataattatgggttaaactgatgaacatgtatgtgaattgtgaattaatgagtgatgaattatgctaatttggtgttatattgacgtggtttgtgaaactatgagtataattactattttctattgtgaaattaatttgaaattaattaaaaaataattattatatacattttattttttttttttytgctctgtctcgcaagctaaacgagtcagctcgagctcgtaaacgagccgagccgagctgactctgtggctcgttatcttaacgaaccgagctgagctggctcgttagcttaacgagccagctcgaactcgaacgagccgagccggctcgttatccacaccatgtcataaacaaccctccaaatcatggcccatcacgagtgacagcccaatacccgtcccatcggtcgacgccctctgataaaaatctggcagaaaccgaaccgtagagcccgagcctcgcggtcgcggatccgtcctgcaaatctcctctcatacttctccaccggtgagcagcgagttcctcgattcagatctcttgaaagttttttctgccagctctctgcgttttctgtttctcaccttcgtgcgctcttcttcttcttgctgccgccattcttctcttgttactgttgctataggatccctgtaagattcccggag

SEQ ID NO: 111 - DNA, 1500 bp, Zea mays
agtcacatcagcgtcacgccatcttctgcttcagacacctatacagtgccggacgcagaaccaaagtctagatggggccaatccacaatggagaaatcacaaaaaatactaaactataactgattttttggtaatagcattaaaattaggttgtaatatcataactattataaaataatgtggatatcgaaaatccttttagcaacaccaaatcatcgataggaaatccaatctacaattagaagaaaaaaaaggtattatgtaagcatcaatgtaagtaaaagaacaaaactatatagaaaaacatcgaaaacaccattaaaacggcaatcttgtggttgtggcagtttgcactctagtgcgaggccgtggccgagtggaggcgggccagccatgacgggctatcggctagacgataagctgacggcaatggcaggcgagccgcaagctagagacggtgtcctgacggcgctcggtcgatatcggtcgtggcctcaatagtagttagatccagcagcttactcatttttcatacctatatttaaactccactctacgaataatacagtgctacaccgtgtaaaacaacataaaaatagtggttttagacgatcatggtgttcatgtgggctgaaccgacgggacacggtagctcgatgttctacaaccatgtatcttgttagaaaaaaaaggcaaacgctactgcacacaacagttgcaggcagtgattcatcactcttacgtactagaggagacgagagggaggggcgcacgtgtcgctgcgcgcgcgtgagatgacaccggtcgggccgccggggaaggagtgtgaacgggtcgccgtcggcccggcggccttcactgccggacaaggacgccgcagcgagcactgtctggcgcgccacacagtacggctgcgggggcaccaacaagacaaccgcccagggaccagccatgtgtacggcccgggccacgtcgacgacgagtcggttgcacgtcccaaagcgtcgcggcaaaaaccgtacagcgatcgcacgtagggtgtggagccgggtggccttcgttcacacggctgacgcgaacgtgtcattaagcccgccgatggcgagccagcggcggatcgcacccgtcggtgcccgatcgatcggatgggaggacggcgacgtgggcagggcagctaaccgccgggctcctctctccatcagatcacgcatcagtccgcgacaagcaaatttaccaaatcggccccgttcacaccactatagtacagccgtgcacccgacgggacgggtccgtggatggagggcgcctagccgccgatcgagagcacccataaatagccgtgccaggacatcagccgagcagcagcagcagctccaacaagacacaccaaaacacctagctagcttaccgcacctgctgcttggggctgccaagtaagtagtaagctagagaagcaaagcaaagcaaagctccgatccaatccaatccatcgcaaggatt

SEQ ID NO: 112 - DNA, 1464 bp, Zea mays
ccggctcatacgtaccagcctatattcccaacctagctctgaatctgatgagttgtgcgccaacaaccatgcatatgctcggtgtagctagtgcggcccattgcagctagtgcctgctgtgactcgaagcagcagcaacgtgcaggctggacgagcagcagaggcgaagcgaagcttccatccatcccgtcgtgtccaccctgggtctcggtcttttatttggatcattccattctacggtcgtcggtcaccaatgactagattagacttaaatctaactgtcaatctccttaatcagatctttgattgagagggctcacggtaaccatggttagagcccggttacatgaagctatataaaggattaaggggtcgtgagaaagcgaacactaatccctcgctctaaatactaatccacggacaaaactcatcgccctcttctacaggacagcggcgactgcaggaatcgaggcatcgtcatcggtaaggatcagatccatctccagctctgcatgaccaaggtatgtctctctatccctctgtaacacgtattagcagttaacaaatacagatccattcattatctatctagtgatctcggattcagtaarttggacacagtaaagatcctaatatgatatctaacaggccagccacatggatggatggatggatgatacatatgctgaaacgaactggagtttccgtcactctcacgtctcgtctcgtgtgtcttgggttttttttttttaaaaaaaaatttctttcctttttcttgggatagcaagcagttcgtgtttttggtgatggtgggaggaggcgacagcgacaggtgcctcatctcatctgatgtgatggcgacaccacaccggccgtcacctgccaaagtctgcttcactttactgctaatgctgctgctcaagctagataattcctcacctcatctctctctttctggctacaagtcagtgattattacgtttcttcctgacagtcctaatcgcatggaaatagaaggctttcttctctttcattaggagttgctgtggaccttttaacatgcacccgtgtatgattctgtacgatcggtttcatgtaattctacagggaagggtaaataatagcaatagctagattgactggacttgattgatttgtttctttattaatgtactctagattatgctcttgatatacaaggcgtgctaaagatattctcaactatatatatatctatatatattgatagtaatatatatggaaccttaatccacgacgccaatggcatcgatcactttttaaccaatccccttctgctcctgctcctgctcccgcgtcaggtggttgcattgcatatatacgcacacgcggtgggagtgggagggggagactctgccctgaccacaagaaccaaactcctctttcctttcctttccatccatcggaccatcgatcacaattttc

SEQ ID NO: 113 - DNA, 161 bp, Zea mays
cgtaagtaacgactgactttggtctaatttcattcattcatttggattgggtggtgagttggrgtgtggctgttgtggatgcaggtttaaggacatgtacatgcaaacaagagatccaggctgatgcccctctggtcactgaagatgtttatgaaatcatc

SEQ ID NO: 114 - DNA, 414 bp, Zea mays
  unsure (1)..(414): unsure at all n locations
aactggatctgctgctctcgagaccgaacaactgcaacaaactcanggcagggactcagcatctacacatcctgttytacgtacggtacgaactgaactaaactacccccatgcatatgatgatacctttctggtaagttgaaagtgttgttttttattcagtttggccttgactctcacttgccaaagatgttcatttttattaaatctgcaggtgattgtgacacaaatcggctgcatgggaaccatactagctgccaagtatgcttgtttgtttctatgcaaattcattcccctaaacatgtaaaatccagttgttatttgcattattagttctgcttctgcataagtagctccattgctatttctttcacaatgcattgaaattgtgaattgtcattctgttcgatcctt

SEQ ID NO: 115 - DNA, 157 bp, Zea mays
gggtccgagcaaaaggccgccggcggcgagccagccagccagttaaagcgatccatagttacatatatatactatcgagcaacaagaaagaaaggaagaaagaagccaagcccaccagggctggggaagagaggagctaaggaaggaaggaaggaag

SEQ ID NO: 116 - DNA, 446 bp, Zea mays
tggcggacaccgcgtgccaggcgagcccgcaccacccgggctggttccggcaccaccgcaccccggccagggcctgcagggagaaacagggggcctcaccgtcagcgtccggaggcgcgtcgttagtgtcttcaatctccacgccctccatgaaaaaaatacgtctgcaaaaccggttgtggccacgcgtgtacttttcattgcagttaaaacagaggcccatgcggcgccgctctgccatctcatcgggggtgaggcgccgttgattgtcctcgccacggccctgctgggtggccctcggtggtgcagggagcgccagcggctgctggggcgctggaagcgctggacgtggcgccggtgcggacagcagaccgcgcgggggcgcccgaggtgcaggctgcaccagccggtcggcctccatcaactccacttggcgcgccaggctc

SEQ ID NO: 117 - DNA, 1500 bp, Zea mays
gtggtggtggtggtggtgagccacttgaacagacgggacatggcggcacgtaaatgccaaaagtttagtgttgtgagaagtgaggataatgatgacgacaccttgtcgtggacgccggcggccggtctggatgtctgatcccaccaccgccgtccgccgccaccacgaccaccaccgaggtctccccactctagagtccagagctgtcactcgttgggcaagtaataagcaacttgctgcccaagccgtcgcatcygtcgccgtcgaatctgaaggtggcatgcggacgacggagaggtcagcggcgaccccgggtcggcgaggagggcctgcttgtccagcgcatcccaccgtcgaccggaaactcgccggaaactttccaggctaccttatccgtcgccaagcggccgtggctagtcagcagtctccggtggctggatccgtgacgtttcgcttgtgaggtcactcaggtcagtagcccggtccggccgtgccgtgcgtgagccatccctgttggctgctgctgctgctgttaagtgctatgctttgctaacatggttactagggcatccataccattccaattttggcgattgcagaaatgacagggaataagaaaaaaaagcacgttgcaatcattggtttagaaaaaaaaaagcaatggccaatgggctctgcgtacgtagtgttacggaggcggcagattggaatcgcgcgggcctgtcactgccacgaacgaaagctatctgctgccctccatgccagggcacactgactgacgcttccaggaccaggatctacacaagatagacaagacaagtacccatcaggcaaggccttcagcccagcaaaggtggccaagccatttttttctcaacaaaactagtgatgtttggttctttataaggttttgactaaagtttagcctgtgtttacatccaatattcgaatgccaataacaagggtttaatatagtctaattacaaactaataacaaggggaaaaacaaagctcttaaaaagatacgtttttatagagagtcgagaaggagcttagggcccacgatcccaggccgatgttcacccagtacaaatgtacaacccttgtcctcctccttggcccatcgtcaatcttcaccaaagccgcctcgtctggatctctctcactcctttcgcgcacaaggttttcaatggcattgaccggtagaacacgtgcccggacgccaattatctcgccctttcagatttgagaacaacaaggaggaaaagtaaacgcaagttcaggaaaggggagcctcaaaaggagagggagagtgagagggaggggaagtgcgctgcagtgctgcgcagctgcgctggggagaagagaagaaggtgccaaccacttcccaaggagaccgccagctctgctgctgcacgaccgaccagcccgtccactcgcctcgccttcctccgagccccggcgaggaagaggaacccggcgccgccggacgcacttccg

SEQ ID NO: 118 - DNA, 1500 bp, Zea mays
cagtctctatacttatatggttgtattatctaaatctctaaacttgtttttagtatcatcaaatattcaaactacttaaacttgtgataacacttaaaacaagttcatgaatctagatgatacgaccataaaagtataagaaacagaatgtgaacgttgagagtttagggactcagatgatacgacttcataagtttatgacctagatgtgcactctaaaagtttagggatcagaataagacaatgatataaatttaaggatcagtagtgtactttactaaaaaaacaaatatacatccttcgtatgctttaaagagtagactcatgcgcggtgacgtgtgactgaacagccgacaacagctaagtggaagaggcgttcaggataccaaatttagttttatattggttagcaaactatttatgagatattacgattggtgataatatatgtattgatagttatgtaatctatattaatattttatcgaatacttatgtgctatcgtaactatggaactcaaactaaaaaaaagtagaaatagagatatacatttccaaaatataaatagaaccggtggcgacagtaaaaattccactccttccggtaaaccgatgcaacccaaccgcctcaaccggtatcccacccgttggcattcaaatattgcctaagcggcaggcgaatcagtggtacggacggccccgatgcatccgctccttccggtggccatctcccgccgtcgatccatgacacaccctccccctcccactcccagtcccatctcaccaacacgtcaagcaggcaatagcaaagcaagcggaagcatccattccatcccctctcaatcgcctccgcggctccgcctccccctcccccaaatttgaaacctccgaggcggacgcgaggcgaagccgtgcgtcggtcatcgagacggccggctgggcgaccgcgccgccgcctctctcctctcgttgcgtgccgcgggggttgcccgcacttgggcgcgcgctcgggcgcggggttggatgcagctccgccgacgtaggtgctcgtcgatcgcgtcggccacaccgggacggtgggtgagtgagatgagatcccatcccgcggcgtttttctttatgtctctcttggtaggagtaggacgaaggatgaactggggttggttcctcttgatcggaagagggacggagggagatctcaggggacttgcgggatcgcggatcgcggactcgcgggatctcaggggggagggagatcccgcaaatatgaagacaacttaaaaattttaagagagggatctcgaggtagcatatctcagagagtggaagggagggagggggtgggtgggtagcgtgttgttggaatgcgggattaggctcatgatgtctggctttggattttcttgttgtttggcttctgttgttatgtactatgtgataatccacaatatacgatggtaaaattatttcgcgtgtgaatgcaacgttgttgcagtaatc

SEQ ID NO: 119 - DNA, 243 bp, Zea mays
ttaaaaaaagtctcatatcaaatgcttctagagctgagcagggctacgggctaaaagcaagctcacttcttgccgccccgcttccttgatttcttcttgcccttcttgttctgcgttctctttgttgcagttgcagtcgcagtcgaacaagacgttacatcttcttccttggctggttccaccgcgtccatccctgctgtgtcaggttcatcattatcagagcatccactccattcatcagcc

SEQ ID NO: 120 - DNA, 160 bp, Zea mays
gcatttctccacagatgcaagcccaaccattctgttcttccaagaaaatactggtagtatcctttttccccctatgtacatataaaccatacttcatatgatgggtcaaattttatgagactcattctattaaatcctttactgctagacattgctcacg

SEQ ID NO: 121 - DNA, 525 bp, Zea mays
ggtgagatgttgcagatcttttctccttttcctctccttttcattttcctttcagtttttccgtggcgaagatactgttgcatttgtgggggcagtgctctgtgcctctgtctgagctgatcccagctgtgattgattgcttgctcatgggtcacggccatgaccatggcatcccctcctctgcaaaagcccgtgcctttggtgtcttgtcacgggcaaaagtggcgcatgttcattattatcccccctgcctttttgctttcgcaagccctgtatgtgtcctggccataaagatgcaatctttatcctctatgcacatacttcacccgaaaaaaagctaaaggggtcactgattggtgctgcttccttaaatcttgcatgtgtgggaactaggaggccattggtcacgggtactgttccccctactgttcttgcttcccgtgtcctgaccatttcagtattcgttcttgttactgatggtgttcttgtgatgaagggttgggtctgtgctcaggtgccagcaag

SEQ ID NO: 122 - DNA, 53 bp, Zea mays
ccgaatctgcgccctccgcgcttagatctcccccctccgcgcttccggatgtc

SEQ ID NO: 123 - DNA, 142 bp, Zea mays
tcggccgcaccgagctggagccgactcgccatcgtcgagtttttttttcggccctacttctgtctccacggctgccgacgagccgcgcaaccgaactcactgcaggaggactcgcacagatcggtgagcgagcaagcgagag

SEQ ID NO: 124 - DNA, 1500 bp, Zea mays
taacaatgcgcacctaagagatagtgaactgattgagtctatcttcctatagttctgccgacttatcctcgcttggttccattgtacggggctccagcgcgggaaagtcgggtctctgttgtggttgcttgctcaacgttgttgggccatccgggctcgcaccgatccggccttacgtcgatctgctttactagtcgttcttccccaggcccacgaagggatgaccttacgatttattaggcccttgggcctttcgtgaggtcttttatccttccagtggacccaggggatatctgtcccccacaagcccccgatctttgggttgattttgagataatcggcccaaagatcctaggtccagcttgcggtcttcgtttatgacaagaaatgctttccgggtagtttggtaaaaacgatttcttactatccccttctgctttgatcactcgaaaactggtgttctgtctcaaactcgtgctttggaggtcagcatttcgtactgtaggaccctgaacttcattgggtgcaccggaggtgcacccaatgggtgtagcccccgagcttcgagcggatttttgaaaataatccactcgaaggtcttcatcagaaatcatttttattttccgcttgcactttgttggaggtcagccttgcctttgatcttgtcatatgctttagaagttagcattatcttgacttgaaatggcgattcattgggtgcactggaggtgcaccacaatgggtgtagccccccgagcttcgagtggatttttgaaaataatccactcgaaggtcttcatttcatgcccttttgctgagaatcatcctctcttttttccgaatgccttagaggtcagcattatgtcattgatattatgctttagaggtcagcatgtattttgtctttgaggccgagttcatgatctgcccatatcttgctaggtggtgcaatttatttgatctgcgactgattggacgttcgatggacgtcccctggctagtcttcatgtcgcttctgtcggtcagacttgtacttcaccggctatatttggctttcctttgatccttactgatatctcacttttgtcttgaggtattcattgcatgccctgcacggatgtgacagttttgaaaaatatactgataattcctgggcgtcccctccccaatgggtgtgggcaagggacggcttggtacgctgagtgttttagtcggctgcttctgagtagtaatgtgatgtgacggcgggtgtaatcatatcccccgcgcggttgactggagtcccaatgggtgttgcgttgcgcgaaacggcgtcagccgcctgacatgtcttcagacgggttgaagtgtgtattgaatgcttcgcgactgttcagtgaccgtggttggaggtgagcggttgccttcttcttctataaataatgcctttgcctctccggctttttcacatctcttgctattctccgctgcttgctttcttctccttctcgcgcttccacc

SEQ ID NO: 125 - DNA, 132 bp, Zea mays
ggtggatttcatatattaagggcgctctgacaatgggagccctggtagattatttatatctatgggattctctttctagcttgtgtctgcagccgaatagggaagatagacacatcttcaccagggcctctg

SEQ ID NO: 126 - DNA, 829 bp, Zea mays
ttttaggattatgtattaatagtaaagaactaactatattatgaataagctaagatatagctgcaaaaatcattgcacctaataatcgaccatattattaaatttgctctcatagaatcagaggctcagtccataagtcagtcctccctgtcgccttgccccgctgcctagctccaatgcatctggcatgcctctccattctccacctaccatgaaaccgacgtcggttacccatagtcaccaggcctggtgccattaaagttttggctctggcactgaacgtgcatttgtatcgtatcgatctggatccatgatcctagaattaatagtagccattctaccgacgctagatcgtaaatttcactgtagacttggaaggatatatatggacaacgacgatatggatatcaaccactaatcttaaagcaacaaaacgaccaccaaacttaaaattaatgaggtagacatatatcatgaatacgaagcatgttgtaggaccgtttttatagctgactggctacgaggatttttttcttcagatctgttgagtacttttcagcggggtatagtaacaggctaacagctaatgagctaataccaggtagacactcttctcgtacagtcgttagctttttatggcacgtgtcatggtgcgcacgatgcactgctgcaggttctggaaactaatacacgtacacggcggccggagccgatcccgggacacgtcagcctgacacccggcgtggttttacatgcatataaaacagcacgcaagcaaatccaaccggcacgcacgcagttgcagtgctactcattactcaacttgcaa

SEQ ID NO: 127 - DNA, 342 bp, Zea mays
cagcccaacatgtcccgaaaatcaaacgggctggaccgaccccaaatctaaacaggcgggctatttcgggcttgaactgagcctggcggcccgaatatacacctataatacccatcatactctatgagtataataaatacaaaataaaatacccgtgagcatcaaaaaataccatactcatgctctaatgaggttttatccactgcctattaccatctctacctgtgtaggcatagtattcctacgagcgttatcgaggtagcacaaacagcaatatatatgaagatcacaaatacagaaacaactaacacccaccaaggaaacagagctactgaagtacta

SEQ ID NO: 128 - DNA, 1393 bp, Zea mays
gatgtggtacagcctccgtgcagccggtggccgggctatctcggaaaggcacgcggggagtcggtcggtggggcaggaccgacgggacgcggcgaccacccataccgtgcgcgacaaactgcgcgtggccttttcttggacggaaagccggtggatccgacgcgcccgcgggttgccgcggcacgggcacggcacgcaggaggggagcctgggaggctggactggtgccgggcggttttgccgcctaccccccgccgcgcaaaccggcgtccggacgggctggtgcgtctcccgccgactccgcctgcgcctgcgccgtgacacggatgccacgagcccacgcacgaccctggcttccgcgaccgcgctgcccgagagcagaacccggccgcggcacgcagttttggcaccgcgcctgccgcccgtacggagcagacggcagagcgagcgtgcttctggcttgtgggtcgctcgtgagtggagcgtttagcttatgcctgttctcactttcttaaattagtgcacgtaaaaccagcgacggagggttccttttttactagtgctatttttttaaccggtttgtcaccgacagaagcgtatgtatatacatgtcaaacgtactagtacactcggtctttttacatacatatggtttgctcgttccttactggttcagtttgtttttgtttccaggagtaggaactctgtactgctacacggcacggcccctccctgctccctcgggtcaaaactcaaaagccttcattttgatcacggccagccggtcaggtcatttctttattattttcatgtcgttattttctttctcgttttttgggtgatgcgaagagccaaacgggagcttaaatattgaccagtgtccttctggagcaaattaactttgactctcaccaagacgtgttttttgcatatacatggactgatggactgatctgtttcttttatgcgagaacaagtactatatggtaagcgagaactcgcagtggtgggaacaaagcccatcgcagaaacggcaccaccaccgctgctctctcgcttcgatttgccttgccatctagattctagatagactgctactgctaccgtccttacgacgcgagaagtggcctgctattgctagaagcccggggtcactttctttgaacgtacgccgtacgcgtatacacacatgctaaagcatcaggtctcctgcctgccccttccttgcccgggccagcctcgccgcttggggcgcgcataaataccagcgcggccgcggtacccctgccacagacacacaacacacaatcccctgcaactgcaagtcgtcttcttccccaagcctaaaaccaacaacagtttggcagatcgcccggctcgatcgatcgcagcc

SEQ ID NO: 129 - DNA, 658 bp, Zea mays
gtcacaatttgacagtcaaggaagcgctagttgaccatggttgggtgagaagtatcaacttacagttcatctcggcaatcgaccacttgagccaattcattgagccttggacaattgtgcaatctatgcgcctcgtgcaaaatacggaggatgagataacttgggccttcactcaagcaggctcctattcaacgtcaacagtatacagagcatagttcataggccacaccgatgtaaacttcaaggcgcttatacagagcatagttcatctgcctaggatgcctagaaagggagtacgctccatgctccttctcacagtgtgggaaatttggaaggaacgaaactcttgtatttttcaatagaaggagagaagcgtgccgacgctcctgtcgaaaatcaaagaagaggccaccctttggggcaccgccgacgccttgcaacttcaggcgatccttccggctatgtaaacctaaagccaatcctcgcgagatccaaaaaaagttgtaaatctgtaatctagccaagttttgcttgcccctttttttggggggagcgccctaggaaaccttgttcaaactcttctttttttttaatagaaatgcacactatcttgtgccgttcatttcaaaaagaggacttgatgatgcaatgttggatg

SEQ ID NO: 130 - DNA, 1022 bp, Zea mays
actcagtagttcggttgtggcccctttcacattgcgtatataaaacaaggaatagggtcaatgcctgaaccaacgttcgccgtacccctttctcgaacacacatgagatctgatctatctcaacacggttagtaaagtgaaggccaccaccgtgatcctcgtcgccaccgacaccgagaatcaaactaccacagtaatggcgtttcttcccaacctcaaagttatacccatctgttttagtgcagatggtggctagagtttacaagctacgatcattacagcctgacaggttcgaggctagctccatttagcaccagctttctgaaacaggaagtactggcgtacatatatgtcatatgtgatccacaaattaaatccacactgaatctaatgtagtaaactgcggcagcaccaaatttcgcgaacccatgacccatgggaatgcgagtgcttttccttgcatcagccaaagatgctcaagggacatcgagagagggagtaggaagttacccgaggaaggggggacgtcggtgtgagatggcgcaccctgtcctgaacgcgaccgcagcgctgacggcgccgatgctgaaaaacaggagcgctcccgcgaacggcgcgcggcgtccgtagagcagcgcgcgctgcgctccggcgggactggcagccgcggaggtgggtggggagaaaactcggaacggtgcggggagtggcatctccggtagcttcgataaccgcttttgtacgcgtcgccgtcggtaaagcgcatcccttgacttgtcgactcacgagcacgattcgtccttgctcctctcttgggctctatcttgtgggcttcacaaggccacactgggctttcagcaaaccattcggccccgacgccgcaactcgcttactcataaaccctctcgcctcggacggaagtctccaaaccaccgagcatcaaaccctaggcgaacccgatccaggaacaccgccaacgccgacgggtggtggagctccgcttcgaccgcgcttctccagcc

SEQ ID NO: 131 - DNA, 421 bp, Zea mays
tctacatctagtattccgttaactaaaatagtggggcccccaggggaaggcccgccgaggccgagcagaggaaacctaccaagtggcaacaacagtccggtccggtgcggtcgcccccaccaaaccgccccgccgagcgacccagtccgtcagcgagcacccctgtcgccgaagcccaggcagcagcagcgggcaggggcgtccgtccggtccgcgcgcgttcgttcccctccccgaccggcagattccccgtccacgcccccgccttaaaacgcccgccactaatcccgtttctcactgcccttccgcggctgtgctgtgctctgctctgctctgctccccgtctttcctcctctcccggtctttcctcctctccccttcccgcccagcgcgtccaccaaggaagcccccacgccacggc

SEQ ID NO: 132 - DNA, 1186 bp, Zea mays
  unsure (1)..(1186): unsure at all n locations
atggcagaaggatgttgtcaacttcatgggaactcatgtcagtaagccatgttgaacggtgcttagcgcacttctgatggagaatggattaatgataccacggacaggaggtttgtgagctggagataaccaaatgagaaggatgcatggatttccagagtggtatgacatggtcgacaaagctagaggccatggatatgcttggaactcanaagtcatgtttcaactgtacgctaccatgttggtaggtcgagattcatgaggaaatgttgaacctttgaatttcggtccccttcagttctctgctcagattctttttcctgacaaatcattctgccaaggttgcttcattccatttgatttgtcaggattcatgagtttgctctacttcttcactttgatctggcagatgtactttttggttgtggcaatcgcctgaagtacaaccactggttggtgtcattgcctgaatcttattatttgaacaaagcattgcctgaattgaagagccaggcatcattcttcagcaatttttgcaacccgggtcgtttttgcaacattcttaggttcaacagaccagcaagatgtgcaaacatgcttcatgttgttggaccacttcaggcacctacatcgctagttcagcttttgagttccttattcgtacgatataactttatcctttcaacaattacgcctactctgatgtggggacattgagcacctatgaatcttaaggttttctgctggttgtcatcacaaaactagttcctgatgttcaaatatcaagaagagatggtggttgaatagccctatatgttggctaatggagagacagtccggcaccttgtgataggcagataggggtggagtaatggtactgcattgttgctagctgtttctctatatctaacaattttgtggcaaggaaacttaccagccagtctgtgtgctgaagattggtggttaccgtctgcctcgctgcagctgtatcttcaattcttcatacacattacttctgctgtcttttcttgcctggagttggttctgactcttcgctttggagggcaaaatgctagtattataattcagaaccattgttgcgataatttaaaattactttaggttattccagttatcagcctattattgttggagattggctgttaaactatgcctaaaatttgaa

SEQ ID NO: 133 - DNA, 1500 bp, Zea mays
gccctacagagaatgtaaacctgtgaattgtactcatggaagacattgaagaaacaacaactagtcaactaatccggctttcacataatcccccatctgcaccgcatgcaagtccgcaagggatcgtcggtccggccattccacgatatccacgggtaatgcagtttgatggaccgatgaattggctgaatgatgaatagcacccaccaccaccttctcaaaagaaaatgtggctgaatagcaacatctgtaaaaaggtagatttggtggatggcagtctctcggtcatctgatgtacctcatattagcgattgcaatattcctcctgttcggaacacaatcggaacggcgtgaaaaaaatacctgaagttttgaaacattgagacaacatgaactgtaatacaaacgtgttcaaacctgcaccgacgaattcgagcaacctcatcaacttcttcacattcattaaataggggagagtgactaaattttaatgacttaaacgaacactaattagtataaataatgactacattacccttacatttgctccacatgcattaaagaggggaaggtagcgactagcgagcacacatggctagcgtttttagggcatgtagaactctgagcccacggatcagttttctaagcacaagagacagctaagagcatgcacgatataaccctaagttcataaatcataaatgtagttaagacataatatatatggagaatcgtgtatagatgagctcttgacgaagaacacacctcttatatttttttcaattagatctagagacttttcaagagaccctatattaaatgatgttgtacacacccttatacctgctagctgctacacgaagaaagagaaggcaagtgggataaaaatcccactttaagtctcttttagccaccactttggtgagtagaaaactattaaagtttagtcaccacactcactatgtttacttttttagagactaaaagtgagtcgtcccaaacccgactatgtttacttttttagagactacaagtgagtcgtcccaaaccagacaggcccttgattcaacagcagccaaccacaactatgtggctcataaagatcatgacggtccccatttgtggtaccagttaatcaaagcttcgcaaccagccaccaaacgagcagctgttaacgatctcctatttgacggaagctacaagctagtaactgtcaggaggccagcgacagacaagagcagcgtggatagagcgggatcaagtgtgtgctgtgtggtagtgagcgccctgagccctggcaatcagaggataggcttcaagtagcacttgccctcgtttaattgcacgcacataaagaaattctctccctctgaacaaaaaacttcctcccgcgcagttctgcggtggccttttaatcttggtgagcttcagttttttgtttcttggactcttcttcttgttaggttgcgttgcgtcctgtgcttctgattggaggccgcc

SEQ ID NO: 134 - DNA, 612 bp, Zea mays
cacacttgtgcaattatcaattccccaaaaaaaaaccatcgttttctccgagagaaaaagaaaacgatgacaattccgagaaggaaaaataaatgcggcgtaggaccggaggagagcccccgcggtttccgaggctattttcgtcactccccggaacggagttaaagacagcgcatgggaccaggcggcggaaagcggccaccggcgcggcgaggcccgagaccgagagcatcgcaacgcgcagcaggcccccacaccccggggggcggggcacgcaagaacgaaccaaaccaacccacacccacggcaccaacaccacccgaagctgattgacgctgagcgcagccaaatccagccagcgataggaatatcgccaagaattctaccgtctgcgtctgcccgtcttcctctctctctctctctcctctccctcattctggatccaccgccgcagccttagctgggtccgtcgctgtcgctccgcctcccgctcgcttgccgggcccgacacgcccgccaccgcctccgctttgtctctccggcgatccgacgccccacccggcgtctgtgcagagcagtcgtgaggagttctctgttgtgggctgcccggcg

SEQ ID NO: 135 - DNA, 1500 bp, Zea mays
aagaatttcattaggttttgagtccaaaaccaaggttcatccctcgaaagttttgaggcccaaaccactctagagtaaactatcctctacactcgctccgtaatctcaayatgtgccactgccagtccctgactgcccgatcaccaagtcctttagttcctctacttaacttatataactatagtgttgacttggtcaaagcacactactccttcatgtactcttgcatcagtccatgtctctggatgtcaatcaccatggtaagttttctggcttctcaagtcacttactccaaaccccgccctccattcttcatcgctctcagtccatggacacgaaccaactttactttcacatttgtcgtcgattgtctatgacttctaatcctgcgcatcacaggctaagagacatgtttcacacaccataactcacactaagactaatcaacactaaagcaaaatcgattttcttgataatcactcataacacttgaagaccacgcacacatccttaatacttttaaacaccaatgttacttttatatgaatagccacagaactaaggctatattcagcagcttattcatctttatatcttattttgaagtttactctgtaagcagtgcagtcgtctaccgtcatatacacaatcggttggccataacctcatctttgtatctcattttgaagtttactctgtaagcagtgcagtagtctaccatcatatacacaatctattggccatagcctaaaaaattagattaatatcagcgagcagtgatccaatgrtcaatgcacatttgtcaccggccggttcgaatccttccagatcatcaggttcgaaatttcatgttcgcctttgctcgctttgatgcattcctgcataaattttagacctcagcctctcacggggtcattctttagaggtagctgatcacatacaaaatctggtcgtaaagatacgcaatactactgtgtacatccgtatgatctgctttctcatggtcattgaactagagtgagagctaggtatggaggagagagatagtgagagagagagaggagggaaagctaaggcgcctttgtatctgctttgtcagcacatgcattctacctctacccactttgtctttcccaccacaaaatccactttggatctgaaaaaaaaaaactaatagtatacccagccagcagcagacctctctaacaagaaaagcacaaacccaaacacccaaataatcatctatccttcacctcaagacatcactgccggccctgcagctcaaaagatgagcaacactcaccaacatacaaagcagcagccacctgcagctacagtgatcgaccccctctatatctacgcacacatctccctgatctcgtcttcagttcagcctcgcaactgccaccggatctttcagcactgactgccgtcgttgctgcatcaaatctgtcttggcaggtgtagctaccagctagctataggtggctcgctggagag

SEQ ID NO: 136 - DNA, 1229 bp, Zea mays
gagtagactaaacacggcgcgcggccgggtcgcgctaccatgcttgccgccgtgcagccgccggcggcctccgccgtcatcaatcttgctcatgctcggcaggcagccacatgtacgtgcctcgttcttcttcttgtttttttttgctcgtcgttgcttttcagaccgtaggtgtgattgcagcgtcgtctttttctcttccatacctctcttgcattggttttcttttctgggagattttttttcatcacctggaacttaggaaacttcaccactagctattttacacgctttgctactacctaccttctatttcgccggccttcatcagtttgccaaagctatgcaaattggtgtgtacgtcttgggtgcatgacatgccagcgctattctatgccgtctatatatctgcccctgtggtgcacgcggtgctgcttattctgcttggcatcgggctatagatgaaaatatgtagactgatggatggatgtcccgtaggatccatatagatagacagatagtagttcattcatcagggaaaccaaagagggaggatgaagaaggggaagcgtagagatctcgccttggcatgctatgctggcacaagatgcagatctgcttgttcgtcaacggtaggtgcggaagcgctgctgcgtcttccttttttttttcttttttttttttgagaaaaaataggtgcggaagtgacgaggctacagagatgggagggagaggctttcgaagctgaaaggaacagcgcacccgccgcccacctagaaaagcccggcccgtgaacatttcgaaactcaaacaaaagaaggtggagacccgcgtcatataatctcaggcccatgaaaaaaattgcgccaactgtagggaagcccaagcccgcgaacatgccgtgccagccaagactccaagcctactgcctactgtctactgccagtgccgcgagccgcgagccgcagccgcttcacgaatcacgacgcgcggccggagcatatcccctgccaggcgtccagacccaaaccgaacgtctcagacagactccgggcctccggctatacaaaagggcacccgacccgagaacaccagccagtgaatgattgtgtgcgggaggagcccaaaccctagaccccgcagccaaagatcccaccgctccaccagaggcgatcgaggagaggactcgagacaacccaaccccgccgccgagctacatcgatccatcg

SEQ ID NO: 137 - DNA, 913 bp, Zea mays
tgtatagtttttaaactctgaaaatttgtatataaaattcaaatagttaaattaaagtgtatatgaggagttaaataaggagaatggttggagatgaggtgaattaaaaagaaaggaaatatatttaaataggtacaaatagggatttaaatacgaataaaaagtataaatatggagatttggaagaacacatgagtgagatcctattttaaaatatagtactataggatctcaacaccaaaaacctgctcgaacagaggttatatttcaaaaaaaaaaaatcgtcaaacaattataagacccgatgtctcaaatcgtaaacagtaaatataggagacatatgctggagccctatcttttttttaaactatttctaacattttattttttaaataatatggtttattttttttaataacatgatataagactgaactgttggagatctaaatatttttatggccttaaatattttaaatcagattctatttcaacttttaaaatttaaatatagtactttttattggagatgctttacaagttgcattaaagttggccagtaggagttggacactgaaagtctgaagccagcggaaaagggaaggcggcctcgtcgtgtcatccggctgttcatctttctagaagaccatagaagaattcacatattctaatcagcaaaactaacatgatgaatcaaaaagtcattcgtgtctcttcacctggcgctgcatgcatgctgccacgtatccgccatggctgccacctccgttcttgtattgtatcctcgccgtacgtccgggaaactccgcctagccaccaacaccacaataatatcacctgcactccatttcagtttcagtgaagctagccatcagtacgcgaacacgctcatcagggtcaggccacagccacc

SEQ ID NO: 138 - DNA, 159 bp, Zea mays
gaactagcggcgcaccacatcggggcgctcgtcaagggatggatgtggatccccatcgcgctcgacaacgtctacacctgccgttgagagatcaggtgcttctggagcaagtaggctgcgaccgtcgagcgcttggacgcgctgctctttgagggcgcc

SEQ ID NO: 139 - DNA, 882 bp, Zea mays
cggcgatctgcgtgctacgagtttccagggcgtgggccggcgggggctcgggtggtggatttcggaccgcattacggtttcgtgggtagatctgggcggtttcgtgcggtgttttatcggtgccctaatgcaggggatttattttttaaaatccgtcgtttttttgtgtgttcaaatttgcggaaattgacggggccaaaatgtgtggattttaggtggtgttgttgtgcctggcctgaattgggcacgaacattgacgcggttctgggtgttgggttgccgtggatttgccggcgacgcgtttctgttcatagccgaaaaatcggagctttatgattcgttttattcggttgggaacatggcccaactggcttgagctgtatccagatagaaggctggttggatttctctgggttagtagggatttgtttgccgccctccaaaacttgtcgtgtggccgtagttgaaatggtttgcaatggatggggcagtgaccgtcccatccgaattgattcgtatgggctcaactggatccggtggcctatgcccgactcctaattaatttcagaaaattgtttgcgtcctcctagtttctgtataaaaaacggaaacgttcattgcttcgttctgtagctatcacggttctggaagccccaaagtggaaatttcaaccatcccattcacacaatagccgtgttcctttcgaggtcttattcacgagaatgcaatggaaaacaggggaaaacagtggcgctttgctgtctaaatggtgaatatatacaccttctcacaaaaacttctgctttattgtttatttgttcaggttggcatttcaagtgcgagaccttggcttctttgaatcccacaaagcacggttgagcc

SEQ ID NO: 140 - DNA, 596 bp, Zea mays
ttgttctgaagttagcttatcaggcctcaacaacaatggaaaaggaattgactgtgatatcttggatagtgatcaaactggagaagctaatttgagggggtatgttctatctgttctcataatagctgtcttgatctcttttacgactggaataactagttcatttcatgctatagccgttttgagtgctgatatgagctgaaacattttaatattgtcttctcttataaaagtctaaaacatgtcaatatggcttatgtaagaaatgatagtgaatgaactgatatacgtacagtatagttagcttgattgacaaggattacgttgaaacccaactgattgctttacaaggcaatttttttgtccattcgactttgctcagcaaggtaccttatatattattatgaaatgaatactttgtttttctggtcaatatactgttggagaaccaacatgtcttacttctgttatatctgctgttgcagggttgatcttagtactgctgaacttatctaaacaaaaacttttctgatataagcacggagcaaggttggagaacaacacacaaccacacaagtaaattacccatttcgttt

SEQ ID NO: 141 - DNA, 1224 bp, Zea mays
agcctagctagcttgttcattccatgcaaatatactaggatctgccaactatcatgagcttccatgcaggccgatcgagagagaaatactcctgcgacttgctacgagataggaacaaaaatgaaggaccataaaagttctgttctatatttctatacgtacgttctagcacatcacacttgatcattccacatttccacttgtccagaaagctttttctgcccggcaaatcgatccggagtatacatgaaatgcatcattaacttttacgtaaatggactttttaactatacatgcacgcatcgtctgctgcctactagtccttcagtcctcctaaaaattactccctacgtcccaaaacagaattcattttatattaaatatacactcattaattaacatatacatgtagttactacatgtatgtctatatttgttatcatctattttgaggttgacgaaaaaagagagaactagaaataactatattttttaagacggatcaagaataattctaacttatccctaagtcaatcaattttaaatctactaaattcacaaaaaaaatgctataagtatatatgataaaaataagtatcactacattttacaaaatatttttcatagcatatgtgtatatgttgttataagtgacatgttcttcactccccgatatatatactccaccagttgcaaacaaataatacaagtatacaacaattccattacgcactgcacgaccccgggctgtaaactacatacatacacgcctacgctacgacccgcaaaagaaaggaaccaaaaaaaaagcagacagcagcaacagtagcttctgcatgggcagctttcgtgtaaagattgcgggtgccatttacaaaaggggaaagatacgtacccagtgatacaataatgattaagctcattattacctccctcctgccaatgccaccccagctctttactcattttataaaaacacccctgagaagactcccaactgcgtccagctccccccacccagctctccttttccgggtcacgtgcggaagcgtcaactggtcaaacccaccattatcactcaggcggaaacgcgccggagggagggagagaggaggggcgtgggtggctgggccgagcgactcctccttccagtccaccgctataaagccccgcaggcctggcgagtcccgacggttccattactggtccctagcaggaagcagg

SEQ ID NO: 142 - DNA, 633 bp, Zea mays
ggtacccctgaaggttttttatatataaaaaataaagaaagtaaaaacctcatctaaatttgtgatttttcttccttttttttagatgaggtgacttatattagatcaagaatagcatgcatattacataacaggaacctggtacacacaaaatctacaatgggaaaacactggtacacacataatgtacgataaaaaaacatggctcccaacaggcagagcttcatctccaatccaatccaccatcgccagacatgaccggaggaaacataactcaaatctgcaccgatgaggaggggccagtaatggccgttacacttttagcagtcaccaagggcaacatcccgcaaccaggggtgcgttaggaagatgaatggttcgggtgacctcgccgagccgggcatagagaaatccgaccccgtcaagcacgtcgacggctggctcgggaaggagaaccggcggcgcctcccatgggcacatcatcggcccggaggaagaagacacggtctagagccgctgctaaccccaccggcgaactcctatagatctactaataacctaggcagctaagctgccgcccgacaactgccgccaccattccatgggacttgcctgcccgctactgcaagacga

SEQ ID NO: 143 - DNA, 49 bp, Zea mays
ataattacgaacagaactcgtgcagtagcaatattctaactatgcattt

SEQ ID NO: 144 - DNA, 410 bp, Zea mays
ggttggcaggacgccaggacccacacattaagctccagggcagcgtgcagcgtgcccagctgctgccaagtgtacgtcttccccgggcagctggataagcctcaccttgtgtccttgtctcaactctcaagtctcaattccgtcgtcgccactcggcccctacacgaaggcacgcagcacatatcagacacctccgaccgtcgcattcttcacgagtcctccggcccagcgcgcgccttctcaaaccttctagaacgcccaccttccttctttcgtccactcctccaccgctccattccgaacctttttaagctctcccatggagtctgacctcatagcttatatagcaaaacaatagaagtagaacaagcacagaactgttaagctccgcaggctgcagctcgtcccca

SEQ ID NO: 145 - DNA, 1500 bp, Zea mays
tagttggcgtggttagtggcacaggtggaccccatgtttcatcgagacatcgatgacggtagcagattgtaaaaatttgcaatgttaaataagaatttggcccttgtttatgcagtttgtgaaatctgatggcgaccgtttttcttattttctcattcagcaacccacacccatccatccgcatgcacgcacaccactaaacctataggggataaatctgtttagctaaggaatactcaatgtttcggacttcaatattcacaaatgaataagtatgactgttaaaaaaaaggtcactcatagcactaagaccacacgacaccatatgtagtaatacaagaagttcaacacactactcaaggaaaagattcaagtttctgtcttgttcatacttcatctcaacttgacgaagaatccatcaccttttgtttcaagcatgccacataaaacctttaggaccacagcagggtgatcccttgtcttgtcaccattcaggcttgtttgcataagcatgtatgtatccacttcaatccatgtgtgttggaatgatttggtgtagattttaaactaattctataccaaatcactccaacctatgtagattgagatgaatatgtacaagaaaatgttcaacatcgggatcctcataggtgacaggaacgtgggtgtgaaatccaatggtctagaaaatgttgcagccgtgaaaaggaaagaatgtgacctcagggctcaggccctcaggggacatagacaggttcaaatatcgcatggtcaaatttgagaatatatgtaggcccacggactctggaggtttgggaatttttaacgaagcgagtctgatcgtttggttttaatccgtatcgtcttctacaatttttatagtgtttgtctctacaaattacagttacagcagtccaaacaactgtttttaatcgaaagcgaacaaccctgctaaaatggatttggagactgtagtggagatgagaagaatggaaaaaaaatatatatgcatgagtacctcaccaactgtaacaacatggggcccaccattcgagcctgttcacttagctttaatacagtgtttttgtctctatagattacagctgcagcactctaaacagacaagcgaacatagttgtcccgtgtcagatgtgtactgctgcagatgaatgacaatccagatagatacagcaacagcttcgtctatatcggatggaagatggtggtgggttagccagtgtttgccttgctacctcgtcgcattcgtctgagagaactagggcgctgtaaattgaagtaaaataaaccttactcagcaagccactggccacttccaaatagtcgttcaaccaaggagcattcgaatcgaaaaaacaaggatgagacggcgcgatgcattgccacgggacacgcaacctcgccgctgactcgcccagtataagaaggaatccagtgttccagtcccaaggacacaagcagcatcaaccgatcgtccaggaa

SEQ ID NO: 146 - DNA, 323 bp, Zea mays
ggttgccgactcccggcgcgctccgttcgaaggcatctcttcgcgcgccacgcgcctagcgcatgccgagccaccgtgatcgtgcccgaccacgtgtgctccacccgcgctcacaccccgccctgcgccccgtccaatcttctcccacagcaactcgttccttccccgcatcccttgccgtacttcgacgtccgcacggtctcggccgctcgctgataaataaacgcagtgaccagtgacgcgcacggatcaatcacgtaaaggcgagaccgcaaggacaccgagctacttcgaatacgaatacgagctcagcctgttccgag

SEQ ID NO: 147 - DNA, 515 bp, Zea mays
ctaggtgtaataagtctctagttctatcatacactgtcagccaaaatgctgcaggtgtgttgcatgtaaattcagtggcacctcaatgttaagaacgagagaagcattcggctgaactaggactctgttcggcattaattatgatgttttattaaaaaataatcatatattattatttatgcagcaatgcaaagtaaacatttttctgattaattaactagattccatagctcagtatatcaaaaattcaaaatagaaccacttttatcaacaatggcccatcaatcaaaagcccactaccatatatgggtagattcatggtacgaactctaaaaccctacggcccatgggccacaaagaagcccaccgatagaggcaacgaatggaacgaagaggatctggcataatgggcatattcgccgccgtcagcctatccaccctcctccgccgctcgcctgcccgctgctgcgcttcaccccgctctcgcctcccgccgccgcgccgtcccggtcgcg

SEQ ID NO: 148 - DNA, 776 bp, Zea mays
ttgggggggggggggggggcgtttaccccggctgcttgcgtcgtcttctccctcaacgcccaggagggggttaacggatcttgcatcgtctttgctaggaaaagaagcggaaccgccgccctgcctcacctacctaccgcatctctgttgctccatttgctatctcccttcatttcccattttattttattacaaacaaaaaatgcaaaaaaatcttagctttcgagcgggtaaggtaataagagagaaacggccggacgttgggcaccaccaagatctacgggcctagagagtttttaaacggctttttcctaccatttgtgctagttccgtctgttttgtctctctctctctctccatcgttacctgattcacatttcatgtttcgatcttgcgcagggctccgtgatgccggcggctctcgacccaggacagcggcttctctgttggcccaagtgcacgcgactgactgccggtgctggtgccttgaaatgcggcagccgttctacggccggcctcccgtccagatgaaggtgcagctggtggaacaggaaggctccaaggggatgggttcttccgggtgcgcggagatagtcgagctggcggacgacccgaaagctgctcgtcctgctgcgcatctgagagtgaggggtcaagcccgtggggcaggaggatggggcgcggtcgtgctcgctggaggatgacccttgacagctcatcaggtcggtcaacgtgcgcacgtcggcgaaggcttctgggcagaggagcaccgatag

SEQ ID NO: 149 - DNA, 167 bp, Zea mays
ccttgtgcacattagttttggctgatgaccggcatgttgcgatttggtgtcataatacttttttatggggtttacctgactccatggacattttaacgattaacactgccacagatacattcaaatacattctgaatatagcattctgctgcagaacactttgagaa

SEQ ID NO: 150 - DNA, 169 bp, Zea mays
gatgatttgaattgcttattgaatatttacgactattcagtgaccgtggtaggagatgagcagttgccttcttcctctataaatagagcgcttgcttcactagcgtcttcacacatctctctgtcgcttgttgcttactctccttttttctcttctcttctactccacc

SEQ ID NO: 151 - DNA, 220 bp, Zea mays
tctcggtgaggtccgagttctccatgtgccgtccaagtatcaattcgctgatatcatgactaaaggcctgccaattcagctatttgaggatttccgatcccgtctttgcatccggaatcctgacgcttcgactgcgggaggctgatagatatatatagcaagtgtatattaggcaagttcatattaggcaagtccacaatcagtgtgattagcacctgcc

SEQ ID NO: 152 - DNA, 167 bp, Zea mays
tcacgttcgggtgggtttcggggccacttcagccgccagcagctagacggccctatctcgctcccgcggccgccgtctccytatcctgccgcggcggcgagcacgtgcggagctgcgggcgccaccagacaaacccgctcattcgttcagcccccctgcccggagca

SEQ ID NO: 153 - DNA, 1020 bp, Zea mays
  unsure (1)..(1020): unsure at all n locations
tctccctcctacggtcctacctacagctgtacaacacatccgaccttcggcttcaggcgatagtcttctctcccttcccctccagcgtctccgtcctattcactgcagacgctcggcgccagcctcccatcactccctccatcgcagtctccacctccatctccctatcgccaggccctgttcacggcagccgacacccgtgatgttgaccgcgacggccaccggcggcggtgacgctgcagacgacagagtttgcgggtaacagacggcgtgagctcaagcagctaaatccttcttcgcagcagctaataactaatcaattctataccagtgtttggccgtcctctgcatctccaaaatgtcgaagccgtcgcctaggtctccattttatcaaaaccagttctgccgtgtttcataatgtcaataatctctgtcaaggtccgctcagccggactcctttccactcaggtttnctatatatatatatatatatatatccanccggacctaaactacctattgtgggccgcgatatctgaggttgggcttcgaccgcactggctgcatctgggatgggcttcagttgattccttctcttggctgtcagcttcaccatcccgtgcagctcatcacttaccgccattatcagggctgctgacacactgtagcccatatatagcgccagcctatgcgcaaggcacgattattatagagacgtgcctgtaattgtatagttttgtgtcgttgttcattttgattatctatatatacatacagatatgagatatcggcgacgtctgatttgtatcgacaaactaaccaaataagcctaatattcaacgcggtgcatgcactgcgcattttatactttattataggctaactaactaactagccagcttctccaagcaattttaatttatatatatgcatgcggcatgcctcagcgaaagcatcggcaccaggccactagtacgtcgtcttccctagctaagctagcttcctggcagcagcaaatta

SEQ ID NO: 154 - DNA, 470 bp, Zea mays
ctgcgtgctccttgggcggcttcacagccccaatctcgtcgctgtcagcatcgacgcacgagtccttcaccacggccttgagaggaggcaccacctccggtgccacggccaccaccatatccccaacgctgccccaacctcccgccgccgccagctcgttcaccgcggcggcggccgcgcccacgaggctcgccgggacccagtgcagcgcggggtactccggggaggccgcgagtacggcagcgcagaagaggaggaggtccccagactccttacccgccggctcctgaagctggggctggggaggggaaggcgaagggaggagagaggcgaggagggacttgacggaggcggatgcgcccgcggggggctcgtacggcgccgcggcgagggagtcgcggagcggcgccgagataacgagcagagaggcacgcgggagcgccgcagcggcggtggcggcggcgtgaggc

SEQ ID NO: 155 - DNA, 297 bp, Zea mays
cgcgctgcacgctggcgagcgatccactcaccgttgatcccaacaaactccggtccccaaactccacagcaccaacagctaagcccgatgcgctgcgtgcgcggcgatccaaccgccggctcacctaaaaatttcggcacgtctaactgcgactggcaggtgcgcacgcgtggtcgcgcggaataaagcggacacgttgcgcccccagcgaagcccgcacgcatcgcattcgcatcgcatcgcaggtcgcatccgacgctagcggctagcctagccgaacagcctgagcgcgcgaag

SEQ ID NO: 156 - DNA, 1500 bp, Zea mays
gttaaaaacaaagaaacaatccatgcacatcatgtaagtatttatattggctcaattccaagcaacctttgcacttacattatgcaaactagttcaatttatgcacatttatatttgctttggtttgtgttggcatcaatcaccaaaaagggggagattgaaagggaattaggcttacacctagtccctaattaattttggtggttgaattgcccaacacaaatattggactaactagtttgctctagtgcataagttatacaggtgccaaaggttcacacttagccaataaaaagaccaagtattgggttcaaataaaggagcaagggtcaaccgaaggcacctctggtctggcgcaccggactgtccggtgtgccaccggacatgtccggtgcaccagaggactccgactccaaactcgtcaccttcgggaaattccagaggcgactccgctataattcaccggactgtccggtgtacaccggacatgtccggtgctccaaagaagagcggcctcaggaactcgccagtctcgggaattcacttctgctgctccgctataattcaccggactgtctggtgtaacagcggggcaacgactatttcggcgccaacggctacctgcgacacattaaatgcgcgcgcagcgcgcgctgaggtcaggcacgcccatactggcgcaccggacaatctacagtgcatgtccggtgcgccaccggacatccaggcgggcccagatgtcagagctccaacagacggaacccaacggctttggtgacgtggctgtcgcaccggacatgtccggtgtgcaccggactgtccggtgcgccatcgaacagatagcctcaccaaacggctagtttggtggttggggctataaatacccccaaaccaccccacattcaagtatccaagtttttccacttcccaactacttacaagagctctagcattcaattctagacacaccaaagagatcaaatcctctccaaattccacacaacgccctagtgactagagagagagatttgcttgtgttctttcgagctcttgcgcttggattgctttcttctttcttgattccttcattgcgatcaaactcacttgtaattgaggcaagagacaccaaacttgtggtggtccttgtgggaactttgtgttccaagtgattgagaagagaaagctcactcgatccgtgggatcgtttgagagagggaagggttgaaagagacccgacctttgtggcctcctcaacggggagtaggtttgagagtaccgaacctcggtaaaacaaatccgcgtgtcacactcttcatttgcttgtgatttgttttccaccctctctcgcggactcggtttcatatttctaacgctaacccggcttgtagttgtgtttatatttgtaaatttcagtttcgccctattcacccccccccctctaggcgactatcaattggtatcaaagccaggttcttcattagagcctaaccgctcgaagta

SEQ ID NO: 157 - DNA, 286 bp, Zea mays
agtaagtattgtcttgtaatagtggatgattattctcgcttcacttgggtattctttttacaggaaaaatctcaaacccaagagaccttaaagggattcttgagacgggctcaaaatgagtttggcttaaggatcaagaaaataagaagcgacaaccgggacggagttcaagaactctcaaatcgaaggctttcttgaggaagagggcatcaagcatgagttctcttctccctacaccccacaacaaaatggtgtagtggagaggaagaatcgaactctattagac

SEQ ID NO: 158 - DNA, 753 bp, Zea mays
atagtggctgtccggtggtgcaccggactgtccggtgcgccacccgacagaaggcaagatttgcctaccaacaatacctccaacggctcctagctgccttggggctataaaagggacccctatgcgcatggaggagagacacaagcattctttgatcatctctaagcaccaagacttcattctcgcgcatttgattctttgtgatagtgacttgagctttatttgagtagagaactcctcgcgttgtgttgtgagctcaagttgtggctagtgtgcatgtttgtgctcttgctttgagtcttgtgtgtgttgctcttccctcccttacatccgtgcttctttgtgatcatcaattgtaagggcgagaggctccaagttgtggagattcctcgcaaacgggatatagtgaaagaaagaaaaacaccgtggtattcaagttgatcattggatcacttgaaacgggttgagtgcaaccctcgtccattgggatgccacaacgtggaggtagacaagtgttgtacttgtcgaaccacaggataactcgtgtgtctcttgtgattgctttttgtgtgattgttgtgattcgcaagagctcacgttatagtcacttggtattatctctctaacacttaaccaagttttgtggctataagttttaagtttttacaggatcacctattcaccccccctctaggtgctctcaattggtatcggagccgttctcttcacaaaagggactaatcgcacgaagag

SEQ ID NO: 159 - DNA, 1500 bp, Zea mays
atattggctcaattccaagcaacctttacacttacattatgcaaactagttcaattatgcacttctatatttgctttggtttgtgttggcatcaatcaccaaaaagggggagattgaaagggaattaggcttacacctagtccctaattaattttggtggttgaattgcccaacacaaatttattggactaactagtttgcccaagtgtatagattatacaggtgttaaaggttcacactcagccaataaaaagatcaaattttggattcaacaaaggagcaaagggccaaccgaaggcacctctggtctggcgcaccggactgtccggtgtgccaccggacagtgtccggtgcaccaccggacatgtccggtgcaccagaggactccaacgcaaactcgccaccttcgggaatttccagaggcactcgcgctataattcaccggactgtccggtgtacaccggacagtgtccggtgcgccaaggaggagcggcctcaggaactcgccagcttcgggaatctccaacggctagtccgctataattcaccggacatgtccggtgtgcaccggactgtccggtgcaactccggagcaacggctattcggcgccaacggctacctgcggcgcattaattgcgcgcgcagcgcgcgcagaagtcaggcgcgcccatactggcacaccggacagcaaacagtacctgtccggtgtgcaccgggacacccagggcgggcccacaagtcagaagctccaacggtcagaatccaacggcagtgatgacgtggcagggggcaccggacatgtccggtgtgcaccggactgtccggtgcgccatcgagcagacagcctcccaacggccacatttggtggttggggctataaatacccccaaccaccccaccattcattgcatccaagttttacacttcccaactactacaagagctctagtattcaattcaagacacaccaaagagatcaaatcctctccaattccacacaaagccctagtgactagtgagagtgatttgtcgtgctcttttgagctcttgcgcatggattgcttcttttctttctcacttgttcttgtgatcaatactccattgtaatcaaggcaagaggcaccaattgtgtggtggcccttgcgggggaagttttgttcccggctttgatttgagaagagaagctcactcggtccgtgggaccgtttgagagagggaagggttgaaagagacccggcctttgtggcctcctcaacggggagtaggtttggaagaaccgaacctcggtaaaacaaattcgcgtgtcacacacttcattattcgcttgcgatttgttttgcgccctctctctcggactcgtttatatttctaacgctaacccggcttgtagttgtgtttatatttgtaaatttcagtttcgccctattcaccccccctctaggcgactatcaattggtatcagagcccggtgcttcattagagcctaaccgctcgaagtg

SEQ ID NO: 160 - DNA, 1500 bp, Zea mays
aattattttatgactgacgaaatattccctatgttccaaaattagttaactcccctgtcttaaaattgttcaagttatatgttcgaattttatcaaaacatatatgttattctcacttttcgatataattttctatttcctaatatagattttttctcatcatatatttattgctatttctttaaaaaatctccttttttctgkgcagtatatgttttctatttttttatttaaattgccgtacgagaagtcaagtatagaaatatagaatggataaaccatcaatcggagacaggacccactgatcgagccgtgagccaagccaatcggagccgccgctggtgcacggagccaggggggcactgcgcgtgttgccacttgccactgagcttcgtgtcgacatctcaagctgctcgacccatgtgtgggcatctcggtcattttgcgaaggccgcgcatcctataaatgagaccccttcctcctcccctgccgttgttgttggcttcgtggtccgtgtttaacgggcgtagagagagaaagagaacagagcgagagagggggaggacgaagccctccgcgtcgtctcctgctgttccatcccacatctattctgcctcggcttgcaccttcgacctcgctggtaagttccatcgcttttaatcgacataggccttttagtcgcgaatattttgggtccgagcaacgaagatgctccgtcttgaatttggtttagctagatgttgttaatcttatcgttcggtcatgttttatcgtggatttggacgttgaaatgccgctatatgaagaattaatttgattttattgcggatgataggggtgattgtcggttagaggggttttaccgttcagatctagtaaaattgcactggtgaaaggaggagaggagtggggcagttaggtttctgggtccacgtttgtttaattatggtgagggtggtttctggttcacctacccggttgaaagggatgcgtgctgacttgggaaggtcctccagtttttgtttgtatctgcgagattctatatatatctacttggctaattttaaaatcgttcaaggttcaatgccagctgttctatctgcaacttagatttaggtttggtaccatgaattttttatagatttgggcaaactgcatgaaatccagtggattatgtcattattatagtgttaggcgtgagtgaactttttcagatttatgacgttggcagttgggtaaaaattggcgcgaaatcattgtgctataatttgttttgtattatgctagattacacactgtcggttaatctgttcttatcacaatgcagttgtcaatgcacagtggtctacctttcttacgcatattacttagatgagtctgctcagcagtagcataatagttcacagacaggactctgaagcaaatttttgttttgagttgcagaaagttctgacctcaaactgaaaggggcctgtgaagcgtttccttgcggcagtgca

SEQ ID NO: 161 - DNA, 48 bp, Zea mays
tgtgagtaactgtggatttggagcttctgagtgtgcggaattctggaa

SEQ ID NO: 162 - DNA, 924 bp, Zea mays
aatgaaatcgctccatttagttaactcatcaacaattaaacacaccctaaaataatgttggacacccgtgaaaggagactttcataacactagcttgtgactaataaggtctctagctatctgcgttgtgatatatttagtggatatgagctccacactttggctcttgtgtatcttgtttcttgcagggtatgttgtatagttgaggatactgatatcgtaaatttttactctatatgtctcaatttataatttgtttaattttttactaacttcgatctgctcatcttatttgtttaatatgaataaaattagctaatagttaaccaactatttatcagttagctaattacatcagtaacttttttttgttctaactattagctctagatattcaaacggggtctaatttgttttaaatctgaattgatgttcataggcatagcggttttagattaaggtctgcagtgcctacggagattccatcagacccaaacggtcccgttgccatccctaccctgtacgctatacacatgctgtgccatccctaccctgtacactatacacatgctgacactcgcaccgcacaccgcacaccgcacgcgaaatccagtcggcgcgacgacatcaccaccgccgtagagttgtggaccaccaccggcgcatgcacagggtccagagatttccttgttccttccttttccccaccgccagcacgtcgtccagcacgtcctcgttcctatcgccccgtgcgcccggtccaccgcccgccaccgtccctggcccctttttcatatccactgtgcagtgcccggctgcccgccgcgccaaccccaccccgctccgcccgtgtaaaccaaaccccgcttcggcggcggcggcgactggcccacgagccttctcgaaccgacgcatccgccaccc

SEQ ID NO: 163 - DNA, 302 bp, Zea mays
caaatgctataagttaagaacaaggcaacacaaaaaatgttaaacgtwaaagtccttcgtccttcgaagcattatttcccttggaatataatgattttcggacgaaggttatgaaggacatatcttcatcaacacaacatataataatgaagaaggaatcatatggaatataacgtaaacaattatgtataattatcaactcatttctatattattattatgaaaaaatagaaatgatattaaattacaaatgtaccttcggcttgaaagaaggtaaaaacacaagcgtgacgcaaaagtaa

SEQ ID NO: 164 - DNA, 1452 bp, Zea mays
cgccgcgccctcaaacacggcgattaatcagctaatttatcagttggctcctctgccattattgaggagcgaaaggtacgtccaggcctctaactccatattgctcataaaacatctctaaggccccgtttgtttcattggaattgaattccattttaataattataatttagataaaattaattaagtttatatatttatatatgtaatatatttgtatattatcttaaatcatatgagagagatagttatatactacatttatattatagcgaaagaagtacaagagtgtgctataagttgtacatcgaaaaaataatatgtaaatctatagaatcaatttccatctctcacccatgaatttgagataaacttatatgataactttggaaagtggtggaatgtcatattctaaaaaaataatctatttcattagtaagatttcaattcctcaaaataaaaggaaacaaacaggacctgaatgaattgagaggcagagcacgtcagaccgtgctgccgacgtaggaagaagaagaagcgcgagtagaggagaccgaactcccaagggaacgaatagtgctcgctgtcgcacgccaatgccgtcgcactgacgtcacgtactgcaagagcacgttacgtgggtcgaggaggaaacgtgccctgccctgtggtgcgtgggccggaaccggacgtcgacggactggccggaggatatttcgtgtccggattagcaatgtattgcccggtcacctttatagggcgccttctgattagcatttcacgggcctccatggcccattaagcagcccaatggtgtcgtggaccgacgtctccctgctcgagactctccgttccgttctactcttgtgcacggcgtcttccaaaaggaaggaaaaaaacggtgcctagcgtcagctacgggggtacgcaccttgaagaaaatggcaacggtgccttgagcccaaccccttcgtgtacatcggtggtccaaattggactcggagacttgggagttcgagttcaggttaaacctcgcctcatcaagtttttttaaaaaaaaactcggctcctcacaccatgtatacgtatagcctgccagcctggcacacgagaaaacaaaaggggagagaagacgtccaccgagctacgttcccaccgctgctggatcgatacagccgagtccaaaagaaaaaaaaaaaaccaccgcaagaatccatccaatccagataacgtcacaaacgactgattttgtgtccatgttgcctccacgcgacggatcgcatcgcctctggtttcgccacgccacggtcccgccagccgccccgaggccagtctaaagccagccgcgcagccgcccacgacacctctcgtctccctagtcctgttgtgccggacccctgcgccgcacccgcacggcaacagcatcgacctaggcccgagataattgtcatt

SEQ ID NO: 165 - DNA, 445 bp, Zea mays
gattgattagttaattatcttgccgatctttttttttctaagttcgcaaaggtgtgttgcatgaactccataaaaattgcctattaacctttttcttgcaaattgcttcttagttcaattgtttggtagtatggatgcgtttactgaaactcacattatggcaggcaaatatcttgttatctgaagcatcccccctaaccattccatttttcttgttgatggcaaatttgatttaacttagttttgttatgtgctatatacttgttatatttacatttatatgctcaccttttttgccaatttgcagctgggaagaagattatttacccacctcaaggtatacaaagggacagaacatccgcacgaggctcaaaaacctgtcccactcccgatcagggataaaagaatacaaaaaactggatagagaattcatcgactgaaaagg

SEQ ID NO: 166 - DNA, 213 bp, Zea mays
tgatttcttcaatcatttagtttagtttcggttctcggttatttctgtttggctcatcggatccggttcattttgccgtgaggccgtgactgttactgtgacgccgtgagtccccgactccacaacagcggccggcactcttccccaactctgcccaaaaatttgaaatccttttcgcttccatcttcaccgacccccgagcaccctatctag

SEQ ID NO: 167 - DNA, 1500 bp, Zea mays
tttaactttaacagtgggcggatcgatcggagttgagtgcgtgtgtacccccgcgatattaggctcggtcttacgatgatgacgagccatatataacgcacaggggcgttacgtaagatgtggtttggtagcacgagaattcaacgtacgtaccgaacaaaagcttgcaaactaacccgtccgatccggtacagtacacgagacggtcgatcgcgtggtcgtcgccgccatgtccggcgagcggcacctcgatcgagccccgtgatgtgctgtgctgtgcgtgctagtgcggacgcggacgcatgcgcgtaagcgtatacatggtcggtcgcggcctccgtagccagtagccacacgcctaacgaacgtggctatagctagctaatcgtctcgcgtcgtgcggggggttttggagattagcgagcgattcgtgctgcttcaccaacacacccaagcaactcgctcccatcccgacgaagcaagcgacaggtagagatagctgctaggcccagggacgacgaattaatacaaatgcaatgcgggtgttctactctactagctagctagtggattctggttttaagcgcgcgcgtacgtgcggccggggttggtcctcgctttatgtttttgcatggattatttcgtgtgtggggttcgttaggactcgtttgggaatggaggcatgtgtacgaatacaatacaaaaatgaaccgtatagtagtcttcgatcaccgctacaagattgtacacatatatactagaacccttaaaattaagtcgtggtgctcaagctgcgatttctgaccaccatgtataccgttgtgtcaacgggcgtacaatctaaacttggaaaaaaaaaagagtaatgccggtgtgtatactattatagttcctcggtcagcatcgcgccacttactctaatttcaacggctcacgaaaaaaaagagggaaatgcatacggatataggatacaatagactagggatgcagaggataagagcatctccaaaagattctttatttttgactctctatttgactctttatttgtcactttataaagattaaactctaaatataatatctcattccaacagggctctccaacatgcaagttagcttgactagcgagatttgctagccaaatttggctagtgaggaagtaaatttagagaaccggatagcttgtcaagttaaatagctagcctgttggagagctattttgctattaaatagctaaaatttagcttgacaagctatttaactagtctgttggacatgctcttacatgttgctgctagagtcggtctaacatttgtatgggaggaagaattcagtaacgtgcatctagcaaagagatcacgtgctgtaactccccctctcacagtactagagggcccacccctacccctgcccccaaatcgccaaatcctccccaccaccgcacgctggtcctgcccgtctcccgcccccgccggccgccggcgactggccgccgcc

SEQ ID NO: 168 - DNA, 206 bp, Zea mays
tccagtccagctcccgtcttctccgcctcaagagtctcagaccaacggcaaagttctagaagcacggttgcacgggcagcacggcataacacctccctccactgatccagttccagtcgcccaacgccccaacgtcttctcttgcaaatcgcaagcaaacttcctgttcagctgagctcagccgaaggttgccgtgctcgcgcgcc

SEQ ID NO: 169 - DNA, 1500 bp, Zea mays
cacaccgtccggagcctagaacgcgcacatagatatttagttgtcggagcggaggttcgaaacgccggtagttggcacgccaggtaggagccttgcgtattctcgacgatctttccaggctccggatggccgtccatgacgccgatcggatccccaagacgacatttcgcttcgggaaccttaacagtratgaggagagggccagagcctcggaaatttgaccccttcctcttaggagtctcgatgctaccgcaagggcttggagcggccacaaattagtgaaaagcgagagatgtatctaggtgaagaaacgttttagcacggttctctgagtctaagatacgattacacccatataacccacataagggcttgttcgtttcgccgttaatccatgtagattgggtggtattgagttggtttaaatccatagcaagtcaaaattcattataattcatctcaatacacacaatccatatggaattgaaataaccgaataagacctgaatggtccatgtgtttaaatccatagttgtatctcatcacaaatgtgtttgtttgcatgccttggaacaatatacatgaaaggggacatgggcatggtctggtggttaaggcttggttgggcggccttggctacgtcgagcggtcatgtrttggccagtcgaccataatgttggccagtcgagcttcttctcccatgatctcatctccatgtatttggtattgtcatacatgaaaactttgtacacggctcatggaattttgcacgtatgcatgcaacgcatgcatgttttctggtcattgtgctggggtaaagcaggagaggactcttttttttaatcatcgcgggagcattcagattagcttgtgtagcacctgattagtctccaatctctttagggggtgtttttctagagactaatttttagtctctcctttttaatctctaaattgtcaaatacaatgactaaaataaaaataatctctcttttaatcagcgtgtttaacaatttagggactaaaagacactaaaacgaaaggactaaaaattaatcataagaaatcaaacacctcctagtctgtgtgtttgggtatttcaatcggtgtatattgacctgcaaattctgtgcattttgctgtcgccctgtactgaacatttttttggctctacctgaaagaggatgtctaataaaaatcagacaggtatgctgccactgctattgccaggaacaagaaaagcatgaatctatccgcgcggatttcactcactcgctctgctcagcgcttactccgtttcccgtgcgcgtatcagcccgggccgttggacatcgcggcctcacgcgttcgacgtgcgcgcgtgcgttactcgtcgtcgtcgggccgcggcgcttgttgcatcacactgtagtatatagaacgagccatccacgcacataaagctacagcatctgctcgatcgtctagcttggacggtggaccgagagaccagccagctag

SEQ ID NO: 170 - DNA, 1500 bp, Zea mays
aaacactctaattaaactttagtctctggactaaaggaaccagacatgcccttaaatatccaatgaagaggcttcaaagttctgtctactcgtggcaagaacgtacacgttctgatataaggaactattgacgtagtagtgtagtactggtttgaattcgaagtatcagcatcaaagttatatgtgcttgttgcaggagcggacatgttctgatacaaggaactattgacgtagtactattgatgcagtagcaaccgtttttgtgttacgatcgtaagaaactaaggtccctttagattgtaggaaaaacaaagaaaaaatgtaggatttgaattcttatgaacaagttattgtagtaccctttggtaagtaagaattacttgcargaaatataaaactttcctttgtacttgatttcacatgaaaaccgtgggaaaagggggatccacttgaacttcatgtttctcccttccctcggtgtgtgtatatatatataccatttaggtgatcttatttaaattggggatttggcacgcgaagcggacgcaaagctcgcgggagtttgttgcgcagagtagagaaagatcagaccatatacacgtgaagaactgtgggttgattgcagcaaatttaaggagtactacaacaacaacaaagtctttttgtctcaagcatgttgggtaggctagagatgaaatcccatataaaaacctcagagctcaacccttaaagaaaagaaaagggagacaaaggcaaaggagaaccgaaaaacgacgaaacggggaaacacataaaaagagataaaacccacaagaaccagcaagatctaaaggggcacaagaaaaggtcaaacgattaaggaggaaaagcgaaactacaaatcagggttctggcacatgaattgcacacttccaccccttcctatccacgacgagctctttatcaatattccactccttcaggtccctcttcatagcctctgtccacatcaaggttggtcgacctctacctctcttcacattctcgggacgcctaattattttgatatgcactggtgcctcttcaggtcttcgttggatatgtccaaaccatctcaaacgatgttgcataagcttctcctcaattggcgccactcctactctcttgtatatcatcattccagactcgatctctccttgtgtggccacatatccagcgcaacatacgcatctctgccacagttgttggacatgtcgtcttttagtgggccaacattctgctccatacaacatagccggtcgaattgctgtcctgtagaatttgtcttttagtttgtgtggcacccaggggtcgcataagacacccgcaacttgccgccacttcaaccatccagctttaattctatgactgacatcctcatcgatgtctccctccttctgaagcattgatcctaagtaacgaaaagtgtctttcttgggtaccacttgcccatcaagactaacatcgccatcctcatacccc

SEQ ID NO: 171 - DNA, 99 bp, Zea mays
gcctattccctgttgtctttcctattttttccctcaaatttcttttgcctgaagtgtttgctgcttataatatgtttttttgcaggtatcatcgtttca

SEQ ID NO: 172 - DNA, 910 bp, Zea mays
gtgctgggaatctgggccgggcttttcgggccagcacgagcacggcccgaaaataagagcccaaagcacggcccggcacgaaaaaatatgggccgggctagcacggcccgaaggcgggcctgggccgggcctcaaattccgacccgtcgggcccccagcacggcacgcatagatgggccgggcttgggccggcacggcccaattaagcccaatctgtttaatctctttaatttagtaagatattgactttatattgttgttatatttagagtttatgtggttaaatgatgctataattgtttaatatctttaatttagtaagatatgaactttacatggttataatattttgattttatgtggtcaaatatacgggtcgggcttgggccggcacggcccaacgaaggcacggcgtggtttagggccgggctgggccactgtttttacacttcgggctggcacggcacggcccaaaaattgtttgggctttcttggcctgaacccgtttggcacgaagcacgatgggcttgggccgggccggcccggcacggcccaattcccagcactacgtccgtccatcgagggagggagacacgcagacggccacagcggctgccactcggctggcgctcacaccggatccgggccccactacccacctcctgtccagcccggtctccacagcagtgcccaccaccgcctgcagtctgcagagatcccccactgattcgctcgccgtccctccgctgcgctgctatataggaccgtgccgccgcgtgcgctcgtggactgtggtgtgccttgtgcgacagtcgccagcctgccccgcctgccggcccggccgcccgcctgcccgcggcactgagaagacgaagctccgggctccgggacgccgagcagaggggaaagg

SEQ ID NO: 173 - DNA, 1500 bp, Zea mays
gtctatttatcatgattattgtgtaatcatggtgtatgttgttgtttattcattttgctgtggcctattcaatttgttgtggcctgattgaatgtatttttagtgaatcggcatcttatcatggaagggcaggcctgatgcacgggatttgtcttactgagtcaccaggtcgcgggttctaagcagggaggcttgcctcggtttatcccttccctagacctcactcatgtgggagcctccgacactgggtttgtcccctttagcaccttatcattactgaagatgagattcctggcgattctgattttttcaaatccatagctagagttttattttcaattggatgatttctaccttttcagacctcctaggtcatctatgtctgcttgaaaaaaacagcattattcattttatcgtgcttttgtatacatttattagtttcaagcaccaaaactattttaaacatggaaataacttagcctgggtttcagctgttagtatcaaaggctcaagccatggtactgttttgacctaatagagtagcacttgttttcgacatagtcctatactcccatatgtagctgctgccggtagttgagcaaaagcaggaagtaaaaaaaaattcctacatgctaccaacgcctgcagtgcacctcgcctgcagttccatgctttgaaagaggtcaatgcattcagtttatgggttagttagatttatagtcagggagagccacatttagttgtttcatgtttggtcaattgagcaattctgaagtacattggatttttccccttgacaatccagatgtgagctgtgacggagccattttttggtgaattatgataccagaaattagtaaattaggacactacattgtgcttgtttcacgaaaaaaaaagaaaacatatttcataaaataataattaggacattgtaccatgctaccatatagcagtattatagacatcaataacctccaaattttgctacttctgaagagtattttgttttacagtgattttgtattagctattggagactgtaatacttgggttggtgtctaatctttttttgtgtggaaatatatattttttgaaagtgttaagaacagtacatcaagaagatacaaaggtttagctcagaaaacttctggcctctactaacacgcacacagccaaaaaggcgaaaaaggggagcaaataccaagcacatctctaatgaccttcaatctgtagattagatcgccacctatgtgccagggagaagaaaaccttggccgtttgcaccaaaagttgtgatcctgccacaacccgctcctacaaatccgactgtcccagtatagtgtgtgttcccagttttaaaggcagttctttaggtcgtgccatttgtttatcatgcagagcatctgtttttgttacgaaacttaatacaattatttttggtatgtccatttgtttttcagttactggactgctgtgagtcgttggtagaatttgtta

SEQ ID NO: 174 - DNA, 377 bp, Zea mays
gtgaacttcgtttgtgtactgtgcgtttagccaagcaagcaatggagcaggaacctttgggtaatcaaaccagagatctgttgtgtcgcagcggcagaagcagaacaggtccactaaccgacgcaaaaaaaatactgtccaagctccacatgagaacagcctttattcctcaatgtattcaagcttattccaaatgttcagttgccactttgattgtttctacgttaatgtgtgtgtacaacatacggaagtaaatagtatggaaaattcgctggtagcaggtttagcttgattcccaaatggtgacaccatcacaagtgcagagtttcttgtagttctctcctaccccggcgcttcttgcaatcacggctgcggca

SEQ ID NO: 175 - DNA, 355 bp, Zea mays
ggtatataaatgagctatgtgtgcaagttagcaaaagaaatttctagaatcaagaatattgagctcatgcctaagtttggtaaaagattgttcatcaagtggcttggtaaagatatcggctaattgatctttagtattaatgtaagaaatctcgatatctcccttttgttggtgatccctaagaaaatgataccgaatggctatgtgcttagtgcggctatgctcgacgggattgtcggccattttgattgcactctcattatcacatagcaaagggactttggttaatttgtagccgtagtctcgcagggtttgcctcatccaaagcaattgcgcgcaacaatggcctgcggca

SEQ ID NO: 176 - DNA, 425 bp, Zea mays
tgtacgttcgcgcgtatttgtagcaggatccatattatttttgttttcttacaatagttagctaagcgctgttgtgttcatgaggctatctttgttcatcccaccttatatattttaaaaaactccactcctacagtctgaagcgaaaggcaatgttttaggccatagttagtttttttagatagattatctttatagtatatatttaggcacaatgtatagatataatcatataagtacatgaaagaaatctaaaaaaccaactttgtaccttctccatctatattagtagttgctttatataaaagagaaaacatttttttaataaatccttctcttttcaagacaagagagaaaataataattaaaaaaaagcagtgaaccttctcgcgctcggcagttggcagtcctgtcctgtggaccgt

SEQ ID NO: 177 - DNA, 624 bp, Zea mays
gtgaacagtgtcgtggagtccagccatcctagttacagtgttttactcttttatagtcttaacgtgatgcatgacgtcagccgaatacggatgttggcattgcacaatgaacatgattttcttttaaaaaatctcgccgtgcagacatatgttttgcttcaatatggataaataactgtttgttttcttgcacgatgaacaagagcggcgtcgagcgtttttctttcctcctcgtcggcgccgccttgcacttccacgcctaatcaatgcagccgtagccgccactgcgcccaaagtcagagccagccgctcatcgtctcttaagagctaggggtactctcctagccaaacacattttttgagtagctctaactttatgtgaagcttacttgcgctgaattgtataagtgaaacataaatttatggagttggagttggacctatggcaaccaaggcctgctgatagtactatatatatgtaaacacccacaagctaaacccctcatcaaaaaagaagaatggcgttgctcggcgagtacagcagtcaggagctcctccaaggtcagcttcagctctgggaccaagtccctgggcttcttcaagtccctcgcgctcgcggtcgcc

SEQ ID NO: 178 - DNA, 1459 bp, Zea mays
atcaggacttacctttctttgccactgggaaccttgtgctttcctaggcaagtgctcgcatgggtacttaagattctatctatgcaacactttcagcttgaataccttaacaatggtacttctctgagatcattaaatcagtttatgtacttgccgacataactttgaagcattgaatcatgcatataggattgcaattaagaacgaaacattacgcaaaatgttaatcaatttggtattagtttctatgcatggatatatatatgtggtacaacatagtaatatctttgtttattttgttatctctatctatagtatttgtcttgtttcatgttcacataaagttgaaacattgtctagatttgctggctagatggaagttgtggaagccaatcaagtacgagtagaaaaataatatgcttgtttctaagttgtagtgtttttacatagtaataagccatatgctcaagtgagaacagatgttgtggttggaaaggatcatctattagatgtttccatgcacaagataagtgttgcagctatacaaactagttttggttttgaggtcaagctggactagggaaacaaagctcaaaatgaatcaatttattagtcaaaacaacatctctattgactgaagattggtcttcttctaacatacttttcaactgtgagtgtctatgttttctaaagattcatttgttggttgctcctgggctccaactcttcttacataggaaaaattaaggaaaaatttgaagtgacttgatttcttggtgaatgatttttttttcatttttgttggagttgttgttatagtcttataggttctgttacttacgtatctgaatatatacaactggagtcaagaaatctctcacttttgtagtgatctggagtgaatgattcttagatacagtaatgatatcaactaactgtgagtaaacactggaacttgccatgttgctagtgctagtcattgtgaagatagtcattgttcatgttgctaatgctagcaatttttcctaccatatttcttggtatgtcttttaggaagcctgctaaattctacattggaacttatcttcaaaatttgtatgtcattgagtccaattttatttgtgcaataaaagcagggaggcttttatctataacattttccttttatcttttatgtagagatttttcttacaactagctgtcaggcaacttctatgttttcctgtagtgtatgtgcgcaaccatgggtcggtacctagggtggactggtccacctggactgtggaggtggcggggctcgtgagacgccccgccaagctgaccatggagcagctggtgacggagttcgaggccttggaactccccgtgacgctggtatgcgtggccaaccgacacaaggagcataacatggtgtgccgaaaagtgggcttgaactggcctcagtgccatctccacgtcc

SEQ ID NO: 179 - DNA, 506 bp, Zea mays
tcatgcagatcagattgcacatgcagaactattcaaaccggatccaaaagccgagcgttgagagcgatctgtaggttggtggcgtctgattctttagagcgttgagagcggtctgcaagtctgcaggttgttaaaattcaaacatacaaaaaagccaagaaaaattcaaacagcaaaaaagccaagttagtgtttcctttagatagtttgttggaaccatgctttatagatagcttcctttagcaaagtgtgctctgtaaatttaagatttagctaggatttttatataagctgttgaagttaaacactcccaaaattgtggacatgtgctgccagcttatgatcgcggaacgaccacgttctgctcacggcacccgaccaaacaggcaaacactgaaacactagtaccacagtagcagcgaggagcaaacagcaaagcacgctctggagaaatccctcgtctaccttcaccagttgaccgcactagtggccgtcgtccgaccacg

SEQ ID NO: 180 - DNA, 1500 bp, Zea mays
cttatttctagagacagctcatctcttccaagtcatctctagaagacatgatcgaaaaaccgcctctacaaggcaagaacaacctaaagtagagagaaatgccgccaaaaaaatgaaatctgtagagataggccggatagtttttacatttctttatttttgtttgtttaaagaagcaaagggtgtagtacacttatctctgaggctgaaagaagtagaaatggaattgatgtcgtcatttcttgacagcaaaactattccctgaaagaagaataactttacatgaatgctagaaaaaaacaaaatgctcctagccagttgatatattaaatatcgcattcccttttcagaaagagagaaaacaacgcgcattggaatcttgacgccttcaattgtgcatatcatctatgtaatcttcatctatcttgattcttcttagacctgtttgtttcagattataatctctctagattatataatccagcagttaaacaaacacctagattataggtacatattatataatctaaagtccagattatgataatcccataatcttctcaaaggtagcttattttgagattatttttggcaaaacactcactgcccatggttatgtaaataaaaattacaatatatgtcatactttcctcaccttaaataaacaaacaagagtattgttgtctttatgaataatctacatttgtataatttatactaccaaacagctacatataaattataatctatctagatctggattatataatttagattataatccagattatataatctataagctaaaacaaacatgcctttagtagtagatttagcttttagtgtgagctatttcttaatttgtccttccaaaacatggtgcgaattgcgatgaacatgaaaatcttattatgtacgtatataatatatcttttgtagcgtcgttcatggtttatcgtataccaaaacttgttaataagctggatttcagaataccattwaaattttacattctcggagatgtaaagcctgctgatgaatttgttaactttctgacgacagaattttgggcctttttcacattatagttcttaaattagaactggctgttgtaatataagaggagcttgcgcatgcatcaggttcgagtaatgtcacaataatcttaaccaaaccgcttattaattaattagggctttctttcatttccaacaatatattatatatattcgagttgatgtaacattccaataaattaaaggctcgtttgaagggcatcaatcaacatgagggaataaattaaaggcctcgtccatatatatcatgaaattgttctagtttgtccggcaatataatcctgaccgtccatcacctgcccacctgtgcgcgcggcgtgggtcggccgtcatcgcgggctataaataggtgcgctccatccttgcaagcaaagcaaaatccggcccggcccaacactagtagcgtagctgagagcctgagacg

SEQ ID NO: 181 - DNA, 1500 bp, Zea mays
tacacataaacatcgagtgagattaagagtctatttagcggataaattgctaaaaaagtcaaataaattataaattgagaaaaagtgagcacttagtatctatttagtcggccatggctaactaggtcatactttatttaggttagtcggaagaactaaatttagctagaaaaaagataaactgataccaccatgagcgtcgactctgataccaagctactcccaacacaagttgtttaagatagcaacacggtctctaaaatataactttgaccaatatttttttaaaaaaataaaaataaactcttaatatatttatacttttgcaaaaaagtactttttaagataaattaatatataaatgttacatttcaaaactaaaaacaaaattattattagtagtcaaagttttatacctttgacttaaatcttgtggtgaaggacttgttttttcagaccggagaaggcgggagggagtagctaggagcctaggaatacaggcactgcctagaccgatccgcagaaaagcaaccagccaatcataagatcgtacgattatgatgagtagcgcaaactctcatcgtcaacactacgggccgggaactggggccggtcaaggctggaccgtccgatgagcgctcggcggccaggaagcggcgagctgaaggagatcaagcgtggtcggttcctgtctgctttcgcttgtccacagcggccgtgtcgtgcgtgccctagcactagcgcggaggtgtgtagtgggtggcttcgtcatcagaagggcagaaagcatatatcgcgtccgggggatccatggtgggtctgggttggattggaccctataaaatgccgcatcactaatctccagagtcctcccctgcctgccctcctcgtctagctggtccctgctgcagcactaagcttagcttagctttgagagcttctccattgtttgcagcactgctaataaagtgctgccgctcttttctctcctctcctctgctctcctagctatacgttctttcttccttacagtacccactgctgctgttcagctgagctaatgcagtgttaagctcagttactgtcgtcggtttcagcaaaagcctcgcagtgtacttgcgcctgaacctgacgagaaagagagcgaggtcaaaacagaggggaaccaaagctccaagaaaggggagggaccttcttcgacccgcttccatccagcatctcgctcgtccgccgctcgaggtccttcctaatcggcggccagccagccagccgcagccgcctcctttggcaagaaggacactagttccacctgttttcttgcaaaagagctttttttttttcttccatccctctctttttcttccccatcgttcgtgtgctgcccccaagaagccgggagctagctagctagcgagcggcccaccggccgagtttggagctagcacgagcaggctgctgtaggcgttggcagcacgctctctttctttccctctcggcggc

SEQ ID NO: 182 - DNA, 1500 bp, Zea mays
ttccttccttccctcatcagccgtcccgtcgatcgggcaaataaagttgcgcctagggaggaaggaaccaggcggcaggctgcccgtgccgacgtggatcgggccagagctaggtaagtgcacctgtgggctgtggtcggcaggcgatcgaaggtgagtgagccggtgagccccgccatgcactgacggagtcactgccgactctcgtcgtccgatctctttttactgtggacgaatgggtgcgtgcagcctatctgcctatgggaagcgagagggggcccgggactgggttgagcaccttgtgcgcaaaggcatggtggcgtctggggccggctgcaggcgtgtgcgcacctgcacgagcgtgcagtcgcggcgcgtggctgcagtttggtgtgcctgggacggggactcgtgccgtgtgtcctgcgcgaggtggttttgcggctggctgacggaatggttgatggaatccttgcgtaaggacgcaactgagaggtaagcccccctcgtccccgtcccccgtgggaaacgggagtgccaaagccttgtggcacaccaaactgtagcttttgatcgtgcatggtggggcgcctacctgatgctacgcaaacttttgtgtcgcagcttcagttaccctgaagagcagggcaagctagcaaaaggtgaaagcgtttggtcacgtagaatccatacaggtcatacatatatagcagtcgcaactcgcaactcgcacgtagagcgtagaggttcaaatctgagccttagttcagaatgcagcttcagtttgggagttcgttcgtgcatagcaggccctatagctggggttagtcgtgtgcaaggattctccatgtggacaacacaacacaagcaagcaagctaatataaggttggatttaaaagtcgcagaacaattcatgacgtgcttggaaaacgttggtagcgtcttttaatgcttgatctaaaggctaagttatcatccatgggctaggtttgtttgttagtattaccctgtccagtgcaagggcaggtaggaggtagagagagaccgagcaagtactaacctttcatggccccggtgtgcccccccagctccctctttcccttgggggccgctgtgtgctccgtcgccatcgcgggggataaaaggaaaaggctccgaggaaacagtataaaagcgcccccggcacgcacgcacgcacgcaggctcactccacgcagcagttgccaggcgcttgtcactccagccagcggcagcccttttccttggcgaggcttggtttagtttagcccgcctgcggtctgccgcctgccaagtgccacctgagacctgatagccgcaaccgtgagaggctggtagcccgtagccggcatccctcgccctcgacccatttgaacagggcctcgagctttgcctctgctgctgctcgcttgatccgtctcttgccgtagtatactacgcgtgctcgatcggcggcggcggctctacgacccgcggccggg

SEQ ID NO: 183 - DNA, 131 bp, Zea mays
ctttgcctagcttattattccttaccgacaaacaaaactgacacggatccgcacagagcaacgaactcgcccagtccggctgctgctgctgcacaacggactcgatctcacggccccgccggctcgcagcc

SEQ ID NO: 184 - DNA, 1228 bp, Zea mays
ctgttgtattcgaaaactgaagcattgtaaactatagtaatatcatgactaaagtatactttagtatttaaaaaactgcagtttgaaaaaactgtgttcccaaacagggtctaaactttagcccatcttgtttagatcccctggctaaaacaattactatagcaattaaaagtcattattagaaacagttgagcaccacctgtaggcgttgagtgggggagcagctgcagctacacactgagtggcggagtaggggtggggaccagcaataaattatgggttttagtcggttttagctcctcggtgagctagaacattttagcccttggtattttagctcataaactaactaaactttagctcttttattttagtccaccgtaactaaacagaccgaccctaagctacatacagtatgtgcctagtggctctattcctagtgcccgtgctggttaaaaaaaaaagttggtataaaacatcttcggcttattgtctggaaatccccgcaagcaatatgttcttcgtttagcttgacttgactattttgattagcttttttgtgtacaataggctcatgctgttgttagttcctcttttggttaaacgctcctcgctgcgcgccttgtttcaggttatttacatcagtgtttaagcttggcgccctttacttgttattgcagtctcaccccaatcttgtttcttattctaatcgatctggttagactgcttgttcaagttgatttttataaaaagagtgctatgttttcctcgttgtttctgtcttgcttaagaaattgatgcctaaattaacatagacacaatatttaatgcatgtctcatgttgtgactatttgtttgactttaatccataccgacttctactgcttttatagtgctttgtctctatgaattagagttgcagtaatttgaacagttgggttaaagcttgattcctcgatttggatagacataacttctaatgcctcatttgcacatattcatcaattgcttcttgaactattcgtgaatgtattcaacaacatgcaaatttcagaccattgtgtgccagaatgtggagctttgaataaacgagatggtcgtcaatagccatgcgtgtttttcctaatctaaagattacaaatacagtacagtcatgcagattcagttcacctaatgttctgtcagttagattttggtcgcgcgaaatatgtagtgtcacacagtttcg

SEQ ID NO: 185 - DNA, 1500 bp, Zea mays
catgctttctctctccccgtaggtacagagccgagcggtggctactatagcccccgcccatgactggaggatgctgggaggacaacattggtaagtacggctgcacatcttgcccggccgagcaaggtggcgttggcgaaggtcggggcaaagatcatgacggcccgacgacgacgacggcccgacactgctatcgaggacctcgccttggccggtagaaactagcacagcgaggccggacgtctctggtgggaccagggcggtagcaggtgtccgtcacggagaggaagcaaacacttcaagagcgcgggagagagaaacgatcggcgtgtagcggacgctcgacaacctctacgtttggcgtctcccaaacgagcgctaaaatttagcgcgccatataccggttgttgttggacgtattgcgcacgtcctcgtccgctaaatttagcgtaccgaaccatttagcagtcattgttggaaacaacctaatatagtagaatgctaattgttaggatctttaccgcctacttttttctcatttgtatagcagttatgttttcattattaatgtatgatccacttgtctctcccacaaaactttttttctcgtattgggattcacgtgttacagttgcatcaacaaagcaaaacaaagagaagagaggcaataatacagtcctgcagggatgtgtttgtcaacaaaaattatagggtatttggtttgttgagtaagttagtccattatattttcactactcacctttttgtttggtttgtagaatataataagttgattcatcaccacctcattccttatagttagttagtgctaatataagaaatgtggtcattccaccgaatttgataaatgaaaccatgatgtactacctaattttttatggagtaatttcttgaaccaaacaccatctaagtttccaaactagtcctcagagatggaaccacggtgcattggcaccggggaaagtgactgactatggcgtcgcccctggcaacagacatgatgaaaatcgtttcttcgactaatcgaacttcatagttactatttgcctaagtaactaactactattgtctatactgcctagtgacatgggatgactctcaagtctcaactcccaacaagcaacacagtgaggttaggtaataccacacactagaattggaaccaaccagacatgtcactgaccaaacgctcgcactccagagtatggaactacacctacaactggaactgcaacgagtatcgtcaacgaagagtcgaagactagctaaaagaactcgaagtctaggaacttccctccgcactcagcaccggaagaagccccagaaatcctcttgctgccaccgccgccgctgttgatctccactctctccgctggcgccggcgccggcgccggcttcggctttgcctgcgcaggcagtgccactgccaccgtggcgggctcgacggccctgggcacgccggggggagtgctgcaccgg

SEQ ID NO: 186 - DNA, 1500 bp, Zea mays
agaacctcgagtatattttaggggcaaagtacccgcacctgtactgatctccgtcctgttctgcccttctctggtgacctttattcttgttcagctttaatttctttgcgtgaaaagggggttggagatgaataaagggcgagctaggcctcatggccagaggagatcgggtcagagtcagatacgagaggtagatgtgcctgccgacccaccggaccacctgtacctgtagggcgagcaaaaaaaaaaaagaaaagaaaaggtgcgcgtgtcccgctgcgggcatgacgttgtcctacaccgtccgggtgattaccactaacgttggcattttttggctaaagcctgattatggaaataatgtaacttgtactacctctacatgtttgattatacccactctgtttttttatttgctgtagtttaatttaaaaattaataagcagacgacaaatattcgagaacggatgttaccatgactgggtcgatactaaaatgtacctccttcgttcctaaataaactaactcctaaagctatctaaaataatatctaaaataacttcaacaaaaaatttgattgttgaaccgaatttatagagaaacaatatttatgacactgaatgatcatattgttaaaaatacattatgatgtgtccaatgctactaatttagtcccataaacctcgacgctcttttctataaacttaaaacttaaatttttttatgatttaaaataactctaggtattgatttattcagaatgtgagaaaataagaacatttagttctatatctattcgtaattttttttgtaaacacatggatagatttgggatgctacaggaccgttatggcatgtacagtgartgttttaagttgtgtcttagagtatgtctagggggtaaatgtaaaaagactcaagacatgtatcttgacgaagacacagtgtcttagctctatgttcgagacagtagattatttgattgatcactttaatttattgaatgctctgatttgtataatgaatatgataagacatatgttttagacatgaccattatattatgttgtgttttagttatgtcttatatttggagtaccgtgcaacagtgtctaggttttacatgcccttagcacctgcctgcgcttactagttattgttccccgcgtgtgccaactatgaaggaagtagcataccacgtgaattttgcattgcaccggcgcggggacgagccggtggatctgcggcacaagagccgtcccaccaaggcaccaacccgaaacgaatccagtgatttcccctcccgcatcgaaacgtcccccaagcagccctgcccggctgcccctgccgcgacgcaactggcaagcatccagcatagcagcgactcccccgctcgccggccagcggccaccagtagttccctttacatccacacacaacgcgcaccacaccacaccacccgacgccaacgtccgggaccaaactccgatccccaccact

SEQ ID NO: 187 - DNA, 1500 bp, Zea mays
ttgggctctaggctccaacggtgtctcatatgggtgacttaaactaaatatatgacgtaatccaaaaataactactttaataatattctattataaaaaattgtaaaaaggatataaggataaaatgccccaaatatattgcatttttttggctacccatctataacataaccaactgagcatttcacggccgcactcctccgccgcccctcgtcgacccctccctcctccatcgtccaggtcatgcgccgcccctagaacacgccatgtcctccacctaccctcaccggccatgggtgtccatctgcttctttcttatgattcctgctgctggagtacaataggtgtccatctgctatgatttctgctgctggagtacagtaggtgtcctgccttttgcttgtgttctgcagttacatgctccaaatttcaacggatgcacttacatgctcccgattttctacaatgtgagcatgccaaactggcaagttgggtttgattatttatctgatttatgtatatgtggatgtggcaccctatacaaaaagagaacacgtgtgctgccttctcatagcatagctttcaattttctgctccttctgccacctacaacagttctactggaggatgaaacacagattgttaggtttgcttgggatttctggtgatccagttgcaaccactaattagtagtgtttattttcaattcctgaaatttgctttagcccattagatctcttaggtcccgtttgtttcctttcattttgaggaattgaaatcttactaatggaatagactatttttttagaatatgacattccaccactttctaaagttatcatgtaagcctatctcaaattcatgggtgagagatggaagttgattctatatatttacatgctattttcccgatgtacaacttatagtgcactcttctacttgcgccgctataacataaatgtagtatataactatatctctcatataatttaggataatatacaaatatattacatatataaataatctaaattataattattaaaatggaaatcaattccaaccaaacaaacggcgccttaaagaaattaaagctaaaactctctcaaacggcctctaaagttgaaagtccagaaaaatgatatcaaacatgccaaatcatgcaagatgcaacgcaacacgtcgactgaagcatctcaggcctctccaacgccggcacaccgcctcgcttctcgcaggtttggtactcgttactcgtagcctattccacacaaacatttttttacccatatctccacgccggcaactcggctaggagcgaggcgaggcagcctaggaggagaaagagagagtgggaatatatatacagagagagagagaggagcctctcttctgctaaaatagacccaaatctcgcagcaacgaattcgcatttcccccacctccacccccactttcccttccgtccccttctcctcgtcgcgatccaaatccgcggcc

SEQ ID NO: 188 - DNA, 92 bp, Zea mays
cgtgagcgcgtcaaaaggatttttatctgtagctttgataaggtagatgctaatatattgctgtcattgttttgcaggatgcggaagggaag

SEQ ID NO: 189 - DNA, 834 bp, Zea mays
tataataaaaacgtaatatttcggcaaccaaatgaatgcaagggaaaataccaataaggatattcttaaatatgaaaaaaaaacatttgcaagacaaaaaaaatccaacgccattaacccaacaaagaaacaaaaccgtttgcaaaaggttatttttcaatatggcctacagaaaatataatatggaaaaggctagctactcaaatacagtacacaatctgttttacgtggatggaccaccaatttatttgctggtttacaaataaattaattggtgtcaataccatcgtcgctcacggtctcgtaaaccttcggatcatatcacagtacagctagcctctgtttaagtcaagaattcgaggatacatgcctgatgcctcaaggtgtatgggttgatgggcaggggagccggcgacgcgcagaacagttggttgcaccaatccaagctaccgcgcgcatgtgtgcattccggtagatcactgaacccgcctccccgcttcaacttgtccccactccgctctcccgctgccactgggcccagcgccacccaaaccccacccacccgcccgccggctcgcgcgcgtccgtcgccatcgccggtcgttacaccgctccccgtcgttgcacttgcgcagcccatgcggccacgccgaccctgctccggtacggtgcgcctctctattaatacgggcccggcgcgaacgcctgactgagcaacagcgagctgcagccacgcgcgccggcgaccaaacaaagccagctaggcaccggcaagggagcggacggagcaagcgcgcggccgatcgatcgagcttcagcttcagctccagcaag

SEQ ID NO: 190 - DNA, 735 bp, Zea mays
agtatttccagcttatctaaagattataaaagatcttacatttccagttaaaaattaaagatggctagagctcttggaaccctgagttatacctgctattagttcatatcgtctggtaagtagaatctatttcacttcagtagaagtacagatcgtctgttgttttctatcagcagtgatcagaaaaatcttggcatgcattactttgtttcggtcccttcgcatttcttgtcaatggcagatttctcccagaagaaaatctgtgtctgaaatttgctaatatgaaatagtacagtatgcccaccagtacttgactttactgactcaatgggccaggcagaaggaaattccaattggttgttttctttgagttgaatcattataacaaacttagccctcattatgatgtatctgcagtttttgaattcaattgaagtaaaaggaaatatcatagtttggtcctttcgtgaattttttttgtccaattttttgtccttgtaggtttttacgttgcattagaaaacattgtaggcaactgattttctaacatgtccctatcagaacttcctccgagaccatttcttgagatcttggcacgagaactacgacgacgacgactggtaatgtgattcttgcgccttcgtttttcccctgtttagactttagagtgaattagtatcattttgctttttcctttcacctgattggcagggtcttagattattcaacattgat

SEQ ID NO: 191 - DNA, 1500 bp, Zea mays
aaaaattcaaaaccatacttacaatacaatattatatgaaaatttaataacaattatgtttttttgaataaaacgaggcagtcaaacttattgttaaaaagtaaaagaaattataaattgaaacagagcgatataatactaggaaaaacataattattaaattatatagatacaataaaaaatatttttataacaaacaaacattatgtacgaaagaaagtagccgagtccacatactatcatttggaattattttatctttttcataaataaaagaaaataccacagaggtcctgctttactctccagactccactctgtacgtttctttgtctgtgatcgtctgtggagggagccgtgcaccaggcaggcaggcaccgcacgaggcctccatttggaccaccgggaccagaacccgatcgggcacggcggagaacgcgagtaagcactcccatcctcaatccctcccctccgcggctccgccgtaaaccccgctgttcttcgccggagcactccctccccgttcccccgccgcccccggccccccggacctcgatatcttcggagcccgccgttgggggcctactgcatgctcaaatcgtagacactctgggtaggcgcagggtggagatccgtccgggctcggatcgatttcttcgttcgctggtgagtagcctaggcaagctgggcggggttgtttaggagctcgctttggtctaggaaaccacctattttctgagtgagaacaattacatccaaatgaactctctccattcagccgggagccatttgcttgcttggcaccctattctagtgactctagtccatccacgcatggttcagttaggttcttacagcgtgcaagatcgacctacactagctgcgggtgctagccatttcccaacaaaattgctatgcccatattaactcctaccttttgcatagggttctttgaggtcttgcggacacctctgtcatctgtagatttcatcttgatccttccaatgaataaaaatttctgtttatatatgttattattcaagaaatcgaggtaggatcaagccattgagctacatttctggtgctgagatctgtttgtgtgtcacatcgacaattgagatgcgctagtgcagttgattaatggggaatatgcagcttgtcttgtgtgcattatgctatgtaattaatctcttgttcagtgaagcataaaataagccatcacaactgcacttaaagcatcagtctgaatcaggggtgcttcttgtcatacaataccatctaacttttttacaaaatattgttaaccaagtaggttggtttgcttatgcaggtcaggtactcaggttagcatccatcacactatcatttgaaccttcatgtgtactggatgtgatacataatgtgcacatattccacatggaatgattcttctgtttgtagcagggaattctaacatttaccaactgcaggtactcasgctctaatatttttacaaaatcg

SEQ ID NO: 192 - DNA, 517 bp, Zea mays
tgatatattacccttgtgatgtcgacatatgtgtggaaatagatcctaacacacatatgttatgcatgtggttttgccccctaaaacctgatgtgatagaatttcataggtattaatttatttttcatagaaaatataggaacaggaaaaaattaggttccagaggaggtataagatcccttttgcaacataggaattttacagaaaccatacatattccccagaaattaaatcatttaaaaaacaggaaaagttgctgcgttgcaaagagccctgagttgtggacactgggcagggtgttttgcgccggatcatacatggccttctgagccacaagggccgtgcacacttcagcccattagatcagcaagcccatccgggcccctctagagcgcattagcactagggtttcccatctcttaaggctgccaccgccagcgccgccccctcggtgcatcctcagtgcgtactgtctgtgcgaaggcgaccattccttcttcgctccttcgccgccgct

SEQ ID NO: 193 - DNA, 762 bp, Zea mays
gctcttaatacaaacatatcttatagtataacctaagaaacttgtgtttttaataacagacgatgtctatgataattaattttatttatctcgttttaagaatctatccgtttcgtcttcaaagatgagtatatgtgcgttgtgttgtgtcttaaaccgtagtcttagagaaaatatcatacttcctctgtcccataaaaaatgtcgttttaatttaacttttttgattgaagtttaattggctcagtttattaaaaaaatcatcattattatttattttcgttctgatttattttatcatataatctattttaactatgaactggattttctacattttcacatatattttaatgaagacgagagtcaaatttgatgttaaaaagtcaaatgacattatttatgaaatataaaaataatataatgtaaaaaccatatacacagtcgaattaaaaacgcagtaattcgcaggcgaagcagcctttcccttccctacaaaaagaggagacgcgcgcacgcaaacccggaggccgggaggcggagggcagaggcagcaccgtcccgtccacctgaccacctccaccattttttcctcttcctcctcgcctccaccccttcccttccatctcttctcacctggccactcctctccctctctcccgcgccgatcgattggcccacccatcgatcgagcacgggaagaagattccagtccggagaggtctcaattcgatcgggctcgttctggtgtgggtgggcacc

SEQ ID NO: 194 - DNA, 1426 bp, Zea mays
cttacgaaaacgaaaccatgggaactgatgttttatatgagttgagatgtatacgcgacccttaaaaccatagcgcagtactagatctcagagcaaacagattagagaagaactgaggagttggggctgtcgctttgcagcccgtgacacattcattcatggcagcctacacaagctgatggggaacactacgagtgagactcccgattctgcgcagtacttaatataataatataatacgcgtcgatcattagtgcttgtttgaccatgtttgctgccgcttgacctctagtatcgtgccaggctggcgtcatggcttgtggcttccaacggccatgcagatgcaggcacgcagctaccatgtcctgcaactgcttgttgcatcactccatccatgcttcagacccaagggattggatgtcagctgtcatcttcggtgtaacgtctcgctggtcctgtcaagaaaaagctgggaaagattactcgtacgctgttctaaacagactgtgattagtcaggtcttctggaatttaacctgttttgttcctacggtttttttagttcaactggtgtctgtaaaaactcatgcggaatttctgcgttccaaatcggcccgccccttgttgacgtttgaaggctggactggaatgcaccttgaaatcctggctcggcctcgtgcagtgcagataccaccaatcaggatctgtattgtttttggagattccaatacctccttctcagtcgcctgctattatctccaagctgtccaaagtcgtcagtttccctccccctacaggctacaaactcctcaccgcaccaccgcgactgcgagagaaaagggggagggggaggagcgaggaggagtaggactgtaggaggagcgacgcatcgcaacgccaacactcacagttgactatcccaccaaggtaacggacacaagcttccctgcagctcgctctcgcattctatctccctcccagtcccagacccagtcccagctgttgcagcctccgaacatccaaagctcctgcactgcacccctgtcagtcaggcctctagctgcagccaaaaaccgctggccttgaacatctccccatccgcctcccgcggcctgccacgcgacatgattgcgtcgcgggctgctgcggagctcagctgcccccgcacgccgctggcgacgccttctgcttgcccgcctctgcccgcccgtcttccctgatccctcctcccctttgcttccgcacgaagatctgggcgtgtcttcttccgacaaagctgtatgtggtccgctccgcttcacaacccccgccgtatcggtcttgttcgttgtcctgccagatacagataggtggctaccactggctcgcgtgacctgttggcttgcttgctcctctccaggttcaggcaggggagagtgcctgtttcg

SEQ ID NO: 195 - DNA, 51 bp, Zea mays
ggtacaagagcgtcatgcaccgggtggtggcgcagccccgacgggaacagg

SEQ ID NO: 196 - DNA, 296 bp, Zea mays
ggtgatggagcagttcgcatcggagatccgcaagctgtcggagaggctgctggacctgctgtgcgagaacctcggcctcgacaggggctacctggcgcgcggccttccgcgggcccagcaagggcgccccgacgttcggcaccaaggtcagcagctacccgccgtgcccgcgcccggacctcgtcagcggcctgcgcgcgcacaccgacgccggcggcatcatcctgctgttccaggacgaccgggtgggcggcctccagctgctcaaggacggcgagtgggttgacgtgccgccc

SEQ ID NO: 197 - DNA, 1500 bp, Zea mays
gaagattgaggaatgaggaaaactaatctaaaataagttaccgctactcctagggcataaatataaagtaactagtgaatagactgatttgatcgattggatgatgcytcaatcggttttaccctatcatatatatggggagatctggatccattcctagacgcttcccaacagattctcgcgtgattagacatataagcacgcatgagataaggattctcgcttgagtaaatctaatcrcggaccatccaggctacacccacggaccgtctcgggtgcagaccgtccagctacgtctaggtgtcaaatatggtgctcaacaataaacgatagtatgatcttttatttatcgtattaaccttttctaaatttgttaagaatctatttattccgaaaagagagtatatttttattaaataattcctctttgacttcagtcacttcaactccgrttgcactaggtaacacatagagatggcaatagggccccgagatctgattccccacggggaattcttccattaaaggatagggatggggaagtttcttccccacgggatgtaaacgagaaaaattctcctccgacgggtaaacgagaacgcggatgaggtagcattcctcatccccgttcctcacgggacctgttaaacttataggtgacaatgttttcatgtaataactaataataaaataaataattatcttgtgaagagatcactggttgtacaaatgtgttcactttgatgcacgcaaaatgatttcttacatctaacaatgtggataagtgactatattttgcatttataacaaagaaagtatgtcctgattataatttaagcggggacggagatttcggcaaggatttatccccgcgggtaacggagatgatgggaaagaaatgtcacccgcaagcgttcgtgggaatccttgcggagaaatttttttgtcgcgaggacggaaatatagagttaaaacccgatgagaattcctgttgacatctctagtctagagggatgttgtccagaacgggcctcccgattttcgttgctgcaaaaatggagttggaagcatatgacgcggaaggcaaccaaaccagtatcaccactaatttgatgcggcccacatcgaagtcgctaaaatccagcatgaacaacggaaaaaggataaatgctcacggttttacaccggcaccagctacacctacaccacagccggggatttcctcgacgcgccctcccaacggtcgaccggatcctgccgtccaccagccccacgcgcccacatcccaccgttcagatcgaccacgccttgccgcaccgagggcagaatcgtccgacgcaaagcctagtctccctcattttaatcacgtcactggccgcaggcgcctcccagtttcaaatctcaaatcctcatcgttctcctttccccaaaggccaaaaccgaccccgctccacgcctccactcccagccccagcggatcttctcgagcggcggccggcg

SEQ ID NO: 198 - DNA, 1500 bp, Zea mays
gtttgacttagagataggaaaatgaatttgatttgcaaaaacaaaccaagtggtggcaaagaatgatccaaatatgccaaataagagtcaaaaacaatttggtcctaacttgcatcgatattgcacttatatttgttgctttttgatgtgttggcataaatcaccaaaaagggggagattgaaagggaaatgtgcccttgggccatttctattatattttggtgattaagtgtccaacacatactaagtgagttgattatgcgccaaacaagcaagaagtgcaaatcatgtaacaaggtatgtttctagacttagtacattgttttgagtactaacatatattgtctaagtgctagaaacagagaaaagaagagaagaacagaaatgcaaaagacttggcttggtacagccaaagtccagctcggtctggcacatcggactgtccggtggtgcaccggatagtgtccgatgcgccaggccagcctccggtgaacaggccactctcgggaaaaatcggcgtcgtacgactataattcaccagactgtccagtggtgcaccggactgtctggtgagccaacggccgcaagcgcaacggtcggctgcgcaatccgcgggcgacacgtggcccgcgtcaacggtcggtagggccaccggactgtccggtgtgcaccggacagtgtccggtgcgccaactgccacgaatctgcaacagtcgtctgtgccagaaaaggaaacagatctacaccggaccgtctacagtgactgtttggtggtgcaccggactatccagtgcaccacccgacagaaggcaaggatagccttccttgttggcctccaacggctcctagctgccttagggctataaaagggacccataggcgcatggaggagtcacccaagcattcactaagcaattttaagtctcccacactccgtctccacgcacttgatcgattgtgttagtgatttgagcttcgttctagttgtgaactctttgtgcttcattttgagctcaagtcttggcttgtgtgcgtgtgtgtgctgcggatttgtgtgtgttgctccccaaccttactcttgtgctttcattgagatctttgttgtaagggcgagagactccaacttgtggagattcctcacaaacgggaaaaagagataaggaagaaaagtcgtggtattcaagttgatcattggatcacttgaaaggggttgagtgcaaccctcgtccgttgggacgccacaacgtggaagtaggcaagtgttacttggtcgaaccacgggataaaatcgtgtgtctcttgtgattgttccttctttgattgtctgtgttcgcaagagctcgtcccattgacttgattaacccgcactaatatttttataatcaaggttgttggaatttagtgttgaattctacaggatcacctattcacccccctctaggtgctctcaattggtatcagagccgttctcttcacgtaagggactaatcgcccgaagag

SEQ ID NO: 199 - DNA, 1365 bp, Zea mays
gtcattttcaacttagaatcacgaaattgattgtttcaactcttaaactttgtacattaggcttaatttcatctatgaactacacaattggtcaactccaggaccacccacaaacgatcatcactatagttgtttccaacaatttaccaatcctatctcacacctcacctcttctttcgaactttactcacctcttatttcgaacttttactctataaacaatgaaaaaaacagtattttacacggccatatccatatgtacgatctgttgacacagctttaggtagtactagtgtcctccgatgtcgaatcggataacacacctttgacaatattcatattttaatataaatatatttaaatatgctcgaatataaataatcagaatgttcgattataatcgaaacgactagcttcctccctcggccctattgtcaaccactctccctgacagtacggcgcgtataaaaaatgcatacgcttcgtcctttcagtctcgttaaaaattggagaaaaaaagcagaagaaaagagaggcgagagacttgaatgccatgccaatgccatacaatgcgctgcaggctgcagctagccagttctgaaccgaactgccaatcatgaagaaacaagacaagaggatagtccgacgagtgcagccggaaaaaaaggctggccgacgtgggccgcaccgcgcctggtcgcctgcccgggcaataatatctcccgccaggcagccaggccgccacgccacagattatgacgcctaggtcccgctcgcccctccacccatgggccatccgagcagtcaccagtgcttgcttctcccgtacttcttcccggtccccccaccgcagctgagctgcggaactccttactcaccgacacgtaggtcccacccgcttgtggccccgccaccagtgacccaaaccatcagagcatcctgtgcacggagcttcctcctcgaatgcgcactaatggtggtagtaataattgctcattagtttaatgagcagcaggtaggcactgtgctggctgtgctgtgctgttcctgtgcctccatcttccgattcccatcccccgtcgtcgcttgtttggtgctgtcttttcctttccgccgcggcaaaagtgaggagcgcgcgggcgagttgggggagacgaacccgtcataactccctcgcttaatcgcgtctcgtgctcctgcctcctgcgtatataaacgcggcaatcgggacgcccggggaggcgttcgttctccttctccatcccacgcgcgcgcaggccaaggccggatcggcggcctctcagatctcgccggccgccgtgagacagagaccgaagggggggttgaccggtgctcgggaggaag

SEQ ID NO: 200 - DNA, 107 bp, Zea mays
tatataataagcttatcttctcgggcttggaaacaccccactgtttaacgttctcttgtagcaccagagagaggcagaggggcgaaggaaggctaggtaggctagcc

SEQ ID NO: 201 - DNA, 709 bp, Zea mays
ctaaaatttattggcttttattattagcaataaatttcatggttctaaatgcgacagtttttttacttgaatagagacatttattttaaccaaagaaaaatcatatatatataataaaaacaaattagtggcatccatacatatggatgcccaaacaattatcggttgaggaagtcaacaggaaagtatcttaaaggttggaaacgtggcaaatcgaggagcatgagctggtagggcactcgcagtgggtggagccggtttgctgacgcggaaggaaccgaccattcatgactcgcttggcacgcggtgaggtgagtgtgagtgtgagtcagcctctcgatctgggttgggttttggtctataaaataccccggcctccatctcttctctgggttgtggttgtggcctcctatccttgcacgcacacgcaaacgcatcccatcctgtcctcgcgttactactagttagttagagagagacagagaggatcgatctgctggcggcgtctaagctggagaaaggcggcgccaccgccgagggcgacgagataggcatcgacccagcggcggagactccggagcagcgcaacaagttcctggtcctccgcctgtacgaggcgctcaacgcccgggacgcgcgccgggcgcggaagctgctggcgcccgacctggagtggtggttccacggcccccccacgcgccagcacatg

SEQ ID NO: 202 - DNA, 327 bp, Zea mays
gggaaaatttaggggtaactgttgcggatagcctcaggcagcgttcctcgctgctgttaagtcaggctccactccagtgtcccgttttgggcctcaggcctccttttgtgcaatccagacgtcgtggtccaaacgcggatcggcggtgccgacggccgggaacccccctcgcgattaacgcccgagcgagatcgctatccgtggaccgtggttgtcgccgtcctcgtcggttcgtccccatcgcacaccctactcccccggtcgtcagccctcagcactcatccggtcatccccaaaccccagaaacctccttggaaccaactgaag

SEQ ID NO: 203 - DNA, 1500 bp, Zea mays
atgctttcatttcaaaataacttatgcacatctgtcaaaatgcaatctagttacatttctacactttatatttgctttggtttgtgttggcatcaatcaccaaaaatggggagattgaaagggaaatagtctcaatatttcctataatcgattttggtgtttgacgaccatcacaaaccttgtggactaaccagtttgcctagttgatcatttcacaggtgcataagttcatctacaactattctaaatcgactgtctggaatactgtagattattccgaacaggagaatctttttggaaaaacacctaagcgcggaccgtccgggcccttgcggcggaccgtccgcgacaccaaggtgaccctcggacaggaacactgcataaacgcaagacaacattatggatcgtccgatggagaagcgagcaccgtccgagaccaagcgcggaccatccggtcggtgaagaaccagaaaaacccgaaagtgacgggttcggtaaaatgaattataagcatccttgcggaccgtctggggtgcaggaccgaaccgttcgcgactgcggtacctgacatctgacaacacatttaatgcatagtagccattgatatagccgttactactaactgttgcgaattcagccattgatgtgcaggggtggaccgtccggactaggggcgcggaccgtccgcggtaggcagaaagggagcaacggctaggaagtggttgtgggctataaatacaaccccaaccacctccattcactccacccaagcactccaatctttcacattcaatacaagagctagcaatccattccaagacacaatcaaagcttccaatctctccaagtttcacaattgagacaagtgatcattagtgattagtgacttgagagagagagtgatctgtgtgttatttgtcgctcytgtcgcttggcttttgcaatcgtgacttgtatcaaagcaagagacaccaagtgtgtggtggtctttgcagggtctaagtgacccgtttgattaaggagaaagctcactcggtctaagtgaccgtttgagagagggaaagggttgaaagagacccggtctttgtgaccacctcaacggggagtaggtttgcaagaaccgaacctcggtaaaacaaatctgcgtgtcacactctttattcgcttgcgatttgttttacgccctctctctcagactcgtttctatttcaaacgctaacccgacctgtagttgtgattaattttgtaaatttcagttttgccctattcaccctcccctctaggcgactttcaattggtatcggagcctggtgcttcattagagcctaaccgctcgaagtgatgtcaggagaacacgccaagaaggagatggagaccggcgacaagcccactacaagccacgagaaggcttcatcggaatagtcccgcaaaaaggggaaagggaaggagaagaaagcctcctcccacaagtcgcatcggagtggcgacaagaaaaagaag

SEQ ID NO: 204 - DNA, 1500 bp, Zea mays
tcatccttgtcatcattggcctcatagtctccatccttgtcattagtgttctcagtggtttcaccctccagaatttgtggtgtagtaccacttgacggatagcagagcgactgggacttaggtttcctctcaagcaaaataaaccatgtttaaatgctccactgggggtaatggatagtttggccgcagatttggttttcctacacgaaataagcaactattcattgacaccaaaatatataaaaacttagctgctctgaccaaaataaaattgcttgagagccctcgtcctgcggatttggtttagatggggtctcgtatcgctagcgagcagagcggctgcgcggctagcgagcggctgggacgagcagagcagaacgccgggacgagcagagcagggagcagagcagaacgtcgggatctgcagagcagagcagacgagcaggaatcacgtcgtccccgcggccgtgatccgcgcccggaaagccagccgtgatctgcagacgaacaggaatcgcgcccggccgcgctcgccaagcacaagcacacaagcacacgaccatgatctgcagacgagcaggaagccagccagacgaacacacaagcacacggtaagaagaagcacgtacctgggaaccgcaggatagcagacacggttggagctctcgctggaggacggcgaaactgctagagatggtcgaaaccctagccaccgctcccttcagcgacaggcaggggtcacgggcatagaggacgcgcgtcgtggagggttgcgggaggggctcgttatgtttttgtccaatggcaattgcgggtaattttgatcaaactttaaggggaggtccatatttggttgattgaggagctgttttaagggagggtggagcaggtttttttagatcccacatttcttcacaaaaacgactcccaatctttcggcttcacacgagaatcagtttaaaaaaatactcgtttggcacggctcctccagatcctcgtttagaatcaggagctggagctgtgccaaacgggccctaaaggctaagctcatgacggtatactattaactcttaccatatgtgatgatctagttttccaaactatgacatatacttcaacacttcatttaatgaaccatttgtaggcagcaacacaaacaggggcccttaaagaggccaaaaaaattctactgccaactcttcttaggtcatagctagaaaccacccatgcatttagggctcctggcttgtggcccataagcgttgaggttataagatggcatttggaagtagaaggatttgaacctctagagcaggagttgctggtcttcctgacacttgagctgattgaactgtaattggctgagggtttttttttctgttgcccctattttgattgtttttctcttattcatggtgaccagtttatttgcaggccagatttctttgtctgacttgtggaagcctcttacaactattgtacaaggctgctgtattgaag

SEQ ID NO: 205 - DNA, 1500 bp, Zea mays
cggcctccgcctccgcctccacgcttctgctgctaggctgcaagggcggcggcgcggcgcggtgggcggcggacagctggccaggtccagcccagtagtccaggtgacgaggtccgcactccgcaacggttctggcgttctgcagctgaggatagacgagagaggaagtgaggatttatattagtgatttacaaggtgagttgttcacttgttccattgtttatgcagatgcaatttgcaactagactagaagtttagaacctataggttggattcttttttcatgcgggagtgggaatacccaaggatttgctccgtgcccttatctgcatgataaatgaatttggagacgaaggcaagtgttcagtgcacgagctgtgtgacgaatgtgttcaactcttagacatttgctgtctattcagggaatgaattttgaataaaattttcatttaggaaattatagttgaccaatatttttggacactagtagaagtggaatggatttggttctgactggttcgttatatataatatagtacgtgcattctgttcttccctttatataattcgccaattcggttcctgtgttcggtggttttggaaactataaatctataatgcctaattacgccatgttctactcataacctttgtgtggttactggctagattgttcactacagttactatgtcttatatcattggtccagtgaactagttggatgctgtttatttcccttcttgtgtacatcgaacatatggtctgtgtattgggttgtttcataaatatgtagctattagtactagaatttgattgatatctgtgttaaattactgtttatttgaaatcactcatcattctaaaaataaggccatggcagaatgagtgtggatgtcgactggctccctctaatgattggatagaaaacactggttgattggtattgcaattagtttgtctaggccaaacccaatctgcttcatgaattgaggttgaatgggtggaagaatagccattggtagcatcggcctaacttctttgattggttcacagatgcaatttttctgcatactcttaatttcacattaaattaatgtagcaatctgagtactcaaagtaacctttcattactactatgaactttttagtgattgcagaattattgataatatgctgcttgaaatattgtttggttttgcaaaatggtgaccagctatcggggttatgatgtgaatgggtgtagattttattcagaggtgcttgagagaccaaaatttaggttaaccatggttaatagttttgtttgtgtatcttgtattgatgaaaatgacatgagtttctgctagaactagctccttcccactgccatagcaacttgaagttagcatggtatgacttgaagtctgaaatctgaatgtgcccataaacactaacatttatatccattattatttgttcatatgcaggcaacttgaaagacagcagggttgcatcccaca

SEQ ID NO: 206 - DNA, 705 bp, Zea mays
tgtatagcatgcttaatgaaacttcgtagaatgatgcagtttaatacgaaaacttggtcatcaagcagactgttgaccttctgaccagtcagcactaaagtaggttggctgcctttctggtagatttgattaagtcggctttagaagcattggaaactagacttaaagagctttccaaaaagtacttatgggccttcatagcttttgggaatcaaaagatatgactgtttcttctggacggttatgttgcgctggactgactcagacatagctcttcttgctgattcgcccttgatatgttttgtcctttctctttggtgaacctaagtaatatcagcatacacgacttaggtagcataaaattctcattagtgtttaattgaaattcataaagtagcgcgtgcacctcttgctgtagcttcttagctcggctacgtgtaattggtgttagaaatatgccctagagataatcatagagatgagcatatttctttgtatccatgatatatatattgcttaattgaatatccatggaaggcagcttgtattgattagcaattatgtgaattgtttgtgagattctttacttatatggttattctaaatgatgtccctagtcagagtcgatgactagcatatgtattagttgatgactacatttcacaagtcatgaacatggagatgttaaactaataatgtgggcgc

SEQ ID NO: 207 - DNA, 410 bp, Zea mays
atcggaagatcaggcactcgcgatcaagggggacatgattaattgattagttatattaagagcagcagactttgtgatctctggaatatatctccttccatttgttaatgtctgtatgaattatttggcggtggacggtggttatcatggaccgataatgccggtacgtacagatgggatgggcatgtggggttaggtgtcacattcaagtgtctacgagatgtttatgggtttatatatttactaggttagtgcccgtgcgttgcaacggtaacatataatatcatgataacttatatataaatatgttatattgttatgagaaaagttttttgtaatccattggtgatcctgtctatacatataaattttgttatgagaaaagtataattgctatccttaacaaatat

SEQ ID NO: 208 - DNA, 91 bp, Zea mays
ggtggccgtcctcgcgcttgcgtccggcgtggcgtagcatgcgccggggccggcgccgtcggccgactgcgcgtcggcgctggccggactc

SEQ ID NO: 209 - DNA, 1500 bp, Zea mays
tgatgctacagtaattcaacaaacatttgctaactgtgaattaattaggtttaaaaaagttcttaccatttagtcttagatgtgtcattagttttataactggactatatttaatattgtagtagacattcaaatatctgatatgatacaagctaaacttaagtctctagaaccaaacacctctgagtcgagttacatcgttgtaactgacattgttgtccaccgaaagtatatcccatgagttcttaggtatatgtggcatggtgatccgacagagactccaatctcatcacacacactaagagggtgtttaaatgtactagagctaataattagttggctaaaaaattctagtgaaattagctagctaacaaatagacaactaaaaacccgtttggtttgagggactaaagattagtccctccattttagtcttatttagtttttaaattgataaacggtgggactaaaacagtgactaaactattttagtctctagtctatcaagaggtgattaaaagggactaaaccatataaattccacttttgcctctcctttattgcagttgcactaatgatgggagaatgctaaggagtattttatctctcttatgatttatttaatatattttgaatagttttagttcctagaaccaaacatggtagggactaaactttagtctactaactaaactttagtctctggactaaaggaaccaaacgaggccttagtccataaattgctaaagggtgggactaaaacatggactaaactgttttagtctttagtcccttaaggagtcattaaaagggactagactatatgaattccactttttactcctcctttatttcagttgcactaacgagggatatttcagtcctcttatgatttatttaatatattttgaatatttttagtccttataaccaaataaggtagagactaagttttagtcttctaaactttattccatagattagaggctaaggtyttgttcgtttgtgtcggattgcacccggaatcgttccagctagtcaaagtttatataaattagagaaacaatttggttaggaatcgttccgacccaccaatccggcacaaacgaacaagcctaaggggccgttcgtttgtttcggaatggaggcctagaacaaattctaaccggtttggttctctaatttatataagttttgatcagctggattgattcctggtccattcctggacaaacgaacaaggcctaagtgaggcagcaaaccaaacgtttactaaaaatgcaagtggccaagatttggctgtgccgtcagcctttgcagttctaaaattgaccatgtgatcgaaaatccaagcagaaagttgtacctttaccctggagggggctgatgcgtcgcttcatttctgctcttctgcygtctagtcctttgtactgaccggcgctccggtcgtctcctcgcgcttgcgggttccccgtccccaccccacgccgggggcaagag

SEQ ID NO: 210 - DNA, 700 bp, Zea mays
tcgagctcggcacccctgcaatttttttccccgctctcatcagttatcacagccgaacaaaaagggcagcagtcatggtctcatggacatggtcatggatcaggctaccggatggcataaaagggcagcgacggggcacatggagccaggtcacagcacggcagatcgcccagtccaccggctcctgcagtcctgcccctcccctcccctcggaatcaacgcggctgaactgaaccaacctccccgatcgaactggccggctgagcgagcccacgtatacttttacggaaacgcccacaccgccggctcgtcttctcccgaacccgaacctaccctccccgattcaaaccgtcgctgccgtcgccgagagagtcgtgactccccccagcggcggcctgcgaccacccgttacccagccgtcccttctccgcagacagcatttgcgcccaccccttcccgtcccgtcccctctccctcgcggaggcccgagagctttgagctgcctcggttaagtcgtcaagtggtccacagggccgccgccgcggcggcggttacgaggcggggagggaattccggcgcgggatgccgcgatcccgcagtgatgcgcggatcagaatatgggtgtgacccaaccgggaagtagtggagactgctggtggaggactagggcctggagtgggagggagctgcggccgcgacg

SEQ ID NO: 211 - DNA, 842 bp, Zea mays
ttggagcagagagagagagaaggctggcttgagcttgttgtgggagcgagggccgaggggcgcttctgctgctgggctggtgcgtgcgtgcgtactgtgatggtgccgagacagtagaggcgtggatcttataaaggggtacaagacgaagcgacggtgcgtaattactagtcctaccaggggtttggttgctagtttagtttccttgaagaccagccgttggatcggtacgtgacggcgatgctagtacattctggctaaaatcgtgttgcgagtatggctacatctgtaaccgatttggctacatccgcatctttttcgttaaatgacaaatcgacgtggtcgggtttttcggcaacgcgaacagattcctccttttgatacgcatacgcaatacgtactacctgcccgtcccaattaacattcgatttagctcttgtttttatatctgtatttgaatgaatggtgataaatcgattaattatttaaaataaattttaacttaggatagatgtaatattaaactctgcaacggacctatgaatccgtgataactactactcacatatagtgaattttccccaaatttaggcctcgtcaaatagagtcccatttagcgtttttttttcgtaattccttttccaatttcagtgcgagctaattggaacttctcgatacagtattgccagccattgaggatatgtccctatatatattgtgtacaaattatattatagtattaataaaaaaaataagggaaatttggatccataccattaaaagatcaccactttagatccataccattactatctcacttacatgtgggtccacatgagtca

SEQ ID NO: 212 - DNA, 1500 bp, Zea mays
ttctatcgaagttgctacaattttttgagggaagcatgttaaatatatcaaaactgcaaacacgagtcctgagagacgaatgcaattccccagcctgcacaaaaaggaggatccaatgaatgctttgctcaaaagtaatcaagtacatgtaaatgtaatatggtattattgtgaaacaaattcaagtataaccagttgcaatgactggagtataaaatataaaaaaaattgaggcaacagaggagcaaaatgaaaaaggctggagagtcagaaagtgacaaaacaggatgacccagtatggatggtttccgttcctctaaagattaaaaaaaaatgtgacaccaaagcagtctgaaccttctggaaccacagcagcatacaaacgatgagttgaggttgatgtatcaaagtttggtagcaaaaaataggaaagacaggggagcctaggccaaaatgaagatttcaacactagaccaaccttttactcataaaatgcattttcactagagggagaattcaagttcacaaaatactttctggtttcttatttgacctttatcaccatcttgttgtttttattgttttttgagacatcactttgactacttacttttgatcactatattattatatacgcaaataaatctaaacttttgaaagtattattgaagacaaacctaaccataagccatatcattctcatattatgcatattaatattttcagacctatcacctatcaatggtcaaattttataaagtttgacaccaagtctaggacatcaaataagaaactgggagtaaaaaagagcaaattatcaaggcccaacaaccgacagctgcccttaaggcgcagaactagaaacagcacataccatgtgaaaccaatataaactggaacaatactgacaacaaaatgcaaattccttgtaaaccttgagatcaaaaccatgtgaatatacctaacatgataaagttttactgtacatagtaacgcaggtgtagaagcaacaggatagaactccatttgaatgtgaagatggtaatttgtgttagcactaaattacaataattccatcatcagtgaactctttgaatgttattatgttttagcatttctgttttaaaatgtatgaagatgttgaaagcaagacatctcatcaatttgatggaaccagaatacgatatttaacaagatgcaatgagccagatatctatcagtgaaaaataatcatcaacattttttctgttggtaattagaaaagcttgagactgggtttctacatacatgaatttataataaggaaaactttatatcagttatctgaatgaaacatctgagatgcaaagtaggttgttcctctttaagattggcacatgctcagcttggactcgtcagagaacttgcaagacccgacagctcgtcctgcttcgtactaccagtagtagcacgtaaaccagggcgccacgccagccggatcggatcgtcttggatgtgggc

SEQ ID NO: 213 - DNA, 1128 bp, Zea mays
acagtacaatacaactcaaacatgatctaaaaagagaaaaccatccggcccaaatcctggaagcccacattagggcatattgtcataataggaggtcagatcatcgagtacacagacatgacactagtacatcgacacctccgaacttgacgttttaggtaagtttttgaggaaaaaaagtagatttgtacgtcatgtcgacgcgaactatatcaaaaagactaacccaacacamcagatccgcagttgttcacgaacacagtggggggtggcagttcatcaaatgttcatagttctaccaaccagcttcgtatgtcgccagacgccaaccgtcgtttcgttctggaaaagatctttgcaagctgaaaagcccgtggagccctgtcccgctcgcgtggcgagtggcgactgccgaatcttggacgattccccggcgtgcacctcatgtcctcgccctgccacaccgccgcggcgggccccgcgtgcatccctacccgtgcagactggctccggccacggcacccatcacaagccgtggtccgtccatgacagctgaccccgctgtgacgccggtcccgcgcgtcatacgtacgcagtcgaagcgaagttccctgggcaaggctcagtcgccagagaagaagcagcagcagcagcccagcggcagatccctgctgtgctgaggcgctgagctgctgagctgaggcgactagcgtcgcgcagcgcaaggcaggcacccccaccctcgcaagtcacgcacaggaggagacgagacgagggagatacttgtttctcccaggacctcgctcaccaactccgggaatccgccaactcccgccgcccgccccggcccgccccgcgccgcgccgcggcgcatcattccttgccagcggcccacgcaaatcccaaatcccaaaccccgcgccgatgcccaccagccctccgctgcccgaccccagccgcccgccgcgccgctcttattatacgccgccccggccgcagctgctcgctgcttaatccgctgcggctcggttcgcgtgcgcgtttttgggagagggcggggcgttggctgtcagcggctggactgggtagtgcggccgtggcggcgccgcgagggaaggggcggcggag

SEQ ID NO: 214 - DNA, 416 bp, Zea mays
cattcattctgaatgtgctcacaacttaacttatgtgttagttttctgtgttattcacatgtatggatgtacccttgattgccacaagtttacatgagcttttagttggataagaagttatggatgtaacctatggattttttttcttttctttcctccttgatgtgactgtgaagttgtgtacttggactgtttataacagcaattcctgaggttatagtgaatgatttgtttaataatttctgactttgcttttgcatccttgtaatgttaatcaactctttcaggattttacggtggagcagggtactataaatcctcctaatggatggaaggcatactatgcggctacaaaagccattattaaccttaatgcagagttctacaatattatcagggaagggtccttaccagca

SEQ ID NO: 215 - DNA, 1500 bp, Zea mays
aaattttccccatccctatatccaacaacccgacaaggacaaaattaaatttccccatttcgatctctatagggactaaattagttatattctatcctctgaggtattgttcggttatttctattctacatggatttgataggattagaaaaaaatatattagaaatttgatttaaacccactcaattgtctttaatctatatgaattaggatgaaaatgaaaagtcttgatagaaaaattctcggcgggaaattggggatgggtccccattggcatgcggcatgccatgtacggtgttcagcccaacaattctgctctgccacttttgattctgtatacatgcgcgttcgctcatttcatttttattttgggctgtgtacagctacgagatcaccggtcttttgttcttcgcgaggctagtcctaccttgtccgtagcactgtgctgaagcatgaacgccctcgtcttccctccggtacgagcccaatgctccgcatcttgttgagcctgaatatttgatttggcgcaactgaaatcctagtccctccagactccagttcggcccagtagtttcgaggcagttttgatcaattttgggctagtttggcaaccagatttctattttttttaaagaaaaaatgaagtaatttttttttgaaaaaaacattggaaaaatagagttctcaaactagcccttatttttttggaagagaaaaggttagtgtagcatttcgacgtagcccaagactgatccgtgaatgtgatacaaccatttcaggcttgtggcttggcaatatgaactacgaatactcctgattctgagtgagtggcgacatgtgaacatcgaaacgacaaagaggacagaacctatgcgttgcgagctagcataaagtcatgggagtagatccatatctcttgttaggacagaacaaagataaaaatgcaaccccctttcggtgtttccagggcactaagatggcataaagtggcttctttaatttcaaacggacaaatctagcgtccaactaccactctaccagcatcaaaggacagattcagcacttagtggtgcctgatagagcataaagagagaagtgaatctgagactgcgacgagcgagtactttgaacctcgaacattgcactgtcatctgtaactgatgagcaaagctgacatggttgatggttcctcgctaagctatgttcgtagcacacaggaacctcgtgcagttaccaaacgtagccccgcgaagatgccgattcgtgccgacgaaagttattctctttatgtcacaaagcaattaggcacactccatccatcagatagctgagccaggaccggaggcggcacaacggaggctggactggattcttgaagaggcttccattccatgggggtatagtgatcccatttccactcctgcctgttgtctgcctccaaggcaacagttttttagtttgcttgcgctctcctgccttcggttcaccgcctctccatga

SEQ ID NO: 216 - DNA, 345 bp, Zea mays
gccccatccgtagcacgcgggctgcagccgccccatccttaaaatgtgggcgcgggcgctaccacggctccgcaccatgcttccgcgctgccagacagcgccgggcgataccatgcccccaccccggcttcttcctgccagtgtaatcggccactacttctccactgctgctcgccgtctcctgaaccaccggtgcgccacacaaacctcccgtgacgtgtctgagtcaagccaggatgtctcacaggaggagcagcggaagccctaaccgaatacaaccgagtcatctcaacgactccggcagtttccaatcgccccttttttaggcgttcaagttccttcgag

SEQ ID NO: 217 - DNA, 985 bp, Zea mays
ctgcaggtctgcaaaaaaaaaaggcaattatacagtcatagtcacaggcagagaaatctgtacacgaaataagtaagtaggttatgttccatggtgtatttagtgtgctaatttgatgccataaatctcagtcgtgcaggtgcatcagtgctagcgaatcattagaaacaaagaattttcacttccccgccaattcctttctttcttcgaacaataacggggcgtttggatcccttcattttaaaggaattggaattcactcaataaagtaacttatttagtttggaatttggcattccaccactttccaaagttcagatataaggttatctcaaattcatagggtggaggataggaaatgattttatgcatgattagaatttgtttctaatctgtaacttacatgacactcttcgttctactcctctataataaaaatgtagcacataaatatctaagacatcttgctaataatagtatgcaaatatattttgtataaaagtgaattagcttaattgatatatgcctaaattactattattagaatggaattcaatgatgcaaacgggacgttattatattccaacaatttcatctcttaaaccagagttcatctcttaaaccagagtcccacaaccgaacatatgcttaagctccaatccactgcactctctgtctctctgtgtctctctgctcggcttgcttcaaacccacttgatcgttgcgtcgtctcccggggcccgggccgacccttagccagctccccgtacgtgcgcaggtctcggcacgctaccccatatatgccgccagccgctctacacagatagagacgcacacgggcagtgacacgcgcgcataccgacggacttggtagctgctcaccagctatccagatcattggctcattgctgcttccattccattcccccttccctcggcatcggccgcgcccgcccgtgtcgggcggaggcggacgcgcgcggga

SEQ ID NO: 218 - DNA, 1449 bp, Zea mays
tactatttttgttgttataattgtttccaagtggttctaaagtaggtgctgtccatggatggggtttatagggctgcacgatgtttgttctgagaaagatttagtttcacaatttatgttcaaggttgggtatcagacaaataacattcgtttaaggagcagcctaactcctccagatcattctggagggaagttaaactctaggagcttattagttgttctgcacttacagtttatgacccacttaatattcatagtatacagtctttaggtgtttctttctgttgttagtaatttatttgattcttgttagtttgctggtatttgcttgatattagtacaagctgtataaagtactttaggcaacctcctgtcacttgtaaagttggaagagtatcaagctctctctgtttgtttgcgcacctcaatgcatttaaattatactcgtcgaccacccagcctagaaagaacctcagcaaatagttctgtgtaatcctttgagaatgagtgtcatactttaggttcggatattcttgatctttgaaattgccagacctaattgttaattggccctgaaaattctgtgttttgcactttgtctgcacttgcactgtggccacttcgaactgtcaaaaatgcaccaaactcagcgcattcttgatatttctctactctctaataccttcagcatgctgcctacattaggcagaccttgctcgtttttgtgccatatgtgaccaaaacagactgccgatatatttgtgctctcagtttttgacaattttttagggttctggtgatgaatttagacattaagtggaccagaataccaaatttctaatatgctgatcttcaatattcttgcaactttgcaaacgtagttaccacatccacaaatgtagtctgcgttgatgcacagaactgcataggaaaatgaaatccttgataaactttattctttcaccatggctgttgaaaagggtagcaatcttcccctcaatgcactatgcaaaaaggttatttaacctatgtaatcaagttttcatagatatttttttgataaaatattacggattcttagaagctttctttctcttcattttgatagttgtcttgtggtctcagctcttcatgtgttcatgtaacacttgtcaccttctgctatttgtttgcctcttaggctcttatttttgtgtacatatgtgatgtaatccattgtgctttcttcactggcactccttaatgtgctcaataaggtttagaacgtgttgaggattaaaaaagatagtttgcatgaaaatttggtacaagcatccaatagtaagttgcgtgctgctttttttagattattgtcgccttgagtgggaaacagtccaaaccttggatgaatatccctagctcgaaatgctgcccataggacagccatttcatgtattttggaatatatag

SEQ ID NO: 219 - DNA, 132 bp, Zea mays
gtttggatctgtagtgcatcgaagctcgcatcagagcaagaaatgatgctttttcttctttcttgtgttacattgctgatgagtgagagtggcacacagcagcgcgcgcaggaagcaagcggctaaggatcg

SEQ ID NO: 220 - DNA, 65 bp, Zea mays
agtagcaacatcgtcaggccaatgacaacaggtgtttcacatgtggcaacaccggacattatgac

SEQ ID NO: 221 - DNA, 786 bp, Zea mays
gctgatgaggcgctgaaagtcgcctagagggggggtgaatagggcgaaactgaaattctcaaaaataatcacaactacaagccgggttagcgttagaaatataatcgagtccacgagagagggtgcaaaacaaatagcaagtgaataaggagtgagacacgtggatttgttttaccgaggttcggttctcgcaaacctactccccgttgaggtggtcacaaagaccgggtctctttcaaccctttccctctctcaaacggtccctcggaccgagtgagctttctcttctcaatcacttggaacacaaagttcctacaaggaccaccacaagattggtgtctcttgcctcaattacaagtgagtttgatcgcaataaagaatcaagaaagaagaaagcaatccaagcgcaagagctcgaaagaacacaagcaaatctctctcactaatcactaaggcgttgtgtggaatttgggagaggatttgatctcttgagtgtgtctagaattgaatgcctagctcttgtaagtggttggaagtgtgaaaacttggatgcaatgaatggtgggtggttgggggtatttatagccccaaccaccaaactagccgtttggtggggctgactgtcgtatggtgcaccggacagtccggtgcacaccggacatgtccggtgcgccagccacgtcaccaaagccgttgggttccgaccgttggagctctgtcttctgggcccgcctggatgtccggtggcgcaccggacatgtactgtagagtgtccggtgcgccagc

SEQ ID NO: 222 - DNA, 807 bp, Zea mays
agggactcaataggccagtaggcgattacaagggtgaaagaaacatctagccttacatttccaggctacagcctaacccctctaatggatagcagcagtggtagccaggacaagaaattcagagacaatgatcgccctgaagcaaaaggttcaccattttcttgctttgctttgttttgctttacctttgctcgctgcctcttctgaagtctgaacttgtagctttttagttagtaccattgtgttcaagataatagctcatatgactttgttatttcaagagatctcacaccaacatattctaatcctccgtgctttattttctctccgtcccaaaaagaatacaattctagcacagtgttatgtcatagtatcgtaaatttgattaattatagataaaaaagtaccaatatctatgataacaaataaatacgattagattattataagatgtgttttcataataaatttatttggagccataaatctaaatactattcactaaaaacgtgatcaaacatgaaccaatttaaccggcatgtaactcatagttgcattctttttgggacagagtgaatacatgaaaactaaaacagatggtaaacagtgaccatttaggatacactataactgacaaaaactgtggggacaaacaggacgccatgtgatttaccatctgaccagcctaatgaagtgcagaggatttagccccttcgaaatagggggaaattattcctaggaaaattgcaaattctcttggcgaacataggattggcaaaccataatatatttctatatggtttgtta

SEQ ID NO: 223 - DNA, 482 bp, Zea mays
tctcagtctcaggggtggctgttacggttacggccctaggctctagccggcggcggcggtgtgtgagggcgccgcaaagattgtggcagcggatgaagaggaaacgcgagtgcgcacgaggagaagaaaccctcaacctcaagtagtcaagtgggccgttctttgcggcggcggttgaagaggaaacgcgagcgcgcacgaggagaagaaaccctccacctcaagtgggccgagttttgcagctttccgattttgcccctgcatccaacggcggaaacagcgatacgaatatacttggattgaaggtttatggggaacccgacctgttctggtgttccgctctgccgagtcgatgagaaatagccgccgggttcacagttcacttgcagtcgcagtcgcagtcgcagttgctggttgctttgctccccacatttgtcgacggtcgccgtcgccggttcctcgtgcaacgcaccgcgctaacg

SEQ ID NO: 224 - DNA, 217 bp, Zea mays
accagaacatcgcggcacctctattgttaaagaagcctgtggagatttaggtgtttattttgtacaaaatttaggtgttattatttggttgggtttgtgagttctcgcgtattgtgagagaactcgaccgtttgctgctgaccccgatcaggtcaggtttttacaatgcttccagggactttgtgggaggctgggagtgttcatgtaacgatctctt

SEQ ID NO: 225 - DNA, 353 bp, Zea mays
acgaggcgggaggggccctgccggcgtgttggtcccgcgcggtggcggcactcgttgtccaatgagatccgctggctcccggggtcaggcggcgagctttgttgagtagtaaatgtagagatgctccaagttgcagcatagtaggctaattttagacgcagttagctgtactactggtaattggcactaacttctgttctcccctggaatatctttctggtaccttgtttctcagatgtgctagtagtatttttttttggggtagtgttggcttgttgtattaatgaggagatcggccaaagcttagatacgaaaagctatggtattctactatacttggagcttccctcgac

SEQ ID NO: 226 - DNA, 490 bp, Zea mays
cgtccccctagtgacttgagagagtgtttgttcatgttcgtttgagctcttgttgcttggatcgctttcttccttcctcatttttgttcccaagagacttgtaatcaaagcaagagacaccaagtgtgtggtggtccttgcggggtctaagtgacccgtttgattaaggagaaagctcactcggtctaagtgaccgtttgtgagagggaaagggttgaaagagacccggtctttatgaccacctcaacggggactaggttctttagtaccgaacctcggtaaaacaaatcaccatgtaaattcgcttgttttccatttgatttgtttttcccctctctcccggactttatttaagtgctaacgctamccccgacttgcagtgtgtgtttaaagttataaatttcagattacgcctattcacccccctctaggagaatttcaattggtatcagagcctggtgcttcattaagagtctaacaactcgaagtg

SEQ ID NO: 227 - DNA, 825 bp, Zea mays
tatcattggttcctgatagacagtttgccaaaaacaggattctttccttcataaactaaatttgttaatggcccggaagtagcatcaagccgagatatcgacataggaggtctgatggaagtaaatggctggttgctattagtagaatcaaaaccatgcatcgaaggttcaattttggtggaaaattgcctacttgcaagagggacatcagtggagttgggaagatagacatgtgctgaattgtacgctcctggtctaggataatacactttctgaagtggagaaaatgtttgaatagagtgaggtagctggtttatattgtttaaaggcatctgctcagaagcaggaacatttataaaggaatgcccatgtctatctagcaacagttcttcgtgtgtctctagatgtgttatcttgatagttctcttatgttcatcaccgcttctaggatactgttgagataattcttgcacatttctcatgtttctaactctgaagaactctagagtgcatcaccttgtctatttagtataaagggacaatgcagttcttaccctttcgttctgttacacaggtgtagcatcttcaaataagaacgaccaggtacggttcctcaaatcctctaaacaggttattcaaatctaacaagttctaacgctcatatgtaattagagtgatttgactccatcatagtgatttgagtctttttctgtgtagtctgtaatttttcaaatttgctcttgcttttgcgtaaaatccattcataccactaatgacttgaatttaatcacccagatccttttcttccttcatgccattccagag

SEQ ID NO: 228 - DNA, 208 bp, Zea mays
accaggagcatctgtgcgttccgtggcagggcgccatggggcaggcgagatccagaagaatcgttctaaccatgtgaatattcattcgtgtgtatcaagcctagtttcaaacactcggtttgctagctagtggatatttagaccctatttgttttgctctcctagattatataagtagattatataagttcgattatggtggaaagtt

SEQ ID NO: 229 - DNA, 456 bp, Zea mays
gtttttttgtcaccatctaatccatgttaaatcatggccgttgatgttacttgagttgccatagggcaaagtttgtgtgtgaattcttttttttttgaggggggggggtgctctttggtgtacttcttttaataaaatgatgtgcagttctcctgcgggaaaaaaaaagaaacaaaatatgcagcaggttgaggcctaggcttacgacagggcaacccgagtcgccgttccaatttgttttgaccgttgatccatttctaaccatttttgaacatgccaccgagcgaggtatactaagttactaacaaagctcgggggccgacagacaaggctgcaaacctcctttacgctgacgatgcacccgtcgtattatcaccaacggcaagtgatgttgctgcattcaaggaaatcattcaccgctttggccaggtaaccaaccttaacaacagtttgatc

SEQ ID NO: 230 - DNA, 78 bp, Zea mays
ggtaccgctctcctcctcttcccttcgccagctgtcttggaactctgcgtgcctcgttgcggcagcagtagtagatag

SEQ ID NO: 231 - DNA, 779 bp, Zea mays
cattagggtttctcaacagtaagacccttggttgggccagccacatccttgtggcagttggttggcatgcatgtcatcctcggaattctgggaattattggccgtccaccgttctcgcacgtaatgtgaaccatcgtctagaagcgtagtacttccattagagcgcccactgggggagctcaagttcttaatgacatatcgttactactgcaactcgatcagatctacaataatctttatcttttgtgctgccgatatattgctttacctgttaacacgcaaaggcacatgcatggacgtacgtacgtacagctgaagggaaaagaaaacattttctagaccggcgaatccccttctttatttgcggtattcaattcctccgacacccccatagatggatctttcggaaaaaaatttgatgcagcactgctgcaaaccagagtgtcagctcattgataaattaaaggatcatatcgcatgcatgaacgcatgggcgggctgatcgatctatcgcttcgcgcggtctttttaatttgcttcctggagacagctagcgttggctgatccaaagcaagaatcctgacgctcttcgcctttgattgaggcgcggctttctcttttccgctgccgtgctgtaatccccccggcgtcaaggcaagcatattatccacctgcataaatgtatatatatagacgccgatggatcggtgtcgtcgtcttcatcatccaggcgccgcagtgtaggtctagatcatccaatccaacacaccggtcgagca

SEQ ID NO: 232 - DNA, 461 bp, Zea mays
gcacatatatacaatacgttttattaatatagcggtggttaatgccatctcctgcgtccaacgcccatcgccgaggytgagaggcaagatctgtcgtcttcagtgccccagcgcgacgccccaaactcccaggctatgcttttgtttatattttattgtcatttcatgattcatgacatggtagactctagactatgctttagacatttaatcagtatattcagctcaaacgaaacaaaatctaaaccagaggccagagggtaagtctcacatcataccacccattcctatttttcctaaagcaggggcagggcaaaccgtatttttggctccgcctagggtctcccttctagtgccgccgcaacctcccttctactgccaccgcaacctccatccttcgaatcccatccgacctagccctacaacccgccggacgacgagcagcgaggcccacggccgag

SEQ ID NO: 233 - DNA, 1500 bp, Zea mays
gcaatacaacacacctaactagatgcatgatattactctgttcatcagtctgaattagtataaatcgttgcctttgtgttcatcagtgagtttagcatgcaacgaattccatcaatttatactttggacaactttataggagaattgttgatcatcaaacaccgacattacatttattttgatatggagtattaccaggataaataatgatatatttttgatataaacttgtaagtgtgatgttgttatgagttaaaaaacatgttcggcaagatacttctttatttattatcgattcctctatatcagtcatatttacttttgtatcctaaaatacttaatgtttgaggatttttagaataaaatagtgttcaatgtaaattgcattgcacccatacttatcgaaggtgttccatgttgactaagtattgagaccctaaaacttatatatagagtcacgtcacaacttcaagctaatataaccaatttaatgtctaagcagatcatctcaccaatttcgttgatcgaactggggatggagtatatttactaagatgtttgttacctttttttatattgtcatcttttaactagttttagggtccatgtttgtgttatgcatgatcgttattttaaatatgaacaaacttaagatagttgattaagcaccatgctatgctagataaagaaataagtatattttccgttctaaattctaagttgctttatttttttgatacattaaatttgatatatatttagaataatatgtgtttaaattaatatatactaggactttcgaatttccatagagtgacgggaactactaggtttccaagagttttcgttgttcttccttgctagaaggctattattttatgtatctacattgtcgtttaattatggtaagtagctacaacgtttttttacctttttatatatatagacattccaacgtgtcattttaaagccataaccattacacggtagaagacgcagtaaaaaatatccaggcaggaaccagctgtggaaagtggctaggtgggtcccacgcatcagttcccacttcccagttcccaccaatgaccaatcagccatcaggccagccacgcggggacaccttccgtggagcgagaaaatgacgcctaatcagcgtgttttgttttgtttcgtctcgtcgaccgagccgtccgtcgtcctccctggcggtctggccgcctccgccttcctccccgtgcgtctcacccttttcctctacagcttcctctgcccaatcagctcgtcctctcccctcctctccctcccgtgaactgctaaaatccctcgccaagcatttccgtcgggttaggtggtagataagccgaaaatcgagtggaaaagcatcaatcgagtgctgcgctagttgcctggttcgtcccaacaaattccaccgggaatcagggtcgtccggcagcggctgaggcgtctgggttctggaggagcggccgtcggtgagggggg

SEQ ID NO: 234 - DNA, 121 bp, Zea mays
ggtggacgagctagtcaaagatgccgagcgaactggacaagataccgagtagaatagaatagcgaagaagaaggagagcttgttggattgagttttgaacatcatttgtctatttttacct

SEQ ID NO: 235 - DNA, 869 bp, Zea mays
agccacccccatcgctactgatagcatgccatagattcgtcaatcgtcacaatgttagagaaattaagacgagacgtgtgttaatggttgtaaagccacagatttatggtatcaaaactgtagattttctttgagtagtttgataaaaacttttgtcgaacatttttttaagggctaatttggaaaccacgttttctcaagtgatttttatttatctaaaagaaattagcttatttttttggtaggaactttgaaaaaataaatcaaactagccataactgaaattttttacccaagttcacatcaggtgtcgctgttaaccttcccttaataatagagatgtccaggccagcaaaagcacaattaagctgatcagacattctaccaaccttttccttttcccacccctctctccctatcacccactgtcagtccaatcaatagttgccgttttggtgcttcaccgacaccgacactttctctcccctccttttctttagagagagatagaaaaaaaaacaaaagaaaagcctcagcacgctaatcatcagcagctggtaacaacgcggtggttgcgctgctcgcctctacaagcaacgcaccaacgccaacgcggcgcggcattattatacaccacaccaccacacccacccatcccacagctcatataccagagccggagcagcttagcgcagcccagagcggcgccgcgccaagcacaacccccacccgccacagccgcgtgcgcatgtgagcggtcgccgcggccgggagaccagaggaggggaggactacgtgcatttcgctgtgccgccgccgcggggttcgtgcgcgagcgagatccggcggggcggggcggggggcctgag

SEQ ID NO: 236 - DNA, 203 bp, Zea mays
ggtaagattccatccacctgcttctcgttttgcctgtactgacatagctgccgcggtggttctccgatttgagcgacgctgccgcagtcgtttccggtttgatcgacgctgccgcgatggttcttcggtttggctgatgagatgctaatgggtgcctctgcggatggtttggatgtgttcgtgcaggtatctcgcgtgactcg

SEQ ID NO: 237 - DNA, 1268 bp, Zea mays
attaatcaaatcaaactaagtaataaggcatatcaacattatattagttaatggaatcaaacaataattgaacgtatcgttggctaaatgtgtaattaattgtgttttaaatgcataaacaaataactaatcataaataataaaaaatagtacaatcaaacattaaataaactgctaatcactatcaaacattaaataaactgctgatcactatttttgatggcaaacaaaaaacggttgccgaaaataaacaataaaatatgcaaaaaaaaaagtttaacatcgcgtgcggttgacaatacggtgagccggagcgagcggctgcacgacgagtcaggatcgggaggtggaaccacgagccggcagcgcgtgggcggggcgagccaggggatgcggcgggagcagcagtcacgacatcagacgacatcagaggatggagggagaaggaaagcgaggaaagagagaagaaatgtttcggctacatgttaaaatcccataagtgcttgttcgttttggtgataatccatatatattgggtgggattgagccgatttaaatctataacaagtcaaaattcatcttaaattgcacccaatacattccaatacatatataatatcaataaccgaacaagccctaagtttttttggtggccgtgaaacttagccgtcgaaagtaacattgttttcgacggccactcacagctgccaaaagtaagacactattttcgacgatcagggtttaaccgacgaaaatagtgtgcagtgatattgcggaggctgacctgcacgagtattggttcgagagacgcttttccaccgggtcacctgcatcagcggggaaggggaggcgagagtttcgctggctggccagaccggcgtgagcccggcgcggctgaacccaccaaccaattacgtccaatgtgcaccagctagtacatgtgtacgtgcaaaacacatcgcaggaaaggcagctgcgcagtcttctccactacgccgcgcctgccttcacagtacgcccgctacactaatatgctatgaatatggacaggacattccagaggtagctgggtggggggtggacagtggatcctccaccagcagcagtgtcctagtcgtcgtgtatcctgatggcatctattctacttgtactgccgggaggccggccggagctggtggctgctcctgttgcattgcgatggcaagtggagtgagtgattgcgaatgtgaccgacgacgggctcatcttcttctcttttacactagagc

SEQ ID NO: 238 - DNA, 411 bp, Zea mays
cctgttcttctcataatcaataagtatcgtaatgattaatgatatcatgatccaaaatctatgtaatgaacaacgagttcatgatttggtataaaaattattagtagagagaatgaaatacaaataataagttgtataattaagtgaccttgcactaagttatccatccaccacatatataacgctagtaaaaactataatagcaagcaagcaacactctcaccgactactgatacattcaccaattgataaaaaatatgaagtaaataaggaataacaagtttgttgttcgtttataaaataaaatgacaatatgcactaggtttggtcgggtttaaaaaacccacgggttcacgggtttgggtactataggaacaaacccgtacccataaacccgctgggtacagattt

SEQ ID NO: 239 - DNA, 146 bp, Zea mays
tgtatgtatcctgctaccgttcttgtctagtcgtcttcctcggcaagccgcggcggtcgttgccccctcgtataatctactcgcggcatccttgtcatcgccgtttcgatttggttgatacagaggggagccgcgagggggcggag

SEQ ID NO: 240 - DNA, 1500 bp, Zea mays
ccaaattggcctcgtaccgttttcaggcttctaggccaacagctctatgttccgattctttacattacttgataggttgctcactttatttacccagttgtaatttctgattatactggctgtcgggagcattagctttgcaaaactgtaggaatatatatgacaacgacgaagatcgagtcgcatggcagtgacagaagaataagaggtgttacgattacaatagctggaaaccaaaacttgctctggttattttgaaggtgtttagattttggaatgacgatgttacaattacactttattctggcaaaggtagattgtagaaggatggatagtgatgcactgttaccgcgtggtactgggttggtctttgtttgttgtacatcagttgttttctggcaggtcgttttgttgacttcgtagctgcccgaataacagaccaattattccatctcagttagagatcatttgtctacggcactcgacattcccttggtttctctcctttctgtctggttttggacttttgtttcagcttttttcagtttctggccactaaaagctgttgcggactgctaaacgtttaactttttagtcagattttataaaattcgtggtaaaaactatccaaaatcaacataaacacataatcggtcaagtcgttgtaatagtatgaatctgtcacttttctagatcctgaaccttatagacacatttatgttcctttgcatgtaatcacaatgatatttagattcttttcatagctaaattcttatcacacctagattctcagaaaaagctggcaagaaaaaaatctgaatcaaatatgccctttgtgcctttttaatcatacgtctgttacatgttctctatcagtttcaaattattataagatgttttggttaggtatttgtgagaatttctcccctccaaagttcaaacggtcaattttcgtcaccaaaacggttgatcctttgtccatctgcgatttgttggatgcagattgtttgatataaaaaacaagtttaagggttcagcttcataatttttgtgaagttgagatgcttcccacaggttgccgaacgaccgggctttatggtgtactagctccggttatggtgtactaggcactagcagatgatctcggccgtcagactcttgatcggatggtgaacggcagtcgttaccgcgagcggtctcagcgaggtgcagtgcagggcgtccgcccgatctctggtcctgaatctggtcgcggtcggacactcgtgcgtgtctgggtctggacgtctggtgcaggtccagggccaggtggtcgtgtcgccgcctccgctcccgcccctcgccgctccgcgtgtcactcgccgcttctcttccattccaccccgcccccattctccctcctcgcgcgtcgcgatgaaagaggcgcaggcttgagcgagaggaccgcgctggacaccaccgcatgctagggaggcagggaggggagccgagccgaggacg

SEQ ID NO: 241 - DNA, 145 bp, Zea mays
aaagatgcaatgatgccatttcattcacatattagtaacgtaatgggtaatcaacaacattaaattatgtttgtttaagtaacgtaatgggtaatgcaatgattcgtagttgggtccttgttttcttgaccagtatttgaacctt

SEQ ID NO: 242 - DNA, 116 bp, Zea mays
cagctcgcctggcttccagatccagcgggcggaggagggggtgcggtgcggtgcggccgtgaccatgaagcagccgaggggccggcatgtagccgcgccgggtgggcaacgccgcc

SEQ ID NO: 243 - DNA, 1500 bp, Zea mays
gctagagcaacgaccatccacctgaaagaggtaagttacaagtctgctgaatgatgcgtcgtctgtctctgaattttctgaaatgcatggtttctcatatacgcgggcatgagcatgggcttgcgcatgccatccctggcaatgcaacagccagcaatccatcaggatagcattgttctagtgttcatttaggattctgtgcattgtttttctctcctttagaagtgtttgcttttaagtatggtgggatgaagccgctccacttctaatttgttgttgtttagattgattccacgtaggatagagtggttttaaaaagagaaaattatgttcaaatgttaaaccatttagttcctcggaatctctcggacggagccgctccatcctaactggctccagaaccaaacactaccatagtgcggcaatgggaggaagcacccccacagagtttgttgtccataccctgttgatagtgataccgatcatactcctaatatgcatatgagtatggtttcaactttcaagagcttagtccatccgtttcgcctgttctgcagagtgtgtcgcaacttgcaaatcgccaccatatgcaatgcatattaggatttctgggtgtatcaccggtatgcaaggtacagcagcaagcacaacaaagctgtcttgtcctgaatcctgatagttgactcaggtttccattccagccactggtttagcgagggaaagttctccctctttttcaaaggaaaccacacctcgcatggatagatttgcagcaatggtctaatcttgcagcacctttcagctccatctcctgtgcagacagactctcgcggcgctcactctgttccctttttccccccctacgtggaaccaaatttgccgccgtacatgatatgatattagcgaatccgagcccatgtccttaaagactgtactttatctgaaacctgattcccagtcactccaaaaagaaaagaaagaaaaaacaggagatctcagttagacatatcaagcattgtttgcataaagcgccatgaatagatgccctggacaagtctctttaacgaacgtagatttttattaacactagctctagtttggtgaccagggaatagggaattagaacggatccatgagaagaaatttctcctatatagatctcttctaattctcttatcactaaatcagcctgtagtgtgtcacaactcacaagtagctagatatatcctacctcttttgctgccaatagaaacgcgaaagaactaacgggcataggcagtattttattttaatcttgtgcccagtgatgtgcagaagcatgagttcctgatatatgtactgcattacattggcacagggagaaggcattgggggttcttgaagtgcagtgcaggtccaggcagctagcagtgaccgagagtgagggacagggcaatggcgtcctcactgctccactgccccgacaagctcccgttcttggacgtggaggccatcctccac

SEQ ID NO: 244 - DNA, 1500 bp, Zea mays
gcgtaactgataccatgcataagaagcacgaagtagttttgtggcctaacaaaccaattatgtggtccaatccaagagcctaattatgtggggaccgtgctggcagttcggcaacttttgtttgtatatggccaactaaacctatttcacatatgtgattcgatgtttatgtagttgcttggatcttggggttttgggagtctgtactcctgcctccgctacctcaaatccatgccgcgctgcacctactctgtttccaatgaaagagttttctgttgcgtctgcactgaggactggtcatggcattaacagggtcagatggtaggcgataatttccattggtcaggcggtagttgcgtccagagagatctcttgacacttatttaggaccaatccctgttccatctctagtgtgtcttttgttatttgttgtgaagtcttcactatttagcagtatgcatgttgtcaaggtgttggcagcatatgggaatatggacagctttgtagcagcgggggtatgaagcaacagaaatgcttgtggagtaccagaagtgagattagcagagacgtaagaggatgggagatgcaagaaaagaacaagacaatgataaatggtactttatatgtcagatctttttgtactatggtggtctttgttttcctctcacctctataaagttgtttggctgtcaactgatagtctggtaccaagagctgtgcacaatttccgtttgccttcgtctctctctctctccccctgagccccctctcgagcctggactttttcttcacctgtactggtccatcattagccaaatctgggtagagagatgatcagcaccagaggtttgtaatcaatctctgttagatagatacgtttaacgttctcaagccgacacatatcatacaccttggatcttaacgaggctcatgttctatcaattatcatcacgtcattgtcaaactttacggtggaatgtaaaactgttgaagaatgcatgcatgctttctgggcaatcgtttgccacctgtagtgcgtttggtggtgcgcatctatctgcttccgtgcacttgtcttctcttcctccacatgctcacggcgtgaagtagtaaaacctgtagcatgtgctgcgaaaatagaaaaaagcatgtgcaagtgtaatatttttattctgatgagttcttgtatatgctgtctacacgcaggttaaatattaataacccctgcagaacccagttgcttactggaaaacaggcccagccaccacctttccatggcactggcaccggttgttgactgctctgctgcctgcacactaatggcggtctctgtccgtctacatatataacacagagggggccgctgcaggagcgggcgcggagcaacaccgtccagtccatcactgccctttgttctcctccacagtcgcagacaaagctggttcgtctcgcggagaggggaagccgggaaggtggataggcggcacccacccatcaccc

SEQ ID NO: 245 - DNA, 580 bp, Zea mays
gtgctgaatgtgtggagcgctaccatcaggaggatggttcccccgctcctgtcgctattcagcacacttaccgctcgccgccccgtggtcattatgcttatggaacccctgactgcagggcccagatagatttggagccatagattgacagagtcggagtctgtaataatgtttatttctgtgtcagtgtcttagtcttaatcggccttagtgttagtttgcttatcatatgttttgatgtttgtcgtgatgattgtcaccgaggtgtgggcatccactgcaacttggtgtaattattaataaagttattcatttagttgggcaaccttttatttccactttcctctttatctgagaagttgcgtttggctgtgttgagagtcagtgaagatgctcatttgttcagtattgtgaagacttttatatatcttttcttatgttgaaaggctccagagtcagatctgatgtgtgtatgctttctacaaatgtttgacaacaggcgcagaggtggaaggtgtgctcaacaggagcagcagacaccccaagatgaggcaccccaacagcagttgccacccctcca

SEQ ID NO: 246 - DNA, 288 bp, Zea mays
agttgtactctgacttttgttccttgagctaaggaacgaaaagaattgacattgctgcatatgcaaagcaacattgctctagttgggaggaaacgttagtagtaattgtagacaactgacaaccacagattttatggtcaatgggatacaatatggctagaagaactgggtttatattccctttacattttagtacacaattatactttgttttgatttgcttgtcattagcttgttttgcaataagtatcttcttttttattttcttctatattttatattttgcag

SEQ ID NO: 247 - DNA, 250 bp, Zea mays
agtgtgataacactgtaagtgaaagcagatgaactgctgaatattgattgatgatatgagggttaaaggttacatatatatagggaggagatctgtgtggtttatggaaacagaaccaatcatgatctcctcacatctctagctatagaaacataaccaatcagggtctctagctatagaaacataaccaatcaggatcccctcatatctctacatatctctagctgtcctaatcagaaccaatcagcag

SEQ ID NO: 248 - DNA, 142 bp, Zea mays
cttgcttaaatcccgacgcgacgctcgcggaggcggcggaaccctataaggcctggatcccgctccgcgcccccgcccccgcccgatttcaggctctagggttacgcatgccctagcctccgctgcccgtggtgccggtgcc

SEQ ID NO: 249 - DNA, 579 bp, Zea mays
tcggcccttccaggctcaggaaagaggggagccgcgagagcgagcaccaacactcgaccggtgtccggtgagccgggacagcgagggggacgcggcggaaacggagggtttttgccggaggcgattgggatggcggacacgatagatgggcgacggcgcgcaaaaagcgacaagattggggggctttggagtgggccgccggggacggcacacggcgagccgctttcgagtgacgatcgcagtcgccaatggctttgtgcttttggctgggctcccctgctcctaggttttctccggcacatattttctactgctagtttttttttagtttttctagaggtctatattttttaagaaaaggtacaaaatactttcattgtctatcgacaatgttcacataactccctataatatcttggtagtttattttatccctccattttttagttggttcaatttacctgttaacaagtttttttatttctttacgtacaaacggagtttttagtttaatttttggaacaattggatctataccattaaaagatccaaactttagatatataccatggaccccac

SEQ ID NO: 250 - DNA, 168 bp, Zea mays
ggtgcggcggcggtgcaccgtccgcttcactcaagtggagagctggcggcgtcggaggaggggaatgcagggtccggggccgggacgtcgtcgtgccgcgctcctgcgcgcgcgcgcaggagaagcgcctggccgcgggtgcggaaatccaaggaggagaggagggag

SEQ ID NO: 251 - DNA, 1500 bp, Zea mays
ctccctagtagtcctatctccgtccatccatcaactttagcacaggatcgatctctagctagctatactgcccatatataggacgactgatcgatggtggtcacatgtgatgtgtcttgtgcatgcatgtatatatgctgctcagtacaagtagctagctagcaggtaatctaatccgcggatagcatagcacgcacgcaccagagaattcggggtttcacccccacggccccaccccacgtccccaccacccgcaacaccccggccggcatctcatgtgcccgggttccatgtggccttgcgttgtctgacttgcaccggtgcacgttcccccccggcccggccgacgccgctggccactgggagtgccaggaccaatctcctgcatgcccccttgtctctacggcgaaaggtcagcttgctagtagtaccagctagctagtagctagcgctagcgcagcaatcaacagggctgcggccctggcgccctgctgcgtcgcccactgcttttgtttttgctttgctatgctctcgatcggctgattggtagagactagagagagcatcaaatccttcggatgatgtgcgatctgcatcaatcgaccagatgagttgctgtgcctaaaagctcaactcgatccgcacagctggacgaccagttcacgaaacacacacacacacacacacacgagtactaccacctccggaatgcaaacctcacgtttccctccttgaggagccaaacgatttttgattcaatggaatatatgaaaacaataaaaaacaaacatttatgatactaaaaattattattatttaatcgactgtagaattatttttaataagttttattggagatacaaatattgatgttgtttttttatgatcttaattatttttttaaaacaattggtgtaagcatgaaacgtttttttatttttttgcgacgcataagacttttgttaaggtcttgttcgtttacgtcggattgcacacggaatcgttccaattaatcaaagtttatataaattagagaaacaatttagctaggatttattccgacccatcaatctgacataaacgaacaaagcctaaagaagggagcaaccgtgacgctcgctgccttccggatttgcgagggggagaggacgaagaagaaggcgagcagtgaccagtggagccagcagtccagcaccagccgaccaccacgctgagaatgagatcaatgacggcacgaggcggggccgtgctcgtgggacccgcctggtggtagcctttctccgggcgtcgtgtagattccaaatttccccatctctctcctatttataggcgccccttccatatcccgcgaatggcgaatgtctcgcacacactcccctgccgctgtgccgcacccgcacccctccagcgcgcgcgggcacgagcacgagtacgaggctccatcgccggacgaccaggtagttgcactgccgccaccgtcgacgacgaccgaaggcgacg

SEQ ID NO: 252 - DNA, 438 bp, Zea mays
gtcatttttggtgaacaaaagaattgcctagtcaaaaacctcaattggagatagctttggataacattgtccatgctcaagtaaattttatttgctaacacctgtccatgttcaatatttttatcccacacctttgaccatgtgtgatcatttttcatgtatcatttgttttgccaagtgcatttaaatgtgaatcagattccaaaacttgtgataatcaattttaagtaacactgatttagagacaggtgaaagaatgccattctaactcgacagggtatctgactttgtatttttcaggacaaggagggcatttcgcctgaccaccagaggctgatttttgctagcaagcaattggaggatgggaaaactttagctgattacaacattcagaaggagtcaacactccctttggtcttgaggctcaagggtggaact

SEQ ID NO: 253 - DNA, 1500 bp, Zea mays
taaaatttttagaaaatcatacaatgtatgtagtgttataatatatattattatcatgccactaggcttaattaaggttaaaaacatgttaattaacgtataataggagcacgatgcttctttatacacatgaagaactataaattgttaaagatgaaatcgtgagcttttcattgagagcttgctcggttaggagtgtattaaaaagaattagagatgattaaatcttttgctagtaaaaaaaaataaaaggagatttcatttttctagtctcctttgatctatatgcaatcgaaataaaagttttacgggtagggtctaagttaatggtcgtgcaaaatactgttttgcattatatattgaactgtttgcagagtgaagtttgaaatagtaagataaagagtgggataagtagtcatcttaggctctgtttgggagggcttcgactccttcaaaagagtacctcttccacaggagctggtgcctttgacagattgtttcacaaaacacgtattttttgattcggtgttgtggcaaaaaaatacgatgaaatctgaacactgtcaacttcaggcaaagcatcaaacgcaaaacaagatattaacatgtgaaacatctagcattgtcattacaatgtttagcaaaactgctatctactatctgaaatttgctacttgatacaagaagctaattggtaattgaaacttccttaccagatcactagcaaacgaagttgctttcttatgaatgctttcttatgacaacttaacacaaacttccttatcagatcacttgtcaaactgcttcagctcgacacaaactgcttccttatcagatcagcatcataagatataagtaacatgattttttgaacttccttatgactgtcagtatatgagcatctggcggcgcggcgttgcgacacggcgatggctcgggaagagatactgctcgaggagagattgcgctgcggcgatggggagagaggcagcgtggatctacgcatacgtggagccgtgcagagctaaaatttaagctccggctctcagcctaggacatgacgtttgggagggaaccggcaaagagccagagccggagcccggagcccttccaaatagcctyttaggctatctcccgcagacggtgtaaacggtcgtgtaaagtactatttgtattgtagattattcgtggaataaagtttgaactatggagcgagtacggtgatatctgttgagagagcaatccaaacacgcccttcgtgtcaagacagctgacacacgattggtgcgtatcgaaagtactcgttaatatctccggcatcgtcacggcggcagccgggatcccccccggtacgagttggtcgagccgtcacgtggggccgctctggcactgccccatggcccccatcaaacactcgccccaacctcaaacagtgaacggcgccacctctccgccgccgtcagatcggagctcgactccgaaccccgcttttcagccgcc

SEQ ID NO: 254 - DNA, 1500 bp, Zea mays
gaatgactggtttgcagtttggtctcctagtcaaagggccttaggagtgccaattcgactctcatccgagtgtactataggcatgatatctcgttatcgagatcttggagagcattttaacaacatcaaggataactcctctctggcggagttgacagctctatcgttttaaattataatattttttatttttaaaatatattaattttactatgctaacattgtgtatatcttgagtgcacgacaaggccaatgcaggtagaaaagctaaaacttagaacataggaaatattattacagagatagtatggataagatagaaatatagacgtactttcttgagatttttgaaagccatgaaacattatatgcaggtagaaaagctaaagcttagaacataggaaatattatatgcacgtctgacatacgaagacccagttggtccaaactgaccgcgcccgcttctatggactatggacagtggacacctcccctggaacgcccgtgggcctggccttggcctcgaagcaacctgcaacgcgggcacgcggctcgtgttgtctctgggctctagctgctttgtcctgccgcacccgcaaagcacagcagcacacccaccgcggctccagaggcggaccccatcggcaaccggctctgtccggaaagcccccaagcgcaaccgcttcttcccggaaagggcaaaaaggaaacgcgcctcgtccggtcggacggaagcccttcttcccctccccatccgccgccactgccccgcgagattcggcgagaattaaggcaccatatcctgcctcctctctcgtctccctatttctctctcactccccacctcccgcgcattccgcaccgataggtaggctcacccggactcgtctcccgctcccccctccctttcccaaaaccctagcgggtttcgacctcccaggccaatcagatcgaccgctgccgcgcgcaattgttgagccatcgaggtaacgtctccaatcgaatatctctacctggatgattttcttgttttctttctccgtacttcctttttccgcgtcggacgatttcttcttagttcacttgttgcgttggacttcttcaacctgttagttgtttgtgtgaattactctatctagtgtactagtagtgtttgatgggatgtggttggatggtccaactgttcataccactgccaaaaaaaggagagggggagggtgagctatcggtgaccagtgcccgcccaatcgatggccttcttggaataaaaaaactcggtttatctgtctgtggtatcaggtttgacttcatactgccctgccccaaaggatcaagatcgcatcaccagtggaagcctcgggggctgctaagtaacgttatctgactggctgactgcgccattgataaccttgggttacaactgcacaggaggctgcgacccacaggccatccggggctcattgcagctgacgaagcccctgcagactactccccgacaat

SEQ ID NO: 255 - DNA, 1500 bp, Zea mays
tgccacaacgtatcaagtttgaggattcaagtaactaatatggcacgtcacattaatatttggtctgagcaaactcggttttagatggattttttgggtgactaagttaaaggacctgttttgctgattttttttaacatccggcgactcaaataacacaacatgataaattcgagaaccgctagtgtgttttactcttattttcacactcgcttgagagttgaaatgattagccgtccaacgcaatgatgtgtgactactctaacggccctttgggccaccaccgttctatatcatcagaagacggtttgcatgtctaaatcactgccatcttggcccctccagctctgacgaattatcatccgtttggccgcttcatttctctccccgcttcggtgctgcctgctggccgaccgccgaagcgacaaccgaggccaccgatcagttgactcccgtctcctcgtcgcagggtctcctcacacgagcacacgaacatcgagccctccccgcaggagcataagacgcttcgcttggtaaggaaaccctaccctacttggacgagcttctctcaacgactcaacctttctttcctggatggattagcagttcagtttactgtgaaatttgcatgtacgtggagtagagggaagcccgaacccggtttattttcgaaatttgctaggggttcagttgaattaaacctcctgaatcctgagcccatgtttgttccgctcctttctggcaaactctctgaaagtcgggttgtgctgtgcgattctggttcgttccatgttgggccaaacaatggctgcagtactttattaccattttaaatccgggtaaatgcagtatgagaacagttcctacttcttacttcagatgttgtggttgaacagatacatttttaagaaatcgatcttctttttttcttatcctagcctcctaggcaagagaacactggttaccatgatagacagtgtgcagtgtgctgtacgtggtgttgctttagtagatgtattaggagaaaacaacctgctagcagagcacccaggctcaagcgaccccgggtagttggcctctcaattatagcctataggcgcgaataaactcattcatacagaagactcaaacaggttttagccaatggggcacagctagagtattatacagggacaactggttacgcagacagtgcactgtgcatggtgttgcttcctggatggacaaggagaaaacgacacttgtgggttgcttgcccgcgactggagtgcaactctaacaagtaatcttcagacaatatgatacataaggatgctgctatcttcttctcatcggtttgatttgacttcacttctactcacacatcattgctctgatccaaatgctggttcctatccttgcagttttctaaaacattgctggggttgcagcatgtgtacttgggcatagagggattgttacatcgagctagtgctttggtctctgctgtagcagagcgca

SEQ ID NO: 256 - DNA, 222 bp, Zea mays
cattttaggctgaattgattttgaagaaatgtaaggatttttttttaaaaaaagataacgcaggaggccaactaccgaggaaagcccagataattacacactagcttcacggtgaaggcagtcggggtcacaattcacaactcccaacccaatccagcccagcaatcaacaattcccccggtcgttttcacttgacatcccccgtcccatagatcgccggcg

SEQ ID NO: 257 - DNA, 1401 bp, Zea mays
ggtaatttaacctttttagaaaaaaaaattatgtttagacctctggacgacttaatgtcgtttttggacactgtccagacgaacgagcaaagagaaacgtgaatgaggacatgagatgagatgctatgagatgagacgtcgatgacttataagcgaaggtggcacgtaaatgctctgcttacggggccagcttcctgcggtactagctctgtggctgtctagggtctagcttcctgtcgctagccaaaatgctccaacgttggtgacgcggatgattcacgtttgctgtcacagatatgtataggtgtatttttccttttatttttgtgtagaaaaacggcaagctgatattggtgggcttgctatatctctggcgtcgggcaaagaaaaaacacagaacggcctcaggcctagattttggtgggcttgctggcagccgctgttattagatctgggcctcaggtctagattttggtgggcttgttggcagccgctgttattatatctgacggtggagatgaaaaaggtgacatggcttcatatgcgttcagatttgctcccgtaaataaaaatctgataacatcttaattgaaccgcacgcggcaatcaaccaggcaagaacctagcaattggcataaccctggcctccatttttctgagagagtgaattgagtgttttttttatataaacgtgcgccttgtgctgtgcattagaaaaacggattaggttccagcgtcgtgtacgaatagattagggcaataaaaaacgttggatcatatcaaatcttatcaaatcgaacctcaacagggagcgtcgttttggctagaagctggaccctaggcagcttcagagctggtatcgcagaaagctgacccgtgccacccttcgcttatcaattcatcgatgtgccatttatattcgatggtgttccgcaaacttctagctatgcagtacatttatctatgtacgctatcagaatatcgaacacatgacagagctcggcgtcgtggtctatgacgccaagctctagccacatgagcgccagcaaggcctgcgtatgccaacgaggccagtacctcagcgtcattgatcaaggcaccgagcattgttatctcggcgccacagcttatggcgccgagcaaaaggtaaaaaacgacattaagctgttcagagatcaaacgtgacttttttttaaaaaaaaagagtaaattgcaaaatgttcggtcggaccaacagccacatcgagccaatgaatctagccgtccgctccctgttgcctcccaagccaaccatatccactctcggcgccgccgcgcatctctcccctcttcttgcccttccttccccccaggccccaacccacgcagcctcactaggggtctaccggcggcggcgacgag

SEQ ID NO: 258 - DNA, 1500 bp, Zea mays
tatgacatgtgtttcacatttaacataattggttgggttgtcgagtatggcttgagtcttgtgagcatgactcgctggaaacggaactatcatgggtatctgcaggcttggcgttgtatgcgcagggaagcaaacatgagctatcccttggtcaatgcacctagagagtatggatggatgtgtgcagccaaccaaatcacactgaaacgattatgtctgcacaccaagatagacaacacaaatgcaagaaaaaaatcgtaagcgtttctgtactactgtctctgcagtttttagaagcaaaaaatgcgcaccggataaagttccaaagacagccggtgtttacattattacgtgtgaactacaggatcaggatcggctcaccggccctattcagcatagctatccagttcaccgtgctagcatgctcaaaaatcctgcacgcccccatatagtattttttttaaaaaaaaatggagccttgtggactatggaatgagcacagccatgtggaaggaaggaggaccagccagagccagcatgcgggggttaaggttaagcaagctgactgttgacaggcaaactggaccagatttccaccgtggcaactcacctttcaataaattttagtgtagcaaactgtgcttatcagaataagaagcttctctcccttccaacacttcgcagtggcacgcacggtagctagtcaataaacatatggataaagttacgctgctggtcacaggccgtcactgtctgtatgtaacagaaaatagtttctgaagagaaaccaagcagtagtatgattgtatgaatctctctctcacacacacacacactcaaattattttggaatcccaaagtacaaactgacaaaaagtaggaatatatcttgaagggggtttttagatccagatactggaggaacgtatcttgaagttcatgcagcagataaaagtaaaactactagttgagaagagtcccatacccccgttgaaaatttgaatccgaaaaaatgaacttgggtgtgtatttatcagtcgttctgtttgcctggggaggctcaagctggtaaacgaagcactgttgcttattagtttaaggattgttttgactgccgtattacgtactcgggtattctaaagtgtgaaccgaaagggacggagacagtgtaattcctcctagattgtccttattgagtcgctaatccgccattaaaatatgcgatgacagctttcaaatagagaaggaagtagatacggctattaaaatcttcagagtggtgggcctcatccagtcattccaacacttcatatatatacacatggtgtgtaatagatttccaagcgcaatagtatacagctctcggctgttgtcttcacctcggcagcttcatccccgaaacccattcacaagatacatactacacaagtaggctttgtaggtttgtaggcagcagcagggcgcctccaagcttcgtcactctagtagtctgtgtaagac

SEQ ID NO: 259 - DNA, 113 bp, Zea mays
ctgcagttttccttttcaattttcatattgatgaaccctaaaggcctaaagtaaatgttacattacccggggaaaatttcttttgctagcttgaagattctttgaattggagg

SEQ ID NO: 260 - DNA, 1241 bp, Zea mays
ttagtttctctgagagcatttatgtaatggggctgcaatattatagacttggactttgatgtaaggataatgaacttttatggagttgggctataccctttttcctgtctagggtttctcacaagggtgaattttacctagacaagtttttaacgaggcagccattgcactaaagctcttaataaatttgtcttcttagcaatttgaacttgtaattctgagttgtttgagtcttaaatgaatctgtaattctaagttctgaccagtttcaacttattctaaactgtttgatgtgtgaggcatttatagtgccccatgacgacacaatattgtgctagcgtgtctggtggcacgatatgtctgcccacttgtatcatgtctgggtcaatgtaccggtacgacgacactatcaggcaggcacggattagctattgtgtttgatcgtgtcgtgcctgatcgtgtcgtgtttgactgtgctaatgctaatgctagtgctagggctagtgtcgtgccagtcatgccacatggctaaaattgaatgtcgtaaccaccatcattagttgtgcaccaccacctccattgaggcaatggtgctgattactcggcccaaaggctgccagggtagtgccagtcgcagctgcatggccccacccatccaagcattcactactcctcattcaatacaagagcaatacacaacactccaagacacaaatcaaagcctccgatcaaatcaaagtccacaattcaactctagtttttaggacttgtgagaagatcggcttgtgttcttttgttgtttttgttgcttggttggctttcttcttcctctattcttgtttcaaactcacttgtaatcaaagcaagagacaccaagttgtggtggtccttgtagtggactaagtgtcccatttgattgaagagaaagactcactcggtctaagtgaccgtttgagagagggaaagggttgaaagagacccggtctttgtgaccacctcaacggggagtaggtttgcaagaaccgaacctcggtaaaacaaatcaccgtgttcatccgctttatttctttgttgatttgttttccctctctttcggactcgattatatttctaacgctaaccccggcttgtagtggtgcttaaactttataaatttcagatttgcctattcacccccctctaggcgactttcaattggtatcagagcctggtacttcattagagcctaaccgctcgaagtg

SEQ ID NO: 261 - DNA, 61 bp, Zea mays
ccactactagaaaaatgtcggctagaaaccgacgttcttactctaatagatcaacgttctt

SEQ ID NO: 262 - DNA, 1079 bp, Zea mays
ttagtccatggatggattggattgcagcagccagcagggcgagatgctgcgggacaggaacagccgaacaggacggggtggcctgcggatcgccgtcgtcatgtgcatctcctcaagagccctgcgagagagctgagagagcaggctcgagcagcacagatgtacagtcgagttggggagcagactgcagtgcacacgggtcaccaacatcaacatggcattctctccctcccgcgcgcgcacgatcgacgctcacgttccgacctcgttcgacgtgtcttcgccaaacacaaacacaaacacaaacagacattctccaatctagggcgcctaggagcattcgctcgctctgatttcaaacaagagccagcagcccagcacggagttctatcagggaccagaccaaacccaacggcctaattttttggtccaacctaggcgagacgagatccttccgccacggagtttgtagccacatgattaagaggtagcggaatgtgtttcacggtcccgacgcggctccgttacggaaccgtatgcgctcgtagtacgtgtctcgcgcaatggcttctcgcggtaacacgccaagatgttgtaaacccttgcgggaaagcttacaccaggaaaggaacaggccgtctgcagtgggatcctgagtcatcgcctgcgacagacagaaaataaggaagtcttggttggattcaaaatgcatgtgtggacttgtttgattgttgtctgcaccgaaccgaccgacgtgcacacgtacgtgcaacttgctttttggttgggatcacaggttttctgccttccgccaccatgtacatgtacaccatcccccgacgtaccctagcaaaagaaatctcctcagattcttcttctactcacctcacactcgcttattaataaggggaaccaggaggaagctgcgtctgcgtgcgtgcgtgcgaggtgagttagtctgagcctgtgacctgtgagctcagcgaggcacaaaccagagctaaagacaagacacacgtctctccactgcccatcaacccatctcattccacgggctgctaaagcacacactagctgca

SEQ ID NO: 263 - DNA, 73 bp, Zea mays
tgtcattggaattccattgacttcgtttgcatatgccgattaggaaagacaaggaaaatcttccggttctgcc

SEQ ID NO: 264 - DNA, 1500 bp, Zea mays
gtgttgtatttgctgccatgattggagttggagctggagcggctatagcctgtgtgtcactggtgatgacaggacaggagcgtcgccggctatagcctgtgtctctgtttggcacgtctttcgtcttcgggcccagtcctgaggggagaagaagcccttagctgatctccctgggagatgtttgtgccctcgtcctcccagcttccaagtctaggagctcctgctccttgatgctggcacagtgggataaaataaaaatctacatcagacagtggttggcaaattgatctgtcttcccaacaggccacaggcctcatctgctctggcctctggcacggtggtcactgcagtgctmactcccgtccagcatggctcgaacctgcctgtcgcctttactcacccctgtgccgtcatgctgacggcgctctcaactcagggttaacggggccaaaacccaaaaggatataattaaattacatccattcgcccattttttaaaagaaaacaaaataaattaaatcaagtttttttagatgaaaaaaatgcaaatgcattgctcgtaactttttttaactaaaatccctcgaaagcaaagcatgccggaggagactttcgggatcacattgcatgccaaggcgccattgttaatccaaaagaacataaaaggcacactcctaatatatctctctctccacgtcgcctttcgccgtcgtcttttgctcaccaactccagcagtgtgcgactccgtatccctaaaacgcgcggccgacacattctctctcctctccgtatccggctccgtttccagcaacactccccatcccactccgcatgcagtctatgacacctgggccccgccagcaggcgcgcgcgcacgcagagagttgcggagaggagagagaaagtgtggaaatggggagcgcagggacacrgcgtccattttgcggagagggatgcggagtctgctggagcgcgcaacagtgcctcagaccgcgcaaaatggggatgcggagtcggatacggagtcttgctggagttggtctaacgcttcgcctttcgacccccctttcctccgacttctttcagcagcatcccctagtcctcgcctggactccgcggagtctttggttgctccgagttcctcgcctggtttttgggcaaggtgagctgctcctttctccattcctctgggagtttccccggttgcttgttgcttcccgttttccttctcggtctgcaaggccttctgattgctggcggctcaccttttcgcaggccaaaatttctgatttttttccaccgccgcaaacccctttgctgtgccataccgccattccattcctaagctgggcgtgggcgggtgaagaaaggaagcgaggccggctgtttcgctgaaaccccgccgcctttttttccttttcttttctggacctgattgaagaaccgtagcagattaggggagggaggagcggcggcggcggcggcggaggccggtcggt

SEQ ID NO: 265 - DNA, 497 bp, Zea mays
caaatagaattacttaactagttgttactttgggtggatcaaacaacactttagttgtaggctcgttgagttccaaacattaaattttgaattacttttttttttcctaaaaacttacaatatcgaatatttttgggattctaaaataggttggagggggtagttgtagtagccacgcgagccccatggaaatctagcacattggaccgttttcactctcttttttctagctctagcttcttgaggtgtaatggattgattttggtaaaagagcatggtggagagaagccgagcagctgacaattattttagaatagttatggtggtaaatgaaaatggagccatgagaagctagtttgttttttttttaacctgaactcctagtgtaaaatgaaattttgattcggcgtcgttcccatcaaaatctgcacgggattctgttgtgcgagtgatactcgtgcagagtctactccgcggctccgcgcgggcgcacgcag

SEQ ID NO: 266 - DNA, 246 bp, Zea mays
cactgtgtgctttatttggagagtcagtactatgaatgtggtgacagcaagcagtggcctcttttacattagatgtcccctatgcagtttgattcctaacatgcaaatggtaggctatttacatgactgagaatataattttgattttttttgcagaatttaaagtgcaacgtgttgattctttttatatgtacttctgaatgcttggacctggtgtgactacatagcctggtattcatttcataa

SEQ ID NO: 267 - DNA, 355 bp, Zea mays
cttttttggtctgtgtttttacaagttaaggacaaggttgtagcatctagtttgcaaaataatatctgaacctcattttttgattctatttagggtgtgggatgagcattctagacggatatcagttctgctagtaatgtaaatagttttgtttcttgtgaaaaaacatgcatatcctgactgcgatatttctgctaaaccttcctgttgtccttccctgcagaaagacaaagtaaaacctgtgcatgttattgatgttcctggtcatgctaggctcaaacccaaacttgatgaagtcctgcctaaagttgttgcggttgtctttgttgttgatgctcaagatttcttgtctagc

SEQ ID NO: 268 - DNA, 632 bp, Zea mays
tatttcatcagaagacattaaaatattatcacagacaacaaagaaaaaggcttggcagaaaaggaagctttttccattaagagaacttacagagccttttaaaatatatgcagtagaggacaagctaattagttcataaaaacaattaagggtctgtttggttgtgctgtgaactgtaaaaaaagttgatgtgggatgtgagctgtaaaaaaaactgttgtggcctgtgagttgttaaaaagctaaaaactgtttggtggaaaccactaaaagccgttaaaagtttttcgatatatgttttcacagttccatccgaaagccacaaaaagcaggtccaggggtgctttcagttttgcactgcgagaaagtcggcttttagaaaaagctgcttcctggatccaaccctttggtttggcttttggcttttagggggcaaaagccaaaccaaacacaccctaaacaaagtaattagcaacggatcttcaaataagtgatttcctgttgtgtgtcagttcagatagatggtgtttctggcccccgtaaggagtttcctgtatatgaatgggaaggagctggtggacgaattggccaggctgtgtatcgatggagacagcaattgcagcgaggaggac

SEQ ID NO: 269 - DNA, 268 bp, Zea mays
cagaaatgggactgcgagacaaggagatctctttcttattcccatgtacaatgggtagcctataagaagctccatacttgtagcgacaacaaaactcgtcgtctctttgtcttcaataattcaatctgcagctccaccgcagttttccaaaatattcttactcttttggtcctctcactggcaaacgagttggagagggcaaagctacttcaaacttccattgtttttcatacttgcatatttatttaaataattggtatcctgcaaa

SEQ ID NO: 270 - DNA, 214 bp, Zea mays
atccatcctcaactccaatagatctcaatcttagaagctttgattcagatattgtatttattactttattaaattggtcagcagacagtgtttccagaattcctagcgcatgtaaatattggcactacagtggtagtttcgaatttatcatgattcatatcatgtcaagatatgcttgaagttctgttcatagctacaagggaacatttcatct

SEQ ID NO: 271 - DNA, 70 bp, Zea mays
ggtgagttccgtcggccgggttccagcgacactcgtcgactgactgatcagtaaagtaacaagggaccgc

SEQ ID NO: 272 - DNA, 667 bp, Zea mays
ccacttttagtttaatggctggggatcgatgaaagcatacggtctacgatcctctgtatatttgagtcggccgcagcggctgctcatactgagatccgaggccgtgatttttcaactcggtatttggctgcctctttctggacgagcaaacacatgtatcgcccttgtaagttgtaacatgcatgtattgcctgcttgtccgttgcattggctgttgccatatcagacagtgagaactgagaacggaggtgctagctgttggctgttgctcgtttctttgccagtttcttgtcagcatagtttgtcactgtccaggcttgccgagggaggagggtatagcggggatatgaatcgcgctttcagccggagcgtgctacagtaccaacaggctcaatctccaaggcaaggtaagaccactggacattacccctctgctactcatacaaatagtaacttgaaagcatggccttgtatatgctcgcgtatcatcaaccgcaactgcaatgcacttcatagagtactagtactatttatacgcgaccacactgatcgctgaacgtagacagcatatacatctagctcattttcccgccacaaaaaaaaaaaaaatcgaacaagtagctccgccatgagcgctacggctgatggcggcagcatcggtactggt

SEQ ID NO: 273 - DNA, 699 bp, Zea mays
accttagggatcgttagtatttagaccgaaatggtgccaaaacatgtgaacatgatagcgcaaggtgtggttgcacggtagcatcacgatttcccttgagccagagcttaagccaagaacggggtacagtgtctcagaaaatggccgacagctaccacgatactgcaactcatcccccacagcatcttcacagaagcacaagccaacaactgccatcagggcatcacttaacaaagacgatgaccagagcagcaagccagcaagcattaacaaacgagaaagaaaccaagaatagttcctatttttttactaaagaaccataaagaataccctgttgcgggtccaaacacggttcacgagtcctgattccccgcgataagccaaagcgtgagttttttcaagtgtccacacttatccaaaatgaaatacaaattcgcataggccgtgctactgtgctagcaagcaactgatcctagtcatacactgggcagcaggcagcgagcattccactccacgacgcaaccatccggcgccggtctccgttcgtcgtcccagtctccgcgccgtcccgtaacaatcacaacactgcaggtagtagctcagtttcagtggtcgccggcgagccactcgactcgagcgcacggccaaattgttggaccgaaatccggttcctccccaccgaacggctacgcatccgcc

SEQ ID NO: 274 - DNA, 1500 bp, Zea mays
ccgctcgttcgccgatgccacgccaaactggtgcatgtrtgcctgtttggctgtttcccctggccccgacctcgtcggctccttaatcgctggaggaagaagaaaaacacgcggcgaagaagaaagcaaaaggaaatagaggatgattacctaacatgtggagtttggatcatcctttagaccatcttttatgtgaaatttgagagctcctagtgtattgaaaattgtttttgcacctcgaggactagttgagtaaattgtgttggttattctcttgttactctccaaagagcaactcttgtgggattgtggccggatggagtgttactatagtgtggttcttacgatgctcgagtgttgggtttgacatgtgatactaattagtgtgtgaaccatttagcttggactcaccataatgggaatgtgagttattagctagcatcagaatataaataataaaccattgtattttttcagttacctggttttgtttgattgctatcacacttatttttcattcatattattctctcgtgtggtagttacttgggtaactatagagaagttcatgttgtaaaagttatgtctctatagtaactaattaaataactgattaaatttggatgagtgagactaatataaagacttagcaactactccttccattccctatcttaaggcactgaaggtttatcataagttgaagttttaaaactttgatcaataatatttacaaatatattgtgctagatgttttaataataaatataacagttttattttatttagtcaatgtttataaatattttgttattaatggtcaaagttttaaaatattgactcaggacaaaccttcgcgaccttaagatagagaatataggagtagttgtttaaagaacttgttgttatgaaatagtgccagagcaagtattctgttcttacaccatctctcatattaattaagtttattttagtatcttatggtattgaaagaagttttataaactatttatatctctctagctatataaacccttataactatctataatttaaattttactttgtgactctaaataaacaatattttgtatgtcactggctctctttagttgtacgtactgggcctgccgtgcgccgtgcaccgcacacctttgggaacacgcggctccggccacttgcaacgatcacgagcgcatgacgttggccccacgccacgcaccaagtttggcggcccatccacgccgtcgatcgcccgacggactgcccccgatctgggagactccctcgagggccccgtgtgtccgacgtccgtgtgggtccggcacgggcgagccagcgccatcaaccggccaacctccgctgtgcctgcactgcatctttaccactagtcgccgtgccgtcccctccccttctctctctcctcgctccccacgccacgcatcgcctcgtcggaacggaaggcggcagcgctgcgagcaagggagggagggagcgggg

SEQ ID NO: 275 - DNA, 1500 bp, Zea mays
gcgcaaaaaaatggatattccccttgcacagcagcatattctttacaggttcttctccgttaaaattccggcgaactaaactgtatgtgattctcgtcctacgagtctgaactctgaaacatrcgtgaacccattggaggaagggagccttgcaaggcgcttgtgtgtccttatgtgagaccgtgttcagcagtttacatatatgcaatggcgaagctatagcaaatcagatgggggtgcaaatattttgagggtgtatagtgataacttgtacgtagtatatatatattgaaaatttagtataaatcactagttttacaaatttgtgtcgatacatgtctatccacaatctcatacgtagcttcgcctctacgtatatagtcacacaaaacactattttgtactatagactgcactgtccgtatagtaaaattagaatatagatatatgaatgggtaaactgctagagatagcccgaatgatctttcaaacgaacgaggccaccggaatctttcaaccgctctatccgttttgtttatccacgtagtggtgcgcgtgtaaaataaacaaactacgagcatctaatcaaacgaacgaggctgtctggttggtcatcacagcgcatgtccggccttttcctttacctgctctgacctaaccagaaagacaacgcagcccgagggcgcgtcgtcgctggcatcgccttgtcgcacgttttcctcccaaatgatgctacggcgtgccgaagcacgagagacgctgccacaagcgacgaaccagtccgtctcccgtctgtccatgcccggcctttggctccaaccaacacacggcggattggcacacaagctgacaagcccaagccgacacggaacgctaaacaacacaaggtcataaacaacgcaaggtcgccgcgtgtgtgtatctcgtgggaggagttgaggcgatggaagctgtggatcatatccatgtcaaagctgtggatcatatccatgcatgtcgccaatcaagaacaacatacatacggatgcatgagccgtgaagcgttcattgaggaaggcacggccacggccgggcagtgaagtcgtcgccaaacaaacaaaagctaggccgcacacacgcactgcagcctcggcgagcactgctgggcaggtcgaggtttcttgcaagccaccgccgccggtgccggttccttgcaacgggcaggagggggtggccgacaagccaacccggccgccggggctctgtgcggctggctggatttttgtatataagattgacgactagtgtcgccaaaggacgatcccatacattgccacttgtcggggaggagagtccggagctgagacggcgagctgcctagctccgttcctgctctatatctcagctcctccgttctgtcctgtggccccgagctgagctgagctgccaaggatacgtacgtacgtacgtcttgagggaggctgccggtcgccctcttctctcgtcgacctcgtcggggtt

SEQ ID NO: 276 - DNA, 1500 bp, Zea mays
aaaaaaaatatacacgtcagaaaagcacatgttgcttgatcggatgctaatccagttagtgcttgtggtttcgcctttggacagggtggaaacggaagtatactgctcgaacgtagtagcagtaactcggccaaagaacggaagagagaaacttgcggaagtgtggtgtgtggcacggcgggcccgcccgacgacacaaaacctggtacgcaaaccagtgctagtactgcgtttgacgcgcgcgcgccgcgcgcccaagcacgtcgtgacacgccagacagtagttgcacacagacttgtctcccagggacagctatcgatcgataaccagcaggcagcagtctactaagcaaggacgacgacagcagccgccctgcatcacgtaccctctagcgacgcaacaacgtgctgtgctgcccgttcgttcagcctgccgctgcgtactggccactggcagtggcagagctacggtcaaccaccgatgccgactaacatcgttacatcaatgacatggtgatattctcttatacctattcgttaaatagaagaattggtaccggtaaaaatatgatcttaacagcgacggtccagcagctaggcgtccggtcagccagcccatgggccatatggcccataatctcagcaaataacaggccaatattcaataatctaccgggacacctcttggctcttgtgtatcactcctagggtgacaataactataagatttaaggatcgaatcgaattaggattaggtcctatttctattgatttttgaactagaatttatttatggccctactattttgtgaagaagcatttggatcacgatctattaccacccctaggcgccataggctatggcggcaagtgttggtcacttgttctcaaatgctatgagttaagaacaagacaacacaaaatattaaatgttaatgtctttcgtccttcgaagcattatttctcttaggatataatgatcttcagataaaggttataaaggacataccttcataaatacggtatatgttaataaaagaagaaacatatgaaatataagagacaatataaacaatcatataacattattaattcattctcattatattatcatggaaagacagaaacaatattgaattacaaatgtaccttcggcttgatagaaggtaaaagtacaagcgtgacgcacaagcgagtacaagtcagcgtgaaaagtacgggggtactgttcatctatttataggcacagggcgcagcctgtgtaaaattacattcatgcccttcatgtttactattgacattaggacaatttaccgaggactaaatagccttttcctctttaagtcggtttcttttctgatactgagccgaagctaccttgcgcgtagcttcggagctggttcgaccttggtctcgaccatgcttttcatattgtgaacaacttcatcccgagtccaaaggtttctgcacatatattacacttgggaaacattgttaatc

SEQ ID NO: 277 - DNA, 1500 bp, Zea mays
tgttcctgggcccacatgtcggggctcagcacccttgtacatgcacccctttagctataaaaggggaggcatgcaacgttacaacacaagctctcttagaccaaacttagacaaagactctcagctctcaagcttccacagcaatccaacacacagtggagtagggtattacgctccggcggcccgaaccactctaaatcctcgcgtgttcatgtgctcggtgatcgcttagcaagacaggcaaaacgcttaagccccttcctcatcttaggatttagggcgggtgcattcccgccacccggccggagaattccctctccgacagtatccttgctgaaatttctgaagttttatagtcttggtttctccttttcctgatcttgtattgtttttgaaaaacctttgatttcattgagaggaattggtttgaggaattgattggtggtgagttgcactcttcgaaccactacatacacctagttgttgcagattttggtcgcgatttgagaaaaactcagtttgaattcattctagaaaaccccaacaaaaccccaatttctggctgtatttttaaatctgcggttgattcacaagtccgattgagctcaatgtttggggagatcttggaaacatatttgctcaggtgtgtgtaaaattttatctaaatcggagttcgtttgattcagttttgaattcaaaaatagaatttcgtactgctgaaaagagcacttgttgatgatactgtattacaccgttttggactcttcggtatcgaatttgcgatccatttgttttgctggtctcatgagagtattatgaacattttataatcatgagatcactcgttcgctgatgtgttcatggtttgggtgtttgctttatctcaattgaaatgaagtgttcattttcagtatttagaagcaagatcagattgactctcatttacctctctggtcgcctcaccggtcctacactagtatttagtggtacaaaaatgttgcttgaaaccatgttaaaatttccaggggcctggatgatgaagcgttcattgctggccatttactcaacctgcaaatatgtatcagtattaaatagcaggaagttttaacaaaacgcaaaggggtagcgtgtaagcttgacacagggatctctgcccctgtctacaagctatcaaccttgaaaagcaagcataacatggacactggcttatctatttccatcccaactaccaaagttttggagattccctgactccatctagatgttcatgaagctatcctctggccttccacagctaactgcttactgatcaagggcgatcacaagctgcaggcgtaaattcaggtgatgattctgctctctatctgcatcttcaaatgtcggccccctatcttcattgtagccaatgcccttgtttgatctgctctctaactgtactgctacttgtttgttcttcgtcatggcttcttctgcagctagcgttctgaagctgccagcaat

SEQ ID NO: 278 - DNA, 483 bp, Zea mays
tagtgattagagagaggatttgtcgtgttcatttgagctctgcgctttggatggcttcttctttctcattctttctggagatcaaactcactgtaaatgagggcaagagacaccaatcgtgtggtggtccttgtgggaacttcgtgttccaattgattgagaagagaagctcactcggtctaagtgaccgtttgagagagggaaagggttgaaagagacccggtctttgtgaccacctcaacggggagtaggtttgcaagaaccgaacctcggtaaaacaaatcaccatgtcatccgctcttattcgcttgtgatttgtttttgccctctctttcggactcgattatatttctaacgctaaccccgacttgtagttgtgcttaaagtttataaatttcagatttgcctattcaccccccctctaggcgactttcaattggtatcagagcccggtacttcattagagcctaaccgctcgaagtg

SEQ ID NO: 279 - DNA, 898 bp, Zea mays
ctgcctgcagtcaaaaactgccaggactgctgctgtccttcccacagaccacgagacttattccaacagggcaaaagtcgggggcggggcagggtggaggattaagattgcatggtgaagaatcggtgctgcctcgcgtgtggtatgttgaggcttggaaatgacggcgtaccgcggtcttcctccttgtgtgccggtgtgtgggtgtagacatcgtcgagttccttcggccatgtgcggcccatcttggagagtcggagctgctcgtcccttgtgttgagctcgacaatgatgactctggatcctctggctttcgctggctggaatacttactttggttaactccaccttctcggctatgccaatctttgctatgtgtactctcaagttgttggctactatgattaagaacatcgatcaaattcgaaggagatgtctctggagagggagtggtgaggctgctcatggcattcctctcatcgcttgggataaggtcacttgtccgaagaacgaaggtggtctgagagtgcttaatccgagaatgaatgtggcccttctgatgaaatttgttcacaagttttacaacagactggacattcccagggtccatatggtgcgggactcctattattcttcgggtcagatcccccactgctctcataagaaagggcccttctggtggagagatgttacacaattactcacctacttcagaggatatgccatgcctcgtgtgggtgatggaagcattatcctcttttggcaggatgtttggaacaatcacgcccccatgacggctttcccctgcctctattccttagcaaaaaaaaataaggaatccacaatgctggcattcatcagtaatgtctttagaagataattttcacactcctctgtc

SEQ ID NO: 280 - DNA, 1500 bp, Zea mays
gccccacaccgacagccccgtatatagagtgagagagtgcaagtgctgaatatagagttttcggtgtcctctatacatgtgcagtcatcggtacagtttaccgctgcagctcccgcgtccactgtaaaatcttaggggagcttttacagctcgcgactgcgcccagccttactcgaggtgacaaacgtcagtggaattctagtcagttttgctatggtcaggtttgacctggtcgggggactacgctgggttcgctatggtcagacggtccgacgaccgaagggatttttagactatgttgtgtgaagctcttatcttcttgagtgaattttttagattttttaagctggtgccttcagttttgctggtgcccttatttttacccttarttgtgtttttttttctcaattttgtccttctagtgctacagaccagaaggacaaaactaagcaaaaaaacataactaagagtaaaaatgaggacaccataataattattatgctgtcttgaggtaccccagccttccatatacacgtacgtcactagctgtattactatgtctagtattattgtggtacatactaaattaaagtttaacatagaaaaacatggtaggatagtcacttagctcaactaataacacttgattttgatgccacccttacttgttacacttagatataccacgtacacgatctataatcttgtatatttaaatctggagatttttaatatggtcaaaacatttagttagattagaagtctagcactcgctcccatgcattcttctaatggttgtcctgaaacactcatacgtgttcgtcctggacggtattcaagacgcatacaggagaataccgtaccggggttaaatttgtttaaactgggccggtcaaacaggtcgcgtggctcgatttaaatggattaattaatttagaagacggtttttgtcgcgcgcatgcggcatgcatatgcgaggacgacgacgatgttgttgtagcatgtgccagagaatgtgtcaccggtcaccggcgtcatcgtctcacggattcactttcaaccgtcactacatacctgcattgatcatgttaggctttgttgggttattctaattctatgtgaattgaagtgtattaaaatgtattgagatgaattttaacttactatgaatttaaaccgactcaataccactcaatccacatggattaacggtaaaacgaataagcccttagctgggttttacatacacaaacacaagtytctgagttaatctgctgtgccacgcggcgtgatgctagcggactggagtggataaggatagtcgcaacccaaggagcgccacacaggcctgagccgtatcacgcccatgcatccacaggattttctcctaaagatcacagactttacttaggccatcacaaggagacgtacgctctctgctagcacccatcttgcagcaggcggagccgcccgacccaatccgtgcgtgtgttggtcgag

SEQ ID NO: 281 - DNA, 89 bp, Zea mays
ggtggtgatgctccgcctcgaccagcagctccggcgctgccggcttcaactccaaggagcagtacctttacggcgagttcagcgtcgag

SEQ ID NO: 282 - DNA, 1500 bp, Zea mays
ttggtctttttattggctgagtgtgaaccttttacacctgtataatctatacactagagcaaactagttagtccaattatttgtgttgggcaattcaaccaccaaaatcatctaggaaaaggtttgaccctatttccctttcaatctccccctttttgtgattgatgccaacacaaaccaaagcaagtatagaagtgcataatttaactagtttgcgtaagatagtgaaagggaaatgtgctcttgggccatttctaagtgttttggtgatttagtgtccaatacaagtgcctgagtgtcaaatggtggacaaagaacaaatcaagtataaaggtatgtttctcagacttagtacattgtttttgagactaatgtattgtgtctaagtactgggaacaggaaaaatcaagttgaaaataaagatggctttgttctgccaaagtcagctctgtctgggtgcaccggactgtccggtggtgcaccggacagtgtccggtgcgccaggatggctcaggcaaacttgctgctctcgggaagaatttaacggcgtacggctataattcaccggactgtccggtgtgcaccggacagtgtccggtgagccaacggtcggtcgcttaatccgggcgcgacgcgtagccgagccaacggctagaagggggcaccggactgtccggtgtgcaccggacagtgtctggtgcgccaacggctccaaggcaccaacggtcggcttcgccaaataaggaaagaaatctgcaccggacagtgttcggtggtgcaccggactgtccggtgcgccaggcgacagaaggcaagaattgccttcccggattgctctcmacggctcctagctgccttggggctataaaagggacccctaggcgcatggaggagaataccaagcattccttgagcactcttgatcactcacactccattcttgcgcacttgttcgacattctagtgatttgagctccgttctagtgtgctagtcttttgagcttaagtctgggtcttgtgtgtgcgtatttgctgtgatctttgtgtcttgtgtgagttgctaatccctcccttgctccgtgcttctttgtgaacttcaagtgtaagggcgagaggctccaagttgtggagattcctcgcaaacgggattaagaaaagcaaagcaaaacaccgtggtattcaagtgggtctttggaccgcttgagaggggttgattgcaaccctcgtccgttgggacgccacaacgtggagtaggcaagcgttggtcttggccgaaccacgggataaccaccgtgccatctctgtgattgatatctttgtggttattgtgttttgttgagactcctctctagccacttggtgattattgtgctaacacttaaccaagttttgtggcttaagttttaagttttacaggatcacctattcaccccccctctaggtgctctcaattggtatcagagtcgttctcttcaagaaagggactaaccgcccgaagag

SEQ ID NO: 283 - DNA, 380 bp, Zea mays
tagcttgtcccaacctccttccatcgcacatcggctagctaccgctctataaagcttgcaacccctacactctctgcctcacactgcacatccatatcgacgacgacgatctagctagcctgcttgagatctccatttttacccacgcgcgatcgcgatcgcactgttcttcttcttcctcgctcctacgtgcacgatcgactagcggcatatatatactgctgctagctaaccgtacgcgcaggtatagcggccgcagctgcgcacgagttcattcctcacctagctagcctggtgaaacaaaagctagcagctagctagcaagagagatcatatatatcgatcaagctatcagaagaggcgatcgacgagctaggacg

SEQ ID NO: 284 - DNA, 1244 bp, Zea mays
ggctgctataagtacaaacagaacgagaagcaccggatctaacaccattcatctgaaattcataagccttcaacttcaaatccttgcattttgaaggtaaccttcatggatgctctgaaggactgtaactatctgtgtatatgcaacactgacataagtctccttatccaagggagacaaatagaagtagtgcacttgcatctagagatcatcttcactcctgttgctgtagacaacacctactgtttcattcttcatgcagccagtacggtgcggacatgtttggtatatggctaaatgtgccacactttgtctaactttattcattcgaattgaataactaaccttacgcagaaaagctaggcaaagtgtggcaattgaggtagcgaaccaaacatgccctacatatccatttccgttatgtgattatgggtcattgtccttcagcctctcatcgcacatactgagaaatgcttgacaaaaccaagagtcagcagaagcatctaaaatccacattttttaacaaacacactacgtgtcatttcaattaagaagaagaaacaggtagggggacaagaactgtccaccccaattacaaggccattcaggagtagcctggactgggccaaacacacctaaaaccaaaaagaagcaggcatacaactactaggaacagccaggagctaggagcaggctctaaagggcatcagctccagctaaacaccaagcatctccttcctcaactagagccaacataacactttgaacacaaggcctagccccctaaaaaaacacaaagattacgtgtttccagatctcccaggctaccaagataattagggtgttgatacccttcctcgattccttcccaacattttttgaactttggcaccaccggctagaaaaatgagaacatccgggtcgaggagctagggtgatcaggcccagctcttgttaaactgctaaccaggattgggtggaacagctggtttttataggtggaaacgtagtgagttattactaacattttctttatttatttatgaaactgcggtggagttagtggatgtgtttaatacatatagcaggagttaaactataattaagaaatccttgtttgcgcaaataaatccatagccgttttatttttcttcatttttttggctgttctcagacaattactattcagaaaactgatctcagttaatctggcaaaagtttttgcagttttctgactcttgagg

SEQ ID NO: 285 - DNA, 157 bp, Zea mays
actgtcatccaatgtgaggttgatgacaaggacagtttcatccatcatatcgagcaagtaacaaagccagtgctgtggtaaaactgcaaagacagaacacaggacacaggagaaatataggcgtaagcatgttaattaagaattaattatatatggg

SEQ ID NO: 286 - DNA, 1036 bp, Zea mays
caacatgataaacctagacctttagatcataaatatagctaaaaaataatatgtataaaaagtcatatattgatggactcttcacaaatagtccgtctctttttttcttacttttagacccttagaggcctatcaagataccactaattaatgaggttgcacatgccttaaggattttgtaacttagggttagtttaggaactctattttctcaaggaatttctattttaccaagtgaaaataaaatatttctcttggtaaaatagaaccccctagaaaaatgtggtttctaaactagtctttaatgtagaaacctagttgcctctttttttattcttatctttaaatcgattgtaagtttactattttttctgtcttcttttctccctcttccacctaagtatttagcacgtttatagcctcctaccatcccaatccaaacggtacaaagtcaacgatcacatacatggcggtggaaaattctgtacatacgtttccttgggtgcaacagttgcgcattgatcgacgactagtacctcctccgtgatagacgcgagcaacctatatgcacatggagccatccttacacgctaaattggagcaacttcacgtattttctataaataacatgctaaattaataaatttagcaatgtaataacataagtagtaaccataatttatttctctctctaataatttattatagtacgtccttcgttttttatttgtttcaaaatcaactaaagagcgacaaatattttaaaacgtataaataaataattgggaacttggactatttttaaccgacctagcatattttaactgtttcttttctctatctcttatcattttctcacctgaaaaagttcgcagcttcaccgaacgaaaatgtcctgtcgttccctttccaaccccgtctccgtctccgcccgccacaacaatatcgcattgacagatcgttcatcgtagcctcctccagtcgtctcccgggatcttctccggctataaatttccgccccaattccccaatccag

SEQ ID NO: 287 - DNA, 1500 bp, Zea mays
cacggcccacagttcctgcggttcgctcggctccagatgggttatgcgatcgggagggtaaggtcgtcgggttatataggcgcgtcttccccggagccgccggaacagaacgccgcacgaggcggtgaagcgcccgcgctttccgcggtccgttgaagccggcgcgtgcggctgaggaagatgacccgtggggcccgccagtcagtggtaccgtgcggactccgggtgaagcggcagacgtgcgggtcccccggatcggtgtcacggacgagcacacgaccgaacctgtgaggctggcacatgggcccaccggtcagcggagttgaggcaagcgcgcggacgaggagtgaactgggccgagaccagaagctgacatgggccgcgcggagtgaagttatgggccggtggtaacggttttagcccaaggtgggttttcatctgtacttattattttcttttttttctatttctatctcccaacttcatattcccaaggatcaagttaaattcaaattgaattcataatttgaattcaaattgcttatgggtttcacacaaggatcaagtgctcaaaagtactagcctaaaataatatatttattcctatatatatattccttcatagtgtatattgtttttttcttttctttccctccttccttttcaaattctatttttttaaacctaaacttgtctcgcaaatttaaatgcataattacaagaacctcagcatgagatgcatatttctatatttatttatttgctatttgactgcttctcttaagtgagtatgcacaaaaaaaattaaataattccaaaaacactttcatgaaaaatacatgtattttttttaccttatgcattttagggctttacaatggaggagtacaccaagcattctttgatcaactctaagcaccaagactccattyccacgcatttgattctttgtgatagcaactagagttccatttgagtagagaactcttcgagttgtgttgcgagctcaagttgtgacttgtgtgcgtgttagtgctctgattttgtgtcttgggtgtgttgctctccctcccttacttccgtgtttctttgtgatcatcatttgtaagggcgagaggctccaagttgtggagatccctcgcaaacgggagatagtaaacgaaagaaaaacaccgtggtattcaagttgatcattggatcacttgagaggggttgagtgcaaccctcgtccgttgggacgccacaacgtggagtaggcaaatgttggacttggccgaaccacgggataaaccactatgtctctctgtgttgatctctttgtggttgttgtgttttgcaagaactcctctctagccacttggctttattgctctaacacttaatcaagtttgtggctttaagttttaagtttttataggatcacctattcacccccctctaggtgctctcaattggtatcagagccgttctcttcataaaagggactaatcgcccgaagag

SEQ ID NO: 288 - DNA, 254 bp, Zea mays
cctcatgattcgaacaagcccttatgttcgcgcaaaggaaattcgggctttctacagggacgtgtccgtaaaacgcgccccgcacgaaaatggccccagcacacagagccttcttccgataaaggctcactctcttcccacctctctctcccctccctcctcagtcgtcacacacactcagccagtccgctgcctccgcgctcccccaaaacccaccgcctcgccggaatcctagccttcgccaaccagtcgcc

SEQ ID NO: 289 - DNA, 245 bp, Zea mays
ttgaagtgctaaagtgaatactaatacgaaacagagggagtattttacctgtttaaccccgcgccctcctcgtcgacggcggcgtcgcctcgtcggcccggcccaccaccgtctataaaggcagagcaggcacgctgccattttctttccacctcactgaccctctccttcctcccaccttcggcccatccatctgtccgtcttcgccacccgtggtctccagaccaatccgaggcacgggacat

SEQ ID NO: 290 - DNA, 202 bp, Zea mays
atagcagaaacgagcgcgtagcatcgtcacctcgtcttgcgttcgtgtgcttggtatagagaaggcacccagtgcctgtgctgcttgcgtattttcgtagggagtcaattttggcggcaaggtataataaggttgtattgcccgatgtacggggtgataaataaggtggttattgccagtgtacgtgggataataaggttgt

SEQ ID NO: 291 - DNA, 305 bp, Zea mays
gcagcagcgtgctgagctcgctagctgctgcgggcggcgggcctgctcctgcttgcggccggctgaccctacgcgcggtgcggatcggagcccgaaacagcgggggttgcacgtgcgtgcggtgcgacccgaaggagcagccacgagtgaccgcccagcgagggaacaatggcgatctaatctactacccaaggaagaagcatgggttttactgtgtaaagatctactgctccgtagtagaaatcaagtccggtcattattgctcttttcttttcttttctttttttcattcagatggcacgacc

SEQ ID NO: 292 - DNA, 198 bp, Zea mays
tgtctctgccttccgctcgtttcttgatctcaccgactaatgcgctgacctgcgtttgggcgattctgcaatctgcattctgcacttgtcttttggtttccaagatttaatcttgctggggctaatgactgcattgctcgattttttggttcccggattcacctgtttccgctgggattgtctctgcaattcctgcag

SEQ ID NO: 293 - DNA, 950 bp, Zea mays
tcactaggtctagatctaagtttagtatacccttaaaataactatagtttttgcaatacttaatttttgaaaacagatattttatctataagaccagtccacaaataaagaatgagcatttgtctgataatttatctatctttctatctataagaaagaagtaccagagaggagatataaactaatagaaaacaaaacaaaaaaaagcggaagaacgaagtgtgaaaaggccgagatagaaggctcgcctcggcagtctgcaaggcgcttgttataaagccgcaagtggtaccatttctcactcgccctctctccgctcgctcgctctctctctcaccgaatcacacacacaggcaggccagtgaggcaggggcacgaaggcgcggctccctctctcaagcccctcgccattactcgctcataaaggaagaacagagcgagcgggtagcgaggaagaagctgggccgcggggcaagaggagagaggtccccagccgtaggtctgctgtgcaactccggctcgccgcctgccaaccgcgcggcgcggccaccacgctaggcccctcgccctcctcgtaggtgaacagagcctgcagtcgatacaacagtaaattccgcggcattccattcgctttccctctcgaaacgcaccctgcatttactgcacgtcgctcgccctccggccatccgcgatcttcaaatcttccactgtaaaaaggttcgtgctgttgttttttttatttactttttttcgtgcgttcgcgttcgacgcctcgctcggctggttccttccttccttccgctgtgttcccttctgtttctgtacgggcggtgtatatatttttgttttatatcgttgtttggatcttgatctggccggctgatgaatacgtgcttctctctccgacgaacgacgcagcgggcggagacgggaaggccgtgcgctcaagg

SEQ ID NO: 294 - DNA, 1500 bp, Zea mays
ttacaaaatagtttgcaaaaacaaaacatgtggtgcaagcgtggtccaaaatgttatataagaaagaaacaattcatgcatatcttgtaagtatttatattggcccaattccaagcaacctttgcactaataattatgcaaactagttcaattatgcacttctatatttgctttggtttgtgttggcatcaatcaccaaaaagggggagattgaaagggaattaggcttacacctagttcctaaataattttggtggttgaattgcccaacacaaataattggactaactagtttgctctagattgtatgttctacaggtgccaaaggttcatctacaactatactaattcgactgtccggaataccgtagattattccggacaggagaagctttttggaaaaacaggccaagcgcggaccgtccgggcccctgcggcggaccgtccgtgacagaagaatgaccctcggacagaaccaatgcaaaaacacaagtttccactacagactgtccggaggaaaagtgaagaccgttcgagccctcgcgcggaccgtccggcctcaggcgcggaccgtccggtcggtaagaaaccgaaaaacccgaaggtgacgggttcggagaaatgaattatagggggcctcgcggaccgtccggggtgcacgaccggaccgtccgcgactggctctgtctgacatctgacgacgcattaaatgcaatatagccgttgatatagccgttactgctgaccgttgcattttcagccgttgatctacaggggcggaccgttcgcaccaggagggcggaccgtccgcgctcagcagaatggcccaacggctaggaagtggttggtggctataaatacaaccccaaccacctccattcacttcacccaagcattccaaccttcaacattcaatacaagagctagcaatctattycaagacacattcaaagcctccatctctccaagtttcacaattgagaaaagagatcattagtgattaagtggcttgagagagaaagtgatccgtgtgttatttgtcgctcttgtcgcttggctctttttcaatcgtgctttcttgattctttcattgcgatcaaactcacttgtaattgaggcaagagacaccaatcttgtggtgatccttgtaggaactttgtgttccaagtgattaagaagagaaagctcactcggtccgagggatcgtttgagagagggaagggttgaaagagacccggcctttgtggcctcctcaacggggagtaggtttgcgagaaccgaacctcggtaaaacaaatccacgtgtctcactcttcatttgcttgcgatttgttttacgccctctctcgcggactcgtttctttatttctaacgctaaccccggcttgtagtcgtgtttatatttgtaaatttcagtttcgccctattcaccccccctctaggcgactttcaattggtatcagagcccggtgcttcattagagcctaaccgctcgaagtg

SEQ ID NO: 295 - DNA, 764 bp, Zea mays
ctgtcacccatagccaccctgccgctctacgctgtcaagcggcaaaccatccactgattactctggaggcgcatcagtgcaccctctgacggtcatttacttaacctatcaacctagctagcagatcgacagatcacagatcgtccacgctgatgtggggatcaggatgcatcatcagtgcaccctggtcggctcctcatatccaggccaccgagccaccgtcctcccagccaaagtgccaaactgtccttgacatgtgggaccgtcgcctcgtaggaggacacgggagggtcgcggcctcgcgggcctttgcggctaaacmaaacaaaagcttcacatgatcacatcacagcgcagcggcgcagagcttcacgctctcccacgcagccctcctccagacctccaccactaccgctaccagcggcagcagcgtcgcccccctccgcctctccgcttccttctagccctctcatcggcatctctagcgcggcgcatctgtagcggaggaggaagagcggagcgtcgtctcgccccgcccgcggcattggctgcgggaactgggaaaggaggaattgaataggtacaagcttcgggaacctgcctgatccggatccgaatccgcgctgccgaccggcggaggtagttgccgcagcacttttttttcgctaatgtttcgctgggattccggatatttttcttatataccttacttagtttttgtttttccttttcatagtttgggggcaacatagcttgctcgagag

SEQ ID NO: 296 - DNA, 1500 bp, Zea mays
catgattagattaattcaggctaggagcgctatttgtcaccgtaggtgaagcttcacccactcagtaacaatagattattactgaagaccgtttcagtaattatcgattattactgaagctagttcagtaataatcgattattactaactcggtgaagctgacraatagtgtgtgtgtgtttatacattaggtctagatgtagcgtagcctttagctttcccaatctaaatcttcacctccctacgtgctttgggtggcctacggacccaaagcggccctacgatctctcctccccaatagaggtcctcccgggagacaagatatacgttaacccgagaactctctgtgccattgcgaacagtccgacaccctatcgtcgacggtccgataacttattatggacggtctggcatccgctacctcacagagccgatctcaaagtcatgtatatttagcatcagggttcacgatatttggccccaaaaaaagatgccgacaatattaaacttagcacgtgaaagtgcattttttgccgtactagctagagagttagcgcggtgaactagatcagatctagaaatttattgttggtggaattatttttagaatttcttttaaaatggattaagaataaaaaaaatcgctgggtgacgcacgcgggattttgtaaccgaarttggagcaacgtgagtaggtgctgtggggcccatggcagtcgcacaagaagaagtgcaaacttggaccttatctgtcggcattttcgtgtagagctgcagcttgcttcatccaatggaactagggttttcaattttacgcttcatccaatccttcatccaatcgtctattcatttttttaattaaaatttatttagagctctatcattttgtgaagaaaatcatttagatcgtgatccattaccacccctaaatggaacacgcactaccggaatcgcgttcttgccgatgtctaaaacactcggcaaagtctattttacacttaacaaaaaatactcggcaaatattttatcggcagactagagtgctgaactcctcctgctagactagagcagagcaacctacagcctatctagtttagttttctaatcctgggtcctggtttactaaaatgacaagtccttgaatgcaacatgaagcctcgtaattcctacgcctctgctctcggtggagtagtatcggacaacgccgagcaccatgcagcagccataacatgaagcctaagggcatgtacagtggtgtttaatgtggagtctcttaaggtgtttaagggggttatttgcaaaaaaatcttagagccgtctctccgcgaagagacgcctctggctcgtaaaccaagtagcaacagacgcctcatttcccactgtacgaatttgtcgtctgttctatcgatctgatgctatacaaatacatttaattctgtatttattaatagactacgtttgtagacactccattgtacaatacagtctcttagttgtctt

SEQ ID NO: 297 - DNA, 1500 bp, Zea mays
caaacgggcactaaatgttgtgtcatgtcagcaattgagatgatgtggcaagcaattaacgaagaaacatatgaaatgggttttatggagatgaaaccatgtctacactattgcttagacatattgtcttgtcttttcatgttacctatgaaaccttgctcaattaaactcttcactgtgagagacgtactgtttcaaccatgatttcatttgtttcttgattatgttacatcttgaaaacacaaatttgaaatctaccactgtggaatggcttggcctcaaccttacctgccgagtgatgcgcgtacgtacggagacagacggagtgagcagctagcatgcagcgttactgtagcaaaaggttccgtcctgcaaggagctgaggaaggaaggaacacgtatccaactgggcgatcattgggcgtggacaagacaagggccggggcagcgaggaccgccattattgatgctgccgctctgcctttttacggggcttctgttgccatggatggatggatgattggcggattgattgatggattggttgcccctcgaccctcgtggggtgtggatgcatggatggattggatgccgcagttattgcccggccaaacacagctgctcggcagcgtcagtgcagtgtcgtcgtccccatggacatgcatgcatgagtgaagcaagcaatcctccattgccagcgtgtgtatgtgtactgacgggagctgtggatcaacaagagtcttccaggctaactgctcgatcccttcaccatacgtccataccattgacatggtctcttccgctcaactgcttccgacctctgcccatcaaaacgaccatctcatgatgtgtgccttctcccattgctaatttgatcagcgggttttagtgcgatcttgcatgcaaagcaccgggcctcaggctcccctccataaatgagaggagtactggcagggcagcagcagcagcgaggctgggtggttatgccacccgccaccacactgcagttcaccgacagcgcgacccagccacaagcccaacccacgacaggacactaggacaggcaaggcaagggcttcggagtccaggccacctagctctgacacaagtgttcctgctgaaaggaaaggtcaccctgacagaacagcaacttggacgcagcgcagccgtggcactgcacgcgcacgcacagcacaacacaacacacagccggccgggggcgtcgtcgctgtatctaaccgcattaacgctgccctgcggacgcaagtacagtgcgggggtagcgctaaaatattcaccggaatggaagggaaagagggccggccggccggcatctacacatacccacccccactccctgatccggaggcactcactcactcgcatcactgactgactggactgctgctcactccttccttccttcccctggcagagaatctgcagtgcttgccggccggcccgtccctgccctgcagagcgcggggatctgcaggcatc

SEQ ID NO: 298 - DNA, 1500 bp, Zea mays
agcagctgtgtttggccgggcaataactgcggcatccaatccatccatgcatccacaccccacgagggtcgaggggcaaccaatccatcaatcaatccgccaatcatccatccatccatggcaacagaagccccgtaaaaaggcagagcggcagcatcaataatggcggtcctcgctgccccggcccttgtcttgtccacgcccaatgatcgcccagttggatacgtgttccttccttcctcagctccttgcaggacggaaccttttgctacagtaacgctgcatgctagctgctcactccgtctgtctccgtacgtacgcgcatcactcggcaggtaaggttgaggccaagccattccacagtggtagatttcaaatttgtgttttcaagatgtaacataatcaagaaacaaatgaaatcatggttgaaacagtacgtctctcacagtgaagagtttaattgagcaaggtttcataggtaacatgaaaagacaagacaatatgtctaagcaatagtgtagacatggtttcatctccataaaacccatttcatatgtttcttcgttaattgcttgccacatcatctcaattgctgacatgacacaacatttagtgcccgtttggttagcatgtgaccaatgcttggaacggttcctagccggattgcttgtctcatttatataagctttgatcaataagaacgatttctgggtgcattcctagacaaaaaaggccttaatgacaatgaaacctctatgaaactgacattgaaaatgaccttacgggggtggtgttagatcttacataaacttgcgtgacccttagccactggatgcttaagaaactaggattataacttcgaggctggatgactaggcaactagggtgatgaagttcgaataagagatagtgaggtagaacgacgacacactttccttcactgactgtatagagagataaatcgaatatgtgagacggggttacaatgaacattgatttgtgtgttggttcttttcttattaatatatgttgtgtgaaagagggccgcaataaaaaggttgttacgtctcctggtcgtgacacctgttcttattagagtctaactttccaatatttgggttacatatcttagttttttctggacagtcaaataatgtggtgaggtgtcaagggcgtagtgatcaagggtaggcggccctcgactacggagttcgtagtctcctgccgtgtcttccagaaccgaaggttatgccccttatggcggctgggcttgagaggagatagagagagagatggataattgttttcttcccttctcaagtgctgattacatctatatatagcccatggctgaaacagataagggtaatctcctcctaaataataggctagataacttctaacagaaaggagtaatcccttcctaaataataggctagatatcttttattgtcttaatcctagcggctaattggtttgggcagccgcctcctgtgctgc

SEQ ID NO: 299 - DNA, 1500 bp, Zea mays
caatgtgacaacgcagtgtagttgccaaaatcgatcaaacaaatcggcgtgagcaggacccgtgccgtccagctggtttcagccatataaaggcttatataaagtatgcaaggtgccagcgtccctgcttgattgctccaccgttgtccgtttcgcttacattaatctcatggccgttgtacacaggggtcttgacgttgcacgaaaaccgcacgactttctgtgtgcctcgttttccaggtagtcgccacgggcgaacaggatgggcactgtaacatgaggcttgagcgtcctgtgatgggatctcgtggaagatgggagtgggcatcattggggcttcacaatactgtgtagatgctgttgctgtcctcatacacgaaaaggagtcttcagttctgtgcaccagctgcaacaacagcaacagctgattctagctccaactcgcgctgcctggtgaaaagcaacggaggagggcctccatacacagtgcttgttgcaagtagctagcaatcggtgtggttccagaatccagatttgatggttcaggaatgtgctagtatgatacgacgtcatgacagggcgtaacacgctgtgctgccacaagtttttgctcccttttcgtgtcaaagggattagagatgagggacacagccaaagcctgcgcacaacacgacatttcggttgcacctaatcaagcgcatagctgcaggcattaggtggtccttgcgatgtgccatactgctgattgagtagctctccgttggtggagaagcatacatactgcgttgccaccaggcaaacgacaaactttttttgtaaaagaaaatttctggcaaattcttatagcaagtttggttattctctattcagaagtcggaaacagggatacaaattcgcaaaagaaaagaaaacggagaggtacagaaactcactgtttgcctgaagcacgtagagactagagaggtgggtgatcttcgctgcaagcgtagcagtgcagaggcatgcatatggccactgcagacttcactgacgcttgtgcctccctcaccatcaccattcaccacacattatcagacgcagactagaaacaatgacacgctgacacacgcatgtatcgtcgccgaatgaagcttagccactgattaaatctagccccaacccccgtattaggcagagccaccggttaggctccagaattatctaacgacgatgagcgctttagtcggtcgcggtcggcaaaattataaccccagaaacctccctggccagacgctcggctccggccggggccttatctctgaggaggaggagaggacttaaacaatccaatcatgaagcagccgcctgttgctgtcacgaaccaccgccaccgtctcactcccactcgccctccttaaatacctcgcctcgcctcggccagtctcgtcaaaagcgagagagctaagctaagccgagctaagaagcacagcaagtctcaccagactagcggctagcgcgaga

SEQ ID NO: 300 - DNA, 338 bp, Zea mays
atttccgttgcaacgcacatatatatatatatagatacagatacgagaggggactttaaaatgctaggaccggcccttgtggggtgggggtttggacgtcgctttcactcgcttgcatgcatgcggatctacggtcatcagttattcagtttgatctaatctaatctatgatatctatagcatacccttccctcgtaactaactacgtggacttcggacacgactatataatctagctgtcctgcccggctgtccctccctcctcttgcccacgtacgtacaccgcctagcagagcaggtcgatcggcttcaccctgcgttgtgccccggccggggag

SEQ ID NO: 301 - DNA, 1500 bp, Zea mays
attcgctttgtaaggtacgaggtattgcaggcactattcaattctcatcatatgaaatattttgtggattttctgttttgtttaacgagtagtacaaaacttttgtacaattggaatctgtgcacctccgttctttctagtctactttttttctgtccacatttatttaaatgataacaaatatatatatataaactatatttatatattatttaatgaatatataattagtctaaaacgaattatattttaaaatagagtgagtataaacrataagtacaagcgatgcatgcggtttgtgcggtcctttcacttttcttgctgtggccacttggccagcaacgtgccctgcaaaagttaatgtgaaaatgctgccaggggctgtttggttcctccgactaagttttagttgcgttgacgctagttaatgctagttaggagtactaaatataatctaaatataaaactaattatattgataatgactaaattataagatgaacttattaagtcgaattaattcatggttcgaccatatgatgctatagtaaatatttagtaattataaattaattaggcttgttaaatttgtcttttcgcctatatataattagtttttaaatttaactatatttaatactcataatagtcattagtctctagaactaaacactcctttatttgttgcatctatgaaggttgccgrctagagcaaggatattgttctatattaagttaaacttaaatttaactatatttaatactcataatagtcattagtctctggaactaaacacccctttatttgttgcatctataaaggttgcgggctagagcaaggatattgttctatattaagttaaacttgagaagtcctttagaaaaaaagaattgtttggaagctttataataagaatttagatttctttcttctttagcttttttttccttttttttgttgaaacctgtctaatttactatacgttttactgtattaaattacgagcattagaagtttaagatgactctgttgttgtatccgtctgattgatattttaatttttacaataaatctagttcgagaagttaaaccaaaccccttattttagagaccaaaccaaaaaccaggaaaaaaaatccacaaaggcacaaagatggaaaaggtgtattggactctttttaaagctaaaaaaacagttcaaaagattgctgcttttcgcttcagtgctgctccgattctgtttcagaagattaacaatttgaaattgtgacgatcctaattgccatcttctcgataataatgaggaaaaaaagattgacgcgcttttcgtgtcctcagaaactgcgggtttgctgaaattctcctccactttcccaagcaaagaacaaagaaccgcccttgttctctgcgactctgcccggccggtctccgaggcgggcggagggaaccagagagcaaggcgaggagcgcggaagggctgagggaaggggcggcggggc

SEQ ID NO: 302 - DNA, 381 bp, Zea mays
cctaaacaaatgaaattcgaaatccgaacaaggcgtaattctatggggtcgcaagccaagaatcgcttaaacagagcacccccaagcgaagcgatgaatcaccccagcgaacattaccagtcgaacgcactattaatctattatacactagtacccacaagtaaaacgttgaagaaccactagagacgggggagccagacctggagtgtgcgcgtggcgaactcaacgccgatggtggacttggagtcgagggcgaaggtgttcttggtgaagcgggagagcaggttggacttccccacgccagagtcgccgatgagcacgaccttgaagagatagtcgtactcgtcgccgccctgctcccacgacgccggccggcgagcc

SEQ ID NO: 303 - DNA, 593 bp, Zea mays
ctgcttcctattttgattgtacagtgtagccatcaatgttataaaaatgatgaattttaatttgtctgaggccaagtgctttaatcggcactaattgtatggtttaattgataacaactgttgtaatgatcatacaaattattgctcgcttatttcgctgtaagggtcaggctgaccacatccaacttctaaacacgatctcgatttggcagttgctggtagttgggctttgaggctgattgtatgatgagtggcaaacagtttatctagatcgggctggtttgatgtatggatacaaacatggtgcgttagaacagcagaacctaacagcccaaacctgggctagttgaacgggccaagccgggtacaggtggcaaacacgctctaaccacccctcctgggcctgggcttcctctcctctccctaggtccctacctctccaatcttctccttccttgaccccagcggaggaggagccaccgagccagggcgtgcgagtgcgaactgcgaacgcagcagcagcagctcacgcgcgcacggcacaccagtgagtgacaccacctctcgcctcagcgccggcccccctataaata

SEQ ID NO: 304 - DNA, 1480 bp, Zea mays
aattacttaaatgagatatttatttaaacacgatctaaactcataaattagttgagtgtgaatgacgagatatatgatgtggggtcagacaagatggagtttcttctcttgctttttttcaggctcacgagatcaaggatggtgagaaaagaggtattaaactataaatgatcaaatgggttgtgtctagcgggccaacctaagacacgactcatttaaaggcttgttcgtttattcctatctcatatgaattagatggaattgaaaaaaatgaaagattttgatttacttggaatttaaaaccacccagtccatatggttgagcaaaatgaacaagccttaatttcattgttaccaaaccggcccttattgtctagactgggaaatttttattatatcatatctataattaccaaagctaaatatacacgacatggatttataatcggcatgtataacgatgataatacagaatccagtttcaaaatgtatcagtttttggtgcaaaacaccagcatattttctcttctatgtctacaattcgatctgcatctgcttgcgcctactgtttcaagcgagattttaggtgaggattttgttctcatgctcttttatttgtgttgtagaagaagttgatgaggaatatgctaagaggatgcctgagacaagccaagttaaaaacgagtgtccatatatacactattgattagtttatttgaaataatatccaacacatttgcacccgttttttgtgtgaatttgcgtaacactattttgctgccaatataagcttcagtggaattttattgtgcaagaatttaaatcatcaatataatattagtgtcacagtgatattttactatgtattttgtatatcatagtgacatttgtcgttgtgtattgaaattttatactcacgttgtttggttgctggactagcgttcggctgcttctgcagtggtagctgctgctgctacgtcacgttatataaaatataaatattatagcatttgcagctactacatcctttaaaccagcactaaataagtgaactaatttttaacttrcgtagcgaagcacaggcacatacctattattatctaatgatgatagtggctccgaagatgggagtgcatctaatgatgggagtaccatataatcctaattgtggagaaggggtcctccaccaaatgatgagcaagagcctacacgggactgtgttcttccmaccaatcaacgccaagatttatgccaaagtttttgagtggaagaactcgggcatcaaagtcgaatgagtggccctggacgcaccactaaaaccatggaagataagcactgtagtagtggagtccatgagagtatcgctgatggcgtacacttcaagttctatacaatgagatgaatcactttgtgaccaatttccaatactacattatgtttgaggtcctggaggtttcgtgggcccgttttttctgatgaa

SEQ ID NO: 305 - DNA, 267 bp, Zea mays
acggcacgttctctctcctctcctctcctctctctgctctgccgccgtcctcgtgtcacatttttaattgatggatgagatcacgattcaaatcattcctgaggacacttggtgctggcgctgacaccctgatcgatccttgcctcccgtccgttccgacgaacacaggagttcgacaagcggtacggcgtcgggtggcagtgcgtggtgggcgccaacttcgggtgcttcttcacccacagcagcggcaccttcatctacttctcc

SEQ ID NO: 306 - DNA, 557 bp, Zea mays
aggagtcaagagattgggcctttttttttcttttgttagagaaaaggattgggcagatgggccaaccggccgctacggaaggaaggaatccttggtagcccatttcctccgtggtcccgtgacggactcgtggtcgtggaggagccgagcctctggctcggatggccggcggccgtcgcgaccgccgacgctcgccccagcgcgccacaacacgacgcccggaggcggagcaggaagaagacaagccaagccaagataagatagagatagagcggacacgcaagtgcattccggaatgggaggaggaggagcaataatagcagcgggcccacacccatcaccctctcgcctcgtctcctccctcccgcagattcccgttgttcccttccggccctgtccttctatcgggaaccttttctcccctccatttatattccttccgccgtctgcccccacggaatcaagaaacaaacgaagccagccagccagccgggtcctcccgcgtagctagcgtaggcgtaggcgtagccgtagcagcgtgtgcgagaggggaagaa

SEQ ID NO: 307 - DNA, 315 bp, Zea mays
ctgctagtaaaaaatgactaatagattttgaatggaacctgtagtgcatggccataagcgtactcgatctgcggcagggcggggtccggtccattctgagggaagacaaaacacgcaatacagtagtattagaatttagaaatgtatgtctctatcctactatttaatgttgggatcgatatatatgatgcccaaggtgcctgctgcctagagtccattgttcattagcaagaagtgcccgaaaacagccggcgacacagctgaggcggcagaagcagcttctctcatcgtggcgtttgagtttcagcaggcagc

SEQ ID NO: 308 - DNA, 66 bp, Zea mays
ctgagctccactcccagaagagtccagcgccgcagaaggggcaggtcagatcagctcggtctcgcc

SEQ ID NO: 309 - DNA, 716 bp, Zea mays
tgcggccttcctggatctcggccgccgctcctcgtgagttcctgctattgaatctggttcctttgcggattttcgaattattatctcgtgcagtggtggcgactgttgagcgcgatagatctgatcctcgtagatcgccgcttgcgggtgggcagagtgatccgacagaccggcggcattgtgacccattcctaggctcgcagcgaaggggtggccgatggaattggttatctcgcgcgttgcagagttggttatctagatttgaggatcacgatgggcgcacgccttttttttgtgaactacgtggactgggatattatcgtgagggtggtctgtttttttttttttgctctacctcaccgagcagttatgcttacttgtagtatatatatatatatataataaatgattcttactggtaatgttaattgtgtagcatacaaagcttttaggcaagagcatggtacccacgtatctggaattatatggattttgtatagtgttccagattagatccgatcatccgagtactacattttactacagtattacttaattgtgtccatgtttaaaataattcccctgtgatggcaaccagatctcttttttgttttgttttctctaatgtcattcctcaacttgtccttgtgagagtactcatgatctcattgtgtttgctagcatattataacaggtcacagaactatcagacaagg

SEQ ID NO: 310 - DNA, 980 bp, Zea mays
cgtccggcctcaggcgcgaaccgtccggtcggtgaagaaccagaaaaactcgaaagtgacgagttcggtaaaatgaattataagcgtcctcgcggaccgtccggggtgcacgaccggaccgtccgtgactgcggtacctgacatctgacgacgcatttaatgcaaagtagtcgttgatatagtcgttattgctgaccgttgcgatttcagccgttgatgtgcagggtggaccgtccggaccaagggcgcggaccgcccgcggttggcagaaagggagcaacgactaggaagtggttgtgggctataaatacaaccccaaccacctccattcacgacacccaagcactccaatctttcacattcaatacaagagctagcaatccattccaagacacaatcaaagcttccaatctctccaagttccacaattgagacaagtgatcattagtgattagcgacttgaaagagagagagtgatctgtgtgttatttgtcgctcttgttgcttggttttcgcaatcgtgctttcttcatccctttctcaaccttctaagtgaattgtaaagcttgcaagagacacctaagtgtgtggtgatccttgtggggtcttagtgacccgtgcgattaagaagaagcactcaaccggtctaagtgactgtttgagagagggaaagggttgaaagagactcggtctttgtgaccacctcaatggggactaggttctttagaaccgaacctcggtaaaataaatcaccgtgttcatccgctttatttcttggttgatttgttttccctctctttcagactcagatttaattctaacgctaaccccggcttgtagtgtgtgcttaagtttataaatttcagattccgcctatccacccctccccctctaggcgactttcaattggtatcagagcctggtacttcattagagtctaaccactcgaagtgatatcgggaggatccgccaagagggag

SEQ ID NO: 311 - DNA, 465 bp, Zea mays
ttgggatctgactacttatcacaaagaatggtcaggtaagaaagtccagattcctctatccctttgtagtcttgcagatgcttattattctaattatattagtttatttaacctttgcaccagaaaatagcaatattcttagtcctcacttagatacatgtctgaaaactttggtattttctgaagagtggtctgaatcagcagtcttacttgtcctatcaggttagtgcactctcaagaatagcacaaggatttcaaattgcttcaatctgtagtacaaatccatccaggtgtagttgagaatgggaacacaatgtatttttatataggcttcgcttgaacctaaaatatctcgcacatgttccattctaagtgctctatcgctcgtaattctcatgccttctgactacgaaatctagcgctgttctggtaggaaattgaccgaactcctccccttttcaagca

SEQ ID NO: 312 - DNA, 263 bp, Zea mays
gtgtgacagattgaaataaaaattagtttatattacactttaataccaccacataccacctcaatccactcccatctgagattatctaaacaagtccttaggaaaattgtgttcctaaactagcacttagagatgctctaattttactagcattttttatcaactaactattagctccaaacaccccctaattttagtagcaagagcaaggaaaacccccagccatcttcatctgcctgctggtgccggactgacggttagag

SEQ ID NO: 313 - DNA, 1031 bp, Zea mays
tattgcggtactgcccacatgccaattacattttgcctttttaccatatatattactagcagcacactcagactacttcgcaaggatggttttcagcaactagtttctgaacagcgtgtccgctgtctggtctgtcaaaataatcttggtactgttctcttctcattactttcagtttttagtattattggcaggatgcagatgctagattgaaactgccggcttgtatataccaacctgaagaagaagaaaaatactacctccatttttaaatagttgacgccaggtagttcatttttgaactaaaaagcgtcaaataaaaaaacagagggagtatgtatctaaataatgaagttttgcttacattatgaattactgtctttgagatttaaacatactacctttctcaactattggacttgtagtgcatttgtttagagatttcaggaaggtaaagggcactttggtcattgtcaatacttatactagtctgtgttctgttgagcttggtagttgaagcacaaaatagcaagattcatatttttaggagtagggcgcaaaaaaagacgcaaggcagtttgttgggtccttagtaagcaaaaaggcttcctgtctcatccaatgtgctaataaaaccccacacggaaaagatagagagaaacagattgcctagcttaaaccttgagtgttctcttcctctcaaacaatcaaaccaactaagccagctgcaatcttctctgtctaatcaacttcatcgttgtttcatacaggttgagtcatcttttcccttaattcatgggcaccagctaatagttttgtctatttcagatcctctagcaggctacttctatgtttcttaataagttttgtctcctgcctttgcttcttcccaaatgttttgatactttagatacttatatggtgcatatatttcctaaatgttgtatttttttatcttttgagtgaaggtaaccagtgccaaaataattgctgggggaggctattttgatggttctcatgaccatattctc

SEQ ID NO: 314 - DNA, 83 bp, Zea mays
aaggaaatcagtggcgaagtctatctttttctcctcctgccgtacgtccgttccagcttgcaaagcgctcgcgagctgctgcc

SEQ ID NO: 315 - DNA, 1500 bp, Zea mays
ttgtggttcattccaatataatggatacattagtccaaatttccactaaataataacaccagtcccttgaacccatatgcatgctcatgcactcctcggaccagaatcctagggtatgtatatgctatatatcctctcgtgtcaaaacacaaggcatgactttttttgatttggtgatgtggtcttcaagaaacacactttgacctgattgttgtagcaaaagaagcttgattgatcattggaaaataactttccaataggaatccaaacatgaccaccaactttatagctgtgtaacggcgcaatacgtgggtggacgacgttaagattaacttccgagaggcaaatcctgctctacgaagttacctaaccctaacttctgagaggcctcttagaatttaagctaacttccgaccaaaactatgcgagtggctaacttccgacgggattagctaacttctgacggtttttctaatttccaagagttaatcgctactttcctacggttagggctctagtaagttaagtattttggtgtagccatagcagtagagaaatataaccatatcatgatttttcagctgcaatgtatatgaaaacaacttatataatttactgtcatagatattaatacacatttaaatggaccattagtgttaggaatatacgagtcattagtgtcagatctttcatgtaactaacttctgattatgttcgcttggctttaatccgatccgtatcggcttctactacttttatagtgtttttgtctctattgtagctacaacagttcaaacagtcgactttaatccaaagtgaacaactattaggtctaatcagagccaaccttggtctttggacgaaatctagtatcaggatgtttacaaacttttttaaaaaattaataaagtccaattcatgagtgccccaaccttcttctctcctcttatttcctccacttggcccccaagcaaagccatagcctctacagcgatgttcctagcaatctttttcatgaaagaaaatttgtcgttgatgtatacgttttttagcagtggagccggcctaacacctaccgtatagcaaatcagcttatatacaaacactttttaatagacatgtgggtacttttttataataaaagcggcaacagaattgccggcttaatttttttttaaaaggcacagagaagactacactatggactagcggactagtttgggaaccctattttttcaatagttttccaaaaatgaattatccttctgaaattggagttctcaaactaatcctacatattatggatataaatatatagttataatctagaaacaccatgtcagaaataacaattctctaaaaagaagagtgatattctcattgctgacacactcgtgacatccccaaatgcaacctcagtcgctctctataaaacttgctccaatatatgttgcaggagtatgtaagaaggggagcatatagtttgtgcgcgtcatcatc

SEQ ID NO: 316 - DNA, 925 bp, Zea mays
ataattcttctccatcaaaaaaggaaaaagaggctagtttcttttgctaggaaattgatcttagactctcctccttctaagcaccatcctgggttattttatttggcatccaaacctgcattgaaatatctagagcaaggccaaaattccggtttgatgaatagtcttggtaaatttaaatttggctcgcttgtttactcgccctcgctgtggcaaccctaagacaatgattttatttttgtgggtacaaaatttaaaaaataatcctttaatgaacctccaggctcctttgcttgtggacccccagatcctcacattaatgatcatgtatctgacgaaaggtccaagagttggagcgtcacttagactgactccaacaggggccacacaaatcggccagccattcaagcctttggctagcgtctctggtttgcctgtccatagatatgacacacgctttcaacagcacaggcaaaaaggtagtccaacaaatcaagcacatggtggggtcatgttctcagacacagaaaaaggaaatggttgttcagccacattacaaactattatggcttatctctctctttccatcatttttgcctggctcgtttgctgccctggtggaaggtgttttatactgctacactagcttgtgggcagctattttagctttgcttatccatttagctgctctgttggagtcagtcttagacgccgtcacagctaacagctgaaggcctgaagcaccctcactttccccactccggagctgcacgggcacgcacgcagtttatccaacgccactgggcctcaacaacaacaatctcccaacgccgccgcttccgccgcatcaagcgctagaactaggaacccctcccaaaggatctcaagaagacaaggacaccgtcgagtcgccgccagtcgctcg

SEQ ID NO: 317 - DNA, 233 bp, Zea mays
cgctagctctctgctctcgtcaacgacaagcatcacattagctgtattcatcaatacatgccgactagctagctagttgccctaaagaaacattctcaagccacccgtccagaaaccctatcaagaattcgagctataaataggagcggcaagcaaacagcgcctcaccaccactcagcttcttctcacttgagtttgtgttattattgtggctagagcctagagcaagcgcg

SEQ ID NO: 318 - DNA, 356 bp, Zea mays
cagcaaaaggaaagtttgacaagtgagctgaagaaacatctatcattggaatgtgaccttttgaacttctttgagcagtttgaaagactgttatgtgatcgtcggtctgcagagatggaggctgatgtgaatgctaatcagagtacaaagaagccaccttctatgcgaatgttaaggcaagctgccaatgcatatacaccttctgcctttaaaatgtttgagagggaatttgaattgtacatggattgcatgctctacatctgtggtgagatgagcacaattttcgagtatagaataagtgttgaggacaagtcaagagatcacttcgttaaatttgattccactcaattcccacg

SEQ ID NO: 319 - DNA, 380 bp, Zea mays
tagtaattttaaaactttgggctccacttggttcatgttaacataaacacaaggggtattcccaatcgtcagttaaaataaacacaaggggtcttcccatgacatgatttgttagcaaggatgtccattgaggttgtgatgcaccttacatttgttttattcatgtataactttgtaagcatactgatgtcttttatttggtctgatatggatattgcatatgtgttggtaacttggtattgttgaaatgtttgttctatatgatccaatcatattctaaagccaccattgagtctcgatttgttttacttaacatttgtagtcacctatctgtgtgttgcactaactattcttaattgtcaggtcctgttggtgaggac

SEQ ID NO: 320 - DNA, 1500 bp, Zea mays
taaaaataaaagaaacaatccatacgtatcttatatgtatttatattggctcaattctaagtaacctttgcacttacaattatgcaaattagttcaattatgcacttctatatttgctttggtttgtgttggcatcaatcaccaaaaagggggagattgaaagggaattaggcttacacctatttcctaattgattttggtggttgaattgcccaacacaaataattggactaactagtttgctctagtctataagttatacaggtgccaaaggttcacaaaaagccaataaaaaaagaccaagaaaagggttcaacaaaaaggagcaagggataaccgaagtgctccctggtctggcgcaccggactgtccgatgtgccaccggacagtgtccggtgcactaggggactctaagctaaacttcgcaccttcgggaattatcagaggcgcttcgctataattcaccggagtgtctggtgcaccaccaaacagtgtccggtgctccagaggagagcgactctgaactcgccagcttcgggaatgcgctgcgctataattcaccggacatgtccggtgcacaccggactgtccggtgagccagttgagcaacggctacttcgcgccaacggtcgactgcaacgtattaaatgcgtgcctgcgcgcgcagaggagcagtgcacgcgcgggtggcacaccagacagtctacaggacttgtccggtgcaccaccggacagccaggcgggcccacacgtcagagctccaacggtcggaacccaatggcctggtgacgtggctggcgcaccggacagtgtccggtggcgcaccggactgtccggtgcgcccgtcgacagcagccttcaccaaacggctagtttggtggttggggttataaatacccccaaccactccacattcaagtcatccaagttttccactcttctacaccttacaagagctagcattcaatacaagacacatcaaagaggtcaaatcctcttccaactccacacaaagccttagtgattagagagagtgatttgtcgtgttcatttgagctcttgcgcttggatcgcttcttttcttccttcattcttgtgatcaaactcaattgtaaccaaggcaagagacaccaattgtgtggtggtccttgcgggaacttcgtgttccgtttgattgagaagagaagctcactcggtccgagggaccgtttgagagagggaaagggttgaaagagacccggtctttgtgaccacctcaacggggagtaggtttgcaagaaccgaacctcggtaaaacaaatcatcgtgtctcgctctttattcactcacgatttgttttgcgccctctctctcggactcgtttctattcctaacgctaacccggcttgtagtttgtgcttaagtttgtaaatttcagattcgccctattcacccccctctaggcgactttcaattggtatcagagcccggtgcttcattagagcctaaccgctcgaagtg

SEQ ID NO: 321 - DNA, 1500 bp, Zea mays
aatgaacctaaacttgattgtgagctcaaaacttatataactcaaccattggctcactagttcgtgcatcaggaaaggtgcatatataagcaaagctattttgatcattaatatctcctaatatattgatttgcttcattgaatgatatacaaaagcattaatggaaataatccaagttgtaaaatcatttgcatatattctacgcttcgattgttgattgcaaacatattttcattgagccaaaggtaaaagttcatcaatacatgtcattcttgaaatgggtcctattgaaacacatagatttgctctttttgtcgtgaatttgtcttgtgaagattgaataattagatgaagcaatatccaagggctaaatcataatgaacattctttaccataaaagttgtagttatgcaatagagatgttttttgtgggtatgcaagatagatatctatacccatatagagcacattatctatttgtatcacatttgaaacgaaccggagggattaaaaaaaatctagagggcatgttctcgtggaatttggatatcttccattggaagtgcctctgcatactcttgggattgaatggactatttctgtccacaacatttatgaaataaatcgtggactaaaatgagaatatcttataagtcacatatggtgtgtggaggtacatataatttattttacggaaacgtacgcgttagtatctatctctagcatttacgaaaggaatccattagacagaagttaaaaatgtctttgttttacaatttaaatatatatctcgatacgcagacatttactcgtggagaagacatatatctctaatatttttctcgtacattatgtatctatatatttattaatatatgcataaaagctaaaatgtgtatattttttctcctaagatcataaatcgtgtgagagagatgtactcacaattaatcctatagcactagtatttatctagtggagtttacacatgtagcataccccatccccagcctacccgtttgtagaggctcttcgctttctctgtctggcctcagcgctccacactcttttgcccctttccagttgtgcatgaccccatcccatccctttcaccaccgcccctcttcctcctcccctagctgcacagcccctcgcagccagtttccctcataacccgtcgtccagagggggccgtaagtatctaatctttctttttcctagagagagacgggagggagtcggggactgagagagatgggtgtagaagcaagaattctccccaattctgtgcctgaattgctttcttagacaaatgacagctgctagtactagtagtacgtatctgtagaccggagacaggagagggactgtgcgctagtcgcggtactggttaagtgatgctgcgattttctattccctcggtcctgtgatgtggtagatcaacggaatttcgtgtttttttgggcagggaattaagcaaaggtggtggggtggtggcc

SEQ ID NO: 322 - DNA, 159 bp, Zea mays
cgtatgtatgttacattgacatgtaagatcttacaattcaggcagggtggcatgttgtcattctgctaatacctggcatctcatctaatttgcctgtcttcaacaggttggagcagttcaatgacatcttgtttcaggagaactggttagtgctggagg

SEQ ID NO: 323 - DNA, 1500 bp, Zea mays
gcttcggttcttaggtacatcaccatcttttacaggtatttctcattttgtgtagggaaatctcaggtataaatcatttcctttgaaacaatggaggtatttggtttgaggaatcacttcattcaaaatgagatggtgtatcataaatcaattcttcgaatttggtgtaatgacatcattcctaatattagtactaactaactataagaaattaggtgatgatggatcaactcatttgttcataaaacaaacgaaaaaattgaggagtgagaagatgttggactagcttattcatcaaaccaaacaccataaatatgtataggttgatgcagcatacgtccaattgatgctttggtaaacttactttactgggtggtgcttgtatggttgacaccagacaaaccaaatcctgaaaatattatttgtacaacttttatatgacattgaaatagttatgttgcatttcaggagacggttttttttctcactttctggtttgttttgaattcactgtacatttttgttctagttgtgttatgcgtatcgttcagttttttcttcttaaagaaacaataaatgcacgattttgttttagttcccaatataagatgctggctactgcagcagccggtgagccaacaagctgcaactgcagccatcacttgtgacaagaggccgatcagcacacctgcaacttagtagggagagactactaatgtcgagttggagtcggtgtgagatggcagcgacgctgaggcggcggccttccctttatgtcgacacaggaggagattgggtctcgtttagatttgtagaagtcaagaaggtaccgacgaacgttgattcacgtatcaaccatattatctttttatttatatatggtgtgaaggatgccacaaccaaggtggttgttgcgccttctattagatagtaataattctgacttggcccccttgactaaattgaagagactaagcagcggctgacgctcgatttggtgtggtgccgaagctgcctcatcttgtctaagcagcggctgacgttcgatttggccgccacaacaacgacgataaatttgtggcgtgctgtggcatgagcggcggccaaccaaacaagtcctaaaaattagctcatgtaaccaaacagctcttaattaaagaaaaaactgagtttggtggactcatttcatcagctcgcttttgtttgactagaattcaattttaaactgaaacaaacacgccctcttctccgtgttccatgtgaccgctagtgagtagtgagttagaaatgtacgcagcaaaagagccgcgcaggacgcccaaaggttgagttcatcagttcaaccccccccccccaaacccccccaaaaaaaagacgcccaaaggttattccccaagcacaaacctctgagtctctgacacaccgccgccgcgccgcatccgctacaggctaccctcaccaccgcgcacaccgaagtagtagcaggcggtgccgccccca

SEQ ID NO: 324 - DNA, 1040 bp, Zea mays
tggagtcaagggtgttgctctgcttcttgatcctcctcgagaaagccactggcgacgtgtagtgcaactacacgatgtcgcttgtggagatattttagtgtcgtcaagtagaacgtcgagctccaacggtcaacgttaagcccccctatcagcggcctcagacacatgaggaaaaatagggtacaaaattgtattcaatcatttttttcgttttattaaatgacgaaatagcattatagcatgtgtgacatgtttcataatgacattcagatgaaatccatcaaaatctataccactatataattcactagtttaaactttacaaaaacccatttaactaaatcacatgtacacctataacatctactgaatccaccaaacaaattgcatccatacttaacacaccatcaaaaccaatgattcaaatcgccgggtaactctctatcttacttaaatctaacaaacaatattatttagatcatttatcatacatcattctatccccttgaccctatggtcctagcctctccctccgcgcgtctacgccgccccctaaccttactcatgcctccattgccgccaatccctcctcttacgctgtcgtcgtcgtcatcgacgaccctctcccctctctaggatcgtaacattattacccgctaatggttaataatggtgaagtacaaagccaacttcttataatgggtaaaattctaaatttctgccttagaaagatagtggatccaatctttgaagtggtaaacggaggaagtccaatattaaaactggtaataattggcagaaatctcatgaaatcaaaatttactcctagatgacttgctaattggtgctaaattcatcgaggcacgcgaactcaaatcaagatctcttcttatgagtttgcttggcggagctcgattcgctgcgtcgctgagcctgagtaatcgattcgtgctgggcggtggcgtggtcggagggatctgaatcctagcgccgtccgtatctgaaacccgcgccggcgagctgctcggcgcctcggtggc

SEQ ID NO: 325 - DNA, 78 bp, Zea mays
ctgatagcgccagcctgggcacctgccctttgtagcccaggctgattaccgattttcttattttccaaggcattcgac

SEQ ID NO: 326 - DNA, 1500 bp, Zea mays
aataaggaaaagcaatccattcattcttagtcatatgtttaaaatctttcaattggtataaattctaagtaacatatgcacatctatctcaattgcaaactagttacatttctgcactccatatttgctttggtttgtgtttgcatcaatcaccaaaaagggggagattgaaaggtaaatagagctaactatttcctataatcgattttggtggttgacatccaacacaaaccacatggactaactagtttgtctagatatcatctattacaggtgcataaggttcaacacaaaccaagaaagaaatctagttagggacacaatcaaaattggagcaaagaactagagtgtgctgaattttggcgcactggacagtgtcctgtgtgcaccggacagtgtccggtgcaccaggccgtacaacagatgaactagccactctcaggaattctaggggcgcgctccgctataattcactggattgtccggtgtgccaccagactgtccagtgagccagtggagcaacgactccctgcatgccaacgatcgactgtatagcgctacagtgcgctacagtgccacgatagaagtcagagtgcagaagtcagagggcaccggactgtccggtgcagcaagacgacaagcgtctccaacggtcaactactccaaaccctaacggttgcgctgacgtggcgtgcaccggacagtgcacaatggctgtccggtggcgcaccggactatctggtgcgcccatcgccagcagcccttgccaatggcctacaagtggttggaggctataaataccccccaaccacctcattcatatccatccaagcattctgaacatctcacttattgcaagagcaaaagacttcactcttagacacaatcaaagcaatcaatccactcaaagccccaaaatcaactctagtgcattacggcttgtgagaggatatcttgtgttcttcgttgctcttgttgcttggcttggcctttttcttttcccttctatttctcaagtgacttgtaatcaaagcaagagacacctaagtgtgtggtggtccttgcggggtctaagtgaccccagagattaaggaaaaggctcactcggtctaagtgaccgtttgagagaggggaagggttgaaatagacctagtctttgtgaccttctcaatggggactaggttctttggaaccgaacctcggtaaaacaaatcattgtgttcactcactttaattcttgtttgatttattttccctcgctaacgtttccttgctagtgtgaatttgagttggctcccatacgtcatccgcaatacttgagcaactcttagcaagagagatattcttttggacttgtatttaattctaacgccaacccctgattctagtgtgtgtttaagtttataaatttcaggtttcgcctattcaccctccctctaggcgactttcaattggtatcagagccaatgcttcattaaagagtctaaccaactcgaagtg

SEQ ID NO: 327 - DNA, 110 bp, Zea mays
actgaatatgccaggcttctaaaatcaaaccactaaagccacctgatgctgtgagggtatgttcagagtctttggcctgccaagctgaaggcctcgagaagaagtttctt

SEQ ID NO: 328 - DNA, 968 bp, Zea mays
tttgcgcagagattgtcttccaaacctctgtcgattgcgcagcgaggtttattgctggctctgcctagctagctagtagtggtgacctgacctctgtctctgtgtgtcgtgggtggatcggggcatggcgatggttctactttatagtaacgcagtgcaagcaagcgaggttttgacatgttcccggcacggacattgatgcagccgtgcgcggggactcactccgggcaacgcgtgctggttattcatcagaaagggtctctgttttgcagaggcgacgaggaaacggtcctgttcatcctgcagtgtgcggtggattgtcgttatagacgattaaattgcacccattgcacaactaatcgcataagatatttcaaaagtacgtatgaatatgcgttggcgatgttgatacttccgtgcccttttcactcgcttcaatgatccgcgaagacttcaggtggaggagtaggttaatgctaaaaccaagacttcgtctctgtttaagcttcaagaattaccagatggcgcgctccaagtgtcgttaaggatttggtttcccccgcacagtcgtgctgctgacgctagcgagttctatgcatccaaccgtataaaattatagtaaaaaactgtaggaaatcatggtcttattatcagtactttttattaccgcgagagagtgaaaatcaaattttcatttgagagagagagaggatcaatagaaatctaaaatacaaatcaatggctgtccgcctgtccctgtccaccatatccaatgggccgaagagcacaaagcaaaacgcactgcccgattttgaacggcccatatcactcaacgaaaccctaaaaccgctgccgcaaccacgtataaaaacaccgcacgccacgccgccgccgtcctattcctcggagagggagaagccgccgccgcagcaatcacagcagcccggagaaagcccaggtccgacaag

SEQ ID NO: 329 - DNA, 492 bp, Zea mays
acgtaagctaccctatactccactgtagtgagcagcatgcggcaggatgtgtacaaaagagatttgaaaaaataatataatgtatagtatttgatatagggttgagatatggagtcaatatgagtgcagatgattatgatatagagtaaaaaaatttgatggcaataataaaaatatttctttaaagatagtgatttacagttacataacggcataacgcggatagccttaacccacccaaaattttccaaacaacaacgccgaccggcgcgccggccggcccaacccaccaaaagccccagagccccagtaaggagggccatgccttctgggacggcccacgtagtaagaagcccgcaaaacccccatctttctctcacaaacaaagcctaagccacagctagcaagcaaaaccagcatctcctccatcccaccccgcgccggcggcgacgccgcatcccctcccgtcccgaaccctaaccccactccatc

SEQ ID NO: 330 - DNA, 133 bp, Zea mays
tgtacctgatgattctgcttctaacaaagagaagtttgaagctgatacaaagtattggaaacagctcatttcagaagtatatttcagtgacttcccatttaattggtcaagcatcgcaatgtaatggacatga

SEQ ID NO: 331 - DNA, 598 bp, Zea mays
atctggacagcaatgtttgtttgtattgactgactttgatatatattgaatcaacctaagatgtttataaatgagttgtagacaattttataagctttctagaaattcttggatcacctgttttggatgcctaaatctccagttatgaagttttgaagtgagtagtcgaattccgtccaaatctggacagcattatcatttaatactgattgacttttttaagtgtctaatctcatggtgatgataataccaaagttgtataggatttcttaggcttaacgtctgtttggtatatattgtgtgtttttgtgagaaatatattgcaaaatctctctctctatatatatatatatctacacctgactctgcaatatataggacatcgctcgaattgtttatatgcaggaataggttgtacaaataatttgaaattgacattaaccactaggtggccacccatcattgttttttaccataaggagtctcattttccagttcttactgaatatacaaatttatctgaatttcgattgtttttctgcttgtgaacctttcattggaacgagacaccgaggaggaggctgagttcagagcgaag

SEQ ID NO: 332 - DNA, 158 bp, Zea mays
acgacaaccagtcggccgagaaggaggactacgaggagaagctcaaggaggtggaggccgtgtgcaaccccatcgtgtcggccgtgtaccagcggtcgggcggcgcccctggcggtgacgctgacggcggtgttgacgacgaccacgacgagctgtag

SEQ ID NO: 333 - DNA, 914 bp, Zea mays
ggtcaagagtgatgccctctatagatgtagttctgagttctcctaggatggctatgcacccatttagttaaggtttcgtctgttcgcttggctttaatccgtaccggcttctactggttctatawtattttgtctatatggattgcaactgtagtagtccgaatagctctagctagcttctacaatattttgggtcttctaaaaacgatcctcttcgccttcatcgactcgccagtcattagtccctgttggtaggggtggtcactttttttccataaaccgaaatccgaaccgtaccgagccgaatcgaaattttggttttttcggtagtttggttcgattttggtttttgtatctaaaaagttcggttttcggtatcgtaatcggttttcaccgtataacgaaccgaaataccaaaaaactaaataccaaactttatcaattatcaaatttgactattcgattatgtgaactaaatgtgtgatacaattaaattgttattcacttatttgtatgtgatgtatgatgtatctctaaatatttatacctatatattttttacttttttaaaattatgtgcaatatatcatgtaaacttgttgtatgtattgtcttgagtataattttggtattcggtttttaccgaaaaaccgaagtaaaaaaccgaaattgaacttttcggtttttcattttctagagaaccggtcggtttctaatgtttgaaaaactgaagttttttaaaaccgaaaaaccgaaccgaagtttagaaaaaaaaccgaatgcccagccctagctccgtggcagcaggttctggatcggctcagggtcagaggatcttattgtttctctcgctgcttgctgcattttttcgcaaggtggtgtggagccgagttgggaggaggactgttgtagca

SEQ ID NO: 334 - DNA, 277 bp, Zea mays
ggatcaatggatgagaatttgcaggccagattttgcataccaacgagcttcaaacattttttttacagcccctaatatccatcacttttgaggttcataaaaacagatcaaaatttacaatttaacttttgaataattttttttctatttgtatggaccacggtggatgttaggggcttttgcatcccggatgcaaataatttttttccgccaaagccaggattcctctgctcttcctgtttagggtttccccctctctctgctcctgccggatgcg

SEQ ID NO: 335 - DNA, 68 bp, Zea mays
tcgaagagacggaggcgagggtagacgacggaggcgaggaggacgacgaggcggaggaggggaagccc

SEQ ID NO: 336 - DNA, 387 bp, Zea mays
gtgatcaaatggactaaatcactttgcagtgagaattagatgggcccgtgcggctggtcaggggtggttgcatgtttcatttgcatgcaatccgtcgcgatctcgaatgtttgattggtaatgttgctttgactgcagtgctgcgatactcaagtggcttgtggaattagcacttggtggtgagcgatagtcattgacttgaagagcgtttggcttgtagctaatgcagtagatggcatcaatttggtttgtttgctcgttggtgcatgtttgaaaattatgattgatgggttgtgatttgactaaaaactttcctctttatcagggtttggtgcaagtggcccatatgttgcgcagaggagcactggtgaagcctaagaacccttt

SEQ ID NO: 337 - DNA, 1500 bp, Zea mays
ttatatcatcatattttttaacaatatacttaatttatattatcaatgtttttatatagccttagttaatttacgatagtttaatttatatggattctacaaattgatttatttgaagtcggagtgagtagctactaattagctaccgccaaagtgctaataataaaattgcctggacaatataggaagtttgtgtacatgtgtcttcagtttctctttttatcgttcggtctatgagcaaaagttcttctaattctatgaatccttctataattcttttcttttgaatatcagttaagaaagtttcggattgtctggtatttcaccaatacttaatccaaagttctaaaattagaagaactagactaaagaccctagtacgattttctaaatacaagagacagataatagactttggatcataaatactgttaacagacaataagtatagagtgtttttacttaacatcttaaagactctttaaaaacgtctcaattaacatgccctaacattagcgtgaattaatcaacattaaaatcggcaatcagttgcgctaggtaatttatttgctgcaattattattgttattattataggtgggaaaacgaactgcggcctcatgggcatttatgtttatatatactttttcctactactaggttgccagaggggctcgtgttgtcatgcatggagcggtggttttggactctggtgtgctttgtgtgaggtgtcagctgagggatttacggggcctcaccagttcacctccaccaaaaaaagatccctagtagtagtaggatatagtggagaaattcttcgacagaactgaagaactgaacgaggagagacaccaaaggaggagaggcatctctcaggcatggagctcaatccggtaaagatctggcacaccctctcttctctcttccctgctgcgttttcttatcatgttcgcgcaatcgaaaattcgtttccccatcgctgttcttgtagaagctgttcctgttcgtgcatgcaaatatgcaattcctgatacagagttttacggttctatcagtctctgtatatacatatggtcatcaggaattgggggcatcgatactagaattgagaacaagattgaatccatattcctcgcctttcatgttctatgttagatgttggagggtcgaagaaatctattaattctaagagcagctagagtttcacttcgtgggtgaattatcagtgttatccgcttatgttgcaatagaactgtcactgcatctgcatgggatgcgtctatagcttacagttctagtagctcttgcatcttcgatcgttgatcactgcctgtaatatgccctgccaatctatccactgagcgattcttctgttctttttttacagaccgaagactctgtgatctccgagttcgtgatcgttcagagatgaaacatatagtccactctttctgtcatgtgagtgaacaatttagcccccaaaaatttactctctgaaac

SEQ ID NO: 338 - DNA, 566 bp, Zea mays
gattctctcctgatctccacttgaacccgttgttatatttttaacctggttcctggtgaatcgaacgcgacgacacggcagtggcagattgcaaagcgccctgaccctgatggaatcgacgtgtcacgtactcacgtgtgtaaagtgccgagccgaatagccgatagatagacgttcttttcccgtgaaacaatcgaagatatgatggtgattcgccagcactccgagacaaggatgtgttgcatttagcaagcgtcttgagaaatctaggcgacctgcaggtcagtcagtcagagagagagaaagagagagagcgggcacggcaggcagagtgttgcggttcagagttcataccgtcgctagacagcgtaccgcgtcgtctcagctcgtctgcacgactgttatataaaacgcacaggcacagatctctctcctcgtccctcacccccacgtcggcattcagcagtcagcaagtaacacgagagtgctagctcccttctccagctagccgtgtggctcgctcttcagatcgctgatctcaggcaagattagcctgcccgccccca

SEQ ID NO: 339 - DNA, 726 bp, Zea mays
ccccggctcctttctaaacccatcgaagatggattgaaagagaagagtggagaggagaaaagttaagcgttggaacactcaagtctagtagtatataacatttctctaaaaaaaactggcatgcgtgagcggcctcacagttaaaagataaagtgttaccgctgacgagaagtaacagtggctaggcaggccggccacacacacgccagcagtccagcacttggccactacttactctccttctatatatgtctctccttctgcccctcctgactttgcctttcaarcaagcgcctcacaaggtatgcacacatagcttagccctctctctctctctctctctagctacctccatcatctccatctctactcctctgattatttcaagaaaaaaaggtagccttttccagttcttcatccatggcaatgcgattagatagtttttctacttcggatcgtgtgcccttttattaggtttcctttatgtgactggtagtgctaggttcatttcgagctcatgcgcatatatgccccatgctaacaataattccaatcaagattcaagttgtccacccactagcgccgttaaccctttgtttgttttgtttgcttcactactcctcgatcatgtaggaaaagatctcctagcagctagccagctacagcctacagcaagagatcggcgcgttgattgcttggatcgaccgaccggccggggtggtcgcc

SEQ ID NO: 340 - DNA, 534 bp, Zea mays
ctggaggttggcttaagtgcacatgcagtgaaaataacgttccacttgcgattcatttaacacaactgtcagtataaatagttttttttattggcggttgatttaggtgaaccccaagcgaaaatatatttacacatgcggttttttaagccgtgctcacctatttattttcagtgtgctaactgaaactgtcggtataaatttttgcgtgccatcagtttagagcacttatctactgactttttttttcagtatcgtacggattttgcaccacgtcgacgaccgtcgataacgaggcacgccgatctagagagctcgaagacctgggaatggcacaggggaccggccggagcccgccggcgccatgcaagctgcctcgatcgcggcctcgacctagtagcccgtccctgtcgcgcccagtcgctcgctgcgcctataaaagccgcccgcggctcgcgtaggctaccagcgcaaactctgcaagggcttcggatcccacaccgaggaaaggagaagagagcgagggtcggaata

SEQ ID NO: 341 - DNA, 953 bp, Zea mays
ctccggttatatatgatcgagtcaatttgactgaaaatgatcaatacaacaaaagagcttgcctgcagggccacgcacaaagcacagcagcagaataaaaggtaaagaaagcatccctttgctcttcttggaagaatgcatctcagcattgctcttcttgcaagagaacataaagattgctccaaagaggaagatactatacttatgcaacagctatatatagacgacgacgttattgatcgatctatccgaaagcatgcgcataagctacacattattaaaacatctaggctagtttgcgtacacaccggaagaacctcgggtatacttattggatttatatatcttgccttcgaaactgtatcagcagcctatatatatatatatatatatgttctacacattctcttttctttctttctttctttctgtcaagaaaagtgtgtaatgaaaaagtagtattaggttttaaaatacaataatttaaggaacaattggatctataccattaaaagatccaaactttagatatataccatggaccccacatgtcattgactcatgtggacccacatgtaagtgagatagtaatggtatggatccaaagtgatgatcttttaatggtatggatccaaatttcccataatttaatggctttcactgacatgtatattcttcattacttgtttttggcacaatggaatatctctagaaagcgtgtattaactatttctcctgatatatttaatacacctgctgctaccaggtacctaccaactgttttgaagcttgctgggaagctttgctatcaagtaccagctgttgtcaagatcagtggtgagcacagcagtcggttgttttccatgcatatttaattaaataaataatcgattgttgcgctagctagctgatactgtacatatatacttgttgtagggttgtatatataagta

SEQ ID NO: 342 - DNA, 1500 bp, Zea mays
tctctcggtattgcgtgaaattagaccacacaattccaaactataattatgtgatatcgaaacaatataattgaaattacatctcattttaataccatgtctaatttgatattcaaaccaattcaattccatcctctacaatatcgacttccaaacagagcattagagacaatttggatctcagtaactaaggaaaaagtggctaaagtttaatcaatccagaagttaaagattcaaacaggaacaactaaaattgactaaaatgatgagaaaaaaatccttccagtcatttttagcttataagtaggagctaaaatttagtcagcttgttttagctcatgcaatgagcaggccatagttagatttgctgatggtgggggattcattgattgacttgatcttgattgcctttacatgaaagtcactgaagttggtttttaatatcttgccacgctattgagctaaatccagcttactcaagtgcctatcttaacctagctatttatattgagcttgtaggtttgtgatgttttttctctctaagacccacattagttatttattcaggataaactattaattaaatgagatcaatgactaatcatatagaaaaaacataccataatctagcatttacattatatttaaatattttagttatttaaaggataacattcctagagatgataactacaaggaaaaacgttcttttttttacgaagtaacaagatgagggatggcttaactatataggagaaaacgtggtaactaaaatcaaagaagagtattcctaaaggtcatacgaaaaatcttttaaagaattatattcctagaagtcatctgtacaaggagcaacaaaatcagtatatagaaaatcttttaaagaattacgttcctagaagccataccatacctataaggagaaacaaaattagtatctaaaataaaaaagaatattcctgaaggccatatcaggaaaaaaccgtatcctggaggtcatatataaaaaaagtacaaaatgacttttatagggaatatttctggaggccatatatagggaaaaattccatcctgaaggtcatatatgaaaaaaaaatacaaaacagcttgaaaaactctatccagaaggtcgtacatgaagaaaaaaacaaattgacttgacgggaaactgtagcctgaaggtcgtatatgaaaaaaatacaggatttagcctgaaccctgaaggagtgaaggtcgtatatgaaaaaaaaacagagtggtttgaaaaaataacaaaaaaatttgacgagagtgggatttgaacccacgccctttcggaccagaaccttaatctggcgccttagaccaactcggccatctcgtcatcttgcttattgtttttacataaatgttttgttgtatgcatcacttcatttgtaaaagtatcgttatccctttaccttctctccagccccacgcacaggttatgcagttcctcagaggttcctggaagctgcaaca

SEQ ID NO: 343 - DNA, 553 bp, Zea mays
acttgaaatccgtacaaactactggctgcctataaatagttgcagtcgactgacaaggcagcacgtaattggagttagtccagttcccacatgtaaaatgtaataaatatatcaagaaaagaaaaagaaaatgcagctaatttgaggtgaccgcgttgttctgtatccctgcctccctggtcatttcttcttttccgtcaaccttctttctcgcgcccaaacaggagttctctcgttctaaaaaaagattgcgaaaggacatgaatgtatgttcaccacgtcgagttgtccagccatttttcttttctcggattctggattcatttcatgttcgcgtttcgtttattgtttttctaattgcccattcattcatgccgttcgtgcccacgcatgcagcccatgaggatcgagcatatggaggagcctagttcttgatccaatctcccagcatgcttgacgaacgcgaagacgaacgtggggcgaacgctgcatgctaacgcggttgatcttattcctaataatccgtagcgattcgggagattgatttttgatc

SEQ ID NO: 344 - DNA, 64 bp, Zea mays
aggcggtgaaatttgaagggcaaggcaatgatcttgtcctcgcgctactgatctgttgatgtga

SEQ ID NO: 345 - DNA, 70 bp, Zea mays
cgggcagtcgtacccctgagacggcgactttcctgaacgccgcggatgtacaccaacccgtgaggtgttt

SEQ ID NO: 346 - DNA, 1441 bp, Zea mays
tgttaaagatttatattaaaaacgtattttactgtagattttgtatatatgtatttatcaggccttcaaatgtcttatatatactagttttatttaattcattataaaataataaaaatggatagagaggagaaaatttttatatacagaaaatatttttagaggtcacaaaaacgttctatacatttaaagtggaaattttaaatttttattattattgtgggttaagtggtatataaaatataacgtgagtggctcagctgttagtgatatataattaattaatcttcgcaaagatggcaaaaaaaaactaagaggcccatttgaagttgagaatcatataaactattcgattaaagacagccttgtattttagagaagacctttttaacacgaaaagtagcttcactctggagtaacttgtccttgtactgctacctcaccagtcaccacttcaccagcgctgttcaacacttcaactgcaaactagaaaagcggccggtagagtggagtcgtggacgagcagttgtggacagagcgagctactggaacggaccacagtatcgcataggattcttgttgggcagttgtgagttttgggagttgatgagttgcaagtaccacacagacacaagaaagataataaacaccttgaaaagtgaatggaagttcagaaaaaaaaacaaaagctgtcccaccgtgctttaaaaaatcgcccaaacttttccggactcttttatcctttgcccaacgtgaacccgcagtcccacacacaagtgcatagaattcacaagagctgaggggggccgggagatagaggagcggcaccgccgtccgccgcaccggcactggaggcgaaatttcattatttggcgcactggagcggggggagagagagagagagctggaaggtggaagcaaaaatccagagtctatagagggaggatggagatctggagctcctggggagcaacgagaagcagctggaaaatctcatggtaacggttggcagagggggtccttgatctcttcctgagctggaggactccatctttcgagccgcggacccggagaaacttggatctctaggccatccaagggaaggtttactcattccttgctggtagcctactgcattgctgcctgccctcagatccgagctgccgcaagaagaaaggtggaatctttgctcgccttctggacaaatccgtccaaatttgggggtttcttgagctgttcttgggagcgccgtgcttcaagtttttttggggggaaaatgtcgttttctttgccggggtagatgcgggagtgatgtcgaccactttatgagctttccccctgctattttggggtttagattcgctctagttatggcggatcttgacatggagcattaggagtttctttcgtcgaaggcggaaggagcttgctgtaagctgca

SEQ ID NO: 347 - DNA, 692 bp, Zea mays
tgtgctgtgtgcatgtccattgccaacgattcacctacggacttacccacgtggcctccatggccccatacgtacaatgattacttgcatttcagatggcacccattcgaaatttcatgcagtaaacccctcccttccaataagtactctatcgctctcatctacagcaaccccaaaatccaaaaacccgatcctaaaacacgttttcttagcccgataccttacctcgcaagagcttggtctagcccgtttaaaatgggtccggacacggaccgacatgaataagcgagctagaaccgaacatagaattaatatcgacaagctagcctgaaccgacccgtttaacgtttggtccgtttttttactaaactatactttttagctcgctaaactcgcttttcgacctgatctttttttacctactggctgaacctacccgtttaaacctatagcgtgccggacccgttcggtgaaataaacccacaggtctgacaagctagacccggttttctggtccacatcactactctccatctagtccacataaaagtcactcagtcctctaatcctctctcgctcgctctctagtctcttttcttctctggtctcgcgttctccctcctctgttcgccgctttataccgcccgcccgcccaccagaacgacatacatcctcctcccccgtcccctcca

SEQ ID NO: 348 - DNA, 1500 bp, Zea mays
ttgtagctatcatgcactgtcacgcttgcgtcactactacgtatgtgaattctactactgaatctttggaaccaatacttacgacagaaaatgggtatatactatgtaatatgaaactatattacacgacagacattttattttatttttgtgtgtgaaacttgcatcaattttaatttgactaacctttaagatatatcgttattggagagtgtacagtacattattagccatattcggagtaaaataatctaagaagaaaatgctctcttctcatatggtatactgtagtgcgcggtaccggcagaatccccgtttatatagagcactaaattaaagcatgcttggaagtacgagtacgcatgaccagaatggcgcatctaccaatcggctcattacaccatggcaagctgcaaataaaaaataatatataatagagaggaaatcaaactctattgatcggatagagagacgccagccaccagcagtccagttgatggtaagcttcctttaatttgcagacacatatgacgggaacatttttggtgtaaacaaatccttccgtacaaccgtgtcaatttttaatctgagccacatgatgatgatttaaagggacgcgcgagagtggataatttcgcaattaaccgtccgctcctaatcacacttttgcaaatctctcctctcaccccgcgctcgctctctcggatcaacatcatgtgacccagattagaagttttcacggttgcacagaagggttggtttgcaccagcagatatgttctccacatgagacccagagtgaaaaaaaatcactaaaacattaactaccctaaaaacaacagatctattaatgaattagatagactttagctagagattaataaatcctattacctcattaactcttcaacacctccaataactgctaatatatggggcctaaattttcactggcagcgttagtacacgtacacttacttttaggtaaacgtctagccgaggtagaaaagcagtaatcacacagaaaagtgtgaaaagatggccatggtcatggacctacagtacgccacacacccgacagcgacaggcaacgaactccaaaacatgtttattaccgacacaaaggtccaaaagatgtcaaaggtttgcaccgctagatttacccggagaagtttctccggactccgggccccgcaaagttattttttttctggctttagatttttttagttattatttttttcaagaaaagagaggaatttattatggacgtagtaaaagtattcgctagagatagagattattagaggtagtcgcagtgttgcacgctggccactaacttcacctcaccgcactctatatagctgccaagcttgaccgcagcttacccagcccaataagcagcgagagagggtcgtcgaggtcgtcgtctctagctagctgctaagagagagagagagagagaggtatacgtaggaccgccggcaactagctaactaac

SEQ ID NO: 349 - DNA, 1196 bp, Zea mays
ggctggacttagctgctgtcagcctcactctgtcgagtggcacagcagtcggagcggggcaggcagtgctgttttcctgtcaggtcggtcagtggagcggcgaagtgactgcggtctcttcggctctgtcgactgaggagcgcgcatcaggataaggtgtcagtcgatccttgcattaaatgcccctacgatacggtcggtcggcgtggcgatctggccaaggttgcttctccgcgaagcctgggcctcgggcgagccgaaggtgtgttcgttgctggaggaggtcctcgggcgagacgtaaatcctccggggtcggctgcccttgcccgaggctgggctcgggcgaggcgcgatcgcgtccctcgaatggaccgatccttgacttaatcgcacccatcaggcttttgcagctttgtgctgatgggggttaccagctgagatttaggagtcttgagagtacccctaattatgatccccgataagactagacttctagagaggtttgtttctagtatttggtaacatgtcacatgcctacgatcaggcaaactgccaaatgtcagacatctagcacgtgtttggttggtgcagacaacttttaatctagacaacaatctaagctctgagccaggcaaattttcagactgcaaacaagcatgccctactctcggagcgacccatgggatgggacagcgacccggcactcccatgctactctactctggctgccgctggaccccgcgcctcagaaaatgttaccacgtctaccacgtgctgggcccctcttcctcatccgtccaaggaaaggggcccgtttcctcgcctagtgagcctacctttcctattaataaatccgtatttgggcaccaacactgttcaggtttggcccattccacgacccataggccgaaaatccaaaagggcgctgaaagggaggcgtcggcggcacgaggcgatcctgatccaacacacatctcgaggcgggtcccggagatcgtccagcgtccacccgctcccgcaccgcaccccatcgcttcgtcgctacgcagttcggtccacctatccctccctccctcatcgcgttttattattcccgtcgttcttcattcggcccttcgccgctgctatatttcgcggccgccttgcctcctaataatagccgccgcgggcagtggataccgacaccgccaccgcc

SEQ ID NO: 350 - DNA, 1500 bp, Zea mays
tcaagtgctacactctaattagccatgagcattccactagagttagtcttcacgctcccacaaggacacgaagcttgatcagatccgagaaaaatcaccaatagacattcaatgatctctcaaactctaagtcggctaagtgacgataatcaccaagagtaacaaaaactaaactagccacgagtatacaaacgcattaaaggctctccatctcactgaaatgtggaatgaatggatgcaagtaagtgaaatgtgtttctcagctcttaaaagatgggtacaaaggctagaagttccaaaagagtgctcaagaccgaccacaagggttatttaaaatcccataagaaagtgaattgttaccctttgtagtagcacaatgcggtctcaccagacatctccacgaacaccgagcacctaatcgaacaaccctaacagctaggaactagttgatcctgtcagaggtctgatgcgcacatccratgcacactagatacattcaatgcatgctagctctaagtgtccccaaaaataacatcttcattgaatggtgtgggtgtggcctttgatgccacactagacacatctagagaaggaatctaaacttcacacactcaaatagaccctcatctgacctctccgatcatacatgtctagtgcacatcagagtaagatgcttagctaaaacttaactcaagtttgctcayaagctggtgcatccggtgagcactccggttcttcaccaaacacgtctgatgagtagtaataactccatcgacaacactttctcaactatttgcaaacatagtgatggggacatccaacatgtttaaggtaactcttgttttggtggaacgtgacacaattcgacttcaaattaaaagacccgaaccatgtaagcttagcaccatgactcctctagttatcaattatgtgattaattcgattgacctcactgcttgtgaaatgaaaaacacaagaaagaactctaaaccacgcatcttaatgaaaataacaattgcgagtgtatgattaagataaaaaaagagtttcacaactgaggacgatgactattcgatgatagattgatataaaggaaatactgagccttaagacgacattcaacaacttacccatatggccgtgtaaaatactgtattttcttataggttagtcctagattttgagatggactcaaactttatacaggagaagaaaaattctctaaatgggtttacggatcccaacagataaactatctctagtgtaagatttctatttttatctttctctattttttttgttttttactttgtgacatgaacgtcctctctctctagcgtcgcatgcggccatcaccatgacaccatccgcccagcatccaacggtagtcatcggcgccgcgtctccggaatcttctctcgccttcttcctttcttgtccccccaccccacgagttacaagctccccttcctctccagcgcgctgagcaacgcaagtaag

SEQ ID NO: 351 - DNA, 274 bp, Zea mays
ggtgagagctgagagctccttgcccttccacaagaaaacgaaaaaaaaaaagaaagaagattaaaacgatgtgctaacgccggcggcatagctgttcgcgcagttcccgctggtctcccggagcggcaagatccggcgcctcgtcgcggaggccaaggacgccaagctggcgcggctcagcctgcacggcaccccggggggcgcgccggcgttcgagctcgccgccaagttctgctacggcgtccacgtggacgtcacggtcgccaacgtcgcc

SEQ ID NO: 352 - DNA, 285 bp, Zea mays
gagctcggtgccacttcgacgccgcgtcagctcgtggacgacagcgcggcaggtagctcggcgccaagatctatggcgccgagatgtgtaaactcggcgacatagctcatggcgccgagaaatgggtccaaaattgcatttaagttttttaggggtctaattgaaaatttttgacacaaaaaggactcaaaaacaaaaaattcggcctccgcctccgcctgcgccacagctgccgattcgaaagccctcgtcctgacccctcgcaaaaccctagctccaaccacc

SEQ ID NO: 353 - DNA, 499 bp, Zea mays
gtaatgttttttttttctcgaacacgcaggagagttgcgtatcattatattaaaagaagaaataaacaaggtctaaaatagaccggggtacaactgacaccttacggcgacctgaacgaaactaacatagactgactcatctatagaactctaggctacatgagagagggaagcaacaagggaggtcaaccccttggccccggcagtctcccacagacggcgctcatccccaacatggattaggaaattagcaatattaggggaaaggccatcaaagatgcatctgttccggtgattccacaaawtttcaactgactgttttctgaagcattgcaaaattatgttattactatgaagtccagtgaagaaactacttttgtgatgactactcatgtcacttttgaattgttacacgtggttaggggaggaaacctcttggaggttgtagttctgatgggtggtatggtagggtgatgggctttgttgctggcaactcgtg

SEQ ID NO: 354 - DNA, 742 bp, Zea mays
tgttgtaagtattttggtgcactttttgtttgcttgccagttgctttaaattactacctctgttcttgaatatttgtcgcccactagttcatttctgaactaaaccgcgacaaataaaaaagaacggagagagtacatccatattcattcttcttaccatgtgatttttatttctacatatccatcttgggtacaccatcacaatatggaatatgactgaaatccattgtttatgcttaaaaacaagtcatagaaaacatgtttaagttgttggaatctacagtttctccatcaagtgatgataaatcactgctgcatgtgtttcttgtatggctcttgcttctcagttttgtcttctactgtatagatttgaaccagataacgtacattatggtaatttgtaaagttctgttggctctacattgactacttatccctttttactgtcgccatccattcagaaccaaaactactacttctggagcatgtttacgagttggttaaaccagtaccatttttctgcgtgtctcagttgtctcmacatcattatcatgctcttcagggttcgtcgccgcttttctcatttcggggaaagcatgaagaatcgtctgctggactgagagcattggctcttcttggagttggtgcctctggtcttttgagttttgctacaatagcatctgctgatgaagctgagcatggcttggcagccccagattatccctagccacatgctggcatc

SEQ ID NO: 355 - DNA, 566 bp, Zea mays
tctgtcaaatctcataatcgaaatatacgacaatagctagtaaagaacgatttaattagtactttatattattttaaaaaatgaaaactggaaaaggaaaagaattggaggaagaaacggacaggataaccgagtgggagagtgggagttggtcacttggtctagtactctagtacagttgttagaataaaccctccactgtcagagcccaaacctctcacgttaaccaaaaaaaagggaaatttggattcataccattaaaagatcaccactttgaatccataccattactatctcacttacatgtgggtccacatgagtcaatgacatgtgaggtccatggtatatatctaaagtttggatcttttaatggtatagatccaattgttcaaaaaaaaaaaaaaggcagaacctttctggtctggccacccgcattccgtgacagttcctcgtcttcttcctctccgcctgctcgcttccccaacccactcacgcttccgctgtgcctgccagttaccttgcgcctcactggatcgcaccaaccctctcccgctcatcggacggcg

SEQ ID NO: 356 - DNA, 753 bp, Zea mays
ttgatactttgtgtttttctaaggcccaccacattacaccaaaatacataaaaacaaccaattataaaatgtttttatgataattttatttaaaacataaatatccttaccgttttttataaatccatcttgtatttgactaatatagcacaaaatttctaaactttttctaaacaaatcacaccctcttaagataacgaacataaccatgtcaacaacatgtaaaacaccggaatggaggtgaaaccttcattaaatgctagtttggaaatttaaatctcatccgcaattttcggtgattgagtgagaaaatgatctaattttccactcaatttccgagagtctgaaaggagatttatgtttccaaactagttctaaatttgtctaaattctagagaaaatgccctatcatcgctggggcttccgtgattcaaattatgcttcacaacagatattccattagtatatatgaatatgactgtttttacatgtatacaatgcataggtataaatattttgtccaaaaaatgtcaccaactaatcacaggctgacctagtgaaactttgaatattcccttcatctggttggactttggactggcttcatgtacttaaaatccacctaaccctaactcgtatgagcaataataaaaataaaaataaataaaaagtgagagagggaggaaggcgcacacttcctccttccttctttccctcttcgtcttcgcttggccggtgggtggtgcggtgggg

SEQ ID NO: 357 - DNA, 68 bp, Zea mays
tgtgatcaaaacatagaatatacccggtacttttacactaccaccaactcttcaaatttctggctttg

SEQ ID NO: 358 - DNA, 522 bp, Zea mays
caaatcctctccaattccactcaagcctttagtgactagcgagagagatttgccgtgttcttttgagctcttgcgcttggatcgcattctttctctctcttgtgctcttgtgatcaacactcgattgtaaccgaggcaagaggcaccgattgtgtggtgacccttgcggggaagttttgttcccggttgattgagaagaaggaaagctcactcggtccgagggaccgtttgagagagggaagggttgaaagagacccggcctttgtggcctcctcaacggggagtaggtttgcgagaaccgaacctcggtaaaacaaatccgcgtgtcactctccttatttgcttgcgatttgttttgcgccctctctcgcggactcgtttatatttctaacgctaacccggcttgtagttgtgattatttttgtaaatttcagtttcgccctattcaccccccccccctctaggcgactatcaattggtatcaaagcccggtgcttcattagagcctaaccgctcgaagtg

SEQ ID NO: 359 - DNA, 1500 bp, Zea mays
ttcaggttttgttagtttatgtgcatatatattgtttattggtccctggtgggctggtctggttggaccttttagttatcaccatggatggtgattagcgtttatatatgtgtgtattgtatttgttatgtatagatatataatttagaaccactcatattttagaatgcaaggaggagcatactatgtctttctcgttgttattaattagtttcatgataaggaaaacatcttttcccactgaaaactaataaggcagctagatctgagatttgaggatcttgaatataagcgtgtaaagtgtggaggaatgtagctagtttctaaagaggaatggcatgtgttggaagctaaagatcgactgactggaacttagcgctctaccgtccaatgtgatgttagacaccgaaaaaagcgtctcaattatttcctgacccactgtgtagctaagctagtagatgggatgatcgccgtgttccttatyaccgctcaacccgtcaacgctgccagcgtttttggaatgaatgaacgatcgcagatgatactagatactgattcccccaaataacacactagtttgctactatactttaaccgattccacctgacctagtacctagcttggcgactgtgtgaaggggcagtggaagaggaactgtccccgatcgatcctgggcaaggagggacggtgatagcggtgggacgggcaggctcaagccccacaagtcccgagcccatagcgtccgctaaagtccctcttaaaattgcatactatattttttcatcatgtattttatgattttcatgatgtttcaatataagacttttaaattactcactccgatctttcttatttgtcacggttcagttcaaaaatgaactagcgacgacaaatatttaagactggtgctagtattatttatctatcacaagtgtgctttagtgaaattatatcactataacattttagtttaggccttctaaatttttttgggctccgtctatatgggcaacaacctgaagcgacaatacacctagaggtggtaataaactataaattttacaccataaaacttgaagatcgaatcgaatcaagctcttttttcattcatttttgaactacattaattaagtagactatttgtctcggattaaagccaactgttcgaactgctgcagctgcaattcgtagaaactaacactgtagaagcaataaaagatgatacaaattaaaaccaagcgaacggactaaagagctcaaataaatagtgaagaaatacttggataataatatattgcaacctctatatgcaccccggagctcgcctataaaaaagcagctcagacatccgccagcaagcaggcaaggcaacatattgtaagcgcgaccacccacgcccaactctcctgctagtataaggtgctcgagctcgagcctccccgtggcagcaactaccagtaccagcagcagctgcccggcgagagaaggaacattcagtc

SEQ ID NO: 360 - DNA, 1198 bp, Zea mays
ggtgtatatatacatttacacatgtcattgtaaaatccaaaatacacaagtatacataaattaacacgcactgcccatataattttcatataacatatatatcccttgcacagactactcatcaaatatatacacatacattgaagaaaaccaataatcaaggtgatggtggtaacaatgataatggtagccatggggatgatggagacracgacgatggtagccacgggaatggtagaggtgaatgtgatgttggagcatatggtgctaggggtaggcatgcctcccaagttatgggacacctcatccacaacgatgtcattcgtttgcagacctattgatgatggcaatcacagacaattatctctagttacaactatccgcctcgacgtgaccaatacctacatacgtatggcaaggattactaggtgaactacaatcaccattcatgagtacttgtttttattcatatatgtataggaaattagtcaagaaatgcggattttgattctttgaatttgaaaacgtaaaccatttaggaaaatgtaaaatccagacaaattttggttaattttctgttttcggaaacgagcgaaaatttggttaaaaaacgggatgagtaaccgtgactctgtttttggttaaaaacaggatgaataaccgtgactctgttgagtagattccaattattttcaaaatgaagcgatacaaacggtcctcagaccgtgtccaacaattcacccctatggtcacctaaaaatactgttttgcactattttatactattttgcactgcagactatctcgttcatagagtgaagtttgaatatatgtatgaggatgtgtaagcttatagagatagccttagaggttgaaatgaaatttctttttaaaaattgatgtgccactaggtttcgatttttgagttttttataaaagtacagtcagaacctgatttggtaataggattacttgaggataaaactcttgcagagttcagattagttttttttctaaaataaagaagttacttcctacagtagacgtgtgggccgagagatgttctaacttgtaacttgtctcggaaacagcggcccagccgcccaaatatcccaaagacggatccgacacacttccgaattccgatccacccacttcatcaccaaggccgtcgtctctccccacgccggccgaacgg

SEQ ID NO: 361 - DNA, 1500 bp, Zea mays
gtagcacttaacccttgcatatgtcaactcgccatcggggttcttaagaccagatcaggttcacaccaaccgagagcacatatacaccaccgtccagcctcttgccacggagggtacacgctactctcgccatctctccactcccgttgcgtgttatcttcttctggtattagtctgcccgaggcaaagcttacccatgatgagtcatgtgaccagttaaaatgtcctcgatcagcaagcctacattcagtataatccttaatcaacctgggtagaacatcacctgttcctagcccaagtcccgatttaagtactttcatccttaggattatttgtattccttaggatgaaaagagcattatagggaaatttgtagtaagatcccaccattgctcccaatgaaaatattcttgcaggcagaagccctccttcctcaggataacctctgagctaggcattaacgcaaaggacagcctctatccgcaagatttacctctagggaaggctaagcaattttgtaaatcatatttgatacttcaccagaagtatctatagcaggattggatttcaaggtagccaatgcatcaaagggtttccaagcaactcctataaacctaatgcacattacgctagacttaaagtgtgtaaaaatcatttaaaaacacaaggaaagggttgcatgcaccggggcttgcctggaataaacactacgttagtgtttgttaggtggcgaccacttgacgatcatccttgtcctagcacttgatcaggtaggttctgttgggggccttcggcttccgaaggtcctcaaaaacatgatttaacaatgtttctggagtataatgtgtgaacaggtaacttcggattcgaatcggtaccgcagtgggagaagcccaaagaatacgaaggttgacacagcgccgaagctgtaagcaggaaagcttcggcgtgatagcagaaaaggaaaccgacttaaagatgaaaaggctattcagacctcgatagattactatagaattactaccaaatgtaaagggcatagatgtaattttacatgggatgcgtcccgtgcctataaataggtgaacagtactcccgtactgttcacgcttgacttggcatttacttttgcgtcacgcttgtactttctttcgagccgaaggtacgcttgtattttgatatcatctctatttttctataatgaaaatatagaaataagttgataattatacataattatttatgttatcccttgtattacatatgattccttcttcatcatgatatgttgtgtttatgaaggtttgtccttcataaccttcgtccgaaaatcattatatctcaagggaaataatgcttcgaaggacgaaggactttaacgtttgacattttttgtgttgccttgttcttaactcatagcattttagaacaagtccccaacattggcgcccacctccggtgaactcattcgaccaccttcggcaagctgtgaccttcgtc

SEQ ID NO: 362 - DNA, 1500 bp, Zea mays
cttgccaacgactgatatgggttagtcacttcaattctacattagtgactgtagccaaatacgtacttgtaggctacttaattaataacctttcaattatcttgccaacgactgaaaccagccctgcagtgtcatgctggtcccctgcaaatgttacaatgggatcgaccgtgtttagagatggccaaacgggccacctggctcggcacgggtccggtgaagcccggtccgttttgggttgggtctgacccgtcaaacacgttagaaaaccggaccgggccatctaagcctgcgggcttgtttccctgtccgagcccgctcacagcgggcctaaacgacccggtaagcacggaaaaagcggaccaaaaaagtgggctaaacggaccggtaagcacggtttagtgcaaaaaacgggtttgacgggtttagaggtaaacgggtcgtgccgggctagcccaccgtgcataatttcttgtccaggcccggcccgcttattcgtgccggcccggacccgtataaaagcgggtcagaccgggccaaaaaaagtgcttcgggctagaggctttcgtgctacgtgctttctgtacatctataaccgtgttaggatgtgttgtgataaagttgaaaccgaacgggtgggggtgtgatgctgagctcatagaggatcttgagttgtgaggcctcaaacccatgtttactgaactaaggacggtgccagaatagttctactataaaaggaaccgagctagtataaagtgagatgactcatgcatatttagaacttgttcggttgcgtgtagatcaaagaattatcctctttaatccctttaatctagatgcaaccgaacaagatgagaggtatgcatgtttcctgtctcatcccaaacacattgggttgaatcctgaatgaaccgcatgattgcagctctcccggcagctcgccgcagcatcatcaggaaagcggccgttaggagaaacgcagacgcctacgctacgacgagcatgattcacatgatcacaccttaacttctcaagggcaaaaggcctatatgagcatgatgctccctgtcccccttttctatacatttccttatagctcatggctttgcagtccgcgccgccatcatcagacctccgttccatctgtgactgtgatccatggccgtggctaggctagccgtagcatttttgccagcgagagccttttgaattgagctatagctgcggcccatgggcgtgggcatcagatttgggactggctttctgcacgcactcccacaccacacacacaccggccactgtctaaaaggcactagtgctacaaataagctgcactgtcctctgccctgacgcccacgtaaacatatttggcgtgcatcccttcgcagtgtttgcttgctgtgctgacttcattggagagagagacagtgaagagtagaggagagagagagagagagagagagagagagagagagagagagagagagagagagagagaaa

SEQ ID NO: 363 - DNA, 165 bp, Zea mays
  unsure (1)..(165): unsure at all n locations
cagggcagctagggagctcactgatcttcctactgttaattcctccgatcttctcagcgcggtgttctagagtgtcgtcgtgagctcactctcacaataaggagaagatctggtgctgagaaaggggggcaacgagaggagagaagaaagataatncggctcggc

SEQ ID NO: 364 - DNA, 594 bp, Zea mays
gcctttagagactataaaaatagatatmcagataaatatagagaacattgtkggagacygtcttagtgctcatacatagcatgctatatagctacttgtcagttcccacgggtcgtgttgagtgtttatttagctagccgtactggaatacactacattagattaaaataaagaagaaaaaagtggtaagataatttctattttgtttatgaaatcgcactcgaaatcgaatcacacagctagggcatacgtgtacatacgaaacaagctaacaaaagctagcgggcggccaccgccgggccttttacacgtacgcgcctcgttcgctgcaaacgcgcgccacggggcytcacatggactgcgctccggctgctgcttcgctttttcttctggctgtccgttcactcgcgtcacgccatcacgtctcgtatcgcatcttgcgcactggccggcgcgcgggcggcgccgctcagctctttcctataaatagggcacaggccacagggaagaagggcaccagccggtgttggtttcagcttgtattcccactctgtcgcacagcgtcgcccgtcgccgctgagatcctaggaagaa

SEQ ID NO: 365 - DNA, 122 bp, Zea mays
gtctttagcgtgtaaattttctccacagggaagtgtttgtcggggacgttgtcttgttaaaagacccagagaaatctggcaattttgttattcgacgactggctgccctggaaggctatgag

SEQ ID NO: 366 - DNA, 1121 bp, Zea mays
atgtatgtatgaaagatataacttcataaacaacattaaaaggaaagaagatgacagtggctcataaagatatcctatgattagtggatcaagtatccattcatccaccaatagagattcaacactgtaaataaaaaagatgaagawtcattatagtacttgccaagcaaggtgacagcatgatatctattttttttatcataactaattcctctacatgttaaggctgggcgcagtggggagctggaaatgctcccctaaacttttacagttcactcaagtgccgcagtagggagctggaaacctcaccttacactctctctccacgctggaaacctcaaatacagtgcatgcgctaaacctgctaacctgctgccggtgcatgtgagtacgtgacggctgccgctagtggtatatgtgtgggaaaaaatgataaaaaagtgtgggaaaaaataatagaatatgtgatagttggtatagggtagatatttagggtgaatatgaacgcagagtattataggatagagtagagaatcttgctgactgtgatgaaatattccttttagagtagaaatttagggttccatgagtgcggatagcctaaggaagcatatgaactgcattcattcataaataatacccaaaaacacgtatgtcttrtaagttatatgcaattgcgtctaaaaattttatcagacgtacaacatgacatttttaggagacaaaattataataaccaatcttcaaaataaaataaataagtagtaatgataaagtgataaacaatattagttctttaatccgcgaaaattaaaattgtacatgtaaaaaaacgaaataaaaagggcgcttgtattaccattgaggtgatcactatttttggtaaatgcacacacaaataaattctatcatgatgcacatattatttatatgtttttggctacctgctaacttaaataaagttgtttacatgtgatattaaatagaggcaaccatataagtgattcaactccatcttcattgtttacatttttgggcattacagtttggctccagcatccgggcgccttcatcctccaccatatcccccgaacgccttcttcctccaccatcgtaccagt

SEQ ID NO: 367 - DNA, 1363 bp, Zea mays
ggtaagggtcttattgttgatatggacaaaatcttctctggtattttccctgttattggattaacttttatgaaatcgtaactttttaaagattcagaacttccaaatattaatttttctttgtgtgtttacatggcaagatagcaagagtttattcatgtaattgaagtcgttaacttgcaaagtgatgtttgttttttcagaggatcttactttactgattgtgccaatatactgctctaaatgttggcgtagcattgcaagatactgccttgtcactaatacttgctaccaactttctaattttgtgggaatgacctagtcgtaagtaaacaaaaagactatcaatcttattctagtcttccattttctatttgtctccaagttattgtagtgtttataagatttttcattattttcttcagatttagacaataaataaataaataaacaaacaaacaaattacatgctgcctgtggattttaatgacttggagacaaattacatatgctttaggtgttgtagtgcacgtattgattgctttgctacttactgcagcagtcagcggtttttattttacttaaccatcacagtttactcgttgtattactttaacaatggcatatgtaaatgtgaaactgatcaagccatggcaggtggcggcagatctccaaggataaaatatttgaagaaataataaaactggaacagtcagaggtttcagctagtattattccttgttctggttgggctcttggaaatatagtgaacttagctaccaatcatgatgacttatccaattcagggtgtttcattcaagagttagatttctgcttatatgttgatgttattaattgtatttctgaaaacttactggaaagttttgagaaaagcaagggaacgtctcaaaatgttggtaatatcactttccatgccgacacatctgttgcagaggaagaggataccaatgacgactgcagaatgagaacattatttatggaccttctgaagccaatttaccagcaatggcaccttagaaaacttttgatgttggcaaaagaggattttccatgccgcagggcaactgattatgatccaaacttgaagaatattcactttcgaatcctaaagttgtcagatgttatatgcttctactatcacatgcttagaattttctcatcacttaacccttctatcggtgcaatgcctattctcaacatgcttgcattctcacctggatttctagttgatttatgggaggcactagaaatgcccatttttggtccacctatccagaattcacaagaaacaggacacgagaaacagttggctacaagtagttcaggtgtgcaagtatcctcc

SEQ ID NO: 368 - DNA, 1389 bp, Zea mays
tctccggttatccgaccccctcgtagcctacgtatgtataggccagtcagctctgctctggtttcctagctacacgtcgatcgagagcgggtgctcacccgggacgacgagctagctcaatctgaccggaccggtgccgttccatccacttataggcgaggccatgcatgcttgcgttgcgtcgcgtccgcagctagctcgcgcaacagtaaacctccgatcgatcgggcgccgcagaacgcggcgacagaaggccatgcgcccatggccctctgatcacgatgtggcagccggccggcatgcaggctccatctggccggggtggtaatcgtcgtctcgaccgcgcgtggtcacgtgccgcccctgcgccttgcctggccgttggaaccgaaggattcctctgtagcctgcctgcctgttccccccgatcggtcgccgttcggggagggaccggcgtacgtggcggaggcggagcgctcgcgctggcggatcggtcttcgtcggcgactagttttttttgggggcgccaagtgcggtgcttattaattgcccgtgtcggctctgtattcgtgccagagtgatcgggcgttttcttttctgacaggatacttcatctggaattttctttccactcagggtgctcgatccggctggggctcacatgacggtgggcttggaatcgatttgcggtagtggcagctgtcacaatatcgtctcctctgccttccgggagttgcgatacgattctcctgtgcaggaaactgcacgtagtttattcacaaagtattcttacggtcggtactgacgagcgtgcagaaccaagcctggagtagcagcagcagtgcaggtgcagcacaaagagagcacaggctttccactggatgatctgggcctctgatggcccgttacaggtaggcccggtcctttactgggctcgcaacctacaaaaccagatttgtaggttctgctttcttgccggccgctccggagcccattacatattcacttaggttatgcgtttatgttacattggattgtggaaacacgtacgcaagtttgcccatgcgtgagtgcgtgacgatgctttgaactggtgggcaacaatatacggcgcccggtgccagcttcggcatgcagcaatcatcatcttcctatcctagacgccaaaaacgactagaaagggcacacgatagtacctacgtgttggtcgacagcgccacagcggtgacaaagctgggactgggaggagcgccacatgcatgcatcgagaagacgatggggccatatgagtagagcgcccatgaatttatgaatataaacgcatgtgccgtctccaaccacctgatctcagtcctgaaacacagatcatcatcattcatggtcatggct

SEQ ID NO: 369 - DNA, 1500 bp, Zea mays
aatgggggggggaattatttcgtgaaagacaagttagagagtttcacaagcttaatggactatgtcggtaccatggatcaggggtaccccttactacagtatgaagacactgtgcatgtgcagctatctctggccgcgtggtgaacaacacctaactctaccacatgagcggtcccaaggacgccacatgaccagaagaggtgatatactctaggatgccatcagtgggtccggacctccacgagagagcaccggacccctgtacactcaacccggacctccgagtacggttcaggactcccaagtaagcaaggcggaccccttgagtggggtccgaacccccctgagtgaggtccggaccacctacagcgatgtcccggaacaggggataccctggcatatctcaaggacaggcaagggtccggtactgatgcgtgtccgggcttcaacctgtgcgctcccgctccctactcaggcggaggcccgatgctgccacgtggcctatcgcccgtgacgtaagccagcgggcggagcctgacgtaaggcctctgggccgcgctgcctctgcatttattgcagagaagatgtgccgcctgtctatcacgttgacagacgaatgtgccccctcaacatttaatgtgccctgtccacaccgctggcaggcggcgtccaggccatcctgcaggcggcgtgcctgtccagtccattgtcaaacagtacgcccgtgctgcgaggtgcactgtgttcatcatcacttatgcgttgccagggaagcttcccctgcatgccaatactacgcagatcacgggtgtcagggcgcaagaagattgctccaccaactccaagtattacatccgttatgttcctaggcacacatgttggggctcagtacccttgtacgcacccccttagctataaaaggggaggcatgcaacgttacaacagaaggcaaaaaagatggactcagacttaggctgattcaagcacacttagacgctcacaagttcatgcaaggtcaatacatcacacagtggagtagggtgttacgctccggcggcccgaaccactctaaatccttgtgtgttcttgtgttctccccattttccaactaacaagcaaaacacttaggtccttcctcatcttaggatttagggtgggtgcattccgccacccggctaaagaatttcctctccgacatttggtgcgccaggtagggggctaggccttaggtttttgcttgttttctcgctcagcatgatggtgcaaattgctgagcaccacgccgagactttggtggatttcctggtggaggaggaaggtgcctcttccacgccacaggttcccaaccgcctagtgtcgggcgctgctgctgtgcacgctgcacggcagcatacaactgcgtagacatcccggactccgtcaagaacggctctaggagcattgtcagcagccagggagttgctgtgtcaccctccaagctccacggcctcaccgggggcc

SEQ ID NO: 370 - DNA, 179 bp, Zea mays
tgcagtgtaactatgcatatctgttaaatatgtgtatgtatttgtcatgtccactttgttctagcacctttatcatcaactcggcattgttgcactacatcactggcagttgtgattctgtttccacattggtactattctcctaactttatggttgcattgtgatcagatgcaacaat

SEQ ID NO: 371 - DNA, 1500 bp, Zea mays
aatcacatatcatgatagtttagatcatgatgaatatattaattttatttttatgttataatatcttataaacatttaatataattggtcaaagttgatagcgattgatctagaacaaactcaaaaagataaactcatgcgaagtatattttttgatgatgcgattttattgaattttctaggatggagcatagggtgaggagccgactaaaaaaatttctatgctaatccttataaaaaagtacaacagagaaatgtttactcctaacttttagtgtaagtgtagaaacggttctcttctactcatacacgaatccattgacattttaggccttctttagaacacaagaaggaatcaacagggaatttttttcgtgtttcaaaggagaccttaaccgttcgactgatgggagtgattctcttggaaagagttattaacatacttgtgcatgctattttgttccaaaaaaaaaaaacgattgcaaatacatttgttaacaagttcgtttaaatatataaacaaaagcattaatatttttacactacataagcatattataaaaatataatttaaaacaaatttaataatgctttttaaaaagtataactgtttacgtttttacttataattaattaaattttgagatactttaatttgtgcttgcattgttctaatgagactacgagagcgttgtgtgtcctgtgtcgttgccactgccacactggcctactattctatagcctctgtccacgtccccggccacgtctctgtcgttttctctccagaagcgtctcgtcgccgctccctcgctacacccccgacccctcacagaaacaaacaagcccagtccagggcaaaaactaaacaagaggggtggtgaagaaaagggaaacggaaccatctcgtggcagagcgccgatctggacggcggaagcaaaagcaaatgtgatggttatccgcactaatgggagccacgttagagcggggtccattggtcggtctcgaccagtagtgcccgtgccctccacctgctgcgccttttcttccatccccacgcgaacgtgggcattcttggcatgccggtgctgcaagataccacgtatctggacccagaagtcagcgaggcacaccctagcgttccttctagacgtcacgccacgccagggaacgaaacgactccttggctagatccgctgactgcctctgccggaacccacgcacccgcgtgctgacgcgcggggtcacacaaacacaacagcgtcacacgcacacacgtacgcgatggtcgcccccaccccgcctgctacgcgtccacagacagggcgccacggcgagcggttgcacgccgcgtgccttgtataaagtcgggggccgccttccgctgtgttctcgcatctctcgccacttcgcaattcgccagtcgccaccggcaccaccacacccaccctcgcggccgcgaacaaacgacccactgaccactggcgggctgcacggcagcc

SEQ ID NO: 372 - DNA, 827 bp, Zea mays
gggaggtataagaattaaggccatggaattgtgtgtcttgtgcaaactcatgcatatgagtgcattatatgtttttcgttatgattctctttgctgcagtgtcttgcttctctgaatttctagcttggttaaaagaatcacctcgttgtgtccatttctggcttggttaaaaaaatcttctcgttgtgttccgtcctctcacgagttatgtcctgcgcaccactctctggctgggccattgcagagtggatggtgacggcccgcaagtgatgggggaccagggttcggagattttttagctgggaccatgttttggtctcttcttagccattagtgggttgtgtgcgtcttgagtgccgacccaagcattatatcgggagggtggtctttctctccccgaccgagttttttttagtatggacagtaatttcgggcaccacacagtcagccccttttgcctaaactgatgcaaaaggggggaaacataaatggagttgacgaccaggtaatattttttgtaaggtcaagattttgacatctaacaacggtttgctcatagtgagaggtggggtgaagtctctaagagcattgtgcattcttcttgaaattatggccctacagtaatgaatcatctgaaagctgcaatgtggaagatgatgataagattttaagaacactagttctgcacatctaatcttgctgatttcgcacatctaatgttgccactccatctgccattgataagaggtactttgtagggttggccatctggaactttgggcacaatatattagtatcctgaatgagttttgcagcctcgcgttcca

SEQ ID NO: 373 - DNA, 1500 bp, Zea mays
tcgccgcccccagcttatttctttctctctctcgtggcgacgccggggcggccgtcgctgccgcctacggtgcccaggtcttcctgcccccccttcgccggcgccgagcacgagaaggtacgccctccccttagtctccccttcatgctgtgcgagacgctgcacccaaaccctaacttactatttgtctatatgtattcggatctgatctaattacaagtgcatatgcatgtatcacggctattaacttcgactactttgcaaaaaaaaaatatatttagtgtgtacatatgtacacccatgttatttactgggtccgcccctgcttttcgctgggaagatgctctgggatcacgttgaaatatcatgcgaaatggagtttggttggcagcacaaaccacaaagtggcagatctttgtgtcattggttgatgtgtgatgttcgtggtatgattggtaccattctagtcagacccataggcgaacagtttagatccggtggctgcatatatcatggggaataagaattatctctcaatggaattggaattgcatagtgttatcctgatgacggaattgatcgtagtcttgaacctctattatcaacttgtgaagcaaaggctatcgctgcagtcttttttcattgggagaaaacttcattaggactttcctacttctatgtagatatagggaatgcatcgctaacttggagttggagtagaatkgaacggtgaattaaaactgcacgagagatggacactagcatacatgatggaagctaaaatagcaagtatttgctttcaaaaaatgctgatttgtccttgatgtagtccactgatctaaaattggagataaggttggatgggtttaatatctaacatcgaatgattgatagtgcattgtaaatggtaaggagggatagcgaagcatattggttgcataccatgctttgagtgtcgtgttttccttttttttatttagaacttgtgaatttgatatgtttgttcacctttcaccatttccacctctaaggtgaattgatttcgatacataattatttaatctcttatcagagtagcctagtactgttttcctctatgaatgggtctctcttcctgttgtgattcatagagccttgcatctgtagtactcaatatccatttctggaaggacacaagtataaaagtccttattacttcattaaagtgggagcataatggttttgatgttagttagattagaacatactggtgcccatttgattctgtatatgtgctgtacatttacttccagtcatttatgaatgaattcgcatagcagtacctaaaccattccattatgatgttaattgctcaactggaaacatttatgttggatactaaaggtcatatttttatttcagtacaattttgtatcggcaagccctgtcttgctatttttgttgcatagtgattactgacaaaacctttaccttgcacagaattgtagttgcatcctaagc

SEQ ID NO: 374 - DNA, 890 bp, Zea mays
ggttttcagattgacatgttccagattgacgtgaatgtaatgttttcatctgtcataactcataaccactcagtttcgttgttaattttgtgccataactcaaacactcggtcccgtttttagttttgggtctgttaggttggcttttaatttttacgcgactataatcatgtcaaaccaaaatagaccgtggcttggtgtgcacgtgatgggctgatggcgttggcgtgccgggccgtgccgcgctccacccaacataatcacacgatccgcacccaagaccaaacacatcatcatgctagttcctcacctgcaactgcaagtctgtcaccccgctcacgggaccagatcgcagtgttgtatacgctatatatttcgcggcatagttgcgtagctacagtatttcatcaattatatttatagcgcgtgcaaatcgttatgatactagtattgaccatagcaagaaatcgtgtgttatataaaggaaaaaatataatagtggaattagaatgaataaaatatgtattaatagttgatatagaaggaatatatatatagcggtagtgtggaaaattataatataaagtaaggaatcttgacgactaaaggattatagatcaaagatatggcactgaggatagcctcacgggcggcggctcgcgtgtcccgccagctagccgcacactttcctctctttcagtttcgcttcgcagacttcgcttgcgcttcacccaaccttaaccgcaacggttcccgtgcggagtttttattatgaatgaatgaatacgaattcagagcacgagcgccgttgattggccgctactagtactaccagctaggccactgctcctctgctacccgctaacctcgcgccggagtcgtcgcccacg

SEQ ID NO: 375 - DNA, 1500 bp, Zea mays
aacaacaacgatccatagggatgtctgatcgttgtccggttccgtccggccgaccacacgctagctattcagtcttcgtcgaccccccacgaatccacgataggtagggtcgagtccagagatggcggcggtcgttcgtcgacccagcaggtcggtcggtcggtcggtgtacgtctttggacccatcggcgttggctggagaacagtcggccgcggccgccccatgctgaagacgtgtcatccacagccctcctgcttgttgctcagcagttgctgtctagcctgcagtatgcatgtactgtttcacatgcatactacttctcttcttcttgatcgatgatgagcgagcggtggattgatggttccattccaatcccatgtgtgcagtaacaatacttggacgacgactgatatatggagctggacatctggaattcgatctttggacgccaacgagctgccctcgctctctagctcgtcacgatgaagaatgccagttttgtacagctgaaacacatgaagcaaggcaggcaaagattcatatccttcgtataggataggaggagggatgatggacggtgtgtggctgccgagttactagacaatatatatataggtgggtgattccatacaacaaggatcagatacgggcctgtttagtagcaaagtttatttacagttctaatacaatctctatttttaaggcgaaattctaggtacactgtaaggcgcagccgggcggatccgcacgatccgacctcgggagtgcgcagatttgcttgacgcgcaccgccgcgccgacagtgacgacactttggcacgcctagctctacattaacttggctcaatttggtggtgtgctactgtcggtgtgtgacataagttagataaatgacataagttagtctaatacgacataagatagtccatcacatgtgatatatagtctattaacaaactatggagtattagagttacacatgtgatgtatagtatgttatattagtataaatttggacagtattttaataatttagacctgtaaacccaaatgatgagcgaccgttaatcctcgtcctgactcagcgagcgaaaaagaaaaacgcaactgagatgccggtgggcgcaaacgcgtatgtagctttcaggtggtggcggtgccgcggtgggcctgtgagctggcagccgccgccgcccctcaagcagcgaagccaacggaggccacaggccaggcgcggcgagctcggagagtcgcgcgcacacatgtacagtgggactgtgggagtccgtccgagtatttaaacccaagcatccaagccccgactcccgcacaccacaacgcccgcctccaaccgcgctttaatgcgcgcgtttcctcttccgcgataaacccggcggctgcctgatcagccatcactccgttacccctctcttctcacaaaaaggcatctgcttgcttgctccgactagccggggagctagcgcgcgggcgatcgagca

SEQ ID NO: 376 - DNA, 477 bp, Zea mays
gagtacaatcttctccgggaggcttcgtcgacctctttgtttgctctcgcgatgcttcgatttcacttcgcctgtctcactccgggaacgctgggccagaggagaaacaacatccgtccagcttcacttgtgcatcatgaacaaggaacattagcagccytgcccgtaattacctgccactcgccacagcatcagcagtgacgtcggtggtgactcctcactcactcgccgctcgatcgcctcccagcactagcttgctcatgttcgtgtctctatataaccccacgtatccggccggacctatcacctctcgtgcgaagaagaaagtgttctcttgcttgatccgccattcagaagccggccactaatccgagctaggcacgctcccatccgacgtcgtcccagctagcacagccatttctgtttcgtttcttccactgcagtcagaacccagaagcagaggccgccgttgcaagc

SEQ ID NO: 377 - DNA, 479 bp, Zea mays
ggtgggtttttatggtaccaaactgtcccttagagtaacaaaatggtacagtttttttagagcaacagaatggcacagtttggcgtaccgtgcatgtgggctgggagaaccagatttggcccaataagtctccaacaccagttgtcacgattccatggtcatcgtttttacagaaacgtccctaaacttatgtctaattaaaacccacggtccaacttatctgtttccaccgtcccgctgaacccgcacccaacagaaacgcgcagctttcctaacgcgcgcagagccgccttctcaacctcctcccggacggcacgctctccgcagcttcctcgccatctcatccacccataccgcgtgcagcttcttcaacctctccctccctccgatatctcgtctcccatcctacggcggagccctcggggacaaccacgagtgcctaagatcccgtcctctgcgttgaccatcgagggatcgcc

SEQ ID NO: 378 - DNA, 536 bp, Zea mays
ccccctaagtaaatgccttaaaccattggccacaaagaatacactatcccgttcttgaatatttgtcgtaccgctagttcatttttgaattataacacgactaacaaaaaagaccggagtgagtactattggactgagtactactgactttcagtgaaatctagagaccatcattgagtctctaagaaaaacatgacaaataaaaaatatataagaaaagcatgaagaattatgtaactgaagaataattcaacaggacatccacatatatagtttcagatcgccaatcaagatgcatggtctataactataatcatgcactctactgtaagtgctaacgtggtctcccgaataagttgtcacccacacagggcacagcttggagttttcctgattgcattaccctgtccaaactgttcttgccaggaacattattcctcctcgtgttccatcttctaaacaaactgcatcctgccatgattcgatgatcgacctcatgtcgctagcactgccctggccagcagaccggcacggcg

SEQ ID NO: 379 - DNA, 117 bp, Zea mays
ccttacagcaaacacatagcgttcagctcacacttcacagtcagttcaggctcatcttttcagcgagttagcagcagcagcttgaggcccagccgcggctgcctgcgcgcaagcata

SEQ ID NO: 380 - DNA, 529 bp, Zea mays
cccctgttttgaatgagcatggactagcgcttccgtggctgcaacaccggccatttacagtacccccaaccatacttcacgcttttgctgggagcgaaaacaacgatgtacggagagctgggaaaaccggacgcagaccacaatctagccagcagacgacgggacgcaaatgatccggccaccttgctctcagtctctcgtccatccactagatccacaaatgccggctcatcccgtgtgtcacttggtattggagctagtgagaaatcgagcccaattctgtagtttcttaactaaaaaaaagctaatccaacgtgtgtcatcatttctatgtaagggtccagtcatagggcgcgtttgttaattgtcgcaggatttggccgcgcgtgccgacgatttggctaacatcagtcaaatgggcaatcagtgtgggggcaagataaatccaagaaccatcaaatggcttcaggtcaggtggcaggttcacaaagacagggtcaggactcaggaggactccaagaaccaccga

SEQ ID NO: 381 - DNA, 1500 bp, Zea mays
cacacatcgtgcgaggaaaagtctgcctgcatttgcgccggcgactggacaacgattgccttgccgacggggtacagtttcggcaagttctttatgggaatgtaaatatatctccgtcgcctcgtctcgattccttgggctgttatctcggtactacttgagtgcagatactgagactctgagagacagagactcctgcccattcattcaaaaaagaaaaaactagttaagcatgcaatcactgtgagacaacacactttatacagtgttttgtctctataaattacagttatagcagtctgaacaactgactttaatccgaaacgaacaaacatcatgtatatattgttcaccattaactaatgctaggagtaatttggtgcttaccatatgattaacacaatcattagctcaaagtcttcaggcttccgggcagatgaaatgaacccgaggagcgccccagaacattcaaaaaaccactctggtcatttttccattcgtcctctccatcgacgttgttgcccctgcaagccagtggaaaacaaccctttgcagaccatttaggatgtgttttattgcgggacagcttagaacagacagtaggacagaaacattttctgacgtcctttctcgtctctctattttcgagagacaactagggacattagtcctgttccaaccattgactctgaatcaaacaaacttatttaagagatcgttytatctcattccgttccgtcgttacaaacaaacacactcttaagtcttctttggaagtaaaggggaaygagagtattagagaggctaaactttctttgccatttaactttaaaaaacaaggagattttagcctctctagtatctttattttcccttgtttctaaacatgtctttagggcttttttttgctagaattcacccagaaatcgttacagacgatcaaacattatataaacatgagcaagcttaacactctggccgatcgttttcgtcacgttggatgataaacttagttatgttgtgccatctaagaccaattcaattcgctgcaaacgacccgtttttttttttaaattcttggcatgcgatgattcacgcaaaacaatgatataaagggttgaatcagtcttaagctttcgtgcgtgcaaacgtcagtggccgtcaatctccttcagatgatgcagctaacgtcagtgcttgtctgacggtctgaccgaacattctggctgcaacgtttcgccggccattagatagatcgacagtctgttcgggttctacttgggccaacttttcggcctgtacgggctctgaaacagagaactcaatgggcttcactcgccgggtccggtgaaattatgggtctgaaatatgaagcccacctgtcttccgctcgcggctcgattcgaagtcaacgaacggcgtccaaccaccgcgggtcagcaaaccaaaagcagagcacgcagcccagcttcacgagattccgtgactgcgacggcgagg

SEQ ID NO: 382 - DNA, 95 bp, Zea mays
tgtatgtactctactactttcttgtagttgcaccaattacaatttctgaatattctctactcttgtaggtcactaatgatattgttaatgctcta

SEQ ID NO: 383 - DNA, 1500 bp, Zea mays
tgcaagaaaatgatacaccaagcaggtaggactgcaggaggctcaacaagcgataccatcaaaacactaaaaaatggaaagcggataaaaagttgcgcaaatacaagaaagcctctctctctaaaagtgtatatctttagttgaaatactactattcaaatttagcacacgttgtaatacccagcggtttgttctaatcttggacgagccgcgtgcatggaccattttgatggcatatatactgacaccatgtgcatccgcgtttcccctatatccaaatcatttacccattaattcaggaattgaacgtagcaaaagagacaactgacgtgcatagcgccatagcctcgtttcccgccctttacctggcgccatgtcctttcgccgcaacagcttcaacttgggctcgaccgctcgatatagagccgaatcaacccattttgaccctgtgaaaccccaaaccaccatgaattctggtcgatgaccctgaaagggaaacgtcaataatctaaatcagacgacctagctggcgtacatgcgggatcgcatcaccgctgacaacgcaagctactaaaagcctctcgccctatcaagaactctccaacaccgcacgaggagctttgaatcagccaggcgccagcgcaagcaaggagatgtgttgtctgagctcgcgactttatgatagaaaatgacacgacatctagggcaagcgggcgatcagaataccaaaacaccccctaaatatactagtgcctgatctagtttacacgttccaactatcacaccaaccccctaaatgataccactagctagccaagtttagagagcgacggtgatcattttgaaagttcatgaactggaatgacacacaattaaccaagtctaagaatccatagttattagcatttgaaagtttgaggaccacaaggacatgaatggatggttaaatttagggatcgatggtgaattttactcccgtagatatttcgggtcccaaactgcatgccacgtaacatgttgggtggatatgctatgaatatataccacagtctgcatgcgtggatgccactcatggcgcatgaacacggagtagcagaggtcgccttgcacatgcaggaggacggatttaggtaggggtccaactgcacctgggggaaatcttctttcatcctcatagggggatgatgactgttccattctaaagcgatcgggtaatggataggaacccagcttttgatcgttgtgaacaccgtacccaaaaaaaaaatatgggtcattgacaggttcccagcttataaaagacaccctcctcctcccatttggagcacggagctcgagcaactaacaacccaccagccaccacgcacagcagcagctagctagctagcaaccacctcgatcgcacagaggccggaagctcagccgcgaattcggcaagcaacaaggagaagtcttgggttcctcgccacctctcgatcggtcaggcggatccaagaagag

SEQ ID NO: 384 - DNA, 993 bp, Zea mays
gagtagtagagatagagataaagattaacgatggtttccagcgtagcaatattacatatattgttaccacatgagctactctattacaaagtgcacctgttctggactcaggaatttgctatttgctattcttctttctttccagcaaggcctcggttccactaccgctcgactcggcttcatcttcccattgcttggcgcctgttcatctgtagccgcccttttgtcctgacaccttgccttgactcgtatcgattcttctcatctaacttttattttttctcagcgtttccacggtgtttgctcgcacaaaaaccgcgttaccgtcctataagcgacggaaataccgcgttcctttgtgtcgtcgcatcggcgtgctcggtacactactcacgagtcacgactactgtcatagtgtcatcacgcgcctgagattttatgcggtttttgacgaaaacatcctgttagtttggaaacaccatttttttcaaaagatttctgtttctatttttctataaaaataactattttttcttagagaaatgaaaaacaattattgaaaaatagggtttcgccctaagacttgttgtcccgcttaaaacactccctgcagtggtgggccgtgtggcctggtccggctctggcatgtggcgcctttcgacgcgcagtttgcacgacacgcccgcacacctagcagtccagtcgtcgcatcctctccgggctccgggctccggacttccgtttccgctgccttctccggttctcccctcaccccactagcccccctgctccgtttctctccccgcccacagctcgaacgccaccaccttcattgtccgcgcgcccgcggctttcgaaaccctagcaccgatccccgtcgccagtcgatcgcagacgcttggagacgttcggggcccatgacgagcggcctctgagcgcgcgagagactagactgctgggtgtgctctagctagatccgaggggcttccgccg

SEQ ID NO: 385 - DNA, 534 bp, Zea mays
tggacaattttgattttatttctaaatattatctaaatgtgttaatgtcttcaaacgatttattttagtgtttgatggctaaattgacggctggagtaagaactttgccgaacttgggtgacggtgttcgcgcgtcctcagcagcttcttctcctcttccgttccatcttggcttgatgtgcttttcttggtccacggcgacctccgactccgaccgagggcaacaaggcagcaaacctcttcccccttcctcgcatctctctctctcaaccgcctacagccctacagtaccccacccccacgccaccaacccggaccgaacctccctctctatctctctctctgctccacctccgttcgtccgactccgaccgcagcccaactcctgctgacttcaacatccattcccccgccattcgcgccaggattactcctccctagctccctccctacttgttgctgatccctcctccccttcctattcccctcccaccaccaccaccaatctaggcagcctccgccaatcaaacaata

SEQ ID NO: 386 - DNA, 68 bp, Zea mays
ctgcaggacgccatggacgagcacggattggaactccccgccgggtaggccgttataggctgaattcc

SEQ ID NO: 387 - DNA, 243 bp, Zea mays
ctctactctactctcttctctctcagtttgctgctccattaatcatagacaagctacttatacaatatatatatggtacgtccctttctactaccagtaccagctgctatactatactgctcccagttcttcctgccctgctgtgctggttcccaatcctcacactgattgtggccttccagttcttgtggtctctcaaccagcatctgatacccaattcctcgcacaaacctgccacacgca

SEQ ID NO: 388 - DNA, 840 bp, Zea mays
tgaccctattccgacatcattctttgctaaattcgccattgctcgctcatgcctaaaaaaagacagagtaagcacgttggggggtgcttggttcttttagcagcacaggctagcatggtaaggctgcctaatcttgctcagcttggccagcaaatataaccatggacaatttaaatagcacaacgacatgcatgtcgtgactgaaatagtacaggaaggcccacccgtcggccagcctccaatcgcagaacgtggtagctttctccgtccgctcgccttgccagcgcgggagagccgaattggccgcccgtccgcttcaacgacgaggaaaagctagcttgcccagacaagttagcttgctaagcaacgcaaggttctaaacacaactagtaccaaacaccccgtcgctaatgcagtatccaagaagatcattagcttatccaatgctgaaggcaaatgacacgtcagtgcaagctcactcacttgatccagatctttccatgcctatgcctataaccctaaataacggagataagctaaaagatatttatctcctgggcccacctgccatcccgggcccaccgcaccagcaaggcctgcaactttcacacctaacccttccaagttaactgcattcacgacccacccccccttcttctctctcctggccacctccgtccattccacactccctcctccggacgcaccttccccgctatataaggcacgcgccccgagctcaggcgaagagagctgcagagagcgtgacgcgtctcccacacggccgccgccctcgccttcgtgcgttccccgcgtagagtttagggttttgtcgccgcc

SEQ ID NO: 389 - DNA, 998 bp, Zea mays
tacctgtaaagaagcttgccgagcgttggtataccctgacattgtacatggttgcgttgcgtgtagcatgtgttgcgcgccaagaggagattaccattgattaagccgaacgcgaccacgacctccatcggcggccacagcacagcacagctgccccgcacctcgttttatattagcactaagccgaatcacaacagatatttatatagacggttggctagcacgctgcccgcctgcgacgctcgctaaacacgtgaacacggatggacggccccagagatcgcgtgcgccgtcccgcattgcccacctgggcctccttatctttcattggcttgtccgctgcgtgggcccaccgacccatgaagtggagggcctttgctgcttccaaccgctgcacgtgggccactctcctgacggggatggaatcaactcaacggtcagacagagccggccacaagctactataggctatctaccgatgcccacatgctgctgtttctgcacgtgcgtggagtaataaaaacgtgcagcaaattgcgatgctccattcgagccatctcagtaggagtacatatattgacgattaggctaaggaggtatttaagaggtccgtgacatgacatggttgcgctcctagcaagcaccaagcaggtgtgtgcgtcattttcacgtgtaaaaatagcacgcccagcggacaccatggctactcacttctcgctgacaatcgggtccacttttgaaggaggcgggctacgaaccctcctgaattgtaggtcggtgctgtggccccgtggcgaagggatgttgtttcccttcctgtatttgtcctcgcctcgccaaccggacaggaggcgggacaggcgcccagcctctgtcacgggcgttttcgccgcataatcccacgggttccgcgtttcaacccatttccttcgcctttccccttcgccctccattctccgcccaccgtttcctcgggtctgccacgctacgccacgccc

SEQ ID NO: 390 - DNA, 118 bp, Zea mays
gatcgttagcgtcggagtttgtaataattcttaagtcagatgtctcagtcttaggtagtcagtttagtttgcttatcagttgcttccatttagtttagtttgcttatcagttgctttc

SEQ ID NO: 391 - DNA, 1500 bp, Zea mays
ttaaatacttccttgtactactaatatctcttttcaaagttctttttcaattagtattaaaaggaaaagagataacaagctaaagaagtgtaaggaaaatggaccccgggccaattggctaagtaagttttggtgtttgatgattaacacaatctgtggactaacaagttttctagtgtttatgattgtagttcacaggatgcaagaactacttggactaaggaattgaggaaagcaacacctcaaaagaagacattaagaagatcaagaaaagtccaagaaaggaggcgtgtgctgcctgcggactgtctgtgcgtggagcaccggactgtccggtgcccacacaccagactgtccggtgcacctaggaactgcagcccaacggctagttccaggtggcacccggagcctacggcgccaacggtcacctgctctgacaggagtcggacaggcaacggctaggcgcaccggacaggctacagtgcgctgtccggtgcaccaccggactgtccgatgcacaccggactgtccggtgtgccgcagagagcagcagcttttctccaacggctacaattgtgttggggggctataaatacacccccaaccggccattctcaggtgtgggagcccaagcaacataccaaggcatattgtagacatttccaagtgctcaaacacccaagtgcttaatagaatcactcggtgattagcgtaggtgctttgcgaagtgcttaggttagttagaccgctttagcgcttgctctaggtgaaccctagattgttgagtgagtttagataaacctcacaacccctcgactcttgcgtgagccattgtaattgtaccgagtggggcgagagtcttgcgagaccgtgacaaccgcgtttgtgtcacggctgccaccgtgtaccggagggaacgaggcccgcggtgtttcggccggaagctcgatagtggagacggcggggagcgtccgagaggagccggaagcggagcaccacttgcgcgtgaagaaggcccacgactctctacagagtactcaaccgaggtgattggcccacgcgtgggcttccctttgcgtaggggcaccaacgaggattagtcgaaaccttgcgtggtttcggatacctcgataaaaatacaggcgccatccacgagagtttgcttctctaccttgcttttagcttccgcatttatattaagcatttaattttcaatcttgtctttatacctagattgtttaggattgaaacttagccattgcggtagagatagcaacacttagacaaaacctagtttgcacattctagattatttatttgcataggtttttctccagggatttatttgtggcctattttagagaaagttttagaagtcctaattcaccccgcctcttaggcgtcacctgtttccttcaattcgtatcagaacctagtttggctcatttgaaacgctttagcttcacctctaaaagagtcgacactttttagagaaagggg

SEQ ID NO: 392 - DNA, 1025 bp, Zea mays
taacgaaggtttatgatcgccgaaggtgttcaaaaaactcaaagagtggaagtgagttcaccggaggtgggcgccaatgttggagacttgttcttgaatgctatgagtcaggaacaaggcaacatagaaaatgttaatcggtaaagtccttcgtccttcgaagcattattcctcttaggatataatggttttcgaacgaaggttatgaagggcataccttcataaatacattatataatgacgaaggatgaattgtaaagaatataaaagataacatagacaattatatattattatcatgtataaacagaaataacgtcgaattacaaatgtaccttcaacttgaaggagatgaaagtacaagcgtgacgcaaaagtggatgccaaatcagcgtgaacagtacgggggtactgttcacctatttataggcacaggacacagcctatgcaaaattacatttatgccctttacatttgataataattctatagtaatctatcgaggtctgaatagccttttcatctttaagtcggtttcattttttgctaccacgccgaagctttcctgctcacaccttcggcgctgtatcaaccttcgtattattctggtctgctgtgataccgacttgagtccgaagatacctgttcacacattatactccagaaatactgttaaatcctgtttttgaggaccttcgtaagccgaaggcccccaacagtagcccctcgcaatattaatttgttttaaaataataaatttagattgcgacatggacgaaggctttacgccgaaggtccgaaaaaacaccttccctttgctagaatagcaacattcactgacaagcggggtctttcaattttcaacgcactgggcgtataaatacagtcataccgcaaactcatttggcacgttctcttgccatctgctcccgctcactcaatttttagctcttgcacactaaaatttgctgagcttttagttttaaagcttcggctttgaaaacagttttttagcgtttccgaag

SEQ ID NO: 393 - DNA, 91 bp, Zea mays
agatcatttaaatttgaccttgctattgaacatggctgattattttgattaaaagctgacttaatgcccttttggagagttggaactcgca

SEQ ID NO: 394 - DNA, 69 bp, Zea mays
ggtattaattaatagtttgtatcgtgttgtaatttttatttcaaactttgttcgcggtttgtaatagta

SEQ ID NO: 395 - DNA, 835 bp, Zea mays
tgcagtacgtcagaggaacctcctccccatgctgaaagggagcagcggatgacactccgccttcgcgcagtcgacatagcggccggtggcgtcgattttttttctctctctcgaatcgggatgtgcttctgggagacgacgagacgatacggaggcttaataacggatgcaaaacgggtccctatcctacccacatcgttctttgtccctcgaaccaaataaacaaacaatcctatgccctgcaacaaccaatctgcgaactccaagctaaaccaaacacgccctctaaaacacagaggcgtggtggtccacctcccctcacagctagctaagcattaacccaatccaaactctggaggccccgcatgtcagccgtgccatgctcctcgatctatgactcgagttctactgctccaggccaaccagaaagcgggagaaaaagcactgtagatcatcgatgtgacgtcccagtgtccttcgcccccactctctctcgtcacaggaaacacattctctctctagcggccccctctcaaacacaaacagccattctctctccctctcaaaactccaaactagagctagaggcctacgaagtagtaggaagctgctgctctcctccatagcccctaccccctcccctacgctgccactctatcgcccagccatacagcagctaccccgctgcctgtcactgagccagcgcggcgcaagtgcgcaaagccgagcgcgagaacccacgaaaccaacccagagcccccattaaggcaggctcgctgcagcacgtctcgcgctccatcgccgcctgtcctcttcctgtaatgtcactcccccg

SEQ ID NO: 396 - DNA, 48 bp, Zea mays
ttttactcatttttttcctgttgcagcttgcgtaaaatatttaaataa

SEQ ID NO: 397 - DNA, 102 bp, Zea mays
gatgcactaatgcagtttttatcttaaaatctggactaatgtatttctcacattttcacttgtttcaccgaatctcggtcggtcccagactgcaagtgccaa

SEQ ID NO: 398 - DNA, 1500 bp, Zea mays
gctgaggggagcaagagtgctgaaagcctgaaagtggtccaatgtttttagatgttctcgaatgttatctgaaatatgaggtttatctcttgcttgatcaacaatagaagcaaacaatcatccttttgtttatttatgtttcccaatataaaggaaaaaggggaaatattttggtgcagtgtgcccaattcttttgtccctagaaaactgtgtagtcgcctatagcaggcactatagtcagttttagctattttagacaccactactatttgtacacacatttctattagcctattttagcctgctatatccatgtatgggccttatgggaactctgcaattactatggatcctcttatacattatgttcgacatagagacaaggtagtatattgagttggaccaataatccttcatatttatttagcctgctgataccgcggcaatgtatagatgtttgtaccatagaaattatcgtaaagtgcacacagctgtatgtatagatgtttagaagtgaccgaagttaggcttgctcaaccggggcaatgatttacttagcctgctgaaatgtactataggtagcattcaagtttgtgaccatcatgcaagtacatgtgggtttgttgaaattgtgtggtcatcggagatgtagcaaaatgttccctatcgagagctcgtgtactatatttgttttatgaacttaattttgttgatgtaggactattacaaagttctagagacaacttaatttttattacaacataatatgtggtcatacatatgttaatgttgcaatattttttccgttgcaacgcacgggtatttacctagtacttgtcatatgtatttatttttgacagagatgatgtcatgttcatccatccaatgcagtcacccgtgaaatctgctaatgccgctagctgcatccttcacatgtgtttgtcccaactcaggttccctgccccctgacaaattgttctgctgtctccaaagattcagtcttggtccccatgccgtgcagaaggctgcccaaaaatgtttcctgtttcctagttcaaagcttgtccagattgactacaaaatactagttaggtttcgaggtaaagcttggtttgttggctgtggcttgttactgttttattcggagtgcgacttttatagtattttgcctctataaattacagtgtttaaacagcacagctgcagtactgccagccagccgaacaggaaagcggtgcacactgactccgaatcataatagcacggctccaaatgttggtagcaggtgtgcagaaattatccaagtgcaggggcatctcctgtgacaaatcgacactgtattatctaattcaatgcactgtcctttgtatttactagcacccctgcctttccagttcagcctgcctgcccaacagtgtatacggctgctcctcgtagatactagtacttggtgatccgtttcacatcgccatggtctgctcttagctgagctgtccatcc

SEQ ID NO: 399 - DNA, 1118 bp, Zea mays
aaaaccttcctgattttctcaacaaccaagcaaataactgaatcaatctattaaactgagcaactaacttaatcaattctgctaaacggactaaccttcagcggttcagccctatccctacggtttacatcatccaagattctaatcctagccactagttccagcgaccttgtcccacctccacgacggccagcaatgcgcggccgcccttagcccacagcggcgcccaccagcgatttgcgacccgacgctctcgcgctctaaatcttagcccgaaaggtgatacaatgtaaatgtaggaacagagacgaacatgtactcaccgtgaatcctgtggcgccgcgacctgaccacgtaaattagcagatcggcggctgtttctaactccggtctgcaattcgtcgcacaccggctatgctctgggaacgtgcagcacgctacgaagatcgcactcccccgcttttcgtggactaagtgccgatgaacagcgatgccgacgatggcgagttctgcgctgcgatccaatcgttcctgggcagcttatatacccatggagggcagagtccgtgtgggaggcgctagggtcaggccctgcatgaacagagtccgcggtgaactcgtgtggacgaagctatcaatttggtttggtgagccacgtccccggccggatccgcggggggacggcgctttcgtccccagcctcacgagatcgggaagggattcccgcacccacgcttgtgaacctcgccgccgtctcctctgccttcatgaccccgccgccgcccgtcccctgctcttcctcgcgcacccaccgtcgcctgtcccctcctcttccttgcgcacccgccgtcgccgcctcctactcgccctcgcgcatttgaggccagctgcggaacgaggtcggacggcggagacgaggtcgaggtctgcggcctcctcagcttgcgcaaggcggcctcctcggcgactcgtgcacggcggggcagctgcggacgaggtcggactgcagggacaagctcgctgttgcctcctcagctgcttctcgtgagtacttctttttctttcattcttgccttcgcatccaccacccgcgcctcgctgcaggttagtcgtgcgcc

SEQ ID NO: 400 - DNA, 1328 bp, Zea mays
caaatctcagcttcggccctgcctctgctccacgtttcttcctcactttcattgctagcaccacgccaccgaatttctgggctgcctcgttgctggcggggagtttgggagcacacatagggaacggtaggagggttgttttcccccctctaaccagtttgggaaccacatttttctaagtgattttcattttcaaaagagaaattagttcattttcccttgaaaaaaatataaatcccttagaaaaatggtgctcccaaactagcccgaaaatgaggattattgggacaaggttttaaagaggtattggagatgctctaaaatcgtgtaagagacatggcaaacagtgtaaccagaggatagaataatctgtgtgtaacccatatcgacagacaggccgactcgtcaagagaacctcggctcgacttgtgagctgattatggacctaagtgtttaatttcttacctcacattcgaccttttctatctctactatatagtaaatcatcatttttatagttttcatgattctaatttcattgcgtcactttttctactttaataacaaaattaaggtaaaatcgagaagttgaggtttaacttggctttacatccacaccttatatatttttatagtttattaaaataaaatctacttgtataatatataaaatcattagcaatgcacgatcacgtgagtatatccttgtgccttgtttcattttttttcacttgtttttcagcatctaggtacttgtgcaggctgaggtgtcgccgtgtcgcagtcgcagcctcgcaggctcgtagtcgtagctacgtcgccgattcctgatcgatctcgtagtgtgccacgctccttggagataccgtccagttggagctgagtctgttcgctgcgcttggattaaaaatattcggatcattgtaactgtaatctatctataaagacaaaataaagaagaagccgatgaatgaattaaagccacagagcgtcggcggtggagacgaccggctccgccaaacactgctgcaccggtcaaacactgctgctccgccaaatacctttcctgcttgaaattctcgtgaagtcatggcaggtgtgctggcactatatatgcctggttcaacgggtcaatcgtccctttgccatggacaccatcacaccagtgctgcggccaacaaatcgtgtatataaccgtataaaatattatttgataccgtaggcaaaattgtttacagaataaagtttaatctactgggaacaatcctttatcgtgctagctctaaacaactccccttcctcagcagaggcgacggaggacgtacgac

SEQ ID NO: 401 - DNA, 104 bp, Zea mays
gcttaagatttacaaaatccatgggaacagttgcagttcggatttccgtccatttcccaggttctcaccggttcctcaaaccctaaaacctccaaaccccagca

SEQ ID NO: 402 - DNA, 462 bp, Zea mays
acgacgtgcccatcggcccgttcgtgttcacggtcggaggcgccgccggggcggaggcggacggcgtcgctgtcgccgacgacgtcgacgaccaggtggacgcggaggcgggcggccggcagggcagcaagatgcacgtcatgtccgccgtgcacgcggagagcccgctgcggagccggtacgccagcgccgtcaagaggcctgagagcccgccgaccctgatgagcagggcatgagtgcattgcaaattttacaaaaggtgtacatagctagctagctgacagattgttcatggattcttttgttttttttttctgttccttagtgatgctattggttcgttctctcaacaatttcaagggagaggtttttgtttcattttttttcttgtgttattatagtatactgctgaggacacctcaaaagtcgtgaggtgtttgtatactgaaagtttgaggcaac

SEQ ID NO: 403 - DNA, 1500 bp, Zea mays
atttgggatgaagtagaggaatacaataaggtacgacatagacctaacaattatactgaacatcattcatactaactaaggaagtaatggaccctctgatatgttaatgacatttttacgaactttaataaacaatgaccattacccttgcttggctaaggtaacacattttgcctgaccctacgatgaatctttctggtactttagtaaaatgagctgttgttctggacagtggggatcaaaaattaattcgcagaagacttgacagttttaggcactatccaagtgagtccgtagtgtagggattacaaattaatgcaatctgcaggccattaggccgtaatactttgcactaccattccttgaagttaatatggaggatattcagcgggttagtaccatagaaatgtgtaaccctaaaaggcacaccagatccgtggagttctttgaactggggaataatcgggtgttgtcggatgaaatcaattacggttgaaaggattagtcgattggtgtagtaattacttcatcaaagatgtgcgcaagaagaacagaaacaataggagtcgaagggcgtacctgaagatccgaagatttgggcgcacagaagaggaatcgaagcgaagattttcggatccgaggaaggcgtcgatgctcggagcggcaaacgaagcaagcgctcgcgaggaacctcgacggagtcggatttgcggccgcttcgtcttcggtcgcgaccggagctggttgctcagcacctccacttcgtcttccaaagatccgacggggaccggcgcgggcgcaaccttcccgcggaggaatcgccgccgcctcgccggaaatcgcagacgcctccaacgggacagaagacgaccgcgaaggttccggtcggtggcgcgggcggagtcttccgcgtgaagccgtggaggaggagtgcacagtcgcgcgctgcatctggggtgagagagaagagggtcgcggcggagggggcgcgtagcaacgagcgttgcggcttcaaggggtgaacagtatcccctataccgtctacagtgataggggaggggaggggaaggggggagcgctgcagtcagtctaaggggcccttccccgctcccgccgccaatagggggctcccacctcaccccctcctcgcggctccaccgcacggttcaactgagccgaccccacccgtcaggtccgcgtgcccgcctcccgttggtccgccgagcatcacatcacaccgctacatacaaataaataagcgagacaccggcgcccaacgacttcccaaatcccgtgtgctggcgtgctcgagcccacatcccaaccatatacgagacgagccgacgttcccccgggcccccaaggaaaaccatgtgctgtgcccgccaggtgccactaaatcggtagcgcatgctagcactgagacggagctcccagtaacggcaacaacaagcagcagcagccagacagccagtagtaacacagtaaccggcagaggcc

SEQ ID NO: 404 - DNA, 425 bp, Zea mays
atataagacacattttatatataaattattatattattatatgtttccgttgtaacgtacgagcactcacctagtttaatacaagaactctgcatcttgcttgtccacgctatcaaattcaatttgccgcaccacaattttgtcttatcctctgccactgatcacacttcacaatgctgttttgacatttatttcacaaaaaaacgaggcgagatccggatacagaaccaccaaactgcacagcccgtcgcctccactcgtgaaccgggacacacgtacgttgaacaaacacccaaggcctgacgagacgagatccggacctccgtcctcccaactagggcgcgcgcgcgacctcggcaccggcggcctcgatccatcgttctctcggatccccgccagtgcatgccctggaacggacggacgga

SEQ ID NO: 405 - DNA, 1500 bp, Zea mays
ctatccaacgacaactaaaaagaaactgagagagtaataatgaaagaaaaaggcttctttaggagccgataagattgacagcatatacactagtaaaacagagacatatattgcgaagcatataatgcaaagatatcagttagatcatgaaactccattcatcccttagtctgtcgtcctcatctctcttgcaatttgcaaacaatatgtgacgtactacggtagttgcttgacttgcattgttcagatcagagctttccagtgctgtcatctgtaaccaagattttagtagcatagaaaaaaaatgaaaagaaaataaaaaaaaaccatatgtcaccgagcgcgtgcggctgattggaaaaagaaataattgatttaatcgtcttgcatgatccacgtgatgacagtaactagctggctagctagcttcttcgtcttcgtgttctctacttctaatttaaaagatggattcctgcgacatgctgacgatggtgcatgcaaggactgaaggacggaccggacctgctgctgttgattaattccttaattatatctacaatttaatcaacaccttagatattatcaaaccagatccgccgggatgcatgaaatcaatcaagcaatcaatgagattgtgcagttatccctttattactctgtagcacaagagagtaatctgaccaaaatacagcttgttatattactctagcaattaatctacgtaggttcaggccatcatctcttgctaaattactatagacaaatggagatagtccagtgaatgaagacattgcaagggtgatctatgatctatccttcgtatcaaatccaacattaactgcacaaatgagaccaagcgagatcaccatcttttcctgaccttatagtaacttcttgaccaatttatatctatggccatatacaatatgcgtttaatagaagaagttgaaaataacttttgcggaggtgagaaagttgtactaaacatatctttaggtcttattcgtttttcctggattccacctaagaattgttctagctgattagaacttatataaattagataatcaatttgactaatgtgaaccattttgttagtgttggatgagcttgttcagatgcgctctttatcagccgaagcggggccgtgcgaaacagtctgtgctccctcactcgtcaaccagctgtagctgttgtggctgtacaaaaggtacagccaagtagccaacagagattttccttttctttgttttggcgatcgaactatattgtcggtgtttcatgtcatcaaccagtacgcattatgtttgtgcatgtaataaatattgctgagtgcattattctatagacttgttatatcttagttgcacggttaggtaagacatatggacacaggcagttgcgtctctgtctcttatatacatatgctagttttgctatattgagttgacatgcccttagttgcgatttgcgaagctagctcccaccatctgcgacgcc

SEQ ID NO: 406 - DNA, 643 bp, Zea mays
tgctaaaacaaggatagagtactattgatctagggtgtgatgtattttggtcacttttgtagtgtgctctatatttctttgataattttttgtaaaataaagcattgctgaagcagtttttcaaaacctcatggtgtgctctgtagttttaggttgactatagtatttgaaactgttttatcagtaacaaccaaacatcttttggctttcaggagcatggtatcatcaaataccatagtatgctttaaaacttaaaaaataacaagcttctaaacagggcctttactaatttgatgctgacacgtttttttataaacttggtagtttgatctagaataagataaaaaaaactatgattttaaacatggaaagtaattttgttattgtaaatttatagttaactttgtatcattttctatagccgatgtgaatataatgacgtcgtaagggacgctagtatttattttgattttatttaatatatatatatatataatctcgattttattttctttttataacaaccaccaccagtgctatagttgcattgcatttccttgccactctctatttcccccagtgctagctctctctctctctctctctctcaaatactgcccatgcggcttgccctcctcgtttg

SEQ ID NO: 407 - DNA, 837 bp, Zea mays
tgctaaaacaaggatagagtactattgatctagggtgtgatgtattttggtcacttttgtagtgtgctctatatttctttgataattttttgtaaaataaagcattgctgaagcagtttttcaaaacctcatggtgtgctctgtagttttaggttgactatagtatttgaaactgttttatcagtaacaaccaaacatcttttggctttcaggagcatggtatcatcaaataccatagtatgctttaaaacttaaaaaataacaagcttctaaacagggcctttactaatttgatgctgacacgtttttttataaacttggtagtttgatctagaataagataaaaaaaactatgattttaaacatggaaagtaattttgttattgtaaatttatagttaactttgtatcattttctatagccgatgtgaatataatgacgtcgtaagggacgctagtatttattttgattttatttaatatatatatatatataatctcgattttattttctttttataacaaccaccaccagtgctatagttgcattgcatttccttgccactctctatttcccccagtgctagctctctctctctctctctctctcaaatactgcccatgcggcttgccctcctcgtttgatgaggccaatggccagcaatggcatggcgtccgcaccctcgcccttcttccctccaaacttcctcctccaaatgcagcagacaccctccgatcatgagcatcaagaacagcatcaccaccaccaccaccacaagcaccacctcgctgctcctccccttcatcctcaccacaaccccttcctcccctcttctca

SEQ ID NO: 408 - DNA, 350 bp, Zea mays
ctccttgcgactgccgattccccatccctgcaagtctacgaccttgsccagcttccacgtattagagtatgtatgctgtgacagattgtaaacgtgtacaccaaagatagaagaggcaaggagatatggtagctagcgctgtaaaaggaaaagagataatctgttactatctttacctccttaattatctcctagccatttatctaggtgctacacctcccctatatgtaagccacggctggggcttttccagccatcaaacaaatcaacacgcagcacgcctgtgacgacgtttctctccttccaagcgcctctgaatctctcacatggtaatcagagcttagggttcc

SEQ ID NO: 409 - DNA, 1500 bp, Zea mays
tggtacaagggtacatgtgtttcctggttagcctttttgtcccgtactcacacgctctgcagctgtggttggaaaagtacacacgaaactagggataacagcgggtcggattcgggtcgggtataataaatacacacccacgaccgtacccgcgggtattagccatacccgcccacaactgtaaccgcgggtaaaaaattatactcgtgctcgtacccgtcgggtatcgggcgggtatcgggtacccgcgggtacatatatctatatatatatccaaaaatatagaaaaattccaaaaaaatataatcataaccagcaaaaattttagaaaacttatgtgtacagggaacacttcaaacaagtcttcataaattatgtgtcaacacaggcatacaaaatataatatgggaacacttcaagtcttcatgatacatgctcactagttttttagtttttacggatatccacgggtaacccgcgggcgacaaaaaatatccgtacccgacccgattttatcacgggtcgggtacgggcaagacccgcgggtacaaattcgtacccgaacccgaacccgacgggtcagatatccgaacccgcggataaaattgccatccctactggcttgactcccctcttctccaactgatctgactctcgatccaagtcggggaagtggagagtggagtgcgtcgtgttggagacatcgcgtagctcgatcggggcaaaggtgttgtcgtagatctgcgcccgggcgatgtggcaatgacctggcacagtttggtcgtcgatcgggatgcttggacccaaggatgatacagtgtggctcgttctagcacaacagccaactgagatctagccgcagctattgctggagtcattgcatgcttggatatataaggagcctttcaaagttagggcagcaaccacctgcccctctgtccttttcctcacatcgatgatgcggtgcgaggttccgctctgatcggtgatgtaggagattgatccaaaatggaacatctcactcggagtgaagctgacgacattggtgaagatgatgaccatggagctatctaatgtcgatgtcaccgcccctacctagcgcgccagccatcagtgtttactaccgaaaacatactatgggatggatcacataatgcttttgtggttggcgatattgattgtacctcgatggttcatgcttaacacaatgaaacacacagatttatacaggtttgggccactggaatgtgtaataccctgcatcctgtgtgctgggtgttagaaatatgccctagagataatcatagagatgagcatatttctttgtatccatgatatatatattgcttaattgaatattcatagaaggcaccttgtattgattagcaattatgtgaattgtttgtgagattctttacttatatggttattcttaatgatgtccctagtcagagtcgatgactagcacatgtattagttgatgactacatttcacaagtc

SEQ ID NO: 410 - DNA, 214 bp, Zea mays
ggtacgtccttcataaccttcgtcctaaattcgttatatccaaagggaaataatgatttgaaggatgaagggctcttgatatttaacattttatgttgccttgttcttgattcatagcatttgagaacaagtccccaacattggcgcccacctccggtgaactcacttccactttttgaagtcttgaacgctttcggcaagcatcaccttcgtc

SEQ ID NO: 411 - DNA, 585 bp, Zea mays
aaccgccatggaaggaaaaaaatggagatgagagcaggtatatgtgctcgagaggtgtgacgtatagagaagtagagattttatgatgccaggtatagatgatgaaacttcgactactagtttgtttttagattataagcttcaaataatgataattaaatactagcaacatatttttttgttcaattagcatcaatctcgcgcgatctatgtaattgttttcatatcgatgatcaaattggtataaatgtgtgaattatagacaaacttacatttttgaacaattgaattgaataaacattggacctgacccaagtgttcatatttattcgcataactgaacttttccagtatgttgaacaagcacggggcaactattcaactttgcaaggattagagtggaaaccccttttgtcttgagggaaaaaaaataaagggagaagctctcctgagaagcatatagcaccagcggaacacgggaacggcggaagcaaacaactagaaattccccagcccggttccttttcgtgcggtttgatctcgtcggaggcccggccgcggttccccaatccgccatcgaattcg

SEQ ID NO: 412 - DNA, 1499 bp, Zea mays
acggtcatcatgtacgtgtcttccttgggctataaaagggaggacacacataaacttgagggggttgaactcatctaagtttatcttgaccctcagcaatacaactaacatgtggagtaggacattacgctccggcggcacgaaccactctaaacccatatgtgtccttgtacttactcatacatctgttcggacaaaaccatggctgcccctctattcttaggattaggcgggtgcactccgccacccagctggagttctctctgacaatatatattttgttactaattacaaagggaatgagagtgctcgcttccgatttaaagctatctctagcatattttctatcgcatctctcattttaaacctcactatggcctgaggagctgctgattggatgttgtatgcatcgtagctgttggatatgtcctctttgattttgtatgctgtcctcgaaaccatgcagtgagatgtgtatttctttgcaaaaacctgtataataaatgaactttggaagcacaaggcccaccggagcactgtgcagcagccttgtcgtcgtggccgtcgtcaggtaaatttcttttctccatagatgttgtacatgtctgtaggaattcagagagaacagtaaagaagcatgtcactgagacaaatgttaggcaaggtgtccctgctctgcaaacggagtccgcatccacagtaatggacgtggctgtggggcccacatggtcccaagctcaaaacctaccgagtcttgacaagttgtgcggagaaaaaaaaggcgtgggaaaaaagaaagacaacatctttgacaagtttacttgctaaaaacagcgcaaaaggcgccaaaaccagagggaaggagggggcgtgaccaaccgctctttccaaacaaccctctttttttttttcgttttcggtgctcgttgtgtttgacccaacccagcgacaacatcacagcaagtagatggacacgcagcacggcaacttttattgcttgtcccgtcgtgcctgcctgccgcgccctcctcatcctcctcctccctcttcctcttgcgcgtcgccaccaccaaattctaaaccgcaatcccgccgcaatccgctccccgcgcgcgaaatcggctcacgcgtcctccgcttttcggctcacgggtcgctgaattgctctttctgctcgctcgctcgctgacttccactcaactgctcgcctggccgcctcctgctagtgcttcaatcgcccggcccccactcgcttgaaggcttccggaagctcgatcccttccgctcgctagctggctgcacagatcttcctcccgaggttcctctttctaccgtcgagtcgaatcggatcaccggagctatcggattcctcaaaatccgagactttggccgcccgccaccccgtctcagtggcggagctgctccgtctggtccgcctctgcctctctggcttgggggcgctctagggttcccgcgcgcgcgccccgtgatgctcggga

SEQ ID NO: 413 - DNA, 1500 bp, Zea mays
tatagagtagtatcacttgctgttgtagtcaatgtttacccttgtttcagttccagcatatctctggtaggctctcctactcacgtttcatgtatggaaacctctacccccctcccaatttccattcaatccctttctaatcaaacgagccctaaacacgagactgaatctatcccatgcccaccatcagtgccatagggcttgtttagttagaaaggaatcagcgggatcgaagaagacacagtggaaaccagtgttttataatagtagggaaataagaaacaagcgacctatttttgagctattgctggagaatctttagataaaggctagttttaaaacttaaatccctccgtcattcatgaggatwaattttccttaatctccgaattcggggatttaaatttccaaactagatctaaacgagaaatatcttccagcgttttgttgaacctctgggcccagtagtttcctcgccccggaccaagctcaggcccggcatcatcattccacatttccactcgaacgccttccatggcccatcctgcctctcggctcacggccgcgtcgggacctgaggcccagcccaactacgatccagccgttgctccgtccgacgtggactggcgccgaagcaaggcaaggcaaggcagcggacagagatgcttccccctcccgtgccggcttgggcagcagttgggctctctcggcccgcctccttcccgagcacgcacgccgcctcgcttccaattcttccccccctctcctcgtccgctccgctccgctcctgcgttgccgtggagtgccgcccggggctccattccattccacccgtagcccggtccccccgcgccgccggcgcgccggttccttcggttcccggtaacgaaccctatcctgctctactactggttgctcggacggattccctctagcttcttatattataaacaagtttcggttgctgcgaacgcgggcaaccccagttcgaatgcttccccctccggtcgcgcgggtttctctgcttcgctggtacgccgctaagctaatggagtccatctatcccgtccttgctgctcgtcgccttctactgcggccggcggcgcgcgcgggatcggttcggttgacccggtaggattaggatataggacgcaaccgcaactggatggtcttcgacggttctgcgcctgcctctaggctagcggctagcactaccgcgagcggttcgtgttcactgctgtgttcccaccatgacccaccacgccaaaatcccctgcccctgccctttgttgcggttcctgttgcgatgaatccggttgttttacatgcgtggcggttgccatactgagtgggtagagactcaaaatatagtgtctactagtgtattgaccgcattcagtttatgtatgtttgctgtttttgctgaaacttgggacagaggttgtgatgctatttttatctgtttgtgtaaccgacgtttattgcggtacagggatcaag

SEQ ID NO: 414 - DNA, 217 bp, Zea mays
ctgcaaggcggccagaaaaagcgcagccctgcgcccatgccacgactcggccacctctccctatggtctcctcctccacttgctcctgctcctccagacctccactccacccctccaaaaggtctagtaaaatagaaggaagccgccccccaatcgttcctagcccggcgcacggcgcacgaaggggttcgatcggatcggcgccggcgggggcgag

SEQ ID NO: 415 - DNA, 282 bp, Zea mays
atgtcgtttcctagttcaaagatgaactattgggcgtcaagtatttagaaacggaggtagtattatataaaatgtttatgccaaaaaatgtaaaatgtccgtccgccgacatcgccctcaaccatctgccgatatgcgaacctggagagtcgttcggacggacgaggaagaaagacggaagtgaggatcctctcctcggcaacgataggtggggcagctgtctcacggtctcaccctgccgtatggggagctcctcctctttcaacgcgtccccggctccac

SEQ ID NO: 416 - DNA, 1500 bp, Zea mays
aaaaagtgtcagccagctgcaggctttgtatacaatcttgtgcgacggcagtgggatacattttgtagtgtatatatatcagctgtatcgattgtagagttgtagtgagcgagtgatatgcataaaatgtaacacagcaccttgtacaagaaacaagccttgttatctgattgttccttgccaacaaaccaaccatcagtctttgaagcagtgggtgtatccacgttgctgattgtattttgcagttatttgtatagatcgttgatcaactaaccgctccccttattctgtttttactagagaccaggttgtagtagatggctttatcaaaattcttttagtgtgtgagttataaaagcttaaatatgatcttaacataagaagctgtattaaaacatgtgtctagacaattgtttttcctagtaagatagatttcttaacaggtttaatcataatttattttataagaatgtgttgatttagaaattatatattatataaaaaattaaaattttgtgtataaataaaaagacgttggttattatatatacaagagaggtggatagggtgatgcaacgttttagaccacttttaggatgattccaaccatcctctcttcatctacatattatttgtttatttttaaatatatctcctttttttccctccctatttcatctcctcttcgaacattttttttcctatttaacttttatttacgttttaattgagttatttgatttttatacgttttaactgagttatatgacttttatacgtctagttttaaaaattatataatatttgtagccgtaatacgcattgtttttagctaaataaacttaaaaaaaattaatttcgtagtcaatctgagagacgagagaattcagcgcagctttcgataccgcttttactttttttttaatttatccaagctactctaaaagtgggttgaagactagacaaacaaagtgagaggcggaagtggaaaaaagacacagcaccgtacgcttgttgtgcacatcgccacatgcatccaggatggaagaagcggcgaggcgatatccagaaagggaactggggataggatcgcaacaagaaattaaagaggcatgggtgcatgtatagttggtgacgaagcatgaatgcattcttcgtggcgaagcgcgacgcttgcctgcaagacacgagggggtaggtgcacgtgtgccgccctgccggagctcacgtgtcccaaatctggaactcatccatccatccggtcgcccggccggcctcatctcctcaccagatcacctactacttgctactcttgctactagctaggtgaggagtaggatcgtggatcgtacgagtagctcaagaaggaaacaaaacggcaggcttgcagttccaatccatcccgctggcatcgtctgttcttcgtccttccatgctctagactagctagcgttgcagtgcagagcatgacacaggcaggcatggagtagtgacatatag

SEQ ID NO: 417 - DNA, 1500 bp, Zea mays
cctacaagaatttgctatagtatccctgccctatggtgggggtgtcttgaaactttgattagtcattgatatttttactgcacatgcacttcatgttctcaagtttcagttcattatgttagttgattgccactagtattctgcggaaatttcacatttcaataatgactcattcattgaccttataacctttccaattttgtgattaactgaaacttggaaaatggttgatttggaggccatgggacttgggagtgggcacgcgcatggatacacaattagacgcaatctgctttgctgagctagcgtgatcgtgcatgctgctgatgcggtctaccacacttcttccatctcattagtggtagatccggcgatatcacagagagcaggatacatacaatgcaagaagttgaaacctaattaatataaaagcaaatttgacttagttaccagactatccgtccctgcgtctcaaattgtacatcgttttaagttttaacatttctaaatttatagagaaagttagcgttctcgtgtggggagttattaaacaacgcttattaataaggtgaatacaagggttttagtgagaatgcacaaaaacaattttaaagaagaaaaccgctggttgcatggaatctgaaaattatgaataggattttaatgaggacacaacaaaaaatttatttaaaaaaaaagaaaggaggagtttgcttggtgcatcaaatttgatagagaaggtttttagtgaaaactacaagatgtttttgataaacaaaaacatagagaagatacagattttagcaataaaaaacgtttaaaaatcatttagtgaaaaaattgaagtaaaaaaacagagaagacgatttttagttcttaaaaagaaacatttagagaaaagaaactcttgctggctgtggggttcgaacccacgcgcacttctgtgcagaagatcttaagtctccccccttaaccactcgggcaaaccagctgttacattatattattagatacaaatatatttagtctatagtaaacgccggagctttccattgtcatagtgccgccaccaccgcatcacatcctctggccagatcttcaatttctgattctaagcagtcttcccttcccaactctggatgagcttcttggcgtggaaacacactatccaactccaagaatgagattcgttcgtgctcctccgatctcctccagagcaagaaaaaactattcgacccctggaaggttctgatataacatgaattatacttaatttgatttgatagattatataataaaagtataagtgtacttttatttgatatttttagtactagtcctagttgattacacaatgatcagtttttctcctttttgtttagggctatagatatataataattactgtattcccagtttcccatacggccacgcctgaatgcccgacctccgtccgatccggtcaaatcctcgccgcccacgcccccgcctccgccggcg

SEQ ID NO: 418 - DNA, 1485 bp, Zea mays
ttatatattacgaatacgaatacgaataattcgatattttgcccatccatatcccatccctacctgcatatagccactttcagccaaagtttcgtacccagaagaatagattcggtgtaaaaaactcaaacacatagttggtcatcaatcatcaacgttcggaatttcatggagactttgagttaatacatcaaaaaattgctagctttaatgaagaacatgcatcgcaccatattgaagagtgttcggttgctagctatatatatttttttcgccacatttcaatttaagtaagtttgattaattaagttgataaatgttcagttgataattaaatgtagacattttttattttatattttacgtgtcatagagtaaaagtgtgtgtctggattttttttaagcatgataaactatgactcaaaaatgcctagctatacaattttatagcttgtcagagcatctccaatagttatgtaaatttagcacctaaattatagatttaaaaagttgctaaatcactttaaggagtagaaaaatatgtgtgttccaatagttctttatttattggttgctaatttttaaaattgtccatgtcaacaaaaaggtgagcagctttctatttttaattgagctagcacatcaacaaccttccataatgtcttggaaggtcaaaattgtcgatgaaagaccagaagatcgcgacgatggcatgaagacaacatatggcactggagatagatttatggttaatgggacagtggaacgatacaaaacggtggtcgaaatatagttttcgcgatggattgagaaccaacattgatttagggagtcccaacgaggttagtaaatgtagggatgaaaacgagttttgtagggagtttgtaaatttaaggacttactttacataactattaggagaagagttttctctgaaaaattcttaaatttatatttagggagttgtttatataactattggcatttgagatgctctaaggaagcgaaggaaataacttggcggcggcgatcctagtcgacaaccgttgaattcgtgagaatcaatcattctgtaggagtaaaaaaataaaataaaatatgcatttcctcgttcctatacgcttaaattagacgaccctggaggcctggactggaatcaggaactaggaaggggcacctgcaagacgtggcgccatgcaagtgcgtcgtcgaccctggcctcttctctctcttgttcctgttatctctctcggctgtccgctgccccgtgatctgagcgcgtttctctcccgtcctctcttctccctctcccgcaacaaacacctgctatccggtctccctctcccctgccatctctctctatcgcattgcttgcgcgagcgcagaaggcacacacgtacagccatggtgatacctcctcctcctcctgatctcctctcctctcctcctccggcctccgtataactaaaagatgatcatcgtgcg

SEQ ID NO: 419 - DNA, 121 bp, Zea mays
ttgagcctgatccgcccgcagcccgatcgggatcgatgggtggggaggcgccggagccgcgatggctgacccgcgctttgagcatcggtggcggtgacggcggctgggttcccgaatcccg

SEQ ID NO: 420 - DNA, 73 bp, Zea mays
ggtgctaaatcttccaaatgttgtatgtaggctcagatgagccttttggtaaagcctatcccttcctgttaaa

SEQ ID NO: 421 - DNA, 652 bp, Zea mays
ggtttgcagaactaccttagtgttcaagttagttaaatcgtgtagtactgtaccctaaatgtctatatctggagggactttaaggaacatataatgtatattaaggtcctgtttggtttctttagccttgggactaaatcttatcatggggctaaactttaatctctaccctattcggttccagggactaaaagtgatcaacagttattaaaacacctgaaaaagactatattgtccttcaaccaactacccttctcccgctgatatccagacagcgtaataaaggaggggcagggaccttaaaaggaaccattttagtgtctgtttgactatttagggactaaaatgcagggactaaaaattagttcttggaaccaaataggtctaacactctaaaaggaagagctgcagtgttttctagaaatgattgtgtacagaatagtcactgctgtaaagtgggttcataccaatttgatacaacattcaccttcacaaagaaaattcagatgacatgtaagattatgcctgacagcctgaggaggtctttcaaaaaccaatctcacaactgctgtctgacatgtcctttcattacttaatatgtgttcccttgcgtctgtagaaaaactacataaaagaagaaacgatagagagg

SEQ ID NO: 422 - DNA, 435 bp, Zea mays
tgtcctcatcaacgggtcagcgccggcctccgcatagaggcgtcgtgccgggctgggcgtcgttcatccgagcggatcaatttatgggcacgaaagggagggcatgaatttttccatgggataacattactccataaccattatttcaattgtattctcgtaacaatatattgccttcaatcacatataattacctagtttagtgaatatcttcctgctagtctgctttgttctgtcttatagtttttcgatgtccaggakagaggagaaatggagaaaagcacagttacaagaggactgccaatcgccaaagtcgtctactgctttctaaacgatcccctatcagtgtccttccattctccaaaatggaacaaggacgaatcatatgtttgaagtcccagctgaaaaggctgcagtcagtcttagattcctcaa

SEQ ID NO: 423 - DNA, 64 bp, Zea mays
attgtaactcactgtaactgtgcactgcatgctcttcatggccagttgatactccataatgtaa

SEQ ID NO: 424 - DNA, 918 bp, Zea mays
atattttatttctgaaacccaactaaacctttattaaaaagatcaatttagtactaaattattatatatatcatacacacaaaggagttttcttaaaaaacaaagtgtactagttgtaaaagttttttccacggaataacgacaaaaaggctcgctgtagatttttattagaagtaataaaagaatcaggcttgatctaggttttgtgatgaaattgagcccaaaaatcagtacgtcccgtctatgaaaagttatcaaaacctttattataaattataataggaagtatactcctaaactaaaaaagttctacaaacacaaacggttttcccttacaacagataatgtactaaatctgggaaaaaatctaaaatagtgaaagaagcttcgtcgtgggtttttattaggagtaaaaaaaacaagcttaatcctggttttgatttgaaaatgaacccgaagttcagccaggatatacgaaatcttggccgaccattgttacgtatatgagcaaatatagtactaatttgaaattatcctacaaaaataaagtgcttcctctgtgacaaataatatattagattcatattaagttgtttcctctagaacgatgggcaaaagctttgtcgtatgcttttattacgactaaaagagaaacaatcgttcacgcgatttttcaagtgaaagcgagaccgaaaaccagcaatgggctgtaggatgcattgagatatttttaccaaatattagccaaacgtttttgttattatgctagtaggcatagcactaattttacaatagactgcaaatataggggctttattacaaaatattctttcggacgtgaaaactcgtcgttgttgattcggagattctaccactccatctccagtttttttcctcgcctgctcggctcccctataa

SEQ ID NO: 425 - DNA, 1500 bp, Zea mays
tagcaagcaaccaaaaaagtgaaatgtgtgcgctctgtaaccaattcagttttgtattagttctgaaacgtcatgctctaaaactatttaaatgtgtgtgctcttcactgaaaattatgttctaaaacaaaagaaattcaattatgaaataaaataaatgtgtgtgcatctcaaaaattcagttctgaaacaaaataaatgtgtgtgcatctcaaaaattcagttctgaaatgtgtgctcctaagaaattccgttatgtaacaaaactcttgaacctctgaaatgtgtatattcctcacaaattgcgaaaatgaaatgctcctgacaaacaatacctagttaaagagaagcagaccggctgatgttgcaaagaaaacagacaagtccttttttgttgcagtgtctattgaatgctcggatagaagaggtatggcttgctcacgaacaaaattgaaaacaagagtagcttacatttgaacctaactatgtggagcaagatgatttattgtgtggtgcaaatgtaattgatgcagtaaaaagattagtaccagagcaaatattcttttgtgatgtagatgcacacaaaagtattgtgacacaagttttaaattcaaatataaagtaggcacatatgttcacgtgctattttagagtatgtagagacctcaaaacaaggggtgatctaaatgcattccctgtccatttgtgaaatataacaaatataactcatgkaacagttgtatgatttattactaaacacaaacaaactgaaacaaaaccagccaccagaactgaagcagtaccaggtaccagtactaaactctaataatgaactctaataacagaatcctttttgaaagaggcacatgtaacctggtggctgagaactgtattactgaactttaattccagaacttagctttaatagtgaactgaactctattacagaactgaattgaactatagtttttgcattcatttttattcagaacctaacgaattgctagcaataattagaaacgaaggtaacttacatttgaacctaaccatgtggagcaagatgatttattgtgtggtgaaaatgtaattgatgcagtaaaaagattagtaccagagcaaatattctttcgtgatgtagacgcacacaaaagtactgtgacacaatctcctatatctgcaaatgtagaaccaagttttaaattcaaatataaaggaggtacatgtgctatgtgctaagaacaaggggtgatctaaatgcattccctgtccattctctgtccatttgtgaaatataacaattgcaaccttggaacagtcgtatgattcatcactaaacataaacaaactgaaacaaaaccagccaccaaaacttgtttacatgaccaattgactaccagatgttttcgaggaagctgaggccaaccaggctggtggaaaatatgataacacatcaattgccagtcgtcgtccccaccgctggccgcgcggaagcccgcgaag

SEQ ID NO: 426 - DNA, 1500 bp, Zea mays
aaaacataaccacaattatgacgtgcatcccacgcagaggttgtgtgtttgatctagggtttgacttacacgcatacgtgggaaggtttgacctggtgtatggcgggagacacatcaggccgcatgcaccttgttgagtgtggtacatagggtggctgggcttcctgtaattattgaaagccatggactcacgatataccgacactatatatatcattgagggttgctatttcattcgtgtttatcttattgcgttatatgcttttgaaaacatcgctatggaactcattaagaatggccttagaacgtacatgtaaattttgcaacaaaaaaaagcaaagcaatttctaatttaactactagacagcacgtacatttaagtagccatataacttcaactttcttgcgtgtgttacatcaactgctttatggacttagggttagctacggatcttcgttactcctagcatcccactcagcaatcataggccggccaatgaatttccagttgttatatatcatcgccttaattgcctggcaattctacgggatactaccaacaactcacagcggccgatcaaaatcgcttccagttgtcaatgaataacggttcgcgtcagatcaaatcctcatttttttgtcagttgtttgttaatgagggaaggaggtaaccaaatcaaatttgcgagacagtgatggagtcgtcatgcctctggatcgcgtgcatatggtggtatcacatcaaactttgtagcactgatgaacccccagttttgaactgtgcggattccatagaattaatccataacggaatcccactgtttcttgcgaaaattcttcgaagtccgtgtcacttcctgaaatattaccatgagtggaggcctaattgtaagcgcagcaatggacgacgaggtgtacgttcaggtacattatctggactcggtagcctcggtttcgtgtaggatgccatacagatacacagttcgtgtgcagctctagaatagtacagatgtccaatgaatgacatcactgaatttaccttgcaccttttcattcaagttggatattattaacttattaatagctggattatgtagtggtctagcgatcgtgagcaattttatccaaggtgctgcaacggtctggttcaaaatttatccgttgcattgcaccgtaccgttcatcttgccggcagatattgactggatccatagatggaacaacgcaagcaaaaagagagcgtcatctacagacagtgtagtagagctagctagcgttcagtttgttgagccgtcagtgtcagtgcgctccaaccaaccattactaaaccccccctcctcttcgcttcgcattcaaatcaacacccatctccgagctggaccaagtcttctagcctagctcttacggcaccaagcaggcctgcacagcatttccgttgcccgcgcgcgcacacactgcaggcctcacttcttggtggcactggcagtggcactggcggca

SEQ ID NO: 427 - DNA, 1500 bp, Zea mays
aaatgattccacggtcaactgtcaaccattaggggctacgattgggacgacgagctcttgccatgccatgccggttgccattggtggagatagcctcgtccgttcgtgcaagtgccatcattccgcaacgcgtgctatcctgccgcgccgccggcaggctcgccactagggttggtcaagtcaacggcacggccgaggagatgagcgacaccggaaagcggtgcgtgcggcgttcctcccgccgacgcgacgtgcggtgcgcggccgcggccraaraaacggcggattcggacgggtcgcttcgctggtgagaatgcagcagctagttgccgttgaggcacatgcacacttccgtaatccactaatccgcacgcggcggcgaagtccaacgaggagggccggccccggcggcgcccggggaccacccgagagatgccccccacctcgttgcggggccctagcgcagggaggcatgcatcggctcccggcatcttctttctactgggcgcgctggcccagcccgtgcccaactcccgagaatggccgggcgggacggcgccacccgacgtcgacgtcgccgtcgcgctgcctcctcgcggacgcaaagacaacatagagagatagagagagttgaaaggtgcaaaggcggggctggcgagtgccgattccgcgcaatcctagttgctctttgctcctgtcgtcctcccggtctttctcaagtttcccttcggctttcgccacttaattcatgtgttacctggccattacgggtggcttaaagcgacgctaaaagatttgcatcaggcatggcctggcacataaacaaccgcagcatcccgggtggtggctggtgcggggcgattaggaatccagagcggccccgcggtgacgcatgattctttccgtgcaggctttcctagctctcccaccttccgcaaacgggtcctatctggctgaccacgcgaacccgccaccccccaaccggtcaattcgtccagctccagccactcgatcagcatgccgggatccgaattcggagcctctccttttaccgattccctcttcttcttcctccagtccccgcacccctctccccgccttcgattacgccacgataaaatagctaaactactagcatgcgagtgggcgtgtccatgtgattgttcagcgtccaggtcaggacttatctcccctgcatctctctctctctctctctctctctctctctctctctctctctctctttcctcttcaatcatcttccgcaacccaccaaccgtggttgattcaacgctccgctccgctccgctcctagtattcgccgccgtctcacggtgacctgttcgtggaaattccttcatttatacgtagagataggttcagatgacacgagcaattatttttcgctaagacgtcgagataggcagcagagcagacagcccgcgcgcggaattgaattactagtcggattaggtgggcaaccacggagttgagcgcgcg

SEQ ID NO: 428 - DNA, 112 bp, Zea mays
ggtaatctgttttgtgtacccttttgatttccctaatgaattgtatttgtatttttctaatatatgttcatctgcatggttctgaataccttcgtcgcagaggtttaaggaa

SEQ ID NO: 429 - DNA, 1500 bp, Zea mays
cacattatatatcaatcgcatcacagaatgaacacatttatcatcaacaccatatatatcacaaagtctcactaatataagtctcactaatataagtctcacaaatataagtcaggatcatcacaaaacagatacaagtctggatcatcactaacatcaccaagtatctcacaagaccaagtctagccaaacatcaccaacactcacaagaccaagtctggatcatcaacgaggtgggcatctggactggttcggcgaagggctggacgaagcatgagggttgttcgacgccgccgattgaccctgcacagagaagagattgtatgtgtgagaacatatgaatatatatcatgcagtactaaaatgttgatactcacagggttatgaaactgagcaggcaggtcagttagagggaacaacggaggtggtggagcaaaaccatgtacgacactaaggctctgcatgtactagaacatctccgccatcctctaatgatccaccaagcgagcggcccaagcctcccgctccgccctcatcctcgattgcatctccatatgttatctcctctcttcttcaagctaggcctgtaatatttcacccaatgttataataatgcaaagagaaggtatataacccaatgttatgataatgcaaagagaatgtttgccgagttgccgggtgacactcgacaaagaagatattttgtcgagtgtaaacgtctgacactcggcaaaattaacggtcgtcaactatagactgctgctgacgacactttgtcgagcgtctctttttgccgagagcttgacactcggcgaagcctccttggccgagtgttttgtccggccctcggtaaatttggtctgtttcgagagtcttattttgctgagagtggcattcggcaaaacatgcctaataaattgcactcgacaaaccgacggcactcgagaaagagccagattccgatagtgataagtacaactagtacttagataaagtatattattatcatcaattaaagcctggtacaaatatttttattaaacctctacatctctaatgtcgttcagttgacgcttattattccagcaagatttgtgattaggaagatgtttatccctgcaggattcctagaggtttttgaagaaatcaaactgccggtatatatacttgggtttcatttatcccggctttcaagttcaaattctagttgagccagttggcgtgttttactagctgcggagggacaaggacggtgtggtggctgtggctcccgctttaagaatcgttcactccagtcccgtctcgtctctccgcgctccagctccacgccaattaaaccctactctactgcttctttctctctcttctctctctgcgtcatctcatttccgtttccgtctctccctctcctcgcccacacgtccaaaaccgaagggagcaaacgaacaaaacccggccgagtaacgcaggagacgaagctgcggaaggcgagcaagcacg

SEQ ID NO: 430 - DNA, 477 bp, Zea mays
ggtgtgaattattaccgttaccatttacgttacatttcgtgaaccaaacaacacctaactctctggctgggccatatggttgttggcccggacttgcacatgtttgtcagacttgagtatgaacataaaaaagccttgtttcacttcacgtttcatatccctgtacataaatccacacacattgaacttgagcgtttgcaactttgcattatattgggaaaatgtatttggcatgcaccatgagaataaatttcctgtatcagttttgagcagcttccgatttcaagtgctgatattgttaactgcaagatttcagtagctatgagtattgagtaaggtcaaataacagttactatattaaaaatgaactcttatcttgttagtaatgtcttatagttttgtccattttaaaaattgggatgttttcaggcagtgcatctgaaaccagatgatagtgattctgaccaagtgccaaac

SEQ ID NO: 431 - DNA, 645 bp, Zea mays
tggttcaactaaaaaaactccaataatgccataatttataatttattataaaaaatatagatagacaacaaagtgatccaaatatattgtacaatgcaatttatttttaaaacacatgatttaagacttaattgtcgaagctcaatttgttcttagtgtctgaaacactttaaatgatatagtattttaattcttgtgtgctcttacacagctacatctaaatatcgttgtatttagacatatataacaaacgtatttaaagaagatagaacgatttatttagatctagataagtattaaatgtatactgtatataattatattactttttgcaatggagtttcgcggagttggacatcaagacctctacccatatatacagggtcccacatgtcagtaagccatccagtagcaaaagcgctagagagaagagagagagactccaagccaagaccaagagtaatcagaagcagctgccaaatggccaaatcccgaaagcccctgtccccagcccgcctctcaaacccctaatccctagccacaccacgccctcttccctccttccccgttggcttcggcggcgggcggccatcagcaaccagcatcgtacggaggagaagcgctgtttacacccgtctggcaggg

SEQ ID NO: 432 - DNA, 1093 bp, Zea mays
tggcggcagttgcggagtcgcagctttgcctcggggatcgggaaggagcaggcaccggctgcgacggcgcttgtggtggaaggtggaagagagacgacaggcaggggaagaaaggagtgtgggttgctcgaggaggcagctgtagctgtggcccacacgcgacgcggtgggggaggcgcgagtggtgggtggccggctgcgtctgcggcgacggcgggggcggaaggcagagcgacgatggctgtaggacgcggagggggagggagagctagggttgcttgggggttgtggggcagggagtgattcacgggggcgacggtcgaaaacgtacgcatgacggacggtgcagattaacgcgcgtggacggcgtagattaacgggaggcagaaccagaggaggcaggctacccttagagccttaatatagtagtatagctacatgtcagtagatggcgcttcctttgtagtttgtggcgttccatctgcatatatatttttatccgaagaaccaaagaaccgccttcctctcaagatctagagtcccatataggaatgtaaaaaatgttataggaaatccacaggattcacattgttcccacagacacttgctgcgtggccgcctgcgctgcgttgcagacttgcagttgcagacggactcgaaactgcgaccaggatgaaccgacagagacgttcactaatttcagaaactgatgaagtgcagaacagcaatgagtaaagatgatgcaagcaaagcaagtgacaatttcagacaagatatgaactgaatgtcgtagataagacaaaccagtgcatatcctccaaatcagatggcctcatcaggaaccataccatggattcggtgcctgcacgagctccctgtttgacggaaccagtggtccgctcggccacctgttttccgagctgcctgcgaaaccgttggccactgagacaagttgacatgaacgcacggcacctcaacacacgtatataatcaagcttctgctcggctcactctacatgccgcatgcgcactgacgttcttgagagtccaggcagagtcgtagtttcttcggaacgcagggaaaaaaaagagg

SEQ ID NO: 433 - DNA, 408 bp, Zea mays
tgcattttacgatttgctacaggtagggtttttatctacatccaaaccgttgtttgtttttcctccaattttctccagcacatttatgtgactgatattatcatatagtcggtatattataacttttagtacggtcatgtatacacattctcagtaattatcgggtcaataatatgtgtatcattcagagcgtcccacgaaataagatgaccgtcatatcctttcgtagtctgtgcccaaatcaaatgcaataaatcacttcgtttgagcagagggaaaaaatgcctttcgaattctaagacttgggcccactgtcagcctcggtagatatcacactcactagtccactcccctcttcactctcgtcggtggattccatgtccaaccgcgtcgccggaggccggaacc

SEQ ID NO: 434 - DNA, 502 bp, Zea mays
cgtccgagtggtctatactattgatttaataaatagtagaacactctgaaagaaaaacaattagattcccacttgcgtcgctgtcacactgcggacccaacccaacgagccctgtggagtcagccactcagcctgcaacgagggcggaggcggacgcctcaggatctatgccaacgaccatttccaagctgacgtggcaggacgtgtcagcatcgtccgacgcggatcgcatgtggcggtgatgataccggttccggacgccacgaagagttcgaatcccccaatcctacgactaataactgccacgagtcttccgccgcctgcaagtccgagcggcagggtatatataagcaggggccagggagaggagcgtcgccggccggaccacccagagccagaagcgcgtcgccagccaactatcgccgctgataaccaacccaatccaacctaacccaaccctgctctctgccgacgcggccggattcgaatccgaggacgatcg

SEQ ID NO: 435 - DNA, 739 bp, Zea mays
ggtgcgcttcgtccgttcggcggagcgaattaagcaagttcccttgaaggctcaggtggagcagcaccgagcatttggccagcgctgccgggatggtccctcgaaattggatctaagaactcgctgggattggatctaagaactcgccaccgcctgagcagttggatcagaagagacgtaagaaccctaaacgccctagttaagacaggaagaaagaagaccagcgcaccctccaaagtgcaatgagggccactgatctaggccacgagccttcttgatagctcgtcgaccccgtccaggtaagtatggagtaaagaagcacggtgcgctcgtcttgtagtgggtgctcggggcgtgtctgccttcgcgcggcgaggcggtactaaactatcgctcagccagtgtgtccgtgtggccgtccgtctccgctctgcctcctcgcttcctcttgggctgcggctgttgggcccttgattccgtgagtggactgcatggaacacagatcggggccctgatccaccagcacaggttttttctgtttaaggccacgcgaagagtatagcagcggtcagcgggtggagtcggcaccggcacgccggccgtcgggaccgcgatgttggccgccgcctgtcctctctccgccgtcgccggtctcctcccgacctctctctcgcagaacataactcctcgccaccctcttactgtcatttcttactatcagttccagtgtgggttttag

SEQ ID NO: 436 - DNA, 1500 bp, Zea mays
tagaaataaaaaaacagcagacattgattgatctacattgaacaaaacgatgaatcgcacatggcaggtttccattaattatcgtgtattcaattagtttactgatttttcaaacgatttagagctagtttgaaaactttatttttctaatagactcctatttccccaataaaaattaaactagtttcccttaaaaatgaaaatcccttaaaatatggttctcaaactagttcttaatagggatgggtaaaaatgtagaaaccgtctataaaaaaaatcgtgtcttcacgtggatcctggaagcaactccagtagttctctaaaaaacttcctaaatcaataatttaggtagttaacatgaaaactattctccaacagttctctaaatgaactttctaaatttaacaacttgtcatctaaccttattttctctctacatttggcaatcatttaacaactccctaaataaaaatgttgactgtattatatagtttttatgacttatttttatatggataaatacaaaacaaaattacaacctatatttagagaactattggagaactcacatttttttactccaaaagtcatttagcaactttttaaatctgtgatttagaaagttaaaatttacataactattggagttgctaaaatcctcattcattttaagccacgacccgattaaaccgatgggtccaatttgatagtcgcgcgccacgtactaccagatgtggtacctttaggccgacatacgcttcatctgccattcctgcctagaagcaactacataggacaaacgtaaggtgaaactaaagccaaatttgtttttttagtttttttctgccacgtttctctccataattctcactgtgctaaatggagatcagcttatttaatcatgcttttttgtttgtacagtttgtggaaaagtgttttttcgctgaccgctctacctccgtaaatctgaagcacccgctactatgccgaagtgacctgagcgtccagtccagggccgtgacggtggagtgtggaccatgtcctatcaccttcgccctcccgtccccgtccctgtcccaccaacccccaaggcccaactccactcatcgccactgcgccgaaacccaaagcggggaggaggagcggaaaagaaaaggaaaatgggaggagcggaagcaagtccgagcaagtcagaggatccgccggcctatctccgcctataaaatgccgtcccaccccccaccttcctagcagctgctctccaccaagagctgctggcaccaccaaaccaatcgctggatttgtccagagtatttccggttttcaccgccctagatctgacccgagacgccgcgtcttcgctgaggttggtcgccgcacttctccctgtaacaatctagactctagactatggtagtgtttttagcttcgattgtttctcctgttggtggggaatttcgtgtggggtgcttattagctattcggcggaacggaatacag

SEQ ID NO: 437 - DNA, 252 bp, Zea mays
cggttgttaccattttagggaatggggctactactctcttctggtcggatagatggattcatgggaataatatccaggacattgcccctgaggtggtgggtatggttggccgcaaggcgtattcttccagaacggtggcacaagctctggataattggcattgggtcagtgatattcgtggtgctcttttcttgagtgggttgcagcaatatctgttgttatgggatactttgggggaagttaggctttctc

SEQ ID NO: 438 - DNA, 97 bp, Zea mays
ggtacagaagtacaagaagctccgcacggcttatcacaagcaggcgttgctccatctcgccggccagacataactccactgacatccggcctgcatc

SEQ ID NO: 439 - DNA, 263 bp, Zea mays
ttgcatgcctgcagcgagcagcgttgggaaggggaaggagaggggggactcaagacttttttttgagataatattcgtcccgttccgtttcatcgctgacgaggcacgttaaggagccaacgcgttaagtccaatgccaagactggcacgtgggtcccaccagtaagagaccgtcaacggggcgccgttagggtatcagaaggaagaccaatcaaagggaggcaaacgccatagcggccaatcacttggcggcggcggcggcg

SEQ ID NO: 440 - DNA, 121 bp, Zea mays
tgcatgcctgcagctgggctgagcctgaggagagcgaccgatcgagagatcatcgatcgaggatcagggacgactcagggtgtgaccgtccgtgtgcgcgaggttgggcgcgcgggcaaag

SEQ ID NO: 441 - DNA, 862 bp, Zea mays
aaagaaacttgcataaattaattgtattacagaagctggagtctacgtgcaagcaaaacactcttgaaacccatattaccaatccgttgaagctgaaaaatcgaagctacaatgtctcaagtgaagccctcacaaacatggcctaattacaccgataaacactacacaataagatgaatttactaaacttaattatttaatgattcaatcatgtgattatacattaattattttctaattatacattaactgtgcttaatgaatttgtctccacatttagtatttagttatgtaattagttttatattcccttcgtcttaaattaaaattcgttttatttttactggattcgtataataattaatgtatatatacatatgtctatgtttataatcatacatatgaatatagatataaaaattagagctaaaaagactactattttaagacggaatgagtagtaagattatttaaatatctgatgtgacactaaccaaactctctcgtccaaatactctccgctctactaaagataaatattctctctatttttttatttgtcacattttaatttaaaaataaactagctgaaatgcatgctagcttgccgcaacgactcggacacagcttttacttccacgaccacagattcccgttgttggagcgcagacgccggccgcagacacaagtttaccgagcgaccagacggcgggagccgtcacgcataaatatacccaccacttcacacttcctctgtcgagaacgaatgctgtctcttcttcccttctatcgagaagctgcccgcgcgctccctccgtagagtccaaaccgccacaggaagcgcaacagcggagtctccaaa

SEQ ID NO: 442 - DNA, 197 bp, Zea mays
aggacatcatccccttcttccagaacgtgaccatccccaaggattggggcaccgtccagcagtgctacatctacctctctggacaagtgaaagagaagctgggcaagattgacccctactttgtcaagctcggtgatgccatggtcacatggattgagcctgggatgagctgaacctggtgacccctgctgtcgcaa

SEQ ID NO: 443 - DNA, 1500 bp, Zea mays
gcaccggccaccggccaccgcagcgcaagacgacgacacggcactggcagcagagcagaacagagcagatgagaggccgggagtcgggaggggacagcgtcgccaggtcgcgggagcaataatggctcatggccggagcactgcgcagatgagagagagatagagagagagacggtcgaggagaccggccggccggtcgctgtcgtgtccggatggctctgccagcgcccgtggggtggaggacgccacgccaggacggtggccggtgccgtggcctcaggtaccggcacatggccggcgcgagcgagctggcacctggcagagtgaaagcgaccaccagccggcagggccggtccctccctgcccccgatccagtcctgtccagcactgcttgcttgcttgcttggcgcgggggtgggcgaatcagaaaatggtgagcccgcgcacgcttcggctgcagcggcggcctgcgctgcggtagagacgagatcggggtcggagtagcacctgggcacagtcgcgagctgtaaaagatacgctatacacatgcagtcacacatgcagtaagaaaaggatgcaacgacggacgctatcacctgcgctattttgcagtcacatatccagaactctgcaggtagagctgtacgggcatcaacgctatagcaataaaataaaccggacggaggtagagctgtacgggcatcaactctgcaggtagagctgcaggcagagagcagcagcatgggtacggtgtgttggtatagagttgagatatagagtaaacatgactgcggaggattatggtatagagtagataatcttgctgacgaggatagaatattcgttttagagtaccaatttagagtagtatgactgcggatagcctaaacatcatgtgtccaacctaggccaaggcgatggccacgtgttccggggcgcgcgcatgttgtcctataattctccttgttgatgtctatacgagtattcaccagttttctatttaagttaaatatgttgttagtgagtgcatcatttgatattgattttactctagcttcacatttgttattatagtttctcaatccttaagcccaagtgcccaacagcccccggcgcgcgggcgagccgacgagagtgggagtgtacggcagcggtagggtgggtttgctctttgattggccgcggctaaacaccaaaccttggggaaatggagctgctcagtggtgcagtggcggagcgggagcttggggaagcggaagcttgcgagcagccagagcactagccattacccagcgctaccctacactgacaagtccatcgatctgatcgcgctgctgctgagtgcagtgtgtatacaaaaggccgtgaaggcggtaagaccgagctgcaaaggggtgtgagggagaagcgagaagcccgtgagctgagctgctgcggtgctagggagccagggtttcgtttcgtttcgtctcgtctggcccctcttctcttggcgcggcc

SEQ ID NO: 444 - DNA, 1047 bp, Zea mays
caaccaccaaagtgaccgttggtgagggcttctgtcgcatggcgcaccggacagtccggtgcgccactggacactgttcggtgtgccagccacgtcacccggccgttagggttctgaccgttggagctctgtcagactgtggcaccggacagtccggtgccgcaccggacaggtactgttcactgtccagtgcgccttctagcgcctgctctgactctgcgcacactctccgcgcactgtaacacttttacaggtttccgttggagtcgaccgttgcgctgtagccgttgctccgctggcacaccgggcagtccggtgccacaccggacagtccgatgaactatagcggagtggcttttctagaaacccgaagctgagcaattcagagttgatctccctggtgcactggacagtccgttgcgccagaccagggcagccttcggttggttttgctcctttctttttgaaccctatcttggagtttttttattggttcgtgttgaacctttggcacctgtagaacttataatctagagcaaactagttagtccaaatatttgtgttggtcaattcaaccaccaaaatcatttaggaaataggtgtaagcctaattccctttcagcttttatgacccagcacgcacccaaacccaacaccatgtgcgacctcgagcctggcgacgttttaaactcccccacacgactccttggtggcgacacatatccatccattcccctcgccaagccgccacggcctgactttccctcccgcacacccgcgaccatacaggcaagtcaggcatacaccaacaacgctcgtcgtgcacctcgcgcctcaggtcaccccaccaaattcctcttgatacgccgaatttcttttgctaattctgctacctcctgtcgctaagccaccatattcagtctaacccctgctctgagctcacctgattggcggctccgttcggcctctgggcctgggtgtaccgactaccgagggctctttcgaaatgtcaattgggtcgagtttggtgggctacgtgaagcatgg

SEQ ID NO: 445 - DNA, 220 bp, Zea mays
ctctctctctctctctctctctctctctctctctctctctctctctctctctctctctctctctctctctctctctctctctctctctctctctcttctcacaaacacaagaagcttgctcagcttagtcagctcagcgcctcagcctcgtcttaaagctagcaccagtaggcgacgctgggtgggagccgagctgcgagcctgcgactgcgagggcata

SEQ ID NO: 446 - DNA, 453 bp, Zea mays
ggctcctaggaaaccttcggggcaggtgcagctgccgttttaattgcactctccaaagtcagaacatgctatgcagtgaaacttgatttcagctgcacgaataatattgctgaatacgaagctttgcttttggggcttcggaagttgaaggcaatggggataagaagggcggttctcaaaactgattcccaagttatttctggtcatgttgacaaaagttgcaaagcaagagatccgaagcttgagaaatatttggatacagtttgaaggcttgaatcttccttcgaagggttttctgtcaagaatattccacgaggagagaatgaacacgctgatctgctagacaagtcagcggcacaggggctgcctttaccttcggaagtattctttgaaacaataaaagcagtgttcaatatatctcctgttcatagcgaagattggagaactgagatc

SEQ ID NO: 447 - DNA, 1500 bp, Zea mays
gaggttcagcaaggcctattggtggtttagagaaaaaaacaaaaaggatccgaaggaagaagactaatgttgatatcacagtaaatcaatttgatggccaacctctcatacatatgcaaccaacaatacaaccacaaaggcatgccataacaatggtataatcctagttcgttgtaacttcatatccctctcaatctcttattattattgtggaattaatattttctgttttttaacttttttaggatcacatagagctgccagacactcaaaatttcaatcatatatcagagtaccatgcagctccaatagcttcatcgcatccatcattcaacatccatatggcatcatctgagcaaaatcaaggcagccaacaacacatgactatcaatccatttagcacaacttcctacaattttttaaggttggatggtgccacatgtactgacgatatttaatagttttggtattagaatatgttacatggtaaaaaggctcaccatatatagttgtagattttctttcatgtactctttagcaacatagagtgtggaactaacttcctgctacatctaatcacgcataaattcatcagtacataattttaaatcctagcaatttatgtatagttcaactgaaatagaaatatgtcagaatatacaccagtacactatacaatacaataatcaataataatcaaataactctgaacgaagacaaagagataaaaaattacagagcataccaacacagagataaaaaaaattacaaagcataccaacatagagtcatagacaaaatcatggagaggccggtggggatgggatgcggcttggctactcccgaacgctactcccatgtgtgctccagccacgtgttcaatctctatttgtcccatgtaatcaactccatgtgtgctccagccacgtgttcaatctctatttgtcccatgtaatcaacttccaccgttaatcccacgtctctacaacggttggacccactagaaccctttgcttatttacaactcatgtcgttagattccttagcgtgccaaaagtaaaaaagctaccgcctagaatacacatcagcgccaagacctcacaaatgccccgccaaaactagccataaataaaataaatatttttattccacaagcaatcacccacaacatagaactgcatctatacctaattctatagaacacaccatatgatgcaatggacccatcagaattctacactacttcagcacagacgaaggatcctgctaaagttgtaattccatcattgagtttcacggctgatcctcctggtaggatgggaatatctggagaatatggagagaacctaggaacatcaccgcatttgagaggggtaagatatataacttcattcgaattactcatttcactcatattatttctcaatgtctaatgattcacactaaaattaggatactggaaatacttcaacatatcaaaataacacttgtccagaaaac

SEQ ID NO: 448 - DNA, 573 bp, Zea mays
cacctccgttggatcaacctgcgcctgtgagcaagttccaacaaaatctttctgatttttatatttatttcagatttttaaaaatttaaatgtttttttaactggaaaccatttccgggccgggctcggccggccgcgagcggcggtttttccttccctggtcccatcccattatcccaccgaaggtccgaagccgagccacggccgccgaggcgtcgcctccacgggacgggaccgcctgcaccaaggtgaggtaccataccacccgtccaccgcacgttcccacccaaacgccccgccgaactaaaccaatctgacggtacgagcgcacttgattcggttcgcctccaccttcctttattatagttgtagcgtcgccgctcggccgggcacgcacgcccagacagacgtagaccagatcggggaccctcgcggcgcccagttcccgagcgaacccaacccactacccacagccaaaagcaaaagcccctcgccttttccgcgcctcggttctcctcccgtccatccccgagcggcgcccgcggcgagaacgaccgacgacgacagggcgag

SEQ ID NO: 449 - DNA, 786 bp, Zea mays
ctaaatggacgatctaggacgatgttgttagccaataaaagtacataaacatgttttggaacccggagatgaacaagcgacttgtatcattcatgggcaggacgtgtgacgtgtcctgtctcaagcatcccgtcccatccgggacaccggctcagttccagacttccagtcccccggctgctttgcggtcccgcagctagttgggctctgggcctgggcctagatcggacccagcaacatgtggccggaggcagcagaaaaccggcggcggccgccgttcccgggacccatcggcgtcggcgtgtctccatttcccgcagcagggcccattggaagtttggaattggaaacccaaaaagcataggcggggggtggcaggggaagcacggagcaagagattcgtttgctgccattattaaccgagccgagccgagagaggtcaagcaacggacccccattcgcatctgcctccttttccttggagccgaagaagagggaaaggaagggaggacagccgccgccgccgccgccgccgccaccgtcaggatgcattccacgaacctcctgctcgaggagcccatccggatggcctccatcctcgagccctccaagcccgtaagccttycgccgtgccgcccgcccgtcgtcatgttcagattcgtttcgtcgctgattcgtgcgggatcggtcgcggaacccctacctcgactgagacctgactaacttttgcttttttcggttcggtgccgggcggatccctgcctggatcagagctacttcccggcg

SEQ ID NO: 450 - DNA, 1500 bp, Zea mays
gaactccaatgagggattccctaacgctacagctcctccgaagctcgcggatcccacaagcgcacacggggcaccccgtggatggcccctgaccccttcaaatgatccctacggtggtgtgcggatgtaatggcggcggcggcgagtggctagagaggggcactcgggtttgagggaggatagaggggaggagggcccaccccattttatactctgtggagcacgaccggagcaatcagagtccgaaccctaaatctcaccatggtggttagagtcatttggctagctggagcgcgcgccaatggcggcagccgttacggccaaagacgaccacggtgctaggctgacgggtaggatccctggtccagtgacctccacgcgcgcgtgaccagagcggtgagcgagggagtgtgggggcaatcagtcagtgcctggggtagacagctgcacgcggttgaagacctgaccggtggggcccacatggaagcgactgaccatgttagggcgctgggccgtgcggtgagaacgaaatggcttactgagccaaggggaggggatcaaagttgggcccaggcgcaattctcttctttattcttttcctttttctggtttttctttcccttttcattttcaaattcccaatttgaattcccatttaaattcaacttcctggtagacttattttaatattaaatgtctaagtcaaacatggcatggggttaacttatctactttattatttatttagtgattattaatgcttctcttttctccaatttctaggattccaatttgagtactaaattccaattcaaattcaaacttgtggtaaacccacactcagattataatattgtcggcgtttcgaacccggggggtccctggaccgacgagtaaattgtcgccgcgtgccccagcccagatgggtcggcgcgagatggagcgcgaaggggggaagaagccggagggagacgggcgtgagaggtggaatcccgtagccttcgtgtttgtcccgcgccctggtcgggtgcgcttgcagtagggggttacaagcgtccacgcgggagggagcgagcggcctcacgtgagcgccgtcccgtccttctcctcgcggccaaccctctgtaagagggccctggtccttcgttttataggcgtaaggaaaggatccaggtgtacaatggggggtgtagcagtgtgctaacgtgtctagcggaggagagctagcgccttaagtacatgccatcgtggcagctggaggggttttggcacccggttcgtgtggtgtcgtggccgtcggaggagcgctggagcctgacggaaggacagctgtcggggctgtcgagtccttgctgacgtcctcttgcttccgtaagggggctgagagccgccatcgtcatagagcgtgcggggcgccataattgctcgtatagtggagcgagccagatgggacgccggtcttgttcccagtagcctgagtcagcttggggcagggtaatg

SEQ ID NO: 451 - DNA, 643 bp, Zea mays
ggggggggtgcgtttggtgcgtcgaactgcttggattgtgtcggctatttcttcttttgaggagtttattaattccatttttggatgcttgaattggagaaccgagcggagttagagtcgcgtaacggtttccccgcgtttcttggccgctgcaaggtgatatgtcttggtactgtagttctgtgctcgaatttaagcattttcgcgaaaacccttttcagaaagttcaccccgtggatcatgggtctcttcttcaattgttttctaagaacaagtatcagttgttgggtttcttgtcggtagtattggtatcacttgtcagtagcctgatatctgaaaaagaataggtttcataattgctctggtgaagcgaactgaattgttagtgctggtttcatagcgtaattagtgaatcgatcagggtcccgatatgaatctagtaggatttgttcagcgtcaataactgtccagatgacgtaattttgctgtcctctcatctgttcggtgtcaaatctttgctggacgataactggccagatgacattttttttttgccaaatgtaggcatgtagctgctacttgtcagctttcaaaggtttctgcatctgcatgacgcctaatctacattgttaaaggttttctg

SEQ ID NO: 452 - DNA, 1500 bp, Zea mays
caattgaagaraccgtaccaatgatatttgatctgtcatttacggtaaaaatgcaccatttgtgcaatatgatgtgcaacaagaaagaaaagaatgggagaagttgaatataatggctttaatctaatgtatacctataccgaacctgtgctatagagagaagactaatgtaaactaaaaaacaatgctgttttattttaaagaaattattttcatgtaaaaagtctaaatgttaaggttagtctgggaatctcatttttaaaagaaattttcattttcttataaaaaattagctcattttttctttaaaaaatgaaaatcttttttaaaaaatgggatttcaagactagaaaactaatagcgtgggcaacttgtcagttactagtactacaccaccccacgtccccaccaggctttttcgctgtctactgatataaaaccaataattacacgaagggaacggccaccgaactccgtccgtccgacgcacacacgccggtaaatttcctccccagttgattccagcggcactgcacttgtgctgcctgcgttcttctcccctgagagctgcggaaagatccaagcgcaaggccacctaaccagaaccaaacaaggccgcctccggatcgccgagcaaattccatattattttcctcccgtttcttgtttttctcctctcgcttatccgtctcccagaaggagagggagagggagagccgaaccggggtgatcgttgccgtccctgtcacccccacaccccgctgtcgtggtgtcctatgcgactcgtttgttgccgtcggtcgcctggttgattaatccaaggccaaggatctcccctccacgaggacctccggagaggccagggtgagctgctataaagctatttctcctgtccacccccacttcttcctcatgctgtcatgcaacatgagcagctcttaagagcataggaggaggggttgattgcggctcggagattcttctcgcgtttctcctgcactttccgtctgatatttatcagcttcttacttcagtccagcagagttcctttgcttcattgctcgctttgaaggggatttttactgctagtctctgagccgtcaaatttttcaccactcagctgtactcccccacgtccaccaggcaagaacagcaacgtcagtttgcagcagaagaaaaggctctccctccctttgtattgaaagcacaaaaaatcctctttatctctctgactccttcccctcactcacaggtggctgcttgttgagtccagtgtgtcagtgtgtgccacttctctcacaaacactgcgagcttgtccctatcctgcaagaaacagcggaccaaagcatccgctccatttctccgctagttcgtgcgtcgatccaaacgccaatcttggatttctgccgcaaggactgtgcttcttgtagcaaaagcccccaaagatttgatccaagccagctcggaatcggatccctgcgaggaccaggcggcctgcc

SEQ ID NO: 453 - DNA, 521 bp, Zea mays
acctaattaagccatacactgttgttagtggtcatatatagttggatcgatcgatgatgcgctttgggcagcaaagagtaagggtctatctggtttgctgactaatttgccacactttatctaccttttctgtctaagattagttattcaattcgaacgactaatcttagttaaagtgtgtagcatagttagccataaaccaaacggaccttaaatcattatgatggcaagttaaatttggtgtccaaagttaatagcagtagacatgtaaaaagatgtcttattagctgacagcaagcacccatccatttcaacttctcgtctcagtttgtacgtagcattacacatgtctagaaacattttacatttgtagttgtagctatatatatatatatagctctcagcagcatgtttaaagtttgattgtgttgtccagtagtacgtacgtacaaagctctagctagatacgacgtcaggctcgtcgggcgtggaaggagaagccggcggggaagaggtggaag

SEQ ID NO: 454 - DNA, 1500 bp, Zea mays
aagaaaatcaaaattttaacataagtatccggagacacaactcaagtcaatcatcgccacgtgctccacgcgaatatcaataaatcgatggggtgggttacaagaccgactccaataagaaatgctaaacgttctgcacattacatttagttatacttagaaaagattctcagttatctaaaacatcaccctgtttgaatacacaagagatagagataattgttagctgttaaaattagctgtagatattcaaacaatttagctaatagtttaattattaactaattttaacaaattatagctaataattagctagttaatttcacccgcattttttagctaattaaatattatctatactgcattcaaacatgcgtttctcacttttatttatagattctctatttattttaatattttaaataatagattaaataaaattaaaatatgtataaaatacttgagagtagtacgtgcatatagaaatctaaagaaaaatgataaaatatacgtataaaaatttagagcaaaatgctaaaatatatctatttatatatacaaaacgtacatagaggatgctactactatctagggccataaaataagctcgaggctcactgtgccaaattacttaatatatagaataatgatggatattggataattttatagatagttagtttgttctttaacgtttcataatagatatatgaaaattcataatttagattactcataatgatatctatatatttcatatttatatactaataattcactatataatgcaattatatatatcaggatgtggctcgcgaggtgaaccgagccagcctatctccacagctcgtgaaatgggcgagccgagccgagctcggtcagccaccaaactgcaccgtcgagtcgagctcagctcgtttctagccctagctactcccaataaataagatatatagtgaaaatcatttagacccgtttgattcctttcattttgagaaattgaaatcttactattggaatatgctattttttagaatgtggcattccaccactttccaaggttatcatataaacctatctcaaatttatggggtgagagataaaaattgattttatagatttacatgctatttttctaatgtacaacttataacacactcttttacttgcttcgttataacatgaatgtagtatataattatctctctcatatgatttaagataatatacaaatatattacatttatatatatatgaatttaattagttttgtctaaattataattattaaaatgaaatttaatttcaacgaaacaaatgagtccttagagaaaatagtagaagaggaatataagaagacaacgagagatatagataacactggactggcaacaacgacaagcaggttgctccaggctccacgcacattcaaacacccgtcgtctcgatagtctcatcacctcgtctgataagacgcacttggtgacttaggttttagcc

SEQ ID NO: 455 - DNA, 882 bp, Zea mays
ggtttgagcagtaatagtattgaaatggttaatcaatcggagtgtattgaagaataaaaagattctgttgccaccggtgagctggagggcagscgtgagaccggagtccggacgccacggattttgatttcatcgtatcgtatctttcttcagaggggagcggggccggcgggccaccagcaacctcctcctttttgctccacctggcttgccttgcctggtcctggtatatctactactacctctgttccttctccttcgccgctgcttccctcctcctcctcctcctgctgcagctcctcctcctcctcccccctgggacgtctaaaggtactcctccttcctttccacctgcttgctactactggtgtagtgtagtgtagtggtgatggcggtggctaggcggcggccgatttagaacggtaccgtgcaaaaataataaatgggttgctgatttgtggtttcctaagcttgcagcttgcttgcactttttgcctttttcggaggccacgggtcaccgctaacctccatccatccatttgccgattcacctacacagcaggtaccctaaaccctctccagccgcatccacttcttcttcttctttcatctttcagaggactaatttctcccgtagccgtagatgtagataccatacgatagttgtttttaattacttagctacgaggacaaacatttgttttaattataccacacgtacgtactggtataattgattctcatctttatcttcttgttcaatttgcatgcaggaacaaacgaggagccctccaaggatatgcgccccgccgcttatacattaaccaaagacttgcctccaatcaatcccaccactcgtgtctacctcttcgagttgcgagg

SEQ ID NO: 456 - DNA, 150 bp, Zea mays
ggtacgtacgctccggtcccccattcgcttcggacgatccgactcgtttttctgttccttccctcgcttaccggcgaactcagcccgcttctgcgtcgaaatggatgaactgccgcagggaggggagggacggcggggaacaagttccgc

SEQ ID NO: 457 - DNA, 1500 bp, Zea mays
atctctagcacgataaacttagtttaattaattatgtctaatccgttgttgttagcttaaactttctagcctcctatgctaagagagttctctagttctactcaggtggattgatatattaattgggaatcttctaggcgtcacaaggtatggtacacatcaatccatgaacggacaaagcaacggtaagatccgacccagtaaaagtaatagcgttaacctaagttatcctggacgaccacgcgtggcaattaaaaaataataatttttgcctcctaaaacctctttcttaattggttcttgattgcaaatcaccagcgaacccatatgaaaggatgctcaaaatctggccaccgcatcagggttggtggatgcaacgtaaaatataatgcataaatcagctctctgatcagttatataatcgtgccgtttaattattcatgccagctttatctgactcacgaaatcattggtaaattattcctcagctgtattagaaagagcagtgttgtttaacttggaaagtgatgtggaagcgtgtgattgcggttgaacttgtataggagtaaaatgaggaacagtaggaaaataaattttcggattaaaacgggttgtttggactgctgcggatataattcatagagataaaaacaccgtagaagtattagaagccggtaaagattaaatccaaatgaacgaacaggctaaacaaatccggcgcctcaaaagtcaagagcaggtactgggctgtcttgcacatgtcgctttttgtctccccctgrcccctgggtgagagtagtagggatgctaaagtttgctttctctttttgaggcatgtgataggctctagttagttgctagggctatgtttataatatttgcgcttttacctatgtatgtaagaaccggatggaataatgctatgcaggaaccaatcatgtttggtcgaaatgtatagtgacctatcagtaagctcagcacctgccccatttcataatgttatccctgttcatgtaccaaggtggctaatgatatacggcatatgaatacagtaatgatccaagcacgtaaaaactcgctagacgtttatgcctgctagcctgctgggtgtgtagactggagtactggacaaacatcgcaatacagaggtacagtatttgtctagccaatgatatacatagatagaaaaccactgttgtacgccactatagctcacgttctccatgagctcttctctctgctgtttcttcctctgctaactgcgttatgatatgacgtcgtataaataatctcacaatacttccttattttcagcatggcctcctttatgtttatttaacagtagcaaccaacgccgatcgatgtttccttcaagaaacggccactcactatgtggtgtgcagaagaacaaatgtaagcagctcctacgggtaccagtagtcatgtcagtgtggaagctttccaaccaacgcctccttcgaggaacccggtcgtgctgac

SEQ ID NO: 458 - DNA, 1500 bp, Zea mays
tccccgatggtgatcgacgacagtgagcttgcattttatgtgtttagtgagacttgagacttccgtgtcttataactatggatgagacattattgtgatgaaattgttgagattatggttgtgattgtgatgtgaaatgatattgtgatgaaaatgctgagattatggttgtcattattcctatgtgattgtctgtgagatgttttatgtgaaaatatggtgtgatatggctattaatatatttgttatgttgtgatatgtggtgtaaaatgaaaatgaaacaacatttgtaatattggtcaagttaacttcttataagctattgaagtcgtagagaaagttaatcagctaattttctagaggctgctgtaaagtaagtggtaggaaattagctgactaactttctagaggctacaataaataataggaagttagctgattaactttctataggccataataaattgtaggaagttacgtggctaacttactaagagactacataagcggtagtaagttagtgggttgacagcgctcgactcctagacgacatgaacgagttaacttccgagaggcatagttggctctaggtaactttctagagggctctaaaaagttaaactaacttcgaaccataatttttcgaaagcttaacttctgatgtgatacggtttcgttaacttccgagaatttacggccaacttactgctctacaaagttaaataggctttttagtgtttgtaacatcacgtgtcagcatcagacacgctcaaaaatccatgtataggagatcaactcctgacccatgatagaaaggtcactaatctcgaacttctccactagctgcggttcaggcaaaggtactcctcagtaagctgtcaccatttcaaaaagcaaaaagctataatctataaacaaatacgtgctttcaaaattgtacttctcaaagccattattccgaaaaaaacatctcctgatttttacctcttagtagagttttgattttctcagtgaaaaaaaaaacagctttaaaaacccaacaaaacaccttttattttgagatgtactagcgagtaaacatttttccttccgtaccacgaccatgacacggctctccgccccggctctccgccaatcgtcccatgtgctgccaccttggcgacccgagtgaatccttcacgtacgtgtgttgcactgcacccatttccaaaccaccgaagcgaagcgaccagaagcctgttaccccccaaggccaaagcgatcacggcgaccagcgagacgacgtgtgcggcaacgcgccacttcagccggacaccggtcgccgcgccacccgcctcgctggaacacgcgtccaaactccaaacccgtctcgcccataaaaccttccgctccccacaaaacccagcacgatctatcacgacgatcagcgcgtatccctgacaaaagcacacagacagctcgtattcgcggctgcaaagctcgagctcagaaagatcagca

SEQ ID NO: 459 - DNA, 223 bp, Zea mays
ggtgatgccttgcactttctaatgttacccgatcccattttaggggattaaaaataaaaaaatataatatccgtaaatatatatttccatccaggattctttcacactcggagtggtgattgtcaagcattgtggatatacagcaactgtgaaggtttctggacgtgcaaaggacagtaatgatgttaaacaaacacatgacgtctctgataattttgatgga

SEQ ID NO: 460 - DNA, 542 bp, Zea mays
gtttagaggtaaaagcctaaaatagactttattaggaagagatatacaatgcaacgaaacacctggtgcaaccgcggtacagggatgaaggtaagaagactcttttatatatttttttcaaaaatcccacctttctatggatattttttaaaagttttttccaaccttcatctttgtgtctgcaaagttgcacaaatgtgtttaattataccagatttattaccttttaataaacactgaacatgggcccgtccgaggccaggctttgcttttccagctcggcaacgtgcaacgtagatcccttcaaacccgcgcccgaggaactagccgttgccatccccccacttcgcccactacctcccaatcccaagtcccaactcgctccccattcgcctccctcccacccggctcctgtcctcttcccctccccaaccagcctccctcaaattcgccgatccccagtagcgaaacccacactcgacaatcctctatcagaatcccgctcccctacaccacggtagctgagaagacggccggcgaag

SEQ ID NO: 461 - DNA, 1185 bp, Zea mays
caaatgcctcgacggatggtgggttcgaaacttcggatgctagctctcccaactctccgtgcgcaatagatttgggagggggaaaaacttcagtggcagctcaaccgtgaaaatagaatgaaaataataagagtgtattttccacatacgcatttgaaggattgtgtgcacttatatagatgcaagagagtaggggaagaggtgctgtcaaatagcttaatgacaaccatcatggtcataagaatgacagttacaagtaaggagggtttgtttgggattataacactccctaactctcaccatcaaaatggttgttactagtaacttaccaaaccataaggtagcacctataattcacccaattactcatcatacataactcctagcttaaacacgagccttaaaatttgtagaatattaaataaatgatccttaaatattctagaatgagcaaggtttcctcgttgattccccatccacgtcagcgtcattccgtggactggaaatctgaggaagagcgaagtgtcggtcggaccgctctagcggcgcggtaatcccctccgtcacctcacggaaaccttgccaaacaggcctacacaggcggaacagaagagcgctgctgcggcgtgggaggccatcgtccgtctggtactctggtgcggtgaaaaaaagcgctcgccagtcgccactgcactactgctggctgctggtgcactgggccgcaccacacccagtctaacttttgctgccgctgcaggccggtcagaccagacaggcagcaggcagccagccagccgcacacacgcaagcaccggcccgggcccacacgcctttcccagcccgcgcatcggaccggaccggaccggaccatactggaccggaccgcgcgaaccggtggtccaagccaacgcggccgtgtcaccaccggctttctttctgtccggacgccaccgctgcgtcacgctgtctactccctacaaagagaccacaccgaatctcccctctcgtctaccctcctctccttcctcgccgcacacacagagtcacagacacacgcaaaaacatttctcccccctcccgactgctactgccgctgcctcctccccctttccgcccgccttcgctccctcccaacccccttcctcctccgtctagggtttcccgccgccgcctgatccgagtcag

SEQ ID NO: 462 - DNA, 1500 bp, Zea mays
aaaatgagttacaagaccccacaggatgacaaggactactttaaggccgtggtgcttgctacttgctagggttggttggtcaactagtccaaccataatcaccatacatatcgatcgatctattagcccctcaacaaacatccagttagctaaagacgctctaaccaactatacctgttggcatgcttgtgttgtaggtaagaacgtgtaagctgacgactgacgatatcccggatttgacatgttgtagctaaacacgcacgatgcgttgggctgaggattttgaagcaagccaagttgtcaacagacgttcgtgggtatgggccgttcgcccaacaccaccaaactactgcgaactccagccgggagcccaaccaacgtatcctcccccgttcatcttcttctccctcccacacccacaccacctcatggtcaaaacacacggcgccgcccgggcctgggcgtacgccggcacggctccacggccatctatttatgccacaggtctcgtccaagcccgtctcgatggcacgccacatgcttctgctacctcatctctccggatcagccagccaagccaaccaggcgaagcagcagctagcattcactccacctctgcatcgcggtcgcgtttctacagtgccactactatctagctccaccacactgatcggtcggtctcggatccactgagtccactcgcgccatcctcgatcgatcggtggatcccccgtgctgtacgacaagccaagccggttccagctagctgcgctcgctcgtcttcaatgcctccccggccgtgcattcaatggccttggcacggttagttgcgcgacgtcgcggcagattggccagtgcgatcgagcccgcggatcggaggccagctgttggcgggtaagacgccgcgcgcggcccggccagcgaacgtcccccggcggcaatttatgggcgaccgcccgtgccgtttctcgttccaccgcctactagccgccaccaaccggccgcctcttcgccttcgccggtgaagtgttttgctttcgttcatcagctgctgatgctcgatcacccgtccacagtacatgtgatgtacagtacgcacgcgtacgctgctgccgcatcaggaacggcagtttttttacacgctggtcgttgccttgcctgttgcctgtagtgtaggaaagctttgcagcttgagctaggggactccgggagggagtatagtagtggtagtagtgtgtgtacgtacagtactgtgccagcaattaatcaccatccctctcaactgtgcaagctcgatccgaccagttctataaaacctcgcctgcagcattctgccatccgtcacctcccatcgtcattgcttgctccatgtggagtcactttattactgcattacactagctagctagctagccacagccagcttcatcttcacgtcgattcgatccatcggtgctgtgtgtaccgtacgccagcttgctgatccatcgccggccgacg

SEQ ID NO: 463 - DNA, 68 bp, Zea mays
agatgagcttatcgcttgttctcttcctctctctcttgtcgctcttgagatgagatgagacgagggga

SEQ ID NO: 464 - DNA, 561 bp, Zea mays
gttgtaaatttcagactgcaagggtgttgtggcaaatagcacacacatggagtggctctgggcctaaaagccaatcgacggtccagacgtatagattgtacaagcctttggagacatcgtgtccgtcagttatttctcttcctcctccaaaccaccgatgtcgctaccggttctatccctgcgctgccattgctcgtccgcatcctccttggatttccctcccaggtacgcctactccatgcgcacgcattcctattccgattcctgcacattccgtggaccgatttggaaaagctgaactggtacatagcgtatctttctctcaccagtctgctgacggtgatgtttataagcgaatctgtactcatatagatttcttgtcttcttacatcgtcaactgtccagctagagatttctgttttcttagatatcttctgtcttcttaaggggagacgaggagggcgcataaaattcacaagaactgtttttgatagattcacaatttgccgtctgagcatgcgaaggctgatgtgagctgtgcaggaaggttagggttttctg

SEQ ID NO: 465 - DNA, 364 bp, Zea mays
cttcactcttatacataaaagcatgatgagcgcgagagtgagacttcttagaataaattctcctaatttgtgctcgggataaccggcagggtataaaatgtaaccctcgttatcctgagtcatgggagctttgcccttaacaaagttagacaatcttttaggggcattaagcttaacattgtctcccttttggaagccaatgccatccttaatcccagggcgtctcccactataaagcatactacgagcaaatttaaaattttcattctctagttcatgctcggcaattttagcatctagtttagctatatgatcattttgttgtttaatcataacaaggtgatcatgaatagcatcaacatta

SEQ ID NO: 466 - DNA, 1500 bp, Zea mays
atttatattggctcaattccaagcaacctttgcacttgtattatgcaaactagttcaattatgcacttctatatttgctttggtttgtgttggcatcaatcaccaaaaagggggagattgaaagggaattaggcttacacctagttcctatataattttggtggttgaattgcccaacacaaatctttggactaactagtttattctagtatataagttatacaggtgcaaaaggttcacacttagccaataaaaagaccaagtattgagttcaacaaaagagcaaaggagcaaccgaaggctcctctggtctggcgcaccggactgtccggtgtgccaccggacagtgtccggtgcaccaccggacagtgtccggtgcaccagaggactccaactccaactcgtcaccttcaggaaaatccaaaaccggcgcgctataattcaccggactgtccggtgtacaccggacagtgtccggtgctccaacgaagacgctgctctggaactcgccagcctcgggatttcatgaaggctgctccgctataattcaccggacatgtccggtgtgcaccggactgtccggtgcatcctcggagcaacggctatttcggcgccaacggctacctgcgacgcatttaatgcgtgcgctgcgcgcacagaagtcaggcgtgcccatactggcgcaccggacactcaacagtacatgtccggtgcgccaccggacatccaggcgggcccagaagtcagaactccaacggtcagaatccaacgacattggtgacgtggctggggcaccggacatgtccggtgtgcaccggactgtccggtgcgccatcgaacagacagcctccaccaacggtcaagtttggtggttggagctataaataccccaaccacctccacattcatggtatccaagttttccacttctcaaccacctacaagagctaggcattcaattctagacacaccaaagagatcaaatcctctccaattccacacaaggctttagtgattagcgagagagatttgccgtgttcttttgagctcttgcgcttggattgcttcttttctttctcacttgttcttgtgatcaaaactccattgtaatcaaggcaagaggcaccaattgtgtggtggcccttgcgggggaagttttgttcccggctttgatttgagaagagaagctcactcggtcggagggaccgtttgagagagggaaagggttgaaagagacccggtctttgtgaccacctcaacggggagtaggtttgcaagaaccgaacctcggtaaaacaaatccacgtgtcacactccttatttgcttgagatttgttttgcaccctctctcgcggactcgtttttatttctaacgctaacccggcttgtagttgtgtttatatttgtaaatttcagtttcgccctattcaccccccctctaggcgactatcaattggtatcagagcccggtgcttcattagagcctaaccgctcgaagtg

SEQ ID NO: 467 - DNA, 198 bp, Zea mays
cgtatgtgagctcactcttgctgtctcacacccccccacaggagaagaaaaggtggttcaggaggagccacaaggcgaggagtatgatctgatctaggtggcgtttctcagtcgacattagcgccgacgatccttagttcgttttatatttgttcttttactttgtaataagtcttccgctatgtaataattactctg

SEQ ID NO: 468 - DNA, 485 bp, Zea mays
atcctctatagtcgttctgcagttagagctttccttccggtggggtggtgccaagctagctaaacacaccgtaaaatacaccgtccacggacgatgggcacggcacgttcccgtcgcagatctgacagatcctccgccacgcgccgacccgagcgagggcaaagccaaaaacgcgccagccgtccattggctggccgtcgcgggatacggcggcaagcacgtccagctcagcccacgaccacgacccctctctccctccgcccccgcctccacggtcggcgcgcccaaacccgtctcctccctcctcctcaccccaccacaccccatccccacctcggatctgctgcccccaccgtttcaaatccacacgcgaacggaaatcgagcgggcgaattgaatcccgtcccgttgttcgggttcggccagcgagcgagcggcgtccggccggctgggcattggttcgtgctcgctcgatcgatcagaaa

SEQ ID NO: 469 - DNA, 350 bp, Zea mays
atctataagtcggtttcactttttgctaccgcgccgaagctttcctgctcacaccttcggctctgtatcaaccttcgtattactctggtctactgtgatgctgacttgaatccgaagatacctgttcacacattatactccagaaatactgttaaatcctgtttttgaggaccttcggatgccgaaggtgcccaacactagccacttggcattcattgtgctaacacttaacaagtctttgtggctataagtttaaacttttacaggatcacctattcacccccccctctaggtgctctcaattggtatcagaggcgttctcttcaagaagggactaatcgcccgaagag

SEQ ID NO: 470 - DNA, 70 bp, Zea mays
ctcagctgtttacaccgatctacgagtatccccacgagaaacccccattccaccatcctctacccaccca

SEQ ID NO: 471 - DNA, 195 bp, Zea mays
ctttgatacttcctttaggtaacatatataccaggtgtgaactaacctgagacttgtggactttgcttgaatctcttttgtggggaagatctgttcactgagcatgatctgtagccagagcttcattgtatatgctcatttcattgtgtggttatttttgtaattcagtcttttgtgtaggacatcatttgctag

SEQ ID NO: 472 - DNA, 130 bp, Zea mays
cgtctcgcaggtgcgtttgcagtttgctgtgcaggtcccttgcacatgtgacaggttgagcagtgagcacttataatttataaatttaatctgtgcaggtcagcaggtcccttgcctccttccatggcgc

SEQ ID NO: 473 - DNA, 1500 bp, Zea mays
ggtggacgaaagaaaaaggtggaatacaagtctctaccatgtctagacaaacaaatggaatagtctttttatacagaatggagcgggtagcgggaatcgaacccgcatcgttagcttggaaggctaggggttatagtcgacgttggttgattatttttgacgtctctaattcaaaaccgaacatgaaattttgatttcattcggctcctttatggatattctcaccacttaacatctatgtcagcttttctgtctgaatggaaccaaagctctccgctttctagatgatccctatagaataggagatagaaattctcctaaatatctatctaatctacttacttcgttccctaatttcattcaagagatcctgaggaaaagagttgggtttccaccgagctgaaacaatataatatactgatggttctagtaaaccaaaaccatcgttttttagctattgggcttccatttcctacaaaacaaaagaagatttagttacgattggaaataaccttttttgtatcttcatccatagatcctttactcatatttattcaatcggaatacttatcggaatacttaatccaatgcaaaattatgcttcgcgactacgtactcataatcgaatttgtattttagatgcaaattcaattagtctttggatactaatcgggagaatgtatattcttcctcaatatgctattgagaggaaaaggattaaatcctttataagaactaaagttttcatcggaatatgaatataaaaaaacttaaggatgccttaagtatatcatttcaaattcagttattaatagaacgaatcacacttttaccactaaactatacccgctacatgtagattatgataccaatgctaccctttgtcaagggtagccattcgagaaggargctaattccaccttatcgaatcaaaggagaaagttcatggcggtgggcggttggtacttcaatcgcggacctttactttaggatttagatagcccctctctagtctgtaaaatacatctcttcttaccataccaatagcgtatgaaccaaatgtatgcatttcgattaggatctattctacggttatgactacaaggatcattatttgtgaggacgtaaatgtgccagactgttgtaaggaatcgtttaattattcctacaatatatactaagagatataaaggcagtacagtccccataaatccctttcttccttttcttttttgttcagaattgaacaaagaaattgcgaaagatgttttcttcctccacgtatcatgaagtgcgagccatagggaaggagtgagatgactttccaaaatttttcatagacttcgtctatcgcttgagagaagcaacaaagagtaataacttaaaaagaaaagcagatacgaatcgctggttagtcgatcctctccatttcttaatttcctctcttcttttccactcaattctagtttatcagattcttgtttaaaagaatcaaagaag

SEQ ID NO: 474 - DNA, 1500 bp, Zea mays
attgttaagcctaaagcccacaatgcagtttcgggcccaaaagaggccacttcgccgccagccagctagccagcccaagtgtccaatgcacgaactgatataagaaaccctagcggagccactaacacagtcgcctccttcytgcgccgccgccgccgccgccgccgctaccaccgcctcgcggccgcytgcggctccgcgtttccgcacggaaggtatggcaaccgtcaaaaccttctcactttgtgttcttgccttggactagcttacgcgttcgcgttatctcttgttgtcgctggaaacgtccctaatttcattcccatgttctgatggttttggtcattagatggtttcgttgttgcatctgtaggtgattaggtgtgactgtagtcactgtcatgcaggtaagtacgtccagttgagttttgagttggttgtttgtgcttagctttccttcccagggacggatccaagcaccgtactgaggtgtctgagacgctatagcttttccaatcgcgtagttgtctatttttgtgcgtggtatatggatcagagaaccctctttgcagcagaggtttgttccttgtttatgctgcctgtagtcgcatgtcagtttaaccttttgagttctaaaagtgtttgggagacccattttaatcgaaagcacacgcactcaggtgctatgtcctttgayatttcatagtcacctatttcattgatgtgcgagatgcaccaggatagcacccttgtggcaggaacttacttttgtttgcttttctgctgcctgtcaaatcctgatatttgtgtgtttgcaaacttacttggttgtttaattcattgctattgattgtcaggtattgtgcttgtataattacattttcatctggtttctattgcatttgtagcagattagttgtagccagtagccactgtcttgcaagcagatagtcatagggaggtattatgcctttgcgatggctgtgttgcgatttaggattgctttctctgggacggatcagagcacatgtactgtggcgatatatctgttttaatagtgtagttgccaatttttctgtctgtgctatatggacaagggaacccgctttgcggcagagatttgttctgtatttctgctgccagtagtcacccaacagctaaatctttttggtttgagttgctatggcttttgacatttcatatttgcctatttcattgatgtgcgagatgcaccaggatggcaggatagcacccatgcagcaggaaattagttttggttgtgtttcttctgcttttcaaatccttgaatttgtgtcgctgcaaacttataggtttctgctgcctgtcaagtcctggtttttgtgtggaagctagctttctttgttgcttaatatattgttacatgaacagctgcattgtctaatgtacatataatcaattctgatttatttctttggttcttgtaaaatatgtagttggtgaaggtttcttgaggctgagaac

SEQ ID NO: 475 - DNA, 232 bp, Zea mays
gtctatttacaactaaaaactcactgtagaattatgcttgggtaaactttggcattattgatcacctaatgcttttttatatctccaggatcctgtccaaagtagtgtgactgttggagtttcacattttgagagatgctcgctctgggttcaagttttgtattacccgttttatggaagtggtggatctgcagactatgaaggaaactatgcagaagaagaggattcgcag

SEQ ID NO: 476 - DNA, 1500 bp, Zea mays
taacaacaagtagctaaaaggtagtgaacctcttgagtttatccctacgtaaccctcgccgacttatcctcgcatggctccgttgcatgggggctccagcgcgggaaagtcgggtctttgttgcgatttactcgttcgacgttgtgggccgtccgggtttgcaccaatctggtcttatgtcttctctgctttgctggctgtttctccccaggcccacgaaggaatgacctcatgatttattgggcctttgggcctttcgtgaggtcttttactcctttagtggacctgggggatatctatcccccacaagcccccgatctttgggctaatttagaagtaatcagcccaaagatcccaggtccaacttgcaggtgttttgaagaagaaagtcttcctgctgtcttctcttgctccgatcactcattttgtaggattctgaacacctgcaagtgtagcccccgaggcttaatttcatgcttgtgccttagaggttggcatttcaatttgtaggattctgaacttcattgggtgcaccggaggtgcacccaatgggtgtagcccccgacctttgagtagattttagaaaacaatctactcgaaggtctttcccggaaattatctccatttgtgcccctgcatcttggtttagggttggtcttttaatcttgtccctcgccttagaagtcggcgctatctcgacttggaatgataatccatggggtgcaccggaggtgcacccaatgggtgtagcccccgaccttcaaatggattttttaaggataatccattcgaaggtcttcctttcgtttgtaaaaatcggcatgaagctatttgcattatgctttggaggtcagcattatgtcatcaatattttgctgcagaggtcagcatatattttgtctttagcagccgagtttgcaatccatccatatcttgctaggtaatgcaatttatttgcttctgcgactgattggacggttgatggacgttttctgtctagtcattgcatcgcttctgtcggccacatcttgtactttgctggctatacttggctttcctctgatccttgctggtatctcatttttgtcttgaggtattcactgcgtgctctgcacggatgtgaccgttttgaaaaatatactgataattcctgggcgtcccccccaatgggtgtgggcaagggacggcttggtgcgctgagtgttttagccggctgcttctgagtagtaatgtgatgggacggctagtgtaatcatatcctttgcgctgttgactggagtcccaatgggtgtagtgttgcatgaaacggcgtcagccgtctgacgtgtcttcagatgggtgggagtgcttattgaatgctttgcgactgttcagtgaccgcggttggaagtgagcggttgcctttcccttctataaataacgcccttgctcctctggttttttcacatctcttcgctgttctttactgcatccttctcctcccttctatctgctttcgcc

SEQ ID NO: 477 - DNA, 1285 bp, Zea mays
ggccagggcagcctcccgcgaagggccttcctcagccacagtcgctggctttttcccgcgacgatcgacagctgcaacagcatcatctctaggatagccaccataaggcaaacagtttaattagaagacacgattcaagcgaacattggatccacgaatatcaaaactccgcagactctctgtcctctgtgcataccgccccacaatcctcacagccccatcctccacttcacgcacgaacgtggctgggtctcaatcgcgtagatccaaggcgaaggcaggacttcgcaccagctgctggcccaaggtaggcatctggcgagggcatacttcgccaagcgcccagccatgcgccaagagccacactccaaaaccaatgaattcctcaactaaatcgcgcccgctgctcatgcgggcagcgcaacggagggccccttcgtcctcatcgttctccgccacctcaaatggtgggaatgccacataacagtgggagaacattacggtcgcagggagtcctgggaggtcttctgttgggggccttcggcttccgaaggtcctcaaaaacgtgatttggcaatgttttctaagtatgcgagcaggtatcttcggaatcaggaatcaggttgcgggtatacagaagcatggtcaagacgaagcttgattgggacgacgatcacgacgaaggatgagatgatcacgaagctacatgcagaagagcttcggcatcatggcgggaaggggaaaccgacttaaagatgaaaagccaaactagacctcgaagaattactatagagttattgataaatgtaaagggcattaatgtaatcttgcatgggctgcgacccgtgcctataaataggtgaacagtattcccgtactgttcacgctgacttggcattcacttttgcgtcacgcctgtattttctttccttcaagccgaaggtacatttgtaatttatctttgtttacacaagtaataaaaatagaaatagattaataataatgtttatagaaattgtgttactttctatattttgtttgaatgttctccattttttatcatgatcatgaaggtatgtccttcatgaccttcgtcctaaattcgttatatccgaagggaaataatgatttgaaggacgaagggcttttgatatttaacattttatgttgccttgttcttgattcatagcatttgagaacaagtccccaacattggcgcccacctccggtgaactcacttccattttttgagtcttgaacactttcggcaagcatcaccttcgtc

SEQ ID NO: 478 - DNA, 1500 bp, Zea mays
gttctgggttctcgttgtgggccgcgtggtgatcccggacagtttgctagcgggccaacaaatgcgatgtcgctgatggaatttgtggtcacgctgctccgcccattacgctccgttttttagagccttgtgcatttatacagaaatactaatagacaaattatttttagttgtgttgttagaccgtgtttagagctaatagttagtgctaaaaattaaaggtagagatcccgacctccaactaattggtagctaacaattagtttattagctctgtttagctaaacagggccttagaatgtcaaaaaaacaaaaaaaactcgaagaagcacaggtcggaatgtcatcagttgggtctgttggtttatttctccacaaggatgctctggagcagcttcgagtgcttcttggatactattgcaagctcaatttctctcttcgacgctaggcagggaagctcatgcaagttcagatgcaagtgctctgtcattcattgcaagttcagtggttatccagtaaagtctggctccaaattctcattgctaaggacacgggtgctcgagctgataagcatggacattcagatgcatgcagaagtaattaattgtcttactctgtgctttggcatgtggactgcagcaatggggtgcacatttgtgtggttatgggatgccaacatgagctagacttcatcgaaaggatgattcaaaaaacacgcggcgtggacccagccagcatggagaccgacggagtcccagtcccgggcttcgtattcgttccacgccagccagccgcagcccttccagcccgggagcgccggccaaactctgaaagcgaacccaggtctccttcaattcaacacgatgcgcgcctcccagaagggcagaaggcggaagccaccggcgccagcacggcgaaatcggggcgggcagcagcaggagcagcacgcaccgtcgcagcgcggtcagggccagtataaaaacgccgtcgcattccaaagccgccggtttccacacaccacgccacagccagccgggggtggttcggcatcggcttcggcaggcagagcactttccatccggccctcgcctcctcgcgctgcatctcccctgacccctgtgccttgtccgcccgcggcagatcctgaggcggctcgcacttccgtgttccgtccgccgcgcttgcctttgcccacgccacgcgatcccaatttccaaacccgagcgaggtcaactcaaagtacccgcgccgcgcgtacgccataaacgttgcctgccgcgtcttccgaccgtcccccacgccacgacgcagtcgcagcagcagatccaccaccgacgcgcgcgccgcgcgccccgacgcggagcgctggatcccgcgcagcaggaggcggccaacccgtcgccgtcgcagtctcccccggcccccgcaagcggcggccgcgccgtccgctaccgcacgccctcgtccccggacctcctgctcctccccgccgacaccaag

SEQ ID NO: 479 - DNA, 292 bp, Zea mays
tgtgagttaaataacaactatgcttattgagttattgtgaggtcacacaacttaccgccgatggaccttttgtctcccttaattctcatttgttacaaagaccattgacctgcttccctcttttagattggcagctggtctagatgtcttactgacttgtttggcatggatatggacgactatcaagaacttgacaatgaaggtggtgaaaatggctttggtgaatctgtaaagccattctatcacctgaatgcactgagtgatctcctaatgcttcccaaaggatgtgctc

SEQ ID NO: 480 - DNA, 440 bp, Zea mays
agggtcttagtgacccgtgtgtttaagaaaaagcactcgataggtctaggtgaccgattgggagaggaatattgttggaatagacctggcctttgtggccacctcaacggaaactaggttctttggaaccgaacctaggtaaacaaatcgccgtgtacatttgtgttgatctccattcgatttgttcatcccctctcgtctctctaaaaattcccttgcacatattgatttgtgttggctcccaaagtcatccgcattgattaagcaactcttgggaaggagaactatcttccgcactctgaattatttcaaacactaaccccaagcatagtgcgtgttaaaatttgtaaatttcaagtttcggctattcacccccctcgaggcgactttcaattggtagcggagctcagtgcttcattagagtctaacaactcgaagtg

SEQ ID NO: 481 - DNA, 1500 bp, Zea mays
cgcgacccgtcaattcgtctgcgacccgtcgtcccgcccgttgggtatgattaagtttaatattgtgttgattagattaatatttagttttcttgtgttaaatttatgtacgtgtatgattaggttaatattgagtattgatgattgccggccatcgtgccgttgaattatgcgtggatgtcagccatcgtgctgatagttttatttgcaggattttgaaacctccccgtgcaggggaggtgctgccgaaattttctgttgctaggcttctgttagaggatggaggaccgtgagtggatgtacacgggccgtagaggaaggaacgatgtcaccactgaatggattagaaagaccgatgatttcgtggaacgggcatatggcgaagctgctaaaggagcgagtctagtcccatgcccgtgcagcaaatgtgccaaccggaaaagaaaaccaaagaagaccatggtagaacatatttggaagaatggatttacgccgggctatactcggtggatctttcatggtgaagcgcatcgtacgagagaggaggtgctgagacaacgtgtcgaggattatgatgccgatgcgggggtagcggatatgttgaacgactatcaggaggcacagtacacgggaggatgtatggatgacgagccagagccgactgcaaaggcgttctacgacatgttcgacgcggcacagaagccccttcacggccagacaaaggtttctcaactggatgccattgggcgtgtaatggcgttcaagtcgcagtacagcatgagtagagacgcattcgatggcttgttgacggttattgggagcctgcttccggatgatcacgttctgccaaagagcatgtacgaggcacagaaactccttcgtgcactcaagatgacgtatgagcagattcatgcttgtccgaagggctgcgtgctatttaggaaagaatacgcagaggcaaagtactgtcccaagtgtaaatcgtctaggttcatggaggtagactctggtgatggacagaagaggcagctcgacatccccttgacaatcctacgacaccttccgttcataccgaggatccagcgtctgtacatgacagaggaatccgcgaaacagatgacatggcacaaaaatggaaaacgatacaatcctgacaagatggtgcacgcatcagatggtgaagcatggaaacactttgatgacattcaccgtgagaaagccgaagaggctcgtaatgtacgtgttgcgttggccacagatgggttcaatccctatggaatgagcgctgccccgtacacatgttggcccgtgtttgttatcccaatcaatctcccccctggtgtgtgctttcaaaggcagaatatattcgtgtcgttgataattccaggacacccgggcaacaaaatgggcgtgtacatggagcctttgatcgatgaattggtacgtgcctaggaggaaggggtatggacgtatgatcgagctacgaagacaaactttaga

SEQ ID NO: 482 - DNA, 499 bp, Zea mays
ggtcgcatatagtatgtaatcataaaatattcatagatcagattttaaattagtcattactcttagcttgtcgcattgactagtgcagacttcttgactgggttttccttcaatttctctgtttttggcttttccaacttactatgcatttagcatgttgcagcctttcatatatgggatagtttgccattgtttaatcagttttaacttgtatttccacctatgtattgcatgttcgcatcagctggcacattgttaattatgttttctttgggacgccgatctggatttaaagatgaaagtatgctatattgtgttcttcaaacacgcattagtgttttttcaactagaaaaacccctgtatggtctatgccgattaagttattatttttctttggaataggtctggtaatagttgttttagtgacaattttactattgggttgatgtaatagttttctgactttgctaactgccccataggtgaaggcacttcaag

SEQ ID NO: 483 - DNA, 215 bp, Zea mays
tgtacggtctcatcgtcggtatcattctctcatcccgtgcaggccaatctcgcgccgattagaaggcttgatatacgccacactgagtcatctgccattgtattcaaagtgttcttttctcggtgaacaatgtgagggatcatgttgagcctgttccacctttgtaacattatattgctattatgtgaagacaaacctagctagctgttgcagtt

SEQ ID NO: 484 - DNA, 386 bp, Zea mays
ttgttgctctacccgcccagaatctctcttctttaacctgttgctgcactccacatctcactggcaaactgagacggcctacatgttcatgtgctgcgatgcaaataccaaattttttggctggctggcgcaggtctcgaaactagcagcgtggtattgacttgtcggtctcctcagctgattccctggcgagtgctctgcaatgggtggagtgctaggcacgcacatcacatgcccatccacctcttgcttcgcgtgcgctaatatatatattcacctgagccaggtcgctgtttcatcatcgtgcttgactgcagtctgcagggggtgtggccgcgctgcagcctgcctgtcaatctcgatcgatcaaggggtggcgtgccgag

SEQ ID NO: 485 - DNA, 408 bp, Zea mays
acattcaaccaaacgcgaacacatctcatcactaaagtctgaatatttcatgcaagataggtcaccctgactgaatctcaatagtcaatacaacgtatgatgtacttttgtcagtatgtgtgtgatgacaactgcatgatccagaactggttgtcatgtggttaaatacatttgccaaattgtcagctggtgctcacaggctattactgcatgtgtaactgtcaagtgctatgatttggacagatagttgttttgttttaaaatgatacttatatattgaccggtggctctgttctttggcatttgtttttttccagggggacattgtatgatgctgctacgacagcttacgggcaggtctgcgcgcagtttcatagctaggcgatcaggaaggttgttggtgctggc

SEQ ID NO: 486 - DNA, 66 bp, Zea mays
cttcgccgccagcccgccgcgacccgcacgcatagcctctgcccgctgcgccacgacagatgccgc

SEQ ID NO: 487 - DNA, 97 bp, Zea mays
aggtatgcacacggtacttgtaataatgcaccttgtctttatggatacttacatatgtcaatttcaatgctgaaagttgttttttggagacttaaca

SEQ ID NO: 488 - DNA, 117 bp, Zea mays
ccatctctgttttttaatcaaagctgaaacctcatgacaaatctgaaggaacttttttccccataacttgtcaatcagattcttgttccattgccagagccggatgctagacatgct

SEQ ID NO: 489 - DNA, 632 bp, Zea mays
ggtaaggttgttaatattgaccacaccctttaactgcatgttccttttccagctgattattttgtaaaggctgacaacatacgtgtgctcataagatttagctagaaattacacaaggtagcagtgtcacgaagcgcagctccttgatctacatttccaaggtcaccagttgatcattcttggacaaatgtctttgactttattcttcataataaagattgttgatggtactaaactcttaggggctctgacttatactttgatcagtagtaaatgtgcattattgttctccatttctttaaactccagctatcagttcatttaccattaaactgtaatggtttatttctttttaaaaaaatgcctgcatcagtatgtttcatacatctgttgtttacacttaaaagttaaaacatggattcagtttaactacaatgaaactgtgatggtatacctggttataaacaaatgtttgtttctgtatgtttcatgccattgctagctcttcccttttctgagttactgatgtggattcagttgagttaatatcaaattgggatttttatatttcattcagtactaatgctaagtatgtttcatgcatctgttagctctttttttacatttcagat

SEQ ID NO: 490 - DNA, 899 bp, Zea mays
agtgcagcccttggcgctgttgtcttcttacgcggcatgacgaaggttgatgctttgccgaagattgtggaagtgagtacaccggaggtgggtgccaatgttggggacttgttctcaaatgctatgagttaagaacaaggcaacacaaaatgttaatggttaaagtccttcgtccttcgaagcattatctcccataggatataatgatcttcagacgaaggttatgaaggacgtacctccatcattgtcggcgtctcgagaccggggggtccctaaggccgacgagtgagtgtgccgcgtgccccagcccagatgggtcgagcgcgtgggcgagcgcgaaggggggaagcgaggtggccggagacgggcgtgagagaggtggaaatcccgcggccttcgtgttcgtcccgcgcccaggtcgggtgcgcttgcagtagggggttacaagcgtccacgcgggtgagggaagcgagcggccccaagagagcgcctgccccgtcctcgtccccgcgcggccaaccttctctaagaaggccctggtccttccttttataggcgtaaggagaggatccaggtgtacaatgggggtgtagcagagtgctacgtgtctagcgggggagagctagcgccctaagtacatgccaatgtggcagccggagagatcttggcaccctgctggtgtgatgtcgtggctgtcggaggagcaatggagcctggcggagggacagctgtcggagcggttgagtccttgctgacgtccccctgcttccgtaagggagctgagagccgccatcgtcacagggctagcggggcgccatcattgcctatctggcggagctagccagatgggacaccggtcttgttctctgtggcccgagtcggctcggggtagagtgatg

SEQ ID NO: 491 - DNA, 362 bp, Zea mays
gagggaaccgctgcagcgtgatccgctggcgctcgcggtgcaggcgtcgaaggtcaacccctatcttccacctcggggggactgcctacccggtggatcgacgcagcagctttattggttccccggagacctgcaagttgcaagacgagctagacctagcaaccgctccctgccgaccttcggcgtcttggagtaaacatttcggcgtccaggcaagtaagcaactcatgtactcaccaattatttcgcagatggttccaaaggttctcacgaccctagggtgttcgatggaatgcgtagctgacaattatttcgcccttttttcagtaccgaagatctcccatccgctctgtcgatttgca

SEQ ID NO: 492 - DNA, 852 bp, Zea mays
agtttgtcccctagcctcctgatctctactgtgattttgcaagctcgaaattaatccagctacaaatggaggccgtgaatgagaccaatggcaacttgccaggctagaaagagagggggtgaaagcatcaaagcctgcgtttgtcccctagcctcctgtccgacatggaagcctgcacttttatatactgttaccaggtggatcatctttgcatcttatcattctctgtcacctgcttggcttgggccttgggctcccatcactccatcaggccgatgccttcaatgcaagctgtaagttgctctaaccacgtctgccgacgcgtctgcaccgttccttcctcctcctacttgctcgcgctgccgtgtccttgccgcatcctcctcctccggcggctgcggcgtacgcgctccggagtccggaggcactcgccgccgtcgaattattcccattctcatcacgccgtgcgccagggatactactatggaccggcgcaggatcttattcggccactagaacccagcgtgagagttccctgccgcattggaatatggatgcaagtggaggtagccatgtgcatccccggccgcccctatttaagcatcatgcagtgcggtaatcctgctcctctcctgttcgtacctgattagttgcttccctattacaaccgtctgtttgaggtctcactcacaggatgctgaaaataagccgcgttgtgtgtgtgtgtgtctaccatgaactgtttgacgcgttcgttcgagctcttcttgaagcagtttgacaagctgtttgtggtcgtctcgttctctgtttggttgtccagtttcagtcccgagacgtggtaatcgctag

SEQ ID NO: 493 - DNA, 594 bp, Zea mays
tgcagaccgcgtaccaggagaaggccgccctcgaggaggagatcgagaccctgaagggttccgccactaccgagggcaagggcatggaagaggggtgtgattctgttgctgctagggacaggacgcctaaggatcagggcgtggtgcctcccgcactggtccgcggctgctggagcagctgccacggctggcatcgcagtggtcttgtttaacctcaagaggtaatctggtggtccgatgcgcgaaagttttgatatgctgctatggcctatatgagaataggcctacatgtatggcctatatgagtcgtgaacacaaacatgaggtataattgagttcttgtctgatcttttgagttgcacctgatcttttgagttcttgtcttggttcgttcttgattcttggacgaggtgggatttggagagccaagggcggcgcggcagcggcggatttctcggtaaatctcggttcttgatgagttatttagttgaggttttgatattgggaagcgctagattaatgtttccgtgagtaattcctttcgcacggttgcatttgttgatgtttaggtcggactagattgtttccatcgag

SEQ ID NO: 494 - DNA, 886 bp, Zea mays
aaatcgccatagatcaggcaggattagacctccaattttatattagagacattgtttggttcttagtattacgaaaattctcatggagaaccatcagcctgattattgttcgcccattgattttggggaactaatcaggcagccaggagccagttgttcacattgctctacccatcaatatacaaaatgttgcaatgtcactgtcagagtaaacaattagacctccaatcacttacaatctttgactcccattttcataaactacctattcagtattcatctctaggtgtatgtcccatgtccgtactggtacttgattacttacaatatcttcagtagtacagagaagcaaagggtggaaagttagctgcaatgctgtgatcaggtaggtgacctgaactattcttcccgtagcgcgaagtctgcacggatcaaacaaggcaaattccgaaagccattgcctgtcggcccgctccaacgtgctcctcgtcatgtgggctctttacgacttgagatcccacatggggctctttacgacttgagatcccacatgccagagtgaggcagtgaccgcaacgcctgcgccaaagtgaaactgaaccagacgatccagctgctccactaccacaaccgcctccccctcgccgcgcctccagcagtccagctccagcagctacgccgtcacgcgagctcacggaccaccggggcctcggaggtcggaaacagaatgactatgcacaaagcctgtctctcattcggggattctagtgccggctactctcatcggggccacttggagcaggcggcattcgctccgtactgctgctgatttggtgagcgcggggagccgcgggatgggagatctggtggaggtggcggctgtggc

SEQ ID NO: 495 - DNA, 443 bp, Zea mays
aattccatttgaccgctccatgtatttttcatgacttcatgtacctacgttatttattggcaccagtaagagcatggacgatcgttggtttttttaccaatactacgtgcaggaatctacagtgcactgttgtgattggatattattgctttaggaacttatgcttttgctaccttctattttctatacttgtatgttgcccaattcatttgaagttcatgctttgtgcttttggggttaacctttcaataccctttgcccatgtccttggaaggcattagtgcatgacacccatatgagggtcaacaagctgacaagacatgattttttcttgagtcggttgcctgtgatttaactttgccatttggttaatagaatactttaacgtgctattgctagtaggtatctaaatctctctccctcctctcttgtcatatactcac

SEQ ID NO: 496 - DNA, 56 bp, Zea mays
agtaagtaacgagtagtagcagccggacgtccgttgttctctcgtaaaagcccctg

SEQ ID NO: 497 - DNA, 1500 bp, Zea mays
gtgccacattagctaaccgttggtccccgcatgcctgcgggagatagccattacaaaaggtccggtgcaacaccggaccggctactatagtatgtacaaggtatggtgatttttataaataaaaacccgagagtcgcctgttcatgtacggaggtggtccagtgcaccactggatcggttcggtgaaccatagtccagcccagcgaagtccttttttttgcaaattgagtccatttgacttggactttctgaaagggaaataggtttacaccttttcccaaattgattttggtggttgaaatgcccaacacaaataattggactaactagtttgctctagattatatgttctacaggtgctaaaggttcaacacaaaccaataaaaatattaaagttagggttcaaaagaaaggagcaaaagaaaccgaagtgaaccctggtctggcacaccagacagtgtccggtgcaccagggtggatcgacttcaaactcttcaccttcaggtttctgagtctgcgctccgctataattcaccggactgtccggtgggtcaccggacggtccagtgaattatagcggagcaacggctatcggcgcaacggtcgactgcacagtgccctgacagagctacagttcgcggcagaagtcagagcaggcgccagtggcgcaccggacagtgaacagtgcctgttcgttgcggcaccggactgtccggtgcaccaagatgtcagagctccaacggtcgaaaccgtcagaaccctaacggttgggtgacgtggctggcgtatcggacagtgtccggtggcgcaccagactgtccggtgcgcccatcgacagttgccatccccaatggcttgttggtggttgagggctataaataccccccccgaccaccacaactccaagcatccaagtcttctaaagttttcattcagtacaagagctagtgcattcactcctagacacaaatcaaaagatcaaagcctctccaagtccctaaaatcattccaaccacctagtgacttgagagagtgtttgttcgtgttctttgtgctcttgttgcttagatcgctttcttccttcctcattcttgttcccaagagacttataatcaaagcaagaaacaccaagtgtgcggtggtccttgtggggtctaagtgacccgtttgattaaggagaaagctcactcggtctaagtgaccgttcgagagagggaaagggttgaaagagacccggtcttggtgaccacctcaacggggactaggttctttagaaccgaacctcggtaaaacaaatcaccgtgttcatccgctttatttcttggttgatttgttttccccctctctatcagactcggatttaattctaacgctaaccccgccttgtagtgtgtgcttaagtttataaattttagattccgcctattcaccccccctctaggcgactttcaattggtatcagagctcggtgcttcattaagagtctaacaactcgaagtg

SEQ ID NO: 498 - DNA, 81 bp, Zea mays
gctgactctcctaatttccttcccgtttttcttcctgtggtcgctcgttgagtgcggaaattccacgaacgtgagctcaac

SEQ ID NO: 499 - DNA, 309 bp, Zea mays
gcgcgtgccggtcgatcgttaccatcgagctatgctagcgcttcggccggccggccggccagcgctctccgttgttggcgtctcgacgggacgacgacgacgacgacggccggcctctctgccgatgctcttgtagcgttgtctgtgtgtgtgtgcactgcatcgtgaactagctagcgcatgatcgcatgcctgtgtaaagacgtaggatccttgatacatttattgcctgctgtagccgcatacggcatacgacgtggctgctccaatttttttgttggagtcgcagcccgtgcatgcgcgtgatcg

SEQ ID NO: 500 - DNA, 190 bp, Zea mays
ggtgggaacctagcggcattgcattgcacgaaccacttacctgtgaaaccgtgcatgctggtttgtgaaattggtgttttcgtcacagggactgcttaggggaaggttcttaaggaatggggcgcttgaagaggagcgaccaccatctgtggcagcgagggagcttgggcagttgaggcagagccatcgt

SEQ ID NO: 501 - DNA, 357 bp, Zea mays
ggtacgcgtcgcacgctcttagctagcgggtctttcagtttaccacccacacgtcgtagcttggcattgtccaaggccttgcttacacagctccttgccttcgattgcagcacctactcagcactagtacatgcctttttttttttgtttgcaagcaattgccggcctcgttcttgttttttttctaatcggtaaaataacgaaacaaagtcgatggcaagtctctgggacagtttgatcgggtgaaggtgctgagtttgtgttgtttttgatcctgttcaaggcgtgtaccgatgcgaaatcgatgcccggagcaacaaggtcgtggcgacggtctcgacggagctcgacccctac

SEQ ID NO: 502 - DNA, 177 bp, Zea mays
tgcagcgtaagaaaaagcagtctgcactcggtcggtcggtcgctctgttcagctagctgcatgctcggccaccatatctcctccagtacgttcgtcgttctccacgccgctatctggtctgcggtaagcagcagctagaggccgttgtgtaggctacacagaagatcatcgaggagg

SEQ ID NO: 503 - DNA, 1362 bp, Zea mays
taactatctcatttaaattaggtctatctacgtgatatatagaaatcgtaggtatgtaagcgagagtttagaataataagaaaatatagtactaaaggggtgtttgaacgcactaaactaatagttagttggctaaaaattcttagtaaaattagctagctaacaatttactaatgtaccaaaaatagcttatagctgaactattagttaaggtatttggatgtcgcaactaattttagcctataactattatctataatgcattcaaatacctcaaaattaaaagaaccctcgtcccacaatcaaggcctaatcctggaattatctatatgacccgcgaagtgcgcggcccacacgctggtacccacaaaattagggaacaacggcacacctgagcggacgaagcgtggcagtcgtgggggccctgattggagtgcctccttgcccatctgtcgtcccttgctgggactcctctgctgccagccaacttgcttacaccttaagtagtacctgaaggagagagttgaggcagcccagcggttgttgagaaaccagcaatccagcatggcacggcaaatattgttgagtatgtgtaattaagcaactatagaaaattacatagaagatgtttacgacaagagaatacatgtcttcgggtgtaagcaaccatcatacagggaaatggttgtggaggccggtctgaaggaaagccagcgcggtacttacccaacaacacaagggacgcaaggacatgtccgtttcctccgccctcccctgttctgctccccttgcttagcttaccaccccaaaagctggctttttgtgcggagtcggttcgagctgaattcggcaggcgggccgccgacggacaggtagaagaaagaaagcgaagcaagcagtgcatctgctgcagcctgcaggcaggcgccgcggcaaggcatcttcggaaacttctggcggccgtcacccgcaaagcgagacacggttcctggattatattgctggcgacacacacaaacagtatcaggccgcctcactgcctgcaagaaagcagctcaggtcagtgagctggtgcctggattatattgctggcgacagcatgatgccgctggaggctaggcgtatatatatacacacacgcagccttcttctagtagctacggagtaccattcatcatcagagctagcaagctcaaagaaaactgagctcgtgtgtggtgagcagcgagtgagtgagggactggtgaccatttcaagaacagcgccgcagcagggagctaattcgttcgttcatcgtcgcatcatcagtttgtgatccttcgcccccgtagcttcctgcaacttcgagctcactaaacaacc

SEQ ID NO: 504 - DNA, 58 bp, Zea mays
tgtaagttacccttgctttttgtttcctttaacaaaaatgtttgtggcccagtagcag

SEQ ID NO: 505 - DNA, 1325 bp, Zea mays
aaaagagaggggacacccttacaactagtctaggtaatcccgagcatcctggttatgtacggggcatcttgtccaaagaaggacggaaataaggattcaaaccatattgggaagctatgtacaagaatcacgttcaatacaagaaagcgacgacaaattattttaaggaggaggccaagaaagacttcaaagacatgatgtctcaaatgctatccaatccttctcttgaattgatgcatcaattgacgagtgcgatgtctattcaacaaatggccactcaagctccccagatgcagctagttctaacaacacaaccattggtcatagctcatagagtgtccaaccattccaagcggtgtcacatctatgacaaataaggtccgctatccagttgacgacatcaatatgcctgtgtcgtgctcgctagtcacaagatatggtattaataatattcatacaagaaaaatagccacagtctttcgatccgggatgttaatatcatggtcgcgatattccagcaaagtactacatggtagaagtgtcgacaatcgttcaaggatacgagaaggacatgctagacattccttgtttcgaggggattgagaaacttggacggactatcaaaaatttcattctttagcctcgacgggacattcaattgagcgagccaccacatcctttccatccctttatattaccttcataaactttcatactttcagcgattttctccttttaacgtggtgccatatcggcaaaagcactaacaaaatctctgaaagtgaaaaaacaaacggtctaaagttgagaggtgtcaaaaactagttttttatgtttagggagaagatcggactactgcaatagctgagaggggcaaactgttttttttttttttttttgcttactgaaaaccagaaaataactggccatcccgacagaagtagctgtgaaatggccagccagcagcccagcacacaggaattgagcccattctcaagagtcaagagacctgtcactgccttgggaaaaagtaagaaaaccctcggataacctggttctcggtcgttaggtttctacagccttccgtggcggtggcgccggtgccgctcgaccgcaccagcccgacgtggaggcccactgttcagtcacccattcggccgctgcggtcacgatctcataaaatgcccgacttcagaaccagcccgccgcgacccccttccccctgacgcctcgcgaagccatcatcttccaaaccctcgccgcagccgcagccgcagccgcagccacccttgcttccgcacgatagtgcccgggaccagccttct

SEQ ID NO: 506 - DNA, 432 bp, Zea mays
tcggtacccctgctcgggccccgcgctgcctaacggtgcacgaaccacgcccacgcggcacgcggctgagccccacgccgtcggcagcgcatggcggttcccccacgtccgtcccgacgccgtgccaacggcccctccctccgcgctctctgccaccccggtcccacttttgcttagaacgcgctgacccacgcgtcagcgtccggcggcgaatgtgtccaaggggtggggtacatttatttttatcacacattatatatatatacattatataataatggaaattaaatccccacgcggccgtcgtttgccccctccctccccacctgcaccaccaccaacaccaaccaacaggtggcgagagcgagagcgagagcaaagagctgagcgggacggagcagctagcgctagggataacgcacacccaccacc

SEQ ID NO: 507 - DNA, 1025 bp, Zea mays
gctttgtcctttaaagccgggtgttacacaatttagggactaaaatgaaaaaaatagagagactaaaaattaatctctagaaaccaaacatccatttagtcaccccactttagtcactatatttgcttttttaggtactaaaagtgactagtcagcctaaaccaaatgggacaagcattaattcactgtgcaaattcataggtccaacttgctgctagcatccatcgtccagcttgctcacacggctattgaggacggcattaaagaggagaatggtaagatgtataaaaatccacttttagtcggcactaaactttagtcaccctatttcagtcattatgtttggtttttttacaactaaaagtgactaaggttctgaaccaaacgggccgaaaatatgctcacagttttacctcccgacaacattctcaaagatttatttttgctcactcgaatttgtgttgttcccttacatttcccagtctgatttatcgaagtacaaaaaatagagargataaaataaataaataaacaaataaatattctctctccctctccaagtcaccgagctgaagcctgaagcatatgccatctacaaatccaaatccaaatccaaatccaaatccaaatcggcaaatcgcaatcgctggtacagatgtctatatacgatggagaagttcacagcccggcccaacgccgcaacggaacgctggtccacggggatcggagcccggtagcaacaggcataaagcaccagcaggcagcaggcctaggagggccccggcccgggggtgcgctgtgtccacgtggcgttcaccatttcggcagaatccgatggcgcgcgctcctcattggccggcgctcaatccatccaaccgccgccgagatttccttcccgcgggcggatcaaaacttgtggctgccccgtgccgcggcgccgctattaataaaaaatctgacgacgtcctccttctcctgctcccttcaacggacttgaccactaaaagctaagcacacccccggcc

SEQ ID NO: 508 - DNA, 262 bp, Zea mays
agtaccgaccgacccctgtccggagcaccgaagacgccgtgaatgaactgtgctgcatcgatgcgttgtactacctccacctccgctctcgaatagttgttgcccgctagttcattttataactaaacgaccataaataaaaaagaacggagggaagatattgtaactaaagtgtaagatgacttttttgtgttgtgtatcgtactactgcttgttcagagatctacgttgatacaaatgatgcttgtgctggaataaacgc

SEQ ID NO: 509 - DNA, 242 bp, Zea mays
acagccccaagcgccactacgtccatctcaacgcgattcgataggcccataaacatgcgtggcgcaacaggctcaaagaaaataccaagttgggctttattggacggagattgtttggcccagtgactctacccacctccagtttccacttagaaaagaataatttctcccgaaaaagggtgaagagcagaacgacgaggagattgcttggtgggaggagttggtgaggagaggtcgcgacc

SEQ ID NO: 510 - DNA, 415 bp, Zea mays
agtagtaatcatcttgagtcctccatgatttccatctaatttgattatttattttgtcaaaaggtactaattataaggtacaaacaaaagaaatcagcaaactttcatgtaaagtccggaattactcactgaatctaaatgctctaccaatgttttgaggagaaaatcatcacaccaagttaccaaacttgatgcaattaattatagctgcactcctatagttgttcattgcaatgggatggatgcatgattatccactattagtttggttctggactctggtagctcactagaaatatgtgcatggactgttggaagtaatattaattacgattttgtattgtattgtctctgcccactaacttttctgtttaccatattatataattatttatttttacaggtgtcttaaatc

SEQ ID NO: 511 - DNA, 1500 bp, Zea mays
tgtggtgcaagcgtggtccaaaatgttaaaaataaagaagcaatccatgcatatattataagtatttatattggctcaattccaagcaacctttgcacttacattatgcaatctagttcaactatgcatttctatacttgctttggtttgtgttggcatcaatcaccaaaaatggggagactaaaagggaattaggcttacacctatttcctaattgattttggtggttgaattgcccaacacaaataattggactaactagttttgctctagtgtataagttatacaggtgccaaaggttcacacttagccaataaaataaccatgaattgggttcaacaaagagagcaagggataaccgaagtgtgccctggtctggcgcaccggactgtccggtgcaccaggggacttcacgctgaactcttcaccttcggtaaaatccagaggcgctccgctataattcaccggactgtccggtgtacaccggacagtgtccggtgccccagggaagagcgactctggaactcgccagcttcgggaattcactccgctataattcaccggacatgtctggtgtacaccggactgtccggtgagccagcggagcaacggctattcggcgccaagggtcacctgctacaacattaaatgcgcgccagagcgcgcagaagtcaggcacgcgtgaagtggcgcaccagacactctacagtacatgtccggtgtgccaccggacatccaggcaggcccagcagtcagagctccaacggtcggaacccaacgtcctggtgacgtggttggcgcaccggacactgtccggtgtgcaccggactgtccggtgcaccatgcgacagacagcctccaccaaacggctagtttggtggttggggctataaatacccccaaccaccccacattcaagtcatccaagttttccaccttccaactacttacaagagctaggcattcaatacaagacacacccaagtgatcaaatcctctcccaattccacaaaagctttagtgttaagtgagagagatttgttgtgttcttttgagctcttgcgcttggattgcttccttctttcattctttcttgcaatcatctcatttgtaagcaaggcaagagacaccaattgtgtggtggtccttgtgggaagtttgattcccaattgatttgagaagagaagctcactcggtccgagggaccgtttgagagagggaaagggttgaaagagacccggtctttgtgaccacctcaacggggagtaggtttgcgagaaccgaacctcggtaaaacaaatccgtgtgtcacactctttattcgcttgcgatttgttttgcaccctctctcgcggacttgattatatttctaatgctaacccgacttgtagttgtgattaactttgtaaatttcagtttcgccctattcaccccccctctaggcgactttcaattggtatcaaagcccggtgcttcattagagcctaaccgctcgaagtg

SEQ ID NO: 512 - DNA, 1029 bp, Zea mays
tcttcggaaacactaaaaaactgtttccaatgccgaagcttcaaaacttaaaaagctaagaaaatcttggtgcgcaagagctaaaaattgagtgagcgggagcagatggcaagagagcgtgccaaatgagcttgcggtatgatcttatttatacgcctagtgcgttgaaaattgaaagaccccgcctgtcagtgaatgttgctattctagcaaagggaaggtgttttttcggaccttcggcttaaagccttcgtccatgtcgcaatctaaatttattattttaaacaaattattattgcgaggggctactgttggggaccttcggcatccaaaggtcctcaaaaacaggatttaatagtatttctggagtataatgtgtgaacaggtatcttcggactcaagtcggcatcacagtagaccagaataatacgaaggatggtgcagcgccgaaggtgtaagcaggaaagcttcggcgtgatagcagaaggtggaaccgacttaaagacgaaaaggctatttagacctcgacagattactatagaattattatcaagtgtaaagggcatgaatgtaattttgtgtgggttgtgtcccgcgcctataaataggtgaacagtacccccgtactggacacgctgacttggcattcgctttttgcgtcacgcttgtattgtcatctccttccgattgaaggtacacttgtaattcaacgatatttctgtttatgcctgataataatatataattgttcatgttgtcttttatattctttacatttcatccttcgtcattgtttaatgaatttatgaaggtacgtccttcataaccttcgtccgtaagccattacatcccaagggaaataatgcttcggaggacgaaggactttaacgattaacatttttctatgttgccttgttcttaactcatagcacttaagaacaagtccccaacattggcgcccacctccggtgaactcacttccactctttgaagttttttgaacaccttcggcgatcataaatctttgtt

SEQ ID NO: 513 - DNA, 493 bp, Zea mays
ggtaattttgtatctacgatgagtaatgggtttaggtactcacatatttggtattgagatatttttttctctctaataggtatgactcacgctatgtgtccactggatatcttgatccactagccactgccatctccaagctgtctccttcagattgtgtatacattataaagtataaaatattatttttttcattctttttttatttgtcgtaaatgataaatatttgagaacatagataatattttatatcgtattgtactgtttatatagtaaaatttgaaatatggagtcgatggatgtgagaaagggagggttgttggagacagtctaaacccttctccatccgacggcggacaccagcttccctccgcccgcccacatccctgctgtgtgctgcgcctccccgcctgatcttgtcgcgcccgagagaccgcgcgccagggaacgtcggccgccggagcctggcctgcattccgggggcagcgagagg

SEQ ID NO: 514 - DNA, 126 bp, Zea mays
ggtctgggatgcaggttgtcgttctagcagaaacatcattcgccgtagatatgatgcgccaagtttattattcttgtttgggctagggatcttgcgtttttttagctagagaagtcttgtaaccaa

SEQ ID NO: 515 - DNA, 333 bp, Zea mays
ttgcataatatgtgctggacgccctggatttgcctttctcccgtccacctccacgcgtctacagttctcccgtctgacctcgcacttgcagcgcacggaaagaaaacagacacgaaatatctgtcgctttctacgaacaagattagcgacaagattgaccccctgaataacccccatcgcgaaggagtacaccaagaaaggcaattcagcactgactgacgacgccactatatgagctgagagctgagagaaagaaatcaggtggggtggagctgtaacagttcgccacggctaggctcctctcccctctcagctctcagctgcccctcctgc

(The sequence listing continues in the following parts.)

We claim:

1. An isolated polynucleotide having promoter function comprising a sequence selected from the group consisting of (a) a sequence comprising SEQ ID NO:3332, and (b) a sequence comprising at least 50 contiguous bases of SEQ ID NO:3332.

2. The polynucleotide molecule of claim 1, wherein the polynucleotide molecule comprises a sequence at least 90% identical to SEQ ID NO:3332.

3. The polynucleotide molecule of claim 1, wherein the polynucleotide molecule comprises a sequence at least 95% identical SEQ ID NO:3332.

4. The polynucleotide molecule of claim 1, wherein the polynucleotide molecule comprises a sequence comprising SEQ ID NO:3332.

5. The polynucleotide molecule of claim 1, wherein the polynucleotide molecule is operably linked to a heterologous transcribable polynucleotide molecule.

6. The polynucleotide molecule of claim 1, wherein the polynucleotide molecule exhibits a constitutive expression pattern.

7. A chimeric molecule comprising the polynucleotide molecule of claim 1.

8. The polynucleotide molecule of claim 5, wherein the transcribable polynucleotide molecule encodes a polypeptide sequence of a protein of agronomic interest.

9. The polynucleotide molecule of claim 5, wherein the transcribable polynucleotide molecule encodes a polypeptide sequence of a protein controlling the phenotype of a trait selected from the group consisting of: herbicide tolerance, insect control, modified yield, fungal disease resistance, virus resistance, nematode resistance, bacterial disease resistance, plant growth and development, starch production, modified oils production, high oil production, modified fatty acid content, high protein production, fruit ripening, enhanced animal and human nutrition, biopolymers, environmental stress resistance, pharmaceutical peptides and secretable peptides, improved processing traits, improved digestibility, enzyme production, flavor, nitrogen fixation, hybrid seed production, fiber production, and biofuel production.

10. The polynucleotide molecule of claim 9, wherein said protein controlling the phenotype of herbicide tolerance is selected from the group consisting of: phosphinothricin acetyltransferase, glyphosate resistant EPSPS, hydroxyphenyl pyruvate dehydrogenase, dalapon dehalogenase, bromoxynil resistant nitrilase, anthranilate synthase, glyphosate oxidoreductase and glyphosate-N-acetyl transferase.

11. A transgenic plant cell stably transformed with the polynucleotide molecule of claim 1.

12. A transgenic plant stably transformed with the polynucleotide molecule claim 1.

13. A seed of said transgenic plant of claim 12, wherein the seed comprises the polynucleotide molecule of claim 1.

14. A progeny of the plant of claim 12, wherein the progeny comprises the polynucleotide molecule of claim 1.

15. The transgenic plant cell of claim 11, wherein said plant cell is from a monocotyledonous plant selected from the group consisting of wheat, maize, rye, rice, corn, oat, barley, turfgrass, sorghum, millet and sugarcane.

16. The transgenic plant of claim 12, wherein said plant is a monocotyledonous plant selected from the group consisting of wheat, maize, rye, rice, corn, oat, barley, turfgrass, sorghum, millet and sugarcane.

17. A seed of the transgenic plant of claim 16, wherein the seed comprises the polynucleotide molecule of claim 1.

18. The transgenic plant cell of claim 11, wherein said plant cell is from a dicotyledonous plant selected from the group consisting of tobacco, tomato, potato, soybean, cotton, canola, sunflower and alfalfa.

19. The transgenic plant of claim 12, wherein said plant is a dicotyledonous plant selected from the group consisting of tobacco, tomato, potato, soybean, cotton, canola, sunflower and alfalfa.

20. A seed of the transgenic plant of claim 19, wherein the seed comprises the polynucleotide molecule of claim 1.

21. A method of inhibiting weed growth in transgenic glyphosate-tolerant crop plants comprising: planting transgenic plants transformed with an expression cassette comprising the polynucleotide molecule of claim 1 operably linked to a transcribable polynucleotide molecule conferring glyphosate tolerance to said plants and applying glyphosate to the field in which the plants are growing at an application rate that inhibits the growth of weeds, wherein the growth and yield of the transgenic plants is not substantially affected by the glyphosate application.

22. A method of conferring insect resistance in transgenic crop plants comprising planting transgenic plants transformed with an expression cassette comprising the polynucleotide molecule of claim 1 operably linked to a transcribable polynucleotide molecule conferring insect resistance to said plants.

23. A method of conferring drought tolerance to transgenic crop plants comprising planting transgenic plants transformed with an expression cassette comprising the polynucleotide molecule of claim 1 operably linked to a transcribable polynucleotide molecule conferring drought tolerance to said plants.

24. A method of conferring low nitrogen tolerance to transgenic crop plants comprising planting transgenic plants transformed with an expression cassette comprising the polynucleotide molecule of claim 1 operably linked to a transcribable polynucleotide molecule conferring low nitrogen tolerance to said plants.

25. A method of conferring cold tolerance to transgenic crop plants comprising planting transgenic plants transformed with an expression cassette comprising the polynucleotide molecule of claim 1 operably linked to a transcribable polynucleotide molecule conferring cold tolerance to said plants.

* * * * *

UNITED STATES PATENT AND TRADEMARK OFFICE
CERTIFICATE OF CORRECTION

PATENT NO. : 7,491,813 B2  Page 1 of 1
APPLICATION NO. : 11/635706
DATED : February 17, 2009
INVENTOR(S) : Wei Wu et al.

It is certified that error appears in the above-identified patent and that said Letters Patent is hereby corrected as shown below:

In Claim 1, column 709, line 21, insert --molecule-- after the word polynucleotide.

In Claim 3, column 709, line 31, insert --to-- after the word identical.

Signed and Sealed this

Thirty-first Day of March, 2009

JOHN DOLL
*Acting Director of the United States Patent and Trademark Office*